United States Patent 11,332,783 (SAMPLE ANALYSIS, PRESENCE DETERMINATION OF A TARGET SEQUENCE) - sequence listing, part 10

SEQ ID NO: 188506 - DNA, 75 bp, Artificial Sequence
  Synthetic
atgtcagtacagtacaatgtacacatggaattaagccagtggtatcaactcaattactgctaaatggcagtttag

SEQ ID NO: 188507 - DNA, 75 bp, Artificial Sequence
  Synthetic
gttagctccgtacaatgtacacatggaattaggccagtggcatcaactcaactgctgctcaatggcagtctagca

SEQ ID NO: 188508 - DNA, 75 bp, Artificial Sequence
  Synthetic
caggcagcagctgacacaggaaacagcagcaaggtcagtcaaaattaccccatagtgcaaaatgcacaagggcaa

SEQ ID NO: 188509 - DNA, 75 bp, Artificial Sequence
  Synthetic
caattactgctaaatggcagtttagcagaagaagacataataattaaatctgaaaacatctcaaacaatgccaaa

SEQ ID NO: 188510 - DNA, 75 bp, Artificial Sequence
  Synthetic
ctgaaaatattacagacaataccaaaaacataatagtacagtttactgagcctgtacaaattaattgtaccagac

SEQ ID NO: 188511 - DNA, 75 bp, Artificial Sequence
  Synthetic
acgctttggaccaggacaagccttctatacaaatgacatcataggggacataagactagcatattgtaatataag

SEQ ID NO: 188512 - DNA, 75 bp, Artificial Sequence
  Synthetic
ggaggaggaaatatgaaagacaattggagaagtgaattatataaatataaagtggtagaaattaagccattagga

SEQ ID NO: 188513 - DNA, 75 bp, Artificial Sequence
  Synthetic
tggcaggtagacaggatgaggattagaacatggaatagtttagtaaaacaccatatgtatgtctcaaagaaagct

SEQ ID NO: 188514 - DNA, 75 bp, Artificial Sequence
  Synthetic
cacactcccatgtaggataaaacaaattgtaagaatgtggcagagagtgggacaagcaatgtatgcccctcccat

SEQ ID NO: 188515 - DNA, 75 bp, Artificial Sequence
  Synthetic
aggaatcgaagaagaaggtggagagcaagacagagacagatccgtgagattagtgagcggattcttgtctcttgc

SEQ ID NO: 188516 - DNA, 75 bp, Artificial Sequence
  Synthetic
ggcttcatggattaggacaatatatttataacacctatggggatacttggacaggagttgaagctataacaagaa

SEQ ID NO: 188517 - DNA, 75 bp, Artificial Sequence
  Synthetic
gggtgggaaatccttaagtatctgggaagccttgtgcagtattgggggctagagctaaaaaagagtgctattagt

SEQ ID NO: 188518 - DNA, 75 bp, Artificial Sequence
  Synthetic
tttcaatataaccacagaactaagggataagaaacagaaagtgtatgcacttttttataaacttgatatagtacc

SEQ ID NO: 188519 - DNA, 75 bp, Artificial Sequence
  Synthetic
gctatcattgtcaagtttgctttctgaacaaaggcttaggcatctcctatggcaggaagaagcggaagcagcgac

SEQ ID NO: 188520 - DNA, 75 bp, Artificial Sequence
  Synthetic
taaaatggggggcaaatggtcaaaaagcagtaaagctgaatggtctagggtgagagaaaaaataagacaaactga

SEQ ID NO: 188521 - DNA, 75 bp, Artificial Sequence
  Synthetic
agacagaaccagatcgattcgattagtgaacggattcttagcacttgcctgggacgatctgcggagcctgtgcct

SEQ ID NO: 188522 - DNA, 75 bp, Artificial Sequence
  Synthetic
cagtaaaattaaagccaggaatggatggcccaaaggttaaacaatggccattgacagaagaaaaaataaaagcat

SEQ ID NO: 188523 - DNA, 75 bp, Artificial Sequence
  Synthetic
tgaaaatgatattagtttggaaatgggagagggagaactaaaaaactgctctttcaatgtcaccacaggtataaa

SEQ ID NO: 188524 - DNA, 75 bp, Artificial Sequence
  Synthetic
tggtcccaacaatatgacccacaatgatgacgggatgggaataaaaaattgctctttcaatgcgaccacagaaat

SEQ ID NO: 188525 - DNA, 75 bp, Artificial Sequence
  Synthetic
ataagacagggcttggaaagggctttgctataagatgggtagcaagtggtcaaaaagcagtatagttggatggcc

SEQ ID NO: 188526 - DNA, 75 bp, Artificial Sequence
  Synthetic
gctgagccagcagcagatggggtgggagcagcatctcgagacctggaaaaacatggagcaatcacaagtagcaat

SEQ ID NO: 188527 - DNA, 75 bp, Artificial Sequence
  Synthetic
attgaaacgtagtgctattagcttatttgatgccacagcaatagcagtagctgaggggacagatagaattataga

SEQ ID NO: 188528 - DNA, 75 bp, Artificial Sequence
  Synthetic
tggatgtgggggatgcatatttttcagtccctctagatgaaagcttcaggaagtatactgcattcactataccta

SEQ ID NO: 188529 - DNA, 75 bp, Artificial Sequence
  Synthetic
ataaaatggggggcaagtggtcaaaaagtagcatagtgggatggcctactgttagggagagaatgagacgaactc

SEQ ID NO: 188530 - DNA, 75 bp, Artificial Sequence
  Synthetic
gtatacatttcgcacctgggcaggcattttatgcaacaggagatataataggagatataagacaagcacactgta

SEQ ID NO: 188531 - DNA, 75 bp, Artificial Sequence
  Synthetic
gccacagagggagccacacaatgaatggacactagaacttttagaggagcttaagaatgaagctgttagacattt

SEQ ID NO: 188532 - DNA, 75 bp, Artificial Sequence
  Synthetic
agaaaaagtatacatataggaccaggaaaagcattctatgcaacagatgaaataataggggatataagacaagca

SEQ ID NO: 188533 - DNA, 75 bp, Artificial Sequence
  Synthetic
ttgcctgggacgacctacggagcctgtgcctcttcagctaccaccgattgagagacttcatattgattgcagcga

SEQ ID NO: 188534 - DNA, 75 bp, Artificial Sequence
  Synthetic
tagactcatgggcaaatttgtggagttggttggacatatcaaactggctgaagtatataaaaatattcataataa

SEQ ID NO: 188535 - DNA, 75 bp, Artificial Sequence
  Synthetic
ccagattgtaagaccattttaagagcattaggaccaggagctacactagaagaaatgatgacagcatgtcaggga

SEQ ID NO: 188536 - DNA, 75 bp, Artificial Sequence
  Synthetic
ataaaatggggggcaagtggtcaaaaagcagtatagttggatggcctgctgtaagagaaagaataagacgaactg

SEQ ID NO: 188537 - DNA, 75 bp, Artificial Sequence
  Synthetic
tactagctataggttgataagttgtaacacctcagtcattacacaagcctgtccaaaggtatcctttgaaccaat

SEQ ID NO: 188538 - DNA, 75 bp, Artificial Sequence
  Synthetic
cagcagtacaaatggcagtattcattcacaattttaaaagaaaaggggggattggggggtacagtgcaggggaaa

SEQ ID NO: 188539 - DNA, 75 bp, Artificial Sequence
  Synthetic
gtagtaaaaattgaaccattaggagtagcacccaccaaggcaaagagaagagtggtgcagagagaaaaaagagca

SEQ ID NO: 188540 - DNA, 75 bp, Artificial Sequence
  Synthetic
agtagctggctggacagatagggttatagaaataggacaaagatttggtagagctattctcaacatacctagaag

SEQ ID NO: 188541 - DNA, 75 bp, Artificial Sequence
  Synthetic
gaacagggaaattctaaaagaaccagtacatggagtatattatgacccatcaaaagacttgatagctgaaataca

SEQ ID NO: 188542 - DNA, 75 bp, Artificial Sequence
  Synthetic
ttagctttgcaagattcaggatcagaagtaaacatagtaacagattcacagtatgcattaggaatcattcaagca

SEQ ID NO: 188543 - DNA, 75 bp, Artificial Sequence
  Synthetic
aaaggcttaggcatttcatatggcaggaagaagcggagacaacgacgaccagcttctcacagcagtaagaatcat

SEQ ID NO: 188544 - DNA, 75 bp, Artificial Sequence
  Synthetic
gagctgagccagcagcagatggggtgggagcagtatctcgagacctagaaaaacatggagcaatcacaagtagca

SEQ ID NO: 188545 - DNA, 75 bp, Artificial Sequence
  Synthetic
agcttctcacagcagtaagaatcatcaagatcatataccagagcagtaagtataattaattagttctgtaatgat

SEQ ID NO: 188546 - DNA, 75 bp, Artificial Sequence
  Synthetic
agatacaggagcagatgatacaatattagaagaaataaatttgccaggaagatggaaaccaaaaataataggggg

SEQ ID NO: 188547 - DNA, 75 bp, Artificial Sequence
  Synthetic
cctatggggatacttgggcaggagttgaagctataataagaatactgcaacaactactgtttattcatttcagaa

SEQ ID NO: 188548 - DNA, 75 bp, Artificial Sequence
  Synthetic
tgaagctataataagaatactgcaacaactactgtttattcatttcagaattgggtgccagcatagcagaatagg

SEQ ID NO: 188549 - DNA, 75 bp, Artificial Sequence
  Synthetic
aggagatatgaaggacaattggagaagtgaattatataagtataaagtagtggaaattaaaccactaggagtagc

SEQ ID NO: 188550 - DNA, 75 bp, Artificial Sequence
  Synthetic
agtaaaattatggtatcagttagaaaaagaacccatagaaggagcagaaactttctatgtagatggggcagctaa

SEQ ID NO: 188551 - DNA, 75 bp, Artificial Sequence
  Synthetic
aggatataatcagtttatgggatcaaagtctaaaaccatgtgtaaagttaaccccactctgtgtcactttaaatt

SEQ ID NO: 188552 - DNA, 75 bp, Artificial Sequence
  Synthetic
tttgcaacaactactgtttattcatttcagaattgggtgccaacatagcagaataggtattgtgcgacagagaag

SEQ ID NO: 188553 - DNA, 75 bp, Artificial Sequence
  Synthetic
ataatcagtttatgggatcaaagcctaaagccatgtgtaaagttgaccccactctgtgtcactttaaactgtagt

SEQ ID NO: 188554 - DNA, 75 bp, Artificial Sequence
  Synthetic
tttaaattgcactgaattgagtattactacttgtaccaatagtagtaccaatagtagcaatagtgctggtagtaa

SEQ ID NO: 188555 - DNA, 75 bp, Artificial Sequence
  Synthetic
ttcttagcagccatagttgtgtggactatagtatttatacaatatagggaaataagaaaacagaaaaaaatagaa

SEQ ID NO: 188556 - DNA, 75 bp, Artificial Sequence
  Synthetic
gcaggaagaagcggagccagcgacgaagagctcctaaaagcagtccggatcatcaaaatcttgtaccaaagcagt

SEQ ID NO: 188557 - DNA, 75 bp, Artificial Sequence
  Synthetic
ggaggaatcgaagaaggaggtggagagcaagacagaaccagatcgattcgattagtcagcggattcttagctctt

SEQ ID NO: 188558 - DNA, 75 bp, Artificial Sequence
  Synthetic
ataggaataggagcactagtagtagcattcatcatagccatagttgtgtggaccatagcatatatagaatatagg

SEQ ID NO: 188559 - DNA, 75 bp, Artificial Sequence
  Synthetic
taacaaattaaaagaatacttccctaagagaaacataacatttaactcatctacaggaggggacttagaaattac

SEQ ID NO: 188560 - DNA, 75 bp, Artificial Sequence
  Synthetic
ggtgggagacactcaaatacctggggaatcttacacagtattggagccaagaactgaagaatagtgctattagcc

SEQ ID NO: 188561 - DNA, 75 bp, Artificial Sequence
  Synthetic
ggtgggagactctcaaatacctggggaatcttacacagtattggagccaagaactgaagaatagtgctattagcc

SEQ ID NO: 188562 - DNA, 75 bp, Artificial Sequence
  Synthetic
ggtgggagaccctcaaatacctggggaatcttacacagtattggagccaagaactgaagaatagtgctattagcc

SEQ ID NO: 188563 - DNA, 75 bp, Artificial Sequence
  Synthetic
ggtgggagacgctcaaatacctggggaatcttacacagtattggagccaagaactgaagaatagtgctattagcc

SEQ ID NO: 188564 - DNA, 75 bp, Artificial Sequence
  Synthetic
gcaaacaggagaaagagagtggcatttgggtcatggagtctccatagaatggagactgagaagatatagcacaca

SEQ ID NO: 188565 - DNA, 75 bp, Artificial Sequence
  Synthetic
ttgtgcatctgatgctaaatcatatagtactgaaagccataatgtctgggctacacatgcctgtgtacccacaga

SEQ ID NO: 188566 - DNA, 75 bp, Artificial Sequence
  Synthetic
aacaatacaagaaaaagtatacatatgggatgggggagagcattttatgcaacaggagaaataataggagatata

SEQ ID NO: 188567 - DNA, 75 bp, Artificial Sequence
  Synthetic
actaatagtacattaggtaacaatagtactatagtagatgatatcagcaaggaaataaaaaactgctctttcaat

SEQ ID NO: 188568 - DNA, 75 bp, Artificial Sequence
  Synthetic
aaaagtagaatagtaggatggcctgagattagggaaagaataagacgaacttctccaacagcagcagcaccagga

SEQ ID NO: 188569 - DNA, 75 bp, Artificial Sequence
  Synthetic
aataaaacaaattataaacatgtggcaggaggtaggacgagcaatgtacgcccctcccattgaaggaaacataac

SEQ ID NO: 188570 - DNA, 75 bp, Artificial Sequence
  Synthetic
atgtaaccaataatgatgcagagatgagaaactgctctttcaatataaccacagaaataagagataggaaaaaga

SEQ ID NO: 188571 - DNA, 75 bp, Artificial Sequence
  Synthetic
aggtataggaataggaccaggacaaacattctttgtaacaaagaaaataataggaaacataagacaagcacattg

SEQ ID NO: 188572 - DNA, 75 bp, Artificial Sequence
  Synthetic
aatggaacaggaccatgtaaaaatgtcagtacagtacaatgtacacatgggattaagccagtggtatcaactcaa

SEQ ID NO: 188573 - DNA, 75 bp, Artificial Sequence
  Synthetic
ttactgctgaatggcagtttagcagaaggaaacataacaattaaaactgaaaacatcacagacaataccaaaaat

SEQ ID NO: 188574 - DNA, 75 bp, Artificial Sequence
  Synthetic
aatgtacacatggaattagaccagtggtaacaactcaactgctgctaaatggcagtctagcagagggagagataa

SEQ ID NO: 188575 - DNA, 75 bp, Artificial Sequence
  Synthetic
gaaaggtatacgtataggaccaggaagagtgatttatgcaacaagtgccataacaggagacataagacaggcaca

SEQ ID NO: 188576 - DNA, 75 bp, Artificial Sequence
  Synthetic
tcaggaggggacccagaagttacaatgcatatttttaattgtagaggagaatttttctactgcaatacaacaaaa

SEQ ID NO: 188577 - DNA, 75 bp, Artificial Sequence
  Synthetic
gaggatagatggaacaagccccagaggaccaagggccacagagggagccacacaatgaatggacactagagcttt

SEQ ID NO: 188578 - DNA, 75 bp, Artificial Sequence
  Synthetic
cacactcccatgtagaataagacagattgtaaacatgtggcagagagtgggacgagcaatgtatgcccctcccat

SEQ ID NO: 188579 - DNA, 75 bp, Artificial Sequence
  Synthetic
ctagagctaaaaaagagtgctattagtctgcttgataccatagcaatagcagtagctgagggaacagatagaatt

SEQ ID NO: 188580 - DNA, 75 bp, Artificial Sequence
  Synthetic
acaggcaacccacctatcccagtaggagaaatctatagaagatggataattctgggattaaataaaatagtaaga

SEQ ID NO: 188581 - DNA, 75 bp, Artificial Sequence
  Synthetic
gctacctacagtaataggacgatgactgaggaaataaaaaattgctctttcaatataaccatggaactaagagat

SEQ ID NO: 188582 - DNA, 75 bp, Artificial Sequence
  Synthetic
atggggcaccatgctccttgggatgttgatgatctgtagtgctgcagaaaacttgtgggtcacagtttattatgg

SEQ ID NO: 188583 - DNA, 75 bp, Artificial Sequence
  Synthetic
tcgattagtgagcggattcttagcgattgcctgggacgatctgcggagcctgtgcctcttcagctaccaccgatt

SEQ ID NO: 188584 - DNA, 75 bp, Artificial Sequence
  Synthetic
aataagacagggcttagaaagaattttgctataagatgggtggcaagtggtccaaacgttgtgggtgggataatg

SEQ ID NO: 188585 - DNA, 75 bp, Artificial Sequence
  Synthetic
ttgctataaaatggggggcaagtggtcaaaaaatagaatagttggatggcctgctgtaagagaaagaataagaag

SEQ ID NO: 188586 - DNA, 75 bp, Artificial Sequence
  Synthetic
atgggtgcgagagcgtccgtattaagcgggggagaattagataggtgggaaaaaatcggcttaggcccgggagta

SEQ ID NO: 188587 - DNA, 75 bp, Artificial Sequence
  Synthetic
aaaaaactgctctttcaatatgaccacagaactaagggataaaagacagaaggtatattcacttttttataaact

SEQ ID NO: 188588 - DNA, 75 bp, Artificial Sequence
  Synthetic
acagaactaagggataaaagacagaaggtatattcacttttttataaacttgatgtagtacaaattgatggcgat

SEQ ID NO: 188589 - DNA, 75 bp, Artificial Sequence
  Synthetic
taaaacaataaaatttaactcatcctcaggaggggacctagaaattacaacacatagctttaattgtagaggaga

SEQ ID NO: 188590 - DNA, 75 bp, Artificial Sequence
  Synthetic
gattgtgcctggctagaagcacaagaggatgaggaagtgggttttccagtcagacctcaggtacctttaagacca

SEQ ID NO: 188591 - DNA, 75 bp, Artificial Sequence
  Synthetic
cacttatctgggaagacctgcggaacctgtgcctcttcagctaccgccacttgagagacttactcttgattgtag

SEQ ID NO: 188592 - DNA, 75 bp, Artificial Sequence
  Synthetic
aaaatgaaacagtgggagaaatgaaaaactgcactttcaatatcaccacaagtatgagcaataaggtgaagcgag

SEQ ID NO: 188593 - DNA, 75 bp, Artificial Sequence
  Synthetic
acaaagaatttttagagcttttcttaacgtacctagaagaataagacaaggatttgaaagagctttgctataaaa

SEQ ID NO: 188594 - DNA, 75 bp, Artificial Sequence
  Synthetic
gtgaattatataaatataaagtggtagaaattaagccattaggagtagcacccactaaggcaaaaagaagagtgg

SEQ ID NO: 188595 - DNA, 75 bp, Artificial Sequence
  Synthetic
cagtatacgtataggaccaggacaagtattctatgcaacagatataaaaggggatataagacaagcacattgtaa

SEQ ID NO: 188596 - DNA, 75 bp, Artificial Sequence
  Synthetic
cagtatacgtataggaccaggacaagtattctatgcaacagatataaaaggggatataagactagcacattgtaa

SEQ ID NO: 188597 - DNA, 75 bp, Artificial Sequence
  Synthetic
cagtatacgtataggaccaggacaagtattctatgcaacagatataaaaggggatataagaccagcacattgtaa

SEQ ID NO: 188598 - DNA, 75 bp, Artificial Sequence
  Synthetic
cagtatacgtataggaccaggacaagtattctatgcaacagatataaaaggggatataagacgagcacattgtaa

SEQ ID NO: 188599 - DNA, 75 bp, Artificial Sequence
  Synthetic
cagtatacgtataggaccaggacaagtattctatgcaacagatataataggggatataagacaagcacattgtaa

SEQ ID NO: 188600 - DNA, 75 bp, Artificial Sequence
  Synthetic
cagtatacgtataggaccaggacaagtattctatgcaacagatataataggggatataagactagcacattgtaa

SEQ ID NO: 188601 - DNA, 75 bp, Artificial Sequence
  Synthetic
cagtatacgtataggaccaggacaagtattctatgcaacagatataataggggatataagaccagcacattgtaa

SEQ ID NO: 188602 - DNA, 75 bp, Artificial Sequence
  Synthetic
cagtatacgtataggaccaggacaagtattctatgcaacagatataataggggatataagacgagcacattgtaa

SEQ ID NO: 188603 - DNA, 75 bp, Artificial Sequence
  Synthetic
cagtatacgtataggaccaggacaagtattctatgcaacagatataacaggggatataagacaagcacattgtaa

SEQ ID NO: 188604 - DNA, 75 bp, Artificial Sequence
  Synthetic
cagtatacgtataggaccaggacaagtattctatgcaacagatataacaggggatataagactagcacattgtaa

SEQ ID NO: 188605 - DNA, 75 bp, Artificial Sequence
  Synthetic
cagtatacgtataggaccaggacaagtattctatgcaacagatataacaggggatataagaccagcacattgtaa

SEQ ID NO: 188606 - DNA, 75 bp, Artificial Sequence
  Synthetic
cagtatacgtataggaccaggacaagtattctatgcaacagatataacaggggatataagacgagcacattgtaa

SEQ ID NO: 188607 - DNA, 75 bp, Artificial Sequence
  Synthetic
cagtatacgtataggaccaggacaagtattctatgcaacagatataagaggggatataagacaagcacattgtaa

SEQ ID NO: 188608 - DNA, 75 bp, Artificial Sequence
  Synthetic
cagtatacgtataggaccaggacaagtattctatgcaacagatataagaggggatataagactagcacattgtaa

SEQ ID NO: 188609 - DNA, 75 bp, Artificial Sequence
  Synthetic
cagtatacgtataggaccaggacaagtattctatgcaacagatataagaggggatataagaccagcacattgtaa

SEQ ID NO: 188610 - DNA, 75 bp, Artificial Sequence
  Synthetic
cagtatacgtataggaccaggacaagtattctatgcaacagatataagaggggatataagacgagcacattgtaa

SEQ ID NO: 188611 - DNA, 75 bp, Artificial Sequence
  Synthetic
cagtatacgtataggaccaggacaagtattctatgcaacagttataaaaggggatataagacaagcacattgtaa

SEQ ID NO: 188612 - DNA, 75 bp, Artificial Sequence
  Synthetic
cagtatacgtataggaccaggacaagtattctatgcaacagttataaaaggggatataagactagcacattgtaa

SEQ ID NO: 188613 - DNA, 75 bp, Artificial Sequence
  Synthetic
cagtatacgtataggaccaggacaagtattctatgcaacagttataaaaggggatataagaccagcacattgtaa

SEQ ID NO: 188614 - DNA, 75 bp, Artificial Sequence
  Synthetic
cagtatacgtataggaccaggacaagtattctatgcaacagttataaaaggggatataagacgagcacattgtaa

SEQ ID NO: 188615 - DNA, 75 bp, Artificial Sequence
  Synthetic
cagtatacgtataggaccaggacaagtattctatgcaacagttataataggggatataagacaagcacattgtaa

SEQ ID NO: 188616 - DNA, 75 bp, Artificial Sequence
  Synthetic
cagtatacgtataggaccaggacaagtattctatgcaacagttataataggggatataagactagcacattgtaa

SEQ ID NO: 188617 - DNA, 75 bp, Artificial Sequence
  Synthetic
cagtatacgtataggaccaggacaagtattctatgcaacagttataataggggatataagaccagcacattgtaa

SEQ ID NO: 188618 - DNA, 75 bp, Artificial Sequence
  Synthetic
cagtatacgtataggaccaggacaagtattctatgcaacagttataataggggatataagacgagcacattgtaa

SEQ ID NO: 188619 - DNA, 75 bp, Artificial Sequence
  Synthetic
cagtatacgtataggaccaggacaagtattctatgcaacagttataacaggggatataagacaagcacattgtaa

SEQ ID NO: 188620 - DNA, 75 bp, Artificial Sequence
  Synthetic
cagtatacgtataggaccaggacaagtattctatgcaacagttataacaggggatataagactagcacattgtaa

SEQ ID NO: 188621 - DNA, 75 bp, Artificial Sequence
  Synthetic
cagtatacgtataggaccaggacaagtattctatgcaacagttataacaggggatataagaccagcacattgtaa

SEQ ID NO: 188622 - DNA, 75 bp, Artificial Sequence
  Synthetic
cagtatacgtataggaccaggacaagtattctatgcaacagttataacaggggatataagacgagcacattgtaa

SEQ ID NO: 188623 - DNA, 75 bp, Artificial Sequence
  Synthetic
cagtatacgtataggaccaggacaagtattctatgcaacagttataagaggggatataagacaagcacattgtaa

SEQ ID NO: 188624 - DNA, 75 bp, Artificial Sequence
  Synthetic
cagtatacgtataggaccaggacaagtattctatgcaacagttataagaggggatataagactagcacattgtaa

SEQ ID NO: 188625 - DNA, 75 bp, Artificial Sequence
  Synthetic
cagtatacgtataggaccaggacaagtattctatgcaacagttataagaggggatataagaccagcacattgtaa

SEQ ID NO: 188626 - DNA, 75 bp, Artificial Sequence
  Synthetic
cagtatacgtataggaccaggacaagtattctatgcaacagttataagaggggatataagacgagcacattgtaa

SEQ ID NO: 188627 - DNA, 75 bp, Artificial Sequence
  Synthetic
cagtatacgtataggaccaggacaagtattctatgcaacagctataaaaggggatataagacaagcacattgtaa

SEQ ID NO: 188628 - DNA, 75 bp, Artificial Sequence
  Synthetic
cagtatacgtataggaccaggacaagtattctatgcaacagctataaaaggggatataagactagcacattgtaa

SEQ ID NO: 188629 - DNA, 75 bp, Artificial Sequence
  Synthetic
cagtatacgtataggaccaggacaagtattctatgcaacagctataaaaggggatataagaccagcacattgtaa

SEQ ID NO: 188630 - DNA, 75 bp, Artificial Sequence
  Synthetic
cagtatacgtataggaccaggacaagtattctatgcaacagctataaaaggggatataagacgagcacattgtaa

SEQ ID NO: 188631 - DNA, 75 bp, Artificial Sequence
  Synthetic
cagtatacgtataggaccaggacaagtattctatgcaacagctataataggggatataagacaagcacattgtaa

SEQ ID NO: 188632 - DNA, 75 bp, Artificial Sequence
  Synthetic
cagtatacgtataggaccaggacaagtattctatgcaacagctataataggggatataagactagcacattgtaa

SEQ ID NO: 188633 - DNA, 75 bp, Artificial Sequence
  Synthetic
cagtatacgtataggaccaggacaagtattctatgcaacagctataataggggatataagaccagcacattgtaa

SEQ ID NO: 188634 - DNA, 75 bp, Artificial Sequence
  Synthetic
cagtatacgtataggaccaggacaagtattctatgcaacagctataataggggatataagacgagcacattgtaa

SEQ ID NO: 188635 - DNA, 75 bp, Artificial Sequence
  Synthetic
cagtatacgtataggaccaggacaagtattctatgcaacagctataacaggggatataagacaagcacattgtaa

SEQ ID NO: 188636 - DNA, 75 bp, Artificial Sequence
  Synthetic
cagtatacgtataggaccaggacaagtattctatgcaacagctataacaggggatataagactagcacattgtaa

SEQ ID NO: 188637 - DNA, 75 bp, Artificial Sequence
  Synthetic
cagtatacgtataggaccaggacaagtattctatgcaacagctataacaggggatataagaccagcacattgtaa

SEQ ID NO: 188638 - DNA, 75 bp, Artificial Sequence
  Synthetic
cagtatacgtataggaccaggacaagtattctatgcaacagctataacaggggatataagacgagcacattgtaa

SEQ ID NO: 188639 - DNA, 75 bp, Artificial Sequence
  Synthetic
cagtatacgtataggaccaggacaagtattctatgcaacagctataagaggggatataagacaagcacattgtaa

SEQ ID NO: 188640 - DNA, 75 bp, Artificial Sequence
  Synthetic
cagtatacgtataggaccaggacaagtattctatgcaacagctataagaggggatataagactagcacattgtaa

SEQ ID NO: 188641 - DNA, 75 bp, Artificial Sequence
  Synthetic
cagtatacgtataggaccaggacaagtattctatgcaacagctataagaggggatataagaccagcacattgtaa

SEQ ID NO: 188642 - DNA, 75 bp, Artificial Sequence
  Synthetic
cagtatacgtataggaccaggacaagtattctatgcaacagctataagaggggatataagacgagcacattgtaa

SEQ ID NO: 188643 - DNA, 75 bp, Artificial Sequence
  Synthetic
cagtatacgtataggaccaggacaagtattctatgcaacaggtataaaaggggatataagacaagcacattgtaa

SEQ ID NO: 188644 - DNA, 75 bp, Artificial Sequence
  Synthetic
cagtatacgtataggaccaggacaagtattctatgcaacaggtataaaaggggatataagactagcacattgtaa

SEQ ID NO: 188645 - DNA, 75 bp, Artificial Sequence
  Synthetic
cagtatacgtataggaccaggacaagtattctatgcaacaggtataaaaggggatataagaccagcacattgtaa

SEQ ID NO: 188646 - DNA, 75 bp, Artificial Sequence
  Synthetic
cagtatacgtataggaccaggacaagtattctatgcaacaggtataaaaggggatataagacgagcacattgtaa

SEQ ID NO: 188647 - DNA, 75 bp, Artificial Sequence
  Synthetic
cagtatacgtataggaccaggacaagtattctatgcaacaggtataataggggatataagacaagcacattgtaa

SEQ ID NO: 188648 - DNA, 75 bp, Artificial Sequence
  Synthetic
cagtatacgtataggaccaggacaagtattctatgcaacaggtataataggggatataagactagcacattgtaa

SEQ ID NO: 188649 - DNA, 75 bp, Artificial Sequence
  Synthetic
cagtatacgtataggaccaggacaagtattctatgcaacaggtataataggggatataagaccagcacattgtaa

SEQ ID NO: 188650 - DNA, 75 bp, Artificial Sequence
  Synthetic
cagtatacgtataggaccaggacaagtattctatgcaacaggtataataggggatataagacgagcacattgtaa

SEQ ID NO: 188651 - DNA, 75 bp, Artificial Sequence
  Synthetic
cagtatacgtataggaccaggacaagtattctatgcaacaggtataacaggggatataagacaagcacattgtaa

SEQ ID NO: 188652 - DNA, 75 bp, Artificial Sequence
  Synthetic
cagtatacgtataggaccaggacaagtattctatgcaacaggtataacaggggatataagactagcacattgtaa

SEQ ID NO: 188653 - DNA, 75 bp, Artificial Sequence
  Synthetic
cagtatacgtataggaccaggacaagtattctatgcaacaggtataacaggggatataagaccagcacattgtaa

SEQ ID NO: 188654 - DNA, 75 bp, Artificial Sequence
  Synthetic
cagtatacgtataggaccaggacaagtattctatgcaacaggtataacaggggatataagacgagcacattgtaa

SEQ ID NO: 188655 - DNA, 75 bp, Artificial Sequence
  Synthetic
cagtatacgtataggaccaggacaagtattctatgcaacaggtataagaggggatataagacaagcacattgtaa

SEQ ID NO: 188656 - DNA, 75 bp, Artificial Sequence
  Synthetic
cagtatacgtataggaccaggacaagtattctatgcaacaggtataagaggggatataagactagcacattgtaa

SEQ ID NO: 188657 - DNA, 75 bp, Artificial Sequence
  Synthetic
cagtatacgtataggaccaggacaagtattctatgcaacaggtataagaggggatataagaccagcacattgtaa

SEQ ID NO: 188658 - DNA, 75 bp, Artificial Sequence
  Synthetic
cagtatacgtataggaccaggacaagtattctatgcaacaggtataagaggggatataagacgagcacattgtaa

SEQ ID NO: 188659 - DNA, 75 bp, Artificial Sequence
  Synthetic
cagaaggagtaggagcagtgtctcaagatttggataagcatggggcaatcacaagcagcaatacagcaactacaa

SEQ ID NO: 188660 - DNA, 75 bp, Artificial Sequence
  Synthetic
gtctactataagggaaagaatgaggcgagctgagccagcagcagcaggggtaggagcagtgtctcaagatttgga

SEQ ID NO: 188661 - DNA, 75 bp, Artificial Sequence
  Synthetic
tataactctcccatgcagaataaagcaaattataaatatgtggcagagaacaggacaagcaatgtatgcccctcc

SEQ ID NO: 188662 - DNA, 75 bp, Artificial Sequence
  Synthetic
aaaaggcatacatctaggaccaggcagagcatttgatgcaataggaggaataataggagatataagacaagcaca

SEQ ID NO: 188663 - DNA, 75 bp, Artificial Sequence
  Synthetic
tggttggatggcctgctgtaagggaaagaatgagacgagctgagccagcagcagatggggtgggagcagcatctc

SEQ ID NO: 188664 - DNA, 75 bp, Artificial Sequence
  Synthetic
cagtggaacttctgggacgcagcagtctcaagggactacagagggggtgggaagcccttaagtatctgggaagtc

SEQ ID NO: 188665 - DNA, 75 bp, Artificial Sequence
  Synthetic
gaccaggggctacactagaagaaatgatgacagcatgtcaaggagtgggagggcctagccataaagcaagagttt

SEQ ID NO: 188666 - DNA, 75 bp, Artificial Sequence
  Synthetic
gatgatacagtattagaagacatgaatttgccaggaagatggaaaccaaaaatgatagggggaattggaggtttt

SEQ ID NO: 188667 - DNA, 75 bp, Artificial Sequence
  Synthetic
ggaagcgcaagaggaggcagacgaagtaggctttccagtcagacctcaggaccaatgacttataaagcagcattc

SEQ ID NO: 188668 - DNA, 75 bp, Artificial Sequence
  Synthetic
tttggggttgctctggaaaactcatttgcaccactactgtgccttggaacaatagttggagtggaaacaaaagtc

SEQ ID NO: 188669 - DNA, 75 bp, Artificial Sequence
  Synthetic
ggactgtggaacttctgggacacagcagtctcaaggggttgagactggggtgggaaggcctcaagtatctgtgga

SEQ ID NO: 188670 - DNA, 75 bp, Artificial Sequence
  Synthetic
gttgatactatagcaatagcagtagctggctggacagatagggttatagaaataggacaaagaattggtagagct

SEQ ID NO: 188671 - DNA, 75 bp, Artificial Sequence
  Synthetic
taacttccctcaaatcactctttggcagcgacccctagtcacagtaagaatagggggacagctaatagaagctct

SEQ ID NO: 188672 - DNA, 75 bp, Artificial Sequence
  Synthetic
tgctaatttgaccaatgtcaataacacaaccaataactctagcaaaataggaaatatcacagatgaagtaaacat

SEQ ID NO: 188673 - DNA, 75 bp, Artificial Sequence
  Synthetic
accacaccagacaagaaacatcagaaagaacccccatttctttggatggggtatgaactccatcctgacaaatgg

SEQ ID NO: 188674 - DNA, 75 bp, Artificial Sequence
  Synthetic
aggagatatgaaagatgaagtaaaaaactgttcttttaatgtaaccacagaactaagagataagcagcagaaggt

SEQ ID NO: 188675 - DNA, 75 bp, Artificial Sequence
  Synthetic
acaaacgaaataacaggagatataagaaaagcatattgtaagattaatggaacagaatggaataaaactttagaa

SEQ ID NO: 188676 - DNA, 75 bp, Artificial Sequence
  Synthetic
caggattgggtgccaacatagcagaataggcattatccgagggagaagaggcagaaatggagccaggagatatta

SEQ ID NO: 188677 - DNA, 75 bp, Artificial Sequence
  Synthetic
gaaaggcttaggcatttcctatggcaggaagaagtggagacagcgacgcacagcttctcgcagcagcaagaatca

SEQ ID NO: 188678 - DNA, 75 bp, Artificial Sequence
  Synthetic
taactttgcgaacagttaagcatagtagcattagttagcagcatttattaatagcaataattgtgtggactatag

SEQ ID NO: 188679 - DNA, 75 bp, Artificial Sequence
  Synthetic
gaattattggaattagataaatgggcaagtttgtggaattggtttaacataacaaattggctgtggtatataaaa

SEQ ID NO: 188680 - DNA, 75 bp, Artificial Sequence
  Synthetic
cgaaagagcgcttttctatagacttgatgtagtaccaattaatgatagtagtagtaatataggtcagtataggct

SEQ ID NO: 188681 - DNA, 75 bp, Artificial Sequence
  Synthetic
cacagtacaatgtacacatggaatcaagccagtagtatcaactcaactactgttaaatggcagtctagcagaagg

SEQ ID NO: 188682 - DNA, 75 bp, Artificial Sequence
  Synthetic
tacccatacaaaaagaaacatgggaaacatggtggatggattattggcaggctacctggattcctgaatgggaat

SEQ ID NO: 188683 - DNA, 75 bp, Artificial Sequence
  Synthetic
gaccaggacaagctttttatgcaacaggtgatataataggggatataaaacaagcacattgtaacgtcagtagag

SEQ ID NO: 188684 - DNA, 75 bp, Artificial Sequence
  Synthetic
aagaagcggagacagcgacgaagacctcctcaaggcagtcagactcatcaagtttctctatcaaagcagtaagta

SEQ ID NO: 188685 - DNA, 75 bp, Artificial Sequence
  Synthetic
ttcatttcagaattgggtgccaacatagcagaataggcattattccacaaagaagagcaaggaatggatcccgta

SEQ ID NO: 188686 - DNA, 75 bp, Artificial Sequence
  Synthetic
ctataacacttatggggatacttgggaaggagttgaagctataataagaatactgcaacaactactgtttattca

SEQ ID NO: 188687 - DNA, 75 bp, Artificial Sequence
  Synthetic
ggaaaatagacaggttaattgaaagaataagtgaaagagcagaagacagtggcaatgagagtgacggggatcaag

SEQ ID NO: 188688 - DNA, 75 bp, Artificial Sequence
  Synthetic
tggagaagtgaattgtataagtataaagtagtagagattaaaccactaggagtagcacctaccaaggcaaaaaga

SEQ ID NO: 188689 - DNA, 75 bp, Artificial Sequence
  Synthetic
aaacaagggcttaggcatttcctatggcaggaagaagcggagacagcgacgaacagctcctcctggcagtaagaa

SEQ ID NO: 188690 - DNA, 75 bp, Artificial Sequence
  Synthetic
gggctttgctataagatgggtggcaagtggtcaaaaatggttggatgggctacggtgagggaaagaatgagacga

SEQ ID NO: 188691 - DNA, 75 bp, Artificial Sequence
  Synthetic
tgtgataaatgtcagctaaaaggagaagccatgcatggacaagtagactgtagtccaggaatatggcaactagat

SEQ ID NO: 188692 - DNA, 75 bp, Artificial Sequence
  Synthetic
ataaaaaattgctctttcaatgcaaccacagaattaagggataagaagcagaaagtgtatgcacttttttataaa

SEQ ID NO: 188693 - DNA, 75 bp, Artificial Sequence
  Synthetic
ttgaataataatagtaccactaccactaatagtagcgagggaaaggaaatgaagaactgttctttcaacatcccc

SEQ ID NO: 188694 - DNA, 75 bp, Artificial Sequence
  Synthetic
cagcaggaaaagaatgaacaagacttattagcattggacaaatgggcaagtctgtggaattggtttgacatatca

SEQ ID NO: 188695 - DNA, 75 bp, Artificial Sequence
  Synthetic
ctattgtaaaaagtgttgctatcattgccaactatgctttttaaagaaaggcttaggcatttcctatggcaggaa

SEQ ID NO: 188696 - DNA, 75 bp, Artificial Sequence
  Synthetic
tacttacaataataacatgactgaagaaatgaaaaattgctctttcaataccaccacagaattaagagataaaaa

SEQ ID NO: 188697 - DNA, 75 bp, Artificial Sequence
  Synthetic
aaactcctccagcagcagaaggagtaggagcagtatctcaagatttagataaacatggagcagtaacaagtagta

SEQ ID NO: 188698 - DNA, 75 bp, Artificial Sequence
  Synthetic
gaccatagtatatatagaatataagaaactaagaaagcaaaggaaaatagactggttacttgaaagaataagtga

SEQ ID NO: 188699 - DNA, 75 bp, Artificial Sequence
  Synthetic
gctctttcaatataaccacagaattaagagataagcaaaagaaagaatacgcgcttttctatagacttgatgtag

SEQ ID NO: 188700 - DNA, 75 bp, Artificial Sequence
  Synthetic
caacaacaatacaagaaaaagtataactataggaccagggagagcattttatgcaacaggagatataataggaga

SEQ ID NO: 188701 - DNA, 75 bp, Artificial Sequence
  Synthetic
aaactaagaaagcaaaggaaaatagactggttacttgaaagaataagtgaaagagcagaagacagtggcaatgag

SEQ ID NO: 188702 - DNA, 75 bp, Artificial Sequence
  Synthetic
acagtatattatggggtgcctgtgtggaaagaagcaaaaaccactttattttgtgcatcagatgctaagggacat

SEQ ID NO: 188703 - DNA, 75 bp, Artificial Sequence
  Synthetic
catggaattaagccagtggtatcaactcaattactgctgaatggcagtttagcagaagaagaaataataattaaa

SEQ ID NO: 188704 - DNA, 75 bp, Artificial Sequence
  Synthetic
tgggatggcctgagattagggaaagattaagacgcactcctccaacagcagcagcagaaggagtaggagcagcat

SEQ ID NO: 188705 - DNA, 75 bp, Artificial Sequence
  Synthetic
tgtgggaaaataacatggtagagcaaatgcatgaagacataatcagtttatgggaggaaagcctaaaaccatgtg

SEQ ID NO: 188706 - DNA, 75 bp, Artificial Sequence
  Synthetic
tacacattggaccagggcaaacgttctatgcaacaggtgagataataggtgatataagacaagctcattgtaatg

SEQ ID NO: 188707 - DNA, 75 bp, Artificial Sequence
  Synthetic
actgggaatagcaatagcactttagggagaggacaagacatgacaaactgctctttcaaggtaaccacagaaaga

SEQ ID NO: 188708 - DNA, 75 bp, Artificial Sequence
  Synthetic
ggacctagaagttacaacacatagttttaattgtagaggagagtttttctattgtaatacatcagaactgtttaa

SEQ ID NO: 188709 - DNA, 75 bp, Artificial Sequence
  Synthetic
tcacactcccatgtaaaataaaacaaattgtaagaatgtggcagagagtgggacaagcaatgtatgcccctccca

SEQ ID NO: 188710 - DNA, 75 bp, Artificial Sequence
  Synthetic
aagaggtaataattagatctaaaaatatcacagacaataccaaaaacataatagtacagtttaaagatgctataa

SEQ ID NO: 188711 - DNA, 75 bp, Artificial Sequence
  Synthetic
actagcacattgtaatattagtagaaaagattggaatgacactttataccaggtagttacacaattaggaaaacg

SEQ ID NO: 188712 - DNA, 75 bp, Artificial Sequence
  Synthetic
aaaccgcctgcaggaggagacatagaaattacaatgcatacttttaattgtggaggggaatttttctattgcaac

SEQ ID NO: 188713 - DNA, 75 bp, Artificial Sequence
  Synthetic
atctgtagatgatatttggaaaaacatgacctggatggagtgggataaagaaattaacaattacacaaaaataat

SEQ ID NO: 188714 - DNA, 75 bp, Artificial Sequence
  Synthetic
tcctgaagtattgggttcaggaactaaagaatagtgctgttagtttgtttaatgcaatagctatagcagtagctg

SEQ ID NO: 188715 - DNA, 75 bp, Artificial Sequence
  Synthetic
agtagcatttgtaatagcagcaatattagcaatagttgtatggtctatagtactcatagaatataggaaaatatt

SEQ ID NO: 188716 - DNA, 75 bp, Artificial Sequence
  Synthetic
gaagactcgcaaatccagcaggagaaaaatgaaaaagatttattagcattggacagttggaaaaatctgtggagt

SEQ ID NO: 188717 - DNA, 75 bp, Artificial Sequence
  Synthetic
gataggtttaagaataatttttgctgtgctttctgtagtgaatagagttaggcagggatactcacctttgtcgtt

SEQ ID NO: 188718 - DNA, 75 bp, Artificial Sequence
  Synthetic
ttaattgtaccagacctagcaacaatacaagaaaaggtatacatataggaccaggacaagcattctatgcaacag

SEQ ID NO: 188719 - DNA, 75 bp, Artificial Sequence
  Synthetic
gtagtgtgagggagggaggagaaatgaaaaactgctctttcaatatcaccacaagcacaggcgctaaggtgacag

SEQ ID NO: 188720 - DNA, 75 bp, Artificial Sequence
  Synthetic
tcctcaggaggggatgtagaaattacaacacatagttttaattgtggaggagagtttttctattgtaatacatca

SEQ ID NO: 188721 - DNA, 75 bp, Artificial Sequence
  Synthetic
caggaactaaagaatagtgctattagtttaattgatacagcagcaatagcagtagctaactggacagataggatt

SEQ ID NO: 188722 - DNA, 75 bp, Artificial Sequence
  Synthetic
agctggagtaataaaaatcagagtgagatttggaaccacacgacctggatggagtgggataggcaaattagtaat

SEQ ID NO: 188723 - DNA, 75 bp, Artificial Sequence
  Synthetic
gaagacatgaaaaattgcactttcaatgtcaccacaagcatgagcaataaggtgcagcgagaacatgcacttttt

SEQ ID NO: 188724 - DNA, 75 bp, Artificial Sequence
  Synthetic
ttcagacctggaggaggagatatgagagacaattggagaagtgaattatacaaatataaagtagtaaaaattgaa

SEQ ID NO: 188725 - DNA, 75 bp, Artificial Sequence
  Synthetic
tggatggcctgctgtaaaagaaagaataagaagaactaatccaaggacagagagagcagcagtgggagtaggagc

SEQ ID NO: 188726 - DNA, 75 bp, Artificial Sequence
  Synthetic
ataagaagaactaatccaaggacagagagagcagcagtgggagtaggagcagcatctcaagatttagataaatat

SEQ ID NO: 188727 - DNA, 75 bp, Artificial Sequence
  Synthetic
ctcaggtaagggaaagaataagacaaaccccgccaacagaaggagcagcagaaggagtaggagcagtgtctcaag

SEQ ID NO: 188728 - DNA, 75 bp, Artificial Sequence
  Synthetic
ctcaggtgcctttaagaccaatgacttataagggagcattcgatcttggcttctttttaaaagaaaaggggggac

SEQ ID NO: 188729 - DNA, 75 bp, Artificial Sequence
  Synthetic
aacaacaatacaagaaaaagtatacatctaggaccaggcagagcgttttatgcaacagaaggaataataggaaat

SEQ ID NO: 188730 - DNA, 75 bp, Artificial Sequence
  Synthetic
agctaacggaacagataggattatagaagtattacaaagagctggtagagctgttcttaacatacctagaaggat

SEQ ID NO: 188731 - DNA, 75 bp, Artificial Sequence
  Synthetic
ttactcaatcctcaggaggggacccagaaattgcaatgcttaattttaattgtggaggggaattcttctactgta

SEQ ID NO: 188732 - DNA, 75 bp, Artificial Sequence
  Synthetic
gttaaatacagtggggggacatcaagcagctatgcaaatgttaaaagataccatcaatgaggaggctgcagaatg

SEQ ID NO: 188733 - DNA, 75 bp, Artificial Sequence
  Synthetic
gctatcattgccaactatgctttttaaagaaaggcttaggcatttcctatggcaggaagaagcggagacagcgac

SEQ ID NO: 188734 - DNA, 75 bp, Artificial Sequence
  Synthetic
aattggataaatgggcaagtttgtggaattggtttgacataacaaactggctgtggtatataaaaatattcataa

SEQ ID NO: 188735 - DNA, 75 bp, Artificial Sequence
  Synthetic
taattttttagggaaaatttggccttcccacaagggggggaggccagggaatttccttcagaacaggccagagcc

SEQ ID NO: 188736 - DNA, 75 bp, Artificial Sequence
  Synthetic
accagctctcaagacaggatcagaagaacttagatcattatttaatacagtagcaaccctctattgtgtacatca

SEQ ID NO: 188737 - DNA, 75 bp, Artificial Sequence
  Synthetic
aacagccccaccagcagagagcttcaggttcgaggagacaacccccgctccgaagcaggagccgaaagacaggga

SEQ ID NO: 188738 - DNA, 75 bp, Artificial Sequence
  Synthetic
agtagcaatacagcagctactaatgctgattgtgcctggctagaagcacaagaggaggaggaggtgggttttcca

SEQ ID NO: 188739 - DNA, 75 bp, Artificial Sequence
  Synthetic
ctcaggtgcctttaagaccaatgacttacaaggcagctctagatcttagccactttttaaaagaaaaggggggac

SEQ ID NO: 188740 - DNA, 75 bp, Artificial Sequence
  Synthetic
ggggaaagaaaaaatatagattaaaacatatagtatgggcaagcagggagctagaacgattcgcagttaaccctg

SEQ ID NO: 188741 - DNA, 75 bp, Artificial Sequence
  Synthetic
agcagcagaagaggtaataattagatctaaaaatatcacagacaataccaaaaacataatagtacagtttaaaga

SEQ ID NO: 188742 - DNA, 75 bp, Artificial Sequence
  Synthetic
cagacctggaggaggagatatgagggacaattggagaagtgaactatataaatataaagtagtaaaaattgaacc

SEQ ID NO: 188743 - DNA, 75 bp, Artificial Sequence
  Synthetic
aactcctcaggggagcaaaagcactaacagacatagtaccactaactgcagaagcagaattagaattggcagaga

SEQ ID NO: 188744 - DNA, 75 bp, Artificial Sequence
  Synthetic
agcaggggcaaggccaatggacatatcaaatatatcaggagccacataaaaacctgaaaacagggaagtatgcaa

SEQ ID NO: 188745 - DNA, 75 bp, Artificial Sequence
  Synthetic
agccagtggctacatagaagcagaagtaatcccagcagaaacaggacaggaaacagcatacttcatattaaaatt

SEQ ID NO: 188746 - DNA, 75 bp, Artificial Sequence
  Synthetic
gttaaggcaaaggaaaatagataggttaattgatagaataagagaaagagcagaagacagtggcaatgagagtga

SEQ ID NO: 188747 - DNA, 75 bp, Artificial Sequence
  Synthetic
agacaaactcctgcaagagcagatgaaagacgcaggcaaaaccctgcagcagcagaaggagtaggaccagtgtct

SEQ ID NO: 188748 - DNA, 75 bp, Artificial Sequence
  Synthetic
gatgcagataccactctattttgtgcatctgatgctaaagcatatagtactgaaaaacataatgtctgggctaca

SEQ ID NO: 188749 - DNA, 75 bp, Artificial Sequence
  Synthetic
catctgatgctaaagcatatagtactgaaaaacataatgtctgggctacacatgcctgtgtacccacagacccca

SEQ ID NO: 188750 - DNA, 75 bp, Artificial Sequence
  Synthetic
ttccagtcagaccacaggtacctacaaggccaatgacttataaggcagcttttgatcttggcttctttttaaaag

SEQ ID NO: 188751 - DNA, 75 bp, Artificial Sequence
  Synthetic
cgtatgtctatgggaccaggacacgtgttctataaaacaggagaaataacaggagatataagacaagcatattgt

SEQ ID NO: 188752 - DNA, 75 bp, Artificial Sequence
  Synthetic
ataaaaaactgctctttcaatataactacagaaataaaagataagaagaaaaaagaatttgcgcttttctataga

SEQ ID NO: 188753 - DNA, 75 bp, Artificial Sequence
  Synthetic
ataaaaaactgctctttcaatttaactacagaaataaaagataagaagaaaaaagaatttgcgcttttctataga

SEQ ID NO: 188754 - DNA, 75 bp, Artificial Sequence
  Synthetic
ataaaaaactgctctttcaatctaactacagaaataaaagataagaagaaaaaagaatttgcgcttttctataga

SEQ ID NO: 188755 - DNA, 75 bp, Artificial Sequence
  Synthetic
ataaaaaactgctctttcaatgtaactacagaaataaaagataagaagaaaaaagaatttgcgcttttctataga

SEQ ID NO: 188756 - DNA, 75 bp, Artificial Sequence
  Synthetic
taatagtagcatgacagaagaaataagaaattgttctttcaacacaactacagaaataagagataagcaaaagaa

SEQ ID NO: 188757 - DNA, 75 bp, Artificial Sequence
  Synthetic
ctctttcaatgtaaccacagaactaagagataagagaaagcatgaatatgcacttttttatagacttgatatagt

SEQ ID NO: 188758 - DNA, 75 bp, Artificial Sequence
  Synthetic
ataatacaagaaaaagtatgaggataggaccaggacaagcatggttctatacaaatgacataataggagacataa

SEQ ID NO: 188759 - DNA, 75 bp, Artificial Sequence
  Synthetic
aaacaataatcttaactaaccactcaggaggggatatagaaattacaacacatagttttaactgcagaggggaat

SEQ ID NO: 188760 - DNA, 75 bp, Artificial Sequence
  Synthetic
aaacaataatctttactaaccactcaggaggggatatagaaattacaacacatagttttaactgcagaggggaat

SEQ ID NO: 188761 - DNA, 75 bp, Artificial Sequence
  Synthetic
aaacaataatcttcactaaccactcaggaggggatatagaaattacaacacatagttttaactgcagaggggaat

SEQ ID NO: 188762 - DNA, 75 bp, Artificial Sequence
  Synthetic
aaacaataatcttgactaaccactcaggaggggatatagaaattacaacacatagttttaactgcagaggggaat

SEQ ID NO: 188763 - DNA, 75 bp, Artificial Sequence
  Synthetic
cccacactaatgatgtaaaacagttaacagaggcagtgcaaaaaatagccacagaaagcatagtaatatggggaa

SEQ ID NO: 188764 - DNA, 75 bp, Artificial Sequence
  Synthetic
gtagaggaggatttttctattgtaatacaacaaacctgtttaacataaacctgactaactggaggtctgatagta

SEQ ID NO: 188765 - DNA, 75 bp, Artificial Sequence
  Synthetic
ggctgtggtatataaaaatatttataatgatagtaggaggtttaataggtttaagaataatttttgctgtgcttt

SEQ ID NO: 188766 - DNA, 75 bp, Artificial Sequence
  Synthetic
aaaaagtgtgaggataggaccaggacaaacattctatgcaacagaagcaataataggaaatataagcgaagcaca

SEQ ID NO: 188767 - DNA, 75 bp, Artificial Sequence
  Synthetic
cctatggcaggaagaagcggagacaacgacgaacagctcctcctggcagtaagaatcatcaagatcctgtaccaa

SEQ ID NO: 188768 - DNA, 75 bp, Artificial Sequence
  Synthetic
tagcacttgcctgggacgatctacggagcctgtgccttttcagctaccaccgcttgagagacttcatcttgattg

SEQ ID NO: 188769 - DNA, 75 bp, Artificial Sequence
  Synthetic
aagagcagaagacagtggcaatgagagtgatggggatattgaggaattgtcaacaatggtggatatggggcatct

SEQ ID NO: 188770 - DNA, 75 bp, Artificial Sequence
  Synthetic
ggccttccaacaaggggaggccaggaaattttcttcagagcaggccagagccaacagccccgctagagccaacag

SEQ ID NO: 188771 - DNA, 75 bp, Artificial Sequence
  Synthetic
atcactctttggcagcgacccttagtcacagtaagaatagggggacagctaatagaagctctattagatacagga

SEQ ID NO: 188772 - DNA, 75 bp, Artificial Sequence
  Synthetic
actaattacaataatagcacaaatgtgaccagtagcatgattggagaaatgaaaaattgctctttcaatataacc

SEQ ID NO: 188773 - DNA, 75 bp, Artificial Sequence
  Synthetic
atcgattcgattagtcagcggattcttagcacttatctgggacgatctgaggaacctgtgcctcttctgctacca

SEQ ID NO: 188774 - DNA, 75 bp, Artificial Sequence
  Synthetic
ccacactcaggaggggatccagaaattacaacacatagctttaattgtagaggagaatttttctattgcaataca

SEQ ID NO: 188775 - DNA, 75 bp, Artificial Sequence
  Synthetic
atttggggaaacatgacctggatgcagtgggatagagaaattagtaattacacagacacaatatacaggttgctt

SEQ ID NO: 188776 - DNA, 75 bp, Artificial Sequence
  Synthetic
gaagtctcgcaaaaccagcaggaaaagaatgaaaaggatttactagcattggacagttggaaaaatctgtggaat

SEQ ID NO: 188777 - DNA, 75 bp, Artificial Sequence
  Synthetic
atggagaaaattagtagatttcagagagctcaataaaagaactcaagacttctgggaggttcaattaggaatacc

SEQ ID NO: 188778 - DNA, 75 bp, Artificial Sequence
  Synthetic
acccaacaataatacaagaaaaagtacgaggatagggataggacgaggacagacattctatgcaatgggacgaat

SEQ ID NO: 188779 - DNA, 75 bp, Artificial Sequence
  Synthetic
gcagaaggagtaggagcagtatctaaagatttagaaaaatttggagcagtcacaagcagtaatacagcacagact

SEQ ID NO: 188780 - DNA, 75 bp, Artificial Sequence
  Synthetic
aggggacagatagggttatagaagtagtacaaagagcttatagagctattctccacatacctacaagaataagac

SEQ ID NO: 188781 - DNA, 75 bp, Artificial Sequence
  Synthetic
aattgtagcaatgccaacacaacaggcaatgtcaacataacaggggacaacatgaatggagaaataaaaaactgc

SEQ ID NO: 188782 - DNA, 75 bp, Artificial Sequence
  Synthetic
ggaggctagaaggagagagatgggtgcgagagcgtcagtattaagcgggggaaaattagatacatgggaaaaaat

SEQ ID NO: 188783 - DNA, 75 bp, Artificial Sequence
  Synthetic
cagagactttctatgtagatggggcagatgatagggacacaaaattaggaaaagctggatatgttacagacagag

SEQ ID NO: 188784 - DNA, 75 bp, Artificial Sequence
  Synthetic
ataggaccaggacaagcaatctatacaacaaatataataggggatataagacaagcacattgtaatgtcagtaga

SEQ ID NO: 188785 - DNA, 75 bp, Artificial Sequence
  Synthetic
aataatagcaatagttgtgtggaccatagtattcatagaatataggaaaatattaagacaaagaaaaatagacag

SEQ ID NO: 188786 - DNA, 75 bp, Artificial Sequence
  Synthetic
attagtgaacggattcttagcacttgcctgggacgacctacggagcctgtgccttttcagctaccaccgattgag

SEQ ID NO: 188787 - DNA, 75 bp, Artificial Sequence
  Synthetic
cccagaagtaatacccatgttttcagcattatcagaaggagccaccccacaagatttaaacaccatgctaaacac

SEQ ID NO: 188788 - DNA, 75 bp, Artificial Sequence
  Synthetic
agggggtgggaagcccttaaatatctgggaagccttgggcagtattggggtcaggagctaaaaaagagtgctatt

SEQ ID NO: 188789 - DNA, 75 bp, Artificial Sequence
  Synthetic
agctctctcgacgcaggactcggcttgctgaagcgcgcacggcaagaggcgaggggcggcgactggtgagtacgc

SEQ ID NO: 188790 - DNA, 75 bp, Artificial Sequence
  Synthetic
ctttcaatgtcaccacatcaataagagatagggtgcggaaagaatacgcactttttaataaacttgatgtagtac

SEQ ID NO: 188791 - DNA, 75 bp, Artificial Sequence
  Synthetic
tcaaagaggagtatagttggatggcctaatgtaagagaaagaataagaagaactaatccactaacagagagagaa

SEQ ID NO: 188792 - DNA, 75 bp, Artificial Sequence
  Synthetic
ctacaaccatcccttcagacaggatcagaagaacttagatcattatataatacagtagcaaccctctattgtgtg

SEQ ID NO: 188793 - DNA, 75 bp, Artificial Sequence
  Synthetic
cctcaggtgcctttaagaccaatgacttataaggcagcattcgatctcagcttctttttaaaagaaaagggggga

SEQ ID NO: 188794 - DNA, 75 bp, Artificial Sequence
  Synthetic
acaacacaagaagaagtacacgtataggaccagggaaagcattctttacagtaggagatataagacaagcacatt

SEQ ID NO: 188795 - DNA, 75 bp, Artificial Sequence
  Synthetic
aggaccagggaaagcattctttacagtaggagatataagacaagcacattgtaacattagtagaaaagactggaa

SEQ ID NO: 188796 - DNA, 75 bp, Artificial Sequence
  Synthetic
gaataccacatccagcagggttaaaaaagaaaaaatcagtaacagtactagatgtgggggatgcatatttttcag

SEQ ID NO: 188797 - DNA, 75 bp, Artificial Sequence
  Synthetic
taccatagcaatagcagtagctggctggacagatagggttatagaaataggacaaagatttggtagagctattct

SEQ ID NO: 188798 - DNA, 75 bp, Artificial Sequence
  Synthetic
tgccaggaaaatggaaaccaaaaatgatagggggaattggaggttttatcaaagtaagacaatatgatcaaatag

SEQ ID NO: 188799 - DNA, 75 bp, Artificial Sequence
  Synthetic
tatcaaatttaccaagaaccattcaaaaatctgaaaacaggaaagtatgcaaaaatgaggactgcccacactaat

SEQ ID NO: 188800 - DNA, 75 bp, Artificial Sequence
  Synthetic
aatatgctttttaaagaaaggcttaggcatttcctatggaaggaagaagcggagacagcgacgaacaacttctta

SEQ ID NO: 188801 - DNA, 75 bp, Artificial Sequence
  Synthetic
agtagcatttattgtagcagtagttgtgtggaccatagtattcatagaatataagaaaatattaaggcaaagaaa

SEQ ID NO: 188802 - DNA, 75 bp, Artificial Sequence
  Synthetic
tactttctatagtaaatagagttaggcagggatattcaccattatcatttcagacccacttcccagccccgaggg

SEQ ID NO: 188803 - DNA, 75 bp, Artificial Sequence
  Synthetic
taataacacagtgaataggactatcagtgaacaggtagaaatgaaaaactgctctttcaatgtaaccacaaaagt

SEQ ID NO: 188804 - DNA, 75 bp, Artificial Sequence
  Synthetic
aaaaaaggaaaaagtctacctgtcatgggtaccagcacacaaaggaattggaggaaatgaacaagtagataaatt

SEQ ID NO: 188805 - DNA, 75 bp, Artificial Sequence
  Synthetic
ctcaggtacctttaagaccaatgacttacaaggcagctttcgatcttagccactttttaaaagaaaaggggggac

SEQ ID NO: 188806 - DNA, 75 bp, Artificial Sequence
  Synthetic
ataatgatgcagagaggcaattttaagggccagaaaagaattaagtgtttcaactgtggcaaagaaggacaccta

SEQ ID NO: 188807 - DNA, 75 bp, Artificial Sequence
  Synthetic
gcattaggaatcattcaagcacaaccagataagagtgaatcagagttagtcaaccaaataatagaacaattaata

SEQ ID NO: 188808 - DNA, 75 bp, Artificial Sequence
  Synthetic
aaggcatatatatagggccaggacgaagattcattgcaacaaacagaatcataggagatataagacaagcacatt

SEQ ID NO: 188809 - DNA, 75 bp, Artificial Sequence
  Synthetic
catctcttcagacaggatcagaagaacttagatcattattcaatacagtagcagtcctttattgtgtgcatcaaa

SEQ ID NO: 188810 - DNA, 75 bp, Artificial Sequence
  Synthetic
agttgtgtggatcatagtatatgtagaatataggaaattggtaaaacaaagaaaaatagactggttaattgaaag

SEQ ID NO: 188811 - DNA, 75 bp, Artificial Sequence
  Synthetic
ggatgaggattagaacatggaatagtttagtaaaacaccatatgtatgtttcaaggagagctaatggatggtttt

SEQ ID NO: 188812 - DNA, 75 bp, Artificial Sequence
  Synthetic
aagccacctttgcctagtgttacgaaactgacagaggatagatggaacaagccccagaagaccaagggccacaga

SEQ ID NO: 188813 - DNA, 75 bp, Artificial Sequence
  Synthetic
ccaatgcctctgacatactaggaaatgtaacagaggaagtaagaaactgcacttttaatatgaccacagtactac

SEQ ID NO: 188814 - DNA, 75 bp, Artificial Sequence
  Synthetic
gagctaccaccgattgagagacttcgcattgattgcagcgaggactgtggaacttctgggacacagcagtctcag

SEQ ID NO: 188815 - DNA, 75 bp, Artificial Sequence
  Synthetic
ctatggcaggaagaagcggagacagcgacgaagacctcctcaaggcagtcagactcatcaagtttctctatcaaa

SEQ ID NO: 188816 - DNA, 75 bp, Artificial Sequence
  Synthetic
gtagcaatagtagtagctaacgggacagataggattatagaagtattacaaagagctggtagagctattcttaac

SEQ ID NO: 188817 - DNA, 75 bp, Artificial Sequence
  Synthetic
aagagctggtagagctattcttaacatacctagaaggataagacagggccttgaaatagctttgcaataaaatgg

SEQ ID NO: 188818 - DNA, 75 bp, Artificial Sequence
  Synthetic
tagaaagctgttaaggcaaagaaaaatagataggttaattgagagaataagagaaagagcagaagacagtggcaa

SEQ ID NO: 188819 - DNA, 75 bp, Artificial Sequence
  Synthetic
agaagtggagacagcgacgaagcgctcctgcaagcagtgaggatcatcaaaatcctctatcaaagcagtgagtaa

SEQ ID NO: 188820 - DNA, 75 bp, Artificial Sequence
  Synthetic
ctcatgatctttggaatgttaatgatctgtaatgctacagacaacttgtgggtcacagtctattatggggtacct

SEQ ID NO: 188821 - DNA, 75 bp, Artificial Sequence
  Synthetic
tttatgggatgaaagcctaaaaccatgtataaagctaacccctctctgtgttactttaaactgtactgatgtaat

SEQ ID NO: 188822 - DNA, 75 bp, Artificial Sequence
  Synthetic
gctaaaaaagagtgctattagtctgcttgataccacagcaatagcagtagctgagggaacagatagaattataga

SEQ ID NO: 188823 - DNA, 75 bp, Artificial Sequence
  Synthetic
gaaataaaaaactgctctttcactgtaaccacagaaataaaggataagaagaagcaagaacacgcgcttttctat

SEQ ID NO: 188824 - DNA, 75 bp, Artificial Sequence
  Synthetic
tcaagatcttataccaaagcagtaagtatatgtaatgctgaatttactagaaaaagtagattatagaatagcagt

SEQ ID NO: 188825 - DNA, 75 bp, Artificial Sequence
  Synthetic
tgatatccacaataataccatgaaaggagaagtaaaaaattgctctttcatggcaaccacagaaataaaagataa

SEQ ID NO: 188826 - DNA, 75 bp, Artificial Sequence
  Synthetic
caataatagcaatagttgtgtggtccatagtattcatagaatataggagaatattaagacaaagaaaaatagaca

SEQ ID NO: 188827 - DNA, 75 bp, Artificial Sequence
  Synthetic
tagaatgtggaaatgttacccgcaatgagacctaccaggagaatgtgagggaaataaaaaattgctctttcaata

SEQ ID NO: 188828 - DNA, 75 bp, Artificial Sequence
  Synthetic
taggaccaggacaagctttctatgcaacaggtgatataatagggaagataagacaagcacattgtaacgtcagta

SEQ ID NO: 188829 - DNA, 75 bp, Artificial Sequence
  Synthetic
aggcccggcaataatacaaggaagagtataagaataggaccaggacaaacatacttttcaacaggagaaataata

SEQ ID NO: 188830 - DNA, 75 bp, Artificial Sequence
  Synthetic
aaattgtactaatttgaatgctactaggtacaatagtagtaaagagggaataggagaaatgaaaaactgctcttt

SEQ ID NO: 188831 - DNA, 75 bp, Artificial Sequence
  Synthetic
tataggttgataagttgtaacacctcagtcattacacaggcctgtccaaaggtatcctttgagccaattcccata

SEQ ID NO: 188832 - DNA, 75 bp, Artificial Sequence
  Synthetic
gagtatagattaataaattgtaatacctcaaccataacacaagcctgtccaaaggtctcttttgacccaattcct

SEQ ID NO: 188833 - DNA, 75 bp, Artificial Sequence
  Synthetic
aaagtataaggataggaccaggacaaacattctatgcaacaggagacataataggagacataagacaagcacatt

SEQ ID NO: 188834 - DNA, 75 bp, Artificial Sequence
  Synthetic
tctgtagtaattaactgtacaagacccaataacaatacaagaaaaagtatacatatgggaccagggagatggtca

SEQ ID NO: 188835 - DNA, 75 bp, Artificial Sequence
  Synthetic
taaaaaactgctcttttaatgtaaccacagaaataaaagataagaaaaagaaagaacgtgcgcttttctatacac

SEQ ID NO: 188836 - DNA, 75 bp, Artificial Sequence
  Synthetic
tccctcaaatcactctttggcagcgacccctaatcacagtaagagtagggggacagctaatagaagctctattag

SEQ ID NO: 188837 - DNA, 75 bp, Artificial Sequence
  Synthetic
tgttataaaatggggggcaagtggtcaaaaagcagtatagttggatggcctgaggtgagagaaagaataagacga

SEQ ID NO: 188838 - DNA, 75 bp, Artificial Sequence
  Synthetic
aaaatcgcagaaccagcaggaaaagaatgaacaggacttattggcattggacaagtgggcaaatctgtggaattg

SEQ ID NO: 188839 - DNA, 75 bp, Artificial Sequence
  Synthetic
atagataggataattaaaagaataagagaaagagcagaagatagtggcaatgagagtgatggggacacagaggaa

SEQ ID NO: 188840 - DNA, 75 bp, Artificial Sequence
  Synthetic
attacacagacataatatacaggttgcttgaagaatcacaaaaccagcaggaagaaaatgaaaaagatttactag

SEQ ID NO: 188841 - DNA, 75 bp, Artificial Sequence
  Synthetic
gctggacttacaatagtagtagcttaagggaagaagtaaaaaactgctctttcaatgtcaccacaaacataagag

SEQ ID NO: 188842 - DNA, 75 bp, Artificial Sequence
  Synthetic
atacaaggaaaagtataccccttggaccagggcaagcgttctatgcaacaggtgacataataggagatataagac

SEQ ID NO: 188843 - DNA, 75 bp, Artificial Sequence
  Synthetic
accagggcaagcgttctatgcaacaggtgacataataggagatataagacaagctcattgtaatgttagtagaac

SEQ ID NO: 188844 - DNA, 75 bp, Artificial Sequence
  Synthetic
taggaggcttgataggtttaagaatagtttttgctgtactttctgtagtaaatagagttaggcagggatactcac

SEQ ID NO: 188845 - DNA, 75 bp, Artificial Sequence
  Synthetic
atctgcaggaggggacctagaaattacaacacatagttttaattgtagaggagaatttttctattgtaatacatc

SEQ ID NO: 188846 - DNA, 75 bp, Artificial Sequence
  Synthetic
aacgaacaatacaggagtaaaaccaggagaagtaaaaaactgcactttcaatatgaccacagaaataagggataa

SEQ ID NO: 188847 - DNA, 75 bp, Artificial Sequence
  Synthetic
gtatcaactcaactgctgttaaatggcagtctagcagagaacgagacagtaattagatctgagaatttcacgaat

SEQ ID NO: 188848 - DNA, 75 bp, Artificial Sequence
  Synthetic
agctatctgcaacatacctagaagaataagacagggctttgaagcagctttgcaataaaatggggggcaagtggt

SEQ ID NO: 188849 - DNA, 75 bp, Artificial Sequence
  Synthetic
ggggggccccaacagggacccgaaagccaaagttagaacccgagaagttctctcgacgcaggaactcggcttgct

SEQ ID NO: 188850 - DNA, 75 bp, Artificial Sequence
  Synthetic
cctggctggaagcgcaagaggaggaaggagaagtaggctttccagtcagacctcaggtacctttaagaccaatga

SEQ ID NO: 188851 - DNA, 75 bp, Artificial Sequence
  Synthetic
cctttgcctagtgttaagaaactgacagaggatagatggaacaagccccagaagaccaagggccacagagggagc

SEQ ID NO: 188852 - DNA, 75 bp, Artificial Sequence
  Synthetic
atggagcaatcacaagtagcaatacagcagctactaatgctgcttgtgcctggctagaagcacaagaggaggagg

SEQ ID NO: 188853 - DNA, 75 bp, Artificial Sequence
  Synthetic
gggggacatcaagcagccatgcaaatgttaaaagagaccatcaatgaggaagctgcagaatgggatagagtacat

SEQ ID NO: 188854 - DNA, 75 bp, Artificial Sequence
  Synthetic
gcaatagtagcattagtagtagcagcaataatagcaatagttgtgtggaccatagtattcatagaatataggaaa

SEQ ID NO: 188855 - DNA, 75 bp, Artificial Sequence
  Synthetic
gaacggattcttagcacttgcctgggacgatctgcggagcctgtgcctcttcagctaccaccgattgagagactt

SEQ ID NO: 188856 - DNA, 75 bp, Artificial Sequence
  Synthetic
ttaaaagcattgggaccagcggctacactagaagaaatgatgacagcatgtcagggagtaggaggacccggccat

SEQ ID NO: 188857 - DNA, 75 bp, Artificial Sequence
  Synthetic
aacagaaggagcagcagaaggagtaggagcagtgtctcaagatttggatacacatggggcaatcacaagcagcaa

SEQ ID NO: 188858 - DNA, 75 bp, Artificial Sequence
  Synthetic
cagcaggaaaagaatgaacaagacttattggcattggacaagtgggcaagtctgtggaattggtttgacatatca

SEQ ID NO: 188859 - DNA, 75 bp, Artificial Sequence
  Synthetic
tattggcattggacaagtgggcaagtctgtggaattggtttgacatatcaaactggctgtggtatataaaaatat

SEQ ID NO: 188860 - DNA, 75 bp, Artificial Sequence
  Synthetic
ccaggccagatgagagaaccaaggggaagtgatatagcaggaactactagtacccttcaggaacaaataggatgg

SEQ ID NO: 188861 - DNA, 75 bp, Artificial Sequence
  Synthetic
gagactggggtgggaaggcctcaagcatctgtggaatctcctgttgtattggggtcgggagctaaaaactagtgc

SEQ ID NO: 188862 - DNA, 75 bp, Artificial Sequence
  Synthetic
tctggctggaagcgcaagaagaagaggatgtaggctttccagtcaggccacaagtaccactgaggccaatgactt

SEQ ID NO: 188863 - DNA, 75 bp, Artificial Sequence
  Synthetic
tctggctggatgcgcaagaagaagaggatgtaggctttccagtcaggccacaagtaccactgaggccaatgactt

SEQ ID NO: 188864 - DNA, 75 bp, Artificial Sequence
  Synthetic
tctggctggacgcgcaagaagaagaggatgtaggctttccagtcaggccacaagtaccactgaggccaatgactt

SEQ ID NO: 188865 - DNA, 75 bp, Artificial Sequence
  Synthetic
tctggctggaggcgcaagaagaagaggatgtaggctttccagtcaggccacaagtaccactgaggccaatgactt

SEQ ID NO: 188866 - DNA, 75 bp, Artificial Sequence
  Synthetic
cacaagtaccactgaggccaatgacttacaaaggagctttagatctcagccactttttaaaagaaaaggggggac

SEQ ID NO: 188867 - DNA, 75 bp, Artificial Sequence
  Synthetic
cagagcagaccagagccaacagccccaccagaagagagcttcaggtttggggaagagacaacaactccctctcag

SEQ ID NO: 188868 - DNA, 75 bp, Artificial Sequence
  Synthetic
acttagtatgggcaagcagggagctggaaagatttgcacttaaccctggccttttagagacatcagaaggctgta

SEQ ID NO: 188869 - DNA, 75 bp, Artificial Sequence
  Synthetic
tgtgggatctgacttagaaataggacagcatagagaaaaagtggaagaattaaggaagcatctattgaggtgggg

SEQ ID NO: 188870 - DNA, 75 bp, Artificial Sequence
  Synthetic
aaggcttaggcatttcctatggcaggaagaagcggagacagcgacgaacagcttcttacagcagtaagaatcatc

SEQ ID NO: 188871 - DNA, 75 bp, Artificial Sequence
  Synthetic
aggatgtatagccctgttagcattttggatataaaacaagggccaaaagaacctttcagagactatgtagatagg

SEQ ID NO: 188872 - DNA, 75 bp, Artificial Sequence
  Synthetic
taaaaccatgtgtaaagctaacccctctctgtgttactttagaatgtactaatgcaaattatactaaggtaaata

SEQ ID NO: 188873 - DNA, 75 bp, Artificial Sequence
  Synthetic
acagattcacaatatgcattggggattattcaagcacaaccagataagagtgaatcagaattagtcagtcaaata

SEQ ID NO: 188874 - DNA, 75 bp, Artificial Sequence
  Synthetic
tataaccacagaattaagagataaggttaagaaagaatacgcgcttttctataaagttgatatagtatcaattaa

SEQ ID NO: 188875 - DNA, 75 bp, Artificial Sequence
  Synthetic
aatggaacagggccatgcacaaatgtcagcacagtacagtgtacacatggaattaagccagtggtatcaactcaa

SEQ ID NO: 188876 - DNA, 75 bp, Artificial Sequence
  Synthetic
caataacacaagaaaaagcatacctatggggccaggacgagcattctatgcaacaggagatgtcataggagacat

SEQ ID NO: 188877 - DNA, 75 bp, Artificial Sequence
  Synthetic
tcctcaggaggggacatagaagttgcctcacatacttttaattgtggaggagaatttttctattgcaacacaaca

SEQ ID NO: 188878 - DNA, 75 bp, Artificial Sequence
  Synthetic
ggccgctatacagaaaatgatactattacactgccatgtagaataaaacaaattataaacatgtggcagagagtg

SEQ ID NO: 188879 - DNA, 75 bp, Artificial Sequence
  Synthetic
ggcttaggcatttcctatggcaggaagaagcggagacagcgacgaagcgctcctccaagcagtgaggatcatcaa

SEQ ID NO: 188880 - DNA, 75 bp, Artificial Sequence
  Synthetic
tcagacctggaggaggagatatgagagacaattggagaagtgaactatataaatataaagtagtaaaaattgaac

SEQ ID NO: 188881 - DNA, 75 bp, Artificial Sequence
  Synthetic
aataggaaaaataggaaatatgagacaagcacattgtaacattagtagagcaaaatggaataacactttaaaaca

SEQ ID NO: 188882 - DNA, 75 bp, Artificial Sequence
  Synthetic
gttcctgtgtggaaagatgcagataccaccctattttgtgcatcagatgccaaagcacatgagacagaagtgcat

SEQ ID NO: 188883 - DNA, 75 bp, Artificial Sequence
  Synthetic
tgattgtgtggcaggtagacaggatgaggattagaacatggcatagtttagtaaaacatcatatgtatgtctcaa

SEQ ID NO: 188884 - DNA, 75 bp, Artificial Sequence
  Synthetic
agaaattgtaacgcacagttttaattgtggaggggaatttttctactgtaattcaacacaactgtttaatagtac

SEQ ID NO: 188885 - DNA, 75 bp, Artificial Sequence
  Synthetic
caggaaatatactgcattcaccatacctagtataaacaatgaaacaccagggattagatatcaatataatgtgct

SEQ ID NO: 188886 - DNA, 75 bp, Artificial Sequence
  Synthetic
ataacaacatattggggtctgcatacaggagaaagagactggcatttgggccagggagtctccatagaatggagg

SEQ ID NO: 188887 - DNA, 75 bp, Artificial Sequence
  Synthetic
ggtaggatctttacaatatttggcactgaaagcattagtaacaccaacaagggcaaagccacctttgcctagtgt

SEQ ID NO: 188888 - DNA, 75 bp, Artificial Sequence
  Synthetic
tgaagtaaggaactgtacttttaatatgaccacagaaataatagataagaagcagaaggcccatgcactttttta

SEQ ID NO: 188889 - DNA, 75 bp, Artificial Sequence
  Synthetic
gacctggatggagtgggataggcaaattagcaactacacaggtgaaatatacagattgcttgaagtctcacaaaa

SEQ ID NO: 188890 - DNA, 75 bp, Artificial Sequence
  Synthetic
taactttacaaatgctaacgatacaaatgttgacgagacccacgaaggtagcatgtctggagaaataaaaaattg

SEQ ID NO: 188891 - DNA, 75 bp, Artificial Sequence
  Synthetic
gatgtaaaacagttaacagaggcagtgcaaaaaatagccatagaaagcatagtaatatgaggaaagacgcctaaa

SEQ ID NO: 188892 - DNA, 75 bp, Artificial Sequence
  Synthetic
tatgggaccaggaagagcactctttagaacaggagaaataataggaaatccaagacaagcattttgtaaggttaa

SEQ ID NO: 188893 - DNA, 75 bp, Artificial Sequence
  Synthetic
acaacgacgagcagcttctcacagcagtgaaaatcatcaagatcctataccaaagcagtaagtataattacttag

SEQ ID NO: 188894 - DNA, 75 bp, Artificial Sequence
  Synthetic
aataaatctgtacaaattgtgtgtataagacccggcaataatacaagaaaaagtataaggataggaccaggacag

SEQ ID NO: 188895 - DNA, 75 bp, Artificial Sequence
  Synthetic
aagacaaagaaaaatagacaggttaattgatagaataagagatagagcagaagacagtggcaatgagagtgaagg

SEQ ID NO: 188896 - DNA, 75 bp, Artificial Sequence
  Synthetic
ggtctacctgtcataagtaccagcacataaaagaattagaggaaatgaacaagtagacaaattagtaagtaatag

SEQ ID NO: 188897 - DNA, 75 bp, Artificial Sequence
  Synthetic
atatgaccacagaactaagagataagaaacagaatgtgtatgcacttttttataaacttgatatagtaccactta

SEQ ID NO: 188898 - DNA, 75 bp, Artificial Sequence
  Synthetic
aatgataccaactacaagaatatcacagatggggaagtaatgaattgctctttcaatataaccacagaaataaga

SEQ ID NO: 188899 - DNA, 75 bp, Artificial Sequence
  Synthetic
agagcagaagcagcagcaactggagcaggaccagtatctcaagatttagctaggcatggagcaatcacaagcagc

SEQ ID NO: 188900 - DNA, 75 bp, Artificial Sequence
  Synthetic
ccacccatagtagcaaaagaaatagtagctagctgtgataaatgtcagctaaaaaaagaagccatacatggacaa

SEQ ID NO: 188901 - DNA, 75 bp, Artificial Sequence
  Synthetic
gtgggagcaatggagaaaggagaaatgaaaaactgctcttttaaagttaccacacacatgagagataagatgcaa

SEQ ID NO: 188902 - DNA, 75 bp, Artificial Sequence
  Synthetic
gccacagagggagccatacaatgaatggatgttagaactgttagaggatcttaagcatgaagctgttagacattt

SEQ ID NO: 188903 - DNA, 75 bp, Artificial Sequence
  Synthetic
gcactaccacagccgatgtctctgacggaataggaaatataacagatgaagtaagaaactgtacttttaatatga

SEQ ID NO: 188904 - DNA, 75 bp, Artificial Sequence
  Synthetic
agaataggcattgttcgagggagaagagtcagggatggatctggtagaccctaacctagatccctggaaccaccc

SEQ ID NO: 188905 - DNA, 75 bp, Artificial Sequence
  Synthetic
atagcagttctctattgtgtacatcaaaggatagatgtaaaagacaccaaagaagccttagataaaatagaagaa

SEQ ID NO: 188906 - DNA, 75 bp, Artificial Sequence
  Synthetic
tggagtaataaatcttatgatgagatttggaacaacatgacatggacacaatgggagagagaaatcagcaattac

SEQ ID NO: 188907 - DNA, 75 bp, Artificial Sequence
  Synthetic
atacaagaaaaagtatacatttaggaccaggacacgctttctatgccacaggtgctataataggggatataagac

SEQ ID NO: 188908 - DNA, 75 bp, Artificial Sequence
  Synthetic
tgctgaggcaaagaaaaatagataggataattaagagaataagtgaaagagcagaagatagtggcaatgagagtg

SEQ ID NO: 188909 - DNA, 75 bp, Artificial Sequence
  Synthetic
gagaaagagcagaagatagtggcaatgagagtgatggggacacagaggaattatccactcttctggagatggggt

SEQ ID NO: 188910 - DNA, 75 bp, Artificial Sequence
  Synthetic
gactgtggaacttctgggacacagcagtctcaagggactgagacgggggtgggaaggcctcaaatatctggggaa

SEQ ID NO: 188911 - DNA, 75 bp, Artificial Sequence
  Synthetic
tgacagcattgataaaaccaaaaaagagaaagccacctctgcctagtgttaggaaattagcagaggatagatgga

SEQ ID NO: 188912 - DNA, 75 bp, Artificial Sequence
  Synthetic
tagtctgcttgataccatagcaatagcagtagctgaaggaacagataggattattgaagtaatacaaagaatttg

SEQ ID NO: 188913 - DNA, 75 bp, Artificial Sequence
  Synthetic
gaagaaataaaaaactgctctttcaatatgaccacagaaataagggataaaacaaagaaagtatattcacttttt

SEQ ID NO: 188914 - DNA, 75 bp, Artificial Sequence
  Synthetic
gaacttaataagagaactcaagacttctgggaagttcaattaggaataccacatcccgcagggttaaaaaagaaa

SEQ ID NO: 188915 - DNA, 75 bp, Artificial Sequence
  Synthetic
atatatctaaagaatggcaagaaataaaaaactgctcttttaatatgaccacagagttaagagataggaaacaga

SEQ ID NO: 188916 - DNA, 75 bp, Artificial Sequence
  Synthetic
gtttcaattgtggcaaagaaggacacctagccagaaattgcagggcccctaggaaaaagggctgttggaaatgtg

SEQ ID NO: 188917 - DNA, 75 bp, Artificial Sequence
  Synthetic
gcttgaagaatcgcaaaaccagcaggaaaagaatgaacaagatttactagcattggacagttggaaaaatctgtg

SEQ ID NO: 188918 - DNA, 75 bp, Artificial Sequence
  Synthetic
aacttctgggacgcagcagtctcaggggactacagagggggtgggaagcccttaagtatctgggaagtcttgtgc

SEQ ID NO: 188919 - DNA, 75 bp, Artificial Sequence
  Synthetic
ccagcggagagctccggggtcagagaggagatagccccctccctgaagcaggagccaaaggagcaggagttatat

SEQ ID NO: 188920 - DNA, 75 bp, Artificial Sequence
  Synthetic
tgcactgattgggataatgctactcttgcaaatatgacgggagaaataaaaaactgcactttcaatatcaccaca

SEQ ID NO: 188921 - DNA, 75 bp, Artificial Sequence
  Synthetic
cagcgacgaagcactcctccaagcagtgagaatcatcagaatcttataccaaagcagtaagtatatatgtaatgc

SEQ ID NO: 188922 - DNA, 75 bp, Artificial Sequence
  Synthetic
ggcaacaatacaagaaaaagtatacatataggaccaggacaatcattctatgcaacagatgctataataggggat

SEQ ID NO: 188923 - DNA, 75 bp, Artificial Sequence
  Synthetic
aaagatagaggtacgagacaccaaggaagccttagacaagatagaggaagaacaaaacaaaagtcagcaaaaaac

SEQ ID NO: 188924 - DNA, 75 bp, Artificial Sequence
  Synthetic
gaagcgctccttcaagcagtgaggatcatcaaaatcttgtatcaaagcagtaagtaccaaatagtagatgtaatg

SEQ ID NO: 188925 - DNA, 75 bp, Artificial Sequence
  Synthetic
ggctatctgcaacgtacctacaagaataagacagggccttgaagcagctttgcaataacatggggggcaagtggt

SEQ ID NO: 188926 - DNA, 75 bp, Artificial Sequence
  Synthetic
aagacaaagtatacatatagcaccaggaagagcattttatgcaacaggtgcaataacaggaaatataagaaaagc

SEQ ID NO: 188927 - DNA, 75 bp, Artificial Sequence
  Synthetic
gcatggagcaattacaagcagcaacacagccaccactaatgctgcttgtgcctggctggaagcacaagaggaggc

SEQ ID NO: 188928 - DNA, 75 bp, Artificial Sequence
  Synthetic
cgaaaatagtactgctggctacaatcatacagaaatgaaaaattgctctttcaacgcaaccacagaaataaaaga

SEQ ID NO: 188929 - DNA, 75 bp, Artificial Sequence
  Synthetic
tgctataacatgggtggaaagtggtcaaaaagtagcatagtgggatggcctgagattagggaaagattaagacgc

SEQ ID NO: 188930 - DNA, 75 bp, Artificial Sequence
  Synthetic
taacagaaaattttaacatgtggaaaaatgacatggtgaagcagatgcatgaggatataatcagttatgggacca

SEQ ID NO: 188931 - DNA, 75 bp, Artificial Sequence
  Synthetic
cttgcgcctggctggaagcacaagaggatgaggaggtaggctttccagtcagaccacaggtacctttaagaccaa

SEQ ID NO: 188932 - DNA, 75 bp, Artificial Sequence
  Synthetic
cacggtctggggcattaaacagctccaggcaagagtcctggctgtggaaagatacctaagggatcaacagctcct

SEQ ID NO: 188933 - DNA, 75 bp, Artificial Sequence
  Synthetic
cacaggtacctttaagaccaatgacttataaggcagcttttgatcttggcttctttttaaaagaaaaggggggac

SEQ ID NO: 188934 - DNA, 75 bp, Artificial Sequence
  Synthetic
caagcaggaatttggaattccctacaatccccaaagtcaaggagtagtagaatctatgaataaagaattaaagaa

SEQ ID NO: 188935 - DNA, 75 bp, Artificial Sequence
  Synthetic
tatcacctagaactttgaatgcatgggtaaaagtaatagaggagaaggctttcagcccagaggtaatacccatgt

SEQ ID NO: 188936 - DNA, 75 bp, Artificial Sequence
  Synthetic
aacattttttgcaactaacataataagagacataagacaagcacattgtaacattagtgaaaaggactagaataa

SEQ ID NO: 188937 - DNA, 75 bp, Artificial Sequence
  Synthetic
aaggtaagacgagcaatgtatgcccctcctattgaaagaaacataacatgtagatcaaatatcacaggactacta

SEQ ID NO: 188938 - DNA, 75 bp, Artificial Sequence
  Synthetic
gcagcagcagaaggagtaggagcagtatctcgagatttagctagacatggagcaatcacaagcagtaatacagcc

SEQ ID NO: 188939 - DNA, 75 bp, Artificial Sequence
  Synthetic
tagtgataagacaagaatggaaaagggagaaataaaaaactgctctttcaatatcaccacaacaataagagacaa

SEQ ID NO: 188940 - DNA, 75 bp, Artificial Sequence
  Synthetic
agccagcagcaggggtgggagcagcatctcgagacctgggaaaacatggggcaatcacaagtagcaatacagcag

SEQ ID NO: 188941 - DNA, 75 bp, Artificial Sequence
  Synthetic
cttagtacaggatcagaagaacttagatcattatttaatacaatagcaaccctttggtgcgtgcatcaaaggatg

SEQ ID NO: 188942 - DNA, 75 bp, Artificial Sequence
  Synthetic
agggcaagcaatatatacaacagaagccataataggagatataagacaagcacattgtaacattagtgaagaaaa

SEQ ID NO: 188943 - DNA, 75 bp, Artificial Sequence
  Synthetic
attgtaatgcacagctttaattgtggaggggaatttttatactgcaatacaacagagctgtttaatagtacttgg

SEQ ID NO: 188944 - DNA, 75 bp, Artificial Sequence
  Synthetic
tgctattagtctgcttgataccatagcaatagcagtagctgaaagaacagataagattataaaattcatacaaga

SEQ ID NO: 188945 - DNA, 75 bp, Artificial Sequence
  Synthetic
ctatgcaaatgttaaaagataccatcaatgaggaagctgcagaatgggacaggatacatccagtacatgcagggc

SEQ ID NO: 188946 - DNA, 75 bp, Artificial Sequence
  Synthetic
gcaaatggtcaaaaagcagcatagttagatggcctgctgtaaaagaaagaataagaagaactgagccagcagcag

SEQ ID NO: 188947 - DNA, 75 bp, Artificial Sequence
  Synthetic
cagtctcaggggacttcagaaggggtggcaaatccttaagtatctgggagggcttggacagtattggtgtctgga

SEQ ID NO: 188948 - DNA, 75 bp, Artificial Sequence
  Synthetic
ctgattgtgcctggctagaagcgcaagaggaagaagaagaagtaggctttccagtcagacctcaggtgcctttaa

SEQ ID NO: 188949 - DNA, 75 bp, Artificial Sequence
  Synthetic
ctgtcagcattttggacataaaacaagggccaaaagaaccctttagagattatgtagataggttctttaaaactc

SEQ ID NO: 188950 - DNA, 75 bp, Artificial Sequence
  Synthetic
ccaggggctacattagaagaaatgatgacagcatgtcagggagtggggggacccggtcataaagcaagagttttg

SEQ ID NO: 188951 - DNA, 75 bp, Artificial Sequence
  Synthetic
atggaaaggatcaccagctatattccagagtagcatgacaaaaatcttagaaccatttagaacacaaaacccaga

SEQ ID NO: 188952 - DNA, 75 bp, Artificial Sequence
  Synthetic
gagaaataggcaattacacaaacttaatatacgacttacttgaaaaatctcagaaccaacaagaaaaaaatgaac

SEQ ID NO: 188953 - DNA, 75 bp, Artificial Sequence
  Synthetic
ttcctatggcaggaagaagcggagacagcgacgagcagctccttacggcagtaagaatcatcaagatcttatacc

SEQ ID NO: 188954 - DNA, 75 bp, Artificial Sequence
  Synthetic
gtaagaatcatcaagatcttataccaaagcagtaagtataatcaatagttttgtaatgatacctttacaaatagc

SEQ ID NO: 188955 - DNA, 75 bp, Artificial Sequence
  Synthetic
catgaaaaattgctctttcaatataaccacagagttaagagataagagaagaaatgaatatgcacttttttatag

SEQ ID NO: 188956 - DNA, 75 bp, Artificial Sequence
  Synthetic
agccatttaaaaacctgaaaacagggaagtatgcaaaaaggaggactgcccacactaatgatgtaaggcaattaa

SEQ ID NO: 188957 - DNA, 75 bp, Artificial Sequence
  Synthetic
ctcctgcaatattggagtcaggaactaaagaatagtgctgttagcttgctaaatgccacagctatagcagtagct

SEQ ID NO: 188958 - DNA, 75 bp, Artificial Sequence
  Synthetic
atcttgggtatgttgctgatctgtagtgctacagagaacttgtgggtcacagtatattatggggtgcctgtgtgg

SEQ ID NO: 188959 - DNA, 75 bp, Artificial Sequence
  Synthetic
aagttaacccctctctgtgttactttaaaatgtacaaacgctactagtaccaacagtagcaacgtggagaacata

SEQ ID NO: 188960 - DNA, 75 bp, Artificial Sequence
  Synthetic
gtattggagtcaggaactaaagaatagtgctgttagcttgctcaatgccacagccatagcagtagctgaggggac

SEQ ID NO: 188961 - DNA, 75 bp, Artificial Sequence
  Synthetic
tgtacacatggaattaagccagtggtatcaactcaactgctgttaaatggaagtctggcaacagaaaagatgata

SEQ ID NO: 188962 - DNA, 75 bp, Artificial Sequence
  Synthetic
aggctctattagacacaggagcagatgatacagtattagaagaaataaatttgccaggaaaatggaaaccaaaaa

SEQ ID NO: 188963 - DNA, 75 bp, Artificial Sequence
  Synthetic
aaagcatacatatagggccaggacaaacactctatgcaacaggtgctataataggaaacataagacaagcatatt

SEQ ID NO: 188964 - DNA, 75 bp, Artificial Sequence
  Synthetic
gcaatataaagtttcaaccatcctcaggaggagacatagaaattgcaatgcacacctttaactgtggaggagaat

SEQ ID NO: 188965 - DNA, 75 bp, Artificial Sequence
  Synthetic
ctcctaaatttagactacccatacaaaaagaaacatgggaagcatggtggatggagtattggcaggctacctgga

SEQ ID NO: 188966 - DNA, 75 bp, Artificial Sequence
  Synthetic
aaataaaaaattgctctttcaatataaccacagaattaagagataagaatcagaaagtatatgcacttttttata

SEQ ID NO: 188967 - DNA, 75 bp, Artificial Sequence
  Synthetic
ctctaaaacaataggaaatctaacagatgaagtaagaaactgttcttttagtatgaccacagaactacaggatag

SEQ ID NO: 188968 - DNA, 75 bp, Artificial Sequence
  Synthetic
tgcatacaggagaaagagaatggcatttgggtcagggggtctccatagaatggaggctgaaaaggtacagaacac

SEQ ID NO: 188969 - DNA, 75 bp, Artificial Sequence
  Synthetic
tatggggatacttgggcaggagtggaagccataataagaattctgcaacaactgctgtttattcatttcagaatt

SEQ ID NO: 188970 - DNA, 75 bp, Artificial Sequence
  Synthetic
attgtaaaaggtgctgcttacattgccaagtttgtttcatgaaaaaaggcttaggcatcttctatggcaggaaga

SEQ ID NO: 188971 - DNA, 75 bp, Artificial Sequence
  Synthetic
ctcacagcagtaagaatcatcaagatcctgtaccaaagcagtaagtatattagttagttctgtaatgacaccttt

SEQ ID NO: 188972 - DNA, 75 bp, Artificial Sequence
  Synthetic
ccaataatgctagcatagacaatggggaagaaataagaaattgctctttcaatatcaccacagaaataagagata

SEQ ID NO: 188973 - DNA, 75 bp, Artificial Sequence
  Synthetic
ggaagaaataagaaattgctctttcaatatcaccacagaaataagagataagagtaagagggaatatgcactttt

SEQ ID NO: 188974 - DNA, 75 bp, Artificial Sequence
  Synthetic
caataatagcaatagttgtgtggaccatagtattaatagaatataggaaaatattaagacaaagaaaaatagaca

SEQ ID NO: 188975 - DNA, 75 bp, Artificial Sequence
  Synthetic
atgggaaaaaattcggttaaggccaggaggaaagaaaaaatatagactaaaacatttggtatgggcaagcaggga

SEQ ID NO: 188976 - DNA, 75 bp, Artificial Sequence
  Synthetic
gaatcgaagaagaaggtggagagcaagacagagacagatccattcgattagtgagcggattcttagcacttgcct

SEQ ID NO: 188977 - DNA, 75 bp, Artificial Sequence
  Synthetic
tagaacagatgcatgaggatataatcagtttatgggatgaaagcctaaaaccatgtgtaaagctaacccctctct

SEQ ID NO: 188978 - DNA, 75 bp, Artificial Sequence
  Synthetic
caataatacaagaaaaagtgtgaggataggaccaggacaaacattctatgcaacaggagacataataggagatat

SEQ ID NO: 188979 - DNA, 75 bp, Artificial Sequence
  Synthetic
ggtgtaagtcaagatatgaaaaactgctctttcaatataaccacagaagtgagagataagcagacaaaagaatac

SEQ ID NO: 188980 - DNA, 75 bp, Artificial Sequence
  Synthetic
tttgcaccatcctcaggaggggacctagaaattacaacacatagctttaattgtagaggagaatttttctattgc

SEQ ID NO: 188981 - DNA, 75 bp, Artificial Sequence
  Synthetic
ggaaaaataacatggtagaacagatgcatgaagatataatcagtttatgggatcaaagcctaaagccatgtgtaa

SEQ ID NO: 188982 - DNA, 75 bp, Artificial Sequence
  Synthetic
ttgtaacacctcagtcattacacaggcctgtccaaagatatcctttgagccaattcccatacattattgtgcccc

SEQ ID NO: 188983 - DNA, 75 bp, Artificial Sequence
  Synthetic
tacaaagagcttatagagctattctccacatacctacaagaataagacagggcttagaaagggctttgctataag

SEQ ID NO: 188984 - DNA, 75 bp, Artificial Sequence
  Synthetic
tgtaccagacctggcaacaatacaagaaaaggtatacatataggaccaggacaggctctctatgcaacaggtgat

SEQ ID NO: 188985 - DNA, 75 bp, Artificial Sequence
  Synthetic
aagaaaatagacaggttaattgagagaataagagaaagagcagaagacagtggcaatgagagtgatggggataca

SEQ ID NO: 188986 - DNA, 75 bp, Artificial Sequence
  Synthetic
gacataagacaagggccaaaggaaccctttagagactatgtagaccggttctttaaaactttaagagctgaacaa

SEQ ID NO: 188987 - DNA, 75 bp, Artificial Sequence
  Synthetic
atggtttgcaacaggagatataataggagatataagacaagcacattgtaatcttagtagcacaatatggaatga

SEQ ID NO: 188988 - DNA, 75 bp, Artificial Sequence
  Synthetic
aaacaataatctttgagaacccctccccaggaggggatatagaaattataacacatagctttaattgtagaggag

SEQ ID NO: 188989 - DNA, 75 bp, Artificial Sequence
  Synthetic
cacaagtagaccctggcctggcagaccagctaattcatatgcactattttgattgttttgcagactctgccataa

SEQ ID NO: 188990 - DNA, 75 bp, Artificial Sequence
  Synthetic
gggatttggggctgcgctggaaaacacatctgcaccactactgtaccttggaacgatagttggagtaataaatct

SEQ ID NO: 188991 - DNA, 75 bp, Artificial Sequence
  Synthetic
agaagaagtatacctataggaccagggagggcattttatacaacagaaataataggggatataagacaagcatat

SEQ ID NO: 188992 - DNA, 75 bp, Artificial Sequence
  Synthetic
caatgtacgcccctcctatccaaggagaaataaggtgtgactcaaacattacaggactactattaacaagagatg

SEQ ID NO: 188993 - DNA, 75 bp, Artificial Sequence
  Synthetic
gaagaagtaaaaaactgctctttcaatgtaaccacagaaataagagacaaaaggaagagcgagtatgcgcttttc

SEQ ID NO: 188994 - DNA, 75 bp, Artificial Sequence
  Synthetic
tcaagacaggatcagaagaacttaaatcattatttaatacaatagcaaccctctggtgcgtacaccaaaggatag

SEQ ID NO: 188995 - DNA, 75 bp, Artificial Sequence
  Synthetic
aaactcatctgcaccactaatgtgccctggaacagtagttggagtaataaatcttataatgatatttgggataac

SEQ ID NO: 188996 - DNA, 75 bp, Artificial Sequence
  Synthetic
ataaggtgcagaaagaatatgcacttttttataaacttgatgtagtaccaatagataatgctgataataataata

SEQ ID NO: 188997 - DNA, 75 bp, Artificial Sequence
  Synthetic
agacaggctaattttttagggaaaatttggccttcccacaaggggaggccagggaatttccttcagaacagacca

SEQ ID NO: 188998 - DNA, 75 bp, Artificial Sequence
  Synthetic
caagcattctatgcaacaggtgccataacaggggatataagacaagcacattgtaatgtcagtagatcagaatgg

SEQ ID NO: 188999 - DNA, 75 bp, Artificial Sequence
  Synthetic
gggatctatggtaggaataagaacatagaatttaactcatcctcaggaggggacctagaaattacaacacatagt

SEQ ID NO: 189000 - DNA, 75 bp, Artificial Sequence
  Synthetic
gacatagcaggaactactagtaaccttcaagaacaaataggatggatgacaaacaatccacctatcccagtggga

SEQ ID NO: 189001 - DNA, 75 bp, Artificial Sequence
  Synthetic
aacatggggcacttacaaccagcaacacatcctccaataatgaggcttgtgcctggctggaagcacaagagcaag

SEQ ID NO: 189002 - DNA, 75 bp, Artificial Sequence
  Synthetic
aacaatacaagaaaaagtatacatataggaccagggagagcattttatacaacaggagaaataataggagatata

SEQ ID NO: 189003 - DNA, 75 bp, Artificial Sequence
  Synthetic
aaggagagataggctttccagtcaggcctcaagtacctttaagaccaatgacttacaaagcagcattcgatcttg

SEQ ID NO: 189004 - DNA, 75 bp, Artificial Sequence
  Synthetic
ctctgggacacagggtgtgggagattctcaaatatctggggagtcttgcccagtattggggtcaggaactgaaga

SEQ ID NO: 189005 - DNA, 75 bp, Artificial Sequence
  Synthetic
gacgcagggggtgggaaatcctcaagtattggtggaatctcctgcagtattggattcaggaactaaagaatagtg

SEQ ID NO: 189006 - DNA, 75 bp, Artificial Sequence
  Synthetic
acaattggagaagtgaattatataaatataaagtagtaaaaattgaaccactaggagtagcacccaccaaggcaa

SEQ ID NO: 189007 - DNA, 75 bp, Artificial Sequence
  Synthetic
aagaaacatcagaaagaacccccatttctttggatggggtatgaactccatcctgacaaatggacagtacagcct

SEQ ID NO: 189008 - DNA, 75 bp, Artificial Sequence
  Synthetic
catctattgaaatggggatttaccacaccagacaaaaaacatcagaaagaacctccatttctttggatgggatat

SEQ ID NO: 189009 - DNA, 75 bp, Artificial Sequence
  Synthetic
gcaacaagtggtcaaaatttagtgttagtgatggtctactgtaagggaaagaataagacgaactgagccagcagc

SEQ ID NO: 189010 - DNA, 75 bp, Artificial Sequence
  Synthetic
ctttccagtcagaccgcaggtacctttaagaccaatgacttataagggagcttttgatcttggcttctttttaaa

SEQ ID NO: 189011 - DNA, 75 bp, Artificial Sequence
  Synthetic
cgcaggtacctttaagaccaatgacttataagggagcttttgatcttggcttctttttaaaagaaaaggggggac

SEQ ID NO: 189012 - DNA, 75 bp, Artificial Sequence
  Synthetic
atgtggcagaaagtaggacgagcaatgtatgcccctcccattgaaggaaacataacatgtaactcaagtatcaca

SEQ ID NO: 189013 - DNA, 75 bp, Artificial Sequence
  Synthetic
acccctgtagcagcagaagaaggagcagcagaaggagtaggaccagcatctcaagatttagctaggcatggagcg

SEQ ID NO: 189014 - DNA, 75 bp, Artificial Sequence
  Synthetic
acagatagggttatagaagtattacaaagagcttgtagagctatcctccacatacctacaagaataagacagggc

SEQ ID NO: 189015 - DNA, 75 bp, Artificial Sequence
  Synthetic
agaaaattcggttgaggccagggggaaagaaaaaatatagactaaaacatctagtatgggcaagcagagagctgg

SEQ ID NO: 189016 - DNA, 75 bp, Artificial Sequence
  Synthetic
taggaccagggcaagcaatatatacaacaggaaccataataggagatataagacaagcatattgtaacattagtg

SEQ ID NO: 189017 - DNA, 75 bp, Artificial Sequence
  Synthetic
attatgtacatcaaaggatacatataagagacacaaaggaagctctagataagttagaggaagaacaaaacaaaa

SEQ ID NO: 189018 - DNA, 75 bp, Artificial Sequence
  Synthetic
aattataaacatgtggcagagagtaggaaaagcaatgtataaccctcccatcgcaggacaaattagatgttcatc

SEQ ID NO: 189019 - DNA, 75 bp, Artificial Sequence
  Synthetic
ggagcctgtgcctcttcagctaccaccgattgagagactgcatattgattgcaacgagagcggtggaacttctaa

SEQ ID NO: 189020 - DNA, 75 bp, Artificial Sequence
  Synthetic
tagtctgcttgacgccttagcaatagtagtagctgaaagaacagataagattataaaattcttacaaaggctttg

SEQ ID NO: 189021 - DNA, 75 bp, Artificial Sequence
  Synthetic
ctttgctataaaatgaagagcaaatggtcaaaaagcagcatagttagatagcctgagataagagaaagaataaga

SEQ ID NO: 189022 - DNA, 75 bp, Artificial Sequence
  Synthetic
atggatgacaagcaacccacctatcccagtgggagaaatctataaaaggtggataatcctgggattaaataaaat

SEQ ID NO: 189023 - DNA, 75 bp, Artificial Sequence
  Synthetic
gagggagaaatggagccagtagatcctaacatagagccctggaaccagccaggaagtcagcctaaaactgcttgt

SEQ ID NO: 189024 - DNA, 75 bp, Artificial Sequence
  Synthetic
aacacatagtatgggcaagcagggagctggaaagatttgcacttaaccctggtcttttagaaacatcagaaggct

SEQ ID NO: 189025 - DNA, 75 bp, Artificial Sequence
  Synthetic
ccagcggagagcctcgggtttggagaggagagaacaccctccccaaaacaggagcagaaggacaaggaacagctt

SEQ ID NO: 189026 - DNA, 75 bp, Artificial Sequence
  Synthetic
tgtgtggaccatagtatatatagaatatagaaagattttaaaacaaaagaaaatagatgggttatttgagagaat

SEQ ID NO: 189027 - DNA, 75 bp, Artificial Sequence
  Synthetic
gagctattattcacatacctagaagaataagacagggcttagaaagggctttgctataaaatgggtggcaagtgg

SEQ ID NO: 189028 - DNA, 75 bp, Artificial Sequence
  Synthetic
gcagtaaggaccatcaagatcttatatcaaagcagtaagtatatatatatgtaatgctgaatttattagcaagag

SEQ ID NO: 189029 - DNA, 75 bp, Artificial Sequence
  Synthetic
agtttatgggatgaaagcctaaaaccatgtgtaaagctaacccctctctgtgttactttaaactgtactaatgta

SEQ ID NO: 189030 - DNA, 75 bp, Artificial Sequence
  Synthetic
ctagcaatagtagcataagctacagaagaaatgaaaaactgctctttctttataaccacagaagtaagagaaaag

SEQ ID NO: 189031 - DNA, 75 bp, Artificial Sequence
  Synthetic
ctagcaatagtagcataagctacagaagaaatgaaaaactgctctttctttataaccacagaagtaagagataag

SEQ ID NO: 189032 - DNA, 75 bp, Artificial Sequence
  Synthetic
ctagcaatagtagcataagctacagaagaaatgaaaaactgctctttctttataaccacagaagtaagagacaag

SEQ ID NO: 189033 - DNA, 75 bp, Artificial Sequence
  Synthetic
ctagcaatagtagcataagctacagaagaaatgaaaaactgctctttctttataaccacagaagtaagagagaag

SEQ ID NO: 189034 - DNA, 75 bp, Artificial Sequence
  Synthetic
gagtattggcaagccacctggattcctgagtgggagtttgtcaatacccctcccctagtaaaattatggtaccag

SEQ ID NO: 189035 - DNA, 75 bp, Artificial Sequence
  Synthetic
acatggaattaagccagtggtatcaactcaattgctgttaaatggaagtctagcaacagaaaaggtaatgatcag

SEQ ID NO: 189036 - DNA, 75 bp, Artificial Sequence
  Synthetic
atacatataggaccaggacaagcattctatgcaacaggtgacataataggagatataagacaagcacattgtaat

SEQ ID NO: 189037 - DNA, 75 bp, Artificial Sequence
  Synthetic
tgaaaaattaaaagaacaatttgggaataataaaacaatagtctttaagccatcctcaggaggggacccagaaat

SEQ ID NO: 189038 - DNA, 75 bp, Artificial Sequence
  Synthetic
cactgcaatgcagaataaaacaaattgtaagaatgtggcagagaacaggacaagcaatgtatgcccctcccagca

SEQ ID NO: 189039 - DNA, 75 bp, Artificial Sequence
  Synthetic
aaacaaattataaacatgtggcaggaggtgggacgagcaatgtataaccctcccattgcaggaaacataacatgt

SEQ ID NO: 189040 - DNA, 75 bp, Artificial Sequence
  Synthetic
ggaccaggacacgtattctatagaacaggagacatagtaggagatataagacaggcatattgtgaggttaatgga

SEQ ID NO: 189041 - DNA, 75 bp, Artificial Sequence
  Synthetic
gggatagataaggctcaagaagaccatgaaaaatatcacagcaattggagagcaatggctagtgattttaatctg

SEQ ID NO: 189042 - DNA, 75 bp, Artificial Sequence
  Synthetic
atgaaaaatatcacagcaattggagagcaatggctagtgattttaatctgccacctatagtagcaaaagaaatag

SEQ ID NO: 189043 - DNA, 75 bp, Artificial Sequence
  Synthetic
aggtgtgaatatcaagcaggacataacaaggtaggatctctacagtacttggcactaacagcattaataacacca

SEQ ID NO: 189044 - DNA, 75 bp, Artificial Sequence
  Synthetic
agagtagtgctattaatttgcttgatacagtagcaatagcaacagctaactggacagatagggttatagaaatag

SEQ ID NO: 189045 - DNA, 75 bp, Artificial Sequence
  Synthetic
atggggggcaaatggtcaaaaagtagcctagtaggatggcctgagattagggaaagaataagaagaactcaagaa

SEQ ID NO: 189046 - DNA, 75 bp, Artificial Sequence
  Synthetic
aagaggaggaggaagaggaggtaggcttcccagtcaggccccaggtacctctaagacctatgacctataagggag

SEQ ID NO: 189047 - DNA, 75 bp, Artificial Sequence
  Synthetic
gtacagcttcttacagcagtaaaaatcatcaagatcctataccagagcagtaagtataattccttaatggtactg

SEQ ID NO: 189048 - DNA, 75 bp, Artificial Sequence
  Synthetic
actcatcctcaggaggggacctagaaattacaacacatagctttaattgtcaaggagaatttttctattgtaata

SEQ ID NO: 189049 - DNA, 75 bp, Artificial Sequence
  Synthetic
tcagacctcaagtgcctttaagaccaatgacttataaggcagcattcgatctcagcttctttttaaaagaaaagg

SEQ ID NO: 189050 - DNA, 75 bp, Artificial Sequence
  Synthetic
tgaggaacaaggagaactaaaaaactgctctttcaatatcaccacaaacatgagagataaggtgcagaaagaata

SEQ ID NO: 189051 - DNA, 75 bp, Artificial Sequence
  Synthetic
tttgctataacatggggggcaaatggtcaaaaagtagcatagtgggatggcctaaggtcagggaaagaataaggc

SEQ ID NO: 189052 - DNA, 75 bp, Artificial Sequence
  Synthetic
taaaaaactgctctttcaatatcaccacaagcataagagataaggtgcagaaacaatatgcacttttttatagcc

SEQ ID NO: 189053 - DNA, 75 bp, Artificial Sequence
  Synthetic
atagaaaaaatagattatagattagcagtaggagcattgatagtagcactaatcatagcaatagttgtgtggacc

SEQ ID NO: 189054 - DNA, 75 bp, Artificial Sequence
  Synthetic
aagcacaggaactaaggtaagagactctgcactttttaataagcttgatgtattaccaatagataatagtagtac

SEQ ID NO: 189055 - DNA, 75 bp, Artificial Sequence
  Synthetic
gaattgaaaaactgttctttcaatgtaaccacagaaacaacagataggaagaagaaagaacacgcgcttttctat

SEQ ID NO: 189056 - DNA, 75 bp, Artificial Sequence
  Synthetic
gttaattgaaagaattagggaaagagcagaagacagtggcaatgagagtgaaggggatacagaggaattggcaac

SEQ ID NO: 189057 - DNA, 75 bp, Artificial Sequence
  Synthetic
atactataccaaagcagtaagtaatacatgtaatgtctcctttagtaatctgttcaataataggactggtagtag

SEQ ID NO: 189058 - DNA, 75 bp, Artificial Sequence
  Synthetic
attacttgtgtaagacccaacaacaatacaagaaaaagtataagtatgggaccagggagagcattttatacaaca

SEQ ID NO: 189059 - DNA, 75 bp, Artificial Sequence
  Synthetic
tctcaatacaggatcagaagaacttaaatcactatataatctactagcaaccctctggtgcgtacatcaaaggat

SEQ ID NO: 189060 - DNA, 75 bp, Artificial Sequence
  Synthetic
accagggagagcattttttacaacaggaagcataataggagatataagacgagcacattgtaatatcagtaaaac

SEQ ID NO: 189061 - DNA, 75 bp, Artificial Sequence
  Synthetic
actgtctattatggggtacctgtgtggaaagatgcagagaccaccctattttgtgcatcagatgctaaagcatat

SEQ ID NO: 189062 - DNA, 75 bp, Artificial Sequence
  Synthetic
tgtaaaaattaattgtaccagacctaacaacaatacaagaaaaggtatacatataggaccaggacaagctttcta

SEQ ID NO: 189063 - DNA, 75 bp, Artificial Sequence
  Synthetic
aacaacaatacaagaaaaggtatacatataggaccaggacaagctttctatgcaacaggtgatataataggggac

SEQ ID NO: 189064 - DNA, 75 bp, Artificial Sequence
  Synthetic
atataggaccaggacaagctttctatgcaacaggtgatataataggggacataagacaagcacattgtaatatca

SEQ ID NO: 189065 - DNA, 75 bp, Artificial Sequence
  Synthetic
taacagtactagtaatagtacctacaatgataacatggatggagctggagaaataaaaaattgttctttcaatat

SEQ ID NO: 189066 - DNA, 75 bp, Artificial Sequence
  Synthetic
gaacaaaacaataatctttaatcaatctgcaggaggggatccagaggttgtaatgcacatttctaattgtggagg

SEQ ID NO: 189067 - DNA, 75 bp, Artificial Sequence
  Synthetic
acccagggtaattcgggtaatactaccaatgaactttcggttaatgctgacaatgaaagaaactgttcttataat

SEQ ID NO: 189068 - DNA, 75 bp, Artificial Sequence
  Synthetic
ataggaccaggacaaaccttctatgcacaaggtgatgtgatagggaacataagaaaagcatattgtgaggtcaat

SEQ ID NO: 189069 - DNA, 75 bp, Artificial Sequence
  Synthetic
cccatgcagaataaaacaacttataaacctgtggcaaagagcaggacaagcaatgtatgcccctcccataccagg

SEQ ID NO: 189070 - DNA, 75 bp, Artificial Sequence
  Synthetic
agtacaatgtacacatggaattaggccagtagtatcaactcaactgctgttaaatggcagtctagcagaaaaaga

SEQ ID NO: 189071 - DNA, 75 bp, Artificial Sequence
  Synthetic
acagcaggcaaaagcggctgacggaaaggtcagtcaaaattatcctatagtgcagaatcttcaagggcaaatggt

SEQ ID NO: 189072 - DNA, 75 bp, Artificial Sequence
  Synthetic
aaggtcagtcaaaattatcctatagtgcagaatcttcaagggcaaatggtacaccaggccatatcacctagaact

SEQ ID NO: 189073 - DNA, 75 bp, Artificial Sequence
  Synthetic
acaagaaaaagtatacatataggaccagggagagcattttatacaacaggagatataataggagatataagacaa

SEQ ID NO: 189074 - DNA, 75 bp, Artificial Sequence
  Synthetic
caatattccaaagtagcatgacaagaatcttagagccctttagagcaaaaaatccagaaatagtcatctatcaat

SEQ ID NO: 189075 - DNA, 75 bp, Artificial Sequence
  Synthetic
actcctcaggaggggacccagaaattgtaacacacagttttatttgtggaggggaattcttctactgtaatacat

SEQ ID NO: 189076 - DNA, 75 bp, Artificial Sequence
  Synthetic
ataaaatgggtggcaagtggtcagaaagtagtgtggttagaaggcatgtacctttaagacaaggcagctatagat

SEQ ID NO: 189077 - DNA, 75 bp, Artificial Sequence
  Synthetic
attctcaacatacctacaagaatcagacagggcctcgaaagagctttgctataagatgggaggcaagtggtcaaa

SEQ ID NO: 189078 - DNA, 75 bp, Artificial Sequence
  Synthetic
gtgctattagcctgcttaatgccacagcaatagtagtagctgaaggaacagataggattatagagatagcacgta

SEQ ID NO: 189079 - DNA, 75 bp, Artificial Sequence
  Synthetic
agctgagccagcagcagatggggtgggagcagtatctcgagacctggaaaaacatggagcaatcacaagtagcaa

SEQ ID NO: 189080 - DNA, 75 bp, Artificial Sequence
  Synthetic
taggatggcctgaaattagggaaagaataagaagaacttctccaacagcagcagcagaaggagtaggagcagcat

SEQ ID NO: 189081 - DNA, 75 bp, Artificial Sequence
  Synthetic
ttatcaagagccatttaaaaacctaaaaacaggaaaatatgcaaaaaggaagtctgctcacactaatgatgtaaa

SEQ ID NO: 189082 - DNA, 75 bp, Artificial Sequence
  Synthetic
atgcagagaggcaattttaaaggagctaaaagaactgttaaatgtttcaactgtggcaaggaagggcacatagcc

SEQ ID NO: 189083 - DNA, 75 bp, Artificial Sequence
  Synthetic
ggaggcttaataggattaagaatagtttttgctgtgcttgctataataaatagagttaggcagggatactcacct

SEQ ID NO: 189084 - DNA, 75 bp, Artificial Sequence
  Synthetic
tcttaacgcttgcctgggacgacctgcggaacctgtgcctcttctgctaccgccgattgagagacttgctattga

SEQ ID NO: 189085 - DNA, 75 bp, Artificial Sequence
  Synthetic
aaggccttaagtactttgggaatctcctggtatattgggtgcaggaactaaaaactagtgctatcactttgttta

SEQ ID NO: 189086 - DNA, 75 bp, Artificial Sequence
  Synthetic
tttattataacatgggtggcaagtggtcaaaacgtagtatagtgggatggtctgaaattagggaaagaatgagac

SEQ ID NO: 189087 - DNA, 75 bp, Artificial Sequence
  Synthetic
gtcaaaacgtagtatagtgggatggtctgaaattagggaaagaatgagacgagcccctccagcagcaacagaggg

SEQ ID NO: 189088 - DNA, 75 bp, Artificial Sequence
  Synthetic
cctcttcagctaccaccgcttgagagacttactcttgattgcaacgaggattgtggaacttctgggacgcagggg

SEQ ID NO: 189089 - DNA, 75 bp, Artificial Sequence
  Synthetic
gagaaaaaataagacaaactcctgtagcagcagaaggagtaggagcagtatctcgagatttagagaaacatggag

SEQ ID NO: 189090 - DNA, 75 bp, Artificial Sequence
  Synthetic
agtagcaaaagaaatagtagctagctgtgataaatgtcagctaaaaggggaagccatgcatggacaagtagactg

SEQ ID NO: 189091 - DNA, 75 bp, Artificial Sequence
  Synthetic
cctatcccagtgggagatatctatagaagatggataatcctgggattaaataaaatagtaagaatgtatagccct

SEQ ID NO: 189092 - DNA, 75 bp, Artificial Sequence
  Synthetic
ttttagatgggatagataaggctcaagaagaacatgaaaaatatcacaacaattggagagcaatggctagtgatt

SEQ ID NO: 189093 - DNA, 75 bp, Artificial Sequence
  Synthetic
acaaaaatcttagagccctttagggcacaaaatccagaaatagtcatctatcaatatatggatgacttgtatgta

SEQ ID NO: 189094 - DNA, 75 bp, Artificial Sequence
  Synthetic
aaactgacagaggatagatggaacaagccccagaagaccaagggccacagagggagccatacaatgaatggacac

SEQ ID NO: 189095 - DNA, 75 bp, Artificial Sequence
  Synthetic
caggaatggatggaccaaaggttaaacaatggccattgacagaagaaaaaataaaagcattaacagaaatttgta

SEQ ID NO: 189096 - DNA, 75 bp, Artificial Sequence
  Synthetic
ccacactaatgatgtaaaacaattaacagaagcagtgcaaaaaatagccacagaaagcatagtaatatggggaaa

SEQ ID NO: 189097 - DNA, 75 bp, Artificial Sequence
  Synthetic
ataatcagcttatgggatgaaagcctaaaaccatgtgtacagttaacccctctctgtgttactttaaactgtact

SEQ ID NO: 189098 - DNA, 75 bp, Artificial Sequence
  Synthetic
catcaaaagaattaatagcagaagtacagaaacaagggctagaccagtggacatatcaaatatatcaagagccat

SEQ ID NO: 189099 - DNA, 75 bp, Artificial Sequence
  Synthetic
tttggatgggatatgagctccatcctgacaagtggacagtccagcctatagagctgccagaaaaggaaagctgga

SEQ ID NO: 189100 - DNA, 75 bp, Artificial Sequence
  Synthetic
ataaggataggaccaggacaagcattctatgcaacaaatggcataataggagacataagagaagcacattgtaac

SEQ ID NO: 189101 - DNA, 75 bp, Artificial Sequence
  Synthetic
aattacaacacctacttttaattgtgcaggagaatttttctattgttatacaacaaacctgtttaatagtacctg

SEQ ID NO: 189102 - DNA, 75 bp, Artificial Sequence
  Synthetic
ctattacactcccatgcagaaaatacaaattataataatgtggcagcggacaggacaagcaatgtatgcccctcc

SEQ ID NO: 189103 - DNA, 75 bp, Artificial Sequence
  Synthetic
taggaccaggacaagtattctatagaacaggagacataataggagatataagacaagcatattgtgagattaatg

SEQ ID NO: 189104 - DNA, 75 bp, Artificial Sequence
  Synthetic
aattgctctttcaatgcaaccacagaactaagagataagaaacagaaagtgcatgcacttttttataaacttgat

SEQ ID NO: 189105 - DNA, 75 bp, Artificial Sequence
  Synthetic
ggtttacctgtcataagtaccagcacataaagaaattaaaagaaatgaacaagtaaataaattagtaagtagtag

SEQ ID NO: 189106 - DNA, 75 bp, Artificial Sequence
  Synthetic
taactgaaacaacaaatcagaagactgaattacaagcaattcaactagctttgcaggattcaggattagaagtaa

SEQ ID NO: 189107 - DNA, 75 bp, Artificial Sequence
  Synthetic
gtaacaacatattggggtctgcatacaggagaaagagaatggcatttgggtcagggggtctccatagaatggagg

SEQ ID NO: 189108 - DNA, 75 bp, Artificial Sequence
  Synthetic
taacatggggggcaagtggtcaaaaagtagcatagtaggatggcctgagattagggaaagaataagaagaactcc

SEQ ID NO: 189109 - DNA, 75 bp, Artificial Sequence
  Synthetic
agtagcatagtaggatggcctgagattagggaaagaataagaagaactcctccagcagcaggagcagaagcagcg

SEQ ID NO: 189110 - DNA, 75 bp, Artificial Sequence
  Synthetic
ctaaaaccataatagtacagctgagcaaatctgtagaaattacttgtgtaagacccaacaacaatacaagaaaaa

SEQ ID NO: 189111 - DNA, 75 bp, Artificial Sequence
  Synthetic
taaaacaccatatgtatatctcaaagaaggctaatagataagtctacagacatcattatgaaagccatcatccaa

SEQ ID NO: 189112 - DNA, 75 bp, Artificial Sequence
  Synthetic
taggacaacatatctataacacctatggggatacttgggaaggagttgaagctataataagaatgttgcaacaac

SEQ ID NO: 189113 - DNA, 75 bp, Artificial Sequence
  Synthetic
catcattatgaaagccatcatccaaaagtaagttcagaagtacacatcccactagaggaagctagattagtaata

SEQ ID NO: 189114 - DNA, 75 bp, Artificial Sequence
  Synthetic
tgctattgtaaaagtgctgcttcatgcagttgtttcataaaaaaaggcttaggcatcttctatggcaggaagaag

SEQ ID NO: 189115 - DNA, 75 bp, Artificial Sequence
  Synthetic
aatggtactagcaacaatactaaggattgggaaaagatgaaggagggagaaataaaaaactgttctttcaatgcc

SEQ ID NO: 189116 - DNA, 75 bp, Artificial Sequence
  Synthetic
caaggaaaagtataaggataggaccaggacaaacattctatgcacatggacaaataataggaaacataagagaag

SEQ ID NO: 189117 - DNA, 75 bp, Artificial Sequence
  Synthetic
tttcctaggccgtggctccatgaattaggacaacatatctataacacctatggggatacttgggaaggagttgaa

SEQ ID NO: 189118 - DNA, 75 bp, Artificial Sequence
  Synthetic
ccaattcccatacattattgtgccccggctggttttgcgattctaaagtgtaatgataagaagttcaatggaaca

SEQ ID NO: 189119 - DNA, 75 bp, Artificial Sequence
  Synthetic
acagcagtaagagccatcaagatcctataccagagcagtaagtataattaatttgcttatgtgatgcaacctttg

SEQ ID NO: 189120 - DNA, 75 bp, Artificial Sequence
  Synthetic
cagagaggaccatacaatgaataggcactacagattctagaagaactcaagcaggaagctgttagacactttcct

SEQ ID NO: 189121 - DNA, 75 bp, Artificial Sequence
  Synthetic
agcgaaagttaatagggactcgaaagcgaaagttccagagaagttctctcgacgcaggactcggcttgctgagtg

SEQ ID NO: 189122 - DNA, 75 bp, Artificial Sequence
  Synthetic
cgaggaccttctcacagcagtaaggatcatcaaaatcttataccaaagcagtaagtattaagtatatgtaatgtc

SEQ ID NO: 189123 - DNA, 75 bp, Artificial Sequence
  Synthetic
taggcatctcctatggcaggaagaagcggagacagcgacgaggacctcctccgagcaataaggatcatcaaaatc

SEQ ID NO: 189124 - DNA, 75 bp, Artificial Sequence
  Synthetic
tactgctactaataccactagtacaaccaatagtacaatagagggaggagaaatgaaaaactgctctttcaatat

SEQ ID NO: 189125 - DNA, 75 bp, Artificial Sequence
  Synthetic
gctttcagacaaaaggcttaggcatttcctatggcaagaagaagcggcgacagcgacgaagcgctcctctgcgca

SEQ ID NO: 189126 - DNA, 75 bp, Artificial Sequence
  Synthetic
tagttgtgtggactatagtaggcatagaatataagagaatactagaccaaaggaaaatagacaggttaattctaa

SEQ ID NO: 189127 - DNA, 75 bp, Artificial Sequence
  Synthetic
aatagcgcaattatcatactcccatgcataatacaactcatcataaacaggtggcaggaagtaggaaaagcaatg

SEQ ID NO: 189128 - DNA, 75 bp, Artificial Sequence
  Synthetic
catagcaatagcagtagctgaaggaacagataggattatagaagtagtacaaagaatttgtagagctatccgcaa

SEQ ID NO: 189129 - DNA, 75 bp, Artificial Sequence
  Synthetic
agcactactcttagcaataattgtgtagatcctagcatatctaaaatatagaaaattagtaaaacaaaaaaaatt

SEQ ID NO: 189130 - DNA, 75 bp, Artificial Sequence
  Synthetic
gaaaaactgcactttcaatataaccacagaaatacgagataagaggaagcaagaatacgcgcttttctatagact

SEQ ID NO: 189131 - DNA, 75 bp, Artificial Sequence
  Synthetic
gaaaattagtaaaacaaaaaaaattagactagttaattaaaagaattaaagaaagagcagaagacagtggcaatg

SEQ ID NO: 189132 - DNA, 75 bp, Artificial Sequence
  Synthetic
tacaatgcacacatggaattaagccagtagtaacaactcaactactgttaaatggcagcctagcagaagaagaag

SEQ ID NO: 189133 - DNA, 75 bp, Artificial Sequence
  Synthetic
cacagtagaaatggaagatgcaagaaattgttcttttaatataaccacagtactaagagataagaaaaagaaagt

SEQ ID NO: 189134 - DNA, 75 bp, Artificial Sequence
  Synthetic
acaagtggtgccaataccacaagtgccccaattgtcaaagaagaaatgaaaaactgctctttcaatactaccaca

SEQ ID NO: 189135 - DNA, 75 bp, Artificial Sequence
  Synthetic
aagaagaagtatacatctagggccaggacaagctttctatgcaacaggtgagatagtaggggatataaggcaagc

SEQ ID NO: 189136 - DNA, 75 bp, Artificial Sequence
  Synthetic
accatagacagcattgtaaaaagagaaataaaaaattgctctttcaatatgaccacagaaataatagataaaaaa

SEQ ID NO: 189137 - DNA, 75 bp, Artificial Sequence
  Synthetic
agttcaatggaacagggctatgcaaaaatgtcagttctttacaaagtacacatggaattaagccactagtatcaa

SEQ ID NO: 189138 - DNA, 75 bp, Artificial Sequence
  Synthetic
gcctgtaaatattacttgtatcagacctaataacaatacaagaaaaagtatacatataggaccaggacaagcctt

SEQ ID NO: 189139 - DNA, 75 bp, Artificial Sequence
  Synthetic
aaaaagtgtacgtataggaccaggacaagtattttatgcaatgggtgacataataggggatataagaaaagcata

SEQ ID NO: 189140 - DNA, 75 bp, Artificial Sequence
  Synthetic
aaattaagagaacattggaacagaacaataatcttcaatagctcctcaggaggggattagatattagtaacgcac

SEQ ID NO: 189141 - DNA, 75 bp, Artificial Sequence
  Synthetic
gtacaagacccaacaataataccagaacaagtgtaaagataagaccaagacaaacattctatgcaacagaagaca

SEQ ID NO: 189142 - DNA, 75 bp, Artificial Sequence
  Synthetic
caataatcttcaatagctcctcaggaggggattagatattagtaacgcacagttttaattgtggaggggaatttt

SEQ ID NO: 189143 - DNA, 75 bp, Artificial Sequence
  Synthetic
gtgggcaagtttgtggagttggtttgacatatcaaattggctgtggtatataagaatattcataatgatagtagg

SEQ ID NO: 189144 - DNA, 75 bp, Artificial Sequence
  Synthetic
tgcaagaaacataacatgtagatcaaatatcacaggactactattgacacataatagaagagtaagtaataagac

SEQ ID NO: 189145 - DNA, 75 bp, Artificial Sequence
  Synthetic
gccagaaaaagacagctggactgtcaatgatatacagaagttagtgggaaaattaaactgggcaagtcagattta

SEQ ID NO: 189146 - DNA, 75 bp, Artificial Sequence
  Synthetic
tttgctgtactttctatagtaaatagagttagccaggggtactcaccattgtcggttacagacccgctttcccag

SEQ ID NO: 189147 - DNA, 75 bp, Artificial Sequence
  Synthetic
taaaaaagaaaaaatcagtaacagtactagatgtgggagatgcatatttttcagttcctttagatgaagacttta

SEQ ID NO: 189148 - DNA, 75 bp, Artificial Sequence
  Synthetic
attagaaaagtaaattatataaatataaagtagtagagattaagccattagaagtaacacccactgaggcaaaaa

SEQ ID NO: 189149 - DNA, 75 bp, Artificial Sequence
  Synthetic
aatacaaggaaaagtatacctataggaccagggagagcattttatacaacaggagacataataggagatataaga

SEQ ID NO: 189150 - DNA, 75 bp, Artificial Sequence
  Synthetic
gtgctgttagcttgctcaataccatagctatagcagtagctgaggggacagataggattatagaaatagtacaaa

SEQ ID NO: 189151 - DNA, 75 bp, Artificial Sequence
  Synthetic
aagacagggaacccttaacttccctcaaatcactctttggcagcgaccccttgtctcaataaaagtagggggcca

SEQ ID NO: 189152 - DNA, 75 bp, Artificial Sequence
  Synthetic
gggtgggaggctctcaaatatctgtggaatctaacacagtattggggccaggagctgaagaggagtgctattagt

SEQ ID NO: 189153 - DNA, 75 bp, Artificial Sequence
  Synthetic
cgcagaaccagcaggaaaagaatgaacaagacttattggcattagacaagtgggcaagtctgtggaattggtttg

SEQ ID NO: 189154 - DNA, 75 bp, Artificial Sequence
  Synthetic
gaaagggctttgctataagatgggtggcaagtggtcaaaatgcagtctgggtggatggcctagggtaagggaaag

SEQ ID NO: 189155 - DNA, 75 bp, Artificial Sequence
  Synthetic
acacaaatttaagataaaatgacctaggtacagtaagataaaaaaattgacaattacacaaacataatatacaag

SEQ ID NO: 189156 - DNA, 75 bp, Artificial Sequence
  Synthetic
aagaacagaataaaaaagatttattagcattagacagttagaacaatctgtagaattagtttgacatatcaaatt

SEQ ID NO: 189157 - DNA, 75 bp, Artificial Sequence
  Synthetic
gagataagggaaagaataagaagaactcccccagcagcaagtggagtaggagcagcatctaaagatctagaaaaa

SEQ ID NO: 189158 - DNA, 75 bp, Artificial Sequence
  Synthetic
attaagcgggggacaattagatagatgggaaaaaattcggttaaggccagggggaaagaaaaaatatagattaaa

SEQ ID NO: 189159 - DNA, 75 bp, Artificial Sequence
  Synthetic
gcgaaagtaagaccagagaagttctctcgacgcaggactcggcttgctgaagtgcacacggcaagaggcgagagc

SEQ ID NO: 189160 - DNA, 75 bp, Artificial Sequence
  Synthetic
gagcctgtgcctcttcagctaccaccgattaaaagacttcatattaattgcagcgagagtagtagaacttctaag

SEQ ID NO: 189161 - DNA, 75 bp, Artificial Sequence
  Synthetic
atggaatagataaggctcaagaagagcatgaaagatatcacagcaattggagagcaatggctagtgagtttaatc

SEQ ID NO: 189162 - DNA, 75 bp, Artificial Sequence
  Synthetic
cacatacctagaagaatcagacagggcttagaaagggctttgctataacatggggggcaagtggtcaaaaagtag

SEQ ID NO: 189163 - DNA, 75 bp, Artificial Sequence
  Synthetic
ccataaagcaagagttttggctgaagcaatgagccaagtaacaaattcagctaccataatgatgcagagaggcaa

SEQ ID NO: 189164 - DNA, 75 bp, Artificial Sequence
  Synthetic
tgtggaaaggaaggacaccaaatgaaagattgtactgagagacaggctaattttttagggaagatctggccttcc

SEQ ID NO: 189165 - DNA, 75 bp, Artificial Sequence
  Synthetic
cagtagcaaccctctattgtgtacatcaaaggatagaggtaaaagacaccaaggaagctttagataaaatagagg

SEQ ID NO: 189166 - DNA, 75 bp, Artificial Sequence
  Synthetic
tcaaaggatagaggtaaaagacaccaaggaagctttagataaaatagaggaaatacaaaataagagcaagcaaaa

SEQ ID NO: 189167 - DNA, 75 bp, Artificial Sequence
  Synthetic
agctgagccagcagcagaaagagtaagaccagcatctaaaaatttagacaagcatagagcacttacaaacagcaa

SEQ ID NO: 189168 - DNA, 75 bp, Artificial Sequence
  Synthetic
ggtgggaagtcctcaaatattggtggaatctcctgcagtattggagtcaggaactaaagaatagtgctgttagct

SEQ ID NO: 189169 - DNA, 75 bp, Artificial Sequence
  Synthetic
ctcgacgcaggactcggcttgctgaagtgcactcggcaagaggcgaggggggcgactggtgagtacgccaaattt

SEQ ID NO: 189170 - DNA, 75 bp, Artificial Sequence
  Synthetic
catcccgcagggttaaaaaagaaaaaatcagtaacagtactggatgtgggtgatgcatatttttcagttccctta

SEQ ID NO: 189171 - DNA, 75 bp, Artificial Sequence
  Synthetic
actatgacagcaatcatccaagaataagctcagaagtacacatcccactaggggatgctgtattagtagtgacaa

SEQ ID NO: 189172 - DNA, 75 bp, Artificial Sequence
  Synthetic
ggaaaggtcagtcaaaattatcctatagtacagaatctccaagggcaaatggtacaccaggccctatcaccaaga

SEQ ID NO: 189173 - DNA, 75 bp, Artificial Sequence
  Synthetic
ccttcaggaacaaatagcatggatgacaagtaacccacctattccagtgggagacatctataaaagatggataat

SEQ ID NO: 189174 - DNA, 75 bp, Artificial Sequence
  Synthetic
gacgagcgactccttacggcagtaagaatcatcaagatcctataccaaagcagtaagtatacttaaatagtcctg

SEQ ID NO: 189175 - DNA, 75 bp, Artificial Sequence
  Synthetic
gaatcatcaagatcctataccaaagcagtaagtatacttaaatagtcctgtaatgcaagctttagaaatagtaag

SEQ ID NO: 189176 - DNA, 75 bp, Artificial Sequence
  Synthetic
ttagtttccctcaaatcactctttggcaacgacctcttgtcacagtaaaaataggaggacagctaaaagaagctc

SEQ ID NO: 189177 - DNA, 75 bp, Artificial Sequence
  Synthetic
ggactgatagtagtgctaatcttagcaatagtagtgtggactatagtagctatagaaattaagaaaatactaaag

SEQ ID NO: 189178 - DNA, 75 bp, Artificial Sequence
  Synthetic
aggggacacagaggaattggcaaggcttgtggagatggggcctcatgatcttgggaatggcaatgatttgtagtg

SEQ ID NO: 189179 - DNA, 75 bp, Artificial Sequence
  Synthetic
aggccggggaatttccttcagagcagaccagagccaacagcccccctccagccaacagccccaccagcagagagc

SEQ ID NO: 189180 - DNA, 75 bp, Artificial Sequence
  Synthetic
aaaattagtagatttcagagaacttaataaaagaactcaagatttttgggaagttcaattaggaataccacatcc

SEQ ID NO: 189181 - DNA, 75 bp, Artificial Sequence
  Synthetic
tgttcaaggtcaaatgatactgatccccgtaataatagaacaattgaggacagcatgaagggagaaataaaaaat

SEQ ID NO: 189182 - DNA, 75 bp, Artificial Sequence
  Synthetic
tgtaacagaaaattttaacatgtggaaaaataacatggtagaacagatgcatgaggatataatcagtttatggga

SEQ ID NO: 189183 - DNA, 75 bp, Artificial Sequence
  Synthetic
taatcataccactatcaatgacaacatgaaaggggaactaaaaaattgttctttcaatgtgactacagcaataaa

SEQ ID NO: 189184 - DNA, 75 bp, Artificial Sequence
  Synthetic
cttaggcatttcctatggcaggaagaagcggagacagcgacgaagcactcctccacgcagtgaggaccatcaaaa

SEQ ID NO: 189185 - DNA, 75 bp, Artificial Sequence
  Synthetic
caacaataatacaagaaaaagtgtaaggataggaccaggacaagcattctatgcaacaggggacataataggaaa

SEQ ID NO: 189186 - DNA, 75 bp, Artificial Sequence
  Synthetic
acttaatagcagaaatacagaaacaaggacaagaccaatggacatatcaaatttatcaagagccatttaaaaatc

SEQ ID NO: 189187 - DNA, 75 bp, Artificial Sequence
  Synthetic
gctgcacaactaagaaaacacctgaacaagagcagctcaatattcaaaccatcctcaggaggggacatagaagtt

SEQ ID NO: 189188 - DNA, 75 bp, Artificial Sequence
  Synthetic
ccaatagtactattacactgccatgcagaataaagcaaattgtaaacatgtggcagagaacaggacgagcaatgt

SEQ ID NO: 189189 - DNA, 75 bp, Artificial Sequence
  Synthetic
aattgctctttcaatgcaaccacagaaataagagataagaaacggaaagtgaatgcacttttttataaacttgat

SEQ ID NO: 189190 - DNA, 75 bp, Artificial Sequence
  Synthetic
tagactgtagtccagggatatggcaattagattgtacacatttagaaggaaaagttatcatagtagcagtccatg

SEQ ID NO: 189191 - DNA, 75 bp, Artificial Sequence
  Synthetic
ggaaaaatcatctgcaccactgctgtgccttggaactctagttggagtaataaatcttatgaggaaatttggaac

SEQ ID NO: 189192 - DNA, 75 bp, Artificial Sequence
  Synthetic
aagatttgttagcattggacaagtgggcaagcctgtggaattggtttgacatatcaaattggctatggtatataa

SEQ ID NO: 189193 - DNA, 75 bp, Artificial Sequence
  Synthetic
aatttgaagaatggtactaaaatcattgggaaatcaataagaggagaaataaaaaactgctctttcaatgtcacc

SEQ ID NO: 189194 - DNA, 75 bp, Artificial Sequence
  Synthetic
aatttcacgaacaatgctaaaaccataatagtacagctgaatgaaactgtagtaattaattgtacaagacccaac

SEQ ID NO: 189195 - DNA, 75 bp, Artificial Sequence
  Synthetic
ggacagatagggttatagaagtagcacaaagagcttggagagccattctccacatacctagaagaatcagacagg

SEQ ID NO: 189196 - DNA, 75 bp, Artificial Sequence
  Synthetic
caatgctaaaatcataatagtacagctgaatgaaactgtagaaattaattgtacaagacccaacaacaatacaag

SEQ ID NO: 189197 - DNA, 75 bp, Artificial Sequence
  Synthetic
gtacaagacccaacaacaatacaagaaaagggataactctaggaccagggagagtattttatacaacaggaaaaa

SEQ ID NO: 189198 - DNA, 75 bp, Artificial Sequence
  Synthetic
cattagtagaaccaaaaaagataaaaccacctctgcctagtgttagaaaattaacagaagatagatggaacaaac

SEQ ID NO: 189199 - DNA, 75 bp, Artificial Sequence
  Synthetic
ctcgacgcaggactcggcttgctgagcgcgcacagcaagaggcgaggggcggcggctggtgagtacgccaaattt

SEQ ID NO: 189200 - DNA, 75 bp, Artificial Sequence
  Synthetic
aaaaaagagaaagccacctctgcctagtgttagaaaattagtagaggatagatggaacaagccccagaagaccag

SEQ ID NO: 189201 - DNA, 75 bp, Artificial Sequence
  Synthetic
agtgttagaaaattagtagaggatagatggaacaagccccagaagaccaggggccgcagagggaaccatacaatg

SEQ ID NO: 189202 - DNA, 75 bp, Artificial Sequence
  Synthetic
aaatctgtggagttggtttgacatatcaaattggttgtggtatataaaaatattcataatgatagtaggaggctt

SEQ ID NO: 189203 - DNA, 75 bp, Artificial Sequence
  Synthetic
ctttttaaagaagggcttaggcatttcctatggcaggaagaagcggagacaacgacgaacagctcctcctggcaa

SEQ ID NO: 189204 - DNA, 75 bp, Artificial Sequence
  Synthetic
tacctagaagaataagacagggctttgaagcagctttgctataaaatggggggcaagtggtcaaaaagcagtata

SEQ ID NO: 189205 - DNA, 75 bp, Artificial Sequence
  Synthetic
aacgacgaacagctcctcctggcaataagaatcatcaagatcttgtacaagagcagtaagtaaaaccaattatat

SEQ ID NO: 189206 - DNA, 75 bp, Artificial Sequence
  Synthetic
aagccccagaagaccaggggccgcagagggaaccatacaatgaatgggcactagagcttttagaggaactcaagc

SEQ ID NO: 189207 - DNA, 75 bp, Artificial Sequence
  Synthetic
ctcccagccccgaggggacccgacaggcccgaaggaatcgaagaagaaggtggagagagagacagagacagatcc

SEQ ID NO: 189208 - DNA, 75 bp, Artificial Sequence
  Synthetic
ggatcatcaaaatcctataccaaagcagtaagtattagaaaatagtatatgtaatgttggctctgcagatctgtg

SEQ ID NO: 189209 - DNA, 75 bp, Artificial Sequence
  Synthetic
tggtaaggcaaaagaaaatagataggataattgatagaataggagagagagcagaagatagtggtaatgagagtg

SEQ ID NO: 189210 - DNA, 75 bp, Artificial Sequence
  Synthetic
ttatgggatgaaagcctaaagccatgtataaaattaaccccactctgtgttactttaaattgcactgatttgaat

SEQ ID NO: 189211 - DNA, 75 bp, Artificial Sequence
  Synthetic
ccttaagtatctgggaagtcttgtgcagtattggggtctggagctaaaaaagagtgctattagtctgcttgatac

SEQ ID NO: 189212 - DNA, 75 bp, Artificial Sequence
  Synthetic
tctattatggggtccctgtgtggaaagaggcaaagaccactttattttgcgcatctaatgctaaagcatatagta

SEQ ID NO: 189213 - DNA, 75 bp, Artificial Sequence
  Synthetic
gctctttcaatatcaccacaagcataggaactaaggtaaaggactatgcacttttttataaacttgatgtggtac

SEQ ID NO: 189214 - DNA, 75 bp, Artificial Sequence
  Synthetic
gaagaatgatatggtagaacagatgcaggaggatataatcagtgtatgggatgaaagcttaaagccatgtgtaaa

SEQ ID NO: 189215 - DNA, 75 bp, Artificial Sequence
  Synthetic
cgagctgagccagcagcagaaggggtgggagcagcatctcgagacctggaaaaacgtggagcaatcacaagtagc

SEQ ID NO: 189216 - DNA, 75 bp, Artificial Sequence
  Synthetic
gtgcctggctagaagcacaagaggaggaggaggtgggttttccagtcagacctcaggtacctttaagaccaatga

SEQ ID NO: 189217 - DNA, 75 bp, Artificial Sequence
  Synthetic
tactgttagtgagatgaaagagtgtcatttcaatataactggaggaggtaggaggaagaaagaatatgcgctttt

SEQ ID NO: 189218 - DNA, 75 bp, Artificial Sequence
  Synthetic
cataccgatgtaatcagtctatgggaccaaagcctaaaaccatgtgtagaactaacccctctctgcgtcacttta

SEQ ID NO: 189219 - DNA, 75 bp, Artificial Sequence
  Synthetic
tcataatagtgcagctaaaagaatctgtagaaattaattgtacaagacccagcaacaatacaaggaaaagtatgt

SEQ ID NO: 189220 - DNA, 75 bp, Artificial Sequence
  Synthetic
aaataataaaacagctacaaccagctcttaagacaggaacagaggaacttaaatcattattcaacacagtagcaa

SEQ ID NO: 189221 - DNA, 75 bp, Artificial Sequence
  Synthetic
tgtactaactacattaatgacacaacgggagaaacaaaagattgctctttcaatatgaccacagaactaagagat

SEQ ID NO: 189222 - DNA, 75 bp, Artificial Sequence
  Synthetic
acagcagaaggagagatagcaattagatcggaaaatatcacaaataatgccaaaaccatactagtacagttagtt

SEQ ID NO: 189223 - DNA, 75 bp, Artificial Sequence
  Synthetic
tgtcagacctgccaacaatacaagaaaaggtatacacacgggaccaggacaagtgctctatgcaacaggggcagt

SEQ ID NO: 189224 - DNA, 75 bp, Artificial Sequence
  Synthetic
gggacataagacaagcacattgtaatgtcagcagaacaaagtggaatgaaactttaagccaggtggctaaacaat

SEQ ID NO: 189225 - DNA, 75 bp, Artificial Sequence
  Synthetic
ttcaataataaggaagaaatgaaaaattgctctttcaatataaccacagaactaagagataagacaaagaaagaa

SEQ ID NO: 189226 - DNA, 75 bp, Artificial Sequence
  Synthetic
aataatctttgctaatcactcaggaggggatgtagaaattacaacaccatattttatttgtggaagggaattttt

SEQ ID NO: 189227 - DNA, 75 bp, Artificial Sequence
  Synthetic
acaatagaatttcaaccagcaagcgcaggggacctagaaattatgacacatacttttaattgtggaggagaattc

SEQ ID NO: 189228 - DNA, 75 bp, Artificial Sequence
  Synthetic
aattcctatacattattgtgctccagctggttatgcgattctaaagtgtaataataagacattcagtggaacagg

SEQ ID NO: 189229 - DNA, 75 bp, Artificial Sequence
  Synthetic
tgtggcagagagtaggacaagcaatgtatgcccctcccatcccaggagaaataaggtgtagatcaaacattacag

SEQ ID NO: 189230 - DNA, 75 bp, Artificial Sequence
  Synthetic
gctattgacacgtgatgggggatatacaaataatactaatggaacagagattttcacacctacaggaagaaatat

SEQ ID NO: 189231 - DNA, 75 bp, Artificial Sequence
  Synthetic
gaaaaagtataaggataggaccagggcaaacattctatgcaacaggagacataacaggagatataagacaagcac

SEQ ID NO: 189232 - DNA, 75 bp, Artificial Sequence
  Synthetic
tcaaatcactctttggcaacgaccccttgtcacaataaaagtagggggccagataaaagaggctctcttagacac

SEQ ID NO: 189233 - DNA, 75 bp, Artificial Sequence
  Synthetic
aggagcagatgatacagtattagaagaaataaatttgccaggaaaatggaaaccaaaaatgatagggggaattgg

SEQ ID NO: 189234 - DNA, 75 bp, Artificial Sequence
  Synthetic
ataaatcttataatgagatttgggaaaacatgacctggagggactgggagagggaaattgacaagtatacagaca

SEQ ID NO: 189235 - DNA, 75 bp, Artificial Sequence
  Synthetic
cctgagtgggagtttgttaatacccctcccctagtaaaattatggtaccagctggaaaaagaacccatagcagga

SEQ ID NO: 189236 - DNA, 75 bp, Artificial Sequence
  Synthetic
aaaagcagggtatgttactgacagaggaaggcagaaaattgtttctctaagtgaaacaacaaatcagaaggctga

SEQ ID NO: 189237 - DNA, 75 bp, Artificial Sequence
  Synthetic
gaacggattcttagcacttgcctgggaagacctacggaacctgtgccttttcagctgccaccgattgagagactt

SEQ ID NO: 189238 - DNA, 75 bp, Artificial Sequence
  Synthetic
tctatggcatactggggctagaactaaagaatagtgcttttaatttgcttgatatattagcaatagcagtagtaa

SEQ ID NO: 189239 - DNA, 75 bp, Artificial Sequence
  Synthetic
aagaatagtgctattagtttgctcgataccatagcaataacagtagctgaagcaacagataggatcatagaaata

SEQ ID NO: 189240 - DNA, 75 bp, Artificial Sequence
  Synthetic
gtggagttggtttaacataacaaattggctgtggtatataagaatattcataatgatagtaggaggcttaatagg

SEQ ID NO: 189241 - DNA, 75 bp, Artificial Sequence
  Synthetic
gcacaaagagcctttagggcgattcttcacatacctgtaagaataagacagggttttgaaagggctttgctataa

SEQ ID NO: 189242 - DNA, 75 bp, Artificial Sequence
  Synthetic
atagtggggtggccagaaattagggaaagaataagacgtgcagcgccaggacgtgctcctccagcagcaccagga

SEQ ID NO: 189243 - DNA, 75 bp, Artificial Sequence
  Synthetic
atctctcgacgcaggactcggcttgctgaaggtgcacacagcaagaggcgagagcggcgcactggtgagtacgcc

SEQ ID NO: 189244 - DNA, 75 bp, Artificial Sequence
  Synthetic
gatgggtgcgagagcgtcaatattacgagggaaaaaattagatacgtgggagggaattcggctaaggccaggggg

SEQ ID NO: 189245 - DNA, 75 bp, Artificial Sequence
  Synthetic
gaagaactgagccagcagcagagggagtaggagcagcgtctcaagacttagataaacatggggcaattacaagca

SEQ ID NO: 189246 - DNA, 75 bp, Artificial Sequence
  Synthetic
gccagaaaaagacagctggactgtcaatgacatacagaagttagtaggaaaattaaattgggcaagtcagattta

SEQ ID NO: 189247 - DNA, 75 bp, Artificial Sequence
  Synthetic
gaggaaggagatgtaggctttccagtcagacctcaggtacctttaagaccaatgacttataagggagcattcgat

SEQ ID NO: 189248 - DNA, 75 bp, Artificial Sequence
  Synthetic
caatcaactctcaggacaggatcagaagaactcaaatcattatataatacactagcaaccctttggtgtgtacat

SEQ ID NO: 189249 - DNA, 75 bp, Artificial Sequence
  Synthetic
gagctggacagatttgcacttaaccctgaccttctagaaacatcaaaaggctgtcaacaaatattagtacagctc

SEQ ID NO: 189250 - DNA, 75 bp, Artificial Sequence
  Synthetic
gagctggacagatttgcacttaaccctgtccttctagaaacatcaaaaggctgtcaacaaatattagtacagctc

SEQ ID NO: 189251 - DNA, 75 bp, Artificial Sequence
  Synthetic
gagctggacagatttgcacttaaccctgcccttctagaaacatcaaaaggctgtcaacaaatattagtacagctc

SEQ ID NO: 189252 - DNA, 75 bp, Artificial Sequence
  Synthetic
gagctggacagatttgcacttaaccctggccttctagaaacatcaaaaggctgtcaacaaatattagtacagctc

SEQ ID NO: 189253 - DNA, 75 bp, Artificial Sequence
  Synthetic
catggatgacaggcaacccacctatcccagtaggggaaatttataaaagatggataattctgggattaaataaaa

SEQ ID NO: 189254 - DNA, 75 bp, Artificial Sequence
  Synthetic
catggatgacaggcaacccacctatcccagtaggggaaatttataaaagttggataattctgggattaaataaaa

SEQ ID NO: 189255 - DNA, 75 bp, Artificial Sequence
  Synthetic
catggatgacaggcaacccacctatcccagtaggggaaatttataaaagctggataattctgggattaaataaaa

SEQ ID NO: 189256 - DNA, 75 bp, Artificial Sequence
  Synthetic
catggatgacaggcaacccacctatcccagtaggggaaatttataaaaggtggataattctgggattaaataaaa

SEQ ID NO: 189257 - DNA, 75 bp, Artificial Sequence
  Synthetic
atgtcagggagtggggggacccggccataaagcaagagttttggctgaggcaatgagccaagcaacaaattcagc

SEQ ID NO: 189258 - DNA, 75 bp, Artificial Sequence
  Synthetic
agtacaatgtacacatggaattagaccagtagtatcaactcaactgctgttaaatggcagtctagcagaagaaga

SEQ ID NO: 189259 - DNA, 75 bp, Artificial Sequence
  Synthetic
ccagtagtatcaactcaactgctgttaaatggcagtctagcagaagaagaggtagtaattagatctgaaaatttc

SEQ ID NO: 189260 - DNA, 75 bp, Artificial Sequence
  Synthetic
tggtcataaagcaagagttttggcagaagcaatgagccaaatgaccaatacagcaaacataatgatgcaaaaggg

SEQ ID NO: 189261 - DNA, 75 bp, Artificial Sequence
  Synthetic
tggtcataaagcaagagttttggcagaagcaatgagccaaatgaccaatacagcaaacataatgatgcaaatggg

SEQ ID NO: 189262 - DNA, 75 bp, Artificial Sequence
  Synthetic
tggtcataaagcaagagttttggcagaagcaatgagccaaatgaccaatacagcaaacataatgatgcaaacggg

SEQ ID NO: 189263 - DNA, 75 bp, Artificial Sequence
  Synthetic
tggtcataaagcaagagttttggcagaagcaatgagccaaatgaccaatacagcaaacataatgatgcaaagggg

SEQ ID NO: 189264 - DNA, 75 bp, Artificial Sequence
  Synthetic
tggtcataaagcaagagttttggctgaagcaatgagccaaatgaccaatacagcaaacataatgatgcaaaaggg

SEQ ID NO: 189265 - DNA, 75 bp, Artificial Sequence
  Synthetic
tggtcataaagcaagagttttggctgaagcaatgagccaaatgaccaatacagcaaacataatgatgcaaatggg

SEQ ID NO: 189266 - DNA, 75 bp, Artificial Sequence
  Synthetic
tggtcataaagcaagagttttggctgaagcaatgagccaaatgaccaatacagcaaacataatgatgcaaacggg

SEQ ID NO: 189267 - DNA, 75 bp, Artificial Sequence
  Synthetic
tggtcataaagcaagagttttggctgaagcaatgagccaaatgaccaatacagcaaacataatgatgcaaagggg

SEQ ID NO: 189268 - DNA, 75 bp, Artificial Sequence
  Synthetic
tggtcataaagcaagagttttggccgaagcaatgagccaaatgaccaatacagcaaacataatgatgcaaaaggg

SEQ ID NO: 189269 - DNA, 75 bp, Artificial Sequence
  Synthetic
tggtcataaagcaagagttttggccgaagcaatgagccaaatgaccaatacagcaaacataatgatgcaaatggg

SEQ ID NO: 189270 - DNA, 75 bp, Artificial Sequence
  Synthetic
tggtcataaagcaagagttttggccgaagcaatgagccaaatgaccaatacagcaaacataatgatgcaaacggg

SEQ ID NO: 189271 - DNA, 75 bp, Artificial Sequence
  Synthetic
tggtcataaagcaagagttttggccgaagcaatgagccaaatgaccaatacagcaaacataatgatgcaaagggg

SEQ ID NO: 189272 - DNA, 75 bp, Artificial Sequence
  Synthetic
tggtcataaagcaagagttttggcggaagcaatgagccaaatgaccaatacagcaaacataatgatgcaaaaggg

SEQ ID NO: 189273 - DNA, 75 bp, Artificial Sequence
  Synthetic
tggtcataaagcaagagttttggcggaagcaatgagccaaatgaccaatacagcaaacataatgatgcaaatggg

SEQ ID NO: 189274 - DNA, 75 bp, Artificial Sequence
  Synthetic
tggtcataaagcaagagttttggcggaagcaatgagccaaatgaccaatacagcaaacataatgatgcaaacggg

SEQ ID NO: 189275 - DNA, 75 bp, Artificial Sequence
  Synthetic
tggtcataaagcaagagttttggcggaagcaatgagccaaatgaccaatacagcaaacataatgatgcaaagggg

SEQ ID NO: 189276 - DNA, 75 bp, Artificial Sequence
  Synthetic
taaaaacatattggggtttgcagacaggagaaagagagtggcatctgggtcatggagtctccatagaatggagat

SEQ ID NO: 189277 - DNA, 75 bp, Artificial Sequence
  Synthetic
cgtgtaacaagtgttattgtaaaaagtgttgctatcattgtcaatgttgcttcataaacaagggcttaggcatct

SEQ ID NO: 189278 - DNA, 75 bp, Artificial Sequence
  Synthetic
gggccacacatgcctgtgtacccacagaccccaacccacaagaagtagtattggaaaatgtgacagaaaatttta

SEQ ID NO: 189279 - DNA, 75 bp, Artificial Sequence
  Synthetic
tgtaatgaatgatttaatagtagtaagcatagtagcattaatagtagcctttattatagcagtagttgtgtggac

SEQ ID NO: 189280 - DNA, 75 bp, Artificial Sequence
  Synthetic
gtggtagtggtggcatggggggaaaaatgatggaggtaggagaaataaaaaactgctctttcaacatcaccacaa

SEQ ID NO: 189281 - DNA, 75 bp, Artificial Sequence
  Synthetic
aagggctgttggaaatgtggaaaagaaggacaccaaatgaaagattgtactgaaaggcaggctaattttttaggg

SEQ ID NO: 189282 - DNA, 75 bp, Artificial Sequence
  Synthetic
ctaccacagggatggaaaggatcaccagcaatattccagtgtagcatgacaaaaatattagaacctttcagaaca

SEQ ID NO: 189283 - DNA, 75 bp, Artificial Sequence
  Synthetic
gcatacagatataatcagtctatgggatcaaagcctaaaaccatgtgtaagtttaacccctctctgcattaccct

SEQ ID NO: 189284 - DNA, 75 bp, Artificial Sequence
  Synthetic
tgctcttataatatgaccacagaattaagagataggagacggagagtatactcaattttctataaacttgatata

SEQ ID NO: 189285 - DNA, 75 bp, Artificial Sequence
  Synthetic
aacaatacaagaaaaagtatacgtataggaccaggacaagcattctatgcaacaggtgaaataataggggagata

SEQ ID NO: 189286 - DNA, 75 bp, Artificial Sequence
  Synthetic
gtacaaatgttaccagaaatagtaatgttaccgtcaataataccatgaaggaagaaataagaaattgctctttca

SEQ ID NO: 189287 - DNA, 75 bp, Artificial Sequence
  Synthetic
tttaataaaacaataatctttcaaccaccctcaggaggagatctagaaattacaatgcatcattttaattgtaga

SEQ ID NO: 189288 - DNA, 75 bp, Artificial Sequence
  Synthetic
aatcagcaaactgaactgcaagccattttattagctttacaggattcaggggtagaagcaaacatagtaacagat

SEQ ID NO: 189289 - DNA, 75 bp, Artificial Sequence
  Synthetic
aatcagcaaactgaactgcaagccattttattagctttacaggattcaggggtagaagcaaacatagttacagat

SEQ ID NO: 189290 - DNA, 75 bp, Artificial Sequence
  Synthetic
aatcagcaaactgaactgcaagccattttattagctttacaggattcaggggtagaagcaaacatagtcacagat

SEQ ID NO: 189291 - DNA, 75 bp, Artificial Sequence
  Synthetic
aatcagcaaactgaactgcaagccattttattagctttacaggattcaggggtagaagcaaacatagtgacagat

SEQ ID NO: 189292 - DNA, 75 bp, Artificial Sequence
  Synthetic
aatcagcaaactgatctgcaagccattttattagctttacaggattcaggggtagaagcaaacatagtaacagat

SEQ ID NO: 189293 - DNA, 75 bp, Artificial Sequence
  Synthetic
aatcagcaaactgatctgcaagccattttattagctttacaggattcaggggtagaagcaaacatagttacagat

SEQ ID NO: 189294 - DNA, 75 bp, Artificial Sequence
  Synthetic
aatcagcaaactgatctgcaagccattttattagctttacaggattcaggggtagaagcaaacatagtcacagat

SEQ ID NO: 189295 - DNA, 75 bp, Artificial Sequence
  Synthetic
aatcagcaaactgatctgcaagccattttattagctttacaggattcaggggtagaagcaaacatagtgacagat

SEQ ID NO: 189296 - DNA, 75 bp, Artificial Sequence
  Synthetic
aatcagcaaactgacctgcaagccattttattagctttacaggattcaggggtagaagcaaacatagtaacagat

SEQ ID NO: 189297 - DNA, 75 bp, Artificial Sequence
  Synthetic
aatcagcaaactgacctgcaagccattttattagctttacaggattcaggggtagaagcaaacatagttacagat

SEQ ID NO: 189298 - DNA, 75 bp, Artificial Sequence
  Synthetic
aatcagcaaactgacctgcaagccattttattagctttacaggattcaggggtagaagcaaacatagtcacagat

SEQ ID NO: 189299 - DNA, 75 bp, Artificial Sequence
  Synthetic
aatcagcaaactgacctgcaagccattttattagctttacaggattcaggggtagaagcaaacatagtgacagat

SEQ ID NO: 189300 - DNA, 75 bp, Artificial Sequence
  Synthetic
aatcagcaaactgagctgcaagccattttattagctttacaggattcaggggtagaagcaaacatagtaacagat

SEQ ID NO: 189301 - DNA, 75 bp, Artificial Sequence
  Synthetic
aatcagcaaactgagctgcaagccattttattagctttacaggattcaggggtagaagcaaacatagttacagat

SEQ ID NO: 189302 - DNA, 75 bp, Artificial Sequence
  Synthetic
aatcagcaaactgagctgcaagccattttattagctttacaggattcaggggtagaagcaaacatagtcacagat

SEQ ID NO: 189303 - DNA, 75 bp, Artificial Sequence
  Synthetic
aatcagcaaactgagctgcaagccattttattagctttacaggattcaggggtagaagcaaacatagtgacagat

SEQ ID NO: 189304 - DNA, 75 bp, Artificial Sequence
  Synthetic
aatcagcatactgaactgcaagccattttattagctttacaggattcaggggtagaagcaaacatagtaacagat

SEQ ID NO: 189305 - DNA, 75 bp, Artificial Sequence
  Synthetic
aatcagcatactgaactgcaagccattttattagctttacaggattcaggggtagaagcaaacatagttacagat

SEQ ID NO: 189306 - DNA, 75 bp, Artificial Sequence
  Synthetic
aatcagcatactgaactgcaagccattttattagctttacaggattcaggggtagaagcaaacatagtcacagat

SEQ ID NO: 189307 - DNA, 75 bp, Artificial Sequence
  Synthetic
aatcagcatactgaactgcaagccattttattagctttacaggattcaggggtagaagcaaacatagtgacagat

SEQ ID NO: 189308 - DNA, 75 bp, Artificial Sequence
  Synthetic
aatcagcatactgatctgcaagccattttattagctttacaggattcaggggtagaagcaaacatagtaacagat

SEQ ID NO: 189309 - DNA, 75 bp, Artificial Sequence
  Synthetic
aatcagcatactgatctgcaagccattttattagctttacaggattcaggggtagaagcaaacatagttacagat

SEQ ID NO: 189310 - DNA, 75 bp, Artificial Sequence
  Synthetic
aatcagcatactgatctgcaagccattttattagctttacaggattcaggggtagaagcaaacatagtcacagat

SEQ ID NO: 189311 - DNA, 75 bp, Artificial Sequence
  Synthetic
aatcagcatactgatctgcaagccattttattagctttacaggattcaggggtagaagcaaacatagtgacagat

SEQ ID NO: 189312 - DNA, 75 bp, Artificial Sequence
  Synthetic
aatcagcatactgacctgcaagccattttattagctttacaggattcaggggtagaagcaaacatagtaacagat

SEQ ID NO: 189313 - DNA, 75 bp, Artificial Sequence
  Synthetic
aatcagcatactgacctgcaagccattttattagctttacaggattcaggggtagaagcaaacatagttacagat

SEQ ID NO: 189314 - DNA, 75 bp, Artificial Sequence
  Synthetic
aatcagcatactgacctgcaagccattttattagctttacaggattcaggggtagaagcaaacatagtcacagat

SEQ ID NO: 189315 - DNA, 75 bp, Artificial Sequence
  Synthetic
aatcagcatactgacctgcaagccattttattagctttacaggattcaggggtagaagcaaacatagtgacagat

SEQ ID NO: 189316 - DNA, 75 bp, Artificial Sequence
  Synthetic
aatcagcatactgagctgcaagccattttattagctttacaggattcaggggtagaagcaaacatagtaacagat

SEQ ID NO: 189317 - DNA, 75 bp, Artificial Sequence
  Synthetic
aatcagcatactgagctgcaagccattttattagctttacaggattcaggggtagaagcaaacatagttacagat

SEQ ID NO: 189318 - DNA, 75 bp, Artificial Sequence
  Synthetic
aatcagcatactgagctgcaagccattttattagctttacaggattcaggggtagaagcaaacatagtcacagat

SEQ ID NO: 189319 - DNA, 75 bp, Artificial Sequence
  Synthetic
aatcagcatactgagctgcaagccattttattagctttacaggattcaggggtagaagcaaacatagtgacagat

SEQ ID NO: 189320 - DNA, 75 bp, Artificial Sequence
  Synthetic
aatcagcacactgaactgcaagccattttattagctttacaggattcaggggtagaagcaaacatagtaacagat

SEQ ID NO: 189321 - DNA, 75 bp, Artificial Sequence
  Synthetic
aatcagcacactgaactgcaagccattttattagctttacaggattcaggggtagaagcaaacatagttacagat

SEQ ID NO: 189322 - DNA, 75 bp, Artificial Sequence
  Synthetic
aatcagcacactgaactgcaagccattttattagctttacaggattcaggggtagaagcaaacatagtcacagat

SEQ ID NO: 189323 - DNA, 75 bp, Artificial Sequence
  Synthetic
aatcagcacactgaactgcaagccattttattagctttacaggattcaggggtagaagcaaacatagtgacagat

SEQ ID NO: 189324 - DNA, 75 bp, Artificial Sequence
  Synthetic
aatcagcacactgatctgcaagccattttattagctttacaggattcaggggtagaagcaaacatagtaacagat

SEQ ID NO: 189325 - DNA, 75 bp, Artificial Sequence
  Synthetic
aatcagcacactgatctgcaagccattttattagctttacaggattcaggggtagaagcaaacatagttacagat

SEQ ID NO: 189326 - DNA, 75 bp, Artificial Sequence
  Synthetic
aatcagcacactgatctgcaagccattttattagctttacaggattcaggggtagaagcaaacatagtcacagat

SEQ ID NO: 189327 - DNA, 75 bp, Artificial Sequence
  Synthetic
aatcagcacactgatctgcaagccattttattagctttacaggattcaggggtagaagcaaacatagtgacagat

SEQ ID NO: 189328 - DNA, 75 bp, Artificial Sequence
  Synthetic
aatcagcacactgacctgcaagccattttattagctttacaggattcaggggtagaagcaaacatagtaacagat

SEQ ID NO: 189329 - DNA, 75 bp, Artificial Sequence
  Synthetic
aatcagcacactgacctgcaagccattttattagctttacaggattcaggggtagaagcaaacatagttacagat

SEQ ID NO: 189330 - DNA, 75 bp, Artificial Sequence
  Synthetic
aatcagcacactgacctgcaagccattttattagctttacaggattcaggggtagaagcaaacatagtcacagat

SEQ ID NO: 189331 - DNA, 75 bp, Artificial Sequence
  Synthetic
aatcagcacactgacctgcaagccattttattagctttacaggattcaggggtagaagcaaacatagtgacagat

SEQ ID NO: 189332 - DNA, 75 bp, Artificial Sequence
  Synthetic
aatcagcacactgagctgcaagccattttattagctttacaggattcaggggtagaagcaaacatagtaacagat

SEQ ID NO: 189333 - DNA, 75 bp, Artificial Sequence
  Synthetic
aatcagcacactgagctgcaagccattttattagctttacaggattcaggggtagaagcaaacatagttacagat

SEQ ID NO: 189334 - DNA, 75 bp, Artificial Sequence
  Synthetic
aatcagcacactgagctgcaagccattttattagctttacaggattcaggggtagaagcaaacatagtcacagat

SEQ ID NO: 189335 - DNA, 75 bp, Artificial Sequence
  Synthetic
aatcagcacactgagctgcaagccattttattagctttacaggattcaggggtagaagcaaacatagtgacagat

SEQ ID NO: 189336 - DNA, 75 bp, Artificial Sequence
  Synthetic
aatcagcagactgaactgcaagccattttattagctttacaggattcaggggtagaagcaaacatagtaacagat

SEQ ID NO: 189337 - DNA, 75 bp, Artificial Sequence
  Synthetic
aatcagcagactgaactgcaagccattttattagctttacaggattcaggggtagaagcaaacatagttacagat

SEQ ID NO: 189338 - DNA, 75 bp, Artificial Sequence
  Synthetic
aatcagcagactgaactgcaagccattttattagctttacaggattcaggggtagaagcaaacatagtcacagat

SEQ ID NO: 189339 - DNA, 75 bp, Artificial Sequence
  Synthetic
aatcagcagactgaactgcaagccattttattagctttacaggattcaggggtagaagcaaacatagtgacagat

SEQ ID NO: 189340 - DNA, 75 bp, Artificial Sequence
  Synthetic
aatcagcagactgatctgcaagccattttattagctttacaggattcaggggtagaagcaaacatagtaacagat

SEQ ID NO: 189341 - DNA, 75 bp, Artificial Sequence
  Synthetic
aatcagcagactgatctgcaagccattttattagctttacaggattcaggggtagaagcaaacatagttacagat

SEQ ID NO: 189342 - DNA, 75 bp, Artificial Sequence
  Synthetic
aatcagcagactgatctgcaagccattttattagctttacaggattcaggggtagaagcaaacatagtcacagat

SEQ ID NO: 189343 - DNA, 75 bp, Artificial Sequence
  Synthetic
aatcagcagactgatctgcaagccattttattagctttacaggattcaggggtagaagcaaacatagtgacagat

SEQ ID NO: 189344 - DNA, 75 bp, Artificial Sequence
  Synthetic
aatcagcagactgacctgcaagccattttattagctttacaggattcaggggtagaagcaaacatagtaacagat

SEQ ID NO: 189345 - DNA, 75 bp, Artificial Sequence
  Synthetic
aatcagcagactgacctgcaagccattttattagctttacaggattcaggggtagaagcaaacatagttacagat

SEQ ID NO: 189346 - DNA, 75 bp, Artificial Sequence
  Synthetic
aatcagcagactgacctgcaagccattttattagctttacaggattcaggggtagaagcaaacatagtcacagat

SEQ ID NO: 189347 - DNA, 75 bp, Artificial Sequence
  Synthetic
aatcagcagactgacctgcaagccattttattagctttacaggattcaggggtagaagcaaacatagtgacagat

SEQ ID NO: 189348 - DNA, 75 bp, Artificial Sequence
  Synthetic
aatcagcagactgagctgcaagccattttattagctttacaggattcaggggtagaagcaaacatagtaacagat

SEQ ID NO: 189349 - DNA, 75 bp, Artificial Sequence
  Synthetic
aatcagcagactgagctgcaagccattttattagctttacaggattcaggggtagaagcaaacatagttacagat

SEQ ID NO: 189350 - DNA, 75 bp, Artificial Sequence
  Synthetic
aatcagcagactgagctgcaagccattttattagctttacaggattcaggggtagaagcaaacatagtcacagat

SEQ ID NO: 189351 - DNA, 75 bp, Artificial Sequence
  Synthetic
aatcagcagactgagctgcaagccattttattagctttacaggattcaggggtagaagcaaacatagtgacagat

SEQ ID NO: 189352 - DNA, 75 bp, Artificial Sequence
  Synthetic
gggtctggaactaaaaaagagtgctattagtttgcttgataccatagcaatagcagtagctgagggaacagatag

SEQ ID NO: 189353 - DNA, 75 bp, Artificial Sequence
  Synthetic
tggagggaaaatgatgaaggaaggagaaatgaaaaactgctctttcaatatcaccacaagcacaagagataggaa

SEQ ID NO: 189354 - DNA, 75 bp, Artificial Sequence
  Synthetic
tggagggaaaatgatgaaggaaggagaaatgaaaaactgctctttcaatatcaccacaagcacaagagataggat

SEQ ID NO: 189355 - DNA, 75 bp, Artificial Sequence
  Synthetic
tggagggaaaatgatgaaggaaggagaaatgaaaaactgctctttcaatatcaccacaagcacaagagataggac

SEQ ID NO: 189356 - DNA, 75 bp, Artificial Sequence
  Synthetic
tggagggaaaatgatgaaggaaggagaaatgaaaaactgctctttcaatatcaccacaagcacaagagataggag

SEQ ID NO: 189357 - DNA, 75 bp, Artificial Sequence
  Synthetic
tggagggaaaatgatgaaggatggagaaatgaaaaactgctctttcaatatcaccacaagcacaagagataggaa

SEQ ID NO: 189358 - DNA, 75 bp, Artificial Sequence
  Synthetic
tggagggaaaatgatgaaggatggagaaatgaaaaactgctctttcaatatcaccacaagcacaagagataggat

SEQ ID NO: 189359 - DNA, 75 bp, Artificial Sequence
  Synthetic
tggagggaaaatgatgaaggatggagaaatgaaaaactgctctttcaatatcaccacaagcacaagagataggac

SEQ ID NO: 189360 - DNA, 75 bp, Artificial Sequence
  Synthetic
tggagggaaaatgatgaaggatggagaaatgaaaaactgctctttcaatatcaccacaagcacaagagataggag

SEQ ID NO: 189361 - DNA, 75 bp, Artificial Sequence
  Synthetic
tggagggaaaatgatgaaggacggagaaatgaaaaactgctctttcaatatcaccacaagcacaagagataggaa

SEQ ID NO: 189362 - DNA, 75 bp, Artificial Sequence
  Synthetic
tggagggaaaatgatgaaggacggagaaatgaaaaactgctctttcaatatcaccacaagcacaagagataggat

SEQ ID NO: 189363 - DNA, 75 bp, Artificial Sequence
  Synthetic
tggagggaaaatgatgaaggacggagaaatgaaaaactgctctttcaatatcaccacaagcacaagagataggac

SEQ ID NO: 189364 - DNA, 75 bp, Artificial Sequence
  Synthetic
tggagggaaaatgatgaaggacggagaaatgaaaaactgctctttcaatatcaccacaagcacaagagataggag

SEQ ID NO: 189365 - DNA, 75 bp, Artificial Sequence
  Synthetic
tggagggaaaatgatgaaggagggagaaatgaaaaactgctctttcaatatcaccacaagcacaagagataggaa

SEQ ID NO: 189366 - DNA, 75 bp, Artificial Sequence
  Synthetic
tggagggaaaatgatgaaggagggagaaatgaaaaactgctctttcaatatcaccacaagcacaagagataggat

SEQ ID NO: 189367 - DNA, 75 bp, Artificial Sequence
  Synthetic
tggagggaaaatgatgaaggagggagaaatgaaaaactgctctttcaatatcaccacaagcacaagagataggac

SEQ ID NO: 189368 - DNA, 75 bp, Artificial Sequence
  Synthetic
tggagggaaaatgatgaaggagggagaaatgaaaaactgctctttcaatatcaccacaagcacaagagataggag

SEQ ID NO: 189369 - DNA, 75 bp, Artificial Sequence
  Synthetic
tggagggtaaatgatgaaggaaggagaaatgaaaaactgctctttcaatatcaccacaagcacaagagataggaa

SEQ ID NO: 189370 - DNA, 75 bp, Artificial Sequence
  Synthetic
tggagggtaaatgatgaaggaaggagaaatgaaaaactgctctttcaatatcaccacaagcacaagagataggat

SEQ ID NO: 189371 - DNA, 75 bp, Artificial Sequence
  Synthetic
tggagggtaaatgatgaaggaaggagaaatgaaaaactgctctttcaatatcaccacaagcacaagagataggac

SEQ ID NO: 189372 - DNA, 75 bp, Artificial Sequence
  Synthetic
tggagggtaaatgatgaaggaaggagaaatgaaaaactgctctttcaatatcaccacaagcacaagagataggag

SEQ ID NO: 189373 - DNA, 75 bp, Artificial Sequence
  Synthetic
tggagggtaaatgatgaaggatggagaaatgaaaaactgctctttcaatatcaccacaagcacaagagataggaa

SEQ ID NO: 189374 - DNA, 75 bp, Artificial Sequence
  Synthetic
tggagggtaaatgatgaaggatggagaaatgaaaaactgctctttcaatatcaccacaagcacaagagataggat

SEQ ID NO: 189375 - DNA, 75 bp, Artificial Sequence
  Synthetic
tggagggtaaatgatgaaggatggagaaatgaaaaactgctctttcaatatcaccacaagcacaagagataggac

SEQ ID NO: 189376 - DNA, 75 bp, Artificial Sequence
  Synthetic
tggagggtaaatgatgaaggatggagaaatgaaaaactgctctttcaatatcaccacaagcacaagagataggag

SEQ ID NO: 189377 - DNA, 75 bp, Artificial Sequence
  Synthetic
tggagggtaaatgatgaaggacggagaaatgaaaaactgctctttcaatatcaccacaagcacaagagataggaa

SEQ ID NO: 189378 - DNA, 75 bp, Artificial Sequence
  Synthetic
tggagggtaaatgatgaaggacggagaaatgaaaaactgctctttcaatatcaccacaagcacaagagataggat

SEQ ID NO: 189379 - DNA, 75 bp, Artificial Sequence
  Synthetic
tggagggtaaatgatgaaggacggagaaatgaaaaactgctctttcaatatcaccacaagcacaagagataggac

SEQ ID NO: 189380 - DNA, 75 bp, Artificial Sequence
  Synthetic
tggagggtaaatgatgaaggacggagaaatgaaaaactgctctttcaatatcaccacaagcacaagagataggag

SEQ ID NO: 189381 - DNA, 75 bp, Artificial Sequence
  Synthetic
tggagggtaaatgatgaaggagggagaaatgaaaaactgctctttcaatatcaccacaagcacaagagataggaa

SEQ ID NO: 189382 - DNA, 75 bp, Artificial Sequence
  Synthetic
tggagggtaaatgatgaaggagggagaaatgaaaaactgctctttcaatatcaccacaagcacaagagataggat

SEQ ID NO: 189383 - DNA, 75 bp, Artificial Sequence
  Synthetic
tggagggtaaatgatgaaggagggagaaatgaaaaactgctctttcaatatcaccacaagcacaagagataggac

SEQ ID NO: 189384 - DNA, 75 bp, Artificial Sequence
  Synthetic
tggagggtaaatgatgaaggagggagaaatgaaaaactgctctttcaatatcaccacaagcacaagagataggag

SEQ ID NO: 189385 - DNA, 75 bp, Artificial Sequence
  Synthetic
tggagggcaaatgatgaaggaaggagaaatgaaaaactgctctttcaatatcaccacaagcacaagagataggaa

SEQ ID NO: 189386 - DNA, 75 bp, Artificial Sequence
  Synthetic
tggagggcaaatgatgaaggaaggagaaatgaaaaactgctctttcaatatcaccacaagcacaagagataggat

SEQ ID NO: 189387 - DNA, 75 bp, Artificial Sequence
  Synthetic
tggagggcaaatgatgaaggaaggagaaatgaaaaactgctctttcaatatcaccacaagcacaagagataggac

SEQ ID NO: 189388 - DNA, 75 bp, Artificial Sequence
  Synthetic
tggagggcaaatgatgaaggaaggagaaatgaaaaactgctctttcaatatcaccacaagcacaagagataggag

SEQ ID NO: 189389 - DNA, 75 bp, Artificial Sequence
  Synthetic
tggagggcaaatgatgaaggatggagaaatgaaaaactgctctttcaatatcaccacaagcacaagagataggaa

SEQ ID NO: 189390 - DNA, 75 bp, Artificial Sequence
  Synthetic
tggagggcaaatgatgaaggatggagaaatgaaaaactgctctttcaatatcaccacaagcacaagagataggat

SEQ ID NO: 189391 - DNA, 75 bp, Artificial Sequence
  Synthetic
tggagggcaaatgatgaaggatggagaaatgaaaaactgctctttcaatatcaccacaagcacaagagataggac

SEQ ID NO: 189392 - DNA, 75 bp, Artificial Sequence
  Synthetic
tggagggcaaatgatgaaggatggagaaatgaaaaactgctctttcaatatcaccacaagcacaagagataggag

SEQ ID NO: 189393 - DNA, 75 bp, Artificial Sequence
  Synthetic
tggagggcaaatgatgaaggacggagaaatgaaaaactgctctttcaatatcaccacaagcacaagagataggaa

SEQ ID NO: 189394 - DNA, 75 bp, Artificial Sequence
  Synthetic
tggagggcaaatgatgaaggacggagaaatgaaaaactgctctttcaatatcaccacaagcacaagagataggat

SEQ ID NO: 189395 - DNA, 75 bp, Artificial Sequence
  Synthetic
tggagggcaaatgatgaaggacggagaaatgaaaaactgctctttcaatatcaccacaagcacaagagataggac

SEQ ID NO: 189396 - DNA, 75 bp, Artificial Sequence
  Synthetic
tggagggcaaatgatgaaggacggagaaatgaaaaactgctctttcaatatcaccacaagcacaagagataggag

SEQ ID NO: 189397 - DNA, 75 bp, Artificial Sequence
  Synthetic
tggagggcaaatgatgaaggagggagaaatgaaaaactgctctttcaatatcaccacaagcacaagagataggaa

SEQ ID NO: 189398 - DNA, 75 bp, Artificial Sequence
  Synthetic
tggagggcaaatgatgaaggagggagaaatgaaaaactgctctttcaatatcaccacaagcacaagagataggat

SEQ ID NO: 189399 - DNA, 75 bp, Artificial Sequence
  Synthetic
tggagggcaaatgatgaaggagggagaaatgaaaaactgctctttcaatatcaccacaagcacaagagataggac

SEQ ID NO: 189400 - DNA, 75 bp, Artificial Sequence
  Synthetic
tggagggcaaatgatgaaggagggagaaatgaaaaactgctctttcaatatcaccacaagcacaagagataggag

SEQ ID NO: 189401 - DNA, 75 bp, Artificial Sequence
  Synthetic
tggaggggaaatgatgaaggaaggagaaatgaaaaactgctctttcaatatcaccacaagcacaagagataggaa

SEQ ID NO: 189402 - DNA, 75 bp, Artificial Sequence
  Synthetic
tggaggggaaatgatgaaggaaggagaaatgaaaaactgctctttcaatatcaccacaagcacaagagataggat

SEQ ID NO: 189403 - DNA, 75 bp, Artificial Sequence
  Synthetic
tggaggggaaatgatgaaggaaggagaaatgaaaaactgctctttcaatatcaccacaagcacaagagataggac

SEQ ID NO: 189404 - DNA, 75 bp, Artificial Sequence
  Synthetic
tggaggggaaatgatgaaggaaggagaaatgaaaaactgctctttcaatatcaccacaagcacaagagataggag

SEQ ID NO: 189405 - DNA, 75 bp, Artificial Sequence
  Synthetic
tggaggggaaatgatgaaggatggagaaatgaaaaactgctctttcaatatcaccacaagcacaagagataggaa

SEQ ID NO: 189406 - DNA, 75 bp, Artificial Sequence
  Synthetic
tggaggggaaatgatgaaggatggagaaatgaaaaactgctctttcaatatcaccacaagcacaagagataggat

SEQ ID NO: 189407 - DNA, 75 bp, Artificial Sequence
  Synthetic
tggaggggaaatgatgaaggatggagaaatgaaaaactgctctttcaatatcaccacaagcacaagagataggac

SEQ ID NO: 189408 - DNA, 75 bp, Artificial Sequence
  Synthetic
tggaggggaaatgatgaaggatggagaaatgaaaaactgctctttcaatatcaccacaagcacaagagataggag

SEQ ID NO: 189409 - DNA, 75 bp, Artificial Sequence
  Synthetic
tggaggggaaatgatgaaggacggagaaatgaaaaactgctctttcaatatcaccacaagcacaagagataggaa

SEQ ID NO: 189410 - DNA, 75 bp, Artificial Sequence
  Synthetic
tggaggggaaatgatgaaggacggagaaatgaaaaactgctctttcaatatcaccacaagcacaagagataggat

SEQ ID NO: 189411 - DNA, 75 bp, Artificial Sequence
  Synthetic
tggaggggaaatgatgaaggacggagaaatgaaaaactgctctttcaatatcaccacaagcacaagagataggac

SEQ ID NO: 189412 - DNA, 75 bp, Artificial Sequence
  Synthetic
tggaggggaaatgatgaaggacggagaaatgaaaaactgctctttcaatatcaccacaagcacaagagataggag

SEQ ID NO: 189413 - DNA, 75 bp, Artificial Sequence
  Synthetic
tggaggggaaatgatgaaggagggagaaatgaaaaactgctctttcaatatcaccacaagcacaagagataggaa

SEQ ID NO: 189414 - DNA, 75 bp, Artificial Sequence
  Synthetic
tggaggggaaatgatgaaggagggagaaatgaaaaactgctctttcaatatcaccacaagcacaagagataggat

SEQ ID NO: 189415 - DNA, 75 bp, Artificial Sequence
  Synthetic
tggaggggaaatgatgaaggagggagaaatgaaaaactgctctttcaatatcaccacaagcacaagagataggac

SEQ ID NO: 189416 - DNA, 75 bp, Artificial Sequence
  Synthetic
tggaggggaaatgatgaaggagggagaaatgaaaaactgctctttcaatatcaccacaagcacaagagataggag

SEQ ID NO: 189417 - DNA, 75 bp, Artificial Sequence
  Synthetic
gtgctgttagcttgcttaatgccacagccatagcagtagctgaggggacagatagggttatagaagtagtacaaa

SEQ ID NO: 189418 - DNA, 75 bp, Artificial Sequence
  Synthetic
agccatagcagtagctgaggggacagatagggttatagaagtagtacaaagagcttatagggctattctccacat

SEQ ID NO: 189419 - DNA, 75 bp, Artificial Sequence
  Synthetic
tgtggcaggtagacaggatgaggattaatacatggaaaagattagtaaagtatcaaatccatatttcaaagaaag

SEQ ID NO: 189420 - DNA, 75 bp, Artificial Sequence
  Synthetic
tgtggcaggtagacaggatgaggattaatacatggaaaagattagtaaagtatcaaatccatttttcaaagaaag

SEQ ID NO: 189421 - DNA, 75 bp, Artificial Sequence
  Synthetic
tgtggcaggtagacaggatgaggattaatacatggaaaagattagtaaagtatcaaatccatctttcaaagaaag

SEQ ID NO: 189422 - DNA, 75 bp, Artificial Sequence
  Synthetic
tgtggcaggtagacaggatgaggattaatacatggaaaagattagtaaagtatcaaatccatgtttcaaagaaag

SEQ ID NO: 189423 - DNA, 75 bp, Artificial Sequence
  Synthetic
tgtggcaggtagacaggatgaggattaatacatggaaaagattagtaaagtatcatatccatatttcaaagaaag

SEQ ID NO: 189424 - DNA, 75 bp, Artificial Sequence
  Synthetic
tgtggcaggtagacaggatgaggattaatacatggaaaagattagtaaagtatcatatccatttttcaaagaaag

SEQ ID NO: 189425 - DNA, 75 bp, Artificial Sequence
  Synthetic
tgtggcaggtagacaggatgaggattaatacatggaaaagattagtaaagtatcatatccatctttcaaagaaag

SEQ ID NO: 189426 - DNA, 75 bp, Artificial Sequence
  Synthetic
tgtggcaggtagacaggatgaggattaatacatggaaaagattagtaaagtatcatatccatgtttcaaagaaag

SEQ ID NO: 189427 - DNA, 75 bp, Artificial Sequence
  Synthetic
tgtggcaggtagacaggatgaggattaatacatggaaaagattagtaaagtatcacatccatatttcaaagaaag

SEQ ID NO: 189428 - DNA, 75 bp, Artificial Sequence
  Synthetic
tgtggcaggtagacaggatgaggattaatacatggaaaagattagtaaagtatcacatccatttttcaaagaaag

SEQ ID NO: 189429 - DNA, 75 bp, Artificial Sequence
  Synthetic
tgtggcaggtagacaggatgaggattaatacatggaaaagattagtaaagtatcacatccatctttcaaagaaag

SEQ ID NO: 189430 - DNA, 75 bp, Artificial Sequence
  Synthetic
tgtggcaggtagacaggatgaggattaatacatggaaaagattagtaaagtatcacatccatgtttcaaagaaag

SEQ ID NO: 189431 - DNA, 75 bp, Artificial Sequence
  Synthetic
tgtggcaggtagacaggatgaggattaatacatggaaaagattagtaaagtatcagatccatatttcaaagaaag

SEQ ID NO: 189432 - DNA, 75 bp, Artificial Sequence
  Synthetic
tgtggcaggtagacaggatgaggattaatacatggaaaagattagtaaagtatcagatccatttttcaaagaaag

SEQ ID NO: 189433 - DNA, 75 bp, Artificial Sequence
  Synthetic
tgtggcaggtagacaggatgaggattaatacatggaaaagattagtaaagtatcagatccatctttcaaagaaag

SEQ ID NO: 189434 - DNA, 75 bp, Artificial Sequence
  Synthetic
tgtggcaggtagacaggatgaggattaatacatggaaaagattagtaaagtatcagatccatgtttcaaagaaag

SEQ ID NO: 189435 - DNA, 75 bp, Artificial Sequence
  Synthetic
tgtggcaggtagacaggatgaggattaatacatggaaaagtttagtaaagtatcaaatccatatttcaaagaaag

SEQ ID NO: 189436 - DNA, 75 bp, Artificial Sequence
  Synthetic
tgtggcaggtagacaggatgaggattaatacatggaaaagtttagtaaagtatcaaatccatttttcaaagaaag

SEQ ID NO: 189437 - DNA, 75 bp, Artificial Sequence
  Synthetic
tgtggcaggtagacaggatgaggattaatacatggaaaagtttagtaaagtatcaaatccatctttcaaagaaag

SEQ ID NO: 189438 - DNA, 75 bp, Artificial Sequence
  Synthetic
tgtggcaggtagacaggatgaggattaatacatggaaaagtttagtaaagtatcaaatccatgtttcaaagaaag

SEQ ID NO: 189439 - DNA, 75 bp, Artificial Sequence
  Synthetic
tgtggcaggtagacaggatgaggattaatacatggaaaagtttagtaaagtatcatatccatatttcaaagaaag

SEQ ID NO: 189440 - DNA, 75 bp, Artificial Sequence
  Synthetic
tgtggcaggtagacaggatgaggattaatacatggaaaagtttagtaaagtatcatatccatttttcaaagaaag

SEQ ID NO: 189441 - DNA, 75 bp, Artificial Sequence
  Synthetic
tgtggcaggtagacaggatgaggattaatacatggaaaagtttagtaaagtatcatatccatctttcaaagaaag

SEQ ID NO: 189442 - DNA, 75 bp, Artificial Sequence
  Synthetic
tgtggcaggtagacaggatgaggattaatacatggaaaagtttagtaaagtatcatatccatgtttcaaagaaag

SEQ ID NO: 189443 - DNA, 75 bp, Artificial Sequence
  Synthetic
tgtggcaggtagacaggatgaggattaatacatggaaaagtttagtaaagtatcacatccatatttcaaagaaag

SEQ ID NO: 189444 - DNA, 75 bp, Artificial Sequence
  Synthetic
tgtggcaggtagacaggatgaggattaatacatggaaaagtttagtaaagtatcacatccatttttcaaagaaag

SEQ ID NO: 189445 - DNA, 75 bp, Artificial Sequence
  Synthetic
tgtggcaggtagacaggatgaggattaatacatggaaaagtttagtaaagtatcacatccatctttcaaagaaag

SEQ ID NO: 189446 - DNA, 75 bp, Artificial Sequence
  Synthetic
tgtggcaggtagacaggatgaggattaatacatggaaaagtttagtaaagtatcacatccatgtttcaaagaaag

SEQ ID NO: 189447 - DNA, 75 bp, Artificial Sequence
  Synthetic
tgtggcaggtagacaggatgaggattaatacatggaaaagtttagtaaagtatcagatccatatttcaaagaaag

SEQ ID NO: 189448 - DNA, 75 bp, Artificial Sequence
  Synthetic
tgtggcaggtagacaggatgaggattaatacatggaaaagtttagtaaagtatcagatccatttttcaaagaaag

SEQ ID NO: 189449 - DNA, 75 bp, Artificial Sequence
  Synthetic
tgtggcaggtagacaggatgaggattaatacatggaaaagtttagtaaagtatcagatccatctttcaaagaaag

SEQ ID NO: 189450 - DNA, 75 bp, Artificial Sequence
  Synthetic
tgtggcaggtagacaggatgaggattaatacatggaaaagtttagtaaagtatcagatccatgtttcaaagaaag

SEQ ID NO: 189451 - DNA, 75 bp, Artificial Sequence
  Synthetic
tgtggcaggtagacaggatgaggattaatacatggaaaagcttagtaaagtatcaaatccatatttcaaagaaag

SEQ ID NO: 189452 - DNA, 75 bp, Artificial Sequence
  Synthetic
tgtggcaggtagacaggatgaggattaatacatggaaaagcttagtaaagtatcaaatccatttttcaaagaaag

SEQ ID NO: 189453 - DNA, 75 bp, Artificial Sequence
  Synthetic
tgtggcaggtagacaggatgaggattaatacatggaaaagcttagtaaagtatcaaatccatctttcaaagaaag

SEQ ID NO: 189454 - DNA, 75 bp, Artificial Sequence
  Synthetic
tgtggcaggtagacaggatgaggattaatacatggaaaagcttagtaaagtatcaaatccatgtttcaaagaaag

SEQ ID NO: 189455 - DNA, 75 bp, Artificial Sequence
  Synthetic
tgtggcaggtagacaggatgaggattaatacatggaaaagcttagtaaagtatcatatccatatttcaaagaaag

SEQ ID NO: 189456 - DNA, 75 bp, Artificial Sequence
  Synthetic
tgtggcaggtagacaggatgaggattaatacatggaaaagcttagtaaagtatcatatccatttttcaaagaaag

SEQ ID NO: 189457 - DNA, 75 bp, Artificial Sequence
  Synthetic
tgtggcaggtagacaggatgaggattaatacatggaaaagcttagtaaagtatcatatccatctttcaaagaaag

SEQ ID NO: 189458 - DNA, 75 bp, Artificial Sequence
  Synthetic
tgtggcaggtagacaggatgaggattaatacatggaaaagcttagtaaagtatcatatccatgtttcaaagaaag

SEQ ID NO: 189459 - DNA, 75 bp, Artificial Sequence
  Synthetic
tgtggcaggtagacaggatgaggattaatacatggaaaagcttagtaaagtatcacatccatatttcaaagaaag

SEQ ID NO: 189460 - DNA, 75 bp, Artificial Sequence
  Synthetic
tgtggcaggtagacaggatgaggattaatacatggaaaagcttagtaaagtatcacatccatttttcaaagaaag

SEQ ID NO: 189461 - DNA, 75 bp, Artificial Sequence
  Synthetic
tgtggcaggtagacaggatgaggattaatacatggaaaagcttagtaaagtatcacatccatctttcaaagaaag

SEQ ID NO: 189462 - DNA, 75 bp, Artificial Sequence
  Synthetic
tgtggcaggtagacaggatgaggattaatacatggaaaagcttagtaaagtatcacatccatgtttcaaagaaag

SEQ ID NO: 189463 - DNA, 75 bp, Artificial Sequence
  Synthetic
tgtggcaggtagacaggatgaggattaatacatggaaaagcttagtaaagtatcagatccatatttcaaagaaag

SEQ ID NO: 189464 - DNA, 75 bp, Artificial Sequence
  Synthetic
tgtggcaggtagacaggatgaggattaatacatggaaaagcttagtaaagtatcagatccatttttcaaagaaag

SEQ ID NO: 189465 - DNA, 75 bp, Artificial Sequence
  Synthetic
tgtggcaggtagacaggatgaggattaatacatggaaaagcttagtaaagtatcagatccatctttcaaagaaag

SEQ ID NO: 189466 - DNA, 75 bp, Artificial Sequence
  Synthetic
tgtggcaggtagacaggatgaggattaatacatggaaaagcttagtaaagtatcagatccatgtttcaaagaaag

SEQ ID NO: 189467 - DNA, 75 bp, Artificial Sequence
  Synthetic
tgtggcaggtagacaggatgaggattaatacatggaaaaggttagtaaagtatcaaatccatatttcaaagaaag

SEQ ID NO: 189468 - DNA, 75 bp, Artificial Sequence
  Synthetic
tgtggcaggtagacaggatgaggattaatacatggaaaaggttagtaaagtatcaaatccatttttcaaagaaag

SEQ ID NO: 189469 - DNA, 75 bp, Artificial Sequence
  Synthetic
tgtggcaggtagacaggatgaggattaatacatggaaaaggttagtaaagtatcaaatccatctttcaaagaaag

SEQ ID NO: 189470 - DNA, 75 bp, Artificial Sequence
  Synthetic
tgtggcaggtagacaggatgaggattaatacatggaaaaggttagtaaagtatcaaatccatgtttcaaagaaag

SEQ ID NO: 189471 - DNA, 75 bp, Artificial Sequence
  Synthetic
tgtggcaggtagacaggatgaggattaatacatggaaaaggttagtaaagtatcatatccatatttcaaagaaag

SEQ ID NO: 189472 - DNA, 75 bp, Artificial Sequence
  Synthetic
tgtggcaggtagacaggatgaggattaatacatggaaaaggttagtaaagtatcatatccatttttcaaagaaag

SEQ ID NO: 189473 - DNA, 75 bp, Artificial Sequence
  Synthetic
tgtggcaggtagacaggatgaggattaatacatggaaaaggttagtaaagtatcatatccatctttcaaagaaag

SEQ ID NO: 189474 - DNA, 75 bp, Artificial Sequence
  Synthetic
tgtggcaggtagacaggatgaggattaatacatggaaaaggttagtaaagtatcatatccatgtttcaaagaaag

SEQ ID NO: 189475 - DNA, 75 bp, Artificial Sequence
  Synthetic
tgtggcaggtagacaggatgaggattaatacatggaaaaggttagtaaagtatcacatccatatttcaaagaaag

SEQ ID NO: 189476 - DNA, 75 bp, Artificial Sequence
  Synthetic
tgtggcaggtagacaggatgaggattaatacatggaaaaggttagtaaagtatcacatccatttttcaaagaaag

SEQ ID NO: 189477 - DNA, 75 bp, Artificial Sequence
  Synthetic
tgtggcaggtagacaggatgaggattaatacatggaaaaggttagtaaagtatcacatccatctttcaaagaaag

SEQ ID NO: 189478 - DNA, 75 bp, Artificial Sequence
  Synthetic
tgtggcaggtagacaggatgaggattaatacatggaaaaggttagtaaagtatcacatccatgtttcaaagaaag

SEQ ID NO: 189479 - DNA, 75 bp, Artificial Sequence
  Synthetic
tgtggcaggtagacaggatgaggattaatacatggaaaaggttagtaaagtatcagatccatatttcaaagaaag

SEQ ID NO: 189480 - DNA, 75 bp, Artificial Sequence
  Synthetic
tgtggcaggtagacaggatgaggattaatacatggaaaaggttagtaaagtatcagatccatttttcaaagaaag

SEQ ID NO: 189481 - DNA, 75 bp, Artificial Sequence
  Synthetic
tgtggcaggtagacaggatgaggattaatacatggaaaaggttagtaaagtatcagatccatctttcaaagaaag

SEQ ID NO: 189482 - DNA, 75 bp, Artificial Sequence
  Synthetic
tgtggcaggtagacaggatgaggattaatacatggaaaaggttagtaaagtatcagatccatgtttcaaagaaag

SEQ ID NO: 189483 - DNA, 75 bp, Artificial Sequence
  Synthetic
tcgcttagtgagcggattctttgcacttgcctgggacgacctgaggagcctgtgcatcttcagctaccaccgctt

SEQ ID NO: 189484 - DNA, 75 bp, Artificial Sequence
  Synthetic
gcgaaagtaaaaccagaggagatctctcgacgcaggactcggcttgctgaagaagaagcgcgcgcggcaagaggc

SEQ ID NO: 189485 - DNA, 75 bp, Artificial Sequence
  Synthetic
tcctaacatagagccctggaaccatccaggaagtcagcctagaactgcttgtactcaatgttattgtaaaaagtg

SEQ ID NO: 189486 - DNA, 75 bp, Artificial Sequence
  Synthetic
aatcatcaagatcatgtaacggagcagtaagtaaatcaattagtctctgtaatgaactctttacaaatagcatca

SEQ ID NO: 189487 - DNA, 75 bp, Artificial Sequence
  Synthetic
aatcatcaagatcatgtatcggagcagtaagtaaatcaattagtctctgtaatgaactctttacaaatagcatca

SEQ ID NO: 189488 - DNA, 75 bp, Artificial Sequence
  Synthetic
aatcatcaagatcatgtaccggagcagtaagtaaatcaattagtctctgtaatgaactctttacaaatagcatca

SEQ ID NO: 189489 - DNA, 75 bp, Artificial Sequence
  Synthetic
aatcatcaagatcatgtagcggagcagtaagtaaatcaattagtctctgtaatgaactctttacaaatagcatca

SEQ ID NO: 189490 - DNA, 75 bp, Artificial Sequence
  Synthetic
aatcatcaagatcttgtaacggagcagtaagtaaatcaattagtctctgtaatgaactctttacaaatagcatca

SEQ ID NO: 189491 - DNA, 75 bp, Artificial Sequence
  Synthetic
aatcatcaagatcttgtatcggagcagtaagtaaatcaattagtctctgtaatgaactctttacaaatagcatca

SEQ ID NO: 189492 - DNA, 75 bp, Artificial Sequence
  Synthetic
aatcatcaagatcttgtaccggagcagtaagtaaatcaattagtctctgtaatgaactctttacaaatagcatca

SEQ ID NO: 189493 - DNA, 75 bp, Artificial Sequence
  Synthetic
aatcatcaagatcttgtagcggagcagtaagtaaatcaattagtctctgtaatgaactctttacaaatagcatca

SEQ ID NO: 189494 - DNA, 75 bp, Artificial Sequence
  Synthetic
aatcatcaagatcctgtaacggagcagtaagtaaatcaattagtctctgtaatgaactctttacaaatagcatca

SEQ ID NO: 189495 - DNA, 75 bp, Artificial Sequence
  Synthetic
aatcatcaagatcctgtatcggagcagtaagtaaatcaattagtctctgtaatgaactctttacaaatagcatca

SEQ ID NO: 189496 - DNA, 75 bp, Artificial Sequence
  Synthetic
aatcatcaagatcctgtaccggagcagtaagtaaatcaattagtctctgtaatgaactctttacaaatagcatca

SEQ ID NO: 189497 - DNA, 75 bp, Artificial Sequence
  Synthetic
aatcatcaagatcctgtagcggagcagtaagtaaatcaattagtctctgtaatgaactctttacaaatagcatca

SEQ ID NO: 189498 - DNA, 75 bp, Artificial Sequence
  Synthetic
aatcatcaagatcgtgtaacggagcagtaagtaaatcaattagtctctgtaatgaactctttacaaatagcatca

SEQ ID NO: 189499 - DNA, 75 bp, Artificial Sequence
  Synthetic
aatcatcaagatcgtgtatcggagcagtaagtaaatcaattagtctctgtaatgaactctttacaaatagcatca

SEQ ID NO: 189500 - DNA, 75 bp, Artificial Sequence
  Synthetic
aatcatcaagatcgtgtaccggagcagtaagtaaatcaattagtctctgtaatgaactctttacaaatagcatca

SEQ ID NO: 189501 - DNA, 75 bp, Artificial Sequence
  Synthetic
aatcatcaagatcgtgtagcggagcagtaagtaaatcaattagtctctgtaatgaactctttacaaatagcatca

SEQ ID NO: 189502 - DNA, 75 bp, Artificial Sequence
  Synthetic
attcatcaagatcatgtaacggagcagtaagtaaatcaattagtctctgtaatgaactctttacaaatagcatca

SEQ ID NO: 189503 - DNA, 75 bp, Artificial Sequence
  Synthetic
attcatcaagatcatgtatcggagcagtaagtaaatcaattagtctctgtaatgaactctttacaaatagcatca

SEQ ID NO: 189504 - DNA, 75 bp, Artificial Sequence
  Synthetic
attcatcaagatcatgtaccggagcagtaagtaaatcaattagtctctgtaatgaactctttacaaatagcatca

SEQ ID NO: 189505 - DNA, 75 bp, Artificial Sequence
  Synthetic
attcatcaagatcatgtagcggagcagtaagtaaatcaattagtctctgtaatgaactctttacaaatagcatca

SEQ ID NO: 189506 - DNA, 75 bp, Artificial Sequence
  Synthetic
attcatcaagatcttgtaacggagcagtaagtaaatcaattagtctctgtaatgaactctttacaaatagcatca

SEQ ID NO: 189507 - DNA, 75 bp, Artificial Sequence
  Synthetic
attcatcaagatcttgtatcggagcagtaagtaaatcaattagtctctgtaatgaactctttacaaatagcatca

SEQ ID NO: 189508 - DNA, 75 bp, Artificial Sequence
  Synthetic
attcatcaagatcttgtaccggagcagtaagtaaatcaattagtctctgtaatgaactctttacaaatagcatca

SEQ ID NO: 189509 - DNA, 75 bp, Artificial Sequence
  Synthetic
attcatcaagatcttgtagcggagcagtaagtaaatcaattagtctctgtaatgaactctttacaaatagcatca

SEQ ID NO: 189510 - DNA, 75 bp, Artificial Sequence
  Synthetic
attcatcaagatcctgtaacggagcagtaagtaaatcaattagtctctgtaatgaactctttacaaatagcatca

SEQ ID NO: 189511 - DNA, 75 bp, Artificial Sequence
  Synthetic
attcatcaagatcctgtatcggagcagtaagtaaatcaattagtctctgtaatgaactctttacaaatagcatca

SEQ ID NO: 189512 - DNA, 75 bp, Artificial Sequence
  Synthetic
attcatcaagatcctgtaccggagcagtaagtaaatcaattagtctctgtaatgaactctttacaaatagcatca

SEQ ID NO: 189513 - DNA, 75 bp, Artificial Sequence
  Synthetic
attcatcaagatcctgtagcggagcagtaagtaaatcaattagtctctgtaatgaactctttacaaatagcatca

SEQ ID NO: 189514 - DNA, 75 bp, Artificial Sequence
  Synthetic
attcatcaagatcgtgtaacggagcagtaagtaaatcaattagtctctgtaatgaactctttacaaatagcatca

SEQ ID NO: 189515 - DNA, 75 bp, Artificial Sequence
  Synthetic
attcatcaagatcgtgtatcggagcagtaagtaaatcaattagtctctgtaatgaactctttacaaatagcatca

SEQ ID NO: 189516 - DNA, 75 bp, Artificial Sequence
  Synthetic
attcatcaagatcgtgtaccggagcagtaagtaaatcaattagtctctgtaatgaactctttacaaatagcatca

SEQ ID NO: 189517 - DNA, 75 bp, Artificial Sequence
  Synthetic
attcatcaagatcgtgtagcggagcagtaagtaaatcaattagtctctgtaatgaactctttacaaatagcatca

SEQ ID NO: 189518 - DNA, 75 bp, Artificial Sequence
  Synthetic
actcatcaagatcatgtaacggagcagtaagtaaatcaattagtctctgtaatgaactctttacaaatagcatca

SEQ ID NO: 189519 - DNA, 75 bp, Artificial Sequence
  Synthetic
actcatcaagatcatgtatcggagcagtaagtaaatcaattagtctctgtaatgaactctttacaaatagcatca

SEQ ID NO: 189520 - DNA, 75 bp, Artificial Sequence
  Synthetic
actcatcaagatcatgtaccggagcagtaagtaaatcaattagtctctgtaatgaactctttacaaatagcatca

SEQ ID NO: 189521 - DNA, 75 bp, Artificial Sequence
  Synthetic
actcatcaagatcatgtagcggagcagtaagtaaatcaattagtctctgtaatgaactctttacaaatagcatca

SEQ ID NO: 189522 - DNA, 75 bp, Artificial Sequence
  Synthetic
actcatcaagatcttgtaacggagcagtaagtaaatcaattagtctctgtaatgaactctttacaaatagcatca

SEQ ID NO: 189523 - DNA, 75 bp, Artificial Sequence
  Synthetic
actcatcaagatcttgtatcggagcagtaagtaaatcaattagtctctgtaatgaactctttacaaatagcatca

SEQ ID NO: 189524 - DNA, 75 bp, Artificial Sequence
  Synthetic
actcatcaagatcttgtaccggagcagtaagtaaatcaattagtctctgtaatgaactctttacaaatagcatca

SEQ ID NO: 189525 - DNA, 75 bp, Artificial Sequence
  Synthetic
actcatcaagatcttgtagcggagcagtaagtaaatcaattagtctctgtaatgaactctttacaaatagcatca

SEQ ID NO: 189526 - DNA, 75 bp, Artificial Sequence
  Synthetic
actcatcaagatcctgtaacggagcagtaagtaaatcaattagtctctgtaatgaactctttacaaatagcatca

SEQ ID NO: 189527 - DNA, 75 bp, Artificial Sequence
  Synthetic
actcatcaagatcctgtatcggagcagtaagtaaatcaattagtctctgtaatgaactctttacaaatagcatca

SEQ ID NO: 189528 - DNA, 75 bp, Artificial Sequence
  Synthetic
actcatcaagatcctgtaccggagcagtaagtaaatcaattagtctctgtaatgaactctttacaaatagcatca

SEQ ID NO: 189529 - DNA, 75 bp, Artificial Sequence
  Synthetic
actcatcaagatcctgtagcggagcagtaagtaaatcaattagtctctgtaatgaactctttacaaatagcatca

SEQ ID NO: 189530 - DNA, 75 bp, Artificial Sequence
  Synthetic
actcatcaagatcgtgtaacggagcagtaagtaaatcaattagtctctgtaatgaactctttacaaatagcatca

SEQ ID NO: 189531 - DNA, 75 bp, Artificial Sequence
  Synthetic
actcatcaagatcgtgtatcggagcagtaagtaaatcaattagtctctgtaatgaactctttacaaatagcatca

SEQ ID NO: 189532 - DNA, 75 bp, Artificial Sequence
  Synthetic
actcatcaagatcgtgtaccggagcagtaagtaaatcaattagtctctgtaatgaactctttacaaatagcatca

SEQ ID NO: 189533 - DNA, 75 bp, Artificial Sequence
  Synthetic
actcatcaagatcgtgtagcggagcagtaagtaaatcaattagtctctgtaatgaactctttacaaatagcatca

SEQ ID NO: 189534 - DNA, 75 bp, Artificial Sequence
  Synthetic
agtcatcaagatcatgtaacggagcagtaagtaaatcaattagtctctgtaatgaactctttacaaatagcatca

SEQ ID NO: 189535 - DNA, 75 bp, Artificial Sequence
  Synthetic
agtcatcaagatcatgtatcggagcagtaagtaaatcaattagtctctgtaatgaactctttacaaatagcatca

SEQ ID NO: 189536 - DNA, 75 bp, Artificial Sequence
  Synthetic
agtcatcaagatcatgtaccggagcagtaagtaaatcaattagtctctgtaatgaactctttacaaatagcatca

SEQ ID NO: 189537 - DNA, 75 bp, Artificial Sequence
  Synthetic
agtcatcaagatcatgtagcggagcagtaagtaaatcaattagtctctgtaatgaactctttacaaatagcatca

SEQ ID NO: 189538 - DNA, 75 bp, Artificial Sequence
  Synthetic
agtcatcaagatcttgtaacggagcagtaagtaaatcaattagtctctgtaatgaactctttacaaatagcatca

SEQ ID NO: 189539 - DNA, 75 bp, Artificial Sequence
  Synthetic
agtcatcaagatcttgtatcggagcagtaagtaaatcaattagtctctgtaatgaactctttacaaatagcatca

SEQ ID NO: 189540 - DNA, 75 bp, Artificial Sequence
  Synthetic
agtcatcaagatcttgtaccggagcagtaagtaaatcaattagtctctgtaatgaactctttacaaatagcatca

SEQ ID NO: 189541 - DNA, 75 bp, Artificial Sequence
  Synthetic
agtcatcaagatcttgtagcggagcagtaagtaaatcaattagtctctgtaatgaactctttacaaatagcatca

SEQ ID NO: 189542 - DNA, 75 bp, Artificial Sequence
  Synthetic
agtcatcaagatcctgtaacggagcagtaagtaaatcaattagtctctgtaatgaactctttacaaatagcatca

SEQ ID NO: 189543 - DNA, 75 bp, Artificial Sequence
  Synthetic
agtcatcaagatcctgtatcggagcagtaagtaaatcaattagtctctgtaatgaactctttacaaatagcatca

SEQ ID NO: 189544 - DNA, 75 bp, Artificial Sequence
  Synthetic
agtcatcaagatcctgtaccggagcagtaagtaaatcaattagtctctgtaatgaactctttacaaatagcatca

SEQ ID NO: 189545 - DNA, 75 bp, Artificial Sequence
  Synthetic
agtcatcaagatcctgtagcggagcagtaagtaaatcaattagtctctgtaatgaactctttacaaatagcatca

SEQ ID NO: 189546 - DNA, 75 bp, Artificial Sequence
  Synthetic
agtcatcaagatcgtgtaacggagcagtaagtaaatcaattagtctctgtaatgaactctttacaaatagcatca

SEQ ID NO: 189547 - DNA, 75 bp, Artificial Sequence
  Synthetic
agtcatcaagatcgtgtatcggagcagtaagtaaatcaattagtctctgtaatgaactctttacaaatagcatca

SEQ ID NO: 189548 - DNA, 75 bp, Artificial Sequence
  Synthetic
agtcatcaagatcgtgtaccggagcagtaagtaaatcaattagtctctgtaatgaactctttacaaatagcatca

SEQ ID NO: 189549 - DNA, 75 bp, Artificial Sequence
  Synthetic
agtcatcaagatcgtgtagcggagcagtaagtaaatcaattagtctctgtaatgaactctttacaaatagcatca

SEQ ID NO: 189550 - DNA, 75 bp, Artificial Sequence
  Synthetic
taattgatagaataagagaaagagaagaggacagtggaaatgacagtgatggagacacagaggagttggcaaaac

SEQ ID NO: 189551 - DNA, 75 bp, Artificial Sequence
  Synthetic
taattgatagaataagagatagagaagaggacagtggaaatgacagtgatggagacacagaggagttggcaaaac

SEQ ID NO: 189552 - DNA, 75 bp, Artificial Sequence
  Synthetic
taattgatagaataagagacagagaagaggacagtggaaatgacagtgatggagacacagaggagttggcaaaac

SEQ ID NO: 189553 - DNA, 75 bp, Artificial Sequence
  Synthetic
taattgatagaataagagagagagaagaggacagtggaaatgacagtgatggagacacagaggagttggcaaaac

SEQ ID NO: 189554 - DNA, 75 bp, Artificial Sequence
  Synthetic
tatttgatagaataagagaaagagaagaggacagtggaaatgacagtgatggagacacagaggagttggcaaaac

SEQ ID NO: 189555 - DNA, 75 bp, Artificial Sequence
  Synthetic
tatttgatagaataagagatagagaagaggacagtggaaatgacagtgatggagacacagaggagttggcaaaac

SEQ ID NO: 189556 - DNA, 75 bp, Artificial Sequence
  Synthetic
tatttgatagaataagagacagagaagaggacagtggaaatgacagtgatggagacacagaggagttggcaaaac

SEQ ID NO: 189557 - DNA, 75 bp, Artificial Sequence
  Synthetic
tatttgatagaataagagagagagaagaggacagtggaaatgacagtgatggagacacagaggagttggcaaaac

SEQ ID NO: 189558 - DNA, 75 bp, Artificial Sequence
  Synthetic
tacttgatagaataagagaaagagaagaggacagtggaaatgacagtgatggagacacagaggagttggcaaaac

SEQ ID NO: 189559 - DNA, 75 bp, Artificial Sequence
  Synthetic
tacttgatagaataagagatagagaagaggacagtggaaatgacagtgatggagacacagaggagttggcaaaac

SEQ ID NO: 189560 - DNA, 75 bp, Artificial Sequence
  Synthetic
tacttgatagaataagagacagagaagaggacagtggaaatgacagtgatggagacacagaggagttggcaaaac

SEQ ID NO: 189561 - DNA, 75 bp, Artificial Sequence
  Synthetic
tacttgatagaataagagagagagaagaggacagtggaaatgacagtgatggagacacagaggagttggcaaaac

SEQ ID NO: 189562 - DNA, 75 bp, Artificial Sequence
  Synthetic
tagttgatagaataagagaaagagaagaggacagtggaaatgacagtgatggagacacagaggagttggcaaaac

SEQ ID NO: 189563 - DNA, 75 bp, Artificial Sequence
  Synthetic
tagttgatagaataagagatagagaagaggacagtggaaatgacagtgatggagacacagaggagttggcaaaac

SEQ ID NO: 189564 - DNA, 75 bp, Artificial Sequence
  Synthetic
tagttgatagaataagagacagagaagaggacagtggaaatgacagtgatggagacacagaggagttggcaaaac

SEQ ID NO: 189565 - DNA, 75 bp, Artificial Sequence
  Synthetic
tagttgatagaataagagagagagaagaggacagtggaaatgacagtgatggagacacagaggagttggcaaaac

SEQ ID NO: 189566 - DNA, 75 bp, Artificial Sequence
  Synthetic
gcagtgaggatcatcaagatcttgtatcaaagcagtaagtactacatagtagatgtaatgattgactggacagca

SEQ ID NO: 189567 - DNA, 75 bp, Artificial Sequence
  Synthetic
tgaaaaatcgcagaaccagcaagaaaagaatgaacaagaattattggaattggataaatgggcaagtttgtggaa

SEQ ID NO: 189568 - DNA, 75 bp, Artificial Sequence
  Synthetic
ttgggttggtgataatttgtagtgcctcaaataacttgtgggtcacagtctattatggggtacctgtgtgggaag

SEQ ID NO: 189569 - DNA, 75 bp, Artificial Sequence
  Synthetic
agtggcaatgagagtgatggggacacagaggaattgtcaacaatggtggatatggggcatcttaggcttttggat

SEQ ID NO: 189570 - DNA, 75 bp, Artificial Sequence
  Synthetic
ttactgtttactcatttcagaattgggtgccagcatagcagaatgggcatcctacaacagagaagatcaagaaat

SEQ ID NO: 189571 - DNA, 75 bp, Artificial Sequence
  Synthetic
ctagtccaaccagtgatgccggtagggtaaacatcagtgaaattatgaaaaactgttcttttaagatgaccacgg

SEQ ID NO: 189572 - DNA, 75 bp, Artificial Sequence
  Synthetic
gtaccagtaataagaccagtaatatgacagagggaggagaaatgaaaaactgctctttcgatatcaccacaagca

SEQ ID NO: 189573 - DNA, 75 bp, Artificial Sequence
  Synthetic
gcatatgagacagaaaagcataatgtctgggctacacatgcctgtgtacccacagaccccaacccacaagaaata

SEQ ID NO: 189574 - DNA, 75 bp, Artificial Sequence
  Synthetic
ggtaaacatcagtgaaattatgaaaaactgttcttttaagatgaccacggaaataagagataaaacaaggagaga

SEQ ID NO: 189575 - DNA, 75 bp, Artificial Sequence
  Synthetic
aaaactgctctttagacacagaagtaggagaactgaaaaactgctctttcaatataaccacagagttaagagata

SEQ ID NO: 189576 - DNA, 75 bp, Artificial Sequence
  Synthetic
ttgctataaaatgggtggcaagtggtcaaaacataaggagggtggatgggctactataagggaaagaatgagacg

SEQ ID NO: 189577 - DNA, 75 bp, Artificial Sequence
  Synthetic
ttgctataaaatgggtggcaagtggtcaaaacataaggtgggtggatgggctactataagggaaagaatgagacg

SEQ ID NO: 189578 - DNA, 75 bp, Artificial Sequence
  Synthetic
ttgctataaaatgggtggcaagtggtcaaaacataaggcgggtggatgggctactataagggaaagaatgagacg

SEQ ID NO: 189579 - DNA, 75 bp, Artificial Sequence
  Synthetic
ttgctataaaatgggtggcaagtggtcaaaacataaggggggtggatgggctactataagggaaagaatgagacg

SEQ ID NO: 189580 - DNA, 75 bp, Artificial Sequence
  Synthetic
gtcaccaataatataactgatggcataacaggagaaataaaaaactgctctttcaatatgaccacagagctaagg

SEQ ID NO: 189581 - DNA, 75 bp, Artificial Sequence
  Synthetic
atgtacacatggaattaagccagtggtatcaactcaactactgctaaatggcagcaaatcagaaggagatataat

SEQ ID NO: 189582 - DNA, 75 bp, Artificial Sequence
  Synthetic
aatataaccacagaactaagagataagaaaaagcaggaatatgcacttttttataaacttgatatagtaccactt

SEQ ID NO: 189583 - DNA, 75 bp, Artificial Sequence
  Synthetic
aattagggaaagagcagaagacagtggcaatgagagtgagggggagattgaggaattgtcaacaatggtggatat

SEQ ID NO: 189584 - DNA, 75 bp, Artificial Sequence
  Synthetic
aagggtatacacatgggtccaggacaagtgctctttgcaacagagagagtagtaggggatataagaagagcatac

SEQ ID NO: 189585 - DNA, 75 bp, Artificial Sequence
  Synthetic
aagtgctctttgcaacagagagagtagtaggggatataagaagagcatactgtaatgttagtagcaactggaaca

SEQ ID NO: 189586 - DNA, 75 bp, Artificial Sequence
  Synthetic
gggccaggacaagcgttctatgcaacaggtgacataataggagatataagacaagcacattgtaatgttagtgga

SEQ ID NO: 189587 - DNA, 75 bp, Artificial Sequence
  Synthetic
aagaaaaggtgtacacataggaccagggcaagcattctatgcaataggtgacataataggggatataagacgagc

SEQ ID NO: 189588 - DNA, 75 bp, Artificial Sequence
  Synthetic
agtaggacaagcaatatatgcccctcccattgaaggaaacattacatgctcatcaaatattacaggattaatatt

SEQ ID NO: 189589 - DNA, 75 bp, Artificial Sequence
  Synthetic
aggaaatgaaaaattgctctttcaatgtatccacagaaataaaagataaaaaacataaagagtatgccacttttt

SEQ ID NO: 189590 - DNA, 75 bp, Artificial Sequence
  Synthetic
gaacaaaacaatagtctttgctaacgccgtaggaggggatccggaaataacaacacatagtttcaattgtagggg

SEQ ID NO: 189591 - DNA, 75 bp, Artificial Sequence
  Synthetic
aaatagaattgccaggaagatggaaaccaaaaatgatagggggaattggaggttttatcaaagtaaaacagtatg

SEQ ID NO: 189592 - DNA, 75 bp, Artificial Sequence
  Synthetic
ttataaacatgtggcagggggtaggacgagcaatgtatgcctctcccattgcaggaaacataacatgtaaatcaa

SEQ ID NO: 189593 - DNA, 75 bp, Artificial Sequence
  Synthetic
caaccatcccttcagacaggatcagaagaacttaaatcattatttaatacagtagcagtcctctattgtgtgcat

SEQ ID NO: 189594 - DNA, 75 bp, Artificial Sequence
  Synthetic
tggtccaaaatgcgaacccagattgtaaaactatcttaaaagcattaggaccagcagctacactagaagaaatga

SEQ ID NO: 189595 - DNA, 75 bp, Artificial Sequence
  Synthetic
ggtttaagagtagtttttgctgtgcttaatgtaataaatagagttaggcagggatactcacccttgtcattccag

SEQ ID NO: 189596 - DNA, 75 bp, Artificial Sequence
  Synthetic
tagtttttgctgtactttctatagtaaatagagttaggcagggatactcaccattgtcattacagacccacctcc

SEQ ID NO: 189597 - DNA, 75 bp, Artificial Sequence
  Synthetic
tgggaaaactaaattgggcaagtcagatttatccaggaattagagtaaagcaactatgtaaactccttagggggg

SEQ ID NO: 189598 - DNA, 75 bp, Artificial Sequence
  Synthetic
aatggacataccaaatttatcaagagccatacaaaaacctgaaaacaggaaaatatgcaaaaagggggtcttccc

SEQ ID NO: 189599 - DNA, 75 bp, Artificial Sequence
  Synthetic
agctaccaccgattgagagacttcatcttgattgcagcgaggactgtggaacttctgggacacagcagtctcaag

SEQ ID NO: 189600 - DNA, 75 bp, Artificial Sequence
  Synthetic
ctgagccagcagcagatggggtgggagcagtatctagagacctggaaaaacatggagcaatcactagtagcaata

SEQ ID NO: 189601 - DNA, 75 bp, Artificial Sequence
  Synthetic
gtattggggtcaggaactaaaaattagtgctataaatttgcttgataccatagcaatagcagcagctgagtggac

SEQ ID NO: 189602 - DNA, 75 bp, Artificial Sequence
  Synthetic
atagaggtaaaagacaccaaggaaactttagacaagatagaggaactacaaaagaagaacaagcaacaggcacag

SEQ ID NO: 189603 - DNA, 75 bp, Artificial Sequence
  Synthetic
atagaggtaaaagacaccaaggaatctttagacaagatagaggaactacaaaagaagaacaagcaacaggcacag

SEQ ID NO: 189604 - DNA, 75 bp, Artificial Sequence
  Synthetic
atagaggtaaaagacaccaaggaacctttagacaagatagaggaactacaaaagaagaacaagcaacaggcacag

SEQ ID NO: 189605 - DNA, 75 bp, Artificial Sequence
  Synthetic
atagaggtaaaagacaccaaggaagctttagacaagatagaggaactacaaaagaagaacaagcaacaggcacag

SEQ ID NO: 189606 - DNA, 75 bp, Artificial Sequence
  Synthetic
tactatgacccagcaaaagaattaatagcagaagtacagaaacaaggggaagaccaatggacatatcaaatttat

SEQ ID NO: 189607 - DNA, 75 bp, Artificial Sequence
  Synthetic
tactatgacccagcaaaagaattaatagcagaagtacagaaacaaggggaagaccaatggacttatcaaatttat

SEQ ID NO: 189608 - DNA, 75 bp, Artificial Sequence
  Synthetic
tactatgacccagcaaaagaattaatagcagaagtacagaaacaaggggaagaccaatggacctatcaaatttat

SEQ ID NO: 189609 - DNA, 75 bp, Artificial Sequence
  Synthetic
tactatgacccagcaaaagaattaatagcagaagtacagaaacaaggggaagaccaatggacgtatcaaatttat

SEQ ID NO: 189610 - DNA, 75 bp, Artificial Sequence
  Synthetic
tgcgacaaagaagagcaagaaatggagccagtagatcctaacctagagccctggaaccatccaggaagtcagcct

SEQ ID NO: 189611 - DNA, 75 bp, Artificial Sequence
  Synthetic
aataagttcagaagtacacatcccactaggggatgctaaattagtaataataacatattggggtctgcatacagg

SEQ ID NO: 189612 - DNA, 75 bp, Artificial Sequence
  Synthetic
gacgaggaggtaggctttccagtaaggcctcaggtgcctctaagaccaatgacttacaagggagctgtggacctc

SEQ ID NO: 189613 - DNA, 75 bp, Artificial Sequence
  Synthetic
gacgaggaggtaggctttccagtaaggcctcaggtgcctctatgaccaatgacttacaagggagctgtggacctc

SEQ ID NO: 189614 - DNA, 75 bp, Artificial Sequence
  Synthetic
gacgaggaggtaggctttccagtaaggcctcaggtgcctctacgaccaatgacttacaagggagctgtggacctc

SEQ ID NO: 189615 - DNA, 75 bp, Artificial Sequence
  Synthetic
gacgaggaggtaggctttccagtaaggcctcaggtgcctctaggaccaatgacttacaagggagctgtggacctc

SEQ ID NO: 189616 - DNA, 75 bp, Artificial Sequence
  Synthetic
ttctctcgacgcaggactcggcttgctgaagtgcacacggcaagaggcgaagggcggcgactggtgagtacgcca

SEQ ID NO: 189617 - DNA, 75 bp, Artificial Sequence
  Synthetic
attggggtctggaactaaaaaagagtgctattagtctgcttgataccatagcaatagcagtagctgagggaacag

SEQ ID NO: 189618 - DNA, 75 bp, Artificial Sequence
  Synthetic
aacagaagaaattaaatcattatataatacagtagcaaccctctattgcgtacatcagaggatagagataaaaga

SEQ ID NO: 189619 - DNA, 75 bp, Artificial Sequence
  Synthetic
atggtaccagttagaaaaagaacccatagtaggagcagaaactttctatgtagatggggcagctaacagggagac

SEQ ID NO: 189620 - DNA, 75 bp, Artificial Sequence
  Synthetic
actactactgctaattacaataatagcatggatgaagaaataaatgaaataaaaaattgctctttcaatacaacc

SEQ ID NO: 189621 - DNA, 75 bp, Artificial Sequence
  Synthetic
gtaagtccattttaaaagcattaggaacaggggctacattagaagaaatgatgacagcatgccagggagtgggag

SEQ ID NO: 189622 - DNA, 75 bp, Artificial Sequence
  Synthetic
atgacagcatgccagggagtgggaggacctggccataaagcaagggttttagctgaggcaatgagtcaagtacaa

SEQ ID NO: 189623 - DNA, 75 bp, Artificial Sequence
  Synthetic
tcagaattgggtgtcaacatagcagaataggcattataccagggagaagaggcaggaatggagccggtagatcct

SEQ ID NO: 189624 - DNA, 75 bp, Artificial Sequence
  Synthetic
ggacacctagccagaaattgcagggcccctagaaaaaagggctgttggaaatgtgggaaggaaggacaccaaatg

SEQ ID NO: 189625 - DNA, 75 bp, Artificial Sequence
  Synthetic
gaccaggacaagcattctacacaacaggtgaaataataggagacataagacaagcacattgtaatattagtaaag

SEQ ID NO: 189626 - DNA, 75 bp, Artificial Sequence
  Synthetic
aaataaaaaactgctctttcaatgtcaccacaaccataaaaaataagagacagagagaatttgcactgttgagta

SEQ ID NO: 189627 - DNA, 75 bp, Artificial Sequence
  Synthetic
tttaactatagcaagcatagtaggattaatagtagcacttattatagtagtagttgtatggaccatagtgttgat

SEQ ID NO: 189628 - DNA, 75 bp, Artificial Sequence
  Synthetic
caagaaatggagccagtagatcctagcctagagccctggaagcatccaggaagtcagcctaagactgcttgtacc

SEQ ID NO: 189629 - DNA, 75 bp, Artificial Sequence
  Synthetic
atcaccagtaccagtacaaacatcaccagtaccagtaatattagcatgaatgtagacatgaaaaattgctctttc

SEQ ID NO: 189630 - DNA, 75 bp, Artificial Sequence
  Synthetic
aggatcaccagcaatatttcagtgtagcatgacaaaaatcttaaaaccttttagagaaagaaacccagaaatagt

SEQ ID NO: 189631 - DNA, 75 bp, Artificial Sequence
  Synthetic
ataggaccaggacaagtgttctatagaacaggagccataacaggagatataagaaaggcatattgtaaaattaat

SEQ ID NO: 189632 - DNA, 75 bp, Artificial Sequence
  Synthetic
cagtaccagcaacagcactagccacaacaccagcaacagcgacagactaaagaaagtagaaatgacaaactgcac

SEQ ID NO: 189633 - DNA, 75 bp, Artificial Sequence
  Synthetic
agaaagtagaaatgacaaactgcacttataatatgaccacaggagtaagagataggaaacagaaggtatactcac

SEQ ID NO: 189634 - DNA, 75 bp, Artificial Sequence
  Synthetic
gaggatagatggaacaagccccagaagaccaagggccacagagggaaccatacaatgaatggacactagagcttt

SEQ ID NO: 189635 - DNA, 75 bp, Artificial Sequence
  Synthetic
agaaacatgggaaacatggtggatggagtattggcaggctacctggattcctgaatgggagtttgtcaatacccc

SEQ ID NO: 189636 - DNA, 75 bp, Artificial Sequence
  Synthetic
ttgataccatagcaatagcagtagctgaaggaacagataggattatagaattaatacaaggaatttgtagagcta

SEQ ID NO: 189637 - DNA, 75 bp, Artificial Sequence
  Synthetic
gatagatggaacaagccccagaagaccaggggccacagagggagccatacaatgaatggacactagagcttttag

SEQ ID NO: 189638 - DNA, 75 bp, Artificial Sequence
  Synthetic
ctaacagggaaactaaagtaggaaaggcagggtatgttactgacaaaggaagacagaaagtaattaccctaactg

SEQ ID NO: 189639 - DNA, 75 bp, Artificial Sequence
  Synthetic
gggtcaaatgacactataactctcccatgcagaataaagcaatttgtaaagatgtggcagagagtaggacaagca

SEQ ID NO: 189640 - DNA, 75 bp, Artificial Sequence
  Synthetic
acagatagggttatagaaacaatacaaagaacttttagagccattctccacatacctagaagaataagacagggc

SEQ ID NO: 189641 - DNA, 75 bp, Artificial Sequence
  Synthetic
atcaagtttctctatcaaagcagtaagtagtacatgtaatgcaacctttagtaatattagcaatagtagcattag

SEQ ID NO: 189642 - DNA, 75 bp, Artificial Sequence
  Synthetic
aataatgccactaataccaataatagtactgtggaaaagatggaacaaggagaaataaaaaactgttcttttaat

SEQ ID NO: 189643 - DNA, 75 bp, Artificial Sequence
  Synthetic
ccttggaatagtagttggagtaataaatctctagatgatatttggggaaacatgacctggatggagtgggataga

SEQ ID NO: 189644 - DNA, 75 bp, Artificial Sequence
  Synthetic
agctcctaggaatctggggatgctctggaaaactcatctgcgccactaatgtgccttggaactctagctggagta

SEQ ID NO: 189645 - DNA, 75 bp, Artificial Sequence
  Synthetic
tacaatgtacacatggaattaggccagtggtgtcaactcaactgctgttaaatggcagtttagcagaaggagagg

SEQ ID NO: 189646 - DNA, 75 bp, Artificial Sequence
  Synthetic
atattcataatgatagtaggaggcttgataggtttaagaatagttttttctgtactttctatagtgaatagagtt

SEQ ID NO: 189647 - DNA, 75 bp, Artificial Sequence
  Synthetic
gagtgggaggacctagccacaaagcaagagtgttggctgaggcaatgagccaagcaaacagtacaaacataatga

SEQ ID NO: 189648 - DNA, 75 bp, Artificial Sequence
  Synthetic
gtggcgcccgaacagggacctgaaagcgaaagtaagaccggaggagatctctcgacgcaggactcggcttgctga

SEQ ID NO: 189649 - DNA, 75 bp, Artificial Sequence
  Synthetic
attatacttgggtccgtaatagtagtttaaaaattagggagggagaaatgaaaaactgctctttcaatgtcaccg

SEQ ID NO: 189650 - DNA, 75 bp, Artificial Sequence
  Synthetic
gaataaaacaatagtctttaatcactcctcaggaggggacccagaaattgtaatgcacagttttaattgtggagg

SEQ ID NO: 189651 - DNA, 75 bp, Artificial Sequence
  Synthetic
gaagaagaaggtggagagagagacagagacagatccggacaattagtgaacggattcttagcacttatctgggtc

SEQ ID NO: 189652 - DNA, 75 bp, Artificial Sequence
  Synthetic
ttagtgctatttctttgtatgatactgtagcagtagcagtagctgagtggacagataggattatagaaataggac

SEQ ID NO: 189653 - DNA, 75 bp, Artificial Sequence
  Synthetic
catacctagaagaattagacagggcttagaaagggctttacaataacatgggtggcaagtggtcaaaaagtagca

SEQ ID NO: 189654 - DNA, 75 bp, Artificial Sequence
  Synthetic
gtaaaaagtgctgctggcattgtcaagtttgctttctgaaaaaaggcttaggcatctcctatggcaggaagaagc

SEQ ID NO: 189655 - DNA, 75 bp, Artificial Sequence
  Synthetic
agaaataaggagaactcccccagcagcaacaggggtaggagcagtatctcaggatttagatagacgtggagcagt

SEQ ID NO: 189656 - DNA, 75 bp, Artificial Sequence
  Synthetic
aaagctatacgtataggaccagggagaacaatttatgcagcaagaaaaataataggagatataagacaagcacat

SEQ ID NO: 189657 - DNA, 75 bp, Artificial Sequence
  Synthetic
tatatcaaagcagtaagtattgcataatataggtaatgattgactggacagaacaagtagattatagaatagcaa

SEQ ID NO: 189658 - DNA, 75 bp, Artificial Sequence
  Synthetic
cagatcatcaaaatcctgtacagaagaagtgagtattagtaataagtatatgtaatgttatcctctttgcatatc

SEQ ID NO: 189659 - DNA, 75 bp, Artificial Sequence
  Synthetic
cagatcatcaaaatcctgtacagaagtagtgagtattagtaataagtatatgtaatgttatcctctttgcatatc

SEQ ID NO: 189660 - DNA, 75 bp, Artificial Sequence
  Synthetic
cagatcatcaaaatcctgtacagaagcagtgagtattagtaataagtatatgtaatgttatcctctttgcatatc

SEQ ID NO: 189661 - DNA, 75 bp, Artificial Sequence
  Synthetic
cagatcatcaaaatcctgtacagaaggagtgagtattagtaataagtatatgtaatgttatcctctttgcatatc

SEQ ID NO: 189662 - DNA, 75 bp, Artificial Sequence
  Synthetic
atctagtatgggcaagcagggaactggagagatttgcacttaaccctggccttttagaaacaacagaaggttgtc

SEQ ID NO: 189663 - DNA, 75 bp, Artificial Sequence
  Synthetic
catttcctatggcaggaagaagcggagacaacgacgatcagctcctcctggcagtaagaatcatcaagatcttat

SEQ ID NO: 189664 - DNA, 75 bp, Artificial Sequence
  Synthetic
agtaatacctaccaaaatgtgaccactcccactcctcctgacatcatgaaaaattgctctttcaatatacccaca

SEQ ID NO: 189665 - DNA, 75 bp, Artificial Sequence
  Synthetic
ttcaatataaccacagaattaagagataagaaaaagaaagtatattcacttttttataaacttgatgtagtacaa

SEQ ID NO: 189666 - DNA, 75 bp, Artificial Sequence
  Synthetic
tggactatagtgtatatagaatataagaaactgttaagacaaaggaaaatagataagttaattaatagaataaga

SEQ ID NO: 189667 - DNA, 75 bp, Artificial Sequence
  Synthetic
agttgaggaatgctactactaataccagtagtactaataccagtagtataatggagggaggagaaatgaaaaact

SEQ ID NO: 189668 - DNA, 75 bp, Artificial Sequence
  Synthetic
gccagtggtatcaactcaactattgttaaatggtagtctagcagaaaaagagataataattagatctaaaaatat

SEQ ID NO: 189669 - DNA, 75 bp, Artificial Sequence
  Synthetic
gcgaccatagaggatgtaatgagagataaaataaaaaattgttctttcaatgcaaccacagaaataaaagataag

SEQ ID NO: 189670 - DNA, 75 bp, Artificial Sequence
  Synthetic
tacaagaaaaagtgtaaggataggaccaggacaaacattctatgcaacaggagaagtaataggagatataagaga

SEQ ID NO: 189671 - DNA, 75 bp, Artificial Sequence
  Synthetic
atacatataggaccaggacaagctttctatgcaagaggtgatataataggggatataaaacaagcatattgtgag

SEQ ID NO: 189672 - DNA, 75 bp, Artificial Sequence
  Synthetic
acaagcctgtccaaaggtctcttttgacccaattcccatacattattgtgctccagctggttatgcgattctaaa

SEQ ID NO: 189673 - DNA, 75 bp, Artificial Sequence
  Synthetic
atcatgaaaaactgctctttcaatgtaactacagaaataagaaataaaaggaagcaagaatacgcgcttttctat

SEQ ID NO: 189674 - DNA, 75 bp, Artificial Sequence
  Synthetic
tcaactcaattgctgttaaatggcagtctagcagaacaagaggtaataattagatctgaaaatatcactaacaat

SEQ ID NO: 189675 - DNA, 75 bp, Artificial Sequence
  Synthetic
ttgtgtgcacaagacccaacaataatacaaggagaagtgtaaggataggaccaggacaaacattctatgcaacaa

SEQ ID NO: 189676 - DNA, 75 bp, Artificial Sequence
  Synthetic
cattctttacaaatgatataataggggatataagacaggcatattgtgtggtcaatagaacacaatggaatgaaa

SEQ ID NO: 189677 - DNA, 75 bp, Artificial Sequence
  Synthetic
tagggaaaatctggccttccagcgggaggccaggaaattttcttcagagcaaaccacaaccaacagccccgccag

SEQ ID NO: 189678 - DNA, 75 bp, Artificial Sequence
  Synthetic
tgtgtgtaccagacctaataacaatacaagaaaaggtatacacatgggaccaggacaagtgctctacgcaacagg

SEQ ID NO: 189679 - DNA, 75 bp, Artificial Sequence
  Synthetic
taagggaaagaatgagacgaactgagccaacaactgaaccagcagctgagccagcagcagttggggtgggagcag

SEQ ID NO: 189680 - DNA, 75 bp, Artificial Sequence
  Synthetic
gccaacaactgaaccagcagctgagccagcagcagttggggtgggagcagtatctcaagacttggcaaaatatgg

SEQ ID NO: 189681 - DNA, 75 bp, Artificial Sequence
  Synthetic
attggaataacactttacgtagagtagctaaaaaactaagagaacactttaataaaacaatagactttacatcac

SEQ ID NO: 189682 - DNA, 75 bp, Artificial Sequence
  Synthetic
ccagacccacctcccagctccgaggggacccgacaggcccgaaggaatcgaagaagaaggtggagagagagacag

SEQ ID NO: 189683 - DNA, 75 bp, Artificial Sequence
  Synthetic
taccatgtaaaataaaacaaattgtgagaatgtggcaaagaacaggacaagcaatatatgcccctcccatcgcag

SEQ ID NO: 189684 - DNA, 75 bp, Artificial Sequence
  Synthetic
accagcaggaaaagaatgaaagggatttactagcattggacagttggaaaaatctgtggaattggtttaacatat

SEQ ID NO: 189685 - DNA, 75 bp, Artificial Sequence
  Synthetic
tatgggataacatgacctggctagaatgggatagagaaattagcaattacacagacataatatatagattaattg

SEQ ID NO: 189686 - DNA, 75 bp, Artificial Sequence
  Synthetic
caaacccagggggtctcgacaggcccggaagaatcggagaagaaggtggagagcaaggcagagacagatcgattc

SEQ ID NO: 189687 - DNA, 75 bp, Artificial Sequence
  Synthetic
acaggcccggaggaatcgaagaagaaggtggagagcaagacaaagacagatccattcgattagtgagcggattct

SEQ ID NO: 189688 - DNA, 75 bp, Artificial Sequence
  Synthetic
gcctggctggaagcacaagaggaagaggaggtaggctttccagtcaggccgcaggtacctttgagaccaatgact

SEQ ID NO: 189689 - DNA, 75 bp, Artificial Sequence
  Synthetic
cgcaggtacctttgagaccaatgacttataagggagctttcgatctcagccactttttaaaagaaaaggggggac

SEQ ID NO: 189690 - DNA, 75 bp, Artificial Sequence
  Synthetic
gtggcgcccgaacagggacccgaaagtaatagggactcgaaagcgaaagttccagagaagttctctcgacgcaag

SEQ ID NO: 189691 - DNA, 75 bp, Artificial Sequence
  Synthetic
cttgcctgggacgacctgcggagcctgtgcctcttcagttaccaccgattgagagacttcgtcttgattgcagcg

SEQ ID NO: 189692 - DNA, 75 bp, Artificial Sequence
  Synthetic
tccagagaagttctctcgacgcaaggactcggcttgctgaggtgcacacagcaagaggcgagagcggcgactggt

SEQ ID NO: 189693 - DNA, 75 bp, Artificial Sequence
  Synthetic
ggggaggcccgggaatttccttcagaacagaccagagccaacagccccgccagcagagagtttcgggttcggaga

SEQ ID NO: 189694 - DNA, 75 bp, Artificial Sequence
  Synthetic
tcagacagggcttggaaagagctttgctataacatgggaggcaaatggtcaaaaagcagcaaaccaggatggcct

SEQ ID NO: 189695 - DNA, 75 bp, Artificial Sequence
  Synthetic
aaaaaatgcagctaccattgtctagtttgctttcagaaaaaaggcttaggcatttcctatggcaggaagaagcgg

SEQ ID NO: 189696 - DNA, 75 bp, Artificial Sequence
  Synthetic
caggaactaaagaatagtgctattagtttgcttaataccacagcaatagcagtagctgaaggaacagatagaatc

SEQ ID NO: 189697 - DNA, 75 bp, Artificial Sequence
  Synthetic
gagctattcttcacatacctagaagaataagacagggtttagaaagagctttgctataaaatggggaacaagtgg

SEQ ID NO: 189698 - DNA, 75 bp, Artificial Sequence
  Synthetic
gagcagaaacttactatgtagatggggcagctaatagggaaacaaaattaggaaaggcaggatatgttactgaca

SEQ ID NO: 189699 - DNA, 75 bp, Artificial Sequence
  Synthetic
cacaagtacctctaagaccaatgacttacaagggagcttttgatctcagccactttttaaaagaaaaggggggac

SEQ ID NO: 189700 - DNA, 75 bp, Artificial Sequence
  Synthetic
tgcagaatcttcaggggcaaatggtacaccaggccctatcacctagaactttgaatgcatgggtaaaagtaatag

SEQ ID NO: 189701 - DNA, 75 bp, Artificial Sequence
  Synthetic
ctcaggtaccattaagaccaatgacatacaaaggagcttttgatcttagcttctttttaaaagaaaaggggggac

SEQ ID NO: 189702 - DNA, 75 bp, Artificial Sequence
  Synthetic
ctcaggttccattaagaccaatgacatacaaaggagcttttgatcttagcttctttttaaaagaaaaggggggac

SEQ ID NO: 189703 - DNA, 75 bp, Artificial Sequence
  Synthetic
ctcaggtcccattaagaccaatgacatacaaaggagcttttgatcttagcttctttttaaaagaaaaggggggac

SEQ ID NO: 189704 - DNA, 75 bp, Artificial Sequence
  Synthetic
ctcaggtgccattaagaccaatgacatacaaaggagcttttgatcttagcttctttttaaaagaaaaggggggac

SEQ ID NO: 189705 - DNA, 75 bp, Artificial Sequence
  Synthetic
aaaatatttttgactagcggaggctagaaggagagagatgggtgcgagagcgtcaatattaagtgggggaaaatt

SEQ ID NO: 189706 - DNA, 75 bp, Artificial Sequence
  Synthetic
cagacctcaggtaccgttaagaccaatgacttacaagggagctttggatcttagccactttttaaaagaaaaggg

SEQ ID NO: 189707 - DNA, 75 bp, Artificial Sequence
  Synthetic
attctaaagtgtaataataagacattcaatgggacaggaccatgcaataatgtcagcacagtacaatgtacacat

SEQ ID NO: 189708 - DNA, 75 bp, Artificial Sequence
  Synthetic
acacctgtcaacataattggaagaaatctgttgactcagcttggttgtactttaaattttcccattagtcctatt

SEQ ID NO: 189709 - DNA, 75 bp, Artificial Sequence
  Synthetic
aaattgcagggcccctaggaaaaagggctgttggaaatgtggaaaggaaggacaccaaatgaaagattgtactga

SEQ ID NO: 189710 - DNA, 75 bp, Artificial Sequence
  Synthetic
ataaaagcattaatagaaatttgtacagaaatggaaaaggaagggaaaatttcaaaaattgggcctgaaaatcca

SEQ ID NO: 189711 - DNA, 75 bp, Artificial Sequence
  Synthetic
tgtgtcactttaaaatgttctacctacaatggtacttacactgataactaccaggaaaagataaaaaattgttct

SEQ ID NO: 189712 - DNA, 75 bp, Artificial Sequence
  Synthetic
tagtagtgacaacatattggggtctgcatacaggagaaagacaatggcatttgggtcagggggtctccattgaat

SEQ ID NO: 189713 - DNA, 75 bp, Artificial Sequence
  Synthetic
tacagaaaacaacaccatcacacttcaatgcagaataaaacaaattataatcatgtggcagggggtagggcgagc

SEQ ID NO: 189714 - DNA, 75 bp, Artificial Sequence
  Synthetic
gacattttcctaggccttggctccatggcttaggacagtatatctataacacttatggggatacttgggaaggag

SEQ ID NO: 189715 - DNA, 75 bp, Artificial Sequence
  Synthetic
tactttgaccaatagcacaaccaatggcaacagtagcataggaaatgtaacagatgaagtaaaaaactgtacttt

SEQ ID NO: 189716 - DNA, 75 bp, Artificial Sequence
  Synthetic
ccagcgggtttaaaaaagaaaaaatcagtaacagtactagatgtgggggatgcatatttttcagttcctttagat

SEQ ID NO: 189717 - DNA, 75 bp, Artificial Sequence
  Synthetic
tacctccaggaatatcaatggaaatgctaccttcaattatagcatggaggaagaaatgagaaattgctcttttaa

SEQ ID NO: 189718 - DNA, 75 bp, Artificial Sequence
  Synthetic
tgtatcctctaacttccctcaaatcactctttggcagcgaccccttgtcacaataagaataggggggcagctgag

SEQ ID NO: 189719 - DNA, 75 bp, Artificial Sequence
  Synthetic
atatacaggttgcttgaagactcgcaaaaccagcaggagaaaaatgaaaaagatttattagcattggacagttgg

SEQ ID NO: 189720 - DNA, 75 bp, Artificial Sequence
  Synthetic
tagttgtgtggaccatagtatatatagaatatagaaagctggtaaagcagaagaaaatagaaaagttattagaga

SEQ ID NO: 189721 - DNA, 75 bp, Artificial Sequence
  Synthetic
acacccagcaggattaaaaaagaaaaaatcagtgacagtactagatgtgggagatgcatatttttcagttccttt

SEQ ID NO: 189722 - DNA, 75 bp, Artificial Sequence
  Synthetic
agcaatccagctagctttgcaggattcaggaccagaagtaaacatagtaacagactcacagtatgcattaggaat

SEQ ID NO: 189723 - DNA, 75 bp, Artificial Sequence
  Synthetic
aacactttaataaaacaatacaatttgaaccacactcaggaggggacctagaagttgtgacacatagctttaatt

SEQ ID NO: 189724 - DNA, 75 bp, Artificial Sequence
  Synthetic
cattcaagcacaaccagataagagtgaatcagagttagtcaatcaaataatagaacagttaataaaaaaggaaag

SEQ ID NO: 189725 - DNA, 75 bp, Artificial Sequence
  Synthetic
ataccactatcatacttccatgcaggataaagcaaattgtaaggatgtggcaggaagtaggacaagcaatgtata

SEQ ID NO: 189726 - DNA, 75 bp, Artificial Sequence
  Synthetic
tgagaaatatcacagtaactggagagcaatggctagtgattttaacctgccacctgtggtagcaaaagaaatagt

SEQ ID NO: 189727 - DNA, 75 bp, Artificial Sequence
  Synthetic
taaaaaactgctcttataatatgaccacgggattaaaagataagaaacagaaagtatactcacttttctatagac

SEQ ID NO: 189728 - DNA, 75 bp, Artificial Sequence
  Synthetic
atatggggaaagactcctaaatttaaattacccatacaaaaagaaacatgggaaacatggtggacagagtattgg

SEQ ID NO: 189729 - DNA, 75 bp, Artificial Sequence
  Synthetic
aggacgtatagttagacctaggtgtgagtatcaagcaggacataacaaggtaggatctctacagtacttggcact

SEQ ID NO: 189730 - DNA, 75 bp, Artificial Sequence
  Synthetic
gacagcgacgaagagctcctcaagacagtaagactcatcaagttcctctaccaaagcagtaagtagtatatgtaa

SEQ ID NO: 189731 - DNA, 75 bp, Artificial Sequence
  Synthetic
aagtataaggataggaccaggacaaacattctatgcaacaggtgatataataggggatataagacaagcacattg

SEQ ID NO: 189732 - DNA, 75 bp, Artificial Sequence
  Synthetic
acattctatgcaacaggtgatataataggggatataagacaagcacattgcaacataagtagagaagaatggaat

SEQ ID NO: 189733 - DNA, 75 bp, Artificial Sequence
  Synthetic
gattgtgtggcaggtagacaggatgaagatcagaacatggaatagtttagtaaagcatcatatgtatgtgtcaaa

SEQ ID NO: 189734 - DNA, 75 bp, Artificial Sequence
  Synthetic
agacctcaggtacctttaagaccaatgacttacaagggagctgtagatcttagccactttttaaaagaaaagggg

SEQ ID NO: 189735 - DNA, 75 bp, Artificial Sequence
  Synthetic
aaattgcactgatagtggtggggcaaaaatggagacaggagaaatgaaaaactgctctttcaatatcaccacaga

SEQ ID NO: 189736 - DNA, 75 bp, Artificial Sequence
  Synthetic
gaaagggtctacctgtcatgggtaccagcacataaaggaattggaggaaatgaacaagtagataaattagtaagt

SEQ ID NO: 189737 - DNA, 75 bp, Artificial Sequence
  Synthetic
aggccagatgagagaaccaaggggaagtgacatagcaggaactactagtacccttcaggaacaaatagcatggat

SEQ ID NO: 189738 - DNA, 75 bp, Artificial Sequence
  Synthetic
agagcaatggctagtgattttaatctgccacctgtagtagcaaaagagatagtagctagctgtgataaatgtcag

SEQ ID NO: 189739 - DNA, 75 bp, Artificial Sequence
  Synthetic
aagttcagaagtacacatcccactaggggatgctaaattagtaataacaacatattggggtctgcatacaggaga

SEQ ID NO: 189740 - DNA, 75 bp, Artificial Sequence
  Synthetic
tgtgttactttaaattgcactaatgtgaatgctaccgataccaatgtgaacgctaccaataacaatgatactagt

SEQ ID NO: 189741 - DNA, 75 bp, Artificial Sequence
  Synthetic
tcaagatctagataaacatggagcaataacaagtagtaatatgaataatgctgataatgcctggctgagagcaca

SEQ ID NO: 189742 - DNA, 75 bp, Artificial Sequence
  Synthetic
cctgtccaaaggtatcctttgaaccaattcccatacattattgtaccccagctggttttgcgcttctaaagtgta

SEQ ID NO: 189743 - DNA, 75 bp, Artificial Sequence
  Synthetic
acaaagaaaaatagacaggttaattgatagaataagagaaagagcagaagacagtggcaatgagagtgacgggga

SEQ ID NO: 189744 - DNA, 75 bp, Artificial Sequence
  Synthetic
cccagctccgaagcaggagccgagagacagggaacccttaacttccctcaaatcactctttggcagcgacccctt

SEQ ID NO: 189745 - DNA, 75 bp, Artificial Sequence
  Synthetic
atcattatttaatacagtagtaaccctctggtgcgtacaccaaaggatagaggtaaaagacaccaaggaagcttt

SEQ ID NO: 189746 - DNA, 75 bp, Artificial Sequence
  Synthetic
tagcaatagcagtagctgagtggacagataggattatagaaataggacaaagaattgggagaggtatcctccaca

SEQ ID NO: 189747 - DNA, 75 bp, Artificial Sequence
  Synthetic
atcaagatcctataccaaagcagtaagtagtatatgtaatgcaatctttagagatattagcaatagcagcattag

SEQ ID NO: 189748 - DNA, 75 bp, Artificial Sequence
  Synthetic
gtgggttacagtttattatggggttcctgtgtggaaagatgcagataccaccctattttgtgcatcagatgccaa

SEQ ID NO: 189749 - DNA, 75 bp, Artificial Sequence
  Synthetic
gatacatgggaaggagtcgaagccataataagaatactgcaacaactattgtttattcatttcagaatcgggtgc

SEQ ID NO: 189750 - DNA, 75 bp, Artificial Sequence
  Synthetic
gatagaggtaaaagacaccaaagaagctctagaggaagtggagaaggcaaaaaagaacagtcagcaaaaaacaca

SEQ ID NO: 189751 - DNA, 75 bp, Artificial Sequence
  Synthetic
ccatgtgtaaaattgacccctctctgtgttactttaaattgtacctctgtcaataatgccactggccaaaatgcc

SEQ ID NO: 189752 - DNA, 75 bp, Artificial Sequence
  Synthetic
aaaattatcctatagtgcagaatgcacaagggcaaatggtacatcaggccatatcacctagaactttaaatgcat

SEQ ID NO: 189753 - DNA, 75 bp, Artificial Sequence
  Synthetic
caataatgccactggccaaaatgcctccatagataatgacatgaagggagaaatacaaaactgctctttcaatat

SEQ ID NO: 189754 - DNA, 75 bp, Artificial Sequence
  Synthetic
gaattcaataccagcactatcatagtcaataccacggaagaaataagaaactgctctttcaatgtaaccacagaa

SEQ ID NO: 189755 - DNA, 75 bp, Artificial Sequence
  Synthetic
aaagtatacatataggaccagggagagcattttatgcaacaggagaaataataggagatataagacaagcacatt

SEQ ID NO: 189756 - DNA, 75 bp, Artificial Sequence
  Synthetic
ggcttgcccaaaggtaacttttgagccaattcccatacattattgtgctccagctggttttgcgatcctaaagtg

SEQ ID NO: 189757 - DNA, 75 bp, Artificial Sequence
  Synthetic
cagtttagcagaaggaaaggaggtagtgattagatctgaaaatatcacaaacaatgctaaaaacataatagtaca

SEQ ID NO: 189758 - DNA, 75 bp, Artificial Sequence
  Synthetic
gtgggaagccctcaaatattggtggaatctcctgcagtattggagtcaggaactaaagaatagtgctgttagttt

SEQ ID NO: 189759 - DNA, 75 bp, Artificial Sequence
  Synthetic
ataagtaatgataccaaggatacaatgagaaattgctctttcaatgcaaccacagtagtacaagataagcatagc

SEQ ID NO: 189760 - DNA, 75 bp, Artificial Sequence
  Synthetic
gcttaatgccacagctatagcagtagctgaggggacagatagagttatagaagtattacaaagaattggtagagc

SEQ ID NO: 189761 - DNA, 75 bp, Artificial Sequence
  Synthetic
gaagaggtgtgcatataggaccagggcaagcattctatgcaacaaatgacatagtaggggacataagacaagcac

SEQ ID NO: 189762 - DNA, 75 bp, Artificial Sequence
  Synthetic
attgtaccagacctaacaacaatacaagacaaagtatacatataggaccaggacaagcattctatacaagtgaca

SEQ ID NO: 189763 - DNA, 75 bp, Artificial Sequence
  Synthetic
tccaaaggtcagttttgacccaattcctatacattattgtgctccagctggttatgcgattctaaagtgtaatga

SEQ ID NO: 189764 - DNA, 75 bp, Artificial Sequence
  Synthetic
aaggatttactagcattggacagttggaaaaatctgtggaattggtttgacataacaaactggctgtggtatata

SEQ ID NO: 189765 - DNA, 75 bp, Artificial Sequence
  Synthetic
aatacctcagtcattaaacaagcttgtccaaaggtgtcttttcaaccaattcccatacattattgtgccccagct

SEQ ID NO: 189766 - DNA, 75 bp, Artificial Sequence
  Synthetic
atgtggcagagagtaggacaagcaatgtatgcccctcccatccaaggaataataaggtgtgaatcaaacattaca

SEQ ID NO: 189767 - DNA, 75 bp, Artificial Sequence
  Synthetic
cctttaattgtggaggagaatttttctattgcaatacaacagatctgttcaataatacatacaatcatacatact

SEQ ID NO: 189768 - DNA, 75 bp, Artificial Sequence
  Synthetic
caataaactttacatcaccctcaggaggggatatagaaattgtgacacatagttttaattgtggaggagaatttt

SEQ ID NO: 189769 - DNA, 75 bp, Artificial Sequence
  Synthetic
gaagtgaattatataaatacaaagtggtagaaattaagccattgggactagcacccactgaagcgaaaaggagag

SEQ ID NO: 189770 - DNA, 75 bp, Artificial Sequence
  Synthetic
aaacaacaaatcagaagactgaattgcaagcaatttatctagctttgcaagattcaggatcagaagtaaacatag

SEQ ID NO: 189771 - DNA, 75 bp, Artificial Sequence
  Synthetic
tgagaccttcagacctacaggaggaaatatgaaggacaattggagaagtgaattatataaatataaagtagtaga

SEQ ID NO: 189772 - DNA, 75 bp, Artificial Sequence
  Synthetic
agtgagtatatattaataaattgtaatacctcagccataacacaagcctgtccaaaggtctcttttgatccaatt

SEQ ID NO: 189773 - DNA, 75 bp, Artificial Sequence
  Synthetic
atgttgaatttactagcaagagtagattatagaataggagtagcagctttgataatagcactaatcatagcaata

SEQ ID NO: 189774 - DNA, 75 bp, Artificial Sequence
  Synthetic
acccagaaatagtgatttatcaatacatggatgacttgtatgtgggatctgacttagaaatagggcagcatagag

SEQ ID NO: 189775 - DNA, 75 bp, Artificial Sequence
  Synthetic
caggggactgagactagggtgggaagccctcaaaattctggggaatcatctatcatactggggtcgggaactaaa

SEQ ID NO: 189776 - DNA, 75 bp, Artificial Sequence
  Synthetic
tgcttgaagactcgcaaatccagcaggaacagaatgaacaagatttattagcattggacaagtggcaaaatctgt

SEQ ID NO: 189777 - DNA, 75 bp, Artificial Sequence
  Synthetic
aaagggaaattaacaattacacaggaataatatacagtctaattgaagaagcacaaaaccagcaggaaaataatg

SEQ ID NO: 189778 - DNA, 75 bp, Artificial Sequence
  Synthetic
ataaaaaactgctctttcaatatcaccacaaacataggagataagatgcagaaagcatatgcacttttttataaa

SEQ ID NO: 189779 - DNA, 75 bp, Artificial Sequence
  Synthetic
caggcccggaagaatcgaagaagaaggtggagagcaaggcagagacagatccattcgcttagtgagcggattctt

SEQ ID NO: 189780 - DNA, 75 bp, Artificial Sequence
  Synthetic
cagcagcagaaggagtaggagcagtatctcaagatttagatagacatggagcaatcacaagcagtaatacagcag

SEQ ID NO: 189781 - DNA, 75 bp, Artificial Sequence
  Synthetic
caagatttagatagacatggagcaattacaagtagtaatataaaccaccctagttgcgcctggctggaagcgcaa

SEQ ID NO: 189782 - DNA, 75 bp, Artificial Sequence
  Synthetic
cgcaggtacctttaagaccaatgacttttaagggagcttttgatctcagcttctttttaaaagaaaaggggggac

SEQ ID NO: 189783 - DNA, 75 bp, Artificial Sequence
  Synthetic
ttcagacctggaggaggagatatgaggaacaattggagaagtgaattatataaatataaagtggtagaaattaag

SEQ ID NO: 189784 - DNA, 75 bp, Artificial Sequence
  Synthetic
gaagaataagacagggctttgaagcagctttgctataaaatggggaacaaatggtcaaaaggctggcctgctgta

SEQ ID NO: 189785 - DNA, 75 bp, Artificial Sequence
  Synthetic
tttaatacaatagcaaccctttggtgcgtacatcaaaggatagaaataaaagacaccaaggaagccttagataaa

SEQ ID NO: 189786 - DNA, 75 bp, Artificial Sequence
  Synthetic
acacaaatagatcctgacctagcagaccgactgattcatctacaatattttgactgtttttcagactctgccata

SEQ ID NO: 189787 - DNA, 75 bp, Artificial Sequence
  Synthetic
attaagcgggggaaaattggatcattgggaaaaaattcggttacggccggggggaaagaaaaaatatagattgaa

SEQ ID NO: 189788 - DNA, 75 bp, Artificial Sequence
  Synthetic
ctggggatttggggttgctctggaaaactcatttgcaccactgctgtgccttggaatgctagttggagtaataaa

SEQ ID NO: 189789 - DNA, 75 bp, Artificial Sequence
  Synthetic
agcttaaatcattatataatgcagtagtagtcctctattttgtacatcaaagagtagagataaaggacaacaagg

SEQ ID NO: 189790 - DNA, 75 bp, Artificial Sequence
  Synthetic
agcttaaatcattatataatgcagtagtagtcctctattttgtacatcaaagagtagagataaaggacatcaagg

SEQ ID NO: 189791 - DNA, 75 bp, Artificial Sequence
  Synthetic
agcttaaatcattatataatgcagtagtagtcctctattttgtacatcaaagagtagagataaaggacaccaagg

SEQ ID NO: 189792 - DNA, 75 bp, Artificial Sequence
  Synthetic
agcttaaatcattatataatgcagtagtagtcctctattttgtacatcaaagagtagagataaaggacagcaagg

SEQ ID NO: 189793 - DNA, 75 bp, Artificial Sequence
  Synthetic
ggaaattagtgcaatagtaggactgatagtagcgctaatcttagcaatagtagtgtggactatagtaggtataga

SEQ ID NO: 189794 - DNA, 75 bp, Artificial Sequence
  Synthetic
agcaatgtcaatggcaacagcacggggtggggcaaggaagaaataaaaaactgctctttcaatataaccacagaa

SEQ ID NO: 189795 - DNA, 75 bp, Artificial Sequence
  Synthetic
agacgtaaagaattggatgacagaaaccttgctggtccgaaatacgaacccagattgtaagaccattttaaccgc

SEQ ID NO: 189796 - DNA, 75 bp, Artificial Sequence
  Synthetic
agacgtaaagaattggatgacagaaaccttgctggtccgaaattcgaacccagattgtaagaccattttaaccgc

SEQ ID NO: 189797 - DNA, 75 bp, Artificial Sequence
  Synthetic
agacgtaaagaattggatgacagaaaccttgctggtccgaaatccgaacccagattgtaagaccattttaaccgc

SEQ ID NO: 189798 - DNA, 75 bp, Artificial Sequence
  Synthetic
agacgtaaagaattggatgacagaaaccttgctggtccgaaatgcgaacccagattgtaagaccattttaaccgc

SEQ ID NO: 189799 - DNA, 75 bp, Artificial Sequence
  Synthetic
tgacgtaaagaattggatgacagaaaccttgctggtccgaaatacgaacccagattgtaagaccattttaaccgc

SEQ ID NO: 189800 - DNA, 75 bp, Artificial Sequence
  Synthetic
tgacgtaaagaattggatgacagaaaccttgctggtccgaaattcgaacccagattgtaagaccattttaaccgc

SEQ ID NO: 189801 - DNA, 75 bp, Artificial Sequence
  Synthetic
tgacgtaaagaattggatgacagaaaccttgctggtccgaaatccgaacccagattgtaagaccattttaaccgc

SEQ ID NO: 189802 - DNA, 75 bp, Artificial Sequence
  Synthetic
tgacgtaaagaattggatgacagaaaccttgctggtccgaaatgcgaacccagattgtaagaccattttaaccgc

SEQ ID NO: 189803 - DNA, 75 bp, Artificial Sequence
  Synthetic
cgacgtaaagaattggatgacagaaaccttgctggtccgaaatacgaacccagattgtaagaccattttaaccgc

SEQ ID NO: 189804 - DNA, 75 bp, Artificial Sequence
  Synthetic
cgacgtaaagaattggatgacagaaaccttgctggtccgaaattcgaacccagattgtaagaccattttaaccgc

SEQ ID NO: 189805 - DNA, 75 bp, Artificial Sequence
  Synthetic
cgacgtaaagaattggatgacagaaaccttgctggtccgaaatccgaacccagattgtaagaccattttaaccgc

SEQ ID NO: 189806 - DNA, 75 bp, Artificial Sequence
  Synthetic
cgacgtaaagaattggatgacagaaaccttgctggtccgaaatgcgaacccagattgtaagaccattttaaccgc

SEQ ID NO: 189807 - DNA, 75 bp, Artificial Sequence
  Synthetic
ggacgtaaagaattggatgacagaaaccttgctggtccgaaatacgaacccagattgtaagaccattttaaccgc

SEQ ID NO: 189808 - DNA, 75 bp, Artificial Sequence
  Synthetic
ggacgtaaagaattggatgacagaaaccttgctggtccgaaattcgaacccagattgtaagaccattttaaccgc

SEQ ID NO: 189809 - DNA, 75 bp, Artificial Sequence
  Synthetic
ggacgtaaagaattggatgacagaaaccttgctggtccgaaatccgaacccagattgtaagaccattttaaccgc

SEQ ID NO: 189810 - DNA, 75 bp, Artificial Sequence
  Synthetic
ggacgtaaagaattggatgacagaaaccttgctggtccgaaatgcgaacccagattgtaagaccattttaaccgc

SEQ ID NO: 189811 - DNA, 75 bp, Artificial Sequence
  Synthetic
agcctgtgagaattaattgtaccagacctaacaacaatacaagaacaagtatacgtataggaccaggacaaacat

SEQ ID NO: 189812 - DNA, 75 bp, Artificial Sequence
  Synthetic
acctaacaacaatacaagaacaagtatacgtataggaccaggacaaacattctatacaagtaacataatagggga

SEQ ID NO: 189813 - DNA, 75 bp, Artificial Sequence
  Synthetic
attgagagacttcatattgattgcagcgagagtggtggaagttctgggacgcagcagtctcaggggactacagag

SEQ ID NO: 189814 - DNA, 75 bp, Artificial Sequence
  Synthetic
aaaatactttgtgaacaaaacaataaaatttgctaattcctcaggaggggatctagaaatcacaacacatagttt

SEQ ID NO: 189815 - DNA, 75 bp, Artificial Sequence
  Synthetic
actataattctcccatgcagaataaaacaaattataaatatgtggcagagagtaggacaagcaatgtatgcccct

SEQ ID NO: 189816 - DNA, 75 bp, Artificial Sequence
  Synthetic
agtataattaaatagtggtgtaatgaatgctttacaaatagcaagcatagtaggattaatagtaacatttatcat

SEQ ID NO: 189817 - DNA, 75 bp, Artificial Sequence
  Synthetic
agttatctatcaatacatggatgacttgtatgtgggatctgatttagaaatagggcaacatagagcaaaaataga

SEQ ID NO: 189818 - DNA, 75 bp, Artificial Sequence
  Synthetic
agaagcgcgcgcggcaagaggcgaggggcggcgactggtgagtacgcctaaaaattttgactagcggaggctaga

SEQ ID NO: 189819 - DNA, 75 bp, Artificial Sequence
  Synthetic
aaaattttgactagcggaggctagaaggagagagatgggtgcgagagcgtcagtattaagcgggggagaattaga

SEQ ID NO: 189820 - DNA, 75 bp, Artificial Sequence
  Synthetic
ctgtgtacccacagaccccaacccacaagaaataaatttgggcaatgtgacagaaaattttaacatatggaaaaa

SEQ ID NO: 189821 - DNA, 75 bp, Artificial Sequence
  Synthetic
aagaacatcaccaataacatctccagggacatcattggtaacatcactgagaaagaaggaataaaaaactgctct

SEQ ID NO: 189822 - DNA, 75 bp, Artificial Sequence
  Synthetic
gggacatcattggtaacatcactgagaaagaaggaataaaaaactgctcttataatatgaccacagatttaagag

SEQ ID NO: 189823 - DNA, 75 bp, Artificial Sequence
  Synthetic
gtattattttgattgtttttcagaatctgctataagaaatgccatattaggacgtatagttagacctaggtgtga

SEQ ID NO: 189824 - DNA, 75 bp, Artificial Sequence
  Synthetic
accactaataacaataccaatagtaatagttgggaaacgatggagagaggagaaataaaaaactgctctttcaat

SEQ ID NO: 189825 - DNA, 75 bp, Artificial Sequence
  Synthetic
tgattgtgtggcaagtagacaggatgaggattagaacatggaaaagtttagtaaaacaccatatgtatatttcaa

SEQ ID NO: 189826 - DNA, 75 bp, Artificial Sequence
  Synthetic
agcagggtatgtcactgacaggggaagacaaaaggttgtttccctaactgagacaacaaatcaaaagactgaatt

SEQ ID NO: 189827 - DNA, 75 bp, Artificial Sequence
  Synthetic
tggttgataccatagcaatagtagtagctggctggacagataggattatagaaataggacaaggaattggtagag

SEQ ID NO: 189828 - DNA, 75 bp, Artificial Sequence
  Synthetic
agctggctggacagataggattatagaaataggacaaggaattggtagagctattctccacatacctagaagaat

SEQ ID NO: 189829 - DNA, 75 bp, Artificial Sequence
  Synthetic
gaaataggacaaggaattggtagagctattctccacatacctagaagaatcagacagggcttagaaagagctttg

SEQ ID NO: 189830 - DNA, 75 bp, Artificial Sequence
  Synthetic
tcctgcagcagcaccaggagtaggagcagtatctcaagatttagataaacatggagcagttacaagtagtaatgt

SEQ ID NO: 189831 - DNA, 75 bp, Artificial Sequence
  Synthetic
tggcagaaaacagggagattctaaaagaaccagtacatggagtgtattatgacccatcaaaagacttaatagcag

SEQ ID NO: 189832 - DNA, 75 bp, Artificial Sequence
  Synthetic
aagtaatacacacagacaatggcagcaatttcaccagtgctgcagtaaaggcagcatgttggtgggcaaatgtca

SEQ ID NO: 189833 - DNA, 75 bp, Artificial Sequence
  Synthetic
tcaaagcagtaagttctaaataatatatgtaatgttagatttaatagcaagagtagattatagaataggagtagg

SEQ ID NO: 189834 - DNA, 75 bp, Artificial Sequence
  Synthetic
gttttgaatatccgcgacatgaatagcactgctaatggtactctggttgggatggagacagaaatgacaaactgc

SEQ ID NO: 189835 - DNA, 75 bp, Artificial Sequence
  Synthetic
cagcaggaagcactatgggcgcagcgtcagtgacgctgacggtacaggccaggcaattattgtctggtatagtgc

SEQ ID NO: 189836 - DNA, 75 bp, Artificial Sequence
  Synthetic
agtcattacacaggcctgtccaaaggtatcctttgaaccaattcccatacattattgtaccccggctggttttgc

SEQ ID NO: 189837 - DNA, 75 bp, Artificial Sequence
  Synthetic
tgcatggaaaagtttagtcaaataccatatgcatgtttcaaagagagccaaaagatggttttatagacatcactt

SEQ ID NO: 189838 - DNA, 75 bp, Artificial Sequence
  Synthetic
tgcatggaaaagtttagtcaaataccatatgcatgtttcaaagagagccaaatgatggttttatagacatcactt

SEQ ID NO: 189839 - DNA, 75 bp, Artificial Sequence
  Synthetic
tgcatggaaaagtttagtcaaataccatatgcatgtttcaaagagagccaaacgatggttttatagacatcactt

SEQ ID NO: 189840 - DNA, 75 bp, Artificial Sequence
  Synthetic
tgcatggaaaagtttagtcaaataccatatgcatgtttcaaagagagccaaaggatggttttatagacatcactt

SEQ ID NO: 189841 - DNA, 75 bp, Artificial Sequence
  Synthetic
gtagtaagaacatattggggtctgcatacaggagaaaaagactggcacttgggtcatggggtctccatagaatgg

SEQ ID NO: 189842 - DNA, 75 bp, Artificial Sequence
  Synthetic
ccatagaatggaggcaggggaggtatagaacacaagtagaccctggcctggcagaccaactgatccatatatatt

SEQ ID NO: 189843 - DNA, 75 bp, Artificial Sequence
  Synthetic
gaagaaatgaaaaattgttcttttaatgcaaccacagagctaagagataagaaacagaaaaaatatgcgcttttt

SEQ ID NO: 189844 - DNA, 75 bp, Artificial Sequence
  Synthetic
cagtacatgcagggcctattccaccaggccagatgagagaaccaaggggaagtgacatagcaggaactactagta

SEQ ID NO: 189845 - DNA, 75 bp, Artificial Sequence
  Synthetic
acaaaaatcttagagccctttagaaaacaaaatccagacatagttatctatcaatacatggatgatttgtatgta

SEQ ID NO: 189846 - DNA, 75 bp, Artificial Sequence
  Synthetic
ggtattatcacactcccatgcagaataagacaaattataaacaggtggcaggaagtaggaaaagcaatgtatgcc

SEQ ID NO: 189847 - DNA, 75 bp, Artificial Sequence
  Synthetic
gacagactattggcaagccacctggattcctgagtgggagtttgttaatacccctcccctagtaaaattatggta

SEQ ID NO: 189848 - DNA, 75 bp, Artificial Sequence
  Synthetic
tgtaaagtgtgttgctggcattgccaactttgctttctgaaaaaaggcttaggcatttcctatggcaagaagaag

SEQ ID NO: 189849 - DNA, 75 bp, Artificial Sequence
  Synthetic
catctcgatcctttatcagagcagtaagtagtacatgtaatgccatctctagaaatagtaggagcatcagtagca

SEQ ID NO: 189850 - DNA, 75 bp, Artificial Sequence
  Synthetic
tgggcaataacagggctgatagtagcactaatcttagcaatagtagtgtggactatagtaggtatagaataaaaa

SEQ ID NO: 189851 - DNA, 75 bp, Artificial Sequence
  Synthetic
gtggcgcccgaacagggaccagggaagcgaaagtgaaagcgacgcagaggactcggcttgctgagcgcgcacagc

SEQ ID NO: 189852 - DNA, 75 bp, Artificial Sequence
  Synthetic
gaaagagcagaagacagtggcaatgagagtgatggggatacagaggaattatccttgcttgtggagatggggaac

SEQ ID NO: 189853 - DNA, 75 bp, Artificial Sequence
  Synthetic
tagaataagagaaagagcagaagatagtggcaatgagagtgatggggatacagaagaattatccactcttatgga

SEQ ID NO: 189854 - DNA, 75 bp, Artificial Sequence
  Synthetic
caagtttgcttcataacaaaaggcttaggcatctcctatggcaggaagaagcggagacagcgacgaagacctcct

SEQ ID NO: 189855 - DNA, 75 bp, Artificial Sequence
  Synthetic
aggttgcttgaagaatcgcaaaaccagcaggaaagaaatgaaaaagatttactagcattggacagttggaaaaat

SEQ ID NO: 189856 - DNA, 75 bp, Artificial Sequence
  Synthetic
catcccttcagacaggatcagaagaacttaaatcattatataatacagtagcagtcctctattgtgtgcatcaaa

SEQ ID NO: 189857 - DNA, 75 bp, Artificial Sequence
  Synthetic
aaaaattgctctttcaatatgaccacagaactaagagataagaaacagaaagtatattcacttttttatagactt

SEQ ID NO: 189858 - DNA, 75 bp, Artificial Sequence
  Synthetic
aacttgtgggtcacagtatattatggggtacctgtgtggaaagaagcaaaaactactctattctgtgcatcagat

SEQ ID NO: 189859 - DNA, 75 bp, Artificial Sequence
  Synthetic
tataggaccaggaagagcattttatgcaacaggagacataataggagacattagacaggcacattgtaatgttag

SEQ ID NO: 189860 - DNA, 75 bp, Artificial Sequence
  Synthetic
tataggaccaggaagagcattttatgcaacaggagacataataggagactttagacaggcacattgtaatgttag

SEQ ID NO: 189861 - DNA, 75 bp, Artificial Sequence
  Synthetic
tataggaccaggaagagcattttatgcaacaggagacataataggagaccttagacaggcacattgtaatgttag

SEQ ID NO: 189862 - DNA, 75 bp, Artificial Sequence
  Synthetic
tataggaccaggaagagcattttatgcaacaggagacataataggagacgttagacaggcacattgtaatgttag

SEQ ID NO: 189863 - DNA, 75 bp, Artificial Sequence
  Synthetic
tataggaccaggaagagcattttatgcaacaggagacataataggtgacattagacaggcacattgtaatgttag

SEQ ID NO: 189864 - DNA, 75 bp, Artificial Sequence
  Synthetic
tataggaccaggaagagcattttatgcaacaggagacataataggtgactttagacaggcacattgtaatgttag

SEQ ID NO: 189865 - DNA, 75 bp, Artificial Sequence
  Synthetic
tataggaccaggaagagcattttatgcaacaggagacataataggtgaccttagacaggcacattgtaatgttag

SEQ ID NO: 189866 - DNA, 75 bp, Artificial Sequence
  Synthetic
tataggaccaggaagagcattttatgcaacaggagacataataggtgacgttagacaggcacattgtaatgttag

SEQ ID NO: 189867 - DNA, 75 bp, Artificial Sequence
  Synthetic
tataggaccaggaagagcattttatgcaacaggagacataataggcgacattagacaggcacattgtaatgttag

SEQ ID NO: 189868 - DNA, 75 bp, Artificial Sequence
  Synthetic
tataggaccaggaagagcattttatgcaacaggagacataataggcgactttagacaggcacattgtaatgttag

SEQ ID NO: 189869 - DNA, 75 bp, Artificial Sequence
  Synthetic
tataggaccaggaagagcattttatgcaacaggagacataataggcgaccttagacaggcacattgtaatgttag

SEQ ID NO: 189870 - DNA, 75 bp, Artificial Sequence
  Synthetic
tataggaccaggaagagcattttatgcaacaggagacataataggcgacgttagacaggcacattgtaatgttag

SEQ ID NO: 189871 - DNA, 75 bp, Artificial Sequence
  Synthetic
tataggaccaggaagagcattttatgcaacaggagacataataggggacattagacaggcacattgtaatgttag

SEQ ID NO: 189872 - DNA, 75 bp, Artificial Sequence
  Synthetic
tataggaccaggaagagcattttatgcaacaggagacataataggggactttagacaggcacattgtaatgttag

SEQ ID NO: 189873 - DNA, 75 bp, Artificial Sequence
  Synthetic
tataggaccaggaagagcattttatgcaacaggagacataataggggaccttagacaggcacattgtaatgttag

SEQ ID NO: 189874 - DNA, 75 bp, Artificial Sequence
  Synthetic
tataggaccaggaagagcattttatgcaacaggagacataataggggacgttagacaggcacattgtaatgttag

SEQ ID NO: 189875 - DNA, 75 bp, Artificial Sequence
  Synthetic
tataggaccaggaagagcattttatgcaacaggtgacataataggagacattagacaggcacattgtaatgttag

SEQ ID NO: 189876 - DNA, 75 bp, Artificial Sequence
  Synthetic
tataggaccaggaagagcattttatgcaacaggtgacataataggagactttagacaggcacattgtaatgttag

SEQ ID NO: 189877 - DNA, 75 bp, Artificial Sequence
  Synthetic
tataggaccaggaagagcattttatgcaacaggtgacataataggagaccttagacaggcacattgtaatgttag

SEQ ID NO: 189878 - DNA, 75 bp, Artificial Sequence
  Synthetic
tataggaccaggaagagcattttatgcaacaggtgacataataggagacgttagacaggcacattgtaatgttag

SEQ ID NO: 189879 - DNA, 75 bp, Artificial Sequence
  Synthetic
tataggaccaggaagagcattttatgcaacaggtgacataataggtgacattagacaggcacattgtaatgttag

SEQ ID NO: 189880 - DNA, 75 bp, Artificial Sequence
  Synthetic
tataggaccaggaagagcattttatgcaacaggtgacataataggtgactttagacaggcacattgtaatgttag

SEQ ID NO: 189881 - DNA, 75 bp, Artificial Sequence
  Synthetic
tataggaccaggaagagcattttatgcaacaggtgacataataggtgaccttagacaggcacattgtaatgttag

SEQ ID NO: 189882 - DNA, 75 bp, Artificial Sequence
  Synthetic
tataggaccaggaagagcattttatgcaacaggtgacataataggtgacgttagacaggcacattgtaatgttag

SEQ ID NO: 189883 - DNA, 75 bp, Artificial Sequence
  Synthetic
tataggaccaggaagagcattttatgcaacaggtgacataataggcgacattagacaggcacattgtaatgttag

SEQ ID NO: 189884 - DNA, 75 bp, Artificial Sequence
  Synthetic
tataggaccaggaagagcattttatgcaacaggtgacataataggcgactttagacaggcacattgtaatgttag

SEQ ID NO: 189885 - DNA, 75 bp, Artificial Sequence
  Synthetic
tataggaccaggaagagcattttatgcaacaggtgacataataggcgaccttagacaggcacattgtaatgttag

SEQ ID NO: 189886 - DNA, 75 bp, Artificial Sequence
  Synthetic
tataggaccaggaagagcattttatgcaacaggtgacataataggcgacgttagacaggcacattgtaatgttag

SEQ ID NO: 189887 - DNA, 75 bp, Artificial Sequence
  Synthetic
tataggaccaggaagagcattttatgcaacaggtgacataataggggacattagacaggcacattgtaatgttag

SEQ ID NO: 189888 - DNA, 75 bp, Artificial Sequence
  Synthetic
tataggaccaggaagagcattttatgcaacaggtgacataataggggactttagacaggcacattgtaatgttag

SEQ ID NO: 189889 - DNA, 75 bp, Artificial Sequence
  Synthetic
tataggaccaggaagagcattttatgcaacaggtgacataataggggaccttagacaggcacattgtaatgttag

SEQ ID NO: 189890 - DNA, 75 bp, Artificial Sequence
  Synthetic
tataggaccaggaagagcattttatgcaacaggtgacataataggggacgttagacaggcacattgtaatgttag

SEQ ID NO: 189891 - DNA, 75 bp, Artificial Sequence
  Synthetic
tataggaccaggaagagcattttatgcaacaggcgacataataggagacattagacaggcacattgtaatgttag

SEQ ID NO: 189892 - DNA, 75 bp, Artificial Sequence
  Synthetic
tataggaccaggaagagcattttatgcaacaggcgacataataggagactttagacaggcacattgtaatgttag

SEQ ID NO: 189893 - DNA, 75 bp, Artificial Sequence
  Synthetic
tataggaccaggaagagcattttatgcaacaggcgacataataggagaccttagacaggcacattgtaatgttag

SEQ ID NO: 189894 - DNA, 75 bp, Artificial Sequence
  Synthetic
tataggaccaggaagagcattttatgcaacaggcgacataataggagacgttagacaggcacattgtaatgttag

SEQ ID NO: 189895 - DNA, 75 bp, Artificial Sequence
  Synthetic
tataggaccaggaagagcattttatgcaacaggcgacataataggtgacattagacaggcacattgtaatgttag

SEQ ID NO: 189896 - DNA, 75 bp, Artificial Sequence
  Synthetic
tataggaccaggaagagcattttatgcaacaggcgacataataggtgactttagacaggcacattgtaatgttag

SEQ ID NO: 189897 - DNA, 75 bp, Artificial Sequence
  Synthetic
tataggaccaggaagagcattttatgcaacaggcgacataataggtgaccttagacaggcacattgtaatgttag

SEQ ID NO: 189898 - DNA, 75 bp, Artificial Sequence
  Synthetic
tataggaccaggaagagcattttatgcaacaggcgacataataggtgacgttagacaggcacattgtaatgttag

SEQ ID NO: 189899 - DNA, 75 bp, Artificial Sequence
  Synthetic
tataggaccaggaagagcattttatgcaacaggcgacataataggcgacattagacaggcacattgtaatgttag

SEQ ID NO: 189900 - DNA, 75 bp, Artificial Sequence
  Synthetic
tataggaccaggaagagcattttatgcaacaggcgacataataggcgactttagacaggcacattgtaatgttag

SEQ ID NO: 189901 - DNA, 75 bp, Artificial Sequence
  Synthetic
tataggaccaggaagagcattttatgcaacaggcgacataataggcgaccttagacaggcacattgtaatgttag

SEQ ID NO: 189902 - DNA, 75 bp, Artificial Sequence
  Synthetic
tataggaccaggaagagcattttatgcaacaggcgacataataggcgacgttagacaggcacattgtaatgttag

SEQ ID NO: 189903 - DNA, 75 bp, Artificial Sequence
  Synthetic
tataggaccaggaagagcattttatgcaacaggcgacataataggggacattagacaggcacattgtaatgttag

SEQ ID NO: 189904 - DNA, 75 bp, Artificial Sequence
  Synthetic
tataggaccaggaagagcattttatgcaacaggcgacataataggggactttagacaggcacattgtaatgttag

SEQ ID NO: 189905 - DNA, 75 bp, Artificial Sequence
  Synthetic
tataggaccaggaagagcattttatgcaacaggcgacataataggggaccttagacaggcacattgtaatgttag

SEQ ID NO: 189906 - DNA, 75 bp, Artificial Sequence
  Synthetic
tataggaccaggaagagcattttatgcaacaggcgacataataggggacgttagacaggcacattgtaatgttag

SEQ ID NO: 189907 - DNA, 75 bp, Artificial Sequence
  Synthetic
tataggaccaggaagagcattttatgcaacaggggacataataggagacattagacaggcacattgtaatgttag

SEQ ID NO: 189908 - DNA, 75 bp, Artificial Sequence
  Synthetic
tataggaccaggaagagcattttatgcaacaggggacataataggagactttagacaggcacattgtaatgttag

SEQ ID NO: 189909 - DNA, 75 bp, Artificial Sequence
  Synthetic
tataggaccaggaagagcattttatgcaacaggggacataataggagaccttagacaggcacattgtaatgttag

SEQ ID NO: 189910 - DNA, 75 bp, Artificial Sequence
  Synthetic
tataggaccaggaagagcattttatgcaacaggggacataataggagacgttagacaggcacattgtaatgttag

SEQ ID NO: 189911 - DNA, 75 bp, Artificial Sequence
  Synthetic
tataggaccaggaagagcattttatgcaacaggggacataataggtgacattagacaggcacattgtaatgttag

SEQ ID NO: 189912 - DNA, 75 bp, Artificial Sequence
  Synthetic
tataggaccaggaagagcattttatgcaacaggggacataataggtgactttagacaggcacattgtaatgttag

SEQ ID NO: 189913 - DNA, 75 bp, Artificial Sequence
  Synthetic
tataggaccaggaagagcattttatgcaacaggggacataataggtgaccttagacaggcacattgtaatgttag

SEQ ID NO: 189914 - DNA, 75 bp, Artificial Sequence
  Synthetic
tataggaccaggaagagcattttatgcaacaggggacataataggtgacgttagacaggcacattgtaatgttag

SEQ ID NO: 189915 - DNA, 75 bp, Artificial Sequence
  Synthetic
tataggaccaggaagagcattttatgcaacaggggacataataggcgacattagacaggcacattgtaatgttag

SEQ ID NO: 189916 - DNA, 75 bp, Artificial Sequence
  Synthetic
tataggaccaggaagagcattttatgcaacaggggacataataggcgactttagacaggcacattgtaatgttag

SEQ ID NO: 189917 - DNA, 75 bp, Artificial Sequence
  Synthetic
tataggaccaggaagagcattttatgcaacaggggacataataggcgaccttagacaggcacattgtaatgttag

SEQ ID NO: 189918 - DNA, 75 bp, Artificial Sequence
  Synthetic
tataggaccaggaagagcattttatgcaacaggggacataataggcgacgttagacaggcacattgtaatgttag

SEQ ID NO: 189919 - DNA, 75 bp, Artificial Sequence
  Synthetic
tataggaccaggaagagcattttatgcaacaggggacataataggggacattagacaggcacattgtaatgttag

SEQ ID NO: 189920 - DNA, 75 bp, Artificial Sequence
  Synthetic
tataggaccaggaagagcattttatgcaacaggggacataataggggactttagacaggcacattgtaatgttag

SEQ ID NO: 189921 - DNA, 75 bp, Artificial Sequence
  Synthetic
tataggaccaggaagagcattttatgcaacaggggacataataggggaccttagacaggcacattgtaatgttag

SEQ ID NO: 189922 - DNA, 75 bp, Artificial Sequence
  Synthetic
tataggaccaggaagagcattttatgcaacaggggacataataggggacgttagacaggcacattgtaatgttag

SEQ ID NO: 189923 - DNA, 75 bp, Artificial Sequence
  Synthetic
gtggtatcaactcaactgctgttaaatggcagtctagcagaaagagaaataaggattagatctgaaaatttcaca

SEQ ID NO: 189924 - DNA, 75 bp, Artificial Sequence
  Synthetic
ttctcaacatacctagaagaataagacagggcttcgaaagggctttgctataaaatgggtggcaagtggtcaaaa

SEQ ID NO: 189925 - DNA, 75 bp, Artificial Sequence
  Synthetic
taagggaaagaatgagaagaactccagcaactgagccaccagcagatggggtgggagcagcatctcaagatttgg

SEQ ID NO: 189926 - DNA, 75 bp, Artificial Sequence
  Synthetic
cgtatagggccaggacaaacattctatgcaacaaatgccataataggggatataagacaggcacattgtactgtc

SEQ ID NO: 189927 - DNA, 75 bp, Artificial Sequence
  Synthetic
caatgacactatcactctcccatgtcgaataaaacaaattgtaaacatgtggcaggaagtaggacaagcaatgta

SEQ ID NO: 189928 - DNA, 75 bp, Artificial Sequence
  Synthetic
cgaggattgtggaacttctgggacgcagggggtgggaagccctcagatattggtggaatatcctgcagtattgga

SEQ ID NO: 189929 - DNA, 75 bp, Artificial Sequence
  Synthetic
ttatagaagtagcacaaagagcttatagggctattatccacatacctagaagagtcagacagggcctcgaaaggg

SEQ ID NO: 189930 - DNA, 75 bp, Artificial Sequence
  Synthetic
caaggaaaagtataaggataggaccaggacaagcattctatgcaacaaatgacataataggaaacataagacaag

SEQ ID NO: 189931 - DNA, 75 bp, Artificial Sequence
  Synthetic
gaatgagacgagctgagccagcagcagatggggtgggagcagtatctcgagacctggaaagacatggagcaatca

SEQ ID NO: 189932 - DNA, 75 bp, Artificial Sequence
  Synthetic
gagtaggagcattgatagtagcactagtcatagcaataatagtgtggatcatagtatatatagaatataggaaat

SEQ ID NO: 189933 - DNA, 75 bp, Artificial Sequence
  Synthetic
atagtatatatagaatataggaaattggtaaaacaaagaagaatagactggttagttaaaagaattagggaaaga

SEQ ID NO: 189934 - DNA, 75 bp, Artificial Sequence
  Synthetic
tggtaaaacaaagaagaatagactggttagttaaaagaattagggaaagagcagaagacagtggcaatgagagtg

SEQ ID NO: 189935 - DNA, 75 bp, Artificial Sequence
  Synthetic
caagaaatggagccagtagatcctaacctagagccctggaaccatccaggaagtcagcctaaaactgcttgcaat

SEQ ID NO: 189936 - DNA, 75 bp, Artificial Sequence
  Synthetic
ggggacccgacaggcccgaaggaatcgaagaagaaggtggagagagagacagagacagatccggtcgattagtgg

SEQ ID NO: 189937 - DNA, 75 bp, Artificial Sequence
  Synthetic
gagtaataaatcttatcatgatatttgggataacatgacctggatgcagtgggataaagaaattagtaattacac

SEQ ID NO: 189938 - DNA, 75 bp, Artificial Sequence
  Synthetic
cggccagagccaacagccccgccagcagagagcttcgggttcagagaggagataaacccctctccgaggcaggag

SEQ ID NO: 189939 - DNA, 75 bp, Artificial Sequence
  Synthetic
cggccagagccaacagccccgccagcagagagcttcgggttcagagaggagataatcccctctccgaggcaggag

SEQ ID NO: 189940 - DNA, 75 bp, Artificial Sequence
  Synthetic
cggccagagccaacagccccgccagcagagagcttcgggttcagagaggagataaccccctctccgaggcaggag

SEQ ID NO: 189941 - DNA, 75 bp, Artificial Sequence
  Synthetic
cggccagagccaacagccccgccagcagagagcttcgggttcagagaggagataagcccctctccgaggcaggag

SEQ ID NO: 189942 - DNA, 75 bp, Artificial Sequence
  Synthetic
cggccagagccaacagccccgccagcagagagcttcgggttctgagaggagataaacccctctccgaggcaggag

SEQ ID NO: 189943 - DNA, 75 bp, Artificial Sequence
  Synthetic
cggccagagccaacagccccgccagcagagagcttcgggttctgagaggagataatcccctctccgaggcaggag

SEQ ID NO: 189944 - DNA, 75 bp, Artificial Sequence
  Synthetic
cggccagagccaacagccccgccagcagagagcttcgggttctgagaggagataaccccctctccgaggcaggag

SEQ ID NO: 189945 - DNA, 75 bp, Artificial Sequence
  Synthetic
cggccagagccaacagccccgccagcagagagcttcgggttctgagaggagataagcccctctccgaggcaggag

SEQ ID NO: 189946 - DNA, 75 bp, Artificial Sequence
  Synthetic
cggccagagccaacagccccgccagcagagagcttcgggttccgagaggagataaacccctctccgaggcaggag

SEQ ID NO: 189947 - DNA, 75 bp, Artificial Sequence
  Synthetic
cggccagagccaacagccccgccagcagagagcttcgggttccgagaggagataatcccctctccgaggcaggag

SEQ ID NO: 189948 - DNA, 75 bp, Artificial Sequence
  Synthetic
cggccagagccaacagccccgccagcagagagcttcgggttccgagaggagataaccccctctccgaggcaggag

SEQ ID NO: 189949 - DNA, 75 bp, Artificial Sequence
  Synthetic
cggccagagccaacagccccgccagcagagagcttcgggttccgagaggagataagcccctctccgaggcaggag

SEQ ID NO: 189950 - DNA, 75 bp, Artificial Sequence
  Synthetic
cggccagagccaacagccccgccagcagagagcttcgggttcggagaggagataaacccctctccgaggcaggag

SEQ ID NO: 189951 - DNA, 75 bp, Artificial Sequence
  Synthetic
cggccagagccaacagccccgccagcagagagcttcgggttcggagaggagataatcccctctccgaggcaggag

SEQ ID NO: 189952 - DNA, 75 bp, Artificial Sequence
  Synthetic
cggccagagccaacagccccgccagcagagagcttcgggttcggagaggagataaccccctctccgaggcaggag

SEQ ID NO: 189953 - DNA, 75 bp, Artificial Sequence
  Synthetic
cggccagagccaacagccccgccagcagagagcttcgggttcggagaggagataagcccctctccgaggcaggag

SEQ ID NO: 189954 - DNA, 75 bp, Artificial Sequence
  Synthetic
acacatggaattaagccagtggtatcaactcaactactgttaaatggtagcctagcagaagaagagataataatt

SEQ ID NO: 189955 - DNA, 75 bp, Artificial Sequence
  Synthetic
atgataccagtagtacaaatgataccagcagggtaaatgttaccagtgttaggaaagaagtaaaaaattgcactt

SEQ ID NO: 189956 - DNA, 75 bp, Artificial Sequence
  Synthetic
gtggcgcccgaacagggacttgaaaacgaaagtagaaccagagaagaactctcgacgcaggactcggcttgctga

SEQ ID NO: 189957 - DNA, 75 bp, Artificial Sequence
  Synthetic
ttgtacaagacccaacaacaatacaagaaaaagtatacatataggaccagggagagcattttatgcaacaggaga

SEQ ID NO: 189958 - DNA, 75 bp, Artificial Sequence
  Synthetic
atttgactagcggaggctagaaggagagagatgggtgcgagagcgtcaatattaagagggggaaaattagataaa

SEQ ID NO: 189959 - DNA, 75 bp, Artificial Sequence
  Synthetic
aagctttagaaaagatagaggaagagcaaaacaaaagtaaaagaaaaaaggcacagcaagcagaagctggcgcag

SEQ ID NO: 189960 - DNA, 75 bp, Artificial Sequence
  Synthetic
ctaaccacactggaaatgctacctttagtcctaaagacactgaaggaatgagaaattgctctttcaatataacca

SEQ ID NO: 189961 - DNA, 75 bp, Artificial Sequence
  Synthetic
aaattgtaatacctcaaccataacacaagcctgtccaaaggtcacttttgacccaattcctatacattattgtgc

SEQ ID NO: 189962 - DNA, 75 bp, Artificial Sequence
  Synthetic
acaaggaaaagcatagggctaggaccaggacgagcattctttgcacatggagacataattggagacataagacaa

SEQ ID NO: 189963 - DNA, 75 bp, Artificial Sequence
  Synthetic
cgagcaagctacacaggaagtaaaaaactggatgacagaaaccttgttggtccaaaatgcaaacccagattgtaa

SEQ ID NO: 189964 - DNA, 75 bp, Artificial Sequence
  Synthetic
acaaccaatggcactaccccaaccagtacggtaaatataacaaatgaagtaaaaaactgttcttttaatgtgacc

SEQ ID NO: 189965 - DNA, 75 bp, Artificial Sequence
  Synthetic
accaaaaaggagaaagccacctttgcctagtgttaggaaactgacagaggatagatggaacaagccccagaagac

SEQ ID NO: 189966 - DNA, 75 bp, Artificial Sequence
  Synthetic
ctccgaagcaggagcagaaggacgagggactgtaccctcccttagcttccctcaaatcactctttggcaacgacc

SEQ ID NO: 189967 - DNA, 75 bp, Artificial Sequence
  Synthetic
aagaacaagtataaacataggaccaggacaagtattctattatagaccaggagatgtaataggagatataagaaa

SEQ ID NO: 189968 - DNA, 75 bp, Artificial Sequence
  Synthetic
aactagtagaggatagatggaacaagccccagaagaccagggaccacagagagaaccacacaatgaatggacact

SEQ ID NO: 189969 - DNA, 75 bp, Artificial Sequence
  Synthetic
tcaaaaagcagcatagttggatggcctgctgtaagagaaagaataagaaaaactgagccagcagcagaaggagta

SEQ ID NO: 189970 - DNA, 75 bp, Artificial Sequence
  Synthetic
cccaggaagtcagcctaaaactgcttgtaacacgtgttattgtaaaaagtgttgctttcattgtcaagtttgctt

SEQ ID NO: 189971 - DNA, 75 bp, Artificial Sequence
  Synthetic
accagctcttcagacaggaacagaagaacttagatcattattcaacacagtagcaactctctattgtgtacatga

SEQ ID NO: 189972 - DNA, 75 bp, Artificial Sequence
  Synthetic
taatgaatgctttaacaatagtaaacatagtagcattaatagtagcatttattttagcagtagttgtgtggacca

SEQ ID NO: 189973 - DNA, 75 bp, Artificial Sequence
  Synthetic
taatgaatgctttaacaatagtaatcatagtagcattaatagtagcatttattttagcagtagttgtgtggacca

SEQ ID NO: 189974 - DNA, 75 bp, Artificial Sequence
  Synthetic
taatgaatgctttaacaatagtaaccatagtagcattaatagtagcatttattttagcagtagttgtgtggacca

SEQ ID NO: 189975 - DNA, 75 bp, Artificial Sequence
  Synthetic
taatgaatgctttaacaatagtaagcatagtagcattaatagtagcatttattttagcagtagttgtgtggacca

SEQ ID NO: 189976 - DNA, 75 bp, Artificial Sequence
  Synthetic
taatgaatgctttatcaatagtaaacatagtagcattaatagtagcatttattttagcagtagttgtgtggacca

SEQ ID NO: 189977 - DNA, 75 bp, Artificial Sequence
  Synthetic
taatgaatgctttatcaatagtaatcatagtagcattaatagtagcatttattttagcagtagttgtgtggacca

SEQ ID NO: 189978 - DNA, 75 bp, Artificial Sequence
  Synthetic
taatgaatgctttatcaatagtaaccatagtagcattaatagtagcatttattttagcagtagttgtgtggacca

SEQ ID NO: 189979 - DNA, 75 bp, Artificial Sequence
  Synthetic
taatgaatgctttatcaatagtaagcatagtagcattaatagtagcatttattttagcagtagttgtgtggacca

SEQ ID NO: 189980 - DNA, 75 bp, Artificial Sequence
  Synthetic
taatgaatgctttaccaatagtaaacatagtagcattaatagtagcatttattttagcagtagttgtgtggacca

SEQ ID NO: 189981 - DNA, 75 bp, Artificial Sequence
  Synthetic
taatgaatgctttaccaatagtaatcatagtagcattaatagtagcatttattttagcagtagttgtgtggacca

SEQ ID NO: 189982 - DNA, 75 bp, Artificial Sequence
  Synthetic
taatgaatgctttaccaatagtaaccatagtagcattaatagtagcatttattttagcagtagttgtgtggacca

SEQ ID NO: 189983 - DNA, 75 bp, Artificial Sequence
  Synthetic
taatgaatgctttaccaatagtaagcatagtagcattaatagtagcatttattttagcagtagttgtgtggacca

SEQ ID NO: 189984 - DNA, 75 bp, Artificial Sequence
  Synthetic
taatgaatgctttagcaatagtaaacatagtagcattaatagtagcatttattttagcagtagttgtgtggacca

SEQ ID NO: 189985 - DNA, 75 bp, Artificial Sequence
  Synthetic
taatgaatgctttagcaatagtaatcatagtagcattaatagtagcatttattttagcagtagttgtgtggacca

SEQ ID NO: 189986 - DNA, 75 bp, Artificial Sequence
  Synthetic
taatgaatgctttagcaatagtaaccatagtagcattaatagtagcatttattttagcagtagttgtgtggacca

SEQ ID NO: 189987 - DNA, 75 bp, Artificial Sequence
  Synthetic
taatgaatgctttagcaatagtaagcatagtagcattaatagtagcatttattttagcagtagttgtgtggacca

SEQ ID NO: 189988 - DNA, 75 bp, Artificial Sequence
  Synthetic
ctttgcaataaaatgggggccaagtggtcacgaagcagtgcagttggatggcctgctgtaagggagagaataaga

SEQ ID NO: 189989 - DNA, 75 bp, Artificial Sequence
  Synthetic
agacctcaggtacctttaagaccaatgacttataagggagcagtcgatctcagcttctttttaaaagaaaagggg

SEQ ID NO: 189990 - DNA, 75 bp, Artificial Sequence
  Synthetic
gatggaaaggatcaccagcaatattccaatgtagcatgacaaaaatcttagagccctttagaaaacaaaatccag

SEQ ID NO: 189991 - DNA, 75 bp, Artificial Sequence
  Synthetic
aaaaacaagatggtagagcagatgcatacagatataattagtctatgggatcaaagcctaaagccatgtgtaagt

SEQ ID NO: 189992 - DNA, 75 bp, Artificial Sequence
  Synthetic
gggatcaaagcctaaagccatgtgtaaaattaaccccactctgtgttactttaaattgcactgatttgaacagta

SEQ ID NO: 189993 - DNA, 75 bp, Artificial Sequence
  Synthetic
ggcatgggggtttactacaccagacaaaaaacatcagaaagaacctccattcctttggatggggtatgaactcca

SEQ ID NO: 189994 - DNA, 75 bp, Artificial Sequence
  Synthetic
aagaataagacagggctttgaagcagctttgcaataaaatggggggcaagtggtcaaaatgcagtggatggcctg

SEQ ID NO: 189995 - DNA, 75 bp, Artificial Sequence
  Synthetic
ctttcaatattaccacagagataagagatagggtgcaagaagaatatgcacttttttataaacttgatgtagtac

SEQ ID NO: 189996 - DNA, 75 bp, Artificial Sequence
  Synthetic
actgctcttataatatgaccacaggattaagtgataggagactgaaagtatactcacttttctataaactagata

SEQ ID NO: 189997 - DNA, 75 bp, Artificial Sequence
  Synthetic
tagacatggagcacttacaaccagcaatacagacaccaataatgctgcttgtgcctggctaagagcgcaagagga

SEQ ID NO: 189998 - DNA, 75 bp, Artificial Sequence
  Synthetic
tatagattaataagttgtaatacctcagttgttaaacaggcttgtccaaaggtaacctttgagccaattcccata

SEQ ID NO: 189999 - DNA, 75 bp, Artificial Sequence
  Synthetic
agaaggtggcgagcaaggcagagacagatccgtgcgcttagtgagcggattcttagcacttgcgtgggacgatct

SEQ ID NO: 190000 - DNA, 75 bp, Artificial Sequence
  Synthetic
gtctttgctataacatgggaggcaagtggtcaaaaagtagcatagtgggatggcctcaggtcagggaaagaataa

SEQ ID NO: 190001 - DNA, 75 bp, Artificial Sequence
  Synthetic
tagaacgattcgcagttaatcctggcctgttagaaacagcagaaggctgtagacaaatactggaacagctacaac

SEQ ID NO: 190002 - DNA, 75 bp, Artificial Sequence
  Synthetic
gaagaagtgatgacagcatgtcagggagtgggaggacccggccacaaagcaagggtgttggctgaggcaatgagc

SEQ ID NO: 190003 - DNA, 75 bp, Artificial Sequence
  Synthetic
cctgttagaaacagcagaaggctgtagacaaatactggaacagctacaaccaagccttcagacaggatcagaaga

SEQ ID NO: 190004 - DNA, 75 bp, Artificial Sequence
  Synthetic
acaaaggaaaatagataggttaattgatagaataagagaaagagcagaagacagtggcaatgaaagtgaggggga

SEQ ID NO: 190005 - DNA, 75 bp, Artificial Sequence
  Synthetic
gggaaggtctcaaatacctggggaatctcctgttgtattgggttcgggaactaagaaatagtgctgtttctttgc

SEQ ID NO: 190006 - DNA, 75 bp, Artificial Sequence
  Synthetic
tgctatcattgccaattgtgctttataaacaaaggcttaggcatctcctatggcaggaagaagcggagaccccga

SEQ ID NO: 190007 - DNA, 75 bp, Artificial Sequence
  Synthetic
actcctccagcagcaacaggagtaggagcagtatctcaggatttaggtaaacatggagcagttacaagcagtaat

SEQ ID NO: 190008 - DNA, 75 bp, Artificial Sequence
  Synthetic
tcaaaagacttgatagctgaaatacagaaacaggggcatgaccaatggacatatcaaatttaccaagaaccattc

SEQ ID NO: 190009 - DNA, 75 bp, Artificial Sequence
  Synthetic
aaaggatcaacagctcctagggatttggggctactctggaaaactcatctgcaccactactgtgccttggaatga

SEQ ID NO: 190010 - DNA, 75 bp, Artificial Sequence
  Synthetic
tgcaataataggactgatagtagcattcatcttagcaatagttgtgtggactatagtacttatagaatataagaa

SEQ ID NO: 190011 - DNA, 75 bp, Artificial Sequence
  Synthetic
cttgaagactcgcaaatccagcaggaaagaaatgaaaaagatttactagcattggacagctggaaaaatctgtgg

SEQ ID NO: 190012 - DNA, 75 bp, Artificial Sequence
  Synthetic
cagacactttcctagaccatggctccatagcttaggacaatatatctatgaaacatatggggatacttggacagg

SEQ ID NO: 190013 - DNA, 75 bp, Artificial Sequence
  Synthetic
agtcgaagctctaataagaacactgcaacaactactgtttactcatttcagaattgggtgccagcatagcagaat

SEQ ID NO: 190014 - DNA, 75 bp, Artificial Sequence
  Synthetic
agaatataagaaattggtaaggcaaagaaaaataaataggttatataaaagaataagagaaagagcagaagacag

SEQ ID NO: 190015 - DNA, 75 bp, Artificial Sequence
  Synthetic
cagcaggcagcaagggctgaaggaaacagcaaccaagtcagtcaaaattatcctatagtgcagaatgcacaagga

SEQ ID NO: 190016 - DNA, 75 bp, Artificial Sequence
  Synthetic
ctagaatatagaaaattggtaaaacaaaggaaaatagactggttaattgaaagaattagggaaagagcagaagac

SEQ ID NO: 190017 - DNA, 75 bp, Artificial Sequence
  Synthetic
gctataaaatggggaacaagtggtcaaaaagctggcctgctgtaagagaaagaataagaagaactgagcccgctg

SEQ ID NO: 190018 - DNA, 75 bp, Artificial Sequence
  Synthetic
aaaaagctggcctgctgtaagagaaagaataagaagaactgagcccgctgtaagagtaaggagaactgagccagc

SEQ ID NO: 190019 - DNA, 75 bp, Artificial Sequence
  Synthetic
tatctatcaatacatggatgatttgtatgtaggatctgatttagaaatagggcagcatagaacaaaaatagagga

SEQ ID NO: 190020 - DNA, 75 bp, Artificial Sequence
  Synthetic
gtaacatgacagaagaaatgagaaactgctcgtacaatacaaccacagaaataagagataaaaaacagaaagtac

SEQ ID NO: 190021 - DNA, 75 bp, Artificial Sequence
  Synthetic
agtgggagaaatttataaaagatggataattctggggttaaataaaatagtgagaatgtatagccctgtcagcat

SEQ ID NO: 190022 - DNA, 75 bp, Artificial Sequence
  Synthetic
tccaccaccaactccactaccctgaaagaagagacaggggcagtacaaaactgttctttcaatatgactacagaa

SEQ ID NO: 190023 - DNA, 75 bp, Artificial Sequence
  Synthetic
ccttctatacaaatgacataataggggatataaaaaaagcattttgtagtatcaacaaaacaaaatgggataata

SEQ ID NO: 190024 - DNA, 75 bp, Artificial Sequence
  Synthetic
aagtgtacatataggaccaggacaagcattctatgcaacaggtgacataataggggatataagaaaagcacattg

SEQ ID NO: 190025 - DNA, 75 bp, Artificial Sequence
  Synthetic
gcattctatgcaacaggtgacataataggggatataagaaaagcacattgtaatgtcagtagagcaaaatggaat

SEQ ID NO: 190026 - DNA, 75 bp, Artificial Sequence
  Synthetic
aatacccatgttttcagcattatcagaaggagccaccccacaagatttaaacaccatgttaaatacagtgggggg

SEQ ID NO: 190027 - DNA, 75 bp, Artificial Sequence
  Synthetic
aggaggggacctagaaattacaacacatagctttaattgtcaaggagaatttttctattgcaatacatcacaact

SEQ ID NO: 190028 - DNA, 75 bp, Artificial Sequence
  Synthetic
tataaagtagtagagattcaaccactaggaatagcacccaccagggcaaaaagacaagtggtgaagagagaaaaa

SEQ ID NO: 190029 - DNA, 75 bp, Artificial Sequence
  Synthetic
aaatagagttaggcagggatactcacctttgtcatttcagacccataccccaagcccagggggactcgacaggcc

SEQ ID NO: 190030 - DNA, 75 bp, Artificial Sequence
  Synthetic
ggggacttagaaattacaacacatagttttaattgtagaggagaatttttctattgcaatacatcagaactgttt

SEQ ID NO: 190031 - DNA, 75 bp, Artificial Sequence
  Synthetic
attagtaataagaacatattggggtctgcagacaggagaaaaagactggcaattgggtcatggagtctccataga

SEQ ID NO: 190032 - DNA, 75 bp, Artificial Sequence
  Synthetic
cactttagattgtacaaatgtaactggtaatgttagtactgaggataaagaagaaataaaaaattgctctttcaa

SEQ ID NO: 190033 - DNA, 75 bp, Artificial Sequence
  Synthetic
agagctggtagagcttttcttcacatacctagaagaatcagacagggcctagaaaggcttctgctataacatggg

SEQ ID NO: 190034 - DNA, 75 bp, Artificial Sequence
  Synthetic
gctattagcttgcttaataccacagcagtagtagtagctgaggggacagatagagttatagaagctttgcaaaga

SEQ ID NO: 190035 - DNA, 75 bp, Artificial Sequence
  Synthetic
actactgttaaatggtagcctagcagaaggagagataataattagatctgaaaacctgacagacaatgtcaaaac

SEQ ID NO: 190036 - DNA, 75 bp, Artificial Sequence
  Synthetic
gctggtagagctattctcaacatacctagaagaataagacagggcttagaaagggctttgctataaaatgggtgg

SEQ ID NO: 190037 - DNA, 75 bp, Artificial Sequence
  Synthetic
gaagcggaagcaccgacgaggaactcctcagagcagtaaggatcatcaaaatcctgtaccaaagcagtaagtaat

SEQ ID NO: 190038 - DNA, 75 bp, Artificial Sequence
  Synthetic
caagatttagataaatatggagcagtcacaagtactaacatgacaagtgctagttgcacctggctagaagcacaa

SEQ ID NO: 190039 - DNA, 75 bp, Artificial Sequence
  Synthetic
tagagataaaagacaccaaggaagctctagataaaatagaggaaatacagaataagagcaaacaaaaacagatag

SEQ ID NO: 190040 - DNA, 75 bp, Artificial Sequence
  Synthetic
aaggaagagggagaagaagtaggctttccagtcagaccacaagtgcctttaagacccatgacttataaagcagct

SEQ ID NO: 190041 - DNA, 75 bp, Artificial Sequence
  Synthetic
agaaagactaaggaaaactgagccagcagcagagggagtaggagccgtgtctcaagacttagctagacatggagc

SEQ ID NO: 190042 - DNA, 75 bp, Artificial Sequence
  Synthetic
aagaacaaataggatggatgacaggcaacccacctatcccagtgggagacatctataaaagatggataatcctgg

SEQ ID NO: 190043 - DNA, 75 bp, Artificial Sequence
  Synthetic
acagtaggaaatataacagatgaagtaggaaatggaagagatgaactaaaaaactgtacctttaatatgaccaca

SEQ ID NO: 190044 - DNA, 75 bp, Artificial Sequence
  Synthetic
ggcagggcctattgcaccaggccaaataagagaaccaaggggaagtgatatagcaggaactactagtacccttca

SEQ ID NO: 190045 - DNA, 75 bp, Artificial Sequence
  Synthetic
tactaccagtagtaataccagtagtacaacagggatagggttagaaatgaaaaactgctctttcaatatcaccac

SEQ ID NO: 190046 - DNA, 75 bp, Artificial Sequence
  Synthetic
aagaagaaggtggagagcaagacagagacagatcaattcgattggtgaacggattcttagcacttttctgggaag

SEQ ID NO: 190047 - DNA, 75 bp, Artificial Sequence
  Synthetic
tattgtaaaaagtgctgctttcattgccaagtttgtttcacaaaaaaaggcttaggcatctcctatggcaggaag

SEQ ID NO: 190048 - DNA, 75 bp, Artificial Sequence
  Synthetic
agaaatgatgacagcatgtcaaggagtgggggggcccagccataaagcaagagttttggctgaggcaatgagcca

SEQ ID NO: 190049 - DNA, 75 bp, Artificial Sequence
  Synthetic
atcgcaaatccagcaggaacaaaatgaaaaagatttattagcattggacaagtggcaaaatctgtggagttggtt

SEQ ID NO: 190050 - DNA, 75 bp, Artificial Sequence
  Synthetic
gccagggaatttcctccagagcaggccagaaccctcagccccaccagcagagagcttcgggtttggagaggagat

SEQ ID NO: 190051 - DNA, 75 bp, Artificial Sequence
  Synthetic
aggcatctcctatggcaggaagaagcggaggcagcgacgaagagcttctcgcagcagtcaaagtcatcaagatct

SEQ ID NO: 190052 - DNA, 75 bp, Artificial Sequence
  Synthetic
ccagatagagaaccaatgaaaaactgctctttcgatgtcaccacaagcctaagagataagattacaaaagaatat

SEQ ID NO: 190053 - DNA, 75 bp, Artificial Sequence
  Synthetic
gccttttagaaacatcagaaggctgtaaacaaataataaaacagctacaaccagctcttcagacaggaacagagg

SEQ ID NO: 190054 - DNA, 75 bp, Artificial Sequence
  Synthetic
atgagagtgagggggacacagaggaattggcaaaacttgtggaaatggggaactttgatccttgggttggtgata

SEQ ID NO: 190055 - DNA, 75 bp, Artificial Sequence
  Synthetic
gtagaaattaattgtacaagacccggctacaacacaataaaaagggtatcgataggaccaggaagaggaagagca

SEQ ID NO: 190056 - DNA, 75 bp, Artificial Sequence
  Synthetic
taaacttgatgtagtaccaatagataatgataataccagctataggttgataaattgtaacacctcagtcattac

SEQ ID NO: 190057 - DNA, 75 bp, Artificial Sequence
  Synthetic
acaccagacaaaaaacatcagaaagaacctccattcctttggatgggatatgaactccatcctgacaaatggaca

SEQ ID NO: 190058 - DNA, 75 bp, Artificial Sequence
  Synthetic
atggggaaagacccctaaatttagactacccatacaaaaggaaacatgggaaacatggtggacagagtattggca

SEQ ID NO: 190059 - DNA, 75 bp, Artificial Sequence
  Synthetic
agatgaaataaaaaactgctcttataatatgaccacaggattaagagataggagacagaaagtatactcactttt

SEQ ID NO: 190060 - DNA, 75 bp, Artificial Sequence
  Synthetic
cagtacaatgtacacatggaattaggccagtagtgtcaactcaactgctgttaaatggcagtctagcagaagaag

SEQ ID NO: 190061 - DNA, 75 bp, Artificial Sequence
  Synthetic
ttatatagtagatgtaatgttagatttagcagcaagagtagattataggataggaatagcagcatttacagtagc

SEQ ID NO: 190062 - DNA, 75 bp, Artificial Sequence
  Synthetic
agtacaatgcacacatggaatcaagccagtagtatcaactcaactgctgttaaatggcagcctagcagaagaaga

SEQ ID NO: 190063 - DNA, 75 bp, Artificial Sequence
  Synthetic
aaaattgcacttacaatgtaaccacagtactaaaagataagaaaaagagtgaatatgcacttttttataaacttg

SEQ ID NO: 190064 - DNA, 75 bp, Artificial Sequence
  Synthetic
ggattggaggaaatgaacaagtagataaattagtcagtaatggaatcagaaaaatactatttttggatgggatag

SEQ ID NO: 190065 - DNA, 75 bp, Artificial Sequence
  Synthetic
tttctatagtgaatagagttaggcagggatactcaccattatcattgcagacccttatcccagtctcgaggggac

SEQ ID NO: 190066 - DNA, 75 bp, Artificial Sequence
  Synthetic
gtgccttggaactctagctggagtaataaaactcagagtgaaatatgggataacatgacctggctgcaatgggat

SEQ ID NO: 190067 - DNA, 75 bp, Artificial Sequence
  Synthetic
aaaggtgtgaggatagggccaggacaaacattttatgcaacaggagacataataggagacataagacaagcatat

SEQ ID NO: 190068 - DNA, 75 bp, Artificial Sequence
  Synthetic
attcgccacatacctagaagaataagacagggcttggaaaggattttgctataagatgggtggcaagtggtcaaa

SEQ ID NO: 190069 - DNA, 75 bp, Artificial Sequence
  Synthetic
agatattcagacctgcaggaggagatatgagggacaattggagaagtgaattatataaatataaagtggtagaaa

SEQ ID NO: 190070 - DNA, 75 bp, Artificial Sequence
  Synthetic
agcatagtaatatggggaaagactcctaaatttagattacccatccaaaaagaaacatgggagacatggtggaca

SEQ ID NO: 190071 - DNA, 75 bp, Artificial Sequence
  Synthetic
agagtcagggatggatccggtagatcctaacctagagccctggaaccatccgggaagtcagcctacaactgcttg

SEQ ID NO: 190072 - DNA, 75 bp, Artificial Sequence
  Synthetic
ttcgaaagggctttacaataacatgggtggcaagtggtcaaaaagtagcatagtgggatggccagctataaggga

SEQ ID NO: 190073 - DNA, 75 bp, Artificial Sequence
  Synthetic
aaagatagatgtaagagacaccaaggaagctttagacaagatagaggaagagcaaaacaaaagtaagaaaaaagc

SEQ ID NO: 190074 - DNA, 75 bp, Artificial Sequence
  Synthetic
ggtggcaagtggtcaaaaagtagcatagtgggatggccagctataagggaaagaataaggagaactcctccaaca

SEQ ID NO: 190075 - DNA, 75 bp, Artificial Sequence
  Synthetic
ggctagaagcacaagaggacgaggatgtgggctttccagtcagacctcaggtaccattaagaccaatgacttata

SEQ ID NO: 190076 - DNA, 75 bp, Artificial Sequence
  Synthetic
agccacctttgcccagtgttaggaagctaacagaagacagatggaacaagccccagaggaccaagggccacagag

SEQ ID NO: 190077 - DNA, 75 bp, Artificial Sequence
  Synthetic
tacagtggggggacatcaagcagccatgcaaatgttaaaagaaaccatcaatgaggaagctgcagaatgggatag

SEQ ID NO: 190078 - DNA, 75 bp, Artificial Sequence
  Synthetic
aagctgttagacattttcctaggccatggcttcatgacttaggacagcatatctataacacctatggggatactt

SEQ ID NO: 190079 - DNA, 75 bp, Artificial Sequence
  Synthetic
caatacaagaaaaagtatacatataggaccagggagggcattttatgcaacaggagacataataggagatataag

SEQ ID NO: 190080 - DNA, 75 bp, Artificial Sequence
  Synthetic
gtgacagaagagtttaatatgtggaaaaataacatggtagagcaaatgcatacagatataatcagtctatgggac

SEQ ID NO: 190081 - DNA, 75 bp, Artificial Sequence
  Synthetic
ctggattcctgagtgggagtttgttaatacccctcccctagtaaaattatggtaccagctggagaaagaacccat

SEQ ID NO: 190082 - DNA, 75 bp, Artificial Sequence
  Synthetic
ttattgaggtgggtgactatcatcttgtggataatcataatttgtagtgctgaaaagttgtgggttacagtatac

SEQ ID NO: 190083 - DNA, 75 bp, Artificial Sequence
  Synthetic
atcaccaataatgaaatgacaaactgctcttacagtattaccacagaactgaaggataagaaacagaaagtatat

SEQ ID NO: 190084 - DNA, 75 bp, Artificial Sequence
  Synthetic
ccggccataaagcaagagttttggctgaagcaatgagccaaatgacaaattcagctaccataatgatgcagagag

SEQ ID NO: 190085 - DNA, 75 bp, Artificial Sequence
  Synthetic
gcactcctccaagcagtgaggatcatcaagattctgtactcaagcagtaagtatatgtaatgttgaatttactag

SEQ ID NO: 190086 - DNA, 75 bp, Artificial Sequence
  Synthetic
aagacaaaagaaaatagactggttagttaaaagaattagggaaagagcagaagacagtggcaatgagagtgaggg

SEQ ID NO: 190087 - DNA, 75 bp, Artificial Sequence
  Synthetic
tttgatagtgaaatgaaaaaggaaataaaaaactgcactttcaatacgaccacagaaagaatagataaaaaagag

SEQ ID NO: 190088 - DNA, 75 bp, Artificial Sequence
  Synthetic
acagaaaattttaacatgtggaaaaatgacatggtagatcagatgcatgaggatataattagtttatgggatcaa

SEQ ID NO: 190089 - DNA, 75 bp, Artificial Sequence
  Synthetic
aaagtgtacgtataggacctggacaaacattctatgcaacagacataataggggatataagacaagcacattgta

SEQ ID NO: 190090 - DNA, 75 bp, Artificial Sequence
  Synthetic
acccccactagcaaccccaatgacaccctgaaggaagagcaaggggcaatacaaaactgtactttcaatataacc

SEQ ID NO: 190091 - DNA, 75 bp, Artificial Sequence
  Synthetic
ccaacaagaaaagaatgaacaagatttattacaattggatacgtgggcaagtttgtggaattggtttagtatatc

SEQ ID NO: 190092 - DNA, 75 bp, Artificial Sequence
  Synthetic
attttcttcagagcagaccaggaccaacagccccaccagagagcagaccagagccaacagccccaccagcagaga

SEQ ID NO: 190093 - DNA, 75 bp, Artificial Sequence
  Synthetic
ggtaggtataggaccaggacaagcattccatgcaacaggtaatataataggagacataagacgagcacagtgtaa

SEQ ID NO: 190094 - DNA, 75 bp, Artificial Sequence
  Synthetic
gttttaattgtggaggagagtttttctattgcaatacatcaggactatttaatagcacttggagtaggaatagca

SEQ ID NO: 190095 - DNA, 75 bp, Artificial Sequence
  Synthetic
cttaatgaatctgtacagattaattgtacaaggcccaacaacaatacaagaaaaagtatacctttaggaccagga

SEQ ID NO: 190096 - DNA, 75 bp, Artificial Sequence
  Synthetic
cccatgtagaataaaacaaattataaacatgtggcagggagtaggacaagcaatgtatgccgctcccattgcagg

SEQ ID NO: 190097 - DNA, 75 bp, Artificial Sequence
  Synthetic
aacatgtggcagggagtaggacaagcaatgtatgccgctcccattgcaggaaatattacctgtaactcaaatatt

SEQ ID NO: 190098 - DNA, 75 bp, Artificial Sequence
  Synthetic
caatgtatgccgctcccattgcaggaaatattacctgtaactcaaatattacagggatactattgacaagagatg

SEQ ID NO: 190099 - DNA, 75 bp, Artificial Sequence
  Synthetic
agtggtaagagataagacgaaggcagtgcatgcacttttttatagacttgatatagtaccacttaatgaggagac

SEQ ID NO: 190100 - DNA, 75 bp, Artificial Sequence
  Synthetic
ccctggctccatggcttaggacagtacatctataacacttatggggatacttgggaaggggttgaagctataata

SEQ ID NO: 190101 - DNA, 75 bp, Artificial Sequence
  Synthetic
gtgtgccctggaactctagttggagtaataaatctcaggaggagatttgggaaaacatgacctggatgcagtggg

SEQ ID NO: 190102 - DNA, 75 bp, Artificial Sequence
  Synthetic
cctggctggaagcgcaagaggaagaggaggtaggctttccagtcaggccacaggtacctgtaagaccaatgactt

SEQ ID NO: 190103 - DNA, 75 bp, Artificial Sequence
  Synthetic
gggggatcttctgttatactggggtcgggaactaaagaatagtgctattaatttgcttgatacagtagcaatagc

SEQ ID NO: 190104 - DNA, 75 bp, Artificial Sequence
  Synthetic
aaaaaattcggttaaggccagggggaaagaaaaaatatagaatgaaacatttagtatgggcaagcagggagctgg

SEQ ID NO: 190105 - DNA, 75 bp, Artificial Sequence
  Synthetic
ctcgggttagggaaagaatgagacaaaaccctccagaaggggttagggaaagaatgagacaaaaccctccagcag

SEQ ID NO: 190106 - DNA, 75 bp, Artificial Sequence
  Synthetic
tcttgtgcagtattggggtctggaactaaaaaagagtgctattagtctgcttgataccatagcaatagcagtagc

SEQ ID NO: 190107 - DNA, 75 bp, Artificial Sequence
  Synthetic
tgaaataaaaaattgctctttcaatgtaaccacagaagtgagagataagaaaaagcaagtgtatgcacttttcta

SEQ ID NO: 190108 - DNA, 75 bp, Artificial Sequence
  Synthetic
cattgggaccagcagctacactagaagaaatgatgacagcatgtcagggagtggggggacccagccataaagcaa

SEQ ID NO: 190109 - DNA, 75 bp, Artificial Sequence
  Synthetic
ataggatagttggatggcctgctataagggaaagaatgagacgaacccctccagcagcaggagcagcagcagaag

SEQ ID NO: 190110 - DNA, 75 bp, Artificial Sequence
  Synthetic
tagttggatggcctgctgtaagagacagaatgagacgagctgagccagcagcagaaggagtaggaccagcatcta

SEQ ID NO: 190111 - DNA, 75 bp, Artificial Sequence
  Synthetic
ccagcaagaaaagaatgaacaagaattattggaattggataaatgggcaagtttgtggaattggtttaacataac

SEQ ID NO: 190112 - DNA, 75 bp, Artificial Sequence
  Synthetic
tgaaagacaggctaattttttagggagaatttggccttccagcaaagggaggccaggaaattttcctcagaacag

SEQ ID NO: 190113 - DNA, 75 bp, Artificial Sequence
  Synthetic
taaataaaatagtaagaatgtatagccctgtcagcattttggacataagacagggaccaaaggaaccttttagag

SEQ ID NO: 190114 - DNA, 75 bp, Artificial Sequence
  Synthetic
gagaggcaggctaattttttagggaaaatttggccttcccacaaggggaggccagggaacttccttcagagcaga

SEQ ID NO: 190115 - DNA, 75 bp, Artificial Sequence
  Synthetic
gaaattattaagacaaagaaaaatagacaggttaattaaaagaataagtgaaagagcagaagacagtggcaatga

SEQ ID NO: 190116 - DNA, 75 bp, Artificial Sequence
  Synthetic
tttcaagatcacatcaggcataagagataaagttcaggaaacatttgcatttttttataagcctgacatagtacc

SEQ ID NO: 190117 - DNA, 75 bp, Artificial Sequence
  Synthetic
gctacactagaagaaatgatgacagcatgccagggagtgggaggacccggccataaagcaagagttttggctgaa

SEQ ID NO: 190118 - DNA, 75 bp, Artificial Sequence
  Synthetic
tatagaataggaatagcagcatttgcagtagcactaatcatagcaataattgtgtggaccatagtatatatagaa

SEQ ID NO: 190119 - DNA, 75 bp, Artificial Sequence
  Synthetic
actatataaagaaatagaactattaacaatagtagtatgaaaggagaaataaaaaactgttctttcaatatcacc

SEQ ID NO: 190120 - DNA, 75 bp, Artificial Sequence
  Synthetic
agatggagggagaaataaaaaactgctctttcaatgtcaccacaagcataagaaataagatgcataaagaatatg

SEQ ID NO: 190121 - DNA, 75 bp, Artificial Sequence
  Synthetic
tgctgtaagagaaagaaggagacaaactgaaccagcagcagagggagtagcagcagagggagtaggaacagcatc

SEQ ID NO: 190122 - DNA, 75 bp, Artificial Sequence
  Synthetic
ctctttcaatataaccacagagctaaaagataagaaaaagaatgaacatgcacttttttatagacttgatatagt

SEQ ID NO: 190123 - DNA, 75 bp, Artificial Sequence
  Synthetic
gaataaaacaataatctttcagaattcaccctcaggaggagacccagaagttgtaatgcatagttttaattgtgc

SEQ ID NO: 190124 - DNA, 75 bp, Artificial Sequence
  Synthetic
atatgagggacaattggagaagtgaattatataaatacaaagtagtaagaattgaaccactaggaatagcaccca

SEQ ID NO: 190125 - DNA, 75 bp, Artificial Sequence
  Synthetic
tagaagaaatgatgacagcatgtcaaggagtgggaggaccaagccacaaagcaagagttttggctgaggcaatga

SEQ ID NO: 190126 - DNA, 75 bp, Artificial Sequence
  Synthetic
aagggacagatagaattttagaattattacaaagagcttttagagctgttcttcacatacccagaagaataagac

SEQ ID NO: 190127 - DNA, 75 bp, Artificial Sequence
  Synthetic
gaagaatcgcagaaccagcaggaaaagaatgagcaagacttattggcattggaccagtgggcaagtctgtggaat

SEQ ID NO: 190128 - DNA, 75 bp, Artificial Sequence
  Synthetic
cagcagcagatggggtgggagcagcatctcgagacctggaaaagcatggagcacttacaagtagcaatacaccag

SEQ ID NO: 190129 - DNA, 75 bp, Artificial Sequence
  Synthetic
ggtaaaagattatgcacttttttataaaagtgatgtagtaccaatagataatgataataccagctataggttaat

SEQ ID NO: 190130 - DNA, 75 bp, Artificial Sequence
  Synthetic
tcaatacaaccacagaaataagagataagaaacagcaagcgtatgcacttttttatagacctgatataataccac

SEQ ID NO: 190131 - DNA, 75 bp, Artificial Sequence
  Synthetic
atggcctgctgtaagagaaagaataagaagaactgagccagcagcagagggagtaggagcagcgtctcaagactt

SEQ ID NO: 190132 - DNA, 75 bp, Artificial Sequence
  Synthetic
aataaaaacatattggggtttgcaaacaggagaaagggaatggcatttgggtcatggatgctccatagaatggag

SEQ ID NO: 190133 - DNA, 75 bp, Artificial Sequence
  Synthetic
taccctatagtgcagaacatccaggggcaaatggtacatcagcccatatcacctagaactttaaatgcatgggta

SEQ ID NO: 190134 - DNA, 75 bp, Artificial Sequence
  Synthetic
ctgtcaatgatatacagaaattagtgggaaaactaaattgggcaagtcaaatttatgcagggattaaagtaaagc

SEQ ID NO: 190135 - DNA, 75 bp, Artificial Sequence
  Synthetic
tacttgggaaggggttgtagctataataagaattttgcaacaactactgtttattcatttcagaattgggtgcca

SEQ ID NO: 190136 - DNA, 75 bp, Artificial Sequence
  Synthetic
attgaaacatctagtatgggcaagcagggagctggaaagatttgcagttaaccccggcctgttagaaacagcaag

SEQ ID NO: 190137 - DNA, 75 bp, Artificial Sequence
  Synthetic
gggggtcagggaagaaataaaaaattgctctttcaatacaaccacagagataagggataagacacggaaagcatt

SEQ ID NO: 190138 - DNA, 75 bp, Artificial Sequence
  Synthetic
tcctcaggaggggacccagaaattgtaatgcacagctttaattgtggaggagaatttttctactgtaatacaaca

SEQ ID NO: 190139 - DNA, 75 bp, Artificial Sequence
  Synthetic
catagtatatatagaatataggaaaataagaaaacagaagaaaatagacaagttacttgatagaataagggaaag

SEQ ID NO: 190140 - DNA, 75 bp, Artificial Sequence
  Synthetic
ttgcaacaactactgtttattcatttcagaattgggtgtcatcatagcagaataggtattattcgacagagaaga

SEQ ID NO: 190141 - DNA, 75 bp, Artificial Sequence
  Synthetic
gagacagcgacgaagcgctcctcctagcggtgaggaccatcaaaatcctataccaaagcagtaagtattttgtaa

SEQ ID NO: 190142 - DNA, 75 bp, Artificial Sequence
  Synthetic
gctgtggaaagatacctaaaggatcaacagctcctagggatttggggttgctctggaaaactcatttgcaccact

SEQ ID NO: 190143 - DNA, 75 bp, Artificial Sequence
  Synthetic
aaaggagaagccatgcatggacaagtagactgtagtccaggaatatggcaattagattgtacacatttagaagga

SEQ ID NO: 190144 - DNA, 75 bp, Artificial Sequence
  Synthetic
ataactattgaaggtgacatggggaaggaaataaaaaactgctcttacaaggtgaccacagaactaagagataag

SEQ ID NO: 190145 - DNA, 75 bp, Artificial Sequence
  Synthetic
ggacaagcaatgtatgcccctcccatccaaggaataataaagtgtgaatcaaacattacaggactaatattaaca

SEQ ID NO: 190146 - DNA, 75 bp, Artificial Sequence
  Synthetic
gaaaaattgctctttcaatgtaaccacagaattaagagataagaagcacaaccagtatgcacttttttatagact

SEQ ID NO: 190147 - DNA, 75 bp, Artificial Sequence
  Synthetic
acatacctagaagaataagacagggctttgaagcagctttgctataaaatggggggcaagtggtcaaaaagcagc

SEQ ID NO: 190148 - DNA, 75 bp, Artificial Sequence
  Synthetic
ctgggaagttcaattaggaataccacatcctgcagggttaaaaaagaaaaaatcagtaacagtactggatgtggg

SEQ ID NO: 190149 - DNA, 75 bp, Artificial Sequence
  Synthetic
actaaagccactagcaaccccctgaggaagatcaaggagcaacaaaactgttccttcaatatgaccacagtagta

SEQ ID NO: 190150 - DNA, 75 bp, Artificial Sequence
  Synthetic
aaagaataagacgaactgagccagcagcagagggagtaggagcagcgtctcaagacttagataaacatggagcac

SEQ ID NO: 190151 - DNA, 75 bp, Artificial Sequence
  Synthetic
accaggacaagcattctatgcaagaggtgacataataggggatataagacaagcacattgtgaggtcaataaaac

SEQ ID NO: 190152 - DNA, 75 bp, Artificial Sequence
  Synthetic
attacaacacatagttttaattgtggaggagaattcttctattgcaatacatcaagactatttaatagtacttgg

SEQ ID NO: 190153 - DNA, 75 bp, Artificial Sequence
  Synthetic
attacaacacatagttttaattgtggaggagaattcttctattgctatacatcaagactatttaatagtacttgg

SEQ ID NO: 190154 - DNA, 75 bp, Artificial Sequence
  Synthetic
attacaacacatagttttaattgtggaggagaattcttctattgccatacatcaagactatttaatagtacttgg

SEQ ID NO: 190155 - DNA, 75 bp, Artificial Sequence
  Synthetic
attacaacacatagttttaattgtggaggagaattcttctattgcgatacatcaagactatttaatagtacttgg

SEQ ID NO: 190156 - DNA, 75 bp, Artificial Sequence
  Synthetic
attactacacatagttttaattgtggaggagaattcttctattgcaatacatcaagactatttaatagtacttgg

SEQ ID NO: 190157 - DNA, 75 bp, Artificial Sequence
  Synthetic
attactacacatagttttaattgtggaggagaattcttctattgctatacatcaagactatttaatagtacttgg

SEQ ID NO: 190158 - DNA, 75 bp, Artificial Sequence
  Synthetic
attactacacatagttttaattgtggaggagaattcttctattgccatacatcaagactatttaatagtacttgg

SEQ ID NO: 190159 - DNA, 75 bp, Artificial Sequence
  Synthetic
attactacacatagttttaattgtggaggagaattcttctattgcgatacatcaagactatttaatagtacttgg

SEQ ID NO: 190160 - DNA, 75 bp, Artificial Sequence
  Synthetic
attaccacacatagttttaattgtggaggagaattcttctattgcaatacatcaagactatttaatagtacttgg

SEQ ID NO: 190161 - DNA, 75 bp, Artificial Sequence
  Synthetic
attaccacacatagttttaattgtggaggagaattcttctattgctatacatcaagactatttaatagtacttgg

SEQ ID NO: 190162 - DNA, 75 bp, Artificial Sequence
  Synthetic
attaccacacatagttttaattgtggaggagaattcttctattgccatacatcaagactatttaatagtacttgg

SEQ ID NO: 190163 - DNA, 75 bp, Artificial Sequence
  Synthetic
attaccacacatagttttaattgtggaggagaattcttctattgcgatacatcaagactatttaatagtacttgg

SEQ ID NO: 190164 - DNA, 75 bp, Artificial Sequence
  Synthetic
attacgacacatagttttaattgtggaggagaattcttctattgcaatacatcaagactatttaatagtacttgg

SEQ ID NO: 190165 - DNA, 75 bp, Artificial Sequence
  Synthetic
attacgacacatagttttaattgtggaggagaattcttctattgctatacatcaagactatttaatagtacttgg

SEQ ID NO: 190166 - DNA, 75 bp, Artificial Sequence
  Synthetic
attacgacacatagttttaattgtggaggagaattcttctattgccatacatcaagactatttaatagtacttgg

SEQ ID NO: 190167 - DNA, 75 bp, Artificial Sequence
  Synthetic
attacgacacatagttttaattgtggaggagaattcttctattgcgatacatcaagactatttaatagtacttgg

SEQ ID NO: 190168 - DNA, 75 bp, Artificial Sequence
  Synthetic
tgggttttccagtcagacctcaggtacctttaagaccaatgacttacaaggcagctctagatcttagccactttt

SEQ ID NO: 190169 - DNA, 75 bp, Artificial Sequence
  Synthetic
gaggagaattcttctattgcaatacatcaagactatttaatagtacttgggataatggtaatttgactttcaatg

SEQ ID NO: 190170 - DNA, 75 bp, Artificial Sequence
  Synthetic
gaggagaattcttctattgctatacatcaagactatttaatagtacttgggataatggtaatttgactttcaatg

SEQ ID NO: 190171 - DNA, 75 bp, Artificial Sequence
  Synthetic
gaggagaattcttctattgccatacatcaagactatttaatagtacttgggataatggtaatttgactttcaatg

SEQ ID NO: 190172 - DNA, 75 bp, Artificial Sequence
  Synthetic
gaggagaattcttctattgcgatacatcaagactatttaatagtacttgggataatggtaatttgactttcaatg

SEQ ID NO: 190173 - DNA, 75 bp, Artificial Sequence
  Synthetic
ctagaagcacaagaggaggaggaggtgggttttccagtcagacctcaggtacctttaagaccaatgacttacaag

SEQ ID NO: 190174 - DNA, 75 bp, Artificial Sequence
  Synthetic
tatacatttaggaccagggcaagcattctatgcaacaggtgatataataggagacataagaaaggcacattgtaa

SEQ ID NO: 190175 - DNA, 75 bp, Artificial Sequence
  Synthetic
gtagcaattacaattttagtagcaatgttacctacaatgagaccgatgaagtaaaaaattgcactttcaatgcaa

SEQ ID NO: 190176 - DNA, 75 bp, Artificial Sequence
  Synthetic
catgcaataatgttagcacagtacaatgtacacatggaattaagccagtagtatcaactcaactcctattaaatg

SEQ ID NO: 190177 - DNA, 75 bp, Artificial Sequence
  Synthetic
agaaactttctatgtagatggggcagctaatagggaaactaaaaaagggaaagcaggatatgttactgacagagg

SEQ ID NO: 190178 - DNA, 75 bp, Artificial Sequence
  Synthetic
gtaacagactcacaatatgcattaggaatcatccaagcacaaccagataaaagtgaatcagagttagtcagtcag

SEQ ID NO: 190179 - DNA, 75 bp, Artificial Sequence
  Synthetic
agaaaattcagttaaggccagggggaaagaaaaaatatagattaaaacatctagtatgggcaagcagggagctgg

SEQ ID NO: 190180 - DNA, 75 bp, Artificial Sequence
  Synthetic
tactctaaactgtagtgatgttatcaatagcactggtactatgaaaaattgttctttcagtgtaaccacagagct

SEQ ID NO: 190181 - DNA, 75 bp, Artificial Sequence
  Synthetic
ctttaatcactcctcaggaggggacccagaaattgtaatgcacagttttaattgtggaggggaatttttctactg

SEQ ID NO: 190182 - DNA, 75 bp, Artificial Sequence
  Synthetic
agattagggaaagaatgagacgaacccctccagcagcagaaagagtaggaacagcatctcaagataaagataaac

SEQ ID NO: 190183 - DNA, 75 bp, Artificial Sequence
  Synthetic
agattagggaaagaatgagacgaacccctccagcagcagaaagagtaggatcagcatctcaagataaagataaac

SEQ ID NO: 190184 - DNA, 75 bp, Artificial Sequence
  Synthetic
agattagggaaagaatgagacgaacccctccagcagcagaaagagtaggaccagcatctcaagataaagataaac

SEQ ID NO: 190185 - DNA, 75 bp, Artificial Sequence
  Synthetic
agattagggaaagaatgagacgaacccctccagcagcagaaagagtaggagcagcatctcaagataaagataaac

SEQ ID NO: 190186 - DNA, 75 bp, Artificial Sequence
  Synthetic
tcgacacttatctgggacgacctgaggaacctgtgcctcttcagctaccaccgcttgagagacttactcttaatt

SEQ ID NO: 190187 - DNA, 75 bp, Artificial Sequence
  Synthetic
gacgtggcctgggtagaagcacaagaggaagaagaggaagtaggctttccagtcagacctcaggtacctttaaga

SEQ ID NO: 190188 - DNA, 75 bp, Artificial Sequence
  Synthetic
gagaaaattcggttaaggccggggggaaaaaaaaaatataaaatgaaacatataatatgggcaagcagggagcta

SEQ ID NO: 190189 - DNA, 75 bp, Artificial Sequence
  Synthetic
gtaaaaaactggatgacagaaaccttgctggtccaaaatgcaaatccagactgtaagaccatcttaagagcatta

SEQ ID NO: 190190 - DNA, 75 bp, Artificial Sequence
  Synthetic
gggtcacagtttattatggggtacctgtgtggaaagaagcaaccaccactttattttgtgcatcagatgctaaag

SEQ ID NO: 190191 - DNA, 75 bp, Artificial Sequence
  Synthetic
tactccaatatttgctataaagaaaaaagacagcactaaatggaggaaattagtagatttcagagagctcaataa

SEQ ID NO: 190192 - DNA, 75 bp, Artificial Sequence
  Synthetic
taatagtaataataccactattagtaaagaggaaacgatagagggaggagaaatgaagaactgctctttcaatat

SEQ ID NO: 190193 - DNA, 75 bp, Artificial Sequence
  Synthetic
cctcccctagtaaaattatggtaccagctggagaaagaacccatagcagaggcagaaactttctatgtagatgga

SEQ ID NO: 190194 - DNA, 75 bp, Artificial Sequence
  Synthetic
actatatcctcctttaacttccctcaaatcactctttggcagcgacccttagtcaaagtaagaatagagggacag

SEQ ID NO: 190195 - DNA, 75 bp, Artificial Sequence
  Synthetic
gaatgtatagccctgtcagcattttggacataaaacaagggccaaaagaaccctttagagactatgtagacaggt

SEQ ID NO: 190196 - DNA, 75 bp, Artificial Sequence
  Synthetic
cattgcaataaaatggggggcaaatggtcaaaaagtagtccagtgggatggcctaatataagagaaagaataaga

SEQ ID NO: 190197 - DNA, 75 bp, Artificial Sequence
  Synthetic
ggaaaagtatacatataggaccagggagagcctggtatgcaacaggagatataataggagatataagaaaagcat

SEQ ID NO: 190198 - DNA, 75 bp, Artificial Sequence
  Synthetic
ggaaaagtatacatataggacctgggagagcctggtatgcaacaggagatataataggagatataagaaaagcat

SEQ ID NO: 190199 - DNA, 75 bp, Artificial Sequence
  Synthetic
ggaaaagtatacatataggacccgggagagcctggtatgcaacaggagatataataggagatataagaaaagcat

SEQ ID NO: 190200 - DNA, 75 bp, Artificial Sequence
  Synthetic
ggaaaagtatacatataggaccggggagagcctggtatgcaacaggagatataataggagatataagaaaagcat

SEQ ID NO: 190201 - DNA, 75 bp, Artificial Sequence
  Synthetic
tacaagaaaaggtatacatctaggaggagtagggagagcattctatgtaaaaggacaaataataggagatataag

SEQ ID NO: 190202 - DNA, 75 bp, Artificial Sequence
  Synthetic
gtgggtcacagtatattatggggtgcctgtgtggaaagatgcagaaaccactttattttgtgcatcagatgctaa

SEQ ID NO: 190203 - DNA, 75 bp, Artificial Sequence
  Synthetic
actgatgctaatatcacactcacatgcagaataaaacagattataaacagatggcaggaagtagggaaagcaatg

SEQ ID NO: 190204 - DNA, 75 bp, Artificial Sequence
  Synthetic
tagtaccaacagtagcaacgtggagaacagggaactaaaaaattgctctttcaatgtaactacagaactaaaaga

SEQ ID NO: 190205 - DNA, 75 bp, Artificial Sequence
  Synthetic
ggtaatgctacccacaagaacagtattggtaatgacatgcaaaattgctctttcaatacaaccacagaactaaga

SEQ ID NO: 190206 - DNA, 75 bp, Artificial Sequence
  Synthetic
cacacaagtagaccctggcctagcagaccaactaattcatctgtattattttgattgtttttcagaatctgctat

SEQ ID NO: 190207 - DNA, 75 bp, Artificial Sequence
  Synthetic
catggaattaagccagtggtgtcaactcaattgctgttaaatggaagcctagcaaaagaagaggtaataattagg

SEQ ID NO: 190208 - DNA, 75 bp, Artificial Sequence
  Synthetic
tacctatggggccaggaaaagcattctttgcaacaggggatattataggaaatataagacaagcacattgtaata

SEQ ID NO: 190209 - DNA, 75 bp, Artificial Sequence
  Synthetic
agaaatgacctgaacaagagcacaataatttttcaaccaccttcaggaggggacatggaaattcaaatgcacact

SEQ ID NO: 190210 - DNA, 75 bp, Artificial Sequence
  Synthetic
ctattacactgccatgcagaataaaacaaattgtaaacatgtggcagagagtaggacaagcaatgtatgcccctc

SEQ ID NO: 190211 - DNA, 75 bp, Artificial Sequence
  Synthetic
atcatcacactccaatgcagaataaaacaatttataaacatgtggcaggaggtaggacgagcaatgtatgcccct

SEQ ID NO: 190212 - DNA, 75 bp, Artificial Sequence
  Synthetic
ggtaggacgagcaatgtatgcccctcccattgcaggaaacataacatgtaaatcaaatatcacaggactactatt

SEQ ID NO: 190213 - DNA, 75 bp, Artificial Sequence
  Synthetic
ggaagaagcgaagacagcgacgaagagctcctcaagacagtcagactcatcaagcttctctatcaaagcagtaag

SEQ ID NO: 190214 - DNA, 75 bp, Artificial Sequence
  Synthetic
ggcaagccacctggattcctgaatgggagtttgtcaataccccccctctagtaaaactatggtatcagttagaaa

SEQ ID NO: 190215 - DNA, 75 bp, Artificial Sequence
  Synthetic
ggcatgccacctggattcctgaatgggagtttgtcaataccccccctctagtaaaactatggtatcagttagaaa

SEQ ID NO: 190216 - DNA, 75 bp, Artificial Sequence
  Synthetic
ggcacgccacctggattcctgaatgggagtttgtcaataccccccctctagtaaaactatggtatcagttagaaa

SEQ ID NO: 190217 - DNA, 75 bp, Artificial Sequence
  Synthetic
ggcaggccacctggattcctgaatgggagtttgtcaataccccccctctagtaaaactatggtatcagttagaaa

SEQ ID NO: 190218 - DNA, 75 bp, Artificial Sequence
  Synthetic
gtagtagcaataatagcaatagttgtgtggaccatagtactcctagaatataggaaaatattaagacagagaaaa

SEQ ID NO: 190219 - DNA, 75 bp, Artificial Sequence
  Synthetic
aagtggtcaaaaaggagtgtggttggatggcctaaagtaagagagagaatgagaagagttgagccagcagcagat

SEQ ID NO: 190220 - DNA, 75 bp, Artificial Sequence
  Synthetic
atcaacagctcctaggactttggggctgctctggcaaactcatctgtcccaccgcagtgccctggaactctagtt

SEQ ID NO: 190221 - DNA, 75 bp, Artificial Sequence
  Synthetic
taaaaggattagaagaaatgaacaggtagataaattagtcagtgctagaatcagaaaaatactgtttttagataa

SEQ ID NO: 190222 - DNA, 75 bp, Artificial Sequence
  Synthetic
taaaaggattagaagaaatgaacaggtagataaattagtcagtgctagtatcagaaaaatactgtttttagataa

SEQ ID NO: 190223 - DNA, 75 bp, Artificial Sequence
  Synthetic
taaaaggattagaagaaatgaacaggtagataaattagtcagtgctagcatcagaaaaatactgtttttagataa

SEQ ID NO: 190224 - DNA, 75 bp, Artificial Sequence
  Synthetic
taaaaggattagaagaaatgaacaggtagataaattagtcagtgctaggatcagaaaaatactgtttttagataa

SEQ ID NO: 190225 - DNA, 75 bp, Artificial Sequence
  Synthetic
atttcagaattgggtgccaacatagcagaataggcattattcaagggagaagaggcagaaatggagccagtagat

SEQ ID NO: 190226 - DNA, 75 bp, Artificial Sequence
  Synthetic
gctctttcaatatcaccacaagcataaaaactaaggtgaaagactatgcacttttttataaagttgatgtagtac

SEQ ID NO: 190227 - DNA, 75 bp, Artificial Sequence
  Synthetic
tcaatggaacaggaccatgtacaaatgtcagtacagtacaatgtacacatggaattaggccagtagtatcaactc

SEQ ID NO: 190228 - DNA, 75 bp, Artificial Sequence
  Synthetic
gccatattaggatatagagttagccctaggtgtgaatatcaagcaggacataataaggtaggatctttacaatac

SEQ ID NO: 190229 - DNA, 75 bp, Artificial Sequence
  Synthetic
tgcttgataccacagcaatagtagtagctgaggcaacagataggattatagaagcagtgcgaacagcttgtagag

SEQ ID NO: 190230 - DNA, 75 bp, Artificial Sequence
  Synthetic
atctaggaccagggaaagcatggtatacaacaggacaaataataggagatataagacaagcacattgtaacctta

SEQ ID NO: 190231 - DNA, 75 bp, Artificial Sequence
  Synthetic
tacaacaggacaaataataggagatataagacaagcacattgtaaccttagtagcacaaaatggaataacacttt

SEQ ID NO: 190232 - DNA, 75 bp, Artificial Sequence
  Synthetic
atataagggaaagaatgagacgaactcggccagcagcagatggggtaggagcagtgtctcaagatttggacaacc

SEQ ID NO: 190233 - DNA, 75 bp, Artificial Sequence
  Synthetic
aaaacagataactaaaaaattaagagaacaatttgggaacaaaacaatagtctttaatcaatcctcaggagggga

SEQ ID NO: 190234 - DNA, 75 bp, Artificial Sequence
  Synthetic
agctataataagaattttgcaacaattactgtttgttcatttcagaattgggtgccaacatagcagaataggcat

SEQ ID NO: 190235 - DNA, 75 bp, Artificial Sequence
  Synthetic
gcttctggcagcagtaagagcaatcaagatcctataccaaagcagtgagtataattaaataagctctgtaatgca

SEQ ID NO: 190236 - DNA, 75 bp, Artificial Sequence
  Synthetic
gagacattcagacctggaggaggaaatatgaaggacaattggagaagtgaattatataaatataaagtggtagaa

SEQ ID NO: 190237 - DNA, 75 bp, Artificial Sequence
  Synthetic
caaccctctgttgtgtacatctaagagaagatgtaaaagataccaaggaagctttagataaaatagaggagatac

SEQ ID NO: 190238 - DNA, 75 bp, Artificial Sequence
  Synthetic
caaccctctgttgtgtacatctaagagtagatgtaaaagataccaaggaagctttagataaaatagaggagatac

SEQ ID NO: 190239 - DNA, 75 bp, Artificial Sequence
  Synthetic
caaccctctgttgtgtacatctaagagcagatgtaaaagataccaaggaagctttagataaaatagaggagatac

SEQ ID NO: 190240 - DNA, 75 bp, Artificial Sequence
  Synthetic
caaccctctgttgtgtacatctaagaggagatgtaaaagataccaaggaagctttagataaaatagaggagatac

SEQ ID NO: 190241 - DNA, 75 bp, Artificial Sequence
  Synthetic
aagatatacctatggggccaggaaaagcattctatgcaatgggtgatataataggggatataagacaagcacatt

SEQ ID NO: 190242 - DNA, 75 bp, Artificial Sequence
  Synthetic
tttgtgggtcacagtctattatggggtacctgtgtggagagacgcagagaccaccttattttgtgcatcagatgc

SEQ ID NO: 190243 - DNA, 75 bp, Artificial Sequence
  Synthetic
aattgaagaatcgcagaaccaacaagaaaagaatgaactagaattattggaattggataagtgggcaagtttgtg

SEQ ID NO: 190244 - DNA, 75 bp, Artificial Sequence
  Synthetic
aggaggggatctagaaataacaacacatagttttaattgtggaggagaatttttctattgtaacacatcaggcct

SEQ ID NO: 190245 - DNA, 75 bp, Artificial Sequence
  Synthetic
tggtagagcagatgcatgaagatataattagtctatgggatcaaagcctaaagccatgtgtaaagttaacccctc

SEQ ID NO: 190246 - DNA, 75 bp, Artificial Sequence
  Synthetic
tttacaacgaagggcttaggcatctcctatggcagaaaaaagcggagacagcgacaaagaactcctcaaagcagt

SEQ ID NO: 190247 - DNA, 75 bp, Artificial Sequence
  Synthetic
agacagcgacgaagcgctcctccaagcagtgaggatcatcaaaatcctatatcaaagcagtaagtatatgtaatg

SEQ ID NO: 190248 - DNA, 75 bp, Artificial Sequence
  Synthetic
caaaagttgtgtggcccaaagtattcatagaatataagaaaataaaaagacaaaaaaaaaaaaataggttaataa

SEQ ID NO: 190249 - DNA, 75 bp, Artificial Sequence
  Synthetic
caaaagttgtgtggcccaaagtattcatagaatataagaaaataaaaagacaaaaaaaaataaataggttaataa

SEQ ID NO: 190250 - DNA, 75 bp, Artificial Sequence
  Synthetic
caaaagttgtgtggcccaaagtattcatagaatataagaaaataaaaagacaaaaaaaaacaaataggttaataa

SEQ ID NO: 190251 - DNA, 75 bp, Artificial Sequence
  Synthetic
caaaagttgtgtggcccaaagtattcatagaatataagaaaataaaaagacaaaaaaaaagaaataggttaataa

SEQ ID NO: 190252 - DNA, 75 bp, Artificial Sequence
  Synthetic
caaaagttgtgtggcccatagtattcatagaatataagaaaataaaaagacaaaaaaaaaaaaataggttaataa

SEQ ID NO: 190253 - DNA, 75 bp, Artificial Sequence
  Synthetic
caaaagttgtgtggcccatagtattcatagaatataagaaaataaaaagacaaaaaaaaataaataggttaataa

SEQ ID NO: 190254 - DNA, 75 bp, Artificial Sequence
  Synthetic
caaaagttgtgtggcccatagtattcatagaatataagaaaataaaaagacaaaaaaaaacaaataggttaataa

SEQ ID NO: 190255 - DNA, 75 bp, Artificial Sequence
  Synthetic
caaaagttgtgtggcccatagtattcatagaatataagaaaataaaaagacaaaaaaaaagaaataggttaataa

SEQ ID NO: 190256 - DNA, 75 bp, Artificial Sequence
  Synthetic
caaaagttgtgtggcccacagtattcatagaatataagaaaataaaaagacaaaaaaaaaaaaataggttaataa

SEQ ID NO: 190257 - DNA, 75 bp, Artificial Sequence
  Synthetic
caaaagttgtgtggcccacagtattcatagaatataagaaaataaaaagacaaaaaaaaataaataggttaataa

SEQ ID NO: 190258 - DNA, 75 bp, Artificial Sequence
  Synthetic
caaaagttgtgtggcccacagtattcatagaatataagaaaataaaaagacaaaaaaaaacaaataggttaataa

SEQ ID NO: 190259 - DNA, 75 bp, Artificial Sequence
  Synthetic
caaaagttgtgtggcccacagtattcatagaatataagaaaataaaaagacaaaaaaaaagaaataggttaataa

SEQ ID NO: 190260 - DNA, 75 bp, Artificial Sequence
  Synthetic
caaaagttgtgtggcccagagtattcatagaatataagaaaataaaaagacaaaaaaaaaaaaataggttaataa

SEQ ID NO: 190261 - DNA, 75 bp, Artificial Sequence
  Synthetic
caaaagttgtgtggcccagagtattcatagaatataagaaaataaaaagacaaaaaaaaataaataggttaataa

SEQ ID NO: 190262 - DNA, 75 bp, Artificial Sequence
  Synthetic
caaaagttgtgtggcccagagtattcatagaatataagaaaataaaaagacaaaaaaaaacaaataggttaataa

SEQ ID NO: 190263 - DNA, 75 bp, Artificial Sequence
  Synthetic
caaaagttgtgtggcccagagtattcatagaatataagaaaataaaaagacaaaaaaaaagaaataggttaataa

SEQ ID NO: 190264 - DNA, 75 bp, Artificial Sequence
  Synthetic
caatagttgtgtggcccaaagtattcatagaatataagaaaataaaaagacaaaaaaaaaaaaataggttaataa

SEQ ID NO: 190265 - DNA, 75 bp, Artificial Sequence
  Synthetic
caatagttgtgtggcccaaagtattcatagaatataagaaaataaaaagacaaaaaaaaataaataggttaataa

SEQ ID NO: 190266 - DNA, 75 bp, Artificial Sequence
  Synthetic
caatagttgtgtggcccaaagtattcatagaatataagaaaataaaaagacaaaaaaaaacaaataggttaataa

SEQ ID NO: 190267 - DNA, 75 bp, Artificial Sequence
  Synthetic
caatagttgtgtggcccaaagtattcatagaatataagaaaataaaaagacaaaaaaaaagaaataggttaataa

SEQ ID NO: 190268 - DNA, 75 bp, Artificial Sequence
  Synthetic
caatagttgtgtggcccatagtattcatagaatataagaaaataaaaagacaaaaaaaaaaaaataggttaataa

SEQ ID NO: 190269 - DNA, 75 bp, Artificial Sequence
  Synthetic
caatagttgtgtggcccatagtattcatagaatataagaaaataaaaagacaaaaaaaaataaataggttaataa

SEQ ID NO: 190270 - DNA, 75 bp, Artificial Sequence
  Synthetic
caatagttgtgtggcccatagtattcatagaatataagaaaataaaaagacaaaaaaaaacaaataggttaataa

SEQ ID NO: 190271 - DNA, 75 bp, Artificial Sequence
  Synthetic
caatagttgtgtggcccatagtattcatagaatataagaaaataaaaagacaaaaaaaaagaaataggttaataa

SEQ ID NO: 190272 - DNA, 75 bp, Artificial Sequence
  Synthetic
caatagttgtgtggcccacagtattcatagaatataagaaaataaaaagacaaaaaaaaaaaaataggttaataa

SEQ ID NO: 190273 - DNA, 75 bp, Artificial Sequence
  Synthetic
caatagttgtgtggcccacagtattcatagaatataagaaaataaaaagacaaaaaaaaataaataggttaataa

SEQ ID NO: 190274 - DNA, 75 bp, Artificial Sequence
  Synthetic
caatagttgtgtggcccacagtattcatagaatataagaaaataaaaagacaaaaaaaaacaaataggttaataa

SEQ ID NO: 190275 - DNA, 75 bp, Artificial Sequence
  Synthetic
caatagttgtgtggcccacagtattcatagaatataagaaaataaaaagacaaaaaaaaagaaataggttaataa

SEQ ID NO: 190276 - DNA, 75 bp, Artificial Sequence
  Synthetic
caatagttgtgtggcccagagtattcatagaatataagaaaataaaaagacaaaaaaaaaaaaataggttaataa

SEQ ID NO: 190277 - DNA, 75 bp, Artificial Sequence
  Synthetic
caatagttgtgtggcccagagtattcatagaatataagaaaataaaaagacaaaaaaaaataaataggttaataa

SEQ ID NO: 190278 - DNA, 75 bp, Artificial Sequence
  Synthetic
caatagttgtgtggcccagagtattcatagaatataagaaaataaaaagacaaaaaaaaacaaataggttaataa

SEQ ID NO: 190279 - DNA, 75 bp, Artificial Sequence
  Synthetic
caatagttgtgtggcccagagtattcatagaatataagaaaataaaaagacaaaaaaaaagaaataggttaataa

SEQ ID NO: 190280 - DNA, 75 bp, Artificial Sequence
  Synthetic
caacagttgtgtggcccaaagtattcatagaatataagaaaataaaaagacaaaaaaaaaaaaataggttaataa

SEQ ID NO: 190281 - DNA, 75 bp, Artificial Sequence
  Synthetic
caacagttgtgtggcccaaagtattcatagaatataagaaaataaaaagacaaaaaaaaataaataggttaataa

SEQ ID NO: 190282 - DNA, 75 bp, Artificial Sequence
  Synthetic
caacagttgtgtggcccaaagtattcatagaatataagaaaataaaaagacaaaaaaaaacaaataggttaataa

SEQ ID NO: 190283 - DNA, 75 bp, Artificial Sequence
  Synthetic
caacagttgtgtggcccaaagtattcatagaatataagaaaataaaaagacaaaaaaaaagaaataggttaataa

SEQ ID NO: 190284 - DNA, 75 bp, Artificial Sequence
  Synthetic
caacagttgtgtggcccatagtattcatagaatataagaaaataaaaagacaaaaaaaaaaaaataggttaataa

SEQ ID NO: 190285 - DNA, 75 bp, Artificial Sequence
  Synthetic
caacagttgtgtggcccatagtattcatagaatataagaaaataaaaagacaaaaaaaaataaataggttaataa

SEQ ID NO: 190286 - DNA, 75 bp, Artificial Sequence
  Synthetic
caacagttgtgtggcccatagtattcatagaatataagaaaataaaaagacaaaaaaaaacaaataggttaataa

SEQ ID NO: 190287 - DNA, 75 bp, Artificial Sequence
  Synthetic
caacagttgtgtggcccatagtattcatagaatataagaaaataaaaagacaaaaaaaaagaaataggttaataa

SEQ ID NO: 190288 - DNA, 75 bp, Artificial Sequence
  Synthetic
caacagttgtgtggcccacagtattcatagaatataagaaaataaaaagacaaaaaaaaaaaaataggttaataa

SEQ ID NO: 190289 - DNA, 75 bp, Artificial Sequence
  Synthetic
caacagttgtgtggcccacagtattcatagaatataagaaaataaaaagacaaaaaaaaataaataggttaataa

SEQ ID NO: 190290 - DNA, 75 bp, Artificial Sequence
  Synthetic
caacagttgtgtggcccacagtattcatagaatataagaaaataaaaagacaaaaaaaaacaaataggttaataa

SEQ ID NO: 190291 - DNA, 75 bp, Artificial Sequence
  Synthetic
caacagttgtgtggcccacagtattcatagaatataagaaaataaaaagacaaaaaaaaagaaataggttaataa

SEQ ID NO: 190292 - DNA, 75 bp, Artificial Sequence
  Synthetic
caacagttgtgtggcccagagtattcatagaatataagaaaataaaaagacaaaaaaaaaaaaataggttaataa

SEQ ID NO: 190293 - DNA, 75 bp, Artificial Sequence
  Synthetic
caacagttgtgtggcccagagtattcatagaatataagaaaataaaaagacaaaaaaaaataaataggttaataa

SEQ ID NO: 190294 - DNA, 75 bp, Artificial Sequence
  Synthetic
caacagttgtgtggcccagagtattcatagaatataagaaaataaaaagacaaaaaaaaacaaataggttaataa

SEQ ID NO: 190295 - DNA, 75 bp, Artificial Sequence
  Synthetic
caacagttgtgtggcccagagtattcatagaatataagaaaataaaaagacaaaaaaaaagaaataggttaataa

SEQ ID NO: 190296 - DNA, 75 bp, Artificial Sequence
  Synthetic
caagagttgtgtggcccaaagtattcatagaatataagaaaataaaaagacaaaaaaaaaaaaataggttaataa

SEQ ID NO: 190297 - DNA, 75 bp, Artificial Sequence
  Synthetic
caagagttgtgtggcccaaagtattcatagaatataagaaaataaaaagacaaaaaaaaataaataggttaataa

SEQ ID NO: 190298 - DNA, 75 bp, Artificial Sequence
  Synthetic
caagagttgtgtggcccaaagtattcatagaatataagaaaataaaaagacaaaaaaaaacaaataggttaataa

SEQ ID NO: 190299 - DNA, 75 bp, Artificial Sequence
  Synthetic
caagagttgtgtggcccaaagtattcatagaatataagaaaataaaaagacaaaaaaaaagaaataggttaataa

SEQ ID NO: 190300 - DNA, 75 bp, Artificial Sequence
  Synthetic
caagagttgtgtggcccatagtattcatagaatataagaaaataaaaagacaaaaaaaaaaaaataggttaataa

SEQ ID NO: 190301 - DNA, 75 bp, Artificial Sequence
  Synthetic
caagagttgtgtggcccatagtattcatagaatataagaaaataaaaagacaaaaaaaaataaataggttaataa

SEQ ID NO: 190302 - DNA, 75 bp, Artificial Sequence
  Synthetic
caagagttgtgtggcccatagtattcatagaatataagaaaataaaaagacaaaaaaaaacaaataggttaataa

SEQ ID NO: 190303 - DNA, 75 bp, Artificial Sequence
  Synthetic
caagagttgtgtggcccatagtattcatagaatataagaaaataaaaagacaaaaaaaaagaaataggttaataa

SEQ ID NO: 190304 - DNA, 75 bp, Artificial Sequence
  Synthetic
caagagttgtgtggcccacagtattcatagaatataagaaaataaaaagacaaaaaaaaaaaaataggttaataa

SEQ ID NO: 190305 - DNA, 75 bp, Artificial Sequence
  Synthetic
caagagttgtgtggcccacagtattcatagaatataagaaaataaaaagacaaaaaaaaataaataggttaataa

SEQ ID NO: 190306 - DNA, 75 bp, Artificial Sequence
  Synthetic
caagagttgtgtggcccacagtattcatagaatataagaaaataaaaagacaaaaaaaaacaaataggttaataa

SEQ ID NO: 190307 - DNA, 75 bp, Artificial Sequence
  Synthetic
caagagttgtgtggcccacagtattcatagaatataagaaaataaaaagacaaaaaaaaagaaataggttaataa

SEQ ID NO: 190308 - DNA, 75 bp, Artificial Sequence
  Synthetic
caagagttgtgtggcccagagtattcatagaatataagaaaataaaaagacaaaaaaaaaaaaataggttaataa

SEQ ID NO: 190309 - DNA, 75 bp, Artificial Sequence
  Synthetic
caagagttgtgtggcccagagtattcatagaatataagaaaataaaaagacaaaaaaaaataaataggttaataa

SEQ ID NO: 190310 - DNA, 75 bp, Artificial Sequence
  Synthetic
caagagttgtgtggcccagagtattcatagaatataagaaaataaaaagacaaaaaaaaacaaataggttaataa

SEQ ID NO: 190311 - DNA, 75 bp, Artificial Sequence
  Synthetic
caagagttgtgtggcccagagtattcatagaatataagaaaataaaaagacaaaaaaaaagaaataggttaataa

SEQ ID NO: 190312 - DNA, 75 bp, Artificial Sequence
  Synthetic
catagaatataagaaaataaaaagacaaaaaaaaataaataggataataaaaaaaaaaaaaaaaaaagcggaaaa

SEQ ID NO: 190313 - DNA, 75 bp, Artificial Sequence
  Synthetic
catagaatataagaaaataaaaagacaaaaaaaaataaataggataataaaaaaaaaaataaaaaaagcggaaaa

SEQ ID NO: 190314 - DNA, 75 bp, Artificial Sequence
  Synthetic
catagaatataagaaaataaaaagacaaaaaaaaataaataggataataaaaaaaaaaacaaaaaaagcggaaaa

SEQ ID NO: 190315 - DNA, 75 bp, Artificial Sequence
  Synthetic
catagaatataagaaaataaaaagacaaaaaaaaataaataggataataaaaaaaaaaagaaaaaaagcggaaaa

SEQ ID NO: 190316 - DNA, 75 bp, Artificial Sequence
  Synthetic
catagaatataagaaaataaaaagacaaaaaaaaataaataggataataaaaaaaataaaaaaaaaagcggaaaa

SEQ ID NO: 190317 - DNA, 75 bp, Artificial Sequence
  Synthetic
catagaatataagaaaataaaaagacaaaaaaaaataaataggataataaaaaaaataataaaaaaagcggaaaa

SEQ ID NO: 190318 - DNA, 75 bp, Artificial Sequence
  Synthetic
catagaatataagaaaataaaaagacaaaaaaaaataaataggataataaaaaaaataacaaaaaaagcggaaaa

SEQ ID NO: 190319 - DNA, 75 bp, Artificial Sequence
  Synthetic
catagaatataagaaaataaaaagacaaaaaaaaataaataggataataaaaaaaataagaaaaaaagcggaaaa

SEQ ID NO: 190320 - DNA, 75 bp, Artificial Sequence
  Synthetic
catagaatataagaaaataaaaagacaaaaaaaaataaataggataataaaaaaaacaaaaaaaaaagcggaaaa

SEQ ID NO: 190321 - DNA, 75 bp, Artificial Sequence
  Synthetic
catagaatataagaaaataaaaagacaaaaaaaaataaataggataataaaaaaaacaataaaaaaagcggaaaa

SEQ ID NO: 190322 - DNA, 75 bp, Artificial Sequence
  Synthetic
catagaatataagaaaataaaaagacaaaaaaaaataaataggataataaaaaaaacaacaaaaaaagcggaaaa

SEQ ID NO: 190323 - DNA, 75 bp, Artificial Sequence
  Synthetic
catagaatataagaaaataaaaagacaaaaaaaaataaataggataataaaaaaaacaagaaaaaaagcggaaaa

SEQ ID NO: 190324 - DNA, 75 bp, Artificial Sequence
  Synthetic
catagaatataagaaaataaaaagacaaaaaaaaataaataggataataaaaaaaagaaaaaaaaaagcggaaaa

SEQ ID NO: 190325 - DNA, 75 bp, Artificial Sequence
  Synthetic
catagaatataagaaaataaaaagacaaaaaaaaataaataggataataaaaaaaagaataaaaaaagcggaaaa

SEQ ID NO: 190326 - DNA, 75 bp, Artificial Sequence
  Synthetic
catagaatataagaaaataaaaagacaaaaaaaaataaataggataataaaaaaaagaacaaaaaaagcggaaaa

SEQ ID NO: 190327 - DNA, 75 bp, Artificial Sequence
  Synthetic
catagaatataagaaaataaaaagacaaaaaaaaataaataggataataaaaaaaagaagaaaaaaagcggaaaa

SEQ ID NO: 190328 - DNA, 75 bp, Artificial Sequence
  Synthetic
catagaatataagaaaataaaaagacaaaaaaaaataaataggttaataaaaaaaaaaaaaaaaaaagcggaaaa

SEQ ID NO: 190329 - DNA, 75 bp, Artificial Sequence
  Synthetic
catagaatataagaaaataaaaagacaaaaaaaaataaataggttaataaaaaaaaaaataaaaaaagcggaaaa

SEQ ID NO: 190330 - DNA, 75 bp, Artificial Sequence
  Synthetic
catagaatataagaaaataaaaagacaaaaaaaaataaataggttaataaaaaaaaaaacaaaaaaagcggaaaa

SEQ ID NO: 190331 - DNA, 75 bp, Artificial Sequence
  Synthetic
catagaatataagaaaataaaaagacaaaaaaaaataaataggttaataaaaaaaaaaagaaaaaaagcggaaaa

SEQ ID NO: 190332 - DNA, 75 bp, Artificial Sequence
  Synthetic
catagaatataagaaaataaaaagacaaaaaaaaataaataggttaataaaaaaaataaaaaaaaaagcggaaaa

SEQ ID NO: 190333 - DNA, 75 bp, Artificial Sequence
  Synthetic
catagaatataagaaaataaaaagacaaaaaaaaataaataggttaataaaaaaaataataaaaaaagcggaaaa

SEQ ID NO: 190334 - DNA, 75 bp, Artificial Sequence
  Synthetic
catagaatataagaaaataaaaagacaaaaaaaaataaataggttaataaaaaaaataacaaaaaaagcggaaaa

SEQ ID NO: 190335 - DNA, 75 bp, Artificial Sequence
  Synthetic
catagaatataagaaaataaaaagacaaaaaaaaataaataggttaataaaaaaaataagaaaaaaagcggaaaa

SEQ ID NO: 190336 - DNA, 75 bp, Artificial Sequence
  Synthetic
catagaatataagaaaataaaaagacaaaaaaaaataaataggttaataaaaaaaacaaaaaaaaaagcggaaaa

SEQ ID NO: 190337 - DNA, 75 bp, Artificial Sequence
  Synthetic
catagaatataagaaaataaaaagacaaaaaaaaataaataggttaataaaaaaaacaataaaaaaagcggaaaa

SEQ ID NO: 190338 - DNA, 75 bp, Artificial Sequence
  Synthetic
catagaatataagaaaataaaaagacaaaaaaaaataaataggttaataaaaaaaacaacaaaaaaagcggaaaa

SEQ ID NO: 190339 - DNA, 75 bp, Artificial Sequence
  Synthetic
catagaatataagaaaataaaaagacaaaaaaaaataaataggttaataaaaaaaacaagaaaaaaagcggaaaa

SEQ ID NO: 190340 - DNA, 75 bp, Artificial Sequence
  Synthetic
catagaatataagaaaataaaaagacaaaaaaaaataaataggttaataaaaaaaagaaaaaaaaaagcggaaaa

SEQ ID NO: 190341 - DNA, 75 bp, Artificial Sequence
  Synthetic
catagaatataagaaaataaaaagacaaaaaaaaataaataggttaataaaaaaaagaataaaaaaagcggaaaa

SEQ ID NO: 190342 - DNA, 75 bp, Artificial Sequence
  Synthetic
catagaatataagaaaataaaaagacaaaaaaaaataaataggttaataaaaaaaagaacaaaaaaagcggaaaa

SEQ ID NO: 190343 - DNA, 75 bp, Artificial Sequence
  Synthetic
catagaatataagaaaataaaaagacaaaaaaaaataaataggttaataaaaaaaagaagaaaaaaagcggaaaa

SEQ ID NO: 190344 - DNA, 75 bp, Artificial Sequence
  Synthetic
catagaatataagaaaataaaaagacaaaaaaaaataaataggctaataaaaaaaaaaaaaaaaaaagcggaaaa

SEQ ID NO: 190345 - DNA, 75 bp, Artificial Sequence
  Synthetic
catagaatataagaaaataaaaagacaaaaaaaaataaataggctaataaaaaaaaaaataaaaaaagcggaaaa

SEQ ID NO: 190346 - DNA, 75 bp, Artificial Sequence
  Synthetic
catagaatataagaaaataaaaagacaaaaaaaaataaataggctaataaaaaaaaaaacaaaaaaagcggaaaa

SEQ ID NO: 190347 - DNA, 75 bp, Artificial Sequence
  Synthetic
catagaatataagaaaataaaaagacaaaaaaaaataaataggctaataaaaaaaaaaagaaaaaaagcggaaaa

SEQ ID NO: 190348 - DNA, 75 bp, Artificial Sequence
  Synthetic
catagaatataagaaaataaaaagacaaaaaaaaataaataggctaataaaaaaaataaaaaaaaaagcggaaaa

SEQ ID NO: 190349 - DNA, 75 bp, Artificial Sequence
  Synthetic
catagaatataagaaaataaaaagacaaaaaaaaataaataggctaataaaaaaaataataaaaaaagcggaaaa

SEQ ID NO: 190350 - DNA, 75 bp, Artificial Sequence
  Synthetic
catagaatataagaaaataaaaagacaaaaaaaaataaataggctaataaaaaaaataacaaaaaaagcggaaaa

SEQ ID NO: 190351 - DNA, 75 bp, Artificial Sequence
  Synthetic
catagaatataagaaaataaaaagacaaaaaaaaataaataggctaataaaaaaaataagaaaaaaagcggaaaa

SEQ ID NO: 190352 - DNA, 75 bp, Artificial Sequence
  Synthetic
catagaatataagaaaataaaaagacaaaaaaaaataaataggctaataaaaaaaacaaaaaaaaaagcggaaaa

SEQ ID NO: 190353 - DNA, 75 bp, Artificial Sequence
  Synthetic
catagaatataagaaaataaaaagacaaaaaaaaataaataggctaataaaaaaaacaataaaaaaagcggaaaa

SEQ ID NO: 190354 - DNA, 75 bp, Artificial Sequence
  Synthetic
catagaatataagaaaataaaaagacaaaaaaaaataaataggctaataaaaaaaacaacaaaaaaagcggaaaa

SEQ ID NO: 190355 - DNA, 75 bp, Artificial Sequence
  Synthetic
catagaatataagaaaataaaaagacaaaaaaaaataaataggctaataaaaaaaacaagaaaaaaagcggaaaa

SEQ ID NO: 190356 - DNA, 75 bp, Artificial Sequence
  Synthetic
catagaatataagaaaataaaaagacaaaaaaaaataaataggctaataaaaaaaagaaaaaaaaaagcggaaaa

SEQ ID NO: 190357 - DNA, 75 bp, Artificial Sequence
  Synthetic
catagaatataagaaaataaaaagacaaaaaaaaataaataggctaataaaaaaaagaataaaaaaagcggaaaa

SEQ ID NO: 190358 - DNA, 75 bp, Artificial Sequence
  Synthetic
catagaatataagaaaataaaaagacaaaaaaaaataaataggctaataaaaaaaagaacaaaaaaagcggaaaa

SEQ ID NO: 190359 - DNA, 75 bp, Artificial Sequence
  Synthetic
catagaatataagaaaataaaaagacaaaaaaaaataaataggctaataaaaaaaagaagaaaaaaagcggaaaa

SEQ ID NO: 190360 - DNA, 75 bp, Artificial Sequence
  Synthetic
catagaatataagaaaataaaaagacaaaaaaaaataaatagggtaataaaaaaaaaaaaaaaaaaagcggaaaa

SEQ ID NO: 190361 - DNA, 75 bp, Artificial Sequence
  Synthetic
catagaatataagaaaataaaaagacaaaaaaaaataaatagggtaataaaaaaaaaaataaaaaaagcggaaaa

SEQ ID NO: 190362 - DNA, 75 bp, Artificial Sequence
  Synthetic
catagaatataagaaaataaaaagacaaaaaaaaataaatagggtaataaaaaaaaaaacaaaaaaagcggaaaa

SEQ ID NO: 190363 - DNA, 75 bp, Artificial Sequence
  Synthetic
catagaatataagaaaataaaaagacaaaaaaaaataaatagggtaataaaaaaaaaaagaaaaaaagcggaaaa

SEQ ID NO: 190364 - DNA, 75 bp, Artificial Sequence
  Synthetic
catagaatataagaaaataaaaagacaaaaaaaaataaatagggtaataaaaaaaataaaaaaaaaagcggaaaa

SEQ ID NO: 190365 - DNA, 75 bp, Artificial Sequence
  Synthetic
catagaatataagaaaataaaaagacaaaaaaaaataaatagggtaataaaaaaaataataaaaaaagcggaaaa

SEQ ID NO: 190366 - DNA, 75 bp, Artificial Sequence
  Synthetic
catagaatataagaaaataaaaagacaaaaaaaaataaatagggtaataaaaaaaataacaaaaaaagcggaaaa

SEQ ID NO: 190367 - DNA, 75 bp, Artificial Sequence
  Synthetic
catagaatataagaaaataaaaagacaaaaaaaaataaatagggtaataaaaaaaataagaaaaaaagcggaaaa

SEQ ID NO: 190368 - DNA, 75 bp, Artificial Sequence
  Synthetic
catagaatataagaaaataaaaagacaaaaaaaaataaatagggtaataaaaaaaacaaaaaaaaaagcggaaaa

SEQ ID NO: 190369 - DNA, 75 bp, Artificial Sequence
  Synthetic
catagaatataagaaaataaaaagacaaaaaaaaataaatagggtaataaaaaaaacaataaaaaaagcggaaaa

SEQ ID NO: 190370 - DNA, 75 bp, Artificial Sequence
  Synthetic
catagaatataagaaaataaaaagacaaaaaaaaataaatagggtaataaaaaaaacaacaaaaaaagcggaaaa

SEQ ID NO: 190371 - DNA, 75 bp, Artificial Sequence
  Synthetic
catagaatataagaaaataaaaagacaaaaaaaaataaatagggtaataaaaaaaacaagaaaaaaagcggaaaa

SEQ ID NO: 190372 - DNA, 75 bp, Artificial Sequence
  Synthetic
catagaatataagaaaataaaaagacaaaaaaaaataaatagggtaataaaaaaaagaaaaaaaaaagcggaaaa

SEQ ID NO: 190373 - DNA, 75 bp, Artificial Sequence
  Synthetic
catagaatataagaaaataaaaagacaaaaaaaaataaatagggtaataaaaaaaagaataaaaaaagcggaaaa

SEQ ID NO: 190374 - DNA, 75 bp, Artificial Sequence
  Synthetic
catagaatataagaaaataaaaagacaaaaaaaaataaatagggtaataaaaaaaagaacaaaaaaagcggaaaa

SEQ ID NO: 190375 - DNA, 75 bp, Artificial Sequence
  Synthetic
catagaatataagaaaataaaaagacaaaaaaaaataaatagggtaataaaaaaaagaagaaaaaaagcggaaaa

SEQ ID NO: 190376 - DNA, 75 bp, Artificial Sequence
  Synthetic
gcaacagcatatgttgcaactcacagtctggggcattaagcagcttcaggcaagagtcctggctatagaaagata

SEQ ID NO: 190377 - DNA, 75 bp, Artificial Sequence
  Synthetic
gtttatgggatcaaagccttaagccatgtgtaaaattgaccccactctgtgtcactttaaattgtactaatgttg

SEQ ID NO: 190378 - DNA, 75 bp, Artificial Sequence
  Synthetic
tattaagtgtttcaactgtggcaaggaaggacatctagccagaaattgcagggcccctagaaaaaagggctgttg

SEQ ID NO: 190379 - DNA, 75 bp, Artificial Sequence
  Synthetic
ggaccagggcaaacattctatgcaacaggtgacataataggggatataagacaggcacattgtaatgtcagtgga

SEQ ID NO: 190380 - DNA, 75 bp, Artificial Sequence
  Synthetic
agcactcaaaacagcaccctggaaggagggacaatgcaaaactgttctttcagtatgaccacagtattaagagat

SEQ ID NO: 190381 - DNA, 75 bp, Artificial Sequence
  Synthetic
acctcaggtacctttaagaccaatgacttacaagggagctctagatcttagccactttttaagagaaaagggggg

SEQ ID NO: 190382 - DNA, 75 bp, Artificial Sequence
  Synthetic
tgctctttcagtgtaaccacagaactaagagataagaggcacaaggagtatgcacttttttataaacttgatata

SEQ ID NO: 190383 - DNA, 75 bp, Artificial Sequence
  Synthetic
atagtagcattagtagtagtagcaataatagcaatagttgtgtggtccatagtattcatagaatataggaaaata

SEQ ID NO: 190384 - DNA, 75 bp, Artificial Sequence
  Synthetic
tagaaattacaacacatagttttaattgtagaggagaatttttctattgcaatacaacaaaactgtttaatagca

SEQ ID NO: 190385 - DNA, 75 bp, Artificial Sequence
  Synthetic
tttgctaactcctcaggaggggatttagaaattacaacacatagttttaattgtagaggagaatttttctattgc

SEQ ID NO: 190386 - DNA, 75 bp, Artificial Sequence
  Synthetic
acaagtgggcaagtctgtggaattggtttaacatatcaaattggctgtggtatataaaaatatttataatgatag

SEQ ID NO: 190387 - DNA, 75 bp, Artificial Sequence
  Synthetic
taataatcagatctcaaaatatctcagataatgcaaaaactataatagtacaccttaataaatctatacaaatta

SEQ ID NO: 190388 - DNA, 75 bp, Artificial Sequence
  Synthetic
taataatcagatctcaaaatatctcagataatgcaaaaactataatagtacaccttaataaatctatacatatta

SEQ ID NO: 190389 - DNA, 75 bp, Artificial Sequence
  Synthetic
taataatcagatctcaaaatatctcagataatgcaaaaactataatagtacaccttaataaatctatacacatta

SEQ ID NO: 190390 - DNA, 75 bp, Artificial Sequence
  Synthetic
taataatcagatctcaaaatatctcagataatgcaaaaactataatagtacaccttaataaatctatacagatta

SEQ ID NO: 190391 - DNA, 75 bp, Artificial Sequence
  Synthetic
taataatcagatctcaaaatatctcagataatgcaaaaactataatagtacaccttaattaatctatacaaatta

SEQ ID NO: 190392 - DNA, 75 bp, Artificial Sequence
  Synthetic
taataatcagatctcaaaatatctcagataatgcaaaaactataatagtacaccttaattaatctatacatatta

SEQ ID NO: 190393 - DNA, 75 bp, Artificial Sequence
  Synthetic
taataatcagatctcaaaatatctcagataatgcaaaaactataatagtacaccttaattaatctatacacatta

SEQ ID NO: 190394 - DNA, 75 bp, Artificial Sequence
  Synthetic
taataatcagatctcaaaatatctcagataatgcaaaaactataatagtacaccttaattaatctatacagatta

SEQ ID NO: 190395 - DNA, 75 bp, Artificial Sequence
  Synthetic
taataatcagatctcaaaatatctcagataatgcaaaaactataatagtacaccttaatcaatctatacaaatta

SEQ ID NO: 190396 - DNA, 75 bp, Artificial Sequence
  Synthetic
taataatcagatctcaaaatatctcagataatgcaaaaactataatagtacaccttaatcaatctatacatatta

SEQ ID NO: 190397 - DNA, 75 bp, Artificial Sequence
  Synthetic
taataatcagatctcaaaatatctcagataatgcaaaaactataatagtacaccttaatcaatctatacacatta

SEQ ID NO: 190398 - DNA, 75 bp, Artificial Sequence
  Synthetic
taataatcagatctcaaaatatctcagataatgcaaaaactataatagtacaccttaatcaatctatacagatta

SEQ ID NO: 190399 - DNA, 75 bp, Artificial Sequence
  Synthetic
taataatcagatctcaaaatatctcagataatgcaaaaactataatagtacaccttaatgaatctatacaaatta

SEQ ID NO: 190400 - DNA, 75 bp, Artificial Sequence
  Synthetic
taataatcagatctcaaaatatctcagataatgcaaaaactataatagtacaccttaatgaatctatacatatta

SEQ ID NO: 190401 - DNA, 75 bp, Artificial Sequence
  Synthetic
taataatcagatctcaaaatatctcagataatgcaaaaactataatagtacaccttaatgaatctatacacatta

SEQ ID NO: 190402 - DNA, 75 bp, Artificial Sequence
  Synthetic
taataatcagatctcaaaatatctcagataatgcaaaaactataatagtacaccttaatgaatctatacagatta

SEQ ID NO: 190403 - DNA, 75 bp, Artificial Sequence
  Synthetic
taataatcagatctcataatatctcagataatgcaaaaactataatagtacaccttaataaatctatacaaatta

SEQ ID NO: 190404 - DNA, 75 bp, Artificial Sequence
  Synthetic
taataatcagatctcataatatctcagataatgcaaaaactataatagtacaccttaataaatctatacatatta

SEQ ID NO: 190405 - DNA, 75 bp, Artificial Sequence
  Synthetic
taataatcagatctcataatatctcagataatgcaaaaactataatagtacaccttaataaatctatacacatta

SEQ ID NO: 190406 - DNA, 75 bp, Artificial Sequence
  Synthetic
taataatcagatctcataatatctcagataatgcaaaaactataatagtacaccttaataaatctatacagatta

SEQ ID NO: 190407 - DNA, 75 bp, Artificial Sequence
  Synthetic
taataatcagatctcataatatctcagataatgcaaaaactataatagtacaccttaattaatctatacaaatta

SEQ ID NO: 190408 - DNA, 75 bp, Artificial Sequence
  Synthetic
taataatcagatctcataatatctcagataatgcaaaaactataatagtacaccttaattaatctatacatatta

SEQ ID NO: 190409 - DNA, 75 bp, Artificial Sequence
  Synthetic
taataatcagatctcataatatctcagataatgcaaaaactataatagtacaccttaattaatctatacacatta

SEQ ID NO: 190410 - DNA, 75 bp, Artificial Sequence
  Synthetic
taataatcagatctcataatatctcagataatgcaaaaactataatagtacaccttaattaatctatacagatta

SEQ ID NO: 190411 - DNA, 75 bp, Artificial Sequence
  Synthetic
taataatcagatctcataatatctcagataatgcaaaaactataatagtacaccttaatcaatctatacaaatta

SEQ ID NO: 190412 - DNA, 75 bp, Artificial Sequence
  Synthetic
taataatcagatctcataatatctcagataatgcaaaaactataatagtacaccttaatcaatctatacatatta

SEQ ID NO: 190413 - DNA, 75 bp, Artificial Sequence
  Synthetic
taataatcagatctcataatatctcagataatgcaaaaactataatagtacaccttaatcaatctatacacatta

SEQ ID NO: 190414 - DNA, 75 bp, Artificial Sequence
  Synthetic
taataatcagatctcataatatctcagataatgcaaaaactataatagtacaccttaatcaatctatacagatta

SEQ ID NO: 190415 - DNA, 75 bp, Artificial Sequence
  Synthetic
taataatcagatctcataatatctcagataatgcaaaaactataatagtacaccttaatgaatctatacaaatta

SEQ ID NO: 190416 - DNA, 75 bp, Artificial Sequence
  Synthetic
taataatcagatctcataatatctcagataatgcaaaaactataatagtacaccttaatgaatctatacatatta

SEQ ID NO: 190417 - DNA, 75 bp, Artificial Sequence
  Synthetic
taataatcagatctcataatatctcagataatgcaaaaactataatagtacaccttaatgaatctatacacatta

SEQ ID NO: 190418 - DNA, 75 bp, Artificial Sequence
  Synthetic
taataatcagatctcataatatctcagataatgcaaaaactataatagtacaccttaatgaatctatacagatta

SEQ ID NO: 190419 - DNA, 75 bp, Artificial Sequence
  Synthetic
taataatcagatctcacaatatctcagataatgcaaaaactataatagtacaccttaataaatctatacaaatta

SEQ ID NO: 190420 - DNA, 75 bp, Artificial Sequence
  Synthetic
taataatcagatctcacaatatctcagataatgcaaaaactataatagtacaccttaataaatctatacatatta

SEQ ID NO: 190421 - DNA, 75 bp, Artificial Sequence
  Synthetic
taataatcagatctcacaatatctcagataatgcaaaaactataatagtacaccttaataaatctatacacatta

SEQ ID NO: 190422 - DNA, 75 bp, Artificial Sequence
  Synthetic
taataatcagatctcacaatatctcagataatgcaaaaactataatagtacaccttaataaatctatacagatta

SEQ ID NO: 190423 - DNA, 75 bp, Artificial Sequence
  Synthetic
taataatcagatctcacaatatctcagataatgcaaaaactataatagtacaccttaattaatctatacaaatta

SEQ ID NO: 190424 - DNA, 75 bp, Artificial Sequence
  Synthetic
taataatcagatctcacaatatctcagataatgcaaaaactataatagtacaccttaattaatctatacatatta

SEQ ID NO: 190425 - DNA, 75 bp, Artificial Sequence
  Synthetic
taataatcagatctcacaatatctcagataatgcaaaaactataatagtacaccttaattaatctatacacatta

SEQ ID NO: 190426 - DNA, 75 bp, Artificial Sequence
  Synthetic
taataatcagatctcacaatatctcagataatgcaaaaactataatagtacaccttaattaatctatacagatta

SEQ ID NO: 190427 - DNA, 75 bp, Artificial Sequence
  Synthetic
taataatcagatctcacaatatctcagataatgcaaaaactataatagtacaccttaatcaatctatacaaatta

SEQ ID NO: 190428 - DNA, 75 bp, Artificial Sequence
  Synthetic
taataatcagatctcacaatatctcagataatgcaaaaactataatagtacaccttaatcaatctatacatatta

SEQ ID NO: 190429 - DNA, 75 bp, Artificial Sequence
  Synthetic
taataatcagatctcacaatatctcagataatgcaaaaactataatagtacaccttaatcaatctatacacatta

SEQ ID NO: 190430 - DNA, 75 bp, Artificial Sequence
  Synthetic
taataatcagatctcacaatatctcagataatgcaaaaactataatagtacaccttaatcaatctatacagatta

SEQ ID NO: 190431 - DNA, 75 bp, Artificial Sequence
  Synthetic
taataatcagatctcacaatatctcagataatgcaaaaactataatagtacaccttaatgaatctatacaaatta

SEQ ID NO: 190432 - DNA, 75 bp, Artificial Sequence
  Synthetic
taataatcagatctcacaatatctcagataatgcaaaaactataatagtacaccttaatgaatctatacatatta

SEQ ID NO: 190433 - DNA, 75 bp, Artificial Sequence
  Synthetic
taataatcagatctcacaatatctcagataatgcaaaaactataatagtacaccttaatgaatctatacacatta

SEQ ID NO: 190434 - DNA, 75 bp, Artificial Sequence
  Synthetic
taataatcagatctcacaatatctcagataatgcaaaaactataatagtacaccttaatgaatctatacagatta

SEQ ID NO: 190435 - DNA, 75 bp, Artificial Sequence
  Synthetic
taataatcagatctcagaatatctcagataatgcaaaaactataatagtacaccttaataaatctatacaaatta

SEQ ID NO: 190436 - DNA, 75 bp, Artificial Sequence
  Synthetic
taataatcagatctcagaatatctcagataatgcaaaaactataatagtacaccttaataaatctatacatatta

SEQ ID NO: 190437 - DNA, 75 bp, Artificial Sequence
  Synthetic
taataatcagatctcagaatatctcagataatgcaaaaactataatagtacaccttaataaatctatacacatta

SEQ ID NO: 190438 - DNA, 75 bp, Artificial Sequence
  Synthetic
taataatcagatctcagaatatctcagataatgcaaaaactataatagtacaccttaataaatctatacagatta

SEQ ID NO: 190439 - DNA, 75 bp, Artificial Sequence
  Synthetic
taataatcagatctcagaatatctcagataatgcaaaaactataatagtacaccttaattaatctatacaaatta

SEQ ID NO: 190440 - DNA, 75 bp, Artificial Sequence
  Synthetic
taataatcagatctcagaatatctcagataatgcaaaaactataatagtacaccttaattaatctatacatatta

SEQ ID NO: 190441 - DNA, 75 bp, Artificial Sequence
  Synthetic
taataatcagatctcagaatatctcagataatgcaaaaactataatagtacaccttaattaatctatacacatta

SEQ ID NO: 190442 - DNA, 75 bp, Artificial Sequence
  Synthetic
taataatcagatctcagaatatctcagataatgcaaaaactataatagtacaccttaattaatctatacagatta

SEQ ID NO: 190443 - DNA, 75 bp, Artificial Sequence
  Synthetic
taataatcagatctcagaatatctcagataatgcaaaaactataatagtacaccttaatcaatctatacaaatta

SEQ ID NO: 190444 - DNA, 75 bp, Artificial Sequence
  Synthetic
taataatcagatctcagaatatctcagataatgcaaaaactataatagtacaccttaatcaatctatacatatta

SEQ ID NO: 190445 - DNA, 75 bp, Artificial Sequence
  Synthetic
taataatcagatctcagaatatctcagataatgcaaaaactataatagtacaccttaatcaatctatacacatta

SEQ ID NO: 190446 - DNA, 75 bp, Artificial Sequence
  Synthetic
taataatcagatctcagaatatctcagataatgcaaaaactataatagtacaccttaatcaatctatacagatta

SEQ ID NO: 190447 - DNA, 75 bp, Artificial Sequence
  Synthetic
taataatcagatctcagaatatctcagataatgcaaaaactataatagtacaccttaatgaatctatacaaatta

SEQ ID NO: 190448 - DNA, 75 bp, Artificial Sequence
  Synthetic
taataatcagatctcagaatatctcagataatgcaaaaactataatagtacaccttaatgaatctatacatatta

SEQ ID NO: 190449 - DNA, 75 bp, Artificial Sequence
  Synthetic
taataatcagatctcagaatatctcagataatgcaaaaactataatagtacaccttaatgaatctatacacatta

SEQ ID NO: 190450 - DNA, 75 bp, Artificial Sequence
  Synthetic
taataatcagatctcagaatatctcagataatgcaaaaactataatagtacaccttaatgaatctatacagatta

SEQ ID NO: 190451 - DNA, 75 bp, Artificial Sequence
  Synthetic
ggcacattgtaatattagtgaagaacaatggtataataaattaaaccaggtaagggcaaagttaaaaactctttt

SEQ ID NO: 190452 - DNA, 75 bp, Artificial Sequence
  Synthetic
aggatagagataaaagacaccaaggaagctttagataagatagaggaagagcaaaacaaaagtaagaaaaaggca

SEQ ID NO: 190453 - DNA, 75 bp, Artificial Sequence
  Synthetic
taagggcaaagttaaaaactcttttccctaatgcaacaataaaatttaactcatcctcaggaggggacctaaaaa

SEQ ID NO: 190454 - DNA, 75 bp, Artificial Sequence
  Synthetic
tacaggagaaagagattggcatttgggtcagggagtctccatagaatggaggaaaaggagatatagcacacaagt

SEQ ID NO: 190455 - DNA, 75 bp, Artificial Sequence
  Synthetic
gaagaagaagtaggctttccagtcagacctcaggtgcctttaagaccaatgacttataagggagcatttgatctc

SEQ ID NO: 190456 - DNA, 75 bp, Artificial Sequence
  Synthetic
caggaggagatctagaagttacaacacatagctttaattgtagaggagaatttttctattgcaatacaacaaaac

SEQ ID NO: 190457 - DNA, 75 bp, Artificial Sequence
  Synthetic
caaaagatggtggtaagaataatggtacttctaatcagactgaaatcttcagacctgggggaggaaatatcaaaa

SEQ ID NO: 190458 - DNA, 75 bp, Artificial Sequence
  Synthetic
caaaagatggtggtaagaataatggtacttctaatcagactgaaatcttcagacctgggggaggaaatatcaaat

SEQ ID NO: 190459 - DNA, 75 bp, Artificial Sequence
  Synthetic
caaaagatggtggtaagaataatggtacttctaatcagactgaaatcttcagacctgggggaggaaatatcaaac

SEQ ID NO: 190460 - DNA, 75 bp, Artificial Sequence
  Synthetic
caaaagatggtggtaagaataatggtacttctaatcagactgaaatcttcagacctgggggaggaaatatcaaag

SEQ ID NO: 190461 - DNA, 75 bp, Artificial Sequence
  Synthetic
caaaagatggtggtaagaataatggtacttctaatcagactgatatcttcagacctgggggaggaaatatcaaaa

SEQ ID NO: 190462 - DNA, 75 bp, Artificial Sequence
  Synthetic
caaaagatggtggtaagaataatggtacttctaatcagactgatatcttcagacctgggggaggaaatatcaaat

SEQ ID NO: 190463 - DNA, 75 bp, Artificial Sequence
  Synthetic
caaaagatggtggtaagaataatggtacttctaatcagactgatatcttcagacctgggggaggaaatatcaaac

SEQ ID NO: 190464 - DNA, 75 bp, Artificial Sequence
  Synthetic
caaaagatggtggtaagaataatggtacttctaatcagactgatatcttcagacctgggggaggaaatatcaaag

SEQ ID NO: 190465 - DNA, 75 bp, Artificial Sequence
  Synthetic
caaaagatggtggtaagaataatggtacttctaatcagactgacatcttcagacctgggggaggaaatatcaaaa

SEQ ID NO: 190466 - DNA, 75 bp, Artificial Sequence
  Synthetic
caaaagatggtggtaagaataatggtacttctaatcagactgacatcttcagacctgggggaggaaatatcaaat

SEQ ID NO: 190467 - DNA, 75 bp, Artificial Sequence
  Synthetic
caaaagatggtggtaagaataatggtacttctaatcagactgacatcttcagacctgggggaggaaatatcaaac

SEQ ID NO: 190468 - DNA, 75 bp, Artificial Sequence
  Synthetic
caaaagatggtggtaagaataatggtacttctaatcagactgacatcttcagacctgggggaggaaatatcaaag

SEQ ID NO: 190469 - DNA, 75 bp, Artificial Sequence
  Synthetic
caaaagatggtggtaagaataatggtacttctaatcagactgagatcttcagacctgggggaggaaatatcaaaa

SEQ ID NO: 190470 - DNA, 75 bp, Artificial Sequence
  Synthetic
caaaagatggtggtaagaataatggtacttctaatcagactgagatcttcagacctgggggaggaaatatcaaat

SEQ ID NO: 190471 - DNA, 75 bp, Artificial Sequence
  Synthetic
caaaagatggtggtaagaataatggtacttctaatcagactgagatcttcagacctgggggaggaaatatcaaac

SEQ ID NO: 190472 - DNA, 75 bp, Artificial Sequence
  Synthetic
caaaagatggtggtaagaataatggtacttctaatcagactgagatcttcagacctgggggaggaaatatcaaag

SEQ ID NO: 190473 - DNA, 75 bp, Artificial Sequence
  Synthetic
caaaagatggtggttagaataatggtacttctaatcagactgaaatcttcagacctgggggaggaaatatcaaaa

SEQ ID NO: 190474 - DNA, 75 bp, Artificial Sequence
  Synthetic
caaaagatggtggttagaataatggtacttctaatcagactgaaatcttcagacctgggggaggaaatatcaaat

SEQ ID NO: 190475 - DNA, 75 bp, Artificial Sequence
  Synthetic
caaaagatggtggttagaataatggtacttctaatcagactgaaatcttcagacctgggggaggaaatatcaaac

SEQ ID NO: 190476 - DNA, 75 bp, Artificial Sequence
  Synthetic
caaaagatggtggttagaataatggtacttctaatcagactgaaatcttcagacctgggggaggaaatatcaaag

SEQ ID NO: 190477 - DNA, 75 bp, Artificial Sequence
  Synthetic
caaaagatggtggttagaataatggtacttctaatcagactgatatcttcagacctgggggaggaaatatcaaaa

SEQ ID NO: 190478 - DNA, 75 bp, Artificial Sequence
  Synthetic
caaaagatggtggttagaataatggtacttctaatcagactgatatcttcagacctgggggaggaaatatcaaat

SEQ ID NO: 190479 - DNA, 75 bp, Artificial Sequence
  Synthetic
caaaagatggtggttagaataatggtacttctaatcagactgatatcttcagacctgggggaggaaatatcaaac

SEQ ID NO: 190480 - DNA, 75 bp, Artificial Sequence
  Synthetic
caaaagatggtggttagaataatggtacttctaatcagactgatatcttcagacctgggggaggaaatatcaaag

SEQ ID NO: 190481 - DNA, 75 bp, Artificial Sequence
  Synthetic
caaaagatggtggttagaataatggtacttctaatcagactgacatcttcagacctgggggaggaaatatcaaaa

SEQ ID NO: 190482 - DNA, 75 bp, Artificial Sequence
  Synthetic
caaaagatggtggttagaataatggtacttctaatcagactgacatcttcagacctgggggaggaaatatcaaat

SEQ ID NO: 190483 - DNA, 75 bp, Artificial Sequence
  Synthetic
caaaagatggtggttagaataatggtacttctaatcagactgacatcttcagacctgggggaggaaatatcaaac

SEQ ID NO: 190484 - DNA, 75 bp, Artificial Sequence
  Synthetic
caaaagatggtggttagaataatggtacttctaatcagactgacatcttcagacctgggggaggaaatatcaaag

SEQ ID NO: 190485 - DNA, 75 bp, Artificial Sequence
  Synthetic
caaaagatggtggttagaataatggtacttctaatcagactgagatcttcagacctgggggaggaaatatcaaaa

SEQ ID NO: 190486 - DNA, 75 bp, Artificial Sequence
  Synthetic
caaaagatggtggttagaataatggtacttctaatcagactgagatcttcagacctgggggaggaaatatcaaat

SEQ ID NO: 190487 - DNA, 75 bp, Artificial Sequence
  Synthetic
caaaagatggtggttagaataatggtacttctaatcagactgagatcttcagacctgggggaggaaatatcaaac

SEQ ID NO: 190488 - DNA, 75 bp, Artificial Sequence
  Synthetic
caaaagatggtggttagaataatggtacttctaatcagactgagatcttcagacctgggggaggaaatatcaaag

SEQ ID NO: 190489 - DNA, 75 bp, Artificial Sequence
  Synthetic
caaaagatggtggtcagaataatggtacttctaatcagactgaaatcttcagacctgggggaggaaatatcaaaa

SEQ ID NO: 190490 - DNA, 75 bp, Artificial Sequence
  Synthetic
caaaagatggtggtcagaataatggtacttctaatcagactgaaatcttcagacctgggggaggaaatatcaaat

SEQ ID NO: 190491 - DNA, 75 bp, Artificial Sequence
  Synthetic
caaaagatggtggtcagaataatggtacttctaatcagactgaaatcttcagacctgggggaggaaatatcaaac

SEQ ID NO: 190492 - DNA, 75 bp, Artificial Sequence
  Synthetic
caaaagatggtggtcagaataatggtacttctaatcagactgaaatcttcagacctgggggaggaaatatcaaag

SEQ ID NO: 190493 - DNA, 75 bp, Artificial Sequence
  Synthetic
caaaagatggtggtcagaataatggtacttctaatcagactgatatcttcagacctgggggaggaaatatcaaaa

SEQ ID NO: 190494 - DNA, 75 bp, Artificial Sequence
  Synthetic
caaaagatggtggtcagaataatggtacttctaatcagactgatatcttcagacctgggggaggaaatatcaaat

SEQ ID NO: 190495 - DNA, 75 bp, Artificial Sequence
  Synthetic
caaaagatggtggtcagaataatggtacttctaatcagactgatatcttcagacctgggggaggaaatatcaaac

SEQ ID NO: 190496 - DNA, 75 bp, Artificial Sequence
  Synthetic
caaaagatggtggtcagaataatggtacttctaatcagactgatatcttcagacctgggggaggaaatatcaaag

SEQ ID NO: 190497 - DNA, 75 bp, Artificial Sequence
  Synthetic
caaaagatggtggtcagaataatggtacttctaatcagactgacatcttcagacctgggggaggaaatatcaaaa

SEQ ID NO: 190498 - DNA, 75 bp, Artificial Sequence
  Synthetic
caaaagatggtggtcagaataatggtacttctaatcagactgacatcttcagacctgggggaggaaatatcaaat

SEQ ID NO: 190499 - DNA, 75 bp, Artificial Sequence
  Synthetic
caaaagatggtggtcagaataatggtacttctaatcagactgacatcttcagacctgggggaggaaatatcaaac

SEQ ID NO: 190500 - DNA, 75 bp, Artificial Sequence
  Synthetic
caaaagatggtggtcagaataatggtacttctaatcagactgacatcttcagacctgggggaggaaatatcaaag

SEQ ID NO: 190501 - DNA, 75 bp, Artificial Sequence
  Synthetic
caaaagatggtggtcagaataatggtacttctaatcagactgagatcttcagacctgggggaggaaatatcaaaa

SEQ ID NO: 190502 - DNA, 75 bp, Artificial Sequence
  Synthetic
caaaagatggtggtcagaataatggtacttctaatcagactgagatcttcagacctgggggaggaaatatcaaat

SEQ ID NO: 190503 - DNA, 75 bp, Artificial Sequence
  Synthetic
caaaagatggtggtcagaataatggtacttctaatcagactgagatcttcagacctgggggaggaaatatcaaac

SEQ ID NO: 190504 - DNA, 75 bp, Artificial Sequence
  Synthetic
caaaagatggtggtcagaataatggtacttctaatcagactgagatcttcagacctgggggaggaaatatcaaag

SEQ ID NO: 190505 - DNA, 75 bp, Artificial Sequence
  Synthetic
caaaagatggtggtgagaataatggtacttctaatcagactgaaatcttcagacctgggggaggaaatatcaaaa

SEQ ID NO: 190506 - DNA, 75 bp, Artificial Sequence
  Synthetic
caaaagatggtggtgagaataatggtacttctaatcagactgaaatcttcagacctgggggaggaaatatcaaat

SEQ ID NO: 190507 - DNA, 75 bp, Artificial Sequence
  Synthetic
caaaagatggtggtgagaataatggtacttctaatcagactgaaatcttcagacctgggggaggaaatatcaaac

SEQ ID NO: 190508 - DNA, 75 bp, Artificial Sequence
  Synthetic
caaaagatggtggtgagaataatggtacttctaatcagactgaaatcttcagacctgggggaggaaatatcaaag

SEQ ID NO: 190509 - DNA, 75 bp, Artificial Sequence
  Synthetic
caaaagatggtggtgagaataatggtacttctaatcagactgatatcttcagacctgggggaggaaatatcaaaa

SEQ ID NO: 190510 - DNA, 75 bp, Artificial Sequence
  Synthetic
caaaagatggtggtgagaataatggtacttctaatcagactgatatcttcagacctgggggaggaaatatcaaat

SEQ ID NO: 190511 - DNA, 75 bp, Artificial Sequence
  Synthetic
caaaagatggtggtgagaataatggtacttctaatcagactgatatcttcagacctgggggaggaaatatcaaac

SEQ ID NO: 190512 - DNA, 75 bp, Artificial Sequence
  Synthetic
caaaagatggtggtgagaataatggtacttctaatcagactgatatcttcagacctgggggaggaaatatcaaag

SEQ ID NO: 190513 - DNA, 75 bp, Artificial Sequence
  Synthetic
caaaagatggtggtgagaataatggtacttctaatcagactgacatcttcagacctgggggaggaaatatcaaaa

SEQ ID NO: 190514 - DNA, 75 bp, Artificial Sequence
  Synthetic
caaaagatggtggtgagaataatggtacttctaatcagactgacatcttcagacctgggggaggaaatatcaaat

SEQ ID NO: 190515 - DNA, 75 bp, Artificial Sequence
  Synthetic
caaaagatggtggtgagaataatggtacttctaatcagactgacatcttcagacctgggggaggaaatatcaaac

SEQ ID NO: 190516 - DNA, 75 bp, Artificial Sequence
  Synthetic
caaaagatggtggtgagaataatggtacttctaatcagactgacatcttcagacctgggggaggaaatatcaaag

SEQ ID NO: 190517 - DNA, 75 bp, Artificial Sequence
  Synthetic
caaaagatggtggtgagaataatggtacttctaatcagactgagatcttcagacctgggggaggaaatatcaaaa

SEQ ID NO: 190518 - DNA, 75 bp, Artificial Sequence
  Synthetic
caaaagatggtggtgagaataatggtacttctaatcagactgagatcttcagacctgggggaggaaatatcaaat

SEQ ID NO: 190519 - DNA, 75 bp, Artificial Sequence
  Synthetic
caaaagatggtggtgagaataatggtacttctaatcagactgagatcttcagacctgggggaggaaatatcaaac

SEQ ID NO: 190520 - DNA, 75 bp, Artificial Sequence
  Synthetic
caaaagatggtggtgagaataatggtacttctaatcagactgagatcttcagacctgggggaggaaatatcaaag

SEQ ID NO: 190521 - DNA, 75 bp, Artificial Sequence
  Synthetic
cctggatgaaatgggaaaaggaaattggcaattactcaaatgaaatatacaggttaattgaagcatcgcagaaac

SEQ ID NO: 190522 - DNA, 75 bp, Artificial Sequence
  Synthetic
cctggatgaaatgggaaaaggaaattggcaattactcaaatgaaatatacaggttaattgaagcatcgcagaatc

SEQ ID NO: 190523 - DNA, 75 bp, Artificial Sequence
  Synthetic
cctggatgaaatgggaaaaggaaattggcaattactcaaatgaaatatacaggttaattgaagcatcgcagaacc

SEQ ID NO: 190524 - DNA, 75 bp, Artificial Sequence
  Synthetic
cctggatgaaatgggaaaaggaaattggcaattactcaaatgaaatatacaggttaattgaagcatcgcagaagc

SEQ ID NO: 190525 - DNA, 75 bp, Artificial Sequence
  Synthetic
cctggatgtaatgggaaaaggaaattggcaattactcaaatgaaatatacaggttaattgaagcatcgcagaaac

SEQ ID NO: 190526 - DNA, 75 bp, Artificial Sequence
  Synthetic
cctggatgtaatgggaaaaggaaattggcaattactcaaatgaaatatacaggttaattgaagcatcgcagaatc

SEQ ID NO: 190527 - DNA, 75 bp, Artificial Sequence
  Synthetic
cctggatgtaatgggaaaaggaaattggcaattactcaaatgaaatatacaggttaattgaagcatcgcagaacc

SEQ ID NO: 190528 - DNA, 75 bp, Artificial Sequence
  Synthetic
cctggatgtaatgggaaaaggaaattggcaattactcaaatgaaatatacaggttaattgaagcatcgcagaagc

SEQ ID NO: 190529 - DNA, 75 bp, Artificial Sequence
  Synthetic
cctggatgcaatgggaaaaggaaattggcaattactcaaatgaaatatacaggttaattgaagcatcgcagaaac

SEQ ID NO: 190530 - DNA, 75 bp, Artificial Sequence
  Synthetic
cctggatgcaatgggaaaaggaaattggcaattactcaaatgaaatatacaggttaattgaagcatcgcagaatc

SEQ ID NO: 190531 - DNA, 75 bp, Artificial Sequence
  Synthetic
cctggatgcaatgggaaaaggaaattggcaattactcaaatgaaatatacaggttaattgaagcatcgcagaacc

SEQ ID NO: 190532 - DNA, 75 bp, Artificial Sequence
  Synthetic
cctggatgcaatgggaaaaggaaattggcaattactcaaatgaaatatacaggttaattgaagcatcgcagaagc

SEQ ID NO: 190533 - DNA, 75 bp, Artificial Sequence
  Synthetic
cctggatggaatgggaaaaggaaattggcaattactcaaatgaaatatacaggttaattgaagcatcgcagaaac

SEQ ID NO: 190534 - DNA, 75 bp, Artificial Sequence
  Synthetic
cctggatggaatgggaaaaggaaattggcaattactcaaatgaaatatacaggttaattgaagcatcgcagaatc

SEQ ID NO: 190535 - DNA, 75 bp, Artificial Sequence
  Synthetic
cctggatggaatgggaaaaggaaattggcaattactcaaatgaaatatacaggttaattgaagcatcgcagaacc

SEQ ID NO: 190536 - DNA, 75 bp, Artificial Sequence
  Synthetic
cctggatggaatgggaaaaggaaattggcaattactcaaatgaaatatacaggttaattgaagcatcgcagaagc

SEQ ID NO: 190537 - DNA, 75 bp, Artificial Sequence
  Synthetic
cccatagtaggagcagaaactttctatgtagatggggcagctaatagggagactaaattaggaaaagcaggatat

SEQ ID NO: 190538 - DNA, 75 bp, Artificial Sequence
  Synthetic
aactccttaggggagccaaagcactaacagacatagtaccactgactgaagaagcagaattagaattggcagaga

SEQ ID NO: 190539 - DNA, 75 bp, Artificial Sequence
  Synthetic
attagcattggacagttggaaaaatctgtggaattggtttgatataacaaattggctatggtatataagaatatt

SEQ ID NO: 190540 - DNA, 75 bp, Artificial Sequence
  Synthetic
aaagttaactcctctctgcattactttagattgtaacatagtggtaaatgaaactgaagtaagaaactgttcttt

SEQ ID NO: 190541 - DNA, 75 bp, Artificial Sequence
  Synthetic
gacctggaaagacatggagcaatcacaagtagcaatacagcagctaccaatgctgattgtgcctggctagaagca

SEQ ID NO: 190542 - DNA, 75 bp, Artificial Sequence
  Synthetic
aaaattcggttaaggccagggggaaagaaacaatatagaatgaaacatctagtatgggcaagcagggagctggaa

SEQ ID NO: 190543 - DNA, 75 bp, Artificial Sequence
  Synthetic
ggctgacaaggaggtcagtcaaaattatcctatagtgcagaatcttcaagggcaaatggtacaccagcccatatc

SEQ ID NO: 190544 - DNA, 75 bp, Artificial Sequence
  Synthetic
atagcacacaagtagaccctgacctagcagaccaactaattcatctgtattactttgattgtttttcagaatctg

SEQ ID NO: 190545 - DNA, 75 bp, Artificial Sequence
  Synthetic
acaaaggaaaatagacaggttaattgatagaataagagaaagagcagaagacagtggcaatgagagtgaggggga

SEQ ID NO: 190546 - DNA, 75 bp, Artificial Sequence
  Synthetic
catccctcccgacaggatcggaggagattagatcattatataatacagtagcagtcctctattatgtacatcaaa

SEQ ID NO: 190547 - DNA, 75 bp, Artificial Sequence
  Synthetic
gcagtcctctattatgtacatcaaaggatacctgtaaaagataccaaagaagctttagagaagttagaggaagag

SEQ ID NO: 190548 - DNA, 75 bp, Artificial Sequence
  Synthetic
tggggtacctgtgtggaaagaagcaaccaccactctattttgtgcatcagatgctaacgcagttaaaacagaggc

SEQ ID NO: 190549 - DNA, 75 bp, Artificial Sequence
  Synthetic
aggggaggccagggaatttccttcagagcagaccagagccaacagccccaccagcagagagcttcaggttcgagg

SEQ ID NO: 190550 - DNA, 75 bp, Artificial Sequence
  Synthetic
aaatgaaaaactgctctttcaatgtcaccacaagcataggagataagatgcagaaagaatatgcacttttttata

SEQ ID NO: 190551 - DNA, 75 bp, Artificial Sequence
  Synthetic
agtttccctcaaatcactctttggcaacgacccattgtcacagtaaaaataggaggacagctaaaggaagctctg

SEQ ID NO: 190552 - DNA, 75 bp, Artificial Sequence
  Synthetic
ggggagaataatgtatgtaacagaacgaatacaaggaggtataagacaagcacattgcaacattagtagagaaaa

SEQ ID NO: 190553 - DNA, 75 bp, Artificial Sequence
  Synthetic
gcgacgaagcgctcctccaagcaataaggatcatcagaatcctgtatcaaagcagtaagtaccatatagtggatg

SEQ ID NO: 190554 - DNA, 75 bp, Artificial Sequence
  Synthetic
taaaaaactgctctttcaatatcacagcaggcataagagataaagttcagaaagcatttgcatttttttataagc

SEQ ID NO: 190555 - DNA, 75 bp, Artificial Sequence
  Synthetic
taattgtgtggaccatagtatatatagaatataggaaactagtaaaacaaagaaaaatagacaggttaattaaaa

SEQ ID NO: 190556 - DNA, 75 bp, Artificial Sequence
  Synthetic
gctaggaaaagcaggatatgtcactgacagaggaagacaaaaggttgtttccctaactgaaacaacaaatcaaaa

SEQ ID NO: 190557 - DNA, 75 bp, Artificial Sequence
  Synthetic
gcaagagcagaagacagtggcaatgagagtgatggagatacagaggagttatccaaacttttggaaatgggggac

SEQ ID NO: 190558 - DNA, 75 bp, Artificial Sequence
  Synthetic
acatggatgatttgtatgtagggtctgacttagaaatagggcaacatagagcaaaaatagaggaactaagagaac

SEQ ID NO: 190559 - DNA, 75 bp, Artificial Sequence
  Synthetic
gccataataagaattctgcaacaactgctgtttattcatttcagaattgggtgtcaacatagcagaataggcatt

SEQ ID NO: 190560 - DNA, 75 bp, Artificial Sequence
  Synthetic
ctcaagaagatcatgaaagatatcacagcaattggagaacaatggctagtgattttaatctgccacctatagtag

SEQ ID NO: 190561 - DNA, 75 bp, Artificial Sequence
  Synthetic
aagtttgtttcatgaaaaaaggcttaggcatctcctatggcaggaagaagagaagacagcgacgaagagctcctc

SEQ ID NO: 190562 - DNA, 75 bp, Artificial Sequence
  Synthetic
aaactaaaaataataatactactcctagtagccctgtgaacaaagaagaaataaaaaactgctctttcagtgcaa

SEQ ID NO: 190563 - DNA, 75 bp, Artificial Sequence
  Synthetic
aaactaataataataatactactcctagtagccctgtgaacaaagaagaaataaaaaactgctctttcagtgcaa

SEQ ID NO: 190564 - DNA, 75 bp, Artificial Sequence
  Synthetic
aaactaacaataataatactactcctagtagccctgtgaacaaagaagaaataaaaaactgctctttcagtgcaa

SEQ ID NO: 190565 - DNA, 75 bp, Artificial Sequence
  Synthetic
aaactaagaataataatactactcctagtagccctgtgaacaaagaagaaataaaaaactgctctttcagtgcaa

SEQ ID NO: 190566 - DNA, 75 bp, Artificial Sequence
  Synthetic
ggatttggggttgctctggaaaactcatctgcaccactaatgtgccttggaattctagttggagtaataaatctc

SEQ ID NO: 190567 - DNA, 75 bp, Artificial Sequence
  Synthetic
ctcagccattaaacaggcttgtccaaaggtaacctttgagccaattcccatacattattgtgctccagctggttt

SEQ ID NO: 190568 - DNA, 75 bp, Artificial Sequence
  Synthetic
actcaactgctgttaaatggtagcctatcagaagaagagatagtaattagatctgagaatatttcagacaatgcc

SEQ ID NO: 190569 - DNA, 75 bp, Artificial Sequence
  Synthetic
atgatttgtaatgtggtaggaaacttgtgggtcacagtctattatggggtacctgtgtggaaagaagcaaaagct

SEQ ID NO: 190570 - DNA, 75 bp, Artificial Sequence
  Synthetic
tctatgcaacaggtgccataataggagatataagacaagcacattgtaatgttagtgaagaccaatggactaaga

SEQ ID NO: 190571 - DNA, 75 bp, Artificial Sequence
  Synthetic
tctatgcaacaggtgccataataggagatataagacaagcacattgtaatgttagtgaagacctatggactaaga

SEQ ID NO: 190572 - DNA, 75 bp, Artificial Sequence
  Synthetic
tctatgcaacaggtgccataataggagatataagacaagcacattgtaatgttagtgaagacccatggactaaga

SEQ ID NO: 190573 - DNA, 75 bp, Artificial Sequence
  Synthetic
tctatgcaacaggtgccataataggagatataagacaagcacattgtaatgttagtgaagaccgatggactaaga

SEQ ID NO: 190574 - DNA, 75 bp, Artificial Sequence
  Synthetic
cagttttgtttgtgcaggagaatttttctattgcaatacaacaggcttatttaatagtagttggacaagaaataa

SEQ ID NO: 190575 - DNA, 75 bp, Artificial Sequence
  Synthetic
aataaaacaaattataaacatgtggcagagagtaggacgagcaatgtataaccctcccataccaggagtaataaa

SEQ ID NO: 190576 - DNA, 75 bp, Artificial Sequence
  Synthetic
gttacaagcaatttatttagctttacaggattcaggatcagaagtgaacatagtaacagactcacagtatgcatt

SEQ ID NO: 190577 - DNA, 75 bp, Artificial Sequence
  Synthetic
gttacaagcaatttatttagctttacaggattcaggatcagaagtgaacatagtaacagactctcagtatgcatt

SEQ ID NO: 190578 - DNA, 75 bp, Artificial Sequence
  Synthetic
gttacaagcaatttatttagctttacaggattcaggatcagaagtgaacatagtaacagactcccagtatgcatt

SEQ ID NO: 190579 - DNA, 75 bp, Artificial Sequence
  Synthetic
gttacaagcaatttatttagctttacaggattcaggatcagaagtgaacatagtaacagactcgcagtatgcatt

SEQ ID NO: 190580 - DNA, 75 bp, Artificial Sequence
  Synthetic
gtataaggataggaccaggacaaacattctttgcaacaaatgaaataataggagacataagaaaagcatattgta

SEQ ID NO: 190581 - DNA, 75 bp, Artificial Sequence
  Synthetic
ctcgcaaatccagcaggagaaaaatgaaaaagatttattagcattggacagttgggcaaatctgtggaattggtt

SEQ ID NO: 190582 - DNA, 75 bp, Artificial Sequence
  Synthetic
ctcccttgcagaataaaacaaattgtaaacatgtggcaggaagtagggaaagcaatgtatgcccctcccattgaa

SEQ ID NO: 190583 - DNA, 75 bp, Artificial Sequence
  Synthetic
acatgtggcagggggtaggacgagcaatgtatgcccctcccattgaaggaaacataacatgtaaatcaaatatca

SEQ ID NO: 190584 - DNA, 75 bp, Artificial Sequence
  Synthetic
tatgatcttggggatgataataatttgtagtgctgtagaaaacttgtgggttactgtctactatggggtacctgt

SEQ ID NO: 190585 - DNA, 75 bp, Artificial Sequence
  Synthetic
aacaggacaagaaacagcatactatatactaaaattagcaggaagatggccagtcaaagtaatacacacagacaa

SEQ ID NO: 190586 - DNA, 75 bp, Artificial Sequence
  Synthetic
ggcctcaaatatctggggaatcttctgttgtattggggtcgggagctaaggaatagtgctattaatttgcttgat

SEQ ID NO: 190587 - DNA, 75 bp, Artificial Sequence
  Synthetic
gccatattaggacacatagttattcctaggtgtgactatcaagcaggacataataataaggtaggatctctacaa

SEQ ID NO: 190588 - DNA, 75 bp, Artificial Sequence
  Synthetic
acagggctttgaagcagctttgctataaaatggggaacaagtggtcaaaaagctggcctgctgtaagagaaagaa

SEQ ID NO: 190589 - DNA, 75 bp, Artificial Sequence
  Synthetic
accaaacaacgaatggacactagagcttttggaggagcttaaaaatgaagctgttagacattttcctagaccctg

SEQ ID NO: 190590 - DNA, 75 bp, Artificial Sequence
  Synthetic
tttaaaagctttgggcccagggccttcacttgaagaactgacgacccctggtccgggagtgggaggacctagcca

SEQ ID NO: 190591 - DNA, 75 bp, Artificial Sequence
  Synthetic
gtaggaggcttggtaggtttaagaatagtttttgctgtactttctatagtaaatagagttaggcagggatactca

SEQ ID NO: 190592 - DNA, 75 bp, Artificial Sequence
  Synthetic
ttaattgaaaaatcgcagaaccaacaagaaaagaatgaacaagaattattggaattagataaatgggcaagtttg

SEQ ID NO: 190593 - DNA, 75 bp, Artificial Sequence
  Synthetic
gggtgtaggagcagcagcagagggagtaggagcagcatctcaagacttagctaaacatggagcatttacaaccag

SEQ ID NO: 190594 - DNA, 75 bp, Artificial Sequence
  Synthetic
gaaagaataaatcaaacccctccagcagcggcagcaggagtaggagcagtatctcaagatttagccaaacatgga

SEQ ID NO: 190595 - DNA, 75 bp, Artificial Sequence
  Synthetic
gggggaaagaaacattatatgctaaaacatttagtatgggcaagcagggagctggaaagatttgcacttaaccct

SEQ ID NO: 190596 - DNA, 75 bp, Artificial Sequence
  Synthetic
ttgtaccagacctaacaataatacaagaaaaggtatacatataggaccaggacaagcattctacgcaacaggtga

SEQ ID NO: 190597 - DNA, 75 bp, Artificial Sequence
  Synthetic
atagcagtagctgaggggacagataggattatagaagtattacaaagagcttgtagagctattctccacatacct

SEQ ID NO: 190598 - DNA, 75 bp, Artificial Sequence
  Synthetic
tagtatttatagaatataggaaaataagaaaacaaaagagaatagataggttaattgatagaataagagaaagag

SEQ ID NO: 190599 - DNA, 75 bp, Artificial Sequence
  Synthetic
tggcactaacagcattagtagctccaaagaagacaaagccacctttgcctagtgttaagaaactagtagaagata

SEQ ID NO: 190600 - DNA, 75 bp, Artificial Sequence
  Synthetic
agtgttaagaaactagtagaagatagatggaacaagccccaggagaccaagggccacagagggagccatacaatg

SEQ ID NO: 190601 - DNA, 75 bp, Artificial Sequence
  Synthetic
gaatttttctattgtgatacatcaggcctgtttaatagcgcttgggcagccaatagcacttggacagccaatgac

SEQ ID NO: 190602 - DNA, 75 bp, Artificial Sequence
  Synthetic
agaagtaaaagacaccaaggaagctttagataaaatagaggagatacaaaataagaataagcaaaagaaacagca

SEQ ID NO: 190603 - DNA, 75 bp, Artificial Sequence
  Synthetic
agaagtaaaagacaccaaggaagctttagataaaatagaggagatacaaaataagattaagcaaaagaaacagca

SEQ ID NO: 190604 - DNA, 75 bp, Artificial Sequence
  Synthetic
agaagtaaaagacaccaaggaagctttagataaaatagaggagatacaaaataagactaagcaaaagaaacagca

SEQ ID NO: 190605 - DNA, 75 bp, Artificial Sequence
  Synthetic
agaagtaaaagacaccaaggaagctttagataaaatagaggagatacaaaataagagtaagcaaaagaaacagca

SEQ ID NO: 190606 - DNA, 75 bp, Artificial Sequence
  Synthetic
agaagtaatagacaccaaggaagctttagataaaatagaggagatacaaaataagaataagcaaaagaaacagca

SEQ ID NO: 190607 - DNA, 75 bp, Artificial Sequence
  Synthetic
agaagtaatagacaccaaggaagctttagataaaatagaggagatacaaaataagattaagcaaaagaaacagca

SEQ ID NO: 190608 - DNA, 75 bp, Artificial Sequence
  Synthetic
agaagtaatagacaccaaggaagctttagataaaatagaggagatacaaaataagactaagcaaaagaaacagca

SEQ ID NO: 190609 - DNA, 75 bp, Artificial Sequence
  Synthetic
agaagtaatagacaccaaggaagctttagataaaatagaggagatacaaaataagagtaagcaaaagaaacagca

SEQ ID NO: 190610 - DNA, 75 bp, Artificial Sequence
  Synthetic
agaagtaacagacaccaaggaagctttagataaaatagaggagatacaaaataagaataagcaaaagaaacagca

SEQ ID NO: 190611 - DNA, 75 bp, Artificial Sequence
  Synthetic
agaagtaacagacaccaaggaagctttagataaaatagaggagatacaaaataagattaagcaaaagaaacagca

SEQ ID NO: 190612 - DNA, 75 bp, Artificial Sequence
  Synthetic
agaagtaacagacaccaaggaagctttagataaaatagaggagatacaaaataagactaagcaaaagaaacagca

SEQ ID NO: 190613 - DNA, 75 bp, Artificial Sequence
  Synthetic
agaagtaacagacaccaaggaagctttagataaaatagaggagatacaaaataagagtaagcaaaagaaacagca

SEQ ID NO: 190614 - DNA, 75 bp, Artificial Sequence
  Synthetic
agaagtaagagacaccaaggaagctttagataaaatagaggagatacaaaataagaataagcaaaagaaacagca

SEQ ID NO: 190615 - DNA, 75 bp, Artificial Sequence
  Synthetic
agaagtaagagacaccaaggaagctttagataaaatagaggagatacaaaataagattaagcaaaagaaacagca

SEQ ID NO: 190616 - DNA, 75 bp, Artificial Sequence
  Synthetic
agaagtaagagacaccaaggaagctttagataaaatagaggagatacaaaataagactaagcaaaagaaacagca

SEQ ID NO: 190617 - DNA, 75 bp, Artificial Sequence
  Synthetic
agaagtaagagacaccaaggaagctttagataaaatagaggagatacaaaataagagtaagcaaaagaaacagca

SEQ ID NO: 190618 - DNA, 75 bp, Artificial Sequence
  Synthetic
agatgtaaaagacaccaaggaagctttagataaaatagaggagatacaaaataagaataagcaaaagaaacagca

SEQ ID NO: 190619 - DNA, 75 bp, Artificial Sequence
  Synthetic
agatgtaaaagacaccaaggaagctttagataaaatagaggagatacaaaataagattaagcaaaagaaacagca

SEQ ID NO: 190620 - DNA, 75 bp, Artificial Sequence
  Synthetic
agatgtaaaagacaccaaggaagctttagataaaatagaggagatacaaaataagactaagcaaaagaaacagca

SEQ ID NO: 190621 - DNA, 75 bp, Artificial Sequence
  Synthetic
agatgtaaaagacaccaaggaagctttagataaaatagaggagatacaaaataagagtaagcaaaagaaacagca

SEQ ID NO: 190622 - DNA, 75 bp, Artificial Sequence
  Synthetic
agatgtaatagacaccaaggaagctttagataaaatagaggagatacaaaataagaataagcaaaagaaacagca

SEQ ID NO: 190623 - DNA, 75 bp, Artificial Sequence
  Synthetic
agatgtaatagacaccaaggaagctttagataaaatagaggagatacaaaataagattaagcaaaagaaacagca

SEQ ID NO: 190624 - DNA, 75 bp, Artificial Sequence
  Synthetic
agatgtaatagacaccaaggaagctttagataaaatagaggagatacaaaataagactaagcaaaagaaacagca

SEQ ID NO: 190625 - DNA, 75 bp, Artificial Sequence
  Synthetic
agatgtaatagacaccaaggaagctttagataaaatagaggagatacaaaataagagtaagcaaaagaaacagca

SEQ ID NO: 190626 - DNA, 75 bp, Artificial Sequence
  Synthetic
agatgtaacagacaccaaggaagctttagataaaatagaggagatacaaaataagaataagcaaaagaaacagca

SEQ ID NO: 190627 - DNA, 75 bp, Artificial Sequence
  Synthetic
agatgtaacagacaccaaggaagctttagataaaatagaggagatacaaaataagattaagcaaaagaaacagca

SEQ ID NO: 190628 - DNA, 75 bp, Artificial Sequence
  Synthetic
agatgtaacagacaccaaggaagctttagataaaatagaggagatacaaaataagactaagcaaaagaaacagca

SEQ ID NO: 190629 - DNA, 75 bp, Artificial Sequence
  Synthetic
agatgtaacagacaccaaggaagctttagataaaatagaggagatacaaaataagagtaagcaaaagaaacagca

SEQ ID NO: 190630 - DNA, 75 bp, Artificial Sequence
  Synthetic
agatgtaagagacaccaaggaagctttagataaaatagaggagatacaaaataagaataagcaaaagaaacagca

SEQ ID NO: 190631 - DNA, 75 bp, Artificial Sequence
  Synthetic
agatgtaagagacaccaaggaagctttagataaaatagaggagatacaaaataagattaagcaaaagaaacagca

SEQ ID NO: 190632 - DNA, 75 bp, Artificial Sequence
  Synthetic
agatgtaagagacaccaaggaagctttagataaaatagaggagatacaaaataagactaagcaaaagaaacagca

SEQ ID NO: 190633 - DNA, 75 bp, Artificial Sequence
  Synthetic
agatgtaagagacaccaaggaagctttagataaaatagaggagatacaaaataagagtaagcaaaagaaacagca

SEQ ID NO: 190634 - DNA, 75 bp, Artificial Sequence
  Synthetic
agacgtaaaagacaccaaggaagctttagataaaatagaggagatacaaaataagaataagcaaaagaaacagca

SEQ ID NO: 190635 - DNA, 75 bp, Artificial Sequence
  Synthetic
agacgtaaaagacaccaaggaagctttagataaaatagaggagatacaaaataagattaagcaaaagaaacagca

SEQ ID NO: 190636 - DNA, 75 bp, Artificial Sequence
  Synthetic
agacgtaaaagacaccaaggaagctttagataaaatagaggagatacaaaataagactaagcaaaagaaacagca

SEQ ID NO: 190637 - DNA, 75 bp, Artificial Sequence
  Synthetic
agacgtaaaagacaccaaggaagctttagataaaatagaggagatacaaaataagagtaagcaaaagaaacagca

SEQ ID NO: 190638 - DNA, 75 bp, Artificial Sequence
  Synthetic
agacgtaatagacaccaaggaagctttagataaaatagaggagatacaaaataagaataagcaaaagaaacagca

SEQ ID NO: 190639 - DNA, 75 bp, Artificial Sequence
  Synthetic
agacgtaatagacaccaaggaagctttagataaaatagaggagatacaaaataagattaagcaaaagaaacagca

SEQ ID NO: 190640 - DNA, 75 bp, Artificial Sequence
  Synthetic
agacgtaatagacaccaaggaagctttagataaaatagaggagatacaaaataagactaagcaaaagaaacagca

SEQ ID NO: 190641 - DNA, 75 bp, Artificial Sequence
  Synthetic
agacgtaatagacaccaaggaagctttagataaaatagaggagatacaaaataagagtaagcaaaagaaacagca

SEQ ID NO: 190642 - DNA, 75 bp, Artificial Sequence
  Synthetic
agacgtaacagacaccaaggaagctttagataaaatagaggagatacaaaataagaataagcaaaagaaacagca

SEQ ID NO: 190643 - DNA, 75 bp, Artificial Sequence
  Synthetic
agacgtaacagacaccaaggaagctttagataaaatagaggagatacaaaataagattaagcaaaagaaacagca

SEQ ID NO: 190644 - DNA, 75 bp, Artificial Sequence
  Synthetic
agacgtaacagacaccaaggaagctttagataaaatagaggagatacaaaataagactaagcaaaagaaacagca

SEQ ID NO: 190645 - DNA, 75 bp, Artificial Sequence
  Synthetic
agacgtaacagacaccaaggaagctttagataaaatagaggagatacaaaataagagtaagcaaaagaaacagca

SEQ ID NO: 190646 - DNA, 75 bp, Artificial Sequence
  Synthetic
agacgtaagagacaccaaggaagctttagataaaatagaggagatacaaaataagaataagcaaaagaaacagca

SEQ ID NO: 190647 - DNA, 75 bp, Artificial Sequence
  Synthetic
agacgtaagagacaccaaggaagctttagataaaatagaggagatacaaaataagattaagcaaaagaaacagca

SEQ ID NO: 190648 - DNA, 75 bp, Artificial Sequence
  Synthetic
agacgtaagagacaccaaggaagctttagataaaatagaggagatacaaaataagactaagcaaaagaaacagca

SEQ ID NO: 190649 - DNA, 75 bp, Artificial Sequence
  Synthetic
agacgtaagagacaccaaggaagctttagataaaatagaggagatacaaaataagagtaagcaaaagaaacagca

SEQ ID NO: 190650 - DNA, 75 bp, Artificial Sequence
  Synthetic
agaggtaaaagacaccaaggaagctttagataaaatagaggagatacaaaataagaataagcaaaagaaacagca

SEQ ID NO: 190651 - DNA, 75 bp, Artificial Sequence
  Synthetic
agaggtaaaagacaccaaggaagctttagataaaatagaggagatacaaaataagattaagcaaaagaaacagca

SEQ ID NO: 190652 - DNA, 75 bp, Artificial Sequence
  Synthetic
agaggtaaaagacaccaaggaagctttagataaaatagaggagatacaaaataagactaagcaaaagaaacagca

SEQ ID NO: 190653 - DNA, 75 bp, Artificial Sequence
  Synthetic
agaggtaaaagacaccaaggaagctttagataaaatagaggagatacaaaataagagtaagcaaaagaaacagca

SEQ ID NO: 190654 - DNA, 75 bp, Artificial Sequence
  Synthetic
agaggtaatagacaccaaggaagctttagataaaatagaggagatacaaaataagaataagcaaaagaaacagca

SEQ ID NO: 190655 - DNA, 75 bp, Artificial Sequence
  Synthetic
agaggtaatagacaccaaggaagctttagataaaatagaggagatacaaaataagattaagcaaaagaaacagca

SEQ ID NO: 190656 - DNA, 75 bp, Artificial Sequence
  Synthetic
agaggtaatagacaccaaggaagctttagataaaatagaggagatacaaaataagactaagcaaaagaaacagca

SEQ ID NO: 190657 - DNA, 75 bp, Artificial Sequence
  Synthetic
agaggtaatagacaccaaggaagctttagataaaatagaggagatacaaaataagagtaagcaaaagaaacagca

SEQ ID NO: 190658 - DNA, 75 bp, Artificial Sequence
  Synthetic
agaggtaacagacaccaaggaagctttagataaaatagaggagatacaaaataagaataagcaaaagaaacagca

SEQ ID NO: 190659 - DNA, 75 bp, Artificial Sequence
  Synthetic
agaggtaacagacaccaaggaagctttagataaaatagaggagatacaaaataagattaagcaaaagaaacagca

SEQ ID NO: 190660 - DNA, 75 bp, Artificial Sequence
  Synthetic
agaggtaacagacaccaaggaagctttagataaaatagaggagatacaaaataagactaagcaaaagaaacagca

SEQ ID NO: 190661 - DNA, 75 bp, Artificial Sequence
  Synthetic
agaggtaacagacaccaaggaagctttagataaaatagaggagatacaaaataagagtaagcaaaagaaacagca

SEQ ID NO: 190662 - DNA, 75 bp, Artificial Sequence
  Synthetic
agaggtaagagacaccaaggaagctttagataaaatagaggagatacaaaataagaataagcaaaagaaacagca

SEQ ID NO: 190663 - DNA, 75 bp, Artificial Sequence
  Synthetic
agaggtaagagacaccaaggaagctttagataaaatagaggagatacaaaataagattaagcaaaagaaacagca

SEQ ID NO: 190664 - DNA, 75 bp, Artificial Sequence
  Synthetic
agaggtaagagacaccaaggaagctttagataaaatagaggagatacaaaataagactaagcaaaagaaacagca

SEQ ID NO: 190665 - DNA, 75 bp, Artificial Sequence
  Synthetic
agaggtaagagacaccaaggaagctttagataaaatagaggagatacaaaataagagtaagcaaaagaaacagca

SEQ ID NO: 190666 - DNA, 75 bp, Artificial Sequence
  Synthetic
aatgtcagaacgtcaccaacagcagcagaaccatatctagtgacatggaaggggaaataaaaaactgctctttca

SEQ ID NO: 190667 - DNA, 75 bp, Artificial Sequence
  Synthetic
aaaatgtagcaatgttaccaataatggtacctacaagggggccgaccaggaaataaaaaattgctctttcaatgc

SEQ ID NO: 190668 - DNA, 75 bp, Artificial Sequence
  Synthetic
agtacagtacaatgtacacatggaattaagccagtggtgtcaactcaactactgttaaatggtagcctatcagaa

SEQ ID NO: 190669 - DNA, 75 bp, Artificial Sequence
  Synthetic
ttcaacataaccacagaactaaaagataagaaaaagaatgtgtatgcacttttttataaacttgatatagtatca

SEQ ID NO: 190670 - DNA, 75 bp, Artificial Sequence
  Synthetic
gtataggaccaggacaaacattctatgcaacaggtgacataataggaaatataagacaagcacattgtaatgtca

SEQ ID NO: 190671 - DNA, 75 bp, Artificial Sequence
  Synthetic
gtggaaaaatgacatggtggatcagatgcatgaggatataatcagtttatgggatgaaagccttaagccatgtgt

SEQ ID NO: 190672 - DNA, 75 bp, Artificial Sequence
  Synthetic
tctttgctaaccactcaggaggggatttagagattacaacacatagttttaattgtagaggagaatttttctatt

SEQ ID NO: 190673 - DNA, 75 bp, Artificial Sequence
  Synthetic
agtttatgggatcaaagcttaaagccatgtgtaaagttaaccccactttgtgttactttaaactgtactaatgct

SEQ ID NO: 190674 - DNA, 75 bp, Artificial Sequence
  Synthetic
aagataagacaaagcaaatgcgtacacttttttatagccttgatatagaactaatcaacaaacaaagtaaaaaca

SEQ ID NO: 190675 - DNA, 75 bp, Artificial Sequence
  Synthetic
aagataagacaaagcaaatgcgtacacttttttatagccttgatatagaactaatcaacaaacaaagtaaataca

SEQ ID NO: 190676 - DNA, 75 bp, Artificial Sequence
  Synthetic
aagataagacaaagcaaatgcgtacacttttttatagccttgatatagaactaatcaacaaacaaagtaaacaca

SEQ ID NO: 190677 - DNA, 75 bp, Artificial Sequence
  Synthetic
aagataagacaaagcaaatgcgtacacttttttatagccttgatatagaactaatcaacaaacaaagtaaagaca

SEQ ID NO: 190678 - DNA, 75 bp, Artificial Sequence
  Synthetic
cggtggaacttctgggacacagcagcctcaaggggctgagactggggtgggaaagcctcaaaattagtgctatta

SEQ ID NO: 190679 - DNA, 75 bp, Artificial Sequence
  Synthetic
tactccagctggatatgcgattctaaagagtaataataaaactttcaatgggaaagggccatgcaacaatgtcag

SEQ ID NO: 190680 - DNA, 75 bp, Artificial Sequence
  Synthetic
tactccagctggatatgcgattctaaagagtaataataaaactttcaatgggaaagggccatgctacaatgtcag

SEQ ID NO: 190681 - DNA, 75 bp, Artificial Sequence
  Synthetic
tactccagctggatatgcgattctaaagagtaataataaaactttcaatgggaaagggccatgccacaatgtcag

SEQ ID NO: 190682 - DNA, 75 bp, Artificial Sequence
  Synthetic
tactccagctggatatgcgattctaaagagtaataataaaactttcaatgggaaagggccatgcgacaatgtcag

SEQ ID NO: 190683 - DNA, 75 bp, Artificial Sequence
  Synthetic
tactccagctggatatgcgattctaaagtgtaataataaaactttcaatgggaaagggccatgcaacaatgtcag

SEQ ID NO: 190684 - DNA, 75 bp, Artificial Sequence
  Synthetic
tactccagctggatatgcgattctaaagtgtaataataaaactttcaatgggaaagggccatgctacaatgtcag

SEQ ID NO: 190685 - DNA, 75 bp, Artificial Sequence
  Synthetic
tactccagctggatatgcgattctaaagtgtaataataaaactttcaatgggaaagggccatgccacaatgtcag

SEQ ID NO: 190686 - DNA, 75 bp, Artificial Sequence
  Synthetic
tactccagctggatatgcgattctaaagtgtaataataaaactttcaatgggaaagggccatgcgacaatgtcag

SEQ ID NO: 190687 - DNA, 75 bp, Artificial Sequence
  Synthetic
tactccagctggatatgcgattctaaagcgtaataataaaactttcaatgggaaagggccatgcaacaatgtcag

SEQ ID NO: 190688 - DNA, 75 bp, Artificial Sequence
  Synthetic
tactccagctggatatgcgattctaaagcgtaataataaaactttcaatgggaaagggccatgctacaatgtcag

SEQ ID NO: 190689 - DNA, 75 bp, Artificial Sequence
  Synthetic
tactccagctggatatgcgattctaaagcgtaataataaaactttcaatgggaaagggccatgccacaatgtcag

SEQ ID NO: 190690 - DNA, 75 bp, Artificial Sequence
  Synthetic
tactccagctggatatgcgattctaaagcgtaataataaaactttcaatgggaaagggccatgcgacaatgtcag

SEQ ID NO: 190691 - DNA, 75 bp, Artificial Sequence
  Synthetic
tactccagctggatatgcgattctaaagggtaataataaaactttcaatgggaaagggccatgcaacaatgtcag

SEQ ID NO: 190692 - DNA, 75 bp, Artificial Sequence
  Synthetic
tactccagctggatatgcgattctaaagggtaataataaaactttcaatgggaaagggccatgctacaatgtcag

SEQ ID NO: 190693 - DNA, 75 bp, Artificial Sequence
  Synthetic
tactccagctggatatgcgattctaaagggtaataataaaactttcaatgggaaagggccatgccacaatgtcag

SEQ ID NO: 190694 - DNA, 75 bp, Artificial Sequence
  Synthetic
tactccagctggatatgcgattctaaagggtaataataaaactttcaatgggaaagggccatgcgacaatgtcag

SEQ ID NO: 190695 - DNA, 75 bp, Artificial Sequence
  Synthetic
agtatctcaagatttagataaatatggagcagtcacaagcagcaatataaatcaccctagttgcacctggctgga

SEQ ID NO: 190696 - DNA, 75 bp, Artificial Sequence
  Synthetic
atcaagaataatgcaggaaccataatagtacaccttaaggaggctatacaaattaattgtacaagacccaataac

SEQ ID NO: 190697 - DNA, 75 bp, Artificial Sequence
  Synthetic
caaaatgggaagaaactttaaaaaaagtaagtaaaaagttaagggaccatgttgttgggaatataacaataatat

SEQ ID NO: 190698 - DNA, 75 bp, Artificial Sequence
  Synthetic
caaaatgggaagaaactttaaaaaatgtaagtaaaaagttaagggaccatgttgttgggaatataacaataatat

SEQ ID NO: 190699 - DNA, 75 bp, Artificial Sequence
  Synthetic
caaaatgggaagaaactttaaaaaacgtaagtaaaaagttaagggaccatgttgttgggaatataacaataatat

SEQ ID NO: 190700 - DNA, 75 bp, Artificial Sequence
  Synthetic
caaaatgggaagaaactttaaaaaaggtaagtaaaaagttaagggaccatgttgttgggaatataacaataatat

SEQ ID NO: 190701 - DNA, 75 bp, Artificial Sequence
  Synthetic
ttgcctcaccacccccaggaggggacatagaaattacaacacatatgtttaattgtggaggagaatttttctact

SEQ ID NO: 190702 - DNA, 75 bp, Artificial Sequence
  Synthetic
atttgggaaaacatgacctggatgcagtgggatagagaaattagtaattacacagacacaatatacaggttgctt

SEQ ID NO: 190703 - DNA, 75 bp, Artificial Sequence
  Synthetic
gaaaaaatatagattaaaacatttagtatgggcaagcagagagttggaaagatttgcacttaaccctagcctctt

SEQ ID NO: 190704 - DNA, 75 bp, Artificial Sequence
  Synthetic
ggcaagtctgtggaattggtttgacataacaaactggctatggtatataaaaatatttataatgatagtaggagg

SEQ ID NO: 190705 - DNA, 75 bp, Artificial Sequence
  Synthetic
aaaacaaattgtaaacatgtggcagggagtaggacgagcaatgtatgccgctcccattgcaggaaaaattgtctg

SEQ ID NO: 190706 - DNA, 75 bp, Artificial Sequence
  Synthetic
gtaccagaccctccaacaatacaagaacaagtgtaagtatgggaccaggaaaagtatactttagaacaggagaca

SEQ ID NO: 190707 - DNA, 75 bp, Artificial Sequence
  Synthetic
gcgcaatattggggtcaggaactaaagaatagtgctactagtttgcttaataccacagcaatagtagtagccgag

SEQ ID NO: 190708 - DNA, 75 bp, Artificial Sequence
  Synthetic
agaaagaataagacgaacccccccagcagcagaaggggtggaagcagtgtctcaagacttagatagacatggggc

SEQ ID NO: 190709 - DNA, 75 bp, Artificial Sequence
  Synthetic
gacagggctttgaagcagctttgcaataaaatggggaacaagtggtcaaaaagtagcatagttggatggcctgct

SEQ ID NO: 190710 - DNA, 75 bp, Artificial Sequence
  Synthetic
aagtagcatagttggatggcctgctataagagaaagaatgaggcgaactgaaccagcagcagaaggagtaggagc

SEQ ID NO: 190711 - DNA, 75 bp, Artificial Sequence
  Synthetic
aagagctgaacaagctacacaagatgtaaaaaattggatgacagataccttgttggtccaaaatgcgaacccaga

SEQ ID NO: 190712 - DNA, 75 bp, Artificial Sequence
  Synthetic
taattgatagaataagagaaagagcagaagacagtggcaatgagagcgaaggagatcaggaagaattatcagcac

SEQ ID NO: 190713 - DNA, 75 bp, Artificial Sequence
  Synthetic
actaatttgacattgagtaatgctactgagggaataaataacaatagtagtattgctagtgaggaaatgaagaac

SEQ ID NO: 190714 - DNA, 75 bp, Artificial Sequence
  Synthetic
tctgggacgcagggggtgggaagcccttaaatatctaggaagtcttgtgcagtattggggtctggaactaaaaaa

SEQ ID NO: 190715 - DNA, 75 bp, Artificial Sequence
  Synthetic
atacattaagaataagacagggttttgcagcagctttgctataaaatggggggcaactggtcaaaaagcagtgca

SEQ ID NO: 190716 - DNA, 75 bp, Artificial Sequence
  Synthetic
agatgtacgagacaccaaagaagccttagacaagatagaggaagaacaaaataaatgtcagcaaaaaacacagca

SEQ ID NO: 190717 - DNA, 75 bp, Artificial Sequence
  Synthetic
agtgggatggcctgctataagggatagaatgagacgagcccctccagcagcccctccagcagcagaagggagagc

SEQ ID NO: 190718 - DNA, 75 bp, Artificial Sequence
  Synthetic
agtgggatggcctgctataagggatagaatgagacgagcccctccagcagcccctccagcagcagaagggtgagc

SEQ ID NO: 190719 - DNA, 75 bp, Artificial Sequence
  Synthetic
agtgggatggcctgctataagggatagaatgagacgagcccctccagcagcccctccagcagcagaagggcgagc

SEQ ID NO: 190720 - DNA, 75 bp, Artificial Sequence
  Synthetic
agtgggatggcctgctataagggatagaatgagacgagcccctccagcagcccctccagcagcagaagggggagc

SEQ ID NO: 190721 - DNA, 75 bp, Artificial Sequence
  Synthetic
ggtatacatatgggaccggggagagcattctatgcaacaggagaaataatagaagatataaggaaagcacattgt

SEQ ID NO: 190722 - DNA, 75 bp, Artificial Sequence
  Synthetic
cataatgatgcagagaagcaattttaaaggccctaaaagaactgttaaatgtttcaactgtggcaaggaagggca

SEQ ID NO: 190723 - DNA, 75 bp, Artificial Sequence
  Synthetic
gggagctggaaagatttgcacttgaccctggccttctagaaacaccagaaggctgtagaaaaataataagacaac

SEQ ID NO: 190724 - DNA, 75 bp, Artificial Sequence
  Synthetic
ccctacagggaacccttaacttccctcagatcactctttggcagcgaccccttgtctcaataagagtagggggcc

SEQ ID NO: 190725 - DNA, 75 bp, Artificial Sequence
  Synthetic
attcatctgtattactttgattgtttttcagaatctgccataaggaaagccatattaggacagatagttaggcct

SEQ ID NO: 190726 - DNA, 75 bp, Artificial Sequence
  Synthetic
aacactttaaaacggatagttacaaaattaggagaacaatttaaaaatcaaaataaaacaataaccttcgatctc

SEQ ID NO: 190727 - DNA, 75 bp, Artificial Sequence
  Synthetic
aaataaaacaataaccttcgatctctcctcaggaggggacccagaaattatgctgcacagtttcagttgtggagg

SEQ ID NO: 190728 - DNA, 75 bp, Artificial Sequence
  Synthetic
ctagggatttggggttgctctggaaaactcatctgcaccactgctgtgccttggaatgctagttggagtaataaa

SEQ ID NO: 190729 - DNA, 75 bp, Artificial Sequence
  Synthetic
agaaatgatgacagcatgtcagggagtgggaggacctggccacaaagcaagagtgttggctgaggcaatgagcca

SEQ ID NO: 190730 - DNA, 75 bp, Artificial Sequence
  Synthetic
agtagcatttatagcagcagtaattgtgtggactatagtatttatacaatataaggaaataagaaaacagaaaaa

SEQ ID NO: 190731 - DNA, 75 bp, Artificial Sequence
  Synthetic
ataaccagtttatgggatgaaggcctaaagccatgtgtaaaattgaccccactctgtgtcactctagattgtgtt

SEQ ID NO: 190732 - DNA, 75 bp, Artificial Sequence
  Synthetic
cagatggggtgggagcagcatctcgggacctggaaagacatggagcaatcacaagtagtaatacagcagctacta

SEQ ID NO: 190733 - DNA, 75 bp, Artificial Sequence
  Synthetic
tagctgaggggacagatagggttatagaagtattacaaagagcttttagagctattctccacatacctacaagaa

SEQ ID NO: 190734 - DNA, 75 bp, Artificial Sequence
  Synthetic
gattttgatccttgggttggtgataatatgtagtgcatcagacaaattgtgggtcacagtctattatggagtacc

SEQ ID NO: 190735 - DNA, 75 bp, Artificial Sequence
  Synthetic
gattttgatccttgggttggtgataatatgtagtgcttcagacaaattgtgggtcacagtctattatggagtacc

SEQ ID NO: 190736 - DNA, 75 bp, Artificial Sequence
  Synthetic
gattttgatccttgggttggtgataatatgtagtgcctcagacaaattgtgggtcacagtctattatggagtacc

SEQ ID NO: 190737 - DNA, 75 bp, Artificial Sequence
  Synthetic
gattttgatccttgggttggtgataatatgtagtgcgtcagacaaattgtgggtcacagtctattatggagtacc

SEQ ID NO: 190738 - DNA, 75 bp, Artificial Sequence
  Synthetic
gattttgatccttgggttggtgataatttgtagtgcatcagacaaattgtgggtcacagtctattatggagtacc

SEQ ID NO: 190739 - DNA, 75 bp, Artificial Sequence
  Synthetic
gattttgatccttgggttggtgataatttgtagtgcttcagacaaattgtgggtcacagtctattatggagtacc

SEQ ID NO: 190740 - DNA, 75 bp, Artificial Sequence
  Synthetic
gattttgatccttgggttggtgataatttgtagtgcctcagacaaattgtgggtcacagtctattatggagtacc

SEQ ID NO: 190741 - DNA, 75 bp, Artificial Sequence
  Synthetic
gattttgatccttgggttggtgataatttgtagtgcgtcagacaaattgtgggtcacagtctattatggagtacc

SEQ ID NO: 190742 - DNA, 75 bp, Artificial Sequence
  Synthetic
gattttgatccttgggttggtgataatctgtagtgcatcagacaaattgtgggtcacagtctattatggagtacc

SEQ ID NO: 190743 - DNA, 75 bp, Artificial Sequence
  Synthetic
gattttgatccttgggttggtgataatctgtagtgcttcagacaaattgtgggtcacagtctattatggagtacc

SEQ ID NO: 190744 - DNA, 75 bp, Artificial Sequence
  Synthetic
gattttgatccttgggttggtgataatctgtagtgcctcagacaaattgtgggtcacagtctattatggagtacc

SEQ ID NO: 190745 - DNA, 75 bp, Artificial Sequence
  Synthetic
gattttgatccttgggttggtgataatctgtagtgcgtcagacaaattgtgggtcacagtctattatggagtacc

SEQ ID NO: 190746 - DNA, 75 bp, Artificial Sequence
  Synthetic
gattttgatccttgggttggtgataatgtgtagtgcatcagacaaattgtgggtcacagtctattatggagtacc

SEQ ID NO: 190747 - DNA, 75 bp, Artificial Sequence
  Synthetic
gattttgatccttgggttggtgataatgtgtagtgcttcagacaaattgtgggtcacagtctattatggagtacc

SEQ ID NO: 190748 - DNA, 75 bp, Artificial Sequence
  Synthetic
gattttgatccttgggttggtgataatgtgtagtgcctcagacaaattgtgggtcacagtctattatggagtacc

SEQ ID NO: 190749 - DNA, 75 bp, Artificial Sequence
  Synthetic
gattttgatccttgggttggtgataatgtgtagtgcgtcagacaaattgtgggtcacagtctattatggagtacc

SEQ ID NO: 190750 - DNA, 75 bp, Artificial Sequence
  Synthetic
attgctctttcaatataaccacagaactaagagataaggaaaagaaagtgaatgcacttttttatagacttgata

SEQ ID NO: 190751 - DNA, 75 bp, Artificial Sequence
  Synthetic
caaagcctaaagccatgtgtaaaattaaccccactctgtgttactttaaattgcactaatttgaatactaccaat

SEQ ID NO: 190752 - DNA, 75 bp, Artificial Sequence
  Synthetic
atacctagaagaatcagacagggcttcgaaagggctttgcaataaagatgggtggcaagtggtcaaaacctagcc

SEQ ID NO: 190753 - DNA, 75 bp, Artificial Sequence
  Synthetic
tagcactgaagaagccaacaatataaccaaaggaatggctgaagaaatgagaaactgctctttcaatgtgacctc

SEQ ID NO: 190754 - DNA, 75 bp, Artificial Sequence
  Synthetic
tagcactgaagaagccaacaatataaccaaaggaatggctgatgaaatgagaaactgctctttcaatgtgacctc

SEQ ID NO: 190755 - DNA, 75 bp, Artificial Sequence
  Synthetic
tagcactgaagaagccaacaatataaccaaaggaatggctgacgaaatgagaaactgctctttcaatgtgacctc

SEQ ID NO: 190756 - DNA, 75 bp, Artificial Sequence
  Synthetic
tagcactgaagaagccaacaatataaccaaaggaatggctgaggaaatgagaaactgctctttcaatgtgacctc

SEQ ID NO: 190757 - DNA, 75 bp, Artificial Sequence
  Synthetic
tagcactgaagaagccaacaatattaccaaaggaatggctgaagaaatgagaaactgctctttcaatgtgacctc

SEQ ID NO: 190758 - DNA, 75 bp, Artificial Sequence
  Synthetic
tagcactgaagaagccaacaatattaccaaaggaatggctgatgaaatgagaaactgctctttcaatgtgacctc

SEQ ID NO: 190759 - DNA, 75 bp, Artificial Sequence
  Synthetic
tagcactgaagaagccaacaatattaccaaaggaatggctgacgaaatgagaaactgctctttcaatgtgacctc

SEQ ID NO: 190760 - DNA, 75 bp, Artificial Sequence
  Synthetic
tagcactgaagaagccaacaatattaccaaaggaatggctgaggaaatgagaaactgctctttcaatgtgacctc

SEQ ID NO: 190761 - DNA, 75 bp, Artificial Sequence
  Synthetic
tagcactgaagaagccaacaatatcaccaaaggaatggctgaagaaatgagaaactgctctttcaatgtgacctc

SEQ ID NO: 190762 - DNA, 75 bp, Artificial Sequence
  Synthetic
tagcactgaagaagccaacaatatcaccaaaggaatggctgatgaaatgagaaactgctctttcaatgtgacctc

SEQ ID NO: 190763 - DNA, 75 bp, Artificial Sequence
  Synthetic
tagcactgaagaagccaacaatatcaccaaaggaatggctgacgaaatgagaaactgctctttcaatgtgacctc

SEQ ID NO: 190764 - DNA, 75 bp, Artificial Sequence
  Synthetic
tagcactgaagaagccaacaatatcaccaaaggaatggctgaggaaatgagaaactgctctttcaatgtgacctc

SEQ ID NO: 190765 - DNA, 75 bp, Artificial Sequence
  Synthetic
tagcactgaagaagccaacaatatgaccaaaggaatggctgaagaaatgagaaactgctctttcaatgtgacctc

SEQ ID NO: 190766 - DNA, 75 bp, Artificial Sequence
  Synthetic
tagcactgaagaagccaacaatatgaccaaaggaatggctgatgaaatgagaaactgctctttcaatgtgacctc

SEQ ID NO: 190767 - DNA, 75 bp, Artificial Sequence
  Synthetic
tagcactgaagaagccaacaatatgaccaaaggaatggctgacgaaatgagaaactgctctttcaatgtgacctc

SEQ ID NO: 190768 - DNA, 75 bp, Artificial Sequence
  Synthetic
tagcactgaagaagccaacaatatgaccaaaggaatggctgaggaaatgagaaactgctctttcaatgtgacctc

SEQ ID NO: 190769 - DNA, 75 bp, Artificial Sequence
  Synthetic
ctgtgcctcttcagctaccaccgcttgagagacttactcttgattgtgacgagggttgtggaacttctgggacgc

SEQ ID NO: 190770 - DNA, 75 bp, Artificial Sequence
  Synthetic
ctgataaagaaataaactttaaccattcctcagggggggacctagaagttacaatgcacacatttaattgtggag

SEQ ID NO: 190771 - DNA, 75 bp, Artificial Sequence
  Synthetic
acaacaatacaagaaaaagtataaatctaggacaagggcgagcatggtatacaacaggacaaataataggagata

SEQ ID NO: 190772 - DNA, 75 bp, Artificial Sequence
  Synthetic
gatccagagattgtaatgcacagctttaattgtggaggggaatttttctactgcaatacatcacaactgtttaat

SEQ ID NO: 190773 - DNA, 75 bp, Artificial Sequence
  Synthetic
aacctataactctcccgtgcagaataaaacaaattgtaaatctgtggcaggaagtaggacgagcaatatatgccc

SEQ ID NO: 190774 - DNA, 75 bp, Artificial Sequence
  Synthetic
caaagccacctttgcctagtgttaggatattagcagaggatagatggaacaagccccagaagaccaggggcccca

SEQ ID NO: 190775 - DNA, 75 bp, Artificial Sequence
  Synthetic
cctatggcaggaagaagcggaaacagcgacgaggaactcctcaaggcagtgagcatcatcaaaatactgtacaac

SEQ ID NO: 190776 - DNA, 75 bp, Artificial Sequence
  Synthetic
aaaaatcatcctggtagcagtccatgtagccagtggctacatagaagcagaggttatcccagcagaaacaggaca

SEQ ID NO: 190777 - DNA, 75 bp, Artificial Sequence
  Synthetic
gattcttgacatttttctgggaggatctacggagcctgtgcctcttcagctaccaccgcttgagagacttactct

SEQ ID NO: 190778 - DNA, 75 bp, Artificial Sequence
  Synthetic
gttagccctaggtgtgaatatcaagcaggacataataaggtaggatctttacaatatctggcactgccagcacta

SEQ ID NO: 190779 - DNA, 75 bp, Artificial Sequence
  Synthetic
acagggaaattctaaaagaaccagtacatggagtgtattatgacccatcaaaagacttaatagcagaaatacaga

SEQ ID NO: 190780 - DNA, 75 bp, Artificial Sequence
  Synthetic
tttccagtcagacctcaagtacctttaagaccaatgacttacaagggagcatttgatctaggcttctttttaaaa

SEQ ID NO: 190781 - DNA, 75 bp, Artificial Sequence
  Synthetic
taaattgtagcaatgttaataacacacaggaagtaaaaaactgcactttcaatatgaccacagagctaagggata

SEQ ID NO: 190782 - DNA, 75 bp, Artificial Sequence
  Synthetic
tagaagtagtacaaagaattggtagagctatttacaatatacctagaaggataagacagggtgcagaaagagctt

SEQ ID NO: 190783 - DNA, 75 bp, Artificial Sequence
  Synthetic
agaaaaatgaaaaggatttattagcattggacagttggaaaaatctgtggagttggtttgacatatcaaattggc

SEQ ID NO: 190784 - DNA, 75 bp, Artificial Sequence
  Synthetic
ctcaggtacctttaagaccaatgacttacaagggagctttagatcttagccactttttaaaagaaaaggggggac

SEQ ID NO: 190785 - DNA, 75 bp, Artificial Sequence
  Synthetic
tatcagtacaatgtgctgccacagggatggaaaggatcaccagcaatattccagagtagcatgacaaaaatctta

SEQ ID NO: 190786 - DNA, 75 bp, Artificial Sequence
  Synthetic
acaatgggagcaagggggaaataaaaagttgctctttcaatacaaccacagaagtaagagataagaagcagaaag

SEQ ID NO: 190787 - DNA, 75 bp, Artificial Sequence
  Synthetic
gcaggaagaagcggagacagcgacgagcagcttctggcggcagtaaaaataatcaagatcctgtaccacagcagt

SEQ ID NO: 190788 - DNA, 75 bp, Artificial Sequence
  Synthetic
cagaaagcatagtaatatggggaaagacccctaaatttaaactacccatacaaaaggaaacatgggaaacatggt

SEQ ID NO: 190789 - DNA, 75 bp, Artificial Sequence
  Synthetic
ttcctatggcaggaagaagcggagacgaagcgctcctccaagccgtgaggatcatcagaatcttataccaaagca

SEQ ID NO: 190790 - DNA, 75 bp, Artificial Sequence
  Synthetic
attccaacagcaacagcaccaggaaggaaatgctagaacaaatgaaaaactgctcttacaatgcgaccacagaac

SEQ ID NO: 190791 - DNA, 75 bp, Artificial Sequence
  Synthetic
ggaaatgctagaacaaatgaaaaactgctcttacaatgcgaccacagaactgagagataaacacaagaaaatgta

SEQ ID NO: 190792 - DNA, 75 bp, Artificial Sequence
  Synthetic
tgctttcattgtcaacggtgctttgtaacaaagggcttaggcatctcctatggcaggaagaagcggagaccgcga

SEQ ID NO: 190793 - DNA, 75 bp, Artificial Sequence
  Synthetic
gaaagagactggcatttgggtcagggagtctccatagaatggaggaaaaggagatatagcacacaagtagaccct

SEQ ID NO: 190794 - DNA, 75 bp, Artificial Sequence
  Synthetic
ttgtgggtcacagtctattatggagtacctgtgtggaaagaagcaaaaactactctattctgtgcatcagatgct

SEQ ID NO: 190795 - DNA, 75 bp, Artificial Sequence
  Synthetic
agtacaatgcacacatgggattaagccagtagtatcaactcaattactgctgaatggcagcttagcagaaggaga

SEQ ID NO: 190796 - DNA, 75 bp, Artificial Sequence
  Synthetic
acaagggaaagtgtacgtataggaccaggacaaactttctttgcaacaggtgatataataggagacataaggaaa

SEQ ID NO: 190797 - DNA, 75 bp, Artificial Sequence
  Synthetic
cccatgcagaataaagcaaattataaacatgtggcaggaggtaggacgagcaatgtatgcccctcccattgcagg

SEQ ID NO: 190798 - DNA, 75 bp, Artificial Sequence
  Synthetic
tgtcagtaccaccacagaaatacaaaattgctctttcaatgcaactacagaactaaaagataagaagaacaagga

SEQ ID NO: 190799 - DNA, 75 bp, Artificial Sequence
  Synthetic
catcctcaggaggggatttagaaattgcaacacatagttttaattgtgcaggagaatttttctattgcaatacat

SEQ ID NO: 190800 - DNA, 75 bp, Artificial Sequence
  Synthetic
ataatgtcagcacagtacaatgtacacatggaattaagccagtggtatcaactcaactactgttaaatggtagcc

SEQ ID NO: 190801 - DNA, 75 bp, Artificial Sequence
  Synthetic
tggacagataggattatagaaataggacaaggaattggtagaggtatcctccacatacctagaagaatcagacag

SEQ ID NO: 190802 - DNA, 75 bp, Artificial Sequence
  Synthetic
gtcaaagaccccaatgccaccgctctcgaaaacagcaccctgcaggaagagtcaggggcaatacaaaactgttct

SEQ ID NO: 190803 - DNA, 75 bp, Artificial Sequence
  Synthetic
gcgacgaagagctcctcaggacagtcagactcatcaagcttctctatcaaagcagtaagtagtacatgtaatgca

SEQ ID NO: 190804 - DNA, 75 bp, Artificial Sequence
  Synthetic
acagtggcaatgagagtgaaggggatcaggaagaattatcagcactggtggagatggggcatcatgctccttggg

SEQ ID NO: 190805 - DNA, 75 bp, Artificial Sequence
  Synthetic
ttaggaccaggacaagcattttatgcaacaggagacataataggagacatcaggaaggcacattgtaacgttagt

SEQ ID NO: 190806 - DNA, 75 bp, Artificial Sequence
  Synthetic
tgtgcatggagtctattatgacccatcaaaagaattaatagcagaagtacagaagcaagggcaagaccaatggac

SEQ ID NO: 190807 - DNA, 75 bp, Artificial Sequence
  Synthetic
ctaaggaatagtgctattagcttgtttgataccacagcagtagcagtagctgagggaacagataggattatagaa

SEQ ID NO: 190808 - DNA, 75 bp, Artificial Sequence
  Synthetic
tttttgctgtgctatctatagtaaatagagttaggcagggatactcacctttgtcgtttcagacccttatcccaa

SEQ ID NO: 190809 - DNA, 75 bp, Artificial Sequence
  Synthetic
ggccttttagaaacatcagaaggctgtaaacaaataataaaacagctacacccagctcttcagacaggaacagag

SEQ ID NO: 190810 - DNA, 75 bp, Artificial Sequence
  Synthetic
ttagggaaagactaagacgagcctccccaacagaagcagcagaaggggtgggagcagcttctcaagacctagcta

SEQ ID NO: 190811 - DNA, 75 bp, Artificial Sequence
  Synthetic
atagcagtagctgaggggacagatagggttatagaagtagtacaaagagcttatagagctattctacacatacct

SEQ ID NO: 190812 - DNA, 75 bp, Artificial Sequence
  Synthetic
actagtaccacaactactattaccccactaatgatggagaagggagaaataaaaaattgctctttcaaaatcacc

SEQ ID NO: 190813 - DNA, 75 bp, Artificial Sequence
  Synthetic
gatgagataataatcagatctgaaaatctcacaaacaatgccaagaccataatagtgcaccttaataaatctgta

SEQ ID NO: 190814 - DNA, 75 bp, Artificial Sequence
  Synthetic
ctcaggtgcctttaagaccaatgaccttcaaggcagcgtttgatctcagcttctttttaaaagaaaaggggggac

SEQ ID NO: 190815 - DNA, 75 bp, Artificial Sequence
  Synthetic
aagagacaccaaggaagctttagagaagatagaggaagagcaaaacaaaagtaagaaaaaagcacagcaagcagc

SEQ ID NO: 190816 - DNA, 75 bp, Artificial Sequence
  Synthetic
accaccctcaggaggagatctagaaattacaatgcatcactttaattgtagaggggaatttttctattgcaatac

SEQ ID NO: 190817 - DNA, 75 bp, Artificial Sequence
  Synthetic
gaaataaagaactgctctttcaatatcaccacagacatgaaagataaggtgcaggaaaaatatgcacttttttat

SEQ ID NO: 190818 - DNA, 75 bp, Artificial Sequence
  Synthetic
tacaatgtgcttccacaaggatggaaaggatcaccagcaatatttcagagtagcatgacaaaaatcttagagccc

SEQ ID NO: 190819 - DNA, 75 bp, Artificial Sequence
  Synthetic
cggcgactggtgagtacgccaatttttgactagcggaggctagaaggagagagatgggtgcgagagcgtcagtat

SEQ ID NO: 190820 - DNA, 75 bp, Artificial Sequence
  Synthetic
gacaaggaccaaaggaaccctttagagattatgtagatcggttctataaaactctaagagccgagcaagcttcac

SEQ ID NO: 190821 - DNA, 75 bp, Artificial Sequence
  Synthetic
gggtgggagcagcatctcgagacctggaaaaacatggagcactcacaagtagcaatacagcagctaacaatgctg

SEQ ID NO: 190822 - DNA, 75 bp, Artificial Sequence
  Synthetic
taggaccagggagagcattttatggaacagaaatcataggagatataagaaaagcacattgtacccttaatagaa

SEQ ID NO: 190823 - DNA, 75 bp, Artificial Sequence
  Synthetic
aattacaatgcatagttttaattgtggaggagaatttttcttctgtaatacaacaaaactgtttgggggtacttg

SEQ ID NO: 190824 - DNA, 75 bp, Artificial Sequence
  Synthetic
aacaagccccagaagaccaggggccacagagagaaccaaacaatgaatggacactagagcttttggaggagctta

SEQ ID NO: 190825 - DNA, 75 bp, Artificial Sequence
  Synthetic
ggggggacatcaagcagccatgcaaatgttaaaagacaccatcaatgaggaagctgcagaatgggacagattaca

SEQ ID NO: 190826 - DNA, 75 bp, Artificial Sequence
  Synthetic
gaaaaagcaacgtatgccaatacaattagaggaccaattaaatcagcatcaaatataacagggctgttaaaaaca

SEQ ID NO: 190827 - DNA, 75 bp, Artificial Sequence
  Synthetic
tcctccaagcagtaaggatcatcaaaatcctctatcaaagcagtaagtatcatatagtaaatgtaatgttagact

SEQ ID NO: 190828 - DNA, 75 bp, Artificial Sequence
  Synthetic
cgagtgagaccttcagacctggaggaggagacatgagggacaattggagaagtgaattatataaatataagagta

SEQ ID NO: 190829 - DNA, 75 bp, Artificial Sequence
  Synthetic
tttatagcagcaatagttgtgtggactatagtatttatagaatataggaaaataagaaaacagaaaaagatagaa

SEQ ID NO: 190830 - DNA, 75 bp, Artificial Sequence
  Synthetic
ttaggaaccaaagaaagactgttaagtgtttcaattgtggtaaagaagggcacatagccagaaattgcagggccc

SEQ ID NO: 190831 - DNA, 75 bp, Artificial Sequence
  Synthetic
attaaccccactctgtgttactttaaattgcactaatttgaatactaataataccagtagtaataccagtactac

SEQ ID NO: 190832 - DNA, 75 bp, Artificial Sequence
  Synthetic
cttaggggaaccaaagcactaacagaagtaataccactaacagaagaagcagagctagaactggcagaaaacagg

SEQ ID NO: 190833 - DNA, 75 bp, Artificial Sequence
  Synthetic
gaaataaaaaattgctctttcaatgtaaccacagaactaagagataagagacagcaagtgtatgcacttttttat

SEQ ID NO: 190834 - DNA, 75 bp, Artificial Sequence
  Synthetic
atgcaactagtagtaatagtacaactgcaactggtagtaataatgcaactggtaataatagtgtttctgataatt

SEQ ID NO: 190835 - DNA, 75 bp, Artificial Sequence
  Synthetic
cattgtcattgcagacccgcctcccaacccagaggggacccgacaggcccgaaggaatcgaagaagaaggtggag

SEQ ID NO: 190836 - DNA, 75 bp, Artificial Sequence
  Synthetic
atagtgcaaaatgcacaagggcaaatggtacatcagcctttatcacctagaactttgaatgcatgggtaaaagta

SEQ ID NO: 190837 - DNA, 75 bp, Artificial Sequence
  Synthetic
gtgtagaagatatgaaaaattgctctttcaatacgactacagaactaagagataagaaaaggggagaatatgcgt

SEQ ID NO: 190838 - DNA, 75 bp, Artificial Sequence
  Synthetic
gccccttcagctacccccgcttggaagacttacccccgattgtgaccaggattggggaacttctgggacgcaggg

SEQ ID NO: 190839 - DNA, 75 bp, Artificial Sequence
  Synthetic
cagaaaattttaacatgtggaaaaataacatggtagaacagatgcatgaggatataattagtttatgggatcaaa

SEQ ID NO: 190840 - DNA, 75 bp, Artificial Sequence
  Synthetic
ctataaaatgggtggcaagtggtcaaaaagtagcatagttgggtggcctgctataagggaaagaatgagacgagc

SEQ ID NO: 190841 - DNA, 75 bp, Artificial Sequence
  Synthetic
tagaagtaaacatagtaacagattcacaatatgcattaggaatcattcaagcacaaccagataaaagtgaatcag

SEQ ID NO: 190842 - DNA, 75 bp, Artificial Sequence
  Synthetic
agtatcaactcaaatgctactaaatggcagcctagcagaagaagaaatagtaattagatctgaaaatattacaga

SEQ ID NO: 190843 - DNA, 75 bp, Artificial Sequence
  Synthetic
aacaataaactttactcagtcctcagggggagatttagaacttacaacacacagctttaattgtggaggagaatt

SEQ ID NO: 190844 - DNA, 75 bp, Artificial Sequence
  Synthetic
aacaagtagataaattagtcagtagtggaatcaggaaagtactatttttagatggcatagataaagcccaagaag

SEQ ID NO: 190845 - DNA, 75 bp, Artificial Sequence
  Synthetic
ctaaaggatcaacagctcctagggatttggggttgctctggaaaactcatttgcaccactaatgtgccttggaat

SEQ ID NO: 190846 - DNA, 75 bp, Artificial Sequence
  Synthetic
gaattggataagtgggcaagcttgtggaattggtttgacataacaaaatggctgtggtatatcaaaatattcata

SEQ ID NO: 190847 - DNA, 75 bp, Artificial Sequence
  Synthetic
aaatgttaatgttacccatgagaatagcacgaagggggaaatgaaaaattgctctttcaatgcaaccacagaact

SEQ ID NO: 190848 - DNA, 75 bp, Artificial Sequence
  Synthetic
accattgacagtgaaatgaacggagaaataaaaaactgctctttcaacataaccacagaactaagagataagaaa

SEQ ID NO: 190849 - DNA, 75 bp, Artificial Sequence
  Synthetic
acttctgggacacagcagtctcaagggactgagactggggtgggagggcctcaaatatctgtggaatcttctgtt

SEQ ID NO: 190850 - DNA, 75 bp, Artificial Sequence
  Synthetic
cagcaatagcagtagctaactggacagattggggtatagaagtagtacaaagaattggtagagctatttgcaaca

SEQ ID NO: 190851 - DNA, 75 bp, Artificial Sequence
  Synthetic
gctaaatggcctgaggtaagggaaagaatgagacaaacccctccagcagcagcagaaggagcaggagcagtatct

SEQ ID NO: 190852 - DNA, 75 bp, Artificial Sequence
  Synthetic
ggatacttgggaaggagttgaagctataataagaattttgcaacaactactgtttgttcatttcagaattgggtg

SEQ ID NO: 190853 - DNA, 75 bp, Artificial Sequence
  Synthetic
aagcctaaagccatgtgtaaaattaaccccactctgtgttactttaaattgcactgatttgaggaatgctactaa

SEQ ID NO: 190854 - DNA, 75 bp, Artificial Sequence
  Synthetic
aagtatacgtataggaccaggacaagcattttatgcaacaggcgctataatagggaatataagacaagcacagtg

SEQ ID NO: 190855 - DNA, 75 bp, Artificial Sequence
  Synthetic
taccactgggaatgctactaataccactagtagtagcgggatggagatggagggaggagaaataaaaaactgctc

SEQ ID NO: 190856 - DNA, 75 bp, Artificial Sequence
  Synthetic
aggatataatcagtttatgggaccaaagcctaaagccatgtgtaaagttgaccccactctgtgtcactttaaatt

SEQ ID NO: 190857 - DNA, 75 bp, Artificial Sequence
  Synthetic
ggaggagatccagaaataacaacacatagttttaattgtggaggagaatttttttattgtaacacatcaggcctg

SEQ ID NO: 190858 - DNA, 75 bp, Artificial Sequence
  Synthetic
gtagtaatactatcaatggtactgtcctctatgaaaatgataccatgtatggagaagtaaaaaattgctctttca

SEQ ID NO: 190859 - DNA, 75 bp, Artificial Sequence
  Synthetic
tgtgtgggccatagtacttatagaagttaggaaaataagaaaacaaaagaaaatagataagttaattgatagaat

SEQ ID NO: 190860 - DNA, 75 bp, Artificial Sequence
  Synthetic
aagaaagccaaaaaatgggtttatagacatcactttgaaagcaggaatccaagaataagttcagaagtacacatc

SEQ ID NO: 190861 - DNA, 75 bp, Artificial Sequence
  Synthetic
agtagtaaaaattgaaccactaggagtagcacccaccagggcaaagagaagagtggtggagagagaaaaaagagc

SEQ ID NO: 190862 - DNA, 75 bp, Artificial Sequence
  Synthetic
tataggaccagggagagcattttatacaacaggagaaataataggagatataagaaaagcacattgtaaccttag

SEQ ID NO: 190863 - DNA, 75 bp, Artificial Sequence
  Synthetic
agctacagccagctcttaagacaggaacagaagaccttcaatcattatataatacaatagcagtcctctattgcg

SEQ ID NO: 190864 - DNA, 75 bp, Artificial Sequence
  Synthetic
agctgataaagaaaaggacagcaagatcagtcaaaattatcctatagtacagaatgcccaggggcaaatggtaca

SEQ ID NO: 190865 - DNA, 75 bp, Artificial Sequence
  Synthetic
acgagtgacaacaaccccaacgtcacgagtggcgagagtgaaatgaaaaactgctctttcaatatgaccacagaa

SEQ ID NO: 190866 - DNA, 75 bp, Artificial Sequence
  Synthetic
gggaaaattagaagaacactttaagaataaaagtatagtttttaatcaatcctcaggaggggacctagaaatcac

SEQ ID NO: 190867 - DNA, 75 bp, Artificial Sequence
  Synthetic
gaacaagccccagaagaccagggaccacagagggagccatacaatgaatggacactagagcttttagaggaactt

SEQ ID NO: 190868 - DNA, 75 bp, Artificial Sequence
  Synthetic
ggaaggacaccaaatgaaagactgtactgagagacaggctaattttttagggaaaatctggccttcccacaaggg

SEQ ID NO: 190869 - DNA, 75 bp, Artificial Sequence
  Synthetic
aattcaaccatcatactcccatgcagaataaaacaaattataaacatgtggcagggggtaggacgagcaatatat

SEQ ID NO: 190870 - DNA, 75 bp, Artificial Sequence
  Synthetic
gtgccttttcagctaccaccgattgagagacttcatattgattgcagcgagagcagcggaacttctgggacgcag

SEQ ID NO: 190871 - DNA, 75 bp, Artificial Sequence
  Synthetic
gataatgttactgttagtgttaatgataccatggaaatgaaaaattgctctttcaatgtaaccacagtagtaaca

SEQ ID NO: 190872 - DNA, 75 bp, Artificial Sequence
  Synthetic
aaaaagtatacgtataggaccaggacaaacgttctatgcaacagacatagtaggaaatataagaaaagcatcttg

SEQ ID NO: 190873 - DNA, 75 bp, Artificial Sequence
  Synthetic
ctgaaggaacagataggattatagaattcatacaaagaatttgtagagctatccgcaacatacctagaagaataa

SEQ ID NO: 190874 - DNA, 75 bp, Artificial Sequence
  Synthetic
gtaagagaaagaataagacaaactgagccagcagcagagggagtaggagcagcgtctcaagacttagataaacat

SEQ ID NO: 190875 - DNA, 75 bp, Artificial Sequence
  Synthetic
agccagcagcagagggagtaggagcagcgtctcaagacttagataaacatggagcacttacaagcagcaacacag

SEQ ID NO: 190876 - DNA, 75 bp, Artificial Sequence
  Synthetic
aaactcaagagcagatttgggaaaacatgacttggatgcagtgggaaaaagaaattagcaattacacaggcataa

SEQ ID NO: 190877 - DNA, 75 bp, Artificial Sequence
  Synthetic
ttttgtgcatcagatgctaaagcatatgaaagagaagtgcataatgtctgggctacacatgcctgtgtacccaca

SEQ ID NO: 190878 - DNA, 75 bp, Artificial Sequence
  Synthetic
agggttaaaaaagaaaaagtcagtaacagtactggatgtgggggatgcatatttttcagttcccttagataagga

SEQ ID NO: 190879 - DNA, 75 bp, Artificial Sequence
  Synthetic
caccaattcccctgacagtaccctgaaggaggagccagaggcaatacaaaactgctctttcgatatgaccacaga

SEQ ID NO: 190880 - DNA, 75 bp, Artificial Sequence
  Synthetic
tacaggctaataaattgtaatacctcaaccattacacaggcttgtccaaaggtatcttgggatccaattcccata

SEQ ID NO: 190881 - DNA, 75 bp, Artificial Sequence
  Synthetic
gaatttgtagagctatctgcaacatacctagaagaataagacagggctttgaagcagctttgcaataaaatgggg

SEQ ID NO: 190882 - DNA, 75 bp, Artificial Sequence
  Synthetic
ctcaggtacctgtaagaccaatgacttacaaggcagctgtagatatgagccactttttaaaagaaaaggggggac

SEQ ID NO: 190883 - DNA, 75 bp, Artificial Sequence
  Synthetic
ttggaactccagttggagtaataaatctcaaaatgatatttgggataacatgacctggatgcagtgggatagaga

SEQ ID NO: 190884 - DNA, 75 bp, Artificial Sequence
  Synthetic
acaggagaaagagaatggcatttgggtcatggagtctccatagaatggagattgagaagatatagcacacaagta

SEQ ID NO: 190885 - DNA, 75 bp, Artificial Sequence
  Synthetic
atggtgataatagcactataggagaaataaaaaaatgctatttcaatactaccacaggcatgatagataagatga

SEQ ID NO: 190886 - DNA, 75 bp, Artificial Sequence
  Synthetic
aaatccagaaatagttatctatcaatacatggatgacttgtatgtaggatctgacttagaaatagggcagcatag

SEQ ID NO: 190887 - DNA, 75 bp, Artificial Sequence
  Synthetic
gcacacagcaagaggcgagagcggcgactggtgagtacgccaaattttgactagcggaggctagaaggagagaga

SEQ ID NO: 190888 - DNA, 75 bp, Artificial Sequence
  Synthetic
ataagacagggctttgaaagagctttgctataaaatgggaggcaagtggtcaaaaagtagcatagttggatggcc

SEQ ID NO: 190889 - DNA, 75 bp, Artificial Sequence
  Synthetic
taggaccagggaaagcattttatgcagcgggagacataataggaaacataagacaagcacactgtaacatcagta

SEQ ID NO: 190890 - DNA, 75 bp, Artificial Sequence
  Synthetic
acccctccagcaccagaaggggcggtagcagaaggggtgggagcagtgtctcgagacttacaaaaccggggggca

SEQ ID NO: 190891 - DNA, 75 bp, Artificial Sequence
  Synthetic
gaatctgtagaaattaattgtacaagacccaacaacaatacaagaaaaagtatacatataggaccagggagagca

SEQ ID NO: 190892 - DNA, 75 bp, Artificial Sequence
  Synthetic
ctcaggtacctttaagaccaatgacctataaggcagctgtagatctcagtcactttttaaaagaaaaggggggac

SEQ ID NO: 190893 - DNA, 75 bp, Artificial Sequence
  Synthetic
tcacacttccatgcagaataaaacaaattgtaaacatgtggcaggaagtaggaaaagcaatgtatgcccctccca

SEQ ID NO: 190894 - DNA, 75 bp, Artificial Sequence
  Synthetic
tcctgtatcaaagcagtaagtaccatatagtagatgtaatgatagattgggtagcaagagtagattatagaatag

SEQ ID NO: 190895 - DNA, 75 bp, Artificial Sequence
  Synthetic
tccagaaatagtcatctatcaatatatggatgacttgtatgtaggatctgatttagaaatagggcaacatagagc

SEQ ID NO: 190896 - DNA, 75 bp, Artificial Sequence
  Synthetic
aaaaattgctctttcaatacaaccacagaaataagagataagaaacagaaagcatatgcacttttttatagacct

SEQ ID NO: 190897 - DNA, 75 bp, Artificial Sequence
  Synthetic
aaaaactactctattctgtgcatcagatgctaaagcatatgagaaagaagtacataatgtctgggctacacatgc

SEQ ID NO: 190898 - DNA, 75 bp, Artificial Sequence
  Synthetic
tgctctggaaaactcatttgcaccactactgtgccttggaatgctagttggagtaataaatctttggatgagatt

SEQ ID NO: 190899 - DNA, 75 bp, Artificial Sequence
  Synthetic
accaccactctattttgtgcatcagatgctaaagcagttgagacagaggtacataatgtctgggccacacatgcc

SEQ ID NO: 190900 - DNA, 75 bp, Artificial Sequence
  Synthetic
agggtaatggtaccagtgttaataatactaccctcaatcaggaagaaatgaaaaattgccctttcaatatgacca

SEQ ID NO: 190901 - DNA, 75 bp, Artificial Sequence
  Synthetic
gaatcgcaaaaccaacaagaaaagaatgaacaagaattattggaattggataaatgggcaagtttgtggaattgg

SEQ ID NO: 190902 - DNA, 75 bp, Artificial Sequence
  Synthetic
cagaattgggtgtcaacacagcagaataggcattactcggcagagaagagtaaggaatggacccagtagatccta

SEQ ID NO: 190903 - DNA, 75 bp, Artificial Sequence
  Synthetic
tatagaaatttgtggaaaaaaggctataggtacagtattagtaggacctacacctgtcaacataattggaagaaa

SEQ ID NO: 190904 - DNA, 75 bp, Artificial Sequence
  Synthetic
cactagtgtgaataacactgcttatgtgaataagactgaagaagagaaagaaatgaaaaactgctctttcaatat

SEQ ID NO: 190905 - DNA, 75 bp, Artificial Sequence
  Synthetic
tattctccatatacctgtaagaataagacagggcttggaaagggctttgctataagatgggtggcaagtggtcaa

SEQ ID NO: 190906 - DNA, 75 bp, Artificial Sequence
  Synthetic
cttatggagatggggcaccatgctccttgggatgttgatgatctgtagtgctgcagaacaattgtgggtcacagt

SEQ ID NO: 190907 - DNA, 75 bp, Artificial Sequence
  Synthetic
aggttaattgaaagaataagagaaagagcagaagacagtggcaacgagagtgatggagacacagaggaattatcc

SEQ ID NO: 190908 - DNA, 75 bp, Artificial Sequence
  Synthetic
agcacagtacaatgtacacatggaattaggccagtagtatcaactcaactactgttaaatggcagtctagcagaa

SEQ ID NO: 190909 - DNA, 75 bp, Artificial Sequence
  Synthetic
agcagaagcaggagcagaaggacgagggactgtaccctcccttagcttccctcaaatcactctttggcaacgacc

SEQ ID NO: 190910 - DNA, 75 bp, Artificial Sequence
  Synthetic
tgcatacagatataatcagtttatgggatcagagcttaaagccatgtgtaaagttaaccccactctgtgttactc

SEQ ID NO: 190911 - DNA, 75 bp, Artificial Sequence
  Synthetic
acaatacaagaaaaagtatacacctaggagcagggaaagcaatttatacaacaggagccataataggaaatataa

SEQ ID NO: 190912 - DNA, 75 bp, Artificial Sequence
  Synthetic
aggagcagggaaagcaatttatacaacaggagccataataggaaatataagacaagcacattgtaacattagttg

SEQ ID NO: 190913 - DNA, 75 bp, Artificial Sequence
  Synthetic
aggaacaaagaaactgctctttcaatgtaactacagccataagagataagaaccagaaggtacatgcactctttt

SEQ ID NO: 190914 - DNA, 75 bp, Artificial Sequence
  Synthetic
ttgggataacatgacctggatgcagtgggatagagaaatcagtaattacacagacacaatatactggttgcttga

SEQ ID NO: 190915 - DNA, 75 bp, Artificial Sequence
  Synthetic
atcaactcaactgttgttaaatggaagcctagcagaagtggaggaggtaataattagatctaaaaatattacaga

SEQ ID NO: 190916 - DNA, 75 bp, Artificial Sequence
  Synthetic
tgttgctatcattgtcaagcttgctttttgaacaagggcttaggcatctcctatggcaggaagaagcggagacag

SEQ ID NO: 190917 - DNA, 75 bp, Artificial Sequence
  Synthetic
gcaggaggggatatagagattataacacatagttttaattgtggaggagagtttttctattgcaatacaacaaaa

SEQ ID NO: 190918 - DNA, 75 bp, Artificial Sequence
  Synthetic
agagttaggcagggatattcaccattatcgttccagacccgccacccagctccgaggggacccgacaggcccgaa

SEQ ID NO: 190919 - DNA, 75 bp, Artificial Sequence
  Synthetic
attctgggacgcagggggtgggaaacccttaagtatctgaaaagtattatacagtattggtgtctggagctaaaa

SEQ ID NO: 190920 - DNA, 75 bp, Artificial Sequence
  Synthetic
cagatggcaggtgatgattgtgtggcaggtagacaggatgaggattaatacatggaaaagtttagtaaaatacca

SEQ ID NO: 190921 - DNA, 75 bp, Artificial Sequence
  Synthetic
tgtggaaaaataaaatggtagagcaaatgcatacagatataatcagtttatgggatcaaagcctaaagccatgtg

SEQ ID NO: 190922 - DNA, 75 bp, Artificial Sequence
  Synthetic
tccctcaaatcactctttggcaacgaccccttgtcacagtaaaaatagggggacagctaaaagaagctctattag

SEQ ID NO: 190923 - DNA, 75 bp, Artificial Sequence
  Synthetic
tttagattgtaaccataatgtcacctataatggctccagggtctataatggcacagacatgaaaaactgctcttt

SEQ ID NO: 190924 - DNA, 75 bp, Artificial Sequence
  Synthetic
aaaacatgggacgatcacagagcgcggtactaatgatgcggcttgtgtttggctagaggcacaagaggatggcca

SEQ ID NO: 190925 - DNA, 75 bp, Artificial Sequence
  Synthetic
ggctagaggcacaagaggatggccaggaggtgggttttccagtcaggcctcaggtacctttaagaccaatgactc

SEQ ID NO: 190926 - DNA, 75 bp, Artificial Sequence
  Synthetic
aaaaggaaaaggtctacctgtcatgggtaccagcacacaaaggaattggaggaaatgaacaagtagataaattag

SEQ ID NO: 190927 - DNA, 75 bp, Artificial Sequence
  Synthetic
gattagtggatggattcttagcacttatctgggacgatctaaggagcctgtgcctcttcagctaccaccgcttga

SEQ ID NO: 190928 - DNA, 75 bp, Artificial Sequence
  Synthetic
taaatggagaaaattagtagatttcagagaacttaataagagaactcaagacttttgggaagttcaattaggaat

SEQ ID NO: 190929 - DNA, 75 bp, Artificial Sequence
  Synthetic
tagtttttgctgtgctttctatagtaaatagagttaggcagggatactcacctctgtctttacagacccttatcc

SEQ ID NO: 190930 - DNA, 75 bp, Artificial Sequence
  Synthetic
aaatggcagtctagcagaagaaaagataagaattaggtcagaaaatatcacaaacaatgccaaaaacataatagt

SEQ ID NO: 190931 - DNA, 75 bp, Artificial Sequence
  Synthetic
agaaataaaaaataagaaaaagaatgagtatgcactcttttatagatctgatatagaaccacttcctggggagga

SEQ ID NO: 190932 - DNA, 75 bp, Artificial Sequence
  Synthetic
cggcgactggtgagtacgccaaaattttttgactagcggaggctagaaggagagagatgggtgcgagagcgtcag

SEQ ID NO: 190933 - DNA, 75 bp, Artificial Sequence
  Synthetic
gagaatttttctattgcagcacatcaggcctgtttaatggcacttggacttggactaatgacactgggagtaata

SEQ ID NO: 190934 - DNA, 75 bp, Artificial Sequence
  Synthetic
gctataacaatgggaggcaaatggtcaaaaggttgtataagtggatggcctgctgtaagggaaagaataaggcaa

SEQ ID NO: 190935 - DNA, 75 bp, Artificial Sequence
  Synthetic
caagaagaagtataaggataggaccaggacaagcattctatgcaacaaatgtaataggagacataaggcaggcat

SEQ ID NO: 190936 - DNA, 75 bp, Artificial Sequence
  Synthetic
caacatatctatgaaacatatggggatacttggacaggagtcgaagctataataagaatactgcaacaactactg

SEQ ID NO: 190937 - DNA, 75 bp, Artificial Sequence
  Synthetic
atacttggacaggagtcgaagctataataagaatactgcaacaactactgtttattcatttcagaattgggtgcc

SEQ ID NO: 190938 - DNA, 75 bp, Artificial Sequence
  Synthetic
ttatataatacaatagcagtcctctattgtgtgcatcaaaagatagatgtaaaagacaccaaggaagctttagat

SEQ ID NO: 190939 - DNA, 75 bp, Artificial Sequence
  Synthetic
tgccatagagtcaacaacagcaaacccaacaccacgagtgacgggagtgaagtaagaatgcaaaactgctctttc

SEQ ID NO: 190940 - DNA, 75 bp, Artificial Sequence
  Synthetic
tacacaggcttgtccaaaggtaacctttgagccaattcccatacattattgtgccccagctggttttgcgattct

SEQ ID NO: 190941 - DNA, 75 bp, Artificial Sequence
  Synthetic
gaacagaagaaattaaatcgttatttaatctagtagcagtcctctattgtgtacatcagaaaatagaggtacaag

SEQ ID NO: 190942 - DNA, 75 bp, Artificial Sequence
  Synthetic
cacaaccaatggctctaacagaataggaaatataacagatgaaataataggaaatataacagatgaaataagaaa

SEQ ID NO: 190943 - DNA, 75 bp, Artificial Sequence
  Synthetic
tcaaataatagagcagttaataaaaaaggaaaaggtctacctggcatgggtaccagcacacaaaggaattggagg

SEQ ID NO: 190944 - DNA, 75 bp, Artificial Sequence
  Synthetic
ggaccaggacaaacgttctatgcaacaggtgacataataggagatataaggaaagtacattgtcagattaatgga

SEQ ID NO: 190945 - DNA, 75 bp, Artificial Sequence
  Synthetic
cactgcagaataaagcaaattgtgagaatgtggcagagagtaggacaagcaatgtatgcccctcccatcccagga

SEQ ID NO: 190946 - DNA, 75 bp, Artificial Sequence
  Synthetic
agagcttttctccacatacctagaagaatcagacagggcttagaaagagctttgctataacatgggtggcaagtg

SEQ ID NO: 190947 - DNA, 75 bp, Artificial Sequence
  Synthetic
tttgctataacatgggtggcaagtggtcaaaaagcagcatagtgggatggcctgagattagggaaagaatgagac

SEQ ID NO: 190948 - DNA, 75 bp, Artificial Sequence
  Synthetic
cagggaactttctccagagcaggccagaaccaacagccccaccagcagaatgcttcgggttcggggaggagatga

SEQ ID NO: 190949 - DNA, 75 bp, Artificial Sequence
  Synthetic
aataagctttaaatcatcctcaggaggagacccagaaattacagcacatagctttaattgtatgggagaattttt

SEQ ID NO: 190950 - DNA, 75 bp, Artificial Sequence
  Synthetic
ggaatttggggctgctctggaaagctcatctgcaccactaatgtgccctggaactctagttggagtaataaatct

SEQ ID NO: 190951 - DNA, 75 bp, Artificial Sequence
  Synthetic
aatcatcacaattccatgcagaataaaacaaattataaacatgtggcagggggtaggaagagcaatgtatgcccc

SEQ ID NO: 190952 - DNA, 75 bp, Artificial Sequence
  Synthetic
ctataaccagccccctgaaggaagaggcaggggcaatacaaaactgttctttcaatgtgaccacagagttaagag

SEQ ID NO: 190953 - DNA, 75 bp, Artificial Sequence
  Synthetic
aggactttgaatgcatgggtaaaagtaatagaagaaaggggtttcagcccagaagtaatacccatgttctcagca

SEQ ID NO: 190954 - DNA, 75 bp, Artificial Sequence
  Synthetic
tgtccaaaggtatcttgggatccaattcccatacattattgtgctccagctggttttgcgattctaaagtgtaat

SEQ ID NO: 190955 - DNA, 75 bp, Artificial Sequence
  Synthetic
taacaccaacaaagataaaaccacctttgcctagtgttaggaagctgacagaggacagatggaacaagccccaga

SEQ ID NO: 190956 - DNA, 75 bp, Artificial Sequence
  Synthetic
ttgcagcgaggactgtggaaattctgggacacagggtgtggcagatcctcaaatatctggggaatcttgcgcaat

SEQ ID NO: 190957 - DNA, 75 bp, Artificial Sequence
  Synthetic
caacaactactgtttgtccatttcagaattgggtgccaacatagcagaataggtattattcgaagcagaagagtc

SEQ ID NO: 190958 - DNA, 75 bp, Artificial Sequence
  Synthetic
aaaggtatacatatgggaccaggacaagcattttatgcagcaggagaaataataggagacatcagaaaagcatat

SEQ ID NO: 190959 - DNA, 75 bp, Artificial Sequence
  Synthetic
ataagaagaacctccccatccccagcagaaggggtgggagcagcgtctcaagatttaggtagacatggggcactt

SEQ ID NO: 190960 - DNA, 75 bp, Artificial Sequence
  Synthetic
ataagaagaacctccccatccccagcagaaggggtgggagcagcgtctcaagatttaggtagtcatggggcactt

SEQ ID NO: 190961 - DNA, 75 bp, Artificial Sequence
  Synthetic
ataagaagaacctccccatccccagcagaaggggtgggagcagcgtctcaagatttaggtagccatggggcactt

SEQ ID NO: 190962 - DNA, 75 bp, Artificial Sequence
  Synthetic
ataagaagaacctccccatccccagcagaaggggtgggagcagcgtctcaagatttaggtaggcatggggcactt

SEQ ID NO: 190963 - DNA, 75 bp, Artificial Sequence
  Synthetic
ataagaagaacctccccttccccagcagaaggggtgggagcagcgtctcaagatttaggtagacatggggcactt

SEQ ID NO: 190964 - DNA, 75 bp, Artificial Sequence
  Synthetic
ataagaagaacctccccttccccagcagaaggggtgggagcagcgtctcaagatttaggtagtcatggggcactt

SEQ ID NO: 190965 - DNA, 75 bp, Artificial Sequence
  Synthetic
ataagaagaacctccccttccccagcagaaggggtgggagcagcgtctcaagatttaggtagccatggggcactt

SEQ ID NO: 190966 - DNA, 75 bp, Artificial Sequence
  Synthetic
ataagaagaacctccccttccccagcagaaggggtgggagcagcgtctcaagatttaggtaggcatggggcactt

SEQ ID NO: 190967 - DNA, 75 bp, Artificial Sequence
  Synthetic
ataagaagaacctccccctccccagcagaaggggtgggagcagcgtctcaagatttaggtagacatggggcactt

SEQ ID NO: 190968 - DNA, 75 bp, Artificial Sequence
  Synthetic
ataagaagaacctccccctccccagcagaaggggtgggagcagcgtctcaagatttaggtagtcatggggcactt

SEQ ID NO: 190969 - DNA, 75 bp, Artificial Sequence
  Synthetic
ataagaagaacctccccctccccagcagaaggggtgggagcagcgtctcaagatttaggtagccatggggcactt

SEQ ID NO: 190970 - DNA, 75 bp, Artificial Sequence
  Synthetic
ataagaagaacctccccctccccagcagaaggggtgggagcagcgtctcaagatttaggtaggcatggggcactt

SEQ ID NO: 190971 - DNA, 75 bp, Artificial Sequence
  Synthetic
ataagaagaacctccccgtccccagcagaaggggtgggagcagcgtctcaagatttaggtagacatggggcactt

SEQ ID NO: 190972 - DNA, 75 bp, Artificial Sequence
  Synthetic
ataagaagaacctccccgtccccagcagaaggggtgggagcagcgtctcaagatttaggtagtcatggggcactt

SEQ ID NO: 190973 - DNA, 75 bp, Artificial Sequence
  Synthetic
ataagaagaacctccccgtccccagcagaaggggtgggagcagcgtctcaagatttaggtagccatggggcactt

SEQ ID NO: 190974 - DNA, 75 bp, Artificial Sequence
  Synthetic
ataagaagaacctccccgtccccagcagaaggggtgggagcagcgtctcaagatttaggtaggcatggggcactt

SEQ ID NO: 190975 - DNA, 75 bp, Artificial Sequence
  Synthetic
aaggcttaggcatctcctatggcaggaagaagcggagacagcgacgaagaactcctcaaggtggtcagactcatc

SEQ ID NO: 190976 - DNA, 75 bp, Artificial Sequence
  Synthetic
atatcagcaatagtagcattggtagtaacgctaataatagcaatagttgtgtggtctatagtactcatagagtgt

SEQ ID NO: 190977 - DNA, 75 bp, Artificial Sequence
  Synthetic
gaggccaggaaattttcctcagagcagaccggaaccaacagccccaccagcagagatctttgggatgggggaaga

SEQ ID NO: 190978 - DNA, 75 bp, Artificial Sequence
  Synthetic
agaactgttcgcagtattaatggctacaatgagagcgtggaggaaataaaaaattgctctttcaatgcaaccaca

SEQ ID NO: 190979 - DNA, 75 bp, Artificial Sequence
  Synthetic
cagaagttatcccagcagaaacaggacaagaaacagcctacttcatactaaagttagcaggaagatggccagtaa

SEQ ID NO: 190980 - DNA, 75 bp, Artificial Sequence
  Synthetic
tggaaaaacaacatggtagaacagatgcataaggatataatcagtctatgggatgagagcctaaagccatgtgtg

SEQ ID NO: 190981 - DNA, 75 bp, Artificial Sequence
  Synthetic
atagtactaaaataaaggaagaagaaaaaatgaaaaactgttcttttaatgtaaccacaacagcaagagatcagc

SEQ ID NO: 190982 - DNA, 75 bp, Artificial Sequence
  Synthetic
ctttcgatattgacacaaaaataggaaatatacgaaaagaacatgcaatttttaataaacttgatatagtaccaa

SEQ ID NO: 190983 - DNA, 75 bp, Artificial Sequence
  Synthetic
agatttgggataacatgacctggatggagtgggaaaaagagattagcaattactcagatgaaatatacaggttaa

SEQ ID NO: 190984 - DNA, 75 bp, Artificial Sequence
  Synthetic
tacctcaaccattacacaggcttgtccaaagatatcctttgagccaattcctatacattattgtgccccagctgg

SEQ ID NO: 190985 - DNA, 75 bp, Artificial Sequence
  Synthetic
ggtaccagcacacaaaggaattggaggaaatgaacaagtagataaattagttagttctggaatcagaaaagtact

SEQ ID NO: 190986 - DNA, 75 bp, Artificial Sequence
  Synthetic
ccatgtgtaaagttgaccccactctgtgtcactttaaattgtacaaaagttacctacaacacaagtgttacccac

SEQ ID NO: 190987 - DNA, 75 bp, Artificial Sequence
  Synthetic
agtgtacgtataggaccaggacaagcataccagttctatggtgaaataatagggaatataagacaagcatattgt

SEQ ID NO: 190988 - DNA, 75 bp, Artificial Sequence
  Synthetic
tttaaaaagaatagctataaaattaagagaacaatttaagaataaaacaatagtttttaattcatcctcgggagg

SEQ ID NO: 190989 - DNA, 75 bp, Artificial Sequence
  Synthetic
taccacttaaagagaactctagtgagtatatattaataaattgcaatacctcaaccataacacaagcctgtccaa

SEQ ID NO: 190990 - DNA, 75 bp, Artificial Sequence
  Synthetic
aatggtcatctatcaatatatggatgacttatatgtaggatctgacttagaaatagggcaacatagagcaaaaat

SEQ ID NO: 190991 - DNA, 75 bp, Artificial Sequence
  Synthetic
gagtcgggaactaaagaatagtgctattagcttgtttaataccacagcaatagtagtagctgaagggacagatag

SEQ ID NO: 190992 - DNA, 75 bp, Artificial Sequence
  Synthetic
agctttgctataaaatgggaagcaagtggtcaaaaagtagcataattggatggcctgctatcagggaaagaatga

SEQ ID NO: 190993 - DNA, 75 bp, Artificial Sequence
  Synthetic
gatgtaatgatagattgggcagcaaaagtagattatagagtaggagtagtagcatttataatagcattactcata

SEQ ID NO: 190994 - DNA, 75 bp, Artificial Sequence
  Synthetic
ctcaggtacctttaagaccaatgacttataaggcagctgtagatctcagccactttttaaaagaaaaggggggac

SEQ ID NO: 190995 - DNA, 75 bp, Artificial Sequence
  Synthetic
gttttatagacatcattttgaaagcactcatccaaagataagttcagaagtacacattccattaggggaagctag

SEQ ID NO: 190996 - DNA, 75 bp, Artificial Sequence
  Synthetic
gaagaagaaggtggagagcaagacagagacagatccgtgcgattagtgaacggattcttagcacttgcctgggac

SEQ ID NO: 190997 - DNA, 75 bp, Artificial Sequence
  Synthetic
agaactgaaatcattacataatacaatagcagttctctattgtgtgcatcaaaaaatagatgtaaaagacaccaa

SEQ ID NO: 190998 - DNA, 75 bp, Artificial Sequence
  Synthetic
gaagacagtggcaatgagagtgatggggatcaggaagaattatcagcaatggtggaaagggggcatcttgctcct

SEQ ID NO: 190999 - DNA, 75 bp, Artificial Sequence
  Synthetic
agtaatgttactggtacccccaatgagggcagggatggacaaatgaaaaattgctctttcaatgtaaccacagaa

SEQ ID NO: 191000 - DNA, 75 bp, Artificial Sequence
  Synthetic
tcaatgaaatctggaatgtaatgacctggatacagtgggaaaaagaaattgacaattacacaggggaaatataca

SEQ ID NO: 191001 - DNA, 75 bp, Artificial Sequence
  Synthetic
agaagtaaaaaactgctctttcaatattaccacaagcataaaagataaggtgcagacagaatatgcactttttta

SEQ ID NO: 191002 - DNA, 75 bp, Artificial Sequence
  Synthetic
atcctcaacatacctagaagaatcagacagggcctcgaaaggtctttactataacatggggagcaagtggtctaa

SEQ ID NO: 191003 - DNA, 75 bp, Artificial Sequence
  Synthetic
gcacttccctaataaaacaataaactttacacaaccctcaggaggggacttagaaatcacaacacatacctttaa

SEQ ID NO: 191004 - DNA, 75 bp, Artificial Sequence
  Synthetic
cctgcaggtttgcaagataatcaagatcctataccaaagcagtaagtaccataaatgtacatattaggaatagga

SEQ ID NO: 191005 - DNA, 75 bp, Artificial Sequence
  Synthetic
aagaagaggaagaggaagtgggttttccagttagacctcaggtaccattaaggccaatgacatataaggcagcta

SEQ ID NO: 191006 - DNA, 75 bp, Artificial Sequence
  Synthetic
cccaacaacaatacaagaaaaggcatacatatgggaccaggaggagcactgtttacaacagaaataacaggaaat

SEQ ID NO: 191007 - DNA, 75 bp, Artificial Sequence
  Synthetic
agcgaaagtagacccaaagaagttttttcaccccagaattcggtttgccaaacccccaacggcaaaaggcaaggg

SEQ ID NO: 191008 - DNA, 75 bp, Artificial Sequence
  Synthetic
gagatattcagacctggaggaggagatatgagggacaattggagaagtgaattatataaatataaagtggtagaa

SEQ ID NO: 191009 - DNA, 75 bp, Artificial Sequence
  Synthetic
agcaatagtaatagtagtgccagcctagaaggggaacagaaattaacaaactgctctttcaatgtaactacagca

SEQ ID NO: 191010 - DNA, 75 bp, Artificial Sequence
  Synthetic
gaagaggcagggatggatccggtagatcctagcctagagccctggaaccatccgggaagtcagcctacaactgct

SEQ ID NO: 191011 - DNA, 75 bp, Artificial Sequence
  Synthetic
ctctgtataggctaataaattgtaatacctcagtcattacacaggcttgcccaaaggtgacctttgaaccaattc

SEQ ID NO: 191012 - DNA, 75 bp, Artificial Sequence
  Synthetic
cactgctgtgccttggaatgctagttggagtaataaatctctgaatgacatttgggataacatgacctggatgca

SEQ ID NO: 191013 - DNA, 75 bp, Artificial Sequence
  Synthetic
tacacatggaattaagccagtggtatcaactcaactgctgttgaatggaagcctagcagaagggcaggtaataat

SEQ ID NO: 191014 - DNA, 75 bp, Artificial Sequence
  Synthetic
agcaatagttgtgtggactatagtattcatagagtgtagaagagtgcaaaagcaaagaaaaatagataggttaat

SEQ ID NO: 191015 - DNA, 75 bp, Artificial Sequence
  Synthetic
ggtatacatatagggccaggacaagcattctatgtaacaggtgaagtcataggaaacataagacaagcacattgt

SEQ ID NO: 191016 - DNA, 75 bp, Artificial Sequence
  Synthetic
attaagaaagcactttaataaaacaataatttttgaaccatcttcaggaggggatatagagattacatcacatac

SEQ ID NO: 191017 - DNA, 75 bp, Artificial Sequence
  Synthetic
gaaaacttgtgggttactgtctactatggggtacctgtgtggagagacgcagagaccaccttattttgtgcatca

SEQ ID NO: 191018 - DNA, 75 bp, Artificial Sequence
  Synthetic
tagccaaaaattgcagggcccctagaaaaaagggctgttggaaatgtggaaaagaaggacatcaaatgaaagact

SEQ ID NO: 191019 - DNA, 75 bp, Artificial Sequence
  Synthetic
aaatggggagcaagtggtcaaaaagctggcctgctgtaagagatagactaagaaaaactgagccagcagcagagg

SEQ ID NO: 191020 - DNA, 75 bp, Artificial Sequence
  Synthetic
ttggatggggtatgaactccatcctgataaatggacagtacagcctatacagctgccagacaaggacagctggac

SEQ ID NO: 191021 - DNA, 75 bp, Artificial Sequence
  Synthetic
aacacggaactaaaagataagaaacataaagagtatgcacttttttataaacttgatatagtaccacttgatggc

SEQ ID NO: 191022 - DNA, 75 bp, Artificial Sequence
  Synthetic
catttaaaaatctaaaaacaggaaagtatgcaaaaatgaggtctgcccacactaatgatgtaaaacaattaacag

SEQ ID NO: 191023 - DNA, 75 bp, Artificial Sequence
  Synthetic
aaatctcacaaaaccagcaggaaaagaatgaacaagacttattatcaatggacaaatggtcaagcctatggaatt

SEQ ID NO: 191024 - DNA, 75 bp, Artificial Sequence
  Synthetic
aaatctcacaaaaccagcaggaaaagaatgaacaagacttattatcattggacaaatggtcaagcctatggaatt

SEQ ID NO: 191025 - DNA, 75 bp, Artificial Sequence
  Synthetic
aaatctcacaaaaccagcaggaaaagaatgaacaagacttattatcactggacaaatggtcaagcctatggaatt

SEQ ID NO: 191026 - DNA, 75 bp, Artificial Sequence
  Synthetic
aaatctcacaaaaccagcaggaaaagaatgaacaagacttattatcagtggacaaatggtcaagcctatggaatt

SEQ ID NO: 191027 - DNA, 75 bp, Artificial Sequence
  Synthetic
atgagcccctcccacaaatacaagaggagggtacacatataggaccagggcgagcactctttacaacagatataa

SEQ ID NO: 191028 - DNA, 75 bp, Artificial Sequence
  Synthetic
cattaggaccagcagctacactagaagaaatgatgacagcatgtcaagaagtaagaagacccggccataaagcaa

SEQ ID NO: 191029 - DNA, 75 bp, Artificial Sequence
  Synthetic
ggagggtacacatataggaccagggcgagcactctttacaacagatataataggagatataagccaagcacactg

SEQ ID NO: 191030 - DNA, 75 bp, Artificial Sequence
  Synthetic
acaagaaaaagtgtaaggataggaccaggacaagcattctatgcaacaggagacataataggagacataagaaaa

SEQ ID NO: 191031 - DNA, 75 bp, Artificial Sequence
  Synthetic
gaagacaaaagagaatagataggttaattgatagaataagagatagagcagaagacagtggcaatgagagtgaag

SEQ ID NO: 191032 - DNA, 75 bp, Artificial Sequence
  Synthetic
aaatagtgttaggcagggatactcacctttgtcgtttcagacccttaccccgaacgcgcggagacccgacaggcc

SEQ ID NO: 191033 - DNA, 75 bp, Artificial Sequence
  Synthetic
gagacttactcttgattgtagcgaggactgtggaacttctggggagaagggggtgggaagccctcaaatatctgt

SEQ ID NO: 191034 - DNA, 75 bp, Artificial Sequence
  Synthetic
accatcacactcctatgcaggataaaacaaattataaacacatggcaggaggtaggacgggcaatatacgcccct

SEQ ID NO: 191035 - DNA, 75 bp, Artificial Sequence
  Synthetic
gctataacaatgggaggcagatggtcaaaaagtagtatagtgggatggcctagaataagggaaagaataaggcgc

SEQ ID NO: 191036 - DNA, 75 bp, Artificial Sequence
  Synthetic
gctataacaatgggaggcagatggtcaaaaagtagtatagtgggatggcctagtataagggaaagaataaggcgc

SEQ ID NO: 191037 - DNA, 75 bp, Artificial Sequence
  Synthetic
gctataacaatgggaggcagatggtcaaaaagtagtatagtgggatggcctagcataagggaaagaataaggcgc

SEQ ID NO: 191038 - DNA, 75 bp, Artificial Sequence
  Synthetic
gctataacaatgggaggcagatggtcaaaaagtagtatagtgggatggcctaggataagggaaagaataaggcgc

SEQ ID NO: 191039 - DNA, 75 bp, Artificial Sequence
  Synthetic
gctataactatgggaggcagatggtcaaaaagtagtatagtgggatggcctagaataagggaaagaataaggcgc

SEQ ID NO: 191040 - DNA, 75 bp, Artificial Sequence
  Synthetic
gctataactatgggaggcagatggtcaaaaagtagtatagtgggatggcctagtataagggaaagaataaggcgc

SEQ ID NO: 191041 - DNA, 75 bp, Artificial Sequence
  Synthetic
gctataactatgggaggcagatggtcaaaaagtagtatagtgggatggcctagcataagggaaagaataaggcgc

SEQ ID NO: 191042 - DNA, 75 bp, Artificial Sequence
  Synthetic
gctataactatgggaggcagatggtcaaaaagtagtatagtgggatggcctaggataagggaaagaataaggcgc

SEQ ID NO: 191043 - DNA, 75 bp, Artificial Sequence
  Synthetic
gctataaccatgggaggcagatggtcaaaaagtagtatagtgggatggcctagaataagggaaagaataaggcgc

SEQ ID NO: 191044 - DNA, 75 bp, Artificial Sequence
  Synthetic
gctataaccatgggaggcagatggtcaaaaagtagtatagtgggatggcctagtataagggaaagaataaggcgc

SEQ ID NO: 191045 - DNA, 75 bp, Artificial Sequence
  Synthetic
gctataaccatgggaggcagatggtcaaaaagtagtatagtgggatggcctagcataagggaaagaataaggcgc

SEQ ID NO: 191046 - DNA, 75 bp, Artificial Sequence
  Synthetic
gctataaccatgggaggcagatggtcaaaaagtagtatagtgggatggcctaggataagggaaagaataaggcgc

SEQ ID NO: 191047 - DNA, 75 bp, Artificial Sequence
  Synthetic
gctataacgatgggaggcagatggtcaaaaagtagtatagtgggatggcctagaataagggaaagaataaggcgc

SEQ ID NO: 191048 - DNA, 75 bp, Artificial Sequence
  Synthetic
gctataacgatgggaggcagatggtcaaaaagtagtatagtgggatggcctagtataagggaaagaataaggcgc

SEQ ID NO: 191049 - DNA, 75 bp, Artificial Sequence
  Synthetic
gctataacgatgggaggcagatggtcaaaaagtagtatagtgggatggcctagcataagggaaagaataaggcgc

SEQ ID NO: 191050 - DNA, 75 bp, Artificial Sequence
  Synthetic
gctataacgatgggaggcagatggtcaaaaagtagtatagtgggatggcctaggataagggaaagaataaggcgc

SEQ ID NO: 191051 - DNA, 75 bp, Artificial Sequence
  Synthetic
attgtgccaatgttaatttgaccaatgcagccaatgtctctaacataataggaaatataacagaggaagtaagaa

SEQ ID NO: 191052 - DNA, 75 bp, Artificial Sequence
  Synthetic
cctggctagaagcacaagaggaagaagaggaagtaggctttccagtcagacctcaggtacctttaagaccaatga

SEQ ID NO: 191053 - DNA, 75 bp, Artificial Sequence
  Synthetic
agaggaagtaggctttccagtcagacctcaggtacctttaagaccaatgacctataagggagctttggatctcag

SEQ ID NO: 191054 - DNA, 75 bp, Artificial Sequence
  Synthetic
aacagctccaggcaagagtcctggctgtggaaagctacctaagggatcaacagctcctaggaatttggggttgct

SEQ ID NO: 191055 - DNA, 75 bp, Artificial Sequence
  Synthetic
agctgaacatcttaagacagcagtacaaatggcagtattcatccacaattttaaaagaaaaggggggattggggg

SEQ ID NO: 191056 - DNA, 75 bp, Artificial Sequence
  Synthetic
caccttaataaatctgtagaaatcaattgtaccagaccctccaacaatacaagaacaagtataaatataggacca

SEQ ID NO: 191057 - DNA, 75 bp, Artificial Sequence
  Synthetic
atataggaccaggacaagcgttctatgcaacagatgacatagtaggagacataagaaaagcattttgtgaggtta

SEQ ID NO: 191058 - DNA, 75 bp, Artificial Sequence
  Synthetic
tcatcaaaatcctataccaaagcagtaagtatatgtaatgctgaatttattagaaagagtagattacagagtagg

SEQ ID NO: 191059 - DNA, 75 bp, Artificial Sequence
  Synthetic
catcgaaaaatagatgtgaaagacaccaaggaggctttagataagatagaggaaatacaaaacaaaagtcagcaa

SEQ ID NO: 191060 - DNA, 75 bp, Artificial Sequence
  Synthetic
ctcaaagaaagccaaaagatggttttatagacatcactttgaaagcaggcatccaagagtaagttcagaagtaca

SEQ ID NO: 191061 - DNA, 75 bp, Artificial Sequence
  Synthetic
ggccagagccaacagccccaccagcagagagcttcgggttcggagaggagataaccccctctccgaagcaggagc

SEQ ID NO: 191062 - DNA, 75 bp, Artificial Sequence
  Synthetic
caagggcagatggtacaccaggccatatcacctaggaccttaaatgcatgggtaaaagtagtagaagaaaaggct

SEQ ID NO: 191063 - DNA, 75 bp, Artificial Sequence
  Synthetic
gatacactggaaaagccagacatgagaaattgctctttcaatgtaacaacagaaataagagataaacagcgcaaa

SEQ ID NO: 191064 - DNA, 75 bp, Artificial Sequence
  Synthetic
gctataataagaatattgcaacaactactgtttatccatttcagaattgggtgtcagcatagcagaataggcatt

SEQ ID NO: 191065 - DNA, 75 bp, Artificial Sequence
  Synthetic
tgtaccagagcagtaagtattgttaagtagtatatgtaatgtctgatttgttagcattaggcatagcagcattaa

SEQ ID NO: 191066 - DNA, 75 bp, Artificial Sequence
  Synthetic
taaagccacctttgcctagtgttaggaagctgacagaggatagatggaacaagccccagaggaccaagggccaca

SEQ ID NO: 191067 - DNA, 75 bp, Artificial Sequence
  Synthetic
accatcctcaggaggggacccagaaattacaacacatagctttaattgtggaggagaatttttctattgcaatac

SEQ ID NO: 191068 - DNA, 75 bp, Artificial Sequence
  Synthetic
gatttggctaagcatggggcaattacaagcagcaacactgcctctactaatcctgactgtgcctggctggaagca

SEQ ID NO: 191069 - DNA, 75 bp, Artificial Sequence
  Synthetic
caagcagcaacactgcctctactaatcctgactgtgcctggctggaagcacaagaagacgaggatgtagggtttc

SEQ ID NO: 191070 - DNA, 75 bp, Artificial Sequence
  Synthetic
acagcaccctgaaggaagacccaggggcaatacaaaactgctctttcaatatgaccacagaaataagagataagc

SEQ ID NO: 191071 - DNA, 75 bp, Artificial Sequence
  Synthetic
taatttgaatgccactaagttaaacattactactactaccaataatagtagttgggaggaggagttaggaatgac

SEQ ID NO: 191072 - DNA, 75 bp, Artificial Sequence
  Synthetic
tttatgcaacaggagacataataggagacatcagaaaggcacattgtaatgttagtggagaacaatggaataaaa

SEQ ID NO: 191073 - DNA, 75 bp, Artificial Sequence
  Synthetic
aaatctgtggagttggtttgacataacaagttggctatggtatataagaatattcataatgatagtaggaggctt

SEQ ID NO: 191074 - DNA, 75 bp, Artificial Sequence
  Synthetic
ttcatagcagccatagttgtgtggaccatagtatttatagaatatagaaaaataagaaaacagaaaaaaatagaa

SEQ ID NO: 191075 - DNA, 75 bp, Artificial Sequence
  Synthetic
ttccttgggttcttgggagcagcaggaagcactatgggcgcggcgtcaataacgctgacggtacaggccagacaa

SEQ ID NO: 191076 - DNA, 75 bp, Artificial Sequence
  Synthetic
tagtaggatggcctgaggtgagagaaagactaaggagaactcagccagcagcagaggaagtaagagcagcagagg

SEQ ID NO: 191077 - DNA, 75 bp, Artificial Sequence
  Synthetic
ggaattaggccagtagtgtcaactcaactgctgttaaatggcagtttagcagaagaagaggtagtaattagatct

SEQ ID NO: 191078 - DNA, 75 bp, Artificial Sequence
  Synthetic
agatgcatgaagatataatcagtctatgggaccaaagcctaaagccatgtgtaaagttaacccctctctgcgtta

SEQ ID NO: 191079 - DNA, 75 bp, Artificial Sequence
  Synthetic
accttatgaatgctagcataaagggagaaatgaaaaactgctctttcaatataaccacagaaataagagataaga

SEQ ID NO: 191080 - DNA, 75 bp, Artificial Sequence
  Synthetic
gggctttggggctgctctggaaaactcatctgtaccactgatgtgccctggaactctagttggagtaataaaact

SEQ ID NO: 191081 - DNA, 75 bp, Artificial Sequence
  Synthetic
acttctagctcaagagataataagtaatgaggaaataagaaactgctctttcactatgaccacagcactaagaga

SEQ ID NO: 191082 - DNA, 75 bp, Artificial Sequence
  Synthetic
acttcttgctcaagagataataagtaatgaggaaataagaaactgctctttcactatgaccacagcactaagaga

SEQ ID NO: 191083 - DNA, 75 bp, Artificial Sequence
  Synthetic
acttctcgctcaagagataataagtaatgaggaaataagaaactgctctttcactatgaccacagcactaagaga

SEQ ID NO: 191084 - DNA, 75 bp, Artificial Sequence
  Synthetic
acttctggctcaagagataataagtaatgaggaaataagaaactgctctttcactatgaccacagcactaagaga

SEQ ID NO: 191085 - DNA, 75 bp, Artificial Sequence
  Synthetic
ggcaagtcagatttacccagggattaaagtaaagcaactgtgtaaactccttaggggagccaaagcactaacaga

SEQ ID NO: 191086 - DNA, 75 bp, Artificial Sequence
  Synthetic
gtaaaagtagggggacagctaatagaagccctattagacacaggagcagatgatacagtattagaagaaatagat

SEQ ID NO: 191087 - DNA, 75 bp, Artificial Sequence
  Synthetic
agcatccaggaagtcagcctaagactgcttgtaccaattgctattgtaaaaagtgttgctttcattgccaagttt

SEQ ID NO: 191088 - DNA, 75 bp, Artificial Sequence
  Synthetic
agacaaagtacaaggataggacctgggcaagtattctatacacatagcataataggagacataagacaagcatat

SEQ ID NO: 191089 - DNA, 75 bp, Artificial Sequence
  Synthetic
aatacaagacaaggtgtacatataggaccaggagcagtattctatagaacaggtgatataataggggatataaga

SEQ ID NO: 191090 - DNA, 75 bp, Artificial Sequence
  Synthetic
taccgccacttgagagacttcatattacttgctgtgaggattgtggacaggggactgaagagagggtgggaagtc

SEQ ID NO: 191091 - DNA, 75 bp, Artificial Sequence
  Synthetic
tcaacataattggacgaaatatgttgactcagattggttgtactttaaatttcccaattagtcctattgacactg

SEQ ID NO: 191092 - DNA, 75 bp, Artificial Sequence
  Synthetic
gtcagattcatcaagttcctgtaccaaagcagtaagtaatacatgtaatgtaccctttacaaatattagcaatag

SEQ ID NO: 191093 - DNA, 75 bp, Artificial Sequence
  Synthetic
cagatagagttatagaaaccttgcaaagagctggtagagctgtgcgcaacatacctagaagagtaagacagggct

SEQ ID NO: 191094 - DNA, 75 bp, Artificial Sequence
  Synthetic
tgttaatggtaccaatgttacctatgataaggccatgggtgaaggaataaaatattgctctttcaacatgaccac

SEQ ID NO: 191095 - DNA, 75 bp, Artificial Sequence
  Synthetic
acaattgtaaaagataaggtaaagaaacaatatgcacttttttatagtcttgatgtaataccattagatgataat

SEQ ID NO: 191096 - DNA, 75 bp, Artificial Sequence
  Synthetic
ccatatcacctagaactttaaatgcatgggtaaaagtaatagaagagaaggctttcagcccggaagtaataccca

SEQ ID NO: 191097 - DNA, 75 bp, Artificial Sequence
  Synthetic
aaaacaggaaaatatgccagaaaaaggtctgctcacactaatgatgtaagacaattaacagaagtggtgcaaaaa

SEQ ID NO: 191098 - DNA, 75 bp, Artificial Sequence
  Synthetic
tagtatgggcaagcagggaactagaacgattcgcagttaatcctggcctgttagaaacagcagaaggatgtagac

SEQ ID NO: 191099 - DNA, 75 bp, Artificial Sequence
  Synthetic
cctgcaagtttgcaagatcatcaaaattctatatcaaagcagtaagtattatcataaatgtatatattaggatta

SEQ ID NO: 191100 - DNA, 75 bp, Artificial Sequence
  Synthetic
tatatgttgataaattgtaacacctcagtcattacacaggcctgtccaaagatatcctttgaaccaattcccata

SEQ ID NO: 191101 - DNA, 75 bp, Artificial Sequence
  Synthetic
aggtaggttttccagtcaaacctcaggtacctttaagaccaatgacttacaaggcagctgtagatcttagccact

SEQ ID NO: 191102 - DNA, 75 bp, Artificial Sequence
  Synthetic
gtctcaagggactgagactagggtgggagggcctcaaatatctggggaatcttctgtcatattgggttcgggaac

SEQ ID NO: 191103 - DNA, 75 bp, Artificial Sequence
  Synthetic
tagtgcagaaccttcaggggcaaatggtacatcaggccctatcacctagaactttaaatgcatgggtaaaagtag

SEQ ID NO: 191104 - DNA, 75 bp, Artificial Sequence
  Synthetic
tatccacatacctagaagaatcagacaaggcttagaaaggcttttgctctaaaatgggtggcaaattgtcaaaaa

SEQ ID NO: 191105 - DNA, 75 bp, Artificial Sequence
  Synthetic
gtaaaatagtgggatggtctagggtaagagaaagaatgcaaaaaactgagccagcagctgagccagcagcagaag

SEQ ID NO: 191106 - DNA, 75 bp, Artificial Sequence
  Synthetic
aaactgtactaatgtcagaaacaatacctctaacagcactagcagtatggaggcaggaggggaactaacaaattg

SEQ ID NO: 191107 - DNA, 75 bp, Artificial Sequence
  Synthetic
atggaattagaccagtggtatcaactcaactgctattaaatggaagcctagcagaagaacagatcataattagaa

SEQ ID NO: 191108 - DNA, 75 bp, Artificial Sequence
  Synthetic
cgaagatctcctcaaagcaataaggatcatcaaaatcctgtacaaaagcagtaagtagcagtaaatagtatatgt

SEQ ID NO: 191109 - DNA, 75 bp, Artificial Sequence
  Synthetic
aagctttaagccaaactcaggaggggacatggaagttagaacacatagttttaattgtagaggagaatttttcta

SEQ ID NO: 191110 - DNA, 75 bp, Artificial Sequence
  Synthetic
ggcaaatttgtggaattggtttgacatatcacgatggctgtggtacataaaaatattcataatgatagtaggagg

SEQ ID NO: 191111 - DNA, 75 bp, Artificial Sequence
  Synthetic
gaaatagtacaaagagttgttagagctattctccacatacctagaaggataagacaaggtttagaactttctttg

SEQ ID NO: 191112 - DNA, 75 bp, Artificial Sequence
  Synthetic
ctttcaatatgactacagagttaagggataagaaacagcaggtgtattcacttttttatagacttgatatagtac

SEQ ID NO: 191113 - DNA, 75 bp, Artificial Sequence
  Synthetic
agccccagaagaccaggggccacagagggagccgttcaatgaatggacactagaactgttagaagagcttaaaca

SEQ ID NO: 191114 - DNA, 75 bp, Artificial Sequence
  Synthetic
tcctgacaaatggacagtgcagcctatacaattgccagacaaggacagctggactgtcaatgatatacagaagtt

SEQ ID NO: 191115 - DNA, 75 bp, Artificial Sequence
  Synthetic
gtgtacgtataggaccaggacaagcattctatgcaacaggtgaggtaacaggagacataagaaaagcattttgtg

SEQ ID NO: 191116 - DNA, 75 bp, Artificial Sequence
  Synthetic
aaagaaaaggggggattggggggtacagtgcaggggaaagaataatagacataatagcaacagacatacaaacta

SEQ ID NO: 191117 - DNA, 75 bp, Artificial Sequence
  Synthetic
gattcctgaatgggagtttgtcaataccccccctctagtaaaactatggtatcagttagaaacagagcccatagc

SEQ ID NO: 191118 - DNA, 75 bp, Artificial Sequence
  Synthetic
caaattacactctcccatgcagaataaagcaaattgtaaggatgtggcagaaaataggacaagcaatgtatgccc

SEQ ID NO: 191119 - DNA, 75 bp, Artificial Sequence
  Synthetic
tattgatttgcttaacaccacagcaatagcagtagctgagggaacagatgggattatagtaatagtgcaaagagc

SEQ ID NO: 191120 - DNA, 75 bp, Artificial Sequence
  Synthetic
ggattatagtaatagtgcaaagagcttggagagctattctccacatacctagaagaataagacagggctttgaaa

SEQ ID NO: 191121 - DNA, 75 bp, Artificial Sequence
  Synthetic
aaatggacagtacagcctatacagctgccagaaaaggatagctggactgtcaatgatatacagaagttagtggga

SEQ ID NO: 191122 - DNA, 75 bp, Artificial Sequence
  Synthetic
ggaaaaaatgacagatatagaaaatataacagagataggaaatataacagatgaggtaagaaactgttcttttaa

SEQ ID NO: 191123 - DNA, 75 bp, Artificial Sequence
  Synthetic
caggcaagagtcctggctgtggaaagatacctaaaggatcaacagctcctaggaatttggggctgctctggaaaa

SEQ ID NO: 191124 - DNA, 75 bp, Artificial Sequence
  Synthetic
tgtacgaggaaataaaaaactgctctttcaatacgaccacagtactaagagataagacacggaaagagtatgcac

SEQ ID NO: 191125 - DNA, 75 bp, Artificial Sequence
  Synthetic
agcagaagttatcccagcagaaacaggacaagaaacagcatactatatactaaaattagcaggaagatggccagt

SEQ ID NO: 191126 - DNA, 75 bp, Artificial Sequence
  Synthetic
cagcaggaaaagaatgaacaagatttattggcattggacaagtgggcaaatctgtggaattggtttgacatatca

SEQ ID NO: 191127 - DNA, 75 bp, Artificial Sequence
  Synthetic
cttttagaaacatcagaaggatgtcaacaaataatggaacagttacaaccagctctcaagacaggatcagaagaa

SEQ ID NO: 191128 - DNA, 75 bp, Artificial Sequence
  Synthetic
tcaaagcagtaagtatatgtaatgctggatttattagaaagagtagattatagaataggagtaggagcattcata

SEQ ID NO: 191129 - DNA, 75 bp, Artificial Sequence
  Synthetic
cccacactaatgatgtaaaacaattaacagaggcagtgcaaaaaatagcccaagaaagcatagtgatatggggaa

SEQ ID NO: 191130 - DNA, 75 bp, Artificial Sequence
  Synthetic
acaacaatgagtcctaataatattagcagtaatgttaaagaaatgaaaaactgcactttcaatacaaccacagaa

SEQ ID NO: 191131 - DNA, 75 bp, Artificial Sequence
  Synthetic
gttcctaggactttggggctgctctggaaaaatcatctgcaccactgctgtgccctggaactccacttggagtaa

SEQ ID NO: 191132 - DNA, 75 bp, Artificial Sequence
  Synthetic
atagtgcagaatcttcaagggcaaatggtacaccaggccatatcacctagaactttgaatgcatgggtaaaagta

SEQ ID NO: 191133 - DNA, 75 bp, Artificial Sequence
  Synthetic
ggaacaacccccagaagaccaggggccgcagagggaaccatataatgaatggacactagagattctagaggatct

SEQ ID NO: 191134 - DNA, 75 bp, Artificial Sequence
  Synthetic
ataatagtaatagttgtgtggactatagtatatatagaatataggaaactggtaaggcaaagaaaaataaatagg

SEQ ID NO: 191135 - DNA, 75 bp, Artificial Sequence
  Synthetic
ggtaaggcaaagaaaaataaataggttatatgaaagaataagagaaagagcagaagacagtggcaatgagagtga

SEQ ID NO: 191136 - DNA, 75 bp, Artificial Sequence
  Synthetic
gggactgagacgggggtgggaaggcctcaaatatctggggaatcttctgttatattggggtcaggaactaaaaat

SEQ ID NO: 191137 - DNA, 75 bp, Artificial Sequence
  Synthetic
taatgttagctcgaatagtgataacaatactaggggagaaataaggaattgcacttttaatatgaccacagagct

SEQ ID NO: 191138 - DNA, 75 bp, Artificial Sequence
  Synthetic
aatgtatgcccctcccattgcaggaaacataacatgtagatcaaatatcacaggactactattagtacgtgatgg

SEQ ID NO: 191139 - DNA, 75 bp, Artificial Sequence
  Synthetic
tttcagagagctcaataaaagaactcaggacttctgggaagttcaattaggaataccgcatccagcaggtttaaa

SEQ ID NO: 191140 - DNA, 75 bp, Artificial Sequence
  Synthetic
tagaatatagaaaattggtaaaacaaagaaaaatagactggttaattgaaagaattagggaaagagcagaagaca

SEQ ID NO: 191141 - DNA, 75 bp, Artificial Sequence
  Synthetic
ttagggaaagaataagacaaactcctccaacacaagcagcaaagggagtaggagcagcatctcaagatttagata

SEQ ID NO: 191142 - DNA, 75 bp, Artificial Sequence
  Synthetic
agccagaaattgcagggcccctaggaaaaagggctgttggaaatgtggaaaggaaggacaccaaatgaaagactg

SEQ ID NO: 191143 - DNA, 75 bp, Artificial Sequence
  Synthetic
tgagagacaggctaattttttagggagaatttggccttcccacaaggggaggccaggaaatttccctcagagcag

SEQ ID NO: 191144 - DNA, 75 bp, Artificial Sequence
  Synthetic
cattattgtgctccagctggttatgcgattctaaagtgtaaagataaaaagttcaatgggacagggccatgcaag

SEQ ID NO: 191145 - DNA, 75 bp, Artificial Sequence
  Synthetic
atgttaatggtactgatatccataataatagcatgaatggagaaatgaaaaattgctcttttaatataaccacag

SEQ ID NO: 191146 - DNA, 75 bp, Artificial Sequence
  Synthetic
atgctaaaaccataatagtacagctgaatgaacctgtaaaaattaattgtacaagacccaacaacaatacaagaa

SEQ ID NO: 191147 - DNA, 75 bp, Artificial Sequence
  Synthetic
gaattagtgagaaggagaaaggagaaatgaaaaactgctctttcaatgttaccacaaacataagagataagataa

SEQ ID NO: 191148 - DNA, 75 bp, Artificial Sequence
  Synthetic
gtattagtgagaaggagaaaggagaaatgaaaaactgctctttcaatgttaccacaaacataagagataagataa

SEQ ID NO: 191149 - DNA, 75 bp, Artificial Sequence
  Synthetic
gcattagtgagaaggagaaaggagaaatgaaaaactgctctttcaatgttaccacaaacataagagataagataa

SEQ ID NO: 191150 - DNA, 75 bp, Artificial Sequence
  Synthetic
ggattagtgagaaggagaaaggagaaatgaaaaactgctctttcaatgttaccacaaacataagagataagataa

SEQ ID NO: 191151 - DNA, 75 bp, Artificial Sequence
  Synthetic
acctttaggaccaggacaagcattttatacaacaggaaaaataataggagacatcagaaaagcacattgcaacgt

SEQ ID NO: 191152 - DNA, 75 bp, Artificial Sequence
  Synthetic
acctttaggaccaggacaagcattttatacaacaggaaaaataataggagacatcagaaatgcacattgcaacgt

SEQ ID NO: 191153 - DNA, 75 bp, Artificial Sequence
  Synthetic
acctttaggaccaggacaagcattttatacaacaggaaaaataataggagacatcagaaacgcacattgcaacgt

SEQ ID NO: 191154 - DNA, 75 bp, Artificial Sequence
  Synthetic
acctttaggaccaggacaagcattttatacaacaggaaaaataataggagacatcagaaaggcacattgcaacgt

SEQ ID NO: 191155 - DNA, 75 bp, Artificial Sequence
  Synthetic
aggtgaaggggcagtagtaatacaagataacagtgacataaaggtagtaccaaggaggaaagtaaagatcattaa

SEQ ID NO: 191156 - DNA, 75 bp, Artificial Sequence
  Synthetic
tcagcggattcttagcgattgcctgggacgatctgcggagcctgtgccttttcagctaccaccgattgagagact

SEQ ID NO: 191157 - DNA, 75 bp, Artificial Sequence
  Synthetic
ggcttaggcatctcctatggcaggaagaagcggagacagcgacgaggaacttctcagagccatcaggatcatcaa

SEQ ID NO: 191158 - DNA, 75 bp, Artificial Sequence
  Synthetic
ggacgagcaatgtatgcccctcccgttgcaggaaacattacctgtaactcaaatattacaggtctactattgaca

SEQ ID NO: 191159 - DNA, 75 bp, Artificial Sequence
  Synthetic
agctgcaatagtaggactagtagtagcattcatagcagccataattgtgtggaccatagtgtatatagaatatag

SEQ ID NO: 191160 - DNA, 75 bp, Artificial Sequence
  Synthetic
ggaccatagtgtatatagaatataggaaaataagaaaacagaaaaaaatagaaaagttacttgatagaataagag

SEQ ID NO: 191161 - DNA, 75 bp, Artificial Sequence
  Synthetic
cgcaacctacctagaagaataagacagggttttgaagcagctttgctataaaatggggagcaaatggtcaaaaag

SEQ ID NO: 191162 - DNA, 75 bp, Artificial Sequence
  Synthetic
agaaatggtaaagaggaaattagaagaacacttccctaataaaacaataacatttaatcaatcttcaggagggga

SEQ ID NO: 191163 - DNA, 75 bp, Artificial Sequence
  Synthetic
gagagacaggctaattttttaggcaggatttggccttcccacaagggaaggccgggaaactttcctcagagcaga

SEQ ID NO: 191164 - DNA, 75 bp, Artificial Sequence
  Synthetic
tgacataaagcaccacccaaatggaaacatatctgtagctcaagaggaaataagaaactgctctttcaatgtaac

SEQ ID NO: 191165 - DNA, 75 bp, Artificial Sequence
  Synthetic
tgacataaagcaccacccaaatggaaacatatctgtagctcaagaggaaataagaaactgctctttcaatgttac

SEQ ID NO: 191166 - DNA, 75 bp, Artificial Sequence
  Synthetic
tgacataaagcaccacccaaatggaaacatatctgtagctcaagaggaaataagaaactgctctttcaatgtcac

SEQ ID NO: 191167 - DNA, 75 bp, Artificial Sequence
  Synthetic
tgacataaagcaccacccaaatggaaacatatctgtagctcaagaggaaataagaaactgctctttcaatgtgac

SEQ ID NO: 191168 - DNA, 75 bp, Artificial Sequence
  Synthetic
agtggtggagagagaaaaaagagcagtgggaataggagctgtgttccttgggttcttgggagcagcaggaagcac

SEQ ID NO: 191169 - DNA, 75 bp, Artificial Sequence
  Synthetic
catcctcctttagtttccctcaaatcactctttggcaacgaccccttgtcgcagtaaaaataggaggacagctga

SEQ ID NO: 191170 - DNA, 75 bp, Artificial Sequence
  Synthetic
aatacctcaaccattacacaggcttgtccaaaggtcacctttgagccaattcccatacattattgtgccccagct

SEQ ID NO: 191171 - DNA, 75 bp, Artificial Sequence
  Synthetic
gatctaccaatatatggatgatttatatgtaggatctgacttagagatagggcagcatagagcaaaaatagagga

SEQ ID NO: 191172 - DNA, 75 bp, Artificial Sequence
  Synthetic
gcgcagtggatggcctgctataagagaaagaatgagacgagctgagccagcagcagaaccagcagcagaaagagt

SEQ ID NO: 191173 - DNA, 75 bp, Artificial Sequence
  Synthetic
agtagtagctgaggggacagatagagttatagaagctttgcaaagagctggtagagctgttctcaacatacctag

SEQ ID NO: 191174 - DNA, 75 bp, Artificial Sequence
  Synthetic
cggagacgactataactcttccctgcagaataaaacaaattgtaaacatgtggcagagagtaggacaggcaatgt

SEQ ID NO: 191175 - DNA, 75 bp, Artificial Sequence
  Synthetic
aggaaaatagacaggttaattgatagaataagagaaagagcagaagacagtggcaatgagagtgatggggatcag

SEQ ID NO: 191176 - DNA, 75 bp, Artificial Sequence
  Synthetic
cggcgactggtgagtacgccaattttgactagcggaggctagaaggagagagatgggtgcgagagcgtcagtatt

SEQ ID NO: 191177 - DNA, 75 bp, Artificial Sequence
  Synthetic
gggcaagtggtcaaaacgtaaggttaactggcctcaggtaagggaaagaatggaaagaactgagccagcagcaga

SEQ ID NO: 191178 - DNA, 75 bp, Artificial Sequence
  Synthetic
gggcaagtggtcaaaacgtaaggtttactggcctcaggtaagggaaagaatggaaagaactgagccagcagcaga

SEQ ID NO: 191179 - DNA, 75 bp, Artificial Sequence
  Synthetic
gggcaagtggtcaaaacgtaaggttcactggcctcaggtaagggaaagaatggaaagaactgagccagcagcaga

SEQ ID NO: 191180 - DNA, 75 bp, Artificial Sequence
  Synthetic
gggcaagtggtcaaaacgtaaggttgactggcctcaggtaagggaaagaatggaaagaactgagccagcagcaga

SEQ ID NO: 191181 - DNA, 75 bp, Artificial Sequence
  Synthetic
ttagatcattatataatacaatagcagtcctctattatgtacatcaaaaggtagaggtaaaagacaccaaggaag

SEQ ID NO: 191182 - DNA, 75 bp, Artificial Sequence
  Synthetic
aaatcattatataatacagtagcaaccctctattgtgtacatcaaaagatagaggtaaaagacaccaaggaagct

SEQ ID NO: 191183 - DNA, 75 bp, Artificial Sequence
  Synthetic
aaaatgctctttccaacctagaagagaaaagggggtaaaagaatatgcactttttcgtaaacttgatttagaact

SEQ ID NO: 191184 - DNA, 75 bp, Artificial Sequence
  Synthetic
aaccatcctcaggaggggacctagaaattacaacacatacctttaattgtagaggagaatttttctattgcaata

SEQ ID NO: 191185 - DNA, 75 bp, Artificial Sequence
  Synthetic
tcttataccaaagcagtaagtataatttaagtaaggtctgtaatgcaatctttagaaatagcaagcatagtagga

SEQ ID NO: 191186 - DNA, 75 bp, Artificial Sequence
  Synthetic
catacatatgggaccagggagagcattttatacaacaggagaggtaacaggagatataagaaaagcacattgtaa

SEQ ID NO: 191187 - DNA, 75 bp, Artificial Sequence
  Synthetic
aacaacaatacaataaaaggcatacatatgggaccaggcaaagcattctatacaacaggacagatagtaggagat

SEQ ID NO: 191188 - DNA, 75 bp, Artificial Sequence
  Synthetic
atatgggaccaggcaaagcattctatacaacaggacagatagtaggagatattagaaaagcatactgtaacatta

SEQ ID NO: 191189 - DNA, 75 bp, Artificial Sequence
  Synthetic
tgagaggagaaatgaaaaactgctcttacaatatgaccacagaaatgagagataaaaaacagaaagtatattcac

SEQ ID NO: 191190 - DNA, 75 bp, Artificial Sequence
  Synthetic
ccatgcagaataaaacaaattataaacatgtggcagagagtaggaaaagcaatgtatgcccctcccattgaagga

SEQ ID NO: 191191 - DNA, 75 bp, Artificial Sequence
  Synthetic
agaactgagccagcagcagaaggggtaggaccagtatctcgagacctggaaaaacacggggcagtcacaagtagc

SEQ ID NO: 191192 - DNA, 75 bp, Artificial Sequence
  Synthetic
cactttaaactgtaacaatgttaccacctacaatggtacctacagtgatggaatgaaaagttgctctttcaatat

SEQ ID NO: 191193 - DNA, 75 bp, Artificial Sequence
  Synthetic
ggtatagtgcaacagcagaacaatctgctgagggctattgaggcgcaacaacatctgttgcaactcacagtctgg

SEQ ID NO: 191194 - DNA, 75 bp, Artificial Sequence
  Synthetic
ggaatttttctactgtaatacatcaggcctgtttaacagcacttggaggccaaacgacatgcagtggtcaaatga

SEQ ID NO: 191195 - DNA, 75 bp, Artificial Sequence
  Synthetic
aatatcaccgagagcatgagaggagaaataaaaaactgctctttcaatgtgaccacagtattaagggataagagt

SEQ ID NO: 191196 - DNA, 75 bp, Artificial Sequence
  Synthetic
acaaaaatataagggaaggtgtgcgtataggaccaggacaagcattctttaaaatgggtggcataacaggggata

SEQ ID NO: 191197 - DNA, 75 bp, Artificial Sequence
  Synthetic
agtaataaatctcaagaactaacatatgggaaaaacatgacctggctagaatgggataaagaaattagtaattac

SEQ ID NO: 191198 - DNA, 75 bp, Artificial Sequence
  Synthetic
tataggaccaggacaagcattctttaaaatgggtggcataacaggggatataagaaaagcatattgtgagattaa

SEQ ID NO: 191199 - DNA, 75 bp, Artificial Sequence
  Synthetic
attagtctatgggaccaaagcctacaaccatgtgtaaagttaacccctctttgcgttactttaaattgtgttact

SEQ ID NO: 191200 - DNA, 75 bp, Artificial Sequence
  Synthetic
ataagacagggccttgaaattgctttgctataaaatgggtagcaagttgtcaaaaagtagtatagtaggatggcc

SEQ ID NO: 191201 - DNA, 75 bp, Artificial Sequence
  Synthetic
taagagataagaaacagaaaatgcatgcgcttttttatagacttgatatagtgccaattgagtcaagtaataata

SEQ ID NO: 191202 - DNA, 75 bp, Artificial Sequence
  Synthetic
aaaattcggttacggccagggggaaagaaaaaatatagattaaaacatatagtatgggcaagcagggagctagaa

SEQ ID NO: 191203 - DNA, 75 bp, Artificial Sequence
  Synthetic
ccttcccacaaggggaggccgggaaacttccctcagggcagactagagccgacagccccaccagcagagagcttc

SEQ ID NO: 191204 - DNA, 75 bp, Artificial Sequence
  Synthetic
gactgtggaaattctggggacacaggggggtggcagaacctcaaatatctgggggaacctttctgttatatgggt

SEQ ID NO: 191205 - DNA, 75 bp, Artificial Sequence
  Synthetic
gactgtggaaattctggggacacaggggggtggcagatcctcaaatatctgggggaacctttctgttatatgggt

SEQ ID NO: 191206 - DNA, 75 bp, Artificial Sequence
  Synthetic
gactgtggaaattctggggacacaggggggtggcagaccctcaaatatctgggggaacctttctgttatatgggt

SEQ ID NO: 191207 - DNA, 75 bp, Artificial Sequence
  Synthetic
gactgtggaaattctggggacacaggggggtggcagagcctcaaatatctgggggaacctttctgttatatgggt

SEQ ID NO: 191208 - DNA, 75 bp, Artificial Sequence
  Synthetic
atggagcagtcacaagtagcaatacaagggctaataatgctaatctcgcctggctggaagcgcaagaggaggagg

SEQ ID NO: 191209 - DNA, 75 bp, Artificial Sequence
  Synthetic
tggctggaagcgcaagaggaggaggaggaggcttttccagtcagaccgcagttacctctaagaccaatgacttat

SEQ ID NO: 191210 - DNA, 75 bp, Artificial Sequence
  Synthetic
agtttgggaacaaaacaataatctttaattcatctacaggaggggatttagaaattacaacacatagtttaaatt

SEQ ID NO: 191211 - DNA, 75 bp, Artificial Sequence
  Synthetic
tagaacagatgcatgaggatataattagtttatgggatcaaagcctaaagccatgtgtaaaattaactccactct

SEQ ID NO: 191212 - DNA, 75 bp, Artificial Sequence
  Synthetic
ataatagcaatagttgtgtggaccatagtaggcatagaatataggaaaatattaagacaaagaaaaatagacagg

SEQ ID NO: 191213 - DNA, 75 bp, Artificial Sequence
  Synthetic
gtttgctttcagacaaaaggcttaggcatttcctatggcaggaagaagcggagacagcgacgaagcgctcctccg

SEQ ID NO: 191214 - DNA, 75 bp, Artificial Sequence
  Synthetic
gactgtggaactgggaagggagggcctcaagtatctgtggaatctcctggtgtattggggtcgggaactaagaat

SEQ ID NO: 191215 - DNA, 75 bp, Artificial Sequence
  Synthetic
gggagagcattttatgcaacaggagacataataggagatataagacaagcacattgtaaccttagtagaacagaa

SEQ ID NO: 191216 - DNA, 75 bp, Artificial Sequence
  Synthetic
tttcaattgtggcaaagaaggacacatagccaaaaattgcagggcccctaggaaaaagggctgttggaaatgtgg

SEQ ID NO: 191217 - DNA, 75 bp, Artificial Sequence
  Synthetic
tatatagcttaattgaagaatcgcagaaccagcaggaaatgaatgaacaagacttattggcattggacaagtggg

SEQ ID NO: 191218 - DNA, 75 bp, Artificial Sequence
  Synthetic
aaaagataccatcaatgaggaggctgcagaatgggatagagtacatccagtacatgcagggcctattgcaccagg

SEQ ID NO: 191219 - DNA, 75 bp, Artificial Sequence
  Synthetic
taagagtagggggacagctaaaggaagctctattagatacaggagcagatgatacagtattagaagacataaatt

SEQ ID NO: 191220 - DNA, 75 bp, Artificial Sequence
  Synthetic
ttcaatacaaccacagaactaaaagataagaagcaccaagagtttgcacttttttatagacttgatatagtacca

SEQ ID NO: 191221 - DNA, 75 bp, Artificial Sequence
  Synthetic
agacagcgacgaaacactcctccaagcagtgaggatcatcaaaatcttgtatcaaagcagtaagtatatgtaatg

SEQ ID NO: 191222 - DNA, 75 bp, Artificial Sequence
  Synthetic
aatagcactaatcatagcaatagttgtgtggaccatagcatacatagaatataggaaattggtaagacaaaggaa

SEQ ID NO: 191223 - DNA, 75 bp, Artificial Sequence
  Synthetic
acatacccaggcgaataagacagggcgctgaaagggctttgttataacatgggtggcaaatggtctaaaagtagt

SEQ ID NO: 191224 - DNA, 75 bp, Artificial Sequence
  Synthetic
ttaagagaacacttccctaataaaacaatagtctttaactcatcctcaggaggggacctagaaattacaacacat

SEQ ID NO: 191225 - DNA, 75 bp, Artificial Sequence
  Synthetic
tagaaattacaacacatagctttaattgtagaggagaatttttctattgcaatacatcaaaactgtttaatagta

SEQ ID NO: 191226 - DNA, 75 bp, Artificial Sequence
  Synthetic
atactacctacaataaaagcatagatggagagtatagagaaataaaaaattgctctttcaatatgaccacagaaa

SEQ ID NO: 191227 - DNA, 75 bp, Artificial Sequence
  Synthetic
agtaaaactatggtatcagttagaaacagagcccatagcaggagcagaaaccttctatgtagatggggcatctaa

SEQ ID NO: 191228 - DNA, 75 bp, Artificial Sequence
  Synthetic
caatacaaaactgttctttctttatgaccacagaagtaagagataagaagcaaaaagtacatgctcttttttata

SEQ ID NO: 191229 - DNA, 75 bp, Artificial Sequence
  Synthetic
ttggggctgctctggaaaactcatctgcaccactaatgtgccttggaactccagttggagtaataaatctcaaca

SEQ ID NO: 191230 - DNA, 75 bp, Artificial Sequence
  Synthetic
gaaagaacccccatttctttggatggggtatgagctccatcctgacaaatggacagtgcagcctatacaactgcc

SEQ ID NO: 191231 - DNA, 75 bp, Artificial Sequence
  Synthetic
acatttaggcccaggacatgcatttcatacaacaggaaagataataggagacatcagaaaggcacattataatat

SEQ ID NO: 191232 - DNA, 75 bp, Artificial Sequence
  Synthetic
agaagaaatgatgacagcatgccagggagtgggaggacctagccataaagcaagggttttggctgaggcaatgag

SEQ ID NO: 191233 - DNA, 75 bp, Artificial Sequence
  Synthetic
agtaaaactatggtaccagttagaaacagaacccatagtaggagcagaaactttctatgtagatggggcagctaa

SEQ ID NO: 191234 - DNA, 75 bp, Artificial Sequence
  Synthetic
tacacagacacaatatacaggttgcttgaagactcacaaaaccagcaggagaaaaatgaaaaggagttattagca

SEQ ID NO: 191235 - DNA, 75 bp, Artificial Sequence
  Synthetic
attgtgtggcaggtagacaggatgaggattaacacatggaaaagtttagtaaaataccatatgcatatttcaaag

SEQ ID NO: 191236 - DNA, 75 bp, Artificial Sequence
  Synthetic
acaaagaagaatagactggttaattgaaagaattagggaaagagcagaagacagtggcaatgagagtgaggggga

SEQ ID NO: 191237 - DNA, 75 bp, Artificial Sequence
  Synthetic
atgcatatggagacatgaaaaactgctctttcaatgtaaccacaatattaagagatcagagggagaaagtatctg

SEQ ID NO: 191238 - DNA, 75 bp, Artificial Sequence
  Synthetic
cctgtcatgggtaccagcacacaaaggaattggaggaaatgaacaagtagataaattagtcagttcaggaatcag

SEQ ID NO: 191239 - DNA, 75 bp, Artificial Sequence
  Synthetic
gttcaatggaacaggaccatgtaaaaatgtcagcacagtacaatgtacacatggaattaggccagtggtgtcaac

SEQ ID NO: 191240 - DNA, 75 bp, Artificial Sequence
  Synthetic
atgttaccagtaatggtactgttaccaataatagtacagacatgagaaattgctctttcaatacaaccacagaac

SEQ ID NO: 191241 - DNA, 75 bp, Artificial Sequence
  Synthetic
ctagcagcaaaacacaactaaggacatctataggacaagggcaagcactcgttacaacaaaacaggtaacaggaa

SEQ ID NO: 191242 - DNA, 75 bp, Artificial Sequence
  Synthetic
atctataggacaagggcaagcactcgttacaacaaaacaggtaacaggaagaaaagcacaatgtacaattgatgg

SEQ ID NO: 191243 - DNA, 75 bp, Artificial Sequence
  Synthetic
aacacagtagcaactctctattgtgtacatgaaaagatagaggtacgagacaccaaggaagccttagacaagata

SEQ ID NO: 191244 - DNA, 75 bp, Artificial Sequence
  Synthetic
ttactataagatgggtggcaagtggtcaaaaagtagtaaaataggatggcctgctataagggacagaatgagaag

SEQ ID NO: 191245 - DNA, 75 bp, Artificial Sequence
  Synthetic
cctcaggtacctttaagaccaatgacttataaagcagctttagatctcagccactttttaaaagaaaagggggga

SEQ ID NO: 191246 - DNA, 75 bp, Artificial Sequence
  Synthetic
cacagtatgcattaggaatcattcaggcacaaccagacaggagtgaatcagagatagtcaatcaaataatagaac

SEQ ID NO: 191247 - DNA, 75 bp, Artificial Sequence
  Synthetic
tgggaaaaaattcggttaaggccagggggaaagaaaaaatatagattaaaacatatagtatgggcaagcagggag

SEQ ID NO: 191248 - DNA, 75 bp, Artificial Sequence
  Synthetic
taaggattctacaacaactattgtttattcatttcagaattgggtgccaccatagcagaataggtgttacgcggc

SEQ ID NO: 191249 - DNA, 75 bp, Artificial Sequence
  Synthetic
tattcatttcagaattgggtgccaccatagcagaataggtgttacgcggcagagaagagtaaggaatggacccag

SEQ ID NO: 191250 - DNA, 75 bp, Artificial Sequence
  Synthetic
gtggtagaaattaagccattaggagtagcacccactgaggcaaaaaggagagtggtggagagagaaaaaagagca

SEQ ID NO: 191251 - DNA, 75 bp, Artificial Sequence
  Synthetic
agcaatgccactaataccactgggagcaagggggaggagggagaaatgagaaactgctctttcaatatcaccacg

SEQ ID NO: 191252 - DNA, 75 bp, Artificial Sequence
  Synthetic
ttggagtaatagatcactagatgatatttgggagaacatgacgtggatgcagtgggaaaaagaaattgaaaatta

SEQ ID NO: 191253 - DNA, 75 bp, Artificial Sequence
  Synthetic
gacccaacaataatacaagaaaaaggataactatgggaccaggaagagtatattatgcaacaggaggcatagtag

SEQ ID NO: 191254 - DNA, 75 bp, Artificial Sequence
  Synthetic
tcaggatcatcaagattttataccaaagcagtaagtatcataaatgtatattttaggaataggaataggagcctt

SEQ ID NO: 191255 - DNA, 75 bp, Artificial Sequence
  Synthetic
tatcacactcccatgcaaaataaaacaaattataaacaggtggcaggaagtaggaaaagcaatgtatgcccctcc

SEQ ID NO: 191256 - DNA, 75 bp, Artificial Sequence
  Synthetic
ctcaaaatatctcagataatacaaaaaccataatagtacatctaaatgaaactgtagtaattaattgtacaagac

SEQ ID NO: 191257 - DNA, 75 bp, Artificial Sequence
  Synthetic
aagcagaagttatcccagcagaaacaggacaggagacagcatactttctgctaaaattagcaggaagatggccag

SEQ ID NO: 191258 - DNA, 75 bp, Artificial Sequence
  Synthetic
cacgagatggtggtgggaatgggtccgacaccaccgcctccttaacaccaggaggaggagatatgaggaacagtt

SEQ ID NO: 191259 - DNA, 75 bp, Artificial Sequence
  Synthetic
tgtcactttaaagtgtaaaaatattacaaatgataatactacagaaatgagaaattgctctttcaatgcaaccac

SEQ ID NO: 191260 - DNA, 75 bp, Artificial Sequence
  Synthetic
tgtcactttatagtgtaaaaatattacaaatgataatactacagaaatgagaaattgctctttcaatgcaaccac

SEQ ID NO: 191261 - DNA, 75 bp, Artificial Sequence
  Synthetic
tgtcactttacagtgtaaaaatattacaaatgataatactacagaaatgagaaattgctctttcaatgcaaccac

SEQ ID NO: 191262 - DNA, 75 bp, Artificial Sequence
  Synthetic
tgtcactttagagtgtaaaaatattacaaatgataatactacagaaatgagaaattgctctttcaatgcaaccac

SEQ ID NO: 191263 - DNA, 75 bp, Artificial Sequence
  Synthetic
ggattgtggaacttctgggacgcagggggtgggaagccctcaaatatctgtggaatctcctgaggttttggggcc

SEQ ID NO: 191264 - DNA, 75 bp, Artificial Sequence
  Synthetic
atcatcaaactcctataccaaagcagtaagtattgagtaactactataggtaatggtgccgttgactcctctgca

SEQ ID NO: 191265 - DNA, 75 bp, Artificial Sequence
  Synthetic
aggtatccttcacatacccagaagaataagacagggcttagagagggctttgctataaaatgggtggcaaattga

SEQ ID NO: 191266 - DNA, 75 bp, Artificial Sequence
  Synthetic
cagccaatcatacagacacaaccaataataccagtatacaacctagtcagcccagtgcaaactgctctttcaatg

SEQ ID NO: 191267 - DNA, 75 bp, Artificial Sequence
  Synthetic
tgaagtaagggaaagaataagaagaactgaggcagcagcagaaggggtaggagcagtatctaaagacctagaaaa

SEQ ID NO: 191268 - DNA, 75 bp, Artificial Sequence
  Synthetic
ccaacaataatacaaggaaaagtataaggataggaccaggacaagcattctatgcaacaggagacataataggaa

SEQ ID NO: 191269 - DNA, 75 bp, Artificial Sequence
  Synthetic
cccagaagatcagggaccacagagggagccgttcaatgaatggacactagaactgttagaagagcttaaacatga

SEQ ID NO: 191270 - DNA, 75 bp, Artificial Sequence
  Synthetic
ataggagatataagacaagcacattgtaacattagtgaagcaaaatggaataacactttaagacagatagtgaaa

SEQ ID NO: 191271 - DNA, 75 bp, Artificial Sequence
  Synthetic
taatgatgtaaaacagttaacagaggcagtgcaaaaaatagccatggaaagcatagtaatatggggaaagactcc

SEQ ID NO: 191272 - DNA, 75 bp, Artificial Sequence
  Synthetic
aatacgagaaaaagtatacatatagggccaggacaagcattctatgcagcagagccagtcataggagatataaga

SEQ ID NO: 191273 - DNA, 75 bp, Artificial Sequence
  Synthetic
ctatagtgaatagagttaggaagggatactcaccactatcattccagacccgcctcccagttccaaggggacccg

SEQ ID NO: 191274 - DNA, 75 bp, Artificial Sequence
  Synthetic
tggcactgaaagcattaacaacaccaaaaaggataaggccacctctgcctagtgttaagaaattaacagaagata

SEQ ID NO: 191275 - DNA, 75 bp, Artificial Sequence
  Synthetic
ggccaggacaagcattctatgcagcagagccagtcataggagatataagacaggcacattgcaatattagtgaag

SEQ ID NO: 191276 - DNA, 75 bp, Artificial Sequence
  Synthetic
acgggagggaacgaaatgaaaaactgctcttacaatatgaccacagaactatgggataagaaacagagagtatat

SEQ ID NO: 191277 - DNA, 75 bp, Artificial Sequence
  Synthetic
aatgggatagagaaattagtaattacacagacataatatacaggttgcttgaagactcgcaaaaccagcaggaga

SEQ ID NO: 191278 - DNA, 75 bp, Artificial Sequence
  Synthetic
catgcaaaataaaacaaattgtaaacatgtggcagagagtaggacaagcaatgtatgcccctcctatcaaaggaa

SEQ ID NO: 191279 - DNA, 75 bp, Artificial Sequence
  Synthetic
taggcagggatactcaccattatcattccagacccacctcccagttccgaggggacccgacaggcccgaaggaat

SEQ ID NO: 191280 - DNA, 75 bp, Artificial Sequence
  Synthetic
gtcagacctcaggtacctttaagaccaatgacctacaaggcagctgttgatcttagccactttttaaaagaaaag

SEQ ID NO: 191281 - DNA, 75 bp, Artificial Sequence
  Synthetic
taactactctaacaacagcagcaaatctagcaacagcagcatacctagtgaggaaataaaaaactgcactttcaa

SEQ ID NO: 191282 - DNA, 75 bp, Artificial Sequence
  Synthetic
ctcaggtacctttaagaccaatgacttacaaaggagcttttgatcttagccactttttaaaagaaaaggggggac

SEQ ID NO: 191283 - DNA, 75 bp, Artificial Sequence
  Synthetic
gaatcaagccagtagtatcaactcaactactgttaaatggcagtctagcagaaaacgacacagtggtaagatctg

SEQ ID NO: 191284 - DNA, 75 bp, Artificial Sequence
  Synthetic
gtataggttaataaattgtaatacttcagtcattaagcaggcttgtccaaaggtatcctttgatccaattcctat

SEQ ID NO: 191285 - DNA, 75 bp, Artificial Sequence
  Synthetic
tataactctccaatgcagaataaagcaaattgtaaggatgtggcagagagtaggacaagcaatgtatgcccctcc

SEQ ID NO: 191286 - DNA, 75 bp, Artificial Sequence
  Synthetic
gaaagaatgaggcgagctgagccagcagcagaaggagtaggagcagcgtctcgagatttggatagacgtggggca

SEQ ID NO: 191287 - DNA, 75 bp, Artificial Sequence
  Synthetic
aggcccggaggaatcgaagaagaagatggcgagcaaggcagcggcagatcaattcgattagtgagcggattctta

SEQ ID NO: 191288 - DNA, 75 bp, Artificial Sequence
  Synthetic
gggatactcggacaggagttgaagctataataagaatactacaacaactactgtttattcatttcagaattgggt

SEQ ID NO: 191289 - DNA, 75 bp, Artificial Sequence
  Synthetic
ggatcagatgcatgaggatgtaatcagcttatgggatgaaagcctaaagccatgtgtaaagttgaccccactctg

SEQ ID NO: 191290 - DNA, 75 bp, Artificial Sequence
  Synthetic
accctctattgcgtacatcaaaaaatagatgtaaaagacaccaaggaagctctagataaaatagaggaaatacaa

SEQ ID NO: 191291 - DNA, 75 bp, Artificial Sequence
  Synthetic
ttcaatgcaaccacagaagtaagagataagaagaacaaagagtatgcacttttttatagacttgatatagtacca

SEQ ID NO: 191292 - DNA, 75 bp, Artificial Sequence
  Synthetic
tgggacgatctacggagcctgtgcctcttcagctaccaccgattgagagacttcatcttgattgcagcgaggact

SEQ ID NO: 191293 - DNA, 75 bp, Artificial Sequence
  Synthetic
tgctaaacatagtggggggacaccaggcagcaatgcaaatgttaaaagataccatcaatgaggaagctgcagaat

SEQ ID NO: 191294 - DNA, 75 bp, Artificial Sequence
  Synthetic
ccataactgataataataataaaatgagaaattgctctttcaatataaccacagaagtaagagataaaaaacaga

SEQ ID NO: 191295 - DNA, 75 bp, Artificial Sequence
  Synthetic
ataagctttaactcatcctcaggaggggacctagaaattacaacacatagttttaattgtaggggagaatttttc

SEQ ID NO: 191296 - DNA, 75 bp, Artificial Sequence
  Synthetic
acaccagacaagaaacatcaaaaagaacccccattcctttggatggggtatgaactccatcctgataaatggaca

SEQ ID NO: 191297 - DNA, 75 bp, Artificial Sequence
  Synthetic
ttttaattgtaggggagaatttttctattgcaatacaacaaaactatttaatagtacagaactatttaatagtac

SEQ ID NO: 191298 - DNA, 75 bp, Artificial Sequence
  Synthetic
acaagtagataaattagtaagtagtggaatcaggaaagtgctatttttagatggaatagataaagctcaagaaga

SEQ ID NO: 191299 - DNA, 75 bp, Artificial Sequence
  Synthetic
ttaacagcattaatagtagcattcataatagtaatagttgtgtggactatagtatatatagaatatagaaaactg

SEQ ID NO: 191300 - DNA, 75 bp, Artificial Sequence
  Synthetic
catagcagaataggcattttgcgacagagaagagcaagaaatggagccagtagatcctaacctagagccctggaa

SEQ ID NO: 191301 - DNA, 75 bp, Artificial Sequence
  Synthetic
atggcactcaaaacagcgccctaagagaagatccaggggcagtacaaaactgttctttcaatatgaccacagaaa

SEQ ID NO: 191302 - DNA, 75 bp, Artificial Sequence
  Synthetic
tagaatataggaaactagtaagacaaagaaaaatagactggttaattgaaagaattagggaaagagcagaagaca

SEQ ID NO: 191303 - DNA, 75 bp, Artificial Sequence
  Synthetic
aatatatctatgaaacttatggggatacctggacaggagttgaagctataataagaatccttcaacaactactgt

SEQ ID NO: 191304 - DNA, 75 bp, Artificial Sequence
  Synthetic
ttttcctcagagcagaccggagccaacagccccaccagcagagagcttggggatgggggaagagataacctcccc

SEQ ID NO: 191305 - DNA, 75 bp, Artificial Sequence
  Synthetic
caataatacaagaaaaagtataaatataggaccaggacgagcattttatgcaacagaacaaataataggagacat

SEQ ID NO: 191306 - DNA, 75 bp, Artificial Sequence
  Synthetic
gcttcataacaaaaggcttaggcatctcctatggcaggaagaagcggggacagcgacgaggaccttctcaaggtg

SEQ ID NO: 191307 - DNA, 75 bp, Artificial Sequence
  Synthetic
atgttaccagtagtagtaatgttaccagtaatagtaatgataccagtattcaggacatgagaaattgctctttca

SEQ ID NO: 191308 - DNA, 75 bp, Artificial Sequence
  Synthetic
agcaatagttgtatggactatagtattcatagagtggagaagaataaaaaggcaaaggagaatagaatatttaat

SEQ ID NO: 191309 - DNA, 75 bp, Artificial Sequence
  Synthetic
gcctaaaaccatgtgtaaaattaaccccactctgtgtaactttaaactgtactgatagaatagggaccaataaca

SEQ ID NO: 191310 - DNA, 75 bp, Artificial Sequence
  Synthetic
acttgatgtagtgcaaatagatggtaataataatactaatagtactaatgccaactataccaactatagattaat

SEQ ID NO: 191311 - DNA, 75 bp, Artificial Sequence
  Synthetic
gaatataggaaaatattaagacaaaggaaaatagacaggttaattgatagaatagcagaaagagcagaagacagt

SEQ ID NO: 191312 - DNA, 75 bp, Artificial Sequence
  Synthetic
tgctgtttattcatttcagaattgggtgtcgacatagcagaataggcatcctccaacagaggagagcaagaaatg

SEQ ID NO: 191313 - DNA, 75 bp, Artificial Sequence
  Synthetic
cccagaagtaaaagataggaaggagaaagtgtatgcacttttttatagacttgatatagtaccacttgataagaa

SEQ ID NO: 191314 - DNA, 75 bp, Artificial Sequence
  Synthetic
tggcttcatggcttaggacaacatatctatgaaacttatggggatacttgggcaggagtggaagccataataaga

SEQ ID NO: 191315 - DNA, 75 bp, Artificial Sequence
  Synthetic
tgatagcaggtgggaagatatgaaggaagaaataaaaaactgctctttcaatatcaccacaggcataaaagataa

SEQ ID NO: 191316 - DNA, 75 bp, Artificial Sequence
  Synthetic
cagggcttagaaagggctttgctataagatgggtggcaagtggtcaaaaaggagtatagttggatggcctgctat

SEQ ID NO: 191317 - DNA, 75 bp, Artificial Sequence
  Synthetic
gaaggccatcaaaatcctatatcaaagcagtaagtatatgtaatgttaagtttgctatacaaagtagattatagg

SEQ ID NO: 191318 - DNA, 75 bp, Artificial Sequence
  Synthetic
ctgtagtgctgcagaacaattgtgggtcacagtctattatggggtgcctgtgtggaaagaagcaaccaccactct

SEQ ID NO: 191319 - DNA, 75 bp, Artificial Sequence
  Synthetic
cagcagaaggggtgggagcagtgtctcaagatttagaaagacggggggcaattacaagcagcaatactagagcta

SEQ ID NO: 191320 - DNA, 75 bp, Artificial Sequence
  Synthetic
atagcacggtaaccaatagtagtagtggggaagaaataagaaactgctctttcaatgtcaccacagaaagaagag

SEQ ID NO: 191321 - DNA, 75 bp, Artificial Sequence
  Synthetic
attaggaatcattcaggcacaaccagacaggagtgaatcagaattagtcaatcaaataatagagaagctaataga

SEQ ID NO: 191322 - DNA, 75 bp, Artificial Sequence
  Synthetic
acagaatgcatgcaggatagaaatcagtaaatgggatcaaagcctaaagccatgtgtaaaattaagtccactatg

SEQ ID NO: 191323 - DNA, 75 bp, Artificial Sequence
  Synthetic
ttactaatgctactacttctactaatactagttgggaaaggatggaggtagaaataaaaaactgctctttcaatg

SEQ ID NO: 191324 - DNA, 75 bp, Artificial Sequence
  Synthetic
aaccccactctgtgttactttaaattgcactaatgtgaatgtgactaatttgaagaatgagactaataccaatag

SEQ ID NO: 191325 - DNA, 75 bp, Artificial Sequence
  Synthetic
aatctgtagcaattaattgtacaagacccaactacattgaaagaagaagaataccacatataggaccagggagag

SEQ ID NO: 191326 - DNA, 75 bp, Artificial Sequence
  Synthetic
agcttaaatcattgttcaatacaatagcagtcctctattatgtacataaaagggaaaagataaaagacaccaagg

SEQ ID NO: 191327 - DNA, 75 bp, Artificial Sequence
  Synthetic
agcttaaatcattgttcaatacaatagctgtcctctattatgtacataaaagggaaaagataaaagacaccaagg

SEQ ID NO: 191328 - DNA, 75 bp, Artificial Sequence
  Synthetic
agcttaaatcattgttcaatacaatagccgtcctctattatgtacataaaagggaaaagataaaagacaccaagg

SEQ ID NO: 191329 - DNA, 75 bp, Artificial Sequence
  Synthetic
agcttaaatcattgttcaatacaatagcggtcctctattatgtacataaaagggaaaagataaaagacaccaagg

SEQ ID NO: 191330 - DNA, 75 bp, Artificial Sequence
  Synthetic
agcttaaatcattgttcaatacattagcagtcctctattatgtacataaaagggaaaagataaaagacaccaagg

SEQ ID NO: 191331 - DNA, 75 bp, Artificial Sequence
  Synthetic
agcttaaatcattgttcaatacattagctgtcctctattatgtacataaaagggaaaagataaaagacaccaagg

SEQ ID NO: 191332 - DNA, 75 bp, Artificial Sequence
  Synthetic
agcttaaatcattgttcaatacattagccgtcctctattatgtacataaaagggaaaagataaaagacaccaagg

SEQ ID NO: 191333 - DNA, 75 bp, Artificial Sequence
  Synthetic
agcttaaatcattgttcaatacattagcggtcctctattatgtacataaaagggaaaagataaaagacaccaagg

SEQ ID NO: 191334 - DNA, 75 bp, Artificial Sequence
  Synthetic
agcttaaatcattgttcaatacactagcagtcctctattatgtacataaaagggaaaagataaaagacaccaagg

SEQ ID NO: 191335 - DNA, 75 bp, Artificial Sequence
  Synthetic
agcttaaatcattgttcaatacactagctgtcctctattatgtacataaaagggaaaagataaaagacaccaagg

SEQ ID NO: 191336 - DNA, 75 bp, Artificial Sequence
  Synthetic
agcttaaatcattgttcaatacactagccgtcctctattatgtacataaaagggaaaagataaaagacaccaagg

SEQ ID NO: 191337 - DNA, 75 bp, Artificial Sequence
  Synthetic
agcttaaatcattgttcaatacactagcggtcctctattatgtacataaaagggaaaagataaaagacaccaagg

SEQ ID NO: 191338 - DNA, 75 bp, Artificial Sequence
  Synthetic
agcttaaatcattgttcaatacagtagcagtcctctattatgtacataaaagggaaaagataaaagacaccaagg

SEQ ID NO: 191339 - DNA, 75 bp, Artificial Sequence
  Synthetic
agcttaaatcattgttcaatacagtagctgtcctctattatgtacataaaagggaaaagataaaagacaccaagg

SEQ ID NO: 191340 - DNA, 75 bp, Artificial Sequence
  Synthetic
agcttaaatcattgttcaatacagtagccgtcctctattatgtacataaaagggaaaagataaaagacaccaagg

SEQ ID NO: 191341 - DNA, 75 bp, Artificial Sequence
  Synthetic
agcttaaatcattgttcaatacagtagcggtcctctattatgtacataaaagggaaaagataaaagacaccaagg

SEQ ID NO: 191342 - DNA, 75 bp, Artificial Sequence
  Synthetic
agcttaaatcattgttcaattcaatagcagtcctctattatgtacataaaagggaaaagataaaagacaccaagg

SEQ ID NO: 191343 - DNA, 75 bp, Artificial Sequence
  Synthetic
agcttaaatcattgttcaattcaatagctgtcctctattatgtacataaaagggaaaagataaaagacaccaagg

SEQ ID NO: 191344 - DNA, 75 bp, Artificial Sequence
  Synthetic
agcttaaatcattgttcaattcaatagccgtcctctattatgtacataaaagggaaaagataaaagacaccaagg

SEQ ID NO: 191345 - DNA, 75 bp, Artificial Sequence
  Synthetic
agcttaaatcattgttcaattcaatagcggtcctctattatgtacataaaagggaaaagataaaagacaccaagg

SEQ ID NO: 191346 - DNA, 75 bp, Artificial Sequence
  Synthetic
agcttaaatcattgttcaattcattagcagtcctctattatgtacataaaagggaaaagataaaagacaccaagg

SEQ ID NO: 191347 - DNA, 75 bp, Artificial Sequence
  Synthetic
agcttaaatcattgttcaattcattagctgtcctctattatgtacataaaagggaaaagataaaagacaccaagg

SEQ ID NO: 191348 - DNA, 75 bp, Artificial Sequence
  Synthetic
agcttaaatcattgttcaattcattagccgtcctctattatgtacataaaagggaaaagataaaagacaccaagg

SEQ ID NO: 191349 - DNA, 75 bp, Artificial Sequence
  Synthetic
agcttaaatcattgttcaattcattagcggtcctctattatgtacataaaagggaaaagataaaagacaccaagg

SEQ ID NO: 191350 - DNA, 75 bp, Artificial Sequence
  Synthetic
agcttaaatcattgttcaattcactagcagtcctctattatgtacataaaagggaaaagataaaagacaccaagg

SEQ ID NO: 191351 - DNA, 75 bp, Artificial Sequence
  Synthetic
agcttaaatcattgttcaattcactagctgtcctctattatgtacataaaagggaaaagataaaagacaccaagg

SEQ ID NO: 191352 - DNA, 75 bp, Artificial Sequence
  Synthetic
agcttaaatcattgttcaattcactagccgtcctctattatgtacataaaagggaaaagataaaagacaccaagg

SEQ ID NO: 191353 - DNA, 75 bp, Artificial Sequence
  Synthetic
agcttaaatcattgttcaattcactagcggtcctctattatgtacataaaagggaaaagataaaagacaccaagg

SEQ ID NO: 191354 - DNA, 75 bp, Artificial Sequence
  Synthetic
agcttaaatcattgttcaattcagtagcagtcctctattatgtacataaaagggaaaagataaaagacaccaagg

SEQ ID NO: 191355 - DNA, 75 bp, Artificial Sequence
  Synthetic
agcttaaatcattgttcaattcagtagctgtcctctattatgtacataaaagggaaaagataaaagacaccaagg

SEQ ID NO: 191356 - DNA, 75 bp, Artificial Sequence
  Synthetic
agcttaaatcattgttcaattcagtagccgtcctctattatgtacataaaagggaaaagataaaagacaccaagg

SEQ ID NO: 191357 - DNA, 75 bp, Artificial Sequence
  Synthetic
agcttaaatcattgttcaattcagtagcggtcctctattatgtacataaaagggaaaagataaaagacaccaagg

SEQ ID NO: 191358 - DNA, 75 bp, Artificial Sequence
  Synthetic
agcttaaatcattgttcaatccaatagcagtcctctattatgtacataaaagggaaaagataaaagacaccaagg

SEQ ID NO: 191359 - DNA, 75 bp, Artificial Sequence
  Synthetic
agcttaaatcattgttcaatccaatagctgtcctctattatgtacataaaagggaaaagataaaagacaccaagg

SEQ ID NO: 191360 - DNA, 75 bp, Artificial Sequence
  Synthetic
agcttaaatcattgttcaatccaatagccgtcctctattatgtacataaaagggaaaagataaaagacaccaagg

SEQ ID NO: 191361 - DNA, 75 bp, Artificial Sequence
  Synthetic
agcttaaatcattgttcaatccaatagcggtcctctattatgtacataaaagggaaaagataaaagacaccaagg

SEQ ID NO: 191362 - DNA, 75 bp, Artificial Sequence
  Synthetic
agcttaaatcattgttcaatccattagcagtcctctattatgtacataaaagggaaaagataaaagacaccaagg

SEQ ID NO: 191363 - DNA, 75 bp, Artificial Sequence
  Synthetic
agcttaaatcattgttcaatccattagctgtcctctattatgtacataaaagggaaaagataaaagacaccaagg

SEQ ID NO: 191364 - DNA, 75 bp, Artificial Sequence
  Synthetic
agcttaaatcattgttcaatccattagccgtcctctattatgtacataaaagggaaaagataaaagacaccaagg

SEQ ID NO: 191365 - DNA, 75 bp, Artificial Sequence
  Synthetic
agcttaaatcattgttcaatccattagcggtcctctattatgtacataaaagggaaaagataaaagacaccaagg

SEQ ID NO: 191366 - DNA, 75 bp, Artificial Sequence
  Synthetic
agcttaaatcattgttcaatccactagcagtcctctattatgtacataaaagggaaaagataaaagacaccaagg

SEQ ID NO: 191367 - DNA, 75 bp, Artificial Sequence
  Synthetic
agcttaaatcattgttcaatccactagctgtcctctattatgtacataaaagggaaaagataaaagacaccaagg

SEQ ID NO: 191368 - DNA, 75 bp, Artificial Sequence
  Synthetic
agcttaaatcattgttcaatccactagccgtcctctattatgtacataaaagggaaaagataaaagacaccaagg

SEQ ID NO: 191369 - DNA, 75 bp, Artificial Sequence
  Synthetic
agcttaaatcattgttcaatccactagcggtcctctattatgtacataaaagggaaaagataaaagacaccaagg

SEQ ID NO: 191370 - DNA, 75 bp, Artificial Sequence
  Synthetic
agcttaaatcattgttcaatccagtagcagtcctctattatgtacataaaagggaaaagataaaagacaccaagg

SEQ ID NO: 191371 - DNA, 75 bp, Artificial Sequence
  Synthetic
agcttaaatcattgttcaatccagtagctgtcctctattatgtacataaaagggaaaagataaaagacaccaagg

SEQ ID NO: 191372 - DNA, 75 bp, Artificial Sequence
  Synthetic
agcttaaatcattgttcaatccagtagccgtcctctattatgtacataaaagggaaaagataaaagacaccaagg

SEQ ID NO: 191373 - DNA, 75 bp, Artificial Sequence
  Synthetic
agcttaaatcattgttcaatccagtagcggtcctctattatgtacataaaagggaaaagataaaagacaccaagg

SEQ ID NO: 191374 - DNA, 75 bp, Artificial Sequence
  Synthetic
agcttaaatcattgttcaatgcaatagcagtcctctattatgtacataaaagggaaaagataaaagacaccaagg

SEQ ID NO: 191375 - DNA, 75 bp, Artificial Sequence
  Synthetic
agcttaaatcattgttcaatgcaatagctgtcctctattatgtacataaaagggaaaagataaaagacaccaagg

SEQ ID NO: 191376 - DNA, 75 bp, Artificial Sequence
  Synthetic
agcttaaatcattgttcaatgcaatagccgtcctctattatgtacataaaagggaaaagataaaagacaccaagg

SEQ ID NO: 191377 - DNA, 75 bp, Artificial Sequence
  Synthetic
agcttaaatcattgttcaatgcaatagcggtcctctattatgtacataaaagggaaaagataaaagacaccaagg

SEQ ID NO: 191378 - DNA, 75 bp, Artificial Sequence
  Synthetic
agcttaaatcattgttcaatgcattagcagtcctctattatgtacataaaagggaaaagataaaagacaccaagg

SEQ ID NO: 191379 - DNA, 75 bp, Artificial Sequence
  Synthetic
agcttaaatcattgttcaatgcattagctgtcctctattatgtacataaaagggaaaagataaaagacaccaagg

SEQ ID NO: 191380 - DNA, 75 bp, Artificial Sequence
  Synthetic
agcttaaatcattgttcaatgcattagccgtcctctattatgtacataaaagggaaaagataaaagacaccaagg

SEQ ID NO: 191381 - DNA, 75 bp, Artificial Sequence
  Synthetic
agcttaaatcattgttcaatgcattagcggtcctctattatgtacataaaagggaaaagataaaagacaccaagg

SEQ ID NO: 191382 - DNA, 75 bp, Artificial Sequence
  Synthetic
agcttaaatcattgttcaatgcactagcagtcctctattatgtacataaaagggaaaagataaaagacaccaagg

SEQ ID NO: 191383 - DNA, 75 bp, Artificial Sequence
  Synthetic
agcttaaatcattgttcaatgcactagctgtcctctattatgtacataaaagggaaaagataaaagacaccaagg

SEQ ID NO: 191384 - DNA, 75 bp, Artificial Sequence
  Synthetic
agcttaaatcattgttcaatgcactagccgtcctctattatgtacataaaagggaaaagataaaagacaccaagg

SEQ ID NO: 191385 - DNA, 75 bp, Artificial Sequence
  Synthetic
agcttaaatcattgttcaatgcactagcggtcctctattatgtacataaaagggaaaagataaaagacaccaagg

SEQ ID NO: 191386 - DNA, 75 bp, Artificial Sequence
  Synthetic
agcttaaatcattgttcaatgcagtagcagtcctctattatgtacataaaagggaaaagataaaagacaccaagg

SEQ ID NO: 191387 - DNA, 75 bp, Artificial Sequence
  Synthetic
agcttaaatcattgttcaatgcagtagctgtcctctattatgtacataaaagggaaaagataaaagacaccaagg

SEQ ID NO: 191388 - DNA, 75 bp, Artificial Sequence
  Synthetic
agcttaaatcattgttcaatgcagtagccgtcctctattatgtacataaaagggaaaagataaaagacaccaagg

SEQ ID NO: 191389 - DNA, 75 bp, Artificial Sequence
  Synthetic
agcttaaatcattgttcaatgcagtagcggtcctctattatgtacataaaagggaaaagataaaagacaccaagg

SEQ ID NO: 191390 - DNA, 75 bp, Artificial Sequence
  Synthetic
taatagcagtcaggataatactaccattgatgagagcatgcgtgaagaaataaaaaattgctcgtacaactcaac

SEQ ID NO: 191391 - DNA, 75 bp, Artificial Sequence
  Synthetic
agctcctccgagcagtgaggatcgtcaaaatcttatatcaaagcagtaagtatcaaatagtagatatagtagatg

SEQ ID NO: 191392 - DNA, 75 bp, Artificial Sequence
  Synthetic
atagtctttaaaaattcctcaggaggggatccagaaattgtaacgcacagttttaattgtagaggggaatccttc

SEQ ID NO: 191393 - DNA, 75 bp, Artificial Sequence
  Synthetic
gaattagggaaagagcagaagacagtggcaatgagagtgaaggggatacagaggaattatcaacaatggtggaca

SEQ ID NO: 191394 - DNA, 75 bp, Artificial Sequence
  Synthetic
gaagctataataagaactctgcaacaactactgtttgttcatttcagaattgggtgccaacatagcagaataggc

SEQ ID NO: 191395 - DNA, 75 bp, Artificial Sequence
  Synthetic
caggaggggacccagaaattgcaatgcacagttttaattgtggaggggaatttttctactgtaatacaacacaac

SEQ ID NO: 191396 - DNA, 75 bp, Artificial Sequence
  Synthetic
tactgtaaaaagtgttgctatcattgccaagtttgctttttgaacaaaggcttaggcatctcctatggcaggaag

SEQ ID NO: 191397 - DNA, 75 bp, Artificial Sequence
  Synthetic
gacgccatcatactcctatgccgaataaacaattatacatgtggcagaagtaggaaaagcatgtttgcccctccc

SEQ ID NO: 191398 - DNA, 75 bp, Artificial Sequence
  Synthetic
aagaagaactcctgcagcagcagacggggtgggagcagcatcccgggacttagaaagacatggggcaattacaag

SEQ ID NO: 191399 - DNA, 75 bp, Artificial Sequence
  Synthetic
ctcaggtaccattaagaccaatgacttacaaggcagctgtagatctaagccactttttaaaagaaaaggggggac

SEQ ID NO: 191400 - DNA, 75 bp, Artificial Sequence
  Synthetic
tctagataaaatagaggaaccgcaaaagaagagccagcaaaagacacaacaggcagcagctgctgcaggaaacag

SEQ ID NO: 191401 - DNA, 75 bp, Artificial Sequence
  Synthetic
ccactatcaatggtgatggtggcatgaggaactgctcttacaatatgaccacagagctaagggataagaaacgga

SEQ ID NO: 191402 - DNA, 75 bp, Artificial Sequence
  Synthetic
aggcttaggcatctcctatggcaggaagaagcggagacagcgacgagcagcttctcgcggcagtaagagtaatca

SEQ ID NO: 191403 - DNA, 75 bp, Artificial Sequence
  Synthetic
tgaagatgaggaagtaggttttccagtcaggcctcaggtgcctttaaggccaatgacctacaaggcagcgtttga

SEQ ID NO: 191404 - DNA, 75 bp, Artificial Sequence
  Synthetic
gacagatagggttatagaagtagtacaaagagcttttagggctatcttacacatacctagaagaataagacaggg

SEQ ID NO: 191405 - DNA, 75 bp, Artificial Sequence
  Synthetic
agcacttatctgggtcgacctgcggaacctgagcctcttcctctaccaccgcttgagagacttactcttgattgt

SEQ ID NO: 191406 - DNA, 75 bp, Artificial Sequence
  Synthetic
aacacaagaacaagtatacgtataggaccaggacaatcattctatgcaacaggtggcataataggggatataaga

SEQ ID NO: 191407 - DNA, 75 bp, Artificial Sequence
  Synthetic
ggggtgtttgaacagggacctgaaagtgaaagtagaccagagaagctctcgacgcgaggactcggcttgctgaat

SEQ ID NO: 191408 - DNA, 75 bp, Artificial Sequence
  Synthetic
gattgtgtggcaggtagacaggatgaggattagaacatggaatagtttagtaaagcaccatatgtatatttcaaa

SEQ ID NO: 191409 - DNA, 75 bp, Artificial Sequence
  Synthetic
tgaatatcaagcaggacataataaggtaggatctctacagtacttggcactgacagcattaataaagccaaaaaa

SEQ ID NO: 191410 - DNA, 75 bp, Artificial Sequence
  Synthetic
ttgtgcctggctggaagcacaagaggatgaggaggtaggctttccagtcaggccgcaggtacccttgagaccaat

SEQ ID NO: 191411 - DNA, 75 bp, Artificial Sequence
  Synthetic
acagaaaacttgtgggtcacagtctattatggggtacctgtgtggaaagaagcaaccaccactctattttgtgca

SEQ ID NO: 191412 - DNA, 75 bp, Artificial Sequence
  Synthetic
gggcacatagccaaaaattgcagggcccctagaaaaaagggctgttggaaatgtggaaaggaaggacaccaaatg

SEQ ID NO: 191413 - DNA, 75 bp, Artificial Sequence
  Synthetic
gacaggaacagaagagcttaaatcattatataacacaatagtagtcctctattatgtacatcaaaagatagatgt

SEQ ID NO: 191414 - DNA, 75 bp, Artificial Sequence
  Synthetic
ggtggacagatagggttatagaagcaggacaaatattattaggaagggcttagaaagggctttgctataacatgg

SEQ ID NO: 191415 - DNA, 75 bp, Artificial Sequence
  Synthetic
agaaggaggtggagagcaaggcagagacagatccgtgcgattagtcagcggattcttagcgcttgcctgggacga

SEQ ID NO: 191416 - DNA, 75 bp, Artificial Sequence
  Synthetic
aggatgtggtgtaaatgatacaatggggacagtaatgaaaaattgctctttcaatgcaactacagagataaaaga

SEQ ID NO: 191417 - DNA, 75 bp, Artificial Sequence
  Synthetic
ctgctctttcaatacaaccacagaaataagagataagaaacagaaagcgtatgcacttttttataaacctgatgt

SEQ ID NO: 191418 - DNA, 75 bp, Artificial Sequence
  Synthetic
caaatactgggacaattacaaccagctcttgagacaggaacagaagaaattaaatcattatataatactgtagca

SEQ ID NO: 191419 - DNA, 75 bp, Artificial Sequence
  Synthetic
caatggaacaggaccatgcaaaaatgtcagtacagtacaatgtacacatggaattaaaccagtggtatcaactca

SEQ ID NO: 191420 - DNA, 75 bp, Artificial Sequence
  Synthetic
gacccggcaataatacaagaaaaagtataaggataggaccaggacaaacattctatgcaaatgacataataggag

SEQ ID NO: 191421 - DNA, 75 bp, Artificial Sequence
  Synthetic
tataaggataggaccaggacaaacattctatgcaaatgacataataggagacataagacaagcacattgtaacat

SEQ ID NO: 191422 - DNA, 75 bp, Artificial Sequence
  Synthetic
tattatgacccatcaaaagacttaatagcagaaatacagaagcaggggctaggccaatggacatatcaaatttat

SEQ ID NO: 191423 - DNA, 75 bp, Artificial Sequence
  Synthetic
gataggaccaggacaaacattctatgcaacaggagatataataggagacataagacaagcacattgtaacattag

SEQ ID NO: 191424 - DNA, 75 bp, Artificial Sequence
  Synthetic
caagataatagtgacataaaggtagtaccaaggaggaaagcaaaaatcattaaggactatggaaaacagatggca

SEQ ID NO: 191425 - DNA, 75 bp, Artificial Sequence
  Synthetic
agccaaaattaccctatagtgcaaaatgcacaagggcaaatggtacatcagtccatatcacctaggactttgaat

SEQ ID NO: 191426 - DNA, 75 bp, Artificial Sequence
  Synthetic
taccagagcagtaagtattgattaagtagtgtatgtaatgtttgatttattagcaatagcaatagtagcattagt

SEQ ID NO: 191427 - DNA, 75 bp, Artificial Sequence
  Synthetic
acagtttagtaaaacatcatatgtatgtttcaaagcaagctcaaggatggttgtatagacatcactatgactgcc

SEQ ID NO: 191428 - DNA, 75 bp, Artificial Sequence
  Synthetic
attccaatagctccactaacagcaccctgagggaagagccaggagcaataaaaaactgttctttcaatatgacca

SEQ ID NO: 191429 - DNA, 75 bp, Artificial Sequence
  Synthetic
gaaaaatgacatggtggatcagatgcatgaggatgtaatcagtttatgggatcaaagcctaaagccatgtgtaaa

SEQ ID NO: 191430 - DNA, 75 bp, Artificial Sequence
  Synthetic
tagtagccagctgtgataaatgtcagctaaaaggggaagccatgcatggacaagtagactgtagtccagggatat

SEQ ID NO: 191431 - DNA, 75 bp, Artificial Sequence
  Synthetic
gagggtgcaaatgaaataaaaaattgctctttcaagatagccacagaattaagagataaggagcagaaagtgtat

SEQ ID NO: 191432 - DNA, 75 bp, Artificial Sequence
  Synthetic
agaaattacaatgcatagttttaattgtagaggagaatttttctactgcaatacatcagaactgtttaatgacac

SEQ ID NO: 191433 - DNA, 75 bp, Artificial Sequence
  Synthetic
taaaacaaattgtaagaatgtggcagggagtaggacaagcaatgtatgctgctcctattgcaggaaacattacct

SEQ ID NO: 191434 - DNA, 75 bp, Artificial Sequence
  Synthetic
gaggatataatcagtttatgggatcaaagcctaaaaccatgtgtaaaattaaccccactctgtgtcactttaaac

SEQ ID NO: 191435 - DNA, 75 bp, Artificial Sequence
  Synthetic
ttaatggcaccaccattaatagcactgggggcccagaaatgaaaaactgctctttcaatataaccacagaaataa

SEQ ID NO: 191436 - DNA, 75 bp, Artificial Sequence
  Synthetic
ataataagaattctgcaacaactactgtttgttcatttcagaattgggtgccaacatagcagaataggcattata

SEQ ID NO: 191437 - DNA, 75 bp, Artificial Sequence
  Synthetic
gagggagccatacaatgaatggacactagagcttttagaggagcttaagaatgaagctgttagacattttcctag

SEQ ID NO: 191438 - DNA, 75 bp, Artificial Sequence
  Synthetic
gatcagatgcatgaagatataatcagtttatgggatcaaagcctaaagccatgtgtaaagttgaccccactctgt

SEQ ID NO: 191439 - DNA, 75 bp, Artificial Sequence
  Synthetic
atagcagaataggcattattcgacagaggagagcaagaaatggagccagtagatcctagactagagccctggaag

SEQ ID NO: 191440 - DNA, 75 bp, Artificial Sequence
  Synthetic
atagaaaatggttaagacaaagaaaaatagacagattagttaagagaattagggagagagcagaagacagtggaa

SEQ ID NO: 191441 - DNA, 75 bp, Artificial Sequence
  Synthetic
taccaggcctagcaacaatacacgaacaagtgtgcctataggaccaggacgagcattctatgcaacaggtgccat

SEQ ID NO: 191442 - DNA, 75 bp, Artificial Sequence
  Synthetic
ctaccaatgggagtaacttgggagagatgaaagaagaaatgaaaaactgctctttcaatattactacacccataa

SEQ ID NO: 191443 - DNA, 75 bp, Artificial Sequence
  Synthetic
ataacacaagcctgtccaaaggtctcatttgacccaattcctatacattattgtgctccagctggttatgcgatt

SEQ ID NO: 191444 - DNA, 75 bp, Artificial Sequence
  Synthetic
caatggacatatcaaatttatcaagagccatttaaaaatctaaaaacaggaaaatatgcaaaaaagaggtctgcc

SEQ ID NO: 191445 - DNA, 75 bp, Artificial Sequence
  Synthetic
tatacaggttgcttgaagactcgcaaatccagcaggaaagaaatgaaaaggatttattagcattggacaattgga

SEQ ID NO: 191446 - DNA, 75 bp, Artificial Sequence
  Synthetic
ggacaagcaatgtatgcccctcccatcccaggagtaataaggtgtgaatcaaacattacaggactaatattaaca

SEQ ID NO: 191447 - DNA, 75 bp, Artificial Sequence
  Synthetic
aatagaagaaatgaaaaattgctctttcaatgtaaccacagtactaagagataagaaagaggagaaatatgcact

SEQ ID NO: 191448 - DNA, 75 bp, Artificial Sequence
  Synthetic
gtgttacgttaaattgcattaacatcaatggtactaacagcactagtactaacatcaatggtgaagtgaaagaag

SEQ ID NO: 191449 - DNA, 75 bp, Artificial Sequence
  Synthetic
tacctagaagaatcagacagggcttcgaaagggctttgctataaaatgggtggcaagtggtcaaaaagtagtata

SEQ ID NO: 191450 - DNA, 75 bp, Artificial Sequence
  Synthetic
tggcaagtggtcaaaaagtagtatagttgggtggcctgctgtaagggaaagaatgagacggaccccttcagcggc

SEQ ID NO: 191451 - DNA, 75 bp, Artificial Sequence
  Synthetic
tgattatgggaatgctactaacatcactaatggtagcaggggaatgatggagaaaggagaaataaaaaattgcac

SEQ ID NO: 191452 - DNA, 75 bp, Artificial Sequence
  Synthetic
gtatttatagaatataggaaaataaaaaagcagaagaaaatagaaaggttacttgatagaataagagaaagagca

SEQ ID NO: 191453 - DNA, 75 bp, Artificial Sequence
  Synthetic
actagaacgatttgccattgatcctggccttttagaaacatcagaaggctgtaagcaaataatagggcagctaca

SEQ ID NO: 191454 - DNA, 75 bp, Artificial Sequence
  Synthetic
tctactatggggtacctgtgtggagagatgcagagaccaccctattttgtgcatcagatgctaaagcatatgata

SEQ ID NO: 191455 - DNA, 75 bp, Artificial Sequence
  Synthetic
ccaattgtaccaacagcaaccactcttgcaacccagagatgataatgaggaactgctcttacaatatgaccacag

SEQ ID NO: 191456 - DNA, 75 bp, Artificial Sequence
  Synthetic
gaataagaaggactaatccagcagcagaaggggtgggagccgcatccagagacttggaaaaacatggggcaataa

SEQ ID NO: 191457 - DNA, 75 bp, Artificial Sequence
  Synthetic
gaaaacagggaagtatgcaaaaaggaggacggcccacactaatgatgtaaaacagttaacagaggcagtgcaaaa

SEQ ID NO: 191458 - DNA, 75 bp, Artificial Sequence
  Synthetic
gtgctattagtctgcttgataccatagcaatagcagtagctgagggaacagatagaattatagaagtaatacaaa

SEQ ID NO: 191459 - DNA, 75 bp, Artificial Sequence
  Synthetic
caggggaatgcaagaatgtcagcacagttcaatgtacacatggaattaaaccagtagtgtcaactcaactactgt

SEQ ID NO: 191460 - DNA, 75 bp, Artificial Sequence
  Synthetic
atagaatataggaaaatactaaaacaaaggagaatagacagaatacttcaaagaataagtgaaagagcagaagac

SEQ ID NO: 191461 - DNA, 75 bp, Artificial Sequence
  Synthetic
taattgtaccagacccaacaacaacacaagaaaaagtgtacgcataggaccaggacaagcattctatgcaacagg

SEQ ID NO: 191462 - DNA, 75 bp, Artificial Sequence
  Synthetic
aaattgtgggttactgtctattatggggtacctgtgtggaaagatgcagagaccaccttattttgtgcatcagat

SEQ ID NO: 191463 - DNA, 75 bp, Artificial Sequence
  Synthetic
tcccaaacccgaggggacccgacaggcccggaggaatcgaagaagaaggtggagagcaagacagagacagatcca

SEQ ID NO: 191464 - DNA, 75 bp, Artificial Sequence
  Synthetic
taactctccaatgcagaataaaacaaattataaatatgtggcagagagtaggacaagcaatgtatgcccctccca

SEQ ID NO: 191465 - DNA, 75 bp, Artificial Sequence
  Synthetic
tacaatgtcaccaatatcaccaatgaaatgaatggagaaatgagaaactgctcttacaatatgaccacagaatta

SEQ ID NO: 191466 - DNA, 75 bp, Artificial Sequence
  Synthetic
ctcccttagcctccctcaaatcactctttggcaacgaccagtagtcacaataaaggtagagggacagctaaagga

SEQ ID NO: 191467 - DNA, 75 bp, Artificial Sequence
  Synthetic
ggcaatgagagtgaaggggacacagaggaattggcaaaacttgtggagatggggcctcatgatctttggaatatt

SEQ ID NO: 191468 - DNA, 75 bp, Artificial Sequence
  Synthetic
agaataagacagggcttagaaagacttttgctataaaatgggtggcaagtggtcaaaaagtaggactggtggatg

SEQ ID NO: 191469 - DNA, 75 bp, Artificial Sequence
  Synthetic
aatgctgattgtgcctggctgcaagcacaagaggaggaagaagaagtaggctttccagtcagacctcaggtgcct

SEQ ID NO: 191470 - DNA, 75 bp, Artificial Sequence
  Synthetic
ctagcaaaatatggagcaatcacaagtagcaatactgctcatactaatgctgattgtgcctggctacaggcacaa

SEQ ID NO: 191471 - DNA, 75 bp, Artificial Sequence
  Synthetic
gggctttgctatagcatgggtggcaagtggtccaaacgtagtgtagttgggtggcctgctataagggaaagaatg

SEQ ID NO: 191472 - DNA, 75 bp, Artificial Sequence
  Synthetic
aacggaacgaacggtaacatatctagggagatgctaggggaaataaagaactgctctttcaatatgaccacagta

SEQ ID NO: 191473 - DNA, 75 bp, Artificial Sequence
  Synthetic
gaggaaaatgaagaagaagtgggttttccagtcagacctcaggttcctttaagaccaatgacctaccaaggagct

SEQ ID NO: 191474 - DNA, 75 bp, Artificial Sequence
  Synthetic
aatgatgcagagaggcaattttaagggcccaaggaaaatcattaagtgtttcaactgtggcaaagaagggcacat

SEQ ID NO: 191475 - DNA, 75 bp, Artificial Sequence
  Synthetic
tggcaggtagacaggatgaggatcagaacatggaatagtttagtaaagcaccatatgtatgtttcaagaaaagct

SEQ ID NO: 191476 - DNA, 75 bp, Artificial Sequence
  Synthetic
aaggtcagtcaaaattatcctatagtacagaatctccaagggcaaatggtacaccaggccatatcacctagaact

SEQ ID NO: 191477 - DNA, 75 bp, Artificial Sequence
  Synthetic
tacaagaaaaggtgtgggtataggaccagggcaaacattctatgcagcagatagaataatagggaatataagaca

SEQ ID NO: 191478 - DNA, 75 bp, Artificial Sequence
  Synthetic
aagctctattagatacaggagcagatgatacagtattagaagaaatgaatttgccaggaaaatggaaaccaaaaa

SEQ ID NO: 191479 - DNA, 75 bp, Artificial Sequence
  Synthetic
ttaggagtaggagcactgataatagcattaatcatagcaatagttgtgtggatcatagtatatatagaatataag

SEQ ID NO: 191480 - DNA, 75 bp, Artificial Sequence
  Synthetic
agcaggttagggaaagaataagacaaacccctgtagcagcagaaggggtgggagcagtgtctcaagacttagcta

SEQ ID NO: 191481 - DNA, 75 bp, Artificial Sequence
  Synthetic
ttagtatgggcaagcagggagctggacagattcgcacttaaccctggcctgttagaaacagcagaaggatgtcag

SEQ ID NO: 191482 - DNA, 75 bp, Artificial Sequence
  Synthetic
caccatacctagtacaaacaatgagacaccaggaattaggtatcagtacaatgtgcttccacaaggatggaaagg

SEQ ID NO: 191483 - DNA, 75 bp, Artificial Sequence
  Synthetic
acaaattggctgtggtatataagactatttataatgatagtaggaggcttaataggtttaagaataatttttgct

SEQ ID NO: 191484 - DNA, 75 bp, Artificial Sequence
  Synthetic
tcctaggaatttggggttgctctggaaaactcatctgcaccactactgtgccctggaactctagttggagtaata

SEQ ID NO: 191485 - DNA, 75 bp, Artificial Sequence
  Synthetic
tctggcatattggatacaggaactaaaaactagtgctactagtttgattgacaccatagcaatagtaatagctgg

SEQ ID NO: 191486 - DNA, 75 bp, Artificial Sequence
  Synthetic
gaactcaataaaagaactcaagacttttgggaggttcaattaggaataccacacccagcaggattaaaaaagaaa

SEQ ID NO: 191487 - DNA, 75 bp, Artificial Sequence
  Synthetic
taccaataataatgttacctacaatgagacaagtcttacagaaatgaaaaattgctctttcaatacaaccacagt

SEQ ID NO: 191488 - DNA, 75 bp, Artificial Sequence
  Synthetic
ggaatttggaattccctacaatccccaaagtcaaggagtagtagaatctatgaataaagaattaaagaaaatcat

SEQ ID NO: 191489 - DNA, 75 bp, Artificial Sequence
  Synthetic
catgggaaacatggtggatggactattggcaggctacctggattcctgaatgggaatttgtcaatacccctcctc

SEQ ID NO: 191490 - DNA, 75 bp, Artificial Sequence
  Synthetic
tgaataaagaattaaagaaaatcataggacaggtaagagatcaagctgaacatcttaagacagcagtacaaatgg

SEQ ID NO: 191491 - DNA, 75 bp, Artificial Sequence
  Synthetic
ccattcaaaaatctgaaaacagggaagtatgcaaaaatgaggactgcccacactaatgatgtaaaacagttaaca

SEQ ID NO: 191492 - DNA, 75 bp, Artificial Sequence
  Synthetic
caaaaggttatttccctaactgagacaacaaatcaaaagactgaactacatgctatccatctagccttgcaggat

SEQ ID NO: 191493 - DNA, 75 bp, Artificial Sequence
  Synthetic
ggaaaagtataaggataggaccaggacaaacattctttgcaacaaatgacataataggagacataaggcaagcac

SEQ ID NO: 191494 - DNA, 75 bp, Artificial Sequence
  Synthetic
tagagaagctaataggaaaggacaaagtctacctgtcatgggtacctgcacacaaaggaattggaggaaatgaac

SEQ ID NO: 191495 - DNA, 75 bp, Artificial Sequence
  Synthetic
atatagactaaaacatctagtatgggcaagcagggagctggaaagattcgcacttaaccctagccttttagaaac

SEQ ID NO: 191496 - DNA, 75 bp, Artificial Sequence
  Synthetic
ggaggaaatatgaaggacaattggagaagtgaattatataaatataaagtggtagaaattaagccattaggaata

SEQ ID NO: 191497 - DNA, 75 bp, Artificial Sequence
  Synthetic
gaacaggaaggaggaaatgaaaaattgctctttcaatgcaaccacattattacatgataagaaacagaaagtgta

SEQ ID NO: 191498 - DNA, 75 bp, Artificial Sequence
  Synthetic
aaaatgaaagggatttattagcattggacaagtggcaaaatctatggaattggtttaacataacaaattggctat

SEQ ID NO: 191499 - DNA, 75 bp, Artificial Sequence
  Synthetic
agtaggaggcttgataggcttaagaataatttttgctgtgctatctatagtaaatagagttaggcagggatactc

SEQ ID NO: 191500 - DNA, 75 bp, Artificial Sequence
  Synthetic
taagaaccatcaaaatcctgtaccagagcagtaagtattggttaaaagtatatgtaatgtctaatttgttagcaa

SEQ ID NO: 191501 - DNA, 75 bp, Artificial Sequence
  Synthetic
cagtctcaggggactacagagggggtgggaagcccttaagtatctaggaaatcttgtgctgtattggggtctgga

SEQ ID NO: 191502 - DNA, 75 bp, Artificial Sequence
  Synthetic
cagagggagccatacaatgaatggacattagaacttttagaggagcttaagagtgaagctgttagacactttcct

SEQ ID NO: 191503 - DNA, 75 bp, Artificial Sequence
  Synthetic
ttaaactgtagtgatgcccgtgatgccaattctcaaaacagcaccctaaaggaagagaaaggggcaataaaaaac

SEQ ID NO: 191504 - DNA, 75 bp, Artificial Sequence
  Synthetic
agatggaacaagccccagaagaccaggggccgcagagagaaccatacaatgaatggacactagagattttagagg

SEQ ID NO: 191505 - DNA, 75 bp, Artificial Sequence
  Synthetic
agctataataagaatactgcaacaactactgtttattcatttcagaattgggtgccagcatagcagaataggcat

SEQ ID NO: 191506 - DNA, 75 bp, Artificial Sequence
  Synthetic
agaccaatggacataccaaatttatcaagagccatttaaaaatctaaaaacaggaaaatatgcaagaaaaaggtc

SEQ ID NO: 191507 - DNA, 75 bp, Artificial Sequence
  Synthetic
gcggagacagcgacgaagcactcctccaagcagtaaggatcatcaaaatcctgtatcaaagcagtaagtaccata

SEQ ID NO: 191508 - DNA, 75 bp, Artificial Sequence
  Synthetic
gttaaagtctcatttccctaataaaacaatatcatttaaccaacccgcaggaggggacctggaaattacaatgca

SEQ ID NO: 191509 - DNA, 75 bp, Artificial Sequence
  Synthetic
acccagattgtaagaccattttaaaagcattaggaccaggggctacattagaagaaatgatgacagcatgtcaag

SEQ ID NO: 191510 - DNA, 75 bp, Artificial Sequence
  Synthetic
gacaccttgttggtccaaaatgcgaacccagattgtaagaccattttaaaagcattaggaccaggggctacatta

SEQ ID NO: 191511 - DNA, 75 bp, Artificial Sequence
  Synthetic
agtctattatggggtacctgtgtggagagaagcaaaaactactctattctgtgcatcagatgctaaagcatatga

SEQ ID NO: 191512 - DNA, 75 bp, Artificial Sequence
  Synthetic
cataatgtctgggctacacatgcctgtgtacccacagaccccaatccacaagaaatagttttgggaaatgtaaca

SEQ ID NO: 191513 - DNA, 75 bp, Artificial Sequence
  Synthetic
gctaatgttaccagtatcaaaaatgaaatgcaaaattgctctttcaatgcaaccacagaaatagtagataaaaaa

SEQ ID NO: 191514 - DNA, 75 bp, Artificial Sequence
  Synthetic
aggacccgggaatgaaaaactgctctttcaatatggccacagaggtaacagataagaaaaaggtagtaaatgcac

SEQ ID NO: 191515 - DNA, 75 bp, Artificial Sequence
  Synthetic
agaaatacagaaacaagggcaagaccaatggacatatcaaatttatcaagaaccatttaaaaatctaaaaacagg

SEQ ID NO: 191516 - DNA, 75 bp, Artificial Sequence
  Synthetic
aagtgttgctttcattgccaagtttgcttcataaaaaaaggcttaggcatctcctatggcaggaagaagcggaga

SEQ ID NO: 191517 - DNA, 75 bp, Artificial Sequence
  Synthetic
ggcctgctataagggagagaatgagacgaactgcgccagcagcagaaggagtaggagcagcgtctcaagacttag

SEQ ID NO: 191518 - DNA, 75 bp, Artificial Sequence
  Synthetic
aatgtcagcacagtacagtgtacacatggcatcaggccagtagtgtccactcaactgttgttgaatggtagtctg

SEQ ID NO: 191519 - DNA, 75 bp, Artificial Sequence
  Synthetic
gaaaactcatctgcaccactaatgtgccttggaactctagttggagtaataaatctctggattacatttgggaaa

SEQ ID NO: 191520 - DNA, 75 bp, Artificial Sequence
  Synthetic
cctccaacaatacaagacaaagtgtacatatgggaccagggcaagcgctctatacaacaaaggtaataggagaaa

SEQ ID NO: 191521 - DNA, 75 bp, Artificial Sequence
  Synthetic
cctccaacaatacaagacaaagtgtacatatgggaccagggcaagcgctctatacaacaaaggtaataggagata

SEQ ID NO: 191522 - DNA, 75 bp, Artificial Sequence
  Synthetic
cctccaacaatacaagacaaagtgtacatatgggaccagggcaagcgctctatacaacaaaggtaataggagaca

SEQ ID NO: 191523 - DNA, 75 bp, Artificial Sequence
  Synthetic
cctccaacaatacaagacaaagtgtacatatgggaccagggcaagcgctctatacaacaaaggtaataggagaga

SEQ ID NO: 191524 - DNA, 75 bp, Artificial Sequence
  Synthetic
atgatgacagcatgtcagggagtggggggacccggccataaagcaagagttttggctgaagcaatgagccaagta

SEQ ID NO: 191525 - DNA, 75 bp, Artificial Sequence
  Synthetic
tggccagtaaaagtagtacacacagacaatggcagcaatttcaccagcgctgcagttaaagcagcctgttggtgg

SEQ ID NO: 191526 - DNA, 75 bp, Artificial Sequence
  Synthetic
aggaccaggacaaaccttctatgccacagatggcataataggggacataagaaaagcatattgtaacattagtga

SEQ ID NO: 191527 - DNA, 75 bp, Artificial Sequence
  Synthetic
acatatgggaccagggcaagcgctctatacaacaaaggtaataggagaaataagaaaagcatattgcaacgttag

SEQ ID NO: 191528 - DNA, 75 bp, Artificial Sequence
  Synthetic
acatatgggaccagggcaagcgctctatacaacaaaggtaataggagatataagaaaagcatattgcaacgttag

SEQ ID NO: 191529 - DNA, 75 bp, Artificial Sequence
  Synthetic
acatatgggaccagggcaagcgctctatacaacaaaggtaataggagacataagaaaagcatattgcaacgttag

SEQ ID NO: 191530 - DNA, 75 bp, Artificial Sequence
  Synthetic
acatatgggaccagggcaagcgctctatacaacaaaggtaataggagagataagaaaagcatattgcaacgttag

SEQ ID NO: 191531 - DNA, 75 bp, Artificial Sequence
  Synthetic
tgaattacatgcaatacatctagccttgcaggattcaggatcagaagtaaatatagtaacagactcacagtatgc

SEQ ID NO: 191532 - DNA, 75 bp, Artificial Sequence
  Synthetic
gaagttgcaacacatatctttaattgtagaggggaatttttctattgctatacctcaaagctgtttaatagtaca

SEQ ID NO: 191533 - DNA, 75 bp, Artificial Sequence
  Synthetic
cccagaagaccaagggccacagagagaaccccataatgaatggacactagaactgttagaagagcttaagaatga

SEQ ID NO: 191534 - DNA, 75 bp, Artificial Sequence
  Synthetic
gccctcaaatatctgtggaatctcgcgcagtattggagtcgggaactaaagaatagtgctattagcttgcttgac

SEQ ID NO: 191535 - DNA, 75 bp, Artificial Sequence
  Synthetic
gaaaaattacaaaaattgggcctgaaaatccatataacactccaatatttgccataaaaaagaaggacagtacta

SEQ ID NO: 191536 - DNA, 75 bp, Artificial Sequence
  Synthetic
aaatccatataacactccaatatttgccataaaaaagaaggacagtactaagtggagaaaattagtagatttcag

SEQ ID NO: 191537 - DNA, 75 bp, Artificial Sequence
  Synthetic
aagatacctaaaggatcaacagctcctagggatttggggctgctctggaaaactcatctgcaccactgctgtgcc

SEQ ID NO: 191538 - DNA, 75 bp, Artificial Sequence
  Synthetic
gattcttaccgcttgcctgggacgacctgcggagcctgtgcctcttcagctaccgccgattgagagactgcatat

SEQ ID NO: 191539 - DNA, 75 bp, Artificial Sequence
  Synthetic
ggtatataagaatatttataatgatagtaggaggcttgataggtttaagaataatttttgctgtgctctctatag

SEQ ID NO: 191540 - DNA, 75 bp, Artificial Sequence
  Synthetic
aaactgctcttttaatataaccacagaaataagagataagagaaggaaagaatacgcgcttttctataaacttga

SEQ ID NO: 191541 - DNA, 75 bp, Artificial Sequence
  Synthetic
aaagcactaacagacatagtaccactaactgaagaagcagaattagaattggcagagaacagggaaattctaaaa

SEQ ID NO: 191542 - DNA, 75 bp, Artificial Sequence
  Synthetic
gctattagcctgttagataccatagcaatagtagtagctgaaggaacagataggattatagaattcatacaagaa

SEQ ID NO: 191543 - DNA, 75 bp, Artificial Sequence
  Synthetic
tggatggcctgctgtaagggaaagaatgagaagagctgagccagcagcagagccagcagcagagggagtaggagc

SEQ ID NO: 191544 - DNA, 75 bp, Artificial Sequence
  Synthetic
aatggcagtttagcagaaagagaaataatgattagatctaaaaatatcacagacaataccaaaatcataatagtg

SEQ ID NO: 191545 - DNA, 75 bp, Artificial Sequence
  Synthetic
aagaaaaagtgtaggaatcggtccaggacaaacattttatgcaacaggtgacataataggaaatataagacaggc

SEQ ID NO: 191546 - DNA, 75 bp, Artificial Sequence
  Synthetic
actttaaattgtagcgatatcaatgtcactgtcaatggcactgtcgacaatagcacaagggaggaaataaaaaac

SEQ ID NO: 191547 - DNA, 75 bp, Artificial Sequence
  Synthetic
ggagatcacactcccatgtaagataaaacaaattgtgagaatgtggcagaaagtaggacaagcaatgtatgcccc

SEQ ID NO: 191548 - DNA, 75 bp, Artificial Sequence
  Synthetic
acagcaggcaaaggcagctgacggaaagatcagtcaaaattatcctatagtgcagaatcttcaagggcaaatggt

SEQ ID NO: 191549 - DNA, 75 bp, Artificial Sequence
  Synthetic
attgtggaacttctgggacgcagggggtgggagacactcaagtattggtggaacatcctgcagtattggggtcag

SEQ ID NO: 191550 - DNA, 75 bp, Artificial Sequence
  Synthetic
taggaaattagtagaggatagatggaacaacccccagaagaccaggggccgcagagggagccatacaatgaatgg

SEQ ID NO: 191551 - DNA, 75 bp, Artificial Sequence
  Synthetic
gcaacagaaacatatctgttgaaatgaaaggggaaataaaaaactgctctttcaatatgaccacagtattaagag

SEQ ID NO: 191552 - DNA, 75 bp, Artificial Sequence
  Synthetic
acatcaaatgaaagattgtactgaaaggcaggctaattttttagggagattttggccttcccagaaggggaggcc

SEQ ID NO: 191553 - DNA, 75 bp, Artificial Sequence
  Synthetic
tcccttagataaggagttcaggaagtacactgcatttaccatacctagtctcaacaatgagacaccaggaatcag

SEQ ID NO: 191554 - DNA, 75 bp, Artificial Sequence
  Synthetic
agatagagttatagaagtagcacaaagagcttgtagagctattctcaacatacctagaaggataagacagggctt

SEQ ID NO: 191555 - DNA, 75 bp, Artificial Sequence
  Synthetic
actcatttgcaccactaatgtgccctggaactctagttggagtaataaatctcagaatgagatatggggaaacat

SEQ ID NO: 191556 - DNA, 75 bp, Artificial Sequence
  Synthetic
gttggctggcctgcagtaagggaaagaataagacaagcccctgcccctccagcagcagaaggagcaggagcagta

SEQ ID NO: 191557 - DNA, 75 bp, Artificial Sequence
  Synthetic
aagactttagaaaatatactgcattcaccatacctagtacaaacaatgagacaccaggaattagatatcagtaca

SEQ ID NO: 191558 - DNA, 75 bp, Artificial Sequence
  Synthetic
tgtatcagagcagtaagtatatgtaatggtgaagttactagaaagagtagattatagattaggagtaggagcttt

SEQ ID NO: 191559 - DNA, 75 bp, Artificial Sequence
  Synthetic
agatgcatgaggatataatcagtttatgggatcaaagcctaaagccatgtgtaaaattaaccccactctgtgtca

SEQ ID NO: 191560 - DNA, 75 bp, Artificial Sequence
  Synthetic
tgtttttagatggaatagataaggcacaagacgagcatgaaaaatatcacagcaattggagagcaatggctagtg

SEQ ID NO: 191561 - DNA, 75 bp, Artificial Sequence
  Synthetic
agaaagggtgaagaaaaaattaggagaacacttctctaataagacaacaataaaattccaaccaccctcaggagg

SEQ ID NO: 191562 - DNA, 75 bp, Artificial Sequence
  Synthetic
gaatggtactagtagcactaatagtactagtggcgctaatagtactaatagtactaatagttgggaaaagatgcc

SEQ ID NO: 191563 - DNA, 75 bp, Artificial Sequence
  Synthetic
gaatggtactagttgcactaatagtactagtggcgctaatagtactaatagtactaatagttgggaaaagatgcc

SEQ ID NO: 191564 - DNA, 75 bp, Artificial Sequence
  Synthetic
gaatggtactagtcgcactaatagtactagtggcgctaatagtactaatagtactaatagttgggaaaagatgcc

SEQ ID NO: 191565 - DNA, 75 bp, Artificial Sequence
  Synthetic
gaatggtactagtggcactaatagtactagtggcgctaatagtactaatagtactaatagttgggaaaagatgcc

SEQ ID NO: 191566 - DNA, 75 bp, Artificial Sequence
  Synthetic
aaatgctactaaaaaaccaaatgaagaaataaaaaattgctctttcaatacaatcacagaggtaagagataagca

SEQ ID NO: 191567 - DNA, 75 bp, Artificial Sequence
  Synthetic
acatcacactcccatgcagaataaaacaaattataaacatgtggcagggggtaggacgagcaatgtatgctcctc

SEQ ID NO: 191568 - DNA, 75 bp, Artificial Sequence
  Synthetic
tatctaccaatacatggatgatttgtatgtagggtctgacttagaaataggacagcatagaacaaaaatagagga

SEQ ID NO: 191569 - DNA, 75 bp, Artificial Sequence
  Synthetic
aataggaccaggacaatcattctatgcaacaggagacataataggaaatataagacaagcacattgtaacattag

SEQ ID NO: 191570 - DNA, 75 bp, Artificial Sequence
  Synthetic
gtggcgcccgaacagggaccggaagttaatagggacgcgaaagcgaaagttccagagaagtatctcgacgcacgg

SEQ ID NO: 191571 - DNA, 75 bp, Artificial Sequence
  Synthetic
aaaattgctctttcaatacaaccacagtattaagagataggaagcagacagagtatgcacttttttatagacttg

SEQ ID NO: 191572 - DNA, 75 bp, Artificial Sequence
  Synthetic
ttgctaccactgctttgcaatgaagggcttaggcatctcctatggcaggaagaagcggagacagcgacacagaac

SEQ ID NO: 191573 - DNA, 75 bp, Artificial Sequence
  Synthetic
catcacaatcccatgcagaataaagcaaattataaacatgtggcaggaggtaggacgagcaatgtatgcccctcc

SEQ ID NO: 191574 - DNA, 75 bp, Artificial Sequence
  Synthetic
tcctccgagcagtcagaaccatcaagatcctgtaccaaagcagtgagtattgataagtagtgtatgtaatgtcag

SEQ ID NO: 191575 - DNA, 75 bp, Artificial Sequence
  Synthetic
ttgctttctgacaaaaggcttaggcatttcctatggcaggaagaagcggagacagcgacgaagcgctcctccaag

SEQ ID NO: 191576 - DNA, 75 bp, Artificial Sequence
  Synthetic
taataaggtaggatctctacaatacttggcactgacagcattgataaaaccaaaaaagataaagccacctctgcc

SEQ ID NO: 191577 - DNA, 75 bp, Artificial Sequence
  Synthetic
gtctgcccacactaatgatgtaaaacaattaacagaagtagtgcaaaaaatagccacagaaagcatagtaatatg

SEQ ID NO: 191578 - DNA, 75 bp, Artificial Sequence
  Synthetic
taggattatagaaatagtacaaagaatctttagagctttaattcacatacctagaagaataagacagggcttgga

SEQ ID NO: 191579 - DNA, 75 bp, Artificial Sequence
  Synthetic
gtcctcaacctacctagaagagtaagacagggctttgaagcagctttgctgtaaaatggggggcaagtggtcaaa

SEQ ID NO: 191580 - DNA, 75 bp, Artificial Sequence
  Synthetic
gcttcataacaaaaggcttaggcatctcctatggcaggaagaagcggagacagcgacgaagacctcctcaaagca

SEQ ID NO: 191581 - DNA, 75 bp, Artificial Sequence
  Synthetic
ctctaacagcaccacccccaacaccctggtagaagagaaaggggaaataaaaaactgttcttttaatatgaccac

SEQ ID NO: 191582 - DNA, 75 bp, Artificial Sequence
  Synthetic
ctacctggcatgggtaccagcacacaaaggaattggaggaaatgaacaagtagataaattagtcagtactggaat

SEQ ID NO: 191583 - DNA, 75 bp, Artificial Sequence
  Synthetic
accagcaggaaagaaatgaaaaagatttattagcattggacagttggaaaaatctatggaattggtttgacataa

SEQ ID NO: 191584 - DNA, 75 bp, Artificial Sequence
  Synthetic
atctgtgcaatagtaggactgatagtagcgctaatcatagcaatagttgtatggactatagtaggtatagaatat

SEQ ID NO: 191585 - DNA, 75 bp, Artificial Sequence
  Synthetic
atagcagcaattatagtagcactaatcttagcaataattgtgtggaccatagtatatctagaatataggaaacta

SEQ ID NO: 191586 - DNA, 75 bp, Artificial Sequence
  Synthetic
ctagtgacatgaaaaattgctccttcaatgcaaccacagaagtaacagataaaataagaaaagagaatgcacttt

SEQ ID NO: 191587 - DNA, 75 bp, Artificial Sequence
  Synthetic
agtgtagagatataaagttcaatggaacagggccatgcaaaaatgtcagcacagtacaatgtacacatggaatca

SEQ ID NO: 191588 - DNA, 75 bp, Artificial Sequence
  Synthetic
gctggaaagatttgcacttaaccctggccttttagaaacatcagaaggctgtaaacagataataaaacagctaca

SEQ ID NO: 191589 - DNA, 75 bp, Artificial Sequence
  Synthetic
cctaatagtactaatagcaatactaatgccactagcaatactactgaagatacaggaatgaaaaactgctcatac

SEQ ID NO: 191590 - DNA, 75 bp, Artificial Sequence
  Synthetic
aattgctctttcaatgtaaccacagaattaagagataagagaaagaatgtgtatgcacttttttataaacttgat

SEQ ID NO: 191591 - DNA, 75 bp, Artificial Sequence
  Synthetic
acatcaagcagccatgcaaatgttaaaagataccatcaatgaggaggctgcagaatgggatagattacatccagt

SEQ ID NO: 191592 - DNA, 75 bp, Artificial Sequence
  Synthetic
gtagtgagtatagattaataaattgtaatacctcagccattacacaggcttgcccaaaggtaacctttgagccaa

SEQ ID NO: 191593 - DNA, 75 bp, Artificial Sequence
  Synthetic
agcacacaaatagatcctgaactagcagaccaactgattcatctgcattattttgattgtttttcagaatctgcc

SEQ ID NO: 191594 - DNA, 75 bp, Artificial Sequence
  Synthetic
cagaggaacttagatcattattcaacacagtagcaactctctattgtgtacataaagggatagatgtacgagaca

SEQ ID NO: 191595 - DNA, 75 bp, Artificial Sequence
  Synthetic
aagcattctatgcagcaggtgaaataataggagatataagacaggcacattgtaatgtcagtagatcaaaatgga

SEQ ID NO: 191596 - DNA, 75 bp, Artificial Sequence
  Synthetic
cacagtctggggcattaagcagctccaggcaagagtcctggctgtggaaagatacctaaaggatcaacagctcct

SEQ ID NO: 191597 - DNA, 75 bp, Artificial Sequence
  Synthetic
acctttgcctagtgttaagaaattaacagaagatagatggaacaagccccagaagaccaggggccacagagagaa

SEQ ID NO: 191598 - DNA, 75 bp, Artificial Sequence
  Synthetic
tgcactgatttaaggaatgttactaacaccactagtagtagtgagggaatgatggagaaaggagaaatgaagaat

SEQ ID NO: 191599 - DNA, 75 bp, Artificial Sequence
  Synthetic
tacaagacccagcaacaatacaagaaaaagtatacatatgggaccaggcaaagcattttgggcaacaggagaaat

SEQ ID NO: 191600 - DNA, 75 bp, Artificial Sequence
  Synthetic
aaagagctggtagagctattctccacatacctagaagaataagacagggcttagaaagggctttgctataaaatg

SEQ ID NO: 191601 - DNA, 75 bp, Artificial Sequence
  Synthetic
tagttggatggcctgctgtaagggaaagaatgagacgaacccctccagcagcagaaggggtgggagcagtgtctc

SEQ ID NO: 191602 - DNA, 75 bp, Artificial Sequence
  Synthetic
aataaaacaatagcctttaaccaatcctcaggaggggacccagaaattacaatgttcaattttaattgtggaggg

SEQ ID NO: 191603 - DNA, 75 bp, Artificial Sequence
  Synthetic
atttggaattccctacaatccccaaagccaaggagtagtggaatctatgaataaagaattaaagaaaattatagg

SEQ ID NO: 191604 - DNA, 75 bp, Artificial Sequence
  Synthetic
aaaggatcaccagcaatattccagtgtagcatgacaaaaatcttagagccctttagagcaaaaaatccagaaata

SEQ ID NO: 191605 - DNA, 75 bp, Artificial Sequence
  Synthetic
actggaaacaactccattttcactgaagaaatgaaaaactgctcttacaatattaccacagaactaagagataag

SEQ ID NO: 191606 - DNA, 75 bp, Artificial Sequence
  Synthetic
cacaagcttgtccaaaggtatcctttgagccaattcctatacattattgtgccccagctggttttgcgattctaa

SEQ ID NO: 191607 - DNA, 75 bp, Artificial Sequence
  Synthetic
agcagcagaaggggtgggagctgcatctcgggacctggaaagacatggggcaatcacaagtagcaatacagcaca

SEQ ID NO: 191608 - DNA, 75 bp, Artificial Sequence
  Synthetic
atacaagaaaaagtatacgctttggaccaggacaagccttctatacaaacagcataataggggatataagacaag

SEQ ID NO: 191609 - DNA, 75 bp, Artificial Sequence
  Synthetic
aatgtgacagaagagtttaacatgtggaaaaataacatggtagagcagatgcatacagatataatcagtctatgg

SEQ ID NO: 191610 - DNA, 75 bp, Artificial Sequence
  Synthetic
cctcccagcccagaggggacccgacaggcccgaaggaatcgaagaagaaggtggagagagagacagagacagatc

SEQ ID NO: 191611 - DNA, 75 bp, Artificial Sequence
  Synthetic
ttaacggacaggcaacagaaagtacattcacttttttatagccttgatctagcacaaatgggtaatagtagttat

SEQ ID NO: 191612 - DNA, 75 bp, Artificial Sequence
  Synthetic
agggataaaggtacaagacaccaaggaagccctagacaagatagaggaagaacaaaacaaaagtcagcaaaaaac

SEQ ID NO: 191613 - DNA, 75 bp, Artificial Sequence
  Synthetic
aagaataagacagggctttgaaagggctttgctataaaatgggtggcaagtggtcaaaaagtagtatagtgggat

SEQ ID NO: 191614 - DNA, 75 bp, Artificial Sequence
  Synthetic
cctaacaataatacaaaaagaggtctacgtataggaccaggaagaacactctatgcagcagataaaataataggg

SEQ ID NO: 191615 - DNA, 75 bp, Artificial Sequence
  Synthetic
tggcagaccaactaattcatatacattattttgattgttttgcagaatctgccataagaaaagccatattaggac

SEQ ID NO: 191616 - DNA, 75 bp, Artificial Sequence
  Synthetic
ttagtagaggatagatggaacaacccccagaagatcaggggccgcagagggaaccatacaatgaatggacactag

SEQ ID NO: 191617 - DNA, 75 bp, Artificial Sequence
  Synthetic
ggagatatagcacacaagtagaccctgacctagcagaccaactaattcatctgtattattttgattgtttttcag

SEQ ID NO: 191618 - DNA, 75 bp, Artificial Sequence
  Synthetic
ctataactctcccatgcaaaataaagcaagttgtaagaatgtggcagagagtaggacaagcagtatatgcccctc

SEQ ID NO: 191619 - DNA, 75 bp, Artificial Sequence
  Synthetic
acaggcccgaaagaatcgaagaaggaggtggcgagcaagacagagacagatccgtgagattagtgagcggattct

SEQ ID NO: 191620 - DNA, 75 bp, Artificial Sequence
  Synthetic
cagtagctaactggacagatagggttatagaagcagcacaaggagcttgtagagctattcgcaacgtaccaagaa

SEQ ID NO: 191621 - DNA, 75 bp, Artificial Sequence
  Synthetic
atggatgacaagcaacccacctgtcccagtgggagacatctataaaagatggatcatcctaggattaaataaaat

SEQ ID NO: 191622 - DNA, 75 bp, Artificial Sequence
  Synthetic
agtaagaatgtatagccctgtcagcattttggacataaaacaagggccaaaagaaccctttagagactatgtaga

SEQ ID NO: 191623 - DNA, 75 bp, Artificial Sequence
  Synthetic
cgcgacgaagacctccttcagaccgtcaggttcatcaagtttctctatcaaagcagtgagtagtacatgtaatgc

SEQ ID NO: 191624 - DNA, 75 bp, Artificial Sequence
  Synthetic
aaacccctccagcagcagaaggagtaggagcagtatctcaagatttagctaggcatggagcaatcacaagcagca

SEQ ID NO: 191625 - DNA, 75 bp, Artificial Sequence
  Synthetic
aggaggggatgtagaaattatgacacatacttttaattgtggaggagaatttttctattgcaatacatcaagact

SEQ ID NO: 191626 - DNA, 75 bp, Artificial Sequence
  Synthetic
tattggggtctgcagacaggagaaaaagattggcacttgggtcatggagtctccatagaatggaggcagggaaaa

SEQ ID NO: 191627 - DNA, 75 bp, Artificial Sequence
  Synthetic
ggaaggacaccaaatgaaagattgtactgaaagacaggctaattttttagggagaatctggccttcccacaaggg

SEQ ID NO: 191628 - DNA, 75 bp, Artificial Sequence
  Synthetic
ttaacagaagatagatggaacaagccccagaagatcaggggccacagagagaaccctacaatgaatggacattag

SEQ ID NO: 191629 - DNA, 75 bp, Artificial Sequence
  Synthetic
aagtggggatttaccacaccagacaagaaacatcagaaagaacccccatttctttggatggggtatgaactccat

SEQ ID NO: 191630 - DNA, 75 bp, Artificial Sequence
  Synthetic
agtttgctttcagacaaaaggcttaggcatttactatggcaggaagaagcggagacagcgacgaagcactcctcc

SEQ ID NO: 191631 - DNA, 75 bp, Artificial Sequence
  Synthetic
ggagacagcgacgaagcactcctccaagcagtgaggatcatcaaaatcctctacgaaagcagtaagtatttgtaa

SEQ ID NO: 191632 - DNA, 75 bp, Artificial Sequence
  Synthetic
aacaacaactccctctcagaagcaggagacggtggacaaggaaaagtatcctttagcttccctcagatcactctt

SEQ ID NO: 191633 - DNA, 75 bp, Artificial Sequence
  Synthetic
aacaacaactccctctcagaagcaggagacggtggacaaggaaatgtatcctttagcttccctcagatcactctt

SEQ ID NO: 191634 - DNA, 75 bp, Artificial Sequence
  Synthetic
aacaacaactccctctcagaagcaggagacggtggacaaggaaacgtatcctttagcttccctcagatcactctt

SEQ ID NO: 191635 - DNA, 75 bp, Artificial Sequence
  Synthetic
aacaacaactccctctcagaagcaggagacggtggacaaggaaaggtatcctttagcttccctcagatcactctt

SEQ ID NO: 191636 - DNA, 75 bp, Artificial Sequence
  Synthetic
aacaacaactccctctcagaagcaggagacggtggacaaggataagtatcctttagcttccctcagatcactctt

SEQ ID NO: 191637 - DNA, 75 bp, Artificial Sequence
  Synthetic
aacaacaactccctctcagaagcaggagacggtggacaaggatatgtatcctttagcttccctcagatcactctt

SEQ ID NO: 191638 - DNA, 75 bp, Artificial Sequence
  Synthetic
aacaacaactccctctcagaagcaggagacggtggacaaggatacgtatcctttagcttccctcagatcactctt

SEQ ID NO: 191639 - DNA, 75 bp, Artificial Sequence
  Synthetic
aacaacaactccctctcagaagcaggagacggtggacaaggataggtatcctttagcttccctcagatcactctt

SEQ ID NO: 191640 - DNA, 75 bp, Artificial Sequence
  Synthetic
aacaacaactccctctcagaagcaggagacggtggacaaggacaagtatcctttagcttccctcagatcactctt

SEQ ID NO: 191641 - DNA, 75 bp, Artificial Sequence
  Synthetic
aacaacaactccctctcagaagcaggagacggtggacaaggacatgtatcctttagcttccctcagatcactctt

SEQ ID NO: 191642 - DNA, 75 bp, Artificial Sequence
  Synthetic
aacaacaactccctctcagaagcaggagacggtggacaaggacacgtatcctttagcttccctcagatcactctt

SEQ ID NO: 191643 - DNA, 75 bp, Artificial Sequence
  Synthetic
aacaacaactccctctcagaagcaggagacggtggacaaggacaggtatcctttagcttccctcagatcactctt

SEQ ID NO: 191644 - DNA, 75 bp, Artificial Sequence
  Synthetic
aacaacaactccctctcagaagcaggagacggtggacaaggagaagtatcctttagcttccctcagatcactctt

SEQ ID NO: 191645 - DNA, 75 bp, Artificial Sequence
  Synthetic
aacaacaactccctctcagaagcaggagacggtggacaaggagatgtatcctttagcttccctcagatcactctt

SEQ ID NO: 191646 - DNA, 75 bp, Artificial Sequence
  Synthetic
aacaacaactccctctcagaagcaggagacggtggacaaggagacgtatcctttagcttccctcagatcactctt

SEQ ID NO: 191647 - DNA, 75 bp, Artificial Sequence
  Synthetic
aacaacaactccctctcagaagcaggagacggtggacaaggagaggtatcctttagcttccctcagatcactctt

SEQ ID NO: 191648 - DNA, 75 bp, Artificial Sequence
  Synthetic
tacaacaactccctctcagaagcaggagacggtggacaaggaaaagtatcctttagcttccctcagatcactctt

SEQ ID NO: 191649 - DNA, 75 bp, Artificial Sequence
  Synthetic
tacaacaactccctctcagaagcaggagacggtggacaaggaaatgtatcctttagcttccctcagatcactctt

SEQ ID NO: 191650 - DNA, 75 bp, Artificial Sequence
  Synthetic
tacaacaactccctctcagaagcaggagacggtggacaaggaaacgtatcctttagcttccctcagatcactctt

SEQ ID NO: 191651 - DNA, 75 bp, Artificial Sequence
  Synthetic
tacaacaactccctctcagaagcaggagacggtggacaaggaaaggtatcctttagcttccctcagatcactctt

SEQ ID NO: 191652 - DNA, 75 bp, Artificial Sequence
  Synthetic
tacaacaactccctctcagaagcaggagacggtggacaaggataagtatcctttagcttccctcagatcactctt

SEQ ID NO: 191653 - DNA, 75 bp, Artificial Sequence
  Synthetic
tacaacaactccctctcagaagcaggagacggtggacaaggatatgtatcctttagcttccctcagatcactctt

SEQ ID NO: 191654 - DNA, 75 bp, Artificial Sequence
  Synthetic
tacaacaactccctctcagaagcaggagacggtggacaaggatacgtatcctttagcttccctcagatcactctt

SEQ ID NO: 191655 - DNA, 75 bp, Artificial Sequence
  Synthetic
tacaacaactccctctcagaagcaggagacggtggacaaggataggtatcctttagcttccctcagatcactctt

SEQ ID NO: 191656 - DNA, 75 bp, Artificial Sequence
  Synthetic
tacaacaactccctctcagaagcaggagacggtggacaaggacaagtatcctttagcttccctcagatcactctt

SEQ ID NO: 191657 - DNA, 75 bp, Artificial Sequence
  Synthetic
tacaacaactccctctcagaagcaggagacggtggacaaggacatgtatcctttagcttccctcagatcactctt

SEQ ID NO: 191658 - DNA, 75 bp, Artificial Sequence
  Synthetic
tacaacaactccctctcagaagcaggagacggtggacaaggacacgtatcctttagcttccctcagatcactctt

SEQ ID NO: 191659 - DNA, 75 bp, Artificial Sequence
  Synthetic
tacaacaactccctctcagaagcaggagacggtggacaaggacaggtatcctttagcttccctcagatcactctt

SEQ ID NO: 191660 - DNA, 75 bp, Artificial Sequence
  Synthetic
tacaacaactccctctcagaagcaggagacggtggacaaggagaagtatcctttagcttccctcagatcactctt

SEQ ID NO: 191661 - DNA, 75 bp, Artificial Sequence
  Synthetic
tacaacaactccctctcagaagcaggagacggtggacaaggagatgtatcctttagcttccctcagatcactctt

SEQ ID NO: 191662 - DNA, 75 bp, Artificial Sequence
  Synthetic
tacaacaactccctctcagaagcaggagacggtggacaaggagacgtatcctttagcttccctcagatcactctt

SEQ ID NO: 191663 - DNA, 75 bp, Artificial Sequence
  Synthetic
tacaacaactccctctcagaagcaggagacggtggacaaggagaggtatcctttagcttccctcagatcactctt

SEQ ID NO: 191664 - DNA, 75 bp, Artificial Sequence
  Synthetic
cacaacaactccctctcagaagcaggagacggtggacaaggaaaagtatcctttagcttccctcagatcactctt

SEQ ID NO: 191665 - DNA, 75 bp, Artificial Sequence
  Synthetic
cacaacaactccctctcagaagcaggagacggtggacaaggaaatgtatcctttagcttccctcagatcactctt

SEQ ID NO: 191666 - DNA, 75 bp, Artificial Sequence
  Synthetic
cacaacaactccctctcagaagcaggagacggtggacaaggaaacgtatcctttagcttccctcagatcactctt

SEQ ID NO: 191667 - DNA, 75 bp, Artificial Sequence
  Synthetic
cacaacaactccctctcagaagcaggagacggtggacaaggaaaggtatcctttagcttccctcagatcactctt

SEQ ID NO: 191668 - DNA, 75 bp, Artificial Sequence
  Synthetic
cacaacaactccctctcagaagcaggagacggtggacaaggataagtatcctttagcttccctcagatcactctt

SEQ ID NO: 191669 - DNA, 75 bp, Artificial Sequence
  Synthetic
cacaacaactccctctcagaagcaggagacggtggacaaggatatgtatcctttagcttccctcagatcactctt

SEQ ID NO: 191670 - DNA, 75 bp, Artificial Sequence
  Synthetic
cacaacaactccctctcagaagcaggagacggtggacaaggatacgtatcctttagcttccctcagatcactctt

SEQ ID NO: 191671 - DNA, 75 bp, Artificial Sequence
  Synthetic
cacaacaactccctctcagaagcaggagacggtggacaaggataggtatcctttagcttccctcagatcactctt

SEQ ID NO: 191672 - DNA, 75 bp, Artificial Sequence
  Synthetic
cacaacaactccctctcagaagcaggagacggtggacaaggacaagtatcctttagcttccctcagatcactctt

SEQ ID NO: 191673 - DNA, 75 bp, Artificial Sequence
  Synthetic
cacaacaactccctctcagaagcaggagacggtggacaaggacatgtatcctttagcttccctcagatcactctt

SEQ ID NO: 191674 - DNA, 75 bp, Artificial Sequence
  Synthetic
cacaacaactccctctcagaagcaggagacggtggacaaggacacgtatcctttagcttccctcagatcactctt

SEQ ID NO: 191675 - DNA, 75 bp, Artificial Sequence
  Synthetic
cacaacaactccctctcagaagcaggagacggtggacaaggacaggtatcctttagcttccctcagatcactctt

SEQ ID NO: 191676 - DNA, 75 bp, Artificial Sequence
  Synthetic
cacaacaactccctctcagaagcaggagacggtggacaaggagaagtatcctttagcttccctcagatcactctt

SEQ ID NO: 191677 - DNA, 75 bp, Artificial Sequence
  Synthetic
cacaacaactccctctcagaagcaggagacggtggacaaggagatgtatcctttagcttccctcagatcactctt

SEQ ID NO: 191678 - DNA, 75 bp, Artificial Sequence
  Synthetic
cacaacaactccctctcagaagcaggagacggtggacaaggagacgtatcctttagcttccctcagatcactctt

SEQ ID NO: 191679 - DNA, 75 bp, Artificial Sequence
  Synthetic
cacaacaactccctctcagaagcaggagacggtggacaaggagaggtatcctttagcttccctcagatcactctt

SEQ ID NO: 191680 - DNA, 75 bp, Artificial Sequence
  Synthetic
gacaacaactccctctcagaagcaggagacggtggacaaggaaaagtatcctttagcttccctcagatcactctt

SEQ ID NO: 191681 - DNA, 75 bp, Artificial Sequence
  Synthetic
gacaacaactccctctcagaagcaggagacggtggacaaggaaatgtatcctttagcttccctcagatcactctt

SEQ ID NO: 191682 - DNA, 75 bp, Artificial Sequence
  Synthetic
gacaacaactccctctcagaagcaggagacggtggacaaggaaacgtatcctttagcttccctcagatcactctt

SEQ ID NO: 191683 - DNA, 75 bp, Artificial Sequence
  Synthetic
gacaacaactccctctcagaagcaggagacggtggacaaggaaaggtatcctttagcttccctcagatcactctt

SEQ ID NO: 191684 - DNA, 75 bp, Artificial Sequence
  Synthetic
gacaacaactccctctcagaagcaggagacggtggacaaggataagtatcctttagcttccctcagatcactctt

SEQ ID NO: 191685 - DNA, 75 bp, Artificial Sequence
  Synthetic
gacaacaactccctctcagaagcaggagacggtggacaaggatatgtatcctttagcttccctcagatcactctt

SEQ ID NO: 191686 - DNA, 75 bp, Artificial Sequence
  Synthetic
gacaacaactccctctcagaagcaggagacggtggacaaggatacgtatcctttagcttccctcagatcactctt

SEQ ID NO: 191687 - DNA, 75 bp, Artificial Sequence
  Synthetic
gacaacaactccctctcagaagcaggagacggtggacaaggataggtatcctttagcttccctcagatcactctt

SEQ ID NO: 191688 - DNA, 75 bp, Artificial Sequence
  Synthetic
gacaacaactccctctcagaagcaggagacggtggacaaggacaagtatcctttagcttccctcagatcactctt

SEQ ID NO: 191689 - DNA, 75 bp, Artificial Sequence
  Synthetic
gacaacaactccctctcagaagcaggagacggtggacaaggacatgtatcctttagcttccctcagatcactctt

SEQ ID NO: 191690 - DNA, 75 bp, Artificial Sequence
  Synthetic
gacaacaactccctctcagaagcaggagacggtggacaaggacacgtatcctttagcttccctcagatcactctt

SEQ ID NO: 191691 - DNA, 75 bp, Artificial Sequence
  Synthetic
gacaacaactccctctcagaagcaggagacggtggacaaggacaggtatcctttagcttccctcagatcactctt

SEQ ID NO: 191692 - DNA, 75 bp, Artificial Sequence
  Synthetic
gacaacaactccctctcagaagcaggagacggtggacaaggagaagtatcctttagcttccctcagatcactctt

SEQ ID NO: 191693 - DNA, 75 bp, Artificial Sequence
  Synthetic
gacaacaactccctctcagaagcaggagacggtggacaaggagatgtatcctttagcttccctcagatcactctt

SEQ ID NO: 191694 - DNA, 75 bp, Artificial Sequence
  Synthetic
gacaacaactccctctcagaagcaggagacggtggacaaggagacgtatcctttagcttccctcagatcactctt

SEQ ID NO: 191695 - DNA, 75 bp, Artificial Sequence
  Synthetic
gacaacaactccctctcagaagcaggagacggtggacaaggagaggtatcctttagcttccctcagatcactctt

SEQ ID NO: 191696 - DNA, 75 bp, Artificial Sequence
  Synthetic
gtcagtaatagtactacccatgatagggatgacattagcaggaaggacgtaatgaaagactgctctttcagtttc

SEQ ID NO: 191697 - DNA, 75 bp, Artificial Sequence
  Synthetic
tattgaaactgtaccagtaaaattaaaaccaggaatggatggcccaaaagttaaacaatggccattgacagaaga

SEQ ID NO: 191698 - DNA, 75 bp, Artificial Sequence
  Synthetic
aagtctgtggagttggtttagcataacaaattggctgtggtatataaaaatatttataatgatagtaggaggctt

SEQ ID NO: 191699 - DNA, 75 bp, Artificial Sequence
  Synthetic
caaataatggaacagttacaaccagctctcaagacaggaacagaagaacttagatcattatataatacagtagca

SEQ ID NO: 191700 - DNA, 75 bp, Artificial Sequence
  Synthetic
atacatatgggatgggggagagcattttatacaaatggacaaataataggaaatataagacaagcacattgtaat

SEQ ID NO: 191701 - DNA, 75 bp, Artificial Sequence
  Synthetic
tataacagatgaagtaaaaaactgttcttttaatatgaccacagaactaagagataagaagcagaaggtctatgc

SEQ ID NO: 191702 - DNA, 75 bp, Artificial Sequence
  Synthetic
ggcagcaagctttcaaaaagccgcatagtgggatgggctagggttagggaaagactaagacgaacccctccaaca

SEQ ID NO: 191703 - DNA, 75 bp, Artificial Sequence
  Synthetic
gctacgaatggtgcccacaataatacctaccttgagggcatggataaggaaataaaaaattgctcttttaataca

SEQ ID NO: 191704 - DNA, 75 bp, Artificial Sequence
  Synthetic
ccagtacatggagtgtattatgacccatcaaaagatttaatagcagaaatacagaagcaagggcaaggccaatgg

SEQ ID NO: 191705 - DNA, 75 bp, Artificial Sequence
  Synthetic
gtggaattggtttgacatatcaaagtggctgtggtatataaaaatattcatcatgatagtaggaggcttaatagg

SEQ ID NO: 191706 - DNA, 75 bp, Artificial Sequence
  Synthetic
ctctggaaaactcatctgcaccactgctgtgccttggaatgctagttggagtaataaatcttataatgagatttg

SEQ ID NO: 191707 - DNA, 75 bp, Artificial Sequence
  Synthetic
atcgcagaaccagcaggaaaagaatgaacaagaattattggaattggataagtgggcaagtttgtggaattggtt

SEQ ID NO: 191708 - DNA, 75 bp, Artificial Sequence
  Synthetic
caatgaatggacactagagattctagaggaactcaagcaggaagctgtcagacactttcctagaccatggctcca

SEQ ID NO: 191709 - DNA, 75 bp, Artificial Sequence
  Synthetic
tgtgtacatcaaaggatagaaataaaagacaccaaggaagccttagataagttagaggaagtacaaaataagagc

SEQ ID NO: 191710 - DNA, 75 bp, Artificial Sequence
  Synthetic
tagtgagcggattcttagctcttgcctgggacgacctacggagcctgtgcctcttcagctaccaccgcttgagag

SEQ ID NO: 191711 - DNA, 75 bp, Artificial Sequence
  Synthetic
gcatatttttcagttcctttacatgaagactttagaaagtatactgcattcaccatacctagtacaaacaatgag

SEQ ID NO: 191712 - DNA, 75 bp, Artificial Sequence
  Synthetic
aaagggcttaggcatctcctatggcaggaagaagcggagacagcgacacagaactcctcaaagcagtcagctaca

SEQ ID NO: 191713 - DNA, 75 bp, Artificial Sequence
  Synthetic
gaactcctcaaagcagtcagctacatcaagatcctgtaccaaagcagtaagtattgttaagtaatatatgtaatg

SEQ ID NO: 191714 - DNA, 75 bp, Artificial Sequence
  Synthetic
acctagagccctggaaccatccaggaagtcagcctagcactccttgtaacaagtgttattgtaaaaagtgctgct

SEQ ID NO: 191715 - DNA, 75 bp, Artificial Sequence
  Synthetic
aagtcagcctagcactccttgtaacaagtgttattgtaaaaagtgctgctatcattgccaactttgcttcacaac

SEQ ID NO: 191716 - DNA, 75 bp, Artificial Sequence
  Synthetic
aggcaatactacctatggaggagaaatgagaaattgctctttcaatataaccacagaattaagagataagaaaag

SEQ ID NO: 191717 - DNA, 75 bp, Artificial Sequence
  Synthetic
tcaagtccatataccaaagcagtaagtagtatatgtaatgcaatctttagagataatatcaatagtagcattagt

SEQ ID NO: 191718 - DNA, 75 bp, Artificial Sequence
  Synthetic
actttaaatgcatgggtaaaagtaatagaagaaaaggctttcagcccagaagtaatacccatgttttcagcatta

SEQ ID NO: 191719 - DNA, 75 bp, Artificial Sequence
  Synthetic
agagaaagagcagaagatagtggcaatgagagtgatggagacagggaggaattatcagctttcgtggggatgggg

SEQ ID NO: 191720 - DNA, 75 bp, Artificial Sequence
  Synthetic
ggcaatacaaaactgttctttcaatatgaccacagaagtaagagataagcagctgaaagtacatgcactttttta

SEQ ID NO: 191721 - DNA, 75 bp, Artificial Sequence
  Synthetic
agctaaaaaagagtgctattagtctgcttgataccatagcaatagcagtagctgaaggaacagataggattatag

SEQ ID NO: 191722 - DNA, 75 bp, Artificial Sequence
  Synthetic
taatgaaactattgttggtggtaccgatagtgacataaaaaactgctctttcaatatgaccacagaactaagaga

SEQ ID NO: 191723 - DNA, 75 bp, Artificial Sequence
  Synthetic
aaaaagtgttgctttcattgccaagtttgtttcataacaaaaggcttaggcatctcctatggcaggaagaagcgg

SEQ ID NO: 191724 - DNA, 75 bp, Artificial Sequence
  Synthetic
atacaagaaaaggtgtacacatgggaccagggcaagcactttatgcaacaaacgtagtaggagacataagaagag

SEQ ID NO: 191725 - DNA, 75 bp, Artificial Sequence
  Synthetic
ttatagcactaatgatagtgtgaaagagatgaagaaagaaatgaggaactgctctttcaatatcaccacaaacat

SEQ ID NO: 191726 - DNA, 75 bp, Artificial Sequence
  Synthetic
ttatagcactaatgatagtgtgaatgagatgaagaaagaaatgaggaactgctctttcaatatcaccacaaacat

SEQ ID NO: 191727 - DNA, 75 bp, Artificial Sequence
  Synthetic
ttatagcactaatgatagtgtgaacgagatgaagaaagaaatgaggaactgctctttcaatatcaccacaaacat

SEQ ID NO: 191728 - DNA, 75 bp, Artificial Sequence
  Synthetic
ttatagcactaatgatagtgtgaaggagatgaagaaagaaatgaggaactgctctttcaatatcaccacaaacat

SEQ ID NO: 191729 - DNA, 75 bp, Artificial Sequence
  Synthetic
aggcggtggaacaaatgagaaattgctctttcaatgtcaccaaaggcataggagataagatgcagaaagaatatg

SEQ ID NO: 191730 - DNA, 75 bp, Artificial Sequence
  Synthetic
gagaaaaatgaaaaggatttattagcattggacagttggaaaaatctgtggaattggtttgacataacaaactgg

SEQ ID NO: 191731 - DNA, 75 bp, Artificial Sequence
  Synthetic
agttgtaatacctcagtcattacacaggcctgtccaaagatatcctttgagccaattcccatacattattgtgcc

SEQ ID NO: 191732 - DNA, 75 bp, Artificial Sequence
  Synthetic
attaacagaagatagatggaacaagccccagaaaaccaagggccacagagagaaccctacaatgagtgggcattg

SEQ ID NO: 191733 - DNA, 75 bp, Artificial Sequence
  Synthetic
atggaattagaccagtagtgccaactcaactactgttaaatggcagtctagcagaaaaaggggtagtaattagaa

SEQ ID NO: 191734 - DNA, 75 bp, Artificial Sequence
  Synthetic
aagtatctgggaagtcttgtgcaatattggggtctagagctaaaaaagagtgctattagtctgcttgataccata

SEQ ID NO: 191735 - DNA, 75 bp, Artificial Sequence
  Synthetic
acgtacaggatgggggaggacaatttatgcaacagaaagaataacaggagatataagaaaagcatattgtgaagt

SEQ ID NO: 191736 - DNA, 75 bp, Artificial Sequence
  Synthetic
gagtggtagatggagaaataaaaatttaaatgacatttggactaacatgacatggatgcagtgggaaaaagaaat

SEQ ID NO: 191737 - DNA, 75 bp, Artificial Sequence
  Synthetic
gaacctgtgcctcttcagctaccgccacttgagagacttcatattaattgcagcgaggattgtggacaggggact

SEQ ID NO: 191738 - DNA, 75 bp, Artificial Sequence
  Synthetic
ccaatagacaaggaactacatcctttaacttccctcagatcactctttggcaacgacccctcgtcacaataaaga

SEQ ID NO: 191739 - DNA, 75 bp, Artificial Sequence
  Synthetic
ggggacccagaaataacaatgcacaattttaattgtggaggggaatttttctactgtaatacatcactgctgttt

SEQ ID NO: 191740 - DNA, 75 bp, Artificial Sequence
  Synthetic
atggcaggaagaagcggaagcaccgacgaggagctcctccaggcagtaaagatcatcaaaatcctgtaccagagc

SEQ ID NO: 191741 - DNA, 75 bp, Artificial Sequence
  Synthetic
ggagtcaggaactaaagaatagtgctattagcttgcttaataccacagcaatagtagtagctgaggggacagata

SEQ ID NO: 191742 - DNA, 75 bp, Artificial Sequence
  Synthetic
gcatgaagcagttagacattttcctaggccatggcttcatggattaggacaacatatctataacacctatgggga

SEQ ID NO: 191743 - DNA, 75 bp, Artificial Sequence
  Synthetic
ttagcagccatagtggtgtggaccatagtagctatagaatatagaaaaataagaaaacagaacagaatagataag

SEQ ID NO: 191744 - DNA, 75 bp, Artificial Sequence
  Synthetic
cccggcaacaagataagaagaaggatacatataggaccagggagagcattttatacagatagagtaggagacata

SEQ ID NO: 191745 - DNA, 75 bp, Artificial Sequence
  Synthetic
aagaaaacagaacagaatagataaggtacttaatagaataagagagagagcagaagacagtggaaatgagagcga

SEQ ID NO: 191746 - DNA, 75 bp, Artificial Sequence
  Synthetic
ccgacaggcccgaaggaatagaagaagaaggtggagagcaaggcagaggcagatccattcgattggtgaacagat

SEQ ID NO: 191747 - DNA, 75 bp, Artificial Sequence
  Synthetic
agacctcaggtacccttaagaccaatgacttataagggagcatttgatctcggcttctttttaaaagaaaagggg

SEQ ID NO: 191748 - DNA, 75 bp, Artificial Sequence
  Synthetic
gtggcctgctataagggaaagattaagacaaacccctccagcagcagaaggggtgggagcagtgtctcaagactt

SEQ ID NO: 191749 - DNA, 75 bp, Artificial Sequence
  Synthetic
agacaaacccctccagcagcagaaggggtgggagcagtgtctcaagacttagaaagacggggggcaattacaagc

SEQ ID NO: 191750 - DNA, 75 bp, Artificial Sequence
  Synthetic
gtaaggatcatcaaaatcctgtacaaaagcagtaagtattagtagttagtagatgtaatgttgcgtcctttggac

SEQ ID NO: 191751 - DNA, 75 bp, Artificial Sequence
  Synthetic
tgtaacagaaaattttaacatgtggaaaaataacatggtagaacagatgcatgaagatataatcagtttatggga

SEQ ID NO: 191752 - DNA, 75 bp, Artificial Sequence
  Synthetic
cctagaagaatcaggcagggcgctgaaagggctttagtataacatgggtaacaaatggtcaaaaagtagtatagt

SEQ ID NO: 191753 - DNA, 75 bp, Artificial Sequence
  Synthetic
aggatggcctaaggttagggaaagaataagacaaactcctgtaacagtagaaggagtgggaacagcagcagcagc

SEQ ID NO: 191754 - DNA, 75 bp, Artificial Sequence
  Synthetic
tgggaatagcactatctctgggaatagcagtgagtgtaaagaaatgagaaattgcactttcaatgtaaccacaga

SEQ ID NO: 191755 - DNA, 75 bp, Artificial Sequence
  Synthetic
tacatggatgatttgtatgtaggatctgacttagagatagggcagcatagaacaaaaatagaggaactgagacaa

SEQ ID NO: 191756 - DNA, 75 bp, Artificial Sequence
  Synthetic
gctagaacgatttgcaattgatcctggccttctaaaaacagcagaaggctgtcgaaaaataatagaacaactaca

SEQ ID NO: 191757 - DNA, 75 bp, Artificial Sequence
  Synthetic
gctagaacgatttgcaattgatcctggccttctaaaaacagcagaaggctgtcgaaaaataatagaacaacttca

SEQ ID NO: 191758 - DNA, 75 bp, Artificial Sequence
  Synthetic
gctagaacgatttgcaattgatcctggccttctaaaaacagcagaaggctgtcgaaaaataatagaacaactcca

SEQ ID NO: 191759 - DNA, 75 bp, Artificial Sequence
  Synthetic
gctagaacgatttgcaattgatcctggccttctaaaaacagcagaaggctgtcgaaaaataatagaacaactgca

SEQ ID NO: 191760 - DNA, 75 bp, Artificial Sequence
  Synthetic
gctagaacgatttgcaattgatcctggccttctataaacagcagaaggctgtcgaaaaataatagaacaactaca

SEQ ID NO: 191761 - DNA, 75 bp, Artificial Sequence
  Synthetic
gctagaacgatttgcaattgatcctggccttctataaacagcagaaggctgtcgaaaaataatagaacaacttca

SEQ ID NO: 191762 - DNA, 75 bp, Artificial Sequence
  Synthetic
gctagaacgatttgcaattgatcctggccttctataaacagcagaaggctgtcgaaaaataatagaacaactcca

SEQ ID NO: 191763 - DNA, 75 bp, Artificial Sequence
  Synthetic
gctagaacgatttgcaattgatcctggccttctataaacagcagaaggctgtcgaaaaataatagaacaactgca

SEQ ID NO: 191764 - DNA, 75 bp, Artificial Sequence
  Synthetic
gctagaacgatttgcaattgatcctggccttctacaaacagcagaaggctgtcgaaaaataatagaacaactaca

SEQ ID NO: 191765 - DNA, 75 bp, Artificial Sequence
  Synthetic
gctagaacgatttgcaattgatcctggccttctacaaacagcagaaggctgtcgaaaaataatagaacaacttca

SEQ ID NO: 191766 - DNA, 75 bp, Artificial Sequence
  Synthetic
gctagaacgatttgcaattgatcctggccttctacaaacagcagaaggctgtcgaaaaataatagaacaactcca

SEQ ID NO: 191767 - DNA, 75 bp, Artificial Sequence
  Synthetic
gctagaacgatttgcaattgatcctggccttctacaaacagcagaaggctgtcgaaaaataatagaacaactgca

SEQ ID NO: 191768 - DNA, 75 bp, Artificial Sequence
  Synthetic
gctagaacgatttgcaattgatcctggccttctagaaacagcagaaggctgtcgaaaaataatagaacaactaca

SEQ ID NO: 191769 - DNA, 75 bp, Artificial Sequence
  Synthetic
gctagaacgatttgcaattgatcctggccttctagaaacagcagaaggctgtcgaaaaataatagaacaacttca

SEQ ID NO: 191770 - DNA, 75 bp, Artificial Sequence
  Synthetic
gctagaacgatttgcaattgatcctggccttctagaaacagcagaaggctgtcgaaaaataatagaacaactcca

SEQ ID NO: 191771 - DNA, 75 bp, Artificial Sequence
  Synthetic
gctagaacgatttgcaattgatcctggccttctagaaacagcagaaggctgtcgaaaaataatagaacaactgca

SEQ ID NO: 191772 - DNA, 75 bp, Artificial Sequence
  Synthetic
tcaaccattaaacaggcttgtccaaaggtgtcttttgacccaattcccatacattattgtgctccagctggtttt

SEQ ID NO: 191773 - DNA, 75 bp, Artificial Sequence
  Synthetic
aaatgtcagtacagtacaatgtacgcatggaattaagccagtggtatcaactcaattactactgaatggaagtct

SEQ ID NO: 191774 - DNA, 75 bp, Artificial Sequence
  Synthetic
aaaaaactgctcttttaatgtgaccacagaaataagggataaaaaacagaaagtacatgcacttttttataaact

SEQ ID NO: 191775 - DNA, 75 bp, Artificial Sequence
  Synthetic
cccaacaacaatacaagaaaaagtgtaagaatcggacctggacaggtattttatgcaacaggggtcataatagga

SEQ ID NO: 191776 - DNA, 75 bp, Artificial Sequence
  Synthetic
taagaatcggacctggacaggtattttatgcaacaggggtcataataggaaatataagagaagcacattgtaatg

SEQ ID NO: 191777 - DNA, 75 bp, Artificial Sequence
  Synthetic
aatagaagtagcacaaagaattggtagagctattatccacacacctagaagaataagacagggcttagaaaggag

SEQ ID NO: 191778 - DNA, 75 bp, Artificial Sequence
  Synthetic
agtgtacatataggaccaggacaagcactctatacaaataacataataggaaatataagagaagcatattgtaag

SEQ ID NO: 191779 - DNA, 75 bp, Artificial Sequence
  Synthetic
gcatctcctatggcaggaagaagcggagacgccgacgaggaactcctcagagccgtcaggatcatcaaaatcctg

SEQ ID NO: 191780 - DNA, 75 bp, Artificial Sequence
  Synthetic
agcagaaggggtgggagcagcatctcgagacttggaaaaatatggagcaattacaaatagcaatacagcagctac

SEQ ID NO: 191781 - DNA, 75 bp, Artificial Sequence
  Synthetic
caattggagaagtgaattatataagtataaaatagtaaaaattaaaccactaggaatagcacccaccagggcaag

SEQ ID NO: 191782 - DNA, 75 bp, Artificial Sequence
  Synthetic
aaaaattcggctaaggccaggaggaaagaaaaaatacaagttaaaacatatagtatgggcaagcagggaactaga

SEQ ID NO: 191783 - DNA, 75 bp, Artificial Sequence
  Synthetic
gcacaggaagatgaagaagtgggctttccagtcagaccccaagtacctttaagaccaatgactttcaaggcagct

SEQ ID NO: 191784 - DNA, 75 bp, Artificial Sequence
  Synthetic
gcctggctagaagcacaagaggaagaggaggtgggttttccagtcagacctcaagtacctttaagaccaatgact

SEQ ID NO: 191785 - DNA, 75 bp, Artificial Sequence
  Synthetic
accatcccttcagacaggatcagaagagcttaaatcattatttaatacagtagcagtcctctattgtgtacatca

SEQ ID NO: 191786 - DNA, 75 bp, Artificial Sequence
  Synthetic
tagcagtcctctattgtgtacatcaaaagatagatgtaaaagacaccaaggaagctttagacaagatagaggaag

SEQ ID NO: 191787 - DNA, 75 bp, Artificial Sequence
  Synthetic
tcaacacaactatatctgaagaaatgaaaggggaaataaaaaactgctctttcaatatgaccacagtattaagag

SEQ ID NO: 191788 - DNA, 75 bp, Artificial Sequence
  Synthetic
ctttaaattttccaattagtcctattgagactgtaccagtaaaattaaagccaggaatggatggcccaaaggtta

SEQ ID NO: 191789 - DNA, 75 bp, Artificial Sequence
  Synthetic
atggtggatcagatgcatgaagatataatcagcatatgggatcaaggtttaaaaccatgtgtgaagctgacccca

SEQ ID NO: 191790 - DNA, 75 bp, Artificial Sequence
  Synthetic
ccaccgatagtagcgggaaagtgatagaaaatggagaagtaaaaaactgctctttcaatatcaccacaactgtaa

SEQ ID NO: 191791 - DNA, 75 bp, Artificial Sequence
  Synthetic
aattgaattgggcaagtcagatttacccagggattaaggtgaagcaattatgtaaattacttaggggaaccaagg

SEQ ID NO: 191792 - DNA, 75 bp, Artificial Sequence
  Synthetic
aggaatcagaggtaggctttccagtcagaccacaagtacctttgagaccaatgacttataaaagtgctcttgacc

SEQ ID NO: 191793 - DNA, 75 bp, Artificial Sequence
  Synthetic
aagactttagaaagtatactgcattcaccatacctagtacaaacaatgagacaccaggaattaggtatcagtaca

SEQ ID NO: 191794 - DNA, 75 bp, Artificial Sequence
  Synthetic
caaccataacacaagcctgtccaaaggtcacttttgacccgattcctatacattattgtgctccagctggttatg

SEQ ID NO: 191795 - DNA, 75 bp, Artificial Sequence
  Synthetic
ggagacagcgacgaagcactcctccaagcagtaaggatcatcaaaatcttatatcaaagcagtaagtatacatat

SEQ ID NO: 191796 - DNA, 75 bp, Artificial Sequence
  Synthetic
aagagaacaatttgggaataaaacaatagtctttgataaacactcaggaggggatccagaagttgtagcacacag

SEQ ID NO: 191797 - DNA, 75 bp, Artificial Sequence
  Synthetic
tgcacaagggcaaatggtacaccagcccatatcacctaggactttaaatgcatgggtaaaagtaatagaagaaaa

SEQ ID NO: 191798 - DNA, 75 bp, Artificial Sequence
  Synthetic
atcacactccaatgtagaataaaacaaattataaacatgtggcaggaagtaggaaaagcaatgtatgcccctccc

SEQ ID NO: 191799 - DNA, 75 bp, Artificial Sequence
  Synthetic
ttagaaaacaaaatccagaaatagttatctatcaatacatggatgatttgtatgtaggatctgacttagaaatag

SEQ ID NO: 191800 - DNA, 75 bp, Artificial Sequence
  Synthetic
caatctgctgagagctattgaggcgcaacagcatctgttgcaactcacagtctggggcatcaagcagctccaggc

SEQ ID NO: 191801 - DNA, 75 bp, Artificial Sequence
  Synthetic
agtagaatccatgaataaagaattaaagaaaatcatagggcaggtaagagatcaagctgagcaccttaagacagc

SEQ ID NO: 191802 - DNA, 75 bp, Artificial Sequence
  Synthetic
atgacctggatgcagtgggatagagaaattagtaattacacaggcataatatacaggttgcttgaagactcgcaa

SEQ ID NO: 191803 - DNA, 75 bp, Artificial Sequence
  Synthetic
cagcatctcaagatttagctagacatggagcaatcacaagcagtaatacatcacatacaaatgctgattgtgcct

SEQ ID NO: 191804 - DNA, 75 bp, Artificial Sequence
  Synthetic
aagacagggcttagaaagggctttgctataaaatgggtggcaaatggtcaaaaagcaaaatgtttggatgggcta

SEQ ID NO: 191805 - DNA, 75 bp, Artificial Sequence
  Synthetic
ctattgcagtagctgagggaacagatagggttatagaagtagtacaaagattttgtagggctatcctccacatac

SEQ ID NO: 191806 - DNA, 75 bp, Artificial Sequence
  Synthetic
atttaataccatagcaaccctttggtgtgtacataaaaggatagaggtaaaagacaccaaggaagccttagataa

SEQ ID NO: 191807 - DNA, 75 bp, Artificial Sequence
  Synthetic
tagaacaaatagttactcctaggtgtaattatcaagcaggacataaccaggtaggatctttacaatatttggcac

SEQ ID NO: 191808 - DNA, 75 bp, Artificial Sequence
  Synthetic
aacggtgttgctttcattgttactggtgctttatgacgaagggcttaggcatctcctatggcaggaagaagcgga

SEQ ID NO: 191809 - DNA, 75 bp, Artificial Sequence
  Synthetic
aattttaatgctagtagtaccagtactggtactgctacctacaataatagcatgaatggacaaataaaaaattgc

SEQ ID NO: 191810 - DNA, 75 bp, Artificial Sequence
  Synthetic
acatagtagaataggcattattggagggagaagaggcaggaatggacctggtagatcctgacctcgagccctgga

SEQ ID NO: 191811 - DNA, 75 bp, Artificial Sequence
  Synthetic
ccttaaatatctgggaagtcttgtgcagtactggggtcaggagctaaaaaagagtactattagtctggttgatac

SEQ ID NO: 191812 - DNA, 75 bp, Artificial Sequence
  Synthetic
ctaaattgtactaatgccactgccgccaatgacaccctgaaagaagagccagagacaatacaaaactgtactttc

SEQ ID NO: 191813 - DNA, 75 bp, Artificial Sequence
  Synthetic
aagacagggctttgaagcagctttgctataaaatgggaggcaaatggtcaaagagcagcatagttggacggcctg

SEQ ID NO: 191814 - DNA, 75 bp, Artificial Sequence
  Synthetic
cttatatccactttaatggtactgttatccacaataatagggatggaaaaataaagaattgcactttcaatgcaa

SEQ ID NO: 191815 - DNA, 75 bp, Artificial Sequence
  Synthetic
tgaccacagaactaagggataagcaaaagaaggtacattcacttttttatagacttgatgtagtacaaattaatg

SEQ ID NO: 191816 - DNA, 75 bp, Artificial Sequence
  Synthetic
ctcccatgtcgaataaaacaaattgtaaacatgtggcagcaagtgggaagagcaatgtatgccgctcccattgca

SEQ ID NO: 191817 - DNA, 75 bp, Artificial Sequence
  Synthetic
ctattgacacgtgatggaggaaaggggaataatactgatagtagtcaagagatattcagacctggaggaggaaat

SEQ ID NO: 191818 - DNA, 75 bp, Artificial Sequence
  Synthetic
aaaaggtatacatataggaccaggacaagcattctatgcaacagatgacataataggggatataagacaagcaca

SEQ ID NO: 191819 - DNA, 75 bp, Artificial Sequence
  Synthetic
tggtatataaaaatattcataatgatagtaggaggcttgataggtttaagaatagtttttgctgtgctttctata

SEQ ID NO: 191820 - DNA, 75 bp, Artificial Sequence
  Synthetic
actactaacagtagtagtaatgggatgaagggagatatgaaaaactgcactttcaatgttaccacaatcagaaga

SEQ ID NO: 191821 - DNA, 75 bp, Artificial Sequence
  Synthetic
cactaacagacatagtaccactaactgaagaagcagaattagaattagcagagaacagggaaattctaaaagaac

SEQ ID NO: 191822 - DNA, 75 bp, Artificial Sequence
  Synthetic
actactgttaaatggcagtctagcagaagaagatatagtaattagatctgaaaatttcacgaacaatgctaaaac

SEQ ID NO: 191823 - DNA, 75 bp, Artificial Sequence
  Synthetic
acaataatacaagaagaagtatgcatctaggaccagggagagcattatttcatgcaacagatataataggagata

SEQ ID NO: 191824 - DNA, 75 bp, Artificial Sequence
  Synthetic
aacggattcttagcacttgcctgggacgacctgaggagcctgtgccttttcagctaccaccgattgagagacttc

SEQ ID NO: 191825 - DNA, 75 bp, Artificial Sequence
  Synthetic
taaggccagggggaaagaaaaaatataaattaaaacatatagtatgggcaagcagggagctagaacgattcgcgg

SEQ ID NO: 191826 - DNA, 75 bp, Artificial Sequence
  Synthetic
atatatggtctacttgaagactcgcagaaccagcaggaaaagaatgaacaagacttattggcattggacaagtgg

SEQ ID NO: 191827 - DNA, 75 bp, Artificial Sequence
  Synthetic
gtgataaatgtcagctaaaaggagaagccatacatggacaagtagactgtagtccaggaatatggcaattagatt

SEQ ID NO: 191828 - DNA, 75 bp, Artificial Sequence
  Synthetic
tgctttctgaacaaaggcttaggcatctcctatggcaggaagaagcggagacagcgacgaagaactcctcagagc

SEQ ID NO: 191829 - DNA, 75 bp, Artificial Sequence
  Synthetic
gagccgatagacaaggaactgtatcctttaacctccctcaaatcactctttggcaacgacccctcgtcacaataa

SEQ ID NO: 191830 - DNA, 75 bp, Artificial Sequence
  Synthetic
acagaaaaaaatagatagattaattgatagaataagagaaagagcagaagacagtggaaatgagagtgaagggga

SEQ ID NO: 191831 - DNA, 75 bp, Artificial Sequence
  Synthetic
gatagaataagagaaagagcagaagacagtggaaatgagagtgaaggggatacagaggaattggcaacacttgtg

SEQ ID NO: 191832 - DNA, 75 bp, Artificial Sequence
  Synthetic
ctcgacgcaggactcggcttgctgaagtgcactcggcaagaggcgaggggcggcgactggtgagtacgccaaatt

SEQ ID NO: 191833 - DNA, 75 bp, Artificial Sequence
  Synthetic
acagtggaaatgagagtgaaggggatacagaggaattggcaacacttgtggacatggtggactttgatccttggg

SEQ ID NO: 191834 - DNA, 75 bp, Artificial Sequence
  Synthetic
agcgtcagtggcgctgacggtacaggccagacaattattgtctggtatagtgcaacagcaaaacaatttgctgag

SEQ ID NO: 191835 - DNA, 75 bp, Artificial Sequence
  Synthetic
agggggaattggaggttttatcaaagtaagacagtatgatcagatactcatagaaatctgcggacataaagctat

SEQ ID NO: 191836 - DNA, 75 bp, Artificial Sequence
  Synthetic
tgtagtaggatggcctgctataagggaaagaatgagaagaactagtccaacagcagaaagagcagcagaaggggt

SEQ ID NO: 191837 - DNA, 75 bp, Artificial Sequence
  Synthetic
cagtactggggacaacgctacgtgtgcagaagcaggaaacttaacaaactgcactttcaatataaccacagaaat

SEQ ID NO: 191838 - DNA, 75 bp, Artificial Sequence
  Synthetic
taaactgtggccataatgacaccctcactaataacactgcccccgtcaataacaccatgagagaagaagtaagaa

SEQ ID NO: 191839 - DNA, 75 bp, Artificial Sequence
  Synthetic
taaactgtggccataatgacaccctcactaattacactgcccccgtcaataacaccatgagagaagaagtaagaa

SEQ ID NO: 191840 - DNA, 75 bp, Artificial Sequence
  Synthetic
taaactgtggccataatgacaccctcactaatcacactgcccccgtcaataacaccatgagagaagaagtaagaa

SEQ ID NO: 191841 - DNA, 75 bp, Artificial Sequence
  Synthetic
taaactgtggccataatgacaccctcactaatgacactgcccccgtcaataacaccatgagagaagaagtaagaa

SEQ ID NO: 191842 - DNA, 75 bp, Artificial Sequence
  Synthetic
tagcgactggtgagtacgctaaaaattttttgactagcagaggctagaaggggaaagatgggtgcaagagcgtct

SEQ ID NO: 191843 - DNA, 75 bp, Artificial Sequence
  Synthetic
ggcaaagtagggcacatagccagaaattgcagggcccctaggaaaaagggctgttggaaatgtggacaggaagga

SEQ ID NO: 191844 - DNA, 75 bp, Artificial Sequence
  Synthetic
agcgttctacgcaacaggtggcataataggaaatataagacaagcatattgtaatataagtagaacaaaatggaa

SEQ ID NO: 191845 - DNA, 75 bp, Artificial Sequence
  Synthetic
ctatgtagatggggcagctaatagggagactaagctaggaaaagcagggtatgtcactgacaaaggaagacaaaa

SEQ ID NO: 191846 - DNA, 75 bp, Artificial Sequence
  Synthetic
gccagcagcagagggggtgggagcagtatctcgagacttggaaaaacatggagcaattacaagtagcaatacagc

SEQ ID NO: 191847 - DNA, 75 bp, Artificial Sequence
  Synthetic
agaactcctgagagctgtcaggatcatcaaaatcctgtatcaaagcagtgagtaataataatcagtatatgtaat

SEQ ID NO: 191848 - DNA, 75 bp, Artificial Sequence
  Synthetic
agggatttggggctgctctggaaaactcatctgcaccactaatgtgccttggaacactagttggagtaataaatc

SEQ ID NO: 191849 - DNA, 75 bp, Artificial Sequence
  Synthetic
tcaacagctcctaggaatttggggatgctctgggaaaatcatctgccccactgctgttccctggaactatacttg

SEQ ID NO: 191850 - DNA, 75 bp, Artificial Sequence
  Synthetic
acagcatactttctcttaaaattagcaggaagatggccagtaaaaacaatacatacagacaatggcagcaatttc

SEQ ID NO: 191851 - DNA, 75 bp, Artificial Sequence
  Synthetic
tgctctttcaatatgaccacagaattaagagataagaaacagaatgtgtatgcacttttttatagacttgatgta

SEQ ID NO: 191852 - DNA, 75 bp, Artificial Sequence
  Synthetic
gaaattaggagaacacttccctaataaaacgataaactttacaacaccctcaggaggggacctagaagttataac

SEQ ID NO: 191853 - DNA, 75 bp, Artificial Sequence
  Synthetic
agtctagcagaaaaagaggtagtgattagatctgaaaatatctcagacaatgccaaaatcataatagtacagttg

SEQ ID NO: 191854 - DNA, 75 bp, Artificial Sequence
  Synthetic
aagtatacatataggaccagggcaagcatgggatgcaacaacaaaaataataggggatataagaaaagcatattg

SEQ ID NO: 191855 - DNA, 75 bp, Artificial Sequence
  Synthetic
ttgctggcattgtcaactatgctttctgaaaaaaggcttaggcatctcctatggcaggaagaagcggaagcaccg

SEQ ID NO: 191856 - DNA, 75 bp, Artificial Sequence
  Synthetic
tgcagaataaaacaaattgtaagaatgtggcagagagtaggacaagcaatgtatgcccctcctatccaaggagaa

SEQ ID NO: 191857 - DNA, 75 bp, Artificial Sequence
  Synthetic
ctcctgcagcagcaagtggagtaggagcagtatctcaagatttagataaacatggagcagtcacaagcagcaata

SEQ ID NO: 191858 - DNA, 75 bp, Artificial Sequence
  Synthetic
agcagtatctcaagatttagataaacatggagcagtcacaagcagcaatataaatcaccctagttgcgcctggct

SEQ ID NO: 191859 - DNA, 75 bp, Artificial Sequence
  Synthetic
gcaggaagaagcggagacagcgacgaagcactcctccaagcagtgaggatcatcaaaatcttatatcaaagcagt

SEQ ID NO: 191860 - DNA, 75 bp, Artificial Sequence
  Synthetic
aagcactcctccaagcagtgaggatcatcaaaatcttatatcaaagcagtaagtatatgtaatgttaaatttaac

SEQ ID NO: 191861 - DNA, 75 bp, Artificial Sequence
  Synthetic
catcaaaatcttatatcaaagcagtaagtatatgtaatgttaaatttaacagcaagagtagattatagattagga

SEQ ID NO: 191862 - DNA, 75 bp, Artificial Sequence
  Synthetic
gactcatcaagactctctatcaaagcagtaagtagtatatgtaatgcaatctttatatatagcagcaatagtagc

SEQ ID NO: 191863 - DNA, 75 bp, Artificial Sequence
  Synthetic
gactcatcaagactctctatcaaagcagtaagtagtatatgtaatgcaatctttatatatagcagcattagtagc

SEQ ID NO: 191864 - DNA, 75 bp, Artificial Sequence
  Synthetic
gactcatcaagactctctatcaaagcagtaagtagtatatgtaatgcaatctttatatatagcagcactagtagc

SEQ ID NO: 191865 - DNA, 75 bp, Artificial Sequence
  Synthetic
gactcatcaagactctctatcaaagcagtaagtagtatatgtaatgcaatctttatatatagcagcagtagtagc

SEQ ID NO: 191866 - DNA, 75 bp, Artificial Sequence
  Synthetic
gactcatcaagactctctatcatagcagtaagtagtatatgtaatgcaatctttatatatagcagcaatagtagc

SEQ ID NO: 191867 - DNA, 75 bp, Artificial Sequence
  Synthetic
gactcatcaagactctctatcatagcagtaagtagtatatgtaatgcaatctttatatatagcagcattagtagc

SEQ ID NO: 191868 - DNA, 75 bp, Artificial Sequence
  Synthetic
gactcatcaagactctctatcatagcagtaagtagtatatgtaatgcaatctttatatatagcagcactagtagc

SEQ ID NO: 191869 - DNA, 75 bp, Artificial Sequence
  Synthetic
gactcatcaagactctctatcatagcagtaagtagtatatgtaatgcaatctttatatatagcagcagtagtagc

SEQ ID NO: 191870 - DNA, 75 bp, Artificial Sequence
  Synthetic
gactcatcaagactctctatcacagcagtaagtagtatatgtaatgcaatctttatatatagcagcaatagtagc

SEQ ID NO: 191871 - DNA, 75 bp, Artificial Sequence
  Synthetic
gactcatcaagactctctatcacagcagtaagtagtatatgtaatgcaatctttatatatagcagcattagtagc

SEQ ID NO: 191872 - DNA, 75 bp, Artificial Sequence
  Synthetic
gactcatcaagactctctatcacagcagtaagtagtatatgtaatgcaatctttatatatagcagcactagtagc

SEQ ID NO: 191873 - DNA, 75 bp, Artificial Sequence
  Synthetic
gactcatcaagactctctatcacagcagtaagtagtatatgtaatgcaatctttatatatagcagcagtagtagc

SEQ ID NO: 191874 - DNA, 75 bp, Artificial Sequence
  Synthetic
gactcatcaagactctctatcagagcagtaagtagtatatgtaatgcaatctttatatatagcagcaatagtagc

SEQ ID NO: 191875 - DNA, 75 bp, Artificial Sequence
  Synthetic
gactcatcaagactctctatcagagcagtaagtagtatatgtaatgcaatctttatatatagcagcattagtagc

SEQ ID NO: 191876 - DNA, 75 bp, Artificial Sequence
  Synthetic
gactcatcaagactctctatcagagcagtaagtagtatatgtaatgcaatctttatatatagcagcactagtagc

SEQ ID NO: 191877 - DNA, 75 bp, Artificial Sequence
  Synthetic
gactcatcaagactctctatcagagcagtaagtagtatatgtaatgcaatctttatatatagcagcagtagtagc

SEQ ID NO: 191878 - DNA, 75 bp, Artificial Sequence
  Synthetic
aagctactctattctgtgcatcagatgctaaagcatatgagaaagaagtgcataatgtctgggctacacatgcct

SEQ ID NO: 191879 - DNA, 75 bp, Artificial Sequence
  Synthetic
tagaatataggaaaatattaagacagaaaaaaatagatagattaattgatagaataagagaaagagcagaagaca

SEQ ID NO: 191880 - DNA, 75 bp, Artificial Sequence
  Synthetic
acatggtggatcagatgcatgaggatataatcagtatatgggatcaaagtctaaaaccatgtgtaaagttgaccc

SEQ ID NO: 191881 - DNA, 75 bp, Artificial Sequence
  Synthetic
taacacaagcctgtccaaaggtcacttttgacccgattcctatacattattgtgctccagctggttatgcgattc

SEQ ID NO: 191882 - DNA, 75 bp, Artificial Sequence
  Synthetic
taaagttagcaggaagatggccagtaaaaacaatacatacagacaatggccccaatttcaccagtgccgcggtta

SEQ ID NO: 191883 - DNA, 75 bp, Artificial Sequence
  Synthetic
aaaaagtataaggataggaccaggacaaacattctatgcaacagacataataggagacataagacaagcacattg

SEQ ID NO: 191884 - DNA, 75 bp, Artificial Sequence
  Synthetic
actgaggatattaaaggagaaataaaaaactgctctttcaatattaccacaaacataaacggtaagatgcagaaa

SEQ ID NO: 191885 - DNA, 75 bp, Artificial Sequence
  Synthetic
caaaaagcagcatagtgggatggcctaaggttagggaaagaataagacaaacccctgtagcagcagacacccctg

SEQ ID NO: 191886 - DNA, 75 bp, Artificial Sequence
  Synthetic
aagctgtcagacactttcctagaccatggctccatagcttaggacaatatatctatgaaacctatggggatactt

SEQ ID NO: 191887 - DNA, 75 bp, Artificial Sequence
  Synthetic
aacaataaaatttgcatcatcctcaggaggggacctagaaattacaacacatagctttaattgtagaggagaatt

SEQ ID NO: 191888 - DNA, 75 bp, Artificial Sequence
  Synthetic
atggagagcggagaaataaaaaactgctctttcaatatcaccacaagcacaaaagataagaagaacacatatgca

SEQ ID NO: 191889 - DNA, 75 bp, Artificial Sequence
  Synthetic
agcacagtacaatgtacacatggaattaagccagtagtgtcaactcaactgctgttgaatggcagtctagcagaa

SEQ ID NO: 191890 - DNA, 75 bp, Artificial Sequence
  Synthetic
tttctatgtagatggggcagctaatagagaaactaaaaaaggaaaagcaggatatgttactgacagaggaagaca

SEQ ID NO: 191891 - DNA, 75 bp, Artificial Sequence
  Synthetic
acaatacaagaagagatatacatataggaccagggagagcattttatgcaggagaaataataggaaatataagaa

SEQ ID NO: 191892 - DNA, 75 bp, Artificial Sequence
  Synthetic
aagtatacatatggggccagggaaagcattttatacaacaggagacataataggagatataagaaaagcacattg

SEQ ID NO: 191893 - DNA, 75 bp, Artificial Sequence
  Synthetic
aggaggaaatatgaaggacaattggagaagtgaattatataaatataaagtggtagaaattaagccattgggagt

SEQ ID NO: 191894 - DNA, 75 bp, Artificial Sequence
  Synthetic
tagaccctggcctggcagatcaactaattcatatgcattactttgattgtttttcagactctgccataaggaaag

SEQ ID NO: 191895 - DNA, 75 bp, Artificial Sequence
  Synthetic
ttacaggtaatacaaatgataccaatattgcaaatgctacatataagtatgaagaaatgaaaaattgctctttca

SEQ ID NO: 191896 - DNA, 75 bp, Artificial Sequence
  Synthetic
gtctttaatcaatcctcaggaggggacccagaaattgtaaggcaccagtttatttgtggaggggagtttttctac

SEQ ID NO: 191897 - DNA, 75 bp, Artificial Sequence
  Synthetic
cggagacagcgacgaagacctcctcaaggcgatcaggctcatcaagttcctctatcaaagcagtaagtaacatat

SEQ ID NO: 191898 - DNA, 75 bp, Artificial Sequence
  Synthetic
gtttatgggatcaaagcctaaaaccatgtgtgaagttaaccccactctgtgttactttagaatgtactaatgcca

SEQ ID NO: 191899 - DNA, 75 bp, Artificial Sequence
  Synthetic
ctgccaccaatcactctgatgccactgccgccagcaccctgaaagaagagccaggggccatacaaaactgttctt

SEQ ID NO: 191900 - DNA, 75 bp, Artificial Sequence
  Synthetic
ctagccttgcaggaatcaggatcagaagtaaatatagtaacagactcacagtatgcattaggaattattcaggca

SEQ ID NO: 191901 - DNA, 75 bp, Artificial Sequence
  Synthetic
tcaacaacaacagcactggcgaaatgaaaaactgctctttcaatgtaactacagtggtaagggataagaagaagc

SEQ ID NO: 191902 - DNA, 75 bp, Artificial Sequence
  Synthetic
accagctcttcagacaggaacagaggaacttagatcattatacaacacagtagcaactctctattgtgtacatga

SEQ ID NO: 191903 - DNA, 75 bp, Artificial Sequence
  Synthetic
cagcggcagagggagtaggagcagcatctcaagacttagataaacatggagcacttacaagcagcaacacagccg

SEQ ID NO: 191904 - DNA, 75 bp, Artificial Sequence
  Synthetic
ccataatagtacaccttaatgaatctgtacagattaattgtacaagacccaacaataatacaagaaaaagtatac

SEQ ID NO: 191905 - DNA, 75 bp, Artificial Sequence
  Synthetic
aacaataatacaagaaaaagtatacatataggaccaggacaagcattttatgcaacaggagacataataggagac

SEQ ID NO: 191906 - DNA, 75 bp, Artificial Sequence
  Synthetic
ggcagtctagcagaaaaggaaataataattagatctgaaaatctcacaaacaatgctaaaaacataatagtacag

SEQ ID NO: 191907 - DNA, 75 bp, Artificial Sequence
  Synthetic
acacaggaaacagcagtcaggtcagccaaaattaccctatagtgcagaaccttcaggggcaaatggtacatcagg

SEQ ID NO: 191908 - DNA, 75 bp, Artificial Sequence
  Synthetic
gacactatcactctcccatgtcgaataaaacaaattgtaaacatgtggcaggaagtgggacgagcaatgtatgcc

SEQ ID NO: 191909 - DNA, 75 bp, Artificial Sequence
  Synthetic
taataggagatataagaagagcacattgtaatatcagtagcacaaaatggaatgaaactttacaacagttagcaa

SEQ ID NO: 191910 - DNA, 75 bp, Artificial Sequence
  Synthetic
gtgtataatactactagcactagtaatactagcacaataatagtagggaatgaagaaatgaaaaactgctctttc

SEQ ID NO: 191911 - DNA, 75 bp, Artificial Sequence
  Synthetic
agttttgctataagatgggtggcaagtggtcaaaaagtagtatgtttggatggtctactgtaagagaaaggatga

SEQ ID NO: 191912 - DNA, 75 bp, Artificial Sequence
  Synthetic
gacagaaataaattttaagccatcttcaggaggggacctagagattacaacacacagttttgtttgtggagggga

SEQ ID NO: 191913 - DNA, 75 bp, Artificial Sequence
  Synthetic
atgacatggtggatcagatgcatgaagatataatcagcttatgggatcaaagcctaaagccatgtgtaaagttga

SEQ ID NO: 191914 - DNA, 75 bp, Artificial Sequence
  Synthetic
aaaaaattgctctttcaatatgaccacagagctaagagataagaaacagaaagtgtatgcacttttttatagact

SEQ ID NO: 191915 - DNA, 75 bp, Artificial Sequence
  Synthetic
gtgccccagctggttttgcgattctaaagtgtaacgataagaagttcaatggaacaggaccatgtaaaaatgtca

SEQ ID NO: 191916 - DNA, 75 bp, Artificial Sequence
  Synthetic
gtgccccagctggttttgcgattctaaagtgtaacgataagaagttcaatggaacaggaccatgttaaaatgtca

SEQ ID NO: 191917 - DNA, 75 bp, Artificial Sequence
  Synthetic
gtgccccagctggttttgcgattctaaagtgtaacgataagaagttcaatggaacaggaccatgtcaaaatgtca

SEQ ID NO: 191918 - DNA, 75 bp, Artificial Sequence
  Synthetic
gtgccccagctggttttgcgattctaaagtgtaacgataagaagttcaatggaacaggaccatgtgaaaatgtca

SEQ ID NO: 191919 - DNA, 75 bp, Artificial Sequence
  Synthetic
gtgccccagctggttttgcgattctaaagtgtaacgttaagaagttcaatggaacaggaccatgtaaaaatgtca

SEQ ID NO: 191920 - DNA, 75 bp, Artificial Sequence
  Synthetic
gtgccccagctggttttgcgattctaaagtgtaacgttaagaagttcaatggaacaggaccatgttaaaatgtca

SEQ ID NO: 191921 - DNA, 75 bp, Artificial Sequence
  Synthetic
gtgccccagctggttttgcgattctaaagtgtaacgttaagaagttcaatggaacaggaccatgtcaaaatgtca

SEQ ID NO: 191922 - DNA, 75 bp, Artificial Sequence
  Synthetic
gtgccccagctggttttgcgattctaaagtgtaacgttaagaagttcaatggaacaggaccatgtgaaaatgtca

SEQ ID NO: 191923 - DNA, 75 bp, Artificial Sequence
  Synthetic
gtgccccagctggttttgcgattctaaagtgtaacgctaagaagttcaatggaacaggaccatgtaaaaatgtca

SEQ ID NO: 191924 - DNA, 75 bp, Artificial Sequence
  Synthetic
gtgccccagctggttttgcgattctaaagtgtaacgctaagaagttcaatggaacaggaccatgttaaaatgtca

SEQ ID NO: 191925 - DNA, 75 bp, Artificial Sequence
  Synthetic
gtgccccagctggttttgcgattctaaagtgtaacgctaagaagttcaatggaacaggaccatgtcaaaatgtca

SEQ ID NO: 191926 - DNA, 75 bp, Artificial Sequence
  Synthetic
gtgccccagctggttttgcgattctaaagtgtaacgctaagaagttcaatggaacaggaccatgtgaaaatgtca

SEQ ID NO: 191927 - DNA, 75 bp, Artificial Sequence
  Synthetic
gtgccccagctggttttgcgattctaaagtgtaacggtaagaagttcaatggaacaggaccatgtaaaaatgtca

SEQ ID NO: 191928 - DNA, 75 bp, Artificial Sequence
  Synthetic
gtgccccagctggttttgcgattctaaagtgtaacggtaagaagttcaatggaacaggaccatgttaaaatgtca

SEQ ID NO: 191929 - DNA, 75 bp, Artificial Sequence
  Synthetic
gtgccccagctggttttgcgattctaaagtgtaacggtaagaagttcaatggaacaggaccatgtcaaaatgtca

SEQ ID NO: 191930 - DNA, 75 bp, Artificial Sequence
  Synthetic
gtgccccagctggttttgcgattctaaagtgtaacggtaagaagttcaatggaacaggaccatgtgaaaatgtca

SEQ ID NO: 191931 - DNA, 75 bp, Artificial Sequence
  Synthetic
ggaccggggagagcattctatgcaacagaaagaatagtaggaaatataagagaagcacattgtaaccttagtaaa

SEQ ID NO: 191932 - DNA, 75 bp, Artificial Sequence
  Synthetic
gcacacaaatagatcctgacctagcagaccaactgattcacctgcattattttgactgtttttcagaatctgcca

SEQ ID NO: 191933 - DNA, 75 bp, Artificial Sequence
  Synthetic
gtctcaataaaagtagggggccagataaaggaggctctcttagacacaggagcagatgatacagtattagaagaa

SEQ ID NO: 191934 - DNA, 75 bp, Artificial Sequence
  Synthetic
ttggacaaatgggcaagtctgtggaattggtttagcataacaaactggctgtggtatataagaatattcataatg

SEQ ID NO: 191935 - DNA, 75 bp, Artificial Sequence
  Synthetic
ctccccctcagaaacaggagccgatagacaaggaactgtatcccttagcttccctcaaatcactctttggcaacg

SEQ ID NO: 191936 - DNA, 75 bp, Artificial Sequence
  Synthetic
ataaacatgtggcaagaggtaggacgagcaatatatgcccctcccattgcaggaaacataacatgtaaatcaaat

SEQ ID NO: 191937 - DNA, 75 bp, Artificial Sequence
  Synthetic
tgtagccagtggctatatagaagcagaagttatcccagcagaaacaggacaggagacagcatactttatattaaa

SEQ ID NO: 191938 - DNA, 75 bp, Artificial Sequence
  Synthetic
tgcaacaactactgtttgttcatttcagaattgggtgtcaacatagcagaataggcattattcgagggagaagag

SEQ ID NO: 191939 - DNA, 75 bp, Artificial Sequence
  Synthetic
gcaatagtaggactgatagtagcgctaatcttagcaatagttgtgtggactatagtaggtatagaatatagaaaa

SEQ ID NO: 191940 - DNA, 75 bp, Artificial Sequence
  Synthetic
tatagtaggtatagaatatagaaaaatacttaaacaaagaaaaatagacaggctaattgagaaaataagtgaaag

SEQ ID NO: 191941 - DNA, 75 bp, Artificial Sequence
  Synthetic
agacggggggcaattacaagcagcaataccagtgctaataatcctgacgtggcctggctggaagcacaagaggac

SEQ ID NO: 191942 - DNA, 75 bp, Artificial Sequence
  Synthetic
ggcctggctggaagcacaagaggacgaggaagtaggctttccagttagacctcaggtacctttaagaccaatgac

SEQ ID NO: 191943 - DNA, 75 bp, Artificial Sequence
  Synthetic
actgcagctatcattgtctagtttgctttcagacaaaaggcttaggcatttcctatggcaggaagaagcggagac

SEQ ID NO: 191944 - DNA, 75 bp, Artificial Sequence
  Synthetic
tggaaggagaaataaaaaactgctcttacaatatgaccacagaagtaagggataagcaaaagaaagtatattcac

SEQ ID NO: 191945 - DNA, 75 bp, Artificial Sequence
  Synthetic
aaaaactgctctttcaatataaccacagaaataagagataagaggaagacagaatatgcgcttttctatagattt

SEQ ID NO: 191946 - DNA, 75 bp, Artificial Sequence
  Synthetic
ggtggatgggctgctgtaagggaaagaatgagacgaactaagccagcagctgagccagcagcagatggggtggga

SEQ ID NO: 191947 - DNA, 75 bp, Artificial Sequence
  Synthetic
aaggagtatacatataggaccaggacgagcattctatgcagcaggtgacataataggggatatacgacaagcaca

SEQ ID NO: 191948 - DNA, 75 bp, Artificial Sequence
  Synthetic
ttcagtacaatgtacacatggaattaaaccagtggtatcaactcaattactactaaatggtagtttagcagaaga

SEQ ID NO: 191949 - DNA, 75 bp, Artificial Sequence
  Synthetic
aaaccagtggtatcaactcaattactactaaatggtagtttagcagaagaagaaatagtaattagatctgaaaac

SEQ ID NO: 191950 - DNA, 75 bp, Artificial Sequence
  Synthetic
tagtgcagcttaataaatctgtagaaattaattgtaccagacccaacaacaatacaagaaaaagtataagaatcg

SEQ ID NO: 191951 - DNA, 75 bp, Artificial Sequence
  Synthetic
ggaggtaaatgacagcactataacgatctcatgcaggataaagcaatttataaatatgtggcagagaacaggacg

SEQ ID NO: 191952 - DNA, 75 bp, Artificial Sequence
  Synthetic
aaaagtataaggataggaccaggacaaacattctttacacatgacataataggagacataagaaaagcatattgt

SEQ ID NO: 191953 - DNA, 75 bp, Artificial Sequence
  Synthetic
acaaaaagttgtctccctaactgacacaacaaatcagaagactgagttacaagcaattcatctagctttgcagga

SEQ ID NO: 191954 - DNA, 75 bp, Artificial Sequence
  Synthetic
aatataagctttaattcaagctcaggaggggacctagaagttacaacacatagttttaattgtagaggagaattt

SEQ ID NO: 191955 - DNA, 75 bp, Artificial Sequence
  Synthetic
tgcatgaagatataattagtctatgggaccaaagcctaaagccatgtgtaaagttaacccctctctgtgttactt

SEQ ID NO: 191956 - DNA, 75 bp, Artificial Sequence
  Synthetic
gtaggctttccagtcagacctcaagtacctttaagaccaatgacttataagggagcggtggatctaggcttcttt

SEQ ID NO: 191957 - DNA, 75 bp, Artificial Sequence
  Synthetic
aataatacaagaaaaggtatacatctaggaccagggcaaacattctttgcaacaggtgaaataatagggaatata

SEQ ID NO: 191958 - DNA, 75 bp, Artificial Sequence
  Synthetic
gctctggaaaactcatctgcaccactgctgtgccttggaactccagttggagtaataaatcttacacagatattt

SEQ ID NO: 191959 - DNA, 75 bp, Artificial Sequence
  Synthetic
ccaattcctatacattattgtactccagctggttatgcgattctaaagtgtaatgataagaatttcaatgggaca

SEQ ID NO: 191960 - DNA, 75 bp, Artificial Sequence
  Synthetic
agcaccaggagtaggagcagtatctcaagatttagataaacatggagcaattacaagtagtaatgtaaaccaccc

SEQ ID NO: 191961 - DNA, 75 bp, Artificial Sequence
  Synthetic
caagatttagataaacatggagcaattacaagtagtaatgtaaaccaccctagttgtgtctggctggaagcgcaa

SEQ ID NO: 191962 - DNA, 75 bp, Artificial Sequence
  Synthetic
gcgatgtatgcccctcccatctcaggagaaataaagtgtgactcaaacattactggactactattaacaagagat

SEQ ID NO: 191963 - DNA, 75 bp, Artificial Sequence
  Synthetic
aaaaaaggcttaggcatcttctatggcaggaggaaacgaagaccgcgacgaagagctcctcagagcagtgaggat

SEQ ID NO: 191964 - DNA, 75 bp, Artificial Sequence
  Synthetic
caacatattggggtctgcatacaggagaaagagactggcatttgggccagggagtctccatagaatggaggaaaa

SEQ ID NO: 191965 - DNA, 75 bp, Artificial Sequence
  Synthetic
tggggtcgggaactaaagaatagtgctattaatttgtttgatacaatagcaatagcagtagctaactggacagat

SEQ ID NO: 191966 - DNA, 75 bp, Artificial Sequence
  Synthetic
gtggcgcccgaacagggacccgaaaagtgaaagtaatagggactcgaaagcgaaagttccagagaattctctcga

SEQ ID NO: 191967 - DNA, 75 bp, Artificial Sequence
  Synthetic
aggacatatagttagtcctaggtgtgaatatcaagcaggacataacaaggtaggatctctacaatacttggcact

SEQ ID NO: 191968 - DNA, 75 bp, Artificial Sequence
  Synthetic
tccagaaatggtcctctatcaatacatagatgatttgtatgtaagatctgacttagaaataaggcagcatagaat

SEQ ID NO: 191969 - DNA, 75 bp, Artificial Sequence
  Synthetic
atacaaagaatttgtagagctatccgcaacatacctagaagaataagacagggctttgaagcagctttgctataa

SEQ ID NO: 191970 - DNA, 75 bp, Artificial Sequence
  Synthetic
cggagacagcgacgaagcactcctccaagcagtgaggatcatcaaaatcttatatcaaagcagtaagtatctgta

SEQ ID NO: 191971 - DNA, 75 bp, Artificial Sequence
  Synthetic
atcattatataatacagtagcaaccctctattgtgtacatcaaaggatagatgtaaaagacaccaaggaagctct

SEQ ID NO: 191972 - DNA, 75 bp, Artificial Sequence
  Synthetic
ttcagacctggaggaggaaatataagggacaattggagaagtgaattatataaatataaagtagtacaaattgaa

SEQ ID NO: 191973 - DNA, 75 bp, Artificial Sequence
  Synthetic
aagtttgcttcacatcaaaaggcttaggcatctcctatggcaggaagaagcggagacggcgacgaagagcttatc

SEQ ID NO: 191974 - DNA, 75 bp, Artificial Sequence
  Synthetic
atcgcagaaccagcaggaaaagaatgaacaagacttattggcattggacaaatgggcaagtctgtggaattggtt

SEQ ID NO: 191975 - DNA, 75 bp, Artificial Sequence
  Synthetic
taggctttccagtcagacctcaggtgcctgtaaggccaatgacttataaggcagcattcgatctcagcttctttt

SEQ ID NO: 191976 - DNA, 75 bp, Artificial Sequence
  Synthetic
tagtaccactgactgaagaagcagaattagaattggcagagaacagagaaattctaaaagaaccagtacatagag

SEQ ID NO: 191977 - DNA, 75 bp, Artificial Sequence
  Synthetic
tagcagtaatagtactgagacccccaaattgaggggtaatagtagtgagacctacaaagatgaggaaatgaaaaa

SEQ ID NO: 191978 - DNA, 75 bp, Artificial Sequence
  Synthetic
tcagactcatcaagtttctctatcaaagcagtaagtagtacatgtaatgcaatctttacaaatagcagcaatagt

SEQ ID NO: 191979 - DNA, 75 bp, Artificial Sequence
  Synthetic
ggaaatgtggaaaggaaggacaccaaatgaaagactgtactgagagacaggctaattttttagggaaaatttggc

SEQ ID NO: 191980 - DNA, 75 bp, Artificial Sequence
  Synthetic
tactgtttatccatttcagaattgggtgccagcatagcagaataggcattttacgacagagaagagcaagaaatg

SEQ ID NO: 191981 - DNA, 75 bp, Artificial Sequence
  Synthetic
tagtacctgggaaatgatggagaaaggagaaataaaaaattgctctttcaatgtcaccacaaacatgagagataa

SEQ ID NO: 191982 - DNA, 75 bp, Artificial Sequence
  Synthetic
actgcccatactaatgatgtaaaacaattaacagaggcagtgcaaaaaatagcccaagaatgtatagtaatataa

SEQ ID NO: 191983 - DNA, 75 bp, Artificial Sequence
  Synthetic
tagggggccagataaaggaggctctcttagatacaggagcagatgatacagtattagaagaaataaatttgccag

SEQ ID NO: 191984 - DNA, 75 bp, Artificial Sequence
  Synthetic
atggggggcaagtggtcaaaaagtagcttcgtaggatggcctaaggttatggaaagaataagacaaactccagca

SEQ ID NO: 191985 - DNA, 75 bp, Artificial Sequence
  Synthetic
aatgggagaaataaaaaattgctctttcaatatcaccacaagcataagtgataaagtgcaaaaaaactatgcatt

SEQ ID NO: 191986 - DNA, 75 bp, Artificial Sequence
  Synthetic
gtaccagtaaaattaaagccaggaatggatggcccaaaagttaaacaatggccattgacagaagagaaaataaaa

SEQ ID NO: 191987 - DNA, 75 bp, Artificial Sequence
  Synthetic
atgcagaataaaacaaattgctatcttgcggttggaagtaggtaaagcaatgtatgccccccccccaattaaaca

SEQ ID NO: 191988 - DNA, 75 bp, Artificial Sequence
  Synthetic
tgtcaaaatgttactgttaatgttactggcacgaatgttactaatgacatgaaagatagcatgaaaaattgcact

SEQ ID NO: 191989 - DNA, 75 bp, Artificial Sequence
  Synthetic
taaggataggaccaggacaagcattctatacaacaaatgccatactaggaaacataagacaagcatattgtaaca

SEQ ID NO: 191990 - DNA, 75 bp, Artificial Sequence
  Synthetic
accttcagtttccctcaaatcactctttggcaacgacctattgtcacagtaagaatagggggacagctaaaagaa

SEQ ID NO: 191991 - DNA, 75 bp, Artificial Sequence
  Synthetic
aagaatagggggacagctaaaagaagctctattagatacaggagcagatgatacagtactagaagacataaattt

SEQ ID NO: 191992 - DNA, 75 bp, Artificial Sequence
  Synthetic
actataggaccagggagggcattttatgcaacaggagatgtaataggagatataagacaagcacattgtaacatt

SEQ ID NO: 191993 - DNA, 75 bp, Artificial Sequence
  Synthetic
caattggagagcaatggctagtgattttaatctgccacctgtagtagcaaaagaaatagtagctagctgtgataa

SEQ ID NO: 191994 - DNA, 75 bp, Artificial Sequence
  Synthetic
ctgttagacattttcctaggccgtggctccatggattaggacaacatatctatgaaacatatggggatacttggg

SEQ ID NO: 191995 - DNA, 75 bp, Artificial Sequence
  Synthetic
aaagcctcctttgcctagtgttaggaaactagtagaagacagatggaacaagccccagaagaccaggggccacag

SEQ ID NO: 191996 - DNA, 75 bp, Artificial Sequence
  Synthetic
tggaactccagttggagtaataaatctcaagaagatatttgggaaaacatgacctggatgcagtgggatagagaa

SEQ ID NO: 191997 - DNA, 75 bp, Artificial Sequence
  Synthetic
ggaacttctgggacgcagcagtctcaggggactacagagggggtgggaagcccttaaatatctgggaagtcttgt

SEQ ID NO: 191998 - DNA, 75 bp, Artificial Sequence
  Synthetic
ggaagccctcaaatatctgtggaatctcctgcagtattggattcaggaactaaagaatagtgctattagcttgct

SEQ ID NO: 191999 - DNA, 75 bp, Artificial Sequence
  Synthetic
cagggatactcacctttgtcgtttcagacccttaccccaaacccgaggggacccgacaggctcggaagaatcgaa

SEQ ID NO: 192000 - DNA, 75 bp, Artificial Sequence
  Synthetic
gaggggacagataggattttagaagggttacaaagagcttttagagctattatacacatacctagaagaataaga

SEQ ID NO: 192001 - DNA, 75 bp, Artificial Sequence
  Synthetic
aacaagggcaagaccaatggacatatcaaatttatcaggagccatttaaaaatctgaaaacagggaaatatgcaa

SEQ ID NO: 192002 - DNA, 75 bp, Artificial Sequence
  Synthetic
gcagtgagtagtatatgtaatgcaatctttagcaatattagcaatagtagcattagtagtagcaataatactagc

SEQ ID NO: 192003 - DNA, 75 bp, Artificial Sequence
  Synthetic
gcagctttgctataaaatggggggcaagtggtcaaaaagcagcatagttggatggcctgctgtaagagaaagaat

SEQ ID NO: 192004 - DNA, 75 bp, Artificial Sequence
  Synthetic
gtggaagccataataagaattctgcaacaactgctgtttattcatttcagaattggatgtcgacatagcagaata

SEQ ID NO: 192005 - DNA, 75 bp, Artificial Sequence
  Synthetic
ataaaaaactgctctttcaatatgaccacagaattaagagacaagaaacagaaaatgcatgcacttttttataga

SEQ ID NO: 192006 - DNA, 75 bp, Artificial Sequence
  Synthetic
gttttgatatgtggaaaaatgacatggtaaaacaaatgcatacagatataatccctttatgggatccaagtctaa

SEQ ID NO: 192007 - DNA, 75 bp, Artificial Sequence
  Synthetic
gttttgatatgtggaaaaatgacatggtataacaaatgcatacagatataatccctttatgggatccaagtctaa

SEQ ID NO: 192008 - DNA, 75 bp, Artificial Sequence
  Synthetic
gttttgatatgtggaaaaatgacatggtacaacaaatgcatacagatataatccctttatgggatccaagtctaa

SEQ ID NO: 192009 - DNA, 75 bp, Artificial Sequence
  Synthetic
gttttgatatgtggaaaaatgacatggtagaacaaatgcatacagatataatccctttatgggatccaagtctaa

SEQ ID NO: 192010 - DNA, 75 bp, Artificial Sequence
  Synthetic
gcatttgggtcagggagtctccatagagtggaggaaagagagatatagcacaccagaaagccctgaacaagaaga

SEQ ID NO: 192011 - DNA, 75 bp, Artificial Sequence
  Synthetic
gcatttgggtcagggagtctccatagagtggaggaaagagagatatagcacaccagaaagccctgaacaagtaga

SEQ ID NO: 192012 - DNA, 75 bp, Artificial Sequence
  Synthetic
gcatttgggtcagggagtctccatagagtggaggaaagagagatatagcacaccagaaagccctgaacaagcaga

SEQ ID NO: 192013 - DNA, 75 bp, Artificial Sequence
  Synthetic
gcatttgggtcagggagtctccatagagtggaggaaagagagatatagcacaccagaaagccctgaacaaggaga

SEQ ID NO: 192014 - DNA, 75 bp, Artificial Sequence
  Synthetic
gcatttgggtcagggagtctccatagagtggaggaaagagagatatagcacaccagaaagccctgaactagaaga

SEQ ID NO: 192015 - DNA, 75 bp, Artificial Sequence
  Synthetic
gcatttgggtcagggagtctccatagagtggaggaaagagagatatagcacaccagaaagccctgaactagtaga

SEQ ID NO: 192016 - DNA, 75 bp, Artificial Sequence
  Synthetic
gcatttgggtcagggagtctccatagagtggaggaaagagagatatagcacaccagaaagccctgaactagcaga

SEQ ID NO: 192017 - DNA, 75 bp, Artificial Sequence
  Synthetic
gcatttgggtcagggagtctccatagagtggaggaaagagagatatagcacaccagaaagccctgaactaggaga

SEQ ID NO: 192018 - DNA, 75 bp, Artificial Sequence
  Synthetic
gcatttgggtcagggagtctccatagagtggaggaaagagagatatagcacaccagaaagccctgaaccagaaga

SEQ ID NO: 192019 - DNA, 75 bp, Artificial Sequence
  Synthetic
gcatttgggtcagggagtctccatagagtggaggaaagagagatatagcacaccagaaagccctgaaccagtaga

SEQ ID NO: 192020 - DNA, 75 bp, Artificial Sequence
  Synthetic
gcatttgggtcagggagtctccatagagtggaggaaagagagatatagcacaccagaaagccctgaaccagcaga

SEQ ID NO: 192021 - DNA, 75 bp, Artificial Sequence
  Synthetic
gcatttgggtcagggagtctccatagagtggaggaaagagagatatagcacaccagaaagccctgaaccaggaga

SEQ ID NO: 192022 - DNA, 75 bp, Artificial Sequence
  Synthetic
gcatttgggtcagggagtctccatagagtggaggaaagagagatatagcacaccagaaagccctgaacgagaaga

SEQ ID NO: 192023 - DNA, 75 bp, Artificial Sequence
  Synthetic
gcatttgggtcagggagtctccatagagtggaggaaagagagatatagcacaccagaaagccctgaacgagtaga

SEQ ID NO: 192024 - DNA, 75 bp, Artificial Sequence
  Synthetic
gcatttgggtcagggagtctccatagagtggaggaaagagagatatagcacaccagaaagccctgaacgagcaga

SEQ ID NO: 192025 - DNA, 75 bp, Artificial Sequence
  Synthetic
gcatttgggtcagggagtctccatagagtggaggaaagagagatatagcacaccagaaagccctgaacgaggaga

SEQ ID NO: 192026 - DNA, 75 bp, Artificial Sequence
  Synthetic
gcatttgggtcagggagtctccatagagtggaggaaagagagatatagcactccagaaagccctgaacaagaaga

SEQ ID NO: 192027 - DNA, 75 bp, Artificial Sequence
  Synthetic
gcatttgggtcagggagtctccatagagtggaggaaagagagatatagcactccagaaagccctgaacaagtaga

SEQ ID NO: 192028 - DNA, 75 bp, Artificial Sequence
  Synthetic
gcatttgggtcagggagtctccatagagtggaggaaagagagatatagcactccagaaagccctgaacaagcaga

SEQ ID NO: 192029 - DNA, 75 bp, Artificial Sequence
  Synthetic
gcatttgggtcagggagtctccatagagtggaggaaagagagatatagcactccagaaagccctgaacaaggaga

SEQ ID NO: 192030 - DNA, 75 bp, Artificial Sequence
  Synthetic
gcatttgggtcagggagtctccatagagtggaggaaagagagatatagcactccagaaagccctgaactagaaga

SEQ ID NO: 192031 - DNA, 75 bp, Artificial Sequence
  Synthetic
gcatttgggtcagggagtctccatagagtggaggaaagagagatatagcactccagaaagccctgaactagtaga

SEQ ID NO: 192032 - DNA, 75 bp, Artificial Sequence
  Synthetic
gcatttgggtcagggagtctccatagagtggaggaaagagagatatagcactccagaaagccctgaactagcaga

SEQ ID NO: 192033 - DNA, 75 bp, Artificial Sequence
  Synthetic
gcatttgggtcagggagtctccatagagtggaggaaagagagatatagcactccagaaagccctgaactaggaga

SEQ ID NO: 192034 - DNA, 75 bp, Artificial Sequence
  Synthetic
gcatttgggtcagggagtctccatagagtggaggaaagagagatatagcactccagaaagccctgaaccagaaga

SEQ ID NO: 192035 - DNA, 75 bp, Artificial Sequence
  Synthetic
gcatttgggtcagggagtctccatagagtggaggaaagagagatatagcactccagaaagccctgaaccagtaga

SEQ ID NO: 192036 - DNA, 75 bp, Artificial Sequence
  Synthetic
gcatttgggtcagggagtctccatagagtggaggaaagagagatatagcactccagaaagccctgaaccagcaga

SEQ ID NO: 192037 - DNA, 75 bp, Artificial Sequence
  Synthetic
gcatttgggtcagggagtctccatagagtggaggaaagagagatatagcactccagaaagccctgaaccaggaga

SEQ ID NO: 192038 - DNA, 75 bp, Artificial Sequence
  Synthetic
gcatttgggtcagggagtctccatagagtggaggaaagagagatatagcactccagaaagccctgaacgagaaga

SEQ ID NO: 192039 - DNA, 75 bp, Artificial Sequence
  Synthetic
gcatttgggtcagggagtctccatagagtggaggaaagagagatatagcactccagaaagccctgaacgagtaga

SEQ ID NO: 192040 - DNA, 75 bp, Artificial Sequence
  Synthetic
gcatttgggtcagggagtctccatagagtggaggaaagagagatatagcactccagaaagccctgaacgagcaga

SEQ ID NO: 192041 - DNA, 75 bp, Artificial Sequence
  Synthetic
gcatttgggtcagggagtctccatagagtggaggaaagagagatatagcactccagaaagccctgaacgaggaga

SEQ ID NO: 192042 - DNA, 75 bp, Artificial Sequence
  Synthetic
gcatttgggtcagggagtctccatagagtggaggaaagagagatatagcaccccagaaagccctgaacaagaaga

SEQ ID NO: 192043 - DNA, 75 bp, Artificial Sequence
  Synthetic
gcatttgggtcagggagtctccatagagtggaggaaagagagatatagcaccccagaaagccctgaacaagtaga

SEQ ID NO: 192044 - DNA, 75 bp, Artificial Sequence
  Synthetic
gcatttgggtcagggagtctccatagagtggaggaaagagagatatagcaccccagaaagccctgaacaagcaga

SEQ ID NO: 192045 - DNA, 75 bp, Artificial Sequence
  Synthetic
gcatttgggtcagggagtctccatagagtggaggaaagagagatatagcaccccagaaagccctgaacaaggaga

SEQ ID NO: 192046 - DNA, 75 bp, Artificial Sequence
  Synthetic
gcatttgggtcagggagtctccatagagtggaggaaagagagatatagcaccccagaaagccctgaactagaaga

SEQ ID NO: 192047 - DNA, 75 bp, Artificial Sequence
  Synthetic
gcatttgggtcagggagtctccatagagtggaggaaagagagatatagcaccccagaaagccctgaactagtaga

SEQ ID NO: 192048 - DNA, 75 bp, Artificial Sequence
  Synthetic
gcatttgggtcagggagtctccatagagtggaggaaagagagatatagcaccccagaaagccctgaactagcaga

SEQ ID NO: 192049 - DNA, 75 bp, Artificial Sequence
  Synthetic
gcatttgggtcagggagtctccatagagtggaggaaagagagatatagcaccccagaaagccctgaactaggaga

SEQ ID NO: 192050 - DNA, 75 bp, Artificial Sequence
  Synthetic
gcatttgggtcagggagtctccatagagtggaggaaagagagatatagcaccccagaaagccctgaaccagaaga

SEQ ID NO: 192051 - DNA, 75 bp, Artificial Sequence
  Synthetic
gcatttgggtcagggagtctccatagagtggaggaaagagagatatagcaccccagaaagccctgaaccagtaga

SEQ ID NO: 192052 - DNA, 75 bp, Artificial Sequence
  Synthetic
gcatttgggtcagggagtctccatagagtggaggaaagagagatatagcaccccagaaagccctgaaccagcaga

SEQ ID NO: 192053 - DNA, 75 bp, Artificial Sequence
  Synthetic
gcatttgggtcagggagtctccatagagtggaggaaagagagatatagcaccccagaaagccctgaaccaggaga

SEQ ID NO: 192054 - DNA, 75 bp, Artificial Sequence
  Synthetic
gcatttgggtcagggagtctccatagagtggaggaaagagagatatagcaccccagaaagccctgaacgagaaga

SEQ ID NO: 192055 - DNA, 75 bp, Artificial Sequence
  Synthetic
gcatttgggtcagggagtctccatagagtggaggaaagagagatatagcaccccagaaagccctgaacgagtaga

SEQ ID NO: 192056 - DNA, 75 bp, Artificial Sequence
  Synthetic
gcatttgggtcagggagtctccatagagtggaggaaagagagatatagcaccccagaaagccctgaacgagcaga

SEQ ID NO: 192057 - DNA, 75 bp, Artificial Sequence
  Synthetic
gcatttgggtcagggagtctccatagagtggaggaaagagagatatagcaccccagaaagccctgaacgaggaga

SEQ ID NO: 192058 - DNA, 75 bp, Artificial Sequence
  Synthetic
gcatttgggtcagggagtctccatagagtggaggaaagagagatatagcacgccagaaagccctgaacaagaaga

SEQ ID NO: 192059 - DNA, 75 bp, Artificial Sequence
  Synthetic
gcatttgggtcagggagtctccatagagtggaggaaagagagatatagcacgccagaaagccctgaacaagtaga

SEQ ID NO: 192060 - DNA, 75 bp, Artificial Sequence
  Synthetic
gcatttgggtcagggagtctccatagagtggaggaaagagagatatagcacgccagaaagccctgaacaagcaga

SEQ ID NO: 192061 - DNA, 75 bp, Artificial Sequence
  Synthetic
gcatttgggtcagggagtctccatagagtggaggaaagagagatatagcacgccagaaagccctgaacaaggaga

SEQ ID NO: 192062 - DNA, 75 bp, Artificial Sequence
  Synthetic
gcatttgggtcagggagtctccatagagtggaggaaagagagatatagcacgccagaaagccctgaactagaaga

SEQ ID NO: 192063 - DNA, 75 bp, Artificial Sequence
  Synthetic
gcatttgggtcagggagtctccatagagtggaggaaagagagatatagcacgccagaaagccctgaactagtaga

SEQ ID NO: 192064 - DNA, 75 bp, Artificial Sequence
  Synthetic
gcatttgggtcagggagtctccatagagtggaggaaagagagatatagcacgccagaaagccctgaactagcaga

SEQ ID NO: 192065 - DNA, 75 bp, Artificial Sequence
  Synthetic
gcatttgggtcagggagtctccatagagtggaggaaagagagatatagcacgccagaaagccctgaactaggaga

SEQ ID NO: 192066 - DNA, 75 bp, Artificial Sequence
  Synthetic
gcatttgggtcagggagtctccatagagtggaggaaagagagatatagcacgccagaaagccctgaaccagaaga

SEQ ID NO: 192067 - DNA, 75 bp, Artificial Sequence
  Synthetic
gcatttgggtcagggagtctccatagagtggaggaaagagagatatagcacgccagaaagccctgaaccagtaga

SEQ ID NO: 192068 - DNA, 75 bp, Artificial Sequence
  Synthetic
gcatttgggtcagggagtctccatagagtggaggaaagagagatatagcacgccagaaagccctgaaccagcaga

SEQ ID NO: 192069 - DNA, 75 bp, Artificial Sequence
  Synthetic
gcatttgggtcagggagtctccatagagtggaggaaagagagatatagcacgccagaaagccctgaaccaggaga

SEQ ID NO: 192070 - DNA, 75 bp, Artificial Sequence
  Synthetic
gcatttgggtcagggagtctccatagagtggaggaaagagagatatagcacgccagaaagccctgaacgagaaga

SEQ ID NO: 192071 - DNA, 75 bp, Artificial Sequence
  Synthetic
gcatttgggtcagggagtctccatagagtggaggaaagagagatatagcacgccagaaagccctgaacgagtaga

SEQ ID NO: 192072 - DNA, 75 bp, Artificial Sequence
  Synthetic
gcatttgggtcagggagtctccatagagtggaggaaagagagatatagcacgccagaaagccctgaacgagcaga

SEQ ID NO: 192073 - DNA, 75 bp, Artificial Sequence
  Synthetic
gcatttgggtcagggagtctccatagagtggaggaaagagagatatagcacgccagaaagccctgaacgaggaga

SEQ ID NO: 192074 - DNA, 75 bp, Artificial Sequence
  Synthetic
gagaaagcaacctttgcccagtgttaagaaactgacagaggatagatggaacaagccccaggaaaccaagggcca

SEQ ID NO: 192075 - DNA, 75 bp, Artificial Sequence
  Synthetic
aaaaatgaaaaactgctctttcaatataaccacagaggtaagagataagacgaggaaagaatatgcactttttta

SEQ ID NO: 192076 - DNA, 75 bp, Artificial Sequence
  Synthetic
caccttaatgaatcagtacaaattaattgcacaagacccaataataatacaaggaaaagtatacagttaggacca

SEQ ID NO: 192077 - DNA, 75 bp, Artificial Sequence
  Synthetic
aaggaaaagtatacagttaggaccaggacgagcattttatgcaacaggggaaataataggagacattagaaaggc

SEQ ID NO: 192078 - DNA, 75 bp, Artificial Sequence
  Synthetic
tcctactaccaagagtaatagtagttggataaatgaggagggagagatgaaaaactgctctttcaatgttaccac

SEQ ID NO: 192079 - DNA, 75 bp, Artificial Sequence
  Synthetic
cagtacaatgtacacatgggattaagccagtggtatcaactcaattactgttaaatggtagcctagcagaaggag

SEQ ID NO: 192080 - DNA, 75 bp, Artificial Sequence
  Synthetic
gagagcattttatgcagcaggagaggtaataggaaagataagacaagcacattgtagccttagtgaatcaaaatg

SEQ ID NO: 192081 - DNA, 75 bp, Artificial Sequence
  Synthetic
acaaatgctacattcaatactagcataaagaaagaaatgagacaatgctctttcaatgtaaccacagtagtaaga

SEQ ID NO: 192082 - DNA, 75 bp, Artificial Sequence
  Synthetic
ctttggggctgctctggaaaactcatctgcaccactaatgtgccctggaactccagttggagtaacaaatcttac

SEQ ID NO: 192083 - DNA, 75 bp, Artificial Sequence
  Synthetic
acactcccatgcagaataaaacaaatcataaacatgtggctggcagtaggaaaagcaacgtctccccctcccatc

SEQ ID NO: 192084 - DNA, 75 bp, Artificial Sequence
  Synthetic
ctccgaagcaggagccgaaagacagggaacccttaatttccctcaaatcactctttggcagcgaccccttgtctc

SEQ ID NO: 192085 - DNA, 75 bp, Artificial Sequence
  Synthetic
tccaggcaagaatcctggctgtggaaagctacctaagggatcaacagctcctaggaatttaaggttgctctagaa

SEQ ID NO: 192086 - DNA, 75 bp, Artificial Sequence
  Synthetic
aacaggaacgagaccttcagacctggaggaggagatatgagagacaattggagaagtgaattatataaatataaa

SEQ ID NO: 192087 - DNA, 75 bp, Artificial Sequence
  Synthetic
gtaatgagtcctttagaaatctgggcaatagtaggactgatagtagcactaatcctagcaatagttgtgtggact

SEQ ID NO: 192088 - DNA, 75 bp, Artificial Sequence
  Synthetic
acaggcccgaagaaatcgaaagaggagatggagagcaaggcaaagacagatccgtgagattagtgcacggattat

SEQ ID NO: 192089 - DNA, 75 bp, Artificial Sequence
  Synthetic
attgacaattacacagatttaatatacagcttgcttgaggaaacgcaaaaccagcaagaaaggaatgaacaagaa

SEQ ID NO: 192090 - DNA, 75 bp, Artificial Sequence
  Synthetic
gcagaagacagtggcaatgagagtgatggggacacagaggaattgtcaacacttattgaactgggggattatgat

SEQ ID NO: 192091 - DNA, 75 bp, Artificial Sequence
  Synthetic
taagtttaagaatagtttttactgtgatttctttagtgaatagagttaggcaaagatattcacctatgtcgtttc

SEQ ID NO: 192092 - DNA, 75 bp, Artificial Sequence
  Synthetic
ctgttgaagtggggatttactacaccagacaaaaaacatcagaaagaacctccatttctttggatgggttatgaa

SEQ ID NO: 192093 - DNA, 75 bp, Artificial Sequence
  Synthetic
cccttagtaatagctgcaatagtaggactaatagtagcattcatagcagccatagttgtgtggacaatagtattt

SEQ ID NO: 192094 - DNA, 75 bp, Artificial Sequence
  Synthetic
cacggatagcgtgaaaggagaaatgagaaactgctctttcaatattaccacagaactaagggataagaaaaagaa

SEQ ID NO: 192095 - DNA, 75 bp, Artificial Sequence
  Synthetic
aggtggcaaatggtcaaaaagtagtatagttaggtggcctgctataaaggaaagaataagaagaactgatccaag

SEQ ID NO: 192096 - DNA, 75 bp, Artificial Sequence
  Synthetic
gactgtgcctagctagaagcacaagaaaaaaatgaggaagtaggctttccagtcagacctcaggtccctttaagg

SEQ ID NO: 192097 - DNA, 75 bp, Artificial Sequence
  Synthetic
tatcacctagaactttgaatgcatgggtgaaagtagtagaagaaaaggctttcagcccagaagtaatacccatgt

SEQ ID NO: 192098 - DNA, 75 bp, Artificial Sequence
  Synthetic
aaaggacaccaaggaagctttagagaagctagaggaagaacaaaacaaaagtcagcaaaagaaacagcaagcggc

SEQ ID NO: 192099 - DNA, 75 bp, Artificial Sequence
  Synthetic
gaataagacagggcttagaaagggctttgctataagatgggtggcaagtggtcaaaatgtagtatgagtggatgg

SEQ ID NO: 192100 - DNA, 75 bp, Artificial Sequence
  Synthetic
agaaaacataaaaaactgctctttcaatgtaaccacagaaataagagataggagtaagaaagaatatgcactttt

SEQ ID NO: 192101 - DNA, 75 bp, Artificial Sequence
  Synthetic
ttagaaacatcagaaggctgtagacaaatactgggacagctacaaccatcccttcagacaggatcagaagaactt

SEQ ID NO: 192102 - DNA, 75 bp, Artificial Sequence
  Synthetic
acatgggagacatggtggacagattattggcaagccacctggattcctgagtgggagtttgttaatacccctccc

SEQ ID NO: 192103 - DNA, 75 bp, Artificial Sequence
  Synthetic
gcaagaggcgaggggcggcgactggtgagtacgccaaaaattttgactagcggaggctagaaggagagagatggg

SEQ ID NO: 192104 - DNA, 75 bp, Artificial Sequence
  Synthetic
aggagcagagactttctatgtagatggggcagctaatagggagactaagctaggaaaagcagggtatgtcactga

SEQ ID NO: 192105 - DNA, 75 bp, Artificial Sequence
  Synthetic
gtataggaatcggtcctggacaaatgttctacgcaacaggtgagataataggagatataagagaagcacattgta

SEQ ID NO: 192106 - DNA, 75 bp, Artificial Sequence
  Synthetic
aagactgcactgagagacaggctaattttttagggaaaatttggccttccaacaaagggaggccagggaactttc

SEQ ID NO: 192107 - DNA, 75 bp, Artificial Sequence
  Synthetic
aggggacctagaaattacaacacatagttttaattgtagaggagaatttttctattgtaacacatcaggactgtt

SEQ ID NO: 192108 - DNA, 75 bp, Artificial Sequence
  Synthetic
acagtattagaagacataaatttgccaggaaaatggaaaccaaaaatgatagggggaattggaggttttatcaaa

SEQ ID NO: 192109 - DNA, 75 bp, Artificial Sequence
  Synthetic
tagcagtagtagtaatagtacccagaataagacatacaatgggaacatgaatgaaataaaaaattgctctttcaa

SEQ ID NO: 192110 - DNA, 75 bp, Artificial Sequence
  Synthetic
ttggggtaacatgacctggatacaatgggaaagggaagtcagcaattacacaaaacaaatatacaccctgattga

SEQ ID NO: 192111 - DNA, 75 bp, Artificial Sequence
  Synthetic
ttggggtaacatgacctggatacaatgggaaagggaagtcagcaattacacaaatcaaatatacaccctgattga

SEQ ID NO: 192112 - DNA, 75 bp, Artificial Sequence
  Synthetic
ttggggtaacatgacctggatacaatgggaaagggaagtcagcaattacacaaaccaaatatacaccctgattga

SEQ ID NO: 192113 - DNA, 75 bp, Artificial Sequence
  Synthetic
ttggggtaacatgacctggatacaatgggaaagggaagtcagcaattacacaaagcaaatatacaccctgattga

SEQ ID NO: 192114 - DNA, 75 bp, Artificial Sequence
  Synthetic
ttggggtaacatgacctggatacaatgggaaagggaagtcagcaattacacataacaaatatacaccctgattga

SEQ ID NO: 192115 - DNA, 75 bp, Artificial Sequence
  Synthetic
ttggggtaacatgacctggatacaatgggaaagggaagtcagcaattacacatatcaaatatacaccctgattga

SEQ ID NO: 192116 - DNA, 75 bp, Artificial Sequence
  Synthetic
ttggggtaacatgacctggatacaatgggaaagggaagtcagcaattacacataccaaatatacaccctgattga

SEQ ID NO: 192117 - DNA, 75 bp, Artificial Sequence
  Synthetic
ttggggtaacatgacctggatacaatgggaaagggaagtcagcaattacacatagcaaatatacaccctgattga

SEQ ID NO: 192118 - DNA, 75 bp, Artificial Sequence
  Synthetic
ttggggtaacatgacctggatacaatgggaaagggaagtcagcaattacacacaacaaatatacaccctgattga

SEQ ID NO: 192119 - DNA, 75 bp, Artificial Sequence
  Synthetic
ttggggtaacatgacctggatacaatgggaaagggaagtcagcaattacacacatcaaatatacaccctgattga

SEQ ID NO: 192120 - DNA, 75 bp, Artificial Sequence
  Synthetic
ttggggtaacatgacctggatacaatgggaaagggaagtcagcaattacacacaccaaatatacaccctgattga

SEQ ID NO: 192121 - DNA, 75 bp, Artificial Sequence
  Synthetic
ttggggtaacatgacctggatacaatgggaaagggaagtcagcaattacacacagcaaatatacaccctgattga

SEQ ID NO: 192122 - DNA, 75 bp, Artificial Sequence
  Synthetic
ttggggtaacatgacctggatacaatgggaaagggaagtcagcaattacacagaacaaatatacaccctgattga

SEQ ID NO: 192123 - DNA, 75 bp, Artificial Sequence
  Synthetic
ttggggtaacatgacctggatacaatgggaaagggaagtcagcaattacacagatcaaatatacaccctgattga

SEQ ID NO: 192124 - DNA, 75 bp, Artificial Sequence
  Synthetic
ttggggtaacatgacctggatacaatgggaaagggaagtcagcaattacacagaccaaatatacaccctgattga

SEQ ID NO: 192125 - DNA, 75 bp, Artificial Sequence
  Synthetic
ttggggtaacatgacctggatacaatgggaaagggaagtcagcaattacacagagcaaatatacaccctgattga

SEQ ID NO: 192126 - DNA, 75 bp, Artificial Sequence
  Synthetic
tggacagatagggttatagaaataggacaaagaattggtagagctattctccatatacctagaagaattagacag

SEQ ID NO: 192127 - DNA, 75 bp, Artificial Sequence
  Synthetic
ccagctcctacagcagcaacaggagtaggagcagtatctcaagatttagaaaaacatggagcaatcacaagcagt

SEQ ID NO: 192128 - DNA, 75 bp, Artificial Sequence
  Synthetic
gactagagccctggaagcatccaggaagtcagcctaggactccttgtaacaaatgctattgtaaaaagtgttgct

SEQ ID NO: 192129 - DNA, 75 bp, Artificial Sequence
  Synthetic
tgatacaatagcaatagcagtagcaaactggacagatagggtaatagaagtagcacaaagagctggtagagctat

SEQ ID NO: 192130 - DNA, 75 bp, Artificial Sequence
  Synthetic
tgatacaatagcaatagcagtagcaaactggacagatagggttatagaagtagcacaaagagctggtagagctat

SEQ ID NO: 192131 - DNA, 75 bp, Artificial Sequence
  Synthetic
tgatacaatagcaatagcagtagcaaactggacagatagggtcatagaagtagcacaaagagctggtagagctat

SEQ ID NO: 192132 - DNA, 75 bp, Artificial Sequence
  Synthetic
tgatacaatagcaatagcagtagcaaactggacagatagggtgatagaagtagcacaaagagctggtagagctat

SEQ ID NO: 192133 - DNA, 75 bp, Artificial Sequence
  Synthetic
tgatacaatagcaatagcagtagctaactggacagatagggtaatagaagtagcacaaagagctggtagagctat

SEQ ID NO: 192134 - DNA, 75 bp, Artificial Sequence
  Synthetic
tgatacaatagcaatagcagtagctaactggacagatagggttatagaagtagcacaaagagctggtagagctat

SEQ ID NO: 192135 - DNA, 75 bp, Artificial Sequence
  Synthetic
tgatacaatagcaatagcagtagctaactggacagatagggtcatagaagtagcacaaagagctggtagagctat

SEQ ID NO: 192136 - DNA, 75 bp, Artificial Sequence
  Synthetic
tgatacaatagcaatagcagtagctaactggacagatagggtgatagaagtagcacaaagagctggtagagctat

SEQ ID NO: 192137 - DNA, 75 bp, Artificial Sequence
  Synthetic
tgatacaatagcaatagcagtagccaactggacagatagggtaatagaagtagcacaaagagctggtagagctat

SEQ ID NO: 192138 - DNA, 75 bp, Artificial Sequence
  Synthetic
tgatacaatagcaatagcagtagccaactggacagatagggttatagaagtagcacaaagagctggtagagctat

SEQ ID NO: 192139 - DNA, 75 bp, Artificial Sequence
  Synthetic
tgatacaatagcaatagcagtagccaactggacagatagggtcatagaagtagcacaaagagctggtagagctat

SEQ ID NO: 192140 - DNA, 75 bp, Artificial Sequence
  Synthetic
tgatacaatagcaatagcagtagccaactggacagatagggtgatagaagtagcacaaagagctggtagagctat

SEQ ID NO: 192141 - DNA, 75 bp, Artificial Sequence
  Synthetic
tgatacaatagcaatagcagtagcgaactggacagatagggtaatagaagtagcacaaagagctggtagagctat

SEQ ID NO: 192142 - DNA, 75 bp, Artificial Sequence
  Synthetic
tgatacaatagcaatagcagtagcgaactggacagatagggttatagaagtagcacaaagagctggtagagctat

SEQ ID NO: 192143 - DNA, 75 bp, Artificial Sequence
  Synthetic
tgatacaatagcaatagcagtagcgaactggacagatagggtcatagaagtagcacaaagagctggtagagctat

SEQ ID NO: 192144 - DNA, 75 bp, Artificial Sequence
  Synthetic
tgatacaatagcaatagcagtagcgaactggacagatagggtgatagaagtagcacaaagagctggtagagctat

SEQ ID NO: 192145 - DNA, 75 bp, Artificial Sequence
  Synthetic
atagttggatggcccgagataagggagagattaagaagaactagaaccacccctgaagcagcagaaggagaagga

SEQ ID NO: 192146 - DNA, 75 bp, Artificial Sequence
  Synthetic
atagttggatggcccgagataagggagagattaagaagaactagaaccacccctgaagcagcagaaggagtagga

SEQ ID NO: 192147 - DNA, 75 bp, Artificial Sequence
  Synthetic
atagttggatggcccgagataagggagagattaagaagaactagaaccacccctgaagcagcagaaggagcagga

SEQ ID NO: 192148 - DNA, 75 bp, Artificial Sequence
  Synthetic
atagttggatggcccgagataagggagagattaagaagaactagaaccacccctgaagcagcagaaggaggagga

SEQ ID NO: 192149 - DNA, 75 bp, Artificial Sequence
  Synthetic
atagttggatggcccgagataagggagagattaagaagaactagaaccacccctgtagcagcagaaggagaagga

SEQ ID NO: 192150 - DNA, 75 bp, Artificial Sequence
  Synthetic
atagttggatggcccgagataagggagagattaagaagaactagaaccacccctgtagcagcagaaggagtagga

SEQ ID NO: 192151 - DNA, 75 bp, Artificial Sequence
  Synthetic
atagttggatggcccgagataagggagagattaagaagaactagaaccacccctgtagcagcagaaggagcagga

SEQ ID NO: 192152 - DNA, 75 bp, Artificial Sequence
  Synthetic
atagttggatggcccgagataagggagagattaagaagaactagaaccacccctgtagcagcagaaggaggagga

SEQ ID NO: 192153 - DNA, 75 bp, Artificial Sequence
  Synthetic
atagttggatggcccgagataagggagagattaagaagaactagaaccacccctgcagcagcagaaggagaagga

SEQ ID NO: 192154 - DNA, 75 bp, Artificial Sequence
  Synthetic
atagttggatggcccgagataagggagagattaagaagaactagaaccacccctgcagcagcagaaggagtagga

SEQ ID NO: 192155 - DNA, 75 bp, Artificial Sequence
  Synthetic
atagttggatggcccgagataagggagagattaagaagaactagaaccacccctgcagcagcagaaggagcagga

SEQ ID NO: 192156 - DNA, 75 bp, Artificial Sequence
  Synthetic
atagttggatggcccgagataagggagagattaagaagaactagaaccacccctgcagcagcagaaggaggagga

SEQ ID NO: 192157 - DNA, 75 bp, Artificial Sequence
  Synthetic
atagttggatggcccgagataagggagagattaagaagaactagaaccacccctggagcagcagaaggagaagga

SEQ ID NO: 192158 - DNA, 75 bp, Artificial Sequence
  Synthetic
atagttggatggcccgagataagggagagattaagaagaactagaaccacccctggagcagcagaaggagtagga

SEQ ID NO: 192159 - DNA, 75 bp, Artificial Sequence
  Synthetic
atagttggatggcccgagataagggagagattaagaagaactagaaccacccctggagcagcagaaggagcagga

SEQ ID NO: 192160 - DNA, 75 bp, Artificial Sequence
  Synthetic
atagttggatggcccgagataagggagagattaagaagaactagaaccacccctggagcagcagaaggaggagga

SEQ ID NO: 192161 - DNA, 75 bp, Artificial Sequence
  Synthetic
atagttggatggcccgagataagggagagattaagaagaactagaacctcccctgaagcagcagaaggagaagga

SEQ ID NO: 192162 - DNA, 75 bp, Artificial Sequence
  Synthetic
atagttggatggcccgagataagggagagattaagaagaactagaacctcccctgaagcagcagaaggagtagga

SEQ ID NO: 192163 - DNA, 75 bp, Artificial Sequence
  Synthetic
atagttggatggcccgagataagggagagattaagaagaactagaacctcccctgaagcagcagaaggagcagga

SEQ ID NO: 192164 - DNA, 75 bp, Artificial Sequence
  Synthetic
atagttggatggcccgagataagggagagattaagaagaactagaacctcccctgaagcagcagaaggaggagga

SEQ ID NO: 192165 - DNA, 75 bp, Artificial Sequence
  Synthetic
atagttggatggcccgagataagggagagattaagaagaactagaacctcccctgtagcagcagaaggagaagga

SEQ ID NO: 192166 - DNA, 75 bp, Artificial Sequence
  Synthetic
atagttggatggcccgagataagggagagattaagaagaactagaacctcccctgtagcagcagaaggagtagga

SEQ ID NO: 192167 - DNA, 75 bp, Artificial Sequence
  Synthetic
atagttggatggcccgagataagggagagattaagaagaactagaacctcccctgtagcagcagaaggagcagga

SEQ ID NO: 192168 - DNA, 75 bp, Artificial Sequence
  Synthetic
atagttggatggcccgagataagggagagattaagaagaactagaacctcccctgtagcagcagaaggaggagga

SEQ ID NO: 192169 - DNA, 75 bp, Artificial Sequence
  Synthetic
atagttggatggcccgagataagggagagattaagaagaactagaacctcccctgcagcagcagaaggagaagga

SEQ ID NO: 192170 - DNA, 75 bp, Artificial Sequence
  Synthetic
atagttggatggcccgagataagggagagattaagaagaactagaacctcccctgcagcagcagaaggagtagga

SEQ ID NO: 192171 - DNA, 75 bp, Artificial Sequence
  Synthetic
atagttggatggcccgagataagggagagattaagaagaactagaacctcccctgcagcagcagaaggagcagga

SEQ ID NO: 192172 - DNA, 75 bp, Artificial Sequence
  Synthetic
atagttggatggcccgagataagggagagattaagaagaactagaacctcccctgcagcagcagaaggaggagga

SEQ ID NO: 192173 - DNA, 75 bp, Artificial Sequence
  Synthetic
atagttggatggcccgagataagggagagattaagaagaactagaacctcccctggagcagcagaaggagaagga

SEQ ID NO: 192174 - DNA, 75 bp, Artificial Sequence
  Synthetic
atagttggatggcccgagataagggagagattaagaagaactagaacctcccctggagcagcagaaggagtagga

SEQ ID NO: 192175 - DNA, 75 bp, Artificial Sequence
  Synthetic
atagttggatggcccgagataagggagagattaagaagaactagaacctcccctggagcagcagaaggagcagga

SEQ ID NO: 192176 - DNA, 75 bp, Artificial Sequence
  Synthetic
atagttggatggcccgagataagggagagattaagaagaactagaacctcccctggagcagcagaaggaggagga

SEQ ID NO: 192177 - DNA, 75 bp, Artificial Sequence
  Synthetic
atagttggatggcccgagataagggagagattaagaagaactagaaccccccctgaagcagcagaaggagaagga

SEQ ID NO: 192178 - DNA, 75 bp, Artificial Sequence
  Synthetic
atagttggatggcccgagataagggagagattaagaagaactagaaccccccctgaagcagcagaaggagtagga

SEQ ID NO: 192179 - DNA, 75 bp, Artificial Sequence
  Synthetic
atagttggatggcccgagataagggagagattaagaagaactagaaccccccctgaagcagcagaaggagcagga

SEQ ID NO: 192180 - DNA, 75 bp, Artificial Sequence
  Synthetic
atagttggatggcccgagataagggagagattaagaagaactagaaccccccctgaagcagcagaaggaggagga

SEQ ID NO: 192181 - DNA, 75 bp, Artificial Sequence
  Synthetic
atagttggatggcccgagataagggagagattaagaagaactagaaccccccctgtagcagcagaaggagaagga

SEQ ID NO: 192182 - DNA, 75 bp, Artificial Sequence
  Synthetic
atagttggatggcccgagataagggagagattaagaagaactagaaccccccctgtagcagcagaaggagtagga

SEQ ID NO: 192183 - DNA, 75 bp, Artificial Sequence
  Synthetic
atagttggatggcccgagataagggagagattaagaagaactagaaccccccctgtagcagcagaaggagcagga

SEQ ID NO: 192184 - DNA, 75 bp, Artificial Sequence
  Synthetic
atagttggatggcccgagataagggagagattaagaagaactagaaccccccctgtagcagcagaaggaggagga

SEQ ID NO: 192185 - DNA, 75 bp, Artificial Sequence
  Synthetic
atagttggatggcccgagataagggagagattaagaagaactagaaccccccctgcagcagcagaaggagaagga

SEQ ID NO: 192186 - DNA, 75 bp, Artificial Sequence
  Synthetic
atagttggatggcccgagataagggagagattaagaagaactagaaccccccctgcagcagcagaaggagtagga

SEQ ID NO: 192187 - DNA, 75 bp, Artificial Sequence
  Synthetic
atagttggatggcccgagataagggagagattaagaagaactagaaccccccctgcagcagcagaaggagcagga

SEQ ID NO: 192188 - DNA, 75 bp, Artificial Sequence
  Synthetic
atagttggatggcccgagataagggagagattaagaagaactagaaccccccctgcagcagcagaaggaggagga

SEQ ID NO: 192189 - DNA, 75 bp, Artificial Sequence
  Synthetic
atagttggatggcccgagataagggagagattaagaagaactagaaccccccctggagcagcagaaggagaagga

SEQ ID NO: 192190 - DNA, 75 bp, Artificial Sequence
  Synthetic
atagttggatggcccgagataagggagagattaagaagaactagaaccccccctggagcagcagaaggagtagga

SEQ ID NO: 192191 - DNA, 75 bp, Artificial Sequence
  Synthetic
atagttggatggcccgagataagggagagattaagaagaactagaaccccccctggagcagcagaaggagcagga

SEQ ID NO: 192192 - DNA, 75 bp, Artificial Sequence
  Synthetic
atagttggatggcccgagataagggagagattaagaagaactagaaccccccctggagcagcagaaggaggagga

SEQ ID NO: 192193 - DNA, 75 bp, Artificial Sequence
  Synthetic
atagttggatggcccgagataagggagagattaagaagaactagaaccgcccctgaagcagcagaaggagaagga

SEQ ID NO: 192194 - DNA, 75 bp, Artificial Sequence
  Synthetic
atagttggatggcccgagataagggagagattaagaagaactagaaccgcccctgaagcagcagaaggagtagga

SEQ ID NO: 192195 - DNA, 75 bp, Artificial Sequence
  Synthetic
atagttggatggcccgagataagggagagattaagaagaactagaaccgcccctgaagcagcagaaggagcagga

SEQ ID NO: 192196 - DNA, 75 bp, Artificial Sequence
  Synthetic
atagttggatggcccgagataagggagagattaagaagaactagaaccgcccctgaagcagcagaaggaggagga

SEQ ID NO: 192197 - DNA, 75 bp, Artificial Sequence
  Synthetic
atagttggatggcccgagataagggagagattaagaagaactagaaccgcccctgtagcagcagaaggagaagga

SEQ ID NO: 192198 - DNA, 75 bp, Artificial Sequence
  Synthetic
atagttggatggcccgagataagggagagattaagaagaactagaaccgcccctgtagcagcagaaggagtagga

SEQ ID NO: 192199 - DNA, 75 bp, Artificial Sequence
  Synthetic
atagttggatggcccgagataagggagagattaagaagaactagaaccgcccctgtagcagcagaaggagcagga

SEQ ID NO: 192200 - DNA, 75 bp, Artificial Sequence
  Synthetic
atagttggatggcccgagataagggagagattaagaagaactagaaccgcccctgtagcagcagaaggaggagga

SEQ ID NO: 192201 - DNA, 75 bp, Artificial Sequence
  Synthetic
atagttggatggcccgagataagggagagattaagaagaactagaaccgcccctgcagcagcagaaggagaagga

SEQ ID NO: 192202 - DNA, 75 bp, Artificial Sequence
  Synthetic
atagttggatggcccgagataagggagagattaagaagaactagaaccgcccctgcagcagcagaaggagtagga

SEQ ID NO: 192203 - DNA, 75 bp, Artificial Sequence
  Synthetic
atagttggatggcccgagataagggagagattaagaagaactagaaccgcccctgcagcagcagaaggagcagga

SEQ ID NO: 192204 - DNA, 75 bp, Artificial Sequence
  Synthetic
atagttggatggcccgagataagggagagattaagaagaactagaaccgcccctgcagcagcagaaggaggagga

SEQ ID NO: 192205 - DNA, 75 bp, Artificial Sequence
  Synthetic
atagttggatggcccgagataagggagagattaagaagaactagaaccgcccctggagcagcagaaggagaagga

SEQ ID NO: 192206 - DNA, 75 bp, Artificial Sequence
  Synthetic
atagttggatggcccgagataagggagagattaagaagaactagaaccgcccctggagcagcagaaggagtagga

SEQ ID NO: 192207 - DNA, 75 bp, Artificial Sequence
  Synthetic
atagttggatggcccgagataagggagagattaagaagaactagaaccgcccctggagcagcagaaggagcagga

SEQ ID NO: 192208 - DNA, 75 bp, Artificial Sequence
  Synthetic
atagttggatggcccgagataagggagagattaagaagaactagaaccgcccctggagcagcagaaggaggagga

SEQ ID NO: 192209 - DNA, 75 bp, Artificial Sequence
  Synthetic
actccatcctgataaatggacagtgcagcctatacagctaccagacaaggatagctggactgtcaatgatataca

SEQ ID NO: 192210 - DNA, 75 bp, Artificial Sequence
  Synthetic
gtgaggataatcaaaatcctgtatcaaagcagtaagtatcatttatgtaatgataagtttattagcagaagtaga

SEQ ID NO: 192211 - DNA, 75 bp, Artificial Sequence
  Synthetic
taataatgctaccattgatggtgccatgaaggaaggaatgaaaaattgctctttcaatacaaccacagaagtaag

SEQ ID NO: 192212 - DNA, 75 bp, Artificial Sequence
  Synthetic
actctaaattgcactgatgttaataccactagtagtggcgaggaaatggtggaaagaggagaaataaagaactgc

SEQ ID NO: 192213 - DNA, 75 bp, Artificial Sequence
  Synthetic
caagcacaaccagataagagtgaatcagagatagtcaatcaaataatagagcaattaataaagaaggaaaaggtc

SEQ ID NO: 192214 - DNA, 75 bp, Artificial Sequence
  Synthetic
ccacagaccccaacccacaagaaatggttttggaaaatgtaacagaaaattttaatatgtggaaaaatgacatgg

SEQ ID NO: 192215 - DNA, 75 bp, Artificial Sequence
  Synthetic
tccattcgattagtgaacggattcttagcgcttgcctgggacgacctgcggaacctgtgcctcttcagctaccac

SEQ ID NO: 192216 - DNA, 75 bp, Artificial Sequence
  Synthetic
taatatcactaacaatgggactaatatcactagcagtggggacacaggaatgacaaactgctctttcaatattac

SEQ ID NO: 192217 - DNA, 75 bp, Artificial Sequence
  Synthetic
tcataccctcctctatggaaattatggtaccagttagagaaaggacccatagtaggagcagagaccttttatgta

SEQ ID NO: 192218 - DNA, 75 bp, Artificial Sequence
  Synthetic
gctaaacacagtgggggggcatcaagcagctatgcaaatgctaaaggatactatcaatgaagaagctgcagaatg

SEQ ID NO: 192219 - DNA, 75 bp, Artificial Sequence
  Synthetic
taatagtacaacagctaatagtacaacagctaatagtactttctacaataacacagagaatgaacaactaaaaaa

SEQ ID NO: 192220 - DNA, 75 bp, Artificial Sequence
  Synthetic
taattaattgtacaagacccaacaacaatacaagaagaagtatacatataggaccagggagtgcattttatacat

SEQ ID NO: 192221 - DNA, 75 bp, Artificial Sequence
  Synthetic
atgcattaggaatcattcaggcacaaccagataagagtgaatcagagttagtcaatcaaataatagaaaagttaa

SEQ ID NO: 192222 - DNA, 75 bp, Artificial Sequence
  Synthetic
tgggaacaaaacagtaatctttaatcaaaccacaaaagggggggacccagaaattgtgatgttcacttttaattg

SEQ ID NO: 192223 - DNA, 75 bp, Artificial Sequence
  Synthetic
caaaccacaaaagggggggacccagaaattgtgatgttcacttttaattgtgcaggggaatttttctactgtaat

SEQ ID NO: 192224 - DNA, 75 bp, Artificial Sequence
  Synthetic
tatggaaaacagatggcaggtgatgattgtgtggcaagtagacaggatgaggattagcacatggaaaagtttagt

SEQ ID NO: 192225 - DNA, 75 bp, Artificial Sequence
  Synthetic
atttggaattccctacaacccccaaagtcaaggagtagtagaatctatgaataaagagctaaagaagatcatagg

SEQ ID NO: 192226 - DNA, 75 bp, Artificial Sequence
  Synthetic
tggccagtaaaagtagtacatacagacaatggcagcaatttcaccagcgctgcagttaaggccgcctgttggtgg

SEQ ID NO: 192227 - DNA, 75 bp, Artificial Sequence
  Synthetic
taatgaaaacatcacgcttccatgcagaataaaacaatttgtgaatatgtggcaggaggtagggcgagcaatgta

SEQ ID NO: 192228 - DNA, 75 bp, Artificial Sequence
  Synthetic
tcagattggttgtactttaaattttccaattagtcctattgagactgtaccagtaaaattaaagccaggaatgga

SEQ ID NO: 192229 - DNA, 75 bp, Artificial Sequence
  Synthetic
tgtttctagatggaatagataaggctcaagaagagcatgaaaaatatcacagcaattggagagcaatggctagtg

SEQ ID NO: 192230 - DNA, 75 bp, Artificial Sequence
  Synthetic
taggaaaataaggaaacagaagaaaatagataagttgcttgatagaataagagaaagagaagaagacagtggcaa

SEQ ID NO: 192231 - DNA, 75 bp, Artificial Sequence
  Synthetic
attcttgccacttatctgggacgacctgcggagcctgtgcctcttcagctaccaccgcttgagagacttactctt

SEQ ID NO: 192232 - DNA, 75 bp, Artificial Sequence
  Synthetic
cacagtctactatggggtacctgtgtggaagacggcagacaccaccctattttgtgcatcagatgctaaagcata

SEQ ID NO: 192233 - DNA, 75 bp, Artificial Sequence
  Synthetic
tttgtgcatcagatgctaaagcatatgatacagaagtacataatgtctgggctacacatgcctgtgtacccacag

SEQ ID NO: 192234 - DNA, 75 bp, Artificial Sequence
  Synthetic
agaaagggctttgatataagatgggtggcaagtggtcaaaaagtagtggatggtctgctataagggaaagaatga

SEQ ID NO: 192235 - DNA, 75 bp, Artificial Sequence
  Synthetic
aatgaatgggcattagagctcttagaggagctcaagagtgaagctgttagacactttcctagggtttggcttcat

SEQ ID NO: 192236 - DNA, 75 bp, Artificial Sequence
  Synthetic
cagctaccaccgcttgagagacttaatcttgattgtagcgaggattgtggaacttctgggacgcagggggtggga

SEQ ID NO: 192237 - DNA, 75 bp, Artificial Sequence
  Synthetic
ctctagattgtcagaactttaaaaacatatctgatggcagcaatagtgaaataaaaaactgttcttttaatatga

SEQ ID NO: 192238 - DNA, 75 bp, Artificial Sequence
  Synthetic
gctgattgtgcctggctagaagcacaagaggaggaggaggaagtgggttttccagtcagacctcaggtaccttta

SEQ ID NO: 192239 - DNA, 75 bp, Artificial Sequence
  Synthetic
cccgaacagggacttgaaagtgaaagagaaacattttaaaaagaaaggggggatgggggggcttgttgaagggcg

SEQ ID NO: 192240 - DNA, 75 bp, Artificial Sequence
  Synthetic
ccaaaggtatcctttgagccaattcccatacattattgtgccccagctggttttgcgattctgaagtgtaaggat

SEQ ID NO: 192241 - DNA, 75 bp, Artificial Sequence
  Synthetic
tagtagtagtagcaataatagcaatagttgtgtggaccatagtgcttatagaatataggaaaatattaagacaaa

SEQ ID NO: 192242 - DNA, 75 bp, Artificial Sequence
  Synthetic
catacaaaaagaaacatgggaaacatggtggacagagtattggcaggctacctggattcctgaatgggagtttgt

SEQ ID NO: 192243 - DNA, 75 bp, Artificial Sequence
  Synthetic
agcagaagacagtggcaatgagagcgagggggatacagaggaattgtcaaaagtggtggatatggggcatcttag

SEQ ID NO: 192244 - DNA, 75 bp, Artificial Sequence
  Synthetic
caagacttagataaatatggagcacttacaaccagcaacacaggcaccaataatgctgcctgtgcctggctggaa

SEQ ID NO: 192245 - DNA, 75 bp, Artificial Sequence
  Synthetic
tacaagacccaacaacaatacaagaagaagtatacatataggaccagggagagcattttatacaacaggagaagt

SEQ ID NO: 192246 - DNA, 75 bp, Artificial Sequence
  Synthetic
aaattgtaataactataatggcaccagtaatatcaccagtgccaatatcaccaaggacatacaaggagaaatgaa

SEQ ID NO: 192247 - DNA, 75 bp, Artificial Sequence
  Synthetic
caaggaaaagtatacagctaggaccaggacgagcattttttacaacaggggatataataggggacataaaaaagg

SEQ ID NO: 192248 - DNA, 75 bp, Artificial Sequence
  Synthetic
acaaactgttctttcaatgtcacaagcataggaaataagatgcagaaagaatatgcacttttttataaacttgat

SEQ ID NO: 192249 - DNA, 75 bp, Artificial Sequence
  Synthetic
tacagaatcttcaagggcaaatggtacatcaacccctatcacctagaaccttgaatgcatgggtaaaagtaatag

SEQ ID NO: 192250 - DNA, 75 bp, Artificial Sequence
  Synthetic
tttgaaagcaggcatccaaaagtaagttcagaagtacacatcccactaggggatgctaaattagtagtaagaaca

SEQ ID NO: 192251 - DNA, 75 bp, Artificial Sequence
  Synthetic
attcccatacattattgtgccccagctggatttgcgattctaaaatgcaatgataagaagttcaatgggacgggt

SEQ ID NO: 192252 - DNA, 75 bp, Artificial Sequence
  Synthetic
taaatggtagatgtaatgttaagtttactagcaaaagtagattataaattaggagtaggagcattgataatagca

SEQ ID NO: 192253 - DNA, 75 bp, Artificial Sequence
  Synthetic
atgtcagcacagtacaatgtacacatggaattaggccagtggtgtcaacccagctactgttaaatggcagtctag

SEQ ID NO: 192254 - DNA, 75 bp, Artificial Sequence
  Synthetic
taacatgacctggatggagtgggaaagagaaattgacaattacacaaacacaatatactccttaattgaagaatc

SEQ ID NO: 192255 - DNA, 75 bp, Artificial Sequence
  Synthetic
ctaggaagggggagagtattttatgcaacaggaggcataaaaggagatataaggtacgcacattgcaacgttagt

SEQ ID NO: 192256 - DNA, 75 bp, Artificial Sequence
  Synthetic
aaattgaaacacacagttttaattgtggaggggaatttttctactgtaatacatcaaagctgtttaatagtactt

SEQ ID NO: 192257 - DNA, 75 bp, Artificial Sequence
  Synthetic
ctgagccagcagcagatggggtgggagcagtatctcgagacctggaaaaacatggagcaatcacaagtagcaata

SEQ ID NO: 192258 - DNA, 75 bp, Artificial Sequence
  Synthetic
gaaagatacctaagggatcaacagctcctagggatttggggctgctctggaaaactcatctgcaccactaatgtg

SEQ ID NO: 192259 - DNA, 75 bp, Artificial Sequence
  Synthetic
tcttgagtgaaataatgagaaattgtactttcaatgtaaccacagaactaagggataagcagacaaaagaatatg

SEQ ID NO: 192260 - DNA, 75 bp, Artificial Sequence
  Synthetic
tcctagggatttggggctgctctggaaaactcatctgcaccactaatgtgccctggaatgctagttggagtaata

SEQ ID NO: 192261 - DNA, 75 bp, Artificial Sequence
  Synthetic
ggaactcgacaggcccggagaaatcaaagaaggaggtggagagcaaggcagagacagatccgtgagattagtgaa

SEQ ID NO: 192262 - DNA, 75 bp, Artificial Sequence
  Synthetic
actccggatacgagtggagaagtaaaaaattgctctttcaatataaccacagaaataagggataagacacagaaa

SEQ ID NO: 192263 - DNA, 75 bp, Artificial Sequence
  Synthetic
caggcatggagctggtagatcctagcctagagccttggaaccacccgggaagtcagcctacaactgcttgtagca

SEQ ID NO: 192264 - DNA, 75 bp, Artificial Sequence
  Synthetic
agatataattagtctatgggatcaaagcctaaagccatgtgtaaagttaacccctctctgcgttactttaaattg

SEQ ID NO: 192265 - DNA, 75 bp, Artificial Sequence
  Synthetic
tgcagaataaaacaaattataaacatgtggcaggaggtaggacgagcaatgtatgcccctcccattgcaggaaac

SEQ ID NO: 192266 - DNA, 75 bp, Artificial Sequence
  Synthetic
aggaagtgtaaggataggaccaggacaaacactctttacaaatgacatgataggagacataagacaagcatactg

SEQ ID NO: 192267 - DNA, 75 bp, Artificial Sequence
  Synthetic
gaaaggatcaccagcaatattccaaagtagcatgacaaaaatcttagagccctttagagcaaaaaatccagaaat

SEQ ID NO: 192268 - DNA, 75 bp, Artificial Sequence
  Synthetic
aacatacccagacgaataagacagggcttggaaagggctttactataaaatgggtggcaaatggtcaaaaagtag

SEQ ID NO: 192269 - DNA, 75 bp, Artificial Sequence
  Synthetic
atggtagtctagcagaaggaggggtaaaaattagatctgaaaatatcagcaacaatgccaaaaacataatagtac

SEQ ID NO: 192270 - DNA, 75 bp, Artificial Sequence
  Synthetic
ataacaagcatacgtataggacccgggcaagcattctatgcaagaggtggcataaaaggggatataagaaaagca

SEQ ID NO: 192271 - DNA, 75 bp, Artificial Sequence
  Synthetic
aggccagggaattttcttcagagcagaccagagccaacagccccaccagaggagagcttcaggtttggggaagag

SEQ ID NO: 192272 - DNA, 75 bp, Artificial Sequence
  Synthetic
gcctggctagaagcacaagaagaagaggaggtgggctttccagtcagacctcaggtacctttaagaccaatgact

SEQ ID NO: 192273 - DNA, 75 bp, Artificial Sequence
  Synthetic
ccacagaattaagagataagaagaagaaagaatatgcgattttctataaacttgatgtagtaccaattgatggga

SEQ ID NO: 192274 - DNA, 75 bp, Artificial Sequence
  Synthetic
cctcaggtggggatctagaaatcataacacatagctttaactgtggaggagaatttttctattgtaacacctcag

SEQ ID NO: 192275 - DNA, 75 bp, Artificial Sequence
  Synthetic
tctcgacgcaggactcggcttgctgaagcgcgcacagcaagaggcgaggggcagcgaacggtgagtacgctaaaa

SEQ ID NO: 192276 - DNA, 75 bp, Artificial Sequence
  Synthetic
gtagcaaccctctattgtgtacatgaaaggataaaggtagcagacaccaaggaagctttagacaagatagaggaa

SEQ ID NO: 192277 - DNA, 75 bp, Artificial Sequence
  Synthetic
ggaagctttagacaagatagaggaagaacaaaccaaaagtaagaaaaaggcacagcaagcaacagctgacacagg

SEQ ID NO: 192278 - DNA, 75 bp, Artificial Sequence
  Synthetic
gaaggacacatagccaaaaattgcagggcccctagaaaaaagggctgttggaaatgtggaaaagaaggacaccaa

SEQ ID NO: 192279 - DNA, 75 bp, Artificial Sequence
  Synthetic
atgaaagactgcactgaaagacaggctaattttttagggaaaatttggccttccaacaaggggaggccagggaat

SEQ ID NO: 192280 - DNA, 75 bp, Artificial Sequence
  Synthetic
tcactatacctagtgtaaataatgagacaccagggattagatatcagtacaatgtgctcccacagggatggaaag

SEQ ID NO: 192281 - DNA, 75 bp, Artificial Sequence
  Synthetic
tgagactggggtgggaaggcctcaagtatctgtggaatctcctgatatattggggtcgggaactaaaaattagtg

SEQ ID NO: 192282 - DNA, 75 bp, Artificial Sequence
  Synthetic
aattttaagggcccaaagaaaagcattaagtgtttcaactgtggcaaagaagggcacacagcaaaaaattgcagg

SEQ ID NO: 192283 - DNA, 75 bp, Artificial Sequence
  Synthetic
ttgacatatcaaattggctatggtatataagaatatttataatgatagtaggaggtttaataggtttaagaatag

SEQ ID NO: 192284 - DNA, 75 bp, Artificial Sequence
  Synthetic
tcaacatacctagaaggataagacaaggctttgaaagagctttgctataaaatgggaggcaaatggtcaaaaagg

SEQ ID NO: 192285 - DNA, 75 bp, Artificial Sequence
  Synthetic
atactgcagttaggcctactgttagcaacaatagtagtatgtatgaagaagtaagaaattgctctttcaatacaa

SEQ ID NO: 192286 - DNA, 75 bp, Artificial Sequence
  Synthetic
gtagggaatggtactaataacaacaatagtagtgagaaaatgatggggaaaggagaaatgaaaaattgctctttc

SEQ ID NO: 192287 - DNA, 75 bp, Artificial Sequence
  Synthetic
gtagggaatggtactaataacaacaatagtagtgagaatatgatggggaaaggagaaatgaaaaattgctctttc

SEQ ID NO: 192288 - DNA, 75 bp, Artificial Sequence
  Synthetic
gtagggaatggtactaataacaacaatagtagtgagaacatgatggggaaaggagaaatgaaaaattgctctttc

SEQ ID NO: 192289 - DNA, 75 bp, Artificial Sequence
  Synthetic
gtagggaatggtactaataacaacaatagtagtgagaagatgatggggaaaggagaaatgaaaaattgctctttc

SEQ ID NO: 192290 - DNA, 75 bp, Artificial Sequence
  Synthetic
gtagggaatggtactaataacaacaatagtagtgagtaaatgatggggaaaggagaaatgaaaaattgctctttc

SEQ ID NO: 192291 - DNA, 75 bp, Artificial Sequence
  Synthetic
gtagggaatggtactaataacaacaatagtagtgagtatatgatggggaaaggagaaatgaaaaattgctctttc

SEQ ID NO: 192292 - DNA, 75 bp, Artificial Sequence
  Synthetic
gtagggaatggtactaataacaacaatagtagtgagtacatgatggggaaaggagaaatgaaaaattgctctttc

SEQ ID NO: 192293 - DNA, 75 bp, Artificial Sequence
  Synthetic
gtagggaatggtactaataacaacaatagtagtgagtagatgatggggaaaggagaaatgaaaaattgctctttc

SEQ ID NO: 192294 - DNA, 75 bp, Artificial Sequence
  Synthetic
gtagggaatggtactaataacaacaatagtagtgagcaaatgatggggaaaggagaaatgaaaaattgctctttc

SEQ ID NO: 192295 - DNA, 75 bp, Artificial Sequence
  Synthetic
gtagggaatggtactaataacaacaatagtagtgagcatatgatggggaaaggagaaatgaaaaattgctctttc

SEQ ID NO: 192296 - DNA, 75 bp, Artificial Sequence
  Synthetic
gtagggaatggtactaataacaacaatagtagtgagcacatgatggggaaaggagaaatgaaaaattgctctttc

SEQ ID NO: 192297 - DNA, 75 bp, Artificial Sequence
  Synthetic
gtagggaatggtactaataacaacaatagtagtgagcagatgatggggaaaggagaaatgaaaaattgctctttc

SEQ ID NO: 192298 - DNA, 75 bp, Artificial Sequence
  Synthetic
gtagggaatggtactaataacaacaatagtagtgaggaaatgatggggaaaggagaaatgaaaaattgctctttc

SEQ ID NO: 192299 - DNA, 75 bp, Artificial Sequence
  Synthetic
gtagggaatggtactaataacaacaatagtagtgaggatatgatggggaaaggagaaatgaaaaattgctctttc

SEQ ID NO: 192300 - DNA, 75 bp, Artificial Sequence
  Synthetic
gtagggaatggtactaataacaacaatagtagtgaggacatgatggggaaaggagaaatgaaaaattgctctttc

SEQ ID NO: 192301 - DNA, 75 bp, Artificial Sequence
  Synthetic
gtagggaatggtactaataacaacaatagtagtgaggagatgatggggaaaggagaaatgaaaaattgctctttc

SEQ ID NO: 192302 - DNA, 75 bp, Artificial Sequence
  Synthetic
gtagggaatggtactaatatcaacaatagtagtgagaaaatgatggggaaaggagaaatgaaaaattgctctttc

SEQ ID NO: 192303 - DNA, 75 bp, Artificial Sequence
  Synthetic
gtagggaatggtactaatatcaacaatagtagtgagaatatgatggggaaaggagaaatgaaaaattgctctttc

SEQ ID NO: 192304 - DNA, 75 bp, Artificial Sequence
  Synthetic
gtagggaatggtactaatatcaacaatagtagtgagaacatgatggggaaaggagaaatgaaaaattgctctttc

SEQ ID NO: 192305 - DNA, 75 bp, Artificial Sequence
  Synthetic
gtagggaatggtactaatatcaacaatagtagtgagaagatgatggggaaaggagaaatgaaaaattgctctttc

SEQ ID NO: 192306 - DNA, 75 bp, Artificial Sequence
  Synthetic
gtagggaatggtactaatatcaacaatagtagtgagtaaatgatggggaaaggagaaatgaaaaattgctctttc

SEQ ID NO: 192307 - DNA, 75 bp, Artificial Sequence
  Synthetic
gtagggaatggtactaatatcaacaatagtagtgagtatatgatggggaaaggagaaatgaaaaattgctctttc

SEQ ID NO: 192308 - DNA, 75 bp, Artificial Sequence
  Synthetic
gtagggaatggtactaatatcaacaatagtagtgagtacatgatggggaaaggagaaatgaaaaattgctctttc

SEQ ID NO: 192309 - DNA, 75 bp, Artificial Sequence
  Synthetic
gtagggaatggtactaatatcaacaatagtagtgagtagatgatggggaaaggagaaatgaaaaattgctctttc

SEQ ID NO: 192310 - DNA, 75 bp, Artificial Sequence
  Synthetic
gtagggaatggtactaatatcaacaatagtagtgagcaaatgatggggaaaggagaaatgaaaaattgctctttc

SEQ ID NO: 192311 - DNA, 75 bp, Artificial Sequence
  Synthetic
gtagggaatggtactaatatcaacaatagtagtgagcatatgatggggaaaggagaaatgaaaaattgctctttc

SEQ ID NO: 192312 - DNA, 75 bp, Artificial Sequence
  Synthetic
gtagggaatggtactaatatcaacaatagtagtgagcacatgatggggaaaggagaaatgaaaaattgctctttc

SEQ ID NO: 192313 - DNA, 75 bp, Artificial Sequence
  Synthetic
gtagggaatggtactaatatcaacaatagtagtgagcagatgatggggaaaggagaaatgaaaaattgctctttc

SEQ ID NO: 192314 - DNA, 75 bp, Artificial Sequence
  Synthetic
gtagggaatggtactaatatcaacaatagtagtgaggaaatgatggggaaaggagaaatgaaaaattgctctttc

SEQ ID NO: 192315 - DNA, 75 bp, Artificial Sequence
  Synthetic
gtagggaatggtactaatatcaacaatagtagtgaggatatgatggggaaaggagaaatgaaaaattgctctttc

SEQ ID NO: 192316 - DNA, 75 bp, Artificial Sequence
  Synthetic
gtagggaatggtactaatatcaacaatagtagtgaggacatgatggggaaaggagaaatgaaaaattgctctttc

SEQ ID NO: 192317 - DNA, 75 bp, Artificial Sequence
  Synthetic
gtagggaatggtactaatatcaacaatagtagtgaggagatgatggggaaaggagaaatgaaaaattgctctttc

SEQ ID NO: 192318 - DNA, 75 bp, Artificial Sequence
  Synthetic
gtagggaatggtactaataccaacaatagtagtgagaaaatgatggggaaaggagaaatgaaaaattgctctttc

SEQ ID NO: 192319 - DNA, 75 bp, Artificial Sequence
  Synthetic
gtagggaatggtactaataccaacaatagtagtgagaatatgatggggaaaggagaaatgaaaaattgctctttc

SEQ ID NO: 192320 - DNA, 75 bp, Artificial Sequence
  Synthetic
gtagggaatggtactaataccaacaatagtagtgagaacatgatggggaaaggagaaatgaaaaattgctctttc

SEQ ID NO: 192321 - DNA, 75 bp, Artificial Sequence
  Synthetic
gtagggaatggtactaataccaacaatagtagtgagaagatgatggggaaaggagaaatgaaaaattgctctttc

SEQ ID NO: 192322 - DNA, 75 bp, Artificial Sequence
  Synthetic
gtagggaatggtactaataccaacaatagtagtgagtaaatgatggggaaaggagaaatgaaaaattgctctttc

SEQ ID NO: 192323 - DNA, 75 bp, Artificial Sequence
  Synthetic
gtagggaatggtactaataccaacaatagtagtgagtatatgatggggaaaggagaaatgaaaaattgctctttc

SEQ ID NO: 192324 - DNA, 75 bp, Artificial Sequence
  Synthetic
gtagggaatggtactaataccaacaatagtagtgagtacatgatggggaaaggagaaatgaaaaattgctctttc

SEQ ID NO: 192325 - DNA, 75 bp, Artificial Sequence
  Synthetic
gtagggaatggtactaataccaacaatagtagtgagtagatgatggggaaaggagaaatgaaaaattgctctttc

SEQ ID NO: 192326 - DNA, 75 bp, Artificial Sequence
  Synthetic
gtagggaatggtactaataccaacaatagtagtgagcaaatgatggggaaaggagaaatgaaaaattgctctttc

SEQ ID NO: 192327 - DNA, 75 bp, Artificial Sequence
  Synthetic
gtagggaatggtactaataccaacaatagtagtgagcatatgatggggaaaggagaaatgaaaaattgctctttc

SEQ ID NO: 192328 - DNA, 75 bp, Artificial Sequence
  Synthetic
gtagggaatggtactaataccaacaatagtagtgagcacatgatggggaaaggagaaatgaaaaattgctctttc

SEQ ID NO: 192329 - DNA, 75 bp, Artificial Sequence
  Synthetic
gtagggaatggtactaataccaacaatagtagtgagcagatgatggggaaaggagaaatgaaaaattgctctttc

SEQ ID NO: 192330 - DNA, 75 bp, Artificial Sequence
  Synthetic
gtagggaatggtactaataccaacaatagtagtgaggaaatgatggggaaaggagaaatgaaaaattgctctttc

SEQ ID NO: 192331 - DNA, 75 bp, Artificial Sequence
  Synthetic
gtagggaatggtactaataccaacaatagtagtgaggatatgatggggaaaggagaaatgaaaaattgctctttc

SEQ ID NO: 192332 - DNA, 75 bp, Artificial Sequence
  Synthetic
gtagggaatggtactaataccaacaatagtagtgaggacatgatggggaaaggagaaatgaaaaattgctctttc

SEQ ID NO: 192333 - DNA, 75 bp, Artificial Sequence
  Synthetic
gtagggaatggtactaataccaacaatagtagtgaggagatgatggggaaaggagaaatgaaaaattgctctttc

SEQ ID NO: 192334 - DNA, 75 bp, Artificial Sequence
  Synthetic
gtagggaatggtactaatagcaacaatagtagtgagaaaatgatggggaaaggagaaatgaaaaattgctctttc

SEQ ID NO: 192335 - DNA, 75 bp, Artificial Sequence
  Synthetic
gtagggaatggtactaatagcaacaatagtagtgagaatatgatggggaaaggagaaatgaaaaattgctctttc

SEQ ID NO: 192336 - DNA, 75 bp, Artificial Sequence
  Synthetic
gtagggaatggtactaatagcaacaatagtagtgagaacatgatggggaaaggagaaatgaaaaattgctctttc

SEQ ID NO: 192337 - DNA, 75 bp, Artificial Sequence
  Synthetic
gtagggaatggtactaatagcaacaatagtagtgagaagatgatggggaaaggagaaatgaaaaattgctctttc

SEQ ID NO: 192338 - DNA, 75 bp, Artificial Sequence
  Synthetic
gtagggaatggtactaatagcaacaatagtagtgagtaaatgatggggaaaggagaaatgaaaaattgctctttc

SEQ ID NO: 192339 - DNA, 75 bp, Artificial Sequence
  Synthetic
gtagggaatggtactaatagcaacaatagtagtgagtatatgatggggaaaggagaaatgaaaaattgctctttc

SEQ ID NO: 192340 - DNA, 75 bp, Artificial Sequence
  Synthetic
gtagggaatggtactaatagcaacaatagtagtgagtacatgatggggaaaggagaaatgaaaaattgctctttc

SEQ ID NO: 192341 - DNA, 75 bp, Artificial Sequence
  Synthetic
gtagggaatggtactaatagcaacaatagtagtgagtagatgatggggaaaggagaaatgaaaaattgctctttc

SEQ ID NO: 192342 - DNA, 75 bp, Artificial Sequence
  Synthetic
gtagggaatggtactaatagcaacaatagtagtgagcaaatgatggggaaaggagaaatgaaaaattgctctttc

SEQ ID NO: 192343 - DNA, 75 bp, Artificial Sequence
  Synthetic
gtagggaatggtactaatagcaacaatagtagtgagcatatgatggggaaaggagaaatgaaaaattgctctttc

SEQ ID NO: 192344 - DNA, 75 bp, Artificial Sequence
  Synthetic
gtagggaatggtactaatagcaacaatagtagtgagcacatgatggggaaaggagaaatgaaaaattgctctttc

SEQ ID NO: 192345 - DNA, 75 bp, Artificial Sequence
  Synthetic
gtagggaatggtactaatagcaacaatagtagtgagcagatgatggggaaaggagaaatgaaaaattgctctttc

SEQ ID NO: 192346 - DNA, 75 bp, Artificial Sequence
  Synthetic
gtagggaatggtactaatagcaacaatagtagtgaggaaatgatggggaaaggagaaatgaaaaattgctctttc

SEQ ID NO: 192347 - DNA, 75 bp, Artificial Sequence
  Synthetic
gtagggaatggtactaatagcaacaatagtagtgaggatatgatggggaaaggagaaatgaaaaattgctctttc

SEQ ID NO: 192348 - DNA, 75 bp, Artificial Sequence
  Synthetic
gtagggaatggtactaatagcaacaatagtagtgaggacatgatggggaaaggagaaatgaaaaattgctctttc

SEQ ID NO: 192349 - DNA, 75 bp, Artificial Sequence
  Synthetic
gtagggaatggtactaatagcaacaatagtagtgaggagatgatggggaaaggagaaatgaaaaattgctctttc

SEQ ID NO: 192350 - DNA, 75 bp, Artificial Sequence
  Synthetic
actggagccaactgccccaccagcagagatctgtgggatgggggaagagatagcctcccctccgaagcaggagca

SEQ ID NO: 192351 - DNA, 75 bp, Artificial Sequence
  Synthetic
aagcgtaaagccatgtgtaaaattagccccactctgtgttactctaaattgcactaatttgaataatagtgttga

SEQ ID NO: 192352 - DNA, 75 bp, Artificial Sequence
  Synthetic
gagaacgagataaaggaagaaataaaaaactgctcttttaatatcaccacaagcagaagaaataaattgcggaaa

SEQ ID NO: 192353 - DNA, 75 bp, Artificial Sequence
  Synthetic
cacacaaaaatctgaaaacagggaaatatgcaaaaaggagaactgcccacactaacgatgtaaaacaactaaccg

SEQ ID NO: 192354 - DNA, 75 bp, Artificial Sequence
  Synthetic
gtgtcactttaaattgcaatactactagccacaataatagcagccccagccccatgacaaattgctctttcaatg

SEQ ID NO: 192355 - DNA, 75 bp, Artificial Sequence
  Synthetic
tgattgtgtggcaggtagacaggatgagaattagaacatggaacagtttagtaaaacatcatatgtatgtctcaa

SEQ ID NO: 192356 - DNA, 75 bp, Artificial Sequence
  Synthetic
ggccattgacagaagaaaaaataaaagcattaacagaaatttgtacagaaatggaaaaggaaggaaaaatttcaa

SEQ ID NO: 192357 - DNA, 75 bp, Artificial Sequence
  Synthetic
ccagtggtatcaactcaactactgttaaatggtagcctagcagaaggggagataataattagatctgaaaatctg

SEQ ID NO: 192358 - DNA, 75 bp, Artificial Sequence
  Synthetic
cagctgaatgaatctgtagtaattaattgtacaagacccaacaacaatacaagaaaaagtatacatatgggacca

SEQ ID NO: 192359 - DNA, 75 bp, Artificial Sequence
  Synthetic
acaaggaaaagtataaggataggaccaggacaagtattctatacaaatgaaataataggaaacataagacaagca

SEQ ID NO: 192360 - DNA, 75 bp, Artificial Sequence
  Synthetic
gggagagcatggttcacaacaggagaaataataggaaatataagagaagcacattgtaaccttagtagaacaaaa

SEQ ID NO: 192361 - DNA, 75 bp, Artificial Sequence
  Synthetic
cttatgaagatatttggggtaacatgacctggatgcaatgggaaggagaaattgataattacacaggtgcaatat

SEQ ID NO: 192362 - DNA, 75 bp, Artificial Sequence
  Synthetic
gcaagaagtaggaaaagcaatgtatgcccctcccatcagaggacaaattagatgctcatcaaatattacagggct

SEQ ID NO: 192363 - DNA, 75 bp, Artificial Sequence
  Synthetic
tagtaataacaacatactgggggctgcatacaggagaaagagattggcatctgggtcagggagtctccatagaat

SEQ ID NO: 192364 - DNA, 75 bp, Artificial Sequence
  Synthetic
gcatacaggagaaagagattggcatctgggtcagggagtctccatagaatggaggcaggggaggtataggacaca

SEQ ID NO: 192365 - DNA, 75 bp, Artificial Sequence
  Synthetic
aggaggtaggctttccagtcaggccgcaggtacctctaagaccaatgacttataaggcagcttttgatcttagct

SEQ ID NO: 192366 - DNA, 75 bp, Artificial Sequence
  Synthetic
tgagtatagactaataaattgtaatacctcagccattacacaggcttgtccaaaggtatcctttgagccaattcc

SEQ ID NO: 192367 - DNA, 75 bp, Artificial Sequence
  Synthetic
agtgttaggaagctaacagaagatagatggaacaagccccagaggaccaagggccacagagggagccatacaatg

SEQ ID NO: 192368 - DNA, 75 bp, Artificial Sequence
  Synthetic
caactcaactgctgttaaatggcagtctagcagaagaagagatagtgattagatctgaaaatatcacaaacaatg

SEQ ID NO: 192369 - DNA, 75 bp, Artificial Sequence
  Synthetic
gtggcgcgcgaacagggactagaaagcgaaagtagacccagaggagctctctcggacgcaggactcggcttgctg

SEQ ID NO: 192370 - DNA, 75 bp, Artificial Sequence
  Synthetic
aatattaagacaaagaaaaatagacaggttaattgatagaataagagaaagagcagaagacagtggcaatgagag

SEQ ID NO: 192371 - DNA, 75 bp, Artificial Sequence
  Synthetic
acatacctagaagaataagacagggcttagaaagggctttgcaataagatgggtggcaagtggtcaaaacgtagt

SEQ ID NO: 192372 - DNA, 75 bp, Artificial Sequence
  Synthetic
cttgggagtagcaggaagcactatgggcgcggcgtcaatgacgctgacggtacaggccagacaattgctgtctgg

SEQ ID NO: 192373 - DNA, 75 bp, Artificial Sequence
  Synthetic
ggcaagtggtcaaaaagcagcatagttggatggcctgctataagagaaagaatcagacgaactgagccagcagca

SEQ ID NO: 192374 - DNA, 75 bp, Artificial Sequence
  Synthetic
aacagaagcagtgcaaaaaatagccacagagagcatagtaatatggggaaaagttcctaaatttaaactacctat

SEQ ID NO: 192375 - DNA, 75 bp, Artificial Sequence
  Synthetic
aagaggaggaagacgaagtaggctttccagtcaggcctcaggtgcttttgagaccaatgacatataagggagcat

SEQ ID NO: 192376 - DNA, 75 bp, Artificial Sequence
  Synthetic
gtatatatacaatataggaaattagtagaacctacgaaaatagactggttaatcaaaagaattagggaaagagca

SEQ ID NO: 192377 - DNA, 75 bp, Artificial Sequence
  Synthetic
actcacaataggcaccctggaggaagatttcggggcgatacaaaactgttctttcaatatgaccacagaagtaac

SEQ ID NO: 192378 - DNA, 75 bp, Artificial Sequence
  Synthetic
actactagtacccttcaggaacaaatagcatggatgacaaataatccacctatcccagtaggagaaatctataaa

SEQ ID NO: 192379 - DNA, 75 bp, Artificial Sequence
  Synthetic
ataataatactgcggagggggtggaagaaatgacaaactgctctttcgatgtcacaaacatgggaaagaagcata

SEQ ID NO: 192380 - DNA, 75 bp, Artificial Sequence
  Synthetic
attagtgagcggattcttagcgcttgcctgggacgacctgcggaacctgtgcctcttcagctaccaccgattgag

SEQ ID NO: 192381 - DNA, 75 bp, Artificial Sequence
  Synthetic
cctgggaatttggggctgctctggaaaactcatctgcaccactactgtaccctggaattctagttggagtaataa

SEQ ID NO: 192382 - DNA, 75 bp, Artificial Sequence
  Synthetic
aaaaagtataaaagtaggatcggggagaataatctatgcaaaaggaagaataataggagatataagaaaagcaca

SEQ ID NO: 192383 - DNA, 75 bp, Artificial Sequence
  Synthetic
cactctcccatgtaaaatacaacaaattgtcaacatgtggcaggaagtaggacgagcaatgtatgctactcccat

SEQ ID NO: 192384 - DNA, 75 bp, Artificial Sequence
  Synthetic
cactctcccatgtaaaatacaacaaattgtcaacatgtggcaggaagtaggacgagcaatgtatgcttctcccat

SEQ ID NO: 192385 - DNA, 75 bp, Artificial Sequence
  Synthetic
cactctcccatgtaaaatacaacaaattgtcaacatgtggcaggaagtaggacgagcaatgtatgctcctcccat

SEQ ID NO: 192386 - DNA, 75 bp, Artificial Sequence
  Synthetic
cactctcccatgtaaaatacaacaaattgtcaacatgtggcaggaagtaggacgagcaatgtatgctgctcccat

SEQ ID NO: 192387 - DNA, 75 bp, Artificial Sequence
  Synthetic
cactctcccatgtaaaatacaacaaattgtcaacatgtggcaggaagttggacgagcaatgtatgctactcccat

SEQ ID NO: 192388 - DNA, 75 bp, Artificial Sequence
  Synthetic
cactctcccatgtaaaatacaacaaattgtcaacatgtggcaggaagttggacgagcaatgtatgcttctcccat

SEQ ID NO: 192389 - DNA, 75 bp, Artificial Sequence
  Synthetic
cactctcccatgtaaaatacaacaaattgtcaacatgtggcaggaagttggacgagcaatgtatgctcctcccat

SEQ ID NO: 192390 - DNA, 75 bp, Artificial Sequence
  Synthetic
cactctcccatgtaaaatacaacaaattgtcaacatgtggcaggaagttggacgagcaatgtatgctgctcccat

SEQ ID NO: 192391 - DNA, 75 bp, Artificial Sequence
  Synthetic
cactctcccatgtaaaatacaacaaattgtcaacatgtggcaggaagtcggacgagcaatgtatgctactcccat

SEQ ID NO: 192392 - DNA, 75 bp, Artificial Sequence
  Synthetic
cactctcccatgtaaaatacaacaaattgtcaacatgtggcaggaagtcggacgagcaatgtatgcttctcccat

SEQ ID NO: 192393 - DNA, 75 bp, Artificial Sequence
  Synthetic
cactctcccatgtaaaatacaacaaattgtcaacatgtggcaggaagtcggacgagcaatgtatgctcctcccat

SEQ ID NO: 192394 - DNA, 75 bp, Artificial Sequence
  Synthetic
cactctcccatgtaaaatacaacaaattgtcaacatgtggcaggaagtcggacgagcaatgtatgctgctcccat

SEQ ID NO: 192395 - DNA, 75 bp, Artificial Sequence
  Synthetic
cactctcccatgtaaaatacaacaaattgtcaacatgtggcaggaagtgggacgagcaatgtatgctactcccat

SEQ ID NO: 192396 - DNA, 75 bp, Artificial Sequence
  Synthetic
cactctcccatgtaaaatacaacaaattgtcaacatgtggcaggaagtgggacgagcaatgtatgcttctcccat

SEQ ID NO: 192397 - DNA, 75 bp, Artificial Sequence
  Synthetic
cactctcccatgtaaaatacaacaaattgtcaacatgtggcaggaagtgggacgagcaatgtatgctcctcccat

SEQ ID NO: 192398 - DNA, 75 bp, Artificial Sequence
  Synthetic
cactctcccatgtaaaatacaacaaattgtcaacatgtggcaggaagtgggacgagcaatgtatgctgctcccat

SEQ ID NO: 192399 - DNA, 75 bp, Artificial Sequence
  Synthetic
tcctcaggaggggacccagaaattgaaatgcacagttttaattgtggaggggaatttttctactgtaatacaaca

SEQ ID NO: 192400 - DNA, 75 bp, Artificial Sequence
  Synthetic
ggaatttttctactgtaatacaacaaagctgtttaatagtacttggcagcgtaatgacacttggaataacagcag

SEQ ID NO: 192401 - DNA, 75 bp, Artificial Sequence
  Synthetic
aataatttttaaaccatcctcaggaggggacccagaaattacaacacacacctttaattgtggaggggagttttt

SEQ ID NO: 192402 - DNA, 75 bp, Artificial Sequence
  Synthetic
caactgattcacctgcattattttaactgtttttcagaatcggccgtaaggaaagccatactaggagaagtagtt

SEQ ID NO: 192403 - DNA, 75 bp, Artificial Sequence
  Synthetic
aaacaatgagacaccagggattagatatcagtacaatgtgcttccacagggatggaaaggatcaccagcaatatt

SEQ ID NO: 192404 - DNA, 75 bp, Artificial Sequence
  Synthetic
ccggggtggagaacaaggaagaagtaaaaaactgctctttcaatatgaccacagagataagggataagaagagga

SEQ ID NO: 192405 - DNA, 75 bp, Artificial Sequence
  Synthetic
ttatctgggacgacctgaggaacctgtgcctcttcagctaccaccgcttgagagacttactcttgattgtagcga

SEQ ID NO: 192406 - DNA, 75 bp, Artificial Sequence
  Synthetic
ttaccctatagtgcaaaatgcacaagggcaaatggtacatcagtccatgtcacctaggactttgaatgcatgggt

SEQ ID NO: 192407 - DNA, 75 bp, Artificial Sequence
  Synthetic
agtatacatataggaccaggaaaagcattctatgcaagaggtgaagtaataggagatataagacaggcattttgt

SEQ ID NO: 192408 - DNA, 75 bp, Artificial Sequence
  Synthetic
tggttttacagacatcattatgaaagcagacatccaaaagtaagttcagaagtacacatcccattaggggatgct

SEQ ID NO: 192409 - DNA, 75 bp, Artificial Sequence
  Synthetic
tgagagacaggctaattttttagggaaaatttggccttccaacaaggggaggccagggaattttcctcagagcag

SEQ ID NO: 192410 - DNA, 75 bp, Artificial Sequence
  Synthetic
ctttactataaaatgggtggcaaatggtcaaaaagtagtatagttggatggcctcaggtaagggaaagaatgaga

SEQ ID NO: 192411 - DNA, 75 bp, Artificial Sequence
  Synthetic
acatatagtatgggcaagcagggagctagagcgattcgcagtcaatcctggcctattagaaacatcagaaggctg

SEQ ID NO: 192412 - DNA, 75 bp, Artificial Sequence
  Synthetic
agcatagtaatatggggaaaaattcctaaatttagactacccatacaaaaagaaacatgggaaacatggtggaca

SEQ ID NO: 192413 - DNA, 75 bp, Artificial Sequence
  Synthetic
ttgaagaatcgcagaaccagcaggaaaagaatgaacaagacttattggcattggacaagtgggcaagtctgtgga

SEQ ID NO: 192414 - DNA, 75 bp, Artificial Sequence
  Synthetic
tggaacactagttggagtaataaatcttatgaggagatttgggataacatgacctggatacaatgggaaagggaa

SEQ ID NO: 192415 - DNA, 75 bp, Artificial Sequence
  Synthetic
gaaaaagacagctggactgtcaatgacatacagaagttagtgggaaaattaaattgggcaagtcagatttacgca

SEQ ID NO: 192416 - DNA, 75 bp, Artificial Sequence
  Synthetic
gaagctctattagatacaggagcagatgatacagtattagaagacataaatttgccaggaaaatggaaaccaaaa

SEQ ID NO: 192417 - DNA, 75 bp, Artificial Sequence
  Synthetic
agtactggtactgctaactatactaataccaggattgaagaaatgaaaaattgctctttcaatacaaccacagaa

SEQ ID NO: 192418 - DNA, 75 bp, Artificial Sequence
  Synthetic
actaccattaatggtgctaataacgctaatagaacaatagaggataagatgggggaactaataaaaagctgctct

SEQ ID NO: 192419 - DNA, 75 bp, Artificial Sequence
  Synthetic
aagacaaacccctccagcagaaggagtaggagcagcacctcaagacttagctaggcatggagcaatcacaagcag

SEQ ID NO: 192420 - DNA, 75 bp, Artificial Sequence
  Synthetic
aaatgatgacagcatgccaaggagtgggaggacccagccataaagcaagggttttggctgaagcaatgagtcagg

SEQ ID NO: 192421 - DNA, 75 bp, Artificial Sequence
  Synthetic
gggaaaacatgacctggatgcagtgggagagagaaattgataattacacagacacaatatacaggttgcttgagg

SEQ ID NO: 192422 - DNA, 75 bp, Artificial Sequence
  Synthetic
aatcattatttaatacagtagcaaccctctattgtgtacatcaaaggatagaggtaagagacaccaaagaagctc

SEQ ID NO: 192423 - DNA, 75 bp, Artificial Sequence
  Synthetic
tagtgagcggattcttagcacttgcctgggacgacctgcggagcctgtgcctcttcagctaccaccgattgagag

SEQ ID NO: 192424 - DNA, 75 bp, Artificial Sequence
  Synthetic
tatgtagatggggcatctaatagagagaccaaaaaaggaaaagcaggatatgttactgacaaaggaagacaaaaa

SEQ ID NO: 192425 - DNA, 75 bp, Artificial Sequence
  Synthetic
taatatgacttgttgggaaaatggaacaaatctgctgaataatattaccagggacatgaaaaactgctctttcaa

SEQ ID NO: 192426 - DNA, 75 bp, Artificial Sequence
  Synthetic
gctaatgctaatgctactgtggataatagcgcagttggacaaataaaaaattgctctttcaaaacaaccacagaa

SEQ ID NO: 192427 - DNA, 75 bp, Artificial Sequence
  Synthetic
gaagaactgagccagcaactgagccagcggcagagggagtagggtcagcatctaaagacttagagaaacatggag

SEQ ID NO: 192428 - DNA, 75 bp, Artificial Sequence
  Synthetic
cttggaatactagttggagtaataaatcttatgaagagatttgggataacatgacttggatgcagtgggagaaag

SEQ ID NO: 192429 - DNA, 75 bp, Artificial Sequence
  Synthetic
gagaccaaggtcaacgtgaccactgtctctataggaaatctaacagatgaagtaagaaactgttcttttaatgtg

SEQ ID NO: 192430 - DNA, 75 bp, Artificial Sequence
  Synthetic
ggagaaataataggagatataagacaagcacattgtaatattagtgcacaaaaatggaatagcactttacaaaag

SEQ ID NO: 192431 - DNA, 75 bp, Artificial Sequence
  Synthetic
ggtaaggataggaccagggcgaacattcgttacacgtaatatagtaggagacataagacaagcatattgtagcat

SEQ ID NO: 192432 - DNA, 75 bp, Artificial Sequence
  Synthetic
tattcataatgatagtaggaggcttaataggtttaagaatagtttttactgtactttctatagtgaatagagtta

SEQ ID NO: 192433 - DNA, 75 bp, Artificial Sequence
  Synthetic
gggatttactacaccagacaaaaagcatcagaaagaacctccattcctttggatgggatatgaactccatcctga

SEQ ID NO: 192434 - DNA, 75 bp, Artificial Sequence
  Synthetic
ggattcttagcactcatctgggacgacctgcggagcctgtgcctcttcagctaccaccgcttgagagacttactc

SEQ ID NO: 192435 - DNA, 75 bp, Artificial Sequence
  Synthetic
acctgcggagcctgtgcctcttcagctaccaccgcttgagagacttactcttgattgtagcgaggattgtggaac

SEQ ID NO: 192436 - DNA, 75 bp, Artificial Sequence
  Synthetic
agagtgtgagaaatgttacccacaatgagagcgggaatggaatgaaaaattgctctttcaatacaaccacagtag

SEQ ID NO: 192437 - DNA, 75 bp, Artificial Sequence
  Synthetic
agacaagttacttaatagaataagagaaagagcagaagatagtggcaatgagagtgatggggatacagaagaatt

SEQ ID NO: 192438 - DNA, 75 bp, Artificial Sequence
  Synthetic
acatggtagaacagatgcatgaggatataattagtttatgggatcaaagcctaaagccatgtgtaaaattaaccc

SEQ ID NO: 192439 - DNA, 75 bp, Artificial Sequence
  Synthetic
gagacaacaaatcaaaagactgaactacatgcaatctatctagccttgcaggattcaggatcagaagtaaatata

SEQ ID NO: 192440 - DNA, 75 bp, Artificial Sequence
  Synthetic
atttgggataacatgacctggatgcagtgggatagagaaattaataattacacaaacataatatacgatttgctt

SEQ ID NO: 192441 - DNA, 75 bp, Artificial Sequence
  Synthetic
ggcagaccagctaattcatatgcattattttgattgttttgcagactctgccataaggaaagccatattaggaca

SEQ ID NO: 192442 - DNA, 75 bp, Artificial Sequence
  Synthetic
ctctatcaaagacaggccggaaacaaaaaactgctctttcgatataaccacagtactaagagataagaaagagaa

SEQ ID NO: 192443 - DNA, 75 bp, Artificial Sequence
  Synthetic
caggtcagccaaaattaccctatagtgcagaacctccaggggcaaatggtacatcagcccatatcacctagaact

SEQ ID NO: 192444 - DNA, 75 bp, Artificial Sequence
  Synthetic
tgggaaatcctcaagtattggtggaatctcctgcagtattggagtcaggaactaaagaatagtgctgttagcttg

SEQ ID NO: 192445 - DNA, 75 bp, Artificial Sequence
  Synthetic
taccacaccagataaaaaacatcagaaagaacccccattcctttggatgggatatgagctccatcctgacaaatg

SEQ ID NO: 192446 - DNA, 75 bp, Artificial Sequence
  Synthetic
gtcacagtctactatggggtgcctgtgtggaaagaagcaaccaccaccctattttgtgcatcagatgctaaagca

SEQ ID NO: 192447 - DNA, 75 bp, Artificial Sequence
  Synthetic
ctgagccagcagcagatggggtgggagcagcatctcgagacctagaaagacatggagcaatcacaagtagcaata

SEQ ID NO: 192448 - DNA, 75 bp, Artificial Sequence
  Synthetic
tagcaatagttgtgtggtccatagtactcatagaatataggaaaatattaagacaaagaaaaatagacaggttaa

SEQ ID NO: 192449 - DNA, 75 bp, Artificial Sequence
  Synthetic
agaagaaatgatgacagcatgtcagggagtggggggacccggccataaagcaagagttttggctgaagcaatgag

SEQ ID NO: 192450 - DNA, 75 bp, Artificial Sequence
  Synthetic
tttaatccatcctcaggaggggacccagaaattgtaatgcacagttttaattgtggaggggaatttttctactgt

SEQ ID NO: 192451 - DNA, 75 bp, Artificial Sequence
  Synthetic
agacaaagaaaaatagacaggttaattgatagaataatagaaagagcagaagacagtggcaatgagagtgagggg

SEQ ID NO: 192452 - DNA, 75 bp, Artificial Sequence
  Synthetic
aagacaaagaaaaatagactggttaattaaaagaattagggaaagggcagaagacagtggcaatgagagtgatgg

SEQ ID NO: 192453 - DNA, 75 bp, Artificial Sequence
  Synthetic
ttatagattaggagtaggagcattaataatagcactaatcatagcaataattgtgtggaccatagtatatataga

SEQ ID NO: 192454 - DNA, 75 bp, Artificial Sequence
  Synthetic
cagggacagcagagatccaatttggaaaggaccagcaaagctactctggaaaggtgaaggggcagtagtaataca

SEQ ID NO: 192455 - DNA, 75 bp, Artificial Sequence
  Synthetic
agaaaatttgtgggtcacagtctattatggggtacctgtgtggaaagaagcaaacaccactctattttgtgcatc

SEQ ID NO: 192456 - DNA, 75 bp, Artificial Sequence
  Synthetic
aaatatggagggagaaataaaaaactgctctttctatgtcaccacaggcgtaggagataataaacgtaaagaaca

SEQ ID NO: 192457 - DNA, 75 bp, Artificial Sequence
  Synthetic
gtggggatttaccacaccagacaaaaaacatcagaaagaacccccatttctttggatgggatatgaactccatcc

SEQ ID NO: 192458 - DNA, 75 bp, Artificial Sequence
  Synthetic
aacaccaataacactgggagtagcaccctgaaggaagagccagaggcaatacaaaactgctctttcaatgcaacc

SEQ ID NO: 192459 - DNA, 75 bp, Artificial Sequence
  Synthetic
aacaccaataacactgggtgtagcaccctgaaggaagagccagaggcaatacaaaactgctctttcaatgcaacc

SEQ ID NO: 192460 - DNA, 75 bp, Artificial Sequence
  Synthetic
aacaccaataacactgggcgtagcaccctgaaggaagagccagaggcaatacaaaactgctctttcaatgcaacc

SEQ ID NO: 192461 - DNA, 75 bp, Artificial Sequence
  Synthetic
aacaccaataacactgggggtagcaccctgaaggaagagccagaggcaatacaaaactgctctttcaatgcaacc

SEQ ID NO: 192462 - DNA, 75 bp, Artificial Sequence
  Synthetic
gtacaaatgcttctgttaatgttagcatgaatggagaaataaaaaattgctctttcaacacaaccacagaattga

SEQ ID NO: 192463 - DNA, 75 bp, Artificial Sequence
  Synthetic
aagatagatgtacgagacaccaaggaagctttagacaagatagaggaagaacaaaacaaaagtcagcaaaaagca

SEQ ID NO: 192464 - DNA, 75 bp, Artificial Sequence
  Synthetic
tacaagaccaaacaaaaagataggaaaaagtataactctaggatgggggagagcattttatgcaacagatggaat

SEQ ID NO: 192465 - DNA, 75 bp, Artificial Sequence
  Synthetic
gaatgcgactaaccatgagggtaggactgtcaatgccactaacaatgtcggaatgaaaaactgctctttcaatat

SEQ ID NO: 192466 - DNA, 75 bp, Artificial Sequence
  Synthetic
tcctaaatttagactacccatccaaaaggaaacatgggagacatggtggacagactattggcaagccacctggat

SEQ ID NO: 192467 - DNA, 75 bp, Artificial Sequence
  Synthetic
gtacaagacccaacaataatacaagaaaaagtataccgataggaccaggaagagcattttatgcaacaggagaca

SEQ ID NO: 192468 - DNA, 75 bp, Artificial Sequence
  Synthetic
aaaaagtataccgataggaccaggaagagcattttatgcaacaggagacataataggagacatcagaaaggcaca

SEQ ID NO: 192469 - DNA, 75 bp, Artificial Sequence
  Synthetic
agagcattttatgcaacaggagacataataggagacatcagaaaggcacattgtaatgttagtggaacacaatgg

SEQ ID NO: 192470 - DNA, 75 bp, Artificial Sequence
  Synthetic
ttatcgtttcagacccacctcccagccccgaggggacccgacaggcccgaaggaatcgaagaagaaggtggagag

SEQ ID NO: 192471 - DNA, 75 bp, Artificial Sequence
  Synthetic
agatatgagggacaattggagaagtgaattatataaatataaagtagtaaaaattgagccattaggaatagcacc

SEQ ID NO: 192472 - DNA, 75 bp, Artificial Sequence
  Synthetic
acaaccagctcttcagacaggaacagaggaacttagatcattattcaacacagtagcaactctctattgtgtaca

SEQ ID NO: 192473 - DNA, 75 bp, Artificial Sequence
  Synthetic
caggaagtgggacgagcaatgtatgccgctcccattgcaggaaacattacctgtaactcaaatattacaggtcta

SEQ ID NO: 192474 - DNA, 75 bp, Artificial Sequence
  Synthetic
ttaacaaaacaacaatacattttcgaccatcctcgggaggagacccagagattacagaacatacctttaattgtg

SEQ ID NO: 192475 - DNA, 75 bp, Artificial Sequence
  Synthetic
gaaagattgtactgagagacaggctaattttttagggaagatctggccttcccacaagggaaggccagggaattt

SEQ ID NO: 192476 - DNA, 75 bp, Artificial Sequence
  Synthetic
gtaagggaaaaataaaacgagctgagccagcagcagaaggggtgggagccaacaactaacaattctggttgcgcc

SEQ ID NO: 192477 - DNA, 75 bp, Artificial Sequence
  Synthetic
tataacatgggtggcaagtggtcaaaaagcagcatagtgggatggcctcaggttagggatagaataagacaaacc

SEQ ID NO: 192478 - DNA, 75 bp, Artificial Sequence
  Synthetic
ggctggaagcacaagaggacgaggaggtaggctttccagttaggccgcaggtgcctttgagaccaatgactttta

SEQ ID NO: 192479 - DNA, 75 bp, Artificial Sequence
  Synthetic
tataatcagtctatgggaccaaagcctaaagccatgtgtaaagttaacccctctctgcgttactttaaattgtac

SEQ ID NO: 192480 - DNA, 75 bp, Artificial Sequence
  Synthetic
aactgccaacatcaatgccactgctaacagcacgatcaaggaagaaataaaaaactgctctttcagtgtaaccac

SEQ ID NO: 192481 - DNA, 75 bp, Artificial Sequence
  Synthetic
atgacctggatgcagtgggaaaaagagattagcaattactcatatgaaatatacaggttaattgaacaatcgcag

SEQ ID NO: 192482 - DNA, 75 bp, Artificial Sequence
  Synthetic
tgccttggaactctagctggagtaataaatctctagaggagatttggaataacatgacctggatggagtgggaaa

SEQ ID NO: 192483 - DNA, 75 bp, Artificial Sequence
  Synthetic
gtagtacaaagagctggtagagctattctccacatacctacaagaataagacagggcttagaaagggctttgctg

SEQ ID NO: 192484 - DNA, 75 bp, Artificial Sequence
  Synthetic
ttagatctgaaaatatcacaaacaatgccaaaaatataatagtacaacttgtcaagcctgtagaaattaattgta

SEQ ID NO: 192485 - DNA, 75 bp, Artificial Sequence
  Synthetic
ggggtgggagcagtatctcgagacctggaaaaacatggagcaattacaagtagcaatacagcagctactaatgct

SEQ ID NO: 192486 - DNA, 75 bp, Artificial Sequence
  Synthetic
cacagcaatagtagtagctgaggggacagatagagttatagaagctttgcaaagagctggtagagctgttctcca

SEQ ID NO: 192487 - DNA, 75 bp, Artificial Sequence
  Synthetic
aaagagctggtagagctgttctccacatacctagaagaataagacagggcttggaaagggctttgcaataaaatg

SEQ ID NO: 192488 - DNA, 75 bp, Artificial Sequence
  Synthetic
gagccgagcaagcttcacaggatgtaaaaaattggatgacagaaaccttgttggtccaaaatgcaaacccagatt

SEQ ID NO: 192489 - DNA, 75 bp, Artificial Sequence
  Synthetic
ctcgacgcaggactcggcttgctgaagcgcgcacggcaagaggcgaggggcggcgaccggtgagtacgccaaaaa

SEQ ID NO: 192490 - DNA, 75 bp, Artificial Sequence
  Synthetic
aactcaagcaggaagctgtcagacactttcctagactatggctccataacttaggacaacatatttatgaaacat

SEQ ID NO: 192491 - DNA, 75 bp, Artificial Sequence
  Synthetic
ggggaaagaaaaaatataaattaaaacatatagtatgggcaagcagggagctagaacgatttgcagttaatcctg

SEQ ID NO: 192492 - DNA, 75 bp, Artificial Sequence
  Synthetic
gtttctgtggatggcctgcggtaagggaaagaacaaggaggactgatccagcagcagaaggggtgggagcagcat

SEQ ID NO: 192493 - DNA, 75 bp, Artificial Sequence
  Synthetic
aacagtactaatgccaatagtagtaataggaactgtactgacatggaagtagaaaacttaagaaactgctctttc

SEQ ID NO: 192494 - DNA, 75 bp, Artificial Sequence
  Synthetic
gcagaaactttctatgtagatggagcagctaatagggaaactaaattaggaaaagcaggatatgttactgacaga

SEQ ID NO: 192495 - DNA, 75 bp, Artificial Sequence
  Synthetic
ggctaataaattgtaatgtctcaaccattaaacaggcttgtccaaaggtgtcttttgacccaattcccatacatt

SEQ ID NO: 192496 - DNA, 75 bp, Artificial Sequence
  Synthetic
ctagaacgatttgcacttaatcctggccttttagaaacatcagaaggctgtaaacaaataataggacagctacaa

SEQ ID NO: 192497 - DNA, 75 bp, Artificial Sequence
  Synthetic
caacaatacaagaaagagtataagaatcggacctggacaaacgttctatgcaacagatataataggagatataag

SEQ ID NO: 192498 - DNA, 75 bp, Artificial Sequence
  Synthetic
aggagtagaaactttctatgtagatggagcagctaatagggagactaaaataggaaaagcagggtatgttactga

SEQ ID NO: 192499 - DNA, 75 bp, Artificial Sequence
  Synthetic
ggactgtcaatgatatacagaaattagtgggaaaactaaattgggcaagtcagatttatccaggaattaaagtaa

SEQ ID NO: 192500 - DNA, 75 bp, Artificial Sequence
  Synthetic
aaagccgtgtgtacaattaaccccactctgtattactttaaattgtactgatttaaagaatgttaatagtaccac

SEQ ID NO: 192501 - DNA, 75 bp, Artificial Sequence
  Synthetic
tgtggaagggaaggacaccaaatgaaagattgcactgaaagacaggctaattttttagggaaaatttggccttcc

SEQ ID NO: 192502 - DNA, 75 bp, Artificial Sequence
  Synthetic
gtaggacgggcaatgtatgcccctcccattgcaggaaatataacatgtaaatcaaatatcacaggactaatattg

SEQ ID NO: 192503 - DNA, 75 bp, Artificial Sequence
  Synthetic
tagacattttcctaggccttggcttcatggcctaggacagcacatctatgacacttatggggatacttgggaagg

SEQ ID NO: 192504 - DNA, 75 bp, Artificial Sequence
  Synthetic
atactaccactgactacaatggtaccagaagtgaagaagtaaaaaattgctctttcaatacaaccgcagagatca

SEQ ID NO: 192505 - DNA, 75 bp, Artificial Sequence
  Synthetic
cccccacagcagcagaaggagtaggagcagcatctcaagatttagctagacatggagcaatcacaagcagcaata

SEQ ID NO: 192506 - DNA, 75 bp, Artificial Sequence
  Synthetic
aacaatagtagtgagtataggttaataaattgtaatacttcagtcattaagcaggcttgtccaaagatatccttt

SEQ ID NO: 192507 - DNA, 75 bp, Artificial Sequence
  Synthetic
ctaataccaatagtagtacggagaaagtaatggaggaaggagaaatgaaaaactgctctttcaatgttaccacaa

SEQ ID NO: 192508 - DNA, 75 bp, Artificial Sequence
  Synthetic
tagaagtaaaagacaccaaagaagctctagaggaagtagaaaagatacaaaagaaaagtcagcaaaaaacacagc

SEQ ID NO: 192509 - DNA, 75 bp, Artificial Sequence
  Synthetic
cagcgtctcgagacttagataaatatggagcacttacaagcagcaacacacccaccaataatgctgattgtgcct

SEQ ID NO: 192510 - DNA, 75 bp, Artificial Sequence
  Synthetic
gctaccgttaagaatgctaccagtaatagtactactacccccactactagcacgactggagaaatgaaaaattgc

SEQ ID NO: 192511 - DNA, 75 bp, Artificial Sequence
  Synthetic
ttgtgtggatcatagtattcatagaatataggaaaatattaaaaaaaaaaaaaaaatagacaggttaattgatag

SEQ ID NO: 192512 - DNA, 75 bp, Artificial Sequence
  Synthetic
aatacaacaacaataatctttaatagttcctcaggaggggacccagagattacagcgcacagctttaactgtgga

SEQ ID NO: 192513 - DNA, 75 bp, Artificial Sequence
  Synthetic
ttgtgggtcacagtctattatggggtacctgtgtggaaagaagcaaccaccactctattttgtgcatcagatgct

SEQ ID NO: 192514 - DNA, 75 bp, Artificial Sequence
  Synthetic
tcaaaatggagtggatggtctaccataagggaaagaatgagacaggctgagccagcaacagagccagcagcagct

SEQ ID NO: 192515 - DNA, 75 bp, Artificial Sequence
  Synthetic
ctttcctaataaaaaaatagaatttgaaccagccgcaggaggggatctagaaattacaacacatagctttaattg

SEQ ID NO: 192516 - DNA, 75 bp, Artificial Sequence
  Synthetic
accactaatgtgccttggaatactagttggagtaataaatctcaggatgaaatctgggagaacatgacctggatg

SEQ ID NO: 192517 - DNA, 75 bp, Artificial Sequence
  Synthetic
caagcagtgaggatcatcaaaatcttgtatcaaagcagtaagtatatgtaatgttggagttattagcaaaagtag

SEQ ID NO: 192518 - DNA, 75 bp, Artificial Sequence
  Synthetic
ctagggctttggggctgctctggaaaactcatctgcaccactgctgtgccttggaactccagttggagtaataaa

SEQ ID NO: 192519 - DNA, 75 bp, Artificial Sequence
  Synthetic
cagaccagagccaacagccccaccagcagagccaacagccccaccagcagagagcttcaggttcgaggagacaac

SEQ ID NO: 192520 - DNA, 75 bp, Artificial Sequence
  Synthetic
aactcatctgcactactgctgtaccttggaactccagttggagtaacaaatctcaagaagagatttggaataaca

SEQ ID NO: 192521 - DNA, 75 bp, Artificial Sequence
  Synthetic
cataactataactataccagaaacaacagtaagattaatgaagtgcaagaaatgaaaaactgctctttcaatatg

SEQ ID NO: 192522 - DNA, 75 bp, Artificial Sequence
  Synthetic
cgactcatcaagtttctctatcaaagcagtaagtagtacatgtaatgcaatctttagaaatattagcaatagtag

SEQ ID NO: 192523 - DNA, 75 bp, Artificial Sequence
  Synthetic
agaagaaggtggagagcaaagcaaagacagatccgtgagattagtgagcggattcttagcacttgcctgggacga

SEQ ID NO: 192524 - DNA, 75 bp, Artificial Sequence
  Synthetic
gagctattctccacatacctacaagaataagacagggcttagaaagggctttgctataaaatgggtggcaagtgg

SEQ ID NO: 192525 - DNA, 75 bp, Artificial Sequence
  Synthetic
gatggggcataatgctccttgggatgttaatgatttgtagtgctacagaacaattgtgggtcacaatctactatg

SEQ ID NO: 192526 - DNA, 75 bp, Artificial Sequence
  Synthetic
gatggggcataatgctccttgggatgttaatgttttgtagtgctacagaacaattgtgggtcacaatctactatg

SEQ ID NO: 192527 - DNA, 75 bp, Artificial Sequence
  Synthetic
gatggggcataatgctccttgggatgttaatgctttgtagtgctacagaacaattgtgggtcacaatctactatg

SEQ ID NO: 192528 - DNA, 75 bp, Artificial Sequence
  Synthetic
gatggggcataatgctccttgggatgttaatggtttgtagtgctacagaacaattgtgggtcacaatctactatg

SEQ ID NO: 192529 - DNA, 75 bp, Artificial Sequence
  Synthetic
gatggggcattatgctccttgggatgttaatgatttgtagtgctacagaacaattgtgggtcacaatctactatg

SEQ ID NO: 192530 - DNA, 75 bp, Artificial Sequence
  Synthetic
gatggggcattatgctccttgggatgttaatgttttgtagtgctacagaacaattgtgggtcacaatctactatg

SEQ ID NO: 192531 - DNA, 75 bp, Artificial Sequence
  Synthetic
gatggggcattatgctccttgggatgttaatgctttgtagtgctacagaacaattgtgggtcacaatctactatg

SEQ ID NO: 192532 - DNA, 75 bp, Artificial Sequence
  Synthetic
gatggggcattatgctccttgggatgttaatggtttgtagtgctacagaacaattgtgggtcacaatctactatg

SEQ ID NO: 192533 - DNA, 75 bp, Artificial Sequence
  Synthetic
gatggggcatcatgctccttgggatgttaatgatttgtagtgctacagaacaattgtgggtcacaatctactatg

SEQ ID NO: 192534 - DNA, 75 bp, Artificial Sequence
  Synthetic
gatggggcatcatgctccttgggatgttaatgttttgtagtgctacagaacaattgtgggtcacaatctactatg

SEQ ID NO: 192535 - DNA, 75 bp, Artificial Sequence
  Synthetic
gatggggcatcatgctccttgggatgttaatgctttgtagtgctacagaacaattgtgggtcacaatctactatg

SEQ ID NO: 192536 - DNA, 75 bp, Artificial Sequence
  Synthetic
gatggggcatcatgctccttgggatgttaatggtttgtagtgctacagaacaattgtgggtcacaatctactatg

SEQ ID NO: 192537 - DNA, 75 bp, Artificial Sequence
  Synthetic
gatggggcatgatgctccttgggatgttaatgatttgtagtgctacagaacaattgtgggtcacaatctactatg

SEQ ID NO: 192538 - DNA, 75 bp, Artificial Sequence
  Synthetic
gatggggcatgatgctccttgggatgttaatgttttgtagtgctacagaacaattgtgggtcacaatctactatg

SEQ ID NO: 192539 - DNA, 75 bp, Artificial Sequence
  Synthetic
gatggggcatgatgctccttgggatgttaatgctttgtagtgctacagaacaattgtgggtcacaatctactatg

SEQ ID NO: 192540 - DNA, 75 bp, Artificial Sequence
  Synthetic
gatggggcatgatgctccttgggatgttaatggtttgtagtgctacagaacaattgtgggtcacaatctactatg

SEQ ID NO: 192541 - DNA, 75 bp, Artificial Sequence
  Synthetic
gaaggggtgggagcagtatctcgagacctggatcaacgtggagcagtcacaactagtaatacagcaagtaacaat

SEQ ID NO: 192542 - DNA, 75 bp, Artificial Sequence
  Synthetic
attgtaccagacctagcaacaatacaagaaaaagtgtacgtataggaccagggcaaacattctatacaacaggtg

SEQ ID NO: 192543 - DNA, 75 bp, Artificial Sequence
  Synthetic
aatcgcagaaccaacaagaaaagaatgaacaagaattattggaattggataagtgggcaaatttgtggaattggt

SEQ ID NO: 192544 - DNA, 75 bp, Artificial Sequence
  Synthetic
aagaaaaagtgtacgtataggaccagggcaaacattctatacaacaggtgcagtaataggggacataagacaagc

SEQ ID NO: 192545 - DNA, 75 bp, Artificial Sequence
  Synthetic
gcgaaagtagaaccagaggagctctctcgacgcaggactcggcttgctgagcgcgcacggcaagaggcgaggggc

SEQ ID NO: 192546 - DNA, 75 bp, Artificial Sequence
  Synthetic
tcctcaggaggggatttagaaattacaacacatagctttaattgtggaggagaatttttctattgcaatacagca

SEQ ID NO: 192547 - DNA, 75 bp, Artificial Sequence
  Synthetic
agtggtcaaaaagtagcatagttggatggcctgctgtaagggagagaataagacgaactgagccagcggcagatg

SEQ ID NO: 192548 - DNA, 75 bp, Artificial Sequence
  Synthetic
tagcattagtagtagcagcaataatagcaataattgtgtggtccatagtactcatagaatataggaaaatattaa

SEQ ID NO: 192549 - DNA, 75 bp, Artificial Sequence
  Synthetic
ccaatagtagtagtgaggagaaagacatgaaaaactgctctttctatgtcacctcaggcatacaagataagtttc

SEQ ID NO: 192550 - DNA, 75 bp, Artificial Sequence
  Synthetic
ccaatagtagtagtgaggagaaagacatgaaaaactgctctttctatgtcacctcaggcatacaagttaagtttc

SEQ ID NO: 192551 - DNA, 75 bp, Artificial Sequence
  Synthetic
ccaatagtagtagtgaggagaaagacatgaaaaactgctctttctatgtcacctcaggcatacaagctaagtttc

SEQ ID NO: 192552 - DNA, 75 bp, Artificial Sequence
  Synthetic
ccaatagtagtagtgaggagaaagacatgaaaaactgctctttctatgtcacctcaggcatacaaggtaagtttc

SEQ ID NO: 192553 - DNA, 75 bp, Artificial Sequence
  Synthetic
ggaaaaacatggagcaatcacaagtagcaatacagcagctactaatgctgattgtgcctggctggaagcacaaga

SEQ ID NO: 192554 - DNA, 75 bp, Artificial Sequence
  Synthetic
aaaaacatcagaaagaacccccatttctttggatggggtatgaactccatcctgataaatggacagtacagccta

SEQ ID NO: 192555 - DNA, 75 bp, Artificial Sequence
  Synthetic
atgggcaagcagggagctggaaagatttgcacttaaccctggccttttagagacatcagaaggctgtaaacaaat

SEQ ID NO: 192556 - DNA, 75 bp, Artificial Sequence
  Synthetic
tagcaactctctattgtgtacatgaaaagatagatgtacgagacaccaaggaagccttagacaagatagaggaag

SEQ ID NO: 192557 - DNA, 75 bp, Artificial Sequence
  Synthetic
tcagaagtaaacatagtaacagactcacagtatgcattaggaatcattcaagcacaaccagataggagtgaatca

SEQ ID NO: 192558 - DNA, 75 bp, Artificial Sequence
  Synthetic
acagcaccctgaaggaagatccaggggaaatacaaaactgtactttcaatatgaccacagaaagaacagataagc

SEQ ID NO: 192559 - DNA, 75 bp, Artificial Sequence
  Synthetic
tcagcaccctgaaggaagatccaggggaaatacaaaactgtactttcaatatgaccacagaaagaacagataagc

SEQ ID NO: 192560 - DNA, 75 bp, Artificial Sequence
  Synthetic
ccagcaccctgaaggaagatccaggggaaatacaaaactgtactttcaatatgaccacagaaagaacagataagc

SEQ ID NO: 192561 - DNA, 75 bp, Artificial Sequence
  Synthetic
gcagcaccctgaaggaagatccaggggaaatacaaaactgtactttcaatatgaccacagaaagaacagataagc

SEQ ID NO: 192562 - DNA, 75 bp, Artificial Sequence
  Synthetic
atagactgggtagaagctctagaaaaggtagttgtaaaattaagagaacagttagttacaaaagtaggaggaaat

SEQ ID NO: 192563 - DNA, 75 bp, Artificial Sequence
  Synthetic
aatgaaacgaacgcaaatataacctttaatcactcctcaggagagggccctagaaattgtaacaccacttttaat

SEQ ID NO: 192564 - DNA, 75 bp, Artificial Sequence
  Synthetic
taatacaagaaaaagtataaggataggaccaggacaaacattctatgcaacaggagacataataggagatataag

SEQ ID NO: 192565 - DNA, 75 bp, Artificial Sequence
  Synthetic
gagaccttcagacctgggggaggaaatatgaaagacaattggagaagtgaattatataaatataaagtagtagaa

SEQ ID NO: 192566 - DNA, 75 bp, Artificial Sequence
  Synthetic
gacaggccagaaggtatcgaagaagaaggtggagagagaaacagaggcagatccgaaagtttagtgagcggattc

SEQ ID NO: 192567 - DNA, 75 bp, Artificial Sequence
  Synthetic
gacaggccagaaggtatcgaagaagaaggtggagagagatacagaggcagatccgaaagtttagtgagcggattc

SEQ ID NO: 192568 - DNA, 75 bp, Artificial Sequence
  Synthetic
gacaggccagaaggtatcgaagaagaaggtggagagagacacagaggcagatccgaaagtttagtgagcggattc

SEQ ID NO: 192569 - DNA, 75 bp, Artificial Sequence
  Synthetic
gacaggccagaaggtatcgaagaagaaggtggagagagagacagaggcagatccgaaagtttagtgagcggattc

SEQ ID NO: 192570 - DNA, 75 bp, Artificial Sequence
  Synthetic
atagggccaggacaggcattctatacaacaggtatcataggggatataagaaaagcatattgtgaggtcaataaa

SEQ ID NO: 192571 - DNA, 75 bp, Artificial Sequence
  Synthetic
atttcagaattgggtgtcaacatagcagaataggcattactccacagagaagagtaaggaatggacccagtagat

SEQ ID NO: 192572 - DNA, 75 bp, Artificial Sequence
  Synthetic
acttactcttgattgtaacgaggattgtggaacttctgggacgcagggggtgggaactcctcaaatattggtgga

SEQ ID NO: 192573 - DNA, 75 bp, Artificial Sequence
  Synthetic
aaaccctcaggaggggacttagaaattacaacacacagttttaattgtggaggagaatttttttattgtgatacc

SEQ ID NO: 192574 - DNA, 75 bp, Artificial Sequence
  Synthetic
ctgcagcagcagaaggggtgggagcagtgtctcaagacttagaaagacggggggcaattacaagcagcaatacca

SEQ ID NO: 192575 - DNA, 75 bp, Artificial Sequence
  Synthetic
aatatagaggtaagagacaccaaagaagctttagataagctagaggaagaacaaaacaaaagtaagaaaaaggca

SEQ ID NO: 192576 - DNA, 75 bp, Artificial Sequence
  Synthetic
gagcaaggcagaaccagatcgattcgattagtcagcggattcttagcacttgcctgggacgacctgaggagcctg

SEQ ID NO: 192577 - DNA, 75 bp, Artificial Sequence
  Synthetic
caaccaaaattaccctatagtgcagaacatgcaggggcaaatggtacatcaggccctatcacctagaactttaaa

SEQ ID NO: 192578 - DNA, 75 bp, Artificial Sequence
  Synthetic
ttttggaccaggacaagtgttatatgcaacaggtgacataataggagacataaggaaagcacattgtactgttaa

SEQ ID NO: 192579 - DNA, 75 bp, Artificial Sequence
  Synthetic
ttctcaacgtacctacaagaatcaggcagggcttcgaaagggctttactataacatgggtaacaagtggtcaaaa

SEQ ID NO: 192580 - DNA, 75 bp, Artificial Sequence
  Synthetic
ctagaagttacaacacttagttttaattgtcagggagaatttttctattgtaatacatcaggcctgtttgataga

SEQ ID NO: 192581 - DNA, 75 bp, Artificial Sequence
  Synthetic
gtataaggataggaccaggacaagcattctatgcaacaaatgacataataggagacataagacaagcacattgta

SEQ ID NO: 192582 - DNA, 75 bp, Artificial Sequence
  Synthetic
caatgagagtgagggggatgtggaagaattggcaaccatggtggatatggagcatcttaggcttgtggttaatga

SEQ ID NO: 192583 - DNA, 75 bp, Artificial Sequence
  Synthetic
cacaagtacctttaagaccaatgacttacaaggcagctgtggatctcagccactttttaaaagaaaaggggggac

SEQ ID NO: 192584 - DNA, 75 bp, Artificial Sequence
  Synthetic
ttaaaagaacacttccctaataaaacaataaaatttgaacaaccctcaggaggggatctagaaattacaacacat

SEQ ID NO: 192585 - DNA, 75 bp, Artificial Sequence
  Synthetic
agatatgagggacaattggagaagtgaattatataagtataaagtagtaaaaattaaaccactaggagtagcacc

SEQ ID NO: 192586 - DNA, 75 bp, Artificial Sequence
  Synthetic
acctaacaataatacaagaagaggtatacatatgggaccagggaaattttatgcaacaggagacataataggaga

SEQ ID NO: 192587 - DNA, 75 bp, Artificial Sequence
  Synthetic
ggtaatgctacctacaatgatcccagttctgaaataaaaaattgctctttcaatgtaaccacagaattaagagat

SEQ ID NO: 192588 - DNA, 75 bp, Artificial Sequence
  Synthetic
acaaactaattcacctgtattattttgattgtttttcagaatctgctataagacatgccatattaggacgtttag

SEQ ID NO: 192589 - DNA, 75 bp, Artificial Sequence
  Synthetic
ttagtagtagtaacaataatagcaatagttgtgtggaccatagtattcatagaatataggaaaatattaagacag

SEQ ID NO: 192590 - DNA, 75 bp, Artificial Sequence
  Synthetic
tgagaactctagtgagtattatagattaataaattgtaatacctcagccataacacaagcctgtccaaaggtcac

SEQ ID NO: 192591 - DNA, 75 bp, Artificial Sequence
  Synthetic
ataatacaagaaaaagtataaggataggaccaggacaaacattttatgcaacaggagatataataggagacataa

SEQ ID NO: 192592 - DNA, 75 bp, Artificial Sequence
  Synthetic
aaggaaacatgggaaacatggtggacagagtattggcaggccacctggattcctgagtgggagtttgtcaatacc

SEQ ID NO: 192593 - DNA, 75 bp, Artificial Sequence
  Synthetic
aaataaaaaattgctctttcaatacaaccacagaaataagagataagaaacagaaagcgtatgcacttttttata

SEQ ID NO: 192594 - DNA, 75 bp, Artificial Sequence
  Synthetic
ctcaggtacctttaagaccaatgacttacaaaggagcgttagatctcagccactttttaagagaaaaggggggac

SEQ ID NO: 192595 - DNA, 75 bp, Artificial Sequence
  Synthetic
caggaatttggcattccctacaatccccaaagtcaaggagtagtagaatctatgaataaagaattaaagaaaatt

SEQ ID NO: 192596 - DNA, 75 bp, Artificial Sequence
  Synthetic
caacaattcaagaaaaagtatatacataggaccagggagaagatttcatgtaacaagagccgtaacaggagatat

SEQ ID NO: 192597 - DNA, 75 bp, Artificial Sequence
  Synthetic
ataatacaagaaaaagtataagaataggaccaggacagacattctatgcaacagacataataggaaacataagaa

SEQ ID NO: 192598 - DNA, 75 bp, Artificial Sequence
  Synthetic
gcacttgcctgggacgatctacggagcctgtgcctcttcagctaccaccgcttgagagacttcatcttgattgta

SEQ ID NO: 192599 - DNA, 75 bp, Artificial Sequence
  Synthetic
aacatttagtatgggcaagcagggagctggaaagatttgcacttaaccctggccttttagaaacagcagaaggct

SEQ ID NO: 192600 - DNA, 75 bp, Artificial Sequence
  Synthetic
tgggtcacggtctattatggggtacctgtgtggagagacgcagagaccaccctattttgtgcatcagatgctaaa

SEQ ID NO: 192601 - DNA, 75 bp, Artificial Sequence
  Synthetic
taaatcattatttaatgcagtagcagtcctctggtgcgtgcaccaaaggatagaggtaaaagacaccaaggaagc

SEQ ID NO: 192602 - DNA, 75 bp, Artificial Sequence
  Synthetic
aaagaacttatagagctattatccacatacctacaagaataagacagggcttggaaagggctttgctataagatg

SEQ ID NO: 192603 - DNA, 75 bp, Artificial Sequence
  Synthetic
tcgactgctacccctagtaccagtagggaggaggtaggagtgaaaaactgctctttctataaccccacaagtaca

SEQ ID NO: 192604 - DNA, 75 bp, Artificial Sequence
  Synthetic
atctactgaaatggggatttaccacaccagataaaaaacatcagaaagaacctccattcctttggatgggatatg

SEQ ID NO: 192605 - DNA, 75 bp, Artificial Sequence
  Synthetic
tccacatacctgttagaataagacagggcttagaaagagctttgctataaaatgggtggcaagtggtcaaaaagt

SEQ ID NO: 192606 - DNA, 75 bp, Artificial Sequence
  Synthetic
caacaactactgtttatccatttcagaattgggtgccagcatagcagaataggcattactcgacagagaagagta

SEQ ID NO: 192607 - DNA, 75 bp, Artificial Sequence
  Synthetic
ggttaattgatagaataagagaaagagcagaagatagtggcaatgagagtgagggagatgaagaggaattatcag

SEQ ID NO: 192608 - DNA, 75 bp, Artificial Sequence
  Synthetic
aaatataatagtacaccttaatgtatctgtacagattaattgtacaagaccctacaacaatacaagaaaaagtat

SEQ ID NO: 192609 - DNA, 75 bp, Artificial Sequence
  Synthetic
agctgttagacattttcctaggccatggctccatggattaggacaacatatctataacacctatggggatacttg

SEQ ID NO: 192610 - DNA, 75 bp, Artificial Sequence
  Synthetic
aagaatgccactgtaagtaacaccactggaaataccactaaggaagacataggaatgaaaaattgctctttcaat

SEQ ID NO: 192611 - DNA, 75 bp, Artificial Sequence
  Synthetic
tattagatacaggagcagatgatacagtattagaagatatagatttgccaggaagatggaaaccaaaaatgatag

SEQ ID NO: 192612 - DNA, 75 bp, Artificial Sequence
  Synthetic
ccgccccgaaggaagatcccctgaaggaagataaaggggcaatacaaaactgtactttcaatatgaccacagaaa

SEQ ID NO: 192613 - DNA, 75 bp, Artificial Sequence
  Synthetic
ccgccccgaaggaagatcccctgaaggaagatataggggcaatacaaaactgtactttcaatatgaccacagaaa

SEQ ID NO: 192614 - DNA, 75 bp, Artificial Sequence
  Synthetic
ccgccccgaaggaagatcccctgaaggaagatacaggggcaatacaaaactgtactttcaatatgaccacagaaa

SEQ ID NO: 192615 - DNA, 75 bp, Artificial Sequence
  Synthetic
ccgccccgaaggaagatcccctgaaggaagatagaggggcaatacaaaactgtactttcaatatgaccacagaaa

SEQ ID NO: 192616 - DNA, 75 bp, Artificial Sequence
  Synthetic
agataatagttagatctgaaaatctcacaaataatgcaaaaatcataatagtacagcttaatgagtcagtaccaa

SEQ ID NO: 192617 - DNA, 75 bp, Artificial Sequence
  Synthetic
ccagggcgagcatactatacaacacaagacataacaggagatataagacaggcacattgtaatattagtgaagca

SEQ ID NO: 192618 - DNA, 75 bp, Artificial Sequence
  Synthetic
aacatacctagaagaatcagacagggcctagaaaggtctttgctataacatgggtggcaagtggtcaaaaagcag

SEQ ID NO: 192619 - DNA, 75 bp, Artificial Sequence
  Synthetic
gcagaccaactgattcatctgcattattttgactgtttttcagaatctgccataaggaaagccatattaggacaa

SEQ ID NO: 192620 - DNA, 75 bp, Artificial Sequence
  Synthetic
tggaactctagctggagtaataaatcatattctgagatttggaataacatgacctggatagagtgggaaagagag

SEQ ID NO: 192621 - DNA, 75 bp, Artificial Sequence
  Synthetic
tataggaccaggacaggcattctatgcaataggtgacataatagggaaaataagacaagcacattgcaatgtcag

SEQ ID NO: 192622 - DNA, 75 bp, Artificial Sequence
  Synthetic
tgttaatggaaaaatatggaaaaatacattagaaaaggtaaatggcaaagttagggtcttatttcaaaataatac

SEQ ID NO: 192623 - DNA, 75 bp, Artificial Sequence
  Synthetic
tgttaatggaaaaatatggataaatacattagaaaaggtaaatggcaaagttagggtcttatttcaaaataatac

SEQ ID NO: 192624 - DNA, 75 bp, Artificial Sequence
  Synthetic
tgttaatggaaaaatatggacaaatacattagaaaaggtaaatggcaaagttagggtcttatttcaaaataatac

SEQ ID NO: 192625 - DNA, 75 bp, Artificial Sequence
  Synthetic
tgttaatggaaaaatatggagaaatacattagaaaaggtaaatggcaaagttagggtcttatttcaaaataatac

SEQ ID NO: 192626 - DNA, 75 bp, Artificial Sequence
  Synthetic
tgttaatggtaaaatatggaaaaatacattagaaaaggtaaatggcaaagttagggtcttatttcaaaataatac

SEQ ID NO: 192627 - DNA, 75 bp, Artificial Sequence
  Synthetic
tgttaatggtaaaatatggataaatacattagaaaaggtaaatggcaaagttagggtcttatttcaaaataatac

SEQ ID NO: 192628 - DNA, 75 bp, Artificial Sequence
  Synthetic
tgttaatggtaaaatatggacaaatacattagaaaaggtaaatggcaaagttagggtcttatttcaaaataatac

SEQ ID NO: 192629 - DNA, 75 bp, Artificial Sequence
  Synthetic
tgttaatggtaaaatatggagaaatacattagaaaaggtaaatggcaaagttagggtcttatttcaaaataatac

SEQ ID NO: 192630 - DNA, 75 bp, Artificial Sequence
  Synthetic
tgttaatggcaaaatatggaaaaatacattagaaaaggtaaatggcaaagttagggtcttatttcaaaataatac

SEQ ID NO: 192631 - DNA, 75 bp, Artificial Sequence
  Synthetic
tgttaatggcaaaatatggataaatacattagaaaaggtaaatggcaaagttagggtcttatttcaaaataatac

SEQ ID NO: 192632 - DNA, 75 bp, Artificial Sequence
  Synthetic
tgttaatggcaaaatatggacaaatacattagaaaaggtaaatggcaaagttagggtcttatttcaaaataatac

SEQ ID NO: 192633 - DNA, 75 bp, Artificial Sequence
  Synthetic
tgttaatggcaaaatatggagaaatacattagaaaaggtaaatggcaaagttagggtcttatttcaaaataatac

SEQ ID NO: 192634 - DNA, 75 bp, Artificial Sequence
  Synthetic
tgttaatgggaaaatatggaaaaatacattagaaaaggtaaatggcaaagttagggtcttatttcaaaataatac

SEQ ID NO: 192635 - DNA, 75 bp, Artificial Sequence
  Synthetic
tgttaatgggaaaatatggataaatacattagaaaaggtaaatggcaaagttagggtcttatttcaaaataatac

SEQ ID NO: 192636 - DNA, 75 bp, Artificial Sequence
  Synthetic
tgttaatgggaaaatatggacaaatacattagaaaaggtaaatggcaaagttagggtcttatttcaaaataatac

SEQ ID NO: 192637 - DNA, 75 bp, Artificial Sequence
  Synthetic
tgttaatgggaaaatatggagaaatacattagaaaaggtaaatggcaaagttagggtcttatttcaaaataatac

SEQ ID NO: 192638 - DNA, 75 bp, Artificial Sequence
  Synthetic
tgtttatggaaaaatatggaaaaatacattagaaaaggtaaatggcaaagttagggtcttatttcaaaataatac

SEQ ID NO: 192639 - DNA, 75 bp, Artificial Sequence
  Synthetic
tgtttatggaaaaatatggataaatacattagaaaaggtaaatggcaaagttagggtcttatttcaaaataatac

SEQ ID NO: 192640 - DNA, 75 bp, Artificial Sequence
  Synthetic
tgtttatggaaaaatatggacaaatacattagaaaaggtaaatggcaaagttagggtcttatttcaaaataatac

SEQ ID NO: 192641 - DNA, 75 bp, Artificial Sequence
  Synthetic
tgtttatggaaaaatatggagaaatacattagaaaaggtaaatggcaaagttagggtcttatttcaaaataatac

SEQ ID NO: 192642 - DNA, 75 bp, Artificial Sequence
  Synthetic
tgtttatggtaaaatatggaaaaatacattagaaaaggtaaatggcaaagttagggtcttatttcaaaataatac

SEQ ID NO: 192643 - DNA, 75 bp, Artificial Sequence
  Synthetic
tgtttatggtaaaatatggataaatacattagaaaaggtaaatggcaaagttagggtcttatttcaaaataatac

SEQ ID NO: 192644 - DNA, 75 bp, Artificial Sequence
  Synthetic
tgtttatggtaaaatatggacaaatacattagaaaaggtaaatggcaaagttagggtcttatttcaaaataatac

SEQ ID NO: 192645 - DNA, 75 bp, Artificial Sequence
  Synthetic
tgtttatggtaaaatatggagaaatacattagaaaaggtaaatggcaaagttagggtcttatttcaaaataatac

SEQ ID NO: 192646 - DNA, 75 bp, Artificial Sequence
  Synthetic
tgtttatggcaaaatatggaaaaatacattagaaaaggtaaatggcaaagttagggtcttatttcaaaataatac

SEQ ID NO: 192647 - DNA, 75 bp, Artificial Sequence
  Synthetic
tgtttatggcaaaatatggataaatacattagaaaaggtaaatggcaaagttagggtcttatttcaaaataatac

SEQ ID NO: 192648 - DNA, 75 bp, Artificial Sequence
  Synthetic
tgtttatggcaaaatatggacaaatacattagaaaaggtaaatggcaaagttagggtcttatttcaaaataatac

SEQ ID NO: 192649 - DNA, 75 bp, Artificial Sequence
  Synthetic
tgtttatggcaaaatatggagaaatacattagaaaaggtaaatggcaaagttagggtcttatttcaaaataatac

SEQ ID NO: 192650 - DNA, 75 bp, Artificial Sequence
  Synthetic
tgtttatgggaaaatatggaaaaatacattagaaaaggtaaatggcaaagttagggtcttatttcaaaataatac

SEQ ID NO: 192651 - DNA, 75 bp, Artificial Sequence
  Synthetic
tgtttatgggaaaatatggataaatacattagaaaaggtaaatggcaaagttagggtcttatttcaaaataatac

SEQ ID NO: 192652 - DNA, 75 bp, Artificial Sequence
  Synthetic
tgtttatgggaaaatatggacaaatacattagaaaaggtaaatggcaaagttagggtcttatttcaaaataatac

SEQ ID NO: 192653 - DNA, 75 bp, Artificial Sequence
  Synthetic
tgtttatgggaaaatatggagaaatacattagaaaaggtaaatggcaaagttagggtcttatttcaaaataatac

SEQ ID NO: 192654 - DNA, 75 bp, Artificial Sequence
  Synthetic
tgttcatggaaaaatatggaaaaatacattagaaaaggtaaatggcaaagttagggtcttatttcaaaataatac

SEQ ID NO: 192655 - DNA, 75 bp, Artificial Sequence
  Synthetic
tgttcatggaaaaatatggataaatacattagaaaaggtaaatggcaaagttagggtcttatttcaaaataatac

SEQ ID NO: 192656 - DNA, 75 bp, Artificial Sequence
  Synthetic
tgttcatggaaaaatatggacaaatacattagaaaaggtaaatggcaaagttagggtcttatttcaaaataatac

SEQ ID NO: 192657 - DNA, 75 bp, Artificial Sequence
  Synthetic
tgttcatggaaaaatatggagaaatacattagaaaaggtaaatggcaaagttagggtcttatttcaaaataatac

SEQ ID NO: 192658 - DNA, 75 bp, Artificial Sequence
  Synthetic
tgttcatggtaaaatatggaaaaatacattagaaaaggtaaatggcaaagttagggtcttatttcaaaataatac

SEQ ID NO: 192659 - DNA, 75 bp, Artificial Sequence
  Synthetic
tgttcatggtaaaatatggataaatacattagaaaaggtaaatggcaaagttagggtcttatttcaaaataatac

SEQ ID NO: 192660 - DNA, 75 bp, Artificial Sequence
  Synthetic
tgttcatggtaaaatatggacaaatacattagaaaaggtaaatggcaaagttagggtcttatttcaaaataatac

SEQ ID NO: 192661 - DNA, 75 bp, Artificial Sequence
  Synthetic
tgttcatggtaaaatatggagaaatacattagaaaaggtaaatggcaaagttagggtcttatttcaaaataatac

SEQ ID NO: 192662 - DNA, 75 bp, Artificial Sequence
  Synthetic
tgttcatggcaaaatatggaaaaatacattagaaaaggtaaatggcaaagttagggtcttatttcaaaataatac

SEQ ID NO: 192663 - DNA, 75 bp, Artificial Sequence
  Synthetic
tgttcatggcaaaatatggataaatacattagaaaaggtaaatggcaaagttagggtcttatttcaaaataatac

SEQ ID NO: 192664 - DNA, 75 bp, Artificial Sequence
  Synthetic
tgttcatggcaaaatatggacaaatacattagaaaaggtaaatggcaaagttagggtcttatttcaaaataatac

SEQ ID NO: 192665 - DNA, 75 bp, Artificial Sequence
  Synthetic
tgttcatggcaaaatatggagaaatacattagaaaaggtaaatggcaaagttagggtcttatttcaaaataatac

SEQ ID NO: 192666 - DNA, 75 bp, Artificial Sequence
  Synthetic
tgttcatgggaaaatatggaaaaatacattagaaaaggtaaatggcaaagttagggtcttatttcaaaataatac

SEQ ID NO: 192667 - DNA, 75 bp, Artificial Sequence
  Synthetic
tgttcatgggaaaatatggataaatacattagaaaaggtaaatggcaaagttagggtcttatttcaaaataatac

SEQ ID NO: 192668 - DNA, 75 bp, Artificial Sequence
  Synthetic
tgttcatgggaaaatatggacaaatacattagaaaaggtaaatggcaaagttagggtcttatttcaaaataatac

SEQ ID NO: 192669 - DNA, 75 bp, Artificial Sequence
  Synthetic
tgttcatgggaaaatatggagaaatacattagaaaaggtaaatggcaaagttagggtcttatttcaaaataatac

SEQ ID NO: 192670 - DNA, 75 bp, Artificial Sequence
  Synthetic
tgttgatggaaaaatatggaaaaatacattagaaaaggtaaatggcaaagttagggtcttatttcaaaataatac

SEQ ID NO: 192671 - DNA, 75 bp, Artificial Sequence
  Synthetic
tgttgatggaaaaatatggataaatacattagaaaaggtaaatggcaaagttagggtcttatttcaaaataatac

SEQ ID NO: 192672 - DNA, 75 bp, Artificial Sequence
  Synthetic
tgttgatggaaaaatatggacaaatacattagaaaaggtaaatggcaaagttagggtcttatttcaaaataatac

SEQ ID NO: 192673 - DNA, 75 bp, Artificial Sequence
  Synthetic
tgttgatggaaaaatatggagaaatacattagaaaaggtaaatggcaaagttagggtcttatttcaaaataatac

SEQ ID NO: 192674 - DNA, 75 bp, Artificial Sequence
  Synthetic
tgttgatggtaaaatatggaaaaatacattagaaaaggtaaatggcaaagttagggtcttatttcaaaataatac

SEQ ID NO: 192675 - DNA, 75 bp, Artificial Sequence
  Synthetic
tgttgatggtaaaatatggataaatacattagaaaaggtaaatggcaaagttagggtcttatttcaaaataatac

SEQ ID NO: 192676 - DNA, 75 bp, Artificial Sequence
  Synthetic
tgttgatggtaaaatatggacaaatacattagaaaaggtaaatggcaaagttagggtcttatttcaaaataatac

SEQ ID NO: 192677 - DNA, 75 bp, Artificial Sequence
  Synthetic
tgttgatggtaaaatatggagaaatacattagaaaaggtaaatggcaaagttagggtcttatttcaaaataatac

SEQ ID NO: 192678 - DNA, 75 bp, Artificial Sequence
  Synthetic
tgttgatggcaaaatatggaaaaatacattagaaaaggtaaatggcaaagttagggtcttatttcaaaataatac

SEQ ID NO: 192679 - DNA, 75 bp, Artificial Sequence
  Synthetic
tgttgatggcaaaatatggataaatacattagaaaaggtaaatggcaaagttagggtcttatttcaaaataatac

SEQ ID NO: 192680 - DNA, 75 bp, Artificial Sequence
  Synthetic
tgttgatggcaaaatatggacaaatacattagaaaaggtaaatggcaaagttagggtcttatttcaaaataatac

SEQ ID NO: 192681 - DNA, 75 bp, Artificial Sequence
  Synthetic
tgttgatggcaaaatatggagaaatacattagaaaaggtaaatggcaaagttagggtcttatttcaaaataatac

SEQ ID NO: 192682 - DNA, 75 bp, Artificial Sequence
  Synthetic
tgttgatgggaaaatatggaaaaatacattagaaaaggtaaatggcaaagttagggtcttatttcaaaataatac

SEQ ID NO: 192683 - DNA, 75 bp, Artificial Sequence
  Synthetic
tgttgatgggaaaatatggataaatacattagaaaaggtaaatggcaaagttagggtcttatttcaaaataatac

SEQ ID NO: 192684 - DNA, 75 bp, Artificial Sequence
  Synthetic
tgttgatgggaaaatatggacaaatacattagaaaaggtaaatggcaaagttagggtcttatttcaaaataatac

SEQ ID NO: 192685 - DNA, 75 bp, Artificial Sequence
  Synthetic
tgttgatgggaaaatatggagaaatacattagaaaaggtaaatggcaaagttagggtcttatttcaaaataatac

SEQ ID NO: 192686 - DNA, 75 bp, Artificial Sequence
  Synthetic
tactattagtctggttgataccatagcaatagcagtagctgaaggaacagataggattatagaattagtacaagg

SEQ ID NO: 192687 - DNA, 75 bp, Artificial Sequence
  Synthetic
tcccagcagaaacaggacaggagacagcatactttatactaaaattagcaggaagatggccagtaaaagtaatac

SEQ ID NO: 192688 - DNA, 75 bp, Artificial Sequence
  Synthetic
agtgctattagcttgtataacaccacagcaatagcagtagctgaggggacagataggtttatagaagtagtacaa

SEQ ID NO: 192689 - DNA, 75 bp, Artificial Sequence
  Synthetic
acgaggaactcctcaagacagtaaggatcatcaaaatcctgtatcaaagcagtaagtaataacaattaatatatg

SEQ ID NO: 192690 - DNA, 75 bp, Artificial Sequence
  Synthetic
tggatggcctgctgtgagggaaagaatgagaagaactagagctgaaccagcagcagtaggggtgggagcagcatc

SEQ ID NO: 192691 - DNA, 75 bp, Artificial Sequence
  Synthetic
gaagaagcggagacagcgacgaagcgctcctccaagcagtgagaatcatcaagatcttatatcaaagcagtaagt

SEQ ID NO: 192692 - DNA, 75 bp, Artificial Sequence
  Synthetic
agggagctggaaagatttgcacttaaccctggccttttagagacatcagaaggctgtaaacaaataatgaaacag

SEQ ID NO: 192693 - DNA, 75 bp, Artificial Sequence
  Synthetic
ggttttccagttagacctcaggtaccgttacgaccaatgacttacaagggagctttggatctgagccacttttta

SEQ ID NO: 192694 - DNA, 75 bp, Artificial Sequence
  Synthetic
acaggttaattgaaagaattagggaaagagcagaagacagtggcaatgagagtgagggggatattgaggaattgt

SEQ ID NO: 192695 - DNA, 75 bp, Artificial Sequence
  Synthetic
gaatgagacgaacccctccagcagcagaaggggtgggagcagtgtctcaagacttagaaagacggggggcaatta

SEQ ID NO: 192696 - DNA, 75 bp, Artificial Sequence
  Synthetic
taatcctttaacctccactaataatattactggggaatccaacatgagaaactgctctttcaatataacctcaga

SEQ ID NO: 192697 - DNA, 75 bp, Artificial Sequence
  Synthetic
atgaacaagtagataaattagtaagtagtggaatcaggaaagtgctgtttctagatggaatagataaggctcaag

SEQ ID NO: 192698 - DNA, 75 bp, Artificial Sequence
  Synthetic
gtctcaaccattaaacaggcttgtccaaaggtgacttttgacccaattcccatacattattgtgctccagctggt

SEQ ID NO: 192699 - DNA, 75 bp, Artificial Sequence
  Synthetic
aaattgtacaaatattactgctaccggtaataaagggaatgctacggttgatcctaccactaaggaagaaataaa

SEQ ID NO: 192700 - DNA, 75 bp, Artificial Sequence
  Synthetic
agaaaattttaacatgtggaaaaatgacatggtggatcagatgcatgaggatataatcagtttatgggatcaaag

SEQ ID NO: 192701 - DNA, 75 bp, Artificial Sequence
  Synthetic
tgcactgatcttaatagaaatactactgaaactaatactagtagtgaggaaataatggaaatgaaaaattgttct

SEQ ID NO: 192702 - DNA, 75 bp, Artificial Sequence
  Synthetic
tgcactgatcttaatagaaattctactgaaactaatactagtagtgaggaaataatggaaatgaaaaattgttct

SEQ ID NO: 192703 - DNA, 75 bp, Artificial Sequence
  Synthetic
tgcactgatcttaatagaaatcctactgaaactaatactagtagtgaggaaataatggaaatgaaaaattgttct

SEQ ID NO: 192704 - DNA, 75 bp, Artificial Sequence
  Synthetic
tgcactgatcttaatagaaatgctactgaaactaatactagtagtgaggaaataatggaaatgaaaaattgttct

SEQ ID NO: 192705 - DNA, 75 bp, Artificial Sequence
  Synthetic
taaccacagaattaagagataagaagcacaaagagtatgcacttttttatagacttgatatagtaccacttgata

SEQ ID NO: 192706 - DNA, 75 bp, Artificial Sequence
  Synthetic
acaggctaattttttagggaaaatctggccttcccacaaggggaggccagggaactttcttcagagcaggccaga

SEQ ID NO: 192707 - DNA, 75 bp, Artificial Sequence
  Synthetic
gaaagctaagggatggttttatagacatcactatgaaagtactcatccaaaaataagttcagaagtacacatccc

SEQ ID NO: 192708 - DNA, 75 bp, Artificial Sequence
  Synthetic
tttagaaacagcagaaggatgtcaacaaataatagaacagttacaaccagctctcaagacaggaacagaagaact

SEQ ID NO: 192709 - DNA, 75 bp, Artificial Sequence
  Synthetic
atgcaacaggagacataataggagatataagacaagcacattgtaacattagtagagcaagatggaataacactt

SEQ ID NO: 192710 - DNA, 75 bp, Artificial Sequence
  Synthetic
aggcagcagctgacacaggaaacagcagcaaggtcagccaaaattaccctatagtgcaaaatgcacaagggcaaa

SEQ ID NO: 192711 - DNA, 75 bp, Artificial Sequence
  Synthetic
caaaagacttaatagcagaaatacagaaacaagggcaagaccaatggacatatcaaatttatcaagagccattta

SEQ ID NO: 192712 - DNA, 75 bp, Artificial Sequence
  Synthetic
aacacatctatgaaacttatggggatacttgggcaggagtggaagccataataagaattctgcaacaactgctgt

SEQ ID NO: 192713 - DNA, 75 bp, Artificial Sequence
  Synthetic
aaacaggagaaagagattggcatttgggtcatggagtctccatagaatggagattgagaagatatagcacacaag

SEQ ID NO: 192714 - DNA, 75 bp, Artificial Sequence
  Synthetic
caaagaaaaatagacaggttaattgatagaataagagaaagagcagaagatagtggcaatgaaagtgaaggggat

SEQ ID NO: 192715 - DNA, 75 bp, Artificial Sequence
  Synthetic
acttccatgcaagataaaacaaattataaacatgtggcaaggagtaggacaagcaatgtatgctcctcccatcag

SEQ ID NO: 192716 - DNA, 75 bp, Artificial Sequence
  Synthetic
actgatctgaagaatgatcctagcagtaatggtagtacccccgtgaatagaaggatggaggggggagaagtaaaa

SEQ ID NO: 192717 - DNA, 75 bp, Artificial Sequence
  Synthetic
tcataagagaaaaggtgaagaaagagtatgcacttttttatgaacttgatataataccaatagaaaatgaataca

SEQ ID NO: 192718 - DNA, 75 bp, Artificial Sequence
  Synthetic
agcctaaagccatgtgtaaaattaactccactctgtgtcactttaaattgtaatattaatagtagtagtggtggt

SEQ ID NO: 192719 - DNA, 75 bp, Artificial Sequence
  Synthetic
cacaggtacctttgagaccaatgacttataaagctgcttttgatctcagcttctttttaaaagaaaaggggggac

SEQ ID NO: 192720 - DNA, 75 bp, Artificial Sequence
  Synthetic
gcagaagtgataaggtgaaaaaagaatatgctcttttttataaacttgatgtagtgaaaacagataatactagca

SEQ ID NO: 192721 - DNA, 75 bp, Artificial Sequence
  Synthetic
agagaaatatggagcacttacaagcagcaacacacccaccaataatgctgattgtgcctggctgcaagcacaaga

SEQ ID NO: 192722 - DNA, 75 bp, Artificial Sequence
  Synthetic
ttaatgctaccgctaatagcaatgctaccattaatggtactgaagaaatgaaaaactgctcttttaatgcaacca

SEQ ID NO: 192723 - DNA, 75 bp, Artificial Sequence
  Synthetic
agtaggctttccagtcagacctcaggtgcctttaagaccaatgacttataagggagcgttcgatctcggcttctt

SEQ ID NO: 192724 - DNA, 75 bp, Artificial Sequence
  Synthetic
aaaatgaggggtgcccacactaatgatgtaaaacaattaacagaggcagtgcaaaaaatagcccaagaatgtata

SEQ ID NO: 192725 - DNA, 75 bp, Artificial Sequence
  Synthetic
agggggaaagaaacactatatgctaaaacacatagtatgggcaagcagggagctggaaagatttgcacttaaccc

SEQ ID NO: 192726 - DNA, 75 bp, Artificial Sequence
  Synthetic
tctctcgacgcaaggactcggcttgctgcagcgcgcacggcaagaggcgaggggcggcgactggtgagtacgcca

SEQ ID NO: 192727 - DNA, 75 bp, Artificial Sequence
  Synthetic
catgcaataatgtcagcacagtacaatgtacacatggaattaagccagtagtatcaactcaactactgttaaatg

SEQ ID NO: 192728 - DNA, 75 bp, Artificial Sequence
  Synthetic
aaaagtataagttttgcaccagggagcactatttatgcaacaggaggtataataggagatataagacaagcacat

SEQ ID NO: 192729 - DNA, 75 bp, Artificial Sequence
  Synthetic
tttcaatgcaaccacagtagtaagagataggaagcagacagtgtatgcacttttttatagacttgatatagtacc

SEQ ID NO: 192730 - DNA, 75 bp, Artificial Sequence
  Synthetic
tcctccacatacctagaagaataagacagggcttcgaaagggctttgctataagatgggtggcaagtggtcaaaa

SEQ ID NO: 192731 - DNA, 75 bp, Artificial Sequence
  Synthetic
cctcctaaaagcggtcagactcatcaagttcctctatcagagcagtaagtagtgcatgtaatgtctcaactgtat

SEQ ID NO: 192732 - DNA, 75 bp, Artificial Sequence
  Synthetic
aggacaaacattctttgcaaatgaaataataggagacataagaaaggcacattgtaacattagtaaggctaattg

SEQ ID NO: 192733 - DNA, 75 bp, Artificial Sequence
  Synthetic
aatgcgaatccagactgtaagtccattttaaaagcattaggaacaggagctacattagaagaaatgatgacagca

SEQ ID NO: 192734 - DNA, 75 bp, Artificial Sequence
  Synthetic
ccatgctccttgggatgttgatgatctgtagtgctgcagaacaattgtgggtcacagtctattatggggtacctg

SEQ ID NO: 192735 - DNA, 75 bp, Artificial Sequence
  Synthetic
tgtggaaagaagcaactaccactctattttgtgcatcagatgctaaagcatatgacacagaggtgcataatgttt

SEQ ID NO: 192736 - DNA, 75 bp, Artificial Sequence
  Synthetic
ctaatagtagtaacttgaaagagaagggagaaataaaaaactgcactttcaatgtcaccacaatgatagaaaata

SEQ ID NO: 192737 - DNA, 75 bp, Artificial Sequence
  Synthetic
ttgacagggacatgcaaggagaaataaaaaactgctctttcaatatgaccacagaaataaaggataagaaacaga

SEQ ID NO: 192738 - DNA, 75 bp, Artificial Sequence
  Synthetic
ttgacagggacatgcaaggagaaataaaaaactgctctttcaatatgaccacagaaatataggataagaaacaga

SEQ ID NO: 192739 - DNA, 75 bp, Artificial Sequence
  Synthetic
ttgacagggacatgcaaggagaaataaaaaactgctctttcaatatgaccacagaaatacaggataagaaacaga

SEQ ID NO: 192740 - DNA, 75 bp, Artificial Sequence
  Synthetic
ttgacagggacatgcaaggagaaataaaaaactgctctttcaatatgaccacagaaatagaggataagaaacaga

SEQ ID NO: 192741 - DNA, 75 bp, Artificial Sequence
  Synthetic
atacctagtataaacaatgagacaccaggaatcagatatcagtacaatgtgctgccacagggatggaaaggatca

SEQ ID NO: 192742 - DNA, 75 bp, Artificial Sequence
  Synthetic
agaatataagaaattgctaaaacaaaggaaaatagacaaattaattgagaggataatagaaagagcagaagacag

SEQ ID NO: 192743 - DNA, 75 bp, Artificial Sequence
  Synthetic
ggtatacatatgggaccaggaaaagtattctatgcagcagatgacatagtaggggatataagacaagcacattgt

SEQ ID NO: 192744 - DNA, 75 bp, Artificial Sequence
  Synthetic
cagacagagttatagaattaggacaaagaattggtagagctatttgcaacatacctagaagaatcagacagggcc

SEQ ID NO: 192745 - DNA, 75 bp, Artificial Sequence
  Synthetic
aataaaaaactgctctttcaatatgaccacagagctaagggataagaaacagaaggtatatgcacttttttatag

SEQ ID NO: 192746 - DNA, 75 bp, Artificial Sequence
  Synthetic
ttaaatggcagcctagcagaagaagatataataatcagatctcaaaatatctcagataatacaaaaactataata

SEQ ID NO: 192747 - DNA, 75 bp, Artificial Sequence
  Synthetic
tgcctggctggaagcacaagaggacgaggatgtaggctttccagtcagaccgcaggtacctttaagaccaatgac

SEQ ID NO: 192748 - DNA, 75 bp, Artificial Sequence
  Synthetic
aactcatcctcaggaggggacccagaaattacaatgcatagtttcaattgtagaggagaatttttctactgcaat

SEQ ID NO: 192749 - DNA, 75 bp, Artificial Sequence
  Synthetic
gaccaggacaagcattttatacaacagagataataggggacataagacaagcatattgtactatcaatggatcag

SEQ ID NO: 192750 - DNA, 75 bp, Artificial Sequence
  Synthetic
agggcttcgaaagggctttgctataagatgggtggcaagtggtcaaaacttagaggatgggatgatgtaagggaa

SEQ ID NO: 192751 - DNA, 75 bp, Artificial Sequence
  Synthetic
tagacatcactatgaaagcactaatccaagaataagttcagaagtacacatcccactaggggatgctaaattggt

SEQ ID NO: 192752 - DNA, 75 bp, Artificial Sequence
  Synthetic
tgtgcctggctagaagcacaagaggatgaggacgtgggctttccagtcagacctcaggtacctttaagaccaatg

SEQ ID NO: 192753 - DNA, 75 bp, Artificial Sequence
  Synthetic
aatagcagtagctgaggggacagataggattatagagttaatacaaagagctattagagctattcttcacatacc

SEQ ID NO: 192754 - DNA, 75 bp, Artificial Sequence
  Synthetic
aagttcagaagtacatatcccactaggagaggctagattagtaataagaacatattggggtctgcagacaggaga

SEQ ID NO: 192755 - DNA, 75 bp, Artificial Sequence
  Synthetic
aagaagaactgatccaagagctgagccagcagcagcaggggtgggagcagtatctcgggacctagaaagacatgg

SEQ ID NO: 192756 - DNA, 75 bp, Artificial Sequence
  Synthetic
gagcattaatagtagcactaatcatagcaatagttgtgtggaccatagcatatatagaatataggaaattggtaa

SEQ ID NO: 192757 - DNA, 75 bp, Artificial Sequence
  Synthetic
atagtgctattagcttgcttaataccacagcaatagtagtagctgaggggacagatagaattatagaagctttgc

SEQ ID NO: 192758 - DNA, 75 bp, Artificial Sequence
  Synthetic
aatgacaaactgctctttcaatatgaccacagaactgagagataagaagaaggcagaatacgcgcttttctatag

SEQ ID NO: 192759 - DNA, 75 bp, Artificial Sequence
  Synthetic
tgataagctcaatgatatcagtaaaatcaatgccacggaaatgaaaaattgctctttcaatgcaaccacagaagt

SEQ ID NO: 192760 - DNA, 75 bp, Artificial Sequence
  Synthetic
ctaccaccgcttgagagacttcatcttgattgcagcgaggactgtggaacttctgggacacagcagtctcaaggg

SEQ ID NO: 192761 - DNA, 75 bp, Artificial Sequence
  Synthetic
gggggcaattacaagcagcaatactaaagataataatcctgacgtggcctggctggaagcacaagaggaagagga

SEQ ID NO: 192762 - DNA, 75 bp, Artificial Sequence
  Synthetic
taatagcaatagttgtgtggtctatagtattcatagaatataggaaaatattaagacaaagaaaaatagacagat

SEQ ID NO: 192763 - DNA, 75 bp, Artificial Sequence
  Synthetic
aggatcagaggaaattaaatcattatataatacagtagcaaccctctattgtgtacatgaaaggataaaggtaaa

SEQ ID NO: 192764 - DNA, 75 bp, Artificial Sequence
  Synthetic
ggtcaggtggaacagatgaaggaaggagaaataaaaaactgctctttcaatatcaccacaaacatggataagaag

SEQ ID NO: 192765 - DNA, 75 bp, Artificial Sequence
  Synthetic
aaacgttactgccagtgatgctagggccagggaagaaatgaaaaattgctctttcaatgcaaccacagaagtaca

SEQ ID NO: 192766 - DNA, 75 bp, Artificial Sequence
  Synthetic
acaatgtacacatggaattaagccagtagtatcaactcaactactgctgaatggcagtttagcagaaaaagatat

SEQ ID NO: 192767 - DNA, 75 bp, Artificial Sequence
  Synthetic
agaagaagtgtagcaattggaccaggacaagcattctatacaacaggagaagtaataggagacataagaaaggca

SEQ ID NO: 192768 - DNA, 75 bp, Artificial Sequence
  Synthetic
taggactgatagtagcgctaatcttagcaatagtagtgtggactatagtagctatagaatttaggaaaatactaa

SEQ ID NO: 192769 - DNA, 75 bp, Artificial Sequence
  Synthetic
cagaagagcttaaatctttatttaatacagtagtagtcctctactatgtacatcaaaaggtagatatacaggaca

SEQ ID NO: 192770 - DNA, 75 bp, Artificial Sequence
  Synthetic
gactttgaatgcatgggtaaaagtaatagaagaaaagggtttcaacccagaagtaatacccatgttctcagcatt

SEQ ID NO: 192771 - DNA, 75 bp, Artificial Sequence
  Synthetic
caagggccaaaagaaccctttagagactatgtagacaggttctttaaaaccctaagagctgagcaagctacacag

SEQ ID NO: 192772 - DNA, 75 bp, Artificial Sequence
  Synthetic
acttcagtcagtacacaggcttgtccaaagatatcctttgaccctattgctataccttattgttctgcttctgga

SEQ ID NO: 192773 - DNA, 75 bp, Artificial Sequence
  Synthetic
tcaactgtggcaaagaaggacacctagccagaaattgcagggcccctaggaaaaagggctgttggaaatgtggga

SEQ ID NO: 192774 - DNA, 75 bp, Artificial Sequence
  Synthetic
tcattctcccaaacacaatcaagataattaaaattatgcagctgggagcaggagcagcacatgctgctcctgcca

SEQ ID NO: 192775 - DNA, 75 bp, Artificial Sequence
  Synthetic
tgcttgatacaatagcaatagcagtagctaactggacagatagggttatagaagtagcacaaagagctggtagag

SEQ ID NO: 192776 - DNA, 75 bp, Artificial Sequence
  Synthetic
agatgcatgaagatataatcagtttatgggatcaaagcttaaatccatgtgtaaaatctactacattcagtatta

SEQ ID NO: 192777 - DNA, 75 bp, Artificial Sequence
  Synthetic
agggggtgggaagccctcaagtattggtggaatctcctgcagtattggagtcaggaactaaagaatagtgctgtt

SEQ ID NO: 192778 - DNA, 75 bp, Artificial Sequence
  Synthetic
ttttaatgcaaccacagaaataagggataagaaacagaaagcgtatgcactcttttatagatctgatgtagtacc

SEQ ID NO: 192779 - DNA, 75 bp, Artificial Sequence
  Synthetic
ggaataccacatcctgcagggttaaaaaagaaaaaatcagtaacagtactagatgtgggagatgcatatttttca

SEQ ID NO: 192780 - DNA, 75 bp, Artificial Sequence
  Synthetic
aattaatacaaagagtttgtagagctatctgcaacatacctacaagaattagacagggctttgaaacagctttgc

SEQ ID NO: 192781 - DNA, 75 bp, Artificial Sequence
  Synthetic
agacagggctttgaaacagctttgctataaaatggggggcacgtggtcaaaattacagcgtagttggcctaatgt

SEQ ID NO: 192782 - DNA, 75 bp, Artificial Sequence
  Synthetic
caagagtaagttcagaagtacacatcccactaggggatgctaaattagtagtaaaaacatattggggtctgcata

SEQ ID NO: 192783 - DNA, 75 bp, Artificial Sequence
  Synthetic
gaatgggagagagaaattagcaattacacaaaccaaatatatgagatacttacagaatcgcagaaccagcaggac

SEQ ID NO: 192784 - DNA, 75 bp, Artificial Sequence
  Synthetic
ctccatcctgataaatggacagtgcagcctataaaactgccagaaaaggaaagctggactgtcaatgatatacag

SEQ ID NO: 192785 - DNA, 75 bp, Artificial Sequence
  Synthetic
ttaaaccagtggtatcaactcaactactgttaaatggtagtctagcagaaggggagataataattaaatctgaaa

SEQ ID NO: 192786 - DNA, 75 bp, Artificial Sequence
  Synthetic
attctaaaagaaccagtacatggagtgtattatgacccatcaaaagacttaatagcagaaatacagaaacaaggg

SEQ ID NO: 192787 - DNA, 75 bp, Artificial Sequence
  Synthetic
ataatacaagaaaaagtataaggataggaccaggacaaacattctttgcaaatgaaataataggagacataagac

SEQ ID NO: 192788 - DNA, 75 bp, Artificial Sequence
  Synthetic
gtattcatagaatataggaaaatattaagacagaaaaaaatagacaggttaattgatagaataagagaaagagca

SEQ ID NO: 192789 - DNA, 75 bp, Artificial Sequence
  Synthetic
gcggggtggacagatagggttattgaacaaacacaaagagcttggaaagccattcttcacatacctagcacaatc

SEQ ID NO: 192790 - DNA, 75 bp, Artificial Sequence
  Synthetic
tacctataataatagcaatggagaagtaaaaaattgcactttcaatacaaccacagaaataagggataggaaaca

SEQ ID NO: 192791 - DNA, 75 bp, Artificial Sequence
  Synthetic
tgagagcatgaaggaaatgaaaaattgctctttcaatgcaaccacagtagtaagagataggaagcagacagtgta

SEQ ID NO: 192792 - DNA, 75 bp, Artificial Sequence
  Synthetic
cctagcagaagaggagataataattagatctgaaaatctgacaaacaatgtcaaaacaataatagtacatcttaa

SEQ ID NO: 192793 - DNA, 75 bp, Artificial Sequence
  Synthetic
gtcacggtctattatggggtacctgtatggagagatgcagaaaccaccctattttgtgcatcagatgctaaagca

SEQ ID NO: 192794 - DNA, 75 bp, Artificial Sequence
  Synthetic
aaattagtaattacacagacacaatatacaggttgcttgaagaatcgcaaagccagcaggagaaaaatgaaaaag

SEQ ID NO: 192795 - DNA, 75 bp, Artificial Sequence
  Synthetic
agaccagagccaacagccccaccagaagagagcttcaggtttggggaggagacaacaactccctctcagaagcag

SEQ ID NO: 192796 - DNA, 75 bp, Artificial Sequence
  Synthetic
ttcctaaaaacaggagcatatctgatgaaatgaaagaggaaataaaaaactgctctttcaatatgaccacagtat

SEQ ID NO: 192797 - DNA, 75 bp, Artificial Sequence
  Synthetic
tagattgcacacatctagaaggaaaagtaattctggtagcagttcatgtagccagtggctatatagaagcagaag

SEQ ID NO: 192798 - DNA, 75 bp, Artificial Sequence
  Synthetic
aactaattcacctgtattattttgactgtttttcagactctgctataagacatgccctattaggacatagagtca

SEQ ID NO: 192799 - DNA, 75 bp, Artificial Sequence
  Synthetic
aagcagctttgctataaaatggggggcaagtggtcaaaaagcagcatagttggatggcctgctgtaagagaaaga

SEQ ID NO: 192800 - DNA, 75 bp, Artificial Sequence
  Synthetic
cctaacgacggtcagactcatcaggtccctctaccaaagcagtaagtagtagatgtaatgcaacccttagtaata

SEQ ID NO: 192801 - DNA, 75 bp, Artificial Sequence
  Synthetic
agaaattacaacacatagttttaattgtggaggagaatttttctattgcaatacatcaggactgtttaatagcac

SEQ ID NO: 192802 - DNA, 75 bp, Artificial Sequence
  Synthetic
cagaattgggtgtcaacatagcagaataggcattattcgacagagaagaacaagaaatggagccagtagatccta

SEQ ID NO: 192803 - DNA, 75 bp, Artificial Sequence
  Synthetic
acctggcagaccaactaattcatctgcattattttgactgtttttcagactctgccataaggaaagccatattag

SEQ ID NO: 192804 - DNA, 75 bp, Artificial Sequence
  Synthetic
ctgggacacagcagtctcaggggcctacagaaggggtgggaagcccttaaatatctgggaaaccttgtgctatat

SEQ ID NO: 192805 - DNA, 75 bp, Artificial Sequence
  Synthetic
agcaatagttgtgtggactatagtaggtatagaatataagagattgctaaagcaaaggaaaatagacaggttaat

SEQ ID NO: 192806 - DNA, 75 bp, Artificial Sequence
  Synthetic
gatggagaaaggagaaataaaaaactgcactttcaatatcaccaccaacacagaagaaaagcagaaagaccatgc

SEQ ID NO: 192807 - DNA, 75 bp, Artificial Sequence
  Synthetic
gatggagaaaggagaaataaaaaactgcactttcaatatcaccaccaacacagaagaaaagcagatagaccatgc

SEQ ID NO: 192808 - DNA, 75 bp, Artificial Sequence
  Synthetic
gatggagaaaggagaaataaaaaactgcactttcaatatcaccaccaacacagaagaaaagcagacagaccatgc

SEQ ID NO: 192809 - DNA, 75 bp, Artificial Sequence
  Synthetic
gatggagaaaggagaaataaaaaactgcactttcaatatcaccaccaacacagaagaaaagcagagagaccatgc

SEQ ID NO: 192810 - DNA, 75 bp, Artificial Sequence
  Synthetic
gatggcctgctgtaagagaaagaataagacaagctaggcccgcagcagaaggagtaggagcagcgtcgcaagact

SEQ ID NO: 192811 - DNA, 75 bp, Artificial Sequence
  Synthetic
tgtagctataacatcactaaggtcaacaatacgtataatgaaatgaaaaactgctcttataatatgacaacagaa

SEQ ID NO: 192812 - DNA, 75 bp, Artificial Sequence
  Synthetic
aggagcagaaactttctatgtagatggagcagctaatagggaaactaaaacaggaaaagcagggtatgttactga

SEQ ID NO: 192813 - DNA, 75 bp, Artificial Sequence
  Synthetic
ttgtccaaaggtatcctttgagccaattcccatacattattgtgctccagctggttttgcgattctaaagtgtaa

SEQ ID NO: 192814 - DNA, 75 bp, Artificial Sequence
  Synthetic
cagaagagtttaacatgtggaaaaataacatggtagagcagatgcatgcagatataatcagtctatgggaccaaa

SEQ ID NO: 192815 - DNA, 75 bp, Artificial Sequence
  Synthetic
ccacagccaaaaacataacaggggacagtgatgaactaagaaactgctctttcaatatgaccacagagctaaggg

SEQ ID NO: 192816 - DNA, 75 bp, Artificial Sequence
  Synthetic
accccccaaatagcactaacatcctgaaagaagacccaggggcaatacaaaactgtactttcaatatgaccacag

SEQ ID NO: 192817 - DNA, 75 bp, Artificial Sequence
  Synthetic
atcctgattgtgcctggctggaagcacaagaggacgaggaggtaggctttccagtcaggccacaggtacctttga

SEQ ID NO: 192818 - DNA, 75 bp, Artificial Sequence
  Synthetic
actctcccatgcagaataaaacaaattgtaaatatgtggcagagagcaggacaagcaatgtatgcccctcccatt

SEQ ID NO: 192819 - DNA, 75 bp, Artificial Sequence
  Synthetic
acaagcaatgtatgcccctcccattccaggagtaataaggtgtgtatcaaacattacaggactactattaacaag

SEQ ID NO: 192820 - DNA, 75 bp, Artificial Sequence
  Synthetic
gattgtgtggcaggtagacaggatgaggattagaacatggaacagtttagtaaagcatcatatgtatgtctcaaa

SEQ ID NO: 192821 - DNA, 75 bp, Artificial Sequence
  Synthetic
taataacaatacaagaagaagtgtacgtataggaccaggacaaacattctatgcaacaggtgcaataatagggcc

SEQ ID NO: 192822 - DNA, 75 bp, Artificial Sequence
  Synthetic
tatacaacttaattgaagaagcgcagaaccagcaagaaaagaatgaacaagacttattggaattggataagtggg

SEQ ID NO: 192823 - DNA, 75 bp, Artificial Sequence
  Synthetic
cgtataggaccaggacaaacattctatgcaacaggtgcaataatagggccgataagaaatgcatattgtactgtc

SEQ ID NO: 192824 - DNA, 75 bp, Artificial Sequence
  Synthetic
gaagatggccagtaaaagtaatacacacagacaatggtagcaatttcaccagcgctgcagttaaagcagcctgtt

SEQ ID NO: 192825 - DNA, 75 bp, Artificial Sequence
  Synthetic
acatacctagaagaataagacagggcttggaaagggctttgctataagatgggtggcaagtggtcaaaaagtagt

SEQ ID NO: 192826 - DNA, 75 bp, Artificial Sequence
  Synthetic
ggacgacctgaggaacctgtgcctcttcagctaccaccgcttgagagacttactcttgattgcaacgaggattgt

SEQ ID NO: 192827 - DNA, 75 bp, Artificial Sequence
  Synthetic
caccgacgaggaactcctcaaggtagtgcggaccatcaaaatcctataccaaagcagtaagtaataataattagt

SEQ ID NO: 192828 - DNA, 75 bp, Artificial Sequence
  Synthetic
ataatcagtttatgggatcaaagcttaaagccatgtgtaaaattaaccccactctgtgttactttaaattgcact

SEQ ID NO: 192829 - DNA, 75 bp, Artificial Sequence
  Synthetic
gatctaaggaatgctactaataccaatagtagtagcgaggaaaagatagagggaggaggaatgaccaactgctct

SEQ ID NO: 192830 - DNA, 75 bp, Artificial Sequence
  Synthetic
gaaacaaaagaagaagtaaaaaattgctcttttaatgtcaccacagtgacaggaaataagccgcagaaagaatat

SEQ ID NO: 192831 - DNA, 75 bp, Artificial Sequence
  Synthetic
tatcaaatttatcaagagccatttaaaaatctgaagacaggaaaatatgcaaaaaggaggtctgcccacactaat

SEQ ID NO: 192832 - DNA, 75 bp, Artificial Sequence
  Synthetic
acaacagtagcattgtaagtgaccaagcagaaatgaaaaattgctctttcaatataaccacagaaataaaagata

SEQ ID NO: 192833 - DNA, 75 bp, Artificial Sequence
  Synthetic
atagaataagagaaagagcagaagacagtggcaatgagagtgacggggatcaagaagaattatcggcatttatgg

SEQ ID NO: 192834 - DNA, 75 bp, Artificial Sequence
  Synthetic
gtggtcaaaagaatggcctgctgtaagggaaagaatgaggcgaacccctccagcagcagaaggagggagaagaaa

SEQ ID NO: 192835 - DNA, 75 bp, Artificial Sequence
  Synthetic
cccatagatagaagaataaacatgaaagaagaaatacaaaattgctctttcaatgcaaccacagaaataagagat

SEQ ID NO: 192836 - DNA, 75 bp, Artificial Sequence
  Synthetic
tcagtcccagtatgcagggagacataaagaattgttctttcaatataaccacagaaataagagacaagagaagga

SEQ ID NO: 192837 - DNA, 75 bp, Artificial Sequence
  Synthetic
ctggaagcacaagaagacgaggaggtaggctttccagtcaggccacaagtacctctaagaccaatgacttacaaa

SEQ ID NO: 192838 - DNA, 75 bp, Artificial Sequence
  Synthetic
ccagtggtatcaactcaattactgctgaatggcagtttagcagaagagaaaataataattagaactgaaaactcc

SEQ ID NO: 192839 - DNA, 75 bp, Artificial Sequence
  Synthetic
caggacaagtgttctatgcaacagacataataggagacataagaaaggcattttgtcatgtaaatgaaacaaagt

SEQ ID NO: 192840 - DNA, 75 bp, Artificial Sequence
  Synthetic
aaaacaaacatatcctttcactcatcctcaggaggggacatagaactcacaacacatagttttaattgtagggga

SEQ ID NO: 192841 - DNA, 75 bp, Artificial Sequence
  Synthetic
atgaagtaaaaaactgttcttttaagatgaccacagaactaagagataagaggaagaaagtccatgcactttttt

SEQ ID NO: 192842 - DNA, 75 bp, Artificial Sequence
  Synthetic
ggacataaagctataggtacagtattagtaggacctacacctgtcaacataattggaagaaatctgatgactcag

SEQ ID NO: 192843 - DNA, 75 bp, Artificial Sequence
  Synthetic
actagagaagtgaattatacaaatataaagtagtagaaattaaaccattaagaatagctccaactgaggcaagaa

SEQ ID NO: 192844 - DNA, 75 bp, Artificial Sequence
  Synthetic
gcaggacctattccaccaggccagattagggaacctagggggagtgatatagctggacctactagttcccctcag

SEQ ID NO: 192845 - DNA, 75 bp, Artificial Sequence
  Synthetic
gtctagggcattaagcagctccagacaaaagtcttggctctagaaagatacctaagagatcaacagctcctaagg

SEQ ID NO: 192846 - DNA, 75 bp, Artificial Sequence
  Synthetic
caaaagtcttggctctagaaagatacctaagagatcaacagctcctaaggctttaaggctgctctagaaaactca

SEQ ID NO: 192847 - DNA, 75 bp, Artificial Sequence
  Synthetic
atggagcaatcacaagtagcaatacagcagctactaatgctgattgtgcctggctagaagcacaagaggaggagg

SEQ ID NO: 192848 - DNA, 75 bp, Artificial Sequence
  Synthetic
ctaaccacaatacgcctgtagataatagtactgctaactacaatgaaagtaatccagaagtgaaaaattgctcct

SEQ ID NO: 192849 - DNA, 75 bp, Artificial Sequence
  Synthetic
gcagcaggaagcactatgggcgcagcgtcaataacgctgacggtacaggccagacaattattgtctggtatagtg

SEQ ID NO: 192850 - DNA, 75 bp, Artificial Sequence
  Synthetic
atcaaagcctaaagccatgtgtaaaattaactccactctgtgttactttgcattgtagtaattggacggttaatt

SEQ ID NO: 192851 - DNA, 75 bp, Artificial Sequence
  Synthetic
aataagacaaacccctgcagcagcagaaggagtaggagcagtatctcaagatttagctaggcatggagcaatcac

SEQ ID NO: 192852 - DNA, 75 bp, Artificial Sequence
  Synthetic
aaatatttataataatagtaggaggcttaataggtttaagaatagtttttgctgtgctttctatagtaaatagag

SEQ ID NO: 192853 - DNA, 75 bp, Artificial Sequence
  Synthetic
tttatgggatcaaagtctaaaaccatgtgtaaagttgaccccactctgtgtcactttaaattgtacaaatgctac

SEQ ID NO: 192854 - DNA, 75 bp, Artificial Sequence
  Synthetic
agattatagaattagcacaaagaatttatagagctatctgctacatacctagaagaataagacaaagttttgaag

SEQ ID NO: 192855 - DNA, 75 bp, Artificial Sequence
  Synthetic
atcaataatgcaatggaagaaatgaaaaattgctctttcaatgcaaacacagagttaagagataagcggcacaaa

SEQ ID NO: 192856 - DNA, 75 bp, Artificial Sequence
  Synthetic
agcagcagagggagtaggagcagcatctcaagacttagataaacatggggcacttacaaccagcaacaccgccag

SEQ ID NO: 192857 - DNA, 75 bp, Artificial Sequence
  Synthetic
gagtaagagcggcatctcgagacttagataaacatagagcacttacaactagcaacacagcccaaaataatcctg

SEQ ID NO: 192858 - DNA, 75 bp, Artificial Sequence
  Synthetic
ccattcctttggatggggtatgaactccatcctgataaatggacagtacagcctatagtgctgccagaaaaagac

SEQ ID NO: 192859 - DNA, 75 bp, Artificial Sequence
  Synthetic
aattacaacacatagttttaattgtggaggagaatttttctattgcaatacatcaggactgtttaatagcaattg

SEQ ID NO: 192860 - DNA, 75 bp, Artificial Sequence
  Synthetic
tgccaagtttgcttcatgtcaaaagcattaggcatctcccatggcaggaagaagcggagacagcgacgaagacct

SEQ ID NO: 192861 - DNA, 75 bp, Artificial Sequence
  Synthetic
taagttcagaagtacacatcccactaggggatgctagattagtagtaagaacatattggggtctgcacacaggag

SEQ ID NO: 192862 - DNA, 75 bp, Artificial Sequence
  Synthetic
gagggaacagataggattatagaagtcatacaaagaatttgtagacaagaataagacagggctttggagcagctt

SEQ ID NO: 192863 - DNA, 75 bp, Artificial Sequence
  Synthetic
agagatcaagctgaacatcttaagacagcagtacaaatggcagtattcatccacaattttaaaagaaaagggggg

SEQ ID NO: 192864 - DNA, 75 bp, Artificial Sequence
  Synthetic
tagaaagtatactgcattcactatacctagtataaataatgagacaccagggattagatatcagtacaatgtgct

SEQ ID NO: 192865 - DNA, 75 bp, Artificial Sequence
  Synthetic
cctagtataaataatgagacaccagggattagatatcagtacaatgtgctcccacagggatggaaaggatcacca

SEQ ID NO: 192866 - DNA, 75 bp, Artificial Sequence
  Synthetic
aataatacaaatagtactcataccaatagtaatagtagtaagatggaggaaggagaaatgaaaaactgcactttc

SEQ ID NO: 192867 - DNA, 75 bp, Artificial Sequence
  Synthetic
aattatacaaatagtactcataccaatagtaatagtagtaagatggaggaaggagaaatgaaaaactgcactttc

SEQ ID NO: 192868 - DNA, 75 bp, Artificial Sequence
  Synthetic
aatcatacaaatagtactcataccaatagtaatagtagtaagatggaggaaggagaaatgaaaaactgcactttc

SEQ ID NO: 192869 - DNA, 75 bp, Artificial Sequence
  Synthetic
aatgatacaaatagtactcataccaatagtaatagtagtaagatggaggaaggagaaatgaaaaactgcactttc

SEQ ID NO: 192870 - DNA, 75 bp, Artificial Sequence
  Synthetic
attatcagaaggagccaccccacaagatttaaataccatgctaaacacagtggggggacatcaagcagctatgca

SEQ ID NO: 192871 - DNA, 75 bp, Artificial Sequence
  Synthetic
gtggcgcccgaacagggacttgaagttaatagggactcggaaagcgaaagtaccagagaagtctctccgacgcag

SEQ ID NO: 192872 - DNA, 75 bp, Artificial Sequence
  Synthetic
agcaatagttgtgtggactatagtaggcatagaatataagaaattgctaaaacaaaggaaaatagacaggttaat

SEQ ID NO: 192873 - DNA, 75 bp, Artificial Sequence
  Synthetic
tctctcgacgcagggactcggcttgctgaggtgcacacggcaagaggcgagagcggcgactggtgagtacgccaa

SEQ ID NO: 192874 - DNA, 75 bp, Artificial Sequence
  Synthetic
gacagtggcaatgagagtgaaggggatacagaggaattgtcagcacttattgacatggggaattatgatcttggg

SEQ ID NO: 192875 - DNA, 75 bp, Artificial Sequence
  Synthetic
gtatggaaagaagcaaaaaccactctattttgtgcatcagatgccaaatcacatagcacagaagcacataatatc

SEQ ID NO: 192876 - DNA, 75 bp, Artificial Sequence
  Synthetic
tgttacctcagtgaacaacaccagctcaggaaacgacatgaaaaactgctctttcaatataaccacagtagtaag

SEQ ID NO: 192877 - DNA, 75 bp, Artificial Sequence
  Synthetic
ggaatgatactaagatctttaatgagaccatggatggaggaataaacatgaaagaagaaatacaaaattgctctt

SEQ ID NO: 192878 - DNA, 75 bp, Artificial Sequence
  Synthetic
atgcacacatggaatcagaccagtagtatcaactcaactactgttaaatggcagtctagcaaaaacggggataaa

SEQ ID NO: 192879 - DNA, 75 bp, Artificial Sequence
  Synthetic
tctagcagaagaagagatcatgattagatctgaaaatctcacaaataatattaaaaacataatagtgcagtttaa

SEQ ID NO: 192880 - DNA, 75 bp, Artificial Sequence
  Synthetic
atcccattaggggaggctagattagtaataacaacatattggggtttgcaaacaggagaaagagattggcatttg

SEQ ID NO: 192881 - DNA, 75 bp, Artificial Sequence
  Synthetic
ggaaacataagacaagcatcttgtactattaatgaaacaagatggaataacactctacaacaggtagctaaaaaa

SEQ ID NO: 192882 - DNA, 75 bp, Artificial Sequence
  Synthetic
tctactgcaatacatcaagactgtttaatggaacatgggagagtagtgcaggaagtactaaaaatagtacaggat

SEQ ID NO: 192883 - DNA, 75 bp, Artificial Sequence
  Synthetic
ctcaagcaggaagctgtcagacactttcctagaccatggcttcatggcttaggacagtatatctatgaaacctat

SEQ ID NO: 192884 - DNA, 75 bp, Artificial Sequence
  Synthetic
caaacgatacaacaaccatcccatgtagaataaaacaaattataaacatgtggcagggaggaaaagcaatgtatg

SEQ ID NO: 192885 - DNA, 75 bp, Artificial Sequence
  Synthetic
ttagaaaacaaaatccagacatagttatctatcaatacatggatgatttatatgtaggatctgacttagaaatag

SEQ ID NO: 192886 - DNA, 75 bp, Artificial Sequence
  Synthetic
cacatggaattaaaccagtggtatcaactcaattgttgttaaatggcagcctagcagaagaagatataataatca

SEQ ID NO: 192887 - DNA, 75 bp, Artificial Sequence
  Synthetic
tatacagataggaccaggacgagcattttggacaacagaaaaaataataggagacatcagaaaggcacattgtaa

SEQ ID NO: 192888 - DNA, 75 bp, Artificial Sequence
  Synthetic
tattttgattgtttttcagaatctgccataaggaaagccatattaggagagatagttagccctaggtgtgaatat

SEQ ID NO: 192889 - DNA, 75 bp, Artificial Sequence
  Synthetic
ggggacagataggattatagaaatagcacaaagaatttatagagctattctccacatacctacaagaataagaca

SEQ ID NO: 192890 - DNA, 75 bp, Artificial Sequence
  Synthetic
ggggacctagaagttacaatgcatagtttcaattgtagaggagaatttttctactgcaatacatcaagactgttt

SEQ ID NO: 192891 - DNA, 75 bp, Artificial Sequence
  Synthetic
acctggatgcaatgggagaaagaaattgaaaattacacagggttaatatacaacttaattgaagaatcacaaatc

SEQ ID NO: 192892 - DNA, 75 bp, Artificial Sequence
  Synthetic
gctctttcaatgcaaccacagaattaaaagataagcagaagtcagtgtatgcacttttttatagacttgatatag

SEQ ID NO: 192893 - DNA, 75 bp, Artificial Sequence
  Synthetic
cattcacaactagcaatacagcagaaaataatgctgatcgtgcctgggtagaagcacaagaggacggggaggagg

SEQ ID NO: 192894 - DNA, 75 bp, Artificial Sequence
  Synthetic
tcactttggattgtacaaatgttactagtggtacgggtaatagtactgcagaaatgaaaaattgctctttcaatg

SEQ ID NO: 192895 - DNA, 75 bp, Artificial Sequence
  Synthetic
caactactgtttattcatttcagaattgggtgccagcacagcagaataggcattatacgacagagaagagcaaga

SEQ ID NO: 192896 - DNA, 75 bp, Artificial Sequence
  Synthetic
attttgactgtttttcagactctgccataaggaaagccatattaggacaagtagttagacataggtgtgaatatc

SEQ ID NO: 192897 - DNA, 75 bp, Artificial Sequence
  Synthetic
atcggggaaaagatggacaggggggaaataaaaaactgctctttcaatatcaccacaaacataagaaataagatg

SEQ ID NO: 192898 - DNA, 75 bp, Artificial Sequence
  Synthetic
ccattcgattagtgaacggattcttagcaattgcctgggacgacctgcggagcctgtgccttttcagctaccacc

SEQ ID NO: 192899 - DNA, 75 bp, Artificial Sequence
  Synthetic
caataatacaagaaaaagtgtaaggataggaccaggacaaacattctatgcaacaggagacataataggagacat

SEQ ID NO: 192900 - DNA, 75 bp, Artificial Sequence
  Synthetic
tattgggggcaggagctaaggaatagtgctgttagcttgcttgacacaacagcaatagcagtagctgagaggaca

SEQ ID NO: 192901 - DNA, 75 bp, Artificial Sequence
  Synthetic
tgagtgtacaagacccaataataacacaagaaaaagtgtgagaataggaccaggacaagcattctatacaacagg

SEQ ID NO: 192902 - DNA, 75 bp, Artificial Sequence
  Synthetic
tgggatggcctcaggttagggaaagaataagacgaacccctccagtagcagatggagtaggagcagtatctcggg

SEQ ID NO: 192903 - DNA, 75 bp, Artificial Sequence
  Synthetic
gagctatctgcaacatacctagaagaataagacagggctttgaagcagctttgctataaaatggggaacaagtgg

SEQ ID NO: 192904 - DNA, 75 bp, Artificial Sequence
  Synthetic
cctctaccaccgcttgagagacttactcttgattgtaacgaggattgtggaacttctgggacgcagggggtggga

SEQ ID NO: 192905 - DNA, 75 bp, Artificial Sequence
  Synthetic
actgctctttcaatataactacagaactaagagacaaaagtaagaaagagtacgcgctcttctataggcctgatg

SEQ ID NO: 192906 - DNA, 75 bp, Artificial Sequence
  Synthetic
atgggaaaaaatccggttacggccagggggaaacaaaaaatataaactaaaacatatagtatgggcaagcaggga

SEQ ID NO: 192907 - DNA, 75 bp, Artificial Sequence
  Synthetic
gaaatgagaaattgctctttcaatgcaaccacagaaataagagataagaaaaagaaggaatatgcacttttttat

SEQ ID NO: 192908 - DNA, 75 bp, Artificial Sequence
  Synthetic
accagctcttcagacaggaacagaggaatttagatcattatataacacagtggcaactctctattgtgtacatac

SEQ ID NO: 192909 - DNA, 75 bp, Artificial Sequence
  Synthetic
tgttgtctggtatagtgcaacagcaaaacaatttgctgagggctatagaggcgcaacagcatatgttgcaactca

SEQ ID NO: 192910 - DNA, 75 bp, Artificial Sequence
  Synthetic
aaacgtaccagtacgagacaccaaggaagccttagacagaatagaggaggaacaaagaaaaggtcagggaaaaac

SEQ ID NO: 192911 - DNA, 75 bp, Artificial Sequence
  Synthetic
gaagctttagacaagatagaggaagaacaagccaaaagtaagaaaaaggcacagcaagcaacagctgacacaaga

SEQ ID NO: 192912 - DNA, 75 bp, Artificial Sequence
  Synthetic
gaattaagccagtggtatcaacccaactactgctgaatggcagtgtgacagaggaagaaataataattcaatctg

SEQ ID NO: 192913 - DNA, 75 bp, Artificial Sequence
  Synthetic
tccactcccatgtaaataaacaaattgtagaatgtggcagagagtgggacaagcaatgtatgcccctcccatcga

SEQ ID NO: 192914 - DNA, 75 bp, Artificial Sequence
  Synthetic
agcttaaatcattatttaatacagtagcagtcctctattttgtacatcaaaaggtagaggtaaaggacaccaagg

SEQ ID NO: 192915 - DNA, 75 bp, Artificial Sequence
  Synthetic
cctcaggaggagatctagaagttacaatgcatcattttaattgtagaggggaatttttctattgcaatacatcaa

SEQ ID NO: 192916 - DNA, 75 bp, Artificial Sequence
  Synthetic
gctttgcaataaaatggggggcaaatggtcaaaaagcagtatagttggatggcctgctgtaagagaaagaataag

SEQ ID NO: 192917 - DNA, 75 bp, Artificial Sequence
  Synthetic
gggctgctctggaaaactcatctgcaccactgctgtgccttggaactccagttggagtaataaatctcaagaaga

SEQ ID NO: 192918 - DNA, 75 bp, Artificial Sequence
  Synthetic
tgagactaataacaatggtagtagtgggggagtgatggagaaagaagaaatgaaaaactgctctttcaatgttac

SEQ ID NO: 192919 - DNA, 75 bp, Artificial Sequence
  Synthetic
aaagaagcataagggaatggcctaaggtgagggaacagataagacaagcccctgcagcagcagaaggagtaggag

SEQ ID NO: 192920 - DNA, 75 bp, Artificial Sequence
  Synthetic
ggtgagggaacagataagacaagcccctgcagcagcagaaggagtaggagcagcatcccaagatttagataagca

SEQ ID NO: 192921 - DNA, 75 bp, Artificial Sequence
  Synthetic
ctcaagtgcctttaaggccaatgacttataaaggagcattcgatctcggcttctttttaaaagaaaaggggggac

SEQ ID NO: 192922 - DNA, 75 bp, Artificial Sequence
  Synthetic
gttagtcctagttgtgaatatcaagcaggacataacaaggtaggatctctacagtacttggcactagcagcatta

SEQ ID NO: 192923 - DNA, 75 bp, Artificial Sequence
  Synthetic
gtggtatcaactcaactactgttaaatggtagcttagcaaaaggggacataataattagctctaaaaatctgaca

SEQ ID NO: 192924 - DNA, 75 bp, Artificial Sequence
  Synthetic
agaggatagatggaacaagccccagaagaccaagggccacagagagagccatacaatgaatggacactagaactt

SEQ ID NO: 192925 - DNA, 75 bp, Artificial Sequence
  Synthetic
ataaatggtacaaacagcatgcgagaggaaatgagaaactgctctttcaatataaccacagaaataagggataag

SEQ ID NO: 192926 - DNA, 75 bp, Artificial Sequence
  Synthetic
ataaaatttaattcattaccaggaggggacccagaagttacaatgcatagttttaattgtggaggagaatttttc

SEQ ID NO: 192927 - DNA, 75 bp, Artificial Sequence
  Synthetic
agcttaggacaatatatctatgaaacttatggggatacttggacaggagtggaagccataataagaattctgcaa

SEQ ID NO: 192928 - DNA, 75 bp, Artificial Sequence
  Synthetic
caaataacccacctatcccagtaggagacatctataaaagatggataattctggggttaaataaaatagtaagaa

SEQ ID NO: 192929 - DNA, 75 bp, Artificial Sequence
  Synthetic
gaaaaggtctacttatcataggtgccagcacacaaaaggattagaggaaatgaacaagtagataaactagtcagt

SEQ ID NO: 192930 - DNA, 75 bp, Artificial Sequence
  Synthetic
aactgtggcaaggaagggcacatagccaaaaattgcagggcccctaggaaaaagggctgttggaagtgtggaagg

SEQ ID NO: 192931 - DNA, 75 bp, Artificial Sequence
  Synthetic
tgcggagcctgtgcctcttcagctaccaccgcttgagagacttactcttgattgtagcgaggagtgtggaacttc

SEQ ID NO: 192932 - DNA, 75 bp, Artificial Sequence
  Synthetic
aatgaaggcttgaacagtactatagaaatgaaaaactgctctttcaaaataaccacaggcatgagagataagatg

SEQ ID NO: 192933 - DNA, 75 bp, Artificial Sequence
  Synthetic
caggctcggaagaatcgaagaaggaggtggagagcaagacagagacagatccattcgattagtgaacggattctt

SEQ ID NO: 192934 - DNA, 75 bp, Artificial Sequence
  Synthetic
gagcttgtagagctattctcaacatacctagaagaataagacagggcttggaaagggctttgctataagatgggg

SEQ ID NO: 192935 - DNA, 75 bp, Artificial Sequence
  Synthetic
gagcagatgatacagtattagaagaaatgaatttgccaggaagatggaaaccaaaaatgataggaggaattggag

SEQ ID NO: 192936 - DNA, 75 bp, Artificial Sequence
  Synthetic
aatgaacaagtagataaattagtcagtgctggaatcagaaaaatactgtttttagatgggatagataaggcacaa

SEQ ID NO: 192937 - DNA, 75 bp, Artificial Sequence
  Synthetic
ataataatgagagtactcctatgaatagtactcaggaaaagatggaggtaggagaaataaaaaactgcactttca

SEQ ID NO: 192938 - DNA, 75 bp, Artificial Sequence
  Synthetic
ataataatgtgagtactcctatgaatagtactcaggaaaagatggaggtaggagaaataaaaaactgcactttca

SEQ ID NO: 192939 - DNA, 75 bp, Artificial Sequence
  Synthetic
ataataatgcgagtactcctatgaatagtactcaggaaaagatggaggtaggagaaataaaaaactgcactttca

SEQ ID NO: 192940 - DNA, 75 bp, Artificial Sequence
  Synthetic
ataataatgggagtactcctatgaatagtactcaggaaaagatggaggtaggagaaataaaaaactgcactttca

SEQ ID NO: 192941 - DNA, 75 bp, Artificial Sequence
  Synthetic
ataatattgagagtactcctatgaatagtactcaggaaaagatggaggtaggagaaataaaaaactgcactttca

SEQ ID NO: 192942 - DNA, 75 bp, Artificial Sequence
  Synthetic
ataatattgtgagtactcctatgaatagtactcaggaaaagatggaggtaggagaaataaaaaactgcactttca

SEQ ID NO: 192943 - DNA, 75 bp, Artificial Sequence
  Synthetic
ataatattgcgagtactcctatgaatagtactcaggaaaagatggaggtaggagaaataaaaaactgcactttca

SEQ ID NO: 192944 - DNA, 75 bp, Artificial Sequence
  Synthetic
ataatattgggagtactcctatgaatagtactcaggaaaagatggaggtaggagaaataaaaaactgcactttca

SEQ ID NO: 192945 - DNA, 75 bp, Artificial Sequence
  Synthetic
ataatactgagagtactcctatgaatagtactcaggaaaagatggaggtaggagaaataaaaaactgcactttca

SEQ ID NO: 192946 - DNA, 75 bp, Artificial Sequence
  Synthetic
ataatactgtgagtactcctatgaatagtactcaggaaaagatggaggtaggagaaataaaaaactgcactttca

SEQ ID NO: 192947 - DNA, 75 bp, Artificial Sequence
  Synthetic
ataatactgcgagtactcctatgaatagtactcaggaaaagatggaggtaggagaaataaaaaactgcactttca

SEQ ID NO: 192948 - DNA, 75 bp, Artificial Sequence
  Synthetic
ataatactgggagtactcctatgaatagtactcaggaaaagatggaggtaggagaaataaaaaactgcactttca

SEQ ID NO: 192949 - DNA, 75 bp, Artificial Sequence
  Synthetic
ataatagtgagagtactcctatgaatagtactcaggaaaagatggaggtaggagaaataaaaaactgcactttca

SEQ ID NO: 192950 - DNA, 75 bp, Artificial Sequence
  Synthetic
ataatagtgtgagtactcctatgaatagtactcaggaaaagatggaggtaggagaaataaaaaactgcactttca

SEQ ID NO: 192951 - DNA, 75 bp, Artificial Sequence
  Synthetic
ataatagtgcgagtactcctatgaatagtactcaggaaaagatggaggtaggagaaataaaaaactgcactttca

SEQ ID NO: 192952 - DNA, 75 bp, Artificial Sequence
  Synthetic
ataatagtgggagtactcctatgaatagtactcaggaaaagatggaggtaggagaaataaaaaactgcactttca

SEQ ID NO: 192953 - DNA, 75 bp, Artificial Sequence
  Synthetic
gctccttgggatgttaatgatctgtagtgctgcagaacaattgtgggtcacagtctattatggggtacctgtgtg

SEQ ID NO: 192954 - DNA, 75 bp, Artificial Sequence
  Synthetic
tggcaggaagaagcggagacagcgacgaggcactcctcagagcagtgaggtccatcaaaatcctataccaaagca

SEQ ID NO: 192955 - DNA, 75 bp, Artificial Sequence
  Synthetic
ctaaagcaaaggaaaatagacaggttaattgagagaataagagaaagagcagaagatagtggcaatgagagtgag

SEQ ID NO: 192956 - DNA, 75 bp, Artificial Sequence
  Synthetic
aggcttaggcatttcctatggcaggaagaagcggagacaacgacgaagcgctcctccaagcagtaaggatcatca

SEQ ID NO: 192957 - DNA, 75 bp, Artificial Sequence
  Synthetic
gtggcaggcagtaggaaaagcaatgtatgcccctcccatcagtggactaattaaatgttcatcaaatattacagg

SEQ ID NO: 192958 - DNA, 75 bp, Artificial Sequence
  Synthetic
tggagtaataaatctctggataagatttggaataacatgacctggatgcagtgggaaagagaaattgacaattac

SEQ ID NO: 192959 - DNA, 75 bp, Artificial Sequence
  Synthetic
aataatgccaccgccaagagcgtgaatacgacagaagaaatgaaaaactgctccttcgatatggagacagaacta

SEQ ID NO: 192960 - DNA, 75 bp, Artificial Sequence
  Synthetic
ggagacagcgacgaagagctcctcaaggtgatcaggctcatcaagatcctataccaaagcagtaagtagtacatg

SEQ ID NO: 192961 - DNA, 75 bp, Artificial Sequence
  Synthetic
aggctagaaggagagagatgggtgcgagagcgtcggtattaagcgggggaaaattagatgcatgggagaaaattc

SEQ ID NO: 192962 - DNA, 75 bp, Artificial Sequence
  Synthetic
taataaattgtaatacctcagtcattacacaggcttgtccaaaggtaacctttgagccaattcccatacattatt

SEQ ID NO: 192963 - DNA, 75 bp, Artificial Sequence
  Synthetic
tagaggaactcaagcaggaagctgtcagacactttcctagaccatggcttcatggcttaggacaatatgtctatg

SEQ ID NO: 192964 - DNA, 75 bp, Artificial Sequence
  Synthetic
aagaagatagtggcaatgagagcgaaggagataaagaggaattatcagcatttgtggggatggggtactgtgctc

SEQ ID NO: 192965 - DNA, 75 bp, Artificial Sequence
  Synthetic
catgaaaagctgttctttcaatgcaaccacagaaataagagataagaaacataaagtgcaggcacttttctataa

SEQ ID NO: 192966 - DNA, 75 bp, Artificial Sequence
  Synthetic
caagccagtagtatcaactcaactgctgttaaatggcagcctagcagaaggagaagtaaaaaatggcagtagcag

SEQ ID NO: 192967 - DNA, 75 bp, Artificial Sequence
  Synthetic
agacctaacaacaatacaagaaaaagtgtacctataggaccaggacgagcactatatacaacaggacagataata

SEQ ID NO: 192968 - DNA, 75 bp, Artificial Sequence
  Synthetic
aatctgtagaaattgtgtgtacaagacctggcaataatacaagaaaaagtataaggataggaccaggacaaacat

SEQ ID NO: 192969 - DNA, 75 bp, Artificial Sequence
  Synthetic
gtggaccatagtatatatagaatataggaaattggtaaaacaaagaaaaatagactggttaattaaaagaattag

SEQ ID NO: 192970 - DNA, 75 bp, Artificial Sequence
  Synthetic
acctaaaggatcaacagctcctggggatttggggttgctctggaaaactcatttgcaccactgctgtgccttgga

SEQ ID NO: 192971 - DNA, 75 bp, Artificial Sequence
  Synthetic
ccctactcctaatagcatgaatgtagaagtaaaaaattgctctttcactaccaccacagaaataaaagataagca

SEQ ID NO: 192972 - DNA, 75 bp, Artificial Sequence
  Synthetic
tttagaatgtacaaaggttagaaatgggactaacagtaagggtaccaacaagacctacgatgagatgaaaaattg

SEQ ID NO: 192973 - DNA, 75 bp, Artificial Sequence
  Synthetic
tttttgacaacaaaacaataatctttgctccatcctcaggaggagacccagaaattacaacacacagctttaatt

SEQ ID NO: 192974 - DNA, 75 bp, Artificial Sequence
  Synthetic
gtggcgcccgaacagggacttgaaagtgaaagttaatagggactcgaaagcggaaggttccagagaagttctctc

SEQ ID NO: 192975 - DNA, 75 bp, Artificial Sequence
  Synthetic
cacactcccatgcagaataaaacaaattataaacatgtggcagggagtaggaagagcaatgtatgcccctcccat

SEQ ID NO: 192976 - DNA, 75 bp, Artificial Sequence
  Synthetic
aataatacaagacaaagtataaggataggaccaggacaagcattctatacaaataacataataggagacataaga

SEQ ID NO: 192977 - DNA, 75 bp, Artificial Sequence
  Synthetic
gcctgagattagggaaagactaagacgaactcctgtagcagcacaaggagtaggagcagtatctcaagatctaga

SEQ ID NO: 192978 - DNA, 75 bp, Artificial Sequence
  Synthetic
caacgacccattgtcacagtaaaaatagaaggacagctgatagaagctctgttagatacaggagcagatgataca

SEQ ID NO: 192979 - DNA, 75 bp, Artificial Sequence
  Synthetic
ataagaaaacagaaaaagatagaaaaattaattgatagaataagagaaagagcagaagacagtggaaatgagagt

SEQ ID NO: 192980 - DNA, 75 bp, Artificial Sequence
  Synthetic
tccttgggttggtgataatttgtagtgcctcagacaaattgtgggtcacagtctattatggggtacctgtgtggg

SEQ ID NO: 192981 - DNA, 75 bp, Artificial Sequence
  Synthetic
cagttacaatcagctctcaagacaggaacagaagaaattaaatcattatataatacagtagcaaccctctattgt

SEQ ID NO: 192982 - DNA, 75 bp, Artificial Sequence
  Synthetic
tgcatctgatgctaaatcatatagttctgaaaaacataatgtctgggccacacatgcctgtgtacccacagaccc

SEQ ID NO: 192983 - DNA, 75 bp, Artificial Sequence
  Synthetic
acaccaaggaagctttagataaaatagaggaaatacaaaataagagcaagcaaaagacacagcaggcagcagctg

SEQ ID NO: 192984 - DNA, 75 bp, Artificial Sequence
  Synthetic
tgtcagcactggtggaaatggggcatgatgctccttgggatgtggacgatctgtagtgctgcaggaggattgtgg

SEQ ID NO: 192985 - DNA, 75 bp, Artificial Sequence
  Synthetic
acatatagtatgggcaagcagggagctagaacgattcgcagttaatcctggcctgttagaaacatcagaaggctg

SEQ ID NO: 192986 - DNA, 75 bp, Artificial Sequence
  Synthetic
ccatcccttcagacaggatcagaagagcttaaatcattatataatacagtagcagtcctctattttgtacatcaa

SEQ ID NO: 192987 - DNA, 75 bp, Artificial Sequence
  Synthetic
ttactaatagcagtagtgtgaaagcgatggaggcagacgaagtgaaaaactgttctttcaatgttacaaatacaa

SEQ ID NO: 192988 - DNA, 75 bp, Artificial Sequence
  Synthetic
agcaggaaaagaatgaacaagaattattggcattggacaaatgggcaagtttgtggagttggtttgacataacaa

SEQ ID NO: 192989 - DNA, 75 bp, Artificial Sequence
  Synthetic
tatggtaccagttggagaaagaacccatagtaggagcagagactttctatgtagatggggcagctaacagggaga

SEQ ID NO: 192990 - DNA, 75 bp, Artificial Sequence
  Synthetic
acagcatgtcagggagtgggaggacctagccacaaagcaagagtgttggctgaggcaatgagccaaacaaacagt

SEQ ID NO: 192991 - DNA, 75 bp, Artificial Sequence
  Synthetic
gaaagaaggataagtataggaccagggagagcatttcgtgcaataaaagctataacaggagatataagaaaagca

SEQ ID NO: 192992 - DNA, 75 bp, Artificial Sequence
  Synthetic
gcaatagttgtgtggatcatagcatatatagaatataggaaattgttaagacaaaggaaaatagactggttaatt

SEQ ID NO: 192993 - DNA, 75 bp, Artificial Sequence
  Synthetic
caccgcttgagagactttgccttgattgcagcgaggacagtggaacttctgggacgcagcagtctcaagggactg

SEQ ID NO: 192994 - DNA, 75 bp, Artificial Sequence
  Synthetic
tataggaaaatattaagacaaagaaaaatagataggttaattgatagaataagagaaagagcagaagacagtggc

SEQ ID NO: 192995 - DNA, 75 bp, Artificial Sequence
  Synthetic
taaaaaagtgctctttcaataccaccacagtaataagagataagaaaaagacagtgtctgcacttttttatagaa

SEQ ID NO: 192996 - DNA, 75 bp, Artificial Sequence
  Synthetic
aagtaaaaaactgctctttcaatatgaccacagaagtaagagatagggaaaagaaaatgcatgcactcttttata

SEQ ID NO: 192997 - DNA, 75 bp, Artificial Sequence
  Synthetic
aatcattcaggcacaaccagacagaagtgaatcagagatagtcaatcaaataatagagaagctaatagaaaagga

SEQ ID NO: 192998 - DNA, 75 bp, Artificial Sequence
  Synthetic
atggatgacttgtatgtaggatctgacttagaaatagggcaacatagagcaaaaatagaggagttaagagaacat

SEQ ID NO: 192999 - DNA, 75 bp, Artificial Sequence
  Synthetic
aactctccaatgcagaataaagcaaattataaatatgtggcagagagtaggacaagcaatgtatgcccctcccat

SEQ ID NO: 193000 - DNA, 75 bp, Artificial Sequence
  Synthetic
tccttgggatgttgatgatctgtagtgctgcagacaaattgtgggtcacagtctattatggagtacctgtgtgga

SEQ ID NO: 193001 - DNA, 75 bp, Artificial Sequence
  Synthetic
tagtagcagcaatattagcaatagttgtgtggtccatagtattcatagaatataggaaaatattaagacaaagaa

SEQ ID NO: 193002 - DNA, 75 bp, Artificial Sequence
  Synthetic
acttccatgcaggataaagcaaattataaacatgtggcagggagtaggacaagcaatgtatgctcctcccatcag

SEQ ID NO: 193003 - DNA, 75 bp, Artificial Sequence
  Synthetic
ataataagaattctgcaacaactactgtttattcatttcagaattgggtgccaacatagcagaataggcattatt

SEQ ID NO: 193004 - DNA, 75 bp, Artificial Sequence
  Synthetic
ttgaagaatcgcagaaccagcaggaaaagaatgaacaagaattattggcattggacaaatgggcaagtttgtgga

SEQ ID NO: 193005 - DNA, 75 bp, Artificial Sequence
  Synthetic
atgcaacagacgaaataataggagatataaggaaagcacattgtaacattagtggaacacaatggaaaaaaactt

SEQ ID NO: 193006 - DNA, 75 bp, Artificial Sequence
  Synthetic
atgcaacagacgaaataataggagatataaggaaagcacattgtaacattagtggaacacaatggaataaaactt

SEQ ID NO: 193007 - DNA, 75 bp, Artificial Sequence
  Synthetic
atgcaacagacgaaataataggagatataaggaaagcacattgtaacattagtggaacacaatggaacaaaactt

SEQ ID NO: 193008 - DNA, 75 bp, Artificial Sequence
  Synthetic
atgcaacagacgaaataataggagatataaggaaagcacattgtaacattagtggaacacaatggaagaaaactt

SEQ ID NO: 193009 - DNA, 75 bp, Artificial Sequence
  Synthetic
atgcaacagacgatataataggagatataaggaaagcacattgtaacattagtggaacacaatggaaaaaaactt

SEQ ID NO: 193010 - DNA, 75 bp, Artificial Sequence
  Synthetic
atgcaacagacgatataataggagatataaggaaagcacattgtaacattagtggaacacaatggaataaaactt

SEQ ID NO: 193011 - DNA, 75 bp, Artificial Sequence
  Synthetic
atgcaacagacgatataataggagatataaggaaagcacattgtaacattagtggaacacaatggaacaaaactt

SEQ ID NO: 193012 - DNA, 75 bp, Artificial Sequence
  Synthetic
atgcaacagacgatataataggagatataaggaaagcacattgtaacattagtggaacacaatggaagaaaactt

SEQ ID NO: 193013 - DNA, 75 bp, Artificial Sequence
  Synthetic
atgcaacagacgacataataggagatataaggaaagcacattgtaacattagtggaacacaatggaaaaaaactt

SEQ ID NO: 193014 - DNA, 75 bp, Artificial Sequence
  Synthetic
atgcaacagacgacataataggagatataaggaaagcacattgtaacattagtggaacacaatggaataaaactt

SEQ ID NO: 193015 - DNA, 75 bp, Artificial Sequence
  Synthetic
atgcaacagacgacataataggagatataaggaaagcacattgtaacattagtggaacacaatggaacaaaactt

SEQ ID NO: 193016 - DNA, 75 bp, Artificial Sequence
  Synthetic
atgcaacagacgacataataggagatataaggaaagcacattgtaacattagtggaacacaatggaagaaaactt

SEQ ID NO: 193017 - DNA, 75 bp, Artificial Sequence
  Synthetic
atgcaacagacgagataataggagatataaggaaagcacattgtaacattagtggaacacaatggaaaaaaactt

SEQ ID NO: 193018 - DNA, 75 bp, Artificial Sequence
  Synthetic
atgcaacagacgagataataggagatataaggaaagcacattgtaacattagtggaacacaatggaataaaactt

SEQ ID NO: 193019 - DNA, 75 bp, Artificial Sequence
  Synthetic
atgcaacagacgagataataggagatataaggaaagcacattgtaacattagtggaacacaatggaacaaaactt

SEQ ID NO: 193020 - DNA, 75 bp, Artificial Sequence
  Synthetic
atgcaacagacgagataataggagatataaggaaagcacattgtaacattagtggaacacaatggaagaaaactt

SEQ ID NO: 193021 - DNA, 75 bp, Artificial Sequence
  Synthetic
atgcaacagtcgaaataataggagatataaggaaagcacattgtaacattagtggaacacaatggaaaaaaactt

SEQ ID NO: 193022 - DNA, 75 bp, Artificial Sequence
  Synthetic
atgcaacagtcgaaataataggagatataaggaaagcacattgtaacattagtggaacacaatggaataaaactt

SEQ ID NO: 193023 - DNA, 75 bp, Artificial Sequence
  Synthetic
atgcaacagtcgaaataataggagatataaggaaagcacattgtaacattagtggaacacaatggaacaaaactt

SEQ ID NO: 193024 - DNA, 75 bp, Artificial Sequence
  Synthetic
atgcaacagtcgaaataataggagatataaggaaagcacattgtaacattagtggaacacaatggaagaaaactt

SEQ ID NO: 193025 - DNA, 75 bp, Artificial Sequence
  Synthetic
atgcaacagtcgatataataggagatataaggaaagcacattgtaacattagtggaacacaatggaaaaaaactt

SEQ ID NO: 193026 - DNA, 75 bp, Artificial Sequence
  Synthetic
atgcaacagtcgatataataggagatataaggaaagcacattgtaacattagtggaacacaatggaataaaactt

SEQ ID NO: 193027 - DNA, 75 bp, Artificial Sequence
  Synthetic
atgcaacagtcgatataataggagatataaggaaagcacattgtaacattagtggaacacaatggaacaaaactt

SEQ ID NO: 193028 - DNA, 75 bp, Artificial Sequence
  Synthetic
atgcaacagtcgatataataggagatataaggaaagcacattgtaacattagtggaacacaatggaagaaaactt

SEQ ID NO: 193029 - DNA, 75 bp, Artificial Sequence
  Synthetic
atgcaacagtcgacataataggagatataaggaaagcacattgtaacattagtggaacacaatggaaaaaaactt

SEQ ID NO: 193030 - DNA, 75 bp, Artificial Sequence
  Synthetic
atgcaacagtcgacataataggagatataaggaaagcacattgtaacattagtggaacacaatggaataaaactt

SEQ ID NO: 193031 - DNA, 75 bp, Artificial Sequence
  Synthetic
atgcaacagtcgacataataggagatataaggaaagcacattgtaacattagtggaacacaatggaacaaaactt

SEQ ID NO: 193032 - DNA, 75 bp, Artificial Sequence
  Synthetic
atgcaacagtcgacataataggagatataaggaaagcacattgtaacattagtggaacacaatggaagaaaactt

SEQ ID NO: 193033 - DNA, 75 bp, Artificial Sequence
  Synthetic
atgcaacagtcgagataataggagatataaggaaagcacattgtaacattagtggaacacaatggaaaaaaactt

SEQ ID NO: 193034 - DNA, 75 bp, Artificial Sequence
  Synthetic
atgcaacagtcgagataataggagatataaggaaagcacattgtaacattagtggaacacaatggaataaaactt

SEQ ID NO: 193035 - DNA, 75 bp, Artificial Sequence
  Synthetic
atgcaacagtcgagataataggagatataaggaaagcacattgtaacattagtggaacacaatggaacaaaactt

SEQ ID NO: 193036 - DNA, 75 bp, Artificial Sequence
  Synthetic
atgcaacagtcgagataataggagatataaggaaagcacattgtaacattagtggaacacaatggaagaaaactt

SEQ ID NO: 193037 - DNA, 75 bp, Artificial Sequence
  Synthetic
atgcaacagccgaaataataggagatataaggaaagcacattgtaacattagtggaacacaatggaaaaaaactt

SEQ ID NO: 193038 - DNA, 75 bp, Artificial Sequence
  Synthetic
atgcaacagccgaaataataggagatataaggaaagcacattgtaacattagtggaacacaatggaataaaactt

SEQ ID NO: 193039 - DNA, 75 bp, Artificial Sequence
  Synthetic
atgcaacagccgaaataataggagatataaggaaagcacattgtaacattagtggaacacaatggaacaaaactt

SEQ ID NO: 193040 - DNA, 75 bp, Artificial Sequence
  Synthetic
atgcaacagccgaaataataggagatataaggaaagcacattgtaacattagtggaacacaatggaagaaaactt

SEQ ID NO: 193041 - DNA, 75 bp, Artificial Sequence
  Synthetic
atgcaacagccgatataataggagatataaggaaagcacattgtaacattagtggaacacaatggaaaaaaactt

SEQ ID NO: 193042 - DNA, 75 bp, Artificial Sequence
  Synthetic
atgcaacagccgatataataggagatataaggaaagcacattgtaacattagtggaacacaatggaataaaactt

SEQ ID NO: 193043 - DNA, 75 bp, Artificial Sequence
  Synthetic
atgcaacagccgatataataggagatataaggaaagcacattgtaacattagtggaacacaatggaacaaaactt

SEQ ID NO: 193044 - DNA, 75 bp, Artificial Sequence
  Synthetic
atgcaacagccgatataataggagatataaggaaagcacattgtaacattagtggaacacaatggaagaaaactt

SEQ ID NO: 193045 - DNA, 75 bp, Artificial Sequence
  Synthetic
atgcaacagccgacataataggagatataaggaaagcacattgtaacattagtggaacacaatggaaaaaaactt

SEQ ID NO: 193046 - DNA, 75 bp, Artificial Sequence
  Synthetic
atgcaacagccgacataataggagatataaggaaagcacattgtaacattagtggaacacaatggaataaaactt

SEQ ID NO: 193047 - DNA, 75 bp, Artificial Sequence
  Synthetic
atgcaacagccgacataataggagatataaggaaagcacattgtaacattagtggaacacaatggaacaaaactt

SEQ ID NO: 193048 - DNA, 75 bp, Artificial Sequence
  Synthetic
atgcaacagccgacataataggagatataaggaaagcacattgtaacattagtggaacacaatggaagaaaactt

SEQ ID NO: 193049 - DNA, 75 bp, Artificial Sequence
  Synthetic
atgcaacagccgagataataggagatataaggaaagcacattgtaacattagtggaacacaatggaaaaaaactt

SEQ ID NO: 193050 - DNA, 75 bp, Artificial Sequence
  Synthetic
atgcaacagccgagataataggagatataaggaaagcacattgtaacattagtggaacacaatggaataaaactt

SEQ ID NO: 193051 - DNA, 75 bp, Artificial Sequence
  Synthetic
atgcaacagccgagataataggagatataaggaaagcacattgtaacattagtggaacacaatggaacaaaactt

SEQ ID NO: 193052 - DNA, 75 bp, Artificial Sequence
  Synthetic
atgcaacagccgagataataggagatataaggaaagcacattgtaacattagtggaacacaatggaagaaaactt

SEQ ID NO: 193053 - DNA, 75 bp, Artificial Sequence
  Synthetic
atgcaacaggcgaaataataggagatataaggaaagcacattgtaacattagtggaacacaatggaaaaaaactt

SEQ ID NO: 193054 - DNA, 75 bp, Artificial Sequence
  Synthetic
atgcaacaggcgaaataataggagatataaggaaagcacattgtaacattagtggaacacaatggaataaaactt

SEQ ID NO: 193055 - DNA, 75 bp, Artificial Sequence
  Synthetic
atgcaacaggcgaaataataggagatataaggaaagcacattgtaacattagtggaacacaatggaacaaaactt

SEQ ID NO: 193056 - DNA, 75 bp, Artificial Sequence
  Synthetic
atgcaacaggcgaaataataggagatataaggaaagcacattgtaacattagtggaacacaatggaagaaaactt

SEQ ID NO: 193057 - DNA, 75 bp, Artificial Sequence
  Synthetic
atgcaacaggcgatataataggagatataaggaaagcacattgtaacattagtggaacacaatggaaaaaaactt

SEQ ID NO: 193058 - DNA, 75 bp, Artificial Sequence
  Synthetic
atgcaacaggcgatataataggagatataaggaaagcacattgtaacattagtggaacacaatggaataaaactt

SEQ ID NO: 193059 - DNA, 75 bp, Artificial Sequence
  Synthetic
atgcaacaggcgatataataggagatataaggaaagcacattgtaacattagtggaacacaatggaacaaaactt

SEQ ID NO: 193060 - DNA, 75 bp, Artificial Sequence
  Synthetic
atgcaacaggcgatataataggagatataaggaaagcacattgtaacattagtggaacacaatggaagaaaactt

SEQ ID NO: 193061 - DNA, 75 bp, Artificial Sequence
  Synthetic
atgcaacaggcgacataataggagatataaggaaagcacattgtaacattagtggaacacaatggaaaaaaactt

SEQ ID NO: 193062 - DNA, 75 bp, Artificial Sequence
  Synthetic
atgcaacaggcgacataataggagatataaggaaagcacattgtaacattagtggaacacaatggaataaaactt

SEQ ID NO: 193063 - DNA, 75 bp, Artificial Sequence
  Synthetic
atgcaacaggcgacataataggagatataaggaaagcacattgtaacattagtggaacacaatggaacaaaactt

SEQ ID NO: 193064 - DNA, 75 bp, Artificial Sequence
  Synthetic
atgcaacaggcgacataataggagatataaggaaagcacattgtaacattagtggaacacaatggaagaaaactt

SEQ ID NO: 193065 - DNA, 75 bp, Artificial Sequence
  Synthetic
atgcaacaggcgagataataggagatataaggaaagcacattgtaacattagtggaacacaatggaaaaaaactt

SEQ ID NO: 193066 - DNA, 75 bp, Artificial Sequence
  Synthetic
atgcaacaggcgagataataggagatataaggaaagcacattgtaacattagtggaacacaatggaataaaactt

SEQ ID NO: 193067 - DNA, 75 bp, Artificial Sequence
  Synthetic
atgcaacaggcgagataataggagatataaggaaagcacattgtaacattagtggaacacaatggaacaaaactt

SEQ ID NO: 193068 - DNA, 75 bp, Artificial Sequence
  Synthetic
atgcaacaggcgagataataggagatataaggaaagcacattgtaacattagtggaacacaatggaagaaaactt

SEQ ID NO: 193069 - DNA, 75 bp, Artificial Sequence
  Synthetic
catctcctatggcaggaagaagcggagacagcgacgaggaactcctcagagcagtaaggatcatcaaaatcctat

SEQ ID NO: 193070 - DNA, 75 bp, Artificial Sequence
  Synthetic
acagacatcattatgaaagcagacatccaaaagtaagttcagaagtacacataccattaggggatgctaaattag

SEQ ID NO: 193071 - DNA, 75 bp, Artificial Sequence
  Synthetic
gcagtaaggatcatcaaaatcctataccaaagcagtaagtagcagaaattaatatatgtaatgaatcagttgcaa

SEQ ID NO: 193072 - DNA, 75 bp, Artificial Sequence
  Synthetic
gcagtaaggatcatcaaaatcctataccaaagcagtaagtagcagtaattaatatatgtaatgaatcagttgcaa

SEQ ID NO: 193073 - DNA, 75 bp, Artificial Sequence
  Synthetic
gcagtaaggatcatcaaaatcctataccaaagcagtaagtagcagcaattaatatatgtaatgaatcagttgcaa

SEQ ID NO: 193074 - DNA, 75 bp, Artificial Sequence
  Synthetic
gcagtaaggatcatcaaaatcctataccaaagcagtaagtagcaggaattaatatatgtaatgaatcagttgcaa

SEQ ID NO: 193075 - DNA, 75 bp, Artificial Sequence
  Synthetic
actaatgatgtaagacagttaacagaggcagtgcaaaaaatagccatggaatgcatagtaatatggggaaagact

SEQ ID NO: 193076 - DNA, 75 bp, Artificial Sequence
  Synthetic
gaactaaagaatagtgctattagtttgcttgatacagtagcaatagcagtagctaactggacagatagggttata

SEQ ID NO: 193077 - DNA, 75 bp, Artificial Sequence
  Synthetic
ctcaggtacctctaagaccaatgacttataaaggagcatttgatctcagcttctttttaaaagaaaaggggggac

SEQ ID NO: 193078 - DNA, 75 bp, Artificial Sequence
  Synthetic
gtggcgcccgaacagggacttgaaagcgaaagtaaaaccagaggagatctctcgacgcaggactcggcttgctga

SEQ ID NO: 193079 - DNA, 75 bp, Artificial Sequence
  Synthetic
agaatcctgcaacaactactgtttattcatttcagaattgggtgtcaacatagcagaataggcattactccacag

SEQ ID NO: 193080 - DNA, 75 bp, Artificial Sequence
  Synthetic
tacctacaagaataagacagggcttagaaagggctttgctataaaatgggtggcaagtggtcaaaaagtagtatg

SEQ ID NO: 193081 - DNA, 75 bp, Artificial Sequence
  Synthetic
gagttgaagctataataaggatattgcaacaactactgtttatccatttcagaattgggtgccatcatagcagaa

SEQ ID NO: 193082 - DNA, 75 bp, Artificial Sequence
  Synthetic
tgggacacactcctacaatatctccgcagaaatgctaggagaaataaaaaactgctcttacaaaatgaccacaga

SEQ ID NO: 193083 - DNA, 75 bp, Artificial Sequence
  Synthetic
tgggacacactcctacaatatctccgcagaaatgctaggagaaataaaaaactgctcttacaatatgaccacaga

SEQ ID NO: 193084 - DNA, 75 bp, Artificial Sequence
  Synthetic
tgggacacactcctacaatatctccgcagaaatgctaggagaaataaaaaactgctcttacaacatgaccacaga

SEQ ID NO: 193085 - DNA, 75 bp, Artificial Sequence
  Synthetic
tgggacacactcctacaatatctccgcagaaatgctaggagaaataaaaaactgctcttacaagatgaccacaga

SEQ ID NO: 193086 - DNA, 75 bp, Artificial Sequence
  Synthetic
agactcatcaagtttctgtaccaaaacagtaagtaatatatgtaatgcagtctttagaaatattagcaatagcag

SEQ ID NO: 193087 - DNA, 75 bp, Artificial Sequence
  Synthetic
cgaaagagaaaccagagggctctcgacgcaggactcggcttgctgaagcgcgcacggcaagaggcgaggggcggc

SEQ ID NO: 193088 - DNA, 75 bp, Artificial Sequence
  Synthetic
atagacaggttaattgatagaataagagaaagagcagaagatagtggcaatgagagtgagggggatgcagaggaa

SEQ ID NO: 193089 - DNA, 75 bp, Artificial Sequence
  Synthetic
cacatggaattaagccagtagtatcaactcaactactgttaaatggcagtttagcagaagaagagatagtgatta

SEQ ID NO: 193090 - DNA, 75 bp, Artificial Sequence
  Synthetic
tggtacatcaggccatatcacctaggactttgaatgcatgggtaaaagtagtagaagaaaaggccttcagtccag

SEQ ID NO: 193091 - DNA, 75 bp, Artificial Sequence
  Synthetic
catgacctggatgcagtgggaaagagaaattgacaattacacaggcttaatatacaccttaattgaagaatcgca

SEQ ID NO: 193092 - DNA, 75 bp, Artificial Sequence
  Synthetic
ttctccacatacctacaagaataagacagggcttggaaagggctttgctataagatgggtggcaagtggtcaaaa

SEQ ID NO: 193093 - DNA, 75 bp, Artificial Sequence
  Synthetic
gaaattgacaattacacaggcttaatatacaccttaattgaagaatcgcaaaaccaacaagaaaagaatgaacaa

SEQ ID NO: 193094 - DNA, 75 bp, Artificial Sequence
  Synthetic
gggatttaccacaccagacaaaaaacatcagaaagaacctccatttctttggatgggttatgaactccatcctga

SEQ ID NO: 193095 - DNA, 75 bp, Artificial Sequence
  Synthetic
gatgatggggaaaggagaaatgcaaaactgttctttcaatataaccacagaaataagaaataaaagacagaatgt

SEQ ID NO: 193096 - DNA, 75 bp, Artificial Sequence
  Synthetic
gccagcagcagatggggtgggagcagcatctcgagacctggcagatcgtggagcattcacaactagcaatacagc

SEQ ID NO: 193097 - DNA, 75 bp, Artificial Sequence
  Synthetic
aatgaaactcataataccaccctgaaggaagagtcaggggcaatacaaaactgttctttcaatatgaccacagca

SEQ ID NO: 193098 - DNA, 75 bp, Artificial Sequence
  Synthetic
ccatcaaaagacttaatagcagaaatacagaagcaggggcaaggccaatggacatatcaaatttatcaagagcca

SEQ ID NO: 193099 - DNA, 75 bp, Artificial Sequence
  Synthetic
atggagagaggagaaataaaaaactgcacttttaatatcaccaccaacaaaggagataagcagagagacaatgca

SEQ ID NO: 193100 - DNA, 75 bp, Artificial Sequence
  Synthetic
atggagagaggagaaataaaaaactgcacttttaatatcaccaccaacaaaggagataagcagagagactatgca

SEQ ID NO: 193101 - DNA, 75 bp, Artificial Sequence
  Synthetic
atggagagaggagaaataaaaaactgcacttttaatatcaccaccaacaaaggagataagcagagagaccatgca

SEQ ID NO: 193102 - DNA, 75 bp, Artificial Sequence
  Synthetic
atggagagaggagaaataaaaaactgcacttttaatatcaccaccaacaaaggagataagcagagagacgatgca

SEQ ID NO: 193103 - DNA, 75 bp, Artificial Sequence
  Synthetic
atggagagaggagaaataaaaaactgcacttttaatatcaccaccaacataggagataagcagagagacaatgca

SEQ ID NO: 193104 - DNA, 75 bp, Artificial Sequence
  Synthetic
atggagagaggagaaataaaaaactgcacttttaatatcaccaccaacataggagataagcagagagactatgca

SEQ ID NO: 193105 - DNA, 75 bp, Artificial Sequence
  Synthetic
atggagagaggagaaataaaaaactgcacttttaatatcaccaccaacataggagataagcagagagaccatgca

SEQ ID NO: 193106 - DNA, 75 bp, Artificial Sequence
  Synthetic
atggagagaggagaaataaaaaactgcacttttaatatcaccaccaacataggagataagcagagagacgatgca

SEQ ID NO: 193107 - DNA, 75 bp, Artificial Sequence
  Synthetic
atggagagaggagaaataaaaaactgcacttttaatatcaccaccaacacaggagataagcagagagacaatgca

SEQ ID NO: 193108 - DNA, 75 bp, Artificial Sequence
  Synthetic
atggagagaggagaaataaaaaactgcacttttaatatcaccaccaacacaggagataagcagagagactatgca

SEQ ID NO: 193109 - DNA, 75 bp, Artificial Sequence
  Synthetic
atggagagaggagaaataaaaaactgcacttttaatatcaccaccaacacaggagataagcagagagaccatgca

SEQ ID NO: 193110 - DNA, 75 bp, Artificial Sequence
  Synthetic
atggagagaggagaaataaaaaactgcacttttaatatcaccaccaacacaggagataagcagagagacgatgca

SEQ ID NO: 193111 - DNA, 75 bp, Artificial Sequence
  Synthetic
atggagagaggagaaataaaaaactgcacttttaatatcaccaccaacagaggagataagcagagagacaatgca

SEQ ID NO: 193112 - DNA, 75 bp, Artificial Sequence
  Synthetic
atggagagaggagaaataaaaaactgcacttttaatatcaccaccaacagaggagataagcagagagactatgca

SEQ ID NO: 193113 - DNA, 75 bp, Artificial Sequence
  Synthetic
atggagagaggagaaataaaaaactgcacttttaatatcaccaccaacagaggagataagcagagagaccatgca

SEQ ID NO: 193114 - DNA, 75 bp, Artificial Sequence
  Synthetic
atggagagaggagaaataaaaaactgcacttttaatatcaccaccaacagaggagataagcagagagacgatgca

SEQ ID NO: 193115 - DNA, 75 bp, Artificial Sequence
  Synthetic
ttattgtgccccagctggttttgcaattctaaagtgtaaagataagaagttcaatggaacaggcccatgcaaaaa

SEQ ID NO: 193116 - DNA, 75 bp, Artificial Sequence
  Synthetic
agaataaagcaaattataaatatgtggcagaaagtaggacaagcaatgtatgcccctcccatccaaggagtaata

SEQ ID NO: 193117 - DNA, 75 bp, Artificial Sequence
  Synthetic
gtcactttagattgtagagactataatggtaccattaatgaaataaaaaactgctctttcaatgcaaccacagaa

SEQ ID NO: 193118 - DNA, 75 bp, Artificial Sequence
  Synthetic
caggaaagaaataaaaaattgcactttcaatgtaaccacagaaataaaagataggaaaagaaaagagtatgcact

SEQ ID NO: 193119 - DNA, 75 bp, Artificial Sequence
  Synthetic
ttcaatgtaaccacagaaataaaagataggaaaagaaaagagtatgcacttttttatagacttgatatagtacca

SEQ ID NO: 193120 - DNA, 75 bp, Artificial Sequence
  Synthetic
ctataggactagggcaggtactccatacaacaagggtaaaaggagatataagacaagcacattgtaacattagta

SEQ ID NO: 193121 - DNA, 75 bp, Artificial Sequence
  Synthetic
ttccttgggttcttaggagcagcaggaagcactatgggcgcagcgtcactaacgctgacggtacaggccagacaa

SEQ ID NO: 193122 - DNA, 75 bp, Artificial Sequence
  Synthetic
ataaaacaataaaatttgaaccagcctcaggaggggatctagaaattacaacacatagctttaattgtagaggag

SEQ ID NO: 193123 - DNA, 75 bp, Artificial Sequence
  Synthetic
aataaaagaactcaagacttttgggaagttcaattaggaataccacatccagcagggttaaaaaagaaaaaatca

SEQ ID NO: 193124 - DNA, 75 bp, Artificial Sequence
  Synthetic
tgtgtataagacccggcaataatacaagaaaaagtataaggataggaccaggacaagtattctttacagccacag

SEQ ID NO: 193125 - DNA, 75 bp, Artificial Sequence
  Synthetic
taataaaacaagaataaaatttgacaaacattcaggaggggatccagaaattacagcacatagctttaattgtgg

SEQ ID NO: 193126 - DNA, 75 bp, Artificial Sequence
  Synthetic
gaaaattagtagatttcagagagctcaataaaagaactcaagatttctgggaggtccaattaggaatacctcatc

SEQ ID NO: 193127 - DNA, 75 bp, Artificial Sequence
  Synthetic
gatgaaatgaaaaattgttctttcaatatgaccacagaattaagagataagaaaaggcaagtgtatgcacttttt

SEQ ID NO: 193128 - DNA, 75 bp, Artificial Sequence
  Synthetic
ggggttgctctggaagacacatttgcaccactaatgtgccctggaactctagttggagtaataaatctctaactg

SEQ ID NO: 193129 - DNA, 75 bp, Artificial Sequence
  Synthetic
ttattagcattggacagttggaaaaatctgtggagttggtttgacatatcaaattggctgtggtatataaaaata

SEQ ID NO: 193130 - DNA, 75 bp, Artificial Sequence
  Synthetic
ggagtgggaaagagaaattgacaattacacaggcttaatatatagcttaattgaggaatcgcaaacccagcaaga

SEQ ID NO: 193131 - DNA, 75 bp, Artificial Sequence
  Synthetic
ctggaagcagaagaggaagaggaggtaggctttccagtcaagccacaggtacctgaaagaccaatgacttacaaa

SEQ ID NO: 193132 - DNA, 75 bp, Artificial Sequence
  Synthetic
ctggaagcagaagaggaagaggaggtaggctttccagtcaagccacaggtacctgaaagaccaatgacttacaat

SEQ ID NO: 193133 - DNA, 75 bp, Artificial Sequence
  Synthetic
ctggaagcagaagaggaagaggaggtaggctttccagtcaagccacaggtacctgaaagaccaatgacttacaac

SEQ ID NO: 193134 - DNA, 75 bp, Artificial Sequence
  Synthetic
ctggaagcagaagaggaagaggaggtaggctttccagtcaagccacaggtacctgaaagaccaatgacttacaag

SEQ ID NO: 193135 - DNA, 75 bp, Artificial Sequence
  Synthetic
ctggaagcagaagaggaagaggaggtaggctttccagtcaagccacaggtacctgtaagaccaatgacttacaaa

SEQ ID NO: 193136 - DNA, 75 bp, Artificial Sequence
  Synthetic
ctggaagcagaagaggaagaggaggtaggctttccagtcaagccacaggtacctgtaagaccaatgacttacaat

SEQ ID NO: 193137 - DNA, 75 bp, Artificial Sequence
  Synthetic
ctggaagcagaagaggaagaggaggtaggctttccagtcaagccacaggtacctgtaagaccaatgacttacaac

SEQ ID NO: 193138 - DNA, 75 bp, Artificial Sequence
  Synthetic
ctggaagcagaagaggaagaggaggtaggctttccagtcaagccacaggtacctgtaagaccaatgacttacaag

SEQ ID NO: 193139 - DNA, 75 bp, Artificial Sequence
  Synthetic
ctggaagcagaagaggaagaggaggtaggctttccagtcaagccacaggtacctgcaagaccaatgacttacaaa

SEQ ID NO: 193140 - DNA, 75 bp, Artificial Sequence
  Synthetic
ctggaagcagaagaggaagaggaggtaggctttccagtcaagccacaggtacctgcaagaccaatgacttacaat

SEQ ID NO: 193141 - DNA, 75 bp, Artificial Sequence
  Synthetic
ctggaagcagaagaggaagaggaggtaggctttccagtcaagccacaggtacctgcaagaccaatgacttacaac

SEQ ID NO: 193142 - DNA, 75 bp, Artificial Sequence
  Synthetic
ctggaagcagaagaggaagaggaggtaggctttccagtcaagccacaggtacctgcaagaccaatgacttacaag

SEQ ID NO: 193143 - DNA, 75 bp, Artificial Sequence
  Synthetic
ctggaagcagaagaggaagaggaggtaggctttccagtcaagccacaggtacctggaagaccaatgacttacaaa

SEQ ID NO: 193144 - DNA, 75 bp, Artificial Sequence
  Synthetic
ctggaagcagaagaggaagaggaggtaggctttccagtcaagccacaggtacctggaagaccaatgacttacaat

SEQ ID NO: 193145 - DNA, 75 bp, Artificial Sequence
  Synthetic
ctggaagcagaagaggaagaggaggtaggctttccagtcaagccacaggtacctggaagaccaatgacttacaac

SEQ ID NO: 193146 - DNA, 75 bp, Artificial Sequence
  Synthetic
ctggaagcagaagaggaagaggaggtaggctttccagtcaagccacaggtacctggaagaccaatgacttacaag

SEQ ID NO: 193147 - DNA, 75 bp, Artificial Sequence
  Synthetic
ctggaagcagaagaggaagaggaggtaggctttccagtcatgccacaggtacctgaaagaccaatgacttacaaa

SEQ ID NO: 193148 - DNA, 75 bp, Artificial Sequence
  Synthetic
ctggaagcagaagaggaagaggaggtaggctttccagtcatgccacaggtacctgaaagaccaatgacttacaat

SEQ ID NO: 193149 - DNA, 75 bp, Artificial Sequence
  Synthetic
ctggaagcagaagaggaagaggaggtaggctttccagtcatgccacaggtacctgaaagaccaatgacttacaac

SEQ ID NO: 193150 - DNA, 75 bp, Artificial Sequence
  Synthetic
ctggaagcagaagaggaagaggaggtaggctttccagtcatgccacaggtacctgaaagaccaatgacttacaag

SEQ ID NO: 193151 - DNA, 75 bp, Artificial Sequence
  Synthetic
ctggaagcagaagaggaagaggaggtaggctttccagtcatgccacaggtacctgtaagaccaatgacttacaaa

SEQ ID NO: 193152 - DNA, 75 bp, Artificial Sequence
  Synthetic
ctggaagcagaagaggaagaggaggtaggctttccagtcatgccacaggtacctgtaagaccaatgacttacaat

SEQ ID NO: 193153 - DNA, 75 bp, Artificial Sequence
  Synthetic
ctggaagcagaagaggaagaggaggtaggctttccagtcatgccacaggtacctgtaagaccaatgacttacaac

SEQ ID NO: 193154 - DNA, 75 bp, Artificial Sequence
  Synthetic
ctggaagcagaagaggaagaggaggtaggctttccagtcatgccacaggtacctgtaagaccaatgacttacaag

SEQ ID NO: 193155 - DNA, 75 bp, Artificial Sequence
  Synthetic
ctggaagcagaagaggaagaggaggtaggctttccagtcatgccacaggtacctgcaagaccaatgacttacaaa

SEQ ID NO: 193156 - DNA, 75 bp, Artificial Sequence
  Synthetic
ctggaagcagaagaggaagaggaggtaggctttccagtcatgccacaggtacctgcaagaccaatgacttacaat

SEQ ID NO: 193157 - DNA, 75 bp, Artificial Sequence
  Synthetic
ctggaagcagaagaggaagaggaggtaggctttccagtcatgccacaggtacctgcaagaccaatgacttacaac

SEQ ID NO: 193158 - DNA, 75 bp, Artificial Sequence
  Synthetic
ctggaagcagaagaggaagaggaggtaggctttccagtcatgccacaggtacctgcaagaccaatgacttacaag

SEQ ID NO: 193159 - DNA, 75 bp, Artificial Sequence
  Synthetic
ctggaagcagaagaggaagaggaggtaggctttccagtcatgccacaggtacctggaagaccaatgacttacaaa

SEQ ID NO: 193160 - DNA, 75 bp, Artificial Sequence
  Synthetic
ctggaagcagaagaggaagaggaggtaggctttccagtcatgccacaggtacctggaagaccaatgacttacaat

SEQ ID NO: 193161 - DNA, 75 bp, Artificial Sequence
  Synthetic
ctggaagcagaagaggaagaggaggtaggctttccagtcatgccacaggtacctggaagaccaatgacttacaac

SEQ ID NO: 193162 - DNA, 75 bp, Artificial Sequence
  Synthetic
ctggaagcagaagaggaagaggaggtaggctttccagtcatgccacaggtacctggaagaccaatgacttacaag

SEQ ID NO: 193163 - DNA, 75 bp, Artificial Sequence
  Synthetic
ctggaagcagaagaggaagaggaggtaggctttccagtcacgccacaggtacctgaaagaccaatgacttacaaa

SEQ ID NO: 193164 - DNA, 75 bp, Artificial Sequence
  Synthetic
ctggaagcagaagaggaagaggaggtaggctttccagtcacgccacaggtacctgaaagaccaatgacttacaat

SEQ ID NO: 193165 - DNA, 75 bp, Artificial Sequence
  Synthetic
ctggaagcagaagaggaagaggaggtaggctttccagtcacgccacaggtacctgaaagaccaatgacttacaac

SEQ ID NO: 193166 - DNA, 75 bp, Artificial Sequence
  Synthetic
ctggaagcagaagaggaagaggaggtaggctttccagtcacgccacaggtacctgaaagaccaatgacttacaag

SEQ ID NO: 193167 - DNA, 75 bp, Artificial Sequence
  Synthetic
ctggaagcagaagaggaagaggaggtaggctttccagtcacgccacaggtacctgtaagaccaatgacttacaaa

SEQ ID NO: 193168 - DNA, 75 bp, Artificial Sequence
  Synthetic
ctggaagcagaagaggaagaggaggtaggctttccagtcacgccacaggtacctgtaagaccaatgacttacaat

SEQ ID NO: 193169 - DNA, 75 bp, Artificial Sequence
  Synthetic
ctggaagcagaagaggaagaggaggtaggctttccagtcacgccacaggtacctgtaagaccaatgacttacaac

SEQ ID NO: 193170 - DNA, 75 bp, Artificial Sequence
  Synthetic
ctggaagcagaagaggaagaggaggtaggctttccagtcacgccacaggtacctgtaagaccaatgacttacaag

SEQ ID NO: 193171 - DNA, 75 bp, Artificial Sequence
  Synthetic
ctggaagcagaagaggaagaggaggtaggctttccagtcacgccacaggtacctgcaagaccaatgacttacaaa

SEQ ID NO: 193172 - DNA, 75 bp, Artificial Sequence
  Synthetic
ctggaagcagaagaggaagaggaggtaggctttccagtcacgccacaggtacctgcaagaccaatgacttacaat

SEQ ID NO: 193173 - DNA, 75 bp, Artificial Sequence
  Synthetic
ctggaagcagaagaggaagaggaggtaggctttccagtcacgccacaggtacctgcaagaccaatgacttacaac

SEQ ID NO: 193174 - DNA, 75 bp, Artificial Sequence
  Synthetic
ctggaagcagaagaggaagaggaggtaggctttccagtcacgccacaggtacctgcaagaccaatgacttacaag

SEQ ID NO: 193175 - DNA, 75 bp, Artificial Sequence
  Synthetic
ctggaagcagaagaggaagaggaggtaggctttccagtcacgccacaggtacctggaagaccaatgacttacaaa

SEQ ID NO: 193176 - DNA, 75 bp, Artificial Sequence
  Synthetic
ctggaagcagaagaggaagaggaggtaggctttccagtcacgccacaggtacctggaagaccaatgacttacaat

SEQ ID NO: 193177 - DNA, 75 bp, Artificial Sequence
  Synthetic
ctggaagcagaagaggaagaggaggtaggctttccagtcacgccacaggtacctggaagaccaatgacttacaac

SEQ ID NO: 193178 - DNA, 75 bp, Artificial Sequence
  Synthetic
ctggaagcagaagaggaagaggaggtaggctttccagtcacgccacaggtacctggaagaccaatgacttacaag

SEQ ID NO: 193179 - DNA, 75 bp, Artificial Sequence
  Synthetic
ctggaagcagaagaggaagaggaggtaggctttccagtcaggccacaggtacctgaaagaccaatgacttacaaa

SEQ ID NO: 193180 - DNA, 75 bp, Artificial Sequence
  Synthetic
ctggaagcagaagaggaagaggaggtaggctttccagtcaggccacaggtacctgaaagaccaatgacttacaat

SEQ ID NO: 193181 - DNA, 75 bp, Artificial Sequence
  Synthetic
ctggaagcagaagaggaagaggaggtaggctttccagtcaggccacaggtacctgaaagaccaatgacttacaac

SEQ ID NO: 193182 - DNA, 75 bp, Artificial Sequence
  Synthetic
ctggaagcagaagaggaagaggaggtaggctttccagtcaggccacaggtacctgaaagaccaatgacttacaag

SEQ ID NO: 193183 - DNA, 75 bp, Artificial Sequence
  Synthetic
ctggaagcagaagaggaagaggaggtaggctttccagtcaggccacaggtacctgtaagaccaatgacttacaaa

SEQ ID NO: 193184 - DNA, 75 bp, Artificial Sequence
  Synthetic
ctggaagcagaagaggaagaggaggtaggctttccagtcaggccacaggtacctgtaagaccaatgacttacaat

SEQ ID NO: 193185 - DNA, 75 bp, Artificial Sequence
  Synthetic
ctggaagcagaagaggaagaggaggtaggctttccagtcaggccacaggtacctgtaagaccaatgacttacaac

SEQ ID NO: 193186 - DNA, 75 bp, Artificial Sequence
  Synthetic
ctggaagcagaagaggaagaggaggtaggctttccagtcaggccacaggtacctgtaagaccaatgacttacaag

SEQ ID NO: 193187 - DNA, 75 bp, Artificial Sequence
  Synthetic
ctggaagcagaagaggaagaggaggtaggctttccagtcaggccacaggtacctgcaagaccaatgacttacaaa

SEQ ID NO: 193188 - DNA, 75 bp, Artificial Sequence
  Synthetic
ctggaagcagaagaggaagaggaggtaggctttccagtcaggccacaggtacctgcaagaccaatgacttacaat

SEQ ID NO: 193189 - DNA, 75 bp, Artificial Sequence
  Synthetic
ctggaagcagaagaggaagaggaggtaggctttccagtcaggccacaggtacctgcaagaccaatgacttacaac

SEQ ID NO: 193190 - DNA, 75 bp, Artificial Sequence
  Synthetic
ctggaagcagaagaggaagaggaggtaggctttccagtcaggccacaggtacctgcaagaccaatgacttacaag

SEQ ID NO: 193191 - DNA, 75 bp, Artificial Sequence
  Synthetic
ctggaagcagaagaggaagaggaggtaggctttccagtcaggccacaggtacctggaagaccaatgacttacaaa

SEQ ID NO: 193192 - DNA, 75 bp, Artificial Sequence
  Synthetic
ctggaagcagaagaggaagaggaggtaggctttccagtcaggccacaggtacctggaagaccaatgacttacaat

SEQ ID NO: 193193 - DNA, 75 bp, Artificial Sequence
  Synthetic
ctggaagcagaagaggaagaggaggtaggctttccagtcaggccacaggtacctggaagaccaatgacttacaac

SEQ ID NO: 193194 - DNA, 75 bp, Artificial Sequence
  Synthetic
ctggaagcagaagaggaagaggaggtaggctttccagtcaggccacaggtacctggaagaccaatgacttacaag

SEQ ID NO: 193195 - DNA, 75 bp, Artificial Sequence
  Synthetic
caaggtagggtctctacagtacttggcactaacagcattaataacaccaaaaaagataaagccacctttgcctag

SEQ ID NO: 193196 - DNA, 75 bp, Artificial Sequence
  Synthetic
tcccagcaccgaggggacccgacaggcccgaaggaatagaagaagaaggtggagagcaaggcagagacagatcaa

SEQ ID NO: 193197 - DNA, 75 bp, Artificial Sequence
  Synthetic
agctataataagaattctgcaacaactactgtttattcatttcagaattgggtgccaacatagcagaataggcat

SEQ ID NO: 193198 - DNA, 75 bp, Artificial Sequence
  Synthetic
tttttagggaagatctggccttcccacaaggggaggccaggaaattttcttcagagcagaccagagccaacagcc

SEQ ID NO: 193199 - DNA, 75 bp, Artificial Sequence
  Synthetic
aaagatttgcacttaaccctagccttttagaaacagcagaaggatgtcaacaaataatggaacagttacaatcat

SEQ ID NO: 193200 - DNA, 75 bp, Artificial Sequence
  Synthetic
tctttggcagcgacccctcgtcacaataaagataggggggcaactaaaggaagctctattagatacaggagcaga

SEQ ID NO: 193201 - DNA, 75 bp, Artificial Sequence
  Synthetic
ttaatagggactcgaaagcgaaagttccagagaagttctctcgacgcaaggactcggcttgctgaggtgcacaca

SEQ ID NO: 193202 - DNA, 75 bp, Artificial Sequence
  Synthetic
gagcctgtgtctcttcagctaccaccacttgagagacttactcttgattgcagcgaggattgtggaacttctggg

SEQ ID NO: 193203 - DNA, 75 bp, Artificial Sequence
  Synthetic
agcttgcttgataccatagcaatagcagtagctgaggggacagataggattatagacgtagtacaaagagcttgt

SEQ ID NO: 193204 - DNA, 75 bp, Artificial Sequence
  Synthetic
acttgtgggttacagtttattatggggttcctgtgtggagagatgcagataccaccctattttgtgcatcagatg

SEQ ID NO: 193205 - DNA, 75 bp, Artificial Sequence
  Synthetic
ataaaatggggggcaagtggtcaaaaagcaagaggagtgactggccagttgtgagagaaagaataagacaaactg

SEQ ID NO: 193206 - DNA, 75 bp, Artificial Sequence
  Synthetic
ggggaagtgatggaggaagtagacatgaaaaactgctctttcaccgttaccaccgaattaaaaaatacggtgagc

SEQ ID NO: 193207 - DNA, 75 bp, Artificial Sequence
  Synthetic
caataaaaaatataagaataggaccagggataggactagggagtacattacatgcaacaaaaagcataacaggaa

SEQ ID NO: 193208 - DNA, 75 bp, Artificial Sequence
  Synthetic
ttaaatggcagtctagcagaagaagagataataatcagatccgaaaatctcacaaacaatgccaaaaccataata

SEQ ID NO: 193209 - DNA, 75 bp, Artificial Sequence
  Synthetic
ttttgtagagctgtccgcaacatacctagaagattaagacagggctttgaaacagctttgctataaaatggggag

SEQ ID NO: 193210 - DNA, 75 bp, Artificial Sequence
  Synthetic
aaaggtcagtcaaaattatcctatagtacagaatctccaagggcaaatggtacaccaggctatatcacctagaac

SEQ ID NO: 193211 - DNA, 75 bp, Artificial Sequence
  Synthetic
caaatggtcaaaaagcagcatagtgggatggcctgaggtaagggaaagactaagacgaactagaacaacagtaag

SEQ ID NO: 193212 - DNA, 75 bp, Artificial Sequence
  Synthetic
ttatctaccaatacatggatgatttgtatgtaggatctgacttagaaatagggcagcatagagcaaaaatagagg

SEQ ID NO: 193213 - DNA, 75 bp, Artificial Sequence
  Synthetic
gcgacgaagcgctcctccaagcagtgaggatcatcaaaatcctatatcaaagcagtaagtatatgtaatgttaga

SEQ ID NO: 193214 - DNA, 75 bp, Artificial Sequence
  Synthetic
cagagaagagtaagggatggatccggtagatcctaacctagagccctggaatcatccggggagtcagcctaaaac

SEQ ID NO: 193215 - DNA, 75 bp, Artificial Sequence
  Synthetic
gcaatagtaggactaatagtagcagccatagcagccataattgtgtggattatagtatttatacaatataaggaa

SEQ ID NO: 193216 - DNA, 75 bp, Artificial Sequence
  Synthetic
atgggagtttgtcaatacccctcctctagtaaaattatggtaccagttagagaaagaccccatagtaggagcaga

SEQ ID NO: 193217 - DNA, 75 bp, Artificial Sequence
  Synthetic
caggtcagggaaaaaataaagcaaactcctccagcagcagcagaaggagtaggagcagtatctcaagatctagat

SEQ ID NO: 193218 - DNA, 75 bp, Artificial Sequence
  Synthetic
taaaggctaaaggagaactaaaaaactgctctttcaatataaccacagaactaagagatagaaaaagtcaagagt

SEQ ID NO: 193219 - DNA, 75 bp, Artificial Sequence
  Synthetic
taaaggcttaaggagaactaaaaaactgctctttcaatataaccacagaactaagagatagaaaaagtcaagagt

SEQ ID NO: 193220 - DNA, 75 bp, Artificial Sequence
  Synthetic
taaaggctcaaggagaactaaaaaactgctctttcaatataaccacagaactaagagatagaaaaagtcaagagt

SEQ ID NO: 193221 - DNA, 75 bp, Artificial Sequence
  Synthetic
taaaggctgaaggagaactaaaaaactgctctttcaatataaccacagaactaagagatagaaaaagtcaagagt

SEQ ID NO: 193222 - DNA, 75 bp, Artificial Sequence
  Synthetic
aagaaagaaactgcacttttttataaacttgatgtagtaccaatagataataataatagtaattataggttgata

SEQ ID NO: 193223 - DNA, 75 bp, Artificial Sequence
  Synthetic
gggaaaaaattcggttaaggccagggggaaagaaaaaatataggctaaaacatctagtatgggcaagcagggagc

SEQ ID NO: 193224 - DNA, 75 bp, Artificial Sequence
  Synthetic
agtggtatcaactcaattactgctgaatggcagtatagcagaagaagaagtaatgattagatctgaaaacatcac

SEQ ID NO: 193225 - DNA, 75 bp, Artificial Sequence
  Synthetic
agaaatacaaaactgctctttcaaggtcaccacaaacataagagataaggtacagaaagaatctgcactttttta

SEQ ID NO: 193226 - DNA, 75 bp, Artificial Sequence
  Synthetic
actaggagctgtgttctttgggttcttgggagcagcaggaagcactatgggcgcggcgtcaataacgctgacggt

SEQ ID NO: 193227 - DNA, 75 bp, Artificial Sequence
  Synthetic
ggaataaaacaataaactttactcaatcctcaggaggggacccagaaattgtaacacacagttttaattgtggag

SEQ ID NO: 193228 - DNA, 75 bp, Artificial Sequence
  Synthetic
agatggaacaagccccagaagaccaggggccccagagagagccatacaatgaatggatgttagagctgttagaag

SEQ ID NO: 193229 - DNA, 75 bp, Artificial Sequence
  Synthetic
tataataagaatcctgcaacaactactgtttattcatttcagaattgggtgtcaacatagcagaataggcattac

SEQ ID NO: 193230 - DNA, 75 bp, Artificial Sequence
  Synthetic
agaaaaggtatacatataggaccagggagagcagtttatacgacaggaagaatagtaggagatataagactagca

SEQ ID NO: 193231 - DNA, 75 bp, Artificial Sequence
  Synthetic
gaataagagaaagagcagaagacagtggcaatgagagtgatggggatacagaggaattgtcaacacttattgaga

SEQ ID NO: 193232 - DNA, 75 bp, Artificial Sequence
  Synthetic
tgagaaactgctcttacagtgtaaccacagaaataagggataagaaaaagaaggtatattcacttttttatagac

SEQ ID NO: 193233 - DNA, 75 bp, Artificial Sequence
  Synthetic
ccatacattattgtgccccagctggttttgcaattctaaagtgtaaagataagaagttcaatggaacaggcccat

SEQ ID NO: 193234 - DNA, 75 bp, Artificial Sequence
  Synthetic
tagcaactctctattgtgtacataaaggcatagaggtacgagacaccaaggaagccttagacaagatagaggaag

SEQ ID NO: 193235 - DNA, 75 bp, Artificial Sequence
  Synthetic
catctctgctaacttaaccaataacatgcaaggggaaataaaaaactgctctttcaatatgaccacagaagtaaa

SEQ ID NO: 193236 - DNA, 75 bp, Artificial Sequence
  Synthetic
ctccaatgcaggataaaacaatttataaacatgtggcagaaggtaggaagagcaatgtataaccctcctattgaa

SEQ ID NO: 193237 - DNA, 75 bp, Artificial Sequence
  Synthetic
cagtgccaccaatggcactcaaaataccaatgatagcctgcaggaagagttaggggaaatacaaaattgtacttt

SEQ ID NO: 193238 - DNA, 75 bp, Artificial Sequence
  Synthetic
ttaattgtaccagacctaacaacaatacaagagaaagtatacgtataggaccaggacaagcattctatgcaacag

SEQ ID NO: 193239 - DNA, 75 bp, Artificial Sequence
  Synthetic
cagaggagcttagatcattatttaatacagtagcaaccctctactgtgtacatcaaaagatagaggtaaaagaca

SEQ ID NO: 193240 - DNA, 75 bp, Artificial Sequence
  Synthetic
tagtaatgttaacaaaactaatactaactttacggatacaacaaatggagaaataaagaattgctctttcaatat

SEQ ID NO: 193241 - DNA, 75 bp, Artificial Sequence
  Synthetic
gaaaaagtgtacgtataggaccaggacaaacattctatgcaacaggtgacataataggagatataagacaagcac

SEQ ID NO: 193242 - DNA, 75 bp, Artificial Sequence
  Synthetic
ggagccaccccacaagatttaaacaccatgctaaacacagtggggggacatcaagcagccatgcaaatgttaaaa

SEQ ID NO: 193243 - DNA, 75 bp, Artificial Sequence
  Synthetic
ggaatttggggttgctctggaagacacatttgcaccactaatgtgccctggaactctagttggagtaataaatct

SEQ ID NO: 193244 - DNA, 75 bp, Artificial Sequence
  Synthetic
agcaagaaaagaatgaacaagaattattggcattggacaagtgggcaagtttgtggaattggtttgacataacaa

SEQ ID NO: 193245 - DNA, 75 bp, Artificial Sequence
  Synthetic
acaaggtttggaagcagccttgctataaaatggggggcaagtgttcaaaattagctggatggtctgctgtaagag

SEQ ID NO: 193246 - DNA, 75 bp, Artificial Sequence
  Synthetic
agaagaattattaagtgtttcaactgtggcaaggaaggacatctagccagaaattgcagggcccctaggaaaaag

SEQ ID NO: 193247 - DNA, 75 bp, Artificial Sequence
  Synthetic
tggagcacttacaaccagcaacacagcccacaataatgctgattgtgcctggctgcaagcacaagaggaggaaga

SEQ ID NO: 193248 - DNA, 75 bp, Artificial Sequence
  Synthetic
tgacctggctgcaatgggataaagaaattagcaattacacagaaataatatataatctaattgaagaatcgcaga

SEQ ID NO: 193249 - DNA, 75 bp, Artificial Sequence
  Synthetic
gagccatttaaaaatctgaagacaggaaaatatgcaagaatgaggggtgcccacactaatgatgtaaaacaatta

SEQ ID NO: 193250 - DNA, 75 bp, Artificial Sequence
  Synthetic
ggttttaagcgggggagaattagataggtgggaaaaaattcgtttaaggccgggagggaagaaaaaatataaact

SEQ ID NO: 193251 - DNA, 75 bp, Artificial Sequence
  Synthetic
gttggtagagctatccgcaacgtacctgtaagaatcagacagggcctagaaagagctttgctttaacatgggtag

SEQ ID NO: 193252 - DNA, 75 bp, Artificial Sequence
  Synthetic
gaaaggatagaggtaaaggacaccaaggaagctttcagaaagatggaggaagaacaaaacaaatgtaagaaaaag

SEQ ID NO: 193253 - DNA, 75 bp, Artificial Sequence
  Synthetic
cctccagcagcagaaggggtgggagcagtgtctcaagacttagaaagacggggggcaattacaagcagcaatact

SEQ ID NO: 193254 - DNA, 75 bp, Artificial Sequence
  Synthetic
cagtgtctcaagacttagaaagacggggggcaattacaagcagcaatactagagccaataatcctgacttggcct

SEQ ID NO: 193255 - DNA, 75 bp, Artificial Sequence
  Synthetic
aaatcattatttaatacagtagcaaccctctattgtgtacatcaaaggatagatgtaaaagacaccaaggaagct

SEQ ID NO: 193256 - DNA, 75 bp, Artificial Sequence
  Synthetic
ggatgatttatatgtaggatctgacttagaaatagggcagcatagagcaaaaatagaggagttaagagaacatct

SEQ ID NO: 193257 - DNA, 75 bp, Artificial Sequence
  Synthetic
aaattcggttaaggccagggggaaagaaaaaatatagactaaaacatttagtatgggcaagcagggagctggaaa

SEQ ID NO: 193258 - DNA, 75 bp, Artificial Sequence
  Synthetic
gtggggatttaccacaccagacaaaaaacatcagaaagaacctccattcctttggatgggttatgaactccatcc

SEQ ID NO: 193259 - DNA, 75 bp, Artificial Sequence
  Synthetic
ggaaaaaattaggttaaggccagggggaaagaaacactatatgctaaaacacctagtatgggcaagcagggagct

SEQ ID NO: 193260 - DNA, 75 bp, Artificial Sequence
  Synthetic
gaaggacagggaaccacccttaacctccctcaaatcactctttggcagcgaccccttgtctcaataaaagtaggg

SEQ ID NO: 193261 - DNA, 75 bp, Artificial Sequence
  Synthetic
cagccataaagcaagagttttggctgaggcaatgagccaagcaacaaatagcgcaacgatctactgccagagagg

SEQ ID NO: 193262 - DNA, 75 bp, Artificial Sequence
  Synthetic
ctaataccactaatagtaataataatgataccactaagggagtgagggaggaaggagaactgaaaaactgctctt

SEQ ID NO: 193263 - DNA, 75 bp, Artificial Sequence
  Synthetic
aattaggaaaggcaggacatgttactgacaaaggaaaacaaaaaattattaccctaactgaaacaacaaaccaaa

SEQ ID NO: 193264 - DNA, 75 bp, Artificial Sequence
  Synthetic
gtttggcgcccgaacagggacccgagagacctgagaaagcacacggctgagtgaaggcagcaagggcggcagaga

SEQ ID NO: 193265 - DNA, 75 bp, Artificial Sequence
  Synthetic
ccaaccgcgacggaggaagacccggtgccagagggctgagcgggacgtgaaggtaagagaggccttcgggacaga

SEQ ID NO: 193266 - DNA, 75 bp, Artificial Sequence
  Synthetic
tagtccaaaagtttgtgtagctatagagctgttttcctaccctcaaggagggtagaagtatagcgggagatgggc

SEQ ID NO: 193267 - DNA, 75 bp, Artificial Sequence
  Synthetic
gcgagatactccgtcttgtcagggaaaaaagcagatgaattagaaaaagttaggttacggcccggcggaaagaaa

SEQ ID NO: 193268 - DNA, 75 bp, Artificial Sequence
  Synthetic
aagtatatgttaaagcatataatatgggcagcaaaagaattggacagattcggattggcagaagacctgttggaa

SEQ ID NO: 193269 - DNA, 75 bp, Artificial Sequence
  Synthetic
aacaaacaaggatgtcaaagaatattagaagttttaaccccattaatgccaacaggctcagaaaatttaaagagt

SEQ ID NO: 193270 - DNA, 75 bp, Artificial Sequence
  Synthetic
ttgtataatactgtctgcgtagtttggtgtttgcacgcagaagagaaagtgaaacacacagaggaagcaaagcag

SEQ ID NO: 193271 - DNA, 75 bp, Artificial Sequence
  Synthetic
ttggtacagagacatctagtggcagaaactaaaactgcagaaaaaataccagcaaaaagtagaccaacagctcca

SEQ ID NO: 193272 - DNA, 75 bp, Artificial Sequence
  Synthetic
cctagtggaggaaattatccagtgcagcaagtaggtggaaattatgtccacttaccattaagccccagaacttta

SEQ ID NO: 193273 - DNA, 75 bp, Artificial Sequence
  Synthetic
aatgcctgggtaaaattagtagaggaaaagaaatttggagcagaagtagtgccaggctttcaggcactgtcagaa

SEQ ID NO: 193274 - DNA, 75 bp, Artificial Sequence
  Synthetic
ggctgcacaccttatgatattaatcagatgctaaattgtgtaggggaacatcaagcggctatgcaaataattaga

SEQ ID NO: 193275 - DNA, 75 bp, Artificial Sequence
  Synthetic
gaaattatcaatgaggaagcagcagactgggacgcacagcatccaaggcagctaccggcacctccggggctgcgc

SEQ ID NO: 193276 - DNA, 75 bp, Artificial Sequence
  Synthetic
tggaaacagttgtactaatggcagctcattgcatgaattttaaaagaaggggaggaataggggatatgacccctg

SEQ ID NO: 193277 - DNA, 75 bp, Artificial Sequence
  Synthetic
gacccgtcagggtcagatatagcaggaaccaccagtactgtagaagagcaaatagagtggatgtatagacaagga

SEQ ID NO: 193278 - DNA, 75 bp, Artificial Sequence
  Synthetic
taccgacgtggaggataccaggcaggctagagaaatggcacagtctggtcaagtacctgaagcatagaacaagag

SEQ ID NO: 193279 - DNA, 75 bp, Artificial Sequence
  Synthetic
aatcctgtcccagtaggacaaatttacaggagatggattcagctaggattacaaaaatgtgtaagaatgtacaat

SEQ ID NO: 193280 - DNA, 75 bp, Artificial Sequence
  Synthetic
aactacaacaggtctcttatgttccccaccacaaggtgggatgggcctggtggacttgcagtagagtaatattcc

SEQ ID NO: 193281 - DNA, 75 bp, Artificial Sequence
  Synthetic
cccactaacattctagacgtaaagcaaggtccaaaagagccattccaagtttatgtagacaggttctacaaaagt

SEQ ID NO: 193282 - DNA, 75 bp, Artificial Sequence
  Synthetic
ggtccaaggatattggaatctgaccccggaaaggggattcttgagctcctatgctgtaagattaacatggtatga

SEQ ID NO: 193283 - DNA, 75 bp, Artificial Sequence
  Synthetic
ttgagagcagaacaaacagacccagcagtgaagaattggatgacccaaacactgctgatccaaaatgccaaccct

SEQ ID NO: 193284 - DNA, 75 bp, Artificial Sequence
  Synthetic
gattgcaaactagtattaaaaggattgggaatgaatcccaccttagaagaaatgttaacagcttgtcagggagtg

SEQ ID NO: 193285 - DNA, 75 bp, Artificial Sequence
  Synthetic
gcaactacccatcagctcacgagaggcaggtaccaagtttacagtttctagccttaagagttgtacaagaaggaa

SEQ ID NO: 193286 - DNA, 75 bp, Artificial Sequence
  Synthetic
ggaggtcctggacaaaaggctaggttaatggccgaggcaatgaaggaagcctttaatggctccttcgcggccgtg

SEQ ID NO: 193287 - DNA, 75 bp, Artificial Sequence
  Synthetic
cagatgagagggaaacaacagaagggggcatcaactattagatgctttaattgtgggaaaccaggccacactgcc

SEQ ID NO: 193288 - DNA, 75 bp, Artificial Sequence
  Synthetic
agaaattgcagggcaccaagaagaaaggggtgctggaaatgtggagaggaaggacacatgcaagcaaactgccca

SEQ ID NO: 193289 - DNA, 75 bp, Artificial Sequence
  Synthetic
aaccaacgggcgggttttttagggttaggaccatggggaaagaagcctcgcaacttccccatgagacagatgcca

SEQ ID NO: 193290 - DNA, 75 bp, Artificial Sequence
  Synthetic
gagggactgaccccatcagcccctccggacccagcagcagaaatgctcgaggagtatatgcagaaggggaaaagt

SEQ ID NO: 193291 - DNA, 75 bp, Artificial Sequence
  Synthetic
cagagggagcagagggagagaccttacaaagaggtgacggaggacttgctgcacctcagttctctctttggaaaa

SEQ ID NO: 193292 - DNA, 75 bp, Artificial Sequence
  Synthetic
gaccagtagtcacagcatatatagaggatcagccagtacaggtactgctagatacaggagctgatgactctatag

SEQ ID NO: 193293 - DNA, 75 bp, Artificial Sequence
  Synthetic
tggcagggatagaattaggacttaattacaagccaaaaatagtagggggaattggaggatttataaatacaaaag

SEQ ID NO: 193294 - DNA, 75 bp, Artificial Sequence
  Synthetic
aataccataaagtaacaattagagtattaggaaaagaaataaaagcaacattaatgactggggagactccaataa

SEQ ID NO: 193295 - DNA, 75 bp, Artificial Sequence
  Synthetic
atattttcggcagaaatatattacagctattaggaatgactttaaattgtccattggcaaaagtagagccaatac

SEQ ID NO: 193296 - DNA, 75 bp, Artificial Sequence
  Synthetic
cagtacacttaaaaccaggaatggatggccccagattaaaacagtggcccctttcaaaagaaaaaatagaagcct

SEQ ID NO: 193297 - DNA, 75 bp, Artificial Sequence
  Synthetic
ttgccagcttactagctagtgcttgcttaatatatagcaccaaaaaatatgtgactgttttctatggcgtgcccg

SEQ ID NO: 193298 - DNA, 75 bp, Artificial Sequence
  Synthetic
tgacagaaatctgccaaaaaatggagagagaaggacagctagaggaagctgcccccaacaacccatataacactc

SEQ ID NO: 193299 - DNA, 75 bp, Artificial Sequence
  Synthetic
gtgactgttttctatggcgtgcccgtgtggagaaatgcatccattcccctcttttgtgcaactaaaaacagagat

SEQ ID NO: 193300 - DNA, 75 bp, Artificial Sequence
  Synthetic
ccacttttgcaattaggaagaaggacaaaagtaaatggagaatgttaatagatttcagggagttaaataaggcca

SEQ ID NO: 193301 - DNA, 75 bp, Artificial Sequence
  Synthetic
cagacaatgatgattatcaggaaatagccttgaatgtgacagaggctttcgatgcatgggataatacagtaacag

SEQ ID NO: 193302 - DNA, 75 bp, Artificial Sequence
  Synthetic
cacagaacttcacagaagtacagttagggattccgcacccagcaggccttccagagaaaaacagaatcacagttc

SEQ ID NO: 193303 - DNA, 75 bp, Artificial Sequence
  Synthetic
tggacataggggacgcctatttttcagtacccttgtatgaaggattcaggcagtacacagcctttaccttgccag

SEQ ID NO: 193304 - DNA, 75 bp, Artificial Sequence
  Synthetic
tctatttgagacatcaataaaaccatgtgtcaaactaacacctctatgtgtagcaatgaactgtaccaacaccac

SEQ ID NO: 193305 - DNA, 75 bp, Artificial Sequence
  Synthetic
tagcaatgaactgtaccaacaccactagcaacacaaacacaccaaccccttcaaacatagaagggcccacactga

SEQ ID NO: 193306 - DNA, 75 bp, Artificial Sequence
  Synthetic
cagtaaacaacatgaggccaggtaaaaggtatgtgtataaagtattaccacaagggtggaagggatcaccagccc

SEQ ID NO: 193307 - DNA, 75 bp, Artificial Sequence
  Synthetic
taaatgaaacttctccatgcatacgaaataacagctgcacaggattgggacaggaagagatagtccagtgtcagt

SEQ ID NO: 193308 - DNA, 75 bp, Artificial Sequence
  Synthetic
tgttccaggccacaatggctacggtactggaacccttcagaaaagctaacccagatgtgattctggtacagtaca

SEQ ID NO: 193309 - DNA, 75 bp, Artificial Sequence
  Synthetic
tcgacatgacaggattagaaagggataagaaaaagcggtataatgaaacatggtattcaaaagatgtagtttgtg

SEQ ID NO: 193310 - DNA, 75 bp, Artificial Sequence
  Synthetic
tggatgacctgctgatagcaagtgataggaacacagcagaacatgatcagatggtaatgcagctaaaagacatgc

SEQ ID NO: 193311 - DNA, 75 bp, Artificial Sequence
  Synthetic
tggtattcaaaagatgtagtttgtgagaccaataatgggccaaatgagacaagcagatgctatatgaaccattgc

SEQ ID NO: 193312 - DNA, 75 bp, Artificial Sequence
  Synthetic
ttaacaagatagggtttagcacaccagaagaaaagtatcagaaagaatatccactaaagtggatggggtatgaac

SEQ ID NO: 193313 - DNA, 75 bp, Artificial Sequence
  Synthetic
tgtaccctaaaaaatggaaactgcagaaaataaccctaccaataaaggaagaatggacagttaatgatattcaga

SEQ ID NO: 193314 - DNA, 75 bp, Artificial Sequence
  Synthetic
ggctttgctttgctaagatgtaatgacaccgactattcaggcttcacgcccaactgtagcaaagtagtagtatcc

SEQ ID NO: 193315 - DNA, 75 bp, Artificial Sequence
  Synthetic
aactggtaggagttcttaattgggcagctcagatatatccaggaataaagacaaagcacctctgtagaatgatca

SEQ ID NO: 193316 - DNA, 75 bp, Artificial Sequence
  Synthetic
ggggaaaacagactctcacagaaaaggtagaatggacagagcaggcagaagcagaacatgcagagaataatatta

SEQ ID NO: 193317 - DNA, 75 bp, Artificial Sequence
  Synthetic
ttctacaacaagaacaagaggggagatactacaaggagggagagccacttgaagcaacagtggtaaaagcacgag

SEQ ID NO: 193318 - DNA, 75 bp, Artificial Sequence
  Synthetic
gtattataatttaacaatgcattgtaagaggccaggaaacaagacagttgtaccaataacactcatgtcagggtt

SEQ ID NO: 193319 - DNA, 75 bp, Artificial Sequence
  Synthetic
acacccagtggggctataaaatacaccaaggttccagaatcctaaaggtaggcaagtttgcaaaagtcaaaaata

SEQ ID NO: 193320 - DNA, 75 bp, Artificial Sequence
  Synthetic
cccacactaacgatctcagattactggccagtgtagtacagaaaataggcaaggagagcctagtaatatggggac

SEQ ID NO: 193321 - DNA, 75 bp, Artificial Sequence
  Synthetic
ataaaacatcccaggtataacggaaacagaaacataagtaaaattaaccttaaaaaaccaggagaaggctcagac

SEQ ID NO: 193322 - DNA, 75 bp, Artificial Sequence
  Synthetic
aattaccaatatttcacctaccagtagagagagaaacttgggaatcatggtggacagactattggcaagtcacgt

SEQ ID NO: 193323 - DNA, 75 bp, Artificial Sequence
  Synthetic
ggatacctgattgggattttatatccaccccaccattgataagattggtattcaatctagtaaaagaccctatac

SEQ ID NO: 193324 - DNA, 75 bp, Artificial Sequence
  Synthetic
aaggagcagaaacctactatgtagatggatcctgcaacagaaatagcaaagaaggtaaagcaggatatatcacag

SEQ ID NO: 193325 - DNA, 75 bp, Artificial Sequence
  Synthetic
atcgaggaaaagaaaaggtaaaagtgctgactgaaaccaccaatcaacaggcagagctagaagcaataaaaatgg

SEQ ID NO: 193326 - DNA, 75 bp, Artificial Sequence
  Synthetic
caactcaacagtgaccagcataattgctaacattgatgggccggataatataagccaaacaaacattaccttcag

SEQ ID NO: 193327 - DNA, 75 bp, Artificial Sequence
  Synthetic
ctttagaagactcaggagacaaagtaaatatggtcacagactcacagtatgtcataggtattttatcaggacagc

SEQ ID NO: 193328 - DNA, 75 bp, Artificial Sequence
  Synthetic
tagaagtgacaccaattggcttcgcacctacaggagaaaaaagatactcctctgctccagggagacataagagag

SEQ ID NO: 193329 - DNA, 75 bp, Artificial Sequence
  Synthetic
ctacagaatcagaatctgaactagtacaacaaattatagaaaatatgattagaaaatcagaaatttatttggcct

SEQ ID NO: 193330 - DNA, 75 bp, Artificial Sequence
  Synthetic
tctgctccagggagacataagagaggtgtgttcgtgctagggttcttaggttttctcacgacagcaggggttgca

SEQ ID NO: 193331 - DNA, 75 bp, Artificial Sequence
  Synthetic
gggtgccagcccataaaggaataggagggaatcaggaagtagacaaactagttagccaagggataagacaggtac

SEQ ID NO: 193332 - DNA, 75 bp, Artificial Sequence
  Synthetic
tgtttctagaaagcatagaaccagctcaggaagaacatgaaaaatatcacagcaatgtaaaggaattgacccata

SEQ ID NO: 193333 - DNA, 75 bp, Artificial Sequence
  Synthetic
aatttggcatcccacagctagtggcaaaacaaatagtaaatacatgtcccaaatgtcaacaaaaaggagaagcaa

SEQ ID NO: 193334 - DNA, 75 bp, Artificial Sequence
  Synthetic
aggaccaggcgcaactaaattcatggggatgtgcatttagacaagtctgccacactactgtaccatgggtaaatg

SEQ ID NO: 193335 - DNA, 75 bp, Artificial Sequence
  Synthetic
cacatgggcaagtagatgcatcagtagggacatggcagatggattgcactcatttagagggaaagatcatcatag

SEQ ID NO: 193336 - DNA, 75 bp, Artificial Sequence
  Synthetic
tagcagtccacgtggccagtggctacatagaagcagaagtaatcccacaagagacagggagacaaacagcgctct

SEQ ID NO: 193337 - DNA, 75 bp, Artificial Sequence
  Synthetic
caaatccgctacctagaggcaaatatcagtgaaagtttagaacaggcacaaatccagcaagaaaagaacatgtat

SEQ ID NO: 193338 - DNA, 75 bp, Artificial Sequence
  Synthetic
tcctattaaagttaattgccagatggccactaacccatttacatacagacaatggagcaaacttccaatctaaag

SEQ ID NO: 193339 - DNA, 75 bp, Artificial Sequence
  Synthetic
atgtttttggcaactggtttgatttgacctcctggatcaaatatattcagtatggagttctcatagtagtaggaa

SEQ ID NO: 193340 - DNA, 75 bp, Artificial Sequence
  Synthetic
aagtgcagatggtaaactggtgggcgggggtagaacactcattcggagtgccctacaacccacaaagccaaggag

SEQ ID NO: 193341 - DNA, 75 bp, Artificial Sequence
  Synthetic
tagtagctcttagaataataatatatgtagtacagctgttaggtagacttagaaggggctataggcctgttttct

SEQ ID NO: 193342 - DNA, 75 bp, Artificial Sequence
  Synthetic
ttgtagaagcaatgaatcaacatctgaaaaaacagatagatagaattagggaacaagcagaaaccgtagaaacaa

SEQ ID NO: 193343 - DNA, 75 bp, Artificial Sequence
  Synthetic
tagtactgatggcagctcattgcatgaattttaaaagaaggggaggaataggggatatgactccagcagagagga

SEQ ID NO: 193344 - DNA, 75 bp, Artificial Sequence
  Synthetic
aaggaggtggaagcgacgagggctacagatcttggccttggcagatcgaatacatccacttcctaattcgccagc

SEQ ID NO: 193345 - DNA, 75 bp, Artificial Sequence
  Synthetic
tagtaaacatgatctccacagaacaagaaatacaattccaaaattcacaaaacaaaaattttaaaaattttcggg

SEQ ID NO: 193346 - DNA, 75 bp, Artificial Sequence
  Synthetic
tctattacagagaaggaagagatcagctctggaaaggcccagcagatctcttatggaaaggagaaggagcagtca

SEQ ID NO: 193347 - DNA, 75 bp, Artificial Sequence
  Synthetic
ctctccgaccactcaggctcccgctcgcacacctccagtatgggatcagctggctccaagaagcagtccaagccg

SEQ ID NO: 193348 - DNA, 75 bp, Artificial Sequence
  Synthetic
cgcacacctccagtatgggatcagctggctccaagaagcagtccaagccgccgcgagggctgcgggagagactct

SEQ ID NO: 193349 - DNA, 75 bp, Artificial Sequence
  Synthetic
taattaaggtagggacagacataaaggttgtacccagaagaaaagcaaaagtaattaaagactatggaggaggaa

SEQ ID NO: 193350 - DNA, 75 bp, Artificial Sequence
  Synthetic
aagaggtggatagtagtgccaacatggagaattgagggaaggttggaaagatggcactctatagtgaaatattat

SEQ ID NO: 193351 - DNA, 75 bp, Artificial Sequence
  Synthetic
tacgagcgccagcaggaccatatgggaggctctcaggaggacggcgaggggaatcatcgcaatccccagaagaat

SEQ ID NO: 193352 - DNA, 75 bp, Artificial Sequence
  Synthetic
aaacataaaacaggagaggcaaaagaatggcgctacgtgccccaccacaaagtgggatgggcatggtggacagca

SEQ ID NO: 193353 - DNA, 75 bp, Artificial Sequence
  Synthetic
tcaagggtaatcatacccctattagaaggagagactctggaaatacaggcatattggaacctaacccccgagaga

SEQ ID NO: 193354 - DNA, 75 bp, Artificial Sequence
  Synthetic
gggtggctgtcacgatatgcagtcagacttacctggtataataaagatttctatacagatgttattccagatgtg

SEQ ID NO: 193355 - DNA, 75 bp, Artificial Sequence
  Synthetic
gcagagcatctagtgcatagtgcttatttctcttgctttgcagcctttgctgtgcgacaagccattagaggagaa

SEQ ID NO: 193356 - DNA, 75 bp, Artificial Sequence
  Synthetic
ggttggcgcccgaacagggacttgagaagagtgagagtcttcagggacacagctgagtgaaggcagtaagggcgg

SEQ ID NO: 193357 - DNA, 75 bp, Artificial Sequence
  Synthetic
aaggtaacatccttctgcagttatccacaagctcataaaagtcaggtacaatctttgcagtttctggccttaaag

SEQ ID NO: 193358 - DNA, 75 bp, Artificial Sequence
  Synthetic
gcttggcagaatggatcccagggaaagggcccctccaggaaacagcggggaggaaacaataggagaggccttcga

SEQ ID NO: 193359 - DNA, 75 bp, Artificial Sequence
  Synthetic
gtggctcgagacaacagtcacacaaatcaacagggaggcagtaaatcatctgcctcgagagctcattttccaggt

SEQ ID NO: 193360 - DNA, 75 bp, Artificial Sequence
  Synthetic
ctggcgaagatcctgggaatattggcataatgagcaggggatgtcacgagcttacaccaagtatagatacctact

SEQ ID NO: 193361 - DNA, 75 bp, Artificial Sequence
  Synthetic
gttgatacaaaaggccttgtttatgcactgcaaaaagggatgcaactgcaggggagaaggccatggagaaggggg

SEQ ID NO: 193362 - DNA, 75 bp, Artificial Sequence
  Synthetic
atggagatcaggaccaccacctcctcctcccccaggtctagcctaaatggctgctcctcctcaagaagaagcccc

SEQ ID NO: 193363 - DNA, 75 bp, Artificial Sequence
  Synthetic
aaaaagcctttttaatactgtctgcgtcatttggtgcttgcacgcagaacagaaagtgaaagatactgaggaagc

SEQ ID NO: 193364 - DNA, 75 bp, Artificial Sequence
  Synthetic
tcaaagagaaccatgggatgagtgggtaatagaagtactggaagatattaagcaagaagctttgaagcactttga

SEQ ID NO: 193365 - DNA, 75 bp, Artificial Sequence
  Synthetic
ccctcgcttgttgcacgctttgggtaactatatctatgataggtatggagacacccttgaaggagcaggagaact

SEQ ID NO: 193366 - DNA, 75 bp, Artificial Sequence
  Synthetic
catcagaatcttgcaaagagccctcttcttgcacttcagagcaggctgccgactctcaagaattggtgggcccag

SEQ ID NO: 193367 - DNA, 75 bp, Artificial Sequence
  Synthetic
caggatttcaggcactatcagagggatgtaccccttatgatatcaatcagatgctaaattgtgtaggagaacatc

SEQ ID NO: 193368 - DNA, 75 bp, Artificial Sequence
  Synthetic
aggacccaatcctctctcagctataccgccctctagaggcatgctataataaatgctattgcaagaagtgttgct

SEQ ID NO: 193369 - DNA, 75 bp, Artificial Sequence
  Synthetic
accattgtcagctttgtttcactaggaaaggccttggcataatatatgagcgacctagaagaagaagagttaaga

SEQ ID NO: 193370 - DNA, 75 bp, Artificial Sequence
  Synthetic
agaaggataaggttcattcacttcctgcatcagaccagtaagtatggcgtctcctggtcttcatctgcttatagg

SEQ ID NO: 193371 - DNA, 75 bp, Artificial Sequence
  Synthetic
catcttgcttttaagtgtcttacagacttggtgcggtctgtatgtaactgttttctatggagtacccgcatggaa

SEQ ID NO: 193372 - DNA, 75 bp, Artificial Sequence
  Synthetic
gaatgcgacggtacccctcttttgtgcaaccaaaaatagggacacgtggggaactacacaatgcctgcctgataa

SEQ ID NO: 193373 - DNA, 75 bp, Artificial Sequence
  Synthetic
gctatgtagatagattctacaaaagcttacgggcagaacaaacagacacggccgtgagagcatggatgacagaga

SEQ ID NO: 193374 - DNA, 75 bp, Artificial Sequence
  Synthetic
taatgattacgttgaaatcccactaaatgtgacagaagcctttgatgcttggaataacactgtaacagaacaggc

SEQ ID NO: 193375 - DNA, 75 bp, Artificial Sequence
  Synthetic
aatagaagatgtttggaacctgtttgaaacctctattaagccatgtgtaaagttgacccccttatgcgtagctat

SEQ ID NO: 193376 - DNA, 75 bp, Artificial Sequence
  Synthetic
gagatgcaacaaaactgagacagaaaaatggggtttaacaaacaagcaaaacacaaccaacacaaccagcacaac

SEQ ID NO: 193377 - DNA, 75 bp, Artificial Sequence
  Synthetic
aacaaccagcacacccaccacaacaaaggaaaaggaaattaagggcaatgaaacttgcataaatgacaataactg

SEQ ID NO: 193378 - DNA, 75 bp, Artificial Sequence
  Synthetic
cgcaggattggagacagaacccatgatagggtgtaagtttaacatgtcaggactaaaaagagatgaagaaaaaga

SEQ ID NO: 193379 - DNA, 75 bp, Artificial Sequence
  Synthetic
atacaatgaaacttggtactcccaggatttagtatgtgaccaaaactataatagcaccaatataagcagatgtta

SEQ ID NO: 193380 - DNA, 75 bp, Artificial Sequence
  Synthetic
catgaatcactgcaacacctctgtgattcaggaatcctgtgacaagcattattgggattcattaagattcaggta

SEQ ID NO: 193381 - DNA, 75 bp, Artificial Sequence
  Synthetic
tcaggaggtggtgccatctgcgcccccgatggacacagcagagagcaagacacatcagagggtgacaccatctgc

SEQ ID NO: 193382 - DNA, 75 bp, Artificial Sequence
  Synthetic
ttgtgccccacctggctttgctttacttaggtgtaatgatactagctattcaggctttcaaccaaactgctctaa

SEQ ID NO: 193383 - DNA, 75 bp, Artificial Sequence
  Synthetic
ggtagtagcttcctcttgtacaagaatgatggaaacacagacttctacctggtttggtcttaatggcactagggc

SEQ ID NO: 193384 - DNA, 75 bp, Artificial Sequence
  Synthetic
agaaaatagaacttatatatattggcatggtagagataataggactataattagcttaaataagtactataattt

SEQ ID NO: 193385 - DNA, 75 bp, Artificial Sequence
  Synthetic
aacaatgagatgtaggagaccaggaaataagacagtacggccaatcaccataatgtctggattggtctttcactc

SEQ ID NO: 193386 - DNA, 75 bp, Artificial Sequence
  Synthetic
gcaaccaattaatgagaggccaaaacaagcatggtgttggtttgaaggagaatggaaaaaggccatccaggaggt

SEQ ID NO: 193387 - DNA, 75 bp, Artificial Sequence
  Synthetic
gaaagacaccttagcaacacatcccagatatactggcacaaatgatacaaaaaagataaatctagtggccccaga

SEQ ID NO: 193388 - DNA, 75 bp, Artificial Sequence
  Synthetic
aggaggggacccggaagttaccttcatgtggacaaattgcagaggagaatttttatattgtaaaatgaattggtt

SEQ ID NO: 193389 - DNA, 75 bp, Artificial Sequence
  Synthetic
cctaaattgggtagaagacagaaatataactcatggaagatggagtactcaaaaaccagcagagaaacagaagag

SEQ ID NO: 193390 - DNA, 75 bp, Artificial Sequence
  Synthetic
caacacacccaccttcgctgtaaggaaaaaggacaaaaacaaatggagaatgctaatagacttcagggaattaaa

SEQ ID NO: 193391 - DNA, 75 bp, Artificial Sequence
  Synthetic
gaactatgtgccttgccacataaggcaaatcataaatacttggcacaaagtagggaaaaatgtgtacctgcctcc

SEQ ID NO: 193392 - DNA, 75 bp, Artificial Sequence
  Synthetic
aagagaaggtaatctaacgtgtaactcatcagtaacaagcataattgcaaacatagactggataagcgacaatga

SEQ ID NO: 193393 - DNA, 75 bp, Artificial Sequence
  Synthetic
aactaatatcaccatgagtgcagaagtggcagaactgtatcgattagagttgggcgattataaattagtagagat

SEQ ID NO: 193394 - DNA, 75 bp, Artificial Sequence
  Synthetic
tacttcagtgtcccactagatccagacttcagacaatatacagcattcactttgccatcaataaataatgcagag

SEQ ID NO: 193395 - DNA, 75 bp, Artificial Sequence
  Synthetic
aacaccaattggcttggccccgacaagtgtaaaaagatattcctcagcaacaccgaggaataagagaggggtctt

SEQ ID NO: 193396 - DNA, 75 bp, Artificial Sequence
  Synthetic
tgtgctagggttcttgggatttctcgcaacggcaggttctgcaatgggcgcagcgtcgctgacgctgacagctca

SEQ ID NO: 193397 - DNA, 75 bp, Artificial Sequence
  Synthetic
gtctcggactttactggctgggatagtgcagcaacagcagcagctgttggatgcagtcaagagacaacaagaatt

SEQ ID NO: 193398 - DNA, 75 bp, Artificial Sequence
  Synthetic
gttgcgattgacagtctggggaactaaaaacctccagacacgcgtcactgccatcgagaaatacctaaaggatca

SEQ ID NO: 193399 - DNA, 75 bp, Artificial Sequence
  Synthetic
ggcacagctaaattcatgggggtgtgcatttagacaggtctgccatactactgtaccatggccaaatgacacatt

SEQ ID NO: 193400 - DNA, 75 bp, Artificial Sequence
  Synthetic
gcaaccaaattgggacaacatgacttggcaagagtgggaaagaaaagtagactttctcacagaaaacatcacaga

SEQ ID NO: 193401 - DNA, 75 bp, Artificial Sequence
  Synthetic
actcttggagcaggcacagattcaacaagaaaagaatatgtatgaactacaaaaattgaacagctgggatgtgtt

SEQ ID NO: 193402 - DNA, 75 bp, Artificial Sequence
  Synthetic
tggcaattggtttgacctcagctcctggatcacctacatacaatatggagtatacttagtagtaggagtaatagg

SEQ ID NO: 193403 - DNA, 75 bp, Artificial Sequence
  Synthetic
gagggatcctactacaaagaaggagtacctctagaagcaacagtgcagaaaaacttagcaaaccagtggacatac

SEQ ID NO: 193404 - DNA, 75 bp, Artificial Sequence
  Synthetic
acttagaataagtatctatatagtacaaatgctattaaggcttagggagggctataggcccgtgttctcttcccc

SEQ ID NO: 193405 - DNA, 75 bp, Artificial Sequence
  Synthetic
caaaaacacccacaccaatggagtaagaatactagcacatgtaatccaaaaaataggaaaagaagcactggttat

SEQ ID NO: 193406 - DNA, 75 bp, Artificial Sequence
  Synthetic
accctcttatcgccagcagatccatatccgacgggaccaggaactgccagacggagaagacagagaagaagacgg

SEQ ID NO: 193407 - DNA, 75 bp, Artificial Sequence
  Synthetic
tggagaaaaaggtggcaacagatcctggccctggcagatagagtacattcatttcctgatccgccagttgattcg

SEQ ID NO: 193408 - DNA, 75 bp, Artificial Sequence
  Synthetic
cctcttgacttggctgtacagcaactgcagagacttaatatacaggagcttccagaccctccaccagctgaccca

SEQ ID NO: 193409 - DNA, 75 bp, Artificial Sequence
  Synthetic
gtggatcctcaggagaatcagtgcagcagcaacagcaactagagactttatcagaacagaagccagttacatcag

SEQ ID NO: 193410 - DNA, 75 bp, Artificial Sequence
  Synthetic
ctatgggtggcaatacttcctcgaagccctccaagcggcgatgcgggctgcgggagagactcttgcaagcgcggg

SEQ ID NO: 193411 - DNA, 75 bp, Artificial Sequence
  Synthetic
gggagaattatgggcaactctgggaaggattggaagagggctactcgcagtcccgaggagaattaggcaagggct

SEQ ID NO: 193412 - DNA, 75 bp, Artificial Sequence
  Synthetic
cgagctcgcgcttaactagggaaatacagggacaagcatataatcaaggagagttcatgaacactccttggaaaa

SEQ ID NO: 193413 - DNA, 75 bp, Artificial Sequence
  Synthetic
acccagctcaaaagaaggaaagaaagcaatataggcagcaaaacaatgatgatgtggatgatgataatgatgact

SEQ ID NO: 193414 - DNA, 75 bp, Artificial Sequence
  Synthetic
tagtaggagtaccagtatggcctagagcccccttaagggctatgacttataaattggcaataaatatgtcacatt

SEQ ID NO: 193415 - DNA, 75 bp, Artificial Sequence
  Synthetic
gaaccagcacaagaagaacatgaaaaatatcatggcaatgtaaaagagctggttcataaatttggaattccacaa

SEQ ID NO: 193416 - DNA, 75 bp, Artificial Sequence
  Synthetic
ggttggcgcccgaacagggacttgaagaggactgagaagccctggaacacggctgagtgaaggcagtaagggcgg

SEQ ID NO: 193417 - DNA, 75 bp, Artificial Sequence
  Synthetic
ctagagcccccttaagggctatgacttataaattggcaataaatatgtcacattttataaaagaaaaggggggac

SEQ ID NO: 193418 - DNA, 75 bp, Artificial Sequence
  Synthetic
ggctgagtgaaggcagtaagggcggcaggaacaaaccacgacggagtgctcctagaaaggcgcgggccgaggtac

SEQ ID NO: 193419 - DNA, 75 bp, Artificial Sequence
  Synthetic
ttcggattagcagagagcctgttggagtcaaaagaaggttgccaaagaattcttacagttttaaatccattaata

SEQ ID NO: 193420 - DNA, 75 bp, Artificial Sequence
  Synthetic
tcagggagtagtagaagcaatgaaccatcatctaaaaaatcaaatagataggatcagagatcaggcagtatcaat

SEQ ID NO: 193421 - DNA, 75 bp, Artificial Sequence
  Synthetic
gcctttttaatacagtctgcgtcatttggtgcttgcacgcagaagagaaagtgaaagatactgaagaagcaaaaa

SEQ ID NO: 193422 - DNA, 75 bp, Artificial Sequence
  Synthetic
ttggtgcttgcacgcagaagagaaagtgaaagatactgaagaagcaaaaaagctagtacagagacatctagtggc

SEQ ID NO: 193423 - DNA, 75 bp, Artificial Sequence
  Synthetic
cacctagtgggaaaggaggaaacttccccgtacaacaagtaggcggcaactatgtccatgtgccgctgagccccc

SEQ ID NO: 193424 - DNA, 75 bp, Artificial Sequence
  Synthetic
gaaccctaaatgcttgggtaaaattagtggaggaaaagaagttcggggcagaagtagtgccaggatttcaggcac

SEQ ID NO: 193425 - DNA, 75 bp, Artificial Sequence
  Synthetic
gaagtagtgccaggatttcaggcactctcagaaggctgcacgccctatgatatcaatcaaatgcttaattgtgtg

SEQ ID NO: 193426 - DNA, 75 bp, Artificial Sequence
  Synthetic
ggcgatcaccaagcagctatgcaaataatcagagaaattatcaatgaggaagcagcagaatgggatgcacagcac

SEQ ID NO: 193427 - DNA, 75 bp, Artificial Sequence
  Synthetic
tgacatagcaggaacaacaagcacagtagaagaacagctccagtggatgtataggcagccaaatcccgtgccggt

SEQ ID NO: 193428 - DNA, 75 bp, Artificial Sequence
  Synthetic
aacagacccggcagtgaagaactggatgacccaaacgctgctaatacagaatgctaacccagactgcaagttagt

SEQ ID NO: 193429 - DNA, 75 bp, Artificial Sequence
  Synthetic
atgacccaaacgctgctaatacagaatgctaacccagactgcaagttagtactaaaaggtctggggatgggtccc

SEQ ID NO: 193430 - DNA, 75 bp, Artificial Sequence
  Synthetic
ccttaagagttgtacaagaaggaaaaaatggatccaagggagagggtgccaccaggaaacagcgacgaagagaca

SEQ ID NO: 193431 - DNA, 75 bp, Artificial Sequence
  Synthetic
accctagaggagatgctgactgcctgtcagggagtaggtggaccaggccaaaaagccagactaatggccgaagcc

SEQ ID NO: 193432 - DNA, 75 bp, Artificial Sequence
  Synthetic
aaaagccagactaatggccgaagccctgaaggaggctttgacaccagcccctatcccatttgcagcagcccaaca

SEQ ID NO: 193433 - DNA, 75 bp, Artificial Sequence
  Synthetic
aagaaaggcatttaagtgttggaactgtggaaaagaaggacactcggcgagacagtgccgagcacccagaaggca

SEQ ID NO: 193434 - DNA, 75 bp, Artificial Sequence
  Synthetic
gggctgctggaaatgtggcaagcaaggacacatcatgtcaaactgcccagaaagacaggcaggttttttagggat

SEQ ID NO: 193435 - DNA, 75 bp, Artificial Sequence
  Synthetic
aagtccacggggaaagaagcctcgcaacttccccgtggcccaagctcctcagggactgataccaacagcaccccc

SEQ ID NO: 193436 - DNA, 75 bp, Artificial Sequence
  Synthetic
aacttccccgtggcccaagctcctcagggactgataccaacagcacccccagcagatccagcaatggacctgttg

SEQ ID NO: 193437 - DNA, 75 bp, Artificial Sequence
  Synthetic
gaacccacagagagggccatgggaagagtgggtagaggacatcctggaggagctaaagcaagaagccttaaaaca

SEQ ID NO: 193438 - DNA, 75 bp, Artificial Sequence
  Synthetic
ggcagagggagcagagggagagaccatacaaagaggtgacagaggacttactgcacctcgagcaaggagagacac

SEQ ID NO: 193439 - DNA, 75 bp, Artificial Sequence
  Synthetic
ctcacagagaggcgacaaaggacttgctgcacctcaattctctctttggagaagaccagtagtcacagcatatat

SEQ ID NO: 193440 - DNA, 75 bp, Artificial Sequence
  Synthetic
tgaggatcagccagtagaagtcttactagacacaggggctgatgattcaatagtagcaggaatagagttagggaa

SEQ ID NO: 193441 - DNA, 75 bp, Artificial Sequence
  Synthetic
caattacactccaaaaatagtagggggaataggaggattcataaataccaaagaatataaaaatgtagaaataga

SEQ ID NO: 193442 - DNA, 75 bp, Artificial Sequence
  Synthetic
aagaatataaaaatgtagaaatagaagtactaaataaaagagtaagagccaccataatgacaggagataccccaa

SEQ ID NO: 193443 - DNA, 75 bp, Artificial Sequence
  Synthetic
agtactaaataaaagagtaagagccaccataatgacaggagataccccaatcaacatctttggcagaaatatcct

SEQ ID NO: 193444 - DNA, 75 bp, Artificial Sequence
  Synthetic
caaaaaaggctaagactgctacatcttctgcatcagacaagtgagtaagatgtgtggtaagaatttactatttgt

SEQ ID NO: 193445 - DNA, 75 bp, Artificial Sequence
  Synthetic
tcaacatctttggcagaaatatcctggcggccttaggcatgtcattaaatttaccaatcgccaagatagaaccaa

SEQ ID NO: 193446 - DNA, 75 bp, Artificial Sequence
  Synthetic
agatggtccaaggctaaaacaatggcccctaacaaaagaaaaaatagaggcactaaaagaaatctgtgaaaaaat

SEQ ID NO: 193447 - DNA, 75 bp, Artificial Sequence
  Synthetic
gcacctccaactaatccttataatacccccacatttgcaattaagaaaaaggacaagaacaagtggaggatgcta

SEQ ID NO: 193448 - DNA, 75 bp, Artificial Sequence
  Synthetic
atgcatgggataatacagtaacagaacaagcagtagaggatgtctggaatctatttgagacatcaataaaaccat

SEQ ID NO: 193449 - DNA, 75 bp, Artificial Sequence
  Synthetic
tgactcaagatttcacagaaattcagctaggaattccacacccggcagggttagccaaaaagaaaaggatcactg

SEQ ID NO: 193450 - DNA, 75 bp, Artificial Sequence
  Synthetic
tactagatgtaggggatgcctatttttccataccactgtatgaagattttaggcagtatactgcatttaccctac

SEQ ID NO: 193451 - DNA, 75 bp, Artificial Sequence
  Synthetic
aaaaagatatatatataaagtcttgccacaaggatggaagggatcaccagcaatttttcaacacacaatgaggca

SEQ ID NO: 193452 - DNA, 75 bp, Artificial Sequence
  Synthetic
tgacatgataggattagagagggataagaaaaaacggtataatgaaacatggtactcaaaagatgtggtgtgtgg

SEQ ID NO: 193453 - DNA, 75 bp, Artificial Sequence
  Synthetic
acatggatgatattttaatagctagtgacaggacaggtttagagcatgacaaggtagtcctacagctaaaagagc

SEQ ID NO: 193454 - DNA, 75 bp, Artificial Sequence
  Synthetic
ttctgaatggcctagggttctctaccccagatgaaaagttccaaaaagaccctccgtttcaatggatgggctatg

SEQ ID NO: 193455 - DNA, 75 bp, Artificial Sequence
  Synthetic
aactatggccaaataaatggaagctacagaaaatacaattgcctcagaaagaagtatggacagtcaatgacattc

SEQ ID NO: 193456 - DNA, 75 bp, Artificial Sequence
  Synthetic
tacatggtttggcttcaatggtacaagggcagaaaacaggacatatatgtattggcatggtagagataataggac

SEQ ID NO: 193457 - DNA, 75 bp, Artificial Sequence
  Synthetic
aaaagctagtgggagtcttaaattgggcagcacaaatctatccaggaataaaaaccaaacatttatgtagactaa

SEQ ID NO: 193458 - DNA, 75 bp, Artificial Sequence
  Synthetic
tcagaggaaaaatgacactcacagaagaagtacagtggacagagttagcagaagcagagctagaagaaaacaaaa

SEQ ID NO: 193459 - DNA, 75 bp, Artificial Sequence
  Synthetic
gaagcagagctagaagaaaacaaaattatcttaagccaggaacaagaagggtgctattaccaagaagaaaaagaa

SEQ ID NO: 193460 - DNA, 75 bp, Artificial Sequence
  Synthetic
ttagaggcaacagtccaaaagagtcaagacaatcagtggacatacaaaatacaccaggaagagaaaatcctaaaa

SEQ ID NO: 193461 - DNA, 75 bp, Artificial Sequence
  Synthetic
gaggtgaagcaaaccctcataaaacattccaggtatacaggaaccaaaaacataagtttagttaactttacaaaa

SEQ ID NO: 193462 - DNA, 75 bp, Artificial Sequence
  Synthetic
acaccaggaagagaaaatcctaaaagtagggaaatatgcaaagataaaaaatacccataccaatggggtcagatt

SEQ ID NO: 193463 - DNA, 75 bp, Artificial Sequence
  Synthetic
ccaggagaaggctcagacccagaagtggcatacatgtggactaactgcagaggagaatttctctactgcaacatg

SEQ ID NO: 193464 - DNA, 75 bp, Artificial Sequence
  Synthetic
tggtgggataactactggcaagtaacatggatcccagagtgggactttgtatctaccccgccactggtcaggcta

SEQ ID NO: 193465 - DNA, 75 bp, Artificial Sequence
  Synthetic
acattcaacctggtaggagatcctataccagatgcagaaaccttctacacagatggatcatgcaacaggcagtca

SEQ ID NO: 193466 - DNA, 75 bp, Artificial Sequence
  Synthetic
acagtgaccagcataattgccaacattgattggagagataatagtagccaagcaaacatcaccttcagtgcagag

SEQ ID NO: 193467 - DNA, 75 bp, Artificial Sequence
  Synthetic
agatggatcatgcaacaggcagtcaaaagaaggaaaagcaggatatgtgacagataaagggagagacagggtaaa

SEQ ID NO: 193468 - DNA, 75 bp, Artificial Sequence
  Synthetic
agtgttagaacaaactaccaatcagcaagcagaattagaagcctttgcaatggcgttggcagactcaggtacaaa

SEQ ID NO: 193469 - DNA, 75 bp, Artificial Sequence
  Synthetic
gacaccaattggcttcgcacctacaggagaaaaaagatactcctctccagggagacacaaaagagatgtgctcgt

SEQ ID NO: 193470 - DNA, 75 bp, Artificial Sequence
  Synthetic
ggttaatatcatagtagactcacaatatgtaatgggaatagtggcaagccaaccaacagaatcagaaagtagaat

SEQ ID NO: 193471 - DNA, 75 bp, Artificial Sequence
  Synthetic
gctagggttcttgggttttctcacgacagcaggagttgcaatgggcgcggcgtccttgacgctgtcggctcagtc

SEQ ID NO: 193472 - DNA, 75 bp, Artificial Sequence
  Synthetic
ttagtgagtcagggaattagacagatattattcatagaaaagatagagccggctcaagaagaacatgaaaaatat

SEQ ID NO: 193473 - DNA, 75 bp, Artificial Sequence
  Synthetic
catagcaacataaaagaactaacccataaatttggaataccccagctagtagcaagacagatagtaaacacatgt

SEQ ID NO: 193474 - DNA, 75 bp, Artificial Sequence
  Synthetic
ccccaatgtcaacaaaaaggagaggccatacatgggcaagtaaatgcagaaataggtgtctggcaaatggattgc

SEQ ID NO: 193475 - DNA, 75 bp, Artificial Sequence
  Synthetic
gaaaagaacatgtatgaattacaaaaactaaatagctgggatgtttttggcaactggtttgatttgacctcctgg

SEQ ID NO: 193476 - DNA, 75 bp, Artificial Sequence
  Synthetic
gacaatggctccaacttcacttcacaggaagtgaagatggtggcatggtgggtaggtatagagcaatcctttgga

SEQ ID NO: 193477 - DNA, 75 bp, Artificial Sequence
  Synthetic
ataggcctgttttctcctcccctcccggttatctccaacagatccgtatccacaagggtcgggaacagccagcca

SEQ ID NO: 193478 - DNA, 75 bp, Artificial Sequence
  Synthetic
gtaccctacaaccctcaaagccagggagtagtagaagcaatgaaccatcacctaaagaatcagataagtagaatt

SEQ ID NO: 193479 - DNA, 75 bp, Artificial Sequence
  Synthetic
acaagaaatacaattcctccaaagaaaaaattcaaattttaaaaatttccaggtctattacagggaaggcagaga

SEQ ID NO: 193480 - DNA, 75 bp, Artificial Sequence
  Synthetic
cctggagggtgccagggaggatggagaaatggcatagccttgtcaagtacctgaaatatagaacaaaagatctag

SEQ ID NO: 193481 - DNA, 75 bp, Artificial Sequence
  Synthetic
caaggtgggatgggcatggtggacttgcagcagggtaatattccctctagaaggaaaaagtcatctagagataca

SEQ ID NO: 193482 - DNA, 75 bp, Artificial Sequence
  Synthetic
ctaataagccactgagagcaatgacacatagattggcaatagacatgtctcattttataaaagaaaaggggggac

SEQ ID NO: 193483 - DNA, 75 bp, Artificial Sequence
  Synthetic
taagaataacctggtacacagaaaggttctggacagatgttaccccagactatgcagacatcctaatacatagca

SEQ ID NO: 193484 - DNA, 75 bp, Artificial Sequence
  Synthetic
cttatttctcttgctttacggcaggtgaagtaagaagagccatcagaggggaaaagttattgtcctgctgcaact

SEQ ID NO: 193485 - DNA, 75 bp, Artificial Sequence
  Synthetic
cccagagaaagggtacctccaggaaacagtggagaagagaccattggagaggccttcgagtggctagacaggact

SEQ ID NO: 193486 - DNA, 75 bp, Artificial Sequence
  Synthetic
agatactggcatgatgagcaagggatgtcaccaagctacacaaagtatagatatttgtgcctaatgcagaaagct

SEQ ID NO: 193487 - DNA, 75 bp, Artificial Sequence
  Synthetic
atatttgtgcctaatgcagaaagctgtattcatacacttcatgagagggtgcacttgcctgggggagggacacgg

SEQ ID NO: 193488 - DNA, 75 bp, Artificial Sequence
  Synthetic
gccgggaggatggagaccaggacctccccctcctccccctccaggtctagtctaatgactgaagcaccaacagag

SEQ ID NO: 193489 - DNA, 75 bp, Artificial Sequence
  Synthetic
ccccctcctccccctccaggtctagtctaatgactgaagcaccaacagagtttcccccagaagatgggaccccgc

SEQ ID NO: 193490 - DNA, 75 bp, Artificial Sequence
  Synthetic
tctaatgactgaagcaccaacagagtttcccccagaagatgggaccccgcagagggaactagggggtgactggat

SEQ ID NO: 193491 - DNA, 75 bp, Artificial Sequence
  Synthetic
agagggaactagggggtgactggataataagaattctagaggaaataagagaagaagccttaaagcattttggac

SEQ ID NO: 193492 - DNA, 75 bp, Artificial Sequence
  Synthetic
gaagaagccttaaagcattttggaccccgcccgctaatcgctcttggcaactatatctatgctagacatggagac

SEQ ID NO: 193493 - DNA, 75 bp, Artificial Sequence
  Synthetic
acgcttgaaggcgcaagaaagctcgttgatatcttacagcgagtcctcttcctgcacttcaaagcaggatgcagc

SEQ ID NO: 193494 - DNA, 75 bp, Artificial Sequence
  Synthetic
cctgcacttcaaagcaggatgcagccgaccaaaggttaatcagacaaggggaggaacttctttaccagttgcacc

SEQ ID NO: 193495 - DNA, 75 bp, Artificial Sequence
  Synthetic
gacccctagaaacatgcaataacaaatgttactgtaagcagtgctgttaccattgccagctgtgctttttaaaca

SEQ ID NO: 193496 - DNA, 75 bp, Artificial Sequence
  Synthetic
atgttactgtaagcagtgctgttaccattgccagctgtgctttttaaacaaggggctcgggatatggtatgaccg

SEQ ID NO: 193497 - DNA, 75 bp, Artificial Sequence
  Synthetic
aaagggcagacggagaagaactcctaagaaaactaaggctcatccgtcttctgcatcagacaagtgagtaaaatg

SEQ ID NO: 193498 - DNA, 75 bp, Artificial Sequence
  Synthetic
tgtggtaagattttattaattgttgccagcttgctagctagtgcttgcttagtatattgcaaaaaacaacaatat

SEQ ID NO: 193499 - DNA, 75 bp, Artificial Sequence
  Synthetic
aacaggcaatagaagatgtctggagcctatttgagacatcaataaaaccatgcgtcaaactaacacctctatgtg

SEQ ID NO: 193500 - DNA, 75 bp, Artificial Sequence
  Synthetic
caacccaaccacaccagcaggcacaacaaagtccttcccaaccccaggagagaataaaaccataaatgaaaatga

SEQ ID NO: 193501 - DNA, 75 bp, Artificial Sequence
  Synthetic
tacatgcatacgcgaaaacaactgtacaggattgggggaggaagagatggtcaactgtcagttcaatatgacagg

SEQ ID NO: 193502 - DNA, 75 bp, Artificial Sequence
  Synthetic
actgatcaggggaaagatgaccctgacagaagaggtgcagtggacagaactagcagaggcagagatgcaggaaaa

SEQ ID NO: 193503 - DNA, 75 bp, Artificial Sequence
  Synthetic
acagaagaggtgcagtggacagaactagcagaggcagagatgcaggaaaacaaaatcatcctggaacaggaacaa

SEQ ID NO: 193504 - DNA, 75 bp, Artificial Sequence
  Synthetic
attagagagggacaagacaaaacggtataatgaaacatggtactcaagagatgtagtttgtgaaccaaataatca

SEQ ID NO: 193505 - DNA, 75 bp, Artificial Sequence
  Synthetic
atgtagtttgtgaaccaaataatcagaccgcagatgggaaagaaaaatgttacatgaaccattgcaacacatcag

SEQ ID NO: 193506 - DNA, 75 bp, Artificial Sequence
  Synthetic
tcatcaaagaatcatgtgataagcactattgggatactataagatttagatattgtgcaccaccgggttatgccc

SEQ ID NO: 193507 - DNA, 75 bp, Artificial Sequence
  Synthetic
tactaagatgcaatgataccaattattcaggcttcgcgccaaattgctctaaggtagtagtttcttcatgcacaa

SEQ ID NO: 193508 - DNA, 75 bp, Artificial Sequence
  Synthetic
ttcaggcttcgcgccaaattgctctaaggtagtagtttcttcatgcacaaggatgatggagacgcaaacctccac

SEQ ID NO: 193509 - DNA, 75 bp, Artificial Sequence
  Synthetic
tgtcacagacaggggaagagacaaggttaaaccattagagcagacaacaaaccaacaagcagaacttgaagcatt

SEQ ID NO: 193510 - DNA, 75 bp, Artificial Sequence
  Synthetic
catcagcttaaacaagtattataatctttctatacattgtaagaggccaggaaacaagacagttatgccaataac

SEQ ID NO: 193511 - DNA, 75 bp, Artificial Sequence
  Synthetic
actcctttcaggggcaaggtttcactcccagccagtaattaatacaaaacctaagcaagcatggtgctggttcaa

SEQ ID NO: 193512 - DNA, 75 bp, Artificial Sequence
  Synthetic
ccacaagtcaatatcatagtagattcacagtatgtcatggggataatagctggacagccaacagaaacagagtca

SEQ ID NO: 193513 - DNA, 75 bp, Artificial Sequence
  Synthetic
aggcgagtggaaaaaggccttggaggaggtgaaagaaacccttaaagaacatcccaggtatagaggacccaatga

SEQ ID NO: 193514 - DNA, 75 bp, Artificial Sequence
  Synthetic
gaggtgaaagaaacccttaaagaacatcccaggtatagaggacccaatgacacaaagcaaattcgctttataaaa

SEQ ID NO: 193515 - DNA, 75 bp, Artificial Sequence
  Synthetic
gattggttcctcaattgggtaggagaaagtaaaggtaaagtgcgcaattatgtgccgtgccatataagtcaaata

SEQ ID NO: 193516 - DNA, 75 bp, Artificial Sequence
  Synthetic
attagaacctggcacaaggtagggataaatgtatatttgcctcctagggaaggagagttggtctgcaactcaacg

SEQ ID NO: 193517 - DNA, 75 bp, Artificial Sequence
  Synthetic
gtgaccagcataattgccaacattgacatgggtaaaaactcaacaaatattacctttagtgcagaggtggcagaa

SEQ ID NO: 193518 - DNA, 75 bp, Artificial Sequence
  Synthetic
tggttttgcacctacatcacaaaaaagatactcctctactccggggagaaataaaagaggtgtactcgtgctagg

SEQ ID NO: 193519 - DNA, 75 bp, Artificial Sequence
  Synthetic
caagtctgccacactactgtaccatgggtaaatgacagcttgtcacctgattgggataacatgacatggcaacaa

SEQ ID NO: 193520 - DNA, 75 bp, Artificial Sequence
  Synthetic
tgggaacaccaaatcagtttcctagaggcaaatatcagtgaaaaattagaacaagcacaaatcctacaagaaaag

SEQ ID NO: 193521 - DNA, 75 bp, Artificial Sequence
  Synthetic
cccgaacagggacctggaagagtgagagtcttcaggagcacagctgagtgaaggcagtaagggcggcaggaatca

SEQ ID NO: 193522 - DNA, 75 bp, Artificial Sequence
  Synthetic
tatattcagtatggagtttttatagtaatagcagtaatagctcttagaatagtaatatatgtagtacagatgtta

SEQ ID NO: 193523 - DNA, 75 bp, Artificial Sequence
  Synthetic
aggagcgggaggaaaagaggcctccgggagtagggtaagtactccaaattttgcattgtctgctctaaagaggag

SEQ ID NO: 193524 - DNA, 75 bp, Artificial Sequence
  Synthetic
ctgttttctcttccccccccggttacttccaacagatccatatccacaaggactgggaacagccagacagagaag

SEQ ID NO: 193525 - DNA, 75 bp, Artificial Sequence
  Synthetic
gagaagctccgtcctgtcagggaagaaaacagatgaattagaaaaagttaggttacggcccggcggaaagaaaag

SEQ ID NO: 193526 - DNA, 75 bp, Artificial Sequence
  Synthetic
gaacagaagaagacgctggagacaacgttggagacagcttgtggccttggccgataagatatattcatttcctga

SEQ ID NO: 193527 - DNA, 75 bp, Artificial Sequence
  Synthetic
gtatatgttgaaacatgtaatatgggcagtgaacgaattagatagatttggattagcagagaccctgttggaatc

SEQ ID NO: 193528 - DNA, 75 bp, Artificial Sequence
  Synthetic
gcagtgaacgaattagatagatttggattagcagagaccctgttggaatcaaaagaaggatgccaaaaaattctt

SEQ ID NO: 193529 - DNA, 75 bp, Artificial Sequence
  Synthetic
tccgccagctgattcgcctcttgaccaggctatacgagatctgcaggagcttactatccaggatcttccagaccc

SEQ ID NO: 193530 - DNA, 75 bp, Artificial Sequence
  Synthetic
ttactatccaggatcttccagaccctccaactgatcagagactggctgagagttaaaacagcacacctgcaatat

SEQ ID NO: 193531 - DNA, 75 bp, Artificial Sequence
  Synthetic
caggatcagaaaatttaaaaagcctttttaatactgtctgcgtcattttctgcctgcacgcagaagagaaagtga

SEQ ID NO: 193532 - DNA, 75 bp, Artificial Sequence
  Synthetic
tgcctgcacgcagaagagaaagtgaaagatacagaggaggcaaaaaagatagcacagcgacacctagcggacgca

SEQ ID NO: 193533 - DNA, 75 bp, Artificial Sequence
  Synthetic
gggtgcgagtggatccaagaagcgttccaagctttcgcaaggactgcgagagagactcttgcgggcgcgtggggg

SEQ ID NO: 193534 - DNA, 75 bp, Artificial Sequence
  Synthetic
gaattctggactgccttgcggcgcttcgggaggggaatacttgcagtcccaagaaggatcagacagggggcagag

SEQ ID NO: 193535 - DNA, 75 bp, Artificial Sequence
  Synthetic
gaaaaaatgacagctacaaataaaccaacagcaccacctagcggcggaaattatccagtgcagcaaatagctggc

SEQ ID NO: 193536 - DNA, 75 bp, Artificial Sequence
  Synthetic
atcgccctcctgtgagggacagcggtatcagcagggagagtacatgaataccccatggagaaccccgggattaga

SEQ ID NO: 193537 - DNA, 75 bp, Artificial Sequence
  Synthetic
aactatgtccacgtgccgctaagcccccgaaccttaaatgcttgggtaaaattagtagaagaaaagaagttcggg

SEQ ID NO: 193538 - DNA, 75 bp, Artificial Sequence
  Synthetic
agaacaggaaaaggcatacaagcagcagaatatggatgatgtagatgcagatgatgatgatctagtagggtttcc

SEQ ID NO: 193539 - DNA, 75 bp, Artificial Sequence
  Synthetic
tgttacaagtagagtaccaatgagaacaatgacctataaattggcagtagacatgtcacattttataaaagaaaa

SEQ ID NO: 193540 - DNA, 75 bp, Artificial Sequence
  Synthetic
gtagagtaccaatgagaacaatgacctataaattggcagtagacatgtcacattttataaaagaaaaagggggac

SEQ ID NO: 193541 - DNA, 75 bp, Artificial Sequence
  Synthetic
aaagaggcctccgggtgaaggtaagtacctacaccaaaaactgtagccagaaaaggcttgttatcctacctttag

SEQ ID NO: 193542 - DNA, 75 bp, Artificial Sequence
  Synthetic
tgaagcagcagactgggaccaacaacacccgtcaccaggcccactgccggcaggacagcttagagacccaagggg

SEQ ID NO: 193543 - DNA, 75 bp, Artificial Sequence
  Synthetic
acagtagaggaacagatacagtggatgtacaggggccaaaatcctatcccagtgggaaacatttatagaagatgg

SEQ ID NO: 193544 - DNA, 75 bp, Artificial Sequence
  Synthetic
agtgggaaacatttatagaagatggattcaaatagggttgcagaaatgtgtccggatgtacaatcctaccaacat

SEQ ID NO: 193545 - DNA, 75 bp, Artificial Sequence
  Synthetic
agggaacatctacaggagatggatccagatagggctacaaaagtgtgtcaggatgtacaacccaactaacatcct

SEQ ID NO: 193546 - DNA, 75 bp, Artificial Sequence
  Synthetic
gattctacaaaagcttacgggcagagcaaacagacccagcagtgaaaagttggatgacacaaacactactggttc

SEQ ID NO: 193547 - DNA, 75 bp, Artificial Sequence
  Synthetic
agacataaaacagggaccaaaggaaccgttccagagctatgtagacaggttctataaaagcttgagggcagaaca

SEQ ID NO: 193548 - DNA, 75 bp, Artificial Sequence
  Synthetic
agaatgctaacccagattgcaagttagtacttaagggcttgggaatgaatcccaccttagaagaaatgctgacgg

SEQ ID NO: 193549 - DNA, 75 bp, Artificial Sequence
  Synthetic
cctgccaaggaataggaggcccagggcagaaggcaaagctaatggccgaggccttaaaagaggctttaacaccgg

SEQ ID NO: 193550 - DNA, 75 bp, Artificial Sequence
  Synthetic
cacccataccgtttgctgcctttcaacagaaaacagggaagagagggacagtgacatgctggaactgtggcaaag

SEQ ID NO: 193551 - DNA, 75 bp, Artificial Sequence
  Synthetic
gtgacatgctggaactgtggcaaagggggacacacagccagacagtgcaaggcccctagaagacagggatgctgg

SEQ ID NO: 193552 - DNA, 75 bp, Artificial Sequence
  Synthetic
tccagcagtggagatgctgaaaagctacatgcagatggggaaacaacagagagagagccgagagagaccctacaa

SEQ ID NO: 193553 - DNA, 75 bp, Artificial Sequence
  Synthetic
ctcaattctctctttggagaagaccagtagtcagagcatgtatcgagggtcagccagtagaagtattactagaca

SEQ ID NO: 193554 - DNA, 75 bp, Artificial Sequence
  Synthetic
ctcaattctctctttggagaagaccagtagtcagtgcatgtatcgagggtcagccagtagaagtattactagaca

SEQ ID NO: 193555 - DNA, 75 bp, Artificial Sequence
  Synthetic
ctcaattctctctttggagaagaccagtagtcagcgcatgtatcgagggtcagccagtagaagtattactagaca

SEQ ID NO: 193556 - DNA, 75 bp, Artificial Sequence
  Synthetic
ctcaattctctctttggagaagaccagtagtcagggcatgtatcgagggtcagccagtagaagtattactagaca

SEQ ID NO: 193557 - DNA, 75 bp, Artificial Sequence
  Synthetic
atagattttagagaactaaacagggtgactcaagatttcacagaaattcagctaggaattccacacccggcaggg

SEQ ID NO: 193558 - DNA, 75 bp, Artificial Sequence
  Synthetic
caaagatgtagaaatagaagtagtgggaaaaacagtaagggcaactataatgacaggagacaccccaataaacat

SEQ ID NO: 193559 - DNA, 75 bp, Artificial Sequence
  Synthetic
tgacaggagacaccccaataaacatttttggcagaaatattttaaatactttaggcatgactctaaatttcccag

SEQ ID NO: 193560 - DNA, 75 bp, Artificial Sequence
  Synthetic
tgacaggagacaccccaataaacatttttggcagaaatattttaaatacttttggcatgactctaaatttcccag

SEQ ID NO: 193561 - DNA, 75 bp, Artificial Sequence
  Synthetic
tgacaggagacaccccaataaacatttttggcagaaatattttaaatactttcggcatgactctaaatttcccag

SEQ ID NO: 193562 - DNA, 75 bp, Artificial Sequence
  Synthetic
tgacaggagacaccccaataaacatttttggcagaaatattttaaatactttgggcatgactctaaatttcccag

SEQ ID NO: 193563 - DNA, 75 bp, Artificial Sequence
  Synthetic
ttgggcatgactctaaatttcccagtggcaaagctagaaccagtaaaagttgagtttaaacctggaaaagatgga

SEQ ID NO: 193564 - DNA, 75 bp, Artificial Sequence
  Synthetic
ttgggcatgactctaaatttcccagtggcaaagctagaaccagtaaaagttgagtttaaacctggaaaagatggt

SEQ ID NO: 193565 - DNA, 75 bp, Artificial Sequence
  Synthetic
ttgggcatgactctaaatttcccagtggcaaagctagaaccagtaaaagttgagtttaaacctggaaaagatggc

SEQ ID NO: 193566 - DNA, 75 bp, Artificial Sequence
  Synthetic
ttgggcatgactctaaatttcccagtggcaaagctagaaccagtaaaagttgagtttaaacctggaaaagatggg

SEQ ID NO: 193567 - DNA, 75 bp, Artificial Sequence
  Synthetic
ttgggcatgactctaaatttcccagtggcaaagctagaaccagtaaaagttgagtttaaacctggaaatgatgga

SEQ ID NO: 193568 - DNA, 75 bp, Artificial Sequence
  Synthetic
ttgggcatgactctaaatttcccagtggcaaagctagaaccagtaaaagttgagtttaaacctggaaatgatggt

SEQ ID NO: 193569 - DNA, 75 bp, Artificial Sequence
  Synthetic
ttgggcatgactctaaatttcccagtggcaaagctagaaccagtaaaagttgagtttaaacctggaaatgatggc

SEQ ID NO: 193570 - DNA, 75 bp, Artificial Sequence
  Synthetic
ttgggcatgactctaaatttcccagtggcaaagctagaaccagtaaaagttgagtttaaacctggaaatgatggg

SEQ ID NO: 193571 - DNA, 75 bp, Artificial Sequence
  Synthetic
ttgggcatgactctaaatttcccagtggcaaagctagaaccagtaaaagttgagtttaaacctggaaacgatgga

SEQ ID NO: 193572 - DNA, 75 bp, Artificial Sequence
  Synthetic
ttgggcatgactctaaatttcccagtggcaaagctagaaccagtaaaagttgagtttaaacctggaaacgatggt

SEQ ID NO: 193573 - DNA, 75 bp, Artificial Sequence
  Synthetic
ttgggcatgactctaaatttcccagtggcaaagctagaaccagtaaaagttgagtttaaacctggaaacgatggc

SEQ ID NO: 193574 - DNA, 75 bp, Artificial Sequence
  Synthetic
ttgggcatgactctaaatttcccagtggcaaagctagaaccagtaaaagttgagtttaaacctggaaacgatggg

SEQ ID NO: 193575 - DNA, 75 bp, Artificial Sequence
  Synthetic
ttgggcatgactctaaatttcccagtggcaaagctagaaccagtaaaagttgagtttaaacctggaaaggatgga

SEQ ID NO: 193576 - DNA, 75 bp, Artificial Sequence
  Synthetic
ttgggcatgactctaaatttcccagtggcaaagctagaaccagtaaaagttgagtttaaacctggaaaggatggt

SEQ ID NO: 193577 - DNA, 75 bp, Artificial Sequence
  Synthetic
ttgggcatgactctaaatttcccagtggcaaagctagaaccagtaaaagttgagtttaaacctggaaaggatggc

SEQ ID NO: 193578 - DNA, 75 bp, Artificial Sequence
  Synthetic
ttgggcatgactctaaatttcccagtggcaaagctagaaccagtaaaagttgagtttaaacctggaaaggatggg

SEQ ID NO: 193579 - DNA, 75 bp, Artificial Sequence
  Synthetic
ttgggcatgactctaaatttcccagtggcaatgctagaaccagtaaaagttgagtttaaacctggaaaagatgga

SEQ ID NO: 193580 - DNA, 75 bp, Artificial Sequence
  Synthetic
ttgggcatgactctaaatttcccagtggcaatgctagaaccagtaaaagttgagtttaaacctggaaaagatggt

SEQ ID NO: 193581 - DNA, 75 bp, Artificial Sequence
  Synthetic
ttgggcatgactctaaatttcccagtggcaatgctagaaccagtaaaagttgagtttaaacctggaaaagatggc

SEQ ID NO: 193582 - DNA, 75 bp, Artificial Sequence
  Synthetic
ttgggcatgactctaaatttcccagtggcaatgctagaaccagtaaaagttgagtttaaacctggaaaagatggg

SEQ ID NO: 193583 - DNA, 75 bp, Artificial Sequence
  Synthetic
ttgggcatgactctaaatttcccagtggcaatgctagaaccagtaaaagttgagtttaaacctggaaatgatgga

SEQ ID NO: 193584 - DNA, 75 bp, Artificial Sequence
  Synthetic
ttgggcatgactctaaatttcccagtggcaatgctagaaccagtaaaagttgagtttaaacctggaaatgatggt

SEQ ID NO: 193585 - DNA, 75 bp, Artificial Sequence
  Synthetic
ttgggcatgactctaaatttcccagtggcaatgctagaaccagtaaaagttgagtttaaacctggaaatgatggc

SEQ ID NO: 193586 - DNA, 75 bp, Artificial Sequence
  Synthetic
ttgggcatgactctaaatttcccagtggcaatgctagaaccagtaaaagttgagtttaaacctggaaatgatggg

SEQ ID NO: 193587 - DNA, 75 bp, Artificial Sequence
  Synthetic
ttgggcatgactctaaatttcccagtggcaatgctagaaccagtaaaagttgagtttaaacctggaaacgatgga

SEQ ID NO: 193588 - DNA, 75 bp, Artificial Sequence
  Synthetic
ttgggcatgactctaaatttcccagtggcaatgctagaaccagtaaaagttgagtttaaacctggaaacgatggt

SEQ ID NO: 193589 - DNA, 75 bp, Artificial Sequence
  Synthetic
ttgggcatgactctaaatttcccagtggcaatgctagaaccagtaaaagttgagtttaaacctggaaacgatggc

SEQ ID NO: 193590 - DNA, 75 bp, Artificial Sequence
  Synthetic
ttgggcatgactctaaatttcccagtggcaatgctagaaccagtaaaagttgagtttaaacctggaaacgatggg

SEQ ID NO: 193591 - DNA, 75 bp, Artificial Sequence
  Synthetic
ttgggcatgactctaaatttcccagtggcaatgctagaaccagtaaaagttgagtttaaacctggaaaggatgga

SEQ ID NO: 193592 - DNA, 75 bp, Artificial Sequence
  Synthetic
ttgggcatgactctaaatttcccagtggcaatgctagaaccagtaaaagttgagtttaaacctggaaaggatggt

SEQ ID NO: 193593 - DNA, 75 bp, Artificial Sequence
  Synthetic
ttgggcatgactctaaatttcccagtggcaatgctagaaccagtaaaagttgagtttaaacctggaaaggatggc

SEQ ID NO: 193594 - DNA, 75 bp, Artificial Sequence
  Synthetic
ttgggcatgactctaaatttcccagtggcaatgctagaaccagtaaaagttgagtttaaacctggaaaggatggg

SEQ ID NO: 193595 - DNA, 75 bp, Artificial Sequence
  Synthetic
ttgggcatgactctaaatttcccagtggcaacgctagaaccagtaaaagttgagtttaaacctggaaaagatgga

SEQ ID NO: 193596 - DNA, 75 bp, Artificial Sequence
  Synthetic
ttgggcatgactctaaatttcccagtggcaacgctagaaccagtaaaagttgagtttaaacctggaaaagatggt

SEQ ID NO: 193597 - DNA, 75 bp, Artificial Sequence
  Synthetic
ttgggcatgactctaaatttcccagtggcaacgctagaaccagtaaaagttgagtttaaacctggaaaagatggc

SEQ ID NO: 193598 - DNA, 75 bp, Artificial Sequence
  Synthetic
ttgggcatgactctaaatttcccagtggcaacgctagaaccagtaaaagttgagtttaaacctggaaaagatggg

SEQ ID NO: 193599 - DNA, 75 bp, Artificial Sequence
  Synthetic
ttgggcatgactctaaatttcccagtggcaacgctagaaccagtaaaagttgagtttaaacctggaaatgatgga

SEQ ID NO: 193600 - DNA, 75 bp, Artificial Sequence
  Synthetic
ttgggcatgactctaaatttcccagtggcaacgctagaaccagtaaaagttgagtttaaacctggaaatgatggt

SEQ ID NO: 193601 - DNA, 75 bp, Artificial Sequence
  Synthetic
ttgggcatgactctaaatttcccagtggcaacgctagaaccagtaaaagttgagtttaaacctggaaatgatggc

SEQ ID NO: 193602 - DNA, 75 bp, Artificial Sequence
  Synthetic
ttgggcatgactctaaatttcccagtggcaacgctagaaccagtaaaagttgagtttaaacctggaaatgatggg

SEQ ID NO: 193603 - DNA, 75 bp, Artificial Sequence
  Synthetic
ttgggcatgactctaaatttcccagtggcaacgctagaaccagtaaaagttgagtttaaacctggaaacgatgga

SEQ ID NO: 193604 - DNA, 75 bp, Artificial Sequence
  Synthetic
ttgggcatgactctaaatttcccagtggcaacgctagaaccagtaaaagttgagtttaaacctggaaacgatggt

SEQ ID NO: 193605 - DNA, 75 bp, Artificial Sequence
  Synthetic
ttgggcatgactctaaatttcccagtggcaacgctagaaccagtaaaagttgagtttaaacctggaaacgatggc

SEQ ID NO: 193606 - DNA, 75 bp, Artificial Sequence
  Synthetic
ttgggcatgactctaaatttcccagtggcaacgctagaaccagtaaaagttgagtttaaacctggaaacgatggg

SEQ ID NO: 193607 - DNA, 75 bp, Artificial Sequence
  Synthetic
ttgggcatgactctaaatttcccagtggcaacgctagaaccagtaaaagttgagtttaaacctggaaaggatgga

SEQ ID NO: 193608 - DNA, 75 bp, Artificial Sequence
  Synthetic
ttgggcatgactctaaatttcccagtggcaacgctagaaccagtaaaagttgagtttaaacctggaaaggatggt

SEQ ID NO: 193609 - DNA, 75 bp, Artificial Sequence
  Synthetic
ttgggcatgactctaaatttcccagtggcaacgctagaaccagtaaaagttgagtttaaacctggaaaggatggc

SEQ ID NO: 193610 - DNA, 75 bp, Artificial Sequence
  Synthetic
ttgggcatgactctaaatttcccagtggcaacgctagaaccagtaaaagttgagtttaaacctggaaaggatggg

SEQ ID NO: 193611 - DNA, 75 bp, Artificial Sequence
  Synthetic
ttgggcatgactctaaatttcccagtggcaaggctagaaccagtaaaagttgagtttaaacctggaaaagatgga

SEQ ID NO: 193612 - DNA, 75 bp, Artificial Sequence
  Synthetic
ttgggcatgactctaaatttcccagtggcaaggctagaaccagtaaaagttgagtttaaacctggaaaagatggt

SEQ ID NO: 193613 - DNA, 75 bp, Artificial Sequence
  Synthetic
ttgggcatgactctaaatttcccagtggcaaggctagaaccagtaaaagttgagtttaaacctggaaaagatggc

SEQ ID NO: 193614 - DNA, 75 bp, Artificial Sequence
  Synthetic
ttgggcatgactctaaatttcccagtggcaaggctagaaccagtaaaagttgagtttaaacctggaaaagatggg

SEQ ID NO: 193615 - DNA, 75 bp, Artificial Sequence
  Synthetic
ttgggcatgactctaaatttcccagtggcaaggctagaaccagtaaaagttgagtttaaacctggaaatgatgga

SEQ ID NO: 193616 - DNA, 75 bp, Artificial Sequence
  Synthetic
ttgggcatgactctaaatttcccagtggcaaggctagaaccagtaaaagttgagtttaaacctggaaatgatggt

SEQ ID NO: 193617 - DNA, 75 bp, Artificial Sequence
  Synthetic
ttgggcatgactctaaatttcccagtggcaaggctagaaccagtaaaagttgagtttaaacctggaaatgatggc

SEQ ID NO: 193618 - DNA, 75 bp, Artificial Sequence
  Synthetic
ttgggcatgactctaaatttcccagtggcaaggctagaaccagtaaaagttgagtttaaacctggaaatgatggg

SEQ ID NO: 193619 - DNA, 75 bp, Artificial Sequence
  Synthetic
ttgggcatgactctaaatttcccagtggcaaggctagaaccagtaaaagttgagtttaaacctggaaacgatgga

SEQ ID NO: 193620 - DNA, 75 bp, Artificial Sequence
  Synthetic
ttgggcatgactctaaatttcccagtggcaaggctagaaccagtaaaagttgagtttaaacctggaaacgatggt

SEQ ID NO: 193621 - DNA, 75 bp, Artificial Sequence
  Synthetic
ttgggcatgactctaaatttcccagtggcaaggctagaaccagtaaaagttgagtttaaacctggaaacgatggc

SEQ ID NO: 193622 - DNA, 75 bp, Artificial Sequence
  Synthetic
ttgggcatgactctaaatttcccagtggcaaggctagaaccagtaaaagttgagtttaaacctggaaacgatggg

SEQ ID NO: 193623 - DNA, 75 bp, Artificial Sequence
  Synthetic
ttgggcatgactctaaatttcccagtggcaaggctagaaccagtaaaagttgagtttaaacctggaaaggatgga

SEQ ID NO: 193624 - DNA, 75 bp, Artificial Sequence
  Synthetic
ttgggcatgactctaaatttcccagtggcaaggctagaaccagtaaaagttgagtttaaacctggaaaggatggt

SEQ ID NO: 193625 - DNA, 75 bp, Artificial Sequence
  Synthetic
ttgggcatgactctaaatttcccagtggcaaggctagaaccagtaaaagttgagtttaaacctggaaaggatggc

SEQ ID NO: 193626 - DNA, 75 bp, Artificial Sequence
  Synthetic
ttgggcatgactctaaatttcccagtggcaaggctagaaccagtaaaagttgagtttaaacctggaaaggatggg

SEQ ID NO: 193627 - DNA, 75 bp, Artificial Sequence
  Synthetic
ccaaagatcagacaatggcctctatccagggaaaagatactagccctaaaagaaatctgtgaaaaaatggaaaag

SEQ ID NO: 193628 - DNA, 75 bp, Artificial Sequence
  Synthetic
ccaaagatcagacaatggcctctatccagggaaaagatactagccctaaaagaaatctgtgaaaaaatggataag

SEQ ID NO: 193629 - DNA, 75 bp, Artificial Sequence
  Synthetic
ccaaagatcagacaatggcctctatccagggaaaagatactagccctaaaagaaatctgtgaaaaaatggacaag

SEQ ID NO: 193630 - DNA, 75 bp, Artificial Sequence
  Synthetic
ccaaagatcagacaatggcctctatccagggaaaagatactagccctaaaagaaatctgtgaaaaaatggagaag

SEQ ID NO: 193631 - DNA, 75 bp, Artificial Sequence
  Synthetic
ccaaagatcagacaatggcctctatccagggaaaagatactagcccttaaagaaatctgtgaaaaaatggaaaag

SEQ ID NO: 193632 - DNA, 75 bp, Artificial Sequence
  Synthetic
ccaaagatcagacaatggcctctatccagggaaaagatactagcccttaaagaaatctgtgaaaaaatggataag

SEQ ID NO: 193633 - DNA, 75 bp, Artificial Sequence
  Synthetic
ccaaagatcagacaatggcctctatccagggaaaagatactagcccttaaagaaatctgtgaaaaaatggacaag

SEQ ID NO: 193634 - DNA, 75 bp, Artificial Sequence
  Synthetic
ccaaagatcagacaatggcctctatccagggaaaagatactagcccttaaagaaatctgtgaaaaaatggagaag

SEQ ID NO: 193635 - DNA, 75 bp, Artificial Sequence
  Synthetic
ccaaagatcagacaatggcctctatccagggaaaagatactagccctcaaagaaatctgtgaaaaaatggaaaag

SEQ ID NO: 193636 - DNA, 75 bp, Artificial Sequence
  Synthetic
ccaaagatcagacaatggcctctatccagggaaaagatactagccctcaaagaaatctgtgaaaaaatggataag

SEQ ID NO: 193637 - DNA, 75 bp, Artificial Sequence
  Synthetic
ccaaagatcagacaatggcctctatccagggaaaagatactagccctcaaagaaatctgtgaaaaaatggacaag

SEQ ID NO: 193638 - DNA, 75 bp, Artificial Sequence
  Synthetic
ccaaagatcagacaatggcctctatccagggaaaagatactagccctcaaagaaatctgtgaaaaaatggagaag

SEQ ID NO: 193639 - DNA, 75 bp, Artificial Sequence
  Synthetic
ccaaagatcagacaatggcctctatccagggaaaagatactagccctgaaagaaatctgtgaaaaaatggaaaag

SEQ ID NO: 193640 - DNA, 75 bp, Artificial Sequence
  Synthetic
ccaaagatcagacaatggcctctatccagggaaaagatactagccctgaaagaaatctgtgaaaaaatggataag

SEQ ID NO: 193641 - DNA, 75 bp, Artificial Sequence
  Synthetic
ccaaagatcagacaatggcctctatccagggaaaagatactagccctgaaagaaatctgtgaaaaaatggacaag

SEQ ID NO: 193642 - DNA, 75 bp, Artificial Sequence
  Synthetic
ccaaagatcagacaatggcctctatccagggaaaagatactagccctgaaagaaatctgtgaaaaaatggagaag

SEQ ID NO: 193643 - DNA, 75 bp, Artificial Sequence
  Synthetic
ccaaagatcagacaatggcctctatccagggataagatactagccctaaaagaaatctgtgaaaaaatggaaaag

SEQ ID NO: 193644 - DNA, 75 bp, Artificial Sequence
  Synthetic
ccaaagatcagacaatggcctctatccagggataagatactagccctaaaagaaatctgtgaaaaaatggataag

SEQ ID NO: 193645 - DNA, 75 bp, Artificial Sequence
  Synthetic
ccaaagatcagacaatggcctctatccagggataagatactagccctaaaagaaatctgtgaaaaaatggacaag

SEQ ID NO: 193646 - DNA, 75 bp, Artificial Sequence
  Synthetic
ccaaagatcagacaatggcctctatccagggataagatactagccctaaaagaaatctgtgaaaaaatggagaag

SEQ ID NO: 193647 - DNA, 75 bp, Artificial Sequence
  Synthetic
ccaaagatcagacaatggcctctatccagggataagatactagcccttaaagaaatctgtgaaaaaatggaaaag

SEQ ID NO: 193648 - DNA, 75 bp, Artificial Sequence
  Synthetic
ccaaagatcagacaatggcctctatccagggataagatactagcccttaaagaaatctgtgaaaaaatggataag

SEQ ID NO: 193649 - DNA, 75 bp, Artificial Sequence
  Synthetic
ccaaagatcagacaatggcctctatccagggataagatactagcccttaaagaaatctgtgaaaaaatggacaag

SEQ ID NO: 193650 - DNA, 75 bp, Artificial Sequence
  Synthetic
ccaaagatcagacaatggcctctatccagggataagatactagcccttaaagaaatctgtgaaaaaatggagaag

SEQ ID NO: 193651 - DNA, 75 bp, Artificial Sequence
  Synthetic
ccaaagatcagacaatggcctctatccagggataagatactagccctcaaagaaatctgtgaaaaaatggaaaag

SEQ ID NO: 193652 - DNA, 75 bp, Artificial Sequence
  Synthetic
ccaaagatcagacaatggcctctatccagggataagatactagccctcaaagaaatctgtgaaaaaatggataag

SEQ ID NO: 193653 - DNA, 75 bp, Artificial Sequence
  Synthetic
ccaaagatcagacaatggcctctatccagggataagatactagccctcaaagaaatctgtgaaaaaatggacaag

SEQ ID NO: 193654 - DNA, 75 bp, Artificial Sequence
  Synthetic
ccaaagatcagacaatggcctctatccagggataagatactagccctcaaagaaatctgtgaaaaaatggagaag

SEQ ID NO: 193655 - DNA, 75 bp, Artificial Sequence
  Synthetic
ccaaagatcagacaatggcctctatccagggataagatactagccctgaaagaaatctgtgaaaaaatggaaaag

SEQ ID NO: 193656 - DNA, 75 bp, Artificial Sequence
  Synthetic
ccaaagatcagacaatggcctctatccagggataagatactagccctgaaagaaatctgtgaaaaaatggataag

SEQ ID NO: 193657 - DNA, 75 bp, Artificial Sequence
  Synthetic
ccaaagatcagacaatggcctctatccagggataagatactagccctgaaagaaatctgtgaaaaaatggacaag

SEQ ID NO: 193658 - DNA, 75 bp, Artificial Sequence
  Synthetic
ccaaagatcagacaatggcctctatccagggataagatactagccctgaaagaaatctgtgaaaaaatggagaag

SEQ ID NO: 193659 - DNA, 75 bp, Artificial Sequence
  Synthetic
ccaaagatcagacaatggcctctatccagggacaagatactagccctaaaagaaatctgtgaaaaaatggaaaag

SEQ ID NO: 193660 - DNA, 75 bp, Artificial Sequence
  Synthetic
ccaaagatcagacaatggcctctatccagggacaagatactagccctaaaagaaatctgtgaaaaaatggataag

SEQ ID NO: 193661 - DNA, 75 bp, Artificial Sequence
  Synthetic
ccaaagatcagacaatggcctctatccagggacaagatactagccctaaaagaaatctgtgaaaaaatggacaag

SEQ ID NO: 193662 - DNA, 75 bp, Artificial Sequence
  Synthetic
ccaaagatcagacaatggcctctatccagggacaagatactagccctaaaagaaatctgtgaaaaaatggagaag

SEQ ID NO: 193663 - DNA, 75 bp, Artificial Sequence
  Synthetic
ccaaagatcagacaatggcctctatccagggacaagatactagcccttaaagaaatctgtgaaaaaatggaaaag

SEQ ID NO: 193664 - DNA, 75 bp, Artificial Sequence
  Synthetic
ccaaagatcagacaatggcctctatccagggacaagatactagcccttaaagaaatctgtgaaaaaatggataag

SEQ ID NO: 193665 - DNA, 75 bp, Artificial Sequence
  Synthetic
ccaaagatcagacaatggcctctatccagggacaagatactagcccttaaagaaatctgtgaaaaaatggacaag

SEQ ID NO: 193666 - DNA, 75 bp, Artificial Sequence
  Synthetic
ccaaagatcagacaatggcctctatccagggacaagatactagcccttaaagaaatctgtgaaaaaatggagaag

SEQ ID NO: 193667 - DNA, 75 bp, Artificial Sequence
  Synthetic
ccaaagatcagacaatggcctctatccagggacaagatactagccctcaaagaaatctgtgaaaaaatggaaaag

SEQ ID NO: 193668 - DNA, 75 bp, Artificial Sequence
  Synthetic
ccaaagatcagacaatggcctctatccagggacaagatactagccctcaaagaaatctgtgaaaaaatggataag

SEQ ID NO: 193669 - DNA, 75 bp, Artificial Sequence
  Synthetic
ccaaagatcagacaatggcctctatccagggacaagatactagccctcaaagaaatctgtgaaaaaatggacaag

SEQ ID NO: 193670 - DNA, 75 bp, Artificial Sequence
  Synthetic
ccaaagatcagacaatggcctctatccagggacaagatactagccctcaaagaaatctgtgaaaaaatggagaag

SEQ ID NO: 193671 - DNA, 75 bp, Artificial Sequence
  Synthetic
ccaaagatcagacaatggcctctatccagggacaagatactagccctgaaagaaatctgtgaaaaaatggaaaag

SEQ ID NO: 193672 - DNA, 75 bp, Artificial Sequence
  Synthetic
ccaaagatcagacaatggcctctatccagggacaagatactagccctgaaagaaatctgtgaaaaaatggataag

SEQ ID NO: 193673 - DNA, 75 bp, Artificial Sequence
  Synthetic
ccaaagatcagacaatggcctctatccagggacaagatactagccctgaaagaaatctgtgaaaaaatggacaag

SEQ ID NO: 193674 - DNA, 75 bp, Artificial Sequence
  Synthetic
ccaaagatcagacaatggcctctatccagggacaagatactagccctgaaagaaatctgtgaaaaaatggagaag

SEQ ID NO: 193675 - DNA, 75 bp, Artificial Sequence
  Synthetic
ccaaagatcagacaatggcctctatccagggagaagatactagccctaaaagaaatctgtgaaaaaatggaaaag

SEQ ID NO: 193676 - DNA, 75 bp, Artificial Sequence
  Synthetic
ccaaagatcagacaatggcctctatccagggagaagatactagccctaaaagaaatctgtgaaaaaatggataag

SEQ ID NO: 193677 - DNA, 75 bp, Artificial Sequence
  Synthetic
ccaaagatcagacaatggcctctatccagggagaagatactagccctaaaagaaatctgtgaaaaaatggacaag

SEQ ID NO: 193678 - DNA, 75 bp, Artificial Sequence
  Synthetic
ccaaagatcagacaatggcctctatccagggagaagatactagccctaaaagaaatctgtgaaaaaatggagaag

SEQ ID NO: 193679 - DNA, 75 bp, Artificial Sequence
  Synthetic
ccaaagatcagacaatggcctctatccagggagaagatactagcccttaaagaaatctgtgaaaaaatggaaaag

SEQ ID NO: 193680 - DNA, 75 bp, Artificial Sequence
  Synthetic
ccaaagatcagacaatggcctctatccagggagaagatactagcccttaaagaaatctgtgaaaaaatggataag

SEQ ID NO: 193681 - DNA, 75 bp, Artificial Sequence
  Synthetic
ccaaagatcagacaatggcctctatccagggagaagatactagcccttaaagaaatctgtgaaaaaatggacaag

SEQ ID NO: 193682 - DNA, 75 bp, Artificial Sequence
  Synthetic
ccaaagatcagacaatggcctctatccagggagaagatactagcccttaaagaaatctgtgaaaaaatggagaag

SEQ ID NO: 193683 - DNA, 75 bp, Artificial Sequence
  Synthetic
ccaaagatcagacaatggcctctatccagggagaagatactagccctcaaagaaatctgtgaaaaaatggaaaag

SEQ ID NO: 193684 - DNA, 75 bp, Artificial Sequence
  Synthetic
ccaaagatcagacaatggcctctatccagggagaagatactagccctcaaagaaatctgtgaaaaaatggataag

SEQ ID NO: 193685 - DNA, 75 bp, Artificial Sequence
  Synthetic
ccaaagatcagacaatggcctctatccagggagaagatactagccctcaaagaaatctgtgaaaaaatggacaag

SEQ ID NO: 193686 - DNA, 75 bp, Artificial Sequence
  Synthetic
ccaaagatcagacaatggcctctatccagggagaagatactagccctcaaagaaatctgtgaaaaaatggagaag

SEQ ID NO: 193687 - DNA, 75 bp, Artificial Sequence
  Synthetic
ccaaagatcagacaatggcctctatccagggagaagatactagccctgaaagaaatctgtgaaaaaatggaaaag

SEQ ID NO: 193688 - DNA, 75 bp, Artificial Sequence
  Synthetic
ccaaagatcagacaatggcctctatccagggagaagatactagccctgaaagaaatctgtgaaaaaatggataag

SEQ ID NO: 193689 - DNA, 75 bp, Artificial Sequence
  Synthetic
ccaaagatcagacaatggcctctatccagggagaagatactagccctgaaagaaatctgtgaaaaaatggacaag

SEQ ID NO: 193690 - DNA, 75 bp, Artificial Sequence
  Synthetic
ccaaagatcagacaatggcctctatccagggagaagatactagccctgaaagaaatctgtgaaaaaatggagaag

SEQ ID NO: 193691 - DNA, 75 bp, Artificial Sequence
  Synthetic
gaggggcaattagaagaagcaccccctactaatccatacaacacacccacctttgccataaagaagaaagacaaa

SEQ ID NO: 193692 - DNA, 75 bp, Artificial Sequence
  Synthetic
ctactaatccatacaacacacccacctttgccataaagaagaaagacaaaaacaaatggagaatgctaatagact

SEQ ID NO: 193693 - DNA, 75 bp, Artificial Sequence
  Synthetic
aacaaatggagaatgctaatagactttagagaattaaacaaggtaacccaggacttcacagaagtccaattgggt

SEQ ID NO: 193694 - DNA, 75 bp, Artificial Sequence
  Synthetic
aacaaatggagaatgctaatagactttagagaattaaacaaggtaacccaggacttcacagaagtccatttgggt

SEQ ID NO: 193695 - DNA, 75 bp, Artificial Sequence
  Synthetic
aacaaatggagaatgctaatagactttagagaattaaacaaggtaacccaggacttcacagaagtccacttgggt

SEQ ID NO: 193696 - DNA, 75 bp, Artificial Sequence
  Synthetic
aacaaatggagaatgctaatagactttagagaattaaacaaggtaacccaggacttcacagaagtccagttgggt

SEQ ID NO: 193697 - DNA, 75 bp, Artificial Sequence
  Synthetic
aacaaatggagaatgctaatagactttagtgaattaaacaaggtaacccaggacttcacagaagtccaattgggt

SEQ ID NO: 193698 - DNA, 75 bp, Artificial Sequence
  Synthetic
aacaaatggagaatgctaatagactttagtgaattaaacaaggtaacccaggacttcacagaagtccatttgggt

SEQ ID NO: 193699 - DNA, 75 bp, Artificial Sequence
  Synthetic
aacaaatggagaatgctaatagactttagtgaattaaacaaggtaacccaggacttcacagaagtccacttgggt

SEQ ID NO: 193700 - DNA, 75 bp, Artificial Sequence
  Synthetic
aacaaatggagaatgctaatagactttagtgaattaaacaaggtaacccaggacttcacagaagtccagttgggt

SEQ ID NO: 193701 - DNA, 75 bp, Artificial Sequence
  Synthetic
aacaaatggagaatgctaatagactttagcgaattaaacaaggtaacccaggacttcacagaagtccaattgggt

SEQ ID NO: 193702 - DNA, 75 bp, Artificial Sequence
  Synthetic
aacaaatggagaatgctaatagactttagcgaattaaacaaggtaacccaggacttcacagaagtccatttgggt

SEQ ID NO: 193703 - DNA, 75 bp, Artificial Sequence
  Synthetic
aacaaatggagaatgctaatagactttagcgaattaaacaaggtaacccaggacttcacagaagtccacttgggt

SEQ ID NO: 193704 - DNA, 75 bp, Artificial Sequence
  Synthetic
aacaaatggagaatgctaatagactttagcgaattaaacaaggtaacccaggacttcacagaagtccagttgggt

SEQ ID NO: 193705 - DNA, 75 bp, Artificial Sequence
  Synthetic
aacaaatggagaatgctaatagactttagggaattaaacaaggtaacccaggacttcacagaagtccaattgggt

SEQ ID NO: 193706 - DNA, 75 bp, Artificial Sequence
  Synthetic
aacaaatggagaatgctaatagactttagggaattaaacaaggtaacccaggacttcacagaagtccatttgggt

SEQ ID NO: 193707 - DNA, 75 bp, Artificial Sequence
  Synthetic
aacaaatggagaatgctaatagactttagggaattaaacaaggtaacccaggacttcacagaagtccacttgggt

SEQ ID NO: 193708 - DNA, 75 bp, Artificial Sequence
  Synthetic
aacaaatggagaatgctaatagactttagggaattaaacaaggtaacccaggacttcacagaagtccagttgggt

SEQ ID NO: 193709 - DNA, 75 bp, Artificial Sequence
  Synthetic
atacccataccaatggggtcagattactagcacaggtagttcagaaaataggaaaagaagcactagtcatctggg

SEQ ID NO: 193710 - DNA, 75 bp, Artificial Sequence
  Synthetic
atcccccacccggcagggttggcagaaagaaggagaataacagtaatagatgtgggagacgcctacttcagtatc

SEQ ID NO: 193711 - DNA, 75 bp, Artificial Sequence
  Synthetic
ccactagatccaaaattcagacagtatacagcattcaccttgccatcaacaaacaaaacagagccaggaaagaga

SEQ ID NO: 193712 - DNA, 75 bp, Artificial Sequence
  Synthetic
ccactagatccaaaattcagacagtatacagcattcaccttgccatcaacaaacaatacagagccaggaaagaga

SEQ ID NO: 193713 - DNA, 75 bp, Artificial Sequence
  Synthetic
ccactagatccaaaattcagacagtatacagcattcaccttgccatcaacaaacaacacagagccaggaaagaga

SEQ ID NO: 193714 - DNA, 75 bp, Artificial Sequence
  Synthetic
ccactagatccaaaattcagacagtatacagcattcaccttgccatcaacaaacaagacagagccaggaaagaga

SEQ ID NO: 193715 - DNA, 75 bp, Artificial Sequence
  Synthetic
ccactagatccaaatttcagacagtatacagcattcaccttgccatcaacaaacaaaacagagccaggaaagaga

SEQ ID NO: 193716 - DNA, 75 bp, Artificial Sequence
  Synthetic
ccactagatccaaatttcagacagtatacagcattcaccttgccatcaacaaacaatacagagccaggaaagaga

SEQ ID NO: 193717 - DNA, 75 bp, Artificial Sequence
  Synthetic
ccactagatccaaatttcagacagtatacagcattcaccttgccatcaacaaacaacacagagccaggaaagaga

SEQ ID NO: 193718 - DNA, 75 bp, Artificial Sequence
  Synthetic
ccactagatccaaatttcagacagtatacagcattcaccttgccatcaacaaacaagacagagccaggaaagaga

SEQ ID NO: 193719 - DNA, 75 bp, Artificial Sequence
  Synthetic
ccactagatccaaacttcagacagtatacagcattcaccttgccatcaacaaacaaaacagagccaggaaagaga

SEQ ID NO: 193720 - DNA, 75 bp, Artificial Sequence
  Synthetic
ccactagatccaaacttcagacagtatacagcattcaccttgccatcaacaaacaatacagagccaggaaagaga

SEQ ID NO: 193721 - DNA, 75 bp, Artificial Sequence
  Synthetic
ccactagatccaaacttcagacagtatacagcattcaccttgccatcaacaaacaacacagagccaggaaagaga

SEQ ID NO: 193722 - DNA, 75 bp, Artificial Sequence
  Synthetic
ccactagatccaaacttcagacagtatacagcattcaccttgccatcaacaaacaagacagagccaggaaagaga

SEQ ID NO: 193723 - DNA, 75 bp, Artificial Sequence
  Synthetic
ccactagatccaaagttcagacagtatacagcattcaccttgccatcaacaaacaaaacagagccaggaaagaga

SEQ ID NO: 193724 - DNA, 75 bp, Artificial Sequence
  Synthetic
ccactagatccaaagttcagacagtatacagcattcaccttgccatcaacaaacaatacagagccaggaaagaga

SEQ ID NO: 193725 - DNA, 75 bp, Artificial Sequence
  Synthetic
ccactagatccaaagttcagacagtatacagcattcaccttgccatcaacaaacaacacagagccaggaaagaga

SEQ ID NO: 193726 - DNA, 75 bp, Artificial Sequence
  Synthetic
ccactagatccaaagttcagacagtatacagcattcaccttgccatcaacaaacaagacagagccaggaaagaga

SEQ ID NO: 193727 - DNA, 75 bp, Artificial Sequence
  Synthetic
ccactagatccataattcagacagtatacagcattcaccttgccatcaacaaacaaaacagagccaggaaagaga

SEQ ID NO: 193728 - DNA, 75 bp, Artificial Sequence
  Synthetic
ccactagatccataattcagacagtatacagcattcaccttgccatcaacaaacaatacagagccaggaaagaga

SEQ ID NO: 193729 - DNA, 75 bp, Artificial Sequence
  Synthetic
ccactagatccataattcagacagtatacagcattcaccttgccatcaacaaacaacacagagccaggaaagaga

SEQ ID NO: 193730 - DNA, 75 bp, Artificial Sequence
  Synthetic
ccactagatccataattcagacagtatacagcattcaccttgccatcaacaaacaagacagagccaggaaagaga

SEQ ID NO: 193731 - DNA, 75 bp, Artificial Sequence
  Synthetic
ccactagatccatatttcagacagtatacagcattcaccttgccatcaacaaacaaaacagagccaggaaagaga

SEQ ID NO: 193732 - DNA, 75 bp, Artificial Sequence
  Synthetic
ccactagatccatatttcagacagtatacagcattcaccttgccatcaacaaacaatacagagccaggaaagaga

SEQ ID NO: 193733 - DNA, 75 bp, Artificial Sequence
  Synthetic
ccactagatccatatttcagacagtatacagcattcaccttgccatcaacaaacaacacagagccaggaaagaga

SEQ ID NO: 193734 - DNA, 75 bp, Artificial Sequence
  Synthetic
ccactagatccatatttcagacagtatacagcattcaccttgccatcaacaaacaagacagagccaggaaagaga

SEQ ID NO: 193735 - DNA, 75 bp, Artificial Sequence
  Synthetic
ccactagatccatacttcagacagtatacagcattcaccttgccatcaacaaacaaaacagagccaggaaagaga

SEQ ID NO: 193736 - DNA, 75 bp, Artificial Sequence
  Synthetic
ccactagatccatacttcagacagtatacagcattcaccttgccatcaacaaacaatacagagccaggaaagaga

SEQ ID NO: 193737 - DNA, 75 bp, Artificial Sequence
  Synthetic
ccactagatccatacttcagacagtatacagcattcaccttgccatcaacaaacaacacagagccaggaaagaga

SEQ ID NO: 193738 - DNA, 75 bp, Artificial Sequence
  Synthetic
ccactagatccatacttcagacagtatacagcattcaccttgccatcaacaaacaagacagagccaggaaagaga

SEQ ID NO: 193739 - DNA, 75 bp, Artificial Sequence
  Synthetic
ccactagatccatagttcagacagtatacagcattcaccttgccatcaacaaacaaaacagagccaggaaagaga

SEQ ID NO: 193740 - DNA, 75 bp, Artificial Sequence
  Synthetic
ccactagatccatagttcagacagtatacagcattcaccttgccatcaacaaacaatacagagccaggaaagaga

SEQ ID NO: 193741 - DNA, 75 bp, Artificial Sequence
  Synthetic
ccactagatccatagttcagacagtatacagcattcaccttgccatcaacaaacaacacagagccaggaaagaga

SEQ ID NO: 193742 - DNA, 75 bp, Artificial Sequence
  Synthetic
ccactagatccatagttcagacagtatacagcattcaccttgccatcaacaaacaagacagagccaggaaagaga

SEQ ID NO: 193743 - DNA, 75 bp, Artificial Sequence
  Synthetic
ccactagatccacaattcagacagtatacagcattcaccttgccatcaacaaacaaaacagagccaggaaagaga

SEQ ID NO: 193744 - DNA, 75 bp, Artificial Sequence
  Synthetic
ccactagatccacaattcagacagtatacagcattcaccttgccatcaacaaacaatacagagccaggaaagaga

SEQ ID NO: 193745 - DNA, 75 bp, Artificial Sequence
  Synthetic
ccactagatccacaattcagacagtatacagcattcaccttgccatcaacaaacaacacagagccaggaaagaga

SEQ ID NO: 193746 - DNA, 75 bp, Artificial Sequence
  Synthetic
ccactagatccacaattcagacagtatacagcattcaccttgccatcaacaaacaagacagagccaggaaagaga

SEQ ID NO: 193747 - DNA, 75 bp, Artificial Sequence
  Synthetic
ccactagatccacatttcagacagtatacagcattcaccttgccatcaacaaacaaaacagagccaggaaagaga

SEQ ID NO: 193748 - DNA, 75 bp, Artificial Sequence
  Synthetic
ccactagatccacatttcagacagtatacagcattcaccttgccatcaacaaacaatacagagccaggaaagaga

SEQ ID NO: 193749 - DNA, 75 bp, Artificial Sequence
  Synthetic
ccactagatccacatttcagacagtatacagcattcaccttgccatcaacaaacaacacagagccaggaaagaga

SEQ ID NO: 193750 - DNA, 75 bp, Artificial Sequence
  Synthetic
ccactagatccacatttcagacagtatacagcattcaccttgccatcaacaaacaagacagagccaggaaagaga

SEQ ID NO: 193751 - DNA, 75 bp, Artificial Sequence
  Synthetic
ccactagatccacacttcagacagtatacagcattcaccttgccatcaacaaacaaaacagagccaggaaagaga

SEQ ID NO: 193752 - DNA, 75 bp, Artificial Sequence
  Synthetic
ccactagatccacacttcagacagtatacagcattcaccttgccatcaacaaacaatacagagccaggaaagaga

SEQ ID NO: 193753 - DNA, 75 bp, Artificial Sequence
  Synthetic
ccactagatccacacttcagacagtatacagcattcaccttgccatcaacaaacaacacagagccaggaaagaga

SEQ ID NO: 193754 - DNA, 75 bp, Artificial Sequence
  Synthetic
ccactagatccacacttcagacagtatacagcattcaccttgccatcaacaaacaagacagagccaggaaagaga

SEQ ID NO: 193755 - DNA, 75 bp, Artificial Sequence
  Synthetic
ccactagatccacagttcagacagtatacagcattcaccttgccatcaacaaacaaaacagagccaggaaagaga

SEQ ID NO: 193756 - DNA, 75 bp, Artificial Sequence
  Synthetic
ccactagatccacagttcagacagtatacagcattcaccttgccatcaacaaacaatacagagccaggaaagaga

SEQ ID NO: 193757 - DNA, 75 bp, Artificial Sequence
  Synthetic
ccactagatccacagttcagacagtatacagcattcaccttgccatcaacaaacaacacagagccaggaaagaga

SEQ ID NO: 193758 - DNA, 75 bp, Artificial Sequence
  Synthetic
ccactagatccacagttcagacagtatacagcattcaccttgccatcaacaaacaagacagagccaggaaagaga

SEQ ID NO: 193759 - DNA, 75 bp, Artificial Sequence
  Synthetic
ccactagatccagaattcagacagtatacagcattcaccttgccatcaacaaacaaaacagagccaggaaagaga

SEQ ID NO: 193760 - DNA, 75 bp, Artificial Sequence
  Synthetic
ccactagatccagaattcagacagtatacagcattcaccttgccatcaacaaacaatacagagccaggaaagaga

SEQ ID NO: 193761 - DNA, 75 bp, Artificial Sequence
  Synthetic
ccactagatccagaattcagacagtatacagcattcaccttgccatcaacaaacaacacagagccaggaaagaga

SEQ ID NO: 193762 - DNA, 75 bp, Artificial Sequence
  Synthetic
ccactagatccagaattcagacagtatacagcattcaccttgccatcaacaaacaagacagagccaggaaagaga

SEQ ID NO: 193763 - DNA, 75 bp, Artificial Sequence
  Synthetic
ccactagatccagatttcagacagtatacagcattcaccttgccatcaacaaacaaaacagagccaggaaagaga

SEQ ID NO: 193764 - DNA, 75 bp, Artificial Sequence
  Synthetic
ccactagatccagatttcagacagtatacagcattcaccttgccatcaacaaacaatacagagccaggaaagaga

SEQ ID NO: 193765 - DNA, 75 bp, Artificial Sequence
  Synthetic
ccactagatccagatttcagacagtatacagcattcaccttgccatcaacaaacaacacagagccaggaaagaga

SEQ ID NO: 193766 - DNA, 75 bp, Artificial Sequence
  Synthetic
ccactagatccagatttcagacagtatacagcattcaccttgccatcaacaaacaagacagagccaggaaagaga

SEQ ID NO: 193767 - DNA, 75 bp, Artificial Sequence
  Synthetic
ccactagatccagacttcagacagtatacagcattcaccttgccatcaacaaacaaaacagagccaggaaagaga

SEQ ID NO: 193768 - DNA, 75 bp, Artificial Sequence
  Synthetic
ccactagatccagacttcagacagtatacagcattcaccttgccatcaacaaacaatacagagccaggaaagaga

SEQ ID NO: 193769 - DNA, 75 bp, Artificial Sequence
  Synthetic
ccactagatccagacttcagacagtatacagcattcaccttgccatcaacaaacaacacagagccaggaaagaga

SEQ ID NO: 193770 - DNA, 75 bp, Artificial Sequence
  Synthetic
ccactagatccagacttcagacagtatacagcattcaccttgccatcaacaaacaagacagagccaggaaagaga

SEQ ID NO: 193771 - DNA, 75 bp, Artificial Sequence
  Synthetic
ccactagatccagagttcagacagtatacagcattcaccttgccatcaacaaacaaaacagagccaggaaagaga

SEQ ID NO: 193772 - DNA, 75 bp, Artificial Sequence
  Synthetic
ccactagatccagagttcagacagtatacagcattcaccttgccatcaacaaacaatacagagccaggaaagaga

SEQ ID NO: 193773 - DNA, 75 bp, Artificial Sequence
  Synthetic
ccactagatccagagttcagacagtatacagcattcaccttgccatcaacaaacaacacagagccaggaaagaga

SEQ ID NO: 193774 - DNA, 75 bp, Artificial Sequence
  Synthetic
ccactagatccagagttcagacagtatacagcattcaccttgccatcaacaaacaagacagagccaggaaagaga

SEQ ID NO: 193775 - DNA, 75 bp, Artificial Sequence
  Synthetic
agatggatcatgcaataggcagtcaaaagaaggaaaagcaggatatgtaacagacagagggagagacaaggtaag

SEQ ID NO: 193776 - DNA, 75 bp, Artificial Sequence
  Synthetic
tacatttataaagttctaccacaaggatggaagggatccccagcaatttttcaatactccatgaggaaggtatta

SEQ ID NO: 193777 - DNA, 75 bp, Artificial Sequence
  Synthetic
tacatttataaagttctaccacaaggatggaagggttccccagcaatttttcaatactccatgaggaaggtatta

SEQ ID NO: 193778 - DNA, 75 bp, Artificial Sequence
  Synthetic
tacatttataaagttctaccacaaggatggaagggctccccagcaatttttcaatactccatgaggaaggtatta

SEQ ID NO: 193779 - DNA, 75 bp, Artificial Sequence
  Synthetic
tacatttataaagttctaccacaaggatggaaggggtccccagcaatttttcaatactccatgaggaaggtatta

SEQ ID NO: 193780 - DNA, 75 bp, Artificial Sequence
  Synthetic
tacatttataaagttctaccacatggatggaagggatccccagcaatttttcaatactccatgaggaaggtatta

SEQ ID NO: 193781 - DNA, 75 bp, Artificial Sequence
  Synthetic
tacatttataaagttctaccacatggatggaagggttccccagcaatttttcaatactccatgaggaaggtatta

SEQ ID NO: 193782 - DNA, 75 bp, Artificial Sequence
  Synthetic
tacatttataaagttctaccacatggatggaagggctccccagcaatttttcaatactccatgaggaaggtatta

SEQ ID NO: 193783 - DNA, 75 bp, Artificial Sequence
  Synthetic
tacatttataaagttctaccacatggatggaaggggtccccagcaatttttcaatactccatgaggaaggtatta

SEQ ID NO: 193784 - DNA, 75 bp, Artificial Sequence
  Synthetic
tacatttataaagttctaccacacggatggaagggatccccagcaatttttcaatactccatgaggaaggtatta

SEQ ID NO: 193785 - DNA, 75 bp, Artificial Sequence
  Synthetic
tacatttataaagttctaccacacggatggaagggttccccagcaatttttcaatactccatgaggaaggtatta

SEQ ID NO: 193786 - DNA, 75 bp, Artificial Sequence
  Synthetic
tacatttataaagttctaccacacggatggaagggctccccagcaatttttcaatactccatgaggaaggtatta

SEQ ID NO: 193787 - DNA, 75 bp, Artificial Sequence
  Synthetic
tacatttataaagttctaccacacggatggaaggggtccccagcaatttttcaatactccatgaggaaggtatta

SEQ ID NO: 193788 - DNA, 75 bp, Artificial Sequence
  Synthetic
tacatttataaagttctaccacagggatggaagggatccccagcaatttttcaatactccatgaggaaggtatta

SEQ ID NO: 193789 - DNA, 75 bp, Artificial Sequence
  Synthetic
tacatttataaagttctaccacagggatggaagggttccccagcaatttttcaatactccatgaggaaggtatta

SEQ ID NO: 193790 - DNA, 75 bp, Artificial Sequence
  Synthetic
tacatttataaagttctaccacagggatggaagggctccccagcaatttttcaatactccatgaggaaggtatta

SEQ ID NO: 193791 - DNA, 75 bp, Artificial Sequence
  Synthetic
tacatttataaagttctaccacagggatggaaggggtccccagcaatttttcaatactccatgaggaaggtatta

SEQ ID NO: 193792 - DNA, 75 bp, Artificial Sequence
  Synthetic
gatcctttcagaaaagccaacagcgatgtcactataattcagtacatggatgacatccttatagcaagtgacaga

SEQ ID NO: 193793 - DNA, 75 bp, Artificial Sequence
  Synthetic
tgacatccttatagcaagtgacagaagtgatctggagcatgacagggtagtgtcccaactaaaagagctattaaa

SEQ ID NO: 193794 - DNA, 75 bp, Artificial Sequence
  Synthetic
agtgatctggagcatgacagggtagtgtcccaactaaaagagctattaaataacatgggattctctaccccagaa

SEQ ID NO: 193795 - DNA, 75 bp, Artificial Sequence
  Synthetic
tgtcccaactaaaagagctattaaataacatgggattctctaccccagaagaaaaattccaaaaagaccctccgt

SEQ ID NO: 193796 - DNA, 75 bp, Artificial Sequence
  Synthetic
tgtcccaactaaaagagctattaaataacatgggattctctaccccagaagaaaaattccaaaatgaccctccgt

SEQ ID NO: 193797 - DNA, 75 bp, Artificial Sequence
  Synthetic
tgtcccaactaaaagagctattaaataacatgggattctctaccccagaagaaaaattccaaaacgaccctccgt

SEQ ID NO: 193798 - DNA, 75 bp, Artificial Sequence
  Synthetic
tgtcccaactaaaagagctattaaataacatgggattctctaccccagaagaaaaattccaaaaggaccctccgt

SEQ ID NO: 193799 - DNA, 75 bp, Artificial Sequence
  Synthetic
tgtcccaactaaaagagctattaaataacatgggattctctaccccagaagaaaaattccataaagaccctccgt

SEQ ID NO: 193800 - DNA, 75 bp, Artificial Sequence
  Synthetic
tgtcccaactaaaagagctattaaataacatgggattctctaccccagaagaaaaattccataatgaccctccgt

SEQ ID NO: 193801 - DNA, 75 bp, Artificial Sequence
  Synthetic
tgtcccaactaaaagagctattaaataacatgggattctctaccccagaagaaaaattccataacgaccctccgt

SEQ ID NO: 193802 - DNA, 75 bp, Artificial Sequence
  Synthetic
tgtcccaactaaaagagctattaaataacatgggattctctaccccagaagaaaaattccataaggaccctccgt

SEQ ID NO: 193803 - DNA, 75 bp, Artificial Sequence
  Synthetic
tgtcccaactaaaagagctattaaataacatgggattctctaccccagaagaaaaattccacaaagaccctccgt

SEQ ID NO: 193804 - DNA, 75 bp, Artificial Sequence
  Synthetic
tgtcccaactaaaagagctattaaataacatgggattctctaccccagaagaaaaattccacaatgaccctccgt

SEQ ID NO: 193805 - DNA, 75 bp, Artificial Sequence
  Synthetic
tgtcccaactaaaagagctattaaataacatgggattctctaccccagaagaaaaattccacaacgaccctccgt

SEQ ID NO: 193806 - DNA, 75 bp, Artificial Sequence
  Synthetic
tgtcccaactaaaagagctattaaataacatgggattctctaccccagaagaaaaattccacaaggaccctccgt

SEQ ID NO: 193807 - DNA, 75 bp, Artificial Sequence
  Synthetic
tgtcccaactaaaagagctattaaataacatgggattctctaccccagaagaaaaattccagaaagaccctccgt

SEQ ID NO: 193808 - DNA, 75 bp, Artificial Sequence
  Synthetic
tgtcccaactaaaagagctattaaataacatgggattctctaccccagaagaaaaattccagaatgaccctccgt

SEQ ID NO: 193809 - DNA, 75 bp, Artificial Sequence
  Synthetic
tgtcccaactaaaagagctattaaataacatgggattctctaccccagaagaaaaattccagaacgaccctccgt

SEQ ID NO: 193810 - DNA, 75 bp, Artificial Sequence
  Synthetic
tgtcccaactaaaagagctattaaataacatgggattctctaccccagaagaaaaattccagaaggaccctccgt

SEQ ID NO: 193811 - DNA, 75 bp, Artificial Sequence
  Synthetic
tgtcccaactaaaagagctattaaataacatgggattctctaccccagaagaaaatttccaaaaagaccctccgt

SEQ ID NO: 193812 - DNA, 75 bp, Artificial Sequence
  Synthetic
tgtcccaactaaaagagctattaaataacatgggattctctaccccagaagaaaatttccaaaatgaccctccgt

SEQ ID NO: 193813 - DNA, 75 bp, Artificial Sequence
  Synthetic
tgtcccaactaaaagagctattaaataacatgggattctctaccccagaagaaaatttccaaaacgaccctccgt

SEQ ID NO: 193814 - DNA, 75 bp, Artificial Sequence
  Synthetic
tgtcccaactaaaagagctattaaataacatgggattctctaccccagaagaaaatttccaaaaggaccctccgt

SEQ ID NO: 193815 - DNA, 75 bp, Artificial Sequence
  Synthetic
tgtcccaactaaaagagctattaaataacatgggattctctaccccagaagaaaatttccataaagaccctccgt

SEQ ID NO: 193816 - DNA, 75 bp, Artificial Sequence
  Synthetic
tgtcccaactaaaagagctattaaataacatgggattctctaccccagaagaaaatttccataatgaccctccgt

SEQ ID NO: 193817 - DNA, 75 bp, Artificial Sequence
  Synthetic
tgtcccaactaaaagagctattaaataacatgggattctctaccccagaagaaaatttccataacgaccctccgt

SEQ ID NO: 193818 - DNA, 75 bp, Artificial Sequence
  Synthetic
tgtcccaactaaaagagctattaaataacatgggattctctaccccagaagaaaatttccataaggaccctccgt

SEQ ID NO: 193819 - DNA, 75 bp, Artificial Sequence
  Synthetic
tgtcccaactaaaagagctattaaataacatgggattctctaccccagaagaaaatttccacaaagaccctccgt

SEQ ID NO: 193820 - DNA, 75 bp, Artificial Sequence
  Synthetic
tgtcccaactaaaagagctattaaataacatgggattctctaccccagaagaaaatttccacaatgaccctccgt

SEQ ID NO: 193821 - DNA, 75 bp, Artificial Sequence
  Synthetic
tgtcccaactaaaagagctattaaataacatgggattctctaccccagaagaaaatttccacaacgaccctccgt

SEQ ID NO: 193822 - DNA, 75 bp, Artificial Sequence
  Synthetic
tgtcccaactaaaagagctattaaataacatgggattctctaccccagaagaaaatttccacaaggaccctccgt

SEQ ID NO: 193823 - DNA, 75 bp, Artificial Sequence
  Synthetic
tgtcccaactaaaagagctattaaataacatgggattctctaccccagaagaaaatttccagaaagaccctccgt

SEQ ID NO: 193824 - DNA, 75 bp, Artificial Sequence
  Synthetic
tgtcccaactaaaagagctattaaataacatgggattctctaccccagaagaaaatttccagaatgaccctccgt

SEQ ID NO: 193825 - DNA, 75 bp, Artificial Sequence
  Synthetic
tgtcccaactaaaagagctattaaataacatgggattctctaccccagaagaaaatttccagaacgaccctccgt

SEQ ID NO: 193826 - DNA, 75 bp, Artificial Sequence
  Synthetic
tgtcccaactaaaagagctattaaataacatgggattctctaccccagaagaaaatttccagaaggaccctccgt

SEQ ID NO: 193827 - DNA, 75 bp, Artificial Sequence
  Synthetic
tgtcccaactaaaagagctattaaataacatgggattctctaccccagaagaaaacttccaaaaagaccctccgt

SEQ ID NO: 193828 - DNA, 75 bp, Artificial Sequence
  Synthetic
tgtcccaactaaaagagctattaaataacatgggattctctaccccagaagaaaacttccaaaatgaccctccgt

SEQ ID NO: 193829 - DNA, 75 bp, Artificial Sequence
  Synthetic
tgtcccaactaaaagagctattaaataacatgggattctctaccccagaagaaaacttccaaaacgaccctccgt

SEQ ID NO: 193830 - DNA, 75 bp, Artificial Sequence
  Synthetic
tgtcccaactaaaagagctattaaataacatgggattctctaccccagaagaaaacttccaaaaggaccctccgt

SEQ ID NO: 193831 - DNA, 75 bp, Artificial Sequence
  Synthetic
tgtcccaactaaaagagctattaaataacatgggattctctaccccagaagaaaacttccataaagaccctccgt

SEQ ID NO: 193832 - DNA, 75 bp, Artificial Sequence
  Synthetic
tgtcccaactaaaagagctattaaataacatgggattctctaccccagaagaaaacttccataatgaccctccgt

SEQ ID NO: 193833 - DNA, 75 bp, Artificial Sequence
  Synthetic
tgtcccaactaaaagagctattaaataacatgggattctctaccccagaagaaaacttccataacgaccctccgt

SEQ ID NO: 193834 - DNA, 75 bp, Artificial Sequence
  Synthetic
tgtcccaactaaaagagctattaaataacatgggattctctaccccagaagaaaacttccataaggaccctccgt

SEQ ID NO: 193835 - DNA, 75 bp, Artificial Sequence
  Synthetic
tgtcccaactaaaagagctattaaataacatgggattctctaccccagaagaaaacttccacaaagaccctccgt

SEQ ID NO: 193836 - DNA, 75 bp, Artificial Sequence
  Synthetic
tgtcccaactaaaagagctattaaataacatgggattctctaccccagaagaaaacttccacaatgaccctccgt

SEQ ID NO: 193837 - DNA, 75 bp, Artificial Sequence
  Synthetic
tgtcccaactaaaagagctattaaataacatgggattctctaccccagaagaaaacttccacaacgaccctccgt

SEQ ID NO: 193838 - DNA, 75 bp, Artificial Sequence
  Synthetic
tgtcccaactaaaagagctattaaataacatgggattctctaccccagaagaaaacttccacaaggaccctccgt

SEQ ID NO: 193839 - DNA, 75 bp, Artificial Sequence
  Synthetic
tgtcccaactaaaagagctattaaataacatgggattctctaccccagaagaaaacttccagaaagaccctccgt

SEQ ID NO: 193840 - DNA, 75 bp, Artificial Sequence
  Synthetic
tgtcccaactaaaagagctattaaataacatgggattctctaccccagaagaaaacttccagaatgaccctccgt

SEQ ID NO: 193841 - DNA, 75 bp, Artificial Sequence
  Synthetic
tgtcccaactaaaagagctattaaataacatgggattctctaccccagaagaaaacttccagaacgaccctccgt

SEQ ID NO: 193842 - DNA, 75 bp, Artificial Sequence
  Synthetic
tgtcccaactaaaagagctattaaataacatgggattctctaccccagaagaaaacttccagaaggaccctccgt

SEQ ID NO: 193843 - DNA, 75 bp, Artificial Sequence
  Synthetic
tgtcccaactaaaagagctattaaataacatgggattctctaccccagaagaaaagttccaaaaagaccctccgt

SEQ ID NO: 193844 - DNA, 75 bp, Artificial Sequence
  Synthetic
tgtcccaactaaaagagctattaaataacatgggattctctaccccagaagaaaagttccaaaatgaccctccgt

SEQ ID NO: 193845 - DNA, 75 bp, Artificial Sequence
  Synthetic
tgtcccaactaaaagagctattaaataacatgggattctctaccccagaagaaaagttccaaaacgaccctccgt

SEQ ID NO: 193846 - DNA, 75 bp, Artificial Sequence
  Synthetic
tgtcccaactaaaagagctattaaataacatgggattctctaccccagaagaaaagttccaaaaggaccctccgt

SEQ ID NO: 193847 - DNA, 75 bp, Artificial Sequence
  Synthetic
tgtcccaactaaaagagctattaaataacatgggattctctaccccagaagaaaagttccataaagaccctccgt

SEQ ID NO: 193848 - DNA, 75 bp, Artificial Sequence
  Synthetic
tgtcccaactaaaagagctattaaataacatgggattctctaccccagaagaaaagttccataatgaccctccgt

SEQ ID NO: 193849 - DNA, 75 bp, Artificial Sequence
  Synthetic
tgtcccaactaaaagagctattaaataacatgggattctctaccccagaagaaaagttccataacgaccctccgt

SEQ ID NO: 193850 - DNA, 75 bp, Artificial Sequence
  Synthetic
tgtcccaactaaaagagctattaaataacatgggattctctaccccagaagaaaagttccataaggaccctccgt

SEQ ID NO: 193851 - DNA, 75 bp, Artificial Sequence
  Synthetic
tgtcccaactaaaagagctattaaataacatgggattctctaccccagaagaaaagttccacaaagaccctccgt

SEQ ID NO: 193852 - DNA, 75 bp, Artificial Sequence
  Synthetic
tgtcccaactaaaagagctattaaataacatgggattctctaccccagaagaaaagttccacaatgaccctccgt

SEQ ID NO: 193853 - DNA, 75 bp, Artificial Sequence
  Synthetic
tgtcccaactaaaagagctattaaataacatgggattctctaccccagaagaaaagttccacaacgaccctccgt

SEQ ID NO: 193854 - DNA, 75 bp, Artificial Sequence
  Synthetic
tgtcccaactaaaagagctattaaataacatgggattctctaccccagaagaaaagttccacaaggaccctccgt

SEQ ID NO: 193855 - DNA, 75 bp, Artificial Sequence
  Synthetic
tgtcccaactaaaagagctattaaataacatgggattctctaccccagaagaaaagttccagaaagaccctccgt

SEQ ID NO: 193856 - DNA, 75 bp, Artificial Sequence
  Synthetic
tgtcccaactaaaagagctattaaataacatgggattctctaccccagaagaaaagttccagaatgaccctccgt

SEQ ID NO: 193857 - DNA, 75 bp, Artificial Sequence
  Synthetic
tgtcccaactaaaagagctattaaataacatgggattctctaccccagaagaaaagttccagaacgaccctccgt

SEQ ID NO: 193858 - DNA, 75 bp, Artificial Sequence
  Synthetic
tgtcccaactaaaagagctattaaataacatgggattctctaccccagaagaaaagttccagaaggaccctccgt

SEQ ID NO: 193859 - DNA, 75 bp, Artificial Sequence
  Synthetic
gccaaaaaagtggaaactgcaaaaaatacaactgccagaaaaggaagtttggacagtgaatgacattcaaaaact

SEQ ID NO: 193860 - DNA, 75 bp, Artificial Sequence
  Synthetic
atacaactgccagaaaaggaagtttggacagtgaatgacattcaaaaactggtaggagtattaaactgggcagct

SEQ ID NO: 193861 - DNA, 75 bp, Artificial Sequence
  Synthetic
ggtaggagtattaaactgggcagctcaactctttcctggaatcaaaacaaggcacatgtgcaaactaattagggg

SEQ ID NO: 193862 - DNA, 75 bp, Artificial Sequence
  Synthetic
ggtaggagtattaaactgggcagctcaactctttcctggaatcaaaacaaggcacatgtgcatactaattagggg

SEQ ID NO: 193863 - DNA, 75 bp, Artificial Sequence
  Synthetic
ggtaggagtattaaactgggcagctcaactctttcctggaatcaaaacaaggcacatgtgcacactaattagggg

SEQ ID NO: 193864 - DNA, 75 bp, Artificial Sequence
  Synthetic
ggtaggagtattaaactgggcagctcaactctttcctggaatcaaaacaaggcacatgtgcagactaattagggg

SEQ ID NO: 193865 - DNA, 75 bp, Artificial Sequence
  Synthetic
ggtaggagtattaaactgggcagctcaactctttcctggaatcaatacaaggcacatgtgcaaactaattagggg

SEQ ID NO: 193866 - DNA, 75 bp, Artificial Sequence
  Synthetic
ggtaggagtattaaactgggcagctcaactctttcctggaatcaatacaaggcacatgtgcatactaattagggg

SEQ ID NO: 193867 - DNA, 75 bp, Artificial Sequence
  Synthetic
ggtaggagtattaaactgggcagctcaactctttcctggaatcaatacaaggcacatgtgcacactaattagggg

SEQ ID NO: 193868 - DNA, 75 bp, Artificial Sequence
  Synthetic
ggtaggagtattaaactgggcagctcaactctttcctggaatcaatacaaggcacatgtgcagactaattagggg

SEQ ID NO: 193869 - DNA, 75 bp, Artificial Sequence
  Synthetic
ggtaggagtattaaactgggcagctcaactctttcctggaatcaacacaaggcacatgtgcaaactaattagggg

SEQ ID NO: 193870 - DNA, 75 bp, Artificial Sequence
  Synthetic
ggtaggagtattaaactgggcagctcaactctttcctggaatcaacacaaggcacatgtgcatactaattagggg

SEQ ID NO: 193871 - DNA, 75 bp, Artificial Sequence
  Synthetic
ggtaggagtattaaactgggcagctcaactctttcctggaatcaacacaaggcacatgtgcacactaattagggg

SEQ ID NO: 193872 - DNA, 75 bp, Artificial Sequence
  Synthetic
ggtaggagtattaaactgggcagctcaactctttcctggaatcaacacaaggcacatgtgcagactaattagggg

SEQ ID NO: 193873 - DNA, 75 bp, Artificial Sequence
  Synthetic
ggtaggagtattaaactgggcagctcaactctttcctggaatcaagacaaggcacatgtgcaaactaattagggg

SEQ ID NO: 193874 - DNA, 75 bp, Artificial Sequence
  Synthetic
ggtaggagtattaaactgggcagctcaactctttcctggaatcaagacaaggcacatgtgcatactaattagggg

SEQ ID NO: 193875 - DNA, 75 bp, Artificial Sequence
  Synthetic
ggtaggagtattaaactgggcagctcaactctttcctggaatcaagacaaggcacatgtgcacactaattagggg

SEQ ID NO: 193876 - DNA, 75 bp, Artificial Sequence
  Synthetic
ggtaggagtattaaactgggcagctcaactctttcctggaatcaagacaaggcacatgtgcagactaattagggg

SEQ ID NO: 193877 - DNA, 75 bp, Artificial Sequence
  Synthetic
caggaatcaggaaggcagacagcactcttcctattaaaactggccagtaggtggccaataacacacttgcacaca

SEQ ID NO: 193878 - DNA, 75 bp, Artificial Sequence
  Synthetic
cagtggacagaattagcagaggcagagttacaggagaaaaaaatcatcttagaacaggaacaagaaggatcctac

SEQ ID NO: 193879 - DNA, 75 bp, Artificial Sequence
  Synthetic
cagtggacagaattagcagaggcagagttacaggagaataaaatcatcttagaacaggaacaagaaggatcctac

SEQ ID NO: 193880 - DNA, 75 bp, Artificial Sequence
  Synthetic
cagtggacagaattagcagaggcagagttacaggagaacaaaatcatcttagaacaggaacaagaaggatcctac

SEQ ID NO: 193881 - DNA, 75 bp, Artificial Sequence
  Synthetic
cagtggacagaattagcagaggcagagttacaggagaagaaaatcatcttagaacaggaacaagaaggatcctac

SEQ ID NO: 193882 - DNA, 75 bp, Artificial Sequence
  Synthetic
agaacaggaacaagaaggatcctactacaaggaaggggtaccattagaagcaacagtacagaaaaacctagcaaa

SEQ ID NO: 193883 - DNA, 75 bp, Artificial Sequence
  Synthetic
tcagtggacatacaagattcatcagggaaaaagaatgttaaaagtaggaaaatatgcaaaggttaaaaacaccca

SEQ ID NO: 193884 - DNA, 75 bp, Artificial Sequence
  Synthetic
tcagtggacatacaagattcatcagggaaatagaatgttaaaagtaggaaaatatgcaaaggttaaaaacaccca

SEQ ID NO: 193885 - DNA, 75 bp, Artificial Sequence
  Synthetic
tcagtggacatacaagattcatcagggaaacagaatgttaaaagtaggaaaatatgcaaaggttaaaaacaccca

SEQ ID NO: 193886 - DNA, 75 bp, Artificial Sequence
  Synthetic
tcagtggacatacaagattcatcagggaaagagaatgttaaaagtaggaaaatatgcaaaggttaaaaacaccca

SEQ ID NO: 193887 - DNA, 75 bp, Artificial Sequence
  Synthetic
aagattatcagagactatggaggaagacaagaactggatagtagtccccacctggagggtgccagggaggatgga

SEQ ID NO: 193888 - DNA, 75 bp, Artificial Sequence
  Synthetic
cctggagggtgccagggaggatggagaagtggcatagccttgtcaagtacctaaaatacagaacaaaagacctag

SEQ ID NO: 193889 - DNA, 75 bp, Artificial Sequence
  Synthetic
gaagtggcatagccttgtcaagtacctaaaatacagaacaaaagacctagaggaggtgcgctatgttccccacca

SEQ ID NO: 193890 - DNA, 75 bp, Artificial Sequence
  Synthetic
accaatattccatctgccagtagaaagagaaacatgggaccagtggtggacagattaatggcaagtgacctggat

SEQ ID NO: 193891 - DNA, 75 bp, Artificial Sequence
  Synthetic
accaatattccatctgccagtagaaagagaaacatgggaccagtggtggacagattattggcaagtgacctggat

SEQ ID NO: 193892 - DNA, 75 bp, Artificial Sequence
  Synthetic
accaatattccatctgccagtagaaagagaaacatgggaccagtggtggacagattactggcaagtgacctggat

SEQ ID NO: 193893 - DNA, 75 bp, Artificial Sequence
  Synthetic
accaatattccatctgccagtagaaagagaaacatgggaccagtggtggacagattagtggcaagtgacctggat

SEQ ID NO: 193894 - DNA, 75 bp, Artificial Sequence
  Synthetic
accaatattccatctgccagtagatagagaaacatgggaccagtggtggacagattaatggcaagtgacctggat

SEQ ID NO: 193895 - DNA, 75 bp, Artificial Sequence
  Synthetic
accaatattccatctgccagtagatagagaaacatgggaccagtggtggacagattattggcaagtgacctggat

SEQ ID NO: 193896 - DNA, 75 bp, Artificial Sequence
  Synthetic
accaatattccatctgccagtagatagagaaacatgggaccagtggtggacagattactggcaagtgacctggat

SEQ ID NO: 193897 - DNA, 75 bp, Artificial Sequence
  Synthetic
accaatattccatctgccagtagatagagaaacatgggaccagtggtggacagattagtggcaagtgacctggat

SEQ ID NO: 193898 - DNA, 75 bp, Artificial Sequence
  Synthetic
accaatattccatctgccagtagacagagaaacatgggaccagtggtggacagattaatggcaagtgacctggat

SEQ ID NO: 193899 - DNA, 75 bp, Artificial Sequence
  Synthetic
accaatattccatctgccagtagacagagaaacatgggaccagtggtggacagattattggcaagtgacctggat

SEQ ID NO: 193900 - DNA, 75 bp, Artificial Sequence
  Synthetic
accaatattccatctgccagtagacagagaaacatgggaccagtggtggacagattactggcaagtgacctggat

SEQ ID NO: 193901 - DNA, 75 bp, Artificial Sequence
  Synthetic
accaatattccatctgccagtagacagagaaacatgggaccagtggtggacagattagtggcaagtgacctggat

SEQ ID NO: 193902 - DNA, 75 bp, Artificial Sequence
  Synthetic
accaatattccatctgccagtagagagagaaacatgggaccagtggtggacagattaatggcaagtgacctggat

SEQ ID NO: 193903 - DNA, 75 bp, Artificial Sequence
  Synthetic
accaatattccatctgccagtagagagagaaacatgggaccagtggtggacagattattggcaagtgacctggat

SEQ ID NO: 193904 - DNA, 75 bp, Artificial Sequence
  Synthetic
accaatattccatctgccagtagagagagaaacatgggaccagtggtggacagattactggcaagtgacctggat

SEQ ID NO: 193905 - DNA, 75 bp, Artificial Sequence
  Synthetic
accaatattccatctgccagtagagagagaaacatgggaccagtggtggacagattagtggcaagtgacctggat

SEQ ID NO: 193906 - DNA, 75 bp, Artificial Sequence
  Synthetic
cccagagtgggactttgtctcgaccccaccattaataagactagcctacaacctagtcaaagaccccatagaggg

SEQ ID NO: 193907 - DNA, 75 bp, Artificial Sequence
  Synthetic
aaaagaaacctactacacagatgggtcctgcaataaagcctcaaaagaaggaaaagcaggatatgtcacagacag

SEQ ID NO: 193908 - DNA, 75 bp, Artificial Sequence
  Synthetic
taaagaaacctactacacagatgggtcctgcaataaagcctcaaaagaaggaaaagcaggatatgtcacagacag

SEQ ID NO: 193909 - DNA, 75 bp, Artificial Sequence
  Synthetic
caaagaaacctactacacagatgggtcctgcaataaagcctcaaaagaaggaaaagcaggatatgtcacagacag

SEQ ID NO: 193910 - DNA, 75 bp, Artificial Sequence
  Synthetic
gaaagaaacctactacacagatgggtcctgcaataaagcctcaaaagaaggaaaagcaggatatgtcacagacag

SEQ ID NO: 193911 - DNA, 75 bp, Artificial Sequence
  Synthetic
gggaaaagataaggtaaaagtgttagaacagacaacaaatcaacaagcagaacttgaagcatttgcattagcatt

SEQ ID NO: 193912 - DNA, 75 bp, Artificial Sequence
  Synthetic
gggaaaagataaggttaaagtgttagaacagacaacaaatcaacaagcagaacttgaagcatttgcattagcatt

SEQ ID NO: 193913 - DNA, 75 bp, Artificial Sequence
  Synthetic
gggaaaagataaggtcaaagtgttagaacagacaacaaatcaacaagcagaacttgaagcatttgcattagcatt

SEQ ID NO: 193914 - DNA, 75 bp, Artificial Sequence
  Synthetic
gggaaaagataaggtgaaagtgttagaacagacaacaaatcaacaagcagaacttgaagcatttgcattagcatt

SEQ ID NO: 193915 - DNA, 75 bp, Artificial Sequence
  Synthetic
gaacagacaacaaatcaacaagcagaacttgaagcatttgcattagcattacaggattcaggaccacaagttaac

SEQ ID NO: 193916 - DNA, 75 bp, Artificial Sequence
  Synthetic
gaacagacaacaaatcaacaagcagaacttgaagcatttgcattagcattacaggattctggaccacaagttaac

SEQ ID NO: 193917 - DNA, 75 bp, Artificial Sequence
  Synthetic
gaacagacaacaaatcaacaagcagaacttgaagcatttgcattagcattacaggattccggaccacaagttaac

SEQ ID NO: 193918 - DNA, 75 bp, Artificial Sequence
  Synthetic
gaacagacaacaaatcaacaagcagaacttgaagcatttgcattagcattacaggattcgggaccacaagttaac

SEQ ID NO: 193919 - DNA, 75 bp, Artificial Sequence
  Synthetic
gaacagacaacaaatcaacaagcagaacttgaagcatttgcattagcatttcaggattcaggaccacaagttaac

SEQ ID NO: 193920 - DNA, 75 bp, Artificial Sequence
  Synthetic
gaacagacaacaaatcaacaagcagaacttgaagcatttgcattagcatttcaggattctggaccacaagttaac

SEQ ID NO: 193921 - DNA, 75 bp, Artificial Sequence
  Synthetic
gaacagacaacaaatcaacaagcagaacttgaagcatttgcattagcatttcaggattccggaccacaagttaac

SEQ ID NO: 193922 - DNA, 75 bp, Artificial Sequence
  Synthetic
gaacagacaacaaatcaacaagcagaacttgaagcatttgcattagcatttcaggattcgggaccacaagttaac

SEQ ID NO: 193923 - DNA, 75 bp, Artificial Sequence
  Synthetic
gaacagacaacaaatcaacaagcagaacttgaagcatttgcattagcattccaggattcaggaccacaagttaac

SEQ ID NO: 193924 - DNA, 75 bp, Artificial Sequence
  Synthetic
gaacagacaacaaatcaacaagcagaacttgaagcatttgcattagcattccaggattctggaccacaagttaac

SEQ ID NO: 193925 - DNA, 75 bp, Artificial Sequence
  Synthetic
gaacagacaacaaatcaacaagcagaacttgaagcatttgcattagcattccaggattccggaccacaagttaac

SEQ ID NO: 193926 - DNA, 75 bp, Artificial Sequence
  Synthetic
gaacagacaacaaatcaacaagcagaacttgaagcatttgcattagcattccaggattcgggaccacaagttaac

SEQ ID NO: 193927 - DNA, 75 bp, Artificial Sequence
  Synthetic
gaacagacaacaaatcaacaagcagaacttgaagcatttgcattagcattgcaggattcaggaccacaagttaac

SEQ ID NO: 193928 - DNA, 75 bp, Artificial Sequence
  Synthetic
gaacagacaacaaatcaacaagcagaacttgaagcatttgcattagcattgcaggattctggaccacaagttaac

SEQ ID NO: 193929 - DNA, 75 bp, Artificial Sequence
  Synthetic
gaacagacaacaaatcaacaagcagaacttgaagcatttgcattagcattgcaggattccggaccacaagttaac

SEQ ID NO: 193930 - DNA, 75 bp, Artificial Sequence
  Synthetic
gaacagacaacaaatcaacaagcagaacttgaagcatttgcattagcattgcaggattcgggaccacaagttaac

SEQ ID NO: 193931 - DNA, 75 bp, Artificial Sequence
  Synthetic
atagaagccttgaacagagaggcagtgaaccatctgccccgagagctcattttccaggtgtggcaaaggtcctgg

SEQ ID NO: 193932 - DNA, 75 bp, Artificial Sequence
  Synthetic
atcatagtagattcacaatatgtcatgggaataatagctgcacaaccaacagaaacagaatcaccaatagtaaca

SEQ ID NO: 193933 - DNA, 75 bp, Artificial Sequence
  Synthetic
atcatagtagattcacaatatgtcatgggaataatagctgcacaaccaacagaaacagaatcaccaatagttaca

SEQ ID NO: 193934 - DNA, 75 bp, Artificial Sequence
  Synthetic
atcatagtagattcacaatatgtcatgggaataatagctgcacaaccaacagaaacagaatcaccaatagtcaca

SEQ ID NO: 193935 - DNA, 75 bp, Artificial Sequence
  Synthetic
atcatagtagattcacaatatgtcatgggaataatagctgcacaaccaacagaaacagaatcaccaatagtgaca

SEQ ID NO: 193936 - DNA, 75 bp, Artificial Sequence
  Synthetic
atcatagtagattcacaatatgtcatgggaataatagctgcacatccaacagaaacagaatcaccaatagtaaca

SEQ ID NO: 193937 - DNA, 75 bp, Artificial Sequence
  Synthetic
atcatagtagattcacaatatgtcatgggaataatagctgcacatccaacagaaacagaatcaccaatagttaca

SEQ ID NO: 193938 - DNA, 75 bp, Artificial Sequence
  Synthetic
atcatagtagattcacaatatgtcatgggaataatagctgcacatccaacagaaacagaatcaccaatagtcaca

SEQ ID NO: 193939 - DNA, 75 bp, Artificial Sequence
  Synthetic
atcatagtagattcacaatatgtcatgggaataatagctgcacatccaacagaaacagaatcaccaatagtgaca

SEQ ID NO: 193940 - DNA, 75 bp, Artificial Sequence
  Synthetic
atcatagtagattcacaatatgtcatgggaataatagctgcacacccaacagaaacagaatcaccaatagtaaca

SEQ ID NO: 193941 - DNA, 75 bp, Artificial Sequence
  Synthetic
atcatagtagattcacaatatgtcatgggaataatagctgcacacccaacagaaacagaatcaccaatagttaca

SEQ ID NO: 193942 - DNA, 75 bp, Artificial Sequence
  Synthetic
atcatagtagattcacaatatgtcatgggaataatagctgcacacccaacagaaacagaatcaccaatagtcaca

SEQ ID NO: 193943 - DNA, 75 bp, Artificial Sequence
  Synthetic
atcatagtagattcacaatatgtcatgggaataatagctgcacacccaacagaaacagaatcaccaatagtgaca

SEQ ID NO: 193944 - DNA, 75 bp, Artificial Sequence
  Synthetic
atcatagtagattcacaatatgtcatgggaataatagctgcacagccaacagaaacagaatcaccaatagtaaca

SEQ ID NO: 193945 - DNA, 75 bp, Artificial Sequence
  Synthetic
atcatagtagattcacaatatgtcatgggaataatagctgcacagccaacagaaacagaatcaccaatagttaca

SEQ ID NO: 193946 - DNA, 75 bp, Artificial Sequence
  Synthetic
atcatagtagattcacaatatgtcatgggaataatagctgcacagccaacagaaacagaatcaccaatagtcaca

SEQ ID NO: 193947 - DNA, 75 bp, Artificial Sequence
  Synthetic
atcatagtagattcacaatatgtcatgggaataatagctgcacagccaacagaaacagaatcaccaatagtgaca

SEQ ID NO: 193948 - DNA, 75 bp, Artificial Sequence
  Synthetic
aaaataattgaagaaatgatcaaaaaagaggcaatatatgtaggatgggtaccagcccacaagggactaggtggt

SEQ ID NO: 193949 - DNA, 75 bp, Artificial Sequence
  Synthetic
aaaataattgaagaaatgatcaaaaatgaggcaatatatgtaggatgggtaccagcccacaagggactaggtggt

SEQ ID NO: 193950 - DNA, 75 bp, Artificial Sequence
  Synthetic
aaaataattgaagaaatgatcaaaaacgaggcaatatatgtaggatgggtaccagcccacaagggactaggtggt

SEQ ID NO: 193951 - DNA, 75 bp, Artificial Sequence
  Synthetic
aaaataattgaagaaatgatcaaaaaggaggcaatatatgtaggatgggtaccagcccacaagggactaggtggt

SEQ ID NO: 193952 - DNA, 75 bp, Artificial Sequence
  Synthetic
ataataattgaagaaatgatcaaaaaagaggcaatatatgtaggatgggtaccagcccacaagggactaggtggt

SEQ ID NO: 193953 - DNA, 75 bp, Artificial Sequence
  Synthetic
ataataattgaagaaatgatcaaaaatgaggcaatatatgtaggatgggtaccagcccacaagggactaggtggt

SEQ ID NO: 193954 - DNA, 75 bp, Artificial Sequence
  Synthetic
ataataattgaagaaatgatcaaaaacgaggcaatatatgtaggatgggtaccagcccacaagggactaggtggt

SEQ ID NO: 193955 - DNA, 75 bp, Artificial Sequence
  Synthetic
ataataattgaagaaatgatcaaaaaggaggcaatatatgtaggatgggtaccagcccacaagggactaggtggt

SEQ ID NO: 193956 - DNA, 75 bp, Artificial Sequence
  Synthetic
acaataattgaagaaatgatcaaaaaagaggcaatatatgtaggatgggtaccagcccacaagggactaggtggt

SEQ ID NO: 193957 - DNA, 75 bp, Artificial Sequence
  Synthetic
acaataattgaagaaatgatcaaaaatgaggcaatatatgtaggatgggtaccagcccacaagggactaggtggt

SEQ ID NO: 193958 - DNA, 75 bp, Artificial Sequence
  Synthetic
acaataattgaagaaatgatcaaaaacgaggcaatatatgtaggatgggtaccagcccacaagggactaggtggt

SEQ ID NO: 193959 - DNA, 75 bp, Artificial Sequence
  Synthetic
acaataattgaagaaatgatcaaaaaggaggcaatatatgtaggatgggtaccagcccacaagggactaggtggt

SEQ ID NO: 193960 - DNA, 75 bp, Artificial Sequence
  Synthetic
agaataattgaagaaatgatcaaaaaagaggcaatatatgtaggatgggtaccagcccacaagggactaggtggt

SEQ ID NO: 193961 - DNA, 75 bp, Artificial Sequence
  Synthetic
agaataattgaagaaatgatcaaaaatgaggcaatatatgtaggatgggtaccagcccacaagggactaggtggt

SEQ ID NO: 193962 - DNA, 75 bp, Artificial Sequence
  Synthetic
agaataattgaagaaatgatcaaaaacgaggcaatatatgtaggatgggtaccagcccacaagggactaggtggt

SEQ ID NO: 193963 - DNA, 75 bp, Artificial Sequence
  Synthetic
agaataattgaagaaatgatcaaaaaggaggcaatatatgtaggatgggtaccagcccacaagggactaggtggt

SEQ ID NO: 193964 - DNA, 75 bp, Artificial Sequence
  Synthetic
aaccaagaagtagaccacctagtaagtcaaggaatcagacaggtcttgttcctagaaaaaatagaaccagctcag

SEQ ID NO: 193965 - DNA, 75 bp, Artificial Sequence
  Synthetic
cctagaaaaaatagaaccagctcaggaagagcatgaaaaatatcatggcaatgtaaaagaactggtccataaatt

SEQ ID NO: 193966 - DNA, 75 bp, Artificial Sequence
  Synthetic
cctagaaaaaatagaaccagctcaggaagagcatgaaaaatatcatggcaatgtaaaagatctggtccataaatt

SEQ ID NO: 193967 - DNA, 75 bp, Artificial Sequence
  Synthetic
cctagaaaaaatagaaccagctcaggaagagcatgaaaaatatcatggcaatgtaaaagacctggtccataaatt

SEQ ID NO: 193968 - DNA, 75 bp, Artificial Sequence
  Synthetic
cctagaaaaaatagaaccagctcaggaagagcatgaaaaatatcatggcaatgtaaaagagctggtccataaatt

SEQ ID NO: 193969 - DNA, 75 bp, Artificial Sequence
  Synthetic
cctagaaaaaatagaaccagctcaggaagagcatgataaatatcatggcaatgtaaaagaactggtccataaatt

SEQ ID NO: 193970 - DNA, 75 bp, Artificial Sequence
  Synthetic
cctagaaaaaatagaaccagctcaggaagagcatgataaatatcatggcaatgtaaaagatctggtccataaatt

SEQ ID NO: 193971 - DNA, 75 bp, Artificial Sequence
  Synthetic
cctagaaaaaatagaaccagctcaggaagagcatgataaatatcatggcaatgtaaaagacctggtccataaatt

SEQ ID NO: 193972 - DNA, 75 bp, Artificial Sequence
  Synthetic
cctagaaaaaatagaaccagctcaggaagagcatgataaatatcatggcaatgtaaaagagctggtccataaatt

SEQ ID NO: 193973 - DNA, 75 bp, Artificial Sequence
  Synthetic
cctagaaaaaatagaaccagctcaggaagagcatgacaaatatcatggcaatgtaaaagaactggtccataaatt

SEQ ID NO: 193974 - DNA, 75 bp, Artificial Sequence
  Synthetic
cctagaaaaaatagaaccagctcaggaagagcatgacaaatatcatggcaatgtaaaagatctggtccataaatt

SEQ ID NO: 193975 - DNA, 75 bp, Artificial Sequence
  Synthetic
cctagaaaaaatagaaccagctcaggaagagcatgacaaatatcatggcaatgtaaaagacctggtccataaatt

SEQ ID NO: 193976 - DNA, 75 bp, Artificial Sequence
  Synthetic
cctagaaaaaatagaaccagctcaggaagagcatgacaaatatcatggcaatgtaaaagagctggtccataaatt

SEQ ID NO: 193977 - DNA, 75 bp, Artificial Sequence
  Synthetic
cctagaaaaaatagaaccagctcaggaagagcatgagaaatatcatggcaatgtaaaagaactggtccataaatt

SEQ ID NO: 193978 - DNA, 75 bp, Artificial Sequence
  Synthetic
cctagaaaaaatagaaccagctcaggaagagcatgagaaatatcatggcaatgtaaaagatctggtccataaatt

SEQ ID NO: 193979 - DNA, 75 bp, Artificial Sequence
  Synthetic
cctagaaaaaatagaaccagctcaggaagagcatgagaaatatcatggcaatgtaaaagacctggtccataaatt

SEQ ID NO: 193980 - DNA, 75 bp, Artificial Sequence
  Synthetic
cctagaaaaaatagaaccagctcaggaagagcatgagaaatatcatggcaatgtaaaagagctggtccataaatt

SEQ ID NO: 193981 - DNA, 75 bp, Artificial Sequence
  Synthetic
gggaatcccacaattagtagcaaaacagatagtaaattcatgtgacaaatgccaacaaaaaggagaagctattca

SEQ ID NO: 193982 - DNA, 75 bp, Artificial Sequence
  Synthetic
gggaatcccacaattagtagcaaaacagatagtaaattcatgtgacaaatgccaacaaaaaggtgaagctattca

SEQ ID NO: 193983 - DNA, 75 bp, Artificial Sequence
  Synthetic
gggaatcccacaattagtagcaaaacagatagtaaattcatgtgacaaatgccaacaaaaaggcgaagctattca

SEQ ID NO: 193984 - DNA, 75 bp, Artificial Sequence
  Synthetic
gggaatcccacaattagtagcaaaacagatagtaaattcatgtgacaaatgccaacaaaaaggggaagctattca

SEQ ID NO: 193985 - DNA, 75 bp, Artificial Sequence
  Synthetic
gggaatcccacaattagtagcaaaacagatagtaaattcatgtgacaaatgccaacataaaggagaagctattca

SEQ ID NO: 193986 - DNA, 75 bp, Artificial Sequence
  Synthetic
gggaatcccacaattagtagcaaaacagatagtaaattcatgtgacaaatgccaacataaaggtgaagctattca

SEQ ID NO: 193987 - DNA, 75 bp, Artificial Sequence
  Synthetic
gggaatcccacaattagtagcaaaacagatagtaaattcatgtgacaaatgccaacataaaggcgaagctattca

SEQ ID NO: 193988 - DNA, 75 bp, Artificial Sequence
  Synthetic
gggaatcccacaattagtagcaaaacagatagtaaattcatgtgacaaatgccaacataaaggggaagctattca

SEQ ID NO: 193989 - DNA, 75 bp, Artificial Sequence
  Synthetic
gggaatcccacaattagtagcaaaacagatagtaaattcatgtgacaaatgccaacacaaaggagaagctattca

SEQ ID NO: 193990 - DNA, 75 bp, Artificial Sequence
  Synthetic
gggaatcccacaattagtagcaaaacagatagtaaattcatgtgacaaatgccaacacaaaggtgaagctattca

SEQ ID NO: 193991 - DNA, 75 bp, Artificial Sequence
  Synthetic
gggaatcccacaattagtagcaaaacagatagtaaattcatgtgacaaatgccaacacaaaggcgaagctattca

SEQ ID NO: 193992 - DNA, 75 bp, Artificial Sequence
  Synthetic
gggaatcccacaattagtagcaaaacagatagtaaattcatgtgacaaatgccaacacaaaggggaagctattca

SEQ ID NO: 193993 - DNA, 75 bp, Artificial Sequence
  Synthetic
gggaatcccacaattagtagcaaaacagatagtaaattcatgtgacaaatgccaacagaaaggagaagctattca

SEQ ID NO: 193994 - DNA, 75 bp, Artificial Sequence
  Synthetic
gggaatcccacaattagtagcaaaacagatagtaaattcatgtgacaaatgccaacagaaaggtgaagctattca

SEQ ID NO: 193995 - DNA, 75 bp, Artificial Sequence
  Synthetic
gggaatcccacaattagtagcaaaacagatagtaaattcatgtgacaaatgccaacagaaaggcgaagctattca

SEQ ID NO: 193996 - DNA, 75 bp, Artificial Sequence
  Synthetic
gggaatcccacaattagtagcaaaacagatagtaaattcatgtgacaaatgccaacagaaaggggaagctattca

SEQ ID NO: 193997 - DNA, 75 bp, Artificial Sequence
  Synthetic
gggaatcccacaattagttgcaaaacagatagtaaattcatgtgacaaatgccaacaaaaaggagaagctattca

SEQ ID NO: 193998 - DNA, 75 bp, Artificial Sequence
  Synthetic
gggaatcccacaattagttgcaaaacagatagtaaattcatgtgacaaatgccaacaaaaaggtgaagctattca

SEQ ID NO: 193999 - DNA, 75 bp, Artificial Sequence
  Synthetic
gggaatcccacaattagttgcaaaacagatagtaaattcatgtgacaaatgccaacaaaaaggcgaagctattca

SEQ ID NO: 194000 - DNA, 75 bp, Artificial Sequence
  Synthetic
gggaatcccacaattagttgcaaaacagatagtaaattcatgtgacaaatgccaacaaaaaggggaagctattca

SEQ ID NO: 194001 - DNA, 75 bp, Artificial Sequence
  Synthetic
gggaatcccacaattagttgcaaaacagatagtaaattcatgtgacaaatgccaacataaaggagaagctattca

SEQ ID NO: 194002 - DNA, 75 bp, Artificial Sequence
  Synthetic
gggaatcccacaattagttgcaaaacagatagtaaattcatgtgacaaatgccaacataaaggtgaagctattca

SEQ ID NO: 194003 - DNA, 75 bp, Artificial Sequence
  Synthetic
gggaatcccacaattagttgcaaaacagatagtaaattcatgtgacaaatgccaacataaaggcgaagctattca

SEQ ID NO: 194004 - DNA, 75 bp, Artificial Sequence
  Synthetic
gggaatcccacaattagttgcaaaacagatagtaaattcatgtgacaaatgccaacataaaggggaagctattca

SEQ ID NO: 194005 - DNA, 75 bp, Artificial Sequence
  Synthetic
gggaatcccacaattagttgcaaaacagatagtaaattcatgtgacaaatgccaacacaaaggagaagctattca

SEQ ID NO: 194006 - DNA, 75 bp, Artificial Sequence
  Synthetic
gggaatcccacaattagttgcaaaacagatagtaaattcatgtgacaaatgccaacacaaaggtgaagctattca

SEQ ID NO: 194007 - DNA, 75 bp, Artificial Sequence
  Synthetic
gggaatcccacaattagttgcaaaacagatagtaaattcatgtgacaaatgccaacacaaaggcgaagctattca

SEQ ID NO: 194008 - DNA, 75 bp, Artificial Sequence
  Synthetic
gggaatcccacaattagttgcaaaacagatagtaaattcatgtgacaaatgccaacacaaaggggaagctattca

SEQ ID NO: 194009 - DNA, 75 bp, Artificial Sequence
  Synthetic
gggaatcccacaattagttgcaaaacagatagtaaattcatgtgacaaatgccaacagaaaggagaagctattca

SEQ ID NO: 194010 - DNA, 75 bp, Artificial Sequence
  Synthetic
gggaatcccacaattagttgcaaaacagatagtaaattcatgtgacaaatgccaacagaaaggtgaagctattca

SEQ ID NO: 194011 - DNA, 75 bp, Artificial Sequence
  Synthetic
gggaatcccacaattagttgcaaaacagatagtaaattcatgtgacaaatgccaacagaaaggcgaagctattca

SEQ ID NO: 194012 - DNA, 75 bp, Artificial Sequence
  Synthetic
gggaatcccacaattagttgcaaaacagatagtaaattcatgtgacaaatgccaacagaaaggggaagctattca

SEQ ID NO: 194013 - DNA, 75 bp, Artificial Sequence
  Synthetic
gggaatcccacaattagtcgcaaaacagatagtaaattcatgtgacaaatgccaacaaaaaggagaagctattca

SEQ ID NO: 194014 - DNA, 75 bp, Artificial Sequence
  Synthetic
gggaatcccacaattagtcgcaaaacagatagtaaattcatgtgacaaatgccaacaaaaaggtgaagctattca

SEQ ID NO: 194015 - DNA, 75 bp, Artificial Sequence
  Synthetic
gggaatcccacaattagtcgcaaaacagatagtaaattcatgtgacaaatgccaacaaaaaggcgaagctattca

SEQ ID NO: 194016 - DNA, 75 bp, Artificial Sequence
  Synthetic
gggaatcccacaattagtcgcaaaacagatagtaaattcatgtgacaaatgccaacaaaaaggggaagctattca

SEQ ID NO: 194017 - DNA, 75 bp, Artificial Sequence
  Synthetic
gggaatcccacaattagtcgcaaaacagatagtaaattcatgtgacaaatgccaacataaaggagaagctattca

SEQ ID NO: 194018 - DNA, 75 bp, Artificial Sequence
  Synthetic
gggaatcccacaattagtcgcaaaacagatagtaaattcatgtgacaaatgccaacataaaggtgaagctattca

SEQ ID NO: 194019 - DNA, 75 bp, Artificial Sequence
  Synthetic
gggaatcccacaattagtcgcaaaacagatagtaaattcatgtgacaaatgccaacataaaggcgaagctattca

SEQ ID NO: 194020 - DNA, 75 bp, Artificial Sequence
  Synthetic
gggaatcccacaattagtcgcaaaacagatagtaaattcatgtgacaaatgccaacataaaggggaagctattca

SEQ ID NO: 194021 - DNA, 75 bp, Artificial Sequence
  Synthetic
gggaatcccacaattagtcgcaaaacagatagtaaattcatgtgacaaatgccaacacaaaggagaagctattca

SEQ ID NO: 194022 - DNA, 75 bp, Artificial Sequence
  Synthetic
gggaatcccacaattagtcgcaaaacagatagtaaattcatgtgacaaatgccaacacaaaggtgaagctattca

SEQ ID NO: 194023 - DNA, 75 bp, Artificial Sequence
  Synthetic
gggaatcccacaattagtcgcaaaacagatagtaaattcatgtgacaaatgccaacacaaaggcgaagctattca

SEQ ID NO: 194024 - DNA, 75 bp, Artificial Sequence
  Synthetic
gggaatcccacaattagtcgcaaaacagatagtaaattcatgtgacaaatgccaacacaaaggggaagctattca

SEQ ID NO: 194025 - DNA, 75 bp, Artificial Sequence
  Synthetic
gggaatcccacaattagtcgcaaaacagatagtaaattcatgtgacaaatgccaacagaaaggagaagctattca

SEQ ID NO: 194026 - DNA, 75 bp, Artificial Sequence
  Synthetic
gggaatcccacaattagtcgcaaaacagatagtaaattcatgtgacaaatgccaacagaaaggtgaagctattca

SEQ ID NO: 194027 - DNA, 75 bp, Artificial Sequence
  Synthetic
gggaatcccacaattagtcgcaaaacagatagtaaattcatgtgacaaatgccaacagaaaggcgaagctattca

SEQ ID NO: 194028 - DNA, 75 bp, Artificial Sequence
  Synthetic
gggaatcccacaattagtcgcaaaacagatagtaaattcatgtgacaaatgccaacagaaaggggaagctattca

SEQ ID NO: 194029 - DNA, 75 bp, Artificial Sequence
  Synthetic
gggaatcccacaattagtggcaaaacagatagtaaattcatgtgacaaatgccaacaaaaaggagaagctattca

SEQ ID NO: 194030 - DNA, 75 bp, Artificial Sequence
  Synthetic
gggaatcccacaattagtggcaaaacagatagtaaattcatgtgacaaatgccaacaaaaaggtgaagctattca

SEQ ID NO: 194031 - DNA, 75 bp, Artificial Sequence
  Synthetic
gggaatcccacaattagtggcaaaacagatagtaaattcatgtgacaaatgccaacaaaaaggcgaagctattca

SEQ ID NO: 194032 - DNA, 75 bp, Artificial Sequence
  Synthetic
gggaatcccacaattagtggcaaaacagatagtaaattcatgtgacaaatgccaacaaaaaggggaagctattca

SEQ ID NO: 194033 - DNA, 75 bp, Artificial Sequence
  Synthetic
gggaatcccacaattagtggcaaaacagatagtaaattcatgtgacaaatgccaacataaaggagaagctattca

SEQ ID NO: 194034 - DNA, 75 bp, Artificial Sequence
  Synthetic
gggaatcccacaattagtggcaaaacagatagtaaattcatgtgacaaatgccaacataaaggtgaagctattca

SEQ ID NO: 194035 - DNA, 75 bp, Artificial Sequence
  Synthetic
gggaatcccacaattagtggcaaaacagatagtaaattcatgtgacaaatgccaacataaaggcgaagctattca

SEQ ID NO: 194036 - DNA, 75 bp, Artificial Sequence
  Synthetic
gggaatcccacaattagtggcaaaacagatagtaaattcatgtgacaaatgccaacataaaggggaagctattca

SEQ ID NO: 194037 - DNA, 75 bp, Artificial Sequence
  Synthetic
gggaatcccacaattagtggcaaaacagatagtaaattcatgtgacaaatgccaacacaaaggagaagctattca

SEQ ID NO: 194038 - DNA, 75 bp, Artificial Sequence
  Synthetic
gggaatcccacaattagtggcaaaacagatagtaaattcatgtgacaaatgccaacacaaaggtgaagctattca

SEQ ID NO: 194039 - DNA, 75 bp, Artificial Sequence
  Synthetic
gggaatcccacaattagtggcaaaacagatagtaaattcatgtgacaaatgccaacacaaaggcgaagctattca

SEQ ID NO: 194040 - DNA, 75 bp, Artificial Sequence
  Synthetic
gggaatcccacaattagtggcaaaacagatagtaaattcatgtgacaaatgccaacacaaaggggaagctattca

SEQ ID NO: 194041 - DNA, 75 bp, Artificial Sequence
  Synthetic
gggaatcccacaattagtggcaaaacagatagtaaattcatgtgacaaatgccaacagaaaggagaagctattca

SEQ ID NO: 194042 - DNA, 75 bp, Artificial Sequence
  Synthetic
gggaatcccacaattagtggcaaaacagatagtaaattcatgtgacaaatgccaacagaaaggtgaagctattca

SEQ ID NO: 194043 - DNA, 75 bp, Artificial Sequence
  Synthetic
gggaatcccacaattagtggcaaaacagatagtaaattcatgtgacaaatgccaacagaaaggcgaagctattca

SEQ ID NO: 194044 - DNA, 75 bp, Artificial Sequence
  Synthetic
gggaatcccacaattagtggcaaaacagatagtaaattcatgtgacaaatgccaacagaaaggggaagctattca

SEQ ID NO: 194045 - DNA, 75 bp, Artificial Sequence
  Synthetic
tggacaggtaaatgcagaactagggacatggcagatggactgcacacatttagaaggaaagattataatagtagc

SEQ ID NO: 194046 - DNA, 75 bp, Artificial Sequence
  Synthetic
acccttgaaggagcaagaaagctcattgatatcttacagcgagccctcttcctgcacttcaaggcaggatgcagc

SEQ ID NO: 194047 - DNA, 75 bp, Artificial Sequence
  Synthetic
tagaaggaaagattataatagtagcagtccatgtagccagtgggttaatagaagcagaaataataccccaagaat

SEQ ID NO: 194048 - DNA, 75 bp, Artificial Sequence
  Synthetic
tagaaggaaagattataatagtagcagtccatgtagccagtgggttaatagaagcagaattaataccccaagaat

SEQ ID NO: 194049 - DNA, 75 bp, Artificial Sequence
  Synthetic
tagaaggaaagattataatagtagcagtccatgtagccagtgggttaatagaagcagaactaataccccaagaat

SEQ ID NO: 194050 - DNA, 75 bp, Artificial Sequence
  Synthetic
tagaaggaaagattataatagtagcagtccatgtagccagtgggttaatagaagcagaagtaataccccaagaat

SEQ ID NO: 194051 - DNA, 75 bp, Artificial Sequence
  Synthetic
tagaaggaaagattataatagtagcagtccatgtagccagtgggtttatagaagcagaaataataccccaagaat

SEQ ID NO: 194052 - DNA, 75 bp, Artificial Sequence
  Synthetic
tagaaggaaagattataatagtagcagtccatgtagccagtgggtttatagaagcagaattaataccccaagaat

SEQ ID NO: 194053 - DNA, 75 bp, Artificial Sequence
  Synthetic
tagaaggaaagattataatagtagcagtccatgtagccagtgggtttatagaagcagaactaataccccaagaat

SEQ ID NO: 194054 - DNA, 75 bp, Artificial Sequence
  Synthetic
tagaaggaaagattataatagtagcagtccatgtagccagtgggtttatagaagcagaagtaataccccaagaat

SEQ ID NO: 194055 - DNA, 75 bp, Artificial Sequence
  Synthetic
tagaaggaaagattataatagtagcagtccatgtagccagtgggttcatagaagcagaaataataccccaagaat

SEQ ID NO: 194056 - DNA, 75 bp, Artificial Sequence
  Synthetic
tagaaggaaagattataatagtagcagtccatgtagccagtgggttcatagaagcagaattaataccccaagaat

SEQ ID NO: 194057 - DNA, 75 bp, Artificial Sequence
  Synthetic
tagaaggaaagattataatagtagcagtccatgtagccagtgggttcatagaagcagaactaataccccaagaat

SEQ ID NO: 194058 - DNA, 75 bp, Artificial Sequence
  Synthetic
tagaaggaaagattataatagtagcagtccatgtagccagtgggttcatagaagcagaagtaataccccaagaat

SEQ ID NO: 194059 - DNA, 75 bp, Artificial Sequence
  Synthetic
tagaaggaaagattataatagtagcagtccatgtagccagtgggttgatagaagcagaaataataccccaagaat

SEQ ID NO: 194060 - DNA, 75 bp, Artificial Sequence
  Synthetic
tagaaggaaagattataatagtagcagtccatgtagccagtgggttgatagaagcagaattaataccccaagaat

SEQ ID NO: 194061 - DNA, 75 bp, Artificial Sequence
  Synthetic
tagaaggaaagattataatagtagcagtccatgtagccagtgggttgatagaagcagaactaataccccaagaat

SEQ ID NO: 194062 - DNA, 75 bp, Artificial Sequence
  Synthetic
tagaaggaaagattataatagtagcagtccatgtagccagtgggttgatagaagcagaagtaataccccaagaat

SEQ ID NO: 194063 - DNA, 75 bp, Artificial Sequence
  Synthetic
cctgcacttcaaggcaggatgcagccgatcaaaggttaatcagacaaggggaggagcttctctatcagctacacc

SEQ ID NO: 194064 - DNA, 75 bp, Artificial Sequence
  Synthetic
gttaaagttggccagcagatggcctatcacacacctgcacacagacaacggtgccaacttcacctcacaagatgt

SEQ ID NO: 194065 - DNA, 75 bp, Artificial Sequence
  Synthetic
gttaaagttggccagcagttggcctatcacacacctgcacacagacaacggtgccaacttcacctcacaagatgt

SEQ ID NO: 194066 - DNA, 75 bp, Artificial Sequence
  Synthetic
gttaaagttggccagcagctggcctatcacacacctgcacacagacaacggtgccaacttcacctcacaagatgt

SEQ ID NO: 194067 - DNA, 75 bp, Artificial Sequence
  Synthetic
gttaaagttggccagcaggtggcctatcacacacctgcacacagacaacggtgccaacttcacctcacaagatgt

SEQ ID NO: 194068 - DNA, 75 bp, Artificial Sequence
  Synthetic
gaagatggtagcctggtgggtaggaatagaacagacctttggagtaccctataacccacaaagtcaaggagtagt

SEQ ID NO: 194069 - DNA, 75 bp, Artificial Sequence
  Synthetic
ataacccacaaagtcaaggagtagtagaagcaatgaaccatcacctaaaaaatcagataagcagactcagagaac

SEQ ID NO: 194070 - DNA, 75 bp, Artificial Sequence
  Synthetic
ataacccacaaagtcaaggagtagtagaagcaatgaaccatcacctaaaaaatcagataagcagactcagagatc

SEQ ID NO: 194071 - DNA, 75 bp, Artificial Sequence
  Synthetic
ataacccacaaagtcaaggagtagtagaagcaatgaaccatcacctaaaaaatcagataagcagactcagagacc

SEQ ID NO: 194072 - DNA, 75 bp, Artificial Sequence
  Synthetic
ataacccacaaagtcaaggagtagtagaagcaatgaaccatcacctaaaaaatcagataagcagactcagagagc

SEQ ID NO: 194073 - DNA, 75 bp, Artificial Sequence
  Synthetic
ggaaaggggaaggagcagtcatcataaaggtagggacagaaatcaaagtagtacccaggagaaaggcaaaaatta

SEQ ID NO: 194074 - DNA, 75 bp, Artificial Sequence
  Synthetic
ggaaaggggaaggagcagtcatcttaaaggtagggacagaaatcaaagtagtacccaggagaaaggcaaaaatta

SEQ ID NO: 194075 - DNA, 75 bp, Artificial Sequence
  Synthetic
ggaaaggggaaggagcagtcatcctaaaggtagggacagaaatcaaagtagtacccaggagaaaggcaaaaatta

SEQ ID NO: 194076 - DNA, 75 bp, Artificial Sequence
  Synthetic
ggaaaggggaaggagcagtcatcgtaaaggtagggacagaaatcaaagtagtacccaggagaaaggcaaaaatta

SEQ ID NO: 194077 - DNA, 75 bp, Artificial Sequence
  Synthetic
taaggcactatggaggaggaaaaggattggattgtagtgccgacatggaagataccaggcaggctagcgagatgg

SEQ ID NO: 194078 - DNA, 75 bp, Artificial Sequence
  Synthetic
attggattgtagtgccgacatggaagataccaggcaggctagcgagatggcacagtctgatcaaataccttaagt

SEQ ID NO: 194079 - DNA, 75 bp, Artificial Sequence
  Synthetic
aacatgtatgaattacaaaaattaaatagctgggatgtttttggcaactggtttgatttaacctcctggatcaga

SEQ ID NO: 194080 - DNA, 75 bp, Artificial Sequence
  Synthetic
ctcttatgtccctcaccacaaggtaggatgggcttggtggacttgcagtagagtaatatttcccctagacaaaga

SEQ ID NO: 194081 - DNA, 75 bp, Artificial Sequence
  Synthetic
ctcttatgtccctcaccacaaggtaggatgggcttggtggacttgcagtagagtaatatttcccctagacaaagt

SEQ ID NO: 194082 - DNA, 75 bp, Artificial Sequence
  Synthetic
ctcttatgtccctcaccacaaggtaggatgggcttggtggacttgcagtagagtaatatttcccctagacaaagc

SEQ ID NO: 194083 - DNA, 75 bp, Artificial Sequence
  Synthetic
ctcttatgtccctcaccacaaggtaggatgggcttggtggacttgcagtagagtaatatttcccctagacaaagg

SEQ ID NO: 194084 - DNA, 75 bp, Artificial Sequence
  Synthetic
ctcttatgtccctcaccacaaggttggatgggcttggtggacttgcagtagagtaatatttcccctagacaaaga

SEQ ID NO: 194085 - DNA, 75 bp, Artificial Sequence
  Synthetic
ctcttatgtccctcaccacaaggttggatgggcttggtggacttgcagtagagtaatatttcccctagacaaagt

SEQ ID NO: 194086 - DNA, 75 bp, Artificial Sequence
  Synthetic
ctcttatgtccctcaccacaaggttggatgggcttggtggacttgcagtagagtaatatttcccctagacaaagc

SEQ ID NO: 194087 - DNA, 75 bp, Artificial Sequence
  Synthetic
ctcttatgtccctcaccacaaggttggatgggcttggtggacttgcagtagagtaatatttcccctagacaaagg

SEQ ID NO: 194088 - DNA, 75 bp, Artificial Sequence
  Synthetic
ctcttatgtccctcaccacaaggtcggatgggcttggtggacttgcagtagagtaatatttcccctagacaaaga

SEQ ID NO: 194089 - DNA, 75 bp, Artificial Sequence
  Synthetic
ctcttatgtccctcaccacaaggtcggatgggcttggtggacttgcagtagagtaatatttcccctagacaaagt

SEQ ID NO: 194090 - DNA, 75 bp, Artificial Sequence
  Synthetic
ctcttatgtccctcaccacaaggtcggatgggcttggtggacttgcagtagagtaatatttcccctagacaaagc

SEQ ID NO: 194091 - DNA, 75 bp, Artificial Sequence
  Synthetic
ctcttatgtccctcaccacaaggtcggatgggcttggtggacttgcagtagagtaatatttcccctagacaaagg

SEQ ID NO: 194092 - DNA, 75 bp, Artificial Sequence
  Synthetic
ctcttatgtccctcaccacaaggtgggatgggcttggtggacttgcagtagagtaatatttcccctagacaaaga

SEQ ID NO: 194093 - DNA, 75 bp, Artificial Sequence
  Synthetic
ctcttatgtccctcaccacaaggtgggatgggcttggtggacttgcagtagagtaatatttcccctagacaaagt

SEQ ID NO: 194094 - DNA, 75 bp, Artificial Sequence
  Synthetic
ctcttatgtccctcaccacaaggtgggatgggcttggtggacttgcagtagagtaatatttcccctagacaaagc

SEQ ID NO: 194095 - DNA, 75 bp, Artificial Sequence
  Synthetic
ctcttatgtccctcaccacaaggtgggatgggcttggtggacttgcagtagagtaatatttcccctagacaaagg

SEQ ID NO: 194096 - DNA, 75 bp, Artificial Sequence
  Synthetic
agcaaacctagaagtccaaggatattggaacctaaccccggaaaggggactcttgagcacctatgctgtaagact

SEQ ID NO: 194097 - DNA, 75 bp, Artificial Sequence
  Synthetic
agcaaacctagatgtccaaggatattggaacctaaccccggaaaggggactcttgagcacctatgctgtaagact

SEQ ID NO: 194098 - DNA, 75 bp, Artificial Sequence
  Synthetic
agcaaacctagacgtccaaggatattggaacctaaccccggaaaggggactcttgagcacctatgctgtaagact

SEQ ID NO: 194099 - DNA, 75 bp, Artificial Sequence
  Synthetic
agcaaacctagaggtccaaggatattggaacctaaccccggaaaggggactcttgagcacctatgctgtaagact

SEQ ID NO: 194100 - DNA, 75 bp, Artificial Sequence
  Synthetic
agcatacctagaagtccaaggatattggaacctaaccccggaaaggggactcttgagcacctatgctgtaagact

SEQ ID NO: 194101 - DNA, 75 bp, Artificial Sequence
  Synthetic
agcatacctagatgtccaaggatattggaacctaaccccggaaaggggactcttgagcacctatgctgtaagact

SEQ ID NO: 194102 - DNA, 75 bp, Artificial Sequence
  Synthetic
agcatacctagacgtccaaggatattggaacctaaccccggaaaggggactcttgagcacctatgctgtaagact

SEQ ID NO: 194103 - DNA, 75 bp, Artificial Sequence
  Synthetic
agcatacctagaggtccaaggatattggaacctaaccccggaaaggggactcttgagcacctatgctgtaagact

SEQ ID NO: 194104 - DNA, 75 bp, Artificial Sequence
  Synthetic
agcacacctagaagtccaaggatattggaacctaaccccggaaaggggactcttgagcacctatgctgtaagact

SEQ ID NO: 194105 - DNA, 75 bp, Artificial Sequence
  Synthetic
agcacacctagatgtccaaggatattggaacctaaccccggaaaggggactcttgagcacctatgctgtaagact

SEQ ID NO: 194106 - DNA, 75 bp, Artificial Sequence
  Synthetic
agcacacctagacgtccaaggatattggaacctaaccccggaaaggggactcttgagcacctatgctgtaagact

SEQ ID NO: 194107 - DNA, 75 bp, Artificial Sequence
  Synthetic
agcacacctagaggtccaaggatattggaacctaaccccggaaaggggactcttgagcacctatgctgtaagact

SEQ ID NO: 194108 - DNA, 75 bp, Artificial Sequence
  Synthetic
agcagacctagaagtccaaggatattggaacctaaccccggaaaggggactcttgagcacctatgctgtaagact

SEQ ID NO: 194109 - DNA, 75 bp, Artificial Sequence
  Synthetic
agcagacctagatgtccaaggatattggaacctaaccccggaaaggggactcttgagcacctatgctgtaagact

SEQ ID NO: 194110 - DNA, 75 bp, Artificial Sequence
  Synthetic
agcagacctagacgtccaaggatattggaacctaaccccggaaaggggactcttgagcacctatgctgtaagact

SEQ ID NO: 194111 - DNA, 75 bp, Artificial Sequence
  Synthetic
agcagacctagaggtccaaggatattggaacctaaccccggaaaggggactcttgagcacctatgctgtaagact

SEQ ID NO: 194112 - DNA, 75 bp, Artificial Sequence
  Synthetic
aacatggtaagagaggaacttttatacagatgtgacacctgatgtggcagaccagctactgcatgggtcttattt

SEQ ID NO: 194113 - DNA, 75 bp, Artificial Sequence
  Synthetic
aacatggtatgagaggaacttttatacagatgtgacacctgatgtggcagaccagctactgcatgggtcttattt

SEQ ID NO: 194114 - DNA, 75 bp, Artificial Sequence
  Synthetic
aacatggtacgagaggaacttttatacagatgtgacacctgatgtggcagaccagctactgcatgggtcttattt

SEQ ID NO: 194115 - DNA, 75 bp, Artificial Sequence
  Synthetic
aacatggtaggagaggaacttttatacagatgtgacacctgatgtggcagaccagctactgcatgggtcttattt

SEQ ID NO: 194116 - DNA, 75 bp, Artificial Sequence
  Synthetic
acagatgtgacacctgatgtggcagaccagctactgcatgggtcttatttctcttgctttacagccaatgaagta

SEQ ID NO: 194117 - DNA, 75 bp, Artificial Sequence
  Synthetic
agctcacgaagggcaggtaccaagcttacagtttctagccctaagggtcatacaggaaggaaaaaatggatccca

SEQ ID NO: 194118 - DNA, 75 bp, Artificial Sequence
  Synthetic
ttacagtttctagccctaagggtcatacaggaaggaaaaaatggatcccagggaaagaataccaccagggaacag

SEQ ID NO: 194119 - DNA, 75 bp, Artificial Sequence
  Synthetic
ggttggcgcccaacagggacttgaaagggactgagaagccctggaacacggctagtgaaggtagtaaggcggcag

SEQ ID NO: 194120 - DNA, 75 bp, Artificial Sequence
  Synthetic
ccacttgccccgagaactcattttccaggtctggcaaaggtgttgggcatactggcgtgatgaacagggcatgtc

SEQ ID NO: 194121 - DNA, 75 bp, Artificial Sequence
  Synthetic
agaggcctccgggtgaaggtaagtgcctacaccgaaaaccgtagccagaaaaggctagttatcctatcttttaga

SEQ ID NO: 194122 - DNA, 75 bp, Artificial Sequence
  Synthetic
ctgttgctaatgcagaaagcaatgtttgtgcactatacaaagggctgtacatgcaggcaggagggccatgggcca

SEQ ID NO: 194123 - DNA, 75 bp, Artificial Sequence
  Synthetic
ctgttgctaatgcagaaagcaatgtttgtgcactatacaaagggctgtacatgcaggcaggagggccatgggcct

SEQ ID NO: 194124 - DNA, 75 bp, Artificial Sequence
  Synthetic
ctgttgctaatgcagaaagcaatgtttgtgcactatacaaagggctgtacatgcaggcaggagggccatgggccc

SEQ ID NO: 194125 - DNA, 75 bp, Artificial Sequence
  Synthetic
ctgttgctaatgcagaaagcaatgtttgtgcactatacaaagggctgtacatgcaggcaggagggccatgggccg

SEQ ID NO: 194126 - DNA, 75 bp, Artificial Sequence
  Synthetic
tgggcagcgaacgaattggacaaattcggattggcagagagcctgttggagtcaaaagaaggttgccaaaagatt

SEQ ID NO: 194127 - DNA, 75 bp, Artificial Sequence
  Synthetic
atggcagaagcaaccacagagatccctccagagaacgagagcccacaaagagaacagtgggaagagagaataggg

SEQ ID NO: 194128 - DNA, 75 bp, Artificial Sequence
  Synthetic
atggcagaagcaaccacagagatccctccagagaacgagagcccacaaagagaacagtgggaagagagattaggg

SEQ ID NO: 194129 - DNA, 75 bp, Artificial Sequence
  Synthetic
atggcagaagcaaccacagagatccctccagagaacgagagcccacaaagagaacagtgggaagagagactaggg

SEQ ID NO: 194130 - DNA, 75 bp, Artificial Sequence
  Synthetic
atggcagaagcaaccacagagatccctccagagaacgagagcccacaaagagaacagtgggaagagagagtaggg

SEQ ID NO: 194131 - DNA, 75 bp, Artificial Sequence
  Synthetic
atggcagaagcaacctcagagatccctccagagaacgagagcccacaaagagaacagtgggaagagagaataggg

SEQ ID NO: 194132 - DNA, 75 bp, Artificial Sequence
  Synthetic
atggcagaagcaacctcagagatccctccagagaacgagagcccacaaagagaacagtgggaagagagattaggg

SEQ ID NO: 194133 - DNA, 75 bp, Artificial Sequence
  Synthetic
atggcagaagcaacctcagagatccctccagagaacgagagcccacaaagagaacagtgggaagagagactaggg

SEQ ID NO: 194134 - DNA, 75 bp, Artificial Sequence
  Synthetic
atggcagaagcaacctcagagatccctccagagaacgagagcccacaaagagaacagtgggaagagagagtaggg

SEQ ID NO: 194135 - DNA, 75 bp, Artificial Sequence
  Synthetic
atggcagaagcaaccccagagatccctccagagaacgagagcccacaaagagaacagtgggaagagagaataggg

SEQ ID NO: 194136 - DNA, 75 bp, Artificial Sequence
  Synthetic
atggcagaagcaaccccagagatccctccagagaacgagagcccacaaagagaacagtgggaagagagattaggg

SEQ ID NO: 194137 - DNA, 75 bp, Artificial Sequence
  Synthetic
atggcagaagcaaccccagagatccctccagagaacgagagcccacaaagagaacagtgggaagagagactaggg

SEQ ID NO: 194138 - DNA, 75 bp, Artificial Sequence
  Synthetic
atggcagaagcaaccccagagatccctccagagaacgagagcccacaaagagaacagtgggaagagagagtaggg

SEQ ID NO: 194139 - DNA, 75 bp, Artificial Sequence
  Synthetic
atggcagaagcaaccgcagagatccctccagagaacgagagcccacaaagagaacagtgggaagagagaataggg

SEQ ID NO: 194140 - DNA, 75 bp, Artificial Sequence
  Synthetic
atggcagaagcaaccgcagagatccctccagagaacgagagcccacaaagagaacagtgggaagagagattaggg

SEQ ID NO: 194141 - DNA, 75 bp, Artificial Sequence
  Synthetic
atggcagaagcaaccgcagagatccctccagagaacgagagcccacaaagagaacagtgggaagagagactaggg

SEQ ID NO: 194142 - DNA, 75 bp, Artificial Sequence
  Synthetic
atggcagaagcaaccgcagagatccctccagagaacgagagcccacaaagagaacagtgggaagagagagtaggg

SEQ ID NO: 194143 - DNA, 75 bp, Artificial Sequence
  Synthetic
atggcagaagcatccacagagatccctccagagaacgagagcccacaaagagaacagtgggaagagagaataggg

SEQ ID NO: 194144 - DNA, 75 bp, Artificial Sequence
  Synthetic
atggcagaagcatccacagagatccctccagagaacgagagcccacaaagagaacagtgggaagagagattaggg

SEQ ID NO: 194145 - DNA, 75 bp, Artificial Sequence
  Synthetic
atggcagaagcatccacagagatccctccagagaacgagagcccacaaagagaacagtgggaagagagactaggg

SEQ ID NO: 194146 - DNA, 75 bp, Artificial Sequence
  Synthetic
atggcagaagcatccacagagatccctccagagaacgagagcccacaaagagaacagtgggaagagagagtaggg

SEQ ID NO: 194147 - DNA, 75 bp, Artificial Sequence
  Synthetic
atggcagaagcatcctcagagatccctccagagaacgagagcccacaaagagaacagtgggaagagagaataggg

SEQ ID NO: 194148 - DNA, 75 bp, Artificial Sequence
  Synthetic
atggcagaagcatcctcagagatccctccagagaacgagagcccacaaagagaacagtgggaagagagattaggg

SEQ ID NO: 194149 - DNA, 75 bp, Artificial Sequence
  Synthetic
atggcagaagcatcctcagagatccctccagagaacgagagcccacaaagagaacagtgggaagagagactaggg

SEQ ID NO: 194150 - DNA, 75 bp, Artificial Sequence
  Synthetic
atggcagaagcatcctcagagatccctccagagaacgagagcccacaaagagaacagtgggaagagagagtaggg

SEQ ID NO: 194151 - DNA, 75 bp, Artificial Sequence
  Synthetic
atggcagaagcatccccagagatccctccagagaacgagagcccacaaagagaacagtgggaagagagaataggg

SEQ ID NO: 194152 - DNA, 75 bp, Artificial Sequence
  Synthetic
atggcagaagcatccccagagatccctccagagaacgagagcccacaaagagaacagtgggaagagagattaggg

SEQ ID NO: 194153 - DNA, 75 bp, Artificial Sequence
  Synthetic
atggcagaagcatccccagagatccctccagagaacgagagcccacaaagagaacagtgggaagagagactaggg

SEQ ID NO: 194154 - DNA, 75 bp, Artificial Sequence
  Synthetic
atggcagaagcatccccagagatccctccagagaacgagagcccacaaagagaacagtgggaagagagagtaggg

SEQ ID NO: 194155 - DNA, 75 bp, Artificial Sequence
  Synthetic
atggcagaagcatccgcagagatccctccagagaacgagagcccacaaagagaacagtgggaagagagaataggg

SEQ ID NO: 194156 - DNA, 75 bp, Artificial Sequence
  Synthetic
atggcagaagcatccgcagagatccctccagagaacgagagcccacaaagagaacagtgggaagagagattaggg

SEQ ID NO: 194157 - DNA, 75 bp, Artificial Sequence
  Synthetic
atggcagaagcatccgcagagatccctccagagaacgagagcccacaaagagaacagtgggaagagagactaggg

SEQ ID NO: 194158 - DNA, 75 bp, Artificial Sequence
  Synthetic
atggcagaagcatccgcagagatccctccagagaacgagagcccacaaagagaacagtgggaagagagagtaggg

SEQ ID NO: 194159 - DNA, 75 bp, Artificial Sequence
  Synthetic
atggcagaagcacccacagagatccctccagagaacgagagcccacaaagagaacagtgggaagagagaataggg

SEQ ID NO: 194160 - DNA, 75 bp, Artificial Sequence
  Synthetic
atggcagaagcacccacagagatccctccagagaacgagagcccacaaagagaacagtgggaagagagattaggg

SEQ ID NO: 194161 - DNA, 75 bp, Artificial Sequence
  Synthetic
atggcagaagcacccacagagatccctccagagaacgagagcccacaaagagaacagtgggaagagagactaggg

SEQ ID NO: 194162 - DNA, 75 bp, Artificial Sequence
  Synthetic
atggcagaagcacccacagagatccctccagagaacgagagcccacaaagagaacagtgggaagagagagtaggg

SEQ ID NO: 194163 - DNA, 75 bp, Artificial Sequence
  Synthetic
atggcagaagcaccctcagagatccctccagagaacgagagcccacaaagagaacagtgggaagagagaataggg

SEQ ID NO: 194164 - DNA, 75 bp, Artificial Sequence
  Synthetic
atggcagaagcaccctcagagatccctccagagaacgagagcccacaaagagaacagtgggaagagagattaggg

SEQ ID NO: 194165 - DNA, 75 bp, Artificial Sequence
  Synthetic
atggcagaagcaccctcagagatccctccagagaacgagagcccacaaagagaacagtgggaagagagactaggg

SEQ ID NO: 194166 - DNA, 75 bp, Artificial Sequence
  Synthetic
atggcagaagcaccctcagagatccctccagagaacgagagcccacaaagagaacagtgggaagagagagtaggg

SEQ ID NO: 194167 - DNA, 75 bp, Artificial Sequence
  Synthetic
atggcagaagcacccccagagatccctccagagaacgagagcccacaaagagaacagtgggaagagagaataggg

SEQ ID NO: 194168 - DNA, 75 bp, Artificial Sequence
  Synthetic
atggcagaagcacccccagagatccctccagagaacgagagcccacaaagagaacagtgggaagagagattaggg

SEQ ID NO: 194169 - DNA, 75 bp, Artificial Sequence
  Synthetic
atggcagaagcacccccagagatccctccagagaacgagagcccacaaagagaacagtgggaagagagactaggg

SEQ ID NO: 194170 - DNA, 75 bp, Artificial Sequence
  Synthetic
atggcagaagcacccccagagatccctccagagaacgagagcccacaaagagaacagtgggaagagagagtaggg

SEQ ID NO: 194171 - DNA, 75 bp, Artificial Sequence
  Synthetic
atggcagaagcacccgcagagatccctccagagaacgagagcccacaaagagaacagtgggaagagagaataggg

SEQ ID NO: 194172 - DNA, 75 bp, Artificial Sequence
  Synthetic
atggcagaagcacccgcagagatccctccagagaacgagagcccacaaagagaacagtgggaagagagattaggg

SEQ ID NO: 194173 - DNA, 75 bp, Artificial Sequence
  Synthetic
atggcagaagcacccgcagagatccctccagagaacgagagcccacaaagagaacagtgggaagagagactaggg

SEQ ID NO: 194174 - DNA, 75 bp, Artificial Sequence
  Synthetic
atggcagaagcacccgcagagatccctccagagaacgagagcccacaaagagaacagtgggaagagagagtaggg

SEQ ID NO: 194175 - DNA, 75 bp, Artificial Sequence
  Synthetic
atggcagaagcagccacagagatccctccagagaacgagagcccacaaagagaacagtgggaagagagaataggg

SEQ ID NO: 194176 - DNA, 75 bp, Artificial Sequence
  Synthetic
atggcagaagcagccacagagatccctccagagaacgagagcccacaaagagaacagtgggaagagagattaggg

SEQ ID NO: 194177 - DNA, 75 bp, Artificial Sequence
  Synthetic
atggcagaagcagccacagagatccctccagagaacgagagcccacaaagagaacagtgggaagagagactaggg

SEQ ID NO: 194178 - DNA, 75 bp, Artificial Sequence
  Synthetic
atggcagaagcagccacagagatccctccagagaacgagagcccacaaagagaacagtgggaagagagagtaggg

SEQ ID NO: 194179 - DNA, 75 bp, Artificial Sequence
  Synthetic
atggcagaagcagcctcagagatccctccagagaacgagagcccacaaagagaacagtgggaagagagaataggg

SEQ ID NO: 194180 - DNA, 75 bp, Artificial Sequence
  Synthetic
atggcagaagcagcctcagagatccctccagagaacgagagcccacaaagagaacagtgggaagagagattaggg

SEQ ID NO: 194181 - DNA, 75 bp, Artificial Sequence
  Synthetic
atggcagaagcagcctcagagatccctccagagaacgagagcccacaaagagaacagtgggaagagagactaggg

SEQ ID NO: 194182 - DNA, 75 bp, Artificial Sequence
  Synthetic
atggcagaagcagcctcagagatccctccagagaacgagagcccacaaagagaacagtgggaagagagagtaggg

SEQ ID NO: 194183 - DNA, 75 bp, Artificial Sequence
  Synthetic
atggcagaagcagccccagagatccctccagagaacgagagcccacaaagagaacagtgggaagagagaataggg

SEQ ID NO: 194184 - DNA, 75 bp, Artificial Sequence
  Synthetic
atggcagaagcagccccagagatccctccagagaacgagagcccacaaagagaacagtgggaagagagattaggg

SEQ ID NO: 194185 - DNA, 75 bp, Artificial Sequence
  Synthetic
atggcagaagcagccccagagatccctccagagaacgagagcccacaaagagaacagtgggaagagagactaggg

SEQ ID NO: 194186 - DNA, 75 bp, Artificial Sequence
  Synthetic
atggcagaagcagccccagagatccctccagagaacgagagcccacaaagagaacagtgggaagagagagtaggg

SEQ ID NO: 194187 - DNA, 75 bp, Artificial Sequence
  Synthetic
atggcagaagcagccgcagagatccctccagagaacgagagcccacaaagagaacagtgggaagagagaataggg

SEQ ID NO: 194188 - DNA, 75 bp, Artificial Sequence
  Synthetic
atggcagaagcagccgcagagatccctccagagaacgagagcccacaaagagaacagtgggaagagagattaggg

SEQ ID NO: 194189 - DNA, 75 bp, Artificial Sequence
  Synthetic
atggcagaagcagccgcagagatccctccagagaacgagagcccacaaagagaacagtgggaagagagactaggg

SEQ ID NO: 194190 - DNA, 75 bp, Artificial Sequence
  Synthetic
atggcagaagcagccgcagagatccctccagagaacgagagcccacaaagagaacagtgggaagagagagtaggg

SEQ ID NO: 194191 - DNA, 75 bp, Artificial Sequence
  Synthetic
gagatcctggaggaaataaagcaagaagccataaagcattttgatcctcgcttgctaaatgcgcttggtaacttt

SEQ ID NO: 194192 - DNA, 75 bp, Artificial Sequence
  Synthetic
gagatcctggaggaaataaagcaagaagccataaagcattttgatcctcgcttgctaattgcgcttggtaacttt

SEQ ID NO: 194193 - DNA, 75 bp, Artificial Sequence
  Synthetic
gagatcctggaggaaataaagcaagaagccataaagcattttgatcctcgcttgctaactgcgcttggtaacttt

SEQ ID NO: 194194 - DNA, 75 bp, Artificial Sequence
  Synthetic
gagatcctggaggaaataaagcaagaagccataaagcattttgatcctcgcttgctaagtgcgcttggtaacttt

SEQ ID NO: 194195 - DNA, 75 bp, Artificial Sequence
  Synthetic
gagatcctggaggaaataaagcaagaagccttaaagcattttgatcctcgcttgctaaatgcgcttggtaacttt

SEQ ID NO: 194196 - DNA, 75 bp, Artificial Sequence
  Synthetic
gagatcctggaggaaataaagcaagaagccttaaagcattttgatcctcgcttgctaattgcgcttggtaacttt

SEQ ID NO: 194197 - DNA, 75 bp, Artificial Sequence
  Synthetic
gagatcctggaggaaataaagcaagaagccttaaagcattttgatcctcgcttgctaactgcgcttggtaacttt

SEQ ID NO: 194198 - DNA, 75 bp, Artificial Sequence
  Synthetic
gagatcctggaggaaataaagcaagaagccttaaagcattttgatcctcgcttgctaagtgcgcttggtaacttt

SEQ ID NO: 194199 - DNA, 75 bp, Artificial Sequence
  Synthetic
gagatcctggaggaaataaagcaagaagccctaaagcattttgatcctcgcttgctaaatgcgcttggtaacttt

SEQ ID NO: 194200 - DNA, 75 bp, Artificial Sequence
  Synthetic
gagatcctggaggaaataaagcaagaagccctaaagcattttgatcctcgcttgctaattgcgcttggtaacttt

SEQ ID NO: 194201 - DNA, 75 bp, Artificial Sequence
  Synthetic
gagatcctggaggaaataaagcaagaagccctaaagcattttgatcctcgcttgctaactgcgcttggtaacttt

SEQ ID NO: 194202 - DNA, 75 bp, Artificial Sequence
  Synthetic
gagatcctggaggaaataaagcaagaagccctaaagcattttgatcctcgcttgctaagtgcgcttggtaacttt

SEQ ID NO: 194203 - DNA, 75 bp, Artificial Sequence
  Synthetic
gagatcctggaggaaataaagcaagaagccgtaaagcattttgatcctcgcttgctaaatgcgcttggtaacttt

SEQ ID NO: 194204 - DNA, 75 bp, Artificial Sequence
  Synthetic
gagatcctggaggaaataaagcaagaagccgtaaagcattttgatcctcgcttgctaattgcgcttggtaacttt

SEQ ID NO: 194205 - DNA, 75 bp, Artificial Sequence
  Synthetic
gagatcctggaggaaataaagcaagaagccgtaaagcattttgatcctcgcttgctaactgcgcttggtaacttt

SEQ ID NO: 194206 - DNA, 75 bp, Artificial Sequence
  Synthetic
gagatcctggaggaaataaagcaagaagccgtaaagcattttgatcctcgcttgctaagtgcgcttggtaacttt

SEQ ID NO: 194207 - DNA, 75 bp, Artificial Sequence
  Synthetic
cttgctaaatgcgcttggtaactttatctacagtaggtatggagatacccttgcaggggcaggagagctcgttaa

SEQ ID NO: 194208 - DNA, 75 bp, Artificial Sequence
  Synthetic
cttgctaattgcgcttggtaactttatctacagtaggtatggagatacccttgcaggggcaggagagctcgttaa

SEQ ID NO: 194209 - DNA, 75 bp, Artificial Sequence
  Synthetic
cttgctaactgcgcttggtaactttatctacagtaggtatggagatacccttgcaggggcaggagagctcgttaa

SEQ ID NO: 194210 - DNA, 75 bp, Artificial Sequence
  Synthetic
cttgctaagtgcgcttggtaactttatctacagtaggtatggagatacccttgcaggggcaggagagctcgttaa

SEQ ID NO: 194211 - DNA, 75 bp, Artificial Sequence
  Synthetic
caagtacaagtagaccaacagcaccacctagcgggagaggaagaaacttccctgtacaacagacaggcggtggca

SEQ ID NO: 194212 - DNA, 75 bp, Artificial Sequence
  Synthetic
aaatcctctctcaactataccgcccccttaaggcatgcaataataaatgctactgtaaaaaatgctgctaccatt

SEQ ID NO: 194213 - DNA, 75 bp, Artificial Sequence
  Synthetic
aaatcctctctcaactataccgcccccttaaggcatgcaataataaatgctactgtaaaatatgctgctaccatt

SEQ ID NO: 194214 - DNA, 75 bp, Artificial Sequence
  Synthetic
aaatcctctctcaactataccgcccccttaaggcatgcaataataaatgctactgtaaaacatgctgctaccatt

SEQ ID NO: 194215 - DNA, 75 bp, Artificial Sequence
  Synthetic
aaatcctctctcaactataccgcccccttaaggcatgcaataataaatgctactgtaaaagatgctgctaccatt

SEQ ID NO: 194216 - DNA, 75 bp, Artificial Sequence
  Synthetic
aaatcctctctcatctataccgcccccttaaggcatgcaataataaatgctactgtaaaaaatgctgctaccatt

SEQ ID NO: 194217 - DNA, 75 bp, Artificial Sequence
  Synthetic
aaatcctctctcatctataccgcccccttaaggcatgcaataataaatgctactgtaaaatatgctgctaccatt

SEQ ID NO: 194218 - DNA, 75 bp, Artificial Sequence
  Synthetic
aaatcctctctcatctataccgcccccttaaggcatgcaataataaatgctactgtaaaacatgctgctaccatt

SEQ ID NO: 194219 - DNA, 75 bp, Artificial Sequence
  Synthetic
aaatcctctctcatctataccgcccccttaaggcatgcaataataaatgctactgtaaaagatgctgctaccatt

SEQ ID NO: 194220 - DNA, 75 bp, Artificial Sequence
  Synthetic
aaatcctctctcacctataccgcccccttaaggcatgcaataataaatgctactgtaaaaaatgctgctaccatt

SEQ ID NO: 194221 - DNA, 75 bp, Artificial Sequence
  Synthetic
aaatcctctctcacctataccgcccccttaaggcatgcaataataaatgctactgtaaaatatgctgctaccatt

SEQ ID NO: 194222 - DNA, 75 bp, Artificial Sequence
  Synthetic
aaatcctctctcacctataccgcccccttaaggcatgcaataataaatgctactgtaaaacatgctgctaccatt

SEQ ID NO: 194223 - DNA, 75 bp, Artificial Sequence
  Synthetic
aaatcctctctcacctataccgcccccttaaggcatgcaataataaatgctactgtaaaagatgctgctaccatt

SEQ ID NO: 194224 - DNA, 75 bp, Artificial Sequence
  Synthetic
aaatcctctctcagctataccgcccccttaaggcatgcaataataaatgctactgtaaaaaatgctgctaccatt

SEQ ID NO: 194225 - DNA, 75 bp, Artificial Sequence
  Synthetic
aaatcctctctcagctataccgcccccttaaggcatgcaataataaatgctactgtaaaatatgctgctaccatt

SEQ ID NO: 194226 - DNA, 75 bp, Artificial Sequence
  Synthetic
aaatcctctctcagctataccgcccccttaaggcatgcaataataaatgctactgtaaaacatgctgctaccatt

SEQ ID NO: 194227 - DNA, 75 bp, Artificial Sequence
  Synthetic
aaatcctctctcagctataccgcccccttaaggcatgcaataataaatgctactgtaaaagatgctgctaccatt

SEQ ID NO: 194228 - DNA, 75 bp, Artificial Sequence
  Synthetic
gccagctttgttttcttagaaaaggtcttgggatatggtatgaccactcgagaaagagaaaaagagctaagacta

SEQ ID NO: 194229 - DNA, 75 bp, Artificial Sequence
  Synthetic
ctgcatctcctgcaccagacaagtgagtatggcatattctagcagctgcctgcctatcacgctcctgcttctaag

SEQ ID NO: 194230 - DNA, 75 bp, Artificial Sequence
  Synthetic
tatctgtgggtttacatgaaaacaatatatcactgtcttctatggcatacccgcgtggaaaaatgcatcaatgcc

SEQ ID NO: 194231 - DNA, 75 bp, Artificial Sequence
  Synthetic
tatctgtgggtttacatgaaaacaatatatcactgtcttctatggcatacccgcgtggaaaaatgcatctatgcc

SEQ ID NO: 194232 - DNA, 75 bp, Artificial Sequence
  Synthetic
tatctgtgggtttacatgaaaacaatatatcactgtcttctatggcatacccgcgtggaaaaatgcatccatgcc

SEQ ID NO: 194233 - DNA, 75 bp, Artificial Sequence
  Synthetic
tatctgtgggtttacatgaaaacaatatatcactgtcttctatggcatacccgcgtggaaaaatgcatcgatgcc

SEQ ID NO: 194234 - DNA, 75 bp, Artificial Sequence
  Synthetic
tatctgtgggtttacatgaaaacaatatatcactgtcttctatggcatacccgcgtggataaatgcatcaatgcc

SEQ ID NO: 194235 - DNA, 75 bp, Artificial Sequence
  Synthetic
tatctgtgggtttacatgaaaacaatatatcactgtcttctatggcatacccgcgtggataaatgcatctatgcc

SEQ ID NO: 194236 - DNA, 75 bp, Artificial Sequence
  Synthetic
tatctgtgggtttacatgaaaacaatatatcactgtcttctatggcatacccgcgtggataaatgcatccatgcc

SEQ ID NO: 194237 - DNA, 75 bp, Artificial Sequence
  Synthetic
tatctgtgggtttacatgaaaacaatatatcactgtcttctatggcatacccgcgtggataaatgcatcgatgcc

SEQ ID NO: 194238 - DNA, 75 bp, Artificial Sequence
  Synthetic
tatctgtgggtttacatgaaaacaatatatcactgtcttctatggcatacccgcgtggacaaatgcatcaatgcc

SEQ ID NO: 194239 - DNA, 75 bp, Artificial Sequence
  Synthetic
tatctgtgggtttacatgaaaacaatatatcactgtcttctatggcatacccgcgtggacaaatgcatctatgcc

SEQ ID NO: 194240 - DNA, 75 bp, Artificial Sequence
  Synthetic
tatctgtgggtttacatgaaaacaatatatcactgtcttctatggcatacccgcgtggacaaatgcatccatgcc

SEQ ID NO: 194241 - DNA, 75 bp, Artificial Sequence
  Synthetic
tatctgtgggtttacatgaaaacaatatatcactgtcttctatggcatacccgcgtggacaaatgcatcgatgcc

SEQ ID NO: 194242 - DNA, 75 bp, Artificial Sequence
  Synthetic
tatctgtgggtttacatgaaaacaatatatcactgtcttctatggcatacccgcgtggagaaatgcatcaatgcc

SEQ ID NO: 194243 - DNA, 75 bp, Artificial Sequence
  Synthetic
tatctgtgggtttacatgaaaacaatatatcactgtcttctatggcatacccgcgtggagaaatgcatctatgcc

SEQ ID NO: 194244 - DNA, 75 bp, Artificial Sequence
  Synthetic
tatctgtgggtttacatgaaaacaatatatcactgtcttctatggcatacccgcgtggagaaatgcatccatgcc

SEQ ID NO: 194245 - DNA, 75 bp, Artificial Sequence
  Synthetic
tatctgtgggtttacatgaaaacaatatatcactgtcttctatggcatacccgcgtggagaaatgcatcgatgcc

SEQ ID NO: 194246 - DNA, 75 bp, Artificial Sequence
  Synthetic
tatctgtgggtttacatgtaaacaatatatcactgtcttctatggcatacccgcgtggaaaaatgcatcaatgcc

SEQ ID NO: 194247 - DNA, 75 bp, Artificial Sequence
  Synthetic
tatctgtgggtttacatgtaaacaatatatcactgtcttctatggcatacccgcgtggaaaaatgcatctatgcc

SEQ ID NO: 194248 - DNA, 75 bp, Artificial Sequence
  Synthetic
tatctgtgggtttacatgtaaacaatatatcactgtcttctatggcatacccgcgtggaaaaatgcatccatgcc

SEQ ID NO: 194249 - DNA, 75 bp, Artificial Sequence
  Synthetic
tatctgtgggtttacatgtaaacaatatatcactgtcttctatggcatacccgcgtggaaaaatgcatcgatgcc

SEQ ID NO: 194250 - DNA, 75 bp, Artificial Sequence
  Synthetic
tatctgtgggtttacatgtaaacaatatatcactgtcttctatggcatacccgcgtggataaatgcatcaatgcc

SEQ ID NO: 194251 - DNA, 75 bp, Artificial Sequence
  Synthetic
tatctgtgggtttacatgtaaacaatatatcactgtcttctatggcatacccgcgtggataaatgcatctatgcc

SEQ ID NO: 194252 - DNA, 75 bp, Artificial Sequence
  Synthetic
tatctgtgggtttacatgtaaacaatatatcactgtcttctatggcatacccgcgtggataaatgcatccatgcc

SEQ ID NO: 194253 - DNA, 75 bp, Artificial Sequence
  Synthetic
tatctgtgggtttacatgtaaacaatatatcactgtcttctatggcatacccgcgtggataaatgcatcgatgcc

SEQ ID NO: 194254 - DNA, 75 bp, Artificial Sequence
  Synthetic
tatctgtgggtttacatgtaaacaatatatcactgtcttctatggcatacccgcgtggacaaatgcatcaatgcc

SEQ ID NO: 194255 - DNA, 75 bp, Artificial Sequence
  Synthetic
tatctgtgggtttacatgtaaacaatatatcactgtcttctatggcatacccgcgtggacaaatgcatctatgcc

SEQ ID NO: 194256 - DNA, 75 bp, Artificial Sequence
  Synthetic
tatctgtgggtttacatgtaaacaatatatcactgtcttctatggcatacccgcgtggacaaatgcatccatgcc

SEQ ID NO: 194257 - DNA, 75 bp, Artificial Sequence
  Synthetic
tatctgtgggtttacatgtaaacaatatatcactgtcttctatggcatacccgcgtggacaaatgcatcgatgcc

SEQ ID NO: 194258 - DNA, 75 bp, Artificial Sequence
  Synthetic
tatctgtgggtttacatgtaaacaatatatcactgtcttctatggcatacccgcgtggagaaatgcatcaatgcc

SEQ ID NO: 194259 - DNA, 75 bp, Artificial Sequence
  Synthetic
tatctgtgggtttacatgtaaacaatatatcactgtcttctatggcatacccgcgtggagaaatgcatctatgcc

SEQ ID NO: 194260 - DNA, 75 bp, Artificial Sequence
  Synthetic
tatctgtgggtttacatgtaaacaatatatcactgtcttctatggcatacccgcgtggagaaatgcatccatgcc

SEQ ID NO: 194261 - DNA, 75 bp, Artificial Sequence
  Synthetic
tatctgtgggtttacatgtaaacaatatatcactgtcttctatggcatacccgcgtggagaaatgcatcgatgcc

SEQ ID NO: 194262 - DNA, 75 bp, Artificial Sequence
  Synthetic
tatctgtgggtttacatgcaaacaatatatcactgtcttctatggcatacccgcgtggaaaaatgcatcaatgcc

SEQ ID NO: 194263 - DNA, 75 bp, Artificial Sequence
  Synthetic
tatctgtgggtttacatgcaaacaatatatcactgtcttctatggcatacccgcgtggaaaaatgcatctatgcc

SEQ ID NO: 194264 - DNA, 75 bp, Artificial Sequence
  Synthetic
tatctgtgggtttacatgcaaacaatatatcactgtcttctatggcatacccgcgtggaaaaatgcatccatgcc

SEQ ID NO: 194265 - DNA, 75 bp, Artificial Sequence
  Synthetic
tatctgtgggtttacatgcaaacaatatatcactgtcttctatggcatacccgcgtggaaaaatgcatcgatgcc

SEQ ID NO: 194266 - DNA, 75 bp, Artificial Sequence
  Synthetic
tatctgtgggtttacatgcaaacaatatatcactgtcttctatggcatacccgcgtggataaatgcatcaatgcc

SEQ ID NO: 194267 - DNA, 75 bp, Artificial Sequence
  Synthetic
tatctgtgggtttacatgcaaacaatatatcactgtcttctatggcatacccgcgtggataaatgcatctatgcc

SEQ ID NO: 194268 - DNA, 75 bp, Artificial Sequence
  Synthetic
tatctgtgggtttacatgcaaacaatatatcactgtcttctatggcatacccgcgtggataaatgcatccatgcc

SEQ ID NO: 194269 - DNA, 75 bp, Artificial Sequence
  Synthetic
tatctgtgggtttacatgcaaacaatatatcactgtcttctatggcatacccgcgtggataaatgcatcgatgcc

SEQ ID NO: 194270 - DNA, 75 bp, Artificial Sequence
  Synthetic
tatctgtgggtttacatgcaaacaatatatcactgtcttctatggcatacccgcgtggacaaatgcatcaatgcc

SEQ ID NO: 194271 - DNA, 75 bp, Artificial Sequence
  Synthetic
tatctgtgggtttacatgcaaacaatatatcactgtcttctatggcatacccgcgtggacaaatgcatctatgcc

SEQ ID NO: 194272 - DNA, 75 bp, Artificial Sequence
  Synthetic
tatctgtgggtttacatgcaaacaatatatcactgtcttctatggcatacccgcgtggacaaatgcatccatgcc

SEQ ID NO: 194273 - DNA, 75 bp, Artificial Sequence
  Synthetic
tatctgtgggtttacatgcaaacaatatatcactgtcttctatggcatacccgcgtggacaaatgcatcgatgcc

SEQ ID NO: 194274 - DNA, 75 bp, Artificial Sequence
  Synthetic
tatctgtgggtttacatgcaaacaatatatcactgtcttctatggcatacccgcgtggagaaatgcatcaatgcc

SEQ ID NO: 194275 - DNA, 75 bp, Artificial Sequence
  Synthetic
tatctgtgggtttacatgcaaacaatatatcactgtcttctatggcatacccgcgtggagaaatgcatctatgcc

SEQ ID NO: 194276 - DNA, 75 bp, Artificial Sequence
  Synthetic
tatctgtgggtttacatgcaaacaatatatcactgtcttctatggcatacccgcgtggagaaatgcatccatgcc

SEQ ID NO: 194277 - DNA, 75 bp, Artificial Sequence
  Synthetic
tatctgtgggtttacatgcaaacaatatatcactgtcttctatggcatacccgcgtggagaaatgcatcgatgcc

SEQ ID NO: 194278 - DNA, 75 bp, Artificial Sequence
  Synthetic
tatctgtgggtttacatggaaacaatatatcactgtcttctatggcatacccgcgtggaaaaatgcatcaatgcc

SEQ ID NO: 194279 - DNA, 75 bp, Artificial Sequence
  Synthetic
tatctgtgggtttacatggaaacaatatatcactgtcttctatggcatacccgcgtggaaaaatgcatctatgcc

SEQ ID NO: 194280 - DNA, 75 bp, Artificial Sequence
  Synthetic
tatctgtgggtttacatggaaacaatatatcactgtcttctatggcatacccgcgtggaaaaatgcatccatgcc

SEQ ID NO: 194281 - DNA, 75 bp, Artificial Sequence
  Synthetic
tatctgtgggtttacatggaaacaatatatcactgtcttctatggcatacccgcgtggaaaaatgcatcgatgcc

SEQ ID NO: 194282 - DNA, 75 bp, Artificial Sequence
  Synthetic
tatctgtgggtttacatggaaacaatatatcactgtcttctatggcatacccgcgtggataaatgcatcaatgcc

SEQ ID NO: 194283 - DNA, 75 bp, Artificial Sequence
  Synthetic
tatctgtgggtttacatggaaacaatatatcactgtcttctatggcatacccgcgtggataaatgcatctatgcc

SEQ ID NO: 194284 - DNA, 75 bp, Artificial Sequence
  Synthetic
tatctgtgggtttacatggaaacaatatatcactgtcttctatggcatacccgcgtggataaatgcatccatgcc

SEQ ID NO: 194285 - DNA, 75 bp, Artificial Sequence
  Synthetic
tatctgtgggtttacatggaaacaatatatcactgtcttctatggcatacccgcgtggataaatgcatcgatgcc

SEQ ID NO: 194286 - DNA, 75 bp, Artificial Sequence
  Synthetic
tatctgtgggtttacatggaaacaatatatcactgtcttctatggcatacccgcgtggacaaatgcatcaatgcc

SEQ ID NO: 194287 - DNA, 75 bp, Artificial Sequence
  Synthetic
tatctgtgggtttacatggaaacaatatatcactgtcttctatggcatacccgcgtggacaaatgcatctatgcc

SEQ ID NO: 194288 - DNA, 75 bp, Artificial Sequence
  Synthetic
tatctgtgggtttacatggaaacaatatatcactgtcttctatggcatacccgcgtggacaaatgcatccatgcc

SEQ ID NO: 194289 - DNA, 75 bp, Artificial Sequence
  Synthetic
tatctgtgggtttacatggaaacaatatatcactgtcttctatggcatacccgcgtggacaaatgcatcgatgcc

SEQ ID NO: 194290 - DNA, 75 bp, Artificial Sequence
  Synthetic
tatctgtgggtttacatggaaacaatatatcactgtcttctatggcatacccgcgtggagaaatgcatcaatgcc

SEQ ID NO: 194291 - DNA, 75 bp, Artificial Sequence
  Synthetic
tatctgtgggtttacatggaaacaatatatcactgtcttctatggcatacccgcgtggagaaatgcatctatgcc

SEQ ID NO: 194292 - DNA, 75 bp, Artificial Sequence
  Synthetic
tatctgtgggtttacatggaaacaatatatcactgtcttctatggcatacccgcgtggagaaatgcatccatgcc

SEQ ID NO: 194293 - DNA, 75 bp, Artificial Sequence
  Synthetic
tatctgtgggtttacatggaaacaatatatcactgtcttctatggcatacccgcgtggagaaatgcatcgatgcc

SEQ ID NO: 194294 - DNA, 75 bp, Artificial Sequence
  Synthetic
tatataactgtcttctatggcatacccgcgtggagaaatgcatcaatacccctgttatgtgcaactaaaaataga

SEQ ID NO: 194295 - DNA, 75 bp, Artificial Sequence
  Synthetic
tatataactgtcttctatggcatacccgcgtggagaaatgcatcaatacccctgttttgtgcaactaaaaataga

SEQ ID NO: 194296 - DNA, 75 bp, Artificial Sequence
  Synthetic
tatataactgtcttctatggcatacccgcgtggagaaatgcatcaatacccctgttctgtgcaactaaaaataga

SEQ ID NO: 194297 - DNA, 75 bp, Artificial Sequence
  Synthetic
tatataactgtcttctatggcatacccgcgtggagaaatgcatcaatacccctgttgtgtgcaactaaaaataga

SEQ ID NO: 194298 - DNA, 75 bp, Artificial Sequence
  Synthetic
tatataactgtcttctatggcatacccgcgtggagaaatgcatcaattcccctgttatgtgcaactaaaaataga

SEQ ID NO: 194299 - DNA, 75 bp, Artificial Sequence
  Synthetic
tatataactgtcttctatggcatacccgcgtggagaaatgcatcaattcccctgttttgtgcaactaaaaataga

SEQ ID NO: 194300 - DNA, 75 bp, Artificial Sequence
  Synthetic
tatataactgtcttctatggcatacccgcgtggagaaatgcatcaattcccctgttctgtgcaactaaaaataga

SEQ ID NO: 194301 - DNA, 75 bp, Artificial Sequence
  Synthetic
tatataactgtcttctatggcatacccgcgtggagaaatgcatcaattcccctgttgtgtgcaactaaaaataga

SEQ ID NO: 194302 - DNA, 75 bp, Artificial Sequence
  Synthetic
tatataactgtcttctatggcatacccgcgtggagaaatgcatcaatccccctgttatgtgcaactaaaaataga

SEQ ID NO: 194303 - DNA, 75 bp, Artificial Sequence
  Synthetic
tatataactgtcttctatggcatacccgcgtggagaaatgcatcaatccccctgttttgtgcaactaaaaataga

SEQ ID NO: 194304 - DNA, 75 bp, Artificial Sequence
  Synthetic
tatataactgtcttctatggcatacccgcgtggagaaatgcatcaatccccctgttctgtgcaactaaaaataga

SEQ ID NO: 194305 - DNA, 75 bp, Artificial Sequence
  Synthetic
tatataactgtcttctatggcatacccgcgtggagaaatgcatcaatccccctgttgtgtgcaactaaaaataga

SEQ ID NO: 194306 - DNA, 75 bp, Artificial Sequence
  Synthetic
tatataactgtcttctatggcatacccgcgtggagaaatgcatcaatgcccctgttatgtgcaactaaaaataga

SEQ ID NO: 194307 - DNA, 75 bp, Artificial Sequence
  Synthetic
tatataactgtcttctatggcatacccgcgtggagaaatgcatcaatgcccctgttttgtgcaactaaaaataga

SEQ ID NO: 194308 - DNA, 75 bp, Artificial Sequence
  Synthetic
tatataactgtcttctatggcatacccgcgtggagaaatgcatcaatgcccctgttctgtgcaactaaaaataga

SEQ ID NO: 194309 - DNA, 75 bp, Artificial Sequence
  Synthetic
tatataactgtcttctatggcatacccgcgtggagaaatgcatcaatgcccctgttgtgtgcaactaaaaataga

SEQ ID NO: 194310 - DNA, 75 bp, Artificial Sequence
  Synthetic
tatattactgtcttctatggcatacccgcgtggagaaatgcatcaatacccctgttatgtgcaactaaaaataga

SEQ ID NO: 194311 - DNA, 75 bp, Artificial Sequence
  Synthetic
tatattactgtcttctatggcatacccgcgtggagaaatgcatcaatacccctgttttgtgcaactaaaaataga

SEQ ID NO: 194312 - DNA, 75 bp, Artificial Sequence
  Synthetic
tatattactgtcttctatggcatacccgcgtggagaaatgcatcaatacccctgttctgtgcaactaaaaataga

SEQ ID NO: 194313 - DNA, 75 bp, Artificial Sequence
  Synthetic
tatattactgtcttctatggcatacccgcgtggagaaatgcatcaatacccctgttgtgtgcaactaaaaataga

SEQ ID NO: 194314 - DNA, 75 bp, Artificial Sequence
  Synthetic
tatattactgtcttctatggcatacccgcgtggagaaatgcatcaattcccctgttatgtgcaactaaaaataga

SEQ ID NO: 194315 - DNA, 75 bp, Artificial Sequence
  Synthetic
tatattactgtcttctatggcatacccgcgtggagaaatgcatcaattcccctgttttgtgcaactaaaaataga

SEQ ID NO: 194316 - DNA, 75 bp, Artificial Sequence
  Synthetic
tatattactgtcttctatggcatacccgcgtggagaaatgcatcaattcccctgttctgtgcaactaaaaataga

SEQ ID NO: 194317 - DNA, 75 bp, Artificial Sequence
  Synthetic
tatattactgtcttctatggcatacccgcgtggagaaatgcatcaattcccctgttgtgtgcaactaaaaataga

SEQ ID NO: 194318 - DNA, 75 bp, Artificial Sequence
  Synthetic
tatattactgtcttctatggcatacccgcgtggagaaatgcatcaatccccctgttatgtgcaactaaaaataga

SEQ ID NO: 194319 - DNA, 75 bp, Artificial Sequence
  Synthetic
tatattactgtcttctatggcatacccgcgtggagaaatgcatcaatccccctgttttgtgcaactaaaaataga

SEQ ID NO: 194320 - DNA, 75 bp, Artificial Sequence
  Synthetic
tatattactgtcttctatggcatacccgcgtggagaaatgcatcaatccccctgttctgtgcaactaaaaataga

SEQ ID NO: 194321 - DNA, 75 bp, Artificial Sequence
  Synthetic
tatattactgtcttctatggcatacccgcgtggagaaatgcatcaatccccctgttgtgtgcaactaaaaataga

SEQ ID NO: 194322 - DNA, 75 bp, Artificial Sequence
  Synthetic
tatattactgtcttctatggcatacccgcgtggagaaatgcatcaatgcccctgttatgtgcaactaaaaataga

SEQ ID NO: 194323 - DNA, 75 bp, Artificial Sequence
  Synthetic
tatattactgtcttctatggcatacccgcgtggagaaatgcatcaatgcccctgttttgtgcaactaaaaataga

SEQ ID NO: 194324 - DNA, 75 bp, Artificial Sequence
  Synthetic
tatattactgtcttctatggcatacccgcgtggagaaatgcatcaatgcccctgttctgtgcaactaaaaataga

SEQ ID NO: 194325 - DNA, 75 bp, Artificial Sequence
  Synthetic
tatattactgtcttctatggcatacccgcgtggagaaatgcatcaatgcccctgttgtgtgcaactaaaaataga

SEQ ID NO: 194326 - DNA, 75 bp, Artificial Sequence
  Synthetic
tatatcactgtcttctatggcatacccgcgtggagaaatgcatcaatacccctgttatgtgcaactaaaaataga

SEQ ID NO: 194327 - DNA, 75 bp, Artificial Sequence
  Synthetic
tatatcactgtcttctatggcatacccgcgtggagaaatgcatcaatacccctgttttgtgcaactaaaaataga

SEQ ID NO: 194328 - DNA, 75 bp, Artificial Sequence
  Synthetic
tatatcactgtcttctatggcatacccgcgtggagaaatgcatcaatacccctgttctgtgcaactaaaaataga

SEQ ID NO: 194329 - DNA, 75 bp, Artificial Sequence
  Synthetic
tatatcactgtcttctatggcatacccgcgtggagaaatgcatcaatacccctgttgtgtgcaactaaaaataga

SEQ ID NO: 194330 - DNA, 75 bp, Artificial Sequence
  Synthetic
tatatcactgtcttctatggcatacccgcgtggagaaatgcatcaattcccctgttatgtgcaactaaaaataga

SEQ ID NO: 194331 - DNA, 75 bp, Artificial Sequence
  Synthetic
tatatcactgtcttctatggcatacccgcgtggagaaatgcatcaattcccctgttttgtgcaactaaaaataga

SEQ ID NO: 194332 - DNA, 75 bp, Artificial Sequence
  Synthetic
tatatcactgtcttctatggcatacccgcgtggagaaatgcatcaattcccctgttctgtgcaactaaaaataga

SEQ ID NO: 194333 - DNA, 75 bp, Artificial Sequence
  Synthetic
tatatcactgtcttctatggcatacccgcgtggagaaatgcatcaattcccctgttgtgtgcaactaaaaataga

SEQ ID NO: 194334 - DNA, 75 bp, Artificial Sequence
  Synthetic
tatatcactgtcttctatggcatacccgcgtggagaaatgcatcaatccccctgttatgtgcaactaaaaataga

SEQ ID NO: 194335 - DNA, 75 bp, Artificial Sequence
  Synthetic
tatatcactgtcttctatggcatacccgcgtggagaaatgcatcaatccccctgttttgtgcaactaaaaataga

SEQ ID NO: 194336 - DNA, 75 bp, Artificial Sequence
  Synthetic
tatatcactgtcttctatggcatacccgcgtggagaaatgcatcaatccccctgttctgtgcaactaaaaataga

SEQ ID NO: 194337 - DNA, 75 bp, Artificial Sequence
  Synthetic
tatatcactgtcttctatggcatacccgcgtggagaaatgcatcaatccccctgttgtgtgcaactaaaaataga

SEQ ID NO: 194338 - DNA, 75 bp, Artificial Sequence
  Synthetic
tatatcactgtcttctatggcatacccgcgtggagaaatgcatcaatgcccctgttatgtgcaactaaaaataga

SEQ ID NO: 194339 - DNA, 75 bp, Artificial Sequence
  Synthetic
tatatcactgtcttctatggcatacccgcgtggagaaatgcatcaatgcccctgttttgtgcaactaaaaataga

SEQ ID NO: 194340 - DNA, 75 bp, Artificial Sequence
  Synthetic
tatatcactgtcttctatggcatacccgcgtggagaaatgcatcaatgcccctgttctgtgcaactaaaaataga

SEQ ID NO: 194341 - DNA, 75 bp, Artificial Sequence
  Synthetic
tatatcactgtcttctatggcatacccgcgtggagaaatgcatcaatgcccctgttgtgtgcaactaaaaataga

SEQ ID NO: 194342 - DNA, 75 bp, Artificial Sequence
  Synthetic
tatatgactgtcttctatggcatacccgcgtggagaaatgcatcaatacccctgttatgtgcaactaaaaataga

SEQ ID NO: 194343 - DNA, 75 bp, Artificial Sequence
  Synthetic
tatatgactgtcttctatggcatacccgcgtggagaaatgcatcaatacccctgttttgtgcaactaaaaataga

SEQ ID NO: 194344 - DNA, 75 bp, Artificial Sequence
  Synthetic
tatatgactgtcttctatggcatacccgcgtggagaaatgcatcaatacccctgttctgtgcaactaaaaataga

SEQ ID NO: 194345 - DNA, 75 bp, Artificial Sequence
  Synthetic
tatatgactgtcttctatggcatacccgcgtggagaaatgcatcaatacccctgttgtgtgcaactaaaaataga

SEQ ID NO: 194346 - DNA, 75 bp, Artificial Sequence
  Synthetic
tatatgactgtcttctatggcatacccgcgtggagaaatgcatcaattcccctgttatgtgcaactaaaaataga

SEQ ID NO: 194347 - DNA, 75 bp, Artificial Sequence
  Synthetic
tatatgactgtcttctatggcatacccgcgtggagaaatgcatcaattcccctgttttgtgcaactaaaaataga

SEQ ID NO: 194348 - DNA, 75 bp, Artificial Sequence
  Synthetic
tatatgactgtcttctatggcatacccgcgtggagaaatgcatcaattcccctgttctgtgcaactaaaaataga

SEQ ID NO: 194349 - DNA, 75 bp, Artificial Sequence
  Synthetic
tatatgactgtcttctatggcatacccgcgtggagaaatgcatcaattcccctgttgtgtgcaactaaaaataga

SEQ ID NO: 194350 - DNA, 75 bp, Artificial Sequence
  Synthetic
tatatgactgtcttctatggcatacccgcgtggagaaatgcatcaatccccctgttatgtgcaactaaaaataga

SEQ ID NO: 194351 - DNA, 75 bp, Artificial Sequence
  Synthetic
tatatgactgtcttctatggcatacccgcgtggagaaatgcatcaatccccctgttttgtgcaactaaaaataga

SEQ ID NO: 194352 - DNA, 75 bp, Artificial Sequence
  Synthetic
tatatgactgtcttctatggcatacccgcgtggagaaatgcatcaatccccctgttctgtgcaactaaaaataga

SEQ ID NO: 194353 - DNA, 75 bp, Artificial Sequence
  Synthetic
tatatgactgtcttctatggcatacccgcgtggagaaatgcatcaatccccctgttgtgtgcaactaaaaataga

SEQ ID NO: 194354 - DNA, 75 bp, Artificial Sequence
  Synthetic
tatatgactgtcttctatggcatacccgcgtggagaaatgcatcaatgcccctgttatgtgcaactaaaaataga

SEQ ID NO: 194355 - DNA, 75 bp, Artificial Sequence
  Synthetic
tatatgactgtcttctatggcatacccgcgtggagaaatgcatcaatgcccctgttttgtgcaactaaaaataga

SEQ ID NO: 194356 - DNA, 75 bp, Artificial Sequence
  Synthetic
tatatgactgtcttctatggcatacccgcgtggagaaatgcatcaatgcccctgttctgtgcaactaaaaataga

SEQ ID NO: 194357 - DNA, 75 bp, Artificial Sequence
  Synthetic
tatatgactgtcttctatggcatacccgcgtggagaaatgcatcaatgcccctgttgtgtgcaactaaaaataga

SEQ ID NO: 194358 - DNA, 75 bp, Artificial Sequence
  Synthetic
gaagcagcagattgggatgcacagcacccaataccaggccccttaccagcagggcagcttagagacccaaggggg

SEQ ID NO: 194359 - DNA, 75 bp, Artificial Sequence
  Synthetic
gtataggccacaaaatcccgtgccggtagggaacatctacagaagatggatccagatagggctacagaagtgtgt

SEQ ID NO: 194360 - DNA, 75 bp, Artificial Sequence
  Synthetic
ccatgtgtcaagttgacacccctatgagtggcaatgaattgtacaaccacggaagccacaccccagaataccaca

SEQ ID NO: 194361 - DNA, 75 bp, Artificial Sequence
  Synthetic
ccatgtgtcaagttgacacccctatgtgtggcaatgaattgtacaaccacggaagccacaccccagaataccaca

SEQ ID NO: 194362 - DNA, 75 bp, Artificial Sequence
  Synthetic
ccatgtgtcaagttgacacccctatgcgtggcaatgaattgtacaaccacggaagccacaccccagaataccaca

SEQ ID NO: 194363 - DNA, 75 bp, Artificial Sequence
  Synthetic
ccatgtgtcaagttgacacccctatgggtggcaatgaattgtacaaccacggaagccacaccccagaataccaca

SEQ ID NO: 194364 - DNA, 75 bp, Artificial Sequence
  Synthetic
ccatgtgtcaagttgacacccctttgagtggcaatgaattgtacaaccacggaagccacaccccagaataccaca

SEQ ID NO: 194365 - DNA, 75 bp, Artificial Sequence
  Synthetic
ccatgtgtcaagttgacacccctttgtgtggcaatgaattgtacaaccacggaagccacaccccagaataccaca

SEQ ID NO: 194366 - DNA, 75 bp, Artificial Sequence
  Synthetic
ccatgtgtcaagttgacacccctttgcgtggcaatgaattgtacaaccacggaagccacaccccagaataccaca

SEQ ID NO: 194367 - DNA, 75 bp, Artificial Sequence
  Synthetic
ccatgtgtcaagttgacacccctttgggtggcaatgaattgtacaaccacggaagccacaccccagaataccaca

SEQ ID NO: 194368 - DNA, 75 bp, Artificial Sequence
  Synthetic
ccatgtgtcaagttgacacccctctgagtggcaatgaattgtacaaccacggaagccacaccccagaataccaca

SEQ ID NO: 194369 - DNA, 75 bp, Artificial Sequence
  Synthetic
ccatgtgtcaagttgacacccctctgtgtggcaatgaattgtacaaccacggaagccacaccccagaataccaca

SEQ ID NO: 194370 - DNA, 75 bp, Artificial Sequence
  Synthetic
ccatgtgtcaagttgacacccctctgcgtggcaatgaattgtacaaccacggaagccacaccccagaataccaca

SEQ ID NO: 194371 - DNA, 75 bp, Artificial Sequence
  Synthetic
ccatgtgtcaagttgacacccctctgggtggcaatgaattgtacaaccacggaagccacaccccagaataccaca

SEQ ID NO: 194372 - DNA, 75 bp, Artificial Sequence
  Synthetic
ccatgtgtcaagttgacacccctgtgagtggcaatgaattgtacaaccacggaagccacaccccagaataccaca

SEQ ID NO: 194373 - DNA, 75 bp, Artificial Sequence
  Synthetic
ccatgtgtcaagttgacacccctgtgtgtggcaatgaattgtacaaccacggaagccacaccccagaataccaca

SEQ ID NO: 194374 - DNA, 75 bp, Artificial Sequence
  Synthetic
ccatgtgtcaagttgacacccctgtgcgtggcaatgaattgtacaaccacggaagccacaccccagaataccaca

SEQ ID NO: 194375 - DNA, 75 bp, Artificial Sequence
  Synthetic
ccatgtgtcaagttgacacccctgtgggtggcaatgaattgtacaaccacggaagccacaccccagaataccaca

SEQ ID NO: 194376 - DNA, 75 bp, Artificial Sequence
  Synthetic
acacggaataccacaataatagaggataatgacccttgtataagtagaaacaactgcacaggattagaaaatgaa

SEQ ID NO: 194377 - DNA, 75 bp, Artificial Sequence
  Synthetic
ggatgacccaaacgctgctaatacagaatgccaacccagactgcaagttagtactaaaaggactggggatgaatc

SEQ ID NO: 194378 - DNA, 75 bp, Artificial Sequence
  Synthetic
gaatgccaacccagactgcaagttagtactaaaaggactggggatgaatcccaccctagaagagatgctgactgc

SEQ ID NO: 194379 - DNA, 75 bp, Artificial Sequence
  Synthetic
gagatggttacatgtaacttcagtatgacagggttagaacaagataagaaaaagaggtataatgagacatggtat

SEQ ID NO: 194380 - DNA, 75 bp, Artificial Sequence
  Synthetic
tcacaggatgtggtttgtgacaaaaacaattcaagcgaaacattaaacaaaacatgttacatgagacattgtaac

SEQ ID NO: 194381 - DNA, 75 bp, Artificial Sequence
  Synthetic
ccctgaaggaggctttgacaccaccccctatcccatttgcagcagcccaacaaagaaaggtaattaggtgttgga

SEQ ID NO: 194382 - DNA, 75 bp, Artificial Sequence
  Synthetic
acatcagtcatcaaagaatcatgtgataagcactattgggatactatgagatttagatactgtacaccaccgggt

SEQ ID NO: 194383 - DNA, 75 bp, Artificial Sequence
  Synthetic
actgcggaaaggagggacactcggcgagacagtgccgagcgcctagaagacagggctgctggaaatgtggcaaga

SEQ ID NO: 194384 - DNA, 75 bp, Artificial Sequence
  Synthetic
ataagcactattgggatactatgagatttagatactgtacaccaccgggttatgccttactaagatgcaatgata

SEQ ID NO: 194385 - DNA, 75 bp, Artificial Sequence
  Synthetic
caggacacgtcatggcaaaatgcccagaaagacaggcaggttttttagggatgggtccatggggaaagaagcccc

SEQ ID NO: 194386 - DNA, 75 bp, Artificial Sequence
  Synthetic
gcaacttccccgtggcccaagctcctccggggctgataccaacagcacccccagcagatccagcagtggatctat

SEQ ID NO: 194387 - DNA, 75 bp, Artificial Sequence
  Synthetic
tggaaagatatatgcagcaggggagagagcagagggagcagagggagagaccatacaaagaggtgacggaagact

SEQ ID NO: 194388 - DNA, 75 bp, Artificial Sequence
  Synthetic
agagcagagggagcagagggagagaccatacaaagaggtgacggaagacttactgcacctccagcagggaaaagc

SEQ ID NO: 194389 - DNA, 75 bp, Artificial Sequence
  Synthetic
ggactatcattagcttaaacaagtattataatctcactatgcactgtaagagaccaggaaataagacagttgtac

SEQ ID NO: 194390 - DNA, 75 bp, Artificial Sequence
  Synthetic
caataacacttatgccaggactagtgtttcactctcagccaatcaaccgcaggcctagacaggcatggtgctggt

SEQ ID NO: 194391 - DNA, 75 bp, Artificial Sequence
  Synthetic
acctcacagagaggcgacagaggacttgctgcacctcaattctctctttggaaaagaccagtagtcacagcatac

SEQ ID NO: 194392 - DNA, 75 bp, Artificial Sequence
  Synthetic
ttagaggcaactggacagaagccatgaaggaggtgaagcaaacccttgtaaagcatcccagatacaagggaacca

SEQ ID NO: 194393 - DNA, 75 bp, Artificial Sequence
  Synthetic
tattagacacaggggctgatgactcaatagtggcaggaatacagttaggggacaattacgttccaaaaatagtgg

SEQ ID NO: 194394 - DNA, 75 bp, Artificial Sequence
  Synthetic
aagcatcccagatacaagggaaccaatgatacgacaaaaattaactttacgaaaccaggagaaggctcagaccca

SEQ ID NO: 194395 - DNA, 75 bp, Artificial Sequence
  Synthetic
gaagtggcatacatgtggactaactgcagaggagaatttctctactgcaacatgacttggttcctcaattgggta

SEQ ID NO: 194396 - DNA, 75 bp, Artificial Sequence
  Synthetic
ggggaatagggggattcataaacaccaaagagattaaaaatatagaaataaaagtactaaataaaagagtaagag

SEQ ID NO: 194397 - DNA, 75 bp, Artificial Sequence
  Synthetic
catgacttggttcctcaattgggtagagaataggacgggcacacagcacaattatgcgccgtgccatataaagca

SEQ ID NO: 194398 - DNA, 75 bp, Artificial Sequence
  Synthetic
gataattaatacctggcataaagtagggaaaaatgtatatttgcctcctagggaaggagaattgacttgcaattc

SEQ ID NO: 194399 - DNA, 75 bp, Artificial Sequence
  Synthetic
aacagtaaccagcataattgctaacattgacacaaaaggaaatcagaccaacattaccttcagtgcagaggtggc

SEQ ID NO: 194400 - DNA, 75 bp, Artificial Sequence
  Synthetic
aaagatggaccaagactgagacaatggcccctaacaaaagagaaaatagaagcactaagagagatctgcgaaaaa

SEQ ID NO: 194401 - DNA, 75 bp, Artificial Sequence
  Synthetic
agaactgtaccgattagagttgggagactacaaattgatagaaataacaccaattggcttcgcacctacaactga

SEQ ID NO: 194402 - DNA, 75 bp, Artificial Sequence
  Synthetic
agggaggtattcctcaactccagggaggaataaaagaggtgtatttgtgctaggattcttgggattccttgcgac

SEQ ID NO: 194403 - DNA, 75 bp, Artificial Sequence
  Synthetic
ggcaggttctgcaatgggcgcagcgtccttgacgctgtcagctcagtcccggactttactggctgggatagtgca

SEQ ID NO: 194404 - DNA, 75 bp, Artificial Sequence
  Synthetic
tgtactagatgtaggggatgcctacttttccataccgctacatgaagattttaggcagtatactgcatttaccct

SEQ ID NO: 194405 - DNA, 75 bp, Artificial Sequence
  Synthetic
gcagcagcaacagctgctggacgtggtcaaaagacaacaggaactgttgcggctgaccgtctgggggacgaaaaa

SEQ ID NO: 194406 - DNA, 75 bp, Artificial Sequence
  Synthetic
gtcaaaagacaacaggaactgttgcggctgaccgtctgggggacgaaaaacctccaggcaagagtcactgccatc

SEQ ID NO: 194407 - DNA, 75 bp, Artificial Sequence
  Synthetic
ttaggcagtatactgcatttaccctaccatcagtaaacaatgcagaaccaggaaaaagatatatatataaggtct

SEQ ID NO: 194408 - DNA, 75 bp, Artificial Sequence
  Synthetic
ttttccataccgctacatgaagattttaggcagtatactgcatttaccctaccatcagtaaacaatgcagaacca

SEQ ID NO: 194409 - DNA, 75 bp, Artificial Sequence
  Synthetic
ggctgaccgtctgggggacgaaaaacctccaggcaagagtcactgccatcgagaagtatctaaaggatcaggcac

SEQ ID NO: 194410 - DNA, 75 bp, Artificial Sequence
  Synthetic
aactaaattcatggggatgtgcgtttaggcaggtctgccacactactgtaccatgggtaaatgaatccttaacgc

SEQ ID NO: 194411 - DNA, 75 bp, Artificial Sequence
  Synthetic
aactaaattcatggggatgtgcgtttaggcaggtctgccacactactgttccatgggtaaatgaatccttaacgc

SEQ ID NO: 194412 - DNA, 75 bp, Artificial Sequence
  Synthetic
aactaaattcatggggatgtgcgtttaggcaggtctgccacactactgtcccatgggtaaatgaatccttaacgc

SEQ ID NO: 194413 - DNA, 75 bp, Artificial Sequence
  Synthetic
aactaaattcatggggatgtgcgtttaggcaggtctgccacactactgtgccatgggtaaatgaatccttaacgc

SEQ ID NO: 194414 - DNA, 75 bp, Artificial Sequence
  Synthetic
atctaaattcatggggatgtgcgtttaggcaggtctgccacactactgtaccatgggtaaatgaatccttaacgc

SEQ ID NO: 194415 - DNA, 75 bp, Artificial Sequence
  Synthetic
atctaaattcatggggatgtgcgtttaggcaggtctgccacactactgttccatgggtaaatgaatccttaacgc

SEQ ID NO: 194416 - DNA, 75 bp, Artificial Sequence
  Synthetic
atctaaattcatggggatgtgcgtttaggcaggtctgccacactactgtcccatgggtaaatgaatccttaacgc

SEQ ID NO: 194417 - DNA, 75 bp, Artificial Sequence
  Synthetic
atctaaattcatggggatgtgcgtttaggcaggtctgccacactactgtgccatgggtaaatgaatccttaacgc

SEQ ID NO: 194418 - DNA, 75 bp, Artificial Sequence
  Synthetic
acctaaattcatggggatgtgcgtttaggcaggtctgccacactactgtaccatgggtaaatgaatccttaacgc

SEQ ID NO: 194419 - DNA, 75 bp, Artificial Sequence
  Synthetic
acctaaattcatggggatgtgcgtttaggcaggtctgccacactactgttccatgggtaaatgaatccttaacgc

SEQ ID NO: 194420 - DNA, 75 bp, Artificial Sequence
  Synthetic
acctaaattcatggggatgtgcgtttaggcaggtctgccacactactgtcccatgggtaaatgaatccttaacgc

SEQ ID NO: 194421 - DNA, 75 bp, Artificial Sequence
  Synthetic
acctaaattcatggggatgtgcgtttaggcaggtctgccacactactgtgccatgggtaaatgaatccttaacgc

SEQ ID NO: 194422 - DNA, 75 bp, Artificial Sequence
  Synthetic
agctaaattcatggggatgtgcgtttaggcaggtctgccacactactgtaccatgggtaaatgaatccttaacgc

SEQ ID NO: 194423 - DNA, 75 bp, Artificial Sequence
  Synthetic
agctaaattcatggggatgtgcgtttaggcaggtctgccacactactgttccatgggtaaatgaatccttaacgc

SEQ ID NO: 194424 - DNA, 75 bp, Artificial Sequence
  Synthetic
agctaaattcatggggatgtgcgtttaggcaggtctgccacactactgtcccatgggtaaatgaatccttaacgc

SEQ ID NO: 194425 - DNA, 75 bp, Artificial Sequence
  Synthetic
agctaaattcatggggatgtgcgtttaggcaggtctgccacactactgtgccatgggtaaatgaatccttaacgc

SEQ ID NO: 194426 - DNA, 75 bp, Artificial Sequence
  Synthetic
caagtcttagaacctttcagaaaagcaaacccagatgtcattctcatccaatacatggatgatattttaatagct

SEQ ID NO: 194427 - DNA, 75 bp, Artificial Sequence
  Synthetic
ctaactgggacaatatgacatggcagcaatgggaggaaaaggtccgcgacctagaggcaaatatcagtcaaattt

SEQ ID NO: 194428 - DNA, 75 bp, Artificial Sequence
  Synthetic
agtgacaggacaggtttagagcatgacaaagtagtcctgcagctaaaagaacttctgaatggcctagggttctct

SEQ ID NO: 194429 - DNA, 75 bp, Artificial Sequence
  Synthetic
actggtttgatttaacctcctggatcagatatattcaatatggagtttatatagtagcaggagtagtagttctta

SEQ ID NO: 194430 - DNA, 75 bp, Artificial Sequence
  Synthetic
ccagaagctggtgggagtcttaaattgggcggcacaaatctatccaggaataaaaaccaaacatttgtgtaggct

SEQ ID NO: 194431 - DNA, 75 bp, Artificial Sequence
  Synthetic
gaatagcaatatacatagtgcaaatgataagtagacttaggaagggctataggcctgttttctcttccccctccg

SEQ ID NO: 194432 - DNA, 75 bp, Artificial Sequence
  Synthetic
gaatagcaatatacatagtgcaaatgttaagtagacttaggaagggctataggcctgttttctcttccccctccg

SEQ ID NO: 194433 - DNA, 75 bp, Artificial Sequence
  Synthetic
gaatagcaatatacatagtgcaaatgctaagtagacttaggaagggctataggcctgttttctcttccccctccg

SEQ ID NO: 194434 - DNA, 75 bp, Artificial Sequence
  Synthetic
gaatagcaatatacatagtgcaaatggtaagtagacttaggaagggctataggcctgttttctcttccccctccg

SEQ ID NO: 194435 - DNA, 75 bp, Artificial Sequence
  Synthetic
gtatagcaatatacatagtgcaaatgataagtagacttaggaagggctataggcctgttttctcttccccctccg

SEQ ID NO: 194436 - DNA, 75 bp, Artificial Sequence
  Synthetic
gtatagcaatatacatagtgcaaatgttaagtagacttaggaagggctataggcctgttttctcttccccctccg

SEQ ID NO: 194437 - DNA, 75 bp, Artificial Sequence
  Synthetic
gtatagcaatatacatagtgcaaatgctaagtagacttaggaagggctataggcctgttttctcttccccctccg

SEQ ID NO: 194438 - DNA, 75 bp, Artificial Sequence
  Synthetic
gtatagcaatatacatagtgcaaatggtaagtagacttaggaagggctataggcctgttttctcttccccctccg

SEQ ID NO: 194439 - DNA, 75 bp, Artificial Sequence
  Synthetic
gcatagcaatatacatagtgcaaatgataagtagacttaggaagggctataggcctgttttctcttccccctccg

SEQ ID NO: 194440 - DNA, 75 bp, Artificial Sequence
  Synthetic
gcatagcaatatacatagtgcaaatgttaagtagacttaggaagggctataggcctgttttctcttccccctccg

SEQ ID NO: 194441 - DNA, 75 bp, Artificial Sequence
  Synthetic
gcatagcaatatacatagtgcaaatgctaagtagacttaggaagggctataggcctgttttctcttccccctccg

SEQ ID NO: 194442 - DNA, 75 bp, Artificial Sequence
  Synthetic
gcatagcaatatacatagtgcaaatggtaagtagacttaggaagggctataggcctgttttctcttccccctccg

SEQ ID NO: 194443 - DNA, 75 bp, Artificial Sequence
  Synthetic
ggatagcaatatacatagtgcaaatgataagtagacttaggaagggctataggcctgttttctcttccccctccg

SEQ ID NO: 194444 - DNA, 75 bp, Artificial Sequence
  Synthetic
ggatagcaatatacatagtgcaaatgttaagtagacttaggaagggctataggcctgttttctcttccccctccg

SEQ ID NO: 194445 - DNA, 75 bp, Artificial Sequence
  Synthetic
ggatagcaatatacatagtgcaaatgctaagtagacttaggaagggctataggcctgttttctcttccccctccg

SEQ ID NO: 194446 - DNA, 75 bp, Artificial Sequence
  Synthetic
ggatagcaatatacatagtgcaaatggtaagtagacttaggaagggctataggcctgttttctcttccccctccg

SEQ ID NO: 194447 - DNA, 75 bp, Artificial Sequence
  Synthetic
aggcctgttttctcttccccctccggttatgtccaacagatccatatccacacggaccagggacagccaaccagc

SEQ ID NO: 194448 - DNA, 75 bp, Artificial Sequence
  Synthetic
tgggcggcacaaatctatccaggaataaaaaccaaacatttgtgtaggctaatcaaaggaaaaatgacactcaca

SEQ ID NO: 194449 - DNA, 75 bp, Artificial Sequence
  Synthetic
cagaagcagagctagaagaaaacaaaattatcttaagccaggaacaagaaggatactattaccaagaagaaaaag

SEQ ID NO: 194450 - DNA, 75 bp, Artificial Sequence
  Synthetic
gaagaaacagaagaaggaggtggaaacgacggggactacagatcttggccctggcagatagaatacgttcatttt

SEQ ID NO: 194451 - DNA, 75 bp, Artificial Sequence
  Synthetic
ctgctgcgccagctgaggaacctcttaatttggctatacaacggctgcagaaccttactgttgaagacctcccaa

SEQ ID NO: 194452 - DNA, 75 bp, Artificial Sequence
  Synthetic
atacaccaggaagagaaaatcctaaaagtagggaaatatgcaaagataaaaaatacccataccaatggggtcaga

SEQ ID NO: 194453 - DNA, 75 bp, Artificial Sequence
  Synthetic
atcctccaaccaatactccaaccactcaggctcccgtttgcatacctccagtatgggatcggctggttccaagaa

SEQ ID NO: 194454 - DNA, 75 bp, Artificial Sequence
  Synthetic
gcgctccgagcagcagcgagggctacgagagagactcttgcgagtgcgggagagaccttatgggaagctctcagg

SEQ ID NO: 194455 - DNA, 75 bp, Artificial Sequence
  Synthetic
ccggtggagagagagacctgggagcagtggtgggataactactggcaagtgacatggatcccagagtgggacttc

SEQ ID NO: 194456 - DNA, 75 bp, Artificial Sequence
  Synthetic
ggggcggcgagagcgatcctcgcgatccccagaagaatcagacaaggacttgaactcgccctcttgtgagggaaa

SEQ ID NO: 194457 - DNA, 75 bp, Artificial Sequence
  Synthetic
tgccctgggggcagaagggggagggcaacaaaatgcagatgaaagtgatgaggacgatgaagtgggagcctatgt

SEQ ID NO: 194458 - DNA, 75 bp, Artificial Sequence
  Synthetic
tataccaggcgcagagaccttctacacagatggatcatgcaatagacagtcaaaggaaggaaaagcaggatatgt

SEQ ID NO: 194459 - DNA, 75 bp, Artificial Sequence
  Synthetic
caaaggaaggaaaagcaggatatgtgacagatagaggaagagacaaggtaagagtactagaacgaactaccaatc

SEQ ID NO: 194460 - DNA, 75 bp, Artificial Sequence
  Synthetic
aagacccagtaggccactgagaccaatgacatacaaaacagcaatagacatgtctcattttctaaaagaaaaggg

SEQ ID NO: 194461 - DNA, 75 bp, Artificial Sequence
  Synthetic
gattggcgcccgaacagggacctgggaagagtgagagtcttcaagagcacagctgagtgaaggcagtaagggcgg

SEQ ID NO: 194462 - DNA, 75 bp, Artificial Sequence
  Synthetic
agcaagcagaattagaagcctttgcgatggcactgacagactcgggtccaaaagttaatatcatagtagactcac

SEQ ID NO: 194463 - DNA, 75 bp, Artificial Sequence
  Synthetic
ccagtaggccactgagaccaatgacatacaaaacagcaatagacatgtctcattttctaaaagaaaaggggggac

SEQ ID NO: 194464 - DNA, 75 bp, Artificial Sequence
  Synthetic
gatggcactgacagactcgggtccaaaagttaatatcatagtagactcacagtatgtaatgggaatagtagtagg

SEQ ID NO: 194465 - DNA, 75 bp, Artificial Sequence
  Synthetic
gaggctccgggagtaaggtaagtactccaaattttgcattgtctactctaaagagggagtagggcataagtggga

SEQ ID NO: 194466 - DNA, 75 bp, Artificial Sequence
  Synthetic
tcagggaagaaaacagatgaattagaaaaagttaggttacggcccggcggaaagaaaaagtatatgctaaaacat

SEQ ID NO: 194467 - DNA, 75 bp, Artificial Sequence
  Synthetic
ccataaatttggaataccccaactagtagcaagacagatagtaaacacatgtgcccaatgccaacagaaaggaga

SEQ ID NO: 194468 - DNA, 75 bp, Artificial Sequence
  Synthetic
tagtaccaacagggtcagaaaatttaaaaagcctttttaatatcgtctgcgtcattttttgcctgcacgcagaag

SEQ ID NO: 194469 - DNA, 75 bp, Artificial Sequence
  Synthetic
ggccatacatgggcaggtaaatgcagaaataggtgtctggcaaatggactgcacacacttagaaggaaagatcat

SEQ ID NO: 194470 - DNA, 75 bp, Artificial Sequence
  Synthetic
tgccgctaagcccccgaaccttaaatgcttgggtaaagttagtagaagaaaagaagttcggggcagaagtagtac

SEQ ID NO: 194471 - DNA, 75 bp, Artificial Sequence
  Synthetic
atgcaccccttatgatataaatcagatgctaaattgtgtaggagaacatcaggcagccatgcaaattattagaga

SEQ ID NO: 194472 - DNA, 75 bp, Artificial Sequence
  Synthetic
aggcagccatgcaaattattagagaaataatcaatgaggaagcagcagactgggaccagcaacacccgtcaccag

SEQ ID NO: 194473 - DNA, 75 bp, Artificial Sequence
  Synthetic
aataatcaatgaggaagcagcagactgggaccagcaacacccgtcaccaggcccaatgccggcaggacaacttag

SEQ ID NO: 194474 - DNA, 75 bp, Artificial Sequence
  Synthetic
ggacccaagagggtcagatatagcaggaaccaccagcacagtagaggaacagatacagtggatgtacagggccca

SEQ ID NO: 194475 - DNA, 75 bp, Artificial Sequence
  Synthetic
gaaaaaattcaaattttaaaaacttccaggtctattacagagaaggcagagatcagctgtggaaaggacctggag

SEQ ID NO: 194476 - DNA, 75 bp, Artificial Sequence
  Synthetic
aactactgtggaagggagacggagcagtcatagtcaaggtaggggcagacataaaagtaataccaagaaggaagg

SEQ ID NO: 194477 - DNA, 75 bp, Artificial Sequence
  Synthetic
tatagaagatggattcaattaggattgcagaaatgtgtccgaatgtacaatcctaccaacatattagacataaag

SEQ ID NO: 194478 - DNA, 75 bp, Artificial Sequence
  Synthetic
ccaagattatcagagactatggaggaaggcaagaactggatagttcccacctggagggtgccagggaggaggatg

SEQ ID NO: 194479 - DNA, 75 bp, Artificial Sequence
  Synthetic
gctatgtagatagattctacaaaagcttacgggcagaacaaacagacccagcagtgaaaaattggatgacacaaa

SEQ ID NO: 194480 - DNA, 75 bp, Artificial Sequence
  Synthetic
cttacgggcagaacaaacagacccagcagtgaaaaattggatgacacaaacactgctgattcagaatgctaaccc

SEQ ID NO: 194481 - DNA, 75 bp, Artificial Sequence
  Synthetic
aaggcaagaactggatagttcccacctggagggtgccagggaggaggatggagaggtggcatagtcttgtcaagt

SEQ ID NO: 194482 - DNA, 75 bp, Artificial Sequence
  Synthetic
ttgggaatgaatcccaccttagaggaaatgctaacggcctgccaagggataggaggcccagggcagaaggcaagg

SEQ ID NO: 194483 - DNA, 75 bp, Artificial Sequence
  Synthetic
aggaggcccagggcagaaggcaaggctaatggccgaagccttaaaagaggccctaacacctgcacccataccgtt

SEQ ID NO: 194484 - DNA, 75 bp, Artificial Sequence
  Synthetic
tgctgccgttcaacaaaaagcagggaagagagggacagtgacatgctggaactgtggcaaacagggacacacagc

SEQ ID NO: 194485 - DNA, 75 bp, Artificial Sequence
  Synthetic
aagagagggacagtgacatgctggaactgtggcaaacagggacacacagccaggcaatgcagggcccctagaaga

SEQ ID NO: 194486 - DNA, 75 bp, Artificial Sequence
  Synthetic
cacttatttctcttgctttacggcaggtgaagtaagaagagccatcagaggggaaaagttattgtcctgctgcaa

SEQ ID NO: 194487 - DNA, 75 bp, Artificial Sequence
  Synthetic
caggacacatcatgtcaaaatgcccagaaagacaggcgggttttttagggttaggaccctggggaaagaagcctc

SEQ ID NO: 194488 - DNA, 75 bp, Artificial Sequence
  Synthetic
ctatccccaagctcataaagtacaggtaccatcacttcaatacctagccctagtggtagtgcaacaaaatgacag

SEQ ID NO: 194489 - DNA, 75 bp, Artificial Sequence
  Synthetic
gcaacttccccatgacccaagtgcctcagggagtgacaccatctgcacccccgatgaacccagcagagggcatga

SEQ ID NO: 194490 - DNA, 75 bp, Artificial Sequence
  Synthetic
tagtggtagtgcaacaaaatgacagaccccagagaaagggtaccgccaggaaacagtggagaagagaccattgga

SEQ ID NO: 194491 - DNA, 75 bp, Artificial Sequence
  Synthetic
cacctcggggggcgacaccatctgcgccccctgcagatccagcagtggagatgctgaaaagttacatgcagatgg

SEQ ID NO: 194492 - DNA, 75 bp, Artificial Sequence
  Synthetic
gagaccctacaaggaggtgacagaggatttgctgcacctcaattctctctttggagaagaccagtagtcaaagca

SEQ ID NO: 194493 - DNA, 75 bp, Artificial Sequence
  Synthetic
agatatttgtgcctgatgcagaaagctgtatttatacatttcaagagagggtgcacttgcctggggggaggacat

SEQ ID NO: 194494 - DNA, 75 bp, Artificial Sequence
  Synthetic
gtaataagaattctgggagaaataaaggaagaagccttaaagcattttgatccccgcttgctaatcgctcttggc

SEQ ID NO: 194495 - DNA, 75 bp, Artificial Sequence
  Synthetic
aactatatccatagtagacatggagacacacctgaaggcgccagagagctcattagaatcctacaacgagccctc

SEQ ID NO: 194496 - DNA, 75 bp, Artificial Sequence
  Synthetic
taaatttcccagtggcaaaggtagaaccagtaaaagttgagttaaaacctggaaaagatgggccaaagatcagac

SEQ ID NO: 194497 - DNA, 75 bp, Artificial Sequence
  Synthetic
ttcgtgcacctcagagcagggtgtaaccgctcaagaattagccaaacaaggagaagaactcctttcccagctgca

SEQ ID NO: 194498 - DNA, 75 bp, Artificial Sequence
  Synthetic
gagaagaactcctttcccagctgcaccgacccctagaggcatctactaactcatgctattgtaagcagtgcagct

SEQ ID NO: 194499 - DNA, 75 bp, Artificial Sequence
  Synthetic
tgctaatagactttagagagttaaacaaggtaacccaggacttcacagaagtcaactgggtattccccacccggc

SEQ ID NO: 194500 - DNA, 75 bp, Artificial Sequence
  Synthetic
cgaaaaagcagacggagaagaactccaagaaagactaagactcattcgtcttctgcatcagacaagtgagtaaga

SEQ ID NO: 194501 - DNA, 75 bp, Artificial Sequence
  Synthetic
aggtggcagaaaaaaggagaataacagtaatagatgtgggagatgcctacttcagtatcccactagatccaaact

SEQ ID NO: 194502 - DNA, 75 bp, Artificial Sequence
  Synthetic
tcagacagtatacagcattcaccttgccatcagtaaacaatgcagagccaggaaagagatacatttataaagttc

SEQ ID NO: 194503 - DNA, 75 bp, Artificial Sequence
  Synthetic
taccacaagggtggaaggggtcccagtcaatttgtcaatactccatgagaaaggtattagatccttttagaaagg

SEQ ID NO: 194504 - DNA, 75 bp, Artificial Sequence
  Synthetic
caatgatgattatcaagaaataaccttgaatgtgacagaggctttcgacgcatgggataatacagtaacagaaca

SEQ ID NO: 194505 - DNA, 75 bp, Artificial Sequence
  Synthetic
tttgagacatcaataaaaccatgcgtcaaactaacacctctatgtgtagcaatgagttgtaacagcaccactaac

SEQ ID NO: 194506 - DNA, 75 bp, Artificial Sequence
  Synthetic
gttattaaatgacatgggattctctaccccagaagaaaagttccaaaaagaccctccgttcaaatggatgggtta

SEQ ID NO: 194507 - DNA, 75 bp, Artificial Sequence
  Synthetic
aacacaaccacaacagggagcacaacagggatgtcagagataaatgaaacttctccatcatactcagacaactgc

SEQ ID NO: 194508 - DNA, 75 bp, Artificial Sequence
  Synthetic
accctccgttcaaatggatgggttatgagctctggccaaaaaagtggaaactgcaaaaaatacaactgccagaaa

SEQ ID NO: 194509 - DNA, 75 bp, Artificial Sequence
  Synthetic
cagggatgtcagagataaatgaaacttctccatcatactcagacaactgcacaggattggggaaggaagagatag

SEQ ID NO: 194510 - DNA, 75 bp, Artificial Sequence
  Synthetic
tcaattgtcagttctatatgacaggattagagagagataagaaaaaacagtataatgaaacatggtactcaaaag

SEQ ID NO: 194511 - DNA, 75 bp, Artificial Sequence
  Synthetic
tgggcagctcaactctttcctggaattaagacaaggcacatatgcaaactaattaggggaaagatgaccctaaca

SEQ ID NO: 194512 - DNA, 75 bp, Artificial Sequence
  Synthetic
atgtagtttgtgaatcaaataataccaaagatgggaaaaacagatgttacatgaaccattgcaacacatcagtca

SEQ ID NO: 194513 - DNA, 75 bp, Artificial Sequence
  Synthetic
aattaggggaaagatgaccctaacagaagaagtacagtggacagaactagcagaagcagagctacaggagaataa

SEQ ID NO: 194514 - DNA, 75 bp, Artificial Sequence
  Synthetic
aatcatcttagaacaggaacaagaaggatcctactacaaggaaagggtaccgctagaagcaacagtacagaaaaa

SEQ ID NO: 194515 - DNA, 75 bp, Artificial Sequence
  Synthetic
tcacagagtcatgtgataagcactattgggatgctataaagtttagatactgtgcaccaccgggttatgccctac

SEQ ID NO: 194516 - DNA, 75 bp, Artificial Sequence
  Synthetic
taagatgcaatgataccaattattcaggcttcgagccaaagtgttctaaagtagtagcttctacatgcacaagga

SEQ ID NO: 194517 - DNA, 75 bp, Artificial Sequence
  Synthetic
gtagtagcttctacatgcacaaggatgatggaaacgcaaacctccacttggtttggctttaatggcactagggca

SEQ ID NO: 194518 - DNA, 75 bp, Artificial Sequence
  Synthetic
tgatggaaacgcaaacctccacttggtttggctttaatggcactagggcagagaatagaacatatatctattggc

SEQ ID NO: 194519 - DNA, 75 bp, Artificial Sequence
  Synthetic
atggcagagataataggactatcatcagcttaaacaagtattataacctttctatacattgtaagagaccaggaa

SEQ ID NO: 194520 - DNA, 75 bp, Artificial Sequence
  Synthetic
catgtcagggttagtgtttcactcccagccaatcaatacaagacctaggcaagcatggtgctggttcaaaggcaa

SEQ ID NO: 194521 - DNA, 75 bp, Artificial Sequence
  Synthetic
aagcatggtgctggttcaaaggcaagtggagggaagccatgcaggaggtaaagcaaacccttataaaacatccca

SEQ ID NO: 194522 - DNA, 75 bp, Artificial Sequence
  Synthetic
cctagaagggagagaaacctactacacagatgggtcctgcaatagaacctcaaaggaaggaaaagcaggatatgt

SEQ ID NO: 194523 - DNA, 75 bp, Artificial Sequence
  Synthetic
aagcaaacccttataaaacatcccaggtataaaggaaccaacgacacaaagaatattaactttacaaaaccagga

SEQ ID NO: 194524 - DNA, 75 bp, Artificial Sequence
  Synthetic
acagatgggtcctgcaatagaacctcaaaggaaggaaaagcaggatatgtcactgacaggggaaaagataaggtt

SEQ ID NO: 194525 - DNA, 75 bp, Artificial Sequence
  Synthetic
aacaagcagaacttgaagcatttgcattagcattaacagactcagaaccacaagttaacatcatagtagattcac

SEQ ID NO: 194526 - DNA, 75 bp, Artificial Sequence
  Synthetic
atttctctactgcaacatgacttggttcctcaattgggtagaaaacagaccgaatcagacacagcacaattatgc

SEQ ID NO: 194527 - DNA, 75 bp, Artificial Sequence
  Synthetic
acagccaacagaaacagaatcaccaatagtagcaaaaataattgaagaaatgatcaaaaaagaggcagtatatgt

SEQ ID NO: 194528 - DNA, 75 bp, Artificial Sequence
  Synthetic
aggatgggtaccagctcacaagggactgggtggtaatcaggaagtagaccacctagtaagtcaaggaatcagaca

SEQ ID NO: 194529 - DNA, 75 bp, Artificial Sequence
  Synthetic
acagttgacctgcaactcaacagtgaccagcataattgctaacattgacgtaaatagtaaccagacaaatattac

SEQ ID NO: 194530 - DNA, 75 bp, Artificial Sequence
  Synthetic
ggtcttgttcctagaaaaaatagaaccagcccaggaagagcatgaaaaatatcatggcaatgtaaaagaactggt

SEQ ID NO: 194531 - DNA, 75 bp, Artificial Sequence
  Synthetic
ctttagtgcagaggtggcagaactataccgattagaattgggagattataaattaatagaagtaacaccaattgg

SEQ ID NO: 194532 - DNA, 75 bp, Artificial Sequence
  Synthetic
ccagcccaggaagagcatgaaaaatatcatggcaatgtaaaagaactggtccataaattcggaattccacaatta

SEQ ID NO: 194533 - DNA, 75 bp, Artificial Sequence
  Synthetic
aattaatagaagtaacaccaattggcttcgcacctacgagagagaaaagatattcctcggctccagtgaggaaca

SEQ ID NO: 194534 - DNA, 75 bp, Artificial Sequence
  Synthetic
aaagaggtgtgtttgtgctagggttcttgggttttctcgcgacagcaggttctgcaatgggcgcggcgtccctga

SEQ ID NO: 194535 - DNA, 75 bp, Artificial Sequence
  Synthetic
cgctgtcggctcagtcccggactttactggccgggatagtgcagcaacagcaacagctgttggacgtagtcaaga

SEQ ID NO: 194536 - DNA, 75 bp, Artificial Sequence
  Synthetic
actggccgggatagtgcagcaacagcaacagctgttggacgtagtcaagagacaacaagaaatgttgcgactgac

SEQ ID NO: 194537 - DNA, 75 bp, Artificial Sequence
  Synthetic
tctcttcctactaaagttggccagcagatggcctatcacacacctacacacagacaacggtgccaacttcacctc

SEQ ID NO: 194538 - DNA, 75 bp, Artificial Sequence
  Synthetic
agatggcctatcacacacctacacacagacaacggtgccaacttcacctcaccaagtgtaaagatggtagcctgg

SEQ ID NO: 194539 - DNA, 75 bp, Artificial Sequence
  Synthetic
ttcatgggggtgtgcgtttaggcaggtctgccacactactgtaccatgggtaaatgattctttatcgcctgactg

SEQ ID NO: 194540 - DNA, 75 bp, Artificial Sequence
  Synthetic
gagtaccctataacccacaaagtcaaggagtagtggaagcaatgaaccatcacctgaaaaatcaaatagacagac

SEQ ID NO: 194541 - DNA, 75 bp, Artificial Sequence
  Synthetic
gaacaatatgacatggcaggaatgggaaaaacaagtccgctacctagaggcaaatatcagtcaaagtttagaaca

SEQ ID NO: 194542 - DNA, 75 bp, Artificial Sequence
  Synthetic
tcagagaccaagcagtatcaatagagacagttgtactaatggcaactcactgcatgaattttaaaagaaggggag

SEQ ID NO: 194543 - DNA, 75 bp, Artificial Sequence
  Synthetic
caaatatcagtcaaagtttagaacaggcacaaattcaacaagaaaagaatatgtatgaattacaaaagctaaata

SEQ ID NO: 194544 - DNA, 75 bp, Artificial Sequence
  Synthetic
tgcatgaattttaaaagaaggggaggaataggggatatgacccctgcagaaagactagttaacatgataaccaca

SEQ ID NO: 194545 - DNA, 75 bp, Artificial Sequence
  Synthetic
ggcacaaattcaacaagaaaagaatatgtatgaattacaaaagctaaatagctgggatgtctttggcaactggtt

SEQ ID NO: 194546 - DNA, 75 bp, Artificial Sequence
  Synthetic
gctgggatgtctttggcaactggtttgatttaacctcctggatcaagtatattcaatatggagtttatatagtag

SEQ ID NO: 194547 - DNA, 75 bp, Artificial Sequence
  Synthetic
ccaacagatccatatccacacggaccggggacagccagccaacgaaggaacagaagaagacgacagagacgacga

SEQ ID NO: 194548 - DNA, 75 bp, Artificial Sequence
  Synthetic
aggaaaaggattggattgtagtgccgacatggaggataccaggcaggctagagagatggcacagtctgattaagt

SEQ ID NO: 194549 - DNA, 75 bp, Artificial Sequence
  Synthetic
tggttacgacttgtagccttggccgataaactatatacatttcctgatccacctactgactcgcctcttgaccgg

SEQ ID NO: 194550 - DNA, 75 bp, Artificial Sequence
  Synthetic
atcttaagtatagaacaggagagttgcaacaggtctcttatgtccctcaccacaaggtaggatgggcttggtgga

SEQ ID NO: 194551 - DNA, 75 bp, Artificial Sequence
  Synthetic
gcaacaggtctcttatgtccctcaccacaaggtaggatgggcttggtggacttgcagtagaataatatttcccct

SEQ ID NO: 194552 - DNA, 75 bp, Artificial Sequence
  Synthetic
gctatacaagatctgcagagacttactatccacgaactccccgacccaccgactgatctcccagaatctaacagc

SEQ ID NO: 194553 - DNA, 75 bp, Artificial Sequence
  Synthetic
cacaaggtaggatgggcttggtggacttgcagtagaataatatttcccctaaacaaaggagcatggctagaagtc

SEQ ID NO: 194554 - DNA, 75 bp, Artificial Sequence
  Synthetic
caaggatattggaacctaaccccagaaaggggattcttgagctcctatgctgtaagactaacatggtatgagagg

SEQ ID NO: 194555 - DNA, 75 bp, Artificial Sequence
  Synthetic
aatcagggactggctgagacttaaagcggcctacctgcaatatgggggcgagtggatccaagaagcattccaagc

SEQ ID NO: 194556 - DNA, 75 bp, Artificial Sequence
  Synthetic
aaaggggattcttgagctcctatgctgtaagactaacatggtatgagaggaacttttatacagatgtaacacctg

SEQ ID NO: 194557 - DNA, 75 bp, Artificial Sequence
  Synthetic
attcgcaaagactacgagagagactcttgcgagcgcatggggggggttatgtgcagcagtgcaacgcgtcgggag

SEQ ID NO: 194558 - DNA, 75 bp, Artificial Sequence
  Synthetic
cttgcgagcgcatggggggggttatgtgcagcagtgcaacgcgtcgggaggggaatactcgcagtcccaagaagg

SEQ ID NO: 194559 - DNA, 75 bp, Artificial Sequence
  Synthetic
tcctgtgagggacagcagtatcggcagggagatttcatgaacaccccatggagaaccccggcaatagaaggacag

SEQ ID NO: 194560 - DNA, 75 bp, Artificial Sequence
  Synthetic
gagaaccccggcaatagaaggacagaaaaagttatacaagcagcaaaatatggatgatatagattctagtgatga

SEQ ID NO: 194561 - DNA, 75 bp, Artificial Sequence
  Synthetic
tggatcccagggagagagtgccaccaggaaacagcgacgaagaaacagtaggagaagcattcgcttggctagaaa

SEQ ID NO: 194562 - DNA, 75 bp, Artificial Sequence
  Synthetic
tgacctagtgggagttcctgttacaccaagagtaccactaagagcaatgacctataaattggcagtagatatgtc

SEQ ID NO: 194563 - DNA, 75 bp, Artificial Sequence
  Synthetic
caccaagagtaccactaagagcaatgacctataaattggcagtagatatgtcacattttataaagaaaaggggac

SEQ ID NO: 194564 - DNA, 75 bp, Artificial Sequence
  Synthetic
agcggtcaaccatttgccccgagaacttattttccaggtctggcagaggtcttgggcatactggcgtgaggaaca

SEQ ID NO: 194565 - DNA, 75 bp, Artificial Sequence
  Synthetic
tatagatacttgttgctaatgcagaaagcaatgtttgtgcactatacaaagggctgtaggtgcctgcaggagggc

SEQ ID NO: 194566 - DNA, 75 bp, Artificial Sequence
  Synthetic
cagagatccctccagagaacgagaacccacaaagagaaccgtgggaagagtggataggggagatcctggaggaaa

SEQ ID NO: 194567 - DNA, 75 bp, Artificial Sequence
  Synthetic
caggaacaaaccacgacggagtgctcctagaaaggcgcgggccgaggtaccaaaggcggcgtgtggagcgggagt

SEQ ID NO: 194568 - DNA, 75 bp, Artificial Sequence
  Synthetic
agggggaggaaatcctctctcaactataccgcccccttaaggcatgcgataatacatgctactgtaagaaatgct

SEQ ID NO: 194569 - DNA, 75 bp, Artificial Sequence
  Synthetic
gctaccattgccagctttgttttcttaaaaagggtcttgggatatgttatgaccgctcgagaaggagatctgcaa

SEQ ID NO: 194570 - DNA, 75 bp, Artificial Sequence
  Synthetic
aaagagctaagactactgcaccttctgcaccagacaagtgagtatggcatattttagcagccgcctgcctattgc

SEQ ID NO: 194571 - DNA, 75 bp, Artificial Sequence
  Synthetic
ttctcagagttttagatccattagtaccaacagggtcagaaaatttaaaaagcctttttaataccgtctgcgtca

SEQ ID NO: 194572 - DNA, 75 bp, Artificial Sequence
  Synthetic
gctcctgcttataggtatcagtgggtttgtatgtaaacaatatgttactgtcttctatggcatacccgcatggag

SEQ ID NO: 194573 - DNA, 75 bp, Artificial Sequence
  Synthetic
gaacgcaacagttcccctcatttgtgcaaccacaaacagagacacctggggaactgtacagtgtctcccagacaa

SEQ ID NO: 194574 - DNA, 75 bp, Artificial Sequence
  Synthetic
tggtgactacactgagatcaggctaaacataacagaggcttttgatgcatgggataatacagtgacacaacaggc

SEQ ID NO: 194575 - DNA, 75 bp, Artificial Sequence
  Synthetic
gccaaatacaagtagaccaacagcaccacctagtgggaaaagaggaaactaccccgtgcaacaagcgggtggcaa

SEQ ID NO: 194576 - DNA, 75 bp, Artificial Sequence
  Synthetic
agtagatgatgtgtggagactctttgaaacctccataaaaccatgtgtcaaactaaccccactgtgtgtggcaat

SEQ ID NO: 194577 - DNA, 75 bp, Artificial Sequence
  Synthetic
agaagtagtgccaggatttcaggcactctcagaaggctgcacgccctatgatattaatcaaatgcttaattgtgt

SEQ ID NO: 194578 - DNA, 75 bp, Artificial Sequence
  Synthetic
gaactgtagtaaaaccgaaacaaacccagggaatgccagtagtactaccaccactaagcctactaccacctctcg

SEQ ID NO: 194579 - DNA, 75 bp, Artificial Sequence
  Synthetic
tgggctgaaaacgattaacgaaacagacccatgcataaaaaatgacagctgcacaggactaggagaagaggaaat

SEQ ID NO: 194580 - DNA, 75 bp, Artificial Sequence
  Synthetic
ataatcagagagattattaatgaagaagcagcagactgggattcgcagcacccaataccaggccccttaccagca

SEQ ID NO: 194581 - DNA, 75 bp, Artificial Sequence
  Synthetic
aatgcaatgtaattttagtatgacgggactaagaagagatgagctaaaacaatataaagacacctggtactcaga

SEQ ID NO: 194582 - DNA, 75 bp, Artificial Sequence
  Synthetic
agatttagagtgtaataataccaggaagtataccagcagatgctatataagaacctgcaacacaacaattatcca

SEQ ID NO: 194583 - DNA, 75 bp, Artificial Sequence
  Synthetic
tagggaacatctacagaagatggatccaaatagggctgcaaaagtgtgtcagaaagtacaacccaactaacatct

SEQ ID NO: 194584 - DNA, 75 bp, Artificial Sequence
  Synthetic
agagtcatgtgacaaacattattgggacagcttaaggtttaggtattgtgctcccccggggttttttctactaag

SEQ ID NO: 194585 - DNA, 75 bp, Artificial Sequence
  Synthetic
agaaagtacaacccaactaacatcttagacataaaacagggaccaaaagaaccgttccaaagctatgtagacagg

SEQ ID NO: 194586 - DNA, 75 bp, Artificial Sequence
  Synthetic
ctcccccggggttttttctactaagatgtaatgataccaactattcaggcttcatgcccaactgcagtaaggtag

SEQ ID NO: 194587 - DNA, 75 bp, Artificial Sequence
  Synthetic
tagcgtcctcctgcacaagaatgatggaaacacagtcctctacatggtttggcttcaatggtacaagggcagaga

SEQ ID NO: 194588 - DNA, 75 bp, Artificial Sequence
  Synthetic
gatgacccaaacgctgctaatacagaatgccaacccagactgcaagttagtactaaaaggactggggatgaatcc

SEQ ID NO: 194589 - DNA, 75 bp, Artificial Sequence
  Synthetic
acaggacatatatatattggcatgaaaaagacaataggaccatcataagcttaaatacatactataatttgtcaa

SEQ ID NO: 194590 - DNA, 75 bp, Artificial Sequence
  Synthetic
caccctagaagagatgctaaccgcctgccagggggtaggcggaccaggccagaaagccaggctaatggctgaagc

SEQ ID NO: 194591 - DNA, 75 bp, Artificial Sequence
  Synthetic
tgccagggggtaggcggaccaggccagaaagccaggctaatggctgaagccctaaaagaggctatgggaccaagc

SEQ ID NO: 194592 - DNA, 75 bp, Artificial Sequence
  Synthetic
tacactgtaagaggccaggaaacaagacggttgtaccaataagaaccgtgtcaggactacttttccattcacagc

SEQ ID NO: 194593 - DNA, 75 bp, Artificial Sequence
  Synthetic
tactaaaaggactggggatgaatcccaccctagaagagatgctaaccgcctgccagggggtaggcggaccaggcc

SEQ ID NO: 194594 - DNA, 75 bp, Artificial Sequence
  Synthetic
cctatcccatttgcagcagcccaacaaagaaaggcaattaggtattggaactgtggaaaggagggacactcggca

SEQ ID NO: 194595 - DNA, 75 bp, Artificial Sequence
  Synthetic
ctatcaataagagacccagacaagcttggtgctggtttaagggaaactggacagaagccataaaggaggtgaaaa

SEQ ID NO: 194596 - DNA, 75 bp, Artificial Sequence
  Synthetic
agacagtgccgagcacctagaagacagggctgctggaagtgtggcaagccaggacacatcatggcaaactgcccg

SEQ ID NO: 194597 - DNA, 75 bp, Artificial Sequence
  Synthetic
ggaccatcataaaacatcccaggtataaaggaggtgcaaaaaatatcacaagcgtaaagttagtatcagaacatg

SEQ ID NO: 194598 - DNA, 75 bp, Artificial Sequence
  Synthetic
aggacacatcatggcaaactgcccggaaagacaggcaggttttttagggttgggcccacggggaaagaagcctcg

SEQ ID NO: 194599 - DNA, 75 bp, Artificial Sequence
  Synthetic
gaaaaggttcagatccagaaacaacatatatgtggaccaattgtagaggagaattcttatactgtaatatgacct

SEQ ID NO: 194600 - DNA, 75 bp, Artificial Sequence
  Synthetic
caacttccccgtgacccaagcccctcaggggctgataccaacagcacctccggcagatccagcagcggaactgtt

SEQ ID NO: 194601 - DNA, 75 bp, Artificial Sequence
  Synthetic
ggttcttaaactgggtagagaacaaaacaaatacaactcggagaaattatgcgccatgtcatatcagacagataa

SEQ ID NO: 194602 - DNA, 75 bp, Artificial Sequence
  Synthetic
aagcagagggagcagagggagagaccatacaaagaggtgacggaggacttgctgcacctcgagcagagagagaca

SEQ ID NO: 194603 - DNA, 75 bp, Artificial Sequence
  Synthetic
tcaacacgtggcacaaggttgggaaaaatatatatttgcctccaagagaaggtgagctctcatgtaattccactg

SEQ ID NO: 194604 - DNA, 75 bp, Artificial Sequence
  Synthetic
tgactagcctcatagccaacatcaactcagacaacagtaccaccaatatttctgtgagtgcagaagtgtcagaac

SEQ ID NO: 194605 - DNA, 75 bp, Artificial Sequence
  Synthetic
tcgaggatcagccggtagaagtcttactagacacaggggctgatgactcaatagtagcaggaatagaattagggg

SEQ ID NO: 194606 - DNA, 75 bp, Artificial Sequence
  Synthetic
taaattagtagaaataacaccaattggcttcgcacctacagatgtaagaagatactcctcagtaaaaccgaggaa

SEQ ID NO: 194607 - DNA, 75 bp, Artificial Sequence
  Synthetic
acaattacactccaaaaatagtagggggaatagggggatttataaacaccaaagaatacaaaaatgtagaaataa

SEQ ID NO: 194608 - DNA, 75 bp, Artificial Sequence
  Synthetic
gggaatagggggatttataaacaccaaagaatacaaaaatgtagaaataaaagtactaaataaaagagtaagagc

SEQ ID NO: 194609 - DNA, 75 bp, Artificial Sequence
  Synthetic
caccataatgacaggagataccccaatcaacatctttggcagaaatattctgacagccttaggcatgtcattaaa

SEQ ID NO: 194610 - DNA, 75 bp, Artificial Sequence
  Synthetic
atcaacatctttggcagaaatattctgacagccttaggcatgtcattaaatttaccagttgccaagatagagcca

SEQ ID NO: 194611 - DNA, 75 bp, Artificial Sequence
  Synthetic
ataaaagtaacattgaagccagggaaagatggaccaaggctgaaacaatggcccctaacaaaagagaaaatagaa

SEQ ID NO: 194612 - DNA, 75 bp, Artificial Sequence
  Synthetic
aagatggaccaaggctgaaacaatggcccctaacaaaagagaaaatagaagcactaaaagagatctgtgaaaaaa

SEQ ID NO: 194613 - DNA, 75 bp, Artificial Sequence
  Synthetic
aattcatggggatgtgctttcagacaggtctgtcacacgactgtaccatggccaaatgaaaccctcacaccaaat

SEQ ID NO: 194614 - DNA, 75 bp, Artificial Sequence
  Synthetic
tggaataacatgacatggcaacagtgggaaaagcaagtccatttcttggatgcaaatataacggctctgttagaa

SEQ ID NO: 194615 - DNA, 75 bp, Artificial Sequence
  Synthetic
gaggctcagatacaacaggaaaagaacatgtatgaattacagaaaataaatagctgggatgtttttggtaattgg

SEQ ID NO: 194616 - DNA, 75 bp, Artificial Sequence
  Synthetic
agctaggaattccacacccggcaggactagccaaaaagaaaaggatctctatattagatgtaggggatgcctatt

SEQ ID NO: 194617 - DNA, 75 bp, Artificial Sequence
  Synthetic
tttgacctcacctcctggataaaatatatccatttaggactatatatagtagcagggttagtagtgttaagaata

SEQ ID NO: 194618 - DNA, 75 bp, Artificial Sequence
  Synthetic
taggcagtatactgcatttaccctaccagcagtaaacaatatggaaccaggaaaaagatatatatataaagtctt

SEQ ID NO: 194619 - DNA, 75 bp, Artificial Sequence
  Synthetic
agtattctcctcccctccctcttatactcaacagatccctatccgcaaggaccggggacagccagccaacgaaga

SEQ ID NO: 194620 - DNA, 75 bp, Artificial Sequence
  Synthetic
aagtcttagaacctttcagaaaagcaaacccagatgtcattctcatccagtacatggatgatatcttaatagcta

SEQ ID NO: 194621 - DNA, 75 bp, Artificial Sequence
  Synthetic
aaacccagatgtcattctcatccagtacatggatgatatcttaatagctagtgacaggacaggtttagagcatga

SEQ ID NO: 194622 - DNA, 75 bp, Artificial Sequence
  Synthetic
tacatggatgatatcttaatagctagtgacaggacaggtttagagcatgacaaagtggtcctgcagctaaaagaa

SEQ ID NO: 194623 - DNA, 75 bp, Artificial Sequence
  Synthetic
cttctaaatggcctagggttttctactccagatgagaagttccaaaaagaccctccatttcaatggatgggctgt

SEQ ID NO: 194624 - DNA, 75 bp, Artificial Sequence
  Synthetic
gcgccagctgaggaacctcttaatttggctatacaacggctgcagaaccttactgttgaagaccttccaaatcct

SEQ ID NO: 194625 - DNA, 75 bp, Artificial Sequence
  Synthetic
gaactatggccaactaaatggaagctgcagaaactacaactgccccagaaagacatatggacagtcaatgacatc

SEQ ID NO: 194626 - DNA, 75 bp, Artificial Sequence
  Synthetic
ccaccaaatctcaaccaatctccaaccactcaggctcccggttgcgtacctccagtatgggatcagctggttcca

SEQ ID NO: 194627 - DNA, 75 bp, Artificial Sequence
  Synthetic
agacatatggacagtcaatgacatccaaaagctagtgggagtcttaaattgggcggcacaaatctattcaggaat

SEQ ID NO: 194628 - DNA, 75 bp, Artificial Sequence
  Synthetic
agaagcgctccgagcggcagcaagggctacgggagaaactcttgcgagtgccggagagaccttatgggaggctct

SEQ ID NO: 194629 - DNA, 75 bp, Artificial Sequence
  Synthetic
aaaaaccaaacacttatgtagactaattagaggaaaaatgacactcacagaagaagtgcagtggacagaactagc

SEQ ID NO: 194630 - DNA, 75 bp, Artificial Sequence
  Synthetic
caggagagcggcgagagcaatcatcgcgatccccaggagaatcagacaaggacttgaactcaccctcttgtgagg

SEQ ID NO: 194631 - DNA, 75 bp, Artificial Sequence
  Synthetic
gacaaaatgcccggggggcagaagggggagggcaacaagatgcagatgaaagtgatgaggacgatgaagtgggag

SEQ ID NO: 194632 - DNA, 75 bp, Artificial Sequence
  Synthetic
gatattattaccaagaagaaaaagaattagaggcaacaatccaaaaaagccaaggacatcaatggacatacaaaa

SEQ ID NO: 194633 - DNA, 75 bp, Artificial Sequence
  Synthetic
ccatatgtaagaccccaatagtaccactgagaccaatgacatacaaactagcagtagacatgtctcattttataa

SEQ ID NO: 194634 - DNA, 75 bp, Artificial Sequence
  Synthetic
caatagtaccactgagaccaatgacatacaaactagcagtagacatgtctcattttataaaagaacaggggggac

SEQ ID NO: 194635 - DNA, 75 bp, Artificial Sequence
  Synthetic
gattggcgcccgaacagggacatgaagaagagtgagagtcttcggagcacggctgagtgaaggcagtaagggcgg

SEQ ID NO: 194636 - DNA, 75 bp, Artificial Sequence
  Synthetic
ggctgagtgaaggcagtaagggcggcaggaatcaaccacgacggagagctcctgtaaaggcgcaggccggtacca

SEQ ID NO: 194637 - DNA, 75 bp, Artificial Sequence
  Synthetic
ggcagcgtgaggagcgggaggaaaagaggcctccgggaggaaaggtgagtactccaaattctgaattgtctgctc

SEQ ID NO: 194638 - DNA, 75 bp, Artificial Sequence
  Synthetic
gtggtgggataactactggcaagtgacatggatcccagagtgggactttgtatctaccccaccactggtcaggtt

SEQ ID NO: 194639 - DNA, 75 bp, Artificial Sequence
  Synthetic
gaggcctccgggaggaaaggtgagtactccaaattctgaattgtctgctctaagaaaggagtagggcataagtgg

SEQ ID NO: 194640 - DNA, 75 bp, Artificial Sequence
  Synthetic
tgtcagggaagaaaacagatgaattagaaaaagttaggttacggcccggcggaaagaaaaggtattgtctaaaac

SEQ ID NO: 194641 - DNA, 75 bp, Artificial Sequence
  Synthetic
ataccaggcgcagagaccttctacacagatggatcatgcaatagacagtcaaaagagggaaaagcaggatatgta

SEQ ID NO: 194642 - DNA, 75 bp, Artificial Sequence
  Synthetic
acagatagaggaaaagacaaagtaaaagtattagaacaaactaccaatcagcaggcagaattagaagtctttcgg

SEQ ID NO: 194643 - DNA, 75 bp, Artificial Sequence
  Synthetic
atataatatgggcagtgaacgaattggacagatttggattagcagagagcctgttggaatcaaaagaaggatgtc

SEQ ID NO: 194644 - DNA, 75 bp, Artificial Sequence
  Synthetic
atggcactggcagactcaggcccaaaggttaatatcatagtagattcacagtatgtaatggggatagtagcaggc

SEQ ID NO: 194645 - DNA, 75 bp, Artificial Sequence
  Synthetic
acaaaattcttacggtcttagctccattagtaccaacaggatcagaaaatttaaaaagcctttttaatactgtct

SEQ ID NO: 194646 - DNA, 75 bp, Artificial Sequence
  Synthetic
gtatgtaatggggatagtagcaggccagccaacagagtcagaaaatagaatagtgaaccagatcatagaagaaat

SEQ ID NO: 194647 - DNA, 75 bp, Artificial Sequence
  Synthetic
agagaaagtgaaagatactgaggaagcaaaaaagatagcacagagacatctagcggcggacacagagaaaatgcc

SEQ ID NO: 194648 - DNA, 75 bp, Artificial Sequence
  Synthetic
gataaagaaggaagcagtctatgttgcatgggtcccagcccataaaggcataggaggaaaccaggaagtagacca

SEQ ID NO: 194649 - DNA, 75 bp, Artificial Sequence
  Synthetic
agctacaagtagaccaacagcaccacctagcggcggaaattacccagtgcagcagatagctggcaactacgtcca

SEQ ID NO: 194650 - DNA, 75 bp, Artificial Sequence
  Synthetic
cctagcggcggaaattacccagtgcagcagatagctggcaactacgtccacatgccgctaagccctcgaacctta

SEQ ID NO: 194651 - DNA, 75 bp, Artificial Sequence
  Synthetic
ccgctcaagaggaacatgaaaaatatcatagcattataaaagaactaacccataaatttggaataccccttctag

SEQ ID NO: 194652 - DNA, 75 bp, Artificial Sequence
  Synthetic
aatgcctgggtaaagttagtagaagaaaagaagttcggggcagaagtagtaccaggattccaggcactatcagaa

SEQ ID NO: 194653 - DNA, 75 bp, Artificial Sequence
  Synthetic
aaaagaagttcggggcagaagtagtaccaggattccaggcactatcagaaggatgcactccttatgatataaatc

SEQ ID NO: 194654 - DNA, 75 bp, Artificial Sequence
  Synthetic
gccatacatgggcaagtaaatgcagaaataggcgtttggcaaatggactacacacacttagaaggaaaaatcatt

SEQ ID NO: 194655 - DNA, 75 bp, Artificial Sequence
  Synthetic
cacacacttagaaggaaaaatcattatagtagcagtacatgttgcaagtggattcatagaagcagaagtcatccc

SEQ ID NO: 194656 - DNA, 75 bp, Artificial Sequence
  Synthetic
atagtagcagtacatgttgcaagtggattcatagaagcagaagtcatcccacaggaatcaggaaggcagacagca

SEQ ID NO: 194657 - DNA, 75 bp, Artificial Sequence
  Synthetic
caaaatcctgttccggtagggaacatttacagaagatggattcaaatagggctgcagaaatgtgtccggatgtac

SEQ ID NO: 194658 - DNA, 75 bp, Artificial Sequence
  Synthetic
gctgcagaaatgtgtccggatgtacaatcctaccaacatattagacataaagcagggaccaaaagaacctttcca

SEQ ID NO: 194659 - DNA, 75 bp, Artificial Sequence
  Synthetic
agcagggaccaaaagaacctttccaaagctacgtagatagattctacaaaagcttacgggcagagcaaacagacc

SEQ ID NO: 194660 - DNA, 75 bp, Artificial Sequence
  Synthetic
ggctaatggctgaggccttaaaagaggccttaacacctgcacccataccgtttgctgccgctcaacaaaaagcag

SEQ ID NO: 194661 - DNA, 75 bp, Artificial Sequence
  Synthetic
atcagctgtggaaaggacctggtgaactactgtggaagggagaaggagcagtcatagtcaaggtagggacagaca

SEQ ID NO: 194662 - DNA, 75 bp, Artificial Sequence
  Synthetic
gtcatagtcaaggtagggacagacataaaagtagtaccaagaaggaaggccaagattatcagggactatggagga

SEQ ID NO: 194663 - DNA, 75 bp, Artificial Sequence
  Synthetic
gaaagagagggacggtgacatgctggaactgtggcaaggtaggacacacagccaagcaatgcagggcccctagaa

SEQ ID NO: 194664 - DNA, 75 bp, Artificial Sequence
  Synthetic
gacagggatgctggaaatgtggaaaacaaggacacatcatgtcaaaatgcccagaaagacaggctggttttttag

SEQ ID NO: 194665 - DNA, 75 bp, Artificial Sequence
  Synthetic
acctggagggtgccagggaggatggagaaatggcatgcccttgtcaagtacctgaaatacagaacaaaagaccta

SEQ ID NO: 194666 - DNA, 75 bp, Artificial Sequence
  Synthetic
gaggaggtgcgctatgttccccaccacaaggtgggatgggcatggtggacttgcagcagggtaatattcccacta

SEQ ID NO: 194667 - DNA, 75 bp, Artificial Sequence
  Synthetic
aggcatattggaacctaacaccagaaaaaggatggctctcctctcatgcagtaagattaacctggtatacagaaa

SEQ ID NO: 194668 - DNA, 75 bp, Artificial Sequence
  Synthetic
aaaaggatggctctcctctcatgcagtaagattaacctggtatacagaaaagttctggacagatgttaccccaga

SEQ ID NO: 194669 - DNA, 75 bp, Artificial Sequence
  Synthetic
agttctggacagatgttaccccagactgtgcagacatcctaatacatagcacttatttctcttgctttacggcag

SEQ ID NO: 194670 - DNA, 75 bp, Artificial Sequence
  Synthetic
agtattactagacacaggagctgacgactcaatagtagcaggaatagaattaggtagcaattacaccccaaaaat

SEQ ID NO: 194671 - DNA, 75 bp, Artificial Sequence
  Synthetic
taggtagcaattacaccccaaaaatagtaggggggataggagggttcataaataccaaagaatacaaagatgtag

SEQ ID NO: 194672 - DNA, 75 bp, Artificial Sequence
  Synthetic
accccaataaacatttttggcagaaatattttaaatacattaggcatgactctaaatttcccagtagcaaagata

SEQ ID NO: 194673 - DNA, 75 bp, Artificial Sequence
  Synthetic
gaaccagtaaaagtcaaactaaagcctgggaaagatggaccaaaaatcagacaatggcctctatccaaagaaaag

SEQ ID NO: 194674 - DNA, 75 bp, Artificial Sequence
  Synthetic
gatatttgtgcctaatgcaaaaagctatatttacacatttcaagagagggtgcacttgctggggggaggacatgg

SEQ ID NO: 194675 - DNA, 75 bp, Artificial Sequence
  Synthetic
atattggccctcaaggaaatctgtgaaaagatggaaaaggagggacagctagaagaagcgccccctactaatcca

SEQ ID NO: 194676 - DNA, 75 bp, Artificial Sequence
  Synthetic
aaaagatggaaaaggagggacagctagaagaagcgccccctactaatccatacaacacacccacctttgccataa

SEQ ID NO: 194677 - DNA, 75 bp, Artificial Sequence
  Synthetic
tgcacttgctggggggaggacatgggccgggaaggattggaagaccaaggacctccccctcctccccctccaggt

SEQ ID NO: 194678 - DNA, 75 bp, Artificial Sequence
  Synthetic
aaaagagagataaaaacaaatggagaatgctaatagattttagagaattaaacaaggtgacccaagactttacag

SEQ ID NO: 194679 - DNA, 75 bp, Artificial Sequence
  Synthetic
ccacggagggacttagggagtgactgggtaatagaaactctgagggaaataaaggaagaagccttaagacatttt

SEQ ID NO: 194680 - DNA, 75 bp, Artificial Sequence
  Synthetic
aacaaggtgacccaagactttacagaagtccaactgggtattccccacccggcagggttggcagaaaaaaggaga

SEQ ID NO: 194681 - DNA, 75 bp, Artificial Sequence
  Synthetic
gggtaatagaaactctgagggaaataaaggaagaagccttaagacattttgatccccgcttgctaattgctcttg

SEQ ID NO: 194682 - DNA, 75 bp, Artificial Sequence
  Synthetic
agacacccttgaaggcgccagagagctcattaaaaccctacaacgagccctcttcgtgcacttcagagcgggatg

SEQ ID NO: 194683 - DNA, 75 bp, Artificial Sequence
  Synthetic
taaccgctcaagaattggctaaacaaggagaagaactccttgcccagctgcaccgacccctagagccatgcacta

SEQ ID NO: 194684 - DNA, 75 bp, Artificial Sequence
  Synthetic
acaaatgctattgtaagcgatgcagtttccattgccagctgtgtttctcgaaaaaggggctcggaatatcatatg

SEQ ID NO: 194685 - DNA, 75 bp, Artificial Sequence
  Synthetic
agcgaaagggcagacgaagaaggactccaaggaaaactaagactccttcgccttctgcaccagacaagtgagtat

SEQ ID NO: 194686 - DNA, 75 bp, Artificial Sequence
  Synthetic
ggagcctggtaggaatcagctgtttgttgtcattttactaacaagtgcttgcttagtatattgtagccagtatgt

SEQ ID NO: 194687 - DNA, 75 bp, Artificial Sequence
  Synthetic
gcttagtatattgtagccagtatgtgactgttttctatggcatacccgcgtggaaaaatgcatctattcccttat

SEQ ID NO: 194688 - DNA, 75 bp, Artificial Sequence
  Synthetic
tttgtgcaactaaaaatagagacacttgggggaccatacagtgcttgccagacaatgatgattatcaggaaataa

SEQ ID NO: 194689 - DNA, 75 bp, Artificial Sequence
  Synthetic
ttgggggaccatacagtgcttgccagacaatgatgattatcaggaaataattttaaatgtgacagaggcttttga

SEQ ID NO: 194690 - DNA, 75 bp, Artificial Sequence
  Synthetic
aaactaattaggggaaagatgaccctaacagaagaagtacaatggacagaattagcagaggcagagttacaggag

SEQ ID NO: 194691 - DNA, 75 bp, Artificial Sequence
  Synthetic
tgcatggaataatacagtgacagaacaagcagtagaagatgtctggcatctatttgagacatcaataaaaccatg

SEQ ID NO: 194692 - DNA, 75 bp, Artificial Sequence
  Synthetic
tgtcaagctaacacctctatgtgtggcaatgaattgtagcagggttcaagggaataccacgaccccgaatcccag

SEQ ID NO: 194693 - DNA, 75 bp, Artificial Sequence
  Synthetic
gacctcgagttccacaacctcgagaccacccacatccgcagcctccataataaatgaaacttctaactgcataga

SEQ ID NO: 194694 - DNA, 75 bp, Artificial Sequence
  Synthetic
gttaaaaacacccacaccaacggggtaagactactggcacatgtagttcagaaaataggaaaagaagccctagtc

SEQ ID NO: 194695 - DNA, 75 bp, Artificial Sequence
  Synthetic
gaaaataggaaaagaagccctagtcatctggggagagataccagtattccatctgccagtagaaagagagacatg

SEQ ID NO: 194696 - DNA, 75 bp, Artificial Sequence
  Synthetic
aaacaacacatgcgcaggattagggtatgaggagatgatgcaatgtgagttcaatatgaaggggttagaacaaga

SEQ ID NO: 194697 - DNA, 75 bp, Artificial Sequence
  Synthetic
taagaaaaggaggtataaggacacatggtatttagaagatgtggtttgtgacaacacaacagctggcacatgtta

SEQ ID NO: 194698 - DNA, 75 bp, Artificial Sequence
  Synthetic
catgagacattgcaacacatcaatcatcaaagagtcatgtgataagcactattgggatgctatgaggtttagata

SEQ ID NO: 194699 - DNA, 75 bp, Artificial Sequence
  Synthetic
tatgtcacagacaggggaaaagataaggttaaagtgctagagcagacaacaaatcaacaagcagaacttgaagca

SEQ ID NO: 194700 - DNA, 75 bp, Artificial Sequence
  Synthetic
ttaagatgtaatgataccaactattcaggctttgaacctaagtgcactaaagtagtagctgcttcatgcacaagg

SEQ ID NO: 194701 - DNA, 75 bp, Artificial Sequence
  Synthetic
agtagtagctgcttcatgcacaaggatgatggaaacgcaaacttctacttggtttggctttaatggcactagagc

SEQ ID NO: 194702 - DNA, 75 bp, Artificial Sequence
  Synthetic
atgatggaaacgcaaacttctacttggtttggctttaatggcactagagcagaaaatagaacatatatctattgg

SEQ ID NO: 194703 - DNA, 75 bp, Artificial Sequence
  Synthetic
ggtttggctttaatggcactagagcagaaaatagaacatatatctattggcatggcagagataataggactatca

SEQ ID NO: 194704 - DNA, 75 bp, Artificial Sequence
  Synthetic
gctggacagccaacagaaacggagtcaccactagtaaatcaaataattgaagaaatgatcaaaaaagaagcaata

SEQ ID NO: 194705 - DNA, 75 bp, Artificial Sequence
  Synthetic
ttagcttaaacaagtattataatctcacaatgcgttgtaagagaccaggaaataagacagttttaccaataacac

SEQ ID NO: 194706 - DNA, 75 bp, Artificial Sequence
  Synthetic
ttatgtcaggattagtgtttcactctcagccaatcaacacaaggcctaggcaggcatggtgccggtttggaggca

SEQ ID NO: 194707 - DNA, 75 bp, Artificial Sequence
  Synthetic
gatggagggaagccatgcaggaggtgaagcaaacccttgtacaacatcccagatacaaaggaatcaatgatacag

SEQ ID NO: 194708 - DNA, 75 bp, Artificial Sequence
  Synthetic
aaagtaccatggcaatgtaaaagaattagttcataaatttggactcccacagttagtggcaaaacaaatagtaaa

SEQ ID NO: 194709 - DNA, 75 bp, Artificial Sequence
  Synthetic
agatacaaaggaatcaatgatacagggaaaattaactttacgaaaccgggagcaggctcagacccggaagtggca

SEQ ID NO: 194710 - DNA, 75 bp, Artificial Sequence
  Synthetic
aatttctctactgtaacatgacttggttcctcaattgggtagaagacaagaaccaaacacggcgcaactattgcc

SEQ ID NO: 194711 - DNA, 75 bp, Artificial Sequence
  Synthetic
gtcataatagtggcagtccatgtagccagtggatttatagaggcagaggtaataccccaagaaacaggaagacaa

SEQ ID NO: 194712 - DNA, 75 bp, Artificial Sequence
  Synthetic
atataaagcagataattaatacctggcataaagtagggaaaaatgtatatttgcctcctagggaaggggagttgg

SEQ ID NO: 194713 - DNA, 75 bp, Artificial Sequence
  Synthetic
acagctctcttcctgttaaaattggccagcagatggcctatcacacacctgcacacagacaacggcgccaacttc

SEQ ID NO: 194714 - DNA, 75 bp, Artificial Sequence
  Synthetic
cctgtgaatcaacagtaaccagcataattgctaacattgacatagataaaaatcggactcataccaacattacct

SEQ ID NO: 194715 - DNA, 75 bp, Artificial Sequence
  Synthetic
ccagcagatggcctatcacacacctgcacacagacaacggcgccaacttcacctcacaagacgtgaagatggcgg

SEQ ID NO: 194716 - DNA, 75 bp, Artificial Sequence
  Synthetic
ttagtgcagaagtggcagaactgtaccgattagaactgggagactacaaattaatagaaataacaccaattggct

SEQ ID NO: 194717 - DNA, 75 bp, Artificial Sequence
  Synthetic
cttcggggtaccctataacccacaaagtcagggagtagtagaagcaatgaaccatcacctaaaaaaccaaataga

SEQ ID NO: 194718 - DNA, 75 bp, Artificial Sequence
  Synthetic
cctggtggatagggatagaacaaaccttcggggtaccctataacccacaaagtcagggagtagtagaagcaatga

SEQ ID NO: 194719 - DNA, 75 bp, Artificial Sequence
  Synthetic
ttaatagaaataacaccaattggcttcgcacctacagatcagagaaggtactcctcaactccagtgaggaacaaa

SEQ ID NO: 194720 - DNA, 75 bp, Artificial Sequence
  Synthetic
agtcagggagtagtagaagcaatgaaccatcacctaaaaaaccaaatagatagaatcagggaccaggcagtatca

SEQ ID NO: 194721 - DNA, 75 bp, Artificial Sequence
  Synthetic
caacaagaaatgttgcgactgaccgtctggggaacgaaaaacctccaggcaagagtcactgctatcgagaagtac

SEQ ID NO: 194722 - DNA, 75 bp, Artificial Sequence
  Synthetic
ctaaagcatcaggcacagctaaattcatggggatgtgcgtttagacaggtctgccacactactgtaccgtgggta

SEQ ID NO: 194723 - DNA, 75 bp, Artificial Sequence
  Synthetic
aatgactctttatcgcctgactggaaaaatatgacatggcaggagtgggagaaacaagtccgctacctagaggca

SEQ ID NO: 194724 - DNA, 75 bp, Artificial Sequence
  Synthetic
gaaacaagtccgctacctagaggcaaatatcagtcaaagtttagaagaagcccaaattcaacaagaaaagaatat

SEQ ID NO: 194725 - DNA, 75 bp, Artificial Sequence
  Synthetic
ggctagagaaatggcacagtctggtcaagtacctgaagcatagaacaaaagagttgcaacaggtctcttatgtcc

SEQ ID NO: 194726 - DNA, 75 bp, Artificial Sequence
  Synthetic
tgggatattcttggcaactggtttgacttaacctcctgggtcaagtatattcaatatggagtgcatatagtagtg

SEQ ID NO: 194727 - DNA, 75 bp, Artificial Sequence
  Synthetic
gtggacttgcagtagagtaatattccccctaaaagaagaagcatacttagaggtccaagggtattggaatctgac

SEQ ID NO: 194728 - DNA, 75 bp, Artificial Sequence
  Synthetic
cccggaaaggggattcttgagctcctatgctgtaagactaacatggtataaaaggagcttttatacagatgtgac

SEQ ID NO: 194729 - DNA, 75 bp, Artificial Sequence
  Synthetic
ttctcttccccccccggttatctccaacagatccatatccacaaggaccggggacagccagccaacgaaggaaca

SEQ ID NO: 194730 - DNA, 75 bp, Artificial Sequence
  Synthetic
gaagaagacgtcggaggcgacagtggttacgacttgtggccttggccaataaactatgtgcagttcctgatccac

SEQ ID NO: 194731 - DNA, 75 bp, Artificial Sequence
  Synthetic
gttacgacttgtggccttggccaataaactatgtgcagttcctgatccacctactgactcgcctcttgatcgggc

SEQ ID NO: 194732 - DNA, 75 bp, Artificial Sequence
  Synthetic
tatacaacatctgcagagacttactatccaagaactccccgacccgccgactgatctcccagagtctaacagcaa

SEQ ID NO: 194733 - DNA, 75 bp, Artificial Sequence
  Synthetic
ccaccaggaaacagcgacgaagaaacaataggagaagcattcgattggctagaaagaacaataacagagctcaac

SEQ ID NO: 194734 - DNA, 75 bp, Artificial Sequence
  Synthetic
agaaagaacaataacagagctcaacagggtagcagtcaaccacttgccccgagaactcattttccaggtctggca

SEQ ID NO: 194735 - DNA, 75 bp, Artificial Sequence
  Synthetic
tcagggactggctgagacttaaggcggcccaactgcaatatgggtgcgagtggatccaagaagctttccaagcat

SEQ ID NO: 194736 - DNA, 75 bp, Artificial Sequence
  Synthetic
tcgcgaggactacgagagagactcttgcgggcgcgtggggatggttatgggaagcagcgcgacgcatcgggaggg

SEQ ID NO: 194737 - DNA, 75 bp, Artificial Sequence
  Synthetic
gaacagggcatgtcaagtagttataccaaatatagatacttgttgctaatgcagaaagcaatgtttgtgcactat

SEQ ID NO: 194738 - DNA, 75 bp, Artificial Sequence
  Synthetic
tgcgggcgcgtggggatggttatgggaagcagcgcgacgcatcgggaggggaatactcgcagttccaagaagaat

SEQ ID NO: 194739 - DNA, 75 bp, Artificial Sequence
  Synthetic
caggcagggagcagaactcgccctcctgtgagggacagcagtatcagcagggagagtacatgaacagcccatgga

SEQ ID NO: 194740 - DNA, 75 bp, Artificial Sequence
  Synthetic
agggccatgggccagggggatggagatcaggacctcctcctcctcctcccccaggcctagcctaatggcagaagc

SEQ ID NO: 194741 - DNA, 75 bp, Artificial Sequence
  Synthetic
gaaacccagcaacagaaagacagaaagatttgtataggcagcaaaatatggatgatgtagattctgatgatgatg

SEQ ID NO: 194742 - DNA, 75 bp, Artificial Sequence
  Synthetic
acctaataggagttcctgttacaccaagagtaccacggagagaaatgacctataaattggcaatagatatgtcac

SEQ ID NO: 194743 - DNA, 75 bp, Artificial Sequence
  Synthetic
caagagtaccacggagagaaatgacctataaattggcaatagatatgtcacattttataaaagaaaaagggggac

SEQ ID NO: 194744 - DNA, 75 bp, Artificial Sequence
  Synthetic
caggaacaaaccacgacggagtgctcctagaaaagcgcgggccaaggtaccaaaaggcggcgtgtggagcgggag

SEQ ID NO: 194745 - DNA, 75 bp, Artificial Sequence
  Synthetic
ggagagctcattaaaatcctccagcgagccctcttcctccacttcagagccggttgtcaacactcaaggatcgga

SEQ ID NO: 194746 - DNA, 75 bp, Artificial Sequence
  Synthetic
gagccctcttcctccacttcagagccggttgtcaacactcaaggatcggacaaccagggggaggaaatcctctct

SEQ ID NO: 194747 - DNA, 75 bp, Artificial Sequence
  Synthetic
caaccagggggaggaaatcctctctcagctataccgccctcttgaagcatgcgataataaatgctactgtaaaaa

SEQ ID NO: 194748 - DNA, 75 bp, Artificial Sequence
  Synthetic
atgctgttaccattgccagctttgtttccttaaaaagggccttgggatatggtatgaccactcgagaaaaagatc

SEQ ID NO: 194749 - DNA, 75 bp, Artificial Sequence
  Synthetic
aaattaggttacggcccggcggaaagaaaaagtacaggttaaaacatattgtgtgggcagcgaacgaattggaca

SEQ ID NO: 194750 - DNA, 75 bp, Artificial Sequence
  Synthetic
gaaaaagtacaggttaaaacatattgtgtgggcagcgaacgaattggacagattcagattagcagaaaacctgtt

SEQ ID NO: 194751 - DNA, 75 bp, Artificial Sequence
  Synthetic
ggagtcaaaagaaggttgccaaaagattctcacagttttagatccattagtaccaacagggtcagaaaatttaaa

SEQ ID NO: 194752 - DNA, 75 bp, Artificial Sequence
  Synthetic
ggcacacactagcaatcacctgtttattttgctcctacttataagtgtctatgggtttctgggtcataagaaaaa

SEQ ID NO: 194753 - DNA, 75 bp, Artificial Sequence
  Synthetic
ctatgtcactgtcttctatggcatacctgcatggaggaacgcaacggttcctctcttctgtgcaaccacaaacag

SEQ ID NO: 194754 - DNA, 75 bp, Artificial Sequence
  Synthetic
ctctcttctgtgcaaccacaaacagggatacctggggaactgtacagtgcctcccagacaatggggattacaccg

SEQ ID NO: 194755 - DNA, 75 bp, Artificial Sequence
  Synthetic
aaaactagtacagagacatctagtggcagaaacaggaactgcagagaaaatgccaaatacaagtagaccaacagc

SEQ ID NO: 194756 - DNA, 75 bp, Artificial Sequence
  Synthetic
gcagaaacaggaactgcagagaaaatgccaaatacaagtagaccaacagcaccacctagtgggaaaggaggaaac

SEQ ID NO: 194757 - DNA, 75 bp, Artificial Sequence
  Synthetic
agatcagtgtaaatataacagaggcttttgatgcatggaataatacagtaacagaacaggcagtagatgatgtgt

SEQ ID NO: 194758 - DNA, 75 bp, Artificial Sequence
  Synthetic
tgccaaatacaagtagaccaacagcaccacctagtgggaaaggaggaaacttccccgtacaacaggcaggtggca

SEQ ID NO: 194759 - DNA, 75 bp, Artificial Sequence
  Synthetic
actatgtccatgtgccactgagcccccgaactctaaatgcttgggtaaaattagtagaggaaaagaagttcgggg

SEQ ID NO: 194760 - DNA, 75 bp, Artificial Sequence
  Synthetic
ccgaactctaaatgcttgggtaaaattagtagaggaaaagaagttcggggcagaagtagtgccaggatttcaggc

SEQ ID NO: 194761 - DNA, 75 bp, Artificial Sequence
  Synthetic
ttagtagaggaaaagaagttcggggcagaagtagtgccaggatttcaggcactctcagaaggctgcacgccctat

SEQ ID NO: 194762 - DNA, 75 bp, Artificial Sequence
  Synthetic
ggagtctttttgaaacctccataaaaccatgtgttaagctgacgccgctgtgcgtggcaatgagatgtaataaca

SEQ ID NO: 194763 - DNA, 75 bp, Artificial Sequence
  Synthetic
caggaaccaatactactactaaacctattactacacctattactactactaaaccatcagaaaacttactcaacg

SEQ ID NO: 194764 - DNA, 75 bp, Artificial Sequence
  Synthetic
acacaagtccatgtattaaaaatgacacctgcccgggaataggactagaaaacacagttgactgttactttaaca

SEQ ID NO: 194765 - DNA, 75 bp, Artificial Sequence
  Synthetic
tgggcgatcaacaagcagccatgcagataatcagagaaattatcaatgaagaagcagcggattgggatgcgcagc

SEQ ID NO: 194766 - DNA, 75 bp, Artificial Sequence
  Synthetic
tgacaggactaagaagagatgagaaaaaacaatataaggacacctggtacgaaaaagatttagagtgcaacggca

SEQ ID NO: 194767 - DNA, 75 bp, Artificial Sequence
  Synthetic
aaaacaatataaggacacctggtacgaaaaagatttagagtgcaacggcaacagcaccagcaccatatgttacat

SEQ ID NO: 194768 - DNA, 75 bp, Artificial Sequence
  Synthetic
gagaacttgtaatacctcagtgatccaagagtcatgtgataaacattactgggacagcttaagatttaggtactg

SEQ ID NO: 194769 - DNA, 75 bp, Artificial Sequence
  Synthetic
tccagatagggctgcagaagtgtgtcagaatgtacaacccaaccaacgtcttagacgtaaagcagggaccaaaag

SEQ ID NO: 194770 - DNA, 75 bp, Artificial Sequence
  Synthetic
caagagtcatgtgataaacattactgggacagcttaagatttaggtactgtgctcccccaggatatgctctgcta

SEQ ID NO: 194771 - DNA, 75 bp, Artificial Sequence
  Synthetic
aatcattccagagctatgtagacaggttctataaaagcttaagggcagagcaagcagacccggcagtaaaaaatt

SEQ ID NO: 194772 - DNA, 75 bp, Artificial Sequence
  Synthetic
gcttgaataagtattataatctaacaatgcattgcagaaggccagggaacaagacagtcataccaataacaatca

SEQ ID NO: 194773 - DNA, 75 bp, Artificial Sequence
  Synthetic
ctgccagggggtaggcggaccaggccaaaaagccagactaatggctgaagccctaaaagaggctttaacaccacc

SEQ ID NO: 194774 - DNA, 75 bp, Artificial Sequence
  Synthetic
ccctatcccatttgcagcagcccaacaaaggaggacaattaggtgttggaactgtgggaaggagggacactcggc

SEQ ID NO: 194775 - DNA, 75 bp, Artificial Sequence
  Synthetic
tgtcaggactgaatttccattcgcagcctctcaataccagacccagacaggcttggtgctggtttaagggaaact

SEQ ID NO: 194776 - DNA, 75 bp, Artificial Sequence
  Synthetic
caaaggaggacaattaggtgttggaactgtgggaaggagggacactcggcgaaacagtgccgagcacctagaaga

SEQ ID NO: 194777 - DNA, 75 bp, Artificial Sequence
  Synthetic
ggatagaagccataagggaggtaaaggagaccatcataaaacatcccaggtataaaggaacaaataacaccgaga

SEQ ID NO: 194778 - DNA, 75 bp, Artificial Sequence
  Synthetic
cagggctgctggaaatgtggcaagccaggacacatcatggcaaattgcccggacagacaggcgggttttttaggg

SEQ ID NO: 194779 - DNA, 75 bp, Artificial Sequence
  Synthetic
ggataagattggtagggccctcggcaggttcagacccagaggtgagacatatgtggactaactgtaggggagaat

SEQ ID NO: 194780 - DNA, 75 bp, Artificial Sequence
  Synthetic
atgggctcacggggaaagaagccccgcaacttccccgtggcccaagctcctcaggggctgataccaacagcaccc

SEQ ID NO: 194781 - DNA, 75 bp, Artificial Sequence
  Synthetic
tcttctattgtaatatgacctggtttttaaactgggtggagaacagaacaggtacaactcagaagaattatgtga

SEQ ID NO: 194782 - DNA, 75 bp, Artificial Sequence
  Synthetic
tcaggggctgataccaacagcacccccagcagatccggcagcggacctgttagagaaatatttgcagcaggggag

SEQ ID NO: 194783 - DNA, 75 bp, Artificial Sequence
  Synthetic
aaagcagagggagcagagggagagaccatacaaggaggtgacggaagacttactgcacctcgagcagggagagac

SEQ ID NO: 194784 - DNA, 75 bp, Artificial Sequence
  Synthetic
cgtgccacatcaaacagatagtcaacacgtggcacaaggttggaaaatacgtatatttgcctccaagggagggta

SEQ ID NO: 194785 - DNA, 75 bp, Artificial Sequence
  Synthetic
cgctctcctgtaattccagtgtcaccagtcttatagccaacattgacgtgtattatgatggcaatgataccaaga

SEQ ID NO: 194786 - DNA, 75 bp, Artificial Sequence
  Synthetic
ttgctgcacctcaattctctctttggaaaagaccagtagtcacagcatacatcgaggatcagccggtagaagtct

SEQ ID NO: 194787 - DNA, 75 bp, Artificial Sequence
  Synthetic
ccaatattaccatgagtgcagaagtgggagaactgtacagattggaactgggggactacaaattagtagaaataa

SEQ ID NO: 194788 - DNA, 75 bp, Artificial Sequence
  Synthetic
gggagaactgtacagattggaactgggggactacaaattagtagaaataacaccgattggctttgcacctacaga

SEQ ID NO: 194789 - DNA, 75 bp, Artificial Sequence
  Synthetic
ggggactacaaattagtagaaataacaccgattggctttgcacctacagagataaaaagatattcctcaacgaca

SEQ ID NO: 194790 - DNA, 75 bp, Artificial Sequence
  Synthetic
ccgaggaataaaagaggtgtaatggtgctagggttcttgggacttcttgcaatggcaggttctgcaatgggcgca

SEQ ID NO: 194791 - DNA, 75 bp, Artificial Sequence
  Synthetic
aatcaacatctttggcagaaatattttgacagccttaggcatgtcattaaatttaccagtcgctaggatagagcc

SEQ ID NO: 194792 - DNA, 75 bp, Artificial Sequence
  Synthetic
aataaaaataacattgaagccaggaaaagacggaccaaggctgaaacaatggcccctaacaaaagaaaaagtaga

SEQ ID NO: 194793 - DNA, 75 bp, Artificial Sequence
  Synthetic
tgcggctgaccgtctggggaacgaaaaacctccagacaagagtcactgccatcgagaaatacctaaaggaccagg

SEQ ID NO: 194794 - DNA, 75 bp, Artificial Sequence
  Synthetic
aaacctccagacaagagtcactgccatcgagaaatacctaaaggaccaggcactactaaattcgtggggatgtgc

SEQ ID NO: 194795 - DNA, 75 bp, Artificial Sequence
  Synthetic
aaagacggaccaaggctgaaacaatggcccctaacaaaagaaaaagtagaagcattaaaggagatctgtgaaaaa

SEQ ID NO: 194796 - DNA, 75 bp, Artificial Sequence
  Synthetic
atggaaaaagagggccaactagaagaggcacctccaactaatccttataatacccccacatttgcaattaagaaa

SEQ ID NO: 194797 - DNA, 75 bp, Artificial Sequence
  Synthetic
ttttaggcaggtttgtcacacgactgtaccatggccaaatgaaactctcacaccagactgggaaaacatgacatg

SEQ ID NO: 194798 - DNA, 75 bp, Artificial Sequence
  Synthetic
gcaacagtgggaaaagcgagtcaatttcttggatgcaaatataacagccctgttagaagaggctcagatacaaca

SEQ ID NO: 194799 - DNA, 75 bp, Artificial Sequence
  Synthetic
tgttagaagaggctcagatacaacaagaaaggaacatgtatgaattacagaaattaaatagctgggatgtttttg

SEQ ID NO: 194800 - DNA, 75 bp, Artificial Sequence
  Synthetic
gtaattggtttgacttcacctcctggatggcatacatcaggttaggactatatgtagtagcaggattaatagtgt

SEQ ID NO: 194801 - DNA, 75 bp, Artificial Sequence
  Synthetic
taagaatagtaatatacattatgcagatgctagcaagacttaggaagggctataggccagtattctcctcccctc

SEQ ID NO: 194802 - DNA, 75 bp, Artificial Sequence
  Synthetic
gatgctagcaagacttaggaagggctataggccagtattctcctcccctccctcttatactcaacagatccctat

SEQ ID NO: 194803 - DNA, 75 bp, Artificial Sequence
  Synthetic
taccacaagggtggaagggatcaccagcaatctttcaatatacaatgaggcagatcttagaacctttcagaaaag

SEQ ID NO: 194804 - DNA, 75 bp, Artificial Sequence
  Synthetic
gccctggcagatagaatacgctcactttctgattcgccaactgaggaacctcttgatttggctgtacaacggctg

SEQ ID NO: 194805 - DNA, 75 bp, Artificial Sequence
  Synthetic
actcctaaatggcctagggttctctaccccagaggagaagttccaaaaagaccctccgtttcaatggatgggcta

SEQ ID NO: 194806 - DNA, 75 bp, Artificial Sequence
  Synthetic
tttctgattcgccaactgaggaacctcttgatttggctgtacaacggctgcaggaacttactgttgaagacctcc

SEQ ID NO: 194807 - DNA, 75 bp, Artificial Sequence
  Synthetic
tgaactgtggccaactaagtggaagctgcagaaaatacaactgccccagaaagaaacatggacagtcaatgacat

SEQ ID NO: 194808 - DNA, 75 bp, Artificial Sequence
  Synthetic
caaatcctccaaccagcactccaaccgctcaggctttcacttgcatacctccagtatgggatcagctggttccaa

SEQ ID NO: 194809 - DNA, 75 bp, Artificial Sequence
  Synthetic
ccagtatgggatcagctggttccaagaagcaatccaagcagcaacgagggctgcgagagagactcttgcgaacac

SEQ ID NO: 194810 - DNA, 75 bp, Artificial Sequence
  Synthetic
ccaaaaactagtgggaatcttaaattgggcggcacaaatctatccaggaataaaaaccaaacacttgtgcaggtt

SEQ ID NO: 194811 - DNA, 75 bp, Artificial Sequence
  Synthetic
aattagaggaaaaatgacactcacagaagaagtgcagtggacagagttagcagaagcagagctagaagagaacag

SEQ ID NO: 194812 - DNA, 75 bp, Artificial Sequence
  Synthetic
aggaagagccctatggaaagctctcagaaggacagcggaagcaatcatcgcgatccccaggaggatcagacaagg

SEQ ID NO: 194813 - DNA, 75 bp, Artificial Sequence
  Synthetic
aattatcctagaccaggaacaggaaggacactattaccaagaagagaaagaattggaggcaacgatccaaaaaag

SEQ ID NO: 194814 - DNA, 75 bp, Artificial Sequence
  Synthetic
acttgaactcgccctcttgtgagggacgcaatgccccaagagcagaagggggagggcaacaagatacagatgata

SEQ ID NO: 194815 - DNA, 75 bp, Artificial Sequence
  Synthetic
ggagggcaacaagatacagatgatagtgatgaggataatgaagtgggggtctatgtaagacccaataggccactg

SEQ ID NO: 194816 - DNA, 75 bp, Artificial Sequence
  Synthetic
aattggaggcaacgatccaaaaaagtcaagacaatcaatggacatataaaatacaccaggaagagaaaatcctaa

SEQ ID NO: 194817 - DNA, 75 bp, Artificial Sequence
  Synthetic
gggacggataccaaaatttcacctaccggtggagagagagacctgggagcagtggtgggataactactggcaggt

SEQ ID NO: 194818 - DNA, 75 bp, Artificial Sequence
  Synthetic
gtatctaccccaccactggtcaggttgacatttaacctagtaggagatcctataccaggcacagagaccttctac

SEQ ID NO: 194819 - DNA, 75 bp, Artificial Sequence
  Synthetic
gagatgggcgcgagaggctccgtcttgtcagggaagaaaacagatgaattagaaaaagttaggttacggcccggc

SEQ ID NO: 194820 - DNA, 75 bp, Artificial Sequence
  Synthetic
atgtagtatgggcagtgaacgaattggatagatatggattagcagagaccctgttggagtcaaaacaaggatgtc

SEQ ID NO: 194821 - DNA, 75 bp, Artificial Sequence
  Synthetic
agcaagcagaactagaggcctttgcgatggcactggcagactcaggtccaaaggttaacatcatagtagactcac

SEQ ID NO: 194822 - DNA, 75 bp, Artificial Sequence
  Synthetic
agtatgtaatgggaatagtagcaagccaaccaacagagtcagagagtagaatagtaaaccaaatcattgaagaca

SEQ ID NO: 194823 - DNA, 75 bp, Artificial Sequence
  Synthetic
gcaaaaaagatagcacagagccatctagcggtggacaaggaaaaaatgccagctacaagtagaccaacagcacca

SEQ ID NO: 194824 - DNA, 75 bp, Artificial Sequence
  Synthetic
cctagcggcggaaattacccagtgcagcagatagccggtaattatgtccacgtgccgctaagtccccgaacccta

SEQ ID NO: 194825 - DNA, 75 bp, Artificial Sequence
  Synthetic
agtacttttcctggagaaaatagagcctgcccaagaggaacatgaaaaatatcatagcaatataaaagagctgat

SEQ ID NO: 194826 - DNA, 75 bp, Artificial Sequence
  Synthetic
aacgcctgggtaaaattagtggaggacaagaagttcggggcagaagtggtgccaggattccaagcactatcggaa

SEQ ID NO: 194827 - DNA, 75 bp, Artificial Sequence
  Synthetic
gggtgcaccccttacgatattaatcagatgctaaattgtgtaggagatcaccaggcagccatgcaaattattagg

SEQ ID NO: 194828 - DNA, 75 bp, Artificial Sequence
  Synthetic
aatcccaccaatatattagatgtaaaacaggggccgaaggagtccttccaaagctatgtagataggttctacaaa

SEQ ID NO: 194829 - DNA, 75 bp, Artificial Sequence
  Synthetic
agcctacgggcagagcaaacggacccagcagtgaaaaattggatgacacagacactgctaattcagaatgccaac

SEQ ID NO: 194830 - DNA, 75 bp, Artificial Sequence
  Synthetic
ccagattgcaagttagtactcaagggcttgggaataaaccccaccctagaggaaatgctaacggcctgccaagga

SEQ ID NO: 194831 - DNA, 75 bp, Artificial Sequence
  Synthetic
gtaggaggcccaggacaaaaggcaagactaatggctgaggccttaaaagaagccctaacacctgcacccataccg

SEQ ID NO: 194832 - DNA, 75 bp, Artificial Sequence
  Synthetic
tttgctgccgctcagcagaaagcaggaaagaggacaataacatgctggaactgtggcaaaggaggccacacagcc

SEQ ID NO: 194833 - DNA, 75 bp, Artificial Sequence
  Synthetic
aggcaatgcaaggcccctagaagacagggatgctggaaatgtgggaaaccaggacacgtcatgtcacaatgccca

SEQ ID NO: 194834 - DNA, 75 bp, Artificial Sequence
  Synthetic
gatagacaggtgggttttttaggattcggaccctggggaaagaagcctcgcaacttccccatggcccaagtgcct

SEQ ID NO: 194835 - DNA, 75 bp, Artificial Sequence
  Synthetic
ccaagattatcagggactatggaggaaggcaagagctggatagtagtccccacctggagggtgccagggaggatg

SEQ ID NO: 194836 - DNA, 75 bp, Artificial Sequence
  Synthetic
cagagggtgacaccatctgcacccccgatggacccaacacaggacatgacacctcagggtgcgactccatctgca

SEQ ID NO: 194837 - DNA, 75 bp, Artificial Sequence
  Synthetic
ccccctgcagatccagcagtggagatgctgaaaaactacatgcagctagggaagcagcagagagagagccgagag

SEQ ID NO: 194838 - DNA, 75 bp, Artificial Sequence
  Synthetic
caggcatattggaacctaacgccagaaaaaggatggctctcctctcattcagtaagactaacctggtatacagaa

SEQ ID NO: 194839 - DNA, 75 bp, Artificial Sequence
  Synthetic
tggagaagaccagtagtcaaagcaagtattgagggtcagccagtagaagtgttactagacacaggggctgatgat

SEQ ID NO: 194840 - DNA, 75 bp, Artificial Sequence
  Synthetic
ccaataaacatttttggcagaaatatcttaaataccttgggcatgactctaaatttcccagtagcaaaaatagaa

SEQ ID NO: 194841 - DNA, 75 bp, Artificial Sequence
  Synthetic
agatatttgtgcctaatgcaaaaggctatgtttatacatctcaagaaagggtgcacttgcctggggggaggacat

SEQ ID NO: 194842 - DNA, 75 bp, Artificial Sequence
  Synthetic
agaaagataaaaacaaatggagaatgctaatagattttagagagttaaacaaggtaacccaagactttacagaag

SEQ ID NO: 194843 - DNA, 75 bp, Artificial Sequence
  Synthetic
gggccgggaggatggagaccaggaccgccccctcctccccctccaggtctagtctaatgatggaaggagctagga

SEQ ID NO: 194844 - DNA, 75 bp, Artificial Sequence
  Synthetic
tccagctgggtattccccacccggctgggctggcagaaaaaagaagaataacagtattagatgtaggagatgcct

SEQ ID NO: 194845 - DNA, 75 bp, Artificial Sequence
  Synthetic
gatgattgtgtaaataaaagaagaagcctaaaggcattttgatccccgcttgctaattgctcttgacaactatat

SEQ ID NO: 194846 - DNA, 75 bp, Artificial Sequence
  Synthetic
acttcagtgtcccactagacccagatttcaggcagtacacagcatttaccttgccaccagtgaataattcaggac

SEQ ID NO: 194847 - DNA, 75 bp, Artificial Sequence
  Synthetic
ctataatagacatggaaacacccttgaaggcgccagagagctcattaaaatcctacaacgagccctctccatgca

SEQ ID NO: 194848 - DNA, 75 bp, Artificial Sequence
  Synthetic
gaaggcgccagagagctcattaaaatcctacaacgagccctctccatgcacctcagagtgggaggtagccgctca

SEQ ID NO: 194849 - DNA, 75 bp, Artificial Sequence
  Synthetic
caggaaaaagatacatttataaggtcctaccacaaggttggaaggggtccccagcaatttttcaatacaccatgg

SEQ ID NO: 194850 - DNA, 75 bp, Artificial Sequence
  Synthetic
agaattggctaaacaaggagaagaactccttgcccagctacaccgacccctagaggcatgcactaacccatgcta

SEQ ID NO: 194851 - DNA, 75 bp, Artificial Sequence
  Synthetic
ggaaggtactagaccccttcagaaaagccaacgatgatgtcaccatagtccagtacatggatgacattcttgtgg

SEQ ID NO: 194852 - DNA, 75 bp, Artificial Sequence
  Synthetic
ttgtaagaagtgcagtttccattgccagctgtgtttcttgaaaaaagggctcgggatatggtatgtgcgaaaagg

SEQ ID NO: 194853 - DNA, 75 bp, Artificial Sequence
  Synthetic
caagtgacagaagtgatctagagcatgacagggtagtatctcaactaaaacaactattaaatgacatgggattct

SEQ ID NO: 194854 - DNA, 75 bp, Artificial Sequence
  Synthetic
cggacgaagaagaactccaaagagaactaagactcatccgccttctacaccagacaagtgagtatggagcctggt

SEQ ID NO: 194855 - DNA, 75 bp, Artificial Sequence
  Synthetic
ctaccccagaagagaagttccaaaaagaccccccattcaaatggatggggtatgagctctggccaaaaaagtgga

SEQ ID NO: 194856 - DNA, 75 bp, Artificial Sequence
  Synthetic
agaccccccattcaaatggatggggtatgagctctggccaaaaaagtggaaactgcaaaaaatacagctaccaga

SEQ ID NO: 194857 - DNA, 75 bp, Artificial Sequence
  Synthetic
aggaatcagctgcttgctgtcattttattaacaagtgcttgcttaatatattgcaaacaatatgtgactgtcttc

SEQ ID NO: 194858 - DNA, 75 bp, Artificial Sequence
  Synthetic
aaaagaagtctggacagtaaatgacatccagaaattagtgggagtactaaactgggcatctcagctttttccagg

SEQ ID NO: 194859 - DNA, 75 bp, Artificial Sequence
  Synthetic
tatggcgtacccgtgtggagaaatgcatctatccccctattttgtgcaaccaaaaatagagatacttgggggacc

SEQ ID NO: 194860 - DNA, 75 bp, Artificial Sequence
  Synthetic
aattaagacaaggaacatatgcaaattaatcagaggaaagatgaccctaacagaagaagtacagtggacagaact

SEQ ID NO: 194861 - DNA, 75 bp, Artificial Sequence
  Synthetic
caaaaatagagatacttgggggaccatacagtgcttgccagacaatgatgattatcaggaaatacctttaaatgt

SEQ ID NO: 194862 - DNA, 75 bp, Artificial Sequence
  Synthetic
cagaagaagtacagtggacagaactggcagaggcagaacttcaggaaaataaaatcatcctagagcaggaacagg

SEQ ID NO: 194863 - DNA, 75 bp, Artificial Sequence
  Synthetic
aatacagtaacagaacaagcaatagaagatgtctggaggctatttgagacatcgataaaaccatgtgtcaagttg

SEQ ID NO: 194864 - DNA, 75 bp, Artificial Sequence
  Synthetic
agggatcctactacaaagaaggagtacctctagaggcaacagtgcagaaaaatctagcaaaccagtggacataca

SEQ ID NO: 194865 - DNA, 75 bp, Artificial Sequence
  Synthetic
acacctctatgtgtggcaatgaattgtaatccagttacagggaataacaccaatgccacagccaaaccaaccgca

SEQ ID NO: 194866 - DNA, 75 bp, Artificial Sequence
  Synthetic
aaattcatcaggggaataggaccctgaaagtaggaaaatatgcaaaggttaaaaacacccataccaatggagtga

SEQ ID NO: 194867 - DNA, 75 bp, Artificial Sequence
  Synthetic
gccagaccaaccaccaacccttcataccttaccataataaatgaaagttctacctgtgtaggcgcagacaattgc

SEQ ID NO: 194868 - DNA, 75 bp, Artificial Sequence
  Synthetic
gactactggcgcatgtggtccagaaaataggaaaagaagcattagttatctggggagaaataccaatgttccacc

SEQ ID NO: 194869 - DNA, 75 bp, Artificial Sequence
  Synthetic
tggggagaaataccaatgttccacctgccggtagagagagagacgtgggatcagtggtggacagactactggcag

SEQ ID NO: 194870 - DNA, 75 bp, Artificial Sequence
  Synthetic
acaggattgggggacgaagggatggttaattgtaagttcaatatgacgggactggaacaagataagataaagggg

SEQ ID NO: 194871 - DNA, 75 bp, Artificial Sequence
  Synthetic
gtaacttggatcccagaatgggattttatttcaaccccaccattagtaagactagcctacaacctagtcaaggac

SEQ ID NO: 194872 - DNA, 75 bp, Artificial Sequence
  Synthetic
tatactgacacatggtactcagatgatgtggtttgtgacagcacaaacaagacaggcacaaacacgacatgttac

SEQ ID NO: 194873 - DNA, 75 bp, Artificial Sequence
  Synthetic
cccctagaaaaggtggaaacctactacacagatgggtcctgcaacagagcctcaaaggaaggaaaggcaggatat

SEQ ID NO: 194874 - DNA, 75 bp, Artificial Sequence
  Synthetic
atgagacattgtaacacatcagtcatcaaggaatcatgtgataaacattattgggattctatgaagtttagatac

SEQ ID NO: 194875 - DNA, 75 bp, Artificial Sequence
  Synthetic
tgcacaccaccgggttatgccttactaagatgcaatgataccaactactcgggctttgcacctaattgccctaaa

SEQ ID NO: 194876 - DNA, 75 bp, Artificial Sequence
  Synthetic
gtttggctttaatggcactagagcagaaaatagaacatatatctattggcatggtagagacaataggactatcat

SEQ ID NO: 194877 - DNA, 75 bp, Artificial Sequence
  Synthetic
tagcttaaacaaacattataatcttacaatgcattgcaagagaccaggaaataagacagttgtaccaataacact

SEQ ID NO: 194878 - DNA, 75 bp, Artificial Sequence
  Synthetic
tatgtcaggacataggtttcattctcaggcagtcatcaacaaaaaacctagacaggcatggtgctggtttaaagg

SEQ ID NO: 194879 - DNA, 75 bp, Artificial Sequence
  Synthetic
caactggaaaggagccatgcaggaggtgaagcaaacccttgcaggacatcccaggtacaaaggaaccaatgatac

SEQ ID NO: 194880 - DNA, 75 bp, Artificial Sequence
  Synthetic
tagtggcaaaacaaatagtaaattcctgtgataaatgccaacaaaaaggggaagctattcatggacaggtaaatg

SEQ ID NO: 194881 - DNA, 75 bp, Artificial Sequence
  Synthetic
ctgtgataaatgccaacaaaaaggggaagctattcatggacaggtaaatgcagaactaggaacatggcagatgga

SEQ ID NO: 194882 - DNA, 75 bp, Artificial Sequence
  Synthetic
ccaggtacaaaggaaccaatgatacgagtaagattaactttgtgaaaccaggagtaggctcagacccagaggtga

SEQ ID NO: 194883 - DNA, 75 bp, Artificial Sequence
  Synthetic
catacatgtggactaactgcagaggagaatttttctactgtaacatgacttggttcctcaattgggtggagaaca

SEQ ID NO: 194884 - DNA, 75 bp, Artificial Sequence
  Synthetic
ctgtacacacttagaaggaaaggtcataatagtggcagtccatgtagccagtgggttcatagaggcagaggtaat

SEQ ID NO: 194885 - DNA, 75 bp, Artificial Sequence
  Synthetic
ggacgagccaaaaacagcgcaactatgcgccatgccatataaggcagataattaatacctggcataaggtagggc

SEQ ID NO: 194886 - DNA, 75 bp, Artificial Sequence
  Synthetic
aatatgtatatttgcctcctagggaaggggagttgacctgcaactcaacagtaaccagcataattgctaacattg

SEQ ID NO: 194887 - DNA, 75 bp, Artificial Sequence
  Synthetic
acacagatggaaatcagaccaacattacctttagtgcagaggtggcagaactgtaccgattagaattgggagact

SEQ ID NO: 194888 - DNA, 75 bp, Artificial Sequence
  Synthetic
acaaattgatagaaataacaccaattggcttcgcacctacaagtgaaaaaagatattcctcggccccagcgagga

SEQ ID NO: 194889 - DNA, 75 bp, Artificial Sequence
  Synthetic
gagacagttgtgctaatggcagctcactgcatgaattttaaaagaaggggaggaataggggatatgacccctgca

SEQ ID NO: 194890 - DNA, 75 bp, Artificial Sequence
  Synthetic
tgagctattgtggaaaggggaaggagcagtcctcgtaaaggtagggacagagatcaaagtaatacccagaagaaa

SEQ ID NO: 194891 - DNA, 75 bp, Artificial Sequence
  Synthetic
caggtctgccacactactgtaccttgggtaaatgactctttaacacctagatggaacaatatgacatggcaggaa

SEQ ID NO: 194892 - DNA, 75 bp, Artificial Sequence
  Synthetic
accacaaggtaggatgggcctggtggacttgcagtagagtaatattccccctaaaagaaggagcatacctagaga

SEQ ID NO: 194893 - DNA, 75 bp, Artificial Sequence
  Synthetic
tccaggggtattggaatctgaccccggaaaggggactcttaagttcctatgctgtgagaataacatggtacagag

SEQ ID NO: 194894 - DNA, 75 bp, Artificial Sequence
  Synthetic
tagtaggaataatagctttaagaatagcaatatatgtagtgcaattgttaagtagatttagaaagggctataggc

SEQ ID NO: 194895 - DNA, 75 bp, Artificial Sequence
  Synthetic
ctgttttctcctccccccccggttatctccaacagatccatatccatacagaccggggacagccggccaacgaag

SEQ ID NO: 194896 - DNA, 75 bp, Artificial Sequence
  Synthetic
aaacagaaggagacgccggagacgccagtggctacgacttctggccttggccgataaactacatacagctcctga

SEQ ID NO: 194897 - DNA, 75 bp, Artificial Sequence
  Synthetic
taggagaggcattcgcatggctagaaagaacactagcagaactcaacaaggaagcagtcaatcatttgccccgag

SEQ ID NO: 194898 - DNA, 75 bp, Artificial Sequence
  Synthetic
tccacctgctgactcgtctcttgactgggctatacagcatctgcagggacttactatccgcgaactccccgaccc

SEQ ID NO: 194899 - DNA, 75 bp, Artificial Sequence
  Synthetic
tgggctatacagcatctgcagggacttactatccgcgaactccccgacccgccgactgatctcccagaatctgac

SEQ ID NO: 194900 - DNA, 75 bp, Artificial Sequence
  Synthetic
aactcattttccaggtctggcaaaagtcttgggcatattggcgtgatgagcagggcatgtccattagctacacca

SEQ ID NO: 194901 - DNA, 75 bp, Artificial Sequence
  Synthetic
aatataggtacttgcttctaatgcaaaaagcaatgtatatacatattgcaaagggctgtacatgccgacgggagg

SEQ ID NO: 194902 - DNA, 75 bp, Artificial Sequence
  Synthetic
agcaatcgcaaggactgcgagagagactcttgcgggcgcgtggagggggttatgtaaggcagtgcagcgcatcgg

SEQ ID NO: 194903 - DNA, 75 bp, Artificial Sequence
  Synthetic
actcttgcgggcgcgtggagggggttatgtaaggcagtgcagcgcatcgggaggggaatcctcgcagtcccaagg

SEQ ID NO: 194904 - DNA, 75 bp, Artificial Sequence
  Synthetic
aggacctcctcctcctcctcctccaggcctagcctaatggcagaagcagccccagagactcctccagagaatgag

SEQ ID NO: 194905 - DNA, 75 bp, Artificial Sequence
  Synthetic
ggcctagcctaatggcagaagcagccccagagactcctccagagaatgaggacccacagagagagccatgggaag

SEQ ID NO: 194906 - DNA, 75 bp, Artificial Sequence
  Synthetic
ggcagggagattacatgaacaccccatggagaaccccagcaatggaaggacagaaagagtcatacaagcagcaaa

SEQ ID NO: 194907 - DNA, 75 bp, Artificial Sequence
  Synthetic
atatggatgatgtagattctgatgataatgaccaagtgggagtttctgttacatcaagagtaccactaagaccaa

SEQ ID NO: 194908 - DNA, 75 bp, Artificial Sequence
  Synthetic
ttggtaattttatctacagtaggcatggagataccctcgcaggagcaggagaactcattaagattctccaacgag

SEQ ID NO: 194909 - DNA, 75 bp, Artificial Sequence
  Synthetic
cgctcttcctccacttcaggggagggtgccagcactcaaggattggacaaccagggggaggaaatcctctctcag

SEQ ID NO: 194910 - DNA, 75 bp, Artificial Sequence
  Synthetic
ggttggcgcccgaacagggacttgaaagaggactgagaagccctggaacacggctgagtgaaggcagtaagggcg

SEQ ID NO: 194911 - DNA, 75 bp, Artificial Sequence
  Synthetic
ccagggggaggaaatcctctctcagctataccgccctcttgaggcatgcaataacacatgctactgcaagaaatg

SEQ ID NO: 194912 - DNA, 75 bp, Artificial Sequence
  Synthetic
caagagtaccactaagaccaatgacctacaagttggcagtagatatgtcacattttataaaagaaaaagggggac

SEQ ID NO: 194913 - DNA, 75 bp, Artificial Sequence
  Synthetic
atgaccactcgagaaaaagatcttcaaaaagggctaaggttactgcatcttctgcaccagacgagtgagtatggc

SEQ ID NO: 194914 - DNA, 75 bp, Artificial Sequence
  Synthetic
acacattaacagtcacctgcttatttcactcctgcttataagtgtctatgggtgtatgtgtaaacaatatgtcac

SEQ ID NO: 194915 - DNA, 75 bp, Artificial Sequence
  Synthetic
agttaggttacggcccaacggaaagaaaagatacaggttaaaacatgttgtgtgggcagcgaatgaattagacag

SEQ ID NO: 194916 - DNA, 75 bp, Artificial Sequence
  Synthetic
attcggattggcagagagcctgttggaatcaaaagaaggttgccaaaagattcttaaagttttagaaccattagt

SEQ ID NO: 194917 - DNA, 75 bp, Artificial Sequence
  Synthetic
aggaacgcaacggttcctctcttctgtgcaaccgcaaacagggatacctggggaactgtgcagtgcctcccagat

SEQ ID NO: 194918 - DNA, 75 bp, Artificial Sequence
  Synthetic
gtgcaaccgcaaacagggatacctggggaactgtgcagtgcctcccagatagtggtgattacaccgagatcagtg

SEQ ID NO: 194919 - DNA, 75 bp, Artificial Sequence
  Synthetic
tgaatataacagaggcttttgatgcatggaataatacagtgacagaacaggcagtagatgatgtgtggaatcttt

SEQ ID NO: 194920 - DNA, 75 bp, Artificial Sequence
  Synthetic
cagaaacaggaactgcagagaaaatgccaaatataagtagaccaacagcaccacctagtgggaaaggaggaaact

SEQ ID NO: 194921 - DNA, 75 bp, Artificial Sequence
  Synthetic
ttgaaacctccctaaaaccatgtgttaagctgacgccgctatgtgtggcaatgaattgttctacaaataacacaa

SEQ ID NO: 194922 - DNA, 75 bp, Artificial Sequence
  Synthetic
gaactaacaatactactgcatctactactactggtaattctactacaccaatagtagtcaatgaagcaattccat

SEQ ID NO: 194923 - DNA, 75 bp, Artificial Sequence
  Synthetic
gtgttaaagctaacaactgctcgggaataggactagaagatgtggttaactgtacctttaacatgacaggactaa

SEQ ID NO: 194924 - DNA, 75 bp, Artificial Sequence
  Synthetic
gacaagatgagagaaaacaatataatgacacctggtacaggagagatttagagtgcgagggtaccagatgttaca

SEQ ID NO: 194925 - DNA, 75 bp, Artificial Sequence
  Synthetic
tgacacctggtacaggagagatttagagtgcgagggtaccagatgttacatgagaacttgtaatacatcagtgat

SEQ ID NO: 194926 - DNA, 75 bp, Artificial Sequence
  Synthetic
gggcagcttagagacccaagggggtctgacatagcaggaacaacaagcacagtagatgaacagatccagtggatg

SEQ ID NO: 194927 - DNA, 75 bp, Artificial Sequence
  Synthetic
ctgacatagcaggaacaacaagcacagtagatgaacagatccagtggatgtataggcaaccaaatcccgtgccgg

SEQ ID NO: 194928 - DNA, 75 bp, Artificial Sequence
  Synthetic
gtgctcccccaggatatgctatactgagatgtaatgataccaactattcaggcttcatgcacaactgtagtaaag

SEQ ID NO: 194929 - DNA, 75 bp, Artificial Sequence
  Synthetic
ccagatagggctacagaaatgtgtcaggatgtacaacccaactaacatcttagatgtgaagcagggaccaaaaga

SEQ ID NO: 194930 - DNA, 75 bp, Artificial Sequence
  Synthetic
caatgcattgcagaaggccagggaacaagacagtcctaccaataacaatcatgtcagggcgaagattccattcgc

SEQ ID NO: 194931 - DNA, 75 bp, Artificial Sequence
  Synthetic
ggcctgttatcaatgagagacccagacaggcttggtgctggtttgagggaaactggacagaggccatgagggagg

SEQ ID NO: 194932 - DNA, 75 bp, Artificial Sequence
  Synthetic
caccctagaggagatgctgactgcctgccagggagtaggcggaccaagccagaaagccagactaatggctgaagc

SEQ ID NO: 194933 - DNA, 75 bp, Artificial Sequence
  Synthetic
tgccagggagtaggcggaccaagccagaaagccagactaatggctgaagccctaaaggaggctttgacgccagcc

SEQ ID NO: 194934 - DNA, 75 bp, Artificial Sequence
  Synthetic
tgaaggagaccgtcatgaaacatcccaggtatacaggaataaagaacatcacgaaaataaatttggtagggccct

SEQ ID NO: 194935 - DNA, 75 bp, Artificial Sequence
  Synthetic
cctatcccatttgcagcagcccaacaaagaagggcaattaggtgttggaattgtggaaaggagggacactcggcg

SEQ ID NO: 194936 - DNA, 75 bp, Artificial Sequence
  Synthetic
cggcaggttcagacccagaggcaagatatatgtggactaactgtaggggagaattcttctattgtaacatgacat

SEQ ID NO: 194937 - DNA, 75 bp, Artificial Sequence
  Synthetic
ggtttttaaactgggtagaaggcaaaaatggaaccaaaagaaattatgtgccgtgtcacatcagacagatagtca

SEQ ID NO: 194938 - DNA, 75 bp, Artificial Sequence
  Synthetic
acacgtggcacaaggttggaaaatacgtatatttgcctccaagggagggcctgctctcctgtaactccactgtca

SEQ ID NO: 194939 - DNA, 75 bp, Artificial Sequence
  Synthetic
caggggctgataccaacagcacccccaatagatccagcagtggacctgttggagaaatatatgcagcaagggaga

SEQ ID NO: 194940 - DNA, 75 bp, Artificial Sequence
  Synthetic
ctgctctcctgtaactccactgtcaccagtattatagccaacattgaatggattgatagcaacgagaccaatatt

SEQ ID NO: 194941 - DNA, 75 bp, Artificial Sequence
  Synthetic
catacaaggaggtgacggaggacttactgcacctcgagcagggagagacgccccacagaggggcgacagaggact

SEQ ID NO: 194942 - DNA, 75 bp, Artificial Sequence
  Synthetic
ggctttgcacctacaaatataaaaagatattcctcagcaacaccgaggaataggagaggtgtaatggtgctaggg

SEQ ID NO: 194943 - DNA, 75 bp, Artificial Sequence
  Synthetic
gatattcctcagcaacaccgaggaataggagaggtgtaatggtgctagggttcctgggatttctggcaacggcag

SEQ ID NO: 194944 - DNA, 75 bp, Artificial Sequence
  Synthetic
atagtagcaggaatagagttaggggacaattacactccaaaaatagtggggggaatagggggattcataaatacc

SEQ ID NO: 194945 - DNA, 75 bp, Artificial Sequence
  Synthetic
gggaatagggggattcataaataccaaagaatataaaaatgtagaaataaaggtactaaataaaagagtaagagc

SEQ ID NO: 194946 - DNA, 75 bp, Artificial Sequence
  Synthetic
agtcaagagtcactgccatcgagaaatacctaaaggaccaggcactgctaaattcgtggggatgtgcttttagac

SEQ ID NO: 194947 - DNA, 75 bp, Artificial Sequence
  Synthetic
atcaacatttttggcagaaatattctggcaaccttaggcatgtcattaaacctaccagtcgccaagttagaccca

SEQ ID NO: 194948 - DNA, 75 bp, Artificial Sequence
  Synthetic
aggtctgtcacacgactgtaccatggccaaatgaatctctcacacccaactggacagacatgacatggcagcaat

SEQ ID NO: 194949 - DNA, 75 bp, Artificial Sequence
  Synthetic
gggaggagaaggtccactacttggatgcaaatataacacaattattagaagaggcacagatacagcaggaaaaga

SEQ ID NO: 194950 - DNA, 75 bp, Artificial Sequence
  Synthetic
gaggcacagatacagcaggaaaagaatatgtatgagctacagaaattgaatcattgggatgtttttagtaattgg

SEQ ID NO: 194951 - DNA, 75 bp, Artificial Sequence
  Synthetic
agcacctccaactaatccttataatacccccacatttgcaattaagaaaaaggacaagaacaaatggagaatgct

SEQ ID NO: 194952 - DNA, 75 bp, Artificial Sequence
  Synthetic
acatcaggttaggactgtatgtagtagtaggattaatagtgttaaggatagtaatatatgttatacagatgctag

SEQ ID NO: 194953 - DNA, 75 bp, Artificial Sequence
  Synthetic
gtgactcaagatttcacagaaattcagctaggaattccacacccggcaggattagccaaaaagaaaaggattact

SEQ ID NO: 194954 - DNA, 75 bp, Artificial Sequence
  Synthetic
accggggacagccagccaacgaagaaacagaagacgaaggtggaagagaaggggattacagatcttggccctggc

SEQ ID NO: 194955 - DNA, 75 bp, Artificial Sequence
  Synthetic
ccatcagtaaacaatgcagagccagaaaaaagatatgtatataaggtcttaccacaaggatggaaaggatcacca

SEQ ID NO: 194956 - DNA, 75 bp, Artificial Sequence
  Synthetic
aaaaaagatatgtatataaggtcttaccacaaggatggaaaggatcaccagcaatctttcaattcatgatgaggc

SEQ ID NO: 194957 - DNA, 75 bp, Artificial Sequence
  Synthetic
ggatcagctggctccaagaagcaatccaagcagcaacgagggctgcgggagagactcttgcgaacgcgggaagag

SEQ ID NO: 194958 - DNA, 75 bp, Artificial Sequence
  Synthetic
ccccagatgagaagttccaaaaggaccctccgtttcaatggatgggctatgaattgtggccaactaaatggaaac

SEQ ID NO: 194959 - DNA, 75 bp, Artificial Sequence
  Synthetic
ccctatgggaagctctcagaagaacggcgggggcaatcatcgcggtccccaggagaatcagacaaggacttgaac

SEQ ID NO: 194960 - DNA, 75 bp, Artificial Sequence
  Synthetic
tgcagaaaatacaattacctcagaaagaaatatggacagtcaatgacatccaaaaactagtaggagttttgaact

SEQ ID NO: 194961 - DNA, 75 bp, Artificial Sequence
  Synthetic
tcgccctcttatgagggacgcatgccccaaggacaaaaggggggagggcaacaagataaagataatagtgatgag

SEQ ID NO: 194962 - DNA, 75 bp, Artificial Sequence
  Synthetic
gggcggcgcagatctatccagggataaaaaccaagcatttatgtaaattgattagaggaaaaatgacactcacag

SEQ ID NO: 194963 - DNA, 75 bp, Artificial Sequence
  Synthetic
acaagataaagataatagtgatgaggatgatgaagtgggagcctatgtaagacccagtaagccactgagagcaat

SEQ ID NO: 194964 - DNA, 75 bp, Artificial Sequence
  Synthetic
aggaagtacagtggacagagttagcagaggcagaactagaagaaaacaaaattatcttaagtcaggaacaagagg

SEQ ID NO: 194965 - DNA, 75 bp, Artificial Sequence
  Synthetic
tggcgcccgaacagggacttgaggaagagtgagagtcttcggagcacggctgagtgagggcagtaagggcggcag

SEQ ID NO: 194966 - DNA, 75 bp, Artificial Sequence
  Synthetic
gatcctactatcaggaagaagaagaactagaagcaacagtcatcaaaagccaagacaatcagtgggcatacaaaa

SEQ ID NO: 194967 - DNA, 75 bp, Artificial Sequence
  Synthetic
gaatcaaccacgacggagagctcctgtaaaagcgcaggccggtaccaggcagcgtgaggagcgggaggagaagag

SEQ ID NO: 194968 - DNA, 75 bp, Artificial Sequence
  Synthetic
tacaccagggagagagggttctaaaagtaggaaagtatgcgaagataaaaaatactcataccaatggggtcagac

SEQ ID NO: 194969 - DNA, 75 bp, Artificial Sequence
  Synthetic
agcgtgaggagcgggaggagaagaggcctccgggagtaaggtgagtactccaaattttaaattgtctactctaag

SEQ ID NO: 194970 - DNA, 75 bp, Artificial Sequence
  Synthetic
tactagcacaagtagtccaaaaaataggaaaggaagcactggtcatttggggacgagtgccaaaatttcacctac

SEQ ID NO: 194971 - DNA, 75 bp, Artificial Sequence
  Synthetic
aaaggagtagggcataagtgggagatgggcgcgagaggctccgtcttgtcagggaagaaaacagatgaattagaa

SEQ ID NO: 194972 - DNA, 75 bp, Artificial Sequence
  Synthetic
cggtagagagagacacctgggagcaatggtgggataactactggcaagtaacatgggtcccagagtgggacttcg

SEQ ID NO: 194973 - DNA, 75 bp, Artificial Sequence
  Synthetic
aaagttaggttacggcccggcggaaagaaaaaatattgtctaaagcatatagtatgggcagtgaacgaattggac

SEQ ID NO: 194974 - DNA, 75 bp, Artificial Sequence
  Synthetic
agtatgggcagtgaacgaattggacagatatggattagcagagagcctgttggagtcaaaagaaggatgtcacaa

SEQ ID NO: 194975 - DNA, 75 bp, Artificial Sequence
  Synthetic
aaaagaaggaaaagcaggatatgtaacagatagagggagagacagggtaagagtattagagcaaacatccaatca

SEQ ID NO: 194976 - DNA, 75 bp, Artificial Sequence
  Synthetic
catttactgtctgcacgcagaagtgaaagtgaaagatactgaggatgctaaaaagatagcacagagccatctagc

SEQ ID NO: 194977 - DNA, 75 bp, Artificial Sequence
  Synthetic
ggcgaacacggaaaaagcgccagctacaagtaaaccaacagcaccacctagtggcagaaattatccagtgcagca

SEQ ID NO: 194978 - DNA, 75 bp, Artificial Sequence
  Synthetic
acaagtaaaccaacagcaccacctagtggcagaaattatccagtgcagcaggtggccggtaattacacccacctg

SEQ ID NO: 194979 - DNA, 75 bp, Artificial Sequence
  Synthetic
gtatgtaatggggatagtagcaggccaaccaacagagtcagaaaatagaatagtaaaccaaatcattgaggacat

SEQ ID NO: 194980 - DNA, 75 bp, Artificial Sequence
  Synthetic
tagtaaaccaaatcattgaggacatgataaagaaagaagcagtctatgttgcatgggtcccagcccataaaggca

SEQ ID NO: 194981 - DNA, 75 bp, Artificial Sequence
  Synthetic
tttagtaagtcagggcatcagacaagtattattcctggaaaagatagagcccgctcaagaagaacacgaaaaata

SEQ ID NO: 194982 - DNA, 75 bp, Artificial Sequence
  Synthetic
gcaccccttatgatattaatcagatgctaaattgtgtaggagaacatcaagcagccatgcaaattattagggaaa

SEQ ID NO: 194983 - DNA, 75 bp, Artificial Sequence
  Synthetic
taattaatgatgaagcagcagactgggaccagcagcacccgtcaccgggcccaatgccagcaggacagcttaggg

SEQ ID NO: 194984 - DNA, 75 bp, Artificial Sequence
  Synthetic
tggcaagacagatagtaaacacatgtgcccaatgccaacagaaaggagaagccatacatgggcaagtaaatgcag

SEQ ID NO: 194985 - DNA, 75 bp, Artificial Sequence
  Synthetic
acccaagagggtcagacatagcaggaaccactagcacagtggaggagcagatacagtggatgtacaggccccaaa

SEQ ID NO: 194986 - DNA, 75 bp, Artificial Sequence
  Synthetic
accctatcccagtaggaaacatttatagaagatggattcagttagggctgcagaaatgtgtccggatgtataacc

SEQ ID NO: 194987 - DNA, 75 bp, Artificial Sequence
  Synthetic
ctaccaatatactggacataaagcagggaccaaaggaacccttccaaagctatgtagacagattctacaaaagtt

SEQ ID NO: 194988 - DNA, 75 bp, Artificial Sequence
  Synthetic
tacgggcagaacaaacagacccggcagtaaaaaattgggtgacgcaaacactgctgattcagaatgctaacccag

SEQ ID NO: 194989 - DNA, 75 bp, Artificial Sequence
  Synthetic
caggaagtgaagatggtggcatggtggataggtatagagcaatcctttggagtaccttacaatccacaaagccag

SEQ ID NO: 194990 - DNA, 75 bp, Artificial Sequence
  Synthetic
ggataggtatagagcaatcctttggagtaccttacaatccacaaagccagggagtagtagaagcaatgaatcacc

SEQ ID NO: 194991 - DNA, 75 bp, Artificial Sequence
  Synthetic
actgcaaattagtacttaagggcctgggaatgaaccccacactagaggaaatgctaacagcctgccaagggatag

SEQ ID NO: 194992 - DNA, 75 bp, Artificial Sequence
  Synthetic
gaggcccagggcaaaaggcaaggctaatggccgaggctttaaaggaagccttgacacctccacctttaccatttg

SEQ ID NO: 194993 - DNA, 75 bp, Artificial Sequence
  Synthetic
ctgcagttcaacaaagagcagggaagagaggagcagtgacatgctggaactgtggcaaaataggacacacagcca

SEQ ID NO: 194994 - DNA, 75 bp, Artificial Sequence
  Synthetic
gagaggagcagtgacatgctggaactgtggcaaaataggacacacagccaggcaatgtaaagcccctagaaggca

SEQ ID NO: 194995 - DNA, 75 bp, Artificial Sequence
  Synthetic
ggacacatcatgtcaaaatgcccagaaagacaggcgggttttttaggatttggcccctggggaaagaagcctcgc

SEQ ID NO: 194996 - DNA, 75 bp, Artificial Sequence
  Synthetic
tggcccctggggaaagaagcctcgcaacttccctgtagcccaagcaccccaggggatactgccatctgcaccacc

SEQ ID NO: 194997 - DNA, 75 bp, Artificial Sequence
  Synthetic
acctggagggtgccagggaggatggagaggtggcatagccttgtcaagcacctgaagtacagaacaaaagactta

SEQ ID NO: 194998 - DNA, 75 bp, Artificial Sequence
  Synthetic
aatgaacccagcagagaacatgacacctcagggtgcaatgccatctgcgccccctgcagatccagcagtggagat

SEQ ID NO: 194999 - DNA, 75 bp, Artificial Sequence
  Synthetic
cccctgcagatccagcagtggagatgttgaaggactacatgcagctagggagaaagcagaaagggggcagggaga

SEQ ID NO: 195000 - DNA, 75 bp, Artificial Sequence
  Synthetic
tttgctgcacctcaattctctctttggagaagaccagtagttaaagcatatattgagggtcaatcagtagaagta

SEQ ID NO: 195001 - DNA, 75 bp, Artificial Sequence
  Synthetic
tattgagggtcaatcagtagaagtattactagacacaggagctgatgactcaatagtagcaggaatagaattagg

SEQ ID NO: 195002 - DNA, 75 bp, Artificial Sequence
  Synthetic
ttactagacacaggagctgatgactcaatagtagcaggaatagaattaggtagtgattacaccccaaaaatagta

SEQ ID NO: 195003 - DNA, 75 bp, Artificial Sequence
  Synthetic
tagtgattacaccccaaaaatagtaggaggaataggaggattcataaatactaaagagtacaaaaatgtagaaat

SEQ ID NO: 195004 - DNA, 75 bp, Artificial Sequence
  Synthetic
ggaggaataggaggattcataaatactaaagagtacaaaaatgtagaaatagaagtagtaggaaaaaagataaga

SEQ ID NO: 195005 - DNA, 75 bp, Artificial Sequence
  Synthetic
gcaactataatgacaggagataccccaataaacatttttggcagaaatattctaaataccttgggcatgactcta

SEQ ID NO: 195006 - DNA, 75 bp, Artificial Sequence
  Synthetic
aatttcccagtagcaaaaatagaaccagtaaaggtcaaactaaaacctggaaaagatggaccaaaaatcagacaa

SEQ ID NO: 195007 - DNA, 75 bp, Artificial Sequence
  Synthetic
tggcctctatctaaagaaaagatactggcccttaaagagatctgtgaaaaaaatggaaaaagagggacaactaga

SEQ ID NO: 195008 - DNA, 75 bp, Artificial Sequence
  Synthetic
ggaagcgccccctactaatccctacaacacacccaccttcgccataaaaaagagagacaaaaacaaatggagaat

SEQ ID NO: 195009 - DNA, 75 bp, Artificial Sequence
  Synthetic
gatatttgtgcataatgcagaaagctgtgtatatacatttcaagaaggggtgcacttgcctggggagaggacatg

SEQ ID NO: 195010 - DNA, 75 bp, Artificial Sequence
  Synthetic
gttgatagattttagagaattaaacaaggtaacccaagactttacagaagtccagctgggcattccccacccggc

SEQ ID NO: 195011 - DNA, 75 bp, Artificial Sequence
  Synthetic
agggctggcagaaagaaaaagaataacagtactagatataggagatgcctacttcagtatcccactagatccaga

SEQ ID NO: 195012 - DNA, 75 bp, Artificial Sequence
  Synthetic
gtctaatgactgaagcaccaacagagtttcccccagaagatgggaccccacggagagagctagggagtacctggg

SEQ ID NO: 195013 - DNA, 75 bp, Artificial Sequence
  Synthetic
taatagaaactctgaaggaaatcaaggaagaagccttaaaacattttgatccctgcttgctaattgctcttggca

SEQ ID NO: 195014 - DNA, 75 bp, Artificial Sequence
  Synthetic
tttcagacaatacacagcatttaccttgccatcagtgaataatgcagaaccaggaaaaagatacatctataaggt

SEQ ID NO: 195015 - DNA, 75 bp, Artificial Sequence
  Synthetic
caggaaaaagatacatctataaggtcctaccacaagggtggaaagggtccccagcaatttttcaatactccgtag

SEQ ID NO: 195016 - DNA, 75 bp, Artificial Sequence
  Synthetic
actatatctataatagacatggagacacccttgaaggagccagagagctcattagagtcctacaacgagccctct

SEQ ID NO: 195017 - DNA, 75 bp, Artificial Sequence
  Synthetic
tcgtgcacatcagagcgggatgtgaccgctcaagaaagggccaaacaaggagaagagctccttgcccagctgcac

SEQ ID NO: 195018 - DNA, 75 bp, Artificial Sequence
  Synthetic
ccgctcaagaaagggccaaacaaggagaagagctccttgcccagctgcaccgacccctagaggcatgcactaact

SEQ ID NO: 195019 - DNA, 75 bp, Artificial Sequence
  Synthetic
caagtgacagaagcgatctagaacatgacagggtagtgcttcaactgaaagagctattaaatgacataggattct

SEQ ID NO: 195020 - DNA, 75 bp, Artificial Sequence
  Synthetic
catgctattgtaagcagtgcagttaccattgccagctgtgtttcttgaaaaaagggctcgggatatggtatgcgc

SEQ ID NO: 195021 - DNA, 75 bp, Artificial Sequence
  Synthetic
gacagggcagacgaagaaggactccaagaaaaactaagactcatccgcctcctgcatcagataagtaagtatgga

SEQ ID NO: 195022 - DNA, 75 bp, Artificial Sequence
  Synthetic
aagagaaagatggacagtaaatgatattcagaaactagtgggagtactaaactgggcagctcaactctttcctgg

SEQ ID NO: 195023 - DNA, 75 bp, Artificial Sequence
  Synthetic
gcctggtaggaatcagctgcttgttgccattttattaactagtgcttgcttaatatattgcaaacaatatgtgac

SEQ ID NO: 195024 - DNA, 75 bp, Artificial Sequence
  Synthetic
gccattttattaactagtgcttgcttaatatattgcaaacaatatgtgactgttttctatggcatacccgcgtgg

SEQ ID NO: 195025 - DNA, 75 bp, Artificial Sequence
  Synthetic
gattaaaacaaggcatatatgcagactaatcaggggaaaaatgaccttgacagaagaagtacagtggacagaatt

SEQ ID NO: 195026 - DNA, 75 bp, Artificial Sequence
  Synthetic
agcagaggcagaatttcaggaaaacaaaattatcttagaacaagaacaggagggatcctactataaagagggaat

SEQ ID NO: 195027 - DNA, 75 bp, Artificial Sequence
  Synthetic
acctctagaagcaacagtacagaaaaacctagcaaatcagtggacatacaaaatccatcagggagacagaatcct

SEQ ID NO: 195028 - DNA, 75 bp, Artificial Sequence
  Synthetic
aagagtaggaaaatatgcaaaggttaaaaacacccacaccaacggagtaagactactggcacatgtaatccagaa

SEQ ID NO: 195029 - DNA, 75 bp, Artificial Sequence
  Synthetic
caagttgacgcccctatgtgtggcgatgaattgtaatataacttcagggactaccgcgaccccgagtccaccaaa

SEQ ID NO: 195030 - DNA, 75 bp, Artificial Sequence
  Synthetic
aataggaaaggaagcattggtcacctggggagaaataccaatgttccacctgccagtagaaagagagacatggga

SEQ ID NO: 195031 - DNA, 75 bp, Artificial Sequence
  Synthetic
cattacaataatagatgaaaattctacctgtataggcgacaacaactgcacaggattagggaaagaagaggtggt

SEQ ID NO: 195032 - DNA, 75 bp, Artificial Sequence
  Synthetic
tcaatggtggacagattactggcaagtaacctggatcccagaatgggattttgtctcaacaccacctttgataag

SEQ ID NO: 195033 - DNA, 75 bp, Artificial Sequence
  Synthetic
tgagtgtgagttcaatatgacggggctagaacaagataagaaaaggaagtataatgacgcatggtactcaagaga

SEQ ID NO: 195034 - DNA, 75 bp, Artificial Sequence
  Synthetic
actagcctataacctagtcaaagaccccctggagggagtagagacctactacacagatggatcctgtaacaggac

SEQ ID NO: 195035 - DNA, 75 bp, Artificial Sequence
  Synthetic
tgtggtttgtgacaagacaaacggaacaggcacatgttacatgagacattgcaacacatcagtcatcaaagagtc

SEQ ID NO: 195036 - DNA, 75 bp, Artificial Sequence
  Synthetic
cccctggagggagtagagacctactacacagatggatcctgtaacaggacctcgaaagaaggaaaggcaggatat

SEQ ID NO: 195037 - DNA, 75 bp, Artificial Sequence
  Synthetic
gtcacagacaggggaaaggataaagttaaagcattagagcaaacaacaaatcagcaagcagaacttgaagcattt

SEQ ID NO: 195038 - DNA, 75 bp, Artificial Sequence
  Synthetic
gcactagcattacaggattcaggaccacaggtcaatatcatagtggactcacaatatgtcatgggaataatagct

SEQ ID NO: 195039 - DNA, 75 bp, Artificial Sequence
  Synthetic
gcacagccaacagaaacagaatcaccaatagtaaagacaatagttgaagaaatgatcaaaaaggaagcaatatac

SEQ ID NO: 195040 - DNA, 75 bp, Artificial Sequence
  Synthetic
gcaaacttctacttggtttggctttaatggcactagagcagaaaatagaacatatatctattggcatggtaagga

SEQ ID NO: 195041 - DNA, 75 bp, Artificial Sequence
  Synthetic
taataggactatcattagcttaaacaagtattataatctcacaatgcattgtaagagaccaggaaataagacagt

SEQ ID NO: 195042 - DNA, 75 bp, Artificial Sequence
  Synthetic
gtaggatgggtgccagctcataaaggactgggtggtaatcaagaagtagaccacctagtgagtcaaggaatcaga

SEQ ID NO: 195043 - DNA, 75 bp, Artificial Sequence
  Synthetic
tgtaccaataacacttatgtcagggcgaaggtttcactctcggccagtctacaacaaaaaacctgggcaggcatg

SEQ ID NO: 195044 - DNA, 75 bp, Artificial Sequence
  Synthetic
cacatcctgtttctagaaaatatagaaccagcccaagaagagcatgaaaaatatcatggtaatgtaaaagaatta

SEQ ID NO: 195045 - DNA, 75 bp, Artificial Sequence
  Synthetic
aaccagcccaagaagagcatgaaaaatatcatggtaatgtaaaagaattagttcataaatttggaattccacaat

SEQ ID NO: 195046 - DNA, 75 bp, Artificial Sequence
  Synthetic
gtgttggtttcaaggcaactggatagaagccatgcgggaggtgaagcaaacccttgcaaaacatcccaggtacgg

SEQ ID NO: 195047 - DNA, 75 bp, Artificial Sequence
  Synthetic
aggaacaaatgatacaggaaaaattaactttacgaagccaggaataggttcagacccagaagtgacatacatgtg

SEQ ID NO: 195048 - DNA, 75 bp, Artificial Sequence
  Synthetic
gaagctatccatggacaggtgaatgcagaactagggacatggcaaatggattgtacacacttagagggaaaaatt

SEQ ID NO: 195049 - DNA, 75 bp, Artificial Sequence
  Synthetic
ataatagtggcagtccatgtagccagtggatttatagaagcagaagtaataccccaagaaacaggaagacagaca

SEQ ID NO: 195050 - DNA, 75 bp, Artificial Sequence
  Synthetic
attgggtagaaaataagacgaaccaaacacacggcaactatgcgccatgccatataaggcagataattaacacct

SEQ ID NO: 195051 - DNA, 75 bp, Artificial Sequence
  Synthetic
aacacacggcaactatgcgccatgccatataaggcagataattaacacctggcataaggtagggacaaatgtata

SEQ ID NO: 195052 - DNA, 75 bp, Artificial Sequence
  Synthetic
gctctcttcctgttaaaactggccagcagatggcctatcacacacctacacacagacaatggtgccaacttcact

SEQ ID NO: 195053 - DNA, 75 bp, Artificial Sequence
  Synthetic
tcacaagacgtgaaaatggcagcctggtggataggagtagaacagaccttcggagtaccttataatccacaaagt

SEQ ID NO: 195054 - DNA, 75 bp, Artificial Sequence
  Synthetic
tagaattgggggactacaaattgatagaagtaacaccaattccgttcgcacctacaaaagagaaaagatattcct

SEQ ID NO: 195055 - DNA, 75 bp, Artificial Sequence
  Synthetic
attgcatgaattttaaaagaaggggaggaataggggatatgacccctgcagaaagaatagttaacatgataactg

SEQ ID NO: 195056 - DNA, 75 bp, Artificial Sequence
  Synthetic
cggctccagtgaggaacaaaagaggtgtgttcgtgctagggttcttgggttttctcgcgacagcaggttctgcaa

SEQ ID NO: 195057 - DNA, 75 bp, Artificial Sequence
  Synthetic
gaaagaatagttaacatgataactgcagaacaggagatacaattcctccaaacaaaaaagttaaaatttcaaaat

SEQ ID NO: 195058 - DNA, 75 bp, Artificial Sequence
  Synthetic
tgtgttcgtgctagggttcttgggttttctcgcgacagcaggttctgcaatgggcggcgcgtccttgacgctgtc

SEQ ID NO: 195059 - DNA, 75 bp, Artificial Sequence
  Synthetic
gggatagtgcagcaacagcaacagctgttggacgtggtcaagagacaacaagaaatgttgcgattgaccgtctgg

SEQ ID NO: 195060 - DNA, 75 bp, Artificial Sequence
  Synthetic
gcagtcatcataaaggtagggacagaaatcaaagtaatacccagaagaaaagcaaagattatcaagaattatgga

SEQ ID NO: 195061 - DNA, 75 bp, Artificial Sequence
  Synthetic
ggaccaggcacagctaaattcatggggatgtgcgtttaggcaggtctgccacactactgtaccatgggtaaatga

SEQ ID NO: 195062 - DNA, 75 bp, Artificial Sequence
  Synthetic
ggaggaaaagaattggattgcagtgccaacatggaggataccgggcaggctagagaaatggcacagcctagtcaa

SEQ ID NO: 195063 - DNA, 75 bp, Artificial Sequence
  Synthetic
ggatgtgcgtttaggcaggtctgccacactactgtaccatgggtaaatgactccttaacacctgactggaacaat

SEQ ID NO: 195064 - DNA, 75 bp, Artificial Sequence
  Synthetic
atatctgaaacatagaacaaaagaattggaacaggtcacttatgttcctcaccataaggtaggatgggcttggtg

SEQ ID NO: 195065 - DNA, 75 bp, Artificial Sequence
  Synthetic
gacctgcagtagagtaatattccccctaaaagaaggagcatatctagagatccaaggatattggaacctgacccc

SEQ ID NO: 195066 - DNA, 75 bp, Artificial Sequence
  Synthetic
ggaaaggggattcctgagtgcctatgctgtaagactaacatggtataagaaaagtttctatacagatgtgacacc

SEQ ID NO: 195067 - DNA, 75 bp, Artificial Sequence
  Synthetic
tgtctttggcaactggtttgatttgacctcctggatcaaatatattcaatatggagtttatatagtagtaggaat

SEQ ID NO: 195068 - DNA, 75 bp, Artificial Sequence
  Synthetic
aaagtttctatacagatgtgacacctgatgtagcagaccacctattgcatgggtcttatttcttttgctttacag

SEQ ID NO: 195069 - DNA, 75 bp, Artificial Sequence
  Synthetic
gaaagggctataggcctgttttctcctccccccccggttatctccaacagatccatatccacacggacaggggac

SEQ ID NO: 195070 - DNA, 75 bp, Artificial Sequence
  Synthetic
aactacccatcagcccatagaggacaggtaccaagtttacagtttctagccctaagggttgtgcaagaaggagga

SEQ ID NO: 195071 - DNA, 75 bp, Artificial Sequence
  Synthetic
agccagccaacgaagaaacagaagaagacgccggagacgacagtggtttcggcttgtggccttggccactaaact

SEQ ID NO: 195072 - DNA, 75 bp, Artificial Sequence
  Synthetic
aggtaccaagtttacagtttctagccctaagggttgtgcaagaaggaggaaatggaccccagggagagagtgccg

SEQ ID NO: 195073 - DNA, 75 bp, Artificial Sequence
  Synthetic
ggcttgtggccttggccactaaactacatacaattcctgatccacctactgactcgcctcttgaccgggctatac

SEQ ID NO: 195074 - DNA, 75 bp, Artificial Sequence
  Synthetic
ccaggaaacagcggcgaagaaacaataggagaagcattcgaatggctagaaagaacaataacagagctcaacaga

SEQ ID NO: 195075 - DNA, 75 bp, Artificial Sequence
  Synthetic
gtagctgtcaatcatctgcccagggaacttattttccaggtctggcagaggtcttgggcatattggcacgaggaa

SEQ ID NO: 195076 - DNA, 75 bp, Artificial Sequence
  Synthetic
ctcccagagtctaacagcaatcagggactggctgagacttaaggcggcctacctgcaatatgggtgcgagtggat

SEQ ID NO: 195077 - DNA, 75 bp, Artificial Sequence
  Synthetic
acctgcaatatgggtgcgagtggatccaagaagcgttccgagcattcgcaaggactgcgagagagactattgcgg

SEQ ID NO: 195078 - DNA, 75 bp, Artificial Sequence
  Synthetic
cagggcatgacaattagctacaccaagtatagatacttgtgtctgatgcagaaagcactgtatatgcaccttgca

SEQ ID NO: 195079 - DNA, 75 bp, Artificial Sequence
  Synthetic
gaaagcactgtatatgcaccttgcaaggggatgtgcatgcttgcgggagggtcatgggccagggggatggagacc

SEQ ID NO: 195080 - DNA, 75 bp, Artificial Sequence
  Synthetic
gcgcgtggagggggttatgtgaagcagcgcaacgcatcgggaggggaatcctcgcagtcccaagaaggatcaggc

SEQ ID NO: 195081 - DNA, 75 bp, Artificial Sequence
  Synthetic
ctcgcagtcccaagaaggatcaggcagggagcagaaatcgccctcctgtgagggacagcagtatcagcagggaga

SEQ ID NO: 195082 - DNA, 75 bp, Artificial Sequence
  Synthetic
gttcatgaacaccccatggagaaccccagcagcaatagggcagaaaaattcatataagcagcaaaatatggatga

SEQ ID NO: 195083 - DNA, 75 bp, Artificial Sequence
  Synthetic
tgtagattctgatgatgatgacctagtgggagttcctgttatgccaagagtaccgctgagagaaatgacctataa

SEQ ID NO: 195084 - DNA, 75 bp, Artificial Sequence
  Synthetic
ttggtaattttatctacggtaggcatggggataccattgcaggagcaggagaactcattagaattctccagcgag

SEQ ID NO: 195085 - DNA, 75 bp, Artificial Sequence
  Synthetic
caagagtaccgctgagagaaatgacctataaactggcaatagatatgtcacattttataaaagaaaaaggaggac

SEQ ID NO: 195086 - DNA, 75 bp, Artificial Sequence
  Synthetic
cagaaacaggaactgcagagaaaatgccaaatataagtagaccaacagcaccacctagtgggaaagggaggaaac

SEQ ID NO: 195087 - DNA, 75 bp, Artificial Sequence
  Synthetic
ttccccgtgcaacaggcaggcggcaactatatccatgtgccgctgagcccccgaactctaaatgcttgggtaaaa

SEQ ID NO: 195088 - DNA, 75 bp, Artificial Sequence
  Synthetic
ccagggggaggaaatcctctctcagttataccgccctcttgaagcatgcagaaataagtgctactgtaagaaatg

SEQ ID NO: 195089 - DNA, 75 bp, Artificial Sequence
  Synthetic
aaaaagggctaaggttactgcgcctactgcatcaaacgagtgagtatggcacatatcaataagtacctgtttgct

SEQ ID NO: 195090 - DNA, 75 bp, Artificial Sequence
  Synthetic
gcactcctgcttataagtatctatggctttatgggcgaggatttcgtcactgtcttctatggcataccagcatgg

SEQ ID NO: 195091 - DNA, 75 bp, Artificial Sequence
  Synthetic
aagaatgcaacagttcccctcttttgtgccaccaaaaatagagatatttggggaactgtgcaatgcctcccagac

SEQ ID NO: 195092 - DNA, 75 bp, Artificial Sequence
  Synthetic
aatcgttccagagctatgtagacagattctacaaaagcctaagggcagaacaaacagacccggctgtaaaaaatt

SEQ ID NO: 195093 - DNA, 75 bp, Artificial Sequence
  Synthetic
aatgatgactatgacgaaatcgcgctgaatataacagaggcttttgatgcatgggataacacagtgacagaacag

SEQ ID NO: 195094 - DNA, 75 bp, Artificial Sequence
  Synthetic
gcagtagcggatgtgtggaatctatttgagacttcaataaaaccatgtgttaaattaaccccactatgtgtaaca

SEQ ID NO: 195095 - DNA, 75 bp, Artificial Sequence
  Synthetic
atgaattgtagtaaccttaacaccacagccaacaccaccacagccaacaacatcacagcctctaagaacataagt

SEQ ID NO: 195096 - DNA, 75 bp, Artificial Sequence
  Synthetic
atgctcaatggaaatgactcatgtatccgagatgacaactgcacaggtatagaatttgagaacatggtaacatgt

SEQ ID NO: 195097 - DNA, 75 bp, Artificial Sequence
  Synthetic
ccctatcccatttgcagcagcccaacaaagaagggcaattaggtgttggaattgtggaaaggagggacactcggc

SEQ ID NO: 195098 - DNA, 75 bp, Artificial Sequence
  Synthetic
cgattcaatatgacaggattaaaagtagatgaaccgaaaacgtataatgacacctggtatgcagaagatgtacag

SEQ ID NO: 195099 - DNA, 75 bp, Artificial Sequence
  Synthetic
tgtaatgggagcagatgccatataaaaacctgtaacacatcaattatccaagagtcatgtgacaaacattattgg

SEQ ID NO: 195100 - DNA, 75 bp, Artificial Sequence
  Synthetic
gaccaattaagatttaggtattgtgcccccccaggctttgcttttatgagatgcaatgattctaactattcaggc

SEQ ID NO: 195101 - DNA, 75 bp, Artificial Sequence
  Synthetic
atgcaatgattctaactattcaggctttatgcccaactgtagcaaggtagtagtatcctcctgtacaagaatgat

SEQ ID NO: 195102 - DNA, 75 bp, Artificial Sequence
  Synthetic
ggaaacacagacctctacgtggtttggcttcaatggtacaagggcagaaaataggacatatatatactggcatgg

SEQ ID NO: 195103 - DNA, 75 bp, Artificial Sequence
  Synthetic
taaaagcaataggaccgtcataagcttaaataaaaaatataatctgacaatacactgtagaaggccaggaaacaa

SEQ ID NO: 195104 - DNA, 75 bp, Artificial Sequence
  Synthetic
aacagtcgtgccagtaacaattatgtcaggtctaatcttccattcacagcctattaatcaaagacccaggcaagc

SEQ ID NO: 195105 - DNA, 75 bp, Artificial Sequence
  Synthetic
ctggtgctggtttggaggaaactggacacaggctataaaggaggtgaaggagaccattgcaaagcatcccagata

SEQ ID NO: 195106 - DNA, 75 bp, Artificial Sequence
  Synthetic
tacaggaacaaacgataccgcaaaaataaagttagcagagcactcgcaaggctcagatccagaagtaagatatat

SEQ ID NO: 195107 - DNA, 75 bp, Artificial Sequence
  Synthetic
gtggactaactgtagaggagagtttttgtactgtaatatgacttggttcctaaactgggtagaaaataggacagg

SEQ ID NO: 195108 - DNA, 75 bp, Artificial Sequence
  Synthetic
aataaaagtaacattgaagccagggaaagatggaccaaggctgaaacaatggcccctaacaaaagaaaaaataga

SEQ ID NO: 195109 - DNA, 75 bp, Artificial Sequence
  Synthetic
aattaagaaaaattatgtgccgtgccacatcagacaggtaatcaacacgtggcataaggttggaaaaaatgtata

SEQ ID NO: 195110 - DNA, 75 bp, Artificial Sequence
  Synthetic
tttgcctccaagagaaggtcaccttacctgtaattccactgttaccagtatcatagccaatattgattggacaaa

SEQ ID NO: 195111 - DNA, 75 bp, Artificial Sequence
  Synthetic
acctgtaattccactgttaccagtatcatagccaatattgattggacaaataataataggactaatattaccatg

SEQ ID NO: 195112 - DNA, 75 bp, Artificial Sequence
  Synthetic
agtgcagaagtgtcagaactgtatagattggaactgggggactacaaactagtagaaataacaccaattggcttt

SEQ ID NO: 195113 - DNA, 75 bp, Artificial Sequence
  Synthetic
gcacctacaagtgtaaaaaggtattcctcagcgacaccgaggaataagagaggtgtaccggtgctagggtttttg

SEQ ID NO: 195114 - DNA, 75 bp, Artificial Sequence
  Synthetic
aggtgtaccggtgctagggtttttgggatttcttgcaacggcaggttctgcaatgggcgcggcgtccttgacgtt

SEQ ID NO: 195115 - DNA, 75 bp, Artificial Sequence
  Synthetic
gtcggcccagtcccggactttattggctgggatagtgcagcagcagcaacagctgctggacgtggtcaaaagaca

SEQ ID NO: 195116 - DNA, 75 bp, Artificial Sequence
  Synthetic
acaggaactgttgcggctgaccgtctgggggacgaaaaacctccaggcaagagtcactgccatcgagaaatacct

SEQ ID NO: 195117 - DNA, 75 bp, Artificial Sequence
  Synthetic
gagtcactgccatcgagaaatacctaaaagaccaggcactactaaattcgtggggatgcgctttcagacaggtct

SEQ ID NO: 195118 - DNA, 75 bp, Artificial Sequence
  Synthetic
gtcacacgactgtaccatggccaaacaaaaatttcactccaaactgggacaacatgacatggcagcagtgggaga

SEQ ID NO: 195119 - DNA, 75 bp, Artificial Sequence
  Synthetic
accaggtccgcttcttggatgaaaatataacaaaattattagaagtggcacagatacaacaagaagagaacatgt

SEQ ID NO: 195120 - DNA, 75 bp, Artificial Sequence
  Synthetic
acaagttacagaaactaaaccaatgggatgtttttagtaattggtttgacttcacctcctggatagcgtatatcc

SEQ ID NO: 195121 - DNA, 75 bp, Artificial Sequence
  Synthetic
ttcacctcctggatagcgtatatccaaataggattatatgtaatagtagggttagtagtactaagaatagtaata

SEQ ID NO: 195122 - DNA, 75 bp, Artificial Sequence
  Synthetic
ttagaaagggctataggccagtattctcctcccctccctcttatgttcaacagatccctatccacaagggccagg

SEQ ID NO: 195123 - DNA, 75 bp, Artificial Sequence
  Synthetic
gacggccagccagcgaagaaacagaagaaggaggtggagacgacgaggactacagatcctggccttggcagatca

SEQ ID NO: 195124 - DNA, 75 bp, Artificial Sequence
  Synthetic
gatacatccacttcctgattcgccaactgaggaacctcttaatttggctatacaacagctgcagaagcttactgt

SEQ ID NO: 195125 - DNA, 75 bp, Artificial Sequence
  Synthetic
tgaagatcttccaacccctccaactagtattccaacagctcagacttccacttgcatacctccaatatgggatcg

SEQ ID NO: 195126 - DNA, 75 bp, Artificial Sequence
  Synthetic
gctggttccaagaagcaatccaagcagcgacgagggctgcgggagagactcttacaaacacaggaagggccctat

SEQ ID NO: 195127 - DNA, 75 bp, Artificial Sequence
  Synthetic
gggaggctctcagaagaacagcgagggcaatcgtcgcgatccccaggaggatcagacaaggactcgaactcgccc

SEQ ID NO: 195128 - DNA, 75 bp, Artificial Sequence
  Synthetic
tcttgtgagggacgcagtgctccaggagcacaagggggagggcaacagggtatagaagatagtgatgaagataat

SEQ ID NO: 195129 - DNA, 75 bp, Artificial Sequence
  Synthetic
gaagtgggagtctatgtaagacccaataggccactaagaccaatgacatataaattggcaatagacatgtctcat

SEQ ID NO: 195130 - DNA, 75 bp, Artificial Sequence
  Synthetic
ccaataggccactaagaccaatgacatataaattggcaatagacatgtctcattggataaaagaaaaggggggac

SEQ ID NO: 195131 - DNA, 75 bp, Artificial Sequence
  Synthetic
gattggcgcccgaacagggacctgaggaagagtgagagtcttcgggacacggctgagtgaaggcagtaagggcgg

SEQ ID NO: 195132 - DNA, 75 bp, Artificial Sequence
  Synthetic
tgcatgggtcccagcccataaaggcataggaggaaaccaggaagtagaccatttagtaagtcagggcatcagaca

SEQ ID NO: 195133 - DNA, 75 bp, Artificial Sequence
  Synthetic
gaggctccgggagtaaaaggtaagtactccaaatttgcaattcgtctactctaggacagggtacggaataagtgg

SEQ ID NO: 195134 - DNA, 75 bp, Artificial Sequence
  Synthetic
atcatagcaatataaaagaactaacccataaatttggaataccccaactagtggcaagacagatagtaaacacat

SEQ ID NO: 195135 - DNA, 75 bp, Artificial Sequence
  Synthetic
ggaaagaaaagatacatgctaaaacatatagtatgggcagtgaatgaattagagagatttggattggcagagagc

SEQ ID NO: 195136 - DNA, 75 bp, Artificial Sequence
  Synthetic
cggttgggatcaaaagaaggatgccggaaaattcggaaagtcttaggaccattagtaccaacaggttcagaaaat

SEQ ID NO: 195137 - DNA, 75 bp, Artificial Sequence
  Synthetic
attagtaccaacaggttcagaaaatttaaaaagtctttataataccgtctgcgtcatcttttgcctgcacgcaga

SEQ ID NO: 195138 - DNA, 75 bp, Artificial Sequence
  Synthetic
cagacaatggccccaacttcacttcacaggaagtgaagatggtggcatggtggataggtatagagcaatcctttg

SEQ ID NO: 195139 - DNA, 75 bp, Artificial Sequence
  Synthetic
tggataggtatagagcaatcctttggagtaccttacaatccacaaagccagggagtagtagaagcaatgaatcac

SEQ ID NO: 195140 - DNA, 75 bp, Artificial Sequence
  Synthetic
gagtaccttacaatccacaaagccagggagtagtagaagcaatgaatcaccacctaaaaaatcagataagtagaa

SEQ ID NO: 195141 - DNA, 75 bp, Artificial Sequence
  Synthetic
agctatgagtaaaccaagtaaaccaactagccgcctagcttatccagtgcagcaaatagctggcaattattccca

SEQ ID NO: 195142 - DNA, 75 bp, Artificial Sequence
  Synthetic
ttagagaacaggcaaatacaatagaaacaatagtactaatggcagttcattgcatgaattttaaaagaaggggag

SEQ ID NO: 195143 - DNA, 75 bp, Artificial Sequence
  Synthetic
aacaatagtactaatggcagttcattgcatgaattttaaaagaaggggaggaataggggatatgaccccagcaga

SEQ ID NO: 195144 - DNA, 75 bp, Artificial Sequence
  Synthetic
cctgccgctaagcccccgaaccttaaatgcctgggtaaaattagtagaagagaagaagttcggggcagaagtagt

SEQ ID NO: 195145 - DNA, 75 bp, Artificial Sequence
  Synthetic
gggtgcaccccttatgatattaatcagatgttaaattgtgtaggagaacatcaggcagccatgcaaattattagg

SEQ ID NO: 195146 - DNA, 75 bp, Artificial Sequence
  Synthetic
gagataattaatgaggaagcagcagactgggaccaacagcatccatcgccaggcccaatgccagcagggcaactc

SEQ ID NO: 195147 - DNA, 75 bp, Artificial Sequence
  Synthetic
agggaaccaagagggtcagacatagcgggaaccaccagcacagtagaagaacagatacagtggatgtacagaccc

SEQ ID NO: 195148 - DNA, 75 bp, Artificial Sequence
  Synthetic
caaaatcctgtcccagtgggaaacatctatagaaggtggattcagttagggctacagaaatgtgtccggatgtac

SEQ ID NO: 195149 - DNA, 75 bp, Artificial Sequence
  Synthetic
aatcctactaatatactggacataaagcaagggccaaaagaacccttccaaagctatgtagatagattctacaaa

SEQ ID NO: 195150 - DNA, 75 bp, Artificial Sequence
  Synthetic
aacactgctgattcagaatgctaacccagattgcaaattagtgcttaagggcttgggaatgaaccccacattaga

SEQ ID NO: 195151 - DNA, 75 bp, Artificial Sequence
  Synthetic
agaaatgctaacagcctgccaggggataggaggcccagggcagaaggcaaggctaatggctgaggctttaaaaga

SEQ ID NO: 195152 - DNA, 75 bp, Artificial Sequence
  Synthetic
agccttgacaccttccaccaatccgtttgccgccgctcaaccaagagcagggaagaggacagtgacatgctggaa

SEQ ID NO: 195153 - DNA, 75 bp, Artificial Sequence
  Synthetic
ctgcggcaaggcgggacatacagccaggcagtgcaaggcccctagaaggcagggatgctggaaatgtggacagca

SEQ ID NO: 195154 - DNA, 75 bp, Artificial Sequence
  Synthetic
caatttccccgtccaggcaccccaggggatagtgccatctgcgcccccgatgaacccagcattcggcatgacacc

SEQ ID NO: 195155 - DNA, 75 bp, Artificial Sequence
  Synthetic
tcagggtgcgattccatctgcaccccctgcagatccagcagaggagatgctaaagaactacatgcaactagggaa

SEQ ID NO: 195156 - DNA, 75 bp, Artificial Sequence
  Synthetic
cctgcagatccagcagaggagatgctaaagaactacatgcaactagggaagaagcagaaggagaacagagagaga

SEQ ID NO: 195157 - DNA, 75 bp, Artificial Sequence
  Synthetic
ttgagggtcaatcagtagaagtattactagacacaggagctgatgactcaatagtagcagggatagaattaggca

SEQ ID NO: 195158 - DNA, 75 bp, Artificial Sequence
  Synthetic
gcaattacaccccaaaaatagtaggtgggataggaggatttataaataccaatgaatacaaaaatgtagaaatag

SEQ ID NO: 195159 - DNA, 75 bp, Artificial Sequence
  Synthetic
aatgaatacaaaaatgtagaaatagaagtagtaggaaaaagagtaagagcaacagtaatgacaggggacacccca

SEQ ID NO: 195160 - DNA, 75 bp, Artificial Sequence
  Synthetic
ataaacatttttggcagaaatattttaaatagcttaggcatgactctaaatttcccagtagcaaggatagaacca

SEQ ID NO: 195161 - DNA, 75 bp, Artificial Sequence
  Synthetic
gtaaaagtccagttaaagcctgaaaaagatgggccaaaaatcagacaatggcccctatccaaagagaaaatacta

SEQ ID NO: 195162 - DNA, 75 bp, Artificial Sequence
  Synthetic
gccctcaaagaaatctgtgaaaaaatggaaaaagagggacagttagaagaggcgcctcctactaatccatacaat

SEQ ID NO: 195163 - DNA, 75 bp, Artificial Sequence
  Synthetic
tcgcccaccttcgccataaaaaagaaagacaaaaacaaatggaggatgctaatagatttcagagaactaaacaag

SEQ ID NO: 195164 - DNA, 75 bp, Artificial Sequence
  Synthetic
ttaaatgtgacagaagcttttgatgcatgggataatacagtaacagaacaagcaatagaagatgtctggagactg

SEQ ID NO: 195165 - DNA, 75 bp, Artificial Sequence
  Synthetic
gtaacccaagaatttacagaggtccagctgggtattcctcacccagcaggactggcatcaaagaaaagaataaca

SEQ ID NO: 195166 - DNA, 75 bp, Artificial Sequence
  Synthetic
gtactagatgtaggagatgcctacttcagtgtcccactagatccagacttcagacaatatacagcatttactttg

SEQ ID NO: 195167 - DNA, 75 bp, Artificial Sequence
  Synthetic
ccagcagtaaataatgcagaaccaggaaagagatatctttacaaagtcctaccacagggatggaagggatcccca

SEQ ID NO: 195168 - DNA, 75 bp, Artificial Sequence
  Synthetic
gcaattttccagtacaccatggcaaaggtactagaccctttcagaaaagccaacaatgatgtcactataatccag

SEQ ID NO: 195169 - DNA, 75 bp, Artificial Sequence
  Synthetic
caacaatgatgtcactataatccagtacatggatgacattctcgtggcaagtgacaggagcgatctggagcatga

SEQ ID NO: 195170 - DNA, 75 bp, Artificial Sequence
  Synthetic
cagggtagtgtctcaactaaaagagctattaaataacatgggattctctactccagaagaaaagttccaaaaaga

SEQ ID NO: 195171 - DNA, 75 bp, Artificial Sequence
  Synthetic
ccctccattcaaatggatggggtatgagctctggccaaagaaatggaaactgcaaaaaatacagctaccagaaaa

SEQ ID NO: 195172 - DNA, 75 bp, Artificial Sequence
  Synthetic
atgataccaactattcaggctttgaacctaagtgctctaaagtagtagctgcttcatgcacaaggatgatggaaa

SEQ ID NO: 195173 - DNA, 75 bp, Artificial Sequence
  Synthetic
agaggtttggacagtaaatgacattcagaagttagtgggagtattaaattgggcagctcaacttttcccggggat

SEQ ID NO: 195174 - DNA, 75 bp, Artificial Sequence
  Synthetic
taagaccaggcatatatgtaaactaataaggggaaagatgaccctaacagaagaggtacaatggactgaattggc

SEQ ID NO: 195175 - DNA, 75 bp, Artificial Sequence
  Synthetic
agaggcagaattccaggaaaacaaaatcatcctagaacaagagcaggaaggatcctattacaaagaaggggtacc

SEQ ID NO: 195176 - DNA, 75 bp, Artificial Sequence
  Synthetic
gatcctattacaaagaaggggtacctttagaagcaacagtgcagaaaaatctagcaaatcagtggacatacaaga

SEQ ID NO: 195177 - DNA, 75 bp, Artificial Sequence
  Synthetic
ttcatcagggagataaaatcctaaaagtaggaaaatatgcaaaggttaaaaacactcacaccaatggagtaagac

SEQ ID NO: 195178 - DNA, 75 bp, Artificial Sequence
  Synthetic
tattggctcatgtagtccaaaaaataggaaaggaagcattggtcatctggggagagataccaatgttccatctac

SEQ ID NO: 195179 - DNA, 75 bp, Artificial Sequence
  Synthetic
cagtagaaagagagacatgggatcagtggtggacagattactggcaagtaacctggatcccagaatgggattttg

SEQ ID NO: 195180 - DNA, 75 bp, Artificial Sequence
  Synthetic
tctcaaccccaccattaataaggttagcctataacctggtcaaagaccccctagaaggagtagaaacttactaca

SEQ ID NO: 195181 - DNA, 75 bp, Artificial Sequence
  Synthetic
ctagaaggagtagaaacttactacacagatggatcctgtaacaaagcctcaaaagaagggaaagcaggatatgtc

SEQ ID NO: 195182 - DNA, 75 bp, Artificial Sequence
  Synthetic
acagacaggggaaaggataaagttaaaccattagaacaaacaacaaatcagcaagcagagcttgaagcatttgca

SEQ ID NO: 195183 - DNA, 75 bp, Artificial Sequence
  Synthetic
ctagcactacaggactcaggaccacaggtcaatatcatagtagattcacaatatgtcatgggaatagtagctgca

SEQ ID NO: 195184 - DNA, 75 bp, Artificial Sequence
  Synthetic
caaccaacagaaacagaatcaccgatagtaagagaaataattgaagaaatgatcaaaaaggaaaaaatatatgta

SEQ ID NO: 195185 - DNA, 75 bp, Artificial Sequence
  Synthetic
ggatgggtaccagctcacaagggactgggtggtaatcaggaagtagaccacctagtgagccaaggaattagacaa

SEQ ID NO: 195186 - DNA, 75 bp, Artificial Sequence
  Synthetic
atcctatttctagaaaaaatagaaccagctcaagaagaacatgaaaaatatcataataatgtaaaagaactagtc

SEQ ID NO: 195187 - DNA, 75 bp, Artificial Sequence
  Synthetic
cagctcaagaagaacatgaaaaatatcataataatgtaaaagaactagtccataaatttgggattccacaattag

SEQ ID NO: 195188 - DNA, 75 bp, Artificial Sequence
  Synthetic
gctattcatggacaggtaaattcagaactagggacatggcaaatggactgtacacatttagagggaaaggttata

SEQ ID NO: 195189 - DNA, 75 bp, Artificial Sequence
  Synthetic
ccaagaaacaggaagacagacagctctcttcctgttaaagctggccagcagatggcctatcacacacctgcacac

SEQ ID NO: 195190 - DNA, 75 bp, Artificial Sequence
  Synthetic
taataggtttaagaatagccatatatatagtgcaattgttaagtagacttagaaagggctataggcctgttttct

SEQ ID NO: 195191 - DNA, 75 bp, Artificial Sequence
  Synthetic
caagatgtgaaaatggcagcctggtggatagggatagaacaaacattcggagtgccctataatccagaaagtcag

SEQ ID NO: 195192 - DNA, 75 bp, Artificial Sequence
  Synthetic
ggagtagtagaagcaatgaaccatcatctgaaaaatcagatagacagaattagagatcaggcagtatcaatagag

SEQ ID NO: 195193 - DNA, 75 bp, Artificial Sequence
  Synthetic
aataggggatatgacccctgcagaaagaatagtcaacatgataactacagaacaagaaatacaattcctccaaac

SEQ ID NO: 195194 - DNA, 75 bp, Artificial Sequence
  Synthetic
tctattgtggaaaggggaaggagcagtcatcataaaggtagggacagaaatcaaagtaatacccagaagaaaagc

SEQ ID NO: 195195 - DNA, 75 bp, Artificial Sequence
  Synthetic
aaagatcataaggaactatggaggaggaaaagaattggattgcagtgccgacgtggaggataccatgcaggctag

SEQ ID NO: 195196 - DNA, 75 bp, Artificial Sequence
  Synthetic
acgtggaggataccatgcaggctagagaggtggcacagtctaattaaatacctgaaatataggacaaaagacttg

SEQ ID NO: 195197 - DNA, 75 bp, Artificial Sequence
  Synthetic
cagggaccacaaatccccctcctctcagggacagcagtatcagcagggagagttcatgaacaccccatggagaac

SEQ ID NO: 195198 - DNA, 75 bp, Artificial Sequence
  Synthetic
ataaggtaggatgggcttggtggacttgcagtagagtaatatttcccctgaaagaaggagcacatctagaagtcc

SEQ ID NO: 195199 - DNA, 75 bp, Artificial Sequence
  Synthetic
gcttttatacagatgtaactcctgatgtagcagaccgattactgcatgggtcttatttctcttcgtttacagcta

SEQ ID NO: 195200 - DNA, 75 bp, Artificial Sequence
  Synthetic
gattggcgcccgaacaggacttgaaggagactggaacacggctgagtgaaggcagtaagggcggcaggaacaaac

SEQ ID NO: 195201 - DNA, 75 bp, Artificial Sequence
  Synthetic
atgaagtaaggagagccatcaggggagaaaagatattgtcccactgcaactacccatcagctcatacaggccagg

SEQ ID NO: 195202 - DNA, 75 bp, Artificial Sequence
  Synthetic
gcgggccgaggtaccaaaggcggcgtgtggagcgggagtaaagaggcctccgggtgaaggtaagtacctacacca

SEQ ID NO: 195203 - DNA, 75 bp, Artificial Sequence
  Synthetic
taccaagtttacagtttctagccctaagagttgtacaagaaggaaaagatggatcccagggagagagtaccacca

SEQ ID NO: 195204 - DNA, 75 bp, Artificial Sequence
  Synthetic
ggaaacagcggcgaagaaacagtaggagaggcattcgaatggctagagacaacattagaacatctcaacagagta

SEQ ID NO: 195205 - DNA, 75 bp, Artificial Sequence
  Synthetic
gattgtgggagatgggcgcgagaagctccgtcttgagagggaaaaaagtagatgaattagaaaaaattaggttac

SEQ ID NO: 195206 - DNA, 75 bp, Artificial Sequence
  Synthetic
ggcccggcgggaagaaaaaatatagactaaagcatattgtgtgggcagcgaatgaattgggcaaattcggattgg

SEQ ID NO: 195207 - DNA, 75 bp, Artificial Sequence
  Synthetic
gcagtcaatcacttgcccagggaacttattttccaggtctggcagaagtcttgggcatattggcgtgaggaacag

SEQ ID NO: 195208 - DNA, 75 bp, Artificial Sequence
  Synthetic
aatgaattgggcaaattcggattggcagaaagcctgttggagtcaaaagaaggttgccaaaaaattattacagtt

SEQ ID NO: 195209 - DNA, 75 bp, Artificial Sequence
  Synthetic
ggcatgtcaattagttataccaaatataggtatttgtgtctaatgcaaaaagcaatgtttatacactttgcaaag

SEQ ID NO: 195210 - DNA, 75 bp, Artificial Sequence
  Synthetic
ataggtatttgtgtctaatgcaaaaagcaatgtttatacactttgcaaagggttgtggatgtctgcgggaaggcc

SEQ ID NO: 195211 - DNA, 75 bp, Artificial Sequence
  Synthetic
cagaaaatttaaaaagcctttttaatactgtctgcgtcatttggtgcttgcacgcagaagagaaagtgaaagata

SEQ ID NO: 195212 - DNA, 75 bp, Artificial Sequence
  Synthetic
atgggccagggggatggagatcaggacctcctcctcctcctcccccaggtctagcctaatggcagaagcagtccc

SEQ ID NO: 195213 - DNA, 75 bp, Artificial Sequence
  Synthetic
ctgaaggagcaaaacaaatagtacagagacatctagtggcagaaacaggaactgcagacaaaatgccaagcacaa

SEQ ID NO: 195214 - DNA, 75 bp, Artificial Sequence
  Synthetic
agagattcctccagaggataaaaacccacaaagagaaccgtgggaacagtgggtagtggacgtcctggaggaaat

SEQ ID NO: 195215 - DNA, 75 bp, Artificial Sequence
  Synthetic
gtagaccagcagcaccacctagcgggagagggggaaattaccccgtgcaacaaatagctggcaactattcccatg

SEQ ID NO: 195216 - DNA, 75 bp, Artificial Sequence
  Synthetic
aaaacaagaagccttaaagcattttgacccccgcttattaactgcacttggcaattttatctacaataggcatgg

SEQ ID NO: 195217 - DNA, 75 bp, Artificial Sequence
  Synthetic
gagagggggaaattaccccgtgcaacaaatagctggcaactattcccatgtgccgttgagcccccgaaccctaaa

SEQ ID NO: 195218 - DNA, 75 bp, Artificial Sequence
  Synthetic
aaatacccttgaaggagcaggagagctcattaaactcctccagcgggcactcttcctccacttcagagggggttg

SEQ ID NO: 195219 - DNA, 75 bp, Artificial Sequence
  Synthetic
ccaacactcaaggattggacaaccggggggaggaaatcctctctcagctataccgccctcttaaggcatgcagta

SEQ ID NO: 195220 - DNA, 75 bp, Artificial Sequence
  Synthetic
atgcttaattgtgtgggcgaccatcaagcagctatgcaaataatcagagagattattaatgaagaagcagcagat

SEQ ID NO: 195221 - DNA, 75 bp, Artificial Sequence
  Synthetic
atacatgctactgtaaaaaatgttcctaccattgccagctttgctttcttaaaaagggcctggggatatgttatg

SEQ ID NO: 195222 - DNA, 75 bp, Artificial Sequence
  Synthetic
aacgctcgagaaagagatcttcaaaaagggctaagactactacatcttctgcaccaaacgagtgagtatggcaca

SEQ ID NO: 195223 - DNA, 75 bp, Artificial Sequence
  Synthetic
gggacaacaagcacagtagaagaacagatccagtggatgtttagagcacaaaatcctataccagtagggaacatc

SEQ ID NO: 195224 - DNA, 75 bp, Artificial Sequence
  Synthetic
tgttaataattacctacttgttacactcctgcttataagtatctatgggtatatgggcaagaactttgtcactgt

SEQ ID NO: 195225 - DNA, 75 bp, Artificial Sequence
  Synthetic
cttctatggtatacccgcatggaaaaatgcatcaattcccctcttttgtgctaccagaaacagagatacctgggg

SEQ ID NO: 195226 - DNA, 75 bp, Artificial Sequence
  Synthetic
cagggaccaaaggagccgttccaaagctatgtagatagattctacaaaagcctaagggcagaacaaacagaccca

SEQ ID NO: 195227 - DNA, 75 bp, Artificial Sequence
  Synthetic
aactgtacaatgcctcccagataatgatgactataccgaaatccaattaaatataacagaggcttttgatgcatg

SEQ ID NO: 195228 - DNA, 75 bp, Artificial Sequence
  Synthetic
gcagtaaaaaattggatgacccaaacactgctggtacagaatgccaacccagactgtaaattagtactaaaagga

SEQ ID NO: 195229 - DNA, 75 bp, Artificial Sequence
  Synthetic
ggataatacagtgacagatcaggcaacaaaggatgtgtggagtctctttgagacctcaataaaaccatgtgttaa

SEQ ID NO: 195230 - DNA, 75 bp, Artificial Sequence
  Synthetic
agatgctgaccgcctgtcagggaataggaggaccaggccagaaagccagattaatggcagaagccttaaaggagg

SEQ ID NO: 195231 - DNA, 75 bp, Artificial Sequence
  Synthetic
attaaccccactgtgtgtgacaatgaagtgtaataagacgtggagctcagctagcaaagagaccactacgtcctc

SEQ ID NO: 195232 - DNA, 75 bp, Artificial Sequence
  Synthetic
ttaatggcagaagccttaaaggaggccctagcaccagcccctatcccatttgcagcagcccaacagagaaggaca

SEQ ID NO: 195233 - DNA, 75 bp, Artificial Sequence
  Synthetic
tgcagcagcccaacagagaaggacaattaagtgctggaattgtggaaaggatgggcactcggcaagacaatgccg

SEQ ID NO: 195234 - DNA, 75 bp, Artificial Sequence
  Synthetic
attaagtgctggaattgtggaaaggatgggcactcggcaagacaatgccgagcacctagaagacagggctgctgg

SEQ ID NO: 195235 - DNA, 75 bp, Artificial Sequence
  Synthetic
cgcgtccctcagatcttctactcagaccctactcaacgaagatagcaaatgtattcaaaatgacagctgtgcagg

SEQ ID NO: 195236 - DNA, 75 bp, Artificial Sequence
  Synthetic
gataggactagaagaaatgatagactgtcaattcaaaatgacaggattaaaaagagatgagtcaaaacaatataa

SEQ ID NO: 195237 - DNA, 75 bp, Artificial Sequence
  Synthetic
atgggcactcggcaagacaatgccgagcacctagaagacagggctgctggaaatgtggcaaatcaggacatgtca

SEQ ID NO: 195238 - DNA, 75 bp, Artificial Sequence
  Synthetic
tggcaaactgcccagaaagacaggctggttttttagggattggcccatggggaaagaagcctcgcaacttccccg

SEQ ID NO: 195239 - DNA, 75 bp, Artificial Sequence
  Synthetic
ggacacctggtataaacaagatttagtgtgtgaaaaggggacaaggagtaatgaaagcaaatgttatataaaaac

SEQ ID NO: 195240 - DNA, 75 bp, Artificial Sequence
  Synthetic
tgacccgagtcccgcaggggctgacaccaacagcacccccagcagacccagcagcagacctgctagagaagtact

SEQ ID NO: 195241 - DNA, 75 bp, Artificial Sequence
  Synthetic
ctgtaatacatcaattatccaagaatcatgtgacaaacattattgggatagtttaagatttaggtattgtgctcc

SEQ ID NO: 195242 - DNA, 75 bp, Artificial Sequence
  Synthetic
tgcagcaagggaggaagcagaaagagcagaaaatgagaccatacaaggaggtgacagaggacttactgcacctcg

SEQ ID NO: 195243 - DNA, 75 bp, Artificial Sequence
  Synthetic
cccaggatttgctttgctaagatgcaatgatactaaatattcaggcttcatgcccaactgtagtaaggtagtagt

SEQ ID NO: 195244 - DNA, 75 bp, Artificial Sequence
  Synthetic
gtgacagaggacttactgcacctcgaacaaggagagacaccacacaaagaggcgacagaggatttgctgcacctc

SEQ ID NO: 195245 - DNA, 75 bp, Artificial Sequence
  Synthetic
aatgatactaaatattcaggcttcatgcccaactgtagtaaggtagtagtatctctgtacagaatgatggaaaca

SEQ ID NO: 195246 - DNA, 75 bp, Artificial Sequence
  Synthetic
aattctctctttggaaaagaccagtagtcacagcatatgttgagggtcagccagtagaagtcttactagacacag

SEQ ID NO: 195247 - DNA, 75 bp, Artificial Sequence
  Synthetic
atggtacaagggcagaaaacaggacatatatctattggcatggtaaagacaataggactatcataagcttaaatt

SEQ ID NO: 195248 - DNA, 75 bp, Artificial Sequence
  Synthetic
catattataatctgacaatgcactgtaaaaggccaggaaacaaaatggttgtgccaataagaaccgtgtcaggta

SEQ ID NO: 195249 - DNA, 75 bp, Artificial Sequence
  Synthetic
ccaaaaatagtagggggaatagggggattcataaacaccaaggaatataaaaatgtagaaataaaagtactaaat

SEQ ID NO: 195250 - DNA, 75 bp, Artificial Sequence
  Synthetic
ttctcttccattcacagcctatcaataaaagacctaaacaagcttggtgctggtttaaaggaaactggacagaag

SEQ ID NO: 195251 - DNA, 75 bp, Artificial Sequence
  Synthetic
aaaaaggtaaaagccaccataatgacaggtgataccccaatcaacatttttggcagaaacattctgacagcctta

SEQ ID NO: 195252 - DNA, 75 bp, Artificial Sequence
  Synthetic
caggtgataccccaatcaacatttttggcagaaacattctgacagccttaggcatgtcattaaatctaccagtcg

SEQ ID NO: 195253 - DNA, 75 bp, Artificial Sequence
  Synthetic
ccatacaggaggtgaaagagaccattaaaaatcatcccagatattcaggaacaacaaatatctcacagataaggt

SEQ ID NO: 195254 - DNA, 75 bp, Artificial Sequence
  Synthetic
ccaaggtagacccgataaaagtaatactgaaaccaggaaaagatggaccaaaagtaagacaatggcctctaacaa

SEQ ID NO: 195255 - DNA, 75 bp, Artificial Sequence
  Synthetic
tagcagagcacgcgagaagctcagatccagaagtaagatatatgtggactaactgtaggggagagtttctctact

SEQ ID NO: 195256 - DNA, 75 bp, Artificial Sequence
  Synthetic
gtaatatgacttttttcttaaactgggtagaaaatagaactgggctcaagagaaattatgcgtcatgccacatca

SEQ ID NO: 195257 - DNA, 75 bp, Artificial Sequence
  Synthetic
ctaatccttataatacccccacatttgcaattaagaaaaaggacaaaaacaaatggagaatgctaatagatttta

SEQ ID NO: 195258 - DNA, 75 bp, Artificial Sequence
  Synthetic
gacagatagtcaacacgtggcacaagattggaagaaatgtgtatttgcctccaagagagggtgaactctcctgta

SEQ ID NO: 195259 - DNA, 75 bp, Artificial Sequence
  Synthetic
attccactgttaccagcctcatagccaacattgactggatagataagaaccttactaatattactgtgagtgcag

SEQ ID NO: 195260 - DNA, 75 bp, Artificial Sequence
  Synthetic
ccacacccagcaggattagccaagaaaagaagaattactgtactagatataggggatgcctacttttccatacca

SEQ ID NO: 195261 - DNA, 75 bp, Artificial Sequence
  Synthetic
aagtgtcagaactgtataaattggaactgggggactacaaattagtagagataacaccaattggctttgcaccta

SEQ ID NO: 195262 - DNA, 75 bp, Artificial Sequence
  Synthetic
ctacatgaggactttagacaatatactgcatttactctaccaacagtgaacaatgcagaaccaggaaagagatat

SEQ ID NO: 195263 - DNA, 75 bp, Artificial Sequence
  Synthetic
caagtataaaaagatattcctcagtgacaccgaggaataaaagaggtgtacttgtgctagggtttttgggattcc

SEQ ID NO: 195264 - DNA, 75 bp, Artificial Sequence
  Synthetic
atatataaagtcctaccacagggatggaaaggatcgccagcaatttttcaacacacaatgaggcaggtcttagag

SEQ ID NO: 195265 - DNA, 75 bp, Artificial Sequence
  Synthetic
gacaccgaggaataaaagaggtgtacttgtgctagggtttttgggattccttgcgacggcaggttctgcaatggg

SEQ ID NO: 195266 - DNA, 75 bp, Artificial Sequence
  Synthetic
ccattcagaaaagcaaacccagacgtcattctcgtccaatatatggatgatatcttaatagctagcgacaggaca

SEQ ID NO: 195267 - DNA, 75 bp, Artificial Sequence
  Synthetic
gacttagagcatgacagaacggtcctgcagttaaaagaacttttaaatggcctaggattctccaccccagatgag

SEQ ID NO: 195268 - DNA, 75 bp, Artificial Sequence
  Synthetic
ctgttgcggctgaccgtctgggggacgaaaaacctccaggcaagagtcactgccatcgagaaatatctcaaagac

SEQ ID NO: 195269 - DNA, 75 bp, Artificial Sequence
  Synthetic
cctaggattctccaccccagatgagaagttccaaaaagaccccccatacaaatggatgggctatgaactatggcc

SEQ ID NO: 195270 - DNA, 75 bp, Artificial Sequence
  Synthetic
caggcacaactaaattcatggggatgtgctttcagacaggtctgtcacacgactgtaccatgggtaaatgaatcc

SEQ ID NO: 195271 - DNA, 75 bp, Artificial Sequence
  Synthetic
cttaagccagactggaataacatgacatggcaacaatgggagaggcaagtccgcttcttggatgcaaatataaca

SEQ ID NO: 195272 - DNA, 75 bp, Artificial Sequence
  Synthetic
aggtgtcctaaattgggcagcacaaatctacccagggataaagaccaaacacttatgtaggctaattagaggaaa

SEQ ID NO: 195273 - DNA, 75 bp, Artificial Sequence
  Synthetic
aaattactagaagaggcacagatacaacaagaaaagaacatgtatgagttacagaaattaaatcaatgggatatt

SEQ ID NO: 195274 - DNA, 75 bp, Artificial Sequence
  Synthetic
aatgacactcacggaagaagtacagtggacagaactagcagaggcagaactagaagagaacaaaattatcttgag

SEQ ID NO: 195275 - DNA, 75 bp, Artificial Sequence
  Synthetic
ttcagtaattggtttgacttcacctcctggatggcatacatcaggttaggattatatatagtaataggaatagta

SEQ ID NO: 195276 - DNA, 75 bp, Artificial Sequence
  Synthetic
ccaggaacaggagggatgctattaccaagaagaaaaggaattagaagcaacagtccaaaaggatcaagacaatca

SEQ ID NO: 195277 - DNA, 75 bp, Artificial Sequence
  Synthetic
caagaagaaaaggaattagaagcaacagtccaaaaggatcaagacaatcagtggacatataaaatacaccaagga

SEQ ID NO: 195278 - DNA, 75 bp, Artificial Sequence
  Synthetic
cctggatggcatacatcaggttaggattatatatagtaataggaatagtagtattaagaatagcaatatacatta

SEQ ID NO: 195279 - DNA, 75 bp, Artificial Sequence
  Synthetic
gtagttcaaaaaataggaaaagaagcactagtcatttggggacgaataccaaaatttcacctaccagtagaaaga

SEQ ID NO: 195280 - DNA, 75 bp, Artificial Sequence
  Synthetic
ggtggaaacaacgagggctacagatcttggccctggcagatcgaatacatccacttcccgattcgccaactgagg

SEQ ID NO: 195281 - DNA, 75 bp, Artificial Sequence
  Synthetic
gacctcttgatttggctatacagcggctgcagaaccttattatcaaagaccttccaaaccctccaaccagtactc

SEQ ID NO: 195282 - DNA, 75 bp, Artificial Sequence
  Synthetic
agactgggacttcgtatctactccaccactggtcaggttagcatttaacctagtaaaagatcccataccaggtga

SEQ ID NO: 195283 - DNA, 75 bp, Artificial Sequence
  Synthetic
caaccgctcaggcttccacctgcatacctccgatatgggatcagctggttccaagaagcaatccaagcagcagcc

SEQ ID NO: 195284 - DNA, 75 bp, Artificial Sequence
  Synthetic
agagaccttctacacagatggatcctgtaataggcaatcaaaagagggaaaagcaggatatataacagatagagg

SEQ ID NO: 195285 - DNA, 75 bp, Artificial Sequence
  Synthetic
tgtaataggcaatcaaaagagggaaaagcaggatatataacagatagagggagagacaaggtaaggatattggag

SEQ ID NO: 195286 - DNA, 75 bp, Artificial Sequence
  Synthetic
agggctgcgggagagactcttgcgagcgcggcgaggacctcgtggggagtcctcaggagagcggcaggagagatc

SEQ ID NO: 195287 - DNA, 75 bp, Artificial Sequence
  Synthetic
caaactaccaatcagcaagcagaattagaagccttcgcaatggcattaacagactcaggtccaaaagccaatatt

SEQ ID NO: 195288 - DNA, 75 bp, Artificial Sequence
  Synthetic
attgcaatacccaggaggatcagacaaggggctgaactcgccctcttgtgatggacaaaagactttgggagcaga

SEQ ID NO: 195289 - DNA, 75 bp, Artificial Sequence
  Synthetic
agactcaggtccaaaagccaatattatagtagactcacagtatgtaatgggaatagtagcgggccagccaacaga

SEQ ID NO: 195290 - DNA, 75 bp, Artificial Sequence
  Synthetic
agggggaggaaaacaagattcagatgaggatgatgaggacaatgaagtaggggtccgtgtaagacccggggtccc

SEQ ID NO: 195291 - DNA, 75 bp, Artificial Sequence
  Synthetic
gaatagtagcgggccagccaacagaatcagagagtaaactagtaaaccaaatcatagaagaaatgataaaaaagg

SEQ ID NO: 195292 - DNA, 75 bp, Artificial Sequence
  Synthetic
ccggggtcccactgaggccaatgacattcaaactagcagtagacatgtctcattttttaaaagaaaagggggaac

SEQ ID NO: 195293 - DNA, 75 bp, Artificial Sequence
  Synthetic
gattggcgcccgaacagggacttgagaaggagtgagagtcctttgaacacggcagagtgaaggcagtaagggcgg

SEQ ID NO: 195294 - DNA, 75 bp, Artificial Sequence
  Synthetic
agcccacaaaggcataggaggaaatcaggaagtagatcatttagtaagtcagggcattagacaagtattattcct

SEQ ID NO: 195295 - DNA, 75 bp, Artificial Sequence
  Synthetic
agaaaaaatagagcccgctcaggaagaacatgagaaatatcatagcaatgtaaaagaattatcccataaatttgg

SEQ ID NO: 195296 - DNA, 75 bp, Artificial Sequence
  Synthetic
caggatccaaccacgacggagtgttcctagaaaggcgcgggtcggtaccagacagcgtgaggaacgggagtgaag

SEQ ID NO: 195297 - DNA, 75 bp, Artificial Sequence
  Synthetic
gaacatgagaaatatcatagcaatgtaaaagaattatcccataaatttggactgcccaaactagtggcaagacaa

SEQ ID NO: 195298 - DNA, 75 bp, Artificial Sequence
  Synthetic
aggcctccgggtgcgcaggtaagtgcaccaaaaatttgtagccaaaaagggctgtgaatcctaccttgaatagtc

SEQ ID NO: 195299 - DNA, 75 bp, Artificial Sequence
  Synthetic
aacagaaaggggaagctatacatgggcaagtagatgcagaactgggcacttggcaaatggactgcacacacttag

SEQ ID NO: 195300 - DNA, 75 bp, Artificial Sequence
  Synthetic
aggtagaagtgtgggagatgggcgcgagaagctccgtcctgtcagggaaaaaagctgatgaattagaaaaagtta

SEQ ID NO: 195301 - DNA, 75 bp, Artificial Sequence
  Synthetic
tggcaaatggactgcacacacttagagggaaaaatcattatagtagcagtacatgttgcaagcgggtttatagaa

SEQ ID NO: 195302 - DNA, 75 bp, Artificial Sequence
  Synthetic
gcagcgaacgaattggacagattcggattagcagagagcctgttggaatcaaaagaaggttgccaaaaaattctt

SEQ ID NO: 195303 - DNA, 75 bp, Artificial Sequence
  Synthetic
acacacctgcacacagataatggtgccaacttcacctcacaggaagtaaagatggtagcgtggtggacaggtata

SEQ ID NO: 195304 - DNA, 75 bp, Artificial Sequence
  Synthetic
tcagtattagctccattagtaccaacaggttcagaaaatttaaagagcctttataatactgtctgcgtcatttgg

SEQ ID NO: 195305 - DNA, 75 bp, Artificial Sequence
  Synthetic
caggttcagaaaatttaaagagcctttataatactgtctgcgtcatttggtgtttgcacgccgaacagaaagtaa

SEQ ID NO: 195306 - DNA, 75 bp, Artificial Sequence
  Synthetic
tgtttgcacgccgaacagaaagtaaaacatactgaagaagcaaaacaagtagtgcagagacatctagtggtagaa

SEQ ID NO: 195307 - DNA, 75 bp, Artificial Sequence
  Synthetic
actggaactacagaaaaagtgcctgccacaagcagaccaatagcaccacctagtggcagaggaggaaactaccca

SEQ ID NO: 195308 - DNA, 75 bp, Artificial Sequence
  Synthetic
aaaagaaggggaggaataggggatatgaccccagcagaaagactaatcaatatgatcaccacagaacaagaaata

SEQ ID NO: 195309 - DNA, 75 bp, Artificial Sequence
  Synthetic
gtgcagcaagtaggcggcaactatgttcatctgccattaagtcctcgaactttaaatgcatgggtaaaattggta

SEQ ID NO: 195310 - DNA, 75 bp, Artificial Sequence
  Synthetic
gaagaaaagaagttcggggcagaagtggtgccaggatttcaggcgctgtcagaaggctgcctaccatatgatatc

SEQ ID NO: 195311 - DNA, 75 bp, Artificial Sequence
  Synthetic
cagagaaggcagagatcagctgtggaaaggacctggggaactactgtggaagggagatggagcagtcatagtcaa

SEQ ID NO: 195312 - DNA, 75 bp, Artificial Sequence
  Synthetic
aatcaaatgctaaattgtgtaggagaacatcaagcagccatgcaaattattagagaaataattaatgaggaggca

SEQ ID NO: 195313 - DNA, 75 bp, Artificial Sequence
  Synthetic
ggtagggacagacataaaaatagtgccaagaaggaaagctaagatcatcagagactatggaggaaggcgagaggt

SEQ ID NO: 195314 - DNA, 75 bp, Artificial Sequence
  Synthetic
gcagaatgggatcttcaacatccacaacaagggccgccgccagcaggacaaatcagggaaccgacaggatcagat

SEQ ID NO: 195315 - DNA, 75 bp, Artificial Sequence
  Synthetic
gcagaatgggatcttcaacatccacaacaagggccgccgccagcaggacaattcagggaaccgacaggatcagat

SEQ ID NO: 195316 - DNA, 75 bp, Artificial Sequence
  Synthetic
gcagaatgggatcttcaacatccacaacaagggccgccgccagcaggacaactcagggaaccgacaggatcagat

SEQ ID NO: 195317 - DNA, 75 bp, Artificial Sequence
  Synthetic
gcagaatgggatcttcaacatccacaacaagggccgccgccagcaggacaagtcagggaaccgacaggatcagat

SEQ ID NO: 195318 - DNA, 75 bp, Artificial Sequence
  Synthetic
gcagattgggatcttcaacatccacaacaagggccgccgccagcaggacaaatcagggaaccgacaggatcagat

SEQ ID NO: 195319 - DNA, 75 bp, Artificial Sequence
  Synthetic
gcagattgggatcttcaacatccacaacaagggccgccgccagcaggacaattcagggaaccgacaggatcagat

SEQ ID NO: 195320 - DNA, 75 bp, Artificial Sequence
  Synthetic
gcagattgggatcttcaacatccacaacaagggccgccgccagcaggacaactcagggaaccgacaggatcagat

SEQ ID NO: 195321 - DNA, 75 bp, Artificial Sequence
  Synthetic
gcagattgggatcttcaacatccacaacaagggccgccgccagcaggacaagtcagggaaccgacaggatcagat

SEQ ID NO: 195322 - DNA, 75 bp, Artificial Sequence
  Synthetic
gcagactgggatcttcaacatccacaacaagggccgccgccagcaggacaaatcagggaaccgacaggatcagat

SEQ ID NO: 195323 - DNA, 75 bp, Artificial Sequence
  Synthetic
gcagactgggatcttcaacatccacaacaagggccgccgccagcaggacaattcagggaaccgacaggatcagat

SEQ ID NO: 195324 - DNA, 75 bp, Artificial Sequence
  Synthetic
gcagactgggatcttcaacatccacaacaagggccgccgccagcaggacaactcagggaaccgacaggatcagat

SEQ ID NO: 195325 - DNA, 75 bp, Artificial Sequence
  Synthetic
gcagactgggatcttcaacatccacaacaagggccgccgccagcaggacaagtcagggaaccgacaggatcagat

SEQ ID NO: 195326 - DNA, 75 bp, Artificial Sequence
  Synthetic
gcagagtgggatcttcaacatccacaacaagggccgccgccagcaggacaaatcagggaaccgacaggatcagat

SEQ ID NO: 195327 - DNA, 75 bp, Artificial Sequence
  Synthetic
gcagagtgggatcttcaacatccacaacaagggccgccgccagcaggacaattcagggaaccgacaggatcagat

SEQ ID NO: 195328 - DNA, 75 bp, Artificial Sequence
  Synthetic
gcagagtgggatcttcaacatccacaacaagggccgccgccagcaggacaactcagggaaccgacaggatcagat

SEQ ID NO: 195329 - DNA, 75 bp, Artificial Sequence
  Synthetic
gcagagtgggatcttcaacatccacaacaagggccgccgccagcaggacaagtcagggaaccgacaggatcagat

SEQ ID NO: 195330 - DNA, 75 bp, Artificial Sequence
  Synthetic
atagcagggaccactagtacaatagaagaacaaattcagtggacacacaggcagcaaaaccctataccagtagga

SEQ ID NO: 195331 - DNA, 75 bp, Artificial Sequence
  Synthetic
aatatatatagaagatggatccaattaggacttcaaaaatgtgtcaggatgtaaaatccaacaaacatcctagat

SEQ ID NO: 195332 - DNA, 75 bp, Artificial Sequence
  Synthetic
aatatatatagaagatggatccaattaggacttcaaaaatgtgtcaggatgtataatccaacaaacatcctagat

SEQ ID NO: 195333 - DNA, 75 bp, Artificial Sequence
  Synthetic
aatatatatagaagatggatccaattaggacttcaaaaatgtgtcaggatgtacaatccaacaaacatcctagat

SEQ ID NO: 195334 - DNA, 75 bp, Artificial Sequence
  Synthetic
aatatatatagaagatggatccaattaggacttcaaaaatgtgtcaggatgtagaatccaacaaacatcctagat

SEQ ID NO: 195335 - DNA, 75 bp, Artificial Sequence
  Synthetic
aatatatatagaagatggatccatttaggacttcaaaaatgtgtcaggatgtaaaatccaacaaacatcctagat

SEQ ID NO: 195336 - DNA, 75 bp, Artificial Sequence
  Synthetic
aatatatatagaagatggatccatttaggacttcaaaaatgtgtcaggatgtataatccaacaaacatcctagat

SEQ ID NO: 195337 - DNA, 75 bp, Artificial Sequence
  Synthetic
aatatatatagaagatggatccatttaggacttcaaaaatgtgtcaggatgtacaatccaacaaacatcctagat

SEQ ID NO: 195338 - DNA, 75 bp, Artificial Sequence
  Synthetic
aatatatatagaagatggatccatttaggacttcaaaaatgtgtcaggatgtagaatccaacaaacatcctagat

SEQ ID NO: 195339 - DNA, 75 bp, Artificial Sequence
  Synthetic
aatatatatagaagatggatccacttaggacttcaaaaatgtgtcaggatgtaaaatccaacaaacatcctagat

SEQ ID NO: 195340 - DNA, 75 bp, Artificial Sequence
  Synthetic
aatatatatagaagatggatccacttaggacttcaaaaatgtgtcaggatgtataatccaacaaacatcctagat

SEQ ID NO: 195341 - DNA, 75 bp, Artificial Sequence
  Synthetic
aatatatatagaagatggatccacttaggacttcaaaaatgtgtcaggatgtacaatccaacaaacatcctagat

SEQ ID NO: 195342 - DNA, 75 bp, Artificial Sequence
  Synthetic
aatatatatagaagatggatccacttaggacttcaaaaatgtgtcaggatgtagaatccaacaaacatcctagat

SEQ ID NO: 195343 - DNA, 75 bp, Artificial Sequence
  Synthetic
aatatatatagaagatggatccagttaggacttcaaaaatgtgtcaggatgtaaaatccaacaaacatcctagat

SEQ ID NO: 195344 - DNA, 75 bp, Artificial Sequence
  Synthetic
aatatatatagaagatggatccagttaggacttcaaaaatgtgtcaggatgtataatccaacaaacatcctagat

SEQ ID NO: 195345 - DNA, 75 bp, Artificial Sequence
  Synthetic
aatatatatagaagatggatccagttaggacttcaaaaatgtgtcaggatgtacaatccaacaaacatcctagat

SEQ ID NO: 195346 - DNA, 75 bp, Artificial Sequence
  Synthetic
aatatatatagaagatggatccagttaggacttcaaaaatgtgtcaggatgtagaatccaacaaacatcctagat

SEQ ID NO: 195347 - DNA, 75 bp, Artificial Sequence
  Synthetic
aatatttatagaagatggatccaattaggacttcaaaaatgtgtcaggatgtaaaatccaacaaacatcctagat

SEQ ID NO: 195348 - DNA, 75 bp, Artificial Sequence
  Synthetic
aatatttatagaagatggatccaattaggacttcaaaaatgtgtcaggatgtataatccaacaaacatcctagat

SEQ ID NO: 195349 - DNA, 75 bp, Artificial Sequence
  Synthetic
aatatttatagaagatggatccaattaggacttcaaaaatgtgtcaggatgtacaatccaacaaacatcctagat

SEQ ID NO: 195350 - DNA, 75 bp, Artificial Sequence
  Synthetic
aatatttatagaagatggatccaattaggacttcaaaaatgtgtcaggatgtagaatccaacaaacatcctagat

SEQ ID NO: 195351 - DNA, 75 bp, Artificial Sequence
  Synthetic
aatatttatagaagatggatccatttaggacttcaaaaatgtgtcaggatgtaaaatccaacaaacatcctagat

SEQ ID NO: 195352 - DNA, 75 bp, Artificial Sequence
  Synthetic
aatatttatagaagatggatccatttaggacttcaaaaatgtgtcaggatgtataatccaacaaacatcctagat

SEQ ID NO: 195353 - DNA, 75 bp, Artificial Sequence
  Synthetic
aatatttatagaagatggatccatttaggacttcaaaaatgtgtcaggatgtacaatccaacaaacatcctagat

SEQ ID NO: 195354 - DNA, 75 bp, Artificial Sequence
  Synthetic
aatatttatagaagatggatccatttaggacttcaaaaatgtgtcaggatgtagaatccaacaaacatcctagat

SEQ ID NO: 195355 - DNA, 75 bp, Artificial Sequence
  Synthetic
aatatttatagaagatggatccacttaggacttcaaaaatgtgtcaggatgtaaaatccaacaaacatcctagat

SEQ ID NO: 195356 - DNA, 75 bp, Artificial Sequence
  Synthetic
aatatttatagaagatggatccacttaggacttcaaaaatgtgtcaggatgtataatccaacaaacatcctagat

SEQ ID NO: 195357 - DNA, 75 bp, Artificial Sequence
  Synthetic
aatatttatagaagatggatccacttaggacttcaaaaatgtgtcaggatgtacaatccaacaaacatcctagat

SEQ ID NO: 195358 - DNA, 75 bp, Artificial Sequence
  Synthetic
aatatttatagaagatggatccacttaggacttcaaaaatgtgtcaggatgtagaatccaacaaacatcctagat

SEQ ID NO: 195359 - DNA, 75 bp, Artificial Sequence
  Synthetic
aatatttatagaagatggatccagttaggacttcaaaaatgtgtcaggatgtaaaatccaacaaacatcctagat

SEQ ID NO: 195360 - DNA, 75 bp, Artificial Sequence
  Synthetic
aatatttatagaagatggatccagttaggacttcaaaaatgtgtcaggatgtataatccaacaaacatcctagat

SEQ ID NO: 195361 - DNA, 75 bp, Artificial Sequence
  Synthetic
aatatttatagaagatggatccagttaggacttcaaaaatgtgtcaggatgtacaatccaacaaacatcctagat

SEQ ID NO: 195362 - DNA, 75 bp, Artificial Sequence
  Synthetic
aatatttatagaagatggatccagttaggacttcaaaaatgtgtcaggatgtagaatccaacaaacatcctagat

SEQ ID NO: 195363 - DNA, 75 bp, Artificial Sequence
  Synthetic
aatatctatagaagatggatccaattaggacttcaaaaatgtgtcaggatgtaaaatccaacaaacatcctagat

SEQ ID NO: 195364 - DNA, 75 bp, Artificial Sequence
  Synthetic
aatatctatagaagatggatccaattaggacttcaaaaatgtgtcaggatgtataatccaacaaacatcctagat

SEQ ID NO: 195365 - DNA, 75 bp, Artificial Sequence
  Synthetic
aatatctatagaagatggatccaattaggacttcaaaaatgtgtcaggatgtacaatccaacaaacatcctagat

SEQ ID NO: 195366 - DNA, 75 bp, Artificial Sequence
  Synthetic
aatatctatagaagatggatccaattaggacttcaaaaatgtgtcaggatgtagaatccaacaaacatcctagat

SEQ ID NO: 195367 - DNA, 75 bp, Artificial Sequence
  Synthetic
aatatctatagaagatggatccatttaggacttcaaaaatgtgtcaggatgtaaaatccaacaaacatcctagat

SEQ ID NO: 195368 - DNA, 75 bp, Artificial Sequence
  Synthetic
aatatctatagaagatggatccatttaggacttcaaaaatgtgtcaggatgtataatccaacaaacatcctagat

SEQ ID NO: 195369 - DNA, 75 bp, Artificial Sequence
  Synthetic
aatatctatagaagatggatccatttaggacttcaaaaatgtgtcaggatgtacaatccaacaaacatcctagat

SEQ ID NO: 195370 - DNA, 75 bp, Artificial Sequence
  Synthetic
aatatctatagaagatggatccatttaggacttcaaaaatgtgtcaggatgtagaatccaacaaacatcctagat

SEQ ID NO: 195371 - DNA, 75 bp, Artificial Sequence
  Synthetic
aatatctatagaagatggatccacttaggacttcaaaaatgtgtcaggatgtaaaatccaacaaacatcctagat

SEQ ID NO: 195372 - DNA, 75 bp, Artificial Sequence
  Synthetic
aatatctatagaagatggatccacttaggacttcaaaaatgtgtcaggatgtataatccaacaaacatcctagat

SEQ ID NO: 195373 - DNA, 75 bp, Artificial Sequence
  Synthetic
aatatctatagaagatggatccacttaggacttcaaaaatgtgtcaggatgtacaatccaacaaacatcctagat

SEQ ID NO: 195374 - DNA, 75 bp, Artificial Sequence
  Synthetic
aatatctatagaagatggatccacttaggacttcaaaaatgtgtcaggatgtagaatccaacaaacatcctagat

SEQ ID NO: 195375 - DNA, 75 bp, Artificial Sequence
  Synthetic
aatatctatagaagatggatccagttaggacttcaaaaatgtgtcaggatgtaaaatccaacaaacatcctagat

SEQ ID NO: 195376 - DNA, 75 bp, Artificial Sequence
  Synthetic
aatatctatagaagatggatccagttaggacttcaaaaatgtgtcaggatgtataatccaacaaacatcctagat

SEQ ID NO: 195377 - DNA, 75 bp, Artificial Sequence
  Synthetic
aatatctatagaagatggatccagttaggacttcaaaaatgtgtcaggatgtacaatccaacaaacatcctagat

SEQ ID NO: 195378 - DNA, 75 bp, Artificial Sequence
  Synthetic
aatatctatagaagatggatccagttaggacttcaaaaatgtgtcaggatgtagaatccaacaaacatcctagat

SEQ ID NO: 195379 - DNA, 75 bp, Artificial Sequence
  Synthetic
aatatgtatagaagatggatccaattaggacttcaaaaatgtgtcaggatgtaaaatccaacaaacatcctagat

SEQ ID NO: 195380 - DNA, 75 bp, Artificial Sequence
  Synthetic
aatatgtatagaagatggatccaattaggacttcaaaaatgtgtcaggatgtataatccaacaaacatcctagat

SEQ ID NO: 195381 - DNA, 75 bp, Artificial Sequence
  Synthetic
aatatgtatagaagatggatccaattaggacttcaaaaatgtgtcaggatgtacaatccaacaaacatcctagat

SEQ ID NO: 195382 - DNA, 75 bp, Artificial Sequence
  Synthetic
aatatgtatagaagatggatccaattaggacttcaaaaatgtgtcaggatgtagaatccaacaaacatcctagat

SEQ ID NO: 195383 - DNA, 75 bp, Artificial Sequence
  Synthetic
aatatgtatagaagatggatccatttaggacttcaaaaatgtgtcaggatgtaaaatccaacaaacatcctagat

SEQ ID NO: 195384 - DNA, 75 bp, Artificial Sequence
  Synthetic
aatatgtatagaagatggatccatttaggacttcaaaaatgtgtcaggatgtataatccaacaaacatcctagat

SEQ ID NO: 195385 - DNA, 75 bp, Artificial Sequence
  Synthetic
aatatgtatagaagatggatccatttaggacttcaaaaatgtgtcaggatgtacaatccaacaaacatcctagat

SEQ ID NO: 195386 - DNA, 75 bp, Artificial Sequence
  Synthetic
aatatgtatagaagatggatccatttaggacttcaaaaatgtgtcaggatgtagaatccaacaaacatcctagat

SEQ ID NO: 195387 - DNA, 75 bp, Artificial Sequence
  Synthetic
aatatgtatagaagatggatccacttaggacttcaaaaatgtgtcaggatgtaaaatccaacaaacatcctagat

SEQ ID NO: 195388 - DNA, 75 bp, Artificial Sequence
  Synthetic
aatatgtatagaagatggatccacttaggacttcaaaaatgtgtcaggatgtataatccaacaaacatcctagat

SEQ ID NO: 195389 - DNA, 75 bp, Artificial Sequence
  Synthetic
aatatgtatagaagatggatccacttaggacttcaaaaatgtgtcaggatgtacaatccaacaaacatcctagat

SEQ ID NO: 195390 - DNA, 75 bp, Artificial Sequence
  Synthetic
aatatgtatagaagatggatccacttaggacttcaaaaatgtgtcaggatgtagaatccaacaaacatcctagat

SEQ ID NO: 195391 - DNA, 75 bp, Artificial Sequence
  Synthetic
aatatgtatagaagatggatccagttaggacttcaaaaatgtgtcaggatgtaaaatccaacaaacatcctagat

SEQ ID NO: 195392 - DNA, 75 bp, Artificial Sequence
  Synthetic
aatatgtatagaagatggatccagttaggacttcaaaaatgtgtcaggatgtataatccaacaaacatcctagat

SEQ ID NO: 195393 - DNA, 75 bp, Artificial Sequence
  Synthetic
aatatgtatagaagatggatccagttaggacttcaaaaatgtgtcaggatgtacaatccaacaaacatcctagat

SEQ ID NO: 195394 - DNA, 75 bp, Artificial Sequence
  Synthetic
aatatgtatagaagatggatccagttaggacttcaaaaatgtgtcaggatgtagaatccaacaaacatcctagat

SEQ ID NO: 195395 - DNA, 75 bp, Artificial Sequence
  Synthetic
gtaaaacaagggccaaaagaaccctttcagtcttatgtagatagattctacaagagtctaagagcagaacaaact

SEQ ID NO: 195396 - DNA, 75 bp, Artificial Sequence
  Synthetic
gtaaaacaagggccaaaagaaccctttcagtcttatgtagatagattctacaagagtcttagagcagaacaaact

SEQ ID NO: 195397 - DNA, 75 bp, Artificial Sequence
  Synthetic
gtaaaacaagggccaaaagaaccctttcagtcttatgtagatagattctacaagagtctcagagcagaacaaact

SEQ ID NO: 195398 - DNA, 75 bp, Artificial Sequence
  Synthetic
gtaaaacaagggccaaaagaaccctttcagtcttatgtagatagattctacaagagtctgagagcagaacaaact

SEQ ID NO: 195399 - DNA, 75 bp, Artificial Sequence
  Synthetic
gatccagcagtaaaaaattggatgacacagacactactgattcaaaatgccaacccagattgtaaattagtacta

SEQ ID NO: 195400 - DNA, 75 bp, Artificial Sequence
  Synthetic
ttgttttacggcgggtgaagtaagaagagccatcagaggggaaaagttactgtcctgctgcaattacccccaagc

SEQ ID NO: 195401 - DNA, 75 bp, Artificial Sequence
  Synthetic
aaggggttgggaatgaatcctactttagaggaaatgttgacagcctgtcaagggataggaggaccagggcaaaaa

SEQ ID NO: 195402 - DNA, 75 bp, Artificial Sequence
  Synthetic
aaggggttgggaatgaatcctactttagaggaaatgttgacagcctgtcaagggttaggaggaccagggcaaaaa

SEQ ID NO: 195403 - DNA, 75 bp, Artificial Sequence
  Synthetic
aaggggttgggaatgaatcctactttagaggaaatgttgacagcctgtcaagggctaggaggaccagggcaaaaa

SEQ ID NO: 195404 - DNA, 75 bp, Artificial Sequence
  Synthetic
aaggggttgggaatgaatcctactttagaggaaatgttgacagcctgtcaaggggtaggaggaccagggcaaaaa

SEQ ID NO: 195405 - DNA, 75 bp, Artificial Sequence
  Synthetic
ccatagatctaaggtaccgttactccaatttctggccttagtagtagtgcaacaaaatggcagaccccagaaaaa

SEQ ID NO: 195406 - DNA, 75 bp, Artificial Sequence
  Synthetic
gccaggcttatggctgaagcattaaaagaagccttaaaccctacagccctaccatttgcagctgctcaacaaaaa

SEQ ID NO: 195407 - DNA, 75 bp, Artificial Sequence
  Synthetic
cagtaccaccaggaaacggtggcgaagtaactattggagaggctttcgcttggctagaaaggatggtagaggcca

SEQ ID NO: 195408 - DNA, 75 bp, Artificial Sequence
  Synthetic
acaggaggaaaaaggagcacaataaaatgttggaattgtggcaaggagggacatacagttagacagtgcagagcc

SEQ ID NO: 195409 - DNA, 75 bp, Artificial Sequence
  Synthetic
cccagaagacaggggtgctggaagtgtgggaagccaggccacattatggccaaatgtccagagagacaggcaggt

SEQ ID NO: 195410 - DNA, 75 bp, Artificial Sequence
  Synthetic
tggcaaaggtcctggagatactggcatgatgacctagggatgtcacaaagttacacaaagtatagatatttgcgc

SEQ ID NO: 195411 - DNA, 75 bp, Artificial Sequence
  Synthetic
tttttagggtttggaccttggggaaagaagcctcgcaacttccccatgacccaagtccctcagggtctgactcca

SEQ ID NO: 195412 - DNA, 75 bp, Artificial Sequence
  Synthetic
ttaatgcagtatgctatgttcatacatgttaagaaagggtgcacttgcctggggggaggacatgggccgggaggg

SEQ ID NO: 195413 - DNA, 75 bp, Artificial Sequence
  Synthetic
tcagcaccaccgatggacccagcagtagacctactgaagaattacatgcaactggggaggaagcaaaaggagcag

SEQ ID NO: 195414 - DNA, 75 bp, Artificial Sequence
  Synthetic
tcagcaccaccgatggacccagcagtagacctactgaagaattacatgcatctggggaggaagcaaaaggagcag

SEQ ID NO: 195415 - DNA, 75 bp, Artificial Sequence
  Synthetic
tcagcaccaccgatggacccagcagtagacctactgaagaattacatgcacctggggaggaagcaaaaggagcag

SEQ ID NO: 195416 - DNA, 75 bp, Artificial Sequence
  Synthetic
tcagcaccaccgatggacccagcagtagacctactgaagaattacatgcagctggggaggaagcaaaaggagcag

SEQ ID NO: 195417 - DNA, 75 bp, Artificial Sequence
  Synthetic
tggagaccaggacctccccctcctcccccaggcctagtctaatgactgaagcaccagcagagtttcccccggagg

SEQ ID NO: 195418 - DNA, 75 bp, Artificial Sequence
  Synthetic
agaaacaaaccctacaaggaggtgacagaagaattgctgcacctcagctctctctttggagacgaccagtagtca

SEQ ID NO: 195419 - DNA, 75 bp, Artificial Sequence
  Synthetic
agaaacaaaccctacaaggaggtgacagaagatttgctgcacctcagctctctctttggagacgaccagtagtca

SEQ ID NO: 195420 - DNA, 75 bp, Artificial Sequence
  Synthetic
agaaacaaaccctacaaggaggtgacagaagacttgctgcacctcagctctctctttggagacgaccagtagtca

SEQ ID NO: 195421 - DNA, 75 bp, Artificial Sequence
  Synthetic
agaaacaaaccctacaaggaggtgacagaagagttgctgcacctcagctctctctttggagacgaccagtagtca

SEQ ID NO: 195422 - DNA, 75 bp, Artificial Sequence
  Synthetic
agaaacaaaccctacaaggaggtgacagatgaattgctgcacctcagctctctctttggagacgaccagtagtca

SEQ ID NO: 195423 - DNA, 75 bp, Artificial Sequence
  Synthetic
agaaacaaaccctacaaggaggtgacagatgatttgctgcacctcagctctctctttggagacgaccagtagtca

SEQ ID NO: 195424 - DNA, 75 bp, Artificial Sequence
  Synthetic
agaaacaaaccctacaaggaggtgacagatgacttgctgcacctcagctctctctttggagacgaccagtagtca

SEQ ID NO: 195425 - DNA, 75 bp, Artificial Sequence
  Synthetic
agaaacaaaccctacaaggaggtgacagatgagttgctgcacctcagctctctctttggagacgaccagtagtca

SEQ ID NO: 195426 - DNA, 75 bp, Artificial Sequence
  Synthetic
agaaacaaaccctacaaggaggtgacagacgaattgctgcacctcagctctctctttggagacgaccagtagtca

SEQ ID NO: 195427 - DNA, 75 bp, Artificial Sequence
  Synthetic
agaaacaaaccctacaaggaggtgacagacgatttgctgcacctcagctctctctttggagacgaccagtagtca

SEQ ID NO: 195428 - DNA, 75 bp, Artificial Sequence
  Synthetic
agaaacaaaccctacaaggaggtgacagacgacttgctgcacctcagctctctctttggagacgaccagtagtca

SEQ ID NO: 195429 - DNA, 75 bp, Artificial Sequence
  Synthetic
agaaacaaaccctacaaggaggtgacagacgagttgctgcacctcagctctctctttggagacgaccagtagtca

SEQ ID NO: 195430 - DNA, 75 bp, Artificial Sequence
  Synthetic
agaaacaaaccctacaaggaggtgacagaggaattgctgcacctcagctctctctttggagacgaccagtagtca

SEQ ID NO: 195431 - DNA, 75 bp, Artificial Sequence
  Synthetic
agaaacaaaccctacaaggaggtgacagaggatttgctgcacctcagctctctctttggagacgaccagtagtca

SEQ ID NO: 195432 - DNA, 75 bp, Artificial Sequence
  Synthetic
agaaacaaaccctacaaggaggtgacagaggacttgctgcacctcagctctctctttggagacgaccagtagtca

SEQ ID NO: 195433 - DNA, 75 bp, Artificial Sequence
  Synthetic
agaaacaaaccctacaaggaggtgacagaggagttgctgcacctcagctctctctttggagacgaccagtagtca

SEQ ID NO: 195434 - DNA, 75 bp, Artificial Sequence
  Synthetic
atgaaaccccaccgagggggccaggggatgagtgggtaataggaatcctgagagaattaagagaagaagctttaa

SEQ ID NO: 195435 - DNA, 75 bp, Artificial Sequence
  Synthetic
ctgcatacatagaaagtcagccagtagaagtactattagacacaggggctgatgactctatagtagcaggaatag

SEQ ID NO: 195436 - DNA, 75 bp, Artificial Sequence
  Synthetic
agcattttgaccctcgcttgctaactactcttggcaactatatctgtgctagacatggagacaccctcgaaagcg

SEQ ID NO: 195437 - DNA, 75 bp, Artificial Sequence
  Synthetic
aattaggaagtaattatagtccaaaaatagtaggaggaataggaggatttattaataccaaagaatacaaaaatg

SEQ ID NO: 195438 - DNA, 75 bp, Artificial Sequence
  Synthetic
ccagagagctcattaatgtcctgcaacgagccctcttcgtgcacttcagagcaggatgtaaaatctcaagaattg

SEQ ID NO: 195439 - DNA, 75 bp, Artificial Sequence
  Synthetic
tagaaattaaagtggtaggaaaaagaatacaggctactgttatgacaggggatacccctataaatatctttggaa

SEQ ID NO: 195440 - DNA, 75 bp, Artificial Sequence
  Synthetic
gccaaacaaggggagagactcctttctcagctataccaacccctagaggcatgcaataacccatgttattgtaag

SEQ ID NO: 195441 - DNA, 75 bp, Artificial Sequence
  Synthetic
ggaacattttagttaagctaggcatgtctctaaattttccaattgcaaaggtagagccagtaaaagtaaggctaa

SEQ ID NO: 195442 - DNA, 75 bp, Artificial Sequence
  Synthetic
atgcaataacccatgttattgtaagaaatgttgttaccattgccagctatgttttttaaaaaagggactcgggat

SEQ ID NO: 195443 - DNA, 75 bp, Artificial Sequence
  Synthetic
atgttatgaacggaagggcagacgaagaaggactccaaagaaagcaaaggctcattcgtcttctgcatcagacaa

SEQ ID NO: 195444 - DNA, 75 bp, Artificial Sequence
  Synthetic
aacctggcatggatgggccaaaaatcaggcaatggcccctatctaaggaaaaaatacaagcactcagggaaattt

SEQ ID NO: 195445 - DNA, 75 bp, Artificial Sequence
  Synthetic
gtgagtataatggatagtagaaatcagctaattgttgccattttactaactagtgcttgcttaatatattgcgcc

SEQ ID NO: 195446 - DNA, 75 bp, Artificial Sequence
  Synthetic
gtgacaaaatggaacaggaagggcaattggaagaagcaccccccaccaatccgtataacacacccacctttacta

SEQ ID NO: 195447 - DNA, 75 bp, Artificial Sequence
  Synthetic
tcaagaagaaggacaaaaacaaatggagaatgttaatagacttcagagaacttaacagggtaacccaggacttta

SEQ ID NO: 195448 - DNA, 75 bp, Artificial Sequence
  Synthetic
caatatgtgactgttttctatggcatacccgcgtggaagaatgcatccattcccctcttttgtgcaaccagaaat

SEQ ID NO: 195449 - DNA, 75 bp, Artificial Sequence
  Synthetic
ctgaagtccagttgggcatacctcaccctgcaggtttggcagaaaaaaggagaataacagtactggatatagggg

SEQ ID NO: 195450 - DNA, 75 bp, Artificial Sequence
  Synthetic
ggaaatacctttaaatgtgacagaggcttttgacgcatggaacaatacagtaacagaacaagcagtagaagatgt

SEQ ID NO: 195451 - DNA, 75 bp, Artificial Sequence
  Synthetic
atgcctacttcagcattcctctagatgtagatttcaggcagtacacagctttcactttaccatcagtaaacaatg

SEQ ID NO: 195452 - DNA, 75 bp, Artificial Sequence
  Synthetic
ctggaatctatttgagacatcagtaaaaccatgtgtcaaattaacacccttatgtgtgcaaatggaatgtaacag

SEQ ID NO: 195453 - DNA, 75 bp, Artificial Sequence
  Synthetic
cagaaccaggaaaaagatacatctacaaggtcctaccgcaaggatggaagggctcaccagctatcttccaacata

SEQ ID NO: 195454 - DNA, 75 bp, Artificial Sequence
  Synthetic
cacaagtacagagagcagtaacagcacaagtgaggggagcacagtcccagagatattaaacgaaactacttcatg

SEQ ID NO: 195455 - DNA, 75 bp, Artificial Sequence
  Synthetic
caatgaggaaggtactagaccccttcagaaaagccaatgaggatataattataatccaatatatggatgacattc

SEQ ID NO: 195456 - DNA, 75 bp, Artificial Sequence
  Synthetic
caatgaggaaggtactagaccccttcagaaaagccaatgaggatataattattatccaatatatggatgacattc

SEQ ID NO: 195457 - DNA, 75 bp, Artificial Sequence
  Synthetic
caatgaggaaggtactagaccccttcagaaaagccaatgaggatataattatcatccaatatatggatgacattc

SEQ ID NO: 195458 - DNA, 75 bp, Artificial Sequence
  Synthetic
caatgaggaaggtactagaccccttcagaaaagccaatgaggatataattatgatccaatatatggatgacattc

SEQ ID NO: 195459 - DNA, 75 bp, Artificial Sequence
  Synthetic
caatgaggaaggtactagaccccttcagaaaagccaatgaggatttaattataatccaatatatggatgacattc

SEQ ID NO: 195460 - DNA, 75 bp, Artificial Sequence
  Synthetic
caatgaggaaggtactagaccccttcagaaaagccaatgaggatttaattattatccaatatatggatgacattc

SEQ ID NO: 195461 - DNA, 75 bp, Artificial Sequence
  Synthetic
caatgaggaaggtactagaccccttcagaaaagccaatgaggatttaattatcatccaatatatggatgacattc

SEQ ID NO: 195462 - DNA, 75 bp, Artificial Sequence
  Synthetic
caatgaggaaggtactagaccccttcagaaaagccaatgaggatttaattatgatccaatatatggatgacattc

SEQ ID NO: 195463 - DNA, 75 bp, Artificial Sequence
  Synthetic
caatgaggaaggtactagaccccttcagaaaagccaatgaggatctaattataatccaatatatggatgacattc

SEQ ID NO: 195464 - DNA, 75 bp, Artificial Sequence
  Synthetic
caatgaggaaggtactagaccccttcagaaaagccaatgaggatctaattattatccaatatatggatgacattc

SEQ ID NO: 195465 - DNA, 75 bp, Artificial Sequence
  Synthetic
caatgaggaaggtactagaccccttcagaaaagccaatgaggatctaattatcatccaatatatggatgacattc

SEQ ID NO: 195466 - DNA, 75 bp, Artificial Sequence
  Synthetic
caatgaggaaggtactagaccccttcagaaaagccaatgaggatctaattatgatccaatatatggatgacattc

SEQ ID NO: 195467 - DNA, 75 bp, Artificial Sequence
  Synthetic
caatgaggaaggtactagaccccttcagaaaagccaatgaggatgtaattataatccaatatatggatgacattc

SEQ ID NO: 195468 - DNA, 75 bp, Artificial Sequence
  Synthetic
caatgaggaaggtactagaccccttcagaaaagccaatgaggatgtaattattatccaatatatggatgacattc

SEQ ID NO: 195469 - DNA, 75 bp, Artificial Sequence
  Synthetic
caatgaggaaggtactagaccccttcagaaaagccaatgaggatgtaattatcatccaatatatggatgacattc

SEQ ID NO: 195470 - DNA, 75 bp, Artificial Sequence
  Synthetic
caatgaggaaggtactagaccccttcagaaaagccaatgaggatgtaattatgatccaatatatggatgacattc

SEQ ID NO: 195471 - DNA, 75 bp, Artificial Sequence
  Synthetic
cataaccaacaacagctgctcagatttagggagtgaagaggtagtcgattgtcggttcaatatgacaggactaca

SEQ ID NO: 195472 - DNA, 75 bp, Artificial Sequence
  Synthetic
ttgtggccagtgacagaactgatttagaacatgatcaagtagttttgcagctaaaggaactcttaaataaaacag

SEQ ID NO: 195473 - DNA, 75 bp, Artificial Sequence
  Synthetic
ttgtggccagtgacagaactgatttagaacatgatcaagtagttttgcagctaaaggaactcttaaataaaactg

SEQ ID NO: 195474 - DNA, 75 bp, Artificial Sequence
  Synthetic
ttgtggccagtgacagaactgatttagaacatgatcaagtagttttgcagctaaaggaactcttaaataaaaccg

SEQ ID NO: 195475 - DNA, 75 bp, Artificial Sequence
  Synthetic
ttgtggccagtgacagaactgatttagaacatgatcaagtagttttgcagctaaaggaactcttaaataaaacgg

SEQ ID NO: 195476 - DNA, 75 bp, Artificial Sequence
  Synthetic
actagataagccacagcaatatagtgaaacatggtactcaaaggatgtagtttgtgacacaactaatgggaccag

SEQ ID NO: 195477 - DNA, 75 bp, Artificial Sequence
  Synthetic
ggttctctacccctgatgaaaagttccaaaaagaccctccatatcaatggatgggatatgaattatggccaaaaa

SEQ ID NO: 195478 - DNA, 75 bp, Artificial Sequence
  Synthetic
ggttctctacccctgatgaaaagttccaaaaagaccctccatatcaatggatgggatatgaattttggccaaaaa

SEQ ID NO: 195479 - DNA, 75 bp, Artificial Sequence
  Synthetic
ggttctctacccctgatgaaaagttccaaaaagaccctccatatcaatggatgggatatgaattctggccaaaaa

SEQ ID NO: 195480 - DNA, 75 bp, Artificial Sequence
  Synthetic
ggttctctacccctgatgaaaagttccaaaaagaccctccatatcaatggatgggatatgaattgtggccaaaaa

SEQ ID NO: 195481 - DNA, 75 bp, Artificial Sequence
  Synthetic
gaaacatggtactcaaaggatgtagtttgtgacacaactaatgggaccagccgcaaatgttacatgaaccattgc

SEQ ID NO: 195482 - DNA, 75 bp, Artificial Sequence
  Synthetic
agtggaaactacaaaagattaacctgccagaaaaagagacttggacagtaaatgatattcaaaaactagtagggg

SEQ ID NO: 195483 - DNA, 75 bp, Artificial Sequence
  Synthetic
agtggaaactacaaaagattaacctgcctgaaaaagagacttggacagtaaatgatattcaaaaactagtagggg

SEQ ID NO: 195484 - DNA, 75 bp, Artificial Sequence
  Synthetic
agtggaaactacaaaagattaacctgcccgaaaaagagacttggacagtaaatgatattcaaaaactagtagggg

SEQ ID NO: 195485 - DNA, 75 bp, Artificial Sequence
  Synthetic
agtggaaactacaaaagattaacctgccggaaaaagagacttggacagtaaatgatattcaaaaactagtagggg

SEQ ID NO: 195486 - DNA, 75 bp, Artificial Sequence
  Synthetic
tactgaaatgggcagctcagctatatccaggaatcaaaacaaaaaacctgtgaaaattaattagaggtaaaatga

SEQ ID NO: 195487 - DNA, 75 bp, Artificial Sequence
  Synthetic
tactgaaatgggcagctcagctatatccaggaatcaaaacaaaaaacctgtgaaaattaattagaggtaatatga

SEQ ID NO: 195488 - DNA, 75 bp, Artificial Sequence
  Synthetic
tactgaaatgggcagctcagctatatccaggaatcaaaacaaaaaacctgtgaaaattaattagaggtaacatga

SEQ ID NO: 195489 - DNA, 75 bp, Artificial Sequence
  Synthetic
tactgaaatgggcagctcagctatatccaggaatcaaaacaaaaaacctgtgaaaattaattagaggtaagatga

SEQ ID NO: 195490 - DNA, 75 bp, Artificial Sequence
  Synthetic
tactgaaatgggcagctcagctatatccaggaatcaaaacaaaaaacctgtgtaaattaattagaggtaaaatga

SEQ ID NO: 195491 - DNA, 75 bp, Artificial Sequence
  Synthetic
tactgaaatgggcagctcagctatatccaggaatcaaaacaaaaaacctgtgtaaattaattagaggtaatatga

SEQ ID NO: 195492 - DNA, 75 bp, Artificial Sequence
  Synthetic
tactgaaatgggcagctcagctatatccaggaatcaaaacaaaaaacctgtgtaaattaattagaggtaacatga

SEQ ID NO: 195493 - DNA, 75 bp, Artificial Sequence
  Synthetic
tactgaaatgggcagctcagctatatccaggaatcaaaacaaaaaacctgtgtaaattaattagaggtaagatga

SEQ ID NO: 195494 - DNA, 75 bp, Artificial Sequence
  Synthetic
tactgaaatgggcagctcagctatatccaggaatcaaaacaaaaaacctgtgcaaattaattagaggtaaaatga

SEQ ID NO: 195495 - DNA, 75 bp, Artificial Sequence
  Synthetic
tactgaaatgggcagctcagctatatccaggaatcaaaacaaaaaacctgtgcaaattaattagaggtaatatga

SEQ ID NO: 195496 - DNA, 75 bp, Artificial Sequence
  Synthetic
tactgaaatgggcagctcagctatatccaggaatcaaaacaaaaaacctgtgcaaattaattagaggtaacatga

SEQ ID NO: 195497 - DNA, 75 bp, Artificial Sequence
  Synthetic
tactgaaatgggcagctcagctatatccaggaatcaaaacaaaaaacctgtgcaaattaattagaggtaagatga

SEQ ID NO: 195498 - DNA, 75 bp, Artificial Sequence
  Synthetic
tactgaaatgggcagctcagctatatccaggaatcaaaacaaaaaacctgtggaaattaattagaggtaaaatga

SEQ ID NO: 195499 - DNA, 75 bp, Artificial Sequence
  Synthetic
tactgaaatgggcagctcagctatatccaggaatcaaaacaaaaaacctgtggaaattaattagaggtaatatga

SEQ ID NO: 195500 - DNA, 75 bp, Artificial Sequence
  Synthetic
tactgaaatgggcagctcagctatatccaggaatcaaaacaaaaaacctgtggaaattaattagaggtaacatga

SEQ ID NO: 195501 - DNA, 75 bp, Artificial Sequence
  Synthetic
tactgaaatgggcagctcagctatatccaggaatcaaaacaaaaaacctgtggaaattaattagaggtaagatga

SEQ ID NO: 195502 - DNA, 75 bp, Artificial Sequence
  Synthetic
tactgaattgggcagctcagctatatccaggaatcaaaacaaaaaacctgtgaaaattaattagaggtaaaatga

SEQ ID NO: 195503 - DNA, 75 bp, Artificial Sequence
  Synthetic
tactgaattgggcagctcagctatatccaggaatcaaaacaaaaaacctgtgaaaattaattagaggtaatatga

SEQ ID NO: 195504 - DNA, 75 bp, Artificial Sequence
  Synthetic
tactgaattgggcagctcagctatatccaggaatcaaaacaaaaaacctgtgaaaattaattagaggtaacatga

SEQ ID NO: 195505 - DNA, 75 bp, Artificial Sequence
  Synthetic
tactgaattgggcagctcagctatatccaggaatcaaaacaaaaaacctgtgaaaattaattagaggtaagatga

SEQ ID NO: 195506 - DNA, 75 bp, Artificial Sequence
  Synthetic
tactgaattgggcagctcagctatatccaggaatcaaaacaaaaaacctgtgtaaattaattagaggtaaaatga

SEQ ID NO: 195507 - DNA, 75 bp, Artificial Sequence
  Synthetic
tactgaattgggcagctcagctatatccaggaatcaaaacaaaaaacctgtgtaaattaattagaggtaatatga

SEQ ID NO: 195508 - DNA, 75 bp, Artificial Sequence
  Synthetic
tactgaattgggcagctcagctatatccaggaatcaaaacaaaaaacctgtgtaaattaattagaggtaacatga

SEQ ID NO: 195509 - DNA, 75 bp, Artificial Sequence
  Synthetic
tactgaattgggcagctcagctatatccaggaatcaaaacaaaaaacctgtgtaaattaattagaggtaagatga

SEQ ID NO: 195510 - DNA, 75 bp, Artificial Sequence
  Synthetic
tactgaattgggcagctcagctatatccaggaatcaaaacaaaaaacctgtgcaaattaattagaggtaaaatga

SEQ ID NO: 195511 - DNA, 75 bp, Artificial Sequence
  Synthetic
tactgaattgggcagctcagctatatccaggaatcaaaacaaaaaacctgtgcaaattaattagaggtaatatga

SEQ ID NO: 195512 - DNA, 75 bp, Artificial Sequence
  Synthetic
tactgaattgggcagctcagctatatccaggaatcaaaacaaaaaacctgtgcaaattaattagaggtaacatga

SEQ ID NO: 195513 - DNA, 75 bp, Artificial Sequence
  Synthetic
tactgaattgggcagctcagctatatccaggaatcaaaacaaaaaacctgtgcaaattaattagaggtaagatga

SEQ ID NO: 195514 - DNA, 75 bp, Artificial Sequence
  Synthetic
tactgaattgggcagctcagctatatccaggaatcaaaacaaaaaacctgtggaaattaattagaggtaaaatga

SEQ ID NO: 195515 - DNA, 75 bp, Artificial Sequence
  Synthetic
tactgaattgggcagctcagctatatccaggaatcaaaacaaaaaacctgtggaaattaattagaggtaatatga

SEQ ID NO: 195516 - DNA, 75 bp, Artificial Sequence
  Synthetic
tactgaattgggcagctcagctatatccaggaatcaaaacaaaaaacctgtggaaattaattagaggtaacatga

SEQ ID NO: 195517 - DNA, 75 bp, Artificial Sequence
  Synthetic
tactgaattgggcagctcagctatatccaggaatcaaaacaaaaaacctgtggaaattaattagaggtaagatga

SEQ ID NO: 195518 - DNA, 75 bp, Artificial Sequence
  Synthetic
tactgaactgggcagctcagctatatccaggaatcaaaacaaaaaacctgtgaaaattaattagaggtaaaatga

SEQ ID NO: 195519 - DNA, 75 bp, Artificial Sequence
  Synthetic
tactgaactgggcagctcagctatatccaggaatcaaaacaaaaaacctgtgaaaattaattagaggtaatatga

SEQ ID NO: 195520 - DNA, 75 bp, Artificial Sequence
  Synthetic
tactgaactgggcagctcagctatatccaggaatcaaaacaaaaaacctgtgaaaattaattagaggtaacatga

SEQ ID NO: 195521 - DNA, 75 bp, Artificial Sequence
  Synthetic
tactgaactgggcagctcagctatatccaggaatcaaaacaaaaaacctgtgaaaattaattagaggtaagatga

SEQ ID NO: 195522 - DNA, 75 bp, Artificial Sequence
  Synthetic
tactgaactgggcagctcagctatatccaggaatcaaaacaaaaaacctgtgtaaattaattagaggtaaaatga

SEQ ID NO: 195523 - DNA, 75 bp, Artificial Sequence
  Synthetic
tactgaactgggcagctcagctatatccaggaatcaaaacaaaaaacctgtgtaaattaattagaggtaatatga

SEQ ID NO: 195524 - DNA, 75 bp, Artificial Sequence
  Synthetic
tactgaactgggcagctcagctatatccaggaatcaaaacaaaaaacctgtgtaaattaattagaggtaacatga

SEQ ID NO: 195525 - DNA, 75 bp, Artificial Sequence
  Synthetic
tactgaactgggcagctcagctatatccaggaatcaaaacaaaaaacctgtgtaaattaattagaggtaagatga

SEQ ID NO: 195526 - DNA, 75 bp, Artificial Sequence
  Synthetic
tactgaactgggcagctcagctatatccaggaatcaaaacaaaaaacctgtgcaaattaattagaggtaaaatga

SEQ ID NO: 195527 - DNA, 75 bp, Artificial Sequence
  Synthetic
tactgaactgggcagctcagctatatccaggaatcaaaacaaaaaacctgtgcaaattaattagaggtaatatga

SEQ ID NO: 195528 - DNA, 75 bp, Artificial Sequence
  Synthetic
tactgaactgggcagctcagctatatccaggaatcaaaacaaaaaacctgtgcaaattaattagaggtaacatga

SEQ ID NO: 195529 - DNA, 75 bp, Artificial Sequence
  Synthetic
tactgaactgggcagctcagctatatccaggaatcaaaacaaaaaacctgtgcaaattaattagaggtaagatga

SEQ ID NO: 195530 - DNA, 75 bp, Artificial Sequence
  Synthetic
tactgaactgggcagctcagctatatccaggaatcaaaacaaaaaacctgtggaaattaattagaggtaaaatga

SEQ ID NO: 195531 - DNA, 75 bp, Artificial Sequence
  Synthetic
tactgaactgggcagctcagctatatccaggaatcaaaacaaaaaacctgtggaaattaattagaggtaatatga

SEQ ID NO: 195532 - DNA, 75 bp, Artificial Sequence
  Synthetic
tactgaactgggcagctcagctatatccaggaatcaaaacaaaaaacctgtggaaattaattagaggtaacatga

SEQ ID NO: 195533 - DNA, 75 bp, Artificial Sequence
  Synthetic
tactgaactgggcagctcagctatatccaggaatcaaaacaaaaaacctgtggaaattaattagaggtaagatga

SEQ ID NO: 195534 - DNA, 75 bp, Artificial Sequence
  Synthetic
tactgaagtgggcagctcagctatatccaggaatcaaaacaaaaaacctgtgaaaattaattagaggtaaaatga

SEQ ID NO: 195535 - DNA, 75 bp, Artificial Sequence
  Synthetic
tactgaagtgggcagctcagctatatccaggaatcaaaacaaaaaacctgtgaaaattaattagaggtaatatga

SEQ ID NO: 195536 - DNA, 75 bp, Artificial Sequence
  Synthetic
tactgaagtgggcagctcagctatatccaggaatcaaaacaaaaaacctgtgaaaattaattagaggtaacatga

SEQ ID NO: 195537 - DNA, 75 bp, Artificial Sequence
  Synthetic
tactgaagtgggcagctcagctatatccaggaatcaaaacaaaaaacctgtgaaaattaattagaggtaagatga

SEQ ID NO: 195538 - DNA, 75 bp, Artificial Sequence
  Synthetic
tactgaagtgggcagctcagctatatccaggaatcaaaacaaaaaacctgtgtaaattaattagaggtaaaatga

SEQ ID NO: 195539 - DNA, 75 bp, Artificial Sequence
  Synthetic
tactgaagtgggcagctcagctatatccaggaatcaaaacaaaaaacctgtgtaaattaattagaggtaatatga

SEQ ID NO: 195540 - DNA, 75 bp, Artificial Sequence
  Synthetic
tactgaagtgggcagctcagctatatccaggaatcaaaacaaaaaacctgtgtaaattaattagaggtaacatga

SEQ ID NO: 195541 - DNA, 75 bp, Artificial Sequence
  Synthetic
tactgaagtgggcagctcagctatatccaggaatcaaaacaaaaaacctgtgtaaattaattagaggtaagatga

SEQ ID NO: 195542 - DNA, 75 bp, Artificial Sequence
  Synthetic
tactgaagtgggcagctcagctatatccaggaatcaaaacaaaaaacctgtgcaaattaattagaggtaaaatga

SEQ ID NO: 195543 - DNA, 75 bp, Artificial Sequence
  Synthetic
tactgaagtgggcagctcagctatatccaggaatcaaaacaaaaaacctgtgcaaattaattagaggtaatatga

SEQ ID NO: 195544 - DNA, 75 bp, Artificial Sequence
  Synthetic
tactgaagtgggcagctcagctatatccaggaatcaaaacaaaaaacctgtgcaaattaattagaggtaacatga

SEQ ID NO: 195545 - DNA, 75 bp, Artificial Sequence
  Synthetic
tactgaagtgggcagctcagctatatccaggaatcaaaacaaaaaacctgtgcaaattaattagaggtaagatga

SEQ ID NO: 195546 - DNA, 75 bp, Artificial Sequence
  Synthetic
tactgaagtgggcagctcagctatatccaggaatcaaaacaaaaaacctgtggaaattaattagaggtaaaatga

SEQ ID NO: 195547 - DNA, 75 bp, Artificial Sequence
  Synthetic
tactgaagtgggcagctcagctatatccaggaatcaaaacaaaaaacctgtggaaattaattagaggtaatatga

SEQ ID NO: 195548 - DNA, 75 bp, Artificial Sequence
  Synthetic
tactgaagtgggcagctcagctatatccaggaatcaaaacaaaaaacctgtggaaattaattagaggtaacatga

SEQ ID NO: 195549 - DNA, 75 bp, Artificial Sequence
  Synthetic
tactgaagtgggcagctcagctatatccaggaatcaaaacaaaaaacctgtggaaattaattagaggtaagatga

SEQ ID NO: 195550 - DNA, 75 bp, Artificial Sequence
  Synthetic
ggtttatgcttgctaagatgcaatgataccaattattcaggctttgagcccaagtgtcctaaagtagtagctgct

SEQ ID NO: 195551 - DNA, 75 bp, Artificial Sequence
  Synthetic
ccttgacggaagaagtacagtggacagaattggcagaagcagaattgcaagaaaacaagattatcctaaaacagg

SEQ ID NO: 195552 - DNA, 75 bp, Artificial Sequence
  Synthetic
ccttgacggaagaagtacagtggacagaattggcagaagcagaattgcaagaaaacaagattatcctataacagg

SEQ ID NO: 195553 - DNA, 75 bp, Artificial Sequence
  Synthetic
ccttgacggaagaagtacagtggacagaattggcagaagcagaattgcaagaaaacaagattatcctacaacagg

SEQ ID NO: 195554 - DNA, 75 bp, Artificial Sequence
  Synthetic
ccttgacggaagaagtacagtggacagaattggcagaagcagaattgcaagaaaacaagattatcctagaacagg

SEQ ID NO: 195555 - DNA, 75 bp, Artificial Sequence
  Synthetic
acatgcacaagaatgatggaaacgcaaacttctacttggtttggctttaatggcactagggcagaaaatagaaca

SEQ ID NO: 195556 - DNA, 75 bp, Artificial Sequence
  Synthetic
tggcactagggcagaaaatagaacatatatctattggcatggtagagataataggactattatcagcttaaatac

SEQ ID NO: 195557 - DNA, 75 bp, Artificial Sequence
  Synthetic
aacaggaaggcgcctattacaaagaagaagagcctttagaagccactgtacagaaaaatttagacaatcagtgga

SEQ ID NO: 195558 - DNA, 75 bp, Artificial Sequence
  Synthetic
aacaggaaggcgcctattacaaagaagaagagccttttgaagccactgtacagaaaaatttagacaatcagtgga

SEQ ID NO: 195559 - DNA, 75 bp, Artificial Sequence
  Synthetic
aacaggaaggcgcctattacaaagaagaagagcctttcgaagccactgtacagaaaaatttagacaatcagtgga

SEQ ID NO: 195560 - DNA, 75 bp, Artificial Sequence
  Synthetic
aacaggaaggcgcctattacaaagaagaagagcctttggaagccactgtacagaaaaatttagacaatcagtgga

SEQ ID NO: 195561 - DNA, 75 bp, Artificial Sequence
  Synthetic
aacaggaaggcgcctattacaaagaagtagagcctttagaagccactgtacagaaaaatttagacaatcagtgga

SEQ ID NO: 195562 - DNA, 75 bp, Artificial Sequence
  Synthetic
aacaggaaggcgcctattacaaagaagtagagccttttgaagccactgtacagaaaaatttagacaatcagtgga

SEQ ID NO: 195563 - DNA, 75 bp, Artificial Sequence
  Synthetic
aacaggaaggcgcctattacaaagaagtagagcctttcgaagccactgtacagaaaaatttagacaatcagtgga

SEQ ID NO: 195564 - DNA, 75 bp, Artificial Sequence
  Synthetic
aacaggaaggcgcctattacaaagaagtagagcctttggaagccactgtacagaaaaatttagacaatcagtgga

SEQ ID NO: 195565 - DNA, 75 bp, Artificial Sequence
  Synthetic
aacaggaaggcgcctattacaaagaagcagagcctttagaagccactgtacagaaaaatttagacaatcagtgga

SEQ ID NO: 195566 - DNA, 75 bp, Artificial Sequence
  Synthetic
aacaggaaggcgcctattacaaagaagcagagccttttgaagccactgtacagaaaaatttagacaatcagtgga

SEQ ID NO: 195567 - DNA, 75 bp, Artificial Sequence
  Synthetic
aacaggaaggcgcctattacaaagaagcagagcctttcgaagccactgtacagaaaaatttagacaatcagtgga

SEQ ID NO: 195568 - DNA, 75 bp, Artificial Sequence
  Synthetic
aacaggaaggcgcctattacaaagaagcagagcctttggaagccactgtacagaaaaatttagacaatcagtgga

SEQ ID NO: 195569 - DNA, 75 bp, Artificial Sequence
  Synthetic
aacaggaaggcgcctattacaaagaaggagagcctttagaagccactgtacagaaaaatttagacaatcagtgga

SEQ ID NO: 195570 - DNA, 75 bp, Artificial Sequence
  Synthetic
aacaggaaggcgcctattacaaagaaggagagccttttgaagccactgtacagaaaaatttagacaatcagtgga

SEQ ID NO: 195571 - DNA, 75 bp, Artificial Sequence
  Synthetic
aacaggaaggcgcctattacaaagaaggagagcctttcgaagccactgtacagaaaaatttagacaatcagtgga

SEQ ID NO: 195572 - DNA, 75 bp, Artificial Sequence
  Synthetic
aacaggaaggcgcctattacaaagaaggagagcctttggaagccactgtacagaaaaatttagacaatcagtgga

SEQ ID NO: 195573 - DNA, 75 bp, Artificial Sequence
  Synthetic
atcaggaaggcgcctattacaaagaagaagagcctttagaagccactgtacagaaaaatttagacaatcagtgga

SEQ ID NO: 195574 - DNA, 75 bp, Artificial Sequence
  Synthetic
atcaggaaggcgcctattacaaagaagaagagccttttgaagccactgtacagaaaaatttagacaatcagtgga

SEQ ID NO: 195575 - DNA, 75 bp, Artificial Sequence
  Synthetic
atcaggaaggcgcctattacaaagaagaagagcctttcgaagccactgtacagaaaaatttagacaatcagtgga

SEQ ID NO: 195576 - DNA, 75 bp, Artificial Sequence
  Synthetic
atcaggaaggcgcctattacaaagaagaagagcctttggaagccactgtacagaaaaatttagacaatcagtgga

SEQ ID NO: 195577 - DNA, 75 bp, Artificial Sequence
  Synthetic
atcaggaaggcgcctattacaaagaagtagagcctttagaagccactgtacagaaaaatttagacaatcagtgga

SEQ ID NO: 195578 - DNA, 75 bp, Artificial Sequence
  Synthetic
atcaggaaggcgcctattacaaagaagtagagccttttgaagccactgtacagaaaaatttagacaatcagtgga

SEQ ID NO: 195579 - DNA, 75 bp, Artificial Sequence
  Synthetic
atcaggaaggcgcctattacaaagaagtagagcctttcgaagccactgtacagaaaaatttagacaatcagtgga

SEQ ID NO: 195580 - DNA, 75 bp, Artificial Sequence
  Synthetic
atcaggaaggcgcctattacaaagaagtagagcctttggaagccactgtacagaaaaatttagacaatcagtgga

SEQ ID NO: 195581 - DNA, 75 bp, Artificial Sequence
  Synthetic
atcaggaaggcgcctattacaaagaagcagagcctttagaagccactgtacagaaaaatttagacaatcagtgga

SEQ ID NO: 195582 - DNA, 75 bp, Artificial Sequence
  Synthetic
atcaggaaggcgcctattacaaagaagcagagccttttgaagccactgtacagaaaaatttagacaatcagtgga

SEQ ID NO: 195583 - DNA, 75 bp, Artificial Sequence
  Synthetic
atcaggaaggcgcctattacaaagaagcagagcctttcgaagccactgtacagaaaaatttagacaatcagtgga

SEQ ID NO: 195584 - DNA, 75 bp, Artificial Sequence
  Synthetic
atcaggaaggcgcctattacaaagaagcagagcctttggaagccactgtacagaaaaatttagacaatcagtgga

SEQ ID NO: 195585 - DNA, 75 bp, Artificial Sequence
  Synthetic
atcaggaaggcgcctattacaaagaaggagagcctttagaagccactgtacagaaaaatttagacaatcagtgga

SEQ ID NO: 195586 - DNA, 75 bp, Artificial Sequence
  Synthetic
atcaggaaggcgcctattacaaagaaggagagccttttgaagccactgtacagaaaaatttagacaatcagtgga

SEQ ID NO: 195587 - DNA, 75 bp, Artificial Sequence
  Synthetic
atcaggaaggcgcctattacaaagaaggagagcctttcgaagccactgtacagaaaaatttagacaatcagtgga

SEQ ID NO: 195588 - DNA, 75 bp, Artificial Sequence
  Synthetic
atcaggaaggcgcctattacaaagaaggagagcctttggaagccactgtacagaaaaatttagacaatcagtgga

SEQ ID NO: 195589 - DNA, 75 bp, Artificial Sequence
  Synthetic
accaggaaggcgcctattacaaagaagaagagcctttagaagccactgtacagaaaaatttagacaatcagtgga

SEQ ID NO: 195590 - DNA, 75 bp, Artificial Sequence
  Synthetic
accaggaaggcgcctattacaaagaagaagagccttttgaagccactgtacagaaaaatttagacaatcagtgga

SEQ ID NO: 195591 - DNA, 75 bp, Artificial Sequence
  Synthetic
accaggaaggcgcctattacaaagaagaagagcctttcgaagccactgtacagaaaaatttagacaatcagtgga

SEQ ID NO: 195592 - DNA, 75 bp, Artificial Sequence
  Synthetic
accaggaaggcgcctattacaaagaagaagagcctttggaagccactgtacagaaaaatttagacaatcagtgga

SEQ ID NO: 195593 - DNA, 75 bp, Artificial Sequence
  Synthetic
accaggaaggcgcctattacaaagaagtagagcctttagaagccactgtacagaaaaatttagacaatcagtgga

SEQ ID NO: 195594 - DNA, 75 bp, Artificial Sequence
  Synthetic
accaggaaggcgcctattacaaagaagtagagccttttgaagccactgtacagaaaaatttagacaatcagtgga

SEQ ID NO: 195595 - DNA, 75 bp, Artificial Sequence
  Synthetic
accaggaaggcgcctattacaaagaagtagagcctttcgaagccactgtacagaaaaatttagacaatcagtgga

SEQ ID NO: 195596 - DNA, 75 bp, Artificial Sequence
  Synthetic
accaggaaggcgcctattacaaagaagtagagcctttggaagccactgtacagaaaaatttagacaatcagtgga

SEQ ID NO: 195597 - DNA, 75 bp, Artificial Sequence
  Synthetic
accaggaaggcgcctattacaaagaagcagagcctttagaagccactgtacagaaaaatttagacaatcagtgga

SEQ ID NO: 195598 - DNA, 75 bp, Artificial Sequence
  Synthetic
accaggaaggcgcctattacaaagaagcagagccttttgaagccactgtacagaaaaatttagacaatcagtgga

SEQ ID NO: 195599 - DNA, 75 bp, Artificial Sequence
  Synthetic
accaggaaggcgcctattacaaagaagcagagcctttcgaagccactgtacagaaaaatttagacaatcagtgga

SEQ ID NO: 195600 - DNA, 75 bp, Artificial Sequence
  Synthetic
accaggaaggcgcctattacaaagaagcagagcctttggaagccactgtacagaaaaatttagacaatcagtgga

SEQ ID NO: 195601 - DNA, 75 bp, Artificial Sequence
  Synthetic
accaggaaggcgcctattacaaagaaggagagcctttagaagccactgtacagaaaaatttagacaatcagtgga

SEQ ID NO: 195602 - DNA, 75 bp, Artificial Sequence
  Synthetic
accaggaaggcgcctattacaaagaaggagagccttttgaagccactgtacagaaaaatttagacaatcagtgga

SEQ ID NO: 195603 - DNA, 75 bp, Artificial Sequence
  Synthetic
accaggaaggcgcctattacaaagaaggagagcctttcgaagccactgtacagaaaaatttagacaatcagtgga

SEQ ID NO: 195604 - DNA, 75 bp, Artificial Sequence
  Synthetic
accaggaaggcgcctattacaaagaaggagagcctttggaagccactgtacagaaaaatttagacaatcagtgga

SEQ ID NO: 195605 - DNA, 75 bp, Artificial Sequence
  Synthetic
agcaggaaggcgcctattacaaagaagaagagcctttagaagccactgtacagaaaaatttagacaatcagtgga

SEQ ID NO: 195606 - DNA, 75 bp, Artificial Sequence
  Synthetic
agcaggaaggcgcctattacaaagaagaagagccttttgaagccactgtacagaaaaatttagacaatcagtgga

SEQ ID NO: 195607 - DNA, 75 bp, Artificial Sequence
  Synthetic
agcaggaaggcgcctattacaaagaagaagagcctttcgaagccactgtacagaaaaatttagacaatcagtgga

SEQ ID NO: 195608 - DNA, 75 bp, Artificial Sequence
  Synthetic
agcaggaaggcgcctattacaaagaagaagagcctttggaagccactgtacagaaaaatttagacaatcagtgga

SEQ ID NO: 195609 - DNA, 75 bp, Artificial Sequence
  Synthetic
agcaggaaggcgcctattacaaagaagtagagcctttagaagccactgtacagaaaaatttagacaatcagtgga

SEQ ID NO: 195610 - DNA, 75 bp, Artificial Sequence
  Synthetic
agcaggaaggcgcctattacaaagaagtagagccttttgaagccactgtacagaaaaatttagacaatcagtgga

SEQ ID NO: 195611 - DNA, 75 bp, Artificial Sequence
  Synthetic
agcaggaaggcgcctattacaaagaagtagagcctttcgaagccactgtacagaaaaatttagacaatcagtgga

SEQ ID NO: 195612 - DNA, 75 bp, Artificial Sequence
  Synthetic
agcaggaaggcgcctattacaaagaagtagagcctttggaagccactgtacagaaaaatttagacaatcagtgga

SEQ ID NO: 195613 - DNA, 75 bp, Artificial Sequence
  Synthetic
agcaggaaggcgcctattacaaagaagcagagcctttagaagccactgtacagaaaaatttagacaatcagtgga

SEQ ID NO: 195614 - DNA, 75 bp, Artificial Sequence
  Synthetic
agcaggaaggcgcctattacaaagaagcagagccttttgaagccactgtacagaaaaatttagacaatcagtgga

SEQ ID NO: 195615 - DNA, 75 bp, Artificial Sequence
  Synthetic
agcaggaaggcgcctattacaaagaagcagagcctttcgaagccactgtacagaaaaatttagacaatcagtgga

SEQ ID NO: 195616 - DNA, 75 bp, Artificial Sequence
  Synthetic
agcaggaaggcgcctattacaaagaagcagagcctttggaagccactgtacagaaaaatttagacaatcagtgga

SEQ ID NO: 195617 - DNA, 75 bp, Artificial Sequence
  Synthetic
agcaggaaggcgcctattacaaagaaggagagcctttagaagccactgtacagaaaaatttagacaatcagtgga

SEQ ID NO: 195618 - DNA, 75 bp, Artificial Sequence
  Synthetic
agcaggaaggcgcctattacaaagaaggagagccttttgaagccactgtacagaaaaatttagacaatcagtgga

SEQ ID NO: 195619 - DNA, 75 bp, Artificial Sequence
  Synthetic
agcaggaaggcgcctattacaaagaaggagagcctttcgaagccactgtacagaaaaatttagacaatcagtgga

SEQ ID NO: 195620 - DNA, 75 bp, Artificial Sequence
  Synthetic
agcaggaaggcgcctattacaaagaaggagagcctttggaagccactgtacagaaaaatttagacaatcagtgga

SEQ ID NO: 195621 - DNA, 75 bp, Artificial Sequence
  Synthetic
acattataatctcacaatgcattgtaagaggccaggaaataagtcagttttgccaataacacttaggtcagggag

SEQ ID NO: 195622 - DNA, 75 bp, Artificial Sequence
  Synthetic
catacaaagttcatcaaggaaacagaatcctaaaagtaggtaaatatgcaaagataaaaaatacccatacaaatg

SEQ ID NO: 195623 - DNA, 75 bp, Artificial Sequence
  Synthetic
agtgtttcactcccgaccgatcatcaatgaaagacccaagcaggcatggtgctggttcggaggtgattggaagaa

SEQ ID NO: 195624 - DNA, 75 bp, Artificial Sequence
  Synthetic
gagtaagattattggctcatgtggtccaaaaaataggaaaggaagcactagtaatatggggaaaattacccttct

SEQ ID NO: 195625 - DNA, 75 bp, Artificial Sequence
  Synthetic
gagtaagattattggctcatgtggtccaaaatataggaaaggaagcactagtaatatggggaaaattacccttct

SEQ ID NO: 195626 - DNA, 75 bp, Artificial Sequence
  Synthetic
gagtaagattattggctcatgtggtccaaaacataggaaaggaagcactagtaatatggggaaaattacccttct

SEQ ID NO: 195627 - DNA, 75 bp, Artificial Sequence
  Synthetic
gagtaagattattggctcatgtggtccaaaagataggaaaggaagcactagtaatatggggaaaattacccttct

SEQ ID NO: 195628 - DNA, 75 bp, Artificial Sequence
  Synthetic
agccatgcaggaggtgaaacaaacccttgtgaaacatcccaggtatagaggaaccaacgacacacagaaaattaa

SEQ ID NO: 195629 - DNA, 75 bp, Artificial Sequence
  Synthetic
ttcatctgccagtagaaagggacacctgggaacaatggtggacagactattggcaagtaacttggatcccagatt

SEQ ID NO: 195630 - DNA, 75 bp, Artificial Sequence
  Synthetic
gaaccaacgacacacagaaaattaactttacacaaccaggaaaaggttcagatgcagaagtggtatacatgtgga

SEQ ID NO: 195631 - DNA, 75 bp, Artificial Sequence
  Synthetic
gggactttgtgtctacaccgcatctagtaaggttagtctacaacctagtcaaagaacctctagagcagacagaga

SEQ ID NO: 195632 - DNA, 75 bp, Artificial Sequence
  Synthetic
ctaactgcagaggagaatttctatactgcaacatgactcggttcctcaattggatagaaaacagggcacacccac

SEQ ID NO: 195633 - DNA, 75 bp, Artificial Sequence
  Synthetic
cctattatacagacgggtcctgcaataaaacctccaaggaaggaaaagcaggctacgtcacagacagaggaaaag

SEQ ID NO: 195634 - DNA, 75 bp, Artificial Sequence
  Synthetic
cctattatacagacgggtcctgcaataaaacctccaaggatggaaaagcaggctacgtcacagacagaggaaaag

SEQ ID NO: 195635 - DNA, 75 bp, Artificial Sequence
  Synthetic
cctattatacagacgggtcctgcaataaaacctccaaggacggaaaagcaggctacgtcacagacagaggaaaag

SEQ ID NO: 195636 - DNA, 75 bp, Artificial Sequence
  Synthetic
cctattatacagacgggtcctgcaataaaacctccaaggagggaaaagcaggctacgtcacagacagaggaaaag

SEQ ID NO: 195637 - DNA, 75 bp, Artificial Sequence
  Synthetic
agcgcaattatgcaccgtgccatataaggcaaataattaatacctggcatagagtaggccaaaatatatatttgc

SEQ ID NO: 195638 - DNA, 75 bp, Artificial Sequence
  Synthetic
acaaggtaaaagtcttagagcagacaacaaaccagcaggcagaacttgaggcatttgcaatggccttgcaggact

SEQ ID NO: 195639 - DNA, 75 bp, Artificial Sequence
  Synthetic
acaaggtaaaagtcttagagcagacaacaaaccagcaggctgaacttgaggcatttgcaatggccttgcaggact

SEQ ID NO: 195640 - DNA, 75 bp, Artificial Sequence
  Synthetic
acaaggtaaaagtcttagagcagacaacaaaccagcaggccgaacttgaggcatttgcaatggccttgcaggact

SEQ ID NO: 195641 - DNA, 75 bp, Artificial Sequence
  Synthetic
acaaggtaaaagtcttagagcagacaacaaaccagcaggcggaacttgaggcatttgcaatggccttgcaggact

SEQ ID NO: 195642 - DNA, 75 bp, Artificial Sequence
  Synthetic
acaaggtaaatgtcttagagcagacaacaaaccagcaggcagaacttgaggcatttgcaatggccttgcaggact

SEQ ID NO: 195643 - DNA, 75 bp, Artificial Sequence
  Synthetic
acaaggtaaatgtcttagagcagacaacaaaccagcaggctgaacttgaggcatttgcaatggccttgcaggact

SEQ ID NO: 195644 - DNA, 75 bp, Artificial Sequence
  Synthetic
acaaggtaaatgtcttagagcagacaacaaaccagcaggccgaacttgaggcatttgcaatggccttgcaggact

SEQ ID NO: 195645 - DNA, 75 bp, Artificial Sequence
  Synthetic
acaaggtaaatgtcttagagcagacaacaaaccagcaggcggaacttgaggcatttgcaatggccttgcaggact

SEQ ID NO: 195646 - DNA, 75 bp, Artificial Sequence
  Synthetic
acaaggtaaacgtcttagagcagacaacaaaccagcaggcagaacttgaggcatttgcaatggccttgcaggact

SEQ ID NO: 195647 - DNA, 75 bp, Artificial Sequence
  Synthetic
acaaggtaaacgtcttagagcagacaacaaaccagcaggctgaacttgaggcatttgcaatggccttgcaggact

SEQ ID NO: 195648 - DNA, 75 bp, Artificial Sequence
  Synthetic
acaaggtaaacgtcttagagcagacaacaaaccagcaggccgaacttgaggcatttgcaatggccttgcaggact

SEQ ID NO: 195649 - DNA, 75 bp, Artificial Sequence
  Synthetic
acaaggtaaacgtcttagagcagacaacaaaccagcaggcggaacttgaggcatttgcaatggccttgcaggact

SEQ ID NO: 195650 - DNA, 75 bp, Artificial Sequence
  Synthetic
acaaggtaaaggtcttagagcagacaacaaaccagcaggcagaacttgaggcatttgcaatggccttgcaggact

SEQ ID NO: 195651 - DNA, 75 bp, Artificial Sequence
  Synthetic
acaaggtaaaggtcttagagcagacaacaaaccagcaggctgaacttgaggcatttgcaatggccttgcaggact

SEQ ID NO: 195652 - DNA, 75 bp, Artificial Sequence
  Synthetic
acaaggtaaaggtcttagagcagacaacaaaccagcaggccgaacttgaggcatttgcaatggccttgcaggact

SEQ ID NO: 195653 - DNA, 75 bp, Artificial Sequence
  Synthetic
acaaggtaaaggtcttagagcagacaacaaaccagcaggcggaacttgaggcatttgcaatggccttgcaggact

SEQ ID NO: 195654 - DNA, 75 bp, Artificial Sequence
  Synthetic
ctcctagggaaggggaattggtctgcaactcaacagtaaccagcataattgctaacattgacatgtttgataacc

SEQ ID NO: 195655 - DNA, 75 bp, Artificial Sequence
  Synthetic
caactcaacagtaaccagcataattgctaacattgacatgtttgataaccagacaagcattacctttagtgcaga

SEQ ID NO: 195656 - DNA, 75 bp, Artificial Sequence
  Synthetic
caggtccaaaagtcaatatcatagtagattcccagtatgtcatgggaatcatagcaggacaaccaacggaaacag

SEQ ID NO: 195657 - DNA, 75 bp, Artificial Sequence
  Synthetic
caggtccaaaagtcaatatcatagtagattcccagtatgtcatgggaatcatagcaggtcaaccaacggaaacag

SEQ ID NO: 195658 - DNA, 75 bp, Artificial Sequence
  Synthetic
caggtccaaaagtcaatatcatagtagattcccagtatgtcatgggaatcatagcaggccaaccaacggaaacag

SEQ ID NO: 195659 - DNA, 75 bp, Artificial Sequence
  Synthetic
caggtccaaaagtcaatatcatagtagattcccagtatgtcatgggaatcatagcagggcaaccaacggaaacag

SEQ ID NO: 195660 - DNA, 75 bp, Artificial Sequence
  Synthetic
caggtccaaaagtcaatatcatagtagattcccagtatgtcatgggtatcatagcaggacaaccaacggaaacag

SEQ ID NO: 195661 - DNA, 75 bp, Artificial Sequence
  Synthetic
caggtccaaaagtcaatatcatagtagattcccagtatgtcatgggtatcatagcaggtcaaccaacggaaacag

SEQ ID NO: 195662 - DNA, 75 bp, Artificial Sequence
  Synthetic
caggtccaaaagtcaatatcatagtagattcccagtatgtcatgggtatcatagcaggccaaccaacggaaacag

SEQ ID NO: 195663 - DNA, 75 bp, Artificial Sequence
  Synthetic
caggtccaaaagtcaatatcatagtagattcccagtatgtcatgggtatcatagcagggcaaccaacggaaacag

SEQ ID NO: 195664 - DNA, 75 bp, Artificial Sequence
  Synthetic
caggtccaaaagtcaatatcatagtagattcccagtatgtcatgggcatcatagcaggacaaccaacggaaacag

SEQ ID NO: 195665 - DNA, 75 bp, Artificial Sequence
  Synthetic
caggtccaaaagtcaatatcatagtagattcccagtatgtcatgggcatcatagcaggtcaaccaacggaaacag

SEQ ID NO: 195666 - DNA, 75 bp, Artificial Sequence
  Synthetic
caggtccaaaagtcaatatcatagtagattcccagtatgtcatgggcatcatagcaggccaaccaacggaaacag

SEQ ID NO: 195667 - DNA, 75 bp, Artificial Sequence
  Synthetic
caggtccaaaagtcaatatcatagtagattcccagtatgtcatgggcatcatagcagggcaaccaacggaaacag

SEQ ID NO: 195668 - DNA, 75 bp, Artificial Sequence
  Synthetic
caggtccaaaagtcaatatcatagtagattcccagtatgtcatggggatcatagcaggacaaccaacggaaacag

SEQ ID NO: 195669 - DNA, 75 bp, Artificial Sequence
  Synthetic
caggtccaaaagtcaatatcatagtagattcccagtatgtcatggggatcatagcaggtcaaccaacggaaacag

SEQ ID NO: 195670 - DNA, 75 bp, Artificial Sequence
  Synthetic
caggtccaaaagtcaatatcatagtagattcccagtatgtcatggggatcatagcaggccaaccaacggaaacag

SEQ ID NO: 195671 - DNA, 75 bp, Artificial Sequence
  Synthetic
caggtccaaaagtcaatatcatagtagattcccagtatgtcatggggatcatagcagggcaaccaacggaaacag

SEQ ID NO: 195672 - DNA, 75 bp, Artificial Sequence
  Synthetic
caggtccaaaagtcaatatcatagttgattcccagtatgtcatgggaatcatagcaggacaaccaacggaaacag

SEQ ID NO: 195673 - DNA, 75 bp, Artificial Sequence
  Synthetic
caggtccaaaagtcaatatcatagttgattcccagtatgtcatgggaatcatagcaggtcaaccaacggaaacag

SEQ ID NO: 195674 - DNA, 75 bp, Artificial Sequence
  Synthetic
caggtccaaaagtcaatatcatagttgattcccagtatgtcatgggaatcatagcaggccaaccaacggaaacag

SEQ ID NO: 195675 - DNA, 75 bp, Artificial Sequence
  Synthetic
caggtccaaaagtcaatatcatagttgattcccagtatgtcatgggaatcatagcagggcaaccaacggaaacag

SEQ ID NO: 195676 - DNA, 75 bp, Artificial Sequence
  Synthetic
caggtccaaaagtcaatatcatagttgattcccagtatgtcatgggtatcatagcaggacaaccaacggaaacag

SEQ ID NO: 195677 - DNA, 75 bp, Artificial Sequence
  Synthetic
caggtccaaaagtcaatatcatagttgattcccagtatgtcatgggtatcatagcaggtcaaccaacggaaacag

SEQ ID NO: 195678 - DNA, 75 bp, Artificial Sequence
  Synthetic
caggtccaaaagtcaatatcatagttgattcccagtatgtcatgggtatcatagcaggccaaccaacggaaacag

SEQ ID NO: 195679 - DNA, 75 bp, Artificial Sequence
  Synthetic
caggtccaaaagtcaatatcatagttgattcccagtatgtcatgggtatcatagcagggcaaccaacggaaacag

SEQ ID NO: 195680 - DNA, 75 bp, Artificial Sequence
  Synthetic
caggtccaaaagtcaatatcatagttgattcccagtatgtcatgggcatcatagcaggacaaccaacggaaacag

SEQ ID NO: 195681 - DNA, 75 bp, Artificial Sequence
  Synthetic
caggtccaaaagtcaatatcatagttgattcccagtatgtcatgggcatcatagcaggtcaaccaacggaaacag

SEQ ID NO: 195682 - DNA, 75 bp, Artificial Sequence
  Synthetic
caggtccaaaagtcaatatcatagttgattcccagtatgtcatgggcatcatagcaggccaaccaacggaaacag

SEQ ID NO: 195683 - DNA, 75 bp, Artificial Sequence
  Synthetic
caggtccaaaagtcaatatcatagttgattcccagtatgtcatgggcatcatagcagggcaaccaacggaaacag

SEQ ID NO: 195684 - DNA, 75 bp, Artificial Sequence
  Synthetic
caggtccaaaagtcaatatcatagttgattcccagtatgtcatggggatcatagcaggacaaccaacggaaacag

SEQ ID NO: 195685 - DNA, 75 bp, Artificial Sequence
  Synthetic
caggtccaaaagtcaatatcatagttgattcccagtatgtcatggggatcatagcaggtcaaccaacggaaacag

SEQ ID NO: 195686 - DNA, 75 bp, Artificial Sequence
  Synthetic
caggtccaaaagtcaatatcatagttgattcccagtatgtcatggggatcatagcaggccaaccaacggaaacag

SEQ ID NO: 195687 - DNA, 75 bp, Artificial Sequence
  Synthetic
caggtccaaaagtcaatatcatagttgattcccagtatgtcatggggatcatagcagggcaaccaacggaaacag

SEQ ID NO: 195688 - DNA, 75 bp, Artificial Sequence
  Synthetic
caggtccaaaagtcaatatcatagtcgattcccagtatgtcatgggaatcatagcaggacaaccaacggaaacag

SEQ ID NO: 195689 - DNA, 75 bp, Artificial Sequence
  Synthetic
caggtccaaaagtcaatatcatagtcgattcccagtatgtcatgggaatcatagcaggtcaaccaacggaaacag

SEQ ID NO: 195690 - DNA, 75 bp, Artificial Sequence
  Synthetic
caggtccaaaagtcaatatcatagtcgattcccagtatgtcatgggaatcatagcaggccaaccaacggaaacag

SEQ ID NO: 195691 - DNA, 75 bp, Artificial Sequence
  Synthetic
caggtccaaaagtcaatatcatagtcgattcccagtatgtcatgggaatcatagcagggcaaccaacggaaacag

SEQ ID NO: 195692 - DNA, 75 bp, Artificial Sequence
  Synthetic
caggtccaaaagtcaatatcatagtcgattcccagtatgtcatgggtatcatagcaggacaaccaacggaaacag

SEQ ID NO: 195693 - DNA, 75 bp, Artificial Sequence
  Synthetic
caggtccaaaagtcaatatcatagtcgattcccagtatgtcatgggtatcatagcaggtcaaccaacggaaacag

SEQ ID NO: 195694 - DNA, 75 bp, Artificial Sequence
  Synthetic
caggtccaaaagtcaatatcatagtcgattcccagtatgtcatgggtatcatagcaggccaaccaacggaaacag

SEQ ID NO: 195695 - DNA, 75 bp, Artificial Sequence
  Synthetic
caggtccaaaagtcaatatcatagtcgattcccagtatgtcatgggtatcatagcagggcaaccaacggaaacag

SEQ ID NO: 195696 - DNA, 75 bp, Artificial Sequence
  Synthetic
caggtccaaaagtcaatatcatagtcgattcccagtatgtcatgggcatcatagcaggacaaccaacggaaacag

SEQ ID NO: 195697 - DNA, 75 bp, Artificial Sequence
  Synthetic
caggtccaaaagtcaatatcatagtcgattcccagtatgtcatgggcatcatagcaggtcaaccaacggaaacag

SEQ ID NO: 195698 - DNA, 75 bp, Artificial Sequence
  Synthetic
caggtccaaaagtcaatatcatagtcgattcccagtatgtcatgggcatcatagcaggccaaccaacggaaacag

SEQ ID NO: 195699 - DNA, 75 bp, Artificial Sequence
  Synthetic
caggtccaaaagtcaatatcatagtcgattcccagtatgtcatgggcatcatagcagggcaaccaacggaaacag

SEQ ID NO: 195700 - DNA, 75 bp, Artificial Sequence
  Synthetic
caggtccaaaagtcaatatcatagtcgattcccagtatgtcatggggatcatagcaggacaaccaacggaaacag

SEQ ID NO: 195701 - DNA, 75 bp, Artificial Sequence
  Synthetic
caggtccaaaagtcaatatcatagtcgattcccagtatgtcatggggatcatagcaggtcaaccaacggaaacag

SEQ ID NO: 195702 - DNA, 75 bp, Artificial Sequence
  Synthetic
caggtccaaaagtcaatatcatagtcgattcccagtatgtcatggggatcatagcaggccaaccaacggaaacag

SEQ ID NO: 195703 - DNA, 75 bp, Artificial Sequence
  Synthetic
caggtccaaaagtcaatatcatagtcgattcccagtatgtcatggggatcatagcagggcaaccaacggaaacag

SEQ ID NO: 195704 - DNA, 75 bp, Artificial Sequence
  Synthetic
caggtccaaaagtcaatatcatagtggattcccagtatgtcatgggaatcatagcaggacaaccaacggaaacag

SEQ ID NO: 195705 - DNA, 75 bp, Artificial Sequence
  Synthetic
caggtccaaaagtcaatatcatagtggattcccagtatgtcatgggaatcatagcaggtcaaccaacggaaacag

SEQ ID NO: 195706 - DNA, 75 bp, Artificial Sequence
  Synthetic
caggtccaaaagtcaatatcatagtggattcccagtatgtcatgggaatcatagcaggccaaccaacggaaacag

SEQ ID NO: 195707 - DNA, 75 bp, Artificial Sequence
  Synthetic
caggtccaaaagtcaatatcatagtggattcccagtatgtcatgggaatcatagcagggcaaccaacggaaacag

SEQ ID NO: 195708 - DNA, 75 bp, Artificial Sequence
  Synthetic
caggtccaaaagtcaatatcatagtggattcccagtatgtcatgggtatcatagcaggacaaccaacggaaacag

SEQ ID NO: 195709 - DNA, 75 bp, Artificial Sequence
  Synthetic
caggtccaaaagtcaatatcatagtggattcccagtatgtcatgggtatcatagcaggtcaaccaacggaaacag

SEQ ID NO: 195710 - DNA, 75 bp, Artificial Sequence
  Synthetic
caggtccaaaagtcaatatcatagtggattcccagtatgtcatgggtatcatagcaggccaaccaacggaaacag

SEQ ID NO: 195711 - DNA, 75 bp, Artificial Sequence
  Synthetic
caggtccaaaagtcaatatcatagtggattcccagtatgtcatgggtatcatagcagggcaaccaacggaaacag

SEQ ID NO: 195712 - DNA, 75 bp, Artificial Sequence
  Synthetic
caggtccaaaagtcaatatcatagtggattcccagtatgtcatgggcatcatagcaggacaaccaacggaaacag

SEQ ID NO: 195713 - DNA, 75 bp, Artificial Sequence
  Synthetic
caggtccaaaagtcaatatcatagtggattcccagtatgtcatgggcatcatagcaggtcaaccaacggaaacag

SEQ ID NO: 195714 - DNA, 75 bp, Artificial Sequence
  Synthetic
caggtccaaaagtcaatatcatagtggattcccagtatgtcatgggcatcatagcaggccaaccaacggaaacag

SEQ ID NO: 195715 - DNA, 75 bp, Artificial Sequence
  Synthetic
caggtccaaaagtcaatatcatagtggattcccagtatgtcatgggcatcatagcagggcaaccaacggaaacag

SEQ ID NO: 195716 - DNA, 75 bp, Artificial Sequence
  Synthetic
caggtccaaaagtcaatatcatagtggattcccagtatgtcatggggatcatagcaggacaaccaacggaaacag

SEQ ID NO: 195717 - DNA, 75 bp, Artificial Sequence
  Synthetic
caggtccaaaagtcaatatcatagtggattcccagtatgtcatggggatcatagcaggtcaaccaacggaaacag

SEQ ID NO: 195718 - DNA, 75 bp, Artificial Sequence
  Synthetic
caggtccaaaagtcaatatcatagtggattcccagtatgtcatggggatcatagcaggccaaccaacggaaacag

SEQ ID NO: 195719 - DNA, 75 bp, Artificial Sequence
  Synthetic
caggtccaaaagtcaatatcatagtggattcccagtatgtcatggggatcatagcagggcaaccaacggaaacag

SEQ ID NO: 195720 - DNA, 75 bp, Artificial Sequence
  Synthetic
aatccccgttagtaaataaaataattgaagaaataattaaaaaagaaactctatatgtaggatgggtaccagctc

SEQ ID NO: 195721 - DNA, 75 bp, Artificial Sequence
  Synthetic
aatccccgttagtaaataaaataattgaagaaataattaaaaaagaatctctatatgtaggatgggtaccagctc

SEQ ID NO: 195722 - DNA, 75 bp, Artificial Sequence
  Synthetic
aatccccgttagtaaataaaataattgaagaaataattaaaaaagaacctctatatgtaggatgggtaccagctc

SEQ ID NO: 195723 - DNA, 75 bp, Artificial Sequence
  Synthetic
aatccccgttagtaaataaaataattgaagaaataattaaaaaagaagctctatatgtaggatgggtaccagctc

SEQ ID NO: 195724 - DNA, 75 bp, Artificial Sequence
  Synthetic
aatccccgttagtaaataaaataattgaagaaattattaaaaaagaaactctatatgtaggatgggtaccagctc

SEQ ID NO: 195725 - DNA, 75 bp, Artificial Sequence
  Synthetic
aatccccgttagtaaataaaataattgaagaaattattaaaaaagaatctctatatgtaggatgggtaccagctc

SEQ ID NO: 195726 - DNA, 75 bp, Artificial Sequence
  Synthetic
aatccccgttagtaaataaaataattgaagaaattattaaaaaagaacctctatatgtaggatgggtaccagctc

SEQ ID NO: 195727 - DNA, 75 bp, Artificial Sequence
  Synthetic
aatccccgttagtaaataaaataattgaagaaattattaaaaaagaagctctatatgtaggatgggtaccagctc

SEQ ID NO: 195728 - DNA, 75 bp, Artificial Sequence
  Synthetic
aatccccgttagtaaataaaataattgaagaaatcattaaaaaagaaactctatatgtaggatgggtaccagctc

SEQ ID NO: 195729 - DNA, 75 bp, Artificial Sequence
  Synthetic
aatccccgttagtaaataaaataattgaagaaatcattaaaaaagaatctctatatgtaggatgggtaccagctc

SEQ ID NO: 195730 - DNA, 75 bp, Artificial Sequence
  Synthetic
aatccccgttagtaaataaaataattgaagaaatcattaaaaaagaacctctatatgtaggatgggtaccagctc

SEQ ID NO: 195731 - DNA, 75 bp, Artificial Sequence
  Synthetic
aatccccgttagtaaataaaataattgaagaaatcattaaaaaagaagctctatatgtaggatgggtaccagctc

SEQ ID NO: 195732 - DNA, 75 bp, Artificial Sequence
  Synthetic
aatccccgttagtaaataaaataattgaagaaatgattaaaaaagaaactctatatgtaggatgggtaccagctc

SEQ ID NO: 195733 - DNA, 75 bp, Artificial Sequence
  Synthetic
aatccccgttagtaaataaaataattgaagaaatgattaaaaaagaatctctatatgtaggatgggtaccagctc

SEQ ID NO: 195734 - DNA, 75 bp, Artificial Sequence
  Synthetic
aatccccgttagtaaataaaataattgaagaaatgattaaaaaagaacctctatatgtaggatgggtaccagctc

SEQ ID NO: 195735 - DNA, 75 bp, Artificial Sequence
  Synthetic
aatccccgttagtaaataaaataattgaagaaatgattaaaaaagaagctctatatgtaggatgggtaccagctc

SEQ ID NO: 195736 - DNA, 75 bp, Artificial Sequence
  Synthetic
ttgggagattacaaattagtagaaataacaccaattggcttcgcacctacatcagaaaaaaggtattcctctgct

SEQ ID NO: 195737 - DNA, 75 bp, Artificial Sequence
  Synthetic
ccacagaggaataaaagaggtgtgtttgtgctaggagtcttgggttttctcgcaacagcaggttctgcaatgggc

SEQ ID NO: 195738 - DNA, 75 bp, Artificial Sequence
  Synthetic
ataaaggaataggaggtaatcaagaggtagaccatctagtaagccagggaattagacaagtactattcttgaaaa

SEQ ID NO: 195739 - DNA, 75 bp, Artificial Sequence
  Synthetic
ataaaggaataggaggtaatcaagaggtagaccatctagtaagccagggaattagacaagtactattcttgtaaa

SEQ ID NO: 195740 - DNA, 75 bp, Artificial Sequence
  Synthetic
ataaaggaataggaggtaatcaagaggtagaccatctagtaagccagggaattagacaagtactattcttgcaaa

SEQ ID NO: 195741 - DNA, 75 bp, Artificial Sequence
  Synthetic
ataaaggaataggaggtaatcaagaggtagaccatctagtaagccagggaattagacaagtactattcttggaaa

SEQ ID NO: 195742 - DNA, 75 bp, Artificial Sequence
  Synthetic
ataaaggaataggaggtaatcaagaggtagaccttctagtaagccagggaattagacaagtactattcttgaaaa

SEQ ID NO: 195743 - DNA, 75 bp, Artificial Sequence
  Synthetic
ataaaggaataggaggtaatcaagaggtagaccttctagtaagccagggaattagacaagtactattcttgtaaa

SEQ ID NO: 195744 - DNA, 75 bp, Artificial Sequence
  Synthetic
ataaaggaataggaggtaatcaagaggtagaccttctagtaagccagggaattagacaagtactattcttgcaaa

SEQ ID NO: 195745 - DNA, 75 bp, Artificial Sequence
  Synthetic
ataaaggaataggaggtaatcaagaggtagaccttctagtaagccagggaattagacaagtactattcttggaaa

SEQ ID NO: 195746 - DNA, 75 bp, Artificial Sequence
  Synthetic
ataaaggaataggaggtaatcaagaggtagaccctctagtaagccagggaattagacaagtactattcttgaaaa

SEQ ID NO: 195747 - DNA, 75 bp, Artificial Sequence
  Synthetic
ataaaggaataggaggtaatcaagaggtagaccctctagtaagccagggaattagacaagtactattcttgtaaa

SEQ ID NO: 195748 - DNA, 75 bp, Artificial Sequence
  Synthetic
ataaaggaataggaggtaatcaagaggtagaccctctagtaagccagggaattagacaagtactattcttgcaaa

SEQ ID NO: 195749 - DNA, 75 bp, Artificial Sequence
  Synthetic
ataaaggaataggaggtaatcaagaggtagaccctctagtaagccagggaattagacaagtactattcttggaaa

SEQ ID NO: 195750 - DNA, 75 bp, Artificial Sequence
  Synthetic
ataaaggaataggaggtaatcaagaggtagaccgtctagtaagccagggaattagacaagtactattcttgaaaa

SEQ ID NO: 195751 - DNA, 75 bp, Artificial Sequence
  Synthetic
ataaaggaataggaggtaatcaagaggtagaccgtctagtaagccagggaattagacaagtactattcttgtaaa

SEQ ID NO: 195752 - DNA, 75 bp, Artificial Sequence
  Synthetic
ataaaggaataggaggtaatcaagaggtagaccgtctagtaagccagggaattagacaagtactattcttgcaaa

SEQ ID NO: 195753 - DNA, 75 bp, Artificial Sequence
  Synthetic
ataaaggaataggaggtaatcaagaggtagaccgtctagtaagccagggaattagacaagtactattcttggaaa

SEQ ID NO: 195754 - DNA, 75 bp, Artificial Sequence
  Synthetic
cgcaacagcaggttctgcaatgggcgcggcgtccttgacgctgtcggctcatcccggactttactgggctgggat

SEQ ID NO: 195755 - DNA, 75 bp, Artificial Sequence
  Synthetic
aaatagaacctgctcaagaagaacatgaaaaatttcatagtaatgtaaaagagttaactcataagtttggcattc

SEQ ID NO: 195756 - DNA, 75 bp, Artificial Sequence
  Synthetic
aaatagaacctgctcaagaagaacatgaaaattttcatagtaatgtaaaagagttaactcataagtttggcattc

SEQ ID NO: 195757 - DNA, 75 bp, Artificial Sequence
  Synthetic
aaatagaacctgctcaagaagaacatgaaaactttcatagtaatgtaaaagagttaactcataagtttggcattc

SEQ ID NO: 195758 - DNA, 75 bp, Artificial Sequence
  Synthetic
aaatagaacctgctcaagaagaacatgaaaagtttcatagtaatgtaaaagagttaactcataagtttggcattc

SEQ ID NO: 195759 - DNA, 75 bp, Artificial Sequence
  Synthetic
gacgtggtcaagagacaacaagaaatgttgcgactgaccgtctggggaacaaaaaatctccagacaagagtcact

SEQ ID NO: 195760 - DNA, 75 bp, Artificial Sequence
  Synthetic
ctcaattagtagcaaaacagatagtaaattcataccacagttgccaacagaaaggagaagccattcatggacagg

SEQ ID NO: 195761 - DNA, 75 bp, Artificial Sequence
  Synthetic
aaaaaatctccagacaagagtcactgctatcgagaaatacctaagggaccaggcgcggctaaattcatggggatg

SEQ ID NO: 195762 - DNA, 75 bp, Artificial Sequence
  Synthetic
taaatgcagaattgggtacttggcaaatggactgcacccatttagaaggaaaagtaatcatagtagcagttcatg

SEQ ID NO: 195763 - DNA, 75 bp, Artificial Sequence
  Synthetic
tgcatttagacaagtctgctacaccactgtactatgggaaaataacagcatagtacctgattggaacaacatgac

SEQ ID NO: 195764 - DNA, 75 bp, Artificial Sequence
  Synthetic
tggccagtggctttgtagaagcagaagtaatcccacaagaaacaggaaggcaaacagcattattcctgttaaaat

SEQ ID NO: 195765 - DNA, 75 bp, Artificial Sequence
  Synthetic
gtggcaggaatgggaacaacaaacccgcgacctagaggcaaatatcagtagatcgttagagcaggcacaaatcca

SEQ ID NO: 195766 - DNA, 75 bp, Artificial Sequence
  Synthetic
tagcagggagatggcctatcacacacctacatacagacaatggtgccaacttcacctcgcaagaggtgaagatgg

SEQ ID NO: 195767 - DNA, 75 bp, Artificial Sequence
  Synthetic
cgcgacctagaggcaaatatcagtagatcgttagagcaggcacaaatccaacaagagaaaaatatgtatgagcta

SEQ ID NO: 195768 - DNA, 75 bp, Artificial Sequence
  Synthetic
caaaaattaaatagctgggatgtttttggcaactggtttgatttaacctcctggattaagtatattcagtatgga

SEQ ID NO: 195769 - DNA, 75 bp, Artificial Sequence
  Synthetic
tagcctggtgggtaggcatcgagcaagcatttggagtaccatacaacccccagagtcaaggggtagtagaatcaa

SEQ ID NO: 195770 - DNA, 75 bp, Artificial Sequence
  Synthetic
ctggattaagtatattcagtatggagtttatgtaataataggaataatagctttaagaatagtaatatatgtagt

SEQ ID NO: 195771 - DNA, 75 bp, Artificial Sequence
  Synthetic
tgaatcatcatctaaagaaacaaatagataaaattagagatcaagcaaattcaatagaaaccatagtgttaatgg

SEQ ID NO: 195772 - DNA, 75 bp, Artificial Sequence
  Synthetic
gacagagaagaaacagacgaagacgccggaaacagcattggagacagctcgtggccttggccaatagcatatata

SEQ ID NO: 195773 - DNA, 75 bp, Artificial Sequence
  Synthetic
ttactacagaacaagaaatacaatttcaacaaacaaaaaattcaaaatttaaaaattttcgggtctattacagag

SEQ ID NO: 195774 - DNA, 75 bp, Artificial Sequence
  Synthetic
catttcctgatccgccagctgattcgcctcttgaccgggctatacagcgtctgcaaggacttactatccaggagc

SEQ ID NO: 195775 - DNA, 75 bp, Artificial Sequence
  Synthetic
aaggcagagaccagctctggaaaggacctggtgagcttttgtggaaaggggaaggagctgtcatcataaaggtag

SEQ ID NO: 195776 - DNA, 75 bp, Artificial Sequence
  Synthetic
ttcccgaccctccaactaatcttccagagtcttcagagagcactaacaacaatcagggactggctgagacttaca

SEQ ID NO: 195777 - DNA, 75 bp, Artificial Sequence
  Synthetic
ggacagaaatcaaagttgtacccagaagaaaagcaaaaatcataaaagattatggaggaggaaaagaggtggata

SEQ ID NO: 195778 - DNA, 75 bp, Artificial Sequence
  Synthetic
atagcctacctgcaatatgggtgcgagtggatccaagaagtgctccaggtccttgcaaggactacgagagagact

SEQ ID NO: 195779 - DNA, 75 bp, Artificial Sequence
  Synthetic
gcagtaccaacatggaggataccaggcagactggagaagtggcatagtctgataaaattcttaaagtttaaaaca

SEQ ID NO: 195780 - DNA, 75 bp, Artificial Sequence
  Synthetic
cttgcgagcgcgtggagagacttgtggggggcaatgggacggatcggcaggggaatacttgcagttccaagaagg

SEQ ID NO: 195781 - DNA, 75 bp, Artificial Sequence
  Synthetic
aaagacctacagaaggcggtttatgttcctcatcacaaagttggatgggcttggtggacttgcagcagggtaata

SEQ ID NO: 195782 - DNA, 75 bp, Artificial Sequence
  Synthetic
atcaggcagggggcagaacttgccctcctgtgaggggcagcggtatcaacagggagactttatgaacaccccatg

SEQ ID NO: 195783 - DNA, 75 bp, Artificial Sequence
  Synthetic
ttcccattaacaaaagaagcacatttggaaatacaagggtattggaacttgacccctgaaaagggatggttaagc

SEQ ID NO: 195784 - DNA, 75 bp, Artificial Sequence
  Synthetic
gagaactccagcagcaggaagggagggaacattgtacaagcaacaaaatatggatgatgtagatgcagataatga

SEQ ID NO: 195785 - DNA, 75 bp, Artificial Sequence
  Synthetic
cagtatgcagtaagattaacctggtacacaagaaaattttatacagatgtgacaccagagacagcagatcaatta

SEQ ID NO: 195786 - DNA, 75 bp, Artificial Sequence
  Synthetic
taacctaataggggtccctgtcacaccaagagtaccattaagggcaatgacatataagttggcagtagatatatc

SEQ ID NO: 195787 - DNA, 75 bp, Artificial Sequence
  Synthetic
ttgcatggatcttattttgattgctttacagctggtgaagtaagaagagccatcaggggagagcagatattgtcc

SEQ ID NO: 195788 - DNA, 75 bp, Artificial Sequence
  Synthetic
caagagtaccattaagggcaatgacatataagttggcagtagatatatcacattttctaaatgaaaaggggggac

SEQ ID NO: 195789 - DNA, 75 bp, Artificial Sequence
  Synthetic
tgctgcaactatccaacagctcataaaaggcaggtgcctagcttgcaatttctagccttacaagtagtgcaaaaa

SEQ ID NO: 195790 - DNA, 75 bp, Artificial Sequence
  Synthetic
ggacatggatccaagggagagagtaccaccagaaaacagcgacgaggagacaatcggagaggcattcgaatggct

SEQ ID NO: 195791 - DNA, 75 bp, Artificial Sequence
  Synthetic
ggacatggatccaagggagagagttccaccagaaaacagcgacgaggagacaatcggagaggcattcgaatggct

SEQ ID NO: 195792 - DNA, 75 bp, Artificial Sequence
  Synthetic
ggacatggatccaagggagagagtcccaccagaaaacagcgacgaggagacaatcggagaggcattcgaatggct

SEQ ID NO: 195793 - DNA, 75 bp, Artificial Sequence
  Synthetic
ggacatggatccaagggagagagtgccaccagaaaacagcgacgaggagacaatcggagaggcattcgaatggct

SEQ ID NO: 195794 - DNA, 75 bp, Artificial Sequence
  Synthetic
caaaggccggcgtgtggagcgggagtgaagaggcctccgggtgaaggtaagtacctacaccaaaattgtagccga

SEQ ID NO: 195795 - DNA, 75 bp, Artificial Sequence
  Synthetic
agaaagaacagtaacagagatcaacaggatagcagtcaatcatttacccagggagcttattttccaggtttggcg

SEQ ID NO: 195796 - DNA, 75 bp, Artificial Sequence
  Synthetic
agaaagaacagttacagagatcaacaggatagcagtcaatcatttacccagggagcttattttccaggtttggcg

SEQ ID NO: 195797 - DNA, 75 bp, Artificial Sequence
  Synthetic
agaaagaacagtcacagagatcaacaggatagcagtcaatcatttacccagggagcttattttccaggtttggcg

SEQ ID NO: 195798 - DNA, 75 bp, Artificial Sequence
  Synthetic
agaaagaacagtgacagagatcaacaggatagcagtcaatcatttacccagggagcttattttccaggtttggcg

SEQ ID NO: 195799 - DNA, 75 bp, Artificial Sequence
  Synthetic
aaggtcctgggaatattggcatgatgaacagggcatgtcagctagttacactaagtatagatatttgttgctgat

SEQ ID NO: 195800 - DNA, 75 bp, Artificial Sequence
  Synthetic
ttaggttacggcccggcggaaagaaaaaatatcagctaaaacatattgtgtgggcagcgaatgaattggacagat

SEQ ID NO: 195801 - DNA, 75 bp, Artificial Sequence
  Synthetic
gcaaaaggctatgtttgtacattgtaagaaaggatgcacatgcttgcagaagggccatgggcctggaggatggag

SEQ ID NO: 195802 - DNA, 75 bp, Artificial Sequence
  Synthetic
acaaggacctcctcctcctcctcctccaggtctagcatagatggcagaagaaatccccccagaagatgaggcccc

SEQ ID NO: 195803 - DNA, 75 bp, Artificial Sequence
  Synthetic
gtcaaaagaaggttgccaaagaattcttaaagttttagaaccattagtgccaacaggatcagaaaatttaaaaag

SEQ ID NO: 195804 - DNA, 75 bp, Artificial Sequence
  Synthetic
ccagagagagccatgggatgaatgggtagtagaagttctggaagaaatcaaagaagaagccttaaaacattttga

SEQ ID NO: 195805 - DNA, 75 bp, Artificial Sequence
  Synthetic
cctttttaatactgtctgcgtagtttggtgcgtgcacgcagaagagaaagtgaaagatactgaaggagcaaaaca

SEQ ID NO: 195806 - DNA, 75 bp, Artificial Sequence
  Synthetic
ccctcgcttgctaactgcgcttggtaactatatctatgataggcatggagacaccctcgagggagcaggagaact

SEQ ID NO: 195807 - DNA, 75 bp, Artificial Sequence
  Synthetic
aataatacagagacatctagcggcagaaatagaaacagcagagaaaatgccaagcacaagtagaccaacagcacc

SEQ ID NO: 195808 - DNA, 75 bp, Artificial Sequence
  Synthetic
cattaaaatcctgcagagagctctcttcctgcactttcgaggagactgtagatgctccaggattggagggaacgc

SEQ ID NO: 195809 - DNA, 75 bp, Artificial Sequence
  Synthetic
acctagtgaacaggggggaaacttccccgtacaacaagtagccggcaactacacccatgtgccgctgagcccccg

SEQ ID NO: 195810 - DNA, 75 bp, Artificial Sequence
  Synthetic
cccgtacaacaagtagccggcaactacacccatgtgccgctgagcccccgaaccttagatgcttgggtaaaatta

SEQ ID NO: 195811 - DNA, 75 bp, Artificial Sequence
  Synthetic
aggcggaaatcctctatcaactataccgccctctagaggcgtgttctaataaatgttattgcaaaaaatgctgct

SEQ ID NO: 195812 - DNA, 75 bp, Artificial Sequence
  Synthetic
atcattgtcagttatgctttcttaacaagggactcggagtatgttatgagcaacctagaagaagaagaactccga

SEQ ID NO: 195813 - DNA, 75 bp, Artificial Sequence
  Synthetic
attaatcaaatgcttaattgtgtgggcgaccatcaagcagccatgcaaataatcagggagattatcaatgaagaa

SEQ ID NO: 195814 - DNA, 75 bp, Artificial Sequence
  Synthetic
aaaagactaaggctaattcattttctgcatcaaacgagtaagtatggcatatcttggcaatcagctgcttatcgc

SEQ ID NO: 195815 - DNA, 75 bp, Artificial Sequence
  Synthetic
gcagcagactgggatgttgcacatcccataccaggccccttaccagcagggcagcttagagaaccaagagggtct

SEQ ID NO: 195816 - DNA, 75 bp, Artificial Sequence
  Synthetic
aaccttactcttaagtacttatgggttctattgtaccaaatatgtcactgttttttatggcatacccgcatggag

SEQ ID NO: 195817 - DNA, 75 bp, Artificial Sequence
  Synthetic
aacctttctcttaagtacttatgggttctattgtaccaaatatgtcactgttttttatggcatacccgcatggag

SEQ ID NO: 195818 - DNA, 75 bp, Artificial Sequence
  Synthetic
aaccttcctcttaagtacttatgggttctattgtaccaaatatgtcactgttttttatggcatacccgcatggag

SEQ ID NO: 195819 - DNA, 75 bp, Artificial Sequence
  Synthetic
aaccttgctcttaagtacttatgggttctattgtaccaaatatgtcactgttttttatggcatacccgcatggag

SEQ ID NO: 195820 - DNA, 75 bp, Artificial Sequence
  Synthetic
gcagcttagagaaccaagagggtctgacatagcaggaacaacaagcacagtagaagaacagatccagtggatgtt

SEQ ID NO: 195821 - DNA, 75 bp, Artificial Sequence
  Synthetic
gacatagcaggaacaacaagcacagtagaagaacagatccagtggatgttcaggccacggaatcctgtgccagta

SEQ ID NO: 195822 - DNA, 75 bp, Artificial Sequence
  Synthetic
gaacgcgagcgtacctctcttctgtgcaaccaaaaatagggacacatggggcactacacagtgccttcctgataa

SEQ ID NO: 195823 - DNA, 75 bp, Artificial Sequence
  Synthetic
gggaacatctatagaagatggatccagatagggctacagaagtgtgtcaggatgtacaacccaaccaacatccta

SEQ ID NO: 195824 - DNA, 75 bp, Artificial Sequence
  Synthetic
tgatgattacagtgaactagcattgaatgtaacagaagcttttgatgcctgggataacacagtaacagaacaggc

SEQ ID NO: 195825 - DNA, 75 bp, Artificial Sequence
  Synthetic
gatgtacaacccaaccaacatcctagacataaaacaaggaccaaaggagccattccaaagctatgtagatagatt

SEQ ID NO: 195826 - DNA, 75 bp, Artificial Sequence
  Synthetic
agtagaagatgtttggaatctgtttgagacatctacaaaaccttgtgttaaattaacacctctgtgcattgccat

SEQ ID NO: 195827 - DNA, 75 bp, Artificial Sequence
  Synthetic
cattccaaagctatgtagatagattctacaaaagcttaagggcagaacaaacagatccagcagtaaagaattgga

SEQ ID NO: 195828 - DNA, 75 bp, Artificial Sequence
  Synthetic
tgactcaaacactgctggtacagaatgccaacccagactgcaaattagtgctgaaaggattagggatgaatccta

SEQ ID NO: 195829 - DNA, 75 bp, Artificial Sequence
  Synthetic
gagatgcaataaaactgagacaaacaaatggggtctaacagggaccaccactgtaacccctgcaacagttcccac

SEQ ID NO: 195830 - DNA, 75 bp, Artificial Sequence
  Synthetic
ccttagaagagatgctaaccgcctgtcagggagtagggggaccaggccagaaagccagattaatggcagaagcct

SEQ ID NO: 195831 - DNA, 75 bp, Artificial Sequence
  Synthetic
aactaaaatggtgacagctgaactagtgaatagcactagccagtgcttaatgtacgataattgtacaggtataca

SEQ ID NO: 195832 - DNA, 75 bp, Artificial Sequence
  Synthetic
aaagccagattaatggcagaagccttaaaggaggccatgacaccagctcctatcccatttgcggcagcccaacaa

SEQ ID NO: 195833 - DNA, 75 bp, Artificial Sequence
  Synthetic
gtcagaatccatggttggctgcaaatttaacatgacagggctaaaaagggatcagagaaaggaatacaatgagac

SEQ ID NO: 195834 - DNA, 75 bp, Artificial Sequence
  Synthetic
ttggtattcacaagatttgcaatgagaacagtccaataagagtgagaatgagagtagatgctatatgaggcactg

SEQ ID NO: 195835 - DNA, 75 bp, Artificial Sequence
  Synthetic
ttggtattcacaagatttgcaatgtgaacagtccaataagagtgagaatgagagtagatgctatatgaggcactg

SEQ ID NO: 195836 - DNA, 75 bp, Artificial Sequence
  Synthetic
ttggtattcacaagatttgcaatgcgaacagtccaataagagtgagaatgagagtagatgctatatgaggcactg

SEQ ID NO: 195837 - DNA, 75 bp, Artificial Sequence
  Synthetic
ttggtattcacaagatttgcaatgggaacagtccaataagagtgagaatgagagtagatgctatatgaggcactg

SEQ ID NO: 195838 - DNA, 75 bp, Artificial Sequence
  Synthetic
acaatgccgagcacccagaaaacagggctgctggaaatgtggcaagccaggacatcttatggcaaactgcccaga

SEQ ID NO: 195839 - DNA, 75 bp, Artificial Sequence
  Synthetic
taatacatcagtcattcaggaatcatgtgataaacattattgggatgctataagatttagatattgtgctccgcc

SEQ ID NO: 195840 - DNA, 75 bp, Artificial Sequence
  Synthetic
aagacaggctggttttttagggcttggcccatggggaaagaagcctcgcaacttccccgtaacccgagttccgca

SEQ ID NO: 195841 - DNA, 75 bp, Artificial Sequence
  Synthetic
agggtttgctttgctaagatgtaatgatactaactattcaggatttgcacctaattgctctaaagtagtggtctc

SEQ ID NO: 195842 - DNA, 75 bp, Artificial Sequence
  Synthetic
gggattaacaccaacagcacccccagcagagccagcagcggacctgctggagcagtatatgcagcaggggagaaa

SEQ ID NO: 195843 - DNA, 75 bp, Artificial Sequence
  Synthetic
tacatgtacaagaatgatggaaacacaaacctctacatggttcgggtttaatggaacaagggcagaaaatagaac

SEQ ID NO: 195844 - DNA, 75 bp, Artificial Sequence
  Synthetic
gcaaagagagcagagagagaggccatacaaagaggtgacggaggacttactgcacctcgagcagggagagacacc

SEQ ID NO: 195845 - DNA, 75 bp, Artificial Sequence
  Synthetic
tacaaagaggtgacggaggacttactgcacctcgagcagggagagacaccacacaaagaggtgacagaggacttg

SEQ ID NO: 195846 - DNA, 75 bp, Artificial Sequence
  Synthetic
atatatctattggcatgggagagacaataggactataataagtttaaataagtattataatttaacaataaaatg

SEQ ID NO: 195847 - DNA, 75 bp, Artificial Sequence
  Synthetic
atatatctattggcatgggagagacaataggactataataagtttaaataagtattataatttaacaataatatg

SEQ ID NO: 195848 - DNA, 75 bp, Artificial Sequence
  Synthetic
atatatctattggcatgggagagacaataggactataataagtttaaataagtattataatttaacaataacatg

SEQ ID NO: 195849 - DNA, 75 bp, Artificial Sequence
  Synthetic
atatatctattggcatgggagagacaataggactataataagtttaaataagtattataatttaacaataagatg

SEQ ID NO: 195850 - DNA, 75 bp, Artificial Sequence
  Synthetic
taggagaccagggaataaaacagtattaccaattactattatgtcagggctagtcttccactctcaaccaatcaa

SEQ ID NO: 195851 - DNA, 75 bp, Artificial Sequence
  Synthetic
tgaaagacccagacaggcttggtgttggtttggaggcaaatggaaggaagccatgcaggaggtaaaggaaaccgt

SEQ ID NO: 195852 - DNA, 75 bp, Artificial Sequence
  Synthetic
gaatagggggattcataaataccaaagaatatgaagatgtagaaataaaagtactaaataaaagagtaaaagcca

SEQ ID NO: 195853 - DNA, 75 bp, Artificial Sequence
  Synthetic
ggtcaagcaccccagctataaaggaacaaatgacacaaagaaaataacctttacaacaccaggagaaggttcaga

SEQ ID NO: 195854 - DNA, 75 bp, Artificial Sequence
  Synthetic
ggtcaagcaccccagctataaaggaacaaatgacacaaagaatataacctttacaacaccaggagaaggttcaga

SEQ ID NO: 195855 - DNA, 75 bp, Artificial Sequence
  Synthetic
ggtcaagcaccccagctataaaggaacaaatgacacaaagaacataacctttacaacaccaggagaaggttcaga

SEQ ID NO: 195856 - DNA, 75 bp, Artificial Sequence
  Synthetic
ggtcaagcaccccagctataaaggaacaaatgacacaaagaagataacctttacaacaccaggagaaggttcaga

SEQ ID NO: 195857 - DNA, 75 bp, Artificial Sequence
  Synthetic
ccataatgacaggtgacaccccaatcaatatttttggcagaaacattttgacagccttaggcatgtcattaaacc

SEQ ID NO: 195858 - DNA, 75 bp, Artificial Sequence
  Synthetic
tccagaagtaaagttcatgtggactaattgcagaggagaattcttgtattgtaaaatgacttggtttctaaattg

SEQ ID NO: 195859 - DNA, 75 bp, Artificial Sequence
  Synthetic
taccagttgccaagatagagccaatagaggtaagattaaagccaggaaaagacgggccaaaattaagacaatggc

SEQ ID NO: 195860 - DNA, 75 bp, Artificial Sequence
  Synthetic
gatagaggacagaaatatgactctcctaaagccccaggaacgacaaagacgcaattatgtaccctgccatattag

SEQ ID NO: 195861 - DNA, 75 bp, Artificial Sequence
  Synthetic
gcagataattaacacatggcacaaagtaggaaaaaatgtgtacttgccccccagagaaggtgatctgacgtgtaa

SEQ ID NO: 195862 - DNA, 75 bp, Artificial Sequence
  Synthetic
actaaaagaaatctgtgaaaaaacggaaagagaaggccaattagaggaggcacctccaactaacccttataatac

SEQ ID NO: 195863 - DNA, 75 bp, Artificial Sequence
  Synthetic
ttcaacagtcaccagcctaatagcgaatatagaagagaataggtctaacaaccatacaaatatcattttcagtgc

SEQ ID NO: 195864 - DNA, 75 bp, Artificial Sequence
  Synthetic
ccccacatttgcaataaagaagaaggacaaaaacaaatggagaatgctaatagattttagagaattaaacaaggt

SEQ ID NO: 195865 - DNA, 75 bp, Artificial Sequence
  Synthetic
aactcaagatttcacagagattcagttagggattccacatccagcaggattagccaagaaaagaagaatcactgt

SEQ ID NO: 195866 - DNA, 75 bp, Artificial Sequence
  Synthetic
agaggtggcagaactgtatcgattagaattgggggattataaattagtagaaataactccaattggctttgcacc

SEQ ID NO: 195867 - DNA, 75 bp, Artificial Sequence
  Synthetic
tagccaagaaaagaagaatcactgtgctggatgtaggggatgcttacttttccataccactgcatgagagcttta

SEQ ID NO: 195868 - DNA, 75 bp, Artificial Sequence
  Synthetic
cacaaatgtaaagagatattcctctgtgacaccgaaaaataaaagaggtgtatttgtgctagggtttttgggatt

SEQ ID NO: 195869 - DNA, 75 bp, Artificial Sequence
  Synthetic
gacagtatactgcatttactctaccatcagtaaacaatgcagaaccaggaaaaagatatatatataaagtcttac

SEQ ID NO: 195870 - DNA, 75 bp, Artificial Sequence
  Synthetic
tcttgcaatggcaggttctgcaatgggcacagcgtcgttgacgctgtcggctcagtcccggactttgttggctgg

SEQ ID NO: 195871 - DNA, 75 bp, Artificial Sequence
  Synthetic
aaaagatatatatataaagtcttaccgcagggatggaagggatcaccagcaatttttcaacacacaatgagacag

SEQ ID NO: 195872 - DNA, 75 bp, Artificial Sequence
  Synthetic
atcttagagccattcagaaaggcaaaccaggatgtcattctcattcaatacatggatgatatcttaatagctagt

SEQ ID NO: 195873 - DNA, 75 bp, Artificial Sequence
  Synthetic
gacgaaaaacctccagactagagtcactgccatcgagaaatatctaaaggaccaggcacggctaaattcatgggg

SEQ ID NO: 195874 - DNA, 75 bp, Artificial Sequence
  Synthetic
catggatgatatcttaatagctagtgacaggacagatttagaacatgacaaggtggtcctgcagttaaaggaact

SEQ ID NO: 195875 - DNA, 75 bp, Artificial Sequence
  Synthetic
atgtgcgtttagacaggtctgccacactactgtaccttgggatgcccttggtgctaataaaacattggagccaca

SEQ ID NO: 195876 - DNA, 75 bp, Artificial Sequence
  Synthetic
actgtggccaactaaatggaagctgcaaaaaatacaattgccccagaaagaagtatggacagtcaatgacatcca

SEQ ID NO: 195877 - DNA, 75 bp, Artificial Sequence
  Synthetic
atggaataatatgacatggcaagaatgggaaaagcagatcaactttttggaggacaacatcacacggctattaga

SEQ ID NO: 195878 - DNA, 75 bp, Artificial Sequence
  Synthetic
caaaaaatacaattgccccagaaagaagtatggacagtcaatgacatccaaaaacatgtgggtgtcctaaattgg

SEQ ID NO: 195879 - DNA, 75 bp, Artificial Sequence
  Synthetic
agaagcacaaattcagcaagaaaaaaatatgtatgagttacagaaattaaatagctgggatgtatttggcaattg

SEQ ID NO: 195880 - DNA, 75 bp, Artificial Sequence
  Synthetic
agaccaaacacttatgtagactaattagaggaaaaatgacactcacagaaggagtgcagtggacagaactagcag

SEQ ID NO: 195881 - DNA, 75 bp, Artificial Sequence
  Synthetic
gtttgacctaacctcctgggttaaatacgtttacttaggcctttatgtagtggcaggagtaatagtgttaagaat

SEQ ID NO: 195882 - DNA, 75 bp, Artificial Sequence
  Synthetic
aagcagaactagaggagaacagaattatcttaagtcaggaacaagaggggcactattaccaagaagaaaaggagt

SEQ ID NO: 195883 - DNA, 75 bp, Artificial Sequence
  Synthetic
agtcatatatgtagtacaaatactaggaagacttaggcaagggtataggcctgtttattcttcccctccctctta

SEQ ID NO: 195884 - DNA, 75 bp, Artificial Sequence
  Synthetic
agtcatatatgtagtacaaatactaggaagacttaggcaagggtataggcctgttttttcttcccctccctctta

SEQ ID NO: 195885 - DNA, 75 bp, Artificial Sequence
  Synthetic
agtcatatatgtagtacaaatactaggaagacttaggcaagggtataggcctgtttcttcttcccctccctctta

SEQ ID NO: 195886 - DNA, 75 bp, Artificial Sequence
  Synthetic
agtcatatatgtagtacaaatactaggaagacttaggcaagggtataggcctgtttgttcttcccctccctctta

SEQ ID NO: 195887 - DNA, 75 bp, Artificial Sequence
  Synthetic
tagaagcaacagtccaaaaagatcaagacaatcaatggacatataaaatacaccagggagaaaaaattctaaaag

SEQ ID NO: 195888 - DNA, 75 bp, Artificial Sequence
  Synthetic
tgttcagcagatccatatccgcaaggaccaggaacagccaaccaaagaagaaatagaaggagaaagtggaaacaa

SEQ ID NO: 195889 - DNA, 75 bp, Artificial Sequence
  Synthetic
tgttcagcagatccatatccgcaaggaccaggaactgccaaccaaagaagaaatagaaggagaaagtggaaacaa

SEQ ID NO: 195890 - DNA, 75 bp, Artificial Sequence
  Synthetic
tgttcagcagatccatatccgcaaggaccaggaaccgccaaccaaagaagaaatagaaggagaaagtggaaacaa

SEQ ID NO: 195891 - DNA, 75 bp, Artificial Sequence
  Synthetic
tgttcagcagatccatatccgcaaggaccaggaacggccaaccaaagaagaaatagaaggagaaagtggaaacaa

SEQ ID NO: 195892 - DNA, 75 bp, Artificial Sequence
  Synthetic
tggaaaagtatgcaaaaatgaaaaatacccataccaacggggtcagattgttagcacaggtagttcaaaaaatag

SEQ ID NO: 195893 - DNA, 75 bp, Artificial Sequence
  Synthetic
aggtggctacagatcttggccttggcagatagaatatattcatttcctgatccgccagctagggaacctcttgac

SEQ ID NO: 195894 - DNA, 75 bp, Artificial Sequence
  Synthetic
aggtggctacagatcttggccttggcagatagaatatattcatttcctgttccgccagctagggaacctcttgac

SEQ ID NO: 195895 - DNA, 75 bp, Artificial Sequence
  Synthetic
aggtggctacagatcttggccttggcagatagaatatattcatttcctgctccgccagctagggaacctcttgac

SEQ ID NO: 195896 - DNA, 75 bp, Artificial Sequence
  Synthetic
aggtggctacagatcttggccttggcagatagaatatattcatttcctggtccgccagctagggaacctcttgac

SEQ ID NO: 195897 - DNA, 75 bp, Artificial Sequence
  Synthetic
tacccataccaacggggtcagattgttagcacaggtagttcaaaaaataggaaaagaagcactggtcatttgggg

SEQ ID NO: 195898 - DNA, 75 bp, Artificial Sequence
  Synthetic
ttggctatacagcaactgcagagccttactatccaggatcatccagactctccaaccgctgttccaaagaatctc

SEQ ID NO: 195899 - DNA, 75 bp, Artificial Sequence
  Synthetic
ttggctatacagcaactgcagagccttactatccaggatcttccagactctccaaccgctgttccaaagaatctc

SEQ ID NO: 195900 - DNA, 75 bp, Artificial Sequence
  Synthetic
ttggctatacagcaactgcagagccttactatccaggatcctccagactctccaaccgctgttccaaagaatctc

SEQ ID NO: 195901 - DNA, 75 bp, Artificial Sequence
  Synthetic
ttggctatacagcaactgcagagccttactatccaggatcgtccagactctccaaccgctgttccaaagaatctc

SEQ ID NO: 195902 - DNA, 75 bp, Artificial Sequence
  Synthetic
caggaccctccaagcaattagagaacatctccggctagaagcagcttatttcagctatgggttccgctggctcca

SEQ ID NO: 195903 - DNA, 75 bp, Artificial Sequence
  Synthetic
atggatcccagactgggactttgtatctaccccaccactggtcaggctagcatttaacctagtaaaagatcctat

SEQ ID NO: 195904 - DNA, 75 bp, Artificial Sequence
  Synthetic
catttaacctagtaaaagatcctatactaggcgcagagaccttctacacagacgggccctgtaataggcaatcaa

SEQ ID NO: 195905 - DNA, 75 bp, Artificial Sequence
  Synthetic
agaagcgtgcaccgcagcaactagggctgcgcaagagactcttacaagcacgtggagagccttatggaaaactct

SEQ ID NO: 195906 - DNA, 75 bp, Artificial Sequence
  Synthetic
aagaaggaaaagcaggatatataacagatagagggagagacaaggtgaaggtactagaacaaactaccaatcagc

SEQ ID NO: 195907 - DNA, 75 bp, Artificial Sequence
  Synthetic
gggaagggttggaagagggatactcgcaataccgagaagaatcaggcaagggcttgagctcactctcttgtgaag

SEQ ID NO: 195908 - DNA, 75 bp, Artificial Sequence
  Synthetic
ggcaacaatacacgcagggtcaatttatgaataccccatggagaaacccagcaacagaaagagcaaagttagcat

SEQ ID NO: 195909 - DNA, 75 bp, Artificial Sequence
  Synthetic
acaggaagcaaaataatgatgatgtagatagtgatgataatgacttagtaggagtaccagtctaccccaaagtcc

SEQ ID NO: 195910 - DNA, 75 bp, Artificial Sequence
  Synthetic
acaggtagcaaaataatgatgatgtagatagtgatgataatgacttagtaggagtaccagtctaccccaaagtcc

SEQ ID NO: 195911 - DNA, 75 bp, Artificial Sequence
  Synthetic
acaggcagcaaaataatgatgatgtagatagtgatgataatgacttagtaggagtaccagtctaccccaaagtcc

SEQ ID NO: 195912 - DNA, 75 bp, Artificial Sequence
  Synthetic
acagggagcaaaataatgatgatgtagatagtgatgataatgacttagtaggagtaccagtctaccccaaagtcc

SEQ ID NO: 195913 - DNA, 75 bp, Artificial Sequence
  Synthetic
gccaacagaatcagaaaatagaatagtaaatcaaatcatagaagaaatgataaaaaaggaagccatctatgttgc

SEQ ID NO: 195914 - DNA, 75 bp, Artificial Sequence
  Synthetic
gtgggtcccagcccacaaaggcatagggggaaatcaggaagtagaccatttagtaagtcagggcatcagacaagt

SEQ ID NO: 195915 - DNA, 75 bp, Artificial Sequence
  Synthetic
ggttggcgcccgaacagggacttgaagagtgagagtcttctgaaactcggctgagtgagggcagtaagggcggca

SEQ ID NO: 195916 - DNA, 75 bp, Artificial Sequence
  Synthetic
ccaaagtcccgctaagagtaatgagttacaaattggcaatagacatgtcacattttataaaagaaaaggggggac

SEQ ID NO: 195917 - DNA, 75 bp, Artificial Sequence
  Synthetic
attgtttctagaaaaaatagagccagctcaggaagaacatgaaaagtatcatagcaatgtgaaagaactatccca

SEQ ID NO: 195918 - DNA, 75 bp, Artificial Sequence
  Synthetic
ggaacaaaccacgacggagtgctcctgtaaaggcgcaggctggtaccaagcagcgtgaggagcgggagtgagagg

SEQ ID NO: 195919 - DNA, 75 bp, Artificial Sequence
  Synthetic
taaatttggattacccaatctggtggcaagacagatagtaaacacatgtgcccaatgtcagcagaagggagaggc

SEQ ID NO: 195920 - DNA, 75 bp, Artificial Sequence
  Synthetic
tctccggttgcaggtaagtgcaacaaaaaatagaaccaaagggttgtctgcctctgagaaaggagaggtagtata

SEQ ID NO: 195921 - DNA, 75 bp, Artificial Sequence
  Synthetic
tatacatgggcaagtgaatgcagaactaggcacttggcaaatggactgcacacacttagaaggaaaagtcatcat

SEQ ID NO: 195922 - DNA, 75 bp, Artificial Sequence
  Synthetic
cctctgagaaaggagaggtagtatattgtgggagatgggcgcgagaaactcgtcttgtcagggaagaaagtagat

SEQ ID NO: 195923 - DNA, 75 bp, Artificial Sequence
  Synthetic
gaattagaaaaagttaggttacggcccaacggaaagaaaaaatacatgttaaaacatgttgtgtgggcagcgaac

SEQ ID NO: 195924 - DNA, 75 bp, Artificial Sequence
  Synthetic
aatagcagtgcatgttgccagtggattcatagaagcagaggtcatcccgcaggaatcaggaagacaaacagcact

SEQ ID NO: 195925 - DNA, 75 bp, Artificial Sequence
  Synthetic
cttcctattaaaactggctagtagatggccaataacacacttgcacacagatagtggtgtcaacttcacctcaca

SEQ ID NO: 195926 - DNA, 75 bp, Artificial Sequence
  Synthetic
gaattggacagatttggattagcagaaagcctgttggaggccaaagaaggatgtcaaaaaattttatcggtgtta

SEQ ID NO: 195927 - DNA, 75 bp, Artificial Sequence
  Synthetic
tggccaataacacacttgcacacagatagtggtgtcaacttcacctcacaggaagtaaagatggtagcatggtgg

SEQ ID NO: 195928 - DNA, 75 bp, Artificial Sequence
  Synthetic
agtagtagaagcaatgaatcaccacctaaaaaatcagataagcagaattagagagcaggcaaatacagtggaaac

SEQ ID NO: 195929 - DNA, 75 bp, Artificial Sequence
  Synthetic
gcagaagagaaagtgaaacatactgaggaagcaaagcagatagtacagagacatctagcggtggaaactgaaact

SEQ ID NO: 195930 - DNA, 75 bp, Artificial Sequence
  Synthetic
gcagaaaaaatgccagccacaagtagaccaacagatccacctagtggcggcagaggaaattacccggtgcagcag

SEQ ID NO: 195931 - DNA, 75 bp, Artificial Sequence
  Synthetic
gcagaaaaaatgccagccacaagtagaccaacagttccacctagtggcggcagaggaaattacccggtgcagcag

SEQ ID NO: 195932 - DNA, 75 bp, Artificial Sequence
  Synthetic
gcagaaaaaatgccagccacaagtagaccaacagctccacctagtggcggcagaggaaattacccggtgcagcag

SEQ ID NO: 195933 - DNA, 75 bp, Artificial Sequence
  Synthetic
gcagaaaaaatgccagccacaagtagaccaacaggtccacctagtggcggcagaggaaattacccggtgcagcag

SEQ ID NO: 195934 - DNA, 75 bp, Artificial Sequence
  Synthetic
taggggatatgaccccagcagaaagactcatcaatatgatctccacagaacaagaaatacaattcctccaaacaa

SEQ ID NO: 195935 - DNA, 75 bp, Artificial Sequence
  Synthetic
ataggtggcaattatgcccacctacctctaagtcctagaacactcaatgcctgggtaaaactggtagaggagaaa

SEQ ID NO: 195936 - DNA, 75 bp, Artificial Sequence
  Synthetic
aaaatttgaaatttaaaaatttcccggtctattacagggaaggcagagatcagctgtggaaaggacctggggagc

SEQ ID NO: 195937 - DNA, 75 bp, Artificial Sequence
  Synthetic
aaatttggagcagaagtagtgccaggatttcaggcactctcagagggctgcacgccctatgatattaatcaaatg

SEQ ID NO: 195938 - DNA, 75 bp, Artificial Sequence
  Synthetic
ggtctattacagggaaggcagagatcagctgtggaaaggacctggggagctactgtggaaaggggacggagcagt

SEQ ID NO: 195939 - DNA, 75 bp, Artificial Sequence
  Synthetic
ttaaattgcgtgggagaacatcaagctgctatgcaaattatcagggaaataattaatgatgaagcagcagattgg

SEQ ID NO: 195940 - DNA, 75 bp, Artificial Sequence
  Synthetic
agatcatcagagactatggaggaaggcaagagctggatagtggtccccacttggagggtgccagggaggatggag

SEQ ID NO: 195941 - DNA, 75 bp, Artificial Sequence
  Synthetic
gacacacagcacccaaaccaaggcccaccaccagcagggcaacttagagagccaagaggttctgatattgcagga

SEQ ID NO: 195942 - DNA, 75 bp, Artificial Sequence
  Synthetic
acaactagcacagtggaagagcagatacagtggatgtacaggccgcaaaatccaataccggtgggtaacatctat

SEQ ID NO: 195943 - DNA, 75 bp, Artificial Sequence
  Synthetic
aaaggtgtgctatgttccccaccataaggtgggatgggcatggtggacttgcagcagggtaatattcccattaca

SEQ ID NO: 195944 - DNA, 75 bp, Artificial Sequence
  Synthetic
aaggtgggatgggcatggtggacttgcagcagggtaatattcccattacaaggaagaagtcatctagagatacag

SEQ ID NO: 195945 - DNA, 75 bp, Artificial Sequence
  Synthetic
cggagatggatccaattgggcctacaaaaatgtgttagaatgtacaatccaactaatatcttagatataaagcaa

SEQ ID NO: 195946 - DNA, 75 bp, Artificial Sequence
  Synthetic
gcatattggaacctaacaccagaaaaaggatggctctcctcttatgcagtaagaataacttggtatacagaaaag

SEQ ID NO: 195947 - DNA, 75 bp, Artificial Sequence
  Synthetic
gggccaaaggagccatttcaaagttatgtagatagattctacaaaagtttgagagcagaacaaacagatccagca

SEQ ID NO: 195948 - DNA, 75 bp, Artificial Sequence
  Synthetic
ttctggacagatgttaccccagactgtgcagactccctaatacatggcacttatttctcttgctttacggcaggt

SEQ ID NO: 195949 - DNA, 75 bp, Artificial Sequence
  Synthetic
gtgaaaaattggatgactcagacgctgctgattcagaatgctaacccagactgcaaactcgtgttaaaaggtttg

SEQ ID NO: 195950 - DNA, 75 bp, Artificial Sequence
  Synthetic
ttatttctcttgctttacggcaggtgaagtaagaagagccatcagaggggaaaagttattgtcctgctgcaatta

SEQ ID NO: 195951 - DNA, 75 bp, Artificial Sequence
  Synthetic
ggtatgaatcctaccttagaagagatgctaacagcctgtcaaggaataggaggaccaggacaaaaagctaggctg

SEQ ID NO: 195952 - DNA, 75 bp, Artificial Sequence
  Synthetic
tccccaggcccataagtcacaggtaccgtcactccaatttctggccttagtggtagtgcaacaaaatggcaaacc

SEQ ID NO: 195953 - DNA, 75 bp, Artificial Sequence
  Synthetic
atggcagaagccttaaaagaggccttacaacctatgcctataccctttgcagcagtccaacagagaggcggccca

SEQ ID NO: 195954 - DNA, 75 bp, Artificial Sequence
  Synthetic
ccagagaaacagtaccaccaggaaacagtggcgaagagactatcggagaggccttcgagtggctagacaggacag

SEQ ID NO: 195955 - DNA, 75 bp, Artificial Sequence
  Synthetic
cagtggcgaagagactatcggagaggccttcgagtggctagacaggacagtagaggccttaaacagagaggcggt

SEQ ID NO: 195956 - DNA, 75 bp, Artificial Sequence
  Synthetic
aggaggccagtcagatgttggaactgtggcaaggaaggacacactgcaaggcagtgtaaagcccctagaagacag

SEQ ID NO: 195957 - DNA, 75 bp, Artificial Sequence
  Synthetic
ggatgctggaaatgtgaaaagccaggacacaacatggctagctgcccagaaaccaaggtgggttttttagggctt

SEQ ID NO: 195958 - DNA, 75 bp, Artificial Sequence
  Synthetic
gtcacaaagttacacaaaatatagatacttgtgcttaatgcagaaagctatgtacacacatttcatgaaagggtg

SEQ ID NO: 195959 - DNA, 75 bp, Artificial Sequence
  Synthetic
ggcccttgggaaaaaaagcctcgcaacttccccatggcccaagtcccgcagggactgaccccaacagcccctcca

SEQ ID NO: 195960 - DNA, 75 bp, Artificial Sequence
  Synthetic
gcagaaccagcagtggatctgctgaccccgacagcccctccagcggacccagcagtggatctgctaaagagctac

SEQ ID NO: 195961 - DNA, 75 bp, Artificial Sequence
  Synthetic
ccaggaggatggagatcaggacctccccctcctccccctccaggtctagtctaatgactgaagcaccaacagagt

SEQ ID NO: 195962 - DNA, 75 bp, Artificial Sequence
  Synthetic
ttcccccggccggaatgggaccccaccagggagccagggatgagtgggtaatagaagtcctgagagaaataaaag

SEQ ID NO: 195963 - DNA, 75 bp, Artificial Sequence
  Synthetic
atgcaacagggcaagaaacaaaaggagaacagagagagaccatacaaggaggtgacggaggatttgctgcacctc

SEQ ID NO: 195964 - DNA, 75 bp, Artificial Sequence
  Synthetic
aagaagctttaaggcattttgaccctcgcatgctaattgctcttggcggctatatctatactagacatggagaca

SEQ ID NO: 195965 - DNA, 75 bp, Artificial Sequence
  Synthetic
aattctctctttggaaacgaccaatagtcactgcatacatagaggggcaaccagtaaaagtactactgaataccg

SEQ ID NO: 195966 - DNA, 75 bp, Artificial Sequence
  Synthetic
cccttgaaagagccagggagctcattaatgccctacaacgagccctcttcatgcacttcagagcaggatgtggcc

SEQ ID NO: 195967 - DNA, 75 bp, Artificial Sequence
  Synthetic
gggctgatgattcaatagtagcagggattaaattagaaccatattatactccaaaaactgtaggggaaatagaag

SEQ ID NO: 195968 - DNA, 75 bp, Artificial Sequence
  Synthetic
taatgccctacaacgagccctcttcatgcacttcagagcaggatgtggccgttcaagagttggccaaacaagggg

SEQ ID NO: 195969 - DNA, 75 bp, Artificial Sequence
  Synthetic
ggttcattaatacaaaaaaatttcacaatgtaaacataaaagtattgggcaaaacaattagaggtaccataatga

SEQ ID NO: 195970 - DNA, 75 bp, Artificial Sequence
  Synthetic
aagaaatcctctctcagctataccgacccctagaaacatgcaataacacatgctattgtaaggaatgctgctacc

SEQ ID NO: 195971 - DNA, 75 bp, Artificial Sequence
  Synthetic
caggagacaccccaatcaatatttttggtaggaatcttttgacagaactgggcatgtctctaaactttccaatag

SEQ ID NO: 195972 - DNA, 75 bp, Artificial Sequence
  Synthetic
attgccagctgtgttttttaaataagggactcgggatatggtatgaccgaaagggcaggcgaagaagatctccaa

SEQ ID NO: 195973 - DNA, 75 bp, Artificial Sequence
  Synthetic
gaaaagaagcactagtcattgggggactaaaaccaggcaaggatggaccaaaattaagacagtggcctttatcta

SEQ ID NO: 195974 - DNA, 75 bp, Artificial Sequence
  Synthetic
agaaaattaaggctcattcgtcttctgcatcagacaagtgagtatgatgtctagtagaaatcagctgcttgttac

SEQ ID NO: 195975 - DNA, 75 bp, Artificial Sequence
  Synthetic
aggaaaaattagaagcattaaaagagatatgtgagaaaatggaaaaggagggacaattggaagaagctcccccca

SEQ ID NO: 195976 - DNA, 75 bp, Artificial Sequence
  Synthetic
tatcttactagctagtgcttgcttagtatattgtaaacaatatgtgactgttttttatggcgtgccagcatggaa

SEQ ID NO: 195977 - DNA, 75 bp, Artificial Sequence
  Synthetic
ctaatccatacaacactcccacctttgccataaagaagaaggacaaaaacaaatggagaatgttaatagacttta

SEQ ID NO: 195978 - DNA, 75 bp, Artificial Sequence
  Synthetic
aaatgcatccattcccctcttttgtgcaaccaaaaatagagatacttggggaaccatacagtgcttaccagacaa

SEQ ID NO: 195979 - DNA, 75 bp, Artificial Sequence
  Synthetic
gagagttaaacagagtaactcaagattttagtgaagtccagttaggtataccccacccagcaggactagctgaga

SEQ ID NO: 195980 - DNA, 75 bp, Artificial Sequence
  Synthetic
tgatgattatcaggaaatagctttgaatgtgacagaggctttcgatgcatgggataatacagtaacagaacaagc

SEQ ID NO: 195981 - DNA, 75 bp, Artificial Sequence
  Synthetic
gaaccatacagtgcttaccagacaatgatgattatcaggaaatagctttgaatgtgacagaggctttcgatgcat

SEQ ID NO: 195982 - DNA, 75 bp, Artificial Sequence
  Synthetic
aaaagaggataacagttctagatgtaggggatgcctacttcagcatcccgctgtgtgaagacttcaggcaatata

SEQ ID NO: 195983 - DNA, 75 bp, Artificial Sequence
  Synthetic
gggataatacagtaacagaacaagcagtagaagatgtctggagactatttgagacatcaataaaaccatgtgtca

SEQ ID NO: 195984 - DNA, 75 bp, Artificial Sequence
  Synthetic
agttaacacctttatgtatagcaatgaagtgtagcaacataagcacagagagcacaaccacatccccgagcccag

SEQ ID NO: 195985 - DNA, 75 bp, Artificial Sequence
  Synthetic
ctgcttttactttaccatccattaataatgcagagccaggaaaaagatacatctacaaggtgttgcctcaaggct

SEQ ID NO: 195986 - DNA, 75 bp, Artificial Sequence
  Synthetic
ggagcacactcaaacccctgataaatgagagcgatccatgcataaaggcagacaactgccccaggggactagggg

SEQ ID NO: 195987 - DNA, 75 bp, Artificial Sequence
  Synthetic
ggaaaggatcaccaacaatttttcagtatacaatgaggaacctactggagccatttagaaaggcaaatgaagatg

SEQ ID NO: 195988 - DNA, 75 bp, Artificial Sequence
  Synthetic
atgaagagatggtcaattgtcggttcaacatgacaggattacagagagataagccaaaacagtataatgaaacat

SEQ ID NO: 195989 - DNA, 75 bp, Artificial Sequence
  Synthetic
ctgtcataattcagtatatggatgacattcttatagccagtgatagaaatgatttagagcatgatcagttagttt

SEQ ID NO: 195990 - DNA, 75 bp, Artificial Sequence
  Synthetic
cacagctcaaggagctactgaataagacaggatttagcaccccagacgaaaaatttcagaaagacccaccacaca

SEQ ID NO: 195991 - DNA, 75 bp, Artificial Sequence
  Synthetic
ggtactcaaaagatgtggtttgtgaaccatttaacaccaccacaaaccagaccaggtgttacatgaaccattgca

SEQ ID NO: 195992 - DNA, 75 bp, Artificial Sequence
  Synthetic
aatggatgggctatgaactatggcctaaaaagtggaaattgcagaaaattgagctcccagaaagagatgtttgga

SEQ ID NO: 195993 - DNA, 75 bp, Artificial Sequence
  Synthetic
cagtaaatgacattcagaagttagtaggagtactaaattgggcagcacaagtttatccaggaataaagacaaaac

SEQ ID NO: 195994 - DNA, 75 bp, Artificial Sequence
  Synthetic
gttacgccctactaagatgcgatgatatcaattattcaggctttgcacccaattgctctaaagtagtagctgcta

SEQ ID NO: 195995 - DNA, 75 bp, Artificial Sequence
  Synthetic
atctttgtaaattaattaaggggaaaatgacactcacagaagaggtacagtggacagaaatggcagaagcagaat

SEQ ID NO: 195996 - DNA, 75 bp, Artificial Sequence
  Synthetic
ggcactagggcagaaaatagaacatatatctattggcatggtagagataatagaactatcatcagcttaaacaaa

SEQ ID NO: 195997 - DNA, 75 bp, Artificial Sequence
  Synthetic
ttgcagagaataagattattttgagtcaggaacaagagggggcttattacagggaagaagaaaatctagaagcaa

SEQ ID NO: 195998 - DNA, 75 bp, Artificial Sequence
  Synthetic
cattataatcttactatgcattgtaagaggccaggaaataagacagttgtaccaataacacttatgtcagggtta

SEQ ID NO: 195999 - DNA, 75 bp, Artificial Sequence
  Synthetic
cagtgcttaaaaatcaagataatcaatggacctacaagatccatcagggtgacaggacattaaaagtaggaaaat

SEQ ID NO: 196000 - DNA, 75 bp, Artificial Sequence
  Synthetic
atatttcactcccagccaatcaataaaagacccagacaagcatggtgctggttcaaaggcgaatggaggaaagcc

SEQ ID NO: 196001 - DNA, 75 bp, Artificial Sequence
  Synthetic
ttgccaaggtaaagaatactcatacaaatggagttcgcctgctagcacatgtggtacagaagataggaaaagaag

SEQ ID NO: 196002 - DNA, 75 bp, Artificial Sequence
  Synthetic
atgcaggaggtgaaggaaacccttgtaaaacatcccaggtataaaggaaccaatgacacaaaccaaattaacttt

SEQ ID NO: 196003 - DNA, 75 bp, Artificial Sequence
  Synthetic
ccatagtaatatggggaaaaattccaatgttccatctgccagtagaaagagaggtctgggaacaatggtggactg

SEQ ID NO: 196004 - DNA, 75 bp, Artificial Sequence
  Synthetic
acaaaaccaggaagaggctcagatgcagaagtggtatatatgtggactaactgcagaggagaatttctccattgc

SEQ ID NO: 196005 - DNA, 75 bp, Artificial Sequence
  Synthetic
actattggcaggtcacctgggtcctagactgggattttgtatccacaccacccctggtgagactggcatataatc

SEQ ID NO: 196006 - DNA, 75 bp, Artificial Sequence
  Synthetic
aacatgacttggttcctcaattgggtggaaaacaaaacgggtcaggaacagcacaattatgcaccgtgccatata

SEQ ID NO: 196007 - DNA, 75 bp, Artificial Sequence
  Synthetic
tagtaaaagaaccattactagaagagacatattatacagatggctcttgtaacagggcttcaaaacaggggaaag

SEQ ID NO: 196008 - DNA, 75 bp, Artificial Sequence
  Synthetic
caggctatgtgacagatagaggaaaagacagagtaaaacctttagaacagaccaccaaccaacaagcagaattag

SEQ ID NO: 196009 - DNA, 75 bp, Artificial Sequence
  Synthetic
aactcaacagtaaccagcttgattgctaacattgacacggatggcaaccagacaaatattacctttagtgcagag

SEQ ID NO: 196010 - DNA, 75 bp, Artificial Sequence
  Synthetic
aagcctttgctatggccttagaagattcaggaccaaaagtaaacattgtgacagattcacaatatataatgggaa

SEQ ID NO: 196011 - DNA, 75 bp, Artificial Sequence
  Synthetic
gtggcagaactataccgattagaattgggggattataaattagtagagataacaccaattggcttcgcacctaca

SEQ ID NO: 196012 - DNA, 75 bp, Artificial Sequence
  Synthetic
taatagcaggacagccaacagaaacagagtccccactagtaagtaaaatcatagaagaacttataaggaaagaag

SEQ ID NO: 196013 - DNA, 75 bp, Artificial Sequence
  Synthetic
tcagaaaggagatactcctctactccaaggaggaataaaagaggtgtgttcgtgctagggttcttaggttttctc

SEQ ID NO: 196014 - DNA, 75 bp, Artificial Sequence
  Synthetic
cagtgtatgttggctgggtacctgctcataagggtattggtggcaatcaagaagtagatcatttggtgagtcagg

SEQ ID NO: 196015 - DNA, 75 bp, Artificial Sequence
  Synthetic
gcgacagcaggttctgcaatgggcacggcagctttaacgctgtctgctcagtctcggactttattggccgggata

SEQ ID NO: 196016 - DNA, 75 bp, Artificial Sequence
  Synthetic
gaattaggcaagtactgtttctagaaaaaatagaaccagctcaggaagaacatgagaaataccatagcaatgtta

SEQ ID NO: 196017 - DNA, 75 bp, Artificial Sequence
  Synthetic
gtgcagcaacagcaacagctgttggacgtggtcaagagacaacaggaaatgttgcgactgaccgtctggggaacg

SEQ ID NO: 196018 - DNA, 75 bp, Artificial Sequence
  Synthetic
aagagctacagcataaatttggtataccacaattagtagccaaacaaatagtaaatacttgtcatgtttgccagc

SEQ ID NO: 196019 - DNA, 75 bp, Artificial Sequence
  Synthetic
agaaaggagaagccatgcatggacaggtaaatacagaagtagggacatggcaaatggactgtacccacttagagg

SEQ ID NO: 196020 - DNA, 75 bp, Artificial Sequence
  Synthetic
ggcgcggctaaattcatggggatgtgcatttagacaagtctgccacactactgtaccatgggtaaataactcctt

SEQ ID NO: 196021 - DNA, 75 bp, Artificial Sequence
  Synthetic
gaaaagttgtcatcgtggcagtacatgtggccagtggctttatagaagcagaagtgatcccgcaggaaactggta

SEQ ID NO: 196022 - DNA, 75 bp, Artificial Sequence
  Synthetic
aaaacctgattgggacaacatgacgtggcaagagtgggaacaacaagtccgttacctagaggcaaatatcagtga

SEQ ID NO: 196023 - DNA, 75 bp, Artificial Sequence
  Synthetic
ggcaaacagccctgttcctactaaagctagcaggaaggtggcctatcactcatttgcacacagataatggtgcca

SEQ ID NO: 196024 - DNA, 75 bp, Artificial Sequence
  Synthetic
acagttagaacgggcacaaattcagcaagaaaagaatacgtatgaactacaaaaattaaatagctgggatgtttt

SEQ ID NO: 196025 - DNA, 75 bp, Artificial Sequence
  Synthetic
acttcacttcacaggaagtaaagatggtagcatggtgggtaggtatagagcatacctttggagtaccctataacc

SEQ ID NO: 196026 - DNA, 75 bp, Artificial Sequence
  Synthetic
taccaactggcttgacttaaccgcctgggtcaagtatattcaatatggagtttatataatagtaggaatagtagc

SEQ ID NO: 196027 - DNA, 75 bp, Artificial Sequence
  Synthetic
cgcaaagccaaggagtggtagaagccatgaatcaccatctaaagaaccaaatagagagaatcagagaacaggcaa

SEQ ID NO: 196028 - DNA, 75 bp, Artificial Sequence
  Synthetic
tttatataatagtaggaatagtagctcttagaatagtaatatatgtagtgcaaatgttaagtagactcaggaagg

SEQ ID NO: 196029 - DNA, 75 bp, Artificial Sequence
  Synthetic
atacaatggagaccatagtcctaatggcagctcactgcatgaattttaaaagaaggggaggaataggggatatga

SEQ ID NO: 196030 - DNA, 75 bp, Artificial Sequence
  Synthetic
tcccggttacatccaacagatccatatccacaaggaccaggaacagccaaccagaggagaaacagaagaagacgt

SEQ ID NO: 196031 - DNA, 75 bp, Artificial Sequence
  Synthetic
ctcctgcagaaagaatcattaacatgatatccacagaacaagaaatacaattcctccaatcaaaaaattcaaaat

SEQ ID NO: 196032 - DNA, 75 bp, Artificial Sequence
  Synthetic
tggagacaacgttggggacagattgtggccctggccgatcgcatatttacatttcctgatccacctgctagctcg

SEQ ID NO: 196033 - DNA, 75 bp, Artificial Sequence
  Synthetic
ttaaaaattttcgggtctattacagagaaggcagagaccaattgtggaaaggcccagcagacttactgtggaagg

SEQ ID NO: 196034 - DNA, 75 bp, Artificial Sequence
  Synthetic
cctcttgatcgggctgtacagcatctgcagggacttactatccaggatctccccgatcctccaaccgatcttccg

SEQ ID NO: 196035 - DNA, 75 bp, Artificial Sequence
  Synthetic
gagaaggagcggtccttattaaggtagggacagacattaaggtaatacccaggagaaaagcaaagatcatcagag

SEQ ID NO: 196036 - DNA, 75 bp, Artificial Sequence
  Synthetic
gagtcttcagagagcgctgacaacaatcagggactggctgagacttaaagcagcctacctgcagtatgggtgcga

SEQ ID NO: 196037 - DNA, 75 bp, Artificial Sequence
  Synthetic
attatggaggaggaaaagaattggatagtagttccaacttggagggtgccgagaaggttagagagatggcactcc

SEQ ID NO: 196038 - DNA, 75 bp, Artificial Sequence
  Synthetic
gtggatccaagaagcgttccgggcctttgcaaggattgcgagagagactcttacaaacacctggagagacttgtg

SEQ ID NO: 196039 - DNA, 75 bp, Artificial Sequence
  Synthetic
ctgatcaaacacctgagtataacacaaaagagctacagaaagtgtgttatgtgccccatcacaaggtaggatggg

SEQ ID NO: 196040 - DNA, 75 bp, Artificial Sequence
  Synthetic
gggggcagtgcagtgggtcgggaggaggatactcgcagtcccaaggaggatcaggcagggggcagaaattgccct

SEQ ID NO: 196041 - DNA, 75 bp, Artificial Sequence
  Synthetic
cttggtggacttgcagcagggtaatatttcctctaaaaaaaggatcacatttggaggtgcaagcctattggaatt

SEQ ID NO: 196042 - DNA, 75 bp, Artificial Sequence
  Synthetic
cctgtgaaggacagcggtatcagcagggagattttatgaataccccatggagaaccccagcaacagaaagagaga

SEQ ID NO: 196043 - DNA, 75 bp, Artificial Sequence
  Synthetic
tgacaccagagaagggatggctatcctcttatgcagtaaggttaacttggtacacaagaggtttttggacagatg

SEQ ID NO: 196044 - DNA, 75 bp, Artificial Sequence
  Synthetic
aagaattgtacaagcaacagaatatggatgatgtagatttagatgatgatgatagcctagtaggggtctctgtca

SEQ ID NO: 196045 - DNA, 75 bp, Artificial Sequence
  Synthetic
taacacctgattgcgcagaccaattactgcatgggagttatttctcttgctttacagcgggtgaagtgaggagag

SEQ ID NO: 196046 - DNA, 75 bp, Artificial Sequence
  Synthetic
caccaagagtacaattaagaacaatgacatacaaattggcagtagatatgtcacatttaataaaagaaagggggg

SEQ ID NO: 196047 - DNA, 75 bp, Artificial Sequence
  Synthetic
caagagtacaattaagaacaatgacatacaaattggcagtagatatgtcacatttaataaaagaaagggggggac

SEQ ID NO: 196048 - DNA, 75 bp, Artificial Sequence
  Synthetic
ccatcagaggagaacagttattgtcctgctgcaactttccatcggctcatagacagcaggtaccatctttacaat

SEQ ID NO: 196049 - DNA, 75 bp, Artificial Sequence
  Synthetic
ttctagcactcagagcattgcaagatgggagatccaagagagagaatcccaccaggaaattcagaagaagaaact

SEQ ID NO: 196050 - DNA, 75 bp, Artificial Sequence
  Synthetic
gtaggagaggctttcagttggctagaaagaactgtgagagatatcaacagggcagcagtgcaacatcttcccagg

SEQ ID NO: 196051 - DNA, 75 bp, Artificial Sequence
  Synthetic
gaacttattttccaggtctggcaaaggtcctggcaatactggcgtgatgaacagggcatgtcagaaagttatact

SEQ ID NO: 196052 - DNA, 75 bp, Artificial Sequence
  Synthetic
aagtatagatatctctgtctgatacagaaagctttatttatgcattgcaaaaagggatgtcaatgcttgggggaa

SEQ ID NO: 196053 - DNA, 75 bp, Artificial Sequence
  Synthetic
ggccatggaccaggaggatggagatcagggcctcctcctcctcccccaccaggattgatctaatggcagaaatac

SEQ ID NO: 196054 - DNA, 75 bp, Artificial Sequence
  Synthetic
agtcaaaagaaggttgccaaaaaattatttcagttttagaaccattagtaccaacagggtcagaaaatttaaaaa

SEQ ID NO: 196055 - DNA, 75 bp, Artificial Sequence
  Synthetic
ctccagaggacggggccccacaaagagagcctggggacgagtgggtgagagaaatactggaggaactaaaagaag

SEQ ID NO: 196056 - DNA, 75 bp, Artificial Sequence
  Synthetic
ttggtgcttgcacgcagaagagaaagtgaaagatactgaagaagcaaaaagaatagtagggagacatctagtggc

SEQ ID NO: 196057 - DNA, 75 bp, Artificial Sequence
  Synthetic
aagctgtaaggcattttgatcctcgcttgctaactgcgcttggtaactatatctataataggcatggagataccc

SEQ ID NO: 196058 - DNA, 75 bp, Artificial Sequence
  Synthetic
agaaacagaaactgcagagaaaatgccaaatataagtagaccaacagcaccacctagcgggaaagggggaaactt

SEQ ID NO: 196059 - DNA, 75 bp, Artificial Sequence
  Synthetic
ttgaaggagcaggagagctcattaaaatcctgcaaagagcaatcttcctccacttcagagggggatgtcggcact

SEQ ID NO: 196060 - DNA, 75 bp, Artificial Sequence
  Synthetic
ccccgtgcaacaaataggcggcaactatgtccatctgccgctgagtccccgaaccctaaatgcttgggtaaagtt

SEQ ID NO: 196061 - DNA, 75 bp, Artificial Sequence
  Synthetic
caaggatcggcagcagcaggggaggaaatcctctcacaactgtaccgccctcttgaggcgtgctctaataaatgc

SEQ ID NO: 196062 - DNA, 75 bp, Artificial Sequence
  Synthetic
tattgtaaaaaatgttgctatcattgccagctatgttttcttaaaaagggccttgggatatgttatgagcaaccc

SEQ ID NO: 196063 - DNA, 75 bp, Artificial Sequence
  Synthetic
ggcgaccatcaagcagcgatgcaaataatcagagaaattattaatgaagaagcagcagactgggatgtacaacat

SEQ ID NO: 196064 - DNA, 75 bp, Artificial Sequence
  Synthetic
agaagaaggagtccaaagaaggttaaggcttattcatctgctccatcaaacaagtaagtatggcatgtcttggca

SEQ ID NO: 196065 - DNA, 75 bp, Artificial Sequence
  Synthetic
ccaataccaggccccttaccagcggggcagctcagagatccacgaggatctgacatagcagggacaacaagcaca

SEQ ID NO: 196066 - DNA, 75 bp, Artificial Sequence
  Synthetic
atcagctgcttatcgctctattgtgtttaaatgcatgcgtgatatactgtactcagtatgtcactgtcttttatg

SEQ ID NO: 196067 - DNA, 75 bp, Artificial Sequence
  Synthetic
gtagaggaacagatcgaatggatgtataggcaagaaaatcctgtaccagtaggaaacatctataggagatggatc

SEQ ID NO: 196068 - DNA, 75 bp, Artificial Sequence
  Synthetic
gcatacctgcatggaggaacgcgacaattcccctcttttgtgcaaccaacaatagagatacatggggaaccacac

SEQ ID NO: 196069 - DNA, 75 bp, Artificial Sequence
  Synthetic
cagataggactgcagaagtgtgtcagaatgtacaatccaaccaacattctagacataaaacaaggaccaaaagag

SEQ ID NO: 196070 - DNA, 75 bp, Artificial Sequence
  Synthetic
agtgccttcctgataatggtgattattcagagttagcattaaatgtcacagaggcctttgatgcctggaataaca

SEQ ID NO: 196071 - DNA, 75 bp, Artificial Sequence
  Synthetic
tcgttccaaagctatgtggatagattctacaaaagcttaagggcagaacagacagatgcagcagtgaagaattgg

SEQ ID NO: 196072 - DNA, 75 bp, Artificial Sequence
  Synthetic
cagtaacagagcaagcagtggaagatgtctggagtctttttgagacatctataaaaccatgtgtaaagttgacac

SEQ ID NO: 196073 - DNA, 75 bp, Artificial Sequence
  Synthetic
atgacccagacgctgctagtgcaatcgaacccagactgtaagttagtactaaagggactagggatgaatcctacc

SEQ ID NO: 196074 - DNA, 75 bp, Artificial Sequence
  Synthetic
ccctttgtatagcaatgagatgtagtaaaactgaaacaaatagatggggattaacaggaacagcagcaacaacaa

SEQ ID NO: 196075 - DNA, 75 bp, Artificial Sequence
  Synthetic
ttagaagagatgctaaccgcctgtcaagggataggtggaccaggccagaaggccagactaatggcagaagcctta

SEQ ID NO: 196076 - DNA, 75 bp, Artificial Sequence
  Synthetic
ctagcccagcaatgcaagaatcaagtaaagtaataaatgaaacagagccttgtatacgaaataatagctgctcag

SEQ ID NO: 196077 - DNA, 75 bp, Artificial Sequence
  Synthetic
aaagaggccatgcgaccagcccctatcccatttgcagcagcccaacagaaaagggcaattaagtgttggaattgt

SEQ ID NO: 196078 - DNA, 75 bp, Artificial Sequence
  Synthetic
gattagaacaagaaccattggtgagttgtagatttaatatgacaggcttaaaaagggataagaaacaagagtata

SEQ ID NO: 196079 - DNA, 75 bp, Artificial Sequence
  Synthetic
ggaaaggaagggcactcggcaagacaatgccgagcgcctagaagacagggctgctggaaatgtggcaagtcagga

SEQ ID NO: 196080 - DNA, 75 bp, Artificial Sequence
  Synthetic
aagaaacatggtattctcatgacatagtttgtgaacagaatactagtgaaagtgaaagtaaatgttacatgaacc

SEQ ID NO: 196081 - DNA, 75 bp, Artificial Sequence
  Synthetic
cacatcatggcaaactgcccagatagacaggctggttttttagggcttggaccatggggaaagaagccccgcaac

SEQ ID NO: 196082 - DNA, 75 bp, Artificial Sequence
  Synthetic
actgcaacacctctgttatccaagagtcttgtgacaaacattattgggatgccataagatttaggtattgtgcac

SEQ ID NO: 196083 - DNA, 75 bp, Artificial Sequence
  Synthetic
gacaggctggttttttagggcttggaccatggggaaagaagccccgcaacttccccgtggtcccaagttcgcagg

SEQ ID NO: 196084 - DNA, 75 bp, Artificial Sequence
  Synthetic
cgccaggctatgctctgttaagatgtaatgatactaattactcaggatttatgcctaattgctctaaagtagtag

SEQ ID NO: 196085 - DNA, 75 bp, Artificial Sequence
  Synthetic
ggctaacaccaacagcacccccaatggatccagcagtggacctactggagaagtacatgcagcaagggagaaaac

SEQ ID NO: 196086 - DNA, 75 bp, Artificial Sequence
  Synthetic
tctctacatgcacaagaatgaggggaacacaaacctctacttggtttggatttaatggcactagatcagaaaata

SEQ ID NO: 196087 - DNA, 75 bp, Artificial Sequence
  Synthetic
agagagagcagagacaaagaccatacaaagaagtgacagaggacttgctgcatctcgagcaaggagagacaccac

SEQ ID NO: 196088 - DNA, 75 bp, Artificial Sequence
  Synthetic
gaacttatatatactggcatggtagagacaatagaacaataattagcttaaataagtattataatttaacaatgt

SEQ ID NO: 196089 - DNA, 75 bp, Artificial Sequence
  Synthetic
actgtagaaggccagggaataagacagtcttaccagtaaccattatgtcaggactagtgttccattctcaagcta

SEQ ID NO: 196090 - DNA, 75 bp, Artificial Sequence
  Synthetic
gacacaggggctgacgactcaatagtagcaggaatagagttagggagcaattatagtccaaaaatagtaggggga

SEQ ID NO: 196091 - DNA, 75 bp, Artificial Sequence
  Synthetic
tagcaggaatagagttagggagcaattatagtccaaaaatagtagggggaataggaggattcataaataccaaag

SEQ ID NO: 196092 - DNA, 75 bp, Artificial Sequence
  Synthetic
tcaataacaatccaaaacaagcttggtgttggtttggtggaaattggaaaggggcaatccaggaggtgaaggaga

SEQ ID NO: 196093 - DNA, 75 bp, Artificial Sequence
  Synthetic
ataggaggattcataaataccaaagaatataaagatgtagaaataagagtgctaaataaaaaggtaagagccacc

SEQ ID NO: 196094 - DNA, 75 bp, Artificial Sequence
  Synthetic
ccattgccaaccatcccaggtatcatggtaccaagaatattagtcagataaatctggcagaaccagcaggaggtg

SEQ ID NO: 196095 - DNA, 75 bp, Artificial Sequence
  Synthetic
ataatgacaggtgataccccaatcaacatttttggcagaaatatcctgacagccttgggcatgtcattaaattta

SEQ ID NO: 196096 - DNA, 75 bp, Artificial Sequence
  Synthetic
attcagaggtaaaatttatgtggactaactgcagaggagaattcctctactgtaagatgacatggttcctcaatt

SEQ ID NO: 196097 - DNA, 75 bp, Artificial Sequence
  Synthetic
ccagtcgccaaaatagaaccagtaaaagtaacattaaagccaggaaaagatgggccaaaacaaagacaatggccc

SEQ ID NO: 196098 - DNA, 75 bp, Artificial Sequence
  Synthetic
gggtagaaaacaggagcatggagggacaaacgtcaagggagagacataaaaggaactatgtgccttgccatatta

SEQ ID NO: 196099 - DNA, 75 bp, Artificial Sequence
  Synthetic
ttaacaagagaaaaaatagaagcactaagagaaatctgtgaaaaaatggaaagagaaggtcagctagaagaagcg

SEQ ID NO: 196100 - DNA, 75 bp, Artificial Sequence
  Synthetic
ggcaggtaattaacacatggcataaagtagggagaaatgtgtatttgcctccaagagaaggagatctcacctgca

SEQ ID NO: 196101 - DNA, 75 bp, Artificial Sequence
  Synthetic
cctccaactaatccctataatacccctacatttgcaattaagaaaaaggacaaaaacaaatggaggatgctgata

SEQ ID NO: 196102 - DNA, 75 bp, Artificial Sequence
  Synthetic
attctacagtaactagcatgattgcaaatattgatcggattaacaaaaatcaaacaaatatctccatgagcgcag

SEQ ID NO: 196103 - DNA, 75 bp, Artificial Sequence
  Synthetic
gattttagagaactaaacaaggtaactcaagatttcacagaggttcagttaggaattccacacccagcaggatta

SEQ ID NO: 196104 - DNA, 75 bp, Artificial Sequence
  Synthetic
aagtggcagaactgtatagattagagttgggggattataaattggtagaaataagaccaattggctttgctccca

SEQ ID NO: 196105 - DNA, 75 bp, Artificial Sequence
  Synthetic
gccaagaaaagaagaattactgtgttagatgtaggagatgcctacttttccatacccctatatgaggattttaga

SEQ ID NO: 196106 - DNA, 75 bp, Artificial Sequence
  Synthetic
caccagtgaaaagatattcctcagtgacaccgaggaataaaaggggagtatttgtgcttgggttcttgggttttc

SEQ ID NO: 196107 - DNA, 75 bp, Artificial Sequence
  Synthetic
gacaccgaggaataaaaggggagtatttgtgcttgggttcttgggttttctcgccacggcaggttctgcaatggg

SEQ ID NO: 196108 - DNA, 75 bp, Artificial Sequence
  Synthetic
cagtaaacaatgcagaaccaggaaaaagatatatatacaaagtcttaccacagggatggaaggggtcaccagcaa

SEQ ID NO: 196109 - DNA, 75 bp, Artificial Sequence
  Synthetic
cagggatggaaggggtcaccagcaatttttcaatacacaatgaggcaagtcttagaaccattcagaaaagcaaac

SEQ ID NO: 196110 - DNA, 75 bp, Artificial Sequence
  Synthetic
cttagaaccattcagaaaagcaaacccagatgtcattatcgttcagtacatggatgatatcttaatagctagtga

SEQ ID NO: 196111 - DNA, 75 bp, Artificial Sequence
  Synthetic
ctaaaaacctccagactagagtcactgccatcgagaaatacctaaaggatcaggcaagtctaaatgcatggggat

SEQ ID NO: 196112 - DNA, 75 bp, Artificial Sequence
  Synthetic
taaatggcctgggattttccaccccagacgaaaagttccaaaaggaccctccataccaatggatgggctatgaac

SEQ ID NO: 196113 - DNA, 75 bp, Artificial Sequence
  Synthetic
gtgcctttagacaggtctgccatactactgtgccatggataaacgacacattaacacctaattgggataatatga

SEQ ID NO: 196114 - DNA, 75 bp, Artificial Sequence
  Synthetic
tgtggccaaccaaatggaaattgcaaaaaatacaattgccccaaaaggaagtatggacagttaatgacatccaga

SEQ ID NO: 196115 - DNA, 75 bp, Artificial Sequence
  Synthetic
cgtggcaagaatgggaggaaaaggtgaactacttggaagaaaatatcacacagctattagaagcagctcaaatac

SEQ ID NO: 196116 - DNA, 75 bp, Artificial Sequence
  Synthetic
aactagtgggtgtcctaaactgggcggcacaaatctacccaggaataaagaccaaacacttatgtaagctaatta

SEQ ID NO: 196117 - DNA, 75 bp, Artificial Sequence
  Synthetic
aacaagagaaaaacatgtatgaattacagaaattaaataactgggatatctttggtaactggtttgatctcacct

SEQ ID NO: 196118 - DNA, 75 bp, Artificial Sequence
  Synthetic
gaggaaagatgacacccacggaagaagtacagtggacagaattagcagaagcagagctggaggaaaacaaaatta

SEQ ID NO: 196119 - DNA, 75 bp, Artificial Sequence
  Synthetic
catgggttaaatatgtatacttaggactgtatgtagtagcaggaataataatacttagaatagtgatatatgtag

SEQ ID NO: 196120 - DNA, 75 bp, Artificial Sequence
  Synthetic
agtacagtggacagaattagcagaagcagagctggaggaaaacaaaattatcttaagccaggaacaggagggaca

SEQ ID NO: 196121 - DNA, 75 bp, Artificial Sequence
  Synthetic
tacagctgttaggtagtcttaggaaaggttataggccagttttctcttcccacccctcttatgttgaacagatcc

SEQ ID NO: 196122 - DNA, 75 bp, Artificial Sequence
  Synthetic
gaagcaacagttcaaaaggatcaagacaatcagtggacatataaagtacaccagggagaaaaaattctaaaagta

SEQ ID NO: 196123 - DNA, 75 bp, Artificial Sequence
  Synthetic
ctatccaacgggaccaggaacagccaaccaaaggagaaatagaagaaggcgctggagacagcggtggctacagat

SEQ ID NO: 196124 - DNA, 75 bp, Artificial Sequence
  Synthetic
ccagggagaaaaaattctaaaagtaggaaaatatgcaaagataaaaaatacccataccaacggggtcaggttgtt

SEQ ID NO: 196125 - DNA, 75 bp, Artificial Sequence
  Synthetic
ggcacaggtagttcagaaaataggaaaagaagcactagtcatttggggacgaataccaaaatttcacctaccagt

SEQ ID NO: 196126 - DNA, 75 bp, Artificial Sequence
  Synthetic
cttggccttggcagataagatatatacatttcctgatccaccaactgattcgcctgttgacttggctatacagca

SEQ ID NO: 196127 - DNA, 75 bp, Artificial Sequence
  Synthetic
gaataccaaaatttcacctaccagtagaaagagagacctgggaacagtggtgggataactattggcaagtgacat

SEQ ID NO: 196128 - DNA, 75 bp, Artificial Sequence
  Synthetic
gctgcagggacttgctatccaggatttgccagagcctccagccgttgttccagagcatcagagaacgtctgcacc

SEQ ID NO: 196129 - DNA, 75 bp, Artificial Sequence
  Synthetic
ggatcccagactgggacttcgtatccaccccaccgttggtcaggttagcatttaacctggtaaaagatcctatac

SEQ ID NO: 196130 - DNA, 75 bp, Artificial Sequence
  Synthetic
ttgaaatagcttacctacaatatgggtggcagtatttcaaagaagcattccaagcgttcgggaaagctgcgcgag

SEQ ID NO: 196131 - DNA, 75 bp, Artificial Sequence
  Synthetic
caccccaccgttggtcaggttagcatttaacctggtaaaagatcctataccaggcgcagagaccttctacacgga

SEQ ID NO: 196132 - DNA, 75 bp, Artificial Sequence
  Synthetic
agactcttagccgcacggggagagaactatgggagactctggggcgggttggaagatggcttcgagctataccaa

SEQ ID NO: 196133 - DNA, 75 bp, Artificial Sequence
  Synthetic
tggatcttgcaataggcaatcaaaagagggaaaagcaggatatataacagatagaggaaaagacaaagtaaggat

SEQ ID NO: 196134 - DNA, 75 bp, Artificial Sequence
  Synthetic
attagagcaaactaccaaccaacaagcagaattagaagcctttgcaatggcagtaacagactcaggtccaaaagt

SEQ ID NO: 196135 - DNA, 75 bp, Artificial Sequence
  Synthetic
ggaggatcaggcaaggatttgagctcgcgcttttgtgaagctcagggccaaggctatagtgaaggagagttcatg

SEQ ID NO: 196136 - DNA, 75 bp, Artificial Sequence
  Synthetic
caatattgtagtagactcacagtatgtaatgggaatagtaacaggccaaccggctgaatcagagagtagaatagt

SEQ ID NO: 196137 - DNA, 75 bp, Artificial Sequence
  Synthetic
aatacaccttggagaaccccagcaacagggaaagataaattacaatataagcaacaaaacatggatgatgtagat

SEQ ID NO: 196138 - DNA, 75 bp, Artificial Sequence
  Synthetic
aaataaaattatagaagagatgataaaaaaggaagcaatctatgttgcatgggtcccggcccacaaaggcatagg

SEQ ID NO: 196139 - DNA, 75 bp, Artificial Sequence
  Synthetic
gaagaagataatgatttagtaggagtagcagtaagaccaagagtagcactgagaacaatgacttacaaattggca

SEQ ID NO: 196140 - DNA, 75 bp, Artificial Sequence
  Synthetic
caagagtagcactgagaacaatgacttacaaattggcagtagatatgtcacattttataaaagaaaaagggggac

SEQ ID NO: 196141 - DNA, 75 bp, Artificial Sequence
  Synthetic
aggaaatcaagaaattgaccacttagtaagtcagggcatcagacaagtattattcctagagagaatagagcccgc

SEQ ID NO: 196142 - DNA, 75 bp, Artificial Sequence
  Synthetic
tcaggaagaacatggaaaatatcatagcaatgtaaaagaactagcccataagtttggattacccaacctggtggc

SEQ ID NO: 196143 - DNA, 75 bp, Artificial Sequence
  Synthetic
aagacaaatagtaaacacatgtgcccagtgccaacaaaaaggggaagctatacatgggcaagtaaatgcagaact

SEQ ID NO: 196144 - DNA, 75 bp, Artificial Sequence
  Synthetic
cagtgccaacaaaaaggggaagctatacatgggcaagtaaatgcagaactaggcacctggcaaatggactgcaca

SEQ ID NO: 196145 - DNA, 75 bp, Artificial Sequence
  Synthetic
tatagaagcagaagtcatcccacaggaatcaggaaggcaaacagcactcttcctattaaaactggccagtaggtg

SEQ ID NO: 196146 - DNA, 75 bp, Artificial Sequence
  Synthetic
tcctattaaaactggccagtaggtggccaataacacacttgcacacagataatggtgccaacttcacttcacagg

SEQ ID NO: 196147 - DNA, 75 bp, Artificial Sequence
  Synthetic
ccttacaatccacaaagccagggagtagtagaagcaatgaatcaccacctgaaaaatcagatagaaagaattaga

SEQ ID NO: 196148 - DNA, 75 bp, Artificial Sequence
  Synthetic
aattcaaaattaaaaaattttcgggtctatttcagagaaggcagaaatcaactgtggcaaggacctggggagcta

SEQ ID NO: 196149 - DNA, 75 bp, Artificial Sequence
  Synthetic
ctgtggaaaggggacggagcagtcatagtcaaggtagggacagatataaaagtaataccaagaagaaaggccaag

SEQ ID NO: 196150 - DNA, 75 bp, Artificial Sequence
  Synthetic
tagtcaaggtagggacagatataaaagtaataccaagaagaaaggccaagatcatcagagactatggaccaaggc

SEQ ID NO: 196151 - DNA, 75 bp, Artificial Sequence
  Synthetic
aagagatggatagcggttcccacctggagggtgccagggaggatggagaaatggcatagccttatcaagtatcta

SEQ ID NO: 196152 - DNA, 75 bp, Artificial Sequence
  Synthetic
ggagggtgccagggaggatggagaaatggcatagccttatcaagtatctaaaatacagaacaaaagatctagaac

SEQ ID NO: 196153 - DNA, 75 bp, Artificial Sequence
  Synthetic
gaaacagtcatctagagatacaggcatattggaacctaacaccagaaaaaggatggctctcctcttattcagtaa

SEQ ID NO: 196154 - DNA, 75 bp, Artificial Sequence
  Synthetic
atattggaacctaacaccagaaaaaggatggctctcctcttattcagtaagaatgacttggtactcagaagggtt

SEQ ID NO: 196155 - DNA, 75 bp, Artificial Sequence
  Synthetic
atttctcttgctttacggcaggtgaagtaagaagagccatcaggggagaaaagtcattgtcctgctgcaattatc

SEQ ID NO: 196156 - DNA, 75 bp, Artificial Sequence
  Synthetic
cccaagcccataagtccaaggtaccgtcactccaatttctggccttagtagtagtacagcaaaatgacaaacccc

SEQ ID NO: 196157 - DNA, 75 bp, Artificial Sequence
  Synthetic
tactggcatgatgagcaagggatgtcacgaagctacacaaagtatagatatttgtgcttaatgcagaaagctgtg

SEQ ID NO: 196158 - DNA, 75 bp, Artificial Sequence
  Synthetic
ttcatgcatttcaagaaagggtgcacttgccggggggaaggacatgggccaggagggtggagatcaggacctccc

SEQ ID NO: 196159 - DNA, 75 bp, Artificial Sequence
  Synthetic
aggagggtggagatcaggacctccccctcctcctcccccaggtttagtctaatgactgaagcaccagcagagttt

SEQ ID NO: 196160 - DNA, 75 bp, Artificial Sequence
  Synthetic
gaagctttaaagcattttgaccctcgcttgctaactgctcttggctactatatctatactagacatggagacacc

SEQ ID NO: 196161 - DNA, 75 bp, Artificial Sequence
  Synthetic
gcttgctaactgctcttggctactatatctatactagacatggagacacccttgaaggcgccagagagctcatta

SEQ ID NO: 196162 - DNA, 75 bp, Artificial Sequence
  Synthetic
cttgaaggcgccagagagctcattagggtcctacaacgagccctcttcacgcacttcagagcaggatgtggccac

SEQ ID NO: 196163 - DNA, 75 bp, Artificial Sequence
  Synthetic
tcaagaattggccaaccaaggggaagaaatcctctctcagctataccgacccctagaaacatgcaataacaaatg

SEQ ID NO: 196164 - DNA, 75 bp, Artificial Sequence
  Synthetic
gaaatcctctctcagctataccgacccctagaaacatgcaataacaaatgcttttgtaaggggtgctgcttccat

SEQ ID NO: 196165 - DNA, 75 bp, Artificial Sequence
  Synthetic
tgccagctgtgttttttaaacaaggggctcgggatatgttatgaccgaaagggcagacgaagaaggagtccgaag

SEQ ID NO: 196166 - DNA, 75 bp, Artificial Sequence
  Synthetic
aaaactaaggctcattcgtctcctgcatcagacaagtgagtacaatgagtggtaaaattcagctgcttgttgcct

SEQ ID NO: 196167 - DNA, 75 bp, Artificial Sequence
  Synthetic
catcagacaagtgagtacaatgagtggtaaaattcagctgcttgttgcctttctgctaactagtgcttgcttaat

SEQ ID NO: 196168 - DNA, 75 bp, Artificial Sequence
  Synthetic
atgcatccattcccctcttttgtgcaactaaaaatagagatacttggggaaccatacagtgcttgccagacaatg

SEQ ID NO: 196169 - DNA, 75 bp, Artificial Sequence
  Synthetic
accatacagtgcttgccagacaatgatgattatcaagagatacctttgaatgtaacagaggcttttgacgcatgg

SEQ ID NO: 196170 - DNA, 75 bp, Artificial Sequence
  Synthetic
tagaagatgtctggaatctatttgagacatcaataaaaccatgtgtcaaattaacgcctttatgtgtaacaatga

SEQ ID NO: 196171 - DNA, 75 bp, Artificial Sequence
  Synthetic
ttaacgcctttatgtgtaacaatgaactgtaacgcaagtacagagagcgcagttgcaactacaagcccatctgga

SEQ ID NO: 196172 - DNA, 75 bp, Artificial Sequence
  Synthetic
cctgatatgataaatgatactgatccatgcatacaattgaacaattgctcaggactgagggaggaagacatggtc

SEQ ID NO: 196173 - DNA, 75 bp, Artificial Sequence
  Synthetic
gagtgtcagttcaatatgacaggactagagttagataagaaaaaacagtatagtgaaacctggtactcaaaagat

SEQ ID NO: 196174 - DNA, 75 bp, Artificial Sequence
  Synthetic
tagtgaaacctggtactcaaaagatgtggtttgtgaatcagataacagcacagaccgaaaaagatgttacatgaa

SEQ ID NO: 196175 - DNA, 75 bp, Artificial Sequence
  Synthetic
gagtcatgtgacaagcactattgggatgctatgagatttagatactgtgcaccaccgggttttgtcttgctaagg

SEQ ID NO: 196176 - DNA, 75 bp, Artificial Sequence
  Synthetic
tgcaatgataccaattactcaggctttgagcccaattgctctaaagtagtagcttctacatgtacaagaatgatg

SEQ ID NO: 196177 - DNA, 75 bp, Artificial Sequence
  Synthetic
gctttaatggcactagggcagaaaatagaacatatatctattggcatggtagggataacagaactattatcagct

SEQ ID NO: 196178 - DNA, 75 bp, Artificial Sequence
  Synthetic
taaacaaatattataatctcaccatactttgtaggagaccagaaaataaaacagttgtaccaataacactcatgt

SEQ ID NO: 196179 - DNA, 75 bp, Artificial Sequence
  Synthetic
acagttgtaccaataacactcatgtcaggccgcagatttcactcccagaagatcatcaataaaaaacccaggcaa

SEQ ID NO: 196180 - DNA, 75 bp, Artificial Sequence
  Synthetic
gcatggtgccggttcaaaggcgagtggagggaagccatgcaggaggtgaaacaaacccttgtaaaacatcccagg

SEQ ID NO: 196181 - DNA, 75 bp, Artificial Sequence
  Synthetic
tataaaggaaccaatgacacaaataaaattaactttacagcaccagaaaaagactcagacccagaagtagcatat

SEQ ID NO: 196182 - DNA, 75 bp, Artificial Sequence
  Synthetic
atgtggactaactgcagaggagaattcctctattgcaacatgacttggttccttaattgggtagaaaacaagacg

SEQ ID NO: 196183 - DNA, 75 bp, Artificial Sequence
  Synthetic
ggtcaacagcataactatgtgccgtgccatatagagcaaataattaatacctggcataaggtagggaaaaatgta

SEQ ID NO: 196184 - DNA, 75 bp, Artificial Sequence
  Synthetic
tatttgcctcctagggaaggagagttgtcctgcgaatcaacagtgaccagtatcattgctaacattgatgttgat

SEQ ID NO: 196185 - DNA, 75 bp, Artificial Sequence
  Synthetic
ggagataaccggacaaatattacctttagtgcagaggtggcagaactataccgattggaattgggggattataaa

SEQ ID NO: 196186 - DNA, 75 bp, Artificial Sequence
  Synthetic
ttagtgcagaggtggcagaactataccgattggaattgggggattataaattagtagaagtaacaccaattggct

SEQ ID NO: 196187 - DNA, 75 bp, Artificial Sequence
  Synthetic
tcgcccctacagcagaaaaaagatactcctctgctccagggagacataagagaggtgtgcttgtgctagggttcc

SEQ ID NO: 196188 - DNA, 75 bp, Artificial Sequence
  Synthetic
taggttttctcacgacagcaggtgctgcaatgggggcggcgtctctgacgctgtcggctcagtctcggactttat

SEQ ID NO: 196189 - DNA, 75 bp, Artificial Sequence
  Synthetic
tgcaatgggggcggcgtctctgacgctgtcggctcagtctcggactttattccgtgggatagtgcagcaacagca

SEQ ID NO: 196190 - DNA, 75 bp, Artificial Sequence
  Synthetic
tctggggaactaaaaacctccaggcaagagtcactgctattgagaagtacctagcagaccaggcgcgactaaatt

SEQ ID NO: 196191 - DNA, 75 bp, Artificial Sequence
  Synthetic
catggggatgtgcgtttagacaagtctgccacactactgtaccatgggtaaatgacaccttaacacctgagtgga

SEQ ID NO: 196192 - DNA, 75 bp, Artificial Sequence
  Synthetic
ctgccacactactgtaccatgggtaaatgacaccttaacacctgagtggaacaacatgacatggcaagaatggga

SEQ ID NO: 196193 - DNA, 75 bp, Artificial Sequence
  Synthetic
acacaaaatccgcttcctagaggcaaatatcagtgagagtttagaacaggcacaaatccagcaagaaaagaatat

SEQ ID NO: 196194 - DNA, 75 bp, Artificial Sequence
  Synthetic
gtatgagctgcaaaagctaaatagctgggatgtttttggcaattggtttgacttaacctcctggatcaagtatat

SEQ ID NO: 196195 - DNA, 75 bp, Artificial Sequence
  Synthetic
acttaacctcctggatcaagtatattcaatatggagtcatgatagtagtaggaatagtagctctcagaatagtaa

SEQ ID NO: 196196 - DNA, 75 bp, Artificial Sequence
  Synthetic
aacagatccatatccacaaggactgggaacagccagacagagaagaaacagaagaagacgttgggaacgacgttg

SEQ ID NO: 196197 - DNA, 75 bp, Artificial Sequence
  Synthetic
ggaacagccagacagagaagaaacagaagaagacgttgggaacgacgttggaagcagatcctggccttggccgat

SEQ ID NO: 196198 - DNA, 75 bp, Artificial Sequence
  Synthetic
agaatatatacatttcctgatccgcctgctgatccgcctcttgaccagactatacaacagctgcagggacttact

SEQ ID NO: 196199 - DNA, 75 bp, Artificial Sequence
  Synthetic
atccagactctacctgatcctccaaccactcagagactggctgagactcaaggcagcctacctgcagtatgggtg

SEQ ID NO: 196200 - DNA, 75 bp, Artificial Sequence
  Synthetic
cgagtggatccaagaagcgttccaggccctcgcgagggttacaagagagactcttacgagcgcggggaggagctt

SEQ ID NO: 196201 - DNA, 75 bp, Artificial Sequence
  Synthetic
gtggggggctctgggacgaatcggaagggggatactcgcagttccacgaaggatcaggcagggagcagaaattgc

SEQ ID NO: 196202 - DNA, 75 bp, Artificial Sequence
  Synthetic
cctcctgtgagggacagagatatcagcaaggagactttatgaataccccatggagaaccccagcaacagaaaagg

SEQ ID NO: 196203 - DNA, 75 bp, Artificial Sequence
  Synthetic
aaaaagaatcgtacaggcaacaaaatatggatgatgtagattcagatgatgatgacctagtaggggtctctgaca

SEQ ID NO: 196204 - DNA, 75 bp, Artificial Sequence
  Synthetic
catcaagagtaccattgagagcaatgacatatagaatggcagtagacatgtcagatttaataaaagataaggggg

SEQ ID NO: 196205 - DNA, 75 bp, Artificial Sequence
  Synthetic
caagagtaccattgagagcaatgacatatagaatggcagtagacatgtcagatttaataaaagataaggggggac

SEQ ID NO: 196206 - DNA, 75 bp, Artificial Sequence
  Synthetic
ggttggcgcccgaacaggacttgaagaagactgagaagccttggaacaagggctgggtgaaggcagtaagggcgg

SEQ ID NO: 196207 - DNA, 75 bp, Artificial Sequence
  Synthetic
caaagcggcgtgtggacgggagtcgagaggcctccgggtgaagggtaagtacctacaccaaaaactgtagccaaa

SEQ ID NO: 196208 - DNA, 75 bp, Artificial Sequence
  Synthetic
caggtagaagattgtgggagatgggcgcgagaaactccgtcttgagagggaaaaaagcagatgaattagaaaaaa

SEQ ID NO: 196209 - DNA, 75 bp, Artificial Sequence
  Synthetic
tgggcagcgaatgaattggacagattcggattagcagagagcctgttggagtcaaaagaaggttgccaaaaaatt

SEQ ID NO: 196210 - DNA, 75 bp, Artificial Sequence
  Synthetic
aatagtacagagacatctagtggcagaaacaggaactgcagagaaaatgccaaatacaagtagaccaacagcacc

SEQ ID NO: 196211 - DNA, 75 bp, Artificial Sequence
  Synthetic
acctagcgggaaaaacttccccgtgcagcaagtagctggcaactatacccatataccactgagtcccggaactct

SEQ ID NO: 196212 - DNA, 75 bp, Artificial Sequence
  Synthetic
cagatgcttaattgtgtgggcgaccatcaagcagctatgcaaataatcagggaaattattaatgaggaagcagca

SEQ ID NO: 196213 - DNA, 75 bp, Artificial Sequence
  Synthetic
gcagggacaacaagcacagtagaagagcagatccagtggatgtttagaccacaaaatcctgtaccagtaggcaac

SEQ ID NO: 196214 - DNA, 75 bp, Artificial Sequence
  Synthetic
atctataggagatggattcagataggactgcaaaagtgcgtcaggatgtacaatccaaccaacatcctagacata

SEQ ID NO: 196215 - DNA, 75 bp, Artificial Sequence
  Synthetic
gactgcaaaagtgcgtcaggatgtacaatccaaccaacatcctagacataaatcaaggaccaaaggaaccattcc

SEQ ID NO: 196216 - DNA, 75 bp, Artificial Sequence
  Synthetic
aaagctatgtagataggttctacaaaagcttgagggcagaacaaacagatccagcagtaaaaaattggatgaccc

SEQ ID NO: 196217 - DNA, 75 bp, Artificial Sequence
  Synthetic
aaacactgctaatacagaatgccaacccagattgtaaattagtactaaaaggattaggaatgaatcctaccttag

SEQ ID NO: 196218 - DNA, 75 bp, Artificial Sequence
  Synthetic
aagaaatgctgaccacctgtcagggggtagggggaccaggccagaaagctagattaatggcagaagccctaaagg

SEQ ID NO: 196219 - DNA, 75 bp, Artificial Sequence
  Synthetic
aggtcatggcaccagcccccatcccatttgcagcagcccagcagagaaagacattcaagtgctggaattgtggaa

SEQ ID NO: 196220 - DNA, 75 bp, Artificial Sequence
  Synthetic
aggaaggacactcggcaagacaatggagcgcgcctagaagacagggctgctggaagtgtggtaagtcaggacatg

SEQ ID NO: 196221 - DNA, 75 bp, Artificial Sequence
  Synthetic
tcatggcaaattgcccagatagacaggctggttttttagggattggccactggggaaagaaggcccgcaacttcc

SEQ ID NO: 196222 - DNA, 75 bp, Artificial Sequence
  Synthetic
aacaccaacagcacccccattggatccagcagtggacctactggagaaatatatgcagcaaggaaaaaggcaaag

SEQ ID NO: 196223 - DNA, 75 bp, Artificial Sequence
  Synthetic
ggagcagagagagagaccgtacaaggaagtgacagaggacttactgcgtttcgagcaggcagagacaccatgcag

SEQ ID NO: 196224 - DNA, 75 bp, Artificial Sequence
  Synthetic
agtagtcacagcacacattgagggtcagccagtagaagttttgttagacacaagggctaacgactcaatagtagc

SEQ ID NO: 196225 - DNA, 75 bp, Artificial Sequence
  Synthetic
taaaaatgtagaaatagaagtcctaggtaaaagggtaaaagccaccataatgacaggtgataccccgatcaacat

SEQ ID NO: 196226 - DNA, 75 bp, Artificial Sequence
  Synthetic
ttttggcagaaatgttctgacagctttaggcatgtcattaaacctgccagttgccaagatagaaccaataaaaat

SEQ ID NO: 196227 - DNA, 75 bp, Artificial Sequence
  Synthetic
ttgccaagatagaaccaataaaaataatgctaaagccagggaaagatggaccaagactaaaacaatggcctttaa

SEQ ID NO: 196228 - DNA, 75 bp, Artificial Sequence
  Synthetic
aacaaatggagaatgctaatagactttagggagctaaacaaggtaactcaggatttcacagaaattcagttagga

SEQ ID NO: 196229 - DNA, 75 bp, Artificial Sequence
  Synthetic
attccacacccagcaggattggccaaaaagaggagaattactgtactagatgtaggggatgcttacttttccata

SEQ ID NO: 196230 - DNA, 75 bp, Artificial Sequence
  Synthetic
tgtaggggatgcttacttttccataccactacatgaggactttagacagtatactgcattcactctaccatcagt

SEQ ID NO: 196231 - DNA, 75 bp, Artificial Sequence
  Synthetic
ggtggaaggggtcaccagcaatttttcaatacacaatgaggcagatcttagaaccattcagaaaagcaaacgagg

SEQ ID NO: 196232 - DNA, 75 bp, Artificial Sequence
  Synthetic
atgtcattatcattcagtacatggatgatatcttaatagccagcgacaggacagacttagaacatgacaaagtgg

SEQ ID NO: 196233 - DNA, 75 bp, Artificial Sequence
  Synthetic
tcctgcagctaaaagaacttctaaatggactaggattttccaccccagatgagaaattccagaaagaccctccat

SEQ ID NO: 196234 - DNA, 75 bp, Artificial Sequence
  Synthetic
atcgctggatgggctatgaattatggccaactaaatggaagttgcaaaaaatacagctgccccaaaaagaagtat

SEQ ID NO: 196235 - DNA, 75 bp, Artificial Sequence
  Synthetic
ggacagtcaatgacatccaaaagctagtgggtgtcctaaattgggcagcacaaatctacccagggataaagacca

SEQ ID NO: 196236 - DNA, 75 bp, Artificial Sequence
  Synthetic
aaaaatgacactcacagaagaggtacagtggacagaattagcagaagcagagctagaggaaaacagaattatctt

SEQ ID NO: 196237 - DNA, 75 bp, Artificial Sequence
  Synthetic
aagccagaaacaagaaggacactattaccaggaagaaaaaaagttagaagcaacagtccagaaagatcaagacaa

SEQ ID NO: 196238 - DNA, 75 bp, Artificial Sequence
  Synthetic
tcagtggacatataaggtacaccagggggagaaaattctcaaaggtgggaaaatatgcaaagataaaaaataccc

SEQ ID NO: 196239 - DNA, 75 bp, Artificial Sequence
  Synthetic
ggggagaaaattctcaaaggtgggaaaatatgcaaagataaaaaatacccataccaacgggtcagattgttagca

SEQ ID NO: 196240 - DNA, 75 bp, Artificial Sequence
  Synthetic
ataactactggcaagtaacatggatcccagactgggactttgtatctaccccaccactggtcaggctagcattta

SEQ ID NO: 196241 - DNA, 75 bp, Artificial Sequence
  Synthetic
acctggtaggagagcctgtaccaggcgcagaaactttctacacagatggatcctgcaataggcagtcaaaagaag

SEQ ID NO: 196242 - DNA, 75 bp, Artificial Sequence
  Synthetic
cgcagaaactttctacacagatggatcctgcaataggcagtcaaaagaagggaaagcaggatatataacagatag

SEQ ID NO: 196243 - DNA, 75 bp, Artificial Sequence
  Synthetic
gagcaaactaccaatcagcaagcagaattagaagcctttgcaatggcactaacagactcaggtccaaaagctaat

SEQ ID NO: 196244 - DNA, 75 bp, Artificial Sequence
  Synthetic
attatagtagactcacaatatgtaatggggatagtagcaggccaaccaacagagtcagagaatagaatagtaaat

SEQ ID NO: 196245 - DNA, 75 bp, Artificial Sequence
  Synthetic
gtcagggcattagacaagtattattcctagagaaaatagaacccgcgcaggaagaacatgaaaaatatcatagca

SEQ ID NO: 196246 - DNA, 75 bp, Artificial Sequence
  Synthetic
atataaaagaactgtcccataaatttggaatacccaagctagtggcaagacaaatagtaaacacatgtgcccatg

SEQ ID NO: 196247 - DNA, 75 bp, Artificial Sequence
  Synthetic
tggaatacccaagctagtggcaagacaaatagtaaacacatgtgcccatgtgcaacagaaaggggaggctataca

SEQ ID NO: 196248 - DNA, 75 bp, Artificial Sequence
  Synthetic
acttggcaaatggactgcacacatttagaaggaaaagtcattatagtagcagtacatgttgcaagtggatttata

SEQ ID NO: 196249 - DNA, 75 bp, Artificial Sequence
  Synthetic
gaggcagaagttatcccacaggaatcaggaaggcaaacagcactgttcttactgaaactggccagtaggtggcca

SEQ ID NO: 196250 - DNA, 75 bp, Artificial Sequence
  Synthetic
atagaacaaacctttggagtgccttacaatccacaaagccaaggagtagtagaagcaatgaatcatcatctaaaa

SEQ ID NO: 196251 - DNA, 75 bp, Artificial Sequence
  Synthetic
attaatggcagttcattgcatgaattttaaaagaaggggaggaataggggatatgaccccagcagaaagaataat

SEQ ID NO: 196252 - DNA, 75 bp, Artificial Sequence
  Synthetic
atacaattcctccaagcaaaaaattcaaaattaaaaaattttcgggtctatttcagagaaggcagagatcagctg

SEQ ID NO: 196253 - DNA, 75 bp, Artificial Sequence
  Synthetic
tggaaaggacctggggaactgctgtggaagggagacggagcagtcatagtcaaggtagggacagaaataaaagta

SEQ ID NO: 196254 - DNA, 75 bp, Artificial Sequence
  Synthetic
gtaccaagaaggaaagccaagatcattaaagactatggaggaaggcaagagatggatagtggttcccatttggag

SEQ ID NO: 196255 - DNA, 75 bp, Artificial Sequence
  Synthetic
ggtgccagggaggatggagagatggcatagcttggtcaagtacttgaaatacagaacaaaagacttagagaaggt

SEQ ID NO: 196256 - DNA, 75 bp, Artificial Sequence
  Synthetic
atgctatgttccccatcataaggtggggtgggcatggtggacttgcagcagggtaatattcccactgaaagagaa

SEQ ID NO: 196257 - DNA, 75 bp, Artificial Sequence
  Synthetic
cagtcatctggagatacaagcatattggaacttaacaccagaaaaaggatggctctcctctcactcagtgagaat

SEQ ID NO: 196258 - DNA, 75 bp, Artificial Sequence
  Synthetic
aacttggtatacagaaaagttctggacagatgttaccccagactgtgcagataccctaatacatagcacttattt

SEQ ID NO: 196259 - DNA, 75 bp, Artificial Sequence
  Synthetic
ctcttgctttacggcaggtgaagtaagaagagccatcagaggggaaaaattattgtcctgctgcaaatacccccg

SEQ ID NO: 196260 - DNA, 75 bp, Artificial Sequence
  Synthetic
agcgcatagatcccaggtaccgtcacttcaatttctggccttagtggtagtgcaacaaaatgacagatcccaggg

SEQ ID NO: 196261 - DNA, 75 bp, Artificial Sequence
  Synthetic
aaacagtgccaccaggaaacagcggcgaggagactatcgaagaggccttcgcatggctagacaggacagtagagg

SEQ ID NO: 196262 - DNA, 75 bp, Artificial Sequence
  Synthetic
ctataaacagagaggcagtgaatcaccacccacgagagctcattttccaggtctggcagaggtcctggagatact

SEQ ID NO: 196263 - DNA, 75 bp, Artificial Sequence
  Synthetic
ggcatgatgaacaagggatgtcaacaagctacacaaaatatagatatttgtgcttaatacagatggcaatgtaca

SEQ ID NO: 196264 - DNA, 75 bp, Artificial Sequence
  Synthetic
tgcatgctaagagagatggcacttgcctggggggaggcatgggccagaagggtggagatcagggacctccccctc

SEQ ID NO: 196265 - DNA, 75 bp, Artificial Sequence
  Synthetic
ctccacctccaggtttagtctaatgactgaagcaccaacagaactccccccggaggataggaccccaccgaggga

SEQ ID NO: 196266 - DNA, 75 bp, Artificial Sequence
  Synthetic
actgaagcaccaacagaactccccccggaggataggaccccaccgagggagccaggggatgcatgggtaatagaa

SEQ ID NO: 196267 - DNA, 75 bp, Artificial Sequence
  Synthetic
atcctgagagaaatagaagaagaagctttaaggcattttgaccctcgcttgctaactgctcttggcagatatatc

SEQ ID NO: 196268 - DNA, 75 bp, Artificial Sequence
  Synthetic
tatactaggcatggagacacccttgaaggcgccagagagctcattagaatcctgcaacgagccctcttcgcgcac

SEQ ID NO: 196269 - DNA, 75 bp, Artificial Sequence
  Synthetic
ttcagagcaggatgtggccactcaagaattggccagacaaggggaggaaatcctctctcagctataccgacccct

SEQ ID NO: 196270 - DNA, 75 bp, Artificial Sequence
  Synthetic
agaggcatgcactaactcctgctattgcaagaaatgctgctacgattgccagctgtgttttttacaaaaggggct

SEQ ID NO: 196271 - DNA, 75 bp, Artificial Sequence
  Synthetic
cgggatatggtatgaccgaaagggcagacgaagaaggactccaaagaaaactaaggctcatccgtcttctgcatc

SEQ ID NO: 196272 - DNA, 75 bp, Artificial Sequence
  Synthetic
agacaagtgagtatgaagggtagtaagaatcaactgctgattgctattgtactagctagtgcttacctaatacat

SEQ ID NO: 196273 - DNA, 75 bp, Artificial Sequence
  Synthetic
actagctagtgcttacctaatacattgcaagcaatttgtgactgttttctacggcatacccgcgtggaggaatgc

SEQ ID NO: 196274 - DNA, 75 bp, Artificial Sequence
  Synthetic
tacagtgcttaccagacaatgatgattatcaggaaataactctaaatgtgacagaggctttcgatgcatggaata

SEQ ID NO: 196275 - DNA, 75 bp, Artificial Sequence
  Synthetic
ggatgtctggaatctatttgagacatcaataaaaccatgtgtcaaattaacacccttatgtgtagcaatgaactg

SEQ ID NO: 196276 - DNA, 75 bp, Artificial Sequence
  Synthetic
tacaaggaacatgaccacatggacagggaggacagacacccaaaatatcacaattataaatgacacttcccatgc

SEQ ID NO: 196277 - DNA, 75 bp, Artificial Sequence
  Synthetic
gcgtgcagacaactgcacaggattaaaggaggaagaaatgatcgactgtcagtttagtatgacaggattagagag

SEQ ID NO: 196278 - DNA, 75 bp, Artificial Sequence
  Synthetic
agacaagagaaaacagtatactgaagcatggtactcaaaagatgtggtttgtgacaataacacctcaagtcagag

SEQ ID NO: 196279 - DNA, 75 bp, Artificial Sequence
  Synthetic
caagtgttacatgaaccattgcaacacatcagtcatcacagagtcatgtgataagcactattgggatgctatgag

SEQ ID NO: 196280 - DNA, 75 bp, Artificial Sequence
  Synthetic
acatcagtcatcacagagtcatgtgataagcactattgggatgctatgaggtttagatactgtgcaccaccgggt

SEQ ID NO: 196281 - DNA, 75 bp, Artificial Sequence
  Synthetic
tttgccttactaagatgcaatgataccaattattcaggctttgcacctaactgctctaaagtagtagctgctaca

SEQ ID NO: 196282 - DNA, 75 bp, Artificial Sequence
  Synthetic
tgcaccagaatgatggaaacgcaaacttctacatggtttggctttaatggcactagagcagaaaatagaacatat

SEQ ID NO: 196283 - DNA, 75 bp, Artificial Sequence
  Synthetic
cactagagcagaaaatagaacatatatctattggcatggtaaagataacagaactattatcagcttaaataactt

SEQ ID NO: 196284 - DNA, 75 bp, Artificial Sequence
  Synthetic
ttataatctcactatgcattgtaagaggccgggaaataagacagtgttaccaataacatttatgtcagggtttaa

SEQ ID NO: 196285 - DNA, 75 bp, Artificial Sequence
  Synthetic
gtttcactcccagccagtcatcaataaaaaacccaggcaagcatggtgttggttcgaaggccaatggaaggaagc

SEQ ID NO: 196286 - DNA, 75 bp, Artificial Sequence
  Synthetic
catgcaggaggtgaaggagacccttgcgaaacatcccagatataaagggaacaggagccgcacagagaatattaa

SEQ ID NO: 196287 - DNA, 75 bp, Artificial Sequence
  Synthetic
acaggagccgcacagagaatattaaatttaaagcaccagggagaggctcagacccagaagtaacatacatgtgga

SEQ ID NO: 196288 - DNA, 75 bp, Artificial Sequence
  Synthetic
ctaactgcagaggagaatctctctactgcaacatgacttggttcctcaattgggtagagaacaggacgggtcaga

SEQ ID NO: 196289 - DNA, 75 bp, Artificial Sequence
  Synthetic
aacagcgcaattatgcaccgtgccgtataaggcaaataattaatacctggcacagggtagggaaaaatctatatt

SEQ ID NO: 196290 - DNA, 75 bp, Artificial Sequence
  Synthetic
tgcctcccagggaaggggagttgacctgcaactcaacggtgaccagcataattgccaacattgatgcgggagatc

SEQ ID NO: 196291 - DNA, 75 bp, Artificial Sequence
  Synthetic
aaacaaatattacctttagtgcagaggcggcagaactataccgattggaattgggggattacaaattagtagaaa

SEQ ID NO: 196292 - DNA, 75 bp, Artificial Sequence
  Synthetic
tcacaccaattggcttcgcacctacatcagtaaagagatactcctctgctcaccagagacatacaagaggtgtgt

SEQ ID NO: 196293 - DNA, 75 bp, Artificial Sequence
  Synthetic
caccagagacatacaagaggtgtgtttgtgctagggttcctaggttttctcgcaacagcaggttctgccatgggc

SEQ ID NO: 196294 - DNA, 75 bp, Artificial Sequence
  Synthetic
gcggcgtccttgacgctgtcagctcagtctcggactttattggccgggatagtgcagcaacagcaacagctgttg

SEQ ID NO: 196295 - DNA, 75 bp, Artificial Sequence
  Synthetic
gctatagagaagtacctaaaggaccaggcgcagctaaattcatggggatgtgcgtttagacaagtctgccacact

SEQ ID NO: 196296 - DNA, 75 bp, Artificial Sequence
  Synthetic
aggcgcagctaaattcatggggatgtgcgtttagacaagtctgccacacttctgtaccatgggtaaatgatacct

SEQ ID NO: 196297 - DNA, 75 bp, Artificial Sequence
  Synthetic
tgacacctgattggaacaatatgacgtggcaggaatgggaacaaaaagtccgctacctggaggcaaatatcagtc

SEQ ID NO: 196298 - DNA, 75 bp, Artificial Sequence
  Synthetic
aaagtctagaacaagcacaaattcagcaagaaaagaatatgtatgagctacaaaaattaaatagctgggatgttt

SEQ ID NO: 196299 - DNA, 75 bp, Artificial Sequence
  Synthetic
ttaccaattggcttgacttcacctcctgggtcaggtatattcaatatggagtttatgtagtagtaggaatagtag

SEQ ID NO: 196300 - DNA, 75 bp, Artificial Sequence
  Synthetic
ctgggtcaggtatattcaatatggagtttatgtagtagtaggaatagtagctttaagaatagtaatatatatagt

SEQ ID NO: 196301 - DNA, 75 bp, Artificial Sequence
  Synthetic
ggctataggcctgttttctcttccccccccggttacatccaacagatccatatccacaaggaccaggaacagcca

SEQ ID NO: 196302 - DNA, 75 bp, Artificial Sequence
  Synthetic
cccccggttacatccaacagatccatatccacaaggaccaggaacagccagccagagaagaaacagaagaagacg

SEQ ID NO: 196303 - DNA, 75 bp, Artificial Sequence
  Synthetic
tatccacaaggaccaggaacagccagccagagaagaaacagaagaagacgttggaagcaacggtggagacagatc

SEQ ID NO: 196304 - DNA, 75 bp, Artificial Sequence
  Synthetic
ttggccttggccgatagcatatatacatttcctgatccgcctgctgattcgcctcttgaccgggctatacaacat

SEQ ID NO: 196305 - DNA, 75 bp, Artificial Sequence
  Synthetic
ctgcagggacttactatccaggatctccccgatcctccaaccaatcttccagagtctccagagagcactaacagc

SEQ ID NO: 196306 - DNA, 75 bp, Artificial Sequence
  Synthetic
aatcagagactggctgaggcttaaagcagcctacctgcagtatgggtgcgagtggatccaagaagcgttccaagc

SEQ ID NO: 196307 - DNA, 75 bp, Artificial Sequence
  Synthetic
ccttgcaaggactacaagagagactcttgcaggcgcggggagagacttgtggagggcgctgcaacgaatcgggag

SEQ ID NO: 196308 - DNA, 75 bp, Artificial Sequence
  Synthetic
ggggatacttgcagtcccacgaaggatcaggcagggagcagaactcgccctcctgtgagggacagcgatatcagc

SEQ ID NO: 196309 - DNA, 75 bp, Artificial Sequence
  Synthetic
agggagattttgtaaataccccatggagaaccccagcagcagaaagggagaaagaattgtacaaacagcaaaata

SEQ ID NO: 196310 - DNA, 75 bp, Artificial Sequence
  Synthetic
tggatgatgtagatctagatgatgatgaccaagtaggattccctgtcacaccaagagtaccattaagaccaatga

SEQ ID NO: 196311 - DNA, 75 bp, Artificial Sequence
  Synthetic
caagagtaccattaagaccaatgacattcaaattggcagtagatatgtctcattttataaaagaaaaagggggac

SEQ ID NO: 196312 - DNA, 75 bp, Artificial Sequence
  Synthetic
caaaggcagcgtgtggagcgggaggagaagaggcctccgggtgaaggtaagtacctacaccaaaaactgtagccg

SEQ ID NO: 196313 - DNA, 75 bp, Artificial Sequence
  Synthetic
atcaggttacggcccggcggaaagaaaaagtacaggctaaaacatattgtgtgggcagcgaataaattggacaga

SEQ ID NO: 196314 - DNA, 75 bp, Artificial Sequence
  Synthetic
agtcaaaagagggttgtcaaaaaattcttacagttttagatccaatggtaccgacaggttcagaaaatttaaaaa

SEQ ID NO: 196315 - DNA, 75 bp, Artificial Sequence
  Synthetic
aaatagtgcggagacatctagtggcagaaacaggaactgcagagaaaatgccaagcacaagtagaccaacagcac

SEQ ID NO: 196316 - DNA, 75 bp, Artificial Sequence
  Synthetic
catctagcgagaagggaggaaattacccagtgcaacatgtaggcggcaactacacccatataccgctgagtcccc

SEQ ID NO: 196317 - DNA, 75 bp, Artificial Sequence
  Synthetic
ggcgaccatcaagcagccatgcagataatcagggagattatcaatgaggaagcagcagaatgggatgtgcaacat

SEQ ID NO: 196318 - DNA, 75 bp, Artificial Sequence
  Synthetic
ccaataccaggccccttaccagcggggcagcttagagagccaaggggatctgacatagcagggacaacaagcaca

SEQ ID NO: 196319 - DNA, 75 bp, Artificial Sequence
  Synthetic
tgacatagcagggacaacaagcacagtagaagaacagatccagtggatgtttaggccacaaaatcctgtaccagt

SEQ ID NO: 196320 - DNA, 75 bp, Artificial Sequence
  Synthetic
ggatgtacaacccgaccaacatcctagacataaaacagggaccaaaggagccgttccaaagctatgtagatagat

SEQ ID NO: 196321 - DNA, 75 bp, Artificial Sequence
  Synthetic
ccgttccaaagctatgtagatagattctacaaaagcttgagggcagaacaaacagatccagcagtgaagaattgg

SEQ ID NO: 196322 - DNA, 75 bp, Artificial Sequence
  Synthetic
aacagatccagcagtgaagaattggatgacccaaacactgctagtacaaaatgccaacccagactgtaaattagt

SEQ ID NO: 196323 - DNA, 75 bp, Artificial Sequence
  Synthetic
gctaaaaggactagggatgaaccctaccttagaagagatgctgaccgcctgtcagggggtaggtgggccaggcca

SEQ ID NO: 196324 - DNA, 75 bp, Artificial Sequence
  Synthetic
gaaagctagattaatggcagaggccctgaaagaggtcataggacctgcccctatcccattcgcagcagcccagca

SEQ ID NO: 196325 - DNA, 75 bp, Artificial Sequence
  Synthetic
ctgaaagaggtcataggacctgcccctatcccattcgcagcagcccagcagagaaaggcatttaaatgctggaac

SEQ ID NO: 196326 - DNA, 75 bp, Artificial Sequence
  Synthetic
tgtggaaaggaagggcactcggcaagacaatgccgagcacctagaaggcagggctgctggaagtgtggtaagcca

SEQ ID NO: 196327 - DNA, 75 bp, Artificial Sequence
  Synthetic
ggacacatcatgacaaactgcccagatagacaggcaggttttttaggactgggcccttggggaaagaagccccgc

SEQ ID NO: 196328 - DNA, 75 bp, Artificial Sequence
  Synthetic
atagacaggcaggttttttaggactgggcccttggggaaagaagccccgcaacttccccgtggcccaagttccgc

SEQ ID NO: 196329 - DNA, 75 bp, Artificial Sequence
  Synthetic
gacagagagagcagagagagagaccatacaaggaagtgacagaggacttactgcacctcgagcagggggagacac

SEQ ID NO: 196330 - DNA, 75 bp, Artificial Sequence
  Synthetic
ctgcacctcgagcagggggagacaccatacagggagccaccaacagaggacttgctgcacctcaattctctcttt

SEQ ID NO: 196331 - DNA, 75 bp, Artificial Sequence
  Synthetic
ccaaggaatataaaaatgtagaaatagaagttctaaataaaaaggtacgggccaccataatgacaggcgacaccc

SEQ ID NO: 196332 - DNA, 75 bp, Artificial Sequence
  Synthetic
caataaaaataatgctaaagccagggaaagatggaccaaaactgagacaatggcccttaacaaaagaaaaaatag

SEQ ID NO: 196333 - DNA, 75 bp, Artificial Sequence
  Synthetic
tggcccttaacaaaagaaaaaatagaagcactaaaagaaatctgtgaaaaaatggaaaaagaaggccagctagag

SEQ ID NO: 196334 - DNA, 75 bp, Artificial Sequence
  Synthetic
gaagcacctccaactaatccttataatacccccacatttgcaatcaagaaaaaggacaaaaacaaatggaggatg

SEQ ID NO: 196335 - DNA, 75 bp, Artificial Sequence
  Synthetic
cttttccataccactacatgaggactttagaccatatactgcatttactctaccatcagtgaacaatgcagaacc

SEQ ID NO: 196336 - DNA, 75 bp, Artificial Sequence
  Synthetic
taccatcagtgaacaatgcagaaccaggaaaaagatacatatataaagtcttgccacagggatggaagggatcac

SEQ ID NO: 196337 - DNA, 75 bp, Artificial Sequence
  Synthetic
acaggtattagaaccattcagaaaagcaaacaaggatgtcattatcattcagtacatggatgatatcttaatagc

SEQ ID NO: 196338 - DNA, 75 bp, Artificial Sequence
  Synthetic
agtacatggatgatatcttaatagctagtgacaggacagatttagaacatgatagggtagtcctgcagctcaagg

SEQ ID NO: 196339 - DNA, 75 bp, Artificial Sequence
  Synthetic
aacttctaaatggcctaggattttctaccccagatgagaagttccaaaaagaccctccataccactggatgggct

SEQ ID NO: 196340 - DNA, 75 bp, Artificial Sequence
  Synthetic
taccccagatgagaagttccaaaaagaccctccataccactggatgggctatgaactatggccaactaaatggaa

SEQ ID NO: 196341 - DNA, 75 bp, Artificial Sequence
  Synthetic
ttgggcagcacaactctacccagggataaagaccaaacacttatgtaggttaatcagaggaaaaatgacactcac

SEQ ID NO: 196342 - DNA, 75 bp, Artificial Sequence
  Synthetic
taatcagaggaaaaatgacactcacagaagaagtacagtggacagaattagcagaagcagagctagaagaaaaca

SEQ ID NO: 196343 - DNA, 75 bp, Artificial Sequence
  Synthetic
atcaagagaatcagtggacatataaaatacaccaggaagaaaaaattctaaaagtaggaaaatatgcaaaggtga

SEQ ID NO: 196344 - DNA, 75 bp, Artificial Sequence
  Synthetic
accagtagagagagaaatctgggagcagtggtgggataactactggcaagtgacatggatcccagactgggactt

SEQ ID NO: 196345 - DNA, 75 bp, Artificial Sequence
  Synthetic
cgtgtctaccccaccactggtcaggttagcgtttaacctggtaggggatcctataccaggtgcagagaccttcta

SEQ ID NO: 196346 - DNA, 75 bp, Artificial Sequence
  Synthetic
cacagatggatcctgcaataggcaatcaaaagaaggaaaagcaggatatgtaacagatagagggaaagacaaggt

SEQ ID NO: 196347 - DNA, 75 bp, Artificial Sequence
  Synthetic
aaagaaactagagcaaactaccaatcagcaagcagaactagaagcctttgcgatggcactaacagactcgggtcc

SEQ ID NO: 196348 - DNA, 75 bp, Artificial Sequence
  Synthetic
aaaagttaatattatagtagactcacagtatgtaatggggatcagtgcaagccaaccaacagagtcagaaagtaa

SEQ ID NO: 196349 - DNA, 75 bp, Artificial Sequence
  Synthetic
cagtatgtaatggggatcagtgcaagccaaccaacagagtcagaaagtaaaatagtgaaccagatcatagaagaa

SEQ ID NO: 196350 - DNA, 75 bp, Artificial Sequence
  Synthetic
ttgcatgggtcccagcccacaaaggcatagggggaaaccaggaagtagatcatttagtgagtcagggtatcagac

SEQ ID NO: 196351 - DNA, 75 bp, Artificial Sequence
  Synthetic
aagtgttgttcctggaaaaaatagagcccgctcaggaagaacatgaaaaatatcatagcaatgtaaaagaactgt

SEQ ID NO: 196352 - DNA, 75 bp, Artificial Sequence
  Synthetic
ctcataaatttggaatacccaatttagtggcaaggcaaatagtaaactcatgtgcccaatgtcaacagaaagggg

SEQ ID NO: 196353 - DNA, 75 bp, Artificial Sequence
  Synthetic
aaggagtagtagaagcaatgaatcaccatctaaaaaaccaaataagtagaatcagagaacaggcaaatacaatag

SEQ ID NO: 196354 - DNA, 75 bp, Artificial Sequence
  Synthetic
cagtcctagtcaaggtaggaacagacataaaaataataccaagaaggaaagccaagatcatcagagactatggag

SEQ ID NO: 196355 - DNA, 75 bp, Artificial Sequence
  Synthetic
gaagacaagagatggatagtggttcccacctggagggtgccagggaggatggagaaatggcatagccttgtcaag

SEQ ID NO: 196356 - DNA, 75 bp, Artificial Sequence
  Synthetic
tagaaaaggtgtgctatgttccccaccataaggtgggatgggcatggtggacttgcagcagggtaatattcccat

SEQ ID NO: 196357 - DNA, 75 bp, Artificial Sequence
  Synthetic
acttgcagcagggtaatattcccattaaaaggaaacagtcatctagagatacaggcatattggaacttaacacca

SEQ ID NO: 196358 - DNA, 75 bp, Artificial Sequence
  Synthetic
ttagtggtagtgcaacaaaatgacagaccccagagagacagtaccaccaggaaacagcggcgaagagactatcgg

SEQ ID NO: 196359 - DNA, 75 bp, Artificial Sequence
  Synthetic
agaggccttcgcctggctaaacaggacagtagaagccataaacagagaagcagtgaatcacctaccccgagaact

SEQ ID NO: 196360 - DNA, 75 bp, Artificial Sequence
  Synthetic
acagtagaagccataaacagagaagcagtgaatcacctaccccgagaacttattttccaggtgtggcagaggtcc

SEQ ID NO: 196361 - DNA, 75 bp, Artificial Sequence
  Synthetic
gcagtgtacatgcatgttaggaaagggtgtacttgcctggggaggggacatgggccaggagggtggagaccaggg

SEQ ID NO: 196362 - DNA, 75 bp, Artificial Sequence
  Synthetic
cctcctcctcctccccctccaggtctggtctaatggctgaagcaccaacagagctccccccggtggatgggaccc

SEQ ID NO: 196363 - DNA, 75 bp, Artificial Sequence
  Synthetic
cactgagggagccaggggatgagtggataatagaaatcttgagagaaataaaagaagaagctttaaagcattttg

SEQ ID NO: 196364 - DNA, 75 bp, Artificial Sequence
  Synthetic
gacacccttgaaggcgccagagagctcattaaagtcctgcaacgagcccttttcacgcacttcagagcaggatgt

SEQ ID NO: 196365 - DNA, 75 bp, Artificial Sequence
  Synthetic
tttcacgcacttcagagcaggatgtggccactcaagaattggccagacaaggggaggaaatcctctctcagctat

SEQ ID NO: 196366 - DNA, 75 bp, Artificial Sequence
  Synthetic
accgacccctagaaacatgcaataactcatgctattgtaagcgatgctgctaccattgtcagatgtgttttctaa

SEQ ID NO: 196367 - DNA, 75 bp, Artificial Sequence
  Synthetic
ctcatgctattgtaagcgatgctgctaccattgtcagatgtgttttctaaacaaggggctcgggatatgttatga

SEQ ID NO: 196368 - DNA, 75 bp, Artificial Sequence
  Synthetic
acgaaagggcagacgaagaaggactccaaagaaaactaagactcatccgtctcctacaccagacaagtgagtatg

SEQ ID NO: 196369 - DNA, 75 bp, Artificial Sequence
  Synthetic
atgaatcagctgcttattgccattttattagctagtgcttgcttagtatattgcacccaatatgtaactgttttc

SEQ ID NO: 196370 - DNA, 75 bp, Artificial Sequence
  Synthetic
tattagctagtgcttgcttagtatattgcacccaatatgtaactgttttctatggcgtacccacgtggaaaaatg

SEQ ID NO: 196371 - DNA, 75 bp, Artificial Sequence
  Synthetic
caaccattcccctcttttgtgcaaccagaaatagggatacttggggaaccatacagtgcttgcctgacaatgatg

SEQ ID NO: 196372 - DNA, 75 bp, Artificial Sequence
  Synthetic
atacagtgcttgcctgacaatgatgattatcaggaaataactttgaatgtaacagaggcttttgatgcatggaat

SEQ ID NO: 196373 - DNA, 75 bp, Artificial Sequence
  Synthetic
acacctttatgtgtagcaatgaaatgcagcagcacagagagcagcacagggaacaacacaacctcaaagagcaca

SEQ ID NO: 196374 - DNA, 75 bp, Artificial Sequence
  Synthetic
agcacaaccacaaccacacccacagaccaggagcaagagataagtgaggatactccatgcgcacgcgcagacaac

SEQ ID NO: 196375 - DNA, 75 bp, Artificial Sequence
  Synthetic
tactccatgcgcacgcgcagacaactgctcaggattgggagaggaagaaacgatcaattgccagttcaatatgac

SEQ ID NO: 196376 - DNA, 75 bp, Artificial Sequence
  Synthetic
aagatgtggtttgtgagacaaataatagcacaaatcagacccagtgttacatgaaccattgcaacacatcagtca

SEQ ID NO: 196377 - DNA, 75 bp, Artificial Sequence
  Synthetic
tgtgcaccaccgggttatgccctattaagatgtaatgataccaattattcaggctttgcacccaactgttctaaa

SEQ ID NO: 196378 - DNA, 75 bp, Artificial Sequence
  Synthetic
gtagtagcttctacatgcaccaggatgatggaaacgcaaacttccacatggtttggctttaatggcactagagca

SEQ ID NO: 196379 - DNA, 75 bp, Artificial Sequence
  Synthetic
cagcttaaacaaatattataatctcagtttgcattgtaagaggccagggaataagacagtgaaacaaataatgct

SEQ ID NO: 196380 - DNA, 75 bp, Artificial Sequence
  Synthetic
tatgtcaggacatgtgtttcactcccactaccagccgatcaataaaagacccagacaagcatggtgctggttcaa

SEQ ID NO: 196381 - DNA, 75 bp, Artificial Sequence
  Synthetic
aggcaaatggaaagacgccatgcaggaggtgaaggaaacccttgcaaaacatcccaggtatagaggaaccaatga

SEQ ID NO: 196382 - DNA, 75 bp, Artificial Sequence
  Synthetic
atcccaggtatagaggaaccaatgacacaaggaatattagctttgcagcgccaggaaaaggctcagacccagaag

SEQ ID NO: 196383 - DNA, 75 bp, Artificial Sequence
  Synthetic
gtgccatataaagcaaataattaacacatggcataaggtagggagaaatgtatatttgcctcccagggaagggga

SEQ ID NO: 196384 - DNA, 75 bp, Artificial Sequence
  Synthetic
gctgtcctgcaactcaacagtaaccagcataattgctaacattgactggcaaaacaataatcagacaaacattac

SEQ ID NO: 196385 - DNA, 75 bp, Artificial Sequence
  Synthetic
aattggtagaaataacaccaattggcttcgcacctacaaaagaaaaaagatactcctctgctcacgggagacata

SEQ ID NO: 196386 - DNA, 75 bp, Artificial Sequence
  Synthetic
caagaggtgtgttcgtgctagggttcttgggttttctcgcaacagcaggttctgcaatgggcgcggcgtccctga

SEQ ID NO: 196387 - DNA, 75 bp, Artificial Sequence
  Synthetic
acctacaggaccaggcgcggctaaattcatggggatgtgcgtttagacaagtctgccacactactgtaccatggg

SEQ ID NO: 196388 - DNA, 75 bp, Artificial Sequence
  Synthetic
ttaatgattccttagcacctgactgggacaatatgacgtggcaggaatgggaaaaacaagtccgctacctggagg

SEQ ID NO: 196389 - DNA, 75 bp, Artificial Sequence
  Synthetic
gaaaaacaagtccgctacctggaggcaaatatcagtaaaagtttagaacaggcacaaattcagcaagagaaaaat

SEQ ID NO: 196390 - DNA, 75 bp, Artificial Sequence
  Synthetic
atgtatgaactacaaaaattaaatagctgggatatttttggcaattggtttgacttaacctcctgggtcaagtat

SEQ ID NO: 196391 - DNA, 75 bp, Artificial Sequence
  Synthetic
tgacttaacctcctgggtcaagtatattcaatatggagtgcttataatagtagcagtaatagctttaagaatagt

SEQ ID NO: 196392 - DNA, 75 bp, Artificial Sequence
  Synthetic
aggcttagaaagggctataggcctgttttctcttccccccccggttatatccaacagatccatatccacaaggac

SEQ ID NO: 196393 - DNA, 75 bp, Artificial Sequence
  Synthetic
ccaacagatccatatccacaaggaccggggacagccagccaacgaagaaacagaagaagacggtggaagcaacgg

SEQ ID NO: 196394 - DNA, 75 bp, Artificial Sequence
  Synthetic
gccagctgattcgcctcttgaccagactatacagcatctgcagggacttactatccaggagcttcctgaccctcc

SEQ ID NO: 196395 - DNA, 75 bp, Artificial Sequence
  Synthetic
actatacagcatctgcagggacttactatccaggagcttcctgaccctccaactcatctaccagaatctcagaga

SEQ ID NO: 196396 - DNA, 75 bp, Artificial Sequence
  Synthetic
ctggctgagacttagaacagccttcttgcaatatgggtgcgagtggatccaagaagcattccaggccgccgcgag

SEQ ID NO: 196397 - DNA, 75 bp, Artificial Sequence
  Synthetic
ggctacaagagagactcttgcgggcgcgtgcaggggcttgtggagggtattggaacgaatcgggaggggaatact

SEQ ID NO: 196398 - DNA, 75 bp, Artificial Sequence
  Synthetic
cgcggttccaagaaggatcagacagggagcagaaatcgccctcctgtgagggacggcagtatcagcagggagact

SEQ ID NO: 196399 - DNA, 75 bp, Artificial Sequence
  Synthetic
ttatgaatactccatggaaggacccagcagcagaaagggagaaaaatttgtacaggcaacaaaatatggatgatg

SEQ ID NO: 196400 - DNA, 75 bp, Artificial Sequence
  Synthetic
tagattcagatgatgatgaccaagtaagagtttctgtcacaccaaaagtaccactaagaccaatgacacatagat

SEQ ID NO: 196401 - DNA, 75 bp, Artificial Sequence
  Synthetic
caaaagtaccactaagaccaatgacacatagattggcaatagatatgtcacatttaataaaaacaagggggggac

SEQ ID NO: 196402 - DNA, 75 bp, Artificial Sequence
  Synthetic
ggctgagtgagggcagtaagggcggcaggaacaaaccacgacggagtgctccagtaaaggcgcaggccgaggtac

SEQ ID NO: 196403 - DNA, 75 bp, Artificial Sequence
  Synthetic
aaagggcttgttatcctacctttagacaggtagaagattgtgggagatgggcgcgagaaactccgtcttgagagg

SEQ ID NO: 196404 - DNA, 75 bp, Artificial Sequence
  Synthetic
atggtgcatacacgcagaagagaaagtgaaagatactgaagaagcaaaaagaatagcactgagacatctagcggc

SEQ ID NO: 196405 - DNA, 75 bp, Artificial Sequence
  Synthetic
cacctagtgggaagggaggaaattaccccgtgcaaagcataggcggcaactatactcatgtgccgctaagtcccc

SEQ ID NO: 196406 - DNA, 75 bp, Artificial Sequence
  Synthetic
ggcgaccatcaagcagctatgcaaataatcagggagattattaatgaagaagcagcagactgggatgccaatcat

SEQ ID NO: 196407 - DNA, 75 bp, Artificial Sequence
  Synthetic
ccaataccaggccccttaccagcggggcagctcagagacccaagagggtctgacatagcaggaacaacaagcaca

SEQ ID NO: 196408 - DNA, 75 bp, Artificial Sequence
  Synthetic
tgacatagcaggaacaacaagcacagtagaagaacagatccaatggatgtttagggcacaaaatcccgtaccagt

SEQ ID NO: 196409 - DNA, 75 bp, Artificial Sequence
  Synthetic
agggaacatctatagaagatggatccagatagggctgcagaagtgtgtcaggatgtacaacccgaccaacatcct

SEQ ID NO: 196410 - DNA, 75 bp, Artificial Sequence
  Synthetic
tctacaaaagcttgagggcagaacaaacagatccagcagtaaaaaattggatgacccaaacactgctagtgcaga

SEQ ID NO: 196411 - DNA, 75 bp, Artificial Sequence
  Synthetic
actaaagggattagggatgaatcctaccttagaagagatgctaactgcctgtcaaggagtaggtggaccaggcca

SEQ ID NO: 196412 - DNA, 75 bp, Artificial Sequence
  Synthetic
gaaagctagactaatggcagaagccttaaaggaggccatgggaccaccccctatcccattcgcagcagcccagca

SEQ ID NO: 196413 - DNA, 75 bp, Artificial Sequence
  Synthetic
ttaaaggaggccatgggaccaccccctatcccattcgcagcagcccagcagagaaggacgattaaatgctggaat

SEQ ID NO: 196414 - DNA, 75 bp, Artificial Sequence
  Synthetic
ggacacatcatgacaaattgccctgatagacaggcgggttttttagggattggcccctggggaaagaagccccgc

SEQ ID NO: 196415 - DNA, 75 bp, Artificial Sequence
  Synthetic
atagacaggcgggttttttagggattggcccctggggaaagaagccccgcaatttccccgtggcccaagttccac

SEQ ID NO: 196416 - DNA, 75 bp, Artificial Sequence
  Synthetic
aggggctaacaccaacagcacccccattggatccagcagtggatctactggagaaatatatgcagcaagggaaaa

SEQ ID NO: 196417 - DNA, 75 bp, Artificial Sequence
  Synthetic
atacaaagaggtgacagaggacttactgcacctcgaacaaggagaggccccatgcagggagacaacagaggactt

SEQ ID NO: 196418 - DNA, 75 bp, Artificial Sequence
  Synthetic
ggaataggaggattcataaataccaaagaatataaaaatgtggaaatagaagttctaggtaaaagggtaagggcc

SEQ ID NO: 196419 - DNA, 75 bp, Artificial Sequence
  Synthetic
ctaccagtcgccaagatagaaccaataaaaataatgctaaagccaggaaaagatggaccaagattgagacaatgg

SEQ ID NO: 196420 - DNA, 75 bp, Artificial Sequence
  Synthetic
ggaaaaagaaggccagctagaggaagcacctccaactaatccttataatacccccacatttgcaatcaggaaaaa

SEQ ID NO: 196421 - DNA, 75 bp, Artificial Sequence
  Synthetic
ggacaagaacaaatggaggatgctaatagattttagagagctaaacaaagtaacccaagatttcacagaaatcca

SEQ ID NO: 196422 - DNA, 75 bp, Artificial Sequence
  Synthetic
gttaggaattccacacccagcaggattagccaaaaagagaagaattactgtactagatgtaggggatgcttattt

SEQ ID NO: 196423 - DNA, 75 bp, Artificial Sequence
  Synthetic
ttagccaaaaagagaagaattactgtactagatgtaggggatgcttatttttccataccattacatgaagacttt

SEQ ID NO: 196424 - DNA, 75 bp, Artificial Sequence
  Synthetic
agacagtacactgcatttactctaccatcagtgaacaatgcagaaccaggaaaaagatacatatataaagtctta

SEQ ID NO: 196425 - DNA, 75 bp, Artificial Sequence
  Synthetic
ccgcaggggtggaaaggatcaccagcaatttttcagtacacaatgaggcaggtcttagagccattcagaaaagca

SEQ ID NO: 196426 - DNA, 75 bp, Artificial Sequence
  Synthetic
tgacaggacagacttagaacatgacaaagtggttctgcagctaaaggaacttctaaataacctaggattctctac

SEQ ID NO: 196427 - DNA, 75 bp, Artificial Sequence
  Synthetic
ttagaggaaaaatgacactcacagaagaggtacaatggacagaattagcagaagcagaactagaagaaaacagaa

SEQ ID NO: 196428 - DNA, 75 bp, Artificial Sequence
  Synthetic
agaggtacaatggacagaattagcagaagcagaactagaagaaaacagaattatcttaagccaagaacaagaggg

SEQ ID NO: 196429 - DNA, 75 bp, Artificial Sequence
  Synthetic
ttatcttaagccaagaacaagagggacactactaccaggaagaaaaggagttagaagcaacagttcaaaaggatc

SEQ ID NO: 196430 - DNA, 75 bp, Artificial Sequence
  Synthetic
gtaggaaaatatgcaaaaataaaacatacccataccaatggagtcaaattattagcacaggtagttcaaaaaata

SEQ ID NO: 196431 - DNA, 75 bp, Artificial Sequence
  Synthetic
catggatcccagactgggacttcgtatctaccccaccactggtcagactagcatttaacttagtaggggatccta

SEQ ID NO: 196432 - DNA, 75 bp, Artificial Sequence
  Synthetic
taccaggcacagagaccttctacacagatggatcctgcaataggcaatcaaaagaaggaaaagcaggatatgtaa

SEQ ID NO: 196433 - DNA, 75 bp, Artificial Sequence
  Synthetic
aaagaaggaaaagcaggatatgtaacagatagaggaagagacaaggtaaaaatactagagcaaactaccaatcag

SEQ ID NO: 196434 - DNA, 75 bp, Artificial Sequence
  Synthetic
tggcactaacagactcaggtccaaaagctaatattatagtagactcacagtatgtaatgggaatagtggcaggcc

SEQ ID NO: 196435 - DNA, 75 bp, Artificial Sequence
  Synthetic
aaccaacagagtcagaaaatagaatagtaaatcaaatcatagaagaaatgataaaaaaggaagcaatctatgttg

SEQ ID NO: 196436 - DNA, 75 bp, Artificial Sequence
  Synthetic
ttagtgagtcaaggcatcagacaagtactgttcctagaaaagatagagcctgctcaggaagaacatgaaaaatat

SEQ ID NO: 196437 - DNA, 75 bp, Artificial Sequence
  Synthetic
tgctcaggaagaacatgaaaaatatcataccaatgtaaaagagctatgccataaatttgatataccccaactagt

SEQ ID NO: 196438 - DNA, 75 bp, Artificial Sequence
  Synthetic
ggcaagacaaatagtaaacacatgtgcccaatatcaacagaaaggggaggctatacatgggcaagtaaatgcaga

SEQ ID NO: 196439 - DNA, 75 bp, Artificial Sequence
  Synthetic
ctatacatgggcaagtaaatgcagaagtgggcacctggcaaatggactgcacacatctagagggaaaaatcatca

SEQ ID NO: 196440 - DNA, 75 bp, Artificial Sequence
  Synthetic
gataatggtgccaacttcacttcacaggaagtaaagatggtagcatggtgggtaggcatagaacaaacctttgga

SEQ ID NO: 196441 - DNA, 75 bp, Artificial Sequence
  Synthetic
catgaattttaaaagaaggggaggaataggggatatgactccatcagaaagactaatcaatatgatcaccacaga

SEQ ID NO: 196442 - DNA, 75 bp, Artificial Sequence
  Synthetic
gactaatcaatatgatcaccacagaacaagagatacaattcctccaagccaaaaattcaaaattaaaaaattttc

SEQ ID NO: 196443 - DNA, 75 bp, Artificial Sequence
  Synthetic
gggtctatttcagagaaggcagagatcagttgtggaaaggacctggggaactactgtggaagggagacggagcag

SEQ ID NO: 196444 - DNA, 75 bp, Artificial Sequence
  Synthetic
aaaaataataccaaggaggaaagccaagatcatcagagactatggaggaaggcaagagctggatagcagttccca

SEQ ID NO: 196445 - DNA, 75 bp, Artificial Sequence
  Synthetic
cctggagggtgccagggagaatggagaagtggcatagccttgtcaagtatctaaaatacaaaacaggagatctag

SEQ ID NO: 196446 - DNA, 75 bp, Artificial Sequence
  Synthetic
aacaggtgtgctatgttccccaccataaggtaggatgggcatggtggacttgcagcagggtaatattcccattaa

SEQ ID NO: 196447 - DNA, 75 bp, Artificial Sequence
  Synthetic
taagaatgacttggtacacagaaaagttctggacagatgtcaccccagactgtgcagacaccctaatacatagta

SEQ ID NO: 196448 - DNA, 75 bp, Artificial Sequence
  Synthetic
atccccgagcccatagatcccaggtaccatcacttcaatttctggccttagtggtagtgcaacaaaatgacagac

SEQ ID NO: 196449 - DNA, 75 bp, Artificial Sequence
  Synthetic
gtggtagtgcaacaaaatgacagaccccagagagaccgtaccaccaggaaacagtggcgaagagactatcgaaga

SEQ ID NO: 196450 - DNA, 75 bp, Artificial Sequence
  Synthetic
tttccaggtgtggcaaaggtcctggagatactggcatgatgaacaagggatgtcacaaagttacaccaagtatag

SEQ ID NO: 196451 - DNA, 75 bp, Artificial Sequence
  Synthetic
agatactggcatgatgaacaagggatgtcacaaagttacaccaagtatagatatttgtgcttaatgcagaaagca

SEQ ID NO: 196452 - DNA, 75 bp, Artificial Sequence
  Synthetic
tgtcacaaagttacaccaagtatagatatttgtgcttaatgcagaaagcagtgttcatacattttaagagagggt

SEQ ID NO: 196453 - DNA, 75 bp, Artificial Sequence
  Synthetic
tctaatgactgaagcaccaacagagctccctccagaggatgggaccccaccgagggagccaggggatgaatgggt

SEQ ID NO: 196454 - DNA, 75 bp, Artificial Sequence
  Synthetic
aatagaaatcctgagagacataaaagaagaagccctaaagcactttgaccctcgcttgctaactgctcttggcgg

SEQ ID NO: 196455 - DNA, 75 bp, Artificial Sequence
  Synthetic
acatatctatgctagacatggagacacccttgaaagagccagagagctcattagggtcctgcaacgagccctctt

SEQ ID NO: 196456 - DNA, 75 bp, Artificial Sequence
  Synthetic
cacgcacttcagggcaggatgcaaccactcaagaattggccaaactaggggaggaaatcctctctcagctatacc

SEQ ID NO: 196457 - DNA, 75 bp, Artificial Sequence
  Synthetic
aacccctagaagaatgtgataactcatgctattgtaagcgatgctgctatcattgccagctatgttttctaaaaa

SEQ ID NO: 196458 - DNA, 75 bp, Artificial Sequence
  Synthetic
atgctattgtaagcgatgctgctatcattgccagctatgttttctaaaaaaggggctcgggatatgttatgaccg

SEQ ID NO: 196459 - DNA, 75 bp, Artificial Sequence
  Synthetic
aaagggcagacgaagaaggactccaaagaaagctaaggctcattcgtcttctgcatcagacaagtgagtatggag

SEQ ID NO: 196460 - DNA, 75 bp, Artificial Sequence
  Synthetic
cgtggcagaaatcagctgcttattgccattctactagctagtgcttgcttaatatattgcagacaacaatatgtg

SEQ ID NO: 196461 - DNA, 75 bp, Artificial Sequence
  Synthetic
aatatattgcagacaacaatatgtgactgttttctatggcgtacccgcgtggaaaaatgcatccattcccctctt

SEQ ID NO: 196462 - DNA, 75 bp, Artificial Sequence
  Synthetic
tggggaactatacagtgcttaccagacaatgatgattatcaggagatacctttaaatgtgacagaggctttcgat

SEQ ID NO: 196463 - DNA, 75 bp, Artificial Sequence
  Synthetic
aagcaatagaggatgtctggaatctattcgagacatcaataaaaccatgtgtcaaattaacacctttatgtgtag

SEQ ID NO: 196464 - DNA, 75 bp, Artificial Sequence
  Synthetic
gtcaaattaacacctttatgtgtagcaatgaaatgtaacataagtacaagtgacacaactatgataaggacaacc

SEQ ID NO: 196465 - DNA, 75 bp, Artificial Sequence
  Synthetic
acacccagcacagctaaagaggcaccaataagtgacaattctccttgcatacgcacaaacaactgctcaggatta

SEQ ID NO: 196466 - DNA, 75 bp, Artificial Sequence
  Synthetic
gaggaagaaaagatagtcaagtgtcacttcaatatgacaggattagaaagagataagaaaaaacagtacaatgaa

SEQ ID NO: 196467 - DNA, 75 bp, Artificial Sequence
  Synthetic
acatggtactcaagcgatgtggtttgtgataatagcacagatcagaccacaaatgagaccacgtgttacatgaac

SEQ ID NO: 196468 - DNA, 75 bp, Artificial Sequence
  Synthetic
agtcatgtgataagcactattgggatgctatgaggtttagatactgtgcaccaccgggttttgccatactaagat

SEQ ID NO: 196469 - DNA, 75 bp, Artificial Sequence
  Synthetic
gcaatgataccaagtactcaggctttgcacccaactgttctaaggtagtagcttctacatgcaccagaatgatgg

SEQ ID NO: 196470 - DNA, 75 bp, Artificial Sequence
  Synthetic
tgcacccaactgttctaaggtagtagcttctacatgcaccagaatgatggaaacgcagacttctacgtggtttgg

SEQ ID NO: 196471 - DNA, 75 bp, Artificial Sequence
  Synthetic
ctttaatggcaccagagcagagaatagaacatatatctattggcatggtaaagataacagaactatcatcagttt

SEQ ID NO: 196472 - DNA, 75 bp, Artificial Sequence
  Synthetic
aaacaagcattataacctctctatgtattgtaggaggccaggaaataagacagtggtgccaataacacttatgtc

SEQ ID NO: 196473 - DNA, 75 bp, Artificial Sequence
  Synthetic
agggcaaagatttcactcccggccaatcattaataaaaggcccaggcaagcatggtgctggttcaaaggcaactg

SEQ ID NO: 196474 - DNA, 75 bp, Artificial Sequence
  Synthetic
gacagaagccatgcaggaggtaaagcaaacccttgcggagcatcccaggtataaaggaaccaaaaacataacgga

SEQ ID NO: 196475 - DNA, 75 bp, Artificial Sequence
  Synthetic
tattaccttcaaagcaccagaaagaggttcagacccagaagtgacatacatgtggtctaactgcagaggagaatt

SEQ ID NO: 196476 - DNA, 75 bp, Artificial Sequence
  Synthetic
tttctactgcaacatgacctggttcctcaattgggtagaaaataaacctaatacgacaaagcgcaattatgcacc

SEQ ID NO: 196477 - DNA, 75 bp, Artificial Sequence
  Synthetic
ctcaattgggtagaaaataaacctaatacgacaaagcgcaattatgcaccatgccatataaggcaaataattaac

SEQ ID NO: 196478 - DNA, 75 bp, Artificial Sequence
  Synthetic
tatatttgcctcccagggaaggggagttgacctgcaactcaacagtgaccagcataattgctaacattgacgaga

SEQ ID NO: 196479 - DNA, 75 bp, Artificial Sequence
  Synthetic
gggataatcagacaacaaatattacctttagtgcagatgtggcagaactgtaccgattggaattgggggattata

SEQ ID NO: 196480 - DNA, 75 bp, Artificial Sequence
  Synthetic
aattggtagaaataacaccaattggcttcgcacctacatcacaaaagagatactcccctgctcacgggagaccta

SEQ ID NO: 196481 - DNA, 75 bp, Artificial Sequence
  Synthetic
aaagaggtgcgtttgtgctagggttcttgggttttctcacaacagcaggagttgcaatgggcacggcgtccttga

SEQ ID NO: 196482 - DNA, 75 bp, Artificial Sequence
  Synthetic
acctaaaggatcaggcacagctaaattcatggggatgtgcgtttagacaagtctgccacactactgtaccatggg

SEQ ID NO: 196483 - DNA, 75 bp, Artificial Sequence
  Synthetic
caaatgagtctttaacacctgattggaacaatatgacatggcaggaatgggaacaaaaggtccgctacctggagg

SEQ ID NO: 196484 - DNA, 75 bp, Artificial Sequence
  Synthetic
caaatatcagtcaaagtttagaagaggcacaacttcagcaagaaaagaatatgtatgaactacaaaaattaaaca

SEQ ID NO: 196485 - DNA, 75 bp, Artificial Sequence
  Synthetic
atgtatgaactacaaaaattaaacaactgggatgtttttaccaactggtttgacttaacctcctggatcagctat

SEQ ID NO: 196486 - DNA, 75 bp, Artificial Sequence
  Synthetic
ccaacagatccatatccacaaggacccggaacagccagccagcgaagaaacagaagaagacgttggaggcaacgg

SEQ ID NO: 196487 - DNA, 75 bp, Artificial Sequence
  Synthetic
tggagacagatcctggccttggcagatagaatatatacatttcctgatccgccagctgatccgcctcttgaccgg

SEQ ID NO: 196488 - DNA, 75 bp, Artificial Sequence
  Synthetic
actatacaacatctgcaggaacttactatccaggatcttccagaccctccaacccatcctccagaatctcagaga

SEQ ID NO: 196489 - DNA, 75 bp, Artificial Sequence
  Synthetic
ctggctgaggcctaaagtagccttcctgcaatatgggtgcgagtggatccaagaagcgttccaggccgctgcaag

SEQ ID NO: 196490 - DNA, 75 bp, Artificial Sequence
  Synthetic
ggctgcaagagagactcttgcgggcgcgtgcagggacgtgtggggaatgttacaacgcattggaaggggaatcct

SEQ ID NO: 196491 - DNA, 75 bp, Artificial Sequence
  Synthetic
tgcggtcccaagaaggatcagacagggagcagaactcgctctcctgtgagggacagcgatatcagcagggggact

SEQ ID NO: 196492 - DNA, 75 bp, Artificial Sequence
  Synthetic
ttatgaataccccatggagagccccagcagcagaggggaagaaaaatgcatacaggcagcaaaatatggatgata

SEQ ID NO: 196493 - DNA, 75 bp, Artificial Sequence
  Synthetic
tagattcagatgatgatgacctagtgggggttcctgccacaccaagagtaccactaagaacaatgacatataaat

SEQ ID NO: 196494 - DNA, 75 bp, Artificial Sequence
  Synthetic
caagagtaccactaagaacaatgacatataaattggcagtagacatgtcacattttataaaagaaaaagggggac

SEQ ID NO: 196495 - DNA, 75 bp, Artificial Sequence
  Synthetic
caaaggcggcgtgtggagcgggagtgaaagaggcctccgggtgaaggtaagtacctacaccgaaaactgtagcca

SEQ ID NO: 196496 - DNA, 75 bp, Artificial Sequence
  Synthetic
agttaggttacggcccggcggaaagaaaaaatacaggttaaaacatattgtgtgggcagcgaatgaattggacag

SEQ ID NO: 196497 - DNA, 75 bp, Artificial Sequence
  Synthetic
ttttttgcatacacgcagaggagaaagtgaaagatactgaggaagcaaaaaagttcgcacggagacatctagtgg

SEQ ID NO: 196498 - DNA, 75 bp, Artificial Sequence
  Synthetic
cagaaacaggaactgcagagaaaatgccaaatacaagtagaccaacagcaccacctagcgggagaggaggaaact

SEQ ID NO: 196499 - DNA, 75 bp, Artificial Sequence
  Synthetic
ccacctagcgggagaggaggaaactaccccgtgcagaatataggcggcaactatacccatgtgccgttgagtccc

SEQ ID NO: 196500 - DNA, 75 bp, Artificial Sequence
  Synthetic
tccaataccaggccccttaccagcggggcagcttagagaaccaagagggtctgacatagcagggacaacaagcac

SEQ ID NO: 196501 - DNA, 75 bp, Artificial Sequence
  Synthetic
ctgacatagcagggacaacaagcacagtagatgaacaaatccagtggatgttcagggcacagaatcctgtaccag

SEQ ID NO: 196502 - DNA, 75 bp, Artificial Sequence
  Synthetic
tgggaaacatctatagaagatggatccagatagggctgcagaagtgtgtcaggatgtacaatccaaccaacatcc

SEQ ID NO: 196503 - DNA, 75 bp, Artificial Sequence
  Synthetic
ttctacaaaagcttgagggcagaacaaacagatgcagcagtgaaaaattggatgactcagacactgctaatacaa

SEQ ID NO: 196504 - DNA, 75 bp, Artificial Sequence
  Synthetic
cttaaaggaggccatgacaccagcccctatcccattcgcagcagcccagcagagaaggacaattaagtgctggaa

SEQ ID NO: 196505 - DNA, 75 bp, Artificial Sequence
  Synthetic
ttgtggaaaagaggggcactcggcaagacaatgccgagcacctagaagacagggctgctggaaatgtggcaagac

SEQ ID NO: 196506 - DNA, 75 bp, Artificial Sequence
  Synthetic
aggacatatcatggcaaagtgcccagacagacaggcgggttttttagggattggcccctggggaaagaagccccg

SEQ ID NO: 196507 - DNA, 75 bp, Artificial Sequence
  Synthetic
ggagaaatatatgcagcaagggagaaagcagagggagcagagagagagaccatacaaagaggtgacagaggactt

SEQ ID NO: 196508 - DNA, 75 bp, Artificial Sequence
  Synthetic
gctgcacctcgagcagggaaagacaccatgcaaggagacaacagaggatttgctgcacctcaattctctctttgg

SEQ ID NO: 196509 - DNA, 75 bp, Artificial Sequence
  Synthetic
aacagaccagtagttacagcacacattgagggacagccagtagaagttttactggacacgggggctgatgattca

SEQ ID NO: 196510 - DNA, 75 bp, Artificial Sequence
  Synthetic
ttgagggacagccagtagaagttttactggacacgggggctgatgattcaatagtagcaggaatagaattaggaa

SEQ ID NO: 196511 - DNA, 75 bp, Artificial Sequence
  Synthetic
gcaattatagtccaaaaatagtagggggaatagggggattcataaataccaaggaatataaaaatgtagaaatag

SEQ ID NO: 196512 - DNA, 75 bp, Artificial Sequence
  Synthetic
aaggaatataaaaatgtagaaatagaagtcctaggtaaaagggtaagggccaccataatgacaggtgatacccca

SEQ ID NO: 196513 - DNA, 75 bp, Artificial Sequence
  Synthetic
caccataatgacaggtgataccccaatcaacatttttggcagaaatattttgacagccttaggcatgtcattaaa

SEQ ID NO: 196514 - DNA, 75 bp, Artificial Sequence
  Synthetic
tgacagccttaggcatgtcattaaatctaccagtcgccaagatagaaccaataaaaataatgctaaagccaggga

SEQ ID NO: 196515 - DNA, 75 bp, Artificial Sequence
  Synthetic
gtaactcaggatttcacagaaattcagttaggaattccacacccagcgggactagccaagaagagaagaattact

SEQ ID NO: 196516 - DNA, 75 bp, Artificial Sequence
  Synthetic
tagacagtacactgcatttaccctaccatcagtgaacaatgcagaaccaggaaaaagatatatatataaagtctt

SEQ ID NO: 196517 - DNA, 75 bp, Artificial Sequence
  Synthetic
cagagtagtcctgcagctaaaggaactcctaaatagcctggggttctctaccccagatgaaaagttccaaaaaga

SEQ ID NO: 196518 - DNA, 75 bp, Artificial Sequence
  Synthetic
gaactgtggccaactaaatggaagctgcagaaaatacagttgccccaaaaagaagtatggacagtcaatgacatc

SEQ ID NO: 196519 - DNA, 75 bp, Artificial Sequence
  Synthetic
caaaaactagtgggtgtcctaaattgggcagcacaaatctacccaggaataaagacaaaacatttatgtaggtta

SEQ ID NO: 196520 - DNA, 75 bp, Artificial Sequence
  Synthetic
attaggggaaaaatgacactcacggaagaaatacagtggacagagttggcagaagcggaactagaagaaaacaga

SEQ ID NO: 196521 - DNA, 75 bp, Artificial Sequence
  Synthetic
aagaaatacagtggacagagttggcagaagcggaactagaagaaaacagagttatcttgagccaggaacaagagg

SEQ ID NO: 196522 - DNA, 75 bp, Artificial Sequence
  Synthetic
gacactattaccaagaggaaaaagaattagaagcaacagtccaaaaggatcaagacaatcagtggacatataaag

SEQ ID NO: 196523 - DNA, 75 bp, Artificial Sequence
  Synthetic
agtaggaaaatatgcaaaggtaaaaaacacccataccaacggagtcagattgttagcacaggtagttcagaaaat

SEQ ID NO: 196524 - DNA, 75 bp, Artificial Sequence
  Synthetic
gataaaaaaggaagcaatctatgttgcatgggtcccagcccacaaaggcataggaggaaatcaggaagtagatca

SEQ ID NO: 196525 - DNA, 75 bp, Artificial Sequence
  Synthetic
tcatagcaatgtaaaagaactatcccataaatttggattaccccaactagtggcaagacaaatagtaaacacatg

SEQ ID NO: 196526 - DNA, 75 bp, Artificial Sequence
  Synthetic
tgcccaatgtcaacagaaaggagaggctatacatgggcaagtaaatgcagacttaggcacttggcaaatggactg

SEQ ID NO: 196527 - DNA, 75 bp, Artificial Sequence
  Synthetic
ggtggccaataacacacttgcacacagataatggtgccaacttcacttcacaggaagtgaagatggtagcatggt

SEQ ID NO: 196528 - DNA, 75 bp, Artificial Sequence
  Synthetic
ggataggtatagaacaatcctttggagtaccttacaatccacaaagccaaggagtagtagaagccatgaatcacc

SEQ ID NO: 196529 - DNA, 75 bp, Artificial Sequence
  Synthetic
aaaaggatggctttcctcatatgcagtaaggctgacttggtacacagaaaaattctggacagatgttaccccaga

SEQ ID NO: 196530 - DNA, 75 bp, Artificial Sequence
  Synthetic
ggaaaagttattgtcctgctgcaattatccccaggcccataaatctcaggtaccgacacttcaatttctggcctt

SEQ ID NO: 196531 - DNA, 75 bp, Artificial Sequence
  Synthetic
agtggtagtgcaacaaaatggcagaccccagagagacagtaccaccaggaaacagcggcgaagagactatcgagc

SEQ ID NO: 196532 - DNA, 75 bp, Artificial Sequence
  Synthetic
aggccttcgcctggctagacaggacagtagaagccataaacagagaggcggtgaatcacctgccccgagagctta

SEQ ID NO: 196533 - DNA, 75 bp, Artificial Sequence
  Synthetic
ttttccaggtgtggcaaaggtcctggagatactggcatgatgaacaagggatgtcaacaagttacacaaagtata

SEQ ID NO: 196534 - DNA, 75 bp, Artificial Sequence
  Synthetic
aatgtacatacatggtaggaaagggtgcacttgccggggggaagggcatgggccaggagggtggagaccaggacc

SEQ ID NO: 196535 - DNA, 75 bp, Artificial Sequence
  Synthetic
tgcacttgccggggggaagggcatgggccaggagggtggagaccaggacctcctcctcctccccctccaggttta

SEQ ID NO: 196536 - DNA, 75 bp, Artificial Sequence
  Synthetic
gtctaatgactgaagcaccaacagagctccccccggaggatgggaccccaccgagggagccaggggatgagtggg

SEQ ID NO: 196537 - DNA, 75 bp, Artificial Sequence
  Synthetic
taatagaaattctgagagagataacagaagaagctcttaagcattttgaccgcagcttgctaactgctcttggca

SEQ ID NO: 196538 - DNA, 75 bp, Artificial Sequence
  Synthetic
gacatatctatactagacatggagatacccttgaaggcgccagagaactcattagaatcttacaacgagccctct

SEQ ID NO: 196539 - DNA, 75 bp, Artificial Sequence
  Synthetic
ggaggaaatcctctctcagctataccgacccctagaagcatgcaataacaattgctattgtaagcgatgctgcta

SEQ ID NO: 196540 - DNA, 75 bp, Artificial Sequence
  Synthetic
ccattgccagatatgttttttaaacaaggggctcgggatatggtatgaacgaaagggcagacgaagaaggactcc

SEQ ID NO: 196541 - DNA, 75 bp, Artificial Sequence
  Synthetic
aaggggctcgggatatggtatgaacgaaagggcagacgaagaaggactccaaagaaagctaagactcatccgtct

SEQ ID NO: 196542 - DNA, 75 bp, Artificial Sequence
  Synthetic
gaaagggcagacgaagaaggactccaaagaaagctaagactcatccgtcttctgcatcagacaagtgagtatgac

SEQ ID NO: 196543 - DNA, 75 bp, Artificial Sequence
  Synthetic
gcgcaaaatgcatcagctgcttattgccattttactaactagtgcttgcttaatatattgcaaaccacaacaata

SEQ ID NO: 196544 - DNA, 75 bp, Artificial Sequence
  Synthetic
taatatattgcaaaccacaacaatatgtaactgttttctatggcatacccgcgtggaggaatgcatccattcccc

SEQ ID NO: 196545 - DNA, 75 bp, Artificial Sequence
  Synthetic
gaacaagcagtagaagatgtctggagtctattcgagacatcaataaaaccatgtgtcaagttaacacccttatgt

SEQ ID NO: 196546 - DNA, 75 bp, Artificial Sequence
  Synthetic
gtagcaatgaactgtagcagactcagtgacagcgcaagcacaaggaacacaaccacaaacgccaccgcagccaca

SEQ ID NO: 196547 - DNA, 75 bp, Artificial Sequence
  Synthetic
accacaatcagagccacaaccatagcaccaaggaacacaaccataagtgagaattctccatgcatacgcgcagac

SEQ ID NO: 196548 - DNA, 75 bp, Artificial Sequence
  Synthetic
aactgctcaggactagaggaggaagagatggtcaagtgtcaattcaatatgacaggattacagatagataagaaa

SEQ ID NO: 196549 - DNA, 75 bp, Artificial Sequence
  Synthetic
aaacagtataacgaaacatggtactcaagcgatgtggtttgtggagaaatgaataacaccacaaaccaaagcagg

SEQ ID NO: 196550 - DNA, 75 bp, Artificial Sequence
  Synthetic
caagcgatgtggtttgtggagaaatgaataacaccacaaaccaaagcaggtgctacatgagccattgcaacacat

SEQ ID NO: 196551 - DNA, 75 bp, Artificial Sequence
  Synthetic
ccttgctaagatgcaatgacaccaattattcagggtttcagcccaattgttctaaagtagtagcttctacatgta

SEQ ID NO: 196552 - DNA, 75 bp, Artificial Sequence
  Synthetic
ttattcagggtttcagcccaattgttctaaagtagtagcttctacatgtaccaggatgatggaaacacaaacttc

SEQ ID NO: 196553 - DNA, 75 bp, Artificial Sequence
  Synthetic
tacgtggtttggctttaatggcactagagcagaaaatagaacatatatctattggcatggtaaagataacagaac

SEQ ID NO: 196554 - DNA, 75 bp, Artificial Sequence
  Synthetic
tatcatcagcttaaatgcaagttataatctctccttgcattgtaagaggccaggaaataaaacagtggtaccaat

SEQ ID NO: 196555 - DNA, 75 bp, Artificial Sequence
  Synthetic
aacacttatgtcaggattagtgtttcattcccagccgatcaatagaagacctaggcaagcatggtgctggttcaa

SEQ ID NO: 196556 - DNA, 75 bp, Artificial Sequence
  Synthetic
gggcaactggaggagagccatgcaggaggtaaaggaaaccattataaaacaccccaggtataagggaaccagtaa

SEQ ID NO: 196557 - DNA, 75 bp, Artificial Sequence
  Synthetic
gaggtaaaggaaaccattataaaacaccccaggtataagggaaccagtaacataacaaatattaccttcacggca

SEQ ID NO: 196558 - DNA, 75 bp, Artificial Sequence
  Synthetic
aggagaatttctctactgcaacatgacttggttcctcaattgggtagaaaacagaactgataagccatggcacaa

SEQ ID NO: 196559 - DNA, 75 bp, Artificial Sequence
  Synthetic
ttatgtaccatgccatataaagcaaataattaacacctggcataaagtaggaagaaatgtatatttgcctcccag

SEQ ID NO: 196560 - DNA, 75 bp, Artificial Sequence
  Synthetic
ggaaggagagttggtctgcaactcaacagtgaccagcataattgctaacattgacgacaaggataatcagacaaa

SEQ ID NO: 196561 - DNA, 75 bp, Artificial Sequence
  Synthetic
acagtgaccagcataattgctaacattgacgacaaggataatcagacaaatattacctttagtgcagatgtggca

SEQ ID NO: 196562 - DNA, 75 bp, Artificial Sequence
  Synthetic
gaactataccgattagaattgggagattataaattagtagaaataacaccaattggcttcgcacctacaccagaa

SEQ ID NO: 196563 - DNA, 75 bp, Artificial Sequence
  Synthetic
aaacgatactcctctgctcacgggagacataaaagaggtgtgtttgtgctagggttcttgggttttctcacaaca

SEQ ID NO: 196564 - DNA, 75 bp, Artificial Sequence
  Synthetic
actaaattcatgggggtgtgcgtttagacaagtctgccacactactgtaccatgggtaaatagttccttagaacc

SEQ ID NO: 196565 - DNA, 75 bp, Artificial Sequence
  Synthetic
tgattgggaaaatatgacgtggcaggaatgggaacaaaaggtccgctacctggaggcaaatatcagtcaaaagtt

SEQ ID NO: 196566 - DNA, 75 bp, Artificial Sequence
  Synthetic
tggaggcaaatatcagtcaaaagttagaagaggcacaaatccagcaggaacagaacatgtatgagctacaaaaat

SEQ ID NO: 196567 - DNA, 75 bp, Artificial Sequence
  Synthetic
aatagtaatatatgtagtacaaatgctaagtagacttagaaagggctataggcctgttttctcttccccccccgg

SEQ ID NO: 196568 - DNA, 75 bp, Artificial Sequence
  Synthetic
ttatatccaacagatccatatccacaaggaccgggaacagccagacagagaagaaacagaagaagacgttggagg

SEQ ID NO: 196569 - DNA, 75 bp, Artificial Sequence
  Synthetic
caacggtggagacagatcttggccctggccgatagcatatatacatttcctgatccgcctgctgattcgcctctt

SEQ ID NO: 196570 - DNA, 75 bp, Artificial Sequence
  Synthetic
tgatccgcctgctgattcgcctcttgaccagactgtacaacagctgcagggacttactatccaggatcttcctga

SEQ ID NO: 196571 - DNA, 75 bp, Artificial Sequence
  Synthetic
ccctccaacccatcttccagaatctcagagaccagctgcgacttagaatagccttcctacaatatgggtgcgagt

SEQ ID NO: 196572 - DNA, 75 bp, Artificial Sequence
  Synthetic
ggatccaagaagcgttccaggccttcgcgagggttacaagagagactcttacgagcgcgtgcaggggcttgtggg

SEQ ID NO: 196573 - DNA, 75 bp, Artificial Sequence
  Synthetic
acgagcgcgtgcaggggcttgtgggggacattgggacgaattgggaggggaatactcgcggtcccaagaaggatc

SEQ ID NO: 196574 - DNA, 75 bp, Artificial Sequence
  Synthetic
agacaaggggcagagatcgccctcctgtgagggacagcagtatcaacaaggggacttcatgaatactccatggag

SEQ ID NO: 196575 - DNA, 75 bp, Artificial Sequence
  Synthetic
aaccccagcaacagaaggggagaaagattcatatagacaacaaaatatggatgatgtagattcagatgatgatga

SEQ ID NO: 196576 - DNA, 75 bp, Artificial Sequence
  Synthetic
cctagtaggatactctgtcacaccaagaacaccactaagagcaatgacatataaattggcagtagatatgtcaca

SEQ ID NO: 196577 - DNA, 75 bp, Artificial Sequence
  Synthetic
caagaacaccactaagagcaatgacatataaattggcagtagatatgtcacattttataaaagaaaaagggggac

SEQ ID NO: 196578 - DNA, 75 bp, Artificial Sequence
  Synthetic
gaaagaggcctccgggtgaaggtaagtacctcaccaaaaactgtagccagaaaaggcttgttatcctacctttag

SEQ ID NO: 196579 - DNA, 75 bp, Artificial Sequence
  Synthetic
acaggtagaagaattgtgggagatgggcgcgaagaactccgtcctgagagggaaaaaagctgatgaattagaaag

SEQ ID NO: 196580 - DNA, 75 bp, Artificial Sequence
  Synthetic
aattaggttacggcccggcggaaagaaaaaatacagagtaaaacatgttgtgtgggcagcgaacgaattggacag

SEQ ID NO: 196581 - DNA, 75 bp, Artificial Sequence
  Synthetic
attcggattaacagaaagcctgttggaatcaaaagagggttgccaaaaaattcttacagttttagatccattagt

SEQ ID NO: 196582 - DNA, 75 bp, Artificial Sequence
  Synthetic
ttcttacagttttagatccattagtgccgacaggttcagaaaatttaaaaagcctttttaatactgtctgcgtca

SEQ ID NO: 196583 - DNA, 75 bp, Artificial Sequence
  Synthetic
ccccctagcgagggagggggaaactttcccgtacaacgcataggcggcaactacacccacgtgccgctgagcccc

SEQ ID NO: 196584 - DNA, 75 bp, Artificial Sequence
  Synthetic
ttcccgtacaacgcataggcggcaactacacccacgtgccgctgagccccagaactctaaatgtttgggtaaaat

SEQ ID NO: 196585 - DNA, 75 bp, Artificial Sequence
  Synthetic
ataatcagggaaattattaatgaagaagcagcagattgggatgtgcaacatccaataccaggccccttaccagca

SEQ ID NO: 196586 - DNA, 75 bp, Artificial Sequence
  Synthetic
tagacataaaacagggaccaaaagaaccgttccaaagctatgtagatagattctacaagagcttgagagcagaac

SEQ ID NO: 196587 - DNA, 75 bp, Artificial Sequence
  Synthetic
agacagatccagcagtaaagaattggatgacccaaacattactgatacaaaatgccaacccagattgtaaaataa

SEQ ID NO: 196588 - DNA, 75 bp, Artificial Sequence
  Synthetic
tactaaaaggactagggatgaatccaaccttagaaggaatgctaaccgcctgtcagggggtaggtgggccaggtc

SEQ ID NO: 196589 - DNA, 75 bp, Artificial Sequence
  Synthetic
aaccttagaaggaatgctaaccgcctgtcagggggtaggtgggccaggtcagaaagctagattaatggcagaagc

SEQ ID NO: 196590 - DNA, 75 bp, Artificial Sequence
  Synthetic
agacagtgccgagcacctagaaaacagggctgttggaagtgtggcaagccaggacatatcatggcaaactgtcca

SEQ ID NO: 196591 - DNA, 75 bp, Artificial Sequence
  Synthetic
gatagacaggcgggttttttagggatgggcccccggggaaagaagccccgcaacttccccgtggcccaaatcccg

SEQ ID NO: 196592 - DNA, 75 bp, Artificial Sequence
  Synthetic
caggggctaacaccaacagcacccccaatggatccagcagtggacctattggagaaatatatgcagcaagggaga

SEQ ID NO: 196593 - DNA, 75 bp, Artificial Sequence
  Synthetic
aagcagagggagcagagagagagaccatacaaggaggtgacagaggacctactgcacctcgagcagggagaagca

SEQ ID NO: 196594 - DNA, 75 bp, Artificial Sequence
  Synthetic
ccctgcggggaaacgacagaagacttgctgcacctcaattctctctttggaaaagacctgtagtcacagcataca

SEQ ID NO: 196595 - DNA, 75 bp, Artificial Sequence
  Synthetic
gctagacacaggggctgacgactcaatagtagcaggaatagagttaggaagtgattataatccaaaaatagtagg

SEQ ID NO: 196596 - DNA, 75 bp, Artificial Sequence
  Synthetic
gggaatagggggattcataaatactaaagaatataaaaatgtagaaatagaagtcctaggtaaaaaggtaagggc

SEQ ID NO: 196597 - DNA, 75 bp, Artificial Sequence
  Synthetic
gcccttaacaaaagaaaaaatagaggcattaaaggaaatctgtgaaaagatggaaagagagggccagctagagga

SEQ ID NO: 196598 - DNA, 75 bp, Artificial Sequence
  Synthetic
gttactcaggagttcacagaaattcagctaggaattccacacccggcaggattggccaagaaaagaagaatcact

SEQ ID NO: 196599 - DNA, 75 bp, Artificial Sequence
  Synthetic
tttccataccactgcatgaggactttagacagtacactgcatttaccttgccgtcagtaaacaatgcagaaccag

SEQ ID NO: 196600 - DNA, 75 bp, Artificial Sequence
  Synthetic
tacatggatgatatcctaatagctagcgacaggtcagatccagaacatgacaaagtagtcctacagctaaaggaa

SEQ ID NO: 196601 - DNA, 75 bp, Artificial Sequence
  Synthetic
caaaagctagtgggcgtcctaaattgggcggcacaaatttacccaggaataaaaacaaaacacttatgtaggtta

SEQ ID NO: 196602 - DNA, 75 bp, Artificial Sequence
  Synthetic
atcaggggaaaattgacactcacagaagaagtgcagtggacagagttagcagaagcggagctagaagaaaacaga

SEQ ID NO: 196603 - DNA, 75 bp, Artificial Sequence
  Synthetic
agaagcggagctagaagaaaacagaatcatattaagccaggaacaagagggacactattacaaagaggaaaaaga

SEQ ID NO: 196604 - DNA, 75 bp, Artificial Sequence
  Synthetic
gacactattacaaagaggaaaaagaactagaggcaacagtccaaaaagaccaagacaatcagtggacgtacaagg

SEQ ID NO: 196605 - DNA, 75 bp, Artificial Sequence
  Synthetic
tacatcagggagaaaaaatcctaaaagtaggaaaatatgcaaaggtaaaaaatgcccataccaacggggtcagat

SEQ ID NO: 196606 - DNA, 75 bp, Artificial Sequence
  Synthetic
acatggatcccagactgggacttcgtatctaccccaccactggtcagactagcatttaacctagtaaaagatccc

SEQ ID NO: 196607 - DNA, 75 bp, Artificial Sequence
  Synthetic
ataccaggcgcagagaccatctacacagacggatcctgcaataagcagtcaaaagaaggaaaagcaggatatgta

SEQ ID NO: 196608 - DNA, 75 bp, Artificial Sequence
  Synthetic
acagatagagggagagacagggtaaaggtactagagcaaactaccaatcagcaagcagaattagaagcctttgca

SEQ ID NO: 196609 - DNA, 75 bp, Artificial Sequence
  Synthetic
tagtaaatcagatcatagaagaaatgataaaaaaggaagcaatctatgttgcatgggtcccagcccacaaaggca

SEQ ID NO: 196610 - DNA, 75 bp, Artificial Sequence
  Synthetic
gcatgggtcccagcccacaaaggcataggaggaaatcaggaggtagatcatttagtaagtcagggcatcagacaa

SEQ ID NO: 196611 - DNA, 75 bp, Artificial Sequence
  Synthetic
tttagtaagtcagggcatcagacaagtattgttcctagaaaaaatagagcccgctcaagaagaacatgaaaaata

SEQ ID NO: 196612 - DNA, 75 bp, Artificial Sequence
  Synthetic
tcataacaatgtgaaagaactatcccacaaatttggattacccaaactagtggcaagacaaatagtaaacacatg

SEQ ID NO: 196613 - DNA, 75 bp, Artificial Sequence
  Synthetic
tgcccaatgtcaacagaaaggggaggctatacatggacaagtaaatgcagaattaggcacgtggcaaatggactg

SEQ ID NO: 196614 - DNA, 75 bp, Artificial Sequence
  Synthetic
atagtggcagtacatgttgcaagtggatttatagaggcagaagtcatcccacaagaatcaggaaggcaaacagca

SEQ ID NO: 196615 - DNA, 75 bp, Artificial Sequence
  Synthetic
ctcttcctattaaagctagctagtagatggccaataacacacctgcacacagataatggagctaacttcacttca

SEQ ID NO: 196616 - DNA, 75 bp, Artificial Sequence
  Synthetic
atctaaaaaaccaaatagacagaatcagagagcaggcaaatacagtagaaacaatagtattaatggcagttcatt

SEQ ID NO: 196617 - DNA, 75 bp, Artificial Sequence
  Synthetic
gtcatagtcaaggtaggaacagacataaaaataataccaagaaggaaggccaagatcatcagggactatggagga

SEQ ID NO: 196618 - DNA, 75 bp, Artificial Sequence
  Synthetic
aggcaagaggtggatagtggtccccacttggagggtaccagggaggatggagaagtggcatagccttgtcaagta

SEQ ID NO: 196619 - DNA, 75 bp, Artificial Sequence
  Synthetic
acttggagggtaccagggaggatggagaagtggcatagccttgtcaagtatctaaaatacaaaacaaaagatctg

SEQ ID NO: 196620 - DNA, 75 bp, Artificial Sequence
  Synthetic
gaaagggtgtgctatgtcccccaccataaggtggggtgggcatggtggacttgcagcagggtaatattcccatta

SEQ ID NO: 196621 - DNA, 75 bp, Artificial Sequence
  Synthetic
ttgcagcagggtaatattcccattaaacaacaatagcaacctagagatacaggcatattggaatctaacaccaga

SEQ ID NO: 196622 - DNA, 75 bp, Artificial Sequence
  Synthetic
aaaaggatggctttcctcttatgcagtaaggataacttggtatacagaaaaattctggacagatgttaccccaga

SEQ ID NO: 196623 - DNA, 75 bp, Artificial Sequence
  Synthetic
tatccccaggcccataagacccaggtaccgacacttcaatttttggccttagtagtagtacaacaaaatgacaga

SEQ ID NO: 196624 - DNA, 75 bp, Artificial Sequence
  Synthetic
aacagcggcgaagagactatcggagaggccttcgcttggctagagaggacggtagaagccataaacagagaggca

SEQ ID NO: 196625 - DNA, 75 bp, Artificial Sequence
  Synthetic
gtgaatcacctgcccagggagctcattttccaggtgtggcaaaggtcctggggatactggcatgatgaacaaggg

SEQ ID NO: 196626 - DNA, 75 bp, Artificial Sequence
  Synthetic
atgtcagcaagttacacaaagtatagatacttatgcttgatgcagaaagcaatgttcatacatgctagaagaggg

SEQ ID NO: 196627 - DNA, 75 bp, Artificial Sequence
  Synthetic
tgcacttgcctgggaggagggcacgggggaggagggtggagatcaggacctctccctcctccccctccaggttgg

SEQ ID NO: 196628 - DNA, 75 bp, Artificial Sequence
  Synthetic
gtttaaatgactgaagcaccaacagagcttcccccggaagataggaccccaccgagggagccaggggatgagtgg

SEQ ID NO: 196629 - DNA, 75 bp, Artificial Sequence
  Synthetic
agcttcccccggaagataggaccccaccgagggagccaggggatgagtgggtaatagaaatcctaagagaaataa

SEQ ID NO: 196630 - DNA, 75 bp, Artificial Sequence
  Synthetic
aagaagaagctttaaggcattttgacccccgcttgctgactgctcttggcagatatatctacactagatatggag

SEQ ID NO: 196631 - DNA, 75 bp, Artificial Sequence
  Synthetic
acacccctgaaggtgccagagagctcattagagtcttgcaacgagcccttttcacacacttcagagcaggatgtg

SEQ ID NO: 196632 - DNA, 75 bp, Artificial Sequence
  Synthetic
cattagagtcttgcaacgagcccttttcacacacttcagagcaggatgtggccactcaagaatcggtcaaccaag

SEQ ID NO: 196633 - DNA, 75 bp, Artificial Sequence
  Synthetic
gccactcaagaatcggtcaaccaagaggaggaaatcctctctcagctattccaacccctagaagcatgcgataac

SEQ ID NO: 196634 - DNA, 75 bp, Artificial Sequence
  Synthetic
tcgtgctattgtaagaaatgctgcttccactgcgagttgtgttttttacaaaagggactcgggatatgttatgac

SEQ ID NO: 196635 - DNA, 75 bp, Artificial Sequence
  Synthetic
cgaaagggcaggcgaagaaggacccgaaagaaaactaaggctcatccgtcttctacaccagacaagtgagtatga

SEQ ID NO: 196636 - DNA, 75 bp, Artificial Sequence
  Synthetic
cacgtgaaagggcccagctgcttgttgtcattttgctaactagtacttgcttaatatattgcaaacaacaatatg

SEQ ID NO: 196637 - DNA, 75 bp, Artificial Sequence
  Synthetic
taactgttttctatggcatacccgcgtggaagaatgcatccatccctctcttttgtgcaaccaaaaatagagata

SEQ ID NO: 196638 - DNA, 75 bp, Artificial Sequence
  Synthetic
cttggggaaccacacaatgcctgccagataatgatgattatcaggagatagctttaaatgtgacagaggctttcg

SEQ ID NO: 196639 - DNA, 75 bp, Artificial Sequence
  Synthetic
agataatgatgattatcaggagatagctttaaatgtgacagaggctttcgatgcatgggacaatacagtgacaga

SEQ ID NO: 196640 - DNA, 75 bp, Artificial Sequence
  Synthetic
acaagcagtagaagatgtctggaatctattcgagacatcaacaaaaccatgtgtcaaattaacacccttatgtgt

SEQ ID NO: 196641 - DNA, 75 bp, Artificial Sequence
  Synthetic
agcaatggagtgcaagaacagagagacagggaacgcaaccacaaccgcaccaacaaccacaccagagattaatga

SEQ ID NO: 196642 - DNA, 75 bp, Artificial Sequence
  Synthetic
gacaactgagataagtgagaacacttcatgcgtacgcggagacaactgctcaggattaagagaggaggagatagt

SEQ ID NO: 196643 - DNA, 75 bp, Artificial Sequence
  Synthetic
catatgtcagttcaatatgacaggattaataagagataagccaaaaaggtataatgaaacatggtactcaagcga

SEQ ID NO: 196644 - DNA, 75 bp, Artificial Sequence
  Synthetic
tgtggtttgtgaaccagatagcaccactagcactcgcaacaatagctcctcaggccagcacatgcgcacgtggta

SEQ ID NO: 196645 - DNA, 75 bp, Artificial Sequence
  Synthetic
catgagagattcatgtgataagcattattgggatgatatgaggtttagatattgcgcaccaccgggttatgcctt

SEQ ID NO: 196646 - DNA, 75 bp, Artificial Sequence
  Synthetic
gctaagatgtaatgataccaattactcaggctttgagcccaattgtactaaagtagtagctgcttcatgcaccag

SEQ ID NO: 196647 - DNA, 75 bp, Artificial Sequence
  Synthetic
tggtttggctttaatggcactagagcagaaaatagaacatatatctattggcatagtagagataacagaactata

SEQ ID NO: 196648 - DNA, 75 bp, Artificial Sequence
  Synthetic
atcagcttaaacaaacattataatctctctatatattgtaagagaccaggaaataaaacagtagtacctataaca

SEQ ID NO: 196649 - DNA, 75 bp, Artificial Sequence
  Synthetic
catatgccaggcttagtgtttcattcccagccaatcaataccagacctagacaagcatggtgctggttcaaaggc

SEQ ID NO: 196650 - DNA, 75 bp, Artificial Sequence
  Synthetic
agatggaaggaagccatgcaggaggtgaagcaaaccattgcagaacaccccaggtataggggaaccaatattaca

SEQ ID NO: 196651 - DNA, 75 bp, Artificial Sequence
  Synthetic
gaaaaaattaaatttacagcaccgggaaaaggttcagacccggaagtggcatacatgtggactaactgcagggga

SEQ ID NO: 196652 - DNA, 75 bp, Artificial Sequence
  Synthetic
gaatttctctactgcaatatgacttggttcctcaattggatagagaacagaacaaatgaaacaaagcacaattat

SEQ ID NO: 196653 - DNA, 75 bp, Artificial Sequence
  Synthetic
gtgccatgccatataaagcagataattaacacttggcataaagcagggagacatgtatatttgcctcccagggaa

SEQ ID NO: 196654 - DNA, 75 bp, Artificial Sequence
  Synthetic
ggcgagttgacctgtgactcaactgtgaccagcataattgctaacattgaagagaatcaaacaaatgttaccttt

SEQ ID NO: 196655 - DNA, 75 bp, Artificial Sequence
  Synthetic
tgaccagcataattgctaacattgaagagaatcaaacaaatgttacctttagtgcaggggtggcagacctatacc

SEQ ID NO: 196656 - DNA, 75 bp, Artificial Sequence
  Synthetic
agtagaaataacaccaattggcttcgcacctacaccagaaaaacgatactcctttgcctccaggagacaaacaag

SEQ ID NO: 196657 - DNA, 75 bp, Artificial Sequence
  Synthetic
gccacactactgtaccatgggaaaatgataccttagtacctaattggaaaaatatgacgtgcaaagaatgggaac

SEQ ID NO: 196658 - DNA, 75 bp, Artificial Sequence
  Synthetic
aatatggagtttacatagtagtaggaataatagctttaagagtagtaatatatgtagtacagttactatgtagct

SEQ ID NO: 196659 - DNA, 75 bp, Artificial Sequence
  Synthetic
ctcctccccccccggttatatccaacagatccatatccacaaggaccaggaacagccagacagagaaggaacaga

SEQ ID NO: 196660 - DNA, 75 bp, Artificial Sequence
  Synthetic
agaagacgttggagacaacggtggatacagatcttggccctggccgatagcatatatacatttcctgatcctcct

SEQ ID NO: 196661 - DNA, 75 bp, Artificial Sequence
  Synthetic
tacagatcttggccctggccgatagcatatatacatttcctgatcctcctgctgattcgcctgttgaccagacta

SEQ ID NO: 196662 - DNA, 75 bp, Artificial Sequence
  Synthetic
tacaacagctgcaaggacttactatccaggagcttcctgaccctccaacccatcctccagaatctcagagactgg

SEQ ID NO: 196663 - DNA, 75 bp, Artificial Sequence
  Synthetic
ctgaggcttagaacagccttcctgcaatatgggtgcgagtggatccaagaagcattccaggccgccgcgaggact

SEQ ID NO: 196664 - DNA, 75 bp, Artificial Sequence
  Synthetic
acgggagagactcttgcgagcgcgtgcaggagcttgtgggggacgttgcgacgcattgggaggggaatactcgcg

SEQ ID NO: 196665 - DNA, 75 bp, Artificial Sequence
  Synthetic
gttccaagaagaatcaggcagggggcagagctcgccctcctgtgagggacggcagaatcaccagggagagtacgc

SEQ ID NO: 196666 - DNA, 75 bp, Artificial Sequence
  Synthetic
ggaccgcccatggaggaatcccatcaacggagagaccgaacgattggtatggggagcagaacaaggggatgtaga

SEQ ID NO: 196667 - DNA, 75 bp, Artificial Sequence
  Synthetic
ttcagatgatgatgacctagtaggagtccctgtcacatcaaggacacaactgagggaaatgacctataaatttgc

SEQ ID NO: 196668 - DNA, 75 bp, Artificial Sequence
  Synthetic
caaggacacaactgagggaaatgacctataaatttgcaatagacatgtctcatttaataaaagataaggggggac

SEQ ID NO: 196669 - DNA, 75 bp, Artificial Sequence
  Synthetic
caaggcggcgtgtggagcgggagtcaagaggcctccgggtgaaggtaagtacctacaccaaaaactgtagccaga

SEQ ID NO: 196670 - DNA, 75 bp, Artificial Sequence
  Synthetic
gcctttttaatactgtctgcgtcatttggtgcatacacgcagaagagaaagtgaaagatactgaagaagcaaaaa

SEQ ID NO: 196671 - DNA, 75 bp, Artificial Sequence
  Synthetic
cacctagcgggggaggaggaaacttccccgtacaacacataggcggcaattatacccatgtgccgctgagtccca

SEQ ID NO: 196672 - DNA, 75 bp, Artificial Sequence
  Synthetic
tgacatagcagggacaacaagcacagtagaggaacagatccagtggatgtttagagcacaaaatcctgtaccagt

SEQ ID NO: 196673 - DNA, 75 bp, Artificial Sequence
  Synthetic
tctacaagagcttgagagcagaacagacagacccagcagtaaagaattggatgacccaaacattactggtacaaa

SEQ ID NO: 196674 - DNA, 75 bp, Artificial Sequence
  Synthetic
atgacccaaacattactggtacaaaatgccaacccagattgtaaattggtactaaaaggactaggaatgaatcct

SEQ ID NO: 196675 - DNA, 75 bp, Artificial Sequence
  Synthetic
accttagaagaaatgctaaccgcctgtcaaggggtaggtgggccaggccagaaagctagattaatggcagaagcc

SEQ ID NO: 196676 - DNA, 75 bp, Artificial Sequence
  Synthetic
gaaagctagattaatggcagaagccttaaaggaggccctggcaccaccacctatcccattcgcagcagcccagca

SEQ ID NO: 196677 - DNA, 75 bp, Artificial Sequence
  Synthetic
gagaaagacaattaggtgctggaattgtggaaaggaaggacactcagcaagacaatgccgagcacctaggagaca

SEQ ID NO: 196678 - DNA, 75 bp, Artificial Sequence
  Synthetic
gggctgttggaagtgtggcaagacaggacatgtcatggcaaactgcccagaaagacaggcgggttttttagggat

SEQ ID NO: 196679 - DNA, 75 bp, Artificial Sequence
  Synthetic
aagcccccggggaaagaagcctcgcaacttccccgtggcccaagttccacaggggctaacaccaacagcacctcc

SEQ ID NO: 196680 - DNA, 75 bp, Artificial Sequence
  Synthetic
aggggctaacaccaacagcacctccaatggatccagcagtggacctactggagaaatatatgcagcaagggagaa

SEQ ID NO: 196681 - DNA, 75 bp, Artificial Sequence
  Synthetic
gctgcacctcaattctctctttggaaaagaccagtagtcacagcatacattgagggtcagccagtagaagtttta

SEQ ID NO: 196682 - DNA, 75 bp, Artificial Sequence
  Synthetic
aaagaccagtagtcacagcatacattgagggtcagccagtagaagttttactagacacaggggctgacgactcaa

SEQ ID NO: 196683 - DNA, 75 bp, Artificial Sequence
  Synthetic
tgagggtcagccagtagaagttttactagacacaggggctgacgactcaatagtagcaggaatagaattaggaag

SEQ ID NO: 196684 - DNA, 75 bp, Artificial Sequence
  Synthetic
ctacccgtcgccaagatagaaccaataaaaataatgctaaaaccaggaaaggatggaccaaaactgagacagtgg

SEQ ID NO: 196685 - DNA, 75 bp, Artificial Sequence
  Synthetic
cccctaaccaaagaaaaaatagaagcattaaaagagatctgtgaaaaaatggaaaaggagggacagctagaggaa

SEQ ID NO: 196686 - DNA, 75 bp, Artificial Sequence
  Synthetic
ggacaagaataaatggaggatgctaatagatttcagggaactaaacaaggtaactcaggaattcacagaaattca

SEQ ID NO: 196687 - DNA, 75 bp, Artificial Sequence
  Synthetic
atagatttcagggaactaaacaaggtaactcaggaattcacagaaattcagttaggaatcccacacccagcagga

SEQ ID NO: 196688 - DNA, 75 bp, Artificial Sequence
  Synthetic
ttggccaagaagagaagaatcactgtactagatgtaggggatgcttacttttccataccactgcatgaagacttt

SEQ ID NO: 196689 - DNA, 75 bp, Artificial Sequence
  Synthetic
tactagatgtaggggatgcttacttttccataccactgcatgaagactttagacagtatactgcatttactttgc

SEQ ID NO: 196690 - DNA, 75 bp, Artificial Sequence
  Synthetic
ccacagggatggaagggatcaccagcaatttttcaatacacaatgaggcagatcttagagccattcagaaaagca

SEQ ID NO: 196691 - DNA, 75 bp, Artificial Sequence
  Synthetic
aaccaggatgtcattatcattcagtacatggatgatatcttaatagctagtgacaggacagatctagaacatgac

SEQ ID NO: 196692 - DNA, 75 bp, Artificial Sequence
  Synthetic
acatggatgatatcttaatagctagtgacaggacagatctagaacatgacagagtagtcctacagctaaaggaac

SEQ ID NO: 196693 - DNA, 75 bp, Artificial Sequence
  Synthetic
ttctaaatggcctagggttttctaccccagatgagaagttccaaaaagatcctccataccaatggatgggttatg

SEQ ID NO: 196694 - DNA, 75 bp, Artificial Sequence
  Synthetic
aactatggccaactaaatggaagttgcagaaaatacagttgccccaaaaggaggtatggacagtcaatgacatcc

SEQ ID NO: 196695 - DNA, 75 bp, Artificial Sequence
  Synthetic
aaaagctggtgggtgtcctaaattgggcagcacaaatctacccaaggataaagacaaagcacttatgtaggttaa

SEQ ID NO: 196696 - DNA, 75 bp, Artificial Sequence
  Synthetic
acactattaccaagaggaaaaggagctagaagccacagtccaaaaagaccaagacaatcagtggacatataaagt

SEQ ID NO: 196697 - DNA, 75 bp, Artificial Sequence
  Synthetic
gtaggaaaatatgcaaaggtgaaaaatgcccataccaatggggtcagattgctagcacaggtagttcagaagata

SEQ ID NO: 196698 - DNA, 75 bp, Artificial Sequence
  Synthetic
gacgaataccaaaatttcacctaccagtagagagagaaacttgggagcagtggtgggatgactactggcaggtaa

SEQ ID NO: 196699 - DNA, 75 bp, Artificial Sequence
  Synthetic
catggatcccagactgggactttgtatccaccccaccactggtcagactagcatttaacctagtaaaagatccca

SEQ ID NO: 196700 - DNA, 75 bp, Artificial Sequence
  Synthetic
agccaatattatagtggattcacaatatgtaatgggaatagtggcaggccaaccaacagagtcagaaaataagat

SEQ ID NO: 196701 - DNA, 75 bp, Artificial Sequence
  Synthetic
tagtagcagtgcatgttgcaagtggatttatagaggcagaagtcatcccacaggaaacaggaaggcaaacagcac

SEQ ID NO: 196702 - DNA, 75 bp, Artificial Sequence
  Synthetic
aggaagtaaagatggtggcatggtggataggtatagagcaatcctttggagtaccttacaatccacaaagccagg

SEQ ID NO: 196703 - DNA, 75 bp, Artificial Sequence
  Synthetic
gaagtggcatagccttgtcaagtatctaaaatacaaaacaaaagatctagaaaaggtgtgctatgtcccccacca

SEQ ID NO: 196704 - DNA, 75 bp, Artificial Sequence
  Synthetic
aagacaatagtcacatagagatacaggcatattggaatctaacaccagaagaaggatggctttcctcttatgcag

SEQ ID NO: 196705 - DNA, 75 bp, Artificial Sequence
  Synthetic
taaggataacctggtacacagagaatttctggacagatgttaccccagactgtacagactccctaatacatagca

SEQ ID NO: 196706 - DNA, 75 bp, Artificial Sequence
  Synthetic
cttatttcgcttgctttacagcaggtgaagtaagaagagccatcagaggggaaaagatattgtcctgctgcaatt

SEQ ID NO: 196707 - DNA, 75 bp, Artificial Sequence
  Synthetic
ggatactggcatgatgaacaagggatgtcagcaagttacacaaaatatagatacctgtgcttgatgcagaaagca

SEQ ID NO: 196708 - DNA, 75 bp, Artificial Sequence
  Synthetic
tgtcagcaagttacacaaaatatagatacctgtgcttgatgcagaaagcaatattcatacatgttagaagagggt

SEQ ID NO: 196709 - DNA, 75 bp, Artificial Sequence
  Synthetic
aatagaaatcctaagagaaataaaagaagaagctttaaggcattttgaccctcgcttgctaactgctcttggcat

SEQ ID NO: 196710 - DNA, 75 bp, Artificial Sequence
  Synthetic
gaagaagctttaaggcattttgaccctcgcttgctaactgctcttggcatatacatctatgatagatatggagac

SEQ ID NO: 196711 - DNA, 75 bp, Artificial Sequence
  Synthetic
cactcaaggatcggccaaccaaggggaggaaatcctctctcaactataccgacccctagaagcatgcgctagcac

SEQ ID NO: 196712 - DNA, 75 bp, Artificial Sequence
  Synthetic
gacccctagaagcatgcgctagcacttgctattgtaaactatgctgctaccattgccagttgtgctttttacaaa

SEQ ID NO: 196713 - DNA, 75 bp, Artificial Sequence
  Synthetic
aagaaaactaagactcatccgactcttacatcagacaagtgagtatggcgcatgaagggactcagctacttattg

SEQ ID NO: 196714 - DNA, 75 bp, Artificial Sequence
  Synthetic
tgagatgcaacacaagtacaaccacaaccacaaccgcacccacaagcacaagtgcagggagcacagccacaccca

SEQ ID NO: 196715 - DNA, 75 bp, Artificial Sequence
  Synthetic
aacccataatggtaaatgagaacacttcatgcatgcacgcaaacaactgctcaggattgggagaggaagaggtag

SEQ ID NO: 196716 - DNA, 75 bp, Artificial Sequence
  Synthetic
tcaattgtgagttcaatatgacaggattagtgagagataaaccaaagacatataatgaaacatggtactcacgtg

SEQ ID NO: 196717 - DNA, 75 bp, Artificial Sequence
  Synthetic
tataatgaaacatggtactcacgtgatgtggattgtgaaccagatagcaccacaaactcgagaaagtgttacatg

SEQ ID NO: 196718 - DNA, 75 bp, Artificial Sequence
  Synthetic
gcaccaccgggttatgccttgctaagatgcaatgataccaattactcaggctttgcacccaattgttctaaagta

SEQ ID NO: 196719 - DNA, 75 bp, Artificial Sequence
  Synthetic
aatagaacatacctttattggcatagtaaaagtgacagaactataatcagcttaaacaaatattataatctctcc

SEQ ID NO: 196720 - DNA, 75 bp, Artificial Sequence
  Synthetic
atacattgtaagaggccaggaaataaaacagtaacaccaataacacttatgtcaggatataagtttcattcccgg

SEQ ID NO: 196721 - DNA, 75 bp, Artificial Sequence
  Synthetic
ccagtaatcaatacaagacctaaacaagcatggtgctggttcaaaggccggtggaaggacgccatgcaggaggta

SEQ ID NO: 196722 - DNA, 75 bp, Artificial Sequence
  Synthetic
aagaaaaccgttgcagaacatcccagggcggtaaccaaggatccaaagaacattacctttgcagcaccgggaaaa

SEQ ID NO: 196723 - DNA, 75 bp, Artificial Sequence
  Synthetic
ggctcagacccggaagtagaatacatgtggactaactgcaggggagaatttctctactgcgacatgacttggttc

SEQ ID NO: 196724 - DNA, 75 bp, Artificial Sequence
  Synthetic
cttgattggatagagaacagacctacgaggaaggcatggcgcaattatgtgccatgccatataaggcaaataatt

SEQ ID NO: 196725 - DNA, 75 bp, Artificial Sequence
  Synthetic
ggagttgacctgcaactcaactgtgaccagcataattgctaacattgatgtaaacgaaatagataaacggacaaa

SEQ ID NO: 196726 - DNA, 75 bp, Artificial Sequence
  Synthetic
tattacctttagtgcagaggtggcagaactataccgagtagaattgggggattataaattggtagaagtaacacc

SEQ ID NO: 196727 - DNA, 75 bp, Artificial Sequence
  Synthetic
aattggcttcgcacctacatcagaaaaacggtactcctctggccaccgggagacatacaagaggtgtgctcgtgc

SEQ ID NO: 196728 - DNA, 75 bp, Artificial Sequence
  Synthetic
tagaattcttgggttttctcgcaacagcaggttctgcaatgggcgcagcgtccttgacgctgtccgctcagcccc

SEQ ID NO: 196729 - DNA, 75 bp, Artificial Sequence
  Synthetic
tagacaagtctgccacactactgtaccatgggtaaatgattccttgacacctgattggaaaaatatgacatggta

SEQ ID NO: 196730 - DNA, 75 bp, Artificial Sequence
  Synthetic
agaatgggaacaaaaagtccgctacctggaggcaaatatcagtcaaagtttagaacaggcacaaatccaacagga

SEQ ID NO: 196731 - DNA, 75 bp, Artificial Sequence
  Synthetic
ctggaggcaaatatcagtcaaagtttagaacaggcacaaatccaacaggaaaagagcatgtatgagcttcaaaaa

SEQ ID NO: 196732 - DNA, 75 bp, Artificial Sequence
  Synthetic
tgaccagactatacaacagctgcaaggacttactatccaggagcttcctgaccctccaacccatcctccagaatc

SEQ ID NO: 196733 - DNA, 75 bp, Artificial Sequence
  Synthetic
tcagagactggctgagacttaaaacagccttcctgcaatatgggtgcgagtggatccaagaagcattccaagcct

SEQ ID NO: 196734 - DNA, 75 bp, Artificial Sequence
  Synthetic
tcgcgaggactgcgggaaagactcttgcgagcgcaggcagaaacttgtgtgggacagtggaaagaattgggaggg

SEQ ID NO: 196735 - DNA, 75 bp, Artificial Sequence
  Synthetic
gggacagtggaaagaattgggaggggaatactcgcaatcccaagaaggatcagacaaggggcagaggtcgccctc

SEQ ID NO: 196736 - DNA, 75 bp, Artificial Sequence
  Synthetic
ctgtgagggacagcaatatcaacaaggggacttcatgaatactccatggagaaccccagcaacagaaaaagggaa

SEQ ID NO: 196737 - DNA, 75 bp, Artificial Sequence
  Synthetic
agacttatacaggcaacaaaatatggatgatgtagattcagatgatgatgacctagtaggagtttctgtcacacc

SEQ ID NO: 196738 - DNA, 75 bp, Artificial Sequence
  Synthetic
caagggtaccactaagaacaatgacatatagaatggcaatagacatgtcacatttaataaaagaaaaggggggac

SEQ ID NO: 196739 - DNA, 75 bp, Artificial Sequence
  Synthetic
ggttggcgcccgaacagggacttgaagaagactgagaagccttggaacacggctgagtgaaggcagtaagggcgg

SEQ ID NO: 196740 - DNA, 75 bp, Artificial Sequence
  Synthetic
caagggcggcgtgtggagcgggagtgaaagaggcctccgggtgaaggtaagtgcctacaccaaatacagtagcca

SEQ ID NO: 196741 - DNA, 75 bp, Artificial Sequence
  Synthetic
aaaaggtacagagacatctagtggcagaaacaaaaactacagaaaaaatgccaagtacaagtagaccaacagcac

SEQ ID NO: 196742 - DNA, 75 bp, Artificial Sequence
  Synthetic
cacctagcgggaacggaggaaacttccccgtacaacaagtggccggcaactatacccatgtgccactaagtcccc

SEQ ID NO: 196743 - DNA, 75 bp, Artificial Sequence
  Synthetic
tattaatcaaatgcttaattgtgtgggcgaccatcaagcagctatgcaaataatcagggaaattattaatgaaga

SEQ ID NO: 196744 - DNA, 75 bp, Artificial Sequence
  Synthetic
ggcgaccatcaagcagctatgcaaataatcagggaaattattaatgaagaagcagcagattgggacgcacaacac

SEQ ID NO: 196745 - DNA, 75 bp, Artificial Sequence
  Synthetic
atgccaacccagactgtaagttagtactaaaaggactagggataaatcctaccttagaagaaatgctaaccgcct

SEQ ID NO: 196746 - DNA, 75 bp, Artificial Sequence
  Synthetic
gacaatgccgagcacctagaagacaaggctgctggaaatgtggcaaggcaggacacatcatggcaaaatgcccag

SEQ ID NO: 196747 - DNA, 75 bp, Artificial Sequence
  Synthetic
aaagacaggcgggttttttagggttgggcccatggggaaagaagccccgcaatttccctgtggcccaaatcccgc

SEQ ID NO: 196748 - DNA, 75 bp, Artificial Sequence
  Synthetic
aggggctgacaccaacagcacccccgatagacccagtagaggacctactagagaagtacatgcagcaagggaaaa

SEQ ID NO: 196749 - DNA, 75 bp, Artificial Sequence
  Synthetic
ggcagagagagcagagagagaggccatacaaagaagtgacagaggacttcctgcagctcgagaaacaagagacac

SEQ ID NO: 196750 - DNA, 75 bp, Artificial Sequence
  Synthetic
catgcagagagacgacagaggacttgctgcacctcaattctctctttggaaaagaccagtagtcacagcacatgt

SEQ ID NO: 196751 - DNA, 75 bp, Artificial Sequence
  Synthetic
aaagaccagtagtcacagcacatgttgagggccagccagtagaagttttgctagacacaggggctgacgactcaa

SEQ ID NO: 196752 - DNA, 75 bp, Artificial Sequence
  Synthetic
gcacctccaactaatccttataatacccccacatttgcaatcaagaaaaaggacaaaaacaaatggagaatgcta

SEQ ID NO: 196753 - DNA, 75 bp, Artificial Sequence
  Synthetic
cccccacatttgcaatcaagaaaaaggacaaaaacaaatggagaatgctaatagattttagagaactaaacaagg

SEQ ID NO: 196754 - DNA, 75 bp, Artificial Sequence
  Synthetic
gttaggaattccacacccagcaggactagccaagaagaaacgaattactgtcctagatgtaggggatgcttactt

SEQ ID NO: 196755 - DNA, 75 bp, Artificial Sequence
  Synthetic
agacagtatactgcatttactctaccatcaataaacaatgctgaaccaggaaaaagatacatatataaagtctca

SEQ ID NO: 196756 - DNA, 75 bp, Artificial Sequence
  Synthetic
aacccggatatcattctcattcagtacatggatgatatcttgatagccagcgacaggacagatttagaacatgac

SEQ ID NO: 196757 - DNA, 75 bp, Artificial Sequence
  Synthetic
acatggatgatatcttgatagccagcgacaggacagatttagaacatgacagagtggttctgcagctaaaggaac

SEQ ID NO: 196758 - DNA, 75 bp, Artificial Sequence
  Synthetic
ttctaaatggcctgggattttccaccccagatgagaagttccaaaaagaccctccataccaatggatgggctatg

SEQ ID NO: 196759 - DNA, 75 bp, Artificial Sequence
  Synthetic
cccagatgagaagttccaaaaagaccctccataccaatggatgggctatgaactgtggccaactaaatggaagct

SEQ ID NO: 196760 - DNA, 75 bp, Artificial Sequence
  Synthetic
aactgtggccaactaaatggaagctgcaaagaatacaattgccccaaaaggaagtatggacagtcaatgacatcc

SEQ ID NO: 196761 - DNA, 75 bp, Artificial Sequence
  Synthetic
gaagcggaactagaagaaaacaaaatcatcttaagccaggaacaagaaggatgctattaccaagaggaaaaggag

SEQ ID NO: 196762 - DNA, 75 bp, Artificial Sequence
  Synthetic
tcatcttaagccaggaacaagaaggatgctattaccaagaggaaaaggagctagaagcaacagtccaaaaagatc

SEQ ID NO: 196763 - DNA, 75 bp, Artificial Sequence
  Synthetic
gtaggaaaatatgcaaaggtaaaaaatacccacaccaacggagtcagactcctagcacaagtagttcaaaaaata

SEQ ID NO: 196764 - DNA, 75 bp, Artificial Sequence
  Synthetic
catggatcccagactgggacttcatatctaccccgccactggtcagattagtatttaacctggtgaaagatccca

SEQ ID NO: 196765 - DNA, 75 bp, Artificial Sequence
  Synthetic
tactaggcgcagaaaccttctacacagatggatcctgcaataagcaatcaagagaaggaaaagcaggatacataa

SEQ ID NO: 196766 - DNA, 75 bp, Artificial Sequence
  Synthetic
cagatagaggaagagacaaggtgaggctattagagcaaaccaccaatcagcaagcagaattagaagcctttgcga

SEQ ID NO: 196767 - DNA, 75 bp, Artificial Sequence
  Synthetic
tggcagtaacagactcaggtccaaaggccaacattatagtagactcacaatatgtaatgggaatagtagcaggcc

SEQ ID NO: 196768 - DNA, 75 bp, Artificial Sequence
  Synthetic
catagcaatgtaaaagaactatcccataaatttggactgcccaaattagtggcaagacaaatagtaaacacatgc

SEQ ID NO: 196769 - DNA, 75 bp, Artificial Sequence
  Synthetic
acccaatgtcagcagaaaggggaggctatacatgggcaagtaaatgcagaattaggcacttggcaaatggactgc

SEQ ID NO: 196770 - DNA, 75 bp, Artificial Sequence
  Synthetic
ataggggatatgaccccagcagaaagactaatcaatatggtcactgcagaacaggaaatacaattcctccaagca

SEQ ID NO: 196771 - DNA, 75 bp, Artificial Sequence
  Synthetic
tcagctgtggaaaggacctggggaactactgtggaagggggacggagcagtcatagtcaaggtaggggctgacat

SEQ ID NO: 196772 - DNA, 75 bp, Artificial Sequence
  Synthetic
aaaaataataccaagaaggaaagctaagatcatcaaagactatggaggaaggcaagagatggatagcggttccaa

SEQ ID NO: 196773 - DNA, 75 bp, Artificial Sequence
  Synthetic
cttggagggtgccagggaggatggagaggtggcatagccttatcaagtatctaaaatacagaacaggagatctag

SEQ ID NO: 196774 - DNA, 75 bp, Artificial Sequence
  Synthetic
aaggagaaagtcatctggagatacaggcatactggaacctaacaccagaaaaaggatggctctcctcctattcag

SEQ ID NO: 196775 - DNA, 75 bp, Artificial Sequence
  Synthetic
taagactaacttggtatacagaaaaattctggacagatgttaccccagactgtgcggactccctaatacatagca

SEQ ID NO: 196776 - DNA, 75 bp, Artificial Sequence
  Synthetic
acccccaagcccataagtaccaggtaccgtcactccagtttctggccttagtggtagtgcaacaaaatggcaggc

SEQ ID NO: 196777 - DNA, 75 bp, Artificial Sequence
  Synthetic
cccagagagacaataccaccaggaaacagtggcgaagaaactatcggagaggccttcgagtggctagacaggacg

SEQ ID NO: 196778 - DNA, 75 bp, Artificial Sequence
  Synthetic
gtagaagccataaacagagaggcagtgaaccacctgccccgagagcttattttccaggtgtggcaaaggtcctgg

SEQ ID NO: 196779 - DNA, 75 bp, Artificial Sequence
  Synthetic
tgtcaataagttacacaaagtatagatatttgtgcctaatgcagaaagctatgttcatacattctaagagagggt

SEQ ID NO: 196780 - DNA, 75 bp, Artificial Sequence
  Synthetic
gcacttgcctggggggaggacatgggccgggaggatggagatcaggacctccccctcctccccctccaggtctag

SEQ ID NO: 196781 - DNA, 75 bp, Artificial Sequence
  Synthetic
tctcccccggaggataggaccccaccgagggagccaggggatgagtgggtaatagaaaccctgagagagataaaa

SEQ ID NO: 196782 - DNA, 75 bp, Artificial Sequence
  Synthetic
taagaagctttaaagcactttgaccctcgcttgctaattactcttggcaactatatctatgctagacatggagac

SEQ ID NO: 196783 - DNA, 75 bp, Artificial Sequence
  Synthetic
acccttgaaggcgccagagggctcattaggatcctacaacgagccctcctcttgcacttcagagcaggatgcggc

SEQ ID NO: 196784 - DNA, 75 bp, Artificial Sequence
  Synthetic
cgctcaaggattggtcagcccaggggacgaaatcctttatcagctataccaacccctagaggcatgcgataacaa

SEQ ID NO: 196785 - DNA, 75 bp, Artificial Sequence
  Synthetic
gacgaaatcctttatcagctataccaacccctagaggcatgcgataacaaatgttactgtaaaaagtgctgctac

SEQ ID NO: 196786 - DNA, 75 bp, Artificial Sequence
  Synthetic
aaagggcagaagaagaagaactccgaagaaaactaaggctcattcgtcttctgcatcagacaagtgagtaagatg

SEQ ID NO: 196787 - DNA, 75 bp, Artificial Sequence
  Synthetic
atgatgactatcaggaaatagctttaaatgtgacagaggccttcgacgcatggaataatacagtaacagaacaag

SEQ ID NO: 196788 - DNA, 75 bp, Artificial Sequence
  Synthetic
tgagacatcaataaaaccatgcgtcaaactaacacccttatgtgtagcaatgcgttgtaacagcacaactgcaaa

SEQ ID NO: 196789 - DNA, 75 bp, Artificial Sequence
  Synthetic
aaacacaacctccacaccaacaaccaccacaacagcaaacacaacaataggagagaattcttcatgcatacgcac

SEQ ID NO: 196790 - DNA, 75 bp, Artificial Sequence
  Synthetic
agacaactgcacagggttgggagaagaagagatggtcgactgtcagttcaatatgacaggattagagagggataa

SEQ ID NO: 196791 - DNA, 75 bp, Artificial Sequence
  Synthetic
gaaaaaactatataatgaaacatggtactcaaaagatgtagtctgtgaatcaaatgacaccaagaaagagaaaac

SEQ ID NO: 196792 - DNA, 75 bp, Artificial Sequence
  Synthetic
tactcaaaagatgtagtctgtgaatcaaatgacaccaagaaagagaaaacatgttacatgaaccactgcaacaca

SEQ ID NO: 196793 - DNA, 75 bp, Artificial Sequence
  Synthetic
tattggcatggtagggataatagaactatcattagcttaaacaagttttataatctcaccgtacattgtaagagg

SEQ ID NO: 196794 - DNA, 75 bp, Artificial Sequence
  Synthetic
tcactcccagccaatcaatagaagacccaggcaagcatggtgctggttcaaaggcgagtggaaggaagccatgaa

SEQ ID NO: 196795 - DNA, 75 bp, Artificial Sequence
  Synthetic
ggaggtgaagctaacccttgcaaaacatcccaggtataaaggaaccaacgacacagaaaaaattcgttttatagc

SEQ ID NO: 196796 - DNA, 75 bp, Artificial Sequence
  Synthetic
catcccaggtataaaggaaccaacgacacagaaaaaattcgttttatagcgccaggagaacgctcagacccagaa

SEQ ID NO: 196797 - DNA, 75 bp, Artificial Sequence
  Synthetic
gggaaggacagttaacctgcaactctacagtgaccagcataattgctaacattgacggaggagagaaccagacaa

SEQ ID NO: 196798 - DNA, 75 bp, Artificial Sequence
  Synthetic
atattacctttagtgcagaggtggcagaactataccgattagaattgggggattataaattgatagaagtaacac

SEQ ID NO: 196799 - DNA, 75 bp, Artificial Sequence
  Synthetic
gattataaattgatagaagtaacaccaattggctttgcacctacaccagtaaaaagatactcctctgctccagtg

SEQ ID NO: 196800 - DNA, 75 bp, Artificial Sequence
  Synthetic
gactgaccgtctggggaacaaaaaatctccaggcaagagtcactgctatcgagaaatacttaaaggaccaggcgc

SEQ ID NO: 196801 - DNA, 75 bp, Artificial Sequence
  Synthetic
ccatgggtaaatgacaccttaacgcctgattggaacaacatgacatggcaggaatgggagcaacgaatccgcaac

SEQ ID NO: 196802 - DNA, 75 bp, Artificial Sequence
  Synthetic
ctagaggcaaatatcagtgaaagtttagaacaggcacaaatccagcaagaaaagaacatgtatgaactacaaaaa

SEQ ID NO: 196803 - DNA, 75 bp, Artificial Sequence
  Synthetic
tagaacaggcacaaatccagcaagaaaagaacatgtatgaactacaaaaattaaatagctgggatgtttttggca

SEQ ID NO: 196804 - DNA, 75 bp, Artificial Sequence
  Synthetic
caaatatattcagtatggagtttatatagtagtaggaataatagttttaagaatagtaatatatgtagtacaaat

SEQ ID NO: 196805 - DNA, 75 bp, Artificial Sequence
  Synthetic
cttacttccaacagatccatatccacaaggaccgggaacagccagccagagaagaaacagaagaagacgttggaa

SEQ ID NO: 196806 - DNA, 75 bp, Artificial Sequence
  Synthetic
acagcgttggagacaattggtggccctggccgataagatatatacatttcctgatccgccagctgattcgcctct

SEQ ID NO: 196807 - DNA, 75 bp, Artificial Sequence
  Synthetic
tgaacagactatacaacatctgcagggacttactatccaggagcttccagaccctccaactaatctcccagagtc

SEQ ID NO: 196808 - DNA, 75 bp, Artificial Sequence
  Synthetic
ttcggagagcattgacagcagtcagagactggctgagatttaacacagcctacctgcaatatgggggcgagtgga

SEQ ID NO: 196809 - DNA, 75 bp, Artificial Sequence
  Synthetic
tccaagaagcgttccgagccttcgcgagggctacgggagagactcttacaaacgcctggagaggcttctggggga

SEQ ID NO: 196810 - DNA, 75 bp, Artificial Sequence
  Synthetic
cactgggacaaattgggaggggaatacttgcagtcccaagaaggatcaggcagggggcagaaatcgccctcctgt

SEQ ID NO: 196811 - DNA, 75 bp, Artificial Sequence
  Synthetic
gagggacggcggtatcaacagggagattttatgaataccccatggagagccccagcagaaggggagaaaggctcg

SEQ ID NO: 196812 - DNA, 75 bp, Artificial Sequence
  Synthetic
tacaagcaacaaaatatggatgatgtagattcagatgatgatgacctagtaggggtccctgtcacaccaagagta

SEQ ID NO: 196813 - DNA, 75 bp, Artificial Sequence
  Synthetic
caagagtaccattaagagaaatgacatataggttggcaagagatatgtcacatttgataaaagaaaaggggggac

SEQ ID NO: 196814 - DNA, 75 bp, Artificial Sequence
  Synthetic
aaagaggcctccgggtgaaggtaagtacctacaccaaaaaattgtagccaggaagggcttgttatcctaccttta

SEQ ID NO: 196815 - DNA, 75 bp, Artificial Sequence
  Synthetic
ccacctagcgggaagggaggaaacttccccgtacaacaagtaggcggcaattatacccatgtgccgctgagtcct

SEQ ID NO: 196816 - DNA, 75 bp, Artificial Sequence
  Synthetic
aagcagcagattgggatgtgcaacatccaataccaggtcccttaccagcggggcagcttagagaaccaagagggt

SEQ ID NO: 196817 - DNA, 75 bp, Artificial Sequence
  Synthetic
agtagatgaacagatccagtggatgtttaggccacaaaatcccgtaccagtgggaaacatctataggagatggat

SEQ ID NO: 196818 - DNA, 75 bp, Artificial Sequence
  Synthetic
ccagataggactgcagaagtgcgtcaggatgtacaacccgaccaacatcctagacataaaacaaggaccaaagga

SEQ ID NO: 196819 - DNA, 75 bp, Artificial Sequence
  Synthetic
tagacataaaacaaggaccaaaggaaccattccaaagttatgtagatagattctacaaaagcttgagggcagaac

SEQ ID NO: 196820 - DNA, 75 bp, Artificial Sequence
  Synthetic
aaacagatccagcagtgaagaattggatgacccagacactactagtacagaatgccaacccagactgtaaattag

SEQ ID NO: 196821 - DNA, 75 bp, Artificial Sequence
  Synthetic
aatgccaacccagactgtaaattagtactaaaaggactagggatgaatcctaccttagaagagatgctaaccgcc

SEQ ID NO: 196822 - DNA, 75 bp, Artificial Sequence
  Synthetic
cttaaaagaggccttgacaccagcccctatcccatttgcagcagcccagcagaaaaggacaattaaatgctggaa

SEQ ID NO: 196823 - DNA, 75 bp, Artificial Sequence
  Synthetic
agacaatgccgagcacctagaagacagggctgctggaagtgtggtaaaccaggacatgtcatagcaaattgccca

SEQ ID NO: 196824 - DNA, 75 bp, Artificial Sequence
  Synthetic
caacttccccgtggcccaagtcccgcaggggctaacaccaacagcacccccagtagatccagcagtggacctact

SEQ ID NO: 196825 - DNA, 75 bp, Artificial Sequence
  Synthetic
ggagaattatatgcagcaaggaaaaagacaaagagaacagagagagagaccatacaaagaagtgacagaggactt

SEQ ID NO: 196826 - DNA, 75 bp, Artificial Sequence
  Synthetic
actgcacctcgagcagggagaggcaccatgcagagagacgacagaggacttgctgcacctcaattctctcttttg

SEQ ID NO: 196827 - DNA, 75 bp, Artificial Sequence
  Synthetic
aaaagaccagtagtcacggcatacgtcgagggccagccagtagaagttctgctagacacgggggctgacgactca

SEQ ID NO: 196828 - DNA, 75 bp, Artificial Sequence
  Synthetic
atagtagcagggatagagttagggagcaattatagtccaaagatagtaggaggaatagggggattcataaatacc

SEQ ID NO: 196829 - DNA, 75 bp, Artificial Sequence
  Synthetic
aggaatagggggattcataaataccaaggaatataaaaatgtaaaaatagaagttttaggtaaaaaggtaagggc

SEQ ID NO: 196830 - DNA, 75 bp, Artificial Sequence
  Synthetic
caccataatgacaggtgacaccccaatcaacatttttggcagaaatattctgacagccttaggcatgtcattaaa

SEQ ID NO: 196831 - DNA, 75 bp, Artificial Sequence
  Synthetic
tttaccagtcgccaaaatagaaccaataaaaataatgttaaagccaggaaaagatggaccaaaactgaggcaatg

SEQ ID NO: 196832 - DNA, 75 bp, Artificial Sequence
  Synthetic
gcccttaacaaaagaaaaaatagaggcactaaaagaaatctgtgaaaaaatggaaagagaaggccagctagagga

SEQ ID NO: 196833 - DNA, 75 bp, Artificial Sequence
  Synthetic
aatagattttagagaactaaacaaggtaactcaagatttcacagaaattcagttaggaattccacacccagcagg

SEQ ID NO: 196834 - DNA, 75 bp, Artificial Sequence
  Synthetic
ccatcaataaacaatgcagaaccaggaaaaagatatatatataaggtcctgcctcagggatggaaggggtcacca

SEQ ID NO: 196835 - DNA, 75 bp, Artificial Sequence
  Synthetic
tacatggatgatatcctaatagctagtgacaggacagatctagaacatgacaaggtggtcctgcagctaaaggaa

SEQ ID NO: 196836 - DNA, 75 bp, Artificial Sequence
  Synthetic
gaactgtggccaactaagtggaagctgcagaagatacagttgccccaaaaagatgtatggacagtaaatgacatc

SEQ ID NO: 196837 - DNA, 75 bp, Artificial Sequence
  Synthetic
caaaagttagtgggtgtcttaaactgggcagcacaaatctacccagggataaaaaccagacacttatgtaagcta

SEQ ID NO: 196838 - DNA, 75 bp, Artificial Sequence
  Synthetic
attagaggaaaaatgacactcacagaagaagtacagtggacagaactagcagaggcggagttagaagagaacaag

SEQ ID NO: 196839 - DNA, 75 bp, Artificial Sequence
  Synthetic
attatcttaagccaggagcaagagggacactattaccaagaagaaaaagagttagaagcaacagtccaaaaggat

SEQ ID NO: 196840 - DNA, 75 bp, Artificial Sequence
  Synthetic
acatggatccctgactgggacttcgtatctaccccgccgctggtcagactagcatttaacctggtaaaagatcct

SEQ ID NO: 196841 - DNA, 75 bp, Artificial Sequence
  Synthetic
tatctaccccgccgctggtcagactagcatttaacctggtaaaagatcctataccaagaacagagactttctaca

SEQ ID NO: 196842 - DNA, 75 bp, Artificial Sequence
  Synthetic
aaaggaaggaaaagcaggatatgtaacagatagagggagagacaaggtaaggatgctagaacaaactaccaatca

SEQ ID NO: 196843 - DNA, 75 bp, Artificial Sequence
  Synthetic
gtatgtaatggggatagtagcaggccagccaacagaatcagagagtagaatagtaaatcaaatcatagaggagat

SEQ ID NO: 196844 - DNA, 75 bp, Artificial Sequence
  Synthetic
taggagggaatcaggaggtagatcagttagtaagtcagggcatcagacaagtgttgttcctggaaaaaatagagc

SEQ ID NO: 196845 - DNA, 75 bp, Artificial Sequence
  Synthetic
agataatggtgccaacttcacttcacaggaagtaaaaatggtagcatggtgggtaggtatagaacaatctttcgg

SEQ ID NO: 196846 - DNA, 75 bp, Artificial Sequence
  Synthetic
tagagaacaggcaaatacagtagaaacaatagtactgatggcaacacactgcatgaattttaaaagaaggggagg

SEQ ID NO: 196847 - DNA, 75 bp, Artificial Sequence
  Synthetic
taaaagtagtaccaaggaggaaagccaagatcatcaaagactatggaggaaggcaagaactggatagtggttccc

SEQ ID NO: 196848 - DNA, 75 bp, Artificial Sequence
  Synthetic
ataaagtaggatgggcatggtggacttgcagcagggtaatattcccattaaagggaaacagtcatctagaaatac

SEQ ID NO: 196849 - DNA, 75 bp, Artificial Sequence
  Synthetic
aaaaggatggctctcctcttattcagtaagaatgacttggtatacggaaaggttctggacagatgttaccccaga

SEQ ID NO: 196850 - DNA, 75 bp, Artificial Sequence
  Synthetic
tatccccaagcccatagagcccaggtaccgtcactccaatttttggccttagtggtagtgcagcaaaatgacaga

SEQ ID NO: 196851 - DNA, 75 bp, Artificial Sequence
  Synthetic
taccgtcactccaatttttggccttagtggtagtgcagcaaaatgacagaccccagagaaacggtacccccagga

SEQ ID NO: 196852 - DNA, 75 bp, Artificial Sequence
  Synthetic
aacagtggcgaagagactatcgaagaggccttcaattggctagacaggacggtagaagccataaacagagaggca

SEQ ID NO: 196853 - DNA, 75 bp, Artificial Sequence
  Synthetic
gagatactggcatgatgaacaagggatgtcacaaagttacacaaagtatagatatttgtgcttaatacagaaggc

SEQ ID NO: 196854 - DNA, 75 bp, Artificial Sequence
  Synthetic
atgtcacaaagttacacaaagtatagatatttgtgcttaatacagaaggctatgttcacacattgtaagagaggg

SEQ ID NO: 196855 - DNA, 75 bp, Artificial Sequence
  Synthetic
tgcacttgcctggggggaggacatgggccaggagggtggagaccaggacctccccctcctccccctccaggtcta

SEQ ID NO: 196856 - DNA, 75 bp, Artificial Sequence
  Synthetic
gtttcccccggaggatgggaccccaccgagggaaccaggggatgagtggataatagaaatcctgagaaaaataaa

SEQ ID NO: 196857 - DNA, 75 bp, Artificial Sequence
  Synthetic
gaaagaagctttaaagcattttgaccctcgcttgctaactgctcttggcaactatatccatactagacatggaga

SEQ ID NO: 196858 - DNA, 75 bp, Artificial Sequence
  Synthetic
actatatccatactagacatggagacacccttgaaggcgccagagagctcattaatgtcctacaacgagccctct

SEQ ID NO: 196859 - DNA, 75 bp, Artificial Sequence
  Synthetic
tcatgcacttcagagcgggatgtaggctctcaagaattggccaaacagggggaagaactcctttcccagctacat

SEQ ID NO: 196860 - DNA, 75 bp, Artificial Sequence
  Synthetic
cgacccctagaaccatgcaataacaaatgctattgtaaaggatgctgcttccactgccagctgtgttttttaaac

SEQ ID NO: 196861 - DNA, 75 bp, Artificial Sequence
  Synthetic
aaggggctcgggatatgttatgaccggaagggcagacgaagaagaactccgaagaaaactaaggctcattcatct

SEQ ID NO: 196862 - DNA, 75 bp, Artificial Sequence
  Synthetic
tctgcatcagacaagtgagtatgatgggtggtagaaatcagctgcttgttgccattttgctaactagtacttgct

SEQ ID NO: 196863 - DNA, 75 bp, Artificial Sequence
  Synthetic
tgatatattgcaccaattatgtgactgttttctatggcatacccgcgtggagaaatgcatccattcccctctttt

SEQ ID NO: 196864 - DNA, 75 bp, Artificial Sequence
  Synthetic
tgaatgtgacagaggctttcgatgcatgggataatacagtaacagaacaagcaatagaagatgtctggaatctat

SEQ ID NO: 196865 - DNA, 75 bp, Artificial Sequence
  Synthetic
atgggataatacagtaacagaacaagcaatagaagatgtctggaatctatttgagacatcaataaaaccatgtgt

SEQ ID NO: 196866 - DNA, 75 bp, Artificial Sequence
  Synthetic
caaattaacgcctttatgtgtagcaatgagatgtaacaacacagatgcaaggaacacaaccacacccacaacagc

SEQ ID NO: 196867 - DNA, 75 bp, Artificial Sequence
  Synthetic
atccccgcgtacaataaaacccgtgacagagataagtgagaattcctcatgcatacgcgcaaacaactgctcagg

SEQ ID NO: 196868 - DNA, 75 bp, Artificial Sequence
  Synthetic
attgggagaagaagaggtggtcaattgtcaattcaatatgacaggattagagagagataagaaaaagcaatatag

SEQ ID NO: 196869 - DNA, 75 bp, Artificial Sequence
  Synthetic
tgagacatggtactcgaaggatgtagtttgtgaaggaaatggcaccacagatacatgttacatgaaccattgcaa

SEQ ID NO: 196870 - DNA, 75 bp, Artificial Sequence
  Synthetic
ttttgccctactaagatgcaatgataccaattattcaggctttgcgcccaattgctctaaggtagtagctgctac

SEQ ID NO: 196871 - DNA, 75 bp, Artificial Sequence
  Synthetic
gcactagagcagaaaatagaacatttatctattggcatggtagggataacagaactatcatcagcttaaacaaat

SEQ ID NO: 196872 - DNA, 75 bp, Artificial Sequence
  Synthetic
attataatctcactatacattgtaagaggccaggaaataagacagtggtaccaataacacttatgtcagggttaa

SEQ ID NO: 196873 - DNA, 75 bp, Artificial Sequence
  Synthetic
ggtttcactcccagccggtcatcaataaaagacccagacaagcatggtgttggttcaaaggtgaatggaagggag

SEQ ID NO: 196874 - DNA, 75 bp, Artificial Sequence
  Synthetic
ccatgcaggaggtgaaggaaacccttgcaaaacatcccaggtataaaggaaccaatgaaacaaagaatattaact

SEQ ID NO: 196875 - DNA, 75 bp, Artificial Sequence
  Synthetic
tgcaaaacatcccaggtataaaggaaccaatgaaacaaagaatattaactttacagcaccaggaaagggctcaga

SEQ ID NO: 196876 - DNA, 75 bp, Artificial Sequence
  Synthetic
cccagaggtggcatacatgtggactaactgcagaggagaatttctctactgcaacatgacttggttcctcaattg

SEQ ID NO: 196877 - DNA, 75 bp, Artificial Sequence
  Synthetic
taattaacacctggcataaggtagggaaaaatgtatatttgcctcccagggaaggggagttgacctgcaactcaa

SEQ ID NO: 196878 - DNA, 75 bp, Artificial Sequence
  Synthetic
gaaggggagttgacctgcaactcaacagtaactagcataattgctaacattgatgcaaatggaaataatacaaat

SEQ ID NO: 196879 - DNA, 75 bp, Artificial Sequence
  Synthetic
attacctttagtgcagaggtggcagaactataccgattagagttgggagattataaattggtagaaataacacca

SEQ ID NO: 196880 - DNA, 75 bp, Artificial Sequence
  Synthetic
aactataccgattagagttgggagattataaattggtagaaataacaccaattggcttcgcacctacagcagaaa

SEQ ID NO: 196881 - DNA, 75 bp, Artificial Sequence
  Synthetic
aaagatactcctctactccaatgaggaacaagagaggtgtgttcgtgctagggttcttgggttttctcgcaacag

SEQ ID NO: 196882 - DNA, 75 bp, Artificial Sequence
  Synthetic
gagtggaacaatatgacgtggcaagaatgggaaggcaaaatccgcgacctggaggcaaatatcagtcaacaatta

SEQ ID NO: 196883 - DNA, 75 bp, Artificial Sequence
  Synthetic
ggaggcaaatatcagtcaacaattagaacaagcacaaattcagcaagagaagaatatgtatgaactacaaaagtt

SEQ ID NO: 196884 - DNA, 75 bp, Artificial Sequence
  Synthetic
aaatagctgggatgtttttggtaactggtttgacttaacctcctggatcaagtatattcaatatggagtttatat

SEQ ID NO: 196885 - DNA, 75 bp, Artificial Sequence
  Synthetic
tggtttgacttaacctcctggatcaagtatattcaatatggagtttatataataataggaatagtagttcttaga

SEQ ID NO: 196886 - DNA, 75 bp, Artificial Sequence
  Synthetic
taagtagacttagaaagggctataggcctgttttctcttccccccccggttacctccaacagatccatatccaca

SEQ ID NO: 196887 - DNA, 75 bp, Artificial Sequence
  Synthetic
aacgttggagacagctcgtggccttggccgataagatatatacatttcctgatccaccagctgattcgcctcttg

SEQ ID NO: 196888 - DNA, 75 bp, Artificial Sequence
  Synthetic
gccggactatacaacatctgcaggaacttactatccaggatctccctgaccctccgaccagttttccagagtctt

SEQ ID NO: 196889 - DNA, 75 bp, Artificial Sequence
  Synthetic
cagagggcactgacagcaatcagagactggctaagaactgacgcagcctacttgcagtatgggtgcgagtggatc

SEQ ID NO: 196890 - DNA, 75 bp, Artificial Sequence
  Synthetic
caaggagcgttccaggccttcgcaagggctacgagagagactcttgcgggcacgtggagagacttgtggggggca

SEQ ID NO: 196891 - DNA, 75 bp, Artificial Sequence
  Synthetic
ctgcagcggatcgggaggggaatacttgcagtcccaagaagaatcaggcagggagcagagatcgccctcctatga

SEQ ID NO: 196892 - DNA, 75 bp, Artificial Sequence
  Synthetic
gggacagcggtatcagcagggagactttatgaataccccatggagaaccccagcaaaagaaggggagaaagaatt

SEQ ID NO: 196893 - DNA, 75 bp, Artificial Sequence
  Synthetic
gtacaagcaacaaaatagagatgatgtagattcggatgatgatgacctagtaggggtctctgtcacaccaagagt

SEQ ID NO: 196894 - DNA, 75 bp, Artificial Sequence
  Synthetic
caagagtaccactaagagaattgacacatagattagcaatagatgtgtcacattttataaaagaaaaagggggac

SEQ ID NO: 196895 - DNA, 75 bp, Artificial Sequence
  Synthetic
gccaaatacaagtagaccaacagcaccacctagcgggaaaggaggaaacttccccgtacaacaagtaggcggcaa

SEQ ID NO: 196896 - DNA, 75 bp, Artificial Sequence
  Synthetic
tgttagcacaagtagttcaaaagataggaaaagaagcactagtcatttggggacgaataccaaaatttcacctac

SEQ ID NO: 196897 - DNA, 75 bp, Artificial Sequence
  Synthetic
ggacgaataccaaaatttcacctaccagtagaaagagagacctgggaacagtggtgggatgactactggcaggtg

SEQ ID NO: 196898 - DNA, 75 bp, Artificial Sequence
  Synthetic
tgaggcatggtactcgaaggatgtagtttgtgaaggaaatggcaccacaagcacatgttacatgaaccattgcaa

SEQ ID NO: 196899 - DNA, 75 bp, Artificial Sequence
  Synthetic
ggtttagatactgtgcaccaccgggttttgccctactaagatgcaatgataccaattattcaggctttgcgccca

SEQ ID NO: 196900 - DNA, 75 bp, Artificial Sequence
  Synthetic
gcaacatgacttggttcctcaattggatagaaaataagacacaccgcaattatgtaccgtgccatataaaacaaa

SEQ ID NO: 196901 - DNA, 75 bp, Artificial Sequence
  Synthetic
ggttggcgcccgaacagggacccgagaagagtgagagtcttcggaacacagctgagtgaaggcagtaagggcggc

SEQ ID NO: 196902 - DNA, 75 bp, Artificial Sequence
  Synthetic
gaagagtgagagtcttcggaacacagctgagtgaaggcagtaagggcggcaggaatcaaccacgacggagagctc

SEQ ID NO: 196903 - DNA, 75 bp, Artificial Sequence
  Synthetic
gctgagtgaaggcagtaagggcggcaggaatcaaccacgacggagagctcctgtaaaggcgcagcggtaccaggc

SEQ ID NO: 196904 - DNA, 75 bp, Artificial Sequence
  Synthetic
aagttaggttacggcccggcggaaagaaaaagtacatgttaaaacatgtaatatgggcagcaaatgaattagaca

SEQ ID NO: 196905 - DNA, 75 bp, Artificial Sequence
  Synthetic
gaaaaagtacatgttaaaacatgtaatatgggcagcaaatgaattagacagattcggattggcagaaaacctgtt

SEQ ID NO: 196906 - DNA, 75 bp, Artificial Sequence
  Synthetic
aagtgaaagataccgaggaagcaaaaaagctagcacagagccatctagtggtagacactgaaaaaacacctactg

SEQ ID NO: 196907 - DNA, 75 bp, Artificial Sequence
  Synthetic
tggcagaaattccccagtgcaacaagtagctggcaattatgtccacgtgccattaagcccccgaaccctaaatgc

SEQ ID NO: 196908 - DNA, 75 bp, Artificial Sequence
  Synthetic
gatttcaggcactatcagagggatgtaccccttatgatattaatcagatgctaaattgtgtaggagaacatcagg

SEQ ID NO: 196909 - DNA, 75 bp, Artificial Sequence
  Synthetic
cagccatgcaagtcattagggaaataatcaatgaggaggcggcagactgggaccagcagcacccggtgccaggtc

SEQ ID NO: 196910 - DNA, 75 bp, Artificial Sequence
  Synthetic
ccccagaggatcagatatagcgggaaccaccagcacagtagaggaacagatacagtggatgtacaggggtcaaag

SEQ ID NO: 196911 - DNA, 75 bp, Artificial Sequence
  Synthetic
tcctatcccagtagggaacatttatagaagatggattcagctaggattgcagaagtgtgtccggatgtacaatcc

SEQ ID NO: 196912 - DNA, 75 bp, Artificial Sequence
  Synthetic
tactggtccagaatgctaacccagattgcaagctagtactcaagggtttggggccacaccccaccctagaggaaa

SEQ ID NO: 196913 - DNA, 75 bp, Artificial Sequence
  Synthetic
tgctgctcaacagaaggcaggaagaagagggacagtgacatgctggaactgtggcaaagggggacatacagccaa

SEQ ID NO: 196914 - DNA, 75 bp, Artificial Sequence
  Synthetic
gcaatgcagggctcctagaagacagggatgctggaaatgtggaaaaccaggacacaacatggcaaattgtccaga

SEQ ID NO: 196915 - DNA, 75 bp, Artificial Sequence
  Synthetic
aagacaggctggttttttagggcttggaccctggggaaagaagcctcgcaacttccccatggcccaagtgcctca

SEQ ID NO: 196916 - DNA, 75 bp, Artificial Sequence
  Synthetic
ggagatagtgccatctgcgcccccgatgaacacagcagagggcaagacacatcagggagcgataccatctgcgcc

SEQ ID NO: 196917 - DNA, 75 bp, Artificial Sequence
  Synthetic
ccctgcagatccggcagtggagatgctgaaaagctacatgcaactagggaagcagcagagagagaagcaggggag

SEQ ID NO: 196918 - DNA, 75 bp, Artificial Sequence
  Synthetic
caactataatgacaggagacaccccaataaatatttttggcagaaatatcttaaacaccttaggcatgactctaa

SEQ ID NO: 196919 - DNA, 75 bp, Artificial Sequence
  Synthetic
aaggatggaccaaaaatcagacaatggcctctatctaaagaaaagatactggcccttagagagatctgtgaaaaa

SEQ ID NO: 196920 - DNA, 75 bp, Artificial Sequence
  Synthetic
ggcccttagagagatctgtgaaaaaatggaaaaggaggggcagctagaagaagcatctcccactaatccatacaa

SEQ ID NO: 196921 - DNA, 75 bp, Artificial Sequence
  Synthetic
aagcatctcccactaatccatacaacacacccacctttgctataaagaaaaaggataaaaacaaatggagaatgc

SEQ ID NO: 196922 - DNA, 75 bp, Artificial Sequence
  Synthetic
caactaggtattccccacccggcagggctggcagaaaaaaggagaataacagtgatagatgtaggagatgcctac

SEQ ID NO: 196923 - DNA, 75 bp, Artificial Sequence
  Synthetic
gccatcaataaataatgcagagccaggaaaaaggtacatttataaagtcctaccacagggatggaagggatcccc

SEQ ID NO: 196924 - DNA, 75 bp, Artificial Sequence
  Synthetic
aaggtactagaccccttcagaagggccaacaatgatgtcaccataatccagtacatggatgacatccttgtggca

SEQ ID NO: 196925 - DNA, 75 bp, Artificial Sequence
  Synthetic
gtacatggatgacatccttgtggcaagcgatagaagtgatctagaacatgataaggtagtgtctcaactaaaaga

SEQ ID NO: 196926 - DNA, 75 bp, Artificial Sequence
  Synthetic
gaggaggtgcagtggacagaactagcagaggcagagatgcaggaaaataaaatcatcctaggacaggaacaggaa

SEQ ID NO: 196927 - DNA, 75 bp, Artificial Sequence
  Synthetic
attcatcagggaaataaagtcctaaaagtaggaaaatatgcaaaggttaaaaacacccacaccaatggagtaaga

SEQ ID NO: 196928 - DNA, 75 bp, Artificial Sequence
  Synthetic
ccagtagagagagagacatgggaccaatggtggacagattactggcaagtgacttggatcccagaatgggacttt

SEQ ID NO: 196929 - DNA, 75 bp, Artificial Sequence
  Synthetic
caaaggaaggaaaggcagggtatgtcacagacaggggaagggacaaagttaaaccattagagcagacaacaaatc

SEQ ID NO: 196930 - DNA, 75 bp, Artificial Sequence
  Synthetic
aacaagcagaacttgaagcatttgcactagcactacaggattcaggaccacaagtcaacatcatagtagactcac

SEQ ID NO: 196931 - DNA, 75 bp, Artificial Sequence
  Synthetic
actagcactacaggattcaggaccacaagtcaacatcatagtagactcacaatatgtcatgggaatagtagctgg

SEQ ID NO: 196932 - DNA, 75 bp, Artificial Sequence
  Synthetic
acagccaacagaaacagagtcaccgatagtaaataagataattgaagaaatgatcaaaaaggaagcaatatatgt

SEQ ID NO: 196933 - DNA, 75 bp, Artificial Sequence
  Synthetic
tgatcaaaaaggaagcaatatatgtaggatgggtgccagctcacaaaggactaggtggtaatcaggaagtagacc

SEQ ID NO: 196934 - DNA, 75 bp, Artificial Sequence
  Synthetic
aggatgggtgccagctcacaaaggactaggtggtaatcaggaagtagaccacctagtaagtcaaggaattaggca

SEQ ID NO: 196935 - DNA, 75 bp, Artificial Sequence
  Synthetic
ctaggtggtaatcaggaagtagaccacctagtaagtcaaggaattaggcaggttctattcctagaaaagatagaa

SEQ ID NO: 196936 - DNA, 75 bp, Artificial Sequence
  Synthetic
tcataaatttggaattccacaactagtggcaaaacaaatagtaaactcctgtgataaatgtcaacaaaaaggaga

SEQ ID NO: 196937 - DNA, 75 bp, Artificial Sequence
  Synthetic
gtggcaaaacaaatagtaaactcctgtgataaatgtcaacaaaaaggagaagctgttcatggacaggtaaatgca

SEQ ID NO: 196938 - DNA, 75 bp, Artificial Sequence
  Synthetic
aatagtagcagtccatgtagccagtgggtttatagaagcagaggtaataccccaagaaacaggaagacaaacagc

SEQ ID NO: 196939 - DNA, 75 bp, Artificial Sequence
  Synthetic
tctcttcctgttaaagctggcaagcagatggcccattacacacttgcacacagacaatggtgccaactttacttc

SEQ ID NO: 196940 - DNA, 75 bp, Artificial Sequence
  Synthetic
acaagatgtaaagatggtggcttggtgggtaggaatagaacaaacctttggagtaccctacaacccacaaagtca

SEQ ID NO: 196941 - DNA, 75 bp, Artificial Sequence
  Synthetic
gagactagttaacatgataaccacagaacaagaaatacaattcttccaagcaaaaaatttaaaatttcaaaattt

SEQ ID NO: 196942 - DNA, 75 bp, Artificial Sequence
  Synthetic
caaaaaatttaaaatttcaaaatttccaggtctattacagagaaggcagagatcaactctggaagggacctggtg

SEQ ID NO: 196943 - DNA, 75 bp, Artificial Sequence
  Synthetic
ccaggtctattacagagaaggcagagatcaactctggaagggacctggtgaactattgtggaagggggaaggagc

SEQ ID NO: 196944 - DNA, 75 bp, Artificial Sequence
  Synthetic
agtcatcataaaggtagggacagagatcaaagtaatacccagaagaaaagcaaagatcataaggcactatggagg

SEQ ID NO: 196945 - DNA, 75 bp, Artificial Sequence
  Synthetic
caaagatcataaggcactatggagggggaaaagaattggattgtagtaccgacgtggaagataccaggcaggcta

SEQ ID NO: 196946 - DNA, 75 bp, Artificial Sequence
  Synthetic
gacgtggaagataccaggcaggctagagaaatggcacagtctagtcaagtatctgaagcatagaacaggagaatt

SEQ ID NO: 196947 - DNA, 75 bp, Artificial Sequence
  Synthetic
gcaacaggtctcttatgtcccccaccacaaggtgggatgggcctggtggacttgcagtagagtaatattccccct

SEQ ID NO: 196948 - DNA, 75 bp, Artificial Sequence
  Synthetic
cacaaggtgggatgggcctggtggacttgcagtagagtaatattccccctaaaaggaggagcatgcctagaggtc

SEQ ID NO: 196949 - DNA, 75 bp, Artificial Sequence
  Synthetic
gacttatttctcttgctttacagccaatgaagtaaggagagccatcaggggagaaaagatattgtcctactgcaa

SEQ ID NO: 196950 - DNA, 75 bp, Artificial Sequence
  Synthetic
aatgaagtaaggagagccatcaggggagaaaagatattgtcctactgcaactacccatcagctcacgaggggcag

SEQ ID NO: 196951 - DNA, 75 bp, Artificial Sequence
  Synthetic
taagagttgtacaagaaggaaaaaatggatcccagggagagagtgccaccaggaaacagcgacgaagagacagta

SEQ ID NO: 196952 - DNA, 75 bp, Artificial Sequence
  Synthetic
ggagaggcattcgcatggctagaaagaacaatagtagaactcaacagggaagcagtcaaccatttgccccgagaa

SEQ ID NO: 196953 - DNA, 75 bp, Artificial Sequence
  Synthetic
cttattttccaggtctggcaaaggtcttgggcatattggcgtgatgatcagggcatgtcaattagctacaccaag

SEQ ID NO: 196954 - DNA, 75 bp, Artificial Sequence
  Synthetic
tataggtacttgcttctgatacaaaaagcaatgtttgtacattttgcaaagggctgtacatgcctgcggggaggc

SEQ ID NO: 196955 - DNA, 75 bp, Artificial Sequence
  Synthetic
cagagactcctccagagaatgaggacccacagagagagccatgggaagagtgggtagaggacgtcctggaggaaa

SEQ ID NO: 196956 - DNA, 75 bp, Artificial Sequence
  Synthetic
cccacagagagagccatgggaagagtgggtagaggacgtcctggaggaaataaagcaagaagccttaagacattt

SEQ ID NO: 196957 - DNA, 75 bp, Artificial Sequence
  Synthetic
tgggtagaggacgtcctggaggaaataaagcaagaagccttaagacattttgatccccgcttgctaactgcgctt

SEQ ID NO: 196958 - DNA, 75 bp, Artificial Sequence
  Synthetic
ggtaactttatttacagtaggcatggagatacccttgcaggggcaggagaactcattaagattctccagcgagcg

SEQ ID NO: 196959 - DNA, 75 bp, Artificial Sequence
  Synthetic
ctcttcctccacttcagaggcggttgtcaacactcaaggattggacaaccagggggaggaaatcctctctcagct

SEQ ID NO: 196960 - DNA, 75 bp, Artificial Sequence
  Synthetic
agggggaggaaatcctctctcagctacaccgccctctgagggcatgcaataatacgtgctattgtaagaaatgtt

SEQ ID NO: 196961 - DNA, 75 bp, Artificial Sequence
  Synthetic
gctaccattgccagctttgttttcttaaaaagggccttgggatatgttatgaccgctcgagaaaaagatcttcaa

SEQ ID NO: 196962 - DNA, 75 bp, Artificial Sequence
  Synthetic
taaaaagggccttgggatatgttatgaccgctcgagaaaaagatcttcaaaaaggaataagactgctacatcttc

SEQ ID NO: 196963 - DNA, 75 bp, Artificial Sequence
  Synthetic
tgcatcagacaagtgagtaagatgtgtggtaagaatctactatttgttgccagcttgctagctagtgcttactta

SEQ ID NO: 196964 - DNA, 75 bp, Artificial Sequence
  Synthetic
atatattgcaccaaatatgtgactgttttctatggcgtgcccgtgtggagaaatgcatccattcccctcttttgt

SEQ ID NO: 196965 - DNA, 75 bp, Artificial Sequence
  Synthetic
agtagaagatgtctggagtctatttgagacatcaataaaaccatgcgtcaaactaacacctctatgtgtagcaat

SEQ ID NO: 196966 - DNA, 75 bp, Artificial Sequence
  Synthetic
gagacatcaataaaaccatgcgtcaaactaacacctctatgtgtagcaatgagttgtaacagcaccaccgccacc

SEQ ID NO: 196967 - DNA, 75 bp, Artificial Sequence
  Synthetic
actacaccaccaagcaccactaacaacacaaccacaacagagcccacaacaggagggccagagataaatgaaact

SEQ ID NO: 196968 - DNA, 75 bp, Artificial Sequence
  Synthetic
tttccatgcatgcgcacagacaactgcacaggattgggagaggaagagatggtcgattgtcagttcaacatgaca

SEQ ID NO: 196969 - DNA, 75 bp, Artificial Sequence
  Synthetic
ggattagagagagataagacaaaacaatatagtgaaacatggtactcaaaagatgtagtttgtgagtcaaataac

SEQ ID NO: 196970 - DNA, 75 bp, Artificial Sequence
  Synthetic
agatgtagtttgtgagtcaaataacgccagtgatgggagagacagatgctacatgaatcattgcaacacatcagt

SEQ ID NO: 196971 - DNA, 75 bp, Artificial Sequence
  Synthetic
gctaagatgtaatgacaccaactattcaggctttatgcccaactgtagtaaggtagtagtgtcctcttgcacaag

SEQ ID NO: 196972 - DNA, 75 bp, Artificial Sequence
  Synthetic
aggtagtagtgtcctcttgcacaagaatgatggaaacacagacctctacatggtttggcttcaatggtacaaggg

SEQ ID NO: 196973 - DNA, 75 bp, Artificial Sequence
  Synthetic
aatgatggaaacacagacctctacatggtttggcttcaatggtacaagggcagaaaataggacatatatgtattg

SEQ ID NO: 196974 - DNA, 75 bp, Artificial Sequence
  Synthetic
cagaaaataggacatatatgtattggcatagtaaagataataggactattataagcttgaataagtattataatt

SEQ ID NO: 196975 - DNA, 75 bp, Artificial Sequence
  Synthetic
ataagcttgaataagtattataatttaacaatacattgtaagaggccaggaaacaagacagttgtaccaataaca

SEQ ID NO: 196976 - DNA, 75 bp, Artificial Sequence
  Synthetic
aaacaagacagttgtaccaataacactcatgtcagggttagtgttccattcccagcctatcaataaaagacctag

SEQ ID NO: 196977 - DNA, 75 bp, Artificial Sequence
  Synthetic
gcaagcatggtgctggttcaaaggcgagtggagggaagccatgcaggaggtgaaacaaacccttataaaacatcc

SEQ ID NO: 196978 - DNA, 75 bp, Artificial Sequence
  Synthetic
tgaaacaaacccttataaaacatcccaggtataaaggaaccaatgacacaaggaatattacctttacaaaaccag

SEQ ID NO: 196979 - DNA, 75 bp, Artificial Sequence
  Synthetic
atacatgtggactaactgcagaggagaatttctctactgcaacatgacttggttcctcaattgggtagaaaacag

SEQ ID NO: 196980 - DNA, 75 bp, Artificial Sequence
  Synthetic
ggttcctcaattgggtagaaaacagaacgggtcagacacagcacaattatgcgccgtgccatataaaacaaataa

SEQ ID NO: 196981 - DNA, 75 bp, Artificial Sequence
  Synthetic
ttaatacctggcacaaggtaggaaaaaatgtgtatttgcctcctagggaaggacaattgacctgcaactcaacag

SEQ ID NO: 196982 - DNA, 75 bp, Artificial Sequence
  Synthetic
ggacaattgacctgcaactcaacagtgaccagcttgattgctaacattgacgtagacgtaggtaataaccggaca

SEQ ID NO: 196983 - DNA, 75 bp, Artificial Sequence
  Synthetic
agattataaattaatagaagtgacaccaattggtttcgcacctacatcagaaaaaagatactcctctactccggg

SEQ ID NO: 196984 - DNA, 75 bp, Artificial Sequence
  Synthetic
gagacataaaagaggtgtattcgtgctagggttcttgggttttctcacgacagcaggagctgcaatgggcgcggc

SEQ ID NO: 196985 - DNA, 75 bp, Artificial Sequence
  Synthetic
cagcaggagctgcaatgggcgcggcgtccttgacgctgtcggctcagtctcggactttactggccgggatagtgc

SEQ ID NO: 196986 - DNA, 75 bp, Artificial Sequence
  Synthetic
ttaggcaagtctgccacactactgtaccatgggtaaatgacagcttgacacctgattgggacaacatgacgtggc

SEQ ID NO: 196987 - DNA, 75 bp, Artificial Sequence
  Synthetic
tcaaatatattcagtatggagtttatatagtagtaggaatagtagctctcagagtaataatatatgtagtacaaa

SEQ ID NO: 196988 - DNA, 75 bp, Artificial Sequence
  Synthetic
tatagtagtaggaatagtagctctcagagtaataatatatgtagtacaaatgataggtagacttagaagaggcta

SEQ ID NO: 196989 - DNA, 75 bp, Artificial Sequence
  Synthetic
aacgacgggggctacagatcttggccctggcagatcgaatacatccacttcctaattcgccagctgaggaacctc

SEQ ID NO: 196990 - DNA, 75 bp, Artificial Sequence
  Synthetic
ttgatttggctatacgacggctgcagaaccttactgttgaagaccttccaaaccctccaaccagctctccaacca

SEQ ID NO: 196991 - DNA, 75 bp, Artificial Sequence
  Synthetic
ctcaggctcctgtttgcgtacctccaatatgggatcggctggttccaagaagcagtccaagcagcagcgggggct

SEQ ID NO: 196992 - DNA, 75 bp, Artificial Sequence
  Synthetic
acgggagagactcttgcgagcacagggaggaccttatgggaggctctcaggaggacggcgaggggaatcatcgca

SEQ ID NO: 196993 - DNA, 75 bp, Artificial Sequence
  Synthetic
gtccccagaagaatcagacaggggcttgaactcgccctcctgtgagggacaaaccgccccaggagcagaaggggg

SEQ ID NO: 196994 - DNA, 75 bp, Artificial Sequence
  Synthetic
agggcaacaagacatagaggaagatgatgaggacaatgaagtaggggtatatgtcaggccccaggtgccattgag

SEQ ID NO: 196995 - DNA, 75 bp, Artificial Sequence
  Synthetic
cccaggtgccattgagaccaatgacatacaaattggcaatagacatgtctcattttataaaagaaaaggggggac

SEQ ID NO: 196996 - DNA, 75 bp, Artificial Sequence
  Synthetic
aggaatcaaccacgacggagagctcctgtaaaggcgcaggcgggtaccaagcagcgtgaggagcgagaggataag

SEQ ID NO: 196997 - DNA, 75 bp, Artificial Sequence
  Synthetic
aggaatcaaccacgacggagtgctcctgtaaaggcgcaggcgggtaccaagcagcgtgaggagcgagaggataag

SEQ ID NO: 196998 - DNA, 75 bp, Artificial Sequence
  Synthetic
aggaatcaaccacgacggagcgctcctgtaaaggcgcaggcgggtaccaagcagcgtgaggagcgagaggataag

SEQ ID NO: 196999 - DNA, 75 bp, Artificial Sequence
  Synthetic
aggaatcaaccacgacggagggctcctgtaaaggcgcaggcgggtaccaagcagcgtgaggagcgagaggataag

SEQ ID NO: 197000 - DNA, 75 bp, Artificial Sequence
  Synthetic
aggcctctgggagtaaggtaagtactccaaaaattttgaattgtctactctagaggagagtaggacataagtggg

SEQ ID NO: 197001 - DNA, 75 bp, Artificial Sequence
  Synthetic
gtcagggaagaaaacagatgaattagaaaaagttaggttacggcccggcgcaaggaaaaggtacatgttgaaaca

SEQ ID NO: 197002 - DNA, 75 bp, Artificial Sequence
  Synthetic
tgtaatatgggcagcaaatgaattagacagatttggattagcagaaagcctgttggaaacaaaagaaggatgtca

SEQ ID NO: 197003 - DNA, 75 bp, Artificial Sequence
  Synthetic
tgttggaaacaaaagaaggatgtcagaaaattcttacggccttagctccattaatgccaacagggtcagaaaatg

SEQ ID NO: 197004 - DNA, 75 bp, Artificial Sequence
  Synthetic
ttaatgccaacagggtcagaaaatgtaaaaagcctttttaatactgtctgcgtcatttggtgcttgcacgcagaa

SEQ ID NO: 197005 - DNA, 75 bp, Artificial Sequence
  Synthetic
ggtccactgccagcgggacaactcagagaccccagaggatcagatatagcgggaaccaccagcacagtagaggaa

SEQ ID NO: 197006 - DNA, 75 bp, Artificial Sequence
  Synthetic
atcctactaatatactagatgtaaaacaagggccaaaagaaccctttcaaagctatgtagatagattctacaaaa

SEQ ID NO: 197007 - DNA, 75 bp, Artificial Sequence
  Synthetic
acaagggccaaaagaaccctttcaaagctatgtagatagattctacaaaagcctacgggcagaacagacagacca

SEQ ID NO: 197008 - DNA, 75 bp, Artificial Sequence
  Synthetic
tttggggccacaccccaccctagaggaaatgctgacggcctgccaagggataggaggcccagggcagaaagcgag

SEQ ID NO: 197009 - DNA, 75 bp, Artificial Sequence
  Synthetic
actaatggctgaggctctaaaagaagccttaacgcctgcacccataccattcgctgctgctcaacagaaggcagg

SEQ ID NO: 197010 - DNA, 75 bp, Artificial Sequence
  Synthetic
cagacagacaggcgggttttttagggtttggaccctggggaaagaagcctcgcaacttccccgcggcccaagtgc

SEQ ID NO: 197011 - DNA, 75 bp, Artificial Sequence
  Synthetic
ctcaggaggtggtgccatctgcgcccccgatggaaacagcagagagcaagatatatcagagagtgacaccatctg

SEQ ID NO: 197012 - DNA, 75 bp, Artificial Sequence
  Synthetic
actcaatagtagcagggatagaattaggatgcaattacaccccaaaaatagtaggagggataggaggattcataa

SEQ ID NO: 197013 - DNA, 75 bp, Artificial Sequence
  Synthetic
aggatgcaattacaccccaaaaatagtaggagggataggaggattcataaatactaaagaatacaaagacataga

SEQ ID NO: 197014 - DNA, 75 bp, Artificial Sequence
  Synthetic
aatagaagtggtaggaaaaagggtaaaagcaactataatgacaggagacaccccaataaatatttttggcagaaa

SEQ ID NO: 197015 - DNA, 75 bp, Artificial Sequence
  Synthetic
ctaaatttcccaatggcaaaattagagccagtgaaggtccagttaaagcctggaaaggatggaccaaaaatcaga

SEQ ID NO: 197016 - DNA, 75 bp, Artificial Sequence
  Synthetic
caatggccactatctaaggagaagatactggcccttagagagatctgtgaaaaaatggaaaaggaggggcagcta

SEQ ID NO: 197017 - DNA, 75 bp, Artificial Sequence
  Synthetic
atgctaatagacttcagagaattaaataaggtaacccaagattttacagaagtccaactaggtattccccaccca

SEQ ID NO: 197018 - DNA, 75 bp, Artificial Sequence
  Synthetic
ataaggtaacccaagattttacagaagtccaactaggtattccccacccagcagggttggcagaaagaaggagaa

SEQ ID NO: 197019 - DNA, 75 bp, Artificial Sequence
  Synthetic
ctacttcagtgtcccactagatccagacttcagacaatatacagcattcactttaccatcaataaataatgcaga

SEQ ID NO: 197020 - DNA, 75 bp, Artificial Sequence
  Synthetic
gtcctaccacagggatggaagggatccccagcaatctttcaatacaccatgaggaaggtactagaccccttcaga

SEQ ID NO: 197021 - DNA, 75 bp, Artificial Sequence
  Synthetic
tttggggacaaataccaatgttccatttgccagtagaaagagagacatgggaccaatggtggacagattactggc

SEQ ID NO: 197022 - DNA, 75 bp, Artificial Sequence
  Synthetic
tttgccagtagaaagagagacatgggaccaatggtggacagattactggcaagtaacttggatcccagaatggga

SEQ ID NO: 197023 - DNA, 75 bp, Artificial Sequence
  Synthetic
gaccaatggtggacagattactggcaagtaacttggatcccagaatgggactttgtctcaaccccaccattggta

SEQ ID NO: 197024 - DNA, 75 bp, Artificial Sequence
  Synthetic
agactagcctacaacctggtcaaggaccccctagaaaaggtagaaaccttctacacagatgggtcctgcaacaga

SEQ ID NO: 197025 - DNA, 75 bp, Artificial Sequence
  Synthetic
aaccaacaagcagaacttgaagcatttgcactggcactacaggattcaggaccacaagtcaatatcatagtagat

SEQ ID NO: 197026 - DNA, 75 bp, Artificial Sequence
  Synthetic
atcaatagtaaacaggataattgaagaaatgatcaaaaaagaagcagtatatgtgggatgggtgccagcccacaa

SEQ ID NO: 197027 - DNA, 75 bp, Artificial Sequence
  Synthetic
aagtatcatggcaatgtaaaagagctagttcataaatttggacttccacacctagtggcaaaacaaatagtaaac

SEQ ID NO: 197028 - DNA, 75 bp, Artificial Sequence
  Synthetic
gagaagctgttcatggacaggtaaatgcagaactagggacatggcaaatggactgtacacatttagaaggaaaaa

SEQ ID NO: 197029 - DNA, 75 bp, Artificial Sequence
  Synthetic
gactgtacacatttagaaggaaaaatcataatagtagcagtccatgtagccagtgggtttatagaagcagaagta

SEQ ID NO: 197030 - DNA, 75 bp, Artificial Sequence
  Synthetic
tcataatagtagcagtccatgtagccagtgggtttatagaagcagaagtaataccccaagaaacaggaagacaaa

SEQ ID NO: 197031 - DNA, 75 bp, Artificial Sequence
  Synthetic
ataccccaagaaacaggaagacaaacagccctcttcctgttgaagctagcaagcagatggcctatcacacacctg

SEQ ID NO: 197032 - DNA, 75 bp, Artificial Sequence
  Synthetic
ctggtgggtaggaatagaacaatcctttggagtaccctacaatccacagagtcagggagtggtagaagcaatgaa

SEQ ID NO: 197033 - DNA, 75 bp, Artificial Sequence
  Synthetic
tgccgacgtggaggataccaggcaggctagagagatggcacagtctggtcaagtacctgaagtataaaacaggag

SEQ ID NO: 197034 - DNA, 75 bp, Artificial Sequence
  Synthetic
ggtccaaggatattggaatctgaccccagaaaggggattcttgagttcctatgctgtaagattaacatggtatga

SEQ ID NO: 197035 - DNA, 75 bp, Artificial Sequence
  Synthetic
agagaacttttacacagatgtaacacctgatgtggcagaccaactattgcatgggacttatttctcttgctttac

SEQ ID NO: 197036 - DNA, 75 bp, Artificial Sequence
  Synthetic
gcaactacccatcagcccacgaaaggcaggtaccaagtttacagtttctagccttaagagtagtacaagaaagaa

SEQ ID NO: 197037 - DNA, 75 bp, Artificial Sequence
  Synthetic
gaaagaacaataacagagctcaacagggaagcagtcaaccatttaccccgggaactcattttccaggtctggcag

SEQ ID NO: 197038 - DNA, 75 bp, Artificial Sequence
  Synthetic
aggtcttgggcatattggcgtgaggaacagggcatgtcaagtagctacaccaagtataggtacttacttctgatg

SEQ ID NO: 197039 - DNA, 75 bp, Artificial Sequence
  Synthetic
gggccatgggccagggggatggagacaaggacctcctcctcctcctcccccaggcctagcctaatggcagaagca

SEQ ID NO: 197040 - DNA, 75 bp, Artificial Sequence
  Synthetic
attttgatccccgcttgctaactgcgcttggtaactttatctacagtaggcatggagacacccttgcaggagcag

SEQ ID NO: 197041 - DNA, 75 bp, Artificial Sequence
  Synthetic
catggagacacccttgcaggagcaggggaactcatcaaaattctccaaagagcactcttcctccacttcagaggc

SEQ ID NO: 197042 - DNA, 75 bp, Artificial Sequence
  Synthetic
atgtgtggtaagaatttactctttattgccagcttgttaactagtgtttccttaatatatagtgccaaaaaatat

SEQ ID NO: 197043 - DNA, 75 bp, Artificial Sequence
  Synthetic
cttttgtgcaactcaaaacagagatacttggggaaccgtacagtgcttgccagataatgatgattatcaagaaat

SEQ ID NO: 197044 - DNA, 75 bp, Artificial Sequence
  Synthetic
tagcaatgaactgtaccaacacaacaaagtccaacaccaatggcaacgtaaacataacaggaaccacactgataa

SEQ ID NO: 197045 - DNA, 75 bp, Artificial Sequence
  Synthetic
atgaaacttctccatgcatacgaaatgacagctgcacaggattgggagaggaagggatagtccagtgtcagttcg

SEQ ID NO: 197046 - DNA, 75 bp, Artificial Sequence
  Synthetic
acatgacaggattagagagagataagaaaaaacgatataatgaaacatggtactcaaaagatgtagtttgtgaga

SEQ ID NO: 197047 - DNA, 75 bp, Artificial Sequence
  Synthetic
gaaaaaacgatataatgaaacatggtactcaaaagatgtagtttgtgagaccaataatgggacaaataggacaga

SEQ ID NO: 197048 - DNA, 75 bp, Artificial Sequence
  Synthetic
acaagcactattgggatgctataaggtttagatactgtgcaccaccgggctttgctttgctaagatgtaatgaca

SEQ ID NO: 197049 - DNA, 75 bp, Artificial Sequence
  Synthetic
aggccaggaaacaagacagttttaccaataacactctcttcaggaagaaggttccactcccagccaatcatcaat

SEQ ID NO: 197050 - DNA, 75 bp, Artificial Sequence
  Synthetic
acaaaacctaggcaagcatggtgccggttcagaggcaggtggagggaagccatgcaggaggtgaaacagaccatt

SEQ ID NO: 197051 - DNA, 75 bp, Artificial Sequence
  Synthetic
atagaacatcccaggtatacaggaaccaaaaacataagtaaaattaactttacaagaccaggagaaggctcagac

SEQ ID NO: 197052 - DNA, 75 bp, Artificial Sequence
  Synthetic
gtagaaaacagaaatcaggcacagctcaattatgcaccgtgccatatcagtcaaataattaatacctggcacaag

SEQ ID NO: 197053 - DNA, 75 bp, Artificial Sequence
  Synthetic
tcaattatgcaccgtgccatatcagtcaaataattaatacctggcacaaggtagggatgaatgtatatttgcctc

SEQ ID NO: 197054 - DNA, 75 bp, Artificial Sequence
  Synthetic
ctcaacagtgaccagcataattgctaacattgattggaaagatgatacgaaccaagcaaacattaccttcagtgc

SEQ ID NO: 197055 - DNA, 75 bp, Artificial Sequence
  Synthetic
caaaaattaaatagctgggatgtttttagcaactggtttgatttgacctcctggatcaaatatattcagtatgga

SEQ ID NO: 197056 - DNA, 75 bp, Artificial Sequence
  Synthetic
gccaacgaagaaacagaagaaggaggtggaagcgacgagggctacagatcttggccttggcagatcgaatacatc

SEQ ID NO: 197057 - DNA, 75 bp, Artificial Sequence
  Synthetic
acctcttgatttggctatacgaaggctgcagaaccttactatcgaagaccttccaaaccctccaaccagctctcc

SEQ ID NO: 197058 - DNA, 75 bp, Artificial Sequence
  Synthetic
gggctgcgggagagactcttgcgagcgccagcaggaccatatgggaggctctcagaagaacggcgaggggaatca

SEQ ID NO: 197059 - DNA, 75 bp, Artificial Sequence
  Synthetic
cgccagcaggaccatatgggaggctctcagaagaacggcgaggggaatcatcgcgatccccagaaggatcagaca

SEQ ID NO: 197060 - DNA, 75 bp, Artificial Sequence
  Synthetic
aggacttgaactcgccctcctgtgagggacaaaacaccccaggggcagaagggggagggcaacaagacatagaag

SEQ ID NO: 197061 - DNA, 75 bp, Artificial Sequence
  Synthetic
ccaataagccactgagatcaatgacatacaaattggcaatagacatgtctcattttataaaagaaaaggggggac

SEQ ID NO: 197062 - DNA, 75 bp, Artificial Sequence
  Synthetic
aggaatcaaccacgacggagtgctcctataacagcgcgggccggtaccaggcagcgtgaggagcgagaggagaag

SEQ ID NO: 197063 - DNA, 75 bp, Artificial Sequence
  Synthetic
gcagcgtgaggagcgagaggagaagaggcctctgggagtaaggtaagtactccaaattttgaactgtctactcta

SEQ ID NO: 197064 - DNA, 75 bp, Artificial Sequence
  Synthetic
aggcctctgggagtaaggtaagtactccaaattttgaactgtctactctagaggagagtaggacataagtgggag

SEQ ID NO: 197065 - DNA, 75 bp, Artificial Sequence
  Synthetic
gaaagtgaaagataccgaggaagcaaaaaagttagcacagagccatctagcggcagccactgaaaaaacaccaac

SEQ ID NO: 197066 - DNA, 75 bp, Artificial Sequence
  Synthetic
accaactgcagataaaccagcagcgacatctagtggcggaaattacccagtgcaacaagtagctggcaattatgt

SEQ ID NO: 197067 - DNA, 75 bp, Artificial Sequence
  Synthetic
agagaaataatcaatgaagaggcggcagactgggaccagcaacacccgataccaggtccactgccagcaggacaa

SEQ ID NO: 197068 - DNA, 75 bp, Artificial Sequence
  Synthetic
cttagagaccccagaggatcagatatagcgggaaccaccagcacagtagaggaacaaatacagtggatgtacagg

SEQ ID NO: 197069 - DNA, 75 bp, Artificial Sequence
  Synthetic
ggtcaaaattccgtcccagtggggaacatttatagaagatggattcaattaggattgcagaaatgtgtcaggatg

SEQ ID NO: 197070 - DNA, 75 bp, Artificial Sequence
  Synthetic
tacaatcctactaatatactagatgtaaaacaagggccaaaagaacccttccaaagctatgtagatagattctac

SEQ ID NO: 197071 - DNA, 75 bp, Artificial Sequence
  Synthetic
tctgcgccccctgcagatccagcagtggagatgctaaaaaactacatgcaactggggaggcagcagagagagaag

SEQ ID NO: 197072 - DNA, 75 bp, Artificial Sequence
  Synthetic
tggagatgctaaaaaactacatgcaactggggaggcagcagagagagaagcaagggagaccctacaaggaggtga

SEQ ID NO: 197073 - DNA, 75 bp, Artificial Sequence
  Synthetic
aagcacatatcgagggtcagccagtagaggtactactagacacaggggctgacgactcaatagtggcaggaatag

SEQ ID NO: 197074 - DNA, 75 bp, Artificial Sequence
  Synthetic
agcctggaaaagatggaccaaaaatcagacagtggcctttatctaaagaaaagatattggcccttagagagatct

SEQ ID NO: 197075 - DNA, 75 bp, Artificial Sequence
  Synthetic
gtgaaaaaatggaaaaggaggggcaactggaagaagcacctcccactaatccatacaacacacccacctttgcta

SEQ ID NO: 197076 - DNA, 75 bp, Artificial Sequence
  Synthetic
actggaagaagcacctcccactaatccatacaacacacccacctttgctataagaaaaaaggacaaaaataaatg

SEQ ID NO: 197077 - DNA, 75 bp, Artificial Sequence
  Synthetic
agaatatcagtactagatgtaggagatgcctacttcagtgtcccactagacccagacttcagacaatatacagca

SEQ ID NO: 197078 - DNA, 75 bp, Artificial Sequence
  Synthetic
accagaaagggaggtttggacagtaaatgacattcagaaactagtgggggtactaaactgggcagctcaactttt

SEQ ID NO: 197079 - DNA, 75 bp, Artificial Sequence
  Synthetic
tactaaactgggcagctcaacttttccctggaatcaaaacaaagcacatctgcaaactaatcagaggaaagatga

SEQ ID NO: 197080 - DNA, 75 bp, Artificial Sequence
  Synthetic
catacaaaattcatcagggggataaagtcctaaaggtaggaaaatatgcaaaggtcaaaaatacccacaccaatg

SEQ ID NO: 197081 - DNA, 75 bp, Artificial Sequence
  Synthetic
gggtatgtcacggacaggggaagagacaaagttaaaccattagagcagacaacaaaccaacaagcagaacttgag

SEQ ID NO: 197082 - DNA, 75 bp, Artificial Sequence
  Synthetic
attaggcaggttctatttctagaaaagatagaaccagcacaagaagaacatgaaaaatatcatggcaatgtaaaa

SEQ ID NO: 197083 - DNA, 75 bp, Artificial Sequence
  Synthetic
tagagatccaaggatattggaatctgaccccagaagagggattcttgagctcctatgctgtaagattaacatggt

SEQ ID NO: 197084 - DNA, 75 bp, Artificial Sequence
  Synthetic
tctagccttaagagttgtacaagaaggaaagaatggatccaagggagagagtgccaccaggaaacagcgacgaag

SEQ ID NO: 197085 - DNA, 75 bp, Artificial Sequence
  Synthetic
gtgccaccaggaaacagcgacgaagagacaataggagaggcattcgcttggctagaaagaacaataacagagctc

SEQ ID NO: 197086 - DNA, 75 bp, Artificial Sequence
  Synthetic
atcttcaaaaagggctaagactgctacatcttctgcatcagacaagtgagtaagatgtggggtaagaatttacta

SEQ ID NO: 197087 - DNA, 75 bp, Artificial Sequence
  Synthetic
acatcttctgcatcagacaagtgagtaagatgtggggtaagaatttactattcattgccagcttactagctagcg

SEQ ID NO: 197088 - DNA, 75 bp, Artificial Sequence
  Synthetic
tttcgatgcatggaataatacagtgacagaacaagcagtagaggatgtctggaatctatttgagacatcaataaa

SEQ ID NO: 197089 - DNA, 75 bp, Artificial Sequence
  Synthetic
tcgctagcaacacaaacacatcagcctctcccccaacctctccaaccacagaagggctgataaatgaaacttctc

SEQ ID NO: 197090 - DNA, 75 bp, Artificial Sequence
  Synthetic
cagtgtcagtttgacatgacaggattacagagagataagaaaaaacgatataatgagacatggtattcaaaagat

SEQ ID NO: 197091 - DNA, 75 bp, Artificial Sequence
  Synthetic
tacagagagataagaaaaaacgatataatgagacatggtattcaaaagatgtagtttgtgagaccaataataaga

SEQ ID NO: 197092 - DNA, 75 bp, Artificial Sequence
  Synthetic
taatgagacatggtattcaaaagatgtagtttgtgagaccaataataagacaaataataagacaaatgagacaaa

SEQ ID NO: 197093 - DNA, 75 bp, Artificial Sequence
  Synthetic
cagatgctacatgaaccattgcaacacatcagtcatcacagagtcatgcgacaagcactattgggatgctatgag

SEQ ID NO: 197094 - DNA, 75 bp, Artificial Sequence
  Synthetic
tttgctttgctaagatgtaatgacaccagctattcaggcttcatgcccaactgtagcaaagtagtagtatcctct

SEQ ID NO: 197095 - DNA, 75 bp, Artificial Sequence
  Synthetic
tacaagggcagaaaacaggacatatatgtactggcatggtagagataataggactatcataagcttaaatagtta

SEQ ID NO: 197096 - DNA, 75 bp, Artificial Sequence
  Synthetic
caataacactcatgtcagggttagtgttccactcccagccaatcaataacaggcctagacaagcatggtgctggt

SEQ ID NO: 197097 - DNA, 75 bp, Artificial Sequence
  Synthetic
gcaggaggtgaagcaaacccttataaaacatcccaggtataacggaaacaaaaacataagtaaaattaactttac

SEQ ID NO: 197098 - DNA, 75 bp, Artificial Sequence
  Synthetic
aaaaccaggaactggctcagacccagaagtggcatacatgtggactaactgcagaggagaattcctctactgcaa

SEQ ID NO: 197099 - DNA, 75 bp, Artificial Sequence
  Synthetic
gcagaggagaattcctctactgcaacatgacttggttcctcaattgggtagaaaacagaacgggtcagcagcaca

SEQ ID NO: 197100 - DNA, 75 bp, Artificial Sequence
  Synthetic
attatgcaccgtgccatataaagcaaataattaatacctggcacaaggtagggaaaaatgtatatttgcctccta

SEQ ID NO: 197101 - DNA, 75 bp, Artificial Sequence
  Synthetic
gggaaaaatgtatatttgcctcctagggaaggagagttgacctgcaactcaacagtgaccagcataattgctaac

SEQ ID NO: 197102 - DNA, 75 bp, Artificial Sequence
  Synthetic
aacagtgaccagcataattgctaacattgattggctggatacaaaccaaacaaacattaccttcagtgcagaggt

SEQ ID NO: 197103 - DNA, 75 bp, Artificial Sequence
  Synthetic
cgcaactaaattcatggggatgcgcgtttagacaagtctgccacactactgtaccatggggaaatgacagtttga

SEQ ID NO: 197104 - DNA, 75 bp, Artificial Sequence
  Synthetic
cacctaaatgggacaacatgacgtggcaacaatgggaaacacaaatccgctacctagaggcaaatatcagtgaaa

SEQ ID NO: 197105 - DNA, 75 bp, Artificial Sequence
  Synthetic
tataggcctgttttctcttccccccccggttatctccaacagatccatatccacgagcaccggggacagccaacc

SEQ ID NO: 197106 - DNA, 75 bp, Artificial Sequence
  Synthetic
ttcctaattcgccagctgaggaacctcttgatttggctatacgaaggctgcagaaccttgctatcgaagaccttc

SEQ ID NO: 197107 - DNA, 75 bp, Artificial Sequence
  Synthetic
gaggagagtaggacataagtgggagatgggcgcgagaggctccgtcttgtcagggaagaagacagatgaattaga

SEQ ID NO: 197108 - DNA, 75 bp, Artificial Sequence
  Synthetic
gaggtgagtaggacataagtgggagatgggcgcgagaggctccgtcttgtcagggaagaagacagatgaattaga

SEQ ID NO: 197109 - DNA, 75 bp, Artificial Sequence
  Synthetic
gaggcgagtaggacataagtgggagatgggcgcgagaggctccgtcttgtcagggaagaagacagatgaattaga

SEQ ID NO: 197110 - DNA, 75 bp, Artificial Sequence
  Synthetic
gaggggagtaggacataagtgggagatgggcgcgagaggctccgtcttgtcagggaagaagacagatgaattaga

SEQ ID NO: 197111 - DNA, 75 bp, Artificial Sequence
  Synthetic
aggatttcaggcactatcagagggatgtaccccttatgatatcaatcaaatgctaaattgtgtgggagaacacca

SEQ ID NO: 197112 - DNA, 75 bp, Artificial Sequence
  Synthetic
aggatttcaggcactatcagagggatgtaccccttatgatatcaatcatatgctaaattgtgtgggagaacacca

SEQ ID NO: 197113 - DNA, 75 bp, Artificial Sequence
  Synthetic
aggatttcaggcactatcagagggatgtaccccttatgatatcaatcacatgctaaattgtgtgggagaacacca

SEQ ID NO: 197114 - DNA, 75 bp, Artificial Sequence
  Synthetic
aggatttcaggcactatcagagggatgtaccccttatgatatcaatcagatgctaaattgtgtgggagaacacca

SEQ ID NO: 197115 - DNA, 75 bp, Artificial Sequence
  Synthetic
aggatttcaggcactatctgagggatgtaccccttatgatatcaatcaaatgctaaattgtgtgggagaacacca

SEQ ID NO: 197116 - DNA, 75 bp, Artificial Sequence
  Synthetic
aggatttcaggcactatctgagggatgtaccccttatgatatcaatcatatgctaaattgtgtgggagaacacca

SEQ ID NO: 197117 - DNA, 75 bp, Artificial Sequence
  Synthetic
aggatttcaggcactatctgagggatgtaccccttatgatatcaatcacatgctaaattgtgtgggagaacacca

SEQ ID NO: 197118 - DNA, 75 bp, Artificial Sequence
  Synthetic
aggatttcaggcactatctgagggatgtaccccttatgatatcaatcagatgctaaattgtgtgggagaacacca

SEQ ID NO: 197119 - DNA, 75 bp, Artificial Sequence
  Synthetic
aggatttcaggcactatccgagggatgtaccccttatgatatcaatcaaatgctaaattgtgtgggagaacacca

SEQ ID NO: 197120 - DNA, 75 bp, Artificial Sequence
  Synthetic
aggatttcaggcactatccgagggatgtaccccttatgatatcaatcatatgctaaattgtgtgggagaacacca

SEQ ID NO: 197121 - DNA, 75 bp, Artificial Sequence
  Synthetic
aggatttcaggcactatccgagggatgtaccccttatgatatcaatcacatgctaaattgtgtgggagaacacca

SEQ ID NO: 197122 - DNA, 75 bp, Artificial Sequence
  Synthetic
aggatttcaggcactatccgagggatgtaccccttatgatatcaatcagatgctaaattgtgtgggagaacacca

SEQ ID NO: 197123 - DNA, 75 bp, Artificial Sequence
  Synthetic
aggatttcaggcactatcggagggatgtaccccttatgatatcaatcaaatgctaaattgtgtgggagaacacca

SEQ ID NO: 197124 - DNA, 75 bp, Artificial Sequence
  Synthetic
aggatttcaggcactatcggagggatgtaccccttatgatatcaatcatatgctaaattgtgtgggagaacacca

SEQ ID NO: 197125 - DNA, 75 bp, Artificial Sequence
  Synthetic
aggatttcaggcactatcggagggatgtaccccttatgatatcaatcacatgctaaattgtgtgggagaacacca

SEQ ID NO: 197126 - DNA, 75 bp, Artificial Sequence
  Synthetic
aggatttcaggcactatcggagggatgtaccccttatgatatcaatcagatgctaaattgtgtgggagaacacca

SEQ ID NO: 197127 - DNA, 75 bp, Artificial Sequence
  Synthetic
aagggccaaaagaacccttccaaagctatgtagatagattctacaaaagcttacgggcagaacaagcagacacgg

SEQ ID NO: 197128 - DNA, 75 bp, Artificial Sequence
  Synthetic
caacttccccgcggcccaagtgcctcaggaggtggtgccatctgcacccccgatggacacagcagagagcaagac

SEQ ID NO: 197129 - DNA, 75 bp, Artificial Sequence
  Synthetic
caggaggtggtgccatctgcacccccgatggacacagcagagagcaagacatatcagagggcgataccatctgcg

SEQ ID NO: 197130 - DNA, 75 bp, Artificial Sequence
  Synthetic
aaaaggacaaaaataaatggagaatgctaatagacttcagggaattaaataaggtaacccaagactttacagaag

SEQ ID NO: 197131 - DNA, 75 bp, Artificial Sequence
  Synthetic
aaaaggacaaaaataaatggagaatgctaatagacttcagggaattaaataaggtaacccaagactttacagatg

SEQ ID NO: 197132 - DNA, 75 bp, Artificial Sequence
  Synthetic
aaaaggacaaaaataaatggagaatgctaatagacttcagggaattaaataaggtaacccaagactttacagacg

SEQ ID NO: 197133 - DNA, 75 bp, Artificial Sequence
  Synthetic
aaaaggacaaaaataaatggagaatgctaatagacttcagggaattaaataaggtaacccaagactttacagagg

SEQ ID NO: 197134 - DNA, 75 bp, Artificial Sequence
  Synthetic
ctgatcaggggaaagatgaccctgacagaagaggtacagtggacagaactagcagaggcagaaatgcaggaaaaa

SEQ ID NO: 197135 - DNA, 75 bp, Artificial Sequence
  Synthetic
ctgatcaggggaaagatgaccctgacagaagaggtacagtggacagaactagcagaggcagaaatgcaggaaaat

SEQ ID NO: 197136 - DNA, 75 bp, Artificial Sequence
  Synthetic
ctgatcaggggaaagatgaccctgacagaagaggtacagtggacagaactagcagaggcagaaatgcaggaaaac

SEQ ID NO: 197137 - DNA, 75 bp, Artificial Sequence
  Synthetic
ctgatcaggggaaagatgaccctgacagaagaggtacagtggacagaactagcagaggcagaaatgcaggaaaag

SEQ ID NO: 197138 - DNA, 75 bp, Artificial Sequence
  Synthetic
ctgatcaggggaaagatgaccctgacagaagaggtacagtggacagaactagcagaggcagatatgcaggaaaaa

SEQ ID NO: 197139 - DNA, 75 bp, Artificial Sequence
  Synthetic
ctgatcaggggaaagatgaccctgacagaagaggtacagtggacagaactagcagaggcagatatgcaggaaaat

SEQ ID NO: 197140 - DNA, 75 bp, Artificial Sequence
  Synthetic
ctgatcaggggaaagatgaccctgacagaagaggtacagtggacagaactagcagaggcagatatgcaggaaaac

SEQ ID NO: 197141 - DNA, 75 bp, Artificial Sequence
  Synthetic
ctgatcaggggaaagatgaccctgacagaagaggtacagtggacagaactagcagaggcagatatgcaggaaaag

SEQ ID NO: 197142 - DNA, 75 bp, Artificial Sequence
  Synthetic
ctgatcaggggaaagatgaccctgacagaagaggtacagtggacagaactagcagaggcagacatgcaggaaaaa

SEQ ID NO: 197143 - DNA, 75 bp, Artificial Sequence
  Synthetic
ctgatcaggggaaagatgaccctgacagaagaggtacagtggacagaactagcagaggcagacatgcaggaaaat

SEQ ID NO: 197144 - DNA, 75 bp, Artificial Sequence
  Synthetic
ctgatcaggggaaagatgaccctgacagaagaggtacagtggacagaactagcagaggcagacatgcaggaaaac

SEQ ID NO: 197145 - DNA, 75 bp, Artificial Sequence
  Synthetic
ctgatcaggggaaagatgaccctgacagaagaggtacagtggacagaactagcagaggcagacatgcaggaaaag

SEQ ID NO: 197146 - DNA, 75 bp, Artificial Sequence
  Synthetic
ctgatcaggggaaagatgaccctgacagaagaggtacagtggacagaactagcagaggcagagatgcaggaaaaa

SEQ ID NO: 197147 - DNA, 75 bp, Artificial Sequence
  Synthetic
ctgatcaggggaaagatgaccctgacagaagaggtacagtggacagaactagcagaggcagagatgcaggaaaat

SEQ ID NO: 197148 - DNA, 75 bp, Artificial Sequence
  Synthetic
ctgatcaggggaaagatgaccctgacagaagaggtacagtggacagaactagcagaggcagagatgcaggaaaac

SEQ ID NO: 197149 - DNA, 75 bp, Artificial Sequence
  Synthetic
ctgatcaggggaaagatgaccctgacagaagaggtacagtggacagaactagcagaggcagagatgcaggaaaag

SEQ ID NO: 197150 - DNA, 75 bp, Artificial Sequence
  Synthetic
aaaaacatcctggaacaggaacaggaaggatcctactacaaagaaggagtacctctagaagcaacagtgcagaaa

SEQ ID NO: 197151 - DNA, 75 bp, Artificial Sequence
  Synthetic
aaaaacatcctggaacaggaacaggaaggatcctactacaaagaaggtgtacctctagaagcaacagtgcagaaa

SEQ ID NO: 197152 - DNA, 75 bp, Artificial Sequence
  Synthetic
aaaaacatcctggaacaggaacaggaaggatcctactacaaagaaggcgtacctctagaagcaacagtgcagaaa

SEQ ID NO: 197153 - DNA, 75 bp, Artificial Sequence
  Synthetic
aaaaacatcctggaacaggaacaggaaggatcctactacaaagaaggggtacctctagaagcaacagtgcagaaa

SEQ ID NO: 197154 - DNA, 75 bp, Artificial Sequence
  Synthetic
aaaaacatcctggaacaggaacaggatggatcctactacaaagaaggagtacctctagaagcaacagtgcagaaa

SEQ ID NO: 197155 - DNA, 75 bp, Artificial Sequence
  Synthetic
aaaaacatcctggaacaggaacaggatggatcctactacaaagaaggtgtacctctagaagcaacagtgcagaaa

SEQ ID NO: 197156 - DNA, 75 bp, Artificial Sequence
  Synthetic
aaaaacatcctggaacaggaacaggatggatcctactacaaagaaggcgtacctctagaagcaacagtgcagaaa

SEQ ID NO: 197157 - DNA, 75 bp, Artificial Sequence
  Synthetic
aaaaacatcctggaacaggaacaggatggatcctactacaaagaaggggtacctctagaagcaacagtgcagaaa

SEQ ID NO: 197158 - DNA, 75 bp, Artificial Sequence
  Synthetic
aaaaacatcctggaacaggaacaggacggatcctactacaaagaaggagtacctctagaagcaacagtgcagaaa

SEQ ID NO: 197159 - DNA, 75 bp, Artificial Sequence
  Synthetic
aaaaacatcctggaacaggaacaggacggatcctactacaaagaaggtgtacctctagaagcaacagtgcagaaa

SEQ ID NO: 197160 - DNA, 75 bp, Artificial Sequence
  Synthetic
aaaaacatcctggaacaggaacaggacggatcctactacaaagaaggcgtacctctagaagcaacagtgcagaaa

SEQ ID NO: 197161 - DNA, 75 bp, Artificial Sequence
  Synthetic
aaaaacatcctggaacaggaacaggacggatcctactacaaagaaggggtacctctagaagcaacagtgcagaaa

SEQ ID NO: 197162 - DNA, 75 bp, Artificial Sequence
  Synthetic
aaaaacatcctggaacaggaacaggagggatcctactacaaagaaggagtacctctagaagcaacagtgcagaaa

SEQ ID NO: 197163 - DNA, 75 bp, Artificial Sequence
  Synthetic
aaaaacatcctggaacaggaacaggagggatcctactacaaagaaggtgtacctctagaagcaacagtgcagaaa

SEQ ID NO: 197164 - DNA, 75 bp, Artificial Sequence
  Synthetic
aaaaacatcctggaacaggaacaggagggatcctactacaaagaaggcgtacctctagaagcaacagtgcagaaa

SEQ ID NO: 197165 - DNA, 75 bp, Artificial Sequence
  Synthetic
aaaaacatcctggaacaggaacaggagggatcctactacaaagaaggggtacctctagaagcaacagtgcagaaa

SEQ ID NO: 197166 - DNA, 75 bp, Artificial Sequence
  Synthetic
aaaatcatcctggaacaggaacaggaaggatcctactacaaagaaggagtacctctagaagcaacagtgcagaaa

SEQ ID NO: 197167 - DNA, 75 bp, Artificial Sequence
  Synthetic
aaaatcatcctggaacaggaacaggaaggatcctactacaaagaaggtgtacctctagaagcaacagtgcagaaa

SEQ ID NO: 197168 - DNA, 75 bp, Artificial Sequence
  Synthetic
aaaatcatcctggaacaggaacaggaaggatcctactacaaagaaggcgtacctctagaagcaacagtgcagaaa

SEQ ID NO: 197169 - DNA, 75 bp, Artificial Sequence
  Synthetic
aaaatcatcctggaacaggaacaggaaggatcctactacaaagaaggggtacctctagaagcaacagtgcagaaa

SEQ ID NO: 197170 - DNA, 75 bp, Artificial Sequence
  Synthetic
aaaatcatcctggaacaggaacaggatggatcctactacaaagaaggagtacctctagaagcaacagtgcagaaa

SEQ ID NO: 197171 - DNA, 75 bp, Artificial Sequence
  Synthetic
aaaatcatcctggaacaggaacaggatggatcctactacaaagaaggtgtacctctagaagcaacagtgcagaaa

SEQ ID NO: 197172 - DNA, 75 bp, Artificial Sequence
  Synthetic
aaaatcatcctggaacaggaacaggatggatcctactacaaagaaggcgtacctctagaagcaacagtgcagaaa

SEQ ID NO: 197173 - DNA, 75 bp, Artificial Sequence
  Synthetic
aaaatcatcctggaacaggaacaggatggatcctactacaaagaaggggtacctctagaagcaacagtgcagaaa

SEQ ID NO: 197174 - DNA, 75 bp, Artificial Sequence
  Synthetic
aaaatcatcctggaacaggaacaggacggatcctactacaaagaaggagtacctctagaagcaacagtgcagaaa

SEQ ID NO: 197175 - DNA, 75 bp, Artificial Sequence
  Synthetic
aaaatcatcctggaacaggaacaggacggatcctactacaaagaaggtgtacctctagaagcaacagtgcagaaa

SEQ ID NO: 197176 - DNA, 75 bp, Artificial Sequence
  Synthetic
aaaatcatcctggaacaggaacaggacggatcctactacaaagaaggcgtacctctagaagcaacagtgcagaaa

SEQ ID NO: 197177 - DNA, 75 bp, Artificial Sequence
  Synthetic
aaaatcatcctggaacaggaacaggacggatcctactacaaagaaggggtacctctagaagcaacagtgcagaaa

SEQ ID NO: 197178 - DNA, 75 bp, Artificial Sequence
  Synthetic
aaaatcatcctggaacaggaacaggagggatcctactacaaagaaggagtacctctagaagcaacagtgcagaaa

SEQ ID NO: 197179 - DNA, 75 bp, Artificial Sequence
  Synthetic
aaaatcatcctggaacaggaacaggagggatcctactacaaagaaggtgtacctctagaagcaacagtgcagaaa

SEQ ID NO: 197180 - DNA, 75 bp, Artificial Sequence
  Synthetic
aaaatcatcctggaacaggaacaggagggatcctactacaaagaaggcgtacctctagaagcaacagtgcagaaa

SEQ ID NO: 197181 - DNA, 75 bp, Artificial Sequence
  Synthetic
aaaatcatcctggaacaggaacaggagggatcctactacaaagaaggggtacctctagaagcaacagtgcagaaa

SEQ ID NO: 197182 - DNA, 75 bp, Artificial Sequence
  Synthetic
aaaaccatcctggaacaggaacaggaaggatcctactacaaagaaggagtacctctagaagcaacagtgcagaaa

SEQ ID NO: 197183 - DNA, 75 bp, Artificial Sequence
  Synthetic
aaaaccatcctggaacaggaacaggaaggatcctactacaaagaaggtgtacctctagaagcaacagtgcagaaa

SEQ ID NO: 197184 - DNA, 75 bp, Artificial Sequence
  Synthetic
aaaaccatcctggaacaggaacaggaaggatcctactacaaagaaggcgtacctctagaagcaacagtgcagaaa

SEQ ID NO: 197185 - DNA, 75 bp, Artificial Sequence
  Synthetic
aaaaccatcctggaacaggaacaggaaggatcctactacaaagaaggggtacctctagaagcaacagtgcagaaa

SEQ ID NO: 197186 - DNA, 75 bp, Artificial Sequence
  Synthetic
aaaaccatcctggaacaggaacaggatggatcctactacaaagaaggagtacctctagaagcaacagtgcagaaa

SEQ ID NO: 197187 - DNA, 75 bp, Artificial Sequence
  Synthetic
aaaaccatcctggaacaggaacaggatggatcctactacaaagaaggtgtacctctagaagcaacagtgcagaaa

SEQ ID NO: 197188 - DNA, 75 bp, Artificial Sequence
  Synthetic
aaaaccatcctggaacaggaacaggatggatcctactacaaagaaggcgtacctctagaagcaacagtgcagaaa

SEQ ID NO: 197189 - DNA, 75 bp, Artificial Sequence
  Synthetic
aaaaccatcctggaacaggaacaggatggatcctactacaaagaaggggtacctctagaagcaacagtgcagaaa

SEQ ID NO: 197190 - DNA, 75 bp, Artificial Sequence
  Synthetic
aaaaccatcctggaacaggaacaggacggatcctactacaaagaaggagtacctctagaagcaacagtgcagaaa

SEQ ID NO: 197191 - DNA, 75 bp, Artificial Sequence
  Synthetic
aaaaccatcctggaacaggaacaggacggatcctactacaaagaaggtgtacctctagaagcaacagtgcagaaa

SEQ ID NO: 197192 - DNA, 75 bp, Artificial Sequence
  Synthetic
aaaaccatcctggaacaggaacaggacggatcctactacaaagaaggcgtacctctagaagcaacagtgcagaaa

SEQ ID NO: 197193 - DNA, 75 bp, Artificial Sequence
  Synthetic
aaaaccatcctggaacaggaacaggacggatcctactacaaagaaggggtacctctagaagcaacagtgcagaaa

SEQ ID NO: 197194 - DNA, 75 bp, Artificial Sequence
  Synthetic
aaaaccatcctggaacaggaacaggagggatcctactacaaagaaggagtacctctagaagcaacagtgcagaaa

SEQ ID NO: 197195 - DNA, 75 bp, Artificial Sequence
  Synthetic
aaaaccatcctggaacaggaacaggagggatcctactacaaagaaggtgtacctctagaagcaacagtgcagaaa

SEQ ID NO: 197196 - DNA, 75 bp, Artificial Sequence
  Synthetic
aaaaccatcctggaacaggaacaggagggatcctactacaaagaaggcgtacctctagaagcaacagtgcagaaa

SEQ ID NO: 197197 - DNA, 75 bp, Artificial Sequence
  Synthetic
aaaaccatcctggaacaggaacaggagggatcctactacaaagaaggggtacctctagaagcaacagtgcagaaa

SEQ ID NO: 197198 - DNA, 75 bp, Artificial Sequence
  Synthetic
aaaagcatcctggaacaggaacaggaaggatcctactacaaagaaggagtacctctagaagcaacagtgcagaaa

SEQ ID NO: 197199 - DNA, 75 bp, Artificial Sequence
  Synthetic
aaaagcatcctggaacaggaacaggaaggatcctactacaaagaaggtgtacctctagaagcaacagtgcagaaa

SEQ ID NO: 197200 - DNA, 75 bp, Artificial Sequence
  Synthetic
aaaagcatcctggaacaggaacaggaaggatcctactacaaagaaggcgtacctctagaagcaacagtgcagaaa

SEQ ID NO: 197201 - DNA, 75 bp, Artificial Sequence
  Synthetic
aaaagcatcctggaacaggaacaggaaggatcctactacaaagaaggggtacctctagaagcaacagtgcagaaa

SEQ ID NO: 197202 - DNA, 75 bp, Artificial Sequence
  Synthetic
aaaagcatcctggaacaggaacaggatggatcctactacaaagaaggagtacctctagaagcaacagtgcagaaa

SEQ ID NO: 197203 - DNA, 75 bp, Artificial Sequence
  Synthetic
aaaagcatcctggaacaggaacaggatggatcctactacaaagaaggtgtacctctagaagcaacagtgcagaaa

SEQ ID NO: 197204 - DNA, 75 bp, Artificial Sequence
  Synthetic
aaaagcatcctggaacaggaacaggatggatcctactacaaagaaggcgtacctctagaagcaacagtgcagaaa

SEQ ID NO: 197205 - DNA, 75 bp, Artificial Sequence
  Synthetic
aaaagcatcctggaacaggaacaggatggatcctactacaaagaaggggtacctctagaagcaacagtgcagaaa

SEQ ID NO: 197206 - DNA, 75 bp, Artificial Sequence
  Synthetic
aaaagcatcctggaacaggaacaggacggatcctactacaaagaaggagtacctctagaagcaacagtgcagaaa

SEQ ID NO: 197207 - DNA, 75 bp, Artificial Sequence
  Synthetic
aaaagcatcctggaacaggaacaggacggatcctactacaaagaaggtgtacctctagaagcaacagtgcagaaa

SEQ ID NO: 197208 - DNA, 75 bp, Artificial Sequence
  Synthetic
aaaagcatcctggaacaggaacaggacggatcctactacaaagaaggcgtacctctagaagcaacagtgcagaaa

SEQ ID NO: 197209 - DNA, 75 bp, Artificial Sequence
  Synthetic
aaaagcatcctggaacaggaacaggacggatcctactacaaagaaggggtacctctagaagcaacagtgcagaaa

SEQ ID NO: 197210 - DNA, 75 bp, Artificial Sequence
  Synthetic
aaaagcatcctggaacaggaacaggagggatcctactacaaagaaggagtacctctagaagcaacagtgcagaaa

SEQ ID NO: 197211 - DNA, 75 bp, Artificial Sequence
  Synthetic
aaaagcatcctggaacaggaacaggagggatcctactacaaagaaggtgtacctctagaagcaacagtgcagaaa

SEQ ID NO: 197212 - DNA, 75 bp, Artificial Sequence
  Synthetic
aaaagcatcctggaacaggaacaggagggatcctactacaaagaaggcgtacctctagaagcaacagtgcagaaa

SEQ ID NO: 197213 - DNA, 75 bp, Artificial Sequence
  Synthetic
aaaagcatcctggaacaggaacaggagggatcctactacaaagaaggggtacctctagaagcaacagtgcagaaa

SEQ ID NO: 197214 - DNA, 75 bp, Artificial Sequence
  Synthetic
gtaacttggatcccagaatgggactttgtctcgaccccaccactggtaagactagcctacaacctggtcaaggaa

SEQ ID NO: 197215 - DNA, 75 bp, Artificial Sequence
  Synthetic
gtaacttggatcccagaatgggactttgtctcgaccccaccactggtaagactagcctacaacctggtcaaggat

SEQ ID NO: 197216 - DNA, 75 bp, Artificial Sequence
  Synthetic
gtaacttggatcccagaatgggactttgtctcgaccccaccactggtaagactagcctacaacctggtcaaggac

SEQ ID NO: 197217 - DNA, 75 bp, Artificial Sequence
  Synthetic
gtaacttggatcccagaatgggactttgtctcgaccccaccactggtaagactagcctacaacctggtcaaggag

SEQ ID NO: 197218 - DNA, 75 bp, Artificial Sequence
  Synthetic
gttacttggatcccagaatgggactttgtctcgaccccaccactggtaagactagcctacaacctggtcaaggaa

SEQ ID NO: 197219 - DNA, 75 bp, Artificial Sequence
  Synthetic
gttacttggatcccagaatgggactttgtctcgaccccaccactggtaagactagcctacaacctggtcaaggat

SEQ ID NO: 197220 - DNA, 75 bp, Artificial Sequence
  Synthetic
gttacttggatcccagaatgggactttgtctcgaccccaccactggtaagactagcctacaacctggtcaaggac

SEQ ID NO: 197221 - DNA, 75 bp, Artificial Sequence
  Synthetic
gttacttggatcccagaatgggactttgtctcgaccccaccactggtaagactagcctacaacctggtcaaggag

SEQ ID NO: 197222 - DNA, 75 bp, Artificial Sequence
  Synthetic
gtcacttggatcccagaatgggactttgtctcgaccccaccactggtaagactagcctacaacctggtcaaggaa

SEQ ID NO: 197223 - DNA, 75 bp, Artificial Sequence
  Synthetic
gtcacttggatcccagaatgggactttgtctcgaccccaccactggtaagactagcctacaacctggtcaaggat

SEQ ID NO: 197224 - DNA, 75 bp, Artificial Sequence
  Synthetic
gtcacttggatcccagaatgggactttgtctcgaccccaccactggtaagactagcctacaacctggtcaaggac

SEQ ID NO: 197225 - DNA, 75 bp, Artificial Sequence
  Synthetic
gtcacttggatcccagaatgggactttgtctcgaccccaccactggtaagactagcctacaacctggtcaaggag

SEQ ID NO: 197226 - DNA, 75 bp, Artificial Sequence
  Synthetic
gtgacttggatcccagaatgggactttgtctcgaccccaccactggtaagactagcctacaacctggtcaaggaa

SEQ ID NO: 197227 - DNA, 75 bp, Artificial Sequence
  Synthetic
gtgacttggatcccagaatgggactttgtctcgaccccaccactggtaagactagcctacaacctggtcaaggat

SEQ ID NO: 197228 - DNA, 75 bp, Artificial Sequence
  Synthetic
gtgacttggatcccagaatgggactttgtctcgaccccaccactggtaagactagcctacaacctggtcaaggac

SEQ ID NO: 197229 - DNA, 75 bp, Artificial Sequence
  Synthetic
gtgacttggatcccagaatgggactttgtctcgaccccaccactggtaagactagcctacaacctggtcaaggag

SEQ ID NO: 197230 - DNA, 75 bp, Artificial Sequence
  Synthetic
ggacagccaacagaaacagagtcatcaatagtaaataagataattgaagaaatgatcaaaaaggaagcagtatat

SEQ ID NO: 197231 - DNA, 75 bp, Artificial Sequence
  Synthetic
accacaaggtgggatgggcctggtggacttgcagtagagtaatattccccctaaaaaaaaaagcatggatagaga

SEQ ID NO: 197232 - DNA, 75 bp, Artificial Sequence
  Synthetic
accacaaggtgggatgggcctggtggacttgcagtagagtaatattccccctaaaataaaaagcatggatagaga

SEQ ID NO: 197233 - DNA, 75 bp, Artificial Sequence
  Synthetic
accacaaggtgggatgggcctggtggacttgcagtagagtaatattccccctaaaacaaaaagcatggatagaga

SEQ ID NO: 197234 - DNA, 75 bp, Artificial Sequence
  Synthetic
accacaaggtgggatgggcctggtggacttgcagtagagtaatattccccctaaaagaaaaagcatggatagaga

SEQ ID NO: 197235 - DNA, 75 bp, Artificial Sequence
  Synthetic
accacaaggtgggatgggcctggtggacttgcagtagagtaatattccccctaataaaaaaagcatggatagaga

SEQ ID NO: 197236 - DNA, 75 bp, Artificial Sequence
  Synthetic
accacaaggtgggatgggcctggtggacttgcagtagagtaatattccccctaatataaaaagcatggatagaga

SEQ ID NO: 197237 - DNA, 75 bp, Artificial Sequence
  Synthetic
accacaaggtgggatgggcctggtggacttgcagtagagtaatattccccctaatacaaaaagcatggatagaga

SEQ ID NO: 197238 - DNA, 75 bp, Artificial Sequence
  Synthetic
accacaaggtgggatgggcctggtggacttgcagtagagtaatattccccctaatagaaaaagcatggatagaga

SEQ ID NO: 197239 - DNA, 75 bp, Artificial Sequence
  Synthetic
accacaaggtgggatgggcctggtggacttgcagtagagtaatattccccctaacaaaaaaagcatggatagaga

SEQ ID NO: 197240 - DNA, 75 bp, Artificial Sequence
  Synthetic
accacaaggtgggatgggcctggtggacttgcagtagagtaatattccccctaacataaaaagcatggatagaga

SEQ ID NO: 197241 - DNA, 75 bp, Artificial Sequence
  Synthetic
accacaaggtgggatgggcctggtggacttgcagtagagtaatattccccctaacacaaaaagcatggatagaga

SEQ ID NO: 197242 - DNA, 75 bp, Artificial Sequence
  Synthetic
accacaaggtgggatgggcctggtggacttgcagtagagtaatattccccctaacagaaaaagcatggatagaga

SEQ ID NO: 197243 - DNA, 75 bp, Artificial Sequence
  Synthetic
accacaaggtgggatgggcctggtggacttgcagtagagtaatattccccctaagaaaaaaagcatggatagaga

SEQ ID NO: 197244 - DNA, 75 bp, Artificial Sequence
  Synthetic
accacaaggtgggatgggcctggtggacttgcagtagagtaatattccccctaagataaaaagcatggatagaga

SEQ ID NO: 197245 - DNA, 75 bp, Artificial Sequence
  Synthetic
accacaaggtgggatgggcctggtggacttgcagtagagtaatattccccctaagacaaaaagcatggatagaga

SEQ ID NO: 197246 - DNA, 75 bp, Artificial Sequence
  Synthetic
accacaaggtgggatgggcctggtggacttgcagtagagtaatattccccctaagagaaaaagcatggatagaga

SEQ ID NO: 197247 - DNA, 75 bp, Artificial Sequence
  Synthetic
ctataccgccccctgggggcatgtaataataagtgctattgtaaggcatgttgctaccattgccagctttgtttt

SEQ ID NO: 197248 - DNA, 75 bp, Artificial Sequence
  Synthetic
gataatgatgattatcaagaaatagccctgaatgtaacagaggctttcgatgcatggaataatacagtaacagaa

SEQ ID NO: 197249 - DNA, 75 bp, Artificial Sequence
  Synthetic
gcaatgaactgtaccaacacaaacacaaacaccacaaacacacccacctcttcaaccggaggagggctgataaat

SEQ ID NO: 197250 - DNA, 75 bp, Artificial Sequence
  Synthetic
aataatgggacaaatgggacaaacagatgctacatgaaccattgcaacacatcagtcatcacagagtcatgcgac

SEQ ID NO: 197251 - DNA, 75 bp, Artificial Sequence
  Synthetic
caagggcagaaaacaggacatatatatactggcatggtagagataataggactgtcataagcttaaatagttatt

SEQ ID NO: 197252 - DNA, 75 bp, Artificial Sequence
  Synthetic
aacattaccttcagtgcagaggtggcagaactgtaccgattagaattgggggattataaattaatagaagtgaca

SEQ ID NO: 197253 - DNA, 75 bp, Artificial Sequence
  Synthetic
ggattataaattaatagaagtgacaccaattggcttcgcacctacagaacaaaaaagatactcctctgatcaaga

SEQ ID NO: 197254 - DNA, 75 bp, Artificial Sequence
  Synthetic
ggattataaattaatagaagtgacaccaattggcttcgcacctacagaacaaaaaagatactcctctgatcaagt

SEQ ID NO: 197255 - DNA, 75 bp, Artificial Sequence
  Synthetic
ggattataaattaatagaagtgacaccaattggcttcgcacctacagaacaaaaaagatactcctctgatcaagc

SEQ ID NO: 197256 - DNA, 75 bp, Artificial Sequence
  Synthetic
ggattataaattaatagaagtgacaccaattggcttcgcacctacagaacaaaaaagatactcctctgatcaagg

SEQ ID NO: 197257 - DNA, 75 bp, Artificial Sequence
  Synthetic
ggattataaattaatagaagtgacaccaattggcttcgcacctacagaacaaaaaagatactcctctgatctaga

SEQ ID NO: 197258 - DNA, 75 bp, Artificial Sequence
  Synthetic
ggattataaattaatagaagtgacaccaattggcttcgcacctacagaacaaaaaagatactcctctgatctagt

SEQ ID NO: 197259 - DNA, 75 bp, Artificial Sequence
  Synthetic
ggattataaattaatagaagtgacaccaattggcttcgcacctacagaacaaaaaagatactcctctgatctagc

SEQ ID NO: 197260 - DNA, 75 bp, Artificial Sequence
  Synthetic
ggattataaattaatagaagtgacaccaattggcttcgcacctacagaacaaaaaagatactcctctgatctagg

SEQ ID NO: 197261 - DNA, 75 bp, Artificial Sequence
  Synthetic
ggattataaattaatagaagtgacaccaattggcttcgcacctacagaacaaaaaagatactcctctgatccaga

SEQ ID NO: 197262 - DNA, 75 bp, Artificial Sequence
  Synthetic
ggattataaattaatagaagtgacaccaattggcttcgcacctacagaacaaaaaagatactcctctgatccagt

SEQ ID NO: 197263 - DNA, 75 bp, Artificial Sequence
  Synthetic
ggattataaattaatagaagtgacaccaattggcttcgcacctacagaacaaaaaagatactcctctgatccagc

SEQ ID NO: 197264 - DNA, 75 bp, Artificial Sequence
  Synthetic
ggattataaattaatagaagtgacaccaattggcttcgcacctacagaacaaaaaagatactcctctgatccagg

SEQ ID NO: 197265 - DNA, 75 bp, Artificial Sequence
  Synthetic
ggattataaattaatagaagtgacaccaattggcttcgcacctacagaacaaaaaagatactcctctgatcgaga

SEQ ID NO: 197266 - DNA, 75 bp, Artificial Sequence
  Synthetic
ggattataaattaatagaagtgacaccaattggcttcgcacctacagaacaaaaaagatactcctctgatcgagt

SEQ ID NO: 197267 - DNA, 75 bp, Artificial Sequence
  Synthetic
ggattataaattaatagaagtgacaccaattggcttcgcacctacagaacaaaaaagatactcctctgatcgagc

SEQ ID NO: 197268 - DNA, 75 bp, Artificial Sequence
  Synthetic
ggattataaattaatagaagtgacaccaattggcttcgcacctacagaacaaaaaagatactcctctgatcgagg

SEQ ID NO: 197269 - DNA, 75 bp, Artificial Sequence
  Synthetic
gagacataagagaggtgtgtttgtactagggttcttaggttttctcacgacagcaggagctacaatgggcgcggc

SEQ ID NO: 197270 - DNA, 75 bp, Artificial Sequence
  Synthetic
gagacataagagaggtgtgtttgtactagggttcttaggttttctcacgacagcaggagcttcaatgggcgcggc

SEQ ID NO: 197271 - DNA, 75 bp, Artificial Sequence
  Synthetic
gagacataagagaggtgtgtttgtactagggttcttaggttttctcacgacagcaggagctccaatgggcgcggc

SEQ ID NO: 197272 - DNA, 75 bp, Artificial Sequence
  Synthetic
gagacataagagaggtgtgtttgtactagggttcttaggttttctcacgacagcaggagctgcaatgggcgcggc

SEQ ID NO: 197273 - DNA, 75 bp, Artificial Sequence
  Synthetic
gagacataagagaggtgtgtttgttctagggttcttaggttttctcacgacagcaggagctacaatgggcgcggc

SEQ ID NO: 197274 - DNA, 75 bp, Artificial Sequence
  Synthetic
gagacataagagaggtgtgtttgttctagggttcttaggttttctcacgacagcaggagcttcaatgggcgcggc

SEQ ID NO: 197275 - DNA, 75 bp, Artificial Sequence
  Synthetic
gagacataagagaggtgtgtttgttctagggttcttaggttttctcacgacagcaggagctccaatgggcgcggc

SEQ ID NO: 197276 - DNA, 75 bp, Artificial Sequence
  Synthetic
gagacataagagaggtgtgtttgttctagggttcttaggttttctcacgacagcaggagctgcaatgggcgcggc

SEQ ID NO: 197277 - DNA, 75 bp, Artificial Sequence
  Synthetic
gagacataagagaggtgtgtttgtcctagggttcttaggttttctcacgacagcaggagctacaatgggcgcggc

SEQ ID NO: 197278 - DNA, 75 bp, Artificial Sequence
  Synthetic
gagacataagagaggtgtgtttgtcctagggttcttaggttttctcacgacagcaggagcttcaatgggcgcggc

SEQ ID NO: 197279 - DNA, 75 bp, Artificial Sequence
  Synthetic
gagacataagagaggtgtgtttgtcctagggttcttaggttttctcacgacagcaggagctccaatgggcgcggc

SEQ ID NO: 197280 - DNA, 75 bp, Artificial Sequence
  Synthetic
gagacataagagaggtgtgtttgtcctagggttcttaggttttctcacgacagcaggagctgcaatgggcgcggc

SEQ ID NO: 197281 - DNA, 75 bp, Artificial Sequence
  Synthetic
gagacataagagaggtgtgtttgtgctagggttcttaggttttctcacgacagcaggagctacaatgggcgcggc

SEQ ID NO: 197282 - DNA, 75 bp, Artificial Sequence
  Synthetic
gagacataagagaggtgtgtttgtgctagggttcttaggttttctcacgacagcaggagcttcaatgggcgcggc

SEQ ID NO: 197283 - DNA, 75 bp, Artificial Sequence
  Synthetic
gagacataagagaggtgtgtttgtgctagggttcttaggttttctcacgacagcaggagctccaatgggcgcggc

SEQ ID NO: 197284 - DNA, 75 bp, Artificial Sequence
  Synthetic
gagacataagagaggtgtgtttgtgctagggttcttaggttttctcacgacagcaggagctgcaatgggcgcggc

SEQ ID NO: 197285 - DNA, 75 bp, Artificial Sequence
  Synthetic
caactaaattcatggggatgcgcgttaagacaagtctgccacactactgtaccatgggaaaataacagattgaca

SEQ ID NO: 197286 - DNA, 75 bp, Artificial Sequence
  Synthetic
caactaaattcatggggatgcgcgttaagacaagtctgccacactactgtaccatgggaaaataacagtttgaca

SEQ ID NO: 197287 - DNA, 75 bp, Artificial Sequence
  Synthetic
caactaaattcatggggatgcgcgttaagacaagtctgccacactactgtaccatgggaaaataacagcttgaca

SEQ ID NO: 197288 - DNA, 75 bp, Artificial Sequence
  Synthetic
caactaaattcatggggatgcgcgttaagacaagtctgccacactactgtaccatgggaaaataacaggttgaca

SEQ ID NO: 197289 - DNA, 75 bp, Artificial Sequence
  Synthetic
caactaaattcatggggatgcgcgttaagacaagtctgccacactactgtaccatgggaaaattacagattgaca

SEQ ID NO: 197290 - DNA, 75 bp, Artificial Sequence
  Synthetic
caactaaattcatggggatgcgcgttaagacaagtctgccacactactgtaccatgggaaaattacagtttgaca

SEQ ID NO: 197291 - DNA, 75 bp, Artificial Sequence
  Synthetic
caactaaattcatggggatgcgcgttaagacaagtctgccacactactgtaccatgggaaaattacagcttgaca

SEQ ID NO: 197292 - DNA, 75 bp, Artificial Sequence
  Synthetic
caactaaattcatggggatgcgcgttaagacaagtctgccacactactgtaccatgggaaaattacaggttgaca

SEQ ID NO: 197293 - DNA, 75 bp, Artificial Sequence
  Synthetic
caactaaattcatggggatgcgcgttaagacaagtctgccacactactgtaccatgggaaaatcacagattgaca

SEQ ID NO: 197294 - DNA, 75 bp, Artificial Sequence
  Synthetic
caactaaattcatggggatgcgcgttaagacaagtctgccacactactgtaccatgggaaaatcacagtttgaca

SEQ ID NO: 197295 - DNA, 75 bp, Artificial Sequence
  Synthetic
caactaaattcatggggatgcgcgttaagacaagtctgccacactactgtaccatgggaaaatcacagcttgaca

SEQ ID NO: 197296 - DNA, 75 bp, Artificial Sequence
  Synthetic
caactaaattcatggggatgcgcgttaagacaagtctgccacactactgtaccatgggaaaatcacaggttgaca

SEQ ID NO: 197297 - DNA, 75 bp, Artificial Sequence
  Synthetic
caactaaattcatggggatgcgcgttaagacaagtctgccacactactgtaccatgggaaaatgacagattgaca

SEQ ID NO: 197298 - DNA, 75 bp, Artificial Sequence
  Synthetic
caactaaattcatggggatgcgcgttaagacaagtctgccacactactgtaccatgggaaaatgacagtttgaca

SEQ ID NO: 197299 - DNA, 75 bp, Artificial Sequence
  Synthetic
caactaaattcatggggatgcgcgttaagacaagtctgccacactactgtaccatgggaaaatgacagcttgaca

SEQ ID NO: 197300 - DNA, 75 bp, Artificial Sequence
  Synthetic
caactaaattcatggggatgcgcgttaagacaagtctgccacactactgtaccatgggaaaatgacaggttgaca

SEQ ID NO: 197301 - DNA, 75 bp, Artificial Sequence
  Synthetic
caactaaattcatggggatgcgcgtttagacaagtctgccacactactgtaccatgggaaaataacagattgaca

SEQ ID NO: 197302 - DNA, 75 bp, Artificial Sequence
  Synthetic
caactaaattcatggggatgcgcgtttagacaagtctgccacactactgtaccatgggaaaataacagtttgaca

SEQ ID NO: 197303 - DNA, 75 bp, Artificial Sequence
  Synthetic
caactaaattcatggggatgcgcgtttagacaagtctgccacactactgtaccatgggaaaataacagcttgaca

SEQ ID NO: 197304 - DNA, 75 bp, Artificial Sequence
  Synthetic
caactaaattcatggggatgcgcgtttagacaagtctgccacactactgtaccatgggaaaataacaggttgaca

SEQ ID NO: 197305 - DNA, 75 bp, Artificial Sequence
  Synthetic
caactaaattcatggggatgcgcgtttagacaagtctgccacactactgtaccatgggaaaattacagattgaca

SEQ ID NO: 197306 - DNA, 75 bp, Artificial Sequence
  Synthetic
caactaaattcatggggatgcgcgtttagacaagtctgccacactactgtaccatgggaaaattacagtttgaca

SEQ ID NO: 197307 - DNA, 75 bp, Artificial Sequence
  Synthetic
caactaaattcatggggatgcgcgtttagacaagtctgccacactactgtaccatgggaaaattacagcttgaca

SEQ ID NO: 197308 - DNA, 75 bp, Artificial Sequence
  Synthetic
caactaaattcatggggatgcgcgtttagacaagtctgccacactactgtaccatgggaaaattacaggttgaca

SEQ ID NO: 197309 - DNA, 75 bp, Artificial Sequence
  Synthetic
caactaaattcatggggatgcgcgtttagacaagtctgccacactactgtaccatgggaaaatcacagattgaca

SEQ ID NO: 197310 - DNA, 75 bp, Artificial Sequence
  Synthetic
caactaaattcatggggatgcgcgtttagacaagtctgccacactactgtaccatgggaaaatcacagtttgaca

SEQ ID NO: 197311 - DNA, 75 bp, Artificial Sequence
  Synthetic
caactaaattcatggggatgcgcgtttagacaagtctgccacactactgtaccatgggaaaatcacagcttgaca

SEQ ID NO: 197312 - DNA, 75 bp, Artificial Sequence
  Synthetic
caactaaattcatggggatgcgcgtttagacaagtctgccacactactgtaccatgggaaaatcacaggttgaca

SEQ ID NO: 197313 - DNA, 75 bp, Artificial Sequence
  Synthetic
caactaaattcatggggatgcgcgtttagacaagtctgccacactactgtaccatgggaaaatgacagattgaca

SEQ ID NO: 197314 - DNA, 75 bp, Artificial Sequence
  Synthetic
caactaaattcatggggatgcgcgtttagacaagtctgccacactactgtaccatgggaaaatgacagtttgaca

SEQ ID NO: 197315 - DNA, 75 bp, Artificial Sequence
  Synthetic
caactaaattcatggggatgcgcgtttagacaagtctgccacactactgtaccatgggaaaatgacagcttgaca

SEQ ID NO: 197316 - DNA, 75 bp, Artificial Sequence
  Synthetic
caactaaattcatggggatgcgcgtttagacaagtctgccacactactgtaccatgggaaaatgacaggttgaca

SEQ ID NO: 197317 - DNA, 75 bp, Artificial Sequence
  Synthetic
caactaaattcatggggatgcgcgttcagacaagtctgccacactactgtaccatgggaaaataacagattgaca

SEQ ID NO: 197318 - DNA, 75 bp, Artificial Sequence
  Synthetic
caactaaattcatggggatgcgcgttcagacaagtctgccacactactgtaccatgggaaaataacagtttgaca

SEQ ID NO: 197319 - DNA, 75 bp, Artificial Sequence
  Synthetic
caactaaattcatggggatgcgcgttcagacaagtctgccacactactgtaccatgggaaaataacagcttgaca

SEQ ID NO: 197320 - DNA, 75 bp, Artificial Sequence
  Synthetic
caactaaattcatggggatgcgcgttcagacaagtctgccacactactgtaccatgggaaaataacaggttgaca

SEQ ID NO: 197321 - DNA, 75 bp, Artificial Sequence
  Synthetic
caactaaattcatggggatgcgcgttcagacaagtctgccacactactgtaccatgggaaaattacagattgaca

SEQ ID NO: 197322 - DNA, 75 bp, Artificial Sequence
  Synthetic
caactaaattcatggggatgcgcgttcagacaagtctgccacactactgtaccatgggaaaattacagtttgaca

SEQ ID NO: 197323 - DNA, 75 bp, Artificial Sequence
  Synthetic
caactaaattcatggggatgcgcgttcagacaagtctgccacactactgtaccatgggaaaattacagcttgaca

SEQ ID NO: 197324 - DNA, 75 bp, Artificial Sequence
  Synthetic
caactaaattcatggggatgcgcgttcagacaagtctgccacactactgtaccatgggaaaattacaggttgaca

SEQ ID NO: 197325 - DNA, 75 bp, Artificial Sequence
  Synthetic
caactaaattcatggggatgcgcgttcagacaagtctgccacactactgtaccatgggaaaatcacagattgaca

SEQ ID NO: 197326 - DNA, 75 bp, Artificial Sequence
  Synthetic
caactaaattcatggggatgcgcgttcagacaagtctgccacactactgtaccatgggaaaatcacagtttgaca

SEQ ID NO: 197327 - DNA, 75 bp, Artificial Sequence
  Synthetic
caactaaattcatggggatgcgcgttcagacaagtctgccacactactgtaccatgggaaaatcacagcttgaca

SEQ ID NO: 197328 - DNA, 75 bp, Artificial Sequence
  Synthetic
caactaaattcatggggatgcgcgttcagacaagtctgccacactactgtaccatgggaaaatcacaggttgaca

SEQ ID NO: 197329 - DNA, 75 bp, Artificial Sequence
  Synthetic
caactaaattcatggggatgcgcgttcagacaagtctgccacactactgtaccatgggaaaatgacagattgaca

SEQ ID NO: 197330 - DNA, 75 bp, Artificial Sequence
  Synthetic
caactaaattcatggggatgcgcgttcagacaagtctgccacactactgtaccatgggaaaatgacagtttgaca

SEQ ID NO: 197331 - DNA, 75 bp, Artificial Sequence
  Synthetic
caactaaattcatggggatgcgcgttcagacaagtctgccacactactgtaccatgggaaaatgacagcttgaca

SEQ ID NO: 197332 - DNA, 75 bp, Artificial Sequence
  Synthetic
caactaaattcatggggatgcgcgttcagacaagtctgccacactactgtaccatgggaaaatgacaggttgaca

SEQ ID NO: 197333 - DNA, 75 bp, Artificial Sequence
  Synthetic
caactaaattcatggggatgcgcgttgagacaagtctgccacactactgtaccatgggaaaataacagattgaca

SEQ ID NO: 197334 - DNA, 75 bp, Artificial Sequence
  Synthetic
caactaaattcatggggatgcgcgttgagacaagtctgccacactactgtaccatgggaaaataacagtttgaca

SEQ ID NO: 197335 - DNA, 75 bp, Artificial Sequence
  Synthetic
caactaaattcatggggatgcgcgttgagacaagtctgccacactactgtaccatgggaaaataacagcttgaca

SEQ ID NO: 197336 - DNA, 75 bp, Artificial Sequence
  Synthetic
caactaaattcatggggatgcgcgttgagacaagtctgccacactactgtaccatgggaaaataacaggttgaca

SEQ ID NO: 197337 - DNA, 75 bp, Artificial Sequence
  Synthetic
caactaaattcatggggatgcgcgttgagacaagtctgccacactactgtaccatgggaaaattacagattgaca

SEQ ID NO: 197338 - DNA, 75 bp, Artificial Sequence
  Synthetic
caactaaattcatggggatgcgcgttgagacaagtctgccacactactgtaccatgggaaaattacagtttgaca

SEQ ID NO: 197339 - DNA, 75 bp, Artificial Sequence
  Synthetic
caactaaattcatggggatgcgcgttgagacaagtctgccacactactgtaccatgggaaaattacagcttgaca

SEQ ID NO: 197340 - DNA, 75 bp, Artificial Sequence
  Synthetic
caactaaattcatggggatgcgcgttgagacaagtctgccacactactgtaccatgggaaaattacaggttgaca

SEQ ID NO: 197341 - DNA, 75 bp, Artificial Sequence
  Synthetic
caactaaattcatggggatgcgcgttgagacaagtctgccacactactgtaccatgggaaaatcacagattgaca

SEQ ID NO: 197342 - DNA, 75 bp, Artificial Sequence
  Synthetic
caactaaattcatggggatgcgcgttgagacaagtctgccacactactgtaccatgggaaaatcacagtttgaca

SEQ ID NO: 197343 - DNA, 75 bp, Artificial Sequence
  Synthetic
caactaaattcatggggatgcgcgttgagacaagtctgccacactactgtaccatgggaaaatcacagcttgaca

SEQ ID NO: 197344 - DNA, 75 bp, Artificial Sequence
  Synthetic
caactaaattcatggggatgcgcgttgagacaagtctgccacactactgtaccatgggaaaatcacaggttgaca

SEQ ID NO: 197345 - DNA, 75 bp, Artificial Sequence
  Synthetic
caactaaattcatggggatgcgcgttgagacaagtctgccacactactgtaccatgggaaaatgacagattgaca

SEQ ID NO: 197346 - DNA, 75 bp, Artificial Sequence
  Synthetic
caactaaattcatggggatgcgcgttgagacaagtctgccacactactgtaccatgggaaaatgacagtttgaca

SEQ ID NO: 197347 - DNA, 75 bp, Artificial Sequence
  Synthetic
caactaaattcatggggatgcgcgttgagacaagtctgccacactactgtaccatgggaaaatgacagcttgaca

SEQ ID NO: 197348 - DNA, 75 bp, Artificial Sequence
  Synthetic
caactaaattcatggggatgcgcgttgagacaagtctgccacactactgtaccatgggaaaatgacaggttgaca

SEQ ID NO: 197349 - DNA, 75 bp, Artificial Sequence
  Synthetic
agggcaacaagacatagaagaagatgatgaagacaatgaagtgggagcatatgtcaggcccaataagccactgag

SEQ ID NO: 197350 - DNA, 75 bp, Artificial Sequence
  Synthetic
ccaataagccactgagagaaatgacatacaaattggcagtagacatgtctcattttataaaagaaaaggggggac

SEQ ID NO: 197351 - DNA, 75 bp, Artificial Sequence
  Synthetic
cagatttggattagcagagagcctgttggaatcaaaagaaggatgtcaaaaaattcttaaggtcttagctccatt

SEQ ID NO: 197352 - DNA, 75 bp, Artificial Sequence
  Synthetic
cagatttggattagcagagagcctgttggaatcaaaagaaggatgtcataaaattcttaaggtcttagctccatt

SEQ ID NO: 197353 - DNA, 75 bp, Artificial Sequence
  Synthetic
cagatttggattagcagagagcctgttggaatcaaaagaaggatgtcacaaaattcttaaggtcttagctccatt

SEQ ID NO: 197354 - DNA, 75 bp, Artificial Sequence
  Synthetic
cagatttggattagcagagagcctgttggaatcaaaagaaggatgtcagaaaattcttaaggtcttagctccatt

SEQ ID NO: 197355 - DNA, 75 bp, Artificial Sequence
  Synthetic
tgcagacaaaccagcagcgacatctagtggcggaaaatacccagtgcaacaagtagctggcaattatgtccacgt

SEQ ID NO: 197356 - DNA, 75 bp, Artificial Sequence
  Synthetic
tgcagacaaaccagcagcgacatctagtggcggaaattacccagtgcaacaagtagctggcaattatgtccacgt

SEQ ID NO: 197357 - DNA, 75 bp, Artificial Sequence
  Synthetic
tgcagacaaaccagcagcgacatctagtggcggaaactacccagtgcaacaagtagctggcaattatgtccacgt

SEQ ID NO: 197358 - DNA, 75 bp, Artificial Sequence
  Synthetic
tgcagacaaaccagcagcgacatctagtggcggaaagtacccagtgcaacaagtagctggcaattatgtccacgt

SEQ ID NO: 197359 - DNA, 75 bp, Artificial Sequence
  Synthetic
gccattaagtccccgaaccctaaatgcctgggtaaaattagtggaggaaaagaagttcggggcagaaatagtacc

SEQ ID NO: 197360 - DNA, 75 bp, Artificial Sequence
  Synthetic
gctgctgctcaacagaaggcaggaaagagagggacattgacatgctggaactgtggcaaagggggacatacagcc

SEQ ID NO: 197361 - DNA, 75 bp, Artificial Sequence
  Synthetic
aggcaatgcagggcccctagaagacaggggtgctggaagtgtggaaaaacaggacacaacatggcaaattgccca

SEQ ID NO: 197362 - DNA, 75 bp, Artificial Sequence
  Synthetic
gaagcaattacaccccaaaaatagtaggagggataggagggttcataaatactaaagaatacaaagacatagaaa

SEQ ID NO: 197363 - DNA, 75 bp, Artificial Sequence
  Synthetic
gaagcaattacaccccaaaaatagtaggagggataggagggttcataaatactaatgaatacaaagacatagaaa

SEQ ID NO: 197364 - DNA, 75 bp, Artificial Sequence
  Synthetic
gaagcaattacaccccaaaaatagtaggagggataggagggttcataaatactaacgaatacaaagacatagaaa

SEQ ID NO: 197365 - DNA, 75 bp, Artificial Sequence
  Synthetic
gaagcaattacaccccaaaaatagtaggagggataggagggttcataaatactaaggaatacaaagacatagaaa

SEQ ID NO: 197366 - DNA, 75 bp, Artificial Sequence
  Synthetic
tagaagtagtaggaaaaagggtaagagcaactataatgacaggagacaccccaataaatatttttggcagaaata

SEQ ID NO: 197367 - DNA, 75 bp, Artificial Sequence
  Synthetic
tccagctaggtattccccacccagcaggattggcagaaagaaggagaatatcagtactagatgtaggagatgcct

SEQ ID NO: 197368 - DNA, 75 bp, Artificial Sequence
  Synthetic
tccagctaggtattccccaccctgcaggattggcagaaagaaggagaatatcagtactagatgtaggagatgcct

SEQ ID NO: 197369 - DNA, 75 bp, Artificial Sequence
  Synthetic
tccagctaggtattccccaccccgcaggattggcagaaagaaggagaatatcagtactagatgtaggagatgcct

SEQ ID NO: 197370 - DNA, 75 bp, Artificial Sequence
  Synthetic
tccagctaggtattccccacccggcaggattggcagaaagaaggagaatatcagtactagatgtaggagatgcct

SEQ ID NO: 197371 - DNA, 75 bp, Artificial Sequence
  Synthetic
cagtacatggatgacatccttgtagcaagcgatagaagtgatttagagcatgatagagtagtatctcaactaaaa

SEQ ID NO: 197372 - DNA, 75 bp, Artificial Sequence
  Synthetic
cagtacatggatgacatccttgttgcaagcgatagaagtgatttagagcatgatagagtagtatctcaactaaaa

SEQ ID NO: 197373 - DNA, 75 bp, Artificial Sequence
  Synthetic
cagtacatggatgacatccttgtcgcaagcgatagaagtgatttagagcatgatagagtagtatctcaactaaaa

SEQ ID NO: 197374 - DNA, 75 bp, Artificial Sequence
  Synthetic
cagtacatggatgacatccttgtggcaagcgatagaagtgatttagagcatgatagagtagtatctcaactaaaa

SEQ ID NO: 197375 - DNA, 75 bp, Artificial Sequence
  Synthetic
gagttactaaatgacatgggattttccaccccagaagaaaagttccaaaaggaccccccattccagtggatgggt

SEQ ID NO: 197376 - DNA, 75 bp, Artificial Sequence
  Synthetic
tatgagctctggccaaaaaagtggaaactgcaaaaaatacaaataccagaaagggaggtttggacagtaaatgac

SEQ ID NO: 197377 - DNA, 75 bp, Artificial Sequence
  Synthetic
actgggcagctcaacttttccccggaatcaaaacaaagcacatatgcagactgatcaggggaaagatgaccctga

SEQ ID NO: 197378 - DNA, 75 bp, Artificial Sequence
  Synthetic
aaattcatcagggagataaagtcctaaaagtaggaaaatatgcaaaggtcaaaaacacccacaccaatggagtaa

SEQ ID NO: 197379 - DNA, 75 bp, Artificial Sequence
  Synthetic
gaatactagcacatgtaatccaaaaaataggaaaagaagcattggttatttggggacaaataccaatgttccatt

SEQ ID NO: 197380 - DNA, 75 bp, Artificial Sequence
  Synthetic
cccctagaaaaggtagaaaccttctacacagatgggtcctgcaacagagtctcaaaagaagggaaggcagggtat

SEQ ID NO: 197381 - DNA, 75 bp, Artificial Sequence
  Synthetic
acacagatgggtcctgcaacagagtctcaaaagaagggaaggcagggtatgtcacagacaggggaagagacaaag

SEQ ID NO: 197382 - DNA, 75 bp, Artificial Sequence
  Synthetic
ctcaaaagaagggaaggcagggtatgtcacagacaggggaagagacaaagttaaaccattagagcagacaacaaa

SEQ ID NO: 197383 - DNA, 75 bp, Artificial Sequence
  Synthetic
gcagatggcctatcacacacctgcacacagacaatggtgccaactttacctcacaagatgtaaagatggtggcct

SEQ ID NO: 197384 - DNA, 75 bp, Artificial Sequence
  Synthetic
ggcaaagatcataaggcattatggaggaggaaaagaattggattgtggtaccgacgtggaggataccaggcaggc

SEQ ID NO: 197385 - DNA, 75 bp, Artificial Sequence
  Synthetic
ggaggaaaagaattggattgtggtaccgacgtggaggataccaggcaggctagagaaatggcacagtctggtcaa

SEQ ID NO: 197386 - DNA, 75 bp, Artificial Sequence
  Synthetic
gtacctgaagcatagaacaagagaactacaacaggtctcttatgttccccaccacaaggtgggatgggcctggtg

SEQ ID NO: 197387 - DNA, 75 bp, Artificial Sequence
  Synthetic
gtacctgaagcatagaacaagagatctacaacaggtctcttatgttccccaccacaaggtgggatgggcctggtg

SEQ ID NO: 197388 - DNA, 75 bp, Artificial Sequence
  Synthetic
gtacctgaagcatagaacaagagacctacaacaggtctcttatgttccccaccacaaggtgggatgggcctggtg

SEQ ID NO: 197389 - DNA, 75 bp, Artificial Sequence
  Synthetic
gtacctgaagcatagaacaagagagctacaacaggtctcttatgttccccaccacaaggtgggatgggcctggtg

SEQ ID NO: 197390 - DNA, 75 bp, Artificial Sequence
  Synthetic
gacttgcagtagagtaatattccccctaaaagaaagagcatggctagagatccaaggatattggaatctgacccc

SEQ ID NO: 197391 - DNA, 75 bp, Artificial Sequence
  Synthetic
gctgtaagattaacatggtatgaagagagcttttacacagatgtaacacctgatgtggcagaccaactattgcat

SEQ ID NO: 197392 - DNA, 75 bp, Artificial Sequence
  Synthetic
agtataggtacttacttctgatgcaaaaagcaatgtttgtacatttttcaaagggctgtacatgccggcgggagg

SEQ ID NO: 197393 - DNA, 75 bp, Artificial Sequence
  Synthetic
ttgctaccattgccagctttgttttcttaacaagggccttgggatatgttatgaacgctcgagaaaaagatcttc

SEQ ID NO: 197394 - DNA, 75 bp, Artificial Sequence
  Synthetic
tatttgagacatcaataaaaccatgtgtcaaactaacacctctatgtgtagcaatgaactgtaccaacgccacta

SEQ ID NO: 197395 - DNA, 75 bp, Artificial Sequence
  Synthetic
gcagcacaaacataacaaggcccaatagcaccattgacaacataaccacaacagagataaatgaaacttcttcat

SEQ ID NO: 197396 - DNA, 75 bp, Artificial Sequence
  Synthetic
gcagcacaaacataacaaggcccaatagcaccattgacaacataaccacaacagagataaatgatacttcttcat

SEQ ID NO: 197397 - DNA, 75 bp, Artificial Sequence
  Synthetic
gcagcacaaacataacaaggcccaatagcaccattgacaacataaccacaacagagataaatgacacttcttcat

SEQ ID NO: 197398 - DNA, 75 bp, Artificial Sequence
  Synthetic
gcagcacaaacataacaaggcccaatagcaccattgacaacataaccacaacagagataaatgagacttcttcat

SEQ ID NO: 197399 - DNA, 75 bp, Artificial Sequence
  Synthetic
gcagcacaaacataacaaggcccattagcaccattgacaacataaccacaacagagataaatgaaacttcttcat

SEQ ID NO: 197400 - DNA, 75 bp, Artificial Sequence
  Synthetic
gcagcacaaacataacaaggcccattagcaccattgacaacataaccacaacagagataaatgatacttcttcat

SEQ ID NO: 197401 - DNA, 75 bp, Artificial Sequence
  Synthetic
gcagcacaaacataacaaggcccattagcaccattgacaacataaccacaacagagataaatgacacttcttcat

SEQ ID NO: 197402 - DNA, 75 bp, Artificial Sequence
  Synthetic
gcagcacaaacataacaaggcccattagcaccattgacaacataaccacaacagagataaatgagacttcttcat

SEQ ID NO: 197403 - DNA, 75 bp, Artificial Sequence
  Synthetic
gcagcacaaacataacaaggcccactagcaccattgacaacataaccacaacagagataaatgaaacttcttcat

SEQ ID NO: 197404 - DNA, 75 bp, Artificial Sequence
  Synthetic
gcagcacaaacataacaaggcccactagcaccattgacaacataaccacaacagagataaatgatacttcttcat

SEQ ID NO: 197405 - DNA, 75 bp, Artificial Sequence
  Synthetic
gcagcacaaacataacaaggcccactagcaccattgacaacataaccacaacagagataaatgacacttcttcat

SEQ ID NO: 197406 - DNA, 75 bp, Artificial Sequence
  Synthetic
gcagcacaaacataacaaggcccactagcaccattgacaacataaccacaacagagataaatgagacttcttcat

SEQ ID NO: 197407 - DNA, 75 bp, Artificial Sequence
  Synthetic
gcagcacaaacataacaaggcccagtagcaccattgacaacataaccacaacagagataaatgaaacttcttcat

SEQ ID NO: 197408 - DNA, 75 bp, Artificial Sequence
  Synthetic
gcagcacaaacataacaaggcccagtagcaccattgacaacataaccacaacagagataaatgatacttcttcat

SEQ ID NO: 197409 - DNA, 75 bp, Artificial Sequence
  Synthetic
gcagcacaaacataacaaggcccagtagcaccattgacaacataaccacaacagagataaatgacacttcttcat

SEQ ID NO: 197410 - DNA, 75 bp, Artificial Sequence
  Synthetic
gcagcacaaacataacaaggcccagtagcaccattgacaacataaccacaacagagataaatgagacttcttcat

SEQ ID NO: 197411 - DNA, 75 bp, Artificial Sequence
  Synthetic
gcatacaaagagacagctgcacagggttgggagaggaagagatggtccagtgtcagtttgacatgataggattag

SEQ ID NO: 197412 - DNA, 75 bp, Artificial Sequence
  Synthetic
gttgggagaggaagagatggtccagtgtcagtttgacatgataggattagagagagataagaaaaaacggtataa

SEQ ID NO: 197413 - DNA, 75 bp, Artificial Sequence
  Synthetic
gtgtgtggagaggccaatggtaacataagcagatgctacatgaatcattgcaacacatcagtcatcacagagtca

SEQ ID NO: 197414 - DNA, 75 bp, Artificial Sequence
  Synthetic
caacacatcagtcatcacagagtcatgtgacaagcactattgggatgctataaggtttagatactgtgcaccacc

SEQ ID NO: 197415 - DNA, 75 bp, Artificial Sequence
  Synthetic
ccaactgtagtaaagtagtagtatcctcttgcacaagaatgatggagacacagacctctacatggtttggcttca

SEQ ID NO: 197416 - DNA, 75 bp, Artificial Sequence
  Synthetic
ctcttgcacaagaatgatggagacacagacctctacatggtttggcttcaatggtacaagggcagaaaacaggac

SEQ ID NO: 197417 - DNA, 75 bp, Artificial Sequence
  Synthetic
atggtacaagggcagaaaacaggacatatatatattggcatggtagagataataggactatcataagcttaaata

SEQ ID NO: 197418 - DNA, 75 bp, Artificial Sequence
  Synthetic
atatatatattggcatggtagagataataggactatcataagcttaaataagtattataatttaacaatgcattg

SEQ ID NO: 197419 - DNA, 75 bp, Artificial Sequence
  Synthetic
taagaggccaggaaacaagacagttgtaccaataacactcatgtcagggttagtgttccactcccagccaatcaa

SEQ ID NO: 197420 - DNA, 75 bp, Artificial Sequence
  Synthetic
gcaactcaacagtaaccagcataattgctaacattgatcacagagaaaatgaaagccgaacaaacattaccttca

SEQ ID NO: 197421 - DNA, 75 bp, Artificial Sequence
  Synthetic
gcaactcaacagtaaccagcataattgctaacattgatctcagagaaaatgaaagccgaacaaacattaccttca

SEQ ID NO: 197422 - DNA, 75 bp, Artificial Sequence
  Synthetic
gcaactcaacagtaaccagcataattgctaacattgatcccagagaaaatgaaagccgaacaaacattaccttca

SEQ ID NO: 197423 - DNA, 75 bp, Artificial Sequence
  Synthetic
gcaactcaacagtaaccagcataattgctaacattgatcgcagagaaaatgaaagccgaacaaacattaccttca

SEQ ID NO: 197424 - DNA, 75 bp, Artificial Sequence
  Synthetic
attagaattgggggattataaattaatagaagtgacaccaattggcttcgcacctacagcagaaaaaagatactc

SEQ ID NO: 197425 - DNA, 75 bp, Artificial Sequence
  Synthetic
atagaagtgacaccaattggcttcgcacctacagcagaaaaaagatactcctctccagggagacataaaagaggt

SEQ ID NO: 197426 - DNA, 75 bp, Artificial Sequence
  Synthetic
gggcgcggcgtccttgacgctgtcggctcagtcccggactttactggctgggatagtgcagcaacagcaacagct

SEQ ID NO: 197427 - DNA, 75 bp, Artificial Sequence
  Synthetic
gaccaggcgcaactaaattcatggggatgcgcgtttagacaagtctgccacactactgtaccatgggtaaatgac

SEQ ID NO: 197428 - DNA, 75 bp, Artificial Sequence
  Synthetic
gaccaggcgcaactaaattcatggggatgcgcgtttagacatgtctgccacactactgtaccatgggtaaatgac

SEQ ID NO: 197429 - DNA, 75 bp, Artificial Sequence
  Synthetic
gaccaggcgcaactaaattcatggggatgcgcgtttagacacgtctgccacactactgtaccatgggtaaatgac

SEQ ID NO: 197430 - DNA, 75 bp, Artificial Sequence
  Synthetic
gaccaggcgcaactaaattcatggggatgcgcgtttagacaggtctgccacactactgtaccatgggtaaatgac

SEQ ID NO: 197431 - DNA, 75 bp, Artificial Sequence
  Synthetic
cactactgtaccatgggtaaatgacagcttgacacctgattgggacaacatgacgtggcaacaatgggaaaaaca

SEQ ID NO: 197432 - DNA, 75 bp, Artificial Sequence
  Synthetic
tggagttttcatagtagtgggaatagtaattcttagaataataatatatgtagtacagctgataagtagacttag

SEQ ID NO: 197433 - DNA, 75 bp, Artificial Sequence
  Synthetic
tggagttttcatagtagtgggaatagtaattcttagaataataatatatgtagtacagctgttaagtagacttag

SEQ ID NO: 197434 - DNA, 75 bp, Artificial Sequence
  Synthetic
tggagttttcatagtagtgggaatagtaattcttagaataataatatatgtagtacagctgctaagtagacttag

SEQ ID NO: 197435 - DNA, 75 bp, Artificial Sequence
  Synthetic
tggagttttcatagtagtgggaatagtaattcttagaataataatatatgtagtacagctggtaagtagacttag

SEQ ID NO: 197436 - DNA, 75 bp, Artificial Sequence
  Synthetic
aaggggctataggcctgttttctcatccccccccggttacttccaacagatccgtatccacaagcaccgggaaca

SEQ ID NO: 197437 - DNA, 75 bp, Artificial Sequence
  Synthetic
aaggggctataggcctgttttctcttccccccccggttacttccaacagatccgtatccacaagcaccgggaaca

SEQ ID NO: 197438 - DNA, 75 bp, Artificial Sequence
  Synthetic
aaggggctataggcctgttttctcctccccccccggttacttccaacagatccgtatccacaagcaccgggaaca

SEQ ID NO: 197439 - DNA, 75 bp, Artificial Sequence
  Synthetic
aaggggctataggcctgttttctcgtccccccccggttacttccaacagatccgtatccacaagcaccgggaaca

SEQ ID NO: 197440 - DNA, 75 bp, Artificial Sequence
  Synthetic
tccccccccggttacttccaacagatccgtatccacaagcaccgggaacagccagccaacgaagaaacagaagaa

SEQ ID NO: 197441 - DNA, 75 bp, Artificial Sequence
  Synthetic
aggaacctcttgatttggctatacggcggctgcagaaccttgctatcgaagaccttccaaatcctccaactagct

SEQ ID NO: 197442 - DNA, 75 bp, Artificial Sequence
  Synthetic
ctccaaccactcaggctcccgcttgcgcacctccaatatgggatcagctggttccaagaagcaatccaagccgca

SEQ ID NO: 197443 - DNA, 75 bp, Artificial Sequence
  Synthetic
cgcacctccaatatgggatcagctggttccaagaagcaatccaagccgcagcgagggctgcgggagagactctta

SEQ ID NO: 197444 - DNA, 75 bp, Artificial Sequence
  Synthetic
atcatcgcaatccccagaagaatcagacaaggacttgaactcaccctcctgtgagggacaaaacgccccaggggc

SEQ ID NO: 197445 - DNA, 75 bp, Artificial Sequence
  Synthetic
aaacaaacccttataaaacatcccaggtataaaggactcaacgaaacaagtaaaattaactttacaaaaccagga

SEQ ID NO: 197446 - DNA, 75 bp, Artificial Sequence
  Synthetic
aagaaagtgaaagataccgaggaagcaaaaaagttagcacagagccatctagcggcagccactgaaaaagcacca

SEQ ID NO: 197447 - DNA, 75 bp, Artificial Sequence
  Synthetic
caggcagccatgcaagtcattagagaaataatcaatgaagaggcggcagactgggaccagcaacacccggtacca

SEQ ID NO: 197448 - DNA, 75 bp, Artificial Sequence
  Synthetic
ggccgtgagagcatggatgacagagacactactgatccagaatgctaacccagattgcaagctagtactcaaggg

SEQ ID NO: 197449 - DNA, 75 bp, Artificial Sequence
  Synthetic
atatatcgagggtcagccagtagaagtgttactagacacaggggctgacgactcaatagtagcagggatagaatt

SEQ ID NO: 197450 - DNA, 75 bp, Artificial Sequence
  Synthetic
agagcaactataatgacaggagacaccccaataaatatttttggcagaaatatcttaagcgccttaggcatgagt

SEQ ID NO: 197451 - DNA, 75 bp, Artificial Sequence
  Synthetic
aaaacttagcaaaccagtggacatacaaaattcatcagggagataaagtcctaaaagtaggaaaatatgcaaagg

SEQ ID NO: 197452 - DNA, 75 bp, Artificial Sequence
  Synthetic
aataatattaaatagtattttagggttaaagtaatactttaaaaggacaagtcacagacatttgatcttagttaa

SEQ ID NO: 197453 - DNA, 75 bp, Artificial Sequence
  Synthetic
ggaggagtgagagcatcaataagtctggcggaggagcaattatacctggtcaaagaagtaccgtttctgtcttca

SEQ ID NO: 197454 - DNA, 75 bp, Artificial Sequence
  Synthetic
tcaaaaagcccagccaaagcagagaggaaaacaacaacacaaaaaaagaaaaagacaagaccacaaacaagaaaa

SEQ ID NO: 197455 - DNA, 75 bp, Artificial Sequence
  Synthetic
ggaaaacaacaacacaaaaaaagaaaaagacaagaccacaaacaagaaaaaggaggaaaaacaaaaacaagaaca

SEQ ID NO: 197456 - DNA, 75 bp, Artificial Sequence
  Synthetic
tactgcttccacattgttgaaatcaaccaaaccagccttaataccttacaacctatgttgttcaagacaagtatc

SEQ ID NO: 197457 - DNA, 75 bp, Artificial Sequence
  Synthetic
cagataaacaacactctcaaagaggaggatttttagtatcactccttgcaatggcttacagtagcccggagttat

SEQ ID NO: 197458 - DNA, 75 bp, Artificial Sequence
  Synthetic
atggcttacagtagcccggagttatatctcactacaaacggtgtcaatgctgatgtcaagtatgtgatatatagt

SEQ ID NO: 197459 - DNA, 75 bp, Artificial Sequence
  Synthetic
acactaaaaccaaaaaaggaagaaagtcagacataaaaactgaggcaagaacaaaaatccaaacaaagacaggat

SEQ ID NO: 197460 - DNA, 75 bp, Artificial Sequence
  Synthetic
agagacaaagatgcaaagttcagagatcctcctcttagtatactcgagcctgctattatcttcatcattatgtca

SEQ ID NO: 197461 - DNA, 75 bp, Artificial Sequence
  Synthetic
ctctgctaatataacagaaattctaagtacaactaaaaaggataaatcagatatatatgacatcatttacactga

SEQ ID NO: 197462 - DNA, 75 bp, Artificial Sequence
  Synthetic
gcaaagagagaatgcggatctagaagcattgcttcagacatatggatatcctgcatgtcttggagctataatagt

SEQ ID NO: 197463 - DNA, 75 bp, Artificial Sequence
  Synthetic
agacattttatatccagaatgtcacttaaactctccgatcgttaaaagcaagattgctcaacttcatgttttgct

SEQ ID NO: 197464 - DNA, 75 bp, Artificial Sequence
  Synthetic
gccataacaagtagtgctggtctaaggaaaggattcttcaatagattagaagcattcagacaggatggaaccgtt

SEQ ID NO: 197465 - DNA, 75 bp, Artificial Sequence
  Synthetic
aaaagtgctctggtcttcacaggagacacagttgaaggcattggtgcagtgatgaggtcacaacaaagcttagta

SEQ ID NO: 197466 - DNA, 75 bp, Artificial Sequence
  Synthetic
ggatcttcaggaatccctgataacaataaccaatgacaccactgtgacaaatgacaatccacaaactagattctt

SEQ ID NO: 197467 - DNA, 75 bp, Artificial Sequence
  Synthetic
ttccagaaatatgcgacaaaataagatccattttttcagtctctgatagattaataagagaactatcatctggat

SEQ ID NO: 197468 - DNA, 75 bp, Artificial Sequence
  Synthetic
attcttgacctataccaattgcggtttaataggtataaatggaatagaactatatgccaataaaaggggacgaga

SEQ ID NO: 197469 - DNA, 75 bp, Artificial Sequence
  Synthetic
atggccgccttgacactatcaaacctgagaccagatctaaacaaactgagaagccttgttgatatctatctatca

SEQ ID NO: 197470 - DNA, 75 bp, Artificial Sequence
  Synthetic
aaagagggatttgactcattaaaagatgtagatattatctcagatataactgataaatataataaaaacacatgg

SEQ ID NO: 197471 - DNA, 75 bp, Artificial Sequence
  Synthetic
gtatactcagagacccagttcatggagactttgccccaggaaactatccagcattgtggagctacgcaatgggtg

SEQ ID NO: 197472 - DNA, 75 bp, Artificial Sequence
  Synthetic
ttgcaggcattatcatctctctactctgctaatataacagaaattctaagtacaattaaaaaagataaatcagat

SEQ ID NO: 197473 - DNA, 75 bp, Artificial Sequence
  Synthetic
caagggcaatcatatcagcagttggaggatggcacaacacagagagtactcagataatcatgataataattgtgt

SEQ ID NO: 197474 - DNA, 75 bp, Artificial Sequence
  Synthetic
gcaacaatatgtaactggaagaacatatttggacatggaaatgtttttacttggacaagctgtagctaaagatgc

SEQ ID NO: 197475 - DNA, 75 bp, Artificial Sequence
  Synthetic
aattatatatagagatttagtgataataataaataaattaaaattaaccggttatgtccttacacctgaattggt

SEQ ID NO: 197476 - DNA, 75 bp, Artificial Sequence
  Synthetic
aggatggcacaacacagagagtactcagataatcatgataataattgtgtgcatacttataataatcatatgtgg

SEQ ID NO: 197477 - DNA, 75 bp, Artificial Sequence
  Synthetic
tatattatactatctatacagggttagaagactattagtaatgattaattcaactcataattcacctgttaatgc

SEQ ID NO: 197478 - DNA, 75 bp, Artificial Sequence
  Synthetic
gaggaagaactaggtgtgacagacacagcaaaagagagactaagacaccatctaacaaacctttcaggaggggat

SEQ ID NO: 197479 - DNA, 75 bp, Artificial Sequence
  Synthetic
agaagactattagtaatgattaattcaactcataattcacctgttaatgcttatactctggagtcaagaatgaga

SEQ ID NO: 197480 - DNA, 75 bp, Artificial Sequence
  Synthetic
aatccctacatgggtaacaactccaattaaaaaatcagatcaagtacattgtagcatacatacaacaatcaaatc

SEQ ID NO: 197481 - DNA, 75 bp, Artificial Sequence
  Synthetic
attaaaaaatcagatcaagtacattgtagcatacatacaacaatcaaatctatccacaacttcaccaatcaggtg

SEQ ID NO: 197482 - DNA, 75 bp, Artificial Sequence
  Synthetic
tacaacaagtaagaaaaacttagggttaaagacaatccagtcaacctataaggcaacagcatccgattatacaaa

SEQ ID NO: 197483 - DNA, 75 bp, Artificial Sequence
  Synthetic
ttaaagacaatccagtcaacctataaggcaacagcatccgattatacaaacgatggctgaaaaagggaaaacaaa

SEQ ID NO: 197484 - DNA, 75 bp, Artificial Sequence
  Synthetic
tagttcatattggtctacaacccgaaatgacaattccacggtaaacacacacattaatacaccagcaggaaggac

SEQ ID NO: 197485 - DNA, 75 bp, Artificial Sequence
  Synthetic
aatgacaattccacggtaaacacacacattaatacaccagcaggaaggacacacatctggctactgattgcaaca

SEQ ID NO: 197486 - DNA, 75 bp, Artificial Sequence
  Synthetic
atagaaaacagaaactaagccaagcaaacaacaaacgagacatcagcagtgatgctgactatgaaaatgatgatg

SEQ ID NO: 197487 - DNA, 75 bp, Artificial Sequence
  Synthetic
acaatgcatacagtattgtccttcattatcatgatcctatgcattgacctaattataaaacaagacacttgtatg

SEQ ID NO: 197488 - DNA, 75 bp, Artificial Sequence
  Synthetic
ttatcatgatcctatgcattgacctaattataaaacaagacacttgtatgaagacaaacatcatgacagtatcct

SEQ ID NO: 197489 - DNA, 75 bp, Artificial Sequence
  Synthetic
gatgctgactatgaaaatgatgatgatgctacagcggctgcagggataggaggaatttaacaggatatttggaca

SEQ ID NO: 197490 - DNA, 75 bp, Artificial Sequence
  Synthetic
ccatgaacgaaagtgccaaaataatcaaagagacaatcacagaattaatcagacaagaagtaatatcaaggacca

SEQ ID NO: 197491 - DNA, 75 bp, Artificial Sequence
  Synthetic
gagctgatcaagacctaatactatatcaattatgttaaaatcagatataatgtataaaaatttaaaaataagaca

SEQ ID NO: 197492 - DNA, 75 bp, Artificial Sequence
  Synthetic
gcatacacgaaaccaaccttcacagtggataccccagcatccaaaactctccttcccgaatggatcaggatgcct

SEQ ID NO: 197493 - DNA, 75 bp, Artificial Sequence
  Synthetic
ccttcccgaatggatcaggatgccttctttcttgagagggatcctgaggccgaaggagaggcactacgaaaacaa

SEQ ID NO: 197494 - DNA, 75 bp, Artificial Sequence
  Synthetic
attggctcagatatgcgaaaacaccattgctattcaccatgcagacggcatatctcctctggacccacacgattt

SEQ ID NO: 197495 - DNA, 75 bp, Artificial Sequence
  Synthetic
gcccaaaagaaaacaagtcatcatgcaaatctgacgataacaataaagacagagcaatctcaacgtcgacccaag

SEQ ID NO: 197496 - DNA, 75 bp, Artificial Sequence
  Synthetic
gatattattaattatgtagaatcaggagaatggttaaatgacgatagcttcaacatatcttacagtctcaaagaa

SEQ ID NO: 197497 - DNA, 75 bp, Artificial Sequence
  Synthetic
aaaacagagacacatgctagaatctttgatcaacaagatatacacagggcctctaggcgaggaactagtccaaac

SEQ ID NO: 197498 - DNA, 75 bp, Artificial Sequence
  Synthetic
aaattcagatatgtatcctgatttaaacccggtaatttctcatacctatgacatcaacgacaacaggaaatcatg

SEQ ID NO: 197499 - DNA, 75 bp, Artificial Sequence
  Synthetic
ctctaggcgaggaactagtccaaaccctctacctgagaatatgggcaatgaaagaaacaccagaatcgacgaaga

SEQ ID NO: 197500 - DNA, 75 bp, Artificial Sequence
  Synthetic
agttattcagtgaaaatgggatggtaaaaggagaaattgacctactaaagagactgactacattatctgtctcag

SEQ ID NO: 197501 - DNA, 75 bp, Artificial Sequence
  Synthetic
gaagtgggataaaaattgaaaatacactcattttcctagggtacggtggcttaacaactccgctccaaggcgaca

SEQ ID NO: 197502 - DNA, 75 bp, Artificial Sequence
  Synthetic
atggaaactagcagcacacatagtacaagaataactgatgtcatcaccaacccaagtccagagcttgaagatgcc

SEQ ID NO: 197503 - DNA, 75 bp, Artificial Sequence
  Synthetic
gataggccaaagattgttgtcgagacaattccaataactcaaaattacttaggtgccgaaggtaggctacttaaa

SEQ ID NO: 197504 - DNA, 75 bp, Artificial Sequence
  Synthetic
aagatcagagagaacacagaactcagaactccacaaatcaacaagtggagacagctccaacctcgaagaccacaa

SEQ ID NO: 197505 - DNA, 75 bp, Artificial Sequence
  Synthetic
gaactccacaaatcaacaagtggagacagctccaacctcgaagaccacaacacaaaaaccagcccaagagttcca

SEQ ID NO: 197506 - DNA, 75 bp, Artificial Sequence
  Synthetic
ctaggtaaaaagatctacatatatactagatcttcaggttggcactccaacctgcaaataggatcattagatatc

SEQ ID NO: 197507 - DNA, 75 bp, Artificial Sequence
  Synthetic
ctagatcttcaggttggcactccaacctgcaaataggatcattagatatcaacaaccccatgaccattaaatggg

SEQ ID NO: 197508 - DNA, 75 bp, Artificial Sequence
  Synthetic
gtacaatttatgtaggggatccttactgtccagtatctgatagaatgcataaagaactccaagaccatgatgata

SEQ ID NO: 197509 - DNA, 75 bp, Artificial Sequence
  Synthetic
cgcctcatgaagtcctgtctcgaccaggaaaccaagactgcaactggtacaacagatgtccgagagaatgcatat

SEQ ID NO: 197510 - DNA, 75 bp, Artificial Sequence
  Synthetic
aggaaaccaagactgcaactggtacaacagatgtccgagagaatgcatatcaggtgtatatactgatgcatatcc

SEQ ID NO: 197511 - DNA, 75 bp, Artificial Sequence
  Synthetic
actatctcctgatgcagtcaatgttgctacaaccacactgtacgcaaacacatcacgtgttaatcccaccataat

SEQ ID NO: 197512 - DNA, 75 bp, Artificial Sequence
  Synthetic
tgttagtaagtcttggtgtaatgaaatcacaacatgaatttgaattatctaggagtgcaagtcatgtatttgcta

SEQ ID NO: 197513 - DNA, 75 bp, Artificial Sequence
  Synthetic
atcacaacatgaatttgaattatctaggagtgcaagtcatgtatttgctaagcgcatgctaaaatctgcaaatta

SEQ ID NO: 197514 - DNA, 75 bp, Artificial Sequence
  Synthetic
gctacaaccacactgtacgcaaacacatcacgtgttaatcccaccataatgtactcaaatacctcagaaattatc

SEQ ID NO: 197515 - DNA, 75 bp, Artificial Sequence
  Synthetic
aacatgctaagactcaagaatgtacaactagaggcagcatacactactacatcatgtatcactcatttcgggaag

SEQ ID NO: 197516 - DNA, 75 bp, Artificial Sequence
  Synthetic
gaggaaatagattcatctagggatcttcataaacggttttcagaataccagaaagaacagaactcactcatgatg

SEQ ID NO: 197517 - DNA, 75 bp, Artificial Sequence
  Synthetic
cttgagcagatcaagacccaacactatatcaattatgtgaaaaccagatatgatgtataaaaatttaaaaacaaa

SEQ ID NO: 197518 - DNA, 75 bp, Artificial Sequence
  Synthetic
cgatcccagtgataccacaagatcaccatcagtcttcacaaaagggaaagataataaggtcaaaaagacaaggtt

SEQ ID NO: 197519 - DNA, 75 bp, Artificial Sequence
  Synthetic
agcacttatagctcaaactagggctaacttaagtttagagaatttgaagttactcactcctgtatcgacttctac

SEQ ID NO: 197520 - DNA, 75 bp, Artificial Sequence
  Synthetic
ataataaggtcaaaaagacaaggtttgatccctctatggaagctctaggaactcaagagttcaagcctgacctga

SEQ ID NO: 197521 - DNA, 75 bp, Artificial Sequence
  Synthetic
ctcagacatcttatatccagaatgtcacttgaactctccgattgtaaaaagcaagattgctcaacttcacgtttt

SEQ ID NO: 197522 - DNA, 75 bp, Artificial Sequence
  Synthetic
taagagaggatgaactaagagatgacatcagaaacccagtactagaagaatacaacaatgaacctcaagcatcca

SEQ ID NO: 197523 - DNA, 75 bp, Artificial Sequence
  Synthetic
catcagaaacccagtactagaagaatacaacaatgaacctcaagcatccaatgcatcacgtctgattccgtccac

SEQ ID NO: 197524 - DNA, 75 bp, Artificial Sequence
  Synthetic
ggtaggagatcctccaaaacatggagtcaggtatcttgatgtgctgctattgggattcttcgaaacacctaagca

SEQ ID NO: 197525 - DNA, 75 bp, Artificial Sequence
  Synthetic
ggtggtcttacatgaacattatagtgtgatcaggattgcataccttgttggagataaggacgtcatcctagtaag

SEQ ID NO: 197526 - DNA, 75 bp, Artificial Sequence
  Synthetic
aggacctctatctggcagcatatctgatctcacagaatcaaccagttattcaatctgtggatccggatccttacc

SEQ ID NO: 197527 - DNA, 75 bp, Artificial Sequence
  Synthetic
ctggacgactcgataaaaggtcatcaaaaataacatgtaagggggaagaattatgggagcttatcgactctttat

SEQ ID NO: 197528 - DNA, 75 bp, Artificial Sequence
  Synthetic
ttcccaatcttggtgaggatgtatataatattatatcactactagaacctttatcacttgctttaatacagttgg

SEQ ID NO: 197529 - DNA, 75 bp, Artificial Sequence
  Synthetic
taatattatatcactactagaacctttatcacttgctttaatacagttggatgaccctgtaactaatttaaaagg

SEQ ID NO: 197530 - DNA, 75 bp, Artificial Sequence
  Synthetic
agctttcatgagacatgttttgactgagctacatacaattttaataaaagataatatatacacagattcagaagc

SEQ ID NO: 197531 - DNA, 75 bp, Artificial Sequence
  Synthetic
aatgacaccactgtgacaaatgacaatccacaaactagattctttggtgctgtcattggtaccatagcactagga

SEQ ID NO: 197532 - DNA, 75 bp, Artificial Sequence
  Synthetic
atccacaaactagattctttggtgctgtcattggtaccatagcactaggagtagccacagctgctcagataactg

SEQ ID NO: 197533 - DNA, 75 bp, Artificial Sequence
  Synthetic
tgtcattggtaccatagcactaggagtagccacagctgctcagataactgcgggaattgcactagccgaagcacg

SEQ ID NO: 197534 - DNA, 75 bp, Artificial Sequence
  Synthetic
acaattctgtagaattcattcaaagaggtataggagaacagataattgcattaaagacattacaagattttgtaa

SEQ ID NO: 197535 - DNA, 75 bp, Artificial Sequence
  Synthetic
ggagaatggttaaatgatgatagcttcaacatatcttacagtctcaaagaaaaagaaattaaacaagagggtcga

SEQ ID NO: 197536 - DNA, 75 bp, Artificial Sequence
  Synthetic
ggaggtgcagatgtcacaaactgtatagaatcaaaattggcatatatatgtcctagagatcctacacaattaata

SEQ ID NO: 197537 - DNA, 75 bp, Artificial Sequence
  Synthetic
ctctttgccaagatgacatacaagatgagagcagttcaggtattagcagaaacattgctagcaaaaggagtaggt

SEQ ID NO: 197538 - DNA, 75 bp, Artificial Sequence
  Synthetic
tcctagagatcctacacaattaatacctgacaaccaacagaagtgtatactcggggatgtatcaaagtgccctgt

SEQ ID NO: 197539 - DNA, 75 bp, Artificial Sequence
  Synthetic
aaagctgcagactcatcaaccgaggggtatgagactctgagctgttttttaaccaccgatttgaaaaaatactgt

SEQ ID NO: 197540 - DNA, 75 bp, Artificial Sequence
  Synthetic
ggtatgagactctgagctgttttttaaccaccgatttgaaaaaatactgtctcaactggagatttgaaagtacag

SEQ ID NO: 197541 - DNA, 75 bp, Artificial Sequence
  Synthetic
ataccagtgaatcaagatcgctcaaaaggagtcacatttttgacctatactaattgtggtttaattggtataaat

SEQ ID NO: 197542 - DNA, 75 bp, Artificial Sequence
  Synthetic
tggttattgatatacccttattttgttccactttcgggggtattctaatcaatcaatttgcatattcactttacg

SEQ ID NO: 197543 - DNA, 75 bp, Artificial Sequence
  Synthetic
aatcaatttgcatattcactttacgggctaaacgtcagagggagggatgaaatatggggatatgtaatacgcata

SEQ ID NO: 197544 - DNA, 75 bp, Artificial Sequence
  Synthetic
cacaaagaactccaagatcatgatgataccggaatctttatccataatccaagagggggaatagagggttattgc

SEQ ID NO: 197545 - DNA, 75 bp, Artificial Sequence
  Synthetic
ataattgtgtgtatacttataataatcatatgtggtatattatattatctatacagggttagaagactattagta

SEQ ID NO: 197546 - DNA, 75 bp, Artificial Sequence
  Synthetic
gtagaaaccagatcaaaagtaagaaaaacttagggtgaatggcaattcacagatcagctcaaccagacatcatca

SEQ ID NO: 197547 - DNA, 75 bp, Artificial Sequence
  Synthetic
agctggctccatagtatcatcgacaacccaaaagaaaacaagtcatcatgcaaatctgacgataacgataaagac

SEQ ID NO: 197548 - DNA, 75 bp, Artificial Sequence
  Synthetic
gattgcaacaacaatgcatgcagcactgtccctcattatcatgatactatgcattgacctaattataaaacaaga

SEQ ID NO: 197549 - DNA, 75 bp, Artificial Sequence
  Synthetic
ccaaaacaatcaaggagacaatcacagaattaatcagacaagaagtgatatcaaggactataaacatacaaagtt

SEQ ID NO: 197550 - DNA, 75 bp, Artificial Sequence
  Synthetic
tattatatcgtgtgatgaatcaagaaccaggagactcaagcttcttagattgggcatcagacccttattcatgca

SEQ ID NO: 197551 - DNA, 75 bp, Artificial Sequence
  Synthetic
cagtacaaagcgggatcccaatattgttaaacaagcaaagcagagatctcacacaattaatagagaagtcatgca

SEQ ID NO: 197552 - DNA, 75 bp, Artificial Sequence
  Synthetic
gttaaacaagcaaagcagagatctcacacaattaatagagaagtcatgcaacaaacaggaattggctcagatatg

SEQ ID NO: 197553 - DNA, 75 bp, Artificial Sequence
  Synthetic
ctcccacattcacaaagtataacaactataatcaaaaatgtaacagctagatcagtattgcaggaatcacctaat

SEQ ID NO: 197554 - DNA, 75 bp, Artificial Sequence
  Synthetic
acaggtgtaagagaagctatagccgggatgcttgatacaacgaaatctctagtaagagctagtgtcaggagagga

SEQ ID NO: 197555 - DNA, 75 bp, Artificial Sequence
  Synthetic
tcattatcaattggtgatgcaatatatgcgtattcatcaaacttaatcactcaaggatgtgcagatatagggaag

SEQ ID NO: 197556 - DNA, 75 bp, Artificial Sequence
  Synthetic
ggaatgatgaatgcgaaacactaatctggaatgaattacagaataattcaatagggtttattcattgtgacatgg

SEQ ID NO: 197557 - DNA, 75 bp, Artificial Sequence
  Synthetic
ggattatcatatagtatcttaagaagacttataaattatgatctattacaatatgagaccttaacaaggacactc

SEQ ID NO: 197558 - DNA, 75 bp, Artificial Sequence
  Synthetic
tcctgatttaaacccggtagtttctcatacctatgacatcaacgacaacaggaaatcatgctctgtaatagctgc

SEQ ID NO: 197559 - DNA, 75 bp, Artificial Sequence
  Synthetic
tccttgcccactgtgaatgagactacagattattcgagtgaaggtatagaagacttagtatttgacatattagat

SEQ ID NO: 197560 - DNA, 75 bp, Artificial Sequence
  Synthetic
caaggcaataccaagtgtgtgataaaaagttgtcccaatgttaatcagagtgtttgcaatgatgctcttaagata

SEQ ID NO: 197561 - DNA, 75 bp, Artificial Sequence
  Synthetic
caggaaaataacaagttaatctatgatcctgatcctctcaaggacatagatctagagttatttagtaaggttagg

SEQ ID NO: 197562 - DNA, 75 bp, Artificial Sequence
  Synthetic
tgtcacgaccaggaaacccagactgcaactggttcaacaaatgtccgagagaatgcatatcaggtgtatacactg

SEQ ID NO: 197563 - DNA, 75 bp, Artificial Sequence
  Synthetic
tagagcaactagtatatgtacagctatgactattgcagacacaatgtctcaattagatagagacaatcttaaaga

SEQ ID NO: 197564 - DNA, 75 bp, Artificial Sequence
  Synthetic
aaaaatcatcaacatgctaagactcaaaaatggacaattagaagcagcatacactactacatcatgtatcactca

SEQ ID NO: 197565 - DNA, 75 bp, Artificial Sequence
  Synthetic
attgttgaaatcaaccaaaccagccttaataccttacaacctatgttgttcaagacaagtatccctaaaatatgt

SEQ ID NO: 197566 - DNA, 75 bp, Artificial Sequence
  Synthetic
gtttctgtcttcacattaggcccgagtgtgacagatgatgcagataaattattaatagcaaccactttcttagcc

SEQ ID NO: 197567 - DNA, 75 bp, Artificial Sequence
  Synthetic
tcaagacaagatactgttagccatttcagtatgtgaatactctgttgacctcttcatgcgtgattggcaagaggg

SEQ ID NO: 197568 - DNA, 75 bp, Artificial Sequence
  Synthetic
ccgactgagacaagggatgatatataatgccaataaagtagctctggcacctcaatgtctcccagtcgacaaaga

SEQ ID NO: 197569 - DNA, 75 bp, Artificial Sequence
  Synthetic
accttatgatttaaaagataacagtataataaatatcaccaaatacaaaatcagaaatggaggtttatcgccccg

SEQ ID NO: 197570 - DNA, 75 bp, Artificial Sequence
  Synthetic
acgactcgaatcattgaaagagtatctagaacttacttttttagacgatcctatattaagatatagtcaattgac

SEQ ID NO: 197571 - DNA, 75 bp, Artificial Sequence
  Synthetic
aagatccttaaacaagaaattaaggatattgatcgttacacttttgaaccttatccggttttctcattagagcta

SEQ ID NO: 197572 - DNA, 75 bp, Artificial Sequence
  Synthetic
gtgacaaaataagatccattttttcagtctctgatagattaataagagaactatcatctggatttcaagaattat

SEQ ID NO: 197573 - DNA, 75 bp, Artificial Sequence
  Synthetic
aatcatattttttaattatatatagagatttagtgataataataaataaattaaaattaaccggttatgtcctta

SEQ ID NO: 197574 - DNA, 75 bp, Artificial Sequence
  Synthetic
atgtcttcagctggacgactcgataagaggtcatcaaaaataacatataagggggaagaattatgggaacttatc

SEQ ID NO: 197575 - DNA, 75 bp, Artificial Sequence
  Synthetic
agaggtcatcaaaaataacatataagggggaagaattatgggaacttatcgactctttatttcccaatcttggtg

SEQ ID NO: 197576 - DNA, 75 bp, Artificial Sequence
  Synthetic
aggatgtgtataatattatatcactgttagagcctttatcacttgctttaatacagttggatgatcctgtaacta

SEQ ID NO: 197577 - DNA, 75 bp, Artificial Sequence
  Synthetic
ttggggataaggacgttatcttagtaagcaaaattgcaccaagattaggtacagactggacaaaacaattaagtt

SEQ ID NO: 197578 - DNA, 75 bp, Artificial Sequence
  Synthetic
aaccaaaaaaggaagaaagccagacataaaaactgaggcgggaacaaaaatccaaacaaagacagaatttaaatt

SEQ ID NO: 197579 - DNA, 75 bp, Artificial Sequence
  Synthetic
gtcattgataaagattttcagagagacatcaattgatgaaaaagcagaaattttctccttttttagaacgtttgg

SEQ ID NO: 197580 - DNA, 75 bp, Artificial Sequence
  Synthetic
aacatttggagcagaggacaccgctgatagggacaacaaaaactgggcaaatgacagcaacgaaagatggatgaa

SEQ ID NO: 197581 - DNA, 75 bp, Artificial Sequence
  Synthetic
gctgccgataaagtaaggacacatatgtattcctccaaaaaaatcatactaaagacactatatgagtgtcatgca

SEQ ID NO: 197582 - DNA, 75 bp, Artificial Sequence
  Synthetic
aagaggatagtattaagatagaaaaatggattctagttgagaaagccaaagttcatgattggatagttagagaat

SEQ ID NO: 197583 - DNA, 75 bp, Artificial Sequence
  Synthetic
catgtatgtcttgaactcaaaaatgcacaaggatccaactctgcaatttcgtatgaatgtgccgtagacaattat

SEQ ID NO: 197584 - DNA, 75 bp, Artificial Sequence
  Synthetic
cacaaggatccaactctgcaatttcgtatgaatgtgccgtagacaattatagtagttttataggatttaaatttt

SEQ ID NO: 197585 - DNA, 75 bp, Artificial Sequence
  Synthetic
aacagggtcatttccagacattaaatttgaatcaagactccaattaggtatagtatcaatatcctctcgtgaaat

SEQ ID NO: 197586 - DNA, 75 bp, Artificial Sequence
  Synthetic
tcgaggtttttataaatgataataattttaaccctgaggatattattaattatgtagaatcaggagaatggttaa

SEQ ID NO: 197587 - DNA, 75 bp, Artificial Sequence
  Synthetic
tataacagaaattctaagtacaattaaaaaagataaatcagatatatatgacatcatttacactgaacaagttaa

SEQ ID NO: 197588 - DNA, 75 bp, Artificial Sequence
  Synthetic
tatttggggcaagacagagcacatctgctgatatcactaatatcgatacatcggactccatacaatgatcttata

SEQ ID NO: 197589 - DNA, 75 bp, Artificial Sequence
  Synthetic
tgacatacaagatgagagcagtccaggtattagcagaaacattgctagcaaaaggagtaggtgagttattcagtg

SEQ ID NO: 197590 - DNA, 75 bp, Artificial Sequence
  Synthetic
tgctgatatcactaatatcgatacatcggactccatacaatgatcttatatcttctcatctttattatctaattt

SEQ ID NO: 197591 - DNA, 75 bp, Artificial Sequence
  Synthetic
aaaatgggatggtaaaaggagaaattgacctactaaagagactgactacattatctgtctcaggtgttccaagat

SEQ ID NO: 197592 - DNA, 75 bp, Artificial Sequence
  Synthetic
gtttaaagagatgagttaacaagataagaaatccctttaactgactcataaaaacatagtaagaaaaacttacaa

SEQ ID NO: 197593 - DNA, 75 bp, Artificial Sequence
  Synthetic
gtgaggagagtagaatctctaggagaacaggtgagtcaaaaacagagacacatgctagaatccttgatcaacaag

SEQ ID NO: 197594 - DNA, 75 bp, Artificial Sequence
  Synthetic
aaaacatagtaagaaaaacttacaacagacaagagtattaataatatatcgatatttcttaaactcttgtctggt

SEQ ID NO: 197595 - DNA, 75 bp, Artificial Sequence
  Synthetic
gatgtaatgagatattcgggtttaaaactttttttaactggatgcaccctattctagaaaaaagtacaatttatg

SEQ ID NO: 197596 - DNA, 75 bp, Artificial Sequence
  Synthetic
tagctaaagatgctgactccaaaatcagcagtgctctggaggaagaactaggtgtgacagacacagcggaagaga

SEQ ID NO: 197597 - DNA, 75 bp, Artificial Sequence
  Synthetic
tacataatccaagaggaggaatagaaggttattgtcaaaaattatggacactgatctctattagtgcaatccatc

SEQ ID NO: 197598 - DNA, 75 bp, Artificial Sequence
  Synthetic
gcttgaagatgccgttctacaaaggaataaaagacggcagacgaccatcaagcgcaaccaaacaagatcagagag

SEQ ID NO: 197599 - DNA, 75 bp, Artificial Sequence
  Synthetic
gagttcctgttacacaaacctataagcaaaaaaagactcacgtctatgaagagatcacaagatatttcggtgcct

SEQ ID NO: 197600 - DNA, 75 bp, Artificial Sequence
  Synthetic
gataacagtataataaatatcaccaaatacaaaatcagaaatggaggtttatcgccccggcagatcaaaatcaga

SEQ ID NO: 197601 - DNA, 75 bp, Artificial Sequence
  Synthetic
tggagaagacagaagctggctccatagcatcatcgacaacccaaaagaaaacaagtcatcatgcaaatctgacga

SEQ ID NO: 197602 - DNA, 75 bp, Artificial Sequence
  Synthetic
accacggtaaatacacacattaacacaccagcaggaaggacacacatctggctactgattgcaacagcaatgcat

SEQ ID NO: 197603 - DNA, 75 bp, Artificial Sequence
  Synthetic
tccacggtaaatacacacattaacacaccagcaggaaggacacacatctggctactgattgcaacagcaatgcat

SEQ ID NO: 197604 - DNA, 75 bp, Artificial Sequence
  Synthetic
cccacggtaaatacacacattaacacaccagcaggaaggacacacatctggctactgattgcaacagcaatgcat

SEQ ID NO: 197605 - DNA, 75 bp, Artificial Sequence
  Synthetic
gccacggtaaatacacacattaacacaccagcaggaaggacacacatctggctactgattgcaacagcaatgcat

SEQ ID NO: 197606 - DNA, 75 bp, Artificial Sequence
  Synthetic
attataagtagtaaaatgtttgtatacagcaaacggatatattatgatgggaaaatcctcccacagtgcctcaaa

SEQ ID NO: 197607 - DNA, 75 bp, Artificial Sequence
  Synthetic
caagaggaaaaacttgtttggaatatataataatattaaatagtattttagggttaaagtaatactttaaaggga

SEQ ID NO: 197608 - DNA, 75 bp, Artificial Sequence
  Synthetic
gaaaatcctcccacagtgcctcaaagctttaacaagatgtgtattttggtcagagacccttgtagatgaaaatag

SEQ ID NO: 197609 - DNA, 75 bp, Artificial Sequence
  Synthetic
gtcagcatgctcaaatattgcaacatctatagccaaagctattgagaatggatattcacctatcttaggctattg

SEQ ID NO: 197610 - DNA, 75 bp, Artificial Sequence
  Synthetic
tcagttgaaaaatcacttgagaataaagtagaagaaaatagaacattacttaaacaaattcaagaggaaatagat

SEQ ID NO: 197611 - DNA, 75 bp, Artificial Sequence
  Synthetic
tttcagaataccagaaagaacagaactcactcatgatggctaatctatctacacttcatataattacagacagag

SEQ ID NO: 197612 - DNA, 75 bp, Artificial Sequence
  Synthetic
caattatatgtctacagctagatgttttgtcagaaatataggtgatccagcagttgcagccctagcagacctaaa

SEQ ID NO: 197613 - DNA, 75 bp, Artificial Sequence
  Synthetic
gagattcatcaaagcaggtctgctagataaacaggtattatatcgtgtgatgaatcaagaaccaggagactcaag

SEQ ID NO: 197614 - DNA, 75 bp, Artificial Sequence
  Synthetic
gataaacaggtattatatcgtgtgatgaatcaagaaccaggagactcaagcttcctagactgggcatcagacccc

SEQ ID NO: 197615 - DNA, 75 bp, Artificial Sequence
  Synthetic
gtctcttttcagaatcaagtagtgaagaagatcttaacttagcatcatttttgatggataggaaagccatattgc

SEQ ID NO: 197616 - DNA, 75 bp, Artificial Sequence
  Synthetic
ccagagtagctcacgagatcctagacaactcacttacaggtgtaagagaagctatagccgggatgcttgatacaa

SEQ ID NO: 197617 - DNA, 75 bp, Artificial Sequence
  Synthetic
ttagatctcaaaggaaagaccaaatctcatcgatacaaaaatgaagatataacttttgaccatcctttttctgca

SEQ ID NO: 197618 - DNA, 75 bp, Artificial Sequence
  Synthetic
gacttagatacacttagcaatggaagtcctgccatacgtatcccttattttggttctgctactgatgaaagatca

SEQ ID NO: 197619 - DNA, 75 bp, Artificial Sequence
  Synthetic
caagtattacggcacagatcaagaattattaaaagcctgcattgacctcaaaataactgtacggagaacagttag

SEQ ID NO: 197620 - DNA, 75 bp, Artificial Sequence
  Synthetic
tacttggacaagctgtagctaaagatgctgactccaaaatcagcagtgctctggaggaagaactaggtgtgacag

SEQ ID NO: 197621 - DNA, 75 bp, Artificial Sequence
  Synthetic
tgggcttatggaactgatgaaatatcatggatggaagcagcacttatagctcaaactagggctaacttaagttta

SEQ ID NO: 197622 - DNA, 75 bp, Artificial Sequence
  Synthetic
ggatgtatcaaagtgccctgtgaccaaagtaataaacaatctagtaccaaagttcgcattcataaatggtggtgt

SEQ ID NO: 197623 - DNA, 75 bp, Artificial Sequence
  Synthetic
atgaaattttcaagtgctactttagttcgggcgagtcgatttattaccatatctaatgataatatggcattaaaa

SEQ ID NO: 197624 - DNA, 75 bp, Artificial Sequence
  Synthetic
tagattgagagatactgctacacagatgaaattttcaagtgctactttagttcgggcgagtcgatttattaccat

SEQ ID NO: 197625 - DNA, 75 bp, Artificial Sequence
  Synthetic
atttagtttatcaacaaattatgttaaccggattgagcttattcgaattcaatatgaggtataaacaaggatcat

SEQ ID NO: 197626 - DNA, 75 bp, Artificial Sequence
  Synthetic
ttccacattgttgaaatcaaccaaaccagccttaataccttccaacctatgttgttcaagacaagtatccctaaa

SEQ ID NO: 197627 - DNA, 75 bp, Artificial Sequence
  Synthetic
gtcagggcccaagactatatcaattatgttaaaaccagatataatatataaaaatttaaaaataaaacatggata

SEQ ID NO: 197628 - DNA, 75 bp, Artificial Sequence
  Synthetic
agagatcactcaagaaaataacaagttaatctatgatcctgatcctctcaaagacatagatttagagttatttag

SEQ ID NO: 197629 - DNA, 75 bp, Artificial Sequence
  Synthetic
aagacatagatttagagttatttagtaaagttaaggatgtagtacacacgattgatatgaattattggtctgatg

SEQ ID NO: 197630 - DNA, 75 bp, Artificial Sequence
  Synthetic
attgatatgaattattggtctgatgatgaaataattagagcaactagtatatgcacagctatgactattgcagac

SEQ ID NO: 197631 - DNA, 75 bp, Artificial Sequence
  Synthetic
aaatgatgatgatataaatagtttaatcaccgagtttatggttattgatatacccttattttgttccactttcgg

SEQ ID NO: 197632 - DNA, 75 bp, Artificial Sequence
  Synthetic
tacccttattttgttccactttcgggggtattctaatcaatcaatttgcatattcactttacgggctaaacgtca

SEQ ID NO: 197633 - DNA, 75 bp, Artificial Sequence
  Synthetic
aaaataagaaaaacgtagggacaaagtcctccactaacgtcaaagaagacaagagtctcaaaaagcccagtcaaa

SEQ ID NO: 197634 - DNA, 75 bp, Artificial Sequence
  Synthetic
tgtaatacgcataattaaagacacatcacatgcagtcctaaaagtactgtccaatgcattatcacatcctaaaat

SEQ ID NO: 197635 - DNA, 75 bp, Artificial Sequence
  Synthetic
aagaacaaaagcaaaaacaaaaacaagaacaaaaagaggaacaaaaacaaaagtacacaccaaaaccaaaaaagg

SEQ ID NO: 197636 - DNA, 75 bp, Artificial Sequence
  Synthetic
attcaaacgattctgggatgcaggagttgtagagcctgtttatgggcctaacttgtccaatcaagacaagatact

SEQ ID NO: 197637 - DNA, 75 bp, Artificial Sequence
  Synthetic
gttgtagagcctgtttatgggcctaacttgtccaatcaagacaagatactgttagccatttcagtatgtgaatac

SEQ ID NO: 197638 - DNA, 75 bp, Artificial Sequence
  Synthetic
gttagccatttcagtatgtgaatactctgttgatcttttcatgcgtgattggcaagagggtataccactagaaat

SEQ ID NO: 197639 - DNA, 75 bp, Artificial Sequence
  Synthetic
aatatgatatgagatggatgcaaaagaataagtcggggaaccatttagatgtctcaaattctcataattttcttg

SEQ ID NO: 197640 - DNA, 75 bp, Artificial Sequence
  Synthetic
atagcagaaatgagaaaactttcatttttagctagacatctagcatacttgtgtagtttggcagagatagctaaa

SEQ ID NO: 197641 - DNA, 75 bp, Artificial Sequence
  Synthetic
caagcctgctgttatcttcatcattatgccaaattccagtagacaaactttcaaatgtaggggttataatcaatg

SEQ ID NO: 197642 - DNA, 75 bp, Artificial Sequence
  Synthetic
gtgtagtttggcagagatagctaaagagggaccaaaattagaatctatgacatctcttgaacgacttgaatcatt

SEQ ID NO: 197643 - DNA, 75 bp, Artificial Sequence
  Synthetic
ttttagctagacatctagcatacttgtgtagtttggcagagatagctaaagagggaccaaaattagaatctatga

SEQ ID NO: 197644 - DNA, 75 bp, Artificial Sequence
  Synthetic
tacaagatggatgtggaacaactcaaattattcaatacaagaatttattaaatagacttctaattcctctgaagg

SEQ ID NO: 197645 - DNA, 75 bp, Artificial Sequence
  Synthetic
gtattgtgatgttgtcgaaggaagatggaatatgtcttcagctggacgactcgataagaggtcatcaaaaataac

SEQ ID NO: 197646 - DNA, 75 bp, Artificial Sequence
  Synthetic
tagccgaagcacgagaagccaggaaggacatagcactaataaaagattccatagtcaagacacacaattctgtag

SEQ ID NO: 197647 - DNA, 75 bp, Artificial Sequence
  Synthetic
gaatcctctagtcaataaggataaagatagattatatctcggagaaggtgcgggtgcaatgctgtcttgttatga

SEQ ID NO: 197648 - DNA, 75 bp, Artificial Sequence
  Synthetic
tgctacattaggaccctgcatgaactattacaattcaggtgttaattcttgtgatctcaacggacaaagagaatt

SEQ ID NO: 197649 - DNA, 75 bp, Artificial Sequence
  Synthetic
tattacaattcaggtgttaattcttgtgatctcaacggacaaagagaattaaatatttatccttcagaagtggca

SEQ ID NO: 197650 - DNA, 75 bp, Artificial Sequence
  Synthetic
gggagatcccagcgataccacaagatcaccatcaatcttcacaaaaggaaaagataataaagtcaagaaaacaag

SEQ ID NO: 197651 - DNA, 75 bp, Artificial Sequence
  Synthetic
attagatgaagatttgacaatttatatgaaggataaagctctatcacctaggaaagcagcatgggattcagtata

SEQ ID NO: 197652 - DNA, 75 bp, Artificial Sequence
  Synthetic
cattgtgacatggaaggcggagaacacaaatgtgatcaggtggtcttacatgaacattatagtgtgatcaggatt

SEQ ID NO: 197653 - DNA, 75 bp, Artificial Sequence
  Synthetic
acaaatgtgatcaggtggtcttacatgaacattatagtgtgatcaggattgcataccttgttggagataaggacg

SEQ ID NO: 197654 - DNA, 75 bp, Artificial Sequence
  Synthetic
caattaagtctgtatctaagatactggagagatgtcagcttaatagtgttgaaaacatctaacccagcctctaca

SEQ ID NO: 197655 - DNA, 75 bp, Artificial Sequence
  Synthetic
gaaatgtatttgatatcaaaagatcctaaatctgatattatagaggatagtaatacagtattggcaaaccttctt

SEQ ID NO: 197656 - DNA, 75 bp, Artificial Sequence
  Synthetic
ctaaatctgatattatagaggatagtaatacagtattggcaaaccttcttccattatctaaagaggatagtatca

SEQ ID NO: 197657 - DNA, 75 bp, Artificial Sequence
  Synthetic
agattcactaactaactaaacataaatccacaatttcaaccagcaatcaaaatcaacatctagagccaactcaaa

SEQ ID NO: 197658 - DNA, 75 bp, Artificial Sequence
  Synthetic
ctagcaaaaggagtgggtgagttattcagtgaaaatgggatggtaaagggagaaattgacctactaaagagactg

SEQ ID NO: 197659 - DNA, 75 bp, Artificial Sequence
  Synthetic
tggtttaattggtataaatggaatagaactatatgccaataaaaggggacgagatactacttgggggaatcaaat

SEQ ID NO: 197660 - DNA, 75 bp, Artificial Sequence
  Synthetic
catcgtcaggtatgctaagaccttaccatcaagcattacaaatcttcggatttgagcctaatttaaacaaattat

SEQ ID NO: 197661 - DNA, 75 bp, Artificial Sequence
  Synthetic
ccatcaagcattacaaatcttcggatttgagcctaatttaaacaaattatgtagagattttttatctacgctaaa

SEQ ID NO: 197662 - DNA, 75 bp, Artificial Sequence
  Synthetic
tatagtagacacaaaaaattgtattatcacttttgatagagtattgagagatacaatctttgagtggactaggat

SEQ ID NO: 197663 - DNA, 75 bp, Artificial Sequence
  Synthetic
tactcagataatcattataataattgtgtgtatacttataataatcatatgtggtatattatattatctatacag

SEQ ID NO: 197664 - DNA, 75 bp, Artificial Sequence
  Synthetic
ctcttagagattcaggtaagttaaaagttatttctagaagacttgtaatatcttggatagcattgtctatgtcta

SEQ ID NO: 197665 - DNA, 75 bp, Artificial Sequence
  Synthetic
tccaattaaaaaatcagatcaagtacattgtagcacacatacaacaatcaaatatatccacaacttctctaatca

SEQ ID NO: 197666 - DNA, 75 bp, Artificial Sequence
  Synthetic
gcagtcaaattatttggggcaagacaaagcacatctgctgatatcactaatatcgatacatctgactccatacaa

SEQ ID NO: 197667 - DNA, 75 bp, Artificial Sequence
  Synthetic
aaagcacatctgctgatatcactaatatcgatacatctgactccatacaatgatcttatatcttctaaattttat

SEQ ID NO: 197668 - DNA, 75 bp, Artificial Sequence
  Synthetic
tatttaattagtttaaagaaatgagttaacaagataaaaaatccccttaaccgaatcataaaaacatattaagaa

SEQ ID NO: 197669 - DNA, 75 bp, Artificial Sequence
  Synthetic
ccggatccttaccaattggcatagccaagtattacggcacagatcaagaattattaaaagcctgcattgacctca

SEQ ID NO: 197670 - DNA, 75 bp, Artificial Sequence
  Synthetic
caaactttcaaatgtaggggttataatcaatgagggcaaattacttaagatagcaggatcttatgaatctagata

SEQ ID NO: 197671 - DNA, 75 bp, Artificial Sequence
  Synthetic
tacggcattgaaactagggatcaagctcacccaacactactctgaattagcaacagcattcagctccaatcttgg

SEQ ID NO: 197672 - DNA, 75 bp, Artificial Sequence
  Synthetic
gacatttgatcttagttaaaacctttataatggctgggctactaagtacttttgatacattcagctccaggagga

SEQ ID NO: 197673 - DNA, 75 bp, Artificial Sequence
  Synthetic
tataatggctgggctactaagtacttttgatacattcagctccaggaggagtgagagcatcaataagtctggcgg

SEQ ID NO: 197674 - DNA, 75 bp, Artificial Sequence
  Synthetic
aggagcaattatacctggtcaaagaagtacagtttctgtcttcacattaggcccgagtgtgacggatgatgcaga

SEQ ID NO: 197675 - DNA, 75 bp, Artificial Sequence
  Synthetic
caagtatgtgatatacagtatagagagagatcctaaaaggacaaaaacagatgggttcattgtcaaaacaagaga

SEQ ID NO: 197676 - DNA, 75 bp, Artificial Sequence
  Synthetic
agagatcctaaaaggacaaaaacagatgggttcattgtcaaaacaagagacatggagtatgaaagaacaacagag

SEQ ID NO: 197677 - DNA, 75 bp, Artificial Sequence
  Synthetic
atgggttcattgtcaaaacaagagacatggagtatgaaagaacaacagagtggttgttcggacctatggtcaaca

SEQ ID NO: 197678 - DNA, 75 bp, Artificial Sequence
  Synthetic
agaacccattgttccaagggcaaagagagaatgcggatctagaagcattgcttcagacatatggatatcctgcat

SEQ ID NO: 197679 - DNA, 75 bp, Artificial Sequence
  Synthetic
aaacaacaacacaaaaaaagaaaaagaaaaagacaagaccacaaacaagaaaaagaggaaaaacaaaaacaagaa

SEQ ID NO: 197680 - DNA, 75 bp, Artificial Sequence
  Synthetic
tagtgaagaagatcttaacttagcatcatttttgatggataggaaagccatattgcccagagtagctcacgagat

SEQ ID NO: 197681 - DNA, 75 bp, Artificial Sequence
  Synthetic
agagaatgcggatctagaagcattgcttcagacatatggatatcctgcatgtctcggagctataatagttcaagt

SEQ ID NO: 197682 - DNA, 75 bp, Artificial Sequence
  Synthetic
acaagtagtgctggtctaagaaaaggattcttcaatagattagaagcattcagacaagatggaaccgtcaaaagt

SEQ ID NO: 197683 - DNA, 75 bp, Artificial Sequence
  Synthetic
attagagaagaacattcagattgtaggaaattacataagagatgcaggattagcatctttcatgaacaccatcaa

SEQ ID NO: 197684 - DNA, 75 bp, Artificial Sequence
  Synthetic
tgttgatatctatctatcaaagggagcccgagccccttttatatgtatactcagagacccagttcatggagactt

SEQ ID NO: 197685 - DNA, 75 bp, Artificial Sequence
  Synthetic
atttaggtgccgaagggaggctacttaaactaggcaaaaagatctacatatatactagatcctcaggttggcact

SEQ ID NO: 197686 - DNA, 75 bp, Artificial Sequence
  Synthetic
tatactagatcctcaggttggcactccaacttgcaaataggatcactagatatcaacaaacccatgaccattaat

SEQ ID NO: 197687 - DNA, 75 bp, Artificial Sequence
  Synthetic
tgcaataggagaactaaggtgtgagactacggcactgaaactagggatcaagctcacccaacactactctgaatt

SEQ ID NO: 197688 - DNA, 75 bp, Artificial Sequence
  Synthetic
aaacctttcaggaggggatggtgcctaccacaaacctacaggtggtggagccatagaagtagcaattgatcatac

SEQ ID NO: 197689 - DNA, 75 bp, Artificial Sequence
  Synthetic
cctgaacacgacgcaaccgcaaatgaagaaggaaccagcaacacatcagttgatgagatggccaagctgttagta

SEQ ID NO: 197690 - DNA, 75 bp, Artificial Sequence
  Synthetic
atctacacttcatataattacagacagaggtgggaaaacgggcgatcccagtgataccacaagatcaccatcagt

SEQ ID NO: 197691 - DNA, 75 bp, Artificial Sequence
  Synthetic
aagatgaagttaatattctctctcggacttgtaggtggaataagtttccatgtacatgcaacaggcacattatcc

SEQ ID NO: 197692 - DNA, 75 bp, Artificial Sequence
  Synthetic
ttatctccatcattatgccaaattccagtagacaaactttcaaatgtaggggttataatcaatgagggcaaatta

SEQ ID NO: 197693 - DNA, 75 bp, Artificial Sequence
  Synthetic
gaaaaaacttgtttggaatatataataatattaaatagtattttagggttaaagtaatactttaaaaggacaagt

SEQ ID NO: 197694 - DNA, 75 bp, Artificial Sequence
  Synthetic
aacagaaactaagccaagcaagcaacgaacgagacatcagcagtgatgctgattatgaaaatgatgatgatgcta

SEQ ID NO: 197695 - DNA, 75 bp, Artificial Sequence
  Synthetic
agaggcaccacgaaaacaagaatcactctcagatgtcatcggactccttgacgtcgtcctatcctacaagcccac

SEQ ID NO: 197696 - DNA, 75 bp, Artificial Sequence
  Synthetic
atataactgataaatataataaaaacacatggtatcgcccatttttaacatggtttagcatcaaatatgatatga

SEQ ID NO: 197697 - DNA, 75 bp, Artificial Sequence
  Synthetic
cctgagaatatgggcaatgaaagaaacaccagaatcgacgaagatccttcaaatgagagaagacatcagagatca

SEQ ID NO: 197698 - DNA, 75 bp, Artificial Sequence
  Synthetic
tatctgatgatggagagagtagaacaaataataatggaagaagcatggaaactagcagcacacatagtacaagaa

SEQ ID NO: 197699 - DNA, 75 bp, Artificial Sequence
  Synthetic
gtagcacacatacaacaatcagatatatccacaacttctctaatcagatgtatgataagtaagaaaaacttaggg

SEQ ID NO: 197700 - DNA, 75 bp, Artificial Sequence
  Synthetic
tagataatataactgctgaggttcaacacaatatacctttaaagaagaatgaaagaactcccttctgggggttaa

SEQ ID NO: 197701 - DNA, 75 bp, Artificial Sequence
  Synthetic
ccaacctcgaagaccacaacaccaaaatcggcccaaaagttccgccgttaaagaacgaagagccagcagccactc

SEQ ID NO: 197702 - DNA, 75 bp, Artificial Sequence
  Synthetic
acatgaatttgaattatctaggagtgcaagtcatgtatttgctaagcgcatgttaaaatctgcaaattaccaaga

SEQ ID NO: 197703 - DNA, 75 bp, Artificial Sequence
  Synthetic
aatgacatttaatctctgtggtatgcttctatcagttgaaaaatcacttgagaataaagtagaagaaaatagaac

SEQ ID NO: 197704 - DNA, 75 bp, Artificial Sequence
  Synthetic
atagattcatctagggatcttcataaacggttttcagaataccagaaagaacagaactcactcatgatggctaat

SEQ ID NO: 197705 - DNA, 75 bp, Artificial Sequence
  Synthetic
acagaactcactcatgatggctaatctatctacacttcatataattacagacagaggcgggaaaacgggagatcc

SEQ ID NO: 197706 - DNA, 75 bp, Artificial Sequence
  Synthetic
tttatattacaaggtccctgaatcagaagagactcgtaggttaatcgaggtttttataaatgataataattttaa

SEQ ID NO: 197707 - DNA, 75 bp, Artificial Sequence
  Synthetic
agaagccagatcaaaagtaagaaaaacttagggtgaatgacaattcacaggtcagctcaacctgacaccatcagc

SEQ ID NO: 197708 - DNA, 75 bp, Artificial Sequence
  Synthetic
acacactctgcactcactcaaactagtcatcgaaaacagtcctctaagcagagcagagaagaaagcttacatcaa

SEQ ID NO: 197709 - DNA, 75 bp, Artificial Sequence
  Synthetic
gagtgaaggtatagaagacttagtatttgacatattagatctcaagggaaagaccaaatctcatcgatacaaaaa

SEQ ID NO: 197710 - DNA, 75 bp, Artificial Sequence
  Synthetic
ttcaaccagcaatcaaaatcaatatctagaactaactcaaaaagccccctcaaaacaattaagaaaaacttaggg

SEQ ID NO: 197711 - DNA, 75 bp, Artificial Sequence
  Synthetic
caaaacaattaagaaaaacttagggtcaaagaaattttacccggagaaagaaaatggctgaaacatacaggttcc

SEQ ID NO: 197712 - DNA, 75 bp, Artificial Sequence
  Synthetic
actaaatatagtagacacaaaaaattgtattatcacatttgatagagtattgagagatacaatctttgagtggac

SEQ ID NO: 197713 - DNA, 75 bp, Artificial Sequence
  Synthetic
ccagattctcacacgaagaaaatgggacagtagaacctctccccctcaaaacaggtcctgacaaaaaagcaatcc

SEQ ID NO: 197714 - DNA, 75 bp, Artificial Sequence
  Synthetic
tctacctgagaatatgggcaatgaaagaaacaccagaatcgacgaagatcctccaaatgagagaagacatcagag

SEQ ID NO: 197715 - DNA, 75 bp, Artificial Sequence
  Synthetic
ctcacatcagaatagtcaaggtaggagatcctccaaaacatggagtcaggtatcttgatgtgctgctattgggat

SEQ ID NO: 197716 - DNA, 75 bp, Artificial Sequence
  Synthetic
gacaaatttgaagatattatacatagtgtgacctataggttcttgactaaagaaataaaaatattgatgaaaatt

SEQ ID NO: 197717 - DNA, 75 bp, Artificial Sequence
  Synthetic
agttagatctggagaaatgatagtatacatggtagattcgatccatgctcctctactaccatggtccagccgact

SEQ ID NO: 197718 - DNA, 75 bp, Artificial Sequence
  Synthetic
aggttatgtttgatattggacatgaattgaaattaaatgagaccattataagtagtaaaatgtttgtatacagca

SEQ ID NO: 197719 - DNA, 75 bp, Artificial Sequence
  Synthetic
aataaagtagctctggcacctcaatgtctcccagtcgacaaagatatcagattcagagttgtatttgtcaacgga

SEQ ID NO: 197720 - DNA, 75 bp, Artificial Sequence
  Synthetic
actccacaaatcaacaagtggagacatctccaacctcgaagaccacaacaccaaaaccagcccaagggttccacc

SEQ ID NO: 197721 - DNA, 75 bp, Artificial Sequence
  Synthetic
ataactcacctattaatgcttatactctggagtcaagaatgaagaacccctacatgggcaaccactccaattaaa

SEQ ID NO: 197722 - DNA, 75 bp, Artificial Sequence
  Synthetic
gtctcccagtcgacaaagatatcagattcagagttgtatttgtcaacggaacatcactgggtacaatcacaattg

SEQ ID NO: 197723 - DNA, 75 bp, Artificial Sequence
  Synthetic
ccaaggtcccaaaaactcttgcagatcttgcattaccgaactcaatatcagtaaatctgttggttacacttaagg

SEQ ID NO: 197724 - DNA, 75 bp, Artificial Sequence
  Synthetic
atctccaacctcgaagaccacaacaccaaaaccagcccaagggttccaccgtcaaggaacgaagagccagcagct

SEQ ID NO: 197725 - DNA, 75 bp, Artificial Sequence
  Synthetic
gtaaatctgttggttacacttaaggcaggagtatcaacagaacaaaaaggaatcctccccgttctagacgatgat

SEQ ID NO: 197726 - DNA, 75 bp, Artificial Sequence
  Synthetic
cttgagcagatcagggcctaacactatatcaattatgttaaaaccagatataatatatgaaaatttaaaaataaa

SEQ ID NO: 197727 - DNA, 75 bp, Artificial Sequence
  Synthetic
atgctcaaatattgcaacatctatagccaaagccattgagaatggatattcacctatcttaggctattgtattgc

SEQ ID NO: 197728 - DNA, 75 bp, Artificial Sequence
  Synthetic
agttgggaaaatatattcagttgaatactgcaaaaataagattgagaagatgaagctaatattctctctcgggct

SEQ ID NO: 197729 - DNA, 75 bp, Artificial Sequence
  Synthetic
catgcaacaggcacattatccaaaactctaatgagtcagcttgcatggaagaaagcagtttgttatcccttaatg

SEQ ID NO: 197730 - DNA, 75 bp, Artificial Sequence
  Synthetic
gatgtaaatccacatatgaatctagtcatctgggcagcttcagtagagatcacaagtgtcgacgctgtgtttcaa

SEQ ID NO: 197731 - DNA, 75 bp, Artificial Sequence
  Synthetic
cacaagtgtcgacgctgtgtttcaacctgcaattccgaaagaattccgctattacccaaatgttgttgcaaaaag

SEQ ID NO: 197732 - DNA, 75 bp, Artificial Sequence
  Synthetic
ttggatagtgttggttaaggccataacaagtagtgctggtctaagaaaaggattcttcaatagattagaagcatt

SEQ ID NO: 197733 - DNA, 75 bp, Artificial Sequence
  Synthetic
cctgcaattccgaaagaattccgctattacccaaatgttgttgcaaaaagtatcgggaaaatcaggaagatataa

SEQ ID NO: 197734 - DNA, 75 bp, Artificial Sequence
  Synthetic
tcagttcaaataagaaaaacgtagggacaaagtcttccactaacatcaaagaagataagagtctcaaaaagccca

SEQ ID NO: 197735 - DNA, 75 bp, Artificial Sequence
  Synthetic
gaagataagagtctcaaaaagcccagccaaagcagagaggaaaacaacaacacaaaaaaagaaaaagacaagacc

SEQ ID NO: 197736 - DNA, 75 bp, Artificial Sequence
  Synthetic
tggagctacgcaatgggtgttgctgtggtacaaaacaaagctatgcaacaatatgtaactggaagaacatatttg

SEQ ID NO: 197737 - DNA, 75 bp, Artificial Sequence
  Synthetic
aaacctttcaggaggggatggtgcctaccacaaacccacaggtggtggagctatagaagtggcaattgatcatac

SEQ ID NO: 197738 - DNA, 75 bp, Artificial Sequence
  Synthetic
aggatcatttattgaaggctcagaaatatgtaagttttgtagatcagaagggaataaccctatgtatacttggtt

SEQ ID NO: 197739 - DNA, 75 bp, Artificial Sequence
  Synthetic
aactcaaattattcaatacaagaatttattaaatagacttctaattcccctgaaggatgccttggatcttcagga

SEQ ID NO: 197740 - DNA, 75 bp, Artificial Sequence
  Synthetic
tatggaactgatgaaatatcatggatggaagcagcacttatagctcaaactagggctaacttaagtttagagaat

SEQ ID NO: 197741 - DNA, 75 bp, Artificial Sequence
  Synthetic
acagctgctcagataactgcaggaattgcactagccgaagcacgagaagccaggaaggacatagcactaataaaa

SEQ ID NO: 197742 - DNA, 75 bp, Artificial Sequence
  Synthetic
ttttagaacgtttggacatcctagcttagaagcaataactgctgccgataaagtaaggacacatatgtattcctc

SEQ ID NO: 197743 - DNA, 75 bp, Artificial Sequence
  Synthetic
caattataataaacggatatagagaaagacacggtggtcaatggccgccatgtgaattccccaatcatgtatgtc

SEQ ID NO: 197744 - DNA, 75 bp, Artificial Sequence
  Synthetic
cataatcaataaggcatcatctttaggaggtgcagatgtcacaaactgtatagaatcaaaattagcatatatatg

SEQ ID NO: 197745 - DNA, 75 bp, Artificial Sequence
  Synthetic
ccatcaagcgcaaccaaacaagatcagagagaacacagaacccagaactccacaaatcaacaagtggagacagct

SEQ ID NO: 197746 - DNA, 75 bp, Artificial Sequence
  Synthetic
agagagaacacagaacccagaactccacaaatcaacaagtggagacagctccaatcttgaagaccacaacaccaa

SEQ ID NO: 197747 - DNA, 75 bp, Artificial Sequence
  Synthetic
ccaatcttgaagaccacaacaccaaaaccagcccaaaagttccaccgtcaaagaacgaagagccagcaaccactc

SEQ ID NO: 197748 - DNA, 75 bp, Artificial Sequence
  Synthetic
ataattgtgtgtatacttataataatcatatgtggtatattatactatctatacagggtcagaagactattaata

SEQ ID NO: 197749 - DNA, 75 bp, Artificial Sequence
  Synthetic
acagaactcactcatgatggctaatctgtctacacttcatataatcacagacagaggtgggaaaacgggcgatcc

SEQ ID NO: 197750 - DNA, 75 bp, Artificial Sequence
  Synthetic
taatcagatgtatgataagtaagaaaaacttagggttaaagacaatccagccaacccacaaggcaacaacatctg

SEQ ID NO: 197751 - DNA, 75 bp, Artificial Sequence
  Synthetic
gattgcaacagcaatgcatgcaacactgtccctcattatcatgatactatgcattgacctaattataaagcaaga

SEQ ID NO: 197752 - DNA, 75 bp, Artificial Sequence
  Synthetic
gcattgacctaattataaagcaagacacttgtatgaagacaaacaccatgacagtatcctccgtgaacgaaagtg

SEQ ID NO: 197753 - DNA, 75 bp, Artificial Sequence
  Synthetic
cgagaacactattgctattcaccatgcagacggaataacccctctggacccacatgatttctggagatgtcccgt

SEQ ID NO: 197754 - DNA, 75 bp, Artificial Sequence
  Synthetic
gaactgtgatagatgttgatttggaaaaatatatggttaccctcttagttaaaataccaattttatcagaaatac

SEQ ID NO: 197755 - DNA, 75 bp, Artificial Sequence
  Synthetic
ggaaatcatgttctgtaatagctgcaggaacaaggggttaccagttatgctccttgcccactgtgaatgagacta

SEQ ID NO: 197756 - DNA, 75 bp, Artificial Sequence
  Synthetic
ttgaagatacactcgttttcctagggtatggtggcttaacaactccgctccaaggcaacaccaagtgtgtgataa

SEQ ID NO: 197757 - DNA, 75 bp, Artificial Sequence
  Synthetic
ttatttatctgataggccaaagattgttgtcgagactattccaataactcagaattatttaggtgccgaagggag

SEQ ID NO: 197758 - DNA, 75 bp, Artificial Sequence
  Synthetic
gctacttaaactaggcaaaaagatctacatatatactagatcttcaggttggcactccaacttgcaaataggatc

SEQ ID NO: 197759 - DNA, 75 bp, Artificial Sequence
  Synthetic
caaatttcctagaagaatctaagacagagcttatgaaagcaagggcaatcatatcggcagttggaggatggcaca

SEQ ID NO: 197760 - DNA, 75 bp, Artificial Sequence
  Synthetic
actggatatcaacaaacccatgactattaattggacgcctcacagagtcctgtcacgaccaggaaacccagactg

SEQ ID NO: 197761 - DNA, 75 bp, Artificial Sequence
  Synthetic
gaatgcatatcaggtgtatacactgatgcatatcctctatcccccgatgcagtcaatgttgctacaaccacactg

SEQ ID NO: 197762 - DNA, 75 bp, Artificial Sequence
  Synthetic
agtcaatgttgctacaaccacactgtacgcaaatacatcacgtgttaatcctaccataatgtactcaaatacctc

SEQ ID NO: 197763 - DNA, 75 bp, Artificial Sequence
  Synthetic
aaagattgtcattgacaaatttgaagatattatacatagtgtgacttataggttcttgactaaagaaataaaaat

SEQ ID NO: 197764 - DNA, 75 bp, Artificial Sequence
  Synthetic
actgaggcaagaacaaaaatccaaacaaagacagaattcgaattcaaaataaacaccaagatagagacaaaaatg

SEQ ID NO: 197765 - DNA, 75 bp, Artificial Sequence
  Synthetic
attgttgaaatcaaccaaaccagccttaataccttccaacctatgttgttcaagacaagtatccctaaagtatgt

SEQ ID NO: 197766 - DNA, 75 bp, Artificial Sequence
  Synthetic
tcgatttattaccatatctaatgataatatggcattaaaagaggcaggagaatctaaagatactaatttagttta

SEQ ID NO: 197767 - DNA, 75 bp, Artificial Sequence
  Synthetic
atatataataatattaaatagtattttagggttaaagtaatactttaaaaggacaagtcacagacatttgatctt

SEQ ID NO: 197768 - DNA, 75 bp, Artificial Sequence
  Synthetic
gactcattaaaagatgtagatatcatctcagatataactgataaatataataaaaacacatggtatcgcccattc

SEQ ID NO: 197769 - DNA, 75 bp, Artificial Sequence
  Synthetic
gacaaatgatgaagacatcattgacatagaaaacaagattgcacgaaggctggctgatagaaaacagaaactaag

SEQ ID NO: 197770 - DNA, 75 bp, Artificial Sequence
  Synthetic
ccaaagttcgcattcataaatggtggtgtagtggctaattgcattgcatccacatgtacatgcgggacaaacaga

SEQ ID NO: 197771 - DNA, 75 bp, Artificial Sequence
  Synthetic
gtgtagtggctaattgcattgcatccacatgtacatgcgggacaaacagaataccagtgaatcaagatcgctcaa

SEQ ID NO: 197772 - DNA, 75 bp, Artificial Sequence
  Synthetic
aatcatatattttaattatatatagagatttagtgataataataaataaattaaaattaaccggttatgtcctta

SEQ ID NO: 197773 - DNA, 75 bp, Artificial Sequence
  Synthetic
cttttgaccatcctttttctgcaatgtatccaagtgtaggaagtgggataaagattgaaaatacactcgttttcc

SEQ ID NO: 197774 - DNA, 75 bp, Artificial Sequence
  Synthetic
ccacaataccaaaaccagcccaagagttccaccgtcaaagaacgaagagccagcagccgctcaaaagaacaacca

SEQ ID NO: 197775 - DNA, 75 bp, Artificial Sequence
  Synthetic
agatcaccatcagtcttcacaaaagggaaagataataaggtcaaaaagacaaggtttgatccctctatggaagct

SEQ ID NO: 197776 - DNA, 75 bp, Artificial Sequence
  Synthetic
ttgaaaatacactcgttttcctaggatacggtggcttaacaactccgctccaaggcaacaccaagtgtgtgataa

SEQ ID NO: 197777 - DNA, 75 bp, Artificial Sequence
  Synthetic
tcaaccgagggctatgaaactttgagttgttttttaactactgatttgaaaaaatactgtcttaactggagattt

SEQ ID NO: 197778 - DNA, 75 bp, Artificial Sequence
  Synthetic
attctagaaaaaagtacaatttatgtaggagatccttactgtccagtatctgatagaatgcacaaagaactccaa

SEQ ID NO: 197779 - DNA, 75 bp, Artificial Sequence
  Synthetic
aaaaagaggagaaaaaacaaaagtacacaccaaaaccaaaaaagggaaaaaaccagatataaaaaccgaggcaag

SEQ ID NO: 197780 - DNA, 75 bp, Artificial Sequence
  Synthetic
tacgcaaatacatcgcgtgttaatcctaccataatgtactcaaatacctcaaaaatcatcaacatgctaagactc

SEQ ID NO: 197781 - DNA, 75 bp, Artificial Sequence
  Synthetic
tgtaggggttataatcaatgagggcaaattacttaagatagcaggatcttatgaatctagatacatagtgttaag

SEQ ID NO: 197782 - DNA, 75 bp, Artificial Sequence
  Synthetic
acactactacatcatgtatcactcatttcggaaagggctactgcttccacattgttgaaatcaaccaaaccagcc

SEQ ID NO: 197783 - DNA, 75 bp, Artificial Sequence
  Synthetic
aaaaattggttaagatgtgcaatattgatcccagctaatataggagggttcaactatatgtctacagctagatgt

SEQ ID NO: 197784 - DNA, 75 bp, Artificial Sequence
  Synthetic
tatatgacaaatagaataagaaaaacttagggttaatgcctgcctatttgtcaaatatggataaacaggagtcaa

SEQ ID NO: 197785 - DNA, 75 bp, Artificial Sequence
  Synthetic
tattcatgcaacctcccacattcacaaagtataacaactataatcaaaaatgtaacagctagatcagtattgcag

SEQ ID NO: 197786 - DNA, 75 bp, Artificial Sequence
  Synthetic
atagagtattgagagatacaatctttgagtggactaggataaaagatgcagataagaagctgagacttacaggta

SEQ ID NO: 197787 - DNA, 75 bp, Artificial Sequence
  Synthetic
ccagagtagctcacgagatcctagacaactcacttacaggtgtaagagaagctatagctgggatgcttgatacaa

SEQ ID NO: 197788 - DNA, 75 bp, Artificial Sequence
  Synthetic
gataagaagctgagacttacaggtaaatatgatctatatcctcttagagattcaggtaagttaaaagttatttct

SEQ ID NO: 197789 - DNA, 75 bp, Artificial Sequence
  Synthetic
ttaacatggtttagcatcaaatatgatatgagatggatgcaaaagaataagtcggggaatcatttagatgtctca

SEQ ID NO: 197790 - DNA, 75 bp, Artificial Sequence
  Synthetic
acttatggaagaccaatccacggtttagaaactccagacccgttagaattattaagaggatcatttattgaaggc

SEQ ID NO: 197791 - DNA, 75 bp, Artificial Sequence
  Synthetic
tcagaagtatgtaagttttgtagatcagagggaaataaccctatgtatacttggttctatcttcctgacaacatc

SEQ ID NO: 197792 - DNA, 75 bp, Artificial Sequence
  Synthetic
gaggctcaactaggttatgttaagaacttaagcaagccggcaaaagcagcaataagaatcgcaatggtttatact

SEQ ID NO: 197793 - DNA, 75 bp, Artificial Sequence
  Synthetic
cagtctcaaagaaaaagaaattaaacaagagggtcgactctttgccaagatgacatacaagatgagagcagtcca

SEQ ID NO: 197794 - DNA, 75 bp, Artificial Sequence
  Synthetic
acctgtagacatttctttaaatcttgcatctgccacaaatttcctagaagaatccaagacagagcttatgaaagc

SEQ ID NO: 197795 - DNA, 75 bp, Artificial Sequence
  Synthetic
caaacgagacatcagcagtgatgctgattatgaaaatgatgatgatgctacagcggctgcagggataggaggaat

SEQ ID NO: 197796 - DNA, 75 bp, Artificial Sequence
  Synthetic
agggtgaatgacaattcacagatcagctcaaccagacatcatcagcatacacgaaaccaaccttcacagtggata

SEQ ID NO: 197797 - DNA, 75 bp, Artificial Sequence
  Synthetic
atgataagtaagaaaaacttagggttaaagacaatccagccaacccacaaggtaacaacatctgactatacaaac

SEQ ID NO: 197798 - DNA, 75 bp, Artificial Sequence
  Synthetic
catctctcgaacgacttgaatcattgaaggagtatctagaacttactttcttagatgatcctatattaagatata

SEQ ID NO: 197799 - DNA, 75 bp, Artificial Sequence
  Synthetic
gaaggagtatctagaacttactttcttagatgatcctatattaagatatagtcaattgacaggtttagttattaa

SEQ ID NO: 197800 - DNA, 75 bp, Artificial Sequence
  Synthetic
atcaggaaatcttcaattaaggtgttgagagtaagaggtatagggataccagaagtcttagaagactgggatcct

SEQ ID NO: 197801 - DNA, 75 bp, Artificial Sequence
  Synthetic
tatacctttaaagaagaatgaaagaactcccttctgggggttaagggtatcaaaatcacaagttctacgacttag

SEQ ID NO: 197802 - DNA, 75 bp, Artificial Sequence
  Synthetic
caaaatcacaagttctacgacttagaggttatgaagagataaaaagagaagaaagagggagatcaggtgtaggat

SEQ ID NO: 197803 - DNA, 75 bp, Artificial Sequence
  Synthetic
taaccctaccttttgatgggcgatatttatcacaccaattgagacttttcgggattaatagcaccagttgtttga

SEQ ID NO: 197804 - DNA, 75 bp, Artificial Sequence
  Synthetic
aacaacaatacaaaaagcccaccaactcctgaacacgacgcaacagcaaatgaagaaggaactggcaacacacca

SEQ ID NO: 197805 - DNA, 75 bp, Artificial Sequence
  Synthetic
gatattcccttcaacgttaacttatatcaggaaatcttcaattaaggtgttgagagtaagaggtatagggatacc

SEQ ID NO: 197806 - DNA, 75 bp, Artificial Sequence
  Synthetic
tcacgagtttatgtcaaagggtcaaggttttattcaatgggaatcctgggtcaacttggatagggaatgatgaat

SEQ ID NO: 197807 - DNA, 75 bp, Artificial Sequence
  Synthetic
ggttttattcaatgggaatcctgggtcaacttggatagggaatgatgaatgtgaaacactaatctggaatgaatt

SEQ ID NO: 197808 - DNA, 75 bp, Artificial Sequence
  Synthetic
caaaatcacaagttctgcgacttagaggttatgaagagataaaaaaggaagaaagaggaagatcaggtgtaggat

SEQ ID NO: 197809 - DNA, 75 bp, Artificial Sequence
  Synthetic
gagttcaagcctgatctgataagagaggatgaactaagagatgacatcagaaacccagtactagaagaatacaac

SEQ ID NO: 197810 - DNA, 75 bp, Artificial Sequence
  Synthetic
aactaactaaacataaatccacaacctaaaccagcaatcaaaatcaatatctagagttaactcaaaaagcctcct

SEQ ID NO: 197811 - DNA, 75 bp, Artificial Sequence
  Synthetic
gaaaagacaagttgtcaacgtcttaattcatattaataattatttatctgataggccaaagattgttgtcgagac

SEQ ID NO: 197812 - DNA, 75 bp, Artificial Sequence
  Synthetic
acacacaagaaaaagaggaaaaacaaaaataagaacaaaaagaggaacaaaaacaaaagtacacactaaaatcaa

SEQ ID NO: 197813 - DNA, 75 bp, Artificial Sequence
  Synthetic
tatatcaaagattgtcattgacaaatttgaagatattatacatagtgtgacctataggttcttgactaaagaaat

SEQ ID NO: 197814 - DNA, 75 bp, Artificial Sequence
  Synthetic
gcagtcaaattatttggggcaagacagagtatatctgctgatatcactaatatcgatacatctgattctatacaa

SEQ ID NO: 197815 - DNA, 75 bp, Artificial Sequence
  Synthetic
ttaataagataaaaaacccccttaaccgaatcataaaaacatattaagaaaaaccaaaaaaagacaagagtatta

SEQ ID NO: 197816 - DNA, 75 bp, Artificial Sequence
  Synthetic
caattatacctggtcaaagaagtacagtttctgtcttcacattaggcccgagtgtgacagatgatgcagataaat

SEQ ID NO: 197817 - DNA, 75 bp, Artificial Sequence
  Synthetic
tcctaaaaggacaaaaacagatgggttcattgtcaaaacaagagacatggagtatgaaagaacaacagagtggtt

SEQ ID NO: 197818 - DNA, 75 bp, Artificial Sequence
  Synthetic
atgattaactcaactaataactcacctattaatgcttatactctggagtcaagaatgaagaacccctacatgggt

SEQ ID NO: 197819 - DNA, 75 bp, Artificial Sequence
  Synthetic
aaagggagcccgagccccttttatatgtatactcagagacccagttcatggagactttgcccctggaaactatcc

SEQ ID NO: 197820 - DNA, 75 bp, Artificial Sequence
  Synthetic
cctgtatcgacttctacaaatttgtcccatagattgagagatactgctacacagatgaaattttcaagtgctact

SEQ ID NO: 197821 - DNA, 75 bp, Artificial Sequence
  Synthetic
atttcaagaattatggttaaatattcttagacaattaggctgtgttgaagggaaagagggatttgactcattaaa

SEQ ID NO: 197822 - DNA, 75 bp, Artificial Sequence
  Synthetic
aaatatttatttgtgataacgacccaaatatagcagaaatgagaaaactttcatttttagctagacatttagcat

SEQ ID NO: 197823 - DNA, 75 bp, Artificial Sequence
  Synthetic
gcatccaaaactctccttcccgaatggatcaggatgccttcttttttgagagggatcctgaggccgaaggagagg

SEQ ID NO: 197824 - DNA, 75 bp, Artificial Sequence
  Synthetic
agatgtcatcggactcctcgacgtcgtcctatcctacaagcccaccgaaattggagaagacagaagctggctcca

SEQ ID NO: 197825 - DNA, 75 bp, Artificial Sequence
  Synthetic
acaagaataactgatgtcattaccaacccaagtccagagcttgaagatgccgttctacaaaggaataaaagacgg

SEQ ID NO: 197826 - DNA, 75 bp, Artificial Sequence
  Synthetic
tacggatgaagacagaaagatggctgagaactttaataagagggaagaagaccaagttgagggatttccagaaga

SEQ ID NO: 197827 - DNA, 75 bp, Artificial Sequence
  Synthetic
agcagtgacatccagagttcctgttacacaaacctataagcaaaaaaagactcacgtctatgaagaaatcacaag

SEQ ID NO: 197828 - DNA, 75 bp, Artificial Sequence
  Synthetic
tactggagagatgtcagcttaatagtgttgaaaacatctaacccagcctctacagaaatgtatttgatatcaaaa

SEQ ID NO: 197829 - DNA, 75 bp, Artificial Sequence
  Synthetic
accatcagtcttcacaaaagggaaagacaataaagtcaagaagacaaggtttgatccctctatggaagctctagg

SEQ ID NO: 197830 - DNA, 75 bp, Artificial Sequence
  Synthetic
acacaaacctataagcaaaaaaagactcacgtctatgaagaaatcacaagatatttcggtgccttgagagaggtt

SEQ ID NO: 197831 - DNA, 75 bp, Artificial Sequence
  Synthetic
tgagatggccaagttgttagtaagtcttggtgtaatgaaatcacaacatgaatttgaattatctaggagtgcaag

SEQ ID NO: 197832 - DNA, 75 bp, Artificial Sequence
  Synthetic
ctaaattttattatttaattaatttaaagagatgaattaataagataaaaaacccccttaaccgaatcataaaaa

SEQ ID NO: 197833 - DNA, 75 bp, Artificial Sequence
  Synthetic
gacaaaccaagaggttaaaaatgtaatggaactatttgaggaagacatagattcactaactaactaaacataaat

SEQ ID NO: 197834 - DNA, 75 bp, Artificial Sequence
  Synthetic
tggaagctctaggaagtcaggagttcaagcctgatttgataagagaggatgaactaagagatgacatcagaaacc

SEQ ID NO: 197835 - DNA, 75 bp, Artificial Sequence
  Synthetic
gagaaagaaaatggctgaaacatacaggttccccagattctcacacgaagaaaatgggacagtagaacctctccc

SEQ ID NO: 197836 - DNA, 75 bp, Artificial Sequence
  Synthetic
actaaacataaatccacaatttcaaccagcaatcaaaatcaatatctagagctaactcaaaaagccccctcaaaa

SEQ ID NO: 197837 - DNA, 75 bp, Artificial Sequence
  Synthetic
cttaaccgaatcataaaaacatattaagaaaaaccaaaaaacgacaagagtattaataatatatcgatatttctt

SEQ ID NO: 197838 - DNA, 75 bp, Artificial Sequence
  Synthetic
gtgagagctagtgttagaagaggaggattatcatatagtatcctaagaagacttataaattatgatctattgcaa

SEQ ID NO: 197839 - DNA, 75 bp, Artificial Sequence
  Synthetic
gattatcatatagtatcctaagaagacttataaattatgatctattgcaatacgagaccttaacaaggacactca

SEQ ID NO: 197840 - DNA, 75 bp, Artificial Sequence
  Synthetic
atcagaatagtcaaggtaggagatcctccaaaacatggagtcaggtatcttgatgtgctgctattgggattcttc

SEQ ID NO: 197841 - DNA, 75 bp, Artificial Sequence
  Synthetic
ttcttagcccactcattggatacagataaacaacactctcaaagaggaggatttttagtatcactccttgcaatg

SEQ ID NO: 197842 - DNA, 75 bp, Artificial Sequence
  Synthetic
tgaacacatccaggtcagatctaactacattagagaagaacattcagattgtaggaaattacataagagatgcag

SEQ ID NO: 197843 - DNA, 75 bp, Artificial Sequence
  Synthetic
ggaacaaaaacaaaagtacacactaaaaccaaaaaaggaagaaagccagacataaaaactgaggcaagaacaaaa

SEQ ID NO: 197844 - DNA, 75 bp, Artificial Sequence
  Synthetic
cactcctcaacaatgacacccattagctctaaatcgcaccatcaatcaaacacagatcaattcgatacaatcagt

SEQ ID NO: 197845 - DNA, 75 bp, Artificial Sequence
  Synthetic
cacagatcaattcgatacaatcagttcaaataagaaaaacgtagggacaaagtcttccactaacaccaaagaaga

SEQ ID NO: 197846 - DNA, 75 bp, Artificial Sequence
  Synthetic
aaaaagaaaaagacaagaccacaaacaagaaatagaggaaaaacaaaaacaagaacaaaaagaggaacaaaaaca

SEQ ID NO: 197847 - DNA, 75 bp, Artificial Sequence
  Synthetic
gaaatatggggatatgtaatacgcataattaaagacacatcacatgcagtcctaaaagtactgtccaatgcatta

SEQ ID NO: 197848 - DNA, 75 bp, Artificial Sequence
  Synthetic
ttcaaatgtaggggttataatcaatgagggcaaattacttaaaatagcaggatcttatgaatctagatacatagt

SEQ ID NO: 197849 - DNA, 75 bp, Artificial Sequence
  Synthetic
aaacaagatcagagagaacacagaacccagaactccacaaatcaacaagtggagacagctccaacctcgaagacc

SEQ ID NO: 197850 - DNA, 75 bp, Artificial Sequence
  Synthetic
ttctaagtacaattaaaaaagataaatcagatatatatgacatcatttacactgaacaagttaaaggaactgtga

SEQ ID NO: 197851 - DNA, 75 bp, Artificial Sequence
  Synthetic
ttgcatccacatgtacatgcggaacaaacagaataccagtgaatcaagatcgctcaaaaggagtcacatttttga

SEQ ID NO: 197852 - DNA, 75 bp, Artificial Sequence
  Synthetic
tgatatacagagcttcatctatatcttataatattgaaggagaagaatggcatgtcgcaatcccaaattacataa

SEQ ID NO: 197853 - DNA, 75 bp, Artificial Sequence
  Synthetic
gttggaggatggcacaacaaagagagtactcagataatcattataataattgtgtgtatacttataataatcata

SEQ ID NO: 197854 - DNA, 75 bp, Artificial Sequence
  Synthetic
taactcaactaataactcacctattaatgcttatactctggagtcaagaatgaagaacccctacatgggcaacca

SEQ ID NO: 197855 - DNA, 75 bp, Artificial Sequence
  Synthetic
acaattagttcatattggtctacaacccgaaatgataactccacggtaaatacacacattaacacaccagcagga

SEQ ID NO: 197856 - DNA, 75 bp, Artificial Sequence
  Synthetic
tatacatagtgtgacttataggttcttgactaaagaaataaaaatattgatgaaaattctaggagcagtcaaatt

SEQ ID NO: 197857 - DNA, 75 bp, Artificial Sequence
  Synthetic
atcacaattgccaaggtcccaaaaactcttgcagatcttgcattaccgaactcaatatcagtaaatctgctggtt

SEQ ID NO: 197858 - DNA, 75 bp, Artificial Sequence
  Synthetic
tctgtggatccggatccttaccaattggcatagccaagtattacggcacagatcaagaattattaaaagcctgca

SEQ ID NO: 197859 - DNA, 75 bp, Artificial Sequence
  Synthetic
aacccctattgagcaacaaccctaatatctcattattacctggaccaagtctactttctggatcttccacaattt

SEQ ID NO: 197860 - DNA, 75 bp, Artificial Sequence
  Synthetic
tcaggttttacaattaggttacatatctttaaattcagatatgtatcctgatttaaacccggtaatttctcatac

SEQ ID NO: 197861 - DNA, 75 bp, Artificial Sequence
  Synthetic
ggtcttcacaggagacacagttgaaggcattggtgcagtgatgaggtcacaacaaagcttagtatctcttatggt

SEQ ID NO: 197862 - DNA, 75 bp, Artificial Sequence
  Synthetic
tagtatttgacatattagatctcaaaggaaagaccaaatctcatcgatacaaaaatgaagatataacttttgacc

SEQ ID NO: 197863 - DNA, 75 bp, Artificial Sequence
  Synthetic
aaaacaacaacacaaaaaaagaaaaggacaagaccacaaacaagaacaaaagcaaaaacaaaaacaagaacaaaa

SEQ ID NO: 197864 - DNA, 75 bp, Artificial Sequence
  Synthetic
tgtcccaatgttaatcagagtgtttgcaatgatgctcttaagataacttggctaaagaaaagacaagttgtcaat

SEQ ID NO: 197865 - DNA, 75 bp, Artificial Sequence
  Synthetic
agatgaagctaatattctctctcgggcttgtaggtggaataagttttcatgtacatgcaacaggcacattatcca

SEQ ID NO: 197866 - DNA, 75 bp, Artificial Sequence
  Synthetic
aagactcaaaaatggaaaattagaggcagcatacactactacatcgtgtatcactcatttcggaaagggctactg

SEQ ID NO: 197867 - DNA, 75 bp, Artificial Sequence
  Synthetic
atatactagatcttcaggttggcactccaacttgcaaataggatcactggatatcaacaaacccatgaccattaa

SEQ ID NO: 197868 - DNA, 75 bp, Artificial Sequence
  Synthetic
caacacaaaaaaagaaaaagacaagaccacaaacaagaaaaagaggaaaaacaaaaacaagaacaaaaagaggaa

SEQ ID NO: 197869 - DNA, 75 bp, Artificial Sequence
  Synthetic
caaaaaaggaagaaagccagacataaaaactgaggcaagaacaaaaatccaaacaaagacagaatttaaatttaa

SEQ ID NO: 197870 - DNA, 75 bp, Artificial Sequence
  Synthetic
cacatcttgagcaggtcagggcctaagactatatcaattatgttaaaaccagatataatatataaaaatttaaaa

SEQ ID NO: 197871 - DNA, 75 bp, Artificial Sequence
  Synthetic
aattcctcagacatcttatatccagaatgtcacttaaattctccgattgttaaaagcaagattgctcaacttcat

SEQ ID NO: 197872 - DNA, 75 bp, Artificial Sequence
  Synthetic
ccttaaacaagaaattaaggatattgatcgttacacttttgaaccttatccgattttctcattagagctactcag

SEQ ID NO: 197873 - DNA, 75 bp, Artificial Sequence
  Synthetic
gaacacgacgcaaccgcaaatgaagaaggaaccagcaacacatcagttgatgagatggccaagctgttagtaagt

SEQ ID NO: 197874 - DNA, 75 bp, Artificial Sequence
  Synthetic
aaatatatggttacccttttagttaaaataccaattttatcagaaataccaggcgtattgatatacagagcttca

SEQ ID NO: 197875 - DNA, 75 bp, Artificial Sequence
  Synthetic
tcatgcaatcttctgtacaattataataaacggatatagagaaagacacggtggtcaatggccgccatgtgaatt

SEQ ID NO: 197876 - DNA, 75 bp, Artificial Sequence
  Synthetic
aagggagcttttatgagacatgttttgactgagctacacacaattttaataaaagataatatatacacagattca

SEQ ID NO: 197877 - DNA, 75 bp, Artificial Sequence
  Synthetic
ccctgcactcactcaaactagtcattgaaaacagtcctctaagcagagtagagaagaaggcttacatcaaatctc

SEQ ID NO: 197878 - DNA, 75 bp, Artificial Sequence
  Synthetic
gagaaattgacctactaaagagactgactacattatctgtctcaggcgttccaagatccaactcagtttacaata

SEQ ID NO: 197879 - DNA, 75 bp, Artificial Sequence
  Synthetic
ggtcaaagatgtaatgagatattcgggtttaaaactttttttaactggatgcaccctattctagaaaaaagtaca

SEQ ID NO: 197880 - DNA, 75 bp, Artificial Sequence
  Synthetic
gtatcaacagaacaaaaaggaatcctccccgtcctagacgatgatggagaaaagaagctcaacttcatggtacac

SEQ ID NO: 197881 - DNA, 75 bp, Artificial Sequence
  Synthetic
ccagttatgctccttgcccactgtgaatgagactacagattactcgagtgaaggtatagaagacttagtatttga

SEQ ID NO: 197882 - DNA, 75 bp, Artificial Sequence
  Synthetic
atgacagtatcctccgtgaacgaaagtgccaaaacaatcaaagagacaatcacagaattaatcagacaagaagtg

SEQ ID NO: 197883 - DNA, 75 bp, Artificial Sequence
  Synthetic
gtggaataagtttccatgtacatgcaacaggcacattatccaagactctaatgagccaacttgcatggaaaaaag

SEQ ID NO: 197884 - DNA, 75 bp, Artificial Sequence
  Synthetic
ggaaaatcaggaagatataagtccacactcctcaacaatgacacccattagctctaaatcgcaccattaatcaaa

SEQ ID NO: 197885 - DNA, 75 bp, Artificial Sequence
  Synthetic
tcaaataagaaaaacgtagggacaaagtcctccactaacatcaaagaagataagagtctcaaaaagcccagccaa

SEQ ID NO: 197886 - DNA, 75 bp, Artificial Sequence
  Synthetic
ctctattagtgcaatccatcttgcagctgttaaagttggtgtcagagtgtcagcaatggtccaaggagacaatca

SEQ ID NO: 197887 - DNA, 75 bp, Artificial Sequence
  Synthetic
caagaacaaaagcaaaaacaaaaacaagaacaaaaagaggagcaaaaacaaaagtacacaccaaaaccaaaaaag

SEQ ID NO: 197888 - DNA, 75 bp, Artificial Sequence
  Synthetic
aaacgaatatattatgatgggaaaatcctcccacagtgcctcaaagctttaacaagatgtgtattttggtcagag

SEQ ID NO: 197889 - DNA, 75 bp, Artificial Sequence
  Synthetic
cccctgatgcattcaatgttgctacaaccacactgtacgcaaatacatcgcgtgttaatcctaccataatgtact

SEQ ID NO: 197890 - DNA, 75 bp, Artificial Sequence
  Synthetic
ctctttttaaaacttgccaacaggtatgtatatcattaggaatgaccattaatcctactattacgtcaactataa

SEQ ID NO: 197891 - DNA, 75 bp, Artificial Sequence
  Synthetic
ccagctaatataggagggttcaactatatgtctacagctagatgttttgtcagaaatataggtgatccagcagtt

SEQ ID NO: 197892 - DNA, 75 bp, Artificial Sequence
  Synthetic
agataacagtataataaatatcaccaaatacaaaatcagaaatggaggtttatcgccccggcagatcaaaatcag

SEQ ID NO: 197893 - DNA, 75 bp, Artificial Sequence
  Synthetic
tgcagtcaatgttgctacaaccacactgtacgcaaatacatcacgtgttaatcctaccataatgtactcaaatac

SEQ ID NO: 197894 - DNA, 75 bp, Artificial Sequence
  Synthetic
cacttacaggtgtaagagaagctatagctgggatgcttgatacaacaaaatctctagtaagagctagtgttagaa

SEQ ID NO: 197895 - DNA, 75 bp, Artificial Sequence
  Synthetic
atcaaatatgatatgagatggatgcaaaagaataagtcggggaatcatttagatgtttcagattctcataatttt

SEQ ID NO: 197896 - DNA, 75 bp, Artificial Sequence
  Synthetic
aagatggaatatgtcttcagctggacgactcgataagaggtcatcaaaaataacatataagggggaagaattatg

SEQ ID NO: 197897 - DNA, 75 bp, Artificial Sequence
  Synthetic
tacacttacatttgaataataaatgctgtatcatagaatctcctcaagaattgaatattcctcctagatctacat

SEQ ID NO: 197898 - DNA, 75 bp, Artificial Sequence
  Synthetic
atcctccgtgaacgagagtgccaaaacaatcaaagagacaatcacagaattaatcagacaagaagtgatatcaag

SEQ ID NO: 197899 - DNA, 75 bp, Artificial Sequence
  Synthetic
aaacctatgatattacacttacatttgaataataaatgctgtatcatagaatctcctcaagaactgaacattcct

SEQ ID NO: 197900 - DNA, 75 bp, Artificial Sequence
  Synthetic
aacccctactgagcaacaaccccaatatctcattattacctggaccaagtctactttctggatctaccacaattt

SEQ ID NO: 197901 - DNA, 75 bp, Artificial Sequence
  Synthetic
agggatgaaatatggggatatgtaatacgcataattaaagacacatcacatgcagtcttaaaagtactgtccaat

SEQ ID NO: 197902 - DNA, 75 bp, Artificial Sequence
  Synthetic
ataatcccatattacatgagaaattgatcaaaaatatgaataagtgcaattcaaatgggtattgggatgaaagga

SEQ ID NO: 197903 - DNA, 75 bp, Artificial Sequence
  Synthetic
gtaagaggtatagggataccagaagtcttagaggactgggatcctgatgctgatagtatgctgctagataatata

SEQ ID NO: 197904 - DNA, 75 bp, Artificial Sequence
  Synthetic
ggaatctttatacataatccaagaggaggaatagaaggttattgtcagaaattatggacactgatctctattagt

SEQ ID NO: 197905 - DNA, 75 bp, Artificial Sequence
  Synthetic
ctaccttttgatgggcgatatttatcacaccaattgagacttttcgggattaatagcaccagttgtttgaaagca

SEQ ID NO: 197906 - DNA, 75 bp, Artificial Sequence
  Synthetic
ttacgtcaactataagagatcaatattttaaagggaaaaattggttaagatgtgcaatattgattccagctaata

SEQ ID NO: 197907 - DNA, 75 bp, Artificial Sequence
  Synthetic
atctaaagaggatagtatcaagatagaaaaatggattttagttgagaaagccaaagttcatgattggatagttag

SEQ ID NO: 197908 - DNA, 75 bp, Artificial Sequence
  Synthetic
catttccagatatgaaatttgagtcaagactccaactaggtatagtatcaatatcctctcgtgaaattaaaaatc

SEQ ID NO: 197909 - DNA, 75 bp, Artificial Sequence
  Synthetic
caacaggtatgtatatcattaggaatgaccattaatcctactattacgtcaactataagagatcaatattttaaa

SEQ ID NO: 197910 - DNA, 75 bp, Artificial Sequence
  Synthetic
ctatacaatgatcttatatcttctaaattttattatttaattagtttaaagagatgaattaataagataaaaaac

SEQ ID NO: 197911 - DNA, 75 bp, Artificial Sequence
  Synthetic
gacatttgatcttagttaaaacctttataatggctgggctactaagtacttttgacacattcagctccaggagga

SEQ ID NO: 197912 - DNA, 75 bp, Artificial Sequence
  Synthetic
atgagaaattgatcaaaaatatgaataagtgcaattcaaatgggtattgggatgaaaggaaaaaatctaaacatg

SEQ ID NO: 197913 - DNA, 75 bp, Artificial Sequence
  Synthetic
atacatctgattctatacaatgatcttatatcttctaaattttattatttaattagtttaaagagatgaattaat

SEQ ID NO: 197914 - DNA, 75 bp, Artificial Sequence
  Synthetic
acaatcacgattcatggtgcagaagaactcgaagaagagacaaatgatgaagacatcattgatatagaaaacaag

SEQ ID NO: 197915 - DNA, 75 bp, Artificial Sequence
  Synthetic
ggacaagtcacagacatttgatcttagttaaaacttttataatggctgggctactaagtacttttgacacattca

SEQ ID NO: 197916 - DNA, 75 bp, Artificial Sequence
  Synthetic
aaggataatatagaatatgagtatatgtgttcagtagaattggcaataggattgaggcaaaaaatgtggtttcat

SEQ ID NO: 197917 - DNA, 75 bp, Artificial Sequence
  Synthetic
gctgttaaagttggtgtcagagtgtcagcaatggtccaaggagataatcaagccatagcagtgacatccagagtt

SEQ ID NO: 197918 - DNA, 75 bp, Artificial Sequence
  Synthetic
agttatatctcactacaaacggtgtcaatgctgatgtcaagtatgtgatatacagtatagagagagatcctaaaa

SEQ ID NO: 197919 - DNA, 75 bp, Artificial Sequence
  Synthetic
aaaagactcacgtctatgaagaaatcacaagatatttcggtgccttgagagaggttatgtttgatattggacatg

SEQ ID NO: 197920 - DNA, 75 bp, Artificial Sequence
  Synthetic
aagaacgaagagccagcagccgctcaaaagaacaaccacaaccacagaaaaacaaaatacacaacaaacaatgca

SEQ ID NO: 197921 - DNA, 75 bp, Artificial Sequence
  Synthetic
aaaagaacaaccacaaccacagaaaaacaaaatacacaacaaacaatgcaaacaacaacacaaaaagcccaccaa

SEQ ID NO: 197922 - DNA, 75 bp, Artificial Sequence
  Synthetic
aatagttcaagtttggatagtgttggttaaggccataacaagtagtgctggtctaaggaaaggattcttcaatag

SEQ ID NO: 197923 - DNA, 75 bp, Artificial Sequence
  Synthetic
caggagacacagttgaaggcattggtgcagtgatgaggtcacaacaaagcttagtatctcttatggtagagactc

SEQ ID NO: 197924 - DNA, 75 bp, Artificial Sequence
  Synthetic
tatagaatatgaatatatgtgttcagtagaattggcaataggattgaggcaaaaaatgtggtttcatctaactta

SEQ ID NO: 197925 - DNA, 75 bp, Artificial Sequence
  Synthetic
caagaggtcaaaaatgtaatggagctattcgaggaagacatagattcactaactaactaaacataaatctacaat

SEQ ID NO: 197926 - DNA, 75 bp, Artificial Sequence
  Synthetic
tattcgaggaagacatagattcactaactaactaaacataaatctacaatttcaaccagcaatcaaaatcaatat

SEQ ID NO: 197927 - DNA, 75 bp, Artificial Sequence
  Synthetic
gctctggaggaagaactaggtgtgacagacacagcaaaagagagactgagacaccatctaacaaacctttcagga

SEQ ID NO: 197928 - DNA, 75 bp, Artificial Sequence
  Synthetic
atggtgcagaagaactcgaagaagagacaaatgatgaagacatcattgatatagaaaacaagattgcacgaaggc

SEQ ID NO: 197929 - DNA, 75 bp, Artificial Sequence
  Synthetic
ataattagagcaactagtatatgcacagctatgactattgcagacacaatgtctcaattagacagagacaatctc

SEQ ID NO: 197930 - DNA, 75 bp, Artificial Sequence
  Synthetic
tggacagtagaagccagatcaaaagtaagaaaaacttagggtgaatgacaattcacagatcagctcaaccagaca

SEQ ID NO: 197931 - DNA, 75 bp, Artificial Sequence
  Synthetic
aaattgcaccaagattaggtacagactggacaaaacaattaagtctgtatctaagatactggagagatgtcagct

SEQ ID NO: 197932 - DNA, 75 bp, Artificial Sequence
  Synthetic
agcaggatcttatgaatctagatacatagtgttaagcctggtaccttccattgacttacaagatggatgtggaac

SEQ ID NO: 197933 - DNA, 75 bp, Artificial Sequence
  Synthetic
agtatctagaacttacttttttagatgatcctatattaagatatagtcaattgacaggtttagttattaagatat

SEQ ID NO: 197934 - DNA, 75 bp, Artificial Sequence
  Synthetic
gtctccattagacctgtagacatttctttaaatcttgcatctgccacaaatttcctagaagaatccaagacagag

SEQ ID NO: 197935 - DNA, 75 bp, Artificial Sequence
  Synthetic
attaaatatttatccttcagaagtggcactggtagggaagaaattgaataatgtcacgagtttatgtcaaagggt

SEQ ID NO: 197936 - DNA, 75 bp, Artificial Sequence
  Synthetic
gatcatttccagatatgaaatttgagtcaagactccaattaggtatagtatcaatatcctctcgtgaaattaaaa

SEQ ID NO: 197937 - DNA, 75 bp, Artificial Sequence
  Synthetic
gttccaccgtcaaagaacgaagagccagcagccgctcaaaagaacaaccacaaccacagaaaaacaaaatacaca

SEQ ID NO: 197938 - DNA, 75 bp, Artificial Sequence
  Synthetic
caaccacagaaaaacaaaatacacaacaaacaatgcaaacaacaacacaaaaagcccaccaactcctgaacacga

SEQ ID NO: 197939 - DNA, 75 bp, Artificial Sequence
  Synthetic
acaaacaatgcaaacaacaacacaaaaagcccaccaactcctgaacacgacgcaaccgcaaatgaagaaggaacc

SEQ ID NO: 197940 - DNA, 75 bp, Artificial Sequence
  Synthetic
atatcactaatatcgatacatctgactccatacaatgatcttatatcttctaaattttattatttaattagttta

SEQ ID NO: 197941 - DNA, 75 bp, Artificial Sequence
  Synthetic
aagggacaagtcacagacatttgatcttagtataaatttttataatggccgggctactaagtacttttgacacat

SEQ ID NO: 197942 - DNA, 75 bp, Artificial Sequence
  Synthetic
attctagaaaaaagtacaatttatgtaggagatccttactgtccagtatctgatagaatgcataaagaactccaa

SEQ ID NO: 197943 - DNA, 75 bp, Artificial Sequence
  Synthetic
aagataaaaaatccccttaaccgaatcataaaaacatattaagaaaaaccaaaaaacgacaagagtattaataat

SEQ ID NO: 197944 - DNA, 75 bp, Artificial Sequence
  Synthetic
catagattcactaactaactaaacataaatctacaatttcaaccagcaatcaaaatcaatatctagagctaactc

SEQ ID NO: 197945 - DNA, 75 bp, Artificial Sequence
  Synthetic
aaaaagcaatcccacacatcagaatagttaaggtaggagatcctccaaaacatggagtcaggtatcttgatgtgc

SEQ ID NO: 197946 - DNA, 75 bp, Artificial Sequence
  Synthetic
catgaacaccatcaagtatggtgtagaaacgaagatggccgccctgacactatcaaatctgagaccagatataaa

SEQ ID NO: 197947 - DNA, 75 bp, Artificial Sequence
  Synthetic
caatgggcgttgctgtggtacaaaacaaagctatgcaacagtatgtaactggaagaacatatttggacatggaaa

SEQ ID NO: 197948 - DNA, 75 bp, Artificial Sequence
  Synthetic
agtgctctggaggaagaactaggtgtgacagatacagcaaaagagagactaagacaccatctgacaaacctttca

SEQ ID NO: 197949 - DNA, 75 bp, Artificial Sequence
  Synthetic
ttacacttaaggcaggagtatcaacggaacaaaaaggaatccttcccgtcctagacgatgatggagaaaagaagc

SEQ ID NO: 197950 - DNA, 75 bp, Artificial Sequence
  Synthetic
ggaggggatggtgcgtaccacaagcctacaggtggtggagctatagaagtggcaattgatcatacagacataaca

SEQ ID NO: 197951 - DNA, 75 bp, Artificial Sequence
  Synthetic
ggacaagtcacagacatttgatcttagttaaaacctttataatggctgggctactaagtacttttgatacattca

SEQ ID NO: 197952 - DNA, 75 bp, Artificial Sequence
  Synthetic
tcaacttcatggtacacctaggaatcataagaagaaaagttgggaaaatatattcagttgaatactgcaaaaata

SEQ ID NO: 197953 - DNA, 75 bp, Artificial Sequence
  Synthetic
caatacaaaaagcccaccaactcctgaacacgacgcaacagcaaacgaagaaggaactggcaacacaccagttga

SEQ ID NO: 197954 - DNA, 75 bp, Artificial Sequence
  Synthetic
gggacaacaagaactggacaaatgacagcaatgaaagatggatgaatcactcgatcagcaaccacacaatcacga

SEQ ID NO: 197955 - DNA, 75 bp, Artificial Sequence
  Synthetic
ctacaggtggtggagctatagaagtggcaattgatcatacagacataacatttggagtcgaggacactgctgatc

SEQ ID NO: 197956 - DNA, 75 bp, Artificial Sequence
  Synthetic
cagcaatgaaagatggatgaatcactcgatcagcaaccacacaatcacgattcgtggtgcagaagaacttgaaga

SEQ ID NO: 197957 - DNA, 75 bp, Artificial Sequence
  Synthetic
agagacaaatgatgaagacatcactgatatagaaaacaagattgcacgaaggctggccgacagaaaacagagact

SEQ ID NO: 197958 - DNA, 75 bp, Artificial Sequence
  Synthetic
gatatagaaaacaagattgcacgaaggctggccgacagaaaacagagactaagccaggcaaacaataaacgagac

SEQ ID NO: 197959 - DNA, 75 bp, Artificial Sequence
  Synthetic
cagtgataccacaagatcaccatcagtcttcacaaaagggaaagataataaggtcaagaagacaaggtttgatcc

SEQ ID NO: 197960 - DNA, 75 bp, Artificial Sequence
  Synthetic
accagcagtgatgctgactatgagaatgatgatgatgctacagcggctgcagggataggaggaatttaacaggat

SEQ ID NO: 197961 - DNA, 75 bp, Artificial Sequence
  Synthetic
aggaagatataagtccacactcctcaacaatgacacccattagctctaaatcacaccattaatcaaatacagatc

SEQ ID NO: 197962 - DNA, 75 bp, Artificial Sequence
  Synthetic
tcatcggactccttgacgtcgtcttatcctacaagcccacagaaattggagaagacagaagctggctccatggta

SEQ ID NO: 197963 - DNA, 75 bp, Artificial Sequence
  Synthetic
tcatcgacaacccaaaagaaaacaagccatcatgcaaagccgacgataacaacaaagacagagcaatctcaacgt

SEQ ID NO: 197964 - DNA, 75 bp, Artificial Sequence
  Synthetic
ccaagatagagacaaagatgcaaagttcagagattctcctcttagtatactcgagcctgctattatcttcatcat

SEQ ID NO: 197965 - DNA, 75 bp, Artificial Sequence
  Synthetic
caaaaatccaaacaaagacagaattcgaattcaaaataaacaccaagatagagacaaaaatgcaaagttcagaga

SEQ ID NO: 197966 - DNA, 75 bp, Artificial Sequence
  Synthetic
aacaaagacagagcaatctcaacgtcgacccaagatcatagatcaagtgaggggagtggaatctctaggagaaca

SEQ ID NO: 197967 - DNA, 75 bp, Artificial Sequence
  Synthetic
caggagtatcaacggaacaaaaaggaatcctccccgtcctagacgatgatggagaaaagaagctcaacttcatgg

SEQ ID NO: 197968 - DNA, 75 bp, Artificial Sequence
  Synthetic
tcatcaaagtgggtccagcagtctccattagacctgtagacatttccttaaatcttgcatctgccacaaatttcc

SEQ ID NO: 197969 - DNA, 75 bp, Artificial Sequence
  Synthetic
taaccaaacaagatcagagagaacacagagttcagaactccacaaatcaacaagtgaaaatagctccaacctcga

SEQ ID NO: 197970 - DNA, 75 bp, Artificial Sequence
  Synthetic
agaccacaacaccaaaaccagcccaaaagttccaccgtcaaagaacgaagagtcagcagccactccaaagaacaa

SEQ ID NO: 197971 - DNA, 75 bp, Artificial Sequence
  Synthetic
aaagttccaccgtcaaagaacgaagagtcagcagccactccaaagaacaaccacaaccacagaaaaacaagatac

SEQ ID NO: 197972 - DNA, 75 bp, Artificial Sequence
  Synthetic
gtcttaattcgtatcaataattatttatctgataggccaaagattgttgtcgagactattccaataactcaaaat

SEQ ID NO: 197973 - DNA, 75 bp, Artificial Sequence
  Synthetic
acaacaaacaatgcaaacaacaacacaaaaagtccaccaactcccgaacacgacgcaaccgcaaatgaagaggaa

SEQ ID NO: 197974 - DNA, 75 bp, Artificial Sequence
  Synthetic
aacagcattcagctccaatcttgggactataggagaaaaaagtcttaccttgcaggcattatcatctctctactc

SEQ ID NO: 197975 - DNA, 75 bp, Artificial Sequence
  Synthetic
cccaagatcatagatcaagtgaggagagtagagtctctaggagaacaggtgagtcaaaaacagagacacatgcta

SEQ ID NO: 197976 - DNA, 75 bp, Artificial Sequence
  Synthetic
gagtcaaaaacagagacacatgctagaatccttgatcaacaaggtgtacacagggcctctaggcgaggaactagt

SEQ ID NO: 197977 - DNA, 75 bp, Artificial Sequence
  Synthetic
agaagaaaatagaacattacttaaacaaattcaagaggaaataaattcatccagggatcttcacaaacggttctc

SEQ ID NO: 197978 - DNA, 75 bp, Artificial Sequence
  Synthetic
ggaataccaaaaagaacagaactcactcatgatggccaatctatccacactccatataattacagatagaggcgg

SEQ ID NO: 197979 - DNA, 75 bp, Artificial Sequence
  Synthetic
ctcatgatggccaatctatccacactccatataattacagatagaggcgggaaaacgggaaatcccagtgatact

SEQ ID NO: 197980 - DNA, 75 bp, Artificial Sequence
  Synthetic
agaagtgtatactcggggatgtatcaaagtgccctgtgaccaaagtaataaacaatctagtaccaaagttcgcat

SEQ ID NO: 197981 - DNA, 75 bp, Artificial Sequence
  Synthetic
acaaggtcaccatcagtcttcacaaaagggaaagacaataaggtcaaaaagacaaggtttgacccctctatggaa

SEQ ID NO: 197982 - DNA, 75 bp, Artificial Sequence
  Synthetic
aagggaaagacaataaggtcaaaaagacaaggtttgacccctctatggaagctctaggaggtcaagagttcaagc

SEQ ID NO: 197983 - DNA, 75 bp, Artificial Sequence
  Synthetic
cactatatgagtgtcatgcaatcttctgcacaattataataaacggatatagagaaagacacggtggtcaatggc

SEQ ID NO: 197984 - DNA, 75 bp, Artificial Sequence
  Synthetic
ctgacttgataagagaggatgaactgagagatgacatcaaaaatccggtactagaagaaaacaacaatgagcctc

SEQ ID NO: 197985 - DNA, 75 bp, Artificial Sequence
  Synthetic
gagagatgacatcaaaaatccggtactagaagaaaacaacaatgagcctcaagcatccaatgcatcacgcctgat

SEQ ID NO: 197986 - DNA, 75 bp, Artificial Sequence
  Synthetic
agctctatcacctaggaaagcagcatgggattcagtatatcctgacagtaatttatattacaaggtccctgaatc

SEQ ID NO: 197987 - DNA, 75 bp, Artificial Sequence
  Synthetic
gacggccgacgaccatcaagcgtaaccaaacaagatcagagagaacacagaattcagaactccacaaatcaacaa

SEQ ID NO: 197988 - DNA, 75 bp, Artificial Sequence
  Synthetic
tccgtccactgaaaaacacactctgcactcactcaaactagttatcgaaaacagtcctctaagcagagtagagaa

SEQ ID NO: 197989 - DNA, 75 bp, Artificial Sequence
  Synthetic
tttgacctatactaattgtggtttaattggtataaatggaatagaactatatgccaacaaaagaggacgagatac

SEQ ID NO: 197990 - DNA, 75 bp, Artificial Sequence
  Synthetic
acagtcctctaagcagagtagagaagaaggcttacatcaaatccctttataagtgtcggacaaaccaagaggtta

SEQ ID NO: 197991 - DNA, 75 bp, Artificial Sequence
  Synthetic
gttccgccgttaaagaacgaagagccagcagccactcaaaagaacaaccacaaccacagaaaaacaaaatacaca

SEQ ID NO: 197992 - DNA, 75 bp, Artificial Sequence
  Synthetic
aatcaaaatcaatatccagagccaactcaaaaagctccctcaaaacaattaagaaaaacttagggtcaaagaaat

SEQ ID NO: 197993 - DNA, 75 bp, Artificial Sequence
  Synthetic
gataagtaagaaaaacttagggttaaagacaatccaaccaacccacaaggtaacaacatctgactatacaaacga

SEQ ID NO: 197994 - DNA, 75 bp, Artificial Sequence
  Synthetic
tggctgaaaaagggaaaacaattagttcatattggtctacaacccgaaatgataactccacggtaaatacacaca

SEQ ID NO: 197995 - DNA, 75 bp, Artificial Sequence
  Synthetic
ccatttcagtatgtgaatactctgttgatcttttcatgcgtgattggcaagagggtataccacttgaaatattta

SEQ ID NO: 197996 - DNA, 75 bp, Artificial Sequence
  Synthetic
acaaacatcatgacagtatcctccgtgaacgagagtgccaaaacaatcaaagagacaatcacagaattaatcaga

SEQ ID NO: 197997 - DNA, 75 bp, Artificial Sequence
  Synthetic
cttctgggggttaagggtatcaaaatcacaagttctacgacttagaggttatgaagagataaaaagggaagaaag

SEQ ID NO: 197998 - DNA, 75 bp, Artificial Sequence
  Synthetic
gtatttgtcaatggaacatcactaggtacaattacaattgctaaggtcccaaaaactcttgcagatcttgcatta

SEQ ID NO: 197999 - DNA, 75 bp, Artificial Sequence
  Synthetic
gtacaattacaattgctaaggtcccaaaaactcttgcagatcttgcattaccgaactcaatatcagtgaatctgc

SEQ ID NO: 198000 - DNA, 75 bp, Artificial Sequence
  Synthetic
gcacattatccaaaactctaatgagccaacttgcatggaaaaaagcagtttgctatcctttaatggatgtaaatc

SEQ ID NO: 198001 - DNA, 75 bp, Artificial Sequence
  Synthetic
cacatatgaatctagtcatctgggcagcttcagtagaaatcacaagtgtcgatgctgtgttccaacctgcaattc

SEQ ID NO: 198002 - DNA, 75 bp, Artificial Sequence
  Synthetic
agcttcagtagaaatcacaagtgtcgatgctgtgttccaacctgcaattccgaaagaatttcgctattacccaaa

SEQ ID NO: 198003 - DNA, 75 bp, Artificial Sequence
  Synthetic
tgttgttgcaaaaagcatcgggaaaatcaggaggatataagtctacactcctcaataatgacacccattagctct

SEQ ID NO: 198004 - DNA, 75 bp, Artificial Sequence
  Synthetic
atcaggaggatataagtctacactcctcaataatgacacccattagctctaaatcgtaccattaatcaaatacag

SEQ ID NO: 198005 - DNA, 75 bp, Artificial Sequence
  Synthetic
atcaattcgatacaatcagttcaaataagaaaaacgtagggacaaagtcctctaccaacatcaaggaagacaaga

SEQ ID NO: 198006 - DNA, 75 bp, Artificial Sequence
  Synthetic
taagaaaaacgtagggacaaagtcctctaccaacatcaaggaagacaagagtctcaaaaagctcagcctaagcag

SEQ ID NO: 198007 - DNA, 75 bp, Artificial Sequence
  Synthetic
agagaaaaacaacaacacaaagaaagaaaaggacaagatcacaaacaagaacaaaagcaaaaacaaaaacaagaa

SEQ ID NO: 198008 - DNA, 75 bp, Artificial Sequence
  Synthetic
gaaaaggacaagatcacaaacaagaacaaaagcaaaaacaaaaacaagaacaaaaaagggaagaaaaacaaaagt

SEQ ID NO: 198009 - DNA, 75 bp, Artificial Sequence
  Synthetic
acaactccgctccaaggcaataccaagtgtgtgataaaaagttgtcccaatgttaatcagagtgtttgcaatgat

SEQ ID NO: 198010 - DNA, 75 bp, Artificial Sequence
  Synthetic
atacacaaaaaccaaaaaagaaaaaaggccagagacaaaaacggaggcaagaacaaaaatttaaacaaaaacaga

SEQ ID NO: 198011 - DNA, 75 bp, Artificial Sequence
  Synthetic
aggccagagacaaaaacggaggcaagaacaaaaatttaaacaaaaacagaatttaaattcataataaacaccaag

SEQ ID NO: 198012 - DNA, 75 bp, Artificial Sequence
  Synthetic
atagagacaaaaatgcaaaaatcagagatcctcttcttagtatactcaagcttgctattatcttcatcattatgt

SEQ ID NO: 198013 - DNA, 75 bp, Artificial Sequence
  Synthetic
gatcctcaggttggcactccaacctgcaaataggatcaatagacatcaacaaacccatgaccatcaattgggcgc

SEQ ID NO: 198014 - DNA, 75 bp, Artificial Sequence
  Synthetic
ggagaattagatggcatcgttatatgacgaattgcaaaaagattacgtaggtccggaaccactagattcggtgcc

SEQ ID NO: 198015 - DNA, 75 bp, Artificial Sequence
  Synthetic
gacgaattgcaaaaagattacgtaggtccggaaccactagattcggtgccggtaacgattccatttttatactat

SEQ ID NO: 198016 - DNA, 75 bp, Artificial Sequence
  Synthetic
gacttctaatctaatttaacacccattcttatataagaacacagtataacttaattacaaaagacctcaaaaact

SEQ ID NO: 198017 - DNA, 75 bp, Artificial Sequence
  Synthetic
ctgatcattctctatctctactaaggatatttctagtctaaagttcaaaatgtcaagtgtcttaaagacatttga

SEQ ID NO: 198018 - DNA, 75 bp, Artificial Sequence
  Synthetic
gacacagcttaatccactcaacatataattgtaagattaataataatggaagattacagcaatctatctcttaaa

SEQ ID NO: 198019 - DNA, 75 bp, Artificial Sequence
  Synthetic
tcattttccgaactgccacaattcttggaatatgcacattgattgttctatgttcaagtattcttcatgaaataa

SEQ ID NO: 198020 - DNA, 75 bp, Artificial Sequence
  Synthetic
tggaatatgcacattgattgttctatgttcaagtattcttcatgaaataattcatcttgatgcttcctctggtct

SEQ ID NO: 198021 - DNA, 75 bp, Artificial Sequence
  Synthetic
caggagcaatctgatgacactccagtacctcttgagacaatcaaacctacaatcagggtatttgtcatcaatagt

SEQ ID NO: 198022 - DNA, 75 bp, Artificial Sequence
  Synthetic
catgaattctgatgattcacagcaaggcattattcagcctattgtagaatcattaaaatcattgattgctttggc

SEQ ID NO: 198023 - DNA, 75 bp, Artificial Sequence
  Synthetic
aatgatcctgccataaggtctagacttttattctttaatctacgaattattatgagtaacaccgcaagagagggg

SEQ ID NO: 198024 - DNA, 75 bp, Artificial Sequence
  Synthetic
taaccagattctgtacaatgttgcaataataattcctcttaaaattgacagtattgagaccgtaatactctctgc

SEQ ID NO: 198025 - DNA, 75 bp, Artificial Sequence
  Synthetic
catagagctggtgctctcctcagtctcttatcactaccttctgcagctatgagtaatcacatcaaattagcaatg

SEQ ID NO: 198026 - DNA, 75 bp, Artificial Sequence
  Synthetic
cattcaccagaagccagcatagatagagtagagataacagggtttgagaataattcattccgagttattccagat

SEQ ID NO: 198027 - DNA, 75 bp, Artificial Sequence
  Synthetic
gagtagagataacagggtttgagaataattcattccgagttattccagatgctcgatcaactatgtccagaggag

SEQ ID NO: 198028 - DNA, 75 bp, Artificial Sequence
  Synthetic
gctcgatcaactatgtccagaggagaggtgctggcctttgaagcattagctgaagacattcctgatacccttaat

SEQ ID NO: 198029 - DNA, 75 bp, Artificial Sequence
  Synthetic
tattcctagctttatcccctcagcaacatctccccacgggtgcactagaataccatcattttcactcagtaagac

SEQ ID NO: 198030 - DNA, 75 bp, Artificial Sequence
  Synthetic
caccaaactccatttgtaaataatgatgtagaagatgacatgtttgatgaaacagagaaattcttagatgtttgc

SEQ ID NO: 198031 - DNA, 75 bp, Artificial Sequence
  Synthetic
atgtagaagatgacatgtttgatgaaacagagaaattcttagatgtttgctacagtgtacttatgcaggcatgga

SEQ ID NO: 198032 - DNA, 75 bp, Artificial Sequence
  Synthetic
tagtaacatgcaagtgtatgactgctcctgatcaaccgccagtatcagtagcaaagcggatggctaaatatcaac

SEQ ID NO: 198033 - DNA, 75 bp, Artificial Sequence
  Synthetic
caatggtagtaaggcatttcatgacttatgagcttcaactttcacaatcaagatctttgctagcaaaccgctact

SEQ ID NO: 198034 - DNA, 75 bp, Artificial Sequence
  Synthetic
ctccagaaattaaaagctctcatgctacattatcagagtctaggacccatggccaagtacatggctctattagaa

SEQ ID NO: 198035 - DNA, 75 bp, Artificial Sequence
  Synthetic
tacattatcagagtctaggacccatggccaagtacatggctctattagaatcaccaaagctgatggattttgtcc

SEQ ID NO: 198036 - DNA, 75 bp, Artificial Sequence
  Synthetic
catctgaatatccattagtctatagttatgcaatgggtattggaactgtccttgatacaaatatgagaaactatg

SEQ ID NO: 198037 - DNA, 75 bp, Artificial Sequence
  Synthetic
tagacaaccaatatctgacccatttgctggagcgaatgacagagaaataggaggccaagcaaatgatacacctgt

SEQ ID NO: 198038 - DNA, 75 bp, Artificial Sequence
  Synthetic
atggtgaggacagaattgacaacgatcaggatcaagctatcagagagaacagaggagagcctggacaactaaaca

SEQ ID NO: 198039 - DNA, 75 bp, Artificial Sequence
  Synthetic
ccggattcaacaacaccaatcacaaagcagcatatacgtcttcaacctgctttaagaatactggaactcagaaga

SEQ ID NO: 198040 - DNA, 75 bp, Artificial Sequence
  Synthetic
accagacaaatgacaaccagcagagactcaatccctccataccgcaaagaacatcaggtatgagcagcgaagagt

SEQ ID NO: 198041 - DNA, 75 bp, Artificial Sequence
  Synthetic
tccaacattcaatgaatcagtacatccgtgcaatgcatgagcaatacagaggtccccaggatgatgataccaatg

SEQ ID NO: 198042 - DNA, 75 bp, Artificial Sequence
  Synthetic
atgccgcagatgggaatgacatttctcttgagctagttggggactttgattcctaattctcaatgtcatacaacc

SEQ ID NO: 198043 - DNA, 75 bp, Artificial Sequence
  Synthetic
atacgttttggctgtattagaatgttatagcattctgctgtgtttcccatatgaagcaagccttcaacaccgact

SEQ ID NO: 198044 - DNA, 75 bp, Artificial Sequence
  Synthetic
tcttgagctagttggggactttgattcctaattctcaatgtcatacaaccagatatacacatccacatcacctaa

SEQ ID NO: 198045 - DNA, 75 bp, Artificial Sequence
  Synthetic
agatacagctgccactcacacactcatccagataaatcaaaccagactcacatcattcgaaaacaattctcccat

SEQ ID NO: 198046 - DNA, 75 bp, Artificial Sequence
  Synthetic
atccagataaatcaaaccagactcacatcattcgaaaacaattctcccataatttaaagaaaaaagcataggccg

SEQ ID NO: 198047 - DNA, 75 bp, Artificial Sequence
  Synthetic
cctttatataatataacaatactattaagattatgatataggccagaatggcggcctcttctgagatactccttc

SEQ ID NO: 198048 - DNA, 75 bp, Artificial Sequence
  Synthetic
gacgggtttaaaatctggtgctcgttcgtggtctgacaacctccaaactagaatcacacaattatggccgaggaa

SEQ ID NO: 198049 - DNA, 75 bp, Artificial Sequence
  Synthetic
gcaaaggcagtatcccacctggtgtcacagctgttctaactagtgcagcagaggcaaaatccaaaccagtcgcca

SEQ ID NO: 198050 - DNA, 75 bp, Artificial Sequence
  Synthetic
ctggtccagtgaaacccaggcggaagaaagtgatcagcaatgctaccccatacactgttgcagacaatactccac

SEQ ID NO: 198051 - DNA, 75 bp, Artificial Sequence
  Synthetic
tacactgttgcagacaatactccacctgagaagctaccaatcaacactccaatacccaatccattacttccactg

SEQ ID NO: 198052 - DNA, 75 bp, Artificial Sequence
  Synthetic
ttacatttgagatgactttaatggtaagcgacatgttcgaggggaggatgaatgtcactgctctctgcactatta

SEQ ID NO: 198053 - DNA, 75 bp, Artificial Sequence
  Synthetic
gcccaagaccccaactttaagagggggggagctaatagagaaagagcaagaggcaaccataggagagaatggagt

SEQ ID NO: 198054 - DNA, 75 bp, Artificial Sequence
  Synthetic
attgcatgggtcggagatcaggtcaaagtcttcgagtggtgtaatcccaggtgtgccccagtcacggcctcagct

SEQ ID NO: 198055 - DNA, 75 bp, Artificial Sequence
  Synthetic
cgcaagttcacctgcacatgcggatcctgccccagcatctgcggagaatgtgagggagatcattgagctcttaaa

SEQ ID NO: 198056 - DNA, 75 bp, Artificial Sequence
  Synthetic
tgagggagatcattgagctcttaaaggggcttgatcttcgccttcagactgtagaagggaaggtagataaaattc

SEQ ID NO: 198057 - DNA, 75 bp, Artificial Sequence
  Synthetic
aaggcgagcgttgcaactgtggaaggtatgataacaacaattaaaatcatggatcccagcacaccaaccaatgtc

SEQ ID NO: 198058 - DNA, 75 bp, Artificial Sequence
  Synthetic
cctgtagaggagatcagaaagagcttacacaatgctccagtagtaattgccggtccaactagtggaggcttcaca

SEQ ID NO: 198059 - DNA, 75 bp, Artificial Sequence
  Synthetic
taatagaatgcggtcctgtcaagtaattgcggaagcaattcttgcaaatcatgcaggtactctaatgaaggaaaa

SEQ ID NO: 198060 - DNA, 75 bp, Artificial Sequence
  Synthetic
tggatgaactagctagacctacactctcatcaacaaaaaagatcacacgaaagcctgaatccaagaaagatttaa

SEQ ID NO: 198061 - DNA, 75 bp, Artificial Sequence
  Synthetic
ctgaccaagtcattgcttactatgagtcaaattggcataatatcagaaaaggcaaagagatatacgcgagataac

SEQ ID NO: 198062 - DNA, 75 bp, Artificial Sequence
  Synthetic
caggcacaaaactaaccttgatgcaacttgcaaatgattgcatttcgcgtccagataccaaaactgagttcgtga

SEQ ID NO: 198063 - DNA, 75 bp, Artificial Sequence
  Synthetic
ctaagattcaagcagcaaccacagaatcacagcttaatgaaatcaagcggtcaataatacgctctgcaatataaa

SEQ ID NO: 198064 - DNA, 75 bp, Artificial Sequence
  Synthetic
atcacagcttaatgaaatcaagcggtcaataatacgctctgcaatataaaataaggtgcaatcacataagagaca

SEQ ID NO: 198065 - DNA, 75 bp, Artificial Sequence
  Synthetic
tccaacatgcatccaatcaagatccagactctgtccatctaaaaatacacccacaattgttaataccaagaaaca

SEQ ID NO: 198066 - DNA, 75 bp, Artificial Sequence
  Synthetic
agactctgtccatctaaaaatacacccacaattgttaataccaagaaacaaccacagccgaaccatgctcaatca

SEQ ID NO: 198067 - DNA, 75 bp, Artificial Sequence
  Synthetic
aaagatccaaataacatcacacatcaatagaagactggacatgataaatttaataaaaaaggaaaagaagtcaag

SEQ ID NO: 198068 - DNA, 75 bp, Artificial Sequence
  Synthetic
taaaatttaaaggacataatagagaaaatctaggtccgaaagcttgcttcccggatagatcccaaaatcatagtc

SEQ ID NO: 198069 - DNA, 75 bp, Artificial Sequence
  Synthetic
gtcttactgcggatgtattaggtgaatgtactcaagcttcctgttcaaattctgctactaccatcatgagattaa

SEQ ID NO: 198070 - DNA, 75 bp, Artificial Sequence
  Synthetic
ccttaaacagatccgaattaggtatctaaatgagcctaattctcgccatacaccaataactttcatcaatacgta

SEQ ID NO: 198071 - DNA, 75 bp, Artificial Sequence
  Synthetic
tccattcgtcaactcacatatgatctaatatttccccaatattccataccaggtgaaacgataagtgggattttc

SEQ ID NO: 198072 - DNA, 75 bp, Artificial Sequence
  Synthetic
caccaataactttcatcaatacgtatggatttgtttatgctcgagacacttcagggggcattcacagtgagctta

SEQ ID NO: 198073 - DNA, 75 bp, Artificial Sequence
  Synthetic
gtattgttctgctcccttcacagctaggtggtcttaattacctcgcatgcagcagattatttaaccgcaatatcg

SEQ ID NO: 198074 - DNA, 75 bp, Artificial Sequence
  Synthetic
aggtggtcttaattacctcgcatgcagcagattatttaaccgcaatatcggagatcctcttggtacagctgtggc

SEQ ID NO: 198075 - DNA, 75 bp, Artificial Sequence
  Synthetic
cctggtccaaatattcagaatgcaaatctagtgctaagatctctgaatgaattctacgtgaaagtcaagaagaca

SEQ ID NO: 198076 - DNA, 75 bp, Artificial Sequence
  Synthetic
atctagtgctaagatctctgaatgaattctacgtgaaagtcaagaagacatcaagccagagagaggaggcagtgt

SEQ ID NO: 198077 - DNA, 75 bp, Artificial Sequence
  Synthetic
ttgaattagttaacattccaactttattgagagaacatgctctttgcaaacgcaaaatgttagtatgctccgcag

SEQ ID NO: 198078 - DNA, 75 bp, Artificial Sequence
  Synthetic
agaagttcctcaagaacccgtcaaagctacaagctggatttgagtatgtatacataccaacttttgtctccatta

SEQ ID NO: 198079 - DNA, 75 bp, Artificial Sequence
  Synthetic
ttcatttggaattaattctgagattgctatgcaaatctgaatcccccttaatgaaatcctacaatgcagacaaga

SEQ ID NO: 198080 - DNA, 75 bp, Artificial Sequence
  Synthetic
gctatgcaaatctgaatcccccttaatgaaatcctacaatgcagacaagacaggtcggggatgccttgcatcagt

SEQ ID NO: 198081 - DNA, 75 bp, Artificial Sequence
  Synthetic
aggaagaaacagatacaaggattttttgacaccacaaggaccattatgagacgatcatttgaaatcaaaccactc

SEQ ID NO: 198082 - DNA, 75 bp, Artificial Sequence
  Synthetic
ctggatccatgtatgtaacattctgaaaaacaaaagcatcaagcaacaaggcagagaatcatatttcatagctaa

SEQ ID NO: 198083 - DNA, 75 bp, Artificial Sequence
  Synthetic
aaaaacaaaagcatcaagcaacaaggcagagaatcatatttcatagctaagtgcatgagcatgcagctgcaggtg

SEQ ID NO: 198084 - DNA, 75 bp, Artificial Sequence
  Synthetic
tccattgcagatctttggggaccaacaatcataatcaaatcattgggtcacatccccaagactgcacttcctttt

SEQ ID NO: 198085 - DNA, 75 bp, Artificial Sequence
  Synthetic
gagattgtgatttttgtatgcagggtgatgacaaatttacttggttctttttacctatggggataattattgatg

SEQ ID NO: 198086 - DNA, 75 bp, Artificial Sequence
  Synthetic
tctgacaaaatcactgtggtcagttggatgtgagatagaatctgccaaattgatacttcaagaatctgatcttaa

SEQ ID NO: 198087 - DNA, 75 bp, Artificial Sequence
  Synthetic
gcatcaattccaaacttggaagccatcaactaaatgctccagcatctgagaatagaaccataatcaaatcatact

SEQ ID NO: 198088 - DNA, 75 bp, Artificial Sequence
  Synthetic
tcaactaaatgctccagcatctgagaatagaaccataatcaaatcatactactagtaactatacaataaccgaca

SEQ ID NO: 198089 - DNA, 75 bp, Artificial Sequence
  Synthetic
attttagtcaacagattatcaagatgttattataggtccgaactgatcaatctaacaaaaaaactaaacgttcca

SEQ ID NO: 198090 - DNA, 75 bp, Artificial Sequence
  Synthetic
tcaacaattaatgataacaggacttgggattattgagacctaccataacccacctataagaacttctacacaaga

SEQ ID NO: 198091 - DNA, 75 bp, Artificial Sequence
  Synthetic
gttattataggtccgaactgatcaatctaacaaaaaaactaaacgttccataataaatcaacattcaggtcaaaa

SEQ ID NO: 198092 - DNA, 75 bp, Artificial Sequence
  Synthetic
tattcaaccatgcatcacctacatccaatgatagtatgcatctttgttatgtacactggaattgtaggttcaggt

SEQ ID NO: 198093 - DNA, 75 bp, Artificial Sequence
  Synthetic
atggctgccttatatgtgaaagcaatggagaggttccccagatcactgttccctatactaatacatttgtatatg

SEQ ID NO: 198094 - DNA, 75 bp, Artificial Sequence
  Synthetic
gattgcacatctagattacctctcctaccaagctaaaattggaagtacagattactactcactcactgataaaat

SEQ ID NO: 198095 - DNA, 75 bp, Artificial Sequence
  Synthetic
ggtggtgctagctttattgttgttaaattgctacctaatcttcccccaaacaatggaacatgcaacattaccagt

SEQ ID NO: 198096 - DNA, 75 bp, Artificial Sequence
  Synthetic
aattgctacctaatcttcccccaaacaatggaacatgcaacattaccagtctagatgcatataatgttactctat

SEQ ID NO: 198097 - DNA, 75 bp, Artificial Sequence
  Synthetic
ttaaattactaacacccctaattgagaacctgagcaaaatctccgctgttacagataccaaaactcgccaagaac

SEQ ID NO: 198098 - DNA, 75 bp, Artificial Sequence
  Synthetic
gaacctgagcaaaatctccgctgttacagataccaaaactcgccaagaacgatttgcaggagtcgttattggact

SEQ ID NO: 198099 - DNA, 75 bp, Artificial Sequence
  Synthetic
ttttaaattaatggcatggaattttcttcttgagcttgcattccagatgtactacttaaggatatcatcttggac

SEQ ID NO: 198100 - DNA, 75 bp, Artificial Sequence
  Synthetic
tgctgcattaggagtagccacagccgcacaaataaccgcagctgtagcaatagtcaaagccaacgcaaatgctgc

SEQ ID NO: 198101 - DNA, 75 bp, Artificial Sequence
  Synthetic
caggatcacatcaatggagctattgttaatgggataacatctgcatcatgccgtgcccatgatgcactcattggg

SEQ ID NO: 198102 - DNA, 75 bp, Artificial Sequence
  Synthetic
ttaatgggataacatctgcatcatgccgtgcccatgatgcactcattgggtcaatattaaatctttatctcactg

SEQ ID NO: 198103 - DNA, 75 bp, Artificial Sequence
  Synthetic
agcttaccacaatatttcacaatcaaataacaaaccctgcgctgacaccgctctccatccaagctttaagaattc

SEQ ID NO: 198104 - DNA, 75 bp, Artificial Sequence
  Synthetic
tcctcggtagcaccttgccaattgtcattgagtccaaactcaaaacaaacctcaacacagcagagctgctcagct

SEQ ID NO: 198105 - DNA, 75 bp, Artificial Sequence
  Synthetic
cattgagtccaaactcaaaacaaacctcaacacagcagagctgctcagctccggattgttaactggtcaaataat

SEQ ID NO: 198106 - DNA, 75 bp, Artificial Sequence
  Synthetic
ttcaatttccccaatgtacatgcaaatgctaattcaaatcaatgttccgacatttataatgcaacccggtgcgaa

SEQ ID NO: 198107 - DNA, 75 bp, Artificial Sequence
  Synthetic
atgaatccttcgaacaattagaaacagatataattcttcattctactttaactgctccttatgataattcagaaa

SEQ ID NO: 198108 - DNA, 75 bp, Artificial Sequence
  Synthetic
catttataatgcaacccggtgcgaaggtaattgatctaattgctatttctgcaaaccataaattgcaagaagtag

SEQ ID NO: 198109 - DNA, 75 bp, Artificial Sequence
  Synthetic
agagtatgcaaatgaactacagaattatccagccaatgactgtgttgtgacaccgaactctgtattctgtagata

SEQ ID NO: 198110 - DNA, 75 bp, Artificial Sequence
  Synthetic
acacaaaagatacagactggtgatcatctttatttagctgaaggaagcggcgcttcaatgtcactcctagaactc

SEQ ID NO: 198111 - DNA, 75 bp, Artificial Sequence
  Synthetic
tttgcatttgccaatggtgtgctctatgctaactgcaaatctttgctatgtaagtgtgccgaccctccccatgtg

SEQ ID NO: 198112 - DNA, 75 bp, Artificial Sequence
  Synthetic
gtgttccatataaattgtggcaagctgatcttgctgatgatagcaacttgataaaagattttgtcccattatgga

SEQ ID NO: 198113 - DNA, 75 bp, Artificial Sequence
  Synthetic
ataaaagattttgtcccattatggaatggaaatggtgcagttacagacttatcaacaaaggatgcagttgcattc

SEQ ID NO: 198114 - DNA, 75 bp, Artificial Sequence
  Synthetic
tcatttaggatcacatctactttcaatgctacatacgtgacagacttctcaatgattaatgcaaatattgtacat

SEQ ID NO: 198115 - DNA, 75 bp, Artificial Sequence
  Synthetic
aatgattaatgcaaatattgtacatctaagtcctctagatttgtcaaaccaaattaattcaataaacaaatctct

SEQ ID NO: 198116 - DNA, 75 bp, Artificial Sequence
  Synthetic
taaaagtgctgaggattggattgcagatagcaactactttgctaatcaagccaggacagccaagacactttattc

SEQ ID NO: 198117 - DNA, 75 bp, Artificial Sequence
  Synthetic
ccaggacagccaagacactttattcattaagtgcaatagcattaatactatcagtgattactttggttgttgtgg

SEQ ID NO: 198118 - DNA, 75 bp, Artificial Sequence
  Synthetic
attaagtgcaatagcattaatactatcagtgattactttggttgttgtgggattgttgattgcctacatcatcaa

SEQ ID NO: 198119 - DNA, 75 bp, Artificial Sequence
  Synthetic
actagtctcccaaatccatcaattcagagcgctagctgctacaacaatgttccacagagaaaatcctgccttctt

SEQ ID NO: 198120 - DNA, 75 bp, Artificial Sequence
  Synthetic
ttatcctttaaacttaagtataatagtttaaaaattaacattaagcctccagataccaatgaatctgaatatatc

SEQ ID NO: 198121 - DNA, 75 bp, Artificial Sequence
  Synthetic
ggtgcagcagggaaagttagaactatcatcaaattaattctagaacgatctttaatgtatacagtccgaaattgg

SEQ ID NO: 198122 - DNA, 75 bp, Artificial Sequence
  Synthetic
ggtgtcgtaacgtctcgtgacactgggttcagttcaaaaatcgacttctactctaatttaacacccattcttata

SEQ ID NO: 198123 - DNA, 75 bp, Artificial Sequence
  Synthetic
ggttcagttcaaaaatcgacttctactctaatttaacacccattcttatataagaacacaatataacttaattac

SEQ ID NO: 198124 - DNA, 75 bp, Artificial Sequence
  Synthetic
agattaataataatggaagattacagcaatctatctcttaaatcaattcctaaaaggacatgtagaatcattttc

SEQ ID NO: 198125 - DNA, 75 bp, Artificial Sequence
  Synthetic
gcaatctatctcttaaatcaattcctaaaaggacatgtagaatcattttccgaactgccacaattcttggaatat

SEQ ID NO: 198126 - DNA, 75 bp, Artificial Sequence
  Synthetic
cgaactgccacaattcttggaatatgcacattgattgttctatgttccagtattcttcatgaaataatccatctt

SEQ ID NO: 198127 - DNA, 75 bp, Artificial Sequence
  Synthetic
ataatcaatcttaaaaatgaaatgactagtctcaaggcgagtgttgcaactgtggaaggtatgataacaacaatt

SEQ ID NO: 198128 - DNA, 75 bp, Artificial Sequence
  Synthetic
atatgcatactgggagcatgtccaacaccaactgtacacccggaaatctgcttctgcatgatgcagcatacatca

SEQ ID NO: 198129 - DNA, 75 bp, Artificial Sequence
  Synthetic
cttctgcatgatgcagcatacatcaatggaataaacaaatttcttgtacttaaatcatacaatgggacgcctaaa

SEQ ID NO: 198130 - DNA, 75 bp, Artificial Sequence
  Synthetic
gttacactcacaatgtaatacttggagattgcctcgattttacgacatctaatcagtatttagcaatggggataa

SEQ ID NO: 198131 - DNA, 75 bp, Artificial Sequence
  Synthetic
agattgcctcgattttacgacatctaatcagtatttagcaatggggataatacaacaatctgctgcggcatttcc

SEQ ID NO: 198132 - DNA, 75 bp, Artificial Sequence
  Synthetic
cataatcaaataacaaaccctgcgctgacaccactctccatccaagctttaagaatcctcctcggtagcaccttg

SEQ ID NO: 198133 - DNA, 75 bp, Artificial Sequence
  Synthetic
ccaattgtcattgagtccaaactcaacacaaacctcaacacagcagagctgctcagttccggactgttaactggt

SEQ ID NO: 198134 - DNA, 75 bp, Artificial Sequence
  Synthetic
gtagctacaagatctgagaaagaagattatgccacaactgacctagctgaactgagacttgctttctattattat

SEQ ID NO: 198135 - DNA, 75 bp, Artificial Sequence
  Synthetic
attatgccacaactgacctagctgaactgagacttgctttctattattataatgatacatttattgagagagtca

SEQ ID NO: 198136 - DNA, 75 bp, Artificial Sequence
  Synthetic
tatctcttccaaatacaacagggcaatgggccacaatcaatcctgcagttggaagcgggatctatcacctaggct

SEQ ID NO: 198137 - DNA, 75 bp, Artificial Sequence
  Synthetic
atgggccacaatcaatcctgcagttggaagcgggatctatcacctaggctttattttatttcctgtatatggtgg

SEQ ID NO: 198138 - DNA, 75 bp, Artificial Sequence
  Synthetic
tctcataaatgggactccttcctacaacgagcagtcctcacgctattttatcccaacacatcccaacataacctg

SEQ ID NO: 198139 - DNA, 75 bp, Artificial Sequence
  Synthetic
agcaaggtgtaatctagttatgtttaacaattctcaagtcatgatgggtgcagaaggtaggctctatgttattga

SEQ ID NO: 198140 - DNA, 75 bp, Artificial Sequence
  Synthetic
tcccaacacatcccaacataacctgtgccggaaactccagtgaacgggctgcagcagcacggggttcctatgtta

SEQ ID NO: 198141 - DNA, 75 bp, Artificial Sequence
  Synthetic
tccgttatcattcatacaggttgattcagagtgctattcttatttgcccattatctgacatgcaaacagcaaggt

SEQ ID NO: 198142 - DNA, 75 bp, Artificial Sequence
  Synthetic
aggctctatgttattgacaacaatttgtattattatcaacgtagttcctcttggtggtctgcatcacttttctac

SEQ ID NO: 198143 - DNA, 75 bp, Artificial Sequence
  Synthetic
aggatcaatacagatttctctaaaggaattcctcctatcattgaggctcaatgggtaccgtcctatcaagttccc

SEQ ID NO: 198144 - DNA, 75 bp, Artificial Sequence
  Synthetic
atgggtaccgtcctatcaagttccccgccctggagtcatgccatgtaatgcaacaagtttttgccctgctaattg

SEQ ID NO: 198145 - DNA, 75 bp, Artificial Sequence
  Synthetic
atgtggaggaactcccagctccagaaaatggttagagattgaccagttagcatcatttgatttggttcaagatgc

SEQ ID NO: 198146 - DNA, 75 bp, Artificial Sequence
  Synthetic
ctatcgatttgctggagcctttctaaaaaatgagtccaaccgaaccaatcccacattttacactgcatcagccaa

SEQ ID NO: 198147 - DNA, 75 bp, Artificial Sequence
  Synthetic
ttgataataatcgaaatgggctcatctcttttaggggagttccaaataataccatttctaagggaactaatacct

SEQ ID NO: 198148 - DNA, 75 bp, Artificial Sequence
  Synthetic
accatttctaagggaactaataccttaatactattgaatgaaaacttaagattcaataataattgaaaggatctc

SEQ ID NO: 198149 - DNA, 75 bp, Artificial Sequence
  Synthetic
taatactattgaatgaaaacttaagattcaataataattgaaaggatctctatcttatgcaatagttatatgttt

SEQ ID NO: 198150 - DNA, 75 bp, Artificial Sequence
  Synthetic
tggctgtattagaatgttatagcattctgctatgtttcccatatgaagcaaaccttcaacaccgacttaggttca

SEQ ID NO: 198151 - DNA, 75 bp, Artificial Sequence
  Synthetic
aaccttcaacaccgacttaggttcaattttctcatcatttactgttgtgatccaatcttactaaagttattctga

SEQ ID NO: 198152 - DNA, 75 bp, Artificial Sequence
  Synthetic
ttctgagatactccttcctgaagtccacttgaactcaccaatagtcaaacacaaactcatatactacttattact

SEQ ID NO: 198153 - DNA, 75 bp, Artificial Sequence
  Synthetic
tgtttgctacagtgtgcttatgcaggcatggatagtaacatgcaagtgtatgactgctcctgatcaaccaccagt

SEQ ID NO: 198154 - DNA, 75 bp, Artificial Sequence
  Synthetic
acaaactcatatactacttattactagggcacttcccgcatgatcttgacatctctgaaataagccctcttcaca

SEQ ID NO: 198155 - DNA, 75 bp, Artificial Sequence
  Synthetic
gcatggatagtaacatgcaagtgtatgactgctcctgatcaaccaccagtatcagtagcaaagatggctaaatat

SEQ ID NO: 198156 - DNA, 75 bp, Artificial Sequence
  Synthetic
ataatgattgggatcaaattgccagagaagaatccaatcttgctgaacgacttggagtagctaaatctgaattaa

SEQ ID NO: 198157 - DNA, 75 bp, Artificial Sequence
  Synthetic
ttctaagcttcaaccaatagaacaatggtacaagttgatcaatgcttcatgtaatactatatctgactcaattga

SEQ ID NO: 198158 - DNA, 75 bp, Artificial Sequence
  Synthetic
tggtacaagttgatcaatgcttcatgtaatactatatctgactcaattgatagatgtatggagaatatttctatt

SEQ ID NO: 198159 - DNA, 75 bp, Artificial Sequence
  Synthetic
aagcttactgggaaaaacaatctattctctcgatccagaggaactgcaggtgcaggtaaaaacagtaaaatcacc

SEQ ID NO: 198160 - DNA, 75 bp, Artificial Sequence
  Synthetic
tctctcgatccagaggaactgcaggtgcaggtaaaaacagtaaaatcaccctcaatgatatccaatctatttggg

SEQ ID NO: 198161 - DNA, 75 bp, Artificial Sequence
  Synthetic
aatcaaacaagtggcagcctaatgtatctttatggcttacaattaaataccaaatgcgacaacttataatgcatc

SEQ ID NO: 198162 - DNA, 75 bp, Artificial Sequence
  Synthetic
atctttatggcttacaattaaataccaaatgcgacaacttataatgcatcaaagttctcgtcagccgactgattt

SEQ ID NO: 198163 - DNA, 75 bp, Artificial Sequence
  Synthetic
agttcacattgttgacacacgatctggtctaatagttatcacccctgaacttgttatttgttttgatcggttgaa

SEQ ID NO: 198164 - DNA, 75 bp, Artificial Sequence
  Synthetic
gctgttgacaacaggacagcagaggacctcggcatgactgctgcagacaaagcagacctcactgcaaccatatca

SEQ ID NO: 198165 - DNA, 75 bp, Artificial Sequence
  Synthetic
aagctatccttgtcccaattacctaggggtagacaaccaatatctgacccatttgctggagcaaatgacagagaa

SEQ ID NO: 198166 - DNA, 75 bp, Artificial Sequence
  Synthetic
ttatctccactagggccaaggatcgatagattgttttccattgtagatgaattagcacaactattaggtgacact

SEQ ID NO: 198167 - DNA, 75 bp, Artificial Sequence
  Synthetic
atagattgttttccattgtagatgaattagcacaactattaggtgacactgtatataaagttattgcatctcttg

SEQ ID NO: 198168 - DNA, 75 bp, Artificial Sequence
  Synthetic
aatctttagtatatgggtgtctacaacttaaagatccagtagtggaattagcagggtcatttcattcctttatta

SEQ ID NO: 198169 - DNA, 75 bp, Artificial Sequence
  Synthetic
cacaagagattatagatatcctaattggttcaaaagcccttgataaggatgaatcaataactgttactacacaat

SEQ ID NO: 198170 - DNA, 75 bp, Artificial Sequence
  Synthetic
cagaggctcccaggatgatgatgccaatgatgccacagatgggaatgacatttctcttgagctagttggagattt

SEQ ID NO: 198171 - DNA, 75 bp, Artificial Sequence
  Synthetic
tgtctcatgagactctggggtcatcccactcttactgctgcgcaagctgcaggcaaagtgagagaatccatgtgt

SEQ ID NO: 198172 - DNA, 75 bp, Artificial Sequence
  Synthetic
gcaggtaagttgcttgatttccctacaataatgaaaactcttgcttttttccatacaattttaattaatggttac

SEQ ID NO: 198173 - DNA, 75 bp, Artificial Sequence
  Synthetic
caataatgaaaactcttgcttttttccatacaattttaattaatggttaccgtagaaagaaaaatggaatgtggc

SEQ ID NO: 198174 - DNA, 75 bp, Artificial Sequence
  Synthetic
tcagagatacagctgccactcacacactcatccagacaaatcaaactagactcacatcattcggaaacaattctc

SEQ ID NO: 198175 - DNA, 75 bp, Artificial Sequence
  Synthetic
actcatccagacaaatcaaactagactcacatcattcggaaacaattctctcataatttaaagaaaaaatcatag

SEQ ID NO: 198176 - DNA, 75 bp, Artificial Sequence
  Synthetic
ctccacttatacttcctaaaaatgcatcaaaaagcttaatagaatttcaacatgataatgctgaaatatcttacg

SEQ ID NO: 198177 - DNA, 75 bp, Artificial Sequence
  Synthetic
gccggacgggttagaaatccggtgcttgttcgtgatcagataacctccacaccagaatcatacaatcatggccga

SEQ ID NO: 198178 - DNA, 75 bp, Artificial Sequence
  Synthetic
tggatgagtgtatttcgtagaagtctaataaaacaacgacatcagagacatcatattcctatgcccaatccattt

SEQ ID NO: 198179 - DNA, 75 bp, Artificial Sequence
  Synthetic
ggtgaatacctccaagatgacacattttgtgcatcttactcattaaaagagaaagaaataaaaccagacggaagg

SEQ ID NO: 198180 - DNA, 75 bp, Artificial Sequence
  Synthetic
ccacctgagaagctaccgatcaacactccaatacccaatccattacttccactggcacgccctcacggaaagatg

SEQ ID NO: 198181 - DNA, 75 bp, Artificial Sequence
  Synthetic
actctaatgaaggaaaacggagttgtcttgaatcaattatcactgaccaaatcattgcttactatgagtcaaatt

SEQ ID NO: 198182 - DNA, 75 bp, Artificial Sequence
  Synthetic
tcaaggtttccacacaatcaagactgactctaaaaataagaggaaaagcaaaactgcatcatcatacctcacaga

SEQ ID NO: 198183 - DNA, 75 bp, Artificial Sequence
  Synthetic
aaactgcatcatcatacctcacagatcctgatgatacatttgaacttagtgcatgttttataactactgatcttg

SEQ ID NO: 198184 - DNA, 75 bp, Artificial Sequence
  Synthetic
tcctgatgatacatttgaacttagtgcatgttttataactactgatcttgctaaatactgtcttcaatggagata

SEQ ID NO: 198185 - DNA, 75 bp, Artificial Sequence
  Synthetic
agctcgcaagttcacctgcacatgcggatcctgccccagcatctgcggagaatgtgaaggagatcattgagctct

SEQ ID NO: 198186 - DNA, 75 bp, Artificial Sequence
  Synthetic
tcagaccataatccattttgctcgaacattaaacagaatgtatggagttccacatttatttgaatggattcatct

SEQ ID NO: 198187 - DNA, 75 bp, Artificial Sequence
  Synthetic
tcgtttaattagatctacattatatgttggtgatccattcaatccccctgctgcgactgatgctttcgatctaga

SEQ ID NO: 198188 - DNA, 75 bp, Artificial Sequence
  Synthetic
taaagtattaaatggtgatatctttatagtctctcccaagggaggtattgaaggcctatgtcagaaaatgtggac

SEQ ID NO: 198189 - DNA, 75 bp, Artificial Sequence
  Synthetic
tcatggatcccagtacaccaactaatgtccctgtagaggagatcagaaagagtttacacaatgttccagtagtaa

SEQ ID NO: 198190 - DNA, 75 bp, Artificial Sequence
  Synthetic
tgtccctgtagaggagatcagaaagagtttacacaatgttccagtagtaattgccggtccaactagtggaggctt

SEQ ID NO: 198191 - DNA, 75 bp, Artificial Sequence
  Synthetic
atagtctctcccaagggaggtattgaaggcctatgtcagaaaatgtggacaatgatctctatttctgtgatcatc

SEQ ID NO: 198192 - DNA, 75 bp, Artificial Sequence
  Synthetic
agtttacacaatgttccagtagtaattgccggtccaactagtggaggcttcacagccgaacaggtgatattgatt

SEQ ID NO: 198193 - DNA, 75 bp, Artificial Sequence
  Synthetic
taatcaggcaattgcagttacaacaagagttcctagatcattacctagtattcagaaaaaggagttagcctatgc

SEQ ID NO: 198194 - DNA, 75 bp, Artificial Sequence
  Synthetic
ggcaagcaagttattttttgaaagacttagggcaaataattatgggttgggtcatcagctaaaggctcaagaaac

SEQ ID NO: 198195 - DNA, 75 bp, Artificial Sequence
  Synthetic
tgcagcttgcaaatgactgcatctcgcgtccagataccaagactgagttcgtgactaagattcaggcagcaacca

SEQ ID NO: 198196 - DNA, 75 bp, Artificial Sequence
  Synthetic
gcggatgtattaggtgaatgtactcaagcttcctgttcaaattctgctactaccatcatgagattaacagaaaat

SEQ ID NO: 198197 - DNA, 75 bp, Artificial Sequence
  Synthetic
aagcttcctgttcaaattctgctactaccatcatgagattaacagaaaatggggttgaaaaagatacatgttata

SEQ ID NO: 198198 - DNA, 75 bp, Artificial Sequence
  Synthetic
agcttaatatttatcagtccattcgtcaactcacatatgatctaatatttccccaatattccataccaggtgaaa

SEQ ID NO: 198199 - DNA, 75 bp, Artificial Sequence
  Synthetic
tcaactcacatatgatctaatatttccccaatattccataccaggtgaaacaatcagtgggattttcctacagca

SEQ ID NO: 198200 - DNA, 75 bp, Artificial Sequence
  Synthetic
tccaagactaatctcacgtattgttctgctcccttcacagctaggcggtcttaattacctcgcatgcagcagatt

SEQ ID NO: 198201 - DNA, 75 bp, Artificial Sequence
  Synthetic
agaggttaattaaatgtggtgctcttgaatcatggatactgtacaatttactagcaagaaaaccagggaaaggtt

SEQ ID NO: 198202 - DNA, 75 bp, Artificial Sequence
  Synthetic
ggagtttttacagataatgcaaaagaggaggaaaatctccttgcaaaatttcttcttgatcgtgatatagtattg

SEQ ID NO: 198203 - DNA, 75 bp, Artificial Sequence
  Synthetic
gtgtttgaattagttaacattccaactttattgagagaacatgctctttgcaaacgcaaaatgttagtatgctct

SEQ ID NO: 198204 - DNA, 75 bp, Artificial Sequence
  Synthetic
ttgaaatcaaaccactctcaactaagaagactctttcagttatagaatataatacaaattacttatcttataact

SEQ ID NO: 198205 - DNA, 75 bp, Artificial Sequence
  Synthetic
accctgtcatacttaatcctttacctattcccggatatttaaattatattactgaccaaacttgcagtattgata

SEQ ID NO: 198206 - DNA, 75 bp, Artificial Sequence
  Synthetic
tattcccggatatttaaattatattactgaccaaacttgcagtattgatatatctagaagtttaagaaaattatc

SEQ ID NO: 198207 - DNA, 75 bp, Artificial Sequence
  Synthetic
atggtcttctttattgaatggaagaactttagaaggattagaaactccagatccaattgaagttgtcaatggttc

SEQ ID NO: 198208 - DNA, 75 bp, Artificial Sequence
  Synthetic
ggggataattattgatggaaatcctgaaactaatccacccatcagagttccatatattgggtctagaacagagga

SEQ ID NO: 198209 - DNA, 75 bp, Artificial Sequence
  Synthetic
aagaagagttgcatcaatggcatatattaaaggtgccacacacagtttgaaggctgctcttaggggcgcaggggt

SEQ ID NO: 198210 - DNA, 75 bp, Artificial Sequence
  Synthetic
gtcacatccccaagactgcacttccttttttcagcaaagatgggattgcctgtcatccattacaagatgtttccc

SEQ ID NO: 198211 - DNA, 75 bp, Artificial Sequence
  Synthetic
atatatttgggcatttggggatactatagtgaactggaatgatgcacttgatattgcaaatactagagttaagat

SEQ ID NO: 198212 - DNA, 75 bp, Artificial Sequence
  Synthetic
atagtgaactggaatgatgcacttgatattgcaaatactagagttaagatatccctagagcaacttcagactctt

SEQ ID NO: 198213 - DNA, 75 bp, Artificial Sequence
  Synthetic
ctaatctagcaaaatcactgtggtcagttggatgtgagatagaatctgccaagttgatacttcaagaatctgatc

SEQ ID NO: 198214 - DNA, 75 bp, Artificial Sequence
  Synthetic
ttacacaccgtttagatgatggagccacaacacttaaattcactccagctagttcctatgcattttctagttata

SEQ ID NO: 198215 - DNA, 75 bp, Artificial Sequence
  Synthetic
agatcaggtcaacggacatttgagaggtccaaattcagcccattcaaaaaatatgcatcaattccaaacttggaa

SEQ ID NO: 198216 - DNA, 75 bp, Artificial Sequence
  Synthetic
ctcatatatcaaatgatcaacaatatttagaaatagatcagagagtagttgattccaatattatttatcaacaat

SEQ ID NO: 198217 - DNA, 75 bp, Artificial Sequence
  Synthetic
tgagacctaccataacccacctataagaacttctacacaagaaatcactctccatttgcacactagctcatcttg

SEQ ID NO: 198218 - DNA, 75 bp, Artificial Sequence
  Synthetic
cttatatgtgaaagcaatggagaggttccccagatcactgttccctatactaatacatttgtatatgatcctgac

SEQ ID NO: 198219 - DNA, 75 bp, Artificial Sequence
  Synthetic
atctagattatctctcctaccaagctaaaattggaagtacagattactactcactcactgataaaattgacctat

SEQ ID NO: 198220 - DNA, 75 bp, Artificial Sequence
  Synthetic
tagcacatttaactgcaaaacaaatgataaactcaataattgggttagatgaaacagtatcaattgtcaatgatg

SEQ ID NO: 198221 - DNA, 75 bp, Artificial Sequence
  Synthetic
caagcaatggaacatgcaacatcaccagtctagatgcatataatgttaccctatttaagttactaacacccctga

SEQ ID NO: 198222 - DNA, 75 bp, Artificial Sequence
  Synthetic
gcttgcattccagatgtactacttaagaatatcatcttggacaaatatatttgactatacttacatgactttacg

SEQ ID NO: 198223 - DNA, 75 bp, Artificial Sequence
  Synthetic
ttgactatacttacatgactttacgcagaatacccggaactgctctaaataatattgcagctactattagccatc

SEQ ID NO: 198224 - DNA, 75 bp, Artificial Sequence
  Synthetic
atgtcaaattaagtattgatgcaattcagtggggagttaaacaagttcttgctgatttatcaaatggaattgatc

SEQ ID NO: 198225 - DNA, 75 bp, Artificial Sequence
  Synthetic
tcagtggggagttaaacaagttcttgctgatttatcaaatggaattgatcttgaaatcttgattctttcagagga

SEQ ID NO: 198226 - DNA, 75 bp, Artificial Sequence
  Synthetic
ttcaatggaaattagtgatagggcaatgaatctcattgctagaaaactaactctccttgcacttgttaaaggtga

SEQ ID NO: 198227 - DNA, 75 bp, Artificial Sequence
  Synthetic
gtgttatcaaaatactcaccacttagatccagatcttcaaaagtatttatataatctaactaatccaaaattgac

SEQ ID NO: 198228 - DNA, 75 bp, Artificial Sequence
  Synthetic
ttagagaatcagacgaaggacaatatattatcacctcatattatgaatccttcgaacaattagaaacagatataa

SEQ ID NO: 198229 - DNA, 75 bp, Artificial Sequence
  Synthetic
ttatgataattcagaaaactctaacaaagttagatttatccctttcgacatctttccacatccagaatctctcga

SEQ ID NO: 198230 - DNA, 75 bp, Artificial Sequence
  Synthetic
tctttccacatccagaatctctcgagaaatatcctcttccagttgatcatgactctcaatctgcaatttcaacac

SEQ ID NO: 198231 - DNA, 75 bp, Artificial Sequence
  Synthetic
gcgattcgcatttgctaatggtgtgctctatgccaactgcaaatctttgctatgtaggtgtgccgacccccccca

SEQ ID NO: 198232 - DNA, 75 bp, Artificial Sequence
  Synthetic
taattccaggccctccttctcatcatgtattacgaccactgggagtgtcctctacagcttggtataaagggataa

SEQ ID NO: 198233 - DNA, 75 bp, Artificial Sequence
  Synthetic
tctacagcttggtataaagggataagttattgtagatacctagaaacacaaaagatacagactggtgatcatctt

SEQ ID NO: 198234 - DNA, 75 bp, Artificial Sequence
  Synthetic
caatgtcactcctagaactcctatttccaggagatactgtctattataatagtctttttagtagtggagagaatc

SEQ ID NO: 198235 - DNA, 75 bp, Artificial Sequence
  Synthetic
tccaggagatactgtctattataatagtctttttagtagtggagagaatcctccacagagaaactatgcccctct

SEQ ID NO: 198236 - DNA, 75 bp, Artificial Sequence
  Synthetic
actatcagtgattactttggttgtcgtgggattgctgattgcctacatcatcaagctggtttctcaaatccatca

SEQ ID NO: 198237 - DNA, 75 bp, Artificial Sequence
  Synthetic
aatggtgcagttacagacttatcaacaaaggatgcagttgcattcataatacataaggtaggagcagaaaaagca

SEQ ID NO: 198238 - DNA, 75 bp, Artificial Sequence
  Synthetic
cgactgctaatataaatcagcaaactctgtccagatcccagattcattcattaattatagcaactactgttctta

SEQ ID NO: 198239 - DNA, 75 bp, Artificial Sequence
  Synthetic
ttaattatagcaactactgttcttaagaggggtgggatattaatttataaaacatcatggcttcctttttctaga

SEQ ID NO: 198240 - DNA, 75 bp, Artificial Sequence
  Synthetic
tttagtcaactagcaagccttctttggtgcttttttgaccggatccatctaatacgtagtagttattctgatcct

SEQ ID NO: 198241 - DNA, 75 bp, Artificial Sequence
  Synthetic
tatcggtttcagtgcagctctagtaactgctactactcttcacaatgacggattcacaacaatacatcccgatgt

SEQ ID NO: 198242 - DNA, 75 bp, Artificial Sequence
  Synthetic
tgtttgtaattattggcaacaccatcttgaaaatgttgggagagtcggaaaagtaattgatgagatacttgatgg

SEQ ID NO: 198243 - DNA, 75 bp, Artificial Sequence
  Synthetic
aagtaattgatgagatacttgatggtttagccaccaacttctttgcaggagataatgggcttattctaagatgtg

SEQ ID NO: 198244 - DNA, 75 bp, Artificial Sequence
  Synthetic
gttggagattgaccagttagcatcatttgatttggttcaagatgctctggtgacacttatcactatacacctaaa

SEQ ID NO: 198245 - DNA, 75 bp, Artificial Sequence
  Synthetic
ggaaattatagaagtacaatcatcacatacagaagattatacatctctcctcttcacaccttataatattggtgc

SEQ ID NO: 198246 - DNA, 75 bp, Artificial Sequence
  Synthetic
aaattaattctagaacgatctttaatgtatacagtccgaaattggttagttttacccagttccatccgggattct

SEQ ID NO: 198247 - DNA, 75 bp, Artificial Sequence
  Synthetic
tttacccagttccatccgggattctgtacgacaagatttggaattagggtcatttagattaatgtctattttaag

SEQ ID NO: 198248 - DNA, 75 bp, Artificial Sequence
  Synthetic
cccacaaaaaaatacttacttgatcagcttacaaggacatatatatcaaccttctttaactctcactcagtcctt

SEQ ID NO: 198249 - DNA, 75 bp, Artificial Sequence
  Synthetic
atcaatggaataaacaaattccttgtacttaaatcatacaatgggacgcctaaatatggacctctcctaaatatt

SEQ ID NO: 198250 - DNA, 75 bp, Artificial Sequence
  Synthetic
atacctctaattaaagacattcagatagaagatattaatgattttgaagatatcgagaggggtatcgatggcgaa

SEQ ID NO: 198251 - DNA, 75 bp, Artificial Sequence
  Synthetic
atcgatggcgaagaattatgacaacaatgattataagaactcatgatagttttatttaagaaaaacatattgatt

SEQ ID NO: 198252 - DNA, 75 bp, Artificial Sequence
  Synthetic
accaaggggagaatcagatggcatcgttatatgacgaattgcaaaaagattacgtaggtccggaaccactagatt

SEQ ID NO: 198253 - DNA, 75 bp, Artificial Sequence
  Synthetic
ttccaatcttcaggactatgaaaaccatttacctaagtgatggaatcaatcgcaaaagctgttcagtcactgcta

SEQ ID NO: 198254 - DNA, 75 bp, Artificial Sequence
  Synthetic
gttatatgacgaattgcaaaaagattacgtaggtccggaaccactagattccggtgccggtaacgattccagttt

SEQ ID NO: 198255 - DNA, 75 bp, Artificial Sequence
  Synthetic
tatactatctgatcattctctatctctattaaggatatttctagtctaaagttcaaaatgtcaagtgttttaaag

SEQ ID NO: 198256 - DNA, 75 bp, Artificial Sequence
  Synthetic
ctattaaggatatttctagtctaaagttcaaaatgtcaagtgttttaaagacatttgaaagatttactatacaac

SEQ ID NO: 198257 - DNA, 75 bp, Artificial Sequence
  Synthetic
ggcaatgggccacaatcaatcctgcagttggaagcgggatctatcatctaggctttatcttatttcctgtatatg

SEQ ID NO: 198258 - DNA, 75 bp, Artificial Sequence
  Synthetic
atctagacttttattctttaatctacgaatcattatgagtaacactgcaagagagggacatagagctggtgctct

SEQ ID NO: 198259 - DNA, 75 bp, Artificial Sequence
  Synthetic
ggctgcagcagcacggagttcctatgtaatccgttatcactcaaacaggttgattcagagtgctgttcttatttg

SEQ ID NO: 198260 - DNA, 75 bp, Artificial Sequence
  Synthetic
gcattagctgaggacattcctgatacccttaatcaccaaactccatttgtaaataatgatgtagaagatgacata

SEQ ID NO: 198261 - DNA, 75 bp, Artificial Sequence
  Synthetic
aggtaggctctatgttattgacaataatttgtattattatcaacgtagttcctcttggtggtctgcatcgctttt

SEQ ID NO: 198262 - DNA, 75 bp, Artificial Sequence
  Synthetic
tatcagtagcaaagcggatggctaaatatcaacaacaagggagaatcaatgctaggtatgtactacaacctgaag

SEQ ID NO: 198263 - DNA, 75 bp, Artificial Sequence
  Synthetic
atatcaacaacaagggagaatcaatgctaggtatgtactacaacctgaagcacaaagactaattcagaatgccat

SEQ ID NO: 198264 - DNA, 75 bp, Artificial Sequence
  Synthetic
cacaaagactaattcagaatgccatccgcaagtcaatggtagtaaggcatttcatgacttatgagcttcaacttt

SEQ ID NO: 198265 - DNA, 75 bp, Artificial Sequence
  Synthetic
ttttgtcccatctgaatatccattagtttatagctatgcaatgggtattggaactgtccttgatacaaatatgag

SEQ ID NO: 198266 - DNA, 75 bp, Artificial Sequence
  Synthetic
ccagattcaataataattgaaaggctctctatcttatgcaatagttatacgttttggctgtattagaatgttata

SEQ ID NO: 198267 - DNA, 75 bp, Artificial Sequence
  Synthetic
gtttatagctatgcaatgggtattggaactgtccttgatacaaatatgagaaattatgcatacggtagatcatat

SEQ ID NO: 198268 - DNA, 75 bp, Artificial Sequence
  Synthetic
gattctgctgtttttcccatatgaagcaatccttcaacaccgacttaggttcaattttctcatcatttactgttg

SEQ ID NO: 198269 - DNA, 75 bp, Artificial Sequence
  Synthetic
ttaaatccgcaatattttcagctaggagtagaaacagcaaggaaacagcagggagctgttgacaacaggacagca

SEQ ID NO: 198270 - DNA, 75 bp, Artificial Sequence
  Synthetic
acccatttgctggagcaaatgacagagaaatgggaggacaagcaaatgatacacctgtgtataacttcaatccaa

SEQ ID NO: 198271 - DNA, 75 bp, Artificial Sequence
  Synthetic
gagagaatagaggagagcctggacaaccaaacaaccagacaagtgacaaccagcagagattcaacccccccatac

SEQ ID NO: 198272 - DNA, 75 bp, Artificial Sequence
  Synthetic
cgcaaagaacatcaggtatgagcagtgaagagttccaacattcaatgaatcagtacatccgtgctatgcatgagc

SEQ ID NO: 198273 - DNA, 75 bp, Artificial Sequence
  Synthetic
tgccaatgatgccacagataggaatgacatttctcttgagctagttggagattttgattcctaactctcaatgtc

SEQ ID NO: 198274 - DNA, 75 bp, Artificial Sequence
  Synthetic
atacaaccagatatacacatccacatcactcagagatacagctgccactcacacactcatccagacaaatcaaac

SEQ ID NO: 198275 - DNA, 75 bp, Artificial Sequence
  Synthetic
acacactcatccagacaaatcaaactagactcacatcattcggaaacaattctctcataatttaagaaaaaatca

SEQ ID NO: 198276 - DNA, 75 bp, Artificial Sequence
  Synthetic
ccgaggaaccaacatacaccactgagcaagttgatgaattaatccatgctggactgggaacagtagatttcttcc

SEQ ID NO: 198277 - DNA, 75 bp, Artificial Sequence
  Synthetic
gcaagttgatgaattaatccatgctggactgggaacagtagatttcttcctatctagacccatagatgctcagtc

SEQ ID NO: 198278 - DNA, 75 bp, Artificial Sequence
  Synthetic
ttctttaggcaaaggcagcatcccaccaggtgtcacagctgttctaactagtgcagcggagacaaaatccaaacc

SEQ ID NO: 198279 - DNA, 75 bp, Artificial Sequence
  Synthetic
agttgctgctggtccagttaaacccaggcggaagaaagtgatcagcaatactactccatacactattgcagacaa

SEQ ID NO: 198280 - DNA, 75 bp, Artificial Sequence
  Synthetic
ttctccagatttaattgctgagatgttgtgtctcatgagactttggggtcatcccactcttactgctgcgcaagt

SEQ ID NO: 198281 - DNA, 75 bp, Artificial Sequence
  Synthetic
ttcagactgtagaagggaaagtagataaaattcttgcaacttctgcaactataatcaatcttaaaaatgaaatga

SEQ ID NO: 198282 - DNA, 75 bp, Artificial Sequence
  Synthetic
tcatattcctatgcccaatccatttaatagacgtctattactcaatttcttagaagatgacagttttgatccagt

SEQ ID NO: 198283 - DNA, 75 bp, Artificial Sequence
  Synthetic
gaaagaaataaaaccagatggaaggatatttgctaagcttactaatagaatgcggtcctgtcaagtaattgcgga

SEQ ID NO: 198284 - DNA, 75 bp, Artificial Sequence
  Synthetic
aaagagtttacacaatgttccagtagtaattgccggtccaactagtggaggcttcacagccgaaggcagtgatat

SEQ ID NO: 198285 - DNA, 75 bp, Artificial Sequence
  Synthetic
ttgatgcagcttgcaaatgactgcatctcgcgtccagataccaagactgagttcgtgactaagattcaggcagca

SEQ ID NO: 198286 - DNA, 75 bp, Artificial Sequence
  Synthetic
tctcgcgtccagataccaagactgagttcgtgactaagattcaggcagcaaccacagaatcacagcttaacgaaa

SEQ ID NO: 198287 - DNA, 75 bp, Artificial Sequence
  Synthetic
ttaaacggtcaataatacgctctgcaatataaaatgaggtgcagtcacacaagagacactcaacatgcatccaat

SEQ ID NO: 198288 - DNA, 75 bp, Artificial Sequence
  Synthetic
aatataaaatgaggtgcagtcacacaagagacactcaacatgcatccaatcaagatccagactccatccatccaa

SEQ ID NO: 198289 - DNA, 75 bp, Artificial Sequence
  Synthetic
gttggtgatccattcaatcctcctgccgcaactgatgctttcgatctagataaagtattaaatggtgatatcttt

SEQ ID NO: 198290 - DNA, 75 bp, Artificial Sequence
  Synthetic
aaacacgcccacaattgtcaacaccaagaaacaaccacagccgaaccatgctcaaccaaaagacccaaacaacac

SEQ ID NO: 198291 - DNA, 75 bp, Artificial Sequence
  Synthetic
aagaaacaaccacagccgaaccatgctcaaccaaaagacccaaacaacacctcacatcaatagaaggctggacat

SEQ ID NO: 198292 - DNA, 75 bp, Artificial Sequence
  Synthetic
gataaatttaataaaaaaagaaaagaagttaagtaaaatttaaaggacacaatagagaaaatctaggtccgaaag

SEQ ID NO: 198293 - DNA, 75 bp, Artificial Sequence
  Synthetic
aatagagaaaatctaggtccgaaagcttgcctctcagacagatcccaaaatcatagtccaaaccccaaacacagc

SEQ ID NO: 198294 - DNA, 75 bp, Artificial Sequence
  Synthetic
agcagacatgcctataatatcattaccagcagatccaacttcacccagtcaatcccttactccgtttccaataca

SEQ ID NO: 198295 - DNA, 75 bp, Artificial Sequence
  Synthetic
ccagcagatccaacttcacccagtcaatcccttactccgtttccaatacaacttgacaccaaagatggcaaggca

SEQ ID NO: 198296 - DNA, 75 bp, Artificial Sequence
  Synthetic
aataagttccacgttcttcatatatagtaaacgggtattttatcaaggacgtatactaacacaggcactcaaaaa

SEQ ID NO: 198297 - DNA, 75 bp, Artificial Sequence
  Synthetic
gagacacttcagggggcattcacagtgagatcagcagtgacctagctgcagggtccataacagcatgcatgatga

SEQ ID NO: 198298 - DNA, 75 bp, Artificial Sequence
  Synthetic
ctgaatgaattctacgtaaaagtcaagaagacatcaagccagagagaggaagcagtgtttgaattagttaacatt

SEQ ID NO: 198299 - DNA, 75 bp, Artificial Sequence
  Synthetic
ccgtcaaagctacaagctggatttgagtatgtatacataccaacttttgtctccattacatactcaccacgaaat

SEQ ID NO: 198300 - DNA, 75 bp, Artificial Sequence
  Synthetic
ctccattacatactcaccacgaaatctgaattaccaagttgccagacctatccttaagttcagatcacgctttgt

SEQ ID NO: 198301 - DNA, 75 bp, Artificial Sequence
  Synthetic
ctgaattaccaagttgccagacctatccttaagttcagatcacgctttgtgtatagcattcatttggaattaatc

SEQ ID NO: 198302 - DNA, 75 bp, Artificial Sequence
  Synthetic
ctcattgaatcaagaatatctttatcctcctactactatacttaaaagacatactcaaaatactttaatggagat

SEQ ID NO: 198303 - DNA, 75 bp, Artificial Sequence
  Synthetic
ctgagattgctatgcaaatctgactcccccttgatgaaatcctacaatgcagacagaacaggtcggggatgcctc

SEQ ID NO: 198304 - DNA, 75 bp, Artificial Sequence
  Synthetic
aggaaaatctccttgcaaaatttcttcttgatcgtgatatagtattgccaagagttgcacacattataatagatc

SEQ ID NO: 198305 - DNA, 75 bp, Artificial Sequence
  Synthetic
cattagatcaggtcaacggacatttgagaggtccaaattcagcccattcaaaaaatatgcatcaattccaaactt

SEQ ID NO: 198306 - DNA, 75 bp, Artificial Sequence
  Synthetic
aaaaatatgcatcaattccaaacttggaagccatcaactgaatgctccagcatctgagaatagaaccacaatcaa

SEQ ID NO: 198307 - DNA, 75 bp, Artificial Sequence
  Synthetic
catctgagaatagaaccacaatcaagtcatactactagtcactatacaataatcaacaattttagtcaactgatt

SEQ ID NO: 198308 - DNA, 75 bp, Artificial Sequence
  Synthetic
accaagatgttatcataggtccgaactgatcaatctaacaaaaaaactaaacgttccacaataaatcaacgttca

SEQ ID NO: 198309 - DNA, 75 bp, Artificial Sequence
  Synthetic
ctgatcaatctaacaaaaaaactaaacgttccacaataaatcaacgttcaggccaaaatattcagccatgcatca

SEQ ID NO: 198310 - DNA, 75 bp, Artificial Sequence
  Synthetic
cctgcatccaatgatagtatgcatctttgttatgtacactggaattgtaggttcagatgccattgctggagatca

SEQ ID NO: 198311 - DNA, 75 bp, Artificial Sequence
  Synthetic
gtgaactggaatgatgcacttgatatcgcaaatactagggttaagatatccctagagcaacttcagacccttaca

SEQ ID NO: 198312 - DNA, 75 bp, Artificial Sequence
  Synthetic
actacttaatataggggtcattcaatcaaagataagatcactcatgtactatactgatggtggtgctagctttat

SEQ ID NO: 198313 - DNA, 75 bp, Artificial Sequence
  Synthetic
tcaaagataagatcactcatgtactatactgatggtggtgctagctttattgttgtaaaattgctacctaatctt

SEQ ID NO: 198314 - DNA, 75 bp, Artificial Sequence
  Synthetic
cccccaagcaatggaacatgcaacatcaccagtctagatgcatataatgttaccctatttaagttactaacaccc

SEQ ID NO: 198315 - DNA, 75 bp, Artificial Sequence
  Synthetic
tcaccagtctagatgcatataatgttaccctatttaagttactaacacccctgattgagaacctgagtaaaattt

SEQ ID NO: 198316 - DNA, 75 bp, Artificial Sequence
  Synthetic
ccactgttacagataccaaaacccgccaaaaacgatttgcaggagtagttgttggacttgctgcattaggagtag

SEQ ID NO: 198317 - DNA, 75 bp, Artificial Sequence
  Synthetic
ccaaaaacgatttgcaggagtagttgttggacttgctgcattaggagtagccacagccgcacaaataactgcagc

SEQ ID NO: 198318 - DNA, 75 bp, Artificial Sequence
  Synthetic
tgtagcaatagtgaaagctaatgcaaatgctgctgcgataaacaatcttgcatcttcaattcaatccaccaacaa

SEQ ID NO: 198319 - DNA, 75 bp, Artificial Sequence
  Synthetic
tgttagaagtgtagatggttgccttatatgtgagagcaatggagaggttcctcagatcactgttccctatactaa

SEQ ID NO: 198320 - DNA, 75 bp, Artificial Sequence
  Synthetic
catcttcaattcaatccaccaacaaggcagtatccgatgtgatagatgcatcaagaacaattgcaaccgcagttc

SEQ ID NO: 198321 - DNA, 75 bp, Artificial Sequence
  Synthetic
ctagcagattatgagattgcacacctagattatctctcctaccaagctaaaattggaagtacagattactactca

SEQ ID NO: 198322 - DNA, 75 bp, Artificial Sequence
  Synthetic
acagtatcaattgtcaatgatgcggttatcctatctgactatactaataactggattagtgaatgttcttatact

SEQ ID NO: 198323 - DNA, 75 bp, Artificial Sequence
  Synthetic
agaagtggttgtacaagttccgaataggattctagagtatgcaaatgaactacaaaattacccagccaatgactg

SEQ ID NO: 198324 - DNA, 75 bp, Artificial Sequence
  Synthetic
tacaaaattacccagccaatgactgtgtcgtgacaccgaactctgtattttgtagatacaatgagggttccccta

SEQ ID NO: 198325 - DNA, 75 bp, Artificial Sequence
  Synthetic
tccctgaatcacaatatcaatgcttgagggggaatcttaattcttgcacttttacccctattatcgggaactttc

SEQ ID NO: 198326 - DNA, 75 bp, Artificial Sequence
  Synthetic
tgtgctctatgccaactgcaaatctttgctatgtaggtgtgccgaccccccccatgttgtatcccaggatgatac

SEQ ID NO: 198327 - DNA, 75 bp, Artificial Sequence
  Synthetic
ccaaggcatcagcataattgatattaagagatgctctgagatgatgcttgacactttttcatttaggatcacatc

SEQ ID NO: 198328 - DNA, 75 bp, Artificial Sequence
  Synthetic
ccagatcttcaaaagtatttatataatctaactaatccaaaattgactgcatttcccagtaacaacttctactta

SEQ ID NO: 198329 - DNA, 75 bp, Artificial Sequence
  Synthetic
gtcaaatcaaatcaattcaataaacaaatctcttaaaagtgctgaggattggattgcagatagcaacttctttgc

SEQ ID NO: 198330 - DNA, 75 bp, Artificial Sequence
  Synthetic
ggattgcagatagcaacttctttgctaatcaagccaggacagccaagacactttattcactaagtgcaatagcat

SEQ ID NO: 198331 - DNA, 75 bp, Artificial Sequence
  Synthetic
tgtcgtgggattgctgattgcctacatcatcaagctggtttctcaaatccatcaattcagatcgctagctgctac

SEQ ID NO: 198332 - DNA, 75 bp, Artificial Sequence
  Synthetic
aacaatgttccacagggaaaatcctgccttcttttccaagaataaccatggaaacatatatgggatatcttaaga

SEQ ID NO: 198333 - DNA, 75 bp, Artificial Sequence
  Synthetic
aatctatcacaagtctatatatgtccacaattgacccttaagaaccaacttccaacgattatccgttaaatttaa

SEQ ID NO: 198334 - DNA, 75 bp, Artificial Sequence
  Synthetic
gtataatagtttaaaaattaacattaagcctccagataccaatgaatatgaatatatctcttagaaaacctgatt

SEQ ID NO: 198335 - DNA, 75 bp, Artificial Sequence
  Synthetic
aagaaaaaacctaaaataagcacgaacccttaaggtgtcgtaacgtctcgtgacaccgggttcagttcaaatatc

SEQ ID NO: 198336 - DNA, 75 bp, Artificial Sequence
  Synthetic
gacctctaacccaatttaacacccattcttatataagaacacagtataatttaatcacaaaagacctcaaaaact

SEQ ID NO: 198337 - DNA, 75 bp, Artificial Sequence
  Synthetic
cttgtccatatagatctcgaatcaactgctaatataaatcagcaaactctgtccagatcccagattcattcatta

SEQ ID NO: 198338 - DNA, 75 bp, Artificial Sequence
  Synthetic
ttcatcttgatgtttcctctggtctcatggattccgatgattcacagcaaggcattattcagcctattatagaat

SEQ ID NO: 198339 - DNA, 75 bp, Artificial Sequence
  Synthetic
cattaaaatcattaattgctttggctaaccagattctgtacaatgttgcaataataattcctcttaaaattgaca

SEQ ID NO: 198340 - DNA, 75 bp, Artificial Sequence
  Synthetic
taaccagattctgtacaatgttgcaataataattcctcttaaaattgacagtatcgagactgtaatattctctgc

SEQ ID NO: 198341 - DNA, 75 bp, Artificial Sequence
  Synthetic
cgcctaaatatggacctctcctaaatattcccagctttatcccctcagcaacatctcccaacgggtgcactagaa

SEQ ID NO: 198342 - DNA, 75 bp, Artificial Sequence
  Synthetic
acatctcccaacgggtgcactagaataccatcattttcactcattaagacccattggtgttacactcacaatgta

SEQ ID NO: 198343 - DNA, 75 bp, Artificial Sequence
  Synthetic
atgcttggagattgcctcgatttcacgacatctaatcagtatttagcaatggggataatacaacaatctgctgca

SEQ ID NO: 198344 - DNA, 75 bp, Artificial Sequence
  Synthetic
aaaccatttacctaagtgatggaatcaatcgcaaaagctgttcagtcactgctataccaggaggttgtgtcttgt

SEQ ID NO: 198345 - DNA, 75 bp, Artificial Sequence
  Synthetic
acagacatttcttaaaaagacacccacaaaaaaatacttacttgatcagcttacaaggacatatatatcaacctt

SEQ ID NO: 198346 - DNA, 75 bp, Artificial Sequence
  Synthetic
ctagctgaactgagacttgctttctattattataatgatacctttattgaaagagtcatatctcttccaaataca

SEQ ID NO: 198347 - DNA, 75 bp, Artificial Sequence
  Synthetic
ctccaccgtccatatcaaaaacaaatatggaaagccttaggtagtgtaatatattgttcggagacagttgatata

SEQ ID NO: 198348 - DNA, 75 bp, Artificial Sequence
  Synthetic
ctgcagttggaagcgggatctatcatctaggctttatcttatttcctgtatatggtggtctcataagtgggactc

SEQ ID NO: 198349 - DNA, 75 bp, Artificial Sequence
  Synthetic
cttcctacaacaagcagtcctcacgctattttatcccaaaacatcccaacataacctgtgccggtaactccagcg

SEQ ID NO: 198350 - DNA, 75 bp, Artificial Sequence
  Synthetic
ctatgtaatccgttatcactcaaacaggttgattcagagtgctgttcttatttgcccattgtctgacatgcacac

SEQ ID NO: 198351 - DNA, 75 bp, Artificial Sequence
  Synthetic
aagttccccgtcctggagtcatgccatgcaatgcaacaagtttttgccctgctaattgcatcacaggggtgtacg

SEQ ID NO: 198352 - DNA, 75 bp, Artificial Sequence
  Synthetic
atgcaatgcaacaagtttttgccctgctaattgcatcacaggggtgtacgcagatgtgtggccgcttaacgatcc

SEQ ID NO: 198353 - DNA, 75 bp, Artificial Sequence
  Synthetic
cagatgtgtggccgcttaacgatccagaacccacatcacaaaatgctctgaatcccaactatcgatttgctggag

SEQ ID NO: 198354 - DNA, 75 bp, Artificial Sequence
  Synthetic
cctttctcagaaatgagtccaaccgaaccaatcccacattctacactgcatcagccagcgccctactaaatacta

SEQ ID NO: 198355 - DNA, 75 bp, Artificial Sequence
  Synthetic
gggctcatctcttttaggggagttccaaataataccatttctaagggaactaataccttaatactattgaatgaa

SEQ ID NO: 198356 - DNA, 75 bp, Artificial Sequence
  Synthetic
tattccgatatttaagaaaaaataacctttatataatgtaacaatactattaagattatgacataggccagaatg

SEQ ID NO: 198357 - DNA, 75 bp, Artificial Sequence
  Synthetic
atcttgacatttctgaaataagcccccttcacaataatgattgggatcaaattgccagagaagaatccaatcttg

SEQ ID NO: 198358 - DNA, 75 bp, Artificial Sequence
  Synthetic
attgccagagaagaatccaatcttgctgaacgacttggagtagctaaatctgaattaattaaacgtgtgcccgca

SEQ ID NO: 198359 - DNA, 75 bp, Artificial Sequence
  Synthetic
tgaattaattaaacgtgtgcccgcatttagagcaactagatggcgtagtcatgcagccgtccttatatggccttc

SEQ ID NO: 198360 - DNA, 75 bp, Artificial Sequence
  Synthetic
tttagagcaactagatggcgtagtcatgcagccgtccttatatggccttcttgtataccatttcttgttaaattc

SEQ ID NO: 198361 - DNA, 75 bp, Artificial Sequence
  Synthetic
ttacatttgagatgactttaatggtaagtgacatgtttgagggaaggatgaatgtcaccgctctctgcactatta

SEQ ID NO: 198362 - DNA, 75 bp, Artificial Sequence
  Synthetic
aacctttctccagatttaattgctgagatgttgtgtctcatgagactttggggtcatcccactcttactgctgcg

SEQ ID NO: 198363 - DNA, 75 bp, Artificial Sequence
  Synthetic
agatgttgtgtctcatgagactttggggtcatcccactcttactgctgcgcaagctgcaggtaaagtgagagaat

SEQ ID NO: 198364 - DNA, 75 bp, Artificial Sequence
  Synthetic
ctatgtgtgcaggtaagttacttgatttccctacaataatgaaaactcttgcttttttccacacaattttaatta

SEQ ID NO: 198365 - DNA, 75 bp, Artificial Sequence
  Synthetic
aatgtggcctccacttatacttcctaaaaatgcatcaaaaagcttaatagaatttcaacatgataatgctgaaat

SEQ ID NO: 198366 - DNA, 75 bp, Artificial Sequence
  Synthetic
tggaaagagatctctctcatagaatttagaaagtgctttgactttgatcctggtgaggagctaagcatttttatg

SEQ ID NO: 198367 - DNA, 75 bp, Artificial Sequence
  Synthetic
ttagaaagtgctttgactttgatcctggtgaggagctaagcatttttatgaaagacaaggcaataagtgctccaa

SEQ ID NO: 198368 - DNA, 75 bp, Artificial Sequence
  Synthetic
ttaccagtggtgaatatctccaagatgacacattttgtgcatcttactcattaaaagagaaagaaataaaaccag

SEQ ID NO: 198369 - DNA, 75 bp, Artificial Sequence
  Synthetic
cggagttgtcttgaatcaattatcactgactaaatcattgcttactatgagtcaaattggcataatatcagaaaa

SEQ ID NO: 198370 - DNA, 75 bp, Artificial Sequence
  Synthetic
ggcgaagagatatacgcgagataacatctcatcccaaggtttccatacaatcaagactgattctaaaaataagag

SEQ ID NO: 198371 - DNA, 75 bp, Artificial Sequence
  Synthetic
tggagttccacatttatttgaatggattcatcttcgtttaattagatctacattatatgttggtgatccattcaa

SEQ ID NO: 198372 - DNA, 75 bp, Artificial Sequence
  Synthetic
aggtattgaaggcctatgtcagaaaatgtggacaatgatctctatttctgtgatcatcctctcttcagccgaatc

SEQ ID NO: 198373 - DNA, 75 bp, Artificial Sequence
  Synthetic
caaaacaagagtaatgagcatggttcaaggagataatcaggcgattgcagttacaacaagagttcctagatcatt

SEQ ID NO: 198374 - DNA, 75 bp, Artificial Sequence
  Synthetic
taatatttccccaatactccataccaggtgaaactataagtgagattttcctacagcatccaagactaatctcac

SEQ ID NO: 198375 - DNA, 75 bp, Artificial Sequence
  Synthetic
gaaaggttcatgggcaactttagcagccgatccatactcattgaatcaagaatatctttatcctcctactactat

SEQ ID NO: 198376 - DNA, 75 bp, Artificial Sequence
  Synthetic
tgttaaagggagtttttacagataatgcaaaagaggaggaaaatctccttgcaaaatttcttcttgatcgtgata

SEQ ID NO: 198377 - DNA, 75 bp, Artificial Sequence
  Synthetic
ttgacaccacaaggaccataatgagacgatcatttgaaatcaaaccactctcaactaagaagactctttcagtca

SEQ ID NO: 198378 - DNA, 75 bp, Artificial Sequence
  Synthetic
tagaatataatactaattacttatcttataactaccctgtcatacttaatcctttacctattcctggatatttaa

SEQ ID NO: 198379 - DNA, 75 bp, Artificial Sequence
  Synthetic
tggcatatattaaaggtgccacacacagtttgaaggctgctcttagaggcgcaggggtatatatttgggcattcg

SEQ ID NO: 198380 - DNA, 75 bp, Artificial Sequence
  Synthetic
tgcaaacattacacaccgtttagatgatggagccacaacacttaaattcactccagctagttcctatgcattttc

SEQ ID NO: 198381 - DNA, 75 bp, Artificial Sequence
  Synthetic
atcctgatccactagcagattatgagattgcacacctagattatctctcctaccaagctaaaattggaagtacag

SEQ ID NO: 198382 - DNA, 75 bp, Artificial Sequence
  Synthetic
tatactaataactggattagtgaatgttcttatactaagatagatttagtttttaaattaatggcatggaatttc

SEQ ID NO: 198383 - DNA, 75 bp, Artificial Sequence
  Synthetic
gttcttatactaagatagatttagtttttaaattaatggcatggaatttccttcttgagcttgcattccagatgt

SEQ ID NO: 198384 - DNA, 75 bp, Artificial Sequence
  Synthetic
actacttaaggatatcatcttggacaaatatatttgactatacttatatgactttgcgcaggatacccggaactg

SEQ ID NO: 198385 - DNA, 75 bp, Artificial Sequence
  Synthetic
ctctaaataatattgcagctactattagccatccaaaattattaagacgtgcaatgaatcttgatattatcactc

SEQ ID NO: 198386 - DNA, 75 bp, Artificial Sequence
  Synthetic
gcaatgaatcttgatattatcactcctatacatgcaccgtatttagcttcattagattatgtcaaattaagtatt

SEQ ID NO: 198387 - DNA, 75 bp, Artificial Sequence
  Synthetic
aaattaaagggatgccaccagaagaaaagtgtttagtcttaactgaatatctagcaatgtgttatcaaaatactc

SEQ ID NO: 198388 - DNA, 75 bp, Artificial Sequence
  Synthetic
taatcaaattagagaatcagacgaaggacaatatattatcacctcatattatgaatccttcgaacaattagaaac

SEQ ID NO: 198389 - DNA, 75 bp, Artificial Sequence
  Synthetic
actgctccttatgataattcagaaactctaacaaagttcgatttatcccttgacatctttccacatccagaatct

SEQ ID NO: 198390 - DNA, 75 bp, Artificial Sequence
  Synthetic
atcatgactctcaatctgcaatttcaacactaattccaggccctccttctcatcatgtattacgaccactaggag

SEQ ID NO: 198391 - DNA, 75 bp, Artificial Sequence
  Synthetic
tgcttcaatgtcacttctagaactcttatttccaggagatactgtctattataatagtctttttagtagtggaga

SEQ ID NO: 198392 - DNA, 75 bp, Artificial Sequence
  Synthetic
atggaaacggtgcagttacagacttatcaacaaaggatgcagttgcattcataatacataaagtaggagcagaga

SEQ ID NO: 198393 - DNA, 75 bp, Artificial Sequence
  Synthetic
tataaaacatcatggcttccgttttctaggtttagtcaactagcaagtctactttggtgcttctttgaccggatc

SEQ ID NO: 198394 - DNA, 75 bp, Artificial Sequence
  Synthetic
catctaatacgtagtagctattctgatcctcacagtcatgaggtttatcttgtatgtagacttgccgcagatttt

SEQ ID NO: 198395 - DNA, 75 bp, Artificial Sequence
  Synthetic
tgacggattcacaacaatacatcctgatgttgtttgtagttattggcaacaccatcttgaaaatgttgggagagt

SEQ ID NO: 198396 - DNA, 75 bp, Artificial Sequence
  Synthetic
aaatggttagagattgaccagttagcatcatttgatttggttcaagatgctctggttacacttatcactatacac

SEQ ID NO: 198397 - DNA, 75 bp, Artificial Sequence
  Synthetic
ctaaaggaaattatagaagtgcagtcatcacatacagaggattatacatctctcctcttcacaccttataatatt

SEQ ID NO: 198398 - DNA, 75 bp, Artificial Sequence
  Synthetic
agggtcatttagattaatgtctattttaagtgaacagacatttcttaaaaagacacccacaaaaaaatacttact

SEQ ID NO: 198399 - DNA, 75 bp, Artificial Sequence
  Synthetic
gcgaagaattatgacaacaatgattataagaactcatgatagttttatttaagaaaaacatattgattttcccct

SEQ ID NO: 198400 - DNA, 75 bp, Artificial Sequence
  Synthetic
gttatatgacgaattgcaaaaagattacgtaggtccggaaccactagattccggtgccggtaacgatctcagttt

SEQ ID NO: 198401 - DNA, 75 bp, Artificial Sequence
  Synthetic
tatactatctgatcattctttatctctactaaggatatttctaatctaaggttcaaaatgtcaagtgtcttaaag

SEQ ID NO: 198402 - DNA, 75 bp, Artificial Sequence
  Synthetic
ctactaaggatatttctaatctaaggttcaaaatgtcaagtgtcttaaagacatttgaaagatttactatacaac

SEQ ID NO: 198403 - DNA, 75 bp, Artificial Sequence
  Synthetic
aggagcttcaggagcaatctgaagacactccaatacctcttgaaacaatcagacctacaatcagagtatttgtca

SEQ ID NO: 198404 - DNA, 75 bp, Artificial Sequence
  Synthetic
cactccaatacctcttgaaacaatcagacctacaatcagagtatttgtcatcaataataatgatcctattgtaag

SEQ ID NO: 198405 - DNA, 75 bp, Artificial Sequence
  Synthetic
gagagggacatagagctggtgctctcctcagtcttttatcactaccttctgcagctatgagtaatcacatcaaac

SEQ ID NO: 198406 - DNA, 75 bp, Artificial Sequence
  Synthetic
cccttaatcaccaaactccatttgtaaataatgatgtggaagatgacatatttgatgaaacagagaaattcttgg

SEQ ID NO: 198407 - DNA, 75 bp, Artificial Sequence
  Synthetic
atgtttgctatagtgtacttatgcaggcatggatagtaacatgcaagtgcatgactgctcctgatcaaccaccag

SEQ ID NO: 198408 - DNA, 75 bp, Artificial Sequence
  Synthetic
cacaatcaagatctttgctagcgaaccgttattatgccatggtgggagacattggcaagtatattgaacacagcg

SEQ ID NO: 198409 - DNA, 75 bp, Artificial Sequence
  Synthetic
aaactatgcatatggtagatcatatctaaatccacaatattttcagctaggggtagaaacagcaaggaaacagca

SEQ ID NO: 198410 - DNA, 75 bp, Artificial Sequence
  Synthetic
gaggacctcggcatgactgctgcagataaagcagacctcactgcaaccatatcaaagctatctttatcccaatta

SEQ ID NO: 198411 - DNA, 75 bp, Artificial Sequence
  Synthetic
cctaggggtagacaaccaatatccgacccatttgctggagcaaatgacagagaaacaggaggacaagcaactgat

SEQ ID NO: 198412 - DNA, 75 bp, Artificial Sequence
  Synthetic
acccatttgctggagcaaatgacagagaaacaggaggacaagcaactgatacacctgtgtataacttcaatccaa

SEQ ID NO: 198413 - DNA, 75 bp, Artificial Sequence
  Synthetic
tcaataatcggaggtatgacaactatgacagtgatagtgaggacagaattgacaacgatcaagatcaggctatca

SEQ ID NO: 198414 - DNA, 75 bp, Artificial Sequence
  Synthetic
gagagaacagaggagaacctggacaaccaaacaaccagacaagcgaaaaccagcagagactcaatctccctgtac

SEQ ID NO: 198415 - DNA, 75 bp, Artificial Sequence
  Synthetic
tgccaatgatgccacagatgggaatgacatttcacttgagctagttggagattttgattcctaactctcactttc

SEQ ID NO: 198416 - DNA, 75 bp, Artificial Sequence
  Synthetic
acataaccagacatacacatccacaccacccagagacatagctaccatccacacactcacccagacaaatcaaac

SEQ ID NO: 198417 - DNA, 75 bp, Artificial Sequence
  Synthetic
ccacccagagacatagctaccatccacacactcacccagacaaatcaaactagattcaaatcattcggaaacaat

SEQ ID NO: 198418 - DNA, 75 bp, Artificial Sequence
  Synthetic
tctcctagaatttaagaaaaaaacataggcccggacgggttagagatccggtgctcgtctgtggccagacaacct

SEQ ID NO: 198419 - DNA, 75 bp, Artificial Sequence
  Synthetic
taggcccggacgggttagagatccggtgctcgtctgtggccagacaacctccacaccagagccacacaatcatgg

SEQ ID NO: 198420 - DNA, 75 bp, Artificial Sequence
  Synthetic
ttctttaggtaaaggcagcatcccaccaggtgtcacggctgttctaaccaatgcagcagaggcaaaatccaaacc

SEQ ID NO: 198421 - DNA, 75 bp, Artificial Sequence
  Synthetic
agttgctgctggtccagtaaaacccagacggaagaaagtgatcagcaataccactccatacactattgcagacaa

SEQ ID NO: 198422 - DNA, 75 bp, Artificial Sequence
  Synthetic
gatgacagacattgacattgtcactgggaacattacagaaggatcatacaaaggtgtggagcttgccaaattagg

SEQ ID NO: 198423 - DNA, 75 bp, Artificial Sequence
  Synthetic
gaagcaaacactactcacaaggttcacctcgaatgagccagtctcctcagctggatccgcccaagaccccaactt

SEQ ID NO: 198424 - DNA, 75 bp, Artificial Sequence
  Synthetic
atgtggatcctgccccagcatctgcggagaatgtgaaggagatcattgagctcttaaaagggcttgatcttcgcc

SEQ ID NO: 198425 - DNA, 75 bp, Artificial Sequence
  Synthetic
aaagagtttacacaatgttccagtagtaattgctggtccgactagtggaggcttcacagccgaaggcagtgacat

SEQ ID NO: 198426 - DNA, 75 bp, Artificial Sequence
  Synthetic
tcacacgaaagcctgaatccaagaaagatttaacaggcataaaactaaccctgatgcagcttgcaaatgactgca

SEQ ID NO: 198427 - DNA, 75 bp, Artificial Sequence
  Synthetic
tctcgcgtccagataccaagactgagtttgtgactaagattcaagcagcaaccacagaatcacagctcaacgaaa

SEQ ID NO: 198428 - DNA, 75 bp, Artificial Sequence
  Synthetic
gtttgtgactaagattcaagcagcaaccacagaatcacagctcaacgaaatcaaacggtcaataatacgctctgc

SEQ ID NO: 198429 - DNA, 75 bp, Artificial Sequence
  Synthetic
aatataaaatgcggtgcaatcacacaagagacattcaacatgcatccgatcaagatccaaactccttccatccga

SEQ ID NO: 198430 - DNA, 75 bp, Artificial Sequence
  Synthetic
aagagacattcaacatgcatccgatcaagatccaaactccttccatccgaaaacacactcaccactgtcaacacc

SEQ ID NO: 198431 - DNA, 75 bp, Artificial Sequence
  Synthetic
aagaaacaactacagccgaaccatgctcaaccaaaagacccaaacaacatctcaaatcgacagaaggctagacat

SEQ ID NO: 198432 - DNA, 75 bp, Artificial Sequence
  Synthetic
ctcaaccaaaagacccaaacaacatctcaaatcgacagaaggctagacatgataaatttaataaaaaattaaaag

SEQ ID NO: 198433 - DNA, 75 bp, Artificial Sequence
  Synthetic
aagttaagtaaaatttaaagaacacaatagagaaaacctaggtccgaaagcttgcctttcagacagatcccaaaa

SEQ ID NO: 198434 - DNA, 75 bp, Artificial Sequence
  Synthetic
aatagagaaaacctaggtccgaaagcttgcctttcagacagatcccaaaatcatagttcaaacttcaaacacagc

SEQ ID NO: 198435 - DNA, 75 bp, Artificial Sequence
  Synthetic
gggaaactccttaaacagattagaattaggtatctaaatgaacctaactctcgtcatacaccaataactttcatc

SEQ ID NO: 198436 - DNA, 75 bp, Artificial Sequence
  Synthetic
ttaggtatctaaatgaacctaactctcgtcatacaccaataactttcatcaatacgtatggatttgtttatgctc

SEQ ID NO: 198437 - DNA, 75 bp, Artificial Sequence
  Synthetic
gagacacttcaggaggcattcacagcgagatcagcagtgacctagctgcagggtccataacggcatgcatgatga

SEQ ID NO: 198438 - DNA, 75 bp, Artificial Sequence
  Synthetic
gggtccataacggcatgcatgatgacactaggtcctggtccaaatattcagaatgcaaatctagtgctaagatcc

SEQ ID NO: 198439 - DNA, 75 bp, Artificial Sequence
  Synthetic
agaagacatcaagccagagggaggaagcagtgtttgaattagttaacattccaaccttattgagagaacatgctc

SEQ ID NO: 198440 - DNA, 75 bp, Artificial Sequence
  Synthetic
tttgcaaacgcaaaacgttagtatgctctgcagaaaaattcctcaagaacccatcaaagctacaagctggatttg

SEQ ID NO: 198441 - DNA, 75 bp, Artificial Sequence
  Synthetic
ctctgcagaaaaattcctcaagaacccatcaaagctacaagctggatttgaatatgtatacatcccaacttttgt

SEQ ID NO: 198442 - DNA, 75 bp, Artificial Sequence
  Synthetic
ctgagattgctatgcaaatctgactcccctttgatgaaatcttataatgcagatcgaacaggtcgaggatgcctc

SEQ ID NO: 198443 - DNA, 75 bp, Artificial Sequence
  Synthetic
ttgggtcacatccccaagactgcacttccttttttcagcaaagacgggattgcctgtcatccactacaagatgtt

SEQ ID NO: 198444 - DNA, 75 bp, Artificial Sequence
  Synthetic
tcccctactctgacaaaatcactgtggtcagtgggatgtgagatagaatctgccaagttgatacttcaagaatct

SEQ ID NO: 198445 - DNA, 75 bp, Artificial Sequence
  Synthetic
tgccaagttgatacttcaagaatctgatattaatgagctaatgggccaccaggacttgattactgataagattgc

SEQ ID NO: 198446 - DNA, 75 bp, Artificial Sequence
  Synthetic
gagaggtccaaattcagcccattcaaaaaatacgcatcaattccaaacttagaagccatcaactgaatgctccag

SEQ ID NO: 198447 - DNA, 75 bp, Artificial Sequence
  Synthetic
catctaggaatagaacaacaactaagtcataccattattgaccatacaataatcaacaattttagccaactgatt

SEQ ID NO: 198448 - DNA, 75 bp, Artificial Sequence
  Synthetic
actaagatattatcataggtccgaactgatcaatctaacaaaaaaactaaacattcaataataaatcaaagttca

SEQ ID NO: 198449 - DNA, 75 bp, Artificial Sequence
  Synthetic
ctgatcaatctaacaaaaaaactaaacattcaataataaatcaaagttcaggccaaattatccagccatgcatca

SEQ ID NO: 198450 - DNA, 75 bp, Artificial Sequence
  Synthetic
actcctcaatgtaggggtcattcaatcaaagataagatcactcatgtactacactgatggtggcgctagctttat

SEQ ID NO: 198451 - DNA, 75 bp, Artificial Sequence
  Synthetic
tcaaagataagatcactcatgtactacactgatggtggcgctagctttattgttgtaaaattactacccaatctt

SEQ ID NO: 198452 - DNA, 75 bp, Artificial Sequence
  Synthetic
tcaccagtctagatgcatataatgttaccctatttaagttgctaacacccctgattgagaacctgagcaaaattt

SEQ ID NO: 198453 - DNA, 75 bp, Artificial Sequence
  Synthetic
ctgctgttacagataccaaaccccgccgagaacgatttgcaggagtcgttattgggcttgctgcactaggagtag

SEQ ID NO: 198454 - DNA, 75 bp, Artificial Sequence
  Synthetic
ccgagaacgatttgcaggagtcgttattgggcttgctgcactaggagtagctacagctgcacaaataaccgcagc

SEQ ID NO: 198455 - DNA, 75 bp, Artificial Sequence
  Synthetic
tgtagcaatagtaaaagccaatgcaaatgctgctgcgataaacaatcttgcatcttcaattcaatccaccaacaa

SEQ ID NO: 198456 - DNA, 75 bp, Artificial Sequence
  Synthetic
aatgctgctgcgataaacaatcttgcatcttcaattcaatccaccaacaaggcagtatccgatgtgataactgca

SEQ ID NO: 198457 - DNA, 75 bp, Artificial Sequence
  Synthetic
tcaagaacaattgcaaccgcagttcaagcgattcaggatcacatcaatggagccattgtcaacgggataacatct

SEQ ID NO: 198458 - DNA, 75 bp, Artificial Sequence
  Synthetic
gcatcatgccgtgcccatgatgcactaattgggtcaatattaaatttgtatctcactgagcttactacaatattt

SEQ ID NO: 198459 - DNA, 75 bp, Artificial Sequence
  Synthetic
ccaattgtcattgaatccaaactcaacacaaaactcaacacagcagagctgctcagttccggactgttaactggt

SEQ ID NO: 198460 - DNA, 75 bp, Artificial Sequence
  Synthetic
ggtgcgaaggtaattgatctaattgctatctctgcaaaccataaattacaagaagtagttgtacaagttcctaat

SEQ ID NO: 198461 - DNA, 75 bp, Artificial Sequence
  Synthetic
agaattctagaatatgcaaatgaactacaaaactacccagccaatgattgtgtcgtgacaccaaactctgtattt

SEQ ID NO: 198462 - DNA, 75 bp, Artificial Sequence
  Synthetic
tacaaaactacccagccaatgattgtgtcgtgacaccaaactctgtattttgtagatacaatgagggttccccga

SEQ ID NO: 198463 - DNA, 75 bp, Artificial Sequence
  Synthetic
tcaagcgattcgcatttgccaatggtgtgctctatgccaactgcaaatctttgctatgtaagtgtgccgaccctc

SEQ ID NO: 198464 - DNA, 75 bp, Artificial Sequence
  Synthetic
tgtgctctatgccaactgcaaatctttgctatgtaagtgtgccgaccctccccatgttgtgtctcaagatgacaa

SEQ ID NO: 198465 - DNA, 75 bp, Artificial Sequence
  Synthetic
ggattgcagatagcaacttcttcgctaatcaagccagaacagccaagacactttattcactaagtgcaatcgcat

SEQ ID NO: 198466 - DNA, 75 bp, Artificial Sequence
  Synthetic
tgttgtgggattgctgattgcctacatcatcaagctggtttctcaaatccatcaattcagagcactagctgctac

SEQ ID NO: 198467 - DNA, 75 bp, Artificial Sequence
  Synthetic
aacaatgttccacagggagaatcctgccgtcttttccaagaacaatcatggaaacatatatgggatatcttaaga

SEQ ID NO: 198468 - DNA, 75 bp, Artificial Sequence
  Synthetic
gccgtcttttccaagaacaatcatggaaacatatatgggatatcttaagaattctatcataagtccatatatgtc

SEQ ID NO: 198469 - DNA, 75 bp, Artificial Sequence
  Synthetic
catgattgacctttaagagccaacctccaatgattatccgttaaattcagatataacaattcaaaaatcaatatt

SEQ ID NO: 198470 - DNA, 75 bp, Artificial Sequence
  Synthetic
tccaatgattatccgttaaattcagatataacaattcaaaaatcaatattaagcctccagataccaatgaatatg

SEQ ID NO: 198471 - DNA, 75 bp, Artificial Sequence
  Synthetic
aatatatctcttagaaaacttgattattatgtgataacatagtacaatttaagaaaaaacctaaaataagcacga

SEQ ID NO: 198472 - DNA, 75 bp, Artificial Sequence
  Synthetic
attatgtgataacatagtacaatttaagaaaaaacctaaaataagcacgaacccttaaggtgtcgtaacgtctcg

SEQ ID NO: 198473 - DNA, 75 bp, Artificial Sequence
  Synthetic
tgacgccgggttcagttcaaacatcgacccctgacccaattcaatacccattttcataaaggaacacagtataat

SEQ ID NO: 198474 - DNA, 75 bp, Artificial Sequence
  Synthetic
ttttcataaaggaacacagtataatttaatcataaaagacctcaaaatctgatacagcttaatccactcaacata

SEQ ID NO: 198475 - DNA, 75 bp, Artificial Sequence
  Synthetic
tgttcaagtattcttcatgagataattcatcttgatgtttcctctggtcttatgaattctgatgagtcacagcaa

SEQ ID NO: 198476 - DNA, 75 bp, Artificial Sequence
  Synthetic
ttcatcttgatgtttcctctggtcttatgaattctgatgagtcacagcaaggcattattcagcctatcatagaat

SEQ ID NO: 198477 - DNA, 75 bp, Artificial Sequence
  Synthetic
cattaaaatcattgattgctttggccaaccagattctatataatgttgcaatagtaattcctcttaaaattgaca

SEQ ID NO: 198478 - DNA, 75 bp, Artificial Sequence
  Synthetic
caaccagattctatataatgttgcaatagtaattcctcttaaaattgacagtatcgaaactgtaatactctctgc

SEQ ID NO: 198479 - DNA, 75 bp, Artificial Sequence
  Synthetic
tttaaaagatatgcacaccgggagtatgtccaatgccaactgcacgccaggaaatctgcttctgcatgatgcagc

SEQ ID NO: 198480 - DNA, 75 bp, Artificial Sequence
  Synthetic
atgtccaatgccaactgcacgccaggaaatctgcttctgcatgatgcagcatacatcaatggaataaacaaattc

SEQ ID NO: 198481 - DNA, 75 bp, Artificial Sequence
  Synthetic
cttgtacttgaatcatacaatgggacgcctaaatatggacctctcctaaatatacccagctttatcccctcagca

SEQ ID NO: 198482 - DNA, 75 bp, Artificial Sequence
  Synthetic
cgcctaaatatggacctctcctaaatatacccagctttatcccctcagcaacatctccccatgggtgtactagaa

SEQ ID NO: 198483 - DNA, 75 bp, Artificial Sequence
  Synthetic
taccatcattttcactcatcaagacccattggtgttacactcacaatgtaatgcttggagattgtcttgatttca

SEQ ID NO: 198484 - DNA, 75 bp, Artificial Sequence
  Synthetic
atgcttggagattgtcttgatttcacggcatctaaccagtatttatcaatggggataatacaacaatctgctgca

SEQ ID NO: 198485 - DNA, 75 bp, Artificial Sequence
  Synthetic
gctataccaggaggttgtgtcttgtattgctatgtagctacaaggtctgaaaaagaagattatgccacgactgat

SEQ ID NO: 198486 - DNA, 75 bp, Artificial Sequence
  Synthetic
attattataatgatacctttattgaaagagtcatatctcttccaaatacaacagggcagtgggccacaatcaacc

SEQ ID NO: 198487 - DNA, 75 bp, Artificial Sequence
  Synthetic
ctgcagtcggaagcgggatctatcatctaggctttatcttatttcctgtatatggtggtctcataaatgggacta

SEQ ID NO: 198488 - DNA, 75 bp, Artificial Sequence
  Synthetic
tctaggctttatcttatttcctgtatatggtggtctcataaatgggactacttcttacaatgagcagtcctcacg

SEQ ID NO: 198489 - DNA, 75 bp, Artificial Sequence
  Synthetic
ctattttatcccaaaacatcccaacataacttgtgccggtaactccagcaaacaggctgcaatagcacggagttc

SEQ ID NO: 198490 - DNA, 75 bp, Artificial Sequence
  Synthetic
ataacttgtgccggtaactccagcaaacaggctgcaatagcacggagttcctatgtcatccgttatcactcaaac

SEQ ID NO: 198491 - DNA, 75 bp, Artificial Sequence
  Synthetic
aggttaattcagagtgctgttcttatttgtccattgtctgacatgcatacagaagagtgtaatctagttatgttt

SEQ ID NO: 198492 - DNA, 75 bp, Artificial Sequence
  Synthetic
tttgtccattgtctgacatgcatacagaagagtgtaatctagttatgtttaacaattcccaagtcatgatgggtg

SEQ ID NO: 198493 - DNA, 75 bp, Artificial Sequence
  Synthetic
cagaaggtaggctctatgttattggtaataatttgtattattatcaacgcagttcctcttggtggtctgcatcgc

SEQ ID NO: 198494 - DNA, 75 bp, Artificial Sequence
  Synthetic
tcttttacaggatcaatacagatttttctaaaggaattcctccgatcattgaggctcaatgggtaccgtcctatc

SEQ ID NO: 198495 - DNA, 75 bp, Artificial Sequence
  Synthetic
agaactcatgtcacgtaatgctctgaaccccaactatcgatttgctggagcctttctcaaaaatgagtccaaccg

SEQ ID NO: 198496 - DNA, 75 bp, Artificial Sequence
  Synthetic
aaccccaactatcgatttgctggagcctttctcaaaaatgagtccaaccgaactaatcccacattctacactgca

SEQ ID NO: 198497 - DNA, 75 bp, Artificial Sequence
  Synthetic
tcggctaactccctcttaaatactaccggattcaacaacaccaatcacaaagcagcatatacatcttcaacctgc

SEQ ID NO: 198498 - DNA, 75 bp, Artificial Sequence
  Synthetic
ccggattcaacaacaccaatcacaaagcagcatatacatcttcaacctgctttaaaaacactggaacccaaaaaa

SEQ ID NO: 198499 - DNA, 75 bp, Artificial Sequence
  Synthetic
tttattgtttaataataattgaaatgggctcatctcttttaggggagttccaaataataccatttttaagggaac

SEQ ID NO: 198500 - DNA, 75 bp, Artificial Sequence
  Synthetic
gggctcatctcttttaggggagttccaaataataccatttttaagggaactaatgctttaatcctattgaatgaa

SEQ ID NO: 198501 - DNA, 75 bp, Artificial Sequence
  Synthetic
gactccagattcaagaataattggaaggctctttattttatgcgatagttatacgttttggctgtattagaatgc

SEQ ID NO: 198502 - DNA, 75 bp, Artificial Sequence
  Synthetic
atacgttttggctgtattagaatgctatagcattctgctgtttttcccatatggaaaaatccttcaacaccaact

SEQ ID NO: 198503 - DNA, 75 bp, Artificial Sequence
  Synthetic
taggttcaattttctcatcatttactgttgtaattcaatcttactaaagttattctgatatttaagaaaaaataa

SEQ ID NO: 198504 - DNA, 75 bp, Artificial Sequence
  Synthetic
tattctgatatttaagaaaaaataatctttatataatgtaacaatactactaagattataatataggccagaatg

SEQ ID NO: 198505 - DNA, 75 bp, Artificial Sequence
  Synthetic
tttagagcaaccagatggcgtagtcatgcagccgtccttatatggccttcttgtataccattccttgttaaattc

SEQ ID NO: 198506 - DNA, 75 bp, Artificial Sequence
  Synthetic
ccctgaacttgttatttgctttgatcggttgaataatgttttaatgtattttacatttgagatgactttaatggt

SEQ ID NO: 198507 - DNA, 75 bp, Artificial Sequence
  Synthetic
aagtgacatgtttgagggacggatgaatgttgccgcgctctgcactattagtcattacttatcaccactagggcc

SEQ ID NO: 198508 - DNA, 75 bp, Artificial Sequence
  Synthetic
aatgttgccgcgctctgcactattagtcattacttatcaccactagggccaaggatagatagattgttttctatt

SEQ ID NO: 198509 - DNA, 75 bp, Artificial Sequence
  Synthetic
gtagatgaattagcacaactattgggtgacactgtatataaaattattgcatctcttgaatctttagtatatggg

SEQ ID NO: 198510 - DNA, 75 bp, Artificial Sequence
  Synthetic
gtgacactgtatataaaattattgcatctcttgaatctttagtatatgggtgtctacaacttaaagatccagtgg

SEQ ID NO: 198511 - DNA, 75 bp, Artificial Sequence
  Synthetic
ttgaattaacaggatcatttcattcctttattacgcaagagattatagatatcctaattgggtcaaaagcccttg

SEQ ID NO: 198512 - DNA, 75 bp, Artificial Sequence
  Synthetic
atcctaattgggtcaaaagcccttgataaggatgaatcaataactgtcactacacaattgctagatatattttcc

SEQ ID NO: 198513 - DNA, 75 bp, Artificial Sequence
  Synthetic
tttccctacaataatgaaaactcttgcttttttccacacaattttaatcaatggttatcgtagaaagaagaatgg

SEQ ID NO: 198514 - DNA, 75 bp, Artificial Sequence
  Synthetic
aaaaatgcatcaaaaagcttaatagagtttcaacatgataatgctgaaatatcttatgagtatacactcaagcat

SEQ ID NO: 198515 - DNA, 75 bp, Artificial Sequence
  Synthetic
taatagaatgcggtcttgtcaagtaattgcggaagcaattcttgcaaatcacgcaggtactctaatgaaggaaaa

SEQ ID NO: 198516 - DNA, 75 bp, Artificial Sequence
  Synthetic
agcaaagagatatacccgagataacatctcatctcaaggtttccatacaatcaagactgactcaaaaaataagaa

SEQ ID NO: 198517 - DNA, 75 bp, Artificial Sequence
  Synthetic
attcatcttcgtttgattagatctacattatatgttggtgatccattcaatcctcctgccacaactgatgccttc

SEQ ID NO: 198518 - DNA, 75 bp, Artificial Sequence
  Synthetic
caaggagataatcaggcgattgcagttacaacaagagttcctagatcattgcctagtgttcagaaaaaggagtta

SEQ ID NO: 198519 - DNA, 75 bp, Artificial Sequence
  Synthetic
gcctacgcagcaagcaagttattctttgaaagacttagggcaaataattatggtttgggtcatcaactaaaggct

SEQ ID NO: 198520 - DNA, 75 bp, Artificial Sequence
  Synthetic
ttgaaagacttagggcaaataattatggtttgggtcatcaactaaaggctcaagagactataataagttccacgt

SEQ ID NO: 198521 - DNA, 75 bp, Artificial Sequence
  Synthetic
tcttcatatatagtaaacgggtattctatcaaggacgtatactaacacaggcacttaaaaatgctagcaagttat

SEQ ID NO: 198522 - DNA, 75 bp, Artificial Sequence
  Synthetic
ctatcaaggacgtatactaacacaggcacttaaaaatgctagcaagttatgtcttactgcagatgtattaggtga

SEQ ID NO: 198523 - DNA, 75 bp, Artificial Sequence
  Synthetic
atgtactcaggcttcctgctcaaattctgctactacaatcatgagattaacagaaaatggggttgagaaagatac

SEQ ID NO: 198524 - DNA, 75 bp, Artificial Sequence
  Synthetic
tctgctactacaatcatgagattaacagaaaatggggttgagaaagatacatgttataagcttaatatttatcaa

SEQ ID NO: 198525 - DNA, 75 bp, Artificial Sequence
  Synthetic
tctattcgtcaactcacatatgatctaatatttccccaatactccataccaggtgaaacaataagtgaaattttc

SEQ ID NO: 198526 - DNA, 75 bp, Artificial Sequence
  Synthetic
taatatttccccaatactccataccaggtgaaacaataagtgaaattttcttacagcatccaagattaatctcac

SEQ ID NO: 198527 - DNA, 75 bp, Artificial Sequence
  Synthetic
aggtggtcttaattacctcgcatgtagcagattatttaaccgcaatatcggagatccccttggtacagccgtggc

SEQ ID NO: 198528 - DNA, 75 bp, Artificial Sequence
  Synthetic
aggaagaaacagatacaagggttttttgacaccacaaggaccataatgagacgatcatttgagatcaaaccactc

SEQ ID NO: 198529 - DNA, 75 bp, Artificial Sequence
  Synthetic
ttgacaccacaaggaccataatgagacgatcatttgagatcaaaccactctcaactaagaagacactttcagtca

SEQ ID NO: 198530 - DNA, 75 bp, Artificial Sequence
  Synthetic
aatggttccttgattgtaggtacaggagattgtgacttttgtatgcagggtgacgataaattcacttggttcttt

SEQ ID NO: 198531 - DNA, 75 bp, Artificial Sequence
  Synthetic
tagttatactcatatatcaaatgatcaacaatatttagaaatagatcagagagtagtcgattccaatattattta

SEQ ID NO: 198532 - DNA, 75 bp, Artificial Sequence
  Synthetic
gggatcattgagacctaccataacccacctatcaggacctctacacaggaaatcaccctccatttgcacactagc

SEQ ID NO: 198533 - DNA, 75 bp, Artificial Sequence
  Synthetic
gattgcacatctagattatctctcctaccaagctaaaattggaagtacagattactactcacttactgataaaat

SEQ ID NO: 198534 - DNA, 75 bp, Artificial Sequence
  Synthetic
aaatatatttgactatacttacatgactttacgcaggatacccggaactgctctaaataatattgcagctactat

SEQ ID NO: 198535 - DNA, 75 bp, Artificial Sequence
  Synthetic
aaaggtgagaactatacatttccaaaaattaaagggatgccaccagaggaaaagtgtttagtcttaactgaatac

SEQ ID NO: 198536 - DNA, 75 bp, Artificial Sequence
  Synthetic
tgtcatctacagcttggtataaagggataagttattgcagatacctggaaacgcaaaagatacagactggtgatc

SEQ ID NO: 198537 - DNA, 75 bp, Artificial Sequence
  Synthetic
gataagttattgcagatacctggaaacgcaaaagatacagactggtgatcatctttatttagctgaaggaagcgg

SEQ ID NO: 198538 - DNA, 75 bp, Artificial Sequence
  Synthetic
cctcttccaactcaatttgtacagagtgttccatataaattgtggcaagctgatcttgctgatgatagtaactta

SEQ ID NO: 198539 - DNA, 75 bp, Artificial Sequence
  Synthetic
gtgttccatataaattgtggcaagctgatcttgctgatgatagtaacttaataaaagattttgtcccattatgga

SEQ ID NO: 198540 - DNA, 75 bp, Artificial Sequence
  Synthetic
atggaaacggagcagttacagacttatcgacaaaggatgcagttgcattcataatacataaagtaggagcggaga

SEQ ID NO: 198541 - DNA, 75 bp, Artificial Sequence
  Synthetic
atcgacaaaggatgcagttgcattcataatacataaagtaggagcggagaaagcatcccttgttcatatagatct

SEQ ID NO: 198542 - DNA, 75 bp, Artificial Sequence
  Synthetic
attcgttaattatagcaactactgttcttaagaggggtgggatattagtttacaaaacatcatggcttccgtttt

SEQ ID NO: 198543 - DNA, 75 bp, Artificial Sequence
  Synthetic
catctaatacgtagtagttattctgatcctcacagtcatgaggtttatcttgtatgtagacttgctgcggatttt

SEQ ID NO: 198544 - DNA, 75 bp, Artificial Sequence
  Synthetic
aaatggttagagattgatcagttagcatcatttgattcagttcaagatgctctagtgacacttatcaccatacac

SEQ ID NO: 198545 - DNA, 75 bp, Artificial Sequence
  Synthetic
agacacccaccaaaaaatacttacttgatcagcttacaaggacatatatatcaaccttctttaattctcactcag

SEQ ID NO: 198546 - DNA, 75 bp, Artificial Sequence
  Synthetic
aagagcttcaggagcaatctgatgacactccagtacctcttgagacaatcaaacctacaataagggtatttgtca

SEQ ID NO: 198547 - DNA, 75 bp, Artificial Sequence
  Synthetic
ccgctactatgctatggtgggagacattggcaagtacattgaacacagcggaatgggaggttttttcttaacact

SEQ ID NO: 198548 - DNA, 75 bp, Artificial Sequence
  Synthetic
gaatgggaggttttttcttaacacttaaatatggacttggaacaagatggcctacattggctcttgcagcattct

SEQ ID NO: 198549 - DNA, 75 bp, Artificial Sequence
  Synthetic
taaatatggacttggaacaagatggcctacattggctcttgcagcattctctggggaactccagaaattaaaagc

SEQ ID NO: 198550 - DNA, 75 bp, Artificial Sequence
  Synthetic
tcaatactcggaggtatgacaactatgacagtgatggtgaggacagaattgacaacgatcaagatcaagctatca

SEQ ID NO: 198551 - DNA, 75 bp, Artificial Sequence
  Synthetic
gagagaacagaggagagcctggacaactaaacaaccagacaagtgacaaccagcagagactcaatctctccatac

SEQ ID NO: 198552 - DNA, 75 bp, Artificial Sequence
  Synthetic
tgaagagttccaacattcaatgaatcagtacatccgtgccatgcatgagcaatacagaggaccccaggatgatga

SEQ ID NO: 198553 - DNA, 75 bp, Artificial Sequence
  Synthetic
tcacttaaagatacagctgccacccacacactcatccagacaaatcaaaccagactcacatcattcagaaacaat

SEQ ID NO: 198554 - DNA, 75 bp, Artificial Sequence
  Synthetic
acacactcatccagacaaatcaaaccagactcacatcattcagaaacaattctctcataatttaagaaaaaaaca

SEQ ID NO: 198555 - DNA, 75 bp, Artificial Sequence
  Synthetic
gcaagttgatgaactaatccatgctggactgggaacagtagatttcttcctatctagacccatagatgctcaatc

SEQ ID NO: 198556 - DNA, 75 bp, Artificial Sequence
  Synthetic
ttccctaggcaagggcagcatcccaccaggtgtcacagctgttctaactagtgcagcagaggcaaaatccaaacc

SEQ ID NO: 198557 - DNA, 75 bp, Artificial Sequence
  Synthetic
gatgacagacattgacattgtcactgggaccattacagaaggatcgtacaaaggtgtggagcttgctaaattagg

SEQ ID NO: 198558 - DNA, 75 bp, Artificial Sequence
  Synthetic
gatttcaatggatgaactagctagacctacactctcatcaacaaaaaagatcacacgaaagcctgaatccaagaa

SEQ ID NO: 198559 - DNA, 75 bp, Artificial Sequence
  Synthetic
tcaagcggtcaataatacgctctgcaatataaaatgaggtgcaatcacacaagagacactcaacatgcatccaat

SEQ ID NO: 198560 - DNA, 75 bp, Artificial Sequence
  Synthetic
caagatccaaattctgtccatccgaaaacacacccacaattgttaacaccaagaaacaaccacagccgaaccatg

SEQ ID NO: 198561 - DNA, 75 bp, Artificial Sequence
  Synthetic
aaacacacccacaattgttaacaccaagaaacaaccacagccgaaccatgcttaatcaaaagatccaaacaacat

SEQ ID NO: 198562 - DNA, 75 bp, Artificial Sequence
  Synthetic
ctcacatcgacagaaggctggacatgataaatttaataaaaaagaaaaaaaagtcaagtaaaatttaaaggacac

SEQ ID NO: 198563 - DNA, 75 bp, Artificial Sequence
  Synthetic
aatagagaaaatctaggtccgaaagcttgcttcccggacagatctcaaaatcatagtctaaacctcaaacacagc

SEQ ID NO: 198564 - DNA, 75 bp, Artificial Sequence
  Synthetic
gggtctataacagcatgcatgatgacgctaggccctggtccaaatattcagaatgcaaatctagtgctaagatct

SEQ ID NO: 198565 - DNA, 75 bp, Artificial Sequence
  Synthetic
gatcttaatgagctaatgggccaccaggaccttatcactgataagattgccatcagatcaggtcaacggacattt

SEQ ID NO: 198566 - DNA, 75 bp, Artificial Sequence
  Synthetic
catctgagaatagaaccacaattaaatcatactattagtaactatacaataataaacaattttagtcaacagatt

SEQ ID NO: 198567 - DNA, 75 bp, Artificial Sequence
  Synthetic
cccccaagcaatggaacatgcaacattaccagtctagatgcatacaatgttaccctatttaaattactgacaccc

SEQ ID NO: 198568 - DNA, 75 bp, Artificial Sequence
  Synthetic
ctgattgagaacctgagcaaaatctccgctgttacagataccaaaacccgccaagaacgatttgcaggagtcgtt

SEQ ID NO: 198569 - DNA, 75 bp, Artificial Sequence
  Synthetic
gttggacttgctgcattaggagtagccacagctgcacaaataaccgcagctgtagcaatagttaaagctaatgca

SEQ ID NO: 198570 - DNA, 75 bp, Artificial Sequence
  Synthetic
ccacagctgcacaaataaccgcagctgtagcaatagttaaagctaatgcaaatgctgccgcgattaataatcttg

SEQ ID NO: 198571 - DNA, 75 bp, Artificial Sequence
  Synthetic
catcttcaattcaatcaacaaacaaggcagtatccgatgtgatagatgcatcaaaaacaattgcaactgcagttc

SEQ ID NO: 198572 - DNA, 75 bp, Artificial Sequence
  Synthetic
tgttccgacatttataatgcaacccggtgcgaaggtaattgatctaattgctatctctgcaaaccataaattgca

SEQ ID NO: 198573 - DNA, 75 bp, Artificial Sequence
  Synthetic
aggattctagagtatgcaaatgaactacaaaattatccagccaatgactgtgttgtgacaccgaactctgtattc

SEQ ID NO: 198574 - DNA, 75 bp, Artificial Sequence
  Synthetic
atcatcaaactagtttcccaaatccatcaattcagagcgctagctgctacaacaatgttccacagggaaaatcct

SEQ ID NO: 198575 - DNA, 75 bp, Artificial Sequence
  Synthetic
atcaattcagagcgctagctgctacaacaatgttccacagggaaaatcctgccttcttttccaagaacaatcatg

SEQ ID NO: 198576 - DNA, 75 bp, Artificial Sequence
  Synthetic
gaaacatatatgggatatcttaagaaatctatcacaagtccatatatgtccacaattgattcttaagaaccaact

SEQ ID NO: 198577 - DNA, 75 bp, Artificial Sequence
  Synthetic
attatgtgatagtgtagtacaatttaagaaaaaacctaaaataagcacgaacccttaaggtgtcgtaacgtctcg

SEQ ID NO: 198578 - DNA, 75 bp, Artificial Sequence
  Synthetic
tatgtatattgagaaacaattaaaatttgacactattaataaatgtcatgctattttctgtacaataataattaa

SEQ ID NO: 198579 - DNA, 75 bp, Artificial Sequence
  Synthetic
aaaatgttgagcctatttgatacatttaatgcacgtaggcaagaaaacataacaaaatcagctggtggagctatc

SEQ ID NO: 198580 - DNA, 75 bp, Artificial Sequence
  Synthetic
ttaatgcacgtaggcaagaaaacataacaaaatcagctggtggagctatcatccctggacagaaaaatactgtct

SEQ ID NO: 198581 - DNA, 75 bp, Artificial Sequence
  Synthetic
ttagctcttctatttctatctcattcattagataatgagaaacaacatgcacaaagagcagggttcttggtgtct

SEQ ID NO: 198582 - DNA, 75 bp, Artificial Sequence
  Synthetic
aagaattacatacttgattggggatgatgatgttgttttagtttctaaaattatacctacaatcacaccgaattg

SEQ ID NO: 198583 - DNA, 75 bp, Artificial Sequence
  Synthetic
aagtaatgcagatgtcaagtatgtcatatacatgattgagaaagatctaaaacggcaaaagtatggaggatttgt

SEQ ID NO: 198584 - DNA, 75 bp, Artificial Sequence
  Synthetic
accaaacaagagaagaaacttgtctgggaatataaatttaactttaaattaacttaggattaaagacattgacta

SEQ ID NO: 198585 - DNA, 75 bp, Artificial Sequence
  Synthetic
cagatgatttttggagatgcacgtctggtcttccatctttaatgaaaactccaaaaataaggttaatgccagggc

SEQ ID NO: 198586 - DNA, 75 bp, Artificial Sequence
  Synthetic
gggaatataaatttaactttaaattaacttaggattaaagacattgactagaaggtcaagaaaagggaactctat

SEQ ID NO: 198587 - DNA, 75 bp, Artificial Sequence
  Synthetic
atatacatgattgagaaagatctaaaacggcaaaagtatggaggatttgtggttaagacgagagagatgatatat

SEQ ID NO: 198588 - DNA, 75 bp, Artificial Sequence
  Synthetic
gatgttttgttcgaatggattaatataactcatgatgataagagacataaattaggtggaagatataacatattc

SEQ ID NO: 198589 - DNA, 75 bp, Artificial Sequence
  Synthetic
tgttgatggctgtatcagaactccgtccttagttataaatgatctgatttatgcttatacctcaaatctaattac

SEQ ID NO: 198590 - DNA, 75 bp, Artificial Sequence
  Synthetic
acacgtttgggtatccatcatgtttaggagctattataatacagatctggatagttttggtcaaagctatcacta

SEQ ID NO: 198591 - DNA, 75 bp, Artificial Sequence
  Synthetic
agaaaatgggatggtgaagggagagattgaattacttaagagattaacgactatatcaatatcaggagttccacg

SEQ ID NO: 198592 - DNA, 75 bp, Artificial Sequence
  Synthetic
agaatctgacaatatcaagactgaacaacaaaacatcagagacagactaaacaagagactcaacgacaagaagaa

SEQ ID NO: 198593 - DNA, 75 bp, Artificial Sequence
  Synthetic
tcagattgggtcaatcatgcggtcccaacagagcttggtaactcttatggttgagacgttaataacaatgaatac

SEQ ID NO: 198594 - DNA, 75 bp, Artificial Sequence
  Synthetic
actacataagagatgcaggtctcgcttcattcttcaatacaatcagatatggaattgagactagaatggcagctt

SEQ ID NO: 198595 - DNA, 75 bp, Artificial Sequence
  Synthetic
ttcattcttcaatacaatcagatatggaattgagactagaatggcagctttgactctatccactctcagaccgga

SEQ ID NO: 198596 - DNA, 75 bp, Artificial Sequence
  Synthetic
tagtgataaatgatctgatttatgcttacacctcaaatctaattactcgaggttgtcaggatataggaaaatcat

SEQ ID NO: 198597 - DNA, 75 bp, Artificial Sequence
  Synthetic
gtatggaggtcttgaacatccaataaatgagaatgtaatctgcaacacaactgggtgtcccgggaaaacacagag

SEQ ID NO: 198598 - DNA, 75 bp, Artificial Sequence
  Synthetic
gaactgtatttgtcaaagggaccacgcgctccattcatctgtatcctcagagatcccatacatggtgagttcgca

SEQ ID NO: 198599 - DNA, 75 bp, Artificial Sequence
  Synthetic
gcgctccattcatctgtatcctcagagatcccatacatggtgagttcgcaccaggcaactatcctgccatatgga

SEQ ID NO: 198600 - DNA, 75 bp, Artificial Sequence
  Synthetic
ggagactacaaaaagctcgaaatgaggtcacctttaatatggggaaagattataacctgttagaagaccagaaga

SEQ ID NO: 198601 - DNA, 75 bp, Artificial Sequence
  Synthetic
ccaggcaactatcctgccatatggagttatgcaatgggagtggcagttgtacaaaacagagccatgcaacagtat

SEQ ID NO: 198602 - DNA, 75 bp, Artificial Sequence
  Synthetic
ataaccgtcagcagtcatacctgtcggaacaataaagaaaaggacaaaaaaagtcaaatagaagaaatcaaaaac

SEQ ID NO: 198603 - DNA, 75 bp, Artificial Sequence
  Synthetic
aggcttaaactcaattccaaaattaaaggtatggacaatatctatgagacagaattactgggggtcagaaggaag

SEQ ID NO: 198604 - DNA, 75 bp, Artificial Sequence
  Synthetic
agggtgactgcaatggttcaaggagacaatcaagccatagctgtaaccacaagagtacccaacaattatgactac

SEQ ID NO: 198605 - DNA, 75 bp, Artificial Sequence
  Synthetic
gatcattttatcaaagaagaggaataatgaatggttacatcatgaaatcaaagaaggggaaagagattatggagt

SEQ ID NO: 198606 - DNA, 75 bp, Artificial Sequence
  Synthetic
ccatggttttcagataggaggatggtcaactccatcattgttgttgacaaaggcttaaactcaattccaaaatta

SEQ ID NO: 198607 - DNA, 75 bp, Artificial Sequence
  Synthetic
atgagctcaacactggaagatgaacttggagtgacacacgaagccaaagaaagcttgaaaagacatataaggaac

SEQ ID NO: 198608 - DNA, 75 bp, Artificial Sequence
  Synthetic
tggatgcaatatgcttctttaatacctgctagtgttgggggattcaattacatggccatgtcaagatgttttgta

SEQ ID NO: 198609 - DNA, 75 bp, Artificial Sequence
  Synthetic
gagtctcataccaaaaatagaagattctaactcttgtggtgaccaacagatcaagcaatacaagaggttattgga

SEQ ID NO: 198610 - DNA, 75 bp, Artificial Sequence
  Synthetic
aagaacaagatggggaacctcaatcatccataatccaatatgcttgggcagaaggaaacagaagcgacgaccgga

SEQ ID NO: 198611 - DNA, 75 bp, Artificial Sequence
  Synthetic
atattagactcacaaaaatcgagagtgaacccagttataacttactcaacagcaaccgaaagagtaaatgagctg

SEQ ID NO: 198612 - DNA, 75 bp, Artificial Sequence
  Synthetic
ctggatatacaacaacaagctgcattacacactataacaaaggatattgttttcatatagtagaaataaatcata

SEQ ID NO: 198613 - DNA, 75 bp, Artificial Sequence
  Synthetic
gttgtttaaaacagaggttccaaaaagctgcagttaatcataattaaccacaatatgcattaacctatctacaat

SEQ ID NO: 198614 - DNA, 75 bp, Artificial Sequence
  Synthetic
aaaagatttattaaggcgaatctattggaccgaagtgttctttataggattatgaatcaagaaccaggtgagtca

SEQ ID NO: 198615 - DNA, 75 bp, Artificial Sequence
  Synthetic
caaatcatggattcttgggaagaggaatcaagagataaatcaactaatatctcctcggccctcaacatcattgaa

SEQ ID NO: 198616 - DNA, 75 bp, Artificial Sequence
  Synthetic
aatataacagcaagaaatgtattacaagattcaccaaatccattattatctggattattcacaaatacaatgata

SEQ ID NO: 198617 - DNA, 75 bp, Artificial Sequence
  Synthetic
caatggcactgtatctgacatactctaccctgagtgtcatcttaactctcctatcgttaaaggtaaaatagcaca

SEQ ID NO: 198618 - DNA, 75 bp, Artificial Sequence
  Synthetic
cacagacagaaccatcagaaacacaatctcaatcatggaatctcaccatcgacaacaacaccgaccgagctgaac

SEQ ID NO: 198619 - DNA, 75 bp, Artificial Sequence
  Synthetic
caatattagttatcactagacagaaaataaagctcaataaattggataaaagacaacgatctatcagaaaattaa

SEQ ID NO: 198620 - DNA, 75 bp, Artificial Sequence
  Synthetic
tagtggatcaactgacaaaaatagacagtctgggtcatcacacgaatgtacaacagaagcaaaagatagaaatat

SEQ ID NO: 198621 - DNA, 75 bp, Artificial Sequence
  Synthetic
gtagagctgagactgtggtctctggaggaatctccagaagcatcacagattctaaaaatggaacccaaaacacgg

SEQ ID NO: 198622 - DNA, 75 bp, Artificial Sequence
  Synthetic
cacagattctaaaaatggaacccaaaacacggaggatattgatctcaatgaaattagaaagatggataaggactc

SEQ ID NO: 198623 - DNA, 75 bp, Artificial Sequence
  Synthetic
gcagttgtacaaaacagagccatgcaacagtatgtgacgggaagatcatatctagatattgatatgttccagcta

SEQ ID NO: 198624 - DNA, 75 bp, Artificial Sequence
  Synthetic
aaagatggataaggactctattgaggggaaaatgcgacaatctgcagatgttccaagcgagatatcaggaagtga

SEQ ID NO: 198625 - DNA, 75 bp, Artificial Sequence
  Synthetic
ttccaagcgagatatcaggaagtgatggtatatttacaacagaacaaagtagaaacagtgatcatggaagaagct

SEQ ID NO: 198626 - DNA, 75 bp, Artificial Sequence
  Synthetic
ggacaagcagtagcacgtgatgctgaagctcagatgagctcaacactggaagatgaacttggagtgacacacgaa

SEQ ID NO: 198627 - DNA, 75 bp, Artificial Sequence
  Synthetic
tcaaaacatggtttactatcaaatatgatatgagaagattgcaaaaggttcgaaatgagatcacttttaatgttg

SEQ ID NO: 198628 - DNA, 75 bp, Artificial Sequence
  Synthetic
gcaacaccagatgatgaagaagaaatactaatgagaaatagtaggatgaagaaaagttcttcaacacaccaggaa

SEQ ID NO: 198629 - DNA, 75 bp, Artificial Sequence
  Synthetic
gattataacttgttagaagaccagaagaatttcttattgatacatccagaattggttttgatattagataaacaa

SEQ ID NO: 198630 - DNA, 75 bp, Artificial Sequence
  Synthetic
ataatgagaaacaacatgcacaaagggcagggttcttggtgtccttattgtcaatggcttatgccaatccagagc

SEQ ID NO: 198631 - DNA, 75 bp, Artificial Sequence
  Synthetic
actggaagatgaacttggagtgacacacgaagccaaagaaagcctgaaaagacatataaggaacataaacagttc

SEQ ID NO: 198632 - DNA, 75 bp, Artificial Sequence
  Synthetic
gaaaagggaaagactggtttaagaaatcaaaagacactgacaaccagacatcaacatcagatcacagatccacat

SEQ ID NO: 198633 - DNA, 75 bp, Artificial Sequence
  Synthetic
atataagctcatgtgctaagttagatccgaaattacaatctatgtatcagaaaggtaataacctgtgggaagtga

SEQ ID NO: 198634 - DNA, 75 bp, Artificial Sequence
  Synthetic
tccacatcaaaagggcagaagaaaatctcaaagacaacaaccaccaacaccgacacaaaggggcaaacagaaata

SEQ ID NO: 198635 - DNA, 75 bp, Artificial Sequence
  Synthetic
agaaaagacatttgatgtgatatcattattagaaccacttgcattatccttaattcaaactcatgatcctgttaa

SEQ ID NO: 198636 - DNA, 75 bp, Artificial Sequence
  Synthetic
cgaacaaactctgaatccaagcccaagacacaaaagacaaatggaaaggaaaggaaggatacagaagagagcaat

SEQ ID NO: 198637 - DNA, 75 bp, Artificial Sequence
  Synthetic
agcaactaatcgaatcaatattttgattcaaatcaataataaataagaaaaacttaggattaaagaatcctatca

SEQ ID NO: 198638 - DNA, 75 bp, Artificial Sequence
  Synthetic
agacacaaaagacaaatggaaaggaaaggaaggatacagaagagagcaatcgatttacagagagggcaattactc

SEQ ID NO: 198639 - DNA, 75 bp, Artificial Sequence
  Synthetic
ggagctatgcaatgggggtggcagttgtacaaaatagagccatgcaacagtatgtgacgggaagatcatatctag

SEQ ID NO: 198640 - DNA, 75 bp, Artificial Sequence
  Synthetic
aatttatttatgataaagacccgctcaaagatgtggacttatcaagacttatggttattaaagaccattcttata

SEQ ID NO: 198641 - DNA, 75 bp, Artificial Sequence
  Synthetic
aagccagagcaaataagagataatcaaaaacttaggacaaaagaagtcaacactaacaactgtcagtagtcatac

SEQ ID NO: 198642 - DNA, 75 bp, Artificial Sequence
  Synthetic
gatctatatcgacatgcaggagatacactagagaacgatgtacaagttaaatcagagatattaagttcatacaat

SEQ ID NO: 198643 - DNA, 75 bp, Artificial Sequence
  Synthetic
aggaaaagatcaagaaaaccaggtttgacccgcttatggaagcacaaggcatcgacaagaacatacccgacctat

SEQ ID NO: 198644 - DNA, 75 bp, Artificial Sequence
  Synthetic
caaaaatcgagagtcaacccagtcataacttactcaacagcaaccgaaagggtaaacgagctggccatccgaaac

SEQ ID NO: 198645 - DNA, 75 bp, Artificial Sequence
  Synthetic
gaattaatggacatgttcaatgaagatgtcaacaattgccaatgatccaacaaagaaacgacaccgaacaaacag

SEQ ID NO: 198646 - DNA, 75 bp, Artificial Sequence
  Synthetic
atggttgaatggtgtatcacttgaaatatacatttgtgacagcgatatggaagtagcaaatgataggaaacaagc

SEQ ID NO: 198647 - DNA, 75 bp, Artificial Sequence
  Synthetic
atgtcaacaattgccaatgatccaacaaagaaacgacaccgaacaaacagacaagaaacaacagtagatcaaaac

SEQ ID NO: 198648 - DNA, 75 bp, Artificial Sequence
  Synthetic
gttgcagtcatcaacaacagcaatctctcacaaagcacaaaacaatcatatataaacgaactcaaacattgcaaa

SEQ ID NO: 198649 - DNA, 75 bp, Artificial Sequence
  Synthetic
ctgtcaacacacacaaaatcaagcagaatgaaacaacagatatcaatcaatatacaaataagaaaaacttaggat

SEQ ID NO: 198650 - DNA, 75 bp, Artificial Sequence
  Synthetic
aattggatgcaatatgcctctttaatacctgctagtgttgggggattcaattacatggccatgtcaagatgtttt

SEQ ID NO: 198651 - DNA, 75 bp, Artificial Sequence
  Synthetic
acggatcccggtatttagatgtcttcttactcggcttcttcgagatggaacgaatcaaagacaaatacgggagtg

SEQ ID NO: 198652 - DNA, 75 bp, Artificial Sequence
  Synthetic
atggtcatatagaaccattaccactcaaagtcaatgaacagagaaaggcagtacctcacattagagttgccaaaa

SEQ ID NO: 198653 - DNA, 75 bp, Artificial Sequence
  Synthetic
atttacaacagaacaaagtagaaacagtgatcatggaagaagcttggaatctatcagtacacctgatacaagatc

SEQ ID NO: 198654 - DNA, 75 bp, Artificial Sequence
  Synthetic
tgaatgatctcgacagtgacccgagttacaaagtttgtggctctggatcattaccaatcggattggctaagtaca

SEQ ID NO: 198655 - DNA, 75 bp, Artificial Sequence
  Synthetic
ttaccaatcggattggctaagtacactgggaatgaccaggaattgttacaagccgcaaccaaactggatatagaa

SEQ ID NO: 198656 - DNA, 75 bp, Artificial Sequence
  Synthetic
gtttgtggctctggatcattaccaatcggactggccaaatacactgggaatgaccaggaattattacaggctgca

SEQ ID NO: 198657 - DNA, 75 bp, Artificial Sequence
  Synthetic
gaaggattttgtcaaaaattatggacactcatatctataagtgcaatacatctagcagctgttagaataggtgtg

SEQ ID NO: 198658 - DNA, 75 bp, Artificial Sequence
  Synthetic
tcaaaacctgtcaatacacacaaaatcaagcagaatgaaacaatagacatcaatcaatatacaaataagaaaaac

SEQ ID NO: 198659 - DNA, 75 bp, Artificial Sequence
  Synthetic
tggatgagaaaggcgaaaaatcactgaatttcatggtccatctcggattgatcaaaagaaaagtaggcagaatgt

SEQ ID NO: 198660 - DNA, 75 bp, Artificial Sequence
  Synthetic
tcacacaacttataaatcagataaatggtataatccattcaagacatggtttaccatcaagtatgatatgaggag

SEQ ID NO: 198661 - DNA, 75 bp, Artificial Sequence
  Synthetic
atggttatctaattactcctgaattagtattgatgtattgtgacgtaatcgaaggccgatggaatataagtgcat

SEQ ID NO: 198662 - DNA, 75 bp, Artificial Sequence
  Synthetic
accaggtttgacccgcttatggaagcacaaggcatcgacaagaacatacccgacctatatcgacatgcaggaaac

SEQ ID NO: 198663 - DNA, 75 bp, Artificial Sequence
  Synthetic
acactagagaatgatgtacaagtcaaatcagagatattaagttcatacaatgagtcaaatgcaacaagactaata

SEQ ID NO: 198664 - DNA, 75 bp, Artificial Sequence
  Synthetic
aacaccgaccgagctgaacagacaaatacaactcctccaacagccactcccagatcaaccaatacaaaagaatca

SEQ ID NO: 198665 - DNA, 75 bp, Artificial Sequence
  Synthetic
aacaatggaactagtaatctctattttagtccggacgtatctattaagccgaagcaaataaaggataatcaaaaa

SEQ ID NO: 198666 - DNA, 75 bp, Artificial Sequence
  Synthetic
cttaggacaaaagaggtcaataccaacaactattagcagtcacactcgcaagaataagagagaagggaccaaaaa

SEQ ID NO: 198667 - DNA, 75 bp, Artificial Sequence
  Synthetic
acaactattagcagtcacactcgcaagaataagagagaagggaccaaaaaagtcaaataggagaaatcaaaacaa

SEQ ID NO: 198668 - DNA, 75 bp, Artificial Sequence
  Synthetic
tttgttcgaatggattaatataactcatgatgataagagacataaattaggtggaagatataacatattcccact

SEQ ID NO: 198669 - DNA, 75 bp, Artificial Sequence
  Synthetic
gatattttctttgggattagttggaggaattagtcttcatgtcaatgcaactggatctatatcaaaaacactagc

SEQ ID NO: 198670 - DNA, 75 bp, Artificial Sequence
  Synthetic
ctagttatctgggcttcatcagtagagattacaagagtggatgcaattttccaaccttctttacctggcgagttc

SEQ ID NO: 198671 - DNA, 75 bp, Artificial Sequence
  Synthetic
tagcaaatgtactaaacaatgtagatactgcatcaaagatagacttcctggcaggattagtcataggggtttcaa

SEQ ID NO: 198672 - DNA, 75 bp, Artificial Sequence
  Synthetic
agatactatcctaacattattgcaaaaggagttgggaaaatcaaacaatggaattaataatctttactttgatct

SEQ ID NO: 198673 - DNA, 75 bp, Artificial Sequence
  Synthetic
aaggagttgggaaaatcaaacaatggaattaataatctttactttgatctagatatacccactaagccagagcaa

SEQ ID NO: 198674 - DNA, 75 bp, Artificial Sequence
  Synthetic
caacttcaatactgctaattattacaaccatgatcatggcatctttctgccaaatagatatcacaaaactacagc

SEQ ID NO: 198675 - DNA, 75 bp, Artificial Sequence
  Synthetic
gaattaataatctttactttgatctagatatacccactaagccagagcaaataagggataatcaaaaacttagga

SEQ ID NO: 198676 - DNA, 75 bp, Artificial Sequence
  Synthetic
ctccattttgatctagatatacccattaagccagagtaaataagggataatcaaaaacttaggacaaaagaagtc

SEQ ID NO: 198677 - DNA, 75 bp, Artificial Sequence
  Synthetic
aaaatgagtataactaactctgcaatatacacattcccagagtcatcattttctgagaatggtcatatagaacca

SEQ ID NO: 198678 - DNA, 75 bp, Artificial Sequence
  Synthetic
tttgaaacaagatatctaattttgagcctcataccaaaaatagaagactctaactcttgtggtgaccaacagatc

SEQ ID NO: 198679 - DNA, 75 bp, Artificial Sequence
  Synthetic
gacaaaatcactaattcgggttggtataaatagagggggactgacatatagtttgttgaggaaaatcagtaatta

SEQ ID NO: 198680 - DNA, 75 bp, Artificial Sequence
  Synthetic
taatcaaaaacttaggacaaaagaagtcaacaccaacagctattagcagtcatacttgtcggaacaagaaagaag

SEQ ID NO: 198681 - DNA, 75 bp, Artificial Sequence
  Synthetic
ctttggaggggtaattggaaccattgctctgggagtagcaacctcagcacaaattacagcggcagttgctctggt

SEQ ID NO: 198682 - DNA, 75 bp, Artificial Sequence
  Synthetic
gctctgggagtagcaacctcagcacaaattacagcggcagttgctctggttgaagccaagcaggcaagatcagac

SEQ ID NO: 198683 - DNA, 75 bp, Artificial Sequence
  Synthetic
accaaacaagagaagaaacttgcttgggaatataaatttaaattaaaattaacttaggattaaagacattgactg

SEQ ID NO: 198684 - DNA, 75 bp, Artificial Sequence
  Synthetic
caaaagagaccggcaacacagcaaacaccgaacacaatgctagcttcaacattgttaattattacaaccatgatt

SEQ ID NO: 198685 - DNA, 75 bp, Artificial Sequence
  Synthetic
atcgaaaaactcaaagaagcaattagggacacaaacaaagcagtgcagtcagttcagagctccataggaaattta

SEQ ID NO: 198686 - DNA, 75 bp, Artificial Sequence
  Synthetic
atgaagatatcacaaaacttcgaaacaagatatctaatcttgagtctcataccaaaaatagaagattctaactct

SEQ ID NO: 198687 - DNA, 75 bp, Artificial Sequence
  Synthetic
acaagaggttattggatagactgatcattcctttatatgatggactaagattacagaaggatgtgatagtgacta

SEQ ID NO: 198688 - DNA, 75 bp, Artificial Sequence
  Synthetic
attaggaattcctaggcaatataaagaacccgaagaacagttattagaaaactacaatcaacatgatgaatttga

SEQ ID NO: 198689 - DNA, 75 bp, Artificial Sequence
  Synthetic
aaaataatatttctcgggtatggaggtcttgaacatccaataaatgagaatgcaatctgcaacacaactgggtgt

SEQ ID NO: 198690 - DNA, 75 bp, Artificial Sequence
  Synthetic
gagacactacttgcaaacaatataggaaaattctttcaagaaaatgggatggtgaagggagagattgaattactt

SEQ ID NO: 198691 - DNA, 75 bp, Artificial Sequence
  Synthetic
aacagaaattccaaaagaaaccggcaacacaacaaacaccgaacacaatgctaacttcaacattgttaattatta

SEQ ID NO: 198692 - DNA, 75 bp, Artificial Sequence
  Synthetic
aaggataatcaaaaacttaggacaaaagaagtcaacgccaacaactattagcagtcatacttgtcggagcaagaa

SEQ ID NO: 198693 - DNA, 75 bp, Artificial Sequence
  Synthetic
aagcaggcaagatcagacattgaaaaactcaaggaagcaatcagggacacaaacaaagcagtgcagtcagttcag

SEQ ID NO: 198694 - DNA, 75 bp, Artificial Sequence
  Synthetic
ccctccaagtcagactccctttattaactaggctgctgaacactcagatctacaaagtagattccatatcatata

SEQ ID NO: 198695 - DNA, 75 bp, Artificial Sequence
  Synthetic
gcacaaacacgtgcaaattttacactagatagtctaaaaattttaactccagtagctacatcaacaaatttatca

SEQ ID NO: 198696 - DNA, 75 bp, Artificial Sequence
  Synthetic
gcgagactaggttgtgaagcagcaggacttcagttagggatcgcattaacacagcattactcagaattaacaaac

SEQ ID NO: 198697 - DNA, 75 bp, Artificial Sequence
  Synthetic
catgtttaggagctcttataatacagatctggatagttttggtcaaagctatcactagtatctcagggttaagaa

SEQ ID NO: 198698 - DNA, 75 bp, Artificial Sequence
  Synthetic
atatttggtgataacataggatcgttacaagaaaaaggaataaaattacaaggtatagcatcattataccgcaca

SEQ ID NO: 198699 - DNA, 75 bp, Artificial Sequence
  Synthetic
cagcagctatatatgcccttctgatccaggatttgtattaaaccatgaaatagagagctgcttatcaggaaacat

SEQ ID NO: 198700 - DNA, 75 bp, Artificial Sequence
  Synthetic
caacagttgataaatatgatatttatgatctattatttacagaatcaataaaggtgagagttatagatgttgatt

SEQ ID NO: 198701 - DNA, 75 bp, Artificial Sequence
  Synthetic
acaatagtggatgctattttccaaccttctttacctggcgagttcagatactatcccaatattattgcagaagga

SEQ ID NO: 198702 - DNA, 75 bp, Artificial Sequence
  Synthetic
atttatttagattaaaagaaaccacaggacacaaccctatagttatgcatctgcacatagaggatgagtgttgta

SEQ ID NO: 198703 - DNA, 75 bp, Artificial Sequence
  Synthetic
tagcacttaagaactatcaagtccttaaaaatcagatctataacaagtgattctgatagtaatgatgaattagat

SEQ ID NO: 198704 - DNA, 75 bp, Artificial Sequence
  Synthetic
gaagaacagtcaaagcaaaagagatgattgtttatacagtacaaaatataaaaccagaactgtacccatggtcta

SEQ ID NO: 198705 - DNA, 75 bp, Artificial Sequence
  Synthetic
gaaggtcaagaaaagggaactctacaatttcaaaaatgttgagcctatttgatacatttaatgcacgtaggcaag

SEQ ID NO: 198706 - DNA, 75 bp, Artificial Sequence
  Synthetic
tacccattaaggctgagtaaataagggataatcaaaaacttaggacaaaagaagtccacaccaacagctattatc

SEQ ID NO: 198707 - DNA, 75 bp, Artificial Sequence
  Synthetic
accaaacaagagaagaaacttgtctggtaatataaatttaaattaaaattaacttaggattaaagacattgacta

SEQ ID NO: 198708 - DNA, 75 bp, Artificial Sequence
  Synthetic
cccagccatatcatgacgaaaggggcatttctaggtggagcagatgtcaaagaatgcatagaagcattcagcagt

SEQ ID NO: 198709 - DNA, 75 bp, Artificial Sequence
  Synthetic
cggcaacacagcaaacaccgaacacaatgctagcttcaacattgttaattattacaaccatgattatggcatcac

SEQ ID NO: 198710 - DNA, 75 bp, Artificial Sequence
  Synthetic
atgtaatacaataggtatcaacggaatgctgttcaacacaaacaaagaaggaactcttgcattctacacaccaga

SEQ ID NO: 198711 - DNA, 75 bp, Artificial Sequence
  Synthetic
gaaattgaaacaaaaaatacagaacaccagaacaacaagatcaaaacatccaatccactcaaaacaaaaatttca

SEQ ID NO: 198712 - DNA, 75 bp, Artificial Sequence
  Synthetic
tctgatggaactgtatttatcaaagggaccacgcgctcctttcatctgtatcctcagagatcctatacatggtga

SEQ ID NO: 198713 - DNA, 75 bp, Artificial Sequence
  Synthetic
atggttattagagaccattcttacacaattgatatgaattattgggatgatactgacatcatacatgcaatttca

SEQ ID NO: 198714 - DNA, 75 bp, Artificial Sequence
  Synthetic
atcataattattttgataatgatcattatattgtttataattaatataacgataattacaattgcaattaagtat

SEQ ID NO: 198715 - DNA, 75 bp, Artificial Sequence
  Synthetic
gataattacaattgcaattaagtattacagaattcaaaagagaaatcgagtggatcaaaatgacaagccatatgt

SEQ ID NO: 198716 - DNA, 75 bp, Artificial Sequence
  Synthetic
caacaaggccaaatcagatctagaagaatcaaaagaatggataagaaggtcaaatcaaaaactagattctattgg

SEQ ID NO: 198717 - DNA, 75 bp, Artificial Sequence
  Synthetic
agatcattagatattaaaattataaaaaacttaggagtaaagttacgcaatccaactctactcatataattgagg

SEQ ID NO: 198718 - DNA, 75 bp, Artificial Sequence
  Synthetic
ctcaatcatctataatccaatatgcttgggcagaaggaaacagaagcgatgatcggactgagcaagctacagaat

SEQ ID NO: 198719 - DNA, 75 bp, Artificial Sequence
  Synthetic
aaacaaagaaggaactcttgcattctacacaccagacgacataacattaaacaattctgttgcacttgatccaat

SEQ ID NO: 198720 - DNA, 75 bp, Artificial Sequence
  Synthetic
tttaagaatattcaacaactgtatattgctcttgggatgaatatcaatccaactataacacagaatatcaaagat

SEQ ID NO: 198721 - DNA, 75 bp, Artificial Sequence
  Synthetic
acaattctgttgcacttgatccaattgacatatcaatcgagctcaacaaggccaaatcagatctagaggaatcaa

SEQ ID NO: 198722 - DNA, 75 bp, Artificial Sequence
  Synthetic
tgacatatcaatcgagctcaacaaggccaaatcagatctagaggaatcaaaagaatggataagaaggtcaaatca

SEQ ID NO: 198723 - DNA, 75 bp, Artificial Sequence
  Synthetic
tcgagatggaatactggaagcataccaatcacggaaaggatgctggtaatgagctggagacgtctatggctactc

SEQ ID NO: 198724 - DNA, 75 bp, Artificial Sequence
  Synthetic
gcagtcaaccacccaccaattccacaaacagaacggaccaggacgaaatagatgatctgtttaatgcatttggaa

SEQ ID NO: 198725 - DNA, 75 bp, Artificial Sequence
  Synthetic
aagaatggataagaaggtcaaatcaaaagctagattctattggaagttggcatcaatctagcactacaatcatag

SEQ ID NO: 198726 - DNA, 75 bp, Artificial Sequence
  Synthetic
tccaaatcaataataaataagaaaaacttaggattaaagaatcctatcataccggaatatagggtggtaaattta

SEQ ID NO: 198727 - DNA, 75 bp, Artificial Sequence
  Synthetic
atatatatttgtgacagcgatatggaagttgcaaatgataggaaacaagccttcatttctagacatctttcattt

SEQ ID NO: 198728 - DNA, 75 bp, Artificial Sequence
  Synthetic
caatagagatatatcctaacctttatcctcaagcctaaggatagataaaaagtaagaaaaacatgtaatatatat

SEQ ID NO: 198729 - DNA, 75 bp, Artificial Sequence
  Synthetic
ttctttataggattatgaatcaagaaccaggtgagtcatcctttttggactgggcttcagacccatattcatgca

SEQ ID NO: 198730 - DNA, 75 bp, Artificial Sequence
  Synthetic
aacaaatgacacatctgtagatcattaaatattaaaattataaaaaacttaggagtaaagttacgcaactcaact

SEQ ID NO: 198731 - DNA, 75 bp, Artificial Sequence
  Synthetic
ttgtttccaattatgggggaaaagacatttgatgtaatatcattattagaaccacttgcattatccctaattcaa

SEQ ID NO: 198732 - DNA, 75 bp, Artificial Sequence
  Synthetic
tctacggattcgcggtattagtccacctgaggtaattgatgattgggatccggtagaagatgagaatatgctgga

SEQ ID NO: 198733 - DNA, 75 bp, Artificial Sequence
  Synthetic
ttcaacattgttaattattacaaccatgattatggcatcacactgccaaatagacatcacaaaactacagcatgt

SEQ ID NO: 198734 - DNA, 75 bp, Artificial Sequence
  Synthetic
gttcaaattctgcaatatcatatgaaaatgctgttgattattaccagagctttataggaataaaatttaataaat

SEQ ID NO: 198735 - DNA, 75 bp, Artificial Sequence
  Synthetic
taacattgttaaaactatcaatgataactgtaataaagataataaagggaataaagttaacaatttctggggatt

SEQ ID NO: 198736 - DNA, 75 bp, Artificial Sequence
  Synthetic
tatatatgcccttctgatccaggatttgtactaaaccatgaaatggagagctgtttatcaggaaacatatcccaa

SEQ ID NO: 198737 - DNA, 75 bp, Artificial Sequence
  Synthetic
acataaataatgagtttatggaagttacagaaaagatccaagtggcatcggataatactaatgatctaatacagt

SEQ ID NO: 198738 - DNA, 75 bp, Artificial Sequence
  Synthetic
aaaatcagatctataacaagtgattctgatgataatgatagactagatgctagtacaaatagtttgacacttcct

SEQ ID NO: 198739 - DNA, 75 bp, Artificial Sequence
  Synthetic
aactgtaataaagataataaagggaataaagttaacaatttctggggattagcatttaaaaactatcaagttctt

SEQ ID NO: 198740 - DNA, 75 bp, Artificial Sequence
  Synthetic
ctgatgataatgatagactagatgctagtacaaatagtttgacacttcctcaaggaggaaattatctgtcgcatc

SEQ ID NO: 198741 - DNA, 75 bp, Artificial Sequence
  Synthetic
aattgagattattcggaatcaacagcactagttgtctgaaagcccttgagttatcacaaattttaatgaaggaag

SEQ ID NO: 198742 - DNA, 75 bp, Artificial Sequence
  Synthetic
tgacccattagaattattatctggggtagtaataacaggatcagaacattgtaaaatatgttattcttcagatgg

SEQ ID NO: 198743 - DNA, 75 bp, Artificial Sequence
  Synthetic
tgaaattacaattagaaatgataatcaagaagtgccaccacaaagaataacacatgatgtgggtataaaaccttt

SEQ ID NO: 198744 - DNA, 75 bp, Artificial Sequence
  Synthetic
aaatccagatgatttctggagatgcacgtctggtcttccatctttgatgaaaactccaaaaataagattaatgcc

SEQ ID NO: 198745 - DNA, 75 bp, Artificial Sequence
  Synthetic
cagcagaaacaggtgtatcatcattaagagttccttattttggatcagtcactgatgaaagatctgaggcacaat

SEQ ID NO: 198746 - DNA, 75 bp, Artificial Sequence
  Synthetic
tcgaaagacgcatattgtactataatggaacctagtgaagttgttttatcaaaacttaaaagattgtcactcttg

SEQ ID NO: 198747 - DNA, 75 bp, Artificial Sequence
  Synthetic
attactcgaggttgccaggatataggaaaatcatatcaagtattacagatagggataataactgtaaactcagac

SEQ ID NO: 198748 - DNA, 75 bp, Artificial Sequence
  Synthetic
tctcatcatggaatctcatcatcgacaacaacaccgaccgaaccgaacagacaagcacaacccccccaacaacaa

SEQ ID NO: 198749 - DNA, 75 bp, Artificial Sequence
  Synthetic
aaataaagatatatctgaacccttatctccaagcctaaggatagacaaaaagtaagaaaaacatgtaatatatat

SEQ ID NO: 198750 - DNA, 75 bp, Artificial Sequence
  Synthetic
ttggtacctgacttaaatcctaggatctctcataccttcaacataaatgacaatagaaagtcatgttctctagca

SEQ ID NO: 198751 - DNA, 75 bp, Artificial Sequence
  Synthetic
gaaactgttctacatgaacattatagtgttataagaattacatacttgattggagatgatgatgttgttttagtt

SEQ ID NO: 198752 - DNA, 75 bp, Artificial Sequence
  Synthetic
aaaccaaagataccaatcttatttatcaacaaatcatgttaacaggattaagtgttttcgaatatttatttagat

SEQ ID NO: 198753 - DNA, 75 bp, Artificial Sequence
  Synthetic
tggacatgttcaatgaggatgtcaacaattgctaatgatccaataaagaaacaacaccgaacaaatagacaagaa

SEQ ID NO: 198754 - DNA, 75 bp, Artificial Sequence
  Synthetic
atcctgcatcaacagaattatatctaatttcgaaagatgcatattgtactataatggaacctagtgaagttgttt

SEQ ID NO: 198755 - DNA, 75 bp, Artificial Sequence
  Synthetic
aatattgttaattattacaaccatgatcatggcatcacactgccaaatagacatcacaaaactacagcatgtagg

SEQ ID NO: 198756 - DNA, 75 bp, Artificial Sequence
  Synthetic
gatggtcaactctataattgttgttgacaagggtttaaactcagttccaaaattgaaggtatggacgatatctat

SEQ ID NO: 198757 - DNA, 75 bp, Artificial Sequence
  Synthetic
ttgaaagaagaaaagatcaagaaaaccaggtttgacccacttatggaggcacaaggcattgacaaaaatataccc

SEQ ID NO: 198758 - DNA, 75 bp, Artificial Sequence
  Synthetic
agatctacatatacacaagatctacaagttggcacagcaagttacaattaggaataattgacattactgactaca

SEQ ID NO: 198759 - DNA, 75 bp, Artificial Sequence
  Synthetic
ggtaacttttaatatggggaaagattataacttgttggaagatcagaagaatttcttattgatacatccagaatt

SEQ ID NO: 198760 - DNA, 75 bp, Artificial Sequence
  Synthetic
gtgatataaggataaaatggacatggcataatgtgctatcaagaccaggaaacaatgaatgtccatggggacatt

SEQ ID NO: 198761 - DNA, 75 bp, Artificial Sequence
  Synthetic
aaaggaaagttaagactgctatcgagaagactagtattaagttggatttcattatcattatcgactcgattactt

SEQ ID NO: 198762 - DNA, 75 bp, Artificial Sequence
  Synthetic
caacagacgaatccaaattcgaaatggaatactggaagcacaccaaccacggaaaggatgctggtaatgagctgg

SEQ ID NO: 198763 - DNA, 75 bp, Artificial Sequence
  Synthetic
taaggaaacgacaccgaacaaacagacaagaaacaacagtagatcaaaacctgtcaacacatacaaaatcaagca

SEQ ID NO: 198764 - DNA, 75 bp, Artificial Sequence
  Synthetic
ggtataatccattcaaaacatggtttactatcaagtatgatatgagaagattacaaaaagctcgaaatgagatca

SEQ ID NO: 198765 - DNA, 75 bp, Artificial Sequence
  Synthetic
cattatctcatcctaaagtattcaagagattctgggattgtggagtcttaaaccctatctacggtcctaatactg

SEQ ID NO: 198766 - DNA, 75 bp, Artificial Sequence
  Synthetic
aggaaaatacacgtttatcagatacccagaaatgtcaaaagaaatgttcaaattacatatacccggtattaacag

SEQ ID NO: 198767 - DNA, 75 bp, Artificial Sequence
  Synthetic
catcgattaaaacataaatacaataaagatatatcctaacctttatctttaagcctattgatagataaaaagtaa

SEQ ID NO: 198768 - DNA, 75 bp, Artificial Sequence
  Synthetic
cccatgttgttcaaaacagagattccaaaaagctgcagttaatcataattaaccataatatgtattaacctatct

SEQ ID NO: 198769 - DNA, 75 bp, Artificial Sequence
  Synthetic
aacaaaatcagctggtggagctatcatccctggacagaaaaatactgtctctatattcgctcttggaccgacaat

SEQ ID NO: 198770 - DNA, 75 bp, Artificial Sequence
  Synthetic
ggatataggaaaatcatatcaagtattacagatagggataataactgtaaactcagacttggtacctgacttaaa

SEQ ID NO: 198771 - DNA, 75 bp, Artificial Sequence
  Synthetic
ggaatataaaaaacttaggagcaaagcgtgctcgaaacatggacactgaatctaacaatggcactgtgtctgaca

SEQ ID NO: 198772 - DNA, 75 bp, Artificial Sequence
  Synthetic
aaatgagtataactaactctgcaatatacacattcccagaatcatcattctctgagaatggtcatatagaaccat

SEQ ID NO: 198773 - DNA, 75 bp, Artificial Sequence
  Synthetic
tctaacaatggcactgtgtctgacatactctatcctgagtgtcaccttaactctcctatcgttaaaggtaaaata

SEQ ID NO: 198774 - DNA, 75 bp, Artificial Sequence
  Synthetic
tcctaggatctctcataccttcaacataaatgacaatagaaagtcatgttctctagcactcctaaatacagatgt

SEQ ID NO: 198775 - DNA, 75 bp, Artificial Sequence
  Synthetic
acataaatacaataaagatatatcctaacctttatctttaagcctattgatagataaaaagtaagaaaaacatgt

SEQ ID NO: 198776 - DNA, 75 bp, Artificial Sequence
  Synthetic
gtgagtgatttaggaaaatacacatttatcagatacccagaaatgtcaaaagaaatgttcaaattacatataccc

SEQ ID NO: 198777 - DNA, 75 bp, Artificial Sequence
  Synthetic
attaagacacaaatacaatagagatatatcctaacctttatccccaagcctaaggatagataaaaagtaagaaaa

SEQ ID NO: 198778 - DNA, 75 bp, Artificial Sequence
  Synthetic
attacaatctatgtatcaaaaaggtaataatctgtgggaagtgatagataaattgtttccaattatgggagaaaa

SEQ ID NO: 198779 - DNA, 75 bp, Artificial Sequence
  Synthetic
tcaatggcatcactatctctacccaacacaatatcaatcaatctgcaggtacacatcaaaacaggggttcagact

SEQ ID NO: 198780 - DNA, 75 bp, Artificial Sequence
  Synthetic
gaaggaaacagaagtgacgaccggactgagcaagctacagaatctgacaatattaagactgaacaacaaaacatc

SEQ ID NO: 198781 - DNA, 75 bp, Artificial Sequence
  Synthetic
tacatccagaattggttttgatattagataaacaaaactataatggttatctaattactcctgaattagtattga

SEQ ID NO: 198782 - DNA, 75 bp, Artificial Sequence
  Synthetic
ggatctctcatactttcaacataaatgacaatagaaagtcatgttctctagcactcctaaatacagatgtatatc

SEQ ID NO: 198783 - DNA, 75 bp, Artificial Sequence
  Synthetic
aacaatggaactagtaatctctactttgatctggatatgtctattaagccaaagcaaataagggataatcaaaaa

SEQ ID NO: 198784 - DNA, 75 bp, Artificial Sequence
  Synthetic
aaccatgatcatggcatcacactgccaaatagacatcacaaaactacagcatgtaggtgtattggtcaacagtcc

SEQ ID NO: 198785 - DNA, 75 bp, Artificial Sequence
  Synthetic
ataattcaaagttttcagagaacaatcaaggatgttttgttcgaatggattaatataacccatgatgataagaga

SEQ ID NO: 198786 - DNA, 75 bp, Artificial Sequence
  Synthetic
attcatagaacctcagttagatgaggatttgacaatttatatgaaagataaagcattatctccaaaaaaatcaaa

SEQ ID NO: 198787 - DNA, 75 bp, Artificial Sequence
  Synthetic
ttggaaagatgtaagtataatatcacttaaaacttctaatcctgcatcaacagaattatatctgatctcgaaaga

SEQ ID NO: 198788 - DNA, 75 bp, Artificial Sequence
  Synthetic
cttaggacaaaagaagtcaataccaacaactattggcaatcatactcgccggaataagaaagaagagatttcaaa

SEQ ID NO: 198789 - DNA, 75 bp, Artificial Sequence
  Synthetic
acaactattggcaatcatactcgccggaataagaaagaagagatttcaaaagttaaatagaagaaatcaaaacaa

SEQ ID NO: 198790 - DNA, 75 bp, Artificial Sequence
  Synthetic
gcagagattttctctttttttagaacatttgggcatcctccattagaggctagtattgcagcagaaaaggttaga

SEQ ID NO: 198791 - DNA, 75 bp, Artificial Sequence
  Synthetic
aaaacctgtcaatacacacgaaaccaagtagaacgaaacaatagacgtcaatcaatatacaaataagaaaaactt

SEQ ID NO: 198792 - DNA, 75 bp, Artificial Sequence
  Synthetic
aaagcacagaacaccagaacaacaagatcaaaacatctaatccactcaaaacaaaaaccccaaaagagaccagca

SEQ ID NO: 198793 - DNA, 75 bp, Artificial Sequence
  Synthetic
gatcaaaacatctaatccactcaaaacaaaaaccccaaaagagaccagcaacacaacaagcattgaacacaatgc

SEQ ID NO: 198794 - DNA, 75 bp, Artificial Sequence
  Synthetic
attaaggaatttctgagtgtagattacattgataaaattttagatatttttgataaatctacaatagatgaaata

SEQ ID NO: 198795 - DNA, 75 bp, Artificial Sequence
  Synthetic
aaccatgattatggcatctttctgccaaatagatatcacaaaactacagcatgtaggtgtattggtcaacagtcc

SEQ ID NO: 198796 - DNA, 75 bp, Artificial Sequence
  Synthetic
agaattacatacttgattggggatgatgatgttgttttagtttctaaaattatacctacaatcactccgaattgg

SEQ ID NO: 198797 - DNA, 75 bp, Artificial Sequence
  Synthetic
gtggacagtggcctcctgtgacattacctgatcatgcacacgaattcatcataaatgcttacggttcaaattctg

SEQ ID NO: 198798 - DNA, 75 bp, Artificial Sequence
  Synthetic
ataaatgcttacggttcaaattctgcaatatcatatgaaaatgctgttgattattatcagagctttataggaata

SEQ ID NO: 198799 - DNA, 75 bp, Artificial Sequence
  Synthetic
atggagtctcaccatcgacaacaacactgaccgagctgaacagacaagcacaactcatccaacagccactcccag

SEQ ID NO: 198800 - DNA, 75 bp, Artificial Sequence
  Synthetic
gaattcaagtcaacggatatttacaatgatggatacgagactgtgagctgtttcctaacaacagatctcaaaaaa

SEQ ID NO: 198801 - DNA, 75 bp, Artificial Sequence
  Synthetic
agattagtcgaagtatttatagcagatagtaaatttgatcctcatcagatattggattatgtagaatctggggac

SEQ ID NO: 198802 - DNA, 75 bp, Artificial Sequence
  Synthetic
atcatattggtttctaaccaaagaaattaaaatactcatgaaattgattggtggtgctaaattattaggaattcc

SEQ ID NO: 198803 - DNA, 75 bp, Artificial Sequence
  Synthetic
atagtagcaattaaatcagtccaggattatgtcaacaaagaaatcgtgccatcgattgcgagactaggttgtgaa

SEQ ID NO: 198804 - DNA, 75 bp, Artificial Sequence
  Synthetic
acattaaacaattctgttgcacttgatccaattgacatatcaatcgagctcaacaaggccaaatcagatctagag

SEQ ID NO: 198805 - DNA, 75 bp, Artificial Sequence
  Synthetic
gcaaaaatgacatacaaaatgagagctacacaggttttatcagagacactacttgcaaacaatataggaaaattc

SEQ ID NO: 198806 - DNA, 75 bp, Artificial Sequence
  Synthetic
agctacatcaacaaatttatcacacagattaaaggatactgcaactcagatgaagttctctagtacatcattgat

SEQ ID NO: 198807 - DNA, 75 bp, Artificial Sequence
  Synthetic
aaaaggtttttttacccgattggaagctttcagacaagacggaacagtgcaggcagggctggtattgagcggtga

SEQ ID NO: 198808 - DNA, 75 bp, Artificial Sequence
  Synthetic
attctaaaagccatacagatgatcttaaaacttataataaaataagtaatcttaatttatcctctaatcagaaat

SEQ ID NO: 198809 - DNA, 75 bp, Artificial Sequence
  Synthetic
taaaacttataataaaataagtaatcttaatttatcctctaatcagaaatcaaagaaatttgaattcaagtcaac

SEQ ID NO: 198810 - DNA, 75 bp, Artificial Sequence
  Synthetic
atctatgtaggtgatccttactgtcctccatcagataaagaacatatatcattagaggatcaccctgattctgga

SEQ ID NO: 198811 - DNA, 75 bp, Artificial Sequence
  Synthetic
ttgtccacacatttgggtatccatcatgtttaggagctcttataatacagatctggatagttttggtcaaagcta

SEQ ID NO: 198812 - DNA, 75 bp, Artificial Sequence
  Synthetic
gtatagaaggattttgtcaaaaattgtggacacttatatccataagtgcaatacatctagcagctgttaggatag

SEQ ID NO: 198813 - DNA, 75 bp, Artificial Sequence
  Synthetic
aggctttttcactcgattggaagctttcagacaagatggaacagtgcaggcaggactggtgttgagtggtgacac

SEQ ID NO: 198814 - DNA, 75 bp, Artificial Sequence
  Synthetic
tataaaaaacttaggagtaaagttacgcaactcaactccactcacataattgagaaagaacccaacagacgaatc

SEQ ID NO: 198815 - DNA, 75 bp, Artificial Sequence
  Synthetic
atcccaatgtccaataaccacggtcacatcagacattgttccaaggtatgcattcgtcaatggaggagtggttgc

SEQ ID NO: 198816 - DNA, 75 bp, Artificial Sequence
  Synthetic
actcgtatttcttaagacatttggtggattattagtaaatcaatttgcatacactctttatagtttaaaaataga

SEQ ID NO: 198817 - DNA, 75 bp, Artificial Sequence
  Synthetic
atcaaccacctgatcaaggagtaaaaattataacacataaagaatgtagtacaataggtatcaacggaatgctgt

SEQ ID NO: 198818 - DNA, 75 bp, Artificial Sequence
  Synthetic
ataaatacaataaagatatatcctaatctttatctttaagcctattgatagacaaaaagtaagaaaaacatgtaa

SEQ ID NO: 198819 - DNA, 75 bp, Artificial Sequence
  Synthetic
acaataggtatcaacggaatgctgttcaatacaaataaagaaggaactcttgcattctacacaccaaatgatata

SEQ ID NO: 198820 - DNA, 75 bp, Artificial Sequence
  Synthetic
ccgatggaatataagtgcatgtgctaagttagatccaaaattacaatctatgtatcaaaaaggtaataatctgtg

SEQ ID NO: 198821 - DNA, 75 bp, Artificial Sequence
  Synthetic
aattttaacaccggtagctacatcaacaaatttatcacacagattaaaggatactgcaactcagatgaaattctc

SEQ ID NO: 198822 - DNA, 75 bp, Artificial Sequence
  Synthetic
aagtctattggattcgtacattgtgatatggacggagctattggtaaatcagaagaaactgttctacttgaacac

SEQ ID NO: 198823 - DNA, 75 bp, Artificial Sequence
  Synthetic
agggttcttggtgtccttattgtcaatggcttatgccaatccagagctctacctgacaacaaatggaagtaatgc

SEQ ID NO: 198824 - DNA, 75 bp, Artificial Sequence
  Synthetic
atctaggtcatgaacttaaattaaatgaaacgattataagtagtaagatgttcatatatagcaaaagaatatatt

SEQ ID NO: 198825 - DNA, 75 bp, Artificial Sequence
  Synthetic
aacttacaataaagtaatcaatcttaatttatctgctaatcctaaatcaaagaagtttgaattcaagtcaacgga

SEQ ID NO: 198826 - DNA, 75 bp, Artificial Sequence
  Synthetic
tttatcaggaggaaggatgataggtggactcgaaacacctgacccattagaattgttatctggggtagtaataac

SEQ ID NO: 198827 - DNA, 75 bp, Artificial Sequence
  Synthetic
tctacattagaattaattcgatatcctgaaagtaatgaatttatttatgataaagacccactcaaagatgtggac

SEQ ID NO: 198828 - DNA, 75 bp, Artificial Sequence
  Synthetic
caaaagaagtcaacaccaacaactgtcagcagtcacacctgtcggaacaacaaagaaaagacaaaaaaagtcaaa

SEQ ID NO: 198829 - DNA, 75 bp, Artificial Sequence
  Synthetic
tagaagaaatcaaaacaaaaatcatagaacaccagaacaacaatatcaaaacatctaattcactcaaaacaaaaa

SEQ ID NO: 198830 - DNA, 75 bp, Artificial Sequence
  Synthetic
tcgagatggaatactggaagcacaccaatcacggaaaggatgctggtaatgagctggagaaatccatggctactc

SEQ ID NO: 198831 - DNA, 75 bp, Artificial Sequence
  Synthetic
agtcaaccacccaccaatcctacaaacagaacaaaccaggacgaaatagacgatctgttcaatgcatttggaagc

SEQ ID NO: 198832 - DNA, 75 bp, Artificial Sequence
  Synthetic
tatgccaacgactgttgatggctgtgtcagaaccccgtccttagtgataaatgatctgatttatgcttacacctc

SEQ ID NO: 198833 - DNA, 75 bp, Artificial Sequence
  Synthetic
cagatcaagaacaagatggggagcctcaatcatccataatccaatatgcttgggcagaaggaaacagaagcgacg

SEQ ID NO: 198834 - DNA, 75 bp, Artificial Sequence
  Synthetic
aatatatatattatggacaataatcctggtgttattatcaatagtcttcatcatagtgctaattaattccatcaa

SEQ ID NO: 198835 - DNA, 75 bp, Artificial Sequence
  Synthetic
attaatacagatacaaaatgaaatgttaaacctcaaagcggatctaaagaaaatggacgaatcacatagaaggtt

SEQ ID NO: 198836 - DNA, 75 bp, Artificial Sequence
  Synthetic
ttatctggattattcacaaatacaatgatagaagaagatgaagaattagccgaattcttgatggacaggaaggta

SEQ ID NO: 198837 - DNA, 75 bp, Artificial Sequence
  Synthetic
tggaagttacagaaaagatccaaatggcatcggataataccaatgatctaatacagtcaggagtgaatacaaggc

SEQ ID NO: 198838 - DNA, 75 bp, Artificial Sequence
  Synthetic
atatttcttatagtctcaaagaaaaagagatcaaacaagaaggtagactctttgcaaaaatgacatacaaaatga

SEQ ID NO: 198839 - DNA, 75 bp, Artificial Sequence
  Synthetic
aaataaagcagtgcagtcagttcagagctctataggaaatttgatagtagcaattaaatcagtccaggattatgt

SEQ ID NO: 198840 - DNA, 75 bp, Artificial Sequence
  Synthetic
cactaagtaggactttgagactaattgtaagcgataaaatcaggtatgaagatatgtgttcagtagaccttgcca

SEQ ID NO: 198841 - DNA, 75 bp, Artificial Sequence
  Synthetic
ttctttcaagaaaatgggatggtgaagggagagattgaattacttaagagattaacgactatatcaatatcagga

SEQ ID NO: 198842 - DNA, 75 bp, Artificial Sequence
  Synthetic
gatatgtgttcagtagaccttgccatagcattgcgacaaaaaatgtggattcatttatcaggaggaaggatgata

SEQ ID NO: 198843 - DNA, 75 bp, Artificial Sequence
  Synthetic
aatattgatcaggaaactgtacagagaggacctgggagaagaggcagctcagatagtagagctgagactgtggtc

SEQ ID NO: 198844 - DNA, 75 bp, Artificial Sequence
  Synthetic
tatcaagtccttaaaatcagatctataacaagtgattctgatgataatgatagactagatgctaatacaagtggt

SEQ ID NO: 198845 - DNA, 75 bp, Artificial Sequence
  Synthetic
ttaatgaaaactccaaaaataaggttaatgccggggccgggattattagctatgccaacgactgttgatggctgt

SEQ ID NO: 198846 - DNA, 75 bp, Artificial Sequence
  Synthetic
acctaacacaatatcaatcaatctgcaggtacacatcaaaacaggggttcagactgactctaaaggggtagttca

SEQ ID NO: 198847 - DNA, 75 bp, Artificial Sequence
  Synthetic
aacaggatcagaacattgtaaaatatgttattcttcagatggtacaaacccatatacttggatgtatttaccggg

SEQ ID NO: 198848 - DNA, 75 bp, Artificial Sequence
  Synthetic
aaaaacttaggacaaaagaagtcaacaccaacaactgtcagcagtcatacctgtcggaacaacaaagaaaagaca

SEQ ID NO: 198849 - DNA, 75 bp, Artificial Sequence
  Synthetic
ttgacacttcctcaaggagggaattatctatcgcatcaattgagattattcggaatcaacagcactagttgtctg

SEQ ID NO: 198850 - DNA, 75 bp, Artificial Sequence
  Synthetic
acacaaatacaatagagatatatcctaacctttatccccaagcctaaggatagataaaaagtaagaaaaacatgt

SEQ ID NO: 198851 - DNA, 75 bp, Artificial Sequence
  Synthetic
cttattttggatcagtcactgatgaaagatctgaggcacaattaggatatatcaagaatcttagtaaacctgcaa

SEQ ID NO: 198852 - DNA, 75 bp, Artificial Sequence
  Synthetic
gcaggagctatgctagcatgttatgatgccacattaggacctgcagttaattattataattcaggtttgaatata

SEQ ID NO: 198853 - DNA, 75 bp, Artificial Sequence
  Synthetic
atagaagatgagtgttgtattaaagaaagttttaacgatgagcatattaatccagaatctacattagaattaatt

SEQ ID NO: 198854 - DNA, 75 bp, Artificial Sequence
  Synthetic
aaaggatactgcaactcaaatgaagttctccagcacatcgttgatcagagtcagtagattcataacaatgtccaa

SEQ ID NO: 198855 - DNA, 75 bp, Artificial Sequence
  Synthetic
tggattaatataactcatgatgataagagacataaattaggtggaagatataacatattcccactgaaaaataag

SEQ ID NO: 198856 - DNA, 75 bp, Artificial Sequence
  Synthetic
aaatagcacaaacacgcgcaaatttcacactagataatcttaaaattctaacaccggtagctacatcaacaaatt

SEQ ID NO: 198857 - DNA, 75 bp, Artificial Sequence
  Synthetic
aacagttattagaaaactacaatcaacatgatgaatttgatatcgattaagacacaaatacaatagagatatatc

SEQ ID NO: 198858 - DNA, 75 bp, Artificial Sequence
  Synthetic
aactcaaatgaagttctccagcacatcattgatcagagtcagtagattcataacaatgtccaatgataacatgtc

SEQ ID NO: 198859 - DNA, 75 bp, Artificial Sequence
  Synthetic
taacaatgtccaatgataacatgtctatcaaggaagctaacgaaaccaaagataccaatcttatttatcaacaaa

SEQ ID NO: 198860 - DNA, 75 bp, Artificial Sequence
  Synthetic
gacacaaaggggcaaacagaaacacagacagaaccatcagaaacacaatctccatcatggaatctcaccatcgac

SEQ ID NO: 198861 - DNA, 75 bp, Artificial Sequence
  Synthetic
agacagaaccatcagaaacacaatctccatcatggaatctcaccatcgacaacaacaccgaccgagctgaacaga

SEQ ID NO: 198862 - DNA, 75 bp, Artificial Sequence
  Synthetic
tatctatgagacaaaattactgggggtcagaaggaaggttacttctactaggtaacaagatctatatatatacaa

SEQ ID NO: 198863 - DNA, 75 bp, Artificial Sequence
  Synthetic
gaagctttcagacaagatggaacagtgcaggcagggctggtgttgagcggtgacacagtggatcagattgggtca

SEQ ID NO: 198864 - DNA, 75 bp, Artificial Sequence
  Synthetic
ggtaacaagatctatatatatacaagatctacaagttggcatagcaagttacaattaggaataattgatattact

SEQ ID NO: 198865 - DNA, 75 bp, Artificial Sequence
  Synthetic
gcaatcgatttacagagagggcaattactctattgcagaatcttggtgtaattcaatccacatcaaaattagatt

SEQ ID NO: 198866 - DNA, 75 bp, Artificial Sequence
  Synthetic
ggacatggcataatgtgctatcaagaccaggaaacaatgaatgtccatggggacattcatgtccagatggatgta

SEQ ID NO: 198867 - DNA, 75 bp, Artificial Sequence
  Synthetic
agcagatactatgtcacaattagatcgagataatctaaaagaaataatagtcattgcaaatgatgatgatattaa

SEQ ID NO: 198868 - DNA, 75 bp, Artificial Sequence
  Synthetic
caaatgacaggaaacaagcctttatttctagacacctttcatttgtttgttgtttagcagaaattgcatcttttg

SEQ ID NO: 198869 - DNA, 75 bp, Artificial Sequence
  Synthetic
catttggtggattattagtaaatcaatttgcatacactctttatagtttaaaaatagaaggtagggacctcattt

SEQ ID NO: 198870 - DNA, 75 bp, Artificial Sequence
  Synthetic
ctgatgaaaaatttgaacatagagcacagactggatatgtatcattagctgatactgatttagaatcattaaagt

SEQ ID NO: 198871 - DNA, 75 bp, Artificial Sequence
  Synthetic
acagactggatatgtatcattagctgatactgatttagaatcattaaagttattgtcgaaaaacatcattaagaa

SEQ ID NO: 198872 - DNA, 75 bp, Artificial Sequence
  Synthetic
ctaaagtattcaagaggttctgggattgtggagtcttaaaccctatctacggtccaaatactgctagtcaagacc

SEQ ID NO: 198873 - DNA, 75 bp, Artificial Sequence
  Synthetic
agataaaacttgccctctctatatgtgaatattcactagatctatttatgagagaatggttgaatggtgtatcac

SEQ ID NO: 198874 - DNA, 75 bp, Artificial Sequence
  Synthetic
tatggaagtagcaaatgacaggaaacaagcctttatttctagacacctttcatttgtttgctgtttagcagaaat

SEQ ID NO: 198875 - DNA, 75 bp, Artificial Sequence
  Synthetic
aattgaaggtatggacgatatctatgagacaaaattactgggggtcagaaggaagattacttctactaggtaaca

SEQ ID NO: 198876 - DNA, 75 bp, Artificial Sequence
  Synthetic
tggatgacgactcaatactagttatcactagacagaaaataaaactcaataaattggataaaagacaacgatcta

SEQ ID NO: 198877 - DNA, 75 bp, Artificial Sequence
  Synthetic
tgcatcttttggacctaatctgttaaacttaacatacttagagagacttgatctattgaaacaatatcttgagtt

SEQ ID NO: 198878 - DNA, 75 bp, Artificial Sequence
  Synthetic
aacaatgaatgtccatggggacattcatgtccggatggatgtataacgggagtatatactgatgcatatccactc

SEQ ID NO: 198879 - DNA, 75 bp, Artificial Sequence
  Synthetic
gagagtcaacccagtcataacttactcaacagcaaccgaaagggtaaacgagctggctatccgaaacaaaacact

SEQ ID NO: 198880 - DNA, 75 bp, Artificial Sequence
  Synthetic
aaagaataaattaatccttgtccaaaatgagtataactaactctgcaatatacacattcccagaatcatcatttt

SEQ ID NO: 198881 - DNA, 75 bp, Artificial Sequence
  Synthetic
ggatccgattgaagatgaaaatatgctggataatattgttaaatctataaatgataactgtaataaagataataa

SEQ ID NO: 198882 - DNA, 75 bp, Artificial Sequence
  Synthetic
agggaataaaattaacaatttctggggactagcacttaagaactatcaagtccttaaaatcagatctataacaag

SEQ ID NO: 198883 - DNA, 75 bp, Artificial Sequence
  Synthetic
gcttggtaactcttatggttgagacgttaataacaatgaatactagcagaaatgatctcacaaccatagaaaaga

SEQ ID NO: 198884 - DNA, 75 bp, Artificial Sequence
  Synthetic
atccactctcagaccggatatcaatagattaaaagctctaatggaactgtatttgtcaaagggaccacgcgctcc

SEQ ID NO: 198885 - DNA, 75 bp, Artificial Sequence
  Synthetic
gctgcaaccaaactagatatagaagtgagaagaacagtcaaagcaaaagagatgattgtttatacagtacaaaat

SEQ ID NO: 198886 - DNA, 75 bp, Artificial Sequence
  Synthetic
tggttatctaattactcctgaattagtattgatgtattgtgacgtagtcgaaggccgatggaatataagtgcatg

SEQ ID NO: 198887 - DNA, 75 bp, Artificial Sequence
  Synthetic
ttgagttatcacaaattttaatgaaggaagttaataaagacaaggacaggctcttcttgggagaaggagcaggag

SEQ ID NO: 198888 - DNA, 75 bp, Artificial Sequence
  Synthetic
taattggtcaacgagaattgaaaatatttccttcagaagtatcattagtaggtaaaaaattaggaaatgtgacac

SEQ ID NO: 198889 - DNA, 75 bp, Artificial Sequence
  Synthetic
atattcccactaaaaaataagggaaagttaagactgctatcgagaagactagtattaagttggatttcattatca

SEQ ID NO: 198890 - DNA, 75 bp, Artificial Sequence
  Synthetic
tccaattatgggagaaaagacatttgatgtgatatcattattagaaccacttgcattatccctaattcaaactca

SEQ ID NO: 198891 - DNA, 75 bp, Artificial Sequence
  Synthetic
gttcaatgggaatccaaattcaacatggataggaaatatggaatgtgagagcttaatatggagtgaattaaatga

SEQ ID NO: 198892 - DNA, 75 bp, Artificial Sequence
  Synthetic
tggataggaaatatggaatgtgagagcttaatatggagtgaattaaatgataagtctattggattagtacattgt

SEQ ID NO: 198893 - DNA, 75 bp, Artificial Sequence
  Synthetic
gcttttttaaatcatgtgttatccgagatggaattgatatttgaatctagagaatcgattaaggaatttctgagt

SEQ ID NO: 198894 - DNA, 75 bp, Artificial Sequence
  Synthetic
tggaagtgacctggattatgatcaggaaactatgttgcagaacggcagaaacaattcgacaattgaagaccttgt

SEQ ID NO: 198895 - DNA, 75 bp, Artificial Sequence
  Synthetic
aagtaatcttaatttatcttctaatcagaaatcaaagaaatttgaattcaagtcaacggatatttacaatgatgg

SEQ ID NO: 198896 - DNA, 75 bp, Artificial Sequence
  Synthetic
aaacaattaaaatttgacactattaataaatgtcatgctatcttctgtacaataataattaacggatatagagag

SEQ ID NO: 198897 - DNA, 75 bp, Artificial Sequence
  Synthetic
atcgattaagacacaaatacaataaagatatatcttaacctttatcctcaagcctaaggatagacaaaaagtaag

SEQ ID NO: 198898 - DNA, 75 bp, Artificial Sequence
  Synthetic
tcttcatgtcaatgcaactggatctatatcaaaaacactagcaagtcagctggtattcaagagggagatttgtta

SEQ ID NO: 198899 - DNA, 75 bp, Artificial Sequence
  Synthetic
ggatttgcaatcaatttaaatcatctggcgaaagaatttttatcaactccagatctgactaacatcaacaatata

SEQ ID NO: 198900 - DNA, 75 bp, Artificial Sequence
  Synthetic
atcctgcatctaatttactgtatcgtactaatgcatccaacgaatcacgaagattagttgaagtatttatagcag

SEQ ID NO: 198901 - DNA, 75 bp, Artificial Sequence
  Synthetic
gaaaatctcaaagacaacaaccaccaacaccgacacaaaggggcaaacagaaatacagacagaaccatcagaaac

SEQ ID NO: 198902 - DNA, 75 bp, Artificial Sequence
  Synthetic
gtactataatggaacctagtgaagttgttttatcaaaacttaaaagattgtcactcttggaagaaaataatctat

SEQ ID NO: 198903 - DNA, 75 bp, Artificial Sequence
  Synthetic
caatttatatgaaagataaagcattatctccaaaaaaatcaaactgggacacagtttatcctgcatctaatttac

SEQ ID NO: 198904 - DNA, 75 bp, Artificial Sequence
  Synthetic
gagtaaataagggataatcaaaaacttaggacaaaagaagtcaacaccaacagctattagcagtcatacttgtcg

SEQ ID NO: 198905 - DNA, 75 bp, Artificial Sequence
  Synthetic
acaacaagcaccgaacacaatgctaatttcaatattgttaattattacaaccatgatcatggcatcacactgcca

SEQ ID NO: 198906 - DNA, 75 bp, Artificial Sequence
  Synthetic
acatcaattgaggttatttggaatcaacagcactagttgtctgaaagctcttgagttatcacaaattttaatgaa

SEQ ID NO: 198907 - DNA, 75 bp, Artificial Sequence
  Synthetic
aaacaagatcagcatcttcaaacttggcaacatcatttgcaaaagcaattgagaatggttattcacctgttctag

SEQ ID NO: 198908 - DNA, 75 bp, Artificial Sequence
  Synthetic
tctcaccatcgacaacaacactgaccgagctgaacagacaagcacaactcctccaacagccactcccagatcaac

SEQ ID NO: 198909 - DNA, 75 bp, Artificial Sequence
  Synthetic
aattacagcagcagttgctctggttgaagccaagcaggcaagatcagacattgaaaaactcaaagaagcaatcag

SEQ ID NO: 198910 - DNA, 75 bp, Artificial Sequence
  Synthetic
agaaaactacaatcaacatgatgaatttgatatcgattaagacacaaatacaatagagatatatcctaaccttta

SEQ ID NO: 198911 - DNA, 75 bp, Artificial Sequence
  Synthetic
ataaagaacccgaagaacagttattagaaaactacaatcaacatgatgaatttgatatcgattaagacacaaata

SEQ ID NO: 198912 - DNA, 75 bp, Artificial Sequence
  Synthetic
caaaagtgatgaagaagtatctgaattaatggacatgttcaatgaggatgtcaataattgctaatgatccaataa

SEQ ID NO: 198913 - DNA, 75 bp, Artificial Sequence
  Synthetic
gttcagagctctataggaaatttgatagtagcaattaaatcggtccaggattatgtcaacaacgaaatcgtgcca

SEQ ID NO: 198914 - DNA, 75 bp, Artificial Sequence
  Synthetic
gacaaaagaattaaaaaagggggaaaagggaaagactggtttaagaaatcaaaagacactgacaaccagacatca

SEQ ID NO: 198915 - DNA, 75 bp, Artificial Sequence
  Synthetic
tttattgtcaatggcttatgccaatccagagctctacctaacaacaaatggaagtaatgcagatgtcaagtatgt

SEQ ID NO: 198916 - DNA, 75 bp, Artificial Sequence
  Synthetic
cagaaatgctatagctggaatgttagatacgacaaaatctttaattcgggttggcataaatagaggaggactgac

SEQ ID NO: 198917 - DNA, 75 bp, Artificial Sequence
  Synthetic
agagggggtatagaaggattttgtcaaaaattatggacactcatatctataagtgcaatacatctagcagctgtt

SEQ ID NO: 198918 - DNA, 75 bp, Artificial Sequence
  Synthetic
tgagtataactaactctgcaatatacacattcccagaatcatcattttccgagaatggtcatatagaaccattac

SEQ ID NO: 198919 - DNA, 75 bp, Artificial Sequence
  Synthetic
ttggcataaatagaggaggactgacatatagtttattgaggaaaatcagtaattatgatctagcacaatatgaaa

SEQ ID NO: 198920 - DNA, 75 bp, Artificial Sequence
  Synthetic
tatccgaattaatggacatgttcaatgaggatgtcaataattgctaatgatccaataaagaaacaacaccgaata

SEQ ID NO: 198921 - DNA, 75 bp, Artificial Sequence
  Synthetic
acacatttgggtatccatcatgtttaggagctcttataatacagatctggatagttttggtcaaagctattacta

SEQ ID NO: 198922 - DNA, 75 bp, Artificial Sequence
  Synthetic
atgtactaaacaatgtagacactgcatcaaagatagacttcctggcaggattagtcataggggtttcaatggata

SEQ ID NO: 198923 - DNA, 75 bp, Artificial Sequence
  Synthetic
caggatttgtactaaaccatgaaatggagagctgtttatcaggaaacatatcccaatgtccaagaaccacagtca

SEQ ID NO: 198924 - DNA, 75 bp, Artificial Sequence
  Synthetic
tggttgtttatacagtacaaaatataaaaccagaactgtacccatggtctagtagactaagaaaaggaatgctgt

SEQ ID NO: 198925 - DNA, 75 bp, Artificial Sequence
  Synthetic
gatctaaagaaaatggacgaatcacatagaaggttgatagaaaatcaaagagaacaattgtcattgatcacgtca

SEQ ID NO: 198926 - DNA, 75 bp, Artificial Sequence
  Synthetic
ccgagttacaaagtttgtggctctggatcattaccaatcggactggccaaatacactgggaatgaccaggaatta

SEQ ID NO: 198927 - DNA, 75 bp, Artificial Sequence
  Synthetic
gagtgtgaatgatcttgacagtgacccgagttacaaagtttgtggctctggatcattaccaatcggactggccaa

SEQ ID NO: 198928 - DNA, 75 bp, Artificial Sequence
  Synthetic
gagcagatcaagaacaagatggagaacctcaatcatctataattcaatatgcttgggcagaaggaaacagaagtg

SEQ ID NO: 198929 - DNA, 75 bp, Artificial Sequence
  Synthetic
gggcttcagacccatattcatgcaatttaccacaatctcaaaatataaccaccatgataaaaaatataacagcaa

SEQ ID NO: 198930 - DNA, 75 bp, Artificial Sequence
  Synthetic
gattacttacgggtcgctttcctgatgaaaaatttgaacatagagcacagactggatatgtgtcattggctgata

SEQ ID NO: 198931 - DNA, 75 bp, Artificial Sequence
  Synthetic
ataaacagttcagagacatctttccacaaaccaacaggtggatcagccatagagatggcaatagatgaagagcca

SEQ ID NO: 198932 - DNA, 75 bp, Artificial Sequence
  Synthetic
tcaatggcatcactatctctacctagcacaatatcaatcaatctgcaggtacacattaaaacaggggtccagact

SEQ ID NO: 198933 - DNA, 75 bp, Artificial Sequence
  Synthetic
gaatccaatgaaaacactgatcccagaacagaacgattctttggaggggtaattggaaccattgctctgggagta

SEQ ID NO: 198934 - DNA, 75 bp, Artificial Sequence
  Synthetic
ttgctaatgatccaataaagaaacaacaccgaataaatagacaagaaacaacagtagttcaaaacctgtcaatac

SEQ ID NO: 198935 - DNA, 75 bp, Artificial Sequence
  Synthetic
atccataatccaatatgcttgggcagaaggaaacagaagcgacgaccggactgagcaagccacagaatctgacaa

SEQ ID NO: 198936 - DNA, 75 bp, Artificial Sequence
  Synthetic
caaaacatccaattcactcaaaacaaaaattccaaaagagaccggcaacacaacaagcaccgaacacaatgctaa

SEQ ID NO: 198937 - DNA, 75 bp, Artificial Sequence
  Synthetic
cagaaaatcgagaaaatgagattgatattttctttgggattagttggaggaatcagtcttcatgtcaatgcaact

SEQ ID NO: 198938 - DNA, 75 bp, Artificial Sequence
  Synthetic
tcaactccactcatataattgagaaagaacccaacagacgaatccaaattcgaaatggaatactggaagcacacc

SEQ ID NO: 198939 - DNA, 75 bp, Artificial Sequence
  Synthetic
aaacttaggagtaaagttacgcaactcaactccactcatataattgagaaagaacccaacagacgaatccaaatt

SEQ ID NO: 198940 - DNA, 75 bp, Artificial Sequence
  Synthetic
caaagttgctcttgctcctcaatgtcttccactagataggagcataaaattcagagtaatctttgtgaattgtac

SEQ ID NO: 198941 - DNA, 75 bp, Artificial Sequence
  Synthetic
ccgcatctcaatctagttatctgggcttcatcagtagagattacaagagtggatgcaattttccaaccttcttta

SEQ ID NO: 198942 - DNA, 75 bp, Artificial Sequence
  Synthetic
gaagcaaataagggataatcaaaaacttaggacaaaagaggtcaataccaacaaccattagcagtcatactcgca

SEQ ID NO: 198943 - DNA, 75 bp, Artificial Sequence
  Synthetic
gaaatccaccaaaacacggatcccggtatttagatgtctttctactcggcttcttcgagatggaacgaatcaaag

SEQ ID NO: 198944 - DNA, 75 bp, Artificial Sequence
  Synthetic
gtatttagatgtctttctactcggcttcttcgagatggaacgaatcaaagataaatacgggagtgtgaatgatct

SEQ ID NO: 198945 - DNA, 75 bp, Artificial Sequence
  Synthetic
atcgacatgcaggaaacacactagaaaacgatgtacaagtcaaatcagagatattaagttcatacaatgagtcaa

SEQ ID NO: 198946 - DNA, 75 bp, Artificial Sequence
  Synthetic
tatcctaacatcattgcaaaaggagttgggaaaattaaacaatggaattaataatctttattttgatctagatat

SEQ ID NO: 198947 - DNA, 75 bp, Artificial Sequence
  Synthetic
ttcaaaattcctaagtcaatggcatcactatctctacccaacacaatatcaatcaatctgcaggtacacatcaaa

SEQ ID NO: 198948 - DNA, 75 bp, Artificial Sequence
  Synthetic
ttgattggagatgatgatgttgttttagtttctaaaattatacctacaatcactccgaattggtctagaatactt

SEQ ID NO: 198949 - DNA, 75 bp, Artificial Sequence
  Synthetic
agagacaaaaaaagtcaaatagaagaaatcaaaacagaaagcatagaacaccagaacaacaagatcaaaacatcc

SEQ ID NO: 198950 - DNA, 75 bp, Artificial Sequence
  Synthetic
aacatccaatccactcaaaacaaagatttcaaaagagaccggcagcacagcaaacaccgaacacaatgctagctt

SEQ ID NO: 198951 - DNA, 75 bp, Artificial Sequence
  Synthetic
atttcaaaagagaccggcagcacagcaaacaccgaacacaatgctagcttcaacattgttaattattacaactat

SEQ ID NO: 198952 - DNA, 75 bp, Artificial Sequence
  Synthetic
atattgtcaattatgatggctcaatctcaacaacaagatttaaaaataataatataagttttgatcaaccatatg

SEQ ID NO: 198953 - DNA, 75 bp, Artificial Sequence
  Synthetic
agatgtcaacaattgccaatgatccaacaaagaaacgacaccgaacaaagagacaagaaacaacagtaggccaaa

SEQ ID NO: 198954 - DNA, 75 bp, Artificial Sequence
  Synthetic
accttctttacctggcgagttcagatactatcctaacattattgcaaaaggagttgggaaaatcaaacaatggaa

SEQ ID NO: 198955 - DNA, 75 bp, Artificial Sequence
  Synthetic
atctaattttgagtctcataccaaaaatagaagattctaactcttgtggtgaccaacagatcaagcaatacaaga

SEQ ID NO: 198956 - DNA, 75 bp, Artificial Sequence
  Synthetic
ctgctgaacactcaaatctacaaagtagattccatatcatataatatccaaaatagagaatggtatatccctctt

SEQ ID NO: 198957 - DNA, 75 bp, Artificial Sequence
  Synthetic
atgaacactatagtgttataagaattacatacttgattggagatgatgatgttgttttagtttccaaaattatac

SEQ ID NO: 198958 - DNA, 75 bp, Artificial Sequence
  Synthetic
ataatagtcattgcaaatgatgatgatattaatagcttaatcactgaatttttgactcttgatatacttgtattt

SEQ ID NO: 198959 - DNA, 75 bp, Artificial Sequence
  Synthetic
tttgactcttgatatacttgtatttcttaagacatttggtggattattagtaaatcaatttgcatacactcttta

SEQ ID NO: 198960 - DNA, 75 bp, Artificial Sequence
  Synthetic
ctagacaatataaagaacccgaagaacagttattagaaaactacaatcaacatgatgaatttgatatcgattaag

SEQ ID NO: 198961 - DNA, 75 bp, Artificial Sequence
  Synthetic
cactgggaatgaccaggaattattacaagctgcaaccaagctggacatagaagtgagaagaacagttaaagcgaa

SEQ ID NO: 198962 - DNA, 75 bp, Artificial Sequence
  Synthetic
atcgtacggcattacaaatctttggatttgcaatcaaattaaatcatctggcggaagaatttttatcaactccag

SEQ ID NO: 198963 - DNA, 75 bp, Artificial Sequence
  Synthetic
aacaggagtgtatactgatgcatatccgctcaatcccacaggaagcattgtgtcatctgtcatattagattcaca

SEQ ID NO: 198964 - DNA, 75 bp, Artificial Sequence
  Synthetic
atttgcaatcaaattaaatcatctggcggaagaatttttatcaactccagatctgaccaatttcgacaatataat

SEQ ID NO: 198965 - DNA, 75 bp, Artificial Sequence
  Synthetic
caacacaatatcaatcaatctgcaggtacacatcaaaacaggggttcagactgattccaaagggatagttcaaat

SEQ ID NO: 198966 - DNA, 75 bp, Artificial Sequence
  Synthetic
ccaaagctttcagcgaacaatcaaggatgtcttgtttgaatggattaatataactcatgatgacaagagacataa

SEQ ID NO: 198967 - DNA, 75 bp, Artificial Sequence
  Synthetic
taactcatgatgacaagagacataaattatgcggtagatataagatattgccacgcgaaaataagggcaagttaa

SEQ ID NO: 198968 - DNA, 75 bp, Artificial Sequence
  Synthetic
gactgttatcgagaagactagtattaagttggatttcattatcattatcgactcgattgcttacaggccgctttc

SEQ ID NO: 198969 - DNA, 75 bp, Artificial Sequence
  Synthetic
agtgagcagtacaatgagatcactagttgcagtcatcaacaacagcaatctccctcaaagcacaaaacaatcata

SEQ ID NO: 198970 - DNA, 75 bp, Artificial Sequence
  Synthetic
atcatctgtcatattggactcacaaaaatcgagagtcaacccagtcataacttactcaacagcaaccgaaagggt

SEQ ID NO: 198971 - DNA, 75 bp, Artificial Sequence
  Synthetic
tactcttaaatatgtacaaatatctggattattaattaaatcgttcccatcaactgtaacatacgtaagaaagac

SEQ ID NO: 198972 - DNA, 75 bp, Artificial Sequence
  Synthetic
acagactggatatgtatcattagctgatacggattcagattcattcaaattatcgtcggaaaacatcaataagaa

SEQ ID NO: 198973 - DNA, 75 bp, Artificial Sequence
  Synthetic
aagttggatttcattatcattatcgactcgattgcttacaggccgctttcctgatggaaaatttgaacatagagc

SEQ ID NO: 198974 - DNA, 75 bp, Artificial Sequence
  Synthetic
tgactgagagaggaggaaagaaagaccaaaatgaatccaatgaaagagtatccatgatcaagacaaaattgaaag

SEQ ID NO: 198975 - DNA, 75 bp, Artificial Sequence
  Synthetic
ggtattagtccacctgaggtaattgatgattgggatccgatagaagatgaaaatatgctggataacattgtcaaa

SEQ ID NO: 198976 - DNA, 75 bp, Artificial Sequence
  Synthetic
tcatattggtttctagcccaagaagttaaaatacttatgaaattgattggtggtgctaaattattaggaattgcc

SEQ ID NO: 198977 - DNA, 75 bp, Artificial Sequence
  Synthetic
ttattgcaaaaggagttgggaaaatcaaacaatggaactagtaatctctattttggtccggatgtatctattaag

SEQ ID NO: 198978 - DNA, 75 bp, Artificial Sequence
  Synthetic
gatacggattcagattcattcaaattatcgtcggaaaacatcaataagaattatagagagtgtataggatcacta

SEQ ID NO: 198979 - DNA, 75 bp, Artificial Sequence
  Synthetic
aggcaatatcaagaaaccgaagaacaggtattagaaaactacaatcaacctgatgaacttgatatcgattaagac

SEQ ID NO: 198980 - DNA, 75 bp, Artificial Sequence
  Synthetic
attggaagttggcatcaatctagcactacaatcatagttattttgataatgatgattatattgtttataattaat

SEQ ID NO: 198981 - DNA, 75 bp, Artificial Sequence
  Synthetic
aatatacatattatggacaataattctagtgttattatcaatagtcttcatcatagtgctaaccaattccatcaa

SEQ ID NO: 198982 - DNA, 75 bp, Artificial Sequence
  Synthetic
aaagtcaaacaagagaaatcaaaacaaaaggtacagaacacccgaacaaaaaaatcgaaacatccaatccatcct

SEQ ID NO: 198983 - DNA, 75 bp, Artificial Sequence
  Synthetic
acctttatctttgagcccaaggatagacaaaaggtaagaaaaacatgtcatatatatataccaagcagagttctt

SEQ ID NO: 198984 - DNA, 75 bp, Artificial Sequence
  Synthetic
aggtattagaaaactacaatcaacctgatgaacttgatatcgattaagacataattacaataaagatatatcgta

SEQ ID NO: 198985 - DNA, 75 bp, Artificial Sequence
  Synthetic
actatagacatcaatcaatatacaaataagaaaaacttaggattaaagagtaaatcaatccttttccaaaatgag

SEQ ID NO: 198986 - DNA, 75 bp, Artificial Sequence
  Synthetic
ggaaatataaatttaaattaaaattaacttaggattaaagacattgactagaaggtcaagaaaagggaactctat

SEQ ID NO: 198987 - DNA, 75 bp, Artificial Sequence
  Synthetic
gagcccaaggatagacaaaaggtaagaaaaacatgtcatatatatataccaagcagagttcttctcttgtttggt

SEQ ID NO: 198988 - DNA, 75 bp, Artificial Sequence
  Synthetic
ccggtatttagatgtctttctactcggcttcttcgagatggaacgaatcaaagacaaatacgggagtgtaaatga

SEQ ID NO: 198989 - DNA, 75 bp, Artificial Sequence
  Synthetic
ctagacagaaaataaaactcaataaattagataaaagacaacgatcaattagaagattaaaattaatattaattg

SEQ ID NO: 198990 - DNA, 75 bp, Artificial Sequence
  Synthetic
tcttgacagtgatccgagttacaaagtttgtggctctggatcattaccaatcggactggctaaatacactgggaa

SEQ ID NO: 198991 - DNA, 75 bp, Artificial Sequence
  Synthetic
accaaacaagagaagagacttgtttggaaatataaatttaaattaaaattaacttaggattaaagacattgacta

SEQ ID NO: 198992 - DNA, 75 bp, Artificial Sequence
  Synthetic
ctgaacactcaaatctacaaagtagactccatatcatataatatccaaaatagagaatggtatatccctcttccc

SEQ ID NO: 198993 - DNA, 75 bp, Artificial Sequence
  Synthetic
tgaaaatattcccttcagaggtatcattagtaggtaaaaaattaggaaatgtgacacagattcttaacagggtaa

SEQ ID NO: 198994 - DNA, 75 bp, Artificial Sequence
  Synthetic
acacaacctataaatcagacaaatggtgcaatccattcaagacatggtttaccatcaagtatgatatgaggagat

SEQ ID NO: 198995 - DNA, 75 bp, Artificial Sequence
  Synthetic
tgtttataattaatataacgataattacaattgcaattaagtattacagaattcaaaagagaaatcgagtggatc

SEQ ID NO: 198996 - DNA, 75 bp, Artificial Sequence
  Synthetic
cattgctgcaagacataaataatgagtttatggaaattacagaaaagatccaaatggcatcggataataccaatg

SEQ ID NO: 198997 - DNA, 75 bp, Artificial Sequence
  Synthetic
gaaggatggtcaactctataattgttgttgacaagggcttgaactcagttccaaaattgaaggtatggacgatat

SEQ ID NO: 198998 - DNA, 75 bp, Artificial Sequence
  Synthetic
ccaacagacgaatccaaattcgaaatggaatactggaagcacaccaatcacggaaaggatgctggtaatgagctg

SEQ ID NO: 198999 - DNA, 75 bp, Artificial Sequence
  Synthetic
ctacaatcactccgaattggtctagaatactttatctatataaattatattggaaagatgtaagtataatatcac

SEQ ID NO: 199000 - DNA, 75 bp, Artificial Sequence
  Synthetic
tggaaagatgtaagtataatatcacttaaaacttctaatcctgcatcaacagaattatatctaatttcgaaagat

SEQ ID NO: 199001 - DNA, 75 bp, Artificial Sequence
  Synthetic
aggacctgcagttaattattataattcaggtttgaatataacagatgtaattggtcaacgagaattgaaaatatt

SEQ ID NO: 199002 - DNA, 75 bp, Artificial Sequence
  Synthetic
agaattatatctaatttcgaaagatgcatattgtactataatggaacctagtgaagttgttttatcaaaacttaa

SEQ ID NO: 199003 - DNA, 75 bp, Artificial Sequence
  Synthetic
atattgtacaacagaacaaagtagaaacagtgatcatggaagaagcttggaatctatcagtacacctgatacaag

SEQ ID NO: 199004 - DNA, 75 bp, Artificial Sequence
  Synthetic
ttttgataatgatgattatattgtttataattaatataacaataattacaattgcaattaagtattacagaattc

SEQ ID NO: 199005 - DNA, 75 bp, Artificial Sequence
  Synthetic
gaattaataatctccattttgatctagatatacccattaagccagagtaaataagggataatcaaaaacttagga

SEQ ID NO: 199006 - DNA, 75 bp, Artificial Sequence
  Synthetic
atcatatggcactacaaatctttggatttcaaatcaatttaaatcatctggcgaaagaatttttatcaactccag

SEQ ID NO: 199007 - DNA, 75 bp, Artificial Sequence
  Synthetic
atctataatacaagtatatgataattaatcagcaatcagacaatagacaaaaggggaatataaaaaacttaggag

SEQ ID NO: 199008 - DNA, 75 bp, Artificial Sequence
  Synthetic
taatcagcaatcagacaatagacaaaaggggaatataaaaaacttaggagcaaagcgtgctcgaaacatggacac

SEQ ID NO: 199009 - DNA, 75 bp, Artificial Sequence
  Synthetic
ctcaatctcaacaacaagatttaagaataataacataagctttgatcaaccttatgctgcactatacccatctgt

SEQ ID NO: 199010 - DNA, 75 bp, Artificial Sequence
  Synthetic
gacattacctgatcatgcacacgaattcatcataaatgcttatggttcaaactctgcaatatcatatgaaaatgc

SEQ ID NO: 199011 - DNA, 75 bp, Artificial Sequence
  Synthetic
gctcaccaacaagataacatatatattatggacgataaccctggtgttattatcaatagtcttcatcatagtgct

SEQ ID NO: 199012 - DNA, 75 bp, Artificial Sequence
  Synthetic
agaaattaataatatatcaaaagttcacacaacttataaatcagataaatggtataatccattcaaaacatggtt

SEQ ID NO: 199013 - DNA, 75 bp, Artificial Sequence
  Synthetic
cttgcattctacacaccaaatgatataacactaaataattctgttgcacttgatccaattgacatatcaatcgag

SEQ ID NO: 199014 - DNA, 75 bp, Artificial Sequence
  Synthetic
tcatattggtttctaaccaaagaagttaaaatacttatgaaattgattggtggtgctaaattattaggaattccc

SEQ ID NO: 199015 - DNA, 75 bp, Artificial Sequence
  Synthetic
atcaggcgtctcatagtccatggttctcggatagaagaatggtcaactccatcattgttgttgacaaaggcttaa

SEQ ID NO: 199016 - DNA, 75 bp, Artificial Sequence
  Synthetic
acaagagactattggatagactgatcattcctttatatgatggactaagattacagaaagatataatagtgacta

SEQ ID NO: 199017 - DNA, 75 bp, Artificial Sequence
  Synthetic
aagcctaaggatagacaaaaagtaagaaaaacatgtaatatatatataccaaacagagttcttctcttgtttggt

SEQ ID NO: 199018 - DNA, 75 bp, Artificial Sequence
  Synthetic
gcatatccactcaatcccacagggagcattgtgtcatctgtcatattagactcacaaaaatcgagagtgaaccca

SEQ ID NO: 199019 - DNA, 75 bp, Artificial Sequence
  Synthetic
ttatgactacagagttaagaaggagatagtttataaagatgtggtgagattttttgattcattaagggaggtgat

SEQ ID NO: 199020 - DNA, 75 bp, Artificial Sequence
  Synthetic
aaagagtaaatgagctggccatccgaaacagaacactctcagctggatatacaacaacaagctgcattacacact

SEQ ID NO: 199021 - DNA, 75 bp, Artificial Sequence
  Synthetic
gataataactgtaaactcagacttggtacctgacttaaatcccaggatctctcataccttcaacataaatgacaa

SEQ ID NO: 199022 - DNA, 75 bp, Artificial Sequence
  Synthetic
tgaatgattactcaatcactctccaagtcagactccctttattaactagactgctgaacactcaaatctacaaag

SEQ ID NO: 199023 - DNA, 75 bp, Artificial Sequence
  Synthetic
cttaggacaaaagaagtcaacaccaacaaccgtcagcagtcatacctgtcggaacaataaagaaaggacaaaaaa

SEQ ID NO: 199024 - DNA, 75 bp, Artificial Sequence
  Synthetic
attcattagtgaaattataattagaaatgataatcaagaagtgctgccacaaagaataacacatgatgtaggtat

SEQ ID NO: 199025 - DNA, 75 bp, Artificial Sequence
  Synthetic
acctcactcatctataattcaatatgcttgggcagaaggaaacagaagtgatgatcggactgagcaagctacaga

SEQ ID NO: 199026 - DNA, 75 bp, Artificial Sequence
  Synthetic
acaaaattactgggggtcagaaggaagattacttctactatgtttcatgatcttcctatacacaatatctacgag

SEQ ID NO: 199027 - DNA, 75 bp, Artificial Sequence
  Synthetic
taagaatattcaacaactatatattgcccttgggatgaatatcaatccaactataacacagaatatcaaagatca

SEQ ID NO: 199028 - DNA, 75 bp, Artificial Sequence
  Synthetic
ttacacacaattatgagtctacctcaaccttacgatatggatgacgactcaatactagttatcactagacagaaa

SEQ ID NO: 199029 - DNA, 75 bp, Artificial Sequence
  Synthetic
tagataggagcataaaattcagagtaatcttcgtgaattgtacggcaattggatcaataactttgttcaaaattc

SEQ ID NO: 199030 - DNA, 75 bp, Artificial Sequence
  Synthetic
aaacttaggattaaagaatcctatcatactggaatatagggtggcaaattcagagtctgcttgcaactcaatcaa

SEQ ID NO: 199031 - DNA, 75 bp, Artificial Sequence
  Synthetic
atgttgttcaaaacagagattccaaaaagctgcagttaatcataattaaccataatatgtattaacctatctata

SEQ ID NO: 199032 - DNA, 75 bp, Artificial Sequence
  Synthetic
aaccgtcagaaacacaatctccattatgggatctcaccatcgacaacaacactgatcgagctgaacagacaagca

SEQ ID NO: 199033 - DNA, 75 bp, Artificial Sequence
  Synthetic
ctgtcggaacaataaagaaaggacaaaaaaagtcaaatagaagaaatcaaaacaaaaagcatagaacaccagaac

SEQ ID NO: 199034 - DNA, 75 bp, Artificial Sequence
  Synthetic
gaaatgaggtcacctttaatatggggaaagattataatctgttagaagaccagaagaatctcttattgatacatc

SEQ ID NO: 199035 - DNA, 75 bp, Artificial Sequence
  Synthetic
ggattagtcataggggtttcaatggacaacgacacaaaattaatacagatacaaaatgaaatgttaaacctcaaa

SEQ ID NO: 199036 - DNA, 75 bp, Artificial Sequence
  Synthetic
attacaaccatgatcatggcatcacactgccaaatagacattacaaaactacagcatgtaggtgtattggtcaac

SEQ ID NO: 199037 - DNA, 75 bp, Artificial Sequence
  Synthetic
acgtctggtcttccatctttgatgagaactccaaaaataagattaatgccggggccaggattactagctatgcca

SEQ ID NO: 199038 - DNA, 75 bp, Artificial Sequence
  Synthetic
aaatgctgttgattattaccagagctttataggaataaaatttaataaattcatagagcctcagttagatgagga

SEQ ID NO: 199039 - DNA, 75 bp, Artificial Sequence
  Synthetic
gattcgcatcaaaagggcaaaagaaaatcccgaagacagcaaccatcaacacagacacaaaagggcaaacagaaa

SEQ ID NO: 199040 - DNA, 75 bp, Artificial Sequence
  Synthetic
acaacagtagttcaaaacctgtcaatacacacgaaatcaagcagaacgaaacaatagacatcaatcaatatacaa

SEQ ID NO: 199041 - DNA, 75 bp, Artificial Sequence
  Synthetic
ataagtaatcagcaatcagacaatagacaaaagggaaatataaaaaacttaggagcaaagcgtgctcggaaaatg

SEQ ID NO: 199042 - DNA, 75 bp, Artificial Sequence
  Synthetic
cacaggcagaatcatcagaaacacaatcctcatcgtggaatctcatcatcgacgacaacaccgaccgaaatggac

SEQ ID NO: 199043 - DNA, 75 bp, Artificial Sequence
  Synthetic
gaatcgatccgaacaaactctgaatccaaacccaagacacaaaagacaaatggaaaggaaaggaaggatacagaa

SEQ ID NO: 199044 - DNA, 75 bp, Artificial Sequence
  Synthetic
tatcaactgtgttcaactccaaaagttgatgaaagatcagattatgcatcatcaggcatagaagatattgtactt

SEQ ID NO: 199045 - DNA, 75 bp, Artificial Sequence
  Synthetic
tatacccatctgttggaccagggatatactacaaaggcaaaataatatttcttgggtatggaggtcttgaacatc

SEQ ID NO: 199046 - DNA, 75 bp, Artificial Sequence
  Synthetic
ttctaacaccggtagctacatcaacaaatttatcacacagattaaaggatactgcaactcaaatgaagttctcca

SEQ ID NO: 199047 - DNA, 75 bp, Artificial Sequence
  Synthetic
atatcaggagttccacggtataatgaagtgtacaataattctaaaagccatacagatgaccttaaaacctacagt

SEQ ID NO: 199048 - DNA, 75 bp, Artificial Sequence
  Synthetic
aacacagatacaaaatgaaatgctaaacctcaaagcagatctaaagaaaatggacgaatcacatagaagattgat

SEQ ID NO: 199049 - DNA, 75 bp, Artificial Sequence
  Synthetic
attcataacaatgtccaatgataacatgtctatcaaggaagctaacgaaaccaaagataccaatcttatttatca

SEQ ID NO: 199050 - DNA, 75 bp, Artificial Sequence
  Synthetic
agtgtatactgatgcatatccgctcaatcccacaggaagcattgtgtcatctgtcatattagattcacaaaaatc

SEQ ID NO: 199051 - DNA, 75 bp, Artificial Sequence
  Synthetic
gagagagtatccatgatcaaaacaaaattgaaagaagaaaagatcaagaaaaccaggtttgacccacttatggag

SEQ ID NO: 199052 - DNA, 75 bp, Artificial Sequence
  Synthetic
tcagcagtcatacctgtcggaacaacaaagaaaagacaaaaaaagtcaaatagaagaaatcaaaacaaaaagcat

SEQ ID NO: 199053 - DNA, 75 bp, Artificial Sequence
  Synthetic
tatatcaatatcaggagttccacgatataatgaagtgtacaataattctaaaagccatacagatgatcttaaaac

SEQ ID NO: 199054 - DNA, 75 bp, Artificial Sequence
  Synthetic
ttacatatacccggcattaacagtaaagtgactgaactattacttaaagcagatagaacatatagtcaaatgact

SEQ ID NO: 199055 - DNA, 75 bp, Artificial Sequence
  Synthetic
agatgtcaacaattgccaatgattcaacaaagaagcaacaccgaacaaagagacaagaaacaacagtaggctaaa

SEQ ID NO: 199056 - DNA, 75 bp, Artificial Sequence
  Synthetic
ctgggattgtggagtcttaaaccctatctatggtcctaatactgctagtcaagaccagataaaactcgccctctc

SEQ ID NO: 199057 - DNA, 75 bp, Artificial Sequence
  Synthetic
atatgtgaatattcactagatctatttatgagagaatggttgaatggtgtatcacttgaaatatacatttgtgac

SEQ ID NO: 199058 - DNA, 75 bp, Artificial Sequence
  Synthetic
gatctatggattaatgtgctatcgaaattagcctcaaaaaatgatggaagcaattatgatcttaatgaagaaatt

SEQ ID NO: 199059 - DNA, 75 bp, Artificial Sequence
  Synthetic
aattagcctcaaaaaatgatggaagcaattatgatcttaatgaagaaattaataatatatcaaaagttcacacaa

SEQ ID NO: 199060 - DNA, 75 bp, Artificial Sequence
  Synthetic
aaatcagaagaaactgttctacatgaacactatagtgttataagaattacatacttgattggagatgatgatgtt

SEQ ID NO: 199061 - DNA, 75 bp, Artificial Sequence
  Synthetic
ctggttgaagccaagcaggcaagatcagacattgaaaaactcaaggaagcaatcagggacacaaataaagcagtg

SEQ ID NO: 199062 - DNA, 75 bp, Artificial Sequence
  Synthetic
atatgaatcaacggctctatttggagaaacttgcaatcaaatatttggattaaataaattgtttaattggttaca

SEQ ID NO: 199063 - DNA, 75 bp, Artificial Sequence
  Synthetic
atgggagaaaagacatttgatgtaatatcattattagaaccacttgcattatccctaattcaaactcatgatcct

SEQ ID NO: 199064 - DNA, 75 bp, Artificial Sequence
  Synthetic
tgatcaaaagaaaagtaggcagaatgtactctgttgaatactgtaaacagaaaatcgagaaaatgagattgatat

SEQ ID NO: 199065 - DNA, 75 bp, Artificial Sequence
  Synthetic
gaagaaacttgtttggaaatataaatttaaattaaaattaacttaggattaaagacattgactagaaggtcaaga

SEQ ID NO: 199066 - DNA, 75 bp, Artificial Sequence
  Synthetic
gatgataatgagaaaatgacattagctcttctatttctatctcattcattagataatgagaaacaacatgcacaa

SEQ ID NO: 199067 - DNA, 75 bp, Artificial Sequence
  Synthetic
agataatgagaaacaacatgcacaaagagcagggttcttggtgtctttattgtcaatggcttatgccaatccaga

SEQ ID NO: 199068 - DNA, 75 bp, Artificial Sequence
  Synthetic
ctaaagcaaatgagagataatcaaaaacttaggacaaaagaagtcaacaccaacaactattagcagtcatacgtg

SEQ ID NO: 199069 - DNA, 75 bp, Artificial Sequence
  Synthetic
taaatcagaagaaactgttctacatgaacactatagtgttataagaattacatacttgattggagatgatgatgt

SEQ ID NO: 199070 - DNA, 75 bp, Artificial Sequence
  Synthetic
aacttaggacaaaagaagtcaacaccaacaactattagcagtcatacgtgcaagaataagaaagaagagattcaa

SEQ ID NO: 199071 - DNA, 75 bp, Artificial Sequence
  Synthetic
caagaataagaaagaagagattcaagaagtcgagaaatcaaaacaaaaggtacagaacacccgaacaaaaaaatc

SEQ ID NO: 199072 - DNA, 75 bp, Artificial Sequence
  Synthetic
gaagtcgagaaatcaaaacaaaaggtacagaacacccgaacaaaaaaatcaaaacatccaatccatcctaaataa

SEQ ID NO: 199073 - DNA, 75 bp, Artificial Sequence
  Synthetic
gacaagggtttgaactcagttccaaaattgaaggtatggacgatatctatgagacaaaattactgggggtcagaa

SEQ ID NO: 199074 - DNA, 75 bp, Artificial Sequence
  Synthetic
atattgatatgttccagctaggacaagcagtagcacgtgatgctgaagctcagatgagctcaacactggaagatg

SEQ ID NO: 199075 - DNA, 75 bp, Artificial Sequence
  Synthetic
aatggttcaaggagacaatcaagctatagctgtaaccacaagagtaccaaacaattatgactacagagttaagaa

SEQ ID NO: 199076 - DNA, 75 bp, Artificial Sequence
  Synthetic
aaattccaaaggagaccggcaacacaacaagcaccaaacacaatgccaacttcaatactgctaattattacaaca

SEQ ID NO: 199077 - DNA, 75 bp, Artificial Sequence
  Synthetic
caacatgatgaatttgatatcgattaagacacaaatacaatagagatatatcctaacctttatccccaagcctaa

SEQ ID NO: 199078 - DNA, 75 bp, Artificial Sequence
  Synthetic
tggttagatgatccagaatttaatatttcttatagtctcaaagaaaaagagatcaaacaagaaggtagactcttt

SEQ ID NO: 199079 - DNA, 75 bp, Artificial Sequence
  Synthetic
cacaccaaccacggaaaggatgctggtaatgagctggagacatccacagccactcatggcaacaagctcaccaac

SEQ ID NO: 199080 - DNA, 75 bp, Artificial Sequence
  Synthetic
acaaatacaatagagatatatcctaacctttatccccaagcctaaggatagacaaaaagtaagaaaaacatgtca

SEQ ID NO: 199081 - DNA, 75 bp, Artificial Sequence
  Synthetic
atcaggaggaaggatgataagtgggctcgaaacacctgacccattagaattgttatctggggtagtaataacagg

SEQ ID NO: 199082 - DNA, 75 bp, Artificial Sequence
  Synthetic
agtcatgtacagaattatataccaatatcattgacacaacaaatatcggatcttaggaaattcattagtgaaatt

SEQ ID NO: 199083 - DNA, 75 bp, Artificial Sequence
  Synthetic
aggagctattataatacagatctggatagttttggtcaaagctatcactagcatctcaggattaagaaaaggctt

SEQ ID NO: 199084 - DNA, 75 bp, Artificial Sequence
  Synthetic
ataaatataatgaagatatatcctaacctttatctttaagcctaaggatagacaaaaagtaagaaaaacatgtaa

SEQ ID NO: 199085 - DNA, 75 bp, Artificial Sequence
  Synthetic
ttaggattaaagacattgagttgaaggtcatgaaaagggagctctacaatttcaaaaatgttgagcctatttgat

SEQ ID NO: 199086 - DNA, 75 bp, Artificial Sequence
  Synthetic
taaaacttacaataaactaagtaatcttaacttatctgctaatcagaaatcaaagaagtttgaattcaagtcaac

SEQ ID NO: 199087 - DNA, 75 bp, Artificial Sequence
  Synthetic
tccattcatctgtatcctcagagatcccatacatggtgagttcgcaccaggcaactatcctgcaatatggagtta

SEQ ID NO: 199088 - DNA, 75 bp, Artificial Sequence
  Synthetic
ttttaagaatattcagcaactatacattgcccttgggatgaatatcaatccaactataacacagaatatcagaga

SEQ ID NO: 199089 - DNA, 75 bp, Artificial Sequence
  Synthetic
actgtgagctgtttcttaacaacagatctcaaaaaatactgtcttaattggagatatgaatcaacagctctattt

SEQ ID NO: 199090 - DNA, 75 bp, Artificial Sequence
  Synthetic
atactgatttagaatcattaaagttattgtcgaaaaacatcattaagaattacagagagtgtatagggtcaatat

SEQ ID NO: 199091 - DNA, 75 bp, Artificial Sequence
  Synthetic
aagactgaacaacaaaacatcagagacagactaaacaagagactcaacgacaagaagaaacaaagcagtcaacca

SEQ ID NO: 199092 - DNA, 75 bp, Artificial Sequence
  Synthetic
ttataaagatgtagtgagattttttgattcattaagagaagtgatggatgatctaggtcatgaacttaaattaaa

SEQ ID NO: 199093 - DNA, 75 bp, Artificial Sequence
  Synthetic
agaattagctgaattcctgatggacaggaaggtaattctccctagagttgcacatgatattctagataattctct

SEQ ID NO: 199094 - DNA, 75 bp, Artificial Sequence
  Synthetic
gattcattaagagaagtgatggatgatctaggtcatgaacttaaattaaatgaaacgattataagtagcaagatg

SEQ ID NO: 199095 - DNA, 75 bp, Artificial Sequence
  Synthetic
cacaggaattagaaatgctatagctggaatgttagatacgacaaaatcactaattcgggttggcataaatagagg

SEQ ID NO: 199096 - DNA, 75 bp, Artificial Sequence
  Synthetic
gagatgatatatgagaagacaactgattggatatttggaagtgacctggattatgatcaggaaactatgttgcag

SEQ ID NO: 199097 - DNA, 75 bp, Artificial Sequence
  Synthetic
caatgtccaagaaccacggtcacatcagacattgttccaagatatgcattcgtcaatggaggagtggttgcaaac

SEQ ID NO: 199098 - DNA, 75 bp, Artificial Sequence
  Synthetic
tcatttgtttgttgtttagcagaaattgcatcttttggacctaacctgttaaacttaacatacttagagagactt

SEQ ID NO: 199099 - DNA, 75 bp, Artificial Sequence
  Synthetic
tattcaagaggttctgggattgtggagtcttaaaccctatctacggtcctaatactgctagtcaagaccagataa

SEQ ID NO: 199100 - DNA, 75 bp, Artificial Sequence
  Synthetic
accacctgatcaaggagtaaaaattataacacataaagaatgtaatacaataggtatcaacggaatgctgttcaa

SEQ ID NO: 199101 - DNA, 75 bp, Artificial Sequence
  Synthetic
atatcaaaagatttattaaggcaaatctattggacaggagtgttctttataggattatgaatcaagaaccaggtg

SEQ ID NO: 199102 - DNA, 75 bp, Artificial Sequence
  Synthetic
ggcagaaggaaacagaagcgatgaccggactgagcaagctacagaatctgacaatatcaagactgaacaacaaaa

SEQ ID NO: 199103 - DNA, 75 bp, Artificial Sequence
  Synthetic
gaatctgacaatattaatactgaacaacaaaacatcagagacagattaaataagagactcaacgacaagaagaaa

SEQ ID NO: 199104 - DNA, 75 bp, Artificial Sequence
  Synthetic
caccagatgatgaagaagaaatactaatgagaaatagtaggatgaagaaaagttcttcaacacaccaggaagatg

SEQ ID NO: 199105 - DNA, 75 bp, Artificial Sequence
  Synthetic
cttaggagtaaagttacgcaatccaactctactcatataattgggaaagaacccaatagacaaatccaaattcga

SEQ ID NO: 199106 - DNA, 75 bp, Artificial Sequence
  Synthetic
aactcagatgaagttctctagtacatcattgatcagggtcagtagattcataacaatgtctaatgataacatgtc

SEQ ID NO: 199107 - DNA, 75 bp, Artificial Sequence
  Synthetic
gataccaatcttatttatcaacaaataatgttaacaggattaagtgttttcgaatatttatttagattgaaagaa

SEQ ID NO: 199108 - DNA, 75 bp, Artificial Sequence
  Synthetic
tttgatatcgattaagacacaaatacaatagagatatatcttaacctttatccccaagcctaaggatagataaaa

SEQ ID NO: 199109 - DNA, 75 bp, Artificial Sequence
  Synthetic
tcaaggatgtcttatttgaatggattaatataactcatgatgataagagacataaattaggcggaagatataaca

SEQ ID NO: 199110 - DNA, 75 bp, Artificial Sequence
  Synthetic
acgtaggcaagaaaacataacaaaatcagctggtggagctatcatccctggacagaaaaatactgtctctatatt

SEQ ID NO: 199111 - DNA, 75 bp, Artificial Sequence
  Synthetic
gatgatactgacatcatacatgcaatttcaatatgtactgcaattacaatagcagatactatgtcacaattagat

SEQ ID NO: 199112 - DNA, 75 bp, Artificial Sequence
  Synthetic
aaaaaattaggaaatgtgacacagattcttaatagggtaaaagtactgttcaatgggaatccaaattcaacatgg

SEQ ID NO: 199113 - DNA, 75 bp, Artificial Sequence
  Synthetic
cacaaaggggcaaacagaaatacagacagaaccatcagaaacacaacctctatcatggaatctcaccatcgacaa

SEQ ID NO: 199114 - DNA, 75 bp, Artificial Sequence
  Synthetic
ttaaatcatctggcgaaagaatttttatcaactccagatctgactaatatcaacaatataattcaaagttttcag

SEQ ID NO: 199115 - DNA, 75 bp, Artificial Sequence
  Synthetic
caatatcatattggtttctgaccaaagaagttaaaatacttatgaaattgattggtggtgctaaattattaggaa

SEQ ID NO: 199116 - DNA, 75 bp, Artificial Sequence
  Synthetic
aaaatctcaaagacaacaaccaccaacactgacacaaaggggcaaacagaaacacagacagaaccatcagaaaca

SEQ ID NO: 199117 - DNA, 75 bp, Artificial Sequence
  Synthetic
tgtatcctcagagatcccatacatggtgagttcgcaccaggcaattatcctgccatatggagttatgcaatggga

SEQ ID NO: 199118 - DNA, 75 bp, Artificial Sequence
  Synthetic
aacacagacagaaccatcagaaacacaatctccatcatggaatctcatcattgacaacaacaccgaccgagctga

SEQ ID NO: 199119 - DNA, 75 bp, Artificial Sequence
  Synthetic
ctcatagtccatggttttcagataggaggatggtcaactccatcattgttgttgacaaaggcttaaactcaattc

SEQ ID NO: 199120 - DNA, 75 bp, Artificial Sequence
  Synthetic
acatccaattcactcaaaataaaaattctaaaagagatcggcaacacaacaagcaccgaacacaatgctaatttc

SEQ ID NO: 199121 - DNA, 75 bp, Artificial Sequence
  Synthetic
gatatatcctaacctttatctttaagcctaatgatagataaaaagtaagaaaaacatgtaatatatatataccaa

SEQ ID NO: 199122 - DNA, 75 bp, Artificial Sequence
  Synthetic
gaaaaatactgtctctatatttgcccttggaccgacaataactgatgataatgagaaaatgacattagcccttct

SEQ ID NO: 199123 - DNA, 75 bp, Artificial Sequence
  Synthetic
aatcattaaagttattgtcgaaaaacatcattaagaattacaaagagtgtatagggtcaatatcatattggtttc

SEQ ID NO: 199124 - DNA, 75 bp, Artificial Sequence
  Synthetic
tccctggacagaaaaatactgtctctatatttgctcttggaccgacaataaccgatgataatgagaaaatgacat

SEQ ID NO: 199125 - DNA, 75 bp, Artificial Sequence
  Synthetic
gagcatatcaatccagaatctacattagaattaattagatatcctgaaagtaatgaatttatttatgataaagac

SEQ ID NO: 199126 - DNA, 75 bp, Artificial Sequence
  Synthetic
aggcacaaggcatcgacaagaacatacccgacctatatcgacatgcaggaaacacactagagaatgatgtacaag

SEQ ID NO: 199127 - DNA, 75 bp, Artificial Sequence
  Synthetic
aacagcactagttgtctgaaagctctcgagttatcacaaattttaatgaaggaagttaataaagacaaggacaga

SEQ ID NO: 199128 - DNA, 75 bp, Artificial Sequence
  Synthetic
caatgagtcaaatgcaacaagactaatacccaaaaaagtgagcagtacaatgagatcactagttgcagtcatcaa

SEQ ID NO: 199129 - DNA, 75 bp, Artificial Sequence
  Synthetic
acattgactagaaggtcaagaaaagggaactctacaatttcaaaaatgttgagcctatttgatacatttaatgca

SEQ ID NO: 199130 - DNA, 75 bp, Artificial Sequence
  Synthetic
ttaatggatatgttcaatgaggatgtcaacaattgctaatgatccaataacgaaacaacaccgaataaatagaca

SEQ ID NO: 199131 - DNA, 75 bp, Artificial Sequence
  Synthetic
ggaactctacaatttcaaaaatgttgagcctatttgatacatttaatgcacgtaggcaagaaaacataacaaaat

SEQ ID NO: 199132 - DNA, 75 bp, Artificial Sequence
  Synthetic
taaagaaaatggatgaatcacatagaaggttgatagaaaatcaaagagaacaattgtcattgatcacgtcattaa

SEQ ID NO: 199133 - DNA, 75 bp, Artificial Sequence
  Synthetic
atcaaagaagaggaataatgaatggttacatcatgaaatcaaagaaggagaaagagattatggagtcatgagacc

SEQ ID NO: 199134 - DNA, 75 bp, Artificial Sequence
  Synthetic
gatgacaaaagaattaaaaaagggggaaaagggaaagactggtttaagaaatcaaaagacactgacaaccagata

SEQ ID NO: 199135 - DNA, 75 bp, Artificial Sequence
  Synthetic
tcaagacaaaattaaaagaggaaaagatcaagaagaccaggttcgatccgcttatggaggcacaaggcatcgaca

SEQ ID NO: 199136 - DNA, 75 bp, Artificial Sequence
  Synthetic
tatctgtataagttatattggaaagatgtaagtataatatcacttaaaacttctaatcctgcatcaacagaatta

SEQ ID NO: 199137 - DNA, 75 bp, Artificial Sequence
  Synthetic
tgttttatcaaaacttaaaagattgtcactcttggaagaaaataatctattaaaatggatcattttatcaaagaa

SEQ ID NO: 199138 - DNA, 75 bp, Artificial Sequence
  Synthetic
atagatgaagagccagaacaatttgaaaatagagcagatcaagaacaagatggggaacctcaatcatccataatc

SEQ ID NO: 199139 - DNA, 75 bp, Artificial Sequence
  Synthetic
caggcaactatcctgccatatggagttatgcaatgggagtggcagttgtacccaacggagccatgtgtcggtata

SEQ ID NO: 199140 - DNA, 75 bp, Artificial Sequence
  Synthetic
caggcaactatcctgccatatggagttatgcaatgggagtggcagttgtacccaacggagccatgtgtcggtatt

SEQ ID NO: 199141 - DNA, 75 bp, Artificial Sequence
  Synthetic
caggcaactatcctgccatatggagttatgcaatgggagtggcagttgtacccaacggagccatgtgtcggtatc

SEQ ID NO: 199142 - DNA, 75 bp, Artificial Sequence
  Synthetic
caggcaactatcctgccatatggagttatgcaatgggagtggcagttgtacccaacggagccatgtgtcggtatg

SEQ ID NO: 199143 - DNA, 75 bp, Artificial Sequence
  Synthetic
agaagtgagaagaacagtcaaagcaaaagagatgattgtttatacagtacaaaatataaaaccagaactgtaccc

SEQ ID NO: 199144 - DNA, 75 bp, Artificial Sequence
  Synthetic
gaaaaacatcattaagaattacagagagtgtatagggtcaatatcgtattggtttctaaccaaggaaatcaaaat

SEQ ID NO: 199145 - DNA, 75 bp, Artificial Sequence
  Synthetic
cttatggttgaaacattaataacaatgaatactagcagaaatgacctcacaaccatagaaaagaatatacaaatt

SEQ ID NO: 199146 - DNA, 75 bp, Artificial Sequence
  Synthetic
aaattattaggaattcctaggcaatataaagaacccgaagaacagttattagaaaactacaatcaacatgatgaa

SEQ ID NO: 199147 - DNA, 75 bp, Artificial Sequence
  Synthetic
ggaattgatatttgaatctagagaatcgattaaggaattactgagtgtagattacattgataagattttagatat

SEQ ID NO: 199148 - DNA, 75 bp, Artificial Sequence
  Synthetic
attctggatgagaaaggcgaaaaatcactgaatttcatggtccatctcggattgatcaaaagaaaagtaggcaga

SEQ ID NO: 199149 - DNA, 75 bp, Artificial Sequence
  Synthetic
ctctataatttcaaaaatgttgagcctatttgatacatttaatgcacgtaggcaagaaaacataacaaaatcagc

SEQ ID NO: 199150 - DNA, 75 bp, Artificial Sequence
  Synthetic
agaaaactacaatcaacatgatgaatttgatatcgattaagacacaaataaaataaagatatatctgaaccctta

SEQ ID NO: 199151 - DNA, 75 bp, Artificial Sequence
  Synthetic
tggtggagctatcatccctggacagaaaaatactgtctctatatttgcccttggaccgacaataactgatgataa

SEQ ID NO: 199152 - DNA, 75 bp, Artificial Sequence
  Synthetic
tcctcagagatcccatacatggtgagttcgcaccaggcaactatcctgccatatggagctatgcaatgggagtgg

SEQ ID NO: 199153 - DNA, 75 bp, Artificial Sequence
  Synthetic
taacaacaaatggaagtaatgcagatgtcaagtatgtcatatacatgattgagaaagatctaaaacggcaaaagt

SEQ ID NO: 199154 - DNA, 75 bp, Artificial Sequence
  Synthetic
ctgtacagagaggatctgggggaagaggcggctcagatagtagagctgagactgtggtccctggaggaatctcca

SEQ ID NO: 199155 - DNA, 75 bp, Artificial Sequence
  Synthetic
caatttgatctagatatacccattaagccagagtaaataagggataatcaaaaacttaggacaaaagaagtcaac

SEQ ID NO: 199156 - DNA, 75 bp, Artificial Sequence
  Synthetic
agagaccggcaacacagcaaacaccgaacacaatgctagcttcaacattgttaattattacaaccatgattatgg

SEQ ID NO: 199157 - DNA, 75 bp, Artificial Sequence
  Synthetic
ctcaatgaaattggaaagatggataaggactctattgaggggaaaatgcgacaatctgcagatgttccaagcgag

SEQ ID NO: 199158 - DNA, 75 bp, Artificial Sequence
  Synthetic
aaaattccaaaagcgaccggcaacacaacaagcaccgaacacaatgctaatttcaatattgttaattatcacaac

SEQ ID NO: 199159 - DNA, 75 bp, Artificial Sequence
  Synthetic
aagacacaaatacaatagagatatatcttaacctttatccccaagcctaaggatagacaaaaggtaagaaaaaca

SEQ ID NO: 199160 - DNA, 75 bp, Artificial Sequence
  Synthetic
agagaatggtatatccctcttcccagccatatcatgacgaaaggggcatttctaggtggagcagatgtcaaagaa

SEQ ID NO: 199161 - DNA, 75 bp, Artificial Sequence
  Synthetic
gaaacaagatatctaattttgagtctcataccaaaaatagaagattctaactcttgtggtgaccagcagatcaag

SEQ ID NO: 199162 - DNA, 75 bp, Artificial Sequence
  Synthetic
tgatgaagaagaaatactaatgagaaatagtaggatgaagaaaagttcttcaacacaccaggaagatgacaaaag

SEQ ID NO: 199163 - DNA, 75 bp, Artificial Sequence
  Synthetic
gggctacacaagttttatcagagacactacttgcaaacaatataggaaaattctttcaagaaaatgggatggtga

SEQ ID NO: 199164 - DNA, 75 bp, Artificial Sequence
  Synthetic
ttcaacacaccaggaagatgacaaaagaattaaaaaagggggaaaagggaaagactggtttaagaaatcaaaaga

SEQ ID NO: 199165 - DNA, 75 bp, Artificial Sequence
  Synthetic
agttccaaggtatgcatttgtcaatggaggagtggttgcgaattgtataacaactacatgtacatgcaatggtat

SEQ ID NO: 199166 - DNA, 75 bp, Artificial Sequence
  Synthetic
caggcagggctggtattgagcggtgacacagtggatcagattgggtcaatcatgcggtctcaacagagcttggta

SEQ ID NO: 199167 - DNA, 75 bp, Artificial Sequence
  Synthetic
gcaactaatcgaatcaacattttgatccaaattaataataaataagaaaaacttaggattaaagaatcctattat

SEQ ID NO: 199168 - DNA, 75 bp, Artificial Sequence
  Synthetic
agaattaaaaaagggggaaaagggaaagactggtttaagaaatcaaaagacactgacaaccagacatcaacatca

SEQ ID NO: 199169 - DNA, 75 bp, Artificial Sequence
  Synthetic
ataattctaaaagccatacagatgaccttaaaacctacaataaaataagtaaccttaatttgtcttctaatcaga

SEQ ID NO: 199170 - DNA, 75 bp, Artificial Sequence
  Synthetic
tcaaagggaccacgcgctcccttcatttgtatcctcagagatcctatacatggtgagttcgcaccaggcaactat

SEQ ID NO: 199171 - DNA, 75 bp, Artificial Sequence
  Synthetic
tagaaaatcaaagagaacaattgtcattgattacgtcattaatttcaaatcttaaaattatgactgagagaggag

SEQ ID NO: 199172 - DNA, 75 bp, Artificial Sequence
  Synthetic
cctgccatatggagctatgcaatgggggtggcagttgtacaaaatagagccatgcaacagtatgtgacgggaaga

SEQ ID NO: 199173 - DNA, 75 bp, Artificial Sequence
  Synthetic
gtatcctcagagatcctatacatggtgagttcgcaccaggcaactatcctgccatatggagctatgcaatggggg

SEQ ID NO: 199174 - DNA, 75 bp, Artificial Sequence
  Synthetic
aagggaccacgcgctcctttcatttgtatcctcagagatcctatacatggtgagttcgcaccaggcaactatcct

SEQ ID NO: 199175 - DNA, 75 bp, Artificial Sequence
  Synthetic
acatataaggaacataaacagttcagagacatctttccacaaaccaacaggtggatcagccatagagatggcaat

SEQ ID NO: 199176 - DNA, 75 bp, Artificial Sequence
  Synthetic
agacaaatccaaattcgaaatggaatactggaagcacaccaaccacggaaaggatgttggcaatgagctggaaac

SEQ ID NO: 199177 - DNA, 75 bp, Artificial Sequence
  Synthetic
aacctcaatcatccataattcaatatgcctgggcagaaggaaatagaagcgatgatcagactgagcaggctacag

SEQ ID NO: 199178 - DNA, 75 bp, Artificial Sequence
  Synthetic
agatgatgaagaagaaatactaatgagaaatagtaggatgaagaaaagttcttcaacacaccaggaagatgacaa

SEQ ID NO: 199179 - DNA, 75 bp, Artificial Sequence
  Synthetic
tctcaaaaacaacaaccatcaacaccgacacaaaggggcaaacagaaatacagacagaatcatcaggaacacaat

SEQ ID NO: 199180 - DNA, 75 bp, Artificial Sequence
  Synthetic
cctcatcatggaatctcaccattgataacaacacagatcgaaccgaacagacaaacacaactcccccaacaacaa

SEQ ID NO: 199181 - DNA, 75 bp, Artificial Sequence
  Synthetic
acactgacaaccagacatcaacatcagatcacagatccacatcaaaagggcaaaagaaaatctcaaagacaacaa

SEQ ID NO: 199182 - DNA, 75 bp, Artificial Sequence
  Synthetic
agatcacagatccacatcaaaagggcaaaagaaaatctcaaagacaacaactaccaacaccgacacaaaggggca

SEQ ID NO: 199183 - DNA, 75 bp, Artificial Sequence
  Synthetic
ttttgattcaaatcaataataaataagaaaaacttaggattaaagaatcctatcacaccagaatatagagtggta

SEQ ID NO: 199184 - DNA, 75 bp, Artificial Sequence
  Synthetic
aacagaaatacagacagaaccatcagaaacacaatctccatcatggaatctcaccatcgacaacaacactgaccg

SEQ ID NO: 199185 - DNA, 75 bp, Artificial Sequence
  Synthetic
acatatctcaatgtccaagaaccacagtcacatcagacatagttccaaggtatgcatttgtcaatggaggagtgg

SEQ ID NO: 199186 - DNA, 75 bp, Artificial Sequence
  Synthetic
agtgtctgaactaatggacatgttcaatgaggatgtcaacaattgctaatgatccaataaagaaataacaccgaa

SEQ ID NO: 199187 - DNA, 75 bp, Artificial Sequence
  Synthetic
caacatcattgaattcatactcagcaccgacccccaagaagacctatcggaaaacgacacaatcaacacaagaac

SEQ ID NO: 199188 - DNA, 75 bp, Artificial Sequence
  Synthetic
gtcaagatgttttgtaaggaatattggtgatccatcagttgctgcattagctgatattaaaagatttattaaggc

SEQ ID NO: 199189 - DNA, 75 bp, Artificial Sequence
  Synthetic
aaaacgacacaatcaacacaagaacccagcaactcagtgccaccatctgtcaaccagaaatcaaaccaacagaaa

SEQ ID NO: 199190 - DNA, 75 bp, Artificial Sequence
  Synthetic
ttgaaagaagaaaagatcaagaaaactaggtttgacccacttatggagacacaagggattgacaagaatatacct

SEQ ID NO: 199191 - DNA, 75 bp, Artificial Sequence
  Synthetic
tagaaccattaccactcaaagtcaatgaacagagaaaggcagtacctcacattagagttgccaaaattggaaatc

SEQ ID NO: 199192 - DNA, 75 bp, Artificial Sequence
  Synthetic
caccaaaacacggatcccggtatttagatgtctttctactcggcttcttcgagatggaacgaatcaaagataaat

SEQ ID NO: 199193 - DNA, 75 bp, Artificial Sequence
  Synthetic
aattgtaagcgataaaatcaagtatgaagatatgtgttcagtagaccttgccatagcattgcgacaaaagatgtg

SEQ ID NO: 199194 - DNA, 75 bp, Artificial Sequence
  Synthetic
agtacaaaatataaaaccagaactgtacccatggtctagtagactaagaaaaggaatgctgttcgatgccaacaa

SEQ ID NO: 199195 - DNA, 75 bp, Artificial Sequence
  Synthetic
agttgctcttgctcctcaatgtcttccactagataggagcataaaattcagagtaatcttcgtgaattgtacggc

SEQ ID NO: 199196 - DNA, 75 bp, Artificial Sequence
  Synthetic
cagctggtattcaagagggagatttgttatcctttaatggacctaaatccgcatctcaatctagttatctgggct

SEQ ID NO: 199197 - DNA, 75 bp, Artificial Sequence
  Synthetic
atggatctcggtatttagatgtcttcctactaggcttcttcgaaatggaacgaatcaaagacaaatacgggagtg

SEQ ID NO: 199198 - DNA, 75 bp, Artificial Sequence
  Synthetic
caacactgacacaaaggggcaaacagaaacacagacagaaccatcagaaacacaatctccatcatggaatctcac

SEQ ID NO: 199199 - DNA, 75 bp, Artificial Sequence
  Synthetic
ttacctaacacaatatcaatcaatctgcaggtacacatcaaaacaggggttcagactgactccaaaggggtagtt

SEQ ID NO: 199200 - DNA, 75 bp, Artificial Sequence
  Synthetic
aaatcccaaagacaacaaccaccaacaccgacacaaaggggcaaacagaaatacaaacagaatcatcagaaacac

SEQ ID NO: 199201 - DNA, 75 bp, Artificial Sequence
  Synthetic
gttcaaaattcctaagtcaatggcatcactatctctacctaacacaatatcaatcaatctgcaggtacacatcaa

SEQ ID NO: 199202 - DNA, 75 bp, Artificial Sequence
  Synthetic
ttacaaagtttgtggctctggatcattaccaatcggattggctaaatacactgggaatgaccaggaattattaca

SEQ ID NO: 199203 - DNA, 75 bp, Artificial Sequence
  Synthetic
gccagagtaaataagggataatcaaaaacttaggacaaaagaagtcaacgccaacaactattagcagtcatactt

SEQ ID NO: 199204 - DNA, 75 bp, Artificial Sequence
  Synthetic
aaaagaatcaatccgaacaaactctgaatccaagcccaagacacaaaagacaaatggaaaggaaaggaaggatac

SEQ ID NO: 199205 - DNA, 75 bp, Artificial Sequence
  Synthetic
caacttccagatcaacctatacaaaagaatcgatccgaacaaattctgaatccaaacccaagacacaaaagacaa

SEQ ID NO: 199206 - DNA, 75 bp, Artificial Sequence
  Synthetic
gccaacgactgttgatggctgtgtcagaactccgtccttagtgataaatgatctgatttatgcttacacctcaaa

SEQ ID NO: 199207 - DNA, 75 bp, Artificial Sequence
  Synthetic
tgcaactcagatgaaattctccagtacatcattgatcagagtcagcagattcataacaatgtccaatgataacat

SEQ ID NO: 199208 - DNA, 75 bp, Artificial Sequence
  Synthetic
gtatgtgtagcaaatgtactaaacaatgtagacactgcatcaaagatagacttcctggcaggattagtcataggg

SEQ ID NO: 199209 - DNA, 75 bp, Artificial Sequence
  Synthetic
tgccaaatagacatcacaaaactacagcatgtaggtgtattggtcaacagtcccaaagggatgaagatatcacaa

SEQ ID NO: 199210 - DNA, 75 bp, Artificial Sequence
  Synthetic
gattccaaagggatagttcaaattttgaatgagaagggcgaaaaatcactgaatttcatgatccatctcggattg

SEQ ID NO: 199211 - DNA, 75 bp, Artificial Sequence
  Synthetic
tgatagaaaatcaaagagaacaattgtcattgatcacgtcattaatttcaaatcttaaaattatgactgagagag

SEQ ID NO: 199212 - DNA, 75 bp, Artificial Sequence
  Synthetic
gtcattgatcacgtcattaatttcaaatcttaaaattatgactgagagaggaggaaagaaagaccaaaatgaatc

SEQ ID NO: 199213 - DNA, 75 bp, Artificial Sequence
  Synthetic
aatcaaaaacttaggacaaaagaggtcaacaccaataaccgtcagcagtcatacctgtcggaacaataaagaaag

SEQ ID NO: 199214 - DNA, 75 bp, Artificial Sequence
  Synthetic
aacaacaagatcaaaacatccaattcactcaaaataaaaattccaaaagagaccggcaacacaacaagcaccgaa

SEQ ID NO: 199215 - DNA, 75 bp, Artificial Sequence
  Synthetic
attattacaaccatgatcatggcatcacactgccaaatagacatcacaaaactacagcatgtaggtgtattggtc

SEQ ID NO: 199216 - DNA, 75 bp, Artificial Sequence
  Synthetic
atcgcaaaaggagttgggaaaatcaaacaatggaactaataatctctacttcaatctggacgcatccattaagcc

SEQ ID NO: 199217 - DNA, 75 bp, Artificial Sequence
  Synthetic
acacaatgctaatttcaatattgtcaattattacaaccatgatcatggcatcacactgccaaatagacattacaa

SEQ ID NO: 199218 - DNA, 75 bp, Artificial Sequence
  Synthetic
cttaggacaaaagaggtcaacaccaacaactattagcagtcatactcgcaggaacaagaaagaagggacaaaaaa

SEQ ID NO: 199219 - DNA, 75 bp, Artificial Sequence
  Synthetic
agcaaaataggagaaatcaaaacaaaaagtacagaacaccaaaacaacaaaaccaaaaaatctgatctattaaaa

SEQ ID NO: 199220 - DNA, 75 bp, Artificial Sequence
  Synthetic
ataaaaatcccaaaagagactggcaacacagcaaacactaaacacaatgccaacttcaacactgctaattattac

SEQ ID NO: 199221 - DNA, 75 bp, Artificial Sequence
  Synthetic
caacaaagaaacgacactgaacaaacagacaagaaacaacagcagatcaaaaactgtcaacacacacaaaatcaa

SEQ ID NO: 199222 - DNA, 75 bp, Artificial Sequence
  Synthetic
aatcaatatacaaataagaaaaacttaggattaaagaataaattaatccttgtccaaaatgagtataactaactc

SEQ ID NO: 199223 - DNA, 75 bp, Artificial Sequence
  Synthetic
cattaccactcaaagtcaatgaacagaggaaagcagtaccccacattagagttgtcaaaatcggaaatccaccaa

SEQ ID NO: 199224 - DNA, 75 bp, Artificial Sequence
  Synthetic
tatggggaaagattataatctgttagaagaccagaagaatctcttattgatacatccagaattggttttgatatt

SEQ ID NO: 199225 - DNA, 75 bp, Artificial Sequence
  Synthetic
aattgcatcttttggacctaacctgttaaacttaacatacttagagagacttgatctattgaaacaatatcttga

SEQ ID NO: 199226 - DNA, 75 bp, Artificial Sequence
  Synthetic
ggaattgcattaacacagcattactcagaattaacaaacatatttggtgataacataggatcgttacaagaaaaa

SEQ ID NO: 199227 - DNA, 75 bp, Artificial Sequence
  Synthetic
gctctgggagtagcaacctcagcacaaatcacagcggcggttgctctggttgaagccaagcaggcaagatcagat

SEQ ID NO: 199228 - DNA, 75 bp, Artificial Sequence
  Synthetic
tcattaccaatcggattggctaagtacactgggaatgatcaggaattgttacaagctgcaaccaaactggacata

SEQ ID NO: 199229 - DNA, 75 bp, Artificial Sequence
  Synthetic
attgagaaactcaaagaagcaatcagggacacaaacaaagcagtgcagtcagttcagagctccatagggaatcta

SEQ ID NO: 199230 - DNA, 75 bp, Artificial Sequence
  Synthetic
acaaaatataaaaccagaactgtacccatggtctagtagactaagaaaaggaatgctgttcgatgccaacaaagt

SEQ ID NO: 199231 - DNA, 75 bp, Artificial Sequence
  Synthetic
gaagtgagaagaacagttaaagcgaaagagatggttgtttacacggtacaaaatataaaaccagaactgtaccca

SEQ ID NO: 199232 - DNA, 75 bp, Artificial Sequence
  Synthetic
gaatgctgttcgatgccaacaaagttgctcttgctcctcaatgtcttccactagataggagcataaaattcagag

SEQ ID NO: 199233 - DNA, 75 bp, Artificial Sequence
  Synthetic
tatatgatggactaagattacagaaggatgtgatagtgactaatcaagaatccaatgaaaacactgatcccagaa

SEQ ID NO: 199234 - DNA, 75 bp, Artificial Sequence
  Synthetic
ccaacagatcaagcaatacaagaggttattggatagactgatcattcctttatatgatggactaagattacagaa

SEQ ID NO: 199235 - DNA, 75 bp, Artificial Sequence
  Synthetic
ataacactaaacaattctgttgctcttgatccaattgacatatcaatcgagctcaacaaggccaaatcagatcta

SEQ ID NO: 199236 - DNA, 75 bp, Artificial Sequence
  Synthetic
atagtagcaatcaaatcagtccaagattatgtcaacaaagaaatcgtgccatcaattgcgaggctaggttgtgaa

SEQ ID NO: 199237 - DNA, 75 bp, Artificial Sequence
  Synthetic
gaagattaaaattaatattaactgagaaagtgagtgatttaggaaaatacacatttatcagatacccagaaatgt

SEQ ID NO: 199238 - DNA, 75 bp, Artificial Sequence
  Synthetic
tttctaggtggagcagatgtcaaagaatgcatagaagcattcagcagttatatatgcccctctgatccaggattt

SEQ ID NO: 199239 - DNA, 75 bp, Artificial Sequence
  Synthetic
agattctggatgagaaaggcgaaaaatcactgaatttcatggtccatctcggattgatcaaaagaaaagtaggca

SEQ ID NO: 199240 - DNA, 75 bp, Artificial Sequence
  Synthetic
acatgtacatgcaatggtatcggtaatagaatcaaccaaccacctgatcaaggagtcaaaattataacacataaa

SEQ ID NO: 199241 - DNA, 75 bp, Artificial Sequence
  Synthetic
agtcagctggtattcaagagggagatttgttatcctttaatggacctaaatccgcatctcaatctagttatctgg

SEQ ID NO: 199242 - DNA, 75 bp, Artificial Sequence
  Synthetic
aaatggtacaatccattcaagacatggtttaccatcaagtatgatatgaggagattacaaaaagctcgaaatgag

SEQ ID NO: 199243 - DNA, 75 bp, Artificial Sequence
  Synthetic
attattgcaaaaggagttgggaaaatcaaacaatggaactagtaatctctatttcaatccagacgtatccattaa

SEQ ID NO: 199244 - DNA, 75 bp, Artificial Sequence
  Synthetic
accaacaggtggatcagccatagagatggcaatagatgaagagccagaacaattcgaacatagagcagatcaaga

SEQ ID NO: 199245 - DNA, 75 bp, Artificial Sequence
  Synthetic
ccaacaaccattagcagtcatactcgcaagaataagaagggagggattttaaaagttaaatagaggaaatcaaaa

SEQ ID NO: 199246 - DNA, 75 bp, Artificial Sequence
  Synthetic
gaatcaaaagaatggataagaaagtcaaatcaaaaactagattctattgggaattggcatcaatctagcaccaca

SEQ ID NO: 199247 - DNA, 75 bp, Artificial Sequence
  Synthetic
aaaagttaaatagaggaaatcaaaacaaaaagtacagaacaccagaacaacaaaatcaaaacatccaactcactc

SEQ ID NO: 199248 - DNA, 75 bp, Artificial Sequence
  Synthetic
caaaatcaaaacatccaactcactcaaaacaaaaatcccaaaagagaccagtaatacaacaagcactgagcacaa

SEQ ID NO: 199249 - DNA, 75 bp, Artificial Sequence
  Synthetic
caaagaataacacatgatgtaggtataaaacctctaaatccagatgatttttggagatgcacgtctggtcttcca

SEQ ID NO: 199250 - DNA, 75 bp, Artificial Sequence
  Synthetic
tggatcaaaatgacaagccatatgtactaacaaacaaataacatatctatagatcatcagatattaagattataa

SEQ ID NO: 199251 - DNA, 75 bp, Artificial Sequence
  Synthetic
gaagcacaccaaccacggaaaggatgttggtaatgagctggagacatccacagccactcatggcaacaagctcac

SEQ ID NO: 199252 - DNA, 75 bp, Artificial Sequence
  Synthetic
aagaatttttatcaactccagatctgactaatatcaataatataatccaaagttttcagcgaacaatcaaggatg

SEQ ID NO: 199253 - DNA, 75 bp, Artificial Sequence
  Synthetic
tgagcctcataccaaaaatagaagactctaactcttgtggtgaccagcagatcaagcaatacaagaagctactgg

SEQ ID NO: 199254 - DNA, 75 bp, Artificial Sequence
  Synthetic
atagactgatcatccctttatatgatggattaagattacagaaagatgtgatagtaaccaatcaggaatccaatg

SEQ ID NO: 199255 - DNA, 75 bp, Artificial Sequence
  Synthetic
gggattatataatgagaacactgagagatacctcccattcaatattaaaagtattatctaatgcattatctcatc

SEQ ID NO: 199256 - DNA, 75 bp, Artificial Sequence
  Synthetic
tagtgaaaaggtccataattcattgctacaagaaataaataatgagtttatggagattacagaaaagatccaaat

SEQ ID NO: 199257 - DNA, 75 bp, Artificial Sequence
  Synthetic
cccatacatggtgagttcgcaccaggcaactatcctgccatatggagttatgcaatgggagtggcagttgtacaa

SEQ ID NO: 199258 - DNA, 75 bp, Artificial Sequence
  Synthetic
tccaggattatgtcaacaacgaaatcgtgccatcgattacgagactaggttgtgaagcagcaggacttcagttag

SEQ ID NO: 199259 - DNA, 75 bp, Artificial Sequence
  Synthetic
ttcttacaattcagagtcatgtccagaattatataccaatatcattgacacaacagatgtcggatcttaggaaat

SEQ ID NO: 199260 - DNA, 75 bp, Artificial Sequence
  Synthetic
tgtgaagcagcaggacttcagttaggaattgcattaacacagcattactcagaattaacaaacatatttggtgat

SEQ ID NO: 199261 - DNA, 75 bp, Artificial Sequence
  Synthetic
aaatatgtacaaatatctggattattaattaaatcattcccatcaactgtaacatatgtaagaaagactgcaatc

SEQ ID NO: 199262 - DNA, 75 bp, Artificial Sequence
  Synthetic
tgttggtaatgagctggaaacatccacagccactcatggcaacaagctcaccaacaagataacatatatattatg

SEQ ID NO: 199263 - DNA, 75 bp, Artificial Sequence
  Synthetic
tcaacacgatgaatttgacatcgattaaaacataaatacaataaagatatatcctaatctttatctttaagccta

SEQ ID NO: 199264 - DNA, 75 bp, Artificial Sequence
  Synthetic
gaggtgcacgtctggtcttccatttttaatgagaaacccaaaaataaggttaatgccagggccgggattattagc

SEQ ID NO: 199265 - DNA, 75 bp, Artificial Sequence
  Synthetic
tacagaatcaataaaggtgagagttatagatgttgatttgaatgattactcaatcactctccaagtcagactccc

SEQ ID NO: 199266 - DNA, 75 bp, Artificial Sequence
  Synthetic
ttcaacataaatgacaatagaaagtcatgttctctagcactcctaaatacagatgtatatcaactgtgttcaact

SEQ ID NO: 199267 - DNA, 75 bp, Artificial Sequence
  Synthetic
ggtacctgacttaaatcctaggatctctcataccttcaacataaatgacaatagaaaatcatgctctctagcact

SEQ ID NO: 199268 - DNA, 75 bp, Artificial Sequence
  Synthetic
cgaatcattgctacaagacataaataatgagtttatggaagttacagaaaagatccaagtggcatctgataatac

SEQ ID NO: 199269 - DNA, 75 bp, Artificial Sequence
  Synthetic
caaatctacaaagtagattccatatcatataatatccaaaacagagaatggtatatcccccttcccagccatatc

SEQ ID NO: 199270 - DNA, 75 bp, Artificial Sequence
  Synthetic
caaccatatgcggcattatacccatctgttggaccagggatatactacaaaggcaaaataatatttctcgggtat

SEQ ID NO: 199271 - DNA, 75 bp, Artificial Sequence
  Synthetic
ctgttggaccagggatatactacaaaggcaaaataatatttctcgggtatggaggtcttgaacatccaataaatg

SEQ ID NO: 199272 - DNA, 75 bp, Artificial Sequence
  Synthetic
gtcacatcagacattgttccaagatatgcatttgtcaatggaggagtggttgcaaactgtataacaactacttgt

SEQ ID NO: 199273 - DNA, 75 bp, Artificial Sequence
  Synthetic
gaatcaaccaaccacctgatcaaggagtaaaaattataacacataaagaatgcaatacaataggtatcaacggaa

SEQ ID NO: 199274 - DNA, 75 bp, Artificial Sequence
  Synthetic
cagcaagttacaattaggaataattgacattactgactacagtgatataaggataaaatggacatggcataatgt

SEQ ID NO: 199275 - DNA, 75 bp, Artificial Sequence
  Synthetic
attaaagaatcctatcacaccggaatatagagtggtaaatttagaatctgcttgcaactcaatcaatagagagtt

SEQ ID NO: 199276 - DNA, 75 bp, Artificial Sequence
  Synthetic
tattggaagttggcatcaatccagcactacaattatagttattttgataatgatgattatattgtttataattaa

SEQ ID NO: 199277 - DNA, 75 bp, Artificial Sequence
  Synthetic
attatgcatcatcaggcatagaagatattgtacttgatattgtcaattatgatggctcaatctcaacaacaagat

SEQ ID NO: 199278 - DNA, 75 bp, Artificial Sequence
  Synthetic
atatggatgacgactcaatactagctatcactagacagaaaataaaactcaataaattagataaaagacaacgat

SEQ ID NO: 199279 - DNA, 75 bp, Artificial Sequence
  Synthetic
tatcactagacagaaaataaaactcaataaattagataaaagacaacgatctattagaagattaaaattaatatt

SEQ ID NO: 199280 - DNA, 75 bp, Artificial Sequence
  Synthetic
tccactaaatcccacagggagcattgtgtcatctgtcatactagactcacagaaatcgagagtgaacccagtcat

SEQ ID NO: 199281 - DNA, 75 bp, Artificial Sequence
  Synthetic
tattacagaattcaaaagagaaatcgaatggatcaaaatgacaagccgtatgtactgacaaacaaataatatatc

SEQ ID NO: 199282 - DNA, 75 bp, Artificial Sequence
  Synthetic
ttgagaaagaacccaacagacgaatccaaattcgaaatggaatactggaagcacaccaatcacggaaaggatgct

SEQ ID NO: 199283 - DNA, 75 bp, Artificial Sequence
  Synthetic
atttgatatcgattaagacacaaatacaatagagatatatcctaacctttatccccaaacctaaagatagacaaa

SEQ ID NO: 199284 - DNA, 75 bp, Artificial Sequence
  Synthetic
taccaatcatggaaaggatgctggtaatgagctggagacgtccatggctactcatggcaacaagatcaccaataa

SEQ ID NO: 199285 - DNA, 75 bp, Artificial Sequence
  Synthetic
agactgcaatcaggcatctcatagtccatggttttcagatagaaggatggtcaactccatcattgttgttgacaa

SEQ ID NO: 199286 - DNA, 75 bp, Artificial Sequence
  Synthetic
catcaaaagtgaaaaggcccacgaatcattgctacaagacataaataatgagtttatggaagttacagaaaagat

SEQ ID NO: 199287 - DNA, 75 bp, Artificial Sequence
  Synthetic
tgtcaagatgttttgtaaggaacattggtgatccatcagttgctgcattagctgatattaaaagatttattaagg

SEQ ID NO: 199288 - DNA, 75 bp, Artificial Sequence
  Synthetic
atgagtctacctcagccttatgatatggatgacgactcaatactagttatcactagacagaaaataaaactcaat

SEQ ID NO: 199289 - DNA, 75 bp, Artificial Sequence
  Synthetic
gatctaatacagtcaggagtgaatacaaggcttcttacaattcagagtcatgtccagaattatataccaatatca

SEQ ID NO: 199290 - DNA, 75 bp, Artificial Sequence
  Synthetic
atgtccatggggacattcatgtccggatggatgtataacgggagtatatactgatgcatatccactcaatcccac

SEQ ID NO: 199291 - DNA, 75 bp, Artificial Sequence
  Synthetic
gatggatgtataacgggagtatatactgatgcatatccactcaatcccacaggaagcattgtatcatctgtcata

SEQ ID NO: 199292 - DNA, 75 bp, Artificial Sequence
  Synthetic
tatcctgagtgtcacctcaattctcctatcgttaaaggtaaaatagcacaattacacacaattatgagtctacct

SEQ ID NO: 199293 - DNA, 75 bp, Artificial Sequence
  Synthetic
agtaaagtgactgaactattacttaaagcagatagaacatatagtcaaatgactgatggattaagagatctatgg

SEQ ID NO: 199294 - DNA, 75 bp, Artificial Sequence
  Synthetic
caggatataggaaaatcatatcaagtcttacagatagggataataactgtaaactcagacttggtacctgactta

SEQ ID NO: 199295 - DNA, 75 bp, Artificial Sequence
  Synthetic
tacgtaagaaagactgcaatcaaatatttaaggattcgcggtattagtccacctgaggtaattgatgattgggat

SEQ ID NO: 199296 - DNA, 75 bp, Artificial Sequence
  Synthetic
ttgatatttgaatctagagaatcgattaaggaatttctgagtgtagattacattgataaaatcttagatattttt

SEQ ID NO: 199297 - DNA, 75 bp, Artificial Sequence
  Synthetic
agaaccacttgcattatccctaattcaaactcatgatcctgtcaaacaactaagaggagcttttttaaatcatgt

SEQ ID NO: 199298 - DNA, 75 bp, Artificial Sequence
  Synthetic
tcctgggaaaacacagagagactgcaatcaggcatctcatagtccatggttttcagatagaaggatggtcaactc

SEQ ID NO: 199299 - DNA, 75 bp, Artificial Sequence
  Synthetic
tgatctgcaacacaactgggtgtcccgggaaaacacagagagactgtaatcaagcgtctcatagtccatggtttt

SEQ ID NO: 199300 - DNA, 75 bp, Artificial Sequence
  Synthetic
aggaaaattctttcaagaaaatgggatggtgaagggagagattgaattacttaagagattaacgactatatcaat

SEQ ID NO: 199301 - DNA, 75 bp, Artificial Sequence
  Synthetic
aagaccaggaaacaatgaatgtccatggggacattcatgtccagatggatgtataacaggagtatatactgatgc

SEQ ID NO: 199302 - DNA, 75 bp, Artificial Sequence
  Synthetic
caaatatttggattaaataaattgtttaattggttacatcctcgtcttgaaggaagtacaatctatgtaggtgat

SEQ ID NO: 199303 - DNA, 75 bp, Artificial Sequence
  Synthetic
aaacacatttcaacccatgttgttcaaaacagagattccaaaaagctgcagttaatcataattaaccataatatg

SEQ ID NO: 199304 - DNA, 75 bp, Artificial Sequence
  Synthetic
agatagtttataaagatgtagtgagattttttgattcattaagagaggtgatggatgatctaggtcatgaactta

SEQ ID NO: 199305 - DNA, 75 bp, Artificial Sequence
  Synthetic
tttacgttcataacccaagagggggtatagaaggattttgtcaaaaattgtggacacttatatccataagtgcaa

SEQ ID NO: 199306 - DNA, 75 bp, Artificial Sequence
  Synthetic
tacatctagcagctgttaggataggtgtgagggtgactgcaatggttcaaggagacaatcaagccatagctgtaa

SEQ ID NO: 199307 - DNA, 75 bp, Artificial Sequence
  Synthetic
aactgaaaaagtgaatgacttaggaaaatacacatttatcagatatccagaaatgtcaaaagaaatgttcaaatt

SEQ ID NO: 199308 - DNA, 75 bp, Artificial Sequence
  Synthetic
attacatatacccggtattaacagtaaagtgaccgaattattacttaaagcagatagaacatatagtcaaatgac

SEQ ID NO: 199309 - DNA, 75 bp, Artificial Sequence
  Synthetic
cctttatctccaagcctaaggatagataaaaagtaagaaaaacatgtaatatatatataccaaacagagttcttc

SEQ ID NO: 199310 - DNA, 75 bp, Artificial Sequence
  Synthetic
gcaaacagaaacacagacagaactatcagaaacacaatctccatcatggaatctcaccatcgacaacaacaccga

SEQ ID NO: 199311 - DNA, 75 bp, Artificial Sequence
  Synthetic
tgatccagaatttaatatttcttatagtctcaaagaaaaggagatcaaacaagaaggtagactctttgcaaaaat

SEQ ID NO: 199312 - DNA, 75 bp, Artificial Sequence
  Synthetic
aatcagtaattatgatctagtgcaatatgaaacactaagtaggactttgcgattaattgtaagtgataaaatcag

SEQ ID NO: 199313 - DNA, 75 bp, Artificial Sequence
  Synthetic
aaatccattattatctggattattcacaaatacaatgatagaagaagatgaagaattagccgagttcttgatgga

SEQ ID NO: 199314 - DNA, 75 bp, Artificial Sequence
  Synthetic
tggttgaatggtgtatcacttgaaatatacatttgtgacagcgatatggaagtagcaaatgacaggaaacaagcc

SEQ ID NO: 199315 - DNA, 75 bp, Artificial Sequence
  Synthetic
acaatatcttgaattaaatatcaaagaagaccctactcttaaatatgtacaaatatctggattattaattaaatc

SEQ ID NO: 199316 - DNA, 75 bp, Artificial Sequence
  Synthetic
agcaaaagaatatattatgatgggagaattcttcctcaagctctgaaagcattatctagatgtgtcttctggtca

SEQ ID NO: 199317 - DNA, 75 bp, Artificial Sequence
  Synthetic
gaagatgaaaatatgctggataacattgtcaaatctataaatgataactgtaataaagataataaagggaataaa

SEQ ID NO: 199318 - DNA, 75 bp, Artificial Sequence
  Synthetic
ctgtacaataataattaacggatacagagagaggcatggtggacagtggcctcctgtgacattacctgatcatgc

SEQ ID NO: 199319 - DNA, 75 bp, Artificial Sequence
  Synthetic
atggatttgaaatcaatttaaatcatctggcgaaagaatttttatcaactccagatctaactaatatcaacaata

SEQ ID NO: 199320 - DNA, 75 bp, Artificial Sequence
  Synthetic
ttggatttgaaatcaatttaaatcatctggcgaaagaatttttatcaactccagatctaactaatatcaacaata

SEQ ID NO: 199321 - DNA, 75 bp, Artificial Sequence
  Synthetic
ctggatttgaaatcaatttaaatcatctggcgaaagaatttttatcaactccagatctaactaatatcaacaata

SEQ ID NO: 199322 - DNA, 75 bp, Artificial Sequence
  Synthetic
gtggatttgaaatcaatttaaatcatctggcgaaagaatttttatcaactccagatctaactaatatcaacaata

SEQ ID NO: 199323 - DNA, 75 bp, Artificial Sequence
  Synthetic
cattatctagatgtgtcttctggtcagaaacagtaatagatgaaacaagatcagcatcttcaaacttggcaacat

SEQ ID NO: 199324 - DNA, 75 bp, Artificial Sequence
  Synthetic
aaaagagaccggcaacacagcaaacaccgaacacaatgctagcttcaatattgttaattattacaaccatgatta

SEQ ID NO: 199325 - DNA, 75 bp, Artificial Sequence
  Synthetic
taaagagaccggcaacacagcaaacaccgaacacaatgctagcttcaatattgttaattattacaaccatgatta

SEQ ID NO: 199326 - DNA, 75 bp, Artificial Sequence
  Synthetic
caaagagaccggcaacacagcaaacaccgaacacaatgctagcttcaatattgttaattattacaaccatgatta

SEQ ID NO: 199327 - DNA, 75 bp, Artificial Sequence
  Synthetic
gaaagagaccggcaacacagcaaacaccgaacacaatgctagcttcaatattgttaattattacaaccatgatta

SEQ ID NO: 199328 - DNA, 75 bp, Artificial Sequence
  Synthetic
caacgaatcacgaagattagttgaagtatttatagcagatagtaaatttgatcctcatcagatattggattatgt

SEQ ID NO: 199329 - DNA, 75 bp, Artificial Sequence
  Synthetic
agagttgcacatgatattctagataattctctcacaggaatcagaaatgctatagctggaatgttagatacgaca

SEQ ID NO: 199330 - DNA, 75 bp, Artificial Sequence
  Synthetic
aatatcaggagttccacggtataatgaagtgtataataattctaaaagccatacagatgatcttaaaacttacaa

SEQ ID NO: 199331 - DNA, 75 bp, Artificial Sequence
  Synthetic
acatccaataaatgagaatgcaatctgtaacaccactgggtgtcctgggaaaacacagagagactgcaatcaggc

SEQ ID NO: 199332 - DNA, 75 bp, Artificial Sequence
  Synthetic
aataggatcagcagaaacaggtatatcatcattaagagttccttattttggatcagtcactgatgaaagatctga

SEQ ID NO: 199333 - DNA, 75 bp, Artificial Sequence
  Synthetic
tggatacgagactgtgagctgtttcctaacaacagatctcaaaaaatactgtcttaattggagatatgaatcaac

SEQ ID NO: 199334 - DNA, 75 bp, Artificial Sequence
  Synthetic
cacaaaccaacaggtggatcagccatagagatggcaatagatgaagagccagaacaattcgaacatagagcagat

SEQ ID NO: 199335 - DNA, 75 bp, Artificial Sequence
  Synthetic
tggatttgaaatcaatttaaatcatctggcgaaagaatttttatcaactccagatctaactaatatcaacaatat

SEQ ID NO: 199336 - DNA, 75 bp, Artificial Sequence
  Synthetic
agattaaaagctctaatggaattgtatttatcaaagggaccacgcgctcccttcatttgtatcctcagagatcct

SEQ ID NO: 199337 - DNA, 75 bp, Artificial Sequence
  Synthetic
aaatgaacttaggattaaagacattgactagaaggtcaagaaaagggaactctacaatttcaaaaatgttgagcc

SEQ ID NO: 199338 - DNA, 75 bp, Artificial Sequence
  Synthetic
atagcatcattataccgcacaaatatcacagaaatattcacaacatcaacagttgataaatatgatatttatgat

SEQ ID NO: 199339 - DNA, 75 bp, Artificial Sequence
  Synthetic
agacccatattcatgcaatttaccacaatctcagaatataaccaccatgataaaaaatataacagcaagaaatgt

SEQ ID NO: 199340 - DNA, 75 bp, Artificial Sequence
  Synthetic
agtgagattttttgattcattaagagaagtgatggatgatctaggtcatgaacttaaattaaatgaaacgattat

SEQ ID NO: 199341 - DNA, 75 bp, Artificial Sequence
  Synthetic
gaagtgatggatgatctaggtcatgaacttaaattaaatgaaacgattataagtagcaagatgttcatatatagc

SEQ ID NO: 199342 - DNA, 75 bp, Artificial Sequence
  Synthetic
acacaccaggaagatgacaaaagaattaaaaaagggggaaaagggaaagactggttcaagaaatcaaaagatact

SEQ ID NO: 199343 - DNA, 75 bp, Artificial Sequence
  Synthetic
gaggtatcattagtaggtaaaaaattaggaaatgtgacacagattcttaacagggtaaaagtactgttcaatggg

SEQ ID NO: 199344 - DNA, 75 bp, Artificial Sequence
  Synthetic
gaaaatctcaaagacaacaaccaccaacactgacacaaaggggcaaacagaaacacagacagaaccatcagaaac

SEQ ID NO: 199345 - DNA, 75 bp, Artificial Sequence
  Synthetic
atcaaaagtgaaaaggcccgcgaatcattgctacaagacataaataatgagtttatggaagttacagaaaagatc

SEQ ID NO: 199346 - DNA, 75 bp, Artificial Sequence
  Synthetic
accaaacaagagaagaaacttgtcaggaaatataaatttaacttaaaattaacttaggattaaagacattgacta

SEQ ID NO: 199347 - DNA, 75 bp, Artificial Sequence
  Synthetic
gatccgatagaagatgaaaatatgctggataacattgtcaaatctataagtgataactgtaataaagataataaa

SEQ ID NO: 199348 - DNA, 75 bp, Artificial Sequence
  Synthetic
tctgtcaaccagaaatcaaaccaacagaaacaagtgaaaaagatagtggatcaactgacaaaaatagacagtctg

SEQ ID NO: 199349 - DNA, 75 bp, Artificial Sequence
  Synthetic
gaatgtgagagcttaatatggagtgaattaaatgataagtctattggattagtacattgtgatatggaaggagct

SEQ ID NO: 199350 - DNA, 75 bp, Artificial Sequence
  Synthetic
caggaaggtaattcttcctagagttgcacatgatattctagataattctcttacaggaattagaaatgccatagc

SEQ ID NO: 199351 - DNA, 75 bp, Artificial Sequence
  Synthetic
tattgcagaatcttggtgtaattcaatccacatcaaaactagatttatatcaagacaagcgagttgtatgtgtag

SEQ ID NO: 199352 - DNA, 75 bp, Artificial Sequence
  Synthetic
gcagtcaaccacctaccaatcccacaaacagaacaaaccaggacgaaatagatgatctgtttaatgcatttggaa

SEQ ID NO: 199353 - DNA, 75 bp, Artificial Sequence
  Synthetic
aaacagaacaaaccaggacgaaatagatgatctgtttaatgcatttggaagcaactaatcgaatcaacgttttaa

SEQ ID NO: 199354 - DNA, 75 bp, Artificial Sequence
  Synthetic
aattaacaatttctggggactagcacttaagaactatcaagtccttaaaatcagatctataacaagtgattctga

SEQ ID NO: 199355 - DNA, 75 bp, Artificial Sequence
  Synthetic
cagatgatgaagaagaaatactaatgagaaacagtaggatgaagaaaagttcttcaacacaccaggaagatgaca

SEQ ID NO: 199356 - DNA, 75 bp, Artificial Sequence
  Synthetic
cagatgatgaagaagaaatactaatgagaaacagtaggatgaagaaaagttcttcaacacaccaggaagatgact

SEQ ID NO: 199357 - DNA, 75 bp, Artificial Sequence
  Synthetic
cagatgatgaagaagaaatactaatgagaaacagtaggatgaagaaaagttcttcaacacaccaggaagatgacc

SEQ ID NO: 199358 - DNA, 75 bp, Artificial Sequence
  Synthetic
cagatgatgaagaagaaatactaatgagaaacagtaggatgaagaaaagttcttcaacacaccaggaagatgacg

SEQ ID NO: 199359 - DNA, 75 bp, Artificial Sequence
  Synthetic
tcgctttcctgatgaaaaatttgaacatagagcacaaactggatatgtgtcattagctgatactgatttagaatc

SEQ ID NO: 199360 - DNA, 75 bp, Artificial Sequence
  Synthetic
gaaagagattatggagttatgagaccatatcatatggcactacaaatctttggatttcaaatcaatttaaatcat

SEQ ID NO: 199361 - DNA, 75 bp, Artificial Sequence
  Synthetic
gaaagcctgaaaagacatataaggaacataaacagttcagagacatctttccataaaccaacaggtggatcagcc

SEQ ID NO: 199362 - DNA, 75 bp, Artificial Sequence
  Synthetic
agtaaacctgcaaaagccgcaataagaatagcaatgatatatacatgggcatttggtaatgatgagatatcttgg

SEQ ID NO: 199363 - DNA, 75 bp, Artificial Sequence
  Synthetic
atcaaaactagatttatatcaagataagcgagttgtatgtgtagcaaatgtactaaacaacgtagacactgcatc

SEQ ID NO: 199364 - DNA, 75 bp, Artificial Sequence
  Synthetic
cttcatcatggaatctcatcatcgacaacaacaccgaccgaaacgaacagacaagcacaactcctccaacaacaa

SEQ ID NO: 199365 - DNA, 75 bp, Artificial Sequence
  Synthetic
tggacatgttcaatgaggatgtcaacaattgctaatgatccaataaagaaataacaccgaataaatagacaagag

SEQ ID NO: 199366 - DNA, 75 bp, Artificial Sequence
  Synthetic
gggagatataatatattcccactgaaaaataagggaaagttaagactgctatcaagaagactagtattaagttgg

SEQ ID NO: 199367 - DNA, 75 bp, Artificial Sequence
  Synthetic
tagagatatatcctaacctttatctccaagcctaaggatagataaaaagtaagaaaaacatgtaatatatatata

SEQ ID NO: 199368 - DNA, 75 bp, Artificial Sequence
  Synthetic
ctgtcaatacacacgaaatcaagcagaatgaaactatagacatcaatcaatatacaaataagaaaaacttaggat

SEQ ID NO: 199369 - DNA, 75 bp, Artificial Sequence
  Synthetic
cctatagttatgcatctgcacatagaagatgagtgttgtattaaagaaagttttaatgatgaacatattaatcca

SEQ ID NO: 199370 - DNA, 75 bp, Artificial Sequence
  Synthetic
tcttgacagtgatccgggttacaaagtctgtggctctggatcattaccaatcggactggctaaatacactgggaa

SEQ ID NO: 199371 - DNA, 75 bp, Artificial Sequence
  Synthetic
tcaatactaaataagtaaaacttaggattaaagaatcctatcacatcggaatatagagtggtaaatttagaatct

SEQ ID NO: 199372 - DNA, 75 bp, Artificial Sequence
  Synthetic
tatgaattattgggatgatactgacatcatacatgcaatttcaatatgtactgcaattacaatagcagatactat

SEQ ID NO: 199373 - DNA, 75 bp, Artificial Sequence
  Synthetic
gacaactgattggatatttggaagtgacctggattatgatcaggaaactatgttgcagaacggcagaaacaattc

SEQ ID NO: 199374 - DNA, 75 bp, Artificial Sequence
  Synthetic
gaaagaagggacaaaaaaagcaaaatagaggaaattgaaacaaaaaatacagaacaccagaacaacaagatcaaa

SEQ ID NO: 199375 - DNA, 75 bp, Artificial Sequence
  Synthetic
ggttctgggattgtggagttttaaaccctatttatggtcctaatactgctagtcaagaccagataaaacttgccc

SEQ ID NO: 199376 - DNA, 75 bp, Artificial Sequence
  Synthetic
aaatttagaatctgcttgcaactcaatcaatagagagttgatggaaagcgatgctaaaaactatcaaatcatgga

SEQ ID NO: 199377 - DNA, 75 bp, Artificial Sequence
  Synthetic
caccgacccccaagaagacctatcggaaaacgacacaatcaacacaagaacccagcaactcagtgccaccatctg

SEQ ID NO: 199378 - DNA, 75 bp, Artificial Sequence
  Synthetic
catttgtcaatggaggagtggttgcaaactgtataacaaccacttgtacatgcaatggaatcggtaatagaatca

SEQ ID NO: 199379 - DNA, 75 bp, Artificial Sequence
  Synthetic
atctgagatggaattgatatttgaatctagagaatcgattaaggaatttctgagtgtagattacattgataaaat

SEQ ID NO: 199380 - DNA, 75 bp, Artificial Sequence
  Synthetic
caaagaaaagacaaaaaaagtcaaatagaagaaatcaaaacaaaaagcatagaacaccagaacaacaagatcaaa

SEQ ID NO: 199381 - DNA, 75 bp, Artificial Sequence
  Synthetic
agttaattattataattcaggtttgaatataacagatgtaattggtcaacgagaattgaaaatatttccttcaga

SEQ ID NO: 199382 - DNA, 75 bp, Artificial Sequence
  Synthetic
aattgattggtggtgctaaattattaggaattcctagacaatataaagaacccgaagaacagttattagaaaact

SEQ ID NO: 199383 - DNA, 75 bp, Artificial Sequence
  Synthetic
aacaatggaattaataatctttattttgatctagatatacccactaagtcagagcaaattaaggataatcaaaaa

SEQ ID NO: 199384 - DNA, 75 bp, Artificial Sequence
  Synthetic
gatgatgttgttttagtttctaaaattatacctacaatcactccgaattggtctagaatactttatctgtataag

SEQ ID NO: 199385 - DNA, 75 bp, Artificial Sequence
  Synthetic
ggatttcaaatcaatttaaatcatctagcgaaagaatttttatcgaccccggacctgactaatatcaacaatata

SEQ ID NO: 199386 - DNA, 75 bp, Artificial Sequence
  Synthetic
atccaaagttttcagcggacaatcaaagatgttttatttgaatggatcaatataactcatgatgataagagacac

SEQ ID NO: 199387 - DNA, 75 bp, Artificial Sequence
  Synthetic
agacaacaaccaccaacactgacacaaaggggcaaacagaaacacagacagaaccatcagaaacacaatctccat

SEQ ID NO: 199388 - DNA, 75 bp, Artificial Sequence
  Synthetic
gaccatatcatatggcactacaaatcttcggatttcaaatcaatttaaatcatctggcgaaagaatttttatcaa

SEQ ID NO: 199389 - DNA, 75 bp, Artificial Sequence
  Synthetic
atattcccactgaaaaataagggaaagttaagactgctatcaagaagactagtattaagttggatttcgttatca

SEQ ID NO: 199390 - DNA, 75 bp, Artificial Sequence
  Synthetic
atatgatgaatttgatatcgattaaaatataaatataatgaagatatatcctaacctttatctttaagcccaagg

SEQ ID NO: 199391 - DNA, 75 bp, Artificial Sequence
  Synthetic
gagctagagacatccacagccacccatggcaacaggctcaccaacaagataacatatatattatggacgataacc

SEQ ID NO: 199392 - DNA, 75 bp, Artificial Sequence
  Synthetic
atggcaacaggctcaccaacaagataacatatatattatggacgataaccctggtgttattatcaatagtcttca

SEQ ID NO: 199393 - DNA, 75 bp, Artificial Sequence
  Synthetic
gttctacatgaacattatagtgttataagaattacatacttgattggggatgatgatgttgttttagtttctaag

SEQ ID NO: 199394 - DNA, 75 bp, Artificial Sequence
  Synthetic
accagatgatgaagaagaaatactaatgagaaatagtaggatgaagaaaagttcttcaacacaccaggaagatga

SEQ ID NO: 199395 - DNA, 75 bp, Artificial Sequence
  Synthetic
aagatactgacaaccagatatcaacatcagatcacagatccacatcaaaagggcaaaagaaaatctcaaagacaa

SEQ ID NO: 199396 - DNA, 75 bp, Artificial Sequence
  Synthetic
atcagatcacagatccacatcaaaagggcaaaagaaaatctcaaagacaacaactaccaacactgacacaaaggg

SEQ ID NO: 199397 - DNA, 75 bp, Artificial Sequence
  Synthetic
aagaacagttattagaaaactacaatcaacatgatgaatttgatatcgattaagacacaaatacaataaagatat

SEQ ID NO: 199398 - DNA, 75 bp, Artificial Sequence
  Synthetic
ttatagtctcaaagaaaaagagatcaaacaagaaggtagactctttgcaaaaatgacatacaaaatgagagctac

SEQ ID NO: 199399 - DNA, 75 bp, Artificial Sequence
  Synthetic
accaaacaagagaagaaacttgcttggtaatataaatttaactttaaattaacttaggattaaagacattgacta

SEQ ID NO: 199400 - DNA, 75 bp, Artificial Sequence
  Synthetic
gtgataaatgatctgatttatgcttacacctcaaatctaattactcgaggttaccaagatataggcaaatcatat

SEQ ID NO: 199401 - DNA, 75 bp, Artificial Sequence
  Synthetic
aagttcatacaatgagtcaaatgcaacaagactaatacccaaaaaagtgagcagtacaatgagatcactagttgc

SEQ ID NO: 199402 - DNA, 75 bp, Artificial Sequence
  Synthetic
caaagcacaaaacaatcatatataaacgaactcaagcattgcaaaaatgatgaagaagtgtctgaactaatggac

SEQ ID NO: 199403 - DNA, 75 bp, Artificial Sequence
  Synthetic
attctaaaagccatacagatgatcttaaaacttacaataaactaagtaatcttaatttatccgctaatcagaaat

SEQ ID NO: 199404 - DNA, 75 bp, Artificial Sequence
  Synthetic
aaaaacttaggattaaagaataaattaatccttgtccaaaatgagtataactaactctgcaatatacacattccc

SEQ ID NO: 199405 - DNA, 75 bp, Artificial Sequence
  Synthetic
aacttactcaacagccaccgaaagggtaaacgagctggccatccgaaacaaaacactctcagctggatatacaac

SEQ ID NO: 199406 - DNA, 75 bp, Artificial Sequence
  Synthetic
aaaggggtagttcagattctggatgagaaaggcgaaaaatcactgaatttcatggtccatctcggattgatcaaa

SEQ ID NO: 199407 - DNA, 75 bp, Artificial Sequence
  Synthetic
cagtagcacgtgatgctgaagctcaaatgagctcaacactagaagatgagcttggagtgacacacgaagctaaag

SEQ ID NO: 199408 - DNA, 75 bp, Artificial Sequence
  Synthetic
tgatgaatttgatatcgattaaaacataaatacaatgaagatatatcctaacctttatctttaagcctaaggata

SEQ ID NO: 199409 - DNA, 75 bp, Artificial Sequence
  Synthetic
catctataattcaatatgcttgggcagaaggaaacagaagtgacgatcgaactgagcaagctacagaatccgaca

SEQ ID NO: 199410 - DNA, 75 bp, Artificial Sequence
  Synthetic
atacaacaacaagctgcattacacactataacaaaggatattgttttcatatagtagaaataaatcataaaagct

SEQ ID NO: 199411 - DNA, 75 bp, Artificial Sequence
  Synthetic
aacaaatcaggatgaaatagatgatctgtttagtgcatttggaagcaactaatcgggtcaacattttgatccaga

SEQ ID NO: 199412 - DNA, 75 bp, Artificial Sequence
  Synthetic
cataaatagaggaggactgacatatagtttgttgaggaaaatcagtaattatgatctagcacaatatgaaacact

SEQ ID NO: 199413 - DNA, 75 bp, Artificial Sequence
  Synthetic
gcagaacggcagaaacaattcaacaattgaagaccttgtccacacatttgggtatccatcatgtttaggagctct

SEQ ID NO: 199414 - DNA, 75 bp, Artificial Sequence
  Synthetic
atatacatgggcatttggtaatgatgagatatcttggatggaagcctcacaaatagcacaaacacgtgcaaattt

SEQ ID NO: 199415 - DNA, 75 bp, Artificial Sequence
  Synthetic
acaactcctccaacagccactcccagatcaaccagtacaaaagaatcaatccgaacaaactctgaatccaagccc

SEQ ID NO: 199416 - DNA, 75 bp, Artificial Sequence
  Synthetic
gcttgcaactcaatcaatagagagttgatggaaagcgatgctaaaaactatcaaatcatggattcttgggaagag

SEQ ID NO: 199417 - DNA, 75 bp, Artificial Sequence
  Synthetic
agcctatttgacacatttaatgcacgtaggcaagaaaacataacaaaatcagctggtggagctatcatccctgga

SEQ ID NO: 199418 - DNA, 75 bp, Artificial Sequence
  Synthetic
agggagatttgttatcctttaatggacctaaatccgcatctcaatctagttatctgggcttcatcagtagagatt

SEQ ID NO: 199419 - DNA, 75 bp, Artificial Sequence
  Synthetic
gaggagattacaaaaagctcgaaatgaggtaacttttaatatggggaaggattataacttgctagaagaccagaa

SEQ ID NO: 199420 - DNA, 75 bp, Artificial Sequence
  Synthetic
tgcaacaccagatgatgaagaagaaatactaatgaaaaatagtaggacaaagaaaagttcttcaacacaccaaga

SEQ ID NO: 199421 - DNA, 75 bp, Artificial Sequence
  Synthetic
ggaaaagggaaagactgggttaagaaatcaaaagacactgacaaccagacaccagcatcagaccatagatccaca

SEQ ID NO: 199422 - DNA, 75 bp, Artificial Sequence
  Synthetic
gaatccaatgaaaacactgatcccagaacagaacgattctttggaggggtaattggaactattgctctgggagta

SEQ ID NO: 199423 - DNA, 75 bp, Artificial Sequence
  Synthetic
tcaaaagggcaaaagaaaatcccaaagacaacaaccatcaacaccgacacaaaagggcaaacagaaacacaggca

SEQ ID NO: 199424 - DNA, 75 bp, Artificial Sequence
  Synthetic
cgtgggatctcatcatcgacgacaacaccgaccgaaatggacatacaagcacaactcctccaacaacaacttcca

SEQ ID NO: 199425 - DNA, 75 bp, Artificial Sequence
  Synthetic
gtctgaaagcccttgagttatcacaaattttaatgaaggaagttaataaagacaaggacaggctcttcctgggag

SEQ ID NO: 199426 - DNA, 75 bp, Artificial Sequence
  Synthetic
atttgatatcgattaagacacaaatacaataaagatatatctgaacccttatcttcaagcctaaggatagacaaa

SEQ ID NO: 199427 - DNA, 75 bp, Artificial Sequence
  Synthetic
aaagagaacaactgtcattgattacgtcattaatttcaaatcttaaaattatgactgaaagaggaggaaagaaag

SEQ ID NO: 199428 - DNA, 75 bp, Artificial Sequence
  Synthetic
caaaatgaaaagccatatgtattaacaaacaaatgacacatctgtagatcattaaatattaaaattataaaaaac

SEQ ID NO: 199429 - DNA, 75 bp, Artificial Sequence
  Synthetic
ctaggtggagcagatgtcaaagaatgcatagaagcattcagcagttatatatgcccttctgatccaggatttgta

SEQ ID NO: 199430 - DNA, 75 bp, Artificial Sequence
  Synthetic
gaagaaaagatcaagaaaaccaggtttgacccacttatggaaacacaaggaattgacaagaatatacccgatcta

SEQ ID NO: 199431 - DNA, 75 bp, Artificial Sequence
  Synthetic
ctccactcatataattgagaaagaacccaacagacgaatccaaattcgaaatggaatactggaagcacaccaatc

SEQ ID NO: 199432 - DNA, 75 bp, Artificial Sequence
  Synthetic
ggtgtctttattgtcaatggcttatgccaatccagaactctacttgacaacaaatggaagtaatgcagatgtcaa

SEQ ID NO: 199433 - DNA, 75 bp, Artificial Sequence
  Synthetic
ctctcacaaagcacaaaacaatcatatataaacgaactcaaacattgcaaaaatgatgaagaagtatctgaatta

SEQ ID NO: 199434 - DNA, 75 bp, Artificial Sequence
  Synthetic
tggaatataagtgcatgtgctaagttagatccaaaattacaatctatgtatcagaaaggtaataatctgtgggaa

SEQ ID NO: 199435 - DNA, 75 bp, Artificial Sequence
  Synthetic
aacaacagatatcaatcaatatacaaataagaaaaacttaggattaaagaataaattaatccttgtccaaaatga

SEQ ID NO: 199436 - DNA, 75 bp, Artificial Sequence
  Synthetic
cataaattaggcgggagatataatatattcccactgaaaaataagggaaagttaagactgctatcgagaagacta

SEQ ID NO: 199437 - DNA, 75 bp, Artificial Sequence
  Synthetic
gtattaagttggatttcgttatcattatcgactcgattacttacgggtcgctttcctgatgaaaaatttgaacat

SEQ ID NO: 199438 - DNA, 75 bp, Artificial Sequence
  Synthetic
cccggtatttagatgtcttcctacttggcttcttcgagatggaacgaatcaaagataaatatgggagtgtgaatg

SEQ ID NO: 199439 - DNA, 75 bp, Artificial Sequence
  Synthetic
cagatatggaattgagactagaatggcagctttgactctatccactctcagaccggatatcaatagattaaaagc

SEQ ID NO: 199440 - DNA, 75 bp, Artificial Sequence
  Synthetic
tagctgatactgatttagaatcattaaagttgttgtcgaaaaacattattaagaattacaaagagtgtatagggt

SEQ ID NO: 199441 - DNA, 75 bp, Artificial Sequence
  Synthetic
aagaacccgaagaacagttattagaaaactacaatcaacatgatgaatttgatatcgattaagacacaaatacaa

SEQ ID NO: 199442 - DNA, 75 bp, Artificial Sequence
  Synthetic
gattaaagacattgactagaaggtcaagaaaagggaactctataatttcaaaaatgttgagcctatttgatacat

SEQ ID NO: 199443 - DNA, 75 bp, Artificial Sequence
  Synthetic
aagaaaagggaactctataatttcaaaaatgttgagcctatttgatacatttaatgcacgtaggcaagaaaacat

SEQ ID NO: 199444 - DNA, 75 bp, Artificial Sequence
  Synthetic
tcaatgtcttccactagataggagcataaaatttagagtaatctttgtaaattgtacagcaattggatcagtaac

SEQ ID NO: 199445 - DNA, 75 bp, Artificial Sequence
  Synthetic
gatcttaggaaattcattagtgaaattacaattagaaatgataatcaagaagtgccaccacaaagaataacacat

SEQ ID NO: 199446 - DNA, 75 bp, Artificial Sequence
  Synthetic
aaagggatagttcaaattttggatgagaaaggcgaaaaatcactgaatttcatggtccatctcggattgatcaaa

SEQ ID NO: 199447 - DNA, 75 bp, Artificial Sequence
  Synthetic
gttcaaaacctgtcaatacacacaaaaccaagcagaatgaaacaatagacatcaatcaatatacaaataagaaaa

SEQ ID NO: 199448 - DNA, 75 bp, Artificial Sequence
  Synthetic
agactcaacgacaagaagaaacaaggcagtcaaccacccaccaatcctacaaacagaacaaaccaggacgaaata

SEQ ID NO: 199449 - DNA, 75 bp, Artificial Sequence
  Synthetic
ggactagttggaggaatcagtcttcatgtcaatgcaactggatccatatcaaaaacactagcaagtcagctggta

SEQ ID NO: 199450 - DNA, 75 bp, Artificial Sequence
  Synthetic
agaacaccagaacaacaagatcaaaacatccaattcactcaaaacaaaaattccaaaagagaccggcaacacaac

SEQ ID NO: 199451 - DNA, 75 bp, Artificial Sequence
  Synthetic
cagatactatcctaatattattgcaaaaggagttgggaaaatcaaacaatggaactagtaatctctactttaatc

SEQ ID NO: 199452 - DNA, 75 bp, Artificial Sequence
  Synthetic
aaactatcaaatcatggattcttgggaagaggaatcaagagataaatcaactaatatctcctcggccctcaacat

SEQ ID NO: 199453 - DNA, 75 bp, Artificial Sequence
  Synthetic
acaaaagaagtcaacaccaacaactattagcaatcatatgtgcaagaacaagatagaagagattcaaaaagtcga

SEQ ID NO: 199454 - DNA, 75 bp, Artificial Sequence
  Synthetic
gaaatcaaaacaaaaggtacaaaatacccgaacaaaaaaatcaaaacatccaatccattctaaataaaaattcta

SEQ ID NO: 199455 - DNA, 75 bp, Artificial Sequence
  Synthetic
aaggagaccagcaacacaacaagcaccaaacacaatgccaacttcaatactgctaatcattacaacaatgatcat

SEQ ID NO: 199456 - DNA, 75 bp, Artificial Sequence
  Synthetic
agatgttagtacaggtggtttgacacttcctcaaggagggaattacctatcacatcaattgaggttatttggaat

SEQ ID NO: 199457 - DNA, 75 bp, Artificial Sequence
  Synthetic
gagaagaacagtcaaagcaaaagagatgattgtttatacagtacaaaatataaaaccagaactgtacccatggtc

SEQ ID NO: 199458 - DNA, 75 bp, Artificial Sequence
  Synthetic
attacttctactaggtaacaagatctacatatatacaagatctacaagttggcacagcaagttacaattaggaat

SEQ ID NO: 199459 - DNA, 75 bp, Artificial Sequence
  Synthetic
aaatagaagactctaactcttgtggtgaccaacagatcaaacaatacaagaggttattggatagactgatcatcc

SEQ ID NO: 199460 - DNA, 75 bp, Artificial Sequence
  Synthetic
atcaaaaacttaggacaaaagaagtcaacaccaacagctattagcagtcatacttgtcggaacaagaaagaaggg

SEQ ID NO: 199461 - DNA, 75 bp, Artificial Sequence
  Synthetic
tacttgtcggaacaagaaagaagggacaaaaaaagcaaaatagaagaaattgaaacaaaaaatacagaacaccag

SEQ ID NO: 199462 - DNA, 75 bp, Artificial Sequence
  Synthetic
ctgatacaagatcaataagtgttgttactgctgcaacaccagatgatgaagaagaaatactaatgagaaatagta

SEQ ID NO: 199463 - DNA, 75 bp, Artificial Sequence
  Synthetic
caatcccatagttatgcatctgcacatagaagatgagtgttgtattaaagaaagttttaacgatgagcatatcaa

SEQ ID NO: 199464 - DNA, 75 bp, Artificial Sequence
  Synthetic
cccaacattattgcaaaaggagttggaaaaatcaaacaatggaattaataatctccaatttgatctagatatacc

SEQ ID NO: 199465 - DNA, 75 bp, Artificial Sequence
  Synthetic
gaaaaatcaaacaatggaattaataatctccaatttgatctagatatacccattaagccagagtaaataagggat

SEQ ID NO: 199466 - DNA, 75 bp, Artificial Sequence
  Synthetic
gaacaggacgattctttggaggggtaattggaactattgctctgggagtagcaacctcagcacaaattacagcgg

SEQ ID NO: 199467 - DNA, 75 bp, Artificial Sequence
  Synthetic
ggcgaaatcagacatcgaaaaactcaaagaagcaatcagggacacaaacaaagcagtgcagtcagttcagagctc

SEQ ID NO: 199468 - DNA, 75 bp, Artificial Sequence
  Synthetic
aaagcttaaacacatttcaacccatgttgttcaaaacagagattccaaaaagctgcagttaatcataattaacca

SEQ ID NO: 199469 - DNA, 75 bp, Artificial Sequence
  Synthetic
acaaacacgcgcaaatttcacactagataatcttaagattctaacaccggtagctacatcaacaaatttatcaca

SEQ ID NO: 199470 - DNA, 75 bp, Artificial Sequence
  Synthetic
taacgaatttatttatgataaagacccactcaaagatgtggacttatcaagacttatggttattaaagaccattc

SEQ ID NO: 199471 - DNA, 75 bp, Artificial Sequence
  Synthetic
gggaatggtatatccctcttcctagccatatcatgacaaaaggggcatttctaggtggagcagatgtcaaggaat

SEQ ID NO: 199472 - DNA, 75 bp, Artificial Sequence
  Synthetic
ataagggataatcaaaaacttaggacaaaagaagtcaacaccaacagctattagcagtcatacttgtcggaacaa

SEQ ID NO: 199473 - DNA, 75 bp, Artificial Sequence
  Synthetic
tttaataaatctacaatagatgaaatagcagagattttctctttttttagaacatttgggcatcctccattagag

SEQ ID NO: 199474 - DNA, 75 bp, Artificial Sequence
  Synthetic
aaccacctgtacatgcaacggaatcggcaatagaatcaatcaaccacctgatcaaggagtaaaaattataacaca

SEQ ID NO: 199475 - DNA, 75 bp, Artificial Sequence
  Synthetic
atcaaggagtaaaaattataacacacaaagaatgcaatacaataggcatcaatggaatgctgttcaacacaaaca

SEQ ID NO: 199476 - DNA, 75 bp, Artificial Sequence
  Synthetic
gagtgtatagggtcaatatcatattggtttctaaccaaagaaatcaaaatacttatgaaattgattggtggtgct

SEQ ID NO: 199477 - DNA, 75 bp, Artificial Sequence
  Synthetic
aagacacaaatacaataaagatatatctgaacccttatcttcaagcctaaggatagacaaaaagtaagaaaaaca

SEQ ID NO: 199478 - DNA, 75 bp, Artificial Sequence
  Synthetic
caacatgatgaatttgatatcgattaagacacaaatacaataaagatatatctgaacccttatcttcaagcctaa

SEQ ID NO: 199479 - DNA, 75 bp, Artificial Sequence
  Synthetic
tctgttgcacttgatccaattgacatatcaatagagcttaacaaagccaaatcagatctagaagaatcaaaggaa

SEQ ID NO: 199480 - DNA, 75 bp, Artificial Sequence
  Synthetic
ccagaattggttttgatattagataaacaaaactataatggttatttgattactcctgaattagtattgatgtat

SEQ ID NO: 199481 - DNA, 75 bp, Artificial Sequence
  Synthetic
ctgctgaacactcaaatctacaaagtagattccatatcatataatatccaaaacagagaatggtatatccctctt

SEQ ID NO: 199482 - DNA, 75 bp, Artificial Sequence
  Synthetic
tggataagaaggtcaaatcaaaaactagattctattggaaactggcatcaatctagcactacaatcataattatt

SEQ ID NO: 199483 - DNA, 75 bp, Artificial Sequence
  Synthetic
cgaattcatcataaatgcttacggttcaaattctgcaatatcatatgaaaatgctgttgattattaccagagctt

SEQ ID NO: 199484 - DNA, 75 bp, Artificial Sequence
  Synthetic
atctagcactacaatcataattattttaataatgatcattatattgtttataattaatgtaacgataattacaat

SEQ ID NO: 199485 - DNA, 75 bp, Artificial Sequence
  Synthetic
caaattttaatgaaggaagttaataaagacaaggacaggctcttcctgggagaaggggcaggagctatgctagca

SEQ ID NO: 199486 - DNA, 75 bp, Artificial Sequence
  Synthetic
atgacatatctatagatcattagatattaaaattataaaaaacttaggagtaaagttacgcaatccaactctact

SEQ ID NO: 199487 - DNA, 75 bp, Artificial Sequence
  Synthetic
acaattgcaattaagtattacagaattcaaaagagaaatcgagtggatcaaaatgaaaagccatatgtattaaca

SEQ ID NO: 199488 - DNA, 75 bp, Artificial Sequence
  Synthetic
gacaaatccaaattcgagatggaatactggaagcataccaatcacggaaaggatgctggcaatgagctggagacg

SEQ ID NO: 199489 - DNA, 75 bp, Artificial Sequence
  Synthetic
ggaatttctgagtgtagattacattgataaaatcttagatatatttaataaatctacaatagatgaaatagcaga

SEQ ID NO: 199490 - DNA, 75 bp, Artificial Sequence
  Synthetic
tctatggctacccatggcaataagctcactaataagataatatatatattatggacaataatcctggtgttatta

SEQ ID NO: 199491 - DNA, 75 bp, Artificial Sequence
  Synthetic
tcactaataagataatatatatattatggacaataatcctggtgttattatcaatagtcttcatcatagtgctaa

SEQ ID NO: 199492 - DNA, 75 bp, Artificial Sequence
  Synthetic
accaaggggagaagagatatggatactgatctggaaaattaaaggtatctaatataggtccggaaagaccttaaa

SEQ ID NO: 199493 - DNA, 75 bp, Artificial Sequence
  Synthetic
ctcatctaactactacaatcagaaaaaaactctcaaaaaccatctctcaacttgcattgacagcatctctccaac

SEQ ID NO: 199494 - DNA, 75 bp, Artificial Sequence
  Synthetic
ggacgatagcgatagcaagttgtcctgagttaacaatcaatccggaccttaaataaagtagctcattaatacatc

SEQ ID NO: 199495 - DNA, 75 bp, Artificial Sequence
  Synthetic
taaagtagctcatcaataaatcatcatgtcttcagttttagctgcttacgaacagtttcttcaaacaactgaaga

SEQ ID NO: 199496 - DNA, 75 bp, Artificial Sequence
  Synthetic
ccatcattgatctcctgacaaaagacaataaaatatatcatcaagaggcaacgatctcgataaacaacatttcta

SEQ ID NO: 199497 - DNA, 75 bp, Artificial Sequence
  Synthetic
atcatgtcttcagttttagctgcttacgaacagtttcttcaaacaactgaagatcggagtttcggtgatcaacaa

SEQ ID NO: 199498 - DNA, 75 bp, Artificial Sequence
  Synthetic
caataaaatatatcatcaagaggcaacgatctcgataaacaacatttctaatagaactataggaagatacagaga

SEQ ID NO: 199499 - DNA, 75 bp, Artificial Sequence
  Synthetic
gtgcaatctgatactttaaaagcagaaatccctgtatttgtacttaatacaaatgatccacagcaaagattcact

SEQ ID NO: 199500 - DNA, 75 bp, Artificial Sequence
  Synthetic
tgagataacatccctcactggacaaatctggataagaggactaaggctaacaccaaatatacaatccagaaaatg

SEQ ID NO: 199501 - DNA, 75 bp, Artificial Sequence
  Synthetic
ttcgtgcaatctgatactttaaaggcagaaatccctgtatttgaccttaatacaaatgatccacaacaaagattc

SEQ ID NO: 199502 - DNA, 75 bp, Artificial Sequence
  Synthetic
ctaatgaatttttgtctccggcaagctgtatcatcatctgccaaatcggcaattaaacaaggggcattattatct

SEQ ID NO: 199503 - DNA, 75 bp, Artificial Sequence
  Synthetic
tagtcaaacagataagaatgggaataaaaatgttgaaaaatcacctctacttacacccaacaacccccaataaaa

SEQ ID NO: 199504 - DNA, 75 bp, Artificial Sequence
  Synthetic
atgtcttcagttttagctgcttacgaacagtttcttcaaacaactgaagatcggggttttggtgatcaacaattt

SEQ ID NO: 199505 - DNA, 75 bp, Artificial Sequence
  Synthetic
tgcagaatcatcttatgattgctgccagagccccagatgctgctcttaggatcattgaagttgatgcaatagacc

SEQ ID NO: 199506 - DNA, 75 bp, Artificial Sequence
  Synthetic
tctctgctttccttgcaggccacatcaatgcagaatcatcttatgattgctgccagagccccagatgctgctctt

SEQ ID NO: 199507 - DNA, 75 bp, Artificial Sequence
  Synthetic
aaaaaaatgtttaataaaaaatatcaaacacatttaaatttaaagaaaacttttcatatctcttctccccttggt

SEQ ID NO: 199508 - DNA, 75 bp, Artificial Sequence
  Synthetic
cgccagattatacattaactattaatccaagatctggctgggatgacatcaagatcagagcttatagagcattat

SEQ ID NO: 199509 - DNA, 75 bp, Artificial Sequence
  Synthetic
tccaagatctggctgggatgacatcaagatcagagcttatagagcattatccagagatttgcctattagcttagc

SEQ ID NO: 199510 - DNA, 75 bp, Artificial Sequence
  Synthetic
atgtcttcggttttagctgcttatgaacaatttcttcaaacaactgaagatcggagttttggtgatcaacaattt

SEQ ID NO: 199511 - DNA, 75 bp, Artificial Sequence
  Synthetic
tgataggacagtatttgtatccagagatgcagaacatgcagtatgcgatgatatggatacatatctgaataggat

SEQ ID NO: 199512 - DNA, 75 bp, Artificial Sequence
  Synthetic
agctgataggacagtatttgtatccagagatgcagaacatgcagtatgtgatgacatggatacatatctgaatag

SEQ ID NO: 199513 - DNA, 75 bp, Artificial Sequence
  Synthetic
attcagtgtattaatacaggtttggataatggtgtgtaaatgcatgacagcttatgatcaacccactggatctga

SEQ ID NO: 199514 - DNA, 75 bp, Artificial Sequence
  Synthetic
ataatggtgtgtaaatgcatgacagcttatgatcaacccactggatctgaagagagaagattagccaagtataag

SEQ ID NO: 199515 - DNA, 75 bp, Artificial Sequence
  Synthetic
agagagaagattagccaagtataagcagcagggtagaatgctggagagatatcaactgcaaacagatgccagaaa

SEQ ID NO: 199516 - DNA, 75 bp, Artificial Sequence
  Synthetic
cagcagggcaggatgttagaaaaatatcaactgcaaacagatgccaggaaaattatccaattagtaataagagaa

SEQ ID NO: 199517 - DNA, 75 bp, Artificial Sequence
  Synthetic
aatcatccaactagtaataagagaaagtatggttataagacaatttcttgtacaggaaatgttaacagctgataa

SEQ ID NO: 199518 - DNA, 75 bp, Artificial Sequence
  Synthetic
tacaggagatgttaacagctgataaagtaggtgcttatactaacagatattatgctatggtaggagatattgcaa

SEQ ID NO: 199519 - DNA, 75 bp, Artificial Sequence
  Synthetic
ggtaggtgcttatactaacaggtattatgccatggtgggagacattgcaaaatatatagctaatgtcggaatgag

SEQ ID NO: 199520 - DNA, 75 bp, Artificial Sequence
  Synthetic
tatgccatggtgggagacattgcaaaatatatagctaatgtcggaatgagcgcgttctttcttacgcttaagttc

SEQ ID NO: 199521 - DNA, 75 bp, Artificial Sequence
  Synthetic
ggcttgggtaatagatggaaaccacttgctttagctgcattttctggtgaactagttaaactgaaatctcttatg

SEQ ID NO: 199522 - DNA, 75 bp, Artificial Sequence
  Synthetic
ttgctttagctgcattttctggtgaactagttaaactgaaatctcttatgtcactatacagaaggttaggtgaca

SEQ ID NO: 199523 - DNA, 75 bp, Artificial Sequence
  Synthetic
tcactatacagaaggttaggtgacagatcaagatacttggctctcttggaatctcctgaactgatggaatttgct

SEQ ID NO: 199524 - DNA, 75 bp, Artificial Sequence
  Synthetic
gatcaagatacttggctctcttggaatctcctgaactgatggaatttgctccagctaattacccactattgttca

SEQ ID NO: 199525 - DNA, 75 bp, Artificial Sequence
  Synthetic
gttatgctatgggagttggaagtgttcaagatccgctgatcagaaattatcagtttggaagaaacttcttaaata

SEQ ID NO: 199526 - DNA, 75 bp, Artificial Sequence
  Synthetic
gatcacaatgaactactgatgccggagcttgaaagtgacagcaaccccttcaatcgtccaagattcacagtcaga

SEQ ID NO: 199527 - DNA, 75 bp, Artificial Sequence
  Synthetic
cagtttggaagaaacttcttaaataccagttacttccagtatggtgttgagactgcaatgaaacatcaaggaaca

SEQ ID NO: 199528 - DNA, 75 bp, Artificial Sequence
  Synthetic
gcaccactcatcccagaaatctcacaccagaatccaactaccagaatgagcagaaacatcaacacaagagacaac

SEQ ID NO: 199529 - DNA, 75 bp, Artificial Sequence
  Synthetic
gttgatcctaaatttgcctcagaacttggaataactgatgaagacagagtggacatcatgcaatctgtcgaaaag

SEQ ID NO: 199530 - DNA, 75 bp, Artificial Sequence
  Synthetic
accagaactgaccatcaagacaccaatgaggatcgaggcagcaacgttccagatgacattcttggagatctagac

SEQ ID NO: 199531 - DNA, 75 bp, Artificial Sequence
  Synthetic
catatatcaggaaaagcaggggatgatatatctcaaccccgcagtgctttcacaatgtctctgaacagatcagct

SEQ ID NO: 199532 - DNA, 75 bp, Artificial Sequence
  Synthetic
agatgacattcttggagatctagacaattgacacatcaccgacctagccatagctacacaacaatcacaaactgg

SEQ ID NO: 199533 - DNA, 75 bp, Artificial Sequence
  Synthetic
ttcattaccaacaataaccctcaagacttatcaggggcaagactttcgaactatgagcaagggtggtctggtata

SEQ ID NO: 199534 - DNA, 75 bp, Artificial Sequence
  Synthetic
gatcaggatgaaacaagagatactcttccggaatctacaatgcacagattccaaaacattgattcaaccaactca

SEQ ID NO: 199535 - DNA, 75 bp, Artificial Sequence
  Synthetic
gaactatgagcaagggtggtcaggtatagatcaggatggaacaagagacactcttccggaatctacaatgcacag

SEQ ID NO: 199536 - DNA, 75 bp, Artificial Sequence
  Synthetic
gatcacaacgaactacagatgccagaatttgaaaatgacatcaatcctttcaatcatccaaggttcacagccaga

SEQ ID NO: 199537 - DNA, 75 bp, Artificial Sequence
  Synthetic
attccaaaatattgattcaaccaactcagatcacaatgaactacagatgccagaattcgaaaatgacagcaatcc

SEQ ID NO: 199538 - DNA, 75 bp, Artificial Sequence
  Synthetic
gcaccactcatcccagaaatctcacaccagactccaaccatcagaatgaacagaaatgtaaacataagagatagc

SEQ ID NO: 199539 - DNA, 75 bp, Artificial Sequence
  Synthetic
tttcaatcatccaaggtttacagccagaacaccactcatcccagaaatctcacaccagactccaaccatcagaat

SEQ ID NO: 199540 - DNA, 75 bp, Artificial Sequence
  Synthetic
agaacaccactcatcccagaaatctcacaccagactccaaccatcagaatgaacaggaatgcaaacacaagagaa

SEQ ID NO: 199541 - DNA, 75 bp, Artificial Sequence
  Synthetic
accagagacgaccgtcaagatgccaacgaggaccgaagcagcaacattccagatgatattcttggagatctagat

SEQ ID NO: 199542 - DNA, 75 bp, Artificial Sequence
  Synthetic
agcatcagagacgatcgtcaagatgccaacgagggccgaagcaacaacattccagatgatatccttggagatcta

SEQ ID NO: 199543 - DNA, 75 bp, Artificial Sequence
  Synthetic
aattaaaacatcaacagcccagtcataatcacacaacaaccataatccaaaaaaatccccaatacccgcaatcgc

SEQ ID NO: 199544 - DNA, 75 bp, Artificial Sequence
  Synthetic
gacaattaaaacatcaacagcccagtcacaatcacacagcaatcataatccaaaaaaatctccaatacccgcaat

SEQ ID NO: 199545 - DNA, 75 bp, Artificial Sequence
  Synthetic
tcccatcaaaagtaagtctcaggagtttaaacaaagggccagagcaagctcctataatcgtcactggcactggag

SEQ ID NO: 199546 - DNA, 75 bp, Artificial Sequence
  Synthetic
acacacacaatgggcacaatcaatcccacactacaacataactcaaaactctcaccaaatacgccatcacaactg

SEQ ID NO: 199547 - DNA, 75 bp, Artificial Sequence
  Synthetic
ctcacacacacaacgggcaaaatcaatcccacaccacaacaaagctcgaaactcccaccgaacacgccatcacaa

SEQ ID NO: 199548 - DNA, 75 bp, Artificial Sequence
  Synthetic
accaatcattgatgcaagacagcatacaagaatctaatcactatgatttaagaaaaaactacgataggctgaacg

SEQ ID NO: 199549 - DNA, 75 bp, Artificial Sequence
  Synthetic
actcccaccgaacacgccatcacaaatgatcaatcattgatacaagacagcatgcaagaactcaatcactatgat

SEQ ID NO: 199550 - DNA, 75 bp, Artificial Sequence
  Synthetic
aagcatcacctaaattatgagatccacgaaccacagagatcacagcgacccagactcactcaatacgccacgccc

SEQ ID NO: 199551 - DNA, 75 bp, Artificial Sequence
  Synthetic
acaagaatctaatcactatgatttaagaaaaaactacgataggctgaacggttgcattcaggtcactcaatcgtt

SEQ ID NO: 199552 - DNA, 75 bp, Artificial Sequence
  Synthetic
cgttcaggctactataatttctaattccggacaaaactgacaaaatgagctttgaaataagtgtagaggaaattg

SEQ ID NO: 199553 - DNA, 75 bp, Artificial Sequence
  Synthetic
aaataagtgtagaggaaattgaagagctcattgagactggcaatctcaacatagaccatgcactaaaagaattag

SEQ ID NO: 199554 - DNA, 75 bp, Artificial Sequence
  Synthetic
atcagcactgcatacaaaatcattccccggcacacacaattcactggctgacagattccctccatgacatcacaa

SEQ ID NO: 199555 - DNA, 75 bp, Artificial Sequence
  Synthetic
aagagctcattgagactggcaatctcaacatagaccatgcactaaaagaattaggtgcaaccagtcaaccgtcac

SEQ ID NO: 199556 - DNA, 75 bp, Artificial Sequence
  Synthetic
gtgcaaccagtcaatcatcactaaacaaacctccatcccaaagtagcagaacagaaggaaatgatggtggaacca

SEQ ID NO: 199557 - DNA, 75 bp, Artificial Sequence
  Synthetic
taaacaaacttccatcccaaagtagcagaacagaaggaaatgatggcggaaccaagatttcaagaaatctggccc

SEQ ID NO: 199558 - DNA, 75 bp, Artificial Sequence
  Synthetic
agatttcaagaaatccggctcctgtagaggcacctgcccatacatccacagcacaacggtcacacaatgaagaga

SEQ ID NO: 199559 - DNA, 75 bp, Artificial Sequence
  Synthetic
cagaacagaaggaaatgatggcggaaccaagatttcaagaaatctggccccagcagaggcacctgcccacatctc

SEQ ID NO: 199560 - DNA, 75 bp, Artificial Sequence
  Synthetic
tgcatgttaccctttgggcctggtcctaacatagggtccccccaaaagatgctagaatacgcagaagacattaag

SEQ ID NO: 199561 - DNA, 75 bp, Artificial Sequence
  Synthetic
atgaatcaggaagacaaaatctagacagcctttccatgatatccaataaaccccagacaggcacgctgcttatgg

SEQ ID NO: 199562 - DNA, 75 bp, Artificial Sequence
  Synthetic
cagcctttccatgatatccaataaaccccagacaggcacgctgcttatgggatcagacacacaacttccaagtcc

SEQ ID NO: 199563 - DNA, 75 bp, Artificial Sequence
  Synthetic
atcaaagacttatcaaggactcattcttgatgcaaaaaagagagcactaaatgagccaagaagggatcaaaagat

SEQ ID NO: 199564 - DNA, 75 bp, Artificial Sequence
  Synthetic
gtccatcaaagacctatcaaggactcattcttgatgcaaaaaagagagcactaaatgagccaagaagggatcaaa

SEQ ID NO: 199565 - DNA, 75 bp, Artificial Sequence
  Synthetic
cattcttgatgcaaaaaagagagcactaaatgagccaagaagggatcaaaaaacaacaaatgaacacggcagtat

SEQ ID NO: 199566 - DNA, 75 bp, Artificial Sequence
  Synthetic
aacaaatgaacatggcagtatgaatgacaccaggatatttaagaggggggaatatagataccaggaaagaggctt

SEQ ID NO: 199567 - DNA, 75 bp, Artificial Sequence
  Synthetic
gaaatcctataaaagtatatgatgaggcatattttgcagagaaatgcaaacaaatgctgctaagcgtaggtatca

SEQ ID NO: 199568 - DNA, 75 bp, Artificial Sequence
  Synthetic
aatatagataccaggaaagaggcttgggttacacagaatcagagatcaagaacacaacccccactccaagacatc

SEQ ID NO: 199569 - DNA, 75 bp, Artificial Sequence
  Synthetic
gaagagagtactcgatttcatgggttaacggaagaaccacaatatccgagtggtgcaatccatgctgcgcaccag

SEQ ID NO: 199570 - DNA, 75 bp, Artificial Sequence
  Synthetic
taacggaagaaccacaatatccgagtggtgcaatccatgctgcgcaccagtcaaatcaactgcctctgtcgaaaa

SEQ ID NO: 199571 - DNA, 75 bp, Artificial Sequence
  Synthetic
gggttaacggaagaaccacaatatccgagtggtgcaatccatgctgcgcaccagtcaaatcaactgcctcggttg

SEQ ID NO: 199572 - DNA, 75 bp, Artificial Sequence
  Synthetic
tcaaatcaactgcctctgtcgaaaaatgcacatgtggaagatgtcccaaaatttgcgaactatgcatcagagatc

SEQ ID NO: 199573 - DNA, 75 bp, Artificial Sequence
  Synthetic
ctaatcatacaaattaatcactgatatagagctaaggaacattttatatccctcctcgttgtatcaccatcacca

SEQ ID NO: 199574 - DNA, 75 bp, Artificial Sequence
  Synthetic
atttgcgaactatgcatcagagatccttgatgcaattaaggcattagaagtgagactagacaggattgaggggaa

SEQ ID NO: 199575 - DNA, 75 bp, Artificial Sequence
  Synthetic
aaagcaatatgcacactctaaatggaatccattcaagaaggcaatatccatgcctgatcttactagcatcaatat

SEQ ID NO: 199576 - DNA, 75 bp, Artificial Sequence
  Synthetic
agttgacaaaattatgcttactcaaaatacaattcagcaaacaaagaatgacactcaacaaatcaaaggttcact

SEQ ID NO: 199577 - DNA, 75 bp, Artificial Sequence
  Synthetic
aatacaattcagcaaacaaagaatgacactcaacaaatcaaaggttcacttgccacaattgagggcctaatcacg

SEQ ID NO: 199578 - DNA, 75 bp, Artificial Sequence
  Synthetic
acaatgaaaataatggatcctggagtcccatcaaaagtaagtctcaggagtttaaacaaagaatcagaacaagtt

SEQ ID NO: 199579 - DNA, 75 bp, Artificial Sequence
  Synthetic
cactttccacaattgagggcttaatcacgacaatgaaaataatggatcctggagtcccatcaaaagtaagtctca

SEQ ID NO: 199580 - DNA, 75 bp, Artificial Sequence
  Synthetic
tcccatcaaaagtaagtctcaggagtttaaacaaagaatcagaacaagttcctataattgttactggtaacggag

SEQ ID NO: 199581 - DNA, 75 bp, Artificial Sequence
  Synthetic
ggagtcccatcaaaagtaagtctcaggagtttaaataaagaatcagaacaagttcctataattgtcactggtaac

SEQ ID NO: 199582 - DNA, 75 bp, Artificial Sequence
  Synthetic
ggagacgtctcaaagtttgttgatcaagacaatacaattacacttgactcattagcaagacccatattatctgga

SEQ ID NO: 199583 - DNA, 75 bp, Artificial Sequence
  Synthetic
gcaagacccatattatctggaaccaaacaaaaaaccgatgagagacgagcaggtgttcgtatagatgcacttaaa

SEQ ID NO: 199584 - DNA, 75 bp, Artificial Sequence
  Synthetic
atagggggggaaaaacgcatccaccgccacgcgcacagatccagaacccaaggcaaccaacacccatcggactcc

SEQ ID NO: 199585 - DNA, 75 bp, Artificial Sequence
  Synthetic
aggtgttcgtatagatgcacttaaaataacagtctcagaaatgattcgggatctatttggagactgtgataagag

SEQ ID NO: 199586 - DNA, 75 bp, Artificial Sequence
  Synthetic
gcaattagatctctagtttattacacctacagtaaaccatcttatctcaccgtagatttaattcctaatttgaag

SEQ ID NO: 199587 - DNA, 75 bp, Artificial Sequence
  Synthetic
caaaaagcttcttgaatcaataaatatggcaactacagagcaagacatcaatctgatcaaaaccaatgcccttag

SEQ ID NO: 199588 - DNA, 75 bp, Artificial Sequence
  Synthetic
aatctagacccaaaatgcaattactcaagtttaaattactataataaaacggcattaagcttgattcaaccaatt

SEQ ID NO: 199589 - DNA, 75 bp, Artificial Sequence
  Synthetic
atcaatctgatcaaaaccaatgcccttagaagcattacctaaaatgtgagagtcataggtcacagagacaatcgt

SEQ ID NO: 199590 - DNA, 75 bp, Artificial Sequence
  Synthetic
aagtatcacctaaattatgagagtcataggtcatagggacaatcgcgattcagatccactcaacacaccaatcct

SEQ ID NO: 199591 - DNA, 75 bp, Artificial Sequence
  Synthetic
tcaatcccacatccaaaagaaacaactggaccacactctcaagaatcaaaaccaaatcgaatgacaacaacatta

SEQ ID NO: 199592 - DNA, 75 bp, Artificial Sequence
  Synthetic
gatccagatccactcaacacaccaatccctcaatttgacatcaaaaagaaacaattggatcacactctcaaaaat

SEQ ID NO: 199593 - DNA, 75 bp, Artificial Sequence
  Synthetic
atcgtcatcaaacaacacacagagcaccatgaccgcacatacacccaacccccaacaggcacaacccaccagctc

SEQ ID NO: 199594 - DNA, 75 bp, Artificial Sequence
  Synthetic
caaaaccaaatcaaatgacaacaatattaattgtcatcaaataaaacacagagcaccatgacagcacatacaccc

SEQ ID NO: 199595 - DNA, 75 bp, Artificial Sequence
  Synthetic
ataggttatttccgtgacaatataaataatttaagaaaaaacagcaataaggggggaccatcatccaaccgatca

SEQ ID NO: 199596 - DNA, 75 bp, Artificial Sequence
  Synthetic
aatatccatcaagtacaacccaccagctcgtaggctatttccatgataatataaatgatttaagaaaaaaaacag

SEQ ID NO: 199597 - DNA, 75 bp, Artificial Sequence
  Synthetic
ggggggaccatcatccaaccgatcataaccatggctcctacccaatccaaagtcagaatccacaatctggccgaa

SEQ ID NO: 199598 - DNA, 75 bp, Artificial Sequence
  Synthetic
caataaggggggacccatcatccaaccgaccacaaccatggctcccacccaatccaaagtcagaatccacaatct

SEQ ID NO: 199599 - DNA, 75 bp, Artificial Sequence
  Synthetic
gctcacgagaagacactaagagctttcccaatagaagttgaacaaaacccagaagggaaaaaattattagtaaaa

SEQ ID NO: 199600 - DNA, 75 bp, Artificial Sequence
  Synthetic
cagattagaataagaacattaggacatgcagatcattcaaatgattcaatttgctttctgaatacctatgggttt

SEQ ID NO: 199601 - DNA, 75 bp, Artificial Sequence
  Synthetic
aggtcaaacaagagattgcgtgttcaccccagttgccggcactttccctaggagatttctcactacatatggtac

SEQ ID NO: 199602 - DNA, 75 bp, Artificial Sequence
  Synthetic
attaaagaagcagtcagccagacagaattcatgagagcaggacagaaatcagagagcaaaaacactctaactgct

SEQ ID NO: 199603 - DNA, 75 bp, Artificial Sequence
  Synthetic
agagagcaaaaacactctaactgcttgtatgttaccctttgggcctggtcctaacattgggtccccccaaaagat

SEQ ID NO: 199604 - DNA, 75 bp, Artificial Sequence
  Synthetic
ctcaattaatcctagtatagtaaataatagcgcaataataatattgattatactttgcatcttattaatagtgat

SEQ ID NO: 199605 - DNA, 75 bp, Artificial Sequence
  Synthetic
gcaaagagcagattgtattctctctagacaggacacctcaggttttcaggggatttcaattccctcgggatcgat

SEQ ID NO: 199606 - DNA, 75 bp, Artificial Sequence
  Synthetic
attcccagtcagataccattgcccagataacagcaactaagagacatattttgcaaatcttacccagatgctcct

SEQ ID NO: 199607 - DNA, 75 bp, Artificial Sequence
  Synthetic
atgcatgtgttccatccgataaatatataaaatcaccagggaagttagtcgcaggacccaattattgctacataa

SEQ ID NO: 199608 - DNA, 75 bp, Artificial Sequence
  Synthetic
caactcccaatttattaaaagaaatccaaaatcaacagagccacagctatcctgcaataacactgcgaccacaat

SEQ ID NO: 199609 - DNA, 75 bp, Artificial Sequence
  Synthetic
ttacttttctttcactgacattctgtcccagcagccaaaaattcaaagtacctagacctgtactaaacttccggt

SEQ ID NO: 199610 - DNA, 75 bp, Artificial Sequence
  Synthetic
agaaattatcatgaagattacttgttctgaaaacagtcctattagaaagacattgataacagatgatcttgaaaa

SEQ ID NO: 199611 - DNA, 75 bp, Artificial Sequence
  Synthetic
caagactgaaccaacagcacaaacgcagaaacccaccaccacaaaaccacagaaagcctcccataatcccccacc

SEQ ID NO: 199612 - DNA, 75 bp, Artificial Sequence
  Synthetic
tggtccaaaagcatctgtgtggattcacctctgcaatctttacaaaggtagaaatcctataaagatatatgacga

SEQ ID NO: 199613 - DNA, 75 bp, Artificial Sequence
  Synthetic
aaccacacaaggcctcgtcctgtaaaacaggaccaaactcacaaggtccagaacaaaatctgaccacaagtataa

SEQ ID NO: 199614 - DNA, 75 bp, Artificial Sequence
  Synthetic
gaaatcctataaagatatatgacgaggcgtattttgcagagaaatgcaaacagatgctattaagtgtaggtatta

SEQ ID NO: 199615 - DNA, 75 bp, Artificial Sequence
  Synthetic
gtgatttgtgggggcccacaatcgcagtacatgcaaatgggaaaatcccaaagtctgccagcctttatttcaact

SEQ ID NO: 199616 - DNA, 75 bp, Artificial Sequence
  Synthetic
aatcccaaagtctgccagcctttatttcaactcaagaggttgggctctacatcctatagctgatgcatctcctac

SEQ ID NO: 199617 - DNA, 75 bp, Artificial Sequence
  Synthetic
agctgatgcatctcctacaatggcaaaacaactttggtccataggttgtgagatcatggaagtcaatgcaatttt

SEQ ID NO: 199618 - DNA, 75 bp, Artificial Sequence
  Synthetic
caaggatgcaagattcacgtggcaatactcaaatattcaaccaagcgaattcaatggtgaaaagaacatggagat

SEQ ID NO: 199619 - DNA, 75 bp, Artificial Sequence
  Synthetic
acaaggctctgattatagcgccctggtagatcatcccgatgtaatctatcggaaaattagaattgatccagcaaa

SEQ ID NO: 199620 - DNA, 75 bp, Artificial Sequence
  Synthetic
tactattccggattgtaactttaatattacttatttcaatatttgtgttatcactcataattgtactacaatcaa

SEQ ID NO: 199621 - DNA, 75 bp, Artificial Sequence
  Synthetic
gtagatcatcccgatgtaatctatcggaaaattagaattgatccagcaaaaaagcaatacgcacactctaaatgg

SEQ ID NO: 199622 - DNA, 75 bp, Artificial Sequence
  Synthetic
aaagcaatacgcacactctaaatggaacccattcaagaaggcaatatccatgcctaatctcactgatgacagtat

SEQ ID NO: 199623 - DNA, 75 bp, Artificial Sequence
  Synthetic
taaatggaacccattcaagaaggcaatatccatgcctaatctcactgatgacagtatttaatcataccaattaat

SEQ ID NO: 199624 - DNA, 75 bp, Artificial Sequence
  Synthetic
ctaatcataccaatcaactattgatatagggctgagcagtatcccacatccttcccaactgcatcaccagcatca

SEQ ID NO: 199625 - DNA, 75 bp, Artificial Sequence
  Synthetic
tattgatatagggctgagcagtatcctacatccttccccactgcatcaccagcatcactcagatccacaaaacca

SEQ ID NO: 199626 - DNA, 75 bp, Artificial Sequence
  Synthetic
ctccgatccatagaaccatactacactatgcaccatctaacatacagccaatcactgaaacacaatcacatcaca

SEQ ID NO: 199627 - DNA, 75 bp, Artificial Sequence
  Synthetic
tactgcaccatgcgccatctaacatacagccaatcactgaaacacaatcacatcacaccaattcaaccaaggaca

SEQ ID NO: 199628 - DNA, 75 bp, Artificial Sequence
  Synthetic
ccaattcaaccaaggatatcccaacaaacaccaaatgatcaaaatatgattgcagtagacataacatcactcaat

SEQ ID NO: 199629 - DNA, 75 bp, Artificial Sequence
  Synthetic
tcctgatacacacgaagtgatctaacatgactgcggtagacacaacatcgcccaatcaaatcaaaaccccatcgt

SEQ ID NO: 199630 - DNA, 75 bp, Artificial Sequence
  Synthetic
caaatcaaactctcattgtacactcagatcacctgacacaactgcaaatttctgaatccgccatcagaaatacat

SEQ ID NO: 199631 - DNA, 75 bp, Artificial Sequence
  Synthetic
tcaaactcattggtgttatactcacaatacaattttacagggatgtgcagatacagtatctagcaatcagtatgt

SEQ ID NO: 199632 - DNA, 75 bp, Artificial Sequence
  Synthetic
atactcaattcacccgacacaaccacaaatctccgaatccgccctcagaaccacaccctcaaacagaccgcccca

SEQ ID NO: 199633 - DNA, 75 bp, Artificial Sequence
  Synthetic
cctcgaatagactattccaaaacatcaaacaatcaatttcgtaattacaacaatcattgtagattttaagaaaaa

SEQ ID NO: 199634 - DNA, 75 bp, Artificial Sequence
  Synthetic
aaccaccaaacaatcaacctcgcaattgtaacaatcattatagattttaagaaaaaattaagagcacaataaata

SEQ ID NO: 199635 - DNA, 75 bp, Artificial Sequence
  Synthetic
attaaaaacacagtaagtaccaaacgcagggggggaaaaacgcatccaccatcaagcacacagctccaaatcctg

SEQ ID NO: 199636 - DNA, 75 bp, Artificial Sequence
  Synthetic
ccaaacgcagggggggaaaaacgcatccaccgtcaagcacacagttccaaattctgaggtgaccaacacccgtcg

SEQ ID NO: 199637 - DNA, 75 bp, Artificial Sequence
  Synthetic
aggtgatcaacacccttcgaattcaattccatcaccaaagaatccaacatgggtgtcaaaggtttatctttaatt

SEQ ID NO: 199638 - DNA, 75 bp, Artificial Sequence
  Synthetic
aaatccgctccatcaacaaagaatccaacatgggagtcaaaggttcatctttaatcatgattgggttattaatct

SEQ ID NO: 199639 - DNA, 75 bp, Artificial Sequence
  Synthetic
atgattgggttattaatctcaccaattaccaatctggatataactcatttaatgaatctaggaacggtaccgact

SEQ ID NO: 199640 - DNA, 75 bp, Artificial Sequence
  Synthetic
aaagattaggtaaatttaatcttactgctggatactccactacaacttgtttcaagcagaccactactgcgagac

SEQ ID NO: 199641 - DNA, 75 bp, Artificial Sequence
  Synthetic
gcaattagatctctagtttactacacttataccaaaccatcttatctcactgtagatttgattcccaatttgaag

SEQ ID NO: 199642 - DNA, 75 bp, Artificial Sequence
  Synthetic
ataacattaaccaacaacagctaacatgaccaatgacactccatgaaacatcacctatcaataataaaaaatata

SEQ ID NO: 199643 - DNA, 75 bp, Artificial Sequence
  Synthetic
aatctggaccaaaattgcaattactcaagcttaaactactacaacaaaactgcactaagcctaattcaaccaatt

SEQ ID NO: 199644 - DNA, 75 bp, Artificial Sequence
  Synthetic
atctatcaatcagaaccaaatctgatccattctcggcaatccaccaagcgaaaacacatatcaagaattaccaac

SEQ ID NO: 199645 - DNA, 75 bp, Artificial Sequence
  Synthetic
tctcactgtagacttgattcccaacttgaagaatctggaccaaaattgtaattactcaagcttaaattactacaa

SEQ ID NO: 199646 - DNA, 75 bp, Artificial Sequence
  Synthetic
tgcactaagcctaattcaaccaattgcagataacatcaatcgccttacaaagcccatcacaagctcagaaattca

SEQ ID NO: 199647 - DNA, 75 bp, Artificial Sequence
  Synthetic
aagtcgtttctttggggcagtcataggtacaattgctcttggtgtagccaccgctgcacaagttacagcagcaat

SEQ ID NO: 199648 - DNA, 75 bp, Artificial Sequence
  Synthetic
ggttcaaagtcgtttctttggggcggtcataggcacaattgctcttggtgtagccaccgctgcacaagttacagc

SEQ ID NO: 199649 - DNA, 75 bp, Artificial Sequence
  Synthetic
ccgctgcacaagttacagcagcaatcggtctagcaaaagctcaagaaaatgcaaaacttatactaactctcaaaa

SEQ ID NO: 199650 - DNA, 75 bp, Artificial Sequence
  Synthetic
cggtctagcaaaagctcaagaaaatgcaaaacttatactaactctcaaaaaagctgcgacagaaacaaatgaggc

SEQ ID NO: 199651 - DNA, 75 bp, Artificial Sequence
  Synthetic
agttcgagatcttgcaaactctaataaaattgtagtaaaaatgatatcagcaattcaaaatcaaataaacactat

SEQ ID NO: 199652 - DNA, 75 bp, Artificial Sequence
  Synthetic
tattcaacctgctatagatcagattaattgtcaaattaaagacctacaagttgccaatattttaaatttgtacct

SEQ ID NO: 199653 - DNA, 75 bp, Artificial Sequence
  Synthetic
aacagagataacgactgttttccacaaccaattgaccaatcctgcattagagtcaattagcattcaagccctcaa

SEQ ID NO: 199654 - DNA, 75 bp, Artificial Sequence
  Synthetic
aaccaattgaccaatcctgcattagagtcaattagcattcaagccctcaaaagcctcttaggacctaccctacca

SEQ ID NO: 199655 - DNA, 75 bp, Artificial Sequence
  Synthetic
acaacatctcggcagcttcagtgatggcatccggcttaattaaaggacagataattgcagttgatataccgacta

SEQ ID NO: 199656 - DNA, 75 bp, Artificial Sequence
  Synthetic
ctaccagaagtgctgtctaaattagatttaaacaacatctcggcagcttcagtgatggcatccggcttaattaaa

SEQ ID NO: 199657 - DNA, 75 bp, Artificial Sequence
  Synthetic
accgagtatatcccctttaagacaagcaaagataatagatctaacttctataacaattcacacaaatagccaaga

SEQ ID NO: 199658 - DNA, 75 bp, Artificial Sequence
  Synthetic
taataaaatatcagatgagactgttaatttgtcagatgaaaaaatctcaaactggtcttcttgaagtcaagttgg

SEQ ID NO: 199659 - DNA, 75 bp, Artificial Sequence
  Synthetic
agtacaggctgtagtaccggctaggtttctcgagattggctcagaaatattaggattcgatggctcagtgtgcca

SEQ ID NO: 199660 - DNA, 75 bp, Artificial Sequence
  Synthetic
tcaagaagtacaggctgtagtaccagctaggtttctcgagattggttcagaaatattaggattcgacggatcagt

SEQ ID NO: 199661 - DNA, 75 bp, Artificial Sequence
  Synthetic
aatcacaaaagatacaatcttttgtccttataatgatgcttatgaattacccatccagcagaagagatgcctaca

SEQ ID NO: 199662 - DNA, 75 bp, Artificial Sequence
  Synthetic
gtgccaaatcacgaaagatacaatcttttgtccttataatgatgcttatgtattacccatccagcaaaagagatg

SEQ ID NO: 199663 - DNA, 75 bp, Artificial Sequence
  Synthetic
ccttataatgatgcttatgaattacccatccagcagaagagatgcctacaaggtcaaacaagggattgcgtgttc

SEQ ID NO: 199664 - DNA, 75 bp, Artificial Sequence
  Synthetic
gatttctgatgtatttgaaggaagacagaatgtcataggattatgttcaatcagttattacttgtctcctctaaa

SEQ ID NO: 199665 - DNA, 75 bp, Artificial Sequence
  Synthetic
accccagttgctggcactttccctcggagatttctcactacatatggtactatagtagctaattgtagagattta

SEQ ID NO: 199666 - DNA, 75 bp, Artificial Sequence
  Synthetic
tattacccatccagcaaaagagatgcctacaaggtcaaacaagagattgcgtgttcaccccagttgctggcactt

SEQ ID NO: 199667 - DNA, 75 bp, Artificial Sequence
  Synthetic
tatagtagctaattgtagagatttagtatgttcttgtctgcgacctcctcaaataatctaccaacctgatgaaaa

SEQ ID NO: 199668 - DNA, 75 bp, Artificial Sequence
  Synthetic
gatttagtatgttcttgtctacgacctcctcaaataatctatcaacctgatgagaatccagttacaatcatagac

SEQ ID NO: 199669 - DNA, 75 bp, Artificial Sequence
  Synthetic
tccagttacaatcatagacaaagacctgtgtacaacattgactctagactccatcactatagagatccagaagtc

SEQ ID NO: 199670 - DNA, 75 bp, Artificial Sequence
  Synthetic
aaagacctgtgcacaacattgactctggactctatcactatagagatccagaagtccattaatagtacttttcga

SEQ ID NO: 199671 - DNA, 75 bp, Artificial Sequence
  Synthetic
cataaatagtacttttcgacgtgaagtagttttagaatctactcaagtcagatctttgactcctcttgatttatc

SEQ ID NO: 199672 - DNA, 75 bp, Artificial Sequence
  Synthetic
gaagtccattaatagtacttttcgacgtgaagtagtattagaatctactcaggtcagatctttgactcctcttga

SEQ ID NO: 199673 - DNA, 75 bp, Artificial Sequence
  Synthetic
gatctttgactcctcttgatttatcaactgatttaaatcaatacaatcaattactcaagagtgctgaagatcaca

SEQ ID NO: 199674 - DNA, 75 bp, Artificial Sequence
  Synthetic
aactgatttaaatcaatacaatcaattactcaagagtgctgaagatcacatccaacgatcaactgattacttaaa

SEQ ID NO: 199675 - DNA, 75 bp, Artificial Sequence
  Synthetic
ctcaattaatcctagtatagtcaataataacgcaataataatattgattatactctgcatcttattaatattgac

SEQ ID NO: 199676 - DNA, 75 bp, Artificial Sequence
  Synthetic
gtcaataataacgcaataataatattgatcatactctgcatcttattaatattgacagtgacaatctgcataatt

SEQ ID NO: 199677 - DNA, 75 bp, Artificial Sequence
  Synthetic
agttacaatctgcataatttggctcaagtatttgactaaggaagttaagaacgtggcaagaaatcaaagacttaa

SEQ ID NO: 199678 - DNA, 75 bp, Artificial Sequence
  Synthetic
gataaagcaataagttgtaataagaaggattggatgagtgtattcagacgaagtcttatacatgagagatgtgca

SEQ ID NO: 199679 - DNA, 75 bp, Artificial Sequence
  Synthetic
tgatcatactctgcatcttattaatattgacagtgacaatctgcataatttggctcaaatacctgactaatgaag

SEQ ID NO: 199680 - DNA, 75 bp, Artificial Sequence
  Synthetic
tagagatgctgatcttttttataagatccctagtcaaataccggtgcctagataataacagccaagattcatatt

SEQ ID NO: 199681 - DNA, 75 bp, Artificial Sequence
  Synthetic
ttataaactttatttatctagatgctccaggaaaaatcatccacaaagatgtaccaaatctcatctcattgaaag

SEQ ID NO: 199682 - DNA, 75 bp, Artificial Sequence
  Synthetic
tgcctagacaataacaaccaaaattcatactctatgaaattcatctagatgctccaggaaaagtcatccacaatg

SEQ ID NO: 199683 - DNA, 75 bp, Artificial Sequence
  Synthetic
taaattttgtgcttcatactctttgaaagaaaaggagataaaagaaactgggagaatatttgcaaagcttacaaa

SEQ ID NO: 199684 - DNA, 75 bp, Artificial Sequence
  Synthetic
aaactcaaaatcaacagaatcacaactattctacaacaacaccacgaccataacaatgttctccaagaaatgaga

SEQ ID NO: 199685 - DNA, 75 bp, Artificial Sequence
  Synthetic
atgcaccaattttcatctcattgaaagaaactcaaaatcaacaggatcacaactactccatgacaacaccacgat

SEQ ID NO: 199686 - DNA, 75 bp, Artificial Sequence
  Synthetic
tgtagttcttgatcagcttaagttgacgaaatcactcctaaccatgagccaaatagggattatctcaaataagga

SEQ ID NO: 199687 - DNA, 75 bp, Artificial Sequence
  Synthetic
gacaaagccaggaatcagaaaaaaatagaaaagaacacaacaacagacagagaaaaagaagaagggcaacatcgc

SEQ ID NO: 199688 - DNA, 75 bp, Artificial Sequence
  Synthetic
cacaacaacgcccccccaaaaatgagagacaaagacaggaatcagaaaaaaatagaaaagaacacaccaacagac

SEQ ID NO: 199689 - DNA, 75 bp, Artificial Sequence
  Synthetic
cctggcaacacccccaatcaacatctcccaaccaagaccgaattgactgcacaacccgaactcaacatcataaaa

SEQ ID NO: 199690 - DNA, 75 bp, Artificial Sequence
  Synthetic
agacaaaaagaagaagaagggcaacatcgccctggcaatatccctcatcaacatcccccaactaagaccgaaccg

SEQ ID NO: 199691 - DNA, 75 bp, Artificial Sequence
  Synthetic
acaacccgaactcaacatcataaaacgagaaagggcccctccacaatgcacccccctagccagctccatcatcaa

SEQ ID NO: 199692 - DNA, 75 bp, Artificial Sequence
  Synthetic
actgcacaagcacagaaactcaacatcacaaaaccggaaagggctctccacaatcctcctccaacaatcaccaac

SEQ ID NO: 199693 - DNA, 75 bp, Artificial Sequence
  Synthetic
attttggaataaacactcctgatgattcattagaaatagctgcatgcttcttaacaacagatttacaaaaatatt

SEQ ID NO: 199694 - DNA, 75 bp, Artificial Sequence
  Synthetic
caaaacaaaacgacacccaatcaaacaatctccacatttcaattttaagaaaaaaactattataggggggaacac

SEQ ID NO: 199695 - DNA, 75 bp, Artificial Sequence
  Synthetic
agaacaaaacgacacccaatcgaacaatcttcacatttcaattttaagaaaaaaactattataggggggaacaca

SEQ ID NO: 199696 - DNA, 75 bp, Artificial Sequence
  Synthetic
acttctcagccctgattgctcaaggcccttgcatgtgcaaccgagacaccccccacaagcaccggaataagacct

SEQ ID NO: 199697 - DNA, 75 bp, Artificial Sequence
  Synthetic
cttctcagccctgaccgtacaaggccctgccctgtgcaactgagacacccccacgagcatcggaacaagacccga

SEQ ID NO: 199698 - DNA, 75 bp, Artificial Sequence
  Synthetic
cctgccctgtgcaactgagacacccccacgagcatcggaacaagacccgacgacaagtgcagcatccacgaccca

SEQ ID NO: 199699 - DNA, 75 bp, Artificial Sequence
  Synthetic
gacaacaaagtagcagccaccacgacccaaaaacaaaattaaaaggatccggtaacagcccatcaaccagcaatc

SEQ ID NO: 199700 - DNA, 75 bp, Artificial Sequence
  Synthetic
atagaatccaacaatccagagagacgtcacatcaactcatccacgaatcttcgaagggaacatcccagacaaaat

SEQ ID NO: 199701 - DNA, 75 bp, Artificial Sequence
  Synthetic
catcaacccagccacgaatctccaaagggaacatcccagacaaaaacatagcccactctccaatcacgaataaac

SEQ ID NO: 199702 - DNA, 75 bp, Artificial Sequence
  Synthetic
cacagcccattccctgatcacggataaactgagaaagatcacaagaatgcaagactcacatggtaatacacaaat

SEQ ID NO: 199703 - DNA, 75 bp, Artificial Sequence
  Synthetic
ccacctggagatgggaattggagtacgctagcagcagatccttatgcagttaacattgattatctatacccacca

SEQ ID NO: 199704 - DNA, 75 bp, Artificial Sequence
  Synthetic
actcaaccaggcaaattcaatggtgaaaagaacatggagattactatttggaattgcaaccttaatattacttgt

SEQ ID NO: 199705 - DNA, 75 bp, Artificial Sequence
  Synthetic
gaacatggagattgctatttcgaattgcaactttgatattacttgtctcaatatttgtgttatcactcataactg

SEQ ID NO: 199706 - DNA, 75 bp, Artificial Sequence
  Synthetic
ttcaatatttgtgttatcgctcataattgtattacagtcaacaccggggaatttgcaaaacgatatcaatataat

SEQ ID NO: 199707 - DNA, 75 bp, Artificial Sequence
  Synthetic
tattacagtcaacaccagggaatctgcaaaacgatatcaatataattagaaaggagctcaatgaacttatggaga

SEQ ID NO: 199708 - DNA, 75 bp, Artificial Sequence
  Synthetic
tagaaaggagctcaatgaacttatggagaattttgaaactacatctaagtcactgttaagtgtatcaaatcaaat

SEQ ID NO: 199709 - DNA, 75 bp, Artificial Sequence
  Synthetic
gagaattttgaaactacatctaagtcactgttaagtgtatcaaatcaaatcacttacgatgtatcagtacttact

SEQ ID NO: 199710 - DNA, 75 bp, Artificial Sequence
  Synthetic
gaaggaagcacttgcacattgaatggcagccctttgcatgatgtctcttttttaaatgggttcaataaattctat

SEQ ID NO: 199711 - DNA, 75 bp, Artificial Sequence
  Synthetic
ttcacatataaagataatatgcaaattaagtttaaatcattattagattaccccaattttattccaactgctaca

SEQ ID NO: 199712 - DNA, 75 bp, Artificial Sequence
  Synthetic
actccccacggatgcattcgaattccatcattctccttaggtcaaacccattggtgttatacccataatataaac

SEQ ID NO: 199713 - DNA, 75 bp, Artificial Sequence
  Synthetic
ctactaggatgtgcagaccctgcatctagcaatcaatatgtatcactaggaaccttacaagtcttaaaaatgggt

SEQ ID NO: 199714 - DNA, 75 bp, Artificial Sequence
  Synthetic
gacccttattttaaagtcgagcatagtcattatttaaatgacgggaggaatcgaaaaggttgttcagtggttgct

SEQ ID NO: 199715 - DNA, 75 bp, Artificial Sequence
  Synthetic
gtccccgacggatgcctgcggaattgtgtgaccatgacaaaaaatgagacagagaatttcaaagacctcaattgg

SEQ ID NO: 199716 - DNA, 75 bp, Artificial Sequence
  Synthetic
caacacaattacttacatacatatcatataatggtaccattaaagactcgtataataaatccaccaggatcatcc

SEQ ID NO: 199717 - DNA, 75 bp, Artificial Sequence
  Synthetic
agagattgggttcatatcgcaccaggggtaggctcgggccttttgtatgccaaattacttatatttcctttgtat

SEQ ID NO: 199718 - DNA, 75 bp, Artificial Sequence
  Synthetic
actgggttcatatcgcaccaggggtaggctcaggcattttgtatgcaaattacattatatttcctttgtatgggg

SEQ ID NO: 199719 - DNA, 75 bp, Artificial Sequence
  Synthetic
tcgacaataagtcatccaaaaattttaagaagaatgattaatttaggaatttgtatcccaagcaattccccgcaa

SEQ ID NO: 199720 - DNA, 75 bp, Artificial Sequence
  Synthetic
gggggtctcacggaaaaatcagtgatacataataatcaatcagggaaatattttttccctaattcaactaaattg

SEQ ID NO: 199721 - DNA, 75 bp, Artificial Sequence
  Synthetic
tacattatatttcctttgtatgggggcctcacagaaaaatcagtgatacataataatcaatcagagaaatatttt

SEQ ID NO: 199722 - DNA, 75 bp, Artificial Sequence
  Synthetic
tacataataatcaatcagggaaatattttttccctaattcaactaaattgcaatgccgtaacagcactatggaaa

SEQ ID NO: 199723 - DNA, 75 bp, Artificial Sequence
  Synthetic
aaataaaaggagcaaaagattcatacacaataacttacttctcagggagacttatacagagtgcatttctggttt

SEQ ID NO: 199724 - DNA, 75 bp, Artificial Sequence
  Synthetic
gtgatctaagacaatttctttctgaagattgtgaaatcttaattcctagtaatgattacatgatggtcggtgcag

SEQ ID NO: 199725 - DNA, 75 bp, Artificial Sequence
  Synthetic
agggtcgattatataacattgagaacaacatattttattatcagagaggatccagctggtggccttatccgagcc

SEQ ID NO: 199726 - DNA, 75 bp, Artificial Sequence
  Synthetic
tttagctaatttatcaatccaacacaatgaatcatatatcaatcaagtaacaaacccaaatatacatccttatcc

SEQ ID NO: 199727 - DNA, 75 bp, Artificial Sequence
  Synthetic
tccagctggtggccttatccgagcctctatagaatcaggttaaaccttagtaagaaatatcctagaataactgaa

SEQ ID NO: 199728 - DNA, 75 bp, Artificial Sequence
  Synthetic
atattttattatcagagaggatccagctggtggccttatccgagcctctatagaattaggttaaaccttagtaat

SEQ ID NO: 199729 - DNA, 75 bp, Artificial Sequence
  Synthetic
attaaatttacaaaaattgaaatcgccccaagaccaggcaacaaagattgtccaggaaataaggcttgcccaaaa

SEQ ID NO: 199730 - DNA, 75 bp, Artificial Sequence
  Synthetic
gaatgtataacgggagtctaccaagatatattgccactaagttatcccaatactgcatttccacacttaaaacaa

SEQ ID NO: 199731 - DNA, 75 bp, Artificial Sequence
  Synthetic
gaacggtgtcactgaaactactgatttatcagttattagctgtactgaattcattattaattctattggagtgga

SEQ ID NO: 199732 - DNA, 75 bp, Artificial Sequence
  Synthetic
gcgtattatacaggtttttatcttaataactcgctcgagagacgcaatccaacattttatactgctgacaatcta

SEQ ID NO: 199733 - DNA, 75 bp, Artificial Sequence
  Synthetic
ccatgtgttacaaataacttgcagctgtcttaaaaaggatgggttattactcttaaagacaagttgggtaccctt

SEQ ID NO: 199734 - DNA, 75 bp, Artificial Sequence
  Synthetic
gattaccatcaacaggaaagattaggtaaattcaatcttactgctggatactctactacaacttgttttaaacag

SEQ ID NO: 199735 - DNA, 75 bp, Artificial Sequence
  Synthetic
accactactgcgaggttatactgtctctacataattgaagtgggtgactcagtcattggggactttcagatcacc

SEQ ID NO: 199736 - DNA, 75 bp, Artificial Sequence
  Synthetic
ctttttttagcagctcaatagaccagactgttaattaatcaacaaagttattctgtaatataaactgatcttata

SEQ ID NO: 199737 - DNA, 75 bp, Artificial Sequence
  Synthetic
ttttacgcttaatagatcagactattaattaatcaacaaagttattctgtaatataaactgatcttatgagtgag

SEQ ID NO: 199738 - DNA, 75 bp, Artificial Sequence
  Synthetic
agtgaaaagatgcctatccaaggaggttgatagacaaatagtaaaagtagcaattgtaacaaaactctaaggaaa

SEQ ID NO: 199739 - DNA, 75 bp, Artificial Sequence
  Synthetic
aagatacttacacaaggtggtcgacagacaaacagtaagagtagcaattgtaacaaaacttcaaggaaaaaataa

SEQ ID NO: 199740 - DNA, 75 bp, Artificial Sequence
  Synthetic
aagtaattcgagaaatattatagactgacttcagagcaaacacaacatcgatccataatagtcaatataatcaat

SEQ ID NO: 199741 - DNA, 75 bp, Artificial Sequence
  Synthetic
ttagagatacatcatagattaacctcagagtaaacacaatatcgacctataatagtcaaaatgatcaacaatact

SEQ ID NO: 199742 - DNA, 75 bp, Artificial Sequence
  Synthetic
aatactctatgagaccttacctatcaacagcaaaaaacacagtccatcaagcggaacccaactcgctccatcctt

SEQ ID NO: 199743 - DNA, 75 bp, Artificial Sequence
  Synthetic
ccatgaggcctcacctatcaacagtttaaagcacagtccatcaagcagagcccaactcacctcatcctcaaccat

SEQ ID NO: 199744 - DNA, 75 bp, Artificial Sequence
  Synthetic
aatcatccactgaaagaaaaaatatacgaaggaccatcggccaccgggtccaaacaatctagcacaaaaattcaa

SEQ ID NO: 199745 - DNA, 75 bp, Artificial Sequence
  Synthetic
ccactgaaagaaaaaatacatgaagaaccattggccaccagatccaaacaatccagcacaaaaattcaaacaacc

SEQ ID NO: 199746 - DNA, 75 bp, Artificial Sequence
  Synthetic
acaaccgccaaactctgttcggcctcaacaaacaatccgccaagccatctgtcattcctataccaacacacaacc

SEQ ID NO: 199747 - DNA, 75 bp, Artificial Sequence
  Synthetic
gccgaactccattcggcctcaacaaacaatccgccaatccgtccatcattcccacactgacacacaaccatccca

SEQ ID NO: 199748 - DNA, 75 bp, Artificial Sequence
  Synthetic
atcccattcctcaaaagcaattcaatccgcgacccaaagaagactctccacatatccagctaatccgtcgatccg

SEQ ID NO: 199749 - DNA, 75 bp, Artificial Sequence
  Synthetic
tttctcaccagcaattcattccgcaagtcaaagaagactctccatatattcagccaatccgtcaatccgacacat

SEQ ID NO: 199750 - DNA, 75 bp, Artificial Sequence
  Synthetic
acacatcatcgtatcttttaagaaaaaaaagagatgagcaattgatacattctatttttcatacacatagtaaat

SEQ ID NO: 199751 - DNA, 75 bp, Artificial Sequence
  Synthetic
cattatatcttttaagaaaaaagagagatgagcaatcgatacattccatttcccatacacatagtaaacattaaa

SEQ ID NO: 199752 - DNA, 75 bp, Artificial Sequence
  Synthetic
attaaatcataaattcaccatagaccaagaccaaagattgaaagactagaatgatcctgtacagcgatagacaag

SEQ ID NO: 199753 - DNA, 75 bp, Artificial Sequence
  Synthetic
tcatggattcaccacagaccaagaccaaaaattggaggaccaaaatggtcctgaatagtgacggataagcaatga

SEQ ID NO: 199754 - DNA, 75 bp, Artificial Sequence
  Synthetic
caatgaggaacaaaaaagatagacaatctccaacaacaaatggcacaaagcgtccaacactaggggggaagagag

SEQ ID NO: 199755 - DNA, 75 bp, Artificial Sequence
  Synthetic
ggaacaaaaaagatagattatctccaacaacgaatagcacaaagcatccaacaataggggggaagggagcacccc

SEQ ID NO: 199756 - DNA, 75 bp, Artificial Sequence
  Synthetic
cacccccaagatggccgaccacactgatgtcctactgccagaagttcatctgagctctcccattgtacggcataa

SEQ ID NO: 199757 - DNA, 75 bp, Artificial Sequence
  Synthetic
gatgtcctactgccagaagttcatctgagctctcccattgtacggcataaactcatttattacatattattggga

SEQ ID NO: 199758 - DNA, 75 bp, Artificial Sequence
  Synthetic
aatttaccaaatcaaataagtcctgaagatcttggacccctatctacaatcaattggagccaggtaagaagagaa

SEQ ID NO: 199759 - DNA, 75 bp, Artificial Sequence
  Synthetic
ccaaatcaaataagtcctgaagatcttggacccctatctacaatcaattggagccaggtaagaagagaagagagt

SEQ ID NO: 199760 - DNA, 75 bp, Artificial Sequence
  Synthetic
aaattatgcttacgtttaatatctgtaaggaacaatcttctaaaacatgtaccctcattgagagaggtagatcca

SEQ ID NO: 199761 - DNA, 75 bp, Artificial Sequence
  Synthetic
tatctgtaaggaataatcttctaaaacatgtaccctcattgagagaggtagatccaacgcgtcaatgtaaaaacc

SEQ ID NO: 199762 - DNA, 75 bp, Artificial Sequence
  Synthetic
tgtattggccacgacctcttcagttttttaaggatttagatttcaatcaatttaaagggaaaattgaaaggtggg

SEQ ID NO: 199763 - DNA, 75 bp, Artificial Sequence
  Synthetic
aaaagattcaacatgctacacagcttgtagtcaataagagaatcgtgagttttttagatttaatcagtgacaaat

SEQ ID NO: 199764 - DNA, 75 bp, Artificial Sequence
  Synthetic
taatatcaaggaaagatttatttactagtgctaggtgcaggcataatggtcatgatagagattcaagattaagag

SEQ ID NO: 199765 - DNA, 75 bp, Artificial Sequence
  Synthetic
tagtgctaggtgcaggcataatggtcatgatagagattcaagattaagagaattagttgatattgaatcaagctg

SEQ ID NO: 199766 - DNA, 75 bp, Artificial Sequence
  Synthetic
catgatagagattcaagattaagagaattagttgatattgaatcaagctggaataagaatcattggacaaatatc

SEQ ID NO: 199767 - DNA, 75 bp, Artificial Sequence
  Synthetic
acgaatcttttcttattaataaagtatcaaatgagattattaatttgtcaaatgaaaaaatctcaaactggcctt

SEQ ID NO: 199768 - DNA, 75 bp, Artificial Sequence
  Synthetic
cttgaagtcaagttggaagacagatcaggcctaattattattactccagaattagtatgcatttatttccaacaa

SEQ ID NO: 199769 - DNA, 75 bp, Artificial Sequence
  Synthetic
gcgaatgtgttaagctatttcacatttgaaatgatccttatgatttccgatgtatttgaaggaaggcaaaatgtg

SEQ ID NO: 199770 - DNA, 75 bp, Artificial Sequence
  Synthetic
tataggattatgttcattagttattacttgtctcctctgaaggatagaataaatgacttactcaattatgtagac

SEQ ID NO: 199771 - DNA, 75 bp, Artificial Sequence
  Synthetic
aaatgacttactcaattatgtagacaatttagcactgatcctaggtaataaggtttattcaattattgctaactt

SEQ ID NO: 199772 - DNA, 75 bp, Artificial Sequence
  Synthetic
agaaagcttagtttatgctaagttacagctgagagatccagtcttagaggtcagaggccaattccattgttttat

SEQ ID NO: 199773 - DNA, 75 bp, Artificial Sequence
  Synthetic
actggaagagattatggaaattttacatgatgttttctcagttgaagagagtgctcaagtatgttctatattgtc

SEQ ID NO: 199774 - DNA, 75 bp, Artificial Sequence
  Synthetic
gtgctcaagtatgttctatattgtcatctttttttagtggtctatcgcctgacctcactgcagaattgttatgca

SEQ ID NO: 199775 - DNA, 75 bp, Artificial Sequence
  Synthetic
aagtatgttctatattgtcatcttttttcagtggcctatcgcctgaccttactgcagaattgttatgcattatga

SEQ ID NO: 199776 - DNA, 75 bp, Artificial Sequence
  Synthetic
ttatgagaatgtggggtcatcccacactcacagctgcaggtgcagcagggaaagttcgtgaatctatgtgtgcac

SEQ ID NO: 199777 - DNA, 75 bp, Artificial Sequence
  Synthetic
actcacagctgcaggtgcagcagggaaagttcgtgaatctatgtgtgcacaaaagctattagatttcacaacaat

SEQ ID NO: 199778 - DNA, 75 bp, Artificial Sequence
  Synthetic
agctgcaggcgcagcagggaaagttcgtgaatctatgtgtgcaccaaagctattagatttcacaacaattatgaa

SEQ ID NO: 199779 - DNA, 75 bp, Artificial Sequence
  Synthetic
catgaaaacattatcattctttcatactatacttataaatgggtataggagaaaacacggcgggatctggccaaa

SEQ ID NO: 199780 - DNA, 75 bp, Artificial Sequence
  Synthetic
cttataaatgggtataggagaaaacacggcgggatctggccaaatgtagtgttaattgatggtactccaaatttt

SEQ ID NO: 199781 - DNA, 75 bp, Artificial Sequence
  Synthetic
tgtaatgttaattgatggtaccccaaattttattgtcagttcaaaaaatgataacgcggaaataagctatgaagt

SEQ ID NO: 199782 - DNA, 75 bp, Artificial Sequence
  Synthetic
aattttattgtcagttcaaaaaatgataacgcggaaataagctatgaagtagcactgaaatactggaaatggata

SEQ ID NO: 199783 - DNA, 75 bp, Artificial Sequence
  Synthetic
tcactgtttgaatttgaaaaatgtttttcagctgacccaggtgaggatttaagtatattcatgaaagataaggca

SEQ ID NO: 199784 - DNA, 75 bp, Artificial Sequence
  Synthetic
tttcagctgacccaggtgaggatttaagtatattcatgaaagataaggcaataagttgtaacaagaaggattgga

SEQ ID NO: 199785 - DNA, 75 bp, Artificial Sequence
  Synthetic
tgtaacaagaaggattggatgagtgtatttagacggagcttaatacatgaaaggtgtgcaaaaaatcatctagaa

SEQ ID NO: 199786 - DNA, 75 bp, Artificial Sequence
  Synthetic
ctagaatgtccatcgaatgtgaatagacgattgttattaaacttcctaaatgattcaaatttcgatcctaattta

SEQ ID NO: 199787 - DNA, 75 bp, Artificial Sequence
  Synthetic
gaattagagtatgtaactaccttacaatatctaactgatgataatttttgtgcctcatactctttgaaagaaaag

SEQ ID NO: 199788 - DNA, 75 bp, Artificial Sequence
  Synthetic
gagataaaagaaactgggagaatatttgcaaaactcacaaagcagatgagatcgtgtcaagtaataacagaatca

SEQ ID NO: 199789 - DNA, 75 bp, Artificial Sequence
  Synthetic
ttgcaaaactcacaaagcagatgagatcgtgtcaagtaataacagaatcaatgcttgctaatcatgcagggaaat

SEQ ID NO: 199790 - DNA, 75 bp, Artificial Sequence
  Synthetic
tatttagagagaatggtgtagttcttgatcagcttaagttaacaaaatcactcttaactatgagtcagataggga

SEQ ID NO: 199791 - DNA, 75 bp, Artificial Sequence
  Synthetic
ttatctccaataaagagcgtaaggctacaaaggactctatgacaatcctaaaggacattaagaagaataaaaata

SEQ ID NO: 199792 - DNA, 75 bp, Artificial Sequence
  Synthetic
tacataaagaaaatgaaaagaaatatggttcagaaaatccatctccttttggagatctaaggaaaaattctgcaa

SEQ ID NO: 199793 - DNA, 75 bp, Artificial Sequence
  Synthetic
tggttcagaaaatccatctccttttggagatctaaggaaaaattctgcaataaatactcctgatgactcattaga

SEQ ID NO: 199794 - DNA, 75 bp, Artificial Sequence
  Synthetic
aatagctgcatgctttttgacaacagatttacaaaaatattgtcttaattggagatatcaagcaataataccctt

SEQ ID NO: 199795 - DNA, 75 bp, Artificial Sequence
  Synthetic
tgctagaacattaaatcgaatgtatggataccctcatttatttgagtggattcatttaagactaatgaaatcaac

SEQ ID NO: 199796 - DNA, 75 bp, Artificial Sequence
  Synthetic
cctcatttatttgagtggattcatttaagactaatgaaatcaactttgtatgtaggtgacccatttaatcctcca

SEQ ID NO: 199797 - DNA, 75 bp, Artificial Sequence
  Synthetic
tttgtatgtaggtgacccgtttaatcctccatcagatcataatgtcagtgatctagataatgcacctaatgatga

SEQ ID NO: 199798 - DNA, 75 bp, Artificial Sequence
  Synthetic
tatttttattgtttcaccaagaggaggtattgaaggtctgtgccaaaaattatggaccatgatttcaattgctac

SEQ ID NO: 199799 - DNA, 75 bp, Artificial Sequence
  Synthetic
tatggaccatgatttcaattgctactatattgttgtcatctgcagaatctaagactagagtaatgagcatggttc

SEQ ID NO: 199800 - DNA, 75 bp, Artificial Sequence
  Synthetic
aaggagacaatcaaacaatagcaataactacaaaagtgccaaggagtatgcctcataaagaaaagaagcaatcag

SEQ ID NO: 199801 - DNA, 75 bp, Artificial Sequence
  Synthetic
cttataatgcaagcaaagaattcttttctagattaaaacaaaataattatgggattggacataatttgaaggaac

SEQ ID NO: 199802 - DNA, 75 bp, Artificial Sequence
  Synthetic
aagaaaccatattatcatctgatttctttgtatatggtaaaagaattttttggagagggaggatactcagccaag

SEQ ID NO: 199803 - DNA, 75 bp, Artificial Sequence
  Synthetic
cgctcaagaatgctagcaaattatgtttaacagctgatatacttggtgactgcactcaatcttcttgctccaatc

SEQ ID NO: 199804 - DNA, 75 bp, Artificial Sequence
  Synthetic
tgcactcaatcttcttgctccaatctggcaacaacaatcatgagattaactgaaaacggacttgaaaaggatgtg

SEQ ID NO: 199805 - DNA, 75 bp, Artificial Sequence
  Synthetic
gcaataagactaaatatattcatggctattagacaattaacttttgatttgatcttccctatgaatacaaataat

SEQ ID NO: 199806 - DNA, 75 bp, Artificial Sequence
  Synthetic
ccctatgaatacaaataatgcatcaaatatttctgacatatatctaaaccatccagatttactagcaagaatttg

SEQ ID NO: 199807 - DNA, 75 bp, Artificial Sequence
  Synthetic
taaaccatccagatttactagcaagaatttgtcttgtcccgtctaaagttggtggtttaaattatctatcaacta

SEQ ID NO: 199808 - DNA, 75 bp, Artificial Sequence
  Synthetic
ggtggtttaaattatctatcaactagtcgattatttaatagaaatataggcgatccattagtgtctgcatttgca

SEQ ID NO: 199809 - DNA, 75 bp, Artificial Sequence
  Synthetic
gatattaagagactaataatggctagatgtattgaaccttgggtcttaacaaatatcatgagacgtcctccggga

SEQ ID NO: 199810 - DNA, 75 bp, Artificial Sequence
  Synthetic
gatgtattgaaccttgggtcttaacaaatatcatgagacgtcctccgggagatggaaattggagtactctagcag

SEQ ID NO: 199811 - DNA, 75 bp, Artificial Sequence
  Synthetic
aattggagtactctagcagcagatccttatgcagtcaatattgattacctatacccaccaactatattccttaaa

SEQ ID NO: 199812 - DNA, 75 bp, Artificial Sequence
  Synthetic
aattggagtactctagcagcagatccttatgcagtcaatattgattacctataccctccaactatattccttaaa

SEQ ID NO: 199813 - DNA, 75 bp, Artificial Sequence
  Synthetic
aattggagtactctagcagcagatccttatgcagtcaatattgattacctataccccccaactatattccttaaa

SEQ ID NO: 199814 - DNA, 75 bp, Artificial Sequence
  Synthetic
aattggagtactctagcagcagatccttatgcagtcaatattgattacctatacccgccaactatattccttaaa

SEQ ID NO: 199815 - DNA, 75 bp, Artificial Sequence
  Synthetic
cttaaacggcatgcccagcagacactgatggaatcaagtgtgaatccgctccttaatgggatattcaatccaaat

SEQ ID NO: 199816 - DNA, 75 bp, Artificial Sequence
  Synthetic
tgatggaatcaagtgtgaatccgctccttaatgggatattcaatccaaatgcaaaagcggaagagaataatttag

SEQ ID NO: 199817 - DNA, 75 bp, Artificial Sequence
  Synthetic
atactagcacaaacaggttgcggaagaaggaagcagattcaaggatatctagattccacacggactatagtaaaa

SEQ ID NO: 199818 - DNA, 75 bp, Artificial Sequence
  Synthetic
ttagctttagatataaaacctttatctttcagaaagacaaaccaagtattagattacaatttaaattacttatct

SEQ ID NO: 199819 - DNA, 75 bp, Artificial Sequence
  Synthetic
ttagacataaaacctttatctttcagaaagacaaaccaagtattagattacaatttaaattacttatcttatcaa

SEQ ID NO: 199820 - DNA, 75 bp, Artificial Sequence
  Synthetic
ctttcagaaagacaaaccaagtattagattacaatttaaattacttatcttatcaattagatatcatactcaaac

SEQ ID NO: 199821 - DNA, 75 bp, Artificial Sequence
  Synthetic
ctagatataatattgaaacctaaaacaggaaaagattcttggagcttagataatatcaatgattgtagtatagat

SEQ ID NO: 199822 - DNA, 75 bp, Artificial Sequence
  Synthetic
ccaaaacagggaaagattcttggagcttagataatattaatgattgtagtatagatctagcaaggaatttaagaa

SEQ ID NO: 199823 - DNA, 75 bp, Artificial Sequence
  Synthetic
agttatcatgggctcctttgttgcatggtaggggattagaaggtttggaaactcctgatcccatagaattgctag

SEQ ID NO: 199824 - DNA, 75 bp, Artificial Sequence
  Synthetic
tggtaggggattagaaggtttggaaactcctgatcccatagaattgctagatggagtcttgttgacaaataagtc

SEQ ID NO: 199825 - DNA, 75 bp, Artificial Sequence
  Synthetic
atggagtcttgttgacaaataagtctctgtgtcatcaatgtgcatcaggaaatgataaatttacttggctttatt

SEQ ID NO: 199826 - DNA, 75 bp, Artificial Sequence
  Synthetic
aatgataaatttacttggctttatttaccgggtggtattcagatagatcttgagccaagcaaaaacccacctatg

SEQ ID NO: 199827 - DNA, 75 bp, Artificial Sequence
  Synthetic
agagtcccatatatcggttcaaagacagatgaacgaagaattgcatcactagcacaaataccaggtgcttctcaa

SEQ ID NO: 199828 - DNA, 75 bp, Artificial Sequence
  Synthetic
agcacaaataccaggtgcttctcaaaatctaaaatcagttttaaggttgaccggtgtatatatttgggcttttgg

SEQ ID NO: 199829 - DNA, 75 bp, Artificial Sequence
  Synthetic
tgataatgaacagaattggcaagatgcgtacgaactttctaagacacgcgtgaatataactttagatcagctcag

SEQ ID NO: 199830 - DNA, 75 bp, Artificial Sequence
  Synthetic
agtactaactcctctacctacttcagcaaatttgacccatcgattagatgatggagtaactcagatgaaatttac

SEQ ID NO: 199831 - DNA, 75 bp, Artificial Sequence
  Synthetic
gtcaggtgctacaaattgatgaatgcaatgtagattcaaatctaatctaccaacagattatgataacaggattag

SEQ ID NO: 199832 - DNA, 75 bp, Artificial Sequence
  Synthetic
caatgtagattcaaatctaatctaccaacagattatgataacaggattaggcattattgagacatggaatgcatt

SEQ ID NO: 199833 - DNA, 75 bp, Artificial Sequence
  Synthetic
gcattattgagacatggaatgcattgcctattaagcatactgtacatgaggtaactttacatctacacactgcag

SEQ ID NO: 199834 - DNA, 75 bp, Artificial Sequence
  Synthetic
cttcatgttgtataaggccagttgattcttgccttgtaaataattccaggcaagatctgccttacttagaagata

SEQ ID NO: 199835 - DNA, 75 bp, Artificial Sequence
  Synthetic
ccttgtaaataattccagacaagatctgccttacttagaagatactactatcaacaaatttatttatgatgatca

SEQ ID NO: 199836 - DNA, 75 bp, Artificial Sequence
  Synthetic
ccactatcaacaaatttatttatgacgatcaacccatcccagaggagaaatcaagtttaatagaacaatttatag

SEQ ID NO: 199837 - DNA, 75 bp, Artificial Sequence
  Synthetic
tcaagtttaatagaacaatttatagttaatgtcaatgtaggtgattttgaattcaatgacactcaaaatagtatt

SEQ ID NO: 199838 - DNA, 75 bp, Artificial Sequence
  Synthetic
gtattattatcacagctaatggggaaaattgttgttgattcaataataggattagatgagtcgacatcaatcatt

SEQ ID NO: 199839 - DNA, 75 bp, Artificial Sequence
  Synthetic
attagatgagtcgacatcaatcattaatgatgcaatcatagagactgattactcttcaaattggatcagtgaatt

SEQ ID NO: 199840 - DNA, 75 bp, Artificial Sequence
  Synthetic
cttaaatacttacttggatcaagtattcatatatattgggtggaacattttattagaattatcatatcagatgta

SEQ ID NO: 199841 - DNA, 75 bp, Artificial Sequence
  Synthetic
ttcatatatattgggtggaacattttattagaattatcatatcagatgtattatttaaggattactggattaatg

SEQ ID NO: 199842 - DNA, 75 bp, Artificial Sequence
  Synthetic
aattatcatatcagatgtattatttaaggattactggattaatgaacttactagattacattgaattaacattgc

SEQ ID NO: 199843 - DNA, 75 bp, Artificial Sequence
  Synthetic
ttatttaaggattactggattaatgaacttactagattatattgaattaacattgcaaaggatacccggattgtc

SEQ ID NO: 199844 - DNA, 75 bp, Artificial Sequence
  Synthetic
aatacagaacttggcttcgacgataagccatccaaaaattttaagaagaatgattaatttaggaatttgtgtccc

SEQ ID NO: 199845 - DNA, 75 bp, Artificial Sequence
  Synthetic
tgattaatttaggaatttgtgtcccaagcaactctccacaatttgcaacacttaacttcacaaagatagctgtgc

SEQ ID NO: 199846 - DNA, 75 bp, Artificial Sequence
  Synthetic
aatgtcttatgtggggtattaaaactgcattaacaaatctttataatcatatatcattcaaaatattaattcact

SEQ ID NO: 199847 - DNA, 75 bp, Artificial Sequence
  Synthetic
cagaagatgcaatagatttaaatgatagaatatataactttgctgcaagaaaactgacattaattgcaatgctat

SEQ ID NO: 199848 - DNA, 75 bp, Artificial Sequence
  Synthetic
atgattttgagtgtaatttaccaaaattaaagggtcttactgcagaaaataaatgttgcatattgactgaattct

SEQ ID NO: 199849 - DNA, 75 bp, Artificial Sequence
  Synthetic
tattaagtgaaacatgcttagcaaatttatcaattcaacacaatgaatcatacatcaatcaagtaacaaatccaa

SEQ ID NO: 199850 - DNA, 75 bp, Artificial Sequence
  Synthetic
tacatcaatcaagtaacaaatccaaatatacatccttatccatgtaatagttattatttatccagaaaggcatta

SEQ ID NO: 199851 - DNA, 75 bp, Artificial Sequence
  Synthetic
aattttataagatcaaagaatgaatcagagttctttctaaagaattattatgatgattatggatttgttgatacc

SEQ ID NO: 199852 - DNA, 75 bp, Artificial Sequence
  Synthetic
cagagttctttctaaagaattattatgatgattatggatttgttgatacccctacagattttttacagcttaaaa

SEQ ID NO: 199853 - DNA, 75 bp, Artificial Sequence
  Synthetic
cctacagattttttacagcttaaaagtgaggaaaataatgatacactcttaacaaatgatattataattgaatta

SEQ ID NO: 199854 - DNA, 75 bp, Artificial Sequence
  Synthetic
aacaaatgatattataattgaattactcaatcattctcaaaaacttgaaagacatgaaatacctttccaggaatc

SEQ ID NO: 199855 - DNA, 75 bp, Artificial Sequence
  Synthetic
agaataatgatacactcctaacaaatgatattataattgaattactcaatcattctcaaaagcttgaaagacacg

SEQ ID NO: 199856 - DNA, 75 bp, Artificial Sequence
  Synthetic
gacatgaaatacctttccaggaatcacccactattgatcaagaaaatttctatccagaacctcctgtacatcata

SEQ ID NO: 199857 - DNA, 75 bp, Artificial Sequence
  Synthetic
gaacctcctgtacatcatatacttaggccattaggcttgacatctacttcatggtataaatcattaagtatagtt

SEQ ID NO: 199858 - DNA, 75 bp, Artificial Sequence
  Synthetic
tacttaggccattaggcttgacatctacttcatggtataaatcattaagtatagttaaattcttagaaatgattc

SEQ ID NO: 199859 - DNA, 75 bp, Artificial Sequence
  Synthetic
aaatacccgatggatctcatttatatttagctgaaggtagtggtgcttctatgacattgatagaaaacttttatc

SEQ ID NO: 199860 - DNA, 75 bp, Artificial Sequence
  Synthetic
ctgggaggaagatatactataacagctattactcaagcgaattaaaccctcctcagaggaactttgaacctttac

SEQ ID NO: 199861 - DNA, 75 bp, Artificial Sequence
  Synthetic
ttgatagaaaacttttatcccgggagaaagatatactataacagctattattcaagcgaattaaacccacctcag

SEQ ID NO: 199862 - DNA, 75 bp, Artificial Sequence
  Synthetic
ccacacaatttattgagagtgtaccatacaaacagattcaggcagaaatagagtgtcatctgggctttgtacaag

SEQ ID NO: 199863 - DNA, 75 bp, Artificial Sequence
  Synthetic
aggaattttgaacctctacccacacaatttattgagagtgtaccatacaaacagattcaggcagaaatagagtgt

SEQ ID NO: 199864 - DNA, 75 bp, Artificial Sequence
  Synthetic
agtacaagtgtttatggaatggtgtcactgaaactactgatttgtcagccattagctgtgctgaattcattatta

SEQ ID NO: 199865 - DNA, 75 bp, Artificial Sequence
  Synthetic
tgtgctgaattcattattaattctattggagtggattcagtcacattaattcattgtgatctagaagaaggattt

SEQ ID NO: 199866 - DNA, 75 bp, Artificial Sequence
  Synthetic
attctattggagtagattcagtcacattaattcattgtgatggagaagaaggatttgatactcctcaagaggaga

SEQ ID NO: 199867 - DNA, 75 bp, Artificial Sequence
  Synthetic
tcattgtgatctagaagaaggatttgaaactcctcaggaggaaatatcatcagctgtcatccatgttttacaaat

SEQ ID NO: 199868 - DNA, 75 bp, Artificial Sequence
  Synthetic
ggatttgatactcctcaagaggagatatcatcagctgtcatccatgtattacaaataacttgcagctgtcttaaa

SEQ ID NO: 199869 - DNA, 75 bp, Artificial Sequence
  Synthetic
caagttgggtaccctttactagattttctacattaatttctatatgctggactttttcatctcaaattatactca

SEQ ID NO: 199870 - DNA, 75 bp, Artificial Sequence
  Synthetic
tacgaagtgcatatagtgacccctctaatcatgaagtttacttagtttgcaaaagatcagaggatggctggtttt

SEQ ID NO: 199871 - DNA, 75 bp, Artificial Sequence
  Synthetic
ctgacttaagaactgctatattaaatgcccagacattgacccaatccaattatacaatattatctccaaatatta

SEQ ID NO: 199872 - DNA, 75 bp, Artificial Sequence
  Synthetic
taaatcattactgggaacaattaatacaccaaaaggataatatcttaaatattataaatgataccatcacgtcat

SEQ ID NO: 199873 - DNA, 75 bp, Artificial Sequence
  Synthetic
taatcagaagatcctacaagcaggtggatcccttagctgtcagcaatggataaatatcacaaatttcaattctct

SEQ ID NO: 199874 - DNA, 75 bp, Artificial Sequence
  Synthetic
tgtaaatttgtacaaacacttagcttctatttatacaatccatattaaagaaattattgaaatactgaagagtga

SEQ ID NO: 199875 - DNA, 75 bp, Artificial Sequence
  Synthetic
tctgtacaagcacttagcctctatttatacggttcatattaaggaaattatagagatattaaagagtgagggaga

SEQ ID NO: 199876 - DNA, 75 bp, Artificial Sequence
  Synthetic
gggagatgaatatctaggtttgatatggtctccatacaatattggagctcaagggaaaataaatactatactacg

SEQ ID NO: 199877 - DNA, 75 bp, Artificial Sequence
  Synthetic
cgaatatctaggtttgatatggtctccatacaatattggagctcaggggaaaataaatactatattacggttatt

SEQ ID NO: 199878 - DNA, 75 bp, Artificial Sequence
  Synthetic
gttattatcagaaaaagtgatgctctatattgttaaaaattggaaattaattgattatcatgcaaaaattgattt

SEQ ID NO: 199879 - DNA, 75 bp, Artificial Sequence
  Synthetic
taaacataacttagaatgtggtgaatttgatgccggctgtttctttaaaccagacttgttgtacaagtatacacc

SEQ ID NO: 199880 - DNA, 75 bp, Artificial Sequence
  Synthetic
taatttagagtgtggtgaatttgatgctggctgtttctttaaaccagacttgttgtacaagtatacaccaaaccc

SEQ ID NO: 199881 - DNA, 75 bp, Artificial Sequence
  Synthetic
aaatccacggtaccttcgtaaaacaatttcaaataatgtgttagttgaattgattactgtaaaaatggtgctaaa

SEQ ID NO: 199882 - DNA, 75 bp, Artificial Sequence
  Synthetic
acggtatcttcgcaagacaatttcaaacaatgtgttagttgaattgattaccgtaaaaatggttctaaaattatc

SEQ ID NO: 199883 - DNA, 75 bp, Artificial Sequence
  Synthetic
attatcccgaccaaaacaaaagcagatttggaaattattaggttgcactctctttgttggaatacaagatgaaca

SEQ ID NO: 199884 - DNA, 75 bp, Artificial Sequence
  Synthetic
tctttgttggaatacaagatgaacagttaggaataaatgagcaaaaaatagacagtaatccagataaatatatcc

SEQ ID NO: 199885 - DNA, 75 bp, Artificial Sequence
  Synthetic
aacaaatgaacaaaaaatagatagtaatccagataagtatgtccaattcaatgatgcaaatgatgaaagagatgt

SEQ ID NO: 199886 - DNA, 75 bp, Artificial Sequence
  Synthetic
aattcaatgatgcaaacgatgaaagagatgtttttggtgatatattataataaattcaacacaaatttaatgatt

SEQ ID NO: 199887 - DNA, 75 bp, Artificial Sequence
  Synthetic
agatgtttttggtgatatattataataaattcaacacaaatttaatgattaatgataataatcatgcaagatatc

SEQ ID NO: 199888 - DNA, 75 bp, Artificial Sequence
  Synthetic
ttttggtgatatattataataaattcaacacagatttagtgattaacgataacaatcatgcaatatatccatatc

SEQ ID NO: 199889 - DNA, 75 bp, Artificial Sequence
  Synthetic
catatcaaatgaattccctaggctattattataatcagattaaaatttttaaaaaatacattattgataaaaact

SEQ ID NO: 199890 - DNA, 75 bp, Artificial Sequence
  Synthetic
ttattataatcagattaaaatttttaaaaaatacattattgataaaaactttttatatcgttcggtatcgatctc

SEQ ID NO: 199891 - DNA, 75 bp, Artificial Sequence
  Synthetic
tcttagaagtgtttaataaaaaattaaaaacatatttaactttaaagaaaacttttcatatctcttctccccttg

SEQ ID NO: 199892 - DNA, 75 bp, Artificial Sequence
  Synthetic
atcgttcggtatcgatctctcttagaagtatttaataaaaaattaaaaacacatttaactttaaagaaaactttt

SEQ ID NO: 199893 - DNA, 75 bp, Artificial Sequence
  Synthetic
ggtccggaaaggttgtaaatcgaggacgatagcgatagcaagttgtcctaaattgacaattaatccggaccttta

SEQ ID NO: 199894 - DNA, 75 bp, Artificial Sequence
  Synthetic
aaggggagaagagatatagatattaatctaaaaaattaaaaatatctaatgtaggtccggaaaggttgtaaatcg

SEQ ID NO: 199895 - DNA, 75 bp, Artificial Sequence
  Synthetic
ctctcttagaagtatttaataaaaaattaaaaacacatttaactttaaagaaaacttttcatatctcttctcccc

SEQ ID NO: 199896 - DNA, 75 bp, Artificial Sequence
  Synthetic
ataaagtagattatcaatatatcaccatgtcttcggttttagctgcttacgagcaatttcttcaaacgactgaag

SEQ ID NO: 199897 - DNA, 75 bp, Artificial Sequence
  Synthetic
ctaaattgacaattaatccggacctttaataaagtagcttatcaatatatcaccatgtcttcggttttagctgct

SEQ ID NO: 199898 - DNA, 75 bp, Artificial Sequence
  Synthetic
ttagaagtgtttaataaaaaattaaaaacatatttaactttaaagaaaacttttcatatctcttctccccttggt

SEQ ID NO: 199899 - DNA, 75 bp, Artificial Sequence
  Synthetic
atcggagttttggtgatcaacaatttgtacaatctgataccttaaaggcagaaatccctgtttttgtacttaata

SEQ ID NO: 199900 - DNA, 75 bp, Artificial Sequence
  Synthetic
tgtacaatctgataccttaaaggcagaaatccctgtttttgtacttaatacaaacgatccacagcaaagatttac

SEQ ID NO: 199901 - DNA, 75 bp, Artificial Sequence
  Synthetic
caaacgatccacagcaaagatttacattaatgaatttttgcctccgacttgccgtatcatcatctgccaagtcag

SEQ ID NO: 199902 - DNA, 75 bp, Artificial Sequence
  Synthetic
caatcaaacagggagcattattatctctgctttctttacaggccacatcaatgcagaatcaccttatgattgctg

SEQ ID NO: 199903 - DNA, 75 bp, Artificial Sequence
  Synthetic
atgcagaatcaccttatgattgctgccagggccccagatgcagctcttagaatcattgaagttgatgcaatagac

SEQ ID NO: 199904 - DNA, 75 bp, Artificial Sequence
  Synthetic
ccacaagattatacattaactattaacccaagatctggctgggatgacatcaagatcagagcttatagggcatta

SEQ ID NO: 199905 - DNA, 75 bp, Artificial Sequence
  Synthetic
caagatcagagcttatagggcattatccagagatttgcctatcagccttgccgataggacagtatttgtatctag

SEQ ID NO: 199906 - DNA, 75 bp, Artificial Sequence
  Synthetic
gacccacaagattatacattaactattaacccaaggtctggctgggatgatatcaagatcagagcttatagggca

SEQ ID NO: 199907 - DNA, 75 bp, Artificial Sequence
  Synthetic
agaagcagaacatgcagtgtgtgacgatatggatacatacctgaataggatattcagtgtattaatacagatttg

SEQ ID NO: 199908 - DNA, 75 bp, Artificial Sequence
  Synthetic
gataatggtgtgcaaatgtatgacagcctatgatcaacccactggatctgaagagagaaggttggctaagtacaa

SEQ ID NO: 199909 - DNA, 75 bp, Artificial Sequence
  Synthetic
ttggataatggtgtgcaaatgtatgacagcctatgatcaacccactggatctgaagagagacgactggctaagta

SEQ ID NO: 199910 - DNA, 75 bp, Artificial Sequence
  Synthetic
aaattatccaattagtaataagagagagtatggttataagacaatttcttgtacaggagatgttaacagctgata

SEQ ID NO: 199911 - DNA, 75 bp, Artificial Sequence
  Synthetic
caagcagcagggcaggatgttagagaaatatcaactgcaaacagatgccaggaaaattatccaattagtaataag

SEQ ID NO: 199912 - DNA, 75 bp, Artificial Sequence
  Synthetic
ggaaaattatccaattagtaataagagaaagtatggttataaggcaatttcttgtacaggagatgttaacagcgg

SEQ ID NO: 199913 - DNA, 75 bp, Artificial Sequence
  Synthetic
ttatgctatggtaggagatattgcaaagtatatagccaatgtcggaatgagtgcattctttcttacactcaagtt

SEQ ID NO: 199914 - DNA, 75 bp, Artificial Sequence
  Synthetic
aagtatatagccaatgtcggaatgagtgcattctttcttacactcaagttcggtttgggtaacaggtggaaacca

SEQ ID NO: 199915 - DNA, 75 bp, Artificial Sequence
  Synthetic
gtcattatacagaagattaggtgacagatcaagatatttggctctcttagaatctcctgaattgatggaatttgc

SEQ ID NO: 199916 - DNA, 75 bp, Artificial Sequence
  Synthetic
ccacttgctctagctgcattttctggtgagttagttaaactgaagtctcttatgtcattatacagaagattaggt

SEQ ID NO: 199917 - DNA, 75 bp, Artificial Sequence
  Synthetic
agatcaagatatttggctctcttagaatctcctgaattgatggaatttgctccagccaattacccgctattattc

SEQ ID NO: 199918 - DNA, 75 bp, Artificial Sequence
  Synthetic
tccagccaattacccgctattattcagttacgccatgggagttggaagtgtccaggatccattgatcagaaacta

SEQ ID NO: 199919 - DNA, 75 bp, Artificial Sequence
  Synthetic
tgctccagctaattacccgctattattcagttacgccatgggagttggaagtgtccaggatccattgatcagaaa

SEQ ID NO: 199920 - DNA, 75 bp, Artificial Sequence
  Synthetic
tcagtttggaaggaacttcttaaacaccagctattttcagtatggtgttgagactgcaatgaaacaccagggtac

SEQ ID NO: 199921 - DNA, 75 bp, Artificial Sequence
  Synthetic
ttatcagtttggaaggaacttcttaaataccagctattttcagtatggtgttgagactgcaatgaaacaccaggg

SEQ ID NO: 199922 - DNA, 75 bp, Artificial Sequence
  Synthetic
agttgaccctaaattggccttagagcttggaataactgatgaagacagagtggatattatgcagtccgttgaaaa

SEQ ID NO: 199923 - DNA, 75 bp, Artificial Sequence
  Synthetic
aataccagctattttcagtatggtgttgagactgcaatgaaacaccagggaacagttgaccctaaattggcttta

SEQ ID NO: 199924 - DNA, 75 bp, Artificial Sequence
  Synthetic
cttggaataactgatgaagacagagtggatattatgcagtccgttgaaaagcacatatcaggaaaagctggtgat

SEQ ID NO: 199925 - DNA, 75 bp, Artificial Sequence
  Synthetic
gagcttggaataaccgatgaagacagagtggacattatgcagtccgttgaaaagcacatatcaggaaaagctgga

SEQ ID NO: 199926 - DNA, 75 bp, Artificial Sequence
  Synthetic
tttcattaacaacaacacttcccaagacttctcaggggcaagactctccaactacgagcaaggatggtccggcac

SEQ ID NO: 199927 - DNA, 75 bp, Artificial Sequence
  Synthetic
gatgatatatcacagcctgcaggtgcatttgcaatgtccctaaacagatcagctttcattaacaacaacacttcc

SEQ ID NO: 199928 - DNA, 75 bp, Artificial Sequence
  Synthetic
aaatcaagatgaaacgagagatgcctatccagaacctacaatgcatagactccaaaacattgaatcaactgactc

SEQ ID NO: 199929 - DNA, 75 bp, Artificial Sequence
  Synthetic
caagacttctcaggggcaagactctccaactacgagcaaggatggtctggcacaaatcaagatgaaacgagagat

SEQ ID NO: 199930 - DNA, 75 bp, Artificial Sequence
  Synthetic
cacaaatcaagatgaaacgagagatgcctatccagaatccacaatgcatagactcccaaacattgaatcaactga

SEQ ID NO: 199931 - DNA, 75 bp, Artificial Sequence
  Synthetic
tccaaaacattgaatcaactgactcagatcacaatgaactactgatgccggagcttgaaagcgacagcaacccct

SEQ ID NO: 199932 - DNA, 75 bp, Artificial Sequence
  Synthetic
gagcttgaaagcgacagcaaccccttcaatcgtccaagattcacagtcagagcaccactcatcccagaaatctcg

SEQ ID NO: 199933 - DNA, 75 bp, Artificial Sequence
  Synthetic
caccagaatccaaataccagaatgagcagagacatcaacacaagggacaacatcagagctgaccgtcaaaatacc

SEQ ID NO: 199934 - DNA, 75 bp, Artificial Sequence
  Synthetic
aatgaggaccgaggcagcaacattccagatgacattcttggagatctagacaattgacacatcaacaacccagcc

SEQ ID NO: 199935 - DNA, 75 bp, Artificial Sequence
  Synthetic
atagctagacaataatcataaaccgggaaaatctcaaagatacacaatcgcacacatacaatgaaagcaatcact

SEQ ID NO: 199936 - DNA, 75 bp, Artificial Sequence
  Synthetic
agacaattgacacatcaccgacctagccatagctacacaacaatcacaaactgggaaaatctcaaagacacacaa

SEQ ID NO: 199937 - DNA, 75 bp, Artificial Sequence
  Synthetic
tctgttccacatcacaacccagaaatcctgccaaacgcaacatcacgaccaatcaactgatgatacacagtagaa

SEQ ID NO: 199938 - DNA, 75 bp, Artificial Sequence
  Synthetic
tcgcacgcacgcaatgaaaacaatcactcctgtcctacatcacaacccagaaaccccgccaaacgcaacatcacg

SEQ ID NO: 199939 - DNA, 75 bp, Artificial Sequence
  Synthetic
tacaagaacacaactgcattgatttaagaaaaaactaagataggcctgaacggttgcattcaggattctcaatcg

SEQ ID NO: 199940 - DNA, 75 bp, Artificial Sequence
  Synthetic
accaatcaattgacaatacacagtagaatacaagaactcaactgctctgatttaagaaaaaactaagataggcct

SEQ ID NO: 199941 - DNA, 75 bp, Artificial Sequence
  Synthetic
ttcaggccaatacaattatcagcttcaaacgaaaacaacaagatgagctttgaaataagcatggaggagattgac

SEQ ID NO: 199942 - DNA, 75 bp, Artificial Sequence
  Synthetic
gaacggttgcattcaggtttctcaatcgttcaggccaatacaattctcagcttcaaacaaaaacaacaagatgag

SEQ ID NO: 199943 - DNA, 75 bp, Artificial Sequence
  Synthetic
gagctcattgaaactggcaatctcaacatagattatgcacttaaagaattaggtgcaaccagtcaactcccgcca

SEQ ID NO: 199944 - DNA, 75 bp, Artificial Sequence
  Synthetic
ctttgaaataagcgtggaggagattgatgatctcattgaaactggcaatctcaacatagattatgcacttaaaga

SEQ ID NO: 199945 - DNA, 75 bp, Artificial Sequence
  Synthetic
aataaatctccgtctcagaccagcaaaacagaagaaaccaacgatgagacaagaacctcaaaaaacttggcatca

SEQ ID NO: 199946 - DNA, 75 bp, Artificial Sequence
  Synthetic
attaggtgcaaccaatcaactcccgccaaacaaacctccgtctcaaatcagcaaaacagaagaaaacaacaatga

SEQ ID NO: 199947 - DNA, 75 bp, Artificial Sequence
  Synthetic
ggagaggcaccagcccacgcctcttcaccactgcggtcacacaatgaagagagtgaatcagggaaacagagccca

SEQ ID NO: 199948 - DNA, 75 bp, Artificial Sequence
  Synthetic
gacaaggatctcaaaaaactcggcatcaggagaggcaccagctcacaccccctcaccactgcggtcacacaatga

SEQ ID NO: 199949 - DNA, 75 bp, Artificial Sequence
  Synthetic
gagtgaatcagggaaacagagcccagacggtttctccatgatatccaacagaccccaaacaggtacactgctcat

SEQ ID NO: 199950 - DNA, 75 bp, Artificial Sequence
  Synthetic
agagaatgaactagggaaacagagctcagacggcttctccatgatatccaacagaccccaaacaggtacgctgct

SEQ ID NO: 199951 - DNA, 75 bp, Artificial Sequence
  Synthetic
gggatcagacacacaatctccaagtccatcaaagacctatcaaggactcattcttgatgcaaagaagagagcgct

SEQ ID NO: 199952 - DNA, 75 bp, Artificial Sequence
  Synthetic
tcagacggcttctccatgatatccaacagaccccaaacaggtacgctgcttatgggatcagacacacaatctcca

SEQ ID NO: 199953 - DNA, 75 bp, Artificial Sequence
  Synthetic
acaacaaatgaacatggaaacacaaatgacaccaggatatttaagaggggggaatatagccaccaagaaagaggc

SEQ ID NO: 199954 - DNA, 75 bp, Artificial Sequence
  Synthetic
tcattcttgatgcaaagaagagagcgctaaatgaaccaagaaggaatcaaaaaacaacaaatgaacatggaaaca

SEQ ID NO: 199955 - DNA, 75 bp, Artificial Sequence
  Synthetic
atgacaccaggatatttaagaggggggaatatagccaccaagaaagaggcttgggttacacaggatcagagatca

SEQ ID NO: 199956 - DNA, 75 bp, Artificial Sequence
  Synthetic
ttgggttacacaggatcagagatcaaaaacgcaatcttcattccaagacatcgaagggaatactcgatttcatgg

SEQ ID NO: 199957 - DNA, 75 bp, Artificial Sequence
  Synthetic
gtcaacggaagaaccacaatatcagagtggtgcaatccatgttgcgcaccagtcaaaccaaccgcctctgtcgaa

SEQ ID NO: 199958 - DNA, 75 bp, Artificial Sequence
  Synthetic
tcaaaaatacaatcttcattccaagacatcgaagggagtactcgatttcatgggtcaacggaagaactacaatat

SEQ ID NO: 199959 - DNA, 75 bp, Artificial Sequence
  Synthetic
cagagtggtgcaatccatgttgcgcaccagtcaaatcaattgcctctgtcgaaaaatgtacatgtggaagatgtc

SEQ ID NO: 199960 - DNA, 75 bp, Artificial Sequence
  Synthetic
aagtgtacatgtggaagatgtcccaaagtttgcgaattgtgcatcagagatccttgatgcaatcaaagcattaga

SEQ ID NO: 199961 - DNA, 75 bp, Artificial Sequence
  Synthetic
ggtgaggttagacaggatcgaagggaaagttgacaaaattatgcttactcaaaatacaattcagcaaacaaaaaa

SEQ ID NO: 199962 - DNA, 75 bp, Artificial Sequence
  Synthetic
agaggtgagattagacaggatcgaaggaaaagtggacaaaattatgcttactcaaaatacagttcagcaaacaaa

SEQ ID NO: 199963 - DNA, 75 bp, Artificial Sequence
  Synthetic
aaaatacaattcagcaaacaaaaaatgacactcagcaaattaaaggctcacttgcaacaattgagggcctaatca

SEQ ID NO: 199964 - DNA, 75 bp, Artificial Sequence
  Synthetic
aaatgacactcaacaaattaaaggttcacttgcaacaattgagggcttaatcacaacaatgaaaataatggaccc

SEQ ID NO: 199965 - DNA, 75 bp, Artificial Sequence
  Synthetic
tcacttgcaacaattgagggcttaatcacaacaatgaaaataatggaccctggagtcccatcaaaagtaagcctc

SEQ ID NO: 199966 - DNA, 75 bp, Artificial Sequence
  Synthetic
agcttaaacaaagggccagagcaagttccaataatcgtcactggtactggcgatgtctcaaaatttgttgatcaa

SEQ ID NO: 199967 - DNA, 75 bp, Artificial Sequence
  Synthetic
tggagtcccatcaaaagtaagcctcagaagtttaaacaaagggccagagcaagctcccgtaatcgtcactggcac

SEQ ID NO: 199968 - DNA, 75 bp, Artificial Sequence
  Synthetic
agaagtttaaacaaagggccagagcaagctcccgtaatcgtcactggcactggagatgtctcaaaatttgttgat

SEQ ID NO: 199969 - DNA, 75 bp, Artificial Sequence
  Synthetic
tcgagatctatttggagactgtgacaagagcagaaaacttcttgaatcaataaacatggcaaccacagagcaaga

SEQ ID NO: 199970 - DNA, 75 bp, Artificial Sequence
  Synthetic
acatggcaaccacagagcaagaaatcaacttgatcaaaactaatgctcttagaagcatcacttaaactatgagat

SEQ ID NO: 199971 - DNA, 75 bp, Artificial Sequence
  Synthetic
ctatgaatcacgaaggtcacagcgacccagattcactcaatacgccaagcgctcaaccccacacccagaagggac

SEQ ID NO: 199972 - DNA, 75 bp, Artificial Sequence
  Synthetic
aatcaacttgatcaaaactaatgctcttagaagcatcacctaaactatgagatccacgaaccacggagatcacag

SEQ ID NO: 199973 - DNA, 75 bp, Artificial Sequence
  Synthetic
aaccgcaccgcatccccaagaatcgacaccagctcagacgacggcaacaccaatcatcacaaaacaaaacacaga

SEQ ID NO: 199974 - DNA, 75 bp, Artificial Sequence
  Synthetic
cgacccagactcactcaatacgccacgccctcaaccccacacccagaagggataactagaccgcatccataagaa

SEQ ID NO: 199975 - DNA, 75 bp, Artificial Sequence
  Synthetic
acatcagcactgcatacaaaatcaccccccagcacacacaatccatcgaccgacagattccctccataacattac

SEQ ID NO: 199976 - DNA, 75 bp, Artificial Sequence
  Synthetic
tcaacaccaactcaaacgacgacaacaccaatcatcacaaaacaacacacagaacatcagtattgcatacaaaat

SEQ ID NO: 199977 - DNA, 75 bp, Artificial Sequence
  Synthetic
aaagtatttaagaaaaaaaccagaagtaaggggggacccatcatccaatcgactgtggccatggctcccactcaa

SEQ ID NO: 199978 - DNA, 75 bp, Artificial Sequence
  Synthetic
cattccccggcacacacaattcactggctgacagattccctccatgacaccacaaagcatttaagaaaaaaacca

SEQ ID NO: 199979 - DNA, 75 bp, Artificial Sequence
  Synthetic
cacaaagcatttaagaaaaaaaccagaagtaaggggggacccatcatccgatcgaccgtggccatggcccccact

SEQ ID NO: 199980 - DNA, 75 bp, Artificial Sequence
  Synthetic
tccaaagtcaaaattcacaatctagctgaagctcacgagaaggtactgagagccttcccaatagaagttgaacag

SEQ ID NO: 199981 - DNA, 75 bp, Artificial Sequence
  Synthetic
caatccaaagtcaaaattcacaatctagctgaagctcatgagaaggtactaagagccttcccaatagaagttgaa

SEQ ID NO: 199982 - DNA, 75 bp, Artificial Sequence
  Synthetic
agccttcccaatagaagttgaacagaactcagaagggaagaaactattagtgaaacagatcagaataagaacgct

SEQ ID NO: 199983 - DNA, 75 bp, Artificial Sequence
  Synthetic
tagctgaagctcatgagaaggtactaagagccttcccaatagaagttgaacagaattcagagggaaagaaactat

SEQ ID NO: 199984 - DNA, 75 bp, Artificial Sequence
  Synthetic
aggacatgcggatcattcaaatgattcaatttgctttctgaatacttacgggtttatcaaggaagcagtcagcca

SEQ ID NO: 199985 - DNA, 75 bp, Artificial Sequence
  Synthetic
tagtgaaacagatcagaataagaacgctaggacatgcggaccattcaaatgattcaatttgctttctgaacactt

SEQ ID NO: 199986 - DNA, 75 bp, Artificial Sequence
  Synthetic
gctaggacatgcggaccattcaaatgattcaatttgctttctgaacacttacgggtttatcaaagaagcagtcag

SEQ ID NO: 199987 - DNA, 75 bp, Artificial Sequence
  Synthetic
ccagacagaattcatgagagcaggacagagactggaaagcaaaaacactctgactgcttgcatgttaccctttgg

SEQ ID NO: 199988 - DNA, 75 bp, Artificial Sequence
  Synthetic
aagatgctagaatatgcagaagacattaagatcaatgtaagaaagacagcaggctgcaaggaacagattgtgttt

SEQ ID NO: 199989 - DNA, 75 bp, Artificial Sequence
  Synthetic
tctctagataggacacctcaagtgttcaggggatttcaatttccccgggatagatatgcatgtgttccatctgac

SEQ ID NO: 199990 - DNA, 75 bp, Artificial Sequence
  Synthetic
atattaagatccatgtaagaaagacagcaggctgcaaagaacagattgtgttttctctagataggacacctccag

SEQ ID NO: 199991 - DNA, 75 bp, Artificial Sequence
  Synthetic
tcaggggatttcaatttccccgggatagatatgcatgtgttccatctgacaaatatataaaatcaccaggaaagt

SEQ ID NO: 199992 - DNA, 75 bp, Artificial Sequence
  Synthetic
tagtcgcaggacccaattattgttacattatcactttcctttcattgacattctgtcccagcagccagaaattca

SEQ ID NO: 199993 - DNA, 75 bp, Artificial Sequence
  Synthetic
cattatcactttcctttcattgacattctgtcccagcagccagaaattcaaagtacctagacccatattgaattt

SEQ ID NO: 199994 - DNA, 75 bp, Artificial Sequence
  Synthetic
ggatagatatgcatgtgttccatctgacaagtatataaaatcaccagggaagttagtcgcaggacccaattattg

SEQ ID NO: 199995 - DNA, 75 bp, Artificial Sequence
  Synthetic
tcgatccacacgaatgaggggtatacatctagagattatcatgaaaattacgtgttctgaaaacagtccaatcag

SEQ ID NO: 199996 - DNA, 75 bp, Artificial Sequence
  Synthetic
tttccgatccacacgaatgaggggtatacatctagagattatcatgaaaattacgtgttctgaaaacagtccaat

SEQ ID NO: 199997 - DNA, 75 bp, Artificial Sequence
  Synthetic
aaagacactaataacagatgatcccgaaaatggaccaaaagcatccgtgtggatccacctctgtaatctttacaa

SEQ ID NO: 199998 - DNA, 75 bp, Artificial Sequence
  Synthetic
tagaaagacattaataacagatgatcctgaaaatggaccaaaagcatctgtgtggatccatctctgtaatcttta

SEQ ID NO: 199999 - DNA, 75 bp, Artificial Sequence
  Synthetic
aggaagaaatcctataaaagtatatgatgaggcatattttgcagagaaatgcaaacaaatgctgttaagcgtagg

SEQ ID NO: 200000 - DNA, 75 bp, Artificial Sequence
  Synthetic
gatgaggcatattttgcagagaaatgcaaacaaatgctgttaagcgtaggtatcagtgatctatgggggcccaca

SEQ ID NO: 200001 - DNA, 75 bp, Artificial Sequence
  Synthetic
caaagggagaaatcctataaaagtatatgatgaggcatattttgcagagaaatgcaaacaaatgctgctaagcgt

SEQ ID NO: 200002 - DNA, 75 bp, Artificial Sequence
  Synthetic
attgcagtacatgcaaatgggaaaatccccaaatctgccagcctttatttcaactcaagaggatgggctttgcat

SEQ ID NO: 200003 - DNA, 75 bp, Artificial Sequence
  Synthetic
tccccaaatctgccagcctttatttcaactcaagaggatgggctttgcatcccatagctgacgcatctcccacaa

SEQ ID NO: 200004 - DNA, 75 bp, Artificial Sequence
  Synthetic
acaattgcagtacatgcaaatggaaaaatccccaaatctgccagcctctatttcaactcaagaggatgggctctg

SEQ ID NO: 200005 - DNA, 75 bp, Artificial Sequence
  Synthetic
tggcaaaacaactatggtctataggctgtgagatcattgaagtcaatgcaatattacaaggctctgattacagtg

SEQ ID NO: 200006 - DNA, 75 bp, Artificial Sequence
  Synthetic
atattacaaggctctgattacagtgctctggtggatcatcccgatgtaatatatcggaaaatcagaattgatcca

SEQ ID NO: 200007 - DNA, 75 bp, Artificial Sequence
  Synthetic
gcaatattacaaggctctgattacagtgctctggtggatcatcccgatgtaatatatcggaaaatcagaattgat

SEQ ID NO: 200008 - DNA, 75 bp, Artificial Sequence
  Synthetic
gcaaaaaagcagtatgcacactctaagtggaatccattcaagaaggcaatatccatgcctgatcttgctggcata

SEQ ID NO: 200009 - DNA, 75 bp, Artificial Sequence
  Synthetic
ccggcaaaaaagcaatatgcacactctaaatggaatccattcaagaaggcaatatccatgcctgatcttgctagc

SEQ ID NO: 200010 - DNA, 75 bp, Artificial Sequence
  Synthetic
aatatctaatcatacaaattaatcactgatatagagttaaggaacattttatattcctccccattgtatcaccat

SEQ ID NO: 200011 - DNA, 75 bp, Artificial Sequence
  Synthetic
ctaaatggaatccattcaagaaggcaatatccatgcctgatcttgctagcataaatatctaatcatacaaattaa

SEQ ID NO: 200012 - DNA, 75 bp, Artificial Sequence
  Synthetic
caccatcccgatatataaaaccacactacactatgcaccgtccaacatccagccaaccacaggatcacaaccaca

SEQ ID NO: 200013 - DNA, 75 bp, Artificial Sequence
  Synthetic
tttatatcccttctcgttgtatcaccatcaccatcctgatatataaaaccacactacactatgtaccgtccaata

SEQ ID NO: 200014 - DNA, 75 bp, Artificial Sequence
  Synthetic
ctacaccaactcaatcaaggacatccctgcaaacatcaaacaaccaaaccatgactgtaacagacacagcaccac

SEQ ID NO: 200015 - DNA, 75 bp, Artificial Sequence
  Synthetic
tctagccaaccataggatcacaaccacattacaccaattcaatcaaggacatccctgcaaatatcaaacaatcaa

SEQ ID NO: 200016 - DNA, 75 bp, Artificial Sequence
  Synthetic
acattacaccaattcaatcaaggacatccctgcaaatatcaaacaatcaaaatacgactgcaatagacacaacat

SEQ ID NO: 200017 - DNA, 75 bp, Artificial Sequence
  Synthetic
ccgaccaagccagaccctcaccatgcacccaagtcacccgacacaaccgcaaactctcgactctaccattcgaca

SEQ ID NO: 200018 - DNA, 75 bp, Artificial Sequence
  Synthetic
aatacgactgcaatagacacaacatcatccgatcaatccagaccctcactttgcacccaagtcatccgacacaac

SEQ ID NO: 200019 - DNA, 75 bp, Artificial Sequence
  Synthetic
cacatcctcgaacagaccacccaaaaacaccgaacaattaatctcctggtcacaacgatcattgtaaattttaag

SEQ ID NO: 200020 - DNA, 75 bp, Artificial Sequence
  Synthetic
cgtaaactctcgactccactatccgaaacatatcctcgaacagaccacccaaaaacatcgaacaatcaatctccc

SEQ ID NO: 200021 - DNA, 75 bp, Artificial Sequence
  Synthetic
aaaaaatctaacacacaactagagccaaacacagggggggaaaaacgcatccgccgccacacgcacagatccaga

SEQ ID NO: 200022 - DNA, 75 bp, Artificial Sequence
  Synthetic
agttgcaatgatcattataaattttaagaaaaaatctgacacacaactaaagccaagcatagggggggaaagacg

SEQ ID NO: 200023 - DNA, 75 bp, Artificial Sequence
  Synthetic
acccaaggcaaccaacacccgtcggactccgctccatcttcaaagaaatcaacatgggtgtcaaaggtctacctc

SEQ ID NO: 200024 - DNA, 75 bp, Artificial Sequence
  Synthetic
catccaccgccacacgcacagatccagaacccaaggcaaccaacacccatcggactccattccatcctcagagaa

SEQ ID NO: 200025 - DNA, 75 bp, Artificial Sequence
  Synthetic
tagttatgattggattattaatctcaccaattaccaatttggatataactcatctaatgaatctaggaacggtac

SEQ ID NO: 200026 - DNA, 75 bp, Artificial Sequence
  Synthetic
cggactccattccatcctcagagaaatcaacatgggtgtcaaaggtctatctctagttatgattggattattaat

SEQ ID NO: 200027 - DNA, 75 bp, Artificial Sequence
  Synthetic
caactgcaattagatctctagtttattacacctacagtaaaccatcctatctcaccgtagatttgattcccaatt

SEQ ID NO: 200028 - DNA, 75 bp, Artificial Sequence
  Synthetic
ctcaccaattaccaatttagatataactcatctaatgaatctaggaacggtaccaaccgcaattagatctctagt

SEQ ID NO: 200029 - DNA, 75 bp, Artificial Sequence
  Synthetic
tgaagaatctagacccaaaatgcaattactcaagtttaaattactacaataaaacggtgttaagcttgattcaac

SEQ ID NO: 200030 - DNA, 75 bp, Artificial Sequence
  Synthetic
ttactcaagtttaaattactacaataaaacggtgttaagcttgattcaaccaattgcagacaatatcaatcacct

SEQ ID NO: 200031 - DNA, 75 bp, Artificial Sequence
  Synthetic
tacaaagccaatcacaagctcagaaattcaaagtcgtttctttggggcagttataggtacagttgctctcggtgt

SEQ ID NO: 200032 - DNA, 75 bp, Artificial Sequence
  Synthetic
aataaaacggcgttaagcttgattcaaccaattgcagacaatatcaatcgccttacacagccaatcacaagctca

SEQ ID NO: 200033 - DNA, 75 bp, Artificial Sequence
  Synthetic
aaaatgcacgacttatactaactctcaaaaaagctgcagaggaaacaaatgatgcagttcgagatctcatagatt

SEQ ID NO: 200034 - DNA, 75 bp, Artificial Sequence
  Synthetic
aggaaaatgcacgacttatactgactctcaaaaaagctgcaaaggaaacaaataatgcagttcaggatctcataa

SEQ ID NO: 200035 - DNA, 75 bp, Artificial Sequence
  Synthetic
ccaacaaaattgtggcaaggatgatatcagcaattcagaatcagataaacactgtcattcaacctgccatagacc

SEQ ID NO: 200036 - DNA, 75 bp, Artificial Sequence
  Synthetic
tctcaaaaaagctgcaaaggaaacaaataatgcagttcaggatctcataaaatccaacaaaattgtggcaaggat

SEQ ID NO: 200037 - DNA, 75 bp, Artificial Sequence
  Synthetic
ggattgactgtcaaatcaaagacttacaagctgctaatattttaaatttgtacctaacagagatcacaactgttt

SEQ ID NO: 200038 - DNA, 75 bp, Artificial Sequence
  Synthetic
accgaatcaattgtcaaatcaaagacctacaagttggtaacattttaaatttgtatctgacagagatcacaactg

SEQ ID NO: 200039 - DNA, 75 bp, Artificial Sequence
  Synthetic
ttttccacaatcaattgaccaatcctgcattagaatcaattagtattcaggctcttaaaagtcttttaggatcta

SEQ ID NO: 200040 - DNA, 75 bp, Artificial Sequence
  Synthetic
taccagaagtgctgtctaagttagatctaaacaatatctcggcagcttcagtgatggcatctggcttaattaaag

SEQ ID NO: 200041 - DNA, 75 bp, Artificial Sequence
  Synthetic
ccttaccagaagtgctatctaagttagatctaaacaatatctcggcagcttcagtaatggcatctggcctaatta

SEQ ID NO: 200042 - DNA, 75 bp, Artificial Sequence
  Synthetic
aaggacagataattgcagttgatataccgactatgacattagtattgatggtccaaataccaagtatctctcctc

SEQ ID NO: 200043 - DNA, 75 bp, Artificial Sequence
  Synthetic
gacaagcaaaaataatagatctaacctctataacaattcacacaaataatcaggaagtacaagctgtggtaccag

SEQ ID NO: 200044 - DNA, 75 bp, Artificial Sequence
  Synthetic
gtccaaataccaagtatctctcctctaagacaagcaaaaataatagatctaacctctataacaattcacacaaat

SEQ ID NO: 200045 - DNA, 75 bp, Artificial Sequence
  Synthetic
caggaagtacaagctgtggtaccagatagagttcttgagattggttcagagatattaggatttgacggttcagtg

SEQ ID NO: 200046 - DNA, 75 bp, Artificial Sequence
  Synthetic
tgccaaatcacgaaagatacaatcttttgtccctacaatgatgcatatatattacccatccagcagaaaagatgc

SEQ ID NO: 200047 - DNA, 75 bp, Artificial Sequence
  Synthetic
cagatagagttcttgagattggttcagagatattaggttttgacggttcagtgtgccaaatcacgaaagatacag

SEQ ID NO: 200048 - DNA, 75 bp, Artificial Sequence
  Synthetic
tttgtccctacaatgatgcatatatattacccatccagcagaaaagatgcctacaaggtcaaacaagagattgcg

SEQ ID NO: 200049 - DNA, 75 bp, Artificial Sequence
  Synthetic
ctacaaggtcaaacaagagattgcgtgttcaccccggttgctggcacctttcctaggagatttctcactacatat

SEQ ID NO: 200050 - DNA, 75 bp, Artificial Sequence
  Synthetic
tccccaaataatctaccaacctgatgagaatccagttacaatcatagataaagacttatgtacaacattgactct

SEQ ID NO: 200051 - DNA, 75 bp, Artificial Sequence
  Synthetic
tatggtactatagtagccaattgtagaaatttagtatgttcttgtctacgacctccccaaataatctaccaacct

SEQ ID NO: 200052 - DNA, 75 bp, Artificial Sequence
  Synthetic
agactccataactatagagatccagaaatccataaatagtacttttcgacgtgaagtagttctagaatctactca

SEQ ID NO: 200053 - DNA, 75 bp, Artificial Sequence
  Synthetic
ggttagatctttgactcctcttgatttatcgaccgatttaagtcaatataatcaattactcaagagtgctgagga

SEQ ID NO: 200054 - DNA, 75 bp, Artificial Sequence
  Synthetic
tcaggtcagatctttgactcctcttgatttatcgaccgacttaagtcaatataatcaattactcaagagtgctga

SEQ ID NO: 200055 - DNA, 75 bp, Artificial Sequence
  Synthetic
ccacatccaacggtcaaatgattacttaaactcaatcaatcctagtatagtaaataatagcgcaataataatatt

SEQ ID NO: 200056 - DNA, 75 bp, Artificial Sequence
  Synthetic
ttaaactcaatcaatcctagtatagtaaataatagcgcaataataatattgattatactctgcatcttattaata

SEQ ID NO: 200057 - DNA, 75 bp, Artificial Sequence
  Synthetic
gatttatcgaccgacttaagtcaatataatcaattactcaagagtgctgaagaccacatccaacggtcaaatgat

SEQ ID NO: 200058 - DNA, 75 bp, Artificial Sequence
  Synthetic
tacttaaactcaattaatcctagtatagtgaataatagcgcaataataatattgattatattctgcatcttatta

SEQ ID NO: 200059 - DNA, 75 bp, Artificial Sequence
  Synthetic
ctgacagtcacaatctgcataatttggctcaagtatttgaccaaagaagttaggaatgtagcaagaaatcaaaga

SEQ ID NO: 200060 - DNA, 75 bp, Artificial Sequence
  Synthetic
atagtgatagttacaatctgcataatttggctcaagtatttgactaaagaagttaagaatgtggcaagaaatcaa

SEQ ID NO: 200061 - DNA, 75 bp, Artificial Sequence
  Synthetic
ctcaatagagatgctgatcttatttataagattcccagtcaaattccattgcccagataattgcaaccaagaggc

SEQ ID NO: 200062 - DNA, 75 bp, Artificial Sequence
  Synthetic
aggctcaatagagatgccgatcttatttataagattcccagtcagataccattgcccagataatagcaactaaga

SEQ ID NO: 200063 - DNA, 75 bp, Artificial Sequence
  Synthetic
acattttgcaaatcttacccagacgctcctagataaatcgcctacaaagaaaaataaactcccaatttatcaaaa

SEQ ID NO: 200064 - DNA, 75 bp, Artificial Sequence
  Synthetic
tttataagattcccagtcagataccattgcccagataatagcaactaagagacatattttgtaaatcttacccag

SEQ ID NO: 200065 - DNA, 75 bp, Artificial Sequence
  Synthetic
atgctcctggatatatcgctcacaaagaaaaatcaactcccaatttatcaaaagaaatccaaaatcaacagagcc

SEQ ID NO: 200066 - DNA, 75 bp, Artificial Sequence
  Synthetic
gaaatccaaaatcaacggagctacagccatcctgcaataacactgcgaccacaatgatactcttcaagaaatgaa

SEQ ID NO: 200067 - DNA, 75 bp, Artificial Sequence
  Synthetic
ggacaaatccagaaacagaaaaaaatagcccaaaacaaattaacagacagagaaagggagaagcaaacccgtctc

SEQ ID NO: 200068 - DNA, 75 bp, Artificial Sequence
  Synthetic
acagctatcctgcaacaacactgcgaccacaatgacactccctaagaaatgaaggacaaatccaggaatagaaaa

SEQ ID NO: 200069 - DNA, 75 bp, Artificial Sequence
  Synthetic
agcaaaacctcccatcaacagcactcgaccaagaccgaattaacagcacgaacgcagaaacccactaccacaaaa

SEQ ID NO: 200070 - DNA, 75 bp, Artificial Sequence
  Synthetic
aaatagcccaaaacaaattaacagacagagaaaggaagaggcaaacccgccccagcaaaatctcccatcaacatc

SEQ ID NO: 200071 - DNA, 75 bp, Artificial Sequence
  Synthetic
ccacagaaattctcccataatcccccaccaacattcaccaacaaatcagaaaatcattcaaccaggcaacctcca

SEQ ID NO: 200072 - DNA, 75 bp, Artificial Sequence
  Synthetic
aatcgaccaagactgaaccaacagcacaaacgcagaaacccaccatcacaaaaccacagaaagcctcccaaaatc

SEQ ID NO: 200073 - DNA, 75 bp, Artificial Sequence
  Synthetic
catttcaagtttaagaaaaaaactattataggggggaacgcacttctcagctccaaccacacgaggccttgtctt

SEQ ID NO: 200074 - DNA, 75 bp, Artificial Sequence
  Synthetic
ccccaccaacatttgccaaaaaaacaaaaaatcattcaaccaaacaacttccacatttcaagtttaagaaaaaaa

SEQ ID NO: 200075 - DNA, 75 bp, Artificial Sequence
  Synthetic
gtaaaacagaatcaatctcacaaagttcaaaacaaaatctgactacaagtggaacctccacaattcaaaattcaa

SEQ ID NO: 200076 - DNA, 75 bp, Artificial Sequence
  Synthetic
ctattataggggggaacgcacttctcagctccaaccacacaaggccttatcttgtaaaacagaaccaatcctaca

SEQ ID NO: 200077 - DNA, 75 bp, Artificial Sequence
  Synthetic
ccaacgatctaacaacaactcatcaactagcaaccatcactgaactcaacaatccagaaggacgtcacatcaatt

SEQ ID NO: 200078 - DNA, 75 bp, Artificial Sequence
  Synthetic
aagttcagaacaaaatctgaccacaagtataacctccacaattcaaaattagatcaacgatctagcaacaactca

SEQ ID NO: 200079 - DNA, 75 bp, Artificial Sequence
  Synthetic
agatcaacgatctagcaacaactcatcaaccagcagccatcactgagctcaacaatccaaaaggacatcacatca

SEQ ID NO: 200080 - DNA, 75 bp, Artificial Sequence
  Synthetic
cattcgtgaatctccaaaagaaataacccaagtaaatttacaatctactctttaattataaataaactaaagtaa

SEQ ID NO: 200081 - DNA, 75 bp, Artificial Sequence
  Synthetic
actcattcgcgactctccaaaagaaataacccaaataaatttacaactcactattcaattataaataaattaaag

SEQ ID NO: 200082 - DNA, 75 bp, Artificial Sequence
  Synthetic
gtcacaaggatgcaagattcacgtggcaatactcaaatattcagccaagcaaattcaatggtaaaaagaacatgg

SEQ ID NO: 200083 - DNA, 75 bp, Artificial Sequence
  Synthetic
ataacccaaataaatttacaactcactattcaattataaataaattaaagcaaatcacaaggatgcaagattcac

SEQ ID NO: 200084 - DNA, 75 bp, Artificial Sequence
  Synthetic
gcaatactcaaatattcagccaagcaaattcaatggtaaaaagaacatggagattactattccggattgtaactt

SEQ ID NO: 200085 - DNA, 75 bp, Artificial Sequence
  Synthetic
atgtcgatataatcagaaaagagctcgatgaacttatggagaactttgaaaccacctctaaatcactgctaagcg

SEQ ID NO: 200086 - DNA, 75 bp, Artificial Sequence
  Synthetic
caatcaactccggggaatttgcaaagtgatgtcgatataatcagaaaagagctcgatgaacttatggagaacttt

SEQ ID NO: 200087 - DNA, 75 bp, Artificial Sequence
  Synthetic
tagcaaatcaaattacttatgatgtatcagttctcacccccataaggcaagaagccactgaaacaaacattattg

SEQ ID NO: 200088 - DNA, 75 bp, Artificial Sequence
  Synthetic
gaaaccacctctaaatcactgctgagcgtagcaaatcagattacttatgatgtatcagttctcactcccataagg

SEQ ID NO: 200089 - DNA, 75 bp, Artificial Sequence
  Synthetic
cgaaaataaaagatcattgcaaagatagggtagttaaaggagagagcacctgcacactgggtcacaagcctctac

SEQ ID NO: 200090 - DNA, 75 bp, Artificial Sequence
  Synthetic
caagaagccatcgaaacaaacattattgcgaaaataaaggatcattgcaaagatagggtagttaggggagaaagc

SEQ ID NO: 200091 - DNA, 75 bp, Artificial Sequence
  Synthetic
tagggtagttaaaggagagagcacctgcacactgggtcacaagcctctacatgatgtttcctttctgaatggatt

SEQ ID NO: 200092 - DNA, 75 bp, Artificial Sequence
  Synthetic
taacaaattctatttcacatatagggacaatgtacaaatcagacttaatccattattagattatcccaattttat

SEQ ID NO: 200093 - DNA, 75 bp, Artificial Sequence
  Synthetic
acctgtacactgagtcacaagcctctacatgatgtttcctttctaaatggatttaacaaattctatttcacatat

SEQ ID NO: 200094 - DNA, 75 bp, Artificial Sequence
  Synthetic
tccaactgctacaactcctcatggatgcattcgaattccatcattctccctaagtcaaactcattggtgttatac

SEQ ID NO: 200095 - DNA, 75 bp, Artificial Sequence
  Synthetic
agggacaatgtacgaatcagacttaatccattattagattatcccaattttattccaactgctacaactcctcat

SEQ ID NO: 200096 - DNA, 75 bp, Artificial Sequence
  Synthetic
tattccaactgctacaactcctcatggatgcattcgaattccatcattttccttaagtcaaactcattggtgtta

SEQ ID NO: 200097 - DNA, 75 bp, Artificial Sequence
  Synthetic
tcacaatacgatcttacggggatgtgaagatacagcatctagcaaacagtatgtatctctaggaaccttacagac

SEQ ID NO: 200098 - DNA, 75 bp, Artificial Sequence
  Synthetic
tactcacaacacaattttacagggatgtgcagatacagtatctagcaatcagtatgtatctcttggaaccttaca

SEQ ID NO: 200099 - DNA, 75 bp, Artificial Sequence
  Synthetic
cttagaaaatggtgatccttatttcaaggtcgagtacagtcattatttaaatgatagaaagaatcgaaaaagttg

SEQ ID NO: 200100 - DNA, 75 bp, Artificial Sequence
  Synthetic
gaccttagaaaatggtaatccttatttcaaggtcgagtatagtcattatttaaatgatgggaagaatcgaaagag

SEQ ID NO: 200101 - DNA, 75 bp, Artificial Sequence
  Synthetic
ctcagtggttgctgtccttgacggatgtttattgtattgtgtgatcatgaccaaaaatgaaacagagaatttcaa

SEQ ID NO: 200102 - DNA, 75 bp, Artificial Sequence
  Synthetic
ttcaaggtcgagtatagtcattatttaaatgatgggaagaatcgaaagagttgctcagtggttgctgtccttgac

SEQ ID NO: 200103 - DNA, 75 bp, Artificial Sequence
  Synthetic
caaggatcctcaattggcaacacaattacttacatatatatcatataatggtactatcaaagagcgtataataaa

SEQ ID NO: 200104 - DNA, 75 bp, Artificial Sequence
  Synthetic
gtactatcaaagagcgtataataaacccacccggatcatctagagattgggttcacatctcaccaggggtaggtt

SEQ ID NO: 200105 - DNA, 75 bp, Artificial Sequence
  Synthetic
gtattttgtattcaaattacatcatatttcccttatatggaggccttatggaaaattcaatgatatataataatc

SEQ ID NO: 200106 - DNA, 75 bp, Artificial Sequence
  Synthetic
aatcagggaaatattttttccctaattcaaccaagttgccatgtagtaataaaaccagtgaaaaaataacaggag

SEQ ID NO: 200107 - DNA, 75 bp, Artificial Sequence
  Synthetic
atcaatcagggaaatatttttatcctaattcaaccaagttaccatgtagtaatagaaccagtgaaaaaataaaag

SEQ ID NO: 200108 - DNA, 75 bp, Artificial Sequence
  Synthetic
caaaagactcatacacaataacttacttctctaagagacttatacagagtgcatttttgatttgtgatttaagac

SEQ ID NO: 200109 - DNA, 75 bp, Artificial Sequence
  Synthetic
aatttctttctgaagattgtgaaattttaattcctagcaatgatcacatgctagttggtgcagagggtcgcctat

SEQ ID NO: 200110 - DNA, 75 bp, Artificial Sequence
  Synthetic
ttacttctctaggagacttatacagagtgcatttttaatttgtgatttgagacaatttctttctgaagattgtga

SEQ ID NO: 200111 - DNA, 75 bp, Artificial Sequence
  Synthetic
ctagttggtgcagagggtcgcctatataatattgaaaataatatattttactatcagagaggatccagctggtgg

SEQ ID NO: 200112 - DNA, 75 bp, Artificial Sequence
  Synthetic
ccctatccaagcctttatagaatcaaattaaattctaataagaaatatcctagaataattgagatcaaatttaca

SEQ ID NO: 200113 - DNA, 75 bp, Artificial Sequence
  Synthetic
tggccatatccaagcctttatagaatcaaattaaatcctaataagaaatatcctagaataattgagatcgaattt

SEQ ID NO: 200114 - DNA, 75 bp, Artificial Sequence
  Synthetic
tagaataattgagatcaaatttacaaaaattgaaatagctccaagacctggcaataaagattgcccaggaaataa

SEQ ID NO: 200115 - DNA, 75 bp, Artificial Sequence
  Synthetic
acaaaaattgagatagctccaagacctggcaataaagattgcccgggaaataaagcttgcccaaaagaatgcata

SEQ ID NO: 200116 - DNA, 75 bp, Artificial Sequence
  Synthetic
taaagcttgcccaaaagaatgcataacaggagtttaccaagacatatggccactaagttatcctaatactgcgtt

SEQ ID NO: 200117 - DNA, 75 bp, Artificial Sequence
  Synthetic
taagttatcctaatactgcgttcccccacaaaaaacgagcgtactatacaggtttttatctcaataattcgcttg

SEQ ID NO: 200118 - DNA, 75 bp, Artificial Sequence
  Synthetic
cactaagttatcctaatactgcgtttccccacaaaaaacgagcgtattatacaggtttttatctcaataactcgc

SEQ ID NO: 200119 - DNA, 75 bp, Artificial Sequence
  Synthetic
cgagacgtaacccgacattttatactgctgacaatctagattaccatcaacaggaaagattgggtaaatttaatc

SEQ ID NO: 200120 - DNA, 75 bp, Artificial Sequence
  Synthetic
tccccacaaaaaacgagcgtattatacaggtttttatctcaataactcgcttgcgagacgtaacccgacatttta

SEQ ID NO: 200121 - DNA, 75 bp, Artificial Sequence
  Synthetic
ttactgctggatattccactacaacttgtttcaagcagactaccactgcaagattatactgcctttacatacttg

SEQ ID NO: 200122 - DNA, 75 bp, Artificial Sequence
  Synthetic
ttgtttcaagcagactaccactgcaagattatactgcctttacatacttgaggtgggtgactcagtaattggtga

SEQ ID NO: 200123 - DNA, 75 bp, Artificial Sequence
  Synthetic
ttttcagatttttccctttttacgctcaatagatcaggctatcacttaatcaataggattactctgtaacacaag

SEQ ID NO: 200124 - DNA, 75 bp, Artificial Sequence
  Synthetic
gcaagactatactgcctttacatacttgaggtgggtgactcagtcattggagattttcagatttttcccttttta

SEQ ID NO: 200125 - DNA, 75 bp, Artificial Sequence
  Synthetic
tcaatagatcaggctatcacttaatcaataggattactctgtaacacaagctgattttataaggtgaaatatgct

SEQ ID NO: 200126 - DNA, 75 bp, Artificial Sequence
  Synthetic
ctgattttataaggtgaaatatgctcatataaaatggtcaatggataaacaataataataatcattataacaaaa

SEQ ID NO: 200127 - DNA, 75 bp, Artificial Sequence
  Synthetic
ttaaaaggacaaaacaattacaagaacactatgaactaatcaggaaacaaacatagcattaactaacaacagcca

SEQ ID NO: 200128 - DNA, 75 bp, Artificial Sequence
  Synthetic
gctcgttaaaaatggttaatagacaaataataataataatcattgcaacaaaattaaaaggataaaataattata

SEQ ID NO: 200129 - DNA, 75 bp, Artificial Sequence
  Synthetic
aataataataataatcattgcaacaaaattaaaaggataaaataattataggaacactatgaaccaatcagaaaa

SEQ ID NO: 200130 - DNA, 75 bp, Artificial Sequence
  Synthetic
acatgaccaatgacactccatgaaacatcatccatcaataacaaaaagtataatctatcaattagaaccaaactt

SEQ ID NO: 200131 - DNA, 75 bp, Artificial Sequence
  Synthetic
caaacataacattaaccaacaacagctaacatgaccaatgacactccatgaaacatcacctatcaataataaaaa

SEQ ID NO: 200132 - DNA, 75 bp, Artificial Sequence
  Synthetic
gatctattctaagtaatctaccaagcgaaaacacacaccaagaatcaccagccatcaaatctgattaatccgaca

SEQ ID NO: 200133 - DNA, 75 bp, Artificial Sequence
  Synthetic
gtataatttatcaattagaaccaaatctgatccattctaggcagtccaccaagagaaaatacatatcaagaatta

SEQ ID NO: 200134 - DNA, 75 bp, Artificial Sequence
  Synthetic
caaaaatccaaacaaccaccggaacaggcccggtcctgataaacaacctgcccggccaccagcccactcaaaatc

SEQ ID NO: 200135 - DNA, 75 bp, Artificial Sequence
  Synthetic
ccaaccatcaagtctgatcaatccgacacaaaaatccaaacaaccgccagaataggcccggtcctgataaacaac

SEQ ID NO: 200136 - DNA, 75 bp, Artificial Sequence
  Synthetic
aggacacaatcaatttcaccccaatcatcagtttaatccgcaagtcaaacaagtccttccacatgcccagagatt

SEQ ID NO: 200137 - DNA, 75 bp, Artificial Sequence
  Synthetic
ctgcccggccaccagcctactcaacatcaagacacaatcattttcacctcaatcatcagtccaatccgtgagtta

SEQ ID NO: 200138 - DNA, 75 bp, Artificial Sequence
  Synthetic
caatcgatctgacacattgctatattttttaagaaaaaagaaaaatgagtgggtgagacattctagttctcatac

SEQ ID NO: 200139 - DNA, 75 bp, Artificial Sequence
  Synthetic
aacaagttcctccacgtgcccagcaatccaatcgatatgacacattgctatatcttttaagaaaaaagaaaattg

SEQ ID NO: 200140 - DNA, 75 bp, Artificial Sequence
  Synthetic
acagaataaacttcgaaccttggatgcagtatggatcaaaattgaagattgaagaactaggatgattccgcacac

SEQ ID NO: 200141 - DNA, 75 bp, Artificial Sequence
  Synthetic
agtgggtgagacattctagttctcatacacagaataaactttgaactttggatacattttggatcaaaattgaag

SEQ ID NO: 200142 - DNA, 75 bp, Artificial Sequence
  Synthetic
tacacagaataaactttgaactttggatacattttggatcaaaattgaagatttaagaactaggatgattccgca

SEQ ID NO: 200143 - DNA, 75 bp, Artificial Sequence
  Synthetic
taacagacaagcaatgaggaataaaaagaatagacaattgcccaagaggaatgacacaaagcatccaacactagg

SEQ ID NO: 200144 - DNA, 75 bp, Artificial Sequence
  Synthetic
cactagtagacaagcaatgaggaacaaaaagaatagacaattgcctgggaggaacgacacaaagcatccaacact

SEQ ID NO: 200145 - DNA, 75 bp, Artificial Sequence
  Synthetic
atgacacaaagcatccaacactaggggggaagagaccacctccaagatggctgatcatactgatgtcctattgcc

SEQ ID NO: 200146 - DNA, 75 bp, Artificial Sequence
  Synthetic
agaggtgcatctgagttcccccattgtacgtcacaaactcatttattatatactattaggaaatttaccaaatca

SEQ ID NO: 200147 - DNA, 75 bp, Artificial Sequence
  Synthetic
agggggaaagagaccacctccaagatggctgaccatactgatgtcctattgccagaggtgcatctgagttccccc

SEQ ID NO: 200148 - DNA, 75 bp, Artificial Sequence
  Synthetic
aataagtcctgaagatcttggacctttatctacaattaattggagccaagttagaagagaagaaagcaaattatg

SEQ ID NO: 200149 - DNA, 75 bp, Artificial Sequence
  Synthetic
aatcttttaaaacatataccctcattgagagagatagatccaacacgtcagtgtaaaaatttgtattggccacga

SEQ ID NO: 200150 - DNA, 75 bp, Artificial Sequence
  Synthetic
aataatcttttaaaacatataccctcattgagagagatagacccaacacgtcagtgtaaaaatctgtattggcca

SEQ ID NO: 200151 - DNA, 75 bp, Artificial Sequence
  Synthetic
cctcttcagttttttaaggatttggatttcaaccaatttaaagggaaaattgaaagatgggaaaaaattcaacac

SEQ ID NO: 200152 - DNA, 75 bp, Artificial Sequence
  Synthetic
cattgagagagatagacccaacacgtcagtgtaaaaatctgtattggccacgacctcttcagttttttaaggatt

SEQ ID NO: 200153 - DNA, 75 bp, Artificial Sequence
  Synthetic
gctacacagcttgtagttaataagagaattatgaattttttagatttaattagtgataaattaatatcaaggaaa

SEQ ID NO: 200154 - DNA, 75 bp, Artificial Sequence
  Synthetic
tagtgataaattaatatcaaggaaagacttatttacaagtgctaggtgcagacacgaaggtcatgatagagattc

SEQ ID NO: 200155 - DNA, 75 bp, Artificial Sequence
  Synthetic
aagattaagagaactagttgatattgaatcgaactggaacaagaatcattggtcaaacactacaaatcttttctt

SEQ ID NO: 200156 - DNA, 75 bp, Artificial Sequence
  Synthetic
gaatcgaactggaacaagaatcattggtcaaacactacaaatcttttcttattaataaaatatcaaatgagactg

SEQ ID NO: 200157 - DNA, 75 bp, Artificial Sequence
  Synthetic
attaataaaatatcaaatgagactgttaatttgtcaaatgaaaaaatctcaaactggtcttcttgaggtcaagtt

SEQ ID NO: 200158 - DNA, 75 bp, Artificial Sequence
  Synthetic
attgaatcgagctggaacaagaatcattggtcaaacactacaaatcttttcttattaataaaatatcagatgaga

SEQ ID NO: 200159 - DNA, 75 bp, Artificial Sequence
  Synthetic
ggaagatagatcaggtttaattataattactcccgaattagtgtgtatttatttctataaagcaaatgtattaag

SEQ ID NO: 200160 - DNA, 75 bp, Artificial Sequence
  Synthetic
gttggaagatagatcaggcttaattataattactcccgagctagtgtgtatttatttccataaagcaaatgtatt

SEQ ID NO: 200161 - DNA, 75 bp, Artificial Sequence
  Synthetic
ctatttcacatttgaaatgatcctcatgatttctgatgtatttgaaggaagacaaaatgtcataggattatgttc

SEQ ID NO: 200162 - DNA, 75 bp, Artificial Sequence
  Synthetic
tttatttccataaagcaaatgtattaagctatttcacatttgaaatgatccttatgatttctgatgtatttgaag

SEQ ID NO: 200163 - DNA, 75 bp, Artificial Sequence
  Synthetic
atgatttctgatgtatttgaaggaagacaaaatgtcataggattatgttcagtcagttattacttatctcctcta

SEQ ID NO: 200164 - DNA, 75 bp, Artificial Sequence
  Synthetic
attatgtagataatttagcactgattctaggaaataaggtttattcaataatcgctaatttagaaagcttagttt

SEQ ID NO: 200165 - DNA, 75 bp, Artificial Sequence
  Synthetic
ctaaaggatagaataaatgacttgcttaattatgtagataatttagcactgattctaggaaataaggtttattca

SEQ ID NO: 200166 - DNA, 75 bp, Artificial Sequence
  Synthetic
tctaggaaataaggtttattcaataatcgctaatttagaaagcttagtttatgctaaattacaattgaaggatcc

SEQ ID NO: 200167 - DNA, 75 bp, Artificial Sequence
  Synthetic
agttttagaagttagaggtcaattccattgttttatactagaagagattatggagatcttacatgatgttttctc

SEQ ID NO: 200168 - DNA, 75 bp, Artificial Sequence
  Synthetic
tccagttttagaagttagaggtcaattccattgtttcatactggaggagattatggagattttacatgatgtttt

SEQ ID NO: 200169 - DNA, 75 bp, Artificial Sequence
  Synthetic
agttgatgagagtgctcaagtgtgttctatactgtcatcttttcttagtggtctgtctcctgaccttactgcaga

SEQ ID NO: 200170 - DNA, 75 bp, Artificial Sequence
  Synthetic
ttatggagattttacatgatgttttctcagttgatgagagtgctcaagtgtgttctatactatcttcttttctta

SEQ ID NO: 200171 - DNA, 75 bp, Artificial Sequence
  Synthetic
attgttatgtattatgagaatgtggggtcatcccactttaacagctgcaggtgcagcggggaaagtacgtgaatc

SEQ ID NO: 200172 - DNA, 75 bp, Artificial Sequence
  Synthetic
gtggtctgtcacctgaccttactgcagagttgttatgtattatgagaatgtggggtcatcccactttaacagctg

SEQ ID NO: 200173 - DNA, 75 bp, Artificial Sequence
  Synthetic
tatgtgtgcaccaaagctactagactttacaacaattatgaaaacattatcattctttcacaccatacttataaa

SEQ ID NO: 200174 - DNA, 75 bp, Artificial Sequence
  Synthetic
tggggtcatcccactttaacagctgcaggtgcagcagggaaagtacgcgaatctatgtgtgcaccaaagctacta

SEQ ID NO: 200175 - DNA, 75 bp, Artificial Sequence
  Synthetic
tgggtacagaagaaagcatggtgggatctggccaactgtgacgttaattgatggtaccccaaattttattgtcag

SEQ ID NO: 200176 - DNA, 75 bp, Artificial Sequence
  Synthetic
tctaaaaaatgataatgcagaaataatttatgaagtggcattgaaatactggaaatggatatcactgattgaatt

SEQ ID NO: 200177 - DNA, 75 bp, Artificial Sequence
  Synthetic
ggtgaggatttaagtatattcatgaaggataaagcaataagttgtaataagaaggattggatgagtgtattcaga

SEQ ID NO: 200178 - DNA, 75 bp, Artificial Sequence
  Synthetic
actggaaatggatatcactgattgaatttgaaaaatgtttttcagctgatccaggtgaggatttaagtatattca

SEQ ID NO: 200179 - DNA, 75 bp, Artificial Sequence
  Synthetic
caaagaataatttagaatgtccatcaaatgtaaatagaagattgttattaaatttcttaaatgactcaaatttcg

SEQ ID NO: 200180 - DNA, 75 bp, Artificial Sequence
  Synthetic
taagaaagattggatgagtgtattcagacgaagtcttatacatgagagatgtgcaaagaataatttggaatgtcc

SEQ ID NO: 200181 - DNA, 75 bp, Artificial Sequence
  Synthetic
atcaaatgtaaatagaagattgttattaaatttcttaaatgactcaaatttcgatccaaatctagaattagagta

SEQ ID NO: 200182 - DNA, 75 bp, Artificial Sequence
  Synthetic
ttaaatttcttaaatgactcaaatttcgatccaaatctagaattagagtatgtaactaccctccagtatctaact

SEQ ID NO: 200183 - DNA, 75 bp, Artificial Sequence
  Synthetic
gatgataaattttgtgcttcatactctttgaaagaaaaggagataaaagaaactgggagaatatttgcaaagctt

SEQ ID NO: 200184 - DNA, 75 bp, Artificial Sequence
  Synthetic
aagcaaatgagatcgtgtcaagtgataacagaatcaatgcttgctaatcatgcagggaaattattcagagaaaac

SEQ ID NO: 200185 - DNA, 75 bp, Artificial Sequence
  Synthetic
taacagaatcaatgcttgctaatcatgcagggaaattattcagagaaaacggtgtagttcttgatcagcttaagt

SEQ ID NO: 200186 - DNA, 75 bp, Artificial Sequence
  Synthetic
ggtgtagttcttgatcagcttaagttaacaaaatcactcctaactatgagccaaattgggatcatttcaaacaag

SEQ ID NO: 200187 - DNA, 75 bp, Artificial Sequence
  Synthetic
gagcgtaaagctacaaaggactctatgacaatcctaaaagacattaagaagaataaaaacatacataaagaaaat

SEQ ID NO: 200188 - DNA, 75 bp, Artificial Sequence
  Synthetic
tgacaatcctaaaagacattaagaagaataaaaacatacataaagaaaatgaaaagaaatatggttcagagaatt

SEQ ID NO: 200189 - DNA, 75 bp, Artificial Sequence
  Synthetic
caacccctttcggagactttgggaaaaattttggaataaatactcctgatgattcattagaaatagctgcatgtt

SEQ ID NO: 200190 - DNA, 75 bp, Artificial Sequence
  Synthetic
ttttaacaacagatttacaaaagtattgtcttaattggagataccaagcaataataccctttgctagaacattaa

SEQ ID NO: 200191 - DNA, 75 bp, Artificial Sequence
  Synthetic
gtttcttaacaacagatttacaaaaatattgtcttaattggagataccaagcaataataccctttgctagaacac

SEQ ID NO: 200192 - DNA, 75 bp, Artificial Sequence
  Synthetic
atgaaatcaactttgtatgtaggtgacccgttcaatcctccatcagatcataatgtgactgacctagataatgca

SEQ ID NO: 200193 - DNA, 75 bp, Artificial Sequence
  Synthetic
taaatcgaatgtacggatatcctcatctcttcgaatggattcatttaagattaatgaaatcaactttgtatgtag

SEQ ID NO: 200194 - DNA, 75 bp, Artificial Sequence
  Synthetic
ccaaatgatgatatatttattgtttcaccaagaggaggtatagaaggtctgtgccaaaaattatggactatgatc

SEQ ID NO: 200195 - DNA, 75 bp, Artificial Sequence
  Synthetic
tcaattgctactatattattgtcatccgcagaatctaagaccagagtaatgagtatggtccagggagataaccaa

SEQ ID NO: 200196 - DNA, 75 bp, Artificial Sequence
  Synthetic
catctgcagaatctaagaccagagtaatgagtatggtccagggagataatcaaacaattgcaataactacaaaag

SEQ ID NO: 200197 - DNA, 75 bp, Artificial Sequence
  Synthetic
acaattgcaataactacaaaagtgccaaggagtatgcctcataaagagaagaagcaatcagcctataacgcgagt

SEQ ID NO: 200198 - DNA, 75 bp, Artificial Sequence
  Synthetic
aaagaattcttttctagattaaagcaaaataattatgggattggacataatttgaaagaacaagaaactatatta

SEQ ID NO: 200199 - DNA, 75 bp, Artificial Sequence
  Synthetic
tcatccgatttttttgtatatggtaaaagaattttttggagagggagaatactcagccaagcacttaaaaatgct

SEQ ID NO: 200200 - DNA, 75 bp, Artificial Sequence
  Synthetic
actcagccaagcacttaaaaatgctagcaaattatgtttgacagctgatattcttggtgattgtactcaatcttc

SEQ ID NO: 200201 - DNA, 75 bp, Artificial Sequence
  Synthetic
ttgttccaatttggcaacaacaataatgagattaactgaaaatggacttgaaaaggatgtagcaataagactaaa

SEQ ID NO: 200202 - DNA, 75 bp, Artificial Sequence
  Synthetic
atgagattaactgaaaatggacttgaaaaggatgtagcaataagactaaatatattcatggctattagacaacta

SEQ ID NO: 200203 - DNA, 75 bp, Artificial Sequence
  Synthetic
tatattcatggctattagacaactaacttttgatttgattttccccatgaatacaaacaatgcatcaaacatttc

SEQ ID NO: 200204 - DNA, 75 bp, Artificial Sequence
  Synthetic
atacaaacaatgcatcaaacatttctgacatatacctgaaccatccagatttactggcaaggatttgtcttatcc

SEQ ID NO: 200205 - DNA, 75 bp, Artificial Sequence
  Synthetic
cgtctcaagttggtgggttaaattatctatcatctagtcgattattcaatagaaacataggtgacccactagtgt

SEQ ID NO: 200206 - DNA, 75 bp, Artificial Sequence
  Synthetic
ttctgacatatatctaaaccatccagatttactggcaagaatttgtcttattccgtctcaagttggtgggttaaa

SEQ ID NO: 200207 - DNA, 75 bp, Artificial Sequence
  Synthetic
ctgcatttgcagatattaaaagattaataatggctaaatgtattgagccttgggtattgacaaatatcatgagac

SEQ ID NO: 200208 - DNA, 75 bp, Artificial Sequence
  Synthetic
aataatggctaaatgtattgagccttgggtattgacaaatatcatgagacgaccacctggagatggaaattggag

SEQ ID NO: 200209 - DNA, 75 bp, Artificial Sequence
  Synthetic
gaccacctggagatggaaattggagtacgctagcagcagatccttatgcagttaacattgactatctatacccac

SEQ ID NO: 200210 - DNA, 75 bp, Artificial Sequence
  Synthetic
ccagcagacattgatggaatcaagtgtgaatccacttcttaatgggatattcaatccaaatgcaaaagcagaaga

SEQ ID NO: 200211 - DNA, 75 bp, Artificial Sequence
  Synthetic
caccaactatatttcttaagcgacatgcccagcagacattgatggaatcaagtgtgaatccacttcttaatggga

SEQ ID NO: 200212 - DNA, 75 bp, Artificial Sequence
  Synthetic
gtgaatccacttcttaatgggatattcaatccaaatgcaaaagcagaagaaaataatttagcccaattccttctc

SEQ ID NO: 200213 - DNA, 75 bp, Artificial Sequence
  Synthetic
aggttgtgggagaaggaagcagattcaaggatatctagattccacacggactatagtaaaattagccttagatat

SEQ ID NO: 200214 - DNA, 75 bp, Artificial Sequence
  Synthetic
aacaggttgtgggagaagaaagcagattcaaggatatctagattccacacggactatagtaaaattagccttaga

SEQ ID NO: 200215 - DNA, 75 bp, Artificial Sequence
  Synthetic
aaagcccttatctttcagaaaaacaaaccaagtattagactacaatttaaattacttatcttatcagcttgatat

SEQ ID NO: 200216 - DNA, 75 bp, Artificial Sequence
  Synthetic
aaccaagtattagactacaatttaaattacttatcttatcagcttgatatcatacttaaaccgaaatcgggaaag

SEQ ID NO: 200217 - DNA, 75 bp, Artificial Sequence
  Synthetic
gattcttggagcttggataacattaatgattgtagtatagatttagcaagaaatttaagaaagctatcatgggct

SEQ ID NO: 200218 - DNA, 75 bp, Artificial Sequence
  Synthetic
taaattacttatcttatcagcttgatatcatacttaaaccgaaatcgggaaatgattcctggagcttggataaca

SEQ ID NO: 200219 - DNA, 75 bp, Artificial Sequence
  Synthetic
agagttactagatggagtcttgttaacaaataaatctttgtgtcaacaatgtgcatcaggtaatgataagtttac

SEQ ID NO: 200220 - DNA, 75 bp, Artificial Sequence
  Synthetic
acaaataaatctttgtgtcaacaatgtgcatcaggtaatgataagtttacttggctttatttgccgggtggtatt

SEQ ID NO: 200221 - DNA, 75 bp, Artificial Sequence
  Synthetic
ttaacaaataaatctttgtgtcatcaatgtgcatcaggaaatgacaagtttacctggctttatttgccgggtggc

SEQ ID NO: 200222 - DNA, 75 bp, Artificial Sequence
  Synthetic
atccacctatgagagttccatatattggttcgaaaacagatgaacgaagaattgcatcattggcccaaataccag

SEQ ID NO: 200223 - DNA, 75 bp, Artificial Sequence
  Synthetic
attcaaatagatcttgagccaagccaaaatccacctatgagagttccatatattggttcaaaaacagatgaacga

SEQ ID NO: 200224 - DNA, 75 bp, Artificial Sequence
  Synthetic
tttaaggctaactggcgtatatatttgggcttttggtgataatgaacagaattggcaagatgcatacgaactgtc

SEQ ID NO: 200225 - DNA, 75 bp, Artificial Sequence
  Synthetic
agaattgcatcattggcccaaataccaggtgcttctcaaaatctaaagtcagttttaaggctaactggcgtatat

SEQ ID NO: 200226 - DNA, 75 bp, Artificial Sequence
  Synthetic
tgggcttttggtgataatgaacagaattggcaagatgcatacgaactgtctaagacacgtgtaaatataacttta

SEQ ID NO: 200227 - DNA, 75 bp, Artificial Sequence
  Synthetic
gatcagctcagagtactaactcctctacctacttcagcaaatttgacccatcggctagatgacggagtaactcag

SEQ ID NO: 200228 - DNA, 75 bp, Artificial Sequence
  Synthetic
gtctaagacacgtgtaaatataactctagatcagctcagagtactaactcctttacctacttcagcaaatttgac

SEQ ID NO: 200229 - DNA, 75 bp, Artificial Sequence
  Synthetic
ttctaatgatcgccaagtgctacaaattgatgaatgcaatgtggattcaaatctaatctatcagcagattatgat

SEQ ID NO: 200230 - DNA, 75 bp, Artificial Sequence
  Synthetic
attgatgaatgcaatgtggattcaaatctaatctatcagcagattatgataacaggattaggtattattgagaca

SEQ ID NO: 200231 - DNA, 75 bp, Artificial Sequence
  Synthetic
atctaatctatcagcagattatgataacaggattaggtattattgagacatggaatgcattgcctattaagcata

SEQ ID NO: 200232 - DNA, 75 bp, Artificial Sequence
  Synthetic
tggaatgcattgcctattaagcatactgtacatgaagtaactttacatttgcacactgcagcttcgtgttgtata

SEQ ID NO: 200233 - DNA, 75 bp, Artificial Sequence
  Synthetic
ctgtacatgaagtaactttacatttgcacactgcagcttcgtgttgtataagacctgttgattcttgccttgtaa

SEQ ID NO: 200234 - DNA, 75 bp, Artificial Sequence
  Synthetic
ataattccagacaagatctaccttatttagaggatactactattaacaagtttatttacgatgatcaacccatcc

SEQ ID NO: 200235 - DNA, 75 bp, Artificial Sequence
  Synthetic
tcccagaagaaaaatcaagcttaatagaacaattcatagttaatgttaatgtgggtgattttgaattcaatgata

SEQ ID NO: 200236 - DNA, 75 bp, Artificial Sequence
  Synthetic
agaacaattcatagttaatgttaatgtgggtgattttgaattcaatgatactcaaaatagtattgtattattatc

SEQ ID NO: 200237 - DNA, 75 bp, Artificial Sequence
  Synthetic
ggtgattttgagttcaatgatacccaaaattgtattgtattattatcacagctaatgggaaaaattgttgttgat

SEQ ID NO: 200238 - DNA, 75 bp, Artificial Sequence
  Synthetic
gtgggtgattttgaattcaatgatactcaaaatagtattgtattattatcacagctaatgggaaaaattgttgtt

SEQ ID NO: 200239 - DNA, 75 bp, Artificial Sequence
  Synthetic
caacatcaattatcaatgatgcaatcatagagactgattattcccataattggatcagtgaattcctaaatacct

SEQ ID NO: 200240 - DNA, 75 bp, Artificial Sequence
  Synthetic
tggatcaggtattcatatatattggggggaatatcttattagaattatcatatcaaatgtattacttaagaatta

SEQ ID NO: 200241 - DNA, 75 bp, Artificial Sequence
  Synthetic
acttggaccaggtattcatatatattggatggaacatcttattagaattatcatatcaaatgtattacttaagga

SEQ ID NO: 200242 - DNA, 75 bp, Artificial Sequence
  Synthetic
ttattggattaatgaatttattagattatattgaattaacattacagaggatacctgggttatcaatacagaatt

SEQ ID NO: 200243 - DNA, 75 bp, Artificial Sequence
  Synthetic
cctgggttatcaatacagaatttggcctctacaataagtcatccgaaaattttaagaagaatgattaatttagga

SEQ ID NO: 200244 - DNA, 75 bp, Artificial Sequence
  Synthetic
atacctgggttatcaatacagaatttggcctctacaataagtcatccaaaaattttaagaagaatgattaattta

SEQ ID NO: 200245 - DNA, 75 bp, Artificial Sequence
  Synthetic
atttgtatcccaagtaattccccgcaatttgcaacactcaactttacaaagatagctgtgcaatgtcttatgtgg

SEQ ID NO: 200246 - DNA, 75 bp, Artificial Sequence
  Synthetic
ggaatttgtatcccaagcaattccccgcaatttgcaacgcttaactttacaaaaatagctgtgcaatgtctcatg

SEQ ID NO: 200247 - DNA, 75 bp, Artificial Sequence
  Synthetic
ggtgttaaaaccgcattaacgaacctttataatcatatatcattcaaaatattaatccactcagaagatgcaata

SEQ ID NO: 200248 - DNA, 75 bp, Artificial Sequence
  Synthetic
tggggcgttaaaaccgcattaacaaacctttataatcatatatcattcaaaatattaatccactcagaagatgcg

SEQ ID NO: 200249 - DNA, 75 bp, Artificial Sequence
  Synthetic
gatttgaatgatagaatatataattttgctgcaagaaagctaacattaattgcaatgctatatgattttgaatgt

SEQ ID NO: 200250 - DNA, 75 bp, Artificial Sequence
  Synthetic
acctttataatcatatatcattcaaaatattaatccactcagaagatgcgatagatttaaatgatagaatatata

SEQ ID NO: 200251 - DNA, 75 bp, Artificial Sequence
  Synthetic
ttgctgcaagaaagctaacattaattgcaatgctatatgattttgaatgtaatttaccaaaattgaagggtctta

SEQ ID NO: 200252 - DNA, 75 bp, Artificial Sequence
  Synthetic
aatttaccaaaattgaagggtcttactgcagaggacaaatgttgcatattgactgaatttttattgagtgaaaca

SEQ ID NO: 200253 - DNA, 75 bp, Artificial Sequence
  Synthetic
attgactgaatttttattgagtgaaacatgtttagccaatttatcaatccaacacaatgaatcatatatcaatca

SEQ ID NO: 200254 - DNA, 75 bp, Artificial Sequence
  Synthetic
aacaaacccaaatatacatccttatccatgtaacagctattatttatctagaaaagcattgaattacataagatc

SEQ ID NO: 200255 - DNA, 75 bp, Artificial Sequence
  Synthetic
aacacaatgaatcatatatcaatcaagtaacaaacccaaatatacatccttatccatgtaacagctattatttat

SEQ ID NO: 200256 - DNA, 75 bp, Artificial Sequence
  Synthetic
aaggaatgattcagagttcttcttaaagaattattatgatgattatggatttgttgatactcctacagatttttt

SEQ ID NO: 200257 - DNA, 75 bp, Artificial Sequence
  Synthetic
gatttgttgatactcctacagattttttacaattaaaaagtagagagaacaatgatacactattaacaaatgaca

SEQ ID NO: 200258 - DNA, 75 bp, Artificial Sequence
  Synthetic
gatacactattaacaaatgacattataattgaattacttaatcattcccaaaagcttgaaaggcatgaaatacct

SEQ ID NO: 200259 - DNA, 75 bp, Artificial Sequence
  Synthetic
aatgatacactattaacaaatgacattgtaattgaattacttaatcattctcaaaagattgaaaggcatgaaata

SEQ ID NO: 200260 - DNA, 75 bp, Artificial Sequence
  Synthetic
cctttccaggaatcatctattactgatcgagaaaattactatccagatcctcctgtacatcatatacttaggcca

SEQ ID NO: 200261 - DNA, 75 bp, Artificial Sequence
  Synthetic
tgtacatcatatacttaggccattgggcttgacatccacttcatggtataaatcattgagtataattaaattctt

SEQ ID NO: 200262 - DNA, 75 bp, Artificial Sequence
  Synthetic
tcctgtacatcatatacttaggccattgggcttgacatccacctcatggtataaatcattgagtataattaaatt

SEQ ID NO: 200263 - DNA, 75 bp, Artificial Sequence
  Synthetic
aggaatgattcagatacctgatggatcccatttatacttagctgaaggcagtggtgcttctatgacattgattga

SEQ ID NO: 200264 - DNA, 75 bp, Artificial Sequence
  Synthetic
cttgggaatgattcagatacctgatggatcccatttatacttggctgaaggcagtggcgcttctatgacattgat

SEQ ID NO: 200265 - DNA, 75 bp, Artificial Sequence
  Synthetic
aaacttttatcctggaagaaagatatattataatagctattactcgagtgagttaaacccaccccagaggaattt

SEQ ID NO: 200266 - DNA, 75 bp, Artificial Sequence
  Synthetic
agaaaacttttatcctgggagaaagatatactataatagctattactcgagtgaattaaatccacctcagaggaa

SEQ ID NO: 200267 - DNA, 75 bp, Artificial Sequence
  Synthetic
tgaacctctccccacacaatttattgagagtgtgccgtacaaacagatccaggcagaaatagagtgtcatttggg

SEQ ID NO: 200268 - DNA, 75 bp, Artificial Sequence
  Synthetic
atatactataatagctattactcgagtgaattaaatccacctcagaggaattttgaacctctccccacacaattt

SEQ ID NO: 200269 - DNA, 75 bp, Artificial Sequence
  Synthetic
atttgtacaagagtacaaatgcttatggaacggtgtcactgaaactactgatttatcaattactagctgtactga

SEQ ID NO: 200270 - DNA, 75 bp, Artificial Sequence
  Synthetic
tccaggcagaaatagagtgtcatttgggatttgtacaagagtataaatgcttgtggaacggtgtcactgaaacta

SEQ ID NO: 200271 - DNA, 75 bp, Artificial Sequence
  Synthetic
attcattattaattctattggagtagattcagtaacattaattcattgtgatttagaagagggatttgatactcc

SEQ ID NO: 200272 - DNA, 75 bp, Artificial Sequence
  Synthetic
ccaagaagaaatatcatcagccatcatccatgtattacaaataacttgcagctgtcttaaaaaagacgggttatt

SEQ ID NO: 200273 - DNA, 75 bp, Artificial Sequence
  Synthetic
gtgatttagaagagggatttgatactccccaggaagaaatatcatcagctatcatccatgtgttacaaataactt

SEQ ID NO: 200274 - DNA, 75 bp, Artificial Sequence
  Synthetic
atccatgtattacaaataacttgcagctgtcttaaaaaagacgggttattactcttaaagacaagttgggtaccc

SEQ ID NO: 200275 - DNA, 75 bp, Artificial Sequence
  Synthetic
ctatatgctggacgttttcatctcaaattatactcataagaagtgcatatagtgacccctctagtcatgaagttt

SEQ ID NO: 200276 - DNA, 75 bp, Artificial Sequence
  Synthetic
agtgacccctctagtcatgaagtttatctagtttgcaaaagatcagaggatggctggttttctgacttaagaact

SEQ ID NO: 200277 - DNA, 75 bp, Artificial Sequence
  Synthetic
tatagtgacccctctagtcatgaagtttacttagtttgcagaagatcagaggatggctggttttctgacttaaga

SEQ ID NO: 200278 - DNA, 75 bp, Artificial Sequence
  Synthetic
catcacgtcatctgatcctcaatactttttatctgataatcaaaagatcctacaagcaggtggatcccttagctg

SEQ ID NO: 200279 - DNA, 75 bp, Artificial Sequence
  Synthetic
tacaagcaggtggatcccttagctgtcagcaatggtataatatcacaaatttcaattctcttgtaaatttgtaca

SEQ ID NO: 200280 - DNA, 75 bp, Artificial Sequence
  Synthetic
atactgaaaagtgagggagatgaatatctaagcttagtatggtctccatacaatattggagctcaaggaaaaatc

SEQ ID NO: 200281 - DNA, 75 bp, Artificial Sequence
  Synthetic
actatattacgattattatcagaaaaagtgatgctatatattgttaaaaattggaaattaattgattatcatgca

SEQ ID NO: 200282 - DNA, 75 bp, Artificial Sequence
  Synthetic
atctaagcttagtatggtctccatacaatattggagctcaaggaaaaatcaatactatattacgattattatcag

SEQ ID NO: 200283 - DNA, 75 bp, Artificial Sequence
  Synthetic
aatgtggtgagtttgatgctggctgcttttttaaaccagacttgttgtataaatatactccaaatccacgatatc

SEQ ID NO: 200284 - DNA, 75 bp, Artificial Sequence
  Synthetic
ttcgcaaaacaatttcaaataatgtattaattgaattgattactgtaaaaatggtactaaaactatctcgaccaa

SEQ ID NO: 200285 - DNA, 75 bp, Artificial Sequence
  Synthetic
atcttcgcaagacaatttcaaataatgtattagttgaattgattactgtaaaaatgatactaaaactatctcgac

SEQ ID NO: 200286 - DNA, 75 bp, Artificial Sequence
  Synthetic
aacaaaaacaaatttggaaattattgggatgtactcttttcgttggaatacaagatgaatctttagaaatggatg

SEQ ID NO: 200287 - DNA, 75 bp, Artificial Sequence
  Synthetic
caaaacaaaaacaaatttggaaattattgggatgtaccctcttcgttggaatacaagatgaatctttagaaatga

SEQ ID NO: 200288 - DNA, 75 bp, Artificial Sequence
  Synthetic
agcaagtagtcgatagtaatctaaatgaatatgtccagtttaatgattcaaacgaagagagggatgtttttggtg

SEQ ID NO: 200289 - DNA, 75 bp, Artificial Sequence
  Synthetic
tgaatatgtccagtttaatgattcaaacgaagagagggatgtttttggtgatatattatagtaaatttaatgcag

SEQ ID NO: 200290 - DNA, 75 bp, Artificial Sequence
  Synthetic
caagatgaatctttagaaatggatgagcaagtagtcgatagtaatctaaatgaatatgtccagtttaatgattca

SEQ ID NO: 200291 - DNA, 75 bp, Artificial Sequence
  Synthetic
atatattatagtaaatttaatgcagatttaacaattaatgatgaataccatgcaggatatttacatcaaatgaac

SEQ ID NO: 200292 - DNA, 75 bp, Artificial Sequence
  Synthetic
tcctcattaaattattataacaagggaaaaatttttaaaaaccattattcaacttacatcgatgatagcatctct

SEQ ID NO: 200293 - DNA, 75 bp, Artificial Sequence
  Synthetic
cagatttgacgattaatgatgaatatcatgcacgatatttacatcaaatgagctcctcatttaattattataact

SEQ ID NO: 200294 - DNA, 75 bp, Artificial Sequence
  Synthetic
ctaacttattattgatttcctgataaaagacaataaaatatatcatcaagaggcaacgatctcaataaacaacat

SEQ ID NO: 200295 - DNA, 75 bp, Artificial Sequence
  Synthetic
agaaaaaaatttttaaaaactatttttcaacttgcattgatgatagcatctctctaatttatcattgatatcctg

SEQ ID NO: 200296 - DNA, 75 bp, Artificial Sequence
  Synthetic
acaaaagacaataaaatatatcatcaagaggcaacgatctcaataaacaacatttctaatagaactatagaaaga

SEQ ID NO: 200297 - DNA, 75 bp, Artificial Sequence
  Synthetic
ttctagtagaactataggaaaatacatagacgagacaatatcctcactggacaaatctggataagaggattaagg

SEQ ID NO: 200298 - DNA, 75 bp, Artificial Sequence
  Synthetic
tacggagacgagacaacatcctcactagacaaatctggataagaggactaaggccaacaccaaatatacaatcca

SEQ ID NO: 200299 - DNA, 75 bp, Artificial Sequence
  Synthetic
ataagaggattaaggccaacaccagatatacaatccagaggatgcagtcaaataaataagaatgggaacaaaaat

SEQ ID NO: 200300 - DNA, 75 bp, Artificial Sequence
  Synthetic
ttaatctaaaaaattaaaaatatctaatataggtccggaaaggttgtaaatcgaggacgatagcgatagcaagtt

SEQ ID NO: 200301 - DNA, 75 bp, Artificial Sequence
  Synthetic
gaaaatgcagtcaaatagataagaatgggaacaaaaatgttgaaaaatcagctctacttacacccaacaacccct

SEQ ID NO: 200302 - DNA, 75 bp, Artificial Sequence
  Synthetic
tcgaggacgatagcgatagcaagttgtcctaagttaacaatcaatccggaccttaaataaagtagctcattaata

SEQ ID NO: 200303 - DNA, 75 bp, Artificial Sequence
  Synthetic
gtcctaagttaacaatcaatccggaccttaaataaagtagctcattaataatccatcatgtcttcagttttagct

SEQ ID NO: 200304 - DNA, 75 bp, Artificial Sequence
  Synthetic
aataaaaccctcgatctcattcgatatcggtttctcaaaaaaatgtttaataaaaaatatcaaacacatttaaat

SEQ ID NO: 200305 - DNA, 75 bp, Artificial Sequence
  Synthetic
accaaggggagaagagatatagatattaatctaaaaaattaaaaatatctaatataggtccggaaaggttgtaaa

SEQ ID NO: 200306 - DNA, 75 bp, Artificial Sequence
  Synthetic
aaaaaaatgtttaataaaaaatatcaaacacatttaaatttaaagaaaacttttcttatctattctccccttggt

SEQ ID NO: 200307 - DNA, 75 bp, Artificial Sequence
  Synthetic
accaaggggagaagagatatagatattgatctgaagaattgagaatatctaatgtaggtccggaaagacctttaa

SEQ ID NO: 200308 - DNA, 75 bp, Artificial Sequence
  Synthetic
ttgatctgaagaattgagaatatctaatgtaggtccggaaagacctttaataaagtagcttatcaatatatcatc

SEQ ID NO: 200309 - DNA, 75 bp, Artificial Sequence
  Synthetic
gcttacgaacagtttcttcaaacaactgaagatcggagtttcggtgatcaacaatttgtgcaatctgatacttta

SEQ ID NO: 200310 - DNA, 75 bp, Artificial Sequence
  Synthetic
attcactctaatgaatttttgtctccggcttgctgtatcatcatctgccaaatcggcgattaagcaaggggcatt

SEQ ID NO: 200311 - DNA, 75 bp, Artificial Sequence
  Synthetic
cggcttgctgtatcatcatctgccaaatcggcgattaagcaaggggcattattatctctgctttccttgcaggcc

SEQ ID NO: 200312 - DNA, 75 bp, Artificial Sequence
  Synthetic
aaacgatccacagcaaagattcacattgatgaatttttgcctccgacttgccgtatcatcatctgccaaatcggc

SEQ ID NO: 200313 - DNA, 75 bp, Artificial Sequence
  Synthetic
ttgctgccagagctccagatgctgctcttaggatcattgaagttgatgcaatagacccgcaggattatacattaa

SEQ ID NO: 200314 - DNA, 75 bp, Artificial Sequence
  Synthetic
ccgtatcatcatctgccaaatcggcaattaaacagggagcattattatctctgctttccttacaggccacatcaa

SEQ ID NO: 200315 - DNA, 75 bp, Artificial Sequence
  Synthetic
ccattaatccaagatctggctgggatgacatcaagatcagagcttatagagcattagccagggatttgcctatca

SEQ ID NO: 200316 - DNA, 75 bp, Artificial Sequence
  Synthetic
tgacatcaagatcagagcttatagagcattagccagggatttgcctatcagcttagctgataggacagtatttgt

SEQ ID NO: 200317 - DNA, 75 bp, Artificial Sequence
  Synthetic
ataggatattcagtgtattaatacaagtttggataatggtgtgtaaatgcatgacagcttatgatcaacccactg

SEQ ID NO: 200318 - DNA, 75 bp, Artificial Sequence
  Synthetic
aagatcagagcttatagggcattatccagagatttgcctatcagcctagccgataggacagtatttgtatccaga

SEQ ID NO: 200319 - DNA, 75 bp, Artificial Sequence
  Synthetic
gtataagcagcagggtaggatgctggagagatatcaactgcaaacagatgccagaaaaatcattcaactagtaat

SEQ ID NO: 200320 - DNA, 75 bp, Artificial Sequence
  Synthetic
aagagaaagtatggttataaggcaatttcttgtacaggaaatgttaacagctgacaaggtaggtgcctatactaa

SEQ ID NO: 200321 - DNA, 75 bp, Artificial Sequence
  Synthetic
ataatggtgtgcaaatgtatgacagcctatgatcaacccactggatctgaagagagaaggttggctaagtataag

SEQ ID NO: 200322 - DNA, 75 bp, Artificial Sequence
  Synthetic
caggtattatgccatggtaggagacattgcaaaatatatagctaatgtcggaatgagtgcgttctttcttacgct

SEQ ID NO: 200323 - DNA, 75 bp, Artificial Sequence
  Synthetic
attgcaaaatatatagctaatgtcggaatgagtgcgttctttcttacgcttaagtttggcttgggtaatagatgg

SEQ ID NO: 200324 - DNA, 75 bp, Artificial Sequence
  Synthetic
ggtgacagatcaagatacttggccctcctggaatctcccgaactaatggaatttgccccagctaattacccgcta

SEQ ID NO: 200325 - DNA, 75 bp, Artificial Sequence
  Synthetic
tcctggaatctcccgaactaatggaatttgccccagctaattacccgctattattcagttatgctatgggagttg

SEQ ID NO: 200326 - DNA, 75 bp, Artificial Sequence
  Synthetic
aggaacagttgatcctaaattggcctcagaacttggaataactgatgaagacagagtggacatcatgcaatctgt

SEQ ID NO: 200327 - DNA, 75 bp, Artificial Sequence
  Synthetic
ccagctaattacccgctattattcagttatgccatgggggttggaagtgtccaggatccattgattagaaactat

SEQ ID NO: 200328 - DNA, 75 bp, Artificial Sequence
  Synthetic
ccaggatccattgattagaaactatcagtttggaaggaacttcttaaataccagttattttcaatatggtgttga

SEQ ID NO: 200329 - DNA, 75 bp, Artificial Sequence
  Synthetic
cagtttggaaggaacttcttaaataccagttattttcaatatggtgttgagactgcaatgaagcaccagggaaca

SEQ ID NO: 200330 - DNA, 75 bp, Artificial Sequence
  Synthetic
tgaaaagcatatatcaggaaaagcaggagatgatatatctcaacccgcaggtgctttcacaatgtctctgaacag

SEQ ID NO: 200331 - DNA, 75 bp, Artificial Sequence
  Synthetic
gtgctttcacaatgtctctgaacagatcagctttcattaacaacaacaaccctcaagacctatcaggggcaagac

SEQ ID NO: 200332 - DNA, 75 bp, Artificial Sequence
  Synthetic
ccagttattttcaatatggtgttgagactgcaatgaagcaccagggaacagttgaccctaaattggccttagagc

SEQ ID NO: 200333 - DNA, 75 bp, Artificial Sequence
  Synthetic
cctcaagacctatcaggggcaagactctcgaactatgagcaagggtggtcaggtatagatcaggatggaacaaga

SEQ ID NO: 200334 - DNA, 75 bp, Artificial Sequence
  Synthetic
tctcgaactatgagcaagggtggtcaggtatagatcaggatggaacaagagacacctttccggaatctacaatgc

SEQ ID NO: 200335 - DNA, 75 bp, Artificial Sequence
  Synthetic
cacatatcaggaaaagctggagatgatatatcacagcctgcaggtgcatttacaatgtctctaagcagatcagct

SEQ ID NO: 200336 - DNA, 75 bp, Artificial Sequence
  Synthetic
acagattccaaaatattgattcaaccaactcagatcacaatgaactacagatgccagaattcgaaaatgacagca

SEQ ID NO: 200337 - DNA, 75 bp, Artificial Sequence
  Synthetic
atcccttcaacaatccaaggttcacagccagaacaccactcatcccagaaatttcacaccagactccaaccatca

SEQ ID NO: 200338 - DNA, 75 bp, Artificial Sequence
  Synthetic
aatcaagatgaaacgagagatgtctatccagaatctacaatgcacagactccaaaacattgaaccaactgactca

SEQ ID NO: 200339 - DNA, 75 bp, Artificial Sequence
  Synthetic
atttcacaccagactccaaccatcagagtgaacagaaatgcaaacacaagagatagcatcagagatgatcgtcaa

SEQ ID NO: 200340 - DNA, 75 bp, Artificial Sequence
  Synthetic
gatgccaacgagggccgaagcaacaacattccagatgatatccttggagatctagataattaaaccatcaacaac

SEQ ID NO: 200341 - DNA, 75 bp, Artificial Sequence
  Synthetic
ccagtcataatcacacagcaatcataatccaaaaaaatccccaatacccgcaatctcacacacacaacgggcaaa

SEQ ID NO: 200342 - DNA, 75 bp, Artificial Sequence
  Synthetic
atcaatcccataccacaacaaaacccgaaactctcaccaaacacgccatcacaaatgatcaatcattgatacagg

SEQ ID NO: 200343 - DNA, 75 bp, Artificial Sequence
  Synthetic
agatgacattcttggagatctagacaattgacacattaacggcccagccatagttacacaataatcacaaaccga

SEQ ID NO: 200344 - DNA, 75 bp, Artificial Sequence
  Synthetic
cgaaactctcaccaaacacgccatcacaaatgatcaatcattgatacaggacagcatgcaagaacttaattacca

SEQ ID NO: 200345 - DNA, 75 bp, Artificial Sequence
  Synthetic
tgatttaagaaaaaactacgataggcctgaacggttgcattcaggtcactcaatcgttcaggctactataatttc

SEQ ID NO: 200346 - DNA, 75 bp, Artificial Sequence
  Synthetic
aaaaatctcaaaggtacacaatcgcacacatacaatgaaagcaatcactcctgtcccacatcacaactcagaaat

SEQ ID NO: 200347 - DNA, 75 bp, Artificial Sequence
  Synthetic
caatcgttcaggctactataatttctaattctggacaaaactgataaaatgagctttgaaataagtgtagaggaa

SEQ ID NO: 200348 - DNA, 75 bp, Artificial Sequence
  Synthetic
cccgccaaacgcaacatcacgaccaatcaactgctgatacatggtagaacagaagaacacaactgcttttattta

SEQ ID NO: 200349 - DNA, 75 bp, Artificial Sequence
  Synthetic
atcaactgctgatacatggtagaacagaagaacacaactgcttttatttaagaaaaaactaagataggctgaacg

SEQ ID NO: 200350 - DNA, 75 bp, Artificial Sequence
  Synthetic
attgaagagctcatcgagactggcaatctcaacatagaccatgcactaaaagaattaggtgcaaccagtcaacca

SEQ ID NO: 200351 - DNA, 75 bp, Artificial Sequence
  Synthetic
tcactagacaaacttccatcccaaggtagcagaacagaaggaaataatggtggaaccaagatttcaagaaatctg

SEQ ID NO: 200352 - DNA, 75 bp, Artificial Sequence
  Synthetic
gtagcagaacagaaggaaataatggtggaaccaagatttcaagaaatctggccccagtagaggcacctgcccaca

SEQ ID NO: 200353 - DNA, 75 bp, Artificial Sequence
  Synthetic
tctccacagcacaacagcaacacaatgaagagaatgaatcaggaaaacaaaatctagacaacctctccatgatat

SEQ ID NO: 200354 - DNA, 75 bp, Artificial Sequence
  Synthetic
atagattatgcacttaaagaattaggtgcaaccagtcaacccccgccaaacagacctctgtctcaaatcagcaaa

SEQ ID NO: 200355 - DNA, 75 bp, Artificial Sequence
  Synthetic
acagaagaaaacaacgatgagacaaggacctcaaaaaactcggcatcagcagaggcaccagctcacgcctcctcg

SEQ ID NO: 200356 - DNA, 75 bp, Artificial Sequence
  Synthetic
ccaacaaaccccagacaggtacgctgcttatgggaccagacacacaacttccaagtccatcaaagacctatcaag

SEQ ID NO: 200357 - DNA, 75 bp, Artificial Sequence
  Synthetic
ccactgcggtcgcacaatgaagagagtgaaccagggaaacagagctcagacggtttctccatgatatccaacaga

SEQ ID NO: 200358 - DNA, 75 bp, Artificial Sequence
  Synthetic
gtgaaccagggaaacagagctcagacggtttctccatgatatccaacagaccccaaacaggtatgctgcttatgg

SEQ ID NO: 200359 - DNA, 75 bp, Artificial Sequence
  Synthetic
gactcattcttgatgcaaaaaagagagcactaaatgagccaagaagggaccaaaaaataacaaatgaacacggca

SEQ ID NO: 200360 - DNA, 75 bp, Artificial Sequence
  Synthetic
gtacaaatgataccaggatatttaagaggggggaatatagataccaggaaagaggcctgggttacacagagtcag

SEQ ID NO: 200361 - DNA, 75 bp, Artificial Sequence
  Synthetic
agaggcctgggttacacagagtcagagatcaagaacacaaccttcaccccaagacatcgaagagagtactcgatt

SEQ ID NO: 200362 - DNA, 75 bp, Artificial Sequence
  Synthetic
aacaaatgaacatggaaacacaaatgacacctggatatttaagaggggggaatatagccaccaagaaagaggctt

SEQ ID NO: 200363 - DNA, 75 bp, Artificial Sequence
  Synthetic
gtcgaaaaatgtacatgtggaagatgtcccaaaatttgcgaattatgcatcagagatccttgatgcaattaaggc

SEQ ID NO: 200364 - DNA, 75 bp, Artificial Sequence
  Synthetic
gggttacacagaatcagagatcaaaaatacaatcttcattccaagacatcgaagagagcactcgatttcatgggt

SEQ ID NO: 200365 - DNA, 75 bp, Artificial Sequence
  Synthetic
cagagatccttgatgcaattaaggcattagaagtaagactagacaggattgaagggaaagttgacaaaattatgc

SEQ ID NO: 200366 - DNA, 75 bp, Artificial Sequence
  Synthetic
aatacaatcttcattccaagacatcgaagagagcactcgatttcatgggtcaatggaagaaccacaatatcagag

SEQ ID NO: 200367 - DNA, 75 bp, Artificial Sequence
  Synthetic
atgtacatgtggaagatgtcccaaaatttgcgaactatgcattagagatccttgatgcaatcaaagcattagagg

SEQ ID NO: 200368 - DNA, 75 bp, Artificial Sequence
  Synthetic
tgaggttagataggatcgaaggaaaagttgacaaaattatgcttactcaaaatacaattcagcaaacaaaaaatg

SEQ ID NO: 200369 - DNA, 75 bp, Artificial Sequence
  Synthetic
tcctggagtcccatcaaaagtaagtctcaggagtttaaataaagaatcagaacaagttcctataattgttactgg

SEQ ID NO: 200370 - DNA, 75 bp, Artificial Sequence
  Synthetic
aacaagttcctataattgttactggtaacggagatgtctcaaagtttgttgatcaagacaatacaattacacttg

SEQ ID NO: 200371 - DNA, 75 bp, Artificial Sequence
  Synthetic
taacggagatgtctcaaagtttgttgatcaagacaatacaattacacttgattcattagcaagacccatattatc

SEQ ID NO: 200372 - DNA, 75 bp, Artificial Sequence
  Synthetic
tgcaacaattgagggcctaatcacaacaatgaaaataatggaccctggagtcccatcaaaagtaagtctcagaag

SEQ ID NO: 200373 - DNA, 75 bp, Artificial Sequence
  Synthetic
tcccatcaaaagtaagtctcagaagtttaaacaaagggccagagcaagttcctataatcgtcactggcactggcg

SEQ ID NO: 200374 - DNA, 75 bp, Artificial Sequence
  Synthetic
agacgagcaggtgttcgtatagatgcacttaaaataacagtctcagaaatgattagagatttatttggagactgt

SEQ ID NO: 200375 - DNA, 75 bp, Artificial Sequence
  Synthetic
atgtctcaaaatttgttgatcaagacaatacaattacacttgatccgttagcaagacccattttgtctggaacca

SEQ ID NO: 200376 - DNA, 75 bp, Artificial Sequence
  Synthetic
gataagagcaaaaagattcttgaatcaataaatatggcaactacagagcaagacatcaatctgatcaaaaccaat

SEQ ID NO: 200377 - DNA, 75 bp, Artificial Sequence
  Synthetic
agcaaataactgatgaaaggagagcaggtgttcgtatagatgcacttaaaataacagtatcagaaatgattcgag

SEQ ID NO: 200378 - DNA, 75 bp, Artificial Sequence
  Synthetic
gcccttagaagcattacctaaaatgtgagagtcataggtcacagagacaatcgcgactcagatccactcaacaca

SEQ ID NO: 200379 - DNA, 75 bp, Artificial Sequence
  Synthetic
atctatttggagactgtgataagagcagaaaacttctcgaatcaataaacatggcaaccacagagcaagatatca

SEQ ID NO: 200380 - DNA, 75 bp, Artificial Sequence
  Synthetic
ccaatccctcaatttaacatcaaaaagaaacaattgaatcacactttcaagaatcaaaaccaaatcgaatgacaa

SEQ ID NO: 200381 - DNA, 75 bp, Artificial Sequence
  Synthetic
actcgatcaaaactaatgctcttagaagcatcacctaaattatgagatccatgaaccacagagatcacagcgacc

SEQ ID NO: 200382 - DNA, 75 bp, Artificial Sequence
  Synthetic
caatatcaatcgtcatcaaataaaacacagagtaccatgacagcacatacatccaatatccattaagcacaaccc

SEQ ID NO: 200383 - DNA, 75 bp, Artificial Sequence
  Synthetic
aagcatcacctaaattatgagatccatgaaccacagagatcacagcgacccagattcacccaatatgccaagccc

SEQ ID NO: 200384 - DNA, 75 bp, Artificial Sequence
  Synthetic
tcgaccccatgcccagaaggaacaactagaccgcatcctcaagaatcaacaccaactcaaatgacgacaacacca

SEQ ID NO: 200385 - DNA, 75 bp, Artificial Sequence
  Synthetic
accagctcgtaggttatttctatgataatataaatgatttaagaaaaaaaacagcaataaggggggacccatcat

SEQ ID NO: 200386 - DNA, 75 bp, Artificial Sequence
  Synthetic
atcatcatcaaacaatacacagaacatcagcactgcatacaaaatcattccccggcacacacaattcactggctc

SEQ ID NO: 200387 - DNA, 75 bp, Artificial Sequence
  Synthetic
ccaaccaaccataaccatggctcctacccaatccaaagtcagaatccacaatctagccgaagctcacgagaaaac

SEQ ID NO: 200388 - DNA, 75 bp, Artificial Sequence
  Synthetic
atcagcactgcatacaaaatcattccccggcacacacaattcactggctcacagattccttccatgacatcacaa

SEQ ID NO: 200389 - DNA, 75 bp, Artificial Sequence
  Synthetic
acccaatccaaagtcagaatccacaatctagccgaagctcacgagaaaacactaagagctttcccaatagaagtt

SEQ ID NO: 200390 - DNA, 75 bp, Artificial Sequence
  Synthetic
agtatttaagaaaaaacagaagtaaggggggaccatcatccaatcgactgtagccatggctcctactcaatccaa

SEQ ID NO: 200391 - DNA, 75 bp, Artificial Sequence
  Synthetic
tcccaatagaagttgaacaaaattcggaggggaataaactattagtgaaacagatcagaataagaacactaggac

SEQ ID NO: 200392 - DNA, 75 bp, Artificial Sequence
  Synthetic
ggacagaaatcagagagcaaaaacactctaactgcttgtatgttaccctttgggcctggtccaaatattgggtcc

SEQ ID NO: 200393 - DNA, 75 bp, Artificial Sequence
  Synthetic
ccccaaaagatgttagaatatgctgaagacattaaaatccatgtgagaaagacagcaggttgtaaagagcagatt

SEQ ID NO: 200394 - DNA, 75 bp, Artificial Sequence
  Synthetic
gacagcaggttgtaaagagcagattgtattctctctagacaggacacctcaggttttcaggggatttcaattccc

SEQ ID NO: 200395 - DNA, 75 bp, Artificial Sequence
  Synthetic
tagggaccgatatgcatgtgttccatccgataaatatataaaatcaccagggaagttagtcgcaggacctaacta

SEQ ID NO: 200396 - DNA, 75 bp, Artificial Sequence
  Synthetic
tccgataaatatataaaatcaccagggaagttagtcgcaggacctaactattgctacataattacttttctttca

SEQ ID NO: 200397 - DNA, 75 bp, Artificial Sequence
  Synthetic
atccatgtaagaaagacagcaggctgcaaggagcagattgtgttttctctagacaggacacctcaagtgttcagg

SEQ ID NO: 200398 - DNA, 75 bp, Artificial Sequence
  Synthetic
agacaggacacctcaagtgttcaggggatttcaatttccccgggatagatatgtatgtgttccatctgacaaata

SEQ ID NO: 200399 - DNA, 75 bp, Artificial Sequence
  Synthetic
aaacttccggtccacacgaatgagaggtatacatttagaaattatcatgaagattacttgttctgaaaacagtcc

SEQ ID NO: 200400 - DNA, 75 bp, Artificial Sequence
  Synthetic
tataaaatcaccagggaagttagtcgcaggacccaattattgctacactatcactttcctctcattgacattctg

SEQ ID NO: 200401 - DNA, 75 bp, Artificial Sequence
  Synthetic
agattacttgttctgaaaacagtccgattagaaagacattaataacagatgatcttgagaatggtccaaaagcat

SEQ ID NO: 200402 - DNA, 75 bp, Artificial Sequence
  Synthetic
tcactttcctctcattgacattctgtcccagcagccaaaaattcaaagtacctagacccatattaaatttccgat

SEQ ID NO: 200403 - DNA, 75 bp, Artificial Sequence
  Synthetic
atatatgacgaggcgtattttgcagagaaatgcaagcagatgcttttaagtgtaggtattagtgatttgtggggg

SEQ ID NO: 200404 - DNA, 75 bp, Artificial Sequence
  Synthetic
gaaatcctataaaagtatatgatgaggcatattttgcagagaaatgcaaacaaatgctgttaagcgtaggcatca

SEQ ID NO: 200405 - DNA, 75 bp, Artificial Sequence
  Synthetic
gtgatctatgggggcctacaattgcagtacatgcaaatgggaaaatccccaaatctgccagcctctatttcaact

SEQ ID NO: 200406 - DNA, 75 bp, Artificial Sequence
  Synthetic
aaatctgccagcctctatttcaactcaagaggatgggctctgcatcctatagctgatgcatctcctacaatggca

SEQ ID NO: 200407 - DNA, 75 bp, Artificial Sequence
  Synthetic
attctaaatggaaccctttcaagaaggcaatatccatgcctaatctcactgatgacagtatttaatcatacaaat

SEQ ID NO: 200408 - DNA, 75 bp, Artificial Sequence
  Synthetic
acaaggctctgattatagtgctctggtggatcatcccgatgtaatatatcggaaaatcagaattgatccggcaaa

SEQ ID NO: 200409 - DNA, 75 bp, Artificial Sequence
  Synthetic
caactatcgatatcaggccgagcagtatcctacatccttccccactgtaccgccagcatcactcagatccacaga

SEQ ID NO: 200410 - DNA, 75 bp, Artificial Sequence
  Synthetic
aaagcagtacgcacactctaaatggaatccattcaagaaggcaatatccatgcctgatcttactggcatcagtat

SEQ ID NO: 200411 - DNA, 75 bp, Artificial Sequence
  Synthetic
accatactaaactatgcaccgtccgacatccagccaatcaccaaaacacaaccacaccacaccaactcaaccaag

SEQ ID NO: 200412 - DNA, 75 bp, Artificial Sequence
  Synthetic
tgcctgatcttactggcatcagtatctaatcatacaaattaatcactgatatagagttaaggaacattttatatc

SEQ ID NO: 200413 - DNA, 75 bp, Artificial Sequence
  Synthetic
gacactctcacaaacaccaaatgatcaaaacatgattgcagtagacacaacatcacccaattaaatcaaaacccc

SEQ ID NO: 200414 - DNA, 75 bp, Artificial Sequence
  Synthetic
cctccccgttgtatcaccatcaccatcctgatctataaaaccacactacactatgaaccatccaatatccagcca

SEQ ID NO: 200415 - DNA, 75 bp, Artificial Sequence
  Synthetic
attgtatactcaattcacccgacacaactacaaatctccgaatccgccctcagaaccacaccctcgaacagaccg

SEQ ID NO: 200416 - DNA, 75 bp, Artificial Sequence
  Synthetic
atcataggatcacaaccacattacaccaattcaatcaaggacatccttgcaaataccaaacaatcaaaacacgac

SEQ ID NO: 200417 - DNA, 75 bp, Artificial Sequence
  Synthetic
ccccaaaccaccaaacaatcaatttcataattgcaacaatcattgtagattttaagaaaaaattaagaacacaat

SEQ ID NO: 200418 - DNA, 75 bp, Artificial Sequence
  Synthetic
tgcaatagacacaacatcacccgatcaagccagacccccaccatgcacccaagtcatccgacacaaccgcaaact

SEQ ID NO: 200419 - DNA, 75 bp, Artificial Sequence
  Synthetic
aaataccaaatacagggggggaaaaacgcatccaccgtcaagcacacagctccaaattctgaggtgaccaacacc

SEQ ID NO: 200420 - DNA, 75 bp, Artificial Sequence
  Synthetic
ctcgattccaccatctgaaacacatcctcgaacagaccattcaaaaacaccgaacaatcaatctcccagttgcaa

SEQ ID NO: 200421 - DNA, 75 bp, Artificial Sequence
  Synthetic
cgaacaatcaatctcccagttgcaatgatcactgtaaattttaagaaaaaatctgacacacagctagagccaaat

SEQ ID NO: 200422 - DNA, 75 bp, Artificial Sequence
  Synthetic
cgtcgaaatctgctctatcaccaaagaatccaacatgggagtcaaaggttcatctttaattatgattgggttatt

SEQ ID NO: 200423 - DNA, 75 bp, Artificial Sequence
  Synthetic
aatctcaccaattaccaatctagatataactcatttaatgaatctaggaacggtaccaactgcaattagatctct

SEQ ID NO: 200424 - DNA, 75 bp, Artificial Sequence
  Synthetic
acagggggggaaaaacgcatccaccgccacgcacacagatccagaacccaaggtaaccaacacccgtcggactcc

SEQ ID NO: 200425 - DNA, 75 bp, Artificial Sequence
  Synthetic
ataactcatttaatgaatctaggaacggtaccaactgcaattagatctctagtttactacacttatactaaacca

SEQ ID NO: 200426 - DNA, 75 bp, Artificial Sequence
  Synthetic
agtttactacacttatactaaaccatcttatctcactgtagacttgattcccaacttgaagaatctggaccaaaa

SEQ ID NO: 200427 - DNA, 75 bp, Artificial Sequence
  Synthetic
actccatcctcaaagaaatcaacatgggtgtcaaaggtttatctctagttatgattggattattaatctcaccaa

SEQ ID NO: 200428 - DNA, 75 bp, Artificial Sequence
  Synthetic
tacaacaaaactgcactaagcttaattcaaccaattgcagataacatcaatcgccttacaaagcccatcacaagc

SEQ ID NO: 200429 - DNA, 75 bp, Artificial Sequence
  Synthetic
ttcaaccaattgcagataacatcaatcgccttacaaagcccatcacaagctcagaggttcaaagtcgtttctttg

SEQ ID NO: 200430 - DNA, 75 bp, Artificial Sequence
  Synthetic
caagtttaaattactataataaaacggcattaagcttgattcaaccaattgcagacaacatcaatcgccttacaa

SEQ ID NO: 200431 - DNA, 75 bp, Artificial Sequence
  Synthetic
gcagacaacatcaatcgccttacaaagccaatcacaagctcagaaatccaaagtcgtttttttggggcagtcata

SEQ ID NO: 200432 - DNA, 75 bp, Artificial Sequence
  Synthetic
aactctcaaaaaagctgcgacagaaacaaatgaggcagttcgagatcttgcaaactccaataaaattgttgtaaa

SEQ ID NO: 200433 - DNA, 75 bp, Artificial Sequence
  Synthetic
ggtacagttgctctcggtgtagttactgctgcacaagttacagcagcaatcggtcttgcaaaagctcaggaaaat

SEQ ID NO: 200434 - DNA, 75 bp, Artificial Sequence
  Synthetic
gatgatatcagcaattcaaaatcaaataaacactatcattcaacctgctatagaccagattaattgtcaaattaa

SEQ ID NO: 200435 - DNA, 75 bp, Artificial Sequence
  Synthetic
gcacaacttatactaactctcaaaaaagctgcaaaagagacaaatgatgcagttcgagatctcacaaaatccaac

SEQ ID NO: 200436 - DNA, 75 bp, Artificial Sequence
  Synthetic
agacctacaggttgccaacatcttaaatttgtacctaacagagataacgactgttttccacaatcaattgaccaa

SEQ ID NO: 200437 - DNA, 75 bp, Artificial Sequence
  Synthetic
aaaattgtggcaaggatgatatcagcaattcagaatcagataaacaccatcattcaacctgccatagaccggatt

SEQ ID NO: 200438 - DNA, 75 bp, Artificial Sequence
  Synthetic
tcccgcattagagtcaattagcattcaagctctcaaaagcctcttaggatctaccctaccagaagtgctgtctaa

SEQ ID NO: 200439 - DNA, 75 bp, Artificial Sequence
  Synthetic
cattcaacctgccatagaccggattaattgtcaaatcaaagacttacaagttgctaatattttaaatttgtacct

SEQ ID NO: 200440 - DNA, 75 bp, Artificial Sequence
  Synthetic
aacagagatcacaactgttttccacaatcaattgaccaatcctgcattagaatcaattagtattcaggctcttaa

SEQ ID NO: 200441 - DNA, 75 bp, Artificial Sequence
  Synthetic
gcttcagtgatggcatccggcttaattaaaggacagataattgcagttgatataccgactatgacactagttttg

SEQ ID NO: 200442 - DNA, 75 bp, Artificial Sequence
  Synthetic
atggtccaaataccgagtatatcccccttaagacaagcaaagataatagatctaacttctataacaattcacaca

SEQ ID NO: 200443 - DNA, 75 bp, Artificial Sequence
  Synthetic
aagtcttctaggatctaccttaccagaagtgctgtctaagttagatctaaacaatatctcggcagcttcagtaat

SEQ ID NO: 200444 - DNA, 75 bp, Artificial Sequence
  Synthetic
ggcatctggcttaattaaaggacagataattgcggttgatataccgaccatgacattagtattgatggtccaaat

SEQ ID NO: 200445 - DNA, 75 bp, Artificial Sequence
  Synthetic
aatagtcaagaagtacaagctgtagtaccagctagggttcttgagattggttcagaaatattaggattcgatgga

SEQ ID NO: 200446 - DNA, 75 bp, Artificial Sequence
  Synthetic
tcagtgtgccaaatcacgaaagatacagtcttttgtccttataatgatgcttatgtattacccatccagcagaag

SEQ ID NO: 200447 - DNA, 75 bp, Artificial Sequence
  Synthetic
ttatgtattacccatccagcagaagagatgcctacaaggccaaacaagagattgtgtgttcaccccagttgctgg

SEQ ID NO: 200448 - DNA, 75 bp, Artificial Sequence
  Synthetic
ggagatttctcactacatatggtactatagtagccaattgtagaaatttagtatgttcttgcctacgacctcccc

SEQ ID NO: 200449 - DNA, 75 bp, Artificial Sequence
  Synthetic
atccagaagtccattaatagtacttttcgacgtgaagtagtattagaatccactcaagtcagatctttgactcct

SEQ ID NO: 200450 - DNA, 75 bp, Artificial Sequence
  Synthetic
gattacttaaactcaattaatcctagtatagtcaataataacgcaataataatattgatcatactctgcatctta

SEQ ID NO: 200451 - DNA, 75 bp, Artificial Sequence
  Synthetic
gatctttgactcctcttgatttatcgaccgatttaaatcaatataatcaattactcaagagtgctgagaaccaca

SEQ ID NO: 200452 - DNA, 75 bp, Artificial Sequence
  Synthetic
aatattgatcatactctgcatcttattaatattgacagtgacaatctgcataatttggctcaaatatttgactaa

SEQ ID NO: 200453 - DNA, 75 bp, Artificial Sequence
  Synthetic
ttactcaagagtgctgagaaccacatccaacggtcaaatgattacttaaactcaattaatcctagtatagtaaat

SEQ ID NO: 200454 - DNA, 75 bp, Artificial Sequence
  Synthetic
tccaacggtcaaatgattacttaaactcaattaatcctagtatagtaaataatagcgcaataataatattgatta

SEQ ID NO: 200455 - DNA, 75 bp, Artificial Sequence
  Synthetic
tgaagttaagaatgtggcaagaaatcaaagactcaatagagatgctgatcttttccataggatccctagtcaaat

SEQ ID NO: 200456 - DNA, 75 bp, Artificial Sequence
  Synthetic
caaagactcaatagagatgctgatcttttccataggatccctagtcaaataccggtgcctagacaataacaacta

SEQ ID NO: 200457 - DNA, 75 bp, Artificial Sequence
  Synthetic
accggtgcctagacaataacaactaagattcatactctatgaaattcatctagatgctccaggaaaagtcatcca

SEQ ID NO: 200458 - DNA, 75 bp, Artificial Sequence
  Synthetic
tactttgcatcttattaatattgacagttacaatctgcataatttggctcaagtatttgactaaagaagttaaga

SEQ ID NO: 200459 - DNA, 75 bp, Artificial Sequence
  Synthetic
atgtagcaagaaatcaaagactcaacagagatgccgatcttatttataagattcccagtcaaataccattgccca

SEQ ID NO: 200460 - DNA, 75 bp, Artificial Sequence
  Synthetic
caatgatgcaccaacttttatctcactgaaagaaactcaaaatcaacaggaccacaactattctacaacaacacc

SEQ ID NO: 200461 - DNA, 75 bp, Artificial Sequence
  Synthetic
acgatcacaacaacgccctccaaaacatgagacacaaagccaagaaaaggaaaaaatagaaaagaacacaacaac

SEQ ID NO: 200462 - DNA, 75 bp, Artificial Sequence
  Synthetic
gataacaacaaccaagagatacattttgcaaatcttacctagatgctccaggggaaatcacccacaaagataaat

SEQ ID NO: 200463 - DNA, 75 bp, Artificial Sequence
  Synthetic
ggacagacaaaaagaagaagaagggcaatatcgccctggcaatatccttcattaacatctcccaaccaagaccga

SEQ ID NO: 200464 - DNA, 75 bp, Artificial Sequence
  Synthetic
caactctcaattcattaaaagaaatccaaaatcaacggagctacagctatcctgcaataacactacgactacaat

SEQ ID NO: 200465 - DNA, 75 bp, Artificial Sequence
  Synthetic
gatattcctcaagaaatgaaggacaaatctaggaatcagaaaagaatagcccaaaacaaatcaatagacagagaa

SEQ ID NO: 200466 - DNA, 75 bp, Artificial Sequence
  Synthetic
accgactgcacaagcacagaaactcaatatcacaaaaccagaaatggccctccacaatcctcctccaacaatcac

SEQ ID NO: 200467 - DNA, 75 bp, Artificial Sequence
  Synthetic
ccaaaacaaatcaatagacagagaaagggaaaggcaaacccgtctcagcaaaacctcccatcaacatcactcgac

SEQ ID NO: 200468 - DNA, 75 bp, Artificial Sequence
  Synthetic
aatatcacaaaaccagaaatggccctccacaatcctcctccaacaatcaccaacagaacaaaacgacacccaatc

SEQ ID NO: 200469 - DNA, 75 bp, Artificial Sequence
  Synthetic
aaacaatctccacatttcaattttaagaaaaaaactattataggggggaacacacttctcagccctgaccgtaca

SEQ ID NO: 200470 - DNA, 75 bp, Artificial Sequence
  Synthetic
caagactgaatcaacagcacagatacagaaacccaccaccacaaaaccacagaaagtctctcataatcccccacc

SEQ ID NO: 200471 - DNA, 75 bp, Artificial Sequence
  Synthetic
aggccctgccctgtgcaactgagacacccccacgagcaccggaacaagacccgacaacaagtgcagcatccacga

SEQ ID NO: 200472 - DNA, 75 bp, Artificial Sequence
  Synthetic
aacattcaccaaaaaaacaaaaaatcattcaaccaaataacttctacatttcaagtttaagaaaaaaactattat

SEQ ID NO: 200473 - DNA, 75 bp, Artificial Sequence
  Synthetic
cccaaaaccaaatcaaagatccggaaacagcccatcgaccagccatcatcatagaatctaacaatccagaaagac

SEQ ID NO: 200474 - DNA, 75 bp, Artificial Sequence
  Synthetic
aggggggaacgcacttctcagctccaaccacacaaggcctcgtcctgtaaaacaggaccaaactcacaaggtcca

SEQ ID NO: 200475 - DNA, 75 bp, Artificial Sequence
  Synthetic
atagaatctaacaatccagaaagacgtcacatcaacccggccacgaatctccaaagggaacatcccagacaaaaa

SEQ ID NO: 200476 - DNA, 75 bp, Artificial Sequence
  Synthetic
gtcacatcaacccggccacgaatctccaaagggaacatcccagacaaaaacacagcccactctccaatcacaaat

SEQ ID NO: 200477 - DNA, 75 bp, Artificial Sequence
  Synthetic
aaccacacaaggcctcgtcctgtaaaacaggaccaaactcacaaggtccagaacaaaatccgacaacaagtagaa

SEQ ID NO: 200478 - DNA, 75 bp, Artificial Sequence
  Synthetic
tctccacaattcaaaattagaccaacgatctagcaacaactcatcaactagcaaccatcagagaattcaacaatc

SEQ ID NO: 200479 - DNA, 75 bp, Artificial Sequence
  Synthetic
aaactgaaaaaaatcataagaatgcaagactcacatagtaatacacaaatattcaatcaggcaaattcaatggtg

SEQ ID NO: 200480 - DNA, 75 bp, Artificial Sequence
  Synthetic
cgatctagcaacaactcatcaactagcaaccatcagagaattcaacaatccagaaggacgtcacatcaactcatt

SEQ ID NO: 200481 - DNA, 75 bp, Artificial Sequence
  Synthetic
cagaaggacgtcacatcaactcattcgcgaatctccaaaagaaataacccaagtaaatttacaactcactcttca

SEQ ID NO: 200482 - DNA, 75 bp, Artificial Sequence
  Synthetic
aaaagaacatggagattgctatttcgaattgcaactttaatattacttgtctcaatatttgtgttatcactcata

SEQ ID NO: 200483 - DNA, 75 bp, Artificial Sequence
  Synthetic
attataaataaattaaagtaaatcacaaggatgcaagattcacgtggcaatactcaaatattcagccaagcgaat

SEQ ID NO: 200484 - DNA, 75 bp, Artificial Sequence
  Synthetic
actgtattacagtcgacaccagggaatttgcaaaacgatatcaatataattagaagggagctcaatgaacttatg

SEQ ID NO: 200485 - DNA, 75 bp, Artificial Sequence
  Synthetic
gagaattttgaaactacatctaaatcactgttaagcgtatcaaatcaaatcacctacgatgtatcagtgctcact

SEQ ID NO: 200486 - DNA, 75 bp, Artificial Sequence
  Synthetic
tactattccgaattgtaactttaatattacttgtttcaatatttgtgttatcactcataattgtactacagtcaa

SEQ ID NO: 200487 - DNA, 75 bp, Artificial Sequence
  Synthetic
cctataagacaagaagccattgaaacaaacatcatttcaaaaataaaagatcattgcaaagatagagtaattaaa

SEQ ID NO: 200488 - DNA, 75 bp, Artificial Sequence
  Synthetic
ctccggggaatttgcaaaatcatatcaatataatcagaaaagagctcgatgaacttatggagaactttgaaacca

SEQ ID NO: 200489 - DNA, 75 bp, Artificial Sequence
  Synthetic
gaaggaggaacttgtacattgaatcgcagccctttgcatgatgtctcctttctaaaaggaatcaacaagttctat

SEQ ID NO: 200490 - DNA, 75 bp, Artificial Sequence
  Synthetic
cctctaaatcactgctgagcgtacgaaatcaaattacttatgatgtatcagttctcacccccataagccaagaag

SEQ ID NO: 200491 - DNA, 75 bp, Artificial Sequence
  Synthetic
gcagccctttgcatgatgtctcctttctaaaaggaatcaacaagttctatttcacatataaagataatatgcaaa

SEQ ID NO: 200492 - DNA, 75 bp, Artificial Sequence
  Synthetic
ctattgaaacaaacataattgcgaaaataaaagatcattgcaaagatagggcagttaaaggagaaagcacctgca

SEQ ID NO: 200493 - DNA, 75 bp, Artificial Sequence
  Synthetic
ttaagttcaaatcattattagattatcccaattttattccaactgctacaactcctcacggatgcattcgaattc

SEQ ID NO: 200494 - DNA, 75 bp, Artificial Sequence
  Synthetic
gcagttaaaggagaaagcacctgcacactgagtcacaggcctctacatgatgtttcttttctgaatggatttaac

SEQ ID NO: 200495 - DNA, 75 bp, Artificial Sequence
  Synthetic
catcattctctttaggtcaaacccattggtgttatacccacaatataatcctacaaggatgtgcagacactgcac

SEQ ID NO: 200496 - DNA, 75 bp, Artificial Sequence
  Synthetic
atagcaatcaatatgtatcactaggaaccttacaagtcttaaaaaatggtgacccttattttaaagtcgagcata

SEQ ID NO: 200497 - DNA, 75 bp, Artificial Sequence
  Synthetic
gtcattatttaaatgacgggaagaatcgaaagagttgttcagtggttgctgtccccgacggatgcctgctgtatt

SEQ ID NO: 200498 - DNA, 75 bp, Artificial Sequence
  Synthetic
gtgtgattatgacaaaaaatgagacagagaatttcaaagatcctcaattagcaacacaattactaacatacatat

SEQ ID NO: 200499 - DNA, 75 bp, Artificial Sequence
  Synthetic
atctctaggaaccttacagaccttagaaaatggtgatccttatttcaaggtcgagtatagtcattatttaaatga

SEQ ID NO: 200500 - DNA, 75 bp, Artificial Sequence
  Synthetic
catataatggtaccattaaagatcgtataataaatccaccaggatcatccagagactgggttcatatcgcaccag

SEQ ID NO: 200501 - DNA, 75 bp, Artificial Sequence
  Synthetic
gtggttgctgttcttgacggatgtttactgtattgtgtgatcatgactaaaaatgaaacagagaatttcaaggat

SEQ ID NO: 200502 - DNA, 75 bp, Artificial Sequence
  Synthetic
cctcaattggcaaacaattacttacatatatatcatataatggtactatcaaagatccgtataataaatccacac

SEQ ID NO: 200503 - DNA, 75 bp, Artificial Sequence
  Synthetic
aaattacattatatttcctttgtatgggggtctcacagaaaaatcggtgatacataataatcaatcagggaaata

SEQ ID NO: 200504 - DNA, 75 bp, Artificial Sequence
  Synthetic
ggatcatctagagattgggttcacatctcaccaggggtaggttcgggtattttgtattcaaattacatcatattt

SEQ ID NO: 200505 - DNA, 75 bp, Artificial Sequence
  Synthetic
tttttttcctaattcaaccaaattgcaatgtcgtaacagcactgtggaaaaaataaaaggagcaaaagattcata

SEQ ID NO: 200506 - DNA, 75 bp, Artificial Sequence
  Synthetic
attcaatgatatataataatcaatcaaggaaatatttttttcctaattcaaccaagttgccatgtagtaacagca

SEQ ID NO: 200507 - DNA, 75 bp, Artificial Sequence
  Synthetic
ccagtgaaaaaataaaaggagcaaaagactcatacacaataacttacttctctaggagacttatacagagtgcat

SEQ ID NO: 200508 - DNA, 75 bp, Artificial Sequence
  Synthetic
agggtcgactatataatattgagaacaacatattttattatcagagaggatccagctggtggccttatccgagcc

SEQ ID NO: 200509 - DNA, 75 bp, Artificial Sequence
  Synthetic
caacatattttattatcagagaggatccagctggtggccttatccgagcctctatagaattagattgaaccttag

SEQ ID NO: 200510 - DNA, 75 bp, Artificial Sequence
  Synthetic
taataaatatcctaaaataactgaaattaaatttacaaaaattgaaattgccccaagaccaggtaacaaagattg

SEQ ID NO: 200511 - DNA, 75 bp, Artificial Sequence
  Synthetic
attaaatttacaaaaattgaaattgccccaagaccaggtaacaaagattgtccagggaataaagcttgcccaaaa

SEQ ID NO: 200512 - DNA, 75 bp, Artificial Sequence
  Synthetic
ttggtgcagagggtcgcctatataatattgaaaataatatatcttactatcagagaggatccagctggtggccct

SEQ ID NO: 200513 - DNA, 75 bp, Artificial Sequence
  Synthetic
gaatgtataacaggagtctatcaagatatatggccactaagttatcctaatactgcatttccacacttgaaacga

SEQ ID NO: 200514 - DNA, 75 bp, Artificial Sequence
  Synthetic
atccaagcctatatagaatcaaattaaatcctagcaagaaatatcctagaataactcagattaaatttacaaaaa

SEQ ID NO: 200515 - DNA, 75 bp, Artificial Sequence
  Synthetic
gcgtattatacaggtttttatctcaataattcgctcgaaagacgcaatccaacgttttatactgctgacaatctg

SEQ ID NO: 200516 - DNA, 75 bp, Artificial Sequence
  Synthetic
ttgagatagcttcaagacctggcaataaagattgcccaggaaataaggcttgtccaaaagaatgcataacgggag

SEQ ID NO: 200517 - DNA, 75 bp, Artificial Sequence
  Synthetic
taaagattgcccaggaaataaggcttgtccaaaagaatgcataacgggagtttaccaagatatatggccactaag

SEQ ID NO: 200518 - DNA, 75 bp, Artificial Sequence
  Synthetic
gattaccatcaacaggaaagattaggcaaattcaatcttactgctggatactctactacaacctgttttaaacag

SEQ ID NO: 200519 - DNA, 75 bp, Artificial Sequence
  Synthetic
ttatcctaatactgcgtttccccacaaaaaacgagcgtattatacaggtttttatctcaataactcgcttgaaag

SEQ ID NO: 200520 - DNA, 75 bp, Artificial Sequence
  Synthetic
accaccactgcgagattatactgtctctacataattgaagtgggtgattcagtcattggggactttcagatcaac

SEQ ID NO: 200521 - DNA, 75 bp, Artificial Sequence
  Synthetic
tctacataattgaagtgggtgattcagtcattggggactttcagatcaacccgtttttacgcttaatagatcaga

SEQ ID NO: 200522 - DNA, 75 bp, Artificial Sequence
  Synthetic
acgtaacccaacattttatactgctgataatctagattaccatcaacaggaaagattaggtaaatttaatcttac

SEQ ID NO: 200523 - DNA, 75 bp, Artificial Sequence
  Synthetic
ccgtttttacgcttaatagatcagactgttaattaatcaacaaaatcattctgtaatataaactgatcctatgag

SEQ ID NO: 200524 - DNA, 75 bp, Artificial Sequence
  Synthetic
gataatctagattaccatcaacaggaaagattaggtaaatttaatcttactgctggatactccactacaacttgt

SEQ ID NO: 200525 - DNA, 75 bp, Artificial Sequence
  Synthetic
aaagattaggtaaatttaatcttactgctggatactccactacaacttgtttcaagcagaccactactgcgaggt

SEQ ID NO: 200526 - DNA, 75 bp, Artificial Sequence
  Synthetic
tgaaaagatacttacacaaggtggtcgacagacaaacagtaagagtagcaattgtaacaaaacttcaaggaaaaa

SEQ ID NO: 200527 - DNA, 75 bp, Artificial Sequence
  Synthetic
tatattgcctttacatacttgaggtgggtgactcagtcattggagatttccagatttttccctttttagcgtctc

SEQ ID NO: 200528 - DNA, 75 bp, Artificial Sequence
  Synthetic
ataattcgagaaacatcatagagtgacctcagagtaaacacaacatcgatctataatagtcaaaatgaccaacaa

SEQ ID NO: 200529 - DNA, 75 bp, Artificial Sequence
  Synthetic
aatagaccaggctatcaattaatcaatagaattactctataacacaagctgatcttataaggtgaaagatgctca

SEQ ID NO: 200530 - DNA, 75 bp, Artificial Sequence
  Synthetic
tactccatgaggcctcacctatcaacagcaaaaagcacagtccatcaagcagagcccaactcgcctcatcctcaa

SEQ ID NO: 200531 - DNA, 75 bp, Artificial Sequence
  Synthetic
tacaaaatggttaatagacaaataataataataatcattgtaacaaaattaaaaggataaaataattataggaac

SEQ ID NO: 200532 - DNA, 75 bp, Artificial Sequence
  Synthetic
taataataatcattgtaacaaaattaaaaggataaaataattataggaacactataaactaatcagaaaacaaac

SEQ ID NO: 200533 - DNA, 75 bp, Artificial Sequence
  Synthetic
ccatccactgaaagaaaaaatacatgaagaaccattggctaccagatccaaacaatccagcacaaaaattcaaac

SEQ ID NO: 200534 - DNA, 75 bp, Artificial Sequence
  Synthetic
actataaactaatcagaaaacaaacataacattaaccagcaacagctaacatgaccaatgatactccgtgaaaca

SEQ ID NO: 200535 - DNA, 75 bp, Artificial Sequence
  Synthetic
aaccgccaaactccattcggcctcaacaaataatccgccaatccgtccatcattcccacactgacacacaaccat

SEQ ID NO: 200536 - DNA, 75 bp, Artificial Sequence
  Synthetic
tcacccatcaataacaaaaaatataatctatcaatcagaaccaaatctgatccattctcggcaatccaccaagcg

SEQ ID NO: 200537 - DNA, 75 bp, Artificial Sequence
  Synthetic
cccattcttcaccagcaactcaatccacaagtcaaagaagactctccatatattcagctgatccgtcaatctgac

SEQ ID NO: 200538 - DNA, 75 bp, Artificial Sequence
  Synthetic
aaaacacacatgaagaatcatcaaccatcaagtctgattaatccgacacaaaaatctgaacaaccgccagaatag

SEQ ID NO: 200539 - DNA, 75 bp, Artificial Sequence
  Synthetic
acatcatcgtatcttttaagaaaaaagagagatgagcaatcgatacattctatttcccatacacatcataaatat

SEQ ID NO: 200540 - DNA, 75 bp, Artificial Sequence
  Synthetic
gcccggtcctgacaaacaacctgcccggccaccagcccactcaacatcaagacacaatcaactccaccccaatca

SEQ ID NO: 200541 - DNA, 75 bp, Artificial Sequence
  Synthetic
cggccaccagcccactcaacatcaagacacaatcaactccaccccaatcatcagtccaatccgcgagtcaaacaa

SEQ ID NO: 200542 - DNA, 75 bp, Artificial Sequence
  Synthetic
taaatcatggattcaccatagaccaagatcaaaaattggaggaccagaatgatcttgaatagtgacggacaagca

SEQ ID NO: 200543 - DNA, 75 bp, Artificial Sequence
  Synthetic
gttcctccacatgcccagcaatttaatcgatctgacacattactatatcttttaagaaaaaagaaaaatgagtga

SEQ ID NO: 200544 - DNA, 75 bp, Artificial Sequence
  Synthetic
atgaggaacaaaaaagatagattattctcaacaacgaatggcacaaagcatccaacaataggggggaagagagca

SEQ ID NO: 200545 - DNA, 75 bp, Artificial Sequence
  Synthetic
gtaagacattctagttctcatacacaggataaacttcgaactttggatgcattatggatcagaattgaagattga

SEQ ID NO: 200546 - DNA, 75 bp, Artificial Sequence
  Synthetic
agaactaggatgattccgtacactagcagacaagcaatgaggaataaaaagaatagacaattgcccaggatgaac

SEQ ID NO: 200547 - DNA, 75 bp, Artificial Sequence
  Synthetic
gacacaaagcatccaacgctaggggggaagagaccacccctaagatggctgaccatactgatgtcctattgccgg

SEQ ID NO: 200548 - DNA, 75 bp, Artificial Sequence
  Synthetic
aggtacatttgagttcccccattgtacggcacaaactcatttattatatactattgggaaatctaccaaatcaaa

SEQ ID NO: 200549 - DNA, 75 bp, Artificial Sequence
  Synthetic
tctgtgaggaacaatcttctaaaacatgtaccctcattgagagaggtagatccaacacatcaatgtaaaaacctg

SEQ ID NO: 200550 - DNA, 75 bp, Artificial Sequence
  Synthetic
agaagagaagaaagcaaattatgtttacgtttagtatctgtaaggaataatcttttaaaacatataccctcattg

SEQ ID NO: 200551 - DNA, 75 bp, Artificial Sequence
  Synthetic
ttagctgatattgaatcaagctggaataagaatcattggtcaaatattacgaatcttttcttattaataaagtac

SEQ ID NO: 200552 - DNA, 75 bp, Artificial Sequence
  Synthetic
gaatcttttcttattaataaagtaccaaatgagattattaatttgtcaaatgaaaaaatctcaaactggccttct

SEQ ID NO: 200553 - DNA, 75 bp, Artificial Sequence
  Synthetic
gtgataaattaatatcaaggaaagatttatttacaagtgctaggtgcagacacaaaggtcatgatagagattcaa

SEQ ID NO: 200554 - DNA, 75 bp, Artificial Sequence
  Synthetic
tgaggtcaagttggaagacagatcaggtttaattataattactccagaattagtgtgtatctatttccaacaagc

SEQ ID NO: 200555 - DNA, 75 bp, Artificial Sequence
  Synthetic
gaatgtgttaagctatttcacatttgaaatgatccttatgatctctgatgtatttgaaggaaggcaaaatgtcat

SEQ ID NO: 200556 - DNA, 75 bp, Artificial Sequence
  Synthetic
aggattatgttcaattagttattacttgtctcctctaaaggatagaataaatgacttactcaattatgtagacaa

SEQ ID NO: 200557 - DNA, 75 bp, Artificial Sequence
  Synthetic
actggtcttcttgaagtcaagttggaagatagatcaggtttaattataattactcccgaattagtgtgcatttat

SEQ ID NO: 200558 - DNA, 75 bp, Artificial Sequence
  Synthetic
atgacttactcaattatgtagacaatttagcactgatcttaggtaataaagtttattcaattattgcaaacttag

SEQ ID NO: 200559 - DNA, 75 bp, Artificial Sequence
  Synthetic
aaagcttagtttatgctaagttacagctgagagatccagtcttagaggtcagaggccaattccattgttttatac

SEQ ID NO: 200560 - DNA, 75 bp, Artificial Sequence
  Synthetic
tagaagagattatggagattttacatgatgttttctcagttgaagagagtgcccaagtatgttctatattgtcat

SEQ ID NO: 200561 - DNA, 75 bp, Artificial Sequence
  Synthetic
taggaaataaggtttattcaataatcgctaatttagaaagtttagtttatgctaaattacaattgaaggatccag

SEQ ID NO: 200562 - DNA, 75 bp, Artificial Sequence
  Synthetic
ttttagcagttagaggtcaattccattgttttatactagaggagattatggagattttacatgatgttttctcag

SEQ ID NO: 200563 - DNA, 75 bp, Artificial Sequence
  Synthetic
atgagaatgtggggtcatcccacactcacagctgcaggcgcagcagggaaagttcgtgaatctatgtgtgcacca

SEQ ID NO: 200564 - DNA, 75 bp, Artificial Sequence
  Synthetic
gagattttacatgatgttttctcagttgatgagagtgcccaagtgtgttctatactgtcatcttttcttagtggt

SEQ ID NO: 200565 - DNA, 75 bp, Artificial Sequence
  Synthetic
aagctattggatttcacaacaatcatgaaaacattatcattctttcatactatacttataaatgggtataggaga

SEQ ID NO: 200566 - DNA, 75 bp, Artificial Sequence
  Synthetic
tatacttataaatgggtataggagaaaacacggcgggatctggccaaatgtagtattaattgatggtaccccaaa

SEQ ID NO: 200567 - DNA, 75 bp, Artificial Sequence
  Synthetic
tgttatgtattatgagaatgtggggtcatcccactctaacagctgcaggtgcagcagggaaagttcgtgaatcta

SEQ ID NO: 200568 - DNA, 75 bp, Artificial Sequence
  Synthetic
ttttattgtcagtcttaaaaatgataacgcagaaataagctatgaagtagcactaaaatactggaaatggatatc

SEQ ID NO: 200569 - DNA, 75 bp, Artificial Sequence
  Synthetic
actatttgaatttgaaaaatgtttttcagctgatccaggtgaggatttaagtatattcatgaaagataaagcaat

SEQ ID NO: 200570 - DNA, 75 bp, Artificial Sequence
  Synthetic
tcagctgatccaggtgaggatttaagtatattcatgaaagataaagcaataagctgtaacaagaaggattggatg

SEQ ID NO: 200571 - DNA, 75 bp, Artificial Sequence
  Synthetic
agaatgtccatcgaatgtaaatagacgattattattaaacttcctaaatgattcaaatttcgatcctaacttaga

SEQ ID NO: 200572 - DNA, 75 bp, Artificial Sequence
  Synthetic
tttcttaaatgactcaaatttcgatccaaatctagaattagagtatgtgactaccctacaatatctaactgatga

SEQ ID NO: 200573 - DNA, 75 bp, Artificial Sequence
  Synthetic
gcttgctaatcatgcagggaaattattcagagagaatggtgtagttcttgatcagcttaagttaacaaaatcact

SEQ ID NO: 200574 - DNA, 75 bp, Artificial Sequence
  Synthetic
cttaactatgagtcagatagggattatttccaacaaagagcgtaaggctacaaaggactctatgacaatcctaaa

SEQ ID NO: 200575 - DNA, 75 bp, Artificial Sequence
  Synthetic
ggacattaagaagaataaaaatagacataaagaacatgaaaagaagtatggttcagaaaattcatctccttttgg

SEQ ID NO: 200576 - DNA, 75 bp, Artificial Sequence
  Synthetic
cagggaaattattcagagaaaacggtgtagttcttgatcagcttaagttaacaaaatcactcctaactatgagcc

SEQ ID NO: 200577 - DNA, 75 bp, Artificial Sequence
  Synthetic
gttcagaaaattcatctccttttggagatctaaggaaaaatgctgcaataaatactcctgatgacacattggaaa

SEQ ID NO: 200578 - DNA, 75 bp, Artificial Sequence
  Synthetic
acaaaatcactcctaactatgagccaaatagggattatctcaaataaggagcgtaaagctacaaaggactccatg

SEQ ID NO: 200579 - DNA, 75 bp, Artificial Sequence
  Synthetic
aaagaaatatggttcagagaattcaactcctttcggagatctggggaaaaattttggaataaacactcctgatga

SEQ ID NO: 200580 - DNA, 75 bp, Artificial Sequence
  Synthetic
tccatcagatcataatgtgattgacctagataatgcacccaatgatgatatctttattgtttcaccaagaggagg

SEQ ID NO: 200581 - DNA, 75 bp, Artificial Sequence
  Synthetic
tggaccatgatttcaattgctactatattgttgtcatctgcagagtctaagactagagtaatgagcatggtccaa

SEQ ID NO: 200582 - DNA, 75 bp, Artificial Sequence
  Synthetic
gccaaaaattatggactatgatctcaattgctactatattattgtcatctgcagaatctaagaccagagtaatga

SEQ ID NO: 200583 - DNA, 75 bp, Artificial Sequence
  Synthetic
aactgcaataactacaaaagtgccaaggagaatgcctcataaagagaagaagcaatcagcttataatgcaagtaa

SEQ ID NO: 200584 - DNA, 75 bp, Artificial Sequence
  Synthetic
ctcaagaatgctagcaaattatgtttaacagctgatatacttggtgactgcactcaatcttcttgttccaatctg

SEQ ID NO: 200585 - DNA, 75 bp, Artificial Sequence
  Synthetic
gcaacaacaatcatgagattgaccgaaaacggacttgaaaaagatgtggcaataagactaaatatattcatggct

SEQ ID NO: 200586 - DNA, 75 bp, Artificial Sequence
  Synthetic
tcagccaagcacttaaaaatgctagcaaattatgtttgacagctgatattctcggttactgtactcaatcttctt

SEQ ID NO: 200587 - DNA, 75 bp, Artificial Sequence
  Synthetic
atcaaatatttctgacatatatctaaaccatccagatttactagcaagaatttgtcttgtcccatcccaagtcgg

SEQ ID NO: 200588 - DNA, 75 bp, Artificial Sequence
  Synthetic
tggactaaattatctatcatctagtcgattattcaatagaaatataggtgatccattagtatctgcatttgcaga

SEQ ID NO: 200589 - DNA, 75 bp, Artificial Sequence
  Synthetic
tattcatggctattagacaactaacttttgatttgatcttccctatgaatacaaataatgcatcaaacatttctg

SEQ ID NO: 200590 - DNA, 75 bp, Artificial Sequence
  Synthetic
cgattattcaatagaaatataggtgatccattagtatctgcatttgcagatattaaaagactaataatggctaga

SEQ ID NO: 200591 - DNA, 75 bp, Artificial Sequence
  Synthetic
acaaataatgcatcaaacatttctgacatatacctgaaccatccagatttactggcaagaatttgtcttatcccg

SEQ ID NO: 200592 - DNA, 75 bp, Artificial Sequence
  Synthetic
tgtattgaaccttgggtcttaacaaatatcatgagacgtcctccaggagacggaaattggagtactctagcagca

SEQ ID NO: 200593 - DNA, 75 bp, Artificial Sequence
  Synthetic
cggaaattggagtactctagcagcagatccttatgcagtcaatattgattacctatacccgccgactatattcct

SEQ ID NO: 200594 - DNA, 75 bp, Artificial Sequence
  Synthetic
taaacggcatgcccagcaaacactgatggaatcaagtgtgaatccgcttctcaatgggatattcaatccaaatgc

SEQ ID NO: 200595 - DNA, 75 bp, Artificial Sequence
  Synthetic
aaaagcggaagagaataatttagctcaatttttgctcgatagagatatagtgttgccaagggtagctcatgttat

SEQ ID NO: 200596 - DNA, 75 bp, Artificial Sequence
  Synthetic
attagcacaaactggttgcggaagaaggaagcagattcaagggtatctagattccacacggactatagtaaaatt

SEQ ID NO: 200597 - DNA, 75 bp, Artificial Sequence
  Synthetic
aggaagcagattcaagggtatctagattccacacggactatagtaaaattagccttagacataaaacctttatct

SEQ ID NO: 200598 - DNA, 75 bp, Artificial Sequence
  Synthetic
ataatttagcccaattccttctcgatagagatatagtattaccaagagtagctcatgttatactagcacaaacag

SEQ ID NO: 200599 - DNA, 75 bp, Artificial Sequence
  Synthetic
aaaacaggaaaagattcttggagcttagataatatcaatgattgtagtatagatctggcaaggaatttaaggaag

SEQ ID NO: 200600 - DNA, 75 bp, Artificial Sequence
  Synthetic
aggatatctagattccacacggactatagtaaagttagccttagatataaaacccctatctttcagaaaaacaaa

SEQ ID NO: 200601 - DNA, 75 bp, Artificial Sequence
  Synthetic
ggagtcttgttaacaaataagtccctgtgtcatcaatgtgcatcaggtaatgataaatttacttggctttatcta

SEQ ID NO: 200602 - DNA, 75 bp, Artificial Sequence
  Synthetic
tgataaatttacttggctttatctaccaggtggtattcagatagatcttgagccaagcaaaaacccacctatgag

SEQ ID NO: 200603 - DNA, 75 bp, Artificial Sequence
  Synthetic
atttaagaaagctatcatgggctcctttgttacatggtaggggattagaaggtttagaaactcctgatcctatag

SEQ ID NO: 200604 - DNA, 75 bp, Artificial Sequence
  Synthetic
ggtttagaaactcctgatcctatagagttgctagatggagtcttgttaacaaataaatctttgtgtcatcaatgt

SEQ ID NO: 200605 - DNA, 75 bp, Artificial Sequence
  Synthetic
cacaaataccaggtgcttctcaaaatctaaaatcagttttaaggttaactggtgtatatatttgggcttttggtg

SEQ ID NO: 200606 - DNA, 75 bp, Artificial Sequence
  Synthetic
aaataaatctttgtgtcatcaatgtgcatcaggaaatgataagtttacttggctttatttaccgggtggcattca

SEQ ID NO: 200607 - DNA, 75 bp, Artificial Sequence
  Synthetic
aaatttgacccatcgattagatgatggagtaactcagatgaaatttacacctgcaagtctatatactttttcaaa

SEQ ID NO: 200608 - DNA, 75 bp, Artificial Sequence
  Synthetic
ggagtaactcagatgaaatttacacctgcaagtctatatactttttcaaattacattcacatctctaatgatcgt

SEQ ID NO: 200609 - DNA, 75 bp, Artificial Sequence
  Synthetic
agacacgtgtaaatataactttagatcagctcagagtactaactcctctacccacttcagcaaatttgacccatc

SEQ ID NO: 200610 - DNA, 75 bp, Artificial Sequence
  Synthetic
ggctagatgacggagtaactcagatgaaatttacacctgcaagtttatacactttctcaaattatattcatattt

SEQ ID NO: 200611 - DNA, 75 bp, Artificial Sequence
  Synthetic
attattgaaacatggaatgcattgcctattaagcacactgtacatgaggtgactttgcatctacacactgcagct

SEQ ID NO: 200612 - DNA, 75 bp, Artificial Sequence
  Synthetic
actttctcaaattatattcatatttctaatgatcgtcaggtgctacaaattgatgaatgcaatgtagattcaaat

SEQ ID NO: 200613 - DNA, 75 bp, Artificial Sequence
  Synthetic
tcgtgttgtataaggccagttgattcttgccttataaataattccagacaagatctgccttacttagaagatact

SEQ ID NO: 200614 - DNA, 75 bp, Artificial Sequence
  Synthetic
cttgccttataaataattccagacaagatctgccttacttagaagatactactatcaataaatttatttatgacg

SEQ ID NO: 200615 - DNA, 75 bp, Artificial Sequence
  Synthetic
gaatgcattgcctatcaagcatactgtacatgaagtaactttgcatttacacactgcagcttcgtgttgtataag

SEQ ID NO: 200616 - DNA, 75 bp, Artificial Sequence
  Synthetic
atcaaccgatcccagaggagaaatcgagtttaatagaacaatttatagttaatgtcaatgtaggtgattttgaat

SEQ ID NO: 200617 - DNA, 75 bp, Artificial Sequence
  Synthetic
acactgcagcttcgtgttgtataagacccgttgattcttgccttgtaaataattccagacaagatctaccttatt

SEQ ID NO: 200618 - DNA, 75 bp, Artificial Sequence
  Synthetic
gagtttaatagaacaatttatagttaatgtcaatgtaggtgattttgaattcaacgatactcaaaatagtattgt

SEQ ID NO: 200619 - DNA, 75 bp, Artificial Sequence
  Synthetic
tagaggatactactattaataagtttatttacgatgatcaacccatcccagaggaaaaatcaagcttagtagaac

SEQ ID NO: 200620 - DNA, 75 bp, Artificial Sequence
  Synthetic
tagatgagtcgacatcaatcattaatgatgcaatcatagagactgattattctcataattggatcagtgaattct

SEQ ID NO: 200621 - DNA, 75 bp, Artificial Sequence
  Synthetic
taatgggaaaaattgttgttgattccataataggattagatgagtcaacatcaattatcaatgatgcaatcatag

SEQ ID NO: 200622 - DNA, 75 bp, Artificial Sequence
  Synthetic
atttaaggattactggattaatgaacttactagattacattgagttgacattgcaacggatacccggattatcaa

SEQ ID NO: 200623 - DNA, 75 bp, Artificial Sequence
  Synthetic
tcaattatcaatgatgcaatcatagagactgattattcccataattggattagtgaattcttaaatacttacttg

SEQ ID NO: 200624 - DNA, 75 bp, Artificial Sequence
  Synthetic
ttgcaacggatacccggattatcaatacagaacttggcttcgacgataagccatccaaaaattttaagaagaatg

SEQ ID NO: 200625 - DNA, 75 bp, Artificial Sequence
  Synthetic
gaccaggtattcatatatattgggtggaacatcttattagaattatcatatcaaatgtattacttaaggattatt

SEQ ID NO: 200626 - DNA, 75 bp, Artificial Sequence
  Synthetic
ggattaatgaatttactagattatattgaattaacattgcaaaggatacctgggttatcaatacagaatttggcc

SEQ ID NO: 200627 - DNA, 75 bp, Artificial Sequence
  Synthetic
ttgtatcccaagcaattccccgcaattcgcaacacttaactttacaaagatagctgtgcaatgtctcatgtgggg

SEQ ID NO: 200628 - DNA, 75 bp, Artificial Sequence
  Synthetic
tttaaatgatagaatatataataaagctgcaagaaagctaacattagttgcaatgctgtatgattttgaatgtaa

SEQ ID NO: 200629 - DNA, 75 bp, Artificial Sequence
  Synthetic
catcaatcaagtaacaaatccaaatatacatccttatccatgtaatagttattatttgtcaagaaaagcattaaa

SEQ ID NO: 200630 - DNA, 75 bp, Artificial Sequence
  Synthetic
tttaccaaaattaaagggtcttactgcagaggataaatgttgcatactgactgaatttttattgagtgagacatg

SEQ ID NO: 200631 - DNA, 75 bp, Artificial Sequence
  Synthetic
gcagaggataaatgttgcatactgactgaatttttattgagtgagacatgcttagctaatttatcaatccaacac

SEQ ID NO: 200632 - DNA, 75 bp, Artificial Sequence
  Synthetic
tacagattttttacagcttaagagtgaggaaaataatgatacactcctaacaaatgatattataattgaattact

SEQ ID NO: 200633 - DNA, 75 bp, Artificial Sequence
  Synthetic
caaacccaaatatacacccttatccatgtaacagctattatttatctagaaaggcattaaattatataagatcaa

SEQ ID NO: 200634 - DNA, 75 bp, Artificial Sequence
  Synthetic
cttaggccattaggcttgacatctacttcatggtataaatcattaagtatagttaaattcttagaaatgacccaa

SEQ ID NO: 200635 - DNA, 75 bp, Artificial Sequence
  Synthetic
agcttgaaaggcatgaaataccttttcaggaatcatctactactgatcgagaaaatttctatccagatcctcctg

SEQ ID NO: 200636 - DNA, 75 bp, Artificial Sequence
  Synthetic
gacattgatagaaaacttttatcccgggagaaagatatactataacagctattattcaagcgaattaaaccctcc

SEQ ID NO: 200637 - DNA, 75 bp, Artificial Sequence
  Synthetic
gggagaaagatatactataacagctattattcaagcgaattaaaccctccccagaggaactttgaacctctaccc

SEQ ID NO: 200638 - DNA, 75 bp, Artificial Sequence
  Synthetic
gaatgattcagatacctgatggatcccatttatacttagctgaaggcagtggcgcttctatgacattgatagaaa

SEQ ID NO: 200639 - DNA, 75 bp, Artificial Sequence
  Synthetic
acttttatcctgggaggaagatatactataatagctattactcaagtgaattaaatccacctcagaggaattttg

SEQ ID NO: 200640 - DNA, 75 bp, Artificial Sequence
  Synthetic
taattcattgtgatctcgaagaaggatttgaaactcctcaggaagaaatatcatcagctaccatccatgttttac

SEQ ID NO: 200641 - DNA, 75 bp, Artificial Sequence
  Synthetic
gcagaaatagagtgtcatttgggatttgtacaagagtacaaatgcttatggaatggtgtcactgaaactactgat

SEQ ID NO: 200642 - DNA, 75 bp, Artificial Sequence
  Synthetic
aaataacttgcagctgtctcaaaaaagatggattattactattaaagacaagctgggtaccctttgctagatttt

SEQ ID NO: 200643 - DNA, 75 bp, Artificial Sequence
  Synthetic
tcattattaattctattggagtggattcagttacattaattcattgtgatttagaggagggatttgatactcccc

SEQ ID NO: 200644 - DNA, 75 bp, Artificial Sequence
  Synthetic
ctacgttaatttctatatgctggactttttcatctcaaattatacttttaagaagtgcatatagtgatccatcca

SEQ ID NO: 200645 - DNA, 75 bp, Artificial Sequence
  Synthetic
atcatgaagtgtatttaatttgcaaaagatcagaagatggttggttttctgacttaagaactgctatattaaatg

SEQ ID NO: 200646 - DNA, 75 bp, Artificial Sequence
  Synthetic
cccaaacattaacccaatccaattatacaatattatctccaaatattataaattattactgggaacaattaatcc

SEQ ID NO: 200647 - DNA, 75 bp, Artificial Sequence
  Synthetic
gtcagaaagatagtatctttgatattataaatgataccatcacatcatctgatcctcattattttttgtctgata

SEQ ID NO: 200648 - DNA, 75 bp, Artificial Sequence
  Synthetic
atcaaaaaattttacaagcaggtggatctcttagctgtcagcaatggtacaatatcacaagtttcaattctatta

SEQ ID NO: 200649 - DNA, 75 bp, Artificial Sequence
  Synthetic
tggatctgtacaagcacttagcctctatttatacagttcatattaaggaaattatagagatattaaagagtgagg

SEQ ID NO: 200650 - DNA, 75 bp, Artificial Sequence
  Synthetic
gagatgaatatctaggtttgatatggtctccatacaatattggagctcaagggaaaataaatactatattacggt

SEQ ID NO: 200651 - DNA, 75 bp, Artificial Sequence
  Synthetic
tattatcagaaaaagtaatgctatatattgttaagaattggaaattaattgattatcatgcaaaaattgatttta

SEQ ID NO: 200652 - DNA, 75 bp, Artificial Sequence
  Synthetic
aacataatttagagtgtggtgaatttgatgctggctgtttctttaaaccagacttgttgtacaagtatacaccaa

SEQ ID NO: 200653 - DNA, 75 bp, Artificial Sequence
  Synthetic
gaagagtgagggagatgaatatctaagcttagtatggtctccatacaatattggagctcaggggaaaatcaatac

SEQ ID NO: 200654 - DNA, 75 bp, Artificial Sequence
  Synthetic
atccacggtaccttcgcaagacaatttcaaacaatgtgttagttgaattgattactgtaaaaatggttctaaaat

SEQ ID NO: 200655 - DNA, 75 bp, Artificial Sequence
  Synthetic
ggaaattaattgattatcatgcaaaaattgactttaaacataatctagaatgtggtgagtttgatgctggctgtt

SEQ ID NO: 200656 - DNA, 75 bp, Artificial Sequence
  Synthetic
tatcccggccaaaacaaaagcagatttggaaattattaggttgcactctctttgtcggaatacaagatgaacagt

SEQ ID NO: 200657 - DNA, 75 bp, Artificial Sequence
  Synthetic
ttggaaattattaggttgcactctctttgtcggaatacaagatgaacagttaggaacaaatgagcaaaaaataga

SEQ ID NO: 200658 - DNA, 75 bp, Artificial Sequence
  Synthetic
tttttaaaccagacttattgtataaatatactccaaatccacgatatcttcgcaaaacaatttcaaataatgtat

SEQ ID NO: 200659 - DNA, 75 bp, Artificial Sequence
  Synthetic
atatactccaaatccacgatatcttcgcaaaacaatttcaaataatgtattagttgaattgattactgtaaaaat

SEQ ID NO: 200660 - DNA, 75 bp, Artificial Sequence
  Synthetic
tttgtcggaatacaagatgaacagttaggaacaaatgagcaaaaaatagatagtaatctagataagtatatccaa

SEQ ID NO: 200661 - DNA, 75 bp, Artificial Sequence
  Synthetic
ttcaatgatgcaaacgatgaaagagatgtttttggtgatatattataataaattcaacacagatttaatgattaa

SEQ ID NO: 200662 - DNA, 75 bp, Artificial Sequence
  Synthetic
ggtactaaaactatctcgaccaaaacaaaagcagatttggaaattattgggatgtacccttttcgttggaataca

SEQ ID NO: 200663 - DNA, 75 bp, Artificial Sequence
  Synthetic
caataacaatcatacaatatatccatatcaaatgaattctctatgctattattataatcagaaaaaaattaaaag

SEQ ID NO: 200664 - DNA, 75 bp, Artificial Sequence
  Synthetic
aaatgaatccttagaaatgaatgagcaagtagtcgatagtaatctaaatgaatatgtccaatttaatgattcaaa

SEQ ID NO: 200665 - DNA, 75 bp, Artificial Sequence
  Synthetic
attataatcagaaaaaaattaaaagaaaatacattactaataaaaacttttcctatcgttcggtatcgatctctc

SEQ ID NO: 200666 - DNA, 75 bp, Artificial Sequence
  Synthetic
caagtagtcgatagtaatctaaatgaatatgtccaatttaatgattcaaacgacgagagagatgtttttggtgat

SEQ ID NO: 200667 - DNA, 75 bp, Artificial Sequence
  Synthetic
atattatagtaaatttaatgcaaatttgacgatcaatgatgaacatcatgcaagacatctacttcaaatgaactc

SEQ ID NO: 200668 - DNA, 75 bp, Artificial Sequence
  Synthetic
aggggagaagagatatggatactaatctaaaaaattaaaaatatctaatataggtccggaaaggttgtaaatcga

SEQ ID NO: 200669 - DNA, 75 bp, Artificial Sequence
  Synthetic
atggagacctccgcatttccaactagattagatacctactgctcagagttttccataccattttttgatttaaaa

SEQ ID NO: 200670 - DNA, 75 bp, Artificial Sequence
  Synthetic
gctcccacttttggattcagccattactagattgtaaagtaggatttttggatgatgccacatacccttgctgga

SEQ ID NO: 200671 - DNA, 75 bp, Artificial Sequence
  Synthetic
ttaagatgcattttttgtagaagatattgtactttaaaagaattagcatccttttttgagaaacagctgagtctg

SEQ ID NO: 200672 - DNA, 75 bp, Artificial Sequence
  Synthetic
cgtttattgatgcaaatatgcgaaatgcattagatggaaaccctatgtctgtggattcgaagcataaagcgccac

SEQ ID NO: 200673 - DNA, 75 bp, Artificial Sequence
  Synthetic
gtttggaaggaaaatgtttgccatgcctgttgcgaaagctgtttgtctttaacggcgaaatatgaatcagagaat

SEQ ID NO: 200674 - DNA, 75 bp, Artificial Sequence
  Synthetic
agcaatataatttaccacctctactgattactagtaatgttgatgtattaaaagaagaatcattacgatatttac

SEQ ID NO: 200675 - DNA, 75 bp, Artificial Sequence
  Synthetic
tattttcaatgcacttgcaaagtgcaagatttgcatgggctattagaaaaaccattgaatgaaattaccattcga

SEQ ID NO: 200676 - DNA, 75 bp, Artificial Sequence
  Synthetic
acagtagagtaacatgttttaaattccccaataaattaccatttgattcacaaaataatcctttatataaattta

SEQ ID NO: 200677 - DNA, 75 bp, Artificial Sequence
  Synthetic
tgtttttactgttatgacttgcttgacctacctaccaaatatgatctgattgcaagagggtatttagcatgttta

SEQ ID NO: 200678 - DNA, 75 bp, Artificial Sequence
  Synthetic
ctgaccaggtttggaaagcgtttttcctgaggcttggcaaacaattagacctcgaggacgacgacgaaaatgaat

SEQ ID NO: 200679 - DNA, 75 bp, Artificial Sequence
  Synthetic
gtcagaggacattggagagctccttgtagaagctgtttgaaaagacaattttggtgttaagatgatgggccaaac

SEQ ID NO: 200680 - DNA, 75 bp, Artificial Sequence
  Synthetic
cagaacgacctgaaagaacgtttagatgcactgcaagcatctctgatgactctttatgaaacaggtcccaaagat

SEQ ID NO: 200681 - DNA, 75 bp, Artificial Sequence
  Synthetic
ggtaacgttaaaggatatcgaattaggggaacctttggaagatctagtgatgccagcccatctattgtgtgaaga

SEQ ID NO: 200682 - DNA, 75 bp, Artificial Sequence
  Synthetic
ttaaaatcacaaataaagcactttgaacttttgagaaaagaaagtgctcttgaatattatgctagaaaagaagga

SEQ ID NO: 200683 - DNA, 75 bp, Artificial Sequence
  Synthetic
agagtcactgtcatcggacgacaccccagaggaggagtcattgtcaccttaccaggttgacactatttgtaattc

SEQ ID NO: 200684 - DNA, 75 bp, Artificial Sequence
  Synthetic
tatacatctttaggcttgcaacacctaccaacactgcaggtgtcagagcacaatgctaaaactgcaattagaatg

SEQ ID NO: 200685 - DNA, 75 bp, Artificial Sequence
  Synthetic
ctgtaacaaacgcattagactgtgtgtgttagctacaactggagcaattcacttattggagcaacttttgtttca

SEQ ID NO: 200686 - DNA, 75 bp, Artificial Sequence
  Synthetic
agtttaattttacagagtctagcaaaatcacaatatgccaatgagcaatggactcttgctgacacaagtgccgac

SEQ ID NO: 200687 - DNA, 75 bp, Artificial Sequence
  Synthetic
cgacttgtcccttgtgtgcccgcactgttccagggacattttgcgccatgggagaacccactaaaggtactgttt

SEQ ID NO: 200688 - DNA, 75 bp, Artificial Sequence
  Synthetic
agatttgattccccacccagaaattgctttaaaaaagacagttatgaagtggaagtgtggtttgatggaaacccg

SEQ ID NO: 200689 - DNA, 75 bp, Artificial Sequence
  Synthetic
ctataaactctttggatgacagtgcatggtttattgtgaatgaagctgagtgtgagaatagaaataatacattgg

SEQ ID NO: 200690 - DNA, 75 bp, Artificial Sequence
  Synthetic
aaaaatgctttcccatacatcaattggagatggatttattatcaggatgacaaggacgaatggcataaaaccgca

SEQ ID NO: 200691 - DNA, 75 bp, Artificial Sequence
  Synthetic
atgaactgtttgatgaaagcacagactgctctaatatatcaaatctaatagacgatgtggatgaactcgatcagg

SEQ ID NO: 200692 - DNA, 75 bp, Artificial Sequence
  Synthetic
ggagaaacagattataatggactgtatttcacagaaagggatgggactaaaacctatttcatactattttctagt

SEQ ID NO: 200693 - DNA, 75 bp, Artificial Sequence
  Synthetic
gaaattccctggcactgttcaactctcaaataacgcaggattgtaacagagcagtaactgtgttaaaacgaaagt

SEQ ID NO: 200694 - DNA, 75 bp, Artificial Sequence
  Synthetic
gatgctgatagatatggaaattcaggaatatggactgtaaatgttaacaatgaacaaatcttcccttctgttgcc

SEQ ID NO: 200695 - DNA, 75 bp, Artificial Sequence
  Synthetic
atgttcaaagtcctccgccgccaagtgttgcggctcttagtccaaggttggaagcaataagaatttctcctcaaa

SEQ ID NO: 200696 - DNA, 75 bp, Artificial Sequence
  Synthetic
agttcttctaggaggtcttcacctgtctccccgaaaaccctcggggacacagacaggagatcaagcagccccacc

SEQ ID NO: 200697 - DNA, 75 bp, Artificial Sequence
  Synthetic
gatccagcagcagcaaaagaaaactgtttcaggacagtggactaggagacgatgaagctacaaattcttttaacc

SEQ ID NO: 200698 - DNA, 75 bp, Artificial Sequence
  Synthetic
acctacaccaagaccccgcagaaagacggaggaagatcgattcagcaggaggaggcaagcactagctctgccacc

SEQ ID NO: 200699 - DNA, 75 bp, Artificial Sequence
  Synthetic
aggtagagactttatcagatgaaactgtggctccctcaggcgccacaagtagcactgccttacaggatattttgt

SEQ ID NO: 200700 - DNA, 75 bp, Artificial Sequence
  Synthetic
aggacatcaggaaggagacgacgacgacgaggagaaggagaaccgaccaccagtaagagaagaagaagaggagaa

SEQ ID NO: 200701 - DNA, 75 bp, Artificial Sequence
  Synthetic
caagtagcaatcagaaagcaaagttgttagcgaaatttgaagagttctatggggttgcatacaatgaaattactc

SEQ ID NO: 200702 - DNA, 75 bp, Artificial Sequence
  Synthetic
cgtcatatcctctctgctgaagaggttggaagtagccatcgatctgttccacgatcaggtctctcaagaattgaa

SEQ ID NO: 200703 - DNA, 75 bp, Artificial Sequence
  Synthetic
gcaaatttaaaagtgataaatctatgtgtgaaaactggataataggggtctttgcagctgcatacgaagtgttag

SEQ ID NO: 200704 - DNA, 75 bp, Artificial Sequence
  Synthetic
agacttgaagaggaagctagggatccaccaatcctcgtggtgaaggggcctgctaatccattaaagtgttggagg

SEQ ID NO: 200705 - DNA, 75 bp, Artificial Sequence
  Synthetic
aaggttcaaaacaattgttgcagcagtattgcgactatattcagtttttacaatttgatttctccggtttgtatt

SEQ ID NO: 200706 - DNA, 75 bp, Artificial Sequence
  Synthetic
tatagatgtgacaaaaaatataaatccttttatttgtgtatgacaactgtttttcgatgggtttccaatgaagta

SEQ ID NO: 200707 - DNA, 75 bp, Artificial Sequence
  Synthetic
tgttgcagttcaaacactccaaaagtagagaaactgttacaaaattattttgtaaattgttaaatattcaagcat

SEQ ID NO: 200708 - DNA, 75 bp, Artificial Sequence
  Synthetic
gatttagcagatgggagagtattggtagcttttgcaaacagtaatcaacgcagccggtttattgacactgttcca

SEQ ID NO: 200709 - DNA, 75 bp, Artificial Sequence
  Synthetic
tacaaatgatgtgtgatccaccaaaaattagaagtgtaccagccgcattgtacttttataaacaaacaatgactg

SEQ ID NO: 200710 - DNA, 75 bp, Artificial Sequence
  Synthetic
cttcctaagggtacctccatgtgtatgggaaatcttgaatgcttataaaatgtatcgcagacgaataaaacgagc

SEQ ID NO: 200711 - DNA, 75 bp, Artificial Sequence
  Synthetic
ggaaatcatatatttatggaacattacctgattggattgctaaactaacacaattaaatcatcaaatggcttctc

SEQ ID NO: 200712 - DNA, 75 bp, Artificial Sequence
  Synthetic
atctgtaacagatatttataagtcgtgtgtccaaggtggtgattgtccaaccgatgtgaaaaataaagtggaggg

SEQ ID NO: 200713 - DNA, 75 bp, Artificial Sequence
  Synthetic
aagcggaatcatttgatttaagtcaaatggtgcagtgggcctatgataaccaaatgacagatgaaccagccattg

SEQ ID NO: 200714 - DNA, 75 bp, Artificial Sequence
  Synthetic
gactacatgggcagacacgttgttgaaggtgtttgggagtatattatacttaggtaacttgggtattggtacggg

SEQ ID NO: 200715 - DNA, 75 bp, Artificial Sequence
  Synthetic
catactattatgccttattagcagaagaagatacaaatgctgcagcatttttaaaaagtaataatcaggttagat

SEQ ID NO: 200716 - DNA, 75 bp, Artificial Sequence
  Synthetic
aagaggaagtggtggatcctttgggtatagaccatttaatgctcaaacacctagggagggaacatctaccatagt

SEQ ID NO: 200717 - DNA, 75 bp, Artificial Sequence
  Synthetic
atgtaagagattgttgtgctatggtaaaaatgtttttaagacaagaaatgagaaacatgagtatgtcacaatgga

SEQ ID NO: 200718 - DNA, 75 bp, Artificial Sequence
  Synthetic
taggccacgtcctaccatacccacggttgatattgttggccccgcagacgtccttcctgttgctccagacgcccc

SEQ ID NO: 200719 - DNA, 75 bp, Artificial Sequence
  Synthetic
tatttaagtgttgtaatgaatgtgaaggagaagaaaattggaaagttattattgactttctaaaattccaacaaa

SEQ ID NO: 200720 - DNA, 75 bp, Artificial Sequence
  Synthetic
tgcaatagttcctttaagtgaggggattcctgaaacaggaatcattgatacgcctgcggctggtccaggattaga

SEQ ID NO: 200721 - DNA, 75 bp, Artificial Sequence
  Synthetic
ttaatattgtagaatttctgtgtgcattaagatcattttttaaaaaaataccaaagaaaaattgtattttaatat

SEQ ID NO: 200722 - DNA, 75 bp, Artificial Sequence
  Synthetic
ttccacaagcattgacataacgacagctgttgaccctatatctgaggtgacaggtgtaggtgaacatccaaatat

SEQ ID NO: 200723 - DNA, 75 bp, Artificial Sequence
  Synthetic
atggtccaccagatactggtaaatcttatttttgcttttcattaattaaatttcttagaggtaaagttgtttcct

SEQ ID NO: 200724 - DNA, 75 bp, Artificial Sequence
  Synthetic
cattaatgtttcagaagatgtagctcaaatagatgtacaaataacaccaccgcctcctaaaaaaatagctttaga

SEQ ID NO: 200725 - DNA, 75 bp, Artificial Sequence
  Synthetic
ttttaaacaagcattctaccttttggttacagccattattagatagtaagataggatttctagatgacgctacat

SEQ ID NO: 200726 - DNA, 75 bp, Artificial Sequence
  Synthetic
tcctagcatctcacacaccacagatgtggaagctactagaatatctcatgtagattcagattataatgtttttgt

SEQ ID NO: 200727 - DNA, 75 bp, Artificial Sequence
  Synthetic
atccatgttggatgtacattgatgaaaatatgagaaatgcattagatggtaatactatgtgtatagatcaaaaac

SEQ ID NO: 200728 - DNA, 75 bp, Artificial Sequence
  Synthetic
aaatccagcttttaatggtgtacacattggtgatccagaatacattgaattagaacaaattaatactatggcgca

SEQ ID NO: 200729 - DNA, 75 bp, Artificial Sequence
  Synthetic
acaaggctccacaacaatatagtttacctccattttttattactagtaatgttgatgtaaaagccaagaatactt

SEQ ID NO: 200730 - DNA, 75 bp, Artificial Sequence
  Synthetic
gtttgaaatagatgagggacctttaagaagtacacctttatctgaccgcgtcatctccagggcgcgagatttata

SEQ ID NO: 200731 - DNA, 75 bp, Artificial Sequence
  Synthetic
tgagatatttacatagtagaattatagcgtttgagttttctaataagttacctatggataatgaaaataatcctg

SEQ ID NO: 200732 - DNA, 75 bp, Artificial Sequence
  Synthetic
tcagagatatgttcaacaggttccagctcgtggtgctgacttagaaggcctaacctcccgcgcttctacgtttga

SEQ ID NO: 200733 - DNA, 75 bp, Artificial Sequence
  Synthetic
tgtacaaatttacagatcaagcttggaaaggctttttccttaagctgcaaaagcatttagatcttcaacccgaag

SEQ ID NO: 200734 - DNA, 75 bp, Artificial Sequence
  Synthetic
atttacaaatcccgcctttgaaggtgatttgacagacatattcaatgatgatttagcagaattagctgacaactc

SEQ ID NO: 200735 - DNA, 75 bp, Artificial Sequence
  Synthetic
ataatgaatcagaacgacctgagagaacgtttagatgcactacaagagcaattaatgactctctatgaattggga

SEQ ID NO: 200736 - DNA, 75 bp, Artificial Sequence
  Synthetic
ctctagacagactattgcatttacagaacagccacgacttttagaaacagctgacagaactattcgtgtaagccg

SEQ ID NO: 200737 - DNA, 75 bp, Artificial Sequence
  Synthetic
cccaccgatttatcctctcaaataaagcattaccaattgttaagaaaagaaagtgtattggagtattatgctaga

SEQ ID NO: 200738 - DNA, 75 bp, Artificial Sequence
  Synthetic
cttaggaagacgtcctggaatgactactcgcagtggtcttaatataggacaacgggtgcatgtgtatgtagacat

SEQ ID NO: 200739 - DNA, 75 bp, Artificial Sequence
  Synthetic
aaagaaggatatgaagtgttaggtctacatcatctaccagttcttaaagtctctgaacataatgccaagcaagca

SEQ ID NO: 200740 - DNA, 75 bp, Artificial Sequence
  Synthetic
aagtcctatccccaaagattctgttgaactacaaacatttggggagtttagtcatgatagttctataatagatga

SEQ ID NO: 200741 - DNA, 75 bp, Artificial Sequence
  Synthetic
ataaaaatgattttgcatttagaaagtcttgcaaaatcagcatataaacatgaaacgtggacattgaatgataca

SEQ ID NO: 200742 - DNA, 75 bp, Artificial Sequence
  Synthetic
attgactacctctagctttattagtccctttgaaaggaatatccaggaaggggatgtattagatactttagagga

SEQ ID NO: 200743 - DNA, 75 bp, Artificial Sequence
  Synthetic
agtgcagatcgtttcatgtctccacccagaaactgctttaaaaaggacagttttgaggtcactgtttggtttgat

SEQ ID NO: 200744 - DNA, 75 bp, Artificial Sequence
  Synthetic
agattttacaggtacacacctagttatggtgaatggcgaagttccagaggataatatagaaataccaacattagc

SEQ ID NO: 200745 - DNA, 75 bp, Artificial Sequence
  Synthetic
cataacccacaaaacgcatttccctatattaattggaaatggatatattaccaggacaataatgatcaatggcat

SEQ ID NO: 200746 - DNA, 75 bp, Artificial Sequence
  Synthetic
tccagaatttaatatgaaggtatttgtgaatgattatgcagcaaatattttttcatatacaccattatttaatgg

SEQ ID NO: 200747 - DNA, 75 bp, Artificial Sequence
  Synthetic
aaagtgccaggaaggactgatcataatggactatattttatagagcatgataatacagttacatattttctgtta

SEQ ID NO: 200748 - DNA, 75 bp, Artificial Sequence
  Synthetic
tcccatacagtttcctagcccttacacaccattgggccctgctgttggcttgacagtaaattttgatgattttga

SEQ ID NO: 200749 - DNA, 75 bp, Artificial Sequence
  Synthetic
tttgcaaaagatgctgagagatatggaaaaacaaaggagtggactgttaatattggaaatgaacaaattcttcct

SEQ ID NO: 200750 - DNA, 75 bp, Artificial Sequence
  Synthetic
tgacagtaaattttgatgattttgatttgcatccttctttattaagaaaacgaaaaaggtctattctctgatttt

SEQ ID NO: 200751 - DNA, 75 bp, Artificial Sequence
  Synthetic
ccctctgttaccagctcttctaggcggtctctatccgactcccctgaggtcaacaggggggccagtacctccacc

SEQ ID NO: 200752 - DNA, 75 bp, Artificial Sequence
  Synthetic
tacgccgaggccgaagaggaaaaccgacgaggatctttacaaccgcagacgacaagccctagcactaccacgtac

SEQ ID NO: 200753 - DNA, 75 bp, Artificial Sequence
  Synthetic
aacagatgaatatgttactcctacaaatatttattttcatgctaatacagagcgtttgcttacggtgggccaccc

SEQ ID NO: 200754 - DNA, 75 bp, Artificial Sequence
  Synthetic
tcaccatcaagaagacgacgacgacgaggacaaggagaatcaaccaccaataaaagacgaagacgagctgaaaga

SEQ ID NO: 200755 - DNA, 75 bp, Artificial Sequence
  Synthetic
ctattacgatatagttgattccgtggatggcaaaactgttactgtgcctaaggtttcagctaaccagtatagagt

SEQ ID NO: 200756 - DNA, 75 bp, Artificial Sequence
  Synthetic
gacggaggagctgatacagtttctcctgacgaagttgggcaaagccatcaactcgtacgaagtacaggtcttaca

SEQ ID NO: 200757 - DNA, 75 bp, Artificial Sequence
  Synthetic
tttacgcttgcgtttaccagatcctaataagtttgctttaatagatactactatatatagtcctgaaagagagcg

SEQ ID NO: 200758 - DNA, 75 bp, Artificial Sequence
  Synthetic
cgaactgagagacttaaagaagaggctaaggatcccccaatagtgtccatcagtggtcccgcaaacaaacttaag

SEQ ID NO: 200759 - DNA, 75 bp, Artificial Sequence
  Synthetic
tttagtatggcgtttacaaggtattgaaattgataggggtggtccccttggggttggcactactggtcatccact

SEQ ID NO: 200760 - DNA, 75 bp, Artificial Sequence
  Synthetic
tgctggaggtatagatgtggtttaaaaacctctaaaaattatacttatatgagctcagtgtttaaatggataact

SEQ ID NO: 200761 - DNA, 75 bp, Artificial Sequence
  Synthetic
gtttgataaactgggtgacactgaaaatccaacggcctatcaaaatgtcttaccaagtgcaatagataataggca

SEQ ID NO: 200762 - DNA, 75 bp, Artificial Sequence
  Synthetic
ggtgacgtaggcttaggagatggtagaatgcttgtagcttttgctaatacacaacaaagaaaccaatttataaat

SEQ ID NO: 200763 - DNA, 75 bp, Artificial Sequence
  Synthetic
aaatgtatctttcgaccctaaacagaatcagatgttcattgttggttgtgcacctgccattggccaacattggga

SEQ ID NO: 200764 - DNA, 75 bp, Artificial Sequence
  Synthetic
gctttaactttacctaaagatatgtcatattgcttaggaaatcttgaaaaattgtaattatgtacccagctaaac

SEQ ID NO: 200765 - DNA, 75 bp, Artificial Sequence
  Synthetic
tttagctaaaccatgtgacaaccctccgccagctcaaggttcctgtccaccaataaaacttgttcacagccctat

SEQ ID NO: 200766 - DNA, 75 bp, Artificial Sequence
  Synthetic
gaataaagcgagcttctgtgcaagacatttacagatcttgtgtgcaagggggggactgtccagaagatgtcaaaa

SEQ ID NO: 200767 - DNA, 75 bp, Artificial Sequence
  Synthetic
tcaggatggggacatgtgcgatattgggcttggtgctgttaattttagtactttttcagcgagtcgtgctgatgc

SEQ ID NO: 200768 - DNA, 75 bp, Artificial Sequence
  Synthetic
ataaagttgaaggaacaacatgggcagatacattgctaaaaatctttagcagtgttatatatttgggaaatttag

SEQ ID NO: 200769 - DNA, 75 bp, Artificial Sequence
  Synthetic
ccctctagaggttattaattccatttgcaaatggccggattttatacagatgacaaaggaaatttatggagatag

SEQ ID NO: 200770 - DNA, 75 bp, Artificial Sequence
  Synthetic
ggattggtactggtaggggaggtggtggttctatgggttacagacctttaggtgcacaaacaccaaatacaggaa

SEQ ID NO: 200771 - DNA, 75 bp, Artificial Sequence
  Synthetic
atgtttcttttatggcaagagggaacaggtctatgctagacacatgttttgtaaagatggagtaaatggtgatag

SEQ ID NO: 200772 - DNA, 75 bp, Artificial Sequence
  Synthetic
caggtgtacctgcacccccaagaccttctattccaacagtagacgttattggtcctcaagaagtactaccaatca

SEQ ID NO: 200773 - DNA, 75 bp, Artificial Sequence
  Synthetic
tattcctcagggtaatgaaccagatgatcatgacagattctttttagaacctgataacaatacaccacctaaaaa

SEQ ID NO: 200774 - DNA, 75 bp, Artificial Sequence
  Synthetic
ctccagatgcacctattatagttcctttagaagaaggaattccagatgttgggctaatagacacacctggaggag

SEQ ID NO: 200775 - DNA, 75 bp, Artificial Sequence
  Synthetic
tggattagggaatcacagttactttcctacacccagtggttctctagttactagtgaggcccagttatttaatag

SEQ ID NO: 200776 - DNA, 75 bp, Artificial Sequence
  Synthetic
gtcctggtttaggagcagaaacaatagatattaccacttctgtggatccattgtcagaggtaacaggtgttgggg

SEQ ID NO: 200777 - DNA, 75 bp, Artificial Sequence
  Synthetic
gccattttgggtgcacagagctcagggtaataataatggtgtcgcatggggaaacgaactttttgttaccattgc

SEQ ID NO: 200778 - DNA, 75 bp, Artificial Sequence
  Synthetic
aacaccctaatatacttggagcgtctgaggatgcggctcaaatagatgttcctatagatatccagctatctccac

SEQ ID NO: 200779 - DNA, 75 bp, Artificial Sequence
  Synthetic
agacaacactagaaacactaatttcatattgtctgtacacaccggtgattcccctattgataatcagtacaaata

SEQ ID NO: 200780 - DNA, 75 bp, Artificial Sequence
  Synthetic
caccacctaaaaagattgcactagatcctatggtgacagacaatatatcagttattgaaataaaagcatcccatg

SEQ ID NO: 200781 - DNA, 75 bp, Artificial Sequence
  Synthetic
taaagcaactgagttcagacactttcttaggcacacagaggaatttgaggttgaaataattatgcagctttgtaa

SEQ ID NO: 200782 - DNA, 75 bp, Artificial Sequence
  Synthetic
tagatcctgatattaatgtatttgttgatgcacaatttgatggcataaatataggccaccctgaagaaatagagc

SEQ ID NO: 200783 - DNA, 75 bp, Artificial Sequence
  Synthetic
gattactttggatgcagacattttagcacatattaatgctatgaatcccaatattctggatgaatggcagctggc

SEQ ID NO: 200784 - DNA, 75 bp, Artificial Sequence
  Synthetic
ttcaagaaataaatcttagagaggagtttgatattgacgagggccctttaaggagtactcctttatctaatcgtg

SEQ ID NO: 200785 - DNA, 75 bp, Artificial Sequence
  Synthetic
ctttgtacctgcgccaccgcagagtctaggagacacatacagatttattaaatctcaagcaaccatgtgtcccac

SEQ ID NO: 200786 - DNA, 75 bp, Artificial Sequence
  Synthetic
ccatctcaagggcacgcgatctttatcatagatttgttcaacaggttcctactcgttctgctgaccttttcagtt

SEQ ID NO: 200787 - DNA, 75 bp, Artificial Sequence
  Synthetic
agaagtacccccctctgaaaagccagacccatataagggcttaaatttttgggacattgatttgcaggatcgctt

SEQ ID NO: 200788 - DNA, 75 bp, Artificial Sequence
  Synthetic
ggtcttcccgcccaaatacatttgaatttgaaaatcccgcctttgatgacgtggtaaccgaagagtttagacgcg

SEQ ID NO: 200789 - DNA, 75 bp, Artificial Sequence
  Synthetic
tacttctgatttggatcagacacctttaggtaaaaagtttttgtaccaactaggaatgctcacaggtggtgttaa

SEQ ID NO: 200790 - DNA, 75 bp, Artificial Sequence
  Synthetic
acctagcgtctgtttcaaatgaagcagaagctcttcccacacaattcattggctctcccagattatcagagctcc

SEQ ID NO: 200791 - DNA, 75 bp, Artificial Sequence
  Synthetic
acgaattaggaatacctatacatccagtactccatctacgctcaggaaacgtagtgtaaagaggcgtcgtgtcac

SEQ ID NO: 200792 - DNA, 75 bp, Artificial Sequence
  Synthetic
cagatcaaacagtgcgaataagcagattaggcaaacaaccaggcataacaactagaagtggattgcagataggtc

SEQ ID NO: 200793 - DNA, 75 bp, Artificial Sequence
  Synthetic
tactagaggtgtgtaagactttcctgctgtacttgaactaactactgtgacctatttgtgcatttacactgtgac

SEQ ID NO: 200794 - DNA, 75 bp, Artificial Sequence
  Synthetic
aaaaaattcattattatcatgattttagtcctattcatgaaattattgaattgcaacctgtgggtgaatatagtc

SEQ ID NO: 200795 - DNA, 75 bp, Artificial Sequence
  Synthetic
aattacaatactgtgaatcctatcaatgtgaattccgtgccctccctataatgtaatgctgtgacttttcacctg

SEQ ID NO: 200796 - DNA, 75 bp, Artificial Sequence
  Synthetic
atgaggcaacaatagttgatcagcttgctacatcttcatttataaacccttttgaaaatgcaataaatggatttt

SEQ ID NO: 200797 - DNA, 75 bp, Artificial Sequence
  Synthetic
tattaattaagccctctaataaacaaaatattaatttgagtcataagtgttgttatttaaaggctgtgtgggtct

SEQ ID NO: 200798 - DNA, 75 bp, Artificial Sequence
  Synthetic
cagatgatcaattattagatacttttgaagaagatttttctcaaactcatttggttgttataggagggttcaggg

SEQ ID NO: 200799 - DNA, 75 bp, Artificial Sequence
  Synthetic
acttctatgcagacatataccacatctctctctgttactacctggtggcctgtatcatttacaaccgacctaggt

SEQ ID NO: 200800 - DNA, 75 bp, Artificial Sequence
  Synthetic
atgatgtggaaatgccctcaatagcaacaacttttacaattaacacatttgttaacattcctgacactagtatag

SEQ ID NO: 200801 - DNA, 75 bp, Artificial Sequence
  Synthetic
aagtacagtaaccgttatcggtttctatttgaagtttgtacacatataaccgttttcggtgggttagagaccgat

SEQ ID NO: 200802 - DNA, 75 bp, Artificial Sequence
  Synthetic
tgataaataacaccggcctacctttatcacctataaatattcctagtgaaaaaaatgtgccagttgtcccaggtt

SEQ ID NO: 200803 - DNA, 75 bp, Artificial Sequence
  Synthetic
ttcggtgttctatcactttaacttcgtgaacgcaccgaaatcggtcgcttgtatagcttgaggctgggtgaatta

SEQ ID NO: 200804 - DNA, 75 bp, Artificial Sequence
  Synthetic
ttgatattaatgtagaggcaagtgattttaatattcatccttcagtgttacggagaaaacgaaaacgctctatgt

SEQ ID NO: 200805 - DNA, 75 bp, Artificial Sequence
  Synthetic
ctcatttggcacactttactttgtagctggctgtgcgcctttgtaccgggagtggttgtacttttggcatcagaa

SEQ ID NO: 200806 - DNA, 75 bp, Artificial Sequence
  Synthetic
tttaattttacagatggctacttggaactccaacgttggaagactttatttgcctccagctaaacctgtggctcg

SEQ ID NO: 200807 - DNA, 75 bp, Artificial Sequence
  Synthetic
tgattgttgttaacaataagactatatacaaacgttggaaccgagaccggtctatatattggggaagaaaagcca

SEQ ID NO: 200808 - DNA, 75 bp, Artificial Sequence
  Synthetic
atggccactgagcatccaagaacattggaggaatattgcttgcagtttgacactactttttttaatttgcatata

SEQ ID NO: 200809 - DNA, 75 bp, Artificial Sequence
  Synthetic
tgttatgtctactgatgaatatgttaagccaacaaatatctattttcattctagcacagaaagactattaactgt

SEQ ID NO: 200810 - DNA, 75 bp, Artificial Sequence
  Synthetic
taagactatatacaaacgttggaaccgagaccggtctatatattggggaagaaaagccaaatttgttcattactc

SEQ ID NO: 200811 - DNA, 75 bp, Artificial Sequence
  Synthetic
tcgtgtatattttgtagccgtttacttaactatcaagatcttgcaagtttttctcttaaacatcttagtttggta

SEQ ID NO: 200812 - DNA, 75 bp, Artificial Sequence
  Synthetic
tggtcatccatattttgatgtagtaggaggcgataataatgtccaagttccaaaggtttcagcaaatcaatatag

SEQ ID NO: 200813 - DNA, 75 bp, Artificial Sequence
  Synthetic
tttagagattctcagtattatgcttgttgtcgcaattgttgtcgcgtgtctgcgaggtttgagtttgagaatcat

SEQ ID NO: 200814 - DNA, 75 bp, Artificial Sequence
  Synthetic
agttatgagattattattaccagatcctaaccagtttgctttaatagacacaacaatatataatcctgaaagaga

SEQ ID NO: 200815 - DNA, 75 bp, Artificial Sequence
  Synthetic
taccaatgctctgttcaatctgtaaatattgaaactgttgcagaaaaagctttgaattgtcttattgttcgttgt

SEQ ID NO: 200816 - DNA, 75 bp, Artificial Sequence
  Synthetic
acgtttagtttggcgtcttcagggcattcaaattgaccgtggtggtcctcttggagtcggtagcacaggtcatcc

SEQ ID NO: 200817 - DNA, 75 bp, Artificial Sequence
  Synthetic
tacaattgtttaactttattggatactgctgaaaagtacgatattgtttgtagtggtggattatttcatttagta

SEQ ID NO: 200818 - DNA, 75 bp, Artificial Sequence
  Synthetic
tctttttgatagatttatggacactgaaaactctaataaatatcctaacttaaatgatggtgtaactgaacatcg

SEQ ID NO: 200819 - DNA, 75 bp, Artificial Sequence
  Synthetic
agaagtcagtggcgaggtttgtgcagagagtgtacaccaagatgattggggcacaacctgatatcaaagatattg

SEQ ID NO: 200820 - DNA, 75 bp, Artificial Sequence
  Synthetic
ccaaaacatttcctttgacccaaaacaaaatcagctatttattgtgggttgtgctccagccactggacagcattg

SEQ ID NO: 200821 - DNA, 75 bp, Artificial Sequence
  Synthetic
atttagatttacaagaattagtattgcctcaaaatcttttagctgaagaaagtttgtcgcctgatgctgatcctg

SEQ ID NO: 200822 - DNA, 75 bp, Artificial Sequence
  Synthetic
ggatgttacagatccctgcgatcttcctttacctaaaggtaattgtccacccattaaattaatacattctactat

SEQ ID NO: 200823 - DNA, 75 bp, Artificial Sequence
  Synthetic
aagaggaggagcaacaattatattgggttgacacctgttgcggtacctgtaaagcaactgtaagagtgtgtgttt

SEQ ID NO: 200824 - DNA, 75 bp, Artificial Sequence
  Synthetic
tgaggatggtgatatgtgtgatatagggttaggtgcagtaaattttgcatcgttttcggctagtagagccgatgc

SEQ ID NO: 200825 - DNA, 75 bp, Artificial Sequence
  Synthetic
ttgctacttcaactgctgtttgcacattgcaatttttattgcaaggacagctttcctttgtgtgcattctgtgtt

SEQ ID NO: 200826 - DNA, 75 bp, Artificial Sequence
  Synthetic
tcctttagaagtgattaattctacatgtaaatggccagattttattcaaatgactaaagaggtgtatgggaacaa

SEQ ID NO: 200827 - DNA, 75 bp, Artificial Sequence
  Synthetic
ccaaaggacgtcgccatggcagacctaactaaaggtactgaacaatttgaaactattgaaaaagatgatagttgg

SEQ ID NO: 200828 - DNA, 75 bp, Artificial Sequence
  Synthetic
attatttttttatggacggcgggaacaattgtatgccagacatttcttttgtaaggatggagtagttggcgacag

SEQ ID NO: 200829 - DNA, 75 bp, Artificial Sequence
  Synthetic
tatattgttagtgaagctgaatgtattactgatttaaattccttggataatatatttgaagagagtacagatggt

SEQ ID NO: 200830 - DNA, 75 bp, Artificial Sequence
  Synthetic
tattcctgaggggaatcctccagatgagcacggacgttttttttatccaaccacggctggcgcaccacctaataa

SEQ ID NO: 200831 - DNA, 75 bp, Artificial Sequence
  Synthetic
tctgttatttctgaattgattgatgatgtggataatgcttcacaggggaattccctggcgttttacaacagtaag

SEQ ID NO: 200832 - DNA, 75 bp, Artificial Sequence
  Synthetic
tggtattgcaccgtctacctactatacaacaccaagtggatctttagttagtagtgaatctcagatatttaacag

SEQ ID NO: 200833 - DNA, 75 bp, Artificial Sequence
  Synthetic
gttacggccgattgcaataaagcaatatcagagctaaaacgaaagtatattaaaagcccgcagcaatgcgttgca

SEQ ID NO: 200834 - DNA, 75 bp, Artificial Sequence
  Synthetic
acctttttgggttcataaggcacagggcaacaataatggtattgcttggaataataatttatttgttaccattgt

SEQ ID NO: 200835 - DNA, 75 bp, Artificial Sequence
  Synthetic
gatttgagtccgagacttgaagcagttaaaatttctgtggaaggaaaaagtaaaagacgattatttcaggacagt

SEQ ID NO: 200836 - DNA, 75 bp, Artificial Sequence
  Synthetic
tgataatactagagggaccaactttgtgttgtcagtttacaatggtgacaatactattaaccaggattatcaata

SEQ ID NO: 200837 - DNA, 75 bp, Artificial Sequence
  Synthetic
ggcattgaggaagatgaaactgcaaatgtttctcaggtacaagctgatactcagataagtgtacccgcaggagct

SEQ ID NO: 200838 - DNA, 75 bp, Artificial Sequence
  Synthetic
taaatccacagattttaggcattttatgagacacacagaggaatatgaagtagaaataacaatgcaactgtgtac

SEQ ID NO: 200839 - DNA, 75 bp, Artificial Sequence
  Synthetic
gatgaaacagttgatttgttaagatgtagtaatagaaaagctgtgttgtacagtaaatttaaagaattatatggt

SEQ ID NO: 200840 - DNA, 75 bp, Artificial Sequence
  Synthetic
agtgcctttagaggctgatgtgttagctcatattaatgcaatggacccttcaatattagaaaactggcagctggc

SEQ ID NO: 200841 - DNA, 75 bp, Artificial Sequence
  Synthetic
gtgagcttttccgagctaacgagattgtttaaaagtcacaaaacatgttcatctaattgggtagtggctgttttt

SEQ ID NO: 200842 - DNA, 75 bp, Artificial Sequence
  Synthetic
atttattccagctcctcctcaaggattggaggatacatataggtttattcagtcattagcagctatgtgtcctaa

SEQ ID NO: 200843 - DNA, 75 bp, Artificial Sequence
  Synthetic
aacgttacagaagaagtattaaatggctcaaaaatattgttacaaaaacatgttgattttatgcagttaattatt

SEQ ID NO: 200844 - DNA, 75 bp, Artificial Sequence
  Synthetic
agatgttcctcgtaagcagccagaagatccatataaggacaaaatattttggactattgacttaaaagataaatt

SEQ ID NO: 200845 - DNA, 75 bp, Artificial Sequence
  Synthetic
gttggactttatgcattatatttaattgagtttaagactgctaaaagtagagaaaccttaacaaaaatgttacaa

SEQ ID NO: 200846 - DNA, 75 bp, Artificial Sequence
  Synthetic
tactgcagaattagatcaaacaccacttggtaaaaagtttctttaccaaatgggacttgttaacaatacttctcg

SEQ ID NO: 200847 - DNA, 75 bp, Artificial Sequence
  Synthetic
caattattaaatgtggaagattatcaaatattatgtgacccaccaaaattaagaagtgtacctgttgcattatat

SEQ ID NO: 200848 - DNA, 75 bp, Artificial Sequence
  Synthetic
tatcaggaatatttacaaaccacctactccatcctctgctaccaggcgtaaaggaactaaaaggcggcgcactac

SEQ ID NO: 200849 - DNA, 75 bp, Artificial Sequence
  Synthetic
ttttataaaagatctatgtccaatataagttttaaatatggtaactttccagattggttatcaaatttagttcta

SEQ ID NO: 200850 - DNA, 75 bp, Artificial Sequence
  Synthetic
tactcgtgtgggctcttagtttctgtgacacacttgacccagttggaacttcactgtgaatgtgtaaccatacca

SEQ ID NO: 200851 - DNA, 75 bp, Artificial Sequence
  Synthetic
ttagatcaccaagttggtagtcaagaaacatttagtctttctgacatggttcaatgggcattcgatcatgactat

SEQ ID NO: 200852 - DNA, 75 bp, Artificial Sequence
  Synthetic
tttcaataaatgattgattattgactcatgagtttgttgatttacttgtgcacacattttatttacatatcagtc

SEQ ID NO: 200853 - DNA, 75 bp, Artificial Sequence
  Synthetic
cttgatgaatcacaaattgcttttaattatgctatggcagcgtcagaaaacgcaaacgctgcagcttttctgcaa

SEQ ID NO: 200854 - DNA, 75 bp, Artificial Sequence
  Synthetic
gttcaaaggttgctcgagaggtcatatctgctgtatttgatacccgaccgatttcggtaagtacaatacttatat

SEQ ID NO: 200855 - DNA, 75 bp, Artificial Sequence
  Synthetic
agcaataatcaagctaagtatttgaaagattgtgctattatggtaaaacattataaaagatatgaaatgcgccaa

SEQ ID NO: 200856 - DNA, 75 bp, Artificial Sequence
  Synthetic
aacaaccggttctggtcgtttagctcgagtgaaccattttgcgaccgttatcggtgcctgtgtctttaaatatgg

SEQ ID NO: 200857 - DNA, 75 bp, Artificial Sequence
  Synthetic
atgtcaatgagctgttggattaatagatgttgttcatcctacaatgaagaatctgattggaagcgtattgcacat

SEQ ID NO: 200858 - DNA, 75 bp, Artificial Sequence
  Synthetic
accgttttcggtcgctgattttcgcgccttttctaagccaccgttttcggtcgtttactagctgcagggtttgtg

SEQ ID NO: 200859 - DNA, 75 bp, Artificial Sequence
  Synthetic
tttctaagatttcaaaatgtaaattttcttgaattcctaattgcatttaaaccatttctaaaaggtacacccaaa

SEQ ID NO: 200860 - DNA, 75 bp, Artificial Sequence
  Synthetic
actcacataccggcctttgcttgtgcctggctgttcgccttggaacaggagtggcttaattctaaagttacaatt

SEQ ID NO: 200861 - DNA, 75 bp, Artificial Sequence
  Synthetic
aaaaattgtatggttatttggggacctcccgatactggaaaatcattattctgtttcagcttgttaaatttcttg

SEQ ID NO: 200862 - DNA, 75 bp, Artificial Sequence
  Synthetic
gttgttaataacaaccatcatctagccaaattcctcaaccgggatcggtctatatatttgggagactcagcacaa

SEQ ID NO: 200863 - DNA, 75 bp, Artificial Sequence
  Synthetic
caaccatcatctagccaaattcctcaaccgggatcggtctatatatttgggagactcagcacaaattcatttcag

SEQ ID NO: 200864 - DNA, 75 bp, Artificial Sequence
  Synthetic
atggctgcagaatatcctacatctgttggggactattgcaaacgatttgagataccatttgataatttaaccttt

SEQ ID NO: 200865 - DNA, 75 bp, Artificial Sequence
  Synthetic
aaaggtaaagtcatttctttcatgaacagtcaaagtcatttttggctaatgcctttgatagatggtaaaattggc

SEQ ID NO: 200866 - DNA, 75 bp, Artificial Sequence
  Synthetic
ccttgtttattttgtaaatctactctatcttctttacagcttcatcattttatgcataaacaattatctttagtt

SEQ ID NO: 200867 - DNA, 75 bp, Artificial Sequence
  Synthetic
ttgttagacgatgcaacatttgcttgttggcaatatatggatgttcacttaagaaacgctttagatggtaatgct

SEQ ID NO: 200868 - DNA, 75 bp, Artificial Sequence
  Synthetic
tggaagaatggggtttgctatgcctgttgtaatccatgcttaaaaattactgctaaatatgaatgtcaaactttt

SEQ ID NO: 200869 - DNA, 75 bp, Artificial Sequence
  Synthetic
gtatctattgatctaaagcataggcaacctgttcaactaagtttgcctccactactagtctctactaatgttgat

SEQ ID NO: 200870 - DNA, 75 bp, Artificial Sequence
  Synthetic
tttcagtgttatgttagtggttctcttattgaggattttcttggaatacctttgtggcttctcattgttagatgc

SEQ ID NO: 200871 - DNA, 75 bp, Artificial Sequence
  Synthetic
gttatgtcagaacaatccttgaaatatttacacagtagagtgaaatgttttaactttcctaataagttgccaaca

SEQ ID NO: 200872 - DNA, 75 bp, Artificial Sequence
  Synthetic
ttggaatgtctctcaaaattaagttatgttgaaaagcttgattgtatttgtgctggagaaaagttttatcttgta

SEQ ID NO: 200873 - DNA, 75 bp, Artificial Sequence
  Synthetic
acagatagtggtgctagtgtgtatgaaattactaatgcatcctgggcatgtttttttagaaagtttgcaaaccaa

SEQ ID NO: 200874 - DNA, 75 bp, Artificial Sequence
  Synthetic
agaggacattggagatcttattgcagagattgtttgggtaaacaatgattgggccgagccctaataatgatgata

SEQ ID NO: 200875 - DNA, 75 bp, Artificial Sequence
  Synthetic
ttagacatttcagaagatgatgaggatggaaactcaggagactctaacagaccgtttcaatgcactgcaagatgc

SEQ ID NO: 200876 - DNA, 75 bp, Artificial Sequence
  Synthetic
tagaattagatttgcatgatctggtattaccttctaatttgataagtgaagaaagtttgtcgcctgatgttgatc

SEQ ID NO: 200877 - DNA, 75 bp, Artificial Sequence
  Synthetic
aatattgaatctgattgaagaaaaccccagtgatttgaaatctattattcgttattgggaactaaatagaaaaga

SEQ ID NO: 200878 - DNA, 75 bp, Artificial Sequence
  Synthetic
ctgaagaggaggagcaattgccctttgcagttgaaactagttgtaagtcctgtggagcaggtgtaagatttacag

SEQ ID NO: 200879 - DNA, 75 bp, Artificial Sequence
  Synthetic
acacgtaacattatattatgctagaaaagaaggatttacacgtttaggcctacagcctgtcccaaccccagctgt

SEQ ID NO: 200880 - DNA, 75 bp, Artificial Sequence
  Synthetic
tgtgtgcaacacatgcagcaattcggaccttacaaatattattgcttcaagaactatctctgatctgtttgcggt

SEQ ID NO: 200881 - DNA, 75 bp, Artificial Sequence
  Synthetic
ctcagaatacaatgcaaaacaagcaatacaaatgcaactgctggtaaatagtttaagtaaatctgtgtttgctaa

SEQ ID NO: 200882 - DNA, 75 bp, Artificial Sequence
  Synthetic
gctcacggagtctcatacaacatggcagaccccactaaaggtacagatatgtgtgcattggagggtactagtcaa

SEQ ID NO: 200883 - DNA, 75 bp, Artificial Sequence
  Synthetic
agaaacttggacattatctgactgtagtgctgaacttataaatacactaccaaaagactgttttaaaaaacaagg

SEQ ID NO: 200884 - DNA, 75 bp, Artificial Sequence
  Synthetic
tggtatatattttctgaagctgagtgcatgggtagcttggacacgctggaggaattatttgataaaagttctgac

SEQ ID NO: 200885 - DNA, 75 bp, Artificial Sequence
  Synthetic
ttatactgtagaagtatggtatgataatgatagaaacaaggcatacccatatactaactggaaaaggatatatta

SEQ ID NO: 200886 - DNA, 75 bp, Artificial Sequence
  Synthetic
tctgatgtgtccaacctgatagatgatatggatgaatcggagcagggaaattccctggcactgtacaaccagcag

SEQ ID NO: 200887 - DNA, 75 bp, Artificial Sequence
  Synthetic
tcaagactcacatgacgaatggcaattaactgaaggaaaggtagatgaaaatggactttattatgatgaaaaaaa

SEQ ID NO: 200888 - DNA, 75 bp, Artificial Sequence
  Synthetic
gtaactgaggattctaataatgcaattgcacagctaaaacgaaagtatactaaaagtcctttgaaaaccaaaccg

SEQ ID NO: 200889 - DNA, 75 bp, Artificial Sequence
  Synthetic
tggtgacagagtttattttatgctgtttggggcagatgcagacaaatatggagtgacaaaagaatggactgtgca

SEQ ID NO: 200890 - DNA, 75 bp, Artificial Sequence
  Synthetic
tcagttgctgaactaagtccccaactggaagcggtcaccatatcaccacagaaatataaaagacgtttatttgtg

SEQ ID NO: 200891 - DNA, 75 bp, Artificial Sequence
  Synthetic
ttatagagatactactattgtctcctcttccagctccagcaggagggtcgcagactccagccaagccttcaccca

SEQ ID NO: 200892 - DNA, 75 bp, Artificial Sequence
  Synthetic
gacagtggaatagttgaagatgaaactgcaaattctgttgaaaaggtagtaggtgaagaggttaacactatcaat

SEQ ID NO: 200893 - DNA, 75 bp, Artificial Sequence
  Synthetic
accctctacctccgggtactccaagaccccatcgccgaagcgtcgacgagctgcagaagaggcagattcctcaac

SEQ ID NO: 200894 - DNA, 75 bp, Artificial Sequence
  Synthetic
aataatatggattctaatattactgttttgcaaagtagtagtaatcaaatacgtatgttagctaagtttaaagat

SEQ ID NO: 200895 - DNA, 75 bp, Artificial Sequence
  Synthetic
atcatcatcatcatcatcagccccatcagggtccccagcgtctaaccttcgagatcggggaggaggacaaggaga

SEQ ID NO: 200896 - DNA, 75 bp, Artificial Sequence
  Synthetic
atgtttggggtctcctactgtgagcttactagggtgtttaaaagtgataagtcttgtgatgataactgggttgta

SEQ ID NO: 200897 - DNA, 75 bp, Artificial Sequence
  Synthetic
acgatccgttcccttatcaaaaagacgaagacacaccagtgaatcagctggggaatctgctgtcccgtctccttc

SEQ ID NO: 200898 - DNA, 75 bp, Artificial Sequence
  Synthetic
aatgttgctgtagcctcggacgaaattattcaggcatcaaaaacaattctacaaaagtattgtgattacatacaa

SEQ ID NO: 200899 - DNA, 75 bp, Artificial Sequence
  Synthetic
tgaagtgggaacaggacatcgactacttgcgcgacaagctcttggaagagttcagcgacttcaagctgaggcttg

SEQ ID NO: 200900 - DNA, 75 bp, Artificial Sequence
  Synthetic
gtaattagctatgggtttcatggactatatttgttacaatttaaaacggcgaaaagtagagaaacagtcataaat

SEQ ID NO: 200901 - DNA, 75 bp, Artificial Sequence
  Synthetic
ggatccattcatcctaattttaaaaggtccttcaaataatttgaaatgctggagaaatagaaataaacataatca

SEQ ID NO: 200902 - DNA, 75 bp, Artificial Sequence
  Synthetic
ttgtttaaaaccgttcttaatattaatgaaaacgttattatgtgtaatcctcctaaaacaagaagtactgctact

SEQ ID NO: 200903 - DNA, 75 bp, Artificial Sequence
  Synthetic
tgtccatgtaaaagctagcagcaatgtttggagatggctgggggagggttatacatacagtagaatgcttttagc

SEQ ID NO: 200904 - DNA, 75 bp, Artificial Sequence
  Synthetic
gcattatacttttataaacttgctgttggaaatgggtcgtttacatttggagaaacccctgattggattgctaga

SEQ ID NO: 200905 - DNA, 75 bp, Artificial Sequence
  Synthetic
ttttgattcagaaacggaaagagaacgctttgtacagtttactaggttccctaaagacactacatatgcctatgg

SEQ ID NO: 200906 - DNA, 75 bp, Artificial Sequence
  Synthetic
catactatgttagaccatcagcttgcttcaacagctgagtcatttgagttatcacaaatgatacaatattgttat

SEQ ID NO: 200907 - DNA, 75 bp, Artificial Sequence
  Synthetic
aaatttagaatcattgtaaaatgtatagaacaaaaagagtaaagcgtgatactgttgaaaatatctatcaacaat

SEQ ID NO: 200908 - DNA, 75 bp, Artificial Sequence
  Synthetic
gatcataatcttgttactgaatgtgaaattgcatacaaatatgcatcaattgcagatgaagataaaaacgcagct

SEQ ID NO: 200909 - DNA, 75 bp, Artificial Sequence
  Synthetic
gcaaaatatctggtaactgcccacctgatgtagtaaataaagtagagcaaacgacccttgctgatctattattaa

SEQ ID NO: 200910 - DNA, 75 bp, Artificial Sequence
  Synthetic
gcatttctaaaaagtaatatgcaagtgaaatatgtaaaagattgttgtgcaatggttagatattataaaagacaa

SEQ ID NO: 200911 - DNA, 75 bp, Artificial Sequence
  Synthetic
aaatatttggaagtgtaatttatttgggtggattgggaattggcacaggttctggtgttggggcttcaagtataa

SEQ ID NO: 200912 - DNA, 75 bp, Artificial Sequence
  Synthetic
tgaaatatgtaaaagattgttgtgcaatggttagatattataaaagacaagaaatgaaagaaatgagtatttcag

SEQ ID NO: 200913 - DNA, 75 bp, Artificial Sequence
  Synthetic
aaccaattcctgaagcacttcctataccggaaggtgcaccaacaaatgaaataccattagaagaattaccatcag

SEQ ID NO: 200914 - DNA, 75 bp, Artificial Sequence
  Synthetic
aatggatatggaaatgttgtgatgaatgtgaaggtaatggtgattggaaagtgttagctcaattttttcgatatc

SEQ ID NO: 200915 - DNA, 75 bp, Artificial Sequence
  Synthetic
ttacaaggcccagcagaccaagcagacctaccacatttggtacacgtatagatcctattagctctgcaacaaatc

SEQ ID NO: 200916 - DNA, 75 bp, Artificial Sequence
  Synthetic
aagaaataagctttgtaagttttatgacagcgttaagagtgctattcaaaaatataccaaaaagaaattgtctag

SEQ ID NO: 200917 - DNA, 75 bp, Artificial Sequence
  Synthetic
gtccccggccagtaaatccacggggtccagctattgtacctcttagtgaagatggactaccagaacctgcaataa

SEQ ID NO: 200918 - DNA, 75 bp, Artificial Sequence
  Synthetic
tgtttcatggtccaccagatactggtaaatcatatatttgttcgtcattaacaaagtttctgcaaggtaaagtag

SEQ ID NO: 200919 - DNA, 75 bp, Artificial Sequence
  Synthetic
ttgggggcggtgcaagtaatgggtatgaggtattaactaatgtagatgcttttgaagacttaagtacagtaactg

SEQ ID NO: 200920 - DNA, 75 bp, Artificial Sequence
  Synthetic
tatcatttatgaatagagcaagccatttttggttacaaccattgcaggattgtaaactaggatttttagatgatg

SEQ ID NO: 200921 - DNA, 75 bp, Artificial Sequence
  Synthetic
gtcatcctacagttttacatggtcaggaagatgtagctgttttagaagtaacaccagtagaaggagtctcacata

SEQ ID NO: 200922 - DNA, 75 bp, Artificial Sequence
  Synthetic
ccacgtacccatgttggcaattcatggatattaatatgagaaatgcattagatggtaacagtatttcattagata

SEQ ID NO: 200923 - DNA, 75 bp, Artificial Sequence
  Synthetic
gaactgtattaggcacttctacacaagatgatatcatatctattattgacagtagtatttctgcaacaacagaaa

SEQ ID NO: 200924 - DNA, 75 bp, Artificial Sequence
  Synthetic
caaagcataaagcacctctgcaaatgaaattgccaccattattggtaactactaatgttgatgtatttgcagaag

SEQ ID NO: 200925 - DNA, 75 bp, Artificial Sequence
  Synthetic
ctatcaatgtttttgtaaatccagattttggaggagtggaaattggagaagaaatagaattaagtccaataaata

SEQ ID NO: 200926 - DNA, 75 bp, Artificial Sequence
  Synthetic
aaagtttaaaatatctaagaagtagattggtatgttttaaatttccaaataaattgccttttacagatgatggtg

SEQ ID NO: 200927 - DNA, 75 bp, Artificial Sequence
  Synthetic
ctatacaagaatttgaaattgaagagcagattcctagagaaagtactccatctcggatttttaacagaactctag

SEQ ID NO: 200928 - DNA, 75 bp, Artificial Sequence
  Synthetic
cattagtttatgaaattactgacaaaacatggaaatgtttttttagcaaatttgctgtgcaattagacctgacaa

SEQ ID NO: 200929 - DNA, 75 bp, Artificial Sequence
  Synthetic
ggcgcgccagacagttgtataatcgaatagttgagcaggctccaactcgaaacatagattttctaggtcaacctt

SEQ ID NO: 200930 - DNA, 75 bp, Artificial Sequence
  Synthetic
caagagaagatttggaaaatgaatcaggccgatctgaccgcgcgtttcgatgcactacaagagactctaatgact

SEQ ID NO: 200931 - DNA, 75 bp, Artificial Sequence
  Synthetic
cccgcgcaattttatttgagtatgataatcccgccttttccgatgatgtcactttgacctttgaaagagatttac

SEQ ID NO: 200932 - DNA, 75 bp, Artificial Sequence
  Synthetic
ctttatgagagaaatgccagagatcttgaatcccaaatattgcattgggaaacagttagaaaacaatatgtaact

SEQ ID NO: 200933 - DNA, 75 bp, Artificial Sequence
  Synthetic
aggaggtagcagctgcaccggatcctactttcacagatgttattcaactacagaaacctcagtttgctataaatc

SEQ ID NO: 200934 - DNA, 75 bp, Artificial Sequence
  Synthetic
atgtattatgctagaaaagagggtttcagaagcctaggcatgcaacccctgcctgctctaacagtgtctgaatat

SEQ ID NO: 200935 - DNA, 75 bp, Artificial Sequence
  Synthetic
aggaaggtttagtcagatttagtagacttggaaccagaggaaagattagtaccagaagtggtacaatattaaagc

SEQ ID NO: 200936 - DNA, 75 bp, Artificial Sequence
  Synthetic
aaagccaaagaaggaatacagatggttttacttttaagaagtctgcaaaaatcagagtttgccactgaggactgg

SEQ ID NO: 200937 - DNA, 75 bp, Artificial Sequence
  Synthetic
agaaggttcatttttattatgatttaagcccaatagcaccagtgcaagaaaacatagaattaaatgtgtttcagg

SEQ ID NO: 200938 - DNA, 75 bp, Artificial Sequence
  Synthetic
acattaatagataccagtgctgaactgttgcatactcctccaaaaaactgttttaaaaagggaggatatacagtg

SEQ ID NO: 200939 - DNA, 75 bp, Artificial Sequence
  Synthetic
actcgtcagatgcagtaactattgtagatgaactaagtagtagcacatttataaaccctctgtttgaagagaatt

SEQ ID NO: 200940 - DNA, 75 bp, Artificial Sequence
  Synthetic
gaagtgtactttgatgaaaatcctgacaatgtttttccttatacaaattgggactttatatattatcaggacaca

SEQ ID NO: 200941 - DNA, 75 bp, Artificial Sequence
  Synthetic
taggggaaagtgctctaattgatgaccttaatgaagtttttgaaaatgcacatctagctttgatagaagaaactg

SEQ ID NO: 200942 - DNA, 75 bp, Artificial Sequence
  Synthetic
aatgaaaagtggcataaaactgcaggactggtggactatgatgggatgtactttcaagagcctaatggagataga

SEQ ID NO: 200943 - DNA, 75 bp, Artificial Sequence
  Synthetic
aggaggatcaaatcattgtacctactttagtaacagactcagtaccaaagtttttttctaatgactacttttcca

SEQ ID NO: 200944 - DNA, 75 bp, Artificial Sequence
  Synthetic
acatatttccaattatttgagaaagatgcgttaagatatggcagcacaggtcgatggagtgtgcaatataaaaat

SEQ ID NO: 200945 - DNA, 75 bp, Artificial Sequence
  Synthetic
aattttcagtaattaacagtaacgaatctcctcctatgtcagtagatgaagcttccatttatccagcaattcaaa

SEQ ID NO: 200946 - DNA, 75 bp, Artificial Sequence
  Synthetic
caaactattttaccctccgcctctgtttctagttctacaaggaggtctgtcgacgaacctgacgaagccaggagc

SEQ ID NO: 200947 - DNA, 75 bp, Artificial Sequence
  Synthetic
tagatccatatggttctgactattatttacatccttctttaatgaaacggcggaagcgtaaatattcagacttac

SEQ ID NO: 200948 - DNA, 75 bp, Artificial Sequence
  Synthetic
gggccatccacatacccctctaccccaccgcaaatctcttctagacgatccgagaccgaggagagaggccttgtc

SEQ ID NO: 200949 - DNA, 75 bp, Artificial Sequence
  Synthetic
tttaattgtttttcagatgactctgtggatgcaacattctggaaaattatacctaccaccagcaaagccagtggc

SEQ ID NO: 200950 - DNA, 75 bp, Artificial Sequence
  Synthetic
tcatccacccttcaaacccccccacaaaccagtggtgaggttcgactacgacgacgacgaggaaaaggagaacga

SEQ ID NO: 200951 - DNA, 75 bp, Artificial Sequence
  Synthetic
caaagtattaaatacagatgattatgttgttggaacaaatctgtttttccatgcctcttctgaaagattattaac

SEQ ID NO: 200952 - DNA, 75 bp, Artificial Sequence
  Synthetic
accaccagaaagtcgcccaccaaaagacgacgaaccgacgaaacagacagcccagggttggagtctgtcccgtct

SEQ ID NO: 200953 - DNA, 75 bp, Artificial Sequence
  Synthetic
ggttggacacccttactttgaaattccaaatcaggctatacccggagctttagctgttccaaaagtctctggatc

SEQ ID NO: 200954 - DNA, 75 bp, Artificial Sequence
  Synthetic
cctgaggcagtgggaacaagacatcgaacggttccgtcaacaggtctatcaagacttagaagacttcaaattgag

SEQ ID NO: 200955 - DNA, 75 bp, Artificial Sequence
  Synthetic
tcaatacagagtttttagatgcttattaccagatcctaataaatttgcacttatcgaaaaatcaatatataatcc

SEQ ID NO: 200956 - DNA, 75 bp, Artificial Sequence
  Synthetic
gctcgggatccacctgcaatcatagttacaggtccggcaaatagcctaaaatgttggagatggaggcttaaaaaa

SEQ ID NO: 200957 - DNA, 75 bp, Artificial Sequence
  Synthetic
agaaagggaacgattagtttggaaacttaaaggcttacaattaggtcgtggtggaccgttaggggttggaaccag

SEQ ID NO: 200958 - DNA, 75 bp, Artificial Sequence
  Synthetic
tatagtagatattatgcacgtatgagcactgtatggagctgggctggggaagtatgtcctaaggcttctaaaaat

SEQ ID NO: 200959 - DNA, 75 bp, Artificial Sequence
  Synthetic
tggtcatcctctttttaataaagtgcttgacacagaaaatcctaatgcttatcctccagaacaaacagacgaaca

SEQ ID NO: 200960 - DNA, 75 bp, Artificial Sequence
  Synthetic
cgcatgcttatagcttttactgatgaaacacaaagaagtgtatttctaaaacttgtgtcattaccaaagcatacc

SEQ ID NO: 200961 - DNA, 75 bp, Artificial Sequence
  Synthetic
aaggcaaaatgtcagcatggatcccaaacaggttcagatgttaatagtaggttgcgaaccagctatgggtgagca

SEQ ID NO: 200962 - DNA, 75 bp, Artificial Sequence
  Synthetic
acatatggtttagcccagttgggaattttgtaacatcatgtataaacgggctagaagaactaaaagagactctgt

SEQ ID NO: 200963 - DNA, 75 bp, Artificial Sequence
  Synthetic
ttgggatgttgcaaagccgtgcgttggagaacaaaataatggcgattgtccacctattgaattagtcagttcagt

SEQ ID NO: 200964 - DNA, 75 bp, Artificial Sequence
  Synthetic
agataacctgtatagacattgtgctttgggtgctgattgtccaccagatgtacgaaataaagtggaaaacactac

SEQ ID NO: 200965 - DNA, 75 bp, Artificial Sequence
  Synthetic
aatacaagatggtgatatgtgtgacacaggatttggtgcagccaattttagacgattacaacaggacaaatcagg

SEQ ID NO: 200966 - DNA, 75 bp, Artificial Sequence
  Synthetic
tcttgctgacatacttttacagatttttggaagtgttatatatttgggtaatttgggaattggtagtggaaaagg

SEQ ID NO: 200967 - DNA, 75 bp, Artificial Sequence
  Synthetic
agttcctttagatatagtagatagtatttgcaaatggcctgatcttataaaaatggagcaagaagtatatggaga

SEQ ID NO: 200968 - DNA, 75 bp, Artificial Sequence
  Synthetic
gtcgggtggttctactggatattccactattactcctgcccctagacctattccgaagcctgctaggccatcacg

SEQ ID NO: 200969 - DNA, 75 bp, Artificial Sequence
  Synthetic
taaactattttttttcacaaaacgggagcaggcctatgccagacattattttgcacgagcgggtgatcctggaga

SEQ ID NO: 200970 - DNA, 75 bp, Artificial Sequence
  Synthetic
accgtttggggttcccttggatcctattgggggaggatatggcagtgaacctattgggagaggtgttcctactga

SEQ ID NO: 200971 - DNA, 75 bp, Artificial Sequence
  Synthetic
tgctatgcccgatggaacagtcaatcaggatatgttttattacagtcctgatcgttctcaaggcgcactacctca

SEQ ID NO: 200972 - DNA, 75 bp, Artificial Sequence
  Synthetic
tgttattgatcctctgtcgtcctctatagtacctttatctgaggatattggggagcctaatataataataactgc

SEQ ID NO: 200973 - DNA, 75 bp, Artificial Sequence
  Synthetic
gaacaagctagcatcccatatttacttcccaactgtaagtggctctctagtttctagtgaagcgcagctatttaa

SEQ ID NO: 200974 - DNA, 75 bp, Artificial Sequence
  Synthetic
tgatccaggcacatcattaggtggtggtgatgttgttaccagcagtaccacaattcttaatcctgcctttgaaaa

SEQ ID NO: 200975 - DNA, 75 bp, Artificial Sequence
  Synthetic
tagaccatattggttacaaaaagctcagggacccaacaatggtatttgttggaataataacttattcctgacagt

SEQ ID NO: 200976 - DNA, 75 bp, Artificial Sequence
  Synthetic
tgaaggactgcctgctgtgttttctaggggtgatgaaagcacagctattttagatgttattccagctgaacctcc

SEQ ID NO: 200977 - DNA, 75 bp, Artificial Sequence
  Synthetic
agttgataacaccagaaacacaaattttactatatcagtgtataagaatggcgcatctgtacccacgccatcaca

SEQ ID NO: 200978 - DNA, 75 bp, Artificial Sequence
  Synthetic
tgtcaaaaaaattgccatagactttacgactcctaatgatacagaaaatatagtcaccactttggctacagtggg

SEQ ID NO: 200979 - DNA, 75 bp, Artificial Sequence
  Synthetic
gtactcttataaagccagtgattttaaacagtatttaagacatgttgaagaatatgatgtagaattaatatttca

SEQ ID NO: 200980 - DNA, 75 bp, Artificial Sequence
  Synthetic
ttcagagtttaatgtatttgtggaccctttaggaacaggtgacacagtaggactcgaagaaatagagttaggccc

SEQ ID NO: 200981 - DNA, 75 bp, Artificial Sequence
  Synthetic
attgtgtaaagtgtcgctggaaccagatattcttgcgcatctcaatgtaatggacccttcaatacttgataattg

SEQ ID NO: 200982 - DNA, 75 bp, Artificial Sequence
  Synthetic
tttaaatgaactatctcaatttgatgtagaggaacccccctctactagtacgcctgctgacactgttagacgtgt

SEQ ID NO: 200983 - DNA, 75 bp, Artificial Sequence
  Synthetic
gcaattggcgttcgtaccgccgccacctcagagtattgaggacaattatagatatataagatcattggctactcg

SEQ ID NO: 200984 - DNA, 75 bp, Artificial Sequence
  Synthetic
tgcaaacagagccaaaacatactataacagatttgtagagcagttgccaacacggaataaagattttctattgca

SEQ ID NO: 200985 - DNA, 75 bp, Artificial Sequence
  Synthetic
cctcagagtattgaggacaattatagatatataagatcattggctactcgatgccctccagaggatcctgaagct

SEQ ID NO: 200986 - DNA, 75 bp, Artificial Sequence
  Synthetic
accttcccgcgcagttcagtttgaatttgaaaatcccgccttcactgatgaagtcagtctgcagtttcagcaaga

SEQ ID NO: 200987 - DNA, 75 bp, Artificial Sequence
  Synthetic
gaaaataaggacccttataaacaatacagcttttggcctgttgatttaactgaacggttttcagctgaattaagt

SEQ ID NO: 200988 - DNA, 75 bp, Artificial Sequence
  Synthetic
acagcttttggcctgttgatttaactgaacggttttcagctgaattaagtcaatttcccctgggtcctgaagctg

SEQ ID NO: 200989 - DNA, 75 bp, Artificial Sequence
  Synthetic
tttagatgaggtagcagctgcacctgatgatgactttagagatatacgtcatcttggcagaccacatctgtctgt

SEQ ID NO: 200990 - DNA, 75 bp, Artificial Sequence
  Synthetic
aaaataaggacccttataaacaatacagcttttggcctgttgatttaactgaacggttttcagctgaattaagtc

SEQ ID NO: 200991 - DNA, 75 bp, Artificial Sequence
  Synthetic
tactgaaggcgggaaaatacgttatagcagattgggaactagaggtactattacaaccagaagtggtttaactat

SEQ ID NO: 200992 - DNA, 75 bp, Artificial Sequence
  Synthetic
aatttcccctgggaagaaaatttttattccaaagtggattattcagaacatattctactacctcaggtacaaaga

SEQ ID NO: 200993 - DNA, 75 bp, Artificial Sequence
  Synthetic
tgggcaaaaggttcatttttattatgactttagcacaatcacttcaggtgagtctattgaattgcagcctattgg

SEQ ID NO: 200994 - DNA, 75 bp, Artificial Sequence
  Synthetic
gattgcgcagcagtatggccagtaacactacgcgtgcaaaacgcaggcgtgtaaaataataatataggaaatatg

SEQ ID NO: 200995 - DNA, 75 bp, Artificial Sequence
  Synthetic
agagcatagtaacattaatgtatttataaatcctttagaggaaagtacgtttatagattctgcaacagctaatac

SEQ ID NO: 200996 - DNA, 75 bp, Artificial Sequence
  Synthetic
ctgtctatgaatgttggtttggaatgcatttcaataaagttgctactgtgaaatttctgactcatggggtcgtta

SEQ ID NO: 200997 - DNA, 75 bp, Artificial Sequence
  Synthetic
aggcaatattggtatagaatacccggacgaggatttggtagacactttagttgaggactttagccaggcacactt

SEQ ID NO: 200998 - DNA, 75 bp, Artificial Sequence
  Synthetic
ttcagtctacacccgagtatatatggagagactccaacagggtaaacaacataatcaataaatcaatatagacat

SEQ ID NO: 200999 - DNA, 75 bp, Artificial Sequence
  Synthetic
aattatatcacaggaagacgaaacaggagaccattttgctattccttctttatcatctaatgttcctgttagagc

SEQ ID NO: 201000 - DNA, 75 bp, Artificial Sequence
  Synthetic
cacacctggcagagctgtcaaccgtttctggtaagaaacttggcgccaacggctattgcataccggttctggtac

SEQ ID NO: 201001 - DNA, 75 bp, Artificial Sequence
  Synthetic
atttgtaccagacataacgggaacattcacatcagatttaaattttaagaaaactataatagattcagtttatcc

SEQ ID NO: 201002 - DNA, 75 bp, Artificial Sequence
  Synthetic
agtaataaagatttttaaaagatacaacatgtgcagacaaactgagttgactcaaagtttggcaaataccgcttt

SEQ ID NO: 201003 - DNA, 75 bp, Artificial Sequence
  Synthetic
atttgttcctttagaaccttcttttgcagttgatgttttctatgatttttatttacatccagagttacaaaggcg

SEQ ID NO: 201004 - DNA, 75 bp, Artificial Sequence
  Synthetic
tgttactggctgtctgcctttgtaccgggagtggtacatatatttcctgtggcaatgattgttgccaacaatcat

SEQ ID NO: 201005 - DNA, 75 bp, Artificial Sequence
  Synthetic
caaacgaaggtattcagaaatattttaatgtttttcagatggctacctggatgcaaaatcgaggaaaattgtact

SEQ ID NO: 201006 - DNA, 75 bp, Artificial Sequence
  Synthetic
atcatcgcagtgcatataagtgaccgggagtggtatctataaaatgcagagagattctggatttatttgcagcag

SEQ ID NO: 201007 - DNA, 75 bp, Artificial Sequence
  Synthetic
atggaggccaatctgccacgcagtctaaatgaatattgtgactattttaagattaatttttttgatttacgattg

SEQ ID NO: 201008 - DNA, 75 bp, Artificial Sequence
  Synthetic
tgccaccggccaagccatctcccagagttttaagtacggatgaatatgtagagggaacacaattatacttttatg

SEQ ID NO: 201009 - DNA, 75 bp, Artificial Sequence
  Synthetic
cgttgcattttttgcttattttatacaagccttacggaccttgctgattttcatactaagaaacttagtatagtt

SEQ ID NO: 201010 - DNA, 75 bp, Artificial Sequence
  Synthetic
ctggttctgaaaggttgttaacagtgggtcatccatattttgatgtttataataatggtgatgaatcattaactg

SEQ ID NO: 201011 - DNA, 75 bp, Artificial Sequence
  Synthetic
tatagaaataattcgccatttgtttgctgtattaaatgtgctcgtcattctgcaagaattgatagagaaaaatat

SEQ ID NO: 201012 - DNA, 75 bp, Artificial Sequence
  Synthetic
taccaaaggtttctgcaaatcagtacagagtcatgaaactaaatttacctgatcctaataagtttgccctagtta

SEQ ID NO: 201013 - DNA, 75 bp, Artificial Sequence
  Synthetic
actttatgttctgtaaactgtgctattcttgatgctgtagttggaaagcctttaaaagaaattattattcgttgc

SEQ ID NO: 201014 - DNA, 75 bp, Artificial Sequence
  Synthetic
ataaatccctgtacaatcccgaaagggagaggctagtttggaaattgacaggattgcaaataggcagaggtggac

SEQ ID NO: 201015 - DNA, 75 bp, Artificial Sequence
  Synthetic
tgtacatgttttgcttcgttggatgatgctgaaaaagctgacgcatgtgctagagagcaagcagttttgttgata

SEQ ID NO: 201016 - DNA, 75 bp, Artificial Sequence
  Synthetic
ctattggtattagttcatcgggtcatcctctgtttaacaagtatggtgatacagaaaatccaaatatgtatcctg

SEQ ID NO: 201017 - DNA, 75 bp, Artificial Sequence
  Synthetic
aggggtaattggcgtacagagtgcagaaattgtaagtcatgaagggaattgtagctacaattccagatatatctt

SEQ ID NO: 201018 - DNA, 75 bp, Artificial Sequence
  Synthetic
ccaaacaagaagatgcagatgataatagaatggacgtgtcgatggatcccaaacagacacagcttttcatagttg

SEQ ID NO: 201019 - DNA, 75 bp, Artificial Sequence
  Synthetic
tagaaaatttggtattgcctgttaatttgctggctgctgaagagtcattgtcgcctgatattgaagcagaggtgg

SEQ ID NO: 201020 - DNA, 75 bp, Artificial Sequence
  Synthetic
gttgcaaacctccaataggtgaacattgggatgttggtaaaatttgtgaaaatgcacagccagaaaaagggtctt

SEQ ID NO: 201021 - DNA, 75 bp, Artificial Sequence
  Synthetic
agccagcaaatccttatagagttgacacctcgtgtggcaattgtaagagaggtgtaaggcttttttttgttgcaa

SEQ ID NO: 201022 - DNA, 75 bp, Artificial Sequence
  Synthetic
gtccaccgattcagttagtgcattctactattcaggatggtgatatgtgtgatataggatttggagcagcaaatt

SEQ ID NO: 201023 - DNA, 75 bp, Artificial Sequence
  Synthetic
cttctgcttcaattcgcacattgcatcttttgctgctggaagaattgcctgtgatctgtctagcttgctccagag

SEQ ID NO: 201024 - DNA, 75 bp, Artificial Sequence
  Synthetic
ttaaaaccctgcaagaagacaaatcaggtgtacccatggatattttaaatgaaacctgcaaatatccagatttct

SEQ ID NO: 201025 - DNA, 75 bp, Artificial Sequence
  Synthetic
aaatttgccaacatgggagacgttaacaaaggtactgatttaaataatattgacaatactgagtggtttattgtg

SEQ ID NO: 201026 - DNA, 75 bp, Artificial Sequence
  Synthetic
tgttaatgtctaaagataaatatggcgatagtctatttttttatggcagaaaggagcaactgtatgctaggcact

SEQ ID NO: 201027 - DNA, 75 bp, Artificial Sequence
  Synthetic
gaagaagcagactgtgtggataatagtttaacagctttagatgacttatttgaagaaagcacaaacgggtcagtg

SEQ ID NO: 201028 - DNA, 75 bp, Artificial Sequence
  Synthetic
tttttatgagaggaggtttggatggagattcttttccattaacaaactatatatatggtgctcagcagggaaagc

SEQ ID NO: 201029 - DNA, 75 bp, Artificial Sequence
  Synthetic
gtttcaaatttactagacgatgaacctgtggatcagggaaattccctggcactatacaacacacaaatcgcagat

SEQ ID NO: 201030 - DNA, 75 bp, Artificial Sequence
  Synthetic
ctcagaatactattgggccatataattactttgttactcctagtggctcattatattctacagattctcagcttt

SEQ ID NO: 201031 - DNA, 75 bp, Artificial Sequence
  Synthetic
gaatgcgacagagctattggggacttaaaacgaaagtatattgggagtccacaaaaatcaattgtagatttgagc

SEQ ID NO: 201032 - DNA, 75 bp, Artificial Sequence
  Synthetic
ttaatagaccatattggttaagtaaagcacagggtgctaataatggtgttttatggaataatcatatgtttataa

SEQ ID NO: 201033 - DNA, 75 bp, Artificial Sequence
  Synthetic
ccgagacttgcagctgtgcatatatcgcctcagagagtgtccaagaaaagattatttgaggacagtggaattgta

SEQ ID NO: 201034 - DNA, 75 bp, Artificial Sequence
  Synthetic
cagtgatggataacaccagaggcactaatataaatatttctgtgtacaaacaaaatgaagctatggctcaggatt

SEQ ID NO: 201035 - DNA, 75 bp, Artificial Sequence
  Synthetic
gaagatgaagcttcaaattctaatgaacttttgcaggtagaggcggagcatgggaaccgccataatgaatcccat

SEQ ID NO: 201036 - DNA, 75 bp, Artificial Sequence
  Synthetic
ataaatataaagcaaacgattttaggaattatttaaggcactgtgaagaatatgaagtggaattaatagtagaac

SEQ ID NO: 201037 - DNA, 75 bp, Artificial Sequence
  Synthetic
aacactgcgttgttggatattttaaagtgtaataatgctaaagcgttatttttaggcaaattcaaagatttattt

SEQ ID NO: 201038 - DNA, 75 bp, Artificial Sequence
  Synthetic
tctgtaaagtgcggttagatccagatgttttagcacacataaatgtaatgaacccttctattttagagaactggg

SEQ ID NO: 201039 - DNA, 75 bp, Artificial Sequence
  Synthetic
ggtgtatcatttactgatcttacaaggcaatttaagagcgataaaacatgttgtgaaaattgggttttagcactt

SEQ ID NO: 201040 - DNA, 75 bp, Artificial Sequence
  Synthetic
agttgtcattcattcctccagctccacaaggcattgaagatacctacagatacttgcaatcattagcaacttcat

SEQ ID NO: 201041 - DNA, 75 bp, Artificial Sequence
  Synthetic
tataaggtatcagatgaaatcataaacagttctaaaacaatattgaaacaacaatgtgaatatgtacagatcata

SEQ ID NO: 201042 - DNA, 75 bp, Artificial Sequence
  Synthetic
gccctagtgaattagtgcctcctgagcgtccagatccatatgaaggtttagtattttggaatataaacctagaag

SEQ ID NO: 201043 - DNA, 75 bp, Artificial Sequence
  Synthetic
atgtatgacattattacattgtatttgttgcaatttagagctgcaaaaagtagagatactattaacaaaatgttc

SEQ ID NO: 201044 - DNA, 75 bp, Artificial Sequence
  Synthetic
ataagttatcagaagaattgtctcagtttcctttagggaaacgatttttatatcaatcagggtattctacttcta

SEQ ID NO: 201045 - DNA, 75 bp, Artificial Sequence
  Synthetic
accacagtgtttgatatacatgttcttcaaattttaagtgacccacctagaagtagaagtgtggcagcagcatta

SEQ ID NO: 201046 - DNA, 75 bp, Artificial Sequence
  Synthetic
gaaaacgtaaactagaacctggttcctctggtgtaacagttaagaaaattagaactgtgaaacgaaagaaatcta

SEQ ID NO: 201047 - DNA, 75 bp, Artificial Sequence
  Synthetic
tttttttttactaaaagaaatagtaatgcttgtttttattttggtgagttaccagagtgggttgctaagcatact

SEQ ID NO: 201048 - DNA, 75 bp, Artificial Sequence
  Synthetic
agttatagtttgttaaatacttaatattactaatttcagatgtataaactgtgacattacaaaccttttcggttt

SEQ ID NO: 201049 - DNA, 75 bp, Artificial Sequence
  Synthetic
ttagtaaatcatcaggtagcagcggctgcagaaacgtttgaattgtcacaaatgatacaatgggcatatgataat

SEQ ID NO: 201050 - DNA, 75 bp, Artificial Sequence
  Synthetic
ggaaatatactgtgaacgtttctggtgtttttgtggaatgaaggataaataaactgctgacaatgcaactaatga

SEQ ID NO: 201051 - DNA, 75 bp, Artificial Sequence
  Synthetic
catctaaatgaagaccatgaaatagcgtatggttatgctcagattgcagacatagatgtaaacgctgctgctttt

SEQ ID NO: 201052 - DNA, 75 bp, Artificial Sequence
  Synthetic
gtcattgtggtcaacattctttcgccgcgcccggttgttatttagttggtctctaaaacacatctagacactcag

SEQ ID NO: 201053 - DNA, 75 bp, Artificial Sequence
  Synthetic
ttgaaaagtaatcaacaagcaaagtatgtgagagattgtgctcatatggttaggttatacagaagacatgaaatg

SEQ ID NO: 201054 - DNA, 75 bp, Artificial Sequence
  Synthetic
cagtgggcatttgccaaatactcggaaaaacaacgttttcggtaagtttttggcgccagcggcgaataacatacc

SEQ ID NO: 201055 - DNA, 75 bp, Artificial Sequence
  Synthetic
cgacaaatgagcatgtctcattggatacaaaaatgctgccgagagtgttctactactggagaatggaaaatcata

SEQ ID NO: 201056 - DNA, 75 bp, Artificial Sequence
  Synthetic
atttgtggttagctgtttcctgtgcaggtaagtgcaagttcaaactaaagataacatctttgttctggctgactt

SEQ ID NO: 201057 - DNA, 75 bp, Artificial Sequence
  Synthetic
gcatcatatttaagatatcaaaatataaatgttgttgcatttttaactgctttgagatctttctttaaatgtata

SEQ ID NO: 201058 - DNA, 75 bp, Artificial Sequence
  Synthetic
tcttggcgcgttctttataccgggagtggtatttggattacatcctttcatgattgttgccaacaattatttcat

SEQ ID NO: 201059 - DNA, 75 bp, Artificial Sequence
  Synthetic
cctaaaaaaaattgtatattattgtatggtcctccagatactggaaagtcatattttggttattcattagtacga

SEQ ID NO: 201060 - DNA, 75 bp, Artificial Sequence
  Synthetic
cgagagtggtataaattaagatgcgtttgcagatttttactcagtcttcatggctgcagaatatcctacatctgt

SEQ ID NO: 201061 - DNA, 75 bp, Artificial Sequence
  Synthetic
atggatcctcagtttcctactgctttagatcaatactgtaaaacgtttggggtatcgttttttgatttagaattg

SEQ ID NO: 201062 - DNA, 75 bp, Artificial Sequence
  Synthetic
tttttaagaggaaaagttatttcaatgatgaatcgccatagtcaattttggttaatgccactacaggatggtaaa

SEQ ID NO: 201063 - DNA, 75 bp, Artificial Sequence
  Synthetic
aattgtatcttttgtaaatatcctgtatgcttacaagatttggctgctttttatatgaaaaatttaagtttaatt

SEQ ID NO: 201064 - DNA, 75 bp, Artificial Sequence
  Synthetic
ataggatttttagatgactgtacttatagtgcatggcagtttatggatattaacatgagagctgcgttaggcggt

SEQ ID NO: 201065 - DNA, 75 bp, Artificial Sequence
  Synthetic
tggagagaaggaagatgttatgcttgctgctgtaaatgtgttaggctttctgctttatttgaatttcaacagcat

SEQ ID NO: 201066 - DNA, 75 bp, Artificial Sequence
  Synthetic
aatgacatttcgttagattcaaaacacaaagcaccagtacagcttaaactacctccattattagttaccagtaat

SEQ ID NO: 201067 - DNA, 75 bp, Artificial Sequence
  Synthetic
tgtcaatgttgtgttccatgtacttcgttgcctgatttaattaacaaacaacttaaagatattataattcgctgc

SEQ ID NO: 201068 - DNA, 75 bp, Artificial Sequence
  Synthetic
catgatgttatggctgatcaaacacttaggtacctacatagcagattaacagcttttaagtttcctaaccaaatg

SEQ ID NO: 201069 - DNA, 75 bp, Artificial Sequence
  Synthetic
agagactgttataatttgttgagttttgttgaaaagcttgattgtgtattgcatgaagagaatttctatcttgta

SEQ ID NO: 201070 - DNA, 75 bp, Artificial Sequence
  Synthetic
cctttagatgaatttggtaatccaatgtatataattaatgacgaaacatggaaatctttctttattaagcttgct

SEQ ID NO: 201071 - DNA, 75 bp, Artificial Sequence
  Synthetic
aggggacattggcggggattgtgcagatattgtatgtttaaacaatgattggagtagaacctacaattgcagata

SEQ ID NO: 201072 - DNA, 75 bp, Artificial Sequence
  Synthetic
gttcaattagacctacagtttgaagaagaagatgaatcaggcagacctgaccgagcgtttcgatgcactgcagga

SEQ ID NO: 201073 - DNA, 75 bp, Artificial Sequence
  Synthetic
ttgaattagatttacaggagttggttttgcctagtaatctactgagtaatgaggaatcattagaagaacaggtgg

SEQ ID NO: 201074 - DNA, 75 bp, Artificial Sequence
  Synthetic
ccagctcctgactctttatgaaacagctccaacagatattcagagtcagataactcattgggcattaactagaag

SEQ ID NO: 201075 - DNA, 75 bp, Artificial Sequence
  Synthetic
aggaggagcagcaagaatattataggattgacactcgttgtcacacttgtggaacaggtgtcagatgctgtgtat

SEQ ID NO: 201076 - DNA, 75 bp, Artificial Sequence
  Synthetic
attaaatgtattaatgtactatgcacgacaagaagggtatagaaatttaggacttcaagcattaccaacattagt

SEQ ID NO: 201077 - DNA, 75 bp, Artificial Sequence
  Synthetic
cagcaacaagctttggtattagacaattagagttacttctgatccacgaaggaatttctttttgctgccctgggt

SEQ ID NO: 201078 - DNA, 75 bp, Artificial Sequence
  Synthetic
ggtgtcagaatataatgcaaaagttgctataaaaatgatgatgctgttaaaaagcttgtctgaatcacaatatgg

SEQ ID NO: 201079 - DNA, 75 bp, Artificial Sequence
  Synthetic
gttccaggagacgatctttccaccatgggagactccaataaaggtacagaaaattgtgaaaatgtaaataataat

SEQ ID NO: 201080 - DNA, 75 bp, Artificial Sequence
  Synthetic
gaaagaaccatggactttagcagatgctagtgcagaactggtgttaacatctccaaaacatacatttaaaaaagg

SEQ ID NO: 201081 - DNA, 75 bp, Artificial Sequence
  Synthetic
gatgctagttggtatatattagaagaggcagaatgtgtggagccattagatagttttgaggaattgttcgataat

SEQ ID NO: 201082 - DNA, 75 bp, Artificial Sequence
  Synthetic
tgcatttcaagttgaagtgtattatgataatgatccacaaaatgctaatgtttatacacaatgggagcatatata

SEQ ID NO: 201083 - DNA, 75 bp, Artificial Sequence
  Synthetic
agtacaggatcagatatttctaatcttattgatgaaattgatgaaacagatgatggaaagtccctagcattgtat

SEQ ID NO: 201084 - DNA, 75 bp, Artificial Sequence
  Synthetic
ttatgaagacttaaatgatatatggcataaagttccaggtgacgttgaccataatggactatcatttacagatgt

SEQ ID NO: 201085 - DNA, 75 bp, Artificial Sequence
  Synthetic
aatgcacaggttaacgaggagtgtgagcaagcaattgccaagctaaaacgaaagtatttgaaaactccggaccag

SEQ ID NO: 201086 - DNA, 75 bp, Artificial Sequence
  Synthetic
tactggagataaaaattactttttattatttcatgaggatgcacaaagatattcaaatactggacaatggactgt

SEQ ID NO: 201087 - DNA, 75 bp, Artificial Sequence
  Synthetic
agtccagagtcagaatctgttgccgctttaagtccacgtttagaagctgttactttatcatctagaaagcaaact

SEQ ID NO: 201088 - DNA, 75 bp, Artificial Sequence
  Synthetic
aaaattcaaatctaccactatttcctctgttgttactagctctaggcaacagtcctccaaccagaaaagggacca

SEQ ID NO: 201089 - DNA, 75 bp, Artificial Sequence
  Synthetic
cagagcaaaaggcgattgtttgatgacagtggaatcctagaagatgaagctgcaaatactaatgaaaaggtagat

SEQ ID NO: 201090 - DNA, 75 bp, Artificial Sequence
  Synthetic
acaatccagaaggagagactcctctccggaagaagggacatcccgtgccttcaggagatctgaaagggatcctga

SEQ ID NO: 201091 - DNA, 75 bp, Artificial Sequence
  Synthetic
caagggaaccatagcggttcagaaaatggcgcgaaaaacaatatgtcagttttgcagatgtctaattggcgagca

SEQ ID NO: 201092 - DNA, 75 bp, Artificial Sequence
  Synthetic
agaaagtatatcaaccaccaccacatcgccaaccacgactagacaacgacgacgacgaagacgaggagaacgagg

SEQ ID NO: 201093 - DNA, 75 bp, Artificial Sequence
  Synthetic
actgcttattctaaaatatctaacctctttggtgtcagttttcatgagttaaccagagcatttaaaaataataaa

SEQ ID NO: 201094 - DNA, 75 bp, Artificial Sequence
  Synthetic
agatcaacaaggagaatcaacccccgagagacccagagccaaaagatccagagggtcctctccagtctctcctga

SEQ ID NO: 201095 - DNA, 75 bp, Artificial Sequence
  Synthetic
acatgctctccaaattgggttgttgggattgttagagctgcagaagaacttatagaaagttgtaaaatactatta

SEQ ID NO: 201096 - DNA, 75 bp, Artificial Sequence
  Synthetic
ggaggtgggcagcagacatcgatcagttccgaaacaccatcttggaagacttagaagacttcaagaggaagctag

SEQ ID NO: 201097 - DNA, 75 bp, Artificial Sequence
  Synthetic
cagcaacattgcaacttttttcaaattataactttagattttacatcaataattttattagaatttaagtctagt

SEQ ID NO: 201098 - DNA, 75 bp, Artificial Sequence
  Synthetic
ggatccacccgttttgtgtataaaaggtccagcaaataatttaaaatgttggaggaatagatttaatgttagatt

SEQ ID NO: 201099 - DNA, 75 bp, Artificial Sequence
  Synthetic
aaatgtagagaaacagtaaataaactctttgtaacattattaaatattgatgaatgtatgattatatctgaacct

SEQ ID NO: 201100 - DNA, 75 bp, Artificial Sequence
  Synthetic
tgcatctttgttttttaaagccagttctgtattcaaatggctaggtgacactgattgtccaactaacactagtag

SEQ ID NO: 201101 - DNA, 75 bp, Artificial Sequence
  Synthetic
cctaaaattcgtagtgtacctgttgcattatttttttataaatcatcttttggaaatgcttcatatgtgtttggt

SEQ ID NO: 201102 - DNA, 75 bp, Artificial Sequence
  Synthetic
aatgcttattgcttttcattctttaaatgaaagatctcgctttttgcagcttgtaactttacctaaaggtacatc

SEQ ID NO: 201103 - DNA, 75 bp, Artificial Sequence
  Synthetic
aaattcccagattgggttgctagacaaactatgatcaatcaccaaattgctggcgctgcagaccaatttgatttc

SEQ ID NO: 201104 - DNA, 75 bp, Artificial Sequence
  Synthetic
atattcatatggttcattagatagtctataagtgcataatgttaagagctcgtagacaaaaacgtgcatcaataa

SEQ ID NO: 201105 - DNA, 75 bp, Artificial Sequence
  Synthetic
tcaaaaatgacgcagtgggctttcgataacaatattgtggaagaatcagagatagcctataaatatgctattgct

SEQ ID NO: 201106 - DNA, 75 bp, Artificial Sequence
  Synthetic
atgatttgtatagaaattgtaggcttgggggtgattgtccagaagatgttaaaaataaagtagaaggaacaacac

SEQ ID NO: 201107 - DNA, 75 bp, Artificial Sequence
  Synthetic
gcagatacggatagtaatgcacaagcattcttgagatgcaataaccaattaagatatgttaaggattgtagtcat

SEQ ID NO: 201108 - DNA, 75 bp, Artificial Sequence
  Synthetic
ttgctgatcgtttattacaaatatttgggagtatactgtactttggcaatttaggaatagggactgggaagggaa

SEQ ID NO: 201109 - DNA, 75 bp, Artificial Sequence
  Synthetic
atggttaaattatacaaaagacaacaaatgaaagaaatgtctatggcagactggatctataaatgttgtgatgaa

SEQ ID NO: 201110 - DNA, 75 bp, Artificial Sequence
  Synthetic
ctggtggctttggtggttataaaccaattggtggaacagcaagcaaaggtcctgaaataactgtgagcagaccaa

SEQ ID NO: 201111 - DNA, 75 bp, Artificial Sequence
  Synthetic
actgatggggaaggtaattggaagcctatagctcagtttttaaggcttcaggaagttaattttctatcattctta

SEQ ID NO: 201112 - DNA, 75 bp, Artificial Sequence
  Synthetic
atgtccctattgatccactaggcggcgctgatgtcatacccttagacattataaatccagaagctccttcagtta

SEQ ID NO: 201113 - DNA, 75 bp, Artificial Sequence
  Synthetic
ataacgttgaaaaccttttttaaaggaatagctaaaaagcaatgtatagtgtttcatggtccacctaatacaggc

SEQ ID NO: 201114 - DNA, 75 bp, Artificial Sequence
  Synthetic
ttccattacaagaaggaggtctgcctaatattcctgtcacagacactgggatcaccactactgatattgcagaaa

SEQ ID NO: 201115 - DNA, 75 bp, Artificial Sequence
  Synthetic
aagtctatgtttacattttcaatagttaaatttctaaaaggaaaagtagtttcatgtatgaatagaaatagtcaa

SEQ ID NO: 201116 - DNA, 75 bp, Artificial Sequence
  Synthetic
tagatattattacaactacaaatcctatagataatcctataactactgatacccagcctacagttataactcaaa

SEQ ID NO: 201117 - DNA, 75 bp, Artificial Sequence
  Synthetic
ttttggttatcaccgttaagtgaagcaaaagttggtataatagatgatgttacatttcctgcatggcaatatatg

SEQ ID NO: 201118 - DNA, 75 bp, Artificial Sequence
  Synthetic
acaatgatatattcattgtcgacatgcaaccaggaccaccacctccgaaacgcattgcattagatgttggtacac

SEQ ID NO: 201119 - DNA, 75 bp, Artificial Sequence
  Synthetic
gatataaatatgagagcagctctagatggaaactacatttcattagatagtaaacatagacagcctctacaaata

SEQ ID NO: 201120 - DNA, 75 bp, Artificial Sequence
  Synthetic
gtccctttgcagatatcgagctgaatgtgtttagagaaccacattttgactcaaatgtcaatgtatttgtggatc

SEQ ID NO: 201121 - DNA, 75 bp, Artificial Sequence
  Synthetic
aagctgccacctacttttattactactaatatagatgtgccaacagaaccttcacttaaatatttatacagtagg

SEQ ID NO: 201122 - DNA, 75 bp, Artificial Sequence
  Synthetic
ctaatattacaggtgatgttgtgggtttagaagaaattgaattaggccctttaaatgaagttgctgaatttgcaa

SEQ ID NO: 201123 - DNA, 75 bp, Artificial Sequence
  Synthetic
gtagtatgctttaaattcccaaatgaaatgcctatggatgaaaatggggagcctgtgtatatgtttgatgacaaa

SEQ ID NO: 201124 - DNA, 75 bp, Artificial Sequence
  Synthetic
ttgaggagggggcgggtcctagtacaagcacacctacacagtctatagaaagaattatcaatcaagggcaacgat

SEQ ID NO: 201125 - DNA, 75 bp, Artificial Sequence
  Synthetic
atgtggaaatgtttttttagaaagtttgggaatcaattagacctcaaagcatctgaagaagagggtgatggagga

SEQ ID NO: 201126 - DNA, 75 bp, Artificial Sequence
  Synthetic
tgtacaatcgttttgtacaacaggttcaaaccagaaatccagacttcgttactaagccttcccgcctagtgacat

SEQ ID NO: 201127 - DNA, 75 bp, Artificial Sequence
  Synthetic
attgaccaggcgtttcgatgtactgcaagatcagttgatgagacattatgaatctgaatctaagtctttacaaga

SEQ ID NO: 201128 - DNA, 75 bp, Artificial Sequence
  Synthetic
ttgaatttgaaaatcccgcctttgacgatgacgtgactttaacctttgaacaggatatcaatgatgtagctgcag

SEQ ID NO: 201129 - DNA, 75 bp, Artificial Sequence
  Synthetic
tcaaataaactattgggaaactattagaaaagaaagtgctttgctgcattatgcacgtcagcaaggcattagtaa

SEQ ID NO: 201130 - DNA, 75 bp, Artificial Sequence
  Synthetic
ctccagactatgaattcagagacatagttagattagaaagaccaatttttactaccacagatgcaggtttacgac

SEQ ID NO: 201131 - DNA, 75 bp, Artificial Sequence
  Synthetic
attgggactgcaacctgttcctgcactggtagtttctgaatacaatggaaaacaagcaatttccataagtctgac

SEQ ID NO: 201132 - DNA, 75 bp, Artificial Sequence
  Synthetic
ttagtagactaggccagcgaggttctataactacacgtagtggcttaactataggtccacgtgttcatttttact

SEQ ID NO: 201133 - DNA, 75 bp, Artificial Sequence
  Synthetic
tttgcaatcactactaaaatcaccatttggaaaagaaacatggacgctacctgagaccagtgcagaactaattaa

SEQ ID NO: 201134 - DNA, 75 bp, Artificial Sequence
  Synthetic
atgattttagtgaaattctaccagaggaaagtatagaactatctacatttgcaattcattctaatgaagatgtat

SEQ ID NO: 201135 - DNA, 75 bp, Artificial Sequence
  Synthetic
tactgaaccaaaaaatacattaaaaaagcatgggtttacagtgactgtttggtttgaccatgaaaaacaaaatgc

SEQ ID NO: 201136 - DNA, 75 bp, Artificial Sequence
  Synthetic
ttattgatcctatggctgaatcatcaatagttaacagtgatattggaagaaaccctacattttcagatgattatt

SEQ ID NO: 201137 - DNA, 75 bp, Artificial Sequence
  Synthetic
aatgcaatatacaaactggaataatatttattatcaagactatgataatgtttggcacaaagtgaagggagaagt

SEQ ID NO: 201138 - DNA, 75 bp, Artificial Sequence
  Synthetic
tagaagatattttcacagaaaattttaataatgcacatttagttttaacatttggtgagcgagacataatcgaag

SEQ ID NO: 201139 - DNA, 75 bp, Artificial Sequence
  Synthetic
ggactataatgggctctattttacagagccatcaggggacagagcatattttaagatatttgctcaggatgctga

SEQ ID NO: 201140 - DNA, 75 bp, Artificial Sequence
  Synthetic
tacctatcagtgtgcctaaagcaggcataaatgtttttataacaggcaactctaatacaactgttgtggattaca

SEQ ID NO: 201141 - DNA, 75 bp, Artificial Sequence
  Synthetic
aatgtatagtaaaactggagaatggactgtgcactataaaacctacactatctcccctccctctggttttagctc

SEQ ID NO: 201142 - DNA, 75 bp, Artificial Sequence
  Synthetic
ctagcataaaggaaacaactataattaccccttcaaccaatttgataaatttaaaacctgctctaggtttatata

SEQ ID NO: 201143 - DNA, 75 bp, Artificial Sequence
  Synthetic
tgcttccagctcttactctagaaccaccgagatatccacatcagcgaccaccagacacacctcgcccgaaaaggc

SEQ ID NO: 201144 - DNA, 75 bp, Artificial Sequence
  Synthetic
ccttaggagaagattttatttttgatccagatttatttagaaaacgtagaaaacgtaaatattctgatgtttaat

SEQ ID NO: 201145 - DNA, 75 bp, Artificial Sequence
  Synthetic
atcaacctctaacgagcaacagcgggtactacggtcgccaccacgacttagggctgccagtgtctcgccaccgca

SEQ ID NO: 201146 - DNA, 75 bp, Artificial Sequence
  Synthetic
gttttacagatgtctctgtggttgccaagcgaaggaaagttatacctgcctccggcaaggccaacaccaagggtt

SEQ ID NO: 201147 - DNA, 75 bp, Artificial Sequence
  Synthetic
acccagctccactaccgaaacccccgaaagagaaagagtacagcgccgacgacgacgagaacaaggagaatctag

SEQ ID NO: 201148 - DNA, 75 bp, Artificial Sequence
  Synthetic
ctgcatacagatgaatatatacagccaactaatatatatttttgcgcaagcactgatcgcctcttaacagtggga

SEQ ID NO: 201149 - DNA, 75 bp, Artificial Sequence
  Synthetic
acccagagaggccacccctaagcgaagaagaaccgaagacagcggaggaagagctggaagaggaggaggagggag

SEQ ID NO: 201150 - DNA, 75 bp, Artificial Sequence
  Synthetic
catccatactttcctattcacaattctgcagatccttctaaagtagaagtaccaaaagtcacaggatgtcagtat

SEQ ID NO: 201151 - DNA, 75 bp, Artificial Sequence
  Synthetic
aggtgcaccgtctcctgaagcagtgggccaaagacatagatcagttgaaacaaaaggtctgtctagacttagagc

SEQ ID NO: 201152 - DNA, 75 bp, Artificial Sequence
  Synthetic
agggttttcagatttcatttgccagatccaaataagtttgcattaatagatcccaaagtttataatccagatgaa

SEQ ID NO: 201153 - DNA, 75 bp, Artificial Sequence
  Synthetic
gttacaagaagaagctagggatccacctgtaattataattagaggaggggcaaatgctttaaaatgcttcagata

SEQ ID NO: 201154 - DNA, 75 bp, Artificial Sequence
  Synthetic
gaacgcttagtttggagattaagggctgtagaatgcggtagaggtggtccattaggaataggtattagtggtcac

SEQ ID NO: 201155 - DNA, 75 bp, Artificial Sequence
  Synthetic
tagaaaaacgcattccagcagtaaacatctttttctttgcatatcttctgtgtttaaatgggttggggattgtac

SEQ ID NO: 201156 - DNA, 75 bp, Artificial Sequence
  Synthetic
ccttattttaataaattagttgatgtagaaaaccctgttgaatatccagcggcacaagcagaagacaacagatta

SEQ ID NO: 201157 - DNA, 75 bp, Artificial Sequence
  Synthetic
tgcaactagtggtagtagaatgttagtttcatttaaagatgttaaacaacgtgaaatgtttataaggcacactac

SEQ ID NO: 201158 - DNA, 75 bp, Artificial Sequence
  Synthetic
gatatggccatggagcctaagcaaaatcaattgattattgtgggttgtgtacccacaataggagaacattgggat

SEQ ID NO: 201159 - DNA, 75 bp, Artificial Sequence
  Synthetic
atttccaaaaggttctgaatatttcttgggacaattaaacagcttgtaacatgaaccctgctaaaaggcgaaagc

SEQ ID NO: 201160 - DNA, 75 bp, Artificial Sequence
  Synthetic
aaggctaaaccttgtaatgatttacctaaaggttcttgtcctccactacaattagtaaattctccaattcaggat

SEQ ID NO: 201161 - DNA, 75 bp, Artificial Sequence
  Synthetic
gtgattctccagataatctttatagacaatgtcaattatcaggcaactgtttaccagatgtaaaaaataaaatag

SEQ ID NO: 201162 - DNA, 75 bp, Artificial Sequence
  Synthetic
ggtgatatgagtgacacaggctttggagccttaaattttgacaacttgtgtgaggatagggccttagtccctcta

SEQ ID NO: 201163 - DNA, 75 bp, Artificial Sequence
  Synthetic
aaggtactaccttggctgatcaattattaaaatggttgggaagttttatatatttggggggattgggtattggaa

SEQ ID NO: 201164 - DNA, 75 bp, Artificial Sequence
  Synthetic
gatatagttaatgagacagctaaatggccagattttctaaaaatgaataaagatccttatggagatcatatattt

SEQ ID NO: 201165 - DNA, 75 bp, Artificial Sequence
  Synthetic
ccggaaagggtacaggaggttctatgggctatacaccattagctacccctagcagagtaattccagatggcacag

SEQ ID NO: 201166 - DNA, 75 bp, Artificial Sequence
  Synthetic
ttctttggtcaaaaggaacagttatatgcaaggcattatggtgctcgtggcggtaatatgggtgatactatacca

SEQ ID NO: 201167 - DNA, 75 bp, Artificial Sequence
  Synthetic
ttattaggcctactgttcctgtagagcctataggtccagcggaactgattcctattgatgtactacagccagagg

SEQ ID NO: 201168 - DNA, 75 bp, Artificial Sequence
  Synthetic
gatgatactcaaggagagtattattatccacccaataatggtgcccaaactccaattgggtcccacatttatttc

SEQ ID NO: 201169 - DNA, 75 bp, Artificial Sequence
  Synthetic
catcagctataattcctttagaagaaggtaccttatctaatataccagacctaaacataccagaaactgaagaaa

SEQ ID NO: 201170 - DNA, 75 bp, Artificial Sequence
  Synthetic
acgaccgtaagtggctccttaactacctctgaatctcagttatttaacagaccttattttattcaaagagctcag

SEQ ID NO: 201171 - DNA, 75 bp, Artificial Sequence
  Synthetic
cagtgatagatactatactaccagaggataacattcttacatcagtggatccagtaaatgatattactaccagta

SEQ ID NO: 201172 - DNA, 75 bp, Artificial Sequence
  Synthetic
ggtccaaataatggtatttgctggtccaatgacttatttattactttattagacacaacacgaaataccaatttt

SEQ ID NO: 201173 - DNA, 75 bp, Artificial Sequence
  Synthetic
gtggtcaccctaacatcataacttcaggtgaagatgcagctattttagaagttcagcctgcaccctcagctccaa

SEQ ID NO: 201174 - DNA, 75 bp, Artificial Sequence
  Synthetic
aatatatcagtttataaaggagatcaaacattaaacccagttacttacaaatacaagtcaacagactttaatcag

SEQ ID NO: 201175 - DNA, 75 bp, Artificial Sequence
  Synthetic
gacgtatagcagttactcaaagcagatacaatgcaactcctcatttaagtgttataactggtaacatttctcagg

SEQ ID NO: 201176 - DNA, 75 bp, Artificial Sequence
  Synthetic
tacactagacatactgaagaatacgagtttgagtttgttatgcagctttgtaaagtacctcttactgcaaatgtt

SEQ ID NO: 201177 - DNA, 75 bp, Artificial Sequence
  Synthetic
attccaacataaatgtgtttgtagatgcacattttacaggtgaggttataggttcttttgaagagatacctcttg

SEQ ID NO: 201178 - DNA, 75 bp, Artificial Sequence
  Synthetic
cttgcacacttaaatgttatgaattcagaaatactagaacgttggaatttagcatttgtgccgccacctccaaca

SEQ ID NO: 201179 - DNA, 75 bp, Artificial Sequence
  Synthetic
aacctttaaatcaaagggaggagtttcaaatagaggcgggaaggaaaactagtacacctagagatactatcagtc

SEQ ID NO: 201180 - DNA, 75 bp, Artificial Sequence
  Synthetic
ggtattgaggatacttatagatatatatctcttgctacgcgctgtccatcaggaaaccctaaatctgaaaaagca

SEQ ID NO: 201181 - DNA, 75 bp, Artificial Sequence
  Synthetic
aaggtttgaataggatacgtcacttgtataatagaagaattttacaacaaccaaccagaaacgtggattttctgg

SEQ ID NO: 201182 - DNA, 75 bp, Artificial Sequence
  Synthetic
gatccttataaagacctaaagttttgggatgttgatatgtcagaaaagttttcctcagatttaagtcagtcttat

SEQ ID NO: 201183 - DNA, 75 bp, Artificial Sequence
  Synthetic
gtcaggcgtctcgggctgttcaatttgaatttgaaaatcccgcctttgaccctgaaataaccctcagatttaatc

SEQ ID NO: 201184 - DNA, 75 bp, Artificial Sequence
  Synthetic
ttaggaagacggtttttgtatcagattggaatgttaaatgggagcaaacgtttacgaactgtagatgctttcaaa

SEQ ID NO: 201185 - DNA, 75 bp, Artificial Sequence
  Synthetic
aggacgttgctgacgttgcaactgctgctcctgattcagcttttgctgacattgtaacttttagcaggccaatat

SEQ ID NO: 201186 - DNA, 75 bp, Artificial Sequence
  Synthetic
acttcagtttctaaaaaatctgcaaaaaggcgcaaaactaaagcctaacgcttttattatgtgtcatatcctgaa

SEQ ID NO: 201187 - DNA, 75 bp, Artificial Sequence
  Synthetic
tttctgagaccgataccggtctcgttagagttagcagactaggacaaaagggtacaattaagacgcgaagcggtc

SEQ ID NO: 201188 - DNA, 75 bp, Artificial Sequence
  Synthetic
tacttgaaaaatcttgtacttgaatatcttttaggcaatcaataaaaactatttccatcaagcaatactgactca

SEQ ID NO: 201189 - DNA, 75 bp, Artificial Sequence
  Synthetic
tgcaaatagggcagaatgttcatttttattatgatgttagtactatagacactagtgatgctatcgaattaatgc

SEQ ID NO: 201190 - DNA, 75 bp, Artificial Sequence
  Synthetic
tgtggtctacatactttccttaccgcacccaacaattatttggccagtattaatacccacacaaacaaacatttt

SEQ ID NO: 201191 - DNA, 75 bp, Artificial Sequence
  Synthetic
cacttggacagacatcagcagatttaagtatagttgatcagcttgccgaaagtacttttgtagaccctatagctc

SEQ ID NO: 201192 - DNA, 75 bp, Artificial Sequence
  Synthetic
caaagtaaagacgacagccagctggacgctttacaacctactctggtacaaaaaaggcgggaaaagaacagtaag

SEQ ID NO: 201193 - DNA, 75 bp, Artificial Sequence
  Synthetic
agttacagaatacagcatttactgaggctgatttggaagatgctttaacagaatcttttgagaattctcatttgg

SEQ ID NO: 201194 - DNA, 75 bp, Artificial Sequence
  Synthetic
taccgaaatcggtcgtaaaatatgccttaggacatttcaagttcaggcgaaagtcaactgactcagactttggca

SEQ ID NO: 201195 - DNA, 75 bp, Artificial Sequence
  Synthetic
ttttacgtactggtagtagacaggaaactatcacttttcctagtttaccacctgaattaggaatacgtatatttg

SEQ ID NO: 201196 - DNA, 75 bp, Artificial Sequence
  Synthetic
ggattaagcttggcaggattaaaagattggcgcgatatattggcagctgttttgtaccgcttacggtactgcatt

SEQ ID NO: 201197 - DNA, 75 bp, Artificial Sequence
  Synthetic
tagatgatgttggtaatgatctgtttatttcatatcctgaaacacatataacaccaataataaatccagatttgc

SEQ ID NO: 201198 - DNA, 75 bp, Artificial Sequence
  Synthetic
ttgtttttaacatgattgttggcaacaatcatagatgttatgaaaaaagaccgggagaggtacatataaatatca

SEQ ID NO: 201199 - DNA, 75 bp, Artificial Sequence
  Synthetic
tcatagatgttatgaaaaaagaccgggagaggtacatataaatatcacatatttgcctcagaatcagtgcttctg

SEQ ID NO: 201200 - DNA, 75 bp, Artificial Sequence
  Synthetic
catttgggcctactgtgccggttttagaatatgatttcactagtgcagactttactttacacccaagtttatctc

SEQ ID NO: 201201 - DNA, 75 bp, Artificial Sequence
  Synthetic
gcaaacgcaaacgaaggccttctttctgattttgcaggatggctttatgggagcgctcatcaggcaaaatatatc

SEQ ID NO: 201202 - DNA, 75 bp, Artificial Sequence
  Synthetic
tacctccagccagaccagttgcaagagtttacaatacggatgaatatgttgtgggaacttcattattttttcatt

SEQ ID NO: 201203 - DNA, 75 bp, Artificial Sequence
  Synthetic
ctgctactgatagactccttaccgttggtcatccttactttgaaattcgtgacaatgtagatcaatctaaggtgt

SEQ ID NO: 201204 - DNA, 75 bp, Artificial Sequence
  Synthetic
tggtccctaaagtttcaggcaatcagtttagagtctttagatgcactttacctgatcctaacaagtttgctttaa

SEQ ID NO: 201205 - DNA, 75 bp, Artificial Sequence
  Synthetic
tagatcaatctgtttataacccagaaacagaaagattagtgtggagattacggggtattgaggttggtcatgggg

SEQ ID NO: 201206 - DNA, 75 bp, Artificial Sequence
  Synthetic
gtcctttgggcattggcactagtgggcatccattgtttaataagtttaatgatacagaaaacccaaataagtatt

SEQ ID NO: 201207 - DNA, 75 bp, Artificial Sequence
  Synthetic
ttccgaaacaaacagatgataacagacaaaatgtctcgtttgatcccaaacaagtccaattattgttggtgggtt

SEQ ID NO: 201208 - DNA, 75 bp, Artificial Sequence
  Synthetic
gcacaccaccaatgggagaacattgggatgttgctaaatcctgcgcaggtgacaatacagatccagggtcctgtc

SEQ ID NO: 201209 - DNA, 75 bp, Artificial Sequence
  Synthetic
ctgctattcagttggtgaatgattacattcaggatggtgatatgtttgatataggtttaggtgcagttaattttg

SEQ ID NO: 201210 - DNA, 75 bp, Artificial Sequence
  Synthetic
gtaattttcaaagagatagagctggtgcaccactggatatcaatactactatttgtaaatggcctgatttactta

SEQ ID NO: 201211 - DNA, 75 bp, Artificial Sequence
  Synthetic
aaatgtctaaggatatttttggagacagtctattcttttatggaaagcgagaacaaggatatgccagacattttt

SEQ ID NO: 201212 - DNA, 75 bp, Artificial Sequence
  Synthetic
ggacacgtgctggtaccactggagacaccatacctgaaccacatgctccagagttctttttaacaccacaaagta

SEQ ID NO: 201213 - DNA, 75 bp, Artificial Sequence
  Synthetic
atcaggatcaggtgaattgtactaatcatatatactttggaacaccaagtggctctttggtctccagcgaatctc

SEQ ID NO: 201214 - DNA, 75 bp, Artificial Sequence
  Synthetic
aattgctaaacagaccatactggttgcaacgagcacaaggaaccaacaatggtatttgttggagaaatgagttat

SEQ ID NO: 201215 - DNA, 75 bp, Artificial Sequence
  Synthetic
ttgttacagtagctgataacacacataatacaaactttacgttgtctgttgcaactacagaaataaaccaggatt

SEQ ID NO: 201216 - DNA, 75 bp, Artificial Sequence
  Synthetic
ataagtataaagctactgattttaaacattatctcagacatgtagaagagtatgaaatagaattcatatttcagc

SEQ ID NO: 201217 - DNA, 75 bp, Artificial Sequence
  Synthetic
tttgtaaaattccactacaggctgatatattagcacatatcaatgctatgaatccaggcattattgatgattggc

SEQ ID NO: 201218 - DNA, 75 bp, Artificial Sequence
  Synthetic
aattggcatttgtgccgcctccaccatccggtattgaggacacttacaggtatattaacagtttggcaacacgtt

SEQ ID NO: 201219 - DNA, 75 bp, Artificial Sequence
  Synthetic
gtccagatcaaaacccaccaactgaaaagcaggatccgtataaggactataatttttgggatgttgacttaacag

SEQ ID NO: 201220 - DNA, 75 bp, Artificial Sequence
  Synthetic
aacgattttcaagcgaactatctcagttttctttgggacgtcgttttctgtatcaaactaatcttattacatctg

SEQ ID NO: 201221 - DNA, 75 bp, Artificial Sequence
  Synthetic
gtaagcgtcctagatccactgttaattatactaaaaagtctgtgaaacgaaaaagaactaaataatggaacatag

SEQ ID NO: 201222 - DNA, 75 bp, Artificial Sequence
  Synthetic
tactgtgaacaaggattactactgtgaaactactctgtaacatttcattgctggcagagccatatttgcaataaa

SEQ ID NO: 201223 - DNA, 75 bp, Artificial Sequence
  Synthetic
tttgcacacttcagcttgagtcacttgtccatttgtgtcattcgcccactttgcgctggcattcggccggctgtc

SEQ ID NO: 201224 - DNA, 75 bp, Artificial Sequence
  Synthetic
aaaacaaacaacaacatctcgataacatctgtccagataaaggtaagtattatataaaataacctttttcggttg

SEQ ID NO: 201225 - DNA, 75 bp, Artificial Sequence
  Synthetic
gtcttggcgggaaagtaagtaccggatacgttactcatgatgtgtttttgccaagatttacaagcttaggcagga

SEQ ID NO: 201226 - DNA, 75 bp, Artificial Sequence
  Synthetic
gatgactcaaacagagttagattttggcttgatagcttttcaaaaaccgttttcggttgcaggcattgttttcta

SEQ ID NO: 201227 - DNA, 75 bp, Artificial Sequence
  Synthetic
acacgttgttggcaactatcatagcctttctaaatatataaccgggagagatacatatataaggagacagaaatt

SEQ ID NO: 201228 - DNA, 75 bp, Artificial Sequence
  Synthetic
tatcatagcctttctaaatatataaccgggagagatacatatataaggagacagaaattactcagaatcagccag

SEQ ID NO: 201229 - DNA, 75 bp, Artificial Sequence
  Synthetic
atggcgaacctcttgcttccagtttgtttggaagagtattgtaattattttgatgttactcctgatgtgcttact

SEQ ID NO: 201230 - DNA, 75 bp, Artificial Sequence
  Synthetic
ttgccttgcattttctgtcgtcgtgatttgtgtgattctgatttagatagttttagcagaaagcgtctgagttta

SEQ ID NO: 201231 - DNA, 75 bp, Artificial Sequence
  Synthetic
gtatggaaaaaaggtgtttgctatgctgcatgtgtgagatgtgttgcacgcacagctgcgtatgaaagagcgaaa

SEQ ID NO: 201232 - DNA, 75 bp, Artificial Sequence
  Synthetic
tattttcaatgtacagtagaagctgtctatatagagtattttactcaaactccattgcaagagttaaatgtgagg

SEQ ID NO: 201233 - DNA, 75 bp, Artificial Sequence
  Synthetic
tgtctgttttgtatggggttgcttactaatgaggagaagattgatattatcgcgtctggttctaaatttcaactg

SEQ ID NO: 201234 - DNA, 75 bp, Artificial Sequence
  Synthetic
gtgcgagggcattggaaaggtgtctgccgcgaatgcttctaagatgcaaggtaaacaagcaacaatcaaagatat

SEQ ID NO: 201235 - DNA, 75 bp, Artificial Sequence
  Synthetic
tacattagatatgaaaaaaattgctttgccctgtaacctattgtgtggagaagagagtttgtcaccagattcaga

SEQ ID NO: 201236 - DNA, 75 bp, Artificial Sequence
  Synthetic
ggaggagcatccagtatataaagttgacagctgttgcgacaactgttgccgagtaattcgtgtcgttgttgttgc

SEQ ID NO: 201237 - DNA, 75 bp, Artificial Sequence
  Synthetic
tactgaaactggcattagagcatttcagcaactattgaccgaagaaatttcgtttctttgccccaactgttccag

SEQ ID NO: 201238 - DNA, 75 bp, Artificial Sequence
  Synthetic
gagtcatttgcaacatggcagattccactaaaggtacagaatcgtttgactgtttagaagggactagtgactggt

SEQ ID NO: 201239 - DNA, 75 bp, Artificial Sequence
  Synthetic
actttgtaactgaagcagactgtgtggatgatatacaatgtattgatgagctgtttgatgacagtacagaatcaa

SEQ ID NO: 201240 - DNA, 75 bp, Artificial Sequence
  Synthetic
acatctcaaatctgttagacgacagtgatgaggtggatcaggggaataccctggctctgtttaatgaacagttgc

SEQ ID NO: 201241 - DNA, 75 bp, Artificial Sequence
  Synthetic
gggaggattgtgacaaaacaatccagttcctaaagcgaaagtatgtaagtagtcctcaggcagatatagcagctt

SEQ ID NO: 201242 - DNA, 75 bp, Artificial Sequence
  Synthetic
taagtccaaagctgcaggctatatctatttctccacaaaaagaaaaacaaagtaaaagacgcttgaattttcagg

SEQ ID NO: 201243 - DNA, 75 bp, Artificial Sequence
  Synthetic
acagtggaattgagcaggatgaagctgaaaatacttttacgtcgcaggtagagatcgccttagataatagtaatg

SEQ ID NO: 201244 - DNA, 75 bp, Artificial Sequence
  Synthetic
ttagtacgcctgaagaaaatggcgtctcaggggttgaagtattggaaagaactaatcagaaagcatatatgttat

SEQ ID NO: 201245 - DNA, 75 bp, Artificial Sequence
  Synthetic
ttaaatttaaagaaacgtttggtgtatcatttaatgaattggttagaagtttcaaaagtgataaatcatgtaatg

SEQ ID NO: 201246 - DNA, 75 bp, Artificial Sequence
  Synthetic
ataattgggttatagctgtttttaaagccgcagaagaagttatggaagcatctaaaatattaattcaaaaatatt

SEQ ID NO: 201247 - DNA, 75 bp, Artificial Sequence
  Synthetic
gtaaccatgcacaaattataatacgtgaatttaatggtgtttatgttgttcaatttaaaagtgctaaaagtagag

SEQ ID NO: 201248 - DNA, 75 bp, Artificial Sequence
  Synthetic
aaactgtcagtaaactgttttgtgaattgttaaatgttcaaagtttccaaataatgtgtgaacctcctaaaatta

SEQ ID NO: 201249 - DNA, 75 bp, Artificial Sequence
  Synthetic
gaagtgtagctgcagcactgtggttttataaacaatcattacttgaaaagagttatgtgtacggtggtcttccac

SEQ ID NO: 201250 - DNA, 75 bp, Artificial Sequence
  Synthetic
aatggatactttcacaaactattgttgatcaccaagcagctgcagctcctgatacatttgaattatctgcactgg

SEQ ID NO: 201251 - DNA, 75 bp, Artificial Sequence
  Synthetic
tccaatgggcatatgataatgatataactgatgaggcacaaatggcctatgaatatgctgaattagcaagtactg

SEQ ID NO: 201252 - DNA, 75 bp, Artificial Sequence
  Synthetic
atagtaatgcagctgctttattaaaacataataatcaagtaaagtttattagagatgcttgtacaatggttagac

SEQ ID NO: 201253 - DNA, 75 bp, Artificial Sequence
  Synthetic
tttataaaagacatgaaatgcgaaaaatgacaatgtctgattggatatggcattgtagtgacaaatgtgaagatg

SEQ ID NO: 201254 - DNA, 75 bp, Artificial Sequence
  Synthetic
ttgctggcgattggaaacctattatgcagttattaaaatttcaacacgttaatatcttagatttcctatatatgt

SEQ ID NO: 201255 - DNA, 75 bp, Artificial Sequence
  Synthetic
ttaaacaatttttaaaaggtacacctaaaagtaattgtttagtgttttatggtccaccagattcaggaaaatcat

SEQ ID NO: 201256 - DNA, 75 bp, Artificial Sequence
  Synthetic
actttacgtattccttaacaaaatttctaagaggtaaagttatttcctatgtaaatactaaaagccaattttttc

SEQ ID NO: 201257 - DNA, 75 bp, Artificial Sequence
  Synthetic
tacaacccttatcagattgtaaaataggattattagatgatgcaacatatccttgttggacattttttgatatta

SEQ ID NO: 201258 - DNA, 75 bp, Artificial Sequence
  Synthetic
atatgagaacagccttagatggtaactgggttagtgttgattttaaacataaagcaccaattcaaatgaaattgc

SEQ ID NO: 201259 - DNA, 75 bp, Artificial Sequence
  Synthetic
cacctttgttagtaacaactaattacgatgttaaaagtgatcaatcattattgtatttgcatagcagagtacaat

SEQ ID NO: 201260 - DNA, 75 bp, Artificial Sequence
  Synthetic
gtatctgttttcctaacaaaatccctcttacagagcaaggaaatcctatatttgagattactgattacacttgga

SEQ ID NO: 201261 - DNA, 75 bp, Artificial Sequence
  Synthetic
aatgtttttttagaaaactggcaacacaattagaactgacaattccggagaaggaagatggattggttgacagac

SEQ ID NO: 201262 - DNA, 75 bp, Artificial Sequence
  Synthetic
cgtttcaatgccatccaagacaatatcttgaatctaattgagcagggagctgaagatttggactcccaaataaat

SEQ ID NO: 201263 - DNA, 75 bp, Artificial Sequence
  Synthetic
tattggaatcttgttagacaagaaaatgtgtatttatattatgggagaaaagaaggcctcacacattttggtctt

SEQ ID NO: 201264 - DNA, 75 bp, Artificial Sequence
  Synthetic
caaccgttacctgtagcagcagtttctgaatataaagcaaaggaagccataaatatggtactgttgttgcagtca

SEQ ID NO: 201265 - DNA, 75 bp, Artificial Sequence
  Synthetic
ttaaaaaagtctgcctatgctaatgaagtatggaccttacaagatgctagtgcagaattaataaatacccaaccc

SEQ ID NO: 201266 - DNA, 75 bp, Artificial Sequence
  Synthetic
aaggattgttttaaaaagcaaccgtacacagtagaagtatggtttaataatgacaggcaaaacagtaatcaatat

SEQ ID NO: 201267 - DNA, 75 bp, Artificial Sequence
  Synthetic
attaattggaacttcatatattaccaagatgctaatgatgtatggcacaaagtacaaggacttgtagattataat

SEQ ID NO: 201268 - DNA, 75 bp, Artificial Sequence
  Synthetic
ggcctgtattatgttgaaactggtggtgaccaagtatactttgcactatttgatgcagatgatcaaaggtttgga

SEQ ID NO: 201269 - DNA, 75 bp, Artificial Sequence
  Synthetic
ggcaccggaatatggagtgtgcattttaaaaataaaactctttccgcccctagcagctctgcaagttccttctcc

SEQ ID NO: 201270 - DNA, 75 bp, Artificial Sequence
  Synthetic
cctcactccgggaagaactacgccaccgtttccagtcccaccgaaaacaccgtatcccaatcggaaagcccagga

SEQ ID NO: 201271 - DNA, 75 bp, Artificial Sequence
  Synthetic
cgactccaaaaatcggaggtcggctctagtaccagtcccagggcgaaaacatctacagttcgacgacgacgagaa

SEQ ID NO: 201272 - DNA, 75 bp, Artificial Sequence
  Synthetic
agagaatctacccccgaaggacaaccttccacctcaacaaagagaagaagaggaagaattggaggaggaggagga

SEQ ID NO: 201273 - DNA, 75 bp, Artificial Sequence
  Synthetic
ggaggagctgaacgagctgtcccgtctcctgaccaagtggggtcgcgacatagatcggtttcaacaacgcatctg

SEQ ID NO: 201274 - DNA, 75 bp, Artificial Sequence
  Synthetic
tcaagacttgcacgacttcagaaagaagcttgggatcccccagtcctaattcttacaggtcctgcaaatgtttta

SEQ ID NO: 201275 - DNA, 75 bp, Artificial Sequence
  Synthetic
aaatgttggcggtatagaaagaaaaatcaaaatgagttttcatttttagatattagtactatattcacttgggtt

SEQ ID NO: 201276 - DNA, 75 bp, Artificial Sequence
  Synthetic
gggagtaacaaagagactgataataaaggccgtatgttaattgcttttcataatgatacagaaagagaacaattt

SEQ ID NO: 201277 - DNA, 75 bp, Artificial Sequence
  Synthetic
gtaaaacatgttcattttcccaaacacacatcatatgctttcggaaaactagataagttgtaaaaatgacaagca

SEQ ID NO: 201278 - DNA, 75 bp, Artificial Sequence
  Synthetic
gagcaaaaaggattaaacgtgattctgtagaaaatttatataaacaatgtaaacttactggtcaatgccctgatg

SEQ ID NO: 201279 - DNA, 75 bp, Artificial Sequence
  Synthetic
atgtaataaacaaagtagaaggcacgactcttgctgatcgattattaaaaattataggtagtgttgtttattttg

SEQ ID NO: 201280 - DNA, 75 bp, Artificial Sequence
  Synthetic
gaggactgggtataggaaccggaaagggttcagggggtgctacaggctatagaccaattggagctacaacaccta

SEQ ID NO: 201281 - DNA, 75 bp, Artificial Sequence
  Synthetic
gagtcacagatgcaattcctgtacggccagtagttcctgttgatcctttagtcccagctgaattaatacctgtag

SEQ ID NO: 201282 - DNA, 75 bp, Artificial Sequence
  Synthetic
accctggagcttcttcaataattcctttgacagaagctggaattcctgatgcaacattaattgaatcaggaggag

SEQ ID NO: 201283 - DNA, 75 bp, Artificial Sequence
  Synthetic
ctgtaattgatgctggctcagcagaaccacctgtacttacaactatagatcctatatcagacgttacagcagtag

SEQ ID NO: 201284 - DNA, 75 bp, Artificial Sequence
  Synthetic
ataaccaacctacagttattacaggacaagatgaaaatatagctgttttagatatacaaccgacaccccaagctc

SEQ ID NO: 201285 - DNA, 75 bp, Artificial Sequence
  Synthetic
ctaaacgtgtaatatcaggtgttaggtcacttggtaaaagcccttttgagccacaaattttattgcctccaccag

SEQ ID NO: 201286 - DNA, 75 bp, Artificial Sequence
  Synthetic
atatgcctgcaattgatgttagtgtatttgttgatgctcagttagttggtgaaactgttggtgctgaattaatac

SEQ ID NO: 201287 - DNA, 75 bp, Artificial Sequence
  Synthetic
cattagatgatattaatttaatagaggaatttgagatacaggagcctgtaacacgaaccagcacgcctgagcagc

SEQ ID NO: 201288 - DNA, 75 bp, Artificial Sequence
  Synthetic
gtctgggaagggcatttcaaagagctcgggaactatataatagacaaataagacaaattagaacccgaaacaggg

SEQ ID NO: 201289 - DNA, 75 bp, Artificial Sequence
  Synthetic
actttttaggacctgtttcgcgcgcaattcaatttgattttgaaaatcccgcctttagcactgacgtcactttgc

SEQ ID NO: 201290 - DNA, 75 bp, Artificial Sequence
  Synthetic
agtttgatcaagacgtgcagaatgtagctgctactccagatccagattttgcagatgttatcacagtacacaggc

SEQ ID NO: 201291 - DNA, 75 bp, Artificial Sequence
  Synthetic
ctcaatactcggaaaccgatagtggtcgcgttagagttagcagacttgccagacggggaacaatcattactagaa

SEQ ID NO: 201292 - DNA, 75 bp, Artificial Sequence
  Synthetic
gtggtacgcaaataggtgaaaatgtacacttctattttgacctcagtactataggttctgacgctgctgatgcca

SEQ ID NO: 201293 - DNA, 75 bp, Artificial Sequence
  Synthetic
tagaattagggacaataggccaacattcaggcgaaactgcaattgtagatgcagtggcagagagcacatttgtag

SEQ ID NO: 201294 - DNA, 75 bp, Artificial Sequence
  Synthetic
atatccctaatagtagtgaaatacaatttgatgatgaggatttgcttgatactcaagtagaaaattttgaagggg

SEQ ID NO: 201295 - DNA, 75 bp, Artificial Sequence
  Synthetic
gtcacctagttctatctggcactggtcgtagaggtgcagtttatagttttcctacattagctcctggtgttgcac

SEQ ID NO: 201296 - DNA, 75 bp, Artificial Sequence
  Synthetic
cgaagatatttgttgatgactttgctaaaaatctttttgtatcatatcctatcagccataataaaactgatatta

SEQ ID NO: 201297 - DNA, 75 bp, Artificial Sequence
  Synthetic
taggcccggatacactacatcctttggagcctccaattatattagattttcaaagttctacctattatttacatc

SEQ ID NO: 201298 - DNA, 75 bp, Artificial Sequence
  Synthetic
cttctttaagacgcagacggaagcggaaacgctcagatatttatgattttctttcagatggctctgtggacacac

SEQ ID NO: 201299 - DNA, 75 bp, Artificial Sequence
  Synthetic
cagaatggtaaactgtatctgccacccccaagaccaatcgccagagttctcagcacggacgaatacgtgacaaat

SEQ ID NO: 201300 - DNA, 75 bp, Artificial Sequence
  Synthetic
actagtctgtttttctatgctggtacagaacgcttactacaagtaggccatccattttttgaagttagaagccct

SEQ ID NO: 201301 - DNA, 75 bp, Artificial Sequence
  Synthetic
caggaaactgttgaggtgccaaaggtatctggtaatcaatatagggtgttacgtttaacattacctgatcctaat

SEQ ID NO: 201302 - DNA, 75 bp, Artificial Sequence
  Synthetic
aaatttgctttagttgattcctctatctttaacatggatagagaacgactagtatggagattaagaggtattgaa

SEQ ID NO: 201303 - DNA, 75 bp, Artificial Sequence
  Synthetic
ataggtcgtggaggaccgttaggggtagccacaacaggcaatccattatttaacaaatataatgatactgaaaat

SEQ ID NO: 201304 - DNA, 75 bp, Artificial Sequence
  Synthetic
cctaacagatatcctctggctcaaacagatgataataggcaaaatgtatctacagacccaaaacaaacacagctc

SEQ ID NO: 201305 - DNA, 75 bp, Artificial Sequence
  Synthetic
tttatggttggctgtgcgcctccaataggggctcattgggatatagctgagttttgtgaaacacatagacctcag

SEQ ID NO: 201306 - DNA, 75 bp, Artificial Sequence
  Synthetic
gctggagaatgtccacctgtgcaattaattaattctgttatacaagatggggatatgtgtgacattggctttggt

SEQ ID NO: 201307 - DNA, 75 bp, Artificial Sequence
  Synthetic
gcttgcaatttcagaacatttcagcaggatagatcaggagtgcctttggatatagtagatagcacctgtaaatat

SEQ ID NO: 201308 - DNA, 75 bp, Artificial Sequence
  Synthetic
ccagattttctaaaaatgactaaagataaatatggtgatgaacttttcttttacggtagacgagaacaattgtac

SEQ ID NO: 201309 - DNA, 75 bp, Artificial Sequence
  Synthetic
actcggcattacttcaccagagctggaacaataggtgatagcattcctacaccttataaaggttctgaattttat

SEQ ID NO: 201310 - DNA, 75 bp, Artificial Sequence
  Synthetic
agacagccacaggatagtcaggcacaaaacactgtagattcccatatttatattgcaactcccagtggttcgcta

SEQ ID NO: 201311 - DNA, 75 bp, Artificial Sequence
  Synthetic
actagtagtgatgcacaattatttaatagaccatattggttacaaaatgctcagggaactaataatggtatttgc

SEQ ID NO: 201312 - DNA, 75 bp, Artificial Sequence
  Synthetic
tggggaaatcagttatttgtgtcatatgttgacaatacgcgcaacactaattttaacttatctgtttacaaatca

SEQ ID NO: 201313 - DNA, 75 bp, Artificial Sequence
  Synthetic
ggggcgcctggtgctccggtgccttctgattatagatataaggcctcagattttaaacaatatttgcgtcatgtt

SEQ ID NO: 201314 - DNA, 75 bp, Artificial Sequence
  Synthetic
gaggaagtggagatagagtgtatattccagctctgcaaggttactttggatgctgacatcttagcacatatcaat

SEQ ID NO: 201315 - DNA, 75 bp, Artificial Sequence
  Synthetic
gtaatgaatccaaacatacttgagcagtggcaattggcatttgttcctccagcaccacaaagtattgaggatcaa

SEQ ID NO: 201316 - DNA, 75 bp, Artificial Sequence
  Synthetic
tatagatttttgcagtccatggcaactaagtgtcctactgctgctgctgcagaagacaacaatgatccttacaaa

SEQ ID NO: 201317 - DNA, 75 bp, Artificial Sequence
  Synthetic
gattataccttttggcaaatagatatgactgaacgattttctttagaattaaatcaatttccactaggtagacgg

SEQ ID NO: 201318 - DNA, 75 bp, Artificial Sequence
  Synthetic
tttttgtatcaaagtggattaataactaacaaacgtgttagaaaagagcagccagcaacacgacgcgtaaaacgc

SEQ ID NO: 201319 - DNA, 75 bp, Artificial Sequence
  Synthetic
aaacgtacctcaaaataagcaatgtatccaaagttgtgaatttttatgtttattgtgataaaatactgtgaatcc

SEQ ID NO: 201320 - DNA, 75 bp, Artificial Sequence
  Synthetic
ctaatactgtgaattccaaaactgtgaatggtctctgaatgtactatatttgtctgaataaattgctgatgcgca

SEQ ID NO: 201321 - DNA, 75 bp, Artificial Sequence
  Synthetic
ataatctggttgcaattttactgactcatttgggggctggcaaatatttttcaccgcacccaacaattatttgga

SEQ ID NO: 201322 - DNA, 75 bp, Artificial Sequence
  Synthetic
tagtatatatgcttggcaaggatgtgatcaatgttgctgacaagcacgaatctgtgagggtcgatactgccaaac

SEQ ID NO: 201323 - DNA, 75 bp, Artificial Sequence
  Synthetic
ctaaagccagcaaccgtttctggtaagtttttggcgccaaagggcaaaaaagcaaccgataacggtctcttagag

SEQ ID NO: 201324 - DNA, 75 bp, Artificial Sequence
  Synthetic
tcaaacaaggtgagtacaagttcaaacagtatatggctgactcaagtgttttggcaacgaccgtaaacgtttcat

SEQ ID NO: 201325 - DNA, 75 bp, Artificial Sequence
  Synthetic
attaatcgcctctgggatagttgttgttgccaacaatcatatcttactacattttttctaccgaagacggtcata

SEQ ID NO: 201326 - DNA, 75 bp, Artificial Sequence
  Synthetic
tatcttactacattttttctaccgaagacggtcatataaatagaagcaaaaaccaaaatagattacttttcacag

SEQ ID NO: 201327 - DNA, 75 bp, Artificial Sequence
  Synthetic
atggagactctcttcccaaccagtttggaggcgtactgcgaatacttcaatatcagctttttcaaactaaatttg

SEQ ID NO: 201328 - DNA, 75 bp, Artificial Sequence
  Synthetic
aagtgcatcttctgtaagaattatctttcgcctgttgacttagctttgtttcatgtaaagcaattgagtcttgta

SEQ ID NO: 201329 - DNA, 75 bp, Artificial Sequence
  Synthetic
tggaagcagcatgtatgctatgcttgttgtaacagatgcttattgctaagtgcaaaatttgaatctgaaaagtac

SEQ ID NO: 201330 - DNA, 75 bp, Artificial Sequence
  Synthetic
tttcaatgtgcgtgtcctgtagaaaatttgcatgcattgttggaaaagccattacaggaaattatattaagatgt

SEQ ID NO: 201331 - DNA, 75 bp, Artificial Sequence
  Synthetic
tattactgttactcgttgcttgatcttgcagagaagtttgatttgatttcgagatctaagcaagcttgcttagtg

SEQ ID NO: 201332 - DNA, 75 bp, Artificial Sequence
  Synthetic
agagggcattggagagcaccttgtaggaattgtatcaggcaggaattctgggtgtaaaatgatgggtaacgcacc

SEQ ID NO: 201333 - DNA, 75 bp, Artificial Sequence
  Synthetic
cacacttaaagatatagaattaggtgctgactttggagaattaattttgccctcacatctattgtgtgaagaatc

SEQ ID NO: 201334 - DNA, 75 bp, Artificial Sequence
  Synthetic
attgtcaccagacgacagcccagaagaggcgttactgtcaccttatagagtggatagtttgtgcaatgcttgcac

SEQ ID NO: 201335 - DNA, 75 bp, Artificial Sequence
  Synthetic
gtccagagtcaggctttgtgtagttgccactgctgaagccattcaatttctggagcaactgctttttcgcgacct

SEQ ID NO: 201336 - DNA, 75 bp, Artificial Sequence
  Synthetic
gtcgattgtctgtcctcgctgttcccgggatattttgcgccatggcagagcccagtaaaggtactgaatctttta

SEQ ID NO: 201337 - DNA, 75 bp, Artificial Sequence
  Synthetic
ctaatgaggataaatatacatggtttattgttaatgaagcagactgtgttgatagcttggatacattcgaggaat

SEQ ID NO: 201338 - DNA, 75 bp, Artificial Sequence
  Synthetic
tatttgatgaaagtacagattgttctgatatttcaaatttaatagacaatgatgtggatgaagccgaccagggaa

SEQ ID NO: 201339 - DNA, 75 bp, Artificial Sequence
  Synthetic
attccctggcgctgttcaactctcaaataacagaggattgtgatagagcaatctctgccttaaaacgaaagtata

SEQ ID NO: 201340 - DNA, 75 bp, Artificial Sequence
  Synthetic
tgaaaagcccgccggagactaatgttgcagctcttagtccgagattggaagctattagtctttccccgcaaaggc

SEQ ID NO: 201341 - DNA, 75 bp, Artificial Sequence
  Synthetic
tgataaaaaggagactgtttgaggacagtggaatagcagaagatgaagctgcaaatgctgttgtacaggtagaca

SEQ ID NO: 201342 - DNA, 75 bp, Artificial Sequence
  Synthetic
atttgacaattgaaaatggcgggagtcagagttccttccgttcagcttctgaagaaatccttttatgtagtaata

SEQ ID NO: 201343 - DNA, 75 bp, Artificial Sequence
  Synthetic
aaagagcaaaactgttttctaaggttcaagaattttatggagtatcgtttgcagaattaactagaagttttaaaa

SEQ ID NO: 201344 - DNA, 75 bp, Artificial Sequence
  Synthetic
gtaataaaacattaagtgacaattgggtagtgtttacatatgctgcagcggtggaagtgttagaaggctcgaaac

SEQ ID NO: 201345 - DNA, 75 bp, Artificial Sequence
  Synthetic
accttttacaacaacactgtttgtatctacagttagctcaatttgacttctgtgggttatttttattgcaattta

SEQ ID NO: 201346 - DNA, 75 bp, Artificial Sequence
  Synthetic
aacatgcaaaaagtagagaaactgtgacgaaattattttgtaatattttaaatattgaagattgtcaaatgcttt

SEQ ID NO: 201347 - DNA, 75 bp, Artificial Sequence
  Synthetic
gtgaaccgccaaaatgtagaagtacccccgcagcattatatttctacaagcaaataattaccgaaaaagcatatt

SEQ ID NO: 201348 - DNA, 75 bp, Artificial Sequence
  Synthetic
catttggcacattaccggattgggtctcaaaacatactcaaattaatcaccaaatagcttcacaagcggaagcat

SEQ ID NO: 201349 - DNA, 75 bp, Artificial Sequence
  Synthetic
tcgaactgtctaaaatgattcaatgggcatatgacaatcaattaacagaagaggcagcaattgcctatgaatatg

SEQ ID NO: 201350 - DNA, 75 bp, Artificial Sequence
  Synthetic
ctttactagccggagaagacgttaatgcagcggcatttctaaaaagtaattcgcaagtaaaatatgtgaaagatt

SEQ ID NO: 201351 - DNA, 75 bp, Artificial Sequence
  Synthetic
gtagtgctatggttaaattgtactttcgtcaggaaatgagaaatatgactatgtcacaatggatttataaatgtt

SEQ ID NO: 201352 - DNA, 75 bp, Artificial Sequence
  Synthetic
gtaaagaatgtgatggagaagaagattggaaagttattgctagcttcttaaaatttcaacaaattaatgtagttg

SEQ ID NO: 201353 - DNA, 75 bp, Artificial Sequence
  Synthetic
aatttctgtgtgccttacgattgttttttaaaaaggtgccaaaaaaaacatgtattgtaatttatggtgaaccag

SEQ ID NO: 201354 - DNA, 75 bp, Artificial Sequence
  Synthetic
acactggaaaatcatatttttgcttttcgtttgttaaatttttaaggggaaaagtagtatcatatatgaacaaga

SEQ ID NO: 201355 - DNA, 75 bp, Artificial Sequence
  Synthetic
gctctcatttctggatacaaccattgctagattgtaaggtaggctttctagatgatgcgacctatccatgttggt

SEQ ID NO: 201356 - DNA, 75 bp, Artificial Sequence
  Synthetic
catttatagatgcaaatatgcgtaatgcactagatggaaatcctatgtgtgtagattctaagcataaagcaccac

SEQ ID NO: 201357 - DNA, 75 bp, Artificial Sequence
  Synthetic
agcaatataatttgccaccattgctaattacaagcaatgtagatgtgctaaaagaagaatctttaaaatatttac

SEQ ID NO: 201358 - DNA, 75 bp, Artificial Sequence
  Synthetic
atagcaggataacatgttttaaatttccaaataaattaccatttgattcacataataatcctttatataaattta

SEQ ID NO: 201359 - DNA, 75 bp, Artificial Sequence
  Synthetic
ctgaccaggtgtggaaatcctttttcctgaggcttggcaaacaattagacctccaggacgacgacgaacatgaat

SEQ ID NO: 201360 - DNA, 75 bp, Artificial Sequence
  Synthetic
cagaacgacctgaaagaacgtttagatgtactgcaagatgctctgatgactctttatgaaacaggtcccacagat

SEQ ID NO: 201361 - DNA, 75 bp, Artificial Sequence
  Synthetic
ttaaaatcccaaattaaacattatgaactgttaaggaaagaaagcgctcttgaatattatgctagaaaagaaggt

SEQ ID NO: 201362 - DNA, 75 bp, Artificial Sequence
  Synthetic
tataccaccttaggtcttcaacatcttccaacattgcaagtgtcagagcacaatgctaaaacggctattagaatg

SEQ ID NO: 201363 - DNA, 75 bp, Artificial Sequence
  Synthetic
agtttaattttgcaaagcctagcaaaatcaccatatgccaaagaaacatggacaatgcctgacacgagtgcagac

SEQ ID NO: 201364 - DNA, 75 bp, Artificial Sequence
  Synthetic
agatatgattctccacctagaaactgctttaagaaagacagttatgaagtggaggtatggtttgatggagatcct

SEQ ID NO: 201365 - DNA, 75 bp, Artificial Sequence
  Synthetic
aaaaatgcatttccatacatcaattggaggtggatttattatcaggatgaccatgacatgtggcacaaagttaaa

SEQ ID NO: 201366 - DNA, 75 bp, Artificial Sequence
  Synthetic
ggagaaaccgattataatggattgtatttcactgaaaaagatggaactaagacttattttatattattctctagt

SEQ ID NO: 201367 - DNA, 75 bp, Artificial Sequence
  Synthetic
gatgctggtagatatggaaatgctggatattggactgtaaatgttgacaatgaacaaatcttcccttctgttgcc

SEQ ID NO: 201368 - DNA, 75 bp, Artificial Sequence
  Synthetic
agttcttctaggaggtcttcacctgtctccccgaaaaccatcggggactcagacaggagaccacccagccccacc

SEQ ID NO: 201369 - DNA, 75 bp, Artificial Sequence
  Synthetic
gccgacaccgagaccccgcagaaagacggaagaagatcgattcagcaggaggaggcaagcactagcactgccatc

SEQ ID NO: 201370 - DNA, 75 bp, Artificial Sequence
  Synthetic
aggacaccaagaaggagacgacgacgacgaggagaaggagaaccaacctccagtaagagacgaagaggaggagaa

SEQ ID NO: 201371 - DNA, 75 bp, Artificial Sequence
  Synthetic
cgtgatttcgtctctgctgaagaagttggaagaagccatcgatcagttccacgaacaggtctatcaagaattgaa

SEQ ID NO: 201372 - DNA, 75 bp, Artificial Sequence
  Synthetic
agacttgaagaggaagctagggatccgccaatagtcgttgtgaaggggcctgctaatccattaaagtgttggagg

SEQ ID NO: 201373 - DNA, 75 bp, Artificial Sequence
  Synthetic
tatagatgtgaaaaaaaatataaatcattttatctatatatgactactgtttttagatggataacaaatgaggta

SEQ ID NO: 201374 - DNA, 75 bp, Artificial Sequence
  Synthetic
gcattggctgatggtagagtgcttatagcctttgcaaacactaatcaacgtacccgctttattgccactgttcca

SEQ ID NO: 201375 - DNA, 75 bp, Artificial Sequence
  Synthetic
ttacctaaaggtgcctccatgtgtatgggaaatttggaatgcttataacatgtatcgcagacgaataaaaagagc

SEQ ID NO: 201376 - DNA, 75 bp, Artificial Sequence
  Synthetic
ttctgttacagacatttacaggtcttgtgtccagggcggggattgtcctaccgatgttaaaaacaaagtggaagg

SEQ ID NO: 201377 - DNA, 75 bp, Artificial Sequence
  Synthetic
gaccacatgggccgatacattattaaaaatatttagtagtgtcatttatttggggaatttaggaataggcactgg

SEQ ID NO: 201378 - DNA, 75 bp, Artificial Sequence
  Synthetic
taagggcagtggtggatcatttggatataggccaatagaagcgcaggtaccccaagggggtggttcctctgtagc

SEQ ID NO: 201379 - DNA, 75 bp, Artificial Sequence
  Synthetic
tagaccacgaccttccattccaacagttgatgttattggtcctacagacatactacctgttgcaccagacgcccc

SEQ ID NO: 201380 - DNA, 75 bp, Artificial Sequence
  Synthetic
tgcaatagttccattaagtgaaggaattccagaaacaggaatcattgatacgcctgcggcaggtccagggttaga

SEQ ID NO: 201381 - DNA, 75 bp, Artificial Sequence
  Synthetic
ttccacagggactgacataactactattattgaccctatatctgaggtaactggtgtaggtgaacatcctaatat

SEQ ID NO: 201382 - DNA, 75 bp, Artificial Sequence
  Synthetic
tatcagtacatccgaagatgtagcacagattgatgttcagctttctccaccaccgcctaaaaaggtagctttaga

SEQ ID NO: 201383 - DNA, 75 bp, Artificial Sequence
  Synthetic
tcccagtataacgcatacatctgttgtagaagctacaagggtttcccatgttgaccctgattataacgtttttgt

SEQ ID NO: 201384 - DNA, 75 bp, Artificial Sequence
  Synthetic
gaatccagcattcaatggcgttcatattggggacccagaatatatagagttaacccaaataaacagaatggctga

SEQ ID NO: 201385 - DNA, 75 bp, Artificial Sequence
  Synthetic
gttcgaaatagatgcgggccctttaagaagtacacctgtatctgagcgcgtgatctccagggcgcgagatttgta

SEQ ID NO: 201386 - DNA, 75 bp, Artificial Sequence
  Synthetic
taatagatatgttcaacaggtccctgctcgtagttctgacctagtaggcctaacctcccgcgcttctcaatttga

SEQ ID NO: 201387 - DNA, 75 bp, Artificial Sequence
  Synthetic
atttgttaatcccgcctttgaaggtgatttgaccagtctgtttaatgatgatctagcagaattagctgcaggttc

SEQ ID NO: 201388 - DNA, 75 bp, Artificial Sequence
  Synthetic
aaccaccgaacctatctcttttactactgaacctcaattatcagaaacagatgatagaacaatacgtcttagtcg

SEQ ID NO: 201389 - DNA, 75 bp, Artificial Sequence
  Synthetic
cttaggccgaaggccgggtatgacaacacgtagtgggcttgatattggacaaagaattcatgtgtatgttgacat

SEQ ID NO: 201390 - DNA, 75 bp, Artificial Sequence
  Synthetic
gagccctataccacgggatactattgaattacagacatttggagaattcagtcatgatagctctgtagttgatga

SEQ ID NO: 201391 - DNA, 75 bp, Artificial Sequence
  Synthetic
attaaccacatctagttttattaacccttttgagatgaacattggtgaaagtgacattttagataccttgcaaga

SEQ ID NO: 201392 - DNA, 75 bp, Artificial Sequence
  Synthetic
ggacttctctggaacccacttggttgtagtaaatagtgatgtaccagaggatacgttagagatacctacactggc

SEQ ID NO: 201393 - DNA, 75 bp, Artificial Sequence
  Synthetic
accagaatttaatgttaaagtgtttgtaaatgactacgctgctaaggcttttccttatcacccgatttctgatgt

SEQ ID NO: 201394 - DNA, 75 bp, Artificial Sequence
  Synthetic
tgcagttaatattcctagtccatatactcctttgggaccctctcagggattaacagtagatttttatgattttga

SEQ ID NO: 201395 - DNA, 75 bp, Artificial Sequence
  Synthetic
taacagtagatttttatgattttgatctgcatccttccttactaagaaaaagaaaaaggtctattttctaatttt

SEQ ID NO: 201396 - DNA, 75 bp, Artificial Sequence
  Synthetic
gcagatggctacttggagttcgaatactggaagattatatttgcctccagccaaacctactgcgaaggttttatc

SEQ ID NO: 201397 - DNA, 75 bp, Artificial Sequence
  Synthetic
aactgatgaatatgttactcctaccaatatttattttcatgccaatactgagagattacttactgttggccatcc

SEQ ID NO: 201398 - DNA, 75 bp, Artificial Sequence
  Synthetic
ttactatgatattgtggaccctgtggacgaaaagactattaccgtgcctaaggtgtcagctaatcaatacagagt

SEQ ID NO: 201399 - DNA, 75 bp, Artificial Sequence
  Synthetic
acttcggctacggttgccagatcctaataggtttgctctcatagacacaacaatatataatcctgaaagggagag

SEQ ID NO: 201400 - DNA, 75 bp, Artificial Sequence
  Synthetic
gttggtttggcgtttacaaggcatagaaattgatagggggggtccccttggtgttgggactactggacatccatt

SEQ ID NO: 201401 - DNA, 75 bp, Artificial Sequence
  Synthetic
atttgacaagcttggtgatacagaaaacccgtctgcataccaaaatgtacctacagatgtagtagataataggca

SEQ ID NO: 201402 - DNA, 75 bp, Artificial Sequence
  Synthetic
aaatgtgtcttttgatcctaagcaaaatcaaatgtttatagttggctgtgcacctgctattggtcaacattggga

SEQ ID NO: 201403 - DNA, 75 bp, Artificial Sequence
  Synthetic
tttagcgaccccttgtgaaaatccccctccacagaaaggctcctgtccccctatcaaacttgtacattcccctat

SEQ ID NO: 201404 - DNA, 75 bp, Artificial Sequence
  Synthetic
tcaggatggggatatgtgtgatattggtttaggtgctgtgaacttcagtacattttctgccagtagagctgatgc

SEQ ID NO: 201405 - DNA, 75 bp, Artificial Sequence
  Synthetic
tcctttggaagtaatcaattctatttgtaaatggccagatttcattcaaatgacaaaggaaatatacggtgatcg

SEQ ID NO: 201406 - DNA, 75 bp, Artificial Sequence
  Synthetic
ctgttttttttatgggaaacgagaacaggtttatgctagacacatgttttgtaaagatggagtaaatggtgacag

SEQ ID NO: 201407 - DNA, 75 bp, Artificial Sequence
  Synthetic
tattcctcagagtaacaatccagaagatcatgatagatttttcttagaacctgatgacaatgcagcccctaaaaa

SEQ ID NO: 201408 - DNA, 75 bp, Artificial Sequence
  Synthetic
tggcttgggaaatcatagttactttcccacacctagtggctctctagtaaccagtgaatcacagttatttaatag

SEQ ID NO: 201409 - DNA, 75 bp, Artificial Sequence
  Synthetic
gcctttttgggtgcataaggctcagggtaataacaatggtattgcttggggaaatgagttatttgtgacaatagc

SEQ ID NO: 201410 - DNA, 75 bp, Artificial Sequence
  Synthetic
agacaatactagaaacaccaactatatattgtcagtttacacgggtgattcccctattgataatcagtataaata

SEQ ID NO: 201411 - DNA, 75 bp, Artificial Sequence
  Synthetic
caagtctactcaatttagacactacctcagacacacagaagaatatgaagttgaaattattatgcagttgtgcaa

SEQ ID NO: 201412 - DNA, 75 bp, Artificial Sequence
  Synthetic
aatcactttagatgcagatatcttagcacacattaacgctatgaatccagctattttagatgaatggcagctggc

SEQ ID NO: 201413 - DNA, 75 bp, Artificial Sequence
  Synthetic
atttgttccagcgccgccacaaagtttggaggatgcatatcgtttcattaggtctcaggcaacaatgtgtcccac

SEQ ID NO: 201414 - DNA, 75 bp, Artificial Sequence
  Synthetic
agagcttccaccaaccgaaaaacctgatccttataaaggattaaacttttgggacgttgatctcaaagaccgatt

SEQ ID NO: 201415 - DNA, 75 bp, Artificial Sequence
  Synthetic
cacttcagatttagatcagacacctttgggaaagaaatttttatatcaaatgggtatgattactggtggagttaa

SEQ ID NO: 201416 - DNA, 75 bp, Artificial Sequence
  Synthetic
aagaataaggaatacctatacatcaagtactccatctacattaaggaaacgcagtgctaaacggcgccgtgtaac

SEQ ID NO: 201417 - DNA, 75 bp, Artificial Sequence
  Synthetic
caccaaaggtgtgtaagaatttcctcctgcacacacatacttactgtgacctatatctaagcatatactgtgact

SEQ ID NO: 201418 - DNA, 75 bp, Artificial Sequence
  Synthetic
tattacaaaatattataatactgtgaatggtaccaatgtgaattccttgccctcccttaatgtgatgttatgacc

SEQ ID NO: 201419 - DNA, 75 bp, Artificial Sequence
  Synthetic
ctttaattgtaattacatcggacttctaataaacaaaatattgttttgactcatctgtgtcttatttaaaccctg

SEQ ID NO: 201420 - DNA, 75 bp, Artificial Sequence
  Synthetic
cgtcgtgtggctatttgccattacagtctgtgtagtgccaaaccttcaacatattgatatacaccgtgcgattgc

SEQ ID NO: 201421 - DNA, 75 bp, Artificial Sequence
  Synthetic
ctttggtaagtactatcaaccgttatcggtgttacaaagtttgtgctactgcagaccggagtcggtcgcggtgac

SEQ ID NO: 201422 - DNA, 75 bp, Artificial Sequence
  Synthetic
cgcttttggtgtaggttcactttaagaatttgaaaagcaccgttttcggtcgctggaatagctggaggctttgtg

SEQ ID NO: 201423 - DNA, 75 bp, Artificial Sequence
  Synthetic
agtcagtcttggcagattgtactttgcagctggctgtgcgcctttgtaccgggagtggttgtacttttggcacta

SEQ ID NO: 201424 - DNA, 75 bp, Artificial Sequence
  Synthetic
gaatgattgttgttaacaatgagagaatacacaaacattggaaccgacaccggtctataaaatggggatgaaaag

SEQ ID NO: 201425 - DNA, 75 bp, Artificial Sequence
  Synthetic
tgagagaatacacaaacattggaaccgacaccggtctataaaatggggatgaaaagccaaatttgttcattactc

SEQ ID NO: 201426 - DNA, 75 bp, Artificial Sequence
  Synthetic
aatggttagatattataaaagacaagaaatgaaagaaaatgagtatttcagaatggatatggaaatgttgtgatg

SEQ ID NO: 201427 - DNA, 75 bp, Artificial Sequence
  Synthetic
ttatttcatatgtaaaaaatcataaccgagagtggtataaattaagatgcgtttgcagatttttactcagtcttc

SEQ ID NO: 201428 - DNA, 75 bp, Artificial Sequence
  Synthetic
atggaggctgcacagtttcctacatgcttgaggacctactgcaacgttttcaatatatcattatttgatttacaa

SEQ ID NO: 201429 - DNA, 75 bp, Artificial Sequence
  Synthetic
ttaaggtgcatattttgcagatgctatctatccttgggtgatttagcgtctttctatgaaaaaaaattaagctta

SEQ ID NO: 201430 - DNA, 75 bp, Artificial Sequence
  Synthetic
atttggaagaataatatatgttttgcatgttgtttacggtgcttgtgtttgagtgcaaggtatgaggcagagcat

SEQ ID NO: 201431 - DNA, 75 bp, Artificial Sequence
  Synthetic
tatttccaatgcgtttgcaaggtgcaaagtttgcatgctctactgaatagaccattgaatgatgttgttatgaga

SEQ ID NO: 201432 - DNA, 75 bp, Artificial Sequence
  Synthetic
tgttattattgttacaacttgcttgacctagcttctaaatatgacttgatttcacgagataagttagcctgttta

SEQ ID NO: 201433 - DNA, 75 bp, Artificial Sequence
  Synthetic
gttagaggacactggagagcaccttgtagagattgtctcaatagagagatataaagatgatgggcctgcagccta

SEQ ID NO: 201434 - DNA, 75 bp, Artificial Sequence
  Synthetic
ccatacaagatattgagttacaagaaactttagagaatttagttatgccatcagcattattatgtgaagagtctt

SEQ ID NO: 201435 - DNA, 75 bp, Artificial Sequence
  Synthetic
tgtcaccggacgacaccccagaggaggagtcattgtcgccttactgggttgattgccgatgctattcttgtgata

SEQ ID NO: 201436 - DNA, 75 bp, Artificial Sequence
  Synthetic
atttggtgcgactttgcgttgctgcaacaactggagcaatacatctgctgcagcagctgctcttcaacgacttat

SEQ ID NO: 201437 - DNA, 75 bp, Artificial Sequence
  Synthetic
ctcttttgtgcccggtgtgttccaggattactgttcgccatggcagacactaaaggtactaataatatagaaatg

SEQ ID NO: 201438 - DNA, 75 bp, Artificial Sequence
  Synthetic
gatgacagttcttggtttattgttcacgaagctgattgtgttgatgttactaatagtttggatgaactatttgag

SEQ ID NO: 201439 - DNA, 75 bp, Artificial Sequence
  Synthetic
gacagcacagactgttctaacatatctaatctaatagacgattccgtggatgaaatcgaccagggaaattccctg

SEQ ID NO: 201440 - DNA, 75 bp, Artificial Sequence
  Synthetic
gcactttacaatcaacaagttacagaggaatgtaacagtgcagttgcaagtctaaaacgaaagttcagaaaaagt

SEQ ID NO: 201441 - DNA, 75 bp, Artificial Sequence
  Synthetic
ccgcctgaacagtcagtggcggctcttagtccacggttgcaagctatatcaatttctcctcaaagaatcgggagc

SEQ ID NO: 201442 - DNA, 75 bp, Artificial Sequence
  Synthetic
agcaaaagaaaattatttgaggacagtggaataggagacgatgaaactacaaatacttaccaggtagaacctgaa

SEQ ID NO: 201443 - DNA, 75 bp, Artificial Sequence
  Synthetic
atcagagacaatgactgtgagagtagaactgttcagtctgcttgtaatgaattgttgcgttgtacaaatctcaga

SEQ ID NO: 201444 - DNA, 75 bp, Artificial Sequence
  Synthetic
gcaaaattgttgtttaaatttgagagtttctatggtgtatcatacactgaattaacaagacaatttaaaagtgat

SEQ ID NO: 201445 - DNA, 75 bp, Artificial Sequence
  Synthetic
aaaactatgaatgaaaactggataatcgctgtttttgcagcatcatgtgagcttatagaaagctccaaacaatta

SEQ ID NO: 201446 - DNA, 75 bp, Artificial Sequence
  Synthetic
ctaaagcagcattgtgattttatacaattgattgagtttgatttttcaggcttatatcttgttaaatttaaacat

SEQ ID NO: 201447 - DNA, 75 bp, Artificial Sequence
  Synthetic
gcaaaaaacagggatacaatcacaaaacttataagttcattattaaatattaatgaaaggcatttactatgcgac

SEQ ID NO: 201448 - DNA, 75 bp, Artificial Sequence
  Synthetic
ccaccaagatgtagaagtacacctgcagctttatatttttataaacataatattacaggaaaagcatttgtctat

SEQ ID NO: 201449 - DNA, 75 bp, Artificial Sequence
  Synthetic
ggtgtgttacctgaatgggtggctaaacaaacccaggttaatcatcaaatggcggcacaggcagacacatttcaa

SEQ ID NO: 201450 - DNA, 75 bp, Artificial Sequence
  Synthetic
ttaagtaaaatggttcaatgggcgtatgataacaaaatgacagaggagccagcaattgcttactattatgctttg

SEQ ID NO: 201451 - DNA, 75 bp, Artificial Sequence
  Synthetic
ttagcagatgaagattctaatgcagctgcgttcttaaacagtaattcacaggtcaagtttgtaaaagactgctgt

SEQ ID NO: 201452 - DNA, 75 bp, Artificial Sequence
  Synthetic
cagatggtaaggttatactttcggcaagaaatgaaaaatatgacaatggcacagtggattttcaaatgttgtagg

SEQ ID NO: 201453 - DNA, 75 bp, Artificial Sequence
  Synthetic
gaatgtgatggtgaagaagattggaaagttattgctaatttacttaagtatcagggtgtaaatataatagagttc

SEQ ID NO: 201454 - DNA, 75 bp, Artificial Sequence
  Synthetic
cttactgccttaagattatttttcaaaagaatacctaaaaaaaattgtatcttaattcatgggccaccagacact

SEQ ID NO: 201455 - DNA, 75 bp, Artificial Sequence
  Synthetic
gggaaatcgtattttgtatactcattagtgcaatttcttagagggaaagttatatcatttgtgaataaacagtct

SEQ ID NO: 201456 - DNA, 75 bp, Artificial Sequence
  Synthetic
agttttttcttacaaccgttgttagattgtaaagtaggatttatggatgatgctacgtatccatgttggtcattt

SEQ ID NO: 201457 - DNA, 75 bp, Artificial Sequence
  Synthetic
atagatgtgcatttgagaaacgcattggatggtaatactatgtgtgtagatgctaaacacaaagcacctcaacaa

SEQ ID NO: 201458 - DNA, 75 bp, Artificial Sequence
  Synthetic
tatcaactgcctcctttttttattactagtaatataaatttaaaacaggaagactctctaagatatttgcatagt

SEQ ID NO: 201459 - DNA, 75 bp, Artificial Sequence
  Synthetic
agagtcactagttttgagtttcctaataaaatgcctttagatgggcaaggggatcctgtgtttaaaatcactgat

SEQ ID NO: 201460 - DNA, 75 bp, Artificial Sequence
  Synthetic
caagcatggaaatttttctttctaaagctcgcaaaacaattagacctgcaagacgccgaaaatgaaccaagagga

SEQ ID NO: 201461 - DNA, 75 bp, Artificial Sequence
  Synthetic
cctgagagagcgtttagatgccattcaaacgcagttgatgaatctttatgaatctagccctacagatttacaatc

SEQ ID NO: 201462 - DNA, 75 bp, Artificial Sequence
  Synthetic
ccaaatcaaacattatcagttactaagaaaagaatgtgctatacagtattatgctaaaaaagaaggttataataa

SEQ ID NO: 201463 - DNA, 75 bp, Artificial Sequence
  Synthetic
tttgggattacagcatttacctccaacccgagtgtcagaacataatagcaagcaagcaattaaaatgtctatctt

SEQ ID NO: 201464 - DNA, 75 bp, Artificial Sequence
  Synthetic
attagaaagcttagcaaaatcaccatacgctaatgaagagtggacattaactgagacgagtgcagatcgtctatt

SEQ ID NO: 201465 - DNA, 75 bp, Artificial Sequence
  Synthetic
gtcacccccccgcaattgtttcaaaaaacaaagttttgaagttgaagtatggtttgaccagaatccaaacaatgc

SEQ ID NO: 201466 - DNA, 75 bp, Artificial Sequence
  Synthetic
attcccatatattaattgggaatggatatattatcaagatgaaaacgatgagtggcataaagtaaagggacgaac

SEQ ID NO: 201467 - DNA, 75 bp, Artificial Sequence
  Synthetic
agattataatggactatattttgtagaagtagatggtacagtgtcatactttctactatttgaaaaggatgctaa

SEQ ID NO: 201468 - DNA, 75 bp, Artificial Sequence
  Synthetic
tagatatggacaaacaggaatgtggactgttaatgttaaaaataagcaaattcttcctccctctgttggtagctc

SEQ ID NO: 201469 - DNA, 75 bp, Artificial Sequence
  Synthetic
tgctaggaggtctgtatctgaatcccagagcaacgggacccaatcccccttcaacacccagactgaagagacggt

SEQ ID NO: 201470 - DNA, 75 bp, Artificial Sequence
  Synthetic
cggaggaagacagattcctcaagaagcggcaggacctagttcaaccacgacatcacctaaaagaggacaacgacg

SEQ ID NO: 201471 - DNA, 75 bp, Artificial Sequence
  Synthetic
acgacgaggaggagaaggagaacagaccaccaataagagacgacgacgagctgaaggacgtggaggaactgctga

SEQ ID NO: 201472 - DNA, 75 bp, Artificial Sequence
  Synthetic
cattactgctgaggaagttgggcaaagccatcgatcagtaccagcagcaggtcttacaagagttgagcgacttaa

SEQ ID NO: 201473 - DNA, 75 bp, Artificial Sequence
  Synthetic
agcagaggctcgggatccgccattagtccttataaaaggttgtgctaataaattgaaatgttggaggtatagatg

SEQ ID NO: 201474 - DNA, 75 bp, Artificial Sequence
  Synthetic
tgaacagaaatgtcctaagccttacagttacatgacctctgtgtttaaatggataaccaatgatgtaacgcttgc

SEQ ID NO: 201475 - DNA, 75 bp, Artificial Sequence
  Synthetic
agacagtagattattagttgcatttcatgatagtgctgaaagagcaaaatttctagcttctgtaagtttacctaa

SEQ ID NO: 201476 - DNA, 75 bp, Artificial Sequence
  Synthetic
aggttctagtcattgcttgggaaacatagaatcattgtaatgagtaaaataagacgtaaacgagcatctcctaca

SEQ ID NO: 201477 - DNA, 75 bp, Artificial Sequence
  Synthetic
gatctttataaagcttgtattgctggcgctgattgtatccctgatgtacaaaataaaatagaaggtaaaacatgg

SEQ ID NO: 201478 - DNA, 75 bp, Artificial Sequence
  Synthetic
gctgacacattattgaaaatatttgggagcttggtatattttggtaatttggggattggaacggggagaggtaca

SEQ ID NO: 201479 - DNA, 75 bp, Artificial Sequence
  Synthetic
ggtggcacaggtggctatagaccgttaggtgcccaaacaccagcaagaacaccatcacttgctcctccaagacct

SEQ ID NO: 201480 - DNA, 75 bp, Artificial Sequence
  Synthetic
tccataccaaatgtggaagttataggccctgcagaaatattgcccattagtcccgaagcacctgctatcgtgcct

SEQ ID NO: 201481 - DNA, 75 bp, Artificial Sequence
  Synthetic
ttacaggaaggcgtgccagatattgggttaattgacactcctggtgctggcccaggtcttgatgttgaccccatt

SEQ ID NO: 201482 - DNA, 75 bp, Artificial Sequence
  Synthetic
gaagttacaactgcaattgatccagtttcagaagtagttggtgtaggtgagcatcccaatgtaatcagcaacaca

SEQ ID NO: 201483 - DNA, 75 bp, Artificial Sequence
  Synthetic
aatgaggttgctcaaatcgatgtgcagctagctcctccaccacctaaacgcattgctttagatcctagttttact

SEQ ID NO: 201484 - DNA, 75 bp, Artificial Sequence
  Synthetic
gacaatacatctatagtgtatactcgtgaatctcacgttgaccccaatgtaaatgtatttgttaatcctctgttt

SEQ ID NO: 201485 - DNA, 75 bp, Artificial Sequence
  Synthetic
gatgcagtgaatataggacagcccgaatatattgaattacaagagataaatttacgtgaggaatttgaaataagt

SEQ ID NO: 201486 - DNA, 75 bp, Artificial Sequence
  Synthetic
gaaggaccaatagaaagcacacctttatctacgcgcgcaatcaacagggcgcgagatttatacagtagatttgtt

SEQ ID NO: 201487 - DNA, 75 bp, Artificial Sequence
  Synthetic
cagcaagttccaaccagacaagctgacattctaggcctgagttcccgcccatcaactgttgaatttgaaaatccc

SEQ ID NO: 201488 - DNA, 75 bp, Artificial Sequence
  Synthetic
gcctttgaaactgatgtgtcagatgtttttcatcaagatgtgttagaagtcagtcaacaagtgcaaaacacccag

SEQ ID NO: 201489 - DNA, 75 bp, Artificial Sequence
  Synthetic
cttaaatttgtatctgaaccacgtttatcacaaacgcctggaaggacagtacgattgagcaggctagctcaaaaa

SEQ ID NO: 201490 - DNA, 75 bp, Artificial Sequence
  Synthetic
cctggtatgacaaccagaagtggtttagaaattggtcaaagagtacatttatattatgatataagtagtattcaa

SEQ ID NO: 201491 - DNA, 75 bp, Artificial Sequence
  Synthetic
cctgaatcaattgaactacagcctttaggtgaatattctcatgaatctacctgggtagatgaattagctagtacc

SEQ ID NO: 201492 - DNA, 75 bp, Artificial Sequence
  Synthetic
acctttatcaatccatttgagaatgcaattaatggtttttcggatgacgttcttttagatcccttagatgaaaat

SEQ ID NO: 201493 - DNA, 75 bp, Artificial Sequence
  Synthetic
ttctctaatagtcatttactattaacagcaacagatacagctgaagataatattgaaattccctctctaccacca

SEQ ID NO: 201494 - DNA, 75 bp, Artificial Sequence
  Synthetic
ggtataggtttaaatatagaactaactaatttaggaaaggatatttttgtatataatgaaggttttgatttgtca

SEQ ID NO: 201495 - DNA, 75 bp, Artificial Sequence
  Synthetic
gatgtaaatgtacctttttcacccctgataccaattaatccatcattaggagctagtgttatatttgatacttat

SEQ ID NO: 201496 - DNA, 75 bp, Artificial Sequence
  Synthetic
gatttgcatccctctttactgaagcgaaaacgcaaacgtccttttttttaattttgcagatggccacttggagtt

SEQ ID NO: 201497 - DNA, 75 bp, Artificial Sequence
  Synthetic
cgaatgcaggaagattatatttgcctcctgtgaagccagtagcaaggattttatcaacagatgaatatattaagc

SEQ ID NO: 201498 - DNA, 75 bp, Artificial Sequence
  Synthetic
caacatcttatttttttcatgctagtacggatagacttttaactgttggccatccatattttgatatagtggata

SEQ ID NO: 201499 - DNA, 75 bp, Artificial Sequence
  Synthetic
atcgccaaaaagtgacagttccaaaggtttctgcaaaccaatttagagtgttacgtttacaattacctgatccta

SEQ ID NO: 201500 - DNA, 75 bp, Artificial Sequence
  Synthetic
atcaatttgctctaattgattctacagtgtataatccagagagagaacgattagtatggcaattgaagggagttc

SEQ ID NO: 201501 - DNA, 75 bp, Artificial Sequence
  Synthetic
agatagatagaggtggtcctctaggcgtagggacaacagggcacccgttatttgataaatttggtgacactgaaa

SEQ ID NO: 201502 - DNA, 75 bp, Artificial Sequence
  Synthetic
accctagtgtttatcctgatgtcacagcaagcaaggaaaacagaatgaatgtttcttttgatcctaaacaaaatc

SEQ ID NO: 201503 - DNA, 75 bp, Artificial Sequence
  Synthetic
aattatttatagtaggctgtaaaccagctataggacagcattgggatattgctgatccttgtacgccacctgtag

SEQ ID NO: 201504 - DNA, 75 bp, Artificial Sequence
  Synthetic
ataaaggcttatgtccacctattaggttagtacacacaactattcaggatggagatatgtgcgatataggtctgg

SEQ ID NO: 201505 - DNA, 75 bp, Artificial Sequence
  Synthetic
gcgctgcaaacttttcagcattttcagaaagtagagcagacgctcctttagagattattaactccacttgtaaat

SEQ ID NO: 201506 - DNA, 75 bp, Artificial Sequence
  Synthetic
ggcctgattttactcaaatgacaaaagatatttatggggacagattgtttttttatggtcgcagagaacaagtgt

SEQ ID NO: 201507 - DNA, 75 bp, Artificial Sequence
  Synthetic
atgctagacattatttttgtaaagatggagttgttggtgatagcattccagatggcgtagaacctaatgagcatg

SEQ ID NO: 201508 - DNA, 75 bp, Artificial Sequence
  Synthetic
gcaggttctttttatcacctgacaatgctacacctccagataaaggcttagccccttcgacgtattatccgacgc

SEQ ID NO: 201509 - DNA, 75 bp, Artificial Sequence
  Synthetic
ccagtggttcgttagttagcagcgaatctcaaatatttaataggccattttgggtacataaagctcagggaagca

SEQ ID NO: 201510 - DNA, 75 bp, Artificial Sequence
  Synthetic
ataatgctatcctttggggaaatgaactatttattactatagtggataatactcgcaacactaattttatattgt

SEQ ID NO: 201511 - DNA, 75 bp, Artificial Sequence
  Synthetic
ctgtatacaaggaagataatcctattgataatcaatataaatataaatcagacaacttcagacattatatgagac

SEQ ID NO: 201512 - DNA, 75 bp, Artificial Sequence
  Synthetic
ataccgaggagtttgaagtggagcttgtgactcaattgtgtaaagttcctctggaagctgatgtgctagcccaca

SEQ ID NO: 201513 - DNA, 75 bp, Artificial Sequence
  Synthetic
ttaatgcaatggactctcgcatcttagatgactgggagttagcatttattccttcacctcctcagggcttggagg

SEQ ID NO: 201514 - DNA, 75 bp, Artificial Sequence
  Synthetic
attcgtatagatttattagatcattagccactatgtgtcctaaggatgttcctaaaccagacaaagaagatcctt

SEQ ID NO: 201515 - DNA, 75 bp, Artificial Sequence
  Synthetic
acaaggatttaacattttggaaggtggatttgcgagataaatttacctccgagcttgatcagacaccattaggca

SEQ ID NO: 201516 - DNA, 75 bp, Artificial Sequence
  Synthetic
aaaaattcttatatcagatgggattacttaattcccgtaagcgaccacggaatatctatgaaccaacaactcctt

SEQ ID NO: 201517 - DNA, 75 bp, Artificial Sequence
  Synthetic
ctactgtgaagcgtcgcactactaaacgacgccgtgttaccagagcagtctcataactgtgaaacttcgtagagc

SEQ ID NO: 201518 - DNA, 75 bp, Artificial Sequence
  Synthetic
tgtactgtgaaaataagctgtgaacatatggtgctatgtatcctgacttacttgatgtgtccactaataaacaag

SEQ ID NO: 201519 - DNA, 75 bp, Artificial Sequence
  Synthetic
gcattgctgactcattatattggtagtttaccctcctattatttgcccacaacatttttgaaaccccacagtgac

SEQ ID NO: 201520 - DNA, 75 bp, Artificial Sequence
  Synthetic
ctgcagacctccagagagtgaacatcgcacacaaacgtcgcgcgaccactttcggtgagttgcctttatccttac

SEQ ID NO: 201521 - DNA, 75 bp, Artificial Sequence
  Synthetic
cacagcgaccgaaaatggttgtcacagtgctttctagtttaaaccaccttttattgaacttagaccgaatttggt

SEQ ID NO: 201522 - DNA, 75 bp, Artificial Sequence
  Synthetic
atagttttggcgcgttctgcaaatccaaccgttaacgatcgtttaagataagctggcaagaacaacaccgttatc

SEQ ID NO: 201523 - DNA, 75 bp, Artificial Sequence
  Synthetic
ggtcgtttttatggctgaaggcatttgagtcatcttctggctgcttgagcctgcagttggctgtcagcctttgta

SEQ ID NO: 201524 - DNA, 75 bp, Artificial Sequence
  Synthetic
ccgggagtggttggtattttggcaatggaatgattgttgttaacaataataccaaaatacatttttgaaccgaag

SEQ ID NO: 201525 - DNA, 75 bp, Artificial Sequence
  Synthetic
aataataccaaaatacatttttgaaccgaagccggtctataaatttagaggtcttccttgtttttcatcatttcg

SEQ ID NO: 201526 - DNA, 75 bp, Artificial Sequence
  Synthetic
atggagactctcttccctaccagtctggaggcgtactgcgactacttcaacattagcttttttaaactgcaattg

SEQ ID NO: 201527 - DNA, 75 bp, Artificial Sequence
  Synthetic
aaatgtattttctgcaggaattatcttacgcctgttgatctagcattatttcatgtaaagcaattgagtcttgta

SEQ ID NO: 201528 - DNA, 75 bp, Artificial Sequence
  Synthetic
tggaaggagcgtatttgctatgcttgttgtaacagatgcttattgcttagtgcaaaatttgaagcggaaaagtac

SEQ ID NO: 201529 - DNA, 75 bp, Artificial Sequence
  Synthetic
tttcagtgtgcgtgtcctgtagaaactttgcatgctttattagagaaacctttacaggaaattatattacgctgt

SEQ ID NO: 201530 - DNA, 75 bp, Artificial Sequence
  Synthetic
tactattgctactcactgcttgatttacctgagaagtttgatttgatatctagatctaagcaggcttgcttagta

SEQ ID NO: 201531 - DNA, 75 bp, Artificial Sequence
  Synthetic
agagggcactggagagcaccttgcagaaattgtatcaagcaggaattctggatttaaaatgatgggaaacgcgcc

SEQ ID NO: 201532 - DNA, 75 bp, Artificial Sequence
  Synthetic
cactataaaagatatagaattagatgctgagcttggggatttaattttgccatcacagctattgtgtgaagaatc

SEQ ID NO: 201533 - DNA, 75 bp, Artificial Sequence
  Synthetic
attgtcaccagacgacagcccagaggaggagttactgtcaccttacagagttgacagtttgtgtaattcttgtac

SEQ ID NO: 201534 - DNA, 75 bp, Artificial Sequence
  Synthetic
agccagagtcaggctttgtgtagttgcaacagctgacgctattcaatttttggagcgactgctttttcgtgacct

SEQ ID NO: 201535 - DNA, 75 bp, Artificial Sequence
  Synthetic
atcgattgtttgccctcggtgttcgcgggacgttttacgccatggcagaacccagtaaaggtactgaaactttta

SEQ ID NO: 201536 - DNA, 75 bp, Artificial Sequence
  Synthetic
ataatgaggataaaaatgcttggtttattgttgatgaagcagactgtgttgatagcttggaaacattcgaggaat

SEQ ID NO: 201537 - DNA, 75 bp, Artificial Sequence
  Synthetic
tatttgatgaaagtacagatggttctgatatatcaaatttaatagacaatgatgtggatgaagtcgaccagggaa

SEQ ID NO: 201538 - DNA, 75 bp, Artificial Sequence
  Synthetic
attccctggcgctgttgaactctcaaataacagaggattgtgatagagcagtctctgccttaaaacgaaagtata

SEQ ID NO: 201539 - DNA, 75 bp, Artificial Sequence
  Synthetic
tgaaaagcccgccggagtctaatgttgcagcacttagtccaagattggaagcaattagtctttctccgcaaagac

SEQ ID NO: 201540 - DNA, 75 bp, Artificial Sequence
  Synthetic
taattaaaaggagactgtttgaggacagtggaatagcagaagatgaagctacaaatgctgctgtacaggtagact

SEQ ID NO: 201541 - DNA, 75 bp, Artificial Sequence
  Synthetic
ctttgtcatacgaaaatggcgggacgcagagctccttaagctctgcttgtgaagagatcctcttatgtagcaata

SEQ ID NO: 201542 - DNA, 75 bp, Artificial Sequence
  Synthetic
aaagagccaaactatttactaagtgccaagacttgtatggagtgtcgttcgcagaactaactagaagttttaaaa

SEQ ID NO: 201543 - DNA, 75 bp, Artificial Sequence
  Synthetic
gtaataaaacgttgagtgacaattgggtagtgtttacattcgcagcagccgtggaagtgttagaagggtcaaagc

SEQ ID NO: 201544 - DNA, 75 bp, Artificial Sequence
  Synthetic
atctgctgcaacaacactgtcattatctacaagtatcacagtttgacttttgtggtttgtttttgctgcatttta

SEQ ID NO: 201545 - DNA, 75 bp, Artificial Sequence
  Synthetic
agcatgctaaaagtagagaaactgttacaaaattgttttgtaatattcttaatattgaagaatgtcaaatgttat

SEQ ID NO: 201546 - DNA, 75 bp, Artificial Sequence
  Synthetic
gtgagccaccaaaatgcagaagtacgccggctgcgctatatttttacaaacaaaaaattaccgagaaagcatatt

SEQ ID NO: 201547 - DNA, 75 bp, Artificial Sequence
  Synthetic
catttggaatattaccagattgggttgtaaaacaaacacaagtaaatcatcagctagcttcacaggcagaagcat

SEQ ID NO: 201548 - DNA, 75 bp, Artificial Sequence
  Synthetic
ttgagttatctaaaatggttcaatgggcatatgacaatcaattaacagaagactctgcaattgcatatgagtatg

SEQ ID NO: 201549 - DNA, 75 bp, Artificial Sequence
  Synthetic
ctttgttagctacagaagatgtaaacgcagctgcatttttaaaaagtaattcacaagttaaatatgttaaagatt

SEQ ID NO: 201550 - DNA, 75 bp, Artificial Sequence
  Synthetic
gcagcgccatggtaaagttatatttaaggcaagaaatgagaaatatgagtatgtctcaatggatatataaatgtt

SEQ ID NO: 201551 - DNA, 75 bp, Artificial Sequence
  Synthetic
gtagagaatgtgatgggcaagaagattggaaggtgattgctagcttcctaaagtttcagcaaattaatgttgtag

SEQ ID NO: 201552 - DNA, 75 bp, Artificial Sequence
  Synthetic
aatttctttgtgcgttacgattgtttttcaagaaagttcccaaaaaaacatgtattgttatttatggggaaccag

SEQ ID NO: 201553 - DNA, 75 bp, Artificial Sequence
  Synthetic
acacgggaaagtcgtatttctgtttttcgtttataaagtttttaagaggtaaagtagtatcatacatgaataaaa

SEQ ID NO: 201554 - DNA, 75 bp, Artificial Sequence
  Synthetic
ctttgtgtctacttttctcaactaaacgaaatttttgctatggccggcatctttgatgctggagtcgtagtgtaa

SEQ ID NO: 201555 - DNA, 75 bp, Artificial Sequence
  Synthetic
gttgtgcatttcagtcgtgctcatctttgtggtgagtattttgctattatgttgttgctctactggttgctgtgg

SEQ ID NO: 201556 - DNA, 75 bp, Artificial Sequence
  Synthetic
ttgaaatttcatttgggttgcaacagtttggaagcaagtgctgtgtgtcctagtctaagggtttcgtgttccgtc

SEQ ID NO: 201557 - DNA, 75 bp, Artificial Sequence
  Synthetic
cttctttagttgtcttgcatcttctactagaggttgttgtgagtcaactaaacttccttattacgacgttgaaaa

SEQ ID NO: 201558 - DNA, 75 bp, Artificial Sequence
  Synthetic
tagtctaagggtttcgtgttccgtcacgagattccattctacaaacgccttacgcgaggttctgtctcgtgtttg

SEQ ID NO: 201559 - DNA, 75 bp, Artificial Sequence
  Synthetic
tgctttttagactttgtgtctacttttctcaactaaacgaaatttttgctacggccggcatctttgatgctggag

SEQ ID NO: 201560 - DNA, 75 bp, Artificial Sequence
  Synthetic
gattcacatacagtaatggctctaggtttgtttactttgcaaatcgagtctgctgttaatcaatcgctaagcaag

SEQ ID NO: 201561 - DNA, 75 bp, Artificial Sequence
  Synthetic
tgtggaagcaaagttttgtctttgtggaaaccagtaactgttcctaatggcctgcaaccgtgtgacacttgccgt

SEQ ID NO: 201562 - DNA, 75 bp, Artificial Sequence
  Synthetic
gtcttgagacctatctagttagtaactgctaatggaacggtttcgatatggatacacaaaaaaaaaaaaaaaaaa

SEQ ID NO: 201563 - DNA, 75 bp, Artificial Sequence
  Synthetic
tcgaaagttagtgccgtagtttcgcgccaggttatccaggatgtgagagctgccgctgtcactttcaacttgcta

SEQ ID NO: 201564 - DNA, 75 bp, Artificial Sequence
  Synthetic
agcaagtgattctgaaatttctgcatatggctgttctactattgcgcaagccgtccgccgttatagcgaggccgc

SEQ ID NO: 201565 - DNA, 75 bp, Artificial Sequence
  Synthetic
ggaaaccagtaactgttcctaatggcctgcaaccgtgtgacacttgccgtagcaagtgattctgaaatttctgca

SEQ ID NO: 201566 - DNA, 75 bp, Artificial Sequence
  Synthetic
gcttatacactaatgagcctctttgttgtttactttgctttttttcaaagcaagatctaatcgaggaagagtagc

SEQ ID NO: 201567 - DNA, 75 bp, Artificial Sequence
  Synthetic
tagcaatggttttagggcatgccgatttgtttcattagatttgcaggattgcatcgttggcattgcagatgatac

SEQ ID NO: 201568 - DNA, 75 bp, Artificial Sequence
  Synthetic
tcttatagtgtttaaaattttaatcctcttcgtttatgtaccattgctgtattggtctcaagcttacattgatgc

SEQ ID NO: 201569 - DNA, 75 bp, Artificial Sequence
  Synthetic
atatgttatgggtctgcatggcaatcagacgttgttttgcaacataatgaaattttctgaccgtccttttatgct

SEQ ID NO: 201570 - DNA, 75 bp, Artificial Sequence
  Synthetic
aattttctgaccgtccttttatgcttcatgggtggttggttttttccaattcaaattaccttttggaggaatttg

SEQ ID NO: 201571 - DNA, 75 bp, Artificial Sequence
  Synthetic
gacgttgattgctgtaattttgcttggaaggtttttccatacagcttggtactgttggctgtacaaaacatggga

SEQ ID NO: 201572 - DNA, 75 bp, Artificial Sequence
  Synthetic
atgttgtcttcggtaagagaggtggtggtaatgtgacatacactgaccagtatctctgtggcgccgatggcaaac

SEQ ID NO: 201573 - DNA, 75 bp, Artificial Sequence
  Synthetic
tttcatagtcttcaatgtaaccacactttgctatgtgcaaggcaaatgttggtttcttgaaaataaggctttgaa

SEQ ID NO: 201574 - DNA, 75 bp, Artificial Sequence
  Synthetic
accatttgtgtgcttctacggaggggaccaatttctttacataggtgacagagttgtttcctatgtctcaactaa

SEQ ID NO: 201575 - DNA, 75 bp, Artificial Sequence
  Synthetic
ctgttatgagtgaagatttatggcagtttgttgaccatttcggtgagaacgaagaaattgtcatcaatggtcgta

SEQ ID NO: 201576 - DNA, 75 bp, Artificial Sequence
  Synthetic
cttacgtttgtgcttggcttactaagcgtaagcccttagattacaaacgtcagaacaacctcgccattgaagaga

SEQ ID NO: 201577 - DNA, 75 bp, Artificial Sequence
  Synthetic
cgatttatacgttgctcttagaggacgtattgacagagatcttagcctttctagaaaggttgatctttacaacgg

SEQ ID NO: 201578 - DNA, 75 bp, Artificial Sequence
  Synthetic
cgatggcaaacctgttatgagtgaagatttatggcagtttgttgaccatttcggtgagaacgaagaaattgtcat

SEQ ID NO: 201579 - DNA, 75 bp, Artificial Sequence
  Synthetic
ttgaatatgtgcatggtgatgctttgcacacactacgcaatggttctgttcttgaaatggctaaggaagtgaaga

SEQ ID NO: 201580 - DNA, 75 bp, Artificial Sequence
  Synthetic
tgaatgtgtatactttttttgtgaacacccagctgtcggaatagttaatacagattttaaattggaatttgaaga

SEQ ID NO: 201581 - DNA, 75 bp, Artificial Sequence
  Synthetic
cttgaaatggctaaggaagtgaagacatctagtaaagttgtgttaagcgatgctcttgacaaactttacaaagtc

SEQ ID NO: 201582 - DNA, 75 bp, Artificial Sequence
  Synthetic
tgtttctgaagctagtggatgatcatgctttagttgtaaatgtaatactgtggtgcgtagtacttatagtacttt

SEQ ID NO: 201583 - DNA, 75 bp, Artificial Sequence
  Synthetic
tttggttctcctgttatgacaaatggttccaacatcctagaggcctttactaaacctgtgtttattagtgcatta

SEQ ID NO: 201584 - DNA, 75 bp, Artificial Sequence
  Synthetic
tgctagtttgtattacaattattaaactaattaaattatgttttacatgccatatgttttgtaataaaacggttt

SEQ ID NO: 201585 - DNA, 75 bp, Artificial Sequence
  Synthetic
atggttctgttcttgaaatggctaaggaagtgaagacatctagtaaagttgtgttaagcgatgctcttgacaaac

SEQ ID NO: 201586 - DNA, 75 bp, Artificial Sequence
  Synthetic
taaacctgtgtttattagtgcattagttcaatgtacttgtggtaccaagtcttggtctgtgggtgattggaccgg

SEQ ID NO: 201587 - DNA, 75 bp, Artificial Sequence
  Synthetic
atggtcccattaaaaatgtgtatcacatttaccaatcatacatgcacatagaccctttccctagacaaattattg

SEQ ID NO: 201588 - DNA, 75 bp, Artificial Sequence
  Synthetic
ttttaaatcctcttgttgcaacttgatcagtaataaactgtgtgttgttcccggtaatgttaaacctggtgatgc

SEQ ID NO: 201589 - DNA, 75 bp, Artificial Sequence
  Synthetic
atcagtaataaactgtgtgttgttcccggtaatgttaaacctggtgatgctgtgattactactcagcaagctggt

SEQ ID NO: 201590 - DNA, 75 bp, Artificial Sequence
  Synthetic
atgtctaaactaaacgacaatgactgaagctaatattactcaggaggagttggtaactcacctgaaaaattggaa

SEQ ID NO: 201591 - DNA, 75 bp, Artificial Sequence
  Synthetic
gctggtgttaagtatttttgtggcatgactcttaagtttgttgcaaatattgaaggtgtctctgtttggagagtg

SEQ ID NO: 201592 - DNA, 75 bp, Artificial Sequence
  Synthetic
ggctcgcggtttactactggttttgtctattttaatggtactgggagaggtgattgtaaaggtttttattcaaat

SEQ ID NO: 201593 - DNA, 75 bp, Artificial Sequence
  Synthetic
tgactcttaagtttgttgcaaatattgaaggtgtctctgtttggagagtgattgctcttcagagtgttgattgct

SEQ ID NO: 201594 - DNA, 75 bp, Artificial Sequence
  Synthetic
ttttagttggaatattattctaactattttcattgtcattcttcagtttggccattataaatactcaagaatctt

SEQ ID NO: 201595 - DNA, 75 bp, Artificial Sequence
  Synthetic
ttgttgcttcttccacttttgtagaagaggaacatgttaatagaatggacacattctgcttcaatgtacgcaata

SEQ ID NO: 201596 - DNA, 75 bp, Artificial Sequence
  Synthetic
ttatggtctgaagatgctagttttgtggcttttgtggccacttgtacttgcactttcaatctttgacacttgggc

SEQ ID NO: 201597 - DNA, 75 bp, Artificial Sequence
  Synthetic
gtgttactgatgagtgtcgtctggccatgttgggtgctgaaatgactagtaatgtcagaagacaagttgcttcag

SEQ ID NO: 201598 - DNA, 75 bp, Artificial Sequence
  Synthetic
aaactggggatccaactgggcctttgtcgcattcagcctttttatggccgtatcaacactcattatgtgggtgat

SEQ ID NO: 201599 - DNA, 75 bp, Artificial Sequence
  Synthetic
gtgtcatagacattagtaccggctggtttgatgtttatgatgacatctttgctgaaagcaaaccatggtttgttc

SEQ ID NO: 201600 - DNA, 75 bp, Artificial Sequence
  Synthetic
gtatttcgtaaatagtttcagacttttccgacgtgctcgaactttttgggcatggaacccggaagtgaatgcaat

SEQ ID NO: 201601 - DNA, 75 bp, Artificial Sequence
  Synthetic
cacagtcacaaccgtgctgggacagacgtactaccaacccattcaacaagctccaacaggcattacggtgacctt

SEQ ID NO: 201602 - DNA, 75 bp, Artificial Sequence
  Synthetic
cttaaacaacttaaagtcactacaggtgaacttgtgagatttgttaagtctatttgcaattcagctgttgctgtc

SEQ ID NO: 201603 - DNA, 75 bp, Artificial Sequence
  Synthetic
ctccaacaggcattacggtgaccttgctgagcggcgtgctttacgtggacggacatagattggcttcaggtgttc

SEQ ID NO: 201604 - DNA, 75 bp, Artificial Sequence
  Synthetic
gtgggtggtactatacaaattctcgctagtgtgcctgagaagtttttgaatgcgtttgacgtgtttgtcacagct

SEQ ID NO: 201605 - DNA, 75 bp, Artificial Sequence
  Synthetic
attcaaactgtctttgactgtgctgttgaaacttgtactattgccggtaaagcatttgacaaggtttttgactat

SEQ ID NO: 201606 - DNA, 75 bp, Artificial Sequence
  Synthetic
ccgtaaattcacgaaacagcacaggttgggttttctacgtacgagtaaaacacggtgacttttctgcagtgagct

SEQ ID NO: 201607 - DNA, 75 bp, Artificial Sequence
  Synthetic
ttgaaacttgtactattgccggtaaagcatttgacaaggtttttgactatgtcttgcttgataatgcgcttgtaa

SEQ ID NO: 201608 - DNA, 75 bp, Artificial Sequence
  Synthetic
ctcctacgagcaatatgacagaaaacgaaagattgcttcatttgatctaaactgaacgaaaagatggctacagtc

SEQ ID NO: 201609 - DNA, 75 bp, Artificial Sequence
  Synthetic
aacttgtcaccacaaagcttaagggtgttcgtgaaggtggccttaataaagttaagtatgcaacagttgttgttg

SEQ ID NO: 201610 - DNA, 75 bp, Artificial Sequence
  Synthetic
aactgggctgattcctctgaaccacaacgtggtcgtcagggcagaataccttattccctttatagccctttgctt

SEQ ID NO: 201611 - DNA, 75 bp, Artificial Sequence
  Synthetic
cttacaatcgccaacaattattccaaactttttgatgaagggtatactgttgtaattggcgatgtggcgtacttt

SEQ ID NO: 201612 - DNA, 75 bp, Artificial Sequence
  Synthetic
gttgatagtgaacaaccttggaaggtgatacctcgtaatttggtacccaccaacaagaaagataaaagcaagctt

SEQ ID NO: 201613 - DNA, 75 bp, Artificial Sequence
  Synthetic
gctagtgacggctacttccgtcttatggccagtccaaatagtgtgttgactactgcagtctataaaccattggtt

SEQ ID NO: 201614 - DNA, 75 bp, Artificial Sequence
  Synthetic
ataggctattggaatattcaaaaacgtttcagaactagaaagggcaaacgggttgacttgtcacctaagttgcac

SEQ ID NO: 201615 - DNA, 75 bp, Artificial Sequence
  Synthetic
gcaatgctgtacttacaatcgccaacaattattctaaactttttgatgaagggcatactgttgtaattggcgatg

SEQ ID NO: 201616 - DNA, 75 bp, Artificial Sequence
  Synthetic
gattttaatgtgaatgttatgggtactagacctgaaaaatttccaaccactgtgacttgtgaaaatttagagtct

SEQ ID NO: 201617 - DNA, 75 bp, Artificial Sequence
  Synthetic
ttctattatcttggcacaggaccccataaagatgctaaattcagagagcgcattgaaggtgttgtctgggttgct

SEQ ID NO: 201618 - DNA, 75 bp, Artificial Sequence
  Synthetic
tgtgacttgtgaaaatttagagtctgctgttttgtttgttaatgacaaaatcactgaattccaattggattacag

SEQ ID NO: 201619 - DNA, 75 bp, Artificial Sequence
  Synthetic
gctgttttgtttgttaatgacaaaatcactgaattccaattggattacagtattgatgtcattgataatgaaata

SEQ ID NO: 201620 - DNA, 75 bp, Artificial Sequence
  Synthetic
gttgatggtgctaaaaccgaacctactggttatggtgttaggcgcaagaatttagatccagaagaaccacgcttc

SEQ ID NO: 201621 - DNA, 75 bp, Artificial Sequence
  Synthetic
tattgatgtcattgataatgaaataattgtcaaacctaatatcagcttatgtgttccactttatgtgagagacta

SEQ ID NO: 201622 - DNA, 75 bp, Artificial Sequence
  Synthetic
agtcaaagtcttccaaatggtgttactgttgttgaagaacctgactctcgtgctccttcgcgttctcagtcaaag

SEQ ID NO: 201623 - DNA, 75 bp, Artificial Sequence
  Synthetic
gtgttccactttatgtgagagactatgttgacaaatgggatgatttttgcagacaatatagtaacgagtcttggt

SEQ ID NO: 201624 - DNA, 75 bp, Artificial Sequence
  Synthetic
agacaatatagtaacgagtcttggtttgaggatgattacaaggcttttatcagtgttttggatatcactgatgct

SEQ ID NO: 201625 - DNA, 75 bp, Artificial Sequence
  Synthetic
tcacagagccgaggtcgtggtgaatttaaacctcagtcgcgcaattcttcaagtgcaagtcaggacgacattatt

SEQ ID NO: 201626 - DNA, 75 bp, Artificial Sequence
  Synthetic
gctgtgaaagctgcagagtctaaagccttcgttgatactattgttccaccttgcccatctattttgaaagttata

SEQ ID NO: 201627 - DNA, 75 bp, Artificial Sequence
  Synthetic
ccttcgttgatactattgttccaccttgcccatctattttgaaagttatagatggaggcaaaatatggaatggtg

SEQ ID NO: 201628 - DNA, 75 bp, Artificial Sequence
  Synthetic
aaggcagtagctgctgctcttaaatctttaggttttgaaaaagagaaagaggcagtgaaaaagggtactcctaag

SEQ ID NO: 201629 - DNA, 75 bp, Artificial Sequence
  Synthetic
ccttctagaaatcagagtcctgcttcttctcagactcgtgccaagagccctgctcgtcctcagaattctgaaaca

SEQ ID NO: 201630 - DNA, 75 bp, Artificial Sequence
  Synthetic
ttattaaaaatgttaactatgttagagactggcttaagtctttgaagttaaatctcacacaacagggtttgcttg

SEQ ID NO: 201631 - DNA, 75 bp, Artificial Sequence
  Synthetic
aaagaacaaaagcatgaaatgcaaaaaccacggtggaaaagacagcctaatgatgatgtgacatctaatgttaca

SEQ ID NO: 201632 - DNA, 75 bp, Artificial Sequence
  Synthetic
cagtgttttggccccagagatccttaccacaactttggaagtgcaggtgttgtagctaatggtgtcaaagccaaa

SEQ ID NO: 201633 - DNA, 75 bp, Artificial Sequence
  Synthetic
gacctttaaaacatatgcttttgataaaccttacattgtgatacgtgatatcgtgtgtaaggttgaaaataaaac

SEQ ID NO: 201634 - DNA, 75 bp, Artificial Sequence
  Synthetic
gggtttgcttggaacatgtgcaaagcgttttaaacgttggcttggcattttgctagaggcctataatgcgttttt

SEQ ID NO: 201635 - DNA, 75 bp, Artificial Sequence
  Synthetic
aaaccttacattgtgatacgtgatatcgtgtgtaaggttgaaaataaaacagaagcagaatggattgaacttttt

SEQ ID NO: 201636 - DNA, 75 bp, Artificial Sequence
  Synthetic
ggctacccacaatttgctgaacttgtgccttctacagctgccatgctgtttgacagtcacattgactctaaggag

SEQ ID NO: 201637 - DNA, 75 bp, Artificial Sequence
  Synthetic
ccacataatgacaggattaagtcttttagtacttttgagagtgcttacatgccaattgcagaccctacacatttt

SEQ ID NO: 201638 - DNA, 75 bp, Artificial Sequence
  Synthetic
tctggcaataatgttgttcttacttacacaactagggttacagtgcccaaggatcacccgcatttgggcaagttc

SEQ ID NO: 201639 - DNA, 75 bp, Artificial Sequence
  Synthetic
gacattgaagaagttgaacttttagatgcagagtttgtagaaccaggctgtggtggtattttgtcagtaatagat

SEQ ID NO: 201640 - DNA, 75 bp, Artificial Sequence
  Synthetic
atgcagagtttgtagaaccaggctgtggtggtattttgtcagtaatagatgagcacgtcttttataagaaggatg

SEQ ID NO: 201641 - DNA, 75 bp, Artificial Sequence
  Synthetic
ttagaggagttaaatgcattcactaagccttcacaaggagacatgcaacaacaccctcttcttaaccctagtgca

SEQ ID NO: 201642 - DNA, 75 bp, Artificial Sequence
  Synthetic
caagaattcaatccatcacaaacttcacctggaactgttgaaccagtctacgatgcagtttctattgaaactgac

SEQ ID NO: 201643 - DNA, 75 bp, Artificial Sequence
  Synthetic
gtgtttattatccatcaaatggtactaacattctacctgttgcgtttacaaaagccgctggtggtaaagtttcat

SEQ ID NO: 201644 - DNA, 75 bp, Artificial Sequence
  Synthetic
ataattgatgaagtcaactaaacatgcatccagaagatttggaatggttttagttgagggttctatgatttggct

SEQ ID NO: 201645 - DNA, 75 bp, Artificial Sequence
  Synthetic
tttctgatgacgttgaagtaaaagacattgaacctgtttacagagtcaagctttgctttgagtttgaagatgaaa

SEQ ID NO: 201646 - DNA, 75 bp, Artificial Sequence
  Synthetic
aatggccactgtgttgtttgaaatcattcaattgttagttgttgctaattcagatggtttgtatgtggttttaag

SEQ ID NO: 201647 - DNA, 75 bp, Artificial Sequence
  Synthetic
aacttgtagatgtttgtgaaaaggcaattggcaagaaaattaaacatgaaggtgactgggatagcttttgtaaga

SEQ ID NO: 201648 - DNA, 75 bp, Artificial Sequence
  Synthetic
gctgatgctgaacgaatggccatgtatacaggttctttaattggtggaattgctttaggaggtcttacatcagcc

SEQ ID NO: 201649 - DNA, 75 bp, Artificial Sequence
  Synthetic
ctattcaatcagcactttctgttgtttcatgctatgtaaatctacctacttattacatttatgatgaagaaggcg

SEQ ID NO: 201650 - DNA, 75 bp, Artificial Sequence
  Synthetic
ttggaattttgcttttgttcttgcttttattatctttctgctgcctgtttctagagagatttggcgccctggtgc

SEQ ID NO: 201651 - DNA, 75 bp, Artificial Sequence
  Synthetic
cgtagatgagtatattgcttttctccgatctatgcatgatggcatgatcagagctgcttttaattaacatgatcc

SEQ ID NO: 201652 - DNA, 75 bp, Artificial Sequence
  Synthetic
gtaatgacttgagtttgcccgttatgatttctgaatggcctctttctgagtcagataaggaagaagatgttcaac

SEQ ID NO: 201653 - DNA, 75 bp, Artificial Sequence
  Synthetic
cttgcttcggcttgacaaggatctagtcttatacacaatggtaagccagtagtagtagaggtataagaaatttgc

SEQ ID NO: 201654 - DNA, 75 bp, Artificial Sequence
  Synthetic
aagctcaacaagaagctactcatattgctgaggatgttgttgaccaagttgaagaagtcaatagcatttttgaca

SEQ ID NO: 201655 - DNA, 75 bp, Artificial Sequence
  Synthetic
tgctgaggatgttgttgaccaagttgaagaagtcaatagcatttttgacattgagacagtggatgttaaacatga

SEQ ID NO: 201656 - DNA, 75 bp, Artificial Sequence
  Synthetic
gaagaagtcaatagcatttttgacattgagacagtggatgttaaacatgagatgagtccttttgaaatgccattt

SEQ ID NO: 201657 - DNA, 75 bp, Artificial Sequence
  Synthetic
cactagtataactcattacaaatgtgctggagtaattaaagatcgctttgacgagccaacaatggaagagccagt

SEQ ID NO: 201658 - DNA, 75 bp, Artificial Sequence
  Synthetic
gaagagttaaatggtttaaagatacttaaacaattggataacaactgctgggttaactcagttatgttacaaata

SEQ ID NO: 201659 - DNA, 75 bp, Artificial Sequence
  Synthetic
tcatttgtcttgagacctatctagttagtaactgctaatggaacggtttcgatatggatacacaaaaaaaaaaaa

SEQ ID NO: 201660 - DNA, 75 bp, Artificial Sequence
  Synthetic
acttaagtaccttatctatctacagatagaaaagttgctttttagactttgtgtctacttttctcaactaaacga

SEQ ID NO: 201661 - DNA, 75 bp, Artificial Sequence
  Synthetic
caattaactggtatacttgatggtgattatgctatgcagttttttaaaatgggccgagttgccaagatgattgaa

SEQ ID NO: 201662 - DNA, 75 bp, Artificial Sequence
  Synthetic
cgctgctacactgctgagcaatgtatacgtggtgctatgggtgatgttggtttgtgtatgtatagacttcttaaa

SEQ ID NO: 201663 - DNA, 75 bp, Artificial Sequence
  Synthetic
gacttacacactggttttatggttatggattataaatgtagttgtaccagtggtaggcttgaagaatcgggagct

SEQ ID NO: 201664 - DNA, 75 bp, Artificial Sequence
  Synthetic
ctaagggtttcgtgttccgtcacgagattccattctacaaacgccttactcgaggttccgtctcgtgtttgtgtg

SEQ ID NO: 201665 - DNA, 75 bp, Artificial Sequence
  Synthetic
gttttgttttgtacgcccactaagaaggcgtttccttatggtacttgtctaaattgtaacgcacctcgcatgtgt

SEQ ID NO: 201666 - DNA, 75 bp, Artificial Sequence
  Synthetic
acaattaggcagttacaaggtaccataatatttgtgcaacaaaaaccagaacctgttaaccctgtttcttttgtt

SEQ ID NO: 201667 - DNA, 75 bp, Artificial Sequence
  Synthetic
gttaaaccagtctgctcatcaatttttcgtggtgctgtgtcttgtggtcattaccagactaacatctattcacaa

SEQ ID NO: 201668 - DNA, 75 bp, Artificial Sequence
  Synthetic
aatttgtgtgtggatggttttggtgttaacaagattcagccctggacaaatgatgcacttaatactatttgtatt

SEQ ID NO: 201669 - DNA, 75 bp, Artificial Sequence
  Synthetic
aaggatgcagattataatgcaaaagatgaaatatctgttacaccaattaaaaacacagttgatacaacacctaag

SEQ ID NO: 201670 - DNA, 75 bp, Artificial Sequence
  Synthetic
gaagaatttgttgttaaagagaagttgaacgccttcctcgttcatggcaatgtagctttctaccaaggtgatgtt

SEQ ID NO: 201671 - DNA, 75 bp, Artificial Sequence
  Synthetic
tatgagtgaagatttatggcagtttgttgaccatttcggtgagaacgaagaaattatcatcaatggtcatactta

SEQ ID NO: 201672 - DNA, 75 bp, Artificial Sequence
  Synthetic
taattacactgttcaaaaactgcaaactttgattgacaacataaatagcacattagttgacttaaagtggctcaa

SEQ ID NO: 201673 - DNA, 75 bp, Artificial Sequence
  Synthetic
gatactgttgttaatggtgttgactttgactttattgtaaatgctgctaatgagaaccttgctcatggtggagga

SEQ ID NO: 201674 - DNA, 75 bp, Artificial Sequence
  Synthetic
ccgggttgagacttatatcaagtggccgtggtgggtgtggttgtgcatttcagtcgtgctcatctttgtggtgag

SEQ ID NO: 201675 - DNA, 75 bp, Artificial Sequence
  Synthetic
aaggtgatgttgatactgttgttaatggtgttgactttgactttattgtaaatgctgctaatgagaaccttgctc

SEQ ID NO: 201676 - DNA, 75 bp, Artificial Sequence
  Synthetic
ttttaatgttgttggtccacgcaagggtaaacatgaacgtgatttactcgtaaaagcttacaacactattaataa

SEQ ID NO: 201677 - DNA, 75 bp, Artificial Sequence
  Synthetic
tgaacaaggcacacctttaacaccaattttgagttgtggtatttttggtgtcaaactcgaaacttcattggaagt

SEQ ID NO: 201678 - DNA, 75 bp, Artificial Sequence
  Synthetic
tttgcttgatgtttgtaatacaaaagaatttaaagtttttgtttatacagacacagaggtttgtaaggttaagga

SEQ ID NO: 201679 - DNA, 75 bp, Artificial Sequence
  Synthetic
ttttgtgtctggtttagtgaatgttcaaaaagttgcacaacctaaaatagaacaaaaaccagtgtccttaattaa

SEQ ID NO: 201680 - DNA, 75 bp, Artificial Sequence
  Synthetic
agttgcacccaagccttacagggtagatggtaaatttagttactttacagaagacttgttgtgtgtcgctgatga

SEQ ID NO: 201681 - DNA, 75 bp, Artificial Sequence
  Synthetic
caaacccattgttttgtttactgactctatgcttactttggatgaccgtggtttggctctagacaatgcacttag

SEQ ID NO: 201682 - DNA, 75 bp, Artificial Sequence
  Synthetic
tggtgtgcttagtgctgctattaaggattgtgttgacataaataaagctataccttctggtaatcttattaagtt

SEQ ID NO: 201683 - DNA, 75 bp, Artificial Sequence
  Synthetic
atgtgtgttgtgccatccgaaaaggacaaacatttagataataatgttcaacgatgcacacgtaagttgaataga

SEQ ID NO: 201684 - DNA, 75 bp, Artificial Sequence
  Synthetic
cttatgtgtgatatagtttgtactataccagctgactacatcttgccattggtgttgtctagtttgacttgtaat

SEQ ID NO: 201685 - DNA, 75 bp, Artificial Sequence
  Synthetic
ttgttgtttacatgtgtgttgtgccatccgaaaaggacaaacatttagataataatgttcaacgatgcacacgta

SEQ ID NO: 201686 - DNA, 75 bp, Artificial Sequence
  Synthetic
gtttcttttgtaggtgaacttaaagctgctgaagctaaagttataactataaaggtgacagaggatggtgttaat

SEQ ID NO: 201687 - DNA, 75 bp, Artificial Sequence
  Synthetic
gttcatgatgtgaccgtgacaacagataagtcatttgaacaacaagttggtgttattgctgacaaggacaaagat

SEQ ID NO: 201688 - DNA, 75 bp, Artificial Sequence
  Synthetic
ctttctggtgcagtacccagtgatcttaacacatctgaattgcttactaaagcaatagatgttgattgggtcgaa

SEQ ID NO: 201689 - DNA, 75 bp, Artificial Sequence
  Synthetic
agtatgcaacagttgttgttggttccactgaagaagttaaatcttcacgtgttgaacgtagcactgctgtactta

SEQ ID NO: 201690 - DNA, 75 bp, Artificial Sequence
  Synthetic
ttttatggctttaaagatgctgttacttttgcaacagttgatcatagtgcttttgcctatgaaagtgctgttgtt

SEQ ID NO: 201691 - DNA, 75 bp, Artificial Sequence
  Synthetic
aatggtattagagtgttaaaaaccagtgataataattgttgggtgaatgctgtttgtattgcactacagtattcg

SEQ ID NO: 201692 - DNA, 75 bp, Artificial Sequence
  Synthetic
attggcgatgtggcgtactttgttagtgacggctacttccgtcttatggccagtccaaatagtgtgttgactact

SEQ ID NO: 201693 - DNA, 75 bp, Artificial Sequence
  Synthetic
aaaccccattttatttcacaaggtcttgatgctgcgtggaataaatttgttttaggcgatgttgaaatttttgtt

SEQ ID NO: 201694 - DNA, 75 bp, Artificial Sequence
  Synthetic
gcatttgtttactatgttgcaagactaatgaaaggtgacaagggtgatgctgaagacactttgaataagttgtct

SEQ ID NO: 201695 - DNA, 75 bp, Artificial Sequence
  Synthetic
aagtatcttgctaatgaagctcaagttcaattagaacattatagttcttgtgttgaatgtgatgctaaatttaaa

SEQ ID NO: 201696 - DNA, 75 bp, Artificial Sequence
  Synthetic
ttcaattagaacattatagttcttgtgttgaatgtgatgctaaatttaaaaactctgttacatctatcaattctg

SEQ ID NO: 201697 - DNA, 75 bp, Artificial Sequence
  Synthetic
ctatagtttgtgctagtgtcaaacgtgatggtgtgcaagttggttattgtgtccatggtattaagtactattcac

SEQ ID NO: 201698 - DNA, 75 bp, Artificial Sequence
  Synthetic
tgatggtgtgcaagttggttattgtgtccatggtattaagtactattcacgtgttaaaagtgttagaggtagagc

SEQ ID NO: 201699 - DNA, 75 bp, Artificial Sequence
  Synthetic
aatatagtaacgagtcttggtttgaggatgattacagggcttttatcagtgttttggacatcactgatgctgctg

SEQ ID NO: 201700 - DNA, 75 bp, Artificial Sequence
  Synthetic
tattatagtcagtgtcgaacagcttgaaccgtgtgttcagtctagacttttgagtggtgttgcttatactgcttt

SEQ ID NO: 201701 - DNA, 75 bp, Artificial Sequence
  Synthetic
tgagtggtgttgcttatactgctttttctggacctgttgataaaggtcattatactgtttatgacactgcaaaga

SEQ ID NO: 201702 - DNA, 75 bp, Artificial Sequence
  Synthetic
aatcaatgtatgatggtgatcgttttgttaaacatgatctttctctgttgtctgtcacatcagttgttatggttg

SEQ ID NO: 201703 - DNA, 75 bp, Artificial Sequence
  Synthetic
tctgtcacatcagttgttatggttggtgattatgttgcacctgttagtacagtgaaacctaaaccagtcatttct

SEQ ID NO: 201704 - DNA, 75 bp, Artificial Sequence
  Synthetic
cttggcattttgctagaggcctataatgcgtttttagacactgtggtttctactgttaaaattggtggcttgacc

SEQ ID NO: 201705 - DNA, 75 bp, Artificial Sequence
  Synthetic
gtctagacttttgagtggtgttgcttatactgctttttctggacctgttgataaaggtcattatactgtttatga

SEQ ID NO: 201706 - DNA, 75 bp, Artificial Sequence
  Synthetic
caacttgatgaaaatgcacagaagttctttgattttggtgattttttgattcataattttgttatttttttcaca

SEQ ID NO: 201707 - DNA, 75 bp, Artificial Sequence
  Synthetic
tagccctttgcttgttgatagtgaacaaccttggaaggtgatacctcgtaatttggtacccatcaacaagaaaga

SEQ ID NO: 201708 - DNA, 75 bp, Artificial Sequence
  Synthetic
tggttattgagtatgtttactttgtgtaaaactgcagtaactacatgtgatgttaaaataatggccaaagcacca

SEQ ID NO: 201709 - DNA, 75 bp, Artificial Sequence
  Synthetic
caaaggacgggtgttgttttaaaacgtagtcttaaatataacttaaaagcgtcagcagctgttcttaaatctaag

SEQ ID NO: 201710 - DNA, 75 bp, Artificial Sequence
  Synthetic
tggtggctgcttgctaagtttacgaaactactgttacttatatatacattgtactcagtagttttgttttgtgta

SEQ ID NO: 201711 - DNA, 75 bp, Artificial Sequence
  Synthetic
gtgagactgttaatggttatgctaagtcaaactttgtcaaggatgattactgtgatggttcattgggctgcaaga

SEQ ID NO: 201712 - DNA, 75 bp, Artificial Sequence
  Synthetic
tgtttagtaatatacaacctttcattgtcatggttttgctgcttatatttggtgacaattatttgagatgcttct

SEQ ID NO: 201713 - DNA, 75 bp, Artificial Sequence
  Synthetic
aagcacagttggtgtttttctaggttataaggaaacaaattggttcttgcactttattccatttgatgttatttg

SEQ ID NO: 201714 - DNA, 75 bp, Artificial Sequence
  Synthetic
tctgaatggcctctttctgttcaacaagctcaacaagaagctactttacctgatattgctgaggatgttgttgac

SEQ ID NO: 201715 - DNA, 75 bp, Artificial Sequence
  Synthetic
tgatgaactgcttgtcactgttattgttattaaggttatttcttttgtcagacatgtgctttttggttgtgaaaa

SEQ ID NO: 201716 - DNA, 75 bp, Artificial Sequence
  Synthetic
tgcttatatttggtgacaattatttgagatgcttcttgctgtattttgttgctcagatgataagcacagttggtg

SEQ ID NO: 201717 - DNA, 75 bp, Artificial Sequence
  Synthetic
gacatgtgctttttggttgtgaaaacccagattgcattgcgtgttctaagagtgctagacttaagagattccctg

SEQ ID NO: 201718 - DNA, 75 bp, Artificial Sequence
  Synthetic
caagttgaagaagtcaatagcatttttgacattgagacagtggatgttaaacatgatgtgagtccttttgaaatg

SEQ ID NO: 201719 - DNA, 75 bp, Artificial Sequence
  Synthetic
gatgttatttgtgatgaactgcttgtcactgttattgttattaaggttatttcttttgtcagacatgtgcttttt

SEQ ID NO: 201720 - DNA, 75 bp, Artificial Sequence
  Synthetic
atagatttttctgtgttgattgtgactcttatggttatggcagcacgtttataacacccgaagtttctagagaac

SEQ ID NO: 201721 - DNA, 75 bp, Artificial Sequence
  Synthetic
ctcttatggttatggcagcacgtttataacacccgaagtttctagagaacttggtaacattactaaaacaaatgt

SEQ ID NO: 201722 - DNA, 75 bp, Artificial Sequence
  Synthetic
ttggtaacattactaaaacaaatgtgcaaccaacaggtccagcgtatgtcatgattgacaaagtggagtttgaaa

SEQ ID NO: 201723 - DNA, 75 bp, Artificial Sequence
  Synthetic
ttaatgcaaatggtggtagtaagttttgtaagaaacatagatttttctgtgttgattgtgactcttatggttatg

SEQ ID NO: 201724 - DNA, 75 bp, Artificial Sequence
  Synthetic
atgattgacaaagtggagtttgaaaatggtttttacaggttgtattccggtgaaacattttggcgttacaacttt

SEQ ID NO: 201725 - DNA, 75 bp, Artificial Sequence
  Synthetic
gatataactgaaagcaagtattcttgcaaagaggtttttaaaaattgtaatgttttggatgatttcatcgtgttt

SEQ ID NO: 201726 - DNA, 75 bp, Artificial Sequence
  Synthetic
aacaataatgggaccaatgtaacgcaggttaaaaatgctagtgtttacttttcacagttgttgtgtaggcccatt

SEQ ID NO: 201727 - DNA, 75 bp, Artificial Sequence
  Synthetic
ttgtattccggtgaaacattttggcgttacaactttgatataactgaaagcaagtattcttgcaaagaggttttt

SEQ ID NO: 201728 - DNA, 75 bp, Artificial Sequence
  Synthetic
aaattagttgacagtgaacttttgtccactttgtcagttgattttaatggtgtcttacacaaggcatacatcgat

SEQ ID NO: 201729 - DNA, 75 bp, Artificial Sequence
  Synthetic
tgctggagtaatcaaagatcgcattgacgagccaacaatggaagagccagtcatttgtcttgagacctatctagt

SEQ ID NO: 201730 - DNA, 75 bp, Artificial Sequence
  Synthetic
gtactacgtaatagctttggtaaagatcttaatgctaatatgtctttagccgagtgcaagagtgctttaggcctg

SEQ ID NO: 201731 - DNA, 75 bp, Artificial Sequence
  Synthetic
tctattagtgatcatgaatttactagtgctatttctaatgcacatcgttgtgacgtgttgttatctgatttgtca

SEQ ID NO: 201732 - DNA, 75 bp, Artificial Sequence
  Synthetic
tgtattaaggatgcagattataatgcaaaagttgaaatatctgttacaccaattaaaaatacagttgatacaaca

SEQ ID NO: 201733 - DNA, 75 bp, Artificial Sequence
  Synthetic
tttaacaactttgtcagttcgtatgctaaacctgaggaaaaattatcagcttatgacttggcgtgttgtatgcgt

SEQ ID NO: 201734 - DNA, 75 bp, Artificial Sequence
  Synthetic
cctaaggaagaatttgttgttaaagagaagttgaacgccttcctcgttcatgacaatgtagctttctaccaaggt

SEQ ID NO: 201735 - DNA, 75 bp, Artificial Sequence
  Synthetic
gcaggtgctaaggttgttaatgccaatgttctgacaaaggaccaaactcctattgtttggcatgcaaaggatttt

SEQ ID NO: 201736 - DNA, 75 bp, Artificial Sequence
  Synthetic
ggaggacttgccaaagctttagatgtgtacactaaaggtaaacttcaacgtttatctaaagaacacattggatta

SEQ ID NO: 201737 - DNA, 75 bp, Artificial Sequence
  Synthetic
aacagtctttctgctgaaggtcgtaagtatattgtaaaaactagcaaagctaagggtttgactttcttgttgaca

SEQ ID NO: 201738 - DNA, 75 bp, Artificial Sequence
  Synthetic
agtatattgtaaaaactagcaaagctaagggtttgactttcttgttgacaattaatgaaaaccaagctgtcacgc

SEQ ID NO: 201739 - DNA, 75 bp, Artificial Sequence
  Synthetic
aaatacctgcaactagcattgttgctaagcaaggtgctggtgatgctggccattcattaacatggctgtggctac

SEQ ID NO: 201740 - DNA, 75 bp, Artificial Sequence
  Synthetic
cattcattaacatggctgtggctactgtgtggtcttgtgtgtttgattcaattctacttgtgctttttcatgccc

SEQ ID NO: 201741 - DNA, 75 bp, Artificial Sequence
  Synthetic
taataatgaacaaggcacacctttaacaccaattttgagctgtggtatttttggtatcaaactcgaaacttcatt

SEQ ID NO: 201742 - DNA, 75 bp, Artificial Sequence
  Synthetic
tattttatgtacgatgtcgtgagtagttttgagggttatgattttaagtatatagaaaatggtcagttgaagaat

SEQ ID NO: 201743 - DNA, 75 bp, Artificial Sequence
  Synthetic
acaccaattttgagctgtggtatttttggtatcaaactcgaaacttcattagaagttttgcttgatgtttgtaat

SEQ ID NO: 201744 - DNA, 75 bp, Artificial Sequence
  Synthetic
tttgaagcgccacttaaatgtgtcagaaacgtttttgaaaactttgaggactggcattatgctaagtttggcttc

SEQ ID NO: 201745 - DNA, 75 bp, Artificial Sequence
  Synthetic
acacctttaaacaagcaaagctgtcctattgtagttggagtttctgaaattgttaatactgtcgctggcattcca

SEQ ID NO: 201746 - DNA, 75 bp, Artificial Sequence
  Synthetic
aatgttcaaaaagttgagcaacctaaaatagaaccaaaaccagtgtccgtaattaaagttgcacccaagccttac

SEQ ID NO: 201747 - DNA, 75 bp, Artificial Sequence
  Synthetic
tctaatgtgtatcttgttggtaaaactttaatttttacactacaagctgcttttggtaatgctggtgtttgttat

SEQ ID NO: 201748 - DNA, 75 bp, Artificial Sequence
  Synthetic
ctttaatttttacactacaagctgcttttggtaatgctggtgtttgttatgacatttttggagtcacaacacctg

SEQ ID NO: 201749 - DNA, 75 bp, Artificial Sequence
  Synthetic
aaaagtgcatttttacttctgcttgtactagattagaaggtttgggtggtaacaatgtttattgttataacacag

SEQ ID NO: 201750 - DNA, 75 bp, Artificial Sequence
  Synthetic
tactagattagaaggtttgggtggtaacaatgtttattgttataacacagagcttatggaaggttctttgcctta

SEQ ID NO: 201751 - DNA, 75 bp, Artificial Sequence
  Synthetic
cagttcaatacaagctaatgcatattataaatatgataatggcaattttattaagttgccagaagttattgcaca

SEQ ID NO: 201752 - DNA, 75 bp, Artificial Sequence
  Synthetic
ttaagttgccagaagttattgcacaaggctttggctttagaacagtacgtactattgctaccaaatactgccgcg

SEQ ID NO: 201753 - DNA, 75 bp, Artificial Sequence
  Synthetic
taggtgaatgtgttgactccaatgcaggtgtgtgttttggctttgacaagtggtttgttaatgatggacgtgttg

SEQ ID NO: 201754 - DNA, 75 bp, Artificial Sequence
  Synthetic
aggtgtgtgttttggctttgacaagtggtttgttaatgatggacgtgttgccaatggttacgtttgtggtactgg

SEQ ID NO: 201755 - DNA, 75 bp, Artificial Sequence
  Synthetic
ccaatggttacgtttgtggtactggtttgtggaaccttgtatttaacatactttccatgttctcatcttcattct

SEQ ID NO: 201756 - DNA, 75 bp, Artificial Sequence
  Synthetic
ctgttgctgcaatgtcaggtcaaattttacttaattgtgcattaggtgcttttgctatcttttgttgttttcttg

SEQ ID NO: 201757 - DNA, 75 bp, Artificial Sequence
  Synthetic
caacagacaagtcatttgaacaacaagttggtgttattgctgataaggacaaagatctttctggtgcagtaccaa

SEQ ID NO: 201758 - DNA, 75 bp, Artificial Sequence
  Synthetic
tttacttaattgtgcattaggtgcttttgctatcttttgttgttttcttgtgacaaagtttagacgcatgtttgg

SEQ ID NO: 201759 - DNA, 75 bp, Artificial Sequence
  Synthetic
tgacaaagtttagacgcatgtttggtgacctttctgtaggtgtttgcactgttgttgtggctgttttgcttaaca

SEQ ID NO: 201760 - DNA, 75 bp, Artificial Sequence
  Synthetic
atcttcattctctgttgctgcaatgtcaggtcaaattttacttaattgtgcattaggtgctcttgctatcttttg

SEQ ID NO: 201761 - DNA, 75 bp, Artificial Sequence
  Synthetic
atgtctcttacattgtaactcagaatttagtaacaatgattgcttatgccatattgtatttctttgctactagaa

SEQ ID NO: 201762 - DNA, 75 bp, Artificial Sequence
  Synthetic
tcaggtcaaattttacttaattgtgcattaggtgctcttgctatcttttgttgctttcttgtgacaaagtttaga

SEQ ID NO: 201763 - DNA, 75 bp, Artificial Sequence
  Synthetic
tgctgcatatttaattgcgtatatttcttttgctccatggtggttgtgtgcttggtactttcttgctatgttgac

SEQ ID NO: 201764 - DNA, 75 bp, Artificial Sequence
  Synthetic
aggtttgttacctagtttgctgaagcttaaagtttcgacaaatcttttcgaaggtgacaaatttgtaggtacatt

SEQ ID NO: 201765 - DNA, 75 bp, Artificial Sequence
  Synthetic
tgaaagtgctgctgcaggaacatttgtcattgacattcgttcttatgagaaacttgctaatagcatctctccaga

SEQ ID NO: 201766 - DNA, 75 bp, Artificial Sequence
  Synthetic
aaagttgaaaagttatgctgctagctataatagatataagtactatagtggtaatgcaaatgaagctgattaccg

SEQ ID NO: 201767 - DNA, 75 bp, Artificial Sequence
  Synthetic
ttgtgcttgttatgcctatttagcaaaagcaatgttggacttttcgcgtgatcataatgacatcttgtacacacc

SEQ ID NO: 201768 - DNA, 75 bp, Artificial Sequence
  Synthetic
tccgactgtcagttatggttctacattacaggctggtttgcgcaaaatggcacaaccatctggctttgtggagaa

SEQ ID NO: 201769 - DNA, 75 bp, Artificial Sequence
  Synthetic
atgtgttgtccgtgtctgctatggaaacactgtgttgaatgggttgtggcttggtgatattgtttattgcccacg

SEQ ID NO: 201770 - DNA, 75 bp, Artificial Sequence
  Synthetic
ggtcattatactgtttatgatactgcaaagaaatcaatgtatgatggtgatcgttttgttaaacatgatctttct

SEQ ID NO: 201771 - DNA, 75 bp, Artificial Sequence
  Synthetic
tcatgttatcgcatctaacacaacttctgctatagattatgatcacgaatatagtattatgcggttgcataattt

SEQ ID NO: 201772 - DNA, 75 bp, Artificial Sequence
  Synthetic
tggttggtggttatgttgcacctgttaatacagtgaaacctaaaccagtcattaatcaacttgatgaaaaggcac

SEQ ID NO: 201773 - DNA, 75 bp, Artificial Sequence
  Synthetic
ttctataatatctggtacagcatttcttggtgttgtaggtgctactatgcatggagtaactcttaaaattaaggt

SEQ ID NO: 201774 - DNA, 75 bp, Artificial Sequence
  Synthetic
ctggtgaaggttttaacatcttagcatgctatgatggttgtgctcaaggtgtttttggtgtgaacatgagaacta

SEQ ID NO: 201775 - DNA, 75 bp, Artificial Sequence
  Synthetic
taatggtgcgtgtggttctcctggctacaatcttaaaaatggcgaggtggaatttgtttatatgcatcaaattga

SEQ ID NO: 201776 - DNA, 75 bp, Artificial Sequence
  Synthetic
tctaagtggtggctgcttgctaagtttacgaaactactgttactcatatatacattgtactcagtagttttgctt

SEQ ID NO: 201777 - DNA, 75 bp, Artificial Sequence
  Synthetic
ttacgaaactactgttactcatatatacattgtactcagtagttttgctttgtgtacgttttggaccgtttaatt

SEQ ID NO: 201778 - DNA, 75 bp, Artificial Sequence
  Synthetic
actcggaagtggtagccatgtaggttctagctttgatggtgttatgtatggtggttttgaagaccaacctaatct

SEQ ID NO: 201779 - DNA, 75 bp, Artificial Sequence
  Synthetic
tcaagttgaatctgcaaaccagatgttaacagttaatgtggtggcatttctttatgctgctatattgaatggttg

SEQ ID NO: 201780 - DNA, 75 bp, Artificial Sequence
  Synthetic
tgctaagtcaaactttgtcaaggatgattactgtgatggttcattgggctgcaagatgtgtctttttggttacca

SEQ ID NO: 201781 - DNA, 75 bp, Artificial Sequence
  Synthetic
cacatggtggcttaaaggtgataaattgtttgtggagcattataatgagtgggcacaggctaatggtttcacagc

SEQ ID NO: 201782 - DNA, 75 bp, Artificial Sequence
  Synthetic
tatgaatggtgaagacgctttttccattcttgctgctaaaactggtgtctgtgtggaaagattacttcatgctat

SEQ ID NO: 201783 - DNA, 75 bp, Artificial Sequence
  Synthetic
tcaagttttgaataatggatttggtggtaaacaaattttgggttattctagtctcaatgatgagttcagtattaa

SEQ ID NO: 201784 - DNA, 75 bp, Artificial Sequence
  Synthetic
tgaagttgtcaaacaaatgtttggtgttaacctgcaaagtggtaaaaccactagtatgtttaaatccataagctt

SEQ ID NO: 201785 - DNA, 75 bp, Artificial Sequence
  Synthetic
ccactatttgggttaaccctggttttcttactccgtttatgattttgcttgttgctttgtcactctgtcttacat

SEQ ID NO: 201786 - DNA, 75 bp, Artificial Sequence
  Synthetic
ttgttgttaaacataaggttttgtttttgcaagtgtttttgttgccttcaattattgtggctgctattcaaaact

SEQ ID NO: 201787 - DNA, 75 bp, Artificial Sequence
  Synthetic
tccataagcttgtttgctggcttctttgtcatgttctgggctgaattatttgtttataccaccactatttgggtt

SEQ ID NO: 201788 - DNA, 75 bp, Artificial Sequence
  Synthetic
gtgcttgggactaccatattacaaaggtgttggcagagaagtttgattataatgtttctgttatgcaaatggaca

SEQ ID NO: 201789 - DNA, 75 bp, Artificial Sequence
  Synthetic
aaatgtgcaaccaacagggccggcctatgtcatgattgacaaagtggagtttgaaaatggtttttacagattgta

SEQ ID NO: 201790 - DNA, 75 bp, Artificial Sequence
  Synthetic
tccagggttttgttaacatttttatttgtctttttgttgcactgttgcatacttggcgctttgctaaagagcgtt

SEQ ID NO: 201791 - DNA, 75 bp, Artificial Sequence
  Synthetic
gtacacattggtgcacttatttgttctcactcattgctgttttatacactgcattgtatagttatgactacgtta

SEQ ID NO: 201792 - DNA, 75 bp, Artificial Sequence
  Synthetic
gtttgctggttatgctactttgtgcaatttctaatgaatggtatattggtgctatcatttttagaatttgtcgtt

SEQ ID NO: 201793 - DNA, 75 bp, Artificial Sequence
  Synthetic
ttggtgttgcatttttaccaatggaatacgtgtcttactttgatggtgttaaaactgtgctgttgttttacatgt

SEQ ID NO: 201794 - DNA, 75 bp, Artificial Sequence
  Synthetic
tgttaggctttgttagctgtatgtactatggtttgttgtactggattaacaggttctgtaagtgcacattaggtg

SEQ ID NO: 201795 - DNA, 75 bp, Artificial Sequence
  Synthetic
tttatgatttctgtgttagtccagccgaatttaagtatatggttgctaatggtttgaatgcaccaaatggccctt

SEQ ID NO: 201796 - DNA, 75 bp, Artificial Sequence
  Synthetic
cgaatttaagtatatggttgctaatggtttgaatgcaccaaatggcccttttgatgcactctttctgtcttttaa

SEQ ID NO: 201797 - DNA, 75 bp, Artificial Sequence
  Synthetic
actaatgggtattggtggtcctagaaccattaaagtttctactgtacagtctaaattgactgatcttaagtgcac

SEQ ID NO: 201798 - DNA, 75 bp, Artificial Sequence
  Synthetic
aaacgtcgttctaatgggcattttgtctaacatgaacatagcttctaactcaaaggagtgggcatattgtgttga

SEQ ID NO: 201799 - DNA, 75 bp, Artificial Sequence
  Synthetic
aatgcacaataaaataaatttgtgtgacgaccctgaaactgctcaagagttattgctggcgttgttggccttttt

SEQ ID NO: 201800 - DNA, 75 bp, Artificial Sequence
  Synthetic
cttgtctaagcatagtgattttggtcttggtgatcttgtcgattcttattttgagaacgactccattttgcaaag

SEQ ID NO: 201801 - DNA, 75 bp, Artificial Sequence
  Synthetic
tgttgcatcttcttttgttggtatgccatcttttgttgcatatgaaacagcaagacaagagtatgaaaatgctgt

SEQ ID NO: 201802 - DNA, 75 bp, Artificial Sequence
  Synthetic
ccatcttttgttgcatatgaaacagcaagacaagagtatgaaaatgctgttgcaaatggttcctcaccacaaata

SEQ ID NO: 201803 - DNA, 75 bp, Artificial Sequence
  Synthetic
tgcaaatggttcctcaccacaaataatcaaacaattgaagaaggctatgaatgttgcaaaagctgagtttgacag

SEQ ID NO: 201804 - DNA, 75 bp, Artificial Sequence
  Synthetic
ggagtcatctgttcaaaagaaaattaacagaatggctgaacaagctgctgcagctatgtacaaagaagcacgtgc

SEQ ID NO: 201805 - DNA, 75 bp, Artificial Sequence
  Synthetic
aacagaatggctgaacaagctgctgcagctatgtacaaagaagcacgtgctgttaacagaaaatcaaaagttgtt

SEQ ID NO: 201806 - DNA, 75 bp, Artificial Sequence
  Synthetic
agtgcaatgcatagtttactctttggcatgctccgacgtttggacatgtctagtgttgacactatccttaatatg

SEQ ID NO: 201807 - DNA, 75 bp, Artificial Sequence
  Synthetic
gcacgtaatggtgttgtccctctttccgttatccctgctacttctgcagccaggctcgtcgtcgtagtgccagat

SEQ ID NO: 201808 - DNA, 75 bp, Artificial Sequence
  Synthetic
catgattcatttgtgaaaatgatggtagatggttttgtgcactacgctggtgttgtttggacattacaggaagtt

SEQ ID NO: 201809 - DNA, 75 bp, Artificial Sequence
  Synthetic
tgttgtttggacattacaggaagttaaggataatgacggtaagaatgtgcatcttaaagatgttacaaaggaaaa

SEQ ID NO: 201810 - DNA, 75 bp, Artificial Sequence
  Synthetic
gcatattataaatatgacaatggcaattttattaagttgccagaagttattgcacaaggctttggttttagaaca

SEQ ID NO: 201811 - DNA, 75 bp, Artificial Sequence
  Synthetic
gtgcgtactattgccaccaaatactgccgcgtaggtgaatgtgttgaatccaatgcaggtgtgtgttttggcttt

SEQ ID NO: 201812 - DNA, 75 bp, Artificial Sequence
  Synthetic
caatgaaggtggacgtgcatttatgtatgcatatgtgactacgaagcctggcatgaagtatgttaaatgggaaca

SEQ ID NO: 201813 - DNA, 75 bp, Artificial Sequence
  Synthetic
tgactctggtgtggttacagttgaattggaaccaccttgcagatttgttatagacacacctaccggaccccaaat

SEQ ID NO: 201814 - DNA, 75 bp, Artificial Sequence
  Synthetic
gctctatacaacaatgaaggtggacgtgcatttatgtatgcatatgtgactacgaagcctggcatgaagtatgtt

SEQ ID NO: 201815 - DNA, 75 bp, Artificial Sequence
  Synthetic
taagtatctttattttgttaagaatcttaacaatttaaggagaggtgctgttttgggttacattggtgccactgt

SEQ ID NO: 201816 - DNA, 75 bp, Artificial Sequence
  Synthetic
gagattgcaagctggcaaacagactgagtttgtttcaaactcccatttattaacacattgttcttttgctgttga

SEQ ID NO: 201817 - DNA, 75 bp, Artificial Sequence
  Synthetic
gagtttgtttcaaactcccatttattaacacattgttcttttgctgttgacccagctgcagcctaccttgatgct

SEQ ID NO: 201818 - DNA, 75 bp, Artificial Sequence
  Synthetic
gttaaacaaggcgcaaaacctgttggcaattgtgtaaagatgttgactaatggttctggtagtggtcaggctatt

SEQ ID NO: 201819 - DNA, 75 bp, Artificial Sequence
  Synthetic
gcaattgtgtaaagatgttgactaatggttctggtagtggtcaggctattactagtaccattgattctaacacta

SEQ ID NO: 201820 - DNA, 75 bp, Artificial Sequence
  Synthetic
cgcaggacacatatggtggcgcgtctgtttgtatttattgcagagcacatgttgcacatccaaccatggacggtt

SEQ ID NO: 201821 - DNA, 75 bp, Artificial Sequence
  Synthetic
cctataagattttgtcttgaaaatactgtttgtaaagtttgtggttgttggcttaatcatggctgtacatgtgac

SEQ ID NO: 201822 - DNA, 75 bp, Artificial Sequence
  Synthetic
ctgtttgtaaagtttgtggttgttggcttaatcatggctgtacatgtgaccggactgctatccaaagttttgata

SEQ ID NO: 201823 - DNA, 75 bp, Artificial Sequence
  Synthetic
cggactgctatccaaagttttgatagcagttatttaaacgagtccggggctctagtgccgctcgactagagccct

SEQ ID NO: 201824 - DNA, 75 bp, Artificial Sequence
  Synthetic
gtaatggtacagacatagattactgtgtccgtgcatttgacgtttacaataaagatgcgtcttttatcggaaaaa

SEQ ID NO: 201825 - DNA, 75 bp, Artificial Sequence
  Synthetic
aaagatgcgtcttttatcggaaaaaatctgaagtccaattgtgtgcgcttcaagaatgtagataaggatgacgcg

SEQ ID NO: 201826 - DNA, 75 bp, Artificial Sequence
  Synthetic
ttctatattgttaaacgttgcattaagtcagttatggaccacgagcagtccatgtataacttacttaaaggctgt

SEQ ID NO: 201827 - DNA, 75 bp, Artificial Sequence
  Synthetic
agtcagttatggaccacgagcagtccatgtataacttacttaaaggctgtaatgctgttgctaagcatgatttct

SEQ ID NO: 201828 - DNA, 75 bp, Artificial Sequence
  Synthetic
aatgctgttgctaagcatgatttctttacttggcatgagggcagaaccatttatggtaatgttagtagacaggat

SEQ ID NO: 201829 - DNA, 75 bp, Artificial Sequence
  Synthetic
cttactaaatacaccatgatggatttgtgcttcgctctgcgtaactttgatgaaaaagattgtgaagtttttaag

SEQ ID NO: 201830 - DNA, 75 bp, Artificial Sequence
  Synthetic
gagatattggttcttactggttgttgtaatactgattactttgaaatgaagaattggtttgaccccatagaaaat

SEQ ID NO: 201831 - DNA, 75 bp, Artificial Sequence
  Synthetic
gtagacaggatcttactaaatacaccatgatggatttgtgcttcgctctgcgtaactttgatgaaaaagattgtg

SEQ ID NO: 201832 - DNA, 75 bp, Artificial Sequence
  Synthetic
gaggacatacaccgtgtgtatgctgctttaggtaaggtagttgcaaatgcaatgcttaagtgtgttgctttttgc

SEQ ID NO: 201833 - DNA, 75 bp, Artificial Sequence
  Synthetic
gacgaaatggtgctcaaaggagttgttggtgttttgaccttagacaaccaagatcttaatgggaatttctatgac

SEQ ID NO: 201834 - DNA, 75 bp, Artificial Sequence
  Synthetic
ttggtgttttgaccttagacaaccaagatcttaatgggaatttctatgacttcggtgactttgtattgtgtcctc

SEQ ID NO: 201835 - DNA, 75 bp, Artificial Sequence
  Synthetic
ctggaatgggaataccctactgcacgtcatactatgcttatatgatgcctgttatgggtatgactaattgtttag

SEQ ID NO: 201836 - DNA, 75 bp, Artificial Sequence
  Synthetic
ctagtgagtgctttatgaaaagtgacatctttggtcaagacttcaaaacttttgatttgttgaaatatgatttca

SEQ ID NO: 201837 - DNA, 75 bp, Artificial Sequence
  Synthetic
cagaacataaggaggttttgtttaacaagtactttaagtattggggacaggattatcatcctgattgtgttgatt

SEQ ID NO: 201838 - DNA, 75 bp, Artificial Sequence
  Synthetic
gccatgacgagatgtgtattttgcattgttcaaattttaacacactcttcgcaaccacaattccaaacacagctt

SEQ ID NO: 201839 - DNA, 75 bp, Artificial Sequence
  Synthetic
ttggacctctgtgcagaaaagtgtttattgatggtgtacccgtagttgctactgctggttaccactttaaacaat

SEQ ID NO: 201840 - DNA, 75 bp, Artificial Sequence
  Synthetic
taggacttgtgtggaacaaagatgttaacacccattctaccagacttactattactgaactcttacagtttgtga

SEQ ID NO: 201841 - DNA, 75 bp, Artificial Sequence
  Synthetic
cagatccaacgcttatagttgcgtcatcgcctgccttggtggataaacgcactgtttgtttttctgtcgctgctt

SEQ ID NO: 201842 - DNA, 75 bp, Artificial Sequence
  Synthetic
tgagtacaggattaacatcccaaacagtaaaacctggccattttaataaggagttttatgacttcttacgttctc

SEQ ID NO: 201843 - DNA, 75 bp, Artificial Sequence
  Synthetic
aagggtttttcgatgagggttcagaattaacattgaagcatttcttttttacacaaaagggtgatgctgcaatta

SEQ ID NO: 201844 - DNA, 75 bp, Artificial Sequence
  Synthetic
caagctcgcgtagcatatcaagtggcagctcgctattttgactgttacgagggtggctgtattacatctagagag

SEQ ID NO: 201845 - DNA, 75 bp, Artificial Sequence
  Synthetic
gttgttgttacaaaccttaataaaagcgctggttggccccttaataagtttggtaaagctggtttatattatgag

SEQ ID NO: 201846 - DNA, 75 bp, Artificial Sequence
  Synthetic
tctattagttatgaggaacaagatgctatttttttattaacaaagcgtaacattctccctactatgactcagtta

SEQ ID NO: 201847 - DNA, 75 bp, Artificial Sequence
  Synthetic
aatcttaaatacgccatatctggtaaggaacgtgcacgtacagtgggtggcgtctctttattagctactatgact

SEQ ID NO: 201848 - DNA, 75 bp, Artificial Sequence
  Synthetic
aggaacgtgcacgtacagtgggtggcgtctctttattagctactatgactacaagacagtttcatcagaaatgtc

SEQ ID NO: 201849 - DNA, 75 bp, Artificial Sequence
  Synthetic
acaagacagtttcatcagaaatgtctaaaatccatagtagctaccagaaatgccactgttgttatcggcactacc

SEQ ID NO: 201850 - DNA, 75 bp, Artificial Sequence
  Synthetic
taaaatccatagtagctaccagaaatgccactgttgttatcggcactaccaagttttatggcggttgggataata

SEQ ID NO: 201851 - DNA, 75 bp, Artificial Sequence
  Synthetic
tgttaaagaacctgatggccgatgttgacgatcctaaattgatgggatgggactatcctaagtgtgatagagcta

SEQ ID NO: 201852 - DNA, 75 bp, Artificial Sequence
  Synthetic
tgccctcaatgattcgtatgttgtcggctatgatcttaggttctaagcatgtcacatgttgtacggctagtgata

SEQ ID NO: 201853 - DNA, 75 bp, Artificial Sequence
  Synthetic
aattttatagacttagtaatgagcttgctcaagttttgaccgaggttgtttattcaaatggtggtttttatttta

SEQ ID NO: 201854 - DNA, 75 bp, Artificial Sequence
  Synthetic
aacctggtggtacaacttctggtgatgcaactacagcctacgccaattctgtctttaatatatttcaggctgtaa

SEQ ID NO: 201855 - DNA, 75 bp, Artificial Sequence
  Synthetic
gttctaacattaattgcgttttgagcgttaactcgtcaaattgcaataattttaatgttaagaagttacagagac

SEQ ID NO: 201856 - DNA, 75 bp, Artificial Sequence
  Synthetic
aactctatgataattgctatagaaatagtaatgttgatgaatcttttgtggatgacttttatggttatttgcaaa

SEQ ID NO: 201857 - DNA, 75 bp, Artificial Sequence
  Synthetic
tgatgatggtgttgtgtgctataataaaacttatgctgaacttggttacattgctgatattagtgcttttaaagc

SEQ ID NO: 201858 - DNA, 75 bp, Artificial Sequence
  Synthetic
aaaacttatgctgaacttggttacattgctgatattagtgcttttaaagccactttgtattatcagaatggtgtg

SEQ ID NO: 201859 - DNA, 75 bp, Artificial Sequence
  Synthetic
cactttgtattatcagaatggtgtgtttatgagtacagctaagtgttggactgaggaagatctttctataggacc

SEQ ID NO: 201860 - DNA, 75 bp, Artificial Sequence
  Synthetic
tcatgaattttgctcacagcacactatgcagattgtagatgaaaatggtaagtattatctaccatatccagatcc

SEQ ID NO: 201861 - DNA, 75 bp, Artificial Sequence
  Synthetic
atgcagattgtagatgaaaatggtaagtattatctaccatatccagatcctagccgtattatttctgctggtgtt

SEQ ID NO: 201862 - DNA, 75 bp, Artificial Sequence
  Synthetic
tagccgtattatttctgctggtgtttttgtggatgacatcactaagactgatgctgtcattcttttggaacgcta

SEQ ID NO: 201863 - DNA, 75 bp, Artificial Sequence
  Synthetic
tttgtggatgacatcactaagactgatgctgtcattcttttggaacgctatgtttctctggctatagatgcatac

SEQ ID NO: 201864 - DNA, 75 bp, Artificial Sequence
  Synthetic
ccattgtccaagcatcctaaacctgagtacaggaaggtgttttacgcattgttagattgggttaaacatctcaac

SEQ ID NO: 201865 - DNA, 75 bp, Artificial Sequence
  Synthetic
aagactcttaacgaaggtgttttggagtctttttctgttacacttttagatgaacaggagtctaagttttgggat

SEQ ID NO: 201866 - DNA, 75 bp, Artificial Sequence
  Synthetic
agaagtctacagtattacaagctgctggtctttgtgtagtatgtggctctcaaacagttctaagatgcggtgatt

SEQ ID NO: 201867 - DNA, 75 bp, Artificial Sequence
  Synthetic
tggtctttgtgtagtatgtggctctcaaacagttctaagatgcggtgattgtttacgcagaccgatgttgtgcac

SEQ ID NO: 201868 - DNA, 75 bp, Artificial Sequence
  Synthetic
gtttacgcagaccgatgttgtgcactaagtgcgcctatgatcatgtgtttggcactgatcataagttcattttag

SEQ ID NO: 201869 - DNA, 75 bp, Artificial Sequence
  Synthetic
ggcactgatcataagttcattttagctattacaccatatgtttgtaacacatctggctgcaacgtaactgacgtt

SEQ ID NO: 201870 - DNA, 75 bp, Artificial Sequence
  Synthetic
acaaaactgtatcttggaggtttgaattattactgtgtagaccacaaaccacatctttcattcccactgtgttca

SEQ ID NO: 201871 - DNA, 75 bp, Artificial Sequence
  Synthetic
gctggtaatgtctttggtttgtacaaaagttctgctttgggttccatggacattgacgtctttaacaaactttct

SEQ ID NO: 201872 - DNA, 75 bp, Artificial Sequence
  Synthetic
acctctgattggtctgacattcgcgactacaagctggctaatgatgcaaaagagtcactaaggttgtttgcagct

SEQ ID NO: 201873 - DNA, 75 bp, Artificial Sequence
  Synthetic
gactaatggttctggtagcggtcaggctattacttgtaccattgattccaacactacgcaggacacatatggtgg

SEQ ID NO: 201874 - DNA, 75 bp, Artificial Sequence
  Synthetic
gaaacggtcaaggctaaagaggaaagtgttaagtcatcatacgcttatgctaccctaaaggagattgtaggtcct

SEQ ID NO: 201875 - DNA, 75 bp, Artificial Sequence
  Synthetic
aaggaacttttgctcttatgggaaagtggaaaagccaaaccaccgttaaaccgtaattctgtttttacatgcttc

SEQ ID NO: 201876 - DNA, 75 bp, Artificial Sequence
  Synthetic
caaattacaaaagactccaagtttcaagttggtgagtttgtgtttgagaaagtagattatggttctgatacggtt

SEQ ID NO: 201877 - DNA, 75 bp, Artificial Sequence
  Synthetic
acttacaaatccactgctactactaagttagtaccaggtatgttatttattttgacttctcataatgttgctcca

SEQ ID NO: 201878 - DNA, 75 bp, Artificial Sequence
  Synthetic
cttagagcgccaacaatggcaaaccaggagaaatattctaccatttacaagttgcacccatcatttaatgttagt

SEQ ID NO: 201879 - DNA, 75 bp, Artificial Sequence
  Synthetic
gatgcttatgcaaatcttgtaccttattaccaacttattggcaaacagcgtatcaccacaatacagggtcctcct

SEQ ID NO: 201880 - DNA, 75 bp, Artificial Sequence
  Synthetic
tctcacgctgctgttgattcgctttgtgcaaaagctgtcacagcctatagtgttgataagtgtacacgtattatt

SEQ ID NO: 201881 - DNA, 75 bp, Artificial Sequence
  Synthetic
agggtcctcctggtagtggaaaatcgcattgctctattggtattggtgtgtattaccctggagcgaggatcgtgt

SEQ ID NO: 201882 - DNA, 75 bp, Artificial Sequence
  Synthetic
cctgcacgtgccagagttgagtgttatagtggttttaaacctaacaatactagtgcacaatacgtgtttagtact

SEQ ID NO: 201883 - DNA, 75 bp, Artificial Sequence
  Synthetic
gttaatgcgttacctgaagttaatgcagacattgttgtcgtggatgaggtgtctatgtgcactaactatgacttg

SEQ ID NO: 201884 - DNA, 75 bp, Artificial Sequence
  Synthetic
tctgtgattaaccagcgtatatcatataaacacattgtatatgttggtgatcctcaacagcttccagctcctaga

SEQ ID NO: 201885 - DNA, 75 bp, Artificial Sequence
  Synthetic
gttcttatctctaaaggtgttatggaaccaattgactataatgttgtgacacaacgtatgtgtgctataggaccc

SEQ ID NO: 201886 - DNA, 75 bp, Artificial Sequence
  Synthetic
gatgtctttttacacaagtgttacagatgtcctgctgaaatagttaacactgtttcagagcttgtttatgaaaac

SEQ ID NO: 201887 - DNA, 75 bp, Artificial Sequence
  Synthetic
gatgtcctgctgaaatagttaacactgtttcagagcttgtttatgaaaacaagtttgtacctgtcaaagaagcta

SEQ ID NO: 201888 - DNA, 75 bp, Artificial Sequence
  Synthetic
aagtttgtacctgtcaaagaagctagtaagcagtgcttcaaaatctttgaacgcggtagtgttcaggtagacaat

SEQ ID NO: 201889 - DNA, 75 bp, Artificial Sequence
  Synthetic
ggttccagtataaataggcgtcaacttgatgttgttaagcgatttatacataaaaactccacatggagcaaggct

SEQ ID NO: 201890 - DNA, 75 bp, Artificial Sequence
  Synthetic
gtgtttatctcaccttacaatagtcaaaattatgtagctgccaggcttttaggtttacaaactcagacagtggat

SEQ ID NO: 201891 - DNA, 75 bp, Artificial Sequence
  Synthetic
tctgctcaaggtagtgaatatgactatgttatattcgcacagacatcagatactgctcatgcctgtaatgccaat

SEQ ID NO: 201892 - DNA, 75 bp, Artificial Sequence
  Synthetic
cgttttaacgttgccattactagagcaaagaaaggtattttctgtattatgtctgacagaactttgtttgatgca

SEQ ID NO: 201893 - DNA, 75 bp, Artificial Sequence
  Synthetic
caaagaaaggtattttctgtattatgtctgacagaactttgtttgatgcacttaagttctttgaagttactatga

SEQ ID NO: 201894 - DNA, 75 bp, Artificial Sequence
  Synthetic
cagatttacagtctgaaagcagttgtggtttgtttaaggattgtgcacgtaaccctattgatttaccaccaagtc

SEQ ID NO: 201895 - DNA, 75 bp, Artificial Sequence
  Synthetic
atgccactacttatttgtcattgtctgatagatttaagactagtggtgacttggctgttcaaataggtaacaaca

SEQ ID NO: 201896 - DNA, 75 bp, Artificial Sequence
  Synthetic
atgtttgtacctatgaacatgtgatttcatatatgggtttcaggtttgatgttagcatgcctggtagtcatagtt

SEQ ID NO: 201897 - DNA, 75 bp, Artificial Sequence
  Synthetic
attggacaagctcgcgtagcatatcaagtggcagctcgctattttgactgttacgagggtggctgtattacatct

SEQ ID NO: 201898 - DNA, 75 bp, Artificial Sequence
  Synthetic
tgttctgtactagagactttgccatgcgtcatgtcagaggttggttaggaatggatgtggaaggtgcacatgtca

SEQ ID NO: 201899 - DNA, 75 bp, Artificial Sequence
  Synthetic
caggtgacaatgttggcactaatgtacctctacaagttggtttttccaatggtgttgattttgtagctcaacctg

SEQ ID NO: 201900 - DNA, 75 bp, Artificial Sequence
  Synthetic
acctctacaagttggtttttccaatggtgttgattttgtagctcaacctgaaggttgtgttttaacaaacactgg

SEQ ID NO: 201901 - DNA, 75 bp, Artificial Sequence
  Synthetic
tatgagtctattagttatgaggaacaagatgctattttttcattaacaaagcgtaatattctccctactatgact

SEQ ID NO: 201902 - DNA, 75 bp, Artificial Sequence
  Synthetic
aagatgctattttttcattaacaaagcgtaatattctccctactatgactcagttaaatcttaaatacgccatat

SEQ ID NO: 201903 - DNA, 75 bp, Artificial Sequence
  Synthetic
cagtgttgtaaaacctgttcgtgctcgtgcaccacctggagaacaatttactcacattgtacctctgttacgcaa

SEQ ID NO: 201904 - DNA, 75 bp, Artificial Sequence
  Synthetic
gggacaaccttggagtgtgttgagaaaacgtattgttcaaatgatagcagattttcttgctggctcatctgatgt

SEQ ID NO: 201905 - DNA, 75 bp, Artificial Sequence
  Synthetic
aatgtctgaaatccatagtagctaccagaaatgccaccgttgttatcggcactaccaagttttatggcgggtggg

SEQ ID NO: 201906 - DNA, 75 bp, Artificial Sequence
  Synthetic
cagaaatgccaccgttgttatcggcactaccaagttttatggcgggtgggataatatgttaaagaacctgatggc

SEQ ID NO: 201907 - DNA, 75 bp, Artificial Sequence
  Synthetic
ggtttagagttgaccactatgcgttattttgttaagattggagctgttaaacattgccaatgtggtactgttgca

SEQ ID NO: 201908 - DNA, 75 bp, Artificial Sequence
  Synthetic
attttgttaagattggagctgttaaacattgccaatgtggtactgttgcaacatgttacaattctgttagtaatg

SEQ ID NO: 201909 - DNA, 75 bp, Artificial Sequence
  Synthetic
actattgttgctttaaacatgcattgggctgtgactatgtttataacccatatgtcatagatattcaacaatggg

SEQ ID NO: 201910 - DNA, 75 bp, Artificial Sequence
  Synthetic
gggctgtgactatgtttataacccatatgtcatagatattcaacaatggggttatgttggttcactctccactaa

SEQ ID NO: 201911 - DNA, 75 bp, Artificial Sequence
  Synthetic
atgctattatgactagatgtttggctgtgtatgactgctttgttaagaatgtggattggtcaattacctacccta

SEQ ID NO: 201912 - DNA, 75 bp, Artificial Sequence
  Synthetic
tgatagctaatgaaaatgccataaacaagggcggtcgcactgtgcagagtcatattatgcgtgctgctattaaat

SEQ ID NO: 201913 - DNA, 75 bp, Artificial Sequence
  Synthetic
tgtacaaccctaaagcaatccatgacattggtaatcctaagggtattcgttgtgctgtaactgatgccaagtggt

SEQ ID NO: 201914 - DNA, 75 bp, Artificial Sequence
  Synthetic
attgttatgacaagaaccctattaattctaatgtgaaaacattggagtatgattacatgacacatggccaaatgg

SEQ ID NO: 201915 - DNA, 75 bp, Artificial Sequence
  Synthetic
aaggcttgtgtttgttttggaattgtaatgtggatatgtaccctgaattctcaattgtttgcaggtttgacacac

SEQ ID NO: 201916 - DNA, 75 bp, Artificial Sequence
  Synthetic
tcaattgtttgcaggtttgacacacgtacacgatctacattgaacctcgaaggtgtaaatggtggttcattgtat

SEQ ID NO: 201917 - DNA, 75 bp, Artificial Sequence
  Synthetic
gtcaataaccatgcatttcacactcctgcttatgataaacgtgctatggctaaattgaaaccagcaccgtttttc

SEQ ID NO: 201918 - DNA, 75 bp, Artificial Sequence
  Synthetic
tactatgatgacggttcatgtgaggttgttcacgatcaagttaactatgttcctttgagagccactaattgcatt

SEQ ID NO: 201919 - DNA, 75 bp, Artificial Sequence
  Synthetic
aacctgagtacaggaaggtgttttacgcattgttagactgggtcaaacatctcaacaagactcttaacgaaggtg

SEQ ID NO: 201920 - DNA, 75 bp, Artificial Sequence
  Synthetic
atttttactcaagctggttttaatatttgggttcctaccacgtttgattgttataatttgtggcagacattcaca

SEQ ID NO: 201921 - DNA, 75 bp, Artificial Sequence
  Synthetic
gatgtcaatttacaaggtttagagaacattgcttttaacgttgttaataaaggttcatttgttggtgctgatggt

SEQ ID NO: 201922 - DNA, 75 bp, Artificial Sequence
  Synthetic
tggtggtgctgtatgttctaagcacgctaatctctatagagcatatgttgagtcatataacatttttactcaagc

SEQ ID NO: 201923 - DNA, 75 bp, Artificial Sequence
  Synthetic
gaattaccagtagccattagtggtgataaagtgttcgtacgtgatggtaacactgataatttagtctttgttaac

SEQ ID NO: 201924 - DNA, 75 bp, Artificial Sequence
  Synthetic
aaaacatcactgcctacaaatatagcatttgaactttttgctaagaggaaggttggtttaacaccacctctcagt

SEQ ID NO: 201925 - DNA, 75 bp, Artificial Sequence
  Synthetic
ttttagctattacaccatatgtgtgtaacacatctggctgcaatgtaaatgacgttacaaaactgtatcttggag

SEQ ID NO: 201926 - DNA, 75 bp, Artificial Sequence
  Synthetic
attctcaaaaaccttggtgttgtcgccacatataagtttgtcttgtgggattatgaagctgagcgtcccttgaca

SEQ ID NO: 201927 - DNA, 75 bp, Artificial Sequence
  Synthetic
agctttactaagtctgtttgtggttatacagactttgcagaggatgtttgtacttgttacgataatagtatacaa

SEQ ID NO: 201928 - DNA, 75 bp, Artificial Sequence
  Synthetic
ggttcatacgaacgttttactctctcaactaatgctgtgttattctctgctactgctgtgaaaacaggtggtaag

SEQ ID NO: 201929 - DNA, 75 bp, Artificial Sequence
  Synthetic
agtttgccggctattaaattgaattttggaatgcttaacggtaatgcaattgctactgtcaaatcagaagatggt

SEQ ID NO: 201930 - DNA, 75 bp, Artificial Sequence
  Synthetic
aacataaaaaatattaactggtttgtttacgtacgcaaagatggtaaacctgttgatcattatgatggtttttat

SEQ ID NO: 201931 - DNA, 75 bp, Artificial Sequence
  Synthetic
acccaaggtcgtaatttacaagactttttgcctcgaagcacaatggaagaagactttttgaacatggatataggc

SEQ ID NO: 201932 - DNA, 75 bp, Artificial Sequence
  Synthetic
aggatttcaacttcgagcacgttgtgtatggtgatgtttcaaaaactactctaggcggtttacacttgttgattt

SEQ ID NO: 201933 - DNA, 75 bp, Artificial Sequence
  Synthetic
cacaagtacgtctgagtaaaatgggcatcttaaaggcagaggagtttgtggcagcatctgacataacactcaaat

SEQ ID NO: 201934 - DNA, 75 bp, Artificial Sequence
  Synthetic
gttgtactgtgacttatcttaatgatcctagttctaagactgtttgtacttacatggatttgttgttggatgatt

SEQ ID NO: 201935 - DNA, 75 bp, Artificial Sequence
  Synthetic
tacatggatttgttgttggatgattttgtttctttattgaagtctttggatttgactgttgtatccaaggttcat

SEQ ID NO: 201936 - DNA, 75 bp, Artificial Sequence
  Synthetic
gaggtcataattgacaacaaaccatggagatggatgctatggtgtaaagataatgccgttgctacattctatcct

SEQ ID NO: 201937 - DNA, 75 bp, Artificial Sequence
  Synthetic
ggagatggatgctatggtgtaaagataatgccgttgctacattctatcctcagttgcagagtgcagaatggaaat

SEQ ID NO: 201938 - DNA, 75 bp, Artificial Sequence
  Synthetic
gcgggtattctatgcctggtatttataagacacaacgtatgtgcttagaaccatgtaatttgtataattatggtg

SEQ ID NO: 201939 - DNA, 75 bp, Artificial Sequence
  Synthetic
caggtttgaagttgcccagtggcattatgttcaatgttgttaaatacactcaattgtgtcaatattttaacagta

SEQ ID NO: 201940 - DNA, 75 bp, Artificial Sequence
  Synthetic
agaatggaaatgcgggtattctatgcctggtatttataagacacaacgtatgtgcttagaaccatgtaatttgta

SEQ ID NO: 201941 - DNA, 75 bp, Artificial Sequence
  Synthetic
ccacgttatgtgttcctcataatatgagagtgttacacttgggtgctggctctgattatggtgttgcaccaggaa

SEQ ID NO: 201942 - DNA, 75 bp, Artificial Sequence
  Synthetic
tctgattatggtgttgcaccaggaactgctgttcttaaaaggtggttgccgcacgacgcaattgttgttgacaat

SEQ ID NO: 201943 - DNA, 75 bp, Artificial Sequence
  Synthetic
gatgttgttgactatgtgagtgacgctgattttagtgttactggtgattgtgcaaccgtttatttggaagacaag

SEQ ID NO: 201944 - DNA, 75 bp, Artificial Sequence
  Synthetic
tttgacttgttaatctctgatatgtacgatggtaggacaaaggcaattgatggtgaaaatgtttcaaaagaagga

SEQ ID NO: 201945 - DNA, 75 bp, Artificial Sequence
  Synthetic
tttttcacttacatcaatggtttcatttgtgaaaaacttgccatcggaggttcgattgctattaaagtaacagag

SEQ ID NO: 201946 - DNA, 75 bp, Artificial Sequence
  Synthetic
ttcgattgctattaaagtaacagagtatagctggaataagaaattgtatgaacttgtacaaagattttctttttg

SEQ ID NO: 201947 - DNA, 75 bp, Artificial Sequence
  Synthetic
gactatgttttgcacttctgttaatacgtcatcatcagaagcctttgttgtcggaattaactatcttggtgattt

SEQ ID NO: 201948 - DNA, 75 bp, Artificial Sequence
  Synthetic
cgcacaaggaccttttatagatggtaacataatacatgcaaattatgtattttggcgtaactccactgttatgag

SEQ ID NO: 201949 - DNA, 75 bp, Artificial Sequence
  Synthetic
tttgtcctacaactctgttttagacctgagtaaatttaattgcaaacacaaagctactgttgttgtgcaattaaa

SEQ ID NO: 201950 - DNA, 75 bp, Artificial Sequence
  Synthetic
tattatgtctgacagaactttgtttgatgcacttaagttctttgaaatcactatgacagatttacagtctgaaag

SEQ ID NO: 201951 - DNA, 75 bp, Artificial Sequence
  Synthetic
ggatagtgatattaatgacatggtgcttagtcttgttaggagtggtaagttgcttgtaaggggtaatggcaagtg

SEQ ID NO: 201952 - DNA, 75 bp, Artificial Sequence
  Synthetic
cttagtcttgttaggagtggtaagttgcttgtaaggggtaatggcaagtgtttgagttttagtaatcatttagtc

SEQ ID NO: 201953 - DNA, 75 bp, Artificial Sequence
  Synthetic
tcaactaaataaaatgtttgttttacttgttgcatatgccttgttgcatattgctggttgtcaaactacaaatgg

SEQ ID NO: 201954 - DNA, 75 bp, Artificial Sequence
  Synthetic
gagtggtaagttgcttgtaaggggtaatggcaagtgtttgagttttagtaatcatttagtctcaactaaataaaa

SEQ ID NO: 201955 - DNA, 75 bp, Artificial Sequence
  Synthetic
atgtatttgctgttgagagtggtggttatataccctccgactttgcatttaataattggttcctcttaactaata

SEQ ID NO: 201956 - DNA, 75 bp, Artificial Sequence
  Synthetic
actacaaatgggatgaacactagtcactctgtttgcaacggctgtgttggtcattcggaaaatgtatttgctgtt

SEQ ID NO: 201957 - DNA, 75 bp, Artificial Sequence
  Synthetic
ttttaatggtactgggagaggtgattgtaaaggtttttattcaaatgcttcgtctgatgtcatacgttacaacat

SEQ ID NO: 201958 - DNA, 75 bp, Artificial Sequence
  Synthetic
ggaaccattttgtttaaaacatcttatggtgctgttgtgttttattgtaccaacaacactttggtttcaggtgat

SEQ ID NO: 201959 - DNA, 75 bp, Artificial Sequence
  Synthetic
gctcacataccatctggtacagttttgggcaatttttattgctttgtaaatactactattggcaatgaaactacg

SEQ ID NO: 201960 - DNA, 75 bp, Artificial Sequence
  Synthetic
tgggcaatttttattgctttgtaaatactactattggcaatgaaactacgtctgcttttgtgggtgcactaccta

SEQ ID NO: 201961 - DNA, 75 bp, Artificial Sequence
  Synthetic
ggctatcgctattttactttaggtaatgtagaagccgttaatttcaatgtcactaatgcagaaaccactgtttgt

SEQ ID NO: 201962 - DNA, 75 bp, Artificial Sequence
  Synthetic
atgtagaagccgttaatttcaatgtcactaatgcagaaaccactgtttgtactgttgcgttagcttcttatgctg

SEQ ID NO: 201963 - DNA, 75 bp, Artificial Sequence
  Synthetic
actgttgcgttagcttcttatgctgacgttttggttaatgtgtcacaaactgctattgctaatataatttattgc

SEQ ID NO: 201964 - DNA, 75 bp, Artificial Sequence
  Synthetic
gtgaccagttgtcctttgatgtaccagatggtttttattccacaagccctattcaatccgttgagctacctgtgt

SEQ ID NO: 201965 - DNA, 75 bp, Artificial Sequence
  Synthetic
agatggtttttattccacaagccctattcaatccgttgagctacctgtgtctattgtgtcgctacctgtttatca

SEQ ID NO: 201966 - DNA, 75 bp, Artificial Sequence
  Synthetic
attcaatccgttgagctacctgtgtctattgtgtcgctacctgtttatcacaaacacacgtttattgtgttgtat

SEQ ID NO: 201967 - DNA, 75 bp, Artificial Sequence
  Synthetic
caaacacacgtttattgtgttgtatgttaacttcaaacttcggagtggcgttggcaggtgctataactgtcgtcc

SEQ ID NO: 201968 - DNA, 75 bp, Artificial Sequence
  Synthetic
tgctgttgttaatattacactggccaattttaatgaaactaaagggcctttgtgtgttgacacatcacacttcac

SEQ ID NO: 201969 - DNA, 75 bp, Artificial Sequence
  Synthetic
tgtgtgttgacacatcacacttcactacccaattcgttggtgccaagtttgataggtggagtgctagtattaaca

SEQ ID NO: 201970 - DNA, 75 bp, Artificial Sequence
  Synthetic
gataggtggagtgctagtattaacacgggaaattgccctttttcttttggcaaagttaataactttgttaaattt

SEQ ID NO: 201971 - DNA, 75 bp, Artificial Sequence
  Synthetic
acacacgtacacgatctacattgaaccttgaaggtgtaaatggtgggtcattgtatgtcaataatcatgcatttc

SEQ ID NO: 201972 - DNA, 75 bp, Artificial Sequence
  Synthetic
tataatggctaatttggctaatcttaattctcataatataggctcattgtatgtttcttggagtgatggtgatgt

SEQ ID NO: 201973 - DNA, 75 bp, Artificial Sequence
  Synthetic
aattactggcgtcccaaaacctgttgagggtgttagttcctttatgaatgttacattgaataaatgtactaaata

SEQ ID NO: 201974 - DNA, 75 bp, Artificial Sequence
  Synthetic
gagggtgttagttcctttatgaatgttacattgaataaatgtactaaatataacatttatgatgtatctggtgtg

SEQ ID NO: 201975 - DNA, 75 bp, Artificial Sequence
  Synthetic
ggtgttattcgcattagcaatgacacctttcttaatggaattacgtacacatcaacttcaggtaaccttctgggt

SEQ ID NO: 201976 - DNA, 75 bp, Artificial Sequence
  Synthetic
cctttcttaatggaattacgtacacatcaacttcaggtaaccttctgggttttaaagatgttactaatggcacca

SEQ ID NO: 201977 - DNA, 75 bp, Artificial Sequence
  Synthetic
tctactctatcactccttgtaacccaccagatcagcttgttgtttatcagcaagctgttgttggtgctatgttgt

SEQ ID NO: 201978 - DNA, 75 bp, Artificial Sequence
  Synthetic
accagatcagcttgttgtttatcagcaagctgttgttggtgctatgttgtctgaaaactttactagttacggctt

SEQ ID NO: 201979 - DNA, 75 bp, Artificial Sequence
  Synthetic
ttctaatgttgtagaaatgccgaaatttttctatgcgtccaatggcacttataattgcacagacgctgttttaac

SEQ ID NO: 201980 - DNA, 75 bp, Artificial Sequence
  Synthetic
ttattctagttttggcgtttgtgcagatggttctataattgctgttcaaccacgtaatgtttcatatgatagtgt

SEQ ID NO: 201981 - DNA, 75 bp, Artificial Sequence
  Synthetic
ttcagctatcgtcacagctaatttgtctataccctccaattggaccacttcggtccaggttgagtatttacaaat

SEQ ID NO: 201982 - DNA, 75 bp, Artificial Sequence
  Synthetic
tctataccctccaattggaccacttcggtccaggttgagtatttacaaattacaagtacacctatcgtagttgat

SEQ ID NO: 201983 - DNA, 75 bp, Artificial Sequence
  Synthetic
tgctccacttatgtttgcaatggtaatgtgcgctgtgttgaattgcttaagcagtatacttctgcttgtaaaact

SEQ ID NO: 201984 - DNA, 75 bp, Artificial Sequence
  Synthetic
gcagtatacttctgcttgtaaaactattgaagacgccttaagaaatagcgccatgctggagtctgcagatgttag

SEQ ID NO: 201985 - DNA, 75 bp, Artificial Sequence
  Synthetic
tgagatgctcacttttgacaagaaagcgtttacacttgctaatgttagtagttttggtgactacaaccttagcag

SEQ ID NO: 201986 - DNA, 75 bp, Artificial Sequence
  Synthetic
gcgtttacacttgctaatgttagtagttttggtgactacaaccttagcagtgttatacctagcttgcccagaagt

SEQ ID NO: 201987 - DNA, 75 bp, Artificial Sequence
  Synthetic
ggtagtagagtggctggtcgcagtgccatagaagacatactttttagcaaacttgttacgtctggacttggcact

SEQ ID NO: 201988 - DNA, 75 bp, Artificial Sequence
  Synthetic
ttgacaagaaagcgtttacacttgctaatgttagtagttttggtgactacaaccttagcagtgttatacctagct

SEQ ID NO: 201989 - DNA, 75 bp, Artificial Sequence
  Synthetic
ctaagggtctttccattgctgacttggcttgtgcccaatattataatggcattatggttttgcctggcgtcgctg

SEQ ID NO: 201990 - DNA, 75 bp, Artificial Sequence
  Synthetic
gtcacgtttaaattatgttgcattgcagactgatgttttacaagaaaatcagaaaattcttgctgcatcttttaa

SEQ ID NO: 201991 - DNA, 75 bp, Artificial Sequence
  Synthetic
cagactgatgttttacaagaaaatcagaaaattcttgctgcatcttttaataaagcaatgaccaacatagtagat

SEQ ID NO: 201992 - DNA, 75 bp, Artificial Sequence
  Synthetic
aacagttgctactgcacttaataagatccaggatgttgttaatcaacaaggcaactcattgaaccatttaacttc

SEQ ID NO: 201993 - DNA, 75 bp, Artificial Sequence
  Synthetic
atccaggatgttgttaatcaacaaggcaactcattgaaccatttaacttctcagttgaggcagaattttcaagcc

SEQ ID NO: 201994 - DNA, 75 bp, Artificial Sequence
  Synthetic
tcagttgaggcagaattttcaagccatctctagctctattcaggctatctatgacagacttgatattattcaggc

SEQ ID NO: 201995 - DNA, 75 bp, Artificial Sequence
  Synthetic
tgatcaacaagtagataggctgattactggtagattggctgctctgaatgtattcgtttctcatacattgactaa

SEQ ID NO: 201996 - DNA, 75 bp, Artificial Sequence
  Synthetic
gtacactgaagttcgtgcttccagacagcttgcacaacaaaaagtgaatgagtgtgtcaaatcccagtctaagcg

SEQ ID NO: 201997 - DNA, 75 bp, Artificial Sequence
  Synthetic
agtgtgtcaaatcccagtctaagcggtatggcttctgtggaaatggcacgcacattttctcacttgttaatgctg

SEQ ID NO: 201998 - DNA, 75 bp, Artificial Sequence
  Synthetic
ctcctgaggggcttgtttttctccatactgtcttgttgccgacacaatataaggatgttgaagcgtggtctgggt

SEQ ID NO: 201999 - DNA, 75 bp, Artificial Sequence
  Synthetic
aaggatgttgaagcgtggtctgggttgtgcgttgatggtagaaacggttatgtgttgagacaacctaatcttgct

SEQ ID NO: 202000 - DNA, 75 bp, Artificial Sequence
  Synthetic
gaattacatctcgcataatgtttgaaccacgtattcctaccatagcagattttgtccaaattgaaaattgcaatg

SEQ ID NO: 202001 - DNA, 75 bp, Artificial Sequence
  Synthetic
tcacatttgttaacatttctcgctctgagttgcaaactattgtgccagagtatattgatgttaataagacgctgc

SEQ ID NO: 202002 - DNA, 75 bp, Artificial Sequence
  Synthetic
ctaatcttgctctttacaaagaaggcaattattatagaattacatctcgcataatgtttgaaccacgtattccta

SEQ ID NO: 202003 - DNA, 75 bp, Artificial Sequence
  Synthetic
tatattgatgttaataagacgctgcaagaattaagttacaaattgccaaattacactgttccagacctagttgtc

SEQ ID NO: 202004 - DNA, 75 bp, Artificial Sequence
  Synthetic
gaacagtacaaccagactattttgaatttgaccagtgaaattagcacccttgaaaataaatctgcggagcttaat

SEQ ID NO: 202005 - DNA, 75 bp, Artificial Sequence
  Synthetic
agttgacttaaagtggctcaaccgtgttgagacttatatcaagtggccgtggtgggtgtggttgtgcatttcagt

SEQ ID NO: 202006 - DNA, 75 bp, Artificial Sequence
  Synthetic
gactattttgaatttgaccagtgaaattagcacccttgaaaataaatctgcggagcttaattacactgttcaaaa

SEQ ID NO: 202007 - DNA, 75 bp, Artificial Sequence
  Synthetic
cgtgctcatctttgtggtgagtatgttgctattatgttgttgttctactggttgctgtggcttctttagttgttt

SEQ ID NO: 202008 - DNA, 75 bp, Artificial Sequence
  Synthetic
gttttgcttgttgcatatgccttgttgcatattgctggttgtcaaactacaaatgggctgaacactagttactct

SEQ ID NO: 202009 - DNA, 75 bp, Artificial Sequence
  Synthetic
tgcatcttctattagaggttgttgtgaatcaactaaacttccttattacgacgttgaaaagatccacatacagta

SEQ ID NO: 202010 - DNA, 75 bp, Artificial Sequence
  Synthetic
caagtggccgtggtgggtgtggttgtgcatttcagtcgtgctcatctttgtggtgagtatgttgctattatgttg

SEQ ID NO: 202011 - DNA, 75 bp, Artificial Sequence
  Synthetic
gtttgcaacggctgtgttggttattcagaaaatgtatttgctgttgagagtggtggttatataccctccgacttt

SEQ ID NO: 202012 - DNA, 75 bp, Artificial Sequence
  Synthetic
atggctctaggtttgttcacattgcaatttgtgtctgctgttaatcaatctcttatcaagtcgaaagttagtgct

SEQ ID NO: 202013 - DNA, 75 bp, Artificial Sequence
  Synthetic
cagaaaatgtatttgctgttgagagtggtggttatataccctccgactttgcattcaataattggttccttctaa

SEQ ID NO: 202014 - DNA, 75 bp, Artificial Sequence
  Synthetic
ctaatacctcatctgttgtagatggtgttgtgaggagttttcagcctttgttgcttaattgcttatggtctgttt

SEQ ID NO: 202015 - DNA, 75 bp, Artificial Sequence
  Synthetic
gaagtttcacgacaggttatccaagacgtgaaagatggcactgttaccttcaacttgctagcgtatacactaatg

SEQ ID NO: 202016 - DNA, 75 bp, Artificial Sequence
  Synthetic
gaatcaactaaacttccttattacgacgttgaaaagatccacatacagtaatggctctaggtttgttcacattgc

SEQ ID NO: 202017 - DNA, 75 bp, Artificial Sequence
  Synthetic
agcctctttgttgtgtattttgctttatttaaagcaagatcacaccgtggcagatctgctcttatagtgtttaaa

SEQ ID NO: 202018 - DNA, 75 bp, Artificial Sequence
  Synthetic
tatttaaagcaagatcacaccgtggcagatctgctcttatagtgtttaaaattttaatccttttcgtttatgtgc

SEQ ID NO: 202019 - DNA, 75 bp, Artificial Sequence
  Synthetic
tgtctattttaatggtactgggagaggtgattgtaaaggtttttcctcagatgttttgtctgatgtcatacgtta

SEQ ID NO: 202020 - DNA, 75 bp, Artificial Sequence
  Synthetic
cattgctgtattggtctcaagcatatattgacgcaactttgattgctgtaattttgcttggaagatttttccata

SEQ ID NO: 202021 - DNA, 75 bp, Artificial Sequence
  Synthetic
cagcttggcactgctggctctacaagacatgggatttcattgtcttcaatgtaaccacactttgctatgtgcaag

SEQ ID NO: 202022 - DNA, 75 bp, Artificial Sequence
  Synthetic
gtaagtgttggtttcttgaaaataaggctctgaaaccattcgtctgtttttacggaggggatcaattcctttaca

SEQ ID NO: 202023 - DNA, 75 bp, Artificial Sequence
  Synthetic
atttttccatacagcttggcactgctggctttacaagacatgggatttcattgtcttcaatgtaaccacactttg

SEQ ID NO: 202024 - DNA, 75 bp, Artificial Sequence
  Synthetic
taggcgacagaattgttacttatctctcaactaacgatttgtacgttgctcttagaggacgtattgataaagacc

SEQ ID NO: 202025 - DNA, 75 bp, Artificial Sequence
  Synthetic
ctcaactaacgatttgtacgttgctcttagaggacgtattgataaagacctcagcctttctagaaaggttgagtt

SEQ ID NO: 202026 - DNA, 75 bp, Artificial Sequence
  Synthetic
caatgtcactactgcagaaaccactgatttttgtactgttgcgttagcttcttatgctgacgttttggttaatgt

SEQ ID NO: 202027 - DNA, 75 bp, Artificial Sequence
  Synthetic
aatccactaagatgttccttaagctagtggatgatcatgctttggttgttaatgtactactctggtgtgtggtgc

SEQ ID NO: 202028 - DNA, 75 bp, Artificial Sequence
  Synthetic
ttatagtgatactactagtgtgtattacaataattaaactaattaagctttgtttcacttgccatatgttttgta

SEQ ID NO: 202029 - DNA, 75 bp, Artificial Sequence
  Synthetic
tgtttatcataaacatacgtttattgtgttgtacgttgacttcaaacctcagagtggcggtggcaagtgctttaa

SEQ ID NO: 202030 - DNA, 75 bp, Artificial Sequence
  Synthetic
gtgttgtacgttgacttcaaacctcagagtggcggtggcaagtgctttaactgttatcctgctggtgttaatatt

SEQ ID NO: 202031 - DNA, 75 bp, Artificial Sequence
  Synthetic
atagaacagtttatggccccattaaaaatgtgtaccacatttaccaatcatatatgcacatagaccctttcccta

SEQ ID NO: 202032 - DNA, 75 bp, Artificial Sequence
  Synthetic
acactggccaattttaatgaaactaaagggcctttgtgtgttgacacatcacacttcactaccaaatacgttgct

SEQ ID NO: 202033 - DNA, 75 bp, Artificial Sequence
  Synthetic
aacgagttattgatttctaaactaaacgacaatgtcaaacgacaattgtacgggtgacattgtcacccatttgaa

SEQ ID NO: 202034 - DNA, 75 bp, Artificial Sequence
  Synthetic
aagggcctttgtgtgttgacacatcacacttcactaccaaatacgttgctgtttatgccaatgttggtaggtgga

SEQ ID NO: 202035 - DNA, 75 bp, Artificial Sequence
  Synthetic
gaattggaattttggttggaatgttattctaaccatattcattgttattcttcagtttggacattataaatactc

SEQ ID NO: 202036 - DNA, 75 bp, Artificial Sequence
  Synthetic
aactttgttaaatttggcagtgtatgtttttcgctaaaggatatacccggtggttgcgcaatgcctatagtggct

SEQ ID NO: 202037 - DNA, 75 bp, Artificial Sequence
  Synthetic
cagattgttttatggtttgaagatgcttgtactgtggcttctttggccacttgtacttgctttgtcaatctttga

SEQ ID NO: 202038 - DNA, 75 bp, Artificial Sequence
  Synthetic
aattgggcttatagtaagtactatactataggctcattgtatgtttcttggagtgatggtgatggaattactggc

SEQ ID NO: 202039 - DNA, 75 bp, Artificial Sequence
  Synthetic
cacctgggctaattgggactctaattgggcctttgttgcatttagctttcttatggccgtatcaacactcgttat

SEQ ID NO: 202040 - DNA, 75 bp, Artificial Sequence
  Synthetic
gtcccacaacctgttgagggtgttagttcctttatgaatgttacattggacaaatgtactaaatataatatttat

SEQ ID NO: 202041 - DNA, 75 bp, Artificial Sequence
  Synthetic
ttcagacttttccgacgtgctcgaactttttgggcatggaatcctgaggttaatgcaatcactgtcacaaccgtg

SEQ ID NO: 202042 - DNA, 75 bp, Artificial Sequence
  Synthetic
ttgggacagacatactatcaacccattcaacaagctccaacaggcattactgtgaccttgttgagcggcgtgctt

SEQ ID NO: 202043 - DNA, 75 bp, Artificial Sequence
  Synthetic
ttcaacaagctccaacaggcattactgtgaccttgttgagcggcgtgctttacgttgacggacatagattggctt

SEQ ID NO: 202044 - DNA, 75 bp, Artificial Sequence
  Synthetic
caggtgttcaggttcataacctacctgaatacatgacagttgccgtgccgagcactactataatttatagtagag

SEQ ID NO: 202045 - DNA, 75 bp, Artificial Sequence
  Synthetic
tcggaaggtccgtaaattctcaaaatagcacaggctgggttttctacgtacgagtaaaacacggtgatttttctg

SEQ ID NO: 202046 - DNA, 75 bp, Artificial Sequence
  Synthetic
cagtgagctcccccatgagcaacatgacagaaaacgaaagattgcttcattttttctaaactgaacgaaaagatg

SEQ ID NO: 202047 - DNA, 75 bp, Artificial Sequence
  Synthetic
cataacctacctgaatacatgacagttgccgtgccgagcactactataatttatagtagagtcggaaggtccgta

SEQ ID NO: 202048 - DNA, 75 bp, Artificial Sequence
  Synthetic
gctacagtcaaatgggctgatgcatctgaaccacaacgtggtcgtcagggtagaataccttattctctttatagc

SEQ ID NO: 202049 - DNA, 75 bp, Artificial Sequence
  Synthetic
cctttgcttgttgatagtgaacaaccttggaaggtgatacctcgtaatttggtacccatcaacaagaaagacaaa

SEQ ID NO: 202050 - DNA, 75 bp, Artificial Sequence
  Synthetic
aataagcttataggctattggaatgttcaaaaacgtttcagaactagaaagggcaaacgggtggatttgtcaccc

SEQ ID NO: 202051 - DNA, 75 bp, Artificial Sequence
  Synthetic
gggcaaacgggtggatttgtcacccaagttacatttttattatcttggcacaggaccccataaagatgcaaaatt

SEQ ID NO: 202052 - DNA, 75 bp, Artificial Sequence
  Synthetic
ttgctaatgttagtagttttggtgactacaaccttagcagcgtcatacctagcttgcccacaagtggtagtagag

SEQ ID NO: 202053 - DNA, 75 bp, Artificial Sequence
  Synthetic
tagagagcgtgttgaaggtgtcgtctgggttgctgttgatggtgctaaaactgaacctacaggttacggtgttag

SEQ ID NO: 202054 - DNA, 75 bp, Artificial Sequence
  Synthetic
gcgcaagaattcagaaccagagataccacacttcaatcaaaagctcccaaatggtgttactgttgttgaagaacc

SEQ ID NO: 202055 - DNA, 75 bp, Artificial Sequence
  Synthetic
tctggacttggcactgtggacgcagactacaaaaagtgcactaagggtctttccattgctgacttggcttgtgct

SEQ ID NO: 202056 - DNA, 75 bp, Artificial Sequence
  Synthetic
gtggtgaatccaaatctcaatctcggaatccttcaagtgacagaaaccataacagtcaggatgacatcatgaagg

SEQ ID NO: 202057 - DNA, 75 bp, Artificial Sequence
  Synthetic
gaatccttcaagtgacagaaaccataacagtcaggatgacatcatgaaggcagtcgctgcggctcttaaatcttt

SEQ ID NO: 202058 - DNA, 75 bp, Artificial Sequence
  Synthetic
aatggccatgtatacaggttctttaattggtggaattgctttaggaggtctaacatcagccgtttcaataccatt

SEQ ID NO: 202059 - DNA, 75 bp, Artificial Sequence
  Synthetic
gttgaagaacctgactcccgtgctccttcccgttctcagtcaaggtctcagagtcgcggtcgtggtgaatccaaa

SEQ ID NO: 202060 - DNA, 75 bp, Artificial Sequence
  Synthetic
aggttttgacaagcctcaggaaaaagacaaaaagtcagcgaaaacgggtactcctaagccttctcgtaatcagag

SEQ ID NO: 202061 - DNA, 75 bp, Artificial Sequence
  Synthetic
gacaaaaagtcagcgaaaacgggtactcctaagccttctcgtaatcagagtcctgcttcttctcaatctgctgcc

SEQ ID NO: 202062 - DNA, 75 bp, Artificial Sequence
  Synthetic
accaacatagtagatgcctttactggtgttaatgatgctattacacaaacttcacaagccctacaaacagttgct

SEQ ID NO: 202063 - DNA, 75 bp, Artificial Sequence
  Synthetic
aagattcttgctcgttctcagagttctgaaacaaaagaacaaaagcatgaaatgcaaaagccacggtggaaaaga

SEQ ID NO: 202064 - DNA, 75 bp, Artificial Sequence
  Synthetic
cagcctaacgatgatgtgacatctaatgtcacacaatgttttggccccagagaccttgaccacaactttggaagt

SEQ ID NO: 202065 - DNA, 75 bp, Artificial Sequence
  Synthetic
cagaattttcaagctatctctagctctattcaggctatctatgacagacttgacactattcaggctgatcaacaa

SEQ ID NO: 202066 - DNA, 75 bp, Artificial Sequence
  Synthetic
gcaggtgttgtggccaatggtgttaaagctaaaggctatccacaatttgctgagcttgtgccgtctacagctgct

SEQ ID NO: 202067 - DNA, 75 bp, Artificial Sequence
  Synthetic
aagctaaaggctatccacaatttgctgagcttgtgccgtctacagctgctatgctttttgatagtcacattgttt

SEQ ID NO: 202068 - DNA, 75 bp, Artificial Sequence
  Synthetic
gtaagtttcttgaggaattaaatgcattcactagagaaatgcaacaacagcctcttcttaaccctagtgcactag

SEQ ID NO: 202069 - DNA, 75 bp, Artificial Sequence
  Synthetic
atcccagtctaagcgttatggcttctgtggaaatggcactcacattttctcaattgttaatgctgctcctgaggg

SEQ ID NO: 202070 - DNA, 75 bp, Artificial Sequence
  Synthetic
aattcaacccatcccaaacttcacctgcaactgttgaaccagtgcgtgatgaagtttctattgaaactgacataa

SEQ ID NO: 202071 - DNA, 75 bp, Artificial Sequence
  Synthetic
tgcaactgttgaaccagtgcgtgatgaagtttctattgaaactgacataattgatgaagtaaactaaacatgcca

SEQ ID NO: 202072 - DNA, 75 bp, Artificial Sequence
  Synthetic
aagcgtggtctgggttgtgcgttgatggtacaaacggttatgtgttgcgacaacctaatcttgctctttacaaag

SEQ ID NO: 202073 - DNA, 75 bp, Artificial Sequence
  Synthetic
gaagtttctattgaaactgacataattgatgaagtaaactaaacatgccactgtgttgtttgaaattcaggcttt

SEQ ID NO: 202074 - DNA, 75 bp, Artificial Sequence
  Synthetic
aacactgtggtcttgactttcaccactagagtgactgtgcccaaagaccatccacacttgggtaagtttcttgag

SEQ ID NO: 202075 - DNA, 75 bp, Artificial Sequence
  Synthetic
agttggaattttgcttttgctcttgtttttattatctttcttttatgaatacatttctttcctctgatctacgta

SEQ ID NO: 202076 - DNA, 75 bp, Artificial Sequence
  Synthetic
tcgcataatgtttgaaccacgtattcctaccatggcagattttgttcaaattgaaaattgcaatgtcacatttgt

SEQ ID NO: 202077 - DNA, 75 bp, Artificial Sequence
  Synthetic
tgatggtacgatcagagctgcttttaattaacatgatcccttgctttggcttgacaaggatctagtcttatacac

SEQ ID NO: 202078 - DNA, 75 bp, Artificial Sequence
  Synthetic
aattaacatgatcccttgctttggcttgacaaggatctagtcttatacacaatggtaagcctgtggtagtaaagg

SEQ ID NO: 202079 - DNA, 75 bp, Artificial Sequence
  Synthetic
aggctttagttggaattttgcttttgctcttgtttttattacctttcttttatgaatacatttctttcctctgat

SEQ ID NO: 202080 - DNA, 75 bp, Artificial Sequence
  Synthetic
tataagaaatttgctactatgttactgaacctaggtgaacgctagtataactcattacaaatgtgctggagtaat

SEQ ID NO: 202081 - DNA, 75 bp, Artificial Sequence
  Synthetic
agtaatcaaagatcgcattgacgagccaacaatggaagagccagtcatttgtcttgagacctatctagttagtaa

SEQ ID NO: 202082 - DNA, 75 bp, Artificial Sequence
  Synthetic
aaaaattgcaaactctgattgacaacataaatagcacattagtcgacttaaagtggctcaaccgggttgagactt

SEQ ID NO: 202083 - DNA, 75 bp, Artificial Sequence
  Synthetic
gacttaagtaccttatctatctacagatagaaaagttgctttttagactttgtgtctacttttctcaactaaacg

SEQ ID NO: 202084 - DNA, 75 bp, Artificial Sequence
  Synthetic
tggaagagccagtcatttgtcttgagacctatctagttagtaactgctaatggaacggtttcgatatggatacac

SEQ ID NO: 202085 - DNA, 75 bp, Artificial Sequence
  Synthetic
acttaagtgtcttatctatctatagatagaaaagtcgctttttagactttgtgtctactcttctcaactaaacga

SEQ ID NO: 202086 - DNA, 75 bp, Artificial Sequence
  Synthetic
aatttttgctacggccggcatctctgatgctggagtcgtggcgtaattgaaatttcatttgggttgcaacagttt

SEQ ID NO: 202087 - DNA, 75 bp, Artificial Sequence
  Synthetic
gtttgttcacattgcaacttgtgtctgctgttaatcaatcgcttagcaatgcgaaagttagtgctgaagtttcac

SEQ ID NO: 202088 - DNA, 75 bp, Artificial Sequence
  Synthetic
ggaaataagtgctgtgcgtcctagtctaagggttctgtgttctgtcacgggattccattctataaacgccttact

SEQ ID NO: 202089 - DNA, 75 bp, Artificial Sequence
  Synthetic
ctaagggttctgtgttctgtcacgggattccattctataaacgccttactcgaggttctgtctcgtgtttgtgtg

SEQ ID NO: 202090 - DNA, 75 bp, Artificial Sequence
  Synthetic
aagatcacaccgtggcagagctgctcttatagtgtttaaaattctaatccttttcgtttatgtgccattgctgta

SEQ ID NO: 202091 - DNA, 75 bp, Artificial Sequence
  Synthetic
agtgatactgaaatttctgcaactggttgctctactattgcgctagccgtccgccgctatagcgaggccgctagc

SEQ ID NO: 202092 - DNA, 75 bp, Artificial Sequence
  Synthetic
aatggatttagagcatgccgatttgtttcatttggcttgcatgattgcgttgttggcattgcaaacgacgactat

SEQ ID NO: 202093 - DNA, 75 bp, Artificial Sequence
  Synthetic
ctgctggctctacaagacatgggatttcattgtcttcaatgtaaccacactttgctatgcaaggtaagtgttggt

SEQ ID NO: 202094 - DNA, 75 bp, Artificial Sequence
  Synthetic
gtcatgggtttgcatggtaaccaaacgttgtcctgcaatataatgaaattttctgaccgtccctttatgcttcgt

SEQ ID NO: 202095 - DNA, 75 bp, Artificial Sequence
  Synthetic
ttctgaccgtccctttatgcttcgtggttggttggttttttccaattcaaattacctcttggaggagtttgatgt

SEQ ID NO: 202096 - DNA, 75 bp, Artificial Sequence
  Synthetic
attcgtttgtttttacggaggggatcaattcctttacataggcgacagaattgtttcttatttctcaactaacga

SEQ ID NO: 202097 - DNA, 75 bp, Artificial Sequence
  Synthetic
tgtcttcggtaagagaggtggtggtaatgtgacatacactgaccagtatctctgtggcgccgatggcaaacctgt

SEQ ID NO: 202098 - DNA, 75 bp, Artificial Sequence
  Synthetic
cataagtgatgatttatggcagtttgttgaccatttcggtgaaaacgaagaaattatcatcaatggtcatactta

SEQ ID NO: 202099 - DNA, 75 bp, Artificial Sequence
  Synthetic
cgtttgtgcttggcttactaagcgcaagcctttagattacaaacgtcagaacaaccttgccattgaagagattga

SEQ ID NO: 202100 - DNA, 75 bp, Artificial Sequence
  Synthetic
acaaccttgccattgaagagattgaatatgtgcgtggcgatgctttgcatacactacgcaatggttctgttcttg

SEQ ID NO: 202101 - DNA, 75 bp, Artificial Sequence
  Synthetic
aaatggctaaggaagtgaagacatctagtaaggttgtgttaagcgatgctcttgacaaactttacaaagtttttg

SEQ ID NO: 202102 - DNA, 75 bp, Artificial Sequence
  Synthetic
gttctcctgttatgacaaatggttctaacatcttagaggcctttattaaacctgtgttcattagtgcatttgttc

SEQ ID NO: 202103 - DNA, 75 bp, Artificial Sequence
  Synthetic
aatgtacttgtggcaacaagtcttggtctgtcggtgattggactggttttaaatccacctgctgtaatgtgctca

SEQ ID NO: 202104 - DNA, 75 bp, Artificial Sequence
  Synthetic
gtaagaaactgtgtgttgttcccggtaatgttaaacctggtgacgctgtggttactactcagcaagctggtgttg

SEQ ID NO: 202105 - DNA, 75 bp, Artificial Sequence
  Synthetic
gtgttaagtacttttgtggcatgactcttaagtttgttgcaaacattgaaggtgtctctgtttggcgagtaatcg

SEQ ID NO: 202106 - DNA, 75 bp, Artificial Sequence
  Synthetic
tgtcaatctttgacacctgggctaattgggattctaattgggcctttgttgcatttagcttttttatggccgtat

SEQ ID NO: 202107 - DNA, 75 bp, Artificial Sequence
  Synthetic
ctgttcagagtgtggatggatttgttgcttctgctacttttgtagaggaggaacatgctaacagaatggatacat

SEQ ID NO: 202108 - DNA, 75 bp, Artificial Sequence
  Synthetic
gaaagcaaaccatggtttgttcgcaaggctgaagacatttttggcccttgttggtccgctcttgtttctgcactt

SEQ ID NO: 202109 - DNA, 75 bp, Artificial Sequence
  Synthetic
tctgcttcaatgtacgcaatagcactactgatgagtgtcgtttggccatgttgggtgctgaaatgaccagtaatg

SEQ ID NO: 202110 - DNA, 75 bp, Artificial Sequence
  Synthetic
tcagaagacaagttgctgcaggtgtcatagacattagtaccggttggttcgatgtttatgatgacatctttgctg

SEQ ID NO: 202111 - DNA, 75 bp, Artificial Sequence
  Synthetic
aaaacaaaccatggtttgttcgcaaggctgaagacatttttggcccgtgttggtctgctcttgtttctgtgctta

SEQ ID NO: 202112 - DNA, 75 bp, Artificial Sequence
  Synthetic
aacagcttaaagtcactacaggtgaacttatgaggtttgttaagtctatttgcagttcagctgttgctgttgtga

SEQ ID NO: 202113 - DNA, 75 bp, Artificial Sequence
  Synthetic
ttgcttgataatgcgcttgtaaaacttgtcaccacaaagcttaagggtgttcgtgaaggtggccttaataaagtt

SEQ ID NO: 202114 - DNA, 75 bp, Artificial Sequence
  Synthetic
gtggtactatacaaattgttgctagtgtgcctgatatgtttctgcctgcttttgacgtgtttgtcaaagctgtgc

SEQ ID NO: 202115 - DNA, 75 bp, Artificial Sequence
  Synthetic
aaactgtttttgactgtgctgttgagaccagtactattgcaggtaaatcatttgacaaggtttttgactatgttt

SEQ ID NO: 202116 - DNA, 75 bp, Artificial Sequence
  Synthetic
tgcttgacaatgcacttgtaaaacttgtcaccataaagcttaagggcgttcgcgcaagtggccttaaaacagtta

SEQ ID NO: 202117 - DNA, 75 bp, Artificial Sequence
  Synthetic
gttgaacgtagcactgctgtacttacaatcgccaataactaccccaaactttcagatgaggggtatactgccgta

SEQ ID NO: 202118 - DNA, 75 bp, Artificial Sequence
  Synthetic
ggatttgtcacccaagctgcatttttattatcttggcacaggaccccataaagatgcaaaatttagagagcgtgt

SEQ ID NO: 202119 - DNA, 75 bp, Artificial Sequence
  Synthetic
gtgatggctacttccgtcttatggccagtccaaatagtgtgttgactactgcagtctataaaccattgtttgctt

SEQ ID NO: 202120 - DNA, 75 bp, Artificial Sequence
  Synthetic
gcagtctataaaccattgtttgcttttaacgtgaatgttatgggtactagacctgaaaaatttccaaccattgtg

SEQ ID NO: 202121 - DNA, 75 bp, Artificial Sequence
  Synthetic
ttgttgaagaacctgactcccgtgctccttcccggtctcagtcgaggtcgcagagtcgcggtcgtggtgaatcca

SEQ ID NO: 202122 - DNA, 75 bp, Artificial Sequence
  Synthetic
acttgtgaaaatttagagtctgccgttttatttgttaatgacaaaatcactgaatttcaattggattgcagtgtt

SEQ ID NO: 202123 - DNA, 75 bp, Artificial Sequence
  Synthetic
tgaatttcaattggattgcagtgttgatgttattgacaatgaaataattgtcaaacctaacatcagcctgtgtgt

SEQ ID NO: 202124 - DNA, 75 bp, Artificial Sequence
  Synthetic
tccactttatgtgagagactatgttgacaaatgggatgatttttgcagacaatatagtaacgagtcttggtttga

SEQ ID NO: 202125 - DNA, 75 bp, Artificial Sequence
  Synthetic
gcgaaaacgggtactcctaagccttctcgtaatcagagtcctgcttcttctcaaacttctgccaagagtcttgct

SEQ ID NO: 202126 - DNA, 75 bp, Artificial Sequence
  Synthetic
agatgattatagggcttttattagcgttttggatgttgctgacgctgatgttaaagctgcagagtctaaggcttt

SEQ ID NO: 202127 - DNA, 75 bp, Artificial Sequence
  Synthetic
tattgataccattattccatcttgtccttctattttgaaaataatagacggtggcaagatatggagtggaatcat

SEQ ID NO: 202128 - DNA, 75 bp, Artificial Sequence
  Synthetic
taaggctgttagctctgttgcagactggcttaaatctttgaaattaactcttacaccagagggtctgtttggtac

SEQ ID NO: 202129 - DNA, 75 bp, Artificial Sequence
  Synthetic
ttgtgctaagcgttttaaacggtttttaaccgttcttttagacgcttacaatgcatttttagacactgtggtttc

SEQ ID NO: 202130 - DNA, 75 bp, Artificial Sequence
  Synthetic
atccacaatttgctgagcttgtgccgtcaacagctgctatgctgtttgatagtcacattgtttccaaagagtcag

SEQ ID NO: 202131 - DNA, 75 bp, Artificial Sequence
  Synthetic
tattgttaagattggtggtaaagcttttaaaaagtatgcatttgacaaaccttatattgtggtatgtgatatcgt

SEQ ID NO: 202132 - DNA, 75 bp, Artificial Sequence
  Synthetic
gtgtaaggttgagcataaaacagatgctgactgggttgagcttatgccacgtaatgacagaattaagtcttttag

SEQ ID NO: 202133 - DNA, 75 bp, Artificial Sequence
  Synthetic
aggagttaaatgcattcactagagaaatgcaacaacatcctcttcttaaccctagtgcactagaattcaacccat

SEQ ID NO: 202134 - DNA, 75 bp, Artificial Sequence
  Synthetic
aatgcaacaacatcctcttcttaaccctagtgcactagaattcaacccatctcaaacttcacctgcaactgctga

SEQ ID NO: 202135 - DNA, 75 bp, Artificial Sequence
  Synthetic
tacttttgaaaatgcatacttacctattgctgacccaacacattttgatattgaagaagttgaacttcttgatac

SEQ ID NO: 202136 - DNA, 75 bp, Artificial Sequence
  Synthetic
ggaatttgttgaaccaggttgtggtggtattttggcattgatagatgatcatgtcttttataaaaaggatgacat

SEQ ID NO: 202137 - DNA, 75 bp, Artificial Sequence
  Synthetic
aaattcaggctttagttggaattttgcttttgttctttcttttattatctttcttttgcctgtttttagagagat

SEQ ID NO: 202138 - DNA, 75 bp, Artificial Sequence
  Synthetic
ttattatccatcaaatggtactaaaatattacccgttgcatttactaaagccgccggtggtaaagtttctttctc

SEQ ID NO: 202139 - DNA, 75 bp, Artificial Sequence
  Synthetic
ttggcgccttggtgccgtagatgaatacattgcttttctctgatctatgtatgatggtacgatcagagctgcttt

SEQ ID NO: 202140 - DNA, 75 bp, Artificial Sequence
  Synthetic
tgacgcagtagaagttaaagatattccacctgtctatagagttaaactttgctttgagtttgaggatgaaaaact

SEQ ID NO: 202141 - DNA, 75 bp, Artificial Sequence
  Synthetic
tgtggatgtgtgtgaaaaggcaattggcgagaaaattaaacatgagggtgactgggatagtttttgtaaaactat

SEQ ID NO: 202142 - DNA, 75 bp, Artificial Sequence
  Synthetic
tcaatcagcactttctgttgtttcaagttatgtaaacctacctacatattacatctacgatgagcaaggcggcac

SEQ ID NO: 202143 - DNA, 75 bp, Artificial Sequence
  Synthetic
gagtccttttgaaatgccatttgaagagttaaatggtttaaagatacttaaacaattggataacaactgctgggt

SEQ ID NO: 202144 - DNA, 75 bp, Artificial Sequence
  Synthetic
tgatttgagtttgcctgttatgatttctgaatggcctctttccgaatcggacaaggaagaggaggttcaacaaga

SEQ ID NO: 202145 - DNA, 75 bp, Artificial Sequence
  Synthetic
taactgctaatggaacggtttcgatatggatacacaaaaaaaaaaaaaaaaaaaaaaaaaaaaaaaaaaaaaaaa

SEQ ID NO: 202146 - DNA, 75 bp, Artificial Sequence
  Synthetic
gcaacaagaagacactgtggtgcctgaagttgaagtcgttgttgaccaagttgaagaagttaatagtagttttgc

SEQ ID NO: 202147 - DNA, 75 bp, Artificial Sequence
  Synthetic
tattgaggcagtggatgttaaacatgaggtgagtccttttgaaatgccatttgaagagttaaatggtttaaaaat

SEQ ID NO: 202148 - DNA, 75 bp, Artificial Sequence
  Synthetic
actcaaacaaatggataataactgctgggttaactcagttatgttacagctacaattaacaggcatactcgacga

SEQ ID NO: 202149 - DNA, 75 bp, Artificial Sequence
  Synthetic
tataatgcgtttttagacactgttgtttctactgttaaaattggtggtttgacctttaaaacatatgcttttgat

SEQ ID NO: 202150 - DNA, 75 bp, Artificial Sequence
  Synthetic
tgactatgctatgcagttctttaaaatgggcagagtttccaagatggttgaacgctgttacaatgctgagcaatg

SEQ ID NO: 202151 - DNA, 75 bp, Artificial Sequence
  Synthetic
tatacgcggtgccatgggtgatgtaggcctttgtttgtatagactgcttaaagatttgcacactggttttatggt

SEQ ID NO: 202152 - DNA, 75 bp, Artificial Sequence
  Synthetic
tatggactacaaatgtagttgtaccagtggtagacttgaagaatcgggttccgtcttgttttgtacacctactaa

SEQ ID NO: 202153 - DNA, 75 bp, Artificial Sequence
  Synthetic
gaaggcgtttccctatggtacttgtctaaattgtaatgcacctcgtatgtgtacaattaggcagttgcaaggtac

SEQ ID NO: 202154 - DNA, 75 bp, Artificial Sequence
  Synthetic
tataatatttgtgcaacaaaacccagaacctgttaatccttgtgcttttgtcgttaaaccagtttgtgcatcagt

SEQ ID NO: 202155 - DNA, 75 bp, Artificial Sequence
  Synthetic
tttccgtggtgctgtgtctagtggccattaccaaataaacatctacccacaaaagttatgtgtggatggttttgg

SEQ ID NO: 202156 - DNA, 75 bp, Artificial Sequence
  Synthetic
tgttaacaagatccagccatggccaaatgatgcacttaacactatttgtattagagatgcaaattatagcgcaaa

SEQ ID NO: 202157 - DNA, 75 bp, Artificial Sequence
  Synthetic
agttgaaaaacctgtaacaccaggtaaaccaccagctgaactagcacctatagatgagactgttgtcaaggttaa

SEQ ID NO: 202158 - DNA, 75 bp, Artificial Sequence
  Synthetic
agaacacattggattagcgggtaaagtaagagttggtacaggagttatggttgagtgtgatagccttagaatttt

SEQ ID NO: 202159 - DNA, 75 bp, Artificial Sequence
  Synthetic
gttgaactctttccttacttgcaacaatgtttctttttatcaaggtgacattgatgctgttgttaatggtgttga

SEQ ID NO: 202160 - DNA, 75 bp, Artificial Sequence
  Synthetic
ttgatgctgttgttaatggtgttgactttgacttcatcgtgaatgttgccaatgaaaaccttgctcatggtggag

SEQ ID NO: 202161 - DNA, 75 bp, Artificial Sequence
  Synthetic
tctaaagaacacattggattagcaggtaaagtaaaggttggcgcaggtgttatggttgagtgtgatggcctgaga

SEQ ID NO: 202162 - DNA, 75 bp, Artificial Sequence
  Synthetic
gtaaagtaaaggttggcgcaggtgttatggttgagtgtgatggcctgagaatttttaatgttgttggtccacgca

SEQ ID NO: 202163 - DNA, 75 bp, Artificial Sequence
  Synthetic
agggtaaacatgaacgtgatttactcataaaagcttacaacactattaataatgaacaaggcatacctttaacac

SEQ ID NO: 202164 - DNA, 75 bp, Artificial Sequence
  Synthetic
caatcctgagctgtggtatttttggtgtcaaacttgaaacttcattagaagttttgcttgctgtttgtaatacaa

SEQ ID NO: 202165 - DNA, 75 bp, Artificial Sequence
  Synthetic
tgtcaaacttgaaacttcattagaagttttgcttgctgtttgtaatacaaaggaagtcaaagtttttgtttacac

SEQ ID NO: 202166 - DNA, 75 bp, Artificial Sequence
  Synthetic
agacacagaggtttgtaaggttaaggattttgtgtctggtttagtgaaagttcaaaaagttgagcaacctaaaat

SEQ ID NO: 202167 - DNA, 75 bp, Artificial Sequence
  Synthetic
agaaccaaaatcagtgtccgtaactaaagtcgcacccaagccttataaggtagatggtaaatttagttactttac

SEQ ID NO: 202168 - DNA, 75 bp, Artificial Sequence
  Synthetic
agacgacttgttgtgtgtcgctgttggcaaacctattgttctgtttactgattctatgcttactttggatgaccg

SEQ ID NO: 202169 - DNA, 75 bp, Artificial Sequence
  Synthetic
tggtttagctttagacaatgcacttaatggtgtgcttagtgctgctattaaggattgtatagacacaaataaagc

SEQ ID NO: 202170 - DNA, 75 bp, Artificial Sequence
  Synthetic
tataccttctggtaatcttattaagtttgacatagagtctgttgttgtctacatgtgcgttgtgccatcggacca

SEQ ID NO: 202171 - DNA, 75 bp, Artificial Sequence
  Synthetic
ggacaaacacttggataagaatgttcaacggtgtacacgtaagctgaatagacttatgtgtgatatagtttgtac

SEQ ID NO: 202172 - DNA, 75 bp, Artificial Sequence
  Synthetic
tataccagctgagcatgtcttgccattattgttgtctagtttgacttgtaatgtttcttttgtaggtgaacttaa

SEQ ID NO: 202173 - DNA, 75 bp, Artificial Sequence
  Synthetic
ttattgttgtctagtttgacttgtaatgtttcttttgtaggtgaacttaaagctgttgaatctaaagttataact

SEQ ID NO: 202174 - DNA, 75 bp, Artificial Sequence
  Synthetic
ataaaggtgacagaggatggtgttaatgttcatgatgtgactgtgacaacagacaagtcatttgaacaacaagtt

SEQ ID NO: 202175 - DNA, 75 bp, Artificial Sequence
  Synthetic
ggtgttattgctgttaaagacaaagatctttctggttcagtaccaagcgatcttaatacatctgagttgcttact

SEQ ID NO: 202176 - DNA, 75 bp, Artificial Sequence
  Synthetic
aaggcaatagatgttgattgggttgaattttatggtttcggagacgctgttacttttgcaacagttgatcatagt

SEQ ID NO: 202177 - DNA, 75 bp, Artificial Sequence
  Synthetic
aattgcagaacaatgaaataatgccaggcaagatgaaggtcaaggccaccaaaggtgaaggtgatggaggcatta

SEQ ID NO: 202178 - DNA, 75 bp, Artificial Sequence
  Synthetic
gattttgcatatgatagtgctgttgttaatggtgtcagagttttgaaaaccagtgataataattgttgggtgaat

SEQ ID NO: 202179 - DNA, 75 bp, Artificial Sequence
  Synthetic
gctgtgtgtatttcactacagtatttgaaaccccactttatttcacaaggtcttgatgctgcatggaacaaattt

SEQ ID NO: 202180 - DNA, 75 bp, Artificial Sequence
  Synthetic
gttttaggcgatgttgaaacttttgtcgcatttgtttactatgtagcagggttagttaaaggtgctaagggtgat

SEQ ID NO: 202181 - DNA, 75 bp, Artificial Sequence
  Synthetic
gctgaagatattttgaataagttatctaagtatcttgctaatgaagcccaagttcaattagaacattatagttct

SEQ ID NO: 202182 - DNA, 75 bp, Artificial Sequence
  Synthetic
tgtgttgaatgtgaggctacatttaaaaaccctgttgcatctgttaattctgctatagtttgtgctagtgtcaaa

SEQ ID NO: 202183 - DNA, 75 bp, Artificial Sequence
  Synthetic
cgtgatggtgtgcaagttggttattgtgcccatggtattaagtactattcacgtgttagaagtgttagcggtaga

SEQ ID NO: 202184 - DNA, 75 bp, Artificial Sequence
  Synthetic
gctattatagtcagtgtcgaacagcttgaaccatgttctcagtctagacttttgagtggtgttgcttacactgct

SEQ ID NO: 202185 - DNA, 75 bp, Artificial Sequence
  Synthetic
ttgaaccatgttctcagtctagacttttgagtggtgttgcttacactgctttttctggacctgctgacaatggtc

SEQ ID NO: 202186 - DNA, 75 bp, Artificial Sequence
  Synthetic
gttatgttggttcactctccactaatcaccatgcaatttgtaatgttcatagaaatgagcacgttgcttctggtg

SEQ ID NO: 202187 - DNA, 75 bp, Artificial Sequence
  Synthetic
tgtctgtcacatcagttgttatggttggtggttatgttgcacctgttaaaacagtgaaacctaaaccagtcatta

SEQ ID NO: 202188 - DNA, 75 bp, Artificial Sequence
  Synthetic
atcaacttgatgagaaggcacagaagttctttgattttggtgactttttggttcataattttgttacttttttca

SEQ ID NO: 202189 - DNA, 75 bp, Artificial Sequence
  Synthetic
gttctttgattttggtgactttttggttcataattttgttacttttttcacatggttgttgagtatgtttacttt

SEQ ID NO: 202190 - DNA, 75 bp, Artificial Sequence
  Synthetic
acgtagtcttaaatataacttaaaagcgtcaacagctgttcttaaatctaagtggtggctgcttgctaagtttat

SEQ ID NO: 202191 - DNA, 75 bp, Artificial Sequence
  Synthetic
gtctttttggttatcaagagttaagtcaatttagccatttggatgttgtgtggaagcatataacagaccctttgt

SEQ ID NO: 202192 - DNA, 75 bp, Artificial Sequence
  Synthetic
gaaactactgttactcatttacacattgtattcagtagttttgcttggtgtactttttggaccgtttaatctttg

SEQ ID NO: 202193 - DNA, 75 bp, Artificial Sequence
  Synthetic
ttgtattcagtagttttgcttggtgtactttttggaccgtttaatctttgtagtgagactgttaatggttatgct

SEQ ID NO: 202194 - DNA, 75 bp, Artificial Sequence
  Synthetic
aagtcaaactttgtcaaggatgattattgtgatggttcattgggctgcaagatgtgtctttttggttaccaggag

SEQ ID NO: 202195 - DNA, 75 bp, Artificial Sequence
  Synthetic
ttaagtcaatttagccatttagatgttgtgtggaagcatataacagaccctttgtttagtaatatgcaacctttc

SEQ ID NO: 202196 - DNA, 75 bp, Artificial Sequence
  Synthetic
ttgtgtggaagcatataacagaccctttgtttagtaatatgcaacctttcattgtcatggttttgttgcttatat

SEQ ID NO: 202197 - DNA, 75 bp, Artificial Sequence
  Synthetic
gctagacttaagagattccctgttaacacaattgttaatggtgtgcaacgttcattttatgttaatgcaaatggt

SEQ ID NO: 202198 - DNA, 75 bp, Artificial Sequence
  Synthetic
ataagcacagttggtgtttttctaggctacaaggaaacaaattggtttttgcactttgttccatttgatgttatt

SEQ ID NO: 202199 - DNA, 75 bp, Artificial Sequence
  Synthetic
ttatggccgtatcaacactcgttatgtgggtgatgtacttcgcaaatagtttcagacttttccgacgtgctcgaa

SEQ ID NO: 202200 - DNA, 75 bp, Artificial Sequence
  Synthetic
atggtggtagtaagttttgtaagaaacatagatttttctgtgttgactgtgactcttatggttatggcaacacgt

SEQ ID NO: 202201 - DNA, 75 bp, Artificial Sequence
  Synthetic
ttataacacctgaagtttctagagaacttggtaatattaccaaaacaaatgtgcaaccaacaggcccagcttatg

SEQ ID NO: 202202 - DNA, 75 bp, Artificial Sequence
  Synthetic
tcatggttgacaaagtggagtttgaaaatggtttctatagattgtattccggtgaaacattttggcgttacaatt

SEQ ID NO: 202203 - DNA, 75 bp, Artificial Sequence
  Synthetic
aaatggtttctatagattgtattccggtgaaacattttggcgttacaattttgatataactgaaagcaagtattc

SEQ ID NO: 202204 - DNA, 75 bp, Artificial Sequence
  Synthetic
ttgcaaagaggttcttaaaaattgtaatgttttggatgatttcatcgtgtttaacaataatggaaccaatgtaac

SEQ ID NO: 202205 - DNA, 75 bp, Artificial Sequence
  Synthetic
acaggttaaaaatgctagtgtttatttttcacagttgttgtgcaggcctattaaattagttgacagtgaactttt

SEQ ID NO: 202206 - DNA, 75 bp, Artificial Sequence
  Synthetic
gtctactttgtcagttgattttaatggtgtcttacataaggcatacattgatgtgctacgtaatagttttggtaa

SEQ ID NO: 202207 - DNA, 75 bp, Artificial Sequence
  Synthetic
agatcttaatgctaatatgtctttagccgagtgtaagagtgctttaggcttgtctattagtgatcatgaatttac

SEQ ID NO: 202208 - DNA, 75 bp, Artificial Sequence
  Synthetic
gtaatgacttgagtttgcccgttatgatttctgaatggcctctttctgttcaacaagctcaacaagaagctactc

SEQ ID NO: 202209 - DNA, 75 bp, Artificial Sequence
  Synthetic
tagtgctatttccaacgcacatcgttgtgacgtgttgttgtctgatttgtcatttaacaactttgtcagttcgta

SEQ ID NO: 202210 - DNA, 75 bp, Artificial Sequence
  Synthetic
tgctaaacctgatgaaaaattatcagcttatgacttggcttgttgtatgcgtgcaggtgctaaggttgttaatgc

SEQ ID NO: 202211 - DNA, 75 bp, Artificial Sequence
  Synthetic
caacgttttgacaaaggatcaaactcctattgtttggcatgcaaaggattttaacagtctttctgctgaaggtcg

SEQ ID NO: 202212 - DNA, 75 bp, Artificial Sequence
  Synthetic
taagtatattgttaaaactagtaaagctaagggcttgactttcttgttgacaattaatgaaaaccaagctgttac

SEQ ID NO: 202213 - DNA, 75 bp, Artificial Sequence
  Synthetic
acaaatacctgcaactagcattgttgctaagcaaggtgctggtgatgctggccattcatcaacatggttgtggct

SEQ ID NO: 202214 - DNA, 75 bp, Artificial Sequence
  Synthetic
actttgtggtcttgtgtgtttgattcaattctatttgtgttttttcatgccctactttgataccgttcgtagttt

SEQ ID NO: 202215 - DNA, 75 bp, Artificial Sequence
  Synthetic
tgagggttatgattttaaatatatagaaaatggtcagttgaagaattttgaagctccacttaaatgtgtcagaaa

SEQ ID NO: 202216 - DNA, 75 bp, Artificial Sequence
  Synthetic
tgtttttgaaaattttgaggattggcattatgctaagtttggctttatacctttaaacaagcaaagctgtcctat

SEQ ID NO: 202217 - DNA, 75 bp, Artificial Sequence
  Synthetic
ctttaaacaagcaaagctgtcctattgtagttggagtttctgaaattgttaacactgttgctggtattccatcta

SEQ ID NO: 202218 - DNA, 75 bp, Artificial Sequence
  Synthetic
gtgcatttttacttctgcttgtactagattggaaggtttgggtggtaacaatgtttattgttataacacagatct

SEQ ID NO: 202219 - DNA, 75 bp, Artificial Sequence
  Synthetic
tatggaaggttcattgccttacagttcaatacaagctaacgcatattataaatatgacaatggtaattttattaa

SEQ ID NO: 202220 - DNA, 75 bp, Artificial Sequence
  Synthetic
gttgccagaagttattgcacaaggctttgggtttagaacagtgcgtactattgctaccaaatattgccgtgtagg

SEQ ID NO: 202221 - DNA, 75 bp, Artificial Sequence
  Synthetic
tgagtgtgttgactccaatgcaggtgtgtgttttggctttgacaagtggtttgttaatgatggacgtgttgacaa

SEQ ID NO: 202222 - DNA, 75 bp, Artificial Sequence
  Synthetic
caaagtttagacgcatgtttggtgacctttctgtaggtgtttgtactgttgttgttgctgttttgcttaacaatg

SEQ ID NO: 202223 - DNA, 75 bp, Artificial Sequence
  Synthetic
tggttatgtttgtggtactggtttgtggaaccttgtatttaacatattttccatgttttcatcttcattttctgt

SEQ ID NO: 202224 - DNA, 75 bp, Artificial Sequence
  Synthetic
agtaacaatgattgcttatgccatattgtatttctttgctactagaagcttacgctatgcatggatttggtgtgc

SEQ ID NO: 202225 - DNA, 75 bp, Artificial Sequence
  Synthetic
tgctgcaatgtcaggccaaattttacttaattgtgcattaggtgcttttgcaatcttttgttgttttctcgtgac

SEQ ID NO: 202226 - DNA, 75 bp, Artificial Sequence
  Synthetic
aaaatttagacgtatgtttggtgatctttctgtgggtgtttgcactgttgttatggctgttctgcttaacaatgt

SEQ ID NO: 202227 - DNA, 75 bp, Artificial Sequence
  Synthetic
ttcatacattgtaactcagaacttagtaacaatgattgcatatgctgtgttgtacttctttgctactagaagttt

SEQ ID NO: 202228 - DNA, 75 bp, Artificial Sequence
  Synthetic
gcgctacgcatggatttggtgtgctgcatatttaattgcatacatatcttttgccccatggtggctgtgtgcttg

SEQ ID NO: 202229 - DNA, 75 bp, Artificial Sequence
  Synthetic
ttgctaatagcatctctccagaaaagttgaaaagttatgctgctagctataatagatacaagtactatagtggta

SEQ ID NO: 202230 - DNA, 75 bp, Artificial Sequence
  Synthetic
gtactttcttgctatgttaacaggtcttttacctagtttgttgaagcttaaagtctcgacaaacctttttgaggg

SEQ ID NO: 202231 - DNA, 75 bp, Artificial Sequence
  Synthetic
tgacaaatttgtaggtacatttgaaagtgctgctgcaggaacatttgttattgacatgcgttcttatgaaaaact

SEQ ID NO: 202232 - DNA, 75 bp, Artificial Sequence
  Synthetic
tgctaatagcatctctccagaaaagttgaaaagttatgctgctagctataatagatacaagtattatagtggtaa

SEQ ID NO: 202233 - DNA, 75 bp, Artificial Sequence
  Synthetic
taaggattgtgttgacataaataaagctataccttctggtaatcttattaagtttgatatagattctgttgttgt

SEQ ID NO: 202234 - DNA, 75 bp, Artificial Sequence
  Synthetic
tgcaaatgaagcagattaccgttgtgcttgttatgcctatttagcgaaagcaatgttggacttttcgcgtgatca

SEQ ID NO: 202235 - DNA, 75 bp, Artificial Sequence
  Synthetic
caatgacattttgtacacacctccaactgtcagttatggttctacattacaggcaggtttgcgtaaaatggcaca

SEQ ID NO: 202236 - DNA, 75 bp, Artificial Sequence
  Synthetic
gccatctggcattgtggaaaaatgcgttgttcgcgtctgttatggcaacactgtgttaaatggtttatggcttgg

SEQ ID NO: 202237 - DNA, 75 bp, Artificial Sequence
  Synthetic
gagtaactcttaaaattaaggtttcacagactaacatgcacacacctagacactcttttagaacactaaaatctg

SEQ ID NO: 202238 - DNA, 75 bp, Artificial Sequence
  Synthetic
tgacattgtttattgtccacgtcatgttattgcatctaacacaactgctgctatagactatgatcatgagtatag

SEQ ID NO: 202239 - DNA, 75 bp, Artificial Sequence
  Synthetic
tattatgcgtttgcataatttttctataaattctggtacagcatttcttggtgttgtaggtgctaccatgcatgg

SEQ ID NO: 202240 - DNA, 75 bp, Artificial Sequence
  Synthetic
tttggtgtgaacatgagaactaattggactatccgtggttcatttattaatggtgcgtgtggttctcctggctac

SEQ ID NO: 202241 - DNA, 75 bp, Artificial Sequence
  Synthetic
agcaactcttaaaattaaagtttcacagactaacatgcacacacctagacattcttttaagacactaaaatctgg

SEQ ID NO: 202242 - DNA, 75 bp, Artificial Sequence
  Synthetic
cgaaggttttaacatcttagcttgctatgatggttgtgcccaaggtgttttcggtgtgaacatgaggaccaattg

SEQ ID NO: 202243 - DNA, 75 bp, Artificial Sequence
  Synthetic
gactatccgaggttcatttattaatggtgcatgtggttctcctggctataatcttaaaaatggcgaagtggaatt

SEQ ID NO: 202244 - DNA, 75 bp, Artificial Sequence
  Synthetic
ggtgcatgtggttctcctggctataatcttaaaaatggcgaagtggaatttgtttacatgcatcagattgaactc

SEQ ID NO: 202245 - DNA, 75 bp, Artificial Sequence
  Synthetic
ggaagtggtagccatgtaggttctagctttgatggtgttatgtatggtggttttgaagaccaacctaaccttcaa

SEQ ID NO: 202246 - DNA, 75 bp, Artificial Sequence
  Synthetic
gttgaatctgccaaccagatgctaacagttaatgtggtcgcatttctttatgctgctatattgaatggttgcaca

SEQ ID NO: 202247 - DNA, 75 bp, Artificial Sequence
  Synthetic
tggtggctcaaaggtgataaattgtctgtagaacattataatgagtgggcacaggctaatggttttacagccatg

SEQ ID NO: 202248 - DNA, 75 bp, Artificial Sequence
  Synthetic
aatggtgaagatgccttttccattcttgctgttaaaactggtgtctgtgttgaaagattactccatgctattcaa

SEQ ID NO: 202249 - DNA, 75 bp, Artificial Sequence
  Synthetic
gttttgaataatggctttggtggtaaaaacattttgggttattctagtcttaatgatgagttcaatattaatgaa

SEQ ID NO: 202250 - DNA, 75 bp, Artificial Sequence
  Synthetic
gttgtcaaacaaatgtttggtgttaacttacaaagtggcaagaccactagtatgtttaaatcactaagtttgttt

SEQ ID NO: 202251 - DNA, 75 bp, Artificial Sequence
  Synthetic
gctggtttctttattatgttctgggctgagttgtttgtttataccaccactgtttgggttaaccctggttttctc

SEQ ID NO: 202252 - DNA, 75 bp, Artificial Sequence
  Synthetic
actccgtttatgattttgcttgttgctttgtcactctgtcttacatcttttgttaaacataaggtgttgttcctt

SEQ ID NO: 202253 - DNA, 75 bp, Artificial Sequence
  Synthetic
caagtgtttttgttgccatcaattattgtggctgcaattcagaactgtgcttgggactaccatgtaacaaaggta

SEQ ID NO: 202254 - DNA, 75 bp, Artificial Sequence
  Synthetic
ttggcagagaagtttgactacaatgtttctgttatgcaaatggacatccagggttttgttaatatttttatttgt

SEQ ID NO: 202255 - DNA, 75 bp, Artificial Sequence
  Synthetic
ttgtttgttgcacttttgcatacttggcgctttgctaaagagcgttgtacgcattggtgcacttacttgttctca

SEQ ID NO: 202256 - DNA, 75 bp, Artificial Sequence
  Synthetic
tgtacgttttggaccgtttaagttttgtagtgagactgttaatggttatgctaagtcaaactttgtcaaggatga

SEQ ID NO: 202257 - DNA, 75 bp, Artificial Sequence
  Synthetic
ctctttgctgttttatacactgcactgtatagttatgattatgttagcttgctagttatgctactttgcgcaatt

SEQ ID NO: 202258 - DNA, 75 bp, Artificial Sequence
  Synthetic
tctaatgaatggtacataggtgctattatttttagaatttgtcgttgtgttgcatgtttgccagtggcatacgtg

SEQ ID NO: 202259 - DNA, 75 bp, Artificial Sequence
  Synthetic
tcatactttggtagtgttaaaactgtgttgttgttttatatgttgttaggctttgttagctgtatgtactatggt

SEQ ID NO: 202260 - DNA, 75 bp, Artificial Sequence
  Synthetic
aatgggtattggtggtcctagaaccattaaagtctctactgtacagtctaaattgactgatcttaagtgcacaaa

SEQ ID NO: 202261 - DNA, 75 bp, Artificial Sequence
  Synthetic
ttgttgtactggattaacagattctgtaaatgcacattaggtgtttatgacttttgtgttagtccagctgaattt

SEQ ID NO: 202262 - DNA, 75 bp, Artificial Sequence
  Synthetic
cgtcgttctaatgggcattttgtctaacatgaacatagcttctaattcaaaggagtgggcatattgtgttgaaat

SEQ ID NO: 202263 - DNA, 75 bp, Artificial Sequence
  Synthetic
aagtacatggttgctaatggtttgaatgcaccagatggcccttttgatgcgctatttctgtcgtttaaactaatg

SEQ ID NO: 202264 - DNA, 75 bp, Artificial Sequence
  Synthetic
ggtattggcggtcctagaactattaaagtttctactgtacaatctaaattgacagatcttaagtgcacaaacgtc

SEQ ID NO: 202265 - DNA, 75 bp, Artificial Sequence
  Synthetic
gttctaatgggcattttgtctaatatgaacatagcttctaactcaaaggagtgggcatattgtgttgaaacgcac

SEQ ID NO: 202266 - DNA, 75 bp, Artificial Sequence
  Synthetic
aataaaataaacttgtgtgataaccccgaaactgctcaggagctgttgctggcgttgttggcatttttcttgtct

SEQ ID NO: 202267 - DNA, 75 bp, Artificial Sequence
  Synthetic
aagcatagtgattttggtcttggcgatcttgtcgattcttattttgagaatgactccattttgcaaagtgttgca

SEQ ID NO: 202268 - DNA, 75 bp, Artificial Sequence
  Synthetic
ggttcttcaccacaaataatcaaacaattgaaaaaggctatgaatgttgcaaaagctgagtttgacagggaatca

SEQ ID NO: 202269 - DNA, 75 bp, Artificial Sequence
  Synthetic
tctgttcaaaggaaaattaatagaatggctgaacaagctgctgcagctatgtataaagaagcacgtgcagtcaat

SEQ ID NO: 202270 - DNA, 75 bp, Artificial Sequence
  Synthetic
agaaaatcaaaggttgttagtgccatgcatagtttactctttggcatgctccgacgattggacatgtctagtgtt

SEQ ID NO: 202271 - DNA, 75 bp, Artificial Sequence
  Synthetic
gatactattcttaatatggcacgtaatggtgttgttcctctttctgttatccctgccacttcggcatccaagctc

SEQ ID NO: 202272 - DNA, 75 bp, Artificial Sequence
  Synthetic
ttaaagatgttacaaaggaaaaccaggaaacacttgtttggcctctgattttgacttgtgaacgtgtcgttaaat

SEQ ID NO: 202273 - DNA, 75 bp, Artificial Sequence
  Synthetic
gtcgtcgtggtgccagatcatgattcatttgcgagaatgatggtagatggttttgtgcactacgctggcgttgtt

SEQ ID NO: 202274 - DNA, 75 bp, Artificial Sequence
  Synthetic
ttttgtgcactacgctggcgttgtttggacattacaagaagttaaggataatgatggtaagaatgtgcatcttaa

SEQ ID NO: 202275 - DNA, 75 bp, Artificial Sequence
  Synthetic
caagatgaaggtcaaggccaccaaaggtgaaggtgatggaggcattattagtgaaggtaatgctctatacaacaa

SEQ ID NO: 202276 - DNA, 75 bp, Artificial Sequence
  Synthetic
gtgaaggtaatgctctatacaacaatgaaggtggacgtgcatttatgtatgcatatgtgactacgaagcctggca

SEQ ID NO: 202277 - DNA, 75 bp, Artificial Sequence
  Synthetic
agatgttacaaaggaaaaccaggaaacacttgtttggcctctgattttgacttgtgaacgcgtcgttaaattgca

SEQ ID NO: 202278 - DNA, 75 bp, Artificial Sequence
  Synthetic
gaacaatgaaataatgccgggcaagatgaaggttaaagccaccaaagctgaaggtgatggaggcattactagtga

SEQ ID NO: 202279 - DNA, 75 bp, Artificial Sequence
  Synthetic
gtatgttaaatgggagcatgactctggtgtggttacagttgaattggaaccaccttgcagatttgttgtagacac

SEQ ID NO: 202280 - DNA, 75 bp, Artificial Sequence
  Synthetic
acctactggacctcaaattaagtatctttactttgttaagaatcttaacactttaaggaggggtgctgttttggg

SEQ ID NO: 202281 - DNA, 75 bp, Artificial Sequence
  Synthetic
ttacataggcgctactgtgagattgcaagctggtaaacagactgagtttgtttcaaattcccatttattaacgca

SEQ ID NO: 202282 - DNA, 75 bp, Artificial Sequence
  Synthetic
tttcaaattcccatttattaacgcattgttcattcgctgttgacccagctgcagcttatcttgatgctgttaaac

SEQ ID NO: 202283 - DNA, 75 bp, Artificial Sequence
  Synthetic
gcacatccaaccatggacggtttttgtcagtacaaaggtaagtgggtacaagtgcctataggtacaaatgaccct

SEQ ID NO: 202284 - DNA, 75 bp, Artificial Sequence
  Synthetic
aaggcgcaaaacctgttggcaactgtgtaaagatgttgactaatggttctggtagtggtcaggctattactagta

SEQ ID NO: 202285 - DNA, 75 bp, Artificial Sequence
  Synthetic
ctattgactctaatactacacaggatacatatggtggcgcttctgtttgtatttattgcagagcacatgttgcac

SEQ ID NO: 202286 - DNA, 75 bp, Artificial Sequence
  Synthetic
atccaaccatggacggtttttgtcagtataaaggcaagtgggtacaagtgcctataggtacaaatgaccctataa

SEQ ID NO: 202287 - DNA, 75 bp, Artificial Sequence
  Synthetic
ctattcaaagttttgataacagttatttaaacgagtcaggggctctagtgccgctcgactagagccctgcaatgg

SEQ ID NO: 202288 - DNA, 75 bp, Artificial Sequence
  Synthetic
tacagacatagattattgtgtccgtgcatttgacgtttacaataaagatgcttcttttatcggcaaaaacttgaa

SEQ ID NO: 202289 - DNA, 75 bp, Artificial Sequence
  Synthetic
cttcttttatcggcaaaaacttgaagtccaattgtgtgcgcttcaagaacgcagataaggatgatgcgttttata

SEQ ID NO: 202290 - DNA, 75 bp, Artificial Sequence
  Synthetic
actaaatacaccatgatggatttgtgcttcgctctgcgtaactttgatgaaagagattgtggagtttttaaggag

SEQ ID NO: 202291 - DNA, 75 bp, Artificial Sequence
  Synthetic
ttgctaagcatgattttttcacttggcatgaaggcagaaccatctatggtaacgttagtagacaggatcttacta

SEQ ID NO: 202292 - DNA, 75 bp, Artificial Sequence
  Synthetic
aatacaccatgatggacttgtgctttgctctgcgtaactttgatgaaaaagactgtgaagttcttaaggagatac

SEQ ID NO: 202293 - DNA, 75 bp, Artificial Sequence
  Synthetic
tggttcttactggttgttgtggtactgattacttcgaaatgaagaattggtttgacccagtagaaaatgaggaca

SEQ ID NO: 202294 - DNA, 75 bp, Artificial Sequence
  Synthetic
tacaccgtgtgtatgctgctttgggtacagtagtcgcaaatgcaatgcttaagtgtgttgctctttgcgacgaaa

SEQ ID NO: 202295 - DNA, 75 bp, Artificial Sequence
  Synthetic
tggtgcttagaggagttgttggtgttttgaccttagacaaccaagatcttaatgggaatttctacgattttgggg

SEQ ID NO: 202296 - DNA, 75 bp, Artificial Sequence
  Synthetic
actttgttttgtgtcctcctggtatgggaataccctattgcacatcatattactcttatatgatgcctgttatgg

SEQ ID NO: 202297 - DNA, 75 bp, Artificial Sequence
  Synthetic
gtatgaccaattgtctagctagtgagtgttttatgaaaagtgacatctttggtcaagacttcaaaacttatgatt

SEQ ID NO: 202298 - DNA, 75 bp, Artificial Sequence
  Synthetic
tgttgaaatatgatttcacagagcataaggaggttttgttcaacaagtattttaagtattggggacagggttacc

SEQ ID NO: 202299 - DNA, 75 bp, Artificial Sequence
  Synthetic
atcctgattgtgtagattgttatgatgagatgtgtattttgcattgttcaaattttaacacactcttcgcaacca

SEQ ID NO: 202300 - DNA, 75 bp, Artificial Sequence
  Synthetic
caattccaaatacagcttttggacccctatgcagaaaagtgtttattgatggtgtacctgttgttgctactgctg

SEQ ID NO: 202301 - DNA, 75 bp, Artificial Sequence
  Synthetic
gttaccattttaaacaactaggacttgtgtggaataaagatgttaacactcactctactagacttactattactg

SEQ ID NO: 202302 - DNA, 75 bp, Artificial Sequence
  Synthetic
aacttttacagttcgtgacagatcctgcgcttatagttgcgtcatcgccagctttagtggataaacgcactgtat

SEQ ID NO: 202303 - DNA, 75 bp, Artificial Sequence
  Synthetic
gcttttctgtcgcagctctgagtacagggttgacatctcaaacagtaaaacctggccattttaataaggagtttt

SEQ ID NO: 202304 - DNA, 75 bp, Artificial Sequence
  Synthetic
atgacttcttacgctctcaagggtttttcgatgaaggttcagaattgacattgaagcacttcttttttacacaaa

SEQ ID NO: 202305 - DNA, 75 bp, Artificial Sequence
  Synthetic
agggtgatgctgcaattaaagattttgactattatcggtataacagacccaccatgctagatattggacaagcac

SEQ ID NO: 202306 - DNA, 75 bp, Artificial Sequence
  Synthetic
gtgtggcatatcaagtagcatctcgttactttgactgctatgaaggtggttgtattacatctagagaggtggttg

SEQ ID NO: 202307 - DNA, 75 bp, Artificial Sequence
  Synthetic
ttactaaccttaataagagtgctggttggccacttaataagtttggtaaagctggtttatattatgagtctatta

SEQ ID NO: 202308 - DNA, 75 bp, Artificial Sequence
  Synthetic
gttatgaagaacaagacgctatgtttgcgttaacaaagcgtaatattctccctactatgactcagttaaatctca

SEQ ID NO: 202309 - DNA, 75 bp, Artificial Sequence
  Synthetic
aatacgccatatctggtaaggagcgtgcacgtacagttggtggtgtctctttgttagctactatgactactagac

SEQ ID NO: 202310 - DNA, 75 bp, Artificial Sequence
  Synthetic
agtttcatcagaaatgtttgaaatctatagttgctactagaaatgccaccgttgttatcggcactaccaaattct

SEQ ID NO: 202311 - DNA, 75 bp, Artificial Sequence
  Synthetic
atggcggttgggacaatatgctaaagaacttgattgctgacgttgacgatcctaagttgatgggctgggactatc

SEQ ID NO: 202312 - DNA, 75 bp, Artificial Sequence
  Synthetic
ctaagtgtgatagagcgatgccttcaatgattcgtatgctgtcggccatgattttaggttctaaacatgttacat

SEQ ID NO: 202313 - DNA, 75 bp, Artificial Sequence
  Synthetic
gttgtacggctagtgacaaattctatagacttagtaatgagcttgctcaagttttaaccgaagttgtttactcaa

SEQ ID NO: 202314 - DNA, 75 bp, Artificial Sequence
  Synthetic
atggtgggttttattttaaacctggtggtacaacttctggtgatgcaactactgcttatgccaactctgttttta

SEQ ID NO: 202315 - DNA, 75 bp, Artificial Sequence
  Synthetic
gacttttatggttatttgcaaaagcatttttctatgatgattctttctgatgatggtgttgtgtgctataataaa

SEQ ID NO: 202316 - DNA, 75 bp, Artificial Sequence
  Synthetic
atatatttcaggctgtaagttctaacattaatcgcattttgagcgttaattcgtcaaattgcaacaaccttaatg

SEQ ID NO: 202317 - DNA, 75 bp, Artificial Sequence
  Synthetic
ttaagaaattacagaaacaactttatgacaattgctatagaaatagtaatgtcgatgagtcttttgtggatgact

SEQ ID NO: 202318 - DNA, 75 bp, Artificial Sequence
  Synthetic
gtcgatgagtcttttgtggatgacttctacggttatttacaaaagcacttttctatgatgattctttctgatgat

SEQ ID NO: 202319 - DNA, 75 bp, Artificial Sequence
  Synthetic
ggtgttgtgtgctataataaaatttatgctgaacttggttacattgctgatattagtgcttttaaagccacttta

SEQ ID NO: 202320 - DNA, 75 bp, Artificial Sequence
  Synthetic
tattatcagaatggtgtattcatgagcacagctaaatgttggactgaggaagacctttctgtaggacctcatgaa

SEQ ID NO: 202321 - DNA, 75 bp, Artificial Sequence
  Synthetic
ttctctggctatagatgcatacccattgtctaagcatcctaaacctgagtacaggaaggtgttttacgcattgtt

SEQ ID NO: 202322 - DNA, 75 bp, Artificial Sequence
  Synthetic
attatttctgctggtgtttttgtggatgacattaccaagactgatgctgtcattcttttagaacgctatgtttct

SEQ ID NO: 202323 - DNA, 75 bp, Artificial Sequence
  Synthetic
ctttttctgttacacttttagatgaacaggagtctaagttttgggatgaaagcttttatgctagtatgtatgaga

SEQ ID NO: 202324 - DNA, 75 bp, Artificial Sequence
  Synthetic
ctggctatagatgcatacccattgtctaaacatcctaaacccgagtataggaaagtgttttatgcactgttagac

SEQ ID NO: 202325 - DNA, 75 bp, Artificial Sequence
  Synthetic
tgggttaaatatctcaataaaactcttaatgaaggtgttttggagtcattctctgtcacacttttagatgaacag

SEQ ID NO: 202326 - DNA, 75 bp, Artificial Sequence
  Synthetic
ctctgtcacacttttagatgaacaggagtccaagttttgggatgaaagcttttatgctagcatgtatgagaagtc

SEQ ID NO: 202327 - DNA, 75 bp, Artificial Sequence
  Synthetic
caaaccgatgttgtgcactaagtgtgcttatgatcatgtgtttggcactgatcataagttcattttggctattac

SEQ ID NO: 202328 - DNA, 75 bp, Artificial Sequence
  Synthetic
accttatgtttgtaacacatctggttgcaatgtaaacgacgttacaaaactgtatcttggaggtttgaattatta

SEQ ID NO: 202329 - DNA, 75 bp, Artificial Sequence
  Synthetic
ctgtgtagatcacaaaccacatttgtcattcccactgtgttcagctggtaatgtctttggtttgtacaaaagttc

SEQ ID NO: 202330 - DNA, 75 bp, Artificial Sequence
  Synthetic
cctaaaggagattgtaggtcctaaggaacttttgctcttatgggaaagtggaaaagccaaaccaccgttaaaccg

SEQ ID NO: 202331 - DNA, 75 bp, Artificial Sequence
  Synthetic
tgctttgggttccatagacgttgatgtttttaataagctttctacttctgattggtctgacattcgtgactataa

SEQ ID NO: 202332 - DNA, 75 bp, Artificial Sequence
  Synthetic
gttagctaatgaagctaaagagtcactaaggctatttgcagctgaaactgtcaaagctaaggaggaaagtgttaa

SEQ ID NO: 202333 - DNA, 75 bp, Artificial Sequence
  Synthetic
ctaaggctatttgcagctgaaactgtcaaagctaaggaggaaagtgttaagtcatcatatgcttatgccacccta

SEQ ID NO: 202334 - DNA, 75 bp, Artificial Sequence
  Synthetic
aaggagattgtaggtcctaaggaacttttgctctcatgggaaagtggaaaagccaaaccaccgttaaaccgtaat

SEQ ID NO: 202335 - DNA, 75 bp, Artificial Sequence
  Synthetic
tctgtatttacttgcttccaaattacaaaggactccaagtttcaagttggtgaatttgtgtttgagaaagtagat

SEQ ID NO: 202336 - DNA, 75 bp, Artificial Sequence
  Synthetic
tatggttctgatacggtgacgtacaagtccactgccactactaagttagtaccaggtatgttatttattttgact

SEQ ID NO: 202337 - DNA, 75 bp, Artificial Sequence
  Synthetic
tctcataatgttgctccacttagagcaccaactatggctaatcaggaaaaatattccaccatttacaagttgcac

SEQ ID NO: 202338 - DNA, 75 bp, Artificial Sequence
  Synthetic
ccatcatttaatgttagtgatgcttatgcaaaccttgtaccttactaccaactcattggtaaacaacgcattact

SEQ ID NO: 202339 - DNA, 75 bp, Artificial Sequence
  Synthetic
acaatacagggtccccctggtagtggtaagtcgcattgttctatcggtattggtgtgtattatcctggagcaaga

SEQ ID NO: 202340 - DNA, 75 bp, Artificial Sequence
  Synthetic
attgtgttcacagcttgttcacatgctgctgttgattcgttgtgtgcaaaagctgccacagcttacagcgttgac

SEQ ID NO: 202341 - DNA, 75 bp, Artificial Sequence
  Synthetic
aagtgtacacgtattattcctgcacgtgctagagttgagtgttatagtggttttaaacctaataataatagtgca

SEQ ID NO: 202342 - DNA, 75 bp, Artificial Sequence
  Synthetic
caatatgtgtttagtactgttaatgcgctacctgaagttaacgcagacattgttgtcgtagatgaagtgtctatg

SEQ ID NO: 202343 - DNA, 75 bp, Artificial Sequence
  Synthetic
tgcactaactatgatttgtctgtgattaaccagcgtatatcatacaaacacattgtgtatgttggtgatcctcaa

SEQ ID NO: 202344 - DNA, 75 bp, Artificial Sequence
  Synthetic
cagctgccagctcctagagttcttatctctaaaggtgttatggaaccaatcgattataatgttgtgacacagcgt

SEQ ID NO: 202345 - DNA, 75 bp, Artificial Sequence
  Synthetic
tctctaaaggtgttatggaaccaatcgattataatgttgtgacacagcgtatgtgtgctataggacctgatgtct

SEQ ID NO: 202346 - DNA, 75 bp, Artificial Sequence
  Synthetic
tacctgtcaaagaagctagtaagcagtgcttcaaaatctttgaacgtggtagtgtgcaggtagataatggttcca

SEQ ID NO: 202347 - DNA, 75 bp, Artificial Sequence
  Synthetic
gtataaatagacgccaacttgatgttgttaagcgatttatacataaaaaccctacatggagtaaagctgtattta

SEQ ID NO: 202348 - DNA, 75 bp, Artificial Sequence
  Synthetic
tttcaccttataatagtcagaactatgtagctgctaggcttttaggtttacaaactcagacggtggattctgctc

SEQ ID NO: 202349 - DNA, 75 bp, Artificial Sequence
  Synthetic
aaggcagtgaatatgactatgtaatattcgcacagacatcagatactgctcatgcttgtaatgccaatcgtttta

SEQ ID NO: 202350 - DNA, 75 bp, Artificial Sequence
  Synthetic
acgttgccattactagagcaaagaaaggcatcttttgtattatgtctgacagaactctgtttgatgcacttaaat

SEQ ID NO: 202351 - DNA, 75 bp, Artificial Sequence
  Synthetic
tctttgaaatcactatgacagatttacagtctgaaaatagttgtggtttgtttaaagattgtgcacgtaacccca

SEQ ID NO: 202352 - DNA, 75 bp, Artificial Sequence
  Synthetic
ttgatttaccaccaagtcatgctactacttatctatcattgtctgatagatttaagactagtggtgatttagctg

SEQ ID NO: 202353 - DNA, 75 bp, Artificial Sequence
  Synthetic
ttcagataggtagcaacaatgtttgcacttatgaacatgtgatctcatatatgggtttcaggtttgacgttagta

SEQ ID NO: 202354 - DNA, 75 bp, Artificial Sequence
  Synthetic
tgcctggcagtcatagtttgttctgtactagagattttgccatgcgtcatgttagaggttggttaggaatggatg

SEQ ID NO: 202355 - DNA, 75 bp, Artificial Sequence
  Synthetic
tagaaggtgcacatgtcacaggtgataatgttggcactaatgtacctctacaagtagggttttccaatggtgtgg

SEQ ID NO: 202356 - DNA, 75 bp, Artificial Sequence
  Synthetic
acaaccttggagtgtgttgagaaaacgtattgttcaaatgatagcagattttcttgctggctcatctgatgtatt

SEQ ID NO: 202357 - DNA, 75 bp, Artificial Sequence
  Synthetic
attttgtagcgcaacctgagggttgtgttgtaacaaacactggtagtgttgtaaaacctgttcgtgcacgtgcac

SEQ ID NO: 202358 - DNA, 75 bp, Artificial Sequence
  Synthetic
ggtgtttgtgctttgggctggcggtttagagttgaccactatgcgttattttgttaagattggagctgttaaaca

SEQ ID NO: 202359 - DNA, 75 bp, Artificial Sequence
  Synthetic
cacctggtgaacaatttacccaccttgtacctctgttacgcaagggacaaccttggagtgttttgagaaaacgta

SEQ ID NO: 202360 - DNA, 75 bp, Artificial Sequence
  Synthetic
ttgttcaaatgatagcagactaccttgctggttcatctgacgtactggtgtttgtactgtgggctggcggtttag

SEQ ID NO: 202361 - DNA, 75 bp, Artificial Sequence
  Synthetic
atgttggttcactctccaataatcaccatgcaatttgtaatgttcatagaaatgaacacgttgcttctggtgatg

SEQ ID NO: 202362 - DNA, 75 bp, Artificial Sequence
  Synthetic
agttgaccactatgcgttattttgtcaagattggagctgttaaacattgccaatgtggtactgttgcaacatgct

SEQ ID NO: 202363 - DNA, 75 bp, Artificial Sequence
  Synthetic
acaactctgttagtaatgattattgttgttttaaacatgcattgggctgtgactatgtttacaatccatatgtca

SEQ ID NO: 202364 - DNA, 75 bp, Artificial Sequence
  Synthetic
tagacattcaacaatggggttatgttggttcactctctattaatcaccatgccatttgtaatgttcatagaaatg

SEQ ID NO: 202365 - DNA, 75 bp, Artificial Sequence
  Synthetic
agcatgtggcttctggtgacgctattatgactagatgtttggctgtgtatgactgctttgttaagaatgtggact

SEQ ID NO: 202366 - DNA, 75 bp, Artificial Sequence
  Synthetic
ggtcaattacctatcctatgatagctaatgaaaaagccataaacaggggtggtcgcactgtgcaaagtcatatca

SEQ ID NO: 202367 - DNA, 75 bp, Artificial Sequence
  Synthetic
ttttacacaaaagggtgatgctgcaattaaagattttgattattatcgttacaacagacctactattctggatat

SEQ ID NO: 202368 - DNA, 75 bp, Artificial Sequence
  Synthetic
tgcgtgctgctattaaattgtacaaccctaaagcaattcatgatattggtaatcctaagggtattcgttgtgctg

SEQ ID NO: 202369 - DNA, 75 bp, Artificial Sequence
  Synthetic
taactgatgcaaagtggtattgttacgacaaggaccctattaattctaatgtgaaaacattagagtacgattaca

SEQ ID NO: 202370 - DNA, 75 bp, Artificial Sequence
  Synthetic
tgacacatggccaaatggatggcttgtgtttgttctggaattgcaatgtggatatgtaccctgaattctcaattg

SEQ ID NO: 202371 - DNA, 75 bp, Artificial Sequence
  Synthetic
tttgcaggtttgatacacgcacgcgctctacattgaaccttgaaggcgtaaatgggggttcgttatacgtcaaca

SEQ ID NO: 202372 - DNA, 75 bp, Artificial Sequence
  Synthetic
accatgcatttcacactccagcttatgataaacgtgctatggccaagttaaaaccagcaccgtttttctattatg

SEQ ID NO: 202373 - DNA, 75 bp, Artificial Sequence
  Synthetic
atgacggtccatgtgaagttgttcatgaccaagtcaactatgttcctttgagagccactaattgtattactaagt

SEQ ID NO: 202374 - DNA, 75 bp, Artificial Sequence
  Synthetic
gtaatattggtggtgctgtatgttctaagcatgctaatctttatagagcatatgtggagtcatataacactttca

SEQ ID NO: 202375 - DNA, 75 bp, Artificial Sequence
  Synthetic
cccaagctggctttaacatttgggttcctaccacgtttgattgttataatttgtggcagacctttacagaggtta

SEQ ID NO: 202376 - DNA, 75 bp, Artificial Sequence
  Synthetic
acctgcaaggtttggagaatattgcttttaatgttttaaaaaaaggttcatttgtctgtgctgatggtgaactac

SEQ ID NO: 202377 - DNA, 75 bp, Artificial Sequence
  Synthetic
cagtagccattagtggtgataaagtgttcgtacgtgatggtaacactgacaatttagtctttgttaataagacat

SEQ ID NO: 202378 - DNA, 75 bp, Artificial Sequence
  Synthetic
cactgcccacaaacatagcatttgaacttttcgcaaagaggaaggttggtttaacaccacccctcagtattctca

SEQ ID NO: 202379 - DNA, 75 bp, Artificial Sequence
  Synthetic
aaaacctcggtgttgttgctacatataagtttgtcttgtgggattatgaagctgagcgtccctttacaagtttta

SEQ ID NO: 202380 - DNA, 75 bp, Artificial Sequence
  Synthetic
ctaagtctgtttgtggttatacagactttacagaggatgtttgtacctgctacgataatagtatacaaggttcgt

SEQ ID NO: 202381 - DNA, 75 bp, Artificial Sequence
  Synthetic
acgaacgttttactctgtcaaataatgctgtgttattctctgctactgctgtgaaagcaggtggtaaaagtttgc

SEQ ID NO: 202382 - DNA, 75 bp, Artificial Sequence
  Synthetic
cggctattaaattgaattttggaatgcttaatggtaatgccattgctactgtcaaatcagaagatggtaacatta

SEQ ID NO: 202383 - DNA, 75 bp, Artificial Sequence
  Synthetic
aaaatgttaactggtttgtttatgtacgcaaagatggtaagcctgttgatcattatgacggtttttacactcaag

SEQ ID NO: 202384 - DNA, 75 bp, Artificial Sequence
  Synthetic
gtcgtaatttacaagactttttgcctcgcagcacaatggaagaagactttttgaatatggatataggtgtattta

SEQ ID NO: 202385 - DNA, 75 bp, Artificial Sequence
  Synthetic
ttcaaaagtatggtctcgaagattttaactttgagcacgttgtgtatggtgatgtgtcaaaaactactctaggcg

SEQ ID NO: 202386 - DNA, 75 bp, Artificial Sequence
  Synthetic
gtttgcacttgttgatctcacaggtacgtctgagtaaaatgggcatcttgaaggcagaagagtttgtgtcagcat

SEQ ID NO: 202387 - DNA, 75 bp, Artificial Sequence
  Synthetic
ctgacataacactcaaatgttgtactgtgacctatcttaatgatcctagttataagactgtttgcacttacatgg

SEQ ID NO: 202388 - DNA, 75 bp, Artificial Sequence
  Synthetic
atttgttgttagatgattttgttgctatattgaagtctttggatttgaccgttgtatctaaggttcatgaggtca

SEQ ID NO: 202389 - DNA, 75 bp, Artificial Sequence
  Synthetic
gattctatggtgtaaagataatgccgttgctacattctatcctcagttacagagtgcagaatggaaatgcggata

SEQ ID NO: 202390 - DNA, 75 bp, Artificial Sequence
  Synthetic
ttctatgcctggtatttataagacacaacgtatgtgcttagaaccatgtaatttgtataattacggtgcgggttt

SEQ ID NO: 202391 - DNA, 75 bp, Artificial Sequence
  Synthetic
gaagttacctagtggcattatgttcaatgttgttaaatatactcaattgtgtcaatatcttaacagtactacttt

SEQ ID NO: 202392 - DNA, 75 bp, Artificial Sequence
  Synthetic
atgcgttcctcataatatgagagtgttacacttaggtgctggttcagattatggtgttgcaccaggaactgccgt

SEQ ID NO: 202393 - DNA, 75 bp, Artificial Sequence
  Synthetic
tcttaaaagatggttgccacatgatgcaattgttgttgataatgatgttgttgactatgtgagtgatgccgattt

SEQ ID NO: 202394 - DNA, 75 bp, Artificial Sequence
  Synthetic
cagtgttactggtgattgtgcaaccgtttatttggaagacaagttcgacttgttaatttctgatatgtacgatgg

SEQ ID NO: 202395 - DNA, 75 bp, Artificial Sequence
  Synthetic
caggacaaaggcaattgatggtgaaaatgtttcgaaagaaggatttttcacttatatcaatggtgtcatttgtga

SEQ ID NO: 202396 - DNA, 75 bp, Artificial Sequence
  Synthetic
gaaacttgccatcggaggctcggttgctattaaagtaacagagtatagctggaacaagaaattgtatgaacttgt

SEQ ID NO: 202397 - DNA, 75 bp, Artificial Sequence
  Synthetic
gctattaaagtaacagagtatagctggaacaagaaattgtatgaacttgtacaaaaattttctttttggactatg

SEQ ID NO: 202398 - DNA, 75 bp, Artificial Sequence
  Synthetic
ttctgcacttctgttaatacgtcatcatcagaagcctttgttgtcggaattaactatcttggtgatttcgcaaaa

SEQ ID NO: 202399 - DNA, 75 bp, Artificial Sequence
  Synthetic
ggaccctttatagatggcaacataatacatgcaaattatgtgttctggcgtaactcaactgttatgagtttgtcc

SEQ ID NO: 202400 - DNA, 75 bp, Artificial Sequence
  Synthetic
tctattggtattggtgtgtattaccctggagcgaggatcgtgttcactgcttgttctcacgctgctgttgattcg

SEQ ID NO: 202401 - DNA, 75 bp, Artificial Sequence
  Synthetic
tacaattctgttttagacttgagtaagtttaattgcaaacataaagcgaccgttgttgtgcaattaaaggatggt

SEQ ID NO: 202402 - DNA, 75 bp, Artificial Sequence
  Synthetic
agtttaattgcaaacataaagcgaccgttgttgtgcaattaaaggatggtgacattaatgaaatggtgcttagtc

SEQ ID NO: 202403 - DNA, 75 bp, Artificial Sequence
  Synthetic
aataaaatgtttgtacttgttgcatatgccttgttgcatattgctggttgtcaaactataaatgttctgaacact

SEQ ID NO: 202404 - DNA, 75 bp, Artificial Sequence
  Synthetic
atgccttgttgcatattgctggttgtcaaactataaatgttctgaacactagtcactctgtttgtaacggctgtg

SEQ ID NO: 202405 - DNA, 75 bp, Artificial Sequence
  Synthetic
gagttttcagcctttgttgcttaattgcttatggtctgtttctggctcgcggtttactactggttttgtctattt

SEQ ID NO: 202406 - DNA, 75 bp, Artificial Sequence
  Synthetic
tccgactttgcatttaataattggtttctcttaactaatacctcatctcttgtagacggtgttgtgaggagtttt

SEQ ID NO: 202407 - DNA, 75 bp, Artificial Sequence
  Synthetic
ctgatgtcatacgttacaacatcaattttgaagaaaaccttagacgtggaaccattttgtttaaaacatcttatg

SEQ ID NO: 202408 - DNA, 75 bp, Artificial Sequence
  Synthetic
tactggttttgtctattttaatggtactgggagaggtgattgtaaaggtttttcttcaaatgttttgtctgatgt

SEQ ID NO: 202409 - DNA, 75 bp, Artificial Sequence
  Synthetic
gcttttgtgggtgcactacctaagacagttcgtgagtttgttatttcacgcacaggacatttttatattaatggc

SEQ ID NO: 202410 - DNA, 75 bp, Artificial Sequence
  Synthetic
gaaaaccttagacgtggaaccattttgtttaaaacatcttttggtgttgttgtgttttattgtaccaacaacact

SEQ ID NO: 202411 - DNA, 75 bp, Artificial Sequence
  Synthetic
cacaggacatttttatattaatggctatcgctatttctctttaggtaatgtagaagccgttaatttcaatgtcac

SEQ ID NO: 202412 - DNA, 75 bp, Artificial Sequence
  Synthetic
tgtgttttattgtaccaacaacactttagtttcaggtgatgcttacataccatttggtacagttttgggcaattt

SEQ ID NO: 202413 - DNA, 75 bp, Artificial Sequence
  Synthetic
tatcgctatttctctttaggtaatgtagaagccgttaatttcaatgtcactaacgctgcaaccactgtttgtact

SEQ ID NO: 202414 - DNA, 75 bp, Artificial Sequence
  Synthetic
catttggtacagttttgggcaatttttattgctttgtaaatactactattggcaatgaaactacttcttcttttg

SEQ ID NO: 202415 - DNA, 75 bp, Artificial Sequence
  Synthetic
tattgctaatataatttattgcaattctgttattaacagactgagatgtgaccagttgtcctttgatgtaccaga

SEQ ID NO: 202416 - DNA, 75 bp, Artificial Sequence
  Synthetic
tagcttcttatgctgacgttttggttaatgtgtcacaaaccgctattgctaatataatttattgcaactctgtta

SEQ ID NO: 202417 - DNA, 75 bp, Artificial Sequence
  Synthetic
acacacgtttattgtgttgtatgtcaacttcgaacttcggcgtggccctggcaggtgctataactgtcgtcctgc

SEQ ID NO: 202418 - DNA, 75 bp, Artificial Sequence
  Synthetic
tttaatgaaactaaagggcccttgtgtgttgacacatcacacttcactacccaattcgttggtaatgtcaagctt

SEQ ID NO: 202419 - DNA, 75 bp, Artificial Sequence
  Synthetic
gctacctgtttatcacaaacatacgtttattgtgttgtacgttgactttaaacctcagagtggcgccggcacgtg

SEQ ID NO: 202420 - DNA, 75 bp, Artificial Sequence
  Synthetic
aacctcagagtggcgccggcacgtgttataactgtcgtccttctgttgttaatattacactggccaattttaatg

SEQ ID NO: 202421 - DNA, 75 bp, Artificial Sequence
  Synthetic
tataatggctaatttggttaatcataaatctcataatataggctcattgtatgtttcttggagtgatggtgatgt

SEQ ID NO: 202422 - DNA, 75 bp, Artificial Sequence
  Synthetic
aaactaaagggcctttgtgtgttgaaacatcacacttcactaccaaatacgttgcttccaatgttggtaggtgga

SEQ ID NO: 202423 - DNA, 75 bp, Artificial Sequence
  Synthetic
aattttgcttatattaattcttatactataggctcattgtatgtttcttggagtgatggtgatggcattactggc

SEQ ID NO: 202424 - DNA, 75 bp, Artificial Sequence
  Synthetic
ccatagaagacatactttttagcaaacttgttacgtctggacttggcactgtggacgcagactacaaaaagtgta

SEQ ID NO: 202425 - DNA, 75 bp, Artificial Sequence
  Synthetic
gatgtatctggtgtgggtgttattcgcattagcaatgacacctttcttaatggaattacgtacacatcaacttca

SEQ ID NO: 202426 - DNA, 75 bp, Artificial Sequence
  Synthetic
tggaattacgtacacatcaacttcaggtaaccttttgggtttcaaagatgttactaatggtatcatctactctat

SEQ ID NO: 202427 - DNA, 75 bp, Artificial Sequence
  Synthetic
ttaggaggtcttacatcagccgcttcaataccattttcattagcaattcagtcacgtttaaattatgttgcattg

SEQ ID NO: 202428 - DNA, 75 bp, Artificial Sequence
  Synthetic
caataccattttcattagcaattcagtcacgtttaaattatgttgcattgcagactgatgttttacaagaaaatc

SEQ ID NO: 202429 - DNA, 75 bp, Artificial Sequence
  Synthetic
cactccttgtaacccaccagatcagcttgttgtttatcagcaagctgttgttggtgctatgttgtctgaaaattc

SEQ ID NO: 202430 - DNA, 75 bp, Artificial Sequence
  Synthetic
aagtagttacggcttctctaatgttgtggaattgcctaactttttctacgcttctaatggcacttacaattgcac

SEQ ID NO: 202431 - DNA, 75 bp, Artificial Sequence
  Synthetic
agatgctgttttaacttattctagctttggtgtttgtgcagatggttccataattgctgttcaaccacgcaatgt

SEQ ID NO: 202432 - DNA, 75 bp, Artificial Sequence
  Synthetic
ttcttatgatggtgtctcagcgattgtcacagctaatttgtctataccttccaattggactacttcagtccaggt

SEQ ID NO: 202433 - DNA, 75 bp, Artificial Sequence
  Synthetic
ccaattggactacttcagtccaggttgagtatttacaaattacaagcacacctattttagtggattgctccactt

SEQ ID NO: 202434 - DNA, 75 bp, Artificial Sequence
  Synthetic
cgtgctcatctttgtggtgagtatgttgctattatgttgttgttctactggttgctgcggcttctttagttgttt

SEQ ID NO: 202435 - DNA, 75 bp, Artificial Sequence
  Synthetic
tctgcttgtaaaactatagaagatgccttaagaattagtgctatgctggagtctgcagatgttggtgagatgctc

SEQ ID NO: 202436 - DNA, 75 bp, Artificial Sequence
  Synthetic
agcttgcctacaagtggtagtagagtggccggtcgcagtgccatagaagacatactttttagtaaagttgttact

SEQ ID NO: 202437 - DNA, 75 bp, Artificial Sequence
  Synthetic
cattaccaagtgtaatattggtggtgctgtatgttctaagcacgctaatctctatagagcgtatgttgagtcata

SEQ ID NO: 202438 - DNA, 75 bp, Artificial Sequence
  Synthetic
atataacggtgaatgtgtatacttgttttgtgaacacccagctgttggaatagtcaatacagatttcaaattaga

SEQ ID NO: 202439 - DNA, 75 bp, Artificial Sequence
  Synthetic
caatattataatggcattatggttttgcctggcgttgctgatgctgaacgaatggccatgtacacaggttcctta

SEQ ID NO: 202440 - DNA, 75 bp, Artificial Sequence
  Synthetic
attggtggcattgccttaggaggtcttacatcagccgctgcaataccattttctttagctcttcaggcacgtttg

SEQ ID NO: 202441 - DNA, 75 bp, Artificial Sequence
  Synthetic
aactatgtggcattgcagactgatgttttgcaagaaaaccagaaaattcttgctgcatcttttaataaagcaatg

SEQ ID NO: 202442 - DNA, 75 bp, Artificial Sequence
  Synthetic
actaacattgtcgatgcctttacaggagtcaatgatgctattactcaaacttcacaagctatacaaacagttgcc

SEQ ID NO: 202443 - DNA, 75 bp, Artificial Sequence
  Synthetic
actgcacttaacaagattcaggatgttgtgaatcaacaaggcaatgcattgaaccatctaacttctcagttgagg

SEQ ID NO: 202444 - DNA, 75 bp, Artificial Sequence
  Synthetic
caaaattttcaagctatttccagttctattcaggctatctatgacagacttgacactattcaggctgatcaacaa

SEQ ID NO: 202445 - DNA, 75 bp, Artificial Sequence
  Synthetic
gtagataggcttattactggtagactggctgctttgaacgcattcgttgctcagacacttactaagtatactgag

SEQ ID NO: 202446 - DNA, 75 bp, Artificial Sequence
  Synthetic
gtgcgtgcttccagacagcttgcacaacaaaaagtgaatgaatgtgtcaaatcccagtctaaccgttatggtttc

SEQ ID NO: 202447 - DNA, 75 bp, Artificial Sequence
  Synthetic
tgtggaaatggcacacacattttctcaattgtgaattctgctcctgaaggccttgtttttcttcacactgtcttg

SEQ ID NO: 202448 - DNA, 75 bp, Artificial Sequence
  Synthetic
ttgcccacgcaatataaggatgttgaagcgtggtccgggctttgcgttgataatacaaacggttatgtgctgcga

SEQ ID NO: 202449 - DNA, 75 bp, Artificial Sequence
  Synthetic
aagaagactttttgaacatggatataggcgtgtttattcaaaagtacggtctagaggatttcaacttcgagcacg

SEQ ID NO: 202450 - DNA, 75 bp, Artificial Sequence
  Synthetic
ccaaagagtcaggcaacactgtggtcttgactttcaccactagagtgactgtgcccaaagaccatccacacttgg

SEQ ID NO: 202451 - DNA, 75 bp, Artificial Sequence
  Synthetic
caacctaatcttgctctttacaaagaaggcaattattatagaatcacatcacgttttatgtttgaaccacgcatc

SEQ ID NO: 202452 - DNA, 75 bp, Artificial Sequence
  Synthetic
acgttttatgtttgaaccacgcatccctactatggcagattttgtccagattgaaaagtgcaatgtcacatttgt

SEQ ID NO: 202453 - DNA, 75 bp, Artificial Sequence
  Synthetic
gaagtttctattgaaactgacataattgatgaagtcaactaaacatgctactgtgttgaaattcaggctttagtt

SEQ ID NO: 202454 - DNA, 75 bp, Artificial Sequence
  Synthetic
ttaacaagacgctgcaagaattaattgacaaattgccaaattatactgtcccagacctaggcatcgaccagtaca

SEQ ID NO: 202455 - DNA, 75 bp, Artificial Sequence
  Synthetic
aaagactgcaaactcttattgacaacataaatagcactttagtcgacttaaagtggctcaaccgggttgagactt

SEQ ID NO: 202456 - DNA, 75 bp, Artificial Sequence
  Synthetic
ctcatttaaaccatgactggtttttatttggtgatagtcgttctgattgtaaccatattaataatttaaaaatta

SEQ ID NO: 202457 - DNA, 75 bp, Artificial Sequence
  Synthetic
cttgtattttactttccacacttttcatctctctgccagtgacgtgttggttgtcctcagcgtccctcccatagg

SEQ ID NO: 202458 - DNA, 75 bp, Artificial Sequence
  Synthetic
tttcaacaagttttgtactatcagaataatgtttttatgtctgaatctaaatgttgggttgaaaatgatattact

SEQ ID NO: 202459 - DNA, 75 bp, Artificial Sequence
  Synthetic
catctctctgccagtgacgtgttggttgtcctcagcgtccctcccataggtcgcaatgattaaaaccagcaaata

SEQ ID NO: 202460 - DNA, 75 bp, Artificial Sequence
  Synthetic
aacatactatgttggttaagatagatggtgattatgtttatttaccatatccagatccttctagaattctaggag

SEQ ID NO: 202461 - DNA, 75 bp, Artificial Sequence
  Synthetic
cggtctcggcttcaagtgggcgccagaatttcgttggctgcttccggatgcagcggaggagttggctagtcctat

SEQ ID NO: 202462 - DNA, 75 bp, Artificial Sequence
  Synthetic
gaatttcgttggctgcttccggatgcagcggaggagttggctagtcctatgaagtcagatgagggtgggttatgc

SEQ ID NO: 202463 - DNA, 75 bp, Artificial Sequence
  Synthetic
cttgtgagtgtggtttaatcataatcttgtattttactttccacacttttcatctctctgccagtgacgtgttgg

SEQ ID NO: 202464 - DNA, 75 bp, Artificial Sequence
  Synthetic
ccctctactggtcaagcgatggaaagtgttggattcgtttatgataatcatgtgaagatagattgtcgctgcatt

SEQ ID NO: 202465 - DNA, 75 bp, Artificial Sequence
  Synthetic
gtgttggattcgtttatgataatcatgtgaagatagattgtcgctgcattcttggacaagaatggcatgtgcagt

SEQ ID NO: 202466 - DNA, 75 bp, Artificial Sequence
  Synthetic
tactattaaaggttcttttttgtgtgggtcatgtggatctgttggttatgtattaacaggtgatagtgttaagtt

SEQ ID NO: 202467 - DNA, 75 bp, Artificial Sequence
  Synthetic
cctatggtgaatccctcgaaggggtcttctgggttgctaatcaccaagctgacacttctactccctccgatgttt

SEQ ID NO: 202468 - DNA, 75 bp, Artificial Sequence
  Synthetic
caaatcttatccgtgatatttttgttcatgaagatctacatgttgtagaagttctaactaaaacagccgtaaagt

SEQ ID NO: 202469 - DNA, 75 bp, Artificial Sequence
  Synthetic
tcatgaagatctacatgttgtagaagttctaactaaaacagccgtaaagtccggtacggcaattttaattaaatc

SEQ ID NO: 202470 - DNA, 75 bp, Artificial Sequence
  Synthetic
acctttgcatagcttgggtggttttcctaaagggtatgttatgggcttgttccgttcatacaagactaaacgtta

SEQ ID NO: 202471 - DNA, 75 bp, Artificial Sequence
  Synthetic
tccgttcatacaagactaaacgttatgttgtacatcatctttctatgactacatctactactaattttggtgaag

SEQ ID NO: 202472 - DNA, 75 bp, Artificial Sequence
  Synthetic
attttttgggttggattgtaccttttggttttatgccatcttatgttcacaaatggtttcaattctgtaggttgt

SEQ ID NO: 202473 - DNA, 75 bp, Artificial Sequence
  Synthetic
ttacagactatatattaattagtagaaattttatatttagacatttgattgttagagtagttataaggtttagct

SEQ ID NO: 202474 - DNA, 75 bp, Artificial Sequence
  Synthetic
tgtaatgcacctaactgtgatgtgagtgatgtcaccaaattatatttgggtggtatgtcttactattgtgaaaac

SEQ ID NO: 202475 - DNA, 75 bp, Artificial Sequence
  Synthetic
actaagcaaaatgccaaggaaatcaggcataaaattttaacaaaacctcgccaaaagcgaactcctaataaacat

SEQ ID NO: 202476 - DNA, 75 bp, Artificial Sequence
  Synthetic
cttttttagcaactattaagctttgtatgcaactttgtggtttttgtaatttctttattatttcaccttcggctt

SEQ ID NO: 202477 - DNA, 75 bp, Artificial Sequence
  Synthetic
ctgaggttcatgctgagcctaaaggtaaatattcacaaaaagcttatgctttacttagacaatatcgtggtatta

SEQ ID NO: 202478 - DNA, 75 bp, Artificial Sequence
  Synthetic
taaatattcacaaaaagcttatgctttacttagacaatatcgtggtattaaacccgtactttttgtagaccagta

SEQ ID NO: 202479 - DNA, 75 bp, Artificial Sequence
  Synthetic
ataccacccacttcagattatttaatctaaatctaaacattatgaataaatctttttttccccaattcacttctg

SEQ ID NO: 202480 - DNA, 75 bp, Artificial Sequence
  Synthetic
tggttgtgactattctggtaaattagcagattgtcttcaagcttatggtcattattctttgcaagatatgagaca

SEQ ID NO: 202481 - DNA, 75 bp, Artificial Sequence
  Synthetic
ttaaccacggtgatagtggttttatttctattttatctggtcttttatataatgtttcttgtatttcatattatg

SEQ ID NO: 202482 - DNA, 75 bp, Artificial Sequence
  Synthetic
ggcatgtagttcgtgattcacgatttgttatgcgcctgcagactatagctactatttgtggtattaaatatgttg

SEQ ID NO: 202483 - DNA, 75 bp, Artificial Sequence
  Synthetic
gtttgtttatcttatcaagatgattattctttggcttatgtggccattgactatcaccttgactatatttaattg

SEQ ID NO: 202484 - DNA, 75 bp, Artificial Sequence
  Synthetic
tgttatgcgcctgcagactatagctactatttgtggtattaaatatgttgcacaacctacagaagatgtagtaga

SEQ ID NO: 202485 - DNA, 75 bp, Artificial Sequence
  Synthetic
ttatggttagatgacaaagtttattgtcctcgtcatgttatatgttcatcctctaatatgaacgaacctgattat

SEQ ID NO: 202486 - DNA, 75 bp, Artificial Sequence
  Synthetic
tggagatgtagttatacgtgaacctgtacatttattatctgctgatgcaatagttttaaagcttcctagtttgat

SEQ ID NO: 202487 - DNA, 75 bp, Artificial Sequence
  Synthetic
gtacatttattatctgctgatgcaatagttttaaagcttcctagtttgatgaaagttatgactcatatggatgat

SEQ ID NO: 202488 - DNA, 75 bp, Artificial Sequence
  Synthetic
taccagatgcagggctgtcaacttgttttgacagtctctttacaaaatccttacactccaaaatatacttttggt

SEQ ID NO: 202489 - DNA, 75 bp, Artificial Sequence
  Synthetic
ttttctattaaatctatatataatgttgatttgtgtgattgtggttttgttatgcagtatggttatgtagattgt

SEQ ID NO: 202490 - DNA, 75 bp, Artificial Sequence
  Synthetic
ttgatttgtgtgattgtggttttgttatgcagtatggttatgtagattgttttaatgataattgtgatttttatg

SEQ ID NO: 202491 - DNA, 75 bp, Artificial Sequence
  Synthetic
tcctcgcataagtgagtatgttgtggatgtttcttatggtttgggtacatattatatacttgatcgtgtttattt

SEQ ID NO: 202492 - DNA, 75 bp, Artificial Sequence
  Synthetic
gttgggtttcaggtaatatgatggatggtttttcttgtccattgtgttgtacagtttatgactctagcgaagtta

SEQ ID NO: 202493 - DNA, 75 bp, Artificial Sequence
  Synthetic
tggtttttcttgtccattgtgttgtacagtttatgactctagcgaagttaaagcccaatcatctggtgttattcc

SEQ ID NO: 202494 - DNA, 75 bp, Artificial Sequence
  Synthetic
aaatactactatattatttactggttatttccctaaatctggtgccaattttagggatctatctttaaaaggtac

SEQ ID NO: 202495 - DNA, 75 bp, Artificial Sequence
  Synthetic
cagttgtatacggaagcctttgttgtgttgtaaatgttgctatgatcatgttatggcaaccaatcataaatatgt

SEQ ID NO: 202496 - DNA, 75 bp, Artificial Sequence
  Synthetic
cttttaatttgtatggttattctgtcacaccatttggttcttgtatatattggtcgccgcgtcctggattgtgga

SEQ ID NO: 202497 - DNA, 75 bp, Artificial Sequence
  Synthetic
tgcagctatagattttgttcagtatgaagtagatagacgtgttttatttgattatgttagtttagtcaaattaat

SEQ ID NO: 202498 - DNA, 75 bp, Artificial Sequence
  Synthetic
ttcctataattaaatcttcagtcaagtcttatgatgatttggtttattcaggtgtagtaggttgtaaatctattg

SEQ ID NO: 202499 - DNA, 75 bp, Artificial Sequence
  Synthetic
gtcttatgatgatttggtttattcaggtgtagtaggttgtaaatctattgttaaagaaactgctcttattactca

SEQ ID NO: 202500 - DNA, 75 bp, Artificial Sequence
  Synthetic
tgcactttacttagattatgttcaatgtaagtgtggtaatcttgaacaaaatcatattcttggcgttaataattc

SEQ ID NO: 202501 - DNA, 75 bp, Artificial Sequence
  Synthetic
tgtaagtgtggtaatcttgaacaaaatcatattcttggcgttaataattcttggtgtaggcaactgttgcttaat

SEQ ID NO: 202502 - DNA, 75 bp, Artificial Sequence
  Synthetic
agaggtgattataatatgcttctaaaaaatattgacttgtttgttaagcgtcgtgctgattttgcttgcaagttt

SEQ ID NO: 202503 - DNA, 75 bp, Artificial Sequence
  Synthetic
tcgtgctgattttgcttgcaagtttgcagtttgtggagatggttttgtaccttttttactagatggtttaattcc

SEQ ID NO: 202504 - DNA, 75 bp, Artificial Sequence
  Synthetic
ccgtagttattatctaattcagagtggtattttctttacatctttgatgtctcaattttcacaagaagtttctga

SEQ ID NO: 202505 - DNA, 75 bp, Artificial Sequence
  Synthetic
ggtattttctttacatctttgatgtctcaattttcacaagaagtttctgatatgtgtttaaaaatgtgtattttg

SEQ ID NO: 202506 - DNA, 75 bp, Artificial Sequence
  Synthetic
tagttcattatgttttaaagtatattttaagggacagacaacacatgagagttcaagtgctgtaaatattcaaca

SEQ ID NO: 202507 - DNA, 75 bp, Artificial Sequence
  Synthetic
tttatggacagagtttcagttgctacattttatatagagcattatgttaataggttggttactcaatttaagtta

SEQ ID NO: 202508 - DNA, 75 bp, Artificial Sequence
  Synthetic
cattttatatagagcattatgttaataggttggttactcaatttaagttattgggtactacacttgttaataaaa

SEQ ID NO: 202509 - DNA, 75 bp, Artificial Sequence
  Synthetic
tggttaattggtttaataccatgttagatgctagtgcacctgctacaggctggcttctttaccaattattgaatg

SEQ ID NO: 202510 - DNA, 75 bp, Artificial Sequence
  Synthetic
agatgctagtgcacctgctacaggctggcttctttaccaattattgaatggtctttttgtagtatctcaagccaa

SEQ ID NO: 202511 - DNA, 75 bp, Artificial Sequence
  Synthetic
ctttaattttgttgctttaatacctgattatgctaaaattttagttaataaattttacactttttttaagttatt

SEQ ID NO: 202512 - DNA, 75 bp, Artificial Sequence
  Synthetic
ggttcacgttctcaatcacgtggacccaataatcgttcattaagtagaagtaattctaattttagacattcagat

SEQ ID NO: 202513 - DNA, 75 bp, Artificial Sequence
  Synthetic
gaatcattttacaagaatatgtatttaaaaagtgccgtgatgcagagtgtaggtgcatgtgttgtttgttcatca

SEQ ID NO: 202514 - DNA, 75 bp, Artificial Sequence
  Synthetic
gattatgctaaaattttagttaataaattttacactttttttaagttattattagagtgtgttacagttgatgtt

SEQ ID NO: 202515 - DNA, 75 bp, Artificial Sequence
  Synthetic
ttaaaagatatgcctgttcttaaaactattaatggtttagtttgtattgtaggcaataagttttataacgttagt

SEQ ID NO: 202516 - DNA, 75 bp, Artificial Sequence
  Synthetic
ctattaatggtttagtttgtattgtaggcaataagttttataacgttagtacagggttaattcctggttttgttt

SEQ ID NO: 202517 - DNA, 75 bp, Artificial Sequence
  Synthetic
attcttctgttatacaagaagttttattgcttcgtcatgatatacaattgaataatgacgttcgtgattatttgt

SEQ ID NO: 202518 - DNA, 75 bp, Artificial Sequence
  Synthetic
taccatgtaatgcacaggaacaacaaatttatttttttgaaggcgttgcagaatctgttatagtagaagatgatg

SEQ ID NO: 202519 - DNA, 75 bp, Artificial Sequence
  Synthetic
aatttatttttttgaaggcgttgcagaatctgttatagtagaagatgatgttattgagaatgtcaaatcttcttt

SEQ ID NO: 202520 - DNA, 75 bp, Artificial Sequence
  Synthetic
tttatactaactttaagttagttggacatgatatttgtgctcaattgaatgataagttaggttttaatgtagatt

SEQ ID NO: 202521 - DNA, 75 bp, Artificial Sequence
  Synthetic
atcatcttatgagtattgtcaaccacctaaatctgtagaaaaaatttgtattatagataatatgtacatgggtaa

SEQ ID NO: 202522 - DNA, 75 bp, Artificial Sequence
  Synthetic
ttatagataatatgtacatgggtaagtgtggtgataaatttttccctattgtcatgaatgataaaaatatttgtc

SEQ ID NO: 202523 - DNA, 75 bp, Artificial Sequence
  Synthetic
cccttctgaagcaaaaggatattggtatagacacaaccggcgttcttttaaaacagctgatggtcaacaaaagca

SEQ ID NO: 202524 - DNA, 75 bp, Artificial Sequence
  Synthetic
ttttagatcaggcttggcgttttccatgtgcaggtagaaaagttaattttaacgagaaacctgttgttatggaga

SEQ ID NO: 202525 - DNA, 75 bp, Artificial Sequence
  Synthetic
atgtgcaggtagaaaagttaattttaacgagaaacctgttgttatggagattccgtctttgatgacagttaaggt

SEQ ID NO: 202526 - DNA, 75 bp, Artificial Sequence
  Synthetic
tatgtttgatttagattctacttttgatgatattttaggtaaagtttgttcagaatttgaagtagaaaagggtgt

SEQ ID NO: 202527 - DNA, 75 bp, Artificial Sequence
  Synthetic
gctaatccagtttggaatagtgctgtttttattagtccttataatagtcagaattatgttgctaagcgtatttta

SEQ ID NO: 202528 - DNA, 75 bp, Artificial Sequence
  Synthetic
tgtgtcaaagattatgaatttaaattttatgatgcttttcctgtagccaagtttgttaaacagttattttatgtc

SEQ ID NO: 202529 - DNA, 75 bp, Artificial Sequence
  Synthetic
agttcttgaagagaatttaaatgcttatgttaattctaatcagaacactgattctgattcgttgagttctaaacc

SEQ ID NO: 202530 - DNA, 75 bp, Artificial Sequence
  Synthetic
gtttgtgatgctatagagaatgctttaaactcttgtaaagagcatccagtggttggttatcaagttcgtgcattt

SEQ ID NO: 202531 - DNA, 75 bp, Artificial Sequence
  Synthetic
gatgatattttaggtaaagtttgttcagaatttgaagtagaaaagggtgttactgtagatgattttgttgctgtt

SEQ ID NO: 202532 - DNA, 75 bp, Artificial Sequence
  Synthetic
tttatttatttgatgaggctggtgatgaagcaatggcctctcgtatgtattgtacttttgctattgaggatgttg

SEQ ID NO: 202533 - DNA, 75 bp, Artificial Sequence
  Synthetic
ttttctaattttattttaaatggtatcaatagtggtaccacttgttctaatgatttattgcagcctaatactgaa

SEQ ID NO: 202534 - DNA, 75 bp, Artificial Sequence
  Synthetic
ttttcatcaaaatgcttcctctttggctttactttatcgtaatttaaaatgtagctatgttttgaataatatttc

SEQ ID NO: 202535 - DNA, 75 bp, Artificial Sequence
  Synthetic
agtttttaatgatgtctataatgatgctttgtttgttagttatggttctagtgttgaaacagaaacatattttaa

SEQ ID NO: 202536 - DNA, 75 bp, Artificial Sequence
  Synthetic
attacacatactaactgttggttgcgttctgtgttacttgtaatgcagaaattaccttttaagtttaaggattta

SEQ ID NO: 202537 - DNA, 75 bp, Artificial Sequence
  Synthetic
atctcattaaatctaaactttttaaacaagattccctgttatccatgcttgtgagtgtggtttaatcataatctt

SEQ ID NO: 202538 - DNA, 75 bp, Artificial Sequence
  Synthetic
gttctgtgttacttgtaatgcagaaattaccttttaagtttaaggatttagctattgaaaatatgtggttatctt

SEQ ID NO: 202539 - DNA, 75 bp, Artificial Sequence
  Synthetic
ataaggtgggttataatcaaagttttgttgattatttactgaccactattcctaaagctattgttttgcctcaag

SEQ ID NO: 202540 - DNA, 75 bp, Artificial Sequence
  Synthetic
ttggtttttaaaccagtttgatattaatgcgtatgctaattggtgttgtttaaaatgtggtttttcttttgattt

SEQ ID NO: 202541 - DNA, 75 bp, Artificial Sequence
  Synthetic
tatggagatattgtgtctcatgtttgtaagtgtggacataatatgactctaatagcagcggacttaccttgtaca

SEQ ID NO: 202542 - DNA, 75 bp, Artificial Sequence
  Synthetic
tctatgattgtttttgtaaatctgttaattggaatttagagtatccaataatttccaatgaggttagtataaata

SEQ ID NO: 202543 - DNA, 75 bp, Artificial Sequence
  Synthetic
gtggatgtaaacgtttgtcattctgtagctgttataggtgatgaacaaatagatggtaagtttgttactaaattt

SEQ ID NO: 202544 - DNA, 75 bp, Artificial Sequence
  Synthetic
tagctgttataggtgatgaacaaatagatggtaagtttgttactaaatttagtggtgataaatttgattttatag

SEQ ID NO: 202545 - DNA, 75 bp, Artificial Sequence
  Synthetic
taggttatggaatgtcatttagtatgtcttcttttgagttagctcaattgtatggtttgtgtataacacctaatg

SEQ ID NO: 202546 - DNA, 75 bp, Artificial Sequence
  Synthetic
gtcttcttttgagttagctcaattgtatggtttgtgtataacacctaatgtatgttttgttaaaggtgatattat

SEQ ID NO: 202547 - DNA, 75 bp, Artificial Sequence
  Synthetic
aaatgttgctagacttgttaaagctgatgttattgttaatcctgctaatgggcatatgctccatggtggtggagt

SEQ ID NO: 202548 - DNA, 75 bp, Artificial Sequence
  Synthetic
attttctcttaatgtacaatatagaattaatggtttgggtgttactatggatgttcttaataaaaatcaaaagtt

SEQ ID NO: 202549 - DNA, 75 bp, Artificial Sequence
  Synthetic
ggtaaaaaattttctaaagaaactgctgctatggttaaatctaaaggtgtttgccaagtaggagattgttatgtt

SEQ ID NO: 202550 - DNA, 75 bp, Artificial Sequence
  Synthetic
ctgctatggttaaatctaaaggtgtttgccaagtaggagattgttatgtttctaccggtggtaaattatgtaaaa

SEQ ID NO: 202551 - DNA, 75 bp, Artificial Sequence
  Synthetic
caattcttaatattgtaggccctgatgctagacaagatggaagacaatcttatgttttgttagcacgtgcttata

SEQ ID NO: 202552 - DNA, 75 bp, Artificial Sequence
  Synthetic
tgctagacaagatggaagacaatcttatgttttgttagcacgtgcttataagcatcttaataattatgattgttg

SEQ ID NO: 202553 - DNA, 75 bp, Artificial Sequence
  Synthetic
gattgacgttcgtaccgtctatcagcttacgatctcttgtcagatctcattaaatctaaactttttaaacaagat

SEQ ID NO: 202554 - DNA, 75 bp, Artificial Sequence
  Synthetic
tttgtctactctcatatcggctggtatatttagtgttcctgctgatgtgtcattaacttaccttctaggtgttgt

SEQ ID NO: 202555 - DNA, 75 bp, Artificial Sequence
  Synthetic
atatttagtgttcctgctgatgtgtcattaacttaccttctaggtgttgttgataaacaagttatccttgttagt

SEQ ID NO: 202556 - DNA, 75 bp, Artificial Sequence
  Synthetic
aataataaagaagattttgatattattcaaaaatgtcaaattacttcagttgttggtactaaagcattggctgtt

SEQ ID NO: 202557 - DNA, 75 bp, Artificial Sequence
  Synthetic
atggacagcgtgtctacgatgatgttgatgctagtttatttgtagatattaataatctgttacattctaaagtta

SEQ ID NO: 202558 - DNA, 75 bp, Artificial Sequence
  Synthetic
tacaagaagttttattgcttcgtcatgatatacaattgaataatgacgttcgtgattatttgttgtctaagatga

SEQ ID NO: 202559 - DNA, 75 bp, Artificial Sequence
  Synthetic
tgatatacaattgaataatgacgttcgtgattatttgttgtctaagatgactagtcttcctaaagattggcgtct

SEQ ID NO: 202560 - DNA, 75 bp, Artificial Sequence
  Synthetic
tatcaataaatttgatgttattaacggtgttaaaactgttaagtattttgagtgtcctaattctatttatatatg

SEQ ID NO: 202561 - DNA, 75 bp, Artificial Sequence
  Synthetic
ggtgttaaaactgttaagtattttgagtgtcctaattctatttatatatgtagtcagggtaaagactttggttat

SEQ ID NO: 202562 - DNA, 75 bp, Artificial Sequence
  Synthetic
ttttgcattttggacagttttttgtactaatgtaaatgcttcttctagtgaagggtttttaataggtataaatta

SEQ ID NO: 202563 - DNA, 75 bp, Artificial Sequence
  Synthetic
gtatgtgatggttctttttataaagcaactgttaatcaagtttgtgttttattagctaagaagatagatgttttg

SEQ ID NO: 202564 - DNA, 75 bp, Artificial Sequence
  Synthetic
caactgttaatcaagtttgtgttttattagctaagaagatagatgttttgcttactgtagatggtgttaatttta

SEQ ID NO: 202565 - DNA, 75 bp, Artificial Sequence
  Synthetic
aatctatttctcttactgtaggtgaagtttttggtaaaatacttggtaatgttttctgtgatggcattgatgtta

SEQ ID NO: 202566 - DNA, 75 bp, Artificial Sequence
  Synthetic
agtttttggtaaaatacttggtaatgttttctgtgatggcattgatgttactaagttaaagtgtagtgattttta

SEQ ID NO: 202567 - DNA, 75 bp, Artificial Sequence
  Synthetic
taccttgttttatgtaaattatttagttgtttataaggaaggttttagaggtcttacttatgtctggctctcata

SEQ ID NO: 202568 - DNA, 75 bp, Artificial Sequence
  Synthetic
tgccgataaaattttatatcagtatgaaaatttgtctttagctgatatttctgctgtacaaagttcatttgggtt

SEQ ID NO: 202569 - DNA, 75 bp, Artificial Sequence
  Synthetic
tataattttttaacagtatgtaaatggtctgtagttgttaacggtccatttttttcttttgaacagtctcataat

SEQ ID NO: 202570 - DNA, 75 bp, Artificial Sequence
  Synthetic
ttatgttgcagcatattaatcttaaatttaataaatggcagtggcaggaagcatggtatgaatttcgtgctggca

SEQ ID NO: 202571 - DNA, 75 bp, Artificial Sequence
  Synthetic
gaccacatagattagttgctcttgttttagctaaaggtcattttaaatttgatgaaccatcagatgctactgatt

SEQ ID NO: 202572 - DNA, 75 bp, Artificial Sequence
  Synthetic
tttagctaaaggtcattttaaatttgatgaaccatcagatgctactgattttattcgtgttgttttgaaacaagc

SEQ ID NO: 202573 - DNA, 75 bp, Artificial Sequence
  Synthetic
tgatttatcaggtgcaatttgtgaattagaacttatttgtgattgtggtattaaacaagaaagtcgtgttggtgt

SEQ ID NO: 202574 - DNA, 75 bp, Artificial Sequence
  Synthetic
tgatgctgttatgcattttggtacattagcaaagactgatctttttaatggttataagattggctgtaattgtgc

SEQ ID NO: 202575 - DNA, 75 bp, Artificial Sequence
  Synthetic
ttagcaaagactgatctttttaatggttataagattggctgtaattgtgcaggtagaattgtccattgtactaaa

SEQ ID NO: 202576 - DNA, 75 bp, Artificial Sequence
  Synthetic
ttgaatgtaccatttttgatttgttctaatactcctctgagtaaggatttacctgatgatgttgttgcagctaac

SEQ ID NO: 202577 - DNA, 75 bp, Artificial Sequence
  Synthetic
ctaatactcctctgagtaaggatttacctgatgatgttgttgcagctaacatgtttatgggtgtaggtgtaggcc

SEQ ID NO: 202578 - DNA, 75 bp, Artificial Sequence
  Synthetic
attatacacatttgaaatgtggttcaccttaccaacattatgatgcttgtagtgttaaaaaatacacaggtgtta

SEQ ID NO: 202579 - DNA, 75 bp, Artificial Sequence
  Synthetic
acatctatgttgactaattattttttggatgatgttgaaatggttgcttataaccctgatctttcacaatattat

SEQ ID NO: 202580 - DNA, 75 bp, Artificial Sequence
  Synthetic
tatactaactttaagttagttggacatgatatttgtgctcaattgaatgataagttaggttttaatgtagatttg

SEQ ID NO: 202581 - DNA, 75 bp, Artificial Sequence
  Synthetic
atgatatttgtgctcaattgaatgataagttaggttttaatgtagatttgccgtttgttgagtacaaagtaacag

SEQ ID NO: 202582 - DNA, 75 bp, Artificial Sequence
  Synthetic
tgattattctctggcttatgtggccattgactatcaccttgactatatttaattgtttttatgctttgaataatg

SEQ ID NO: 202583 - DNA, 75 bp, Artificial Sequence
  Synthetic
tctggcctgtagctactggtgatgttgttttggcatctgatgatttatatgtgaaacgttattttaaaggatgtg

SEQ ID NO: 202584 - DNA, 75 bp, Artificial Sequence
  Synthetic
tgttttggcatctgatgatttatatgtgaaacgttattttaaaggatgtgaaacttttggtaagcctgttatttg

SEQ ID NO: 202585 - DNA, 75 bp, Artificial Sequence
  Synthetic
gttttgtcatgatgaagcatcattgaattctcttacttattttaataaacctagttttaaatctgaaaatagata

SEQ ID NO: 202586 - DNA, 75 bp, Artificial Sequence
  Synthetic
aattctcttacttattttaataaacctagttttaaatctgaaaatagatatagtgttttgtctgttgattctgta

SEQ ID NO: 202587 - DNA, 75 bp, Artificial Sequence
  Synthetic
tctgaggagtcacaaggtaatgtggttactcctgttatggaatcgcagattagtactaaagaggttaagttaaag

SEQ ID NO: 202588 - DNA, 75 bp, Artificial Sequence
  Synthetic
tacagggtgtcaaacttggcactggttatactctttcagatttgcccgtatatgttactgtagctaaggtgcaag

SEQ ID NO: 202589 - DNA, 75 bp, Artificial Sequence
  Synthetic
tagtactaaagaggttaagttaaagggtgttagaaagactgttaaaatagaagatgctattattgttaatgatga

SEQ ID NO: 202590 - DNA, 75 bp, Artificial Sequence
  Synthetic
aagatgctattattgttaatgatgaaaatagttctattaaggttgttaaaagtttatctttagttgatgtttggg

SEQ ID NO: 202591 - DNA, 75 bp, Artificial Sequence
  Synthetic
agatactattgatggtgtcgttgaagacactattaatgacgatgaagatgttgttactggtgacaatgacgatga

SEQ ID NO: 202592 - DNA, 75 bp, Artificial Sequence
  Synthetic
aaatagttctattaaggttgttaaaagtttatctttagttgatgtttgggatatgtatttgacaggttgtgatta

SEQ ID NO: 202593 - DNA, 75 bp, Artificial Sequence
  Synthetic
tgttgtttgggttgctaatgaattgtcacgcctagttaaatcacccacagttagggaatatatacgatatggtat

SEQ ID NO: 202594 - DNA, 75 bp, Artificial Sequence
  Synthetic
taaagcaagagctatagaattttatggttttttgaagtggttgtttatttatgtttttagtttattacattttac

SEQ ID NO: 202595 - DNA, 75 bp, Artificial Sequence
  Synthetic
ggttttttgaagtggttgtttatttatgtttttagtttattacattttacaaatgataaaaccattttttatact

SEQ ID NO: 202596 - DNA, 75 bp, Artificial Sequence
  Synthetic
acagaaatagcttctaagtttacttttaatttgttttgtttggctcttaaaaatgcttttcagacatttagatgg

SEQ ID NO: 202597 - DNA, 75 bp, Artificial Sequence
  Synthetic
gcatctgtttctacatcttttttgcaatcaggtattgtaaagatggtatctcctacgtcaaaaattgaaccttgt

SEQ ID NO: 202598 - DNA, 75 bp, Artificial Sequence
  Synthetic
tagttcgtaagaacctctcaaagtatactatgttagatctttgctatgcattgcgccattttgattgtaatgatt

SEQ ID NO: 202599 - DNA, 75 bp, Artificial Sequence
  Synthetic
gtagctgattttgcttattggtttttaaaccagtttgatattaatgcgtatgctaattggtgttgtttaaaatgt

SEQ ID NO: 202600 - DNA, 75 bp, Artificial Sequence
  Synthetic
ttgtagccactgtgtttttgttttggtttaattttttgtatataaatgttatttttagtgacttttatcttccta

SEQ ID NO: 202601 - DNA, 75 bp, Artificial Sequence
  Synthetic
tacactggcgagggtgatcaaattattttttatgagggtgttaatttcaatcctcatcataggtttaagtgcttc

SEQ ID NO: 202602 - DNA, 75 bp, Artificial Sequence
  Synthetic
gggaagaattgttatgtggataaaggctacttttggtttggttacaatttgtgatttttattctaagttaggtgt

SEQ ID NO: 202603 - DNA, 75 bp, Artificial Sequence
  Synthetic
gctacttttggtttggttacaatttgtgatttttattctaagttaggtgtaggttttacaagtcatttttgtaat

SEQ ID NO: 202604 - DNA, 75 bp, Artificial Sequence
  Synthetic
ggtagttttatatgtgaattgtgtcattctggttttgatatgttggatacatatgcagctatagattttgttcag

SEQ ID NO: 202605 - DNA, 75 bp, Artificial Sequence
  Synthetic
ttgattatgttagtttagtcaaattaattgttgaactcgttattggttattcattatatacagtatggttttatc

SEQ ID NO: 202606 - DNA, 75 bp, Artificial Sequence
  Synthetic
aattgttgaactcgttattggttattcattatatacagtatggttttatccattattttgtcttattggtttaca

SEQ ID NO: 202607 - DNA, 75 bp, Artificial Sequence
  Synthetic
attatttactacatggttgcctgatttgtttatgttagaaactatgcattggttgattagatttattgtatttgt

SEQ ID NO: 202608 - DNA, 75 bp, Artificial Sequence
  Synthetic
ggctgatgagatcgctaatcttgttttagccaagcttggtaaagattctaaacctcagcaagttactaagcaaaa

SEQ ID NO: 202609 - DNA, 75 bp, Artificial Sequence
  Synthetic
ttgtttatgttagaaactatgcattggttgattagatttattgtatttgtagctaatatgttacctgcttttgtc

SEQ ID NO: 202610 - DNA, 75 bp, Artificial Sequence
  Synthetic
ttgttgcggttttatatagttgttactgctatgtataaagtagttggttttattaggcatattgtctatggttgt

SEQ ID NO: 202611 - DNA, 75 bp, Artificial Sequence
  Synthetic
ataaacgaaattgtagtgttcgtgttaagtgtagtactattgttggtggtgtaattcgttattatgatattactg

SEQ ID NO: 202612 - DNA, 75 bp, Artificial Sequence
  Synthetic
taagtgtagtactattgttggtggtgtaattcgttattatgatattactgctaatggtggtactggtttttgtgt

SEQ ID NO: 202613 - DNA, 75 bp, Artificial Sequence
  Synthetic
tgttaaagcttggtactaatgatcctcagtttcctattcttgcagaattagctcctacaccaggtgcttttttct

SEQ ID NO: 202614 - DNA, 75 bp, Artificial Sequence
  Synthetic
ttcaagagattgttagtgatagagaagttattttgtgttgggagacaggtaaagttaaaccaccacttaataaaa

SEQ ID NO: 202615 - DNA, 75 bp, Artificial Sequence
  Synthetic
taaacatcaatggaattgttttaattgccattcttttaaaccaggtaacacttttataactgtagaagctgctat

SEQ ID NO: 202616 - DNA, 75 bp, Artificial Sequence
  Synthetic
tacaagtggtataaagtttcaaactgttaaaccaggtaattttaaccaagatttttatgagtttgtcaaaagtaa

SEQ ID NO: 202617 - DNA, 75 bp, Artificial Sequence
  Synthetic
tgccattcttttaaaccaggtaacacttttataactgtagaagctgctatagaactttctaaagagcttaaacga

SEQ ID NO: 202618 - DNA, 75 bp, Artificial Sequence
  Synthetic
cctgtaaatccaactgatgcttcacattatgtagttactgatattaagcaagttggttgtatgatgcgtttgttc

SEQ ID NO: 202619 - DNA, 75 bp, Artificial Sequence
  Synthetic
tgtagatattaataatctgttacattctaaagttaaagttgttcctaatttgtatgtagttgtagtagagagtga

SEQ ID NO: 202620 - DNA, 75 bp, Artificial Sequence
  Synthetic
tctaaagttaaagttgttcctaatttgtatgtagttgtagtagagagtgatgctgatagagctaattttctgaat

SEQ ID NO: 202621 - DNA, 75 bp, Artificial Sequence
  Synthetic
aggatcatagtttacttgctactcttgatgatccttatgtagaagactctgttgcttaatgagaatgaatcctaa

SEQ ID NO: 202622 - DNA, 75 bp, Artificial Sequence
  Synthetic
gctgttgtgttttatgcacaatcattgtataggcctatattacttgtagacaaaaagttaattactacagcttgt

SEQ ID NO: 202623 - DNA, 75 bp, Artificial Sequence
  Synthetic
tgtataggcctatattacttgtagacaaaaagttaattactacagcttgtaatggtatctctgtaacccagacta

SEQ ID NO: 202624 - DNA, 75 bp, Artificial Sequence
  Synthetic
taaatctagtggtatggatactgccttgttaagagcttaaatctaaactattaggatgtcttatactcccggtca

SEQ ID NO: 202625 - DNA, 75 bp, Artificial Sequence
  Synthetic
tgtttgatgtttatgttgatacttttatgtctcattttgatgttgatagaaagagttttaataattttgttaata

SEQ ID NO: 202626 - DNA, 75 bp, Artificial Sequence
  Synthetic
tatgtctcattttgatgttgatagaaagagttttaataattttgttaatattgctcatgcttctcttagagaggg

SEQ ID NO: 202627 - DNA, 75 bp, Artificial Sequence
  Synthetic
tatcagaatgaattcttgctgtaataacagatagagtaggttgttacagactatatattaattagtagaaatttt

SEQ ID NO: 202628 - DNA, 75 bp, Artificial Sequence
  Synthetic
aaacatattttaaagttaatggtttatggtcacctactattacacatactaactgttggttgcgttctgtgttac

SEQ ID NO: 202629 - DNA, 75 bp, Artificial Sequence
  Synthetic
tgtgcaattagaaaaggttttagatacttttgtgggatgtgtacgtaaatgttgttccattgattcagatgttga

SEQ ID NO: 202630 - DNA, 75 bp, Artificial Sequence
  Synthetic
ttagctgtagtataaacgcctccgggaagagctatcaattgtagtgtttaatatatatattagtatatgattgaa

SEQ ID NO: 202631 - DNA, 75 bp, Artificial Sequence
  Synthetic
tcagcttacgatctcttgtcagatctcattaaatctaaactttttaaacaagattccctgttatccatgcttgtg

SEQ ID NO: 202632 - DNA, 75 bp, Artificial Sequence
  Synthetic
acttttgtgggatgtgtacgtaaatgttgttccattgattcagatgttgaaacaagatttattactaaatctatg

SEQ ID NO: 202633 - DNA, 75 bp, Artificial Sequence
  Synthetic
atatctgcagtagctgctggtttggaatttactgatgaaaattataacaatttggtacctacatatttaaagagt

SEQ ID NO: 202634 - DNA, 75 bp, Artificial Sequence
  Synthetic
gcattttttgtgttatgagtaatatgcaattatttgaatctcttaattttattactctacctttagataaaattc

SEQ ID NO: 202635 - DNA, 75 bp, Artificial Sequence
  Synthetic
aattttgttgttcacatggtgatagattctatcgccttgcgaatgaatgtgctcaagttttgagtgaaatagtta

SEQ ID NO: 202636 - DNA, 75 bp, Artificial Sequence
  Synthetic
aatttactgatgaaaattataacaatttggtacctacatatttaaagagtgataatattgtagctgctgatttag

SEQ ID NO: 202637 - DNA, 75 bp, Artificial Sequence
  Synthetic
gtgttcttatacagaatggtgctaagcatgtacagggtaatgttgctaaggcagctaatatttcttgtatatggt

SEQ ID NO: 202638 - DNA, 75 bp, Artificial Sequence
  Synthetic
caggttcacgttctcaatcacgtggacccaataatcgttcattaagtagaagtaattctaattttagacattctg

SEQ ID NO: 202639 - DNA, 75 bp, Artificial Sequence
  Synthetic
taaaaaattaggccctatttttaatagagctttacttaatactgtcatttttgcagacaccttagttgaagtagg

SEQ ID NO: 202640 - DNA, 75 bp, Artificial Sequence
  Synthetic
aacaattgcttgcttattataattttttaacagtatgtaaatggtctgtagttgttaacggtccatttttttctt

SEQ ID NO: 202641 - DNA, 75 bp, Artificial Sequence
  Synthetic
tgctgatttacagcataaattaaaaaaagcatgtgttaaaactggcttgaagttaaaattgacttttaataagca

SEQ ID NO: 202642 - DNA, 75 bp, Artificial Sequence
  Synthetic
tttatattattgtgggctttattgcctacatatagtgtttataagtctgatattcatttgcctgcttatgctagt

SEQ ID NO: 202643 - DNA, 75 bp, Artificial Sequence
  Synthetic
ctacatatagtgtttataagtctgatattcatttgcctgcttatgctagttttaaagttattgataatggtgttg

SEQ ID NO: 202644 - DNA, 75 bp, Artificial Sequence
  Synthetic
ttagagatatttcagttaatgatttatgttttgctaataaatttttccaatttgatcaatggtatgagtccactt

SEQ ID NO: 202645 - DNA, 75 bp, Artificial Sequence
  Synthetic
tgttggttaagatagatggtgactatgtttatctaccctatccagacccttctagaattttaggagctggttgtt

SEQ ID NO: 202646 - DNA, 75 bp, Artificial Sequence
  Synthetic
gttatggatgaagatatcggttctactatgtttaatgttcctactaaagttttgagacatggctttcatgtttta

SEQ ID NO: 202647 - DNA, 75 bp, Artificial Sequence
  Synthetic
gtgatagtgttcagtgctatacaccacatattcagatttcttataatgatttttatgctagtggttgtgttttat

SEQ ID NO: 202648 - DNA, 75 bp, Artificial Sequence
  Synthetic
aatcacctgaattgtttgactctcttaatttaagtgctgatactcagcacatttcaaatgattttactcctgagg

SEQ ID NO: 202649 - DNA, 75 bp, Artificial Sequence
  Synthetic
catctttgtgtactatgtttaaaagaggtgatggtacaccacatccttattgttattcagatggtgttatgaaga

SEQ ID NO: 202650 - DNA, 75 bp, Artificial Sequence
  Synthetic
tcgtgttggtgttgatgctgttatgcattttggtacattagcaaagactgatctttttaatggttataagattgg

SEQ ID NO: 202651 - DNA, 75 bp, Artificial Sequence
  Synthetic
atagagatggacagcgtgtttacgatgatgttgatgctagtttatttgtagatattaataatctgttacattcta

SEQ ID NO: 202652 - DNA, 75 bp, Artificial Sequence
  Synthetic
atgcttctttgtatacatctttggttccacatacacgttatagccttgctaattctaatggttttataagatttc

SEQ ID NO: 202653 - DNA, 75 bp, Artificial Sequence
  Synthetic
tccacatacacgttatagccttgctaattctaatggttttataagatttcctgatgttattagtgaaggtattgt

SEQ ID NO: 202654 - DNA, 75 bp, Artificial Sequence
  Synthetic
ttattgtttgtattagaagttgtttataaatattttgaaatttatgatggtggttgtataccagcatcacaagtt

SEQ ID NO: 202655 - DNA, 75 bp, Artificial Sequence
  Synthetic
ttttgaggctattttgttaaatttaaaactgcttggaataggtggcgtgccagttattgaagtctcccaaattca

SEQ ID NO: 202656 - DNA, 75 bp, Artificial Sequence
  Synthetic
acgtattgtaagaacgcgctctatgacttattgtagagtgggtgcatgtgaatacgccgaagagggtatatgttt

SEQ ID NO: 202657 - DNA, 75 bp, Artificial Sequence
  Synthetic
taattttaatagttcctgggttttgaataatgattattatagaagtatgcctggaactttttgtggtagagatct

SEQ ID NO: 202658 - DNA, 75 bp, Artificial Sequence
  Synthetic
ctggaactttttgtggtagagatctttttgatttgttttatcaattttttagtagtttaattcgtcctatagatt

SEQ ID NO: 202659 - DNA, 75 bp, Artificial Sequence
  Synthetic
tcttttctcttactgctagttctatttttggagctatattggctatagttgttgtcttggttttttattatttaa

SEQ ID NO: 202660 - DNA, 75 bp, Artificial Sequence
  Synthetic
agtggttctgatatgaattgtaatattcctactcaatgttattataataatggtagtagtggtagaatagtttat

SEQ ID NO: 202661 - DNA, 75 bp, Artificial Sequence
  Synthetic
tcctatttgtgcatgtgtttatgcttgtttttatttttatgtaacattgtattttccttctgaaattagtgtaat

SEQ ID NO: 202662 - DNA, 75 bp, Artificial Sequence
  Synthetic
tgtttttatttttatgtaacattgtattttccttctgaaattagtgtaattatgcatttgcaatggattgttatg

SEQ ID NO: 202663 - DNA, 75 bp, Artificial Sequence
  Synthetic
gatactgttaaccctgattcttttaatttgtatggttattctgttacaccatttggttcttgtatatattggtca

SEQ ID NO: 202664 - DNA, 75 bp, Artificial Sequence
  Synthetic
tatggtgctataatgcctttttggttttgtgtcacatatgtagctatggttattgcaaaccatgttttatggtta

SEQ ID NO: 202665 - DNA, 75 bp, Artificial Sequence
  Synthetic
tttgtgtcacatatgtagctatggttattgcaaaccatgttttatggttattttcatattgtaggaaaattggtg

SEQ ID NO: 202666 - DNA, 75 bp, Artificial Sequence
  Synthetic
ttaatgtatgtagtgatagtacatttgaagaaacatctcttactacttttatgattactaaagattcttattgta

SEQ ID NO: 202667 - DNA, 75 bp, Artificial Sequence
  Synthetic
tgaagaaacatctcttactacttttatgattactaaagattcttattgtagattaaagaattctgtttctgatgt

SEQ ID NO: 202668 - DNA, 75 bp, Artificial Sequence
  Synthetic
tgcctacaatagatatttgagtttgtataataagtatcgttactatagtggtaaaatggatactgctgcctatag

SEQ ID NO: 202669 - DNA, 75 bp, Artificial Sequence
  Synthetic
gtaaaatggatactgctgcctatagagaagcggcgtgttctcagttagctaaagctatggaaacatttaatcaca

SEQ ID NO: 202670 - DNA, 75 bp, Artificial Sequence
  Synthetic
ataatggtaatgatgtcttataccaacctcctacagcatctgtttctacatcttttttgcaatcaggtattgtaa

SEQ ID NO: 202671 - DNA, 75 bp, Artificial Sequence
  Synthetic
cttttaaaactgttttagtaagtcctggtttgtgtatatcaggtgatgtaggtattgcacctaaacaagggtatt

SEQ ID NO: 202672 - DNA, 75 bp, Artificial Sequence
  Synthetic
tatggtagtatgactttgaatggtttatggttagatgacaaagtttattgtcctcgtcatgttatatgttcatcc

SEQ ID NO: 202673 - DNA, 75 bp, Artificial Sequence
  Synthetic
aggtgattttactataatgtctggtcggatgagtttaacagttgtgtcttaccagatgcagggctgtcaacttgt

SEQ ID NO: 202674 - DNA, 75 bp, Artificial Sequence
  Synthetic
tttgacagtctctttacaaaatccttacactccaaaatatacttttggtaatgttaaacctggtgaaacttttac

SEQ ID NO: 202675 - DNA, 75 bp, Artificial Sequence
  Synthetic
atgttaaacctggtgaaacttttactgttttagctgcgtataatggccgaccacaaggggcatttcatgttacta

SEQ ID NO: 202676 - DNA, 75 bp, Artificial Sequence
  Synthetic
ttcttttttgtgtgggtcatgtggatctgttggttatgtattaacaggtgatagtgttaagtttgtatatatgca

SEQ ID NO: 202677 - DNA, 75 bp, Artificial Sequence
  Synthetic
tctgttggttatgtattaacaggtgatagtgttaagtttgtatatatgcatcaattagagctcagtactggttgt

SEQ ID NO: 202678 - DNA, 75 bp, Artificial Sequence
  Synthetic
acatcatttcctactaatatagctgttgaattgtttacaaaacgtagtatccggcaccaccctgaacttaagatt

SEQ ID NO: 202679 - DNA, 75 bp, Artificial Sequence
  Synthetic
ttgcttggctctatgcagctatacttaataattgtgcttggtttgtacaaaatgatgtttgttctactgaagatt

SEQ ID NO: 202680 - DNA, 75 bp, Artificial Sequence
  Synthetic
ttgtcacactggtactgattttaatggtaatttttatggtccatatagagatgctcaagttgtacagttgccagt

SEQ ID NO: 202681 - DNA, 75 bp, Artificial Sequence
  Synthetic
aagttgaagctactggcttatttgctgagagagattgttatatatttaaaagaactgttgctaaagctcctcctg

SEQ ID NO: 202682 - DNA, 75 bp, Artificial Sequence
  Synthetic
tagttgaagctactggcttatttgctgagagagattgttatatatttaaaagaactgttgctaaagctcctcctg

SEQ ID NO: 202683 - DNA, 75 bp, Artificial Sequence
  Synthetic
cagttgaagctactggcttatttgctgagagagattgttatatatttaaaagaactgttgctaaagctcctcctg

SEQ ID NO: 202684 - DNA, 75 bp, Artificial Sequence
  Synthetic
gagttgaagctactggcttatttgctgagagagattgttatatatttaaaagaactgttgctaaagctcctcctg

SEQ ID NO: 202685 - DNA, 75 bp, Artificial Sequence
  Synthetic
ttaatgtttgggctatggcaaatggttttagccaagtaaaagcagatcttgttttagatgctttggcttcaatga

SEQ ID NO: 202686 - DNA, 75 bp, Artificial Sequence
  Synthetic
gatttgtatggtcaatggtatgattttggtgattttatacaaacagccccaggatttggtgtggcagttgcagat

SEQ ID NO: 202687 - DNA, 75 bp, Artificial Sequence
  Synthetic
gaagttgtacttttgaagatgaattggcaccttctgacgtttatcaacaattggctggtgttaaattgcaatcta

SEQ ID NO: 202688 - DNA, 75 bp, Artificial Sequence
  Synthetic
ggcaccttctgacgtttatcaacaattggctggtgttaaattgcaatctaaaacaaaaagatttattaaagaaac

SEQ ID NO: 202689 - DNA, 75 bp, Artificial Sequence
  Synthetic
aggatttggtgtggcagttgcagattcttactattcttatatgatgcctatgttgactatgtgtcatgtattaga

SEQ ID NO: 202690 - DNA, 75 bp, Artificial Sequence
  Synthetic
aatttattggattttgatatctacatttttgtttagttgtataatttctgcatttgttaaatggactatatttat

SEQ ID NO: 202691 - DNA, 75 bp, Artificial Sequence
  Synthetic
tttttgtttagttgtataatttctgcatttgttaaatggactatatttatgtatattaatacacatatgattggt

SEQ ID NO: 202692 - DNA, 75 bp, Artificial Sequence
  Synthetic
gttacattatgtgtactttgttttgttagttttatgatgttactagttaaacataagcatttttatttgactatg

SEQ ID NO: 202693 - DNA, 75 bp, Artificial Sequence
  Synthetic
tgctttcggagtacccctttctgaagcaaaaggatattggtatagacacagccggcgttcttttaaaacagctga

SEQ ID NO: 202694 - DNA, 75 bp, Artificial Sequence
  Synthetic
ttatgaagtattttatggttgtattttatgtgtttttgctatttttataactatgcatagtattaatcatgacat

SEQ ID NO: 202695 - DNA, 75 bp, Artificial Sequence
  Synthetic
agaatagttactttaatttctatgtggtattttggttcgaatttagaagaggatgttttgttatttattacagcc

SEQ ID NO: 202696 - DNA, 75 bp, Artificial Sequence
  Synthetic
ctattttgtcattagctatagcaaaaattgttgctaattggttgtctgttaatatattttattttacagatgtac

SEQ ID NO: 202697 - DNA, 75 bp, Artificial Sequence
  Synthetic
ttacttatttatagggtatattttatcttgttattggggatttttctctcttttaaacagtgtttttagaatgcc

SEQ ID NO: 202698 - DNA, 75 bp, Artificial Sequence
  Synthetic
gcgttcttttaaaacagctgatggtcaacaaaagcagttgttaccgagatggtatttctactatctcggtaccgg

SEQ ID NO: 202699 - DNA, 75 bp, Artificial Sequence
  Synthetic
tcttgttattggggatttttctctcttttaaacagtgtttttagaatgcctatgggtgtttataattataaaatt

SEQ ID NO: 202700 - DNA, 75 bp, Artificial Sequence
  Synthetic
tctgttcaagaattgcgttatatgaatgctaatggcttacgtccacctcgtaatagttttgaggctattttgtta

SEQ ID NO: 202701 - DNA, 75 bp, Artificial Sequence
  Synthetic
aattcaatcaaaattgactgatgtgaaatgtgctaatgttgttttgttaaattgtttacagcatttgcatgttgc

SEQ ID NO: 202702 - DNA, 75 bp, Artificial Sequence
  Synthetic
tgttttgcctcaaggtggttatgtagctgattttgcttattggtttttaaaccagtttgatattaatgcgtatgc

SEQ ID NO: 202703 - DNA, 75 bp, Artificial Sequence
  Synthetic
ttttgataagcttgctcaattattgattgttttattcgccaatcctgctgcagttgatactaagtgtcttgcaag

SEQ ID NO: 202704 - DNA, 75 bp, Artificial Sequence
  Synthetic
gttcaagatagtaccgttttgcaggctttgcaaagtgagtttgtaaatatggctagttttgttgaatatgaagtc

SEQ ID NO: 202705 - DNA, 75 bp, Artificial Sequence
  Synthetic
ctttgcaaagtgagtttgtaaatatggctagttttgttgaatatgaagtcgcaaagaaaaatttggctgatgcta

SEQ ID NO: 202706 - DNA, 75 bp, Artificial Sequence
  Synthetic
aaaatagtggttctgttaatcaacaacagataaaacagttagaaaaagcatgtaatatagctaagtctgtgtatg

SEQ ID NO: 202707 - DNA, 75 bp, Artificial Sequence
  Synthetic
cttactaacatgtataaagaggctcggattaatgataagaagagtaaagttgtttccgctttgcagacaatgctt

SEQ ID NO: 202708 - DNA, 75 bp, Artificial Sequence
  Synthetic
ctaatactttaactataataataccagataaacaagtttttgataaagttgttgataatgtttatgttacatatg

SEQ ID NO: 202709 - DNA, 75 bp, Artificial Sequence
  Synthetic
tcctcattggaattctgatcaagctattacattcttaaaagaatggaatttctctttgggtgtaatattacttct

SEQ ID NO: 202710 - DNA, 75 bp, Artificial Sequence
  Synthetic
tgcgaacaggtataatgaagttgctaatgctgttatgcagaataatgagttgatgcctcataaattaaaaataca

SEQ ID NO: 202711 - DNA, 75 bp, Artificial Sequence
  Synthetic
ctagtgttgaaacagaaacatattttaaagttaatggtttatggtcacctactattacacatactaactgttggt

SEQ ID NO: 202712 - DNA, 75 bp, Artificial Sequence
  Synthetic
attataataatggtagtagtggtagaatagtttatgctgttcttagtgatgttgatggtcttaagtatactaaga

SEQ ID NO: 202713 - DNA, 75 bp, Artificial Sequence
  Synthetic
gttgatggtcttaagtatactaagataatgaaagatgatggaaattgtgttgttttagagcttgatcctccttgt

SEQ ID NO: 202714 - DNA, 75 bp, Artificial Sequence
  Synthetic
taattttttgtatataaatgttatttttagtgacttttatcttcctaatattagtgtttttcctatttttgtggg

SEQ ID NO: 202715 - DNA, 75 bp, Artificial Sequence
  Synthetic
tgttttagagcttgatcctccttgtaaattttctatacaagatgttaagggacttaaaattaagtatctttattt

SEQ ID NO: 202716 - DNA, 75 bp, Artificial Sequence
  Synthetic
gacttaaaattaagtatctttattttattaaaggatgtaacactttagctagagggtgggttgttggtactttat

SEQ ID NO: 202717 - DNA, 75 bp, Artificial Sequence
  Synthetic
cttcaacaattagattgcaggctggtgttgctactgagtatgcagctaattcttctatactttcattatgtgcat

SEQ ID NO: 202718 - DNA, 75 bp, Artificial Sequence
  Synthetic
tgttgctactgagtatgcagctaattcttctatactttcattatgtgcattttctgtagatcctaagaaaactta

SEQ ID NO: 202719 - DNA, 75 bp, Artificial Sequence
  Synthetic
tttagattatatacaacaaggtggtgtacctataattaattgtgttaaaatgctctgtgatcatgctggtactgg

SEQ ID NO: 202720 - DNA, 75 bp, Artificial Sequence
  Synthetic
gtggtgcctctgtttgtatttattgccgtgcacgtgtagagcatccagatgtagatggtatatgtaaattacgtg

SEQ ID NO: 202721 - DNA, 75 bp, Artificial Sequence
  Synthetic
ttactggtgacaatgacgatgaagatgttgttactggtgacaatgacgatgaagagattgttactggtgacaatg

SEQ ID NO: 202722 - DNA, 75 bp, Artificial Sequence
  Synthetic
ttcctgtgtaggttcaagtgtcgctgttcaatctaaagatttaaattttttaaacgggttcggggtactagtgtg

SEQ ID NO: 202723 - DNA, 75 bp, Artificial Sequence
  Synthetic
atgaccaaattgttgttactggtgatgatgtagatgatattgaaagtgtctatgattttgatacttataaagctc

SEQ ID NO: 202724 - DNA, 75 bp, Artificial Sequence
  Synthetic
gttcaatctaaagatttaaattttttaaacgggttcggggtactagtgtgaatgcccggctagtaccctgtgcta

SEQ ID NO: 202725 - DNA, 75 bp, Artificial Sequence
  Synthetic
gtggtttatctactgatgttcaattaagggcatttgatatttgtaataccaatagagctggtataggtttatatt

SEQ ID NO: 202726 - DNA, 75 bp, Artificial Sequence
  Synthetic
aatctaaatctaaacattatgaataaatctttttttcctcaatttacttctgatcaagctgttacattcttaaaa

SEQ ID NO: 202727 - DNA, 75 bp, Artificial Sequence
  Synthetic
agagaaaacttattatgagttgactaaaagttgtggtgttgtggctgaacatgatttctttacatttgatattga

SEQ ID NO: 202728 - DNA, 75 bp, Artificial Sequence
  Synthetic
atattgtgtgaaattctttgtgagtatgctgattgtaaagaatcctacttttctaagaaagattggtatgatttt

SEQ ID NO: 202729 - DNA, 75 bp, Artificial Sequence
  Synthetic
gttgaaaatcctgatattattaatatatataaaaaattaggccctatttttaatagagctttacttaatactgtc

SEQ ID NO: 202730 - DNA, 75 bp, Artificial Sequence
  Synthetic
taatagagctttacttaatactgtcatttttgcagacaccttagttgaagtaggtttagttggtgttttaacttt

SEQ ID NO: 202731 - DNA, 75 bp, Artificial Sequence
  Synthetic
taggtttagttggtgttttaactttagataaccaagatttgtatggtcaatggtatgattttggtgattttatac

SEQ ID NO: 202732 - DNA, 75 bp, Artificial Sequence
  Synthetic
atgatgcctatgttgactatgtgtcatgtattagattgtgaattatttgttaatgatagttatagacaattcgat

SEQ ID NO: 202733 - DNA, 75 bp, Artificial Sequence
  Synthetic
ttttaagtattggggtatgaagtatcatcctaatactgtggattgtgataatgataggtgtattattcattgtgc

SEQ ID NO: 202734 - DNA, 75 bp, Artificial Sequence
  Synthetic
catcctaatactgtggattgtgataatgataggtgtattattcattgtgctaattttaatatactatttagtatg

SEQ ID NO: 202735 - DNA, 75 bp, Artificial Sequence
  Synthetic
gttttacctaatacttgttttggtccccttgttagacaaatttttgtagatggtgtaccgtttgttgtttctatt

SEQ ID NO: 202736 - DNA, 75 bp, Artificial Sequence
  Synthetic
gatttacttctttatgcagcagatcctgctatgcatgttgcatctgctagtgctctgcttgatttacgaacttgt

SEQ ID NO: 202737 - DNA, 75 bp, Artificial Sequence
  Synthetic
tgtttaaagagggtagtacagttgatttgaaacattttttctttactcaagatggtaatgctgcaattactgatt

SEQ ID NO: 202738 - DNA, 75 bp, Artificial Sequence
  Synthetic
tttgaaacattttttctttactcaagatggtaatgctgcaattactgattataattattataagtataatttacc

SEQ ID NO: 202739 - DNA, 75 bp, Artificial Sequence
  Synthetic
tactatggttgatattaagcagttattgtttgtattagaagttgtttataaatattttgaaatttatgatggtgg

SEQ ID NO: 202740 - DNA, 75 bp, Artificial Sequence
  Synthetic
gttgtcacactggcactgattttactggtaatttttatggtccatatagagatgctcaagttgtacagttgccag

SEQ ID NO: 202741 - DNA, 75 bp, Artificial Sequence
  Synthetic
gtagtaatgatgtatggatttttaacaaggtgaggttttatcgtgcgttatattctaatatggctctttttcgct

SEQ ID NO: 202742 - DNA, 75 bp, Artificial Sequence
  Synthetic
gttaataattatgataaaagtgctggttatccatttaataaatttggtaaagccagactttattatgaggcatta

SEQ ID NO: 202743 - DNA, 75 bp, Artificial Sequence
  Synthetic
agccagactttattatgaggcattatcatttgaagaacagaatgaaatttatgcatatactaaacgtaatgttct

SEQ ID NO: 202744 - DNA, 75 bp, Artificial Sequence
  Synthetic
atgcatatactaaacgtaatgttctgcccaccttaactcaaatgaatttaaaatatgctatcagtgctaagaata

SEQ ID NO: 202745 - DNA, 75 bp, Artificial Sequence
  Synthetic
gagctcgcactgtagcaggtgtttctattcttagtactatgacaggccgaatgttccatcaaaaatgtttgaaga

SEQ ID NO: 202746 - DNA, 75 bp, Artificial Sequence
  Synthetic
gtatagcagctacccgaggtgttcctgttgttataggaaccactaaattttatggtggttgggacgatatgttac

SEQ ID NO: 202747 - DNA, 75 bp, Artificial Sequence
  Synthetic
tgttgttataggaaccactaaattttatggtggttgggacgatatgttacgtcatcttataaaggatgttgacaa

SEQ ID NO: 202748 - DNA, 75 bp, Artificial Sequence
  Synthetic
gtttcctattcttgcagaattagctcctacaccaggtgcttttttctttggttctaaattagacttggttaaaag

SEQ ID NO: 202749 - DNA, 75 bp, Artificial Sequence
  Synthetic
ccctgttcttatgggttgggattatcctaaatgtgatcgtgctatgccaaatattttgcgtattgttagtagttt

SEQ ID NO: 202750 - DNA, 75 bp, Artificial Sequence
  Synthetic
aaagatgtttttgaacttcattattctggttctattaggtttgatagtactttaccaggctttgagacaattatg

SEQ ID NO: 202751 - DNA, 75 bp, Artificial Sequence
  Synthetic
atcgccttgcgaatgaatgtgctcaagttttgagtgaaatagttatgtgtggcggttgctattatgttaagcctg

SEQ ID NO: 202752 - DNA, 75 bp, Artificial Sequence
  Synthetic
cttatgttaattctaatcagaacactgattctgattcgttgagttctaaacctcagcgtaaaagaggtgttaaac

SEQ ID NO: 202753 - DNA, 75 bp, Artificial Sequence
  Synthetic
tggccataagattgaagatttaagtatacgcaatttacaaaaacgcttatactctaatgtttatcgtacagatta

SEQ ID NO: 202754 - DNA, 75 bp, Artificial Sequence
  Synthetic
atacgcaatttacaaaaacgcttatactctaatgtttatcgtacagattatgttgattatacatttgttaatgag

SEQ ID NO: 202755 - DNA, 75 bp, Artificial Sequence
  Synthetic
gtactatcagaataatgtttttatgtctgaatctaaatgttgggttgaaaatgatattactaatggtcctcatga

SEQ ID NO: 202756 - DNA, 75 bp, Artificial Sequence
  Synthetic
ggcttcaatgacaggtgtttctattgaaaccttattggctgctattaagcgtctatatatgggatttcaaggtcg

SEQ ID NO: 202757 - DNA, 75 bp, Artificial Sequence
  Synthetic
actctgtaccttgttttatgtaaattatttagttgtttataaggaaggttttagaggttttacttatgtctggct

SEQ ID NO: 202758 - DNA, 75 bp, Artificial Sequence
  Synthetic
gagctatcaattgtagtgtttaatatatatattagtatatgattgaaattaattatagccttttggaggaattac

SEQ ID NO: 202759 - DNA, 75 bp, Artificial Sequence
  Synthetic
taaagatggtttatgtatgttttggaattgtaatgttgataaatatccatctaattcaattgtttgtagatttga

SEQ ID NO: 202760 - DNA, 75 bp, Artificial Sequence
  Synthetic
gatgatttattgaagactgacagtgttcttttgatagagcgctttgtaagtctagctatagatgcttacccttta

SEQ ID NO: 202761 - DNA, 75 bp, Artificial Sequence
  Synthetic
aaaaagtctttcgtgtatatttagaatatataaaaaaactgtataatgatcttggtactcagatcttagatagtt

SEQ ID NO: 202762 - DNA, 75 bp, Artificial Sequence
  Synthetic
atatataaaaaaactgtataatgatcttggtactcagatcttagatagttatagtgttattttaagtacttgtga

SEQ ID NO: 202763 - DNA, 75 bp, Artificial Sequence
  Synthetic
gtgccgtgatgcagagtgtaggtgcatgtgttgtttgttcatcacaaacttctttgcgttgtggcagttgtatac

SEQ ID NO: 202764 - DNA, 75 bp, Artificial Sequence
  Synthetic
gtaagcctttgttatgttgtaaatgttgttatgaccatgttatggcaactaatcataaatatgttttgagtgtct

SEQ ID NO: 202765 - DNA, 75 bp, Artificial Sequence
  Synthetic
attgtgaaaaccataaaccccattattcatttaagttagttatgaatggtatggtctttggtttgtataaacaat

SEQ ID NO: 202766 - DNA, 75 bp, Artificial Sequence
  Synthetic
tgattttaataagatagctagttgtaaatggacagaagttgatgattatgttctggcaaatgagtgtattgaacg

SEQ ID NO: 202767 - DNA, 75 bp, Artificial Sequence
  Synthetic
tcaagagattgttagtgatagagaagttattttgtgttgggagacaggtaaagttaaaccaccacttaataaaaa

SEQ ID NO: 202768 - DNA, 75 bp, Artificial Sequence
  Synthetic
actagtactggtaagacagttttaggtgagtatgtttttgataaaagtgaattaactaacggtgtgtattaccgc

SEQ ID NO: 202769 - DNA, 75 bp, Artificial Sequence
  Synthetic
gtgagtatgtttttgataaaagtgaattaactaacggtgtgtattaccgcgctacaactacttataaactttcta

SEQ ID NO: 202770 - DNA, 75 bp, Artificial Sequence
  Synthetic
taggtgatgtttttgttttaacatcacattctgtagctagtttaagtgcacctacacttgtcccacaagagaact

SEQ ID NO: 202771 - DNA, 75 bp, Artificial Sequence
  Synthetic
acattctgtagctagtttaagtgcacctacacttgtcccacaagagaactatgctagtataagattttctagtgt

SEQ ID NO: 202772 - DNA, 75 bp, Artificial Sequence
  Synthetic
acttttaatttgttttgtttggctcttaaaaatgcttttcagacatttagatggagtatatttataaaaggtttt

SEQ ID NO: 202773 - DNA, 75 bp, Artificial Sequence
  Synthetic
ttatagtgttccattggtgtttcaaaataatgttgctaattatcagcacattggaatgaaacgttattgcactgt

SEQ ID NO: 202774 - DNA, 75 bp, Artificial Sequence
  Synthetic
ttggaatgaaacgttattgcactgttcaaggtccccctggtacgggaaagtctcatcttgctataggtctagctg

SEQ ID NO: 202775 - DNA, 75 bp, Artificial Sequence
  Synthetic
tttattactacacagcacgtgtagtttatactgctgctagtcatgctgctgtagatgcattgtgtgaaaaagctt

SEQ ID NO: 202776 - DNA, 75 bp, Artificial Sequence
  Synthetic
tacacgtattattcctgctaaagttcgtgtagattgttatgataagtttaaaattaatgataccacttgtaagta

SEQ ID NO: 202777 - DNA, 75 bp, Artificial Sequence
  Synthetic
aaattaatgataccacttgtaagtatgtttttaccacaataaatgcattaccagagttggttacagatattgttg

SEQ ID NO: 202778 - DNA, 75 bp, Artificial Sequence
  Synthetic
ttgttgatgaagttagtatgcttactaattatgaattgtctgttataaatgctcgtattaaagctaaacattatg

SEQ ID NO: 202779 - DNA, 75 bp, Artificial Sequence
  Synthetic
acctgcaccacgtgtgctgttgagcaagggttctttagaacctaggcacttcaattctattactaaaataatgtg

SEQ ID NO: 202780 - DNA, 75 bp, Artificial Sequence
  Synthetic
aaaacttaagcgtgcttttggagattatactagtgttgtagttataaatgttattgtttggtgtattaattttct

SEQ ID NO: 202781 - DNA, 75 bp, Artificial Sequence
  Synthetic
cacaaacagcagaaacagcccattctgttaatgttaatcgatttaatgttgccataactagagccaagaagggca

SEQ ID NO: 202782 - DNA, 75 bp, Artificial Sequence
  Synthetic
attatttgaatctcttaattttattactctacctttagataaaattcaaaatcaaactttacctcgtttgcattg

SEQ ID NO: 202783 - DNA, 75 bp, Artificial Sequence
  Synthetic
agttcatttgggtttgatcagcaacaattgcttgcttattataattttttaacagtatgtaaatggtctgtagtt

SEQ ID NO: 202784 - DNA, 75 bp, Artificial Sequence
  Synthetic
atcaaactttacctcgtttgcattgcacaactaatctttttaaagattgtagtaaaagttgcttaggttatcatc

SEQ ID NO: 202785 - DNA, 75 bp, Artificial Sequence
  Synthetic
cagcgcatgccccctcatttttagcagttgatgataaatataaggttaatgaaaatttggctgtaaatttaaata

SEQ ID NO: 202786 - DNA, 75 bp, Artificial Sequence
  Synthetic
agttgatgataaatataaggttaatgaaaatttggctgtaaatttaaatatttgtgaacctgttttaacatattc

SEQ ID NO: 202787 - DNA, 75 bp, Artificial Sequence
  Synthetic
tttctgctgtttattataatagttggcaaaatcttttgtatgattctaatggcaacattattggttttaaagatt

SEQ ID NO: 202788 - DNA, 75 bp, Artificial Sequence
  Synthetic
ttgcggttttatatagttgttactgctatgtataaagtagttggttttattaggcatattgtctatggttgtaat

SEQ ID NO: 202789 - DNA, 75 bp, Artificial Sequence
  Synthetic
tcgtttaatatctcttatgggttttaaattagatttgactcttgatggttattctaaattgtttattactaaaga

SEQ ID NO: 202790 - DNA, 75 bp, Artificial Sequence
  Synthetic
cctcgtcatgttatatgtttatcctctaatatgaatgaacctgattattctgccttattatgtagagttactcta

SEQ ID NO: 202791 - DNA, 75 bp, Artificial Sequence
  Synthetic
tgaagccattaaacgtgttagaggttgggttggttttgatgttgaaggcgctcatgctactcgcgaaaacattgg

SEQ ID NO: 202792 - DNA, 75 bp, Artificial Sequence
  Synthetic
ttgacagtctctttacaaaatccttacactccaaaatatacttttggtgttgttaaacctggtgaaacttttact

SEQ ID NO: 202793 - DNA, 75 bp, Artificial Sequence
  Synthetic
aaaaatttaaacatttaataccccttatgtcaaaaggtcaaaagtgggatattgttagaattagaattgttcaaa

SEQ ID NO: 202794 - DNA, 75 bp, Artificial Sequence
  Synthetic
ttctgatagtgtagtatttattacttggtctgccagttttgaacttacttgtttaaggtattttgctaaattagg

SEQ ID NO: 202795 - DNA, 75 bp, Artificial Sequence
  Synthetic
tggtctgccagttttgaacttacttgtttaaggtattttgctaaattaggcagagagcttaattgtaatgtgtgt

SEQ ID NO: 202796 - DNA, 75 bp, Artificial Sequence
  Synthetic
tctaatcgtgctacatgctacaattctagaactggttattatggttgttggcgccatagttatacttgtgattat

SEQ ID NO: 202797 - DNA, 75 bp, Artificial Sequence
  Synthetic
ctagaactggttattatggttgttggcgccatagttatacttgtgattatgtgtataatccacttattgtagata

SEQ ID NO: 202798 - DNA, 75 bp, Artificial Sequence
  Synthetic
tcacaggctatcattttactagtactggtaagacagttttaggtgagtatgtttttgataaaagtgaattaacta

SEQ ID NO: 202799 - DNA, 75 bp, Artificial Sequence
  Synthetic
tgctccatggtggtggagttgcaaaagctatagctgtagctgcaggtaaaaaattttctaaagaaactgctgcta

SEQ ID NO: 202800 - DNA, 75 bp, Artificial Sequence
  Synthetic
ttttgtaaatctgttaattggaatttagagtatccaataatttctaatgaggtcagtataaatacatcttgtagg

SEQ ID NO: 202801 - DNA, 75 bp, Artificial Sequence
  Synthetic
ttattgcagcgtgtcatgcttaaagctgccatgctatgtaatagatacaacttatgttatgacataggcaatcct

SEQ ID NO: 202802 - DNA, 75 bp, Artificial Sequence
  Synthetic
aagataattttaaagatggtttatgtatgttttggaattgtaatgttgataaatatccatctaattcaattgttt

SEQ ID NO: 202803 - DNA, 75 bp, Artificial Sequence
  Synthetic
taaattaaaccttcctggatgtaatggtggtagtttgtatgttaataaacatgcattccatactaatccttttac

SEQ ID NO: 202804 - DNA, 75 bp, Artificial Sequence
  Synthetic
cctatgccttttttctattattcagatacgccttgtgtgtacgtagatggtttagaatctaaacaagttgattac

SEQ ID NO: 202805 - DNA, 75 bp, Artificial Sequence
  Synthetic
atacgccttgtgtgtacgtagatggtttagaatctaaacaagttgattacgttcctttaagaagcgccacttgta

SEQ ID NO: 202806 - DNA, 75 bp, Artificial Sequence
  Synthetic
tcacacggtgtaatctaggtggagctgtttgttcaaagcatgctgaagaatattgtaactaccttgagtcttata

SEQ ID NO: 202807 - DNA, 75 bp, Artificial Sequence
  Synthetic
tgtttgttcaaagcatgctgaagaatattgtaactaccttgagtcttataatatagttactacagcaggctttac

SEQ ID NO: 202808 - DNA, 75 bp, Artificial Sequence
  Synthetic
tttttgggtttataagaattttgatttttataatttatggaacacttttactacgttacagagtttagaaaacgt

SEQ ID NO: 202809 - DNA, 75 bp, Artificial Sequence
  Synthetic
ttaataaaacttaagcgtgcttttggagattatactagtgttgtagttataaatgttattgtttggtgtattaat

SEQ ID NO: 202810 - DNA, 75 bp, Artificial Sequence
  Synthetic
aaaaggttttcttgttgtagccactgtgtttttgttttggtttaattttttgtatataaatgttatttttagtga

SEQ ID NO: 202811 - DNA, 75 bp, Artificial Sequence
  Synthetic
agttgttgttaagattaataatgtagatactgttatttttaaaaataatacatcatttcctactaatatagctgt

SEQ ID NO: 202812 - DNA, 75 bp, Artificial Sequence
  Synthetic
cggcaccaccctgaacttaagattcttagaaatttgaacattgatatttgttggaagcatgtcctgtgggattat

SEQ ID NO: 202813 - DNA, 75 bp, Artificial Sequence
  Synthetic
gcaacaattgcttgcttactataattttttaacagtatgtaaatggtctgtagttgttaacggtccatttttttc

SEQ ID NO: 202814 - DNA, 75 bp, Artificial Sequence
  Synthetic
ttagaaatttgaacattgatatttgttggaagcatgtcctgtgggattatgttaaagatagtttgttttgtagtt

SEQ ID NO: 202815 - DNA, 75 bp, Artificial Sequence
  Synthetic
ccacttatggtgtttgtaaatacacagatttgaagttcatcgaaaatttgaatatactttttgatggtcgtgaca

SEQ ID NO: 202816 - DNA, 75 bp, Artificial Sequence
  Synthetic
agatttgaagttcatcgaaaatttgaatatactttttgatggtcgtgacactggcgctttagaagcttttagaaa

SEQ ID NO: 202817 - DNA, 75 bp, Artificial Sequence
  Synthetic
tctaattctaggttgtggcagtattgtagtattttacataatgaaatactatctacttcagatttaagtgtagct

SEQ ID NO: 202818 - DNA, 75 bp, Artificial Sequence
  Synthetic
agcaagaaatggtgtttttattagtactgaaaaattaagtaggttatcaatgattaaaggtccgcaacgagctga

SEQ ID NO: 202819 - DNA, 75 bp, Artificial Sequence
  Synthetic
actgaaaaattaagtaggttatcaatgattaaaggtccgcaacgagctgatttaaatggtgtgattgtggataaa

SEQ ID NO: 202820 - DNA, 75 bp, Artificial Sequence
  Synthetic
gttggagaactcaaagttgagttttggttcgctatgagaaaagatggtgacgatgttatcttcagccgaacagac

SEQ ID NO: 202821 - DNA, 75 bp, Artificial Sequence
  Synthetic
gcccacaaggtaatctaggtggtaattgcgcgggtaatgtcattggtaatgatgctctaacacgttttactatct

SEQ ID NO: 202822 - DNA, 75 bp, Artificial Sequence
  Synthetic
ttgcgcgggtaatgtcattggtaatgatgctctaacacgttttactatctttactcagagtcgtgtattgtcaag

SEQ ID NO: 202823 - DNA, 75 bp, Artificial Sequence
  Synthetic
ttttgaacctcgctcagatttagaacgggattttattgatatggatgataatctgtttattgctaaatatggttt

SEQ ID NO: 202824 - DNA, 75 bp, Artificial Sequence
  Synthetic
cgggattttattgatatggatgataatctgtttattgctaaatatggtttagaagactatgcatttgatcatata

SEQ ID NO: 202825 - DNA, 75 bp, Artificial Sequence
  Synthetic
tctaatttgttaattcaagagtttttacagtatgattctagtattcattcatattttattactgatcaggagtgt

SEQ ID NO: 202826 - DNA, 75 bp, Artificial Sequence
  Synthetic
atattttattactgatcaggagtgtggtagtagtaagagtgtttgtacagttattgatttattattagatgattt

SEQ ID NO: 202827 - DNA, 75 bp, Artificial Sequence
  Synthetic
ggtagtagtaagagtgtttgtacagttattgatttattattagatgattttgtttctattgttaagtcattaaat

SEQ ID NO: 202828 - DNA, 75 bp, Artificial Sequence
  Synthetic
tggacagcgtgtttacgatgatgttgatgctagtttatttgtagatattaataatctgttacattctaaagttaa

SEQ ID NO: 202829 - DNA, 75 bp, Artificial Sequence
  Synthetic
ttgagttgtgttagtaaagttgttaatattaatgttgattttaaggattttcaatttatgttgtggtgtaatgat

SEQ ID NO: 202830 - DNA, 75 bp, Artificial Sequence
  Synthetic
tcaatttatgttgtggtgtaatgataataaaattatgactttttatcctaaaatgcaagccactaatgattggaa

SEQ ID NO: 202831 - DNA, 75 bp, Artificial Sequence
  Synthetic
acctggctattctatgcctgttttgtataagtatttgaatgttccattagagagagtctctttatggaattatgg

SEQ ID NO: 202832 - DNA, 75 bp, Artificial Sequence
  Synthetic
tataagtatttgaatgttccattagagagagtctctttatggaattatggtaaacctattaatttgcctacaggc

SEQ ID NO: 202833 - DNA, 75 bp, Artificial Sequence
  Synthetic
tggtgatgcccacgaaggtatcttctgggtcgctagtcaccaagctgacacttctattccctccgatgtttcggc

SEQ ID NO: 202834 - DNA, 75 bp, Artificial Sequence
  Synthetic
ggtctgataaagaagtagctccaggttctgctgttttaagacagtggttaccatctggtagtattcttgtagata

SEQ ID NO: 202835 - DNA, 75 bp, Artificial Sequence
  Synthetic
actctttatgttaaaaactggtgtagatgttcttgtctacctgaccccatttctacttattctcctaacacatgt

SEQ ID NO: 202836 - DNA, 75 bp, Artificial Sequence
  Synthetic
attgggatttgataatatctgatatgtatgatcctcttactaaaaatattggtgattataatgtgagtaaggatg

SEQ ID NO: 202837 - DNA, 75 bp, Artificial Sequence
  Synthetic
gtttttttacttacatttgtcatttaattcgtgataaattatctttgggtggtagtgtagctataaaaattacag

SEQ ID NO: 202838 - DNA, 75 bp, Artificial Sequence
  Synthetic
aattcgtgataaattatctttgggtggtagtgtagctataaaaattacagagttttcttggaatgctgatttata

SEQ ID NO: 202839 - DNA, 75 bp, Artificial Sequence
  Synthetic
ctactattaatcaagattcttatggtggtgcctcagtttgtatttactgccgtgcacgtgtagagcatccagatg

SEQ ID NO: 202840 - DNA, 75 bp, Artificial Sequence
  Synthetic
aataggtataaattacctgggtaaatcttcttttgaaatagatggcaatgttatgcatgctaactatttgttttg

SEQ ID NO: 202841 - DNA, 75 bp, Artificial Sequence
  Synthetic
ataaaagatcctattctctatgtgttaacacatgatgtttgtcaagtttgtggattttggagagatggcagttgt

SEQ ID NO: 202842 - DNA, 75 bp, Artificial Sequence
  Synthetic
ttcaccttctaaagacacttttgaacttcgttactctggttctattaggtttgatagtactttacctggttttga

SEQ ID NO: 202843 - DNA, 75 bp, Artificial Sequence
  Synthetic
cttgttagatctcattaaatctaaactatgttaattatttttttatttttttatttctgttatggttttaatgaa

SEQ ID NO: 202844 - DNA, 75 bp, Artificial Sequence
  Synthetic
ttgactctcttaatttaagtgctgatactcagcacatttcaaatgattttactcctgaggatcatagtttacttg

SEQ ID NO: 202845 - DNA, 75 bp, Artificial Sequence
  Synthetic
tagttttaaccataaagttataggaggtttgcatttgcttataggcttatttcgtaggcaaaaaaaatctaattt

SEQ ID NO: 202846 - DNA, 75 bp, Artificial Sequence
  Synthetic
aataatttaaaaattaaaaattttgattatttggatattcaccctagtttgtgcaacaatggtaagatttcatct

SEQ ID NO: 202847 - DNA, 75 bp, Artificial Sequence
  Synthetic
gttgtatgatgcgtttgttctatgatagagatggacagcgtgtttacgatgatgttgatgctagtttatttgtag

SEQ ID NO: 202848 - DNA, 75 bp, Artificial Sequence
  Synthetic
agtgccggtgattctatttttaagagttttcatttcactcgattttataattacactggcgaaggtgatcaaatt

SEQ ID NO: 202849 - DNA, 75 bp, Artificial Sequence
  Synthetic
gttttcatttcactcgattttataattacactggcgaaggtgatcaaattattttttatgagggtgttaatttta

SEQ ID NO: 202850 - DNA, 75 bp, Artificial Sequence
  Synthetic
agttgaagctactggcttatttgctgagagagattgttatatatttaaaagaactgttgctaaagctcctcctgg

SEQ ID NO: 202851 - DNA, 75 bp, Artificial Sequence
  Synthetic
atttaatgttgccataactagagccaagaagggtattttctgtgttatgagtaatatgcaattatttgaatctct

SEQ ID NO: 202852 - DNA, 75 bp, Artificial Sequence
  Synthetic
atccttatcatagatttaagtgttttcctaatggtagtaatgatgtatggcttcttaacaaggtaagattttatc

SEQ ID NO: 202853 - DNA, 75 bp, Artificial Sequence
  Synthetic
tcctaatggtagtaatgatgtatggcttcttaacaaggtaagattttatcgtgccttatattctaatatggcctt

SEQ ID NO: 202854 - DNA, 75 bp, Artificial Sequence
  Synthetic
ttataaaaaattaggccctatttttaatagagctttacttaatactgtcagttttgcagatactttagtaaaagt

SEQ ID NO: 202855 - DNA, 75 bp, Artificial Sequence
  Synthetic
ttttcgttatcttacttttgttgatattccttataatgtttctctttctaagtttaattcttgtaaaagtgatat

SEQ ID NO: 202856 - DNA, 75 bp, Artificial Sequence
  Synthetic
aggtttagttggtgttttaactttagataatcaagacttgtatggtcaatggtatgattttggtgattttataca

SEQ ID NO: 202857 - DNA, 75 bp, Artificial Sequence
  Synthetic
attccttataatgtttctctttctaagtttaattcttgtaaaagtgatattttatcacttaacaatcctattttt

SEQ ID NO: 202858 - DNA, 75 bp, Artificial Sequence
  Synthetic
attaattattctaaggaagtttattttactttattaggttgttctctttatttagtaccgctttgcctttttaaa

SEQ ID NO: 202859 - DNA, 75 bp, Artificial Sequence
  Synthetic
ttactttattaggttgttctctttatttagtaccgctttgcctttttaaatctaactttagtcagtactattata

SEQ ID NO: 202860 - DNA, 75 bp, Artificial Sequence
  Synthetic
acatagatactggctctgtttatggtttttctaatgttgtttatcctgatttagactgtatttatatttctctta

SEQ ID NO: 202861 - DNA, 75 bp, Artificial Sequence
  Synthetic
tttttctaatgttgtttatcctgatttagactgtatttatatttctcttaaaccaggttcttataaagtttccac

SEQ ID NO: 202862 - DNA, 75 bp, Artificial Sequence
  Synthetic
cactgcaccttttttatccttacctactaaagctctctgttttgataaatctaaacaatttgtacctgtacaggt

SEQ ID NO: 202863 - DNA, 75 bp, Artificial Sequence
  Synthetic
actaaagctctctgttttgataaatctaaacaatttgtacctgtacaggttgttgattctagatggaacaacgag

SEQ ID NO: 202864 - DNA, 75 bp, Artificial Sequence
  Synthetic
atgttgatgctagtttatttgtagatattaataatctgttacattctaaagttaaagttgttcctaatttgtatg

SEQ ID NO: 202865 - DNA, 75 bp, Artificial Sequence
  Synthetic
tcttacctaatacttgttttggtcctcttgttagacaaatttttgtagatggtgttccgtttgttgtttcaattg

SEQ ID NO: 202866 - DNA, 75 bp, Artificial Sequence
  Synthetic
cgtgcctcagatatttctttatctgttgcatgtcaattgccatattgttattttcgcaattcttctgctaattat

SEQ ID NO: 202867 - DNA, 75 bp, Artificial Sequence
  Synthetic
tgtatttcatattatggtgtatttctatatgataattttacatccatttggccctattattcttttggtaggtgt

SEQ ID NO: 202868 - DNA, 75 bp, Artificial Sequence
  Synthetic
tatatgataattttacatccatttggccctattattcttttggtaggtgtcctacatcttctattattaaacatc

SEQ ID NO: 202869 - DNA, 75 bp, Artificial Sequence
  Synthetic
caatttgtgtttatgattttttgcctattattttacaaggtattttattatgtttagctttactttttgttgttt

SEQ ID NO: 202870 - DNA, 75 bp, Artificial Sequence
  Synthetic
tattattttacaaggtattttattatgtttagctttactttttgttgtttttctattattcttgttatataacga

SEQ ID NO: 202871 - DNA, 75 bp, Artificial Sequence
  Synthetic
tagatctcattaaatctaaacatgttattaattatttttattttgcctacaacattagctgttataggtgatttt

SEQ ID NO: 202872 - DNA, 75 bp, Artificial Sequence
  Synthetic
tattaattatttttattttgcctacaacattagctgttataggtgattttaattgtactaattttgctattaatg

SEQ ID NO: 202873 - DNA, 75 bp, Artificial Sequence
  Synthetic
gacctttctgatagtgtagtatttattacttggtctgccagttttgaacttacttgtttaaggtattttgctaaa

SEQ ID NO: 202874 - DNA, 75 bp, Artificial Sequence
  Synthetic
aggatactgccttgttaagagcttaaatctaaactattaggatgtcttatactcccggtcattatgctggaagta

SEQ ID NO: 202875 - DNA, 75 bp, Artificial Sequence
  Synthetic
tggatactgccttgttaagagcttaaatctaaactattaggatgtcttatactcccggtcattatgctggaagta

SEQ ID NO: 202876 - DNA, 75 bp, Artificial Sequence
  Synthetic
cggatactgccttgttaagagcttaaatctaaactattaggatgtcttatactcccggtcattatgctggaagta

SEQ ID NO: 202877 - DNA, 75 bp, Artificial Sequence
  Synthetic
gggatactgccttgttaagagcttaaatctaaactattaggatgtcttatactcccggtcattatgctggaagta

SEQ ID NO: 202878 - DNA, 75 bp, Artificial Sequence
  Synthetic
aagtgagtatgttgtggatgtttcttatggtttgggtacatattatatacttgatcgtgtttatttaaatactac

SEQ ID NO: 202879 - DNA, 75 bp, Artificial Sequence
  Synthetic
ttaataattatgacaaaagtgctggttatccatttaataaatttggtaaagctagactttattatgaggcattat

SEQ ID NO: 202880 - DNA, 75 bp, Artificial Sequence
  Synthetic
catttgaggagcagaatgaaatttatgcatatactaaacgtaatgtgttgcccactttaactcaaatgaatttaa

SEQ ID NO: 202881 - DNA, 75 bp, Artificial Sequence
  Synthetic
tgcatatactaaacgtaatgtgttgcccactttaactcaaatgaatttaaaatatgctattagtgctaagaatag

SEQ ID NO: 202882 - DNA, 75 bp, Artificial Sequence
  Synthetic
gagtactctttggtatcagaaaccctttttatctgattttaataatggtattttttctagagttaagaatactaa

SEQ ID NO: 202883 - DNA, 75 bp, Artificial Sequence
  Synthetic
tttttatctgattttaataatggtattttttctagagttaagaatactaagttgtatgttaataaaactttgtat

SEQ ID NO: 202884 - DNA, 75 bp, Artificial Sequence
  Synthetic
agctcgtactgttgcaggtgtttccattcttagtactatgacaggtcgaatgtttcatcaaaaatgtttgaagag

SEQ ID NO: 202885 - DNA, 75 bp, Artificial Sequence
  Synthetic
ttatcttcaacaattagattgcaggctggtgttgctactgagtatgcagctaattcttctatactttcattatgt

SEQ ID NO: 202886 - DNA, 75 bp, Artificial Sequence
  Synthetic
agtgagtttagtactatagttataggtagtgtttttattaacaactcttatactattgttgttcaacctcataat

SEQ ID NO: 202887 - DNA, 75 bp, Artificial Sequence
  Synthetic
gtagtgtttttattaacaactcttatactattgttgttcaacctcataatggtgttttggagattacagcttgtc

SEQ ID NO: 202888 - DNA, 75 bp, Artificial Sequence
  Synthetic
aatacactatgtgtgagtatcctcatactatttgtaaatctaaaggtagttctcgtaatgaatcttggcattttg

SEQ ID NO: 202889 - DNA, 75 bp, Artificial Sequence
  Synthetic
tttatcaagaacgtggcactttttatgcttattatgctgactctggcatgcctactacttttttatttagtttgt

SEQ ID NO: 202890 - DNA, 75 bp, Artificial Sequence
  Synthetic
cctactacttttttatttagtttgtatcttggtactcttttatctcattattatgttttgcctttgacttgtaat

SEQ ID NO: 202891 - DNA, 75 bp, Artificial Sequence
  Synthetic
tggtactagcagtggtgatgcaaccactgcttttgctaactctgtttttaatatatgtcaagctgttactgctaa

SEQ ID NO: 202892 - DNA, 75 bp, Artificial Sequence
  Synthetic
ttatgttttgcctttgacttgtaatgctatatcttctaatactgataatgagactttacaatattgggtcacacc

SEQ ID NO: 202893 - DNA, 75 bp, Artificial Sequence
  Synthetic
tttgtctaaacgccaatatcttcttaaatttgacaaccgtggtgttattactaatgctgttgattgttctagtag

SEQ ID NO: 202894 - DNA, 75 bp, Artificial Sequence
  Synthetic
ctaatgctgttgattgttctagtagtttctttagtgagattcaatgtaaaactaaatctttattacctaatactg

SEQ ID NO: 202895 - DNA, 75 bp, Artificial Sequence
  Synthetic
tttctttagtgagattcaatgtaaaactaaatctttattacctaatactggtgtttatgacttatctggttttac

SEQ ID NO: 202896 - DNA, 75 bp, Artificial Sequence
  Synthetic
tgttaagcctgttgcaactgtacatcgtcgtattcctgatttacctgattgtgacattgataaatggcttaacaa

SEQ ID NO: 202897 - DNA, 75 bp, Artificial Sequence
  Synthetic
cgtcgtattcctgatttacctgattgtgacattgataaatggcttaacaattttaatgtaccctcacctcttaat

SEQ ID NO: 202898 - DNA, 75 bp, Artificial Sequence
  Synthetic
tgggaacgtaaaattttttctaattgcaactttaatttgagtactttgcttcgtttagttcatactgattctttt

SEQ ID NO: 202899 - DNA, 75 bp, Artificial Sequence
  Synthetic
gcaactttaatttgagtactttgcttcgtttagttcatactgattctttttcttgtaataattttgatgaatcta

SEQ ID NO: 202900 - DNA, 75 bp, Artificial Sequence
  Synthetic
agatatatggtagttgttttaagagtattgttttagataaatttgccatacccaactccagacgatctgatttgc

SEQ ID NO: 202901 - DNA, 75 bp, Artificial Sequence
  Synthetic
tattgttttagataaatttgccatacccaactccagacgatctgatttgcagttgggcagttctggttttctgca

SEQ ID NO: 202902 - DNA, 75 bp, Artificial Sequence
  Synthetic
atcttctaattataaaattgacactacttctagttcttgtcaattgtattatagtttgcctgcaattaatgttac

SEQ ID NO: 202903 - DNA, 75 bp, Artificial Sequence
  Synthetic
acttctagttcttgtcaattgtattatagtttgcctgcaattaatgttactattaataattataatccttcttct

SEQ ID NO: 202904 - DNA, 75 bp, Artificial Sequence
  Synthetic
aaaagtttttcgtgtatatttagaatatataaaaaaactatataatgatcttggtaatcagatcttagatagtta

SEQ ID NO: 202905 - DNA, 75 bp, Artificial Sequence
  Synthetic
tgtggtattttgggtcgaatttagaagaggatgttttgttatttattacagcctttttaggtacttatacatgga

SEQ ID NO: 202906 - DNA, 75 bp, Artificial Sequence
  Synthetic
tggaatagaaggtatggttttaataattttaatttgagctctcatagtgttgtttactcacgttattgtttttct

SEQ ID NO: 202907 - DNA, 75 bp, Artificial Sequence
  Synthetic
attttaatttgagctctcatagtgttgtttactcacgttattgtttttctgttaataatactttttgtccttgtg

SEQ ID NO: 202908 - DNA, 75 bp, Artificial Sequence
  Synthetic
tatataaaaaaactatataatgatcttggtaatcagatcttagatagttatagtgttattttaagtacttgtgat

SEQ ID NO: 202909 - DNA, 75 bp, Artificial Sequence
  Synthetic
agtttggaatagtgctgtttttattagtccttataatagtcagaattatgttgctaagcgtgttttaggtgttca

SEQ ID NO: 202910 - DNA, 75 bp, Artificial Sequence
  Synthetic
ctaaaccttcttttgcttcaagttgcaagagtcataaaccaccttctgcttcctgtcctattggtactaattatc

SEQ ID NO: 202911 - DNA, 75 bp, Artificial Sequence
  Synthetic
caagagtcataaaccaccttctgcttcctgtcctattggtactaattatcgttcttgtgagagtactactgtact

SEQ ID NO: 202912 - DNA, 75 bp, Artificial Sequence
  Synthetic
gaagcctttgttgtgttgtaaatgttgctatgatcatgttatggcaaccaatcataaatatgttttgagtgtttc

SEQ ID NO: 202913 - DNA, 75 bp, Artificial Sequence
  Synthetic
cgaccacactgactggtgtaggtgttcttgtttacctgatcctataactgcttatgaccctaggtcttgttctca

SEQ ID NO: 202914 - DNA, 75 bp, Artificial Sequence
  Synthetic
tgtagtactgatgcctttctaggttggtcttatgacacttgcgtcagtaacaaccgttgtaatattttttctaat

SEQ ID NO: 202915 - DNA, 75 bp, Artificial Sequence
  Synthetic
aattggttaccattataaagagttaggtgtagttatgaacttggatgttgacacacaccgctatcgtttgtctct

SEQ ID NO: 202916 - DNA, 75 bp, Artificial Sequence
  Synthetic
gatgtttgtgttgattacgacctttatggtattacaggacaaggtatttttaaagaagtttctgctgtttattat

SEQ ID NO: 202917 - DNA, 75 bp, Artificial Sequence
  Synthetic
taaagattttgttactaataaaacatataatattttcccttgttatgcaggaagagtttctgctgcttttcatca

SEQ ID NO: 202918 - DNA, 75 bp, Artificial Sequence
  Synthetic
tgagtatgtttttgataaaagtgaattaactaatggtgtttattatcgcgctacaactacttacaaactttctat

SEQ ID NO: 202919 - DNA, 75 bp, Artificial Sequence
  Synthetic
aggtgatgtttttgtcttaacatcacattctgtagctaatctaagtgcacctacacttgttccacaagagaacta

SEQ ID NO: 202920 - DNA, 75 bp, Artificial Sequence
  Synthetic
tcagccatattttgatagttatcttggttgcgtttttaatgctgataatttaactgattattctgtttcttcttg

SEQ ID NO: 202921 - DNA, 75 bp, Artificial Sequence
  Synthetic
cattctgtagctaatctaagtgcacctacacttgttccacaagagaactatgctagtataagattttctagtgtt

SEQ ID NO: 202922 - DNA, 75 bp, Artificial Sequence
  Synthetic
tgctcttcgcatgggtagtggtttttgtgttgattataactcaccttctttttcctcttcgcgtcgtaaacgtag

SEQ ID NO: 202923 - DNA, 75 bp, Artificial Sequence
  Synthetic
tatagcgttcctttgctgtttcaaactaatgttgctaactatcagcacattggaatgaaacgttattgcactgtg

SEQ ID NO: 202924 - DNA, 75 bp, Artificial Sequence
  Synthetic
tggaatgaaacgttattgcactgtgcaaggtcctcctggtacgggcaagtctcaccttgctataggtttagctgt

SEQ ID NO: 202925 - DNA, 75 bp, Artificial Sequence
  Synthetic
aagtatttctgcttcttatcggtttgttacttttgaaccctttaatgtcagttttgttaatgacagtattgagtc

SEQ ID NO: 202926 - DNA, 75 bp, Artificial Sequence
  Synthetic
gttacttttgaaccctttaatgtcagttttgttaatgacagtattgagtctgtgggtggtctttatgagatcaaa

SEQ ID NO: 202927 - DNA, 75 bp, Artificial Sequence
  Synthetic
attcccactaactttactatagttggtcaagaggaatttattcaaactaattctcctaaagttactattgattgt

SEQ ID NO: 202928 - DNA, 75 bp, Artificial Sequence
  Synthetic
gtcaagaggaatttattcaaactaattctcctaaagttactattgattgttctttatttgtctgttctaattatg

SEQ ID NO: 202929 - DNA, 75 bp, Artificial Sequence
  Synthetic
acacgcattatacctgctaaagttcgtgtagattgttatgataagtttaaaattaatgatactacttgtaagtat

SEQ ID NO: 202930 - DNA, 75 bp, Artificial Sequence
  Synthetic
ttcctgttgttataggaactactaaattttatggtggctgggatgatatgttacgccatcttataaaggatgttg

SEQ ID NO: 202931 - DNA, 75 bp, Artificial Sequence
  Synthetic
cagcttgccatgacttattgtcagagtatggcactttttgtgataatattaatagtattttagatgaagttaatg

SEQ ID NO: 202932 - DNA, 75 bp, Artificial Sequence
  Synthetic
gtatggcactttttgtgataatattaatagtattttagatgaagttaatggtttacttgatactactcaattgca

SEQ ID NO: 202933 - DNA, 75 bp, Artificial Sequence
  Synthetic
aattaatgatactacttgtaagtatgtttttactacaataaatgcattaccagagttagtcacagatattgttgt

SEQ ID NO: 202934 - DNA, 75 bp, Artificial Sequence
  Synthetic
tgtagctgatactcttatgcaaggtgtcacacttagctccaatcttaatactaatttgcattttgatgttgataa

SEQ ID NO: 202935 - DNA, 75 bp, Artificial Sequence
  Synthetic
aagctggttgtttattttgttataaacgaaattgtagtgttcgtgttaagtgtagtactattgttggtggtgtaa

SEQ ID NO: 202936 - DNA, 75 bp, Artificial Sequence
  Synthetic
ctaatttgcattttgatgttgataatattaattttaaatccctagttggatgtttaggtccacactgcggttctt

SEQ ID NO: 202937 - DNA, 75 bp, Artificial Sequence
  Synthetic
cctgcaccacgtgtgctattgagtaagggttctttagaacctaggcattttaattctattactaaaataatgtgc

SEQ ID NO: 202938 - DNA, 75 bp, Artificial Sequence
  Synthetic
cattccatactaatccttttactagaactgtttttgaaaatcttaagcctatgccttttttctattattcagata

SEQ ID NO: 202939 - DNA, 75 bp, Artificial Sequence
  Synthetic
cttctcgttctttttttgaagatttattgtttgacaaagttaaactttcagatgttggttttgttgaagcttata

SEQ ID NO: 202940 - DNA, 75 bp, Artificial Sequence
  Synthetic
attgtttgacaaagttaaactttcagatgttggttttgttgaagcttataacaattgtactggtggtagtgaaat

SEQ ID NO: 202941 - DNA, 75 bp, Artificial Sequence
  Synthetic
tagagatcttctttgtgtacaatcctttaatggtattaaagttttgcctcctattttgtctgaatctcaaatttc

SEQ ID NO: 202942 - DNA, 75 bp, Artificial Sequence
  Synthetic
ctattttgtctgaatctcaaatttctggttacaccacagccgctactgttgctgctatgtttccaccatggtcag

SEQ ID NO: 202943 - DNA, 75 bp, Artificial Sequence
  Synthetic
ttgggtgttactatggatgttcttaataaaaatcaaaagttgatagctactgcttttaataatgctcttctttct

SEQ ID NO: 202944 - DNA, 75 bp, Artificial Sequence
  Synthetic
cttataatagtcagaactatgttgctaagcgtattttaggtgttcaaacacaaactgttgattctgctcaaggtt

SEQ ID NO: 202945 - DNA, 75 bp, Artificial Sequence
  Synthetic
attcagaatggttttagtgctaccaactctgcacttgctaaaatacaaagtgttgttaattctaatgctcaagca

SEQ ID NO: 202946 - DNA, 75 bp, Artificial Sequence
  Synthetic
ctgaatatgattatgttatatattcacaaacagcagaaacagctcattctattaatgttaatcgatttaatgttg

SEQ ID NO: 202947 - DNA, 75 bp, Artificial Sequence
  Synthetic
actctgcacttgctaaaatacaaagtgttgttaattctaatgctcaagcacttaatagtttgttacagcaattat

SEQ ID NO: 202948 - DNA, 75 bp, Artificial Sequence
  Synthetic
ttaataaatttggtgcaattagttcttctttacaagaaattttatctcgtctcgatgctttagaggctcaggttc

SEQ ID NO: 202949 - DNA, 75 bp, Artificial Sequence
  Synthetic
tttctgtgttatgagtaatatgcaattatttgaatctcttaattttattactttacctttagataaaattcagaa

SEQ ID NO: 202950 - DNA, 75 bp, Artificial Sequence
  Synthetic
ttatttgaatctcttaattttattactttacctttagataaaattcagaatcaaactttatctcgtttgcattgt

SEQ ID NO: 202951 - DNA, 75 bp, Artificial Sequence
  Synthetic
actactaatctttttaaagattgtagtaaaaattttttaggttaccacccagctcatgctccttcatttttatca

SEQ ID NO: 202952 - DNA, 75 bp, Artificial Sequence
  Synthetic
gtaaaaattttttaggttaccacccagctcatgctccttcatttttatcagttgatgataaatataaggtcaacg

SEQ ID NO: 202953 - DNA, 75 bp, Artificial Sequence
  Synthetic
tatggagaaggttaatgagtgtgttaaaagtcaatctcctcgtattaatttttgtggtaatggtaatcatatttt

SEQ ID NO: 202954 - DNA, 75 bp, Artificial Sequence
  Synthetic
aagatttggctgtttgtttaaacatttgtgaacctgttttaacatattctcgtttaatatctctcatggggttta

SEQ ID NO: 202955 - DNA, 75 bp, Artificial Sequence
  Synthetic
aaaagtcaatctcctcgtattaatttttgtggtaatggtaatcatattttgtcattagttcaaaatgctccttat

SEQ ID NO: 202956 - DNA, 75 bp, Artificial Sequence
  Synthetic
ttgtgaacctgttttaacatattctcgtttaatatctctcatggggtttaaattggatttgactcttgatggtta

SEQ ID NO: 202957 - DNA, 75 bp, Artificial Sequence
  Synthetic
ggtttgttgtttatgcattttagttataaacctatttcttttaaaactgttttagtaagtcctggtttgtgtata

SEQ ID NO: 202958 - DNA, 75 bp, Artificial Sequence
  Synthetic
ttctaaattttttattactaaagacgaagctattaaacgtgttagaggttgggttggttttgatgtagaaggagc

SEQ ID NO: 202959 - DNA, 75 bp, Artificial Sequence
  Synthetic
gaagctattaaacgtgttagaggttgggttggttttgatgtagaaggagcccatgctacgcgtgacaacattgga

SEQ ID NO: 202960 - DNA, 75 bp, Artificial Sequence
  Synthetic
tgatcattggatgttcactggtagttcttactattatcctgaaccaatttcagataaaaatgttgtttttatgaa

SEQ ID NO: 202961 - DNA, 75 bp, Artificial Sequence
  Synthetic
tcttactattatcctgaaccaatttcagataaaaatgttgtttttatgaatacttgttctgttaattttactaaa

SEQ ID NO: 202962 - DNA, 75 bp, Artificial Sequence
  Synthetic
tggtgatgatgtagatgatattgaaagtatttatgactttgatacttataaagctcttttagtttttaatgatgt

SEQ ID NO: 202963 - DNA, 75 bp, Artificial Sequence
  Synthetic
gcgcctcttgtttatttgaatcattctgtaccaaaattgtctgattttgaatctgagttatctcattggtttaaa

SEQ ID NO: 202964 - DNA, 75 bp, Artificial Sequence
  Synthetic
taactttaaacatttaataccccttatgtcgaaaggtcaaaagtgggatgttgttagaatcagaattgttcaaat

SEQ ID NO: 202965 - DNA, 75 bp, Artificial Sequence
  Synthetic
ctgtaccaaaattgtctgattttgaatctgagttatctcattggtttaaaaatcaaacatccattgctcctaatt

SEQ ID NO: 202966 - DNA, 75 bp, Artificial Sequence
  Synthetic
atgtcgaaaggtcaaaagtgggatgttgttagaatcagaattgttcaaatgttgtctgattatcttttggatctt

SEQ ID NO: 202967 - DNA, 75 bp, Artificial Sequence
  Synthetic
tgactttaaatcttcatactattaatgctacttttttagatttgtattatgagatgaatcttattcaagagtcta

SEQ ID NO: 202968 - DNA, 75 bp, Artificial Sequence
  Synthetic
tgctacttttttagatttgtattatgagatgaatcttattcaagagtctattaagtctttgaataatagttatat

SEQ ID NO: 202969 - DNA, 75 bp, Artificial Sequence
  Synthetic
ggtctgccagttttgaacttacgtgtttaaggtattttgctaaattaggtagagagctcaattgtgatgtgtgtc

SEQ ID NO: 202970 - DNA, 75 bp, Artificial Sequence
  Synthetic
caatcttaaagatataggtacatatgaaatgtatgtaaaatggccttggtatgtttggctactaatttctttttc

SEQ ID NO: 202971 - DNA, 75 bp, Artificial Sequence
  Synthetic
ctaatcgtgcaacatgctataattctagaactggttattacggttgttggcgccatagttatacttgtgattatg

SEQ ID NO: 202972 - DNA, 75 bp, Artificial Sequence
  Synthetic
gaaatgtatgtaaaatggccttggtatgtttggctactaatttctttttcatttataatattccttgtattgctc

SEQ ID NO: 202973 - DNA, 75 bp, Artificial Sequence
  Synthetic
ttttttatatgttgttgtactggttgtggttctgcatgttttagtaaatgtcataattgttgtgatgagtatggt

SEQ ID NO: 202974 - DNA, 75 bp, Artificial Sequence
  Synthetic
gtggttctgcatgttttagtaaatgtcataattgttgtgatgagtatggtggtcatcatgattttgttatcaaaa

SEQ ID NO: 202975 - DNA, 75 bp, Artificial Sequence
  Synthetic
ttaactagtaatcatgatataatttgtaatgtacataaaggtgcacatgttgcatcatctgatgcaattatgact

SEQ ID NO: 202976 - DNA, 75 bp, Artificial Sequence
  Synthetic
catctcatgatgattagaatctcttgtcagatctcattaaatctaaactttatttatggacgtttggagacctag

SEQ ID NO: 202977 - DNA, 75 bp, Artificial Sequence
  Synthetic
gtcagatctcattaaatctaaactttatttatggacgtttggagacctagctacacacattctcttgttattaga

SEQ ID NO: 202978 - DNA, 75 bp, Artificial Sequence
  Synthetic
gaatttggtgttacaaaccttgaagatttgtgtctaaagtataattactgtcaacctattgttggttactgtatt

SEQ ID NO: 202979 - DNA, 75 bp, Artificial Sequence
  Synthetic
tattgcagcgtgttatgcttaaagctgccatgctatgtaatagatacaatttatgttatgacattggcaatccta

SEQ ID NO: 202980 - DNA, 75 bp, Artificial Sequence
  Synthetic
tcaacctattgttggttactgtattgtacctttaaatgtttggtgtcgcaagtttggcaaatttgcatctcactt

SEQ ID NO: 202981 - DNA, 75 bp, Artificial Sequence
  Synthetic
caacaatggtaagatttcatctagtgccggtgattctatttttaagagttttcatttcactcgattttataatta

SEQ ID NO: 202982 - DNA, 75 bp, Artificial Sequence
  Synthetic
tgataatgagactttacaatattgggtcacacctttgtctaaacgccaatatcttcttaaatttgacaaccgtgg

SEQ ID NO: 202983 - DNA, 75 bp, Artificial Sequence
  Synthetic
tacattacgtagtcacgatatttcccatagtaataattttggtgttgtaactagttttactacttatggtaatac

SEQ ID NO: 202984 - DNA, 75 bp, Artificial Sequence
  Synthetic
catagtaataattttggtgttgtaactagttttactacttatggtaatactgtttctgaggctgtgtctagatta

SEQ ID NO: 202985 - DNA, 75 bp, Artificial Sequence
  Synthetic
gttactggtgacaatgatgaccaaattgttgttactggtgatgatgtagatgatattgaaagtatttatgacttt

SEQ ID NO: 202986 - DNA, 75 bp, Artificial Sequence
  Synthetic
gttgaatcagcttctgaatttattgtttggcgtgcagaggcacttaataagtatggttgatttatttttcaatga

SEQ ID NO: 202987 - DNA, 75 bp, Artificial Sequence
  Synthetic
ggacttaccttgtacattacatttttcattatttgatgacaatttttgtgctttttgcacccctaaaaaaaattt

SEQ ID NO: 202988 - DNA, 75 bp, Artificial Sequence
  Synthetic
gatacttataaagctcttttagtttttaatgatgtctataatgatgctttgtttgttagttatggttctagtgtt

SEQ ID NO: 202989 - DNA, 75 bp, Artificial Sequence
  Synthetic
aaattaaacctccctggatgtaatggtggtagtttgtatgttaataaacatgcatttcatactaatccttttacc

SEQ ID NO: 202990 - DNA, 75 bp, Artificial Sequence
  Synthetic
ttagttttagttttattttgtcttatttctttaatctttgttgttgcttttttagcaactattaagctttgtatg

SEQ ID NO: 202991 - DNA, 75 bp, Artificial Sequence
  Synthetic
tttggcgtgcagaggcacttaataagtatggttgatttatttttcaatgatactgcttggtacataggacagatt

SEQ ID NO: 202992 - DNA, 75 bp, Artificial Sequence
  Synthetic
gtggtagtttgtatgttaataaacatgcatttcatactaatccttttaccagaacggtctttgaaaatcttaaac

SEQ ID NO: 202993 - DNA, 75 bp, Artificial Sequence
  Synthetic
ctatgccatttttttactattcagatactccttgtgtgtatgtagatggtttggaatccaaacaagttgattatg

SEQ ID NO: 202994 - DNA, 75 bp, Artificial Sequence
  Synthetic
ttattatttcaccttcggcttacgtttataaaagaggtatgcagttgtataagtcttatagtgaacaagttatac

SEQ ID NO: 202995 - DNA, 75 bp, Artificial Sequence
  Synthetic
tactccttgtgtgtatgtagatggtttggaatccaaacaagttgattatgtgcctttaagaagcgctacttgtat

SEQ ID NO: 202996 - DNA, 75 bp, Artificial Sequence
  Synthetic
cacacgatgtaatttaggtggtgctgtttgttctaagcatgctgaagattattgtaaatatcttgagtcttataa

SEQ ID NO: 202997 - DNA, 75 bp, Artificial Sequence
  Synthetic
gtttgttctaagcatgctgaagattattgtaaatatcttgagtcttataatgtagctactacagcaggctttact

SEQ ID NO: 202998 - DNA, 75 bp, Artificial Sequence
  Synthetic
agctgttacattcttaaaagaatggaatttctctttgggtgtaatactactttttattactatcatattgcagtt

SEQ ID NO: 202999 - DNA, 75 bp, Artificial Sequence
  Synthetic
ttttgggtttataagacttttgatttttataatttatggaatactttcactatgttgcagagcttagaaaatgta

SEQ ID NO: 203000 - DNA, 75 bp, Artificial Sequence
  Synthetic
tttgggaaattgttatagatgtcctaaagaaattgtagaaactgtttcagcattggtttatgataataaacttaa

SEQ ID NO: 203001 - DNA, 75 bp, Artificial Sequence
  Synthetic
aatttctctttgggtgtaatactactttttattactatcatattgcagttcggttatacgagccgtagtatgttt

SEQ ID NO: 203002 - DNA, 75 bp, Artificial Sequence
  Synthetic
atatataatttggttaatgctggtcattatgatggacgtataggtgaattgccttgtgctattatgaatgacaaa

SEQ ID NO: 203003 - DNA, 75 bp, Artificial Sequence
  Synthetic
ttatatacaacaaggtggtgtacctataattaattgtgttaaaatgctctgtgatcatgctggtactggtatggc

SEQ ID NO: 203004 - DNA, 75 bp, Artificial Sequence
  Synthetic
tatgctctgaataatgcttttcttgcattttctatagtgtttactattatttctattgttatatggattctttat

SEQ ID NO: 203005 - DNA, 75 bp, Artificial Sequence
  Synthetic
cattttctatagtgtttactattatttctattgttatatggattctttattttgttaatagtattcggcttttta

SEQ ID NO: 203006 - DNA, 75 bp, Artificial Sequence
  Synthetic
tataatggccgaccacaaggggcatttcatgttactatgcgtagtagttatactattaaaggttcttttttgtgt

SEQ ID NO: 203007 - DNA, 75 bp, Artificial Sequence
  Synthetic
atcttggcattttgataaatctgaacctttgtgtctgttcaagaaaaattttacttataatgtttctacagattg

SEQ ID NO: 203008 - DNA, 75 bp, Artificial Sequence
  Synthetic
gccatcaccctgaacttaagattcttagaaatttgaatattgatatttgttggaagcatgtcctttgggattatg

SEQ ID NO: 203009 - DNA, 75 bp, Artificial Sequence
  Synthetic
taatccagagaccaataatcttatgtgtattgatatgaaaggcaagatgtttgttaggccagttattgaggacta

SEQ ID NO: 203010 - DNA, 75 bp, Artificial Sequence
  Synthetic
tgtattgatatgaaaggcaagatgtttgttaggccagttattgaggactatcacacattaactgctactgttatt

SEQ ID NO: 203011 - DNA, 75 bp, Artificial Sequence
  Synthetic
ttctattgttatatggattctttattttgttaatagtattcggctttttattagaactggcagttggtggagttt

SEQ ID NO: 203012 - DNA, 75 bp, Artificial Sequence
  Synthetic
tacctatggtgtctgcaaatacacagatttaaattttattgaaaatttgaatgtactttttgatggtcgtgacaa

SEQ ID NO: 203013 - DNA, 75 bp, Artificial Sequence
  Synthetic
atactgttatttttaaaaataatacatcacttcctactaatatagctgttgaattatttacaaaacgtagtattc

SEQ ID NO: 203014 - DNA, 75 bp, Artificial Sequence
  Synthetic
tagaaatttgaatattgatatttgttggaagcatgtcctttgggattatgttaaagatagtttgttttgtagttc

SEQ ID NO: 203015 - DNA, 75 bp, Artificial Sequence
  Synthetic
gatttaaattttattgaaaatttgaatgtactttttgatggtcgtgacaatggtgctttagaagcttttagaaaa

SEQ ID NO: 203016 - DNA, 75 bp, Artificial Sequence
  Synthetic
gcaagaaatggtgtttttattagtactggaaaattaagtagtttgtctatgattaaaggtccgcaacgagctgat

SEQ ID NO: 203017 - DNA, 75 bp, Artificial Sequence
  Synthetic
ctggaaaattaagtagtttgtctatgattaaaggtccgcaacgagctgatttaaatggcgtaattgtggataaag

SEQ ID NO: 203018 - DNA, 75 bp, Artificial Sequence
  Synthetic
ttggagaactcaatgttgagttttggtttgctatgagaaaagatggtgacgatgttatcttcagccgtgcagaca

SEQ ID NO: 203019 - DNA, 75 bp, Artificial Sequence
  Synthetic
tgaattgttgccgttttcagcgtatagatgacgacggtaataaattggataagttctttgttgtcaaaagaacta

SEQ ID NO: 203020 - DNA, 75 bp, Artificial Sequence
  Synthetic
agagcttaaatctaaactattaggatgtcttatactcccggtcattatgctggaagtagaagctcctctggaaat

SEQ ID NO: 203021 - DNA, 75 bp, Artificial Sequence
  Synthetic
tgtcttatactcccggtcattatgctggaagtagaagctcctctggaaatcgttcaggaatcctcaagaaaactt

SEQ ID NO: 203022 - DNA, 75 bp, Artificial Sequence
  Synthetic
cccacaaggtaatctaggtggtaattgtgcaggtaatgccagcggtaatgatgctctagcgcgttttactatctt

SEQ ID NO: 203023 - DNA, 75 bp, Artificial Sequence
  Synthetic
gtttgctatgagaaaagatggtgacgatgttatcttcagccgtgcagacagcctaagcccaagccattactggag

SEQ ID NO: 203024 - DNA, 75 bp, Artificial Sequence
  Synthetic
cttgggctgaccaatctgagcgaaattaccaaacctttaatagaggcagaaaaacccaacctaaattcactgtgt

SEQ ID NO: 203025 - DNA, 75 bp, Artificial Sequence
  Synthetic
ttaccaaacctttaatagaggcagaaaaacccaacctaaattcactgtgtctactcaaccacaaggaaatactat

SEQ ID NO: 203026 - DNA, 75 bp, Artificial Sequence
  Synthetic
tttgaacctcgctcagatttagaacgggattttattgatatggaggatagtctgtttatagccaaatatggttta

SEQ ID NO: 203027 - DNA, 75 bp, Artificial Sequence
  Synthetic
tgtgcaggtaatgccagcggtaatgatgctctagcgcgttttactatctttactcagagtcgtgtattgtcaacc

SEQ ID NO: 203028 - DNA, 75 bp, Artificial Sequence
  Synthetic
cccacattattcctggttctccgggatcactcaatttcaaaaaggtagagactttaaattttcagatggtcaagg

SEQ ID NO: 203029 - DNA, 75 bp, Artificial Sequence
  Synthetic
gggattttattgatatggaggatagtctgtttatagccaaatatggtttagaagattatgcatttgatcatatag

SEQ ID NO: 203030 - DNA, 75 bp, Artificial Sequence
  Synthetic
tttatggtagttttaattataaagttataggaggtttgcacttgcttataggtttatttcgtagactaaaaaaat

SEQ ID NO: 203031 - DNA, 75 bp, Artificial Sequence
  Synthetic
tataggaggtttgcacttgcttataggtttatttcgtagactaaaaaaatctaatttggtaattcaagagttttt

SEQ ID NO: 203032 - DNA, 75 bp, Artificial Sequence
  Synthetic
atcactcaatttcaaaaaggtagagactttaaattttcagatggtcaaggagttcccattgctttcggagtcccc

SEQ ID NO: 203033 - DNA, 75 bp, Artificial Sequence
  Synthetic
gcagtatgattctagtattcattcatatttcattactgatcaagagtgtggtagtagtaagagtgtttgtacagt

SEQ ID NO: 203034 - DNA, 75 bp, Artificial Sequence
  Synthetic
tatttcattactgatcaagagtgtggtagtagtaagagtgtttgtacagttattgatttattattagatgacttt

SEQ ID NO: 203035 - DNA, 75 bp, Artificial Sequence
  Synthetic
gttgttattgttaagtcattaaatttgaattgtgttagtaaagttgttaatattaatgttgactttaaggacttt

SEQ ID NO: 203036 - DNA, 75 bp, Artificial Sequence
  Synthetic
tgaattgtgttagtaaagttgttaatattaatgttgactttaaggactttcaatttatgttgtggtgtaatgata

SEQ ID NO: 203037 - DNA, 75 bp, Artificial Sequence
  Synthetic
caagaagctatccctactaggtttccgcctggtacgattttgcctcaaggctattatgttgaaggctcaggaagg

SEQ ID NO: 203038 - DNA, 75 bp, Artificial Sequence
  Synthetic
ataaaattatgactttttatcctaaaatgcaagctactagtgactggaaacctggttattctatgcctgttttat

SEQ ID NO: 203039 - DNA, 75 bp, Artificial Sequence
  Synthetic
tagattgtgaattatttgttaatgatagttatagacaattcgatcttgtacagtatgattttactgattacaagt

SEQ ID NO: 203040 - DNA, 75 bp, Artificial Sequence
  Synthetic
cgcctggtacgattttgcctcaaggctattatgttgaaggctcaggaaggtctgcttctaatagtcgaccaggtt

SEQ ID NO: 203041 - DNA, 75 bp, Artificial Sequence
  Synthetic
gatatacaacagtggggttacacaggttctttaactagtaatcatgatataatttgtaatgtacataaaggtgca

SEQ ID NO: 203042 - DNA, 75 bp, Artificial Sequence
  Synthetic
tcaattatgtcagtatttaaatactacaacattagctgttcctgttaatatgcgtgtcttacacttaggtgcagg

SEQ ID NO: 203043 - DNA, 75 bp, Artificial Sequence
  Synthetic
cttggtaaagattctaaacctcagcaagtcactaagcaaaatgccaaggaaatcaggcataaaattttaactaaa

SEQ ID NO: 203044 - DNA, 75 bp, Artificial Sequence
  Synthetic
atctgataaagaagtagcccctggttctgctgttttaagacagtggttaccatctggtagtattcttgtagataa

SEQ ID NO: 203045 - DNA, 75 bp, Artificial Sequence
  Synthetic
cctcgccaaaagcgaactcctaataaacattgtaatgttcaacagtgttttggtaaaagaggaccttctcaaaac

SEQ ID NO: 203046 - DNA, 75 bp, Artificial Sequence
  Synthetic
tctgctgttttaagacagtggttaccatctggtagtattcttgtagataatgatttaaatccttttgttagtgat

SEQ ID NO: 203047 - DNA, 75 bp, Artificial Sequence
  Synthetic
ttggtactaatgatcctcagtttcctattcttgcagaattagctcctacaccaggtgcttttttctttggttcta

SEQ ID NO: 203048 - DNA, 75 bp, Artificial Sequence
  Synthetic
gattatgaatttaaattctatgatgcttctcctgttgtcaagtctgttaaacagttgttttatgtttatgatgtt

SEQ ID NO: 203049 - DNA, 75 bp, Artificial Sequence
  Synthetic
gtagttgttaacggtccatttttttcttttgaacagtctcataataattgttatgtgaatgtagcttgtcttatg

SEQ ID NO: 203050 - DNA, 75 bp, Artificial Sequence
  Synthetic
ttgggatctgataatatctgatatgtatgatcctcttactaagaatattggtgattataatgtgagtaaggatgg

SEQ ID NO: 203051 - DNA, 75 bp, Artificial Sequence
  Synthetic
cgaggctgactcacctgttaaagatgtttttgaacttcgttattctggttctattaggtttgatagtactttacc

SEQ ID NO: 203052 - DNA, 75 bp, Artificial Sequence
  Synthetic
tttctttacttatatttgttatttaattcgtgataaattatctttgggtggtagtgttgctataaaaattacaga

SEQ ID NO: 203053 - DNA, 75 bp, Artificial Sequence
  Synthetic
attcgtgataaattatctttgggtggtagtgttgctataaaaattacagaattttcttggaatgctgacttatat

SEQ ID NO: 203054 - DNA, 75 bp, Artificial Sequence
  Synthetic
gtttttgaacttcgttattctggttctattaggtttgatagtactttacctggttttgagacaattatgaaagtt

SEQ ID NO: 203055 - DNA, 75 bp, Artificial Sequence
  Synthetic
cttaaagagaatttagatgcttatgttaattctaatcagaacactgtttctggttcgctgagtcctaaacctcag

SEQ ID NO: 203056 - DNA, 75 bp, Artificial Sequence
  Synthetic
gtatatatgcatcaattagagctcagtactggttgtcacactggcactgattttactggtaatttttatggtcca

SEQ ID NO: 203057 - DNA, 75 bp, Artificial Sequence
  Synthetic
ttaattctaatcagaacactgtttctggttcgctgagtcctaaacctcagcgtaaaagaggtgttaaacaatcac

SEQ ID NO: 203058 - DNA, 75 bp, Artificial Sequence
  Synthetic
cctgctttgaaatagatggcaatgttatgcatgccaactatttgttttggagaaatagtacaacatggaatggtg

SEQ ID NO: 203059 - DNA, 75 bp, Artificial Sequence
  Synthetic
ctgaattgtttgactctcttaatttaagtgctgatactcagcacatttcaaatgattttactcctgaggatcata

SEQ ID NO: 203060 - DNA, 75 bp, Artificial Sequence
  Synthetic
tcttattgaaagaggtaagttattagtgcgtgatacgcgtaaagaaatttttgttggtgatagtcttgtaaacac

SEQ ID NO: 203061 - DNA, 75 bp, Artificial Sequence
  Synthetic
ttacgatctcttgtcagatctcattaaatctaaactttttaaacaagattccctgttatccatgcttgtgagtgt

SEQ ID NO: 203062 - DNA, 75 bp, Artificial Sequence
  Synthetic
tgtaaccatattaataatttaaaaattaaaaattatggttatttggatattcaccctagtttgtgtaataatggt

SEQ ID NO: 203063 - DNA, 75 bp, Artificial Sequence
  Synthetic
attataaaggctcagtttaaaccatttgctaaagttgacggtgtttatactaactttaagttagttggacatgat

SEQ ID NO: 203064 - DNA, 75 bp, Artificial Sequence
  Synthetic
aaaatttcatctagtgctggtgattctatttttaagagttatcattttacccggttttataattacactggcgag

SEQ ID NO: 203065 - DNA, 75 bp, Artificial Sequence
  Synthetic
gtgttaatttcaatcctcatcataggtttaagtgcttctttaatggtagtaatgatgtatggatttttaacaagg

SEQ ID NO: 203066 - DNA, 75 bp, Artificial Sequence
  Synthetic
taatatggctctttttcgctatcttacctttgttgatattctttacaatttttctttttctattaaggctaatat

SEQ ID NO: 203067 - DNA, 75 bp, Artificial Sequence
  Synthetic
ttgtaatagtaatattttatcacttaataatcctatttttattagtactaattattctaaggacgtttatttcac

SEQ ID NO: 203068 - DNA, 75 bp, Artificial Sequence
  Synthetic
tttatcagggtgttctttgtatttagtacctctttgtctttttaaatctaattttagtcagtactattataatat

SEQ ID NO: 203069 - DNA, 75 bp, Artificial Sequence
  Synthetic
ggatactggctttgcttatggttattctaattttgtttcttctgatttagattgtacatatatttctcttaaacc

SEQ ID NO: 203070 - DNA, 75 bp, Artificial Sequence
  Synthetic
tggttcttataaaattttttctactggttttgttttatccatacctactaaagctctttgctttaataaatctaa

SEQ ID NO: 203071 - DNA, 75 bp, Artificial Sequence
  Synthetic
ggttttgttttatccatacctactaaagctctttgctttaataaatctaaacaatttgtacccgtgcaggttgtt

SEQ ID NO: 203072 - DNA, 75 bp, Artificial Sequence
  Synthetic
attttgtaggttgtatattgaagagagtgatttaataatttcaaattttaaatttgatgattatgattttagtgt

SEQ ID NO: 203073 - DNA, 75 bp, Artificial Sequence
  Synthetic
gattctaggtggaacaatcttcgtgcatcggatacttcattatccgatgcatgtcagttgccttattgttatttt

SEQ ID NO: 203074 - DNA, 75 bp, Artificial Sequence
  Synthetic
catcggatacttcattatccgatgcatgtcagttgccttattgttattttcgcaattcttctggtaattatgttg

SEQ ID NO: 203075 - DNA, 75 bp, Artificial Sequence
  Synthetic
gcaaatatgatattaatcatggtgataatggttttacttctattctatctggtcttttatataatgtctcttgta

SEQ ID NO: 203076 - DNA, 75 bp, Artificial Sequence
  Synthetic
taatggttttacttctattctatctggtcttttatataatgtctcttgtatttcttattatggctcctttttgta

SEQ ID NO: 203077 - DNA, 75 bp, Artificial Sequence
  Synthetic
tcaagcttatggtcattattctttgcaagatatgagacaaaagcagtctgtatggcttgccaattgtgactttga

SEQ ID NO: 203078 - DNA, 75 bp, Artificial Sequence
  Synthetic
tgacaattttacatcaatttggcctcgtttttcttttggtaattgtcctacatctgcttatattaaattaaattg

SEQ ID NO: 203079 - DNA, 75 bp, Artificial Sequence
  Synthetic
cgtttttcttttggtaattgtcctacatctgcttatattaaattaaattgtttctatgatcctttgcctattatt

SEQ ID NO: 203080 - DNA, 75 bp, Artificial Sequence
  Synthetic
ttacaaggtattttattatttttagctttattgtttattgtgtttttactttttctagtttaccatggctaatat

SEQ ID NO: 203081 - DNA, 75 bp, Artificial Sequence
  Synthetic
ctttattgtttattgtgtttttactttttctagtttaccatggctaatattaaatctaaacatgtttttaattat

SEQ ID NO: 203082 - DNA, 75 bp, Artificial Sequence
  Synthetic
ttagagagagtttctttatggaattatggtaaagctattaatttaccaacaggttgtatgatgaatgttgctaag

SEQ ID NO: 203083 - DNA, 75 bp, Artificial Sequence
  Synthetic
ttttattttgcctacaacactagctgttataggtgattttaattgtactaactcttttattaatgattataataa

SEQ ID NO: 203084 - DNA, 75 bp, Artificial Sequence
  Synthetic
gttataggtgattttaattgtactaactcttttattaatgattataataaaaccattccgcgtataagcgaggat

SEQ ID NO: 203085 - DNA, 75 bp, Artificial Sequence
  Synthetic
gttgttgatgtatctcttggtttgggcacatattatgttcttaaccgtgtttatttaaatactaccttgttattt

SEQ ID NO: 203086 - DNA, 75 bp, Artificial Sequence
  Synthetic
tggtataaaccaccttttctgtcagattttaataatggtattttttctaaggttaagaatactaagttatatgtt

SEQ ID NO: 203087 - DNA, 75 bp, Artificial Sequence
  Synthetic
attttaataatggtattttttctaaggttaagaatactaagttatatgttaataatactttgtatagtgaattta

SEQ ID NO: 203088 - DNA, 75 bp, Artificial Sequence
  Synthetic
gtactatagttataggtagtgtttttgttaatacttcttatactattgttgttcaacctcacaatggtattttgg

SEQ ID NO: 203089 - DNA, 75 bp, Artificial Sequence
  Synthetic
tgttaatacttcttatactattgttgttcaacctcacaatggtattttggagattacagcttgtcagtatactat

SEQ ID NO: 203090 - DNA, 75 bp, Artificial Sequence
  Synthetic
gtgtgaatatcctcacactgtttgtaagtctaagggtagtattcgtaatgaatcttggcacattgattcttcgga

SEQ ID NO: 203091 - DNA, 75 bp, Artificial Sequence
  Synthetic
aagtctaagggtagtattcgtaatgaatcttggcacattgattcttcggaacctttatgcttgtttaagaaaaat

SEQ ID NO: 203092 - DNA, 75 bp, Artificial Sequence
  Synthetic
tttacttataatgtttctgcagattggctgtattttcatttttatcaagaacgtggtgttttttatgcatattat

SEQ ID NO: 203093 - DNA, 75 bp, Artificial Sequence
  Synthetic
caaatactgacaatgaaactttagaatattgggttacaccgctatctagacgtcagtatcttcttaattttgatg

SEQ ID NO: 203094 - DNA, 75 bp, Artificial Sequence
  Synthetic
agcacggtgttattactaatgccgttgattgttcaagtagttttcttagtgagattcaatgtaaaactcaatctt

SEQ ID NO: 203095 - DNA, 75 bp, Artificial Sequence
  Synthetic
tgattgttcaagtagttttcttagtgagattcaatgtaaaactcaatcttttgcacctaatactggtgtttatga

SEQ ID NO: 203096 - DNA, 75 bp, Artificial Sequence
  Synthetic
ttaatattaaatctaaactatgttaattatatttttattttttaatttttgttatggttttaatgaacctttgaa

SEQ ID NO: 203097 - DNA, 75 bp, Artificial Sequence
  Synthetic
gagattcaatgtaaaactcaatcttttgcacctaatactggtgtttatgatttgtctggttttactgtaaagcct

SEQ ID NO: 203098 - DNA, 75 bp, Artificial Sequence
  Synthetic
gttgcaactgtttatcgtcggattcctaatttacctgattgtgacattgacaactggcttaataatgttagtgta

SEQ ID NO: 203099 - DNA, 75 bp, Artificial Sequence
  Synthetic
caactggcttaataatgttagtgtaccttcacctcttaattgggaacgtagaattttttctaattgtaacttcaa

SEQ ID NO: 203100 - DNA, 75 bp, Artificial Sequence
  Synthetic
tttaagcactttacttcgtctagttcatgttgattctttttcttgtaataatcttgataaatctaaaatttttgg

SEQ ID NO: 203101 - DNA, 75 bp, Artificial Sequence
  Synthetic
catgttgattctttttcttgtaataatcttgataaatctaaaatttttggtagttgctttaatagtattactgtt

SEQ ID NO: 203102 - DNA, 75 bp, Artificial Sequence
  Synthetic
gacaagtttgctatacctaatcgcagacgagatgatttgcaattgggcagttctggctttttgcaatcatctaat

SEQ ID NO: 203103 - DNA, 75 bp, Artificial Sequence
  Synthetic
gacgagatgatttgcaattgggcagttctggctttttgcaatcatctaattacaaaatagatatttcttctagtt

SEQ ID NO: 203104 - DNA, 75 bp, Artificial Sequence
  Synthetic
cttgtcaattgtattatagtttacctttagttaatgttactattaataactttaatccatcttcttggaatagga

SEQ ID NO: 203105 - DNA, 75 bp, Artificial Sequence
  Synthetic
tttagttaatgttactattaataactttaatccatcttcttggaataggaggtatggttttggtagttttaatgt

SEQ ID NO: 203106 - DNA, 75 bp, Artificial Sequence
  Synthetic
gtcttcttatgacgttgtttattctgatcattgtttttctgttaacagcgacttttgcccttgtgcagatccgtc

SEQ ID NO: 203107 - DNA, 75 bp, Artificial Sequence
  Synthetic
catactatgttggttaagatagatggtgattatgtttatttaccatatccagatccttctagaattttaggagct

SEQ ID NO: 203108 - DNA, 75 bp, Artificial Sequence
  Synthetic
aactggtgtagatgttcttgtctacctgaccccatttctacttattctcctaacacatgtcctcaaaagaaggtc

SEQ ID NO: 203109 - DNA, 75 bp, Artificial Sequence
  Synthetic
ctgaccccatttctacttattctcctaacacatgtcctcaaaagaaggtcgttgttggtataggtgaacattgtc

SEQ ID NO: 203110 - DNA, 75 bp, Artificial Sequence
  Synthetic
actggttatactctttcagatttgcccgtatatgttactgtagctaaggtgcaagtactttgtacctataaacgt

SEQ ID NO: 203111 - DNA, 75 bp, Artificial Sequence
  Synthetic
caggtcttggtattaatgaggaaaaatgtggtacacaattaaatcatagttcctgttcttgtagtcctgatgcct

SEQ ID NO: 203112 - DNA, 75 bp, Artificial Sequence
  Synthetic
tatagagaatgctttaaactcttgtaaagagcatccagtggttggttatcaagttcgtgcatttttaaataaact

SEQ ID NO: 203113 - DNA, 75 bp, Artificial Sequence
  Synthetic
atgtggtacacaattaaatcatagttcctgttcttgtagtcctgatgcctttttgggttggtcttttgatagttg

SEQ ID NO: 203114 - DNA, 75 bp, Artificial Sequence
  Synthetic
tattagtaataatcgttgcaatattttttctaattttatttttaatggaattaatagtggcaccacttgttctaa

SEQ ID NO: 203115 - DNA, 75 bp, Artificial Sequence
  Synthetic
ttttctaattttatttttaatggaattaatagtggcaccacttgttctaatgatttgttatattctaacactgaa

SEQ ID NO: 203116 - DNA, 75 bp, Artificial Sequence
  Synthetic
gatgaggctggtgatgaagcaatggcctctcgtatgtattgtacttttgctattgaggatgttgaagacgttatc

SEQ ID NO: 203117 - DNA, 75 bp, Artificial Sequence
  Synthetic
gtttctactggtgtttgtgttaattatgatctttatggcatcacaggccaaggtatttttaaagaagtttctgcg

SEQ ID NO: 203118 - DNA, 75 bp, Artificial Sequence
  Synthetic
atgatctttatggcatcacaggccaaggtatttttaaagaagtttctgcggcttattataataattggcagaatc

SEQ ID NO: 203119 - DNA, 75 bp, Artificial Sequence
  Synthetic
ttttgtatgattctaatggtaatattattggttttaaagattttttgactaataaaacttacactatacttcctt

SEQ ID NO: 203120 - DNA, 75 bp, Artificial Sequence
  Synthetic
tattggttttaaagattttttgactaataaaacttacactatacttccttgttattctggtagagtgtctgctgc

SEQ ID NO: 203121 - DNA, 75 bp, Artificial Sequence
  Synthetic
tgttgttactggtgacaatgacgatgaagatgttgttactggtgacaatgacgatgaagatgttgttactggtga

SEQ ID NO: 203122 - DNA, 75 bp, Artificial Sequence
  Synthetic
caatgacgatgaagatgttgttactggtgacaatgacgatgaagatgttgttactggtgacaatgacgatgaaga

SEQ ID NO: 203123 - DNA, 75 bp, Artificial Sequence
  Synthetic
actgattttactggtaatttttatggtccatatagagatgctcaagttgtacagttgccagttaaggactatgtc

SEQ ID NO: 203124 - DNA, 75 bp, Artificial Sequence
  Synthetic
attttatcaaaattcttcttcaccagctttgctttatcgtaatttaaagtgtagttatgttttgaataatatttc

SEQ ID NO: 203125 - DNA, 75 bp, Artificial Sequence
  Synthetic
gctttgctttatcgtaatttaaagtgtagttatgttttgaataatatttcttttatctcacaaccattttatttt

SEQ ID NO: 203126 - DNA, 75 bp, Artificial Sequence
  Synthetic
gatagttatcttggttgtgttttgaatgctgttaatttaactagctattctgtatcctcttgtgatttgcgtatg

SEQ ID NO: 203127 - DNA, 75 bp, Artificial Sequence
  Synthetic
ttgtagagtgggtgcatgtgaatacgccgaagagggtatatgttttaattttaatagttcctgggttttgaataa

SEQ ID NO: 203128 - DNA, 75 bp, Artificial Sequence
  Synthetic
atgctgttaatttaactagctattctgtatcctcttgtgatttgcgtatgggtagtgggttttgtattgattatg

SEQ ID NO: 203129 - DNA, 75 bp, Artificial Sequence
  Synthetic
ctttaccctcttctcggcgtaagcgtagaggtatttcttctccttatcgctttgtaacttttgaaccctttaatg

SEQ ID NO: 203130 - DNA, 75 bp, Artificial Sequence
  Synthetic
tagaggtatttcttctccttatcgctttgtaacttttgaaccctttaatgttagttttgttaacgatagtgttga

SEQ ID NO: 203131 - DNA, 75 bp, Artificial Sequence
  Synthetic
ctctctggtataaaccaccttttctgtcagattttaataatggtattttttctaaggttaagaatactaagttat

SEQ ID NO: 203132 - DNA, 75 bp, Artificial Sequence
  Synthetic
tttaattcgtcctatagatttcttttctcttactgctagttctatttttggagctatattggctatagttgttgt

SEQ ID NO: 203133 - DNA, 75 bp, Artificial Sequence
  Synthetic
aactgttggtggtttatttgagattcagattcctactaactttaccatagctggtcatgaagaatttattcagac

SEQ ID NO: 203134 - DNA, 75 bp, Artificial Sequence
  Synthetic
cttaagcgtgcttttggagattatactagtgttgtagttataaatgttgttgtttggtgtattaattttcttatg

SEQ ID NO: 203135 - DNA, 75 bp, Artificial Sequence
  Synthetic
acattcagattctatagtaaaacctgatatggctgatgagatcgctaatcttgttttagccaagcttggtaaaga

SEQ ID NO: 203136 - DNA, 75 bp, Artificial Sequence
  Synthetic
atgctgcttgtcatgatttattgtcggaatatggcactttttgcgataatattaatagtattttaaatgaagtca

SEQ ID NO: 203137 - DNA, 75 bp, Artificial Sequence
  Synthetic
ggaatatggcactttttgcgataatattaatagtattttaaatgaagtcaatgatttacttgatattactcagtt

SEQ ID NO: 203138 - DNA, 75 bp, Artificial Sequence
  Synthetic
gcaggttgctaatgctttaatgcaaggtgttacacttagttctaatcttaatactaatctacactctgatgttga

SEQ ID NO: 203139 - DNA, 75 bp, Artificial Sequence
  Synthetic
tttgatattaatgcgtatgctaattggtgttgtttaaaatgtggtttttcttttgatttaaatggtttggatgct

SEQ ID NO: 203140 - DNA, 75 bp, Artificial Sequence
  Synthetic
ggtgttacacttagttctaatcttaatactaatctacactctgatgttgataatatagattttaaatctcttcta

SEQ ID NO: 203141 - DNA, 75 bp, Artificial Sequence
  Synthetic
ggttgtttaggttcacaatgtggttcttcgtctagatctttgttagaggatttattattcaacaaggtcaaactt

SEQ ID NO: 203142 - DNA, 75 bp, Artificial Sequence
  Synthetic
cactttcttatttagtttatatttaggtactattttatctcattattatgttatgcctttgacttgtaatgctat

SEQ ID NO: 203143 - DNA, 75 bp, Artificial Sequence
  Synthetic
cttcgtctagatctttgttagaggatttattattcaacaaggtcaaactttcagatgtaggttttgttgaagctt

SEQ ID NO: 203144 - DNA, 75 bp, Artificial Sequence
  Synthetic
ataataattgcactggtggtagtgaaattagagatcttctctgtgtgcaatcttttaatggtattaaagtattac

SEQ ID NO: 203145 - DNA, 75 bp, Artificial Sequence
  Synthetic
ctcccattttatctgagactcaaatttctggctatactacagctgctactgtggcggctatgtttccgccatggt

SEQ ID NO: 203146 - DNA, 75 bp, Artificial Sequence
  Synthetic
ggtttgggtgttactatggatgttcttaataagaatcaaaagttaatagctaatgcttttaataaagctcttctt

SEQ ID NO: 203147 - DNA, 75 bp, Artificial Sequence
  Synthetic
tctatccagaatggttttactgctactaactctgctcttgctaaaattcaaagtgtcgttaatgctaatgctcaa

SEQ ID NO: 203148 - DNA, 75 bp, Artificial Sequence
  Synthetic
cctaattcgacactaggtggtaacccctcgctattattcggaataggacactctctatcagaatgaattcttgct

SEQ ID NO: 203149 - DNA, 75 bp, Artificial Sequence
  Synthetic
ctaactctgctcttgctaaaattcaaagtgtcgttaatgctaatgctcaagcacttaatagtttgttacaacaat

SEQ ID NO: 203150 - DNA, 75 bp, Artificial Sequence
  Synthetic
tatttaataaatttggtgctattagttcttctttacaagaaattttgtctcgccttgataatttagaagctcagg

SEQ ID NO: 203151 - DNA, 75 bp, Artificial Sequence
  Synthetic
ttcttctttacaagaaattttgtctcgccttgataatttagaagctcaggttcagattgataggctcattaatgg

SEQ ID NO: 203152 - DNA, 75 bp, Artificial Sequence
  Synthetic
tagagtagttataaggtttagctgtagtataaacgcctccgggaagagctatcaattgtagtgtttaatatatat

SEQ ID NO: 203153 - DNA, 75 bp, Artificial Sequence
  Synthetic
tcgtttgactgctttaaatgcttatgtttctcaacagcttagtgatattacacttattaaggctggagcttctcg

SEQ ID NO: 203154 - DNA, 75 bp, Artificial Sequence
  Synthetic
gtttctcaacagcttagtgatattacacttattaaggctggagcttctcgtgctattgagaaggttaatgagtgt

SEQ ID NO: 203155 - DNA, 75 bp, Artificial Sequence
  Synthetic
tcctgtgttatttactaatagtactgatactgttaaccctgattcttttaatttgtatggttattctgtcacacc

SEQ ID NO: 203156 - DNA, 75 bp, Artificial Sequence
  Synthetic
gttaaaagtcaatcccctcgtataaatttttgtggcaatggtaaccacattttatcattggttcaaaatgctcct

SEQ ID NO: 203157 - DNA, 75 bp, Artificial Sequence
  Synthetic
atttttgtggcaatggtaaccacattttatcattggttcaaaatgctccttatggtttgcttttcattcatttta

SEQ ID NO: 203158 - DNA, 75 bp, Artificial Sequence
  Synthetic
gttataaacctacttcttttaaaactgtcttagtaagtccaggtttatgtttatccggtgatagaggtattgcac

SEQ ID NO: 203159 - DNA, 75 bp, Artificial Sequence
  Synthetic
taggccgtgttattaaatttgagacagatgcatacaaactttttttgagtggtgatgattgttttgtttcaaatt

SEQ ID NO: 203160 - DNA, 75 bp, Artificial Sequence
  Synthetic
ttatccggtgatagaggtattgcacctaagcaaggttattttattaaacaaaatgattcctggatgtttactggt

SEQ ID NO: 203161 - DNA, 75 bp, Artificial Sequence
  Synthetic
agttagcgatgattatgttcaagatagtaccgttttgcaggctttgcaaagtgagtttgtaaatatggctagttt

SEQ ID NO: 203162 - DNA, 75 bp, Artificial Sequence
  Synthetic
agttcctattattacccagaaccaatttcagataaaaatgttgttttcatgaatagttgctctgttaattttact

SEQ ID NO: 203163 - DNA, 75 bp, Artificial Sequence
  Synthetic
tttcagataaaaatgttgttttcatgaatagttgctctgttaattttactaaagctccatttatttatcttaata

SEQ ID NO: 203164 - DNA, 75 bp, Artificial Sequence
  Synthetic
attctataccaaatttgtctgattttgaagccgagttttctctttggtttaaaaatcatacttctatagcaccta

SEQ ID NO: 203165 - DNA, 75 bp, Artificial Sequence
  Synthetic
tgaagccgagttttctctttggtttaaaaatcatacttctatagcacctaatttaacctttaattctcatattaa

SEQ ID NO: 203166 - DNA, 75 bp, Artificial Sequence
  Synthetic
tgctacttttttagatctgtattatgaaatgaatgttattcaggaatctattaaatctttgaacagtagttttat

SEQ ID NO: 203167 - DNA, 75 bp, Artificial Sequence
  Synthetic
gaaatgaatgttattcaggaatctattaaatctttgaacagtagttttattaatcttaaagaaataggtacttat

SEQ ID NO: 203168 - DNA, 75 bp, Artificial Sequence
  Synthetic
gaaatgtatgttaaatggccttggtacatttggttgttaattgtcattttatttataatttttcttatgatactt

SEQ ID NO: 203169 - DNA, 75 bp, Artificial Sequence
  Synthetic
acatttggttgttaattgtcattttatttataatttttcttatgatacttttctttatatgctgctgtactggtt

SEQ ID NO: 203170 - DNA, 75 bp, Artificial Sequence
  Synthetic
gtggttcagcatgttttagtaaatgtcataattgttgtgatgagtatgggggtcacaatgattttgttattaaag

SEQ ID NO: 203171 - DNA, 75 bp, Artificial Sequence
  Synthetic
tcataattgttgtgatgagtatgggggtcacaatgattttgttattaaagcatctcatgatgattagattttaaa

SEQ ID NO: 203172 - DNA, 75 bp, Artificial Sequence
  Synthetic
tctaaactttatatatggaagtttggaggcctagctataaatattctcttattactagagaatttggtgtcacag

SEQ ID NO: 203173 - DNA, 75 bp, Artificial Sequence
  Synthetic
ggtgacaataacgatgaagatgttgttactggtgacaataacgatgaagagagtgttactggtgacaatgatgac

SEQ ID NO: 203174 - DNA, 75 bp, Artificial Sequence
  Synthetic
gaggcctagctataaatattctcttattactagagaatttggtgtcacagatcttgaggatttgtgttttaaata

SEQ ID NO: 203175 - DNA, 75 bp, Artificial Sequence
  Synthetic
taattattgccaaccttgtgttggttattgtattgtacctttaaacgtttggtgtcgtaagtttggtaaatttgc

SEQ ID NO: 203176 - DNA, 75 bp, Artificial Sequence
  Synthetic
tattgtattgtacctttaaacgtttggtgtcgtaagtttggtaaatttgcttcttattttgttttacgtagtcat

SEQ ID NO: 203177 - DNA, 75 bp, Artificial Sequence
  Synthetic
gctgtgaattttacttatgtttatgaagtattttatggttgtattttatgtgtttttgctatttttataactatg

SEQ ID NO: 203178 - DNA, 75 bp, Artificial Sequence
  Synthetic
gacacctctcataagaataattttggtgttataactagttttactagttatggtaacactgtttctgaggctgtt

SEQ ID NO: 203179 - DNA, 75 bp, Artificial Sequence
  Synthetic
gtgttataactagttttactagttatggtaacactgtttctgaggctgtttctaaattagttgaatcagcatctg

SEQ ID NO: 203180 - DNA, 75 bp, Artificial Sequence
  Synthetic
attttatcgcttggcgagctgaagcacttaataagtatggttgatgtatttttcactgatactgcttggtatgta

SEQ ID NO: 203181 - DNA, 75 bp, Artificial Sequence
  Synthetic
tttcactgatactgcttggtatgtaggtcagattttctttttagttttatcttgtgtcattttcttaatttttgt

SEQ ID NO: 203182 - DNA, 75 bp, Artificial Sequence
  Synthetic
catagctggtcatgaagaatttattcagactagttctcctaaagttactattgattgttcagcttttgtttgctc

SEQ ID NO: 203183 - DNA, 75 bp, Artificial Sequence
  Synthetic
tgttgcacttttagcaactattaaactttgtattcaaatttgtggtttttgtaatatttttattatttcaccttc

SEQ ID NO: 203184 - DNA, 75 bp, Artificial Sequence
  Synthetic
ctttgtattcaaatttgtggtttttgtaatatttttattatttcaccttctgcctatgtttataatagaggtaga

SEQ ID NO: 203185 - DNA, 75 bp, Artificial Sequence
  Synthetic
atgaatgttgctaagtatactcaattatgtcagtatttgaatactacaacattagctgttcctgttaatatgcgt

SEQ ID NO: 203186 - DNA, 75 bp, Artificial Sequence
  Synthetic
cagttgtataagtcttatagtgaacatgtcataccttctactttagatgatttaatttaaatctaaacatcatga

SEQ ID NO: 203187 - DNA, 75 bp, Artificial Sequence
  Synthetic
gatgcttgtagtgttaaaaaatatacaggtgttagtggttgtttaactgactgcttgtatcttaaaaatttaacc

SEQ ID NO: 203188 - DNA, 75 bp, Artificial Sequence
  Synthetic
actgcagtttggttatacgagtcgtagtatgtttgtttatcttattaagatgattattctttggcttatgtggcc

SEQ ID NO: 203189 - DNA, 75 bp, Artificial Sequence
  Synthetic
tacaagtccctttgggtataaaagaccctattctttatgtgttaacacatgatgtttgtcaagtctgtggttttt

SEQ ID NO: 203190 - DNA, 75 bp, Artificial Sequence
  Synthetic
caatattattgtgataatggtaagtattatacaaaacctattataaaggctcagtttaaaccatttgctaaagtt

SEQ ID NO: 203191 - DNA, 75 bp, Artificial Sequence
  Synthetic
agtatgtttgtttatcttattaagatgattattctttggcttatgtggccattgaccattatcttgactatattt

SEQ ID NO: 203192 - DNA, 75 bp, Artificial Sequence
  Synthetic
aattgcttttatgctttgaataatatctttcttgggctttctatactgtttactattatttctattgttatatgg

SEQ ID NO: 203193 - DNA, 75 bp, Artificial Sequence
  Synthetic
tactattatttctattgttatatggattttatattttgtcaacagtattcggctttttatcagaactggcagttg

SEQ ID NO: 203194 - DNA, 75 bp, Artificial Sequence
  Synthetic
gtggagttttaacccagagactaataatcttatgtgtattgatatgaaaggtaagatgtatgttaggccagttat

SEQ ID NO: 203195 - DNA, 75 bp, Artificial Sequence
  Synthetic
aatcttatgtgtattgatatgaaaggtaagatgtatgttaggccagttattgaggactatcatacattaacggct

SEQ ID NO: 203196 - DNA, 75 bp, Artificial Sequence
  Synthetic
actgttatccgtggtcatctttatatacagggtgttaaacttggcactggttacacgcttgccgatttgcctgtt

SEQ ID NO: 203197 - DNA, 75 bp, Artificial Sequence
  Synthetic
tacagggtgttaaacttggcactggttacacgcttgccgatttgcctgtttatgttactgtagctaaggtgcaag

SEQ ID NO: 203198 - DNA, 75 bp, Artificial Sequence
  Synthetic
tatagtttatttgatatgactaaattttctttgaaattggctggcactgctgtagtaaatttaagaccagatcaa

SEQ ID NO: 203199 - DNA, 75 bp, Artificial Sequence
  Synthetic
tgagcgaagccatcaaacctataatagaggcagaaaaccccaacccaaattcactgtgtctactcaaccacaagg

SEQ ID NO: 203200 - DNA, 75 bp, Artificial Sequence
  Synthetic
atatggtattaaacctattactatacctatagatttgttatgtttaagagatgataatcaaactcttttagttcc

SEQ ID NO: 203201 - DNA, 75 bp, Artificial Sequence
  Synthetic
ttcttttaaaacagctgatggtcaacaaaagcagttgttaccaagatggtatttctactatctcggtaccggtcc

SEQ ID NO: 203202 - DNA, 75 bp, Artificial Sequence
  Synthetic
gccattactggagcccacaaggtaatctaggtggtaattgcgcgggtaatgtcattggtaatgatgctctaacac

SEQ ID NO: 203203 - DNA, 75 bp, Artificial Sequence
  Synthetic
tggacccaataatcgttcattaagtagaagtaattctaattttagacattctgattctatagtgaaacctgatat

SEQ ID NO: 203204 - DNA, 75 bp, Artificial Sequence
  Synthetic
ggctgatgagattgctagtcttgtcttggccaagcttggtaaagattctaaacctcagcaagttaccaagcaaaa

SEQ ID NO: 203205 - DNA, 75 bp, Artificial Sequence
  Synthetic
ttggccaagcttggtaaagattctaaacctcagcaagttaccaagcaaaatgctaaggaaattaggcataaaatt

SEQ ID NO: 203206 - DNA, 75 bp, Artificial Sequence
  Synthetic
ttaatgaaacctcgccaaaagcgaactcctaataaattttgtaatgttcaacagtgttttggtaaaagaggaccg

SEQ ID NO: 203207 - DNA, 75 bp, Artificial Sequence
  Synthetic
ctcctaataaattttgtaatgttcaacagtgttttggtaaaagaggaccgctccaaaactttggtaattctgaaa

SEQ ID NO: 203208 - DNA, 75 bp, Artificial Sequence
  Synthetic
tgcaaataggtttttcaactggtgtggattttgtagttgaagctactggcttatttgctgagagagattgttata

SEQ ID NO: 203209 - DNA, 75 bp, Artificial Sequence
  Synthetic
tgttaaagcttggtactaatgatcctcaatttcctattcttgctgaattagcccctacaccaggtgcttttttct

SEQ ID NO: 203210 - DNA, 75 bp, Artificial Sequence
  Synthetic
tcaatttcctattcttgctgaattagcccctacaccaggtgcttttttctttggctctaaattagagttgtttaa

SEQ ID NO: 203211 - DNA, 75 bp, Artificial Sequence
  Synthetic
ctatatattaattagtagaaactttatatttaaatatttgattgttagagtagttataaggtttagctgtagtat

SEQ ID NO: 203212 - DNA, 75 bp, Artificial Sequence
  Synthetic
gagctagcaattatagtatttaatatatatattagtatatgattgaaattaattatagccttttggaggaattac

SEQ ID NO: 203213 - DNA, 75 bp, Artificial Sequence
  Synthetic
gcctttttagataagttagatgttaatagtggctttgctgtttttgttaagtctaaagttggtaactatcgttta

SEQ ID NO: 203214 - DNA, 75 bp, Artificial Sequence
  Synthetic
tcaacttactgctgatttacagcataaattaaaaaaagcatgtgttaaaactggcttgaagttaaaattgacttt

SEQ ID NO: 203215 - DNA, 75 bp, Artificial Sequence
  Synthetic
tgaggctactattaaccaagattcttatggtggtgcctctgtttgtatttattgccgtgcacgtgtagagcatcc

SEQ ID NO: 203216 - DNA, 75 bp, Artificial Sequence
  Synthetic
cctggttctctgggattacccaatttcaaaaaggtagagactttaaatttccagatggtcaaggagtacccattg

SEQ ID NO: 203217 - DNA, 75 bp, Artificial Sequence
  Synthetic
tttttccaatttgatcaatggtatgagtccacttttgggtctgtttactatcataattctatggattgccctatt

SEQ ID NO: 203218 - DNA, 75 bp, Artificial Sequence
  Synthetic
catttgctagtgatagtgttcagtgctatacaccacatattcagatttcttataatgatttttatgctagtggtt

SEQ ID NO: 203219 - DNA, 75 bp, Artificial Sequence
  Synthetic
ttgatagagcgctttgtaagtctagctatagatgcttaccctttagtacatcatgaaaatgaagaataccaaaaa

SEQ ID NO: 203220 - DNA, 75 bp, Artificial Sequence
  Synthetic
tcaagtttatcctatttgtgcatgtgtttatgcttgtttttatttttatgtaacattgtattttccttctgaaat

SEQ ID NO: 203221 - DNA, 75 bp, Artificial Sequence
  Synthetic
aatgattggaaacctggctattctatgcctgttttgtataagtatttgaatgttccattagagagagtctcttta

SEQ ID NO: 203222 - DNA, 75 bp, Artificial Sequence
  Synthetic
tttaaatactactatattatttactggttatttccctaaagctggtgctaattttagggatctatctttaaaagg

SEQ ID NO: 203223 - DNA, 75 bp, Artificial Sequence
  Synthetic
cctcgctatgagtcggaataggacactctctatcagaatgaattcttgctgttacaacagatagagtaggttgtt

SEQ ID NO: 203224 - DNA, 75 bp, Artificial Sequence
  Synthetic
ctgattattctgccttattgtgtagagttactctaggtgattttactataatgtctggtcggatgagtttaacag

SEQ ID NO: 203225 - DNA, 75 bp, Artificial Sequence
  Synthetic
gcagatcttgttttagatgctttggcttcaatgacaggtgtttctattgaaactttattggctgctattaagcgt

SEQ ID NO: 203226 - DNA, 75 bp, Artificial Sequence
  Synthetic
ggtgacaatgacgatgaagatgttgttactggtgacaatgatgatgacaatgatgaccaaattgttgttattggt

SEQ ID NO: 203227 - DNA, 75 bp, Artificial Sequence
  Synthetic
attgttttgcctcaaggtggttttgtagctgattttgcttattggtttttaaaccagtttgatattaatgcgtat

SEQ ID NO: 203228 - DNA, 75 bp, Artificial Sequence
  Synthetic
tttgttttgcctcaaggtggttttgtagctgattttgcttattggtttttaaaccagtttgatattaatgcgtat

SEQ ID NO: 203229 - DNA, 75 bp, Artificial Sequence
  Synthetic
cttgttttgcctcaaggtggttttgtagctgattttgcttattggtttttaaaccagtttgatattaatgcgtat

SEQ ID NO: 203230 - DNA, 75 bp, Artificial Sequence
  Synthetic
gttgttttgcctcaaggtggttttgtagctgattttgcttattggtttttaaaccagtttgatattaatgcgtat

SEQ ID NO: 203231 - DNA, 75 bp, Artificial Sequence
  Synthetic
ggttgtattttatgtgtttttgctatttttataactatgcatagtattaatcatgacattttttctttgatgttt

SEQ ID NO: 203232 - DNA, 75 bp, Artificial Sequence
  Synthetic
aaccataaagttataggaggtttgcatttgcttataggcttatttcgtaggctaaaaaaatctaatttgttaatt

SEQ ID NO: 203233 - DNA, 75 bp, Artificial Sequence
  Synthetic
attattcatttaagttagttatgaatggtatggtctttggtttgtataaacaatcttgtacgggttcaccttata

SEQ ID NO: 203234 - DNA, 75 bp, Artificial Sequence
  Synthetic
tctcttgagttacttatttatagggtatattttatcttgttattggggatttttctctcttttaaacagtgtttt

SEQ ID NO: 203235 - DNA, 75 bp, Artificial Sequence
  Synthetic
tgtataccagcatcacaagttattgttaataattatgataaaagtgctggttatccatttaataaatttggtaaa

SEQ ID NO: 203236 - DNA, 75 bp, Artificial Sequence
  Synthetic
gctactggcttatttgctgagagagattgttatacttttaaaaaaactgtagctaaagctcctcctggtgaaaaa

SEQ ID NO: 203237 - DNA, 75 bp, Artificial Sequence
  Synthetic
agctcgcaaacttgaacgtatggcagacctagcacttactaacatgtataaagaggctcggattaatgataagaa

SEQ ID NO: 203238 - DNA, 75 bp, Artificial Sequence
  Synthetic
aattggataatcaggctttaaattctattctggataatgctgttaaaggttgtgtacctttgagtgctattccag

SEQ ID NO: 203239 - DNA, 75 bp, Artificial Sequence
  Synthetic
aattacctgcaccacgtgtgctgttgagcaagggttctttagaacctaggcacttcaattctattactaaaataa

SEQ ID NO: 203240 - DNA, 75 bp, Artificial Sequence
  Synthetic
tatacagactgttcaagatgctgatggtattaataaacagttaactgatattagtgttgattctaattggcctct

SEQ ID NO: 203241 - DNA, 75 bp, Artificial Sequence
  Synthetic
tactgataatgagactttacaatattgggtcacacctttgtctaaacgccaatatcttcttaaatttgacaaccg

SEQ ID NO: 203242 - DNA, 75 bp, Artificial Sequence
  Synthetic
aattacgtggtaaatttgtacaagtccctttgggtataaaagatcctattctttatgtgttaacacatgatgttt

SEQ ID NO: 203243 - DNA, 75 bp, Artificial Sequence
  Synthetic
catatagttcgtaggaatctttcaaagtatactatgttagatctttgctatgcattgcgtcattttgatcgtaat

SEQ ID NO: 203244 - DNA, 75 bp, Artificial Sequence
  Synthetic
gatatacaacagtggggttatacaggttctttaactagtaatcacgatataatttgtaatgtacataaaggtgca

SEQ ID NO: 203245 - DNA, 75 bp, Artificial Sequence
  Synthetic
taaagtatattttaagggacagacaacacatgagagttcaagtgctgtaaatattcaacagatatatttaattag

SEQ ID NO: 203246 - DNA, 75 bp, Artificial Sequence
  Synthetic
tttttgtgttatgagtaatatgcaattatttgaatctcttaattttattactctacctttagataaaattcaaaa

SEQ ID NO: 203247 - DNA, 75 bp, Artificial Sequence
  Synthetic
ccattacaagtggtataaaatttcaaactgtaaaaccaggtaactttaaccaagacttttacgagtttgttaaaa

SEQ ID NO: 203248 - DNA, 75 bp, Artificial Sequence
  Synthetic
atagtacaacatggaatggcggtgcttatagtttatttgatatgactaaattttctttgaaattggctggcactg

SEQ ID NO: 203249 - DNA, 75 bp, Artificial Sequence
  Synthetic
acaacagtggggttatacaggttctttaactagtaatcacgatataatttgtaatgtacataaaggtgcacatgt

SEQ ID NO: 203250 - DNA, 75 bp, Artificial Sequence
  Synthetic
tgatgcaactactgcttttgctaattctgtttttaatatatgtcaggctgttactgctaatgtttgttctcttat

SEQ ID NO: 203251 - DNA, 75 bp, Artificial Sequence
  Synthetic
ggcctgtaatggccataagattgaagatttaagtatacgcaatttacaaaaacgcttatactctaatgtttatcg

SEQ ID NO: 203252 - DNA, 75 bp, Artificial Sequence
  Synthetic
gtaagcattttagtatgatgattttgagtgatgatggtgttgtctgttataactctgattatgctagtaagggtt

SEQ ID NO: 203253 - DNA, 75 bp, Artificial Sequence
  Synthetic
cttacaacacccttttcacttaaaggaggtgttgtattgagtaatttgttatatatattattttttattagttta

SEQ ID NO: 203254 - DNA, 75 bp, Artificial Sequence
  Synthetic
accagatcaattaaatgatttagtttattctcttattgaaagaggtaaattattagttcgcgatacgcgtaaaga

SEQ ID NO: 203255 - DNA, 75 bp, Artificial Sequence
  Synthetic
tattgaacgtttaaagttatttgctgcagaaactcaaaaggcaactgaagaggcttttaaacaaagctatgcttc

SEQ ID NO: 203256 - DNA, 75 bp, Artificial Sequence
  Synthetic
gactgttaatgttattgcttggctctatgcagctatacttaataattgtgcttggtttgtacaaaatgatgtttg

SEQ ID NO: 203257 - DNA, 75 bp, Artificial Sequence
  Synthetic
acgtgtagtttatactgctgctagtcatgctgctgtagatgcattgtgtgaaaaagcttataagtttttaaatat

SEQ ID NO: 203258 - DNA, 75 bp, Artificial Sequence
  Synthetic
tatgcttactaattatgaattgtctgttataaatgctcgtattaaagctaaacattatgtatatattggagatcc

SEQ ID NO: 203259 - DNA, 75 bp, Artificial Sequence
  Synthetic
gcaacattattggttttaaagattttgttactaataaaacatataatattttcccttgttatgcaggaagagttt

SEQ ID NO: 203260 - DNA, 75 bp, Artificial Sequence
  Synthetic
gtatgatgaatgttgctaagtatactcaattatgtcagtatttgaatactacaacattagctgttcctgttaata

SEQ ID NO: 203261 - DNA, 75 bp, Artificial Sequence
  Synthetic
atctttttgggaaattgttataggtgtcctaaagaaattgtagaaactgtttcagcattggtttatgataataaa

SEQ ID NO: 203262 - DNA, 75 bp, Artificial Sequence
  Synthetic
attatgttgctaagcgtgttttaggtgttcaaacacaaactgtagattctgctcaaggttcggaatatgattatg

SEQ ID NO: 203263 - DNA, 75 bp, Artificial Sequence
  Synthetic
agtctctggttggtgttggtgaacattgtgcagggttcggtgttgatgaagaaaagtgtggtgtattggatggat

SEQ ID NO: 203264 - DNA, 75 bp, Artificial Sequence
  Synthetic
agaaatagtacaacatggaatggtggtgcttatagtttatttgatatgactaaattttctttgaaattggctggc

SEQ ID NO: 203265 - DNA, 75 bp, Artificial Sequence
  Synthetic
aaattaaaaatacaagttgttaatagtggttctgatatgaattgtaatattcctactcaatgttattataataat

SEQ ID NO: 203266 - DNA, 75 bp, Artificial Sequence
  Synthetic
ttatttaaatactaccttgttatttacgggttattttcctaaatctggtgctaattttagagacttggctttaaa

SEQ ID NO: 203267 - DNA, 75 bp, Artificial Sequence
  Synthetic
aattatgactcgttgtttagcaatctatgattgtttttgtaaatctgttaattggaatttagagtatccaataat

SEQ ID NO: 203268 - DNA, 75 bp, Artificial Sequence
  Synthetic
tgttgttaattcttgtgttaaatctaagcctccttctgccatttgtcctgctggtactaaatatcgtcattgcga

SEQ ID NO: 203269 - DNA, 75 bp, Artificial Sequence
  Synthetic
ttaataaacatgcattccatactaatccttttactagaactgtttttgaaaatcttaagcctatgccttttttct

SEQ ID NO: 203270 - DNA, 75 bp, Artificial Sequence
  Synthetic
acctcgtaatagttttgaggctattttgttaaatttaaaactgcttggaataggtggcgtgccagttattgaagt

SEQ ID NO: 203271 - DNA, 75 bp, Artificial Sequence
  Synthetic
gataggcttattaatggtcgtttaactgctttaaatgcttatgtctctcaacagcttagtgatatttctcttgta

SEQ ID NO: 203272 - DNA, 75 bp, Artificial Sequence
  Synthetic
tgttgcttctaattctaagttgtggcagtattgtagtgttttacataatgaaatactatctacttcagatttgag

SEQ ID NO: 203273 - DNA, 75 bp, Artificial Sequence
  Synthetic
agaaaacgtaatatataacttggttaatgttggtcattatgatggacgtacaggtgaattaccttgtgctattat

SEQ ID NO: 203274 - DNA, 75 bp, Artificial Sequence
  Synthetic
ttgttgtttctattggttaccattacaaagagttaggtgtagttatgaacttagatgttgacacacaccgttatc

SEQ ID NO: 203275 - DNA, 75 bp, Artificial Sequence
  Synthetic
gtggtagagatctttttgatttgttttatcaattttttagtagtttaattcgtcctatagatttcttttctctta

SEQ ID NO: 203276 - DNA, 75 bp, Artificial Sequence
  Synthetic
cagtggttaccatctggtagtattcttgtagataatgatttaaacccatttgttagcgatagtttagttacttat

SEQ ID NO: 203277 - DNA, 75 bp, Artificial Sequence
  Synthetic
tttggagattgtatgactttaccatttgattgtcattgggatttgataatatctgatatgtatgatcctcttact

SEQ ID NO: 203278 - DNA, 75 bp, Artificial Sequence
  Synthetic
tagctatggagaaggttaatgagtgtgttaaaagtcaatctcctcgtattaatttttgtggtaatggtaatcata

SEQ ID NO: 203279 - DNA, 75 bp, Artificial Sequence
  Synthetic
atgatgacaatgatgaccaaattgttgttattggtgatgatgtagatgatattgaccctattaattgtgaaagta

SEQ ID NO: 203280 - DNA, 75 bp, Artificial Sequence
  Synthetic
tggcttcaatgacaggtgtttctattgaaactttattggctgctattaagcgtctatatatgggatttcaaggtc

SEQ ID NO: 203281 - DNA, 75 bp, Artificial Sequence
  Synthetic
tgtattgtacttttgctattgaggatgttgaagacgttatcagtagtgaagctgtcgaagatactattgatggtg

SEQ ID NO: 203282 - DNA, 75 bp, Artificial Sequence
  Synthetic
ttgtaaatacttgttagatctcattaaatctaaactatgttaattatttttttatttttttatttctgttatggt

SEQ ID NO: 203283 - DNA, 75 bp, Artificial Sequence
  Synthetic
gaaatttttctagtgctgtcatatgttatggcagtcctagtgtaattgaaatttcgtcaagtttgtaaactggtt

SEQ ID NO: 203284 - DNA, 75 bp, Artificial Sequence
  Synthetic
gaaatttttctagtgctgtcatttgttatggcagtcctagtgtaattgaaatttcgtcaagtttgtaaactggtt

SEQ ID NO: 203285 - DNA, 75 bp, Artificial Sequence
  Synthetic
gaaatttttctagtgctgtcatctgttatggcagtcctagtgtaattgaaatttcgtcaagtttgtaaactggtt

SEQ ID NO: 203286 - DNA, 75 bp, Artificial Sequence
  Synthetic
gaaatttttctagtgctgtcatgtgttatggcagtcctagtgtaattgaaatttcgtcaagtttgtaaactggtt

SEQ ID NO: 203287 - DNA, 75 bp, Artificial Sequence
  Synthetic
gctgttatgagtctagatatggcttgcaaaacttactacagttacctaacttttattatgttagtaatggtggta

SEQ ID NO: 203288 - DNA, 75 bp, Artificial Sequence
  Synthetic
ttgttatggcagtcctagtgtaattgaaatttcgtcaagtttgtaaactggttaggcaagtgttgtattttctgt

SEQ ID NO: 203289 - DNA, 75 bp, Artificial Sequence
  Synthetic
ccaataactgctaaccatgttttacaatcaagtgacacttgctgttgcaagtgattcggaaatttcaggttttgg

SEQ ID NO: 203290 - DNA, 75 bp, Artificial Sequence
  Synthetic
ttttgccattccttctgtagccgttcgcgcttatagcgaagccgctgcacaaggttttcaggcatgccgctttgt

SEQ ID NO: 203291 - DNA, 75 bp, Artificial Sequence
  Synthetic
tgcttttggcttacaggattgtgtaaccggtattaatgatgacgattatgtcattgcattgactggtactaatca

SEQ ID NO: 203292 - DNA, 75 bp, Artificial Sequence
  Synthetic
tattgctggacaagcttttttctatagtggtggtttttatcgttttatggttgattctacaactgtattaaatga

SEQ ID NO: 203293 - DNA, 75 bp, Artificial Sequence
  Synthetic
tcattgcattgactggtactaatcagctttgtgccaaaattttacttttttctgatagacctcttaatttgcgag

SEQ ID NO: 203294 - DNA, 75 bp, Artificial Sequence
  Synthetic
gttggctcattttttctaacagcaattatgttcttcaggactttgatgttgtttttggccatggtgcaggaagtg

SEQ ID NO: 203295 - DNA, 75 bp, Artificial Sequence
  Synthetic
gtttttggccatggtgcaggaagtgtggtttttgtggataagtatatgtgtggttttgatggtaaacctgtgtta

SEQ ID NO: 203296 - DNA, 75 bp, Artificial Sequence
  Synthetic
caatgcgaggctgttgtgattgtggttcaactaaacttccttattacgaatttgaaaaggtccacgttcaataat

SEQ ID NO: 203297 - DNA, 75 bp, Artificial Sequence
  Synthetic
tatactaaagagtttagatcttggtgtaatatctaaagttcatgaagttattatagataataaaccttataggtg

SEQ ID NO: 203298 - DNA, 75 bp, Artificial Sequence
  Synthetic
tattgttattgatggtgtcacttatcaattagcatgggatgttatacgtaaagacctttcttatgaacagcaaaa

SEQ ID NO: 203299 - DNA, 75 bp, Artificial Sequence
  Synthetic
tgttttagctattgagagcattcattatcttggtactacaggtcatactttgaagtctggttgcaaactcattaa

SEQ ID NO: 203300 - DNA, 75 bp, Artificial Sequence
  Synthetic
tcatgatgttactgtcttgcgtgacaatcttaaacctgttactacacttagtactatcactgcttatttgttagt

SEQ ID NO: 203301 - DNA, 75 bp, Artificial Sequence
  Synthetic
accatttattacaaatggtatatcattgctagatataattgttaaaccagttttctttaatgcttttgttaaatg

SEQ ID NO: 203302 - DNA, 75 bp, Artificial Sequence
  Synthetic
cttcttgttgtggcacacctgctaagaaactttgtgttgttcctggtaatgttgttcctggtgatgtgatcatca

SEQ ID NO: 203303 - DNA, 75 bp, Artificial Sequence
  Synthetic
aacctacaacttatgcgtaaggttgacttgtataatggtgctgtcatttacatttttgccgaagagcctgttgtt

SEQ ID NO: 203304 - DNA, 75 bp, Artificial Sequence
  Synthetic
aagcgagcactgattttcatcaattagaatatgactctgttagagaagaggttgatataattgaacaaccttttg

SEQ ID NO: 203305 - DNA, 75 bp, Artificial Sequence
  Synthetic
gtgcttctgttacagaagatgttaaatttgctgctagcactggtgttattgacattagtgctggtatgtttggtc

SEQ ID NO: 203306 - DNA, 75 bp, Artificial Sequence
  Synthetic
gacattagtgctggtatgtttggtctttacgatgacatattgacaaacaataaaccttggtttgtacgcaaagct

SEQ ID NO: 203307 - DNA, 75 bp, Artificial Sequence
  Synthetic
taaaccttggtttgtacgcaaagcttctgggctttttgatgcaatctgggatgcttttgttgccgctattaagct

SEQ ID NO: 203308 - DNA, 75 bp, Artificial Sequence
  Synthetic
tctgggctttttgatgcaatctgggatgcttttgttgccgctattaagcttgtgccaactactactggtggtttg

SEQ ID NO: 203309 - DNA, 75 bp, Artificial Sequence
  Synthetic
gttaggtttgttaagtctatcgcttcaactgttttaactgtttctaatggtgttattattatgtgtgcagatgtt

SEQ ID NO: 203310 - DNA, 75 bp, Artificial Sequence
  Synthetic
gtctaatagtagtgtgcctctttcagaggtttatgtccatttacgtaactggaactttagttggaatttaattct

SEQ ID NO: 203311 - DNA, 75 bp, Artificial Sequence
  Synthetic
tgcatttgatttttctttagatgtatttaaaattggtgatgttaaatttaaacgacttggtgattatgttcttac

SEQ ID NO: 203312 - DNA, 75 bp, Artificial Sequence
  Synthetic
tttagtaatcatttagtctcaactaaatgaaacttttcttgattttgcttgttttgcccttggcctcttgctttt

SEQ ID NO: 203313 - DNA, 75 bp, Artificial Sequence
  Synthetic
actgaagttgttcgtggtgttcgtgatgctcgcataaagaaagccatgtttactaaagtagttgtaggtcctaca

SEQ ID NO: 203314 - DNA, 75 bp, Artificial Sequence
  Synthetic
gtttattgccaactcattggatttgtgctaatcagagtacatctgtttactcagccaatggtttcttttatattg

SEQ ID NO: 203315 - DNA, 75 bp, Artificial Sequence
  Synthetic
tgctaatcagagtacatctgtttactcagccaatggtttcttttatattgatgttggtaatcaccgtagtgcttt

SEQ ID NO: 203316 - DNA, 75 bp, Artificial Sequence
  Synthetic
actgaagttaagttttctgttattgaacttgccactgttaatttgcgtcttgttgattgtgcacctgtagtttgc

SEQ ID NO: 203317 - DNA, 75 bp, Artificial Sequence
  Synthetic
acataattattacttaccggtgatggctgcacctacaggtgttacattaacacttcttagtggtgtacttcttgt

SEQ ID NO: 203318 - DNA, 75 bp, Artificial Sequence
  Synthetic
actgttataatatttgggagcaattctgcattgataattgtggtgagccatggtttttgactgattataatgcta

SEQ ID NO: 203319 - DNA, 75 bp, Artificial Sequence
  Synthetic
aaagttttgcttgagaggtttttacctaagtgtcctgaaatactgttgagtattgatgatggccatttatggaat

SEQ ID NO: 203320 - DNA, 75 bp, Artificial Sequence
  Synthetic
cattcctaatggtttcccttttaataattggtttttgctaactaatggttccacactagtggacggggtctctag

SEQ ID NO: 203321 - DNA, 75 bp, Artificial Sequence
  Synthetic
ctaagtgtcctgaaatactgttgagtattgatgatggccatttatggaatctttttgttgaaaagtttaattttg

SEQ ID NO: 203322 - DNA, 75 bp, Artificial Sequence
  Synthetic
ttacagattggttaaaaactcttaagcttacacttacttctaatggtcttttaggtaattgtgccaaacgtttta

SEQ ID NO: 203323 - DNA, 75 bp, Artificial Sequence
  Synthetic
atttgcctcctaaagttcatttttattacctaggtactggacctcataaggaccttaaattcagacaacgttctg

SEQ ID NO: 203324 - DNA, 75 bp, Artificial Sequence
  Synthetic
ttgctgatgttatgcgttacaatcttaacttcagtgctaattctgtggataatctcaagagtggtgttatagttt

SEQ ID NO: 203325 - DNA, 75 bp, Artificial Sequence
  Synthetic
gtgtttgcattaaatattatgctgttaatgttccatatgtagttattagtggttttgtaagtcgtgtaattcgta

SEQ ID NO: 203326 - DNA, 75 bp, Artificial Sequence
  Synthetic
gagaaaggtgtgacgtgacttttccttgtgttagttgtgtcacttttttctatgaatttttagacacgtgtttta

SEQ ID NO: 203327 - DNA, 75 bp, Artificial Sequence
  Synthetic
ttcaactcgtaacaactcacgagactcttctcgtagcacttcaagacaacagtctcgcactcgttctgattctaa

SEQ ID NO: 203328 - DNA, 75 bp, Artificial Sequence
  Synthetic
gtgttagtaaacctaatgccattgatgttgaacatttagagcttaaagaaaccgtttttgttgaacctaaggatg

SEQ ID NO: 203329 - DNA, 75 bp, Artificial Sequence
  Synthetic
tgttgaacatttagagcttaaagaaaccgtttttgttgaacctaaggatggtggtcaattttttgtttctgatga

SEQ ID NO: 203330 - DNA, 75 bp, Artificial Sequence
  Synthetic
gtggtcaattttttgtttctgatgattatctttggtatgttgtagatgacatttattatccagcttcatgtaatg

SEQ ID NO: 203331 - DNA, 75 bp, Artificial Sequence
  Synthetic
ttgatttgggttttatcgaagctgtcaattttaatgtcacaactgctagtgccacagatttttggacggttgcat

SEQ ID NO: 203332 - DNA, 75 bp, Artificial Sequence
  Synthetic
atttattatccagcttcatgtaatggtgtattgccagttgcttttacaaaattggcaggtggtaaaatatctttt

SEQ ID NO: 203333 - DNA, 75 bp, Artificial Sequence
  Synthetic
tctgatgatgttatagtccatgatgttgaacctacccataaagtcaagctcatatttgagtttgaagatgatgtt

SEQ ID NO: 203334 - DNA, 75 bp, Artificial Sequence
  Synthetic
ttgacattaaaaataataatgttaatactgtttgttttgttgatgttgattttcatagtgtaaaaataaaagctg

SEQ ID NO: 203335 - DNA, 75 bp, Artificial Sequence
  Synthetic
ttgacattaaaaataataatgttaatactgtttgttttgttgatgttgattttcatagtgtaaaaatataagctg

SEQ ID NO: 203336 - DNA, 75 bp, Artificial Sequence
  Synthetic
ttgacattaaaaataataatgttaatactgtttgttttgttgatgttgattttcatagtgtaaaaatacaagctg

SEQ ID NO: 203337 - DNA, 75 bp, Artificial Sequence
  Synthetic
ttgacattaaaaataataatgttaatactgtttgttttgttgatgttgattttcatagtgtaaaaatagaagctg

SEQ ID NO: 203338 - DNA, 75 bp, Artificial Sequence
  Synthetic
ttgacattaaaaataatattgttaatactgtttgttttgttgatgttgattttcatagtgtaaaaataaaagctg

SEQ ID NO: 203339 - DNA, 75 bp, Artificial Sequence
  Synthetic
ttgacattaaaaataatattgttaatactgtttgttttgttgatgttgattttcatagtgtaaaaatataagctg

SEQ ID NO: 203340 - DNA, 75 bp, Artificial Sequence
  Synthetic
ttgacattaaaaataatattgttaatactgtttgttttgttgatgttgattttcatagtgtaaaaatacaagctg

SEQ ID NO: 203341 - DNA, 75 bp, Artificial Sequence
  Synthetic
ttgacattaaaaataatattgttaatactgtttgttttgttgatgttgattttcatagtgtaaaaatagaagctg

SEQ ID NO: 203342 - DNA, 75 bp, Artificial Sequence
  Synthetic
ttgacattaaaaataatactgttaatactgtttgttttgttgatgttgattttcatagtgtaaaaataaaagctg

SEQ ID NO: 203343 - DNA, 75 bp, Artificial Sequence
  Synthetic
ttgacattaaaaataatactgttaatactgtttgttttgttgatgttgattttcatagtgtaaaaatataagctg

SEQ ID NO: 203344 - DNA, 75 bp, Artificial Sequence
  Synthetic
ttgacattaaaaataatactgttaatactgtttgttttgttgatgttgattttcatagtgtaaaaatacaagctg

SEQ ID NO: 203345 - DNA, 75 bp, Artificial Sequence
  Synthetic
ttgacattaaaaataatactgttaatactgtttgttttgttgatgttgattttcatagtgtaaaaatagaagctg

SEQ ID NO: 203346 - DNA, 75 bp, Artificial Sequence
  Synthetic
ttgacattaaaaataatagtgttaatactgtttgttttgttgatgttgattttcatagtgtaaaaataaaagctg

SEQ ID NO: 203347 - DNA, 75 bp, Artificial Sequence
  Synthetic
ttgacattaaaaataatagtgttaatactgtttgttttgttgatgttgattttcatagtgtaaaaatataagctg

SEQ ID NO: 203348 - DNA, 75 bp, Artificial Sequence
  Synthetic
ttgacattaaaaataatagtgttaatactgtttgttttgttgatgttgattttcatagtgtaaaaatacaagctg

SEQ ID NO: 203349 - DNA, 75 bp, Artificial Sequence
  Synthetic
ttgacattaaaaataatagtgttaatactgtttgttttgttgatgttgattttcatagtgtaaaaatagaagctg

SEQ ID NO: 203350 - DNA, 75 bp, Artificial Sequence
  Synthetic
ttgacattaaaaatattaatgttaatactgtttgttttgttgatgttgattttcatagtgtaaaaataaaagctg

SEQ ID NO: 203351 - DNA, 75 bp, Artificial Sequence
  Synthetic
ttgacattaaaaatattaatgttaatactgtttgttttgttgatgttgattttcatagtgtaaaaatataagctg

SEQ ID NO: 203352 - DNA, 75 bp, Artificial Sequence
  Synthetic
ttgacattaaaaatattaatgttaatactgtttgttttgttgatgttgattttcatagtgtaaaaatacaagctg

SEQ ID NO: 203353 - DNA, 75 bp, Artificial Sequence
  Synthetic
ttgacattaaaaatattaatgttaatactgtttgttttgttgatgttgattttcatagtgtaaaaatagaagctg

SEQ ID NO: 203354 - DNA, 75 bp, Artificial Sequence
  Synthetic
ttgacattaaaaatattattgttaatactgtttgttttgttgatgttgattttcatagtgtaaaaataaaagctg

SEQ ID NO: 203355 - DNA, 75 bp, Artificial Sequence
  Synthetic
ttgacattaaaaatattattgttaatactgtttgttttgttgatgttgattttcatagtgtaaaaatataagctg

SEQ ID NO: 203356 - DNA, 75 bp, Artificial Sequence
  Synthetic
ttgacattaaaaatattattgttaatactgtttgttttgttgatgttgattttcatagtgtaaaaatacaagctg

SEQ ID NO: 203357 - DNA, 75 bp, Artificial Sequence
  Synthetic
ttgacattaaaaatattattgttaatactgtttgttttgttgatgttgattttcatagtgtaaaaatagaagctg

SEQ ID NO: 203358 - DNA, 75 bp, Artificial Sequence
  Synthetic
ttgacattaaaaatattactgttaatactgtttgttttgttgatgttgattttcatagtgtaaaaataaaagctg

SEQ ID NO: 203359 - DNA, 75 bp, Artificial Sequence
  Synthetic
ttgacattaaaaatattactgttaatactgtttgttttgttgatgttgattttcatagtgtaaaaatataagctg

SEQ ID NO: 203360 - DNA, 75 bp, Artificial Sequence
  Synthetic
ttgacattaaaaatattactgttaatactgtttgttttgttgatgttgattttcatagtgtaaaaatacaagctg

SEQ ID NO: 203361 - DNA, 75 bp, Artificial Sequence
  Synthetic
ttgacattaaaaatattactgttaatactgtttgttttgttgatgttgattttcatagtgtaaaaatagaagctg

SEQ ID NO: 203362 - DNA, 75 bp, Artificial Sequence
  Synthetic
ttgacattaaaaatattagtgttaatactgtttgttttgttgatgttgattttcatagtgtaaaaataaaagctg

SEQ ID NO: 203363 - DNA, 75 bp, Artificial Sequence
  Synthetic
ttgacattaaaaatattagtgttaatactgtttgttttgttgatgttgattttcatagtgtaaaaatataagctg

SEQ ID NO: 203364 - DNA, 75 bp, Artificial Sequence
  Synthetic
ttgacattaaaaatattagtgttaatactgtttgttttgttgatgttgattttcatagtgtaaaaatacaagctg

SEQ ID NO: 203365 - DNA, 75 bp, Artificial Sequence
  Synthetic
ttgacattaaaaatattagtgttaatactgtttgttttgttgatgttgattttcatagtgtaaaaatagaagctg

SEQ ID NO: 203366 - DNA, 75 bp, Artificial Sequence
  Synthetic
ttgacattaaaaatactaatgttaatactgtttgttttgttgatgttgattttcatagtgtaaaaataaaagctg

SEQ ID NO: 203367 - DNA, 75 bp, Artificial Sequence
  Synthetic
ttgacattaaaaatactaatgttaatactgtttgttttgttgatgttgattttcatagtgtaaaaatataagctg

SEQ ID NO: 203368 - DNA, 75 bp, Artificial Sequence
  Synthetic
ttgacattaaaaatactaatgttaatactgtttgttttgttgatgttgattttcatagtgtaaaaatacaagctg

SEQ ID NO: 203369 - DNA, 75 bp, Artificial Sequence
  Synthetic
ttgacattaaaaatactaatgttaatactgtttgttttgttgatgttgattttcatagtgtaaaaatagaagctg

SEQ ID NO: 203370 - DNA, 75 bp, Artificial Sequence
  Synthetic
ttgacattaaaaatactattgttaatactgtttgttttgttgatgttgattttcatagtgtaaaaataaaagctg

SEQ ID NO: 203371 - DNA, 75 bp, Artificial Sequence
  Synthetic
ttgacattaaaaatactattgttaatactgtttgttttgttgatgttgattttcatagtgtaaaaatataagctg

SEQ ID NO: 203372 - DNA, 75 bp, Artificial Sequence
  Synthetic
ttgacattaaaaatactattgttaatactgtttgttttgttgatgttgattttcatagtgtaaaaatacaagctg

SEQ ID NO: 203373 - DNA, 75 bp, Artificial Sequence
  Synthetic
ttgacattaaaaatactattgttaatactgtttgttttgttgatgttgattttcatagtgtaaaaatagaagctg

SEQ ID NO: 203374 - DNA, 75 bp, Artificial Sequence
  Synthetic
ttgacattaaaaatactactgttaatactgtttgttttgttgatgttgattttcatagtgtaaaaataaaagctg

SEQ ID NO: 203375 - DNA, 75 bp, Artificial Sequence
  Synthetic
ttgacattaaaaatactactgttaatactgtttgttttgttgatgttgattttcatagtgtaaaaatataagctg

SEQ ID NO: 203376 - DNA, 75 bp, Artificial Sequence
  Synthetic
ttgacattaaaaatactactgttaatactgtttgttttgttgatgttgattttcatagtgtaaaaatacaagctg

SEQ ID NO: 203377 - DNA, 75 bp, Artificial Sequence
  Synthetic
ttgacattaaaaatactactgttaatactgtttgttttgttgatgttgattttcatagtgtaaaaatagaagctg

SEQ ID NO: 203378 - DNA, 75 bp, Artificial Sequence
  Synthetic
ttgacattaaaaatactagtgttaatactgtttgttttgttgatgttgattttcatagtgtaaaaataaaagctg

SEQ ID NO: 203379 - DNA, 75 bp, Artificial Sequence
  Synthetic
ttgacattaaaaatactagtgttaatactgtttgttttgttgatgttgattttcatagtgtaaaaatataagctg

SEQ ID NO: 203380 - DNA, 75 bp, Artificial Sequence
  Synthetic
ttgacattaaaaatactagtgttaatactgtttgttttgttgatgttgattttcatagtgtaaaaatacaagctg

SEQ ID NO: 203381 - DNA, 75 bp, Artificial Sequence
  Synthetic
ttgacattaaaaatactagtgttaatactgtttgttttgttgatgttgattttcatagtgtaaaaatagaagctg

SEQ ID NO: 203382 - DNA, 75 bp, Artificial Sequence
  Synthetic
ttgacattaaaaatagtaatgttaatactgtttgttttgttgatgttgattttcatagtgtaaaaataaaagctg

SEQ ID NO: 203383 - DNA, 75 bp, Artificial Sequence
  Synthetic
ttgacattaaaaatagtaatgttaatactgtttgttttgttgatgttgattttcatagtgtaaaaatataagctg

SEQ ID NO: 203384 - DNA, 75 bp, Artificial Sequence
  Synthetic
ttgacattaaaaatagtaatgttaatactgtttgttttgttgatgttgattttcatagtgtaaaaatacaagctg

SEQ ID NO: 203385 - DNA, 75 bp, Artificial Sequence
  Synthetic
ttgacattaaaaatagtaatgttaatactgtttgttttgttgatgttgattttcatagtgtaaaaatagaagctg

SEQ ID NO: 203386 - DNA, 75 bp, Artificial Sequence
  Synthetic
ttgacattaaaaatagtattgttaatactgtttgttttgttgatgttgattttcatagtgtaaaaataaaagctg

SEQ ID NO: 203387 - DNA, 75 bp, Artificial Sequence
  Synthetic
ttgacattaaaaatagtattgttaatactgtttgttttgttgatgttgattttcatagtgtaaaaatataagctg

SEQ ID NO: 203388 - DNA, 75 bp, Artificial Sequence
  Synthetic
ttgacattaaaaatagtattgttaatactgtttgttttgttgatgttgattttcatagtgtaaaaatacaagctg

SEQ ID NO: 203389 - DNA, 75 bp, Artificial Sequence
  Synthetic
ttgacattaaaaatagtattgttaatactgtttgttttgttgatgttgattttcatagtgtaaaaatagaagctg

SEQ ID NO: 203390 - DNA, 75 bp, Artificial Sequence
  Synthetic
ttgacattaaaaatagtactgttaatactgtttgttttgttgatgttgattttcatagtgtaaaaataaaagctg

SEQ ID NO: 203391 - DNA, 75 bp, Artificial Sequence
  Synthetic
ttgacattaaaaatagtactgttaatactgtttgttttgttgatgttgattttcatagtgtaaaaatataagctg

SEQ ID NO: 203392 - DNA, 75 bp, Artificial Sequence
  Synthetic
ttgacattaaaaatagtactgttaatactgtttgttttgttgatgttgattttcatagtgtaaaaatacaagctg

SEQ ID NO: 203393 - DNA, 75 bp, Artificial Sequence
  Synthetic
ttgacattaaaaatagtactgttaatactgtttgttttgttgatgttgattttcatagtgtaaaaatagaagctg

SEQ ID NO: 203394 - DNA, 75 bp, Artificial Sequence
  Synthetic
ttgacattaaaaatagtagtgttaatactgtttgttttgttgatgttgattttcatagtgtaaaaataaaagctg

SEQ ID NO: 203395 - DNA, 75 bp, Artificial Sequence
  Synthetic
ttgacattaaaaatagtagtgttaatactgtttgttttgttgatgttgattttcatagtgtaaaaatataagctg

SEQ ID NO: 203396 - DNA, 75 bp, Artificial Sequence
  Synthetic
ttgacattaaaaatagtagtgttaatactgtttgttttgttgatgttgattttcatagtgtaaaaatacaagctg

SEQ ID NO: 203397 - DNA, 75 bp, Artificial Sequence
  Synthetic
ttgacattaaaaatagtagtgttaatactgtttgttttgttgatgttgattttcatagtgtaaaaatagaagctg

SEQ ID NO: 203398 - DNA, 75 bp, Artificial Sequence
  Synthetic
cttacatctgcaatgaatgtcattgggcaacatattaagttgccacaattttatatttatgatgaagagggtggt

SEQ ID NO: 203399 - DNA, 75 bp, Artificial Sequence
  Synthetic
attgattcctaatcaggctgcgttattctttgatagtgaggttagcactgatgaagtgggtgataatgttcagat

SEQ ID NO: 203400 - DNA, 75 bp, Artificial Sequence
  Synthetic
actccccatttattatcaacacacggacataaattttactgcaactgcatcttttggtggttcttgttatgtttg

SEQ ID NO: 203401 - DNA, 75 bp, Artificial Sequence
  Synthetic
agcactgattttcatcaattagaatttgttagagaagaggttgatataattgaacaaccttttggggaagttgaa

SEQ ID NO: 203402 - DNA, 75 bp, Artificial Sequence
  Synthetic
cggctatcaacataattctgttgctgatgttatgcgttacaatcttaacttcagtgctaattctgtggacaatct

SEQ ID NO: 203403 - DNA, 75 bp, Artificial Sequence
  Synthetic
tttctttttcttttagagatgaattgggtgttcgtgttttagatcaatctgataataattgttggattagtacca

SEQ ID NO: 203404 - DNA, 75 bp, Artificial Sequence
  Synthetic
cacttatacagttgcaacttacaaagcttttggatgattctattgagatgcaattgtttaaagttggtaaagttg

SEQ ID NO: 203405 - DNA, 75 bp, Artificial Sequence
  Synthetic
gcttttggatgattctattgagatgcaattgtttaaagttggtaaagttgattcaattgttcaaaagtgttatga

SEQ ID NO: 203406 - DNA, 75 bp, Artificial Sequence
  Synthetic
atgttctataacttttgagatgtcttgtgattgtggtaaaaagtttgatgagcaagttggttgtttgttttggat

SEQ ID NO: 203407 - DNA, 75 bp, Artificial Sequence
  Synthetic
tatgccttacacaaaactttttcaaaaaggtgagtgttgtatttgtcataaaatgcagacttataagcttgttag

SEQ ID NO: 203408 - DNA, 75 bp, Artificial Sequence
  Synthetic
tgttagtgagaaaatttctgttatggataaacttgatactggtgcacaaaaatttttccagtttggtgattttgt

SEQ ID NO: 203409 - DNA, 75 bp, Artificial Sequence
  Synthetic
agaaatagaagctggtgaagttaaaccttttgctgtatataaaaatgttaaattttatttaggtgatatttcaca

SEQ ID NO: 203410 - DNA, 75 bp, Artificial Sequence
  Synthetic
ccttttgctgtatataaaaatgttaaattttatttaggtgatatttcacaccttgtaaactgtgtttcttttgac

SEQ ID NO: 203411 - DNA, 75 bp, Artificial Sequence
  Synthetic
acgtgctattgatattttgactgaaggtcaacttcagtcattatctaaagattacattagtagtaatggtccact

SEQ ID NO: 203412 - DNA, 75 bp, Artificial Sequence
  Synthetic
gagtgtgaaaaattcaatgtatttaatgttgttggtccgcgaactggtaaacatgagcattcattacttgttgaa

SEQ ID NO: 203413 - DNA, 75 bp, Artificial Sequence
  Synthetic
atggtattccacttatgcctcttcttagttgtggtatttttggtgtaaggattgaaaattctcttaaagctttgt

SEQ ID NO: 203414 - DNA, 75 bp, Artificial Sequence
  Synthetic
tgtatgcgtgccggttctaaggttgttaaccataatgttttaatcaaagagtcaatacctattgtttggggtgtc

SEQ ID NO: 203415 - DNA, 75 bp, Artificial Sequence
  Synthetic
gcaagtttttgtttattcttcaaatgaagaacaagctgttcttaagtttttagatggtttagatttaacaccagt

SEQ ID NO: 203416 - DNA, 75 bp, Artificial Sequence
  Synthetic
gaagaacaagctgttcttaagtttttagatggtttagatttaacaccagtcattgatgatgttgatgttgttaaa

SEQ ID NO: 203417 - DNA, 75 bp, Artificial Sequence
  Synthetic
ccttttagagttgaaggtaatttttcattctttgattgtggtgtcaatgccttggatggtgatatttacttatta

SEQ ID NO: 203418 - DNA, 75 bp, Artificial Sequence
  Synthetic
ataaacaaggacaattattggacacaaaacttaatggtattttgcaacaggcagctcttgattatcttgctacag

SEQ ID NO: 203419 - DNA, 75 bp, Artificial Sequence
  Synthetic
aaaacttaatggtattttgcaacaggcagctcttgattatcttgctacagttaaaactgtaccagctggtaattt

SEQ ID NO: 203420 - DNA, 75 bp, Artificial Sequence
  Synthetic
ggttaaacttgttgttgagagttgtaccatttatatgtgtgttgtaccatcgataaatgatctttcttttgataa

SEQ ID NO: 203421 - DNA, 75 bp, Artificial Sequence
  Synthetic
aaatcttggtcgttgtgtgcgtaaacttaatagattgaaaacttgtgttattgccaatgttcctgctattgatgt

SEQ ID NO: 203422 - DNA, 75 bp, Artificial Sequence
  Synthetic
cttaatagattgaaaacttgtgttattgccaatgttcctgctattgatgttttgaaaaagcttctttcaagtttg

SEQ ID NO: 203423 - DNA, 75 bp, Artificial Sequence
  Synthetic
atgttaaagatgttgttgttgagtcttctaagtcacttggtaaacaattgggtgttgtgagtgatggtgttgact

SEQ ID NO: 203424 - DNA, 75 bp, Artificial Sequence
  Synthetic
gaaatgcagtcacaatcatctcatgttgttcagaacacagtacttaatgcttctattccagaatctaaaccattg

SEQ ID NO: 203425 - DNA, 75 bp, Artificial Sequence
  Synthetic
ccagaagttgactgggttgctttttacggttttgaaaaggcagcactttttgcttctttggatgtaaagccatat

SEQ ID NO: 203426 - DNA, 75 bp, Artificial Sequence
  Synthetic
caataattgttgggttaatgcaacttgtataattttacagtatcttaagcctacttttaaatctaagggtttaaa

SEQ ID NO: 203427 - DNA, 75 bp, Artificial Sequence
  Synthetic
tgttctttggaataaatttgttacaggtgatgttggaccttttgttagttttatttattttataactatgtcttc

SEQ ID NO: 203428 - DNA, 75 bp, Artificial Sequence
  Synthetic
ggtgatgttggaccttttgttagttttatttattttataactatgtcttcaaagggtcaaaagggtgatgctgaa

SEQ ID NO: 203429 - DNA, 75 bp, Artificial Sequence
  Synthetic
ttatttattttataactatgtcttcaaagggtcaaaagggtgatgctgaagaggcattatctaaattgtcagagt

SEQ ID NO: 203430 - DNA, 75 bp, Artificial Sequence
  Synthetic
tggtcagttttatattaatggttttaagtattttgatttgggttttatcgaagctgtcaattttaatgtcacgac

SEQ ID NO: 203431 - DNA, 75 bp, Artificial Sequence
  Synthetic
tggaagagccaacaacatatctaaaaatgttttgtctggtacttgttaatgatattgtttttgatatggatacac

SEQ ID NO: 203432 - DNA, 75 bp, Artificial Sequence
  Synthetic
atttgattagtgattctattgttactcttgaacaatattcaacttgtgacatttgtaaaagtactgtagttgaag

SEQ ID NO: 203433 - DNA, 75 bp, Artificial Sequence
  Synthetic
tgtgcttaaagatggttgtgatgttggtttttgtccacacagacataaattgcgttcacgtgttaagtttgttaa

SEQ ID NO: 203434 - DNA, 75 bp, Artificial Sequence
  Synthetic
gtaattctagtgataatggtatttcagccataatcactgctaatttatccattccctctaactggactacttcag

SEQ ID NO: 203435 - DNA, 75 bp, Artificial Sequence
  Synthetic
gtattgttgagtcttcttgtgttttgttgtctttctacaggttgttgtggttgttgcaattgtttaacttcatca

SEQ ID NO: 203436 - DNA, 75 bp, Artificial Sequence
  Synthetic
tattaaacaattgaagcgtgccatgaatattgcaaaatctgaatttgatcatgagatatctgttcagaagaaaat

SEQ ID NO: 203437 - DNA, 75 bp, Artificial Sequence
  Synthetic
ctaagttgcttaatggtattgcttatacaacattttcaggttcttttgataacggtcactatgtagtttatgatg

SEQ ID NO: 203438 - DNA, 75 bp, Artificial Sequence
  Synthetic
aacggtcactatgtagtttatgatgctgctaataatgctgtctatgatggtgctcgtttatttgcttcagatttg

SEQ ID NO: 203439 - DNA, 75 bp, Artificial Sequence
  Synthetic
tgctcgtttatttgcttcagatttgtctactttagctgttacagctattgttgtagtaggtggttgtgtaacatc

SEQ ID NO: 203440 - DNA, 75 bp, Artificial Sequence
  Synthetic
attgttctgtttttaacttggttgcttagtatgtttagtcttttacgtacttctattatgaagcatgatattaaa

SEQ ID NO: 203441 - DNA, 75 bp, Artificial Sequence
  Synthetic
tgtataaacctagtattattcatgacattggtaatcctaaaggtgtacgttgtgctgttactgacgccaaatggt

SEQ ID NO: 203442 - DNA, 75 bp, Artificial Sequence
  Synthetic
ttattgttactttgtttaagttcttattgttattatatgctatttatgcacttgtttttatgattgtgcaattta

SEQ ID NO: 203443 - DNA, 75 bp, Artificial Sequence
  Synthetic
attgttattatatgctatttatgcacttgtttttatgattgtgcaatttagtccttttaatagtcttttatgtgg

SEQ ID NO: 203444 - DNA, 75 bp, Artificial Sequence
  Synthetic
tgacattgtaagtggttatgaaaaatccacttttaataaggatatttattgtggtaattctatggtttgtaagat

SEQ ID NO: 203445 - DNA, 75 bp, Artificial Sequence
  Synthetic
ctattagaggttcttgtgaaaagaacctacaacttatgcgtaaggttgatttgtataatggtgctgtcatttaca

SEQ ID NO: 203446 - DNA, 75 bp, Artificial Sequence
  Synthetic
aatgatttggatcatactagtcttgtttggaagcacattcgtgatcctatattaatcagtttacaaccatttgtt

SEQ ID NO: 203447 - DNA, 75 bp, Artificial Sequence
  Synthetic
tttggaagcacattcgtgatcctatattaatcagtttacaaccatttgttatacttgttattttgttaatttttg

SEQ ID NO: 203448 - DNA, 75 bp, Artificial Sequence
  Synthetic
gtaatatgtatttgcgttttggacttttatattttgttgcacaatttattagtacttttggttctttcttaggct

SEQ ID NO: 203449 - DNA, 75 bp, Artificial Sequence
  Synthetic
tgtgtctactcctctcaactaaacgaaatttttctagtgctgtcatttgttatggcagtcctagtgtaattgaaa

SEQ ID NO: 203450 - DNA, 75 bp, Artificial Sequence
  Synthetic
aatgagtttttagctacatttattgtctgcaaaattgttttatttgttagacatattattgttggctgtaataat

SEQ ID NO: 203451 - DNA, 75 bp, Artificial Sequence
  Synthetic
aagcactggtggttctgtccactagtgcacacattgatacttaagtggtgttctgtcactgcttattgtggaagc

SEQ ID NO: 203452 - DNA, 75 bp, Artificial Sequence
  Synthetic
tctgcaaaattgttttatttgttagacatattattgttggctgtaataatgctgactgtgtagcttgttctaaaa

SEQ ID NO: 203453 - DNA, 75 bp, Artificial Sequence
  Synthetic
gtgctagacttaaacgtgtaccacttcaaactattattaatggtatgcataaatcattctatgttaatgctaatg

SEQ ID NO: 203454 - DNA, 75 bp, Artificial Sequence
  Synthetic
tcaaactattattaatggtatgcataaatcattctatgttaatgctaatggtggtacttgtttctgtaataaaca

SEQ ID NO: 203455 - DNA, 75 bp, Artificial Sequence
  Synthetic
caacccacagctcctgcatatattattattgataaggtagattttgttaatggattttatcgtctttatagtggt

SEQ ID NO: 203456 - DNA, 75 bp, Artificial Sequence
  Synthetic
ttattgataaggtagattttgttaatggattttatcgtctttatagtggtgacactttttggcggtatgactttg

SEQ ID NO: 203457 - DNA, 75 bp, Artificial Sequence
  Synthetic
accgacccttccttgataatagcttcttccccagcactcgttgaccaacgcactatttgtttttctgttgcagca

SEQ ID NO: 203458 - DNA, 75 bp, Artificial Sequence
  Synthetic
acattactgaatctaagtatagttgtaaagaggttctgaagaattgtaatgttttagaaaattttattgtttaca

SEQ ID NO: 203459 - DNA, 75 bp, Artificial Sequence
  Synthetic
taaagaggttctgaagaattgtaatgttttagaaaattttattgtttacaataatagtggtagtaacattacaca

SEQ ID NO: 203460 - DNA, 75 bp, Artificial Sequence
  Synthetic
atactattagctacaattccaccttacaatctggtcttaagaagatggcacaaccatctggttgtgttgagagat

SEQ ID NO: 203461 - DNA, 75 bp, Artificial Sequence
  Synthetic
ttactattagctacaattccaccttacaatctggtcttaagaagatggcacaaccatctggttgtgttgagagat

SEQ ID NO: 203462 - DNA, 75 bp, Artificial Sequence
  Synthetic
ctactattagctacaattccaccttacaatctggtcttaagaagatggcacaaccatctggttgtgttgagagat

SEQ ID NO: 203463 - DNA, 75 bp, Artificial Sequence
  Synthetic
gtactattagctacaattccaccttacaatctggtcttaagaagatggcacaaccatctggttgtgttgagagat

SEQ ID NO: 203464 - DNA, 75 bp, Artificial Sequence
  Synthetic
gattaaaaatgcttgtgtttatttttctcaattgttgtgtgaacctataaagttggtaaattcagagttgttgtc

SEQ ID NO: 203465 - DNA, 75 bp, Artificial Sequence
  Synthetic
ggtaaacaccgtagtgcttttgcactccatagtggttattatgatgctaaccagtattatatttatctcactaat

SEQ ID NO: 203466 - DNA, 75 bp, Artificial Sequence
  Synthetic
gttttgcataaggcatatgttgatgttttgtgtaatagtttttttaaggagctaactgctaacatgtccatggct

SEQ ID NO: 203467 - DNA, 75 bp, Artificial Sequence
  Synthetic
gacgttttgctttcagatttgtcatttaataatttttttatttcttatgctaaacctgaagataagttgtccgtt

SEQ ID NO: 203468 - DNA, 75 bp, Artificial Sequence
  Synthetic
ttaataatttttttatttcttatgctaaacctgaagataagttgtccgtttatgatattgcttgttgtatgcgtg

SEQ ID NO: 203469 - DNA, 75 bp, Artificial Sequence
  Synthetic
gaagaaatttcctcctccttcattttacatgcctcttttggttagttctgataaggcaccatatagggtcatccc

SEQ ID NO: 203470 - DNA, 75 bp, Artificial Sequence
  Synthetic
atactctttctcaagaaggtaagaagtaccttgttaaaacaactaaagcaaagggtttgacttttttattaactt

SEQ ID NO: 203471 - DNA, 75 bp, Artificial Sequence
  Synthetic
ttaatgataaccaagcaattacacaagttcctgctactagtatagttgcaaaacagggtgctggttttaaacgta

SEQ ID NO: 203472 - DNA, 75 bp, Artificial Sequence
  Synthetic
agttcctgctactagtatagttgcaaaacagggtgctggttttaaacgtacttataattttctgtggtatgtatg

SEQ ID NO: 203473 - DNA, 75 bp, Artificial Sequence
  Synthetic
ttataagcttgttagtatgaaaggtactggtgtgtttgtacaggatccagcacctattgacattgatgctttccc

SEQ ID NO: 203474 - DNA, 75 bp, Artificial Sequence
  Synthetic
aaattcattagaccctttttgctttgatgttaacactttactttctaatcaattacgtctagcttttcttggtgc

SEQ ID NO: 203475 - DNA, 75 bp, Artificial Sequence
  Synthetic
ccactgtaactagctttcatggttatgattttaagtacattgagaatggtcagttgaaggtgtttgaagcacctt

SEQ ID NO: 203476 - DNA, 75 bp, Artificial Sequence
  Synthetic
tgattttaagtacattgagaatggtcagttgaaggtgtttgaagcacctttacactgtgttcgtaatgtttttga

SEQ ID NO: 203477 - DNA, 75 bp, Artificial Sequence
  Synthetic
taattttaatcaatggcatgaggctaagtttggtgttgttactactaatagtgataaatgtcctatagttgttgg

SEQ ID NO: 203478 - DNA, 75 bp, Artificial Sequence
  Synthetic
gtgataaatgtcctatagttgttggtgtttcagagcgtattaatgttgttcctggtgttccaacaaatgtatatt

SEQ ID NO: 203479 - DNA, 75 bp, Artificial Sequence
  Synthetic
tggtaggaaagactcttgtttttacattacaggctgcttttggaaacacaggtgtttgttatgactttgatggtg

SEQ ID NO: 203480 - DNA, 75 bp, Artificial Sequence
  Synthetic
ggtgtttgttatgactttgatggtgttaccactagtgataagtgtatttttaattctgcttgtactaggttggaa

SEQ ID NO: 203481 - DNA, 75 bp, Artificial Sequence
  Synthetic
ttctaaaccttatagtactttacagcccaatgcttattataagtatgatgttaaaaattatgtacgttttccaga

SEQ ID NO: 203482 - DNA, 75 bp, Artificial Sequence
  Synthetic
ttaaaaattatgtacgttttccagaaattttagctagaggttttggcttacgtactattagaactttggctacac

SEQ ID NO: 203483 - DNA, 75 bp, Artificial Sequence
  Synthetic
cgtactattagaactttggctacacgttattgtagagttggtgaatgccgtgactcacataaaggtgtttgtttt

SEQ ID NO: 203484 - DNA, 75 bp, Artificial Sequence
  Synthetic
ggttttgataaatggtatgttaatgatggacgtgttgatgatggttacatttgtggtgatggtcttatagacctt

SEQ ID NO: 203485 - DNA, 75 bp, Artificial Sequence
  Synthetic
ttgtggtgatggtcttatagaccttcttgttaatgtactctcaatctttagttcatcttttagcgttgtggctat

SEQ ID NO: 203486 - DNA, 75 bp, Artificial Sequence
  Synthetic
ttttatcgttttatggttgattctacaactgtattaaatgaccctgtttttactggtgagttattttatactatt

SEQ ID NO: 203487 - DNA, 75 bp, Artificial Sequence
  Synthetic
gtctggacatatgttgtttaactttctttttgcagcatttattacatttttgtgctttttagttactaaatttaa

SEQ ID NO: 203488 - DNA, 75 bp, Artificial Sequence
  Synthetic
ctttttgcagcatttattacatttttgtgctttttagttactaaatttaaacgtgtttttggtgatctttcttat

SEQ ID NO: 203489 - DNA, 75 bp, Artificial Sequence
  Synthetic
ttccagaatctaaaccattggctgatgatgattcagccattatagaaattgtcaacgaggttttgcattaaattg

SEQ ID NO: 203490 - DNA, 75 bp, Artificial Sequence
  Synthetic
ggtgtttttactgttgtttgtgcaactttgattaataacatttcttatgttgttactcaaaatttattttttatg

SEQ ID NO: 203491 - DNA, 75 bp, Artificial Sequence
  Synthetic
tttttactaggacagtgcgttatgcttggatttggcatattgcatacattgttgcatacttcttgttaataccat

SEQ ID NO: 203492 - DNA, 75 bp, Artificial Sequence
  Synthetic
ttggatttggcatattgcatacattgttgcatacttcttgttaataccatggtggcttctcacatggtttagttt

SEQ ID NO: 203493 - DNA, 75 bp, Artificial Sequence
  Synthetic
tgctgcatttttagagcttttacctaatgtttttaagttaaaaatctctactcaattgtttgaaggtgataagtt

SEQ ID NO: 203494 - DNA, 75 bp, Artificial Sequence
  Synthetic
gcaggtacatttgttcttgacatgcgttcttatgaaaggctgataaatactatttcacctgagaaacttaagaat

SEQ ID NO: 203495 - DNA, 75 bp, Artificial Sequence
  Synthetic
gttcttatgaaaggctgataaatactatttcacctgagaaacttaagaattatgctgcaagttataataaatata

SEQ ID NO: 203496 - DNA, 75 bp, Artificial Sequence
  Synthetic
aatattatagtggtagtgctagtgaggctgattatcgttgtgcttgttatgctcatttagccaaggctatgttag

SEQ ID NO: 203497 - DNA, 75 bp, Artificial Sequence
  Synthetic
tacaattccaccttacaatctggtcttaagaagatggcacaaccatctggttgtgttgagagatgtgtggttcgc

SEQ ID NO: 203498 - DNA, 75 bp, Artificial Sequence
  Synthetic
ttaagaagatggcacaaccatctggttgtgttgagagatgtgtggttcgcgtctgttatggtagtactgtgctta

SEQ ID NO: 203499 - DNA, 75 bp, Artificial Sequence
  Synthetic
atggagtttggttaggtgacactgttacttgtcctagacatgtcatagcaccatcaaccactgttcttattgatt

SEQ ID NO: 203500 - DNA, 75 bp, Artificial Sequence
  Synthetic
aatttttagacacgtgttttggtgttagtaaacctaatgccattgatgttgaacatttagagcttaaagaaactg

SEQ ID NO: 203501 - DNA, 75 bp, Artificial Sequence
  Synthetic
gtgttacaatgcatggttctgtgttgcgtattaaggtttcacaatctaatgtacatacacctaaacatgttttta

SEQ ID NO: 203502 - DNA, 75 bp, Artificial Sequence
  Synthetic
gcgtattaaggtttcacaatctaatgtacatacacctaaacatgtttttaaaacgttgaaacctggtgattcttt

SEQ ID NO: 203503 - DNA, 75 bp, Artificial Sequence
  Synthetic
taatattttagcatgttatgaaggtattgcatctggtgtttttggtgttaatttacgtacaaactttactattaa

SEQ ID NO: 203504 - DNA, 75 bp, Artificial Sequence
  Synthetic
attgcatctggtgtttttggtgttaatttacgtacaaactttactattaaaggttcttttataaatggagcttgt

SEQ ID NO: 203505 - DNA, 75 bp, Artificial Sequence
  Synthetic
ggttctcctggttataatgttagaaatgatggtactgttgagttttgttatttacaccaaattgagttaggtagt

SEQ ID NO: 203506 - DNA, 75 bp, Artificial Sequence
  Synthetic
tacaggtgatttagctgttcaaataggttcaaataatgtttgtacttatgaacatgttatatcatttatgggttt

SEQ ID NO: 203507 - DNA, 75 bp, Artificial Sequence
  Synthetic
atgatggtactgttgagttttgttatttacaccaaattgagttaggtagtggtgctcatgttggttctgatttta

SEQ ID NO: 203508 - DNA, 75 bp, Artificial Sequence
  Synthetic
ctggtagtgtttatggtaattttgatgaccaacctagtttgcaagttgagagtgccaaccttatgctatcagata

SEQ ID NO: 203509 - DNA, 75 bp, Artificial Sequence
  Synthetic
atttatgatgaagagggtggttatgatgtttctaaaccagttatgatttcacaatggcctattagtgatgatagt

SEQ ID NO: 203510 - DNA, 75 bp, Artificial Sequence
  Synthetic
taatggttatacaagtgtttctagtgttgagtgctattctattttggcagcaaaaactggtgttagtgttgaaca

SEQ ID NO: 203511 - DNA, 75 bp, Artificial Sequence
  Synthetic
tatgttcgtaaaaatggtcaatttcaagatcactatgatggtttttacactcaaggtaggaatttatcagacttt

SEQ ID NO: 203512 - DNA, 75 bp, Artificial Sequence
  Synthetic
gttgagtgctattctattttggcagcaaaaactggtgttagtgttgaacaattgttagcttccattcaacatctt

SEQ ID NO: 203513 - DNA, 75 bp, Artificial Sequence
  Synthetic
catgaaggttttggtggtaaaaacatacttggttattctagtttatgtgatgagttcacactagctgaagttgtg

SEQ ID NO: 203514 - DNA, 75 bp, Artificial Sequence
  Synthetic
tacttggttattctagtttatgtgatgagttcacactagctgaagttgtgaagcagatgtatggtgttaacttgc

SEQ ID NO: 203515 - DNA, 75 bp, Artificial Sequence
  Synthetic
aaagtggtaaggttatttttggtttaaaaacaatgtttttatttagcgttttcttcacaatgttttgggcagaac

SEQ ID NO: 203516 - DNA, 75 bp, Artificial Sequence
  Synthetic
ttcttcacaatgttttgggcagaactctttatttatacaaacactatatggataaaccctgtgatacttacacct

SEQ ID NO: 203517 - DNA, 75 bp, Artificial Sequence
  Synthetic
atattttgtctacttttgtttttgtcattagttttaactatgtttcttaaacataagtttttgtttttgcaagta

SEQ ID NO: 203518 - DNA, 75 bp, Artificial Sequence
  Synthetic
cattagttttaactatgtttcttaaacataagtttttgtttttgcaagtatttttattacctactgttattgcaa

SEQ ID NO: 203519 - DNA, 75 bp, Artificial Sequence
  Synthetic
ctgctttatataattgtgttttggattattacatagtaaaatttttggctgaccattttaactataatgtttcag

SEQ ID NO: 203520 - DNA, 75 bp, Artificial Sequence
  Synthetic
tttggtgtctttgacattaaaaatagtagtgttaatactgtttgttttgttgatgttgattttcatagtgtagaa

SEQ ID NO: 203521 - DNA, 75 bp, Artificial Sequence
  Synthetic
gtggtgactttttgagtttgcttgttatgtttttatgtgctatatctagtgattggtacattggtgccattgttt

SEQ ID NO: 203522 - DNA, 75 bp, Artificial Sequence
  Synthetic
ttatttaggtgatatttcacaccttgtaaactgtgtttcttttgactttgttgtcaatgctgctaatgaaaatct

SEQ ID NO: 203523 - DNA, 75 bp, Artificial Sequence
  Synthetic
tttttcacctgaaagtgtatttagtgtttttggtgatgtgaaacttactttagttgtttatttaatttgtggtta

SEQ ID NO: 203524 - DNA, 75 bp, Artificial Sequence
  Synthetic
gtttttggtgatgtgaaacttactttagttgtttatttaatttgtggttatttagtttgtacttattggggcatt

SEQ ID NO: 203525 - DNA, 75 bp, Artificial Sequence
  Synthetic
aacttcagtcattatctaaagattacattagtagtaatggtccacttaaggttggagcaggtgttatgttggagt

SEQ ID NO: 203526 - DNA, 75 bp, Artificial Sequence
  Synthetic
ttgtattggttcaataggttttttaaatgtactatgggtgtttatgattttaaggtgagtgctgctgaatttaaa

SEQ ID NO: 203527 - DNA, 75 bp, Artificial Sequence
  Synthetic
attggtggtgaccgttgtataaaaatttcaactgtccaatccaaactgactgatttgaagtgtactaatgttgtg

SEQ ID NO: 203528 - DNA, 75 bp, Artificial Sequence
  Synthetic
aagattaatctttgtgatgaccctgaaaaagctcaaggtatgttgttagcactccttgcgttctttctaagtaaa

SEQ ID NO: 203529 - DNA, 75 bp, Artificial Sequence
  Synthetic
catagtgattttggtcttgatggccttattgattcttattttgataatagtagcacccttcagagtgttgcttca

SEQ ID NO: 203530 - DNA, 75 bp, Artificial Sequence
  Synthetic
ttattgattcttattttgataatagtagcacccttcagagtgttgcttcatcatttgttagtatgccatcatata

SEQ ID NO: 203531 - DNA, 75 bp, Artificial Sequence
  Synthetic
ctaactctattttaatgttggataaacaaggacaattattggacacaaaacttaatggtattttgcaacaggcag

SEQ ID NO: 203532 - DNA, 75 bp, Artificial Sequence
  Synthetic
ttgcttatgaaaatgctagacaagcttatgaagatgctattgctaatggatcttcttctcaacttattaaacaat

SEQ ID NO: 203533 - DNA, 75 bp, Artificial Sequence
  Synthetic
ctataacaactagtgtagatgctaacaccaatcaagattcttatggtggagcgtctatttgtttgtattgtcggg

SEQ ID NO: 203534 - DNA, 75 bp, Artificial Sequence
  Synthetic
ctgaacaagctgctacacagatgtataaagaagcacgctctgttaatagaaaatctaaagttattagtgctatgc

SEQ ID NO: 203535 - DNA, 75 bp, Artificial Sequence
  Synthetic
taaagaagcacgctctgttaatagaaaatctaaagttattagtgctatgcactctttactttttggaatgttaag

SEQ ID NO: 203536 - DNA, 75 bp, Artificial Sequence
  Synthetic
atttgttttgttcaatgttactaaactatgcttcgtttcaggcaagtgttggtatcttgaacaatcattttatga

SEQ ID NO: 203537 - DNA, 75 bp, Artificial Sequence
  Synthetic
acgtttggatatgtctagtgttgaaactgttttgaatttagcacgtgatggtgttgtgccattgtcagttatacc

SEQ ID NO: 203538 - DNA, 75 bp, Artificial Sequence
  Synthetic
attgttagtccagatcttgaatcttattctaagattgtttgtgatggttctgttcattatgctggagttgtttgg

SEQ ID NO: 203539 - DNA, 75 bp, Artificial Sequence
  Synthetic
ttgacatggcctcttatccttaattgtgaacgtgttgttaaacttcaaaataatgaaattatgcctggtaaactt

SEQ ID NO: 203540 - DNA, 75 bp, Artificial Sequence
  Synthetic
aagcaaaaacctatgaaagctgagggtgatggtggtgttttaggtgatggtaatgccttgtataatactgagggt

SEQ ID NO: 203541 - DNA, 75 bp, Artificial Sequence
  Synthetic
agacctttcttatgaacagcaaaatgttttaaccattgaaagcattcattaccttggtactacaggtcatacttt

SEQ ID NO: 203542 - DNA, 75 bp, Artificial Sequence
  Synthetic
agacctttcttatgaacagcaaaatgttttaaccattgatagcattcattaccttggtactacaggtcatacttt

SEQ ID NO: 203543 - DNA, 75 bp, Artificial Sequence
  Synthetic
agacctttcttatgaacagcaaaatgttttaaccattgacagcattcattaccttggtactacaggtcatacttt

SEQ ID NO: 203544 - DNA, 75 bp, Artificial Sequence
  Synthetic
agacctttcttatgaacagcaaaatgttttaaccattgagagcattcattaccttggtactacaggtcatacttt

SEQ ID NO: 203545 - DNA, 75 bp, Artificial Sequence
  Synthetic
agacctttcttatgaacagcaaaatgttttatccattgaaagcattcattaccttggtactacaggtcatacttt

SEQ ID NO: 203546 - DNA, 75 bp, Artificial Sequence
  Synthetic
agacctttcttatgaacagcaaaatgttttatccattgatagcattcattaccttggtactacaggtcatacttt

SEQ ID NO: 203547 - DNA, 75 bp, Artificial Sequence
  Synthetic
agacctttcttatgaacagcaaaatgttttatccattgacagcattcattaccttggtactacaggtcatacttt

SEQ ID NO: 203548 - DNA, 75 bp, Artificial Sequence
  Synthetic
agacctttcttatgaacagcaaaatgttttatccattgagagcattcattaccttggtactacaggtcatacttt

SEQ ID NO: 203549 - DNA, 75 bp, Artificial Sequence
  Synthetic
agacctttcttatgaacagcaaaatgttttacccattgaaagcattcattaccttggtactacaggtcatacttt

SEQ ID NO: 203550 - DNA, 75 bp, Artificial Sequence
  Synthetic
agacctttcttatgaacagcaaaatgttttacccattgatagcattcattaccttggtactacaggtcatacttt

SEQ ID NO: 203551 - DNA, 75 bp, Artificial Sequence
  Synthetic
agacctttcttatgaacagcaaaatgttttacccattgacagcattcattaccttggtactacaggtcatacttt

SEQ ID NO: 203552 - DNA, 75 bp, Artificial Sequence
  Synthetic
agacctttcttatgaacagcaaaatgttttacccattgagagcattcattaccttggtactacaggtcatacttt

SEQ ID NO: 203553 - DNA, 75 bp, Artificial Sequence
  Synthetic
agacctttcttatgaacagcaaaatgttttagccattgaaagcattcattaccttggtactacaggtcatacttt

SEQ ID NO: 203554 - DNA, 75 bp, Artificial Sequence
  Synthetic
agacctttcttatgaacagcaaaatgttttagccattgatagcattcattaccttggtactacaggtcatacttt

SEQ ID NO: 203555 - DNA, 75 bp, Artificial Sequence
  Synthetic
agacctttcttatgaacagcaaaatgttttagccattgacagcattcattaccttggtactacaggtcatacttt

SEQ ID NO: 203556 - DNA, 75 bp, Artificial Sequence
  Synthetic
agacctttcttatgaacagcaaaatgttttagccattgagagcattcattaccttggtactacaggtcatacttt

SEQ ID NO: 203557 - DNA, 75 bp, Artificial Sequence
  Synthetic
ggtaaaacttttatgtacgcttatatttctaataaagctgaccttaaatttgttaagtgggagtatgagggtggt

SEQ ID NO: 203558 - DNA, 75 bp, Artificial Sequence
  Synthetic
cttgtcgatttatggtcgaaacacctaatggtcctcaagtgaagtatttgtattttgttaaaaatttaaacacct

SEQ ID NO: 203559 - DNA, 75 bp, Artificial Sequence
  Synthetic
tacgtagaggtgccgttcttggttttataggtgccacaattcgtctacaagctggtaaacaaactgaattggctg

SEQ ID NO: 203560 - DNA, 75 bp, Artificial Sequence
  Synthetic
tataggtgccacaattcgtctacaagctggtaaacaaactgaattggctgttaattctggacttttaactgcttg

SEQ ID NO: 203561 - DNA, 75 bp, Artificial Sequence
  Synthetic
acttacttggaagctgttaaacatggtgcaaaacctgtaagtaattgtattaagatgttatctaatggtgctggt

SEQ ID NO: 203562 - DNA, 75 bp, Artificial Sequence
  Synthetic
ttatggtggagcgtctatttgtttgtattgtcgagctcacgttcctcaccctagtatggatggttactgtaagtt

SEQ ID NO: 203563 - DNA, 75 bp, Artificial Sequence
  Synthetic
agtgatatggagtatgattttcttaacatggatatgggtgtttttattaataaatatggtcttgaggattttaat

SEQ ID NO: 203564 - DNA, 75 bp, Artificial Sequence
  Synthetic
taagggtaaatgtgttcaggttcctattggttgtttggatcctattaggttttgtttagaaaataatgtgtgtaa

SEQ ID NO: 203565 - DNA, 75 bp, Artificial Sequence
  Synthetic
ctttagctgttacagctattgttgtagtaggtggttgtgtaacatctaatgttccaccaattgttagtgagaaaa

SEQ ID NO: 203566 - DNA, 75 bp, Artificial Sequence
  Synthetic
ggatgtgcttgtgaccgtacaactattcaaagtgttgacatttcttatttaaacgagcaaggggttctagtgcag

SEQ ID NO: 203567 - DNA, 75 bp, Artificial Sequence
  Synthetic
aaacgagcaaggggttctagtgcagctcgactagaaccctgtaatggcacggacatcgataagtgtgttcgtgct

SEQ ID NO: 203568 - DNA, 75 bp, Artificial Sequence
  Synthetic
cacctataaagttgaattttggtatgttgaatggtatgccagtttcttctattaagggtgataaaggtgttgaaa

SEQ ID NO: 203569 - DNA, 75 bp, Artificial Sequence
  Synthetic
agatggcagagtcatttatggtaatgttagtagacataatcttactaaatatactatgatggacttggtctatgc

SEQ ID NO: 203570 - DNA, 75 bp, Artificial Sequence
  Synthetic
tgtgatgttctaaaagaagtattagttttaactggttgttgtgacaattcttattttgatagtaagggttggtat

SEQ ID NO: 203571 - DNA, 75 bp, Artificial Sequence
  Synthetic
ttttaactggttgttgtgacaattcttattttgatagtaagggttggtatgacccagttgaaaatgaagatatac

SEQ ID NO: 203572 - DNA, 75 bp, Artificial Sequence
  Synthetic
atagagtttatgcatctcttggcaaaattgtagctagagctatgcttaaatgcgttgctctatgtgatgcgatgg

SEQ ID NO: 203573 - DNA, 75 bp, Artificial Sequence
  Synthetic
tgcgttgctctatgtgatgcgatggttgctaaaggtgttgttggtgttttaacattagataaccaagatcttaat

SEQ ID NO: 203574 - DNA, 75 bp, Artificial Sequence
  Synthetic
gttttaactgtttctaatggtgttattattatgtgtgcagatgttccagatgcttttcaaccagtttaccgtaca

SEQ ID NO: 203575 - DNA, 75 bp, Artificial Sequence
  Synthetic
ggtaacttttatgattttggtgattttgttgttagcttacctaatatgggtgttccctgttgtacatcatattat

SEQ ID NO: 203576 - DNA, 75 bp, Artificial Sequence
  Synthetic
ttgttgttagcttacctaatatgggtgttccctgttgtacatcatattattcttatatgatgcctattatgggtt

SEQ ID NO: 203577 - DNA, 75 bp, Artificial Sequence
  Synthetic
taactaattgtttagctagtgagtgttttgtcaagagtgatatttttggtagtgattttaaaacttttgatttgc

SEQ ID NO: 203578 - DNA, 75 bp, Artificial Sequence
  Synthetic
ttttgtcaagagtgatatttttggtagtgattttaaaacttttgatttgcttaagtatgatttcactgaacataa

SEQ ID NO: 203579 - DNA, 75 bp, Artificial Sequence
  Synthetic
agaaaatttattcaataagtactttaagcattggagttttgattatcatcctaattgtagtgactgttatgatga

SEQ ID NO: 203580 - DNA, 75 bp, Artificial Sequence
  Synthetic
aagcattggagttttgattatcatcctaattgtagtgactgttatgatgatatgtgtgttatacattgtgctaat

SEQ ID NO: 203581 - DNA, 75 bp, Artificial Sequence
  Synthetic
tttaatacactatttgccacaactataccaggtactgcttttggtccactatgtcgtaaagtttttatagatggt

SEQ ID NO: 203582 - DNA, 75 bp, Artificial Sequence
  Synthetic
taaaactgcagtttttgtgtacacatgtgtggttgatggttgtagtgtcattgttagacgtgatgctacattcgc

SEQ ID NO: 203583 - DNA, 75 bp, Artificial Sequence
  Synthetic
atcattttaagcaattaggtttggtttggaataaagatgttaacacacactcagttaggttgacaattactgaac

SEQ ID NO: 203584 - DNA, 75 bp, Artificial Sequence
  Synthetic
tttctgttgcagcattgagtactggtttgacaaatcaagttgttaagccaggtcattttaatgaagagttttata

SEQ ID NO: 203585 - DNA, 75 bp, Artificial Sequence
  Synthetic
tttgacaaatcaagttgttaagccaggtcattttaatgaagagttttataactttcttcgtttaagaggtttctt

SEQ ID NO: 203586 - DNA, 75 bp, Artificial Sequence
  Synthetic
tgatgaaggttctgaacttacattaaaacatttcttcttcgcacagaatggtgatgctgctgttaaagattttga

SEQ ID NO: 203587 - DNA, 75 bp, Artificial Sequence
  Synthetic
gctcccaattaaacaacctttttctttttcttttagagatgaattgggtgttcgtgttttagatcaatctgataa

SEQ ID NO: 203588 - DNA, 75 bp, Artificial Sequence
  Synthetic
ttttgacatttatgaaggtggctgtattaaggcatgtgaagttgttgtaacaaatcttaataagagtgctggttg

SEQ ID NO: 203589 - DNA, 75 bp, Artificial Sequence
  Synthetic
attaaggcatgtgaagttgttgtaacaaatcttaataagagtgctggttggccattaaataagtttggtaaagct

SEQ ID NO: 203590 - DNA, 75 bp, Artificial Sequence
  Synthetic
ttctaaggttgttaaccataatgttttaatcaaagagtcaatacctattgtttggggtgtcaaggactttaatac

SEQ ID NO: 203591 - DNA, 75 bp, Artificial Sequence
  Synthetic
atgctattagtggtaaagaacgtgctagaactgttggtggtgtttctctgttgtccacaatgaccacaagacaat

SEQ ID NO: 203592 - DNA, 75 bp, Artificial Sequence
  Synthetic
accatcaaaaacatcttaaatccattgttaatacacgcaatgccactgttgttattggtactaccaaattttatg

SEQ ID NO: 203593 - DNA, 75 bp, Artificial Sequence
  Synthetic
tgttaatacacgcaatgccactgttgttattggtactaccaaattttatggtggttggaataatatgttgcgtac

SEQ ID NO: 203594 - DNA, 75 bp, Artificial Sequence
  Synthetic
aattttcaaaagttcaagactatttgtttctcaaccgtcgaagtgcctggtagttgtaattttccgcttgaagcc

SEQ ID NO: 203595 - DNA, 75 bp, Artificial Sequence
  Synthetic
tttaattgatggtgttgaaaaccctatgctcatgggttgggattatcccaaatgtgatagagctttgcctaacat

SEQ ID NO: 203596 - DNA, 75 bp, Artificial Sequence
  Synthetic
gtactgcaacagataggttttataggcttggtaatgagttggcacaagttttaacagaagttgtttattctaatg

SEQ ID NO: 203597 - DNA, 75 bp, Artificial Sequence
  Synthetic
tctatgttacaattaggtgttcctgacaattcttcaactttgtcacgggtttattgccaactcattggatttgtg

SEQ ID NO: 203598 - DNA, 75 bp, Artificial Sequence
  Synthetic
ttaacagaagttgtttattctaatggtggtttttattttaagccaggtggtacgacttctggtgacgctagtaca

SEQ ID NO: 203599 - DNA, 75 bp, Artificial Sequence
  Synthetic
gcttggtaatgagttggcacaagttttaacagaagttgtttattctaatggtggtttttattttaagccaggtgg

SEQ ID NO: 203600 - DNA, 75 bp, Artificial Sequence
  Synthetic
taacaggttgcttagtgtcccatcagattcatgtaataatgttaatgttagggatctacaacgacgtctgtatga

SEQ ID NO: 203601 - DNA, 75 bp, Artificial Sequence
  Synthetic
taccagaataatgtctttatgagtacttctaaatgttgggttgaagaagatttaactaagggaccacatgagttt

SEQ ID NO: 203602 - DNA, 75 bp, Artificial Sequence
  Synthetic
cttctaaatgttgggttgaagaagatttaactaagggaccacatgagttttgttcccagcatactatgcaaatag

SEQ ID NO: 203603 - DNA, 75 bp, Artificial Sequence
  Synthetic
taatgtttgtaattatgaacatgttatatcatttatgggttttaggtttgctattagtattcatggtagtcataa

SEQ ID NO: 203604 - DNA, 75 bp, Artificial Sequence
  Synthetic
taatgtttgtaattatgaacatgttatatcatttatgggttttaggtttgctattagtattcatggtagtcatat

SEQ ID NO: 203605 - DNA, 75 bp, Artificial Sequence
  Synthetic
taatgtttgtaattatgaacatgttatatcatttatgggttttaggtttgctattagtattcatggtagtcatac

SEQ ID NO: 203606 - DNA, 75 bp, Artificial Sequence
  Synthetic
taatgtttgtaattatgaacatgttatatcatttatgggttttaggtttgctattagtattcatggtagtcatag

SEQ ID NO: 203607 - DNA, 75 bp, Artificial Sequence
  Synthetic
taatgtttgtaattatgaacatgttatatcatttatgggttttaggtttgctattagtattcttggtagtcataa

SEQ ID NO: 203608 - DNA, 75 bp, Artificial Sequence
  Synthetic
taatgtttgtaattatgaacatgttatatcatttatgggttttaggtttgctattagtattcttggtagtcatat

SEQ ID NO: 203609 - DNA, 75 bp, Artificial Sequence
  Synthetic
taatgtttgtaattatgaacatgttatatcatttatgggttttaggtttgctattagtattcttggtagtcatac

SEQ ID NO: 203610 - DNA, 75 bp, Artificial Sequence
  Synthetic
taatgtttgtaattatgaacatgttatatcatttatgggttttaggtttgctattagtattcttggtagtcatag

SEQ ID NO: 203611 - DNA, 75 bp, Artificial Sequence
  Synthetic
taatgtttgtaattatgaacatgttatatcatttatgggttttaggtttgctattagtattcctggtagtcataa

SEQ ID NO: 203612 - DNA, 75 bp, Artificial Sequence
  Synthetic
taatgtttgtaattatgaacatgttatatcatttatgggttttaggtttgctattagtattcctggtagtcatat

SEQ ID NO: 203613 - DNA, 75 bp, Artificial Sequence
  Synthetic
taatgtttgtaattatgaacatgttatatcatttatgggttttaggtttgctattagtattcctggtagtcatac

SEQ ID NO: 203614 - DNA, 75 bp, Artificial Sequence
  Synthetic
taatgtttgtaattatgaacatgttatatcatttatgggttttaggtttgctattagtattcctggtagtcatag

SEQ ID NO: 203615 - DNA, 75 bp, Artificial Sequence
  Synthetic
taatgtttgtaattatgaacatgttatatcatttatgggttttaggtttgctattagtattcgtggtagtcataa

SEQ ID NO: 203616 - DNA, 75 bp, Artificial Sequence
  Synthetic
taatgtttgtaattatgaacatgttatatcatttatgggttttaggtttgctattagtattcgtggtagtcatat

SEQ ID NO: 203617 - DNA, 75 bp, Artificial Sequence
  Synthetic
taatgtttgtaattatgaacatgttatatcatttatgggttttaggtttgctattagtattcgtggtagtcatac

SEQ ID NO: 203618 - DNA, 75 bp, Artificial Sequence
  Synthetic
taatgtttgtaattatgaacatgttatatcatttatgggttttaggtttgctattagtattcgtggtagtcatag

SEQ ID NO: 203619 - DNA, 75 bp, Artificial Sequence
  Synthetic
taatgtttgtatttatgaacatgttatatcatttatgggttttaggtttgctattagtattcatggtagtcataa

SEQ ID NO: 203620 - DNA, 75 bp, Artificial Sequence
  Synthetic
taatgtttgtatttatgaacatgttatatcatttatgggttttaggtttgctattagtattcatggtagtcatat

SEQ ID NO: 203621 - DNA, 75 bp, Artificial Sequence
  Synthetic
taatgtttgtatttatgaacatgttatatcatttatgggttttaggtttgctattagtattcatggtagtcatac

SEQ ID NO: 203622 - DNA, 75 bp, Artificial Sequence
  Synthetic
taatgtttgtatttatgaacatgttatatcatttatgggttttaggtttgctattagtattcatggtagtcatag

SEQ ID NO: 203623 - DNA, 75 bp, Artificial Sequence
  Synthetic
taatgtttgtatttatgaacatgttatatcatttatgggttttaggtttgctattagtattcttggtagtcataa

SEQ ID NO: 203624 - DNA, 75 bp, Artificial Sequence
  Synthetic
taatgtttgtatttatgaacatgttatatcatttatgggttttaggtttgctattagtattcttggtagtcatat

SEQ ID NO: 203625 - DNA, 75 bp, Artificial Sequence
  Synthetic
taatgtttgtatttatgaacatgttatatcatttatgggttttaggtttgctattagtattcttggtagtcatac

SEQ ID NO: 203626 - DNA, 75 bp, Artificial Sequence
  Synthetic
taatgtttgtatttatgaacatgttatatcatttatgggttttaggtttgctattagtattcttggtagtcatag

SEQ ID NO: 203627 - DNA, 75 bp, Artificial Sequence
  Synthetic
taatgtttgtatttatgaacatgttatatcatttatgggttttaggtttgctattagtattcctggtagtcataa

SEQ ID NO: 203628 - DNA, 75 bp, Artificial Sequence
  Synthetic
taatgtttgtatttatgaacatgttatatcatttatgggttttaggtttgctattagtattcctggtagtcatat

SEQ ID NO: 203629 - DNA, 75 bp, Artificial Sequence
  Synthetic
taatgtttgtatttatgaacatgttatatcatttatgggttttaggtttgctattagtattcctggtagtcatac

SEQ ID NO: 203630 - DNA, 75 bp, Artificial Sequence
  Synthetic
taatgtttgtatttatgaacatgttatatcatttatgggttttaggtttgctattagtattcctggtagtcatag

SEQ ID NO: 203631 - DNA, 75 bp, Artificial Sequence
  Synthetic
taatgtttgtatttatgaacatgttatatcatttatgggttttaggtttgctattagtattcgtggtagtcataa

SEQ ID NO: 203632 - DNA, 75 bp, Artificial Sequence
  Synthetic
taatgtttgtatttatgaacatgttatatcatttatgggttttaggtttgctattagtattcgtggtagtcatat

SEQ ID NO: 203633 - DNA, 75 bp, Artificial Sequence
  Synthetic
taatgtttgtatttatgaacatgttatatcatttatgggttttaggtttgctattagtattcgtggtagtcatac

SEQ ID NO: 203634 - DNA, 75 bp, Artificial Sequence
  Synthetic
taatgtttgtatttatgaacatgttatatcatttatgggttttaggtttgctattagtattcgtggtagtcatag

SEQ ID NO: 203635 - DNA, 75 bp, Artificial Sequence
  Synthetic
taatgtttgtacttatgaacatgttatatcatttatgggttttaggtttgctattagtattcatggtagtcataa

SEQ ID NO: 203636 - DNA, 75 bp, Artificial Sequence
  Synthetic
taatgtttgtacttatgaacatgttatatcatttatgggttttaggtttgctattagtattcatggtagtcatat

SEQ ID NO: 203637 - DNA, 75 bp, Artificial Sequence
  Synthetic
taatgtttgtacttatgaacatgttatatcatttatgggttttaggtttgctattagtattcatggtagtcatac

SEQ ID NO: 203638 - DNA, 75 bp, Artificial Sequence
  Synthetic
taatgtttgtacttatgaacatgttatatcatttatgggttttaggtttgctattagtattcatggtagtcatag

SEQ ID NO: 203639 - DNA, 75 bp, Artificial Sequence
  Synthetic
taatgtttgtacttatgaacatgttatatcatttatgggttttaggtttgctattagtattcttggtagtcataa

SEQ ID NO: 203640 - DNA, 75 bp, Artificial Sequence
  Synthetic
taatgtttgtacttatgaacatgttatatcatttatgggttttaggtttgctattagtattcttggtagtcatat

SEQ ID NO: 203641 - DNA, 75 bp, Artificial Sequence
  Synthetic
taatgtttgtacttatgaacatgttatatcatttatgggttttaggtttgctattagtattcttggtagtcatac

SEQ ID NO: 203642 - DNA, 75 bp, Artificial Sequence
  Synthetic
taatgtttgtacttatgaacatgttatatcatttatgggttttaggtttgctattagtattcttggtagtcatag

SEQ ID NO: 203643 - DNA, 75 bp, Artificial Sequence
  Synthetic
taatgtttgtacttatgaacatgttatatcatttatgggttttaggtttgctattagtattcctggtagtcataa

SEQ ID NO: 203644 - DNA, 75 bp, Artificial Sequence
  Synthetic
taatgtttgtacttatgaacatgttatatcatttatgggttttaggtttgctattagtattcctggtagtcatat

SEQ ID NO: 203645 - DNA, 75 bp, Artificial Sequence
  Synthetic
taatgtttgtacttatgaacatgttatatcatttatgggttttaggtttgctattagtattcctggtagtcatac

SEQ ID NO: 203646 - DNA, 75 bp, Artificial Sequence
  Synthetic
taatgtttgtacttatgaacatgttatatcatttatgggttttaggtttgctattagtattcctggtagtcatag

SEQ ID NO: 203647 - DNA, 75 bp, Artificial Sequence
  Synthetic
taatgtttgtacttatgaacatgttatatcatttatgggttttaggtttgctattagtattcgtggtagtcataa

SEQ ID NO: 203648 - DNA, 75 bp, Artificial Sequence
  Synthetic
taatgtttgtacttatgaacatgttatatcatttatgggttttaggtttgctattagtattcgtggtagtcatat

SEQ ID NO: 203649 - DNA, 75 bp, Artificial Sequence
  Synthetic
taatgtttgtacttatgaacatgttatatcatttatgggttttaggtttgctattagtattcgtggtagtcatac

SEQ ID NO: 203650 - DNA, 75 bp, Artificial Sequence
  Synthetic
taatgtttgtacttatgaacatgttatatcatttatgggttttaggtttgctattagtattcgtggtagtcatag

SEQ ID NO: 203651 - DNA, 75 bp, Artificial Sequence
  Synthetic
taatgtttgtagttatgaacatgttatatcatttatgggttttaggtttgctattagtattcatggtagtcataa

SEQ ID NO: 203652 - DNA, 75 bp, Artificial Sequence
  Synthetic
taatgtttgtagttatgaacatgttatatcatttatgggttttaggtttgctattagtattcatggtagtcatat

SEQ ID NO: 203653 - DNA, 75 bp, Artificial Sequence
  Synthetic
taatgtttgtagttatgaacatgttatatcatttatgggttttaggtttgctattagtattcatggtagtcatac

SEQ ID NO: 203654 - DNA, 75 bp, Artificial Sequence
  Synthetic
taatgtttgtagttatgaacatgttatatcatttatgggttttaggtttgctattagtattcatggtagtcatag

SEQ ID NO: 203655 - DNA, 75 bp, Artificial Sequence
  Synthetic
taatgtttgtagttatgaacatgttatatcatttatgggttttaggtttgctattagtattcttggtagtcataa

SEQ ID NO: 203656 - DNA, 75 bp, Artificial Sequence
  Synthetic
taatgtttgtagttatgaacatgttatatcatttatgggttttaggtttgctattagtattcttggtagtcatat

SEQ ID NO: 203657 - DNA, 75 bp, Artificial Sequence
  Synthetic
taatgtttgtagttatgaacatgttatatcatttatgggttttaggtttgctattagtattcttggtagtcatac

SEQ ID NO: 203658 - DNA, 75 bp, Artificial Sequence
  Synthetic
taatgtttgtagttatgaacatgttatatcatttatgggttttaggtttgctattagtattcttggtagtcatag

SEQ ID NO: 203659 - DNA, 75 bp, Artificial Sequence
  Synthetic
taatgtttgtagttatgaacatgttatatcatttatgggttttaggtttgctattagtattcctggtagtcataa

SEQ ID NO: 203660 - DNA, 75 bp, Artificial Sequence
  Synthetic
taatgtttgtagttatgaacatgttatatcatttatgggttttaggtttgctattagtattcctggtagtcatat

SEQ ID NO: 203661 - DNA, 75 bp, Artificial Sequence
  Synthetic
taatgtttgtagttatgaacatgttatatcatttatgggttttaggtttgctattagtattcctggtagtcatac

SEQ ID NO: 203662 - DNA, 75 bp, Artificial Sequence
  Synthetic
taatgtttgtagttatgaacatgttatatcatttatgggttttaggtttgctattagtattcctggtagtcatag

SEQ ID NO: 203663 - DNA, 75 bp, Artificial Sequence
  Synthetic
taatgtttgtagttatgaacatgttatatcatttatgggttttaggtttgctattagtattcgtggtagtcataa

SEQ ID NO: 203664 - DNA, 75 bp, Artificial Sequence
  Synthetic
taatgtttgtagttatgaacatgttatatcatttatgggttttaggtttgctattagtattcgtggtagtcatat

SEQ ID NO: 203665 - DNA, 75 bp, Artificial Sequence
  Synthetic
taatgtttgtagttatgaacatgttatatcatttatgggttttaggtttgctattagtattcgtggtagtcatac

SEQ ID NO: 203666 - DNA, 75 bp, Artificial Sequence
  Synthetic
taatgtttgtagttatgaacatgttatatcatttatgggttttaggtttgctattagtattcgtggtagtcatag

SEQ ID NO: 203667 - DNA, 75 bp, Artificial Sequence
  Synthetic
tttgttagaacgttatgtgtctttagctattgatgcataccctctttcaaaacaccctaattctgaatatcgtaa

SEQ ID NO: 203668 - DNA, 75 bp, Artificial Sequence
  Synthetic
gctattgatgcataccctctttcaaaacaccctaattctgaatatcgtaaggttttttacgtattacttgattgg

SEQ ID NO: 203669 - DNA, 75 bp, Artificial Sequence
  Synthetic
gttaagcatcttaacaaaaatttgaatgagggtgttcttgaatctttttctgttacacttcttgataatcaagaa

SEQ ID NO: 203670 - DNA, 75 bp, Artificial Sequence
  Synthetic
ttcgttgtggtgattgtctgcgtaagcctatgttgtgcactaaatgcgcatatgatcatgtatttggtaccgacc

SEQ ID NO: 203671 - DNA, 75 bp, Artificial Sequence
  Synthetic
gcctatgttgtgcactaaatgcgcatatgatcatgtatttggtaccgaccacaagtttattttggctataacacc

SEQ ID NO: 203672 - DNA, 75 bp, Artificial Sequence
  Synthetic
tatgatcatgtatttggtaccgaccacaagtttattttggctataacaccgtatgtatgtaatgcatcaggttgt

SEQ ID NO: 203673 - DNA, 75 bp, Artificial Sequence
  Synthetic
ggtgttagtgatgtcaaaaaattgtatcttggtggtttgaattactattgtacaaatcataaaccacagttgtct

SEQ ID NO: 203674 - DNA, 75 bp, Artificial Sequence
  Synthetic
atcttggtggtttgaattactattgtacaaatcataaaccacagttgtcttttccattatgttcagctggtaata

SEQ ID NO: 203675 - DNA, 75 bp, Artificial Sequence
  Synthetic
tatttggtttatataaaaattcagcaactggttccttagatgttgaagtttttaataggcttgcaacgtctgatt

SEQ ID NO: 203676 - DNA, 75 bp, Artificial Sequence
  Synthetic
aactggttccttagatgttgaagtttttaataggcttgcaacgtctgattggactgatgttagggactataaact

SEQ ID NO: 203677 - DNA, 75 bp, Artificial Sequence
  Synthetic
tgctaatgatgttaaagatacacttagactctttgcggctgaaactattaaagctaaagaagagagtgttaagtc

SEQ ID NO: 203678 - DNA, 75 bp, Artificial Sequence
  Synthetic
agactctttgcggctgaaactattaaagctaaagaagagagtgttaagtcttcttatgcttttgcaactcttaaa

SEQ ID NO: 203679 - DNA, 75 bp, Artificial Sequence
  Synthetic
tttatcaacaaagcattattggtgccatgaccgctgttaatgagtctagatatggcttgcaaaacttactacagt

SEQ ID NO: 203680 - DNA, 75 bp, Artificial Sequence
  Synthetic
agtttggattgcaagatggtttttattctgcaaattttcttgatgataatgttttgcctgagacttatgttgcac

SEQ ID NO: 203681 - DNA, 75 bp, Artificial Sequence
  Synthetic
gaggttgttggacctaaagaattgcttcttagttgggaaagtggtaaagttaaaccacctttgaatcgtaattct

SEQ ID NO: 203682 - DNA, 75 bp, Artificial Sequence
  Synthetic
ttcttagttgggaaagtggtaaagttaaaccacctttgaatcgtaattctgttttcacctgttttcaaataagta

SEQ ID NO: 203683 - DNA, 75 bp, Artificial Sequence
  Synthetic
aggactcaaaattccaaataggtgagttcatctttgagaaggttgaatatggttctgatactgttacgtataagt

SEQ ID NO: 203684 - DNA, 75 bp, Artificial Sequence
  Synthetic
ctataaagttgaattttgggtatgttgaatggtatgccagtttcttctattaagggtgataaaggtgttgaaaaa

SEQ ID NO: 203685 - DNA, 75 bp, Artificial Sequence
  Synthetic
caactattgctaaccaagagaagtattctagcatttataaattgcaccctgcttttaatgtcagtgatgcatatg

SEQ ID NO: 203686 - DNA, 75 bp, Artificial Sequence
  Synthetic
ttctagcatttataaattgcaccctgcttttaatgtcagtgatgcatatgctaatttggttccatattaccaact

SEQ ID NO: 203687 - DNA, 75 bp, Artificial Sequence
  Synthetic
tattggtaaacaaaagataactacaatacagggtcctcctggtagtggtaagtcacattgttctattggacttgg

SEQ ID NO: 203688 - DNA, 75 bp, Artificial Sequence
  Synthetic
gtttttgttgcttgtgcccatgctgctgttgattccttatgtgcaaaagctatgactgtttatagcattgataag

SEQ ID NO: 203689 - DNA, 75 bp, Artificial Sequence
  Synthetic
ctgttgattccttatgtgcaaaagctatgactgtttatagcattgataagtgtactaggattatacctgcaagag

SEQ ID NO: 203690 - DNA, 75 bp, Artificial Sequence
  Synthetic
ctcgggttgagtgttatagtggctttaaaccaaataacactagtgcacaatacatatttagcactgttaacgcat

SEQ ID NO: 203691 - DNA, 75 bp, Artificial Sequence
  Synthetic
tacctgagtgtaatgctgatatcgttgttgtagatgaagtttcaatgtgtacaaattatgacctttctgttatta

SEQ ID NO: 203692 - DNA, 75 bp, Artificial Sequence
  Synthetic
tgttgtagatgaagtttcaatgtgtacaaattatgacctttctgttattaatcagcgtttatcatataaacatat

SEQ ID NO: 203693 - DNA, 75 bp, Artificial Sequence
  Synthetic
ttataacgttgttactcaacgtatgtgtgctataggccctgatgtttttcttcataaatgttatagatgtcctgc

SEQ ID NO: 203694 - DNA, 75 bp, Artificial Sequence
  Synthetic
cttgtttatgagaacaagtttgtccctgttaaacctgctagtaaacagtgttttaaagtcttttttaagggtaat

SEQ ID NO: 203695 - DNA, 75 bp, Artificial Sequence
  Synthetic
ttaacagaaagcagcttgaaatagttaagctgtttttagttaaaaatccaagttggagtaaggctgtgtttattt

SEQ ID NO: 203696 - DNA, 75 bp, Artificial Sequence
  Synthetic
taagctgtttttagttaaaaatccaagttggagtaaggctgtgtttatttctccttataatagtcagaattatgt

SEQ ID NO: 203697 - DNA, 75 bp, Artificial Sequence
  Synthetic
ctatgttacaattacgtgttcctgacaattcttcaactattgttaccggtttattgccaactcattggttttgtg

SEQ ID NO: 203698 - DNA, 75 bp, Artificial Sequence
  Synthetic
tgctagtagatttttaggacttcaaattcaaactgttgattcttctcaaggtagtgagtatgattatgtaatcta

SEQ ID NO: 203699 - DNA, 75 bp, Artificial Sequence
  Synthetic
attcaaactgttgattcttctcaaggtagtgagtatgattatgtaatctatgcacaaacttctgacactgcacat

SEQ ID NO: 203700 - DNA, 75 bp, Artificial Sequence
  Synthetic
gcttgcaatgtaaaccgttttaatgttgctataacacgtgctaagaagggtatattttgtgtaatgtgtgataaa

SEQ ID NO: 203701 - DNA, 75 bp, Artificial Sequence
  Synthetic
atttaccaccaactcatgcacacactttcttgtcgttgtcagatcagtttaagactacaggtgatttagctgttc

SEQ ID NO: 203702 - DNA, 75 bp, Artificial Sequence
  Synthetic
ctaaagttcatttttattacctaggtactggacctcataaggaccttaaattcagacaacgttttgatggtgttg

SEQ ID NO: 203703 - DNA, 75 bp, Artificial Sequence
  Synthetic
ttatgaacatgttatatcatttatgggttttaggtttgatattagtattcctggtagtcatagtttgttttgtac

SEQ ID NO: 203704 - DNA, 75 bp, Artificial Sequence
  Synthetic
ggttttaggtttgatattagtattcctggtagtcatagtttgttttgtacacgtgactttgctattcgcaatgtg

SEQ ID NO: 203705 - DNA, 75 bp, Artificial Sequence
  Synthetic
cgtggttggttgggtatggatgttgaaagtgctcatgtttgtggcgataacataggtactaatgttcctttacag

SEQ ID NO: 203706 - DNA, 75 bp, Artificial Sequence
  Synthetic
cataggtactaatgttcctttacaggttggtttttcaaatggtgttaattttgttgtgcaaactgaaggttgtgt

SEQ ID NO: 203707 - DNA, 75 bp, Artificial Sequence
  Synthetic
tggttaattgttcgtagacgcattgtgcaaatgatatctgattatttgtccaatttgtctgacattcttgtcttt

SEQ ID NO: 203708 - DNA, 75 bp, Artificial Sequence
  Synthetic
atgtctagaggaaagtcagaactttttctgtttgtgttgttggagtacttaaagatcgcacaggcgcgccaacaa

SEQ ID NO: 203709 - DNA, 75 bp, Artificial Sequence
  Synthetic
gttttgtgggcaggtagtttggaattaactacaatgcgttactttgtaaaaatagggccaattaaatattgttat

SEQ ID NO: 203710 - DNA, 75 bp, Artificial Sequence
  Synthetic
taactacaatgcgttactttgtaaaaatagggccaattaaatattgttattgtggtaattctgccacttgttata

SEQ ID NO: 203711 - DNA, 75 bp, Artificial Sequence
  Synthetic
cagaacagttaggtgtgcctttgggcataactatatcgggtgaaactgtacgtttgcatttatataatgcaactc

SEQ ID NO: 203712 - DNA, 75 bp, Artificial Sequence
  Synthetic
attcagttagtaatgaatattgttgttttaaacatgcattgggttgtgattatgtttacaatccgtatgcttttg

SEQ ID NO: 203713 - DNA, 75 bp, Artificial Sequence
  Synthetic
tttcattcttgggtaagtgtttgaagaagaactgtgttcgttttaaaaatgctgatcttaaggatggttattttg

SEQ ID NO: 203714 - DNA, 75 bp, Artificial Sequence
  Synthetic
tttcattcttgggtaagtgtttgaagatgaactgtgttcgttttaaaaatgctgatcttaaggatggttattttg

SEQ ID NO: 203715 - DNA, 75 bp, Artificial Sequence
  Synthetic
tttcattcttgggtaagtgtttgaagacgaactgtgttcgttttaaaaatgctgatcttaaggatggttattttg

SEQ ID NO: 203716 - DNA, 75 bp, Artificial Sequence
  Synthetic
tttcattcttgggtaagtgtttgaagaggaactgtgttcgttttaaaaatgctgatcttaaggatggttattttg

SEQ ID NO: 203717 - DNA, 75 bp, Artificial Sequence
  Synthetic
atatacaacagtggggttatgttggttccttgagccaaaaccaccacacattctgtaacattcatagaaacgagc

SEQ ID NO: 203718 - DNA, 75 bp, Artificial Sequence
  Synthetic
atgatgcctctggtgatgctgttatgacacgttgtttggcagtacatgattgttttgtcaaaaatgttgattgga

SEQ ID NO: 203719 - DNA, 75 bp, Artificial Sequence
  Synthetic
gacacgttgtttggcagtacatgattgttttgtcaaaaatgttgattggactgtaacgtacccctttattgcaaa

SEQ ID NO: 203720 - DNA, 75 bp, Artificial Sequence
  Synthetic
tgagaaatttatcaatggctgtgggcgtaatgtccagggacatgttgttcgtgcagccttgaaattgtataaacc

SEQ ID NO: 203721 - DNA, 75 bp, Artificial Sequence
  Synthetic
tagtgttattcatgacattggtaatcctaaaggtgtacgttgtgctgttactgatgccaaatggtactgttatga

SEQ ID NO: 203722 - DNA, 75 bp, Artificial Sequence
  Synthetic
atgtatccagaattttcaattgtgtgtcgttttgacacacgtactcgttctgtttttaatttagaaggtgttaat

SEQ ID NO: 203723 - DNA, 75 bp, Artificial Sequence
  Synthetic
tgtttttaatttagaaggtgttaatggtggttctctttatgttaacaaacatgcgtttcatacaccagcatatga

SEQ ID NO: 203724 - DNA, 75 bp, Artificial Sequence
  Synthetic
taaacgtgcttttgttaaattaaaacctatgccctttttttactttgatgacagtgattgtgatgttgtgcaaga

SEQ ID NO: 203725 - DNA, 75 bp, Artificial Sequence
  Synthetic
cctatgccctttttttactttgatgacagtgattgtgatgttgtgcaagaacaagttaattatgtaccccttcgc

SEQ ID NO: 203726 - DNA, 75 bp, Artificial Sequence
  Synthetic
gctagtagttgtgttacccgttgtaatataggtggtgctgtttgttcaaaacatgcaaatttgtatcaaaaatat

SEQ ID NO: 203727 - DNA, 75 bp, Artificial Sequence
  Synthetic
gttgaggcatataatacatttacacaggctggttttaacatttgggtaccacatagttttgatgtttataatttg

SEQ ID NO: 203728 - DNA, 75 bp, Artificial Sequence
  Synthetic
acatagttttgatgtttataatttgtggcaaatttttattgaaactaatttacaaagtcttgaaaatatagcatt

SEQ ID NO: 203729 - DNA, 75 bp, Artificial Sequence
  Synthetic
tggcaaatttttattgaaactaatttacaaagtcttgaaaatatagcatttaatgttgtaaaaaaagggtgtttt

SEQ ID NO: 203730 - DNA, 75 bp, Artificial Sequence
  Synthetic
actggtgttgatggtgagttacctgttgcagttgttaacgacaaagtttttgttcgctatggcgatgttgacaac

SEQ ID NO: 203731 - DNA, 75 bp, Artificial Sequence
  Synthetic
ctgatataaattttactgcgactgcatcttttggtggttcttgttatgtttgcaaaccacatcaggttaatatat

SEQ ID NO: 203732 - DNA, 75 bp, Artificial Sequence
  Synthetic
tgcctactaatgttgcttttgaattgtttgcaaaacgaaaaatgggtttaacaccaccattgtctattctcaaaa

SEQ ID NO: 203733 - DNA, 75 bp, Artificial Sequence
  Synthetic
atttgttttatgggattatgaagctgaaagaccttttacctcatatactaagagtgtatgtaaatacactgattt

SEQ ID NO: 203734 - DNA, 75 bp, Artificial Sequence
  Synthetic
aggcgtggtcgggtatctgtgttgatggcatttacggctatgttctgcgtcaacctaacttggttctttattctg

SEQ ID NO: 203735 - DNA, 75 bp, Artificial Sequence
  Synthetic
tgtggttgttggttgggacacgggtgtgcttgtgatcgtacaaccattcaaagtgttgacatttcttatttaaac

SEQ ID NO: 203736 - DNA, 75 bp, Artificial Sequence
  Synthetic
tttgggtggtgacaatgtttattgttacaacactgatcttattgaaggttctaaaccttatagtactttacagcc

SEQ ID NO: 203737 - DNA, 75 bp, Artificial Sequence
  Synthetic
gtatgattttcttaacatggatatgggtgtttttattaataaatatggtcttgaggattttaattttgaacatgt

SEQ ID NO: 203738 - DNA, 75 bp, Artificial Sequence
  Synthetic
ggtgtttttattaataaatatggtcttgaggattttaattttgaacatgttgtatatggtgatgtttcaaaaact

SEQ ID NO: 203739 - DNA, 75 bp, Artificial Sequence
  Synthetic
cgtaactttgatgaacaaaattgtgatgttctaaaagaagtattagttttaactggttgttgtgacaattcttat

SEQ ID NO: 203740 - DNA, 75 bp, Artificial Sequence
  Synthetic
acattaggaggtcttcatttgttgatatcacagtttaggcttagtaaaatgggtgttttgaaagctgatgatttt

SEQ ID NO: 203741 - DNA, 75 bp, Artificial Sequence
  Synthetic
cctaaaaacatgtgggaatttagagattactttaataataatactgatagtattgttattggtggtgtcacttat

SEQ ID NO: 203742 - DNA, 75 bp, Artificial Sequence
  Synthetic
tgaacttagttcaaaagttgtttgtacttatatggatttgttgttggacgactttgttactatactaaagagttt

SEQ ID NO: 203743 - DNA, 75 bp, Artificial Sequence
  Synthetic
ttgattaataacatttcttatgttgttactcaaaatttattttttatgttgctttatgctattttgtattttgtt

SEQ ID NO: 203744 - DNA, 75 bp, Artificial Sequence
  Synthetic
catgaagttattatagataataaaccttataggtggatgttgtggtgtaaagataaccacttgtccactttttat

SEQ ID NO: 203745 - DNA, 75 bp, Artificial Sequence
  Synthetic
cttataggtggatgttgtggtgtaaagataaccacttgtccactttttatccacagttgcagtctgctgaatgga

SEQ ID NO: 203746 - DNA, 75 bp, Artificial Sequence
  Synthetic
agtgtggttatgctatgccacaaatttataagcttcaacgtatgtgtttggaaccttgtaatttatataattatg

SEQ ID NO: 203747 - DNA, 75 bp, Artificial Sequence
  Synthetic
ttataagcttcaacgtatgtgtttggaaccttgtaatttatataattatggtgctggtattaagttgcctagtgg

SEQ ID NO: 203748 - DNA, 75 bp, Artificial Sequence
  Synthetic
tataatgttaaatgttgttaaatacactcagctttgtcaatacctaaatagcactacaatgtgcgtacctcataa

SEQ ID NO: 203749 - DNA, 75 bp, Artificial Sequence
  Synthetic
ttgtgctactgtttaccttgaagataagtttgacttacttatttctgatatgtatgatggtagaattaaattttg

SEQ ID NO: 203750 - DNA, 75 bp, Artificial Sequence
  Synthetic
aagtttgacttacttatttctgatatgtatgatggtagaattaaattttgtgatggtgaaaacgtctctaaagat

SEQ ID NO: 203751 - DNA, 75 bp, Artificial Sequence
  Synthetic
caatgcgaggttgttgtgattgtggttcaactaaacttccttattacgaatttgaaaaggtccacgttcaataat

SEQ ID NO: 203752 - DNA, 75 bp, Artificial Sequence
  Synthetic
ttattagagaaaaattagctattggtggtagtgttgccattaagattacagaatatagttggaataagtatcttt

SEQ ID NO: 203753 - DNA, 75 bp, Artificial Sequence
  Synthetic
ttggactttgttttgcacgtctgttaatacatcctcttcagaagcttttcttattggtattaattatttaggtga

SEQ ID NO: 203754 - DNA, 75 bp, Artificial Sequence
  Synthetic
ctttattcaaggtccttttatagctggtaacactgttcatgctaattatatattttggcgtaattctactattat

SEQ ID NO: 203755 - DNA, 75 bp, Artificial Sequence
  Synthetic
ggtaacactgttcatgctaattatatattttggcgtaattctactattatgtctttgtcatacaattcagtttta

SEQ ID NO: 203756 - DNA, 75 bp, Artificial Sequence
  Synthetic
ataaggccactgttgttgttacacttaaagatagtgatgtaaatgatatggttttgagtttgattaagagtggta

SEQ ID NO: 203757 - DNA, 75 bp, Artificial Sequence
  Synthetic
gttttattgtagtaattcttcctcaggtgttcttgacaccacaataccttttggcccttcctctcaaccttatta

SEQ ID NO: 203758 - DNA, 75 bp, Artificial Sequence
  Synthetic
gttgttgcctttttgtatgctgctttgttgaatggttgtaggtggtggttgcgttcaactagagttaatgttgat

SEQ ID NO: 203759 - DNA, 75 bp, Artificial Sequence
  Synthetic
atgctagtatttctatgttacaattaggtgttcctgataactcttcaactattgtcacaggtttgttgccagtcc

SEQ ID NO: 203760 - DNA, 75 bp, Artificial Sequence
  Synthetic
attggatttgtgctaatcagagcacatctagttacccagccaatggctttttctatattgatgtcggtaaacacc

SEQ ID NO: 203761 - DNA, 75 bp, Artificial Sequence
  Synthetic
ttctatattgatgtcggtaaacaccgtagtgcttttgcactccatagtggttattatgatgctaaccagtattat

SEQ ID NO: 203762 - DNA, 75 bp, Artificial Sequence
  Synthetic
gtagtgcttttgcactccatagtggttattatgatgctaaccagtattatatttatctcactaataaaatacatt

SEQ ID NO: 203763 - DNA, 75 bp, Artificial Sequence
  Synthetic
cattgagcagattagtgcttttactaaacccagttctatcaaagaaatgcagtcacaatcatctcatgctgttca

SEQ ID NO: 203764 - DNA, 75 bp, Artificial Sequence
  Synthetic
tttggtatgttgtagatgacatttattatccagcttcatgtaatggtgtattgccagttgcttttacaaaattag

SEQ ID NO: 203765 - DNA, 75 bp, Artificial Sequence
  Synthetic
attcacagaacagttaggtgtgcctttgggcataactatatcgggtgaaactgtacgtttgcatttatataatgc

SEQ ID NO: 203766 - DNA, 75 bp, Artificial Sequence
  Synthetic
gcttataaacttactaaacttagtgttaaatgttactttagtgaatcctgtgtttttagtgttgtcaatgctacc

SEQ ID NO: 203767 - DNA, 75 bp, Artificial Sequence
  Synthetic
atggccgtatagttaattacactgtttgtgatgattgtaatggttacactgataacatattttctgttcaacagg

SEQ ID NO: 203768 - DNA, 75 bp, Artificial Sequence
  Synthetic
aatggttctacactagtggacggtgtctctagactttaccaaccacttcgtttaacttgtttatggcctgtacct

SEQ ID NO: 203769 - DNA, 75 bp, Artificial Sequence
  Synthetic
cattctgttgctgatgttatgcgttacaatcttaacttcagttctaattctgtggataatctcaagagtggtgtt

SEQ ID NO: 203770 - DNA, 75 bp, Artificial Sequence
  Synthetic
ataccttttggcccttcctctcaaccttattactgttttataaatagtaccatcaacaccactcatgttagcact

SEQ ID NO: 203771 - DNA, 75 bp, Artificial Sequence
  Synthetic
tggctattatgcctatctctataaaaatttttcatttgttttgttcaatgttactaaactatgctttgtttcagg

SEQ ID NO: 203772 - DNA, 75 bp, Artificial Sequence
  Synthetic
ttttggttaatgttagtgcaactaacattcaaaacttactttattgcgattctccatttgaaaagttgcagtgtg

SEQ ID NO: 203773 - DNA, 75 bp, Artificial Sequence
  Synthetic
tggtttttattctgcaaattttcttgatgataatgttttgcctgatacttatgttgcacttcctatttattatca

SEQ ID NO: 203774 - DNA, 75 bp, Artificial Sequence
  Synthetic
tatatctcttaatggtaatacttcagtgtgtgttagaacatctcatttttcaattaggtatatttataaccgcgt

SEQ ID NO: 203775 - DNA, 75 bp, Artificial Sequence
  Synthetic
ttttttctgatagaccccttaatttgcgaggttggctcattttttctaacagcaattatgttcttcaggactttg

SEQ ID NO: 203776 - DNA, 75 bp, Artificial Sequence
  Synthetic
tgcctggtagttgtaattttccacttgaagccacctggcattacacttcttatactattgttggtgctttgtatg

SEQ ID NO: 203777 - DNA, 75 bp, Artificial Sequence
  Synthetic
tatactattgttggtgctttgtatgttacttggtctgaaggtaattccattactggtgtaccttatcctgtctct

SEQ ID NO: 203778 - DNA, 75 bp, Artificial Sequence
  Synthetic
ttacttggtctgaaggtaattccattactggtgtaccttatcctgtctctggtattcgtgagtttagtaatttag

SEQ ID NO: 203779 - DNA, 75 bp, Artificial Sequence
  Synthetic
ttttaaataattgtaccaaatataatatttatgattatgttggtactggaattatacgttcttcaaaccagtcac

SEQ ID NO: 203780 - DNA, 75 bp, Artificial Sequence
  Synthetic
tatttatgattatgttggtactggaattatacgttcttcaaaccagtcacttgctggtggtattacatatgtttc

SEQ ID NO: 203781 - DNA, 75 bp, Artificial Sequence
  Synthetic
gattctgttcactaatgaatacactgatatttaaatggtgttccgtcactgcttattgtggaagcaacgttctgt

SEQ ID NO: 203782 - DNA, 75 bp, Artificial Sequence
  Synthetic
gattctgttcactaatgaatacactgatatttaattggtgttccgtcactgcttattgtggaagcaacgttctgt

SEQ ID NO: 203783 - DNA, 75 bp, Artificial Sequence
  Synthetic
gattctgttcactaatgaatacactgatatttaactggtgttccgtcactgcttattgtggaagcaacgttctgt

SEQ ID NO: 203784 - DNA, 75 bp, Artificial Sequence
  Synthetic
gattctgttcactaatgaatacactgatatttaagtggtgttccgtcactgcttattgtggaagcaacgttctgt

SEQ ID NO: 203785 - DNA, 75 bp, Artificial Sequence
  Synthetic
gattctgttcactaatgtatacactgatatttaaatggtgttccgtcactgcttattgtggaagcaacgttctgt

SEQ ID NO: 203786 - DNA, 75 bp, Artificial Sequence
  Synthetic
gattctgttcactaatgtatacactgatatttaattggtgttccgtcactgcttattgtggaagcaacgttctgt

SEQ ID NO: 203787 - DNA, 75 bp, Artificial Sequence
  Synthetic
gattctgttcactaatgtatacactgatatttaactggtgttccgtcactgcttattgtggaagcaacgttctgt

SEQ ID NO: 203788 - DNA, 75 bp, Artificial Sequence
  Synthetic
gattctgttcactaatgtatacactgatatttaagtggtgttccgtcactgcttattgtggaagcaacgttctgt

SEQ ID NO: 203789 - DNA, 75 bp, Artificial Sequence
  Synthetic
gattctgttcactaatgcatacactgatatttaaatggtgttccgtcactgcttattgtggaagcaacgttctgt

SEQ ID NO: 203790 - DNA, 75 bp, Artificial Sequence
  Synthetic
gattctgttcactaatgcatacactgatatttaattggtgttccgtcactgcttattgtggaagcaacgttctgt

SEQ ID NO: 203791 - DNA, 75 bp, Artificial Sequence
  Synthetic
gattctgttcactaatgcatacactgatatttaactggtgttccgtcactgcttattgtggaagcaacgttctgt

SEQ ID NO: 203792 - DNA, 75 bp, Artificial Sequence
  Synthetic
gattctgttcactaatgcatacactgatatttaagtggtgttccgtcactgcttattgtggaagcaacgttctgt

SEQ ID NO: 203793 - DNA, 75 bp, Artificial Sequence
  Synthetic
gattctgttcactaatggatacactgatatttaaatggtgttccgtcactgcttattgtggaagcaacgttctgt

SEQ ID NO: 203794 - DNA, 75 bp, Artificial Sequence
  Synthetic
gattctgttcactaatggatacactgatatttaattggtgttccgtcactgcttattgtggaagcaacgttctgt

SEQ ID NO: 203795 - DNA, 75 bp, Artificial Sequence
  Synthetic
gattctgttcactaatggatacactgatatttaactggtgttccgtcactgcttattgtggaagcaacgttctgt

SEQ ID NO: 203796 - DNA, 75 bp, Artificial Sequence
  Synthetic
gattctgttcactaatggatacactgatatttaagtggtgttccgtcactgcttattgtggaagcaacgttctgt

SEQ ID NO: 203797 - DNA, 75 bp, Artificial Sequence
  Synthetic
gattctgttcactattgaatacactgatatttaaatggtgttccgtcactgcttattgtggaagcaacgttctgt

SEQ ID NO: 203798 - DNA, 75 bp, Artificial Sequence
  Synthetic
gattctgttcactattgaatacactgatatttaattggtgttccgtcactgcttattgtggaagcaacgttctgt

SEQ ID NO: 203799 - DNA, 75 bp, Artificial Sequence
  Synthetic
gattctgttcactattgaatacactgatatttaactggtgttccgtcactgcttattgtggaagcaacgttctgt

SEQ ID NO: 203800 - DNA, 75 bp, Artificial Sequence
  Synthetic
gattctgttcactattgaatacactgatatttaagtggtgttccgtcactgcttattgtggaagcaacgttctgt

SEQ ID NO: 203801 - DNA, 75 bp, Artificial Sequence
  Synthetic
gattctgttcactattgtatacactgatatttaaatggtgttccgtcactgcttattgtggaagcaacgttctgt

SEQ ID NO: 203802 - DNA, 75 bp, Artificial Sequence
  Synthetic
gattctgttcactattgtatacactgatatttaattggtgttccgtcactgcttattgtggaagcaacgttctgt

SEQ ID NO: 203803 - DNA, 75 bp, Artificial Sequence
  Synthetic
gattctgttcactattgtatacactgatatttaactggtgttccgtcactgcttattgtggaagcaacgttctgt

SEQ ID NO: 203804 - DNA, 75 bp, Artificial Sequence
  Synthetic
gattctgttcactattgtatacactgatatttaagtggtgttccgtcactgcttattgtggaagcaacgttctgt

SEQ ID NO: 203805 - DNA, 75 bp, Artificial Sequence
  Synthetic
gattctgttcactattgcatacactgatatttaaatggtgttccgtcactgcttattgtggaagcaacgttctgt

SEQ ID NO: 203806 - DNA, 75 bp, Artificial Sequence
  Synthetic
gattctgttcactattgcatacactgatatttaattggtgttccgtcactgcttattgtggaagcaacgttctgt

SEQ ID NO: 203807 - DNA, 75 bp, Artificial Sequence
  Synthetic
gattctgttcactattgcatacactgatatttaactggtgttccgtcactgcttattgtggaagcaacgttctgt

SEQ ID NO: 203808 - DNA, 75 bp, Artificial Sequence
  Synthetic
gattctgttcactattgcatacactgatatttaagtggtgttccgtcactgcttattgtggaagcaacgttctgt

SEQ ID NO: 203809 - DNA, 75 bp, Artificial Sequence
  Synthetic
gattctgttcactattggatacactgatatttaaatggtgttccgtcactgcttattgtggaagcaacgttctgt

SEQ ID NO: 203810 - DNA, 75 bp, Artificial Sequence
  Synthetic
gattctgttcactattggatacactgatatttaattggtgttccgtcactgcttattgtggaagcaacgttctgt

SEQ ID NO: 203811 - DNA, 75 bp, Artificial Sequence
  Synthetic
gattctgttcactattggatacactgatatttaactggtgttccgtcactgcttattgtggaagcaacgttctgt

SEQ ID NO: 203812 - DNA, 75 bp, Artificial Sequence
  Synthetic
gattctgttcactattggatacactgatatttaagtggtgttccgtcactgcttattgtggaagcaacgttctgt

SEQ ID NO: 203813 - DNA, 75 bp, Artificial Sequence
  Synthetic
gattctgttcactactgaatacactgatatttaaatggtgttccgtcactgcttattgtggaagcaacgttctgt

SEQ ID NO: 203814 - DNA, 75 bp, Artificial Sequence
  Synthetic
gattctgttcactactgaatacactgatatttaattggtgttccgtcactgcttattgtggaagcaacgttctgt

SEQ ID NO: 203815 - DNA, 75 bp, Artificial Sequence
  Synthetic
gattctgttcactactgaatacactgatatttaactggtgttccgtcactgcttattgtggaagcaacgttctgt

SEQ ID NO: 203816 - DNA, 75 bp, Artificial Sequence
  Synthetic
gattctgttcactactgaatacactgatatttaagtggtgttccgtcactgcttattgtggaagcaacgttctgt

SEQ ID NO: 203817 - DNA, 75 bp, Artificial Sequence
  Synthetic
gattctgttcactactgtatacactgatatttaaatggtgttccgtcactgcttattgtggaagcaacgttctgt

SEQ ID NO: 203818 - DNA, 75 bp, Artificial Sequence
  Synthetic
gattctgttcactactgtatacactgatatttaattggtgttccgtcactgcttattgtggaagcaacgttctgt

SEQ ID NO: 203819 - DNA, 75 bp, Artificial Sequence
  Synthetic
gattctgttcactactgtatacactgatatttaactggtgttccgtcactgcttattgtggaagcaacgttctgt

SEQ ID NO: 203820 - DNA, 75 bp, Artificial Sequence
  Synthetic
gattctgttcactactgtatacactgatatttaagtggtgttccgtcactgcttattgtggaagcaacgttctgt

SEQ ID NO: 203821 - DNA, 75 bp, Artificial Sequence
  Synthetic
gattctgttcactactgcatacactgatatttaaatggtgttccgtcactgcttattgtggaagcaacgttctgt

SEQ ID NO: 203822 - DNA, 75 bp, Artificial Sequence
  Synthetic
gattctgttcactactgcatacactgatatttaattggtgttccgtcactgcttattgtggaagcaacgttctgt

SEQ ID NO: 203823 - DNA, 75 bp, Artificial Sequence
  Synthetic
gattctgttcactactgcatacactgatatttaactggtgttccgtcactgcttattgtggaagcaacgttctgt

SEQ ID NO: 203824 - DNA, 75 bp, Artificial Sequence
  Synthetic
gattctgttcactactgcatacactgatatttaagtggtgttccgtcactgcttattgtggaagcaacgttctgt

SEQ ID NO: 203825 - DNA, 75 bp, Artificial Sequence
  Synthetic
gattctgttcactactggatacactgatatttaaatggtgttccgtcactgcttattgtggaagcaacgttctgt

SEQ ID NO: 203826 - DNA, 75 bp, Artificial Sequence
  Synthetic
gattctgttcactactggatacactgatatttaattggtgttccgtcactgcttattgtggaagcaacgttctgt

SEQ ID NO: 203827 - DNA, 75 bp, Artificial Sequence
  Synthetic
gattctgttcactactggatacactgatatttaactggtgttccgtcactgcttattgtggaagcaacgttctgt

SEQ ID NO: 203828 - DNA, 75 bp, Artificial Sequence
  Synthetic
gattctgttcactactggatacactgatatttaagtggtgttccgtcactgcttattgtggaagcaacgttctgt

SEQ ID NO: 203829 - DNA, 75 bp, Artificial Sequence
  Synthetic
gattctgttcactagtgaatacactgatatttaaatggtgttccgtcactgcttattgtggaagcaacgttctgt

SEQ ID NO: 203830 - DNA, 75 bp, Artificial Sequence
  Synthetic
gattctgttcactagtgaatacactgatatttaattggtgttccgtcactgcttattgtggaagcaacgttctgt

SEQ ID NO: 203831 - DNA, 75 bp, Artificial Sequence
  Synthetic
gattctgttcactagtgaatacactgatatttaactggtgttccgtcactgcttattgtggaagcaacgttctgt

SEQ ID NO: 203832 - DNA, 75 bp, Artificial Sequence
  Synthetic
gattctgttcactagtgaatacactgatatttaagtggtgttccgtcactgcttattgtggaagcaacgttctgt

SEQ ID NO: 203833 - DNA, 75 bp, Artificial Sequence
  Synthetic
gattctgttcactagtgtatacactgatatttaaatggtgttccgtcactgcttattgtggaagcaacgttctgt

SEQ ID NO: 203834 - DNA, 75 bp, Artificial Sequence
  Synthetic
gattctgttcactagtgtatacactgatatttaattggtgttccgtcactgcttattgtggaagcaacgttctgt

SEQ ID NO: 203835 - DNA, 75 bp, Artificial Sequence
  Synthetic
gattctgttcactagtgtatacactgatatttaactggtgttccgtcactgcttattgtggaagcaacgttctgt

SEQ ID NO: 203836 - DNA, 75 bp, Artificial Sequence
  Synthetic
gattctgttcactagtgtatacactgatatttaagtggtgttccgtcactgcttattgtggaagcaacgttctgt

SEQ ID NO: 203837 - DNA, 75 bp, Artificial Sequence
  Synthetic
gattctgttcactagtgcatacactgatatttaaatggtgttccgtcactgcttattgtggaagcaacgttctgt

SEQ ID NO: 203838 - DNA, 75 bp, Artificial Sequence
  Synthetic
gattctgttcactagtgcatacactgatatttaattggtgttccgtcactgcttattgtggaagcaacgttctgt

SEQ ID NO: 203839 - DNA, 75 bp, Artificial Sequence
  Synthetic
gattctgttcactagtgcatacactgatatttaactggtgttccgtcactgcttattgtggaagcaacgttctgt

SEQ ID NO: 203840 - DNA, 75 bp, Artificial Sequence
  Synthetic
gattctgttcactagtgcatacactgatatttaagtggtgttccgtcactgcttattgtggaagcaacgttctgt

SEQ ID NO: 203841 - DNA, 75 bp, Artificial Sequence
  Synthetic
gattctgttcactagtggatacactgatatttaaatggtgttccgtcactgcttattgtggaagcaacgttctgt

SEQ ID NO: 203842 - DNA, 75 bp, Artificial Sequence
  Synthetic
gattctgttcactagtggatacactgatatttaattggtgttccgtcactgcttattgtggaagcaacgttctgt

SEQ ID NO: 203843 - DNA, 75 bp, Artificial Sequence
  Synthetic
gattctgttcactagtggatacactgatatttaactggtgttccgtcactgcttattgtggaagcaacgttctgt

SEQ ID NO: 203844 - DNA, 75 bp, Artificial Sequence
  Synthetic
gattctgttcactagtggatacactgatatttaagtggtgttccgtcactgcttattgtggaagcaacgttctgt

SEQ ID NO: 203845 - DNA, 75 bp, Artificial Sequence
  Synthetic
tgcactcttgcataaaattcattagaccctttttgctttgatgttaacactttactttctaatcaattacgtcta

SEQ ID NO: 203846 - DNA, 75 bp, Artificial Sequence
  Synthetic
taactctggtaatttacttggttttaaaaatgtttccactggtaacatttttattgtgacaccatgtaaccaacc

SEQ ID NO: 203847 - DNA, 75 bp, Artificial Sequence
  Synthetic
atcggtgttatgttggagtgtgaaaaattcaacgtatttaatgttgttggtccgcgaactggtaaacatgagcat

SEQ ID NO: 203848 - DNA, 75 bp, Artificial Sequence
  Synthetic
gctgtatataaaaatgttaaattttatttacgtgatatttcacaccttgtaaactgtgtttcttttgactttgtt

SEQ ID NO: 203849 - DNA, 75 bp, Artificial Sequence
  Synthetic
aggtgttttacctattaatactgatactgtcttatctgtagctccagaagttgactgggttgctttttacggttt

SEQ ID NO: 203850 - DNA, 75 bp, Artificial Sequence
  Synthetic
tccacacagacataaattgcgttcacgtgttaagtttgttaatggacgcgttgttattaccaatgttggtgaacc

SEQ ID NO: 203851 - DNA, 75 bp, Artificial Sequence
  Synthetic
cttttgataacggtcactatgtagtttatgatgctgctaataatgctgtctatgatggtgctcgtttattttctt

SEQ ID NO: 203852 - DNA, 75 bp, Artificial Sequence
  Synthetic
attttttacgttgctttatgctattttgtattttgtttctactaggacagtgcgttatgcctccatttggcatat

SEQ ID NO: 203853 - DNA, 75 bp, Artificial Sequence
  Synthetic
attttttacgttgctttatgctattttgtattttgtttctactaggacagtgcgttttgcctccatttggcatat

SEQ ID NO: 203854 - DNA, 75 bp, Artificial Sequence
  Synthetic
attttttacgttgctttatgctattttgtattttgtttctactaggacagtgcgttctgcctccatttggcatat

SEQ ID NO: 203855 - DNA, 75 bp, Artificial Sequence
  Synthetic
attttttacgttgctttatgctattttgtattttgtttctactaggacagtgcgttgtgcctccatttggcatat

SEQ ID NO: 203856 - DNA, 75 bp, Artificial Sequence
  Synthetic
cttggtcgttgtgtgcgtaaacttaatagattgaaaacttgtgttattgccaatgttcctgctattgatgtgtct

SEQ ID NO: 203857 - DNA, 75 bp, Artificial Sequence
  Synthetic
cccttccttgataatagcttcttccccagcactcgttgatcaacgcactatttgtttttctgttgcagcattgag

SEQ ID NO: 203858 - DNA, 75 bp, Artificial Sequence
  Synthetic
ttctaattttggtatttgtgctgatggttctttaattcctgttcgtccgcgtaattctagtgataatggtatttc

SEQ ID NO: 203859 - DNA, 75 bp, Artificial Sequence
  Synthetic
tcctaaaggtgtacgttgagctgttactgatgccaaatggtactgttatgacaagcaacctgttaatagtaatgt

SEQ ID NO: 203860 - DNA, 75 bp, Artificial Sequence
  Synthetic
tcctaaaggtgtacgttgtgctgttactgatgccaaatggtactgttatgacaagcaacctgttaatagtaatgt

SEQ ID NO: 203861 - DNA, 75 bp, Artificial Sequence
  Synthetic
tcctaaaggtgtacgttgcgctgttactgatgccaaatggtactgttatgacaagcaacctgttaatagtaatgt

SEQ ID NO: 203862 - DNA, 75 bp, Artificial Sequence
  Synthetic
tcctaaaggtgtacgttgggctgttactgatgccaaatggtactgttatgacaagcaacctgttaatagtaatgt

SEQ ID NO: 203863 - DNA, 75 bp, Artificial Sequence
  Synthetic
tgggtgttttgaaagctgatgattttgtcactgcttctgacacaactttgaggtgctgtactgttacttatccta

SEQ ID NO: 203864 - DNA, 75 bp, Artificial Sequence
  Synthetic
ggtgtaatatctacagttcatgaagttaatatagataataaaccttataggtggatgttgtggtgtaaagataac

SEQ ID NO: 203865 - DNA, 75 bp, Artificial Sequence
  Synthetic
ggtgtaatatctacagttcatgaagttattatagataataaaccttataggtggatgttgtggtgtaaagataac

SEQ ID NO: 203866 - DNA, 75 bp, Artificial Sequence
  Synthetic
ggtgtaatatctacagttcatgaagttactatagataataaaccttataggtggatgttgtggtgtaaagataac

SEQ ID NO: 203867 - DNA, 75 bp, Artificial Sequence
  Synthetic
ggtgtaatatctacagttcatgaagttagtatagataataaaccttataggtggatgttgtggtgtaaagataac

SEQ ID NO: 203868 - DNA, 75 bp, Artificial Sequence
  Synthetic
attccctctaactggactacttcagttcaagttgagtacctccaaattactagtactccaatagttgttgattgt

SEQ ID NO: 203869 - DNA, 75 bp, Artificial Sequence
  Synthetic
ttcaagttgagtacctccaaattactagtactccaatagttgttgattgtgctacttatgtgtgtaatggtaacc

SEQ ID NO: 203870 - DNA, 75 bp, Artificial Sequence
  Synthetic
ttacaattacgtgttcctgacaattcttcaactattgttaccggtttattgccaactcattggttttgtgctaat

SEQ ID NO: 203871 - DNA, 75 bp, Artificial Sequence
  Synthetic
tttatttaaagagtggcacttgtccattttctttttctaagttaaataattttcaaaagttcaagactatttgtt

SEQ ID NO: 203872 - DNA, 75 bp, Artificial Sequence
  Synthetic
ctcgctgtaagaatctacttaagcagtatacttctgcttgtaaaactattgaagatgccttacgacttagtgctc

SEQ ID NO: 203873 - DNA, 75 bp, Artificial Sequence
  Synthetic
gtatacttctgcttgtaaaactattgaagatgccttacgacttagtgctcatttggaaactaatgatgttagtag

SEQ ID NO: 203874 - DNA, 75 bp, Artificial Sequence
  Synthetic
atcttgaacaatcattttatgaaactcgttctgctgctatttatggtggtgaccactacgtcgttttaggtggtg

SEQ ID NO: 203875 - DNA, 75 bp, Artificial Sequence
  Synthetic
agccgtatagcaggacgtagtgctttggaagatttgttgtttagcaaagttgttacatctggtttgggtactgtt

SEQ ID NO: 203876 - DNA, 75 bp, Artificial Sequence
  Synthetic
atggttttgccaggtgttgctgatgctgaacgtatggccatgtacacaggttctcttataggtggcatggtgctc

SEQ ID NO: 203877 - DNA, 75 bp, Artificial Sequence
  Synthetic
ctgaacgtatggccatgtacacaggttctcttataggtggcatggtgctcggaggtcttacatcagcagccgcca

SEQ ID NO: 203878 - DNA, 75 bp, Artificial Sequence
  Synthetic
tacctttttctttggcactgcaagcacgacttaactatgttgctttacaaactgatgtgcttcaagaaaatcaga

SEQ ID NO: 203879 - DNA, 75 bp, Artificial Sequence
  Synthetic
actgatgtgcttcaagaaaatcagaaaattttggctgcatcatttaataaggctattaataacattgttgcttct

SEQ ID NO: 203880 - DNA, 75 bp, Artificial Sequence
  Synthetic
agccgcctaaatattcttctaaggttgttttgagtggtgaatggaatgctgtgtatagggcgtttggttcaccat

SEQ ID NO: 203881 - DNA, 75 bp, Artificial Sequence
  Synthetic
tttagtagcgttaatgatgctattacacaaactgcagaggctatacatactgttactattgcacttaataagatt

SEQ ID NO: 203882 - DNA, 75 bp, Artificial Sequence
  Synthetic
cacaaactgcagaggctatacatactgttactattgcacttaataagattcaggatgttgttaatcaacagggta

SEQ ID NO: 203883 - DNA, 75 bp, Artificial Sequence
  Synthetic
gtgctcttaaccatctcacttcacaattgagacataattttcaggccatttctaattcaattcaagctatttatg

SEQ ID NO: 203884 - DNA, 75 bp, Artificial Sequence
  Synthetic
attgagacataattttcaggccatttctaattcaattcaagctatttatgaccggcttgattcaattcaagccga

SEQ ID NO: 203885 - DNA, 75 bp, Artificial Sequence
  Synthetic
tcaacaagttgacagattaattactggacggcttgcagctttgaatgcatttgtttcccaagttttgaataaata

SEQ ID NO: 203886 - DNA, 75 bp, Artificial Sequence
  Synthetic
taaaactgcagtttttgtgtacacatgtgtggttgatggctgtagtgtcattgttagacgtgatgctacattcgc

SEQ ID NO: 203887 - DNA, 75 bp, Artificial Sequence
  Synthetic
taacttccagggtcatgtttcaacctcgtttacctgttttgtctgattttgtgcaaatatataattgtaatgtta

SEQ ID NO: 203888 - DNA, 75 bp, Artificial Sequence
  Synthetic
gtgcaaatatataattgtaatgttacttttgttaacatatctcgtgtcgagttacatactgtcatacctgactac

SEQ ID NO: 203889 - DNA, 75 bp, Artificial Sequence
  Synthetic
ctttttcacatgtaatagtaatgctaatatctctatgttacaattaggtgttcctgacaattcttcaactattgt

SEQ ID NO: 203890 - DNA, 75 bp, Artificial Sequence
  Synthetic
cttttgttaacatatctcgtgtcgagttacatactgtcatacctgactacgttgatgttaataaaacattacaag

SEQ ID NO: 203891 - DNA, 75 bp, Artificial Sequence
  Synthetic
agtttgcacaaaacttaccaaagtatgttaagcctaattttgacttgactccttttaatttaacatatcttaatt

SEQ ID NO: 203892 - DNA, 75 bp, Artificial Sequence
  Synthetic
tgttaagcctaattttgacttgactccttttaatttaacatatcttaatttgagttctgagttgaagcaactcga

SEQ ID NO: 203893 - DNA, 75 bp, Artificial Sequence
  Synthetic
ttttagacgtgttttggtaaaattgcttgatgtttataatggttttcttgaaactgtttgtagtgtcgcacacac

SEQ ID NO: 203894 - DNA, 75 bp, Artificial Sequence
  Synthetic
agctaaaactgctagtcttttccaaactactgttgaattacaaggtcttattgatcagattaacagtacatatgt

SEQ ID NO: 203895 - DNA, 75 bp, Artificial Sequence
  Synthetic
tgatttgaagttgcttaataggtttgaaaattatattaaatggccttggtgggtttggctcattatttctgttgt

SEQ ID NO: 203896 - DNA, 75 bp, Artificial Sequence
  Synthetic
aacttactcttgaaagtactattaataagagtgtggctaatctcaaattaccacctcatgatgttactgtcttgc

SEQ ID NO: 203897 - DNA, 75 bp, Artificial Sequence
  Synthetic
ccacctcatgatgttactgtcttgcgtgacaatctcaaacctgttactacacttagtactatcactgcttatttg

SEQ ID NO: 203898 - DNA, 75 bp, Artificial Sequence
  Synthetic
ttagttagtttgtttgtcacttattttgctttattcaaacctcttactgctagaggtcgtgttgcttgttttgtt

SEQ ID NO: 203899 - DNA, 75 bp, Artificial Sequence
  Synthetic
ttaaaactattgacactatttgtctatgtgcctttattggttctttttggtatgtatcttgacagttttataatt

SEQ ID NO: 203900 - DNA, 75 bp, Artificial Sequence
  Synthetic
ttttctacgctgttgtttcgattcatacatgttggctattatgcctatctctataaaaatttttcatttgttttg

SEQ ID NO: 203901 - DNA, 75 bp, Artificial Sequence
  Synthetic
gctattagtggtaaagaacgtgctagaactgttggtggtgtttctctgttgtctacaatgaccacaagacaatac

SEQ ID NO: 203902 - DNA, 75 bp, Artificial Sequence
  Synthetic
acaatcattttatgaaaatcgttttgctgctatttatggtggtgaccactatgtcgttttaggtggtgaaactat

SEQ ID NO: 203903 - DNA, 75 bp, Artificial Sequence
  Synthetic
atgtcgttttaggtggtgaaactattacttttgtttcttttgatgacctttatgttgctattagaggttcttgtg

SEQ ID NO: 203904 - DNA, 75 bp, Artificial Sequence
  Synthetic
aaaagaacctacaacttatgcgtaaggttgacttgtataatggtgctgtcatttacatttttgccgaagagcctg

SEQ ID NO: 203905 - DNA, 75 bp, Artificial Sequence
  Synthetic
actatacgaagatgttccttcgattaattgatgacaatggcattgtcctcaattccattttatggctccttgtta

SEQ ID NO: 203906 - DNA, 75 bp, Artificial Sequence
  Synthetic
aattgatgacaatggcattgtcctcaattccattttatggctccttgttatgatatttttctttgtgttggcaat

SEQ ID NO: 203907 - DNA, 75 bp, Artificial Sequence
  Synthetic
gacttttattaaactgattcaattgtgttttacttgtcattatttttttagtaggacattatatcaaccagttta

SEQ ID NO: 203908 - DNA, 75 bp, Artificial Sequence
  Synthetic
tgttttacttgtcattatttttttagtaggacattatatcaaccagtttataaaatttttcttgcttaccaagat

SEQ ID NO: 203909 - DNA, 75 bp, Artificial Sequence
  Synthetic
tatatgcaaatagcacctgttccagctgaagtactaaatgtctaaactaaacgatgtctaatagtagtgtgcctc

SEQ ID NO: 203910 - DNA, 75 bp, Artificial Sequence
  Synthetic
tgcagtatgggcattataagtatagcagacttctttatggtttaaagatgtctgttttatggtgtttatggccac

SEQ ID NO: 203911 - DNA, 75 bp, Artificial Sequence
  Synthetic
cagacttctttatggtttaaagatgtctgttttatggtgtttatggccacttgttctagctttgtctatttttga

SEQ ID NO: 203912 - DNA, 75 bp, Artificial Sequence
  Synthetic
gcaaactcattaatgccaagccgcctaaatattcttctaaggttgttttgagtggtgaatggaatgctgtgtata

SEQ ID NO: 203913 - DNA, 75 bp, Artificial Sequence
  Synthetic
ctgttttgtcaattttaatgtggactgggtcttttttggttttagtattcttatgtctattattacactttgttt

SEQ ID NO: 203914 - DNA, 75 bp, Artificial Sequence
  Synthetic
gttgttaagacagatgctgttgttttgttagaacgttatgtgtctttagctattgatgcataccctctttcaaaa

SEQ ID NO: 203915 - DNA, 75 bp, Artificial Sequence
  Synthetic
cttgttgatggccataagattgctactcgtgttcaagtgggtcagttgcctaaatatgtaatagttgctacacct

SEQ ID NO: 203916 - DNA, 75 bp, Artificial Sequence
  Synthetic
ctcgtgttcaagtgggtcagttgcctaaatatgtaatagttgctacacctagtaccacaattgtttgtgaccgtg

SEQ ID NO: 203917 - DNA, 75 bp, Artificial Sequence
  Synthetic
ttatttgaaaatggtattccacttatgcctcttcttagttgtggtatttttggtgtaaggattgaaaattctctt

SEQ ID NO: 203918 - DNA, 75 bp, Artificial Sequence
  Synthetic
ttggtcgctctgttaatgaaacaagccagactggttgggcattctacgtccgtgctaaacatggtgatttttctg

SEQ ID NO: 203919 - DNA, 75 bp, Artificial Sequence
  Synthetic
ccagactggttgggcattctacgtccgtgctaaacatggtgatttttctggtgttgcctctcaggagggtgtttt

SEQ ID NO: 203920 - DNA, 75 bp, Artificial Sequence
  Synthetic
gtcagaaagagagaagttgcttcatttaatctaaactaaacaaaatggctagtgtaaattgggccgatgacagag

SEQ ID NO: 203921 - DNA, 75 bp, Artificial Sequence
  Synthetic
tggtaagggtaataaagatgagcagattggttattggaatgttcaagagcgttggcgtatgcgcagggggcaacg

SEQ ID NO: 203922 - DNA, 75 bp, Artificial Sequence
  Synthetic
aaggaaggtgctaaaactgttaataccagtcttggtaatcgcaaacgtaatcagaaacctttggaaccaaagttc

SEQ ID NO: 203923 - DNA, 75 bp, Artificial Sequence
  Synthetic
tcagaaacctttggaaccaaagttctctattgctttgcctccagagctctctgttgttgagtttgaggatcgctc

SEQ ID NO: 203924 - DNA, 75 bp, Artificial Sequence
  Synthetic
taataactcatctcgtgctagcagtcgttcttcaactcgtaacaactcacgagactcttctcgtagcacttcaag

SEQ ID NO: 203925 - DNA, 75 bp, Artificial Sequence
  Synthetic
ttgctgctgttactttggctttaaagaacttaggttttgataaccagtcgaagtcacctagttcttctggtactt

SEQ ID NO: 203926 - DNA, 75 bp, Artificial Sequence
  Synthetic
gaacttaggttttgataaccagtcgaagtcacctagttcttctggtacttccactcctaagaaacctaataagcc

SEQ ID NO: 203927 - DNA, 75 bp, Artificial Sequence
  Synthetic
tctttctcaacccagggctgataagccttctcagttgaagaaacctcgttggaagcgtgttcctaccagagagga

SEQ ID NO: 203928 - DNA, 75 bp, Artificial Sequence
  Synthetic
cgtgattttaatcacaatatgggggattcagatcttgttcagaatggtgttgatgccaaaggttttccacagctt

SEQ ID NO: 203929 - DNA, 75 bp, Artificial Sequence
  Synthetic
tcacaggtttgttgccagtccattggatttgtgctaatcagagtacatctagttacccagccaacggctttttct

SEQ ID NO: 203930 - DNA, 75 bp, Artificial Sequence
  Synthetic
ttgtagctaaggataataagaaccttcctaagttcattgagcagattagtgcttttactaaacccagttctatca

SEQ ID NO: 203931 - DNA, 75 bp, Artificial Sequence
  Synthetic
gcttttactaaacccagttctatcaaagaaatgcagtcacaatcatctcatgctgttcagaacacagtacttaat

SEQ ID NO: 203932 - DNA, 75 bp, Artificial Sequence
  Synthetic
tggctgatgatgattcagccattatagaaattgtcaacgaggttttgcattaaattgttttgtaattccagttga

SEQ ID NO: 203933 - DNA, 75 bp, Artificial Sequence
  Synthetic
agaaattgtcaacgaggttttgcattaaattgttttgtaattccagttgaatgtttattattattagttgcaacc

SEQ ID NO: 203934 - DNA, 75 bp, Artificial Sequence
  Synthetic
ccatgcgtttagcgcatgataagggtttagtcttacacacaatggtaggccagtgatagtaaagtgtaagtaatt

SEQ ID NO: 203935 - DNA, 75 bp, Artificial Sequence
  Synthetic
ataaacttactaaacttagtgttaaatgttactttagtgaatcctgtgtttttagtgttgtcaatgccaccatta

SEQ ID NO: 203936 - DNA, 75 bp, Artificial Sequence
  Synthetic
gttgttggagtacttaaagatcgcataggcgcgccaacaatggaagagccaacaacatatctaaaaatgttttgt

SEQ ID NO: 203937 - DNA, 75 bp, Artificial Sequence
  Synthetic
tatgaacattgcagctaattctagtgaatgggcttattgtgttgatttacacaataagattaatctttgtgatga

SEQ ID NO: 203938 - DNA, 75 bp, Artificial Sequence
  Synthetic
aactaaacgaaatttttctagtgctgtcatttgttatggcagtcctagtgtaattgaaatttcgtcaagtttgta

SEQ ID NO: 203939 - DNA, 75 bp, Artificial Sequence
  Synthetic
tgaagatgatgttgttaccagtctttgtaagaagagttttggtaagtctattatttatacaggtgattgggaagg

SEQ ID NO: 203940 - DNA, 75 bp, Artificial Sequence
  Synthetic
ttatgtcattgcattgactggtactaatcagctctgtgccaaaattttacctttttctgatagaccccttaattt

SEQ ID NO: 203941 - DNA, 75 bp, Artificial Sequence
  Synthetic
gatagtattgttattgatggtgtcacttatcaactagcatgggatgttatacgtaaagacctttcttatgaacag

SEQ ID NO: 203942 - DNA, 75 bp, Artificial Sequence
  Synthetic
caaaatgttttagccattgagagcattcattaccttggtactacaggtcatactttgaagtctggttgcaaactt

SEQ ID NO: 203943 - DNA, 75 bp, Artificial Sequence
  Synthetic
accagttttctttaatgcttttgttaaatgcaattgtggttctgagagttggagtgttggtgcatgggatggtta

SEQ ID NO: 203944 - DNA, 75 bp, Artificial Sequence
  Synthetic
ggtgttaaatactatgctggcttagttgttaaacatattactaacattactggtgtgtctttatggcgtgttaca

SEQ ID NO: 203945 - DNA, 75 bp, Artificial Sequence
  Synthetic
tggtgtgtctttatggcgtgttacagctgttcattctgatggaatgtttgtggcatcatcttcttatgatgcact

SEQ ID NO: 203946 - DNA, 75 bp, Artificial Sequence
  Synthetic
gctgttcattctgatggaatgtttgtggcatcatcttcttatgatgcactcttgcatagaaattcattagaccct

SEQ ID NO: 203947 - DNA, 75 bp, Artificial Sequence
  Synthetic
ggtgctggttctgacaaaggtgtggcacctggtacaactgttttaaaacgttggctaccacccgatgcaataatc

SEQ ID NO: 203948 - DNA, 75 bp, Artificial Sequence
  Synthetic
aacaataaaccttggtttgtacgcaaagcttctgggctttttgatgcaatctgggatgcttttgttgccgctatt

SEQ ID NO: 203949 - DNA, 75 bp, Artificial Sequence
  Synthetic
ttttggttaggtttgttaagtctattgcttcaactgttttaactgtctctaatggtgttattattatgtgtgcag

SEQ ID NO: 203950 - DNA, 75 bp, Artificial Sequence
  Synthetic
aatggtgttattattatgtgtgcagatgttccagatgcttttcaatcagtttatcgcacatttacacaagctatt

SEQ ID NO: 203951 - DNA, 75 bp, Artificial Sequence
  Synthetic
tgtttcattcttgggtaagtgtttgaagatgaactgtgttcgttttaaaaatgctgatcttaaggatggttattt

SEQ ID NO: 203952 - DNA, 75 bp, Artificial Sequence
  Synthetic
atgtatttaaaattggtgatgttaaatttaaacgacttggtgattatgttcttactgaaaacgctcttgttcgtt

SEQ ID NO: 203953 - DNA, 75 bp, Artificial Sequence
  Synthetic
tattgaacttgccactgttaatttgcgtcttgttgattgtgcacctgtagtttgccctaaaggtaagattgttgt

SEQ ID NO: 203954 - DNA, 75 bp, Artificial Sequence
  Synthetic
tcctgtttttactggtgatttattttacactattaagtttagtggttttaagcttgatggttttaaccatcagtt

SEQ ID NO: 203955 - DNA, 75 bp, Artificial Sequence
  Synthetic
agcttgatggttttaaccatcagtttgttactgctagttctgctacagatgccattattgctgttgagctgttgt

SEQ ID NO: 203956 - DNA, 75 bp, Artificial Sequence
  Synthetic
ttaatggtaacttttatgattttggtgattttgttgttagcttacctaatatgggtgttccctgttgtacatcat

SEQ ID NO: 203957 - DNA, 75 bp, Artificial Sequence
  Synthetic
ttagtggttttgtaagtcgtgtaattcgtagagaaaggtgtgacatgacttttccttgtgttagttgtgtcactt

SEQ ID NO: 203958 - DNA, 75 bp, Artificial Sequence
  Synthetic
gcagattttagcattacaggtgattgtgctactgtttatcttgaagataagtttgacttacttatttctgatatg

SEQ ID NO: 203959 - DNA, 75 bp, Artificial Sequence
  Synthetic
aagcgagcactgattttcatcaattagaatgtattgttgatgactctgttagagaagaggttgatataattgaac

SEQ ID NO: 203960 - DNA, 75 bp, Artificial Sequence
  Synthetic
agaatgtattgttgatgactctgttagagaagaggttgatataattgaacaaccttttgaagaagttgaacatgt

SEQ ID NO: 203961 - DNA, 75 bp, Artificial Sequence
  Synthetic
atggtgaaaacgtctctaaagatgggttttttacttatcttaatggtgttattagagaaaaattagctattggtg

SEQ ID NO: 203962 - DNA, 75 bp, Artificial Sequence
  Synthetic
gctctcaattaaacaacctttttctttttcttttagagatgaattgggtgttcgtgttttagatcaatctgataa

SEQ ID NO: 203963 - DNA, 75 bp, Artificial Sequence
  Synthetic
gtttaaagttggtaaagttgattcaattgtccaaaagtgttatgagttgtctcatttaattagtggttcacttgg

SEQ ID NO: 203964 - DNA, 75 bp, Artificial Sequence
  Synthetic
tgatagtggtaaacttcttagtgaacttcttaaagaaaaatatacatgttctataacttttgagatgtcttgtga

SEQ ID NO: 203965 - DNA, 75 bp, Artificial Sequence
  Synthetic
ctataacttttgagatgtcttgtgattgtggtaaaaagtttgatgagcaggttggttgtttgttttggattatgc

SEQ ID NO: 203966 - DNA, 75 bp, Artificial Sequence
  Synthetic
ctcaactaaatgaaacttttcttgattttgcttgttttgcccctggcctcttgctttttcacatgtaatagtaat

SEQ ID NO: 203967 - DNA, 75 bp, Artificial Sequence
  Synthetic
ctgtatatttaggtgttaagggttctggtcattatcaaacaaatttatacagttttaacaaagctattgatggtt

SEQ ID NO: 203968 - DNA, 75 bp, Artificial Sequence
  Synthetic
aatagttgacaaagatggtacctattatttgccttacccagatcctagtaggatcttgtcagctggtgtttttgt

SEQ ID NO: 203969 - DNA, 75 bp, Artificial Sequence
  Synthetic
ctattgatattttgactgaaggtcaacttcagtcattatctaaagattacattagtagtaatggtccacttaagg

SEQ ID NO: 203970 - DNA, 75 bp, Artificial Sequence
  Synthetic
tttttatgctagtatgtatgaaaattctacaatattgcaagctgctggtttatgtgttgtttgtggttcacaaac

SEQ ID NO: 203971 - DNA, 75 bp, Artificial Sequence
  Synthetic
gtgtttttagtgttgtcaacgccaccgttactgtgaatgtcaccacacataatggccgtgtagttaactacactg

SEQ ID NO: 203972 - DNA, 75 bp, Artificial Sequence
  Synthetic
attccacttatgcctcttcttagttgtggtatttttggtgtaaggattgaaaattctcttaaagctttgtttagt

SEQ ID NO: 203973 - DNA, 75 bp, Artificial Sequence
  Synthetic
aatggccgtgtagttaactacactgtttgtgatgattgtaatggttatactgataacatattttctgttcaacag

SEQ ID NO: 203974 - DNA, 75 bp, Artificial Sequence
  Synthetic
atgttaattgtaacggctatcaacataattctgttgctgatgttatgcgttacaatcttaacttcagtgctaatt

SEQ ID NO: 203975 - DNA, 75 bp, Artificial Sequence
  Synthetic
tgtggtatgtatgtttatttgttgttgcattgtttattggtgtctcatttattgattatacaaccactgtaacta

SEQ ID NO: 203976 - DNA, 75 bp, Artificial Sequence
  Synthetic
tatagtttttaaaactctacagtacgatgttttgttttactgtagtaattcctcttcgggcgttctagacaccac

SEQ ID NO: 203977 - DNA, 75 bp, Artificial Sequence
  Synthetic
aactgttaaatttgttgtagagagtaatgttatggatgttaacgactgttttaagaatgataatgtagttttgaa

SEQ ID NO: 203978 - DNA, 75 bp, Artificial Sequence
  Synthetic
agtcacttggtaaacaattgggtgttgtgagtgatggtgttgactcttttgaaggtgttttacctattaatactg

SEQ ID NO: 203979 - DNA, 75 bp, Artificial Sequence
  Synthetic
tttgaaaaggcagcactttttgcttctttggatgtaaagccatatggttaccctaatgattttgttggtggtttt

SEQ ID NO: 203980 - DNA, 75 bp, Artificial Sequence
  Synthetic
actcagctccagatggtttgctttttcttcatactgttttgctgccaactgattacaagaatgtaaaggcgtggt

SEQ ID NO: 203981 - DNA, 75 bp, Artificial Sequence
  Synthetic
attagtgattctattgttactcttgaacaatattcaacttgtgacatttgtaaaagtactgtagttgaagttaaa

SEQ ID NO: 203982 - DNA, 75 bp, Artificial Sequence
  Synthetic
aagcattattggtgccatgactgctgttaatgagtctagatatggcttgcaaaacttactacagttacctaactt

SEQ ID NO: 203983 - DNA, 75 bp, Artificial Sequence
  Synthetic
tgccaaggctcctaaacgtacaggtgttattttgacacgtagttttaagtataacattaaatctgctttgtttgt

SEQ ID NO: 203984 - DNA, 75 bp, Artificial Sequence
  Synthetic
ttgtaagtggttatgaaaaatccacttttaataaggatatttattgtggtaattctatggtttgtaagatgtgtt

SEQ ID NO: 203985 - DNA, 75 bp, Artificial Sequence
  Synthetic
tcaggttcctattggttgtttggatcctattaggttttgtttagaaaataatgtgtgtaatgtttgtggttgttg

SEQ ID NO: 203986 - DNA, 75 bp, Artificial Sequence
  Synthetic
acaacatatctaaaaatgttttgtctggtacttgttaatgatattgtttttgatatggatacacaaaaaaaaaaa

SEQ ID NO: 203987 - DNA, 75 bp, Artificial Sequence
  Synthetic
attttgttgcacaatttattagtacttttggttctttcttaggctttcatcagaaacagtggtttttacattttg

SEQ ID NO: 203988 - DNA, 75 bp, Artificial Sequence
  Synthetic
tcttttgtgttaattgtgattcttttgggcctggtaatacttttattaatggtgatattgcaagagagcttggta

SEQ ID NO: 203989 - DNA, 75 bp, Artificial Sequence
  Synthetic
gtgattatgtttacaatccgtatgcttttgatatacaacagtggggttatgttggttccttgagccaaaaccacc

SEQ ID NO: 203990 - DNA, 75 bp, Artificial Sequence
  Synthetic
aatgggctatggctaatggttatacaagtgtttctagtgttgagtgctattctattttggcagcaaaaactggtg

SEQ ID NO: 203991 - DNA, 75 bp, Artificial Sequence
  Synthetic
aaaatgcttgtgtttatttttctcaattgttgtgtgaacctataaagttggtaaattcagagttgttgtcaactt

SEQ ID NO: 203992 - DNA, 75 bp, Artificial Sequence
  Synthetic
ctgctaacatgtccatggctgaatgtaaagctacacttggtttgactgtttctgatgatgattttgtttcagctg

SEQ ID NO: 203993 - DNA, 75 bp, Artificial Sequence
  Synthetic
cctaaaggtaagattgttgttattgctggacaagcttttttctatagtggtggtttttatcgttttatggttgat

SEQ ID NO: 203994 - DNA, 75 bp, Artificial Sequence
  Synthetic
gttaatagtttcagactttggcgccgtgttaaaactttttgggcttttaatcctgaaactaatgcaatcatctct

SEQ ID NO: 203995 - DNA, 75 bp, Artificial Sequence
  Synthetic
tctaaggttgttaatcataatgttttaatcaaagagtcaatacctattgtttggggtgtcaaggactttaatact

SEQ ID NO: 203996 - DNA, 75 bp, Artificial Sequence
  Synthetic
actgctggttatcattttaagcaattaggtttggtttggaataaagatgttaacacacactcagttaggttgaca

SEQ ID NO: 203997 - DNA, 75 bp, Artificial Sequence
  Synthetic
gagaaaggtgtgacatgacttttccttgtgttagttgtgtcacctttttctatgaatttttagacacttgttttg

SEQ ID NO: 203998 - DNA, 75 bp, Artificial Sequence
  Synthetic
tctatatcttatgaagaacaggatgctttgtttgctttgacaaagcgtaatgtcctccctactatgacacagctg

SEQ ID NO: 203999 - DNA, 75 bp, Artificial Sequence
  Synthetic
gttttgacaatagtattcagggttcgtatgagcgttttacgcttactacgaacgctgttttattttctactgttg

SEQ ID NO: 204000 - DNA, 75 bp, Artificial Sequence
  Synthetic
aggctgcttttggaaacacaggtgtttgttatgactttgatggtgttactactagtgataagtgtatttttaatt

SEQ ID NO: 204001 - DNA, 75 bp, Artificial Sequence
  Synthetic
ctgcttgtactaggttggaaggtttgggtggtgacaatgtttattgttacaatactgatcttattgaaggttcta

SEQ ID NO: 204002 - DNA, 75 bp, Artificial Sequence
  Synthetic
agcactgattttcatcaattagaatgtattgttgatgactctgttagagaagaggttgatataattgaacaacct

SEQ ID NO: 204003 - DNA, 75 bp, Artificial Sequence
  Synthetic
aaaatgggtgttttgaaagctgatgattttgtcattgcttctgacacaactttgaggtgctgtactgttacttat

SEQ ID NO: 204004 - DNA, 75 bp, Artificial Sequence
  Synthetic
gcaaaagatcataatgacatgttatattctccacctaccattagctacaattccaccttacaatctggtcttaag

SEQ ID NO: 204005 - DNA, 75 bp, Artificial Sequence
  Synthetic
gatcgcataggcgcgccaacaatggaagagccaacaacatatctaaaaatgttttgtctggtacttgttaatgat

SEQ ID NO: 204006 - DNA, 75 bp, Artificial Sequence
  Synthetic
tggaggcggtgttgcacgtgctattgatattttgactgaaggtcaacttcagtcattatctaaagattacattag

SEQ ID NO: 204007 - DNA, 75 bp, Artificial Sequence
  Synthetic
ataatgtgtgtaatgtttgtggttgctggttgggacatggatgtgcttgtgaccgtacaactattcaaagtgttg

SEQ ID NO: 204008 - DNA, 75 bp, Artificial Sequence
  Synthetic
ggccgttttggtggttttagtaatcatttagtctcaactaaatgaaacttttcttgattttgcttattttgcccc

SEQ ID NO: 204009 - DNA, 75 bp, Artificial Sequence
  Synthetic
gttgcctttttgtatgctgctttgttgaatggttgtaggtggtggttgcgttcaactagagttaatgttgatggt

SEQ ID NO: 204010 - DNA, 75 bp, Artificial Sequence
  Synthetic
acttaatggccgtatagttaattacactgtttgtgatgattgtaatggttacactgataacatattttctgttca

SEQ ID NO: 204011 - DNA, 75 bp, Artificial Sequence
  Synthetic
actgtttgtgatgattgtaatggttacactgataacatattttctgttcaacaggatggccgcattcctaatggt

SEQ ID NO: 204012 - DNA, 75 bp, Artificial Sequence
  Synthetic
ttttcttttaataattggtttttgttaactaatggttctacactagtggacggtgtctctagactttaccaacca

SEQ ID NO: 204013 - DNA, 75 bp, Artificial Sequence
  Synthetic
atttttacacacatggcgcttttctaaagaacgtttcacacattggtttacatatgtgtgttctcttatagcagt

SEQ ID NO: 204014 - DNA, 75 bp, Artificial Sequence
  Synthetic
ttttgtttattttaacgccactggttctgatgttaattgtaatggttatcaacatcattctgttgctgatgttat

SEQ ID NO: 204015 - DNA, 75 bp, Artificial Sequence
  Synthetic
gactttttgagtttgcttgttatgtttttatgtgctatatctagtgattggtacattggtgccattgtttttagg

SEQ ID NO: 204016 - DNA, 75 bp, Artificial Sequence
  Synthetic
tgcttttactaaacccagttctatcaaagaaatgcagtcacaatcatctcatgttgttcaaaacacagtaattaa

SEQ ID NO: 204017 - DNA, 75 bp, Artificial Sequence
  Synthetic
tgcttttactaaacccagttctatcaaagaaatgcagtcacaatcatctcatgttgttcaaaacacagtatttaa

SEQ ID NO: 204018 - DNA, 75 bp, Artificial Sequence
  Synthetic
tgcttttactaaacccagttctatcaaagaaatgcagtcacaatcatctcatgttgttcaaaacacagtacttaa

SEQ ID NO: 204019 - DNA, 75 bp, Artificial Sequence
  Synthetic
tgcttttactaaacccagttctatcaaagaaatgcagtcacaatcatctcatgttgttcaaaacacagtagttaa

SEQ ID NO: 204020 - DNA, 75 bp, Artificial Sequence
  Synthetic
tgcttttactaaacccagttctatcaaagaaatgcagtcacaatcatctcatgttgttcaaaactcagtaattaa

SEQ ID NO: 204021 - DNA, 75 bp, Artificial Sequence
  Synthetic
tgcttttactaaacccagttctatcaaagaaatgcagtcacaatcatctcatgttgttcaaaactcagtatttaa

SEQ ID NO: 204022 - DNA, 75 bp, Artificial Sequence
  Synthetic
tgcttttactaaacccagttctatcaaagaaatgcagtcacaatcatctcatgttgttcaaaactcagtacttaa

SEQ ID NO: 204023 - DNA, 75 bp, Artificial Sequence
  Synthetic
tgcttttactaaacccagttctatcaaagaaatgcagtcacaatcatctcatgttgttcaaaactcagtagttaa

SEQ ID NO: 204024 - DNA, 75 bp, Artificial Sequence
  Synthetic
tgcttttactaaacccagttctatcaaagaaatgcagtcacaatcatctcatgttgttcaaaacccagtaattaa

SEQ ID NO: 204025 - DNA, 75 bp, Artificial Sequence
  Synthetic
tgcttttactaaacccagttctatcaaagaaatgcagtcacaatcatctcatgttgttcaaaacccagtatttaa

SEQ ID NO: 204026 - DNA, 75 bp, Artificial Sequence
  Synthetic
tgcttttactaaacccagttctatcaaagaaatgcagtcacaatcatctcatgttgttcaaaacccagtacttaa

SEQ ID NO: 204027 - DNA, 75 bp, Artificial Sequence
  Synthetic
tgcttttactaaacccagttctatcaaagaaatgcagtcacaatcatctcatgttgttcaaaacccagtagttaa

SEQ ID NO: 204028 - DNA, 75 bp, Artificial Sequence
  Synthetic
tgcttttactaaacccagttctatcaaagaaatgcagtcacaatcatctcatgttgttcaaaacgcagtaattaa

SEQ ID NO: 204029 - DNA, 75 bp, Artificial Sequence
  Synthetic
tgcttttactaaacccagttctatcaaagaaatgcagtcacaatcatctcatgttgttcaaaacgcagtatttaa

SEQ ID NO: 204030 - DNA, 75 bp, Artificial Sequence
  Synthetic
tgcttttactaaacccagttctatcaaagaaatgcagtcacaatcatctcatgttgttcaaaacgcagtacttaa

SEQ ID NO: 204031 - DNA, 75 bp, Artificial Sequence
  Synthetic
tgcttttactaaacccagttctatcaaagaaatgcagtcacaatcatctcatgttgttcaaaacgcagtagttaa

SEQ ID NO: 204032 - DNA, 75 bp, Artificial Sequence
  Synthetic
tgcttttactaaacccagttctatcaaagaaatgcagtcacaatcatctcatgttgttcataacacagtaattaa

SEQ ID NO: 204033 - DNA, 75 bp, Artificial Sequence
  Synthetic
tgcttttactaaacccagttctatcaaagaaatgcagtcacaatcatctcatgttgttcataacacagtatttaa

SEQ ID NO: 204034 - DNA, 75 bp, Artificial Sequence
  Synthetic
tgcttttactaaacccagttctatcaaagaaatgcagtcacaatcatctcatgttgttcataacacagtacttaa

SEQ ID NO: 204035 - DNA, 75 bp, Artificial Sequence
  Synthetic
tgcttttactaaacccagttctatcaaagaaatgcagtcacaatcatctcatgttgttcataacacagtagttaa

SEQ ID NO: 204036 - DNA, 75 bp, Artificial Sequence
  Synthetic
tgcttttactaaacccagttctatcaaagaaatgcagtcacaatcatctcatgttgttcataactcagtaattaa

SEQ ID NO: 204037 - DNA, 75 bp, Artificial Sequence
  Synthetic
tgcttttactaaacccagttctatcaaagaaatgcagtcacaatcatctcatgttgttcataactcagtatttaa

SEQ ID NO: 204038 - DNA, 75 bp, Artificial Sequence
  Synthetic
tgcttttactaaacccagttctatcaaagaaatgcagtcacaatcatctcatgttgttcataactcagtacttaa

SEQ ID NO: 204039 - DNA, 75 bp, Artificial Sequence
  Synthetic
tgcttttactaaacccagttctatcaaagaaatgcagtcacaatcatctcatgttgttcataactcagtagttaa

SEQ ID NO: 204040 - DNA, 75 bp, Artificial Sequence
  Synthetic
tgcttttactaaacccagttctatcaaagaaatgcagtcacaatcatctcatgttgttcataacccagtaattaa

SEQ ID NO: 204041 - DNA, 75 bp, Artificial Sequence
  Synthetic
tgcttttactaaacccagttctatcaaagaaatgcagtcacaatcatctcatgttgttcataacccagtatttaa

SEQ ID NO: 204042 - DNA, 75 bp, Artificial Sequence
  Synthetic
tgcttttactaaacccagttctatcaaagaaatgcagtcacaatcatctcatgttgttcataacccagtacttaa

SEQ ID NO: 204043 - DNA, 75 bp, Artificial Sequence
  Synthetic
tgcttttactaaacccagttctatcaaagaaatgcagtcacaatcatctcatgttgttcataacccagtagttaa

SEQ ID NO: 204044 - DNA, 75 bp, Artificial Sequence
  Synthetic
tgcttttactaaacccagttctatcaaagaaatgcagtcacaatcatctcatgttgttcataacgcagtaattaa

SEQ ID NO: 204045 - DNA, 75 bp, Artificial Sequence
  Synthetic
tgcttttactaaacccagttctatcaaagaaatgcagtcacaatcatctcatgttgttcataacgcagtatttaa

SEQ ID NO: 204046 - DNA, 75 bp, Artificial Sequence
  Synthetic
tgcttttactaaacccagttctatcaaagaaatgcagtcacaatcatctcatgttgttcataacgcagtacttaa

SEQ ID NO: 204047 - DNA, 75 bp, Artificial Sequence
  Synthetic
tgcttttactaaacccagttctatcaaagaaatgcagtcacaatcatctcatgttgttcataacgcagtagttaa

SEQ ID NO: 204048 - DNA, 75 bp, Artificial Sequence
  Synthetic
tgcttttactaaacccagttctatcaaagaaatgcagtcacaatcatctcatgttgttcacaacacagtaattaa

SEQ ID NO: 204049 - DNA, 75 bp, Artificial Sequence
  Synthetic
tgcttttactaaacccagttctatcaaagaaatgcagtcacaatcatctcatgttgttcacaacacagtatttaa

SEQ ID NO: 204050 - DNA, 75 bp, Artificial Sequence
  Synthetic
tgcttttactaaacccagttctatcaaagaaatgcagtcacaatcatctcatgttgttcacaacacagtacttaa

SEQ ID NO: 204051 - DNA, 75 bp, Artificial Sequence
  Synthetic
tgcttttactaaacccagttctatcaaagaaatgcagtcacaatcatctcatgttgttcacaacacagtagttaa

SEQ ID NO: 204052 - DNA, 75 bp, Artificial Sequence
  Synthetic
tgcttttactaaacccagttctatcaaagaaatgcagtcacaatcatctcatgttgttcacaactcagtaattaa

SEQ ID NO: 204053 - DNA, 75 bp, Artificial Sequence
  Synthetic
tgcttttactaaacccagttctatcaaagaaatgcagtcacaatcatctcatgttgttcacaactcagtatttaa

SEQ ID NO: 204054 - DNA, 75 bp, Artificial Sequence
  Synthetic
tgcttttactaaacccagttctatcaaagaaatgcagtcacaatcatctcatgttgttcacaactcagtacttaa

SEQ ID NO: 204055 - DNA, 75 bp, Artificial Sequence
  Synthetic
tgcttttactaaacccagttctatcaaagaaatgcagtcacaatcatctcatgttgttcacaactcagtagttaa

SEQ ID NO: 204056 - DNA, 75 bp, Artificial Sequence
  Synthetic
tgcttttactaaacccagttctatcaaagaaatgcagtcacaatcatctcatgttgttcacaacccagtaattaa

SEQ ID NO: 204057 - DNA, 75 bp, Artificial Sequence
  Synthetic
tgcttttactaaacccagttctatcaaagaaatgcagtcacaatcatctcatgttgttcacaacccagtatttaa

SEQ ID NO: 204058 - DNA, 75 bp, Artificial Sequence
  Synthetic
tgcttttactaaacccagttctatcaaagaaatgcagtcacaatcatctcatgttgttcacaacccagtacttaa

SEQ ID NO: 204059 - DNA, 75 bp, Artificial Sequence
  Synthetic
tgcttttactaaacccagttctatcaaagaaatgcagtcacaatcatctcatgttgttcacaacccagtagttaa

SEQ ID NO: 204060 - DNA, 75 bp, Artificial Sequence
  Synthetic
tgcttttactaaacccagttctatcaaagaaatgcagtcacaatcatctcatgttgttcacaacgcagtaattaa

SEQ ID NO: 204061 - DNA, 75 bp, Artificial Sequence
  Synthetic
tgcttttactaaacccagttctatcaaagaaatgcagtcacaatcatctcatgttgttcacaacgcagtatttaa

SEQ ID NO: 204062 - DNA, 75 bp, Artificial Sequence
  Synthetic
tgcttttactaaacccagttctatcaaagaaatgcagtcacaatcatctcatgttgttcacaacgcagtacttaa

SEQ ID NO: 204063 - DNA, 75 bp, Artificial Sequence
  Synthetic
tgcttttactaaacccagttctatcaaagaaatgcagtcacaatcatctcatgttgttcacaacgcagtagttaa

SEQ ID NO: 204064 - DNA, 75 bp, Artificial Sequence
  Synthetic
tgcttttactaaacccagttctatcaaagaaatgcagtcacaatcatctcatgttgttcagaacacagtaattaa

SEQ ID NO: 204065 - DNA, 75 bp, Artificial Sequence
  Synthetic
tgcttttactaaacccagttctatcaaagaaatgcagtcacaatcatctcatgttgttcagaacacagtatttaa

SEQ ID NO: 204066 - DNA, 75 bp, Artificial Sequence
  Synthetic
tgcttttactaaacccagttctatcaaagaaatgcagtcacaatcatctcatgttgttcagaacacagtacttaa

SEQ ID NO: 204067 - DNA, 75 bp, Artificial Sequence
  Synthetic
tgcttttactaaacccagttctatcaaagaaatgcagtcacaatcatctcatgttgttcagaacacagtagttaa

SEQ ID NO: 204068 - DNA, 75 bp, Artificial Sequence
  Synthetic
tgcttttactaaacccagttctatcaaagaaatgcagtcacaatcatctcatgttgttcagaactcagtaattaa

SEQ ID NO: 204069 - DNA, 75 bp, Artificial Sequence
  Synthetic
tgcttttactaaacccagttctatcaaagaaatgcagtcacaatcatctcatgttgttcagaactcagtatttaa

SEQ ID NO: 204070 - DNA, 75 bp, Artificial Sequence
  Synthetic
tgcttttactaaacccagttctatcaaagaaatgcagtcacaatcatctcatgttgttcagaactcagtacttaa

SEQ ID NO: 204071 - DNA, 75 bp, Artificial Sequence
  Synthetic
tgcttttactaaacccagttctatcaaagaaatgcagtcacaatcatctcatgttgttcagaactcagtagttaa

SEQ ID NO: 204072 - DNA, 75 bp, Artificial Sequence
  Synthetic
tgcttttactaaacccagttctatcaaagaaatgcagtcacaatcatctcatgttgttcagaacccagtaattaa

SEQ ID NO: 204073 - DNA, 75 bp, Artificial Sequence
  Synthetic
tgcttttactaaacccagttctatcaaagaaatgcagtcacaatcatctcatgttgttcagaacccagtatttaa

SEQ ID NO: 204074 - DNA, 75 bp, Artificial Sequence
  Synthetic
tgcttttactaaacccagttctatcaaagaaatgcagtcacaatcatctcatgttgttcagaacccagtacttaa

SEQ ID NO: 204075 - DNA, 75 bp, Artificial Sequence
  Synthetic
tgcttttactaaacccagttctatcaaagaaatgcagtcacaatcatctcatgttgttcagaacccagtagttaa

SEQ ID NO: 204076 - DNA, 75 bp, Artificial Sequence
  Synthetic
tgcttttactaaacccagttctatcaaagaaatgcagtcacaatcatctcatgttgttcagaacgcagtaattaa

SEQ ID NO: 204077 - DNA, 75 bp, Artificial Sequence
  Synthetic
tgcttttactaaacccagttctatcaaagaaatgcagtcacaatcatctcatgttgttcagaacgcagtatttaa

SEQ ID NO: 204078 - DNA, 75 bp, Artificial Sequence
  Synthetic
tgcttttactaaacccagttctatcaaagaaatgcagtcacaatcatctcatgttgttcagaacgcagtacttaa

SEQ ID NO: 204079 - DNA, 75 bp, Artificial Sequence
  Synthetic
tgcttttactaaacccagttctatcaaagaaatgcagtcacaatcatctcatgttgttcagaacgcagtagttaa

SEQ ID NO: 204080 - DNA, 75 bp, Artificial Sequence
  Synthetic
tgagtgctgctgaatttaaatacatggttgctaatggacttcatgcaccacatggaccttttgatgcactttggt

SEQ ID NO: 204081 - DNA, 75 bp, Artificial Sequence
  Synthetic
cactgtgcgtgagattgttgttgctagaactggtcagttttatattaatggttttaagtattttgatttgggttt

SEQ ID NO: 204082 - DNA, 75 bp, Artificial Sequence
  Synthetic
gcttttcttggtgcttctgttacagaagatgttaaatttgctgctagcactggtgttattgacattagtgctggt

SEQ ID NO: 204083 - DNA, 75 bp, Artificial Sequence
  Synthetic
cttaaagaatttttctatctatagatagagaattttcttatttagactttgtgtctactcttctcaactaaacga

SEQ ID NO: 204084 - DNA, 75 bp, Artificial Sequence
  Synthetic
attgtgttgatttacacaataagattaatctttgtgatgacccagaaaaagctcaaggtatgttgttagcactcc

SEQ ID NO: 204085 - DNA, 75 bp, Artificial Sequence
  Synthetic
ttcgtcaagtttgtaaactggttaggcaagtgttgtattttctgtgtctaagcactggtgattctgttcactagt

SEQ ID NO: 204086 - DNA, 75 bp, Artificial Sequence
  Synthetic
ttctcaacttattaaacaattgaagcgtgccatgaatatcgcaaagtctgaatttgatcatgagatatctgttca

SEQ ID NO: 204087 - DNA, 75 bp, Artificial Sequence
  Synthetic
tcggaaatttcaggttttggttttgccattccttctgtagccgttcgcacttatagcgaagccgctgcacaaggt

SEQ ID NO: 204088 - DNA, 75 bp, Artificial Sequence
  Synthetic
tggatatgtctagtgttgaaactgttttgaatttagcacgtgatggtgttgtgccattgtcagttatacccgcaa

SEQ ID NO: 204089 - DNA, 75 bp, Artificial Sequence
  Synthetic
tttgtggataagtatatgtgtggttttgatggtaaacctgtgttacctaaaaacatgtgggaatttagggattac

SEQ ID NO: 204090 - DNA, 75 bp, Artificial Sequence
  Synthetic
attatgctggagttgtttggacacttaatgatgttaaagacaatgatggtagacctgttcatgttaaagagatta

SEQ ID NO: 204091 - DNA, 75 bp, Artificial Sequence
  Synthetic
aacaaagcattattggtgccatgactgctgttaatgagtctagatatggcttgcaaaacttactacagttaccta

SEQ ID NO: 204092 - DNA, 75 bp, Artificial Sequence
  Synthetic
aacttttatgtacgcttatatttctaataaagctgaccttaaatttgttaagtgggagtatgagggtggttgcaa

SEQ ID NO: 204093 - DNA, 75 bp, Artificial Sequence
  Synthetic
gtgccacaattcgtctacaagctggtaaacaaactgaattggctgttaattctggacttttaactgcttgtgctt

SEQ ID NO: 204094 - DNA, 75 bp, Artificial Sequence
  Synthetic
gctaacaccaatcaagattcttatggtggagcgtctatttgtttgtattgtcgggcccacgttcctcaccctagt

SEQ ID NO: 204095 - DNA, 75 bp, Artificial Sequence
  Synthetic
aggtgtactaagtcggttatggaacacgagcaatccatgtataacctacttaacttttctggtgctttggctgag

SEQ ID NO: 204096 - DNA, 75 bp, Artificial Sequence
  Synthetic
gacgcttagcacagcagaagattaatgaatgtgtcaaatcacaatctaatagatatggtttttgtggcaatggca

SEQ ID NO: 204097 - DNA, 75 bp, Artificial Sequence
  Synthetic
ttgataattgtggtgagccatggtttttgactgattataatgctatcttgcagagtaataaccctcaatgtgcta

SEQ ID NO: 204098 - DNA, 75 bp, Artificial Sequence
  Synthetic
attataagtatgatgttaaaaattatgtacgttttccagaaattttagctagaggttttggcttacgtactatta

SEQ ID NO: 204099 - DNA, 75 bp, Artificial Sequence
  Synthetic
taattgtgccaaacgttttagacgtgttttggtaaaattgcttgatgtctataatggttttcttgaaactgtctg

SEQ ID NO: 204100 - DNA, 75 bp, Artificial Sequence
  Synthetic
taggttgacaatcactgaacttttgcaatttgttaccgacccttccttgataatagcttcttccccagcactcgt

SEQ ID NO: 204101 - DNA, 75 bp, Artificial Sequence
  Synthetic
gctgctgttaaagattttgacttttaccgttataataagcctaccattttagatatttgtcaagctagagttaca

SEQ ID NO: 204102 - DNA, 75 bp, Artificial Sequence
  Synthetic
gacacaactgaaccttaagtatgctattagtggtaaagaacgtgctagaactgttggtggtgtttctttgttgtc

SEQ ID NO: 204103 - DNA, 75 bp, Artificial Sequence
  Synthetic
tttatgatgaagagggtggttatgatgtttctaaaccagttatgatttcacaatggcctattagtgatgatagtg

SEQ ID NO: 204104 - DNA, 75 bp, Artificial Sequence
  Synthetic
ttttattttaagccaggtggtacgacttctggtgacgctagtacagcttatgctaattctatttttaacattttt

SEQ ID NO: 204105 - DNA, 75 bp, Artificial Sequence
  Synthetic
gtcattcattgatgattattatggttatcttaggaaacatttttcaatgatgattctctctgatgacggtgttgt

SEQ ID NO: 204106 - DNA, 75 bp, Artificial Sequence
  Synthetic
aaagatggtacctattatttgccttacccagatcctagtaggatcttgtcagctggtgtttttgttgatgatgtt

SEQ ID NO: 204107 - DNA, 75 bp, Artificial Sequence
  Synthetic
aaacactacttttgattttttaagtaatgcttctagttcttttgactgtatagttaatttgttatttacagaaca

SEQ ID NO: 204108 - DNA, 75 bp, Artificial Sequence
  Synthetic
taacatgatacgtatgatttcagccatggtgttgggttctaagcatgttaattgttgtactgcaacagataggtt

SEQ ID NO: 204109 - DNA, 75 bp, Artificial Sequence
  Synthetic
agtatgtatgaaaattctacaatattgcaagctgctggcttatgtgttgtttgtggttcacaaactgttcttcgt

SEQ ID NO: 204110 - DNA, 75 bp, Artificial Sequence
  Synthetic
ctaatggtttcccttttaataattggtttttgttaactaatggttccacactagtggacggggtctctagacttt

SEQ ID NO: 204111 - DNA, 75 bp, Artificial Sequence
  Synthetic
gtaaaatttttggctgaccattttaactataatgtttcagtattacaaatggatgttcagggtttagttaatgtt

SEQ ID NO: 204112 - DNA, 75 bp, Artificial Sequence
  Synthetic
tgccaaggctcctaaacgtacaggtgttattttgacacgtagttttaagtataacattagatctgctttgtttgt

SEQ ID NO: 204113 - DNA, 75 bp, Artificial Sequence
  Synthetic
cagggttcgtatgagcgttttacgcttactacgaacgctgttttattttctactgttgtcattaaaaatttaaca

SEQ ID NO: 204114 - DNA, 75 bp, Artificial Sequence
  Synthetic
tgatactgttacgtataagtctactgtaactactaagttagttcctggtatgatttttgtcttaacatctcacaa

SEQ ID NO: 204115 - DNA, 75 bp, Artificial Sequence
  Synthetic
tggtaacacttcagtgtgtgttagaacatctcatttttcaattaggtatatttataaccgcgttaagagtggttc

SEQ ID NO: 204116 - DNA, 75 bp, Artificial Sequence
  Synthetic
gtaaacaaaagataactacaatacagggtcctcctggtagtggtaagtcacattgttccattggacttggattgt

SEQ ID NO: 204117 - DNA, 75 bp, Artificial Sequence
  Synthetic
cgtttatcatataaacatattgtttatgttggtgatccacaacaacttcctgcacctagagtaatgattactaaa

SEQ ID NO: 204118 - DNA, 75 bp, Artificial Sequence
  Synthetic
acgttgttactcaacgtatgtgtgctataggccctgatgtttttcttcataaatgttatagatgtcctgctgaaa

SEQ ID NO: 204119 - DNA, 75 bp, Artificial Sequence
  Synthetic
aacattggtaatcctaaaggtgtacattgtgctgttactgatgccaaatggtactgtttatgacaagcaacctgt

SEQ ID NO: 204120 - DNA, 75 bp, Artificial Sequence
  Synthetic
aacattggtaatcctaaaggtgtactttgtgctgttactgatgccaaatggtactgtttatgacaagcaacctgt

SEQ ID NO: 204121 - DNA, 75 bp, Artificial Sequence
  Synthetic
aacattggtaatcctaaaggtgtaccttgtgctgttactgatgccaaatggtactgtttatgacaagcaacctgt

SEQ ID NO: 204122 - DNA, 75 bp, Artificial Sequence
  Synthetic
aacattggtaatcctaaaggtgtacgttgtgctgttactgatgccaaatggtactgtttatgacaagcaacctgt

SEQ ID NO: 204123 - DNA, 75 bp, Artificial Sequence
  Synthetic
tacattggtaatcctaaaggtgtacattgtgctgttactgatgccaaatggtactgtttatgacaagcaacctgt

SEQ ID NO: 204124 - DNA, 75 bp, Artificial Sequence
  Synthetic
tacattggtaatcctaaaggtgtactttgtgctgttactgatgccaaatggtactgtttatgacaagcaacctgt

SEQ ID NO: 204125 - DNA, 75 bp, Artificial Sequence
  Synthetic
tacattggtaatcctaaaggtgtaccttgtgctgttactgatgccaaatggtactgtttatgacaagcaacctgt

SEQ ID NO: 204126 - DNA, 75 bp, Artificial Sequence
  Synthetic
tacattggtaatcctaaaggtgtacgttgtgctgttactgatgccaaatggtactgtttatgacaagcaacctgt

SEQ ID NO: 204127 - DNA, 75 bp, Artificial Sequence
  Synthetic
cacattggtaatcctaaaggtgtacattgtgctgttactgatgccaaatggtactgtttatgacaagcaacctgt

SEQ ID NO: 204128 - DNA, 75 bp, Artificial Sequence
  Synthetic
cacattggtaatcctaaaggtgtactttgtgctgttactgatgccaaatggtactgtttatgacaagcaacctgt

SEQ ID NO: 204129 - DNA, 75 bp, Artificial Sequence
  Synthetic
cacattggtaatcctaaaggtgtaccttgtgctgttactgatgccaaatggtactgtttatgacaagcaacctgt

SEQ ID NO: 204130 - DNA, 75 bp, Artificial Sequence
  Synthetic
cacattggtaatcctaaaggtgtacgttgtgctgttactgatgccaaatggtactgtttatgacaagcaacctgt

SEQ ID NO: 204131 - DNA, 75 bp, Artificial Sequence
  Synthetic
gacattggtaatcctaaaggtgtacattgtgctgttactgatgccaaatggtactgtttatgacaagcaacctgt

SEQ ID NO: 204132 - DNA, 75 bp, Artificial Sequence
  Synthetic
gacattggtaatcctaaaggtgtactttgtgctgttactgatgccaaatggtactgtttatgacaagcaacctgt

SEQ ID NO: 204133 - DNA, 75 bp, Artificial Sequence
  Synthetic
gacattggtaatcctaaaggtgtaccttgtgctgttactgatgccaaatggtactgtttatgacaagcaacctgt

SEQ ID NO: 204134 - DNA, 75 bp, Artificial Sequence
  Synthetic
gacattggtaatcctaaaggtgtacgttgtgctgttactgatgccaaatggtactgtttatgacaagcaacctgt

SEQ ID NO: 204135 - DNA, 75 bp, Artificial Sequence
  Synthetic
ggttgacaatggctctagtattaacagaaagcagcttgaaatagttaagctgtttttagttaaaaatccaagttg

SEQ ID NO: 204136 - DNA, 75 bp, Artificial Sequence
  Synthetic
gtttgattcacttaagttttttgagattaaacatgcagatttacactctagccaggtttgtggcttgtttaaaaa

SEQ ID NO: 204137 - DNA, 75 bp, Artificial Sequence
  Synthetic
gacacaactttgaggtgttgcactgttacttatcctaatgaacttagttcaaaagttgtttgtacttatatggat

SEQ ID NO: 204138 - DNA, 75 bp, Artificial Sequence
  Synthetic
ttacttatcctaatgaacttagttcaaaagttgtttgtacttatatggatttgttggtggacgactttgttttta

SEQ ID NO: 204139 - DNA, 75 bp, Artificial Sequence
  Synthetic
aaccactgttcttattgattatgatcatgcatatagtactatgcgtttgcataatttttcagtgtctcataatgg

SEQ ID NO: 204140 - DNA, 75 bp, Artificial Sequence
  Synthetic
ccaattttggtgatgttattaaacctgtttgtgcaaaatctccaccaggtgaacaatttagacaccttgttcctc

SEQ ID NO: 204141 - DNA, 75 bp, Artificial Sequence
  Synthetic
taactcttcaactattgtcacaggtttgttgccagtccattggatttgtgctaatcagagcacatctagttaccc

SEQ ID NO: 204142 - DNA, 75 bp, Artificial Sequence
  Synthetic
tcactctgaagatttgtaagtttggaaacacttcttttgattttttaagtaatgtttctacttctcatcattgta

SEQ ID NO: 204143 - DNA, 75 bp, Artificial Sequence
  Synthetic
ggtggtgctgtttgttcaaaacatgcaaatttgtatcaaaaatatgttgaggcatataatacatttacacaggct

SEQ ID NO: 204144 - DNA, 75 bp, Artificial Sequence
  Synthetic
gctatggcgatgttgacaacttggtttttacaaataaaacaacattgcctactaatgttgcttttgaattgtttg

SEQ ID NO: 204145 - DNA, 75 bp, Artificial Sequence
  Synthetic
ggtgttgttgctacatataaatttgttttatgggattatgaagctgaaagaccttttacctcatataccaagagt

SEQ ID NO: 204146 - DNA, 75 bp, Artificial Sequence
  Synthetic
gtaatgtcgttcctggtgatgtgatcatcacctcaactagtgctggttgtggtgttaaatactatgctggcttag

SEQ ID NO: 204147 - DNA, 75 bp, Artificial Sequence
  Synthetic
atttacggctatgttctgcgtcaacctaacttggttctttattctgataatggtgtctttcgtgtaacttccagg

SEQ ID NO: 204148 - DNA, 75 bp, Artificial Sequence
  Synthetic
atgcattgtttaacttcatcaatgcgaggttgttgtgattgtggttcaactaaacttccttattacgaatttgaa

SEQ ID NO: 204149 - DNA, 75 bp, Artificial Sequence
  Synthetic
ttgcattgtttaacttcatcaatgcgaggttgttgtgattgtggttcaactaaacttccttattacgaatttgaa

SEQ ID NO: 204150 - DNA, 75 bp, Artificial Sequence
  Synthetic
ctgcattgtttaacttcatcaatgcgaggttgttgtgattgtggttcaactaaacttccttattacgaatttgaa

SEQ ID NO: 204151 - DNA, 75 bp, Artificial Sequence
  Synthetic
gtgcattgtttaacttcatcaatgcgaggttgttgtgattgtggttcaactaaacttccttattacgaatttgaa

SEQ ID NO: 204152 - DNA, 75 bp, Artificial Sequence
  Synthetic
tgattctctctgatgacggtgttgtctgttataacaaggattatgctgagttaggttatatagcagacattagtg

SEQ ID NO: 204153 - DNA, 75 bp, Artificial Sequence
  Synthetic
attctatttttaacatttttcaagccgtgagttctaacattaacaggttgcttagtgtcccatcagattcatgta

SEQ ID NO: 204154 - DNA, 75 bp, Artificial Sequence
  Synthetic
aggttaactagtgttgaagagtcattcattgatgattattatggttatcttaggaaacatttttcaatgatgatt

SEQ ID NO: 204155 - DNA, 75 bp, Artificial Sequence
  Synthetic
actgttttaaaacgttggctaccacctgatgcaataatcattgataatgatatcaatgattatgttagtgatgca

SEQ ID NO: 204156 - DNA, 75 bp, Artificial Sequence
  Synthetic
tatcaatgattatgttagtgatgcagattttagcattacaggtgattgtgctactgtttaccttgaagataagtt

SEQ ID NO: 204157 - DNA, 75 bp, Artificial Sequence
  Synthetic
agagaaaaattagctattggtggtagtgttgccattaagattacagaatatagttggaataagtatctttatgaa

SEQ ID NO: 204158 - DNA, 75 bp, Artificial Sequence
  Synthetic
caactcagctccagatggtttgctttttcttcatactgttttgctgccaaccgactacaagaatgtaaaggcgtg

SEQ ID NO: 204159 - DNA, 75 bp, Artificial Sequence
  Synthetic
cactgttcatgctaattatatattttggcgtaattctactattatgtctttgtcatacaattcagttttagattt

SEQ ID NO: 204160 - DNA, 75 bp, Artificial Sequence
  Synthetic
gtttgattcacttaagttttttgagattaaacatgcagacttacattctagccaggtttgtggcttgtttaaaaa

SEQ ID NO: 204161 - DNA, 75 bp, Artificial Sequence
  Synthetic
ttgttacgcaataatggttgttttggtggttttagtaatcatttagtctcaactaaatgaaacttttcttgattt

SEQ ID NO: 204162 - DNA, 75 bp, Artificial Sequence
  Synthetic
gtggttttagtaatcatttagtctcaactaaatgaaacttttcttgattttgcttgttttgcccctggcctcttg

SEQ ID NO: 204163 - DNA, 75 bp, Artificial Sequence
  Synthetic
atgatgctaatcagtattatatttatgttactaatgaaataggcttaaatgcttctgttactcttaagatttgta

SEQ ID NO: 204164 - DNA, 75 bp, Artificial Sequence
  Synthetic
tttaagtaatgcttctagttcttttgactgtatagttaatttgttatttacagaacagttaggtgcgcctttggg

SEQ ID NO: 204165 - DNA, 75 bp, Artificial Sequence
  Synthetic
gactgtatagttaatttgttatttacagaacagttaggtgcgcctttgggcataactatatctggtgaaactgta

SEQ ID NO: 204166 - DNA, 75 bp, Artificial Sequence
  Synthetic
cgtctgcatttatataatgtaactcgtactttttatgtgccagcagcttataaacttactaaacttagtgttaaa

SEQ ID NO: 204167 - DNA, 75 bp, Artificial Sequence
  Synthetic
aacctgttaatagtaatgtcaagttgttggattatgattatgcaacccatggtcaacttgatggtctttgtctat

SEQ ID NO: 204168 - DNA, 75 bp, Artificial Sequence
  Synthetic
ataattggtttttgttaactaatggttccacactagtggatggagtctctagactttatcaaccactccgtttaa

SEQ ID NO: 204169 - DNA, 75 bp, Artificial Sequence
  Synthetic
agactttatcaaccactccgtttaacttgtttatggcctgtacctggtcttaaatcttcaactggttttgtttat

SEQ ID NO: 204170 - DNA, 75 bp, Artificial Sequence
  Synthetic
cttgtttatggcctgtacctggtcttaaatcttcaactggttttgtttattttaatgccactggttctgatgtta

SEQ ID NO: 204171 - DNA, 75 bp, Artificial Sequence
  Synthetic
caggtgttcttgacaccacaataccttttggcccttcctctcaaccttattactgttttataaacagtactatca

SEQ ID NO: 204172 - DNA, 75 bp, Artificial Sequence
  Synthetic
tactgttttataaacagtactatcaacactactcatgttagcacttttgtgggtattttaccacccactgtgcgt

SEQ ID NO: 204173 - DNA, 75 bp, Artificial Sequence
  Synthetic
acactactcatgttagcacttttgtgggtattttaccacccactgtgcgtgaaattgttgttgctagaactggtc

SEQ ID NO: 204174 - DNA, 75 bp, Artificial Sequence
  Synthetic
gggtattttaccacccactgtgcgtgaaattgttgttgctagaactggtcagttttatattaatggttttaagta

SEQ ID NO: 204175 - DNA, 75 bp, Artificial Sequence
  Synthetic
tttcgatttgggtttcatagaagctgtcaattttaatgtcacgactgctagtgccacagatttttggacggttgc

SEQ ID NO: 204176 - DNA, 75 bp, Artificial Sequence
  Synthetic
tggacaatctcaagagtggtgttatagtttttaaaactttacagtacgatgttttgttttattgtagtaattctt

SEQ ID NO: 204177 - DNA, 75 bp, Artificial Sequence
  Synthetic
ctagtgccacagatttttggacggttgcatttgctacttttgttgatgttttggttaatgttagtgcaactaaca

SEQ ID NO: 204178 - DNA, 75 bp, Artificial Sequence
  Synthetic
gcacatttatttaaagagtggcacttgtccattttctttttctaagttaaataattttcaaaagtttaagactat

SEQ ID NO: 204179 - DNA, 75 bp, Artificial Sequence
  Synthetic
tttgtggcaacatcttcttatgatgcactcttgcatagaaattcattagaccctttttgctttgatgttaacact

SEQ ID NO: 204180 - DNA, 75 bp, Artificial Sequence
  Synthetic
tatgtagttattagtggttttgtaagtcgtgtaattcgtagagaaaggtgtgacgtgacttttccttgtgttagt

SEQ ID NO: 204181 - DNA, 75 bp, Artificial Sequence
  Synthetic
ctgtcttatctgtagctccagaagttgactgggttgctttttacggttttgaaaaggcagcactttttgcttctt

SEQ ID NO: 204182 - DNA, 75 bp, Artificial Sequence
  Synthetic
caggttcttttgataacggtcactatgtagtttaagatgctgctaataatgctgtctatgatggtgctcgtttat

SEQ ID NO: 204183 - DNA, 75 bp, Artificial Sequence
  Synthetic
ttttttatttcttatgctaaacctgaagataagttgtccgtttatgatattgcttgttgtatgcgtgccggttct

SEQ ID NO: 204184 - DNA, 75 bp, Artificial Sequence
  Synthetic
tacctaatgtttttaagttaaaaatctctactcaattgtttgaaggtgataagtttataggtacttttgagagtg

SEQ ID NO: 204185 - DNA, 75 bp, Artificial Sequence
  Synthetic
tgttatattctccacctaccattagctacaattccaccttacaatctggtcttaagaagatggcacaaccatctg

SEQ ID NO: 204186 - DNA, 75 bp, Artificial Sequence
  Synthetic
gtgcaaaatctccaccaggtgaacaatttagacaccttgttcctcttttacgtaaaggacaaccttggttaattg

SEQ ID NO: 204187 - DNA, 75 bp, Artificial Sequence
  Synthetic
aaatgtttcattcttgggtaagtgtttgaagatgaactgtgttcgttttaaaaatgctgatcttaaggatggtta

SEQ ID NO: 204188 - DNA, 75 bp, Artificial Sequence
  Synthetic
tagttgacaaagatggtacctattatttgccttatccagatcctagtaggatcttgtcagctggtgtttttgttg

SEQ ID NO: 204189 - DNA, 75 bp, Artificial Sequence
  Synthetic
gagtctagatatggcttgcaaaacttactacagttacctaacttttattatgttagtaatggtggtaacaattgc

SEQ ID NO: 204190 - DNA, 75 bp, Artificial Sequence
  Synthetic
tgtccaatttgtctgacattattgtctttgttttgtgggcaggtagtttggaattaagtacaatgcgttactttg

SEQ ID NO: 204191 - DNA, 75 bp, Artificial Sequence
  Synthetic
atcaatggctgtgggcgtaatgtccagggacatgttgttcgtgcagccttgaaattgtataaacaaagtgttatt

SEQ ID NO: 204192 - DNA, 75 bp, Artificial Sequence
  Synthetic
ttttagtaatcatttagtctcaactaaatgaaacttttcttgattttgcttattttgcccctggtttcttgctct

SEQ ID NO: 204193 - DNA, 75 bp, Artificial Sequence
  Synthetic
tctgatgttaattgtaatggttatcaacatcattctgtttgctgatgttatgcgttacaatcttaacttcagttc

SEQ ID NO: 204194 - DNA, 75 bp, Artificial Sequence
  Synthetic
tcttttggtggttcttgttatgtttgcaaaccacatcaggttaatatatctcttaatggtaatacttcagtgtct

SEQ ID NO: 204195 - DNA, 75 bp, Artificial Sequence
  Synthetic
catgtttcaacctcgtttacctgtttcgtccgattttgtgcaaatatataattgtaatgttacttttgttaacat

SEQ ID NO: 204196 - DNA, 75 bp, Artificial Sequence
  Synthetic
ttcatagaaacgagcatgatgcctctggtgatgctgttatgacacgttgtttggcagtacatgattgttttgtca

SEQ ID NO: 204197 - DNA, 75 bp, Artificial Sequence
  Synthetic
taagtggtgttctgtcactgcttattgtggaagcaacgttctgtcgttgtggaaaccaataactgctaaccatgt

SEQ ID NO: 204198 - DNA, 75 bp, Artificial Sequence
  Synthetic
taactttcgatagcaatgcttttagtttggctaatgttactagttttggagattataacctttctagtgttttac

SEQ ID NO: 204199 - DNA, 75 bp, Artificial Sequence
  Synthetic
gggctgataagccttctcagttgaagaaacctcgttggaagcgtgttcctaccagagaggaaaatgttattcagt

SEQ ID NO: 204200 - DNA, 75 bp, Artificial Sequence
  Synthetic
catctggtttgggtactgttgatgttgactataagtcttgtactaaaggtctttctattgctgaccttgcttgtg

SEQ ID NO: 204201 - DNA, 75 bp, Artificial Sequence
  Synthetic
acttccagggtcatgtttcaacctcgcttacctgttttgtctgattttgtgcaaatatataattgtaatgttact

SEQ ID NO: 204202 - DNA, 75 bp, Artificial Sequence
  Synthetic
acgtaaagacctttcttatgaacagcaaaatgttttagccattgagagcattcattatcttggtactacaggtca

SEQ ID NO: 204203 - DNA, 75 bp, Artificial Sequence
  Synthetic
tatcacctcaactgatgctggttgtggtgttaaatactatgctggcttagttgtcaaacacattattaacattac

SEQ ID NO: 204204 - DNA, 75 bp, Artificial Sequence
  Synthetic
caacatcttcttatgatgcacttttgcatagaaattcattagaccctttttgctttgatgttaacactttacttt

SEQ ID NO: 204205 - DNA, 75 bp, Artificial Sequence
  Synthetic
tgggtaagtgtttgaagatgaactgtgttcgttttaaaaatgctgatcttaaggatggttattttgttataaaga

SEQ ID NO: 204206 - DNA, 75 bp, Artificial Sequence
  Synthetic
acatcaggttaatatatctcttaatggtaatacttcagtgtgtgttagaacatctcatttttcaattaggtatat

SEQ ID NO: 204207 - DNA, 75 bp, Artificial Sequence
  Synthetic
ttcaatcgtcaactcagctccagatggtttgctttttcttcatactgttttgctgccaactgattacaagaatgt

SEQ ID NO: 204208 - DNA, 75 bp, Artificial Sequence
  Synthetic
aattctccaatggaaagagttagtctctggaattatgggaagccagttactttgcctacaggctgtatgatgaat

SEQ ID NO: 204209 - DNA, 75 bp, Artificial Sequence
  Synthetic
tcccctgtattaggttgtctaggcagcgaatgtagtaaagcttccagtagatctgctatagaggatttacttttt

SEQ ID NO: 204210 - DNA, 75 bp, Artificial Sequence
  Synthetic
tactagcaccacggatgatgtttgcaatagtattgccaatggacaagaggaggcatcagaagtcttagatatagt

SEQ ID NO: 204211 - DNA, 75 bp, Artificial Sequence
  Synthetic
aacgcgtagaactatggcattgggatacaggtgttgtttcctgtttatataagcgtaatttcacatatgatgtga

SEQ ID NO: 204212 - DNA, 75 bp, Artificial Sequence
  Synthetic
tcatagtggtgtttatattcatttctgctgttaacagctttcagccagggacgtgttgtatcctaggcagtggcc

SEQ ID NO: 204213 - DNA, 75 bp, Artificial Sequence
  Synthetic
gttgttatagtggtcgtgtatctgcggcctttcatgctaattcctctgaaccagcattgttattcaggaatgtta

SEQ ID NO: 204214 - DNA, 75 bp, Artificial Sequence
  Synthetic
gtgaagcagatgttgtatctgcggattctgatggttttgtgcatgatcacatagatgttgttgattatgataccg

SEQ ID NO: 204215 - DNA, 75 bp, Artificial Sequence
  Synthetic
ggcctttcatgctaattcctctgaaccagcattgttattcaggaatgttaaatgcaactacgtttttaataatac

SEQ ID NO: 204216 - DNA, 75 bp, Artificial Sequence
  Synthetic
gcgacttattataatagttggcagaacctcttatatgattctaatggtaatctctatggtttcagggattattta

SEQ ID NO: 204217 - DNA, 75 bp, Artificial Sequence
  Synthetic
ttatgctatacataaggaacctgcttttattaaggttcttggtgtgtatgtgcctaaagcaactcgcaacaattg

SEQ ID NO: 204218 - DNA, 75 bp, Artificial Sequence
  Synthetic
aattattttgatagttaccttggttgtgttgttaatgctgacaatagtacttctattgctgtccaaacatgtgat

SEQ ID NO: 204219 - DNA, 75 bp, Artificial Sequence
  Synthetic
gtgttgttaatgctgacaatagtacttctattgctgtccaaacatgtgatctcacagtaggtagtggttattgtt

SEQ ID NO: 204220 - DNA, 75 bp, Artificial Sequence
  Synthetic
cgtgcaaggacctcctggtacagggaagtcacatcttgctattggtcttgctgtattttattgtacagcacgtgt

SEQ ID NO: 204221 - DNA, 75 bp, Artificial Sequence
  Synthetic
aagctggaaacagacggaatttgtcctgaaaatcatgtgatggtggattgtcgccgacttcttaaacaagagtgt

SEQ ID NO: 204222 - DNA, 75 bp, Artificial Sequence
  Synthetic
aggataaaaatttgcagagtttgtggttgtcctataaacaacattttgatcagttgtttatagacactattatgc

SEQ ID NO: 204223 - DNA, 75 bp, Artificial Sequence
  Synthetic
tttattaaggttcttggtgtgtatgtgcctaaagcaactcgcaacaattgttggttgcggtctgttttgacagtt

SEQ ID NO: 204224 - DNA, 75 bp, Artificial Sequence
  Synthetic
gttgtcctataaacaacattttgatcagttgtttatagacactattatgcagaagctacctgcaaacatagttgt

SEQ ID NO: 204225 - DNA, 75 bp, Artificial Sequence
  Synthetic
aaattgttatgaatgcaagtccatatgatttggaggtgctacttcaagatgctttgcagtcccgtgaagcagttt

SEQ ID NO: 204226 - DNA, 75 bp, Artificial Sequence
  Synthetic
catatggcacatggtggtggtgttgcaaaggctattgcagtagcagctggacagcagtttgttaaagagactacc

SEQ ID NO: 204227 - DNA, 75 bp, Artificial Sequence
  Synthetic
tttgcttattggctgtttactttgtgtgagtggcaagcgacatctcattggaggtgtcttaaatgtgatatggca

SEQ ID NO: 204228 - DNA, 75 bp, Artificial Sequence
  Synthetic
tgttcttttatggagatatagtgtcacatgtctgtaagtgtggagaacctatggttcttcttaaagttaatgtgc

SEQ ID NO: 204229 - DNA, 75 bp, Artificial Sequence
  Synthetic
ggttgaatatggtagtttttgtgataacataaatgccatactcacagaagtaaatgagttatttgacactacaca

SEQ ID NO: 204230 - DNA, 75 bp, Artificial Sequence
  Synthetic
aacataaatgccatactcacagaagtaaatgagttatttgacactacacagctgcaagttgctaatagtttaatg

SEQ ID NO: 204231 - DNA, 75 bp, Artificial Sequence
  Synthetic
tggtgcaggtcaattcgtgggttgggtcatacccttagcctttatgcctgtgcaatcccggaaatttattgttcc

SEQ ID NO: 204232 - DNA, 75 bp, Artificial Sequence
  Synthetic
agacaagcagttttgtgcttttacgactcaacgtcgtatttttaaggctgcttgtgttattgataaaaatgaccg

SEQ ID NO: 204233 - DNA, 75 bp, Artificial Sequence
  Synthetic
taaaagatggcgttaatttcaatgtagatgacatcaacttttcccctgtattaggttgtttaggaagtgattgta

SEQ ID NO: 204234 - DNA, 75 bp, Artificial Sequence
  Synthetic
gtcatacccttagcctttatgcctgtgcaatcccggaaatttattgttccatgggttatgtacttgcgtaagcgt

SEQ ID NO: 204235 - DNA, 75 bp, Artificial Sequence
  Synthetic
actcaacgtcgtatttttaaggctgcttgtgttattgataaaaatgaccgtcattcaatggctgtcattgatggt

SEQ ID NO: 204236 - DNA, 75 bp, Artificial Sequence
  Synthetic
atcatggacgtggcggttttggacatgtttatgattttaaagttgaagatgcttatgaccaggtgcatgatgagc

SEQ ID NO: 204237 - DNA, 75 bp, Artificial Sequence
  Synthetic
ctgatattaacagtgctaagtttgattttattattgggcatgagatgacatttaatatgtcgtcatttgaaattg

SEQ ID NO: 204238 - DNA, 75 bp, Artificial Sequence
  Synthetic
aaattgtctgatgtcggttttgttgaggcttataataattgcactggaggtgctgaaattagggacctcctttgt

SEQ ID NO: 204239 - DNA, 75 bp, Artificial Sequence
  Synthetic
ttttattattgggcatgagatgacatttaatatgtcgtcatttgaaattgcccagttgtatggttgttgtataac

SEQ ID NO: 204240 - DNA, 75 bp, Artificial Sequence
  Synthetic
tctttcttttaatgtagggcgttctatcgtttacgaaacagatgctaataagttgattttaagcaatgacgttgc

SEQ ID NO: 204241 - DNA, 75 bp, Artificial Sequence
  Synthetic
gatgtgataagaattgctcagcttgtatatgctgatgttgttgtaaacccagccaatggtcatatggctcatggt

SEQ ID NO: 204242 - DNA, 75 bp, Artificial Sequence
  Synthetic
catgatgttgtttatgcacaacattgttttaaagctccctcaaatttctgtccgtgtaaattggatgggtctttg

SEQ ID NO: 204243 - DNA, 75 bp, Artificial Sequence
  Synthetic
tcagattagtggttacactttggctgccacctccgctagcttgtttccaccgtggacagcagcggcaggtgtccc

SEQ ID NO: 204244 - DNA, 75 bp, Artificial Sequence
  Synthetic
caggatgttttatccttaagacatgatatagcacttgatgatgatgcacgaacctttgttcagagcaatgttgat

SEQ ID NO: 204245 - DNA, 75 bp, Artificial Sequence
  Synthetic
agtatcgtattaatgggcttggtgtcaccatggatgtgctaagtcaaaatcaaaagcttattgctaatgcattta

SEQ ID NO: 204246 - DNA, 75 bp, Artificial Sequence
  Synthetic
tcaggaactcctttttgatgtaattgtggcatggcatgttgtgcgtgatccacgttatgttatgagattgcagag

SEQ ID NO: 204247 - DNA, 75 bp, Artificial Sequence
  Synthetic
ggagactgccaatatggttaaatctaaaggagtttgcgctactggtgattgttatgtttcatcaggtggcaaatt

SEQ ID NO: 204248 - DNA, 75 bp, Artificial Sequence
  Synthetic
atgttctaagccaaaaccaaaagcttattgctaatgcatttaacaacgctttgacagccattcagaatgggtttg

SEQ ID NO: 204249 - DNA, 75 bp, Artificial Sequence
  Synthetic
tatatgctgatgttgttgtaaacccagccaatggtcatatggctcatggtggtggtgttgcaaaagctatagcta

SEQ ID NO: 204250 - DNA, 75 bp, Artificial Sequence
  Synthetic
gccacctccgctagcttgtttccaccgtggacagcagcggcaggtgtcccattttatttaaatgttcagtatcgt

SEQ ID NO: 204251 - DNA, 75 bp, Artificial Sequence
  Synthetic
ccttacaagtgcccccaaactaaatacttagttggcataggtgagcactgttcgggtcttgctattaaaagtgat

SEQ ID NO: 204252 - DNA, 75 bp, Artificial Sequence
  Synthetic
tgtttatgaattgcgctataatggcgcaattagatttgatagtacactttcaggttttgagaccataatgaaggt

SEQ ID NO: 204253 - DNA, 75 bp, Artificial Sequence
  Synthetic
gctgaagctcttaataagttattgcaacaactatctaatagatttggtgccataagtgcctctttacaagaaatt

SEQ ID NO: 204254 - DNA, 75 bp, Artificial Sequence
  Synthetic
gtttggccgtttatgattgtttttgcaataatattaattggaatgtggagtatcccatcatttcaaatgagttaa

SEQ ID NO: 204255 - DNA, 75 bp, Artificial Sequence
  Synthetic
tgtgtaatggttctgttgttataaaagaacctgtgcatgtttatgcagatgactctattattttacgtcaatata

SEQ ID NO: 204256 - DNA, 75 bp, Artificial Sequence
  Synthetic
ggtgttgtagaaaaacaagttattcttgttagcaataacaaagaagattttgatataatttctaagtgtcagata

SEQ ID NO: 204257 - DNA, 75 bp, Artificial Sequence
  Synthetic
ttttggataaagtggacatcttgctaactgttgatggtgttaatttcactaacaggtttgtgcctgtaggtgaaa

SEQ ID NO: 204258 - DNA, 75 bp, Artificial Sequence
  Synthetic
ttgttagcaataacaaagaagattttgatataatttctaagtgtcagataacggctgtagagggcactagaaaat

SEQ ID NO: 204259 - DNA, 75 bp, Artificial Sequence
  Synthetic
acagagcgcttgaaattgtttgctgcagaaacgcaaaaggcaactgaggaagcctttaagcagagttatgcatca

SEQ ID NO: 204260 - DNA, 75 bp, Artificial Sequence
  Synthetic
gacatataagcaccttaacaagtatgattgtagtatcactacactcatttcagctggcatatttagtgtgccctc

SEQ ID NO: 204261 - DNA, 75 bp, Artificial Sequence
  Synthetic
agggcgccatgttaaatatgaaacagatgctaataaattgcttattagcagtgacgtagtatttgtttctacttt

SEQ ID NO: 204262 - DNA, 75 bp, Artificial Sequence
  Synthetic
tcatattatatcattagtgcagaatgctccttatggtttgtattttatccactttaactatgtccccaccaagta

SEQ ID NO: 204263 - DNA, 75 bp, Artificial Sequence
  Synthetic
ttcccgagaatgatgatgatgcttggtttaagctatcgtaccattatgaaaacaattcttggttcttccgacatg

SEQ ID NO: 204264 - DNA, 75 bp, Artificial Sequence
  Synthetic
attcttttactctgtatggccaaactgtagtttattttggaggttgtgtgtattggagtccagcacgtaatatat

SEQ ID NO: 204265 - DNA, 75 bp, Artificial Sequence
  Synthetic
tgtagtttattttggaggttgtgtgtattggagtccagcacgtaatatatggattcctatattaaaatcctctgt

SEQ ID NO: 204266 - DNA, 75 bp, Artificial Sequence
  Synthetic
ttttgtgaatagtatcaggttgtttattagaactggaagtttttggagtttcaacccagaaacaaacaacttgat

SEQ ID NO: 204267 - DNA, 75 bp, Artificial Sequence
  Synthetic
ctgtgcattgctggtgatagaggtatagctcctaagagtggttattttgttaatgtaaataatacttggatgttc

SEQ ID NO: 204268 - DNA, 75 bp, Artificial Sequence
  Synthetic
tcaacccagaaacaaacaacttgatgtgtatagatatgaaaggaacaatgtatgttaggccgataattgaggact

SEQ ID NO: 204269 - DNA, 75 bp, Artificial Sequence
  Synthetic
actggagttttaggttgcaaggctattgtaaaggaaacaaatctcatttgcaaagctttgtaccttgattatgtt

SEQ ID NO: 204270 - DNA, 75 bp, Artificial Sequence
  Synthetic
atgatgcgcgtgtttttgtgcagtcaaatatggagaatttgcctgcagattggcgcatagttaataaatttgatc

SEQ ID NO: 204271 - DNA, 75 bp, Artificial Sequence
  Synthetic
gatgtttgcagccagggtaaagagtttggttatgtacagcaaggttctttttataaggccactgttagccaaatt

SEQ ID NO: 204272 - DNA, 75 bp, Artificial Sequence
  Synthetic
aatttaaaattgttcaatggcaggaggcgtggcttgaatttcgttctggccgccctgctagatttgtatctttgg

SEQ ID NO: 204273 - DNA, 75 bp, Artificial Sequence
  Synthetic
aaatatggagaatttgcctgcagattggcgcatagttaataaatttgatcagattaatggtgttagaaccattaa

SEQ ID NO: 204274 - DNA, 75 bp, Artificial Sequence
  Synthetic
taatttcaccactcgatatgtgccgtgtggtgaagtttttggcaaaacattaggtaatgtattttgtgatgctat

SEQ ID NO: 204275 - DNA, 75 bp, Artificial Sequence
  Synthetic
atattcagcctgaagactacagaagtgttgatgttgctattcaagaagttattgatgacatgcattggggtgagg

SEQ ID NO: 204276 - DNA, 75 bp, Artificial Sequence
  Synthetic
tagagaatattgattattttaatatgcggcgcgctaaatttagtttagaaacttttactgtttgtgcagatggct

SEQ ID NO: 204277 - DNA, 75 bp, Artificial Sequence
  Synthetic
ttggttatgtacagcaaggttctttttataaggccactgttagccaaattaaggctttgtttgttgataaaatag

SEQ ID NO: 204278 - DNA, 75 bp, Artificial Sequence
  Synthetic
tgtggtgaagtttttggcaaaacattaggtaatgtattttgtgatgctattaatgttactaaatgtaaagccgaa

SEQ ID NO: 204279 - DNA, 75 bp, Artificial Sequence
  Synthetic
ttatgccttttctcttagatgatttagttccacgcgcatattatttggcagtaagtggtcaagcattttgtgatt

SEQ ID NO: 204280 - DNA, 75 bp, Artificial Sequence
  Synthetic
ttcagtttgacaacctgtctaatgcagatttgaaagctgttaagagttctttcaattttgaccagaaagaattgt

SEQ ID NO: 204281 - DNA, 75 bp, Artificial Sequence
  Synthetic
gcaccatagcccaactcacggatgctgcactttccattaaggaaaatgttgattttataaacagcatgcaattca

SEQ ID NO: 204282 - DNA, 75 bp, Artificial Sequence
  Synthetic
atgctaaagaccagtacggcaccgatattgacggagtctactgggtcgctagcaaccaggctgatgtcaataccc

SEQ ID NO: 204283 - DNA, 75 bp, Artificial Sequence
  Synthetic
tatttttaaaggtgataaggttggtcattatgttcatgttaagtgtgaacagtcttatcagctttatgatgcttc

SEQ ID NO: 204284 - DNA, 75 bp, Artificial Sequence
  Synthetic
aatggtaaatattttacttttaagcaggcaaataataattgctttgttaatgttgcatgtcttatgcttcagaat

SEQ ID NO: 204285 - DNA, 75 bp, Artificial Sequence
  Synthetic
agatttgaaagctgttaagagttctttcaattttgaccagaaagaattgttggcttattacaatgtccttgtgaa

SEQ ID NO: 204286 - DNA, 75 bp, Artificial Sequence
  Synthetic
aggcaaataataattgctttgttaatgttgcatgtcttatgcttcagaatgttaatctgaagtttgtaagcgtgc

SEQ ID NO: 204287 - DNA, 75 bp, Artificial Sequence
  Synthetic
ctaaaattgttcatttctttaagacttttactactagcactgctcttgcatttgcatgggttttatttcatgttt

SEQ ID NO: 204288 - DNA, 75 bp, Artificial Sequence
  Synthetic
tagagctggtaaaccccttcggtttgtagcacttgtttatgctaaaggttcttttaaatttggagatcctgctga

SEQ ID NO: 204289 - DNA, 75 bp, Artificial Sequence
  Synthetic
aaacatcacatgacgactaaggtcgtctttgattttggctcctgacgatatattacatcccttcaatcatctgaa

SEQ ID NO: 204290 - DNA, 75 bp, Artificial Sequence
  Synthetic
tgcatggtgcttatatagtagtggagagtgatatatattttgttaaaaacattcctcgttatgctagtgctgttg

SEQ ID NO: 204291 - DNA, 75 bp, Artificial Sequence
  Synthetic
ttagcactaagcttaaagatggcgttaatttcaatgtagacgacatcaatttttcccctgtattaggttgtttag

SEQ ID NO: 204292 - DNA, 75 bp, Artificial Sequence
  Synthetic
gcctgctgtcttagtgggtattgtgtcttatataactagtaaatctgtaatgccaatggctaaccattgatggta

SEQ ID NO: 204293 - DNA, 75 bp, Artificial Sequence
  Synthetic
ccgcatgtgattatgagattgtttgtaaatgtggtgttaagcaggagcagcgtaaaggtattgacgctgttatgc

SEQ ID NO: 204294 - DNA, 75 bp, Artificial Sequence
  Synthetic
agttgtactggactctttaagagttacttttattgatggcctttcttgttttaagattggacgtagaagaatttg

SEQ ID NO: 204295 - DNA, 75 bp, Artificial Sequence
  Synthetic
tcggtttcgttgaggcttataataattgtactggaggtgccgaaattagggacctcatttgtgtgcaaagttata

SEQ ID NO: 204296 - DNA, 75 bp, Artificial Sequence
  Synthetic
gtagcacttgtttatgctaaaggttcttttaaatttggagatcctgctgatgccagagattttattcgtgtggtt

SEQ ID NO: 204297 - DNA, 75 bp, Artificial Sequence
  Synthetic
gactttctataggtattgatactagcaccactggttttacctgcttttacggtactagtttcaaaccatattata

SEQ ID NO: 204298 - DNA, 75 bp, Artificial Sequence
  Synthetic
tgcagttgtggtgataagctaattcattgtacgcgaattaaggttccatttttaatttgcagcaacacaccaaaa

SEQ ID NO: 204299 - DNA, 75 bp, Artificial Sequence
  Synthetic
caccactggttttacctgcttttacggtactagtttcaaaccatattataatttaggtgaaccttataactttaa

SEQ ID NO: 204300 - DNA, 75 bp, Artificial Sequence
  Synthetic
taaatgtggtgttaagcaggagcagcgtaaaggtattgacgctgttatgcattttggaacattgagtcgtgaaga

SEQ ID NO: 204301 - DNA, 75 bp, Artificial Sequence
  Synthetic
attgtacgcgaattaaggttccatttttaatttgcagcaacacaccaaaagacaatgttttgcctaagggtgtga

SEQ ID NO: 204302 - DNA, 75 bp, Artificial Sequence
  Synthetic
tcttatataactagtaaatctgtaatgccaatggctaaccattgatggtacagattatactaatattatgcctag

SEQ ID NO: 204303 - DNA, 75 bp, Artificial Sequence
  Synthetic
taatgtgggtcattatactcatttgagatgtgattcaagttatcaactttttgatgcttctaatgttaaaaagat

SEQ ID NO: 204304 - DNA, 75 bp, Artificial Sequence
  Synthetic
agatgtgattcaagttatcaactttttgatgcttctaatgttaaaaagattactacagtcagtggtaaaatcact

SEQ ID NO: 204305 - DNA, 75 bp, Artificial Sequence
  Synthetic
agataaaatttgcattgtggataatgtttatatggccaaggctggtgacaaatattaccctgttgtggttgatga

SEQ ID NO: 204306 - DNA, 75 bp, Artificial Sequence
  Synthetic
gttagtaatcaaaacttcacatgacgactaagttcgtctttgattcattgcactgatcttttgttagatcttttt

SEQ ID NO: 204307 - DNA, 75 bp, Artificial Sequence
  Synthetic
agcaaacatttaggtctgttttgacgacctattatttagatgatgttatgaaggttgagtataagcctgatctta

SEQ ID NO: 204308 - DNA, 75 bp, Artificial Sequence
  Synthetic
gacctattatttagatgatgttatgaaggttgagtataagcctgatcttacacagtattactgtgaaggaggcaa

SEQ ID NO: 204309 - DNA, 75 bp, Artificial Sequence
  Synthetic
gtgttacatttaaggaacagcctacagtaaaggagattataagcatgcctaagattattaaggttttttatgagc

SEQ ID NO: 204310 - DNA, 75 bp, Artificial Sequence
  Synthetic
ggacatttggagacctgagaagaaatatctccgttatattaacggttttaatgtctcagaattagaagatgcttg

SEQ ID NO: 204311 - DNA, 75 bp, Artificial Sequence
  Synthetic
gctcagtttagaacttttgagaaagttgatggtgcctatatcaattttaaattggtaggacacaccgtctgtgat

SEQ ID NO: 204312 - DNA, 75 bp, Artificial Sequence
  Synthetic
ttgatggtgcctatatcaattttaaattggtaggacacaccgtctgtgatagtcttaatgctaaattgggttttg

SEQ ID NO: 204313 - DNA, 75 bp, Artificial Sequence
  Synthetic
aacagcttagtgattctacactagtaaaatttagtgcagcacaagctatggagaaggttaatgaatgtgtcaaaa

SEQ ID NO: 204314 - DNA, 75 bp, Artificial Sequence
  Synthetic
aaaatttagtgcagcacaagctatggagaaggttaatgaatgtgtcaaaagccaatcatctaggataaatttttg

SEQ ID NO: 204315 - DNA, 75 bp, Artificial Sequence
  Synthetic
tacagcattcgctaatactgtagaggatgctgttaacaaactggttttcttagctgttgactttattacctggcg

SEQ ID NO: 204316 - DNA, 75 bp, Artificial Sequence
  Synthetic
catagaagagaaactttctccatgtaaggagattgaaggtgtaggtgctaaagttagtgcctttttacagaaatt

SEQ ID NO: 204317 - DNA, 75 bp, Artificial Sequence
  Synthetic
cgtgctcttcagaagcgcttatactcacatgtgtatagaagtgatatggttgattcaacctttgtcacagaatat

SEQ ID NO: 204318 - DNA, 75 bp, Artificial Sequence
  Synthetic
taaagtgactgagtggccaacagctacaggcgatgtggtgttggctaatgatgatttatatgttaagaggtatga

SEQ ID NO: 204319 - DNA, 75 bp, Artificial Sequence
  Synthetic
acaggcgatgtggtgttggctaatgatgatttatatgttaagaggtatgaaagagggtgtattacttttggtaag

SEQ ID NO: 204320 - DNA, 75 bp, Artificial Sequence
  Synthetic
aaggagattgaaggtgtaggtgctaaagttagtgcctttttacagaaattagaggataattccctatttttattt

SEQ ID NO: 204321 - DNA, 75 bp, Artificial Sequence
  Synthetic
aagcatcccttaattctcttacatattttaatcgacctagtttggttgatgttaataagtttgatgttttgaaag

SEQ ID NO: 204322 - DNA, 75 bp, Artificial Sequence
  Synthetic
ttttaatcgacctagtttggttgatgttaataagtttgatgttttgaaagttgatgatgttgttgcagaagttga

SEQ ID NO: 204323 - DNA, 75 bp, Artificial Sequence
  Synthetic
gaggaaagtgatgttgaagaagatgatgtagaagatgaggaaactgatttaactgtcacaagtgctggacagcct

SEQ ID NO: 204324 - DNA, 75 bp, Artificial Sequence
  Synthetic
gggagtacaggtattggtgcgagtacagacaatgttgaagcttgtgctgctgctttggctccaggcaaccaaggg

SEQ ID NO: 204325 - DNA, 75 bp, Artificial Sequence
  Synthetic
cagacaatgttgaagcttgtgctgctgctttggctccaggcaaccaagggagttatgcagctaatggtttagcca

SEQ ID NO: 204326 - DNA, 75 bp, Artificial Sequence
  Synthetic
tctgattcacaagttgaagaagatgtagaaatgtcggattttgttgatcttgaatctgtgattcaggattatgaa

SEQ ID NO: 204327 - DNA, 75 bp, Artificial Sequence
  Synthetic
tgaatctgtgattcaggattatgaaaatgtttgttttgagttttatactacagagccagaatttgttaaagtttt

SEQ ID NO: 204328 - DNA, 75 bp, Artificial Sequence
  Synthetic
tggtgttaaaaagccttttaaggttgaaaatagtattgttattaatgacagtactagtgataccaaatttgttaa

SEQ ID NO: 204329 - DNA, 75 bp, Artificial Sequence
  Synthetic
gaaaatagtattgttattaatgacagtactagtgataccaaatttgttaagagtttgtctattgtggatgtttat

SEQ ID NO: 204330 - DNA, 75 bp, Artificial Sequence
  Synthetic
atgttgttaatgctgctaatgctttaagcgttgcggttaacgtaccaacaattaagaggtttataaaatttggta

SEQ ID NO: 204331 - DNA, 75 bp, Artificial Sequence
  Synthetic
aagcgttgcggttaacgtaccaacaattaagaggtttataaaatttggtatgactgttgttagtataccaataga

SEQ ID NO: 204332 - DNA, 75 bp, Artificial Sequence
  Synthetic
cccgttgatgtagttaaagtggtgcgtaataaaatttttgcctgctttaattttattagatggctttttgtctta

SEQ ID NO: 204333 - DNA, 75 bp, Artificial Sequence
  Synthetic
tgtgatgattatactggacaccaggagttagtaattaaaacatcacatgacgactaagttcgtctttgatttatt

SEQ ID NO: 204334 - DNA, 75 bp, Artificial Sequence
  Synthetic
tttaaccttatgtgattggcagtgtgttgcatactggaaatgcattaaatgtgatttagctcttaagcttaaagg

SEQ ID NO: 204335 - DNA, 75 bp, Artificial Sequence
  Synthetic
gttgcatactggaaatgcattaaatgtgatttagctcttaagcttaaaggcttggatgctatgttcttttatggt

SEQ ID NO: 204336 - DNA, 75 bp, Artificial Sequence
  Synthetic
ttatttggctggattaaaatatctgctgataataaagtaatatacatcacagaaattgcatcaaagcttacttgt

SEQ ID NO: 204337 - DNA, 75 bp, Artificial Sequence
  Synthetic
tatgcttagtacattacattggagtgttaggttgctggtgtctttagctaatatgttaccagcacatgtgtttat

SEQ ID NO: 204338 - DNA, 75 bp, Artificial Sequence
  Synthetic
gttactaagtttttgtttaatgtttatttaggcatggcactttcacactattatgtcatgcctctgacttgtatt

SEQ ID NO: 204339 - DNA, 75 bp, Artificial Sequence
  Synthetic
gtggtgagtctatggtacttattgatgttgatgtgccatttacagcccactttgcccttaaagataagttgtttt

SEQ ID NO: 204340 - DNA, 75 bp, Artificial Sequence
  Synthetic
acaaccattgacggtacagattatactaatattatgcctagtactgtttctacaacagtttatttaggctgttct

SEQ ID NO: 204341 - DNA, 75 bp, Artificial Sequence
  Synthetic
gtataaagcagcttgtgttgtggatgttaatgatagtcattctatggctgttgttgatggtaaacaaattgatga

SEQ ID NO: 204342 - DNA, 75 bp, Artificial Sequence
  Synthetic
gttaatgatagtcattctatggctgttgttgatggtaaacaaattgatgatcatcgtatcactagtattactagt

SEQ ID NO: 204343 - DNA, 75 bp, Artificial Sequence
  Synthetic
ttgttgatggtaaacaaattgatgatcatcgtatcactagtattactagtgataagtttgattttattattgggc

SEQ ID NO: 204344 - DNA, 75 bp, Artificial Sequence
  Synthetic
gttttacctgtttttcacggtactagttccaaaccatattataatttaggtagaccttataactttaagcattat

SEQ ID NO: 204345 - DNA, 75 bp, Artificial Sequence
  Synthetic
gccctagtaatggacatctggagacctgagattaaatatctccgttatactaacggttttaatgtctcagaatta

SEQ ID NO: 204346 - DNA, 75 bp, Artificial Sequence
  Synthetic
aaacctgatcttcccaattgcaatatagaagcttggcttaatgataagtcggtgccctctccattaaattgggaa

SEQ ID NO: 204347 - DNA, 75 bp, Artificial Sequence
  Synthetic
ttgttaaaggtgatataattaaagtgtctaagcttgttaaagcagaagttgtagtaaaccctgctaatggccata

SEQ ID NO: 204348 - DNA, 75 bp, Artificial Sequence
  Synthetic
ctaacattatgcctattactgtttttacaacagtttatttaggcgtttctataggtattgacactagcaccactg

SEQ ID NO: 204349 - DNA, 75 bp, Artificial Sequence
  Synthetic
tcattgaattgatagttagttacgccctgtatacggcatggttttacccattgtttgctcttattagtattcaga

SEQ ID NO: 204350 - DNA, 75 bp, Artificial Sequence
  Synthetic
tggtacagacacaacagacgttcttttaaaacagccgatggcaaccagcgtcaattgctgccacgatggtatttt

SEQ ID NO: 204351 - DNA, 75 bp, Artificial Sequence
  Synthetic
gtgcaggttcagaaaaaggagtagcaccgggttctgcagttcttaggcagtggttgcctgctggtactattcttg

SEQ ID NO: 204352 - DNA, 75 bp, Artificial Sequence
  Synthetic
gtagtattagatttgctagtgtttatagtgtgcttgagacgtttcagaacaatgtcgttaattatcaacacattg

SEQ ID NO: 204353 - DNA, 75 bp, Artificial Sequence
  Synthetic
gttcctagtcatgcttggtgccgtaatcaaggtagcttttgtgctacattcactctttatggcaaatccaaacat

SEQ ID NO: 204354 - DNA, 75 bp, Artificial Sequence
  Synthetic
cactctttatggcaaatccaaacattatgataaatattttggagtaataactggttttacagcattcgctaatac

SEQ ID NO: 204355 - DNA, 75 bp, Artificial Sequence
  Synthetic
agacttgtgtgatggttctgttgttataaaggaacctgtgcatgtttatgcggatgactctattattttacgtca

SEQ ID NO: 204356 - DNA, 75 bp, Artificial Sequence
  Synthetic
ggcacttgtcctgcaggtactaattatttaacttgtgataatttatgtactcttgatcctattacatttaaagct

SEQ ID NO: 204357 - DNA, 75 bp, Artificial Sequence
  Synthetic
ccacagcaagtaactaagcagaccgccaaagaaattagacagaaaattttgaataaaccccgccagaagaggagc

SEQ ID NO: 204358 - DNA, 75 bp, Artificial Sequence
  Synthetic
gcctccactgctctcagaaaatcagatcagtggatacactttggctgccacctctgctagtctgtttcctccttg

SEQ ID NO: 204359 - DNA, 75 bp, Artificial Sequence
  Synthetic
gtacttgccaaccacaagcatttttgggttggtctgcagactcttgtttacaaggagacaagtgtaatatttttg

SEQ ID NO: 204360 - DNA, 75 bp, Artificial Sequence
  Synthetic
ctaatgtctctgttttaactacaccctttagtcttaaagggggtgcagtttttagttattttgtttatgtatgtt

SEQ ID NO: 204361 - DNA, 75 bp, Artificial Sequence
  Synthetic
ggataaagtttttggttatgtacagcagggtatttttaataaggctactgttgctcaaattaaagccttgttttt

SEQ ID NO: 204362 - DNA, 75 bp, Artificial Sequence
  Synthetic
acatttccacgacaaaagttaagagtctttcgatgataagaggtccaccgcgtgctgaattaaatggcgtagtgg

SEQ ID NO: 204363 - DNA, 75 bp, Artificial Sequence
  Synthetic
ctaatttcattttgcatgatgttaataatggtcttacttgttctactgatttacaaaaagctaacacagaaatag

SEQ ID NO: 204364 - DNA, 75 bp, Artificial Sequence
  Synthetic
tgtgatggagttaatgtcacgaagcataagtgtgatataaattataaaggtaaagtctttttccagtttgataat

SEQ ID NO: 204365 - DNA, 75 bp, Artificial Sequence
  Synthetic
tcaatggtatgagtctacatttggtctaagttattatagtaacagtatggcttgtcccattgttgttgctgtagt

SEQ ID NO: 204366 - DNA, 75 bp, Artificial Sequence
  Synthetic
catgccaactcttccgaaccagcattgctatttcggaatattaaatgcaactacgtttttaataatagtcttaca

SEQ ID NO: 204367 - DNA, 75 bp, Artificial Sequence
  Synthetic
atgtggtggttgttgtgatgattatactggacacccggagttagtaattaaaacatcacatgacgactaaggtcg

SEQ ID NO: 204368 - DNA, 75 bp, Artificial Sequence
  Synthetic
aggttgttgttaatggtaagtatttcacttttaagcaagctaataacaattgttttgttaatgtttcttgcttaa

SEQ ID NO: 204369 - DNA, 75 bp, Artificial Sequence
  Synthetic
cgtttgatagttatcttggttgtgttgtcaatgcttataatagtactgctatttctgttcaaacatgtgatctca

SEQ ID NO: 204370 - DNA, 75 bp, Artificial Sequence
  Synthetic
gatcctgctgattctagagatttcttgcgtgttgtgtttagtcaagttgatttgactggggcaatatgtgatttt

SEQ ID NO: 204371 - DNA, 75 bp, Artificial Sequence
  Synthetic
tgcgtgttgtgtttagtcaagttgatttgactggggcaatatgtgattttgaaattgcatgtaaatgtggtgtaa

SEQ ID NO: 204372 - DNA, 75 bp, Artificial Sequence
  Synthetic
ccaatggctacaaccattgatggtacagattatactaacattatgcctattactgtttctacaacagtttattta

SEQ ID NO: 204373 - DNA, 75 bp, Artificial Sequence
  Synthetic
gatgtaccatttttaatttgcagtaatacacctgctagtgtaaaattacctaagggtgtaggaagtgcaaatatt

SEQ ID NO: 204374 - DNA, 75 bp, Artificial Sequence
  Synthetic
gctactgaagctaaggggtactggtacagacacaacagacgttcttttaaaacagccgatggcaaccagcgtcaa

SEQ ID NO: 204375 - DNA, 75 bp, Artificial Sequence
  Synthetic
ttcatgttaagtgtgaacaatcttatcagctttatgatgcttctaatgttaagaaggttacagatgttactggca

SEQ ID NO: 204376 - DNA, 75 bp, Artificial Sequence
  Synthetic
agaccagtatggcaccgatattgacggagtcttctgggtcgctagtaaccaggctgatgtcaataccccggctga

SEQ ID NO: 204377 - DNA, 75 bp, Artificial Sequence
  Synthetic
atgatgttaagaaaattgagtataaacctgacttgtcacaatattattgtgacggaggtaagtattatactcagc

SEQ ID NO: 204378 - DNA, 75 bp, Artificial Sequence
  Synthetic
attcgagaaagtagatggtgtgtatactaattttaaattgataggacacaccgtctgtgacagtcttaatgctaa

SEQ ID NO: 204379 - DNA, 75 bp, Artificial Sequence
  Synthetic
tttgttgaatataagattactgagtggccaacagctacaggtgatgtggtgttggctactgatgatttgtatgtt

SEQ ID NO: 204380 - DNA, 75 bp, Artificial Sequence
  Synthetic
tctttaacatattttaatagatcttcattggttgatgataataaatttgatgttttaaaagtggatgatgtggac

SEQ ID NO: 204381 - DNA, 75 bp, Artificial Sequence
  Synthetic
aaccaaatatgttaagagtttgtctattgttgatgtgtatgatatgtggcttacaggttgtaagtatgttgttag

SEQ ID NO: 204382 - DNA, 75 bp, Artificial Sequence
  Synthetic
gttaacgtacctacaatacgtaagtttataaaatttggtatgactcttgttagtataccaattgatttgttaaat

SEQ ID NO: 204383 - DNA, 75 bp, Artificial Sequence
  Synthetic
ttataaaatttggtatgactcttgttagtataccaattgatttgttaaatttaagagagattaagcctgctgtta

SEQ ID NO: 204384 - DNA, 75 bp, Artificial Sequence
  Synthetic
ttgtttggggttttatgaatcttcagttgaagaatattaaactcagtgaaaatgtttttgcttcctagatttatt

SEQ ID NO: 204385 - DNA, 75 bp, Artificial Sequence
  Synthetic
ggcactctctatcagaatggatgtcttgctgctataatagatagagaaggttatagcagactatagattaattag

SEQ ID NO: 204386 - DNA, 75 bp, Artificial Sequence
  Synthetic
tttgacatttaagtggagtatggttgctagaggtgcttgcattatagcgactatatttctattgtggtttaattt

SEQ ID NO: 204387 - DNA, 75 bp, Artificial Sequence
  Synthetic
tggagcttagtactggttgtcatactggtactgatttcaatggggatttttatggtccttataaggatgctcagg

SEQ ID NO: 204388 - DNA, 75 bp, Artificial Sequence
  Synthetic
ggcagatgtcctactgctgctgatattaatatccctgatttacccatttgtgtgcatgacccgctaccagttatt

SEQ ID NO: 204389 - DNA, 75 bp, Artificial Sequence
  Synthetic
cgtgcatcccgcttcactgatctcttgttagatctttttgtaatctaaactttataaaaacatccactccctgta

SEQ ID NO: 204390 - DNA, 75 bp, Artificial Sequence
  Synthetic
tgcacagtggattaagaacacttttagtcttgtaactatttgtgatctatattccattcaggatgtgggttttaa

SEQ ID NO: 204391 - DNA, 75 bp, Artificial Sequence
  Synthetic
gctataatagatagagaaggttatagcagactatagattaattagttgaaagttttgtgtggtaatgtatagtgt

SEQ ID NO: 204392 - DNA, 75 bp, Artificial Sequence
  Synthetic
gcatgtcagttctgcttggcaggatttgatatgttagataattataaagccattgatgtagtacagtatgaagct

SEQ ID NO: 204393 - DNA, 75 bp, Artificial Sequence
  Synthetic
agttttgtgtggtaatgtatagtgttggagaaagtgaaagacttgcggaagtaattgccgacaagtgcccaaggg

SEQ ID NO: 204394 - DNA, 75 bp, Artificial Sequence
  Synthetic
actgatctcttgttagatctttttgtaatctaaactttataaaaacatccactccctgtaatctatgcttgtggg

SEQ ID NO: 204395 - DNA, 75 bp, Artificial Sequence
  Synthetic
cattgatgtagtacagtatgaagctgataggagagcatttgttgattatacaggtgtgttaaagattgtcattga

SEQ ID NO: 204396 - DNA, 75 bp, Artificial Sequence
  Synthetic
caggtgtgttaaagattgtcattgaattgatagttagttacgccctgtatacggcatggttttatccattgtttg

SEQ ID NO: 204397 - DNA, 75 bp, Artificial Sequence
  Synthetic
ttaattatgcccaattggaagaatcccaaaaaaaaaaaaaaaaaaaaaaaaaaaaaaaaaaaaaaaaaaaaaaaa

SEQ ID NO: 204398 - DNA, 75 bp, Artificial Sequence
  Synthetic
tcgaactacactgggctccagaatttccatggatgtttgaggacgcagaggagaagttggacaaccctagtagtt

SEQ ID NO: 204399 - DNA, 75 bp, Artificial Sequence
  Synthetic
agaattagaagatgcttgttttaaatttaactatcaatttcctaaagtaggatattgtagagttcctagtcatgc

SEQ ID NO: 204400 - DNA, 75 bp, Artificial Sequence
  Synthetic
cttagtacattacattggagttttaggttgctggtggctttagctaatatgttaccagcacatgtgtttatgagg

SEQ ID NO: 204401 - DNA, 75 bp, Artificial Sequence
  Synthetic
gttggattatggcttctacatttttgtttagttgtataattacagcatttgtgaaatggactatgtttatgtatg

SEQ ID NO: 204402 - DNA, 75 bp, Artificial Sequence
  Synthetic
gcacactatggtttaaaccaccatttctttctgattttattaatggtatttttgctaaggtcaaaaataccaagg

SEQ ID NO: 204403 - DNA, 75 bp, Artificial Sequence
  Synthetic
tgtgctacattcactctttatggtaaatccaaacattatgataaatattttggagtaataaatggtttcacagca

SEQ ID NO: 204404 - DNA, 75 bp, Artificial Sequence
  Synthetic
ctaggaagatgcatagttttagatgttaaaggtgtagaagaattgcatgacgatttagttaattacattcgtgat

SEQ ID NO: 204405 - DNA, 75 bp, Artificial Sequence
  Synthetic
tgttgcctatggttgtaataaatctggttgtttgttttgttacaagaggaatcgtagtctacgtgttaaatgtag

SEQ ID NO: 204406 - DNA, 75 bp, Artificial Sequence
  Synthetic
tattacgatgttatggctaatggtggcactggcttttgttcaaaacatcaatggaattgcattgattgtgattct

SEQ ID NO: 204407 - DNA, 75 bp, Artificial Sequence
  Synthetic
gcactggcttttgttcaaaacatcaatggaattgcattgattgtgattcttataaaccaggtaatacttttatta

SEQ ID NO: 204408 - DNA, 75 bp, Artificial Sequence
  Synthetic
tggaccatgggtttgtttcggcgtagaagtgtgtgtaacactggtcgttgcactgttaataagcatgtggcctat

SEQ ID NO: 204409 - DNA, 75 bp, Artificial Sequence
  Synthetic
tcagttgagtatacttatactgatgaagttatttaaggcatgttattgcttataggaatggtctttgttacatta

SEQ ID NO: 204410 - DNA, 75 bp, Artificial Sequence
  Synthetic
tcagttgagtatacttatactgatgaagttatttatggcatgttattgcttataggaatggtctttgttacatta

SEQ ID NO: 204411 - DNA, 75 bp, Artificial Sequence
  Synthetic
tcagttgagtatacttatactgatgaagttatttacggcatgttattgcttataggaatggtctttgttacatta

SEQ ID NO: 204412 - DNA, 75 bp, Artificial Sequence
  Synthetic
tcagttgagtatacttatactgatgaagttatttagggcatgttattgcttataggaatggtctttgttacatta

SEQ ID NO: 204413 - DNA, 75 bp, Artificial Sequence
  Synthetic
taaggaattgaaacggcccattcagcctacagatgttgcttatcatacggttaccgatgttaagcaagttggttg

SEQ ID NO: 204414 - DNA, 75 bp, Artificial Sequence
  Synthetic
gtgtaataccttagtactgtccccttctatttatgtgtttaatagaggtaggcagttttatgagttttacaatga

SEQ ID NO: 204415 - DNA, 75 bp, Artificial Sequence
  Synthetic
ctactaccaactatgttggtgtttatgatattaatcatggggatgctggttttactagcatactcagtggtttgt

SEQ ID NO: 204416 - DNA, 75 bp, Artificial Sequence
  Synthetic
tatagatgctttagcttctatgactggtgtgtctttggaaacattattggctgctattaagcgtctcaagaatgg

SEQ ID NO: 204417 - DNA, 75 bp, Artificial Sequence
  Synthetic
gatggacagcgcacatatgatgatgttaatgctagtttgtttgtggattatagtaatttgctacattctaaggtt

SEQ ID NO: 204418 - DNA, 75 bp, Artificial Sequence
  Synthetic
ttaatgctagtttgtttgtggattatagtaatttgctacattctaaggttaagagtgtgcctaatatgcatgttg

SEQ ID NO: 204419 - DNA, 75 bp, Artificial Sequence
  Synthetic
ttatctatggctgcagcaaaggttattgctaagtgggttgctgtgaatgttttgtatttcacagatatacctcaa

SEQ ID NO: 204420 - DNA, 75 bp, Artificial Sequence
  Synthetic
ccagtttatatctggactgctgatgaagctattaaattcctaaaggaatggaatttttctttgggtattatacta

SEQ ID NO: 204421 - DNA, 75 bp, Artificial Sequence
  Synthetic
agctaattttctgaatgctgctgtattttatgcacagtctttgtttagacctattttaatggttgataaaaatct

SEQ ID NO: 204422 - DNA, 75 bp, Artificial Sequence
  Synthetic
gataactactgctaacactggtacgtctgttacagaaactatgtttgatgtttatgtggatacatttttgtctat

SEQ ID NO: 204423 - DNA, 75 bp, Artificial Sequence
  Synthetic
tctatagcaccacctactggtgtttatgaattaaacggttacactgttcagccaattgcagatgtttaccgacgt

SEQ ID NO: 204424 - DNA, 75 bp, Artificial Sequence
  Synthetic
tttagctgattctgtcatgtctgctgtatcggcaggtcttgaattgacggatgaaagttgtaataacttggtgcc

SEQ ID NO: 204425 - DNA, 75 bp, Artificial Sequence
  Synthetic
acaagttgtcagttgtattataatttacctgctgctaatgtttctgttagcaggtttaatccttctacttggaat

SEQ ID NO: 204426 - DNA, 75 bp, Artificial Sequence
  Synthetic
ccagcataaattgaagaaagcatgttgtaaaactggtttgaaactgaagcttacttataataagcagatggctaa

SEQ ID NO: 204427 - DNA, 75 bp, Artificial Sequence
  Synthetic
ggttggattcctggtaacatgatagatggttttgcttgcaccacttgtggtcatgtttatgaagtaggtgatttg

SEQ ID NO: 204428 - DNA, 75 bp, Artificial Sequence
  Synthetic
gcaggaacagcgtactggtgtggacgctgttatgcattttggtacattgagtcgtgaagatcttgagattggtta

SEQ ID NO: 204429 - DNA, 75 bp, Artificial Sequence
  Synthetic
ctgtggtgcttaatgcccacttacacagtacacaaatcagattttcagcttcccgtttatgccagttataaagtt

SEQ ID NO: 204430 - DNA, 75 bp, Artificial Sequence
  Synthetic
cagtacacaaatcagattttcagcttcccgtttatgccagttataaagttttagataatggtgttattagagatg

SEQ ID NO: 204431 - DNA, 75 bp, Artificial Sequence
  Synthetic
aggcgtggcttgaatttcgttctggccgccctgctagatttgtatctttggttttggccaaaggtgggtttaaat

SEQ ID NO: 204432 - DNA, 75 bp, Artificial Sequence
  Synthetic
acttctcagcaaccatcaggagggaatgttgtaccctactattcttggttctctggaattactcagtttcaaaag

SEQ ID NO: 204433 - DNA, 75 bp, Artificial Sequence
  Synthetic
taacaaatttgaacaatttgatcaatggtatgagtctacatttggtctaagttattatagtaacagtatggcttg

SEQ ID NO: 204434 - DNA, 75 bp, Artificial Sequence
  Synthetic
gctctgaattcaatattagataatgctgtgaagggttgtgtaccattgaatgcaatcccttcattggctgcaaat

SEQ ID NO: 204435 - DNA, 75 bp, Artificial Sequence
  Synthetic
atgtgctaatgttgtcttgcttaattgcttgcaacatttgcatgttgcttctaattctaagttgtggcagtattg

SEQ ID NO: 204436 - DNA, 75 bp, Artificial Sequence
  Synthetic
tggtttgttatataattcaccttgtttttcgcagcaaggcgtttttaggtatgataatgttagcagtgtctggcc

SEQ ID NO: 204437 - DNA, 75 bp, Artificial Sequence
  Synthetic
atgtccctaccaaagtgttacgatatggttatcatgtgttgcactttattacacatgcactttctgctgatggag

SEQ ID NO: 204438 - DNA, 75 bp, Artificial Sequence
  Synthetic
tggttatcatgtgttgcactttattacacatgcactttctgctgatggagtgcagtgttatacgccacatagtca

SEQ ID NO: 204439 - DNA, 75 bp, Artificial Sequence
  Synthetic
actgctgctgatattaatatccctgatttacccatttgtgtgtatgatccgctaccagttattttgcttggcatt

SEQ ID NO: 204440 - DNA, 75 bp, Artificial Sequence
  Synthetic
tgtatagttcattggtacctcacgtgcggtataatcttgctaatgctaaaggttttatccgttttccagaagtgt

SEQ ID NO: 204441 - DNA, 75 bp, Artificial Sequence
  Synthetic
aagttactattgattgtgctgcatttgtctgtggtgattatgcagcatgtaaatcacagttggttgaatatggta

SEQ ID NO: 204442 - DNA, 75 bp, Artificial Sequence
  Synthetic
gcgtactcgttctatgtcgtattgcagagttggattatgtgaggaagctgatgagggtatatgctttaattttaa

SEQ ID NO: 204443 - DNA, 75 bp, Artificial Sequence
  Synthetic
agagttggattatgtgaggaagctgatgagggtatatgctttaattttaatggttcttgggtgcttaataatgat

SEQ ID NO: 204444 - DNA, 75 bp, Artificial Sequence
  Synthetic
gcacagcctgtggattttttggcattgactgctagttccattgctggtgctatacttgctgtaattgttgttttg

SEQ ID NO: 204445 - DNA, 75 bp, Artificial Sequence
  Synthetic
gcaggtgtttttaccaatcatgatgtagtttatgcccaacattgttttaaagctcccaaaaatttctgtccgtgt

SEQ ID NO: 204446 - DNA, 75 bp, Artificial Sequence
  Synthetic
tttacgaaacagatgctaataagttgattttaatcaatgatgttgcatttgtttcgacatttaatgtcttacagg

SEQ ID NO: 204447 - DNA, 75 bp, Artificial Sequence
  Synthetic
acgttgtagcacctgttatggtggttgcgacgtgaatagtcatgtagcctaccaattgtttttaatagacccaca

SEQ ID NO: 204448 - DNA, 75 bp, Artificial Sequence
  Synthetic
tggtgtgtaaattttatgatgctttttgtgtttcaagtttaccccacactttcttgtgtatatgctatttgttat

SEQ ID NO: 204449 - DNA, 75 bp, Artificial Sequence
  Synthetic
taggttgctggtgtctttagctaatatgttaccagcacatgtgtttatgaggttttatattattattgcctcttt

SEQ ID NO: 204450 - DNA, 75 bp, Artificial Sequence
  Synthetic
aaactgtattgtgcctttacagctcctgaagatgatgactttcttgaggaaagtgatgttgaagaagatgatgta

SEQ ID NO: 204451 - DNA, 75 bp, Artificial Sequence
  Synthetic
ctgatttttcattagcggatagtgtagttgaagttgttacaacttcacttacaccatgtggttattctgaaccac

SEQ ID NO: 204452 - DNA, 75 bp, Artificial Sequence
  Synthetic
acaatggctagttatgtatggcactattatgcctttatggttttgtttgctatatatagctgttgttgtttcaaa

SEQ ID NO: 204453 - DNA, 75 bp, Artificial Sequence
  Synthetic
cggagataagtgtgataatgcacttacaatggctagttatgtatggcactattatgcctttatggttttgtttgc

SEQ ID NO: 204454 - DNA, 75 bp, Artificial Sequence
  Synthetic
gtagtgatggtacatttgaagaaatggctctcactacttttatgattacaaaagattcttattgtaagcttaaga

SEQ ID NO: 204455 - DNA, 75 bp, Artificial Sequence
  Synthetic
acaaaaagctaacacagacataattcttggtgtttgtgttaattatgacctttatggtatttcaggccaaggcat

SEQ ID NO: 204456 - DNA, 75 bp, Artificial Sequence
  Synthetic
aaagattcttattgtaagcttaagaattctttgtctgatgttgcttttaatagatatttgagtttgtataataaa

SEQ ID NO: 204457 - DNA, 75 bp, Artificial Sequence
  Synthetic
gctgctatacttaacaattgtaattggtttgtacaaagtgataagtgttctgtagaagattttaatgtgtgggct

SEQ ID NO: 204458 - DNA, 75 bp, Artificial Sequence
  Synthetic
cctcctaccaatgttgtttcgcatttaaatggagattggtttttatttggtgacagtcgttcagattgtaatcat

SEQ ID NO: 204459 - DNA, 75 bp, Artificial Sequence
  Synthetic
cttttggtaaacctgttatatggttaagccatgagaaagcttccctcaattctttaacatattttaatagacctt

SEQ ID NO: 204460 - DNA, 75 bp, Artificial Sequence
  Synthetic
atcctacttctaaggtagaaccatgtgttgtcagtgttacctatggtaatatgacattgaatggtttatggttgg

SEQ ID NO: 204461 - DNA, 75 bp, Artificial Sequence
  Synthetic
agtgccaaagggaagagccagcatgttaagttactacccagtaattagtaaatgaatgaagttaattatggccaa

SEQ ID NO: 204462 - DNA, 75 bp, Artificial Sequence
  Synthetic
ttgtgtgaccatgctggtaccggtatggccataactattaaacctgaagctaccactagtcaggattcgtatggt

SEQ ID NO: 204463 - DNA, 75 bp, Artificial Sequence
  Synthetic
tgtaatatgttctgcttcagatatgactaatccagattatacaaatttgttgtgtagagtaacatcaagtgattt

SEQ ID NO: 204464 - DNA, 75 bp, Artificial Sequence
  Synthetic
agtagatgatttagtacctcgttcatattatttgattaaaagtggccaggccttttctgaaaagttgaatcagtt

SEQ ID NO: 204465 - DNA, 75 bp, Artificial Sequence
  Synthetic
aggacactttggatgatggtccaagtgtggagacatctgattcacaagttgaagaagatgtagaaatgtcggatt

SEQ ID NO: 204466 - DNA, 75 bp, Artificial Sequence
  Synthetic
tatatatgccaatgtaatttttagtgatttttatttgcctaaaatcggtttcttgccgacttttgttggtaagat

SEQ ID NO: 204467 - DNA, 75 bp, Artificial Sequence
  Synthetic
aaatatacatttggtgtggttaaaccaggtgagacttttactgttttagctgcttataacggcaaaccacaagga

SEQ ID NO: 204468 - DNA, 75 bp, Artificial Sequence
  Synthetic
gtggctgtgtgctttcctccgcttgtactatgtttgcaatggccgatggtagtccacaaccttattgttatacag

SEQ ID NO: 204469 - DNA, 75 bp, Artificial Sequence
  Synthetic
aatttgtttatatgcatcaattggagcttagtactggttgtcatactggtactgacttcaatggggatttttatg

SEQ ID NO: 204470 - DNA, 75 bp, Artificial Sequence
  Synthetic
aatattatcctgtagtggtagataagcaggcagggcttttggatcaggcatggaggattccttgcgcaggtaggc

SEQ ID NO: 204471 - DNA, 75 bp, Artificial Sequence
  Synthetic
tttatgctgctatacttaacaattgtaattggtttgtacaaagtgataagtgttctgtagaagattttaatgtgt

SEQ ID NO: 204472 - DNA, 75 bp, Artificial Sequence
  Synthetic
taaggaattgaaacggcctattcagcctacagatgttgcttatcatacggttactgatgttaagcaagttggttg

SEQ ID NO: 204473 - DNA, 75 bp, Artificial Sequence
  Synthetic
tttctgctgttgttgctgatgcaatagaggataaacttactccatgtaaggaggttgatggtgtaggcgctaaag

SEQ ID NO: 204474 - DNA, 75 bp, Artificial Sequence
  Synthetic
agaggataaacttactccatgtaaggaggttgatggtgtaggcgctaaagtcagtgcctttttgcagaagttgga

SEQ ID NO: 204475 - DNA, 75 bp, Artificial Sequence
  Synthetic
gacgctggcgaatgcgtcctagcttctaaattgtattgcacattttcagctcctgttgatgaagattttggagag

SEQ ID NO: 204476 - DNA, 75 bp, Artificial Sequence
  Synthetic
gtttgcagacaaattagtggaggtaggcttagtaggtgttttaacacttgataatcaagacttaaatggtaaatg

SEQ ID NO: 204477 - DNA, 75 bp, Artificial Sequence
  Synthetic
ctaaattgtattgcacattttcagctcctgttgatgaagattttggagagccagaatttgaagaagatgatgttg

SEQ ID NO: 204478 - DNA, 75 bp, Artificial Sequence
  Synthetic
ggtatgataatgttagcagtgtctggcctctctacccttatggcagatgccctactgctgctgatattaataccc

SEQ ID NO: 204479 - DNA, 75 bp, Artificial Sequence
  Synthetic
aaagagggtagttcagttgatctgaagcactttttctttacgcaggatggtaatgctgctattactgattataat

SEQ ID NO: 204480 - DNA, 75 bp, Artificial Sequence
  Synthetic
gcaaccccagggtgtggtgttgctatagcagattcttactattcatatatgatgcctatgctgactatgtgtcat

SEQ ID NO: 204481 - DNA, 75 bp, Artificial Sequence
  Synthetic
tgctactacctcggatgaggtttgtgccaatggacaggaggaggcatcagaagtcttagatattgttgaggttga

SEQ ID NO: 204482 - DNA, 75 bp, Artificial Sequence
  Synthetic
gccaatggacaggaggaggcatcagaagtcttagatattgttgaggttgaagattctatggaagaacttcatgtc

SEQ ID NO: 204483 - DNA, 75 bp, Artificial Sequence
  Synthetic
atgttgtatctgcggattctgatggttttgtgtatgatcatatagatgtagttgattatgataccttttattgtg

SEQ ID NO: 204484 - DNA, 75 bp, Artificial Sequence
  Synthetic
agatagatagacttattaatggtcgtcttaccgctcttaatgcttatgtttctcaacagcttagtgattctacat

SEQ ID NO: 204485 - DNA, 75 bp, Artificial Sequence
  Synthetic
acagcaggaacctgcttttgttaaggttcttggtgtgtatgtacctaaagcaacgcgcaataattgttggttgcg

SEQ ID NO: 204486 - DNA, 75 bp, Artificial Sequence
  Synthetic
gttcttggtgtgtatgtacctaaagcaacgcgcaataattgttggttgcgttctgtgttggcagtttttcagaaa

SEQ ID NO: 204487 - DNA, 75 bp, Artificial Sequence
  Synthetic
aaaaacagacgaagtcgtagagcgattaccactggttatcggtttactaattttgagccatttactgttaattca

SEQ ID NO: 204488 - DNA, 75 bp, Artificial Sequence
  Synthetic
taaacagcattttgatcagttgtttatagacactattatgcagaagatacctgaaaacatagttgttccacaggg

SEQ ID NO: 204489 - DNA, 75 bp, Artificial Sequence
  Synthetic
acgctgttatgcattttggtacattgagtcgtgaagatcttgagattggttataccgtggactgttcttgcggta

SEQ ID NO: 204490 - DNA, 75 bp, Artificial Sequence
  Synthetic
tggctacttactttgtgtgattggcaagcaacatctcattggagatgtcttaaatgtgatatggatctaaacctt

SEQ ID NO: 204491 - DNA, 75 bp, Artificial Sequence
  Synthetic
tggggcttgttttccttgatgaacagtttgtttagaatgcctttgggtgtttataattataaaatttcagtacag

SEQ ID NO: 204492 - DNA, 75 bp, Artificial Sequence
  Synthetic
atggagacatagtgtcacatgtttgtaagtgtggagcatccatggttcttcttaaaattgatgtgccatttactg

SEQ ID NO: 204493 - DNA, 75 bp, Artificial Sequence
  Synthetic
tgaagcccttatgcttaattttaagctgctgggtattggaggtgttccaatcattgaagtatctcaatttcaatc

SEQ ID NO: 204494 - DNA, 75 bp, Artificial Sequence
  Synthetic
cttttgctaattcagtttttaacatatgtcaagctgtttcagccaatgtatgtgctttaatgtcatgcaatggta

SEQ ID NO: 204495 - DNA, 75 bp, Artificial Sequence
  Synthetic
aacatttgcatgttgcttctaattctaagttgtggcagtattgtagcactttgcacaatgaaatacttgccactt

SEQ ID NO: 204496 - DNA, 75 bp, Artificial Sequence
  Synthetic
gcttgctcagttattaattgttttgtttgctaatccagctgctgtggatagcaagtgcctgactagtattgaaga

SEQ ID NO: 204497 - DNA, 75 bp, Artificial Sequence
  Synthetic
gcaagtgcctgactagtattgaagaagtttgcgatgattacgcaaaggacaatactgttttgcaggctttacaga

SEQ ID NO: 204498 - DNA, 75 bp, Artificial Sequence
  Synthetic
agtttgcgatgattacgcaaaggacaatactgttttgcaggctttacagagtgaatttgttaatatggctagctt

SEQ ID NO: 204499 - DNA, 75 bp, Artificial Sequence
  Synthetic
aatcttgatgaggcgcgttttagtggttctgctaatcaacagcagttaaaacagctagagaaagcctgtaatatt

SEQ ID NO: 204500 - DNA, 75 bp, Artificial Sequence
  Synthetic
gttctgctaatcaacagcagttaaaacagctagagaaagcctgtaatattgctaaatctgcttatgaacgcgacc

SEQ ID NO: 204501 - DNA, 75 bp, Artificial Sequence
  Synthetic
gctagatctcagggtaagcaaagttatgcattgttggaaaagacatataagcaccttaacaagtatgattgtagt

SEQ ID NO: 204502 - DNA, 75 bp, Artificial Sequence
  Synthetic
ttctttaacatattttaatagaccttcattggttgatgataataaatttgatgttttaaaagtggatgatgttga

SEQ ID NO: 204503 - DNA, 75 bp, Artificial Sequence
  Synthetic
tatggctgatttggctcttactaatatgtataaagaagctagaattaatgataagaagagtaaggttgtttctgc

SEQ ID NO: 204504 - DNA, 75 bp, Artificial Sequence
  Synthetic
gcaccttaacaagtatgattgtagtcttactacacttatttcagctggcatatttagtgtgccctctgatgtatc

SEQ ID NO: 204505 - DNA, 75 bp, Artificial Sequence
  Synthetic
gtgcgtaagttagataatcaagctctgaattcaatattagataacgctgtgaagggttgtgtaccattgaatgca

SEQ ID NO: 204506 - DNA, 75 bp, Artificial Sequence
  Synthetic
tgaattcaatattagataacgctgtgaagggttgtgtaccattgaatgcaataccttcattggcagcaaatactc

SEQ ID NO: 204507 - DNA, 75 bp, Artificial Sequence
  Synthetic
ttcagatggtacaaataagcagttgaatgagatatctgatgattgtaactggccactagttattattgcaaatcg

SEQ ID NO: 204508 - DNA, 75 bp, Artificial Sequence
  Synthetic
tatgtgtgtaacgcaccaggatgtgatgtaaatgatgttaccaaattgtatctaggtggtatgtcatattattgt

SEQ ID NO: 204509 - DNA, 75 bp, Artificial Sequence
  Synthetic
acacctactcaatgttactataataatagtaacaatgggaagattgtttatgctatacttagtgatgttgatggt

SEQ ID NO: 204510 - DNA, 75 bp, Artificial Sequence
  Synthetic
atagtaacaatgggaagattgtttatgctatacttagtgatgttgatggtcttaagtatacaaaaattcttaaag

SEQ ID NO: 204511 - DNA, 75 bp, Artificial Sequence
  Synthetic
cctgcgctgttaattatactaaagcgccgtatgtaatgctgaacacttcaatacccaaccttcctgattttaagg

SEQ ID NO: 204512 - DNA, 75 bp, Artificial Sequence
  Synthetic
ttttggtctatataaacaatcttgtacaggatctccgtacatagatgattttaatcgtatagctagttgtaaatg

SEQ ID NO: 204513 - DNA, 75 bp, Artificial Sequence
  Synthetic
gttagatcctccttgtaaatttactgttcaagatgctaaaggtcttaaaattaagtacctttattttgtaaaagg

SEQ ID NO: 204514 - DNA, 75 bp, Artificial Sequence
  Synthetic
acaggatctccgtacatagatgattttaatcgtatagctagttgtaaatggactgatgttgatgattacatactg

SEQ ID NO: 204515 - DNA, 75 bp, Artificial Sequence
  Synthetic
ttgagaccataatgaaggtgttgaatgagaatttgaatgcctatcaacaacaagatggtatgatgaatatgagtc

SEQ ID NO: 204516 - DNA, 75 bp, Artificial Sequence
  Synthetic
ttaagtacctttattttgtaaaaggttgtaacacactagcaagaggctgggttgttggtacaatttcttctacag

SEQ ID NO: 204517 - DNA, 75 bp, Artificial Sequence
  Synthetic
aaagtgtactacagtttccattaatgatgttgacactggtgttccttctataagtactgatgttgtcgatgttac

SEQ ID NO: 204518 - DNA, 75 bp, Artificial Sequence
  Synthetic
agttgaacacccagatgttgatgggttgtgcaaattacgcggcaagtttgtacaagtgcctgtaggtataaaaga

SEQ ID NO: 204519 - DNA, 75 bp, Artificial Sequence
  Synthetic
tacaagtgcctgtaggtataaaagatcctgtgtcttatgttttgacacatgatgtttgtcgagtttgtggatttt

SEQ ID NO: 204520 - DNA, 75 bp, Artificial Sequence
  Synthetic
tagcactgacactactgttcaatcaaaagatactaattttttaaacgggttcggggtacgagtgtagatgcccgt

SEQ ID NO: 204521 - DNA, 75 bp, Artificial Sequence
  Synthetic
tcggggtacgagtgtagatgcccgtctcgtaccctgcgccagtggtttatctactgatgtacaattaagggcatt

SEQ ID NO: 204522 - DNA, 75 bp, Artificial Sequence
  Synthetic
ggcattggtttacatttaaaagttaattgttgccgttttcagcgtgttgatgagaacggtgataaattagatcag

SEQ ID NO: 204523 - DNA, 75 bp, Artificial Sequence
  Synthetic
attgttgccgttttcagcgtgttgatgagaacggtgataaattagatcagttctttgttgttaagaggacagatc

SEQ ID NO: 204524 - DNA, 75 bp, Artificial Sequence
  Synthetic
tgaaattgttcgctgcagaaacgcaaaaggcgactgaggaagcctttaagcagagttatgcatcagcaacaatac

SEQ ID NO: 204525 - DNA, 75 bp, Artificial Sequence
  Synthetic
atgctatgagcgtgtaaaagattgtaagtttgtggctgaacacgatttctttacatttgatgtagaaggtagtcg

SEQ ID NO: 204526 - DNA, 75 bp, Artificial Sequence
  Synthetic
aagtttgtggctgaacacgatttctttacatttgatgtagaaggtagtcgtgtgccacacattgtacgcaaggat

SEQ ID NO: 204527 - DNA, 75 bp, Artificial Sequence
  Synthetic
agatctttttccaatctagcattttttaccacgcccttttaatggacatttggagacctgagaagaaatttctcc

SEQ ID NO: 204528 - DNA, 75 bp, Artificial Sequence
  Synthetic
tttgctatgcattgcgacattttgatcgcaatgattgcatgctgctttgtgacattctctctatatatgctggtt

SEQ ID NO: 204529 - DNA, 75 bp, Artificial Sequence
  Synthetic
gacattctctctatatatgctggttgtgaacaatcctactttactaagaaggattggtatgattttgttgaaaat

SEQ ID NO: 204530 - DNA, 75 bp, Artificial Sequence
  Synthetic
ttaacaaactggttttcttagctgttgactttattacctggcgtagacaggagttaaatgtttatggctgatgct

SEQ ID NO: 204531 - DNA, 75 bp, Artificial Sequence
  Synthetic
cctgatattattaatgtgtataaaaagctaggacctatttttaatagagccctagttagcgctactgagtttgcg

SEQ ID NO: 204532 - DNA, 75 bp, Artificial Sequence
  Synthetic
atagtgtgcctgagacgtttcagagcaatgtcgttaattatcaacacattggaatgaaacgttattgtaccgtgc

SEQ ID NO: 204533 - DNA, 75 bp, Artificial Sequence
  Synthetic
agatttaaatggtaaatggtatgattttggtgactatgttattgcagccccaggatgtggtgttgctatagcaga

SEQ ID NO: 204534 - DNA, 75 bp, Artificial Sequence
  Synthetic
acatcttgctatcggtttggctgtatattattgtacagctagagttgtatacactgccgctagccatgctgctgt

SEQ ID NO: 204535 - DNA, 75 bp, Artificial Sequence
  Synthetic
acactgccgctagccatgctgctgttgatgcattgtgtgaaaaggcatataaatttttaaatattaatgattgca

SEQ ID NO: 204536 - DNA, 75 bp, Artificial Sequence
  Synthetic
atgctgaccatgtgtcatgcattggattgcgaattgtatgtgaataatgcttatagactatttgatcttgtacag

SEQ ID NO: 204537 - DNA, 75 bp, Artificial Sequence
  Synthetic
tatgattttactgattacaagcttgaattgtttaataagtattttaagcactggagtatgccatatcatcctaac

SEQ ID NO: 204538 - DNA, 75 bp, Artificial Sequence
  Synthetic
ccattgtttgcccttatcagtattcagatcttgaccacttggctgcctgagctttttatgcttagtacattacat

SEQ ID NO: 204539 - DNA, 75 bp, Artificial Sequence
  Synthetic
attaatgacaccactcgtaagtatgtgtttactactataaatgcattacctgagatggtgactgatattgttgtt

SEQ ID NO: 204540 - DNA, 75 bp, Artificial Sequence
  Synthetic
tgctaattcagtctttaacatatgtcaagctgtttcagccaatgtatgtgctttaatgtcatgcaatggcaataa

SEQ ID NO: 204541 - DNA, 75 bp, Artificial Sequence
  Synthetic
tctatagtttttaccatagtggccattattatgtggattgtgtattttgtgaatagtatcaggttgtttattaga

SEQ ID NO: 204542 - DNA, 75 bp, Artificial Sequence
  Synthetic
tatataggtgatcctgctcaattgccagcacctcgtgtgttgttgagtaaaggatccctagaacctaaatatttt

SEQ ID NO: 204543 - DNA, 75 bp, Artificial Sequence
  Synthetic
ggcaaatttttgtggatggtgtgccttttgttgtttcaattggctaccattataaagaacttggtattgtgatga

SEQ ID NO: 204544 - DNA, 75 bp, Artificial Sequence
  Synthetic
gcttaggtcctgatattttcttgggaacatgttatcgttgtcccaaggaaattgtggatacagtctcggccttgg

SEQ ID NO: 204545 - DNA, 75 bp, Artificial Sequence
  Synthetic
tcgcttgtctttaaaagacttgcttttatatgctgctgatccagctttgcatgtagcttctgctagtgctttgta

SEQ ID NO: 204546 - DNA, 75 bp, Artificial Sequence
  Synthetic
cttttactcctggtaagcaatccagtagtagagcgtcctctggaaatcgttctggtaatggcatcctcaagtggg

SEQ ID NO: 204547 - DNA, 75 bp, Artificial Sequence
  Synthetic
ccctgacggtcacaataatacgcggtcatctttactattcaaaggtataaaactaggtattggctattctttggc

SEQ ID NO: 204548 - DNA, 75 bp, Artificial Sequence
  Synthetic
aacatgttatcgttgtcccaaggaaattgtggatacagtctcggccttggtttatgataataagcttaaggctaa

SEQ ID NO: 204549 - DNA, 75 bp, Artificial Sequence
  Synthetic
gttgccgctataacaagcggtgtaaaatttcaaacagttaaacctggtaattttaatcaggatttttatgatttt

SEQ ID NO: 204550 - DNA, 75 bp, Artificial Sequence
  Synthetic
aaggtttactttaagggcgttacaacacatgagagttctagtgctgttaatatgcagcagatttatttaattagt

SEQ ID NO: 204551 - DNA, 75 bp, Artificial Sequence
  Synthetic
ataagcgatactagtggttttgctgtttatgttaagttcaaagtcggtaattaccgactgccatcaacccaaaag

SEQ ID NO: 204552 - DNA, 75 bp, Artificial Sequence
  Synthetic
ttttaatcaggatttttatgattttgttttaagtaaaggcctgcttaaagagggtagctcagttgatctgaagca

SEQ ID NO: 204553 - DNA, 75 bp, Artificial Sequence
  Synthetic
cacatgagagttctagtgctgttaatatgcagcagatttatttaattagtaagtttttgaaggctaatcccttgt

SEQ ID NO: 204554 - DNA, 75 bp, Artificial Sequence
  Synthetic
atgggaattcgttttgaatatacatcacccactgataagctagctatgattatgggttattgttgtttagatgtg

SEQ ID NO: 204555 - DNA, 75 bp, Artificial Sequence
  Synthetic
gctgctattactgattataattattataagtataatttgcccaccatggtggacattaagcagttgttgtttgtt

SEQ ID NO: 204556 - DNA, 75 bp, Artificial Sequence
  Synthetic
atataatagtcagaactttgctgctaagcgcgttttgggtcttcaaacccaaaccgtagattcagcgcagggttc

SEQ ID NO: 204557 - DNA, 75 bp, Artificial Sequence
  Synthetic
ggacattaagcagttgttgtttgttttggaagttgtttataagtattttgagatttatgatggtgggtgtatacc

SEQ ID NO: 204558 - DNA, 75 bp, Artificial Sequence
  Synthetic
aagcgcgttttgggtcttcaaacccaaaccgtagattcagcgcagggttctgaatatgattatgttatctattca

SEQ ID NO: 204559 - DNA, 75 bp, Artificial Sequence
  Synthetic
ttaatgttaaccgcttcaacgttgctattactagagccaagaaaggtattctttgtgtcatgtgtaatatgcagc

SEQ ID NO: 204560 - DNA, 75 bp, Artificial Sequence
  Synthetic
tattactagagccaagaaaggtattctttgtgtcatgtgtaatatgcagctttttgaggcgttacaatttacagc

SEQ ID NO: 204561 - DNA, 75 bp, Artificial Sequence
  Synthetic
tatgataagagtgctggctatccatttaacaaatttggaaaagccaggctctattatgaagcattatcatttgag

SEQ ID NO: 204562 - DNA, 75 bp, Artificial Sequence
  Synthetic
agccaactttgagctcacttgtctccgatactttgcaaaagtaggtcgtgagatctcttgtaatgtgtgcactaa

SEQ ID NO: 204563 - DNA, 75 bp, Artificial Sequence
  Synthetic
aaattgcagtgtactactaatttatttaaagattgtagcaagagctatgttggctaccatccagctcatgctcct

SEQ ID NO: 204564 - DNA, 75 bp, Artificial Sequence
  Synthetic
ctaagcgtaatgtcctgccaacacttactcaaatgaatttgaaatatgctattagtgctaagaatagagcccgca

SEQ ID NO: 204565 - DNA, 75 bp, Artificial Sequence
  Synthetic
ttaaagattgtagcaagagctatgttggctaccatccagctcatgctccttcgtttttagcagtggatgaaaagt

SEQ ID NO: 204566 - DNA, 75 bp, Artificial Sequence
  Synthetic
attagtgctaagaatagagcccgcactgttgctggtgtttccatacttagtactatgactggcagaatgtttcat

SEQ ID NO: 204567 - DNA, 75 bp, Artificial Sequence
  Synthetic
ttgccttggagtaggtgattcctctgtaacatattcaagactaatatcactcatgggttttaagttagatttgac

SEQ ID NO: 204568 - DNA, 75 bp, Artificial Sequence
  Synthetic
gtaacatattcaagactaatatcactcatgggttttaagttagatttgacacttgagggatattgtaagttattt

SEQ ID NO: 204569 - DNA, 75 bp, Artificial Sequence
  Synthetic
gtgttagagcatgggttgggttcgatgctgaaggcgctcatgctacgcgtgacaacatagggactaacttcccac

SEQ ID NO: 204570 - DNA, 75 bp, Artificial Sequence
  Synthetic
tgctgaaggcgctcatgctacgcgtgacaacatagggactaacttcccacttcaattagggttttccactggaat

SEQ ID NO: 204571 - DNA, 75 bp, Artificial Sequence
  Synthetic
ggtgttctgattcaaaattctgcaaagcatgtgcagggtaatgttgctaaaatagctggtgtttcctgtatatgg

SEQ ID NO: 204572 - DNA, 75 bp, Artificial Sequence
  Synthetic
caaagcgataggttttatcgacttgcgaatgaatgcgcacaagttttgagtgaaattgttatgtgtggtggctgt

SEQ ID NO: 204573 - DNA, 75 bp, Artificial Sequence
  Synthetic
ttgttctctgagagagatggttacagttttaaaaaggctgtggcgaaagctccaccaggcgaacaatttaagcac

SEQ ID NO: 204574 - DNA, 75 bp, Artificial Sequence
  Synthetic
gattgcctgtgtcaaagattttgattttaagttctatgatgcccaaccaattgttaagtctgtcaagactctttt

SEQ ID NO: 204575 - DNA, 75 bp, Artificial Sequence
  Synthetic
gttttaaaaaggctgtggcgaaagctccaccaggcgaacaatttaagcaccttatccctttgatgactagaggtc

SEQ ID NO: 204576 - DNA, 75 bp, Artificial Sequence
  Synthetic
aatagtacaaatgttttcagatcatttagttgatctgtctgatagcgttgtacttgttacatgggctgccagctt

SEQ ID NO: 204577 - DNA, 75 bp, Artificial Sequence
  Synthetic
ttagttgatctgtctgatagcgttgtacttgttacatgggctgccagctttgagctcacttgtctccgatacttt

SEQ ID NO: 204578 - DNA, 75 bp, Artificial Sequence
  Synthetic
gtaatgtgtgtactaaccgtgccacagtttataattctagaactggttactatggctgctggcgtcatagtgttt

SEQ ID NO: 204579 - DNA, 75 bp, Artificial Sequence
  Synthetic
tagtttgtatgttaataaacatgcattccacactaaacccttttctagggcagcctttgagcatttgaagcctat

SEQ ID NO: 204580 - DNA, 75 bp, Artificial Sequence
  Synthetic
tttttaaataagcattttagtatgatgattttgagtgatgatggggttgtgtgttataattctgattatgcgtcc

SEQ ID NO: 204581 - DNA, 75 bp, Artificial Sequence
  Synthetic
tgattttgagtgatgatggggttgtgtgttataattctgattatgcgtccaaagggtatattgctaatataagtg

SEQ ID NO: 204582 - DNA, 75 bp, Artificial Sequence
  Synthetic
atgctaagcaggttgattatgtacctttgaaatccgccacttgcatcacaagatgcaatttaggtggtgcagttt

SEQ ID NO: 204583 - DNA, 75 bp, Artificial Sequence
  Synthetic
aaattggaatgtggagtatcccatcatttcaaatgagttaagtattaattcctcttgtaggacgttgcagcgtgt

SEQ ID NO: 204584 - DNA, 75 bp, Artificial Sequence
  Synthetic
agctggatgttttgtagatgatttgttaaagactgatagtgttcttttaatagaacgatttgtaagtcttgcaat

SEQ ID NO: 204585 - DNA, 75 bp, Artificial Sequence
  Synthetic
aacaggtatagtttgtgctacgatataggcaatccaaaggcgattgcttgtatcaaaggctatgattttaagttt

SEQ ID NO: 204586 - DNA, 75 bp, Artificial Sequence
  Synthetic
tatcaaaggctatgattttaagttttatgattctcaaccaattgttaagtctgttaagactttggtttattctta

SEQ ID NO: 204587 - DNA, 75 bp, Artificial Sequence
  Synthetic
tggtgacagtttggttaatgtaatctaaactttaaaaatggcagtcgcttatgcagacaagcctaatcactttat

SEQ ID NO: 204588 - DNA, 75 bp, Artificial Sequence
  Synthetic
ttcgtgtttatttggcgtatataaagaagttgtacaatgacctgggtaatcagatcttggatagctacagtgtta

SEQ ID NO: 204589 - DNA, 75 bp, Artificial Sequence
  Synthetic
gaaaatgaagaataccaaaaggtttttcgtgtttatttggcgtatataaagaagttgtacaatgacctgggtaat

SEQ ID NO: 204590 - DNA, 75 bp, Artificial Sequence
  Synthetic
cagatcttggatagctacagtgttattttaagtacttgtgatggacaaaagtttactgatgagtccttttacaag

SEQ ID NO: 204591 - DNA, 75 bp, Artificial Sequence
  Synthetic
tgcagttgtatgtagatttgacacgagagtgttgaacaatttaaatctgcctggctgtaatggtggaagtttgta

SEQ ID NO: 204592 - DNA, 75 bp, Artificial Sequence
  Synthetic
tgcagagtgttggagcttgcgtggtctgttcttctcaaacatcattacgttgtggcagttgcatcagaaagcctc

SEQ ID NO: 204593 - DNA, 75 bp, Artificial Sequence
  Synthetic
ggtgcatgatgagcctaagggtaagttttctaagaaggcttatgctttaattagagggtatcgtggtgttaaacc

SEQ ID NO: 204594 - DNA, 75 bp, Artificial Sequence
  Synthetic
aatcccttttctagggcagcctttgaatatttaaagcctatgccatttttttattattcagatacgccttgtgtg

SEQ ID NO: 204595 - DNA, 75 bp, Artificial Sequence
  Synthetic
aatatttaaagcctatgccatttttttattattcagatacgccttgtgtgtatatggatggcatggacaataagc

SEQ ID NO: 204596 - DNA, 75 bp, Artificial Sequence
  Synthetic
agaaagtagatggtgtgtatactaattttaaattgataggacacaccgtctgtgatattcttaatgctaagttgg

SEQ ID NO: 204597 - DNA, 75 bp, Artificial Sequence
  Synthetic
cgctacctgcatcactagatgtaatttaggtggcgctgtttgtctaaaacatgctgaagagtatcgtgaatacct

SEQ ID NO: 204598 - DNA, 75 bp, Artificial Sequence
  Synthetic
ttaggtggcgctgtttgtctaaaacatgctgaagagtatcgtgaataccttgaatcttataacacagctactaca

SEQ ID NO: 204599 - DNA, 75 bp, Artificial Sequence
  Synthetic
agacctttgatttttataatttgtggaacacattcaccaagctacaaagcttggagaatgttgtttataatttag

SEQ ID NO: 204600 - DNA, 75 bp, Artificial Sequence
  Synthetic
tcgtatagctagttgtaaatggaccgatgtggatgattacatactagctaatgaatgtacagagcgtttgaaatt

SEQ ID NO: 204601 - DNA, 75 bp, Artificial Sequence
  Synthetic
caaggtaatctggggagtaatgaacccggtaatgtcggtggtaatgatgctctggcaacctccactatctttaca

SEQ ID NO: 204602 - DNA, 75 bp, Artificial Sequence
  Synthetic
tcatgtgactatgcgtagtagttataccattaagggttcctttttatgcggatcttgtggatctgttggttatgt

SEQ ID NO: 204603 - DNA, 75 bp, Artificial Sequence
  Synthetic
gaacacattcaccaagctacaaagcttggagaatgttgtttataatttagtcaagactggatattatactggcca

SEQ ID NO: 204604 - DNA, 75 bp, Artificial Sequence
  Synthetic
actgaggaagcctttaagcagagttatgcatcagcaacaatacaagagattgttagtgagcgcgaattgattctc

SEQ ID NO: 204605 - DNA, 75 bp, Artificial Sequence
  Synthetic
ataaatgataaagtagtggctaagattgaacaggaggatgttgttgtttttactaataacacaacataccctact

SEQ ID NO: 204606 - DNA, 75 bp, Artificial Sequence
  Synthetic
tactaataacacaacataccctactaacattgctgttgaattgtttgccaaacgtagtattcggcaccaccctga

SEQ ID NO: 204607 - DNA, 75 bp, Artificial Sequence
  Synthetic
tcttgggagattggaaaagttaagccaccacttaataaaaattatgtttttactggctaccattttactaaaaat

SEQ ID NO: 204608 - DNA, 75 bp, Artificial Sequence
  Synthetic
caccacttaataaaaattatgtttttactggctaccattttactaaaaatggtaagacagttttaggtgagtatg

SEQ ID NO: 204609 - DNA, 75 bp, Artificial Sequence
  Synthetic
tggtgtgtattatcgcgccacaaccacttataagctatctgtaggagatgtttttgttttaacctctcattcagt

SEQ ID NO: 204610 - DNA, 75 bp, Artificial Sequence
  Synthetic
tagtctttcgatgattagaggtccaccacgtgctgaattaaatggcgtagtggtagataaagttggagacgcgta

SEQ ID NO: 204611 - DNA, 75 bp, Artificial Sequence
  Synthetic
ttcattcttgcaatctggtattgtgaaaatggtaaatcctacttctaaggtagaaccatgtgttgtcagtgttac

SEQ ID NO: 204612 - DNA, 75 bp, Artificial Sequence
  Synthetic
gttacatattcaagattaatatcactcatgggttttaaactggatgttacccttgatgggtattgtaagcttttt

SEQ ID NO: 204613 - DNA, 75 bp, Artificial Sequence
  Synthetic
accttgattatgttcaacacaagtgtggcaatttacaccaacgggagttgctaggtgtttcagatgtgtggcata

SEQ ID NO: 204614 - DNA, 75 bp, Artificial Sequence
  Synthetic
aaagaggggcaagatgtcatcttcagccaatctgacagctctaaccagagcccacaaggtaatctggggagtaat

SEQ ID NO: 204615 - DNA, 75 bp, Artificial Sequence
  Synthetic
ttgtgtgaaaaagcatataaatttttgaatataaatgattgcactcgtattgttcctgccaaggtcagggtggag

SEQ ID NO: 204616 - DNA, 75 bp, Artificial Sequence
  Synthetic
gtcggtggtaatgatgctctgacagtctctaccatctttacacaaagtcgtgttattagctcttttacatgtcga

SEQ ID NO: 204617 - DNA, 75 bp, Artificial Sequence
  Synthetic
accgacatggaaaaagattttatagctttagagcaagatgtgttcattcaaaagtatggtttagaggattatgcc

SEQ ID NO: 204618 - DNA, 75 bp, Artificial Sequence
  Synthetic
gacatcaatttttcccctgtattaggttgtttaggaagcgattgtaataaagtttccagtagatctgctatagag

SEQ ID NO: 204619 - DNA, 75 bp, Artificial Sequence
  Synthetic
gtgatcctgctcaattgccagcaccacgtgtgttattgagcaagggtacacttgaacctaaatattttaacactg

SEQ ID NO: 204620 - DNA, 75 bp, Artificial Sequence
  Synthetic
ttactaagctcatgtgttgcttagggccagacatttttcttggtacatgttatagatgtcctaaggaaatcgttg

SEQ ID NO: 204621 - DNA, 75 bp, Artificial Sequence
  Synthetic
gccagacatttttcttggtacatgttatagatgtcctaaggaaatcgttgatacagtgtccgccttggtttatga

SEQ ID NO: 204622 - DNA, 75 bp, Artificial Sequence
  Synthetic
gtacaatgtaagtaaagatggtttctttacatacatttgtcatatgattcgcgacaagttagctctgggtggcag

SEQ ID NO: 204623 - DNA, 75 bp, Artificial Sequence
  Synthetic
ttatgatctttatggtatttcaggccaaggcatttttgttgaggttaatgcgacttattataatagttggcagaa

SEQ ID NO: 204624 - DNA, 75 bp, Artificial Sequence
  Synthetic
agtagttcattgtgttttaaggtctattataagggcgttacaacacatgaaagttctagtgctgtaaatatgcag

SEQ ID NO: 204625 - DNA, 75 bp, Artificial Sequence
  Synthetic
cagatttatttgattaataagtttttgaaggctaaccctttgtggcataaagctgtttttattagcccatataat

SEQ ID NO: 204626 - DNA, 75 bp, Artificial Sequence
  Synthetic
aaatgaataggttacaggaggcaataaaagttttaaatcagagctacatcaatctcaaggacattggtacatatg

SEQ ID NO: 204627 - DNA, 75 bp, Artificial Sequence
  Synthetic
cagaaacagcgcattctgtaaatgttaatcgcttcaatgttgctattactcgagccaagaaaggtattctttgtg

SEQ ID NO: 204628 - DNA, 75 bp, Artificial Sequence
  Synthetic
gtattgcatactaagagtgcagcaggttatggtggttttggttgtaaagattcttttactctgtatggccaaact

SEQ ID NO: 204629 - DNA, 75 bp, Artificial Sequence
  Synthetic
tatagcggttatcacccagctcatgctccttcatttttggcagtagatgacaaatataaggcaactggcgattta

SEQ ID NO: 204630 - DNA, 75 bp, Artificial Sequence
  Synthetic
ctccttcatttttggcagtagatgacaaatataaggcaactggcgatttagccgtgtgtcttggtattggtgatt

SEQ ID NO: 204631 - DNA, 75 bp, Artificial Sequence
  Synthetic
tgctgaattatataagttaatgggttgttttgcattttggacggttttctgtacaaatgcaaatgcttcttctag

SEQ ID NO: 204632 - DNA, 75 bp, Artificial Sequence
  Synthetic
gtggagtgtttgaagtggatgatactgttgatatggaggaattttatgctgtggtgattgatgccatagaagaga

SEQ ID NO: 204633 - DNA, 75 bp, Artificial Sequence
  Synthetic
atgctcttgaagcgcaagctcagatagacagacttattaatgggcgtcttaccgctcttaatgcttatgtttctc

SEQ ID NO: 204634 - DNA, 75 bp, Artificial Sequence
  Synthetic
tgttttgcattttggacggttttctgtacaaatgcaaatgcttcttctagtgagggatttttaattggcataaat

SEQ ID NO: 204635 - DNA, 75 bp, Artificial Sequence
  Synthetic
ttatttgttttggagaaattctacagtttggaatgggggttcttatagcctctttgatatggctaaattcccact

SEQ ID NO: 204636 - DNA, 75 bp, Artificial Sequence
  Synthetic
ctggtttgtttgctgatagagatggttacagctttaaaaaggctgtggcgaaagctcctcctggtgaacaattta

SEQ ID NO: 204637 - DNA, 75 bp, Artificial Sequence
  Synthetic
aatttgagagcagaccagatcaatgatatggtttactcacttttagagaagggtaaactacttattcgagataca

SEQ ID NO: 204638 - DNA, 75 bp, Artificial Sequence
  Synthetic
tgttgaagaagatgatgtagaaggtgaggaaactgatttaactgtcacaagtgctggacagccttgtgttgctag

SEQ ID NO: 204639 - DNA, 75 bp, Artificial Sequence
  Synthetic
aggtcatcgctgggatgttgttagacctagaatagtacaaatgtttgcagatcatttaattgatctgtctgattg

SEQ ID NO: 204640 - DNA, 75 bp, Artificial Sequence
  Synthetic
cctagaatagtacaaatgtttgcagatcatttaattgatctgtctgattgtgttgtgctagttacatgggcagcc

SEQ ID NO: 204641 - DNA, 75 bp, Artificial Sequence
  Synthetic
atcaccggctagacttgaaatagttaagcttggtgctgaaaagaaagatggtttttatgaaaccatagctagcca

SEQ ID NO: 204642 - DNA, 75 bp, Artificial Sequence
  Synthetic
aattttaaaatgtctgtcgcttacgcagataggcccactcattttattaattttccattaatctcctttgaggga

SEQ ID NO: 204643 - DNA, 75 bp, Artificial Sequence
  Synthetic
atatggtttactcacttttagagaagggtaaactacttattcgagatacaagcaaagaagtttttgttggagata

SEQ ID NO: 204644 - DNA, 75 bp, Artificial Sequence
  Synthetic
cagataggcccactcattttattaattttccattaatctcctttgagggattcatgttaaattttaaagatttgc

SEQ ID NO: 204645 - DNA, 75 bp, Artificial Sequence
  Synthetic
gttactatggttgttggcgccatagtgttacatgtgattacttgtataatccacttattgttgatattcaacagt

SEQ ID NO: 204646 - DNA, 75 bp, Artificial Sequence
  Synthetic
cgactgcaaattgcaaatggtgccccacgttagtcttgcaatgcttgacattgttcaagaccaaatcaaatgtgt

SEQ ID NO: 204647 - DNA, 75 bp, Artificial Sequence
  Synthetic
cacgttagtcttgcaatgcttgacattgttcaagaccaaatcaaatgtgtggataccagtttgcaacaagttata

SEQ ID NO: 204648 - DNA, 75 bp, Artificial Sequence
  Synthetic
agattgtaattgtttggggttttatgaatcttcagttgaagaagactaaactcagtgaaaatgtttttgcttcct

SEQ ID NO: 204649 - DNA, 75 bp, Artificial Sequence
  Synthetic
tccacattaattttggaaatccaaaaatcctaggcagatgtgttgttttggaagttaaaggtttagaagaattgc

SEQ ID NO: 204650 - DNA, 75 bp, Artificial Sequence
  Synthetic
aatattaattggaatgtggagtatcccatcatttcaaatgagttaagtattaatacctcttgtagggtcttgcag

SEQ ID NO: 204651 - DNA, 75 bp, Artificial Sequence
  Synthetic
atggtgaaatagaaagaagtatcagtgagaaaggttgtgtaattggtcagtcccgtccttggattgcccactgta

SEQ ID NO: 204652 - DNA, 75 bp, Artificial Sequence
  Synthetic
tcccgtccttggattgcccactgtactattgcacaactcactgatgcggctctagtcataaatgagaatttagat

SEQ ID NO: 204653 - DNA, 75 bp, Artificial Sequence
  Synthetic
acagtcgttcagattgtaatcatgttgttactaccaacccccgtaattattcttatatggaccttaatcctgcct

SEQ ID NO: 204654 - DNA, 75 bp, Artificial Sequence
  Synthetic
tctgcaacagatatactttgtgttatgatattggcaacccaaaagcgattgcctgtgtcaaagattttgatttta

SEQ ID NO: 204655 - DNA, 75 bp, Artificial Sequence
  Synthetic
ataccataactatcacccctgcttcacattctaggcttgaattagtcaagattggtgcagaaaagaaagatggtt

SEQ ID NO: 204656 - DNA, 75 bp, Artificial Sequence
  Synthetic
acattctaggcttgaattagtcaagattggtgcagaaaagaaagatggtttttataagagtgttgttagccattg

SEQ ID NO: 204657 - DNA, 75 bp, Artificial Sequence
  Synthetic
ttgtgccgcaggagaattatagtagtattagatttgctagtgtttatagtgtgcttgagacgtttcagaacaatg

SEQ ID NO: 204658 - DNA, 75 bp, Artificial Sequence
  Synthetic
ccgcccacagacaagctagcaatgattatgggttattgttgtttagaaaagataagagaagagcttgatggagaa

SEQ ID NO: 204659 - DNA, 75 bp, Artificial Sequence
  Synthetic
ttatgggttattgttgtttagaaaagataagagaagagcttgatggagaagattttccccagcatgatgatgatg

SEQ ID NO: 204660 - DNA, 75 bp, Artificial Sequence
  Synthetic
tgaaaataacctttggttttacaggcatgtctatagaaatagtagttattttagacttgtctgcaagttgaaaga

SEQ ID NO: 204661 - DNA, 75 bp, Artificial Sequence
  Synthetic
catgtctatagaaatagtagttattttagacttgtctgcaagttgaaagattgtatttgtatgggttatgattct

SEQ ID NO: 204662 - DNA, 75 bp, Artificial Sequence
  Synthetic
agttaaaatgtatttgttgctgaaatttttggctatacttgttgcaggttcttatggttttcaaaacccgcctgt

SEQ ID NO: 204663 - DNA, 75 bp, Artificial Sequence
  Synthetic
tttttggctatacttgttgcaggttcttatggttttcaaaacccgcctgtcaacatagtatctcatgttaatgag

SEQ ID NO: 204664 - DNA, 75 bp, Artificial Sequence
  Synthetic
gcttcactgatctcttgttagatcttttcataatctaaactttataaaaacatccactccctgtagtctatgcct

SEQ ID NO: 204665 - DNA, 75 bp, Artificial Sequence
  Synthetic
ctacagcaggttttactttttgggtctataagacatttgatttttataatttgtggaatacgttcaccaagctac

SEQ ID NO: 204666 - DNA, 75 bp, Artificial Sequence
  Synthetic
ctataagacatttgatttttataatttgtggaatacgttcaccaagctacaaagcttggagaatgttgtatataa

SEQ ID NO: 204667 - DNA, 75 bp, Artificial Sequence
  Synthetic
gttctgactgtaaccatataaacacaatcaatcctcgtaattattcttatatggaccttaatcctgcgttgtgta

SEQ ID NO: 204668 - DNA, 75 bp, Artificial Sequence
  Synthetic
aatcaatcctcgtaattattcttatatggaccttaatcctgcgttgtgtaattctggtaagatttcttctaaagc

SEQ ID NO: 204669 - DNA, 75 bp, Artificial Sequence
  Synthetic
ggtgatttgatagcacaatcttcaggtgttttgcctgttaatcctgtattgcatactaagagtgcagcaggttat

SEQ ID NO: 204670 - DNA, 75 bp, Artificial Sequence
  Synthetic
cactttacagatttttacaactatactggagaaggccagcaaattatattttatgagggtgttaattttactcct

SEQ ID NO: 204671 - DNA, 75 bp, Artificial Sequence
  Synthetic
aatcatggctttaaatgcaccgcttctggtgataatgccgtttggatgcaaaataaagcccggttttatgatatt

SEQ ID NO: 204672 - DNA, 75 bp, Artificial Sequence
  Synthetic
ccagagcttaagctctttagaaatttaaatatagacgtgtgctggaagcacgtcatttgggattatgctagagaa

SEQ ID NO: 204673 - DNA, 75 bp, Artificial Sequence
  Synthetic
tgatcttatttctaagtgtcagataactgctgttgagggcactaagaaattggcagcgcgtctttcttttaatgt

SEQ ID NO: 204674 - DNA, 75 bp, Artificial Sequence
  Synthetic
gcagtcttacttttaagaccgttgcttacaattatagtggtactgctgttgctactaatttgtgtaagcaaagtt

SEQ ID NO: 204675 - DNA, 75 bp, Artificial Sequence
  Synthetic
gtgtctgcatatatacagatttaaagttcattgataaattgaatgtcctttttgatggtcgtgataatggtgctc

SEQ ID NO: 204676 - DNA, 75 bp, Artificial Sequence
  Synthetic
ctttgactatgaataaccccactatcatagctagggagagtgggcttacagattattattatactagcacagcta

SEQ ID NO: 204677 - DNA, 75 bp, Artificial Sequence
  Synthetic
ctctctacccctatggcagatgccctactgctgctgatattaatacccctgatgtacctatttgtgtgtatgatc

SEQ ID NO: 204678 - DNA, 75 bp, Artificial Sequence
  Synthetic
gattattattatactagcacagctaatttttcattgcagggctgtgatgagtatatagttccgctatgttatttt

SEQ ID NO: 204679 - DNA, 75 bp, Artificial Sequence
  Synthetic
ttgaagcttttaaacgttctaataatggcgtttacatttccacgacaaaagttaagagtctttcgatgataagag

SEQ ID NO: 204680 - DNA, 75 bp, Artificial Sequence
  Synthetic
atttttcattgcagggctgtgatgagtatatagttccgctatgttattttaatggtaagtttctttccagtagca

SEQ ID NO: 204681 - DNA, 75 bp, Artificial Sequence
  Synthetic
ttttaatattgatactggtgaagtatttggttttaactcaacccgtcccactgagtatggtattgattttaattg

SEQ ID NO: 204682 - DNA, 75 bp, Artificial Sequence
  Synthetic
tttggttttaactcaacccgtcccactgagtatggtattgattttaattgtttttattatagagtgccctctggt

SEQ ID NO: 204683 - DNA, 75 bp, Artificial Sequence
  Synthetic
aaagccttgtttttggataaagtggacatcttgctaactgttgatggtgttaatttcactaataggtttgtgcct

SEQ ID NO: 204684 - DNA, 75 bp, Artificial Sequence
  Synthetic
tgatgttaacagttccgtctaagatcatttgtttgtccaagcctaaggattttactcctgttcaggttgttgact

SEQ ID NO: 204685 - DNA, 75 bp, Artificial Sequence
  Synthetic
ttctattagcactgatactgtcgatgttactaatggtttaggtacttattatgttttagatcgtgtgtatttaaa

SEQ ID NO: 204686 - DNA, 75 bp, Artificial Sequence
  Synthetic
atgtcgtactgatatggaaaaagattttatagctttagatcaagatgtgtttattcagaagtatggtttggagga

SEQ ID NO: 204687 - DNA, 75 bp, Artificial Sequence
  Synthetic
catttgtttgtccaagcctaaggattttactcctgttcaggttgttgactctagatggaattcagccaggcgttc

SEQ ID NO: 204688 - DNA, 75 bp, Artificial Sequence
  Synthetic
caattgccgtactgttattttcgtaattctacctcagattataaaggggtttatgatattaaccatggtgatgct

SEQ ID NO: 204689 - DNA, 75 bp, Artificial Sequence
  Synthetic
aaatgttcagtatcgtattaatgggattggtgttaccatggatgtgctaagtcaaaatcaaaagcttattgctaa

SEQ ID NO: 204690 - DNA, 75 bp, Artificial Sequence
  Synthetic
attctacctcagattataaaggggtttatgatattaaccatggtgatgctggttttaccagtatactcagtggtt

SEQ ID NO: 204691 - DNA, 75 bp, Artificial Sequence
  Synthetic
gttactaatggtttaggtacttattatgttttagatcgtgtgtatttaaatactacgttgttgcttaatggttac

SEQ ID NO: 204692 - DNA, 75 bp, Artificial Sequence
  Synthetic
gtaattttaatatgagcagcctgatgtcttttattcaggcagactcatttacttgtaataatattgatgctgcta

SEQ ID NO: 204693 - DNA, 75 bp, Artificial Sequence
  Synthetic
atggcagggtgtttacagatttgataatgttagtactgtttggcccctatacccttttggtaaatgccctactgc

SEQ ID NO: 204694 - DNA, 75 bp, Artificial Sequence
  Synthetic
cacacctgtgcacatataagcgtggttttcttgacaggataagcgatactagtggttttgctgtttatgttaagt

SEQ ID NO: 204695 - DNA, 75 bp, Artificial Sequence
  Synthetic
aatgttagtactgtttggcccctatacccttttggtaaatgccctactgctgctaatcttgcgaatgttgatggt

SEQ ID NO: 204696 - DNA, 75 bp, Artificial Sequence
  Synthetic
ccattatattgcttggcgttttgttgggtctggctgtcataattattatagcactcctattttattttatggtgg

SEQ ID NO: 204697 - DNA, 75 bp, Artificial Sequence
  Synthetic
gggtctggctgtcataattattatagcactcctattttattttatggtggataatggtactaggcttcatgaagc

SEQ ID NO: 204698 - DNA, 75 bp, Artificial Sequence
  Synthetic
tattacttttatttttcctacctaccgcttttgctgttgtaggagatgtaaaatgtactactataggtgttaacg

SEQ ID NO: 204699 - DNA, 75 bp, Artificial Sequence
  Synthetic
gcagatgcagttgtaaatgctttttatggtgttgatttgaaagattgtggttttgttatgcagtttggttatatt

SEQ ID NO: 204700 - DNA, 75 bp, Artificial Sequence
  Synthetic
aagtactgagactgttgatgttactaacggtcttggcacttattatgtgcttgatcgtgtttatttaaataccac

SEQ ID NO: 204701 - DNA, 75 bp, Artificial Sequence
  Synthetic
atgaatgttgctaagtatacccagttatgtcaatatctgaatactacaacattagctgtacctgttaatatgcga

SEQ ID NO: 204702 - DNA, 75 bp, Artificial Sequence
  Synthetic
aacggtcttggcacttattatgtgcttgatcgtgtttatttaaataccacattgttgctcaatggctattatccc

SEQ ID NO: 204703 - DNA, 75 bp, Artificial Sequence
  Synthetic
ttgatcgtgtttatttaaataccacattgttgctcaatggctattatcccacttctggtgccaattatcgcaatt

SEQ ID NO: 204704 - DNA, 75 bp, Artificial Sequence
  Synthetic
atattgggttacacccctcacttctaaacaatatctactagctttcaatcaagatggtgttatttttaatgctgt

SEQ ID NO: 204705 - DNA, 75 bp, Artificial Sequence
  Synthetic
aaacaatatctactagctttcaatcaagatggtgttatttttaatgctgttgattgtaagagtgattttatgagt

SEQ ID NO: 204706 - DNA, 75 bp, Artificial Sequence
  Synthetic
gagcaccttatggtataagccaccctttttgtccgagtttaatgatggtgttttcgctaaggtcaagaataccaa

SEQ ID NO: 204707 - DNA, 75 bp, Artificial Sequence
  Synthetic
tttttgtccgagtttaatgatggtgttttcgctaaggtcaagaataccaaagtaactaaaaatggtattgtctat

SEQ ID NO: 204708 - DNA, 75 bp, Artificial Sequence
  Synthetic
tatacccatttgtgagtgacagtgtcgctacatattttggggattgtataaccttaccctttgattgtcaatggg

SEQ ID NO: 204709 - DNA, 75 bp, Artificial Sequence
  Synthetic
ggtactattcttgtagataatgatttatacccatttgtgagtgacagtgtcgctacatattttggggattgtata

SEQ ID NO: 204710 - DNA, 75 bp, Artificial Sequence
  Synthetic
gtactacatttgttaatacctcttatactgttgttgtgcaacctaggactaccgttgttaattctaaattacaag

SEQ ID NO: 204711 - DNA, 75 bp, Artificial Sequence
  Synthetic
ccctattactaagaacataggggagtacaatgtgagtaaagatggtttctttacatacatttgtcatatgattcg

SEQ ID NO: 204712 - DNA, 75 bp, Artificial Sequence
  Synthetic
gattgtctgtatcttaaaaatttgaaacaaacttttaaatcggtgttaaccacctattatttggatgatgttaag

SEQ ID NO: 204713 - DNA, 75 bp, Artificial Sequence
  Synthetic
tactgttgttgtgcaacctaggactaccgttgttaattctaaattacaaggtcttttggagattactatttgtca

SEQ ID NO: 204714 - DNA, 75 bp, Artificial Sequence
  Synthetic
agacaagttagctctgggtggcagtgttgctataaaaataacagagttttcttggaatgcagaattatataagtt

SEQ ID NO: 204715 - DNA, 75 bp, Artificial Sequence
  Synthetic
actgtttgcaacagtggtattgggtcaccacgcaaagagttgtggcattatgagaaggctgtggcctcctgttta

SEQ ID NO: 204716 - DNA, 75 bp, Artificial Sequence
  Synthetic
caccacgcaaagagttgtggcattatgagaaggctgtggcctcctgtttatatcggcgtaattttacgtacgatg

SEQ ID NO: 204717 - DNA, 75 bp, Artificial Sequence
  Synthetic
aatggggtattttgcattttggactgtgttttgcacaaatgcaaatgcttcttctagtgaaggatttttaattgg

SEQ ID NO: 204718 - DNA, 75 bp, Artificial Sequence
  Synthetic
aatagtattgccaatggacaagaggaggcatcagaagtcttagatatagttgaggttgaagattctatggaagca

SEQ ID NO: 204719 - DNA, 75 bp, Artificial Sequence
  Synthetic
tttttaccaacagggtggtactttttatgcttattatacagatagtggttttattaccactttcttgtttaatat

SEQ ID NO: 204720 - DNA, 75 bp, Artificial Sequence
  Synthetic
tatgcttattatacagatagtggttttattaccactttcttgtttaatatttaccttggtacaagtttatcgcat

SEQ ID NO: 204721 - DNA, 75 bp, Artificial Sequence
  Synthetic
gtttctgcggcctttcatgctaactcttccgaaccagcattgctatttcggaatattaaatgcaactacgttttt

SEQ ID NO: 204722 - DNA, 75 bp, Artificial Sequence
  Synthetic
tatagaattgatactactgctacaagttgtcagttgtattataatttacctgctgctaatgtttctgttagcagg

SEQ ID NO: 204723 - DNA, 75 bp, Artificial Sequence
  Synthetic
tatagcctgtttgatatggctaaattcccgcttaagttggctggtactgccgtaataaatttaagagcagaccag

SEQ ID NO: 204724 - DNA, 75 bp, Artificial Sequence
  Synthetic
gtggtaagttagacctgcaatattgggttacaccactcactaatagacagtttttgttggtatttaatcaggatg

SEQ ID NO: 204725 - DNA, 75 bp, Artificial Sequence
  Synthetic
cgtaataaatttaagagcagaccagattaatgatatggtttattcccttcttgaaaagggtaaactacttattag

SEQ ID NO: 204726 - DNA, 75 bp, Artificial Sequence
  Synthetic
ggttacaccactcactaatagacagtttttgttggtatttaatcaggatggcattatttataatgcagttgattg

SEQ ID NO: 204727 - DNA, 75 bp, Artificial Sequence
  Synthetic
agagttggccaaagtgcagaatttatctgggaatcctgacgagccccagaaggatgtttatgaattgcgctataa

SEQ ID NO: 204728 - DNA, 75 bp, Artificial Sequence
  Synthetic
aagtgtaatacccaaaatgtgaaacctagtacaggtgtttatgatttaactggttacactgttcaacctatagct

SEQ ID NO: 204729 - DNA, 75 bp, Artificial Sequence
  Synthetic
ctagtacaggtgtttatgatttaactggttacactgttcaacctatagctgatgtgtaccggcgtattcctaatt

SEQ ID NO: 204730 - DNA, 75 bp, Artificial Sequence
  Synthetic
gcttagtgctcctactgttgcatctcctcttaattgggagcgtaggacgttctctaattgtaattttaatatgag

SEQ ID NO: 204731 - DNA, 75 bp, Artificial Sequence
  Synthetic
cctcttaattgggagcgtaggacgttctctaattgtaattttaatatgagcagcctgctgagtttcattcaggct

SEQ ID NO: 204732 - DNA, 75 bp, Artificial Sequence
  Synthetic
gctacagggccttacaagtgcccccaaactaaatatttagttggtataggtgagcactgttcgggtcttgctatt

SEQ ID NO: 204733 - DNA, 75 bp, Artificial Sequence
  Synthetic
catacagcctgaagactataaaagtgttgatgtcgctattcaagaagttattgatgatatgcattggggtgatgg

SEQ ID NO: 204734 - DNA, 75 bp, Artificial Sequence
  Synthetic
atgctgctaaattgtatggtatgtgttttggcagtgttactattgataaatttgctatacctaatagcaggaagg

SEQ ID NO: 204735 - DNA, 75 bp, Artificial Sequence
  Synthetic
cttgtagttgccaaccacaagcatttttgggttggtctgttgactcttgtttacaaggggataggtgtaatattt

SEQ ID NO: 204736 - DNA, 75 bp, Artificial Sequence
  Synthetic
ttatttacagtcctttaattatagaatagataccacagccactagctgtcaattatattatagtttgggtgctga

SEQ ID NO: 204737 - DNA, 75 bp, Artificial Sequence
  Synthetic
ttataaacagcatgcaattcaattataaaatcaccatcaacccctcatcaccggctagacttgaaatagttaagc

SEQ ID NO: 204738 - DNA, 75 bp, Artificial Sequence
  Synthetic
ccttctgcctggaataggcggtatggttttaatgatacaatgtttaagcctcagcctgcaggtttttttactaac

SEQ ID NO: 204739 - DNA, 75 bp, Artificial Sequence
  Synthetic
tcagcctgcaggtttttttactaaccatgatgtggtttattcaaaacagtgctttaaggttcctaacacatattg

SEQ ID NO: 204740 - DNA, 75 bp, Artificial Sequence
  Synthetic
ttataaaatcaccatcaacccctcatcaccggctagacttgaaatagttaagctcggtgctgaaaagaaagatgg

SEQ ID NO: 204741 - DNA, 75 bp, Artificial Sequence
  Synthetic
tgtgtaggcaatggtgtttctgctggagtcagtggtactaccactggctctggcacttgtcctttaggtacatct

SEQ ID NO: 204742 - DNA, 75 bp, Artificial Sequence
  Synthetic
caattacgtttttaataacactctttcacgacagctgcaacctattaactattttgatagctatcttggttgtgt

SEQ ID NO: 204743 - DNA, 75 bp, Artificial Sequence
  Synthetic
tatcgcacttgttttaatcctatacaatgtgcatgcacttgtgatcctgagcctattaatgcaattttaacctct

SEQ ID NO: 204744 - DNA, 75 bp, Artificial Sequence
  Synthetic
agtctcttgttggtcttggagagcattgctcaggtttaggtatacatgaagatttttgcggaggctcaccttgtt

SEQ ID NO: 204745 - DNA, 75 bp, Artificial Sequence
  Synthetic
ttgctcaggtttaggtatacatgaagatttttgcggaggctcaccttgttcttgtccagccaatgcctttatggc

SEQ ID NO: 204746 - DNA, 75 bp, Artificial Sequence
  Synthetic
gatggacgctgcaatattttttccaatttaattttaaatgatgttaatagtggtgctacttgttctactgattta

SEQ ID NO: 204747 - DNA, 75 bp, Artificial Sequence
  Synthetic
tggtgctacttgttctactgatttacaacggtccaatactgagatcgttgttggtgtttgtgtcaaatatgactt

SEQ ID NO: 204748 - DNA, 75 bp, Artificial Sequence
  Synthetic
gttctgcttttgtttgtggtgattatgcagcatgtaaatcacagttggttgaatatggtagcttctgtgacaata

SEQ ID NO: 204749 - DNA, 75 bp, Artificial Sequence
  Synthetic
tttattgaggttaatgccacttattataatagttggcagaacctcctttatgactctaatggtaatctctatggt

SEQ ID NO: 204750 - DNA, 75 bp, Artificial Sequence
  Synthetic
ataatagttggcagaacctcctttatgactctaatggtaatctctatggttttagggattaccttactaatagaa

SEQ ID NO: 204751 - DNA, 75 bp, Artificial Sequence
  Synthetic
aaagctggcaactccatttttaggagttttcactttaccgatttttataattacacaggcgaaggtcaacaaatt

SEQ ID NO: 204752 - DNA, 75 bp, Artificial Sequence
  Synthetic
aggtagagtttcagccgcttaccactctgatgcatctgagccagctcttttgtatcgtaatttaaaatgcaacta

SEQ ID NO: 204753 - DNA, 75 bp, Artificial Sequence
  Synthetic
tctgatgcatctgagccagctcttttgtatcgtaatttaaaatgcaactacgtttttaataatactattgctaga

SEQ ID NO: 204754 - DNA, 75 bp, Artificial Sequence
  Synthetic
atgcagaataaaggcttgttttatactcaggtttataagaatatggctgtgtatcgcagccttacttttgttaat

SEQ ID NO: 204755 - DNA, 75 bp, Artificial Sequence
  Synthetic
atagttttttaggttgcattgttaatgctgataatagcacttctagtgtagtggatacttgcgtgttaaccatgg

SEQ ID NO: 204756 - DNA, 75 bp, Artificial Sequence
  Synthetic
tgctgataatagcacttctagtgtagtggatacttgcgtgttaaccatgggaagtggttattgtgttgattattc

SEQ ID NO: 204757 - DNA, 75 bp, Artificial Sequence
  Synthetic
tacaagctagagctttttgtaaacctggtactttagtccttaataaccctgcatatatagctcctcaagctaact

SEQ ID NO: 204758 - DNA, 75 bp, Artificial Sequence
  Synthetic
ccgacaagtgcccaaggggaagagccagcatgttaagttaccacccagtaattagtaaatgaatgaagttaatta

SEQ ID NO: 204759 - DNA, 75 bp, Artificial Sequence
  Synthetic
gcctccactgctctcagaaaatcagatcagtggatacactttggctgccacctctgctagcctgtttcctccatg

SEQ ID NO: 204760 - DNA, 75 bp, Artificial Sequence
  Synthetic
ccttctactggatatcgtctcaccaattttgagccattcaatgttagattggtgaatgatagtgtagaacctgtt

SEQ ID NO: 204761 - DNA, 75 bp, Artificial Sequence
  Synthetic
agctgatttttatttgtcaggttgtgacgagtatatcgtaccactttgtatttttaacggcaagtttttgtcgaa

SEQ ID NO: 204762 - DNA, 75 bp, Artificial Sequence
  Synthetic
attttgagccattcaatgttagattggtgaatgatagtgtagaacctgttggtggtttgtatgaaattcagatcc

SEQ ID NO: 204763 - DNA, 75 bp, Artificial Sequence
  Synthetic
cggccagccatgcagctgttgacgcattgtgtgaaaaagcatataaatttttgaatataaatgattgcactcgta

SEQ ID NO: 204764 - DNA, 75 bp, Artificial Sequence
  Synthetic
tttttaacggcaagtttttgtcgaatacaaagtattatgattatagtcaatattattttaataaagacactggtg

SEQ ID NO: 204765 - DNA, 75 bp, Artificial Sequence
  Synthetic
tgaggagttcattcaaactaactcccctaaggttactattgattgtgcggcatttgtttgtggtgactatgctgc

SEQ ID NO: 204766 - DNA, 75 bp, Artificial Sequence
  Synthetic
cctaaggttactattgattgtgcggcatttgtttgtggtgactatgctgcttgtagagaacagttggttgagtat

SEQ ID NO: 204767 - DNA, 75 bp, Artificial Sequence
  Synthetic
aaccattaccactggttttgattttaattgtcattatttagttttaccctctggtaattatttagccatttcaaa

SEQ ID NO: 204768 - DNA, 75 bp, Artificial Sequence
  Synthetic
ctatactcacagaagtaaatgacctacttgatactacccagtttcaggtagctaatagtttaatgaatggtgtca

SEQ ID NO: 204769 - DNA, 75 bp, Artificial Sequence
  Synthetic
aaagcaatctgtcttaataagcgtaaggattttacgcctgtacaggttgttgattcgcggtggaacaatgccagg

SEQ ID NO: 204770 - DNA, 75 bp, Artificial Sequence
  Synthetic
tgagctattgttaactgttccaacgaaagcaatctgtcttaataagcgtaaggattttacgcctgtacaggttgt

SEQ ID NO: 204771 - DNA, 75 bp, Artificial Sequence
  Synthetic
aggattttacgcctgtacaggttgttgattcgcggtggaacaatgccaggcagtctgataacatgacggcggttg

SEQ ID NO: 204772 - DNA, 75 bp, Artificial Sequence
  Synthetic
acttgatactacccagtttcaggtagctaatagtttaatgaatggtgtcactctaagctctaggcttaagactgg

SEQ ID NO: 204773 - DNA, 75 bp, Artificial Sequence
  Synthetic
aatttttcttctgttttgggttgtgtaggcagtgattgtaatactgtctcaagtagatccgctatagaggactta

SEQ ID NO: 204774 - DNA, 75 bp, Artificial Sequence
  Synthetic
taggcagtgattgtaatactgtctcaagtagatccgctatagaggacttacttttcaataaagtaaggttgtctg

SEQ ID NO: 204775 - DNA, 75 bp, Artificial Sequence
  Synthetic
attatatcattagtgcagaatgctccatatggtttgtattttatccactttagctatgtccctactaagtatgtc

SEQ ID NO: 204776 - DNA, 75 bp, Artificial Sequence
  Synthetic
taattgtacaggaggtgccgaaattagggatctcctttgtgtacaaacttttaatggaattaaagttttaccacc

SEQ ID NO: 204777 - DNA, 75 bp, Artificial Sequence
  Synthetic
catatggtttgtattttatccactttagctatgtccctactaagtatgtcacagcgaaggttagtcccggtctgt

SEQ ID NO: 204778 - DNA, 75 bp, Artificial Sequence
  Synthetic
agggatctcctttgtgtacaaacttttaatggaattaaagttttaccacctgttttgtctgaaaatcagattagt

SEQ ID NO: 204779 - DNA, 75 bp, Artificial Sequence
  Synthetic
ctagtctctttccaccatggactgcggctgcaggtattcctttttatttaaatgttcagtatcgtataaatggac

SEQ ID NO: 204780 - DNA, 75 bp, Artificial Sequence
  Synthetic
ggctgcaggtattcctttttatttaaatgttcagtatcgtataaatggactcggtgtaactatggatgtactgag

SEQ ID NO: 204781 - DNA, 75 bp, Artificial Sequence
  Synthetic
ttgtagttttgttgttatattttatggtggataatgttactaggctgcatgatgcttagaccataatctaaacat

SEQ ID NO: 204782 - DNA, 75 bp, Artificial Sequence
  Synthetic
atgagtacctgtgctgttaattatactaaagcgccggatgtaatgctgaacatttcaacacccaacctccctgat

SEQ ID NO: 204783 - DNA, 75 bp, Artificial Sequence
  Synthetic
gcatttaacaatgcccttggtgctattcagaatgggtttgatgctaccaattctgctttagtcaagattcaggct

SEQ ID NO: 204784 - DNA, 75 bp, Artificial Sequence
  Synthetic
ttcagaatgggtttgatgctaccaattctgctttagtcaagattcaggctgttgttaatgctaatgcagaagcat

SEQ ID NO: 204785 - DNA, 75 bp, Artificial Sequence
  Synthetic
taatagatttggtgccataagttcgtctttgcaagaaattctatctcgtcttgatgctcttgaagcgcaagctca

SEQ ID NO: 204786 - DNA, 75 bp, Artificial Sequence
  Synthetic
ttattatgttttagatcgtgtgtatttaaatactactttgtttcttaatggttactatcctacttcaggttccac

SEQ ID NO: 204787 - DNA, 75 bp, Artificial Sequence
  Synthetic
tctttgcaagaaattctatctcgtcttgatgctcttgaagcgcaagctcagatagaccggttgattaatggcaga

SEQ ID NO: 204788 - DNA, 75 bp, Artificial Sequence
  Synthetic
ctcagcagcttagtgacactactcttgttaaatttagtgcttcacaggcgattgagaaggttaatgaatgtgtta

SEQ ID NO: 204789 - DNA, 75 bp, Artificial Sequence
  Synthetic
tgttaaatttagtgcttcacaggcgattgagaaggttaatgaatgtgttaagagtcaatcccttagagtcaattt

SEQ ID NO: 204790 - DNA, 75 bp, Artificial Sequence
  Synthetic
gacaccaggagttagtaattaaaacatcacatgaagactaagttcgtctttgatttattggctcctgacgatata

SEQ ID NO: 204791 - DNA, 75 bp, Artificial Sequence
  Synthetic
atcacatgaagactaagttcgtctttgatttattggctcctgacgatatattacatccctccaatcatgtgaatc

SEQ ID NO: 204792 - DNA, 75 bp, Artificial Sequence
  Synthetic
ctaatttttatgctagtggctgtgtgctttcctctgcttgcactatgtttacaatggccgatggtagtccacaac

SEQ ID NO: 204793 - DNA, 75 bp, Artificial Sequence
  Synthetic
taaattacaaggtcttttagagatctctgtttgccagtataatatgtgcgagtacccacatacgatttgtcatcc

SEQ ID NO: 204794 - DNA, 75 bp, Artificial Sequence
  Synthetic
gacggtcacaataatacgcggtcatctttacattcaaggtataaaactaggtattggctattctttggcagattt

SEQ ID NO: 204795 - DNA, 75 bp, Artificial Sequence
  Synthetic
ttgtattttcatttttatcaagaaggtggtactttttatgcatattttacagacactggtgttgttactaagttt

SEQ ID NO: 204796 - DNA, 75 bp, Artificial Sequence
  Synthetic
caccggatgtaatgttgaacatttctatacccaaccttcctgactttaaggaagagttggatcaatggtttaaaa

SEQ ID NO: 204797 - DNA, 75 bp, Artificial Sequence
  Synthetic
acggtactagttccaaaccatattataattcaggtagaccttataactttaagcattattgccaaagtttttaag

SEQ ID NO: 204798 - DNA, 75 bp, Artificial Sequence
  Synthetic
gcaccactggttttacctgtttttcacggtactagttccaaaccatattataattcaggtagaccttataacttt

SEQ ID NO: 204799 - DNA, 75 bp, Artificial Sequence
  Synthetic
ttccagtttgataatctttctagtgaagatttaaaggctgtaagaagttcttttaattttgatcagaaggaattg

SEQ ID NO: 204800 - DNA, 75 bp, Artificial Sequence
  Synthetic
gtgtaaaacacaatctatagcaccacctactggtgtttatgaattaaacggttacactgttcagccaattgcaga

SEQ ID NO: 204801 - DNA, 75 bp, Artificial Sequence
  Synthetic
tttgctgctgtacaggatgtgggactagctgttttaagaaatgtggtggttgttgtgatgattatactggacatc

SEQ ID NO: 204802 - DNA, 75 bp, Artificial Sequence
  Synthetic
tagctgttttaagaaatgtggtggttgttgtgatgattatactggacatcaagagctagttattaaaacctcaca

SEQ ID NO: 204803 - DNA, 75 bp, Artificial Sequence
  Synthetic
tttaagcatttgctaaagttcttaaggccaacccttattaatggacatctggagacctgagaggaaatttctccg

SEQ ID NO: 204804 - DNA, 75 bp, Artificial Sequence
  Synthetic
ggccaacccttattaatggacatctggagacctgagaggaaatttctccgttttactaacggatttaatgtccca

SEQ ID NO: 204805 - DNA, 75 bp, Artificial Sequence
  Synthetic
ttaattaccaatttcctaaagtaggatattgtagagttcctaattatgcttggtgtcgtaatcaaggtagctttt

SEQ ID NO: 204806 - DNA, 75 bp, Artificial Sequence
  Synthetic
atattgtagagttcctaattatgcttggtgtcgtaatcaaggtagcttttgtgctacatttaccctttacggcaa

SEQ ID NO: 204807 - DNA, 75 bp, Artificial Sequence
  Synthetic
tcgctaatactatagaggaggctgttaacaaactggttttagaggctgttgattttattatctggcgtagccaga

SEQ ID NO: 204808 - DNA, 75 bp, Artificial Sequence
  Synthetic
ggcaatagaacccctacctctggtgtaacacctgacatggctgatcaaattgctagtcttgttctggcaaaactt

SEQ ID NO: 204809 - DNA, 75 bp, Artificial Sequence
  Synthetic
atcttaactattttcaattgcgtgtatgcgttgaataatgtgtatcttggcttctctatagtttttactatagtg

SEQ ID NO: 204810 - DNA, 75 bp, Artificial Sequence
  Synthetic
acatttacaggtccttacaagtgcccccaaactaaatctttagttggtataggtgagcactgttcaggtcttgct

SEQ ID NO: 204811 - DNA, 75 bp, Artificial Sequence
  Synthetic
tagaactggaagttggtggagtttcaacccagaaacaaacaacttgatgtgtatagatatgaagggaaggatgta

SEQ ID NO: 204812 - DNA, 75 bp, Artificial Sequence
  Synthetic
tttttgctaatttaattttgcatgatgttaatagtggtcttacttgttctactgatttacaaaaagctaacacag

SEQ ID NO: 204813 - DNA, 75 bp, Artificial Sequence
  Synthetic
catacccttacggtcacaataatacgtggtcatctttacatgcaaggtataaaactaggtactggctattctttg

SEQ ID NO: 204814 - DNA, 75 bp, Artificial Sequence
  Synthetic
gtggtcatctttacatgcaaggtataaaactaggtactggctattctttgtcagatttgccagcttatgtgactg

SEQ ID NO: 204815 - DNA, 75 bp, Artificial Sequence
  Synthetic
gtttatgttgttaagatgatcattttgtggcttatgtggccccttactatcatcttaactattttcaactgcgta

SEQ ID NO: 204816 - DNA, 75 bp, Artificial Sequence
  Synthetic
tagctcaactcacggatgcagcactgtccattaaggaaaatgttgattttataaacagcatgcaattcaattata

SEQ ID NO: 204817 - DNA, 75 bp, Artificial Sequence
  Synthetic
tgtggcttatgtggccccttactatcatcttaactattttcaactgcgtatacgcgttgaataacgtttatcttg

SEQ ID NO: 204818 - DNA, 75 bp, Artificial Sequence
  Synthetic
ggccattattatgtggattttgtattttgtgaatagtatcaggttatttattagaactggcagttggtggagttt

SEQ ID NO: 204819 - DNA, 75 bp, Artificial Sequence
  Synthetic
caacccagaaacaaacaacctgatgtgtgtagatatgaagggtaagatgtatgttaggcctattattgaggacca

SEQ ID NO: 204820 - DNA, 75 bp, Artificial Sequence
  Synthetic
gatgaatatgagtccaaaaccacagcgtcagcgtggtcataagaatggacaaggagaaaatgataatataagtgt

SEQ ID NO: 204821 - DNA, 75 bp, Artificial Sequence
  Synthetic
cctattgcaccaggagtcccagctactgaagctaaggggtactggtacagacacaacagacgttcctttaaaaca

SEQ ID NO: 204822 - DNA, 75 bp, Artificial Sequence
  Synthetic
tcacagtaggtagtggttactgtgtggattactctaaaaacagacgaagtcgtagagcgattaccactggttatc

SEQ ID NO: 204823 - DNA, 75 bp, Artificial Sequence
  Synthetic
cctcgcagaaaagtcgagataaggcactctctatcagaatggatgtcttgctgctataatagatagagaaggtta

SEQ ID NO: 204824 - DNA, 75 bp, Artificial Sequence
  Synthetic
ttgagaaatcaaatctaaactttaaggatgtctttcactcctggcaagcagtccagtagtagagcatcctctgga

SEQ ID NO: 204825 - DNA, 75 bp, Artificial Sequence
  Synthetic
ggatgtctttcactcctggcaagcagtccagtagtagagcatcctctggaaatcgtgctggtaatggaatcctta

SEQ ID NO: 204826 - DNA, 75 bp, Artificial Sequence
  Synthetic
ttcaaataccttcagagtttactataggtaatatggaggagtttattcaaacaagctctcctaaagttactattg

SEQ ID NO: 204827 - DNA, 75 bp, Artificial Sequence
  Synthetic
attgtgctgcatttgtctgtggtgattatgcagcatgtaaatcacagttggttgaatatggtagtttctgtgata

SEQ ID NO: 204828 - DNA, 75 bp, Artificial Sequence
  Synthetic
ctagggcagcctttgagcatttgaagcctatgccattcttctattattcagatacgccttgtgtgtatatggatg

SEQ ID NO: 204829 - DNA, 75 bp, Artificial Sequence
  Synthetic
tgttccctactactcttggttctctggaattacccagtttcaaaagggaaaggagtttcaatttgctgaaggaca

SEQ ID NO: 204830 - DNA, 75 bp, Artificial Sequence
  Synthetic
aaatgaactacttgacactacacagttgcaagtagctaatagtttaatgaatggtgttactcttagcactaagct

SEQ ID NO: 204831 - DNA, 75 bp, Artificial Sequence
  Synthetic
ccaattctggcaatagaacccctacctctggtgtaacacctgatatggctgatcaaattgctagtcttgttctgg

SEQ ID NO: 204832 - DNA, 75 bp, Artificial Sequence
  Synthetic
agatgacatcaacttttcccctgtattaggttgtttaggaagtgattgtaataaagcttccactagatctgctat

SEQ ID NO: 204833 - DNA, 75 bp, Artificial Sequence
  Synthetic
ccatctactgaagctaaggggtattggtacagacacaaccgacgttcttttaaaacagccgatggcaatcaacgc

SEQ ID NO: 204834 - DNA, 75 bp, Artificial Sequence
  Synthetic
taaaacagccgatggcaatcaacgccaattgttgccacgctggtatttttactacttgggaacaggcccgcatgc

SEQ ID NO: 204835 - DNA, 75 bp, Artificial Sequence
  Synthetic
gaggatttactttttgataaagtaaagttatctgatgtcggtttcgttgaggcttataataattgtactggaggt

SEQ ID NO: 204836 - DNA, 75 bp, Artificial Sequence
  Synthetic
agttatctgatgtcggtttcgttgaggcttataataattgtactggaggtgccgaaattagggacctcatttgtg

SEQ ID NO: 204837 - DNA, 75 bp, Artificial Sequence
  Synthetic
gacggagtcttctgggtcgctaacaagcaggctgatgttaataccccagctgacgttgtcgatcgggacccaagc

SEQ ID NO: 204838 - DNA, 75 bp, Artificial Sequence
  Synthetic
ttccgcctggtacggtactccctcaaggttactatattgaaggctcgggaaggtctgtttctaattccagatcta

SEQ ID NO: 204839 - DNA, 75 bp, Artificial Sequence
  Synthetic
tattcaacagtggggctattcaggctctttgtcaagtaatcatgatatgtattgtagcatccataaaggggctca

SEQ ID NO: 204840 - DNA, 75 bp, Artificial Sequence
  Synthetic
tagtgcaggatcaagaagtagagccaattccggcactagaacatctacctctggtgtgacacctgatatggctga

SEQ ID NO: 204841 - DNA, 75 bp, Artificial Sequence
  Synthetic
attgcgctataatggcgcaattagatttgatagtacactttcaggttttgagaccataatgaaggtgttgaatga

SEQ ID NO: 204842 - DNA, 75 bp, Artificial Sequence
  Synthetic
aattccggcactagaacatctacctctggtgtgacacctgatatggctgatcagattgctagtcttgtgctggct

SEQ ID NO: 204843 - DNA, 75 bp, Artificial Sequence
  Synthetic
attcaagctgttgttaatgcaaatgctgaagctcttaataacttattgcaacaactctctaatagatttggtgct

SEQ ID NO: 204844 - DNA, 75 bp, Artificial Sequence
  Synthetic
cgcagcaagttactaagcagactgccaaagaagtcaggcagaaaattttgaataagcctcgccaaaagaggagcc

SEQ ID NO: 204845 - DNA, 75 bp, Artificial Sequence
  Synthetic
caaagaagtcaggcagaaaattttgaataagcctcgccaaaagaggagcccaaataaacaatgcactgttcagca

SEQ ID NO: 204846 - DNA, 75 bp, Artificial Sequence
  Synthetic
aggcttataataattgcactggaggtgctgaaattagggacctcctttgtgttcaaagttataatggcatcaaag

SEQ ID NO: 204847 - DNA, 75 bp, Artificial Sequence
  Synthetic
caaaattttggcggagcagaaatgttaaaactgggaactagtgatccacagttccccattcttgcagagcttgca

SEQ ID NO: 204848 - DNA, 75 bp, Artificial Sequence
  Synthetic
gaatgaaccttatgtcggcacctggtggtaacccctcgcaggaaagtcgggataaggcactctctatcagaatgg

SEQ ID NO: 204849 - DNA, 75 bp, Artificial Sequence
  Synthetic
taaaactgggaactagtgatccacagttccccattcttgcagagcttgcacctacagcaggtgcatttttctttg

SEQ ID NO: 204850 - DNA, 75 bp, Artificial Sequence
  Synthetic
acagaatttgtctgggagtgttgatgagccccagaaggatgtttatgaattgcgctataatggcgcgattagatt

SEQ ID NO: 204851 - DNA, 75 bp, Artificial Sequence
  Synthetic
gagccccagaaggatgtttatgaattgcgctataatggcgcgattagatttgacagcacacttccaggttttgaa

SEQ ID NO: 204852 - DNA, 75 bp, Artificial Sequence
  Synthetic
tgtatagtgttggagaaagtgaaagacttgcggaagtaattgccgacaagtgcccaaggggaagagccagcatgt

SEQ ID NO: 204853 - DNA, 75 bp, Artificial Sequence
  Synthetic
atttgaatgcctatcaacaacaggatgatgggacgaatatgagcccaaaaccacagcgacagcgtggtcaaaaga

SEQ ID NO: 204854 - DNA, 75 bp, Artificial Sequence
  Synthetic
ctatagctttttgtaaatctggtaatttagtccttaataaccctgcttatatagctcctcgagctaactctggga

SEQ ID NO: 204855 - DNA, 75 bp, Artificial Sequence
  Synthetic
tgatgggacgaatatgagcccaaaaccacagcgacagcgtggtcaaaagaagggtggagaaaatgaagatgtaag

SEQ ID NO: 204856 - DNA, 75 bp, Artificial Sequence
  Synthetic
aaaaacatccactccctgtattctatgcttgtgggcgtagatttttcatagtggtgtctatattcatttctgctg

SEQ ID NO: 204857 - DNA, 75 bp, Artificial Sequence
  Synthetic
cagcaaaataagagtagagagttgactgcagaggacatcagccttcttaagcagatggatgatcccctcaccgaa

SEQ ID NO: 204858 - DNA, 75 bp, Artificial Sequence
  Synthetic
caactatttggttgtgtacaagcatacatttagaggctatgtttatgcatggctatcatattatgttccatcagt

SEQ ID NO: 204859 - DNA, 75 bp, Artificial Sequence
  Synthetic
aggatgttgttgtttttactaataacacaacataccctactaacattgcagttgaattgtttgccaaacgtagtg

SEQ ID NO: 204860 - DNA, 75 bp, Artificial Sequence
  Synthetic
cacaacataccctactaacattgcagttgaattgtttgccaaacgtagtgtgcgtcatcatcccgagcttaagct

SEQ ID NO: 204861 - DNA, 75 bp, Artificial Sequence
  Synthetic
atttaggtgttctgattcaaaattctgctaagcatgtgcagggtaatgttgctaaaatagccggtgtttcctgta

SEQ ID NO: 204862 - DNA, 75 bp, Artificial Sequence
  Synthetic
gctggtgtagctatgcttgttttactattcttcatatgctgttgtacaggatgtgggactagttgttttaagaaa

SEQ ID NO: 204863 - DNA, 75 bp, Artificial Sequence
  Synthetic
tattcttcatatgctgttgtacaggatgtgggactagttgttttaagaaatgtggtggttgttgtgatgattata

SEQ ID NO: 204864 - DNA, 75 bp, Artificial Sequence
  Synthetic
aggtagttgataatgtctatgttacctatgcgggtaatgtatggcagattcaaactatccaggattcagatggta

SEQ ID NO: 204865 - DNA, 75 bp, Artificial Sequence
  Synthetic
tgttggaaacacgtcatttgggattatgttagacagagtatatactgcagtaatacctttggtgtctgcacatat

SEQ ID NO: 204866 - DNA, 75 bp, Artificial Sequence
  Synthetic
aggcatgctatgtgagaggttgtaatcctaatggatggaccatgggtttgtttcggcgtagaagtgtgtgtaaca

SEQ ID NO: 204867 - DNA, 75 bp, Artificial Sequence
  Synthetic
atgttactaatggtttgggtacttattatgttttagatcgtgtgtatttaaatactacgttgtttcttaatggtt

SEQ ID NO: 204868 - DNA, 75 bp, Artificial Sequence
  Synthetic
aacttcacatgacgactaagttcgtctttgatttattgcactgatctcttgttagatctttttgtaatctagcat

SEQ ID NO: 204869 - DNA, 75 bp, Artificial Sequence
  Synthetic
aatactacgttgtttcttaatggttattaccctacttcaggttccacatatcgtaatatggcactgaagggaact

SEQ ID NO: 204870 - DNA, 75 bp, Artificial Sequence
  Synthetic
gttagatctttttgtaatctagcatttgccaaagttcttaagaccacgccctattaatggacatctggcgacctg

SEQ ID NO: 204871 - DNA, 75 bp, Artificial Sequence
  Synthetic
attgcgccctcctaagaatagttttgaagcccttatgcttaattttaagctgttgggtattggaggtgttccaat

SEQ ID NO: 204872 - DNA, 75 bp, Artificial Sequence
  Synthetic
taatgtatagtgagttccctgctataactataggtagtacttttgtaaatacatcctatagtgtggtagtacaac

SEQ ID NO: 204873 - DNA, 75 bp, Artificial Sequence
  Synthetic
tattgctaatgcatttaacaacgctttgacagccattcagaatgggtttgatgcaaccaattctgctttagttaa

SEQ ID NO: 204874 - DNA, 75 bp, Artificial Sequence
  Synthetic
acactgtgtggtatgtggggcaaataatttttatagttgccatttgtttattggttacaatagttgtagtggcat

SEQ ID NO: 204875 - DNA, 75 bp, Artificial Sequence
  Synthetic
ttggttacaatagttgtagtggcatttttggcaacttttaaattgtgtattcaactttgcggtatgtgtaatacc

SEQ ID NO: 204876 - DNA, 75 bp, Artificial Sequence
  Synthetic
attacacaggcgaaggtcaacaaattattttttatgagggtgttaattttacgccttatcatgcctttaaatgca

SEQ ID NO: 204877 - DNA, 75 bp, Artificial Sequence
  Synthetic
gcacaacattgttttaaagctcccacaaatttctgtccgtgtaaattggatgggtctttgtgtgtaggtaatggt

SEQ ID NO: 204878 - DNA, 75 bp, Artificial Sequence
  Synthetic
gtgtgtaggtagtggtcctggtaaaaataatggtataggcacttgtcctgcaggtactaattatttaacttgtca

SEQ ID NO: 204879 - DNA, 75 bp, Artificial Sequence
  Synthetic
aatattgggttacacccctcacttctagacaatatttactcgctttcaatcaagatggtattatttttaatgctg

SEQ ID NO: 204880 - DNA, 75 bp, Artificial Sequence
  Synthetic
ctggactgctgatgaagctattaaattcctaaaggaatggaatttttctttgggtattatactactttttattac

SEQ ID NO: 204881 - DNA, 75 bp, Artificial Sequence
  Synthetic
ctgcggcacgatattagacttgatgatgatgcgcgtgtttttgtgcagtcaaatatggagaatttgcctgcagat

SEQ ID NO: 204882 - DNA, 75 bp, Artificial Sequence
  Synthetic
caaggcatttttgttgaggttaatgcgacttattataatagttggcagaaccttttatatgattctaatggtaat

SEQ ID NO: 204883 - DNA, 75 bp, Artificial Sequence
  Synthetic
agtcgcagtatgtttgtttatgttattaagatgattattttgtggcttatgtggccccttactataatcttaact

SEQ ID NO: 204884 - DNA, 75 bp, Artificial Sequence
  Synthetic
aagcttggcttaatgataagtcggtgccctctccattaaattgggaacgtaagacattttcaaattgtaatttta

SEQ ID NO: 204885 - DNA, 75 bp, Artificial Sequence
  Synthetic
cgtagagcgattaccactggttatcggtttactaattttgagccatttactgttaattcagtaaatgacagttta

SEQ ID NO: 204886 - DNA, 75 bp, Artificial Sequence
  Synthetic
ataatgtgtatcttggcctttctatagtttttaccatagtggccattattatgtggattgtgtattttgtgaata

SEQ ID NO: 204887 - DNA, 75 bp, Artificial Sequence
  Synthetic
tgcatagttttagatgttaaaggtgtagaagaattgcatgacgatttagttaattacattcgtgataaaggttgt

SEQ ID NO: 204888 - DNA, 75 bp, Artificial Sequence
  Synthetic
ctaagagtggttattttgttaatgtaaataatacttggatgttcactggtagtggttattactaccctgaaccta

SEQ ID NO: 204889 - DNA, 75 bp, Artificial Sequence
  Synthetic
atgttatgcatgccaattatttgttttggagaaattctacagtttggaatgggggttcttatagcctctttgata

SEQ ID NO: 204890 - DNA, 75 bp, Artificial Sequence
  Synthetic
accatcaggagggaatgttgtaccctactactcttggttctctggaattactcagtttcaaaagggaaaggagtt

SEQ ID NO: 204891 - DNA, 75 bp, Artificial Sequence
  Synthetic
ttgtgaaaatggttaatcctacttctaaggtagaaccatgtattgtcagtgttacctatggtaatatgacattga

SEQ ID NO: 204892 - DNA, 75 bp, Artificial Sequence
  Synthetic
cagagtttactataggtaatatggaggagtttattcaaacaagttctcctaaagttactattgattgtgctgcat

SEQ ID NO: 204893 - DNA, 75 bp, Artificial Sequence
  Synthetic
aggctattccgactaggtttccgcctggtacggtactccctcagggttactatattgaaggctcaggaaggtctg

SEQ ID NO: 204894 - DNA, 75 bp, Artificial Sequence
  Synthetic
tatattgaaggctcaggaaggtctgctcctaattccagatctacttcgcgcacatccagcagagcctctagtgca

SEQ ID NO: 204895 - DNA, 75 bp, Artificial Sequence
  Synthetic
tggattgctcattgtactatagcacaactcactgatgcggctttagtcattaatgagaatttagattttataaat

SEQ ID NO: 204896 - DNA, 75 bp, Artificial Sequence
  Synthetic
ttggtggtggggaaatgttaaaacttggaactagtgacccacagttccccattcttgcagaactcgcacccacag

SEQ ID NO: 204897 - DNA, 75 bp, Artificial Sequence
  Synthetic
attcttgcagaactcgcacccacagctggtgcgtttttctttggatcaagattagagttggccaaagtgcagaat

SEQ ID NO: 204898 - DNA, 75 bp, Artificial Sequence
  Synthetic
caatgccaggcagtctgataacatgacggcggttgcttgtcaacctccgtactgttattttcgtaattctactac

SEQ ID NO: 204899 - DNA, 75 bp, Artificial Sequence
  Synthetic
agaggacatcagccttcttaagaagatggatgagccctatactgaagacacctcagaaatataagagaatgaacc

SEQ ID NO: 204900 - DNA, 75 bp, Artificial Sequence
  Synthetic
tgacaaagattttaatactattttaaacactgcctgcggtgtgtttgaagtagatgatactgtggatatggagga

SEQ ID NO: 204901 - DNA, 75 bp, Artificial Sequence
  Synthetic
gaggataattccctatttttatttgatgaggctggtgatgaagttcttgcctctaaattgtattgtgcttttaca

SEQ ID NO: 204902 - DNA, 75 bp, Artificial Sequence
  Synthetic
aaatcagagctacatcaatctcaaggacattggtacatatgaatattatgtaaaatggccttggtatgtatggct

SEQ ID NO: 204903 - DNA, 75 bp, Artificial Sequence
  Synthetic
taaaaataatggtataggcacttgtcctgcaggtactaattatttaacttgtgataatttgtgtactcttgatcc

SEQ ID NO: 204904 - DNA, 75 bp, Artificial Sequence
  Synthetic
ctaattataagacccattgaggtcgagcatattataatagctaccacaatgcctgctgtttagtgggtactgtgt

SEQ ID NO: 204905 - DNA, 75 bp, Artificial Sequence
  Synthetic
ataagcgtggttttcttgacaagataggcgatactagtggttttgctgtttatgttaagtccaaagtcggtaatt

SEQ ID NO: 204906 - DNA, 75 bp, Artificial Sequence
  Synthetic
gcctaatacgtgaaattgttatgaatgcaagtccatatgatttggaggtgctacttcaagatgctttgcagtccc

SEQ ID NO: 204907 - DNA, 75 bp, Artificial Sequence
  Synthetic
atggttgtgattatactggtagtcttgcagatggcttagaggcttatgctgataagacattgcaagaaatgaagg

SEQ ID NO: 204908 - DNA, 75 bp, Artificial Sequence
  Synthetic
aaacagacgaagtcgtagagcgattaccactggttatcggtttactaattttgagccatttactgttaattcagt

SEQ ID NO: 204909 - DNA, 75 bp, Artificial Sequence
  Synthetic
gtttttccagcataactatagataagtttgctatacccaatggcaggaaggttgacctacaattgggtaatttgg

SEQ ID NO: 204910 - DNA, 75 bp, Artificial Sequence
  Synthetic
ggaggcagatacagttgtaaatgctttttatggtgttgctttgaaagattgtggttttgttatgcagtttggtta

SEQ ID NO: 204911 - DNA, 75 bp, Artificial Sequence
  Synthetic
attgtggataatgtttatatggccaaggctggtgacaaatattaccctgttgtggttgatgatcatgttggactc

SEQ ID NO: 204912 - DNA, 75 bp, Artificial Sequence
  Synthetic
gaacttttatgattcgtagttgctatagcggtcgtgtttctgcggcctttcatgctaactcttccgaaccagcat

SEQ ID NO: 204913 - DNA, 75 bp, Artificial Sequence
  Synthetic
tacattatttgaattctaagattgttgatttggctcaacattttagtgattttggaacaagttttgtttctaaaa

SEQ ID NO: 204914 - DNA, 75 bp, Artificial Sequence
  Synthetic
caaacccaaaccgtggattctgctcaaggttctgaatacgattatgttatatattcacagactgcagaaacagcg

SEQ ID NO: 204915 - DNA, 75 bp, Artificial Sequence
  Synthetic
cgtggcttgttacattcatcccaattgccattagatgtttatgatttaaccatgcctagtcaagttcagaaagcc

SEQ ID NO: 204916 - DNA, 75 bp, Artificial Sequence
  Synthetic
tgccattagatgtttatgatttaaccatgcctagtcaagttcagaaagccaagcaaaaacctatttatttaaaag

SEQ ID NO: 204917 - DNA, 75 bp, Artificial Sequence
  Synthetic
tctttgattttggctcctgacgatatattacatcccttcaatcatctgaagttaattataagaccattaaggtcg

SEQ ID NO: 204918 - DNA, 75 bp, Artificial Sequence
  Synthetic
ttggatgattttgtggctcttgttaagtcacttaatcttaactgtgtgagtaaggttgttaatgttaatgttgat

SEQ ID NO: 204919 - DNA, 75 bp, Artificial Sequence
  Synthetic
ttacatgggcagccaactttgagctcacttgtctccgctactttgcaaaagtaggtcgtgagatttcttgtaatg

SEQ ID NO: 204920 - DNA, 75 bp, Artificial Sequence
  Synthetic
aaggtgaggaaactgatttaactatcacaagtgctggacagccttgtgttgctagtgaacaggaggaatcttctg

SEQ ID NO: 204921 - DNA, 75 bp, Artificial Sequence
  Synthetic
gtatgtgcctaaagcaactcgcaacaattgctggttgcgatcagttttggcagtgatgcagaaattgccctgtca

SEQ ID NO: 204922 - DNA, 75 bp, Artificial Sequence
  Synthetic
atccaaacattatgagtagtaaaactacaccagcaccagtttatatctggactgctgatgaagctattaaattcc

SEQ ID NO: 204923 - DNA, 75 bp, Artificial Sequence
  Synthetic
ccgacttttgttggtaagatcgcacagtggattaagaacacttttagtcttgtaactatttgtgatctatattcc

SEQ ID NO: 204924 - DNA, 75 bp, Artificial Sequence
  Synthetic
aggggaagagccagcatgttaagttaccacccagtaattagtaaatgaatgaagttaattatggccaattggaag

SEQ ID NO: 204925 - DNA, 75 bp, Artificial Sequence
  Synthetic
tgtaactatttgtgatctatattccattcaggatgtgggttttaagaatcagtattgtaatggaagtatcgcatg

SEQ ID NO: 204926 - DNA, 75 bp, Artificial Sequence
  Synthetic
ctgccaaagaagtcagacagaaaattttgaataagccccgccagaagaggagccccaataaacaatgcactgttc

SEQ ID NO: 204927 - DNA, 75 bp, Artificial Sequence
  Synthetic
ttagtaaatgaatgaagttaattatggccaattggaagaatcacaaaaaaaaaaaaaaaaaaaaaaaaaaaaaaa

SEQ ID NO: 204928 - DNA, 75 bp, Artificial Sequence
  Synthetic
aagttaccacccagtaattagtaaatgaatgaagttaattatggccaattggaagaatcacaaaaaaaaaaaaaa

SEQ ID NO: 204929 - DNA, 75 bp, Artificial Sequence
  Synthetic
aattgcccaattgtatggttcttgtataacacctaatgtgtgttttgttaaaggtgatataattaaagtgtctaa

SEQ ID NO: 204930 - DNA, 75 bp, Artificial Sequence
  Synthetic
agtaatcaaaacttcacatgacgactaagttcgtctttgattcattgcattgatcttttgttagatctttttcca

SEQ ID NO: 204931 - DNA, 75 bp, Artificial Sequence
  Synthetic
aaattatgtaaaactgtgcttaatgttgttggacctgatgcgagaacacagggtaaacaaagttatgtattgtta

SEQ ID NO: 204932 - DNA, 75 bp, Artificial Sequence
  Synthetic
tgttcttgttagcaataatcaagaggattttgatcttatttctaagtgtcagataactgctgttgagggcactaa

SEQ ID NO: 204933 - DNA, 75 bp, Artificial Sequence
  Synthetic
ctactgctaatactggtacgtctgttacagaaactatgtttgatgtttatgtggatacatttttgtctatgtttg

SEQ ID NO: 204934 - DNA, 75 bp, Artificial Sequence
  Synthetic
atgcttgtaaagatggatggggacgatgtctatcttccatatcctgatcctagtcgtatattaggagctggatgt

SEQ ID NO: 204935 - DNA, 75 bp, Artificial Sequence
  Synthetic
ggtatagctcctaagagcggctattttgttaatgtaaataatatgtggatgtttactggtagcggttattactac

SEQ ID NO: 204936 - DNA, 75 bp, Artificial Sequence
  Synthetic
ttgttaatgtaaataatatgtggatgtttactggtagcggttattactaccctgaacctataactgaaaataatg

SEQ ID NO: 204937 - DNA, 75 bp, Artificial Sequence
  Synthetic
ctttgtgttataagtttggccatgttgttggttaagcataagcatctttatttgactatgtatataattcctgtg

SEQ ID NO: 204938 - DNA, 75 bp, Artificial Sequence
  Synthetic
ccagagcccacaaggtaatctggggagtaatggtaaacccggtaatgtcggtggtaatgatgctctgtcaatctc

SEQ ID NO: 204939 - DNA, 75 bp, Artificial Sequence
  Synthetic
tcttagagatctctgtttgccagtatactatgtgcgagtacccaaatacgatttgtcatcctaatctgggtaatc

SEQ ID NO: 204940 - DNA, 75 bp, Artificial Sequence
  Synthetic
accaggatgtgatgtaaatgatgttaccaaattgtatctaggtggtatgtcatattattgtgaagatcataagcc

SEQ ID NO: 204941 - DNA, 75 bp, Artificial Sequence
  Synthetic
caaccactcatgggtgtactattaatactagtacagctctacattggctttaggcattttgttaacacagccacc

SEQ ID NO: 204942 - DNA, 75 bp, Artificial Sequence
  Synthetic
tactagtacagctctacattggctttaggcattttgttaacacagccaccatcgggttaaaccggtttatggtgc

SEQ ID NO: 204943 - DNA, 75 bp, Artificial Sequence
  Synthetic
atagatggaaatgttatgcatgccaattatttgttttggagaaattctacagtttggaacgggggtgcttatagc

SEQ ID NO: 204944 - DNA, 75 bp, Artificial Sequence
  Synthetic
ttgtattataatttacctgctgctaatgtttctgttagcaggtttaatccttctacttggaataagagatttggt

SEQ ID NO: 204945 - DNA, 75 bp, Artificial Sequence
  Synthetic
tgttcaatggcaagaggcatggcttgaatttcgttctggccgccctgctagatttgtagctttggttttggccaa

SEQ ID NO: 204946 - DNA, 75 bp, Artificial Sequence
  Synthetic
atcaatctcaaggacattggtacatatgaatattatgtaaaatggccttggtatgtatggcttttaatcggcctt

SEQ ID NO: 204947 - DNA, 75 bp, Artificial Sequence
  Synthetic
cgtattctaatttttatgctagtggctgtgtgctttcctctgcttgcactatgtttgcaatggccgatggtagtc

SEQ ID NO: 204948 - DNA, 75 bp, Artificial Sequence
  Synthetic
aaatattttagaataataactggtttcacagcgttcgccaatactatagaggaggctgttaataaactggtttta

SEQ ID NO: 204949 - DNA, 75 bp, Artificial Sequence
  Synthetic
aattcattgtgtacgatttgatgtaccatttttaatttgcagtaatacacctgctagtgtaaaattacctaaggg

SEQ ID NO: 204950 - DNA, 75 bp, Artificial Sequence
  Synthetic
tagaggtaggcagttttatgagttgtataatcaagtaaaaccaccagtccttaatgtggatgacgtttagttaat

SEQ ID NO: 204951 - DNA, 75 bp, Artificial Sequence
  Synthetic
gcttttggtgattacaccagtattgtttttgttaatgtgattgtgtggtgtgtaaattttatgatgctttttgtg

SEQ ID NO: 204952 - DNA, 75 bp, Artificial Sequence
  Synthetic
gcctttatggttttgtttgctatatatatctgttgttgtttcaaatcatgctttttgggtattttcttactgcag

SEQ ID NO: 204953 - DNA, 75 bp, Artificial Sequence
  Synthetic
acatattttaatagacctttattggttgatgataataaatttgatgttttaaaagtggatgatgttgatgatagt

SEQ ID NO: 204954 - DNA, 75 bp, Artificial Sequence
  Synthetic
acaataatacgtggccacctttattttcaaggtgtaaaactaggaatcggctattctttgtcagatttgccagtt

SEQ ID NO: 204955 - DNA, 75 bp, Artificial Sequence
  Synthetic
aagaaaccaaagaaatcaacattattaagttaagtggtgttaaaaaaccatttaaggttgaagatagtgtcattg

SEQ ID NO: 204956 - DNA, 75 bp, Artificial Sequence
  Synthetic
tgtctatagttgatgtgtatgatatgtggcttacaggttgtaggtatgttgttagaactgctaatgctttgagca

SEQ ID NO: 204957 - DNA, 75 bp, Artificial Sequence
  Synthetic
ccctttgtggcataaagccgtttttattagcccatataatagccagaactttgcagctaagcgtgttttgggttt

SEQ ID NO: 204958 - DNA, 75 bp, Artificial Sequence
  Synthetic
tcttgacaagataggcgataatagtggttttgctgtttatgttaagtccaaagtcggtaattatcgactgccttc

SEQ ID NO: 204959 - DNA, 75 bp, Artificial Sequence
  Synthetic
tttactacattgaccttagataaagttccacaggccgttgaaacgagagttcaatgtagtaccaatttatttaaa

SEQ ID NO: 204960 - DNA, 75 bp, Artificial Sequence
  Synthetic
tgcatgctttaattttattaaatggctttttgtcttattatttggctggattaaaatatccgctgataataaagt

SEQ ID NO: 204961 - DNA, 75 bp, Artificial Sequence
  Synthetic
cgaccagtctacaaattttcaaaccagaggtagaagagctcaacccaagcaaactgctacttctcaaccagcagg

SEQ ID NO: 204962 - DNA, 75 bp, Artificial Sequence
  Synthetic
agtgatgtcttatcaaatgcagggttgtatgcttgttcttacagtgaccctgcaaaattctcgtacgccaaaata

SEQ ID NO: 204963 - DNA, 75 bp, Artificial Sequence
  Synthetic
cgccttattaaagatgttgacaatcctgtacttatgggttgggattatcctaagtgtgatcgtgctatgccaaac

SEQ ID NO: 204964 - DNA, 75 bp, Artificial Sequence
  Synthetic
tttttatttggtgacagtcgttcagattgtaatcatattgttaatatcaacccccataattattcttatatggac

SEQ ID NO: 204965 - DNA, 75 bp, Artificial Sequence
  Synthetic
gaggatgaattgacacctagcgatgtttatcaacaactcgctggtatcaagttacaatcaaagcgcactagattg

SEQ ID NO: 204966 - DNA, 75 bp, Artificial Sequence
  Synthetic
ttttgtgttaaattataaaggtttacaatttcaaattctcgatgaaggagtggattgtaaaatacaaacagcgcc

SEQ ID NO: 204967 - DNA, 75 bp, Artificial Sequence
  Synthetic
tggtggctttagctaatatgttaccagcacatgtgtttatgaggttttatattattattgcctcttttattaagc

SEQ ID NO: 204968 - DNA, 75 bp, Artificial Sequence
  Synthetic
ttaccctttgattgtcaatgggatttgataatctctgatatgtatgacctattactagacataggagtacatgta

SEQ ID NO: 204969 - DNA, 75 bp, Artificial Sequence
  Synthetic
attatcaaaataacgtttttatgtcagaatccaaatgttgggttgaacatgacataaataatggacctcatgaat

SEQ ID NO: 204970 - DNA, 75 bp, Artificial Sequence
  Synthetic
gatcttttcataatctaaactttataaaaacatccactccctgtagtctatgcctgtgggcgtagatttttcata

SEQ ID NO: 204971 - DNA, 75 bp, Artificial Sequence
  Synthetic
tgtttgttggtcgtgtgatttctgttgtctctttgtggtacatgggttctaacttagaggaagaaattcttctta

SEQ ID NO: 204972 - DNA, 75 bp, Artificial Sequence
  Synthetic
tgtctctttgtggtacatgggttctaacttagaggaagaaattcttcttatgttggcttctctttttggtactta

SEQ ID NO: 204973 - DNA, 75 bp, Artificial Sequence
  Synthetic
agttttggatacctttttaagctgtgctcgtaaaagttgttctattgattcagatgttgatactaagtgtttagc

SEQ ID NO: 204974 - DNA, 75 bp, Artificial Sequence
  Synthetic
aacatgaggcatgttgttcgcaaagcgataggttttatcgacttgcgaatgaatgcgcacaagttttgagtgaaa

SEQ ID NO: 204975 - DNA, 75 bp, Artificial Sequence
  Synthetic
atagaagtgttgatgttgctattcaagaaggttattgatgacatgcattggggtgagggctttcagattaaattt

SEQ ID NO: 204976 - DNA, 75 bp, Artificial Sequence
  Synthetic
cgccctcctaagaatagttttgaagcccttatgcttaattttaagcttttgggtattggaggtgtgccaattatt

SEQ ID NO: 204977 - DNA, 75 bp, Artificial Sequence
  Synthetic
tgataaagttgtggctaagatcgataaggaggatgttgtcatttttattaataatacaacataccctactaatgt

SEQ ID NO: 204978 - DNA, 75 bp, Artificial Sequence
  Synthetic
gttagccactggatgggaagtcgttttgaatataatccacccactgataagctagctatgattatgggttattgt

SEQ ID NO: 204979 - DNA, 75 bp, Artificial Sequence
  Synthetic
ggttgggttatacccttagcctttatgcctgtgcaatcccggaaatttattgttccttgggttatgtacttgcgt

SEQ ID NO: 204980 - DNA, 75 bp, Artificial Sequence
  Synthetic
gtgtgaccatgctggtaccggtatggccattactgttaaacccgatgctaccactaatcaggattcatatggtgg

SEQ ID NO: 204981 - DNA, 75 bp, Artificial Sequence
  Synthetic
caaagaactatggcatttggatacaggtgttgtttcctgtttatataagcgtaatttcacatatgatgtgaatgc

SEQ ID NO: 204982 - DNA, 75 bp, Artificial Sequence
  Synthetic
ataattgtaccagataaaagtgtttatgatcaggtagttgacaatgtctatgttacctatgcgggtaatgtatgg

SEQ ID NO: 204983 - DNA, 75 bp, Artificial Sequence
  Synthetic
attattcttatatggaccttaatcctgccctgtgtgattctggtaaaatatcatctaaagctggcaactccattt

SEQ ID NO: 204984 - DNA, 75 bp, Artificial Sequence
  Synthetic
actacattgaccttagataaagtgccacaggccgttgaaacgaaagttcaatgtagtactaatttatttaaagat

SEQ ID NO: 204985 - DNA, 75 bp, Artificial Sequence
  Synthetic
agaagattattggtggtttgcatttgttaataggcttgtaccgaagacagcaaacttccaatctggttattcagg

SEQ ID NO: 204986 - DNA, 75 bp, Artificial Sequence
  Synthetic
agcctaatcactttatcaattttccacttacccagtttcagggttttgtgttaaattataaaggtttacaatttc

SEQ ID NO: 204987 - DNA, 75 bp, Artificial Sequence
  Synthetic
aaataatgaattaatgcctgctaagttgaaaactcaggttgttaatagtggtccagatcagacttgtaatacacc

SEQ ID NO: 204988 - DNA, 75 bp, Artificial Sequence
  Synthetic
ttgggtgcttaataatgattattatagatcattgcctgggaccttttgtggtagagatgtttttgatttaattta

SEQ ID NO: 204989 - DNA, 75 bp, Artificial Sequence
  Synthetic
tgggacaaatttcccacttcaattaggattttccacaggaattgattttgttgtggaagccactggtttgtttgc

SEQ ID NO: 204990 - DNA, 75 bp, Artificial Sequence
  Synthetic
taatatgcatgttgtggtagtggaaaatgatgctgataaagctaattttctgaatgctgctgtattttatgcaca

SEQ ID NO: 204991 - DNA, 75 bp, Artificial Sequence
  Synthetic
tgcttaattttaagctgttgggtattggaggtgttccaattattgaagtatctcaatttcaatcaaaattgactg

SEQ ID NO: 204992 - DNA, 75 bp, Artificial Sequence
  Synthetic
gtgttaaaagccaatcatctaggataaatttctgtggtaatggtaatcatattatatcattagtgcagaatgctc

SEQ ID NO: 204993 - DNA, 75 bp, Artificial Sequence
  Synthetic
aaggtcttttagaggtctctgtttgccagtataatatgtgcgagtacccacatacgatttgtcatcctaaactgg

SEQ ID NO: 204994 - DNA, 75 bp, Artificial Sequence
  Synthetic
atggggatgctggttttactagcatactcagtggtttgttatatgattcaccttgtttttcgcagcaaggtgttt

SEQ ID NO: 204995 - DNA, 75 bp, Artificial Sequence
  Synthetic
tcagttggctaaagcaatggacacatttaccaataataatggtagtgatgtgctttaccaaccgcctactgcttc

SEQ ID NO: 204996 - DNA, 75 bp, Artificial Sequence
  Synthetic
ataagttcttctttacaagaaattctatctagacttgatgctcttgaagcggaagctcagatagatagacttatt

SEQ ID NO: 204997 - DNA, 75 bp, Artificial Sequence
  Synthetic
tatgactgtgttgttacaactttgatctcagctggtatatttagtgtgccttctgatgtgtctttaacatatcta

SEQ ID NO: 204998 - DNA, 75 bp, Artificial Sequence
  Synthetic
tgccctactgctgctgatattaatacccctgatgtacctatttgtgtgtatgatccgctaccacttattttgctt

SEQ ID NO: 204999 - DNA, 75 bp, Artificial Sequence
  Synthetic
aggcacttgtcctgcaggtactaattatttaacttgccataatgctgcccaatgtgattgtttgtgcactccaga

SEQ ID NO: 205000 - DNA, 75 bp, Artificial Sequence
  Synthetic
catgtaactatgcgtagtagttataccattaagggttcctttttatgcggatcttgtggatctgttggttatgta

SEQ ID NO: 205001 - DNA, 75 bp, Artificial Sequence
  Synthetic
ggacctatttttaatagagccctagttagcgctactgagtttgcagacaaattggtggaggtaggcttagtaggc

SEQ ID NO: 205002 - DNA, 75 bp, Artificial Sequence
  Synthetic
aaccacatactaccaatttggataataaattacaaggtctcttagagatctctgtttgccagtatactatgtgcg

SEQ ID NO: 205003 - DNA, 75 bp, Artificial Sequence
  Synthetic
ataactatagataagtttgctatacccaatggcaggaaggttgacctacaattgggcaatttgggctatttgcag

SEQ ID NO: 205004 - DNA, 75 bp, Artificial Sequence
  Synthetic
gactatttgatcttgtacagtatgattttactgattacaagctcgaattgtttaataagtattttaagcactgga

SEQ ID NO: 205005 - DNA, 75 bp, Artificial Sequence
  Synthetic
acaggtgtttttactaatcacagtgtagtttatgcacaacactgtttcaaagcccctaaaaatttctgtccgtgt

SEQ ID NO: 205006 - DNA, 75 bp, Artificial Sequence
  Synthetic
tagtggtgatgcaactactgcttttgctaattcagtttttaacatatgtcaagctgtttcagccaatgtatgtgc

SEQ ID NO: 205007 - DNA, 75 bp, Artificial Sequence
  Synthetic
aagacactggtgttatttatggtctcaattctacagaaaccattaccactggttttgattttaattgtcattatt

SEQ ID NO: 205008 - DNA, 75 bp, Artificial Sequence
  Synthetic
tcagatcagtggatacactttggctgccacctctgctagtctatttcctccttggacagcagcagcaggtgtacc

SEQ ID NO: 205009 - DNA, 75 bp, Artificial Sequence
  Synthetic
ctttcaacaggtattgtattatcaaaataacgtttttatgtcagaatccaaatgttgggttgaaaatgacataaa

SEQ ID NO: 205010 - DNA, 75 bp, Artificial Sequence
  Synthetic
ttacctgctgctaatgtttctgttagcaggtttaatccttctacttggaataggagatttggttttacagaacaa

SEQ ID NO: 205011 - DNA, 75 bp, Artificial Sequence
  Synthetic
ataggtattgacactagcaccactggttttacctgtttttcacggtactagttccaaaccatattataattcagg

SEQ ID NO: 205012 - DNA, 75 bp, Artificial Sequence
  Synthetic
gttttacctgtttttcacggtactagttccaaaccatattataattcaggtagaccttataactttaagcattat

SEQ ID NO: 205013 - DNA, 75 bp, Artificial Sequence
  Synthetic
ggcgtttttaggtatgataatgttagcagtgtctggcctctctacccctatggcagatgtcccactgctgctgat

SEQ ID NO: 205014 - DNA, 75 bp, Artificial Sequence
  Synthetic
aaagcccaatttaaaacattcgagaaagtagatggtgtgtatactaattttaaattgataggacacaccgtctgt

SEQ ID NO: 205015 - DNA, 75 bp, Artificial Sequence
  Synthetic
ttatattattagctgttattggggtttgttttccttgatgaacagtttgtttagaatgcctttgggtgtttataa

SEQ ID NO: 205016 - DNA, 75 bp, Artificial Sequence
  Synthetic
tgactggcagaatgtttcatcaaaaatgtttgaaaagtatagcagctacacgtggtgttcctgttgttataggca

SEQ ID NO: 205017 - DNA, 75 bp, Artificial Sequence
  Synthetic
gttaatccaaacattatgagtagtgtaactacaccagcaccagtttacacctggactgctgatgaagctattaaa

SEQ ID NO: 205018 - DNA, 75 bp, Artificial Sequence
  Synthetic
tgagaaagcttccctcaattctttaacatattttaatagacctttattggttgatgataataaatttgatgtttt

SEQ ID NO: 205019 - DNA, 75 bp, Artificial Sequence
  Synthetic
taatctaaacatgtttttgatacttttaatttccttaccaacggcttttgctgttataggagatttaaagtgtac

SEQ ID NO: 205020 - DNA, 75 bp, Artificial Sequence
  Synthetic
ctgttataggagatttaaagtgtactacagtttccattaatgatgttgacactggtgttccttctattagcactg

SEQ ID NO: 205021 - DNA, 75 bp, Artificial Sequence
  Synthetic
cttattttatcactgacgagaagagtggtggtagtaagagtgtttgcactgttatagacattttgttggatgatt

SEQ ID NO: 205022 - DNA, 75 bp, Artificial Sequence
  Synthetic
taactattttgatagttatcttggttgtgttgtcaatgctgataatagtacttctagtgttgttcaaacatgtga

SEQ ID NO: 205023 - DNA, 75 bp, Artificial Sequence
  Synthetic
aagggaactttactattgagcacactatggtttaaaccaccttttctttctgattttactaatggtatttttgct

SEQ ID NO: 205024 - DNA, 75 bp, Artificial Sequence
  Synthetic
tgcaaaggctattgcagtagcagctggacagcagtttgttaaagagactaccgatatggttaagtctaaaggagt

SEQ ID NO: 205025 - DNA, 75 bp, Artificial Sequence
  Synthetic
ctgcatatagggaggctgcttgttctcagttggctaaagcaatggacacatttaccaataataatggtagtgatg

SEQ ID NO: 205026 - DNA, 75 bp, Artificial Sequence
  Synthetic
ttttacagacactggtgttgttactaagtttctgtttaatgtttatttaggcacggtgctctcacattattatgt

SEQ ID NO: 205027 - DNA, 75 bp, Artificial Sequence
  Synthetic
catataagcgtggttttcttgacaagataagcgatactagtggttttgctgtttatgttaagtccaaagtcggta

SEQ ID NO: 205028 - DNA, 75 bp, Artificial Sequence
  Synthetic
tgcttccaactcatctatattgtctttatgtgcgttttctgtagatcctaagaaaacgtatttagattttataca

SEQ ID NO: 205029 - DNA, 75 bp, Artificial Sequence
  Synthetic
gatgctaccaattctgctttagttaaaattcaagctgttgttaatgcaaatgctgaagctcttaataacttattg

SEQ ID NO: 205030 - DNA, 75 bp, Artificial Sequence
  Synthetic
gcattacagtttactacattgaccttggataaagtgccgcaggccattgaaacgagagttcaatgtagtaccaat

SEQ ID NO: 205031 - DNA, 75 bp, Artificial Sequence
  Synthetic
gatacatttttgtctatgtttgatgtggataaaaagagtcttaatgctttaatagcaactgcgcattcttctata

SEQ ID NO: 205032 - DNA, 75 bp, Artificial Sequence
  Synthetic
gtacaggaaagtcacatcttgctattggtcttgctgtatattattgtacagcacgtgtagtatacactgcggcca

SEQ ID NO: 205033 - DNA, 75 bp, Artificial Sequence
  Synthetic
tgataagtttaaaattaatgacaccactcgtaagtatgtgtttactactataaatgcattacctgagatggtgac

SEQ ID NO: 205034 - DNA, 75 bp, Artificial Sequence
  Synthetic
cttgttctactgatttacaaaaatcaaacacagacataattcttggtgtttgtgttaattatgatctttatggta

SEQ ID NO: 205035 - DNA, 75 bp, Artificial Sequence
  Synthetic
gcaccagatttgtcacttgattatataaatgttacattcttggacctacaagatgaaatgaataggttacaggag

SEQ ID NO: 205036 - DNA, 75 bp, Artificial Sequence
  Synthetic
gctggcgaggaagttcttgctcctaaattgtattgtgcctttacagctcctgaagatgatgactttcttgaggaa

SEQ ID NO: 205037 - DNA, 75 bp, Artificial Sequence
  Synthetic
gtcgagcatattataatagctaccacaatgcctgctgtttagtgggtactgtgtcttatataactagtaaacctg

SEQ ID NO: 205038 - DNA, 75 bp, Artificial Sequence
  Synthetic
gattgtcaggatgatcggtgtattatacattgtgctaattttaacatactttttagtatggttttacctaataca

SEQ ID NO: 205039 - DNA, 75 bp, Artificial Sequence
  Synthetic
ggtctttgttacattacgtagcattaaccatgatttgttttcttttataatgtttgttggtcgtgtgatttctgt

SEQ ID NO: 205040 - DNA, 75 bp, Artificial Sequence
  Synthetic
taaagatggtttgtgtatgttttggaactgcaatgtggataagtatccaccgaatgcagttgtatgtagatttga

SEQ ID NO: 205041 - DNA, 75 bp, Artificial Sequence
  Synthetic
aactgcaatgtggataagtatccaccgaatgcagttgtatgtagatttgacacgagagtgttgaataatttaaat

SEQ ID NO: 205042 - DNA, 75 bp, Artificial Sequence
  Synthetic
ggctccgcacaagctacagctttttgtaaatctggtagtttagtccttaataaccctgcttatatagctcctcaa

SEQ ID NO: 205043 - DNA, 75 bp, Artificial Sequence
  Synthetic
tgaacctataactgaaaataatgttgttgttatgagtacctgcgctgttaattatactaaagcgccgtatgtaat

SEQ ID NO: 205044 - DNA, 75 bp, Artificial Sequence
  Synthetic
ggttttgctgtttatgttaagtccaaagtcggtaattaccgactgccatcaacccaaaagggttctggcatggac

SEQ ID NO: 205045 - DNA, 75 bp, Artificial Sequence
  Synthetic
agataagtttgctatacccaatggcaggaaggttgacctacatttgtttaatttgggctatttgcagtcatttaa

SEQ ID NO: 205046 - DNA, 75 bp, Artificial Sequence
  Synthetic
cctgattttaaggaagagttggatcaatggtttaaaaatcaaacatcagtggcaccagatttgtcacttgattat

SEQ ID NO: 205047 - DNA, 75 bp, Artificial Sequence
  Synthetic
acagcattcgctaatactgctagaggaggctgttaacaaactggttttcttagctgttactttattacctgcgga

SEQ ID NO: 205048 - DNA, 75 bp, Artificial Sequence
  Synthetic
gatagcattgggacaaatttcccacttcaattagggttttccacaggaattgattttgttgtggaagccactggt

SEQ ID NO: 205049 - DNA, 75 bp, Artificial Sequence
  Synthetic
ttatgaattgcgctataacggcgcaattaggtttgacagtacactttcaggttttgagaccataatgaaggtgct

SEQ ID NO: 205050 - DNA, 75 bp, Artificial Sequence
  Synthetic
accatggatgtgctaagtcaaaatcaaaagcttattgctaatgcatttaacaatgctcttggtgctattcaggaa

SEQ ID NO: 205051 - DNA, 75 bp, Artificial Sequence
  Synthetic
tagagagttgactgcagaggacatcagccttcttaagaagatggatgagccctatactgaagacacctcagaaat

SEQ ID NO: 205052 - DNA, 75 bp, Artificial Sequence
  Synthetic
acatgtttttgatacttttaatttccttaccaacggcttttgctgttataggagatttaaattgtcctttagata

SEQ ID NO: 205053 - DNA, 75 bp, Artificial Sequence
  Synthetic
ctccagcatacactcttattttatcactgatgagaagagtggtggtagtaagagtgtttgcactgttatagatat

SEQ ID NO: 205054 - DNA, 75 bp, Artificial Sequence
  Synthetic
aaagatcataaacgtggcggttttgaacacgtttataattttaaagttgaggatgcttacgacctggttcatgat

SEQ ID NO: 205055 - DNA, 75 bp, Artificial Sequence
  Synthetic
agaggccctaatcagaattttggtggtggagaaatgttaaaacttggaactagtgacccacagttccccattctt

SEQ ID NO: 205056 - DNA, 75 bp, Artificial Sequence
  Synthetic
gacgatgtctaccttccatatcctaatcctagtcgtatattaggagctggatgttttgtagatgatttgttaaag

SEQ ID NO: 205057 - DNA, 75 bp, Artificial Sequence
  Synthetic
taaattacaaggtcttttagaggtctctgtttgccagtataatatgtgtgagtacccacatacgatttgtcatcc

SEQ ID NO: 205058 - DNA, 75 bp, Artificial Sequence
  Synthetic
ccattcaggattatatacaatctgttaattttgtagcatggctttatgctgctatacttaacaattgtaattggt

SEQ ID NO: 205059 - DNA, 75 bp, Artificial Sequence
  Synthetic
acgttcttttaaaacagccgatggcaaccagcgtcaactgctgccacgatggtatttttactatcttggaacagg

SEQ ID NO: 205060 - DNA, 75 bp, Artificial Sequence
  Synthetic
ttctcaaacatcattacgttgtggcagttgcatcagaaagcctcttctttgctgcaagtgttgttatgatcatgt

SEQ ID NO: 205061 - DNA, 75 bp, Artificial Sequence
  Synthetic
atttgatgaggctggcgaggaagttcttgctcctaaattgtattgtgcttttacagctcctgaagatgatgactt

SEQ ID NO: 205062 - DNA, 75 bp, Artificial Sequence
  Synthetic
gtagagcctctagtgcaggatcgcgtagtagagccaattctggcaatagaacccctacctctggtgtaacacctg

SEQ ID NO: 205063 - DNA, 75 bp, Artificial Sequence
  Synthetic
ataatcaagctctgaattcaatattagataacgctgtgaagggttgtgtaccattgaatgcaataccttcattgg

SEQ ID NO: 205064 - DNA, 75 bp, Artificial Sequence
  Synthetic
ttgataaattgaatgtcctttttgatggtcgtgataatggtgctcttgaagcttttaaacgctctaataatggcg

SEQ ID NO: 205065 - DNA, 75 bp, Artificial Sequence
  Synthetic
aagcaacagtatagtcagttgtttgttgataccttggttaataagatacctgctaatattgtagttccacaaggt

SEQ ID NO: 205066 - DNA, 75 bp, Artificial Sequence
  Synthetic
ggtacttataagtgcccccaaactaaatctttagttggtataggtgagcactgttcgggtcttgctgttaaaagt

SEQ ID NO: 205067 - DNA, 75 bp, Artificial Sequence
  Synthetic
ttagaggaagaaattcttcttatgttggcttccctttttggtacttacacatggacaacagttttatctatggct

SEQ ID NO: 205068 - DNA, 75 bp, Artificial Sequence
  Synthetic
gttgtacctgagggttggcgtgttgtcaataagttttatcaaattaatggtgttagaaccgttaagtattttgag

SEQ ID NO: 205069 - DNA, 75 bp, Artificial Sequence
  Synthetic
cgtgcgtgcatcccgcttcactgatctcttgttagatctttttataatctaaactttataaaaacatccactccc

SEQ ID NO: 205070 - DNA, 75 bp, Artificial Sequence
  Synthetic
taaggttgttaatgttaatgttgattttaaagattttcagttcatgctttggtgtaacgatgagaaagttatgac

SEQ ID NO: 205071 - DNA, 75 bp, Artificial Sequence
  Synthetic
cagtatgtttgtttatgttattaagatgatcattttgtggcttatgtggccccttactatcatcttaactatttt

SEQ ID NO: 205072 - DNA, 75 bp, Artificial Sequence
  Synthetic
tgattctaatggtaacctctacggttttagagactacataacaaacagaacttttatgattcgtagttgctatag

SEQ ID NO: 205073 - DNA, 75 bp, Artificial Sequence
  Synthetic
tgttattaatgctcgtattcgtgctaagcattatgtttatattggtgatcctgctcaattgccagcaccacgtgt

SEQ ID NO: 205074 - DNA, 75 bp, Artificial Sequence
  Synthetic
tgtctacaggaaaagtttttatttccgtaagtcttgtcaaaatttagattgtaattgtttggggttttatgaatc

SEQ ID NO: 205075 - DNA, 75 bp, Artificial Sequence
  Synthetic
cgtgaaattgttatgaatacacgtccatatgatttggaggtgctacttcaagatgctttgcagtcccgcgaagca

SEQ ID NO: 205076 - DNA, 75 bp, Artificial Sequence
  Synthetic
attgtgagcgaattgcgtgcgtgcatcccgcttcaccgatctcttgttagatctcttttaatctaaactttataa

SEQ ID NO: 205077 - DNA, 75 bp, Artificial Sequence
  Synthetic
tcccgcttcaccgatctcttgttagatctcttttaatctaaactttataaaaacacccactccctgtaatctatg

SEQ ID NO: 205078 - DNA, 75 bp, Artificial Sequence
  Synthetic
atctcttttaatctaaactttataaaaacacccactccctgtaatctatgcttgcgagcttagacttttcatagt

SEQ ID NO: 205079 - DNA, 75 bp, Artificial Sequence
  Synthetic
tgtgtaacactggtcgctgcgctgttaacaagcatgtggcctatcagctatatatgattgatcctgcgggtgtct

SEQ ID NO: 205080 - DNA, 75 bp, Artificial Sequence
  Synthetic
aacaactctcagccagggacgtgttgtatcctagtcagtggccctcccataggtcacaatggcgaagatcaacaa

SEQ ID NO: 205081 - DNA, 75 bp, Artificial Sequence
  Synthetic
gtatcctagtcagtggccctcccataggtcacaatggcgaagatcaacaaatacggtctcgacctgcaatgggct

SEQ ID NO: 205082 - DNA, 75 bp, Artificial Sequence
  Synthetic
cacaaatgcaaatgcttcttctagtgaagggtttttaattggcataaattatttgggtaagcccaaggttgagat

SEQ ID NO: 205083 - DNA, 75 bp, Artificial Sequence
  Synthetic
caggggtagaagagctcaacccaagcaaactgctacttctcagcaaccatcaggagggaatgttgtaccctacta

SEQ ID NO: 205084 - DNA, 75 bp, Artificial Sequence
  Synthetic
acacagaggagaagttggataaccctagtgggtcagaggtgggtataatttgccccaccactgcgcaagagttgg

SEQ ID NO: 205085 - DNA, 75 bp, Artificial Sequence
  Synthetic
tagtgggtcagaggtgggtataatttgccccaccactgcgcaagagttgggaacaggtagaattgctcttgagaa

SEQ ID NO: 205086 - DNA, 75 bp, Artificial Sequence
  Synthetic
tatttgttttggagaaattccacagtttggaacgggggtgcttatagcctgtttgatatggctaaattcccgctt

SEQ ID NO: 205087 - DNA, 75 bp, Artificial Sequence
  Synthetic
cttgtagctttagcttttaaaaatgcatttttgacatttaagtggagtgtggttgctagaggtgcttgcattata

SEQ ID NO: 205088 - DNA, 75 bp, Artificial Sequence
  Synthetic
ctcattcaggagggttgtgtgcagtccaacctgatacgtgaaataaagatgaatacacgtcctggtgatatggac

SEQ ID NO: 205089 - DNA, 75 bp, Artificial Sequence
  Synthetic
aggcttatgctttaattagaggataccgtggtgttaaaccgcttctttatgtagaccagtatggttgtgattata

SEQ ID NO: 205090 - DNA, 75 bp, Artificial Sequence
  Synthetic
ccaacctgatacgtgaaataaagatgaatacacgtcctggtgatatggaccgtgttattcaagatgccttactgt

SEQ ID NO: 205091 - DNA, 75 bp, Artificial Sequence
  Synthetic
cccgcggcgtttgtctattgagacatgctataagtggggttgttgtccacaaggttgggctatgggactgtttag

SEQ ID NO: 205092 - DNA, 75 bp, Artificial Sequence
  Synthetic
ggagccaggaactcccttttgatgtaactgtggcatggcacgttgtgcgtgatccacgttatgttatgagactgc

SEQ ID NO: 205093 - DNA, 75 bp, Artificial Sequence
  Synthetic
cttgatgggtattgtaagctttttataactaaagaagaagctgttaaacgcgtgcgtgcctgggttggctttgat

SEQ ID NO: 205094 - DNA, 75 bp, Artificial Sequence
  Synthetic
aaggttgggctatgggactgtttagacgttgtagcacctgttatggaggttgcgacgtgaatagtcatgtagcat

SEQ ID NO: 205095 - DNA, 75 bp, Artificial Sequence
  Synthetic
acgttgtagcacctgttatggaggttgcgacgtgaatagtcatgtagcataccaattgtttttaatagacccaca

SEQ ID NO: 205096 - DNA, 75 bp, Artificial Sequence
  Synthetic
tgcatatgttgctaaccctactgaagacttgtgtgatggttctgttgttataaaggaacctgtgcatgtttatgc

SEQ ID NO: 205097 - DNA, 75 bp, Artificial Sequence
  Synthetic
tttgtagggtgggtggtgcctctagctaagttatcaaaagaggcacaagccaaaactgtgccctggaccatgtgg

SEQ ID NO: 205098 - DNA, 75 bp, Artificial Sequence
  Synthetic
tatctaaggaattgaaacggcctattcagcctacagatgttgcttatcatacggttacggatgttaagcaagttg

SEQ ID NO: 205099 - DNA, 75 bp, Artificial Sequence
  Synthetic
caaaactgtgccctggaccatgtggttgcgtaaacgtggagaaaagggtgcttataataaataccacaagcttga

SEQ ID NO: 205100 - DNA, 75 bp, Artificial Sequence
  Synthetic
ttgttggaaagagcctacgatagtgttcttgatgaacctaaaggtaaattttctgcaaaagcatttgctctttta

SEQ ID NO: 205101 - DNA, 75 bp, Artificial Sequence
  Synthetic
ttcttgatgaacctaaaggtaaattttctgcaaaagcatttgctcttttaagaagttatcgtggtgttaagccac

SEQ ID NO: 205102 - DNA, 75 bp, Artificial Sequence
  Synthetic
tttgttatataattcatcttgtttttcgcagcaaggcgtttttaggtatgataatattagcagtgtctggcctct

SEQ ID NO: 205103 - DNA, 75 bp, Artificial Sequence
  Synthetic
gttcctggtaatatgatagatggttttgcttgcactacttgtggtcatgtctatgagacaggtgatttgctagca

SEQ ID NO: 205104 - DNA, 75 bp, Artificial Sequence
  Synthetic
tgattatactggtagtcttgcagttggtttagaggcttatgctgataagacactccaggaaatgaagagtttatt

SEQ ID NO: 205105 - DNA, 75 bp, Artificial Sequence
  Synthetic
ggtttagaggcttatgctgataagacactccaggaaatgaagagtttatttggtgtttggagtcaggaactttct

SEQ ID NO: 205106 - DNA, 75 bp, Artificial Sequence
  Synthetic
tagacttgaaatagttaagcttggtgctgaaaagaaagatggtttttatgaaaccatagttagccactggatggg

SEQ ID NO: 205107 - DNA, 75 bp, Artificial Sequence
  Synthetic
ttgtgcgtgatacacgctacaaaatgaaattacagagtgctgctactatacgtagtatcacatatgttgccaatc

SEQ ID NO: 205108 - DNA, 75 bp, Artificial Sequence
  Synthetic
attgttgatattcaacagtggggatatattggttctttatcaagtaatcatgatttatattgtagtgtccataaa

SEQ ID NO: 205109 - DNA, 75 bp, Artificial Sequence
  Synthetic
gaaattacagagtgctgctactatacgtagtatcacatatgttgccaatcctactgaagatttgtgtgatggttc

SEQ ID NO: 205110 - DNA, 75 bp, Artificial Sequence
  Synthetic
tgttattgcttataggaatggtctttgttacattacgtagcattaaccatgatttgttttcttttataatgtttg

SEQ ID NO: 205111 - DNA, 75 bp, Artificial Sequence
  Synthetic
gtttatgctgctgattctattatccttcggctacccaagttagttgccattatggatcatttttatatggaagaa

SEQ ID NO: 205112 - DNA, 75 bp, Artificial Sequence
  Synthetic
tgttcaacacaagtgtggcaatttacaccagcgggagttgctaggtgtgtcagatgtgtggcataaacaattgtt

SEQ ID NO: 205113 - DNA, 75 bp, Artificial Sequence
  Synthetic
tatggatcatttttatatggaagaagatagggctcttgatgctatttatggtgtcaagttggaagaatgtggtct

SEQ ID NO: 205114 - DNA, 75 bp, Artificial Sequence
  Synthetic
atagatgctttagcttctatgactggtgtgtctttggaaacactattggctgctattaagcgtcttaagaatggt

SEQ ID NO: 205115 - DNA, 75 bp, Artificial Sequence
  Synthetic
tgttatgcaatttggttatattgattgcaagcaagattcttgcgattttagaggttggcttcctggcaatatgat

SEQ ID NO: 205116 - DNA, 75 bp, Artificial Sequence
  Synthetic
tgcaagcaagattcttgcgattttagaggttggcttcctggcaatatgatagatggttttgtgtgcacaacttgt

SEQ ID NO: 205117 - DNA, 75 bp, Artificial Sequence
  Synthetic
ttagatcgtgtgtatttaaataccacgttgttgctcaatggttattatcccacttcgggctccacataccgtaat

SEQ ID NO: 205118 - DNA, 75 bp, Artificial Sequence
  Synthetic
cgttgttgctcaatggttattatcccacttcgggctccacataccgtaatatggctttgaagggtactttattgt

SEQ ID NO: 205119 - DNA, 75 bp, Artificial Sequence
  Synthetic
ggttttatgccttttcttttagatgatttggttccgcgcgcatattatttggcagtaagtggtcaagcattttgt

SEQ ID NO: 205120 - DNA, 75 bp, Artificial Sequence
  Synthetic
tactagctcaatcttcaggtgttttaccatcaaaccctgttttgcgcactaagagtgcagcaggttatgcgggtt

SEQ ID NO: 205121 - DNA, 75 bp, Artificial Sequence
  Synthetic
taggttttgataaccctcctaccaatgttgtttcgcatttaaatggagattggtttttatttggtgacagtcgtt

SEQ ID NO: 205122 - DNA, 75 bp, Artificial Sequence
  Synthetic
ttttttgtctgattttactgcgggtatttttgcaaaggtaaaaaataccaaagttgttaagagtggtgtaacata

SEQ ID NO: 205123 - DNA, 75 bp, Artificial Sequence
  Synthetic
ctgttgtgtctaagagtaaagagttacttgatgtgtctctggattctttaagtgcagctatacattatttgaatt

SEQ ID NO: 205124 - DNA, 75 bp, Artificial Sequence
  Synthetic
aagagtgcagcaggttatgcgggttttggttgtaaagattcttttactttatttgaccagactgtagtgtgtttt

SEQ ID NO: 205125 - DNA, 75 bp, Artificial Sequence
  Synthetic
ggtggttgtgtttattggaacccagtgcctaagatatggattccaatattaaagtcatctgttaaggcttttgat

SEQ ID NO: 205126 - DNA, 75 bp, Artificial Sequence
  Synthetic
tgcctaagatatggattccaatattaaagtcatctgttaaggcttttgatggtttggtttatacaggatctgtag

SEQ ID NO: 205127 - DNA, 75 bp, Artificial Sequence
  Synthetic
gagctacatcaatctcaaggacattggtacatatgagtattatgtaaaatggccttggtatgtatggcttttaat

SEQ ID NO: 205128 - DNA, 75 bp, Artificial Sequence
  Synthetic
taaattacaaggtcttttagaggtctctgtttgccagtataatatgtgcgagtacccacaaacgatttgtcatcc

SEQ ID NO: 205129 - DNA, 75 bp, Artificial Sequence
  Synthetic
tgctcttatttgtaaggccttgtatcttgattatgttcaacataagtgtggcaacttggatcagcgtgagttgtt

SEQ ID NO: 205130 - DNA, 75 bp, Artificial Sequence
  Synthetic
cttgattatgttcaacataagtgtggcaacttggatcagcgtgagttgttagggttgtcagatgtgtggcataag

SEQ ID NO: 205131 - DNA, 75 bp, Artificial Sequence
  Synthetic
ataaacctttgttagatcatattgattattttaatatgcgtcgtgctaaatttagtttagaaacatttactgttt

SEQ ID NO: 205132 - DNA, 75 bp, Artificial Sequence
  Synthetic
acagctctttgtaaatctggtagtttagttcttaataaccctgcatatatagctcgtgaagctaattttggggat

SEQ ID NO: 205133 - DNA, 75 bp, Artificial Sequence
  Synthetic
gagtcttacaatacagctactacagcaggttttactttttgggtctataagacatttgatttttataatttgtgg

SEQ ID NO: 205134 - DNA, 75 bp, Artificial Sequence
  Synthetic
gttcagatggctttatgccttttttagtagatgatttaatacctcgttcatattatttgattaaaagtggccagg

SEQ ID NO: 205135 - DNA, 75 bp, Artificial Sequence
  Synthetic
agtagatgatttaatacctcgttcatattatttgattaaaagtggccaggccttttctgaaaattttgatcagtt

SEQ ID NO: 205136 - DNA, 75 bp, Artificial Sequence
  Synthetic
gctggtgaaatgccttgtgccattataaatgataaagttgtgactaagatcgataaggaggatgttgtcattttt

SEQ ID NO: 205137 - DNA, 75 bp, Artificial Sequence
  Synthetic
gaagtgtctcttgactctttggaagcagcgatgtgttatttaaatcttaaaattgcagatttggcacaacatttt

SEQ ID NO: 205138 - DNA, 75 bp, Artificial Sequence
  Synthetic
tctgtttttaagcctcgacctgcaggtgttcttactaatcatgatgtagtttatgcacaacactgtttcaaagct

SEQ ID NO: 205139 - DNA, 75 bp, Artificial Sequence
  Synthetic
cagcgatgtgttatttaaatcttaaaattgcagatttggcacaacattttagtgcattaggcacagtttttgtgt

SEQ ID NO: 205140 - DNA, 75 bp, Artificial Sequence
  Synthetic
ggtaaactacttgttagagatacaaataaagaagtttttgttggtgacagtttggttaatgtaatctaaacttta

SEQ ID NO: 205141 - DNA, 75 bp, Artificial Sequence
  Synthetic
ttttactactaatactgctcgtgcatttgcatgggttttatttcatgtgttgcatgggttttacatggtagttga

SEQ ID NO: 205142 - DNA, 75 bp, Artificial Sequence
  Synthetic
tttgcatgggttttatttcatgtgttgcatgggttttacatggtagttgagagtagtatatattttgttaagagc

SEQ ID NO: 205143 - DNA, 75 bp, Artificial Sequence
  Synthetic
taatgtttatatggccaaggctggtgacaaatattaccctgttgtggttgatggtcatgtaggactcttggatca

SEQ ID NO: 205144 - DNA, 75 bp, Artificial Sequence
  Synthetic
aggcgtgttacatttaaggaacagcctacagtaaatgagattgcaagcacacctaagactattaaagttttttat

SEQ ID NO: 205145 - DNA, 75 bp, Artificial Sequence
  Synthetic
tacaggcatttcaggacgttgttagagttgtattggaatctttaagagttacttttattaaaggcctttctgttt

SEQ ID NO: 205146 - DNA, 75 bp, Artificial Sequence
  Synthetic
acaggtgttgtttcctgtttatataagcgtaatttcacatatgatgtgaatgctaattatttgtattttcatttt

SEQ ID NO: 205147 - DNA, 75 bp, Artificial Sequence
  Synthetic
gagcttgacaaagattttaatactattttaaacactgcatgtggagtgtttgaagtagatgataccgtggatatg

SEQ ID NO: 205148 - DNA, 75 bp, Artificial Sequence
  Synthetic
agttgtattggaatctttaagagttacttttattaaaggcctttctgtttttaagataggacgtaaaagaatttg

SEQ ID NO: 205149 - DNA, 75 bp, Artificial Sequence
  Synthetic
cttgagcgtggtttgttagattcatcgcacttaccatcgagtgtttatgatttgaccatgcctagtaaaattcag

SEQ ID NO: 205150 - DNA, 75 bp, Artificial Sequence
  Synthetic
ggtggacaaggttggagacactgattgtgtgttttattttgctgtgcgtaaagaaggtcaggatgtcatcttcag

SEQ ID NO: 205151 - DNA, 75 bp, Artificial Sequence
  Synthetic
cgcacttaccatcgagtgtttatgatttgaccatgcctagtaaaattcagaaagccaaccagaagcctatttatt

SEQ ID NO: 205152 - DNA, 75 bp, Artificial Sequence
  Synthetic
ctaatgtttctgttagcaggtttaatccttctacttggaatagaagatttggttttacagagcaagctgttttta

SEQ ID NO: 205153 - DNA, 75 bp, Artificial Sequence
  Synthetic
attaagtgatgatgtggtagaagttgttacagcttcaattataccatgtggctattctaaaccacctaaaatagc

SEQ ID NO: 205154 - DNA, 75 bp, Artificial Sequence
  Synthetic
taatcatgatgttgtctatgcacaacattgttttaaagcccctaccactttttgtccatgtaaattgaatggctc

SEQ ID NO: 205155 - DNA, 75 bp, Artificial Sequence
  Synthetic
agaaaaaatctgtgttgtggataatgtttatatggctaaggctggtgataaatattatcctgtagtggtagataa

SEQ ID NO: 205156 - DNA, 75 bp, Artificial Sequence
  Synthetic
aatattatcctgtagtggtagataaacaggtagggcttttggatcaggtatggaggattccttgtgcaggtaggc

SEQ ID NO: 205157 - DNA, 75 bp, Artificial Sequence
  Synthetic
cattgttttaaagcccctaccactttttgtccatgtaaattgaatggctctctttgtgttggtagtggtcctggt

SEQ ID NO: 205158 - DNA, 75 bp, Artificial Sequence
  Synthetic
atttaactgtcacaagtgctggagagccttgtgttgccagtgaacaggaggagtcttctgaaatcttagaggaca

SEQ ID NO: 205159 - DNA, 75 bp, Artificial Sequence
  Synthetic
gtataggtacttgccctgcaggtacttattatttaacatgctacaattataatcaatgtacttgtttatgtgcac

SEQ ID NO: 205160 - DNA, 75 bp, Artificial Sequence
  Synthetic
agttaaagaaatttctacttcattaaaaataaaggtctgttatgaacttgatgtggattttaattctatattaaa

SEQ ID NO: 205161 - DNA, 75 bp, Artificial Sequence
  Synthetic
ttcaaccagaagattattggtggtttgcacttgttaataggcttgtaccgaagacagcaaacttccaatctggtt

SEQ ID NO: 205162 - DNA, 75 bp, Artificial Sequence
  Synthetic
aaaataaaggtctgttatgaacttgatgtggattttaattctatattaaacactgcttgtagcgtgtttgaggta

SEQ ID NO: 205163 - DNA, 75 bp, Artificial Sequence
  Synthetic
ttattatttaacatgctacaattataatcaatgtacttgtttatgtgcacctgatcccatcacatccacagtcgc

SEQ ID NO: 205164 - DNA, 75 bp, Artificial Sequence
  Synthetic
ccccaaactagatatttggttggtgtaggagagcattgttctggtcttgctattaatagtgatcattgtggaggc

SEQ ID NO: 205165 - DNA, 75 bp, Artificial Sequence
  Synthetic
tttcagctgttgttgctgatgcaatagaggacaaacttactccatgtaaggagcttgatggtgtaggcgctaaag

SEQ ID NO: 205166 - DNA, 75 bp, Artificial Sequence
  Synthetic
cttccttctataagtactgatactgttgatgttactaatggtttgggtacttattatgttttagatcgtgtgtat

SEQ ID NO: 205167 - DNA, 75 bp, Artificial Sequence
  Synthetic
taggagagcattgttctggtcttgctattaatagtgatcattgtggaggcaatctttgtacttgccaaccacaag

SEQ ID NO: 205168 - DNA, 75 bp, Artificial Sequence
  Synthetic
agaggacaaacttactccatgtaaggagcttgatggtgtaggcgctaaagttagtgcctttttgcagaagttgga

SEQ ID NO: 205169 - DNA, 75 bp, Artificial Sequence
  Synthetic
ttgtttacaaggggacaggtgtaatattttttctaatttaattttgcatggtgttaatagtggtactacttgttc

SEQ ID NO: 205170 - DNA, 75 bp, Artificial Sequence
  Synthetic
gaagctggtgattgtatcctagcttctaaattgtactgcacattctcagagccggttgatgaagattttggggat

SEQ ID NO: 205171 - DNA, 75 bp, Artificial Sequence
  Synthetic
ttggtgtaacgatgagaaagttatgactttctatcctcgtttgcaagctgcatctgactggaagcctggttattc

SEQ ID NO: 205172 - DNA, 75 bp, Artificial Sequence
  Synthetic
gagtttcctgctataactataggtagtacttttgtaaatacatcctatagtgtggtagtacaaccacatactacc

SEQ ID NO: 205173 - DNA, 75 bp, Artificial Sequence
  Synthetic
ctaaattgtactgcacattctcagagccggttgatgaagattttggggatccagaacttgaagaagacgatgttg

SEQ ID NO: 205174 - DNA, 75 bp, Artificial Sequence
  Synthetic
caaagttatctctgctcttctaagtcaatggctgagtcaccctttcgcgtgcaaagccgctatgtcctcatcact

SEQ ID NO: 205175 - DNA, 75 bp, Artificial Sequence
  Synthetic
tacgctcaatgcggagagctggacccatgggctgttcacgactctattacttcatacccagctgagtgtctcatt

SEQ ID NO: 205176 - DNA, 75 bp, Artificial Sequence
  Synthetic
ggtcgagagaaccacgctgatgggggcattcatctccacgctttcgtggatttcggtcgacgcatcaatctcagg

SEQ ID NO: 205177 - DNA, 75 bp, Artificial Sequence
  Synthetic
gacccgcgacgcttcgatgttgacgaccgccacccgaacattcaaccatgtggtagaacaccacaaaagatgctc

SEQ ID NO: 205178 - DNA, 75 bp, Artificial Sequence
  Synthetic
gactatgcgatcaaggacggagacgttgtcgcaggagggctcagtaccagaatcggaactgaaattcagggaact

SEQ ID NO: 205179 - DNA, 75 bp, Artificial Sequence
  Synthetic
gacaacgtctggtctcgaattgcagatgcagcaagtgtggaggagttttgggagcttgttcgagagctggcacca

SEQ ID NO: 205180 - DNA, 75 bp, Artificial Sequence
  Synthetic
cgagcgcttttatgcaaccaccaatctctccgtgcctacgccgagtggcactatcgaccccctgcggttgcatac

SEQ ID NO: 205181 - DNA, 75 bp, Artificial Sequence
  Synthetic
gaacacccccctggacttcagctttgcactggaaaatttccagaactcgatgcgtgggtacgtgacaacctgtct

SEQ ID NO: 205182 - DNA, 75 bp, Artificial Sequence
  Synthetic
ggaactggtaagtagcgcccgtcgcctgatgccgcgaggccataaatggcctttcgggggggccccccccggggg

SEQ ID NO: 205183 - DNA, 75 bp, Artificial Sequence
  Synthetic
tcccaccccctccctcagcggccggctcgagggcttttcttatagaaaggaatcctactaatggttgtacagttg

SEQ ID NO: 205184 - DNA, 75 bp, Artificial Sequence
  Synthetic
gacgtcctcgaagcctgattttgtggggcgagacgcgtctcggaaaaacggtctgggcgcgatcactgggtccac

SEQ ID NO: 205185 - DNA, 75 bp, Artificial Sequence
  Synthetic
acatccactgctgcctgcagtggaacgtggacgacctcaagtcagggctggaagacgccaagtacgcagtgcttg

SEQ ID NO: 205186 - DNA, 75 bp, Artificial Sequence
  Synthetic
acgatattcaagggaacttccagttttttccggcatacaaggggtggcttggagggcaatccacattcacggtca

SEQ ID NO: 205187 - DNA, 75 bp, Artificial Sequence
  Synthetic
cggataaatacagggggaagacgacgatcaattgggggaggcccaccatctggctcatgaatgacgatccagaag

SEQ ID NO: 205188 - DNA, 75 bp, Artificial Sequence
  Synthetic
aagtggggcacgtggacttcaattggttgcagggaaattgtgacatcatccacctcaccgaatctctcattgtct

SEQ ID NO: 205189 - DNA, 75 bp, Artificial Sequence
  Synthetic
agctagcgctcgtgccaataataggtaccctcagggttgaaagtcaaggcctgatttcaaccagttgctggtact

SEQ ID NO: 205190 - DNA, 75 bp, Artificial Sequence
  Synthetic
gcattgtaaacaatgtcgtacacatacaaatcccccatcccaggcttgccagtcaccgaaaccggtgagccgccg

SEQ ID NO: 205191 - DNA, 75 bp, Artificial Sequence
  Synthetic
tcagtgggggcagtgtcatcttcgtcatcatcgtaaaccaaattcttccgcgccggatgccattggcggaatgtg

SEQ ID NO: 205192 - DNA, 75 bp, Artificial Sequence
  Synthetic
cgggacattccgctctcatcgccggggttgagtgtgactgttcggtcatacatcggtgtgatgcgtgacgtgtcc

SEQ ID NO: 205193 - DNA, 75 bp, Artificial Sequence
  Synthetic
agcttggcagtgaactcggaaccccaatcacctccctcgaatccatcccaccaaacactgcgtatgtgtgctgcc

SEQ ID NO: 205194 - DNA, 75 bp, Artificial Sequence
  Synthetic
tgatccaaagtgggctgtgcaatggcgcgcaccatgtccaccccatgaccggttggatccaccactttgttgtaa

SEQ ID NO: 205195 - DNA, 75 bp, Artificial Sequence
  Synthetic
tagggtacaatccacggggtatcctggtcgtacagggatctacccttgtaagtgaaaacaacgcggcgccatttc

SEQ ID NO: 205196 - DNA, 75 bp, Artificial Sequence
  Synthetic
cacacaccgtctcctaggacgtcgatctgcaggcgttctttgtacccaacagagaaggtcgtctgacgctgtcgg

SEQ ID NO: 205197 - DNA, 75 bp, Artificial Sequence
  Synthetic
gccgattcaccctctgcatgcaacccaagtcggcgtgcactcgggcaaaacggggatgtgaaccccgtcgtggtg

SEQ ID NO: 205198 - DNA, 75 bp, Artificial Sequence
  Synthetic
gtgagggggttcaaattgaaagtgccgtcgggagaaatgaagccaggcatcatgttatcatgcttcttaatcgaa

SEQ ID NO: 205199 - DNA, 75 bp, Artificial Sequence
  Synthetic
gtgatgttcgagatgcggcggcgggaatttcgagccccagaatatttgcgagttcttcgacctcgagtcgtaact

SEQ ID NO: 205200 - DNA, 75 bp, Artificial Sequence
  Synthetic
gtcttgcgaaaagtagaacggcgccgagacgtacgcgcgcggcgacgacgtcgggtgtaacggcgcggcattctg

SEQ ID NO: 205201 - DNA, 75 bp, Artificial Sequence
  Synthetic
ggcaatgctcacacgtcgaagcggttgagggtggggcagctgaaaatgctggcgggggcgtctcgcgaacgtacg

SEQ ID NO: 205202 - DNA, 75 bp, Artificial Sequence
  Synthetic
aataaaatgcctcgttcggatccatttaaaatcggagaagttgttggagggaaaaaaaatcgcgcaaagcggggt

SEQ ID NO: 205203 - DNA, 75 bp, Artificial Sequence
  Synthetic
cgcgcaaagcggggtacccctcggcctatttatacctcgctccccgctggctcatggctcattgagaagagcaga

SEQ ID NO: 205204 - DNA, 75 bp, Artificial Sequence
  Synthetic
gtaaaattttcgaattttataataattaagaaaggagtttaatagtttatcacaacttaaaagtgaaatttattt

SEQ ID NO: 205205 - DNA, 75 bp, Artificial Sequence
  Synthetic
acgcgtggatgtccaatggtctgtacgtggatcaagatgtcacacgagctcaaatctacatgttcaagcccacca

SEQ ID NO: 205206 - DNA, 75 bp, Artificial Sequence
  Synthetic
aagaaaggaggactacttatgcaagtagcccctaatgtatggagtaaatattttaatattccaaatccaggatta

SEQ ID NO: 205207 - DNA, 75 bp, Artificial Sequence
  Synthetic
tgttatggaagtatgaaaatctgggaaccaccggtactaaattagtaccactcatgatgcccaaagctggagata

SEQ ID NO: 205208 - DNA, 75 bp, Artificial Sequence
  Synthetic
cgtgcttactttagcaatgtagtgtctggacagccggaggtatatcggacgccattttataaaggtatgtctttg

SEQ ID NO: 205209 - DNA, 75 bp, Artificial Sequence
  Synthetic
acaggaaattggttgatttccaggtactgttcaataatctcgtctccactatgttaggtgatgaagatttcggca

SEQ ID NO: 205210 - DNA, 75 bp, Artificial Sequence
  Synthetic
gaatccatctgtgacgagtggtacaagaaacttgtgtctatagacacacagtggcccaccttgatggaattcgaa

SEQ ID NO: 205211 - DNA, 75 bp, Artificial Sequence
  Synthetic
tcatgagcggtgacgtctttaaggcgttcggtgctgatggtctggttaaactgctggctgttgacagcactacca

SEQ ID NO: 205212 - DNA, 75 bp, Artificial Sequence
  Synthetic
gatgacctgcggaagaaggtcggtccgatgtcagtcatgttgcctttaaaggaaagaatgagtgacattgactct

SEQ ID NO: 205213 - DNA, 75 bp, Artificial Sequence
  Synthetic
tgacattgcccacatacgatcccctcatcctggctcaaattcatagtgctagggctgtgggcgcacctatcctgg

SEQ ID NO: 205214 - DNA, 75 bp, Artificial Sequence
  Synthetic
tactatgattctatctccaaggatcaggttcccttcgatacaaaggctattagcgcggccaaatcggagtggaaa

SEQ ID NO: 205215 - DNA, 75 bp, Artificial Sequence
  Synthetic
aaacttccactcttactggtttcccaggccgtcagtggcaaattacacaaaaccctgacgttaataatggcgcca

SEQ ID NO: 205216 - DNA, 75 bp, Artificial Sequence
  Synthetic
ggcgtatcccgactacgcctgcgcagcgaggttaacactgttgccgtcatgaagaagtcaaccaacagtggatcg

SEQ ID NO: 205217 - DNA, 75 bp, Artificial Sequence
  Synthetic
tcatattccatccctcttttggatatgatggacaggatcacgaggaattatccttccgggccatgtgttctaaca

SEQ ID NO: 205218 - DNA, 75 bp, Artificial Sequence
  Synthetic
ccatacttctccaagcggaaagcagttgtatctaagactataccatgtgatgtgtacatggatggtcgatattgt

SEQ ID NO: 205219 - DNA, 75 bp, Artificial Sequence
  Synthetic
tgattctcaatcttcctggtgaggcacactcggcggagatgatcattgaggctactcgcctggctactatgttcc

SEQ ID NO: 205220 - DNA, 75 bp, Artificial Sequence
  Synthetic
gtcatgcgccagaatggtcgtgaatggtctggtgcagctgtgctcgggtggcgaggccaggagggtggccctaaa

SEQ ID NO: 205221 - DNA, 75 bp, Artificial Sequence
  Synthetic
aggtgaaggcagttccggccggtgatacatctaagcccgtgctgtatttgccaaatggtttcgggactgaggtcg

SEQ ID NO: 205222 - DNA, 75 bp, Artificial Sequence
  Synthetic
ccaacagacgtgaaacagcgggtagtgtggatgtttcctttcgctgttaatattcgtgagctgcaggtctatcaa

SEQ ID NO: 205223 - DNA, 75 bp, Artificial Sequence
  Synthetic
ttaatgactacactatgatcagtgtagataaagcaactccacacgacctcaccatccataccttcttcaacaaca

SEQ ID NO: 205224 - DNA, 75 bp, Artificial Sequence
  Synthetic
ccactaatccttacgttccaaagattgggattggtgccagcgtgggttagcatggaagctgttgataggcgtatc

SEQ ID NO: 205225 - DNA, 75 bp, Artificial Sequence
  Synthetic
ttttggttcctaatgccaaagagaattatgttgcgaatctggaactgctgaataacatcattcagttcgattggg

SEQ ID NO: 205226 - DNA, 75 bp, Artificial Sequence
  Synthetic
actaagatgtttgatacaaaaggaccacgtgatgtggtggtctgtacagacttctccaagttcgaccagcatttt

SEQ ID NO: 205227 - DNA, 75 bp, Artificial Sequence
  Synthetic
ctcctcagctctacctgacgtatggtattgctcaggagtcgtttggtccctttgctcagctgaatgattggacca

SEQ ID NO: 205228 - DNA, 75 bp, Artificial Sequence
  Synthetic
aatccaacgtgccagagtgtagccaaagagctgttggctgatctgcttacaggtcaggaagccgtcgactggtta

SEQ ID NO: 205229 - DNA, 75 bp, Artificial Sequence
  Synthetic
tccttacgggtgaaactctggctcggatgcatgaagtatgtgtcaccagcatgttcgatgttcctcagatgggct

SEQ ID NO: 205230 - DNA, 75 bp, Artificial Sequence
  Synthetic
atgttcgatgttcctcagatgggcttcaacaaataaatgttggcctggggtgtgtgtgcgttaagcacacacctc

SEQ ID NO: 205231 - DNA, 75 bp, Artificial Sequence
  Synthetic
gaacgtgtgttcccaattaaatatgctatacccttagcttataattggggtgaaatcaggtatggtatccatgga

SEQ ID NO: 205232 - DNA, 75 bp, Artificial Sequence
  Synthetic
atgggatcgggttctggcggcactaacgccgatgagacgttggtgcatagggtgctgcaacacgaagcagcgatt

SEQ ID NO: 205233 - DNA, 75 bp, Artificial Sequence
  Synthetic
agccaccataccactcttaacccaaattcgcagtgtctgggtgacgatggcgttttaacttacccaggtatatct

SEQ ID NO: 205234 - DNA, 75 bp, Artificial Sequence
  Synthetic
gcggaggatgtaatgcaatcatactcgcgccacggtctcgatatgaacctagagaaacagtatgtgagcaaacaa

SEQ ID NO: 205235 - DNA, 75 bp, Artificial Sequence
  Synthetic
gactgcacatatttacgcaggtggcatcatacagattatcgcgtagacggcatgtgtgtgggagtgtactcaacc

SEQ ID NO: 205236 - DNA, 75 bp, Artificial Sequence
  Synthetic
atgcgggcgttaggcaggttggctatgcaagagcgctactatgacccagacgtatggggtgagaagatggtcacc

SEQ ID NO: 205237 - DNA, 75 bp, Artificial Sequence
  Synthetic
ctacgttatctatccatcattgagaatgtgaagtatcatcctctaaaggaagagttcctggacttttgcatcaaa

SEQ ID NO: 205238 - DNA, 75 bp, Artificial Sequence
  Synthetic
ggggataaaactagacttggactaggaatcccaggctttctggacaacatcgctggtgaggcccagaaggctatc

SEQ ID NO: 205239 - DNA, 75 bp, Artificial Sequence
  Synthetic
gacatgatgccagatttccttggctacaccaagtcgttgcagtatgatggtgatctgcgacgtaatgctgctgcc

SEQ ID NO: 205240 - DNA, 75 bp, Artificial Sequence
  Synthetic
ggtattgaaaactggtgggttgttcaagcattgaaatcgagacgctgacgatcgagatggtgcagcaaaccattg

SEQ ID NO: 205241 - DNA, 75 bp, Artificial Sequence
  Synthetic
tgttcaagcattgaaatcgagacgctgacgatcgagatggtgcagcaaaccattgggactaacagtcccaactgc

SEQ ID NO: 205242 - DNA, 75 bp, Artificial Sequence
  Synthetic
gtaaattaaatgctatttacaaaatttaaacagaaaggagagatgttatgaaccggttttacaaggtttcataca

SEQ ID NO: 205243 - DNA, 75 bp, Artificial Sequence
  Synthetic
tcgaaaatagcactacctggggcagccgacacactaacatcgtctgtttaaccagaagtgttactgaaaggaggt

SEQ ID NO: 205244 - DNA, 75 bp, Artificial Sequence
  Synthetic
tatttaatgacagctaatcaaattgcctatcaaaagcatcttgaaacggccagagtcaatgccgtgggtgagatg

SEQ ID NO: 205245 - DNA, 75 bp, Artificial Sequence
  Synthetic
caacgtggacttgaacttgatgagtccaggaggcacaacatttctcaggaacaactgaaaacacgtgagttaact

SEQ ID NO: 205246 - DNA, 75 bp, Artificial Sequence
  Synthetic
gaattggaacgcagcaaccgcgcagttgaaaaggaaacgtctcgtcacaatgtcgttaccgaaactgagacacgc

SEQ ID NO: 205247 - DNA, 75 bp, Artificial Sequence
  Synthetic
agatctaatttagctcgtgagtgggaaacttatcgtagcaattctgcgcgcgaaatggagactcagaggagtaac

SEQ ID NO: 205248 - DNA, 75 bp, Artificial Sequence
  Synthetic
atttcctatgaggctattaagagaggacagctagctctggaccgagctgagctgaacgaatcgatacgtgccacc

SEQ ID NO: 205249 - DNA, 75 bp, Artificial Sequence
  Synthetic
aacgaaaatcttgctttacagtattctaaattacaaacggagagtttactaactcaacgtggtcaagatctacaa

SEQ ID NO: 205250 - DNA, 75 bp, Artificial Sequence
  Synthetic
cataagaatgctattataggtgcaagcgccaatgcattcggttctttgttgggatactcaacagcaagtgcggat

SEQ ID NO: 205251 - DNA, 75 bp, Artificial Sequence
  Synthetic
cgagccagtcgtgaggaaatcgcatccgctaatcgtaaatcacaagaacatattgccagcatgcaagtcttgggt

SEQ ID NO: 205252 - DNA, 75 bp, Artificial Sequence
  Synthetic
agcatggccaataccatgttctcatccgtatccaatctagttggaaagacagctggcgcatttgcaggaggttta

SEQ ID NO: 205253 - DNA, 75 bp, Artificial Sequence
  Synthetic
tcatgaaacagaatgatactaagaaaaccacacaacgtcgcaactccaagaagtacagttctaagacgaaccgcg

SEQ ID NO: 205254 - DNA, 75 bp, Artificial Sequence
  Synthetic
gcacgaaacgtgcgccgcgcgatcaggaggttgggacgggtgcgcaagaaagtactcgtaatgacgttgcttggt

SEQ ID NO: 205255 - DNA, 75 bp, Artificial Sequence
  Synthetic
atgctcgttatcctcatattttggaggaagctacgcgcctgccttttgcttatcctattgggcagtattatgata

SEQ ID NO: 205256 - DNA, 75 bp, Artificial Sequence
  Synthetic
ctggatactctgttgcaagcgctactgagtggtctaagtacgtagatactagcctgaccattcctggtgtgatgt

SEQ ID NO: 205257 - DNA, 75 bp, Artificial Sequence
  Synthetic
gtgttaactttacacccaccccgggtgaatcttataataagaattcacctatcaatatagctgcacagaatgtct

SEQ ID NO: 205258 - DNA, 75 bp, Artificial Sequence
  Synthetic
acacgtatgtgcggcacatgaattccggacacgccaactatgagcaggctgatcttatgatgtacttgctggcta

SEQ ID NO: 205259 - DNA, 75 bp, Artificial Sequence
  Synthetic
tggacagtttgtacattttccacagctatgttcggaaaatccttgccatttccaagttatatacgcctgtgaaca

SEQ ID NO: 205260 - DNA, 75 bp, Artificial Sequence
  Synthetic
agtatttcccgagagctttgttagtagctttgggtgttgatcctgaagatgttttcgctaaccaggcgcaatggg

SEQ ID NO: 205261 - DNA, 75 bp, Artificial Sequence
  Synthetic
aatacttcgtcaacatggtggcatacagggctggagcgttcgctgctcctgcaagtatgacttattatgagcgtc

SEQ ID NO: 205262 - DNA, 75 bp, Artificial Sequence
  Synthetic
aagtcttaagtacccctgcctgtatttagagtctatgtcttattatagacgctcttattaccctcgtaggcgatc

SEQ ID NO: 205263 - DNA, 75 bp, Artificial Sequence
  Synthetic
cccaaagcttacaagactaagttcttctacagactatatatcgaagagactgttaacttcaaaggtccggtcagc

SEQ ID NO: 205264 - DNA, 75 bp, Artificial Sequence
  Synthetic
atgtatgctactaactcttctgtagccggtagcttttatcctctcaatcatgtggacagatttatatatccagtc

SEQ ID NO: 205265 - DNA, 75 bp, Artificial Sequence
  Synthetic
cgcaggagatactaaacatggcctatagaactggattgtatgctttacctattgcaggacgtttcatttacgaat

SEQ ID NO: 205266 - DNA, 75 bp, Artificial Sequence
  Synthetic
tagaactggattgtatgctttacctattgcaggacgtttcatttacgaatacgatcgcatgaaagactacggtaa

SEQ ID NO: 205267 - DNA, 75 bp, Artificial Sequence
  Synthetic
atgaacgagctgggaagtacaacacaggctcctgcccgtaaccctatcaatggttctgactggcacaatgatggc

SEQ ID NO: 205268 - DNA, 75 bp, Artificial Sequence
  Synthetic
gatggcaaaagactacagacgtaatactggccgtacttctaagtatgcaacccagggatatgaagctcagatgta

SEQ ID NO: 205269 - DNA, 75 bp, Artificial Sequence
  Synthetic
aatcaaggaggtgagaactgatggctgaaatatatatcaacaataaacgtatggttgagggtctcctgatgacat

SEQ ID NO: 205270 - DNA, 75 bp, Artificial Sequence
  Synthetic
caggcaagctggtcaattatatgattctgctctttcgtttggtacttctgttgctggacgtgttggaagatcaac

SEQ ID NO: 205271 - DNA, 75 bp, Artificial Sequence
  Synthetic
ttgaggatgatctctggactgatgaggatgaagaggcatactctgacccttcaaatcacttaccgtctgatggtc

SEQ ID NO: 205272 - DNA, 75 bp, Artificial Sequence
  Synthetic
tctgctctttcgtttggtacttctgttgctggacgtgttggaagatcaacaaaggatgtgacgaaattatgacta

SEQ ID NO: 205273 - DNA, 75 bp, Artificial Sequence
  Synthetic
ggatgaagaggcatactctgacccttcaaatcacttaccgtctgatggtctgatgtctgatggtctgactgactg

SEQ ID NO: 205274 - DNA, 75 bp, Artificial Sequence
  Synthetic
cccaaagttatacctattttcttgacctcgctacctcgcctgataaggttcaggtcgttggcgtttcagctggcg

SEQ ID NO: 205275 - DNA, 75 bp, Artificial Sequence
  Synthetic
caggtcgttggcgtttcagctggcggtatggaatgcatgcgtagactattacctttctttgcagcgtacaaatac

SEQ ID NO: 205276 - DNA, 75 bp, Artificial Sequence
  Synthetic
acctttctttgcagcgtacaaatactacaagctcggtcatgtcaagcttaaagtcgttccggctagcactttacc

SEQ ID NO: 205277 - DNA, 75 bp, Artificial Sequence
  Synthetic
tgtcgaccccacaggcttatcttatgaggctggtgaaaacacagttgaccccagagaccagttcaacccaggact

SEQ ID NO: 205278 - DNA, 75 bp, Artificial Sequence
  Synthetic
tgttagaatcaccaatggtgaggacattgtagtcccaactaccatggaccaatactactcattaatgttagatag

SEQ ID NO: 205279 - DNA, 75 bp, Artificial Sequence
  Synthetic
aatactactcattaatgttagatagacgttggttcaagttcaatcttcagagtggtttttcccgtgatgctgtgc

SEQ ID NO: 205280 - DNA, 75 bp, Artificial Sequence
  Synthetic
actcagaacttcccatctgtacgtaatcctcttagagaagtttacaatcgtcagggactggttaactcattagat

SEQ ID NO: 205281 - DNA, 75 bp, Artificial Sequence
  Synthetic
tatacaatccactctgcgctcccctcttcaagcacatacgcattatatctttgccctctaaaccggaaggcacgt

SEQ ID NO: 205282 - DNA, 75 bp, Artificial Sequence
  Synthetic
cctccagctgtcgattatactcccttagatgaaggctctgatcctagaggtttcttccaagtcggtaacgatatg

SEQ ID NO: 205283 - DNA, 75 bp, Artificial Sequence
  Synthetic
tagatgaaggctctgatcctagaggtttcttccaagtcggtaacgatatgtacttagactggctccctactgatt

SEQ ID NO: 205284 - DNA, 75 bp, Artificial Sequence
  Synthetic
tgatagctctcatcttcagagcgcagtattttgttagccagctcttccctgaattcccttgtaaatctatgatta

SEQ ID NO: 205285 - DNA, 75 bp, Artificial Sequence
  Synthetic
ctgatactgcgtgggatacgactcctaatgttcctaaatacggtagaccagctgcagttccagaagttccattaa

SEQ ID NO: 205286 - DNA, 75 bp, Artificial Sequence
  Synthetic
cgtctatctgtctgtcgtcttgttccagatccagcagggctctctgccacggtctgaactctggattcaccatcg

SEQ ID NO: 205287 - DNA, 75 bp, Artificial Sequence
  Synthetic
gctgcagttccagaagttccattaatgacctttgtactacctcaagcttacaagactaggttttattatcgtgtc

SEQ ID NO: 205288 - DNA, 75 bp, Artificial Sequence
  Synthetic
actctggtatttttatccacgagcatacatagtcgccttcttttagaacatagtcaaaatttctaacactagtac

SEQ ID NO: 205289 - DNA, 75 bp, Artificial Sequence
  Synthetic
tatgttactgagactgtatacttcaaagatcctgttgctctcaatgtctcttcagtttcttctcctggctctttt

SEQ ID NO: 205290 - DNA, 75 bp, Artificial Sequence
  Synthetic
aagatcctgttgctctcaatgtctcttcagtttcttctcctggctcttttgtcgttaataacggtgtggatagat

SEQ ID NO: 205291 - DNA, 75 bp, Artificial Sequence
  Synthetic
agctaacatgcccaaaagcagaccatactttccgcatttcgctgatatctgcaccaactttaagtacaagtcgta

SEQ ID NO: 205292 - DNA, 75 bp, Artificial Sequence
  Synthetic
ttcagtttcttctcctggctcttttgtcgttaataacggtgtggatagattcattggtcttcccgatataaaatc

SEQ ID NO: 205293 - DNA, 75 bp, Artificial Sequence
  Synthetic
tagtcaaaatttctaacactagtacagctaacatgcccaaaagcagaccatactttccgcatttcgctgatatct

SEQ ID NO: 205294 - DNA, 75 bp, Artificial Sequence
  Synthetic
tggagagagactttctagcatcatttctgcttctcctgtttactcaggttatataaacgatggatccgattatcg

SEQ ID NO: 205295 - DNA, 75 bp, Artificial Sequence
  Synthetic
tctggtaatgtttgtatccgttttctcctgtttctcttccatatgcatacctctcgcaatacttgtttagccatt

SEQ ID NO: 205296 - DNA, 75 bp, Artificial Sequence
  Synthetic
atataaacgatggatccgattatcggcaagacactggtggtgcttaatggcatatgtatatctcaatggtcgtcg

SEQ ID NO: 205297 - DNA, 75 bp, Artificial Sequence
  Synthetic
tagccattctaccattgtcttctcaggtaccttatccgctgagacggttatatcataccatttaggactaggcat

SEQ ID NO: 205298 - DNA, 75 bp, Artificial Sequence
  Synthetic
tagtcttaagtactactacccgtatttagagtctatgtcttattacagacgctcttattatcctcgtaggcgatc

SEQ ID NO: 205299 - DNA, 75 bp, Artificial Sequence
  Synthetic
tcttctaccaggtggactcatggtttatgaggatgaagtctggaccaaagaagatgaagaggaatactctaaccc

SEQ ID NO: 205300 - DNA, 75 bp, Artificial Sequence
  Synthetic
tatgaggatgaagtctggaccaaagaagatgaagaggaatactctaaccctgacaaccatctccctcctatggaa

SEQ ID NO: 205301 - DNA, 75 bp, Artificial Sequence
  Synthetic
cgcaggagatactaaacatggtttatagaactggattgtacgctttacctattgcaggacgtttcatttacgaat

SEQ ID NO: 205302 - DNA, 75 bp, Artificial Sequence
  Synthetic
tgacaaccatctccctcctatggaagttgagtctgagtccctctaaaccctttcccaaaccctttcttacttttt

SEQ ID NO: 205303 - DNA, 75 bp, Artificial Sequence
  Synthetic
ctgttgtctgttgtctgatcctatcactccttctgtgagcgaagcgaacccctatacccgcaccccagcctaacg

SEQ ID NO: 205304 - DNA, 75 bp, Artificial Sequence
  Synthetic
cctatacccgcaccccagcctaacgtgtctaatttcagacattttgtcggatttcagacattttgctcccatgaa

SEQ ID NO: 205305 - DNA, 75 bp, Artificial Sequence
  Synthetic
cccagggatatgaagctcagatgtatcgtcaggctggtcatttatatgattctgctctttcgtttggtacctctg

SEQ ID NO: 205306 - DNA, 75 bp, Artificial Sequence
  Synthetic
tcgtcaggctggtcatttatatgattctgctctttcgtttggtacctctgtctctggacgtgttggaagatcaac

SEQ ID NO: 205307 - DNA, 75 bp, Artificial Sequence
  Synthetic
acccggggtttaaaagaatataataaaagatattagggcgcaaggcgggagtattacgcggtagcgcccaagcct

SEQ ID NO: 205308 - DNA, 75 bp, Artificial Sequence
  Synthetic
tgcgcttatttcgcgagttgtactagacctagctcgcccggtgcccaaaacctgaaccggtcttctgacagcaga

SEQ ID NO: 205309 - DNA, 75 bp, Artificial Sequence
  Synthetic
caggtcattggcgtttcagctggtggtatggaatgcatgcgtagactattaccgttctttgcagcttacaaatac

SEQ ID NO: 205310 - DNA, 75 bp, Artificial Sequence
  Synthetic
tcgtattttggatactcatttgtaaaaacaaacactcttggactgtctatccacatttcttcccatgtgtacctg

SEQ ID NO: 205311 - DNA, 75 bp, Artificial Sequence
  Synthetic
aaacaaacactcttggactgtctatccacatttcttcccatgtgtacctgtcgtcccacatgtacccatttttga

SEQ ID NO: 205312 - DNA, 75 bp, Artificial Sequence
  Synthetic
tacaagctcggtcatgtcaaacttaaagtcgttccggctagcactttacctgtcgatcctacaggtttatcttat

SEQ ID NO: 205313 - DNA, 75 bp, Artificial Sequence
  Synthetic
tgtcgatcctacaggtttatcttatgaagctggtgagaataccgtagaccccagggatcagtttaacccaggact

SEQ ID NO: 205314 - DNA, 75 bp, Artificial Sequence
  Synthetic
tctggcttttcccgggatgctgtgccacgtgtctggagaattgcacagttacaccaagaccgttttccaggtaac

SEQ ID NO: 205315 - DNA, 75 bp, Artificial Sequence
  Synthetic
gatggaatattgattgccatattcttcatacacatatactttgtaacaaacgactttccagtgtttccacgcagg

SEQ ID NO: 205316 - DNA, 75 bp, Artificial Sequence
  Synthetic
tctataatacagtctacttctctgtcgttttgtttcaggtctactaagtgctgttgccagggtcttaactgagca

SEQ ID NO: 205317 - DNA, 75 bp, Artificial Sequence
  Synthetic
actcagaacttgccatctgtacgtaatcctcttagagaagtttacaatcgtcagggactggttaactcagagact

SEQ ID NO: 205318 - DNA, 75 bp, Artificial Sequence
  Synthetic
tttcggatagcgtctggtactttgatccatgaacatacgaagtcaccttcttttagaacatagtcaaaatttcta

SEQ ID NO: 205319 - DNA, 75 bp, Artificial Sequence
  Synthetic
tccatgaacatacgaagtcaccttcttttagaacatagtcaaaatttctaacactagtagggctacaatgaccac

SEQ ID NO: 205320 - DNA, 75 bp, Artificial Sequence
  Synthetic
ctgatactgcgtgggatacgactcctaatgttcctaaattcggtagaccggctgcagttccagaggttcccttaa

SEQ ID NO: 205321 - DNA, 75 bp, Artificial Sequence
  Synthetic
gctgcagttccagaggttcccttaatgacttttatactacctcaggctcataagacgaagttttattaccgtgtc

SEQ ID NO: 205322 - DNA, 75 bp, Artificial Sequence
  Synthetic
acaactctgacttggaaatgttcgtatccgtcttctcctcgttctcttccgtaagcatatctttctccattttca

SEQ ID NO: 205323 - DNA, 75 bp, Artificial Sequence
  Synthetic
ttcagtttcttctcctggctcttttgtcgttaataacggtgtggatagattcgttggtcttcctgatataaaatc

SEQ ID NO: 205324 - DNA, 75 bp, Artificial Sequence
  Synthetic
aagtcttatgtactcctacccgtatttagagtctatgtcttattacagacgctcttattaccctcgtaggcgatc

SEQ ID NO: 205325 - DNA, 75 bp, Artificial Sequence
  Synthetic
ttagagtctatgtcttattacagacgctcttattaccctcgtaggcgatcctacggcaggcgcagatactacaga

SEQ ID NO: 205326 - DNA, 75 bp, Artificial Sequence
  Synthetic
tctgcttctcctgtttactcaggttatataaacgatggatccgattatcggcaagacactggtggtgcttaaatg

SEQ ID NO: 205327 - DNA, 75 bp, Artificial Sequence
  Synthetic
ctacggcaggcgcagatactacagacgcaggagatactaagcatggcctatagaactggattgtacgctttacct

SEQ ID NO: 205328 - DNA, 75 bp, Artificial Sequence
  Synthetic
tctgttgtctgttgtcccttgtctgatcctatcactccttctgtgagcgaagcgaacccctatacccgcacccca

SEQ ID NO: 205329 - DNA, 75 bp, Artificial Sequence
  Synthetic
cccagggatatgaagctcagatgtaccggcaagctggtcaattatatgattctgctctttcgtttggtacgtctg

SEQ ID NO: 205330 - DNA, 75 bp, Artificial Sequence
  Synthetic
tctgctctttcgtttggtacgtctgttgctggacgtgttggaagatcaaccaaggatgtgacgaaactatgacta

SEQ ID NO: 205331 - DNA, 75 bp, Artificial Sequence
  Synthetic
caaggatgtgacgaaactatgactacccaaagttatacctattttcttgacctcgctacctcgcctgataagatt

SEQ ID NO: 205332 - DNA, 75 bp, Artificial Sequence
  Synthetic
ctgtactagacctagctcgcccggtgcccagaacctgaaccggtcttctgacaacaggtcatattttggatactc

SEQ ID NO: 205333 - DNA, 75 bp, Artificial Sequence
  Synthetic
gtatggaatgcatgcgtagactattacctttctttgcagcgtacaaatactacaagctctcccatgtcaagctta

SEQ ID NO: 205334 - DNA, 75 bp, Artificial Sequence
  Synthetic
tgtacctgtcgtcccatatgtacccatttttgatgctttcaatggctgaccatgtttcttttgcttgcttacttc

SEQ ID NO: 205335 - DNA, 75 bp, Artificial Sequence
  Synthetic
gaagcaggtgagaataccgtagaccccagagaccaatttaatccaggacttgttagaatcaccaatggtgaggac

SEQ ID NO: 205336 - DNA, 75 bp, Artificial Sequence
  Synthetic
atcgtagttccaactaccatggaccaatactactcattaatgttagatagacgttggtacaagttcaatctccag

SEQ ID NO: 205337 - DNA, 75 bp, Artificial Sequence
  Synthetic
cacgtatgtctataatacagtctacttctctgtcgttttgtttcaggtctactaagtgctgttgccagggtttta

SEQ ID NO: 205338 - DNA, 75 bp, Artificial Sequence
  Synthetic
tctggcttttcccgttatgctgtgccacgtgtctggagaattgcacagttacaccaagaccgtttcccaggtaac

SEQ ID NO: 205339 - DNA, 75 bp, Artificial Sequence
  Synthetic
attgagcatttcggatagcgtctggtatttttatccacgagcatacataatcaccttcctttaggacatagtcaa

SEQ ID NO: 205340 - DNA, 75 bp, Artificial Sequence
  Synthetic
actcagaacctcccatctgtacgtgatcctcttagagaagtttacaatcgtcaggcactggttaactcagcagat

SEQ ID NO: 205341 - DNA, 75 bp, Artificial Sequence
  Synthetic
atcctcttagagaagtttacaatcgtcaggcactggttaactcagcagatcctgcagctgtcgaatatgctccct

SEQ ID NO: 205342 - DNA, 75 bp, Artificial Sequence
  Synthetic
aatttctaacactagtagggctacaatgaccactatgcccccatatttcccgcattgtttcccagcttgtaggat

SEQ ID NO: 205343 - DNA, 75 bp, Artificial Sequence
  Synthetic
atgaccactatgcccccatatttcccgcattgtttcccagcttgtaggattttgtaatacaactctgacttggaa

SEQ ID NO: 205344 - DNA, 75 bp, Artificial Sequence
  Synthetic
ctgatactgcatgggatacgactcctaatattcctaaatacggtagaccggctgcagttccagaggttcccttaa

SEQ ID NO: 205345 - DNA, 75 bp, Artificial Sequence
  Synthetic
ttacctttgtactacctcaagcttacaagactaagttttattatcgtgtctatgtcactgagactgtatgcttca

SEQ ID NO: 205346 - DNA, 75 bp, Artificial Sequence
  Synthetic
taaccacttctttagtatttcttcaggacattttgctctagaaacggttatatcgtaccatttaggctctgtcat

SEQ ID NO: 205347 - DNA, 75 bp, Artificial Sequence
  Synthetic
aaccttttatactttttactcctatttaggtttatgtcttactacagacgttcctattaccgtcgtaggcgatac

SEQ ID NO: 205348 - DNA, 75 bp, Artificial Sequence
  Synthetic
aagaacctgttgctctcaatgtctcttcagttcaatttcctggctattttgtcgttaataacggtgtggatagat

SEQ ID NO: 205349 - DNA, 75 bp, Artificial Sequence
  Synthetic
ttcctattaccgtcgtaggcgatactacggtagaagaccaacctatagacgctcatattctagaaggagaaggta

SEQ ID NO: 205350 - DNA, 75 bp, Artificial Sequence
  Synthetic
tcattggtcttcccgatatagcttctggagagacactttctagcatcttttctgcttctcctgtttactcgggtt

SEQ ID NO: 205351 - DNA, 75 bp, Artificial Sequence
  Synthetic
agtcgggtctgagtccctctaaaccttttcccaaaccctttcttactttttctgttgtctgatgtatgatgtctg

SEQ ID NO: 205352 - DNA, 75 bp, Artificial Sequence
  Synthetic
cagtactttgcctgtggatcctactggcttatcgtattctgctggtgaaaacacagtcgatccccgtgatcagtt

SEQ ID NO: 205353 - DNA, 75 bp, Artificial Sequence
  Synthetic
tctgttgtctgatgtatgatgtctgatgtctgatgtctgatcctatcactcttttgtgagcgaagcgaaccccta

SEQ ID NO: 205354 - DNA, 75 bp, Artificial Sequence
  Synthetic
ataggtcagcttcatcaggatgttttccctggtgcagttcagaatttaccttctattactaagacttcttctggt

SEQ ID NO: 205355 - DNA, 75 bp, Artificial Sequence
  Synthetic
tctgtcaattcctatgatactagtaaccgtatcgaccatgttgagaacggatcttctgctttcaatttctattca

SEQ ID NO: 205356 - DNA, 75 bp, Artificial Sequence
  Synthetic
ggttctaatcctcattctatatttcaggtcggtggtaaagaacgtatgggctggatgcctactgatgctttctat

SEQ ID NO: 205357 - DNA, 75 bp, Artificial Sequence
  Synthetic
aggtcggtggtaaagaacgtatgggctggatgcctactgatgctttctatgatcctggtaatcctgatcttactc

SEQ ID NO: 205358 - DNA, 75 bp, Artificial Sequence
  Synthetic
atgtattctactaactcttctgtatccggtagcttctatcctctcaatcaggtggacagatttatatacccagtc

SEQ ID NO: 205359 - DNA, 75 bp, Artificial Sequence
  Synthetic
tagtagggctacaatgaccactattcccccatatttcccgcattgtttcccagcttgtaggattgcgtaatacaa

SEQ ID NO: 205360 - DNA, 75 bp, Artificial Sequence
  Synthetic
ttgaggatgatctctggacccctgaggatgaagaggcatactccgatcctctcaatcatttaccgcctgatgaca

SEQ ID NO: 205361 - DNA, 75 bp, Artificial Sequence
  Synthetic
ctgtctgatgacactgtctgatgtctggtctatcattccgcgaagcggcatttcgcctatacacgtcctaggtgg

SEQ ID NO: 205362 - DNA, 75 bp, Artificial Sequence
  Synthetic
ctctgacttggaaatgttcgtatccgtcttctcctcgttctcttccgtaagcatatctttctccattttcatcta

SEQ ID NO: 205363 - DNA, 75 bp, Artificial Sequence
  Synthetic
aagtcttaagtacccctacccgtatttagagtctatgtcttattacagacgctcttattaccctcgtaggcgatc

SEQ ID NO: 205364 - DNA, 75 bp, Artificial Sequence
  Synthetic
gctcttattaccctcgtaggcgatcctacggcaggcgcagatactacagacgcaggagatactaaacatggccta

SEQ ID NO: 205365 - DNA, 75 bp, Artificial Sequence
  Synthetic
agccctcgcggtttttttatttttaaccaactattctcatctgcgagaactgcttatatactttgtcggatttca

SEQ ID NO: 205366 - DNA, 75 bp, Artificial Sequence
  Synthetic
gacacggttcccaaagtttaaaagaatataataaaagatattagggcgcaagtcgggagtattacgcggtagcgc

SEQ ID NO: 205367 - DNA, 75 bp, Artificial Sequence
  Synthetic
cgcaggagatactaaacatggcctatagaactgggttgtatgctttacctattgcaggacgttttatttacgaat

SEQ ID NO: 205368 - DNA, 75 bp, Artificial Sequence
  Synthetic
agtcgggagtattacgcggtagcgcccaagacttgcgcttatttcgcgagttgtactagacctagctcgcctggt

SEQ ID NO: 205369 - DNA, 75 bp, Artificial Sequence
  Synthetic
atgatcgtatgaaggactacggtaagatggcaaaagactacagacgtaatactggtcgtacctctaagtatgcaa

SEQ ID NO: 205370 - DNA, 75 bp, Artificial Sequence
  Synthetic
actggtcgtacctctaagtatgcaaccgctggatatgaagctcagatgtatcggcaagctggtcaattatatgat

SEQ ID NO: 205371 - DNA, 75 bp, Artificial Sequence
  Synthetic
tgtatctgtcgtcccacatgtacccatttttgatgctttcaattgctgaccacgtttcttttgcttgcttgcttc

SEQ ID NO: 205372 - DNA, 75 bp, Artificial Sequence
  Synthetic
ctgctcttgggatgtcgaaaatgtatgtaccaagctttgctcgtttcatacacatacgcattatatctttccctg

SEQ ID NO: 205373 - DNA, 75 bp, Artificial Sequence
  Synthetic
aggtcgttccggctagcactttacctgtagacccaactggactcagttatgaagcaggtgagaataccgtagacc

SEQ ID NO: 205374 - DNA, 75 bp, Artificial Sequence
  Synthetic
cacgcacgtctataatacagtctacttctctgtcgttttgtttcaggtctactaagtgctgttgccacgctttta

SEQ ID NO: 205375 - DNA, 75 bp, Artificial Sequence
  Synthetic
gaagcaggtgagaataccgtagaccccagagatcaatttaatccaggacttgttagaatcaccaatggtgaggac

SEQ ID NO: 205376 - DNA, 75 bp, Artificial Sequence
  Synthetic
atgcccaaaagcagaccatactttccgcatttcgctgatatctgcaccaactttaagtacaagtcgtacctggta

SEQ ID NO: 205377 - DNA, 75 bp, Artificial Sequence
  Synthetic
acaccaagaccgttttccaggtaacactcagaacctcccatctgtacgtaatcctcttagagaagtttacaatcg

SEQ ID NO: 205378 - DNA, 75 bp, Artificial Sequence
  Synthetic
actcagaacctcccatctgtacgtaatcctcttagagaagtttacaatcgtcagggactggttaactcagaggat

SEQ ID NO: 205379 - DNA, 75 bp, Artificial Sequence
  Synthetic
gtgcttgtatccgttttctcctgtttctcttccatatgcatacctttcacaatacttctctaaccattctaccat

SEQ ID NO: 205380 - DNA, 75 bp, Artificial Sequence
  Synthetic
cctccaggtgtcgattatactcccttagatgaaggctctgatcctagaggtttcttccaagtcggtaacgatatg

SEQ ID NO: 205381 - DNA, 75 bp, Artificial Sequence
  Synthetic
taaccattctaccattgtcttttcagggaccttatccgctgagacggttatatcgtaccatttaggactaggcat

SEQ ID NO: 205382 - DNA, 75 bp, Artificial Sequence
  Synthetic
aagtcttaagtacccttacccgtatttagagtctatgtcttattatagacgctcttattaccctcgtaggcgatc

SEQ ID NO: 205383 - DNA, 75 bp, Artificial Sequence
  Synthetic
tatttggattggctccctactgattctgatactgcatgggatacgactcctaatgttcctaagttcggtagaccg

SEQ ID NO: 205384 - DNA, 75 bp, Artificial Sequence
  Synthetic
gctgcagttccagaggttcccttaatgacctttgtactacctcaagcttacaagacgaggttttattaccgtatc

SEQ ID NO: 205385 - DNA, 75 bp, Artificial Sequence
  Synthetic
ccggcaagctggtcaattatatgattctgctctttcttttggtacgtctgttgctggacgtgtttcaagatcaac

SEQ ID NO: 205386 - DNA, 75 bp, Artificial Sequence
  Synthetic
tatatcactgagactgtatacttcaaagaacctgttgctctcaatgtctcttcagtctcttctcctggctccttt

SEQ ID NO: 205387 - DNA, 75 bp, Artificial Sequence
  Synthetic
ttcagtctcttctcctggctcctttgtcattaataacggtgtggatagattcattggtatgcccgatatacaatc

SEQ ID NO: 205388 - DNA, 75 bp, Artificial Sequence
  Synthetic
ccagagaccaatttaacccaggccttgtccgaatcaccaatggtgaggacattgtagtcccaactaccatggacc

SEQ ID NO: 205389 - DNA, 75 bp, Artificial Sequence
  Synthetic
tggagagagactttctagcatcatttctgcttctcctgtttactcaggttatataaacgatggatctgattatcg

SEQ ID NO: 205390 - DNA, 75 bp, Artificial Sequence
  Synthetic
aatattactcattaatgttagataggcgctggttcaagttcaacctccaatctggcttttcccgtgatgctgtgc

SEQ ID NO: 205391 - DNA, 75 bp, Artificial Sequence
  Synthetic
gcatatgtgtatctgaatggtcgtcgtcttctaccaggtggactcatggtttatgaggatgaagtctggaccaaa

SEQ ID NO: 205392 - DNA, 75 bp, Artificial Sequence
  Synthetic
cacgtgtctggagaattgcacagttacgccaagaccgtttcccaggtaacactcagaacgtcctatctgtacgta

SEQ ID NO: 205393 - DNA, 75 bp, Artificial Sequence
  Synthetic
ctgacaaccatctccctcctatggaagttgggtctgagtccctctaaaccctttcccaaaccctttcttactttt

SEQ ID NO: 205394 - DNA, 75 bp, Artificial Sequence
  Synthetic
catcttgattggctccctactgattctgatactgcatgggatacgactactaacgttcctaaatacggtaaaccg

SEQ ID NO: 205395 - DNA, 75 bp, Artificial Sequence
  Synthetic
gcctaacgtgtctaatttcatacattttgtcggatttcagacattttgctcccatgaaacccgtggtttaaaaga

SEQ ID NO: 205396 - DNA, 75 bp, Artificial Sequence
  Synthetic
gctgcagttccagaggttcccttaatgacctttatactacctcaagcttacaagacgaggttttattaccgtgtc

SEQ ID NO: 205397 - DNA, 75 bp, Artificial Sequence
  Synthetic
tatatcactgagtctgtatacttcaaagaacctgttgctctcaatgtctcttcagtcgcttcccctggctctttt

SEQ ID NO: 205398 - DNA, 75 bp, Artificial Sequence
  Synthetic
gcccaaaacctgaaccggtcttctgacaacaagtcgtactttggatactcatttgtaaaaacaaacactcttgga

SEQ ID NO: 205399 - DNA, 75 bp, Artificial Sequence
  Synthetic
ttcagtcgcttcccctggctcttttgtcgttaataacggtgtggatagattcgttggtcttcccgagatacgcag

SEQ ID NO: 205400 - DNA, 75 bp, Artificial Sequence
  Synthetic
tgtacctgtcgtcccacatgtacccatttttgatgctttcaattgctgaccatgtttcctttgcttgcttgcttc

SEQ ID NO: 205401 - DNA, 75 bp, Artificial Sequence
  Synthetic
ctgcccgtggtatgtcgaaaatgtatgtaccaagctttgctcgtttcatacacatacgcattatatctttccctg

SEQ ID NO: 205402 - DNA, 75 bp, Artificial Sequence
  Synthetic
taagaccagatggaatattgattgccatattcttcatacacatatactttgtaacaaacgactttccagtgtttc

SEQ ID NO: 205403 - DNA, 75 bp, Artificial Sequence
  Synthetic
ttgtactagacctagctcgcccggtgcccagaatctgaaccggtcttctgataacagatcgtattttggatactc

SEQ ID NO: 205404 - DNA, 75 bp, Artificial Sequence
  Synthetic
actgagcatttcggatagcgtctggtactttgatccatgaacatacgaagtcaccttcttttagaacatagtcaa

SEQ ID NO: 205405 - DNA, 75 bp, Artificial Sequence
  Synthetic
tcaccttcttttagaacatagtcaaaatttctaacactagtagggctacaatgaccactatgcttccatatttcc

SEQ ID NO: 205406 - DNA, 75 bp, Artificial Sequence
  Synthetic
tgtaccaagctttgctcgtttcatacacatacgcattatatctttccctgtaagagaagatggaatattgattgc

SEQ ID NO: 205407 - DNA, 75 bp, Artificial Sequence
  Synthetic
taaccacttccgtagtatttcttcaggacattttgccttagaaacggttatatcgtaccatttaggctctgtcat

SEQ ID NO: 205408 - DNA, 75 bp, Artificial Sequence
  Synthetic
aaccttttatatttttactcttatttaggtttatgtcttactacagacgttattattcccgtaggcgttcctacg

SEQ ID NO: 205409 - DNA, 75 bp, Artificial Sequence
  Synthetic
gtggcagacgcaggcgaactaattatagacgcaggtggtactaaacatggctagacaagaatgggcctatggagt

SEQ ID NO: 205410 - DNA, 75 bp, Artificial Sequence
  Synthetic
cgcattgtttcccagcttgtaggattgcgtaatacaactctgacttggaaatgttcgtatccgtcttctcctcgt

SEQ ID NO: 205411 - DNA, 75 bp, Artificial Sequence
  Synthetic
cccttttttgggtggtgttataagtggctatgataaatggaaagattttaaagcaatggatagggattatcagcg

SEQ ID NO: 205412 - DNA, 75 bp, Artificial Sequence
  Synthetic
aaacacaggacgatactacaaatacccgtcacaaggctataatgcaatggctggtaatactgctcgtggtactct

SEQ ID NO: 205413 - DNA, 75 bp, Artificial Sequence
  Synthetic
cgagcgtactatatctcttgggatgcgttcagctagaaccgctcgaagggttggatctcataactatggtacaac

SEQ ID NO: 205414 - DNA, 75 bp, Artificial Sequence
  Synthetic
tcggagtgtgatggacctatgatgcaaaagtttagatggtttgttgatcttagtacaactcctgagaaagttact

SEQ ID NO: 205415 - DNA, 75 bp, Artificial Sequence
  Synthetic
gttctcaaaatcacctgcggcggtactcgctgtttgagaagactattacctttttttagtgcttataagtatttt

SEQ ID NO: 205416 - DNA, 75 bp, Artificial Sequence
  Synthetic
aagttaggtaaaacaactgttaaattcgttcccagttctacactgcccgtcgaccccacaggtttgtcgtatgaa

SEQ ID NO: 205417 - DNA, 75 bp, Artificial Sequence
  Synthetic
gcaggtgaaaacacagttgaccctcgcgacatgttcaatccgggcttagtcagaatcaccaacggagaggatctg

SEQ ID NO: 205418 - DNA, 75 bp, Artificial Sequence
  Synthetic
atcgtagtcccaactactatggaccaatactactcattaatgttagatagacgttggttcaagttcaatctccag

SEQ ID NO: 205419 - DNA, 75 bp, Artificial Sequence
  Synthetic
gctgatgttgtactcaatgatatttcaaccgctgaagatcagaataacatttattatgctatgatgttagacccc

SEQ ID NO: 205420 - DNA, 75 bp, Artificial Sequence
  Synthetic
aatactactcattaatgttagatagacgttggttcaagttcaatctccagtctggcttttcccgtgatgctgttc

SEQ ID NO: 205421 - DNA, 75 bp, Artificial Sequence
  Synthetic
cacgtgtctggagaattgcacagttacaccaagaccgtttcccaggtaacactcagaacttcccatctgtacgta

SEQ ID NO: 205422 - DNA, 75 bp, Artificial Sequence
  Synthetic
cgttggttcaagtttagactccaagatggcttcaggcgtgatgctgttcctttatactggcgtgtcggtcagtta

SEQ ID NO: 205423 - DNA, 75 bp, Artificial Sequence
  Synthetic
catcaggataatttccctggctctgttaataattatttaactgttcaatctgatacttctcagcctcctgctgta

SEQ ID NO: 205424 - DNA, 75 bp, Artificial Sequence
  Synthetic
agccatgaaataagtttttatacaacaggtgcatctggtaatcgtattatgaataatttgattcgttctggttct

SEQ ID NO: 205425 - DNA, 75 bp, Artificial Sequence
  Synthetic
agtccacacgctatgtttcaatttggacatcacgatagggttggttggctacctactgatatgtttactaataat

SEQ ID NO: 205426 - DNA, 75 bp, Artificial Sequence
  Synthetic
ctgatactgcgtgggatacgacttctaatgttcctaaatacggtagaccagctgcagttccagaggttccactga

SEQ ID NO: 205427 - DNA, 75 bp, Artificial Sequence
  Synthetic
taatgttcctaaatacggtagaccagctgcagttccagaggttccactgataacttttgtactacctcaagctta

SEQ ID NO: 205428 - DNA, 75 bp, Artificial Sequence
  Synthetic
tatgacaattatccaggtacttctactatgagtcctaataccccccctgaggttgacttgcttactgtagttctc

SEQ ID NO: 205429 - DNA, 75 bp, Artificial Sequence
  Synthetic
cctgccgcttacaagactcgtttctactacagactttatattacagaagaagtttactttaaagagccagtgtct

SEQ ID NO: 205430 - DNA, 75 bp, Artificial Sequence
  Synthetic
ttcagttcaaactcctggctcttttgttgttaataacggtgtggatagattcattggtatgcctgatatacgttc

SEQ ID NO: 205431 - DNA, 75 bp, Artificial Sequence
  Synthetic
atattcgcaggtcagcttgctaacggtcagtacgtttcaacaaccatggatcgctttacatatccgactttgcag

SEQ ID NO: 205432 - DNA, 75 bp, Artificial Sequence
  Synthetic
ggcaagtttccggggaacctcaatggagtttcttctgatacatttttacctattgagttagataattcgggaggt

SEQ ID NO: 205433 - DNA, 75 bp, Artificial Sequence
  Synthetic
tctgttgtctgatgtctgatcttatcactcttttgtgagcgaagcgaacccctatacccgcaccccagcctaacg

SEQ ID NO: 205434 - DNA, 75 bp, Artificial Sequence
  Synthetic
gagacaccgtgagcgtgtattacaacggtaaagaaatgatcgagatgaaatgcatggagtttgtcgagaccccag

SEQ ID NO: 205435 - DNA, 75 bp, Artificial Sequence
  Synthetic
tgcatggagtttgtcgagaccccagaggagtttgaagaagcttatgctaatcccgataatcacttaatgtctgat

SEQ ID NO: 205436 - DNA, 75 bp, Artificial Sequence
  Synthetic
ggtctgactgactgatacggtctggctatcactccgcgaagcggcatttcgcctatacacgtcctaggtgtgcct

SEQ ID NO: 205437 - DNA, 75 bp, Artificial Sequence
  Synthetic
ccacatttcttcccatgtgtacctgtcgtcccacatgtacccatttttgatgctttcaatggctgaccatgtttc

SEQ ID NO: 205438 - DNA, 75 bp, Artificial Sequence
  Synthetic
ctcgcggtttttttatatttaaccaactattctcatcacagagaaccacttatatactttgtcggatttcagaca

SEQ ID NO: 205439 - DNA, 75 bp, Artificial Sequence
  Synthetic
ctttgcttgcttgcttcctgctcttgggatgtcgaaaatgtatgtaccaagctttgctcgtttcatacacatacg

SEQ ID NO: 205440 - DNA, 75 bp, Artificial Sequence
  Synthetic
cggttcccaagatttaaaagaaataagtaagaaagatattgagcgggcgcagtattacgcggtagcgctagaagc

SEQ ID NO: 205441 - DNA, 75 bp, Artificial Sequence
  Synthetic
ccgctcttaatgtgcaagactcacgagccccgtcggcgtaggtgcccagaaccttaacctgtcctccgacaccaa

SEQ ID NO: 205442 - DNA, 75 bp, Artificial Sequence
  Synthetic
gtcatatttgggatactcatttgtgaacacccatattctcggaggatctatccacttctcctcccatgtgtaacg

SEQ ID NO: 205443 - DNA, 75 bp, Artificial Sequence
  Synthetic
gtcgtcccataagtaaccgttttttatactctcgatagcgctccacacgctcttgctctgtttcgttatggcacg

SEQ ID NO: 205444 - DNA, 75 bp, Artificial Sequence
  Synthetic
aagtcttaagtacccctccccttatatagagtctatgtcttattacagacgctcttattaccctcgtaggcgatc

SEQ ID NO: 205445 - DNA, 75 bp, Artificial Sequence
  Synthetic
gggcatatcgaatatatacaatccactctgcgctcccctcttcaagcacatacgcattatatctttcccctctaa

SEQ ID NO: 205446 - DNA, 75 bp, Artificial Sequence
  Synthetic
ctacggtaggcgcagatattacagacgtaggagatactaaacatggcctatcagactggattgtacgctttacct

SEQ ID NO: 205447 - DNA, 75 bp, Artificial Sequence
  Synthetic
acctgcaggtacgtttacagctctcattttcagagcgcagtattttgttagccagctcttccctgtattccctgc

SEQ ID NO: 205448 - DNA, 75 bp, Artificial Sequence
  Synthetic
tacaagctcggtcatgtcaagcttaaagttgttcctgccagtactctccccgtggacccgactggactcagttat

SEQ ID NO: 205449 - DNA, 75 bp, Artificial Sequence
  Synthetic
taagtctattattacgtctatctgtctgtcgtcttgctccagatccagcagcgcactctgccatggccggaatac

SEQ ID NO: 205450 - DNA, 75 bp, Artificial Sequence
  Synthetic
tggattctgcatattctctggtatttttatccatgagcatacatagtcaccttcttttagaacatagtcaaaatt

SEQ ID NO: 205451 - DNA, 75 bp, Artificial Sequence
  Synthetic
tctgacgctagtacagctaacatgcccaaaagcagaccatactttccgcatttcgctgatatctgcaccagtttt

SEQ ID NO: 205452 - DNA, 75 bp, Artificial Sequence
  Synthetic
tctggcttttcccgggatgctgtgccacgtgtctggagaattgcacagttacaccaagaccgtttcccaggtaac

SEQ ID NO: 205453 - DNA, 75 bp, Artificial Sequence
  Synthetic
actcagaacttcccatctgtacgtaatcctcttagagaagtttacaatcgtcagggactggttagctcagcagat

SEQ ID NO: 205454 - DNA, 75 bp, Artificial Sequence
  Synthetic
aagtacaattcgtacttggtaatgtttgtatccgttttctcctgtttctcttccatatgcatacctctcacaata

SEQ ID NO: 205455 - DNA, 75 bp, Artificial Sequence
  Synthetic
cttgtttaaccattctaccattatcttctcgggtaccttatctgctgagactgttatatcataccatttaggact

SEQ ID NO: 205456 - DNA, 75 bp, Artificial Sequence
  Synthetic
tagatgaaggctctgatcctagaggtttcttccaagtcggtaacgatatgtatttggactggctccctacagatt

SEQ ID NO: 205457 - DNA, 75 bp, Artificial Sequence
  Synthetic
aagtcttaagtatccctacccttatttagagtctatgtcttattacagacgctcttattaccctcgtaggcgatc

SEQ ID NO: 205458 - DNA, 75 bp, Artificial Sequence
  Synthetic
ttagagtctatgtcttattacagacgctcttattaccctcgtaggcgatcctacggcaggcgcagatattacaga

SEQ ID NO: 205459 - DNA, 75 bp, Artificial Sequence
  Synthetic
taaccattctaccattatcttctcgggtaccttatctgctgagactgttatatcataccatttaggactaggcat

SEQ ID NO: 205460 - DNA, 75 bp, Artificial Sequence
  Synthetic
tgacttttatactacctcaagcttacaagacgaggttttattaccgcgtctatatcactgagactgtatacttca

SEQ ID NO: 205461 - DNA, 75 bp, Artificial Sequence
  Synthetic
tatatcactgagactgtatacttcaaagaacctgtcgctctcaatgtctcttcagtttcttctcccggctctttt

SEQ ID NO: 205462 - DNA, 75 bp, Artificial Sequence
  Synthetic
attgcaggacgtttcatttacgaatatgaccgcatgaaggactacggtaagatggcaaaagactacagacgtaat

SEQ ID NO: 205463 - DNA, 75 bp, Artificial Sequence
  Synthetic
gtcgttaataacggtgtggatagattcattggtcttcctgatatagcttctggagagagactttctagcatcatt

SEQ ID NO: 205464 - DNA, 75 bp, Artificial Sequence
  Synthetic
ccgtcaagctggacaattatatgattctgcacttacgtttggtacgtctgttgctggacgtgttggaagatcaac

SEQ ID NO: 205465 - DNA, 75 bp, Artificial Sequence
  Synthetic
tctgcttctcctgtttactcaggttatataaacgatggatccgattatcgtgaagacactggtggtgcttaaatg

SEQ ID NO: 205466 - DNA, 75 bp, Artificial Sequence
  Synthetic
tgtagacccaaccggattgagttatgaagcaggtgagaataccgtagaccccagagaccaatttaacccaggact

SEQ ID NO: 205467 - DNA, 75 bp, Artificial Sequence
  Synthetic
ccaagccttgcgcttatttcgcgagctgtactagacctagctcgcccggtgcccaaaacctgaaccggtcttctg

SEQ ID NO: 205468 - DNA, 75 bp, Artificial Sequence
  Synthetic
attgtagtcccaactaccatggaccaatactactcattaatgttagatagacgttggttcaagttcaatctccag

SEQ ID NO: 205469 - DNA, 75 bp, Artificial Sequence
  Synthetic
acagcaggtcgtattttggatattcatttgtaaaaacaaacactcttggactttctatccacatttcttcccagc

SEQ ID NO: 205470 - DNA, 75 bp, Artificial Sequence
  Synthetic
acgttggttcaagttcaatctccagtctggcttttctcgagatgctgtgccacgtgtctggagaattgcacagtt

SEQ ID NO: 205471 - DNA, 75 bp, Artificial Sequence
  Synthetic
atcctcttagagaagtttacaatcgtcaaggactggttaactcagcagatcctccagctgtcgattatactccct

SEQ ID NO: 205472 - DNA, 75 bp, Artificial Sequence
  Synthetic
actgagcatttcggatagcgtctggtactttgatccatgaacatatgaagtcaccttctttcagaacatagtcaa

SEQ ID NO: 205473 - DNA, 75 bp, Artificial Sequence
  Synthetic
tggatgaaggctctgatcctagaggtttcttccaagtcggtaatgatatgcatcttgattggctccctactgatt

SEQ ID NO: 205474 - DNA, 75 bp, Artificial Sequence
  Synthetic
ctgatactgcttgggatacgactcctaatattcctaaatacggtagaccggctgcagttccagaggttccattga

SEQ ID NO: 205475 - DNA, 75 bp, Artificial Sequence
  Synthetic
taatattcctaaatacggtagaccggctgcagttccagaggttccattgattacttttgtactacctcaagctta

SEQ ID NO: 205476 - DNA, 75 bp, Artificial Sequence
  Synthetic
caagacgaagttttattaccgtgtctatgtcactgagactgtatacttcaaagaacctgttgctctcaatgtctc

SEQ ID NO: 205477 - DNA, 75 bp, Artificial Sequence
  Synthetic
ttcagtgcaaactcctggctcttttgtcgttaataacggtgtggatagattcattggtattcccgatatacaatc

SEQ ID NO: 205478 - DNA, 75 bp, Artificial Sequence
  Synthetic
actggtcgtacctctaagtatgcaactcagggctatgaagctcagatgtatcgtcaggctggtcaattatatgat

SEQ ID NO: 205479 - DNA, 75 bp, Artificial Sequence
  Synthetic
atataaacgatggatctgattatcggcaagacactggtggtgcttaaatggcatatgtgtatctgaatggtcgtc

SEQ ID NO: 205480 - DNA, 75 bp, Artificial Sequence
  Synthetic
gaagatgaagaggagtactctaaccctgacaatcatcttcctcctattgaagtcgggtctgagtccctctaaacc

SEQ ID NO: 205481 - DNA, 75 bp, Artificial Sequence
  Synthetic
tacaagcttggtcatgtcaagctcaaagtcgttccggctagcactttacctgtcgacccaaccggcttatcgtat

SEQ ID NO: 205482 - DNA, 75 bp, Artificial Sequence
  Synthetic
agtcgggtctgagtccctctaaaccctttcccaaaccctttcttactttttctgttgtctgttgtctgatgtctg

SEQ ID NO: 205483 - DNA, 75 bp, Artificial Sequence
  Synthetic
gaagcaggtgaaaataccgtagaccccagagatcaatttaacccaggacttgttagaatcaccaatggtgaggac

SEQ ID NO: 205484 - DNA, 75 bp, Artificial Sequence
  Synthetic
atcgtagtacccaccaccatggatcagtactactcattaatgttagatagacgttggttcaagttcaacctccag

SEQ ID NO: 205485 - DNA, 75 bp, Artificial Sequence
  Synthetic
actcagaacttgccatctgtacgtaatcctaatagagaagtttacaatcgtcagggactggttaactcagcagat

SEQ ID NO: 205486 - DNA, 75 bp, Artificial Sequence
  Synthetic
caacagatcgtactttggatattcatttgtaaaaacaatcacttttggactgtctatccacatttcttcccatgt

SEQ ID NO: 205487 - DNA, 75 bp, Artificial Sequence
  Synthetic
ctgacactgcatgggatacgactcctaatattcctaaatacggtaaaccggctgcagttccagaggttcccttaa

SEQ ID NO: 205488 - DNA, 75 bp, Artificial Sequence
  Synthetic
tgacttttgtactacctcaggcttataagacgaagttttattaccgtgtctatgtcactgagtctgtatacttca

SEQ ID NO: 205489 - DNA, 75 bp, Artificial Sequence
  Synthetic
tatgtcactgagtctgtatacttcaaagatccagtagctctcaatgtctcttcagtgcaaactcctggctctttt

SEQ ID NO: 205490 - DNA, 75 bp, Artificial Sequence
  Synthetic
tctctgtcgttttgtttcaggtctactaattgctgttgccagggtcttaactgagcatttcggatagcgtctggt

SEQ ID NO: 205491 - DNA, 75 bp, Artificial Sequence
  Synthetic
atttttatccacgagcatacatagtcgccttcttttagaacatagtcaaaatttctaacactagtacggctacaa

SEQ ID NO: 205492 - DNA, 75 bp, Artificial Sequence
  Synthetic
cgccttcttttagaacatagtcaaaatttctaacactagtacggctacaatgaccactatgcctccatatttccc

SEQ ID NO: 205493 - DNA, 75 bp, Artificial Sequence
  Synthetic
gtattacgcggtagcgcccaagccttgcgcttatttcgcgagctgtactagacctagctcgcccggtgcccagaa

SEQ ID NO: 205494 - DNA, 75 bp, Artificial Sequence
  Synthetic
tgcgcttatttcgcgagctgtactagacctagctcgcccggtgcccagaacctgaagcggtcttctgacaacaaa

SEQ ID NO: 205495 - DNA, 75 bp, Artificial Sequence
  Synthetic
aaccttttatactttttagccctatttagtcttatgtcttattacagacgttcctactaccctaggagacgatcc

SEQ ID NO: 205496 - DNA, 75 bp, Artificial Sequence
  Synthetic
ttcctactaccctaggagacgatcctacggcagacgctcgacttacagacgttcatattccagaaggagaaggta

SEQ ID NO: 205497 - DNA, 75 bp, Artificial Sequence
  Synthetic
ttgatatgaatcacccatggatgtatgcaattccattcggccttggcaagactatacatgcttatgacaattaca

SEQ ID NO: 205498 - DNA, 75 bp, Artificial Sequence
  Synthetic
aagatatgcgtcagatgcagaaagattattatcgtaatactggacgtacttcaaagtatcctacccgttcctatg

SEQ ID NO: 205499 - DNA, 75 bp, Artificial Sequence
  Synthetic
atgctatggcgtattctggtcctgccaactacctctatgagtctgctgtccgtggtggttctaagctatacagat

SEQ ID NO: 205500 - DNA, 75 bp, Artificial Sequence
  Synthetic
ctacaaggagtttgatggattatgactaatttcgtttctcagaagtttcagtggtttgttgatttacagacttct

SEQ ID NO: 205501 - DNA, 75 bp, Artificial Sequence
  Synthetic
tcagatagcatgcaggttgttactattactgctggtggtcagcgtgtgcgcagaaggttacttcctttttttgct

SEQ ID NO: 205502 - DNA, 75 bp, Artificial Sequence
  Synthetic
cagaaggttacttcctttttttgctgctttcaagtactataaacttggatcagtttctgttaggtttgttcctgc

SEQ ID NO: 205503 - DNA, 75 bp, Artificial Sequence
  Synthetic
cagtactctccctgtggatcctactggcctatcgtattctgctggtgaaaacacagtcgatccccgcgatcagtt

SEQ ID NO: 205504 - DNA, 75 bp, Artificial Sequence
  Synthetic
caatcccggattagtcaggataaccaatggtgaggacttcaatattgatactgctcttcttgccgatgatacagc

SEQ ID NO: 205505 - DNA, 75 bp, Artificial Sequence
  Synthetic
aatggtgaggacttcaatattgatactgctcttcttgccgatgatacagcagctcagaacatgtactatcagctt

SEQ ID NO: 205506 - DNA, 75 bp, Artificial Sequence
  Synthetic
atgttagatccgcgctggtacaaattcaatcttcagtctggattcagaagaaaagctataccgctgtactggtcg

SEQ ID NO: 205507 - DNA, 75 bp, Artificial Sequence
  Synthetic
ataggtcagcttcatcaggatgtcttccccggtgctgttcagaatttacctgctattactaagaattcttctggt

SEQ ID NO: 205508 - DNA, 75 bp, Artificial Sequence
  Synthetic
tctgtcaattcctatgatactggcactcgtatcgaccatattgaaaatggatcttctgctttcaatttctattca

SEQ ID NO: 205509 - DNA, 75 bp, Artificial Sequence
  Synthetic
ggttctaatccgcattctatatttcaggtcggtggtaaagatcgtatgggctggatgcctactgatgctttctat

SEQ ID NO: 205510 - DNA, 75 bp, Artificial Sequence
  Synthetic
aggtcggtggtaaagatcgtatgggctggatgcctactgatgctttctatgatcccggcaatcctgatcttactc

SEQ ID NO: 205511 - DNA, 75 bp, Artificial Sequence
  Synthetic
ttggttctatggctcaggtacctgaggtcgagcttctccgtgttattctccccaaagcttacaagactaagttct

SEQ ID NO: 205512 - DNA, 75 bp, Artificial Sequence
  Synthetic
acgcttaacagctaaaaaccagaagacagagaaggaatcgaaggggaaaagaaaaagtaacacttctacaatgga

SEQ ID NO: 205513 - DNA, 75 bp, Artificial Sequence
  Synthetic
tcctgaacaagtagttttcaagtctcggaaggaaattgtcgtgttgagaccagaggtgatatcggatcagtatga

SEQ ID NO: 205514 - DNA, 75 bp, Artificial Sequence
  Synthetic
atacaaataccctgcgatagagaacaaagagaagcctacaataactctacaaaaagcccctgatctgaacatagc

SEQ ID NO: 205515 - DNA, 75 bp, Artificial Sequence
  Synthetic
atacaaatctgttttgtcagcattcaatactgcccgtctggaccaggaagatgtttgttcatatttagccgctgc

SEQ ID NO: 205516 - DNA, 75 bp, Artificial Sequence
  Synthetic
aatgaggatttttgagggcaactgtccagaggattggataagctacggaatcataatagccaagaaaggagaaac

SEQ ID NO: 205517 - DNA, 75 bp, Artificial Sequence
  Synthetic
tattaaccccggacacctagtaaatataaaacggactgagcaagaaggaaactgggcacaagttgcaggagctgg

SEQ ID NO: 205518 - DNA, 75 bp, Artificial Sequence
  Synthetic
tgtaattaaagatcctactgatgctgagcatgcatcattggttggccttctgttgtgcttgtataggttaagtaa

SEQ ID NO: 205519 - DNA, 75 bp, Artificial Sequence
  Synthetic
aatagtgggtcaaaacacagcaaattacaaaactaatgttgcagaccggatggaacaaatttttgaaactgcacc

SEQ ID NO: 205520 - DNA, 75 bp, Artificial Sequence
  Synthetic
atttgtgaagattatagagcatcacaccttgatgactactcacaagatgtgtgcaaattggagtacaatccctaa

SEQ ID NO: 205521 - DNA, 75 bp, Artificial Sequence
  Synthetic
tttcagattcttagctgggacttacgatatgtttttctctaggatagatcatctctatggagctatcagagtagg

SEQ ID NO: 205522 - DNA, 75 bp, Artificial Sequence
  Synthetic
aaccgttgtaacagcttacgaagattgcaccggattggtttctttcacaggatttcttaagcagataaatcttac

SEQ ID NO: 205523 - DNA, 75 bp, Artificial Sequence
  Synthetic
tgcaggagaagctatgctgtactttttccacaagaacttcgaggaagagtttaagagaatgttcaagcctggtca

SEQ ID NO: 205524 - DNA, 75 bp, Artificial Sequence
  Synthetic
agaaacggctacccctcactcctacttcgtgcatttcaggtctttaggactgagtgggaaatctccttactcatc

SEQ ID NO: 205525 - DNA, 75 bp, Artificial Sequence
  Synthetic
taatgcggttggtcacatgtttaacttgatacattttgtggggtgctacatgggtcagatcagatctctaaatgc

SEQ ID NO: 205526 - DNA, 75 bp, Artificial Sequence
  Synthetic
aactgtcattcagacatgtgcacctcatgaaatgtcggttttgggaggttacttaggagaggaattctttgggaa

SEQ ID NO: 205527 - DNA, 75 bp, Artificial Sequence
  Synthetic
aggaacattcgagagaagattctttagaaacattgaagaaatgaaaacctatgaagagttagaagaaagacgagt

SEQ ID NO: 205528 - DNA, 75 bp, Artificial Sequence
  Synthetic
cgaggcagcgctagaagacgacggcactgttgattctggggaagaagacgattggacaggggagtctagatcccc

SEQ ID NO: 205529 - DNA, 75 bp, Artificial Sequence
  Synthetic
agaggcggtgtttaatcgcatcatggtaaacaaaggaagattgcgtcctcatcacatcaagaggtttagaaacgt

SEQ ID NO: 205530 - DNA, 75 bp, Artificial Sequence
  Synthetic
cagtgcaaatcatcaggcaagaccgaattcttttgcagaattcctttctaaagtatattctgatacatcatgaga

SEQ ID NO: 205531 - DNA, 75 bp, Artificial Sequence
  Synthetic
tcagatgagaagagctctttttgaaaaaaacatcaacacttctccacttcacctagcatccatcatgagcaagaa

SEQ ID NO: 205532 - DNA, 75 bp, Artificial Sequence
  Synthetic
ccttataagaccgagtgacatcagggccgggctgcaggatatagagatggcggaggatacagtcaacttggttta

SEQ ID NO: 205533 - DNA, 75 bp, Artificial Sequence
  Synthetic
tcaaaacctgatgagtgatcaagcccatttaagagaggaccctatagacatcaagactcttcccgaacattttca

SEQ ID NO: 205534 - DNA, 75 bp, Artificial Sequence
  Synthetic
aggaatttcattgaagggaaatgaggggaatacagctgatcgccaggaagaagaagagtatgaggatgatacaga

SEQ ID NO: 205535 - DNA, 75 bp, Artificial Sequence
  Synthetic
gtcagaggacattgaccccatggaagagcttcaagatttcctagatgatttgggatctcagatcttgtccagatt

SEQ ID NO: 205536 - DNA, 75 bp, Artificial Sequence
  Synthetic
aaagaagggagataaaatcaagaaaatatggccaggggcctctctgtccatacagaattttgttaaaacaaaatt

SEQ ID NO: 205537 - DNA, 75 bp, Artificial Sequence
  Synthetic
cctctccaaaatatcagatgcggtttgcgaagacaaattttctcagactgatccaataatgtcgttttgtgaagg

SEQ ID NO: 205538 - DNA, 75 bp, Artificial Sequence
  Synthetic
ctcaacaattccttcagaaagcctagaatatgagaaggaagtagagatgagagatgacgagtcgaatcagtgttg

SEQ ID NO: 205539 - DNA, 75 bp, Artificial Sequence
  Synthetic
ctcagaactgcatgaagatgaagaagttgaagcagagattgctcatcaagtgggagaaagctttgctaaaaaata

SEQ ID NO: 205540 - DNA, 75 bp, Artificial Sequence
  Synthetic
caagttcccttcaagatcatctgggatcttcttgtggaactttgaacaactaaagatgaatttagatgatatcgt

SEQ ID NO: 205541 - DNA, 75 bp, Artificial Sequence
  Synthetic
taagactgcacaagaggttccgggaatcatagaatgggctagggaggggaaaaacctccctttaagaggtatact

SEQ ID NO: 205542 - DNA, 75 bp, Artificial Sequence
  Synthetic
agggtatgtgggtcttaaacactctaaacggtttcaattgctggttgatcaagatagaatgtccaatttaattca

SEQ ID NO: 205543 - DNA, 75 bp, Artificial Sequence
  Synthetic
aaaagatctcgattcatactctgtcaaaaaatgactctgatccagaaagtactcagatcaatagttcagcacact

SEQ ID NO: 205544 - DNA, 75 bp, Artificial Sequence
  Synthetic
tcatacatgaaaaaaacgttaacatcactcattatggagttttttagaaagttgatgagaaattgtaaagacgac

SEQ ID NO: 205545 - DNA, 75 bp, Artificial Sequence
  Synthetic
agttcttctaaagaggctactgctcctgtgttgcctgaggatgatgacatatggatccccccccctgaatacgtt

SEQ ID NO: 205546 - DNA, 75 bp, Artificial Sequence
  Synthetic
cccttaagtgatattacaggcagttctagctcaagaaacttctgtatcaacggagaagtcaagatttgcagccct

SEQ ID NO: 205547 - DNA, 75 bp, Artificial Sequence
  Synthetic
aacggatattcattcaaaatagttcgtcatatcctaagatcttttgaaggagtgtattctggtaacagacgaatg

SEQ ID NO: 205548 - DNA, 75 bp, Artificial Sequence
  Synthetic
ataggactcgtcaaaatagttatagggttaactctatctgggagtccgatccctgaagggatgaattgggcatac

SEQ ID NO: 205549 - DNA, 75 bp, Artificial Sequence
  Synthetic
agattcaggagaactcttgtctttcagtggaaagatagcgctgggccgttagagggagaggagcttgattactca

SEQ ID NO: 205550 - DNA, 75 bp, Artificial Sequence
  Synthetic
caggagattacctgggaggatgacaatgaatttgtcggattacagataagagtgagtgctaaacaatgtcatatc

SEQ ID NO: 205551 - DNA, 75 bp, Artificial Sequence
  Synthetic
acagggagatcttggtgcataaacataaactctagagcttgccagttctgggcagatatgcaactgaagaccaag

SEQ ID NO: 205552 - DNA, 75 bp, Artificial Sequence
  Synthetic
caatctgaagaggatggaaatacctctgttcttctagagtgaaatataaattaaccatgtcggcagttaacagac

SEQ ID NO: 205553 - DNA, 75 bp, Artificial Sequence
  Synthetic
tcagatcaagtgagcaatagaacaaacaagctagtgccctcatcaagctgcacaatgacaccttcttcctgttct

SEQ ID NO: 205554 - DNA, 75 bp, Artificial Sequence
  Synthetic
tatactcttcgagacatactttgttttggatgcataacaatgtgaaaaaaactaagatggtaatcgacagtatca

SEQ ID NO: 205555 - DNA, 75 bp, Artificial Sequence
  Synthetic
acatctctcatcatcttaagtaagagatggctcagttggtcactttggtgctgaacggattgtcccttttgacag

SEQ ID NO: 205556 - DNA, 75 bp, Artificial Sequence
  Synthetic
ggccaggcatatttccaatgtatacaatccctgaagggctgggtccctggactccgattgatttatctcatctga

SEQ ID NO: 205557 - DNA, 75 bp, Artificial Sequence
  Synthetic
agtgtcctgacaatacatactttgcagaagagggctgcaatgagggcagcaaggtgtcttacttagaactgaagc

SEQ ID NO: 205558 - DNA, 75 bp, Artificial Sequence
  Synthetic
cttcttttcattctcaaaacaaagtacagggatttacctgtacagggataatcaacatggcaaccacatacacca

SEQ ID NO: 205559 - DNA, 75 bp, Artificial Sequence
  Synthetic
atttcgttggttatgtcaccaccacttttcagcggtcccacttcatccccaaccagagggattgtcgtcaagcta

SEQ ID NO: 205560 - DNA, 75 bp, Artificial Sequence
  Synthetic
gagagtggaagaaggaaggggacccaagatacgaagagtcattgaccactccttatcccgactctaaatggttga

SEQ ID NO: 205561 - DNA, 75 bp, Artificial Sequence
  Synthetic
gaacagtcacaacctccaaggaatcatggctgatattggatcctgcagtggttgagatggacatctacaacaaga

SEQ ID NO: 205562 - DNA, 75 bp, Artificial Sequence
  Synthetic
caatgttttctccagtccttcggaatggatactgcaacttttctccagaaaatccagatttttgtgagacaaatc

SEQ ID NO: 205563 - DNA, 75 bp, Artificial Sequence
  Synthetic
atcaacactccatttggattccggaagatgagggacgaggaattacatgtgacatcttccaagcgagtactggta

SEQ ID NO: 205564 - DNA, 75 bp, Artificial Sequence
  Synthetic
tattactgaaaaatggaagcaaagtctgcggtttccaagatgaaagaggattattcagaagcataaagggtgcat

SEQ ID NO: 205565 - DNA, 75 bp, Artificial Sequence
  Synthetic
gcaaaatgataatctgtggaaagtctggggtccgactatatgatgggacatgggtgtcttacaattctgttgata

SEQ ID NO: 205566 - DNA, 75 bp, Artificial Sequence
  Synthetic
acctcaggatgtgttccagatcaaaaatggtgaacaaacacacagttaaattggataatatagaagagtccattg

SEQ ID NO: 205567 - DNA, 75 bp, Artificial Sequence
  Synthetic
tgagagatcttattaagaagcgtgaagagtgcctagatgctctagaagaagtcatgttgactagatctataagct

SEQ ID NO: 205568 - DNA, 75 bp, Artificial Sequence
  Synthetic
tcagaaagttgagtctctttagaaagcaagttccaggaagagggtatgtttacactatgataaacaatacaatga

SEQ ID NO: 205569 - DNA, 75 bp, Artificial Sequence
  Synthetic
tggaggcaacagggcattataaatcagtggataactggacagacattctacctaacccaatctgccttatggtgg

SEQ ID NO: 205570 - DNA, 75 bp, Artificial Sequence
  Synthetic
acggcaagtgtcatccaggttatgatggtgtattatttaacggtatcataagagacagtagaggcaaaatactaa

SEQ ID NO: 205571 - DNA, 75 bp, Artificial Sequence
  Synthetic
ttccagaaatgcaatcacatctactccgagaccatctggagttgctcaagagaaattccattccctggagacacc

SEQ ID NO: 205572 - DNA, 75 bp, Artificial Sequence
  Synthetic
ctcttgtgcactattctgaaaatggggaagatggctcagatcttaccagctttgctcagctatacataaaagacc

SEQ ID NO: 205573 - DNA, 75 bp, Artificial Sequence
  Synthetic
ctcatttgtctgtttctgacatagatataggatttccttcatggaagaagtatttgatgattgtggggggagtgt

SEQ ID NO: 205574 - DNA, 75 bp, Artificial Sequence
  Synthetic
tgataggactaattgtcttctggttcttggtcaagttgttgtttagagtatgttatactgttaagaggaaaaggc

SEQ ID NO: 205575 - DNA, 75 bp, Artificial Sequence
  Synthetic
ttcgtgagggttctatgaatgagacatccagtggccctgtcattcggacttctggtgacaaacagctttcgtggg

SEQ ID NO: 205576 - DNA, 75 bp, Artificial Sequence
  Synthetic
aatcttacaagagttctgcattctagtgggtttttgtgtagagtgttacatgggcttcagcccttagaaaaaggg

SEQ ID NO: 205577 - DNA, 75 bp, Artificial Sequence
  Synthetic
ccgaccaatcactgcctctaaaaaagttacattgccaaaagcattcttggatccagcgcttctccgggtcatttc

SEQ ID NO: 205578 - DNA, 75 bp, Artificial Sequence
  Synthetic
tcaggccagtaaccgttaaagatcatccgaccaatcatgtcggatccttcaccctagagagcatcgcttcttatc

SEQ ID NO: 205579 - DNA, 75 bp, Artificial Sequence
  Synthetic
cgaacctccctcttcatgatgctagatgaacacactctgtatttattcttgattctactcatgaacttcaaatca

SEQ ID NO: 205580 - DNA, 75 bp, Artificial Sequence
  Synthetic
tgtatctctgtttccctctctgctatatctataagtatctactaagttttatcatcatatcttcttgcggtaatc

SEQ ID NO: 205581 - DNA, 75 bp, Artificial Sequence
  Synthetic
agggtaaatctctaaaagagaacttatgaactgctgcaactatctaactcatgttgtaacatgaaaacactacat

SEQ ID NO: 205582 - DNA, 75 bp, Artificial Sequence
  Synthetic
taaatatgggctggttttttactgcaaatcatttaagagacttgtctccagaaatttctataacatcagtgaaaa

SEQ ID NO: 205583 - DNA, 75 bp, Artificial Sequence
  Synthetic
aaacagcagaagaagaccaatgatttcatgaacagaaagttcaacatcactccctctcacaaactagatcatgga

SEQ ID NO: 205584 - DNA, 75 bp, Artificial Sequence
  Synthetic
ctggtcagaggtgatagatgacccggaagatccattcagtttggatgaagaatcttgttctgttgatgtccctcc

SEQ ID NO: 205585 - DNA, 75 bp, Artificial Sequence
  Synthetic
aaacattctcagaacttccgactataatttaaactcccccctgttagaggaccaaagtttgctgatgattgagtg

SEQ ID NO: 205586 - DNA, 75 bp, Artificial Sequence
  Synthetic
gttaaaaactgccaacaaaccatctaggctcagacactctgaagggttactgagatcttacaaaactctaaaaga

SEQ ID NO: 205587 - DNA, 75 bp, Artificial Sequence
  Synthetic
ttgcctcaagaaaatagatttggactccttgagatatggaggtcaaggagctaaattagcttttaagagatgggt

SEQ ID NO: 205588 - DNA, 75 bp, Artificial Sequence
  Synthetic
cacgcacaactatgtagagtctactcgaaacaggaagatgtttatggatcttagagagttttatcagaaactgga

SEQ ID NO: 205589 - DNA, 75 bp, Artificial Sequence
  Synthetic
gcctatagaaactattacgaatagatttctagagaggagaggtttgcagtgtccttctttagggatactagaaag

SEQ ID NO: 205590 - DNA, 75 bp, Artificial Sequence
  Synthetic
cttcaagactttaagccctgactcagctctcggaagatatttcgtcaatgtttatgcatcttatcttgtctttca

SEQ ID NO: 205591 - DNA, 75 bp, Artificial Sequence
  Synthetic
tgttataatgctctatatgaactctctagattgggatgaagaaaaagccattatcgccttatggaggtccttctt

SEQ ID NO: 205592 - DNA, 75 bp, Artificial Sequence
  Synthetic
ggattataactccaggaccaactctgtgtcagtaaaagacttgctgtgggggaggatggtggtcactaaagaata

SEQ ID NO: 205593 - DNA, 75 bp, Artificial Sequence
  Synthetic
cgttctgatgctagatatcagctgcttgtttgataggaatttcatgctcatgttgaaagatacttttttatccag

SEQ ID NO: 205594 - DNA, 75 bp, Artificial Sequence
  Synthetic
attcaactctttgtcaatattattgtctcctccggattctctttactcagcagacttctctgagtccttgtgtga

SEQ ID NO: 205595 - DNA, 75 bp, Artificial Sequence
  Synthetic
cttgtataatgtgggagacaacatcatagcagaatgtgggaacgctggttatgatatcataaaaatgcttgaacc

SEQ ID NO: 205596 - DNA, 75 bp, Artificial Sequence
  Synthetic
gtttgtagtcaacaaacttgtgaaaagtgctgaagaatttcgcccaatgattccaaaattgggagattttcccga

SEQ ID NO: 205597 - DNA, 75 bp, Artificial Sequence
  Synthetic
attcattaaagacaagactcagcagttgattggcacctttggtcctgtggccaatttctttttttcaaaattgga

SEQ ID NO: 205598 - DNA, 75 bp, Artificial Sequence
  Synthetic
gcaatacaataacatccatgatttggtttttgtgtacggatgttacagacactggggtcacccccatattgatta

SEQ ID NO: 205599 - DNA, 75 bp, Artificial Sequence
  Synthetic
cagaaaggggttgtcaaaattgtatgatcaagtccatatgaaaaagtcaatagactccaggtatcaagaaagtct

SEQ ID NO: 205600 - DNA, 75 bp, Artificial Sequence
  Synthetic
agcgagtgacctagccaagaagattttgaggtggggatttgacaaatactctaaatggtacgttgatgttaaaaa

SEQ ID NO: 205601 - DNA, 75 bp, Artificial Sequence
  Synthetic
ggtccccttacatcatcctcttagatcttatatattgactcagacatggcctccaaaacatatagcagatatgat

SEQ ID NO: 205602 - DNA, 75 bp, Artificial Sequence
  Synthetic
agggaacacttggcatgaactgcccataactcaactgtttgacatcccagagtctatggacccatcagagatatt

SEQ ID NO: 205603 - DNA, 75 bp, Artificial Sequence
  Synthetic
ggatgacaaatcacactcatttacgagaagcaaactgatagcatggttgagtgagggaagaggaggaccagttcc

SEQ ID NO: 205604 - DNA, 75 bp, Artificial Sequence
  Synthetic
aagtgaaaaggtgatcataactgctctgtctcagaaccctgtgaatccaagagagttcttaaagagaattgatga

SEQ ID NO: 205605 - DNA, 75 bp, Artificial Sequence
  Synthetic
tcatggattagaccctgatgatttgataataggtttgaaacccaaggaaagagaattaaagattgaaggcagatt

SEQ ID NO: 205606 - DNA, 75 bp, Artificial Sequence
  Synthetic
ttttgctttgatgtcatggaatttaaggctttactttgtcataacagagaagttgttggctaatcatatcatacc

SEQ ID NO: 205607 - DNA, 75 bp, Artificial Sequence
  Synthetic
actttttgactctctcactatgacagacaatttgaacaaagtctttaagaagttaatagacagagtgacaggtca

SEQ ID NO: 205608 - DNA, 75 bp, Artificial Sequence
  Synthetic
aggactcaccgactactctagagtgacctatgcttttcatttggactacgagaagtggaacaatcatcaaagaat

SEQ ID NO: 205609 - DNA, 75 bp, Artificial Sequence
  Synthetic
ggagtcaacagagcatgttttccaggttttagacaaagtcttcggcctaaaaaaagtcttctctcgaacgcatga

SEQ ID NO: 205610 - DNA, 75 bp, Artificial Sequence
  Synthetic
gttttttcaaaaatcgtggatctactactctgaaagatctgatctgataggcatatgggggaacaaaatatgttg

SEQ ID NO: 205611 - DNA, 75 bp, Artificial Sequence
  Synthetic
cttagacatgagcgaaggccccacctgttgggacggacaagatggaggccttgagggtttgagacaaaagggatg

SEQ ID NO: 205612 - DNA, 75 bp, Artificial Sequence
  Synthetic
gagtctcgtgagtctcttgatgatagatcgtgaatctcaaataaggaatacaagaaccaagattctagctcaagg

SEQ ID NO: 205613 - DNA, 75 bp, Artificial Sequence
  Synthetic
agacaaccaggtcttatgtccaacttatgtggtgtcacaagggttgaatgaggacggtctaaaatatgagttgga

SEQ ID NO: 205614 - DNA, 75 bp, Artificial Sequence
  Synthetic
gaacatatctagaaatgccttgtccatttatagagcaatagaggagggagcaaggaagttaggccttatcattaa

SEQ ID NO: 205615 - DNA, 75 bp, Artificial Sequence
  Synthetic
aaaagaggagactatgtgtagttatgattttctaatatacgggaagacacctttatacagaggcaatatattggt

SEQ ID NO: 205616 - DNA, 75 bp, Artificial Sequence
  Synthetic
tcctgaatctaagagatgggcaagagtgtcttgcatatcaaacgatcaaatcattagtcttgctaacatcatgtc

SEQ ID NO: 205617 - DNA, 75 bp, Artificial Sequence
  Synthetic
tacagtatctaccaatgctttaacagtcgcccagcattctcaatctctggtaaaacctataagagactttcttat

SEQ ID NO: 205618 - DNA, 75 bp, Artificial Sequence
  Synthetic
gatgtccgttcaggcagtctatcattactttctgttcagtcctattctcaagagtcgagttcactgcatcttgaa

SEQ ID NO: 205619 - DNA, 75 bp, Artificial Sequence
  Synthetic
tctatctcatgagaggttgttacttgccatgtccagaatcatatttcttgatccttcattaggaggggtttctgg

SEQ ID NO: 205620 - DNA, 75 bp, Artificial Sequence
  Synthetic
aatgtctttaggaaggtttcatatcagacaattctctgacccggtgactgaaggtttatctttttggaaagagat

SEQ ID NO: 205621 - DNA, 75 bp, Artificial Sequence
  Synthetic
atgggagtgctcatctgaagagtggatactttctctttgtcaagaggctggaaacccagatataggagaaaggac

SEQ ID NO: 205622 - DNA, 75 bp, Artificial Sequence
  Synthetic
actggaaagttttacaaggttgttagaggatcctaccaccctgaatattagagggggggccagtcctactattct

SEQ ID NO: 205623 - DNA, 75 bp, Artificial Sequence
  Synthetic
cctaaaggaagccataagacaggccctttatgatgaagtcgacaaagtctcaaactctgagttcagagaagctat

SEQ ID NO: 205624 - DNA, 75 bp, Artificial Sequence
  Synthetic
aatattgtccaagacacatagagacaactttgttttgtacttgagatcgattgagcccctttttcctaggttctt

SEQ ID NO: 205625 - DNA, 75 bp, Artificial Sequence
  Synthetic
gagtgaactcttcagctcatctttccttggaatacctgaatctatcatcggactcattcagaattctaggaccat

SEQ ID NO: 205626 - DNA, 75 bp, Artificial Sequence
  Synthetic
tcgtagacagttcagaaagagcttgtctcgtacgctggaaaaatccttttacaagtctgaattgagtggtcttga

SEQ ID NO: 205627 - DNA, 75 bp, Artificial Sequence
  Synthetic
aaagatggctcaaatggggcagagagtcgggactgtctggaaatgttctgctgaaagggcagataggcttagaga

SEQ ID NO: 205628 - DNA, 75 bp, Artificial Sequence
  Synthetic
gatatcttggggaaggaaagtggtagggactacagttccgcatccttcagagctgttaagtttgacccccagatc

SEQ ID NO: 205629 - DNA, 75 bp, Artificial Sequence
  Synthetic
ttccataagttgtggatgtagaatccaggatgtccagaaacctagagtctcagtgtccgttcttccttcctttga

SEQ ID NO: 205630 - DNA, 75 bp, Artificial Sequence
  Synthetic
caatcgttttgtatctagagggcctctcaaaggatatttgggatcttcaacatctgtgtcgactcagctatttca

SEQ ID NO: 205631 - DNA, 75 bp, Artificial Sequence
  Synthetic
tgcttgggagaaggtgactaatgtacatgtagtgagaagagcgctatcgttgaaagaatctatcaattggttcat

SEQ ID NO: 205632 - DNA, 75 bp, Artificial Sequence
  Synthetic
agaaagggattcaaacttggcaaaaactataataaggaacataaagtccttgacagggccagagtttgagataga

SEQ ID NO: 205633 - DNA, 75 bp, Artificial Sequence
  Synthetic
tgagattcccttgttcaaaagaacagggtctgccctccatcgattcaaatcttccagatacagcgaaggaggtta

SEQ ID NO: 205634 - DNA, 75 bp, Artificial Sequence
  Synthetic
ctcttcagtgtgtcccaatttgttgtctcatatctcagtcagtacagataccatgtctgagctgacacatgatgg

SEQ ID NO: 205635 - DNA, 75 bp, Artificial Sequence
  Synthetic
aaggaatttcgacttcatgttccaaccgttgatgttgtattctcagacatggactgcagagcttgttcaaagaaa

SEQ ID NO: 205636 - DNA, 75 bp, Artificial Sequence
  Synthetic
tctgaagcttcgagactctacataccactggcatctcagatgtaaagattgtgtgagaccaattgacgatgtggt

SEQ ID NO: 205637 - DNA, 75 bp, Artificial Sequence
  Synthetic
gctagaatgtccaaagatctttgaattcccagatatttcaacccgaatttctaggatggtatccggcgccgtgcc

SEQ ID NO: 205638 - DNA, 75 bp, Artificial Sequence
  Synthetic
agaattcaagaaattaccagaggttagtttgaagcagggcaatctcagcatgatgagcaatgaagacaaatcatt

SEQ ID NO: 205639 - DNA, 75 bp, Artificial Sequence
  Synthetic
ccatattgggacagctcaaggattgttatactctattcttgtggctattcatgacccaggatataatgaccactc

SEQ ID NO: 205640 - DNA, 75 bp, Artificial Sequence
  Synthetic
tatttttcccgtgaatatatactctcgactatccccaagaggatatttgaggggattggctagaggcattctgat

SEQ ID NO: 205641 - DNA, 75 bp, Artificial Sequence
  Synthetic
agggtcatccatctgcttcttaactagaatgaccaagattaatgtgaatcgtcctttagagttgatgtccggagt

SEQ ID NO: 205642 - DNA, 75 bp, Artificial Sequence
  Synthetic
gatctcttacatattacttagactggattcccatccaagcttatatgttatgttgagagagcctcttataagatc

SEQ ID NO: 205643 - DNA, 75 bp, Artificial Sequence
  Synthetic
agagatattctctatccctcagaaggttcctgcagcttaccctacaacaatgagagaaggcaatcgggcagtctt

SEQ ID NO: 205644 - DNA, 75 bp, Artificial Sequence
  Synthetic
aagtcacttgcaatatacgttaagatatgataaagacagtttggttgatggctctggatcaaactggttgtgggt

SEQ ID NO: 205645 - DNA, 75 bp, Artificial Sequence
  Synthetic
gttttctgactttagaagttctaagatgacatacctgacattgatcacatatcagactcatctgttattgcaaaa

SEQ ID NO: 205646 - DNA, 75 bp, Artificial Sequence
  Synthetic
ggtaggaaagaacctgtctaagaaaatgaaatctgatctcagacagcttagctctctcatgagacaagtactggg

SEQ ID NO: 205647 - DNA, 75 bp, Artificial Sequence
  Synthetic
aggccagtcagatatgtcaatgaaagatgtggacattgatcaaagagtcatatgtgatgctatccacagagtgaa

SEQ ID NO: 205648 - DNA, 75 bp, Artificial Sequence
  Synthetic
atggatcgatcaagaagtcagacatgcagccaaagaactgcatagatctgaagactcgccatcatcagtcttcag

SEQ ID NO: 205649 - DNA, 75 bp, Artificial Sequence
  Synthetic
gagatctagtcaatctgaatgggtttgttcttctcaacagttagccatcacgacttctgccaacccctctcatcc

SEQ ID NO: 205650 - DNA, 75 bp, Artificial Sequence
  Synthetic
gtctcccatagatgtcaaggcaatcagcaaaaagttacaaaatcctctgatatctggactgagggtagtgcagtg

SEQ ID NO: 205651 - DNA, 75 bp, Artificial Sequence
  Synthetic
ggctacaggagcacattataaaataaagcctatactgaattctttgcaatttgaaccaaagctttgtttggtggt

SEQ ID NO: 205652 - DNA, 75 bp, Artificial Sequence
  Synthetic
cggagatgggtcaggaggaatatctagatgtattttacaatttttccccggaaccaagcttgtctttaacagcct

SEQ ID NO: 205653 - DNA, 75 bp, Artificial Sequence
  Synthetic
tctccagctaaacgacatgatggcttctgggacacatcctttgcctccctctgctttatcccatggaggaaagag

SEQ ID NO: 205654 - DNA, 75 bp, Artificial Sequence
  Synthetic
ccttacagatagagttgttgatttcgaactcatctgggagaagccgtctgatctcagaaactcagtgacctggaa

SEQ ID NO: 205655 - DNA, 75 bp, Artificial Sequence
  Synthetic
ttacttcagagatgtccagagagatctgtctacgaatttcgacttgattgtatgtgatgcagaggtcactgacat

SEQ ID NO: 205656 - DNA, 75 bp, Artificial Sequence
  Synthetic
atcatccatgaacagaatagcctttctcctttcaaattttatactgtctataaaaagccctttgaccctgatatt

SEQ ID NO: 205657 - DNA, 75 bp, Artificial Sequence
  Synthetic
taaatcctatggaactatgttagtaaacccagattataaagcactcaattatctttctcaggtatttcctaacat

SEQ ID NO: 205658 - DNA, 75 bp, Artificial Sequence
  Synthetic
gagtggagtgatcacacaaacaacgtcttctttctcctcagaactctatttgctttgtgcaaaatcaggagattt

SEQ ID NO: 205659 - DNA, 75 bp, Artificial Sequence
  Synthetic
ttacaaagaaacagaatatatcactgcctcatccatcagagagctaagtcttgttttattcaattgtagaagtcc

SEQ ID NO: 205660 - DNA, 75 bp, Artificial Sequence
  Synthetic
gaaaagtgaaatgacaagagccagatcactgaactacaaagaccttataatgggctttcctcctgaaataatctc

SEQ ID NO: 205661 - DNA, 75 bp, Artificial Sequence
  Synthetic
taaccctttcaatgaaatgatcataactctaatagacagcgaggtggagtcctttttggttcacaagatggtaga

SEQ ID NO: 205662 - DNA, 75 bp, Artificial Sequence
  Synthetic
tgacttagaactgactcgaggaagtctacaaaggttagctagaatcttagccattgtagtagtatactcaaatag

SEQ ID NO: 205663 - DNA, 75 bp, Artificial Sequence
  Synthetic
agtctttaatgtgtccaagcctctgacaggccaaaagttcatccctccttcagatcctaagttgttaaggcattt

SEQ ID NO: 205664 - DNA, 75 bp, Artificial Sequence
  Synthetic
caacatctgtgcaagtacatttctctttttaaactccttgataggagacattgaaggcttctccagactacactt

SEQ ID NO: 205665 - DNA, 75 bp, Artificial Sequence
  Synthetic
cctttataacgaaaagatatcatattactttaagaaacaaactcataaaggcaaggtctatctggtttggagctg

SEQ ID NO: 205666 - DNA, 75 bp, Artificial Sequence
  Synthetic
gtcgaacgaaagtccaacatgtaaacaagttgcatgcaactccatgctaagcctttcttcccactggatcagaat

SEQ ID NO: 205667 - DNA, 75 bp, Artificial Sequence
  Synthetic
gatttacaaagtgattagagtaacaagaataaatgagagaggaagcaaaatcctagatgagatgacaactccatt

SEQ ID NO: 205668 - DNA, 75 bp, Artificial Sequence
  Synthetic
gagaacatacaatagatggttaaaaattcaagacatcagacacaggacgtcacttttggaatactggtctaatta

SEQ ID NO: 205669 - DNA, 75 bp, Artificial Sequence
  Synthetic
agggagccgagtctaattggaccagccgaaggtcagtcaacgtttctgtgaaaaaaacatttaattctttcaaca

SEQ ID NO: 205670 - DNA, 75 bp, Artificial Sequence
  Synthetic
aaaaacatttaattctttcaacaacggtctgttatcgcctttttctctattttttattgtttttttgttaagcgt

SEQ ID NO: 205671 - DNA, 75 bp, Artificial Sequence
  Synthetic
agaaattcacctgtgtgaatttcactaaccgttttagtggagagaacttttgtttaacacagtctgaatagtttt

SEQ ID NO: 205672 - DNA, 75 bp, Artificial Sequence
  Synthetic
taaccgttttagtggagagaacttttgtttaacacagtctgaatagttttttagcaagggatttcccatgtctaa

SEQ ID NO: 205673 - DNA, 75 bp, Artificial Sequence
  Synthetic
ttagcaagggatttcccatgtctaaaaaaccaggaaagtccgctgcaaagcggactgtcaatatgctaaaacgcc

SEQ ID NO: 205674 - DNA, 75 bp, Artificial Sequence
  Synthetic
tggctagcgtgtccccctcaagggggcgaagaactattcggagaatgctagatgtgagaggagcaccaagattga

SEQ ID NO: 205675 - DNA, 75 bp, Artificial Sequence
  Synthetic
gatgtgagaggagcaccaagattgatcctagccctcatggcttttttccgtttcgcagcaatcaagcccactctg

SEQ ID NO: 205676 - DNA, 75 bp, Artificial Sequence
  Synthetic
ggcttgaaaaaacgatggcgttctgtcaacaagacagtcgctgtcaaacatctgaccaacttcaaaaaggaactg

SEQ ID NO: 205677 - DNA, 75 bp, Artificial Sequence
  Synthetic
tcaacaagacagtcgctgtcaaacatctgaccaacttcaaaaaggaactgaccaccatgctcgactcagtcaaca

SEQ ID NO: 205678 - DNA, 75 bp, Artificial Sequence
  Synthetic
accaccatgctcgactcagtcaacaagcgcaaggaaaagaagaagagcttctcaacggccctgctctggattacc

SEQ ID NO: 205679 - DNA, 75 bp, Artificial Sequence
  Synthetic
atgatcacagcggtcgccggcctcaagatctcatcacacagagaccggcctctgctgatggtgaacaaaactgat

SEQ ID NO: 205680 - DNA, 75 bp, Artificial Sequence
  Synthetic
gtgtcggatgccatcccagtgccctcagtgaaaggaaccaacatgtgcacgatcagggctttggacgtaggctac

SEQ ID NO: 205681 - DNA, 75 bp, Artificial Sequence
  Synthetic
acttgcgcttatgacacaacttacgagtgccctcacctggaagtgaccatggatccggaagacatagattgttgg

SEQ ID NO: 205682 - DNA, 75 bp, Artificial Sequence
  Synthetic
tgcacacttgaatctgtttatgttaactacggactctgcaagcaaaaccatcatgttagaaggggccgacgtgcg

SEQ ID NO: 205683 - DNA, 75 bp, Artificial Sequence
  Synthetic
atcaacattcctcaccacggagagagccatcttgaaaaccgggcgactccatggatggacaccaccaagacaacc

SEQ ID NO: 205684 - DNA, 75 bp, Artificial Sequence
  Synthetic
aagtatctaactaaagttgagaattgggttatacgcaatcctggatatgcactagtagcattggccacagcctgg

SEQ ID NO: 205685 - DNA, 75 bp, Artificial Sequence
  Synthetic
atgttaggtagcaacaccccgcagagggtggtcttcatgatcatgatgatgctcattgctccagcatacagcttg

SEQ ID NO: 205686 - DNA, 75 bp, Artificial Sequence
  Synthetic
aactgcttgggaatctcaaaccgagattttgttgaaggcttgtctggaggcacatgggtggacattgtgctggaa

SEQ ID NO: 205687 - DNA, 75 bp, Artificial Sequence
  Synthetic
ggagggagctgtgtgacagttatggccaaggacaaaccaacactagacatcaagttgataagaatggaagccaag

SEQ ID NO: 205688 - DNA, 75 bp, Artificial Sequence
  Synthetic
gacctggccacggttcgtagttactgctaccaggccactgtcaccgactcgtcaactgaggccagatgccctacc

SEQ ID NO: 205689 - DNA, 75 bp, Artificial Sequence
  Synthetic
atgggtgaagcccacaactccaaatctcttgacgccagctacgtctgcaaatcatcatacgtggatcgcggatgg

SEQ ID NO: 205690 - DNA, 75 bp, Artificial Sequence
  Synthetic
ggcaatggatgcgggctctttgggaaagggagcatccaaacttgtgtgaagttttcatgtcctggaaaggctact

SEQ ID NO: 205691 - DNA, 75 bp, Artificial Sequence
  Synthetic
gggaaaagcattcagagggagaatctgaactatgacgttgcagtgtacgtgcacggaccaataagcgcagccgca

SEQ ID NO: 205692 - DNA, 75 bp, Artificial Sequence
  Synthetic
cacggcaactacaccgcccaattgacagggaagtacgctgccaaattctctatcactccaagtgcaccaacatac

SEQ ID NO: 205693 - DNA, 75 bp, Artificial Sequence
  Synthetic
actgcaaatttgggggaatatggagaagcaacaatggagtgtgaaccacgggccgccttggacattgacaactac

SEQ ID NO: 205694 - DNA, 75 bp, Artificial Sequence
  Synthetic
tatgtcatgtcactcaacaacaaacattggcttgtcaaccgtgactggttccatgatctggatctaccctggact

SEQ ID NO: 205695 - DNA, 75 bp, Artificial Sequence
  Synthetic
ggacccgccactgagtcgtggaagaaccgtgagagcctcatcgagtttgaggagccccatgctactcgacaaaca

SEQ ID NO: 205696 - DNA, 75 bp, Artificial Sequence
  Synthetic
gtagttgctttgggtaaccaagagggcgctctgcatacggctttggcaggtgccatacccgtggaagtctcaagc

SEQ ID NO: 205697 - DNA, 75 bp, Artificial Sequence
  Synthetic
acgactctcactttgaactctggacacctcaagtgcaggttgaagctggataagctcaagatcaaagggacaact

SEQ ID NO: 205698 - DNA, 75 bp, Artificial Sequence
  Synthetic
tacgctatgtgcaaagggactttcgcgtttgcccaaaccccagtggatacaggccatggcaccatcgtggctgag

SEQ ID NO: 205699 - DNA, 75 bp, Artificial Sequence
  Synthetic
ctgacctacacagggacggacggaccgtgcaagatccccatctccatgactgcagatttgcgggacatgactcca

SEQ ID NO: 205700 - DNA, 75 bp, Artificial Sequence
  Synthetic
atcggaagacttgtcacagtcaatccaataatcccaagctcggccaaatcccaaaagattctggttgaacttgag

SEQ ID NO: 205701 - DNA, 75 bp, Artificial Sequence
  Synthetic
cccccctttgggagctcgttcatcctcgtgggccaagaaaacaaccagattaagtaccaatggcacaagactggc

SEQ ID NO: 205702 - DNA, 75 bp, Artificial Sequence
  Synthetic
agcacaattggaaatgctctgaaaacgacttggaagggagctcaaaggtttgctgtcctcggagacacagcttgg

SEQ ID NO: 205703 - DNA, 75 bp, Artificial Sequence
  Synthetic
gactttggttctgtgggtggaattttcaattccattgggaaaaccattcatggagtgtttggcaccgccttcagg

SEQ ID NO: 205704 - DNA, 75 bp, Artificial Sequence
  Synthetic
tcattgtttggaggtatgtcgtgggtaacgcaagctctcatgggagctcttctgctctggctcggcatcagtgct

SEQ ID NO: 205705 - DNA, 75 bp, Artificial Sequence
  Synthetic
cgtgaaaggacggtgtctttgataatgctgagtgtgggtggcatcctccttttcttggctgtcaatgtgcatgct

SEQ ID NO: 205706 - DNA, 75 bp, Artificial Sequence
  Synthetic
gacaccggttgtgctattgacatggcacgtcgtgagctgaaatgtggaagtggtatcttcatccacaacgatgtt

SEQ ID NO: 205707 - DNA, 75 bp, Artificial Sequence
  Synthetic
gagacatggaggaacaattacaaataccacccactcacgccacgcggctttgccaaggtcattcagatgtcaaag

SEQ ID NO: 205708 - DNA, 75 bp, Artificial Sequence
  Synthetic
gataaaggtgtctgcggcataagatcagtgggcagacttgagcacgagatgtgggaggccatcgcacctgagttg

SEQ ID NO: 205709 - DNA, 75 bp, Artificial Sequence
  Synthetic
aacgccatcttcgaggacaatggagtggacctcagcgttgtcgtgaaaggccagacagggatttacaaacgtgca

SEQ ID NO: 205710 - DNA, 75 bp, Artificial Sequence
  Synthetic
cccaaacgcctcaccgagacgaaagatgaaatgagctttggatggaagaattggggaaagagctttatcttttca

SEQ ID NO: 205711 - DNA, 75 bp, Artificial Sequence
  Synthetic
accgaaacagccaactccacattcattgtcgatggaccagaaagtaaagagtgcccaacatcagaccgggcttgg

SEQ ID NO: 205712 - DNA, 75 bp, Artificial Sequence
  Synthetic
aactccctagaattggaggatttcgggttcggaatcatctcaaccaagattttcctaaaggtcaacgagcaacgg

SEQ ID NO: 205713 - DNA, 75 bp, Artificial Sequence
  Synthetic
ggaaactcatgcgactcagcggtgattggaacagccgtcaagggcaatgaagctgtccatagtgacttgggattc

SEQ ID NO: 205714 - DNA, 75 bp, Artificial Sequence
  Synthetic
tggatccagagcacaaagaatgaatcctggcaactggagagagcagtccttggggaggtcaagtcgtgcacatgg

SEQ ID NO: 205715 - DNA, 75 bp, Artificial Sequence
  Synthetic
ccggaaagccacacattgtggggcgacggagttgaggagagtgacttgattattccaatcacgctggccggacca

SEQ ID NO: 205716 - DNA, 75 bp, Artificial Sequence
  Synthetic
aaaagccaccacaacatgcgcccagggtacaagactcaaaccaaagggccctggcatgaggagacacctctcgtc

SEQ ID NO: 205717 - DNA, 75 bp, Artificial Sequence
  Synthetic
atcgagtttgctgaatgtccagggaccacagtgacccaggaagagagttgtggcggtagaggaccatcaattagg

SEQ ID NO: 205718 - DNA, 75 bp, Artificial Sequence
  Synthetic
acaacaacagcaagtggaaggaccatacgcaattggtgttgcaagaactgcacccttcctccactccgatttatg

SEQ ID NO: 205719 - DNA, 75 bp, Artificial Sequence
  Synthetic
gccggggaaaactgctggtatggcgtggaagtcagacccaagcgcgagaatgaggaaaccctaatcaagtcaaaa

SEQ ID NO: 205720 - DNA, 75 bp, Artificial Sequence
  Synthetic
gtctcagcggggaatggccagaccattgagcccttccaactcgggatcctaatggcatttgtgttcacccaagaa

SEQ ID NO: 205721 - DNA, 75 bp, Artificial Sequence
  Synthetic
gtcctgaggaggaggtggacggcgaacctagcgttgcccacctcagccttgctaatggcttgtttcatctttggc

SEQ ID NO: 205722 - DNA, 75 bp, Artificial Sequence
  Synthetic
ggcttcacctacctggacctgttcaggtattttatccttgtgggtgcggcctttgcagaggcaaacagcggtggg

SEQ ID NO: 205723 - DNA, 75 bp, Artificial Sequence
  Synthetic
gacgtcgttcatctagccatgatagctgcttttaacatccagccagtggcactagtcactaccttcttcaggaaa

SEQ ID NO: 205724 - DNA, 75 bp, Artificial Sequence
  Synthetic
aattggaccaaccgggagaacatgattctcatcatcgctgcagcatgcacacagatggcgtgcatggagttgaag

SEQ ID NO: 205725 - DNA, 75 bp, Artificial Sequence
  Synthetic
attgagttgtttcatgtcatgaattcactttctttggcatggatgatactcaaggccctgacaactggcacgact

SEQ ID NO: 205726 - DNA, 75 bp, Artificial Sequence
  Synthetic
tcgactcttgcaatgccgtttctggcagctctgtccccacccatgaactggcttgggctggacgtagtaaggtgt

SEQ ID NO: 205727 - DNA, 75 bp, Artificial Sequence
  Synthetic
cttctgatcatggctggagttgcagcgctcattagtgagcgtagggagagcttggccaagaaaaaaggggccttg

SEQ ID NO: 205728 - DNA, 75 bp, Artificial Sequence
  Synthetic
ctcatctctgcagccttagctttgacgggagctttctcgccgctggttctgcagggagccctgatgttcactcaa

SEQ ID NO: 205729 - DNA, 75 bp, Artificial Sequence
  Synthetic
agtttgggaaaacggggatggcctgccagtgaagtactaacagccgtgggcatgactttcgctcttgcggggagt

SEQ ID NO: 205730 - DNA, 75 bp, Artificial Sequence
  Synthetic
gttgccagactggacggagggactatggccatcccattggccaccatggccatactggctgttgcctatgtcctc

SEQ ID NO: 205731 - DNA, 75 bp, Artificial Sequence
  Synthetic
tcaggaaaatccactgacatgtggttggaacgctgcgctgacatctcatggatcaatgaggctgagatcacaggg

SEQ ID NO: 205732 - DNA, 75 bp, Artificial Sequence
  Synthetic
accagcccacgtcttgatgtcgaacttgattccaacggagacttcaagatgatcaatgaccctggagttccaatg

SEQ ID NO: 205733 - DNA, 75 bp, Artificial Sequence
  Synthetic
tggatgtggacttgtagaatgggcctcatggcaatggcagcatacaaccccgtgcttattccagtgtccatggcc

SEQ ID NO: 205734 - DNA, 75 bp, Artificial Sequence
  Synthetic
ggatactggatgacagtgaaaatccacaagcgtggaggggtcatgtgggacgttccagctcccaagcaatttggc

SEQ ID NO: 205735 - DNA, 75 bp, Artificial Sequence
  Synthetic
aagacggagttaaaacccggagtctacagagtcatgaccatgggaattttgggacggtaccagtcaggtgtgggg

SEQ ID NO: 205736 - DNA, 75 bp, Artificial Sequence
  Synthetic
gtcatgtgggatggagtcttccacaccatgtggcatgtcacacagggagccgccttgcgaaatggtgaaggacgc

SEQ ID NO: 205737 - DNA, 75 bp, Artificial Sequence
  Synthetic
ctcaaccccacttgggggagtgtgcgtgatgacttaatatcctatgggggcaagtggaaactctcagccacatgg

SEQ ID NO: 205738 - DNA, 75 bp, Artificial Sequence
  Synthetic
aatggaagtgaggaggtccagatgatcgccgtggaaccaggaaaggctgcaaaaaactaccaaaccaagccagga

SEQ ID NO: 205739 - DNA, 75 bp, Artificial Sequence
  Synthetic
gtgttcaaaacgccggcaggagaaattggtgccatcacactggattttcccaagggcacttcgggatcgcccatc

SEQ ID NO: 205740 - DNA, 75 bp, Artificial Sequence
  Synthetic
attaacaaagccggggaaatcactggactgtatggcaatggaattgtgctggaaagaggggcatatgtcagcgcc

SEQ ID NO: 205741 - DNA, 75 bp, Artificial Sequence
  Synthetic
atcacacaaggagagcggcaggaagaggaaactccggaggcattcacgccggacatgctaaaaaaacgaaggctc

SEQ ID NO: 205742 - DNA, 75 bp, Artificial Sequence
  Synthetic
acaatactggatctccatccaggagctgggaaaacaagaagggtcatccctcagattgtcagagagtgcgtgaaa

SEQ ID NO: 205743 - DNA, 75 bp, Artificial Sequence
  Synthetic
gcccgcctccgaacggtcatactggttcccaccagagtcgtcgccgctgaaatggcagaggcacttcgtggtctc

SEQ ID NO: 205744 - DNA, 75 bp, Artificial Sequence
  Synthetic
cccatcaggtatcaaacatcagccgtcaaggcagaacactctgggaatgagatagtggatgccatgcgccacgca

SEQ ID NO: 205745 - DNA, 75 bp, Artificial Sequence
  Synthetic
acactgacacagcgcctgctaacaccagcaaaagtgccgaactacaacgtgtttgtgatggatgaagcccacttc

SEQ ID NO: 205746 - DNA, 75 bp, Artificial Sequence
  Synthetic
actgacccagcaagtatagcggcaagggggtacatttcaaccaaggtggaacttggggaggctgcggccatcttc

SEQ ID NO: 205747 - DNA, 75 bp, Artificial Sequence
  Synthetic
atgactgcaacaccgccgggaacgactgacccctttccagactcaaatgctccaatcattgaccaagaggctgaa

SEQ ID NO: 205748 - DNA, 75 bp, Artificial Sequence
  Synthetic
atccccgacagggcttggaatagtggcttcgagtggatcacagaatacacaggaaagaccgtctggtttgtaccc

SEQ ID NO: 205749 - DNA, 75 bp, Artificial Sequence
  Synthetic
agtgtgcgcatgggcaatgaaattgccatgtgcttgaccaaagcggggaaaaaggtgatccaactgaataggaag

SEQ ID NO: 205750 - DNA, 75 bp, Artificial Sequence
  Synthetic
agctacgactctgagtaccagaagtgcaaaggcaatgactgggacttcgtcataacaactgacatttccgaaatg

SEQ ID NO: 205751 - DNA, 75 bp, Artificial Sequence
  Synthetic
ggggccaattttggcgctcatagggtcattgacagtaggaagtgcgtgaaaccagtcattctggacggagatgac

SEQ ID NO: 205752 - DNA, 75 bp, Artificial Sequence
  Synthetic
agagtcctcatgaatgggccggccccaatcaccccagcaagcgcagcccaaaggagaggtaggattggaagggac

SEQ ID NO: 205753 - DNA, 75 bp, Artificial Sequence
  Synthetic
ccgacccaatcaggggacgagtacttctacggaggaccaaccaccactgatgacacgggacatgctcactggatt

SEQ ID NO: 205754 - DNA, 75 bp, Artificial Sequence
  Synthetic
gaagcaaagatcctcctggacaacatccaactacagaatggactagtggcccagttgtatggcccggagcgtgac

SEQ ID NO: 205755 - DNA, 75 bp, Artificial Sequence
  Synthetic
aaggtcttcacaaccgatggtgagtaccggttacgcagcgagcagaaaaagaacttcgtggaattcctcaggaca

SEQ ID NO: 205756 - DNA, 75 bp, Artificial Sequence
  Synthetic
ggtgacctcccagtgtggctgtcatacaaggttgctgaagcggggtacgcctacacagacaggagatggtgtttt

SEQ ID NO: 205757 - DNA, 75 bp, Artificial Sequence
  Synthetic
gacggacccgcaaacaacacaattctagaggttagaggagacccagaagtctggacgcgacaaggggaaaaaagg

SEQ ID NO: 205758 - DNA, 75 bp, Artificial Sequence
  Synthetic
attctgcgcccaagatggtcagatgcacgagtctactgtgataaccaagccctgagatccttcaaggagtttgcg

SEQ ID NO: 205759 - DNA, 75 bp, Artificial Sequence
  Synthetic
gcagggaagcgctcagcaggctcagtcatggaggtaatgggtagaatgcctgactatttttggacaaagactctc

SEQ ID NO: 205760 - DNA, 75 bp, Artificial Sequence
  Synthetic
aatgcagcagacaacctgtatgttctggccacagccaacaaaggagggcgagcccatcaagcggcacttgaagag

SEQ ID NO: 205761 - DNA, 75 bp, Artificial Sequence
  Synthetic
ctgcctgacacagttgaaaccatcttgctcatgacaatgatgtgtgtggcatcactgggaatgttcactctgatg

SEQ ID NO: 205762 - DNA, 75 bp, Artificial Sequence
  Synthetic
gttcaccggaggggtctgggcaagactggactgggaaccctagtgctcgcgacggtcacggtcctcctatggatc

SEQ ID NO: 205763 - DNA, 75 bp, Artificial Sequence
  Synthetic
tcagatgtgccagccccaaagatagctggagttctcctaattgcattcctgctgatgatcgtcctcatcccagaa

SEQ ID NO: 205764 - DNA, 75 bp, Artificial Sequence
  Synthetic
cccgaaaagcaaaggagccagacagataaccatttggcaatctttctcgtgtgcgttcttctgttgattggggcc

SEQ ID NO: 205765 - DNA, 75 bp, Artificial Sequence
  Synthetic
gtttccgccaacgaaatggggtggcttgagacaaccaaaaaagacatcggaaagctgttccgctcaagtggagac

SEQ ID NO: 205766 - DNA, 75 bp, Artificial Sequence
  Synthetic
acacaagagcagtcgacctggcaatcttgggcacccgaggtgagagcagccactgcatgggcaggttatgctggg

SEQ ID NO: 205767 - DNA, 75 bp, Artificial Sequence
  Synthetic
ctcacagtgttcttaacaccacttttccggcatctcatcaccacccagtatgtgagcttttccctgaccgcaatt

SEQ ID NO: 205768 - DNA, 75 bp, Artificial Sequence
  Synthetic
acagcccaggcctcggctttgtttggtctgagcgcaggttacccctttgttgggattgacttggcggtgggtttc

SEQ ID NO: 205769 - DNA, 75 bp, Artificial Sequence
  Synthetic
ctattactcgggtgctacggacagtacaacttgccaacagctgtggcgaccggcctgcttctcctagctcactat

SEQ ID NO: 205770 - DNA, 75 bp, Artificial Sequence
  Synthetic
ggatacatgatcccagggtggcaggctgaggccatgcgtgcagcacaaaagagaacagcagctggcgtgatgaag

SEQ ID NO: 205771 - DNA, 75 bp, Artificial Sequence
  Synthetic
aatgcagttgttgatggaattgtggcaacggacattccagaagtggacactgcaacaccaatcacagagaaaaaa

SEQ ID NO: 205772 - DNA, 75 bp, Artificial Sequence
  Synthetic
ctgggccagatcttgctcattctactgtgcggagcatctctcttagttaagtttgacaccatggttttagtggaa

SEQ ID NO: 205773 - DNA, 75 bp, Artificial Sequence
  Synthetic
gcaggggtcttgacaacatcagccatggccactctcattgagggaaacgccaacacagtctggaactcaacggtg

SEQ ID NO: 205774 - DNA, 75 bp, Artificial Sequence
  Synthetic
gcggttggtgtttgccacctcatgcggggagcttggctggctgggccttcgatcggatggaccatcgttagaaat

SEQ ID NO: 205775 - DNA, 75 bp, Artificial Sequence
  Synthetic
cttgagaaccccaaattgaagcgcggaggaggatcggctccaacccttggagagatatggaaagcccaactgaac

SEQ ID NO: 205776 - DNA, 75 bp, Artificial Sequence
  Synthetic
caactgaccagggaggaattcatggcgtaccgaagagatgggatcctcgaagtggacaggacacaggcgcggaga

SEQ ID NO: 205777 - DNA, 75 bp, Artificial Sequence
  Synthetic
gcacgccaaagtggaatcacaaccggagggcatccggtatcccgaggaacggccaaactacgctggatggttgag

SEQ ID NO: 205778 - DNA, 75 bp, Artificial Sequence
  Synthetic
cggggatttgtgaggcccattgggaaagtggttgatcttggctgtggcaggggaggctggagctactattgtgcc

SEQ ID NO: 205779 - DNA, 75 bp, Artificial Sequence
  Synthetic
accctcagacatgtgcaggaagtgagaggatacacaaagggtggaccaggccacgaggaaccggtgatgatgcaa

SEQ ID NO: 205780 - DNA, 75 bp, Artificial Sequence
  Synthetic
agttatggatggaacattgtcaccatgaaaagcggtgttgacgtgttctacaagcccactgagtcctgtgacaca

SEQ ID NO: 205781 - DNA, 75 bp, Artificial Sequence
  Synthetic
ctcctctgtgacatcggagagtcttcttcctcagttggagttgaggaggccagaactctcagggtcttggacatg

SEQ ID NO: 205782 - DNA, 75 bp, Artificial Sequence
  Synthetic
gttgaaccatggcttagagctgccaatagtttctgcatcaaagtgttgtgcccatacaccccaaaggtcattgaa

SEQ ID NO: 205783 - DNA, 75 bp, Artificial Sequence
  Synthetic
cgcctggagcgccttcaaagggcttatggtggcggactggtcagagtcccgctttctaggaactccacgcatgag

SEQ ID NO: 205784 - DNA, 75 bp, Artificial Sequence
  Synthetic
atgtactgggtcagtggggcatcaagcaacatcatcaatgccgtcaccgtcacaagccagatcctcgtgcagcgc

SEQ ID NO: 205785 - DNA, 75 bp, Artificial Sequence
  Synthetic
atgaataaaggctgccgacatggccctcgctatgaggaggatgtttgcttgggaagcggcacacgtgccgtggcc

SEQ ID NO: 205786 - DNA, 75 bp, Artificial Sequence
  Synthetic
acccaggcatcaccctctgatcacaccaagatcaagcacaggctggagcggctgaggaaagagttttcagcaacc

SEQ ID NO: 205787 - DNA, 75 bp, Artificial Sequence
  Synthetic
ccaagatcaagcacaggctggagcggctgaggaaagagttttcagcaacctggcacatcgaccttgaacatccgt

SEQ ID NO: 205788 - DNA, 75 bp, Artificial Sequence
  Synthetic
tggcacatcgaccttgaacatccgtaccggacatggcactaccacggaagctacgaggttcagcccactggatca

SEQ ID NO: 205789 - DNA, 75 bp, Artificial Sequence
  Synthetic
gccaactcaatggtcaatggcgtggtgcgcctgttgtctaagccatgggacgcaattaccagcgtggtaaccatg

SEQ ID NO: 205790 - DNA, 75 bp, Artificial Sequence
  Synthetic
gcaatgactgacacgaccccctttggccaacaaagggtgtttaaagagaaggtggatacacgggccccagaccca

SEQ ID NO: 205791 - DNA, 75 bp, Artificial Sequence
  Synthetic
gcggtgggagttgctcaggcactggacatcacaacaggctggctatggaccttcctggctagaagcaagaaaccc

SEQ ID NO: 205792 - DNA, 75 bp, Artificial Sequence
  Synthetic
aggatgtgcacgcgtgaggagtttatcgcgaaggtcaatagcaacgcggcattgggcgcggtgtttgatgagcag

SEQ ID NO: 205793 - DNA, 75 bp, Artificial Sequence
  Synthetic
aaccagtggtcaacggctagagaagcagtggaagacccagccttctggaacctagttgatgaggagcgcaaagcc

SEQ ID NO: 205794 - DNA, 75 bp, Artificial Sequence
  Synthetic
cacctggcaggacgctgtgaaacatgcatctacaacatgatgggaaagcgagagaaaaaactaggagagttcggg

SEQ ID NO: 205795 - DNA, 75 bp, Artificial Sequence
  Synthetic
aaggcaaagggaagcagagccatctggtacatgtggcttggagctagattcttggaatttgaagcactgggcttt

SEQ ID NO: 205796 - DNA, 75 bp, Artificial Sequence
  Synthetic
ctaaatgaagaccattggatgagcagagagaactcactgggtggagtcgaagggcaaggactccagaaacttggg

SEQ ID NO: 205797 - DNA, 75 bp, Artificial Sequence
  Synthetic
tacattctgagggacatctcacacctggagggtggaaacatgtttgctgatgacactgcaggctgggataccaga

SEQ ID NO: 205798 - DNA, 75 bp, Artificial Sequence
  Synthetic
atcacgagggctgatcttgaaaacgaagccaaagtgatgaacatgatggatggagaacataaacaactcgccaag

SEQ ID NO: 205799 - DNA, 75 bp, Artificial Sequence
  Synthetic
gctataatcgaattgacctacaggcataaagtagtcaaggtcatgcggcctgcgcggggagggaagacagtcatg

SEQ ID NO: 205800 - DNA, 75 bp, Artificial Sequence
  Synthetic
gacatcatctccagggaggaccagagagggagtggccaagtagtcacctatgcacttaacaccttcaccaacctg

SEQ ID NO: 205801 - DNA, 75 bp, Artificial Sequence
  Synthetic
gcggctcaactagtgagatgcatggagggggaggaactgttgacggagagtgacgtgcacggcttgagcccgaag

SEQ ID NO: 205802 - DNA, 75 bp, Artificial Sequence
  Synthetic
aagaagcaagcagtccggaactggttgatccaaaatggaagagagaggctttcgcgcatggctgtcagtggagat

SEQ ID NO: 205803 - DNA, 75 bp, Artificial Sequence
  Synthetic
gactgcgtggtgaaacccattgatgaccgattcgcgagcgcccttcatttcctcaatggcatggcaaagatcagg

SEQ ID NO: 205804 - DNA, 75 bp, Artificial Sequence
  Synthetic
aaagatacccaggaatggaaaccatccgtgggctggagcaactggcaggaagtgccatttggctcccaccatttc

SEQ ID NO: 205805 - DNA, 75 bp, Artificial Sequence
  Synthetic
aatgagctgctgatgaaagatggacgcaccatcgtagttccatgccgttcccaagatgaactagtgggaagagca

SEQ ID NO: 205806 - DNA, 75 bp, Artificial Sequence
  Synthetic
ccaagatgaactagtgggaagagcacgggtgtcacctggtagcggatggagcctgcgagagacagcttgtctgag

SEQ ID NO: 205807 - DNA, 75 bp, Artificial Sequence
  Synthetic
caaagcctatgcccagatgtggttgctcatgtatttccaccgccgtgacctccgtctcatggccaacgccatctg

SEQ ID NO: 205808 - DNA, 75 bp, Artificial Sequence
  Synthetic
ttcagcagtgcctgtggattgggtcccgactggacgaaccacatggtccatccacggaaaaggagaatggatgac

SEQ ID NO: 205809 - DNA, 75 bp, Artificial Sequence
  Synthetic
cacagaggacatgctccaagtgtggaacagggtctggattgaggacaatgagcacatggaggacaagacacccat

SEQ ID NO: 205810 - DNA, 75 bp, Artificial Sequence
  Synthetic
cacgtcttggactgacatcccctacatcggaaagagggaggaccaatggtgtggtagtctgattggaacccgaca

SEQ ID NO: 205811 - DNA, 75 bp, Artificial Sequence
  Synthetic
gagagcaacatgggcggagaatatatatacaccaataatgcaaatccgcaacttgatcggggatgagaagtatgt

SEQ ID NO: 205812 - DNA, 75 bp, Artificial Sequence
  Synthetic
ggactgcatggtgtcccagcacaggttcgaaacaccttcgcccgtgctgttcaccggcgccatctaaacccaaaa

SEQ ID NO: 205813 - DNA, 75 bp, Artificial Sequence
  Synthetic
ttcgaaacaccttcgcccgtgctgttcaccggcgccatctaaacccaaaagaccaaaaaaggacaattgtgtcag

SEQ ID NO: 205814 - DNA, 75 bp, Artificial Sequence
  Synthetic
gccatggaaacatgccacccaaagcttgtagagggtgcagcctgcgccaagccccaggaggactgggttaccaaa

SEQ ID NO: 205815 - DNA, 75 bp, Artificial Sequence
  Synthetic
gccgttaggcccccacggcccatttcaggagacagcgcgactcctggaggaaggactagaggttagaggagaccc

SEQ ID NO: 205816 - DNA, 75 bp, Artificial Sequence
  Synthetic
gtggaacatcgctgaggcccaaaccagcccgaagctgtaggactggtggaaggactagaggttagtggagacccc

SEQ ID NO: 205817 - DNA, 75 bp, Artificial Sequence
  Synthetic
agcccgaagctgtaggactggtggaaggactagaggttagtggagacccctcagcaccaagcgcgaaacaaacag

SEQ ID NO: 205818 - DNA, 75 bp, Artificial Sequence
  Synthetic
catattgacgcctgggaaagaccgggagatcctctgctttccatcaccagccactaggcacagatcgccgcaagt

SEQ ID NO: 205819 - DNA, 75 bp, Artificial Sequence
  Synthetic
cctctgctttccatcaccagccactaggcacagatcgccgcaagtagtggctggtggtgaaaaacacatggatct

SEQ ID NO: 205820 - DNA, 75 bp, Artificial Sequence
  Synthetic
agaaattcacctgtgtgaaatttcaccaacagttttagtgaaaagaactttgtttaacacagtctgaatagtttt

SEQ ID NO: 205821 - DNA, 75 bp, Artificial Sequence
  Synthetic
ttagcagaggtactaccatgtctaaaaaaccaggaggacccgccggaaggcgggttgtcaatatgctgaaacgcc

SEQ ID NO: 205822 - DNA, 75 bp, Artificial Sequence
  Synthetic
cagccagcgtttccccaataaaagggataaagaggctaattggaaatttgactgatgggagaggaccactacgag

SEQ ID NO: 205823 - DNA, 75 bp, Artificial Sequence
  Synthetic
tggttctcgctttcatcgcatttttccgttttgcagccatcatgcccacccaaggactactccgcaggtggcgcg

SEQ ID NO: 205824 - DNA, 75 bp, Artificial Sequence
  Synthetic
tgatgaacaaaagtgaggcgcttaagcacctcacttcatttaaaaaagaaatatccaacatgctgaacatcatca

SEQ ID NO: 205825 - DNA, 75 bp, Artificial Sequence
  Synthetic
atagacggaaggccaaacgtggaaacgggagcgtgctactttggatcgcgcttgtgactggatcaatggctctgc

SEQ ID NO: 205826 - DNA, 75 bp, Artificial Sequence
  Synthetic
gcctggggacatatcaaggcaaagttttgatgtcaatcaacaagaccgacgtggctgagataatcccaatcccaa

SEQ ID NO: 205827 - DNA, 75 bp, Artificial Sequence
  Synthetic
caactaagggagacaatttgtgtaccgtccgagcgatggatgtgggatatatgtgccagaatgacataacatacg

SEQ ID NO: 205828 - DNA, 75 bp, Artificial Sequence
  Synthetic
aatgcccccgcctggaaccaggaatggatccagaggatatagattgttggtgcgatcgagaggccatatatgtac

SEQ ID NO: 205829 - DNA, 75 bp, Artificial Sequence
  Synthetic
actatggcctatgcactaagaaccatcgggagaggcgagggcgcagatctgtgaacattccaagccacggagaaa

SEQ ID NO: 205830 - DNA, 75 bp, Artificial Sequence
  Synthetic
gccaactggagaacagaggcactccgtggctggacacggccaagaccaccaaatacctgacgaaggttgagaact

SEQ ID NO: 205831 - DNA, 75 bp, Artificial Sequence
  Synthetic
ggatgataaggaatcctgggtacgccattgttgctgtggcagccgcttggatgcttggaagcaataccagccaga

SEQ ID NO: 205832 - DNA, 75 bp, Artificial Sequence
  Synthetic
aggtcatcttcacaattatgctacttctgatagccccagcctacagcatcaactgcttgggtgtgaccaaccgcg

SEQ ID NO: 205833 - DNA, 75 bp, Artificial Sequence
  Synthetic
atttcgtggaaggaatgtcaggtggcacttgggtggacatcgtgcttgagggagacggctgtgtgactatcatgg

SEQ ID NO: 205834 - DNA, 75 bp, Artificial Sequence
  Synthetic
ctaaagacaaacctaccctagacatcaggcttttgaaaatggaagccaaggacctagcgaccgttaggtcatact

SEQ ID NO: 205835 - DNA, 75 bp, Artificial Sequence
  Synthetic
gctaccatgccactgtgaccagcgtttccagtgaagccagatgccccacaatgggggaagcccacaatccaaaag

SEQ ID NO: 205836 - DNA, 75 bp, Artificial Sequence
  Synthetic
cacttgacagcaactatctatgtaaatcaacgtatgttgatcgtggatggggcaatggatgtggcctatttggga

SEQ ID NO: 205837 - DNA, 75 bp, Artificial Sequence
  Synthetic
aaggaagcctgcagacctgcgttaaatttggatgcacgcagaaagctatgggaatgaccatccagcgtgaaaatc

SEQ ID NO: 205838 - DNA, 75 bp, Artificial Sequence
  Synthetic
ttgactacgaactggccatctacgtgcatggacctaccagcgtggcagctcatgggaactacacaacacaattgg

SEQ ID NO: 205839 - DNA, 75 bp, Artificial Sequence
  Synthetic
gagccaagcatgccgcaaagttttcaatcacccccagcagtccgtcattcacagccaatttaggagaatacggtg

SEQ ID NO: 205840 - DNA, 75 bp, Artificial Sequence
  Synthetic
aggcaacagttgattgcgaaccccgagctgctcttgacattgacaactattatgtcatgtctatgaacaacaaac

SEQ ID NO: 205841 - DNA, 75 bp, Artificial Sequence
  Synthetic
attggcttgtcaaccgcgactggtttcatgacttggacttgccttggacgggacccgcaacagatgtttggaagt

SEQ ID NO: 205842 - DNA, 75 bp, Artificial Sequence
  Synthetic
accgtgaaagcctggtggagtttgaggaagcacacgttacaaggcaaaccgttgtcgcgctagccgctcaggagg

SEQ ID NO: 205843 - DNA, 75 bp, Artificial Sequence
  Synthetic
gagaacttcatattgttctagccggagctattccggttacagtggctggaacgacgttaacactcacgtcagggc

SEQ ID NO: 205844 - DNA, 75 bp, Artificial Sequence
  Synthetic
atctgaaatgccgaatgaaactggacaagctcaaaatcaaagggtcaacatacctgatgtgcaaggacaaatttg

SEQ ID NO: 205845 - DNA, 75 bp, Artificial Sequence
  Synthetic
cttttgccaagaacccagttgacacaggacacggcacaatcgtgacggaggtacagtacgctggttctgatgggc

SEQ ID NO: 205846 - DNA, 75 bp, Artificial Sequence
  Synthetic
catgcaggattccaatcaccatgaccgagaacctacatgatctcactcccatcggacgattggtgacggtcaatc

SEQ ID NO: 205847 - DNA, 75 bp, Artificial Sequence
  Synthetic
catttgttccctcatccgagacggcacaaaaaattttgattgaactcgagcccccctttgggacatccttcatac

SEQ ID NO: 205848 - DNA, 75 bp, Artificial Sequence
  Synthetic
tggtgggtacaggtcccaaccaggtgaaataccagtggcataagtctggtagtgtgatcgggagcgcgttcaaaa

SEQ ID NO: 205849 - DNA, 75 bp, Artificial Sequence
  Synthetic
ccaccatcaaaggtgcgcaacgcatggccgtgctaggtgaaactgcatgggacttcggatctgttggtggagtct

SEQ ID NO: 205850 - DNA, 75 bp, Artificial Sequence
  Synthetic
ttaactccataggcaagggaattcatggactcttcggaggagcgtttagaaccctctttggagggatgtcctggg

SEQ ID NO: 205851 - DNA, 75 bp, Artificial Sequence
  Synthetic
ttactcaagccctcatgggagcgctgctcctatggctaggggtgagctcccgagaaagaaccgtctcgataaccc

SEQ ID NO: 205852 - DNA, 75 bp, Artificial Sequence
  Synthetic
tcttggctactggaggaattcttctcttcttggccatgaacgtccatgccgacacaggatgcgcgattgacatta

SEQ ID NO: 205853 - DNA, 75 bp, Artificial Sequence
  Synthetic
cgcggcgggagttgaaatgtgggagtggaatattcatccataacgatgttgaaacatggcgtgacaactacaagt

SEQ ID NO: 205854 - DNA, 75 bp, Artificial Sequence
  Synthetic
accatccatcaactcccaagaactttgccaagattattcacaaggcttacaaagaaggcatttgtggggtgagat

SEQ ID NO: 205855 - DNA, 75 bp, Artificial Sequence
  Synthetic
cagccagtaggctggaacacgagatgtggaagcacatcgctcctgagctgaatgccatcttggaagacaacgagg

SEQ ID NO: 205856 - DNA, 75 bp, Artificial Sequence
  Synthetic
tggatttgagtgtcgttgtggaggaacacaagggcatatacaaaaaggccccactgcgcctggaaaataccagcg

SEQ ID NO: 205857 - DNA, 75 bp, Artificial Sequence
  Synthetic
atgagatgcacttcgggtggaaaaattgggggaaaagctttctcttcaaaacacaaatggcaaacagcacatttg

SEQ ID NO: 205858 - DNA, 75 bp, Artificial Sequence
  Synthetic
tggttgacgggccagagacaaaggaatgtcccacagaacgaagagcatggaactcacttgaaatagaagactttg

SEQ ID NO: 205859 - DNA, 75 bp, Artificial Sequence
  Synthetic
gagtggggatcatgtcaacaaaggtgttcctaaaggtgaacggagataagaccgaagtttgtgactcaatggtca

SEQ ID NO: 205860 - DNA, 75 bp, Artificial Sequence
  Synthetic
tgggaaccgcaatcaaaggaaaccgggcggttcacagtgacttgggctactggattgaaagcggaaagaatacaa

SEQ ID NO: 205861 - DNA, 75 bp, Artificial Sequence
  Synthetic
gctggcgcctagaacgtgcagtcttgggggaagtccgctcctgcacctggccggagagtcacaccctgtggaacg

SEQ ID NO: 205862 - DNA, 75 bp, Artificial Sequence
  Synthetic
agggagttgaagacagtgatctgataattccgccaaccttgggagggcctcgcacccaccacaacaaaagagagg

SEQ ID NO: 205863 - DNA, 75 bp, Artificial Sequence
  Synthetic
gatacaaaactcagctcaaggggccctggaatgaggaggggcccatcatcatcgagtttggagagtgcccaggta

SEQ ID NO: 205864 - DNA, 75 bp, Artificial Sequence
  Synthetic
ctaaagtcacgcaggaggagagctgcaggaacagagcagcctcagcaagaaccacgacagcaagtggcaaggtca

SEQ ID NO: 205865 - DNA, 75 bp, Artificial Sequence
  Synthetic
ttagggactggtgctgcaaaaattgcactatgccccctctcagattcaccacaaaaaacggctgctggtatggga

SEQ ID NO: 205866 - DNA, 75 bp, Artificial Sequence
  Synthetic
tggagatcaggcctaaacacgaaagcgaagaaacactcataaaatcgaaagtgacagctgggaccggaaacgaca

SEQ ID NO: 205867 - DNA, 75 bp, Artificial Sequence
  Synthetic
tctgcaggttccagctggggctgttgatggctttcgtcttcacgcaagaagtcctgcgcaagcgatggacggcgc

SEQ ID NO: 205868 - DNA, 75 bp, Artificial Sequence
  Synthetic
gtttggcactacccacggcagctctgttgctggcctgttttgtgctgggggcttttacctactcggacatgatac

SEQ ID NO: 205869 - DNA, 75 bp, Artificial Sequence
  Synthetic
ggtactttgtcttagtgggttgtgcttttgccgaatccaacagtgggggagatgtcatacatctcgcgctgatcg

SEQ ID NO: 205870 - DNA, 75 bp, Artificial Sequence
  Synthetic
cagtattcaacattcagccagcagccttggtatccacattcttccgcaaccgctggaccaaccgggaaaacctcc

SEQ ID NO: 205871 - DNA, 75 bp, Artificial Sequence
  Synthetic
tgctagtgatagccgcagccatggctcagatggcttggagcgatgtgggcattgagattatgcccataatgaacg

SEQ ID NO: 205872 - DNA, 75 bp, Artificial Sequence
  Synthetic
caatggcgcttgcttggatgatcctcaaggcagtctctatcgggacggtttcaacaatagccatgcccatcttgt

SEQ ID NO: 205873 - DNA, 75 bp, Artificial Sequence
  Synthetic
caggactggcgcctccaatggaatggtttggactggacgtcctgcgctgcctcctgctcatagtgggagtcgccg

SEQ ID NO: 205874 - DNA, 75 bp, Artificial Sequence
  Synthetic
ccctcataaaggagaggaaggagaacttggccaagaagaaaggagccctactcatctcagccggcctagcactca

SEQ ID NO: 205875 - DNA, 75 bp, Artificial Sequence
  Synthetic
ctggagctttctctccactggttctccaaggggctcttatgctctcagaatgtgccacgaagcgtggatggccag

SEQ ID NO: 205876 - DNA, 75 bp, Artificial Sequence
  Synthetic
cgagtgaagtgctgacagccataggcatgacaatcgctctggctggaagcgtggcccgcctcgacagcggaacca

SEQ ID NO: 205877 - DNA, 75 bp, Artificial Sequence
  Synthetic
tggccattcctctcgctaccacctctatcctttttgtgtcatacgtgttatcaggcaaatccacggatatgtgga

SEQ ID NO: 205878 - DNA, 75 bp, Artificial Sequence
  Synthetic
tagagaggtgtgctgatgtgacctgggaggaagaagcggagatcacaggaaccagcccgcgcctggatgttgaac

SEQ ID NO: 205879 - DNA, 75 bp, Artificial Sequence
  Synthetic
ttgatgacaatggtgacttcaagatgatcaacgatccgggtgtccccatgtggatgtgggcgagccgaatgggac

SEQ ID NO: 205880 - DNA, 75 bp, Artificial Sequence
  Synthetic
tcatgtgcatggcagcgtacaacccagtgctgatccctgtttccgtggcaggatactggatgacaagaaagatcc

SEQ ID NO: 205881 - DNA, 75 bp, Artificial Sequence
  Synthetic
ataagaggggtggtgttctgtgggaccttccagcccccaagcagatgggacgctcggatatgaaaccaggggtct

SEQ ID NO: 205882 - DNA, 75 bp, Artificial Sequence
  Synthetic
accgtgtgatgacctccggagtactcgggagctaccagtctggagtgggagtcatgtatgacggcgtcttccaca

SEQ ID NO: 205883 - DNA, 75 bp, Artificial Sequence
  Synthetic
caatgtggcatgtcacacaaggggcggccctccgcaatggggaaggacgactgaatcccacctggggcagcgtgc

SEQ ID NO: 205884 - DNA, 75 bp, Artificial Sequence
  Synthetic
gagacgatctcatcacctacggtggaaagtggaaattgtcggcaacatgggatggaacagaggaagtccagctga

SEQ ID NO: 205885 - DNA, 75 bp, Artificial Sequence
  Synthetic
tagcagctgaacccggaaagccagtgaagaacttccagacaaggcctggggtcttcaagaccccagccggtgagg

SEQ ID NO: 205886 - DNA, 75 bp, Artificial Sequence
  Synthetic
tgggagccatcacccttgactttccgaaaggaacatccgggtcgcccatcgtgaataaggccggagcggtcattg

SEQ ID NO: 205887 - DNA, 75 bp, Artificial Sequence
  Synthetic
ggctgtacggcaatggactggtcctctcccacggagcatatgtaagtgccatctcccaaggagaacgtcaagaag

SEQ ID NO: 205888 - DNA, 75 bp, Artificial Sequence
  Synthetic
aggaggctcctgaagccttcacgccagaaatgcttaggaaaagacagctaacaattcttgacctccaccccggag

SEQ ID NO: 205889 - DNA, 75 bp, Artificial Sequence
  Synthetic
cagggaagactaggcgagtgataccccagattgttagagaggcagtgaaacaaaggttgcgcacagttatcctgg

SEQ ID NO: 205890 - DNA, 75 bp, Artificial Sequence
  Synthetic
ccccgagtcgagtggttgcggctgagatagctgaagcactgcgtggactcccagtgaggttccaaacaagcgccg

SEQ ID NO: 205891 - DNA, 75 bp, Artificial Sequence
  Synthetic
tcaaagcagaacactccggaactgaaattgttgatgtcatgtgccatgccacgctaacgcagcggctcatgaccc

SEQ ID NO: 205892 - DNA, 75 bp, Artificial Sequence
  Synthetic
caatgcgggttcccaactacaatgtgttcgtcatggatgaggcccactttaccgacccagcgagcattgcagcgc

SEQ ID NO: 205893 - DNA, 75 bp, Artificial Sequence
  Synthetic
gaggatacatctcaaccaaagttgaaagtggtgaggcggcagcgatctttatgacagccacccctcctggaacca

SEQ ID NO: 205894 - DNA, 75 bp, Artificial Sequence
  Synthetic
tagatccattcccagactccaattctcccatcatagatcaggaagctgagatcccagacagggcttggaatagtg

SEQ ID NO: 205895 - DNA, 75 bp, Artificial Sequence
  Synthetic
gatttgagtggatcactgactacacagggaaaacagtgtggtttgttcccagtgtgaggagtggaaacgaaatcg

SEQ ID NO: 205896 - DNA, 75 bp, Artificial Sequence
  Synthetic
cgatgtgcctcaccaaagccggaaagaaggtcatccagctaaacaggaaaagttatgaaacagaataccagaaat

SEQ ID NO: 205897 - DNA, 75 bp, Artificial Sequence
  Synthetic
gcaagggaaatgactgggattacgtggtgacgacagacatttctgaaatgggggccaacttcggagcccacagag

SEQ ID NO: 205898 - DNA, 75 bp, Artificial Sequence
  Synthetic
tcattgacagcaggaagtgcgtgaaaccagtcataattaatgatggagaaggcagagtgcaattgaatgggccac

SEQ ID NO: 205899 - DNA, 75 bp, Artificial Sequence
  Synthetic
tccccatcacagcatccagcgcagcccaacggcgagggagagtggggagagacccaacgcagtcaggtgatgaat

SEQ ID NO: 205900 - DNA, 75 bp, Artificial Sequence
  Synthetic
actactacggtgggccaatcaccaatgacgacacaggccacgcccactggatagaagccaagatgctactggaca

SEQ ID NO: 205901 - DNA, 75 bp, Artificial Sequence
  Synthetic
acatccaattacaaaatggactggtggcacagctctacaagcccgagcgtgacaaggtgttcgccactgatgggg

SEQ ID NO: 205902 - DNA, 75 bp, Artificial Sequence
  Synthetic
aataccgcctgaggggggaacagaaaaagcactttgtggaactcatgaggacaggtgaacttccagtgtggcttt

SEQ ID NO: 205903 - DNA, 75 bp, Artificial Sequence
  Synthetic
cgtacaaggtagctgaagccggaatcaattacacagaccgcagatggtgctttgatggaccccacaacaacacaa

SEQ ID NO: 205904 - DNA, 75 bp, Artificial Sequence
  Synthetic
tcctggaagacaatactgaagtggagatatggaccagacaaggagagaggaaggtgctgcggcccaggtggtcag

SEQ ID NO: 205905 - DNA, 75 bp, Artificial Sequence
  Synthetic
acgcgagagtgtactcggacaaccaggcgcttagagcattcaaagaatttgcggcggggaagcgctccgcgggct

SEQ ID NO: 205906 - DNA, 75 bp, Artificial Sequence
  Synthetic
caatgatggacgtcatggcccgtatgccagactatttctggacaaaaaccatgaacgcagctgacaatctctacg

SEQ ID NO: 205907 - DNA, 75 bp, Artificial Sequence
  Synthetic
tccttgccaccacggaaaagggtggaagagcacatcgggcagccctggaggaacttccagacacactggaaacgg

SEQ ID NO: 205908 - DNA, 75 bp, Artificial Sequence
  Synthetic
ttctgttgatcgccatgatgagcttagcttcttgcgggatgctggctttgatgatgcaaagaaaagggattggga

SEQ ID NO: 205909 - DNA, 75 bp, Artificial Sequence
  Synthetic
aaaccggaatgggaacggcagtcttgaccgccgtgacaattctgctgtggatggctgacgtgcctgctcccaaga

SEQ ID NO: 205910 - DNA, 75 bp, Artificial Sequence
  Synthetic
ttgccggagttctgctgatctccttcctgctcatgattgttttgattccagaaccggaaaaacaacgcagccaaa

SEQ ID NO: 205911 - DNA, 75 bp, Artificial Sequence
  Synthetic
ctgacaaccatctggccgtttttctcatctgcgcactgctcttggtcagtgctgtctcggcaaatgaaatgggat

SEQ ID NO: 205912 - DNA, 75 bp, Artificial Sequence
  Synthetic
ggcttgacacgacgaagagggacttggggaagctattttcaggaccgagcgcagtgacaaccagccgttgggaac

SEQ ID NO: 205913 - DNA, 75 bp, Artificial Sequence
  Synthetic
ctctcaagctggccttggccctgaaaccagccacggcgtgggcgggctatgctggaatgaccatgctcttaacgc

SEQ ID NO: 205914 - DNA, 75 bp, Artificial Sequence
  Synthetic
ccctgttcagacacctgatcacaacccagtacatcagcttttcactcacggccatcacatcccaggcatcagcct

SEQ ID NO: 205915 - DNA, 75 bp, Artificial Sequence
  Synthetic
tgtttggcctgaattctggatacccctttgtgggagtggacctgtcagtcgtgttcttacttgtgggatgctacg

SEQ ID NO: 205916 - DNA, 75 bp, Artificial Sequence
  Synthetic
gccaatacaacttgccaacaacaatggccacaatcggactactggtggggcactacgctttcatgatccccggtt

SEQ ID NO: 205917 - DNA, 75 bp, Artificial Sequence
  Synthetic
ggcaagcagaagccatgcgcgcagctcaaaggaggacagccgccggcgtcatgaagaatgcagtcgtggacggca

SEQ ID NO: 205918 - DNA, 75 bp, Artificial Sequence
  Synthetic
tcgtggccacagacatccccgagatggacacagcgactcctatagtggagaagaagatgggtcaagtcatgttac

SEQ ID NO: 205919 - DNA, 75 bp, Artificial Sequence
  Synthetic
tgatcataagtgccctggccatcttgctgaatccagacacaatgacagtggtcgagggaggagtgctgataacgg

SEQ ID NO: 205920 - DNA, 75 bp, Artificial Sequence
  Synthetic
cagctttagcaacccttcttgagggaaacgccaacacggtctggaactcaaccgttgcggttggagtgtgccacc

SEQ ID NO: 205921 - DNA, 75 bp, Artificial Sequence
  Synthetic
tcatgcgaggaggttgggcggcagggccttcaataggatggaccatcattaggaacctggaagctccgaaagtga

SEQ ID NO: 205922 - DNA, 75 bp, Artificial Sequence
  Synthetic
agaggggagggatagcagcccctaccctgggagagatatggaaaagcagactcaatcagctcaccagggaacagt

SEQ ID NO: 205923 - DNA, 75 bp, Artificial Sequence
  Synthetic
tcatggaatacaggaaggatggcatcattgaagttgacaggactgcggcccgccgagcacggcgtgaaggaaaca

SEQ ID NO: 205924 - DNA, 75 bp, Artificial Sequence
  Synthetic
gaacaggaggacacccagtgtccagaggaacagcgaagttgcgatggcttgtggaacggggttttgctaagccct

SEQ ID NO: 205925 - DNA, 75 bp, Artificial Sequence
  Synthetic
tggggaaagtggtcgacctgggctgtggacgcggaggatggagttactactgtgccaccctgcgccatgtgcagg

SEQ ID NO: 205926 - DNA, 75 bp, Artificial Sequence
  Synthetic
aagtaaggggatacacaaaaggaggcccgggccacgaagaacccatgctcatgcagagctacgggtggaacattg

SEQ ID NO: 205927 - DNA, 75 bp, Artificial Sequence
  Synthetic
tctccatgaagagtggaatagatgttttctaccggccaactgaggcctgtgacacagtgctctgtgacataggcg

SEQ ID NO: 205928 - DNA, 75 bp, Artificial Sequence
  Synthetic
agtcatcccccagtcctggtgttgaagaggctcggaccctacgggtgctcgagatgattgaaccctggcttcgaa

SEQ ID NO: 205929 - DNA, 75 bp, Artificial Sequence
  Synthetic
ctgccaaccagtattgcgtgaaagtgctgtgcccctacacccctaaagtgatcgaacgcctggagaaactccagc

SEQ ID NO: 205930 - DNA, 75 bp, Artificial Sequence
  Synthetic
gcaaatacggggggggactagtcagagtgcctctttccagaaactccaatcatgagatgtactgggtcagtgaag

SEQ ID NO: 205931 - DNA, 75 bp, Artificial Sequence
  Synthetic
catcatcaaacttgattaatgcggtcaatgccacaagccaagtgctcctgcagcgcttggagaaggaccaccgaa

SEQ ID NO: 205932 - DNA, 75 bp, Artificial Sequence
  Synthetic
agggaccaagatatgaggaggacgttgacctggggagcggcaccagatcggtggcccggaggtcccctttcatgg

SEQ ID NO: 205933 - DNA, 75 bp, Artificial Sequence
  Synthetic
acaccaggaagatccatcaccggatcgaaaggctgaagagtgaattctctacaacatggcactatgattgtgagc

SEQ ID NO: 205934 - DNA, 75 bp, Artificial Sequence
  Synthetic
atccataccgtacctggaactatcatgggagttatgaggtaaaacccaccggctcagctagctccatggttaatg

SEQ ID NO: 205935 - DNA, 75 bp, Artificial Sequence
  Synthetic
gggttgtcaagttaatgtcaaagccctgggatagcatccaaagcgtcctgactatggccatgactgacaccacac

SEQ ID NO: 205936 - DNA, 75 bp, Artificial Sequence
  Synthetic
cgtttgggcaacagcgggtttttaaggaaaaggtcgacaccaaggccccggaacccgccccaggcgtgaaagcgg

SEQ ID NO: 205937 - DNA, 75 bp, Artificial Sequence
  Synthetic
tcttagacttgaccacagactggctatgggcggtcttgtgtaggagaaagaaacccaggatgtgcacaaaggaag

SEQ ID NO: 205938 - DNA, 75 bp, Artificial Sequence
  Synthetic
agttcatagccaaggtgaacagccacgctgccctgggggcgatctttgaagagcagaaccagtgggcttcggcga

SEQ ID NO: 205939 - DNA, 75 bp, Artificial Sequence
  Synthetic
gagaagcggttgaagacccagggttttggaattttgttgacaaggaacggcaagcacatctggaaggccggtgtg

SEQ ID NO: 205940 - DNA, 75 bp, Artificial Sequence
  Synthetic
agacatgcatttacaacatgatgggaaagcgagagaagaagctaggagagtttgggaaagctaagggcagccgcg

SEQ ID NO: 205941 - DNA, 75 bp, Artificial Sequence
  Synthetic
ccatttggtatatgtggctgggggcaaggtttcttgagttcgaagcgctcggatttctcaatgaagaccactgga

SEQ ID NO: 205942 - DNA, 75 bp, Artificial Sequence
  Synthetic
tgagtagagagaattcatatgggggagtagaaggaaagggactccagaagctgggatacatcctccaagagattt

SEQ ID NO: 205943 - DNA, 75 bp, Artificial Sequence
  Synthetic
ccaggaaagaaggtggacacatgtttgcggatgacactgccggctgggatacaagagtcacactaacggacctgg

SEQ ID NO: 205944 - DNA, 75 bp, Artificial Sequence
  Synthetic
aaaatgaggccaagataacaagatggatggaaccggagcatcggaaactggcagaagccatgattgagctcacat

SEQ ID NO: 205945 - DNA, 75 bp, Artificial Sequence
  Synthetic
acaagaacaaagtggtcaaagtcacgaggccaggaaaagaggggaagacggtgatggacatcatttcacgaaacg

SEQ ID NO: 205946 - DNA, 75 bp, Artificial Sequence
  Synthetic
accagagagggagtgggcaggttgtgacgtatgccctaaacacctacaccaatctggctgttcaactcatcaggt

SEQ ID NO: 205947 - DNA, 75 bp, Artificial Sequence
  Synthetic
gcatggagggtgaaggccttctggaggaggaagagaccatgcggatctctgatgccaaacggagggcagtgcaag

SEQ ID NO: 205948 - DNA, 75 bp, Artificial Sequence
  Synthetic
cctggcttgacaccaatgggactgaaaggctcactccgatggcagtaagtggggatgattgcgtggtcaagccca

SEQ ID NO: 205949 - DNA, 75 bp, Artificial Sequence
  Synthetic
ttgacaacagattcgcaactgctctccattttctgaatggaatgtcaaaggtgaggaaagatatacaggaatgga

SEQ ID NO: 205950 - DNA, 75 bp, Artificial Sequence
  Synthetic
agccttccactggctggaccaattggcaggaggtcccattctgctcccatcattttaatgagctggtcatgcgtg

SEQ ID NO: 205951 - DNA, 75 bp, Artificial Sequence
  Synthetic
atggcaggaaaatcgtcgtgccctgtagggcccaagatgaactaattggaagagcccgggtgtccccagggagtg

SEQ ID NO: 205952 - DNA, 75 bp, Artificial Sequence
  Synthetic
gatggagcctgcgagaaactgcctgtctgggaaaagcttacgctcagatgtggctgctcatgtacttccacagac

SEQ ID NO: 205953 - DNA, 75 bp, Artificial Sequence
  Synthetic
gggatctacgcttaatggccaacgccatttgctcggccgtgcccattgactgggttccgactggaagaacaacct

SEQ ID NO: 205954 - DNA, 75 bp, Artificial Sequence
  Synthetic
ggtcgatacatggaaagggtgagtggatgacaaccgaggacatgctcgcagtgtggaacagagtgtggatctttg

SEQ ID NO: 205955 - DNA, 75 bp, Artificial Sequence
  Synthetic
agaatgaacacatggaagacaaaacacctgtatacagctggactgacgtcccctacattgggaagcgcgaagacc

SEQ ID NO: 205956 - DNA, 75 bp, Artificial Sequence
  Synthetic
agtggtgtggcagcttgatagggcaccgttccagggccacctgggccgagaacatctacacgcccatcatgcagg

SEQ ID NO: 205957 - DNA, 75 bp, Artificial Sequence
  Synthetic
tccgcaatctcataggagctgagagatatgtggattatatgccagcacagacaaggttcgcacatgaagcagagc

SEQ ID NO: 205958 - DNA, 75 bp, Artificial Sequence
  Synthetic
ttcaaggaggagttctgtaagactgaacagcccagagaaatgcgaaacgaaatgtaaataatgtaaataaaatag

SEQ ID NO: 205959 - DNA, 75 bp, Artificial Sequence
  Synthetic
caagaagaagtcaggccgtccttggacgccacccaaagcatgggagggtgctgcctgcgacaagccccaggagga

SEQ ID NO: 205960 - DNA, 75 bp, Artificial Sequence
  Synthetic
ctgggttttcaaagccatgagcccccacggcccaaccctgggaaagcgcgacccaggggttaggactagaggtta

SEQ ID NO: 205961 - DNA, 75 bp, Artificial Sequence
  Synthetic
gaggagacccagtggaaacatcagccaaggcccagaccattccaaagctgtaggaatggtggaaggactagaggt

SEQ ID NO: 205962 - DNA, 75 bp, Artificial Sequence
  Synthetic
tagaggagaccccttggcacacaagcgcaaagacaaacagcatattgacacctgggaaagaccgggagaccctct

SEQ ID NO: 205963 - DNA, 75 bp, Artificial Sequence
  Synthetic
ccctctgctctgcaacaccagccactaggcacagatcgccgaaatctgtggctggtgctgcaaaacacaggatct

SEQ ID NO: 205964 - DNA, 75 bp, Artificial Sequence
  Synthetic
agaaattcacctgtgtgaaatttcactaaccgttttagtggagagaacttttgtttaacacagtctgaatagttt

SEQ ID NO: 205965 - DNA, 75 bp, Artificial Sequence
  Synthetic
tttagcaagggatttcccatgtctaaaaaaccaggaaagtccgctgcaaagcggactgtcaatatgctaaaacgc

SEQ ID NO: 205966 - DNA, 75 bp, Artificial Sequence
  Synthetic
ttggctagcgtgtcccctctcaagggggcgaagaagctactcggagaattgctaagtgggaaaggagcaataaga

SEQ ID NO: 205967 - DNA, 75 bp, Artificial Sequence
  Synthetic
ttgatcctagccctcatggcttttttccgtttcgcagcaatcaagcccactttgggcttgaaaaaacgatggcgt

SEQ ID NO: 205968 - DNA, 75 bp, Artificial Sequence
  Synthetic
aacaaacgcaaggaaaagaagaagagtttctcaacggccctgctctggatcaccatgatcacagtggtcgctggc

SEQ ID NO: 205969 - DNA, 75 bp, Artificial Sequence
  Synthetic
ctcaagatttcatcacacagaggccgacctctgctgatggtgaacaaaactgatgtgtcggatgccatcccagta

SEQ ID NO: 205970 - DNA, 75 bp, Artificial Sequence
  Synthetic
ccctcagtgaaaggaaccaacatgtgcacgattagggctttggacgtaggctacacgtgcgcttatgacacaact

SEQ ID NO: 205971 - DNA, 75 bp, Artificial Sequence
  Synthetic
tatgagtgccctcacctggaagtgaccatggacccggaggacatagattgttggtgcacacttgaatccgtctat

SEQ ID NO: 205972 - DNA, 75 bp, Artificial Sequence
  Synthetic
gttaattacggactctgcaagcaaaaccaccatgttagaaggggcagacgtgcgatcaacattcctcaccacgga

SEQ ID NO: 205973 - DNA, 75 bp, Artificial Sequence
  Synthetic
gagagtcatctcgaaaaccgggcgactccatggatggacaccaccaagacaactaaatatctaaccaaagttgag

SEQ ID NO: 205974 - DNA, 75 bp, Artificial Sequence
  Synthetic
aattgggtcatacgcaatcctggatacgcactagtagcattggccacagcctggatgctaggtagcaacaccccg

SEQ ID NO: 205975 - DNA, 75 bp, Artificial Sequence
  Synthetic
cagagggtggtcttcatgatcatgatgatgctcattgctccagcgtacagcttgaactgcttgggaatctcgaac

SEQ ID NO: 205976 - DNA, 75 bp, Artificial Sequence
  Synthetic
cgagacttcgttgagggcttgtccggaggcacatgggtggacattgtgctagaaggagggagctgtgtgacagtc

SEQ ID NO: 205977 - DNA, 75 bp, Artificial Sequence
  Synthetic
atggctaaggacaaacccacgctagacatcaagctgattagaatggaagccaaggatctggccacggttcgtagc

SEQ ID NO: 205978 - DNA, 75 bp, Artificial Sequence
  Synthetic
tactgctaccaggccactgtcactgactcgtcaactgaggccagatgccctaccatgggtgaagctcacaactcc

SEQ ID NO: 205979 - DNA, 75 bp, Artificial Sequence
  Synthetic
aaatctcttgacgctagctacgtctgcaaatcatcatacgtggatcgcggatggggcaatggatgtgggctcttt

SEQ ID NO: 205980 - DNA, 75 bp, Artificial Sequence
  Synthetic
ggaaaagggagtatccaaacttgtgtgaagttctcatgtcctggaaaggctactgggaaaagtatccagagggag

SEQ ID NO: 205981 - DNA, 75 bp, Artificial Sequence
  Synthetic
aacctgaactatgacgttgcagtgtacgtgcacggaccaacaagtgcggccgcacatggcaactacaccgcccag

SEQ ID NO: 205982 - DNA, 75 bp, Artificial Sequence
  Synthetic
ttgacagggaagtacgccgccaaattctcgattactccaagtgcaccaacatacaccgcaaacctgggggaatat

SEQ ID NO: 205983 - DNA, 75 bp, Artificial Sequence
  Synthetic
ggagaagcaacaatggagtgtgaaccacgggccgccctggacattgacaactactatgtcatgtcactcaacaac

SEQ ID NO: 205984 - DNA, 75 bp, Artificial Sequence
  Synthetic
aaacattggcttgtcaaccgtgactggtttcatgatctggatctaccctggaccggacccgctactgagtcgtgg

SEQ ID NO: 205985 - DNA, 75 bp, Artificial Sequence
  Synthetic
aagaaccgtgagagcctcatcgagtttgaggagccccatgctactcgacaaacagtagtcgccttgggtaaccaa

SEQ ID NO: 205986 - DNA, 75 bp, Artificial Sequence
  Synthetic
gagggtgctctgcacacggctttggcaggggccatacccgtggaagtctcaagcacgactctcactttgaactct

SEQ ID NO: 205987 - DNA, 75 bp, Artificial Sequence
  Synthetic
ggacatctcaagtgcaggttgaagttggacaagctcaagattaaagggacaacctatgctatgtgcaaagggact

SEQ ID NO: 205988 - DNA, 75 bp, Artificial Sequence
  Synthetic
ttcgcgtttgcccaaaccccagtggacacaggccatggcaccatcgtggctgaactgacctacacagggacggac

SEQ ID NO: 205989 - DNA, 75 bp, Artificial Sequence
  Synthetic
ggaccgtgcaagatccccatctccatgactgcagacctgcgggacatgactccaatcggaaggcttgttacagtc

SEQ ID NO: 205990 - DNA, 75 bp, Artificial Sequence
  Synthetic
aatccaataattccaagctcggccaactcccaaaagattctggttgaacttgagcccccctttgggagttcgttc

SEQ ID NO: 205991 - DNA, 75 bp, Artificial Sequence
  Synthetic
atccttgtcggccaagaaaacagccagatcaagtaccaatggcacaagactggcagcacaattgggaatgccctg

SEQ ID NO: 205992 - DNA, 75 bp, Artificial Sequence
  Synthetic
aaaacgacttggaagggagctcaaaggtttgctgtcctcggagatacagcttgggattttggttctgtgggtgga

SEQ ID NO: 205993 - DNA, 75 bp, Artificial Sequence
  Synthetic
attttcaattccattgggaagaccatccatggagtttttggtaccgccttcaggtcattgttcggaggcatgtcg

SEQ ID NO: 205994 - DNA, 75 bp, Artificial Sequence
  Synthetic
tgggtaacacaagctctcatgggagctctcctactctggctcggcatcagtgcccgtgagaggacggtgtctttg

SEQ ID NO: 205995 - DNA, 75 bp, Artificial Sequence
  Synthetic
ataatgctgagtgtggggggcatcctccttttcttggctgtcaatgtgcatgctgacaccggctgtgccattgat

SEQ ID NO: 205996 - DNA, 75 bp, Artificial Sequence
  Synthetic
atggcacgtcgcgagctgaaatgtggaagtggcatcttcatccacaatgatgttgagacatggaggaacaattac

SEQ ID NO: 205997 - DNA, 75 bp, Artificial Sequence
  Synthetic
aaataccacccactcacgccgcgcggctttgccaaggtcattcagatgtcaaaggacaaaggtgtctgcggcata

SEQ ID NO: 205998 - DNA, 75 bp, Artificial Sequence
  Synthetic
agatcagtgggcaggcttgagcacgagatgtgggaagccattgcacctgagttgaacgcaatctttgaggacaat

SEQ ID NO: 205999 - DNA, 75 bp, Artificial Sequence
  Synthetic
ggagtggacctcagcgttgtcgtgaaaggccagacagggatctacaaacgtgcacccaaacgcctcactgagacg

SEQ ID NO: 206000 - DNA, 75 bp, Artificial Sequence
  Synthetic
aaagatgaaatgagctttggatggaagaattggggaaagagctttatcttttcaactgagacagccaactccaca

SEQ ID NO: 206001 - DNA, 75 bp, Artificial Sequence
  Synthetic
ttcattgttgatggaccagaaagcaaagagtgcccgacatcagaccgggcttggaattccctagaattggaggat

SEQ ID NO: 206002 - DNA, 75 bp, Artificial Sequence
  Synthetic
tttggttttggcatcatctcaaccaagattttcctaaaggtcaatgagcagcgaggaaactcatgcgactcagcg

SEQ ID NO: 206003 - DNA, 75 bp, Artificial Sequence
  Synthetic
gtgatcggaacagctgtcaagggcaatgaagccgtccatagtgacctgggatactggattgagagcaagaagaat

SEQ ID NO: 206004 - DNA, 75 bp, Artificial Sequence
  Synthetic
gaatcctggcaactggagagagcagtccttggggaagtcaagtcgtgcacatggccggaaagccacacattgtgg

SEQ ID NO: 206005 - DNA, 75 bp, Artificial Sequence
  Synthetic
ggcgatggagttgaggagagtgacctgattattccaatcacgctggcaggaccaaaaagccaccacaacatgcgc

SEQ ID NO: 206006 - DNA, 75 bp, Artificial Sequence
  Synthetic
ccggggtacaagacccaaaccaaagggccctggcatgaggagacacctctcgtcatcgagtttgctgagtgtccg

SEQ ID NO: 206007 - DNA, 75 bp, Artificial Sequence
  Synthetic
gggaccacagtgacccaggaagagagttgtggcggcaggggaccatcaatccggactacaacagcaagtggaagg

SEQ ID NO: 206008 - DNA, 75 bp, Artificial Sequence
  Synthetic
accattcgtgattggtgttgcaagaattgcaccctccctccgctccgattcatggccggggacaactgctggtat

SEQ ID NO: 206009 - DNA, 75 bp, Artificial Sequence
  Synthetic
ggcatggaagtcagacccaagcgcgaaaatgaggaaaccctgatcaagtcaaaagtctcagcggggaatggccag

SEQ ID NO: 206010 - DNA, 75 bp, Artificial Sequence
  Synthetic
accattgagccctttcaacttgggattctaatggcatttgtgttcactcaagaagtcctgaggaagaggtggacg

SEQ ID NO: 206011 - DNA, 75 bp, Artificial Sequence
  Synthetic
gcgaacctagcgctacccacctcagccttgctaatggcttgtttcatctttggtggcttcacctacttggacttg

SEQ ID NO: 206012 - DNA, 75 bp, Artificial Sequence
  Synthetic
ttcagatacttcatccttgtgggtgcggcctttgcagaggcaaacagcggtggggacgtcgtccatctagctatg

SEQ ID NO: 206013 - DNA, 75 bp, Artificial Sequence
  Synthetic
atagccgcttttaacatccagccagtggcactagtcaccaccttcttcaggaaaaattggaccaatcgggagaac

SEQ ID NO: 206014 - DNA, 75 bp, Artificial Sequence
  Synthetic
atgattctcatcattgccgcagcatgcacacagatggcgtgcatggagttgaagattgagctgtttcatgtcatg

SEQ ID NO: 206015 - DNA, 75 bp, Artificial Sequence
  Synthetic
aattcactctctttggcatggatgatactcaaggccctgacaactggcacgacttcgactcttgcaatgccgttt

SEQ ID NO: 206016 - DNA, 75 bp, Artificial Sequence
  Synthetic
ctggcagccctgtctccacccatgaattggcttggactggacgtggtgagatgtcttctgatcatggctggggtt

SEQ ID NO: 206017 - DNA, 75 bp, Artificial Sequence
  Synthetic
gcagcgctcattagcgagcgtagggagagcttggccaagaaaaaaggagccttgctcatctctgcagccttggtt

SEQ ID NO: 206018 - DNA, 75 bp, Artificial Sequence
  Synthetic
ttgacgggagctttctcaccgctggttctgcaaggagccctgatgttcactcaaagtttgggaaaacggggatgg

SEQ ID NO: 206019 - DNA, 75 bp, Artificial Sequence
  Synthetic
cctgccagtgaagtactaacagccgtgggcatgactttcgctcttgcggggagtgttgctagactggatggaggc

SEQ ID NO: 206020 - DNA, 75 bp, Artificial Sequence
  Synthetic
acaatggccatcccattggccaccatggccatattggctgttgcctatgtcctctcaggaaaatccactgacatg

SEQ ID NO: 206021 - DNA, 75 bp, Artificial Sequence
  Synthetic
tggctggaacgctgcgctgacatctcatggatcaatgaagctgaaattacagggactagcccacgtcttgatgtc

SEQ ID NO: 206022 - DNA, 75 bp, Artificial Sequence
  Synthetic
gaacttgattccaacggagactttaagatgatcaatgaccctggagttccaatgtggatgtggacttgcagaatg

SEQ ID NO: 206023 - DNA, 75 bp, Artificial Sequence
  Synthetic
ggcctcatggcaatggctgcatacaacccagtgctaattccagtgtccatggctggatactggatgacagtgaaa

SEQ ID NO: 206024 - DNA, 75 bp, Artificial Sequence
  Synthetic
attcacaagcgtggaggggtcatgtgggacgtcccagctcccaagcaattcggcaagacggagttaaaacccgga

SEQ ID NO: 206025 - DNA, 75 bp, Artificial Sequence
  Synthetic
gtctacagagtcatgaccatgggaattctgggaaggtaccagtcaggcgtaggagtcatgtgggatggagttttt

SEQ ID NO: 206026 - DNA, 75 bp, Artificial Sequence
  Synthetic
cacaccatgtggcatgtcacacagggagccgccttgcgaaatggtgaaggacgccttaaccccacctggggaagt

SEQ ID NO: 206027 - DNA, 75 bp, Artificial Sequence
  Synthetic
gtgcgtgacgacttgatatcctatgggggcaagtggaaactctcagccacatggaatggaagtgaggaggtccag

SEQ ID NO: 206028 - DNA, 75 bp, Artificial Sequence
  Synthetic
atgatcgccgtggagccaggaaaggctgcaaaaaactaccaaaccaaaccaggagtgttcaaaacgccggcagga

SEQ ID NO: 206029 - DNA, 75 bp, Artificial Sequence
  Synthetic
gaaattggtgccatcacactggattttcccaagggcacctcgggatcgcccatcattaacaaagccggggaaatc

SEQ ID NO: 206030 - DNA, 75 bp, Artificial Sequence
  Synthetic
attggactgtatggcaatggactcgtgttggcaagtggggcttatgtcagcgccatcacacaaggagagcggcag

SEQ ID NO: 206031 - DNA, 75 bp, Artificial Sequence
  Synthetic
gaagaggaaactcctgaggcattcacgccggacatgctgaagaagcgaaggctcacaatactggatctccatcct

SEQ ID NO: 206032 - DNA, 75 bp, Artificial Sequence
  Synthetic
ggagctgggaaaacaagaagagtcatccctcagatcgtcagagagtgtgtgaaagcccgcctccgaacggtcata

SEQ ID NO: 206033 - DNA, 75 bp, Artificial Sequence
  Synthetic
ctggctcccaccagagtcgttgcagctgaaatggcagaggcacttcgtggtctccccatcaggtatcaaacatca

SEQ ID NO: 206034 - DNA, 75 bp, Artificial Sequence
  Synthetic
gccgtcaaggcggaacactctgggaatgagatagtggatgtcatgtgccatgcaacactaacacagcgcctgcta

SEQ ID NO: 206035 - DNA, 75 bp, Artificial Sequence
  Synthetic
acaccagcaaaagtgccgaattacaatgtgtttgtgatggatgaggcccactttactgacccagcaagcatagca

SEQ ID NO: 206036 - DNA, 75 bp, Artificial Sequence
  Synthetic
gcaagagggtacatttcaactaaggtggaacttggggaggctgcggccatcttcatgactgcaacaccgcccgga

SEQ ID NO: 206037 - DNA, 75 bp, Artificial Sequence
  Synthetic
acaactgatccttttccagactcaaatgctccaatcattgaccaggaggctgaaatccccgacagggcctggaat

SEQ ID NO: 206038 - DNA, 75 bp, Artificial Sequence
  Synthetic
agtggctttgaatggattacagaatacacaggaaagaccgtctggtttgtacccagtgtgcgcatgggcaatgaa

SEQ ID NO: 206039 - DNA, 75 bp, Artificial Sequence
  Synthetic
atcgccatgtgcctgaccaaagcggggaaaaaggtgatccaactgaacaggaagagctacgattctgaataccag

SEQ ID NO: 206040 - DNA, 75 bp, Artificial Sequence
  Synthetic
aagtgcaaaggaaacgactgggactttgtcataacaactgacatctccgaaatgggggccaattttggcgctcat

SEQ ID NO: 206041 - DNA, 75 bp, Artificial Sequence
  Synthetic
agggttattgacagcaggaagtgcgtgaaaccagtcattctggatggagatgacagagtcctcatgaatgggcca

SEQ ID NO: 206042 - DNA, 75 bp, Artificial Sequence
  Synthetic
gccccaatcaccccagcaagtgcagcccaaaggagaggtaggattgggagagacccgacccagtcaggggacgag

SEQ ID NO: 206043 - DNA, 75 bp, Artificial Sequence
  Synthetic
tacttctatggaggaccaaccaccactgatgacacgggacatgctcactggattgaagcaaagatccttctggac

SEQ ID NO: 206044 - DNA, 75 bp, Artificial Sequence
  Synthetic
aacatccaactgcagaatggactcgtggctcagttgtatggcccggagcgtgacaaggtcttcacgaccgatggt

SEQ ID NO: 206045 - DNA, 75 bp, Artificial Sequence
  Synthetic
gagtaccggttgcgcagcgagcagaaaaagaactttgtggaattcctcaggacaggcgacctcccagtgtggctg

SEQ ID NO: 206046 - DNA, 75 bp, Artificial Sequence
  Synthetic
tcatataaggtagctgaggcggggtacgcttacacagacaggagatggtgttttgacggacccgcaaacaacaca

SEQ ID NO: 206047 - DNA, 75 bp, Artificial Sequence
  Synthetic
attctagaggacaacaacgaagtggagatctggacgcgacaaggggaaaaaaggattctgcgcccaagatggtca

SEQ ID NO: 206048 - DNA, 75 bp, Artificial Sequence
  Synthetic
gatgcacgagtctactgtgacaaccaagccctgagatctttcaaggagtttgcggcagggaagcgctcagcaggc

SEQ ID NO: 206049 - DNA, 75 bp, Artificial Sequence
  Synthetic
tcagtcatggaggtaatgggcagaatgcctgactatttttggacaaagactctcaacgcagcagacaacctgtac

SEQ ID NO: 206050 - DNA, 75 bp, Artificial Sequence
  Synthetic
gttctggccacagccaacaaaggagggcgagcccatcaagcggcacttgaagaactgcctgacacagttgagacc

SEQ ID NO: 206051 - DNA, 75 bp, Artificial Sequence
  Synthetic
atcttgctcatgacaatgatgtgtgtggcatcactgggaatgttcgctctgatggttcatcggaggggactaggc

SEQ ID NO: 206052 - DNA, 75 bp, Artificial Sequence
  Synthetic
aaaactggactgggcaccttagtgcttgcgacggtcacggtcctcctatggatctcagatgtgccggccccaaaa

SEQ ID NO: 206053 - DNA, 75 bp, Artificial Sequence
  Synthetic
atagctggagttcttctgattgcattcctgctgatgatcgtcctcatcccagaacccgaaaaacaaaggagccag

SEQ ID NO: 206054 - DNA, 75 bp, Artificial Sequence
  Synthetic
acggacaaccacttggcaatctttctcgtgtgcgttctcctgttaattggagccgtctccgccaacgaaatgggg

SEQ ID NO: 206055 - DNA, 75 bp, Artificial Sequence
  Synthetic
tggcttgagacaaccaaaaaagacattggaaagctgttccgctcaactggagacacacaagagcagtcggcctgg

SEQ ID NO: 206056 - DNA, 75 bp, Artificial Sequence
  Synthetic
cattcttgggcacccgaggtgagagcagccacggcatgggcaggttatgctggactcacagtgttcctaacacca

SEQ ID NO: 206057 - DNA, 75 bp, Artificial Sequence
  Synthetic
ctcttccgacatctcatcaccacccagtatgtgagcttttccctgaccgcgatcacggcccaggcctcggctctg

SEQ ID NO: 206058 - DNA, 75 bp, Artificial Sequence
  Synthetic
tttggcctgagcgcaggttacccctttgttgggattgacttggcggtggggttcctattactcgggtgctacgga

SEQ ID NO: 206059 - DNA, 75 bp, Artificial Sequence
  Synthetic
cagtacaacctgccaacagctgtggcgaccggcctcctcctcctagcccactatggatacatgattccagggtgg

SEQ ID NO: 206060 - DNA, 75 bp, Artificial Sequence
  Synthetic
caggctgaggctatgcgtgcagcacaaaagagaacagcagctggcgtgatgaagaacgcagttgttgatggaatt

SEQ ID NO: 206061 - DNA, 75 bp, Artificial Sequence
  Synthetic
gtggcaacggacattccagaagtggacaccgcaacaccaataacagagaaaaaactgggccagatcttgctcatt

SEQ ID NO: 206062 - DNA, 75 bp, Artificial Sequence
  Synthetic
ctactatgcggagcatctcttttggttaagtttgacaccatggttttagtggaagcaggggtcttgacaacgtca

SEQ ID NO: 206063 - DNA, 75 bp, Artificial Sequence
  Synthetic
gccatggccactctcattgagggaaacgccaacacagtctggaactcaaccgtggcggttggtgtttgccacctc

SEQ ID NO: 206064 - DNA, 75 bp, Artificial Sequence
  Synthetic
atgcggggagcttggctggctgggccatcgattggatggaccattgtcagaaatcttgagaaccccaaactgaag

SEQ ID NO: 206065 - DNA, 75 bp, Artificial Sequence
  Synthetic
cggggaggaggatcggctccaacccttggagagatatggaaagcccaactaaaccaattgaccagggaggaattc

SEQ ID NO: 206066 - DNA, 75 bp, Artificial Sequence
  Synthetic
atggcataccgaagggatgggatccttgaagtggacagaacacaggcgcgtagagcacgccaaagtggaatcaca

SEQ ID NO: 206067 - DNA, 75 bp, Artificial Sequence
  Synthetic
actggagggcatccggtgtctcgaggaacagccaaactacgctggatggttgagcgaggatttgtgaagcccatt

SEQ ID NO: 206068 - DNA, 75 bp, Artificial Sequence
  Synthetic
ggaaaagtggttgatcttggctgtggcaggggaggctggagctattactgtgccacccttaggcatgtgcaagaa

SEQ ID NO: 206069 - DNA, 75 bp, Artificial Sequence
  Synthetic
gtgagaggatacacaaaaggcggaccaggccatgaggaaccagtgatgatgcaaagttatggatggaacattgtc

SEQ ID NO: 206070 - DNA, 75 bp, Artificial Sequence
  Synthetic
accatgaaaagcggtgttgacgtgttctacaagcccactgagtcctgtgacacactcctctgtgacattggagag

SEQ ID NO: 206071 - DNA, 75 bp, Artificial Sequence
  Synthetic
tcttcttcctcagtcggagttgaggaggccagaactctcagggtcttggacatggtcgaaccatggctcagggct

SEQ ID NO: 206072 - DNA, 75 bp, Artificial Sequence
  Synthetic
gccaacagtttctgcatcaaggtactatgcccatacaccccaaaggtcattgaacgcctggagcgcctccaaagg

SEQ ID NO: 206073 - DNA, 75 bp, Artificial Sequence
  Synthetic
gcttatggtggcggactagtcagagtcccgctttccaggaactccacgcatgagatgtactgggtcagtggggca

SEQ ID NO: 206074 - DNA, 75 bp, Artificial Sequence
  Synthetic
tcaagtaacatcatcaatgccgtcaccgtcacaagccagatcctcgtgcagcgtatgaacaaaggctgccgacat

SEQ ID NO: 206075 - DNA, 75 bp, Artificial Sequence
  Synthetic
ggccctcgctatgaagaggatgtatgcttaggaagcggcacacgtgccgtggccacccaggcatcaccctctgat

SEQ ID NO: 206076 - DNA, 75 bp, Artificial Sequence
  Synthetic
ccgtaccggacatggcactaccatggaagctatgaagttcagcccactggatcagctaactcaatggtcaatggt

SEQ ID NO: 206077 - DNA, 75 bp, Artificial Sequence
  Synthetic
gtagtgcgcttgttgtctaagccatgggacgcaatcaccagcgtggtaaccatggcaatgactgacacgaccccc

SEQ ID NO: 206078 - DNA, 75 bp, Artificial Sequence
  Synthetic
tttggccaacaaagggtgtttaaagagaaggtggacacacgggctccggacccagcagtaggagttgcccaagca

SEQ ID NO: 206079 - DNA, 75 bp, Artificial Sequence
  Synthetic
ctggacattacaacaggctggctatggaccttcctggctagaagcaagaagcccagaatgtgcacgcgtgaggag

SEQ ID NO: 206080 - DNA, 75 bp, Artificial Sequence
  Synthetic
tttatcgcgaaggtcaacagcaacgcggcattgggcgcggtgtttgatgagcagaaccaatggtcaacggctaga

SEQ ID NO: 206081 - DNA, 75 bp, Artificial Sequence
  Synthetic
gaggcagttgaagacccagccttctggaacctagttgatgaggagcgcaaggcccacctggcaggacgttgtgaa

SEQ ID NO: 206082 - DNA, 75 bp, Artificial Sequence
  Synthetic
acatgcatttacaacatgatgggaaagcgagagaaaaaactgggggaattcgggaaagcgaagggaagcagagcc

SEQ ID NO: 206083 - DNA, 75 bp, Artificial Sequence
  Synthetic
atctggtacatgtggctcggagctagattcctggagtttgaggcactgggctttctaaacgaagaccattggatg

SEQ ID NO: 206084 - DNA, 75 bp, Artificial Sequence
  Synthetic
agtagagagaactcattgggtggagtcgaagggcaaggactccagaaacttgggtacattctgagagacatctca

SEQ ID NO: 206085 - DNA, 75 bp, Artificial Sequence
  Synthetic
cacctggagggtggaaacatgttcgctgacgacactgcaggatgggacaccagaatcacaagggctgatcttgag

SEQ ID NO: 206086 - DNA, 75 bp, Artificial Sequence
  Synthetic
aacgaagccaaagtgatgaacatgatggaaggagaacacaaacaactcgctcaggccataatcgagctaacctac

SEQ ID NO: 206087 - DNA, 75 bp, Artificial Sequence
  Synthetic
aggcacaaagtagtcaaagtcatgcggcctgcgcggggagggaagacagtcatggacatcatctccagggaggac

SEQ ID NO: 206088 - DNA, 75 bp, Artificial Sequence
  Synthetic
cagagagggagtggccaagtggttacctatgcacttaacaccttcaccaacctggcggttcagttagtgagatgc

SEQ ID NO: 206089 - DNA, 75 bp, Artificial Sequence
  Synthetic
atggaaggggaggaactgctgacggagagtgacgtgcacggcttgagcccgaagaagaagcaagcagtccggaat

SEQ ID NO: 206090 - DNA, 75 bp, Artificial Sequence
  Synthetic
tggttgatccaaaatggaagagagaggctctcgcgcatggctgtcagtggggacgactgtgtggtgaaacccatt

SEQ ID NO: 206091 - DNA, 75 bp, Artificial Sequence
  Synthetic
gacgaccgattcgcgagcgccttgcactttctcaatggcatggcaaagatcaggaaagacacccaggaatggaaa

SEQ ID NO: 206092 - DNA, 75 bp, Artificial Sequence
  Synthetic
ccatccgtaggctggagcaactggcaggaagtgccattttgctcccaccatttcaacgagctgttgatgaaggat

SEQ ID NO: 206093 - DNA, 75 bp, Artificial Sequence
  Synthetic
ggacgtaccatcgtagttccatgccgctcccaagatgaactagtgggaagagcgcgggtgtcacctggcagtggg

SEQ ID NO: 206094 - DNA, 75 bp, Artificial Sequence
  Synthetic
agcgcgggtgtcacctggcagtgggtggagtttgcgggagacggcttgtctgagcaaagcctatgcccagatgtg

SEQ ID NO: 206095 - DNA, 75 bp, Artificial Sequence
  Synthetic
gttgctcatgtatttccaccgccgtgacctccgtctcatggccaacgccatctgttcagcagtgcccgtggactg

SEQ ID NO: 206096 - DNA, 75 bp, Artificial Sequence
  Synthetic
ggtcccgactggacgaaccacatggtccatccacgggaaaggagaatggatgaccacagaggacatgctccaagt

SEQ ID NO: 206097 - DNA, 75 bp, Artificial Sequence
  Synthetic
gtggaacagggtctggattgaggacaatgagcacatggaggacaagacgcccatcacgtctgggactgacatccc

SEQ ID NO: 206098 - DNA, 75 bp, Artificial Sequence
  Synthetic
ctacctcggaaagagggaggaccaatggtgtggcagcctgattggaacccgacagagagccacatgggcggagaa

SEQ ID NO: 206099 - DNA, 75 bp, Artificial Sequence
  Synthetic
catatatacaccaataatgcaaatccgcaacctaattggggatgagaagtacgtggattacatggtgtcccagca

SEQ ID NO: 206100 - DNA, 75 bp, Artificial Sequence
  Synthetic
caggttcgaaacaccttcacctgtgctgttcaccggcgccatctaaacccaaaagacaaaaaaaggacaattgtg

SEQ ID NO: 206101 - DNA, 75 bp, Artificial Sequence
  Synthetic
ctgttcaccggcgccatctaaacccaaaagacaaaaaaaggacaattgtgtcaggccatggaaacatgccaccca

SEQ ID NO: 206102 - DNA, 75 bp, Artificial Sequence
  Synthetic
aagcttgtagagggtgcagcctgcgccaagccccaggaggactgggttaccaaagccgttaggcccccacggccc

SEQ ID NO: 206103 - DNA, 75 bp, Artificial Sequence
  Synthetic
attccaggagacagcgcgactcctggaggaaggactagaggttagaggagaccccgtggaatatcgctgaggccc

SEQ ID NO: 206104 - DNA, 75 bp, Artificial Sequence
  Synthetic
aaaccagcccgaagctgtaggactggtggaaggactagaggttagtggagacccctcagcaccaagcgcaaaaca

SEQ ID NO: 206105 - DNA, 75 bp, Artificial Sequence
  Synthetic
gtggaaggactagaggttagtggagacccctcagcaccaagcgcaaaacaaacagcatattgacgcctgggaaag

SEQ ID NO: 206106 - DNA, 75 bp, Artificial Sequence
  Synthetic
tcctctgctttccatcaccagccactaggcacagatcgccgcaagttgtggctggtggtgaaaaacacaggatct

SEQ ID NO: 206107 - DNA, 75 bp, Artificial Sequence
  Synthetic
ggagctatagcagggtttatagaaggaggatggcaggggatggtagatggttggtatgggtaccatcatagcaac

SEQ ID NO: 206108 - DNA, 75 bp, Artificial Sequence
  Synthetic
gattagggcatccgtcgggaagatgattgatggaattgggagattctacatccaaatgtgcactgaacttaaact

SEQ ID NO: 206109 - DNA, 75 bp, Artificial Sequence
  Synthetic
attgatggaattgggagattctacatccaaatgtgcactgaacttaaactcagtgatcatgaagggcggttgatc

SEQ ID NO: 206110 - DNA, 75 bp, Artificial Sequence
  Synthetic
aaggaataaatacctggaagaacaccccagcgcggggaaagatcccaagaaaactggggggcccatatacaggag

SEQ ID NO: 206111 - DNA, 75 bp, Artificial Sequence
  Synthetic
cccagcgcggggaaagatcccaagaaaactggggggcccatatacaggagaatcgatgggaaatggatgagggaa

SEQ ID NO: 206112 - DNA, 75 bp, Artificial Sequence
  Synthetic
atgaatccaaatcagaagataatagcaattggctctgtttctctaaccattgcgataatatgtttcctcatgcag

SEQ ID NO: 206113 - DNA, 75 bp, Artificial Sequence
  Synthetic
caatggtgaggatgctacatctggtctaactcacataatgatttggcattccaatttgaatgatgcaacatacca

SEQ ID NO: 206114 - DNA, 75 bp, Artificial Sequence
  Synthetic
ctaactcacataatgatttggcattccaatttgaatgatgcaacataccagaggacaagagctcttgttcgaact

SEQ ID NO: 206115 - DNA, 75 bp, Artificial Sequence
  Synthetic
gacacacattcacatattctcattcactggagaggaaatggccactaaagctgactatactcttgatgaggagag

SEQ ID NO: 206116 - DNA, 75 bp, Artificial Sequence
  Synthetic
agaggagataagtggagtgaaattggaatcgataggagtttaccaaatactgtcaatttattctacagtggcgag

SEQ ID NO: 206117 - DNA, 75 bp, Artificial Sequence
  Synthetic
aaggtccggagctgcaggtgctgcagtcaaaggaatcgggacaatggtgatggaactgatcagaatggtcaaacg

SEQ ID NO: 206118 - DNA, 75 bp, Artificial Sequence
  Synthetic
gtcaaaggaatcgggacaatggtgatggaactgatcagaatggtcaaacgggggatcaacgatcgaaatttttgg

SEQ ID NO: 206119 - DNA, 75 bp, Artificial Sequence
  Synthetic
ccaatgggtcgttacaatgcagaatttgcatttaaatttgtgagttcagattgtagttaaaaacacccttgtttc

SEQ ID NO: 206120 - DNA, 75 bp, Artificial Sequence
  Synthetic
tgatggatgcccttaaattaagcatcgaagatccaagccatgagggggaaggtataccactatatgatgcaatca

SEQ ID NO: 206121 - DNA, 75 bp, Artificial Sequence
  Synthetic
aatgcatgaagacatttttcggctggaaagagcccaacattgtaaaaccacatgaaaagggcataaatcccaatt

SEQ ID NO: 206122 - DNA, 75 bp, Artificial Sequence
  Synthetic
cctgcagtatccagtgggtacgacttcgaaaaagagggatattccttggtgggaatagaccctttcaaactgctt

SEQ ID NO: 206123 - DNA, 75 bp, Artificial Sequence
  Synthetic
aatacccaattacagcagacaagagaataatggacatgattccagagaggaatgaacaaggacaaaccctctgga

SEQ ID NO: 206124 - DNA, 75 bp, Artificial Sequence
  Synthetic
caaaatagccaaatatacagcttaatcagacctaacgagaatccagcacacaagagtcagctggtgtggatggca

SEQ ID NO: 206125 - DNA, 75 bp, Artificial Sequence
  Synthetic
gacaaaagtatctcctcgggggaaactgtcaactagaggagtacaaattgcttcaaatgagaacatggataatat

SEQ ID NO: 206126 - DNA, 75 bp, Artificial Sequence
  Synthetic
ctgtcaactagaggagtacaaattgcttcaaatgagaacatggataatatgggatcgagcactcttgaactgaga

SEQ ID NO: 206127 - DNA, 75 bp, Artificial Sequence
  Synthetic
gaaatggatgagagagctgatcctgtatgacaaagaggagatcagaaggatctggcgtcaagcgaacaatggaga

SEQ ID NO: 206128 - DNA, 75 bp, Artificial Sequence
  Synthetic
gagggcctccgcaggccaaaccagtgtgcaacctacgttttctgtacaaagaaacctcccatttgaaaagtcaac

SEQ ID NO: 206129 - DNA, 75 bp, Artificial Sequence
  Synthetic
ctagggcaaaagaggtacaccaaaacaacatactggtgggacggactccaatcctctgatgactttgctctcata

SEQ ID NO: 206130 - DNA, 75 bp, Artificial Sequence
  Synthetic
gtgcaacctacgttttctgtacaaagaaacctcccatttgaaaagtcaaccatcatggcagcattcactggaaat

SEQ ID NO: 206131 - DNA, 75 bp, Artificial Sequence
  Synthetic
aatagtatctgcaacaccacaggggtagagaagcctaaatttcttccggatctgtatgattacaaggagaacaga

SEQ ID NO: 206132 - DNA, 75 bp, Artificial Sequence
  Synthetic
aacaagagtggacaaactgactcaaggtcgccagacttatgactggacattgaatagaaaccaaccggccgcaac

SEQ ID NO: 206133 - DNA, 75 bp, Artificial Sequence
  Synthetic
atcctctgatgactttgctctcatagtgaatgctccgaatcatgagggaatacaagcaggagtagacagattcta

SEQ ID NO: 206134 - DNA, 75 bp, Artificial Sequence
  Synthetic
aggtgcaaaaccagaagaagtgtcattccgggggaggggagttttcgagctctcagacgagaaggcaacgaaccc

SEQ ID NO: 206135 - DNA, 75 bp, Artificial Sequence
  Synthetic
tttctttggcatatccggaaacaagttgtagaccaaaaactgagtgatgccccattccttgatcggcttcgccga

SEQ ID NO: 206136 - DNA, 75 bp, Artificial Sequence
  Synthetic
cccattccttgatcggcttcgccgagatcagaggtccctaaggggaagaggcaatactctcggtctagacatcaa

SEQ ID NO: 206137 - DNA, 75 bp, Artificial Sequence
  Synthetic
aaagcagaaatcctggaaatgctgaaattgaagatctcatctttctggcacggtctgcactcatcctgagaggat

SEQ ID NO: 206138 - DNA, 75 bp, Artificial Sequence
  Synthetic
aggagacacacaaatccagacgagaagatcattcgagataaagaagctgtgggatcaaacccaatcaagggcagg

SEQ ID NO: 206139 - DNA, 75 bp, Artificial Sequence
  Synthetic
attgtagaaaagattctgaaagaagaatctgatgaggcacttaaaatgaccatggtctcgacacctgcttcgcga

SEQ ID NO: 206140 - DNA, 75 bp, Artificial Sequence
  Synthetic
aatctgatgaggcacttaaaatgaccatggtctcgacacctgcttcgcgatacataactgacatgactattgagg

SEQ ID NO: 206141 - DNA, 75 bp, Artificial Sequence
  Synthetic
caatcatggagaaaaacatcatgttaaaagcgaatttcaatgtgatttttggccgactagagaccatagtattac

SEQ ID NO: 206142 - DNA, 75 bp, Artificial Sequence
  Synthetic
aggggagttcaaattgcttcaaatgagaacatggaaacgatggattccagcactcttgaattgagaagcagatat

SEQ ID NO: 206143 - DNA, 75 bp, Artificial Sequence
  Synthetic
gaggagtgctcttgctatcctcgatatcctggtgtcagatgtgtctgcagagacaactggaaaggctccaatagg

SEQ ID NO: 206144 - DNA, 75 bp, Artificial Sequence
  Synthetic
tggcgagaacagctaggtcagaagtttgaagagataagatggctaattgaagaagtgagacacagattaagaaca

SEQ ID NO: 206145 - DNA, 75 bp, Artificial Sequence
  Synthetic
ttggagctgtgaaaggtcttgataaaatctgcctaggacatcatgcagtggccaatgggaccatcgtaaagactc

SEQ ID NO: 206146 - DNA, 75 bp, Artificial Sequence
  Synthetic
tatacagagattcgcttggagaagcagtgatgagggtgggagacttccactccctccaaatcagaaacggaaaat

SEQ ID NO: 206147 - DNA, 75 bp, Artificial Sequence
  Synthetic
aatctgcctaggacatcatgcagtggccaatgggaccatcgtaaagactctcaccaacgaacgggaagaggtgac

SEQ ID NO: 206148 - DNA, 75 bp, Artificial Sequence
  Synthetic
acataaatcggacaggaacatttgaattcacgagctttttctaccgctatggattcgtagccaatttcagtatgg

SEQ ID NO: 206149 - DNA, 75 bp, Artificial Sequence
  Synthetic
cctatgaacagatggagactggtggagaacgccagaatgccaccgagatcagggcttctgttggaagaatggttg

SEQ ID NO: 206150 - DNA, 75 bp, Artificial Sequence
  Synthetic
tcgttccatcaggccccctcaaagccgagatcgcgcagagacttgaagatgtctttgctgggaaaaacacagatc

SEQ ID NO: 206151 - DNA, 75 bp, Artificial Sequence
  Synthetic
aaggaagaaaccataaagatctgagcaattgccatccaataggaatgctaatagggacaccagcttgtgatctgc

SEQ ID NO: 206152 - DNA, 75 bp, Artificial Sequence
  Synthetic
gaccaagaaggaaggttgatccaaaacagcataacaatagagagaatggttctctctgcattcgatgaaaggagg

SEQ ID NO: 206153 - DNA, 75 bp, Artificial Sequence
  Synthetic
tctctctgcattcgatgaaaggaggaacaggtacctagaggaacaccctagtgcagggaaggacccgaagaaaac

SEQ ID NO: 206154 - DNA, 75 bp, Artificial Sequence
  Synthetic
actaaggggattttagggtttgttttcacgctcaccgtgcccagtgagcgaggactgcagcgtagacgctttgtc

SEQ ID NO: 206155 - DNA, 75 bp, Artificial Sequence
  Synthetic
ctattcatcaaggactacaggtacacataccgatgccacagaggggatacacaaatccaaacgaggagatcattc

SEQ ID NO: 206156 - DNA, 75 bp, Artificial Sequence
  Synthetic
tactgctatcctggagctactgtaaatgaagaggcactgaggcagaaaataatggaaagtggaggaatcagcaaa

SEQ ID NO: 206157 - DNA, 75 bp, Artificial Sequence
  Synthetic
caaaatgccctcaatgggaatggagacccaaataacatggacaaagcagttaaactgtataggaaacttaagagg

SEQ ID NO: 206158 - DNA, 75 bp, Artificial Sequence
  Synthetic
attgagagcatgattgaggccgagtcttccgtcaaagagaaagatatgacaaaggaattctttgagaacaaatca

SEQ ID NO: 206159 - DNA, 75 bp, Artificial Sequence
  Synthetic
tgacaaagaagaaataaggagagtttggcgccaagcaaacaatggtgaagatgcaacagctggccttactcatat

SEQ ID NO: 206160 - DNA, 75 bp, Artificial Sequence
  Synthetic
taaagcatgcatgaggaatggagggaatagcttttatgcagagcttaagtggctggtatcaaagaacaaaggaca

SEQ ID NO: 206161 - DNA, 75 bp, Artificial Sequence
  Synthetic
gtgtgcaacatgtgagcagattgctgattcccagcacaggtctcataggcagatggtggcaacaaccaatccatt

SEQ ID NO: 206162 - DNA, 75 bp, Artificial Sequence
  Synthetic
gctctctgctttcgatgagagaagaaataagtacctagaagagcatcccagtgctgggaaggatcctaagaaaac

SEQ ID NO: 206163 - DNA, 75 bp, Artificial Sequence
  Synthetic
aggcaatgagagccattgggactcatcctagttccagtactggtctaagagatgatcttcttgaaaatttgcaga

SEQ ID NO: 206164 - DNA, 75 bp, Artificial Sequence
  Synthetic
aaagcggcagaattgattttcactggacgctagtacggccaggtgataatatcaccttctcacacaatgggggtc

SEQ ID NO: 206165 - DNA, 75 bp, Artificial Sequence
  Synthetic
gatcaggaatgagaatactggtaagaggcaattccccagtgtttaattacaacaaggccaccaagaggctcacag

SEQ ID NO: 206166 - DNA, 75 bp, Artificial Sequence
  Synthetic
aatgtggaagccatggattccaataccttagagctgagaagcagatactgggccataaggaccagaagtggagga

SEQ ID NO: 206167 - DNA, 75 bp, Artificial Sequence
  Synthetic
acaggaatgagaaacgtgccagaaataatgcaagagagaggtctatttggtgcaatagcggggtttatagagaat

SEQ ID NO: 206168 - DNA, 75 bp, Artificial Sequence
  Synthetic
ggtatggtttcagacaccaaaatgcccagggcacaggccaagctgctgattacaagagtactcaggcagctattg

SEQ ID NO: 206169 - DNA, 75 bp, Artificial Sequence
  Synthetic
ccactagaggagttcagattgcttcaaatgagaacgtagacgcaatggactccagcactcttgaactgagaagcc

SEQ ID NO: 206170 - DNA, 75 bp, Artificial Sequence
  Synthetic
catggaacagggacagggtacactatggacacagtcaacagaacacaccaatattcagagagggggaagtggacg

SEQ ID NO: 206171 - DNA, 75 bp, Artificial Sequence
  Synthetic
ttcgagtcaatagaatctgaattcagtgagatcgaacatcagatcggtaacgtcatcaattggactaaggattca

SEQ ID NO: 206172 - DNA, 75 bp, Artificial Sequence
  Synthetic
tgtatgactacaaggaaaaccgattcattgaaattggagtgacgaggagggaagtccacatatattacctagaga

SEQ ID NO: 206173 - DNA, 75 bp, Artificial Sequence
  Synthetic
atgcaacagtcctcaccaaatccttgatgggaaaaattgcacactgatagatgctctattgggggatcctcattg

SEQ ID NO: 206174 - DNA, 75 bp, Artificial Sequence
  Synthetic
gaagtccacatatattacctagagaaagccaacaaaataaaatccgagaagacacacatccacattttctcattc

SEQ ID NO: 206175 - DNA, 75 bp, Artificial Sequence
  Synthetic
gccagaccagaagatgtgtctttccaggggcggggagttttcgagctctcggacgaaaaggcaacgaacccgatc

SEQ ID NO: 206176 - DNA, 75 bp, Artificial Sequence
  Synthetic
aaagaagagctccaagattgtaagattgctcccttaatggttgcatacatgttggagagggaactggtccgcaaa

SEQ ID NO: 206177 - DNA, 75 bp, Artificial Sequence
  Synthetic
atgaaatggggtatggagatgaggcgttgtcttcttcaatcccttcagcaaattgaaagcatgattgaggccgaa

SEQ ID NO: 206178 - DNA, 75 bp, Artificial Sequence
  Synthetic
ttgctcccttaatggttgcatacatgttggagagggaactggtccgcaaaaccagattcctaccggtagcaggcg

SEQ ID NO: 206179 - DNA, 75 bp, Artificial Sequence
  Synthetic
ttggactggagttgctcaagacggatcaagctatgcctgcagaaggggatctgttaaaagtttctttagtagatt

SEQ ID NO: 206180 - DNA, 75 bp, Artificial Sequence
  Synthetic
gagtaagggacaacatgaccaagaaaatggtcacacaaagaacaatagggaagaaaaagcaaagagtgaataaga

SEQ ID NO: 206181 - DNA, 75 bp, Artificial Sequence
  Synthetic
ttgttcttctagccgttgtcatgggtcttgtcttcttctgtctgaagaatggaaacatgcgatgcacaatctgta

SEQ ID NO: 206182 - DNA, 75 bp, Artificial Sequence
  Synthetic
gactgattcaagctgggtagaacttgatgaaataggggaagatgttgctccaatcgaacacattgcaagcatgag

SEQ ID NO: 206183 - DNA, 75 bp, Artificial Sequence
  Synthetic
aacacctgggatgcaaattagagggttcgtgtactttgttgagactctagctagaagcatttgcgagaagcttga

SEQ ID NO: 206184 - DNA, 75 bp, Artificial Sequence
  Synthetic
aaggcctctcctaatagatggcacagcatcactgagccctgggatgatgatgggcatgttcaacatgctaagtac

SEQ ID NO: 206185 - DNA, 75 bp, Artificial Sequence
  Synthetic
tggttcagaaacatcctgagcatcgcaccaataatgttctcaaacaaaatggcaagactgggaaaaggatacatg

SEQ ID NO: 206186 - DNA, 75 bp, Artificial Sequence
  Synthetic
ataattctattaatcatgaagactgtcattgttctgagttggcttttctgtctggttttcagccaaaatccttca

SEQ ID NO: 206187 - DNA, 75 bp, Artificial Sequence
  Synthetic
cattgttcaggcgcttagggataacctggaacctggaaccttcgatcttgaagggctatatgaagcaatcgagga

SEQ ID NO: 206188 - DNA, 75 bp, Artificial Sequence
  Synthetic
tcctatataaataaaacagggacatttgaattcactagctttttttatcgatatggatttgtggctaattttagc

SEQ ID NO: 206189 - DNA, 75 bp, Artificial Sequence
  Synthetic
gagcattggagtaacagtgataaagaacaacatgataaacaatgaccttggaccagcaacagcccaaatggctct

SEQ ID NO: 206190 - DNA, 75 bp, Artificial Sequence
  Synthetic
ataagatggagttcgagccgttccaatccttggtacctaaagctaccagaggtcaatacagtggatttgtgagaa

SEQ ID NO: 206191 - DNA, 75 bp, Artificial Sequence
  Synthetic
caatgaccaaagatgcagaaagaggcaaattaaaaagacgggcaattgcaacacccgggatgcaaatcagagggt

SEQ ID NO: 206192 - DNA, 75 bp, Artificial Sequence
  Synthetic
acacacaaatccaaacaagaagatcattcgagataaagaagctgtgggatcaaacccaatcaaggacaggactat

SEQ ID NO: 206193 - DNA, 75 bp, Artificial Sequence
  Synthetic
gtcacacaaaatggagggagtggtgcttgtaaaagagggcctgccaatggcttcttcagtagactgaattggctg

SEQ ID NO: 206194 - DNA, 75 bp, Artificial Sequence
  Synthetic
tcgtaaggggcaattcccctgtgttcaactacaataaggcaaccaaaaggcttaccgtccttggaaaggacgcag

SEQ ID NO: 206195 - DNA, 75 bp, Artificial Sequence
  Synthetic
gataatgagccaagtggctacgcacaaacagactgtgtgttggaagcgatggctttccttgaagagtcccaccca

SEQ ID NO: 206196 - DNA, 75 bp, Artificial Sequence
  Synthetic
actgtgaaaattcaatggtcacaagatcccacaatgttatataataagatggaattcgagccattccagtctctg

SEQ ID NO: 206197 - DNA, 75 bp, Artificial Sequence
  Synthetic
ataccagcagaaatgcttgcaaacattgacttgaaatacttcaatgaatcaacgagaaagaaaatcgagagaata

SEQ ID NO: 206198 - DNA, 75 bp, Artificial Sequence
  Synthetic
gaggattcctcattttgggcaaagaagacaagagatatggcccagcattgagcatcaatgagctgagcaatcttg

SEQ ID NO: 206199 - DNA, 75 bp, Artificial Sequence
  Synthetic
tgtaaacaaaattacctatggagcatgtcccaaatatgtcaagcagagcactctaaaattggcaactggaatgcg

SEQ ID NO: 206200 - DNA, 75 bp, Artificial Sequence
  Synthetic
cttaataagagcactgacactaaacacaatgacaaaagatgcagaaaggggtaaattgaagaggcgggcaattgc

SEQ ID NO: 206201 - DNA, 75 bp, Artificial Sequence
  Synthetic
gatagatggttggtatggtttcaggcatcaaaactcagaaggtacaggacaagcagcagaccttaaaagcactca

SEQ ID NO: 206202 - DNA, 75 bp, Artificial Sequence
  Synthetic
taattaagaagtacacatcggggagacaggaaaagaacccgtcacttaggatgaaatggatgatggcaatgaagt

SEQ ID NO: 206203 - DNA, 75 bp, Artificial Sequence
  Synthetic
gcaatctggacttcctgttggagggaatgagaagaaggctaaattggcaaatgtcgtaagaaagatgatgactaa

SEQ ID NO: 206204 - DNA, 75 bp, Artificial Sequence
  Synthetic
gaacaaggacaaactctatggagtaaaatgagtgatgctggatcagatagagtgatggtatcacctttggctgta

SEQ ID NO: 206205 - DNA, 75 bp, Artificial Sequence
  Synthetic
cgggcattcaaatgacactgtacatgataggaccccttatcgaaccctattgatgaatgaattgggtgttccatt

SEQ ID NO: 206206 - DNA, 75 bp, Artificial Sequence
  Synthetic
acatggtggaataggaatggacccgtgacaagtacggtccattacccaaaagtgtacaaaacttatttcgacaaa

SEQ ID NO: 206207 - DNA, 75 bp, Artificial Sequence
  Synthetic
ggaatggctgtttcaagatataccacaaatgtgataatgcctgcatagagtcaattaggaatgggacctatgatc

SEQ ID NO: 206208 - DNA, 75 bp, Artificial Sequence
  Synthetic
agtcaagatacgcagaagagtagacataaaccctggtcatgcagacctcagtgccaaagaggcacaagatgtaat

SEQ ID NO: 206209 - DNA, 75 bp, Artificial Sequence
  Synthetic
gatggaggaccaaatctgtacaatatccggaatctccacattccagaggtctgcttgaagtgggaactaatggat

SEQ ID NO: 206210 - DNA, 75 bp, Artificial Sequence
  Synthetic
tgggattcatcatgtgggcctgccagagaggcaatattaggtgcaacatttgcatttgagtatactaataattaa

SEQ ID NO: 206211 - DNA, 75 bp, Artificial Sequence
  Synthetic
catcgaagatccaagccatgagggggaaggtataccactatatgatgcaatcaaatgcatgaagacatttttcgg

SEQ ID NO: 206212 - DNA, 75 bp, Artificial Sequence
  Synthetic
taaataagacagggacatttgaattcacaagctttttttatcgctatggatttgtggctaattttagcatggagc

SEQ ID NO: 206213 - DNA, 75 bp, Artificial Sequence
  Synthetic
cggtttcaggcatcaaaattctgaaggcacaggacaagcagcagatcttaaaagcactcaagcagcaatcaacca

SEQ ID NO: 206214 - DNA, 75 bp, Artificial Sequence
  Synthetic
atcatgaagatctgttccaccattgaagagctcagacggcaacaacagtagatttagcttgtccttcatgaaaaa

SEQ ID NO: 206215 - DNA, 75 bp, Artificial Sequence
  Synthetic
tgataaataatgatcttggaccagcaacagcacaaatggctcttcaactatttatcaaggactacagatacacat

SEQ ID NO: 206216 - DNA, 75 bp, Artificial Sequence
  Synthetic
ttaaaagaacaagcgggtcgtcagtcaaaaaagaagaagaggtgcttacaggcaatctccaaacattgagaataa

SEQ ID NO: 206217 - DNA, 75 bp, Artificial Sequence
  Synthetic
ggcaatctccaaacattgagaataagagtacatgaggggtatgaggagttcacaatggtggggaaaagagcaaca

SEQ ID NO: 206218 - DNA, 75 bp, Artificial Sequence
  Synthetic
gagtacatgaggggtatgaggagttcacaatggtggggaaaagagcaacagctatactaagaaaagcaaccagaa

SEQ ID NO: 206219 - DNA, 75 bp, Artificial Sequence
  Synthetic
ctgaaaaaactatgggagcagacccgttcaaaggcaggactgttagtatctgatggaggaccaaacctgtacaat

SEQ ID NO: 206220 - DNA, 75 bp, Artificial Sequence
  Synthetic
gcaataatcgtggccatggtgttttcacaagaagattgcatgataaaagcagttagaggtgacctgaattttgtc

SEQ ID NO: 206221 - DNA, 75 bp, Artificial Sequence
  Synthetic
tgaagactaccggggtaggctgtgtaatcctctaaacccatttgtcagtcataaggaaattgagtccgtaaataa

SEQ ID NO: 206222 - DNA, 75 bp, Artificial Sequence
  Synthetic
aacagagcaaatcagcggttgaaccccatgcatcagcttttaaggcattttcagaaggatgcgaaagtgctcttt

SEQ ID NO: 206223 - DNA, 75 bp, Artificial Sequence
  Synthetic
ttccaatgataagcaagtgcagaaccaaagaaggaagacggaagacaaatctgtacggattcattataaaaggaa

SEQ ID NO: 206224 - DNA, 75 bp, Artificial Sequence
  Synthetic
attaccagatatgactccaagcacagagatgtcaatgagaggaataagagtcagcaaaatgggtgtggatgaata

SEQ ID NO: 206225 - DNA, 75 bp, Artificial Sequence
  Synthetic
ctccagtacagagagggtggtggttagcattgatcggtttttgagagttcgagaccaacgtgggaatgtattatt

SEQ ID NO: 206226 - DNA, 75 bp, Artificial Sequence
  Synthetic
atctcctgaggaggtcagtgaaacacagggaactgagagactgacaataacttattcatcgtcgatgatgtggga

SEQ ID NO: 206227 - DNA, 75 bp, Artificial Sequence
  Synthetic
gcagtgtatacattgaggtattgcacttgactcaagggacctgttgggaacaaatgtacactcctggtggagaag

SEQ ID NO: 206228 - DNA, 75 bp, Artificial Sequence
  Synthetic
tacaacaaaatggaatttgaaccatttcaatctttagtccccaaggccattagaagccaatacagtgggtttgtc

SEQ ID NO: 206229 - DNA, 75 bp, Artificial Sequence
  Synthetic
ggcaactctccagtgttcaattacaacaaagcaaccaaaaggctcacaatccttggaaaagatgcaggtgcattg

SEQ ID NO: 206230 - DNA, 75 bp, Artificial Sequence
  Synthetic
agcaaaatctgtattcaacagcctatatgcatctccacaacttgaggggttttcagctgaatcaagaaaattgct

SEQ ID NO: 206231 - DNA, 75 bp, Artificial Sequence
  Synthetic
gaatgtgaggggatcagggatgagaatacttgtaaggggcaattctcctgtattcaactacaacaagaccactaa

SEQ ID NO: 206232 - DNA, 75 bp, Artificial Sequence
  Synthetic
atacttgtaaggggcaattctcctgtattcaactacaacaagaccactaaaaggctaacaattctcggaaaagat

SEQ ID NO: 206233 - DNA, 75 bp, Artificial Sequence
  Synthetic
acaacagcataaggatcggttccaaaggggatgtgtttgttataagagagccattcatctcatgctctcacttgg

SEQ ID NO: 206234 - DNA, 75 bp, Artificial Sequence
  Synthetic
gggtgatggtgtctcccctggccgtaacttggtggaacagaaatggaccgacaacaagtacagttcattatccaa

SEQ ID NO: 206235 - DNA, 75 bp, Artificial Sequence
  Synthetic
gaatcggttcattgaaattggagtaacacggagggaagtccacatatattacctagagaaagccaacaaaataaa

SEQ ID NO: 206236 - DNA, 75 bp, Artificial Sequence
  Synthetic
cgccgtcttgagagggttcctcattataggtaaggaagacagaaggtacggaccagcattaagcatcaatgaact

SEQ ID NO: 206237 - DNA, 75 bp, Artificial Sequence
  Synthetic
tagcaatggtgttctcacaggaggattgcatgataaaggcagtccgaggcgatctgaatttcgtaaatagagcaa

SEQ ID NO: 206238 - DNA, 75 bp, Artificial Sequence
  Synthetic
gccagtggatacgactttgaaagagagggatactctctagtcggaattgatcctttccgtctgctccaaaacagt

SEQ ID NO: 206239 - DNA, 75 bp, Artificial Sequence
  Synthetic
acgggactctagtatacttactgacagccagacagcgaccaaaagaattcggatggccatcaattaatactgaat

SEQ ID NO: 206240 - DNA, 75 bp, Artificial Sequence
  Synthetic
aggcctaccagaagcgaatgggagtgcagatgcagcgattcaagtgatcctctcgtcattgcagcaaatatcatt

SEQ ID NO: 206241 - DNA, 75 bp, Artificial Sequence
  Synthetic
atgaatccaaatcaaaagataataacgattggctctgtttctctcaccatttccacaatatgcttcttcatgcaa

SEQ ID NO: 206242 - DNA, 75 bp, Artificial Sequence
  Synthetic
caactcccccccaaacaaccaagtgatgctgtgtgaaccaacaataatagaaagaaacataacagagatagtgta

SEQ ID NO: 206243 - DNA, 75 bp, Artificial Sequence
  Synthetic
ggacaacaaacaccgaaactggagcacctcagcttaacccgatcgatggaccactaccggaggataatgagccaa

SEQ ID NO: 206244 - DNA, 75 bp, Artificial Sequence
  Synthetic
cactacatttcacgcagagtgaatacactaactcctctacaaacaaagtagtgtcatgtgaatcaaccataatag

SEQ ID NO: 206245 - DNA, 75 bp, Artificial Sequence
  Synthetic
tctaaggacaattcgattaggctttccgctggtggggacatctgggtgacaagagaaccttatgtgtcatgcgat

SEQ ID NO: 206246 - DNA, 75 bp, Artificial Sequence
  Synthetic
attaagcattgaagacccgagtcacgagggggagggaataccactatatgatgcaatcaaatgcatgaagacatt

SEQ ID NO: 206247 - DNA, 75 bp, Artificial Sequence
  Synthetic
acaccgacgtggtaaattttgtgagcatggagttttctctcactgacccgagacttgaaccacataaatgggaga

SEQ ID NO: 206248 - DNA, 75 bp, Artificial Sequence
  Synthetic
tcatctggggaccaagcaagtgtgcatagcatggtccagctcaagttgtcacgatggaaaagcatggctgcatgt

SEQ ID NO: 206249 - DNA, 75 bp, Artificial Sequence
  Synthetic
aagctgttaccatttgcagcagccccaccggagcaaagcagaatgcagttttcttctctaactgtgaacgtgaga

SEQ ID NO: 206250 - DNA, 75 bp, Artificial Sequence
  Synthetic
ttgtataacgggggatgataaaaatgcaactgctagcttcatttacaatgggaggcttgtagatagtgttgtttc

SEQ ID NO: 206251 - DNA, 75 bp, Artificial Sequence
  Synthetic
atggtctaaaaacatcctcagaactcaggagtcagaatgcgtttgcatcaatggaacttgtacagtagtaatgac

SEQ ID NO: 206252 - DNA, 75 bp, Artificial Sequence
  Synthetic
attgtcaggaagtgctcagcatgtcgaagagtgctcttgctatcctcgatatcctggtgtcagatgtgtctgcag

SEQ ID NO: 206253 - DNA, 75 bp, Artificial Sequence
  Synthetic
actgtccgggagtgcccagcatgtggaagaatgctcttgttaccctcgatatccagaagttagatgtgtttgcag

SEQ ID NO: 206254 - DNA, 75 bp, Artificial Sequence
  Synthetic
ggtaatgaaacggaaacgggactctagcatacttactgacagccagacagcgaccaaaagaattcggatggccat

SEQ ID NO: 206255 - DNA, 75 bp, Artificial Sequence
  Synthetic
aaataggcaagtcatagttgaaagtgataacaggtctgggtattctggtatattctctgttgaaggtaagacctg

SEQ ID NO: 206256 - DNA, 75 bp, Artificial Sequence
  Synthetic
atgaatgcaggttctatgctctcagccaaggaacaacaatcagagggaaacactcaaacggaacaatacacgata

SEQ ID NO: 206257 - DNA, 75 bp, Artificial Sequence
  Synthetic
ttttgtggcacctcaggtacatatggaacaggctcatggcctgatggggcggacctcaatctcatgcctatataa

SEQ ID NO: 206258 - DNA, 75 bp, Artificial Sequence
  Synthetic
tcgaacttgcagaaaaagcaatgaaagagtatggggaggatctgaaaattgaaaccaacaaatttgcagcaatat

SEQ ID NO: 206259 - DNA, 75 bp, Artificial Sequence
  Synthetic
gaaaccaacaaatttgcagcaatatgcactcacttggaggtgtgtttcatgtattcagatttccatttcatcaat

SEQ ID NO: 206260 - DNA, 75 bp, Artificial Sequence
  Synthetic
atgaatccaaatcaaaagataataacaattggctctgtttctctcatcattgccacaatatgcttccttatgcaa

SEQ ID NO: 206261 - DNA, 75 bp, Artificial Sequence
  Synthetic
aacttgacgatccaaatgcactgttaaagcacagatttgaaataatcgaggggagagacagaacaatggcctgga

SEQ ID NO: 206262 - DNA, 75 bp, Artificial Sequence
  Synthetic
aaagcacagatttgaaataatcgaggggagagacagaacaatggcctggacagtagtaaacagtatctgcaacac

SEQ ID NO: 206263 - DNA, 75 bp, Artificial Sequence
  Synthetic
ctgtcaaagagaaagacatgaccaaggaattctttgaaaacaaatcggaaacatggccaatcggagagtcaccca

SEQ ID NO: 206264 - DNA, 75 bp, Artificial Sequence
  Synthetic
gagggctattgcaacacctgggatgcaaattagagggttcgtgtactttgttgagactctagctagaagcatttg

SEQ ID NO: 206265 - DNA, 75 bp, Artificial Sequence
  Synthetic
agaacagattcatcgagattggagtgacaaggagagaagtccacatatattaccttgaaaaggccaataagatta

SEQ ID NO: 206266 - DNA, 75 bp, Artificial Sequence
  Synthetic
tctgcttgaaatgggagctgatggacgaagactatcagggaaggctttgtaaccccctgaatccgtttgtcagcc

SEQ ID NO: 206267 - DNA, 75 bp, Artificial Sequence
  Synthetic
taccttgaaaaggccaataagattaaatctgagaacacacacattcacattttttcattcactggggaggaaatg

SEQ ID NO: 206268 - DNA, 75 bp, Artificial Sequence
  Synthetic
catctccacaacttgaggggttttcggctgaatcgagaaaattgcttctcattgttcaggcacttagggacaacc

SEQ ID NO: 206269 - DNA, 75 bp, Artificial Sequence
  Synthetic
gttgatccggatgatcaagcgagggatcaatgatcgcaatttctggaggggcgaaagtggacgaagaaccagaat

SEQ ID NO: 206270 - DNA, 75 bp, Artificial Sequence
  Synthetic
aagaagagtaagggacaacatgaccaagaaaatggtcacacaaagaacaatagggaaaaagaaacagagattgag

SEQ ID NO: 206271 - DNA, 75 bp, Artificial Sequence
  Synthetic
tgtgacggcagcatgtcctcatgctgggacaaacagcttctacagaaatttaatatggctagtaaaaaagggaaa

SEQ ID NO: 206272 - DNA, 75 bp, Artificial Sequence
  Synthetic
aattgagcattgaagacccaagtcacgaaggagaagggatcccattatatgatgcgatcaagtgcataaaaacat

SEQ ID NO: 206273 - DNA, 75 bp, Artificial Sequence
  Synthetic
agtcaaaccacacgaaaagggaataaattcaaattacctgctgtcatggaagcaagtactgtcagaattgcagga

SEQ ID NO: 206274 - DNA, 75 bp, Artificial Sequence
  Synthetic
ccgctggtggggacatttgggtgacaagagaaccttatgtgtcatgcgatcctgacaagtgttatcaatttgccc

SEQ ID NO: 206275 - DNA, 75 bp, Artificial Sequence
  Synthetic
agaactaaaaacatgaagaaaacgagtcaactgaagtgggctcttggtgaaaacatggcaccagagaaggtagac

SEQ ID NO: 206276 - DNA, 75 bp, Artificial Sequence
  Synthetic
gtcaactgaagtgggctcttggtgaaaacatggcaccagagaaggtagactttgaaaactgcagagacataagcg

SEQ ID NO: 206277 - DNA, 75 bp, Artificial Sequence
  Synthetic
gtagtcattgcctagatcctaacaatgaggaaggtggtcatggggtgaaaggctgggcctttgatgatggaaatg

SEQ ID NO: 206278 - DNA, 75 bp, Artificial Sequence
  Synthetic
ttgattattgctgccaggaacatagtgagaagagcaacagtatcagcagacccactagcatctttattggagatg

SEQ ID NO: 206279 - DNA, 75 bp, Artificial Sequence
  Synthetic
tggatacagagtgagttcaacaaggcctgtgagctaactgattcagtctggatagagctcgatgaaattggagag

SEQ ID NO: 206280 - DNA, 75 bp, Artificial Sequence
  Synthetic
cctcccattcgagagagcaaccattatggcggcatttacaggaaacactgaaggcagaacttcagacatgagaac

SEQ ID NO: 206281 - DNA, 75 bp, Artificial Sequence
  Synthetic
gacgtagccccaattgagcacattgcaagcatgagaaggaattatttcacagcagaggtgtcccattgtagagct

SEQ ID NO: 206282 - DNA, 75 bp, Artificial Sequence
  Synthetic
atggaagcaaaactgtttgtgctattctgtacattcactgtactgaaagctgacaccatctgtgtgggctaccat

SEQ ID NO: 206283 - DNA, 75 bp, Artificial Sequence
  Synthetic
atcctgtgcagcaatggacgattttcaactaattcccatgataagcaagtgcagaactaaagagggaaggcgaaa

SEQ ID NO: 206284 - DNA, 75 bp, Artificial Sequence
  Synthetic
tgacaccatctgtgtgggctaccatgcaaacaactctacagacactgttgacacagtactggaaaagaatgtaac

SEQ ID NO: 206285 - DNA, 75 bp, Artificial Sequence
  Synthetic
caactaattcccatgataagcaagtgcagaactaaagagggaaggcgaaaaaccaatttatatggattcatcata

SEQ ID NO: 206286 - DNA, 75 bp, Artificial Sequence
  Synthetic
acacagtactggaaaagaatgtaactgtgactcactcagtgaatttgctcgaagacagccataatgggaagctct

SEQ ID NO: 206287 - DNA, 75 bp, Artificial Sequence
  Synthetic
gagggcgattgcaacacctggaatgcagattagaggtttcgtctacttcgttgaaacacttgcaaggagcatatg

SEQ ID NO: 206288 - DNA, 75 bp, Artificial Sequence
  Synthetic
catggagttttctctcacagacccgagacttgaaccacataaatgggagaaatactgtgtccttgagataggaga

SEQ ID NO: 206289 - DNA, 75 bp, Artificial Sequence
  Synthetic
agacttgaaccacataaatgggagaaatactgtgtccttgagataggagatatgttactaagaagtgccataggc

SEQ ID NO: 206290 - DNA, 75 bp, Artificial Sequence
  Synthetic
ggatggctcctgggcaatccagagtgtgatcttctactcactgcaaactcatggtcctatataatagagacgtcc

SEQ ID NO: 206291 - DNA, 75 bp, Artificial Sequence
  Synthetic
atggtcctatataatagagacgtccaattcagagaacgggacatgctatcccggtgaattcatagattatgagga

SEQ ID NO: 206292 - DNA, 75 bp, Artificial Sequence
  Synthetic
ggtcaaaatgaaatggggaatggagatgagacgttgcctccttcagtcactccagcagatcgagagcatgattga

SEQ ID NO: 206293 - DNA, 75 bp, Artificial Sequence
  Synthetic
tccagcagatcgagagcatgattgaagccgagtcctcagttaaagagaaagacatgaccaaagagttttttgaga

SEQ ID NO: 206294 - DNA, 75 bp, Artificial Sequence
  Synthetic
tccccaaggcaaattcatggccaaaccatgagacaaccaaaggtgttacagctgcttgctcctactctggggcta

SEQ ID NO: 206295 - DNA, 75 bp, Artificial Sequence
  Synthetic
ccatgagacaaccaaaggtgttacagctgcttgctcctactctggggctagcagtttttatcgaaatttgctgtg

SEQ ID NO: 206296 - DNA, 75 bp, Artificial Sequence
  Synthetic
tcacgctcaccgtgcccagtgagcgaggactgcagcgtagacgctttgttcaaaatgccctcaatgggaatggag

SEQ ID NO: 206297 - DNA, 75 bp, Artificial Sequence
  Synthetic
ggttccattgggaaagtctgtaggactctattggctaagtcagtattcaatagcctgtatgcatcaccacaattg

SEQ ID NO: 206298 - DNA, 75 bp, Artificial Sequence
  Synthetic
ctctattggctaagtcagtattcaatagcctgtatgcatcaccacaattggaaggattttcagcggagtcaagaa

SEQ ID NO: 206299 - DNA, 75 bp, Artificial Sequence
  Synthetic
acaataaggggaaagaagtgctcgtgctctggggagtgcaccatcctccgaccaccagtgaacaacaaagtctat

SEQ ID NO: 206300 - DNA, 75 bp, Artificial Sequence
  Synthetic
gctctggggagtgcaccatcctccgaccaccagtgaacaacaaagtctataccagaatactgatgcatacgtctc

SEQ ID NO: 206301 - DNA, 75 bp, Artificial Sequence
  Synthetic
gacccaaagttagagggcaggcaggcaggatgaactattattggacactattagaccaagaggacaccataacat

SEQ ID NO: 206302 - DNA, 75 bp, Artificial Sequence
  Synthetic
caggatgaactattattggacactattagaccaagaggacaccataacatttgaggccactggaaatctgatagc

SEQ ID NO: 206303 - DNA, 75 bp, Artificial Sequence
  Synthetic
atgcgtcttggttcaactccttcctgacacatgcattaaaatagttatggcagtgctactatttgttatccgtac

SEQ ID NO: 206304 - DNA, 75 bp, Artificial Sequence
  Synthetic
ttgacaacaaacattcaaatggcacaatacacgatagaatccctcatcgaacccttttgatgaatgagttaggtg

SEQ ID NO: 206305 - DNA, 75 bp, Artificial Sequence
  Synthetic
cccactgcagggccactgaatacataatgaagggagtgtatataaatacagctctgctcaatgcatcctgtgcgg

SEQ ID NO: 206306 - DNA, 75 bp, Artificial Sequence
  Synthetic
acccttttgatgaatgagttaggtgttccatttcatttgggaaccaaacaggtatgcatagcatggtctagctca

SEQ ID NO: 206307 - DNA, 75 bp, Artificial Sequence
  Synthetic
catcagatgctccagttcacaattgcgacacaagatgccaaaccccccacggagcgttgaacagtagccttcctt

SEQ ID NO: 206308 - DNA, 75 bp, Artificial Sequence
  Synthetic
ggtatgcatagcatggtctagctcaagttgccatgacgggaaagcatggttgcacgtttgtgtcactggggatga

SEQ ID NO: 206309 - DNA, 75 bp, Artificial Sequence
  Synthetic
aatgataagcaaatgcaggaccaaagaagggagacggaaaacaaatctgtatggattcatcataaaaggaagatc

SEQ ID NO: 206310 - DNA, 75 bp, Artificial Sequence
  Synthetic
tcagtgactatgaagggagactgatccagaacagcataacaatagagagaatggtactttctgcatttgatgaaa

SEQ ID NO: 206311 - DNA, 75 bp, Artificial Sequence
  Synthetic
cgacacaagatgccaaaccccccacggagcgttgaacagtagccttccttttcagaatgtgcatcctatcaccat

SEQ ID NO: 206312 - DNA, 75 bp, Artificial Sequence
  Synthetic
gactaagaaatgtcccatccattcaatccagaggactatttggagcaattgccggattcattgaaggaggatgga

SEQ ID NO: 206313 - DNA, 75 bp, Artificial Sequence
  Synthetic
atccagaggactatttggagcaattgccggattcattgaaggaggatggacaggcatgatagatggctggtatgg

SEQ ID NO: 206314 - DNA, 75 bp, Artificial Sequence
  Synthetic
gatgatgactaattcgcaagacacagagctctccttcacaattactggggacaacaccaagtggaatgaaaatca

SEQ ID NO: 206315 - DNA, 75 bp, Artificial Sequence
  Synthetic
tgttgaacgaagcaaagcctacagcaactgttacccttatgatgtgccggattatgcctcccttaggtcactagt

SEQ ID NO: 206316 - DNA, 75 bp, Artificial Sequence
  Synthetic
aactgttacccttatgatgtgccggattatgcctcccttaggtcactagttgcctcatccggcacactggagttt

SEQ ID NO: 206317 - DNA, 75 bp, Artificial Sequence
  Synthetic
gcacacagaatgcaattgatggaataacaaataaggtgaattcggtaattgaaaaaatgaacactcaattcactg

SEQ ID NO: 206318 - DNA, 75 bp, Artificial Sequence
  Synthetic
aacaaataaggtgaattcggtaattgaaaaaatgaacactcaattcactgcagtgggtaaagaattcaacaacct

SEQ ID NO: 206319 - DNA, 75 bp, Artificial Sequence
  Synthetic
agtttctttagtagattaaattggttgacccacttaaacttcaaatacccagcattgaacgtgactatgccaaac

SEQ ID NO: 206320 - DNA, 75 bp, Artificial Sequence
  Synthetic
atgtttggacatacaatgctgaactgctcgttttactggaaaatgaaagaactcttgactttcatgattccaatg

SEQ ID NO: 206321 - DNA, 75 bp, Artificial Sequence
  Synthetic
actcttgactttcatgattccaatgtgaggagtttgtatgagagagtcaaatcacaactgaggaataacgccaaa

SEQ ID NO: 206322 - DNA, 75 bp, Artificial Sequence
  Synthetic
gagggatcaacgaccggaatttctggagaggcgaaaatggaagaagaacaaggattgcatatgagagaatgtgca

SEQ ID NO: 206323 - DNA, 75 bp, Artificial Sequence
  Synthetic
ggagatgatgtttggatgggaagaacaatcagtaaagattctcgctcaggctatgagacctttagggtcattggt

SEQ ID NO: 206324 - DNA, 75 bp, Artificial Sequence
  Synthetic
tctatcacaagtgtgatgatgaatgtatggaaagtgtgaagaacggcacatatgattatcccaaatattcagaag

SEQ ID NO: 206325 - DNA, 75 bp, Artificial Sequence
  Synthetic
tatggaaagtgtgaagaacggcacatatgattatcccaaatattcagaagagtctaggttgaatcgagaagaaat

SEQ ID NO: 206326 - DNA, 75 bp, Artificial Sequence
  Synthetic
atgatgccacatatcagaggacaagggcacttgtgcgtactgggatggatcccaggatgtgctctctgatgcaag

SEQ ID NO: 206327 - DNA, 75 bp, Artificial Sequence
  Synthetic
tacaggatttgcacctttttctaaggacaattcaattcggctttctgctggtggggacatctgggtgacaagaga

SEQ ID NO: 206328 - DNA, 75 bp, Artificial Sequence
  Synthetic
gttggaacaatggtgatggaattgatccggatgatcaagagagggatcaatgataggaatttctggagaggcgaa

SEQ ID NO: 206329 - DNA, 75 bp, Artificial Sequence
  Synthetic
cttgttagtctccctgggggcaatcagcttctggatgtgctctaatgggtcattgcaatgcagaatatgcattta

SEQ ID NO: 206330 - DNA, 75 bp, Artificial Sequence
  Synthetic
tcaaaacagccaggtcttcagtctcattaggccaaatgaaaatccagcacataagagccaattagtgtggatggc

SEQ ID NO: 206331 - DNA, 75 bp, Artificial Sequence
  Synthetic
atttccacttcattgatgagcggggcgaatcaataattgtggaatctggtgatccaaatgcattactgaagcacc

SEQ ID NO: 206332 - DNA, 75 bp, Artificial Sequence
  Synthetic
acattctctgtacagagaaacctcccatttgagagagcaaccattatggcagcatttacaggaaacactgaaggc

SEQ ID NO: 206333 - DNA, 75 bp, Artificial Sequence
  Synthetic
gctagtttcatttacaatgggaggcttgtagatagtattggttcatggtccaaaaatatactcagaacccaggag

SEQ ID NO: 206334 - DNA, 75 bp, Artificial Sequence
  Synthetic
tgcctgattaatgatccctgggttttgcttaatgcatcttggttcaactccttcctcacacatgcactgaaataa

SEQ ID NO: 206335 - DNA, 75 bp, Artificial Sequence
  Synthetic
aagtagatattgggctataagaaccagaagcggagggaacaccaatcaacagagggcatctgcaggacagatcag

SEQ ID NO: 206336 - DNA, 75 bp, Artificial Sequence
  Synthetic
gaaatctcaccattaccttctcttccaggacatactgatgaggatgtcaaaaatgcaattggggtcctcatcgga

SEQ ID NO: 206337 - DNA, 75 bp, Artificial Sequence
  Synthetic
aattgagtcagaagtttgaagaaataagatggctgattgaagaagtgcgacatagattgaagattacagagaaca

SEQ ID NO: 206338 - DNA, 75 bp, Artificial Sequence
  Synthetic
gtgcctgcttcacgctacctaactgacatgactcttgaagaaatgtcaagagactggttcatgctcatgcccaag

SEQ ID NO: 206339 - DNA, 75 bp, Artificial Sequence
  Synthetic
gagaacagaatggtactggccagtactacggctaaggccatggagcaaatggcagggtcaagtgagcaggcagca

SEQ ID NO: 206340 - DNA, 75 bp, Artificial Sequence
  Synthetic
acatgactcttgaagaaatgtcaagagactggttcatgctcatgcccaagcagaaagtggcaggctccctctgta

SEQ ID NO: 206341 - DNA, 75 bp, Artificial Sequence
  Synthetic
gggcaatggttgtttcaaaatataccacaaatgtgacaatgcctgcataggatcaatcagaaatggaacttatga

SEQ ID NO: 206342 - DNA, 75 bp, Artificial Sequence
  Synthetic
aatgtgcactgaactcaaactcagtgattatgagggacgactaatccagaatagcataacaatagagaggatggt

SEQ ID NO: 206343 - DNA, 75 bp, Artificial Sequence
  Synthetic
tcttctctttgcaacaatcagcattgtcaaaagcgatcatatttgcattggttatcatgcaaataactcgacaga

SEQ ID NO: 206344 - DNA, 75 bp, Artificial Sequence
  Synthetic
ttaaacaaccggttccagatcaagggagttgagctgaagtcagggtacaaagattggatcctatggatttccttt

SEQ ID NO: 206345 - DNA, 75 bp, Artificial Sequence
  Synthetic
gaagtatgcttcatgtattcagatttccacttcatcaatgagcaaggcgagtcaataatcgtagaacttggtgat

SEQ ID NO: 206346 - DNA, 75 bp, Artificial Sequence
  Synthetic
tccacttcatcaatgagcaaggcgagtcaataatcgtagaacttggtgatcctaatgcacttttgaagcacagat

SEQ ID NO: 206347 - DNA, 75 bp, Artificial Sequence
  Synthetic
ttgctttgttggggttcatcatgtgggcctgccaaaagggcaacattaggtgcaacatttgcatttgagtgcatt

SEQ ID NO: 206348 - DNA, 75 bp, Artificial Sequence
  Synthetic
agtatttgcaacactacaggggctgagaaaccaaagtttctaccagatttgtatgattacaaggaaaatagattc

SEQ ID NO: 206349 - DNA, 75 bp, Artificial Sequence
  Synthetic
tggtgcacttgccagttgcatgggcctcatatacaacaggatggggactgtgaccactgaagtggcatttggcct

SEQ ID NO: 206350 - DNA, 75 bp, Artificial Sequence
  Synthetic
tctggtggacctcaaacagtattgttgtgttttgtggcacctcaggtacatatggaacaggctcatggcctgatg

SEQ ID NO: 206351 - DNA, 75 bp, Artificial Sequence
  Synthetic
ggccaataaaattaaatctgagaaaacacacatccacattttctcgttcactggggaagaaatggccacaaaggc

SEQ ID NO: 206352 - DNA, 75 bp, Artificial Sequence
  Synthetic
gtgtggcttatcaaaaaggacaatgcatacccaacaataaagaaaggctacaataataccaaccgagaagatctc

SEQ ID NO: 206353 - DNA, 75 bp, Artificial Sequence
  Synthetic
ttttttgaaaacaacaccacgaccacttagacttccgaatgggcctccctgttctcagcggtccaaattcctgct

SEQ ID NO: 206354 - DNA, 75 bp, Artificial Sequence
  Synthetic
cttagacttccgaatgggcctccctgttctcagcggtccaaattcctgctgatggatgccttaaaattaagcatt

SEQ ID NO: 206355 - DNA, 75 bp, Artificial Sequence
  Synthetic
aactgcaacaccaggtgtcagactccaataggagcgataaactctagtatgccattccacaacatacaccctctc

SEQ ID NO: 206356 - DNA, 75 bp, Artificial Sequence
  Synthetic
atgcatgagaacattctttggatggaaggaacccaatgttgttaaaccacacgaaaagggaataaatccaaatta

SEQ ID NO: 206357 - DNA, 75 bp, Artificial Sequence
  Synthetic
aaggaacccaatgttgttaaaccacacgaaaagggaataaatccaaattatcttctgtcatggaagcaagtactg

SEQ ID NO: 206358 - DNA, 75 bp, Artificial Sequence
  Synthetic
accaatgggacctccaagatcaagatgaaatggggtatggaaatgaggcgctgccttcttcagtctcttcaacag

SEQ ID NO: 206359 - DNA, 75 bp, Artificial Sequence
  Synthetic
agtcctgcctgcctgcttgtgtgtatggacttgcggtggccagtggatacgactttgaaagagagggatactccc

SEQ ID NO: 206360 - DNA, 75 bp, Artificial Sequence
  Synthetic
cttctgtcaaagaaaaggacatgactaaggaattctttgaaaacaagtcggaaacatggccaattggagaatccc

SEQ ID NO: 206361 - DNA, 75 bp, Artificial Sequence
  Synthetic
tatgaaaaaaacaagtcagctaaagtgggcacttggtgagaacatggcaccagaaaaggtagactttgacgactg

SEQ ID NO: 206362 - DNA, 75 bp, Artificial Sequence
  Synthetic
tgggcacttggtgagaacatggcaccagaaaaggtagactttgacgactgtaaagatgtaggtgatttgaagcaa

SEQ ID NO: 206363 - DNA, 75 bp, Artificial Sequence
  Synthetic
tgagttcaacaaggcatgcgaactgacagattcaagctggatagagcttgatgagattggagaagatgtggctcc

SEQ ID NO: 206364 - DNA, 75 bp, Artificial Sequence
  Synthetic
acagattcaagctggatagagcttgatgagattggagaagatgtggctccaattgaacacattgcaagcatgaga

SEQ ID NO: 206365 - DNA, 75 bp, Artificial Sequence
  Synthetic
agcaaaagcaggggaatttcacaatcaaccaagatggaaacaacaacaataatagctatactgctaatggtaact

SEQ ID NO: 206366 - DNA, 75 bp, Artificial Sequence
  Synthetic
aatgaagggggtgtacatcaatactgccttacttaatgcatcttgtgcagcaatggatgatttccaattaattcc

SEQ ID NO: 206367 - DNA, 75 bp, Artificial Sequence
  Synthetic
aatagctatactgctaatggtaactgcaagcaatgcagataaaatctgcattggctaccagtcaacaaactccac

SEQ ID NO: 206368 - DNA, 75 bp, Artificial Sequence
  Synthetic
caatggatgatttccaattaattccaatgataagcaagtgtagaactaaggagggaaggcgaaagaccaacttgt

SEQ ID NO: 206369 - DNA, 75 bp, Artificial Sequence
  Synthetic
aggataatgcaaaagagctgggaaacggttgtttcgagttctatcacaaatgtaataatgaatgtatggaaagtg

SEQ ID NO: 206370 - DNA, 75 bp, Artificial Sequence
  Synthetic
gcaagcaatgcagataaaatctgcattggctaccagtcaacaaactccacagagactgttgatacactaatagaa

SEQ ID NO: 206371 - DNA, 75 bp, Artificial Sequence
  Synthetic
caatggactccagtactcttgaactaaggagcagatactgggctataaggacaaggagtgggggaaacactaatc

SEQ ID NO: 206372 - DNA, 75 bp, Artificial Sequence
  Synthetic
tggaatgctatgcgcaacagatctgggatatcctctcattctagacacttgcaccatcgaagggctagtctatgg

SEQ ID NO: 206373 - DNA, 75 bp, Artificial Sequence
  Synthetic
ggatatcctctcattctagacacttgcaccatcgaagggctagtctatggcaacccttcttgtgatctgctattg

SEQ ID NO: 206374 - DNA, 75 bp, Artificial Sequence
  Synthetic
gtaaactttgtgagcatggagttttctctcactgacccaagacttgaaccacacaaatgggagaagtactgtgtt

SEQ ID NO: 206375 - DNA, 75 bp, Artificial Sequence
  Synthetic
acccgatcgtgccttcctttgacatgagtaatgaaggatcttatttcttcggagacaatgcagaggagtatgaca

SEQ ID NO: 206376 - DNA, 75 bp, Artificial Sequence
  Synthetic
aatgtgttatcctgggaatgtagagaacctagaagaactcaggtcttttttcagttttgctaattcatatcaaag

SEQ ID NO: 206377 - DNA, 75 bp, Artificial Sequence
  Synthetic
atccggaatctccacattccggaagtctgcttgaaatgggagctaatggacgaagactatcagggaaggctttgc

SEQ ID NO: 206378 - DNA, 75 bp, Artificial Sequence
  Synthetic
ggtccaaactataaaaatggaaagaatagtgattgccctcgcaataatcagcattgtcaaaggtgaccaaatctg

SEQ ID NO: 206379 - DNA, 75 bp, Artificial Sequence
  Synthetic
gcattgtcaaaggtgaccaaatctgcattggttatcatgcaaacaattcaacagagcaggttgatacaatcatgg

SEQ ID NO: 206380 - DNA, 75 bp, Artificial Sequence
  Synthetic
cattggttatcatgcaaacaattcaacagagcaggttgatacaatcatggagaagaatgtgacggtcacacatgc

SEQ ID NO: 206381 - DNA, 75 bp, Artificial Sequence
  Synthetic
gcccatgttcttgtatgtgaggacaaatggaacctcaaaaattaaaatgaaatggggaatggagatgaggcgttg

SEQ ID NO: 206382 - DNA, 75 bp, Artificial Sequence
  Synthetic
cagaagcatgagatggctgactcataagagcaattcttaccccgttcaagacgctcaatacactaacaatgaggg

SEQ ID NO: 206383 - DNA, 75 bp, Artificial Sequence
  Synthetic
agagttctttgagaacaaatcagaaacatggcccattggagagtctcccaaaggagtggaggaaagttccattgg

SEQ ID NO: 206384 - DNA, 75 bp, Artificial Sequence
  Synthetic
gaaggtctgcaggactttattagcaaagtcggtatttaacagcttgtatgcatctccacaactagaaggattttc

SEQ ID NO: 206385 - DNA, 75 bp, Artificial Sequence
  Synthetic
gagtgaggcccctcattctgaaggattgcagtgtagctggatggcttcttggaaacccaatgtgtgatgaattcc

SEQ ID NO: 206386 - DNA, 75 bp, Artificial Sequence
  Synthetic
tgcttttggtctagtgtgtgccacttgtgaacagattgctgattcacagcatcggtctcacagacaaatggctac

SEQ ID NO: 206387 - DNA, 75 bp, Artificial Sequence
  Synthetic
tccaatactttagagctgagaagcagatactgggccataaggaccagaagtggaggaaataccaatcaacaaaaa

SEQ ID NO: 206388 - DNA, 75 bp, Artificial Sequence
  Synthetic
ttgcagtgtagctggatggcttcttggaaacccaatgtgtgatgaattcctgaatgtaccggaatggtcatacat

SEQ ID NO: 206389 - DNA, 75 bp, Artificial Sequence
  Synthetic
gcatccgctggccagatcagtgtgcaacctacattctcagtgcaacggaatctcccttttgaaagagcaaccgtt

SEQ ID NO: 206390 - DNA, 75 bp, Artificial Sequence
  Synthetic
tgatacaacaacaagcgtgacaacagaagatataaatcgaactttcaagccagtgataggaccaagaccccttgt

SEQ ID NO: 206391 - DNA, 75 bp, Artificial Sequence
  Synthetic
atgattacgaagaactgaagcatttaatgagcagcacaaaccattttgagaaaattcagataattcctaggagtt

SEQ ID NO: 206392 - DNA, 75 bp, Artificial Sequence
  Synthetic
aagagcaattcttaccccgttcaagacgctcaatacactaacaatgagggaaagaacattctcttcatgtggggc

SEQ ID NO: 206393 - DNA, 75 bp, Artificial Sequence
  Synthetic
gaagatataaatcgaactttcaagccagtgataggaccaagaccccttgtaaacggacagcaggggagaattgac

SEQ ID NO: 206394 - DNA, 75 bp, Artificial Sequence
  Synthetic
tttggtccaatcatgatgcctcatcaggagtaagttcggcatgcccatacaatggcagatcttcctttttcagga

SEQ ID NO: 206395 - DNA, 75 bp, Artificial Sequence
  Synthetic
tgggaatctgattgcaccatggtatgggcacattctttcaggagaaagccatggcagaatcttgaagactgattt

SEQ ID NO: 206396 - DNA, 75 bp, Artificial Sequence
  Synthetic
gggcacattctttcaggagaaagccatggcagaatcttgaagactgatttgaatagtggcaactgcgtagtgcaa

SEQ ID NO: 206397 - DNA, 75 bp, Artificial Sequence
  Synthetic
ttcactacccaaaggtatataaaacttatttcgaaaaagttgaaaggttgaaacacgggacctttggccctgtac

SEQ ID NO: 206398 - DNA, 75 bp, Artificial Sequence
  Synthetic
acctacaacaacaccaatgtagaagaccttttaataatatggggaattcaccaccctaatgatgcagctgaacaa

SEQ ID NO: 206399 - DNA, 75 bp, Artificial Sequence
  Synthetic
accttttaataatatggggaattcaccaccctaatgatgcagctgaacaaacaaaactctatcagaactcgaaca

SEQ ID NO: 206400 - DNA, 75 bp, Artificial Sequence
  Synthetic
cagcaaatatgcatttgggaattgccccaaatacgttggagtcaagagtctcaaattggcagttggtttgaggaa

SEQ ID NO: 206401 - DNA, 75 bp, Artificial Sequence
  Synthetic
catgagggaagaatatcaacaggaacagcagaatgctgtggatgttgacgatggtcattttgtcaacatagagct

SEQ ID NO: 206402 - DNA, 75 bp, Artificial Sequence
  Synthetic
cccaaatacgttggagtcaagagtctcaaattggcagttggtttgaggaacgtacctgctgcatcagatagaggg

SEQ ID NO: 206403 - DNA, 75 bp, Artificial Sequence
  Synthetic
ctggccagcactacagctaaagctatggagcagatggcgggatcaagtgagcaggcagcagaagccatggagatc

SEQ ID NO: 206404 - DNA, 75 bp, Artificial Sequence
  Synthetic
atagccactagacccaaagtaaacgggcaaagtggaagaatggaatttttctggacaatactgaggccgaatgat

SEQ ID NO: 206405 - DNA, 75 bp, Artificial Sequence
  Synthetic
ggcaaagtggaagaatggaatttttctggacaatactgaggccgaatgatgcaatcagctttgaaagcaatggga

SEQ ID NO: 206406 - DNA, 75 bp, Artificial Sequence
  Synthetic
tgctggctggtatggtttccagcattcaaatgaccagggaactggaatggctgcagatagagaatcaactcaaga

SEQ ID NO: 206407 - DNA, 75 bp, Artificial Sequence
  Synthetic
tcaaatgaccagggaactggaatggctgcagatagagaatcaactcaagaggcagttgacaaaataacgtccaaa

SEQ ID NO: 206408 - DNA, 75 bp, Artificial Sequence
  Synthetic
gcaatcatgagaagtgaattggagtatggtaactgtgacaccaaatgtcagaccccagtgggagctataaattcc

SEQ ID NO: 206409 - DNA, 75 bp, Artificial Sequence
  Synthetic
gaagagtaccggcaggaacagcagaatgctgtggatgttgacgatggtcattttgtcaacatagaattggagtaa

SEQ ID NO: 206410 - DNA, 75 bp, Artificial Sequence
  Synthetic
atggtaactgtgacaccaaatgtcagaccccagtgggagctataaattccagtatgccattccacaatgttcatc

SEQ ID NO: 206411 - DNA, 75 bp, Artificial Sequence
  Synthetic
tgaattcagtgaaattgaagccaggctcaatatgattaacaacaagattgatgatcaaatacaagacatttgggc

SEQ ID NO: 206412 - DNA, 75 bp, Artificial Sequence
  Synthetic
ctcaatatgattaacaacaagattgatgatcaaatacaagacatttgggcttacaatgcagaattgctagtactg

SEQ ID NO: 206413 - DNA, 75 bp, Artificial Sequence
  Synthetic
cttgcaacaggactaagaaacgttccccaaagagaaacaagaggactatttggagcaatagcaggattcatagaa

SEQ ID NO: 206414 - DNA, 75 bp, Artificial Sequence
  Synthetic
cccaaagagaaacaagaggactatttggagcaatagcaggattcatagaaggaggatggcaaggaatggttgatg

SEQ ID NO: 206415 - DNA, 75 bp, Artificial Sequence
  Synthetic
gaaacacgggacctttggccctgttcacttcagaaatcaagttaaaataagacggagggttgacataaaccctgg

SEQ ID NO: 206416 - DNA, 75 bp, Artificial Sequence
  Synthetic
atataacaaggtgaaaagagcattgggttctaatgcagtagaagatggaaatggatgctttgaattgtaccataa

SEQ ID NO: 206417 - DNA, 75 bp, Artificial Sequence
  Synthetic
atggatgctttgaattgtaccataaatgtgatgatcaatgtatggaaacgattagaaacgggacctatgacaaac

SEQ ID NO: 206418 - DNA, 75 bp, Artificial Sequence
  Synthetic
agccatggaacagggacagggtacaccatggacacagtcaacagaacacaccaatattcagaaaagggggagtgg

SEQ ID NO: 206419 - DNA, 75 bp, Artificial Sequence
  Synthetic
gacaaagaatctacccagaaagcaatcgatgggatcaccaataaagtaaactcaatcattgacaaaatgaacact

SEQ ID NO: 206420 - DNA, 75 bp, Artificial Sequence
  Synthetic
tcgatgggatcaccaataaagtaaactcaatcattgacaaaatgaacactcaattcgaagccgttgggaaagaat

SEQ ID NO: 206421 - DNA, 75 bp, Artificial Sequence
  Synthetic
gggtttgctgcctttctattctgggccatgtcaaacggatcttgcagatgcaacatttgtatataattagcaaaa

SEQ ID NO: 206422 - DNA, 75 bp, Artificial Sequence
  Synthetic
gggtttttagatgtatggacttacaatgcagaacttcttgtgctcatggaaaatgagagaactttggacttccat

SEQ ID NO: 206423 - DNA, 75 bp, Artificial Sequence
  Synthetic
atgcagaacttcttgtgctcatggaaaatgagagaactttggacttccatgattcaaatgtcaagaacctatacg

SEQ ID NO: 206424 - DNA, 75 bp, Artificial Sequence
  Synthetic
ggctggatcgagtgaacaggcagcagaggccatggaggttgctaatcagactaggcagatggtgcatgcaatgag

SEQ ID NO: 206425 - DNA, 75 bp, Artificial Sequence
  Synthetic
atgttgtgagaaagatgatgactaattcacaagacacagagctttctttcacaatcactggggacaacactaaat

SEQ ID NO: 206426 - DNA, 75 bp, Artificial Sequence
  Synthetic
tagatttcctcaaggatgtgatggaatcaatggataaggaagaaatggagataacaacacatttccagagaaaga

SEQ ID NO: 206427 - DNA, 75 bp, Artificial Sequence
  Synthetic
aaggcaaccagaaggctgatccagctaatagtaagtggaagggacgagcaatcaattgccgaagcaataattgtg

SEQ ID NO: 206428 - DNA, 75 bp, Artificial Sequence
  Synthetic
tgctttgaattctaccacaagtgtgacaatgaatgcatggaaagtgtgagaaatggaacgtatgactatccgcaa

SEQ ID NO: 206429 - DNA, 75 bp, Artificial Sequence
  Synthetic
acaatgaatgcatggaaagtgtgagaaatggaacgtatgactatccgcaatattcggaagaatcaagactgaaca

SEQ ID NO: 206430 - DNA, 75 bp, Artificial Sequence
  Synthetic
gcatgattaaggcagttcgaggtgacctgaatttcgtcaatagggcgaaccagcggctgaacccaatgcatcaac

SEQ ID NO: 206431 - DNA, 75 bp, Artificial Sequence
  Synthetic
ctatcaatctactcaacagtggcgagttccctagcactggcaatcatgatagctggtctatctttttggatgtgc

SEQ ID NO: 206432 - DNA, 75 bp, Artificial Sequence
  Synthetic
agctggtctatctttttggatgtgctccaatggatcattgcagtgcagaatttgcatctagagctgtgagttcag

SEQ ID NO: 206433 - DNA, 75 bp, Artificial Sequence
  Synthetic
accgaggtcgaaacgtacgttctctctatcgtcccgtcaggccccctcaaagccgagatcgcgcagagacttgaa

SEQ ID NO: 206434 - DNA, 75 bp, Artificial Sequence
  Synthetic
attggccaacaccatagaagtctttagatcgaatggcctaacagctaatgagtcaggaaggctaatagatttctt

SEQ ID NO: 206435 - DNA, 75 bp, Artificial Sequence
  Synthetic
aatcaattgctgaagcaataattgtggccatggtattttcacaagaggattgcatgatcaaggcagttcgaggtg

SEQ ID NO: 206436 - DNA, 75 bp, Artificial Sequence
  Synthetic
ctgactaaggggattttaggatttgtgttcacgctcaccgtgcccagtgagcgaggactgcagcgtagacgcttt

SEQ ID NO: 206437 - DNA, 75 bp, Artificial Sequence
  Synthetic
gcgaggactgcagcgtagacgctttgtccaaaatgccctcaatgggaatggggatccaaacaacatggacagagc

SEQ ID NO: 206438 - DNA, 75 bp, Artificial Sequence
  Synthetic
atcccggtgtcagatgtgtttgcagagacaactggaaaggctccaataggcccatcgtagatattaatataaaag

SEQ ID NO: 206439 - DNA, 75 bp, Artificial Sequence
  Synthetic
aaaggcaatgaaagaatatggggaagatccgaaaatcgaaacaaacaaattcgcatcaatatgcacacacttaga

SEQ ID NO: 206440 - DNA, 75 bp, Artificial Sequence
  Synthetic
agagcaatgatggatcaagtgcgagagagcagaaatcctgggaatgctgaaattgaagatcttatttttctggca

SEQ ID NO: 206441 - DNA, 75 bp, Artificial Sequence
  Synthetic
tgataaacaatgatcttggacctgcaacagcccagatggcccttcaattgttcatcaaagactacagatacacat

SEQ ID NO: 206442 - DNA, 75 bp, Artificial Sequence
  Synthetic
ggagtaacagtgataaagaacaacatgataaacaatgatcttggacctgcaacagcccagatggcccttcaattg

SEQ ID NO: 206443 - DNA, 75 bp, Artificial Sequence
  Synthetic
ttcatcaaagactacagatacacatatagatgccatagaggggacacacaaattcagacgagaagatcattcgag

SEQ ID NO: 206444 - DNA, 75 bp, Artificial Sequence
  Synthetic
tgaccactgaagtggcatttggcctggtgtgtgccacgtgcgagcagattgctgattcccagcatcggtctcaca

SEQ ID NO: 206445 - DNA, 75 bp, Artificial Sequence
  Synthetic
ggagtagatgaatactccagcacagagagagtggttgtgagcattgaccgatttttaagagtccgggaccaacgg

SEQ ID NO: 206446 - DNA, 75 bp, Artificial Sequence
  Synthetic
acgggctccaatcctctgatgatttcgctcttattgtaaatgccccgaatcatgaaggaatacaagcaggggtgg

SEQ ID NO: 206447 - DNA, 75 bp, Artificial Sequence
  Synthetic
ccatggagcaaatggcagggtcaagtgagcaggcagcagaggctatggaggttgctagtcaggctagacagatgg

SEQ ID NO: 206448 - DNA, 75 bp, Artificial Sequence
  Synthetic
tcatcctagctccagtgctggtctgaaagatgatcttcttgaaaatttgcaggcctaccagaagcggatgggagt

SEQ ID NO: 206449 - DNA, 75 bp, Artificial Sequence
  Synthetic
ggtagtccttaatattctcctacatatagttagcattacagtaacagtgttagttcttcctggaaatggaaataa

SEQ ID NO: 206450 - DNA, 75 bp, Artificial Sequence
  Synthetic
gggatcttgcacttgatattgtggattcttgatcgtcttttcttcaaatgcatttatcgtcgccttaaatacggt

SEQ ID NO: 206451 - DNA, 75 bp, Artificial Sequence
  Synthetic
tctcgttattgccgcaagtatcattgggatcttgcacttgatattgtggattcttgatcgtcttttcttcaaatg

SEQ ID NO: 206452 - DNA, 75 bp, Artificial Sequence
  Synthetic
accgaggtcgaaacgtacgttctctctatcgtcccgtcaggccccctcaaagccgagatcgcacagagacttgaa

SEQ ID NO: 206453 - DNA, 75 bp, Artificial Sequence
  Synthetic
ccatgcgcaggcttgccgaccaaagtctcccaccgaacttctccagccttgaaaactttagagcctatgtggatg

SEQ ID NO: 206454 - DNA, 75 bp, Artificial Sequence
  Synthetic
aaacgaatcagctgacatgagtattggagtaacagtgataaagaacaacatgataaacaatgaccttggacctgc

SEQ ID NO: 206455 - DNA, 75 bp, Artificial Sequence
  Synthetic
acaatacagaagcattgtgtgatgccaaggggtttgcacccttttccaaagacaatggaataagaattggatcga

SEQ ID NO: 206456 - DNA, 75 bp, Artificial Sequence
  Synthetic
tcttgaaagttccagcgcaaaatgccataagcaccacattcccgtacactggagatcctccatacagccatggaa

SEQ ID NO: 206457 - DNA, 75 bp, Artificial Sequence
  Synthetic
atgggaagaaatggatgacaattggagtaacgggccctgatgccaaagcagtagcagtggtgcattatgggggaa

SEQ ID NO: 206458 - DNA, 75 bp, Artificial Sequence
  Synthetic
gaaattctttcccagtagttcgtatcggagaccagttggaatttccagtatggtggaggccatggtgtctcgggc

SEQ ID NO: 206459 - DNA, 75 bp, Artificial Sequence
  Synthetic
gcgacgagttcatcagagtgccggaatggtcttacatagtggagagggctaacccagccaatgacctctgttacc

SEQ ID NO: 206460 - DNA, 75 bp, Artificial Sequence
  Synthetic
gaatcatcatgcacttgcattcaaggtgaatgttattgggtaatgacggatggaccagcaaacagacaagcacaa

SEQ ID NO: 206461 - DNA, 75 bp, Artificial Sequence
  Synthetic
aaatatattcaatatggaacgaataaaagaattaagagatctaatgtcacagtcccgcactcgcgagatactaac

SEQ ID NO: 206462 - DNA, 75 bp, Artificial Sequence
  Synthetic
aaagaattaagagatctaatgtcacagtcccgcactcgcgagatactaacaaaaaccactgtggaccatatggcc

SEQ ID NO: 206463 - DNA, 75 bp, Artificial Sequence
  Synthetic
agtcccgcactcgcgagatactaacaaaaaccactgtggaccatatggccataatcaagaaatacacatcaggaa

SEQ ID NO: 206464 - DNA, 75 bp, Artificial Sequence
  Synthetic
attatctcctggcttggaagcaagtgttagcagaactacaggatattgaaaacgaggagaaaattccaaaaacga

SEQ ID NO: 206465 - DNA, 75 bp, Artificial Sequence
  Synthetic
cgagatactaacaaaaaccactgtggaccatatggccataatcaagaaatacacatctgggaggcaggagaagaa

SEQ ID NO: 206466 - DNA, 75 bp, Artificial Sequence
  Synthetic
aagacaaacgatgctgggtcggacagggtgatggtgtcccccctagctgtaacttggtggaataggaatgggcct

SEQ ID NO: 206467 - DNA, 75 bp, Artificial Sequence
  Synthetic
tgtagtgaattttgtgagcatggagttttctcttactgatcctagactagagccacataaatgggagaaatactg

SEQ ID NO: 206468 - DNA, 75 bp, Artificial Sequence
  Synthetic
ctcgggcagaagaagtacaccaaaaccacatattggtgggatggactccaatcctcagatgacttcgccctcata

SEQ ID NO: 206469 - DNA, 75 bp, Artificial Sequence
  Synthetic
attgaacccatcgacagtgtaatgggaatgatcgggatattgcctgatatgaccccaagcacggaaatgtcgctg

SEQ ID NO: 206470 - DNA, 75 bp, Artificial Sequence
  Synthetic
actgcagtaggccaagtgtcaagacccatgtttctgtatgtgagaaccaatgggacctccaagatcaagatgaaa

SEQ ID NO: 206471 - DNA, 75 bp, Artificial Sequence
  Synthetic
tacaaaccctggccatgctgatctcagtgctaaagaagcacaagatgtcatcatggaagttgttttcccaaatga

SEQ ID NO: 206472 - DNA, 75 bp, Artificial Sequence
  Synthetic
acaagaaaccaacctgaatggttcaggaatgtcttgagcattgcacctataatgttctcaaataaaatggcaaga

SEQ ID NO: 206473 - DNA, 75 bp, Artificial Sequence
  Synthetic
caccaaatgtcaaactccaataggggcgataaactctagtatgccattccacaatatacaccctctcactatcgg

SEQ ID NO: 206474 - DNA, 75 bp, Artificial Sequence
  Synthetic
tccaaatcaaaagataataaccattgggtcaatctgcatggtaattggaataataagtctggtgctacaaattgg

SEQ ID NO: 206475 - DNA, 75 bp, Artificial Sequence
  Synthetic
ggagtggaggaaggttccatcgggaaggtgtgcagaaccttactagcaaaatctgtattcaacagcctatatgca

SEQ ID NO: 206476 - DNA, 75 bp, Artificial Sequence
  Synthetic
actaccccgaaacatgcaatcaaagtgtcattaactacgaaaataatacttgggtgaatcagacatacatcaaca

SEQ ID NO: 206477 - DNA, 75 bp, Artificial Sequence
  Synthetic
gcaggtaattcttctctctgtcccatcagtggatgggctatatacagcaaggataacggtataagaataggttcc

SEQ ID NO: 206478 - DNA, 75 bp, Artificial Sequence
  Synthetic
aaattggtgggataaggatggtggacatccttaggcaaaatccaactgaggaacaagctgtggatatatgcagag

SEQ ID NO: 206479 - DNA, 75 bp, Artificial Sequence
  Synthetic
cagaacctgcaagctggtcggaatcaacatgagcaaaaagaagtcctacataaacaggacaggaacatttgaatt

SEQ ID NO: 206480 - DNA, 75 bp, Artificial Sequence
  Synthetic
ggaatgcaggaccttctttctaactcagggggcattgttgaatgacaagcattccaatggaaccgttaaagacag

SEQ ID NO: 206481 - DNA, 75 bp, Artificial Sequence
  Synthetic
ttcaaaagaacaagtgggtcatccgtcacgaaggaagaggaagtgcttacgggcaacctccaaacattgaaaata

SEQ ID NO: 206482 - DNA, 75 bp, Artificial Sequence
  Synthetic
aagccaacaagataaaatctgaaaagacacacattcacatcttttcatttactggagaagaaatggccaccaaag

SEQ ID NO: 206483 - DNA, 75 bp, Artificial Sequence
  Synthetic
atcctttagttttgggggtttcactttcaaaagaacaagtgggtcatccgtcacgaaggaagaggaagtgcttac

SEQ ID NO: 206484 - DNA, 75 bp, Artificial Sequence
  Synthetic
tgtcccgttggtgaagctccttccccatacaactcaagatttgagtctgttgcttggtcagcaagcgcttgtcat

SEQ ID NO: 206485 - DNA, 75 bp, Artificial Sequence
  Synthetic
tcacaatggttgggcagagggcaacagctatcctgaggaaagcaactaggaggctgattcagctgatagtaagcg

SEQ ID NO: 206486 - DNA, 75 bp, Artificial Sequence
  Synthetic
ggcaatcattgtagcgatggtgttctcacaggaggattgtatggtaaaggcagtccgaggcgatctaaatttcgt

SEQ ID NO: 206487 - DNA, 75 bp, Artificial Sequence
  Synthetic
tacacatcaggaaggcaagagaagaaccctgcactcaggatgaagtggatgatggcaatgaaatatccaatcaca

SEQ ID NO: 206488 - DNA, 75 bp, Artificial Sequence
  Synthetic
caattggctctgtttctctcatcattgccacaatatgcttccttatgcaaattgccatcctggtaactactgtaa

SEQ ID NO: 206489 - DNA, 75 bp, Artificial Sequence
  Synthetic
ataataacagataccatcaagagttggaggaacaacatattgagaacacaagagtctgaatgtgcctgtattaat

SEQ ID NO: 206490 - DNA, 75 bp, Artificial Sequence
  Synthetic
ctgaagaagctgtgggaacaaacccgttcaaaggcaggactactggtctcagatggagggccaaatctatacaat

SEQ ID NO: 206491 - DNA, 75 bp, Artificial Sequence
  Synthetic
ttcaaaaggacgcaaaggtgctatttcagaattggggaattgaacccattgataatgtcatggggatgatcggga

SEQ ID NO: 206492 - DNA, 75 bp, Artificial Sequence
  Synthetic
atacaagatcttcaagatagaaaaggggagggtagtcaaatcagttgagttgaatgcccctaattaccactatga

SEQ ID NO: 206493 - DNA, 75 bp, Artificial Sequence
  Synthetic
atgctgtgtgaaccaacaataatagaaagaaacacaacagagattgtgtatttgaccaacaccaccatagagaag

SEQ ID NO: 206494 - DNA, 75 bp, Artificial Sequence
  Synthetic
gggagggtagtcaaatcagttgagttgaatgcccctaattaccactatgaggagtgctcctgttatcctgatgct

SEQ ID NO: 206495 - DNA, 75 bp, Artificial Sequence
  Synthetic
agaactgtcactgagaggagtgagagttagtaaaatgggagtggatgaatattccagcactgaaagagtagttgt

SEQ ID NO: 206496 - DNA, 75 bp, Artificial Sequence
  Synthetic
atgggtgtccttcaatcagaacttagaatatcaaataggatacatatgcagcggaatttttggagataacccgcg

SEQ ID NO: 206497 - DNA, 75 bp, Artificial Sequence
  Synthetic
gaatatcaaataggatacatatgcagcggaatttttggagataacccgcgccccaatgatggaacaggcagttgt

SEQ ID NO: 206498 - DNA, 75 bp, Artificial Sequence
  Synthetic
ccgcagggtcgacataaacccaggccatgcagatcttagtgctaaagaagcacaagatgtcatcatggaggtcgt

SEQ ID NO: 206499 - DNA, 75 bp, Artificial Sequence
  Synthetic
catgcagatcttagtgctaaagaagcacaagatgtcatcatggaggtcgtattcccaaacgaagttggagccaga

SEQ ID NO: 206500 - DNA, 75 bp, Artificial Sequence
  Synthetic
atacggtaatggtgtttggataggaagaactaagagcactagctcaaggagtgggtttgagatgatttgggatcc

SEQ ID NO: 206501 - DNA, 75 bp, Artificial Sequence
  Synthetic
agaactaagagcactagctcaaggagtgggtttgagatgatttgggatcccaatgggtggacagatacagatagc

SEQ ID NO: 206502 - DNA, 75 bp, Artificial Sequence
  Synthetic
agatcactggcaagctggattcagagcgaattcaataaggcatgtgaattgaccgactcaagctggatagaactt

SEQ ID NO: 206503 - DNA, 75 bp, Artificial Sequence
  Synthetic
tcaaatatattcaatatggagagaataaaagaactgagagatctaatgtcacagtcccgcacccgcgagatactc

SEQ ID NO: 206504 - DNA, 75 bp, Artificial Sequence
  Synthetic
tagtggaagttttgttcagcatccagaattgacggggctggattgcatgaggccttgcttctgggtcgagctaat

SEQ ID NO: 206505 - DNA, 75 bp, Artificial Sequence
  Synthetic
atggaacttgtacagtagtaatgactgatgggagcgcttcaggaaaagctgatactaaaatactattcattgagg

SEQ ID NO: 206506 - DNA, 75 bp, Artificial Sequence
  Synthetic
aggatgaaatggatgatggcaatgaaatatccaatcacagctgacaagagaataatggaaatgattcctgagagg

SEQ ID NO: 206507 - DNA, 75 bp, Artificial Sequence
  Synthetic
ggtcttggccagacggtgctgagttgccattcaccattgacaagtagtttgttcaaaaaactccttgtttctact

SEQ ID NO: 206508 - DNA, 75 bp, Artificial Sequence
  Synthetic
gcaaaacaaatgatgccggctcagaccgagtgatggtatcacctttggccgtgacatggtggaataggaatggac

SEQ ID NO: 206509 - DNA, 75 bp, Artificial Sequence
  Synthetic
cccatcgtagatataaatgtaaaggattatagcattgtttccagttatgtatgctcaggacttgttggagacaca

SEQ ID NO: 206510 - DNA, 75 bp, Artificial Sequence
  Synthetic
ctcatttgaggaatgatactgatgtggtaaactttgtgagcatggaattttctctcactgatccgaggctagaac

SEQ ID NO: 206511 - DNA, 75 bp, Artificial Sequence
  Synthetic
ccgagtgatggtatcacctttggccgtgacatggtggaataggaatggaccgacaacaagcacagtccattaccc

SEQ ID NO: 206512 - DNA, 75 bp, Artificial Sequence
  Synthetic
agacaactggaaaggctccaataggcccatcgtagatataaatgtaaaggattatagcattgtttccagttatgt

SEQ ID NO: 206513 - DNA, 75 bp, Artificial Sequence
  Synthetic
cctttggccccgtccacttcaggaatcaagttaagataagaaggagagttgacataaaccctggccatgcagatc

SEQ ID NO: 206514 - DNA, 75 bp, Artificial Sequence
  Synthetic
gacataaaccctggccatgcagatcttagtgctaaggaggcgcaggatgtaatcatggaagttgtcttcccaaat

SEQ ID NO: 206515 - DNA, 75 bp, Artificial Sequence
  Synthetic
tcaaaatgaatccaaatcagaagatagtaaccattggatcaatctgtatggtaattggagtaattagcttgatgt

SEQ ID NO: 206516 - DNA, 75 bp, Artificial Sequence
  Synthetic
gtaattggagtaattagcttgatgttacagattgggaacataatatcaatatgggtcagtcattcaattcaaaca

SEQ ID NO: 206517 - DNA, 75 bp, Artificial Sequence
  Synthetic
aattgaacccattgacaatgtaatgggaatgatcgggatattgcccgacatgaccccaagtactgagatgtcgct

SEQ ID NO: 206518 - DNA, 75 bp, Artificial Sequence
  Synthetic
gaacgctgtagcttcagtaacattagctggcaattcatctctttgccccattaaaggatgggctgtacacagtaa

SEQ ID NO: 206519 - DNA, 75 bp, Artificial Sequence
  Synthetic
ctacataaatacagctctgctcaatgcatcttgtgcagccatggatgacttccagctgattccaatgataagcaa

SEQ ID NO: 206520 - DNA, 75 bp, Artificial Sequence
  Synthetic
catacatgctagaaagagagttagtccgcaaaacaaggttcctcccagtggctggtgggacaagcagtgtctata

SEQ ID NO: 206521 - DNA, 75 bp, Artificial Sequence
  Synthetic
gctggcaattcatctctttgccccattaaaggatgggctgtacacagtaaagacaacagtataaggattgggtcc

SEQ ID NO: 206522 - DNA, 75 bp, Artificial Sequence
  Synthetic
ccaggaggagaagtgagaaatgatgatgtcgaccaaagtctgattattgctgccaggaacatagtaagaagagca

SEQ ID NO: 206523 - DNA, 75 bp, Artificial Sequence
  Synthetic
gcggctacaaagatgtgatactttggtttagcttcggggcatcatgtttcatacttctagccattgtaatgggcc

SEQ ID NO: 206524 - DNA, 75 bp, Artificial Sequence
  Synthetic
agcgaaagcaggtcaattatattcaatatggaaagaataaaagaactaagaaatctaatgtcgcagtctcgcacc

SEQ ID NO: 206525 - DNA, 75 bp, Artificial Sequence
  Synthetic
acaaattggaggaataaggatggtggacatccttaggcagaatccaacggaggaacaagccgtagacatatgcaa

SEQ ID NO: 206526 - DNA, 75 bp, Artificial Sequence
  Synthetic
aagccaataaaataaaatctgagaagacacacattcacatcttttcattcactggagaggagatggccaccaaag

SEQ ID NO: 206527 - DNA, 75 bp, Artificial Sequence
  Synthetic
catataactcaaggtttgagtctgttgcttggtcggcaagtgcttgccatgatggcaccagttggttgataattg

SEQ ID NO: 206528 - DNA, 75 bp, Artificial Sequence
  Synthetic
aacccagcacttaggatgaaatggatgatggcaatgaaatatccaattacagcagacaagaggataacggaaatg

SEQ ID NO: 206529 - DNA, 75 bp, Artificial Sequence
  Synthetic
ctttcaaaaggacaagtggatcgtcagtcaaaaaagaagaagaagtgcttacgggcaaccttcaaacactgaaaa

SEQ ID NO: 206530 - DNA, 75 bp, Artificial Sequence
  Synthetic
gatggcaccagttggttgataattggaatttctggtccagacaatggggctgtggcggtattgaaatacaatggc

SEQ ID NO: 206531 - DNA, 75 bp, Artificial Sequence
  Synthetic
agtcaaaaaagaagaagaagtgcttacgggcaaccttcaaacactgaaaataagagtacatgcggggtatgaaga

SEQ ID NO: 206532 - DNA, 75 bp, Artificial Sequence
  Synthetic
agagtctgaatgtgcatgtgtaaatggctcttgctttgctgttatgacagatggaccaagtaatgggcaggcatc

SEQ ID NO: 206533 - DNA, 75 bp, Artificial Sequence
  Synthetic
acgtatgttctctctatcgttccatcaggccccctcaaagccgagatcgcgcagagacttgaagatgtctttgct

SEQ ID NO: 206534 - DNA, 75 bp, Artificial Sequence
  Synthetic
ggagattgatccaactaatagtaagtgggagggatgagcagtcaattgctgaggcaataatcgtagccatggtat

SEQ ID NO: 206535 - DNA, 75 bp, Artificial Sequence
  Synthetic
tcacctctggctgtgacatggtggaataggaatggaccaatgacaaatacagttcattatccaaaaatctacaaa

SEQ ID NO: 206536 - DNA, 75 bp, Artificial Sequence
  Synthetic
gaggcaataatcgtagccatggtattttcgcaagaggattgcatgatcaaagcagttcgaggcgatctaaacttt

SEQ ID NO: 206537 - DNA, 75 bp, Artificial Sequence
  Synthetic
gggcaattctccagtgttcaattacaataaggccaccaagaggcttacagttctcggaaaagatgcaggtgcatt

SEQ ID NO: 206538 - DNA, 75 bp, Artificial Sequence
  Synthetic
ccattttagaaaccaagtcaaaatacgtcggagagttgacataaatcctggtcatgcagatctcagtgccaagga

SEQ ID NO: 206539 - DNA, 75 bp, Artificial Sequence
  Synthetic
cgtcggagagttgacataaatcctggtcatgcagatctcagtgccaaggaggcacaggatgtaatcatggaagtt

SEQ ID NO: 206540 - DNA, 75 bp, Artificial Sequence
  Synthetic
tgagagcatgattgaggccgagtcttctgtcaaagagaaagacatgaccaaggaattctttgaaaacaaatcgga

SEQ ID NO: 206541 - DNA, 75 bp, Artificial Sequence
  Synthetic
tttcagaactggggaattgaacccattgacaacgtaatgggaatgatcggaatattacctgacatgactccaagt

SEQ ID NO: 206542 - DNA, 75 bp, Artificial Sequence
  Synthetic
cttccaaaaagatgcaaaggtgctttttcagaactggggaattgaacccattgacaacgtaatgggaatgatcgg

SEQ ID NO: 206543 - DNA, 75 bp, Artificial Sequence
  Synthetic
caattactggggacaatacaaaatggaatgagaatcaaaatcctaggatgtttctggcaatgataacgtacatca

SEQ ID NO: 206544 - DNA, 75 bp, Artificial Sequence
  Synthetic
ggtccagtgtcctctaacggggcatatggggtaaaagggttctcatttaaatatggcaatggtgtctggatcggg

SEQ ID NO: 206545 - DNA, 75 bp, Artificial Sequence
  Synthetic
atgggtatctttcaatcagaatttggagtatcaaataggatatatttgcagtggagttttcggtgacaatccacg

SEQ ID NO: 206546 - DNA, 75 bp, Artificial Sequence
  Synthetic
gtactccagcacggagagagtggtggtgagtattgatcgatttttgagggttagggaccaacggggaaacgtatt

SEQ ID NO: 206547 - DNA, 75 bp, Artificial Sequence
  Synthetic
aggatgggggctgtaaccactgaagtggcatttggcctggtgtgtgcaacatgtgagcagattgctgattcccag

SEQ ID NO: 206548 - DNA, 75 bp, Artificial Sequence
  Synthetic
tagggaaaggatacatgttcgaaagtaagagcatgaagttacgaacacaaataccagcagaaatgcttgcaaaca

SEQ ID NO: 206549 - DNA, 75 bp, Artificial Sequence
  Synthetic
attgtctcccgaagaagtcagtgagacacagggaacagagaagttgacaataacttactcgtcatcaatgatgtg

SEQ ID NO: 206550 - DNA, 75 bp, Artificial Sequence
  Synthetic
aacgataaccaaagagaagaaagaagaactccaggattgcaaaatttctcctttgatggttgcatacatgttgga

SEQ ID NO: 206551 - DNA, 75 bp, Artificial Sequence
  Synthetic
ttcctcccagtggctggtggaacaagcagtgtgtacattgaagtgttgcatttgactcaaggaacatgctgggaa

SEQ ID NO: 206552 - DNA, 75 bp, Artificial Sequence
  Synthetic
tgagaacagaatggttttggccagcactacagctaaggctatggagcaaatggctggatcaagtgagcaggcagc

SEQ ID NO: 206553 - DNA, 75 bp, Artificial Sequence
  Synthetic
gaactgacaggattagattgcataagaccttgcttctgggttgagttaatcagagggcggcccaaagagagcaca

SEQ ID NO: 206554 - DNA, 75 bp, Artificial Sequence
  Synthetic
cggtttgaaataatcgaaggacgagatcgtaccatggcctggacagtagtgaatagtatttgtaacactacagga

SEQ ID NO: 206555 - DNA, 75 bp, Artificial Sequence
  Synthetic
aacaaaaaagaaaattgagaagataagacctctattaatagatggtacagcctcattgagccctggaatgatgat

SEQ ID NO: 206556 - DNA, 75 bp, Artificial Sequence
  Synthetic
gtgagaagagctgcagtatcagcagacccactagcatctttattggagatgtgccacagcacacagattggtgga

SEQ ID NO: 206557 - DNA, 75 bp, Artificial Sequence
  Synthetic
aatgtacactccaggaggggaagtgagaaatgacgatgttgaccagagtttgatcattgctgctcgaaacattgt

SEQ ID NO: 206558 - DNA, 75 bp, Artificial Sequence
  Synthetic
gggtatatgcaaggctgcaatgggactgagaattagctcatccttcagttttggtggattcacatttaagagaac

SEQ ID NO: 206559 - DNA, 75 bp, Artificial Sequence
  Synthetic
gtgaggacactgttccaacagatgcgagatgtgcttggaacatttgacaccgttcaaataataaaacttctccct

SEQ ID NO: 206560 - DNA, 75 bp, Artificial Sequence
  Synthetic
ctgagaattagctcatccttcagttttggtggattcacatttaagagaacaagcggatcatcagtcaagagagag

SEQ ID NO: 206561 - DNA, 75 bp, Artificial Sequence
  Synthetic
caattggctctgtttctctaatcattgcgataatatgtctcctcatgcaaattgccatcttaacaacgactatga

SEQ ID NO: 206562 - DNA, 75 bp, Artificial Sequence
  Synthetic
gggatatgaagagttcacaatggttgggagaagagcaacagccatactcagaaaagcaaccaggagattgattca

SEQ ID NO: 206563 - DNA, 75 bp, Artificial Sequence
  Synthetic
gggagaagagcaacagccatactcagaaaagcaaccaggagattgattcagctgatagtgagtgggagagacgaa

SEQ ID NO: 206564 - DNA, 75 bp, Artificial Sequence
  Synthetic
gatgctggtgcattgaccgaagatcctgatgaaggcacagctggagtggagtctgccgttctgagaggatttctc

SEQ ID NO: 206565 - DNA, 75 bp, Artificial Sequence
  Synthetic
gataaacaacgaccttggaccagcaacagctcagatggctcttcagctattcatcaaggactacagatacacata

SEQ ID NO: 206566 - DNA, 75 bp, Artificial Sequence
  Synthetic
acaggagtcgataagcctaaattcctcccagacttgtatgactacaaagagaaccgattcattgaaattggagtg

SEQ ID NO: 206567 - DNA, 75 bp, Artificial Sequence
  Synthetic
ttgtatgataaaagcagttagaggtgatctgaatttcgtcaatagggcgaatcagcgactgaatcctatgcatca

SEQ ID NO: 206568 - DNA, 75 bp, Artificial Sequence
  Synthetic
gatctgaatttcgtcaatagggcgaatcagcgactgaatcctatgcatcaacttttaagacattttcagaaggat

SEQ ID NO: 206569 - DNA, 75 bp, Artificial Sequence
  Synthetic
gggaatgattgggatattgcccgacatgactccaagcatcgagatgtcaatgagaggagtgagaatcagcaaaat

SEQ ID NO: 206570 - DNA, 75 bp, Artificial Sequence
  Synthetic
atgactccaagcatcgagatgtcaatgagaggagtgagaatcagcaaaatgggtgtagatgagtactccagcacg

SEQ ID NO: 206571 - DNA, 75 bp, Artificial Sequence
  Synthetic
gaaacgggactctagcatacttactgacagccagacagcgaccaaaagaattcggatggccatcaattagtgtcg

SEQ ID NO: 206572 - DNA, 75 bp, Artificial Sequence
  Synthetic
tgcgacaatgcttcaatccaatgatcgtcgagcttgcggaaaaggcaatgaaggaatatggggaagatccaaaaa

SEQ ID NO: 206573 - DNA, 75 bp, Artificial Sequence
  Synthetic
atcctctgaatccattcgtcagccatagggaaattgaatctgtcaacaatgctatagtaatgccagctcatggcc

SEQ ID NO: 206574 - DNA, 75 bp, Artificial Sequence
  Synthetic
aggaaatgtactactgtctcccgaggaggtcagtgaaacacagggaacagagaaactgacaataacttactcatc

SEQ ID NO: 206575 - DNA, 75 bp, Artificial Sequence
  Synthetic
ttgggtcccgttatgtgtgctcaggacttgtcggcgacacaccaagaaatgatgatagcaccagcagcagcaatt

SEQ ID NO: 206576 - DNA, 75 bp, Artificial Sequence
  Synthetic
gaggtcagtgaaacacagggaacagagaaactgacaataacttactcatcgtcaatgatgtgggagattaatggt

SEQ ID NO: 206577 - DNA, 75 bp, Artificial Sequence
  Synthetic
ctgaagcaccgatttgaaataattgaaggaagagaccgaacaatggcctggacagtggtgaatagcatctgcaac

SEQ ID NO: 206578 - DNA, 75 bp, Artificial Sequence
  Synthetic
aaggaagagaccgaacaatggcctggacagtggtgaatagcatctgcaacaccacagaggtcgagaaacctaagt

SEQ ID NO: 206579 - DNA, 75 bp, Artificial Sequence
  Synthetic
aactgttaaaattcagtggtcccagaaccctacaatgctatacaataaaatggaatttgaaccatttcagtcttt

SEQ ID NO: 206580 - DNA, 75 bp, Artificial Sequence
  Synthetic
gtaacacggagagaggttcatatatactacctagagaaagccaacaagataaaatctgaaaagacacacattcac

SEQ ID NO: 206581 - DNA, 75 bp, Artificial Sequence
  Synthetic
tccaacaaatgagggatgtgcttgggacatttgataccgcacagataataaaacttcttcccttcgcagccgctc

SEQ ID NO: 206582 - DNA, 75 bp, Artificial Sequence
  Synthetic
gagggggaaggtataccactatatgatgcaatcaaatgcatgaagacatttttcggctggaaagagcccaacatt

SEQ ID NO: 206583 - DNA, 75 bp, Artificial Sequence
  Synthetic
atgcaatcaaatgcatgaagacatttttcggctggaaagagcccaacattgtaaaaccacatgaaaagggcataa

SEQ ID NO: 206584 - DNA, 75 bp, Artificial Sequence
  Synthetic
tttcggctggaaagagcccaacattgtaaaaccacatgaaaagggcataaatcccaattacctcctggcttggaa

SEQ ID NO: 206585 - DNA, 75 bp, Artificial Sequence
  Synthetic
gttctcggaaaggatgctggcactttaaccgaagacccagatgaaggcacagctggagtggagtccgctgttctg

SEQ ID NO: 206586 - DNA, 75 bp, Artificial Sequence
  Synthetic
aaacaaagaacatgaagaaaacaagccaattgaagtgggcacttggtgagaatatggcaccagaaaaagtagact

SEQ ID NO: 206587 - DNA, 75 bp, Artificial Sequence
  Synthetic
ccaattgaagtgggcacttggtgagaatatggcaccagaaaaagtagactttgaggactgcaaagatgttagcga

SEQ ID NO: 206588 - DNA, 75 bp, Artificial Sequence
  Synthetic
gagcctatgtggatggattcgaaccgaacggctgcattgagggcaagctttctcaaatgtcaaaagaagtgaacg

SEQ ID NO: 206589 - DNA, 75 bp, Artificial Sequence
  Synthetic
tgccaaacaatgacagatttgacaaattgtacatttggggagttcaccatccgggtacagacaaggaccaaatca

SEQ ID NO: 206590 - DNA, 75 bp, Artificial Sequence
  Synthetic
gaacggctgcattgagggcaagctttctcaaatgtcaaaagaagtgaacgccaggattgagccattcctgaagac

SEQ ID NO: 206591 - DNA, 75 bp, Artificial Sequence
  Synthetic
gatgggcccccttgctctcagcggtcaaaattcttgctgatggatgccttgaaactgagcattgaagacccgagt

SEQ ID NO: 206592 - DNA, 75 bp, Artificial Sequence
  Synthetic
aattgagagcatgattgaggccgagtcctctgtcaaagagaaagacatgaccaaagaattctttgaaaacaaatc

SEQ ID NO: 206593 - DNA, 75 bp, Artificial Sequence
  Synthetic
tcggaaaggtgtgcaggactttgctggcaaaatctgtattcaacagtttgtatgcatctccacaacttgaaggat

SEQ ID NO: 206594 - DNA, 75 bp, Artificial Sequence
  Synthetic
atttttcggctggaaagagcccaacataatcaaaccacatgagaaaggcataaatcccaattaccttctggcttg

SEQ ID NO: 206595 - DNA, 75 bp, Artificial Sequence
  Synthetic
gaagcaagtgctagcagaactccaggaccttgaaaatgaagagaagatcccaaagacaaagaacatgaagaagac

SEQ ID NO: 206596 - DNA, 75 bp, Artificial Sequence
  Synthetic
aatggaagcattcccaatgacaagccttttcaaaatgtgaacaggatcacatatggggcctgtcccagatatgtt

SEQ ID NO: 206597 - DNA, 75 bp, Artificial Sequence
  Synthetic
acattgaaaataagagtgcatgaagggtatgaggaattcacaatggttgggcggagagcaacagcaattctaaga

SEQ ID NO: 206598 - DNA, 75 bp, Artificial Sequence
  Synthetic
gagaacatggcaccagaaaaagtggactttgaggattgcaaggatattggcgatctaaagcaatatgatagtgat

SEQ ID NO: 206599 - DNA, 75 bp, Artificial Sequence
  Synthetic
gctggatccagagtgaattcaataaggcatgtgaattgaccgactcaagctggatagaacttgatgaaataggag

SEQ ID NO: 206600 - DNA, 75 bp, Artificial Sequence
  Synthetic
taaaagggagatctcatttgaggaatgatactgatgtggtaaactttgtgagcatggaattttctctcactgacc

SEQ ID NO: 206601 - DNA, 75 bp, Artificial Sequence
  Synthetic
tgaacgccagaatgccactgagatcagagcatctgttgggagaatggttggtggaattggaaggttttacgtaca

SEQ ID NO: 206602 - DNA, 75 bp, Artificial Sequence
  Synthetic
aggggcgataaactctagtatgccattccacaacatacaccctctcaccatcggagaatgtcccaaatatgtgaa

SEQ ID NO: 206603 - DNA, 75 bp, Artificial Sequence
  Synthetic
gatctaaatttcgtaaacagagcaaaccaaagattaaatcccatgcatcaactcctgagacattttcaaaaggac

SEQ ID NO: 206604 - DNA, 75 bp, Artificial Sequence
  Synthetic
acagcataacaatagagagaatggttctctctgcctttgatgaaaggagaaacaggtacctggaagaacatccaa

SEQ ID NO: 206605 - DNA, 75 bp, Artificial Sequence
  Synthetic
cgaagggagactgatccaaaacagcataaccatagagaggatggttctctcggcatttgatgagaggagaaacaa

SEQ ID NO: 206606 - DNA, 75 bp, Artificial Sequence
  Synthetic
tggagctatagcaggttttatagagggaggatggcagggaatggtagatggttggtatgggtaccaccacagcaa

SEQ ID NO: 206607 - DNA, 75 bp, Artificial Sequence
  Synthetic
aacaggtacctggaagaacatccaagtgctgggaaggacccaaagaaaactggaggtccgatataccgacggaga

SEQ ID NO: 206608 - DNA, 75 bp, Artificial Sequence
  Synthetic
gatcagaagtccctaagaggaagaggcaacactcttggtctggacatcgaaacagctactcgtgcgggaaaacag

SEQ ID NO: 206609 - DNA, 75 bp, Artificial Sequence
  Synthetic
ctttggctggaaagagcctaaaatagtcaaaccacatgagaaaggcataaatcccaattacctcatggcttggaa

SEQ ID NO: 206610 - DNA, 75 bp, Artificial Sequence
  Synthetic
aaggctctattgggaaagtatgcagaaccttactggcaaagtctgtattcaacagtctgtacgcatctccacaac

SEQ ID NO: 206611 - DNA, 75 bp, Artificial Sequence
  Synthetic
gaggatttggcgtcaagcaaacaatggagaagatgcaactgctggcctcacccacctgatgatctggcattccaa

SEQ ID NO: 206612 - DNA, 75 bp, Artificial Sequence
  Synthetic
aacagctactcgtgcgggaaaacagatagtggagcggattcttaatgaagaacctgatgaggcacttaaaatgcc

SEQ ID NO: 206613 - DNA, 75 bp, Artificial Sequence
  Synthetic
gcgatggtgttctcacaggaggactgtatgataaaggcagttcgaggagatttgaatttcgtgaatagagcgaac

SEQ ID NO: 206614 - DNA, 75 bp, Artificial Sequence
  Synthetic
aaccttactggcaaagtctgtattcaacagtctgtacgcatctccacaacttgaggggttttcagctgaatcgag

SEQ ID NO: 206615 - DNA, 75 bp, Artificial Sequence
  Synthetic
gctttttaagggttcgagatcagcggggaaatgtactcttatctcccgaagaggtcagcgaaactcagggaacag

SEQ ID NO: 206616 - DNA, 75 bp, Artificial Sequence
  Synthetic
gcaaggatcaactcttccgaggagatctggagctgctggtgcagcagtaaagggagtcggaacgatggtaatgga

SEQ ID NO: 206617 - DNA, 75 bp, Artificial Sequence
  Synthetic
atcaatgatgtgggaaatcaatggtcctgaatcagtgcttgtcaacacctatcaatggatcatcagaaattggga

SEQ ID NO: 206618 - DNA, 75 bp, Artificial Sequence
  Synthetic
gcatcccagtgctgggaaagatcccaagaagactggaggtccaatttacaggaggagagatggcaaatgggtgag

SEQ ID NO: 206619 - DNA, 75 bp, Artificial Sequence
  Synthetic
attaacgatcgaaatttctggagaggtgaaaatggaagaaaaacaagaattgcgtatgagagaatgtgcaacatt

SEQ ID NO: 206620 - DNA, 75 bp, Artificial Sequence
  Synthetic
agtttaaaatgaatccaaatcagaaaataataacaattggttctgtgtcattggcactagttgtactcaacatac

SEQ ID NO: 206621 - DNA, 75 bp, Artificial Sequence
  Synthetic
tcattgttctaagctatcttttctgtctggctctcagccaagattactcagaaaacaacaacagcactgcaacac

SEQ ID NO: 206622 - DNA, 75 bp, Artificial Sequence
  Synthetic
ttggcactagttgtactcaacatactgcttcatattgcatcaatagttatagggataatatcagtgacaaaagaa

SEQ ID NO: 206623 - DNA, 75 bp, Artificial Sequence
  Synthetic
tgcttcatattgcatcaatagttatagggataatatcagtgacaaaagaaagcagtatatcatcaccctgcaaca

SEQ ID NO: 206624 - DNA, 75 bp, Artificial Sequence
  Synthetic
tctggctctcagccaagattactcagaaaacaacaacagcactgcaacactgtgcttagggcaccatgcggtacc

SEQ ID NO: 206625 - DNA, 75 bp, Artificial Sequence
  Synthetic
gccgagattgaagacctcatcttcctggcacggtctgcactcattctaagaggatcagtggctcataaatcctgc

SEQ ID NO: 206626 - DNA, 75 bp, Artificial Sequence
  Synthetic
aaacggaaactggcgagagcaattgagtcagaagtttgaagaaataaggtggctgattgaagaagtacgacatag

SEQ ID NO: 206627 - DNA, 75 bp, Artificial Sequence
  Synthetic
tctctgatgcaaggctcaacccttccgaggagatctggggctgctggagcggcagtgaaaggggttggaacaatg

SEQ ID NO: 206628 - DNA, 75 bp, Artificial Sequence
  Synthetic
attaacaacactgtttacatcgaaagagagtcacgtcaagaacctgagtttttaaacaacacagaacctctctgc

SEQ ID NO: 206629 - DNA, 75 bp, Artificial Sequence
  Synthetic
gagagtcacgtcaagaacctgagtttttaaacaacacagaacctctctgcaatgtatccgggtttgcaatagtct

SEQ ID NO: 206630 - DNA, 75 bp, Artificial Sequence
  Synthetic
aagggaaggatactctctagtgggaatagacccttttcgtctgctgcaaaacagccaggtcttcagcctaattag

SEQ ID NO: 206631 - DNA, 75 bp, Artificial Sequence
  Synthetic
ggggcaattcccctgtgttcaactacaataaggcgaccaaaaggcttactgttcttggaaaggacgcaggtgcat

SEQ ID NO: 206632 - DNA, 75 bp, Artificial Sequence
  Synthetic
agagaaccttttgtagcatgtggtccaacagaatgtcggacatttttcctaacgcaaggtgccttactgaatgac

SEQ ID NO: 206633 - DNA, 75 bp, Artificial Sequence
  Synthetic
atggcgtcccaaggcaccaaacggtcttatgaacagatggaaactgatggagatcgccagaatgcaactgagatt

SEQ ID NO: 206634 - DNA, 75 bp, Artificial Sequence
  Synthetic
caacagaatgtcggacatttttcctaacgcaaggtgccttactgaatgacaaacattccaacaatacagtgaagg

SEQ ID NO: 206635 - DNA, 75 bp, Artificial Sequence
  Synthetic
ccctgggttttgctcaatgcgtcttggttcaactccttcctgacacatgcattaaaatagttatggcagtgctac

SEQ ID NO: 206636 - DNA, 75 bp, Artificial Sequence
  Synthetic
aatgcttaccaggccaagtttgagtctgtcgcatggtcggccacagcatgccatgatggcaaagagtggttggca

SEQ ID NO: 206637 - DNA, 75 bp, Artificial Sequence
  Synthetic
ctgtcgcatggtcggccacagcatgccatgatggcaaagagtggttggcagtagggataagtggtgcagatgacg

SEQ ID NO: 206638 - DNA, 75 bp, Artificial Sequence
  Synthetic
aaatgagaacatggaaacaatggattccagcactcttgaactgaggagcagatattgggccataagaaccaggag

SEQ ID NO: 206639 - DNA, 75 bp, Artificial Sequence
  Synthetic
tgacaactttgacaagttgtatgtctggggagttcaccacccaagcacaaaccaagagcaaaccaacctatatgt

SEQ ID NO: 206640 - DNA, 75 bp, Artificial Sequence
  Synthetic
tcatggagaaagcagattctaagaacacaagaatcgtcatgtgtgtgtgtgaaagggcactgttattgggtaatg

SEQ ID NO: 206641 - DNA, 75 bp, Artificial Sequence
  Synthetic
ggcatgccactctgcggcatttgaagatctgagagtgtcaagcttcatcagaggaacaagagtagtcccaagagg

SEQ ID NO: 206642 - DNA, 75 bp, Artificial Sequence
  Synthetic
cacaagaatcgtcatgtgtgtgtgtgaaagggcactgttattgggtaatgacggatggtcctgcgaataatcagg

SEQ ID NO: 206643 - DNA, 75 bp, Artificial Sequence
  Synthetic
atcgtgccctcttttgatatgagtaatgaaggatcttatttcttcggagacaatgcagaggagtacgacaattaa

SEQ ID NO: 206644 - DNA, 75 bp, Artificial Sequence
  Synthetic
agacgcaactgctggtctcacccatttgatgatttggcattccaatctgaatgatgccacataccagagaacaag

SEQ ID NO: 206645 - DNA, 75 bp, Artificial Sequence
  Synthetic
attgcttcaaatgagaacatggagacaatggactccagtactcttgaactgaggagcagatactgggctataaga

SEQ ID NO: 206646 - DNA, 75 bp, Artificial Sequence
  Synthetic
gaagtgtcatttcagggaggtcacattgaagagtgctcttgctaccccaacttgggtaaagtggaatgcgtttgc

SEQ ID NO: 206647 - DNA, 75 bp, Artificial Sequence
  Synthetic
ttgaagagtgctcttgctaccccaacttgggtaaagtggaatgcgtttgccgagataattggaatggaatgaata

SEQ ID NO: 206648 - DNA, 75 bp, Artificial Sequence
  Synthetic
taatcccgaacattggatccaggccttgggtcagaggccaatcagggaggataagcatctactggacaatagtga

SEQ ID NO: 206649 - DNA, 75 bp, Artificial Sequence
  Synthetic
ggaaaagctcaataatgaggtcagatgcaccaattgacacatgcatttctgagtgcatcactcctaatggaagca

SEQ ID NO: 206650 - DNA, 75 bp, Artificial Sequence
  Synthetic
aaagtccgaaaatcgagacgaacaaatttgccgcaatatgcacacacctagaagtctgcttcatgtattcggact

SEQ ID NO: 206651 - DNA, 75 bp, Artificial Sequence
  Synthetic
gagtgcatcactcctaatggaagcatcccaaatgacaagccatttcagaatgtaaataagatcacctacgggaca

SEQ ID NO: 206652 - DNA, 75 bp, Artificial Sequence
  Synthetic
tgtgccggaataccgacagacactccacgggttcaagacagtagtttcagtggttcctgtactaatgctgttgga

SEQ ID NO: 206653 - DNA, 75 bp, Artificial Sequence
  Synthetic
gaaactgtggacacactaacggaaactaatgttcctgtgacacatgccaaagaattgctccacacagagcacaat

SEQ ID NO: 206654 - DNA, 75 bp, Artificial Sequence
  Synthetic
cacgggttcaagacagtagtttcagtggttcctgtactaatgctgttggagggagtgggacgaacaactatggag

SEQ ID NO: 206655 - DNA, 75 bp, Artificial Sequence
  Synthetic
agcaaaagcaggggaatttcttaactagcaaaatggaaataataccactgatgactgtacttctattagtaacaa

SEQ ID NO: 206656 - DNA, 75 bp, Artificial Sequence
  Synthetic
ggtctgttcggtgcaatagcaggattcatagaaaatggatgggaaggaatgatagacggttggtatggtttcaga

SEQ ID NO: 206657 - DNA, 75 bp, Artificial Sequence
  Synthetic
gaaatcccctcatcctagacacatgcactatcgaaggacttatctatggtaacccttcttgtgacatgttgttgg

SEQ ID NO: 206658 - DNA, 75 bp, Artificial Sequence
  Synthetic
gttagcatttcatcccgaagtgggtttgagatcttattgatagaagatggttggaccaaaacgagcaaaaatgtt

SEQ ID NO: 206659 - DNA, 75 bp, Artificial Sequence
  Synthetic
ttgagatcttattgatagaagatggttggaccaaaacgagcaaaaatgttgtcagaaaggtggaggtcctcaaca

SEQ ID NO: 206660 - DNA, 75 bp, Artificial Sequence
  Synthetic
tgctttctttggcatgtccgcaaacgatttgcagaccaagaactgggtgatgccccattccttgaccggcttcgc

SEQ ID NO: 206661 - DNA, 75 bp, Artificial Sequence
  Synthetic
taggggtctatgggattcctttcgtcaatccgagagaggcgaagagacaattgaagaaaggtttgaaatcacagg

SEQ ID NO: 206662 - DNA, 75 bp, Artificial Sequence
  Synthetic
acatgttaccctgggaatgtggaaaacttagaggaactcagaatactttttagttcctctagttcctatcaaaga

SEQ ID NO: 206663 - DNA, 75 bp, Artificial Sequence
  Synthetic
caccagaactctgagggtacaggacaagccgcagacctaaaaagcacacaggcagccattgaccagattaatggg

SEQ ID NO: 206664 - DNA, 75 bp, Artificial Sequence
  Synthetic
actaataaacaatgcttagttccatgtttctggctggaaatgataagaggaaaaccagaagagagaacaagcatt

SEQ ID NO: 206665 - DNA, 75 bp, Artificial Sequence
  Synthetic
cactgtgtcaagctttcaggtagactgctttctttggcatgtccgcaaacgatttgcagaccaagaactgggtga

SEQ ID NO: 206666 - DNA, 75 bp, Artificial Sequence
  Synthetic
ttcctaagagtccgagatcagaggggaaacgtgctcttatctccagaagaagttagtgaaacacaaggaacggag

SEQ ID NO: 206667 - DNA, 75 bp, Artificial Sequence
  Synthetic
aagaatccgacgaggcactcaaaatgactattgcctctgtgcctgcttcacgctacctaactgacatgactcttg

SEQ ID NO: 206668 - DNA, 75 bp, Artificial Sequence
  Synthetic
tttgtggtgtttcgagtgaggtcccagggtggtcctgggatgatggagcaattcttccctttgacatcgataaga

SEQ ID NO: 206669 - DNA, 75 bp, Artificial Sequence
  Synthetic
tacatcatccacccactgatactgcacagacgaatttgtacacaagaaccgacacaacaacaagcgtaacaacag

SEQ ID NO: 206670 - DNA, 75 bp, Artificial Sequence
  Synthetic
tgctatctatggcacataagaaagctgctcagcatgagagacatgtgtgatgctccctttgatgatagactcaga

SEQ ID NO: 206671 - DNA, 75 bp, Artificial Sequence
  Synthetic
ctaattgccctatgtggaagcccattcccagttgggtccggttccttccccgatggggcacagatccaatacttt

SEQ ID NO: 206672 - DNA, 75 bp, Artificial Sequence
  Synthetic
atgacatatacagggatgaagcattaaacaatcgattccaaatcaaaggtgtggagctaaagtctgggtacaaag

SEQ ID NO: 206673 - DNA, 75 bp, Artificial Sequence
  Synthetic
gcgagtggccacaatggaaggcaaaaagattgttgaggacatcctaaagagtgaaacggatgaaaacctcaaaat

SEQ ID NO: 206674 - DNA, 75 bp, Artificial Sequence
  Synthetic
ccagacattgcgagtaagatccaatgggaatctaattgctccatggtttggacacgttctctcaggagagagcca

SEQ ID NO: 206675 - DNA, 75 bp, Artificial Sequence
  Synthetic
aggaaataagcagggagtggtacatgctcatgccaaggcagaaaataacagggggtctgatggtgaaaatggacc

SEQ ID NO: 206676 - DNA, 75 bp, Artificial Sequence
  Synthetic
ccactccctccaaagcagaaacggaaaatggcgagaacaattgagtcagaagtttgaagaaataaggtggctgat

SEQ ID NO: 206677 - DNA, 75 bp, Artificial Sequence
  Synthetic
cagtacattacctttccacaatatcagtaaatatgcatttggggattgccccaaatacattggagtcaagagtct

SEQ ID NO: 206678 - DNA, 75 bp, Artificial Sequence
  Synthetic
actcaaggcaaacttctctgtcctatttgatcaactggaaacattagtctcactgagggctttcacagacgatgg

SEQ ID NO: 206679 - DNA, 75 bp, Artificial Sequence
  Synthetic
acagattcgagttggattgaacttgatgaaataggagaagatgttgctccaattgagcacattgcaagtatgaga

SEQ ID NO: 206680 - DNA, 75 bp, Artificial Sequence
  Synthetic
tatttggagccatagctggattcatagaaggaggttggccaggactggttgccggttggtatggtttccaacatt

SEQ ID NO: 206681 - DNA, 75 bp, Artificial Sequence
  Synthetic
attccttccatgccaggacattctacagaggatgtcaaaaatgcaattggaatcctcatcggtggacttgaatgg

SEQ ID NO: 206682 - DNA, 75 bp, Artificial Sequence
  Synthetic
cagaggatgtcaaaaatgcaattggaatcctcatcggtggacttgaatggaatgataactcaattcgagcgtctg

SEQ ID NO: 206683 - DNA, 75 bp, Artificial Sequence
  Synthetic
aattgagcacattgcaagtatgagaaggaactatttcacagcggaagtgtctcattgcagggctactgaatacat

SEQ ID NO: 206684 - DNA, 75 bp, Artificial Sequence
  Synthetic
ccactccctccaaagcagaaacgctacatggcgagaagagttgagtcagaagtttgaagagatcagatggctaat

SEQ ID NO: 206685 - DNA, 75 bp, Artificial Sequence
  Synthetic
caagcaatatgaaataattgatcatgaattcagtgaggttgaaactagactcaatatgatcaataacaagattga

SEQ ID NO: 206686 - DNA, 75 bp, Artificial Sequence
  Synthetic
gacaatgaagggaggctgatccaaaacagtatcacaatagaaagaatggtcctgtctgcctttgatgagagaagg

SEQ ID NO: 206687 - DNA, 75 bp, Artificial Sequence
  Synthetic
acagtatcacaatagaaagaatggtcctgtctgcctttgatgagagaaggaacagatacttggaggaacatccca

SEQ ID NO: 206688 - DNA, 75 bp, Artificial Sequence
  Synthetic
taacgttcttgcaggcattgcaactcttacttgaggttgagagtgagataaggacattttcttttcagcttattt

SEQ ID NO: 206689 - DNA, 75 bp, Artificial Sequence
  Synthetic
ttgagaaccagaaaacactcgatgagcatgatgcaaacgtgaacaacctatacaacaaggtgaaaagggccttag

SEQ ID NO: 206690 - DNA, 75 bp, Artificial Sequence
  Synthetic
gaaggaaaatgggtaagagaattggtcctgtatgacaaggaagaaataagaagaatatggagacaagcaaacaat

SEQ ID NO: 206691 - DNA, 75 bp, Artificial Sequence
  Synthetic
aagaatatggagacaagcaaacaatggagaagattctactgctggcctcacccacttgatgatctggcactccaa

SEQ ID NO: 206692 - DNA, 75 bp, Artificial Sequence
  Synthetic
ccctgggggcaatcagtttctggatgtgctctaatgggtcattgcaatgcagaatatgcatttagagcttggatt

SEQ ID NO: 206693 - DNA, 75 bp, Artificial Sequence
  Synthetic
tctggagcggctggtgcagccgtaaaaggagttggaacaatggtgatggagcttatcagaatgataaagagagga

SEQ ID NO: 206694 - DNA, 75 bp, Artificial Sequence
  Synthetic
ggtttgctgccttcttattctgggccatgtcaaacggatcatgcagatgcaacatctgtatataattagcaaaac

SEQ ID NO: 206695 - DNA, 75 bp, Artificial Sequence
  Synthetic
tacatacagatgtgcactgaactcaaactcagtgactacgaagggaggctgatccaaaacagcataaccatagag

SEQ ID NO: 206696 - DNA, 75 bp, Artificial Sequence
  Synthetic
gttgccagtcaggctaggcagatggtgcaggcaatgaggactattgggactcatcctagctccagtgctggtctg

SEQ ID NO: 206697 - DNA, 75 bp, Artificial Sequence
  Synthetic
tggccaggtctgcactcattctgaggggagcagtagctcacaaatcatgccttcctgcttgtgtgtatggacttg

SEQ ID NO: 206698 - DNA, 75 bp, Artificial Sequence
  Synthetic
acaatggagaggacgcaactgctggccttacccacctgatgatatggcattccaatctaaatgatgccacatatc

SEQ ID NO: 206699 - DNA, 75 bp, Artificial Sequence
  Synthetic
aaacgatggaagttgttcaacaaacaagagtggacaaattgacccaaggccgtcagacctatgattggacattaa

SEQ ID NO: 206700 - DNA, 75 bp, Artificial Sequence
  Synthetic
agcaaaagcagggtgaaaatgaatccaaatcaaaagataacatgcatttcagcaacaggagtaacactatcggta

SEQ ID NO: 206701 - DNA, 75 bp, Artificial Sequence
  Synthetic
aagagtggacaaattgacccaaggccgtcagacctatgattggacattaaacaggaatcagccggctgcaactgc

SEQ ID NO: 206702 - DNA, 75 bp, Artificial Sequence
  Synthetic
agcaacaggagtaacactatcggtagtaagcctgctaataggaatcgccaatttgggcctaaatatcggactaca

SEQ ID NO: 206703 - DNA, 75 bp, Artificial Sequence
  Synthetic
atagaccccttccggctgctccaaaacagccaagtgttcagtctaatccgtcccaatgaaaatccagcacacaag

SEQ ID NO: 206704 - DNA, 75 bp, Artificial Sequence
  Synthetic
catggacaaagcagttaagctatacaagaagctaaagagggaaatgacattccatggagcaaaggaagttgcact

SEQ ID NO: 206705 - DNA, 75 bp, Artificial Sequence
  Synthetic
gtaagcctgctaataggaatcgccaatttgggcctaaatatcggactacactacaaagtgagtgattcaacaact

SEQ ID NO: 206706 - DNA, 75 bp, Artificial Sequence
  Synthetic
acagccaagtgttcagtctaatccgtcccaatgaaaatccagcacacaagagccagttggtgtggatggcatgtc

SEQ ID NO: 206707 - DNA, 75 bp, Artificial Sequence
  Synthetic
taacattatagtgaataagaacgaagaaagaacatttctcaacttgaccaaaccgctatgtgaagtcaactcatg

SEQ ID NO: 206708 - DNA, 75 bp, Artificial Sequence
  Synthetic
agagtgttaccaagagggcaactgtccacaaggggcgttcaaatcgcatccaacgagaacatggaaactatgagc

SEQ ID NO: 206709 - DNA, 75 bp, Artificial Sequence
  Synthetic
tgtgagcagatcgctgatgcacaacaccgttcacacagacagatggcggcaaccaccaacccactgatcaggcat

SEQ ID NO: 206710 - DNA, 75 bp, Artificial Sequence
  Synthetic
aaatcctcgaatgttcctggcgatgattacatacatcaccagaaatcaacccgagtggtttagaaacatcctgag

SEQ ID NO: 206711 - DNA, 75 bp, Artificial Sequence
  Synthetic
actagaattgcttacgagagaatgtgcaacatcctcaagggaaaattccaaacagcagcacaacgagcaatgatg

SEQ ID NO: 206712 - DNA, 75 bp, Artificial Sequence
  Synthetic
gcagaatacagaaattggtcaaaaccgcaatgtgacattacaggatttgcacctttttctaaggacaattcgatt

SEQ ID NO: 206713 - DNA, 75 bp, Artificial Sequence
  Synthetic
aatgaaaagaaggctaaactggcaaatgttgtgagaaaaatgatgactaattcgcaagacacagagctctctttc

SEQ ID NO: 206714 - DNA, 75 bp, Artificial Sequence
  Synthetic
ggctggatcaagtgagcaggcagcagaagccatggaagttgcaagtcaggctaggcaaatggtgcaggcaatgag

SEQ ID NO: 206715 - DNA, 75 bp, Artificial Sequence
  Synthetic
gtcctgtgatccacaaggatgcaggatgtttgctctgagtcaaggcacaacactcagagggcgacatgcgaatgg

SEQ ID NO: 206716 - DNA, 75 bp, Artificial Sequence
  Synthetic
gcatcagctggacaaatcagtgtgcaacccactttctcagtacaaaggaatctcccttttgaaagagcgaccatc

SEQ ID NO: 206717 - DNA, 75 bp, Artificial Sequence
  Synthetic
gaaagaacatttctcaacttgaccaaaccgctatgtgaagtcaactcatggcacattctatcgaaagacaatgca

SEQ ID NO: 206718 - DNA, 75 bp, Artificial Sequence
  Synthetic
atgtttgctctgagtcaaggcacaacactcagagggcgacatgcgaatggaaccatacatgataggagcccattt

SEQ ID NO: 206719 - DNA, 75 bp, Artificial Sequence
  Synthetic
tagggtcgaatgcataggatggtcaagcacgtcatgccatgatggcatatcaaggatgtcaatatgcatatcagg

SEQ ID NO: 206720 - DNA, 75 bp, Artificial Sequence
  Synthetic
agcacgtcatgccatgatggcatatcaaggatgtcaatatgcatatcaggaccgaataacaatgcatcggcagtg

SEQ ID NO: 206721 - DNA, 75 bp, Artificial Sequence
  Synthetic
gctccaaaacagtcaagtcttcagtctcatcagaccaaacgaaaatccagcgcataaaagccagctggtatggat

SEQ ID NO: 206722 - DNA, 75 bp, Artificial Sequence
  Synthetic
cattcttaggactcaagaatcagaatgtgtgtgccataaaggaatctgcccagtggtcatgacagatggtccagc

SEQ ID NO: 206723 - DNA, 75 bp, Artificial Sequence
  Synthetic
tgtgtgtgccataaaggaatctgcccagtggtcatgacagatggtccagcaaacaacaaggcagcaactaagata

SEQ ID NO: 206724 - DNA, 75 bp, Artificial Sequence
  Synthetic
atggatgtcaatccgactttactcttcttgaaagtgccagcacaaaatgctataagcactacattcccatatact

SEQ ID NO: 206725 - DNA, 75 bp, Artificial Sequence
  Synthetic
taacattcatgcaagcattacaactgctgtttgaagtggaacaggagataagaactttctcatttcagcttattt

SEQ ID NO: 206726 - DNA, 75 bp, Artificial Sequence
  Synthetic
cgctcaacacatcgaagagtgttcatgctacggagcagcagggatgatcaaatgtgtatgcagagacaattggaa

SEQ ID NO: 206727 - DNA, 75 bp, Artificial Sequence
  Synthetic
caggaacaggatacactatggacacggtcaacagaacacaccaatactcagagaaggggaagtggacaacaaaca

SEQ ID NO: 206728 - DNA, 75 bp, Artificial Sequence
  Synthetic
tgctacggagcagcagggatgatcaaatgtgtatgcagagacaattggaagggggcaaatagaccaataatcact

SEQ ID NO: 206729 - DNA, 75 bp, Artificial Sequence
  Synthetic
ggtccatcttggtgactgcagttttgagggatggattgtagggaatccctcctgtgccaccaacatcaacataag

SEQ ID NO: 206730 - DNA, 75 bp, Artificial Sequence
  Synthetic
tgaagactatcagggaaggctttgcaaccccctgaatccgtttgtcagccacaaagagatagagtctgtaaacaa

SEQ ID NO: 206731 - DNA, 75 bp, Artificial Sequence
  Synthetic
tccaatcgatgggccattacctgaagataacgagccaagcggatatgcacaaacagactgtgtgttggaagcaat

SEQ ID NO: 206732 - DNA, 75 bp, Artificial Sequence
  Synthetic
cttaaccgacacaagtcgtcctaatgaccccaccaatgggaactgcgttgcgccaataacaggagggagcccaga

SEQ ID NO: 206733 - DNA, 75 bp, Artificial Sequence
  Synthetic
aaacagactgtgtgttggaagcaatggccttccttgaggagtcccacccaggtatctttgaaaactcatgtcttg

SEQ ID NO: 206734 - DNA, 75 bp, Artificial Sequence
  Synthetic
ggccttccttgaggagtcccacccaggtatctttgaaaactcatgtcttgaaacgatggaagtcattcaacaaac

SEQ ID NO: 206735 - DNA, 75 bp, Artificial Sequence
  Synthetic
gaccccaccaatgggaactgcgttgcgccaataacaggagggagcccagacccaggggtaaaagggtttgcattc

SEQ ID NO: 206736 - DNA, 75 bp, Artificial Sequence
  Synthetic
gatctaatgtcacagtctcgcactcgcgagatactaaccaaaaccactgttgaccacatggccataatcaaaaag

SEQ ID NO: 206737 - DNA, 75 bp, Artificial Sequence
  Synthetic
atcaggctacgaaatgttaaaggtcccaaatgcagaaaccgacactcaatcagggccaacctcataccagctgat

SEQ ID NO: 206738 - DNA, 75 bp, Artificial Sequence
  Synthetic
atagaaaccagcctgctgcaactgctttggccaacaccatagaggtcttcaggttgaatggcctaacagctaatg

SEQ ID NO: 206739 - DNA, 75 bp, Artificial Sequence
  Synthetic
aattcagacaaggaggtcattcgagctgaagaagttgtgggaacaaacccgctcaaaagcaggactgctggtctc

SEQ ID NO: 206740 - DNA, 75 bp, Artificial Sequence
  Synthetic
gagagtggttgtaagcatcgatcgcttcttgagagttcgagaccagcgggggaatgttctcttgtctcctgagga

SEQ ID NO: 206741 - DNA, 75 bp, Artificial Sequence
  Synthetic
ccaaatgcagaaaccgacactcaatcagggccaacctcataccagctgattgtcaacaaccaaaattggtcaggg

SEQ ID NO: 206742 - DNA, 75 bp, Artificial Sequence
  Synthetic
caaggatgtaatggagtcaatggacaaagaaaagatggaggtaataacacattttcagagaaaaagaagagtaag

SEQ ID NO: 206743 - DNA, 75 bp, Artificial Sequence
  Synthetic
ttgtttttatgtggagctaatcagagggagacccaaagagagtgatgtactgtggacttccaatagcatggtagc

SEQ ID NO: 206744 - DNA, 75 bp, Artificial Sequence
  Synthetic
attttcagagaaaaagaagagtaagggacaacatgaccaaaaaaatgatcacacaaagaacaataggcaagaaaa

SEQ ID NO: 206745 - DNA, 75 bp, Artificial Sequence
  Synthetic
ggatcatggtcctggcatgatggtgcagaaatcatctactttaagtagaaataatttaagaaaaacacccttgtt

SEQ ID NO: 206746 - DNA, 75 bp, Artificial Sequence
  Synthetic
ggcgaaaggataacgtttgagagcaatggaggccttctagcccccagatacggatatatcattgagaagtacggt

SEQ ID NO: 206747 - DNA, 75 bp, Artificial Sequence
  Synthetic
gaaacacgggacctttggccctgtgcacttcagaaaccaagttaagataagacggagggtcgacataaacccggg

SEQ ID NO: 206748 - DNA, 75 bp, Artificial Sequence
  Synthetic
gaaagttaaagaggcgagcaattgcaacaccgggaatgcaaattagaggatttgtgtattttgtggaaacactag

SEQ ID NO: 206749 - DNA, 75 bp, Artificial Sequence
  Synthetic
aacaccgggaatgcaaattagaggatttgtgtattttgtggaaacactagcgaggagcatatgtgagaaacttga

SEQ ID NO: 206750 - DNA, 75 bp, Artificial Sequence
  Synthetic
aatacaagccaaaggggaatccttgaagacgaacagatgtatcaaaagtgctgcaatctattcgaaaaattcttc

SEQ ID NO: 206751 - DNA, 75 bp, Artificial Sequence
  Synthetic
tacctaactgaaatgactctcgaagaaatgtcgagggactggttcatgctcatgcccaagcagaaagtggtgggt

SEQ ID NO: 206752 - DNA, 75 bp, Artificial Sequence
  Synthetic
aaggcaagagaagaaccctgcactcaggatgaagtggatgatggcaatgaaatatccaattacagcagacaagag

SEQ ID NO: 206753 - DNA, 75 bp, Artificial Sequence
  Synthetic
tgggaaaagctcaataatgagatcagatgcacccattggcaaatgcaattctgaatgcatcactccaaatggaag

SEQ ID NO: 206754 - DNA, 75 bp, Artificial Sequence
  Synthetic
aatgttctcaaataaaatggcaagactaggaaagggatacatgttcgaaagtaagagcatgaagctacggacgca

SEQ ID NO: 206755 - DNA, 75 bp, Artificial Sequence
  Synthetic
gtaagagcatgaagctacggacgcaaataccagcagaaatgcttgcaaacattgatctgaaatatttcaacgaat

SEQ ID NO: 206756 - DNA, 75 bp, Artificial Sequence
  Synthetic
gcaaaacaaacgatgctggctcagaccgagtgatggtatcacctctggctgtgacatggtggaataggaatggac

SEQ ID NO: 206757 - DNA, 75 bp, Artificial Sequence
  Synthetic
ccgagtgatggtatcacctctggctgtgacatggtggaataggaatggaccaacaactagtacagttcattatcc

SEQ ID NO: 206758 - DNA, 75 bp, Artificial Sequence
  Synthetic
gcctcattaagccctggaatgatgatgggcatgtttaacatgctaagtacagtcttaggggtctcaatactgaac

SEQ ID NO: 206759 - DNA, 75 bp, Artificial Sequence
  Synthetic
agtcaattgctgaagcaataattgtggccatggtattctcacaagaggattgcatgattaaggcagttcgaggtg

SEQ ID NO: 206760 - DNA, 75 bp, Artificial Sequence
  Synthetic
gacataaaccctggccacgcagacctcagtgccaaagaggcacaggatgtaatcatggaagtcgttttcccaaat

SEQ ID NO: 206761 - DNA, 75 bp, Artificial Sequence
  Synthetic
cggagtcccaactgacgataacaaaagaaaagaaggaagaacttcaggactgcaagattgcccctttgatggttg

SEQ ID NO: 206762 - DNA, 75 bp, Artificial Sequence
  Synthetic
agaaaagaaggaagaacttcaggactgcaagattgcccctttgatggttgcatacatgctagagagagagttggt

SEQ ID NO: 206763 - DNA, 75 bp, Artificial Sequence
  Synthetic
gcattgcaagcagtactgtactggtgggtctcatacttgcatttataatgtgggcatgcagcagtggtaattgcc

SEQ ID NO: 206764 - DNA, 75 bp, Artificial Sequence
  Synthetic
ggagtaacagtgataaagaacaatatgataaacaatgaccttggaccagcaacagctcagatggctcttcaactg

SEQ ID NO: 206765 - DNA, 75 bp, Artificial Sequence
  Synthetic
gaccaagaagggaggttaatccaaaacagtataacaatagagagaatggttctctctgcatttgatgaaaggagg

SEQ ID NO: 206766 - DNA, 75 bp, Artificial Sequence
  Synthetic
aggccccctcaaagccgagatagcacagagacttgaagatgtttttgcagggaagaacacagatcttgaggctct

SEQ ID NO: 206767 - DNA, 75 bp, Artificial Sequence
  Synthetic
tctctctgcatttgatgaaaggaggaaccggtacttagaggaacatcctagtgcagggaaggacccgaagaagac

SEQ ID NO: 206768 - DNA, 75 bp, Artificial Sequence
  Synthetic
tcagtggataatcagaaactgggaaactgtaaaaattcaatggtcacaggatcccacaatgttgtataataagat

SEQ ID NO: 206769 - DNA, 75 bp, Artificial Sequence
  Synthetic
cttattcatcgtcgatgatgtgggagattaacggtcctgagtcggttttggtcaatacctatcaatggatcatca

SEQ ID NO: 206770 - DNA, 75 bp, Artificial Sequence
  Synthetic
aattcaaacaaggagatctttcgagctgaagaaactgtgggagcaaacccgctcaaaagcaggactgttggtttc

SEQ ID NO: 206771 - DNA, 75 bp, Artificial Sequence
  Synthetic
ggaattcgagccatttcagtctctggtccctaaggcagccagaggtcaatacagtgggttcgtgaggacactatt

SEQ ID NO: 206772 - DNA, 75 bp, Artificial Sequence
  Synthetic
agatggcgggccaaacctatacaacatccggaatctccatattccagaggtctgcctgaaatgggaattaatgga

SEQ ID NO: 206773 - DNA, 75 bp, Artificial Sequence
  Synthetic
attgaacctattgataatgtcatggggatgataggaatattgcctgacatgactccaagcacagagatgtcactg

SEQ ID NO: 206774 - DNA, 75 bp, Artificial Sequence
  Synthetic
ttctgtatgataaagaagagataaggagaatttggcgccaagcaaacaatggagaagacgcaactgctggtctca

SEQ ID NO: 206775 - DNA, 75 bp, Artificial Sequence
  Synthetic
cctaaatgatgccacataccagagaacaagagcccttgttcgaactggaatggatcccagaatgtgctctctaat

SEQ ID NO: 206776 - DNA, 75 bp, Artificial Sequence
  Synthetic
aggtaattccccagtgttcaattacaacaaggccaccaagaggctcacagttctcgggaaagatgcaggtgcatt

SEQ ID NO: 206777 - DNA, 75 bp, Artificial Sequence
  Synthetic
ataaggaaattgagtctgtaaacaatgctgtagtgatgccagctcatggtccagccaaaagcatggaatatgatg

SEQ ID NO: 206778 - DNA, 75 bp, Artificial Sequence
  Synthetic
agggagtcgggactatggtaatggaactaattcggatgataaagcgaggtattaatgaccggaacttctggagag

SEQ ID NO: 206779 - DNA, 75 bp, Artificial Sequence
  Synthetic
aataccagccaaagggggatccttgaagatgagcagatgtaccaaaagtgctgcaatctatttgaaaaattcttc

SEQ ID NO: 206780 - DNA, 75 bp, Artificial Sequence
  Synthetic
tgtgagcagattgctgactcccagcatcggtcccacaggcagatggtgacaacaaccaacccattaatcagacac

SEQ ID NO: 206781 - DNA, 75 bp, Artificial Sequence
  Synthetic
ggcagttcgaggtgatctgaactttgtcaatagggcaaatcagcggctaaacccaatgcatcaactcctgagaca

SEQ ID NO: 206782 - DNA, 75 bp, Artificial Sequence
  Synthetic
gcacggattgacttcgagtctggaaggattaagaaagaagagtttgctgagatcatgaagatctgttccaccatt

SEQ ID NO: 206783 - DNA, 75 bp, Artificial Sequence
  Synthetic
acaataacgacccctgcgataccgaactgcagtgacactataataacatacaataacactgtgataaacaacata

SEQ ID NO: 206784 - DNA, 75 bp, Artificial Sequence
  Synthetic
ttacctgcttgtgtgtatggactcgctgttgccagtggatatgattttgagagggaagggtattctctagttgga

SEQ ID NO: 206785 - DNA, 75 bp, Artificial Sequence
  Synthetic
actgagatgtcgctgagggggataagagtcagtaagatgggagttgatgaatactccagcacagagagagtagta

SEQ ID NO: 206786 - DNA, 75 bp, Artificial Sequence
  Synthetic
gctgtgccccttcagaggattcttcccttttcacaaggacaatgcaatacgactgggtgagaacaaagacgtcat

SEQ ID NO: 206787 - DNA, 75 bp, Artificial Sequence
  Synthetic
accaaatgaaaaccccgcacataaaagtcaattggtatggatggcatgccattctgcagcatttgaagacctgag

SEQ ID NO: 206788 - DNA, 75 bp, Artificial Sequence
  Synthetic
tcccgcactcaggatgaaatggatgatggcgatgaaatatccgatcactgctgacaaaaggataatggaaatgat

SEQ ID NO: 206789 - DNA, 75 bp, Artificial Sequence
  Synthetic
attgtcgcctgaagaagtcagcgagacacaagggacagagaagctgacaataacttattcgtcatcaatgatgtg

SEQ ID NO: 206790 - DNA, 75 bp, Artificial Sequence
  Synthetic
attctgcagcatttgaagacctgagagtatcaagtttcattagagggacgagggtaatcccaagagggcaactat

SEQ ID NO: 206791 - DNA, 75 bp, Artificial Sequence
  Synthetic
caggatcggacagagtgatggtgtcccctcttgctgtgacgtggtggaacaggaatgggccaactacaagcacag

SEQ ID NO: 206792 - DNA, 75 bp, Artificial Sequence
  Synthetic
ccctcttgctgtgacgtggtggaacaggaatgggccaactacaagcacagttcattatccaaaggtatacaaaac

SEQ ID NO: 206793 - DNA, 75 bp, Artificial Sequence
  Synthetic
tataagtaccactttcccttatactggtgatcccccatacagccatggaacaggaacagggtataccatggacac

SEQ ID NO: 206794 - DNA, 75 bp, Artificial Sequence
  Synthetic
atggatgtcaatccgactctactattcctaaaggtaccagcgcaaaatgctataagtaccactttcccttatact

SEQ ID NO: 206795 - DNA, 75 bp, Artificial Sequence
  Synthetic
caggaacagggtataccatggacactgtcaataggacgcatcagtactcagagaagggaaaatggacaacaaaca

SEQ ID NO: 206796 - DNA, 75 bp, Artificial Sequence
  Synthetic
gcatctgcggggcaaatcagtgtgcagcccactttctcagtgcagagaagtcttcccttcgaaagggctaccatt

SEQ ID NO: 206797 - DNA, 75 bp, Artificial Sequence
  Synthetic
acttccggaatcaagtaaagatacgccgtagggttgacataaacccaggtcatgctgatcttagtgcaaaagaag

SEQ ID NO: 206798 - DNA, 75 bp, Artificial Sequence
  Synthetic
ccgtagggttgacataaacccaggtcatgctgatcttagtgcaaaagaagcacaagatgtcatcatggaagtcgt

SEQ ID NO: 206799 - DNA, 75 bp, Artificial Sequence
  Synthetic
caataacaaaagaaaagaaagaggagcttcaagactgtaagattgctcctttaatggtagcatacatgttagaga

SEQ ID NO: 206800 - DNA, 75 bp, Artificial Sequence
  Synthetic
aaacgatggaagttgttcagcaaacacgagtggacaaactgacccaaggtcgacaaacatatgattggacattga

SEQ ID NO: 206801 - DNA, 75 bp, Artificial Sequence
  Synthetic
cagtgttcaattacaataaggccaccaagaggcttacagttctcgggaaagatgcaggtgcattgaccgaagatc

SEQ ID NO: 206802 - DNA, 75 bp, Artificial Sequence
  Synthetic
cgacaaacatatgattggacattgaacagaaaccagcctgctgcaactgccctagccaacaccatagaggttttc

SEQ ID NO: 206803 - DNA, 75 bp, Artificial Sequence
  Synthetic
cctacctgtagctggcgggacaagcagcgtgtatatcgaggtattgcatttgactcaggggacctgctgggaaca

SEQ ID NO: 206804 - DNA, 75 bp, Artificial Sequence
  Synthetic
acagaaaccagcctgctgcaactgccctagccaacaccatagaggttttcagatcgaatggtctagctgctaatg

SEQ ID NO: 206805 - DNA, 75 bp, Artificial Sequence
  Synthetic
tgactcaggggacctgctgggaacaaatgtacactccaggaggagaggtgaggaatgatgatgttgaccagagct

SEQ ID NO: 206806 - DNA, 75 bp, Artificial Sequence
  Synthetic
aatgtacactccaggaggagaggtgaggaatgatgatgttgaccagagcttaatcattgctgccaggaacattgt

SEQ ID NO: 206807 - DNA, 75 bp, Artificial Sequence
  Synthetic
gtgcgggaaggcaaattgtggagcagattctagaggaagaatctgatgagacacttaaaatgactattgcttctg

SEQ ID NO: 206808 - DNA, 75 bp, Artificial Sequence
  Synthetic
aaagaagaaatggaaataacaacacatttccaaagaaaaaggagagttagagacaacatgaccaagaaaatgatc

SEQ ID NO: 206809 - DNA, 75 bp, Artificial Sequence
  Synthetic
gacactcccaggccagccgacccttcaacaatgtcatgtgactccccaagcaatgtcaatggaggacccggagtg

SEQ ID NO: 206810 - DNA, 75 bp, Artificial Sequence
  Synthetic
aaggctaatgtgctaatcgggcaaggagacgtagtgttggtaatgaaacggaaacgggactctagcatacttact

SEQ ID NO: 206811 - DNA, 75 bp, Artificial Sequence
  Synthetic
gccatagcacacaaattggaggaacacggatggtggacatccttagacaaaatccaacagaagagcaagccgtgg

SEQ ID NO: 206812 - DNA, 75 bp, Artificial Sequence
  Synthetic
cgtcgagcttgcggaaaaggcaatgaaagaatatggggaagatccgaaaatcgaaaccaacaaattcgctgcaat

SEQ ID NO: 206813 - DNA, 75 bp, Artificial Sequence
  Synthetic
gactggttcatgctcatgccaaagcagaaagtggctggttccctgtgcattagaatggaccaggcaataatggat

SEQ ID NO: 206814 - DNA, 75 bp, Artificial Sequence
  Synthetic
acaatgactaaagatgcggaaagaggcaaattgaagaggcgggcaattgcgacacccgggatgcagatcagaggt

SEQ ID NO: 206815 - DNA, 75 bp, Artificial Sequence
  Synthetic
atttccaaagaaaaaggagagttagagacaacatgaccaagaaaatgatcacacaaagaacaataggaaagaaga

SEQ ID NO: 206816 - DNA, 75 bp, Artificial Sequence
  Synthetic
caaagcctaattattgcggccaggaacatagtaagaagagccgcagtatcagcagatccactagcatctttattg

SEQ ID NO: 206817 - DNA, 75 bp, Artificial Sequence
  Synthetic
atcaattacacagacactggtgtccaacaatgactggtcgggctattcaggtagtttcattgtcaaaaccaagga

SEQ ID NO: 206818 - DNA, 75 bp, Artificial Sequence
  Synthetic
acagaagacccagatgaggggacagcgggagtggaatctgcagtattaagagggtttctaattctaggcaaagag

SEQ ID NO: 206819 - DNA, 75 bp, Artificial Sequence
  Synthetic
gcaaattgaagaggcgggcaattgcgacacccgggatgcagatcagaggtttcgtttatttcgtcgaaacacttg

SEQ ID NO: 206820 - DNA, 75 bp, Artificial Sequence
  Synthetic
actatacaggatgtgacttcgattatactagccggcaattcctcactttgcccagtaagtggatgggctatatac

SEQ ID NO: 206821 - DNA, 75 bp, Artificial Sequence
  Synthetic
aatgagaaaaaggctaaattggcaaatgttgtaagaaaaatgatgactaattctcaagacacggaagtctctttc

SEQ ID NO: 206822 - DNA, 75 bp, Artificial Sequence
  Synthetic
gacagtggtgaatagcatctgcaacaccacaggggtcgagaagcctaaattccttccggatctgtatgattacaa

SEQ ID NO: 206823 - DNA, 75 bp, Artificial Sequence
  Synthetic
gcatgataaaggcggtccgaggtgatttgaactttgtgaacagagctaaccaacgactaaatcccatgcaccagc

SEQ ID NO: 206824 - DNA, 75 bp, Artificial Sequence
  Synthetic
acaagaaaccaacctgaatggtttagaaatgtcttgagtattgcccctataatgttctcaaacaaaatggcaaga

SEQ ID NO: 206825 - DNA, 75 bp, Artificial Sequence
  Synthetic
ataatcactcactgagtgacatcaaaatcatggcgtcccaaggcaccaaacgatcttatgaacagatggaaactg

SEQ ID NO: 206826 - DNA, 75 bp, Artificial Sequence
  Synthetic
tttgaactttgtgaacagagctaaccaacgactaaatcccatgcaccagctcttgaggcatttccaaaaggatgc

SEQ ID NO: 206827 - DNA, 75 bp, Artificial Sequence
  Synthetic
atgagtcttctaaccgaggtcgaaacgtatgttctctctatcatcccatcaggccccctcaaagccgagatcgcg

SEQ ID NO: 206828 - DNA, 75 bp, Artificial Sequence
  Synthetic
ggatgattggaatattgcccgacatgacccccagcacggacatgtcactaagaggagtaagagtgagcaaaatgg

SEQ ID NO: 206829 - DNA, 75 bp, Artificial Sequence
  Synthetic
ggattcctttcgtcagtccgaaagaggcgaagagacaattgaagaaagatttgaaatcacaggaaccatgcgcag

SEQ ID NO: 206830 - DNA, 75 bp, Artificial Sequence
  Synthetic
cctccccttcgaaagagcgaccattatggcagcatttacaggaaatactgagggtagaacgtctgacatgaggac

SEQ ID NO: 206831 - DNA, 75 bp, Artificial Sequence
  Synthetic
gacccccagcacggacatgtcactaagaggagtaagagtgagcaaaatgggagtggatgaatattctagtactga

SEQ ID NO: 206832 - DNA, 75 bp, Artificial Sequence
  Synthetic
ggaatgtgctattgtcccctgaagaggtcagtgaaacacaaggaatggagaggttgactataacatattcatctt

SEQ ID NO: 206833 - DNA, 75 bp, Artificial Sequence
  Synthetic
ggtcagtgaaacacaaggaatggagaggttgactataacatattcatcttccatgatgtgggagattaacggacc

SEQ ID NO: 206834 - DNA, 75 bp, Artificial Sequence
  Synthetic
atcctctgatgactttgcactcatagtgaatgcacctaatcatgaagggatacaagcaggagtggacagatttta

SEQ ID NO: 206835 - DNA, 75 bp, Artificial Sequence
  Synthetic
agttgtatgggtctcatatacaaccggatgggaacagtgaacacagaagtggctcttggtctagtgtgtgctact

SEQ ID NO: 206836 - DNA, 75 bp, Artificial Sequence
  Synthetic
cctgagaggaagaagcagcactcttggtctggacatcagaactgccactcgtgaaggaaagcatatagtggaacg

SEQ ID NO: 206837 - DNA, 75 bp, Artificial Sequence
  Synthetic
catgagggagaggggataccactatacgatgcaatcaaatgcatgaagacatttttcggctggaaagagcccaac

SEQ ID NO: 206838 - DNA, 75 bp, Artificial Sequence
  Synthetic
ccgtgaagattcaatggtcccaagacccaacaatactatacaataaactggaatttgaaccctttcaatcgttgg

SEQ ID NO: 206839 - DNA, 75 bp, Artificial Sequence
  Synthetic
gaatttgaaccctttcaatcgttggtgcccaaggctgctagatgccaatatagtggatttgtaagaacactattc

SEQ ID NO: 206840 - DNA, 75 bp, Artificial Sequence
  Synthetic
atcgttctcacagacagatggcagctactaccaacccactaatcaggcatgagaacagaatggtgctggccagca

SEQ ID NO: 206841 - DNA, 75 bp, Artificial Sequence
  Synthetic
cattcgatactgtccaaataataaagctactaccatttgcagcagctccaccagtgcagagtaggatgcagtttt

SEQ ID NO: 206842 - DNA, 75 bp, Artificial Sequence
  Synthetic
gctactaccatttgcagcagctccaccagtgcagagtaggatgcagttttcttctctaaccgtgaatgtgagggg

SEQ ID NO: 206843 - DNA, 75 bp, Artificial Sequence
  Synthetic
atgaatccaaatcaaaggataatagcgattgggtcagtgaacacagtattatccacaatagcactgctaattggg

SEQ ID NO: 206844 - DNA, 75 bp, Artificial Sequence
  Synthetic
gccttgaaaactttagagcctatgtggatggattcgagccgaacggctgcattgagggcaagctttctcaaatgt

SEQ ID NO: 206845 - DNA, 75 bp, Artificial Sequence
  Synthetic
accgatgccataggggagatactcaaatccaaacaagaagatcgtttgagctgaaaaagctgtgggagcagaccc

SEQ ID NO: 206846 - DNA, 75 bp, Artificial Sequence
  Synthetic
ttgaaaatttgcaggcttaccagaaacgaatgggtttgcaaatgcagcgattcaagtgatcctctcgtctttgcc

SEQ ID NO: 206847 - DNA, 75 bp, Artificial Sequence
  Synthetic
acaaggcaaccaagaggcttatagtcctcggaaaggatgcaggtgcacttacagaggaccaagatgagggaacag

SEQ ID NO: 206848 - DNA, 75 bp, Artificial Sequence
  Synthetic
gaaaacatggcaccagaaaaagtggactttgaggattgcaaggatgttggcgatttgaaacagtatgatagcgat

SEQ ID NO: 206849 - DNA, 75 bp, Artificial Sequence
  Synthetic
tggtcatacaacgcagagcttcttgttgccctggagaaccaacatacaattgatctaactgactcagaaatgaac

SEQ ID NO: 206850 - DNA, 75 bp, Artificial Sequence
  Synthetic
cttgttctcagcggtctaaattcttgctgatggatgctctgaaactaagcatcgaagacccgagtcatgagggag

SEQ ID NO: 206851 - DNA, 75 bp, Artificial Sequence
  Synthetic
agggtttctgatcttgggcaaagaagacaaaagatttggacctgcattgagcatcaacgaattgggcaatcttgc

SEQ ID NO: 206852 - DNA, 75 bp, Artificial Sequence
  Synthetic
cattctaatttgaatgatgccacatatcagaggaccagagccctagtgcgcaccgggatggaccccaggatgtgc

SEQ ID NO: 206853 - DNA, 75 bp, Artificial Sequence
  Synthetic
atcagaaacctccacattcccgaagtctgtttgaagtgggagctaatggatgaggattatcaaggcaggctgtgc

SEQ ID NO: 206854 - DNA, 75 bp, Artificial Sequence
  Synthetic
atggatgtcaatccgactttacttttcttgaaaattccagcacaaaatgctataagcattacattcccttatact

SEQ ID NO: 206855 - DNA, 75 bp, Artificial Sequence
  Synthetic
gcaatagctgggtttatagaaggcggatggcaagggatggttgatggctggtatgggtatcatcacagcaatgat

SEQ ID NO: 206856 - DNA, 75 bp, Artificial Sequence
  Synthetic
ccagccaaaagcatggaatacgacgctgttgcaactacacattcctggattcccaagaggaatcgttccattctc

SEQ ID NO: 206857 - DNA, 75 bp, Artificial Sequence
  Synthetic
ataggcaacttagctttcaatgcagttattcatggcaaagttgagaacagtaacggtggaattgcaccaaccacc

SEQ ID NO: 206858 - DNA, 75 bp, Artificial Sequence
  Synthetic
agtaaatagaacacatcaatactcagagaaggggagatggacaataaatacagagactggagcacctcaacttaa

SEQ ID NO: 206859 - DNA, 75 bp, Artificial Sequence
  Synthetic
tgcgacaatatgtttactcattcagattgccatcttagcaacgactatgacactacatttcaagcagaacgagta

SEQ ID NO: 206860 - DNA, 75 bp, Artificial Sequence
  Synthetic
caggaacaggatacaccatggacacagtaaatagaacacatcaatactcagagaaggggagatggacaataaata

SEQ ID NO: 206861 - DNA, 75 bp, Artificial Sequence
  Synthetic
cgagatactgacaaaaaccacagtggaccatatggccataatcaagaagtacacatcaggaagacaggagaagaa

SEQ ID NO: 206862 - DNA, 75 bp, Artificial Sequence
  Synthetic
tccaaggacaactcaattaggctttctgcaggtggggatatttgggtgacaagagaaccctatgtgtcgtgcggt

SEQ ID NO: 206863 - DNA, 75 bp, Artificial Sequence
  Synthetic
tgtcccactgcagggccactgaatacataatgaaaggagtctacataaatacagctctgctcaatgcatcttgtg

SEQ ID NO: 206864 - DNA, 75 bp, Artificial Sequence
  Synthetic
cacacaagagccaattggtatggatggcatgtcattctgctgcatttgaggatttgagagtgtcaagcttcatca

SEQ ID NO: 206865 - DNA, 75 bp, Artificial Sequence
  Synthetic
tttggccaacactatagaggttttcagatcgaacggtctaacagccagtgaatcagggagactaattgatttcct

SEQ ID NO: 206866 - DNA, 75 bp, Artificial Sequence
  Synthetic
caaggttcaggatatgcagcagacaaagaatccactcaaaaggcaattgacgggataactaacaaggtaaattct

SEQ ID NO: 206867 - DNA, 75 bp, Artificial Sequence
  Synthetic
agcaaaagcagggtagataatcactcacccgagtgacatcaacatcatggcgtctcaaggcaccaaacgatctta

SEQ ID NO: 206868 - DNA, 75 bp, Artificial Sequence
  Synthetic
gatagaagtccctatagaacccttttgatgagcgaactgggtgttccatttcatttgggaaccaaacaagtgtgc

SEQ ID NO: 206869 - DNA, 75 bp, Artificial Sequence
  Synthetic
aacagtctatacgcatctccacaacttgagggattttcagcagaatcgaggaaattgcttctcattgttcaggca

SEQ ID NO: 206870 - DNA, 75 bp, Artificial Sequence
  Synthetic
ctgcaggtggggatatttgggtgacaagagaaccctatgtgtcgtgcggtctcaacaagtgttaccaatttgcac

SEQ ID NO: 206871 - DNA, 75 bp, Artificial Sequence
  Synthetic
atcgcttggtccagctcaagctgccatgatggtaaagcatggttgcatgtttgtgtcactggggatgatagaaat

SEQ ID NO: 206872 - DNA, 75 bp, Artificial Sequence
  Synthetic
aacaaaggttgaacaaaaagagctacttaataagagcactgacactaaacacaatgacaaaagatgcagaaagag

SEQ ID NO: 206873 - DNA, 75 bp, Artificial Sequence
  Synthetic
ggtacctggaggaacaccccagtgcggggaaggacccgaagaaaactggaggtccaatttataagaggagagacg

SEQ ID NO: 206874 - DNA, 75 bp, Artificial Sequence
  Synthetic
cctggttcaactccttcctcacacatgcactgaaatagttgtggcaatgctactatttgctatccatactgtcca

SEQ ID NO: 206875 - DNA, 75 bp, Artificial Sequence
  Synthetic
cacggacaatctgtgagaaacttgagcaatctggacttcctgtcggagggaatgagaagaaggctaaattggcaa

SEQ ID NO: 206876 - DNA, 75 bp, Artificial Sequence
  Synthetic
actccaggactgcaaaattgcccccttaatggttgcgtacatgttggaaagagaactggtccgcaagactcgatt

SEQ ID NO: 206877 - DNA, 75 bp, Artificial Sequence
  Synthetic
taggcacgattgcagtactcataggaatagcaaacctgggactgaacataggactacatctgaagccaaactgca

SEQ ID NO: 206878 - DNA, 75 bp, Artificial Sequence
  Synthetic
gatgaatccaaatcagaagattctatgcacttctgccactgctattgtaataggcacgattgcagtactcatagg

SEQ ID NO: 206879 - DNA, 75 bp, Artificial Sequence
  Synthetic
caggagtcagaatgcgtttgcatcaatggaacgtgtgcagtagtaatgactgatggaagcgcatcagggagggct

SEQ ID NO: 206880 - DNA, 75 bp, Artificial Sequence
  Synthetic
tcatgtcttgaaacaatggaaattgttcaacaaacaagagtggataaactgacccaaggtcgtcagacctatgac

SEQ ID NO: 206881 - DNA, 75 bp, Artificial Sequence
  Synthetic
gaggagtgctcttgttaccctcggtacccagaagttagatgtgtttgcagagacaattggaagggctccaataga

SEQ ID NO: 206882 - DNA, 75 bp, Artificial Sequence
  Synthetic
gaaacatggccaattggagaatcccccaggggagtagaggaaggctctattggaaaagtatgtagaaccttgctg

SEQ ID NO: 206883 - DNA, 75 bp, Artificial Sequence
  Synthetic
aacaactactataacgaaacaaacatcacccaaataagcaataccaacatccaaatggaggagaaaacaaagaga

SEQ ID NO: 206884 - DNA, 75 bp, Artificial Sequence
  Synthetic
gagcagacccgttcaaaggcaggactgttggtttcagatggaggcccaaatttatacaatatacggaatctccac

SEQ ID NO: 206885 - DNA, 75 bp, Artificial Sequence
  Synthetic
atgctcaggacttgttggcgatacaccaagaagtgatgacagctccagcagcagtaactgcagggatcctaataa

SEQ ID NO: 206886 - DNA, 75 bp, Artificial Sequence
  Synthetic
tctgcactataaattcatggcatatctatgggaaagacaatgcagtaagaattggggagaactcagatgttctag

SEQ ID NO: 206887 - DNA, 75 bp, Artificial Sequence
  Synthetic
gcagtaactgcagggatcctaataacgagagagggagcccaggagtgaaaggatgggcctttgacagtggaaatg

SEQ ID NO: 206888 - DNA, 75 bp, Artificial Sequence
  Synthetic
aatgttctcaaacaaaatggcgagattgggaaaaggttacatgttcgagagtaagagcatgaggctaaggacaca

SEQ ID NO: 206889 - DNA, 75 bp, Artificial Sequence
  Synthetic
caacaaaaaagaaaattgagaaaataagacctctcctaatagatggtacagcctcgctgagtccgggaatgatga

SEQ ID NO: 206890 - DNA, 75 bp, Artificial Sequence
  Synthetic
gctctcagccaaggaacaacaattagagggaaacactcaaatggaacaatacacgatagatcccagtaccgcgcc

SEQ ID NO: 206891 - DNA, 75 bp, Artificial Sequence
  Synthetic
actttcaaggtcattggtggttggaacgcggctaattcaaagtcacaaataaataggcaagtcatagttgatagt

SEQ ID NO: 206892 - DNA, 75 bp, Artificial Sequence
  Synthetic
agaatgcattggttggtcaagtactagctgtcatgatggtagagccaggatgtcaatatgtatatcaggcccaaa

SEQ ID NO: 206893 - DNA, 75 bp, Artificial Sequence
  Synthetic
ttataaatattagcccattgtcaggaagtgctcagcacgttgaggaatgctcctgttatccccggtatcctgaag

SEQ ID NO: 206894 - DNA, 75 bp, Artificial Sequence
  Synthetic
agctgtcatgatggtagagccaggatgtcaatatgtatatcaggcccaaacaacaatgcgtcagcagtaatttgg

SEQ ID NO: 206895 - DNA, 75 bp, Artificial Sequence
  Synthetic
tgatagtgagtgggagagatgaacaatctattgcagaagccataattgtagctatggtgttttcacaagaagact

SEQ ID NO: 206896 - DNA, 75 bp, Artificial Sequence
  Synthetic
atcctctgatgatttcgctctcatagtgaatgcaccgaatcatgagggaatacaagctggagtggacagattcta

SEQ ID NO: 206897 - DNA, 75 bp, Artificial Sequence
  Synthetic
agggaatacaagcaggagtggatagattctacaggacctgcaagttagtgggaatcaacatgagcaaaaagaagt

SEQ ID NO: 206898 - DNA, 75 bp, Artificial Sequence
  Synthetic
acggacacaagaatctgaatgcgtatgccacaacggtgtctgcccggtagtattcacagatgggtctgccaccgg

SEQ ID NO: 206899 - DNA, 75 bp, Artificial Sequence
  Synthetic
cacaagctttttctatcgatatggatttgtagccaattttagcatggaactgcccagctttggagtatctgggat

SEQ ID NO: 206900 - DNA, 75 bp, Artificial Sequence
  Synthetic
taaatcggacagggacatttgagttcacaagctttttctatcgatatggatttgtagccaattttagcatggaac

SEQ ID NO: 206901 - DNA, 75 bp, Artificial Sequence
  Synthetic
tgccacaacggtgtctgcccggtagtattcacagatgggtctgccaccggacctgcagaaacaagagtatactat

SEQ ID NO: 206902 - DNA, 75 bp, Artificial Sequence
  Synthetic
tggaagactttgtgcgacaatgtttcaatccaatgattgtcgagcttgcggaaaagacaatgaaagagtatgggg

SEQ ID NO: 206903 - DNA, 75 bp, Artificial Sequence
  Synthetic
ggagttacagtaataaagaataatatgataaataatgatcttgggccagcaacagcacaaatggctcttcagcta

SEQ ID NO: 206904 - DNA, 75 bp, Artificial Sequence
  Synthetic
acacattgaagaatgctcatgctatggagtgcaggcaggtattacttgcacgtgcagagataattggcagggttc

SEQ ID NO: 206905 - DNA, 75 bp, Artificial Sequence
  Synthetic
atgactaagtcgtacagaaatcccaggaacaaaccagctctgataatttggggagtgcatcactctggatcggct

SEQ ID NO: 206906 - DNA, 75 bp, Artificial Sequence
  Synthetic
gagaaatttttccctagtagttcatacaggagaccggttggaatttctagcatggtggaggccatggtgtctagg

SEQ ID NO: 206907 - DNA, 75 bp, Artificial Sequence
  Synthetic
agaggaataagggtcagtaaaatgggggtagatgagtattccagcactgagagagtggttgtaagcatcgatcgc

SEQ ID NO: 206908 - DNA, 75 bp, Artificial Sequence
  Synthetic
ggagtgcaggcaggtattacttgcacgtgcagagataattggcagggttcaaatagaccagtaattcaaatagat

SEQ ID NO: 206909 - DNA, 75 bp, Artificial Sequence
  Synthetic
gtggaaacaagttgataacagtaggaagctcaaaataccagcagtcattcaccccaagcccgggggcacgaccac

SEQ ID NO: 206910 - DNA, 75 bp, Artificial Sequence
  Synthetic
agataatccccggccgaacgacccagcagtaggtaagtgtaatgacccttacccaggaaataacaacaatggagt

SEQ ID NO: 206911 - DNA, 75 bp, Artificial Sequence
  Synthetic
ctgaaaaagttatgggagcagacccgttcaaaaacaggactgttggtatctgatggaggaccaaacttatacaac

SEQ ID NO: 206912 - DNA, 75 bp, Artificial Sequence
  Synthetic
cactttctcggtacagagaaaccttcccttcgaaagagcgactattatggcagcattcacaggaagtactgaggg

SEQ ID NO: 206913 - DNA, 75 bp, Artificial Sequence
  Synthetic
caaaggattttcatacctggatgggggtaatacttggctaggaagaacaataagcacagcttccagatcaggata

SEQ ID NO: 206914 - DNA, 75 bp, Artificial Sequence
  Synthetic
tgaagactacagaggtaggctgtgtaatcctctcaatccatttgttagtcataaggaaattgagtccgtaaataa

SEQ ID NO: 206915 - DNA, 75 bp, Artificial Sequence
  Synthetic
cgattaccctattcaagacgcccaatacacaaataatcaagggaagaacattcttttcatgtggggcataaatca

SEQ ID NO: 206916 - DNA, 75 bp, Artificial Sequence
  Synthetic
aagttcacatatactacctggagaaagccaacaagataaaaaccgagaagacacacattcacatcttctcattca

SEQ ID NO: 206917 - DNA, 75 bp, Artificial Sequence
  Synthetic
agccaacaagataaaaaccgagaagacacacattcacatcttctcattcacgggggaggaaatggccaccggagc

SEQ ID NO: 206918 - DNA, 75 bp, Artificial Sequence
  Synthetic
ctgaatacataatgaagggagtgtacataaacacagccctattgaatgcatcctgtgcagccatggatgacttcc

SEQ ID NO: 206919 - DNA, 75 bp, Artificial Sequence
  Synthetic
cccaaggccaaacaattgtattaaacactgactggagtggctacagtgggtccttcatggactattgggctgaag

SEQ ID NO: 206920 - DNA, 75 bp, Artificial Sequence
  Synthetic
ctgttgctactacacattcatggatccctaagaggaaccgctccattctcaatacaagccaaaggggaattcttg

SEQ ID NO: 206921 - DNA, 75 bp, Artificial Sequence
  Synthetic
tccttcatggactattgggctgaaggggagtgctaccgagcgtgtttttacgtggagttaatacgcggaaggccc

SEQ ID NO: 206922 - DNA, 75 bp, Artificial Sequence
  Synthetic
ctgcaatctattcgagaaattcttccccagtagttcatacaggagaccagttggaatctccagcatggtagaggc

SEQ ID NO: 206923 - DNA, 75 bp, Artificial Sequence
  Synthetic
ccggaacagagtaggatgcaattttcttctctaactgtgaacgtgagaggttcagggatgagaatactcattagg

SEQ ID NO: 206924 - DNA, 75 bp, Artificial Sequence
  Synthetic
attgatgccagaattgacttcgagtctggaaggattaagaaggaagagttctctgagatcatgaagatctgttcc

SEQ ID NO: 206925 - DNA, 75 bp, Artificial Sequence
  Synthetic
atgaagaaaacactgctccttgcagcaatcaccatctgcattcaagcagacgagatctgcatcgggtacctgagc

SEQ ID NO: 206926 - DNA, 75 bp, Artificial Sequence
  Synthetic
aaacagctactcgtgcgggaaagcagatagtggagcgaattctggagaaggaatctgatgaggcacttaaaatgc

SEQ ID NO: 206927 - DNA, 75 bp, Artificial Sequence
  Synthetic
taaccacagaagtggcttttggtctagtatgtgccacttgtgagcagattgctgactctcagcatcgatcccaca

SEQ ID NO: 206928 - DNA, 75 bp, Artificial Sequence
  Synthetic
cgagatctgcatcgggtacctgagcaacaactcaacagaaaaagtggacacaataattgagagtaatgtcacggt

SEQ ID NO: 206929 - DNA, 75 bp, Artificial Sequence
  Synthetic
ccttgggaaagatgcaggttcattgacagaagacccagatgaggggacagcgggagtggaatctgcagtattaag

SEQ ID NO: 206930 - DNA, 75 bp, Artificial Sequence
  Synthetic
aggaagtgaacgctagaatcgagccctttttgaagacaacgccacgccctctcaaattacctaatggccctccct

SEQ ID NO: 206931 - DNA, 75 bp, Artificial Sequence
  Synthetic
aacgagcacactgggtctttctgctcaatcgatgggaaagcaccaataagtcttggtgattgctcctttgctggt

SEQ ID NO: 206932 - DNA, 75 bp, Artificial Sequence
  Synthetic
ggaacatatgattaccccaaatatgaagaagagtctaagctgaacaggaacgaaatcaaaggggtgaaattgagc

SEQ ID NO: 206933 - DNA, 75 bp, Artificial Sequence
  Synthetic
ctatggagcagatggctggatcgagtgaacaagcagcagaggcaatggaggttgcaggccaggctagacagatgg

SEQ ID NO: 206934 - DNA, 75 bp, Artificial Sequence
  Synthetic
tcttggtgattgctcctttgctggttggatccttggaaacccgatgtgtgatgatttgattgggaaaacatcatg

SEQ ID NO: 206935 - DNA, 75 bp, Artificial Sequence
  Synthetic
cagataaacggataatggagatgattcctgagagaaatgagcagggtcaaactctttggagcaagatgaatgatg

SEQ ID NO: 206936 - DNA, 75 bp, Artificial Sequence
  Synthetic
tggatccttggaaacccgatgtgtgatgatttgattgggaaaacatcatggtcctacatcgtggagaaaccaaac

SEQ ID NO: 206937 - DNA, 75 bp, Artificial Sequence
  Synthetic
gggactggatgctttgagatatttcataagtgtgatgatcagtgcatggagagcataaggaacaacacttatgac

SEQ ID NO: 206938 - DNA, 75 bp, Artificial Sequence
  Synthetic
atccacaatagcactgctaattgggataggcaacttagctttcaatgcagttattcatggcaaagttgagaacag

SEQ ID NO: 206939 - DNA, 75 bp, Artificial Sequence
  Synthetic
gaggctgaagtttagtggggtcctcgagttcagcaaatttgaagccttcacttcaaatggatggggagcagtgaa

SEQ ID NO: 206940 - DNA, 75 bp, Artificial Sequence
  Synthetic
ttcattatccacaggtctataaaacatactttgaaaaagttgaaaggttaaaacatggaacctttggtcctgttc

SEQ ID NO: 206941 - DNA, 75 bp, Artificial Sequence
  Synthetic
gagttcagcaaatttgaagccttcacttcaaatggatggggagcagtgaattctggtgctggtgttaccgcagcc

SEQ ID NO: 206942 - DNA, 75 bp, Artificial Sequence
  Synthetic
ggagacttccactcccttcagatcagaaacggaaaatggcgagagcaattgagtcagaagtttgaagaaataaga

SEQ ID NO: 206943 - DNA, 75 bp, Artificial Sequence
  Synthetic
tcctgagagaaatgagcagggtcaaactctttggagcaagatgaatgatgccggatcagacagagtgatggtatc

SEQ ID NO: 206944 - DNA, 75 bp, Artificial Sequence
  Synthetic
tactaccatcaataacataacaaatgttgttcttcgagatccggagagacatttcagagctccgctgccattgtg

SEQ ID NO: 206945 - DNA, 75 bp, Artificial Sequence
  Synthetic
ccaccaatcagggacatatcctgttataaggaggacattcaataacaccaaaggaagagatgtattaatggtatg

SEQ ID NO: 206946 - DNA, 75 bp, Artificial Sequence
  Synthetic
cacaagatgtcatcatggaagtcgttttcccaaatgaggttggagccaaaatactgacatcagagtcacaattaa

SEQ ID NO: 206947 - DNA, 75 bp, Artificial Sequence
  Synthetic
atactttgaaaaagttgaaaggttaaaacatggaacctttggtcctgttcacttccgaaatcaagtcaagatacg

SEQ ID NO: 206948 - DNA, 75 bp, Artificial Sequence
  Synthetic
gggaatccaccaccctgcaactctaaaggaacaccaagacttgtacaaaaaggacagttcttatgtagcagtagg

SEQ ID NO: 206949 - DNA, 75 bp, Artificial Sequence
  Synthetic
gttgttcttcgagatccggagagacatttcagagctccgctgccattgtgccctttcagagggttcttcccgttt

SEQ ID NO: 206950 - DNA, 75 bp, Artificial Sequence
  Synthetic
acagattcaagttggattgaacttgatgagataggggaggatgttgctccaatcgagcacattgcaagtatgaga

SEQ ID NO: 206951 - DNA, 75 bp, Artificial Sequence
  Synthetic
caccagtactcagaaaaagggacatggacaacaaacaccgaaactggagcacctcagcttaacccgatcgatgga

SEQ ID NO: 206952 - DNA, 75 bp, Artificial Sequence
  Synthetic
actccaggactgtaagattgctcccttaatggtggcatacatgttggaaagagagctggttcgcaaaactagatt

SEQ ID NO: 206953 - DNA, 75 bp, Artificial Sequence
  Synthetic
aagtgaatggtcaggctgggagaatgacattctattggaccatagtgaaaccgggagaagcaataacatttgagt

SEQ ID NO: 206954 - DNA, 75 bp, Artificial Sequence
  Synthetic
aagagaaccctacatcagctgtgacaatgagggttgttggtcctttgcactggctcaaggcgcgctcctggggac

SEQ ID NO: 206955 - DNA, 75 bp, Artificial Sequence
  Synthetic
tgactcaagggacctgctgggaacaaatgtacactccaggaggggaagtgagaaatgacgatgttgaccagagtt

SEQ ID NO: 206956 - DNA, 75 bp, Artificial Sequence
  Synthetic
tgtgctcggaaactacaaagaaatgtgtgctgcatggtccagtagcagctgcttcgatggaaaagaatggttgca

SEQ ID NO: 206957 - DNA, 75 bp, Artificial Sequence
  Synthetic
ccgggagaagcaataacatttgagtcaaatggcgcatttcttgctcctaggtatgcttttgaattagtgtccctg

SEQ ID NO: 206958 - DNA, 75 bp, Artificial Sequence
  Synthetic
aatgaagggagtgtacataaacacagccctgttgaatgcatcatgtgcagccatggatgacttccagctaattcc

SEQ ID NO: 206959 - DNA, 75 bp, Artificial Sequence
  Synthetic
aatgagggttgttggtcctttgcactggctcaaggcgcgctcctggggacaaagcacagcaatgggacaaacaag

SEQ ID NO: 206960 - DNA, 75 bp, Artificial Sequence
  Synthetic
taagtgccagtccgaaattggagggataaacactaataggagcttccacaatgtccataggaacacaataggaga

SEQ ID NO: 206961 - DNA, 75 bp, Artificial Sequence
  Synthetic
gccatagtacattaattggcggggttaggatggtggacatccttaggcaaaacccgacagaggaacaagctgtag

SEQ ID NO: 206962 - DNA, 75 bp, Artificial Sequence
  Synthetic
agctgcaacggctttagccaacaccatagaggtcttcagatcgaacggtctaacagctaatgaatcggggagact

SEQ ID NO: 206963 - DNA, 75 bp, Artificial Sequence
  Synthetic
gcaagggtcaactcttccgaggagatctggagctgcaggtgcagcagtaaagggaatagggacgatggtgatgga

SEQ ID NO: 206964 - DNA, 75 bp, Artificial Sequence
  Synthetic
atcatggcagaacaatatattgaggacacaagagtcagaatgccagtgtctatacgggacctgcatcgtggcagt

SEQ ID NO: 206965 - DNA, 75 bp, Artificial Sequence
  Synthetic
aacccgacagaggaacaagctgtagatatatgcaaggcagcaatgggtctgaaaatcagttcatcattcagcttt

SEQ ID NO: 206966 - DNA, 75 bp, Artificial Sequence
  Synthetic
aggcctttttggtgcaatagctggtttcatagaaggtggttggccaggtctaatcaatggttggtatggattcca

SEQ ID NO: 206967 - DNA, 75 bp, Artificial Sequence
  Synthetic
aaataacaacacatttccaaagaaaaagaagagtaagggacaacatgaccaagaaaatggtcacacaaagaacaa

SEQ ID NO: 206968 - DNA, 75 bp, Artificial Sequence
  Synthetic
aagaggggaaagtcataaaatacgagaaggtaccagacgacaagatacagcacttggaagagtgttcatgttaca

SEQ ID NO: 206969 - DNA, 75 bp, Artificial Sequence
  Synthetic
aatggggaatggaaatgaggcgatgcctccttcaatctcttcaacaaattgagagtatgattgaggccgagtctt

SEQ ID NO: 206970 - DNA, 75 bp, Artificial Sequence
  Synthetic
ccaccaacccactaatcaggcatgagaacagaatggtgctggccagcactacagctaaggctatggagcagatgg

SEQ ID NO: 206971 - DNA, 75 bp, Artificial Sequence
  Synthetic
gaagctgaaaagagaaataacattccatggggctaaggaggttgcactcagctactcaaccggtgcactcgccag

SEQ ID NO: 206972 - DNA, 75 bp, Artificial Sequence
  Synthetic
taaagtcaataacattgttgatcgaatgaatacgaactttgagtctgttcaacatgaattcagtgaaattgaaga

SEQ ID NO: 206973 - DNA, 75 bp, Artificial Sequence
  Synthetic
atgcagaaagaggtaaattgaagaggagggcgattgcaacacctggaatgcagattagaggtttcgtctacttcg

SEQ ID NO: 206974 - DNA, 75 bp, Artificial Sequence
  Synthetic
atcaatcgctgaagcgatcatagtagcgatggtgttctcacaggaggactgtatgataaaggcagttcgaggaga

SEQ ID NO: 206975 - DNA, 75 bp, Artificial Sequence
  Synthetic
atggattccaacactgtgtcaagtttccaggtagattgctttctttggcatatccggaaacaagttgtagaccaa

SEQ ID NO: 206976 - DNA, 75 bp, Artificial Sequence
  Synthetic
caattgggactcatcctaactctagtgctggtctgagagataatcttcttgaaaatttgcaggcctaccagaaac

SEQ ID NO: 206977 - DNA, 75 bp, Artificial Sequence
  Synthetic
tgacgggaggagaggagtcaaagggttcggatttaaagttcagaatgatgtatggcttgggagaacaatatcata

SEQ ID NO: 206978 - DNA, 75 bp, Artificial Sequence
  Synthetic
aacatgaattcagtgaaattgaagagagaataaaccagttgtcaaaacatgtggatgattctgttattgacatat

SEQ ID NO: 206979 - DNA, 75 bp, Artificial Sequence
  Synthetic
gatctccatgattctaatgttcgaaacctccatgaaaaggtcagacgaatgctgaaggacaatgctaaagatgaa

SEQ ID NO: 206980 - DNA, 75 bp, Artificial Sequence
  Synthetic
ctaaattggcaaatgttgtaagaaagatgatgactaattcgcaagacacagagctctccttcacaattactgggg

SEQ ID NO: 206981 - DNA, 75 bp, Artificial Sequence
  Synthetic
aaaagtgttatttcaaaattggggggttgagcccatagacaatgtcatggggatgatcgggatactgcctgatat

SEQ ID NO: 206982 - DNA, 75 bp, Artificial Sequence
  Synthetic
atttccagaggaagaggagagtgagagacaacatgaccaaaaaaatggtcacacagagaacaatagggaagaaaa

SEQ ID NO: 206983 - DNA, 75 bp, Artificial Sequence
  Synthetic
agggctatatgaagcaattgaggagtgcctgattaatgatccctgggttttgcttaatgcatcttggttcaactc

SEQ ID NO: 206984 - DNA, 75 bp, Artificial Sequence
  Synthetic
acctccatgaaaaggtcagacgaatgctgaaggacaatgctaaagatgaagggaacggttgttttaccttctatc

SEQ ID NO: 206985 - DNA, 75 bp, Artificial Sequence
  Synthetic
cataaggaatttgaagaggagtccaaactgaacagacaagaaattgagggagtgaaactggattccaatggcaac

SEQ ID NO: 206986 - DNA, 75 bp, Artificial Sequence
  Synthetic
gagagtggtcgttagcattgatcggttcctaagagtccgagatcagaggggaaacgtgctcttatctccagaaga

SEQ ID NO: 206987 - DNA, 75 bp, Artificial Sequence
  Synthetic
gttgagcccatagacaatgtcatggggatgatcgggatactgcctgatatgacccccagtacagagatgtcattg

SEQ ID NO: 206988 - DNA, 75 bp, Artificial Sequence
  Synthetic
agaaagtggaaggacctctttgcatcagaatggaccaggcaatcatggagaaaaacatcatgttaaaagcgaatt

SEQ ID NO: 206989 - DNA, 75 bp, Artificial Sequence
  Synthetic
tatagttactttctgtggactagacaatgaacctggatcgggcaattggcctgatggtgccaacattgggtttat

SEQ ID NO: 206990 - DNA, 75 bp, Artificial Sequence
  Synthetic
ggcagcaatcattatggggttcatcctctgggcgtgcagcaatgggtcatgtagatgtaccatttgcatttagaa

SEQ ID NO: 206991 - DNA, 75 bp, Artificial Sequence
  Synthetic
ggtctggatatcgagacagctactcgggcgggaaggcaaatagtggagcagattctggaggaagaatctgatgag

SEQ ID NO: 206992 - DNA, 75 bp, Artificial Sequence
  Synthetic
ggaatcggtgctagtcaacacataccagtggatcattaggaattgggaaactgtgaaaattcaatggtcccaaga

SEQ ID NO: 206993 - DNA, 75 bp, Artificial Sequence
  Synthetic
atatgttcgaaagtaagagcatgaagctacgaacacaaataccagcagaaatgcttgcaagtattgacctcaaat

SEQ ID NO: 206994 - DNA, 75 bp, Artificial Sequence
  Synthetic
gcatctgcaggacaggtcagcgttcaacccactttctcagtacagagaaatcttcccttcgaaagagcaaccatt

SEQ ID NO: 206995 - DNA, 75 bp, Artificial Sequence
  Synthetic
aggacatactattgaggatgtcaaaaatgcaattggggtcctcatcggaggacttgaatggaatgataacacagt

SEQ ID NO: 206996 - DNA, 75 bp, Artificial Sequence
  Synthetic
tatgactcttgaagaaatgtcaagggactggtttatgctcatgccaaagcagaaagtggctggttccctgtgcat

SEQ ID NO: 206997 - DNA, 75 bp, Artificial Sequence
  Synthetic
atgtattcggatttccactttattgacgagaggggtgactcagtaattgtggaatctggagatccaaatgtatta

SEQ ID NO: 206998 - DNA, 75 bp, Artificial Sequence
  Synthetic
tagtggatttgtgaggacattattccagcaaatgcgtgatgtattagggacatttgataccgttcaaataataaa

SEQ ID NO: 206999 - DNA, 75 bp, Artificial Sequence
  Synthetic
cagtggatcattaggaattgggaaactgtgaaaattcaatggtcccaagatcccacaataatatacaataaaatg

SEQ ID NO: 207000 - DNA, 75 bp, Artificial Sequence
  Synthetic
cagcaaatgcgtgatgtattagggacatttgataccgttcaaataataaaactactaccgtttgcagcagctcca

SEQ ID NO: 207001 - DNA, 75 bp, Artificial Sequence
  Synthetic
agaaagtggctggttccctgtgcatcagaatggaccaggcaataatggacaaaaccataacattgaaagcaaatt

SEQ ID NO: 207002 - DNA, 75 bp, Artificial Sequence
  Synthetic
acgagaggggtgactcagtaattgtggaatctggagatccaaatgtattattgaagcaccgatttgagataattg

SEQ ID NO: 207003 - DNA, 75 bp, Artificial Sequence
  Synthetic
agaagtcctacataaatagaacaggaacatttgaattcacaagctttttctatcgctatgggtttgtagctaatt

SEQ ID NO: 207004 - DNA, 75 bp, Artificial Sequence
  Synthetic
ctctggaatgaggatactggtgagaggtaattctcctgtttttaattacaacaaagcaaccaaaaggcttacagt

SEQ ID NO: 207005 - DNA, 75 bp, Artificial Sequence
  Synthetic
accacaggagtcaagaagcctaaatttcttccagatttatatgattacaaagaaaaccgattcgtcgagattggt

SEQ ID NO: 207006 - DNA, 75 bp, Artificial Sequence
  Synthetic
accgctttggccaacactatagaaatcttcagatcgaacggtctaacagccaatgaatcgggacggctgatagat

SEQ ID NO: 207007 - DNA, 75 bp, Artificial Sequence
  Synthetic
tctcgggaaggatgcaggagcactggcagaagacccagatgaggggacagcaggagtggaatctgcagtattgag

SEQ ID NO: 207008 - DNA, 75 bp, Artificial Sequence
  Synthetic
aaaatctgaaaagactcatattcacattttctcttttactggagaggaaatggccaccaaagcggattacactct

SEQ ID NO: 207009 - DNA, 75 bp, Artificial Sequence
  Synthetic
aggacatactgatgaggatgtccaaaatgcaattgggaccctcatcggaggacttgaatggaatgataacacaat

SEQ ID NO: 207010 - DNA, 75 bp, Artificial Sequence
  Synthetic
tgcgataatatgcttcctcatgcagattgccatcttaacaacgactatgacactacatttcaagcagaatgaatg

SEQ ID NO: 207011 - DNA, 75 bp, Artificial Sequence
  Synthetic
agatcatttgagttgaagaagctttgggagcaaacccgttcaaaggcaggactgctgatttcagatggaggacca

SEQ ID NO: 207012 - DNA, 75 bp, Artificial Sequence
  Synthetic
cagctctaataatatgggggatccatcattccggatcaactgcagagcaaaccaagctatatgggagtggaaaca

SEQ ID NO: 207013 - DNA, 75 bp, Artificial Sequence
  Synthetic
aacctatataatatcagaaatctccatattccagaggtctgtctgaaatgggagctaatggatgaagattatcag

SEQ ID NO: 207014 - DNA, 75 bp, Artificial Sequence
  Synthetic
attgcaacacccggaatgcaaatcagaggattcgtgtactttgttgaaacattagcgaggagtatctgtgaaaaa

SEQ ID NO: 207015 - DNA, 75 bp, Artificial Sequence
  Synthetic
gaggattcgtgtactttgttgaaacattagcgaggagtatctgtgaaaaacttgagcaatctggacttccagttg

SEQ ID NO: 207016 - DNA, 75 bp, Artificial Sequence
  Synthetic
gaacggctgcattgagggcaagctttctcagatgtcaaaagaagtgaatgcgcggattgagccatttgtgaaaac

SEQ ID NO: 207017 - DNA, 75 bp, Artificial Sequence
  Synthetic
gtccgtaaacaatgctgtggtaatgccagcccatggtccagccaaaagcatggaatatgatgctgttgcaactac

SEQ ID NO: 207018 - DNA, 75 bp, Artificial Sequence
  Synthetic
ttccactttattgatgaacgaggcgagtcaataattgtggaatctggtgatccgaatgcattgttgaagcaccga

SEQ ID NO: 207019 - DNA, 75 bp, Artificial Sequence
  Synthetic
actaactcacaagatactgaactctccttcacaattactggagataatactaaatggaatgagaatcagaaccct

SEQ ID NO: 207020 - DNA, 75 bp, Artificial Sequence
  Synthetic
ctaaattcttactaatggatgccctcaagctaagtattgaggacccaagccatgaaggggaaggaatacccctgt

SEQ ID NO: 207021 - DNA, 75 bp, Artificial Sequence
  Synthetic
tggaatatgatgctgttgcaactacacattcctgggtccccaagaggaaccgttccattctcaacactagccaaa

SEQ ID NO: 207022 - DNA, 75 bp, Artificial Sequence
  Synthetic
agtcaataattgtggaatctggtgatccgaatgcattgttgaagcaccgatttgaaataattgaagggagagatc

SEQ ID NO: 207023 - DNA, 75 bp, Artificial Sequence
  Synthetic
caagctaagtattgaggacccaagccatgaaggggaaggaatacccctgtatgatgcaatcaagtgcatgaagac

SEQ ID NO: 207024 - DNA, 75 bp, Artificial Sequence
  Synthetic
gagaagccaaaatttctcccagatttgtatgactacaaagaaaacagattcattgaaattggagtaacacggaga

SEQ ID NO: 207025 - DNA, 75 bp, Artificial Sequence
  Synthetic
taaatcccaattatctcctagcttggaagcaagtacttgcggaactccaggacattgaaaatgaggagaaaatcc

SEQ ID NO: 207026 - DNA, 75 bp, Artificial Sequence
  Synthetic
gaagcaagtacttgcggaactccaggacattgaaaatgaggagaaaatccccaaaacaaaaaacatgaaaaaaac

SEQ ID NO: 207027 - DNA, 75 bp, Artificial Sequence
  Synthetic
gacacatatccacatattctcattcactggagaggaaatggctaccaaagcggaatatacccttgatgaagaaag

SEQ ID NO: 207028 - DNA, 75 bp, Artificial Sequence
  Synthetic
actttgaagactgcaaagatatcaatgacctaaaacaatatgacagtgatgaaccggagcccagatcgctagcaa

SEQ ID NO: 207029 - DNA, 75 bp, Artificial Sequence
  Synthetic
atggagagaataaaagaactaagagacctaatgtcacagtctcgcactcgcgagatactgacaaaaaccacagtg

SEQ ID NO: 207030 - DNA, 75 bp, Artificial Sequence
  Synthetic
tgacctaaaacaatatgacagtgatgaaccggagcccagatcgctagcaagctggatccaaagtgagtttaacaa

SEQ ID NO: 207031 - DNA, 75 bp, Artificial Sequence
  Synthetic
tatttttagcaagatctgcactgatattgagaggatcagttgctcacaaatcttgcctacctgcctgtgcgtatg

SEQ ID NO: 207032 - DNA, 75 bp, Artificial Sequence
  Synthetic
ttcggatttaaagttcagaatgatgtatggcttgggagaacaatatcatatagcagccgatcaggattcgaggtg

SEQ ID NO: 207033 - DNA, 75 bp, Artificial Sequence
  Synthetic
cggacaaaagaataatggagatgatccctgagagaaatgaacagggtcagatcctttggagtaaaactaatgatg

SEQ ID NO: 207034 - DNA, 75 bp, Artificial Sequence
  Synthetic
aagatgttgcccctattgaacacattgcaagtatgagaaggaactatttcacagcggaagtgtctcactgcaggg

SEQ ID NO: 207035 - DNA, 75 bp, Artificial Sequence
  Synthetic
ctccaatcctctgatgattttgctctcatcgtaaatgcgccggatcatgagggaatacaagcaggagtggataga

SEQ ID NO: 207036 - DNA, 75 bp, Artificial Sequence
  Synthetic
aaagaagtgaatgccagaattgagccattcctgaagacaacaccccgccctctaaaattacctgatgggcctcca

SEQ ID NO: 207037 - DNA, 75 bp, Artificial Sequence
  Synthetic
tccaattgattccaatgataagcaaatgccgaaccaaagaaggtagacggaaaacaaatctgtatggattcattg

SEQ ID NO: 207038 - DNA, 75 bp, Artificial Sequence
  Synthetic
gaataagcatctattggacaatagtaaaaccgggagacatacttttgattaacagcacagggaatctaattgccc

SEQ ID NO: 207039 - DNA, 75 bp, Artificial Sequence
  Synthetic
ctttggtttagcttcggggcatcatgtttcatacttctagccattgcaatgggccttgtcttcatatgtgtgaaa

SEQ ID NO: 207040 - DNA, 75 bp, Artificial Sequence
  Synthetic
agcatggagttttctcttacggacccgaggctggaaccgcataaatgggaaaagtactgtgtccttgaaataggt

SEQ ID NO: 207041 - DNA, 75 bp, Artificial Sequence
  Synthetic
gtttcatacttctagccattgcaatgggccttgtcttcatatgtgtgaaaaatggaaacatgcggtgcactattt

SEQ ID NO: 207042 - DNA, 75 bp, Artificial Sequence
  Synthetic
atacgtaagaaccaatgggacctcaaaaatcaagatgaagtggggtatggaaatgagacgctgccttctccaatc

SEQ ID NO: 207043 - DNA, 75 bp, Artificial Sequence
  Synthetic
ggcagagctccaagacattgaaaatgaggagaagatcccaaaaacaaagaacatgaagaaaacaagccagttgag

SEQ ID NO: 207044 - DNA, 75 bp, Artificial Sequence
  Synthetic
gtgggcacttggtgagaatatggcaccagaaaaaatggactttgaggattgcaaagatgttagtgatctaaagca

SEQ ID NO: 207045 - DNA, 75 bp, Artificial Sequence
  Synthetic
aacagtctctatgcatctccacaacttgagggattttcagctgaatctaggaaattactcctcattgttcaggca

SEQ ID NO: 207046 - DNA, 75 bp, Artificial Sequence
  Synthetic
aacagattcaagttggattgaacttgatgaaataggggaggacgttgctccgattgagcacattgcaagcatgag

SEQ ID NO: 207047 - DNA, 75 bp, Artificial Sequence
  Synthetic
gattggtctggttattcaggcagctttgtcattgagaacaacggctgttttcaaccttgcttttatgttgagctc

SEQ ID NO: 207048 - DNA, 75 bp, Artificial Sequence
  Synthetic
atggattcaaatactgtatcgagtttccaggtagattgctttctttggcatgtccgcaaaagatttgcagaccaa

SEQ ID NO: 207049 - DNA, 75 bp, Artificial Sequence
  Synthetic
gtgggtcatctatcaaaagagaagaagaagtgctaacgggcaacctccaaacattgaaaatacgagtacatgaag

SEQ ID NO: 207050 - DNA, 75 bp, Artificial Sequence
  Synthetic
tgtccgcaaaagatttgcagaccaagagatgggcgatgccccattcatggaccggctccgccgagaccagaagtc

SEQ ID NO: 207051 - DNA, 75 bp, Artificial Sequence
  Synthetic
acattgaaaatacgagtacatgaaggatatgaggaattcacgatggttgggcgaagagcaactgccatactaagg

SEQ ID NO: 207052 - DNA, 75 bp, Artificial Sequence
  Synthetic
caatgatcagcaagtgcagaaccaaagagggaagacggaaaactaatctctatgggttcattgtaaaaggaagat

SEQ ID NO: 207053 - DNA, 75 bp, Artificial Sequence
  Synthetic
agcgaaagcaggtcaaatatattcaatatggagagaataaaggaattaagagatctaatgtcacaatctcgcact

SEQ ID NO: 207054 - DNA, 75 bp, Artificial Sequence
  Synthetic
gagatgggcgatgccccattcatggaccggctccgccgagaccagaagtctttaaaggggaggagcagcactctt

SEQ ID NO: 207055 - DNA, 75 bp, Artificial Sequence
  Synthetic
gattctaaaagaagaatacaatgaggcattaaagatgagtattgcctcaacacctgcctcccgctacatgactga

SEQ ID NO: 207056 - DNA, 75 bp, Artificial Sequence
  Synthetic
gacacttaagatgaccattgcatctgtacctacttcgcgctacatagctgacatgaccctcgaggaaatgtcacg

SEQ ID NO: 207057 - DNA, 75 bp, Artificial Sequence
  Synthetic
gcattaaagatgagtattgcctcaacacctgcctcccgctacatgactgacatgtctccagaggagatgtcaaga

SEQ ID NO: 207058 - DNA, 75 bp, Artificial Sequence
  Synthetic
agactggttcatgctcatgcctaggcaaaagataataggccctctttgtgtgcgaatggaccaggcgatcatgga

SEQ ID NO: 207059 - DNA, 75 bp, Artificial Sequence
  Synthetic
cttgaatttcgtaaacagagcgaaccaacggctgaatcctatgcaccagcttctgaggcacttccaaaaagacgc

SEQ ID NO: 207060 - DNA, 75 bp, Artificial Sequence
  Synthetic
cagaatggatcaggcaatcatagataaggaagtcacactaaaagcgaatttcagtgtaacttttggacggctgga

SEQ ID NO: 207061 - DNA, 75 bp, Artificial Sequence
  Synthetic
tcagtgtaacttttggacggctggagactctcatactattgagggcttttacaagtgatggggctattgttggtg

SEQ ID NO: 207062 - DNA, 75 bp, Artificial Sequence
  Synthetic
aagggagtggaggaaagctccatcgggaaggtgtgcagaactttactggcgaaatctgtatttaacagcctatat

SEQ ID NO: 207063 - DNA, 75 bp, Artificial Sequence
  Synthetic
gagagtggttgtgagcatcgaccgcttcctaagggttcgagatcagcgggggaacgtgctcttgtcccctgagga

SEQ ID NO: 207064 - DNA, 75 bp, Artificial Sequence
  Synthetic
tctcccttttgaacgagcaaccgttttggcagctttcagcgggaacaatgaaggacggacatccgacatgcgaac

SEQ ID NO: 207065 - DNA, 75 bp, Artificial Sequence
  Synthetic
gccatgcagatctcagtgctaaagaagcacaagatgtcatcatggaggtcgttttcccaaatgaagtgggagcta

SEQ ID NO: 207066 - DNA, 75 bp, Artificial Sequence
  Synthetic
atgaatccaaatcaaaagataatagcacttggctccgcttctctaactatagcgatagtatgtctactcatccag

SEQ ID NO: 207067 - DNA, 75 bp, Artificial Sequence
  Synthetic
gaattcgaaccattccaatccttggtacctaaggctgccagaggccaatacagtggatttgtaagaacattgttt

SEQ ID NO: 207068 - DNA, 75 bp, Artificial Sequence
  Synthetic
agcgatagtatgtctactcatccagattgccatcttggcaacgactatgacactacatttcacgcagagtgaata

SEQ ID NO: 207069 - DNA, 75 bp, Artificial Sequence
  Synthetic
aagggagctggtccgcaaaaccagattcctaccggtagcaggcggaacaagcagtgtgtacattgaggtattaca

SEQ ID NO: 207070 - DNA, 75 bp, Artificial Sequence
  Synthetic
cactacatttcacgcagagtgaatacactaactcctcgagaaataaggtaataccatgtgaatcaatcataatag

SEQ ID NO: 207071 - DNA, 75 bp, Artificial Sequence
  Synthetic
tacctaaggctgccagaggccaatacagtggatttgtaagaacattgtttcaacagatgcgcgatgtgttgggga

SEQ ID NO: 207072 - DNA, 75 bp, Artificial Sequence
  Synthetic
cgccgtcttgagagggttcctcattataggtaaagaagacagaagatacggaccagcattaagcatcaatgaact

SEQ ID NO: 207073 - DNA, 75 bp, Artificial Sequence
  Synthetic
gagagttgtcctaaagcagcagaatacaagaattggtcaaaacctcaatgtcagattacagggtttgcccctttc

SEQ ID NO: 207074 - DNA, 75 bp, Artificial Sequence
  Synthetic
ggtaactccccggtgtttaactacaacaagacaaccaagaggcttacagtccttgggaaagatgcaggttcatta

SEQ ID NO: 207075 - DNA, 75 bp, Artificial Sequence
  Synthetic
acaagacaaccaagaggcttacagtccttgggaaagatgcaggttcattaacagaagacccggatgagggtacag

SEQ ID NO: 207076 - DNA, 75 bp, Artificial Sequence
  Synthetic
atagcatggtccagctcaagctgccatgatggtagggcatggctacatgtttgtgtcactggagatgataagaat

SEQ ID NO: 207077 - DNA, 75 bp, Artificial Sequence
  Synthetic
agtagtgaatagtatctgcaacaccacaggagttgacaaacctaaattcctccctgatttgtatgactacaaaga

SEQ ID NO: 207078 - DNA, 75 bp, Artificial Sequence
  Synthetic
atctagaaaaagccaacaagataaaatcagagaagacacacattcacatattctcattcactggagaagaaatgg

SEQ ID NO: 207079 - DNA, 75 bp, Artificial Sequence
  Synthetic
attatagtattgattccagttatgtgtgctcaggacttgttggcgacacaccaaggagtgacgacagctccagca

SEQ ID NO: 207080 - DNA, 75 bp, Artificial Sequence
  Synthetic
gtgctcaggacttgttggcgacacaccaaggagtgacgacagctccagcagcagcaactgcagggatcctaataa

SEQ ID NO: 207081 - DNA, 75 bp, Artificial Sequence
  Synthetic
atcaatgatgtgggaaattaacggccctgagtcagtacttgttaacacctaccaatggatcatcagaaactggga

SEQ ID NO: 207082 - DNA, 75 bp, Artificial Sequence
  Synthetic
aaatggccagtaggggtctatgggattcctttcgtcagtccgagagaggcgaagagacaattgaagaaagatttg

SEQ ID NO: 207083 - DNA, 75 bp, Artificial Sequence
  Synthetic
atgtttggatgggaagaacaatcaaaaaggactcgcgcgcaggttatgaaactttcagggttgttgatggttgga

SEQ ID NO: 207084 - DNA, 75 bp, Artificial Sequence
  Synthetic
tttgccctcatagtaaacgcaccaaatcatgagggaatacaagcaggagtggatagattctacaggacctgcaag

SEQ ID NO: 207085 - DNA, 75 bp, Artificial Sequence
  Synthetic
tgccgaccaaagtctcccaccgaacttctccagccttgaaaactttagagcctatgtggatggattcgaaccgaa

SEQ ID NO: 207086 - DNA, 75 bp, Artificial Sequence
  Synthetic
tacagtggatttgtgagaacattattccaacaaatgcgtgatgtactggggacgtttgacactgtccagataata

SEQ ID NO: 207087 - DNA, 75 bp, Artificial Sequence
  Synthetic
gatggaggaccaaatttatacaatatccggaatcttcacattcctgaagtctgcttaaaatgggagctaatggat

SEQ ID NO: 207088 - DNA, 75 bp, Artificial Sequence
  Synthetic
gtctcaaggcaccaaacgatcttatgaacaaatggaaactggtggggaacgccagaatgccactgaaatcagagc

SEQ ID NO: 207089 - DNA, 75 bp, Artificial Sequence
  Synthetic
ccagagtgtggtggacttcaaatagcatcattgtattttgtgggacttcaggtacctatggaacaggctcatggc

SEQ ID NO: 207090 - DNA, 75 bp, Artificial Sequence
  Synthetic
catcattgtattttgtgggacttcaggtacctatggaacaggctcatggcctgatggagcggatatcaatttcat

SEQ ID NO: 207091 - DNA, 75 bp, Artificial Sequence
  Synthetic
acacaagccaaaggggaattcttgaggatgaacagatgtaccagaagtgctgcaatctgttcgagaaatttttcc

SEQ ID NO: 207092 - DNA, 75 bp, Artificial Sequence
  Synthetic
atggaaacagtaacactgatgactatactactatttgtaacaacaagcaatgcagacaaaatctgtatcggccac

SEQ ID NO: 207093 - DNA, 75 bp, Artificial Sequence
  Synthetic
tgcagacaaaatctgtatcggccaccaatcaacaaattctacagaaactgtggacacgctaacagaaactaatgt

SEQ ID NO: 207094 - DNA, 75 bp, Artificial Sequence
  Synthetic
ctccacacagatcacaatggaatgctgtgtgcaacaaatctaggacatcccctcatcctagatacatgtaacgta

SEQ ID NO: 207095 - DNA, 75 bp, Artificial Sequence
  Synthetic
agaatggtcttacattgtcgaaagaccgtcggcagtgaatggaacgtgttaccctgggaatgtagaaaacttgga

SEQ ID NO: 207096 - DNA, 75 bp, Artificial Sequence
  Synthetic
ccgtcggcagtgaatggaacgtgttaccctgggaatgtagaaaacttggaggaactcagaacactttttagttcc

SEQ ID NO: 207097 - DNA, 75 bp, Artificial Sequence
  Synthetic
gttggaacaatggtgatggaattgatccggatgatcaagcgagggatcaatgatcggaatttctggagaggcgaa

SEQ ID NO: 207098 - DNA, 75 bp, Artificial Sequence
  Synthetic
ggatccagagtgaattcaacaaggcatgcgaattgacagattcgagttggattgaacttgatgaaataggggagg

SEQ ID NO: 207099 - DNA, 75 bp, Artificial Sequence
  Synthetic
gacttacactggaacaagcaaatcatgttcagactccttctatagaaatatgagatggctgactcaaaagaacgg

SEQ ID NO: 207100 - DNA, 75 bp, Artificial Sequence
  Synthetic
tttattgatgaacggagtgaatcaataattgtagaatctggagatccgaacgcattattgaaacaccgatttgaa

SEQ ID NO: 207101 - DNA, 75 bp, Artificial Sequence
  Synthetic
tcctttttgtctggggcatacatcatccacccactgatactgcacagacaaatttatacacaagaaccgacacaa

SEQ ID NO: 207102 - DNA, 75 bp, Artificial Sequence
  Synthetic
atggaagacccagatgagggaacagcaggagtggaatctgcggtattgagaggatttctgattctgggaaaagaa

SEQ ID NO: 207103 - DNA, 75 bp, Artificial Sequence
  Synthetic
ggacagaactttcaaaccattaatagggccaaggccacttgttaatggtctaattggaagaattaattattattg

SEQ ID NO: 207104 - DNA, 75 bp, Artificial Sequence
  Synthetic
ttgaagtgctgcacttaactcagggaacatgctgggagcaaatgtacactccaggaggaaaagtgagaaatgatg

SEQ ID NO: 207105 - DNA, 75 bp, Artificial Sequence
  Synthetic
atagggcaaggagacgtggtgttggtaatgaaacggaaacgggactctagcatacttactgacagtcagacagcg

SEQ ID NO: 207106 - DNA, 75 bp, Artificial Sequence
  Synthetic
acaagataaaatccgagaagacacatattcacatattctcattcacaggagaagagatggcaaccaaagcggact

SEQ ID NO: 207107 - DNA, 75 bp, Artificial Sequence
  Synthetic
tgaaaagggtggcttaaacagtacactgccattccacaatatcagtaaatatgcattcgggaactgccccaaata

SEQ ID NO: 207108 - DNA, 75 bp, Artificial Sequence
  Synthetic
atgcattcgggaactgccccaaatatattggagtcaagagtctcaagctagcaataggtctgagaaacgtgcctg

SEQ ID NO: 207109 - DNA, 75 bp, Artificial Sequence
  Synthetic
ttcatcaaggactacagatacacatatcggtgtcacaggggtgatacacaaatccaaacgaggagatcattcgag

SEQ ID NO: 207110 - DNA, 75 bp, Artificial Sequence
  Synthetic
tgcaggacaaatcagcgtacagcccacattctctgtgcagagaaacctcccattcgagagagcaaccattatggc

SEQ ID NO: 207111 - DNA, 75 bp, Artificial Sequence
  Synthetic
gaatcacccaaaggggtggaggaaggctccatcgggaaggtgtgcagaacattgctagcaaagtctgtgttcaac

SEQ ID NO: 207112 - DNA, 75 bp, Artificial Sequence
  Synthetic
ggttggccaggattagtagctggttggtatggtttccagcattctaatgatcagggagttggtatagcggcagat

SEQ ID NO: 207113 - DNA, 75 bp, Artificial Sequence
  Synthetic
gtgaatgctagaattgagccatttttgaaaacaacgccacgtcctctcaaattacctgatgggcctccttgctct

SEQ ID NO: 207114 - DNA, 75 bp, Artificial Sequence
  Synthetic
agcaaaagcaggggttataccatagacaaccgaactaaagacaatgaccatcacttttctcatcctcctgttcac

SEQ ID NO: 207115 - DNA, 75 bp, Artificial Sequence
  Synthetic
ggtatggtttccagcattctaatgatcagggagttggtatagcggcagataaggtttcaacccaaaaggcagttg

SEQ ID NO: 207116 - DNA, 75 bp, Artificial Sequence
  Synthetic
tcacttttctcatcctcctgttcacagtagtgaaaggggaccaaatatgcatcggataccatgccaacaattcca

SEQ ID NO: 207117 - DNA, 75 bp, Artificial Sequence
  Synthetic
agtagtgaaaggggaccaaatatgcatcggataccatgccaacaattccacagaaaaagttgacacaatcttgga

SEQ ID NO: 207118 - DNA, 75 bp, Artificial Sequence
  Synthetic
ccactatacgatgcaatcaaatgcatgaagacatttttcgggtggaaagagcccagcatcgtgaaaccacatgag

SEQ ID NO: 207119 - DNA, 75 bp, Artificial Sequence
  Synthetic
atgaggttgaaactagactcaatatgatcaataataaaattgatgaccaaatacaagacgtatgggcatataatg

SEQ ID NO: 207120 - DNA, 75 bp, Artificial Sequence
  Synthetic
agtttaaaatgaatccaaatcagaaaataataaccattggatccgtatcattgggattggttgtattcaatgttc

SEQ ID NO: 207121 - DNA, 75 bp, Artificial Sequence
  Synthetic
ttgggattggttgtattcaatgttctattgcatatcgtgagcatcatagtaacagtagtggtcctgggaagtagc

SEQ ID NO: 207122 - DNA, 75 bp, Artificial Sequence
  Synthetic
atggaaagttgtgcaaattaagtgggatccctccattggaactgggggattgcagcattgcaggttggctccttg

SEQ ID NO: 207123 - DNA, 75 bp, Artificial Sequence
  Synthetic
tattgcatatcgtgagcatcatagtaacagtagtggtcctgggaagtagcgggggtaatggagtttgtaatgaga

SEQ ID NO: 207124 - DNA, 75 bp, Artificial Sequence
  Synthetic
gcaaacgtgaacaatctatacaacaaagtgaaaagggccctgggctcaaatgcactggaagatggaaagggttgc

SEQ ID NO: 207125 - DNA, 75 bp, Artificial Sequence
  Synthetic
tggcataacactagcgtagttgaatacataccacatttaagtggagacacttacacaaacaatactgaagcagta

SEQ ID NO: 207126 - DNA, 75 bp, Artificial Sequence
  Synthetic
gtggaaaaggaaaacccggtgaatggtctgtgctatccaggcagtttcaatgagtatgaagaattgaaacatctc

SEQ ID NO: 207127 - DNA, 75 bp, Artificial Sequence
  Synthetic
aaagtagattttgaggactgcaaagatgttagagatctgaaacaatatgacagtgatgaaccagaaactagatca

SEQ ID NO: 207128 - DNA, 75 bp, Artificial Sequence
  Synthetic
accaatgcatggaaacaattcggaacgggacctataataggagaaagtatcaagaggaatcaagactagaaaggc

SEQ ID NO: 207129 - DNA, 75 bp, Artificial Sequence
  Synthetic
acataccacatttaagtggagacacttacacaaacaatactgaagcagtatgtgacgtcaagggctttgcccctt

SEQ ID NO: 207130 - DNA, 75 bp, Artificial Sequence
  Synthetic
atggacccagcacacaacaactggtggttctcgggcctgtgcagtatctgggaatccatcattcttcagaaacat

SEQ ID NO: 207131 - DNA, 75 bp, Artificial Sequence
  Synthetic
ataagggaaccctttgtctcctgttcgcccagggagtgcagaactttcttcctcactcaagggtccctactcaat

SEQ ID NO: 207132 - DNA, 75 bp, Artificial Sequence
  Synthetic
cgcccagggagtgcagaactttcttcctcactcaagggtccctactcaatgacaaacactcgaatggaacagtaa

SEQ ID NO: 207133 - DNA, 75 bp, Artificial Sequence
  Synthetic
aattatccaattgctaaaaggtcatacaacaacacaagtggggagcaaatgctgataatctggggggtacaccat

SEQ ID NO: 207134 - DNA, 75 bp, Artificial Sequence
  Synthetic
gctgataatctggggggtacaccatcccaatgacgatacagaacaaaggacactgtaccagaatgtgggaacata

SEQ ID NO: 207135 - DNA, 75 bp, Artificial Sequence
  Synthetic
cccaatgtataccaagccaagtttgaagctgtagcgtggtcagcgacagcttgccatgatggaaagaagtggatg

SEQ ID NO: 207136 - DNA, 75 bp, Artificial Sequence
  Synthetic
cactgtaccagaatgtgggaacatatgtttccgttggaacatcaacattgaataagaggtcaatccctgagatag

SEQ ID NO: 207137 - DNA, 75 bp, Artificial Sequence
  Synthetic
aagctgtagcgtggtcagcgacagcttgccatgatggaaagaagtggatgacggttggtgttacagggcctgact

SEQ ID NO: 207138 - DNA, 75 bp, Artificial Sequence
  Synthetic
ccagaaaaggtagactttgaggattgcaaggatgttagagatctaaaacagtatgacagtgatgaaccagagtca

SEQ ID NO: 207139 - DNA, 75 bp, Artificial Sequence
  Synthetic
atgaatccaaatcagaagattataaccattggatcaatttgtatgataatcggaacagtcagcttgattgtacaa

SEQ ID NO: 207140 - DNA, 75 bp, Artificial Sequence
  Synthetic
actctactagaaacatgggacgtcataaattttgagagcactggtaatttaattgcaccagaatatggattcaaa

SEQ ID NO: 207141 - DNA, 75 bp, Artificial Sequence
  Synthetic
aattcttgggcaggagatatcttgaggacccaggagtcatcctgcacctgcatacagggtgattgctactgggtg

SEQ ID NO: 207142 - DNA, 75 bp, Artificial Sequence
  Synthetic
cggaacagtcagcttgattgtacaaattggaaacataatctcaatatgggttaatcattcaattcagacatgcat

SEQ ID NO: 207143 - DNA, 75 bp, Artificial Sequence
  Synthetic
aatgggaaaagtactgtgtcctcgagataggagacatgctcctccggactgcagtaggtcaagtttcaaggccca

SEQ ID NO: 207144 - DNA, 75 bp, Artificial Sequence
  Synthetic
taaattttgagagcactggtaatttaattgcaccagaatatggattcaaaatatcaaagagaggaagctcaggaa

SEQ ID NO: 207145 - DNA, 75 bp, Artificial Sequence
  Synthetic
ggacccaggagtcatcctgcacctgcatacagggtgattgctactgggtgatgactgacggccctgccaataggc

SEQ ID NO: 207146 - DNA, 75 bp, Artificial Sequence
  Synthetic
cccttaggggcaataaatacaacattgcccttccataacattcacccattgacaataggtgagtgtcccaagtat

SEQ ID NO: 207147 - DNA, 75 bp, Artificial Sequence
  Synthetic
atggatatcaactttagtgggggtcatattgaagagtgttcttgctaccctaatgacggcaatgtggaatgcgtt

SEQ ID NO: 207148 - DNA, 75 bp, Artificial Sequence
  Synthetic
ttcagtaactttagcaggcaattcctctctttgccctattagtggatgggccatatacagtaaggacaatggtat

SEQ ID NO: 207149 - DNA, 75 bp, Artificial Sequence
  Synthetic
atattgaagagtgttcttgctaccctaatgacggcaatgtggaatgcgtttgtagagacaactggacaggaacca

SEQ ID NO: 207150 - DNA, 75 bp, Artificial Sequence
  Synthetic
tgcccttccataacattcacccattgacaataggtgagtgtcccaagtatgtcaagtcggatagactggtcttgg

SEQ ID NO: 207151 - DNA, 75 bp, Artificial Sequence
  Synthetic
atgaatccaaatcagaaactattcgcattatccggagtggcaatagcgcttagtgtactgaacttattgatagga

SEQ ID NO: 207152 - DNA, 75 bp, Artificial Sequence
  Synthetic
ttgtgtgcagggctgccaagcgacactccaagaggagaagatgcccaattctcaggttcttgcaccagtcccgta

SEQ ID NO: 207153 - DNA, 75 bp, Artificial Sequence
  Synthetic
tagtgtactgaacttattgataggactctcaaatgtcggattgaatgtatctctacatctaaaagaagcaggacc

SEQ ID NO: 207154 - DNA, 75 bp, Artificial Sequence
  Synthetic
ctctcaaatgtcggattgaatgtatctctacatctaaaagaagcaggacccaaacaggaagagaatttgacatgc

SEQ ID NO: 207155 - DNA, 75 bp, Artificial Sequence
  Synthetic
gccgatcggagaatcccccaggggagtggaggaaggctccatcggaaaggtgtgcagaaccttgctggcgaagtc

SEQ ID NO: 207156 - DNA, 75 bp, Artificial Sequence
  Synthetic
cgtgttctcatttagaatgcaggaccttcttcttaacccagggagctttgttgaatgataaacattctaatggaa

SEQ ID NO: 207157 - DNA, 75 bp, Artificial Sequence
  Synthetic
attgcctagatcctaacaatgaggaaggtggtcatggggtgaaaggctgggcctttgatgatggaaatgacgtgt

SEQ ID NO: 207158 - DNA, 75 bp, Artificial Sequence
  Synthetic
cgtacctctaggtcaggatttgagataataagagtaaagaatggctggacacagacaagtaaagaacagattaaa

SEQ ID NO: 207159 - DNA, 75 bp, Artificial Sequence
  Synthetic
caagagtctatgtaatgttgaggggtgggtcgtgatagcaaaagacaatgcagtaagatttggggaaagtgagca

SEQ ID NO: 207160 - DNA, 75 bp, Artificial Sequence
  Synthetic
tgggtcgtgatagcaaaagacaatgcagtaagatttggggaaagtgagcaaatcattattaccagagaaccatac

SEQ ID NO: 207161 - DNA, 75 bp, Artificial Sequence
  Synthetic
caatctagagagaagactagaaaacttaaataagaagatggaagatggatttctagatgtatggacttacaatgc

SEQ ID NO: 207162 - DNA, 75 bp, Artificial Sequence
  Synthetic
ttctagatgtatggacttacaatgccgaactcctagttctaatggaaaatgagaggacacttgatttccatgact

SEQ ID NO: 207163 - DNA, 75 bp, Artificial Sequence
  Synthetic
aatgcgtattggttcaactccttcctcgcacatgcactgaattagttagggcaatgctactgcttgctatccata

SEQ ID NO: 207164 - DNA, 75 bp, Artificial Sequence
  Synthetic
aaaagctgtttggttccatgtttttgggtagaaacgatcagaggtaaaccggaggagagaacaatctggacctcc

SEQ ID NO: 207165 - DNA, 75 bp, Artificial Sequence
  Synthetic
taccattaggaacaaacattcaaacggaacaattcacgacagaacagcctttagaggcctcatctccactccatt

SEQ ID NO: 207166 - DNA, 75 bp, Artificial Sequence
  Synthetic
ggaacaattcacgacagaacagcctttagaggcctcatctccactccattgggcactccaccaaccgtaagtaat

SEQ ID NO: 207167 - DNA, 75 bp, Artificial Sequence
  Synthetic
gctaaggaaatagggaacggatgctttgagttttatcataaatgtgatgatgaatgcatgaacagcgtcagaaat

SEQ ID NO: 207168 - DNA, 75 bp, Artificial Sequence
  Synthetic
ttgattatgaagtcgccgattggtcgtggcacgatggagctattcttccttttgacatcgataagatgtgattta

SEQ ID NO: 207169 - DNA, 75 bp, Artificial Sequence
  Synthetic
caagatagaaaaagggaaagtagttaaatcagttgaattgaatgcacctaattaccactacgaggaatgctcctg

SEQ ID NO: 207170 - DNA, 75 bp, Artificial Sequence
  Synthetic
agaagcctaaatttcttccggatttatacgactacaaagaaaatcgattcgttgaaattggagtgacacgaaggg

SEQ ID NO: 207171 - DNA, 75 bp, Artificial Sequence
  Synthetic
tggcagaatgactatctgtatacaagggaataatgacaatgctacagcaacggtttattataacagaaggctgac

SEQ ID NO: 207172 - DNA, 75 bp, Artificial Sequence
  Synthetic
gggaataatgacaatgctacagcaacggtttattataacagaaggctgaccactaccattaagacctgggctaga

SEQ ID NO: 207173 - DNA, 75 bp, Artificial Sequence
  Synthetic
aatatgggggtctatcaaatacttgctatatacgctacagttgcaggctctttgtcactggcaatcatgatagct

SEQ ID NO: 207174 - DNA, 75 bp, Artificial Sequence
  Synthetic
agctgataggatttgtgttgggtacttaagcacaaactcatcagaaagggttgacacactgttagagaataatgt

SEQ ID NO: 207175 - DNA, 75 bp, Artificial Sequence
  Synthetic
atggcgtctcaaggcaccaaacgatcttatgaacagatggaaactggtggagaacgccagaatgccactgaaatc

SEQ ID NO: 207176 - DNA, 75 bp, Artificial Sequence
  Synthetic
gggatttctttttggatgtgttctaatgggtctctgcaatgcagaatttgcatttgactgtgagtcaatttgtaa

SEQ ID NO: 207177 - DNA, 75 bp, Artificial Sequence
  Synthetic
tgcagttgtaatgaccgatgggtcggctagtagtcaagcccatacaaaagtaatgtatttccacaaggggttggt

SEQ ID NO: 207178 - DNA, 75 bp, Artificial Sequence
  Synthetic
gctagtagtcaagcccatacaaaagtaatgtatttccacaaggggttggtagttaaggaggaggcattgaaggga

SEQ ID NO: 207179 - DNA, 75 bp, Artificial Sequence
  Synthetic
agtgcacttgggagactgtagcttcgagggctggattctagggaaccctgcctgtgccagcaacctggggattag

SEQ ID NO: 207180 - DNA, 75 bp, Artificial Sequence
  Synthetic
caatcaaaatttagagtaccaaacaggatacatatgtagtggggttttcggagacagtccacgccctaatgatgg

SEQ ID NO: 207181 - DNA, 75 bp, Artificial Sequence
  Synthetic
tgtttggattgggagaaccaaaaccactaattccagaagtggctttgaaatgatttgggatccgaatgggtggac

SEQ ID NO: 207182 - DNA, 75 bp, Artificial Sequence
  Synthetic
ttaagcacaaactcatcagaaagggttgacacactgttagagaataatgtcccggttacaagttctgttgacttg

SEQ ID NO: 207183 - DNA, 75 bp, Artificial Sequence
  Synthetic
gacctgtgtgtgcagagataattggcagggagcaaacagacctattatagaaattgacatgaacacattggaaca

SEQ ID NO: 207184 - DNA, 75 bp, Artificial Sequence
  Synthetic
cagggagcaaacagacctattatagaaattgacatgaacacattggaacacacaagtagatatgtgtgcaccgga

SEQ ID NO: 207185 - DNA, 75 bp, Artificial Sequence
  Synthetic
ggagaagacgcaactgctggtctcactcacctgatgatctggcattccaacctaaatgatgccacataccagaga

SEQ ID NO: 207186 - DNA, 75 bp, Artificial Sequence
  Synthetic
agaattgaggcacttgtttagtgggatcaaatctttcagtagaacagaattgatcgcacctacctcttggggggc

SEQ ID NO: 207187 - DNA, 75 bp, Artificial Sequence
  Synthetic
attggtctggatatagcgggagttttgtccaacatccggaactgacaggattaaactgcatgagaccgtgtttct

SEQ ID NO: 207188 - DNA, 75 bp, Artificial Sequence
  Synthetic
gagggctggattctagggaaccctgcctgtgccagcaacctggggattagagaatggtcatatttgattgaagac

SEQ ID NO: 207189 - DNA, 75 bp, Artificial Sequence
  Synthetic
caatccaataactggaagtcctggcgctccgggagtgaagggatttggatttctaaatggggataatacatggct

SEQ ID NO: 207190 - DNA, 75 bp, Artificial Sequence
  Synthetic
gctccgggagtgaagggatttggatttctaaatggggataatacatggcttggtaggaccatcagtcccagatca

SEQ ID NO: 207191 - DNA, 75 bp, Artificial Sequence
  Synthetic
tgtggtgtaaatagtgacactgtgggttggtcttggccagacggtgctgagttgccattcaccattgacaagtaa

SEQ ID NO: 207192 - DNA, 75 bp, Artificial Sequence
  Synthetic
ggcgagaggaaatacatatcctgtgatccgcgggacctacaacaacaccactggcagagatgtcttggttatatg

SEQ ID NO: 207193 - DNA, 75 bp, Artificial Sequence
  Synthetic
atcaaatctttcagtagaacagaattgatcgcacctacctcttggggggcagtgaatgatggagtaacagctgcc

SEQ ID NO: 207194 - DNA, 75 bp, Artificial Sequence
  Synthetic
caagatctgtattgggtaccacgccaacaattcaacaacacaagtggatacactacttgagaagaatgtaactgt

SEQ ID NO: 207195 - DNA, 75 bp, Artificial Sequence
  Synthetic
ttctagaatagctgagcggcaggaaattgtcgacaacagcaattggtcaggctattccggaagctttattgacta

SEQ ID NO: 207196 - DNA, 75 bp, Artificial Sequence
  Synthetic
attgtcgacaacagcaattggtcaggctattccggaagctttattgactattggaatgataacagtgagtgttac

SEQ ID NO: 207197 - DNA, 75 bp, Artificial Sequence
  Synthetic
taccagttcatggagcaagaagtacaacctagaaactggaacccgacctggatacaatggccaaaagagttggat

SEQ ID NO: 207198 - DNA, 75 bp, Artificial Sequence
  Synthetic
atccgcgggacctacaacaacaccactggcagagatgtcttggttatatggggtatacatcaccctgtctccaca

SEQ ID NO: 207199 - DNA, 75 bp, Artificial Sequence
  Synthetic
ttcaatcaaaatttggagtatcaaataggatatatatgcagtggagttttcggagacaatccacgccccaatgat

SEQ ID NO: 207200 - DNA, 75 bp, Artificial Sequence
  Synthetic
cctaaaggattgcaccatagaaggttggatactggggaatcctaaatgcgacttattgcttggtgatcaaagttg

SEQ ID NO: 207201 - DNA, 75 bp, Artificial Sequence
  Synthetic
atatgtgtggtggacaagtaacagtctaattgccctatgtggaagcccattcccagttgggtccggttccttccc

SEQ ID NO: 207202 - DNA, 75 bp, Artificial Sequence
  Synthetic
atatggttacattattgaggaatatggaaaagggcgaattttccaaagtcgcattcgcattgctaaatgtaacac

SEQ ID NO: 207203 - DNA, 75 bp, Artificial Sequence
  Synthetic
gatatgcattggataccactccaacaattccacagaaaaagtagacacaattctagagaggaatgtcactgtgac

SEQ ID NO: 207204 - DNA, 75 bp, Artificial Sequence
  Synthetic
agggttttcatttaaatacggcaatggtgtttggatcgggagaaccaaaagcactaattccaggagcggctttga

SEQ ID NO: 207205 - DNA, 75 bp, Artificial Sequence
  Synthetic
aacctagaaactggaacccgacctggatacaatggccaaaagagttggatgaagatttactggtatctgatgcac

SEQ ID NO: 207206 - DNA, 75 bp, Artificial Sequence
  Synthetic
gaaggcatttataggatcaggagaaagagtagagagatttgagatgtttcccaaaagcacatgggcaggagtaga

SEQ ID NO: 207207 - DNA, 75 bp, Artificial Sequence
  Synthetic
ggaaaagggcgaattttccaaagtcgcattcgcattgctaaatgtaacactaaatgtcagacatcagtaggtgga

SEQ ID NO: 207208 - DNA, 75 bp, Artificial Sequence
  Synthetic
ttgcccgaaatacataaaatctggacagctcaaattggccactggacttaggaatgtacctgccatatcaaacag

SEQ ID NO: 207209 - DNA, 75 bp, Artificial Sequence
  Synthetic
gggagactgcagcatcgctgggtggctccttggaaatccagaatgtgataggcttctaactgtgccagaatggtc

SEQ ID NO: 207210 - DNA, 75 bp, Artificial Sequence
  Synthetic
cagctcaaattggccactggacttaggaatgtacctgccatatcaaacagaggattgtttggggctattgcaggc

SEQ ID NO: 207211 - DNA, 75 bp, Artificial Sequence
  Synthetic
tctaataagagcattgacactgaacacaatgacaaaagacgccgaaagaggcaaattaaagagaagagcaattgc

SEQ ID NO: 207212 - DNA, 75 bp, Artificial Sequence
  Synthetic
agtaaaaactgattcagcaacatatccagtaattaaggggacgtacaacaatactggaacccagccaatcctcta

SEQ ID NO: 207213 - DNA, 75 bp, Artificial Sequence
  Synthetic
agagtagagagatttgagatgtttcccaaaagcacatgggcaggagtagatactagtagaggggtgacaaacgct

SEQ ID NO: 207214 - DNA, 75 bp, Artificial Sequence
  Synthetic
acatcagaatgaacaaggaacgggcatagctgcagacaaagaatcaacacaaaaggctattgatcaaataacaac

SEQ ID NO: 207215 - DNA, 75 bp, Artificial Sequence
  Synthetic
acacctccttagtagtgtaacacacttcgagaaagtgaagattttgcccaaagataggtggacacagcatacaac

SEQ ID NO: 207216 - DNA, 75 bp, Artificial Sequence
  Synthetic
atagctgcagacaaagaatcaacacaaaaggctattgatcaaataacaactaagataaacaatataatagaaaaa

SEQ ID NO: 207217 - DNA, 75 bp, Artificial Sequence
  Synthetic
ccagtaattaaggggacgtacaacaatactggaacccagccaatcctctatttctggggtgtccatcatcctcct

SEQ ID NO: 207218 - DNA, 75 bp, Artificial Sequence
  Synthetic
aatgggaactgaaagcatgaattttgccaagagtccggaaattgcagcaagacctgctgtgaacggccaaaggag

SEQ ID NO: 207219 - DNA, 75 bp, Artificial Sequence
  Synthetic
gccaagagtccggaaattgcagcaagacctgctgtgaacggccaaaggagcagaattgattattactggtctgtc

SEQ ID NO: 207220 - DNA, 75 bp, Artificial Sequence
  Synthetic
aaggataaatatgcttgcagacagaatagatgatgctgtaactgacatatggtcatacaatgcaaagcttcttgt

SEQ ID NO: 207221 - DNA, 75 bp, Artificial Sequence
  Synthetic
agggtcgaattacccaattgccaagggatcatacaataatacaagtggggaacaaatgctgatcatttggggagt

SEQ ID NO: 207222 - DNA, 75 bp, Artificial Sequence
  Synthetic
atagatgatgctgtaactgacatatggtcatacaatgcaaagcttcttgttttactagaaaacgacaagactcta

SEQ ID NO: 207223 - DNA, 75 bp, Artificial Sequence
  Synthetic
ttcgagaaagtgaagattttgcccaaagataggtggacacagcatacaacaactggaggctcacgggcttgcgca

SEQ ID NO: 207224 - DNA, 75 bp, Artificial Sequence
  Synthetic
aggacatactgacaaggatgtcaaaaatgcaattgaggtcctcatcggaggatttgaatggaatgataacacagt

SEQ ID NO: 207225 - DNA, 75 bp, Artificial Sequence
  Synthetic
tccttggtatgcctacaaatttgtcagcaaaaataagaagggagctgtcttcaagtcagatttaccaatcgagaa

SEQ ID NO: 207226 - DNA, 75 bp, Artificial Sequence
  Synthetic
cagactacactctcgacgaggaaagcagggctaggattaaaaccaggctgtttaccataagacaagaaatggcca

SEQ ID NO: 207227 - DNA, 75 bp, Artificial Sequence
  Synthetic
gctgagggccaatgcaattgatgaggggaatggatgttttgaactcctccataaatgtaatgactcttgcatgga

SEQ ID NO: 207228 - DNA, 75 bp, Artificial Sequence
  Synthetic
gacattgaacaaaagatcaatcccagaaatagccataagacctaaagtgaatggacagggaggcagaatggaatt

SEQ ID NO: 207229 - DNA, 75 bp, Artificial Sequence
  Synthetic
gatggctcctcgggaacccaatgtgcgacgaattcctcaatgtgccggaatggtcttacatagtggagaagatca

SEQ ID NO: 207230 - DNA, 75 bp, Artificial Sequence
  Synthetic
gataggagaatgccctaaatatgtaaaaagtgaaagtctgaggcttgcaacggggttaagaaatgttccacagat

SEQ ID NO: 207231 - DNA, 75 bp, Artificial Sequence
  Synthetic
gggaatggatgttttgaactcctccataaatgtaatgactcttgcatggagacaataagaaatggaacgtacaat

SEQ ID NO: 207232 - DNA, 75 bp, Artificial Sequence
  Synthetic
tataaaactgaagtcagacgacaatgtctacaaagcattgtcgatttacagctgcattgcaagcagtattgtatt

SEQ ID NO: 207233 - DNA, 75 bp, Artificial Sequence
  Synthetic
atttaaaatatccaaacggggtagctcagggatcatgaaaacagaagggacacttgaaaactgcgaaactaaatg

SEQ ID NO: 207234 - DNA, 75 bp, Artificial Sequence
  Synthetic
gctgcattgcaagcagtattgtattggtaggactcatacttgcattcatcatgtgggcatgcagcagtggcagtt

SEQ ID NO: 207235 - DNA, 75 bp, Artificial Sequence
  Synthetic
aaaagtgaaagtctgaggcttgcaacggggttaagaaatgttccacagattgcaactagaggaatttttggagct

SEQ ID NO: 207236 - DNA, 75 bp, Artificial Sequence
  Synthetic
gaaatagccataagacctaaagtgaatggacagggaggcagaatggaattctcgtggactatattggatatgttg

SEQ ID NO: 207237 - DNA, 75 bp, Artificial Sequence
  Synthetic
ttttagaaatgtggtatggcttaccaaaaagagcgatgcatacccaacaataaagaaaagttacaataataccaa

SEQ ID NO: 207238 - DNA, 75 bp, Artificial Sequence
  Synthetic
caaatatgtaaaatcagagaggttagtcttggcaacaggattaagaaatgtccctcaaattgaatcaagagggct

SEQ ID NO: 207239 - DNA, 75 bp, Artificial Sequence
  Synthetic
ggctcaggatatgcagcagacagagaaagcacccaaaaggctatagacggaattacaaataaggtcaactccatc

SEQ ID NO: 207240 - DNA, 75 bp, Artificial Sequence
  Synthetic
gtggaatcgggagattctacatacaaatgtgcactgagctcaaactcagcgactatgaagggagactgatccaga

SEQ ID NO: 207241 - DNA, 75 bp, Artificial Sequence
  Synthetic
tcagggatcatgaaaacagaagggacacttgaaaactgcgaaactaaatgtcaaactccattgggagcaataaat

SEQ ID NO: 207242 - DNA, 75 bp, Artificial Sequence
  Synthetic
cagagcagacaaggctttatcaaaacccaactacctatatttccgttgggacatcaacactaaaccagagattgg

SEQ ID NO: 207243 - DNA, 75 bp, Artificial Sequence
  Synthetic
ccttgagagaagaattggcaatctgaataagagaatggaagatgggtttctggatgtttggacttacaatgctga

SEQ ID NO: 207244 - DNA, 75 bp, Artificial Sequence
  Synthetic
acatcaacactaaaccagagattggtacccaaaatagctactagatctaaggtaaacgggcaaagtggaaggatg

SEQ ID NO: 207245 - DNA, 75 bp, Artificial Sequence
  Synthetic
aacagatacttggaagagcatcccagtgctggaaaggatcccaagaaaactgggggtccaatctacagaagaagg

SEQ ID NO: 207246 - DNA, 75 bp, Artificial Sequence
  Synthetic
aacagctcaaatggctcttcagctgttcatcaaggattacagatacacgtatcggtgtcacagaggagacacaca

SEQ ID NO: 207247 - DNA, 75 bp, Artificial Sequence
  Synthetic
atttgatgaaagaaggaacagatacctggaagagcaccccagtgcaggaaaggaccctaagaaaactggaggtcc

SEQ ID NO: 207248 - DNA, 75 bp, Artificial Sequence
  Synthetic
caaatcgcagctaagggacaacgctaatgatctaggaaatgggtgttttgaattttggcataaatgtgacaatga

SEQ ID NO: 207249 - DNA, 75 bp, Artificial Sequence
  Synthetic
aattcaataatttggaaaaaagactggaaaacctgaataaaaagatggaggacggattcctagatgtgtggacat

SEQ ID NO: 207250 - DNA, 75 bp, Artificial Sequence
  Synthetic
gaggatttggcgccaggcgaataatggagaagatgcaactgctggcctcactcacctgatgatctggcattccaa

SEQ ID NO: 207251 - DNA, 75 bp, Artificial Sequence
  Synthetic
ggagaagatgcaactgctggcctcactcacctgatgatctggcattccaatctgaatgatgccacttaccaaaga

SEQ ID NO: 207252 - DNA, 75 bp, Artificial Sequence
  Synthetic
acctatgactatcccaaatatcaaaaggagagtaaattaaacaggcaggggatagaatctgtgaagctagagaat

SEQ ID NO: 207253 - DNA, 75 bp, Artificial Sequence
  Synthetic
ggaaaacctgaataaaaagatggaggacggattcctagatgtgtggacatacaatgctgagcttctagttctaat

SEQ ID NO: 207254 - DNA, 75 bp, Artificial Sequence
  Synthetic
taaactccagtatgccattccacaacatccaccctctcaccatcggggaatgccccaaatatgtgaaatcaaata

SEQ ID NO: 207255 - DNA, 75 bp, Artificial Sequence
  Synthetic
atgacaaagtcagaatgcaattgagggacaatgcaaaagaactagggaatggatgtttcgaattttaccataaat

SEQ ID NO: 207256 - DNA, 75 bp, Artificial Sequence
  Synthetic
gcaaggatcaactctccccaggagatctggagctgcaggtgcagcagtgaagggggttggaacaatggtaatgga

SEQ ID NO: 207257 - DNA, 75 bp, Artificial Sequence
  Synthetic
tctggagctgcaggtgcagcagtgaagggggttggaacaatggtaatggaactaattcggatgataaagagagga

SEQ ID NO: 207258 - DNA, 75 bp, Artificial Sequence
  Synthetic
ggacaatgcaaaagaactagggaatggatgtttcgaattttaccataaatgtgatgatgaatgcatgaatagcgt

SEQ ID NO: 207259 - DNA, 75 bp, Artificial Sequence
  Synthetic
catccaccctctcaccatcggggaatgccccaaatatgtgaaatcaaatagattagtccttgctactgggctcag

SEQ ID NO: 207260 - DNA, 75 bp, Artificial Sequence
  Synthetic
acaggaatgagatcaaaggggttaaattgagcaacatgggggtttatcaaatccttgcaatttatgctacagtgg

SEQ ID NO: 207261 - DNA, 75 bp, Artificial Sequence
  Synthetic
tgcatatgaaaggatgtgcaacatcctcaaaggaaaactccaaacggcagcacaaagagcaatgatggaccaagt

SEQ ID NO: 207262 - DNA, 75 bp, Artificial Sequence
  Synthetic
ctcaaaggaaaactccaaacggcagcacaaagagcaatgatggaccaagtacgagaaagcaggaatccagggaat

SEQ ID NO: 207263 - DNA, 75 bp, Artificial Sequence
  Synthetic
caggctccttgtcactggcaatcatgatagctgggatcttcttatggatgtgctctaacgggtctctgcaatgca

SEQ ID NO: 207264 - DNA, 75 bp, Artificial Sequence
  Synthetic
tcattgacaaaatgaacactcagtttgaggctgttggaagggaatttaataacttagaaaggagaatagaaaatt

SEQ ID NO: 207265 - DNA, 75 bp, Artificial Sequence
  Synthetic
ctccaagaggagaagatgcccaattctcaggttcttgcaccagtcccgtagggggtcaagggtacggtgtaaaag

SEQ ID NO: 207266 - DNA, 75 bp, Artificial Sequence
  Synthetic
gggatcagtggctcacaaatcctgcttgcctgcttgtgtgtatggacttgctgtagcaagcgggtacgattttga

SEQ ID NO: 207267 - DNA, 75 bp, Artificial Sequence
  Synthetic
ctgtagcaagcgggtacgattttgaaagagagggatattccttggtcggaatagatccattccgtctgcttcaaa

SEQ ID NO: 207268 - DNA, 75 bp, Artificial Sequence
  Synthetic
attctgcagcatttgaagacttgagagtgtcaagcttcatcagaggaacaagggtgcttccgagaggacagctgt

SEQ ID NO: 207269 - DNA, 75 bp, Artificial Sequence
  Synthetic
gggttcaaattgcttcaaatgagaacatggaagcaatggactccaatactcttgaactgagaagtagatattggg

SEQ ID NO: 207270 - DNA, 75 bp, Artificial Sequence
  Synthetic
cttgaactgagaagtagatattgggctataagaaccagaagcggagggaacaccaaccaacagagggcatctgca

SEQ ID NO: 207271 - DNA, 75 bp, Artificial Sequence
  Synthetic
ggcttttggcctagtgtgtgccacttgtgagcagattgctgactcacagcaccggtctcaccggcagatggtgac

SEQ ID NO: 207272 - DNA, 75 bp, Artificial Sequence
  Synthetic
tccagcactcttgaactgaggagcagatactgggctataagaaccagaagtgggggaaacactaatcaacaaaga

SEQ ID NO: 207273 - DNA, 75 bp, Artificial Sequence
  Synthetic
cagagactggggcaccccagctcaacccgattgatggaccactacctgaagataatgaaccaagtggatatgcac

SEQ ID NO: 207274 - DNA, 75 bp, Artificial Sequence
  Synthetic
tttaataagagctttgacactaaacaaaatgacaaaagatgcagaaagaagaaagagaaagaggcgagcaattgc

SEQ ID NO: 207275 - DNA, 75 bp, Artificial Sequence
  Synthetic
gcatccgcaggacaaatcagtgtccaacctactttctcagtacagagaaacctccctttcgagagagcaactatc

SEQ ID NO: 207276 - DNA, 75 bp, Artificial Sequence
  Synthetic
ccacggctaaggccatggagcagatggctgggtcgagtgaacaggcagcggaggccatggaggttgctagtcagg

SEQ ID NO: 207277 - DNA, 75 bp, Artificial Sequence
  Synthetic
cgaggagcatatgtgagaaactccagcaatccgggctcccaggtggagggaaagagaagaaggctaaattggcaa

SEQ ID NO: 207278 - DNA, 75 bp, Artificial Sequence
  Synthetic
gcaatccgggctcccaggtggagggaaagagaagaaggctaaattggcaaatgtagggagaaagatgatgactaa

SEQ ID NO: 207279 - DNA, 75 bp, Artificial Sequence
  Synthetic
aactccaggactgcaaaatcgcccctttgatggttgcatacatgctagaaagggagttggtccgcaaaacgagat

SEQ ID NO: 207280 - DNA, 75 bp, Artificial Sequence
  Synthetic
atggagaaaatagttctctctcttgcaacaatcagccttgtcaaaagcgatcatatttgcattggttatcatgca

SEQ ID NO: 207281 - DNA, 75 bp, Artificial Sequence
  Synthetic
aaaggatgtaatggaatcaatggataaagaggaaatagagataacaacacactttcaaagaaaaaggagagtaag

SEQ ID NO: 207282 - DNA, 75 bp, Artificial Sequence
  Synthetic
ggaacgagaaccacaatcctcgtatatttctggcaaggacaacatacaccacaaggaaccaacctgaatggttca

SEQ ID NO: 207283 - DNA, 75 bp, Artificial Sequence
  Synthetic
gaccaactagcgacctccaccatacctgaccatctagcgacctccacaagcagggtgacaaaaacataatggatt

SEQ ID NO: 207284 - DNA, 75 bp, Artificial Sequence
  Synthetic
gaccaactagcgacctccaccatacctgaccatctagcgacctccacatgcagggtgacaaaaacataatggatt

SEQ ID NO: 207285 - DNA, 75 bp, Artificial Sequence
  Synthetic
gaccaactagcgacctccaccatacctgaccatctagcgacctccacacgcagggtgacaaaaacataatggatt

SEQ ID NO: 207286 - DNA, 75 bp, Artificial Sequence
  Synthetic
gaccaactagcgacctccaccatacctgaccatctagcgacctccacaggcagggtgacaaaaacataatggatt

SEQ ID NO: 207287 - DNA, 75 bp, Artificial Sequence
  Synthetic
taataagagtaaagaatggctggacacagacaagtaaagaacagattaaaaaacaagtagttgttgataatttga

SEQ ID NO: 207288 - DNA, 75 bp, Artificial Sequence
  Synthetic
cctaaggggaagaggcagcactcttggtctggacatcgaaacagctactcgtgcgggaaagcagatagtggagcg

SEQ ID NO: 207289 - DNA, 75 bp, Artificial Sequence
  Synthetic
agtgaaaggctgggcctttgatgatggaaatgacgtgtggatgggaagaacaatcaacgagacgtcacgcttagg

SEQ ID NO: 207290 - DNA, 75 bp, Artificial Sequence
  Synthetic
tgcagataaataggcaagtcatagttgacagaggtgataggtccggttattctggtattttctctgttgaaggca

SEQ ID NO: 207291 - DNA, 75 bp, Artificial Sequence
  Synthetic
tgacagaggtgataggtccggttattctggtattttctctgttgaaggcaaaagctgcatcaatcggtgctttta

SEQ ID NO: 207292 - DNA, 75 bp, Artificial Sequence
  Synthetic
gatgtgtacagaactcaaactcagtgacaatgaagggaggctgatccagaacagtataacaatagagagaatggt

SEQ ID NO: 207293 - DNA, 75 bp, Artificial Sequence
  Synthetic
tcttcagaaatgtggtgtggcttatcaaaaaggacaatgcatacccaacaataaagaaaggctacaataatacca

SEQ ID NO: 207294 - DNA, 75 bp, Artificial Sequence
  Synthetic
aagagtggataaactgacccaaggtcgccagacctatgactggacattgaatagaaaccagccggctgcaactgc

SEQ ID NO: 207295 - DNA, 75 bp, Artificial Sequence
  Synthetic
ctgcaatctatttgaaaaattctcccctagaagcccatacaggagaccagttggaatttccagcaggggggaggc

SEQ ID NO: 207296 - DNA, 75 bp, Artificial Sequence
  Synthetic
attggccaacactatagaggtcttcagatcgaacggtctaacggccaatgaatcaggaagactaatagactttct

SEQ ID NO: 207297 - DNA, 75 bp, Artificial Sequence
  Synthetic
tcacattgaaagcaaatttcagtgtgattttcaatcggcttgaagccctgatactacttagagcttttacggaag

SEQ ID NO: 207298 - DNA, 75 bp, Artificial Sequence
  Synthetic
gtagataatcactcaatgagtgacatcgaagccatggcgtctcaaggcaccaaacgatcatatgaacaaatggag

SEQ ID NO: 207299 - DNA, 75 bp, Artificial Sequence
  Synthetic
agacaacatgaccaagaaaatgatcacacagagaacaataggaaagaaaaagcaaaggttgaacaagaggagcta

SEQ ID NO: 207300 - DNA, 75 bp, Artificial Sequence
  Synthetic
atggagagaataaaggaattaagaataaagggactaagagatttgatgtcgcagtcttgcactcgcgagatattg

SEQ ID NO: 207301 - DNA, 75 bp, Artificial Sequence
  Synthetic
gcaaactgaagagacgggcaattgcaacacccggaatgcaaatcaggggatttgtatactttgtcgagacactag

SEQ ID NO: 207302 - DNA, 75 bp, Artificial Sequence
  Synthetic
aagacaggagaagaatcccgcactcaggatgaaatggatgatggcgatgaaatatccgatcactgctgacaaaag

SEQ ID NO: 207303 - DNA, 75 bp, Artificial Sequence
  Synthetic
cagtggccagtggatatgactttgagagagaaggatactccctggttggaatagaccctttccgtctgcttcaaa

SEQ ID NO: 207304 - DNA, 75 bp, Artificial Sequence
  Synthetic
aacacccggaatgcaaatcaggggatttgtatactttgtcgagacactagcaaggagtatctgtgagaaacttga

SEQ ID NO: 207305 - DNA, 75 bp, Artificial Sequence
  Synthetic
cagcatttgatgagagaagaaacaaatacctggaagagcatcccagtgctgggaaagaccctaagaagactggag

SEQ ID NO: 207306 - DNA, 75 bp, Artificial Sequence
  Synthetic
agaactcatcctttatgacaaagaagaaataaggagagtttggcgccaagcaaacaatggcgaagatgcaacagc

SEQ ID NO: 207307 - DNA, 75 bp, Artificial Sequence
  Synthetic
aaaaattacggagaatagctttgagcaaataacttttatgcaagccttacaactaatgccagaagtggaggtcga

SEQ ID NO: 207308 - DNA, 75 bp, Artificial Sequence
  Synthetic
aaaaattacggagaatagctttgagcaaataacttttatgcaagccttacaactaatgccagaagtggaggtcgt

SEQ ID NO: 207309 - DNA, 75 bp, Artificial Sequence
  Synthetic
aaaaattacggagaatagctttgagcaaataacttttatgcaagccttacaactaatgccagaagtggaggtcgc

SEQ ID NO: 207310 - DNA, 75 bp, Artificial Sequence
  Synthetic
aaaaattacggagaatagctttgagcaaataacttttatgcaagccttacaactaatgccagaagtggaggtcgg

SEQ ID NO: 207311 - DNA, 75 bp, Artificial Sequence
  Synthetic
aaaaattacggagaatagctttgagcaaataacttttatgcaagccttacaactaatgcctgaagtggaggtcga

SEQ ID NO: 207312 - DNA, 75 bp, Artificial Sequence
  Synthetic
aaaaattacggagaatagctttgagcaaataacttttatgcaagccttacaactaatgcctgaagtggaggtcgt

SEQ ID NO: 207313 - DNA, 75 bp, Artificial Sequence
  Synthetic
aaaaattacggagaatagctttgagcaaataacttttatgcaagccttacaactaatgcctgaagtggaggtcgc

SEQ ID NO: 207314 - DNA, 75 bp, Artificial Sequence
  Synthetic
aaaaattacggagaatagctttgagcaaataacttttatgcaagccttacaactaatgcctgaagtggaggtcgg

SEQ ID NO: 207315 - DNA, 75 bp, Artificial Sequence
  Synthetic
aaaaattacggagaatagctttgagcaaataacttttatgcaagccttacaactaatgcccgaagtggaggtcga

SEQ ID NO: 207316 - DNA, 75 bp, Artificial Sequence
  Synthetic
aaaaattacggagaatagctttgagcaaataacttttatgcaagccttacaactaatgcccgaagtggaggtcgt

SEQ ID NO: 207317 - DNA, 75 bp, Artificial Sequence
  Synthetic
aaaaattacggagaatagctttgagcaaataacttttatgcaagccttacaactaatgcccgaagtggaggtcgc

SEQ ID NO: 207318 - DNA, 75 bp, Artificial Sequence
  Synthetic
aaaaattacggagaatagctttgagcaaataacttttatgcaagccttacaactaatgcccgaagtggaggtcgg

SEQ ID NO: 207319 - DNA, 75 bp, Artificial Sequence
  Synthetic
aaaaattacggagaatagctttgagcaaataacttttatgcaagccttacaactaatgccggaagtggaggtcga

SEQ ID NO: 207320 - DNA, 75 bp, Artificial Sequence
  Synthetic
aaaaattacggagaatagctttgagcaaataacttttatgcaagccttacaactaatgccggaagtggaggtcgt

SEQ ID NO: 207321 - DNA, 75 bp, Artificial Sequence
  Synthetic
aaaaattacggagaatagctttgagcaaataacttttatgcaagccttacaactaatgccggaagtggaggtcgc

SEQ ID NO: 207322 - DNA, 75 bp, Artificial Sequence
  Synthetic
aaaaattacggagaatagctttgagcaaataacttttatgcaagccttacaactaatgccggaagtggaggtcgg

SEQ ID NO: 207323 - DNA, 75 bp, Artificial Sequence
  Synthetic
aaaaattacggagaatagctttgagcaaataacttttatgcaagccttacaactattgccagaagtggaggtcga

SEQ ID NO: 207324 - DNA, 75 bp, Artificial Sequence
  Synthetic
aaaaattacggagaatagctttgagcaaataacttttatgcaagccttacaactattgccagaagtggaggtcgt

SEQ ID NO: 207325 - DNA, 75 bp, Artificial Sequence
  Synthetic
aaaaattacggagaatagctttgagcaaataacttttatgcaagccttacaactattgccagaagtggaggtcgc

SEQ ID NO: 207326 - DNA, 75 bp, Artificial Sequence
  Synthetic
aaaaattacggagaatagctttgagcaaataacttttatgcaagccttacaactattgccagaagtggaggtcgg

SEQ ID NO: 207327 - DNA, 75 bp, Artificial Sequence
  Synthetic
aaaaattacggagaatagctttgagcaaataacttttatgcaagccttacaactattgcctgaagtggaggtcga

SEQ ID NO: 207328 - DNA, 75 bp, Artificial Sequence
  Synthetic
aaaaattacggagaatagctttgagcaaataacttttatgcaagccttacaactattgcctgaagtggaggtcgt

SEQ ID NO: 207329 - DNA, 75 bp, Artificial Sequence
  Synthetic
aaaaattacggagaatagctttgagcaaataacttttatgcaagccttacaactattgcctgaagtggaggtcgc

SEQ ID NO: 207330 - DNA, 75 bp, Artificial Sequence
  Synthetic
aaaaattacggagaatagctttgagcaaataacttttatgcaagccttacaactattgcctgaagtggaggtcgg

SEQ ID NO: 207331 - DNA, 75 bp, Artificial Sequence
  Synthetic
aaaaattacggagaatagctttgagcaaataacttttatgcaagccttacaactattgcccgaagtggaggtcga

SEQ ID NO: 207332 - DNA, 75 bp, Artificial Sequence
  Synthetic
aaaaattacggagaatagctttgagcaaataacttttatgcaagccttacaactattgcccgaagtggaggtcgt

SEQ ID NO: 207333 - DNA, 75 bp, Artificial Sequence
  Synthetic
aaaaattacggagaatagctttgagcaaataacttttatgcaagccttacaactattgcccgaagtggaggtcgc

SEQ ID NO: 207334 - DNA, 75 bp, Artificial Sequence
  Synthetic
aaaaattacggagaatagctttgagcaaataacttttatgcaagccttacaactattgcccgaagtggaggtcgg

SEQ ID NO: 207335 - DNA, 75 bp, Artificial Sequence
  Synthetic
aaaaattacggagaatagctttgagcaaataacttttatgcaagccttacaactattgccggaagtggaggtcga

SEQ ID NO: 207336 - DNA, 75 bp, Artificial Sequence
  Synthetic
aaaaattacggagaatagctttgagcaaataacttttatgcaagccttacaactattgccggaagtggaggtcgt

SEQ ID NO: 207337 - DNA, 75 bp, Artificial Sequence
  Synthetic
aaaaattacggagaatagctttgagcaaataacttttatgcaagccttacaactattgccggaagtggaggtcgc

SEQ ID NO: 207338 - DNA, 75 bp, Artificial Sequence
  Synthetic
aaaaattacggagaatagctttgagcaaataacttttatgcaagccttacaactattgccggaagtggaggtcgg

SEQ ID NO: 207339 - DNA, 75 bp, Artificial Sequence
  Synthetic
aaaaattacggagaatagctttgagcaaataacttttatgcaagccttacaactactgccagaagtggaggtcga

SEQ ID NO: 207340 - DNA, 75 bp, Artificial Sequence
  Synthetic
aaaaattacggagaatagctttgagcaaataacttttatgcaagccttacaactactgccagaagtggaggtcgt

SEQ ID NO: 207341 - DNA, 75 bp, Artificial Sequence
  Synthetic
aaaaattacggagaatagctttgagcaaataacttttatgcaagccttacaactactgccagaagtggaggtcgc

SEQ ID NO: 207342 - DNA, 75 bp, Artificial Sequence
  Synthetic
aaaaattacggagaatagctttgagcaaataacttttatgcaagccttacaactactgccagaagtggaggtcgg

SEQ ID NO: 207343 - DNA, 75 bp, Artificial Sequence
  Synthetic
aaaaattacggagaatagctttgagcaaataacttttatgcaagccttacaactactgcctgaagtggaggtcga

SEQ ID NO: 207344 - DNA, 75 bp, Artificial Sequence
  Synthetic
aaaaattacggagaatagctttgagcaaataacttttatgcaagccttacaactactgcctgaagtggaggtcgt

SEQ ID NO: 207345 - DNA, 75 bp, Artificial Sequence
  Synthetic
aaaaattacggagaatagctttgagcaaataacttttatgcaagccttacaactactgcctgaagtggaggtcgc

SEQ ID NO: 207346 - DNA, 75 bp, Artificial Sequence
  Synthetic
aaaaattacggagaatagctttgagcaaataacttttatgcaagccttacaactactgcctgaagtggaggtcgg

SEQ ID NO: 207347 - DNA, 75 bp, Artificial Sequence
  Synthetic
aaaaattacggagaatagctttgagcaaataacttttatgcaagccttacaactactgcccgaagtggaggtcga

SEQ ID NO: 207348 - DNA, 75 bp, Artificial Sequence
  Synthetic
aaaaattacggagaatagctttgagcaaataacttttatgcaagccttacaactactgcccgaagtggaggtcgt

SEQ ID NO: 207349 - DNA, 75 bp, Artificial Sequence
  Synthetic
aaaaattacggagaatagctttgagcaaataacttttatgcaagccttacaactactgcccgaagtggaggtcgc

SEQ ID NO: 207350 - DNA, 75 bp, Artificial Sequence
  Synthetic
aaaaattacggagaatagctttgagcaaataacttttatgcaagccttacaactactgcccgaagtggaggtcgg

SEQ ID NO: 207351 - DNA, 75 bp, Artificial Sequence
  Synthetic
aaaaattacggagaatagctttgagcaaataacttttatgcaagccttacaactactgccggaagtggaggtcga

SEQ ID NO: 207352 - DNA, 75 bp, Artificial Sequence
  Synthetic
aaaaattacggagaatagctttgagcaaataacttttatgcaagccttacaactactgccggaagtggaggtcgt

SEQ ID NO: 207353 - DNA, 75 bp, Artificial Sequence
  Synthetic
aaaaattacggagaatagctttgagcaaataacttttatgcaagccttacaactactgccggaagtggaggtcgc

SEQ ID NO: 207354 - DNA, 75 bp, Artificial Sequence
  Synthetic
aaaaattacggagaatagctttgagcaaataacttttatgcaagccttacaactactgccggaagtggaggtcgg

SEQ ID NO: 207355 - DNA, 75 bp, Artificial Sequence
  Synthetic
aaaaattacggagaatagctttgagcaaataacttttatgcaagccttacaactagtgccagaagtggaggtcga

SEQ ID NO: 207356 - DNA, 75 bp, Artificial Sequence
  Synthetic
aaaaattacggagaatagctttgagcaaataacttttatgcaagccttacaactagtgccagaagtggaggtcgt

SEQ ID NO: 207357 - DNA, 75 bp, Artificial Sequence
  Synthetic
aaaaattacggagaatagctttgagcaaataacttttatgcaagccttacaactagtgccagaagtggaggtcgc

SEQ ID NO: 207358 - DNA, 75 bp, Artificial Sequence
  Synthetic
aaaaattacggagaatagctttgagcaaataacttttatgcaagccttacaactagtgccagaagtggaggtcgg

SEQ ID NO: 207359 - DNA, 75 bp, Artificial Sequence
  Synthetic
aaaaattacggagaatagctttgagcaaataacttttatgcaagccttacaactagtgcctgaagtggaggtcga

SEQ ID NO: 207360 - DNA, 75 bp, Artificial Sequence
  Synthetic
aaaaattacggagaatagctttgagcaaataacttttatgcaagccttacaactagtgcctgaagtggaggtcgt

SEQ ID NO: 207361 - DNA, 75 bp, Artificial Sequence
  Synthetic
aaaaattacggagaatagctttgagcaaataacttttatgcaagccttacaactagtgcctgaagtggaggtcgc

SEQ ID NO: 207362 - DNA, 75 bp, Artificial Sequence
  Synthetic
aaaaattacggagaatagctttgagcaaataacttttatgcaagccttacaactagtgcctgaagtggaggtcgg

SEQ ID NO: 207363 - DNA, 75 bp, Artificial Sequence
  Synthetic
aaaaattacggagaatagctttgagcaaataacttttatgcaagccttacaactagtgcccgaagtggaggtcga

SEQ ID NO: 207364 - DNA, 75 bp, Artificial Sequence
  Synthetic
aaaaattacggagaatagctttgagcaaataacttttatgcaagccttacaactagtgcccgaagtggaggtcgt

SEQ ID NO: 207365 - DNA, 75 bp, Artificial Sequence
  Synthetic
aaaaattacggagaatagctttgagcaaataacttttatgcaagccttacaactagtgcccgaagtggaggtcgc

SEQ ID NO: 207366 - DNA, 75 bp, Artificial Sequence
  Synthetic
aaaaattacggagaatagctttgagcaaataacttttatgcaagccttacaactagtgcccgaagtggaggtcgg

SEQ ID NO: 207367 - DNA, 75 bp, Artificial Sequence
  Synthetic
aaaaattacggagaatagctttgagcaaataacttttatgcaagccttacaactagtgccggaagtggaggtcga

SEQ ID NO: 207368 - DNA, 75 bp, Artificial Sequence
  Synthetic
aaaaattacggagaatagctttgagcaaataacttttatgcaagccttacaactagtgccggaagtggaggtcgt

SEQ ID NO: 207369 - DNA, 75 bp, Artificial Sequence
  Synthetic
aaaaattacggagaatagctttgagcaaataacttttatgcaagccttacaactagtgccggaagtggaggtcgc

SEQ ID NO: 207370 - DNA, 75 bp, Artificial Sequence
  Synthetic
aaaaattacggagaatagctttgagcaaataacttttatgcaagccttacaactagtgccggaagtggaggtcgg

SEQ ID NO: 207371 - DNA, 75 bp, Artificial Sequence
  Synthetic
taccaccaacccactaatcaggcatgaaaacaggatggtgctggccagcactacagctaaagctatggagcagat

SEQ ID NO: 207372 - DNA, 75 bp, Artificial Sequence
  Synthetic
aagacctctactaatagatggcacagcctcattgagccctggaatgatgatgggcatgttcaacatgctgagtac

SEQ ID NO: 207373 - DNA, 75 bp, Artificial Sequence
  Synthetic
aggaagttgcactcagttactcaactggtgcgcttgccagctgcatgggtctcatatacaacaggatggggacag

SEQ ID NO: 207374 - DNA, 75 bp, Artificial Sequence
  Synthetic
aataaggccactaaaaggcttacagttctcgggaaagatgcaggtgcactgaccgaagatccagatgaaggcaca

SEQ ID NO: 207375 - DNA, 75 bp, Artificial Sequence
  Synthetic
gcaatatcctcaaaggaaaatttcaaacagctgcccagagggcaatgatggatcaagtaagagaaagtcgaaacc

SEQ ID NO: 207376 - DNA, 75 bp, Artificial Sequence
  Synthetic
cagtggcccataagtcctgcctgcctgcttgtgtgtatggacttgctgtggccagtggatacgactttgagagag

SEQ ID NO: 207377 - DNA, 75 bp, Artificial Sequence
  Synthetic
aatatgagcaagaagaaatcttacataaatcggacaggaacatttgagttcacaagctttttctaccgttatgga

SEQ ID NO: 207378 - DNA, 75 bp, Artificial Sequence
  Synthetic
cacaagctttttctaccgttatggatttgtggccaatttcagtatggagctgcccagctttggagtgtctggaat

SEQ ID NO: 207379 - DNA, 75 bp, Artificial Sequence
  Synthetic
atggaagtcccagtattcgcactcctagtgttaaccagcatatgcgtacaagctgataggatttgtgttgggtac

SEQ ID NO: 207380 - DNA, 75 bp, Artificial Sequence
  Synthetic
gctggtatggatggcatgccattctgcagcatttgaagatctgagagtgtcaagctttatcagaggaacaagagt

SEQ ID NO: 207381 - DNA, 75 bp, Artificial Sequence
  Synthetic
gtatctggaggagcatcccagtgctgggaaggatcccaagaagactggaggtccaatctacaggaggagagatgg

SEQ ID NO: 207382 - DNA, 75 bp, Artificial Sequence
  Synthetic
gggatattgcacttgatattgtggattcttgatcgtcttttcttcaaatgcatttatcgtcgctttaaatacggt

SEQ ID NO: 207383 - DNA, 75 bp, Artificial Sequence
  Synthetic
attgcttcaaatgagaatgtggaaaccatggactccaataccctggaactaagaagcagatactgggccataagg

SEQ ID NO: 207384 - DNA, 75 bp, Artificial Sequence
  Synthetic
aacagctcagatggctctccagctattcatcaaggactacagatacacttatcggtgccacagaggtgatacgca

SEQ ID NO: 207385 - DNA, 75 bp, Artificial Sequence
  Synthetic
acagccattctaaggaaagaacccagaaggctgatcccactgttagggagtggaagagatgaacagtcaattgct

SEQ ID NO: 207386 - DNA, 75 bp, Artificial Sequence
  Synthetic
gttcaaaggcgggactgctggtttcagatgggggaccaaacctatacaacatccggaatctccacattccggagg

SEQ ID NO: 207387 - DNA, 75 bp, Artificial Sequence
  Synthetic
cgccagacctatgactggacattgaatagaaatcaaccagctgcaactgctttggccaacactatagaggtcttc

SEQ ID NO: 207388 - DNA, 75 bp, Artificial Sequence
  Synthetic
tctgcttgaagtgggaactaatggatgaagactatcagggcagactgtgcaatcctttgaacccatttgtcagcc

SEQ ID NO: 207389 - DNA, 75 bp, Artificial Sequence
  Synthetic
ccatggaacaggaacaggatacaccatggacacagtcaacagaacacataaatactcagaaaaaggaaagtggac

SEQ ID NO: 207390 - DNA, 75 bp, Artificial Sequence
  Synthetic
tggaaagtgcaaagccagaggatttgtccttccaggggcggggagtcttcgagctctcggacgaaaaggcaacga

SEQ ID NO: 207391 - DNA, 75 bp, Artificial Sequence
  Synthetic
cgaaacgtacgttctctctatcattccatcaggccccctcaaagccgagatcgcgcagagacttgaggatgtttt

SEQ ID NO: 207392 - DNA, 75 bp, Artificial Sequence
  Synthetic
acaaataacttttatgcaagccttacaactattgcttgaagtggagcaagagataagaactttctcgtttcagct

SEQ ID NO: 207393 - DNA, 75 bp, Artificial Sequence
  Synthetic
gtgacaaaaacataatggactccaacaccatgtcaagctttcaggtagactgttttctttggcatattcgcaagc

SEQ ID NO: 207394 - DNA, 75 bp, Artificial Sequence
  Synthetic
tcctaagaggaaccgctccattcttaacaccagccaaaggggaattcttgaagatgagcagatgtatcaaaagtg

SEQ ID NO: 207395 - DNA, 75 bp, Artificial Sequence
  Synthetic
gggtaacaagagaaccttatgtgtcatgtgataccagtaagtgttaccaatttgcacttggacaggggactacgc

SEQ ID NO: 207396 - DNA, 75 bp, Artificial Sequence
  Synthetic
atttgatgtcgcagtctcgcactcgcgagatactgacaaaaaccactgtggaccatatggccataataaagaaat

SEQ ID NO: 207397 - DNA, 75 bp, Artificial Sequence
  Synthetic
acaattactggagacaacaccaaatggaatgagaatcaaaatcctcgaatgtttctggcaatgataacatatatc

SEQ ID NO: 207398 - DNA, 75 bp, Artificial Sequence
  Synthetic
aatgttctcaaacaaaatggcaagactagggaaaggatacatgtttgagagtaagagcatgaagttgcgaacaca

SEQ ID NO: 207399 - DNA, 75 bp, Artificial Sequence
  Synthetic
agaaatgggccaacgacaagtacagtccactatccaaaggtctacaaaacctactttgaaaaggtcgaaaggttg

SEQ ID NO: 207400 - DNA, 75 bp, Artificial Sequence
  Synthetic
agagtggataaactgacccaaggccgccagacctatgactggacgttgaatagaaatcagccggctgctactgca

SEQ ID NO: 207401 - DNA, 75 bp, Artificial Sequence
  Synthetic
tgggtatgttcaacatgctgagtacagttttaggagtctcaatcctgaatcttggacaaaagaagtacacaaaaa

SEQ ID NO: 207402 - DNA, 75 bp, Artificial Sequence
  Synthetic
catgcagatctcagtgccaaagaagcacaggatgtcatcatggaggtcgttttcccaaatgaagttggagccagg

SEQ ID NO: 207403 - DNA, 75 bp, Artificial Sequence
  Synthetic
atggcacagcctcattgagtcctggaatgatgatgggcatgttcaacatgttgagtacagtcttaggagtttcaa

SEQ ID NO: 207404 - DNA, 75 bp, Artificial Sequence
  Synthetic
acttcaggactgtaagattgctcctttgatggtggcatacatgttggagagagagctggttcgcaaaaccagatt

SEQ ID NO: 207405 - DNA, 75 bp, Artificial Sequence
  Synthetic
cacaagtttcttctaccgttatgggttcgtagccaatttcagcatggagctgcccagctttggggtgtctgggat

SEQ ID NO: 207406 - DNA, 75 bp, Artificial Sequence
  Synthetic
agactggttcatgctcatgcccaagcaaaaagtagcaggctccctctgtatcagaatggaccaggcgattatgga

SEQ ID NO: 207407 - DNA, 75 bp, Artificial Sequence
  Synthetic
tgcccagctttggggtgtctgggattaacgaatcggctgacatgagcattggagttacagtgataaaaaacaata

SEQ ID NO: 207408 - DNA, 75 bp, Artificial Sequence
  Synthetic
tgatcattgctgctagaaatatcgttaggagagcaacagtatcagcagacccattggcttcgctcttggaaatgt

SEQ ID NO: 207409 - DNA, 75 bp, Artificial Sequence
  Synthetic
tcacaagatacagagctctccttcacaattactggagacaacaccaaatggaatgagaatcaaaacccccggatg

SEQ ID NO: 207410 - DNA, 75 bp, Artificial Sequence
  Synthetic
agaccatcaaacagtgacccatccaacaataacgacccctgcgataccgaactgcagtgacactataataacata

SEQ ID NO: 207411 - DNA, 75 bp, Artificial Sequence
  Synthetic
ttcatcaaagactacaggtacacataccggtgccacaggggtgatacacaaattcaaacaaggagatcgttcgag

SEQ ID NO: 207412 - DNA, 75 bp, Artificial Sequence
  Synthetic
ggaggtgtcactaagctattcaactggtgcacttgccagttgcatgggcctcatatacaacaggatgggaacagt

SEQ ID NO: 207413 - DNA, 75 bp, Artificial Sequence
  Synthetic
atccggaatctccacattccagaggtctgcctgaagtgggagctaatggatgaagattaccaaggtagactgtgt

SEQ ID NO: 207414 - DNA, 75 bp, Artificial Sequence
  Synthetic
acactgaaaataagagtacatgaaggatatgaggaattcacaatggttgggcgaagagctacagccattttgagg

SEQ ID NO: 207415 - DNA, 75 bp, Artificial Sequence
  Synthetic
aaagatgatcttcttgaaaatttgcaggcctaccagaaacggatgggagtgcaaatgcaacgattcaagtgatcc

SEQ ID NO: 207416 - DNA, 75 bp, Artificial Sequence
  Synthetic
tcatatacaacaggatgggaacagtgaccacagaagctgcttttggtctagtgtgtgccacttgtgaacaaattg

SEQ ID NO: 207417 - DNA, 75 bp, Artificial Sequence
  Synthetic
cgctgtggtaatgccagcccatggtccagccaagagtatggaatatgatgcagttgcaactacacactcatggat

SEQ ID NO: 207418 - DNA, 75 bp, Artificial Sequence
  Synthetic
acatgaagaaaacaagccaattgaagtgggcactcggtgaaaatatggcaccagaaaaagtagactttgatgact

SEQ ID NO: 207419 - DNA, 75 bp, Artificial Sequence
  Synthetic
gtcaatcgctgaagcaatcatagtggcaatggttttctcacaagaggactgcatgataaaagcagtacgaggtga

SEQ ID NO: 207420 - DNA, 75 bp, Artificial Sequence
  Synthetic
gcatgataaaagcagtacgaggtgatctgaattttgttaacagagcgaatcagcggctaaatcctatgcatcaac

SEQ ID NO: 207421 - DNA, 75 bp, Artificial Sequence
  Synthetic
aagatgaacagatgtaccagaagtgctgcaatctattcgagaaattcttccctagtagttcatacaggaggccag

SEQ ID NO: 207422 - DNA, 75 bp, Artificial Sequence
  Synthetic
catcctagctccagtgctggtctgaaagatgaccttcttgaaaatttgcaggcctaccagaagcgaatgggagtg

SEQ ID NO: 207423 - DNA, 75 bp, Artificial Sequence
  Synthetic
cagatgcagcggttcaagtgatcctctcgtcattgcagcaaacatcattgggatcttgcacctgatattgtggat

SEQ ID NO: 207424 - DNA, 75 bp, Artificial Sequence
  Synthetic
gcacggattgatttcgagtctggaaggattaagaaagaagaatttgctgagatcatgaagatctgttccaccatt

SEQ ID NO: 207425 - DNA, 75 bp, Artificial Sequence
  Synthetic
ccattctcaacaccagccaaagggggattcttgaggacgaacagatgtaccagaagtgctgcaacctattcgaaa

SEQ ID NO: 207426 - DNA, 75 bp, Artificial Sequence
  Synthetic
gagagtggtcgtgagcattgatcgtttcttgagagtccgagatcagaggggaaacgtgctcctgtctcctgagga

SEQ ID NO: 207427 - DNA, 75 bp, Artificial Sequence
  Synthetic
gaggccagttggaatttccagcatggtggaggccatggtgtctagggcccgaattgatgcacgaattgacttcga

SEQ ID NO: 207428 - DNA, 75 bp, Artificial Sequence
  Synthetic
gtggaggccatggtgtctagggcccgaattgatgcacgaattgacttcgaatctggaaggattaagaaagaagag

SEQ ID NO: 207429 - DNA, 75 bp, Artificial Sequence
  Synthetic
tcctgccctcagaatgaagtggatgatggcaatgaaatatccaatcacagcagacaaaagaataatggagatgat

SEQ ID NO: 207430 - DNA, 75 bp, Artificial Sequence
  Synthetic
tttgctgagatcatgaagatctgttccaccattgaagagctcagacggcaaaaataatagtggaggtcgctagat

SEQ ID NO: 207431 - DNA, 75 bp, Artificial Sequence
  Synthetic
acagccatggaacaggaacaggatacaccatggacacagtaaacagaacacaccaatactcagaaaagggaaagt

SEQ ID NO: 207432 - DNA, 75 bp, Artificial Sequence
  Synthetic
atgatgtatggttaggtagaacagtgtcaactagtggtagatcgggctttgaaattatcaaagttacagaggggt

SEQ ID NO: 207433 - DNA, 75 bp, Artificial Sequence
  Synthetic
gctgtggtgatgccagctcatggcccagccaaaagcatggagtatgatgccgttgcaactacacattcatggatt

SEQ ID NO: 207434 - DNA, 75 bp, Artificial Sequence
  Synthetic
ctggatcggacagggtgatggtgtctcccctagctgtaacttggtggaacaggaatggaccgacaacaagtacag

SEQ ID NO: 207435 - DNA, 75 bp, Artificial Sequence
  Synthetic
accccagctcaacccgattgatggaccactacctgaggataatgaaccaagtgggtatgcacaaacagactgtgt

SEQ ID NO: 207436 - DNA, 75 bp, Artificial Sequence
  Synthetic
tagtgggtttgtgaggacattattccagcagatgcgtgatgtgctggggacatttgacactgtccaaatagtaaa

SEQ ID NO: 207437 - DNA, 75 bp, Artificial Sequence
  Synthetic
aaacatggaacttttggtcccgttcatttccggaatcaagttaagatacgccgccgagtggatataaacccgggc

SEQ ID NO: 207438 - DNA, 75 bp, Artificial Sequence
  Synthetic
gtgggtatgcacaaacagactgtgttctagaggctatggctttccttgaagaatcccacccaggaatatttgaga

SEQ ID NO: 207439 - DNA, 75 bp, Artificial Sequence
  Synthetic
ccgccgagtggatataaacccgggccatgcagacctcagtgctaaagaagcacaagatgttatcatggaggttgt

SEQ ID NO: 207440 - DNA, 75 bp, Artificial Sequence
  Synthetic
ttcaggaatgagaatacttgtgagaggcaattcccctgtgttcaactataacaaggcaaccaagagactcacagt

SEQ ID NO: 207441 - DNA, 75 bp, Artificial Sequence
  Synthetic
accatctagcgacctccacgaaagcaggtcaaatatattcaatatggaaagaataaaagaactaagagatttgat

SEQ ID NO: 207442 - DNA, 75 bp, Artificial Sequence
  Synthetic
ggagcaagacaaatgatgctggatcagacagagtgatggtgtcacctctggctgtgacgtggtggaacagaaatg

SEQ ID NO: 207443 - DNA, 75 bp, Artificial Sequence
  Synthetic
atattgacatcagaatcgcaattgacaataacaaaagagaagaaagaagagctccatgattgtaagattgctcct

SEQ ID NO: 207444 - DNA, 75 bp, Artificial Sequence
  Synthetic
caataacaaaagagaagaaagaagagctccatgattgtaagattgctcctttaatggtggcatacatgctggaaa

SEQ ID NO: 207445 - DNA, 75 bp, Artificial Sequence
  Synthetic
tcattataaaaggaagatcccacttgaggaatgataccgatgtggtgaactttgtgagtatggaattctctctta

SEQ ID NO: 207446 - DNA, 75 bp, Artificial Sequence
  Synthetic
cttagaagtgtgtttcatgtattcagatttccatttcattgatgaacgaggtgagtcgataatcgtggaatctgg

SEQ ID NO: 207447 - DNA, 75 bp, Artificial Sequence
  Synthetic
attggaaacataatctcaatatgggttaatcattcaattcagacatgcattacttatgaaaacaacacctgggta

SEQ ID NO: 207448 - DNA, 75 bp, Artificial Sequence
  Synthetic
aaggagagtaagagacaacatgaccaagaagatggtcacgcaaagaacaatagggaagaaaaaacagagactgaa

SEQ ID NO: 207449 - DNA, 75 bp, Artificial Sequence
  Synthetic
tgatcatcgctgccagaaacattgttaggagagcaacagtatcggcagacccactggcatcactactggagatgt

SEQ ID NO: 207450 - DNA, 75 bp, Artificial Sequence
  Synthetic
taggagagcaacagtatcggcagacccactggcatcactactggagatgtgtcacagcacacagattggtggaat

SEQ ID NO: 207451 - DNA, 75 bp, Artificial Sequence
  Synthetic
atgcagagagaggcaagttaaaaagaagggctatcgcaacacctgggatgcagattagaggtttcgtatactttg

SEQ ID NO: 207452 - DNA, 75 bp, Artificial Sequence
  Synthetic
ccagccaagagcatggaatatgatgctgttgccaccactcactcctggatccctaagaggaaccgctccatcctc

SEQ ID NO: 207453 - DNA, 75 bp, Artificial Sequence
  Synthetic
ccacattcccttatactggagaccctccatacagccatggaacaggaacaggatacaccatggacacagtcaaca

SEQ ID NO: 207454 - DNA, 75 bp, Artificial Sequence
  Synthetic
ccactttcccttatactggagaccctccatacagccatggaacaggaacaggatacaccatggacacagtcaaca

SEQ ID NO: 207455 - DNA, 75 bp, Artificial Sequence
  Synthetic
ccaccttcccttatactggagaccctccatacagccatggaacaggaacaggatacaccatggacacagtcaaca

SEQ ID NO: 207456 - DNA, 75 bp, Artificial Sequence
  Synthetic
ccacgttcccttatactggagaccctccatacagccatggaacaggaacaggatacaccatggacacagtcaaca

SEQ ID NO: 207457 - DNA, 75 bp, Artificial Sequence
  Synthetic
atatatgcaaagcagcaatgggcttgaggatcagttcatcctttagctttggaggcttcactttcaaaaggacaa

SEQ ID NO: 207458 - DNA, 75 bp, Artificial Sequence
  Synthetic
gtattcaacagtttgtatgcatctccacaactcgaggggttttcagctgaatcaagaaaaatgcttctcattgtt

SEQ ID NO: 207459 - DNA, 75 bp, Artificial Sequence
  Synthetic
ataattctattaatcatgaagaccattgttgtcctgagttgttttttctgtctggctttctgccaaaatccttca

SEQ ID NO: 207460 - DNA, 75 bp, Artificial Sequence
  Synthetic
ccagcggctgaacccaatgcatcaactcttaagacacttccaaaaggatgcaaaagtgcttttccaaaactgggg

SEQ ID NO: 207461 - DNA, 75 bp, Artificial Sequence
  Synthetic
atatgaagcaattgaggagtgcctgattaatgatccctgggttttgcttaatgcatcttggttcaactccttcct

SEQ ID NO: 207462 - DNA, 75 bp, Artificial Sequence
  Synthetic
aaataggcaagtcatagttgaaagaggtaacagatccggttattccggtattttctccgttgaagacaaaagctg

SEQ ID NO: 207463 - DNA, 75 bp, Artificial Sequence
  Synthetic
cctcacagaattctcgatggaagagactgcacattaatggatgccttactaggggaccctcattgtgatgtattt

SEQ ID NO: 207464 - DNA, 75 bp, Artificial Sequence
  Synthetic
aaaagtgctgtttcagaactggggagttgaacccattgacaatgtcatggggatgatcgggatattacctgacat

SEQ ID NO: 207465 - DNA, 75 bp, Artificial Sequence
  Synthetic
gttgaacccattgacaatgtcatggggatgatcgggatattacctgacatgactccaagcactgagatgtcactg

SEQ ID NO: 207466 - DNA, 75 bp, Artificial Sequence
  Synthetic
aaacggattgcgtgttggaagcaatggcttttcttgaagaatcccacccagggatctttgaaaactcttgtcttg

SEQ ID NO: 207467 - DNA, 75 bp, Artificial Sequence
  Synthetic
ctgctacccatatgatgtgccagactatgcatctctcagatctctagtggcctcatcaggaaccctagagttcat

SEQ ID NO: 207468 - DNA, 75 bp, Artificial Sequence
  Synthetic
gagagtggttgtgagcattgaccgtttcttgagagtccgagatcagcgaggaaacatactcttatctcctgaaga

SEQ ID NO: 207469 - DNA, 75 bp, Artificial Sequence
  Synthetic
taaatcccatgcatcaactcctgaggcatttccaaaaggatgcaaaggtcctgtttcaaaactggggaattgaac

SEQ ID NO: 207470 - DNA, 75 bp, Artificial Sequence
  Synthetic
aagttaacaataacatattcatcctccatgatgtgggaaatcaacggccctgaatcagtgcttgtcaacacttac

SEQ ID NO: 207471 - DNA, 75 bp, Artificial Sequence
  Synthetic
agcacagagatgtcattgagaggagtgagagttagtaaaatgggagtagatgaatattccagcactgagagagtg

SEQ ID NO: 207472 - DNA, 75 bp, Artificial Sequence
  Synthetic
tgtgccggattatgcctcccttaggtcactagttgcctcatccggcaccctggaatttacccaagagaacttcaa

SEQ ID NO: 207473 - DNA, 75 bp, Artificial Sequence
  Synthetic
gaatttgaaccattccaatccttggtacccaaagccgccagaggccaatacagcggatttgtgagaacactattc

SEQ ID NO: 207474 - DNA, 75 bp, Artificial Sequence
  Synthetic
gagtagatgaatattccagtactgagagagtggtcgtgagtattgatcgtttcttgagggtccgagaccagaggg

SEQ ID NO: 207475 - DNA, 75 bp, Artificial Sequence
  Synthetic
tcgaaccatggcctggacagtggtgaatagtatctgcaacaccacaggagtagagaagcctaaatttcttccgga

SEQ ID NO: 207476 - DNA, 75 bp, Artificial Sequence
  Synthetic
ctggtaatagtttctttagtagattgaattggttgtatcatttgggtcacaaatatccagcgcagaatgtaacta

SEQ ID NO: 207477 - DNA, 75 bp, Artificial Sequence
  Synthetic
tgccaaacaatgacaactttgacaaattgtacatttggggggttcaccacccgggtacggacgaagaccaaacct

SEQ ID NO: 207478 - DNA, 75 bp, Artificial Sequence
  Synthetic
aacttatacaatatacggaatcttcacattcctgaagtctgcttaaaatgggagctaatggatgatgattatcgg

SEQ ID NO: 207479 - DNA, 75 bp, Artificial Sequence
  Synthetic
acaaggcaaccaaaaggcttacagtcctcggaaaggacgctggtgcattaacagaagatccagacgagggaacag

SEQ ID NO: 207480 - DNA, 75 bp, Artificial Sequence
  Synthetic
acagaagatccagacgagggaacagccggagttgaatctgcagtactaaggggatttctaattctgggcaaggag

SEQ ID NO: 207481 - DNA, 75 bp, Artificial Sequence
  Synthetic
gtgggagccagaatactaacatcagaatcacaattaacaataactaaagagaaaaaagaagaactccgagattgt

SEQ ID NO: 207482 - DNA, 75 bp, Artificial Sequence
  Synthetic
tggaatatgatgccgttgcaactacacattcctggattcccaagaggaatcgttctattctcaacacaagccaaa

SEQ ID NO: 207483 - DNA, 75 bp, Artificial Sequence
  Synthetic
caaatgaaaagtttcatcagattgagaaggagttttcagaggtggaaggaagaattcaggatcttgagaaatatg

SEQ ID NO: 207484 - DNA, 75 bp, Artificial Sequence
  Synthetic
ccactcagattacctgatgggcctccttgctctcagcggtcaaaatttctgctgatggatgctctgaaactaagt

SEQ ID NO: 207485 - DNA, 75 bp, Artificial Sequence
  Synthetic
tctgtcaaagagaaagacatgaccaaagaattctttgagaacaaatcagaaacatggccaattggagaatcacct

SEQ ID NO: 207486 - DNA, 75 bp, Artificial Sequence
  Synthetic
aatgatgattgctggtcctttgcccttgcccaaggggctctgctaggaactaaacacagcaatggaaccataaaa

SEQ ID NO: 207487 - DNA, 75 bp, Artificial Sequence
  Synthetic
cggtctgctctcattctgagaggatcagtggctcataagtcctgcctgcctgcttgtgtgtatggacttgctgtg

SEQ ID NO: 207488 - DNA, 75 bp, Artificial Sequence
  Synthetic
gagagaactggttcgcaaaacaagatttctaccagtagctggaggaacaagcagtgtgtatatcgaagtgttgca

SEQ ID NO: 207489 - DNA, 75 bp, Artificial Sequence
  Synthetic
actgacagtcagacagcgaccaaaaggattcggatggccatccattaatgagatgaaggtcgctagatggtcaac

SEQ ID NO: 207490 - DNA, 75 bp, Artificial Sequence
  Synthetic
actgacagtcagacagcgaccaaaaggattcggatggccatccattaatgagatgaaggtcgctagatggtctac

SEQ ID NO: 207491 - DNA, 75 bp, Artificial Sequence
  Synthetic
actgacagtcagacagcgaccaaaaggattcggatggccatccattaatgagatgaaggtcgctagatggtccac

SEQ ID NO: 207492 - DNA, 75 bp, Artificial Sequence
  Synthetic
actgacagtcagacagcgaccaaaaggattcggatggccatccattaatgagatgaaggtcgctagatggtcgac

SEQ ID NO: 207493 - DNA, 75 bp, Artificial Sequence
  Synthetic
actgacagtcagacagcgaccaaaaggattcggatggccatccattaatgagatgtaggtcgctagatggtcaac

SEQ ID NO: 207494 - DNA, 75 bp, Artificial Sequence
  Synthetic
actgacagtcagacagcgaccaaaaggattcggatggccatccattaatgagatgtaggtcgctagatggtctac

SEQ ID NO: 207495 - DNA, 75 bp, Artificial Sequence
  Synthetic
actgacagtcagacagcgaccaaaaggattcggatggccatccattaatgagatgtaggtcgctagatggtccac

SEQ ID NO: 207496 - DNA, 75 bp, Artificial Sequence
  Synthetic
actgacagtcagacagcgaccaaaaggattcggatggccatccattaatgagatgtaggtcgctagatggtcgac

SEQ ID NO: 207497 - DNA, 75 bp, Artificial Sequence
  Synthetic
actgacagtcagacagcgaccaaaaggattcggatggccatccattaatgagatgcaggtcgctagatggtcaac

SEQ ID NO: 207498 - DNA, 75 bp, Artificial Sequence
  Synthetic
actgacagtcagacagcgaccaaaaggattcggatggccatccattaatgagatgcaggtcgctagatggtctac

SEQ ID NO: 207499 - DNA, 75 bp, Artificial Sequence
  Synthetic
actgacagtcagacagcgaccaaaaggattcggatggccatccattaatgagatgcaggtcgctagatggtccac

SEQ ID NO: 207500 - DNA, 75 bp, Artificial Sequence
  Synthetic
actgacagtcagacagcgaccaaaaggattcggatggccatccattaatgagatgcaggtcgctagatggtcgac

SEQ ID NO: 207501 - DNA, 75 bp, Artificial Sequence
  Synthetic
actgacagtcagacagcgaccaaaaggattcggatggccatccattaatgagatggaggtcgctagatggtcaac

SEQ ID NO: 207502 - DNA, 75 bp, Artificial Sequence
  Synthetic
actgacagtcagacagcgaccaaaaggattcggatggccatccattaatgagatggaggtcgctagatggtctac

SEQ ID NO: 207503 - DNA, 75 bp, Artificial Sequence
  Synthetic
actgacagtcagacagcgaccaaaaggattcggatggccatccattaatgagatggaggtcgctagatggtccac

SEQ ID NO: 207504 - DNA, 75 bp, Artificial Sequence
  Synthetic
actgacagtcagacagcgaccaaaaggattcggatggccatccattaatgagatggaggtcgctagatggtcgac

SEQ ID NO: 207505 - DNA, 75 bp, Artificial Sequence
  Synthetic
actgacagtcagacagcgaccaaaaggattcggatggccatccattaatgtgatgaaggtcgctagatggtcaac

SEQ ID NO: 207506 - DNA, 75 bp, Artificial Sequence
  Synthetic
actgacagtcagacagcgaccaaaaggattcggatggccatccattaatgtgatgaaggtcgctagatggtctac

SEQ ID NO: 207507 - DNA, 75 bp, Artificial Sequence
  Synthetic
actgacagtcagacagcgaccaaaaggattcggatggccatccattaatgtgatgaaggtcgctagatggtccac

SEQ ID NO: 207508 - DNA, 75 bp, Artificial Sequence
  Synthetic
actgacagtcagacagcgaccaaaaggattcggatggccatccattaatgtgatgaaggtcgctagatggtcgac

SEQ ID NO: 207509 - DNA, 75 bp, Artificial Sequence
  Synthetic
actgacagtcagacagcgaccaaaaggattcggatggccatccattaatgtgatgtaggtcgctagatggtcaac

SEQ ID NO: 207510 - DNA, 75 bp, Artificial Sequence
  Synthetic
actgacagtcagacagcgaccaaaaggattcggatggccatccattaatgtgatgtaggtcgctagatggtctac

SEQ ID NO: 207511 - DNA, 75 bp, Artificial Sequence
  Synthetic
actgacagtcagacagcgaccaaaaggattcggatggccatccattaatgtgatgtaggtcgctagatggtccac

SEQ ID NO: 207512 - DNA, 75 bp, Artificial Sequence
  Synthetic
actgacagtcagacagcgaccaaaaggattcggatggccatccattaatgtgatgtaggtcgctagatggtcgac

SEQ ID NO: 207513 - DNA, 75 bp, Artificial Sequence
  Synthetic
actgacagtcagacagcgaccaaaaggattcggatggccatccattaatgtgatgcaggtcgctagatggtcaac

SEQ ID NO: 207514 - DNA, 75 bp, Artificial Sequence
  Synthetic
actgacagtcagacagcgaccaaaaggattcggatggccatccattaatgtgatgcaggtcgctagatggtctac

SEQ ID NO: 207515 - DNA, 75 bp, Artificial Sequence
  Synthetic
actgacagtcagacagcgaccaaaaggattcggatggccatccattaatgtgatgcaggtcgctagatggtccac

SEQ ID NO: 207516 - DNA, 75 bp, Artificial Sequence
  Synthetic
actgacagtcagacagcgaccaaaaggattcggatggccatccattaatgtgatgcaggtcgctagatggtcgac

SEQ ID NO: 207517 - DNA, 75 bp, Artificial Sequence
  Synthetic
actgacagtcagacagcgaccaaaaggattcggatggccatccattaatgtgatggaggtcgctagatggtcaac

SEQ ID NO: 207518 - DNA, 75 bp, Artificial Sequence
  Synthetic
actgacagtcagacagcgaccaaaaggattcggatggccatccattaatgtgatggaggtcgctagatggtctac

SEQ ID NO: 207519 - DNA, 75 bp, Artificial Sequence
  Synthetic
actgacagtcagacagcgaccaaaaggattcggatggccatccattaatgtgatggaggtcgctagatggtccac

SEQ ID NO: 207520 - DNA, 75 bp, Artificial Sequence
  Synthetic
actgacagtcagacagcgaccaaaaggattcggatggccatccattaatgtgatggaggtcgctagatggtcgac

SEQ ID NO: 207521 - DNA, 75 bp, Artificial Sequence
  Synthetic
actgacagtcagacagcgaccaaaaggattcggatggccatccattaatgcgatgaaggtcgctagatggtcaac

SEQ ID NO: 207522 - DNA, 75 bp, Artificial Sequence
  Synthetic
actgacagtcagacagcgaccaaaaggattcggatggccatccattaatgcgatgaaggtcgctagatggtctac

SEQ ID NO: 207523 - DNA, 75 bp, Artificial Sequence
  Synthetic
actgacagtcagacagcgaccaaaaggattcggatggccatccattaatgcgatgaaggtcgctagatggtccac

SEQ ID NO: 207524 - DNA, 75 bp, Artificial Sequence
  Synthetic
actgacagtcagacagcgaccaaaaggattcggatggccatccattaatgcgatgaaggtcgctagatggtcgac

SEQ ID NO: 207525 - DNA, 75 bp, Artificial Sequence
  Synthetic
actgacagtcagacagcgaccaaaaggattcggatggccatccattaatgcgatgtaggtcgctagatggtcaac

SEQ ID NO: 207526 - DNA, 75 bp, Artificial Sequence
  Synthetic
actgacagtcagacagcgaccaaaaggattcggatggccatccattaatgcgatgtaggtcgctagatggtctac

SEQ ID NO: 207527 - DNA, 75 bp, Artificial Sequence
  Synthetic
actgacagtcagacagcgaccaaaaggattcggatggccatccattaatgcgatgtaggtcgctagatggtccac

SEQ ID NO: 207528 - DNA, 75 bp, Artificial Sequence
  Synthetic
actgacagtcagacagcgaccaaaaggattcggatggccatccattaatgcgatgtaggtcgctagatggtcgac

SEQ ID NO: 207529 - DNA, 75 bp, Artificial Sequence
  Synthetic
actgacagtcagacagcgaccaaaaggattcggatggccatccattaatgcgatgcaggtcgctagatggtcaac

SEQ ID NO: 207530 - DNA, 75 bp, Artificial Sequence
  Synthetic
actgacagtcagacagcgaccaaaaggattcggatggccatccattaatgcgatgcaggtcgctagatggtctac

SEQ ID NO: 207531 - DNA, 75 bp, Artificial Sequence
  Synthetic
actgacagtcagacagcgaccaaaaggattcggatggccatccattaatgcgatgcaggtcgctagatggtccac

SEQ ID NO: 207532 - DNA, 75 bp, Artificial Sequence
  Synthetic
actgacagtcagacagcgaccaaaaggattcggatggccatccattaatgcgatgcaggtcgctagatggtcgac

SEQ ID NO: 207533 - DNA, 75 bp, Artificial Sequence
  Synthetic
actgacagtcagacagcgaccaaaaggattcggatggccatccattaatgcgatggaggtcgctagatggtcaac

SEQ ID NO: 207534 - DNA, 75 bp, Artificial Sequence
  Synthetic
actgacagtcagacagcgaccaaaaggattcggatggccatccattaatgcgatggaggtcgctagatggtctac

SEQ ID NO: 207535 - DNA, 75 bp, Artificial Sequence
  Synthetic
actgacagtcagacagcgaccaaaaggattcggatggccatccattaatgcgatggaggtcgctagatggtccac

SEQ ID NO: 207536 - DNA, 75 bp, Artificial Sequence
  Synthetic
actgacagtcagacagcgaccaaaaggattcggatggccatccattaatgcgatggaggtcgctagatggtcgac

SEQ ID NO: 207537 - DNA, 75 bp, Artificial Sequence
  Synthetic
actgacagtcagacagcgaccaaaaggattcggatggccatccattaatgggatgaaggtcgctagatggtcaac

SEQ ID NO: 207538 - DNA, 75 bp, Artificial Sequence
  Synthetic
actgacagtcagacagcgaccaaaaggattcggatggccatccattaatgggatgaaggtcgctagatggtctac

SEQ ID NO: 207539 - DNA, 75 bp, Artificial Sequence
  Synthetic
actgacagtcagacagcgaccaaaaggattcggatggccatccattaatgggatgaaggtcgctagatggtccac

SEQ ID NO: 207540 - DNA, 75 bp, Artificial Sequence
  Synthetic
actgacagtcagacagcgaccaaaaggattcggatggccatccattaatgggatgaaggtcgctagatggtcgac

SEQ ID NO: 207541 - DNA, 75 bp, Artificial Sequence
  Synthetic
actgacagtcagacagcgaccaaaaggattcggatggccatccattaatgggatgtaggtcgctagatggtcaac

SEQ ID NO: 207542 - DNA, 75 bp, Artificial Sequence
  Synthetic
actgacagtcagacagcgaccaaaaggattcggatggccatccattaatgggatgtaggtcgctagatggtctac

SEQ ID NO: 207543 - DNA, 75 bp, Artificial Sequence
  Synthetic
actgacagtcagacagcgaccaaaaggattcggatggccatccattaatgggatgtaggtcgctagatggtccac

SEQ ID NO: 207544 - DNA, 75 bp, Artificial Sequence
  Synthetic
actgacagtcagacagcgaccaaaaggattcggatggccatccattaatgggatgtaggtcgctagatggtcgac

SEQ ID NO: 207545 - DNA, 75 bp, Artificial Sequence
  Synthetic
actgacagtcagacagcgaccaaaaggattcggatggccatccattaatgggatgcaggtcgctagatggtcaac

SEQ ID NO: 207546 - DNA, 75 bp, Artificial Sequence
  Synthetic
actgacagtcagacagcgaccaaaaggattcggatggccatccattaatgggatgcaggtcgctagatggtctac

SEQ ID NO: 207547 - DNA, 75 bp, Artificial Sequence
  Synthetic
actgacagtcagacagcgaccaaaaggattcggatggccatccattaatgggatgcaggtcgctagatggtccac

SEQ ID NO: 207548 - DNA, 75 bp, Artificial Sequence
  Synthetic
actgacagtcagacagcgaccaaaaggattcggatggccatccattaatgggatgcaggtcgctagatggtcgac

SEQ ID NO: 207549 - DNA, 75 bp, Artificial Sequence
  Synthetic
actgacagtcagacagcgaccaaaaggattcggatggccatccattaatgggatggaggtcgctagatggtcaac

SEQ ID NO: 207550 - DNA, 75 bp, Artificial Sequence
  Synthetic
actgacagtcagacagcgaccaaaaggattcggatggccatccattaatgggatggaggtcgctagatggtctac

SEQ ID NO: 207551 - DNA, 75 bp, Artificial Sequence
  Synthetic
actgacagtcagacagcgaccaaaaggattcggatggccatccattaatgggatggaggtcgctagatggtccac

SEQ ID NO: 207552 - DNA, 75 bp, Artificial Sequence
  Synthetic
actgacagtcagacagcgaccaaaaggattcggatggccatccattaatgggatggaggtcgctagatggtcgac

SEQ ID NO: 207553 - DNA, 75 bp, Artificial Sequence
  Synthetic
tccaattacggcagacaaaaggataatggagatgatcccggaaagaaatgagcaaggtcagaccctttggagcaa

SEQ ID NO: 207554 - DNA, 75 bp, Artificial Sequence
  Synthetic
tgtgttgcttggtcaagtagcagttgtttcgatggaaaggaatggatgcatgtttgcatgactggaaatgacaat

SEQ ID NO: 207555 - DNA, 75 bp, Artificial Sequence
  Synthetic
gagtgaattcaacaaggcatgtgaattgaccgattcaagctggatagaacttgatgagataggggaagatgttgc

SEQ ID NO: 207556 - DNA, 75 bp, Artificial Sequence
  Synthetic
ggatatatgcaaggcagcaatgggtctaaggatcagttcatccttcagctttggaggtttcactttcaaaaggac

SEQ ID NO: 207557 - DNA, 75 bp, Artificial Sequence
  Synthetic
tagatctctggtcttacaacgcggagcttcttgttgccttggaaaaccaacatacaattgatttaactgattcag

SEQ ID NO: 207558 - DNA, 75 bp, Artificial Sequence
  Synthetic
ggtttgagtctgttgcttggtcagcaagtgcttgtcatgatggcattagttggttaacaatcggaatttctggcc

SEQ ID NO: 207559 - DNA, 75 bp, Artificial Sequence
  Synthetic
aggagaaactactttacagcagaagtatcccattgcagggctactgagtacatcatgaaaggagtgtacataaat

SEQ ID NO: 207560 - DNA, 75 bp, Artificial Sequence
  Synthetic
aaggtcgaaaggttgaaacatggtaccttcggccctgtccacttcagaaatcaagttaaaataaggaggagagtt

SEQ ID NO: 207561 - DNA, 75 bp, Artificial Sequence
  Synthetic
agagaagaaagaagagctccagaattgtaaaattgctcccttgatggtggcgtacatgctagaaagagaattggt

SEQ ID NO: 207562 - DNA, 75 bp, Artificial Sequence
  Synthetic
tttccctcacagacccgagactggagccacacaaatgggaaaagtactgtgttctcgaaataggagatatgctct

SEQ ID NO: 207563 - DNA, 75 bp, Artificial Sequence
  Synthetic
gccacacaaatgggaaaagtactgtgttctcgaaataggagatatgctcttgaggactgcgataggtcaagtgtc

SEQ ID NO: 207564 - DNA, 75 bp, Artificial Sequence
  Synthetic
ttgaagtgttgcacttaacccaagggacgtgctgggagcagatgtacactccaggaggagaagtgagaaatgatg

SEQ ID NO: 207565 - DNA, 75 bp, Artificial Sequence
  Synthetic
gacgtgctgggagcagatgtacactccaggaggagaagtgagaaatgatgatgttgaccaaagtttgattatcgc

SEQ ID NO: 207566 - DNA, 75 bp, Artificial Sequence
  Synthetic
aaggaactattttacagcagaggtgtcccactgcagggctactgaatacataatgaagggagtgtacataaatac

SEQ ID NO: 207567 - DNA, 75 bp, Artificial Sequence
  Synthetic
tgctagaaacatagtaagaagagcagcagtgtcagcagacccattagcatctctcttggaaatgtgccacagcac

SEQ ID NO: 207568 - DNA, 75 bp, Artificial Sequence
  Synthetic
caaggaattctttgaaaacaaatcagaaacatggccaattggagagtcacccaaaggagtggaagaaggttctat

SEQ ID NO: 207569 - DNA, 75 bp, Artificial Sequence
  Synthetic
gattggtcaggttactcagggagtttcattgttgagaacaacggctgtttccagccctgcttctatatcgaactc

SEQ ID NO: 207570 - DNA, 75 bp, Artificial Sequence
  Synthetic
gacatccttagacagaatccaactgaggaacaagccgtagacatatgcaaggcagcaatagggttgaggatcagc

SEQ ID NO: 207571 - DNA, 75 bp, Artificial Sequence
  Synthetic
atgacgtttcttggacaagcaatagtatagttactttctgtggactagacaatgaacctggatcgggaaattggc

SEQ ID NO: 207572 - DNA, 75 bp, Artificial Sequence
  Synthetic
gtgattgagaatgaatcctaatcaaaaattattcgcactctctggagtggccatagcactgagcatcctcaacct

SEQ ID NO: 207573 - DNA, 75 bp, Artificial Sequence
  Synthetic
attcacaatggttgggagaagagcaacagctattctcagaaaggcaaccaggagattgatccaattaatagtaag

SEQ ID NO: 207574 - DNA, 75 bp, Artificial Sequence
  Synthetic
ccatagcactgagcatcctcaacctactaataggaatatccaatgtgggactgaatgtctcactacacttaaagg

SEQ ID NO: 207575 - DNA, 75 bp, Artificial Sequence
  Synthetic
actaataggaatatccaatgtgggactgaatgtctcactacacttaaagggaagcaatgaccaagataaaaattg

SEQ ID NO: 207576 - DNA, 75 bp, Artificial Sequence
  Synthetic
gtgcttggaaaggatgcaggtgcattaatggaagacccagacgagggaacagcaggagtggaatctgcggtattg

SEQ ID NO: 207577 - DNA, 75 bp, Artificial Sequence
  Synthetic
acgacttgaaacagtacaacagtgatgagccagagcccagatcactagcatgttggatccagaatgaattcaaca

SEQ ID NO: 207578 - DNA, 75 bp, Artificial Sequence
  Synthetic
atgtcaacaatactactgtcatcaataaggaaacagggactgcaaagccaaattatctaatgctgaacaagagct

SEQ ID NO: 207579 - DNA, 75 bp, Artificial Sequence
  Synthetic
taaggaaacagggactgcaaagccaaattatctaatgctgaacaagagcttatgcaaagttgaaggatgggtagt

SEQ ID NO: 207580 - DNA, 75 bp, Artificial Sequence
  Synthetic
ttccagaactggggaattgaatccatcgacaatgtgatgggaatgatcggaatactgcccgacatgaccccaagc

SEQ ID NO: 207581 - DNA, 75 bp, Artificial Sequence
  Synthetic
ttaaaatgaatccaaatcagaaaataataaccattgggtcagtatccttaggattggtaatccttaatattctcc

SEQ ID NO: 207582 - DNA, 75 bp, Artificial Sequence
  Synthetic
tgacaagagagccgtatgtatcatgtgatccattaggatgtaaaatgtacgcactgcatcaagggacaaccatta

SEQ ID NO: 207583 - DNA, 75 bp, Artificial Sequence
  Synthetic
tgatccattaggatgtaaaatgtacgcactgcatcaagggacaaccattagaaacaagcattcaaacggaacaat

SEQ ID NO: 207584 - DNA, 75 bp, Artificial Sequence
  Synthetic
tcattagggaatacaatgaaacagtaagggttgagaaggtaacacaatggcacaataccaatgttattgagtata

SEQ ID NO: 207585 - DNA, 75 bp, Artificial Sequence
  Synthetic
cccctgtagtcagcaatagtgactttctttgtgtaggatggtcaagcaccagttgccatgacggcatcgggcgga

SEQ ID NO: 207586 - DNA, 75 bp, Artificial Sequence
  Synthetic
tctttgtgtaggatggtcaagcaccagttgccatgacggcatcgggcggatgaccatttgtgtgcagggaaataa

SEQ ID NO: 207587 - DNA, 75 bp, Artificial Sequence
  Synthetic
aagtatggaattttcccttaccgacccaaggttggaaccacataaatgggaaaagtattgtgttcttgaaatagg

SEQ ID NO: 207588 - DNA, 75 bp, Artificial Sequence
  Synthetic
gcaaagatgtcagcgatctgaaacagtatgacagtgatgagccagaacccagatcactagcaagctggatccaga

SEQ ID NO: 207589 - DNA, 75 bp, Artificial Sequence
  Synthetic
ggagatcaatggccctgagtcagtgctagtcaacacttatcaatggataatcagaaactgggaaattgtgaaaat

SEQ ID NO: 207590 - DNA, 75 bp, Artificial Sequence
  Synthetic
aaatcagttgaattgaatgcacctaattaccactacgaggaatgctcctgttatcctgattctggagaaatcacc

SEQ ID NO: 207591 - DNA, 75 bp, Artificial Sequence
  Synthetic
aaaattgagactggccacaggattgaggaatgtcccgtctattcaatctagaggcctatttggggccattgccgg

SEQ ID NO: 207592 - DNA, 75 bp, Artificial Sequence
  Synthetic
taaaaacatgggcaggaaacatccttaggacgcaagagtcggaatgtgtatgccacaatggaacatgtgtagtaa

SEQ ID NO: 207593 - DNA, 75 bp, Artificial Sequence
  Synthetic
taggacgcaagagtcggaatgtgtatgccacaatggaacatgtgtagtaataatgaccgatggatcggcaagcag

SEQ ID NO: 207594 - DNA, 75 bp, Artificial Sequence
  Synthetic
accggagcccctatagaactctaatgagtgtagaaatagggcaatcacccaatgtgtaccaggcaaggtttgagg

SEQ ID NO: 207595 - DNA, 75 bp, Artificial Sequence
  Synthetic
aggaatcccttaaaggatcagccagacacatagaggagtgctcatgctatgggcacaattcgaaggtgacttgtg

SEQ ID NO: 207596 - DNA, 75 bp, Artificial Sequence
  Synthetic
cagtagcgtggtcagctactgcatgtcatgatgggaagaaatggatgacaattggagtaacgggccctgatgcca

SEQ ID NO: 207597 - DNA, 75 bp, Artificial Sequence
  Synthetic
acacatagaggagtgctcatgctatgggcacaattcgaaggtgacttgtgtatgcagggacaactggcaaggagc

SEQ ID NO: 207598 - DNA, 75 bp, Artificial Sequence
  Synthetic
tttgctgctgccccaccagaacagagtaggatgcaattttcctcattgactgtgaatgtgagaggatcagggttg

SEQ ID NO: 207599 - DNA, 75 bp, Artificial Sequence
  Synthetic
tatggattcatcataaaaggaagatctcacttgaggaacgataccgatgtggtaaacttcgtgagtatggagttt

SEQ ID NO: 207600 - DNA, 75 bp, Artificial Sequence
  Synthetic
aatatctatgtacaggagttctcactgacacgagcagaccatcagataaatcaatgggagactgtaataatccga

SEQ ID NO: 207601 - DNA, 75 bp, Artificial Sequence
  Synthetic
tgacacgagcagaccatcagataaatcaatgggagactgtaataatccgatcactgggagtccgggagcccctgg

SEQ ID NO: 207602 - DNA, 75 bp, Artificial Sequence
  Synthetic
tcgtaggtcaactcattcctcacacatgcactaagatagatcgtttggtgccttgagacgccatgatcgtttggt

SEQ ID NO: 207603 - DNA, 75 bp, Artificial Sequence
  Synthetic
tcgttggtcaactcattcctcacacatgcactaagatagatcgtttggtgccttgagacgccatgatcgtttggt

SEQ ID NO: 207604 - DNA, 75 bp, Artificial Sequence
  Synthetic
tcgtcggtcaactcattcctcacacatgcactaagatagatcgtttggtgccttgagacgccatgatcgtttggt

SEQ ID NO: 207605 - DNA, 75 bp, Artificial Sequence
  Synthetic
tcgtgggtcaactcattcctcacacatgcactaagatagatcgtttggtgccttgagacgccatgatcgtttggt

SEQ ID NO: 207606 - DNA, 75 bp, Artificial Sequence
  Synthetic
tcttgaaataggggacatgctcctgcgaactgcaataggccaagtatcaaggcccatgttcctatatgtaagaac

SEQ ID NO: 207607 - DNA, 75 bp, Artificial Sequence
  Synthetic
cgaactgcaataggccaagtatcaaggcccatgttcctatatgtaagaaccaatgggacttccaaaatcaagatg

SEQ ID NO: 207608 - DNA, 75 bp, Artificial Sequence
  Synthetic
gaaatcagtttcaatggaggccatatagaagaatgctcatgctaccccaatgaaggtaaagtggaatgtgtttgt

SEQ ID NO: 207609 - DNA, 75 bp, Artificial Sequence
  Synthetic
cgataagtcctcgttccaggagtggttttgagatgttgaagatacccaatgctgagacagacccaaattctaaaa

SEQ ID NO: 207610 - DNA, 75 bp, Artificial Sequence
  Synthetic
tacgacagtgatgagccagagcccagatcactagcatgttggatccagaatgaattcaacaaggcatgtgaattg

SEQ ID NO: 207611 - DNA, 75 bp, Artificial Sequence
  Synthetic
atacttactgacagccagacagcgaccaaaagaattcggatggccatcaattaatgtcgaattgtttaaaaacga

SEQ ID NO: 207612 - DNA, 75 bp, Artificial Sequence
  Synthetic
ttttgagatgttgaagatacccaatgctgagacagacccaaattctaaaatcaccgagaggcaagaaatagttga

SEQ ID NO: 207613 - DNA, 75 bp, Artificial Sequence
  Synthetic
atgacaattggaatggctaacttaatattacaaattggaaacataatctcaatatggattagccactcaattcaa

SEQ ID NO: 207614 - DNA, 75 bp, Artificial Sequence
  Synthetic
ttcaccataagacaagagatggccagtaggggcctatgggattcctttcgtcagtccgagagaggcgaagagaca

SEQ ID NO: 207615 - DNA, 75 bp, Artificial Sequence
  Synthetic
aaggcagtgagtgctacaatccctgtttttatattgaattaataagaggaaggcctgaagaagccaagtatgttt

SEQ ID NO: 207616 - DNA, 75 bp, Artificial Sequence
  Synthetic
cttgggaatcaaagtcagattgaaacatgcaatcaaagcgtcattacttatgaaaacaacacttgggtaaatcag

SEQ ID NO: 207617 - DNA, 75 bp, Artificial Sequence
  Synthetic
ttggattcaggcagggcaatgatgtatggatgggaaggaccattagcagaacatcaagatcagggtttgaaatcc

SEQ ID NO: 207618 - DNA, 75 bp, Artificial Sequence
  Synthetic
actatgtggaagcccaatctcagttgggtccggttccttccccgatggggcacaaatccaatacttttcgtaaat

SEQ ID NO: 207619 - DNA, 75 bp, Artificial Sequence
  Synthetic
ggacaatggaactggcctgatggggctaaaatagagtacttcctctaactgtggaggtcgctagatggtcagatc

SEQ ID NO: 207620 - DNA, 75 bp, Artificial Sequence
  Synthetic
ggacaatggaactggcctgatggggctaaaatagagtacttcctctaactgtggaggtcgctagatggtcagttc

SEQ ID NO: 207621 - DNA, 75 bp, Artificial Sequence
  Synthetic
ggacaatggaactggcctgatggggctaaaatagagtacttcctctaactgtggaggtcgctagatggtcagctc

SEQ ID NO: 207622 - DNA, 75 bp, Artificial Sequence
  Synthetic
ggacaatggaactggcctgatggggctaaaatagagtacttcctctaactgtggaggtcgctagatggtcaggtc

SEQ ID NO: 207623 - DNA, 75 bp, Artificial Sequence
  Synthetic
ggatacatatgtagtggggttttcggagacagtccacgccctaatgatgggacaggcagttgtggtccggtgtcc

SEQ ID NO: 207624 - DNA, 75 bp, Artificial Sequence
  Synthetic
ttccgtgaaattagcgggcaattcctctctctgccctgttagtggatgggctatatacagtaaagacaacagtgt

SEQ ID NO: 207625 - DNA, 75 bp, Artificial Sequence
  Synthetic
acctgaccatctagcgacctccacaagcaggggatacaaaatgaacactcaaatcctggtattcgctctgattgc

SEQ ID NO: 207626 - DNA, 75 bp, Artificial Sequence
  Synthetic
acctgaccatctagcgacctccactagcaggggatacaaaatgaacactcaaatcctggtattcgctctgattgc

SEQ ID NO: 207627 - DNA, 75 bp, Artificial Sequence
  Synthetic
acctgaccatctagcgacctccaccagcaggggatacaaaatgaacactcaaatcctggtattcgctctgattgc

SEQ ID NO: 207628 - DNA, 75 bp, Artificial Sequence
  Synthetic
acctgaccatctagcgacctccacgagcaggggatacaaaatgaacactcaaatcctggtattcgctctgattgc

SEQ ID NO: 207629 - DNA, 75 bp, Artificial Sequence
  Synthetic
aggactgcagcgtagacgctttgtccaaaatgccctaaatgggaatggggacccgaacaacatggatagagcagt

SEQ ID NO: 207630 - DNA, 75 bp, Artificial Sequence
  Synthetic
tttgtcataagggaaccattcatatcatgctcccccttggaatgcagaaccttcttcttgactcaaggggccttg

SEQ ID NO: 207631 - DNA, 75 bp, Artificial Sequence
  Synthetic
ggaagtcgtcaatgcaactgaaacagtagaacgaacaaacatccccagaatctgctcaaaagggaaaaggacagt

SEQ ID NO: 207632 - DNA, 75 bp, Artificial Sequence
  Synthetic
gaccatgagattgccgactggtcatggcacgatggagctattcttccttttgacatcgataagatgtaatttacg

SEQ ID NO: 207633 - DNA, 75 bp, Artificial Sequence
  Synthetic
atgggaataataccactgatgactgtacttctattagtaacaacaagcaatgcagacaaaatatgcattggccat

SEQ ID NO: 207634 - DNA, 75 bp, Artificial Sequence
  Synthetic
gaagttccctctccatacaactcaagatttgagtcggtcgcttggtcagcaagtgcttgtcatgatggcatcaat

SEQ ID NO: 207635 - DNA, 75 bp, Artificial Sequence
  Synthetic
actgaaggcacttattgggtcaggagaaagggtagagagatttgagatgtttcccaaaagtacatggacaggagt

SEQ ID NO: 207636 - DNA, 75 bp, Artificial Sequence
  Synthetic
ctggctagcactactgcaaaggctatggaacagatggctggatcgagtgaacaggcagcagaggccatggaggtt

SEQ ID NO: 207637 - DNA, 75 bp, Artificial Sequence
  Synthetic
tgataaaatctgtctaggacatcatgcagtggctaatgggaccatcgtaaagactctcacaaacgaacaggaaga

SEQ ID NO: 207638 - DNA, 75 bp, Artificial Sequence
  Synthetic
atgtacaaaatagtagtgataatcgcgctccttggagctgtgaaaggtcttgataaaatctgtctaggacatcat

SEQ ID NO: 207639 - DNA, 75 bp, Artificial Sequence
  Synthetic
aaagtacaatggcataataacagacactatcaagagttggagaaacaatatattgagaacacaagagtctgaatg

SEQ ID NO: 207640 - DNA, 75 bp, Artificial Sequence
  Synthetic
gtatgaaaggaagaaaacataaagacctgggcaactgccatccaatagggatgctaatagggactccagcttgtg

SEQ ID NO: 207641 - DNA, 75 bp, Artificial Sequence
  Synthetic
atggacaggcctcatacaagatcttcagaatagaaaagggaaagatagtcaaatcagtcgaaatgaatgccccta

SEQ ID NO: 207642 - DNA, 75 bp, Artificial Sequence
  Synthetic
attgcttactgctaccctggagctactgtaaatgtagaagcactaaggcagaagataatggagagtggagggatc

SEQ ID NO: 207643 - DNA, 75 bp, Artificial Sequence
  Synthetic
aggaattctttgaaaacaaatcggaaacatggccaattggagaatcacccaaaggagtggaggaaggctccattg

SEQ ID NO: 207644 - DNA, 75 bp, Artificial Sequence
  Synthetic
ggagggaatagcttttatgcagagcttaagtggctggtatcaaagagcaaaggacaaaacttccctcagaccacg

SEQ ID NO: 207645 - DNA, 75 bp, Artificial Sequence
  Synthetic
ggatacatatgcagtgggattttcggagacaatccacgccctaatgataagacaggcagttgtggtccagtatcg

SEQ ID NO: 207646 - DNA, 75 bp, Artificial Sequence
  Synthetic
gagacaatccacgccctaatgataagacaggcagttgtggtccagtatcgtctaatggagcaaatggagtaaaag

SEQ ID NO: 207647 - DNA, 75 bp, Artificial Sequence
  Synthetic
aacacttacagaaatacagacacggctgaacacctcataatgtggggaattcatcacccttctagcactcaagag

SEQ ID NO: 207648 - DNA, 75 bp, Artificial Sequence
  Synthetic
ctgtgatgccacatgccagactatcgcaggagtcctaaggaccaataaaacatttcagaatgtgagtcctctgtg

SEQ ID NO: 207649 - DNA, 75 bp, Artificial Sequence
  Synthetic
cttcctgagagggaaatctatgggaattcagagtggagtgcaggttgatgccgattgtgaaggggattgctatca

SEQ ID NO: 207650 - DNA, 75 bp, Artificial Sequence
  Synthetic
ccaggagcgagaccacaagttaatggtcaatctggaaggattgatttccattggctgatgctaaatcccaatgat

SEQ ID NO: 207651 - DNA, 75 bp, Artificial Sequence
  Synthetic
attagttcaagaaaaggttttgagatgatttgggatccaaatggatggactgggacagacaataacttctcaata

SEQ ID NO: 207652 - DNA, 75 bp, Artificial Sequence
  Synthetic
cacttaccggaacaattttgttccggttgttggagcaagacctcaggtcaatggacaaagtggcagaattgattt

SEQ ID NO: 207653 - DNA, 75 bp, Artificial Sequence
  Synthetic
atggacaaagtggcagaattgattttcactggacactagtacagccaggtgacaacatcaccttctcacacaatg

SEQ ID NO: 207654 - DNA, 75 bp, Artificial Sequence
  Synthetic
agtggtcaggatatagcgggagttttgttctgcatccagaactaacagggctggattgtataagaccttgcttct

SEQ ID NO: 207655 - DNA, 75 bp, Artificial Sequence
  Synthetic
aaaatgtccgagatatgttaagcaaaggagtctgctgctagcaacagggatgaagaatgttcctgagattccaaa

SEQ ID NO: 207656 - DNA, 75 bp, Artificial Sequence
  Synthetic
ggaatccaatcagacgcaccaatagacaataattgtgagtccaaatgtttttggagagggggttctataaataca

SEQ ID NO: 207657 - DNA, 75 bp, Artificial Sequence
  Synthetic
gggagcagcatatccttttgtggtgtaaacagtgacactgtgggttggtcttggccagacggtgctgagttgcca

SEQ ID NO: 207658 - DNA, 75 bp, Artificial Sequence
  Synthetic
tgaaaaaggtggcctaaacagtacattacctttccacaatatcagtaaatatgcatttggggattgccccaaata

SEQ ID NO: 207659 - DNA, 75 bp, Artificial Sequence
  Synthetic
acaataattgtgagtccaaatgtttttggagagggggttctataaatacaaggcttccctttcaaaatttgtcac

SEQ ID NO: 207660 - DNA, 75 bp, Artificial Sequence
  Synthetic
taaacagtgacactgtgggttggtcttggccagacggtgctgagttgccatttaccattgacaagtaatttgttc

SEQ ID NO: 207661 - DNA, 75 bp, Artificial Sequence
  Synthetic
cttgcaacaggaatgagaaacgtaccagaactaatacaagggagaggtctatttggtgcaatagcagggttttta

SEQ ID NO: 207662 - DNA, 75 bp, Artificial Sequence
  Synthetic
atggctggtatggtttcagacatcaaaatgctcagggcacaggccaggccgctgattacaagagtactcaggcag

SEQ ID NO: 207663 - DNA, 75 bp, Artificial Sequence
  Synthetic
gtgacccgaatgcactattgaagcaccgatttgagataattgaaggaagagaccgaatcatggcctggacagtgg

SEQ ID NO: 207664 - DNA, 75 bp, Artificial Sequence
  Synthetic
ccgatttgagataattgaaggaagagaccgaatcatggcctggacagtggtgaacagtatatgtaacacaacagg

SEQ ID NO: 207665 - DNA, 75 bp, Artificial Sequence
  Synthetic
tgcttatgaaagaatgtgcaatatcctcaaaggaaaatttcagacagctgcccagagggcaatgatggatcaagt

SEQ ID NO: 207666 - DNA, 75 bp, Artificial Sequence
  Synthetic
ggagaaccagcatacaatcgacatggctgactcagagatgttgaatctatatgaaagagtgaggaaacaactaag

SEQ ID NO: 207667 - DNA, 75 bp, Artificial Sequence
  Synthetic
gctgactcagagatgttgaatctatatgaaagagtgaggaaacaactaaggcagaatgcagaagaagatgggaaa

SEQ ID NO: 207668 - DNA, 75 bp, Artificial Sequence
  Synthetic
ggtcctcatcggaggacttgaatggaatgataacacagttcgagtctctgaaaatctacagagattcgcttggag

SEQ ID NO: 207669 - DNA, 75 bp, Artificial Sequence
  Synthetic
aagaaacaacacctatgaccattcacagtacagagaggaagctcttttgaacagattgaatatcaacccagtgac

SEQ ID NO: 207670 - DNA, 75 bp, Artificial Sequence
  Synthetic
accatttattcgactgtcgcctcatctcttgtacttgcaatggggtttgctgccttcttattctgggccatgtca

SEQ ID NO: 207671 - DNA, 75 bp, Artificial Sequence
  Synthetic
gcctcatctcttgtacttgcaatggggtctgctgccttcttattctgggccatgtcaaacgtatcaagcagagtc

SEQ ID NO: 207672 - DNA, 75 bp, Artificial Sequence
  Synthetic
atgattgcaatcgttgttatagcgatattggcatcggccggaaaatcagacaagatctgtattgggtaccacgcc

SEQ ID NO: 207673 - DNA, 75 bp, Artificial Sequence
  Synthetic
gcacggattgacttcgagtctggaaggattaagagagaagagtttgctgaaatggtgaagatctgttccaccatt

SEQ ID NO: 207674 - DNA, 75 bp, Artificial Sequence
  Synthetic
aattgactgattcaagctggatagaacttgatgaaataggagaagatgttgccccgattgaacatatcgcaagca

SEQ ID NO: 207675 - DNA, 75 bp, Artificial Sequence
  Synthetic
aacaattcaacaacacaagtggatacactacttgagaagaatgtaactgtcacacattcagttgaattactagag

SEQ ID NO: 207676 - DNA, 75 bp, Artificial Sequence
  Synthetic
attgcaatggggtttgctgccttcttgttctgggccatgtccaatggatcttgcagatgcaacatttgtatataa

SEQ ID NO: 207677 - DNA, 75 bp, Artificial Sequence
  Synthetic
gacaagagatatggcccagcattaagcatcaatgaactgagcaatcttgcaaagggagagaaggctaatgtgcta

SEQ ID NO: 207678 - DNA, 75 bp, Artificial Sequence
  Synthetic
ctactgttcttaaaggttccagcgcaaaatgccataagcacaacattcccttatactggagatcctccatacagc

SEQ ID NO: 207679 - DNA, 75 bp, Artificial Sequence
  Synthetic
gcattttatgtctgattttcgctcaaaaacttcccggaagtgacaacagcatggcaacgctgtgcctgggacacc

SEQ ID NO: 207680 - DNA, 75 bp, Artificial Sequence
  Synthetic
gaaccaatggaacctccaagatcaagatgaaatggggcatggaaatgaggcgctgccttcttcagtctcttcagc

SEQ ID NO: 207681 - DNA, 75 bp, Artificial Sequence
  Synthetic
agatcgagagcatgatcgaggccgagtcttctgtcaaagagaaagacatgactaaggaattctttgaaaacaaat

SEQ ID NO: 207682 - DNA, 75 bp, Artificial Sequence
  Synthetic
tggatactggggaatcctaaatgcgacttattgcttggtgatcaaagttggtcatacatagtggaaagacctaat

SEQ ID NO: 207683 - DNA, 75 bp, Artificial Sequence
  Synthetic
tgataaacaacgatcttggaccagcaacagctcaaatggcccttcagctatttatcaaagactacagatacacat

SEQ ID NO: 207684 - DNA, 75 bp, Artificial Sequence
  Synthetic
ggaaaacaaaagcaacaaaaatgaaggcaatactagtagttctgctatacacatttgcaaccgcaaatgcagaca

SEQ ID NO: 207685 - DNA, 75 bp, Artificial Sequence
  Synthetic
acatttgcaaccgcaaatgcagacacattatgtataggttatcatgcgaacaattcaacagacactgtagacaca

SEQ ID NO: 207686 - DNA, 75 bp, Artificial Sequence
  Synthetic
cattatgtataggttatcatgcgaacaattcaacagacactgtagacacagtactagaaaagaatgtaacagtaa

SEQ ID NO: 207687 - DNA, 75 bp, Artificial Sequence
  Synthetic
gtctcgcactcgcgagatactgacaaaaaccacagtggaccatatggccataattaagaagtacacatcgggaag

SEQ ID NO: 207688 - DNA, 75 bp, Artificial Sequence
  Synthetic
caattcaacagacactgtagacacagtactagaaaagaatgtaacagtaacacactctgttaaccttctagaaga

SEQ ID NO: 207689 - DNA, 75 bp, Artificial Sequence
  Synthetic
aatgcagatgcatatgtttttgtggggacatcaagatacagcaagaagttcaagccggaaatagcaataagaccc

SEQ ID NO: 207690 - DNA, 75 bp, Artificial Sequence
  Synthetic
caacttgtcagacacccgagggtgctataaacaccagcctcccatttcagaatatacatccgatcacaattggaa

SEQ ID NO: 207691 - DNA, 75 bp, Artificial Sequence
  Synthetic
gatcatgaagatctgttccaccattgaagaactcagacggcaaaaataatgaatttagcttgtccttcatgaaaa

SEQ ID NO: 207692 - DNA, 75 bp, Artificial Sequence
  Synthetic
gaactgggtgatgccccattccttgatcggcttcgccgagatcagaagtcccttagaggaaggggcagcactctt

SEQ ID NO: 207693 - DNA, 75 bp, Artificial Sequence
  Synthetic
actttctgcatttgatgaaagaaggaacaggtacctggaagaacaccccagtgcggggaaggacccgaagaaaac

SEQ ID NO: 207694 - DNA, 75 bp, Artificial Sequence
  Synthetic
aaatttcaccattgccttctgttccagaacagactaatgaggatgtcaatagtgcaattggggtcctcatcggag

SEQ ID NO: 207695 - DNA, 75 bp, Artificial Sequence
  Synthetic
agtcaattagtgtggatggcatgtcactctgcagcatttgaggaccttagagtctcaagcttcatcagaggaaca

SEQ ID NO: 207696 - DNA, 75 bp, Artificial Sequence
  Synthetic
aatggcaagactagggaaaggatacatgttcgaaagtaagagcatgaagctacgaacacaaataccagcagaaat

SEQ ID NO: 207697 - DNA, 75 bp, Artificial Sequence
  Synthetic
ctggatgtgctctaatgggtctctacagtgtagaatatgtatttaacattaggatttcagaagcatgagaaaaac

SEQ ID NO: 207698 - DNA, 75 bp, Artificial Sequence
  Synthetic
acatcatggcgtctcaaggcaccaaacgatcttatgagcagatggaaactggtggtgaacgccagaatgccactg

SEQ ID NO: 207699 - DNA, 75 bp, Artificial Sequence
  Synthetic
agttgaaaggttaaaacatggaacattcggccctgtccatttccgaaaccaagttaaaatacgccgccgagttga

SEQ ID NO: 207700 - DNA, 75 bp, Artificial Sequence
  Synthetic
cctcattgactgtgaatgtgagaggatcaggattgaggatactggtaagaggcaattctccagtgttcaattaca

SEQ ID NO: 207701 - DNA, 75 bp, Artificial Sequence
  Synthetic
acgatcttatgagcagatggaaactggtggtgaacgccagaatgccactgagattcgggcatctgtcggaaggat

SEQ ID NO: 207702 - DNA, 75 bp, Artificial Sequence
  Synthetic
atacagatgtgcactgaactcaaactgagtgacaatgaaggaaggctgatacaaaacagtatcacaatagagaga

SEQ ID NO: 207703 - DNA, 75 bp, Artificial Sequence
  Synthetic
acaaggcaaccaaacggcttacagttcttggaaaggatgcaggtgcattgactgaagatccagatgaaggcacat

SEQ ID NO: 207704 - DNA, 75 bp, Artificial Sequence
  Synthetic
tgagtgacaatgaaggaaggctgatacaaaacagtatcacaatagagagaatggtcctgtctgcatttgatgaga

SEQ ID NO: 207705 - DNA, 75 bp, Artificial Sequence
  Synthetic
caactcccccccaaacaaccaagcaatgctgtgtgaaccaacaataatagaaagaaacacaacagagattgtgta

SEQ ID NO: 207706 - DNA, 75 bp, Artificial Sequence
  Synthetic
agctctcgtgcgtactggaatggatccccggatgtgctctctgatgcaaggatcaactctcccgaggagatctgg

SEQ ID NO: 207707 - DNA, 75 bp, Artificial Sequence
  Synthetic
gacaattgggactcatcctaactccagtgctggtctgagagataatcttcttgaaaatttgcaggcataccagaa

SEQ ID NO: 207708 - DNA, 75 bp, Artificial Sequence
  Synthetic
aaaactggtggaccaatttacagaaggagagaggggaaatgggtgagagaattggtcctatatgacaaggaagaa

SEQ ID NO: 207709 - DNA, 75 bp, Artificial Sequence
  Synthetic
ggagagaggggaaatgggtgagagaattggtcctatatgacaaggaagaaataagaagaatctggcgacaggcaa

SEQ ID NO: 207710 - DNA, 75 bp, Artificial Sequence
  Synthetic
agttgcatgggcctcatatacaacagaatggggactgttgccacagaggtggcatttggtctggtgtgcgcaacc

SEQ ID NO: 207711 - DNA, 75 bp, Artificial Sequence
  Synthetic
atggatgtcaacccgactttacttttcttgaaagtaccagtgcaaaatgctataagtaccacattcccttatact

SEQ ID NO: 207712 - DNA, 75 bp, Artificial Sequence
  Synthetic
ctagacaaatggtacaggcaatgagaacaattgggactcaccctaattctagcaccggtctaaaagatgatcttc

SEQ ID NO: 207713 - DNA, 75 bp, Artificial Sequence
  Synthetic
cgggatggaccccaggatgtgctccctcatgcagggatcgacactcccaagaaggtctggagcggccggtgcagc

SEQ ID NO: 207714 - DNA, 75 bp, Artificial Sequence
  Synthetic
gaaggtctggagcggccggtgcagctgtaaaaggggttgggacaatggtgatggagctcatcagaatgataaaaa

SEQ ID NO: 207715 - DNA, 75 bp, Artificial Sequence
  Synthetic
cgaggagtatctgtgagaaacttgagcaatctggactcccagtcggagggaatgagaagaaagctaaattggcaa

SEQ ID NO: 207716 - DNA, 75 bp, Artificial Sequence
  Synthetic
agaattgcttatgagagaatgtgcaacatccttaaagggaaattccaaacagcagcacaacgagctatgatggat

SEQ ID NO: 207717 - DNA, 75 bp, Artificial Sequence
  Synthetic
gaaatgctgaaattgaagacctcatctttttggccaggtctgcccttattctgaggggagcagtagctcataaat

SEQ ID NO: 207718 - DNA, 75 bp, Artificial Sequence
  Synthetic
ctgaggggagcagtagctcataaatcatgcctgcctgcctgtgtgtatggacttgctgtagcaagtggatatgac

SEQ ID NO: 207719 - DNA, 75 bp, Artificial Sequence
  Synthetic
ggtcccaagaggacagctatccactagaggggttcaaattgcttcaaatgagaacatggaagcaatggactccaa

SEQ ID NO: 207720 - DNA, 75 bp, Artificial Sequence
  Synthetic
aactgagggaaaatgctgaggatatgggcaatggttgtttcaagatataccacaaatgtgacaatgcctgcatag

SEQ ID NO: 207721 - DNA, 75 bp, Artificial Sequence
  Synthetic
acttgctgtagcaagtggatatgacttcgaaagggagggatattcccttgttgggatagaccctttccgtctgct

SEQ ID NO: 207722 - DNA, 75 bp, Artificial Sequence
  Synthetic
gacgagataggagaagatgttgccccgattgaacacatcgcaagcatgaggaggaactattttacagcagaagtg

SEQ ID NO: 207723 - DNA, 75 bp, Artificial Sequence
  Synthetic
atgtcattctgctgcatttgaggatttgagagtgtcaagcttcatcaggggagcaagagtgttgccaagagggca

SEQ ID NO: 207724 - DNA, 75 bp, Artificial Sequence
  Synthetic
agcaaaaataagaagggagctgtcttcaagtcagatttaccaatcgagaactgcgatgccacatgccagacaatt

SEQ ID NO: 207725 - DNA, 75 bp, Artificial Sequence
  Synthetic
attggccaacaccatagaagtttttagatcaaatggtcttacagctaatgaatcaggaaggctaatagatttcct

SEQ ID NO: 207726 - DNA, 75 bp, Artificial Sequence
  Synthetic
tgagttccagcacccttgaattaaggagcaaatactgggcaataaggactagaagcggaggaaacaccaaccaac

SEQ ID NO: 207727 - DNA, 75 bp, Artificial Sequence
  Synthetic
agaaacctcccttttgaaagagcaacaatcatggctgcattcacaggaaatgcagaaggaagaacatccgatatg

SEQ ID NO: 207728 - DNA, 75 bp, Artificial Sequence
  Synthetic
acgatgaccaaagatgcagagagaggcaaattaaaaaggagggctatcgcaacacctgggatgcaaattagaggg

SEQ ID NO: 207729 - DNA, 75 bp, Artificial Sequence
  Synthetic
aggactgagatcatacggatgatggaaagtgcaagaccagaagatgtgtctttccaggggcggggagtcttcgag

SEQ ID NO: 207730 - DNA, 75 bp, Artificial Sequence
  Synthetic
atagggaaattgaatctgtcaacaatgctgtagtaatgccagctcatggcccggccaagagtatggagtatgatg

SEQ ID NO: 207731 - DNA, 75 bp, Artificial Sequence
  Synthetic
ctctcagacgaaaaggccacgaacccgatcgtgccttcctttgacatgagtaaagaaggatcttatttctttgga

SEQ ID NO: 207732 - DNA, 75 bp, Artificial Sequence
  Synthetic
gcagcactcttggtatcgacattgaggcagctactcgctctgggaagcagataatagagcggattctggatgaag

SEQ ID NO: 207733 - DNA, 75 bp, Artificial Sequence
  Synthetic
ggcagctactcgctctgggaagcagataatagagcggattctggatgaagaatcagacgaggcattgaaaatgac

SEQ ID NO: 207734 - DNA, 75 bp, Artificial Sequence
  Synthetic
aaatgtcaagggattggtttatgcttatgcccaaacagaagtttgctggtcccctctgcatcaaaatggatcagg

SEQ ID NO: 207735 - DNA, 75 bp, Artificial Sequence
  Synthetic
aaccgattggaaactctcgtgctgctgagggctttcaccaatgagggagcaatagtgggcgaaatttcacaattg

SEQ ID NO: 207736 - DNA, 75 bp, Artificial Sequence
  Synthetic
gacggaaagtggatgagagaactcatcctttatgacaaagaagaaataaggagagtttggcgccaagcaaacaat

SEQ ID NO: 207737 - DNA, 75 bp, Artificial Sequence
  Synthetic
aggatgtcaaaaatgcaattggagtcctcatcgggggacttgaatggaatgataacacagttcgaatctctgaaa

SEQ ID NO: 207738 - DNA, 75 bp, Artificial Sequence
  Synthetic
cctcatcgggggacttgaatggaatgataacacagttcgaatctctgaaactctacagagattcgcttggggaag

SEQ ID NO: 207739 - DNA, 75 bp, Artificial Sequence
  Synthetic
ttcgctccagagcagaaacagaaactggcgagaacaattgagtcagaagtttgaagaaatgagatggttgattga

SEQ ID NO: 207740 - DNA, 75 bp, Artificial Sequence
  Synthetic
agcgaaagcaggcaaaccatttgaatggatgtcaatccgactttacttttcttgaaagtgccagtgcaaaatgct

SEQ ID NO: 207741 - DNA, 75 bp, Artificial Sequence
  Synthetic
caaagattaaaccccatgcatcaactcctgagacattttcaaaaggacgcaaaagtgctatttcaaaattgggga

SEQ ID NO: 207742 - DNA, 75 bp, Artificial Sequence
  Synthetic
gaggtcgaaacgtacgttctctctatcattccatcaggccccctcaaagccgagatagcacagagacttgaagat

SEQ ID NO: 207743 - DNA, 75 bp, Artificial Sequence
  Synthetic
ttcaggtagactgcttcctttggcatgtccgcaaacggtttgcagacaatggattgggtgatgccccatttcttg

SEQ ID NO: 207744 - DNA, 75 bp, Artificial Sequence
  Synthetic
ctaataatggagaggacgcaactgctggtctcactcatttgatgatttggcattccaatctgaatgatgccacat

SEQ ID NO: 207745 - DNA, 75 bp, Artificial Sequence
  Synthetic
tgtccgcaaacggtttgcagacaatggattgggtgatgccccatttcttgaccggctccgccgagaccaaaagtc

SEQ ID NO: 207746 - DNA, 75 bp, Artificial Sequence
  Synthetic
tttggcgccaagcaaacaatggcgaagatgcaacagcaggccttactcatatcatgatttggcattccaacctga

SEQ ID NO: 207747 - DNA, 75 bp, Artificial Sequence
  Synthetic
aaagctttacagaaagctgaagagagagataacattccacggagctaaggaagtggcactcagctactcaactgg

SEQ ID NO: 207748 - DNA, 75 bp, Artificial Sequence
  Synthetic
gagataacattccacggagctaaggaagtggcactcagctactcaactggtgcacttgccagctgcatgggtctc

SEQ ID NO: 207749 - DNA, 75 bp, Artificial Sequence
  Synthetic
accctctggagcaaaacaaacgatgctggatcggaccgcgtgatggtatcacccctggccgtaacatggtggaat

SEQ ID NO: 207750 - DNA, 75 bp, Artificial Sequence
  Synthetic
ggatgggctgtacacagtaaggacaacagtataagaattggttccaagggggatgtgtttgtaattagagagccg

SEQ ID NO: 207751 - DNA, 75 bp, Artificial Sequence
  Synthetic
gtgtgccacttgtgagcagattgctgactctcagcatcgatcccacaggcagatggtgaccacaaccaatccact

SEQ ID NO: 207752 - DNA, 75 bp, Artificial Sequence
  Synthetic
ttcatctcatgctctcatttggaatgcagaactttctttttgacccagggagccttactgaatgacaagcactcc

SEQ ID NO: 207753 - DNA, 75 bp, Artificial Sequence
  Synthetic
tcgagtctctgaaagtctacagagattcgcttggagaaagtataatgaggacgggagaccttcactaccttcaga

SEQ ID NO: 207754 - DNA, 75 bp, Artificial Sequence
  Synthetic
tgaccgaaatttctggaggggtgaaaatggacgaaggacaagggttgcttatgaaagaatgtgcaatatcctcaa

SEQ ID NO: 207755 - DNA, 75 bp, Artificial Sequence
  Synthetic
aataagagaatggaagatgggtttctggatgtttggacttacaatgctgagttgttggttcttcttgaaaatgaa

SEQ ID NO: 207756 - DNA, 75 bp, Artificial Sequence
  Synthetic
caagtggtcagcctgatgagaccaaatgaaaacccagctcacaagagtcaattggtgtggatggcatgccactct

SEQ ID NO: 207757 - DNA, 75 bp, Artificial Sequence
  Synthetic
ccccattgcatttgggtaaatgtaacattgctggctggatcctgggaaatccagagtgtgaatcactctccacag

SEQ ID NO: 207758 - DNA, 75 bp, Artificial Sequence
  Synthetic
taacatttatgcaagccttacaactactgcttgaagtggagcaagagataagaactttctcgtttcagcttattt

SEQ ID NO: 207759 - DNA, 75 bp, Artificial Sequence
  Synthetic
taatagtaagtgggagagacgagcagtcagttgctgaggcaataattgttgccatggtgttttcacaagaggatt

SEQ ID NO: 207760 - DNA, 75 bp, Artificial Sequence
  Synthetic
gaagagtaagagacaacatgaccaagaaaatggtcacacaaagaacaataggaaagaagaagcagaggctaaaca

SEQ ID NO: 207761 - DNA, 75 bp, Artificial Sequence
  Synthetic
ccgatgtcacaggggtgatacgcaaattcaaacgaggagagcattcgagctgaagaagctgtgggagcagacccg

SEQ ID NO: 207762 - DNA, 75 bp, Artificial Sequence
  Synthetic
acatttccagaggaagaggagagtgagggacaacatgaccaagaaaatggtcacacagagaacaataggaaagaa

SEQ ID NO: 207763 - DNA, 75 bp, Artificial Sequence
  Synthetic
agggacaacatgaccaagaaaatggtcacacagagaacaataggaaagaaaaaacaaagactgaacaaaaggagc

SEQ ID NO: 207764 - DNA, 75 bp, Artificial Sequence
  Synthetic
tttcaggtagactgtttcctttggcacatccgcaaacggtttgcagacaatggattgggtgatgccccattccta

SEQ ID NO: 207765 - DNA, 75 bp, Artificial Sequence
  Synthetic
cacgtgtgagcagattgctgattcccagcatcggtctcacagacaaatggtgacaacaaccaacccgctaatcag

SEQ ID NO: 207766 - DNA, 75 bp, Artificial Sequence
  Synthetic
gatcggctccgccgagatcaaaagtccctaaaaggaagaggcaacaccctcagcctcgacatcgaaacagccact

SEQ ID NO: 207767 - DNA, 75 bp, Artificial Sequence
  Synthetic
cttgttgggaaacaaattgtggagtggattttaaaagaggaatccagcgagacacttaagatgaccattgcatct

SEQ ID NO: 207768 - DNA, 75 bp, Artificial Sequence
  Synthetic
atggccatcatttatctaattcttttgcttgcaacagtgagaggagaccagatatgcattggataccactccaac

SEQ ID NO: 207769 - DNA, 75 bp, Artificial Sequence
  Synthetic
acatgaccctcgaggaaatgtcacgagactggttcatgctcatgcctaggcaaaagataataggccctctttgtg

SEQ ID NO: 207770 - DNA, 75 bp, Artificial Sequence
  Synthetic
tgaggaccattgggactcatcctagctccagtgctggtctgaaagatgatcttcttgaaaatttgcaggcctacc

SEQ ID NO: 207771 - DNA, 75 bp, Artificial Sequence
  Synthetic
atgttcgaaagtaagagcatgaagcttcgaacacaaataccggcagaaatgctggcaagtattgatctgaaatat

SEQ ID NO: 207772 - DNA, 75 bp, Artificial Sequence
  Synthetic
atcatgaagatctgttccaccattgaagagctcagacggcaaaaatagtgaatttagcttgtccttcatgaaaaa

SEQ ID NO: 207773 - DNA, 75 bp, Artificial Sequence
  Synthetic
agtctatgagggaagaatatcggcaggaacagcagagtgctgtggatgttgacgatggtcattttgtcaacatag

SEQ ID NO: 207774 - DNA, 75 bp, Artificial Sequence
  Synthetic
attcgcttggagaaaccgtaatgaggatgggagaccttcactacctccagaacagaaatgaaaggtggcgagagc

SEQ ID NO: 207775 - DNA, 75 bp, Artificial Sequence
  Synthetic
aattccacagaaaaagtagacacaattctagagaggaatgtcactgtgactcacgctcaagacattcttgagaag

SEQ ID NO: 207776 - DNA, 75 bp, Artificial Sequence
  Synthetic
ccgaactgttggttctattggaaaatgaaagaactttggactaccacgattcaaatgtgaagaacttgtatgaaa

SEQ ID NO: 207777 - DNA, 75 bp, Artificial Sequence
  Synthetic
gaaacacctattgagcaggataaaccattttgagaaaatacggatcattcccaaagattcttggtcagatcatga

SEQ ID NO: 207778 - DNA, 75 bp, Artificial Sequence
  Synthetic
tgggcatgttcaacatgctaagtacggttttgggagtctcgatactgaatcttggacaaaagaaatacaccaaga

SEQ ID NO: 207779 - DNA, 75 bp, Artificial Sequence
  Synthetic
gcttgaagtagagcaagagataaggactttctcgtttcagcttatttaatgataaaaaacacccttgtttctact

SEQ ID NO: 207780 - DNA, 75 bp, Artificial Sequence
  Synthetic
tttgtcagccacaaagagatagagtctgtaaacaatgctgtggtgatgccagctcatggcccagccaagagcatg

SEQ ID NO: 207781 - DNA, 75 bp, Artificial Sequence
  Synthetic
gaaagagcctaacataatcaaaccacatgagaaaggcataaaccctaattatctactggcttggaagcaggtgct

SEQ ID NO: 207782 - DNA, 75 bp, Artificial Sequence
  Synthetic
ttggaatttctagcatggtggaggccatggtgtctagggcccggattgatgccagggtcgacttcgagtctggac

SEQ ID NO: 207783 - DNA, 75 bp, Artificial Sequence
  Synthetic
ctccttggaaatccagaatgtgataggcttctaactgtgccagaatggtcatatataatggagaaagaaaatcca

SEQ ID NO: 207784 - DNA, 75 bp, Artificial Sequence
  Synthetic
tagatgtctggacttataatgcagaacttctggttctcatggaaaatgagagaactctagacttccatgactcaa

SEQ ID NO: 207785 - DNA, 75 bp, Artificial Sequence
  Synthetic
aacatggtggaacagaaacggaccaacggcaagtacggtccactatcccaaagtctacaaaacttactttgaaaa

SEQ ID NO: 207786 - DNA, 75 bp, Artificial Sequence
  Synthetic
acggcaagtacggtccactatcccaaagtctacaaaacttactttgaaaaagttgagagattgaaacatggaaca

SEQ ID NO: 207787 - DNA, 75 bp, Artificial Sequence
  Synthetic
aagaggaaatagagataacaacccactttcaaagaaaaaggagagtaagagacaacatgaccaagaagatggtca

SEQ ID NO: 207788 - DNA, 75 bp, Artificial Sequence
  Synthetic
cactatggacacagtcaacaggacacaccaatattcagaaaaagggaaatggacgacaaacacagagactggggc

SEQ ID NO: 207789 - DNA, 75 bp, Artificial Sequence
  Synthetic
cacaaatcctggtcatgcagatctcagtgctaaagaggcacaggacgtcatcatggaagttgtattcccaaatga

SEQ ID NO: 207790 - DNA, 75 bp, Artificial Sequence
  Synthetic
agtgctaaagaggcacaggacgtcatcatggaagttgtattcccaaatgaagtgggggctagaatactaacatca

SEQ ID NO: 207791 - DNA, 75 bp, Artificial Sequence
  Synthetic
gaggattagctcatctttcagttttggtgggttcactttcaaaaggacaagcggatcatcagtcaagaaagaaga

SEQ ID NO: 207792 - DNA, 75 bp, Artificial Sequence
  Synthetic
aaaagaaggaggagcttcaggactgcaaaattgctcccctaatggttgcatacatgttggaaagagaactggtcc

SEQ ID NO: 207793 - DNA, 75 bp, Artificial Sequence
  Synthetic
taaaaaacaacatgataaacaatgaccttggaccagcaacagcccaaatggctcttcagctgttcatcaaggatt

SEQ ID NO: 207794 - DNA, 75 bp, Artificial Sequence
  Synthetic
gaagtcttgcatttgactcaaggaacctgctgggaacaaatgtacactccaggaggggaagtgagaaatgatgat

SEQ ID NO: 207795 - DNA, 75 bp, Artificial Sequence
  Synthetic
cctgctgggaacaaatgtacactccaggaggggaagtgagaaatgatgatgttgaccagagtttaatcattgctg

SEQ ID NO: 207796 - DNA, 75 bp, Artificial Sequence
  Synthetic
actgccatcctggtgactactgtaacattgcatttcaagcagcaggattgcaactcctctccaaacaaccaggta

SEQ ID NO: 207797 - DNA, 75 bp, Artificial Sequence
  Synthetic
gaatcaatggataaagaggaaatagaaataacaacacattttcaaagaaaaaggagagtgagagacaacatgacc

SEQ ID NO: 207798 - DNA, 75 bp, Artificial Sequence
  Synthetic
cttctagaaatgtgccatagtactcaaataggcggaataaggatggtagacatccttagacaaaacccaacagaa

SEQ ID NO: 207799 - DNA, 75 bp, Artificial Sequence
  Synthetic
gtcgttcagctttggaggattcacttttaaaaggacaagtgggtcatctatcaaaagagaagaagaagtgctcac

SEQ ID NO: 207800 - DNA, 75 bp, Artificial Sequence
  Synthetic
tgatgaatgaattgggtgttccatttcatttgggaaccaggcaagtgtgcatagcatggtccagctcaagttgtc

SEQ ID NO: 207801 - DNA, 75 bp, Artificial Sequence
  Synthetic
aagaagaagtgctcacaggcaacctccaaacattgaaaataagagtacatgaaggatatgaggaattcacaatgg

SEQ ID NO: 207802 - DNA, 75 bp, Artificial Sequence
  Synthetic
ggagggatgaacaatccattgctgaagccataattgtagcaatggtgttttcacaagaagattgcatgataaaag

SEQ ID NO: 207803 - DNA, 75 bp, Artificial Sequence
  Synthetic
aggacctgcaagttagtgggaatcaacatgagcaaaaagaagtcctatataaataagacagggacatttgaattc

SEQ ID NO: 207804 - DNA, 75 bp, Artificial Sequence
  Synthetic
gatgatgactaattcacaagacacagagctttctttcacaatcactggggacaacactaaatggaatgaaaacca

SEQ ID NO: 207805 - DNA, 75 bp, Artificial Sequence
  Synthetic
cctatgcaccagcttctgaggcacttccaaaaggacgcgaaggtgttgtttcaaaattggggagttgagcccatt

SEQ ID NO: 207806 - DNA, 75 bp, Artificial Sequence
  Synthetic
tccaaaaggacgcgaaggtgttgtttcaaaattggggagttgagcccattgacaacgtcatggggatgataggaa

SEQ ID NO: 207807 - DNA, 75 bp, Artificial Sequence
  Synthetic
gccaagatgaatcaatcagcaacactaaatttcttgctgagaaagctgtggcttcagtaacattagcgggcaatt

SEQ ID NO: 207808 - DNA, 75 bp, Artificial Sequence
  Synthetic
ggatcatacaataatacaagtggggaacaaatgctgatcatttggggagtacaccatcccaatgatgatgctgaa

SEQ ID NO: 207809 - DNA, 75 bp, Artificial Sequence
  Synthetic
actctagcactgagagagtggttgtgagcatagatcgtttcctaagggttcgagaccagcgggggaatgtgctcc

SEQ ID NO: 207810 - DNA, 75 bp, Artificial Sequence
  Synthetic
gaggagtgctcctgttatcctcgatatcctggtgtcagatgtgtctgcagagacaactggaaaggctccaatagg

SEQ ID NO: 207811 - DNA, 75 bp, Artificial Sequence
  Synthetic
gggaattgaacccattgacaatgtaatggggatgatcggaatattgcctgacatgacccccagcacagagatgtc

SEQ ID NO: 207812 - DNA, 75 bp, Artificial Sequence
  Synthetic
acgtattcatcgtcgatgatgtgggagatcaacggtccggagtcagttctagtcaacacctatcaatggatcatc

SEQ ID NO: 207813 - DNA, 75 bp, Artificial Sequence
  Synthetic
agatcaacggtccggagtcagttctagtcaacacctatcaatggatcatcagaaattgggaagttgtaaagattc

SEQ ID NO: 207814 - DNA, 75 bp, Artificial Sequence
  Synthetic
ttagtagggatcaatatgagcaaaaagaagtcctacataaataagactggaacatttgaattcacaagctttttt

SEQ ID NO: 207815 - DNA, 75 bp, Artificial Sequence
  Synthetic
aagaggttagtgaaacacagggaacagaaaagctgactataacatattcatcgtccatgatgtgggagatcaatg

SEQ ID NO: 207816 - DNA, 75 bp, Artificial Sequence
  Synthetic
tgcagcagctccaccggaacagagtaggatgcaattttcttctctaactgtgaatgtgagagggtcagggatgag

SEQ ID NO: 207817 - DNA, 75 bp, Artificial Sequence
  Synthetic
atgatgccacctatcagagaacgagagctctcgtgcgtactggaatggacccccggatgtgctctctgatgcaag

SEQ ID NO: 207818 - DNA, 75 bp, Artificial Sequence
  Synthetic
gtgtttaactacaacaagacaaccaagagacttacagtccttgggaaagatgcaggctccttaacagaagacccg

SEQ ID NO: 207819 - DNA, 75 bp, Artificial Sequence
  Synthetic
aggtgctgcatttaactcaggggacatgctgggagcaaatgtacaccccgggaggggaagtgaggaatgacgatg

SEQ ID NO: 207820 - DNA, 75 bp, Artificial Sequence
  Synthetic
acgatggaaaagcatggctgcatgtttgtgtgacgggagatgacaaaaatgcaactgctagcatcatttacaatg

SEQ ID NO: 207821 - DNA, 75 bp, Artificial Sequence
  Synthetic
tctaggtaaagaagacaaaagatacgggccagcattgagcatcaatgaactgagcaatcttgcgaaaggagaaaa

SEQ ID NO: 207822 - DNA, 75 bp, Artificial Sequence
  Synthetic
aacaagcggtggacatatgcaaagcagcaatgggcttaaggatcagctcatctttcagctttggcggattcactt

SEQ ID NO: 207823 - DNA, 75 bp, Artificial Sequence
  Synthetic
tcaagcaatgcttgcaaaaggaaatctgttaaaagtttctttagtagattgaattggttgcatagtttggagtac

SEQ ID NO: 207824 - DNA, 75 bp, Artificial Sequence
  Synthetic
gcccggattgatgccaggattgacttcgagtctggacggatcaagaaagaagagttctctgagatcatgaagatc

SEQ ID NO: 207825 - DNA, 75 bp, Artificial Sequence
  Synthetic
ggacttgaatggaatgataacacagttcgagtctctgaaactctacagagattcgcttggagaagcagtaatgag

SEQ ID NO: 207826 - DNA, 75 bp, Artificial Sequence
  Synthetic
tcgagtctggacggatcaagaaagaagagttctctgagatcatgaagatctgttccaccattgaagaactcagac

SEQ ID NO: 207827 - DNA, 75 bp, Artificial Sequence
  Synthetic
gagtacatgaggggtatgaagagttcacaatggttgggagaagggcaacagccattctcaggaaggcaaccagaa

SEQ ID NO: 207828 - DNA, 75 bp, Artificial Sequence
  Synthetic
tcaaatatattcaatatggagagaataaaagaactaagagatctaatgtcgcagtctcgcactcgcgagatactc

SEQ ID NO: 207829 - DNA, 75 bp, Artificial Sequence
  Synthetic
acaggagtcgataagcctaaatttctcccagatttgtatgactacaaagagaaccgattcattgaaattggagtg

SEQ ID NO: 207830 - DNA, 75 bp, Artificial Sequence
  Synthetic
agaggggttcaaattgcttcaaatgagaacatagaagcaatggactccaacactcttgaactgagaagtagatat

SEQ ID NO: 207831 - DNA, 75 bp, Artificial Sequence
  Synthetic
tgggctataagaaccagaagcggaggaaacaccaaccaacagagggcatctgcaggacaggtcagcgttcaaccc

SEQ ID NO: 207832 - DNA, 75 bp, Artificial Sequence
  Synthetic
ccgtgtgatggtatcacccctggccgtaacatggtggaataggaatggcccaacaacaagcacagttcactaccc

SEQ ID NO: 207833 - DNA, 75 bp, Artificial Sequence
  Synthetic
agcaaaagcaggggaatttcacaaccactcaagatggagacagtatcactaataactatactactggtagcagca

SEQ ID NO: 207834 - DNA, 75 bp, Artificial Sequence
  Synthetic
gaaattgggaaactgtgaaaattcaatggtcacaagaccccacgatgttatataacaagatggaattcgagccat

SEQ ID NO: 207835 - DNA, 75 bp, Artificial Sequence
  Synthetic
gagagcatgattgaagctgaatcctccgtcaaagagaaagacctgaccaaagaattctttgaaaacaaatcagaa

SEQ ID NO: 207836 - DNA, 75 bp, Artificial Sequence
  Synthetic
tcagataataaaacttctcccctttgctgctgctccaccagaacaaagtaggatgcaattctcctccttgactgt

SEQ ID NO: 207837 - DNA, 75 bp, Artificial Sequence
  Synthetic
ctgcatgggatcaatcagaaatggaacctatgaccatgatgtatacagagatgaggcattaaacaatcggttcca

SEQ ID NO: 207838 - DNA, 75 bp, Artificial Sequence
  Synthetic
tggaatgtgtcttacagtgggacaagcaaagcatgttcagattcattctacagaagcatgagatggttgactcaa

SEQ ID NO: 207839 - DNA, 75 bp, Artificial Sequence
  Synthetic
atgaaggcacagctggagtagagtctgctgtcttgagagggttcctcattttgggcaaagaagacaagagatatg

SEQ ID NO: 207840 - DNA, 75 bp, Artificial Sequence
  Synthetic
ccttcaaaaggacaagcggatcatctgttaagaaagaagaagaagtgctcacgggcaacctccaaacaatgaaaa

SEQ ID NO: 207841 - DNA, 75 bp, Artificial Sequence
  Synthetic
gcggaagtatcccattgcagggctactgaatacataatgaagggagtgtacataaacacagccctgttgaatgca

SEQ ID NO: 207842 - DNA, 75 bp, Artificial Sequence
  Synthetic
ggacacattctttcaggagagagccacggaagaatcctgaagactgatttaaaaaggggtagctgcacagtgcaa

SEQ ID NO: 207843 - DNA, 75 bp, Artificial Sequence
  Synthetic
ctaaaacaccggtttgaaataattgaagggagagatcgcactatggcctggacagtagtgaacagtatttgcaac

SEQ ID NO: 207844 - DNA, 75 bp, Artificial Sequence
  Synthetic
acaaatctgtatgggttcattataaaaggaagatcccatttgagaaatgacaccgatgtggtaaattttgtgagc

SEQ ID NO: 207845 - DNA, 75 bp, Artificial Sequence
  Synthetic
ttctcccggatttgtacgattacaaagagaatcgtttcattgaaattggagtaaccaggagggaagtccatatat

SEQ ID NO: 207846 - DNA, 75 bp, Artificial Sequence
  Synthetic
gagtcagcaaaatgggagtagatgaatattccagtacggagagagtggtagtgagcattgaccgatttttgagag

SEQ ID NO: 207847 - DNA, 75 bp, Artificial Sequence
  Synthetic
gtgagcattgaccgatttttgagagttcgggatcaacgagggaacgtgctattgtcccccgaagaggtcagcgag

SEQ ID NO: 207848 - DNA, 75 bp, Artificial Sequence
  Synthetic
actagccccatgggaaaccaggggtatggagttaaaggattcgggttcaggcagggcaatgatgtatggatggga

SEQ ID NO: 207849 - DNA, 75 bp, Artificial Sequence
  Synthetic
ggagatcaatggtcctgagtcagtgctggtcaacacttatcaatggatcataaggaactgggaaagcttgaaaat

SEQ ID NO: 207850 - DNA, 75 bp, Artificial Sequence
  Synthetic
taaggaactgggaaagcttgaaaattcaatggtcacaggatcccacgatgttatacaacaaaatggaatttgaac

SEQ ID NO: 207851 - DNA, 75 bp, Artificial Sequence
  Synthetic
tcaatggtcacaggatcccacgatgttatacaacaaaatggaatttgaaccattccagtctcttgtccctaaggc

SEQ ID NO: 207852 - DNA, 75 bp, Artificial Sequence
  Synthetic
agcatgacgcaaatgtaaacaatctatataataaagtgaagagggcgttgggttccaatgcagtggaagatggga

SEQ ID NO: 207853 - DNA, 75 bp, Artificial Sequence
  Synthetic
caatgatcaaggatctgggtatgcagcagacaaagagtccactcaaaaggcaattgatggaatcaccaataaggt

SEQ ID NO: 207854 - DNA, 75 bp, Artificial Sequence
  Synthetic
gaaatgaatccaaatcagaggataatagcgattgggtcagtaaacacagtattatctaccatagcactgctgatt

SEQ ID NO: 207855 - DNA, 75 bp, Artificial Sequence
  Synthetic
attatctaccatagcactgctgattgggataggcaatttggctttcaatgcagttattcatggcaaagttgaaga

SEQ ID NO: 207856 - DNA, 75 bp, Artificial Sequence
  Synthetic
aaatcctcaccatttattcgactgtcgcctcatctcttgtgattgcaatggggtttgctgccttcttgttctggg

SEQ ID NO: 207857 - DNA, 75 bp, Artificial Sequence
  Synthetic
tcccaaatgacaagccctttcagaatgtaaacaaaatcacctatggggcatgtcccaaatatgtcaagcagaaca

SEQ ID NO: 207858 - DNA, 75 bp, Artificial Sequence
  Synthetic
ctgataacagtttctttagtagattgaattggttgacccacttaaattacaaatatccagcattgaaaattacta

SEQ ID NO: 207859 - DNA, 75 bp, Artificial Sequence
  Synthetic
caaaaacgaagaacatgaagaaaacaagccaattgaaatgggcacttggtgaaaacatggcaccagagaaagtgg

SEQ ID NO: 207860 - DNA, 75 bp, Artificial Sequence
  Synthetic
aagccaattgaaatgggcacttggtgaaaacatggcaccagagaaagtggactttgaagactgcaaggatgtcag

SEQ ID NO: 207861 - DNA, 75 bp, Artificial Sequence
  Synthetic
aggccccctcaaagccgagatcgcgcagagacttgaggatgtttttgcagggaagaacacagatctcgaggctct

SEQ ID NO: 207862 - DNA, 75 bp, Artificial Sequence
  Synthetic
ccgggtacgtacaatgaccaaatcagcctatatgctcaagcatcaggaataatcacagtctctaccaaaagaacc

SEQ ID NO: 207863 - DNA, 75 bp, Artificial Sequence
  Synthetic
caacactacaatcaacaacataacaaacgttgttcttcaggatccgggaaaacatttcaggcttccattgccctt

SEQ ID NO: 207864 - DNA, 75 bp, Artificial Sequence
  Synthetic
gaatgtgcctgagaaacaaaccaggggtctgttcggtgcaaaagcagggttcatagaaaacggatgggaaggaat

SEQ ID NO: 207865 - DNA, 75 bp, Artificial Sequence
  Synthetic
gatgcaggtgcattgactgaagatccagatgaaggcacagctggagtggagtctgctgtcctgaggggattcctc

SEQ ID NO: 207866 - DNA, 75 bp, Artificial Sequence
  Synthetic
aacgttgttcttcaggatccgggaaaacatttcaggcttccattgcccttgtgtcctttcaaaggtttcttccca

SEQ ID NO: 207867 - DNA, 75 bp, Artificial Sequence
  Synthetic
aacaagggaaccctacatcagttgcgacaatgaagtctgttggtcttttgcattagctcaaggcgcacttctggg

SEQ ID NO: 207868 - DNA, 75 bp, Artificial Sequence
  Synthetic
gacaatgaagtctgttggtcttttgcattagctcaaggcgcacttctgggaacaaagcacagcaatgggacaaat

SEQ ID NO: 207869 - DNA, 75 bp, Artificial Sequence
  Synthetic
agcaaaagcaggtactgatccaaaatggaagactttgtgcgacaatgcttcaatccaatgatcgtcgagcttgca

SEQ ID NO: 207870 - DNA, 75 bp, Artificial Sequence
  Synthetic
tcccgttcttgggaactacagggaaatgtgcatcgcatggtccagcagcagctgctttgatgggaaagaatggct

SEQ ID NO: 207871 - DNA, 75 bp, Artificial Sequence
  Synthetic
atgtgcatcgcatggtccagcagcagctgctttgatgggaaagaatggctacatgtttgtgtcacaggagatgac

SEQ ID NO: 207872 - DNA, 75 bp, Artificial Sequence
  Synthetic
caagtcgtggcggaacaacatattaaggacccaggagtcggaatgtcagtgtttgtacgggacctgtgttgtggc

SEQ ID NO: 207873 - DNA, 75 bp, Artificial Sequence
  Synthetic
cgtgaatgaagaagctctgaggcaaattctcagagaatcaggcggaattgacaaggaagcaatgggattcacata

SEQ ID NO: 207874 - DNA, 75 bp, Artificial Sequence
  Synthetic
tgaatgcccctaattatcactatgaggaatgctcctgttatcctgattctagtgaaatcacatgtgtgtgcaggg

SEQ ID NO: 207875 - DNA, 75 bp, Artificial Sequence
  Synthetic
taaaagaggggagaatcataaaatacgaaagggtaccagataacaagatacagcatttggaagaatgttcatgtt

SEQ ID NO: 207876 - DNA, 75 bp, Artificial Sequence
  Synthetic
aacaggccatgggttcgcatgaacaatgaaactatattggaaactggatatgtatgcagcaaattccattcggac

SEQ ID NO: 207877 - DNA, 75 bp, Artificial Sequence
  Synthetic
acgatcttatgaacagatggagactggtggagagcgccagaatgctactgagatcagggcatcggttggaagaat

SEQ ID NO: 207878 - DNA, 75 bp, Artificial Sequence
  Synthetic
ggttgatggaaggaggggagttaaaggattcggatttaaagtccaaaatgatgtatggctcgggagaacaatatc

SEQ ID NO: 207879 - DNA, 75 bp, Artificial Sequence
  Synthetic
ggattcggatttaaagtccaaaatgatgtatggctcgggagaacaatatcatatagtagccgatcaggatttgaa

SEQ ID NO: 207880 - DNA, 75 bp, Artificial Sequence
  Synthetic
attcttgaggacgacaccacgccccctcagattgcctgatgggcctctttgccaccagcggtcaaagttcctgct

SEQ ID NO: 207881 - DNA, 75 bp, Artificial Sequence
  Synthetic
ggatacaaagattggatcctatggatttcctttgccatatcatgttttttgctttgtgttgttttgttggggttc

SEQ ID NO: 207882 - DNA, 75 bp, Artificial Sequence
  Synthetic
gatggatgctctgaaactaagtattgaagacccgagtcacgagggggagggaataccactatatgatgcaatcaa

SEQ ID NO: 207883 - DNA, 75 bp, Artificial Sequence
  Synthetic
agttactcaaacacttgtttccaataatgattggtctgggtattcaggcagctttgtcattgagaacaatggttg

SEQ ID NO: 207884 - DNA, 75 bp, Artificial Sequence
  Synthetic
aatgattggtctgggtattcaggcagctttgtcattgagaacaatggttgttttcagccttgtttttatgttgaa

SEQ ID NO: 207885 - DNA, 75 bp, Artificial Sequence
  Synthetic
ggtcaaagtgctctaccttttcatcatagtgttgggcagatactcaaaagcagacaaaatatgcataggatacct

SEQ ID NO: 207886 - DNA, 75 bp, Artificial Sequence
  Synthetic
atagtgttgggcagatactcaaaagcagacaaaatatgcataggatacctgagcaataactcaacagataaagta

SEQ ID NO: 207887 - DNA, 75 bp, Artificial Sequence
  Synthetic
gaagtttgtttcatgtattcggatttccatttcatcgacgaacggggtgaatcaataattgtagaatctggtgac

SEQ ID NO: 207888 - DNA, 75 bp, Artificial Sequence
  Synthetic
cagacaaaatatgcataggatacctgagcaataactcaacagataaagtagatacactgactgaaaatggagttc

SEQ ID NO: 207889 - DNA, 75 bp, Artificial Sequence
  Synthetic
tgctcattgaatgggatcagcccggttcatcttggtgactgcagttttgagggatggattgtagggaacccctcc

SEQ ID NO: 207890 - DNA, 75 bp, Artificial Sequence
  Synthetic
ttcatcttggtgactgcagttttgagggatggattgtagggaacccctcctgtgctaccaatatcaacataagag

SEQ ID NO: 207891 - DNA, 75 bp, Artificial Sequence
  Synthetic
aacgactttttcaacagactgaattggctaaccaaatctgatgggaatgcatacccactccaaaacctgacaaag

SEQ ID NO: 207892 - DNA, 75 bp, Artificial Sequence
  Synthetic
ccaggagagttggacaacaatggtgagctgcggcatcttttcagtggagtaaactcttttagcaggacagaattg

SEQ ID NO: 207893 - DNA, 75 bp, Artificial Sequence
  Synthetic
aaactcttttagcaggacagaattgataagtcccagcaaatggggggatgtcctggatggagtcactgcttcatg

SEQ ID NO: 207894 - DNA, 75 bp, Artificial Sequence
  Synthetic
tcatttgagaaatgatactgatgtggtgaactttgtaagtatggagttctcactcactgacccgagactggagcc

SEQ ID NO: 207895 - DNA, 75 bp, Artificial Sequence
  Synthetic
aaaagaatgagagatatccagttgtaagaggggattataacaacacaacaggacgagatgttttggtgatttggg

SEQ ID NO: 207896 - DNA, 75 bp, Artificial Sequence
  Synthetic
ggtcacaatgtacaaaatagtactaatactcgcgctccttggagcggtgcatggtcttgacaaaatatgtcttgg

SEQ ID NO: 207897 - DNA, 75 bp, Artificial Sequence
  Synthetic
ggacgagatgttttggtgatttggggaatccaccacccagattcggaagctacagccacaaaactatatgtcaac

SEQ ID NO: 207898 - DNA, 75 bp, Artificial Sequence
  Synthetic
acatcatgcagtctccaacggcaccattgtaaagactctcacaaacgaaaaggaagaggtgaccaatgctactga

SEQ ID NO: 207899 - DNA, 75 bp, Artificial Sequence
  Synthetic
attgtaaagactctcacaaacgaaaaggaagaggtgaccaatgctactgaaacagtggagagcaaaagcctggac

SEQ ID NO: 207900 - DNA, 75 bp, Artificial Sequence
  Synthetic
gtccaatctacaggaggagagatgggaaatgggtgagagaactgatcctatatgacaaagaagagatcagaagaa

SEQ ID NO: 207901 - DNA, 75 bp, Artificial Sequence
  Synthetic
gctcgaaatcgggaccagaataggtgacggacaaaaaagttggatgaaaatatattggcacctcatgcgcccagg

SEQ ID NO: 207902 - DNA, 75 bp, Artificial Sequence
  Synthetic
ctgaatactgcggttcctataggatcctgcgttagtaagtgccacaccgacaggggctcaatcactaccactaaa

SEQ ID NO: 207903 - DNA, 75 bp, Artificial Sequence
  Synthetic
aatagggatgataatagggactcctgcttgtgatctacacctcaccggaacatgggacactttaatagagagaga

SEQ ID NO: 207904 - DNA, 75 bp, Artificial Sequence
  Synthetic
cgaaaggataacatttgagagcaatgggggccttctagcacccagatacggatatatcattgagaagtatggttc

SEQ ID NO: 207905 - DNA, 75 bp, Artificial Sequence
  Synthetic
caaacagggatctttgaaactggctacaggaatgaggaacatccctgagaaggcaaccagaggcctgtttggtgc

SEQ ID NO: 207906 - DNA, 75 bp, Artificial Sequence
  Synthetic
caattccattgcctactgttacccgggtgccactgtgaatgaagaagcattaaggcagaaaattatggaaagtgg

SEQ ID NO: 207907 - DNA, 75 bp, Artificial Sequence
  Synthetic
gccaaacttccgtaggtggaataaacaccaacaaaactttccagaacatagacaggaatgccctgggagaatgtc

SEQ ID NO: 207908 - DNA, 75 bp, Artificial Sequence
  Synthetic
caccaacaaaactttccagaacatagacaggaatgccctgggagaatgtccgaagtacataaagtctgggcaatt

SEQ ID NO: 207909 - DNA, 75 bp, Artificial Sequence
  Synthetic
atgggttcaggcatcagaatgcagaaggaacagggacggctgcagatctcaagtcgactcaggcagctattgatc

SEQ ID NO: 207910 - DNA, 75 bp, Artificial Sequence
  Synthetic
actaatcagaatgatcaaacgtgggatcaatgaccgaaacttctggagaggtgaaaatggacgaagaacaaggat

SEQ ID NO: 207911 - DNA, 75 bp, Artificial Sequence
  Synthetic
cagctggaaccactaaagcatgcatgagaaatggaggaaatagtttctatgcggagctaaagtggctagtgtcaa

SEQ ID NO: 207912 - DNA, 75 bp, Artificial Sequence
  Synthetic
agagcaaaggacaaaacttcccacaaacaacaaacacatacagaaatacagattcagcagaacaccttataatct

SEQ ID NO: 207913 - DNA, 75 bp, Artificial Sequence
  Synthetic
tgtttggtgcaattgcaggattcatagagggagggtggcctggtctgatcaatggatggtatggtttccagcatc

SEQ ID NO: 207914 - DNA, 75 bp, Artificial Sequence
  Synthetic
agagggagggtggcctggtctgatcaatggatggtatggtttccagcatcagaatgaacaagggactggcattgc

SEQ ID NO: 207915 - DNA, 75 bp, Artificial Sequence
  Synthetic
tgcttaatgcatcttggttcaactccttcctcacacatgcactgaagtagttgtggcaatgctactatttgctat

SEQ ID NO: 207916 - DNA, 75 bp, Artificial Sequence
  Synthetic
ccattgggacagtttgcatgatagttggaataatcagtctattgttacagataggaaacatagtctcgttatgga

SEQ ID NO: 207917 - DNA, 75 bp, Artificial Sequence
  Synthetic
acaagaaaagaatgatctgtatggaacacaatcactttccatttcagtagggagttctacttatcaaaacaactt

SEQ ID NO: 207918 - DNA, 75 bp, Artificial Sequence
  Synthetic
taaacaacataatagaaaagatgaacggaaattatgattcaataagaggagaattcaatcaagtagaaaagagaa

SEQ ID NO: 207919 - DNA, 75 bp, Artificial Sequence
  Synthetic
ggaaaatcacactgagatgtgcaaccaaagtgtcattacatatgtaaataacacatgggtgaaccgaacttatgt

SEQ ID NO: 207920 - DNA, 75 bp, Artificial Sequence
  Synthetic
ttgatttccattggacgatggtacaaccaggtgataacatcactttttcgcataatggtggattaatagcaccta

SEQ ID NO: 207921 - DNA, 75 bp, Artificial Sequence
  Synthetic
cggaaattatgattcaataagaggagaattcaatcaagtagaaaagagaatcaacatgctggctgatcgagttga

SEQ ID NO: 207922 - DNA, 75 bp, Artificial Sequence
  Synthetic
actatacaggatgtgacttcgattatactagccggcaattcatcactttgcccagtaagtgggtgggctgtatac

SEQ ID NO: 207923 - DNA, 75 bp, Artificial Sequence
  Synthetic
cctaagaggaatcgctccattctcaacaccagccaaagggggattcttgaggatgaacagatgtaccagaagtgc

SEQ ID NO: 207924 - DNA, 75 bp, Artificial Sequence
  Synthetic
ttgaaaatggtagaacattagacttgcatgatgcaaatgtcagaaacttacatgatcaggtcaaaagggtattga

SEQ ID NO: 207925 - DNA, 75 bp, Artificial Sequence
  Synthetic
atgttctcaaacaaaatggcaagactaggaaaagggtacatgttcgagagtaaaaggatgaagctccgaacacag

SEQ ID NO: 207926 - DNA, 75 bp, Artificial Sequence
  Synthetic
tcagtagacagtgactgtgagtcaaaatgtttctggaaaggtggatccatcaacaccaaacttccttttcagaat

SEQ ID NO: 207927 - DNA, 75 bp, Artificial Sequence
  Synthetic
aagagaaccattcatttcatgctctcaattggaatgcagaaccttttttctgacccaaggcgctttgctgaatga

SEQ ID NO: 207928 - DNA, 75 bp, Artificial Sequence
  Synthetic
caattggaatgcagaaccttttttctgacccaaggcgctttgctgaatgacaaacattctaatggaaccgtcaag

SEQ ID NO: 207929 - DNA, 75 bp, Artificial Sequence
  Synthetic
ttagaaatggcacatacaatcatgaagattacaaggaagaatcacaactgaacagacaggaaattgaggggataa

SEQ ID NO: 207930 - DNA, 75 bp, Artificial Sequence
  Synthetic
aatgtgccagaggttgtccaaggaagaggcctgtttggagcaatagctggattcatagaaaatggatgggaagga

SEQ ID NO: 207931 - DNA, 75 bp, Artificial Sequence
  Synthetic
catttgacactgtccaaataataaaaagagtcacagtagcagcagacccgccggagcagagtaggatgcagttct

SEQ ID NO: 207932 - DNA, 75 bp, Artificial Sequence
  Synthetic
aactgaagactgaagacaatgtttataaaatactatcgatttatagctgcattgcaagcagtactgtgctggtag

SEQ ID NO: 207933 - DNA, 75 bp, Artificial Sequence
  Synthetic
atctccatacaactcaaggttcgaatcagttgcttggtcagcaagtgcatgccatgatgggatgggatggctaac

SEQ ID NO: 207934 - DNA, 75 bp, Artificial Sequence
  Synthetic
tcagttgcttggtcagcaagtgcatgccatgatgggatgggatggctaacaatcgggatctctggtccagataat

SEQ ID NO: 207935 - DNA, 75 bp, Artificial Sequence
  Synthetic
attgcaagcagtactgtgctggtaggtctcatacttgcatttatattatgggcatgcagcagtggcaattgccgt

SEQ ID NO: 207936 - DNA, 75 bp, Artificial Sequence
  Synthetic
caggcagctatagatcaaataaccgggaaattgaataggctgatagagaagacaaacacagagttcgaatccata

SEQ ID NO: 207937 - DNA, 75 bp, Artificial Sequence
  Synthetic
gaggcctgtttggagcaatagctggattcatagaaaatggatgggaaggaatggtagatggttggtatggtttcc

SEQ ID NO: 207938 - DNA, 75 bp, Artificial Sequence
  Synthetic
ggaaattgaataggctgatagagaagacaaacacagagttcgaatccatagaatctgaattcagtgaaatagaac

SEQ ID NO: 207939 - DNA, 75 bp, Artificial Sequence
  Synthetic
aagttggagaaacaaaatattaagaacacaagagtcggaatgtgtttgtatgaacggttcttgttttactgtatt

SEQ ID NO: 207940 - DNA, 75 bp, Artificial Sequence
  Synthetic
acacaagagtcggaatgtgtttgtatgaacggttcttgttttactgtattaactgatggcccaagcaatgggcaa

SEQ ID NO: 207941 - DNA, 75 bp, Artificial Sequence
  Synthetic
tgaacggttcttgttttactgtattaactgatggcccaagcaatgggcaagcctcgtacaaaatatttaaagtgg

SEQ ID NO: 207942 - DNA, 75 bp, Artificial Sequence
  Synthetic
attcctttcgtcagtccgaaagaggcgaagaaacaattgaagaaaaatttgagatcacaggaactatgcgcaggc

SEQ ID NO: 207943 - DNA, 75 bp, Artificial Sequence
  Synthetic
tggacgtatcaagctgaattgctggtagcaatggaaaatcagcatacaattgacatggctgattcagaaatgctg

SEQ ID NO: 207944 - DNA, 75 bp, Artificial Sequence
  Synthetic
tagcaatggaaaatcagcatacaattgacatggctgattcagaaatgctgaatctatatgagagggtgaggaagc

SEQ ID NO: 207945 - DNA, 75 bp, Artificial Sequence
  Synthetic
tgagctggatgcccccaattaccactatgaggaatgctcatgttatcctgatacaggcaaagtaatgtgtgtttg

SEQ ID NO: 207946 - DNA, 75 bp, Artificial Sequence
  Synthetic
atggatgtcaatccgactctacttttcctaaaagttccagcgcaaaatgccataagcaccacattcccttatact

SEQ ID NO: 207947 - DNA, 75 bp, Artificial Sequence
  Synthetic
aaatgcagttggggtcctcatcggaggacttgaatggaatggtaacacggttcgagtctctgaaaatatacagag

SEQ ID NO: 207948 - DNA, 75 bp, Artificial Sequence
  Synthetic
cggccatgggtctctttcaatcagaatcttgactatcaaataggatacatatgcagtggagttttcggtgataac

SEQ ID NO: 207949 - DNA, 75 bp, Artificial Sequence
  Synthetic
cacaaatgcgatgacaactgtatggaaagcatcagaaacaacacttatgaccatacacaatacagagaagaagca

SEQ ID NO: 207950 - DNA, 75 bp, Artificial Sequence
  Synthetic
cggtggaactctcttctgggtacaaagatgttatactgtggtttagcttcggggcgtcatgctttgtacttttgg

SEQ ID NO: 207951 - DNA, 75 bp, Artificial Sequence
  Synthetic
ctgtcatcatggggcttgttttcttctgcttgaaaaatggaaacatgcgatgcacaatctgtatttagttaaaaa

SEQ ID NO: 207952 - DNA, 75 bp, Artificial Sequence
  Synthetic
cagaagtggatttgaaatgatttgggatccaaatgggtggactgaaactgatagtagtttctctatgaagcagga

SEQ ID NO: 207953 - DNA, 75 bp, Artificial Sequence
  Synthetic
agaacgccaaaatgctactgaaatcagagcatctgttgggagaatgattggaggaattggaagattctacataca

SEQ ID NO: 207954 - DNA, 75 bp, Artificial Sequence
  Synthetic
ggatacagtgggagttttgtccaacatcctgaattaacaggaatgaattgcataaggccttgtttctgggtggaa

SEQ ID NO: 207955 - DNA, 75 bp, Artificial Sequence
  Synthetic
acagtataacaatagagagaatggtcctctctgcatttgatgagaggagaaacaaatacccagaggaacatccca

SEQ ID NO: 207956 - DNA, 75 bp, Artificial Sequence
  Synthetic
tgtggcgtaaatggtgaaaccgcaagctggtcatggccagacggagctgatctgccattcaccattgacaagtag

SEQ ID NO: 207957 - DNA, 75 bp, Artificial Sequence
  Synthetic
tatgacaaagaggagatcagaaggatttggcgtcaggcgaacaatggagaagacgcaactgctggtctcacccat

SEQ ID NO: 207958 - DNA, 75 bp, Artificial Sequence
  Synthetic
agcaaaagcaggggaaaataaaagcaagcaaaatgaaggcaatactagtagtcctgctatatacatttacaaccg

SEQ ID NO: 207959 - DNA, 75 bp, Artificial Sequence
  Synthetic
aggaggaccaatctacaaaaagagagacggaaagtggatgagagagctgatcctgtatgacaaagatgaaatcag

SEQ ID NO: 207960 - DNA, 75 bp, Artificial Sequence
  Synthetic
ggaaagcaaccagaagactgatccaactgatagtgagtgggaaagatgagcaatcaatcgccgaggcgatcatag

SEQ ID NO: 207961 - DNA, 75 bp, Artificial Sequence
  Synthetic
ggaataccactatatgatgcaatcaaatgcatgaagacattttttggctggaaagagcctaacatagtcaaacca

SEQ ID NO: 207962 - DNA, 75 bp, Artificial Sequence
  Synthetic
agctgctggagcagcggtaaaaggagttggaacgatggtgatggaattgatccgaatgattaagcgagggatcaa

SEQ ID NO: 207963 - DNA, 75 bp, Artificial Sequence
  Synthetic
gagatattccccaagacaagttcatggcccaatcatgacacgaacaaaggtgtgacggcagcatgtcctcatgct

SEQ ID NO: 207964 - DNA, 75 bp, Artificial Sequence
  Synthetic
tggcacgatctgcactcattctgagaggatcagtggcccacaaatcatgcctacctgcttgtatatatggacttg

SEQ ID NO: 207965 - DNA, 75 bp, Artificial Sequence
  Synthetic
acttatttcgaaaaagtcgaaaggttaaaacatggtacctttggccctgtccacttcagaaatcaagttaaaata

SEQ ID NO: 207966 - DNA, 75 bp, Artificial Sequence
  Synthetic
ttctcgtgctatgggccattcaccatccatctaccagtgccgaccaacaaagtctctaccaaaatgcagatgcct

SEQ ID NO: 207967 - DNA, 75 bp, Artificial Sequence
  Synthetic
atagatcctttccgcctgcttcaaagcagtcaggtgttcagcctcattagaccaaatgagaatccagtacataag

SEQ ID NO: 207968 - DNA, 75 bp, Artificial Sequence
  Synthetic
atgaatccaaatcagaagataataacgattggttctgcttctctcactattgccacaatgtgcttcattatgcaa

SEQ ID NO: 207969 - DNA, 75 bp, Artificial Sequence
  Synthetic
tgccacaatgtgcttcattatgcaaattgccattcttgtaactactgtaacactgcatttcaagcaatatgaatg

SEQ ID NO: 207970 - DNA, 75 bp, Artificial Sequence
  Synthetic
gcagtcaggtgttcagcctcattagaccaaatgagaatccagtacataagagccagctgatatggatggcatgtc

SEQ ID NO: 207971 - DNA, 75 bp, Artificial Sequence
  Synthetic
gaaatgtcttaagcattgctcctataatgttctcaaacaagatggcgagattagggaaagggtacatgttcgaaa

SEQ ID NO: 207972 - DNA, 75 bp, Artificial Sequence
  Synthetic
ataacattcgaagcaactggaaatctagtggcaccgagatatgccttcgcattgaaaagaaattctggatctggt

SEQ ID NO: 207973 - DNA, 75 bp, Artificial Sequence
  Synthetic
aaagtggtcccaagaggacaattgtccaccagaggggttcaaattgcgtcaaatgaaaacatagaaacaatggag

SEQ ID NO: 207974 - DNA, 75 bp, Artificial Sequence
  Synthetic
aaagaaacataacagaggtggtgtatctgaccaataccaccatagagaaggaaatatgccccaagctagcagaat

SEQ ID NO: 207975 - DNA, 75 bp, Artificial Sequence
  Synthetic
tactcttgaactgaggagcaggtactgggctataaggaccaggagcggaggaaacactaaccagcaaagagcatc

SEQ ID NO: 207976 - DNA, 75 bp, Artificial Sequence
  Synthetic
acgattgtgatacgacttgtcagacacccaatggtgctataaacaccagcctcccatttcaaaatatacatccag

SEQ ID NO: 207977 - DNA, 75 bp, Artificial Sequence
  Synthetic
aaatgaaaacatagaaacaatggagtcaattactcttgaactgagaagcaaatactgggctataagaaccaggag

SEQ ID NO: 207978 - DNA, 75 bp, Artificial Sequence
  Synthetic
attatcatttcagatacatcagtccacgattgtgatacgacttgtcagacacccaatggtgctataaacaccagc

SEQ ID NO: 207979 - DNA, 75 bp, Artificial Sequence
  Synthetic
tgtaaaaagtactaaactgagaatggccacaggtttaaggaatatcccgtctattcaatctagaggcctgtttgg

SEQ ID NO: 207980 - DNA, 75 bp, Artificial Sequence
  Synthetic
cctaacaagtgctaccaatttgcccttggtcagggaacaacactaagcaacaggcattcaaatgacacagtacat

SEQ ID NO: 207981 - DNA, 75 bp, Artificial Sequence
  Synthetic
atggaagcaaaactatttgtattattctgtgcattcactgcactgaaagctgacaccatttgtgtaggctaccat

SEQ ID NO: 207982 - DNA, 75 bp, Artificial Sequence
  Synthetic
agcgaaagcaggtactgatccaaaatggaagactttgtgcgacaatgcttcaatccaatgatcgtcgagcttgcg

SEQ ID NO: 207983 - DNA, 75 bp, Artificial Sequence
  Synthetic
acgggatcactaacaaggtaaactctgttattgaaaagatgaacacacaattcacggcagtaggtaaagagttca

SEQ ID NO: 207984 - DNA, 75 bp, Artificial Sequence
  Synthetic
acacaatactggagaaaaatgtgactgttacccattcagttaatttactggaaaacagccataatgggaaactct

SEQ ID NO: 207985 - DNA, 75 bp, Artificial Sequence
  Synthetic
ttgtataactggacatgatgaaaatgcaactgctagtttcatttacgatggaaggcttgttgatagtattggttc

SEQ ID NO: 207986 - DNA, 75 bp, Artificial Sequence
  Synthetic
gtggtcttacataatagagacttcaaattcaaaaaatggagcatgctatcccggagaattcgctgattatgaaga

SEQ ID NO: 207987 - DNA, 75 bp, Artificial Sequence
  Synthetic
aagtaagaagccaactaaaaaacaatgccaaggaaattggaaatggctgctttgaattttaccacaaatgtgatg

SEQ ID NO: 207988 - DNA, 75 bp, Artificial Sequence
  Synthetic
ccggagaattcgctgattatgaagagttaaaggagcagttgagtacagtttcttcatttgaaagatttgaaattt

SEQ ID NO: 207989 - DNA, 75 bp, Artificial Sequence
  Synthetic
tttgaattttaccacaaatgtgatgacatgtgcatggaaagcgtcaaaaatggaacttatgattaccctaaatac

SEQ ID NO: 207990 - DNA, 75 bp, Artificial Sequence
  Synthetic
aattcaaaaaatggagcatgctatcccggagaattcgctgattatgaagagttaaaggagcagttgagtacagtt

SEQ ID NO: 207991 - DNA, 75 bp, Artificial Sequence
  Synthetic
acatgtgcatggaaagcgtcaaaaatggaacttatgattaccctaaatactcagaggaagcaaaactaaacagag

SEQ ID NO: 207992 - DNA, 75 bp, Artificial Sequence
  Synthetic
tgataaataatgatcttgggccagcaacagcacaaatggctcttcagctattcatcaaggactacaggtacacat

SEQ ID NO: 207993 - DNA, 75 bp, Artificial Sequence
  Synthetic
gttgcatgctcccactctggagccaacagtttttatcggaatttactatggatagtaaagaaaggaaactcctat

SEQ ID NO: 207994 - DNA, 75 bp, Artificial Sequence
  Synthetic
acacacatccacattttctcattcactggagaagagatggccaccaaagcagattacactcttgacgaagagagc

SEQ ID NO: 207995 - DNA, 75 bp, Artificial Sequence
  Synthetic
tgatgaatgaattgggtgttccatttcatttagggaccaggcaagtgtgcatggcatggtccagctcaagttgtc

SEQ ID NO: 207996 - DNA, 75 bp, Artificial Sequence
  Synthetic
tcctgcccttaggatgaagtggatgatggcaatgaaatatccaattacagcagacaaaaggataatggagatgat

SEQ ID NO: 207997 - DNA, 75 bp, Artificial Sequence
  Synthetic
ggcaatcagtttctggatgtgctctaatgggtcgctacagtgcagaatatgtatttaacattaggatttcagaaa

SEQ ID NO: 207998 - DNA, 75 bp, Artificial Sequence
  Synthetic
cccagaaaaaatgacaggtccagtagtagcaattgtctgaatcctaacaatgaggaagggagccatggagtgaaa

SEQ ID NO: 207999 - DNA, 75 bp, Artificial Sequence
  Synthetic
accgacagtgaccaacaaaccctctaccagaataatcatacatatgtttcagttggatcatcaaaatactacaaa

SEQ ID NO: 208000 - DNA, 75 bp, Artificial Sequence
  Synthetic
atggcaatgaaatatccaattacagcagacaaaaggataatggagatgatcccggaaagaaatgagcaaggtcag

SEQ ID NO: 208001 - DNA, 75 bp, Artificial Sequence
  Synthetic
aatttggggagtgcaccaccctccaaccgacagtgaccaacaaaccctctaccagaataatcatacatatgtttc

SEQ ID NO: 208002 - DNA, 75 bp, Artificial Sequence
  Synthetic
acagtttttatcggaatttactatggatagtaaagaaaggaaactcctatcctaagctcagcaattcatacacaa

SEQ ID NO: 208003 - DNA, 75 bp, Artificial Sequence
  Synthetic
gtagcaattgtctgaatcctaacaatgaggaagggagccatggagtgaaaggatgggcctttgatgacggaaatg

SEQ ID NO: 208004 - DNA, 75 bp, Artificial Sequence
  Synthetic
accatggcacgcatttgcattgaaaaaaggctctagttctggaattatgatgtcggatgctcaggttcacaattg

SEQ ID NO: 208005 - DNA, 75 bp, Artificial Sequence
  Synthetic
gccaccctgagacatgcaatcaaagtgtcattacctacgaaaacaatacttgggtgaatcaaacataccttaaca

SEQ ID NO: 208006 - DNA, 75 bp, Artificial Sequence
  Synthetic
ccccgatcgaacacattgcaagcatgaggaggaattactttacagctgaagtgtctcactgcagggcaacagaat

SEQ ID NO: 208007 - DNA, 75 bp, Artificial Sequence
  Synthetic
ttcagaatgtacatcccgtcactattggagaatgccccaaatatgttaaaagcacccaactgagaatggcaacag

SEQ ID NO: 208008 - DNA, 75 bp, Artificial Sequence
  Synthetic
tgggcactcggtgaaaacatggcaccagagaaggtagactttgaagattgcaaagatgtcaacgacctgaaacag

SEQ ID NO: 208009 - DNA, 75 bp, Artificial Sequence
  Synthetic
gccggattcattgaaggaggatggacaggaatggtagatggatggtatggataccaccatcaaaatgagcaggga

SEQ ID NO: 208010 - DNA, 75 bp, Artificial Sequence
  Synthetic
caaggggccttgttgaatgacaagcattccaatggaaccgttaaagacagaagcccttatagaaccctaatgagc

SEQ ID NO: 208011 - DNA, 75 bp, Artificial Sequence
  Synthetic
aagcatcaatgaactgagcaatcttgcaaaaggagagaaggctaatgtgctaattgggcaaggagacgtggtgtt

SEQ ID NO: 208012 - DNA, 75 bp, Artificial Sequence
  Synthetic
attgcaatgaaacagtcattagggaatacaatgaaacagtaagggttgagaaggtaacacaatggcacaatacca

SEQ ID NO: 208013 - DNA, 75 bp, Artificial Sequence
  Synthetic
agagaaaaggatggaaaatttgaataagaaggttgatgatgggtttttagatgtatggacatataatgctgagtt

SEQ ID NO: 208014 - DNA, 75 bp, Artificial Sequence
  Synthetic
tgcctggtcagcaagtgcctgccacgatggcattagctggttgacaattggtatttccggcccagacaatggggc

SEQ ID NO: 208015 - DNA, 75 bp, Artificial Sequence
  Synthetic
gatggcattagctggttgacaattggtatttccggcccagacaatggggcagtggctgtattgaagtacaatggc

SEQ ID NO: 208016 - DNA, 75 bp, Artificial Sequence
  Synthetic
gcaaattaaagagaagagcaattgcaacacccggaatgcaaatcagaggatttgtatactttgttgaaacattag

SEQ ID NO: 208017 - DNA, 75 bp, Artificial Sequence
  Synthetic
taaaaaatttatatgaaaaggtcaaatcacaactaaggaacaatgccaaggaaatcggaaatggctgctttgagt

SEQ ID NO: 208018 - DNA, 75 bp, Artificial Sequence
  Synthetic
atcacaactaaggaacaatgccaaggaaatcggaaatggctgctttgagttctatcacaaatgtgataatgagtg

SEQ ID NO: 208019 - DNA, 75 bp, Artificial Sequence
  Synthetic
agaatctgaatgtgcctgcattaatggttcttgctttaccataatgactgatggaccaagtaatggtcaggcttc

SEQ ID NO: 208020 - DNA, 75 bp, Artificial Sequence
  Synthetic
ggttcttgctttaccataatgactgatggaccaagtaatggtcaggcttcatacaagattttcaagatagaaaag

SEQ ID NO: 208021 - DNA, 75 bp, Artificial Sequence
  Synthetic
agaagagtttgctgagatcatgaagatctgttccaccattgaagagctcagacggcaaaaatagtgaatttagct

SEQ ID NO: 208022 - DNA, 75 bp, Artificial Sequence
  Synthetic
aatccaagttgaatagggaggaaatagatggtgtgaaactagaatcaatgggaattcaccagattttggcgatct

SEQ ID NO: 208023 - DNA, 75 bp, Artificial Sequence
  Synthetic
agagtgttcctgttatcctgatgctagtgaggtgatgtgtgtatgcagggacaattggcatggttcaaatcggcc

SEQ ID NO: 208024 - DNA, 75 bp, Artificial Sequence
  Synthetic
agtgaggtgatgtgtgtatgcagggacaattggcatggttcaaatcggccatgggtgtccttcaaccagaatcta

SEQ ID NO: 208025 - DNA, 75 bp, Artificial Sequence
  Synthetic
tcccaatgacggaacaggcagttgtggtccagtatcttctaatggggcatatggggtaaaagggttttcgtttag

SEQ ID NO: 208026 - DNA, 75 bp, Artificial Sequence
  Synthetic
ggtccagtatcttctaatggggcatatggggtaaaagggttttcgtttagatacggtaacggtgtttggatagga

SEQ ID NO: 208027 - DNA, 75 bp, Artificial Sequence
  Synthetic
aaaggtgtgcagaaccttactagcaaaatctgtattcaacagcctatatgcatctccacaactcgaggggttctc

SEQ ID NO: 208028 - DNA, 75 bp, Artificial Sequence
  Synthetic
caatggatggacagagacggataacagtttctctgtgaagcaagacattgtcgcaataactgattggtcaggata

SEQ ID NO: 208029 - DNA, 75 bp, Artificial Sequence
  Synthetic
cagcggaagttttgttcagcacccggaactgacagggctggattgcatgcgaccttgcttttgggttgagctgat

SEQ ID NO: 208030 - DNA, 75 bp, Artificial Sequence
  Synthetic
gctctgtttctctaatcattgcgataatatgtctcctcatgcagattgccatcttaacaacgactatgacactac

SEQ ID NO: 208031 - DNA, 75 bp, Artificial Sequence
  Synthetic
tcccactgcagggctactgaatacataatgaagggagtgtacataaatacagctttgctcaatgcatcttgtgca

SEQ ID NO: 208032 - DNA, 75 bp, Artificial Sequence
  Synthetic
tccatggggccaaagaggtgtcactaagctactcaactggtgcacttgccagttgcatgggcctcatatacaaca

SEQ ID NO: 208033 - DNA, 75 bp, Artificial Sequence
  Synthetic
agttgcatgggcctcatatacaacagaatgggaacagtgaccacagaagctgcttttggcctagtgtgtgccact

SEQ ID NO: 208034 - DNA, 75 bp, Artificial Sequence
  Synthetic
cgaatcaataattgtggaatctggtgatccaaatgcattactgaagcatcgatttgagataattgaaggaagaga

SEQ ID NO: 208035 - DNA, 75 bp, Artificial Sequence
  Synthetic
agatggaggaccaaatctatacaatatccggaatctccacatcccggaagtttgcttgaagtgggagctaatgga

SEQ ID NO: 208036 - DNA, 75 bp, Artificial Sequence
  Synthetic
caagagaataatactcaaggcaaacttctctgtcctatttgatcaactggaaacattagtactactgagggcttt

SEQ ID NO: 208037 - DNA, 75 bp, Artificial Sequence
  Synthetic
ctgcaatctattcgagaaattcttccctagcagttcatacaggagaccggttggaatttccagcatggtggaggc

SEQ ID NO: 208038 - DNA, 75 bp, Artificial Sequence
  Synthetic
tcttgaaagtgccagctcaaaatgctataagcactacattcccttacactggagatcctccatacagccatggaa

SEQ ID NO: 208039 - DNA, 75 bp, Artificial Sequence
  Synthetic
cctcacagaactcttttaatgaatgagttaggtgtcccatttcatttgggaaccaaacaagtgtgcatagcatgg

SEQ ID NO: 208040 - DNA, 75 bp, Artificial Sequence
  Synthetic
cctcagaactcaggagtcagaatgcgtttgcatcaatggaacttgtgcagtggtaatgactgatggaagtgcatc

SEQ ID NO: 208041 - DNA, 75 bp, Artificial Sequence
  Synthetic
gacaatgagccaagcgggtatgctcaaacagactgcgtcctggaggcaatggctttccttgaggaatcccaccca

SEQ ID NO: 208042 - DNA, 75 bp, Artificial Sequence
  Synthetic
acctagaagagcatcccagtgctgggaaggaccctaagaaaacaggaggacccatatatagaagaatagacggaa

SEQ ID NO: 208043 - DNA, 75 bp, Artificial Sequence
  Synthetic
aagagtggacaagctgacccaaggccgtcagacctatgactggacattaaatagaaaccaaccggctgcaactgc

SEQ ID NO: 208044 - DNA, 75 bp, Artificial Sequence
  Synthetic
gacgggaatgatgtttggatgggacggacaatcaaaaatggttcacgctcaggttatgagacttttagggtcgtc

SEQ ID NO: 208045 - DNA, 75 bp, Artificial Sequence
  Synthetic
tcacgcagacctcagtgccaaagaggcacaggatgtgatcatggaggtggttttcccaaatgaagtgggagcgag

SEQ ID NO: 208046 - DNA, 75 bp, Artificial Sequence
  Synthetic
ttcccttatactggagatcctccatacagccatggaacagggacagggtacaccatggacacagtcaacagaaca

SEQ ID NO: 208047 - DNA, 75 bp, Artificial Sequence
  Synthetic
agtggtcagcctgatgagaccaaatgaaaacccagctcacaagagtcaattagtgtggatggcatgccactctgc

SEQ ID NO: 208048 - DNA, 75 bp, Artificial Sequence
  Synthetic
ataatggagaagatgcaactgctggtctcactcatctgatgatctggcactccaacctgaatgatgccacatacc

SEQ ID NO: 208049 - DNA, 75 bp, Artificial Sequence
  Synthetic
gagaaatacgttgaagacactaaaatagatctctggtcttacaacgctgagcttcttgttgccctggaaaaccaa

SEQ ID NO: 208050 - DNA, 75 bp, Artificial Sequence
  Synthetic
cttctgtcaaagaaaaagacatgactaaagaattttttgagaacaagtcggaaacgtggccaattggagaatccc

SEQ ID NO: 208051 - DNA, 75 bp, Artificial Sequence
  Synthetic
acaatgacaaaggatgcagaaagaggcaaattgaaaaggcgtgcaattgcaacaccagggatgcagatcagagga

SEQ ID NO: 208052 - DNA, 75 bp, Artificial Sequence
  Synthetic
tgggcacttggtgagaatatggcaccagagaaagtagattttgatgactgcaaagatgttggtgatctcaaacag

SEQ ID NO: 208053 - DNA, 75 bp, Artificial Sequence
  Synthetic
agtaaaaggggtcggaacaatggtaatggaattgattcggatgataaagcgagggattaatgatcggaatttctg

SEQ ID NO: 208054 - DNA, 75 bp, Artificial Sequence
  Synthetic
gcaatctgggctcccggttggaggaaatgaaaagaaagccaaattggcaaatgttgtgaggaaaatgatgaccaa

SEQ ID NO: 208055 - DNA, 75 bp, Artificial Sequence
  Synthetic
ggatacaaagattggatcctatggatttcctttaccatatcatgctttttgctttgtgttgttctgctggggttc

SEQ ID NO: 208056 - DNA, 75 bp, Artificial Sequence
  Synthetic
ggatacaaagattggatcctatggatttcctttaccatttcatgctttttgctttgtgttgttctgctggggttc

SEQ ID NO: 208057 - DNA, 75 bp, Artificial Sequence
  Synthetic
ggatacaaagattggatcctatggatttcctttaccatctcatgctttttgctttgtgttgttctgctggggttc

SEQ ID NO: 208058 - DNA, 75 bp, Artificial Sequence
  Synthetic
ggatacaaagattggatcctatggatttcctttaccatgtcatgctttttgctttgtgttgttctgctggggttc

SEQ ID NO: 208059 - DNA, 75 bp, Artificial Sequence
  Synthetic
ggatacaaagattggatcctatggatttccttttccatatcatgctttttgctttgtgttgttctgctggggttc

SEQ ID NO: 208060 - DNA, 75 bp, Artificial Sequence
  Synthetic
ggatacaaagattggatcctatggatttccttttccatttcatgctttttgctttgtgttgttctgctggggttc

SEQ ID NO: 208061 - DNA, 75 bp, Artificial Sequence
  Synthetic
ggatacaaagattggatcctatggatttccttttccatctcatgctttttgctttgtgttgttctgctggggttc

SEQ ID NO: 208062 - DNA, 75 bp, Artificial Sequence
  Synthetic
ggatacaaagattggatcctatggatttccttttccatgtcatgctttttgctttgtgttgttctgctggggttc

SEQ ID NO: 208063 - DNA, 75 bp, Artificial Sequence
  Synthetic
ggatacaaagattggatcctatggatttcctttcccatatcatgctttttgctttgtgttgttctgctggggttc

SEQ ID NO: 208064 - DNA, 75 bp, Artificial Sequence
  Synthetic
ggatacaaagattggatcctatggatttcctttcccatttcatgctttttgctttgtgttgttctgctggggttc

SEQ ID NO: 208065 - DNA, 75 bp, Artificial Sequence
  Synthetic
ggatacaaagattggatcctatggatttcctttcccatctcatgctttttgctttgtgttgttctgctggggttc

SEQ ID NO: 208066 - DNA, 75 bp, Artificial Sequence
  Synthetic
ggatacaaagattggatcctatggatttcctttcccatgtcatgctttttgctttgtgttgttctgctggggttc

SEQ ID NO: 208067 - DNA, 75 bp, Artificial Sequence
  Synthetic
ggatacaaagattggatcctatggatttcctttgccatatcatgctttttgctttgtgttgttctgctggggttc

SEQ ID NO: 208068 - DNA, 75 bp, Artificial Sequence
  Synthetic
ggatacaaagattggatcctatggatttcctttgccatttcatgctttttgctttgtgttgttctgctggggttc

SEQ ID NO: 208069 - DNA, 75 bp, Artificial Sequence
  Synthetic
ggatacaaagattggatcctatggatttcctttgccatctcatgctttttgctttgtgttgttctgctggggttc

SEQ ID NO: 208070 - DNA, 75 bp, Artificial Sequence
  Synthetic
ggatacaaagattggatcctatggatttcctttgccatgtcatgctttttgctttgtgttgttctgctggggttc

SEQ ID NO: 208071 - DNA, 75 bp, Artificial Sequence
  Synthetic
gaaatgttttaagcattgcccctataatgttctcaaacaaagtggcaagactaggaaaaggatacatgttcgaaa

SEQ ID NO: 208072 - DNA, 75 bp, Artificial Sequence
  Synthetic
acttgctgtggccagtggatatgactttgagagagaagggtactctctggtcggaatagaccctttccgtctgct

SEQ ID NO: 208073 - DNA, 75 bp, Artificial Sequence
  Synthetic
gtaagagcatgaaactacggacacaaataccagcagacatgcttgcagatattgacttgaaatacttcaatgaat

SEQ ID NO: 208074 - DNA, 75 bp, Artificial Sequence
  Synthetic
gctaggtcttatcaaagaatccagattttcccagacacaatctggaatgtgtcttacaatgggacaagcaaagca

SEQ ID NO: 208075 - DNA, 75 bp, Artificial Sequence
  Synthetic
gagaatgaactattactggacactagtagagcctggagacaagataacattcgaagcaactggaaatctagtggt

SEQ ID NO: 208076 - DNA, 75 bp, Artificial Sequence
  Synthetic
ttttcccagacacaatctggaatgtgtcttacaatgggacaagcaaagcatgctcaggttcattctacagaagca

SEQ ID NO: 208077 - DNA, 75 bp, Artificial Sequence
  Synthetic
gcctcattaagtcctggaatgatgatgggcatgtttaacatgcttagcactgtcctaggagtttcaatcctgaat

SEQ ID NO: 208078 - DNA, 75 bp, Artificial Sequence
  Synthetic
tgcatgatcaaggcagttcgaggtgatttgaactttgtcaacagagcaaaccagcggctaaacccaatgcaccaa

SEQ ID NO: 208079 - DNA, 75 bp, Artificial Sequence
  Synthetic
atcagacctaacgagaatccagcacacaagagtcaactggtgtggatggcatgccattctgctgcatttgaagat

SEQ ID NO: 208080 - DNA, 75 bp, Artificial Sequence
  Synthetic
ccagcggctaaacccaatgcaccaactcttgagacacttccaaaaggatgcaaaagtgcttttccaaaactgggg

SEQ ID NO: 208081 - DNA, 75 bp, Artificial Sequence
  Synthetic
gtgaatgcacctgaccatgagggaatacaagcgggagtgaacaggttctataggacctgcaaactggttgggatc

SEQ ID NO: 208082 - DNA, 75 bp, Artificial Sequence
  Synthetic
tgggcatgtttaacatgcttagcactgtcctaggagtttcaatcctgaatcttgggcaaaagagatacactaaaa

SEQ ID NO: 208083 - DNA, 75 bp, Artificial Sequence
  Synthetic
caacgagtgtggcaacagaagaaataaataggatcttcaaaccattgataggaccaaggcctcttgtcaacggtt

SEQ ID NO: 208084 - DNA, 75 bp, Artificial Sequence
  Synthetic
aatatgagcaaaaagaaatcttacataaataggacaggaacatttgaattcacaagctttttctaccgctacggg

SEQ ID NO: 208085 - DNA, 75 bp, Artificial Sequence
  Synthetic
gagggggataagagtcagtaagatgggagtagatgaatactccagcactgagagagtggtagtgagcattgaccg

SEQ ID NO: 208086 - DNA, 75 bp, Artificial Sequence
  Synthetic
taaataggacaggaacatttgaattcacaagctttttctaccgctacgggtttgtagccaattttagtatggagc

SEQ ID NO: 208087 - DNA, 75 bp, Artificial Sequence
  Synthetic
ctgcgaataaaatctgatgggaatctaatagctccatggtatggacacattctttcaggagagagccacggaaga

SEQ ID NO: 208088 - DNA, 75 bp, Artificial Sequence
  Synthetic
cgttgaggacactaaaatagatctctggtcatacaacgcggagcttcttgttgccctggagaaccaacatacaat

SEQ ID NO: 208089 - DNA, 75 bp, Artificial Sequence
  Synthetic
atgctagcaagcattgacctgaagtatttcaatgaatcaacaaggaagaaaattgagaaaataaggcctcttcta

SEQ ID NO: 208090 - DNA, 75 bp, Artificial Sequence
  Synthetic
tcaatgatgtgggagatcaacggtcctgaatctgttttggtcaatacttatcagtggatcatcaggaattgggag

SEQ ID NO: 208091 - DNA, 75 bp, Artificial Sequence
  Synthetic
aatccaaacgaaaagatcatttgagctaaaaaggctatgggatcagacccattcaaaaacaggactactgatttc

SEQ ID NO: 208092 - DNA, 75 bp, Artificial Sequence
  Synthetic
gggtgacaagagaaccttatgtgtcatgcgatcctgacaagtgttatcaatttgcccttggacagggaacaacac

SEQ ID NO: 208093 - DNA, 75 bp, Artificial Sequence
  Synthetic
acaagagctcttgttcgcacgggaatggatcccagaatgtgctctctaatgcaaggttcaacacttcccagaagg

SEQ ID NO: 208094 - DNA, 75 bp, Artificial Sequence
  Synthetic
ccagcagatgcgggatgtgcttggaactttcgacactgttcagataataaaacttctcccctttgctgctgctcc

SEQ ID NO: 208095 - DNA, 75 bp, Artificial Sequence
  Synthetic
aatcctctgaatccatttgttaaccacaagggaattgagtccgtaaacagtgccgtggtaatgccagcccatggt

SEQ ID NO: 208096 - DNA, 75 bp, Artificial Sequence
  Synthetic
aacttctcccctttgctgctgctccaccagaacaaagtaggatgcagttctcctccttgactgtgaatgtgcggg

SEQ ID NO: 208097 - DNA, 75 bp, Artificial Sequence
  Synthetic
agagactcaacccaaaaggcaattgataaaataacatccaaagtgaataatatagtcgacaaaatgaacaagcag

SEQ ID NO: 208098 - DNA, 75 bp, Artificial Sequence
  Synthetic
ggaatggatcccagaatgtgctctctaatgcaaggttcaacacttcccagaaggtctggtgccgcaggtgctgcg

SEQ ID NO: 208099 - DNA, 75 bp, Artificial Sequence
  Synthetic
aataaggccactaagaggcttacagttctcggaaaggatgcaggtgcattgaccgaagaccccgatgaaggcaca

SEQ ID NO: 208100 - DNA, 75 bp, Artificial Sequence
  Synthetic
gacatgagcattggagtaacagtgataaagaataacatgataaacaatgaccttggaccagcaacagcccaaatg

SEQ ID NO: 208101 - DNA, 75 bp, Artificial Sequence
  Synthetic
cctcatcggaggacttgaatggaatgataacacagttcgggtctctgaaactctacagagattcgcttggagaag

SEQ ID NO: 208102 - DNA, 75 bp, Artificial Sequence
  Synthetic
ctgcaatctattcgaaaaattcttccctagcagttcatacaggaggccagttggaatttccagcatggtggaggc

SEQ ID NO: 208103 - DNA, 75 bp, Artificial Sequence
  Synthetic
ttggaatttccagcatggtggaggccatggtatctagggccagaattgatgcacggattgatttcgagtctggaa

SEQ ID NO: 208104 - DNA, 75 bp, Artificial Sequence
  Synthetic
ccttcttttccaggacatactgatgaggatgtcaaaaatgcaattggggtcctcatcggaggacttgaatggaat

SEQ ID NO: 208105 - DNA, 75 bp, Artificial Sequence
  Synthetic
ttctcggaaaggatgcaggtgcattgaccgaagaccccgatgaaggcacagctggagtagagtctgccgttttaa

SEQ ID NO: 208106 - DNA, 75 bp, Artificial Sequence
  Synthetic
atggaaagaataaaagaattaagagatctaatgtcacagtcccacactcgcgagatactgacaaaaaccacagtg

SEQ ID NO: 208107 - DNA, 75 bp, Artificial Sequence
  Synthetic
aattcaaaaaatggagcatgctaccccggagaattcgctgaatatgaagaattaagggagcagctgagtacagtt

SEQ ID NO: 208108 - DNA, 75 bp, Artificial Sequence
  Synthetic
gataccagcagaaatgctagcaagcattgacctgaagtatttcaatgaatcaacaaggaagaaaattgagaaaat

SEQ ID NO: 208109 - DNA, 75 bp, Artificial Sequence
  Synthetic
ccatgatacaactaaaggtaccacagttgcatgctcccactctggagccaaaagtttttataggaacttaatatg

SEQ ID NO: 208110 - DNA, 75 bp, Artificial Sequence
  Synthetic
cgatccaaatgcactcctaaaacaccggtttgaaataattgaagggagagatcgcactatggcctggacagtagt

SEQ ID NO: 208111 - DNA, 75 bp, Artificial Sequence
  Synthetic
acactttggagtaagacaaatgatgctggatcagatagggtgatggtatcacccctagcagtaacttggtggaat

SEQ ID NO: 208112 - DNA, 75 bp, Artificial Sequence
  Synthetic
atgagtgacatcgaagccatggcgtctcaaggcaccaaacgatcatatgaacaaatggagactggtggggagcgc

SEQ ID NO: 208113 - DNA, 75 bp, Artificial Sequence
  Synthetic
aggaaaggaccgacaacagataccgtccactatccgaaagtctacaaaacatattttgaaaaagttgaaaggtta

SEQ ID NO: 208114 - DNA, 75 bp, Artificial Sequence
  Synthetic
acaataaggggaagaaggtgcttgtaatttggggagtgcaccaccctccaaactacagtaaccaacaagccctct

SEQ ID NO: 208115 - DNA, 75 bp, Artificial Sequence
  Synthetic
actttcaaaatcaagttaaaatacgtcgaagagttgacataaacccaggccatgcagacctcagtgccaaggaag

SEQ ID NO: 208116 - DNA, 75 bp, Artificial Sequence
  Synthetic
tttcccaaatgaagtgggagccagaatattaacatcagagtcgcaattaacaataacaagagagaagaaagagga

SEQ ID NO: 208117 - DNA, 75 bp, Artificial Sequence
  Synthetic
accatggcaagcatttgcattgaaaaaaggcgatagttctggaatcatggtatcggatgctcaggtccacaattg

SEQ ID NO: 208118 - DNA, 75 bp, Artificial Sequence
  Synthetic
aatcaggcatgagaacagaatggtgctggccagcactacagctaaggccatggagcagatggcaggatcaagtga

SEQ ID NO: 208119 - DNA, 75 bp, Artificial Sequence
  Synthetic
ttaatggtggcatacatgttggaaagagaactggttcgcaaaaccagattcctgccggtagcaggtgggacaagc

SEQ ID NO: 208120 - DNA, 75 bp, Artificial Sequence
  Synthetic
agcgtgtacattgaagtattgcacttgactcaaggaacttgctgggagcagatgtacactccaggtggggaggtg

SEQ ID NO: 208121 - DNA, 75 bp, Artificial Sequence
  Synthetic
tgatcatcgctgccagaaacattgttaggagagcaacagtatcggcagatccactggcatcactactggaaatgt

SEQ ID NO: 208122 - DNA, 75 bp, Artificial Sequence
  Synthetic
atatatgcaaagcagcaatgggtttgagaatcagctcctcttttagctttggaggtttcactttcaaaagaacaa

SEQ ID NO: 208123 - DNA, 75 bp, Artificial Sequence
  Synthetic
agaagtgcttacaggcaacctccaaacactaaaattaagagtacatgaggggtatgaggagttcacaatggttgg

SEQ ID NO: 208124 - DNA, 75 bp, Artificial Sequence
  Synthetic
gagagttggttcgtaagacgaggtttctcccggtggctggtggaacaagcagtgtttatattgaagtgctgcact

SEQ ID NO: 208125 - DNA, 75 bp, Artificial Sequence
  Synthetic
tgatagtaagtggaagagacgaacaatcaattgctgaagcgatcatagtagcaatggtattctcacaagaggatt

SEQ ID NO: 208126 - DNA, 75 bp, Artificial Sequence
  Synthetic
atgcagagagaggcaaattaaaaagaagggctattgcaacacctgggatgcaaattagagggttcgtgtacttcg

SEQ ID NO: 208127 - DNA, 75 bp, Artificial Sequence
  Synthetic
acgaaaaacaagatttctcccagttgctggcggaacaagcagtatatacattgaagttttacatttgactcaggg

SEQ ID NO: 208128 - DNA, 75 bp, Artificial Sequence
  Synthetic
caacggctgaatcccatgcatcaacttctgaggcacttccagaaggatgcaaaggtactgattcaaaattgggga

SEQ ID NO: 208129 - DNA, 75 bp, Artificial Sequence
  Synthetic
gatctcatttgaggaatgatactgatgtagtgaattttgtgagcatggagttttcccttactgatcctagactag

SEQ ID NO: 208130 - DNA, 75 bp, Artificial Sequence
  Synthetic
actccacagtcgccagttccctggtcttgttagtctccctgggggcaatcagcttctggatgtgttctaatgggt

SEQ ID NO: 208131 - DNA, 75 bp, Artificial Sequence
  Synthetic
ttctgaggcacttccagaaggatgcaaaggtactgattcaaaattggggaattgaacctattgacaatgtcatgg

SEQ ID NO: 208132 - DNA, 75 bp, Artificial Sequence
  Synthetic
aagaacaagctgtggatatatgcaaggctgcaatgggattgagaatcagctcatccttcagctttggtggcttta

SEQ ID NO: 208133 - DNA, 75 bp, Artificial Sequence
  Synthetic
gaaatgtactcctgtctcctgaggaggttagcgaaacacaaggaacggagaaattgacaataacctattcatcat

SEQ ID NO: 208134 - DNA, 75 bp, Artificial Sequence
  Synthetic
ttggaaaggtatgcaggactctgctagcaaaatctgtattcaacagcttgtatgcatctccacaacttgagggat

SEQ ID NO: 208135 - DNA, 75 bp, Artificial Sequence
  Synthetic
caatggatcattagaaattgggaaactgtgaagatccaatggtctcaagaccccacaatgctatacaacaaaatg

SEQ ID NO: 208136 - DNA, 75 bp, Artificial Sequence
  Synthetic
ctgtgaagatccaatggtctcaagaccccacaatgctatacaacaaaatggaatttgagccttttcaatctctag

SEQ ID NO: 208137 - DNA, 75 bp, Artificial Sequence
  Synthetic
ataataacaatcggctctgtctctctgaccatcgcaacagtatgtttcctcatgcagattgccatcttagcaacg

SEQ ID NO: 208138 - DNA, 75 bp, Artificial Sequence
  Synthetic
cagcagatgcgtgatgtgctggggacatttgatactgttcaaataataaaactgctgccattcgcagcagcacca

SEQ ID NO: 208139 - DNA, 75 bp, Artificial Sequence
  Synthetic
gctctcctttacaattactggagacaataccaaatggaatgaaaatcagaaccctcggatgtttttggcgatgat

SEQ ID NO: 208140 - DNA, 75 bp, Artificial Sequence
  Synthetic
tgaccatcgcaacagtatgtttcctcatgcagattgccatcttagcaacgaccgtgacactgcatttcaagcaaa

SEQ ID NO: 208141 - DNA, 75 bp, Artificial Sequence
  Synthetic
catttgatactgttcaaataataaaactgctgccattcgcagcagcaccacctgagcagagtaggatgcagttct

SEQ ID NO: 208142 - DNA, 75 bp, Artificial Sequence
  Synthetic
ataatagaaaagaacataacagagatagtgtatttgaataatactaccatagaaaaagaaatttgtcttaaagta

SEQ ID NO: 208143 - DNA, 75 bp, Artificial Sequence
  Synthetic
ggtaactctcctatatttaattacaataaggcaaccaaaaggctaacagtcctcggaaaggacgcaggtgcatta

SEQ ID NO: 208144 - DNA, 75 bp, Artificial Sequence
  Synthetic
gatggcaagattagggaaaggatacatgttcgagagtaagagcatgaaactacgaacacaaataccagcagaaat

SEQ ID NO: 208145 - DNA, 75 bp, Artificial Sequence
  Synthetic
acagaagatccagatgaaggaacagctggagtggaatctgcagtactgagaggattcctaattctaggaaaggaa

SEQ ID NO: 208146 - DNA, 75 bp, Artificial Sequence
  Synthetic
tcctttctccaaggacaactcaattcggctttctgctggtggggacatttgggtaacaagggagccttatgtgtc

SEQ ID NO: 208147 - DNA, 75 bp, Artificial Sequence
  Synthetic
ttgagaaaataagacctctcctaatagatgggactgcctcattgagtcctggaatgatgatgggcatgttcaaca

SEQ ID NO: 208148 - DNA, 75 bp, Artificial Sequence
  Synthetic
aaaaggggagaaagccaacgtgttgataggacagggagacgtggtgttggtaatgaaacggaaacgaaactctag

SEQ ID NO: 208149 - DNA, 75 bp, Artificial Sequence
  Synthetic
tttgcacttggccaagggaccacgctgaacaacaaacactcaaatggcacaatacatgatagaatcccacatcga

SEQ ID NO: 208150 - DNA, 75 bp, Artificial Sequence
  Synthetic
aatacatgatagaatcccacatcgaactcttttaatgaatgaattgggtgttccgtttcatttgggaaccagaca

SEQ ID NO: 208151 - DNA, 75 bp, Artificial Sequence
  Synthetic
tcagaaattgggaagctgttaaaattcaatggtctcagaatcctgcaatgttgtacaacaaaatggaatttgaac

SEQ ID NO: 208152 - DNA, 75 bp, Artificial Sequence
  Synthetic
atggaagactttgtgcgacaatgctttaatccaatgatcatcgagcttgcggaaaaagcaatgaaagaacatgga

SEQ ID NO: 208153 - DNA, 75 bp, Artificial Sequence
  Synthetic
agctgtcatgatgggaaagcatggctgcatgtctgtgtcactggggatgatagaaatgcaactgctagtttcatt

SEQ ID NO: 208154 - DNA, 75 bp, Artificial Sequence
  Synthetic
ggaaaaagcaatgaaagaacatggagaagacccgaaaattgaaacaaacaagtttgctgcaatatgtacgcacct

SEQ ID NO: 208155 - DNA, 75 bp, Artificial Sequence
  Synthetic
gaagacccgaaaattgaaacaaacaagtttgctgcaatatgtacgcacctagaagtctgtttcatgtattctgat

SEQ ID NO: 208156 - DNA, 75 bp, Artificial Sequence
  Synthetic
tgcatcaatggaacttgtacagtggtaatgactgatggaagtgcatcaggaagggctgatactagaatactattc

SEQ ID NO: 208157 - DNA, 75 bp, Artificial Sequence
  Synthetic
gagaagcccaggttcctcccggatctgtatgactacaaggagaatcgattcattgaaataggcgtaacaagaaga

SEQ ID NO: 208158 - DNA, 75 bp, Artificial Sequence
  Synthetic
gcatatagaggaatgttcctgttacccccgatatccagatgttagatgtgtttgcagagataactggaagggctc

SEQ ID NO: 208159 - DNA, 75 bp, Artificial Sequence
  Synthetic
ccccgatatccagatgttagatgtgtttgcagagataactggaagggctctaatagacccgttatagatataagt

SEQ ID NO: 208160 - DNA, 75 bp, Artificial Sequence
  Synthetic
atcattcgagctaaagaaactgtgggagcagacccgttcaaaagcaggactgttggtttcagatggaggaccaaa

SEQ ID NO: 208161 - DNA, 75 bp, Artificial Sequence
  Synthetic
ggagatcccccatatagccatggaacaggaacaggatacaccatggacacagtcaacagaacacaccaatattca

SEQ ID NO: 208162 - DNA, 75 bp, Artificial Sequence
  Synthetic
tgacacacctaggaacgatgatagctctagcagcagcaactgcagggatcctaacaatgagagagggaatccagg

SEQ ID NO: 208163 - DNA, 75 bp, Artificial Sequence
  Synthetic
ttcaccattagacaggaaatggccatcaggggcctatgggactcctttcgtcagtccgaaagaggcgaagacaca

SEQ ID NO: 208164 - DNA, 75 bp, Artificial Sequence
  Synthetic
gggaatgatgtttggatggggagaacaatcagcaaagattcgcgctcaggttatgagaccttcagggtcactggt

SEQ ID NO: 208165 - DNA, 75 bp, Artificial Sequence
  Synthetic
tgggcatgtttaacatgcttagcactgtcctaggagtttcaatcctgaatcttgggcaaaattgcccttccaaaa

SEQ ID NO: 208166 - DNA, 75 bp, Artificial Sequence
  Synthetic
aaagctgcatcaataggtgtttttatgtggagttaataagagggaggccacaggagaccagggtatggtggactt

SEQ ID NO: 208167 - DNA, 75 bp, Artificial Sequence
  Synthetic
agcgaaagcaggggtttaaaatgaatccaaatcagaaaataataaccattggatcaatctgtctggtagtcggac

SEQ ID NO: 208168 - DNA, 75 bp, Artificial Sequence
  Synthetic
ggatcaatctgtctggtagtcggactaattagcctaatattgcaaatagggaatataatctcaatatggattagc

SEQ ID NO: 208169 - DNA, 75 bp, Artificial Sequence
  Synthetic
taattagcctaatattgcaaatagggaatataatctcaatatggattagccattcaattcaaactggaagtcaaa

SEQ ID NO: 208170 - DNA, 75 bp, Artificial Sequence
  Synthetic
catgagaaaggcataaatccaaactatctcctgacttggaaacaagtgctagctgagctacaagacattgaaagt

SEQ ID NO: 208171 - DNA, 75 bp, Artificial Sequence
  Synthetic
tgggtaaaggacacaacttcagtgatattaaccggcaattcatctctttgtcccatccgtgggtgggctatatac

SEQ ID NO: 208172 - DNA, 75 bp, Artificial Sequence
  Synthetic
tattaaccggcaattcatctctttgtcccatccgtgggtgggctatatacagcaaagacaatagcataagaattg

SEQ ID NO: 208173 - DNA, 75 bp, Artificial Sequence
  Synthetic
gtgggtacttggtgaaaacatggcacctgaaaaggtggattttgaggattgcaaagatatcagtgatttaaaaca

SEQ ID NO: 208174 - DNA, 75 bp, Artificial Sequence
  Synthetic
cctgaaaaggtggattttgaggattgcaaagatatcagtgatttaaaacagtatgacagtgatgagccaaaattg

SEQ ID NO: 208175 - DNA, 75 bp, Artificial Sequence
  Synthetic
cacttggaatgcaggaccttttttctgacccaaggtgccttactgaatgacaggcattcaaatgggactgttaag

SEQ ID NO: 208176 - DNA, 75 bp, Artificial Sequence
  Synthetic
accagaaaccaacccgagtggtttagaaacatcctgagcatggcacccataatgttctcaaataaaatggcaaga

SEQ ID NO: 208177 - DNA, 75 bp, Artificial Sequence
  Synthetic
aacggattctagctggatagagcttgatgaaataggggaggatgtcgctccaatcgagcacattgctagtatgag

SEQ ID NO: 208178 - DNA, 75 bp, Artificial Sequence
  Synthetic
aggtttacaaaacctactttgagaaggtcgaaagattaaagcatggaaccttcggtcccgttcactttcgaaatc

SEQ ID NO: 208179 - DNA, 75 bp, Artificial Sequence
  Synthetic
tctcaaatgtccaaagaagtgaatgcccaaattgaaccttttctgaagacaacaccaagaccaatcaaacttccg

SEQ ID NO: 208180 - DNA, 75 bp, Artificial Sequence
  Synthetic
tgacccaaggtgccttactgaatgacaggcattcaaatgggactgttaaggacagaagcccttatagggccttaa

SEQ ID NO: 208181 - DNA, 75 bp, Artificial Sequence
  Synthetic
tcggttgcttggtcagcaagtgcatgtcatgatggcatgggctggctaacaatcggaatttcaggtccagataat

SEQ ID NO: 208182 - DNA, 75 bp, Artificial Sequence
  Synthetic
gtcatgatggcatgggctggctaacaatcggaatttcaggtccagataatggagcagtggctgtattaaaataca

SEQ ID NO: 208183 - DNA, 75 bp, Artificial Sequence
  Synthetic
gatgaaataggggaggatgtcgctccaatcgagcacattgctagtatgaggaggaactacttcacagcagaggtg

SEQ ID NO: 208184 - DNA, 75 bp, Artificial Sequence
  Synthetic
gcaatggatgattttcagttgatcccaatgataagcaaatgcagaacaaaggaaggaaggcggaagacaaatcta

SEQ ID NO: 208185 - DNA, 75 bp, Artificial Sequence
  Synthetic
acacaagagtctgaatgtgcctgtgtaaatggttcatgttttactataatgactgatggcccgagtgatgggctg

SEQ ID NO: 208186 - DNA, 75 bp, Artificial Sequence
  Synthetic
taaatggttcatgttttactataatgactgatggcccgagtgatgggctggcctcgtacaaaattttcaagatcg

SEQ ID NO: 208187 - DNA, 75 bp, Artificial Sequence
  Synthetic
ggtaaattttgtgagtatggagttttctctcaccgatccgaggctggagccccacaagtgggagaagtattgtgt

SEQ ID NO: 208188 - DNA, 75 bp, Artificial Sequence
  Synthetic
tatgaggaatgttcctgttaccctgataccggcaaagtgatgtgtgtgtgcagagacaattggcatggttcgaac

SEQ ID NO: 208189 - DNA, 75 bp, Artificial Sequence
  Synthetic
ataccggcaaagtgatgtgtgtgtgcagagacaattggcatggttcgaaccggccatgggtgtctttcgatcaaa

SEQ ID NO: 208190 - DNA, 75 bp, Artificial Sequence
  Synthetic
gttgatcagagtttaattattgctgctagaaatattgtcaggagagcaacagtatcagcagacccgttggcttcg

SEQ ID NO: 208191 - DNA, 75 bp, Artificial Sequence
  Synthetic
tgagagcatgattgaagcggaatcttctgttaaagaaaaggacatgaccaaagaattttttgaaaacaaatctga

SEQ ID NO: 208192 - DNA, 75 bp, Artificial Sequence
  Synthetic
ccgcgtcccaaagatggaacaggcagctgtggtccagtgtatgttgatggagcaaacggagtaaagggattttca

SEQ ID NO: 208193 - DNA, 75 bp, Artificial Sequence
  Synthetic
gctgtggtccagtgtatgttgatggagcaaacggagtaaagggattttcatataggtatggtaatggtgtttgga

SEQ ID NO: 208194 - DNA, 75 bp, Artificial Sequence
  Synthetic
gaaaagtatgcagaaccttattggcaaaatctgtattcaatagcctgtatgcatccccacaactcgagggatttt

SEQ ID NO: 208195 - DNA, 75 bp, Artificial Sequence
  Synthetic
aaaatctgtattcaatagcctgtatgcatccccacaactcgagggattttcagctgaatcaaggaagttacttct

SEQ ID NO: 208196 - DNA, 75 bp, Artificial Sequence
  Synthetic
gatcctaatggatggacagagactgatagtaagttctctgtgaggcaagatgttgtggcaatgactgattggtca

SEQ ID NO: 208197 - DNA, 75 bp, Artificial Sequence
  Synthetic
aagggctgtatgatgcaattgaggagtgcctgattaatgatccttgggttttgcttaatgcgtcttggttcaact

SEQ ID NO: 208198 - DNA, 75 bp, Artificial Sequence
  Synthetic
tataaggccgtgcttctgggttgaattaatcaggggacgacctaaagaaaaaacaatctggactagtgcgagcag

SEQ ID NO: 208199 - DNA, 75 bp, Artificial Sequence
  Synthetic
caaaacgtcattacttacgaaaacaacacttgggtcaaccagacgtatgttaacatcagcaacactaattttgtt

SEQ ID NO: 208200 - DNA, 75 bp, Artificial Sequence
  Synthetic
agcaaaagcaggggtcacaatgtacaaaatagtactagtacttgcgctcctcggagcggtgcatggtcttgacaa

SEQ ID NO: 208201 - DNA, 75 bp, Artificial Sequence
  Synthetic
agtaaagataatagtgtaagaataggttccaagggggatgtgtttgtcataagggagccattcatttcatgctcc

SEQ ID NO: 208202 - DNA, 75 bp, Artificial Sequence
  Synthetic
tcctgttagtggatgggctatatacagtaaagataatagtgtaagaataggttccaagggggatgtgtttgtcat

SEQ ID NO: 208203 - DNA, 75 bp, Artificial Sequence
  Synthetic
ttgcataaggggatctaatagtagtttctttagtagattaaattggttgacccacttaaacttcaaatacccagc

SEQ ID NO: 208204 - DNA, 75 bp, Artificial Sequence
  Synthetic
tgtctcctgaagaggttagtgaaacacagggaacagaaaagctgacgataacatattcatcgtccatgatgtggg

SEQ ID NO: 208205 - DNA, 75 bp, Artificial Sequence
  Synthetic
aagggagccattcatttcatgctcccacttggaatgcagaactttcttcttaactcaaggggcccttttgaatga

SEQ ID NO: 208206 - DNA, 75 bp, Artificial Sequence
  Synthetic
taggagagcaacagtatcggcagatccactggcatcactattggagatgtgtcacagcacacaaattggagggat

SEQ ID NO: 208207 - DNA, 75 bp, Artificial Sequence
  Synthetic
tgagctgtcctattggtgaagttccttctccatacaactcaagatttgagtcagtcgcttggtcagcaagtgcct

SEQ ID NO: 208208 - DNA, 75 bp, Artificial Sequence
  Synthetic
ttattttgaaaaggtcgaaagattaaaacatggtacctttggccctgtccacttcagaaaccaagttaaaataag

SEQ ID NO: 208209 - DNA, 75 bp, Artificial Sequence
  Synthetic
agaagtgcttacaggcaatctccaaacactaaaaatacgcgtacatgaggggtatgaggagttcacaatggttgg

SEQ ID NO: 208210 - DNA, 75 bp, Artificial Sequence
  Synthetic
gagttggagaaaaaacatattaagaacacaagagtctgaatgtgcatgcgttaatggttcttgctttacagtaat

SEQ ID NO: 208211 - DNA, 75 bp, Artificial Sequence
  Synthetic
gcatgataaaggctgtcagaggtgatttgaactttgtaaacagagctaaccaacggctgaatcccatgcatcagc

SEQ ID NO: 208212 - DNA, 75 bp, Artificial Sequence
  Synthetic
aaaaggggaaagtagtcaaatcagttgagttgaatgcccctaattatcactatgaggaatgctcctgttatcctg

SEQ ID NO: 208213 - DNA, 75 bp, Artificial Sequence
  Synthetic
tgagttgaatgcccctaattatcactatgaggaatgctcctgttatcctgaatctggtgaaatcacatgtgtgtg

SEQ ID NO: 208214 - DNA, 75 bp, Artificial Sequence
  Synthetic
gactccaagcacagagatgtcactaagaggggtgagggtcagtaaaacaggagtagacgaatactctagtactga

SEQ ID NO: 208215 - DNA, 75 bp, Artificial Sequence
  Synthetic
ggaccagcattgagcatcaacgaattgagcaatcttgcgaaaggggagaaggctaatgtgttgatagggcaagga

SEQ ID NO: 208216 - DNA, 75 bp, Artificial Sequence
  Synthetic
atctggaatatcaaatgggatacatatgcagtgggattttcggagataatccacgccctaatgataaaacaggca

SEQ ID NO: 208217 - DNA, 75 bp, Artificial Sequence
  Synthetic
gaaaccttcaaagtcattgaaggatggtccaaccctaagtccaaattgcagataaataggcaagtcatagttgac

SEQ ID NO: 208218 - DNA, 75 bp, Artificial Sequence
  Synthetic
gatccggacggatggaccaaaacagacgataaattctcagtgaagcaagatatcataggaataaatgattggtca

SEQ ID NO: 208219 - DNA, 75 bp, Artificial Sequence
  Synthetic
cagcagatgcgtgatgtgctggggacatttgacactgtccaaatagtaaagctgctgccctttgcagcagcgcca

SEQ ID NO: 208220 - DNA, 75 bp, Artificial Sequence
  Synthetic
acaggagtcgataagcctaaattcctcccagatttgtatgattacaaagaaaaccgattcattgaaattggagtg

SEQ ID NO: 208221 - DNA, 75 bp, Artificial Sequence
  Synthetic
catttgacactgtccaaatagtaaagctgctgccctttgcagcagcgccaccggagcagagtaggatgcaattct

SEQ ID NO: 208222 - DNA, 75 bp, Artificial Sequence
  Synthetic
atggattcaaacactgtgtcaagctttcaggtagactgctttctttggcatatccgcaaacggtttgcagactgg

SEQ ID NO: 208223 - DNA, 75 bp, Artificial Sequence
  Synthetic
ttcaggtagactgctttctttggcatatccgcaaacggtttgcagactggggacttggtgatgctccatttctcg

SEQ ID NO: 208224 - DNA, 75 bp, Artificial Sequence
  Synthetic
tgcatacgagaggatgtgcaacatcctcaaagggaaattccaaacagcagcacaaagggcaatgatggatcaagt

SEQ ID NO: 208225 - DNA, 75 bp, Artificial Sequence
  Synthetic
ggtctggaaatcgaaccagctactcgtgcaggaaaacaaatagtgaagcgtattctggaaaaagagtatgatgaa

SEQ ID NO: 208226 - DNA, 75 bp, Artificial Sequence
  Synthetic
tattctggaaaaagagtatgatgaatcacttaaaatgactatcgcttctgtgcctgcttcatgctatctaactga

SEQ ID NO: 208227 - DNA, 75 bp, Artificial Sequence
  Synthetic
cggaattgacccttgacgcagaaagcaggtacagattcaaaatgagactttgtacgataatgcatcaaatggcca

SEQ ID NO: 208228 - DNA, 75 bp, Artificial Sequence
  Synthetic
cagcaaatgcgggatgtgcttggaacatttgacactgtccaaataataaaacttctcccctttgctgctgcccca

SEQ ID NO: 208229 - DNA, 75 bp, Artificial Sequence
  Synthetic
tggtttagcttcggggcgtcatgctttgtgcttttggctgtcatcatggggcttgttttcttctgcttgaaaaat

SEQ ID NO: 208230 - DNA, 75 bp, Artificial Sequence
  Synthetic
aggacatactgatgaggatgtcaaaaatgcaattgaggtcctcatcaaaggatttgaatggaatagtaacacagt

SEQ ID NO: 208231 - DNA, 75 bp, Artificial Sequence
  Synthetic
gtaaaaccacatgtaaaaggcataaatcccaactacctcctggcttggaagcaggtgctggcagaactccaagac

SEQ ID NO: 208232 - DNA, 75 bp, Artificial Sequence
  Synthetic
caggtacagattcaaaatgagactttgtacgataatgcatcaaatggccagtatgagtcgatggaattcctttcg

SEQ ID NO: 208233 - DNA, 75 bp, Artificial Sequence
  Synthetic
acaggagacctccattccctccaaagcagaaacgggagatggcgagaacaactgggccaaaagtttgaagaaata

SEQ ID NO: 208234 - DNA, 75 bp, Artificial Sequence
  Synthetic
gcagaaacgggagatggcgagaacaactgggccaaaagtttgaagaaataagatggttaattgaagaagtgcgac

SEQ ID NO: 208235 - DNA, 75 bp, Artificial Sequence
  Synthetic
tcttggaaaggatgcaggtgcattgactgaagatccagatgaaggcacagctggagtggagtctgctgtcctgag

SEQ ID NO: 208236 - DNA, 75 bp, Artificial Sequence
  Synthetic
cgataaccaaggaaaagaaggaggagcttcaggactgcaaaattgcccctttaatggtggcttacatgttggaga

SEQ ID NO: 208237 - DNA, 75 bp, Artificial Sequence
  Synthetic
atgcgagttgacagattcaagttggattgaacttgatgaaataggggaagatgttgctccaattgagcacattgc

SEQ ID NO: 208238 - DNA, 75 bp, Artificial Sequence
  Synthetic
gatgaaataggggaggatgtcgaaccaattgagcacattgctagtatgaggaggaactatttcacagcagaagtg

SEQ ID NO: 208239 - DNA, 75 bp, Artificial Sequence
  Synthetic
aggaacaagccgtagacatatgcaaggcagcaataggattgaggatcagctcatctttcagttttggtgggttca

SEQ ID NO: 208240 - DNA, 75 bp, Artificial Sequence
  Synthetic
atctgttgggagaatggttggtggaattgggagattctacatacagatgtgcactgaactcaagctcagcgacta

SEQ ID NO: 208241 - DNA, 75 bp, Artificial Sequence
  Synthetic
ggatgggggctgtgaccactgaagtggcatttggcctggtatgtgcaacctgtgaacagattgctgactcccagc

SEQ ID NO: 208242 - DNA, 75 bp, Artificial Sequence
  Synthetic
atatctggaagagcatcccagtgctgggaaagaccctaagaagactggaggcccaatatacaggaggagagatgg

SEQ ID NO: 208243 - DNA, 75 bp, Artificial Sequence
  Synthetic
aatttcacaaccactcaagatggaagcagcaacaacaataataactatactactagcaataacaggaagcaatgc

SEQ ID NO: 208244 - DNA, 75 bp, Artificial Sequence
  Synthetic
atagtagtttctctatgaagcaggacattatagcattgaatgattggtcaggatacagtggaagttttgtccaac

SEQ ID NO: 208245 - DNA, 75 bp, Artificial Sequence
  Synthetic
tactagcaataacaggaagcaatgcggacaaaatctgcattggctaccaatcaacaaactccacggaaactgtag

SEQ ID NO: 208246 - DNA, 75 bp, Artificial Sequence
  Synthetic
ggctgctggagcagcagtgaaaggagttggaacaatggtgatggaattgattcggatgatcaaacgagggatcaa

SEQ ID NO: 208247 - DNA, 75 bp, Artificial Sequence
  Synthetic
tgatattgtggattcttgatcgtctttttttcaaatgcatttaccgtcgctttaaatacggactgaaaggagggc

SEQ ID NO: 208248 - DNA, 75 bp, Artificial Sequence
  Synthetic
ggacaaaatctgcattggctaccaatcaacaaactccacggaaactgtagacacgctaaccgaaaacaatgttcc

SEQ ID NO: 208249 - DNA, 75 bp, Artificial Sequence
  Synthetic
gtgcaacaaacctggggcgtcctcttattctagacacctgtaccattgaaggactaatctatggcaacccgtctt

SEQ ID NO: 208250 - DNA, 75 bp, Artificial Sequence
  Synthetic
aatgaccattggctccatttcattagggttggctgtattcaatgttctactgcatgccgtgagcatcacactaac

SEQ ID NO: 208251 - DNA, 75 bp, Artificial Sequence
  Synthetic
tcagctgttaatggagtgtgctaccccggaaatgtagaaaacctggaagaattaaggtcactttttagttccgcc

SEQ ID NO: 208252 - DNA, 75 bp, Artificial Sequence
  Synthetic
agggatactccctagtcggaatcgatcctttccgcctgctccaaaacagtcaagtcttcagtcttatcagaccaa

SEQ ID NO: 208253 - DNA, 75 bp, Artificial Sequence
  Synthetic
ttacagtggaacaagcaaagcatgttcagattcattctacagaagcatgaggtggttgactcaaaagaacaacaa

SEQ ID NO: 208254 - DNA, 75 bp, Artificial Sequence
  Synthetic
ttttcatgtggggcataaatcacccacccactgatactgcacaaacaaatctgtacacaaggactgacacaacaa

SEQ ID NO: 208255 - DNA, 75 bp, Artificial Sequence
  Synthetic
acccactgatactgcacaaacaaatctgtacacaaggactgacacaacaacaagtgtggcgacggaagacataaa

SEQ ID NO: 208256 - DNA, 75 bp, Artificial Sequence
  Synthetic
aagagagacattcatctcatgctcccacttggaatgcagaactttcttcttaactcaaggagcccttctgaatga

SEQ ID NO: 208257 - DNA, 75 bp, Artificial Sequence
  Synthetic
aaggaaggattgattattattgggcggtgttaaaaccaggtcagacattgcgagtaagatccaacgggaatctaa

SEQ ID NO: 208258 - DNA, 75 bp, Artificial Sequence
  Synthetic
ggtgttaaaaccaggtcagacattgcgagtaagatccaacgggaatctaatcgctccatggtatggacacattct

SEQ ID NO: 208259 - DNA, 75 bp, Artificial Sequence
  Synthetic
gtatgacagtgatgagccagagcctagatctctagcaagctgggtccaaaatgaattcaataaggcatgtgaatt

SEQ ID NO: 208260 - DNA, 75 bp, Artificial Sequence
  Synthetic
actgtgtagtgcaatgtcaaacagaaagaggtggtttgaacactacattgccatttcacaacgtgagcaagtacg

SEQ ID NO: 208261 - DNA, 75 bp, Artificial Sequence
  Synthetic
catatgaacaaatggagactggtggggagcgccaggatgccacagaaatcagagcatctgtcggaagaatgattg

SEQ ID NO: 208262 - DNA, 75 bp, Artificial Sequence
  Synthetic
aagaggtggtttgaacactacattgccatttcacaacgtgagcaagtacgcattcggaaattgcccaaagtatat

SEQ ID NO: 208263 - DNA, 75 bp, Artificial Sequence
  Synthetic
gtggaatcgggaaattctacatccaaatgtgcactgaactcaaactcagtgattatgagggacgactaatccaaa

SEQ ID NO: 208264 - DNA, 75 bp, Artificial Sequence
  Synthetic
gatcaaatagaggactatttggagccatagctggtttcatagagggaggttggtcaggattagttgctggttggt

SEQ ID NO: 208265 - DNA, 75 bp, Artificial Sequence
  Synthetic
catagctggtttcatagagggaggttggtcaggattagttgctggttggtatgggttccagcattcaaatgatca

SEQ ID NO: 208266 - DNA, 75 bp, Artificial Sequence
  Synthetic
atgaaggcaatactagtagtcctgctatatacatttacaaccgcaaatgccgacacattatgtataggttatcat

SEQ ID NO: 208267 - DNA, 75 bp, Artificial Sequence
  Synthetic
aaataacgtccaaagtaaataatatagtcgacaaaatgaacaaacagtatgagattattgaccatgaattcagcg

SEQ ID NO: 208268 - DNA, 75 bp, Artificial Sequence
  Synthetic
agcgcaaaatgccataagcaccacattcccttatactggagatcctccatacagccatggaacaggaacagggta

SEQ ID NO: 208269 - DNA, 75 bp, Artificial Sequence
  Synthetic
agattgaaactagactcaatatgatcaatgataagatcgatgaccaaattcaagacatatgggcatataatgctg

SEQ ID NO: 208270 - DNA, 75 bp, Artificial Sequence
  Synthetic
tatatacatttacaaccgcaaatgccgacacattatgtataggttatcatgcaaacaattcaactgacaccgtag

SEQ ID NO: 208271 - DNA, 75 bp, Artificial Sequence
  Synthetic
aaggaggggttttgagatgatttgggatccaaacggatggaccggaacagacgataaattctcagtaaaacaaga

SEQ ID NO: 208272 - DNA, 75 bp, Artificial Sequence
  Synthetic
cttgttaaaagtgatcagatttgcattggttaccatgcaaacaactcgacagagcaggttgacacgataatggaa

SEQ ID NO: 208273 - DNA, 75 bp, Artificial Sequence
  Synthetic
agtgcatggagacaattcgaaacgggacctataacagaagaaagtatcaggaggaatcaagactagagagacaga

SEQ ID NO: 208274 - DNA, 75 bp, Artificial Sequence
  Synthetic
atccagaattgaccggactggattgtattagaccttgtttttgggttgagctaatcagaggacgacccaaggaaa

SEQ ID NO: 208275 - DNA, 75 bp, Artificial Sequence
  Synthetic
cccagagggcaatgatggatcaagtgagagaaagtcgaaacccaggaaatgctgagattgaagatctcattttcc

SEQ ID NO: 208276 - DNA, 75 bp, Artificial Sequence
  Synthetic
catatccttttgtggtgtaagtagtggaacagtgggttggtcttggccagacggtgctgagttgccatttaccat

SEQ ID NO: 208277 - DNA, 75 bp, Artificial Sequence
  Synthetic
gagagaaagtcgaaacccaggaaatgctgagattgaagatctcattttcctggcacggtcagcacttattctaag

SEQ ID NO: 208278 - DNA, 75 bp, Artificial Sequence
  Synthetic
acagtcaagtgttcagcctgataagaccaaatgaaaacccagctcacaagagtcaattagtgtggatggcatgtc

SEQ ID NO: 208279 - DNA, 75 bp, Artificial Sequence
  Synthetic
atggaaactggtggagagcgccagaatgctactgagatcagggcatctgttggaagaatggttagtggcattggg

SEQ ID NO: 208280 - DNA, 75 bp, Artificial Sequence
  Synthetic
actctgctgcatttgaggatctaagggtatcaagtttcataagagggaagaaagtgcttccaagaggaaagcttt

SEQ ID NO: 208281 - DNA, 75 bp, Artificial Sequence
  Synthetic
aggactgcagcgtagacggtttgtccaaaacgccctaaatgggaatggagacccaaacaatatggacaaggcagt

SEQ ID NO: 208282 - DNA, 75 bp, Artificial Sequence
  Synthetic
tccaataccttagagctgagaagcagatactgggccataaggaccagaagtggaggaaataccaatcaacagaaa

SEQ ID NO: 208283 - DNA, 75 bp, Artificial Sequence
  Synthetic
ggaagagcaccccagtgcggggaaggaccctaagaaaactggaggtccaatttatcggaggagagacgggaaatg

SEQ ID NO: 208284 - DNA, 75 bp, Artificial Sequence
  Synthetic
ggacaattttaaaaccgaatgatgcaatccacttcgagagtaatggaaatttcattgctccagaatatgcataca

SEQ ID NO: 208285 - DNA, 75 bp, Artificial Sequence
  Synthetic
atgtgccacttgtgagcagattgctgacgcacaacatcggtcccacaggcagatggcgactactaccaatccact

SEQ ID NO: 208286 - DNA, 75 bp, Artificial Sequence
  Synthetic
aatccacttcgagagtaatggaaatttcattgctccagaatatgcatacaaaattgtcaagaaaggggactcaac

SEQ ID NO: 208287 - DNA, 75 bp, Artificial Sequence
  Synthetic
ttcattgctccagaatatgcatacaaaattgtcaagaaaggggactcaacaattatgaaaagtgaagtggaatat

SEQ ID NO: 208288 - DNA, 75 bp, Artificial Sequence
  Synthetic
atatggcattccaatctgaatgatgccacatatcagagaacaagagctctcgtgcgtaccggaatggaccccagg

SEQ ID NO: 208289 - DNA, 75 bp, Artificial Sequence
  Synthetic
cgggaacaggatacaccatggacacagtcaacagaacacatcaatattcagaaaaggggaaatggacaacaaaca

SEQ ID NO: 208290 - DNA, 75 bp, Artificial Sequence
  Synthetic
agtcaacagaacacatcaatattcagaaaaggggaaatggacaacaaacacagagactggggcaccccaacttaa

SEQ ID NO: 208291 - DNA, 75 bp, Artificial Sequence
  Synthetic
ggattgggtgatgccccattccttgatcggctccgccgagatcaaaagtccctaaaaggaagaggcaacaccctt

SEQ ID NO: 208292 - DNA, 75 bp, Artificial Sequence
  Synthetic
aggtcaactcgatcattgacaaaatgaacactcaatttgaggccgttggaagggaatttaataacttagaaagga

SEQ ID NO: 208293 - DNA, 75 bp, Artificial Sequence
  Synthetic
ttatcgtcgctttaaatacggtttgaaaagagggccttctacggaaggagtgcctgagtctatgagggaagagta

SEQ ID NO: 208294 - DNA, 75 bp, Artificial Sequence
  Synthetic
ttagggataatgcaaaggagctgggtaatggttgtttcgagttctatcacaaatgtgataatgaatgtatggaaa

SEQ ID NO: 208295 - DNA, 75 bp, Artificial Sequence
  Synthetic
ccaaatactgtcaatttattcaacagtggcgagttccctagcactggcaatcatggtggctggtctatctttatg

SEQ ID NO: 208296 - DNA, 75 bp, Artificial Sequence
  Synthetic
gtggatggcatgccactctgcagcatttgaggacctcagagtctcaagtttcatcagaggggcaagagtggtccc

SEQ ID NO: 208297 - DNA, 75 bp, Artificial Sequence
  Synthetic
aaattggcaaatgttgtgaggaagatgatgactaattcacaagacacagagctctccttcacaattactggagac

SEQ ID NO: 208298 - DNA, 75 bp, Artificial Sequence
  Synthetic
cattcgaattcacaagctttttctaccgctatggatttgtagctaacttcagtatggagttgcccagttttggag

SEQ ID NO: 208299 - DNA, 75 bp, Artificial Sequence
  Synthetic
caaatgccgacacattatgtataggttatcatgcaaacaattcaactgacaccgtagacacagtactagaaaaga

SEQ ID NO: 208300 - DNA, 75 bp, Artificial Sequence
  Synthetic
gaagtctgtttcatgtattcggatttccatttcattgacgaacagggtgaatcaatcattgtagaatctggtgat

SEQ ID NO: 208301 - DNA, 75 bp, Artificial Sequence
  Synthetic
ttcatacccaaagatcaacaaatcctacattaacaataaagagaaggaagttctcgtgctatgggccattcacca

SEQ ID NO: 208302 - DNA, 75 bp, Artificial Sequence
  Synthetic
agtctcgcactcgcgagatactgacaaaaacaactgtggaccatatggccataatcaagaaatatacatcgggaa

SEQ ID NO: 208303 - DNA, 75 bp, Artificial Sequence
  Synthetic
cacaagctttttctatcgctatggatttgtagccaattttagcatggagctgcccagttttggagtatctggaat

SEQ ID NO: 208304 - DNA, 75 bp, Artificial Sequence
  Synthetic
aggtctataaaacctattttgaaaaggtcgaaaggctaaaacatggaaccttcggccccgttcacttccgaaacc

SEQ ID NO: 208305 - DNA, 75 bp, Artificial Sequence
  Synthetic
gaacagataacgtttatgcaagccttacaactactgcttgaagtggagcaagagataagagccttctcgtttcag

SEQ ID NO: 208306 - DNA, 75 bp, Artificial Sequence
  Synthetic
aatggggaatggaaatgaggcgctgccttctccaatctcttcagcagattgagagtatgattgaggctgagtctt

SEQ ID NO: 208307 - DNA, 75 bp, Artificial Sequence
  Synthetic
cagaatggaccaggcaataatggataaaaacatcatactgaaagcaaacttcagtgtgatttttgaccggctgga

SEQ ID NO: 208308 - DNA, 75 bp, Artificial Sequence
  Synthetic
agatggaggaccaaatttatacaatatccggaatctccacattccggaagtctgcctgaagtgggagctaatgga

SEQ ID NO: 208309 - DNA, 75 bp, Artificial Sequence
  Synthetic
tagatatttaaagatgagtcttctaaccgaggtcgaaacgtacgttctttctatcatcccgtcaggccccctcaa

SEQ ID NO: 208310 - DNA, 75 bp, Artificial Sequence
  Synthetic
gaaataacattccatggagctaaagaggtcgcactcagttactcaaccggtgcacttgccagttgcatgggtctc

SEQ ID NO: 208311 - DNA, 75 bp, Artificial Sequence
  Synthetic
aggtcgcactcagttactcaaccggtgcacttgccagttgcatgggtctcatatacaacaggatgggaacggtga

SEQ ID NO: 208312 - DNA, 75 bp, Artificial Sequence
  Synthetic
cacatgcactgaaatagttgtggcagtgctactatttgctatccatactgtccaaaaaagtaccttgtttctact

SEQ ID NO: 208313 - DNA, 75 bp, Artificial Sequence
  Synthetic
tcacaatggtcgggcgaagagcaacagccattctaaggaaagcaaccagaagactgatccaactgatagtgagtg

SEQ ID NO: 208314 - DNA, 75 bp, Artificial Sequence
  Synthetic
atagaaatcaaccggcagcaactgcattggccaacaccatagaagtttttagatcaaatggtctaacagctaatg

SEQ ID NO: 208315 - DNA, 75 bp, Artificial Sequence
  Synthetic
cccaactcaacccgattgatggaccattacctgaggataacgagcccagtgggtatgcacaaacagattgtgtat

SEQ ID NO: 208316 - DNA, 75 bp, Artificial Sequence
  Synthetic
agcgcaaaatgccataagcaccacattcccttatactggagatcctccatacagccatggaacaggaacaggata

SEQ ID NO: 208317 - DNA, 75 bp, Artificial Sequence
  Synthetic
tgacaataataactggtctggttattctggtattttctctgttgaaggcaaaagctgcatcaataggtgttttta

SEQ ID NO: 208318 - DNA, 75 bp, Artificial Sequence
  Synthetic
ggacaacatgaccaagaagatggtcacacaaagaacaatagggaagaaaaaacaaagagtgaataagaggagtta

SEQ ID NO: 208319 - DNA, 75 bp, Artificial Sequence
  Synthetic
gacccaaggtcgccagacttatgactggacattgaatagaaaccaaccggctgcaactgctttggccaacactat

SEQ ID NO: 208320 - DNA, 75 bp, Artificial Sequence
  Synthetic
aaacagattgtgtgttggaagcaatggctttccttgaagaatcccacccagggatctttgaaaactcatgtcttg

SEQ ID NO: 208321 - DNA, 75 bp, Artificial Sequence
  Synthetic
acaataacgaaagagaagaaagaagagctccaagattgtaaaatcgcccctttgatggtggcatacatgctagaa

SEQ ID NO: 208322 - DNA, 75 bp, Artificial Sequence
  Synthetic
aggtccggttattctggtattttctccgttgaaggtaaaagctgcatcaatcggtgcttttatgtggagttgata

SEQ ID NO: 208323 - DNA, 75 bp, Artificial Sequence
  Synthetic
aatggcaagactaggaaaaggatacatgttcgaaagtaagagcatgaagttacgaacacaaataccagcagaaat

SEQ ID NO: 208324 - DNA, 75 bp, Artificial Sequence
  Synthetic
atagaaatcaaccggctgcaactgctttggccaacactatagaggtcttcagatcgaacggtctaacagctaatg

SEQ ID NO: 208325 - DNA, 75 bp, Artificial Sequence
  Synthetic
agatggtacagcctcattgagccctggaatgatgatgggcatgttcaacatgctgagtacagtcctaggagtttc

SEQ ID NO: 208326 - DNA, 75 bp, Artificial Sequence
  Synthetic
gatgagggaacagcaggagtggaatctgcagtattgagagggtttctaattctgggcaaagaagacaaaagatat

SEQ ID NO: 208327 - DNA, 75 bp, Artificial Sequence
  Synthetic
aacatgagcaaaaagaagtcctatataaataagactgggacatttgaattcacaagctttttttatcgctatggg

SEQ ID NO: 208328 - DNA, 75 bp, Artificial Sequence
  Synthetic
gaatatggggaagatccgaaaatcgaaacgaacaaattcgcatcaatatgcacacacttagaagtctgcttcatg

SEQ ID NO: 208329 - DNA, 75 bp, Artificial Sequence
  Synthetic
aaacgaacaaattcgcatcaatatgcacacacttagaagtctgcttcatgtactctgatttccacttcattgacg

SEQ ID NO: 208330 - DNA, 75 bp, Artificial Sequence
  Synthetic
aagacacacattcacatcttctcatttactggagaagaaatggccaccaaagcagactacactcttgacgaagaa

SEQ ID NO: 208331 - DNA, 75 bp, Artificial Sequence
  Synthetic
aagttaaaatacgccgccgagttgatacaaaccctggccatgcagatctcagtgctaaagaagcacaagatgtca

SEQ ID NO: 208332 - DNA, 75 bp, Artificial Sequence
  Synthetic
gagatcaggaggatttggcgccaagcgaacaatggagaggacgcaactgctggccttacccacctgatgatatgg

SEQ ID NO: 208333 - DNA, 75 bp, Artificial Sequence
  Synthetic
gtaacatggtggaataggaatggcccaacaacaagcacagttcactaccctaaggtatataaaacttatttcgaa

SEQ ID NO: 208334 - DNA, 75 bp, Artificial Sequence
  Synthetic
cctagtagctcgtacaggagaccggttggaatttctagcatggtagaggccatggtgtctagggcccggattgat

SEQ ID NO: 208335 - DNA, 75 bp, Artificial Sequence
  Synthetic
tcctcactgactgtgaatgtgagaggatcaggaatgaggatactggtaagaggcaattctccagtgttcaactac

SEQ ID NO: 208336 - DNA, 75 bp, Artificial Sequence
  Synthetic
agttaaaaaacaatgccaaagaaattggaaatggctgctttgaattttaccacaaatgcgataacacgtgcatgg

SEQ ID NO: 208337 - DNA, 75 bp, Artificial Sequence
  Synthetic
gaacatgaagaagacaagccaattgaagtgggcacttggtgagaacatggcaccagaaaaagtggactttgagga

SEQ ID NO: 208338 - DNA, 75 bp, Artificial Sequence
  Synthetic
gatcaagtgcgagagagcagaaatcctgggaatgctgaaattgaagatctcatttttctggcacggtctgcactc

SEQ ID NO: 208339 - DNA, 75 bp, Artificial Sequence
  Synthetic
aacatggcaccggagaaggtagactttgaagattgcaaagatgtcaacgacctgaaacagtacgacagtgatgag

SEQ ID NO: 208340 - DNA, 75 bp, Artificial Sequence
  Synthetic
tttcacaagaggattgcatgatcaaggcagttaggggcgatctgaactttgttaatagggcaaatcagcggctga

SEQ ID NO: 208341 - DNA, 75 bp, Artificial Sequence
  Synthetic
tatctcccgaagaggtcagcgaaacccaggggacagagaagttgacaataacatattcatcatcaatgatgtggg

SEQ ID NO: 208342 - DNA, 75 bp, Artificial Sequence
  Synthetic
aataccagcagaaatgctagcaagcattgacctgaagtacttcaatgaatcaacaaagaagaaaattgagaaaat

SEQ ID NO: 208343 - DNA, 75 bp, Artificial Sequence
  Synthetic
agcagactacacccttgatgaagaaagcagggcaagaatcaaaaccaggctgttcaccataagacaagaaatggc

SEQ ID NO: 208344 - DNA, 75 bp, Artificial Sequence
  Synthetic
ccactcagattacctgatggccctccctgctctcagcggtcaaaatttttgctgatggatgcgctgaaattaagt

SEQ ID NO: 208345 - DNA, 75 bp, Artificial Sequence
  Synthetic
ataataacaattggctcagtctctctaaccattgcaacagtatgtttcctcatgcagattgccatcctagcaacg

SEQ ID NO: 208346 - DNA, 75 bp, Artificial Sequence
  Synthetic
atgaagagaagatcccaaagacaaagaacatgaagaaaacaagccaattgaagtgggcactcggtgaaaatatgg

SEQ ID NO: 208347 - DNA, 75 bp, Artificial Sequence
  Synthetic
ccaagtagtgccatgtgaaccaattataatagagaggaacacaacagaggtagtgtatttgaatagtactaccat

SEQ ID NO: 208348 - DNA, 75 bp, Artificial Sequence
  Synthetic
tagtgtatttgaatagtactaccatagagaaagagttttgtcctaaagtagtaggctacaggaattggtcaaaac

SEQ ID NO: 208349 - DNA, 75 bp, Artificial Sequence
  Synthetic
agatcgaacggattgacagctaatgaatcaggaaggctaatagatttcctcaaggatgtgatggaatcaatggat

SEQ ID NO: 208350 - DNA, 75 bp, Artificial Sequence
  Synthetic
aaaatgaatccaaatcagaagataatagcaattggtgccgtctctctaactattgcgataatatgcctcctcatg

SEQ ID NO: 208351 - DNA, 75 bp, Artificial Sequence
  Synthetic
atgaatccaaatcagaaaataatagccattggctctatatcattgggattggttgtattcaatgttctattgcat

SEQ ID NO: 208352 - DNA, 75 bp, Artificial Sequence
  Synthetic
ggttgtattcaatgttctattgcatgtcgtaagcatcatagtaacagtattagtccttaggggaggcggcaacaa

SEQ ID NO: 208353 - DNA, 75 bp, Artificial Sequence
  Synthetic
gtcgtaagcatcatagtaacagtattagtccttaggggaggcggcaacaatgggatttgtaacgagacggtagta

SEQ ID NO: 208354 - DNA, 75 bp, Artificial Sequence
  Synthetic
actcttttgatgagtgagttgggtgttccgtttcatttgggaaccaaacaagtatgcatagcatggtccagctca

SEQ ID NO: 208355 - DNA, 75 bp, Artificial Sequence
  Synthetic
tactagtgtaatcgaacacgtgccatattggaatgaaggcacttacatgaataacacagaagcaatatgtgatgt

SEQ ID NO: 208356 - DNA, 75 bp, Artificial Sequence
  Synthetic
agtatgcatagcatggtccagctcaagttgccatgatggaaaagcatggctacacgtttgtgtcactggggatga

SEQ ID NO: 208357 - DNA, 75 bp, Artificial Sequence
  Synthetic
tattggaatgaaggcacttacatgaataacacagaagcaatatgtgatgtcaagggctttgcacctttctccaag

SEQ ID NO: 208358 - DNA, 75 bp, Artificial Sequence
  Synthetic
gtatgattacaaagagaaccggttcattgaaattggagtaacacggagggaagtccacatatattacctagagaa

SEQ ID NO: 208359 - DNA, 75 bp, Artificial Sequence
  Synthetic
gcctttcgtttcttgttcgcccacggaatgcagaactttcttcctcactcaggggtccctgctcaatgataagca

SEQ ID NO: 208360 - DNA, 75 bp, Artificial Sequence
  Synthetic
gctgaaagaggcaagttgaaaaggagggcaatcgcaacacccgggatgcaaatcagaggattcgtgtattttgta

SEQ ID NO: 208361 - DNA, 75 bp, Artificial Sequence
  Synthetic
gaatgcagaactttcttcctcactcaggggtccctgctcaatgataagcactcaaatggaacagtgaaagataga

SEQ ID NO: 208362 - DNA, 75 bp, Artificial Sequence
  Synthetic
aatcagaggattcgtgtattttgtagaagcactagcgaggagcatctgtgagaaacttgagcaatctggcctccc

SEQ ID NO: 208363 - DNA, 75 bp, Artificial Sequence
  Synthetic
ttagtccattgtcaggaagtgctcagcatatagaggagtgttcctgttatccccgatacccaaacgtcagatgtg

SEQ ID NO: 208364 - DNA, 75 bp, Artificial Sequence
  Synthetic
ctaccaagccagattcgaagctgtggcgtggtcagcaactgcttgccatgatgggaagaagtggatgacagttgg

SEQ ID NO: 208365 - DNA, 75 bp, Artificial Sequence
  Synthetic
atcagggctgaggatactggtaagaggcaactctccagtgttcaattacaacaaagcaaccaaaaggcttacaat

SEQ ID NO: 208366 - DNA, 75 bp, Artificial Sequence
  Synthetic
caaggagttcttcgaaaacaaatcggaaacgtggccaattggtgaatcacccaaaggagtggaggaaggctctat

SEQ ID NO: 208367 - DNA, 75 bp, Artificial Sequence
  Synthetic
gcgtggtcagcaactgcttgccatgatgggaagaagtggatgacagttggtgtgacagggccagattctaaggca

SEQ ID NO: 208368 - DNA, 75 bp, Artificial Sequence
  Synthetic
gttatgtgtgttcaggacttgttggagacacaccaaggaacgacgatagttctagcagcagcaactgcaaggatc

SEQ ID NO: 208369 - DNA, 75 bp, Artificial Sequence
  Synthetic
ggcaggggatatattgagaactcaagaatcatcctgtacttgcattcaaggtgattgctattgggtgatgactga

SEQ ID NO: 208370 - DNA, 75 bp, Artificial Sequence
  Synthetic
atgcatctccacaactcgaggggttttcagctgaatcgagaaaattgcttctcattgttcaggcacttagggaca

SEQ ID NO: 208371 - DNA, 75 bp, Artificial Sequence
  Synthetic
gaatcatcctgtacttgcattcaaggtgattgctattgggtgatgactgacggtccagccaataggcaggcacag

SEQ ID NO: 208372 - DNA, 75 bp, Artificial Sequence
  Synthetic
caatcagtaaagattcacgttcgggctatgagacctttagggtcattggtggctggatcactgctaattctaagt

SEQ ID NO: 208373 - DNA, 75 bp, Artificial Sequence
  Synthetic
tagctttaatggagggcatattgaagagtgttcttgctaccctaacgatgggaaagtggaatgtgtgtgtaggga

SEQ ID NO: 208374 - DNA, 75 bp, Artificial Sequence
  Synthetic
gagtgttcttgctaccctaacgatgggaaagtggaatgtgtgtgtagggataattggacagggactaacagacca

SEQ ID NO: 208375 - DNA, 75 bp, Artificial Sequence
  Synthetic
gctgcaatgagacagtcattagagaatacaatgaaacagtaagggttgaaaaggtaacacaatggcacaatacca

SEQ ID NO: 208376 - DNA, 75 bp, Artificial Sequence
  Synthetic
tctggtattttctctgttgaaaacaaaggctgcatcaataggtgtttctatgtggagttgataagaggaaggccg

SEQ ID NO: 208377 - DNA, 75 bp, Artificial Sequence
  Synthetic
ggggctgcccagtgatactccaagaggggaggatgctcaatttactggttcatgcactagccccatggggaatca

SEQ ID NO: 208378 - DNA, 75 bp, Artificial Sequence
  Synthetic
aatcaatcattgtagaatctggtgatccaaatgcattgctgaagcaccgatttgagataattgaaggaagagaca

SEQ ID NO: 208379 - DNA, 75 bp, Artificial Sequence
  Synthetic
tccaaatgcattgctgaagcaccgatttgagataattgaaggaagagacaggactatggcctggacagtagtgaa

SEQ ID NO: 208380 - DNA, 75 bp, Artificial Sequence
  Synthetic
ggggaggatgctcaatttactggttcatgcactagccccatggggaatcaggggtatggtgtaaaaggcttcgga

SEQ ID NO: 208381 - DNA, 75 bp, Artificial Sequence
  Synthetic
ttccatttcattgacgaacagggtgaatcaatcattgtagaatctggtgatccaaatgcattgctgaagcaccga

SEQ ID NO: 208382 - DNA, 75 bp, Artificial Sequence
  Synthetic
ttggaatttctagcatggtggaggcaatggtgtctagggcccggattgatgccagaattgacttcgagtctggaa

SEQ ID NO: 208383 - DNA, 75 bp, Artificial Sequence
  Synthetic
cagatcaggctttgagatactaagggtaaggaatggttggacacaaacaagtaaagagcagattaggaaacaggt

SEQ ID NO: 208384 - DNA, 75 bp, Artificial Sequence
  Synthetic
gtaaggaatggttggacacaaacaagtaaagagcagattaggaaacaggtagttgttgataatttgaactggtcg

SEQ ID NO: 208385 - DNA, 75 bp, Artificial Sequence
  Synthetic
tgtctgggattaatgagtcagctgacatgagcattggtgttacagtaataaagaacaatatgataaacaacgatc

SEQ ID NO: 208386 - DNA, 75 bp, Artificial Sequence
  Synthetic
cttagttccttgtttttgggttgaaatgatcagaggcaagccagaggaaaaaacaatctggacttccagtagctc

SEQ ID NO: 208387 - DNA, 75 bp, Artificial Sequence
  Synthetic
cattgtaatgtgtggagttgatgatgaagttgccgattggtcgtggcacgacggagctattcttccctttgacat

SEQ ID NO: 208388 - DNA, 75 bp, Artificial Sequence
  Synthetic
attaaaatgaaatggggcatggagatgaggcgatgccttcttcaatcccttcaacaaattgagagcatgattgag

SEQ ID NO: 208389 - DNA, 75 bp, Artificial Sequence
  Synthetic
tgagggcaagctttctcaaatgtcaaaagaagtgagtgcccaaattgaaccattcttgaagacaacaccacgccc

SEQ ID NO: 208390 - DNA, 75 bp, Artificial Sequence
  Synthetic
tgctctcagcggtcaaagttcttgctgatggatgctctgaaactaagtattgaagacccgagtcatgaaggggaa

SEQ ID NO: 208391 - DNA, 75 bp, Artificial Sequence
  Synthetic
tgatggatgctctgaaactaagtattgaagacccgagtcatgaaggggaaggaataccactatatgatgcaatca

SEQ ID NO: 208392 - DNA, 75 bp, Artificial Sequence
  Synthetic
tccctttgcattagaatggaccaagcaatagtggacaaaaacatcacattgaaagcaaatttcagtgtgattttc

SEQ ID NO: 208393 - DNA, 75 bp, Artificial Sequence
  Synthetic
ggttatctctccagatttgtcttacagagtcgggtacttgtgtgcaggtctccccagcgacactccaagaggaga

SEQ ID NO: 208394 - DNA, 75 bp, Artificial Sequence
  Synthetic
gtcacgcttaggctatgaaaccttcaaagtcatcaaaggatggtccaaacccaactccaaattacagacaaatag

SEQ ID NO: 208395 - DNA, 75 bp, Artificial Sequence
  Synthetic
gggataccactatatgatgcgatcaaatgcatgaaaacattcttcggctggaaagagcccaacattatcaaacca

SEQ ID NO: 208396 - DNA, 75 bp, Artificial Sequence
  Synthetic
gaatctggaaggattaagaaagaagagtttgctgagatcatgaagatctgttccaccattgaagagctcagacgg

SEQ ID NO: 208397 - DNA, 75 bp, Artificial Sequence
  Synthetic
ggaatgcagaactttctttttgactcagggagctttactgaatgacaagcactccaacgggactgtcaaagatag

SEQ ID NO: 208398 - DNA, 75 bp, Artificial Sequence
  Synthetic
gaagagaagatcccaaagacaaagaacatgaagagaacaagccaattgaagtgggcacttggtgagaatatggca

SEQ ID NO: 208399 - DNA, 75 bp, Artificial Sequence
  Synthetic
gcaaagatgtcggtgatctcaaacagtatgacagcgatgagccagagcctagatctctagcaagctgggtccaaa

SEQ ID NO: 208400 - DNA, 75 bp, Artificial Sequence
  Synthetic
tgaatgcccctaattatcactatgaggaatgctcctgttatcctgatgctggcgaaatcatgtgtgtgtgcaggg

SEQ ID NO: 208401 - DNA, 75 bp, Artificial Sequence
  Synthetic
aagaaaactggaggtccgatctacaggaggagagatgggaaatggatgagagaattgatcctatatgacaaagaa

SEQ ID NO: 208402 - DNA, 75 bp, Artificial Sequence
  Synthetic
tgttgaatgtgactatgccaaataatgacaactttgataaattgtatgtatggggagttcaccacccaagcacaa

SEQ ID NO: 208403 - DNA, 75 bp, Artificial Sequence
  Synthetic
ggctggaaccacacaagtgggaaaagtactgtgttcttgaaataggagacatgctattacgaactgcaataggcc

SEQ ID NO: 208404 - DNA, 75 bp, Artificial Sequence
  Synthetic
acattttctgcctggttttcggtcaagatctttcagggaatgaaaacagtacagcaacactgtgcttgggacatc

SEQ ID NO: 208405 - DNA, 75 bp, Artificial Sequence
  Synthetic
aggttgacacaataatggaaaagaacgttactgttacacatgcccaagacatactggaaaagacacacaacggga

SEQ ID NO: 208406 - DNA, 75 bp, Artificial Sequence
  Synthetic
gatggaagagactgcacactaatagatgccttactgggagaccctcattgtgacgtttttcaggatgagacatgg

SEQ ID NO: 208407 - DNA, 75 bp, Artificial Sequence
  Synthetic
cagcgttcaacccactttttcggtacagagaaaccttcccttcgaaagagcgaccattatggcagcatttacagg

SEQ ID NO: 208408 - DNA, 75 bp, Artificial Sequence
  Synthetic
gaactggttaactaagtcaggaaatgcatatccagtgttgaacgttactatgccaaataatgacaattttgacaa

SEQ ID NO: 208409 - DNA, 75 bp, Artificial Sequence
  Synthetic
aaagaaacacaacagagattgtgtatttgaccaacaccaccatagagaaagaaatatgccccaaaccagcagaat

SEQ ID NO: 208410 - DNA, 75 bp, Artificial Sequence
  Synthetic
tgccaaataatgacaattttgacaaactgtacatctggggagtccatcatccgagtacaaatcaagagcaaacca

SEQ ID NO: 208411 - DNA, 75 bp, Artificial Sequence
  Synthetic
aaggctctaccaaaacccaactacctatatttccattgggacttcaacactaaaccagagattggtaccaaaaat

SEQ ID NO: 208412 - DNA, 75 bp, Artificial Sequence
  Synthetic
gaaataacattccatggagctaaggaggtcgcactcagttactcaaccggtgcacttgccagttgcatgggtctc

SEQ ID NO: 208413 - DNA, 75 bp, Artificial Sequence
  Synthetic
atgcgcattgggaaaagctcaataatgagatcagatgcacccattgagacttgcatttctgaatgcatcactccg

SEQ ID NO: 208414 - DNA, 75 bp, Artificial Sequence
  Synthetic
ccttccaaaatgtaaacaaaatcacatacggggcatgtcccaaatatgttaagcaaaacaccctgaagttggcaa

SEQ ID NO: 208415 - DNA, 75 bp, Artificial Sequence
  Synthetic
gatactaaaatactattcgttgaggaggggaagatcgttcatattagcacattgtcaggaagtgctcagcatgtt

SEQ ID NO: 208416 - DNA, 75 bp, Artificial Sequence
  Synthetic
attgaaaaaacgaatgagaaattccatcagatcgaaaaggagttttccgaagtggaaggaagaattcaggatctt

SEQ ID NO: 208417 - DNA, 75 bp, Artificial Sequence
  Synthetic
gagaaatacgttgaagacacaaagatagatctctggtcttacaatgcagaacttcttgttgctttagagaatcag

SEQ ID NO: 208418 - DNA, 75 bp, Artificial Sequence
  Synthetic
ggaagacggattcctagatgtctggacttataatgctgaacttctggttctcatggagaatgagagaactctaga

SEQ ID NO: 208419 - DNA, 75 bp, Artificial Sequence
  Synthetic
ttataatgctgaacttctggttctcatggagaatgagagaactctagacttccatgactcaaatgtcaagaacct

SEQ ID NO: 208420 - DNA, 75 bp, Artificial Sequence
  Synthetic
agatataccataaatgtgacaatgcttgcatagagtcaattagaaatggaacttataatcatgacatatacagag

SEQ ID NO: 208421 - DNA, 75 bp, Artificial Sequence
  Synthetic
aaccaacgagaaattccatcagattgaaaaagaattctcagaagtagaagggagaattcaggacctcgagaaata

SEQ ID NO: 208422 - DNA, 75 bp, Artificial Sequence
  Synthetic
aacttggtggaataggaatgggccgacgacaaatacagttcattatccaaaagtttacaaaacatacttcgagaa

SEQ ID NO: 208423 - DNA, 75 bp, Artificial Sequence
  Synthetic
ggacgcaactgctggtctaacccatatgatgatctggcattccaatctgaatgatgccacatatcagaggacaag

SEQ ID NO: 208424 - DNA, 75 bp, Artificial Sequence
  Synthetic
aaaacttcccggaagtgacaacagcatggcaacgctgtgcctgggacaccatgcagtgccaaacggaacattagt

SEQ ID NO: 208425 - DNA, 75 bp, Artificial Sequence
  Synthetic
atggcaacgctgtgcctgggacaccatgcagtgccaaacggaacattagtgaaaacaatcacggatgaccaaatt

SEQ ID NO: 208426 - DNA, 75 bp, Artificial Sequence
  Synthetic
tccagagttcctcaacaggtagaatatgcaacagtcctcaccaaatccttgatgggaaaaattgcacactgatag

SEQ ID NO: 208427 - DNA, 75 bp, Artificial Sequence
  Synthetic
tgatgacttccaaaacaaggaatgggacctttttgttgaacgaagcacagcctacagcagctgttacccttatta

SEQ ID NO: 208428 - DNA, 75 bp, Artificial Sequence
  Synthetic
tctagctatgcctgcagaaggggatctgttaacagtttctttagtagattgaattggttgtataacttgaattac

SEQ ID NO: 208429 - DNA, 75 bp, Artificial Sequence
  Synthetic
agactttgatactactaagggctttcactgaggagggagcaatcgttggagaaatttcaccattaccttctcttc

SEQ ID NO: 208430 - DNA, 75 bp, Artificial Sequence
  Synthetic
attgtacatttggggggttcaccacccgggtacggacaaggaccaaaccaacctatatgtccaagcatcagggag

SEQ ID NO: 208431 - DNA, 75 bp, Artificial Sequence
  Synthetic
tctgaccaacaccaccatagagaaggaaatatgccccaaaccagcagaatacagaaattggtcaaagccgcaatg

SEQ ID NO: 208432 - DNA, 75 bp, Artificial Sequence
  Synthetic
ccgggtacggacaaggaccaaaccaacctatatgtccaagcatcagggagagttatagtctctaccaaaagaagc

SEQ ID NO: 208433 - DNA, 75 bp, Artificial Sequence
  Synthetic
caacaaacggtaatcccgaatatcgggtctagaccctgggtaaggggtgtctccagcataataagcatctattgg

SEQ ID NO: 208434 - DNA, 75 bp, Artificial Sequence
  Synthetic
ggtctagaccctgggtaaggggtgtctccagcataataagcatctattggacgatagtaaaaccgggagacatac

SEQ ID NO: 208435 - DNA, 75 bp, Artificial Sequence
  Synthetic
ttttaaggcattttcagaaagatgcgaaagtgctttttcaaaattggggagttgaacacatcgacagtgtgatgg

SEQ ID NO: 208436 - DNA, 75 bp, Artificial Sequence
  Synthetic
ttttgattaacagcacagggaatctaattgcccctcggggttacttcaaaatacaaagtgggaaaagctcaataa

SEQ ID NO: 208437 - DNA, 75 bp, Artificial Sequence
  Synthetic
atgcaattctgaatgcattactccaaatggaagcattcccaatgacaaaccttttcaaaatgtaaacaagatcac

SEQ ID NO: 208438 - DNA, 75 bp, Artificial Sequence
  Synthetic
caggaatgcggaatgtaccagagaaacaaactagaggcatattcggcgcaattgcaggtttcatagaaaatggtt

SEQ ID NO: 208439 - DNA, 75 bp, Artificial Sequence
  Synthetic
acaaactagaggcatattcggcgcaattgcaggtttcatagaaaatggttgggagggaatggtagacggttggta

SEQ ID NO: 208440 - DNA, 75 bp, Artificial Sequence
  Synthetic
aaataggcaagtcatagttgacagaggtaataggtccggttattctggtattttctctgttgaaggcaaaagctg

SEQ ID NO: 208441 - DNA, 75 bp, Artificial Sequence
  Synthetic
atgcaacagtcctcatcagatccttgatggagaaaactgcacactaatagatgctctattgggagaccctcagtg

SEQ ID NO: 208442 - DNA, 75 bp, Artificial Sequence
  Synthetic
tagatctctggtcttacaacgctgagcttcttgttgccctggagaaccaacatacaattgatttaaccgactcag

SEQ ID NO: 208443 - DNA, 75 bp, Artificial Sequence
  Synthetic
gtacaataagatggagtttgaaccgttccaatccttggtacccaaagctgccagaggtcaatacagtgggtttgt

SEQ ID NO: 208444 - DNA, 75 bp, Artificial Sequence
  Synthetic
gtttttacagaaatctgatatggctgacagtgaaaaatggtttgtacccaaacctgagcaagtcctatgaaaacg

SEQ ID NO: 208445 - DNA, 75 bp, Artificial Sequence
  Synthetic
cgcaggtgcattaacagaggatccagatgagggaacagctggagtggaatctgcagtactgaggggattcctaat

SEQ ID NO: 208446 - DNA, 75 bp, Artificial Sequence
  Synthetic
gacagtgaaaaatggtttgtacccaaacctgagcaagtcctatgaaaacgacaaagggaaagaagtccttatttt

SEQ ID NO: 208447 - DNA, 75 bp, Artificial Sequence
  Synthetic
gatcaaaggtgttcagctaaagtcaggatacaaagattggatcctatggatttcctttgccatatcatgcttttt

SEQ ID NO: 208448 - DNA, 75 bp, Artificial Sequence
  Synthetic
tttcctttgccatatcatgctttttgctttgtgttgttctgctggggttcattatgtgggcctgccaaaaaggca

SEQ ID NO: 208449 - DNA, 75 bp, Artificial Sequence
  Synthetic
atatggcaatggtgtctggatcgggaggaccaaaagcactcattccaggagcggctttgaaatgatttgggatcc

SEQ ID NO: 208450 - DNA, 75 bp, Artificial Sequence
  Synthetic
gctttgtgttgttctgctggggttcattatgtgggcctgccaaaaaggcaacattaggtgcaacatttgcatttg

SEQ ID NO: 208451 - DNA, 75 bp, Artificial Sequence
  Synthetic
aagaatatcgaaaggaacagcagagtgctgtggatgctgacgacagtcattttgtcagcatagagttggagtaaa

SEQ ID NO: 208452 - DNA, 75 bp, Artificial Sequence
  Synthetic
accacgccctctcagactacctgaggggcctccctgctcccagcggtcgaagttcttactgatggatgcccttaa

SEQ ID NO: 208453 - DNA, 75 bp, Artificial Sequence
  Synthetic
cacaaaatgccattaacgggattacaaacaaggtgaattctgtaattgagaaaatgaacactcaattcacagctg

SEQ ID NO: 208454 - DNA, 75 bp, Artificial Sequence
  Synthetic
tcaagttaaaataagaaggagagttgatacaaaccctggccatgcagatctcagtgccaaggaggcacaggatgt

SEQ ID NO: 208455 - DNA, 75 bp, Artificial Sequence
  Synthetic
atggcgtctcaaggcaccaaacgatcctatgaacagatggaaactggtggagaacgccagaatgccactgagatc

SEQ ID NO: 208456 - DNA, 75 bp, Artificial Sequence
  Synthetic
tgaagaaggtggtcatggggtgaaaggctgggcctttgatgatggaaatgacgtgtggatgggaagaacaatcaa

SEQ ID NO: 208457 - DNA, 75 bp, Artificial Sequence
  Synthetic
tggcacagcatcattgagtcctggaatgatgatgggcatgttcaacatgctaagtacagttttaggagtctcgat

SEQ ID NO: 208458 - DNA, 75 bp, Artificial Sequence
  Synthetic
ctgatgatctggcattccaatctaaatgatgccacataccaaagaacaagagctcttgtgcgtactggaatggac

SEQ ID NO: 208459 - DNA, 75 bp, Artificial Sequence
  Synthetic
aaacggttgtttcgagttctatcacaaatgtgataatgaatgtatggaaagtgtaagaaacgggacgtatgacta

SEQ ID NO: 208460 - DNA, 75 bp, Artificial Sequence
  Synthetic
agtgctgggtaactacaaggagatatgtgtagcttggtcaagtagcagttgtttcgatggaaaggaatggatgca

SEQ ID NO: 208461 - DNA, 75 bp, Artificial Sequence
  Synthetic
gtgtaagaaacgggacgtatgactacccgcagtattcagaagaagcaagattaaaaagagaggaaataagtggag

SEQ ID NO: 208462 - DNA, 75 bp, Artificial Sequence
  Synthetic
gaaaggggagaaagctaatgtgttgatagggcaaggagacgtggtgttggtaatgaaacggaaacgggactctag

SEQ ID NO: 208463 - DNA, 75 bp, Artificial Sequence
  Synthetic
gacacttgttatccatttgatgtgccggattaccagagcttgcggagtatcctagcaaacaatgggaaatttgag

SEQ ID NO: 208464 - DNA, 75 bp, Artificial Sequence
  Synthetic
atggaacttgtacagtagtaatgactgatggaagtgcatcaggaagagctgatactaaaatattattcattaaag

SEQ ID NO: 208465 - DNA, 75 bp, Artificial Sequence
  Synthetic
atgaacactcaaatcctagtattcgctctgattgcgatcattccaacaaatgcagacaaaatctgcctcggacat

SEQ ID NO: 208466 - DNA, 75 bp, Artificial Sequence
  Synthetic
tctcttactgacccgaggctggagccacacaagtgggaaaagtactgtgttctcgagataggagacatgctccta

SEQ ID NO: 208467 - DNA, 75 bp, Artificial Sequence
  Synthetic
agtcgaagcccaggaaacgctgagattgaagacctcattttcctggcacggtcagcactcattctgaggggatca

SEQ ID NO: 208468 - DNA, 75 bp, Artificial Sequence
  Synthetic
acattcttaaaggaaaatttcaaacagctgcacaaagagcaatggtggatcaagtgagagaaagtcggaacccag

SEQ ID NO: 208469 - DNA, 75 bp, Artificial Sequence
  Synthetic
acaagcaaatcatgttcagattcattctacaggaatatgagatggctaactcaaaagaacgggaattatcctgtt

SEQ ID NO: 208470 - DNA, 75 bp, Artificial Sequence
  Synthetic
atggattcgaaccaaacggctgcattgagggcaagctttctcaaatgtcaaaagaagtgaatgcccaaattgaac

SEQ ID NO: 208471 - DNA, 75 bp, Artificial Sequence
  Synthetic
cattgctttgagctacattctatgtctagttttcgctcaagaacttcctggaaatgacgacagcacggcaacgct

SEQ ID NO: 208472 - DNA, 75 bp, Artificial Sequence
  Synthetic
atagatcctttccgtctgcttcaaaacagccaggtctttagtctcattagaccaaatgagaacccagcacacaag

SEQ ID NO: 208473 - DNA, 75 bp, Artificial Sequence
  Synthetic
atggatgtcaatccgaccctacttttcttaaaggttccaacgcaaaatgccataagcaccacattcccttatact

SEQ ID NO: 208474 - DNA, 75 bp, Artificial Sequence
  Synthetic
gaaatgtcttaagcattgctcctataatgttctcaaacaaaatggcaagattaggaaaaggatacatgttcgaaa

SEQ ID NO: 208475 - DNA, 75 bp, Artificial Sequence
  Synthetic
agcaaaagcaggggaaaataaaaacaaccaaaatgaaggcaaacctactggtcctgttatgtgcacttgcagctg

SEQ ID NO: 208476 - DNA, 75 bp, Artificial Sequence
  Synthetic
gtcctgttatgtgcacttgcagctgcagatgcagacacaatatgtataggctaccatgcgaacaattcaaccgac

SEQ ID NO: 208477 - DNA, 75 bp, Artificial Sequence
  Synthetic
cagatgcagacacaatatgtataggctaccatgcgaacaattcaaccgacactgttgacacagtgctcgagaaga

SEQ ID NO: 208478 - DNA, 75 bp, Artificial Sequence
  Synthetic
aaaaggcagttgacaaaataacatccaaggtgaacaatatagtcgacaagatgaacaagcaatatgaaataattg

SEQ ID NO: 208479 - DNA, 75 bp, Artificial Sequence
  Synthetic
aaactatgtagattaaaaggaatagccccactacaattggggaaatgtaacatcgccggatggctcttgggaaac

SEQ ID NO: 208480 - DNA, 75 bp, Artificial Sequence
  Synthetic
caactcccccccaaacaaccaagtaatgctgtgtgaaccaacaataatagaaaagaacacaacagagattgtgta

SEQ ID NO: 208481 - DNA, 75 bp, Artificial Sequence
  Synthetic
ccccactacaattggggaaatgtaacatcgccggatggctcttgggaaacccagaatgcgacccactgcttccag

SEQ ID NO: 208482 - DNA, 75 bp, Artificial Sequence
  Synthetic
tgttatccaggagatttcatcgactatgaggagctgagggagcaattgagctcagtgtcatcattcgaaagattc

SEQ ID NO: 208483 - DNA, 75 bp, Artificial Sequence
  Synthetic
ctaaagaagctgtgggatcaaacccaatcaaaggcagggttattagtatctgatggagggccaaatttatacaat

SEQ ID NO: 208484 - DNA, 75 bp, Artificial Sequence
  Synthetic
gtcccagatatgtcaagcaaaacactctgaaattggcaacaggaatgagaaatgtaccagagaaacaaactagag

SEQ ID NO: 208485 - DNA, 75 bp, Artificial Sequence
  Synthetic
atgaggagctgagggagcaattgagctcagtgtcatcattcgaaagattcgaaatatttcccaaagaaagctcat

SEQ ID NO: 208486 - DNA, 75 bp, Artificial Sequence
  Synthetic
gtggatggttggtacggtttcaggcatcaaaattctgagggaaggggacaagcagcagatctcaaaagcactcaa

SEQ ID NO: 208487 - DNA, 75 bp, Artificial Sequence
  Synthetic
gggaaaagcagtttttacagaaatttgctatggctgacggagaaggagggctcatacccaaagctgaaaaattct

SEQ ID NO: 208488 - DNA, 75 bp, Artificial Sequence
  Synthetic
tgctatggctgacggagaaggagggctcatacccaaagctgaaaaattcttatgtgaacaagaaagggaaagaag

SEQ ID NO: 208489 - DNA, 75 bp, Artificial Sequence
  Synthetic
aatatctatcagaatgaaaatgcttatgtctctgtagtgacttcaaattataacaggagatttaccccggaaata

SEQ ID NO: 208490 - DNA, 75 bp, Artificial Sequence
  Synthetic
atgtctctgtagtgacttcaaattataacaggagatttaccccggaaatagcagaaagacccaaagtaagagatc

SEQ ID NO: 208491 - DNA, 75 bp, Artificial Sequence
  Synthetic
ataatatttgaggcaaatggaaatctaatagcaccaaggtatgctttcgcactgagtagaggctttgggtccggc

SEQ ID NO: 208492 - DNA, 75 bp, Artificial Sequence
  Synthetic
taatagcaccaaggtatgctttcgcactgagtagaggctttgggtccggcatcatcacctcaaacgcatcaatgc

SEQ ID NO: 208493 - DNA, 75 bp, Artificial Sequence
  Synthetic
ctccctttccagaatatacacccagtcacaataggagagtgcccaaaatacgtcaggagtgccaaattgaggatg

SEQ ID NO: 208494 - DNA, 75 bp, Artificial Sequence
  Synthetic
tcttgaaagtgccagtgcaaaatgctataagtaccacgttcccttatactggagaccctccatacagccatggaa

SEQ ID NO: 208495 - DNA, 75 bp, Artificial Sequence
  Synthetic
tcacaataggagagtgcccaaaatacgtcaggagtgccaaattgaggatggttacaggactaaggaacattccgt

SEQ ID NO: 208496 - DNA, 75 bp, Artificial Sequence
  Synthetic
tgttgttgccgcgaatatcattgggatcttgcacttgatattgtggattcttgatcgtctttttttcaaatgcat

SEQ ID NO: 208497 - DNA, 75 bp, Artificial Sequence
  Synthetic
ggctttccttgaagaatctcacccagggatctttgaaaactcgtgtcttgaaacgatggaaattgttcagcaaac

SEQ ID NO: 208498 - DNA, 75 bp, Artificial Sequence
  Synthetic
ggatggactggaatgatagatggatggtacggttatcatcatcagaatgaacagggatcaggctatgcagcggat

SEQ ID NO: 208499 - DNA, 75 bp, Artificial Sequence
  Synthetic
tgttatcgagaaaatgaacattcaattcacagctgtgggtaaagaattcaacaaattagaaaaaaggatggaaaa

SEQ ID NO: 208500 - DNA, 75 bp, Artificial Sequence
  Synthetic
cagaattgttagttctactggaaaatgaaaggactctggatttccatgactcaaatgtgaagaatctgtatgaga

SEQ ID NO: 208501 - DNA, 75 bp, Artificial Sequence
  Synthetic
tgaaaggactctggatttccatgactcaaatgtgaagaatctgtatgagaaagtaaaaagccaattaaagaataa

SEQ ID NO: 208502 - DNA, 75 bp, Artificial Sequence
  Synthetic
cacaagatgtcatcatggaggtcgtattcccaaacgaagttggagccagaatattgacatcagagtcacagttaa

SEQ ID NO: 208503 - DNA, 75 bp, Artificial Sequence
  Synthetic
atgaatgcatggaaagtgtaagaaatgggacttatgattatcccaaatattcagaagagtcaaagttgaacaggg

SEQ ID NO: 208504 - DNA, 75 bp, Artificial Sequence
  Synthetic
tgggacttatgattatcccaaatattcagaagagtcaaagttgaacagggaaaaggtagatggagtgaaattgga

SEQ ID NO: 208505 - DNA, 75 bp, Artificial Sequence
  Synthetic
cactggtgcttttggtctccctgggggcaatcagtttctggatgtgttctaatggatctttgcagtgcagaatat

SEQ ID NO: 208506 - DNA, 75 bp, Artificial Sequence
  Synthetic
ggcaatcagtttctggatgtgttctaatggatctttgcagtgcagaatatgcatctgagattagaatttcagaaa

SEQ ID NO: 208507 - DNA, 75 bp, Artificial Sequence
  Synthetic
taatagtaagtgggagagacgagcagtcaattgctgaggcaataattgtggccatggtattttcacaagaggatt

SEQ ID NO: 208508 - DNA, 75 bp, Artificial Sequence
  Synthetic
aacaatagagagaatggtgctctctgcttttgatgagagaagaaataaatacctagaagagcatcccagtgctgg

SEQ ID NO: 208509 - DNA, 75 bp, Artificial Sequence
  Synthetic
atggagagaataaaggaactaagagatttgatgtcgcagtctcgcactcgcgagatactgacaaaaaccacagtg

SEQ ID NO: 208510 - DNA, 75 bp, Artificial Sequence
  Synthetic
catttgacactgtccaaataataaaacttctcccctttgctgctgctccaccggaacagagtaggatgcagttct

SEQ ID NO: 208511 - DNA, 75 bp, Artificial Sequence
  Synthetic
gttgcacataaatcttgcctgcctgcttgtgtgtatgggcttgcagtggcaagtgggcatgactttgaaagggaa

SEQ ID NO: 208512 - DNA, 75 bp, Artificial Sequence
  Synthetic
aatgtgcactgaactcaaactcagtgacaatgaagggaggctgattcagaacagcataacaatagagagaatggt

SEQ ID NO: 208513 - DNA, 75 bp, Artificial Sequence
  Synthetic
tctctctgcatttgatgaaagaaggaacagatacctggaagaacatcccaatgcggggaaggacccaaagaagac

SEQ ID NO: 208514 - DNA, 75 bp, Artificial Sequence
  Synthetic
aggatttctgattctgggcaaagaagacaaaagatatgggccagcattgagcatcaacgaattgagcaatcttgc

SEQ ID NO: 208515 - DNA, 75 bp, Artificial Sequence
  Synthetic
gaaattttccaccagtgtgacaacaactgcatcgaaagcataagaaatggaacatatgaccatgatatttacaga

SEQ ID NO: 208516 - DNA, 75 bp, Artificial Sequence
  Synthetic
cagtaacccatcgaataatcaagtgatgccatgtgaaccgatcataatagagaggaacacagtgcatttgaatag

SEQ ID NO: 208517 - DNA, 75 bp, Artificial Sequence
  Synthetic
agaggaacacagtgcatttgaatagtactaccatagagagggaaatttgtcctaaagtggcagaatacaagaatt

SEQ ID NO: 208518 - DNA, 75 bp, Artificial Sequence
  Synthetic
atggcgtctcaaggcaccaaacgatcttatgaacaaatggaaactggtggagagcgccagaatgctactgagatc

SEQ ID NO: 208519 - DNA, 75 bp, Artificial Sequence
  Synthetic
tctagttcaagctgctatgatggaaaagcatggttacatatttgtgttactggggatgataaaaatgctactgct

SEQ ID NO: 208520 - DNA, 75 bp, Artificial Sequence
  Synthetic
gctgaaattgaagatctcatcttcctggcacgatctgcactcatcctgagaggatcagtagcccataagtcctgc

SEQ ID NO: 208521 - DNA, 75 bp, Artificial Sequence
  Synthetic
tggcacgatctgcactcatcctgagaggatcagtagcccataagtcctgcctgcctgcatgtgtatacggccttg

SEQ ID NO: 208522 - DNA, 75 bp, Artificial Sequence
  Synthetic
gtggcattgggaggttctacatacagatgtgcacagaactcaaactcagtgactatgaagggagactgatccaga

SEQ ID NO: 208523 - DNA, 75 bp, Artificial Sequence
  Synthetic
aaaaacaagatttctcccagtttctggaggaacaagcagtatatacattgaagttttacatttgactcagggaac

SEQ ID NO: 208524 - DNA, 75 bp, Artificial Sequence
  Synthetic
gtgcggggaaggacccgaagaaaactggaggcccaatttatcggaggagagacggaaagtgggtgagggagctga

SEQ ID NO: 208525 - DNA, 75 bp, Artificial Sequence
  Synthetic
ttctgtacgacaaagaggagatcaggaggatttggcgtcaagcgaacaatggagaggacgcaactgctggtctta

SEQ ID NO: 208526 - DNA, 75 bp, Artificial Sequence
  Synthetic
tcctgttatccccgatatcctgaagttaggtgtgtttgcagagacaattggaagggctccaataggcccattata

SEQ ID NO: 208527 - DNA, 75 bp, Artificial Sequence
  Synthetic
agactggccccaagaggacaactatcgacgagaggagttcaaatagcttcgaatgagaacatggaaacaatagac

SEQ ID NO: 208528 - DNA, 75 bp, Artificial Sequence
  Synthetic
ttgagtccagttatgtgtgctcaggacttgttggcgacacaccaagaaatgatgatagctccagcagcagcaact

SEQ ID NO: 208529 - DNA, 75 bp, Artificial Sequence
  Synthetic
tgcatatgagagaatgtgcaacatcctcaaagggaaattccaaacagcagcacaaagagcaatgatggatcaagt

SEQ ID NO: 208530 - DNA, 75 bp, Artificial Sequence
  Synthetic
ctcaaagggaaattccaaacagcagcacaaagagcaatgatggatcaagtgcgagagagcagaaatcctggaaat

SEQ ID NO: 208531 - DNA, 75 bp, Artificial Sequence
  Synthetic
aagggtggataaactaactcaaggtcgccagacttatgattggacattaaacagaaatcaaccggcagcaactgc

SEQ ID NO: 208532 - DNA, 75 bp, Artificial Sequence
  Synthetic
attcaaagtcacagataaataggcaagtcatagttgacagtgacgactggtctgggtattccggcatcttctctg

SEQ ID NO: 208533 - DNA, 75 bp, Artificial Sequence
  Synthetic
atggaaagaatagtgattgcccttgcaatagtaagcattgccacaggtgaccgaatctgcattggttatcatgca

SEQ ID NO: 208534 - DNA, 75 bp, Artificial Sequence
  Synthetic
aggatcagtggcccataagtcctgcttgcctgcttgtgtatacggacttgcagtggccagtggatatgactttga

SEQ ID NO: 208535 - DNA, 75 bp, Artificial Sequence
  Synthetic
ccgaatctgcattggttatcatgcaaacaattcaacgaagcaggttgacacaatcatggagaagaatgtgacggt

SEQ ID NO: 208536 - DNA, 75 bp, Artificial Sequence
  Synthetic
aacaattcaacgaagcaggttgacacaatcatggagaagaatgtgacggtaacacatgctcaggacatactggaa

SEQ ID NO: 208537 - DNA, 75 bp, Artificial Sequence
  Synthetic
tctgaaagactgcaatgtagctggatggcttcttggaaatccaatgtgtgatgaattcctaaatgtaccggaatg

SEQ ID NO: 208538 - DNA, 75 bp, Artificial Sequence
  Synthetic
tggcttcttggaaatccaatgtgtgatgaattcctaaatgtaccggaatggtcatacattgtggaaaaagataat

SEQ ID NO: 208539 - DNA, 75 bp, Artificial Sequence
  Synthetic
gaagcatttcatgagcagcacaaaccatttagagaaaattcagatatttcctaggagctcttggtccaaccatga

SEQ ID NO: 208540 - DNA, 75 bp, Artificial Sequence
  Synthetic
catttagagaaaattcagatatttcctaggagctcttggtccaaccatgatgcctcatcaggagtgagctcagca

SEQ ID NO: 208541 - DNA, 75 bp, Artificial Sequence
  Synthetic
gcatctgcagggcagatcagcgttcagcccactttctcggtacagagaaaccttccctttgaaagagcgaccatt

SEQ ID NO: 208542 - DNA, 75 bp, Artificial Sequence
  Synthetic
ccagataataaagcttctcccttttgcagctgctccaccaaagcaaagcagaatgcagttctcttcactgactgt

SEQ ID NO: 208543 - DNA, 75 bp, Artificial Sequence
  Synthetic
caagaagaacaatgtgtaccgaacaataacaaggacatacaaaaacaccaatgtagaagaccttttagtattatg

SEQ ID NO: 208544 - DNA, 75 bp, Artificial Sequence
  Synthetic
atggattccaacactgtgtcaagctttcaggtagactgctttctttggcatgtccgcaaacgatttgcagaccaa

SEQ ID NO: 208545 - DNA, 75 bp, Artificial Sequence
  Synthetic
ataacaaggacatacaaaaacaccaatgtagaagaccttttagtattatggggaattcaccaccctaatgatgca

SEQ ID NO: 208546 - DNA, 75 bp, Artificial Sequence
  Synthetic
aacatcaacactgaatcagaggtcaatcccagaaatagccaccagacccaaagtgaatggacagagtggaaggat

SEQ ID NO: 208547 - DNA, 75 bp, Artificial Sequence
  Synthetic
accggctccgccgagatcagaagtccctaagaggaagaggcaacactcttggtctggacatcgaaacagctactc

SEQ ID NO: 208548 - DNA, 75 bp, Artificial Sequence
  Synthetic
gtactgggaactttatagctcccgagtatgcatacaggattgttaaaaaaggaaactcagcaattatgaaaagtg

SEQ ID NO: 208549 - DNA, 75 bp, Artificial Sequence
  Synthetic
aaagcaaacttcagtgtgatttttgaccgattagaaaccctaatactgcttagagctttcacagaggaaggagca

SEQ ID NO: 208550 - DNA, 75 bp, Artificial Sequence
  Synthetic
atgtccatccccttaccattggggagtgccccaagtatgtcaaattgaaaaagctggtccttgcaacagggctaa

SEQ ID NO: 208551 - DNA, 75 bp, Artificial Sequence
  Synthetic
cggtctgctctcattctgagggggtcagtggctcataagtcttgcctgcctgcttgtgtgtatggacttgctgtg

SEQ ID NO: 208552 - DNA, 75 bp, Artificial Sequence
  Synthetic
aattcagacaagaagatcattcgagctaaagagcctgtgggatcaaacccaatcaaaagcaggattattagtatc

SEQ ID NO: 208553 - DNA, 75 bp, Artificial Sequence
  Synthetic
tttatagaaggaggatggcaaggaatggtagatggatggtatggataccatcatagcaatgagcaaggtagcgga

SEQ ID NO: 208554 - DNA, 75 bp, Artificial Sequence
  Synthetic
agtgcagaatgtttgccctcagccaaggtaccacactaaggggtcggcatgcaaatgggactatacatgacagaa

SEQ ID NO: 208555 - DNA, 75 bp, Artificial Sequence
  Synthetic
tggtagatggatggtatggataccatcatagcaatgagcaaggtagcggatatgctgcggataaagaatctacac

SEQ ID NO: 208556 - DNA, 75 bp, Artificial Sequence
  Synthetic
atgaacactcaattcgaagccattgggaaagaattcaacaacctagaaaagagaatagagaatttgaataagaaa

SEQ ID NO: 208557 - DNA, 75 bp, Artificial Sequence
  Synthetic
ggaaagaattcaacaacctagaaaagagaatagagaatttgaataagaaaatggaagacggctttatagatgtat

SEQ ID NO: 208558 - DNA, 75 bp, Artificial Sequence
  Synthetic
accccgcactcaggatgaaatggatgatggcaatgaaatatccaatcacagcagacaagagaataatggaaatga

SEQ ID NO: 208559 - DNA, 75 bp, Artificial Sequence
  Synthetic
gatctccatgattcaaatgttaagaacttatacgatagggtccgacatcagctgagagacaatgcaaaggaatta

SEQ ID NO: 208560 - DNA, 75 bp, Artificial Sequence
  Synthetic
acaggaagtgcacagcatatagaggaatgctcatgctatggagcagaagaggtgattaaatgcatttgcagggac

SEQ ID NO: 208561 - DNA, 75 bp, Artificial Sequence
  Synthetic
cacctctggctgtgacatggtggaataggaatggaccaacaacaagtacagtccactacccaaaggtatacaaaa

SEQ ID NO: 208562 - DNA, 75 bp, Artificial Sequence
  Synthetic
aagtgtgaggaatggaacgtatgactatccgcaatactcagaagaatcaagaatgaaaagggaggagatagacgg

SEQ ID NO: 208563 - DNA, 75 bp, Artificial Sequence
  Synthetic
catttcagaaatcaagttaagataagacgaagggtcgatataaacccaggccatgcagacctcagtgccaaagag

SEQ ID NO: 208564 - DNA, 75 bp, Artificial Sequence
  Synthetic
gacgaagggtcgatataaacccaggccatgcagacctcagtgccaaagaggcgcaggatgtaattatggaagttg

SEQ ID NO: 208565 - DNA, 75 bp, Artificial Sequence
  Synthetic
tcacgctcaccgtgcccagtgagcgaggactgcagcgtagacgctttgtccagaatgccctaaatggaaatggag

SEQ ID NO: 208566 - DNA, 75 bp, Artificial Sequence
  Synthetic
ctacggaagtggcttttggcctagtgtgtgccacttgtgagcagattgcagattcacagcatcggtctcacagac

SEQ ID NO: 208567 - DNA, 75 bp, Artificial Sequence
  Synthetic
acagcataacaatagaaagaatggttctctctgcatttgatgaaaggaggaacaaatacctggaagaacatccca

SEQ ID NO: 208568 - DNA, 75 bp, Artificial Sequence
  Synthetic
ggtctgttcggtgcaatagcaggattcatagaaaatggatgggagggaatgatagatggttggtatggtttcagg

SEQ ID NO: 208569 - DNA, 75 bp, Artificial Sequence
  Synthetic
taaatggaaatggagatccaaacaacatggataaggcagttaaactatacaggaagctgaaaagagagataacat

SEQ ID NO: 208570 - DNA, 75 bp, Artificial Sequence
  Synthetic
gtgtgccacttgtgagcagattgcagattcacagcatcggtctcacagacagatggcaaccatcaccaacccact

SEQ ID NO: 208571 - DNA, 75 bp, Artificial Sequence
  Synthetic
tggaggtccaatttatcggaggagagacgggaaatggatgagagagctgattctgtatgacaaagaggagatcag

SEQ ID NO: 208572 - DNA, 75 bp, Artificial Sequence
  Synthetic
atagtagcactctgtggatccaaggagcgattgggatcttggtcatggcatgatggggctgaaatcatctacttt

SEQ ID NO: 208573 - DNA, 75 bp, Artificial Sequence
  Synthetic
gaaaaggggaaatggacaacaaactcagagactggagcaccccaacttaacccaattgatggaccactgcctgag

SEQ ID NO: 208574 - DNA, 75 bp, Artificial Sequence
  Synthetic
acaggaatcagccggctgcaactgcattagctaatactatagaggtcttcagatcgaacggtctgacagctaatg

SEQ ID NO: 208575 - DNA, 75 bp, Artificial Sequence
  Synthetic
gcaggcagcggaagccatggagattgctaatcaggctaggcagatggtgcaggcaatgaggacaattgggactca

SEQ ID NO: 208576 - DNA, 75 bp, Artificial Sequence
  Synthetic
taaggatggtcgacatccttcggcaaaatccaacagaggagcaagctgtggacatatgtaaggcagcaatgggct

SEQ ID NO: 208577 - DNA, 75 bp, Artificial Sequence
  Synthetic
gattcacagcatcggtctcacagacagatggcaaccatcaccaacccactaatcaggcatgaaaacagaatggtg

SEQ ID NO: 208578 - DNA, 75 bp, Artificial Sequence
  Synthetic
tggaccccagaatgtgctctctgatgcaaggatcaactctcccgaggagatctggagctgctggtgcagcagtaa

SEQ ID NO: 208579 - DNA, 75 bp, Artificial Sequence
  Synthetic
ttgatcgtcttttcttcaaatgcatttatcgtcgccttaaatacggtttgaaaagagggccttctacggaaggag

SEQ ID NO: 208580 - DNA, 75 bp, Artificial Sequence
  Synthetic
ccggcaggaacagcagagtgctgtggatgttgacgatggtcattttgtcaacatagagttggagtaaaaaactac

SEQ ID NO: 208581 - DNA, 75 bp, Artificial Sequence
  Synthetic
gcagaatacagaaattggtcaaagccgcaatgtgacattacaggatttgcacctttttctaaggacaattcgatt

SEQ ID NO: 208582 - DNA, 75 bp, Artificial Sequence
  Synthetic
taaacaacgtgcattcaaataacacagtacgtgataggaccccttatcggaccctattgatgaatgagttaggtg

SEQ ID NO: 208583 - DNA, 75 bp, Artificial Sequence
  Synthetic
cagcgactgaatcccatgcaccaactcttgaggcatttccaaaaagatgcaaaagtgcttttccagaactgggga

SEQ ID NO: 208584 - DNA, 75 bp, Artificial Sequence
  Synthetic
accctattgatgaatgagttaggtgttccttttcatctggggaccaagcaagtgtgcatagcatggtccagctca

SEQ ID NO: 208585 - DNA, 75 bp, Artificial Sequence
  Synthetic
gataatgagcccagtgggtatgcacaaacagattgtgtattggaagcaatggctttccttgaagaatcccaccca

SEQ ID NO: 208586 - DNA, 75 bp, Artificial Sequence
  Synthetic
gagagggataagagtcagtaagatgggagtagatgaatactccagtacagagagagtagtagtgagcatcgaccg

SEQ ID NO: 208587 - DNA, 75 bp, Artificial Sequence
  Synthetic
aaggcctcttctaatagatggtacagcctcattgagccctggaatgatgatgggcatgttcaacatgctaagtac

SEQ ID NO: 208588 - DNA, 75 bp, Artificial Sequence
  Synthetic
tgtatcaatggaacttgtacagtagtaatgactgatgggagtgcttcaggaaaagctgatactaaaatactattc

SEQ ID NO: 208589 - DNA, 75 bp, Artificial Sequence
  Synthetic
aagtcagcgagacacaaggaacagaaaaattgacaattacttattcgtcatcaatgatgtgggagatcaatgggc

SEQ ID NO: 208590 - DNA, 75 bp, Artificial Sequence
  Synthetic
gaccccaagcacggaaatgtcgctgagagggataagagtcagcaaaatgggagtagatgaatattccagcacgga

SEQ ID NO: 208591 - DNA, 75 bp, Artificial Sequence
  Synthetic
agtcaatagaacacatcaatattcagagaaagggaaatggacaacaaacacagagactggggcacctcaactcaa

SEQ ID NO: 208592 - DNA, 75 bp, Artificial Sequence
  Synthetic
acagtcaggtcttcagtctcattagaccaaatgagaatccagcacacaagagtcaactggtgtggatggcatgcc

SEQ ID NO: 208593 - DNA, 75 bp, Artificial Sequence
  Synthetic
aaacgatggaaattgttcaacaaacaagagtggacaaactgacccaaggtcgccagacttatgactggacattga

SEQ ID NO: 208594 - DNA, 75 bp, Artificial Sequence
  Synthetic
ggctttccttgaagaatcccacccagggatctttgaaaactcatgccttgaaacgatggaagttattcagcaaac

SEQ ID NO: 208595 - DNA, 75 bp, Artificial Sequence
  Synthetic
cacaagttttttctatcgctatggatttgtagccaacttcagcatggagttgcccagctttggagtgtctgggat

SEQ ID NO: 208596 - DNA, 75 bp, Artificial Sequence
  Synthetic
aagttgacaataacttattcgtcatcaatgatgtgggagatcaacggtcctgagtcagtgctggtcaacacttat

SEQ ID NO: 208597 - DNA, 75 bp, Artificial Sequence
  Synthetic
ggaattctttgaaaacaaatcagaaacatggccaattggggagtcacccaagggggtggaagaaggctcgattgg

SEQ ID NO: 208598 - DNA, 75 bp, Artificial Sequence
  Synthetic
atcggtgtcacagaggagacacacaaattcagacaaggaggtcattcgagctgaagaaattgtgggaacaaaccc

SEQ ID NO: 208599 - DNA, 75 bp, Artificial Sequence
  Synthetic
aattcagacaaggaggtcattcgagctgaagaaattgtgggaacaaacccgctcaaaagcaggactgctggtttc

SEQ ID NO: 208600 - DNA, 75 bp, Artificial Sequence
  Synthetic
acaatgaccaaggatgcagaaagaggcaaattgaagaggcgagcaattgcaacacccggaatgcaaatcagagga

SEQ ID NO: 208601 - DNA, 75 bp, Artificial Sequence
  Synthetic
attttcagagaaagagaagagtaagagacaacattaccaaaaggatggtcacacaaagaacaatagggaagaaga

SEQ ID NO: 208602 - DNA, 75 bp, Artificial Sequence
  Synthetic
ggaatgagaatcaaaatcctaggatgtttctggcaatgataacgtacatcacaaggaaccagccagaatggtttc

SEQ ID NO: 208603 - DNA, 75 bp, Artificial Sequence
  Synthetic
tttgtgtactttgttgagacattagcgaggagcatctgtgagaaacttgaacaatctggactccctgttggaggg

SEQ ID NO: 208604 - DNA, 75 bp, Artificial Sequence
  Synthetic
agaaagtggcaggttccctttgcatcagaatggaccaggcaataatggataaaaacatcacattgaaagcaaact

SEQ ID NO: 208605 - DNA, 75 bp, Artificial Sequence
  Synthetic
aatgttctcaaacaagatggcaagattagggaaaggatacatgttcgaaagtaagagcatgagattacgaacaca

SEQ ID NO: 208606 - DNA, 75 bp, Artificial Sequence
  Synthetic
ttcacaagatacagaactctcctttacaattactggagacaataccaaatggaatgagaatcagaatcctcggat

SEQ ID NO: 208607 - DNA, 75 bp, Artificial Sequence
  Synthetic
cagaatggaccaggcaataatggataaaaacatcacattgaaagcaaacttcagtgtgatttttgatcggctgga

SEQ ID NO: 208608 - DNA, 75 bp, Artificial Sequence
  Synthetic
taacgaaaaggaaaattgagaagataagacctctattaatagatggtacagcctcattgagccctggaatgatga

SEQ ID NO: 208609 - DNA, 75 bp, Artificial Sequence
  Synthetic
tgctaagggctttcaccgaagagggagcaattgttggcgaaatctcaccattgccttcttttccaggacatacta

SEQ ID NO: 208610 - DNA, 75 bp, Artificial Sequence
  Synthetic
aatgttctcaaacaaaatggcaagattgggaaagggatacatgtttgagagcaggagcatgaaactacgcacaca

SEQ ID NO: 208611 - DNA, 75 bp, Artificial Sequence
  Synthetic
atcctctgatgatttcgctctcattgtgaatgcaccgaaccatgaaggaatacaagcaggggtggatagatttta

SEQ ID NO: 208612 - DNA, 75 bp, Artificial Sequence
  Synthetic
cgacaagaaagaaaatcgagagaataagacctctcttaatagatggtacagcttcattaagtcctggaatgatga

SEQ ID NO: 208613 - DNA, 75 bp, Artificial Sequence
  Synthetic
gtgaatgcaccgaaccatgaaggaatacaagcaggggtggatagattttataggacttgtaaactagttgggatc

SEQ ID NO: 208614 - DNA, 75 bp, Artificial Sequence
  Synthetic
agcaaaagcagggtagataatcactcactgagtgacatccacatcatggcgtctcaaggcaccaaacgatcttat

SEQ ID NO: 208615 - DNA, 75 bp, Artificial Sequence
  Synthetic
ctaacattgaatacgatgaccaaagatgcagagagaggcaagttaaaaagaagggctatcgcaacacctgggatg

SEQ ID NO: 208616 - DNA, 75 bp, Artificial Sequence
  Synthetic
cacgagctttttttaccgctatggattcgtagccaatttcagtatggagctgcccagttttggagtggctggaat

SEQ ID NO: 208617 - DNA, 75 bp, Artificial Sequence
  Synthetic
aggccccctcaaagccgagatcgcgcagagacttgaagatgtctttgcagggaagaacacagatctcgaggctct

SEQ ID NO: 208618 - DNA, 75 bp, Artificial Sequence
  Synthetic
tgcccagttttggagtggctggaattaatgaatcggccgacatgagcattggtgttacagtaataaagaacaata

SEQ ID NO: 208619 - DNA, 75 bp, Artificial Sequence
  Synthetic
ttcagtgtgatctttaaccgattagagactttgatattactaagggctttcactgaggagggagcaatcgttgga

SEQ ID NO: 208620 - DNA, 75 bp, Artificial Sequence
  Synthetic
gtgaatgcaccaaaccatgaaggaatacaagcaggagtggataggttctataggacctgcaaattggtcgggatc

SEQ ID NO: 208621 - DNA, 75 bp, Artificial Sequence
  Synthetic
cgtgcccagtgagcgaggactgcagcgtagacgctttgtccaaaatgccctaaatgggaatggagacccaaacaa

SEQ ID NO: 208622 - DNA, 75 bp, Artificial Sequence
  Synthetic
ttcatcaaggactacagatacacataccgatgccacagaggggatacgcaaatccaaacgaggagatcattcgag

SEQ ID NO: 208623 - DNA, 75 bp, Artificial Sequence
  Synthetic
atcttgaggctctcatggaatggctaaagacaagaccaatcttgtcacctctgactaaggggattttaggatttg

SEQ ID NO: 208624 - DNA, 75 bp, Artificial Sequence
  Synthetic
aacctagaagaactcaggtcttttttcagttttgctaattcatatcaaagagtccagatctttccagacaccatc

SEQ ID NO: 208625 - DNA, 75 bp, Artificial Sequence
  Synthetic
agatggaggaccaaatctatacaatatccgaaatctccatattcctgaggtctgcttgaaatgggaattgatgga

SEQ ID NO: 208626 - DNA, 75 bp, Artificial Sequence
  Synthetic
aacagctcagatggctcttcaactattcataaaggactacagatacacatatcgatgtcacaggggggatacaca

SEQ ID NO: 208627 - DNA, 75 bp, Artificial Sequence
  Synthetic
attatagcattgtttccagttatgtatgctcaggacttgttggagacacacccagaaaaaacgacagctccagca

SEQ ID NO: 208628 - DNA, 75 bp, Artificial Sequence
  Synthetic
gctcaaaggcagggctgttggtttcagatgggggaccaaacctgtataacatacgaaatctccatatcccagagg

SEQ ID NO: 208629 - DNA, 75 bp, Artificial Sequence
  Synthetic
tgaccccaagtactgagatgtcactgaggggaataagagtcagtaagatgggagtagatgaatactccagtacag

SEQ ID NO: 208630 - DNA, 75 bp, Artificial Sequence
  Synthetic
ggctgggtcgagtgagcaagcagcggaagccatggaggttgctagtcaggctaggcagatggtgcaggcgatgag

SEQ ID NO: 208631 - DNA, 75 bp, Artificial Sequence
  Synthetic
ttcccttatactggagatcccccatacagccatggaacaggaacaggatacaccatggacacagtcaacagaaca

SEQ ID NO: 208632 - DNA, 75 bp, Artificial Sequence
  Synthetic
agatgggggaccaaacctgtataacatacgaaatctccatatcccagaggtttgtctgaagtgggaactaatgga

SEQ ID NO: 208633 - DNA, 75 bp, Artificial Sequence
  Synthetic
atagggaaattgagtctgtaaacaatgctgtggtaacgccagctcatggcccagccaaaagcatggaatatgatg

SEQ ID NO: 208634 - DNA, 75 bp, Artificial Sequence
  Synthetic
ggggaaattccaaacagcagcacaacgagcaatgatggaccaagtgagagaaagccggaatcctgggaatgctga

SEQ ID NO: 208635 - DNA, 75 bp, Artificial Sequence
  Synthetic
ccagccaaaagcatggaatatgatgctgttgcgactacacactcatggacccctaagaggaaccgatccattctt

SEQ ID NO: 208636 - DNA, 75 bp, Artificial Sequence
  Synthetic
gcacgaattgattttgagtctggaaggattaagaaagtagagtttgctgagatcatgaagatctgttccaccatt

SEQ ID NO: 208637 - DNA, 75 bp, Artificial Sequence
  Synthetic
gtccctaaggcagccagaggtcaatacagtggattcgtgaggacactattccagcaaatgcgagatgtgcttgga

SEQ ID NO: 208638 - DNA, 75 bp, Artificial Sequence
  Synthetic
atctaatgtcacagtcccgcactcgcgagatactaacaaaaaccactgtggaccacatggccataatcaagaaat

SEQ ID NO: 208639 - DNA, 75 bp, Artificial Sequence
  Synthetic
cgagatactaacaaaaaccactgtggaccacatggccataatcaagaaatacacatcaggaagacaggagaagaa

SEQ ID NO: 208640 - DNA, 75 bp, Artificial Sequence
  Synthetic
tatgagggaagagtatcggcaggaacagcagagtgctgtggatgttgacgatggtcattttgtcaacatagagct

SEQ ID NO: 208641 - DNA, 75 bp, Artificial Sequence
  Synthetic
caagtcttcagtctcatcagaccaaacgaaaatccagcacataaaagtcaactggtttggatggcatgccactct

SEQ ID NO: 208642 - DNA, 75 bp, Artificial Sequence
  Synthetic
cggacaagagaataatagatatgattcctgaaaggaatgaacaagggcagacgctctggagcaagacaaatgatg

SEQ ID NO: 208643 - DNA, 75 bp, Artificial Sequence
  Synthetic
actggtttggatggcatgccactctgctgcatttgaagatctgagggtatcaagcttcatcagaggaacaagagt

SEQ ID NO: 208644 - DNA, 75 bp, Artificial Sequence
  Synthetic
tcgagaaaataaggcctctactgattgatggcacagcctcattgagtcctgggatgatgatgggtatgttcaata

SEQ ID NO: 208645 - DNA, 75 bp, Artificial Sequence
  Synthetic
atggcaatgaaatatccgatcacagcagacaagagaataatagagatgatccctgaaaggaatgaacaaggacag

SEQ ID NO: 208646 - DNA, 75 bp, Artificial Sequence
  Synthetic
ccctctagctgtaacttggtggaacaggaatgggccgacaacaagtacagtccattatccaaaagtttacaaaac

SEQ ID NO: 208647 - DNA, 75 bp, Artificial Sequence
  Synthetic
aggaatgggccgacaacaagtacagtccattatccaaaagtttacaaaacatattttgagaggatggagaggttg

SEQ ID NO: 208648 - DNA, 75 bp, Artificial Sequence
  Synthetic
tgactcaaggaacctgctgggaacagatgtacactccaggcggagaagtaagaaatgacgatgttgaccagagtc

SEQ ID NO: 208649 - DNA, 75 bp, Artificial Sequence
  Synthetic
ggaaacaatgctatcaatcacgattctgtttctgctcatagcagagagctcctctcagaattacacagggaatcc

SEQ ID NO: 208650 - DNA, 75 bp, Artificial Sequence
  Synthetic
cctctcagaattacacagggaatcctgtgatatgcctgggacatcatgccgtatccaatgggacaatggtgaaaa

SEQ ID NO: 208651 - DNA, 75 bp, Artificial Sequence
  Synthetic
gcttcaagattgtaagattgctcctttaatgatggcatacatgttggaaagggaattggtccggaaaaccagatt

SEQ ID NO: 208652 - DNA, 75 bp, Artificial Sequence
  Synthetic
caaactccacaaccacaataatcaactacaatacccagaacaatttcacaaatgtgaccaatattgtgctaatta

SEQ ID NO: 208653 - DNA, 75 bp, Artificial Sequence
  Synthetic
ctacaatacccagaacaatttcacaaatgtgaccaatattgtgctaattaaagaagaaaacaaaatgttcacaaa

SEQ ID NO: 208654 - DNA, 75 bp, Artificial Sequence
  Synthetic
tcgcaacatctaccagagctatgccctagtcctttaagattagtagatgggcaaacttgtgacatcgtcaatggt

SEQ ID NO: 208655 - DNA, 75 bp, Artificial Sequence
  Synthetic
gagcagatcaaaaggcaagttgtggtcgataacttgaattggtcaggatacagtggttctttcacactaccggtg

SEQ ID NO: 208656 - DNA, 75 bp, Artificial Sequence
  Synthetic
aatgagaagaaggctaaattggcaaatgtcgtgagaaaaatgatgactaactcacaagatacagagctctccttt

SEQ ID NO: 208657 - DNA, 75 bp, Artificial Sequence
  Synthetic
acaattactggagacaacaccaaatggaatgagaatcaaaatcctcggatgttcctggcaatgataacatacatc

SEQ ID NO: 208658 - DNA, 75 bp, Artificial Sequence
  Synthetic
taactcaagggacttgttgggaacagatgtacactccaggaggagaagtgagaaatgatgatgtcgaccagagtt

SEQ ID NO: 208659 - DNA, 75 bp, Artificial Sequence
  Synthetic
acaatgcgattagaataggagaggatgcccacatacttgtcacaagagaaccatatctctcgtgtggaccaaacg

SEQ ID NO: 208660 - DNA, 75 bp, Artificial Sequence
  Synthetic
aggcaccacactaaggggtcggcatgcaaatgggactatacatgaccgaagtccgtttagagcattaataagttg

SEQ ID NO: 208661 - DNA, 75 bp, Artificial Sequence
  Synthetic
ctagtcctttaagattagtagatgggcaaacttgtgacatcgtcaatggtgccttgggaagtccaggctgtgatc

SEQ ID NO: 208662 - DNA, 75 bp, Artificial Sequence
  Synthetic
aacccaactgaggagcaagctgtggatatatgtaaagcagcaatggggttgagaatcagttcatctttcagcttt

SEQ ID NO: 208663 - DNA, 75 bp, Artificial Sequence
  Synthetic
gcaaagggcaacagctatcttgaggaaagcaactagaaggctgattcaactgatagtaagcggaaggaatgaaca

SEQ ID NO: 208664 - DNA, 75 bp, Artificial Sequence
  Synthetic
gatggtccagcacctcatgccatgacggcatctcaagaatgtcaatctgcatgtcaggacctaataacaatgctt

SEQ ID NO: 208665 - DNA, 75 bp, Artificial Sequence
  Synthetic
cggattaccagagcttacggagtatcctagcaaacaatgggaaatttgagttcatcgctgaggaattccagtgga

SEQ ID NO: 208666 - DNA, 75 bp, Artificial Sequence
  Synthetic
ggcccatgttcctatatgtgagaaccaatggaacctccaagatcaagatgaaatggggtatggaaatgaggcgct

SEQ ID NO: 208667 - DNA, 75 bp, Artificial Sequence
  Synthetic
aatgattttttcaacagactgaactggctaaccaaatccgatgggaatgcgtacccacttcaaaatctgacaaag

SEQ ID NO: 208668 - DNA, 75 bp, Artificial Sequence
  Synthetic
gcatgataaaggcagtccgaggcgatctaaactttgtaaacagagcaaaccaaagattaaaccccatgcatcaac

SEQ ID NO: 208669 - DNA, 75 bp, Artificial Sequence
  Synthetic
ggctaaccaaatccgatgggaatgcgtacccacttcaaaatctgacaaaggtcaacaacggggattatgcaaggc

SEQ ID NO: 208670 - DNA, 75 bp, Artificial Sequence
  Synthetic
aatcagaatgtgtatgtcataatgggatatgccctgtggtgatgacagatggcccagctaataacagagcagaaa

SEQ ID NO: 208671 - DNA, 75 bp, Artificial Sequence
  Synthetic
agtattaggagtctcaatcctgaatcttgggcaaaagaggtacactaaaaccacatactggtgggatggactcca

SEQ ID NO: 208672 - DNA, 75 bp, Artificial Sequence
  Synthetic
ttgtacaagaacaatcctgggagagtgactgtttccaccaaaaccagtcaaacaagtgtggtaccaaatatcggc

SEQ ID NO: 208673 - DNA, 75 bp, Artificial Sequence
  Synthetic
atcaatcgctgaagcgatcattgtagcaatggtgttctcacaggaggattgcatgataaaagcagtccgaggtga

SEQ ID NO: 208674 - DNA, 75 bp, Artificial Sequence
  Synthetic
gaaaatacagaaaatagaggaattgacaggaagtgcacagcatatagaagagtgctcatgctatggagcagaaga

SEQ ID NO: 208675 - DNA, 75 bp, Artificial Sequence
  Synthetic
tgactgtttccaccaaaaccagtcaaacaagtgtggtaccaaatatcggcagtagaccatgggtgagaggccaaa

SEQ ID NO: 208676 - DNA, 75 bp, Artificial Sequence
  Synthetic
ttcggtcccgttcacttccgaaatcaggttaagatacgccgtcgagttgatacaaatccaggccatgcagatctt

SEQ ID NO: 208677 - DNA, 75 bp, Artificial Sequence
  Synthetic
aacatgagcaaaaagaagtcttacataaatcggacaggaacttttgagttcacaagctttttctaccgctatggg

SEQ ID NO: 208678 - DNA, 75 bp, Artificial Sequence
  Synthetic
gtcttcaacaccatagggaatttaattgccccaagaggtcattacaagcttaacagtcaaaagaagagtactatt

SEQ ID NO: 208679 - DNA, 75 bp, Artificial Sequence
  Synthetic
agaggagtaagagttagtaaaatgggagtagatgaatattccagcactgaaagagtagttgtaagcattgaccgc

SEQ ID NO: 208680 - DNA, 75 bp, Artificial Sequence
  Synthetic
ttgccccaagaggtcattacaagcttaacagtcaaaagaagagtactattctgaatactgcaattcccataggat

SEQ ID NO: 208681 - DNA, 75 bp, Artificial Sequence
  Synthetic
agtgggagctagaatattgacatcagagtcgcagttgaccataactagagagaagaaagaagagctccaggattg

SEQ ID NO: 208682 - DNA, 75 bp, Artificial Sequence
  Synthetic
aaaagtgctgtttcagagctggggaattgaacctattgataatgtcatggggatgatcggaatattgcctgacat

SEQ ID NO: 208683 - DNA, 75 bp, Artificial Sequence
  Synthetic
aagtgggcactcggtgaaaatatggcgccagagaaagtagactttgatgattgcaaagatgttagtgatctcaaa

SEQ ID NO: 208684 - DNA, 75 bp, Artificial Sequence
  Synthetic
ccctttcagaacatctcgagaatatcaatcggggactgccccaagtatgtcaaacagggatccttaaaactagct

SEQ ID NO: 208685 - DNA, 75 bp, Artificial Sequence
  Synthetic
caatcggggactgccccaagtatgtcaaacagggatccttaaaactagctacaggaatgagaaacatccctgaga

SEQ ID NO: 208686 - DNA, 75 bp, Artificial Sequence
  Synthetic
tcattgttctaagttattttttctgtctggctctcggccaagattactcagagaacaacaacagcactgcaacac

SEQ ID NO: 208687 - DNA, 75 bp, Artificial Sequence
  Synthetic
ttcttaagagtcagagatcaaagggggaacgtgctcttatccccagaagaggttagcgaaacgcaagggacagag

SEQ ID NO: 208688 - DNA, 75 bp, Artificial Sequence
  Synthetic
tcccactatgctgtacaataagatggagttcgaaccgttccaatccttggtacctaaagctgccagaggtcaata

SEQ ID NO: 208689 - DNA, 75 bp, Artificial Sequence
  Synthetic
tctggctctcggccaagattactcagagaacaacaacagcactgcaacactgtgcttggggcatcatgcagtacc

SEQ ID NO: 208690 - DNA, 75 bp, Artificial Sequence
  Synthetic
tggcaaggtctaattgatggttggtacgggtttaggcaccagaatgctgaaggaacaggaacagctgctgatctc

SEQ ID NO: 208691 - DNA, 75 bp, Artificial Sequence
  Synthetic
caggtgatagtaaacaaccaaaactggtcggggtactcaggggcgtttatcgattattgggctgataaagagtgc

SEQ ID NO: 208692 - DNA, 75 bp, Artificial Sequence
  Synthetic
atgccactgaattagtccagagctcctcaacagggaaaatatgcaacaacccacatagaatccttgatgggaggg

SEQ ID NO: 208693 - DNA, 75 bp, Artificial Sequence
  Synthetic
tgctgtggtaatgccagcccatggcccagccaagagcatggaatatgatgctgttgcgactacacactcatggat

SEQ ID NO: 208694 - DNA, 75 bp, Artificial Sequence
  Synthetic
acgggtttaggcaccagaatgctgaaggaacaggaacagctgctgatctcaagtctacccaggcagctatcgatc

SEQ ID NO: 208695 - DNA, 75 bp, Artificial Sequence
  Synthetic
actgtacactgatagatgccctactgggagacccccactgtgatgtattccaagatgaaacctgggacctttatg

SEQ ID NO: 208696 - DNA, 75 bp, Artificial Sequence
  Synthetic
caccaaattgaaaaggaatttgaacaagtggaggggagaattcaagacttggagagatatgttgaagacacaaag

SEQ ID NO: 208697 - DNA, 75 bp, Artificial Sequence
  Synthetic
gaatttgaaccgttccaatccttggtgcctaaagctgccagaggtcagtatagtgggtttgtgagaacactattc

SEQ ID NO: 208698 - DNA, 75 bp, Artificial Sequence
  Synthetic
aagtggaggggagaattcaagacttggagagatatgttgaagacacaaagattgacctgtggtcttacaatgctg

SEQ ID NO: 208699 - DNA, 75 bp, Artificial Sequence
  Synthetic
ttggactggagttgctcaagacggatcaagcaatgcttgcagaagggaatctaataaaagtttcttcagtagatt

SEQ ID NO: 208700 - DNA, 75 bp, Artificial Sequence
  Synthetic
tatgcatcgctcaggtctctagttgcctcctcaggaaccctagagttcatcacagaaggattcacatggacagga

SEQ ID NO: 208701 - DNA, 75 bp, Artificial Sequence
  Synthetic
tcttggaaaggatgcaggtgcattaacagaggatccagacgaggggacagccggagtggaatctgcagtattgag

SEQ ID NO: 208702 - DNA, 75 bp, Artificial Sequence
  Synthetic
gagatgaacaaactctttgaaagagttagacgccaactacgagagaatgcagaggacaaaggaaacgggtgtttt

SEQ ID NO: 208703 - DNA, 75 bp, Artificial Sequence
  Synthetic
cacagaaggattcacatggacaggagtcactcaaaatggaggaagcaatgcctgcaaaagagggcctgctagtgg

SEQ ID NO: 208704 - DNA, 75 bp, Artificial Sequence
  Synthetic
ggtaactcccccgtgttcaattacaataaagcaaccaaaaggctgacggtcctagggaaggatgcaggctcattg

SEQ ID NO: 208705 - DNA, 75 bp, Artificial Sequence
  Synthetic
agagtacatgagggctatgaggaattcacaatggttgggcggagagcgacagctatcctgaggaaagcaaccaga

SEQ ID NO: 208706 - DNA, 75 bp, Artificial Sequence
  Synthetic
gacatatgaccatgatatttatagagacgaagcaatcaacaacagattccagatacaaggagtcaaattgaccca

SEQ ID NO: 208707 - DNA, 75 bp, Artificial Sequence
  Synthetic
tgacaactttgataaactgtatgtctggggagttcaccacccaagcacaaaccaggaacagaccaacctatacgt

SEQ ID NO: 208708 - DNA, 75 bp, Artificial Sequence
  Synthetic
gaaagtccaaaaatcgaaacgaacaaattcgccgcaatatgcacacacttagaagtctgcttcatgtattcagat

SEQ ID NO: 208709 - DNA, 75 bp, Artificial Sequence
  Synthetic
ccctgaaagaaatgagcaaggtcagactctttggagcaaaacaaatgatgctggatcagacagagtgatggtgtc

SEQ ID NO: 208710 - DNA, 75 bp, Artificial Sequence
  Synthetic
taataccgaatattggatcaaggccttgggtcaggggccaatcagggaggataagcatctactggacaatagtga

SEQ ID NO: 208711 - DNA, 75 bp, Artificial Sequence
  Synthetic
agaaatggaccaacgacaagtacagtccattatccaaaggtctataaaacctactttgaaaaagtcgaaaggtta

SEQ ID NO: 208712 - DNA, 75 bp, Artificial Sequence
  Synthetic
ttgggtcaggggccaatcagggaggataagcatctactggacaatagtgaaaccaggggatgtactggtaattaa

SEQ ID NO: 208713 - DNA, 75 bp, Artificial Sequence
  Synthetic
atgaatccaaatcagaggataataacaatcggctccgtctctctagctactgcaacagtatgtttcctcatgcag

SEQ ID NO: 208714 - DNA, 75 bp, Artificial Sequence
  Synthetic
tgcaacagtatgtttcctcatgcagattgccatcttaacaatgactgtgacactacatttcaaacacaacgaatg

SEQ ID NO: 208715 - DNA, 75 bp, Artificial Sequence
  Synthetic
ggaaaagttcaataatgagatcagatgtgcctattgacacatgcatttctgagtgcatcactcctaatggaagca

SEQ ID NO: 208716 - DNA, 75 bp, Artificial Sequence
  Synthetic
gtccaaaatgcccttaatgggaatggggatccaaacaacatggacagagcggtcaaactgtacaggaagcttaaa

SEQ ID NO: 208717 - DNA, 75 bp, Artificial Sequence
  Synthetic
gttagtaaaatgggagtggatgaatattccagcactgagagagtggttgtaagtattgaccgtttcttaagggtt

SEQ ID NO: 208718 - DNA, 75 bp, Artificial Sequence
  Synthetic
agaggagcatagactacaggaattggtcaaaaccgcagtgtcaaatcaccgggtttgctcctttttccaaggaca

SEQ ID NO: 208719 - DNA, 75 bp, Artificial Sequence
  Synthetic
tgtaaacaagatcacttacggagcatgtcctaagtatgtcaagcagaacactttgaaactggcaacagggatgag

SEQ ID NO: 208720 - DNA, 75 bp, Artificial Sequence
  Synthetic
gagaactggttcgcaaaaccagattcctaccagtagctggcgggacaagcagcgtgtatatcgaggtgttgcact

SEQ ID NO: 208721 - DNA, 75 bp, Artificial Sequence
  Synthetic
aatggtctcaagaccccacgatgctgtacaataagatggagtttgaaccgttccaatccttggtacccaaagctg

SEQ ID NO: 208722 - DNA, 75 bp, Artificial Sequence
  Synthetic
caccagaactctgagggtacaggacaagctgcagatctgaaaagtacacaggcagccattgaccagattaatgga

SEQ ID NO: 208723 - DNA, 75 bp, Artificial Sequence
  Synthetic
aatgtacacaccgggaggggaggtgagaaatgatgatgttgatcagagtttaattattgctgctagaaatattgt

SEQ ID NO: 208724 - DNA, 75 bp, Artificial Sequence
  Synthetic
aaatatatcacaaatgtgacaatgcctgcataggatcaatcagaaatggaacttatgaccatgatgtatacagag

SEQ ID NO: 208725 - DNA, 75 bp, Artificial Sequence
  Synthetic
taattattgctgctagaaatattgttaggagagcaacagtatcagcagacccgttggcttcgctcttggagatgt

SEQ ID NO: 208726 - DNA, 75 bp, Artificial Sequence
  Synthetic
acaaaacaagtgtgcatagcatggtccagttcaagttgccatgacggaaaagcatggttgcatgtctgtgttact

SEQ ID NO: 208727 - DNA, 75 bp, Artificial Sequence
  Synthetic
gaaggaattttctgaagtagaaggaagaatccaggaccttgagaaatatgtagaagacactaagatagatctatg

SEQ ID NO: 208728 - DNA, 75 bp, Artificial Sequence
  Synthetic
tagaagacactaagatagatctatggtcttacaatgcagagcttctggtggccttggaaaaccagcatacaatcg

SEQ ID NO: 208729 - DNA, 75 bp, Artificial Sequence
  Synthetic
aacccaacagaagagcaagctgtggatatatgcaaagcagcaatgggtctaaggatcagttcatccttcagcttt

SEQ ID NO: 208730 - DNA, 75 bp, Artificial Sequence
  Synthetic
tgacagtataggttcatggtctcaaaatatcctcagaactcaggagtcagagtgcgtttgcatcaatgggacttg

SEQ ID NO: 208731 - DNA, 75 bp, Artificial Sequence
  Synthetic
tcactaggaattcaaagtgacgttcctttggactctagttgcgagggggattgcttccacaatggaggtacgata

SEQ ID NO: 208732 - DNA, 75 bp, Artificial Sequence
  Synthetic
agaagtgctcacaggcaacctccaaacattgaaaataagagtgcatgaaggatatgaggaattcacaatggttgg

SEQ ID NO: 208733 - DNA, 75 bp, Artificial Sequence
  Synthetic
atgggttcaggcatcaaaatgcagaagggacagggacggctgcagatctcaagtcgacccaggcagctattgatc

SEQ ID NO: 208734 - DNA, 75 bp, Artificial Sequence
  Synthetic
agtgcgtttgcatcaatgggacttgtacagtagtaatgactgatggaagcgcatcagggaaagcagagactagaa

SEQ ID NO: 208735 - DNA, 75 bp, Artificial Sequence
  Synthetic
tcaatcagaaacgggacctatgatcatgacatatacagggatgaggcattaaacaaccgattccaaatcaagggt

SEQ ID NO: 208736 - DNA, 75 bp, Artificial Sequence
  Synthetic
gacaatgagccaagtggatatgcacaaacggactgtgtccttgaagcaatggctttccttgaagagtcccaccca

SEQ ID NO: 208737 - DNA, 75 bp, Artificial Sequence
  Synthetic
cctgttatcctcgatacccaaatgtcagatgtgtatgcagagacaactggaagggctctaataggcccgttatag

SEQ ID NO: 208738 - DNA, 75 bp, Artificial Sequence
  Synthetic
acctcctggcttggaagcaggtgctggcagaactccaagacattgaaaatgaagataaaatcccaaaaacaaaga

SEQ ID NO: 208739 - DNA, 75 bp, Artificial Sequence
  Synthetic
ccagaaaaagtagactttgaggactgcaaagatgttagcgatctaaaacagtatgacagtgatgaaccagaccct

SEQ ID NO: 208740 - DNA, 75 bp, Artificial Sequence
  Synthetic
atgatagctctagcagcagcaactgcagagatcctaataatgagaggggaaaccctggagtgaaagggtgggcct

SEQ ID NO: 208741 - DNA, 75 bp, Artificial Sequence
  Synthetic
agatcgaacggtctgacagctaatgaatcaggaaggctaatagattttctcaaggatgtgatggaatcaatggat

SEQ ID NO: 208742 - DNA, 75 bp, Artificial Sequence
  Synthetic
aaagaggaaatggaaataacaacgcatttccaaaggaaaagaagagtgagggacaacatgaccaagaaaatggtc

SEQ ID NO: 208743 - DNA, 75 bp, Artificial Sequence
  Synthetic
agaggagtgagagtcagtaaaatgggagtggatgaatattccagtactgagagagtggtcgtgagcattgatcgt

SEQ ID NO: 208744 - DNA, 75 bp, Artificial Sequence
  Synthetic
ggacaacatgaccaagaaaatggtcacacaaagaacaataggaaagaagaagcagaggctaaacaaaaggagcta

SEQ ID NO: 208745 - DNA, 75 bp, Artificial Sequence
  Synthetic
gggaaggacaatcagtaaagattcgcgctcaggctatgagacttttagggtcattggtggttgggcaattgccaa

SEQ ID NO: 208746 - DNA, 75 bp, Artificial Sequence
  Synthetic
atttccaaaggaaaagaagagtgagggacaacatgaccaagaaaatggtcacacaaagaacaataggaaagaaga

SEQ ID NO: 208747 - DNA, 75 bp, Artificial Sequence
  Synthetic
tatgacagcgacgagccagagcccagatctctagcaagctgggtccaaaatgaattcaacaaggcatgtgaattg

SEQ ID NO: 208748 - DNA, 75 bp, Artificial Sequence
  Synthetic
gccatggatgacttccaattgattccaatgataagcaagtgcagaaccaaagaaggaagacggaagacaaatctg

SEQ ID NO: 208749 - DNA, 75 bp, Artificial Sequence
  Synthetic
caaggagcatttgtgagaagcttgaacaatctggactcccagttggaggcaatgaaaagaaggctaaactggcaa

SEQ ID NO: 208750 - DNA, 75 bp, Artificial Sequence
  Synthetic
ggtaaactttgtgagcatggaattctctcttactgacccgaggctggaaccacacaagtgggaaaagtactgtgt

SEQ ID NO: 208751 - DNA, 75 bp, Artificial Sequence
  Synthetic
cagcagatgcgtgatgtgctggggacatttgacactgtccagataataaagctactaccatttgcagcagcccca

SEQ ID NO: 208752 - DNA, 75 bp, Artificial Sequence
  Synthetic
tgggctataaggacaagaagtggaggaaacactaaccaacagagagcatctgcagggcaaatcagcgtacagccc

SEQ ID NO: 208753 - DNA, 75 bp, Artificial Sequence
  Synthetic
acaatcactggagacaacaccaaatggaatgaaaatcagaaccctaggatgtttctggcaatgataacatatata

SEQ ID NO: 208754 - DNA, 75 bp, Artificial Sequence
  Synthetic
ttccactttattgatgaacggggcgaatcaataattgtagaatctggagatccgaatgcattattgagacacagg

SEQ ID NO: 208755 - DNA, 75 bp, Artificial Sequence
  Synthetic
aaagacaagaccaatcctgtcacctctgactaaggggattttaggatttgtattcacgctcaccgtgcccagtga

SEQ ID NO: 208756 - DNA, 75 bp, Artificial Sequence
  Synthetic
ataattctattaatcatgaagaccattattgttctgagttgttttttctgtctggcttcctgccaaaaatcctca

SEQ ID NO: 208757 - DNA, 75 bp, Artificial Sequence
  Synthetic
ggaatgaaaatcagaaccctaggatgtttctggcaatgataacatatataacaagaaaccaacctgaatggttta

SEQ ID NO: 208758 - DNA, 75 bp, Artificial Sequence
  Synthetic
gagaacaacaacaacactgcaacactgtgcttggggcatcatgcagtaccaaacggaacaatagtgaaaacaata

SEQ ID NO: 208759 - DNA, 75 bp, Artificial Sequence
  Synthetic
gccttcttcaatcccttcaacaaattgagagcatgattgaggccgagtcttctgtcaaagagaaagacatgacca

SEQ ID NO: 208760 - DNA, 75 bp, Artificial Sequence
  Synthetic
tgtgcttggggcatcatgcagtaccaaacggaacaatagtgaaaacaataacggatgatcaaattgaagtaacta

SEQ ID NO: 208761 - DNA, 75 bp, Artificial Sequence
  Synthetic
gagaaacctaaattcctcccagatttgtatgactacaaagaagaccgattcattgaaattggggtgacacggagg

SEQ ID NO: 208762 - DNA, 75 bp, Artificial Sequence
  Synthetic
tctgtcaaagagaaagacatgaccaaagaattctttgaaaccaaatcagaaacgtggccaattggggaatcacct

SEQ ID NO: 208763 - DNA, 75 bp, Artificial Sequence
  Synthetic
caacaagaaagaaaatagagaaaataaggcctcttctaatagatggtaccgcctcattgagtcctggaatgatga

SEQ ID NO: 208764 - DNA, 75 bp, Artificial Sequence
  Synthetic
atgaatccaaatcagaagataataacaattggtgtagtgaatacgactctatcaacaatagcccttcttattgga

SEQ ID NO: 208765 - DNA, 75 bp, Artificial Sequence
  Synthetic
tacacacattcacatattctcattcactggagaggaaatggcaaccagatcagactacacccttgatgaagagag

SEQ ID NO: 208766 - DNA, 75 bp, Artificial Sequence
  Synthetic
atcaacaatagcccttcttattggaattgggaatctgattttcaacactgttatacatgagaaaataggagtcca

SEQ ID NO: 208767 - DNA, 75 bp, Artificial Sequence
  Synthetic
tttactataaggcaggaaatggccagtagagggctatgggatacctttcgtcaatccgagagaggcgaagaaaca

SEQ ID NO: 208768 - DNA, 75 bp, Artificial Sequence
  Synthetic
ctgcatttgatgaaaggaggaacaaatatctggaagaacatcccagtgcggggaaggatccgaagaaaaccggag

SEQ ID NO: 208769 - DNA, 75 bp, Artificial Sequence
  Synthetic
atgaatccaaatcaaaagataatggccattggatcagtctgtatggtaattggaatagttagcttaatgttacag

SEQ ID NO: 208770 - DNA, 75 bp, Artificial Sequence
  Synthetic
gtcacacaaaatggagggagtggtgcttgcaaaagaggacccgctaatggcttttttagtagactgaattggctg

SEQ ID NO: 208771 - DNA, 75 bp, Artificial Sequence
  Synthetic
tggaatagttagcttaatgttacagattgggaacacaatctcaatatgggtcagtcattcatttcaaacaagagt

SEQ ID NO: 208772 - DNA, 75 bp, Artificial Sequence
  Synthetic
cataaggacaatgcaatacgattgggtgagaacaaagatgtaatagtcacgagggagccttatgtcagttgcgac

SEQ ID NO: 208773 - DNA, 75 bp, Artificial Sequence
  Synthetic
aatgggcggagaacaaggatcgcatatgagagaatgtgcaacatcctcaaagggaaattccaaacagcagcacaa

SEQ ID NO: 208774 - DNA, 75 bp, Artificial Sequence
  Synthetic
cgataattttgacaaattgtacgtgtggggagttcatcatccaagcacaaaccaagagcaaaccaatttgtatgt

SEQ ID NO: 208775 - DNA, 75 bp, Artificial Sequence
  Synthetic
taatgaatctgcagacatgagcattggagtaacagtgataaagaacaacatgataaacaatgatcttggaccagc

SEQ ID NO: 208776 - DNA, 75 bp, Artificial Sequence
  Synthetic
ctgtggcttcagtaacattagcgggcaattcgtctctttgccccattagggggtgggctgtacacagcaaggaca

SEQ ID NO: 208777 - DNA, 75 bp, Artificial Sequence
  Synthetic
tttggcgtcaagcgaacaatggagaagacgcaactgctggtctcactcatctgatgatctggcattccaacctga

SEQ ID NO: 208778 - DNA, 75 bp, Artificial Sequence
  Synthetic
gatcaactctcccaaggagatctggagctgctggtgcagcagtaaagggagttgggacaatggtgatggaactga

SEQ ID NO: 208779 - DNA, 75 bp, Artificial Sequence
  Synthetic
tcaactagaagaagccagcaaaccataattcccaacatcggatccaggccttgggtcagaggccaatcaggaaga

SEQ ID NO: 208780 - DNA, 75 bp, Artificial Sequence
  Synthetic
ttgggtcagaggccaatcaggaagaataagtatctactggacaatagtaaagccaggagacatactggtgattaa

SEQ ID NO: 208781 - DNA, 75 bp, Artificial Sequence
  Synthetic
gaggcagcactcttggtctggacatcgaaacagccactcgtgctggaaagcagatagtggagaggattctggagg

SEQ ID NO: 208782 - DNA, 75 bp, Artificial Sequence
  Synthetic
ctgaagaagttgtgggaacaaacccgctcaaaagcaggactgctggtctcagatggaggaccaaacctatataat

SEQ ID NO: 208783 - DNA, 75 bp, Artificial Sequence
  Synthetic
aatgatgattgctggtcctttgcccttgctcaaggggctctattaggaactaaacacagcaatgggaccatcaag

SEQ ID NO: 208784 - DNA, 75 bp, Artificial Sequence
  Synthetic
cgaggttattttaagatgcgcactgggaaaagctcgataatgagatcagatgcacctattgacacatgtatttct

SEQ ID NO: 208785 - DNA, 75 bp, Artificial Sequence
  Synthetic
acctcctggcttggaagcaagtgctggcagaactccaagatattgaaaatgaggagagaacaccaaaggcaaaga

SEQ ID NO: 208786 - DNA, 75 bp, Artificial Sequence
  Synthetic
atcatggagaagggatatactaagaactcaagagtctgaatgtcaatgcattgatgggacctgtattgtcgctgt

SEQ ID NO: 208787 - DNA, 75 bp, Artificial Sequence
  Synthetic
ctgtattgaaatacaatggcataataacagacaccatcaagagttggaggaacaacatactgagaactcaagagt

SEQ ID NO: 208788 - DNA, 75 bp, Artificial Sequence
  Synthetic
cagtggctcataagtcctgcttgcctgcttgtgtatatggacttgctgtggccagtggatatgactttgagagag

SEQ ID NO: 208789 - DNA, 75 bp, Artificial Sequence
  Synthetic
gaggagggaagataataaagtatgaagacattcccaaaacaaagatacaacatttagaggagtgttcttgctatg

SEQ ID NO: 208790 - DNA, 75 bp, Artificial Sequence
  Synthetic
agacattcccaaaacaaagatacaacatttagaggagtgttcttgctatgtggacatcgatgtgtactgcatatg

SEQ ID NO: 208791 - DNA, 75 bp, Artificial Sequence
  Synthetic
catttagaggagtgttcttgctatgtggacatcgatgtgtactgcatatgtagggacaattggaaaggttccaac

SEQ ID NO: 208792 - DNA, 75 bp, Artificial Sequence
  Synthetic
gaccgattcaagttgggttgaacttgatgaaataggggaagacgttgctccaattgaacacattgcgagtatgag

SEQ ID NO: 208793 - DNA, 75 bp, Artificial Sequence
  Synthetic
caggtgttcagcctcattagaccaaatgagaatccggcacataagagtcagctggtatggatggcatgccattct

SEQ ID NO: 208794 - DNA, 75 bp, Artificial Sequence
  Synthetic
agatcttcaaaatgaaaaaagggaaagtagttaaatcagtcgagttgaatgctcctaattatcactatgaggaat

SEQ ID NO: 208795 - DNA, 75 bp, Artificial Sequence
  Synthetic
gatgaaataggggaagacgttgctccaattgaacacattgcgagtatgagaagaaactacttcacagcggaagta

SEQ ID NO: 208796 - DNA, 75 bp, Artificial Sequence
  Synthetic
cggattaagaaggaggagtttgctgagatcatgaagatctgttccaccattgaagagctcagacggcagaaatag

SEQ ID NO: 208797 - DNA, 75 bp, Artificial Sequence
  Synthetic
atgtagcaaattccattcagacacccccaggccagccgatccttcaacagtgtcatgtgattccccaagtaacat

SEQ ID NO: 208798 - DNA, 75 bp, Artificial Sequence
  Synthetic
ggtcccaagaggacaactgtccaccagaggagttcaaatagcttcaaatgaaaacatggaaacaatggactccag

SEQ ID NO: 208799 - DNA, 75 bp, Artificial Sequence
  Synthetic
cccaggccagccgatccttcaacagtgtcatgtgattccccaagtaacatcaatggaggacctggagtcaaagga

SEQ ID NO: 208800 - DNA, 75 bp, Artificial Sequence
  Synthetic
agtagttaaatcagtcgagttgaatgctcctaattatcactatgaggaatgctcctgttatcctgatgcgggaga

SEQ ID NO: 208801 - DNA, 75 bp, Artificial Sequence
  Synthetic
taacatttatgcaagccttacaactattgcttgaagtggagcaagagataagaactttctcgtttcagcttattt

SEQ ID NO: 208802 - DNA, 75 bp, Artificial Sequence
  Synthetic
cccatttgagaaatgacacagatgtggtgaattttgtgagtatggagttctctcttaccgacccgaggctggagc

SEQ ID NO: 208803 - DNA, 75 bp, Artificial Sequence
  Synthetic
gtcttacaatgcggaacttcttgtggcgctggaaaaccagcatacaattgatctgactgattcagaaatgaacaa

SEQ ID NO: 208804 - DNA, 75 bp, Artificial Sequence
  Synthetic
tactggaagatcaggctttgaagtcatcaaagtcacagaaggatggatcaactccctcaatcatgctaaatcagt

SEQ ID NO: 208805 - DNA, 75 bp, Artificial Sequence
  Synthetic
gcaatggcgtttggatcgggagaaccaaaagcactaattccagaagcggctttgaaatggtttgggatccaaatg

SEQ ID NO: 208806 - DNA, 75 bp, Artificial Sequence
  Synthetic
ggaatggctgtttcaaaatatatcacaaatgtgacaatgcttgcatagagtcaatcaggaatgggacctatgatc

SEQ ID NO: 208807 - DNA, 75 bp, Artificial Sequence
  Synthetic
gccggatcagaccgagtgatggtatcacctctggctgtgacatggtggaataggaatggaccaacaacaagtaca

SEQ ID NO: 208808 - DNA, 75 bp, Artificial Sequence
  Synthetic
tcataagaatgatggaaagtgccagaccagaagatgtgtctttccaggggcggggagtcttcgagctctcggacg

SEQ ID NO: 208809 - DNA, 75 bp, Artificial Sequence
  Synthetic
ataactgattggtcaggatatagcgggagttttgtccagcatccagaactgacaggattagattgcataagacct

SEQ ID NO: 208810 - DNA, 75 bp, Artificial Sequence
  Synthetic
aagtggggcatggagatgagacgatgccttcttcaatcccttcaacaaattgaaagcatgattgaggctgaatct

SEQ ID NO: 208811 - DNA, 75 bp, Artificial Sequence
  Synthetic
gtggaactgaaatccggatacaaagattggattctatggatttcctttgccatatcatgctttttgctgtgtgtt

SEQ ID NO: 208812 - DNA, 75 bp, Artificial Sequence
  Synthetic
tgaaagcatgattgaggctgaatcttccgtcaaagagaaagacatgaccaaagaattctttgagaacaaatcaga

SEQ ID NO: 208813 - DNA, 75 bp, Artificial Sequence
  Synthetic
tccgtcaaagagaaagacatgaccaaagaattctttgagaacaaatcagaaaaatggccagttggtgaatcaccc

SEQ ID NO: 208814 - DNA, 75 bp, Artificial Sequence
  Synthetic
caatggaacctccaaaataaagatgaagtggggcatggagatgagacgatgccttcttcaatcccttcaacaaat

SEQ ID NO: 208815 - DNA, 75 bp, Artificial Sequence
  Synthetic
agtgcttctttttgcggcaatcagccttgttaaaagcgatcatatttgcattggttatcatgcaaataactcgac

SEQ ID NO: 208816 - DNA, 75 bp, Artificial Sequence
  Synthetic
acgataacaaaggagaagaaggaagaactccaggactgcaaaatcgcccctctgatggttgcatacatgctagaa

SEQ ID NO: 208817 - DNA, 75 bp, Artificial Sequence
  Synthetic
cttgttaaaagcgatcatatttgcattggttatcatgcaaataactcgacaaagcaggttgacacaataatggaa

SEQ ID NO: 208818 - DNA, 75 bp, Artificial Sequence
  Synthetic
tttgaaataattgaaggaagagaccgaacaatggcctggacagtggtgaatagtatctgcaacaccacaggagtc

SEQ ID NO: 208819 - DNA, 75 bp, Artificial Sequence
  Synthetic
ctggaacctgggaccttcgatcttggggggctatatgaagcaattgaggagtgcctgattaatgatccctgggtt

SEQ ID NO: 208820 - DNA, 75 bp, Artificial Sequence
  Synthetic
tgggaagctctgcgatctaaatggagtgaaacctctgattttaaaagattgtagtgtagcaggatggctcctcgg

SEQ ID NO: 208821 - DNA, 75 bp, Artificial Sequence
  Synthetic
cattgaaattggagtgacacggagggaagtccacatatactacctagaaaaagccaacaagataaagtccgaaaa

SEQ ID NO: 208822 - DNA, 75 bp, Artificial Sequence
  Synthetic
aatgtgccagaatggtcttacatagtagagaaggccaatccagccaatggcctctgttacccagggaatttcaac

SEQ ID NO: 208823 - DNA, 75 bp, Artificial Sequence
  Synthetic
atggatgtcaatccgactttacttttcttgaaagttccagcgcaaaatgctataagcaccacattcccgtacact

SEQ ID NO: 208824 - DNA, 75 bp, Artificial Sequence
  Synthetic
cctctgttacccagggaatttcaacgattatgaggaattgaaacacctattgagcaggataaaccattttgagaa

SEQ ID NO: 208825 - DNA, 75 bp, Artificial Sequence
  Synthetic
aaatccaacagaggaacaagccgtggacatatgcaaggcagcaatgggcttgaggattagctcatctttcagctt

SEQ ID NO: 208826 - DNA, 75 bp, Artificial Sequence
  Synthetic
gggtgagtgcagcatgtccataccagggaaattcctccttcttcagaaatgtggtgtggcttatcaaaaaggaca

SEQ ID NO: 208827 - DNA, 75 bp, Artificial Sequence
  Synthetic
gcgcttaaaatgactattgcttcagtgccggtttcacgctacctaactgatatgactcttgaagaaatgtcaagg

SEQ ID NO: 208828 - DNA, 75 bp, Artificial Sequence
  Synthetic
gactggttgatgctaatgccaaaacagaaattggccagttccctctgcatcaggatggaccaagcgataatgaat

SEQ ID NO: 208829 - DNA, 75 bp, Artificial Sequence
  Synthetic
cctcagattgcctgatgggcctccttgctctcagcggtcgaaattcttgctgatggatgctctgaagttgagcat

SEQ ID NO: 208830 - DNA, 75 bp, Artificial Sequence
  Synthetic
aatgcatgaaaacattcttcggctggaaagagcccaacattatcaaaccacatgagaaaggcataaaccccaatt

SEQ ID NO: 208831 - DNA, 75 bp, Artificial Sequence
  Synthetic
accccacgatgttatataacaagatggaattcgagccatttcaatccctggtccctaaggcagccagaggtcagt

SEQ ID NO: 208832 - DNA, 75 bp, Artificial Sequence
  Synthetic
aatgttctcaaacaaaatggcaagactagggaaaggatacatgttcgaaagtaagagcatgaagcttcgaacaca

SEQ ID NO: 208833 - DNA, 75 bp, Artificial Sequence
  Synthetic
tatgccattccacaacatacatcccctcaccatcggagaatgtcccaaatatgtgaaatcaaacaaattagtcct

SEQ ID NO: 208834 - DNA, 75 bp, Artificial Sequence
  Synthetic
agcgggtagtggtaagcatcgaccgatttttaagagttcgagaccaacgggggaacgtactattgtcacccgaag

SEQ ID NO: 208835 - DNA, 75 bp, Artificial Sequence
  Synthetic
gaagctgacaatcacttattcgtcatcaatgatgtgggaaatcaatggtcctgagtcggtgttggtcaatactta

SEQ ID NO: 208836 - DNA, 75 bp, Artificial Sequence
  Synthetic
gacagattcaagctggattgaacttgatgaaataggagaggacattgctccaattgagcacattgcaagtatgag

SEQ ID NO: 208837 - DNA, 75 bp, Artificial Sequence
  Synthetic
aaggcaatagacggagtcaccaataaggtcaactcgatcattgacaaaatgaacactcagtttgaggccgtagga

SEQ ID NO: 208838 - DNA, 75 bp, Artificial Sequence
  Synthetic
taatgaagggagtatacgtaaacacggccctgttgaatgcatcctgtgcagccatggatgactttcaactgattc

SEQ ID NO: 208839 - DNA, 75 bp, Artificial Sequence
  Synthetic
tctaaggacaattcgattaggctttctgctggtggggacatctgggtgacaagagaaccttatgtgtcatgtgat

SEQ ID NO: 208840 - DNA, 75 bp, Artificial Sequence
  Synthetic
aacaaggccaccaagaggctaacagttctcgggaaagatgcaggtgcattgaccgaagatccagatgaaggcaca

SEQ ID NO: 208841 - DNA, 75 bp, Artificial Sequence
  Synthetic
caggagtcagaatgcgtttgtatcaatggaacttgtgcagtagtaatgactgatggaagtgcttcaggaaaagct

SEQ ID NO: 208842 - DNA, 75 bp, Artificial Sequence
  Synthetic
gtggcaagttccttagtactggcaatcatgatggctggtctatctttatggatgtgttccaacgggtcgttacag

SEQ ID NO: 208843 - DNA, 75 bp, Artificial Sequence
  Synthetic
agcgaaagcagggtgacaaaaacataatggattccaacacgataacctcgtttcaggtagattgctatctatggc

SEQ ID NO: 208844 - DNA, 75 bp, Artificial Sequence
  Synthetic
agcgaaagcaggagtttaaaatgaatccaaatcagaaaataataaccattgggtcagtgtccttaggattggtag

SEQ ID NO: 208845 - DNA, 75 bp, Artificial Sequence
  Synthetic
ctccctggaaatggaaataatgggagctgcaatgaaacaatcattagggaatacaatgaaacagtacggattgag

SEQ ID NO: 208846 - DNA, 75 bp, Artificial Sequence
  Synthetic
ccgcaggagctgcagtgaaaggagttggaacactagcaatggaattgatcagaatgatcaaacgtggtatcaatg

SEQ ID NO: 208847 - DNA, 75 bp, Artificial Sequence
  Synthetic
acatcttctgtctggctttcggtcaggacctcacagggaatgacaacagtacggcaacactgtgcctgggacacc

SEQ ID NO: 208848 - DNA, 75 bp, Artificial Sequence
  Synthetic
ggacctcacagggaatgacaacagtacggcaacactgtgcctgggacaccatgcagtgccgaacgggacaatagt

SEQ ID NO: 208849 - DNA, 75 bp, Artificial Sequence
  Synthetic
ttcaaagctcttcaacagggaaaatatgcaacaatccccacagaatccttgatggaagggactgcacactaatag

SEQ ID NO: 208850 - DNA, 75 bp, Artificial Sequence
  Synthetic
acaaatttgctgcaatatgcacacacttagaagtatgtttcatgtactcagatttccatttcattgatgaacgag

SEQ ID NO: 208851 - DNA, 75 bp, Artificial Sequence
  Synthetic
tgatgtctttcaagatgaaacatgggacctctttgtagagcggagcaatgctttcagcaattgttacccttacga

SEQ ID NO: 208852 - DNA, 75 bp, Artificial Sequence
  Synthetic
cgtaccagattatgcatctcttcgatccctagttgcatcatcaggcacattggagttcatcactgaaggtttcac

SEQ ID NO: 208853 - DNA, 75 bp, Artificial Sequence
  Synthetic
tccctagttgcatcatcaggcacattggagttcatcactgaaggtttcacttggacaggagtaactcagaatgga

SEQ ID NO: 208854 - DNA, 75 bp, Artificial Sequence
  Synthetic
ttggacaggagtaactcagaatggagggagcaatgcttgcaaaaggggacctgctagcggtttctttagtagatt

SEQ ID NO: 208855 - DNA, 75 bp, Artificial Sequence
  Synthetic
aaaaggccaataaaataaagtctgagaagacacacatccacatcttttcattcactggggaagaaatggctacta

SEQ ID NO: 208856 - DNA, 75 bp, Artificial Sequence
  Synthetic
ataattgggcaagttgaaatcagtttcaatggaggccatatagaagaatgctcatgctacccaaatgaaggtaaa

SEQ ID NO: 208857 - DNA, 75 bp, Artificial Sequence
  Synthetic
caacagactataatcccgaacattggatctagaccctgggtaaggggccagtctggcagaataagcatctattgg

SEQ ID NO: 208858 - DNA, 75 bp, Artificial Sequence
  Synthetic
gatctagaccctgggtaaggggccagtctggcagaataagcatctattggacaatagtcaaacctggggacgtac

SEQ ID NO: 208859 - DNA, 75 bp, Artificial Sequence
  Synthetic
aactccttcctcacacatgcactgaaatagttgtggcaatgctactatttgctatccatactgtccaaaaaagta

SEQ ID NO: 208860 - DNA, 75 bp, Artificial Sequence
  Synthetic
agcaaaagcaggggaaatatcaagaaatcaagatgaagaaaacactgctccttgcagcgatcatcatctgcattc

SEQ ID NO: 208861 - DNA, 75 bp, Artificial Sequence
  Synthetic
tggtaatcaatagcaatggaaacctaatcgctcctcggggctacttcaaaatgcgcactgggaaaagctcaataa

SEQ ID NO: 208862 - DNA, 75 bp, Artificial Sequence
  Synthetic
taggtcactagttgcctcatccggcacactggagtttaacaatgaaagcttcaattggactggagtcactcaaaa

SEQ ID NO: 208863 - DNA, 75 bp, Artificial Sequence
  Synthetic
atagcaggttttatagaaaatggatgggaagggatgatagatggttggtatggcttcaggcatcaaaattccgaa

SEQ ID NO: 208864 - DNA, 75 bp, Artificial Sequence
  Synthetic
aaggggcaagccggaagaaaagacgatatggacctcaagtagctccattgtgatgtgtggagtagaccatgagat

SEQ ID NO: 208865 - DNA, 75 bp, Artificial Sequence
  Synthetic
tggcttcaggcatcaaaattccgaaggtacaggacaagcagcagatcttaaaagcactcaggcagccatcgacca

SEQ ID NO: 208866 - DNA, 75 bp, Artificial Sequence
  Synthetic
actatgccaaacaatgaacaatttgacaaattgtacatttggggggttcaccacccgggtacggacaaggaccaa

SEQ ID NO: 208867 - DNA, 75 bp, Artificial Sequence
  Synthetic
ggtacaggacaagcagcagatcttaaaagcactcaggcagccatcgaccagatcaatgggaagttgaacagagta

SEQ ID NO: 208868 - DNA, 75 bp, Artificial Sequence
  Synthetic
tgatgtgtggagtagaccatgagattgccgactggtcgtggcacgatggagctattcttccttttgacatcgata

SEQ ID NO: 208869 - DNA, 75 bp, Artificial Sequence
  Synthetic
ctcgatgaaataggggaggacgttgccccgatcgaacacattgcaagcatgaggaggaattactttacagctgaa

SEQ ID NO: 208870 - DNA, 75 bp, Artificial Sequence
  Synthetic
agtagaagggaggattcaggaccttgagaaatacgttgaagacacaaagatagatctctggtcttacaatgcaga

SEQ ID NO: 208871 - DNA, 75 bp, Artificial Sequence
  Synthetic
gagaaatacgttgaagacacaaagatagatctctggtcttacaatgcagagcttcttgttgccctggagaatcag

SEQ ID NO: 208872 - DNA, 75 bp, Artificial Sequence
  Synthetic
atttatacgattacaaagagaatcgcttcattgaaattggagtaaccaggagggaagtccatatatactatttag

SEQ ID NO: 208873 - DNA, 75 bp, Artificial Sequence
  Synthetic
cttcattgaaattggagtaaccaggagggaagtccatatatactatttagaaaaggccaataagataaagtctga

SEQ ID NO: 208874 - DNA, 75 bp, Artificial Sequence
  Synthetic
agggaagtccatatatactatttagaaaaggccaataagataaagtctgagaagacacacatccatatcttttca

SEQ ID NO: 208875 - DNA, 75 bp, Artificial Sequence
  Synthetic
tacatgttggagagagaactggttcgcaaaacaagatttctaccagtagctggagggacaagcagtgtgtatatc

SEQ ID NO: 208876 - DNA, 75 bp, Artificial Sequence
  Synthetic
gcaacaggaatgcgaaatgtaccagagaaacaaactagaggcatatttggcgcaatagcgggtttcatagaaaat

SEQ ID NO: 208877 - DNA, 75 bp, Artificial Sequence
  Synthetic
ggatacaaagactggatcctgtggatttcctttgccatatcatgctttttgctttgtgttgttctactggggttt

SEQ ID NO: 208878 - DNA, 75 bp, Artificial Sequence
  Synthetic
tttcctttgccatatcatgctttttgctttgtgttgttctactggggtttattatgtgggcctgccagagaggca

SEQ ID NO: 208879 - DNA, 75 bp, Artificial Sequence
  Synthetic
ctcaaaagcactcaagcagcaatcgatcaaatcaatgggaagctgaatcgattgatcgggaaaaccaacgagaaa

SEQ ID NO: 208880 - DNA, 75 bp, Artificial Sequence
  Synthetic
aaccatttctgaagacaacaccacgccctctgagattaccggaagggcctccttgctctcagcggtcgaaatttc

SEQ ID NO: 208881 - DNA, 75 bp, Artificial Sequence
  Synthetic
ttcaaaatataccacaaatgtgacaatgcctgcataggatcaatcagaaatggaacttatgaccacgatgtatac

SEQ ID NO: 208882 - DNA, 75 bp, Artificial Sequence
  Synthetic
ccttgctctcagcggtcgaaatttctgctgatggatgctctgaagcttagcattgaagacccgagtcatgaaggc

SEQ ID NO: 208883 - DNA, 75 bp, Artificial Sequence
  Synthetic
cccgaggagatctggagctgctggtgcagcggtgaagggagtcgggacgatggtaatggagctaattcgaatgat

SEQ ID NO: 208884 - DNA, 75 bp, Artificial Sequence
  Synthetic
tcctgtatgacaaagaggagatcagaaggatctggcgtcaagcgaataatggagaggacgcgaccgctggtctaa

SEQ ID NO: 208885 - DNA, 75 bp, Artificial Sequence
  Synthetic
taagtcctgcctgcctgcttgtgtgtacggacttgctgtggccagtgggtacgactttgagagagaaggatattc

SEQ ID NO: 208886 - DNA, 75 bp, Artificial Sequence
  Synthetic
acagtcaggtcctcagtctaattagatcaaatgagaatccatcacataaaagtcaattggtgtggatggcatgcc

SEQ ID NO: 208887 - DNA, 75 bp, Artificial Sequence
  Synthetic
acataatgaagggagtatacataaacacagctttgctcaatgcttcttgtgcggcaatggatgattttcagctga

SEQ ID NO: 208888 - DNA, 75 bp, Artificial Sequence
  Synthetic
gcggcaatggatgattttcagctgatcccaatgataagcaaatgcagaaccaaagaagggcggcgaaagacaaat

SEQ ID NO: 208889 - DNA, 75 bp, Artificial Sequence
  Synthetic
cctgaagtctgcttaaagtgggagctgatggatgaggattatcggggaagactttgtaatcccctgaatcccttt

SEQ ID NO: 208890 - DNA, 75 bp, Artificial Sequence
  Synthetic
aaccacataaatgggagaaatactgtgtccttgaaataggggacatgctcctgcggactgcaataggccaagtat

SEQ ID NO: 208891 - DNA, 75 bp, Artificial Sequence
  Synthetic
tgcagcagccccgccggagcagagtaggatgcagttctcttctctaactgtgaacgtgaggggttcaggaatgag

SEQ ID NO: 208892 - DNA, 75 bp, Artificial Sequence
  Synthetic
cagaggaacaagagtagtcccaagaggacaactatccaccagaggagttcaaattgcttcaaacgagaatatgga

SEQ ID NO: 208893 - DNA, 75 bp, Artificial Sequence
  Synthetic
tgtccttgaaataggggacatgctcctgcggactgcaataggccaagtatcgagacccatgttcttgtatgtgag

SEQ ID NO: 208894 - DNA, 75 bp, Artificial Sequence
  Synthetic
aattgaaagcatgattgaggccgaatcctctgtcaaagagaaagacatgaccaaagaattcttcgaaaacaaatc

SEQ ID NO: 208895 - DNA, 75 bp, Artificial Sequence
  Synthetic
acatgaggactgaaatcataagaatgatggaaagtgccagaccagaagatgtgtctttccaggggcggggagtct

SEQ ID NO: 208896 - DNA, 75 bp, Artificial Sequence
  Synthetic
acacccgggatgcaaattagagggttcgtgtacttcgttgaaactttagctagaagcatttgcgaaaagcttgaa

SEQ ID NO: 208897 - DNA, 75 bp, Artificial Sequence
  Synthetic
ggcaaaatctgtgttcaacagcttgtatgcatctccacaacttgagggattttcagctgagtcgagaaagctgct

SEQ ID NO: 208898 - DNA, 75 bp, Artificial Sequence
  Synthetic
aaacaccgatttgaaataatcgaagggagagaccgaacaatggcctggacagtggtgaatagtatctgcaacacc

SEQ ID NO: 208899 - DNA, 75 bp, Artificial Sequence
  Synthetic
tatgagggaagagtaccagcaggagcgacagagtgctgtggatgttgacgatggtcattttgtcaacatagagct

SEQ ID NO: 208900 - DNA, 75 bp, Artificial Sequence
  Synthetic
caaagaatcaacctgagtggttcagaaacatcctgagcatcgcaccaataatgttctcaaacaaaatggcaagac

SEQ ID NO: 208901 - DNA, 75 bp, Artificial Sequence
  Synthetic
gatgccccattccttgaccggcttcgccgagatcagaagtccctaagaggaagaggcagcactcttggtctggac

SEQ ID NO: 208902 - DNA, 75 bp, Artificial Sequence
  Synthetic
atggatgtcaatccgactttacttttcttgaaagtaccagcgcaaaatgccataagtactacattcccttatact

SEQ ID NO: 208903 - DNA, 75 bp, Artificial Sequence
  Synthetic
ctgcctgcttgtgtatatggacttattgtggcaagtggatatgactttgaaaaagaagggtactccctagtcgga

SEQ ID NO: 208904 - DNA, 75 bp, Artificial Sequence
  Synthetic
atgtccgcaaacgatttgcagaccaagaactgggtgatgccccattccttgaccggcttcgccgagatcagaagt

SEQ ID NO: 208905 - DNA, 75 bp, Artificial Sequence
  Synthetic
agaagaatctgatgaggcacttaaaatgactattgcttcagtgccgacttcacgctacctaactgacatgactct

SEQ ID NO: 208906 - DNA, 75 bp, Artificial Sequence
  Synthetic
tgaagagatgtcaagggactggttcatgctcatgcccaaacagaaagtagcaggttccctttgcatcaaaatgga

SEQ ID NO: 208907 - DNA, 75 bp, Artificial Sequence
  Synthetic
gacaatgagccaagtggatacgcacagacagattgtgtgttagaagcaatggctttccttgaagaatctcatcca

SEQ ID NO: 208908 - DNA, 75 bp, Artificial Sequence
  Synthetic
actacttagagctttcacagaagaaggagcaattgtgggagaaatctcaccattaccttctcttccaggacatac

SEQ ID NO: 208909 - DNA, 75 bp, Artificial Sequence
  Synthetic
ttcagtgtgatcttcgatcggctggagacactaatactactcagagctttcactgaagagggagcaattgtcggc

SEQ ID NO: 208910 - DNA, 75 bp, Artificial Sequence
  Synthetic
cattaccttctcttccaggacatactgatgaggatgtcaaaaatgcaattgggatcctcatcggaggacttgaat

SEQ ID NO: 208911 - DNA, 75 bp, Artificial Sequence
  Synthetic
agacactaatactactcagagctttcactgaagagggagcaattgtcggcgaaatttcaccattgccttctcttc

SEQ ID NO: 208912 - DNA, 75 bp, Artificial Sequence
  Synthetic
cgccagacctatgactggacattgaatagaaaccagccggctgcaactgctttggctaatactatagaggtattc

SEQ ID NO: 208913 - DNA, 75 bp, Artificial Sequence
  Synthetic
caggacatactgatgaggatgtcaaaaatgcaattggggtcctcatcggaggacttgaatggaatgataacacag

SEQ ID NO: 208914 - DNA, 75 bp, Artificial Sequence
  Synthetic
agggataacctggaacctggaaccttcgatcttgaagggctatatgaagcaatcgaggagtgcctgattaatgat

SEQ ID NO: 208915 - DNA, 75 bp, Artificial Sequence
  Synthetic
acaatgacgaaagatgcagaaaggggcaaattgaagaggcgggcaattgcaacacccggaatgcagatcagggga

SEQ ID NO: 208916 - DNA, 75 bp, Artificial Sequence
  Synthetic
tttgtgtactttgttgaaacattggcgagaagcatctgtgaaaaacttgaacagtcaggacttcctgttggaggg

SEQ ID NO: 208917 - DNA, 75 bp, Artificial Sequence
  Synthetic
aagccaacaaaataaaatctgagaagacacacatccatattttttcattcactggagaggagatggccaccaaag

SEQ ID NO: 208918 - DNA, 75 bp, Artificial Sequence
  Synthetic
atcccctgaatccctttgtcagtcataaagaaattgagtctgtaaacaatgctgtagtaatgccagcccatggtc

SEQ ID NO: 208919 - DNA, 75 bp, Artificial Sequence
  Synthetic
gaaatgtattgagtattgcccctataatgttctcaaacaaaatggcaaggttgggaaagggatacatgtttgaga

SEQ ID NO: 208920 - DNA, 75 bp, Artificial Sequence
  Synthetic
aaagagagataacattccatggggctaaggaagttgcactcagctactcaaccggtgcacttgccagttgtatgg

SEQ ID NO: 208921 - DNA, 75 bp, Artificial Sequence
  Synthetic
taaggaagttgcactcagctactcaaccggtgcacttgccagttgtatgggtctcatatacaacaggatgggaac

SEQ ID NO: 208922 - DNA, 75 bp, Artificial Sequence
  Synthetic
attgacctgaaatacttcaatgaatcaacaagaaagaaaatcgagagaataagacctctattaatagatggcaca

SEQ ID NO: 208923 - DNA, 75 bp, Artificial Sequence
  Synthetic
tctcagattacctgatgggcctccttgctctcagcgatcaaagttcttgctgatggatgctctgaaactaagtat

SEQ ID NO: 208924 - DNA, 75 bp, Artificial Sequence
  Synthetic
atcctctgatgatttcgctctaatagtgaatgcaccaaaccatgaaggaatacaagcaggggtgaataggttcta

SEQ ID NO: 208925 - DNA, 75 bp, Artificial Sequence
  Synthetic
tacaagcaggggtgaataggttctatagaacctgcaaactggttggaatcaatatgagcaaaaagaaatcctaca

SEQ ID NO: 208926 - DNA, 75 bp, Artificial Sequence
  Synthetic
agacggaggaccaaatctgtataatatccgaaatctccacatcccagaagtctgcctgaagtgggaactaatgga

SEQ ID NO: 208927 - DNA, 75 bp, Artificial Sequence
  Synthetic
atccgaaatctccacatcccagaagtctgcctgaagtgggaactaatggatgaagactatcagggtagactatgt

SEQ ID NO: 208928 - DNA, 75 bp, Artificial Sequence
  Synthetic
gagatcctccatacagccatggaacaggaacaggatacaccatggacacagtcaacagaacacatcaatactcag

SEQ ID NO: 208929 - DNA, 75 bp, Artificial Sequence
  Synthetic
ataatgaaccgagcgggtacgcacaaacggactgcgtgttggaagcaatggctttccttgaagaatcacacccag

SEQ ID NO: 208930 - DNA, 75 bp, Artificial Sequence
  Synthetic
ggtgaattttgtaagcatggagttctccctcactgacccgagactggaaccacacaaatgggaaaagtactgtgt

SEQ ID NO: 208931 - DNA, 75 bp, Artificial Sequence
  Synthetic
ctgcaatctattcgagaaattcttccctagtagttcatacaggaggccggttggaatttctagtatggtagaggc

SEQ ID NO: 208932 - DNA, 75 bp, Artificial Sequence
  Synthetic
atggaaggcaaaaagattgttgaagacatcctaaagagtgagacggatgaaaatctcaaaattgcaattgcatcc

SEQ ID NO: 208933 - DNA, 75 bp, Artificial Sequence
  Synthetic
gatcgaacggcctaacaactaatgaatcagggaggctaatagacttcctaaaggacgtgatggactcaatgaata

SEQ ID NO: 208934 - DNA, 75 bp, Artificial Sequence
  Synthetic
atgaagactatcattgctttgagctacattctatgtctggttttcgctcaaaaacttcctggaaatgacaatagc

SEQ ID NO: 208935 - DNA, 75 bp, Artificial Sequence
  Synthetic
ctgttgcaactacacattcttggattccaaaaaggaatcgttccattctcaatactagccaaaggggaattcttg

SEQ ID NO: 208936 - DNA, 75 bp, Artificial Sequence
  Synthetic
acggcaacgctgtgccttgggcaccatgcagtaccaaacggaacgatagtgaaaacaatcacgaatgaccaaatt

SEQ ID NO: 208937 - DNA, 75 bp, Artificial Sequence
  Synthetic
ttgaagtgctgcacttaactcagggaacatgctgggagcaaatgtacactccaggaggagaagtgagaaatgatg

SEQ ID NO: 208938 - DNA, 75 bp, Artificial Sequence
  Synthetic
ttaataagagcactgacactgaacacaatgacaaaggatgcagaaagaggcaaattgaaaaggagggcaattgca

SEQ ID NO: 208939 - DNA, 75 bp, Artificial Sequence
  Synthetic
caatgacaaaggatgcagaaagaggcaaattgaaaaggagggcaattgcaacacccggaatgcagatcagaggat

SEQ ID NO: 208940 - DNA, 75 bp, Artificial Sequence
  Synthetic
actccaagattgtaagattgcccctttaatggtggcatacatgttggaaagagaactggtccgcaaaaccagatt

SEQ ID NO: 208941 - DNA, 75 bp, Artificial Sequence
  Synthetic
aagaatggttgacatccttaaacaaaatccaacggaagagcaagccgtggatatatgcaaagcagcaatgggttt

SEQ ID NO: 208942 - DNA, 75 bp, Artificial Sequence
  Synthetic
gttgaaactattgataatgtcatgggaatgatcggaatattgcctgacatgactccaagcacagagatgtcactg

SEQ ID NO: 208943 - DNA, 75 bp, Artificial Sequence
  Synthetic
ccgggtacggacaaggaccaaatcttcctgtatgctcaatcatcaggaagaatcacagtatctaccaaaagaagc

SEQ ID NO: 208944 - DNA, 75 bp, Artificial Sequence
  Synthetic
caagagcatgaagctacggacacaaataccagcagaaatgcttgcaaccattgacctgaaatacttcaatgaatc

SEQ ID NO: 208945 - DNA, 75 bp, Artificial Sequence
  Synthetic
tttccaaaaagatgcaaaagtgcttttccagaactggggaattgaacccatcgacagtgtaatgggaatgatcgg

SEQ ID NO: 208946 - DNA, 75 bp, Artificial Sequence
  Synthetic
cacatactggtgggacggactccaatcctctgatgatttcgccctcatagtaaatgcaccaaatcatgagggaat

SEQ ID NO: 208947 - DNA, 75 bp, Artificial Sequence
  Synthetic
gagtcagcaaaatgggggtagatgagtattccagcacggagagagtggtagtgagcattgaccgatttttgagag

SEQ ID NO: 208948 - DNA, 75 bp, Artificial Sequence
  Synthetic
atgcaagtctgaatgcatcactccaaatggaagcattcccaatgacaaaccattccaaaatgtaaacaggatcac

SEQ ID NO: 208949 - DNA, 75 bp, Artificial Sequence
  Synthetic
ttcgggatcaacgagggaacgtactattgtctcccgaagaggtcagcgagacacagggaactgagaaattgacaa

SEQ ID NO: 208950 - DNA, 75 bp, Artificial Sequence
  Synthetic
atatgagcaaaaagaagtcttatataaataggacaggaacatttgagttcacaagttttttctaccggtatggat

SEQ ID NO: 208951 - DNA, 75 bp, Artificial Sequence
  Synthetic
aaataggacaggaacatttgagttcacaagttttttctaccggtatggatttgtggccaacttcagtatggagct

SEQ ID NO: 208952 - DNA, 75 bp, Artificial Sequence
  Synthetic
atccggagtggagtccgccgtcttgagagggttcctcattataggtaaggaagacagaagatacggaccagcatt

SEQ ID NO: 208953 - DNA, 75 bp, Artificial Sequence
  Synthetic
gggttacagtaataaagaacaatatgataaataatgaccttggaccagcaacagcccagatggctcttcagctat

SEQ ID NO: 208954 - DNA, 75 bp, Artificial Sequence
  Synthetic
gaaagagccccacattgtcaagccgcatgagaaaggcataaatccaaactatctcctggcttggaaacaagtgct

SEQ ID NO: 208955 - DNA, 75 bp, Artificial Sequence
  Synthetic
tcatcaaggattatcggtacacgtaccgatgccacaggggtgatacgcaaattcaaacaaggagatcatttgagc

SEQ ID NO: 208956 - DNA, 75 bp, Artificial Sequence
  Synthetic
aatattctcagaactcaggagtcagagtgtgtttgcatcaatgggacttgtacagtagtaatgactgatggaaac

SEQ ID NO: 208957 - DNA, 75 bp, Artificial Sequence
  Synthetic
caacaaggaagaaaattgaaaaaataaggcctcttctaatagatggcacagcatcattgagccctggaatgatga

SEQ ID NO: 208958 - DNA, 75 bp, Artificial Sequence
  Synthetic
gcttcttgttgccctggagaaccaacatacaattgatctaactgactcagaaatgaacaaactgtttgaaaaaac

SEQ ID NO: 208959 - DNA, 75 bp, Artificial Sequence
  Synthetic
tccggaatctccacattccagaggtctgcttgaagtgggaattaatggatgaggattataagggcaggctgtgca

SEQ ID NO: 208960 - DNA, 75 bp, Artificial Sequence
  Synthetic
gccgtagtgatgccagcccatggtccagcaaagagcatggagtatgatgccgttgcgactacacactcatggatc

SEQ ID NO: 208961 - DNA, 75 bp, Artificial Sequence
  Synthetic
tgtgaaccaacaataatagaaagaaacataacagagatagtgtatctgaccaacaccacaatagagaaggaaata

SEQ ID NO: 208962 - DNA, 75 bp, Artificial Sequence
  Synthetic
ggatgaacagatgtatcagaagtgctgcaatctatttgagaagttcttccctagtagttcatataggaggccagt

SEQ ID NO: 208963 - DNA, 75 bp, Artificial Sequence
  Synthetic
ctttgtgttgctttgttggggttcatcatgtgggcctgccaaaagggcaacattaggtgcaacatttgcatttga

SEQ ID NO: 208964 - DNA, 75 bp, Artificial Sequence
  Synthetic
atggaagactttgtgcgacaatgcttcaatccaatgattgtcgagcttgcggaaaaggcaatgaaagaatatggg

SEQ ID NO: 208965 - DNA, 75 bp, Artificial Sequence
  Synthetic
atgagccttctaaccgaggtcgaaacgtatgttctctctatcgttccatcaggccccctcaaagccgagatcgcg

SEQ ID NO: 208966 - DNA, 75 bp, Artificial Sequence
  Synthetic
gtgggcacttggtgagaatatggcaccagaaaaggtagactttgaggattgcaaagatgttagagatctaaaaca

SEQ ID NO: 208967 - DNA, 75 bp, Artificial Sequence
  Synthetic
ttttagggtttgttttcacgctcaccgtgcccagtgagcgaggactgcagcgtagacgctttgtccaaaatgccc

SEQ ID NO: 208968 - DNA, 75 bp, Artificial Sequence
  Synthetic
gaaaagcatggctgcatgtttgtataacgggggatgataaaaatgcaactgctagcttcatttacaatgggaggc

SEQ ID NO: 208969 - DNA, 75 bp, Artificial Sequence
  Synthetic
tcagaatgaaatggatgatggcaatgaaatatccaatcacagcagacaagagaataatggagatgattcctgaaa

SEQ ID NO: 208970 - DNA, 75 bp, Artificial Sequence
  Synthetic
agaaagttgaaaggttacaacatggaaccttcggtcctgtccatttcagaaaccaagttaaaatacgccgccgag

SEQ ID NO: 208971 - DNA, 75 bp, Artificial Sequence
  Synthetic
gcattgtttccagttatgtgtgttcaggacttgttggagacacacccagaaaaaacgacagctccagcagtagcc

SEQ ID NO: 208972 - DNA, 75 bp, Artificial Sequence
  Synthetic
gtcatcatggaggtcgtcttcccaaatgaggtgggagctagaatattgacctcagagtcgcagttgacaataacg

SEQ ID NO: 208973 - DNA, 75 bp, Artificial Sequence
  Synthetic
tttgtacatttacagctacatatgcggacacaatatgtataggataccatgccaacaactcaaccgacactgttg

SEQ ID NO: 208974 - DNA, 75 bp, Artificial Sequence
  Synthetic
gcaagtcatagttgacagaggtgataggtccggttattctggtattttctctgttgaaggcaaaagctgcatcaa

SEQ ID NO: 208975 - DNA, 75 bp, Artificial Sequence
  Synthetic
tatgagggaagaatatcgaaaggaacagcagaatgctgtggatgctgacgacagtcattttgtcagcatagagtt

SEQ ID NO: 208976 - DNA, 75 bp, Artificial Sequence
  Synthetic
atggatgtcaatccgactctactgttcttaaaagttccagcgcagaatgccataagcacaacattcccttatact

SEQ ID NO: 208977 - DNA, 75 bp, Artificial Sequence
  Synthetic
aggattaagaaagaagagttcgctgagatcatgaagatctgttccaccattgaagagctcagacggcaaaaatag

SEQ ID NO: 208978 - DNA, 75 bp, Artificial Sequence
  Synthetic
atcactactggagatgtgccacagcacacaaattggtggaataaggatggtggacatccttaggcaaaatccaac

SEQ ID NO: 208979 - DNA, 75 bp, Artificial Sequence
  Synthetic
acacaaattggtggaataaggatggtggacatccttaggcaaaatccaactgaggaacaagctgtggatatatgc

SEQ ID NO: 208980 - DNA, 75 bp, Artificial Sequence
  Synthetic
gttcatcctttagcttcggaggctttactttcaaaagaacaagtggatcatccgtcaagaaggaagaggaagtgc

SEQ ID NO: 208981 - DNA, 75 bp, Artificial Sequence
  Synthetic
gaattcacaatggttgggcgaagagcaacagctattctgaggaaagcaactagaaggctgattcagttgatagta

SEQ ID NO: 208982 - DNA, 75 bp, Artificial Sequence
  Synthetic
tagaaggctgattcagttgatagtaagtgggagagacgaacaatcaatcgctgaagcaatcatcgtagctatggt

SEQ ID NO: 208983 - DNA, 75 bp, Artificial Sequence
  Synthetic
ggaatattacctgacatgactccaagcacagagatgtcactgagaggagtaagagttagtaaaatgggagtagat

SEQ ID NO: 208984 - DNA, 75 bp, Artificial Sequence
  Synthetic
ttgccagttgcatgggcctcatatacaataggatgggggctgtaaccactgaagtggcatttggcctggtatgtg

SEQ ID NO: 208985 - DNA, 75 bp, Artificial Sequence
  Synthetic
aaacacagggaacagagaaattaacaataacatattcatcatcaatgatgtgggaaatcaatggtcctgagtcag

SEQ ID NO: 208986 - DNA, 75 bp, Artificial Sequence
  Synthetic
accgttccaatccttagtacctaaagctgccagaggtcaatacagtggatttgtgagaacactattccaacaaat

SEQ ID NO: 208987 - DNA, 75 bp, Artificial Sequence
  Synthetic
ctgcctgcttgtgtgtatgggcttgcggtagcaagtgggcatgactttgaaagggaagggtactcactggtcggg

SEQ ID NO: 208988 - DNA, 75 bp, Artificial Sequence
  Synthetic
ggtgtgcgccacatgtgagcagattgctgattcccagcatcggtctcacagacaaatggtgacaacaaccaaccc

SEQ ID NO: 208989 - DNA, 75 bp, Artificial Sequence
  Synthetic
actgcagtggaacagtcattagagaatacaatgaaacagtaaggattgagaaagtaacacaatggcacaatacca

SEQ ID NO: 208990 - DNA, 75 bp, Artificial Sequence
  Synthetic
atcggtgccatagaggagacacacaaatccaaacgagaagatcattcgagataaagaagctgtgggatcaaaccc

SEQ ID NO: 208991 - DNA, 75 bp, Artificial Sequence
  Synthetic
acagagccattgtgtgatgctaagggttttgcccccttttccaaagacaacgggataaggattgggtcaaggggt

SEQ ID NO: 208992 - DNA, 75 bp, Artificial Sequence
  Synthetic
tcgaacctgggacctttgatcttggggggctatatgaagcaattgaggagtgcctgattaatgatccctgggttt

SEQ ID NO: 208993 - DNA, 75 bp, Artificial Sequence
  Synthetic
gagatattctaagaactcaggaatcatcatgcacttgcattcaaggtgagtgttattgggtgatgacggatgggc

SEQ ID NO: 208994 - DNA, 75 bp, Artificial Sequence
  Synthetic
atggattccaacacgataacctcgtttcaggtagattgctatctatggcacataagaaagctgctcagcatgaga

SEQ ID NO: 208995 - DNA, 75 bp, Artificial Sequence
  Synthetic
ggattaagaaggaagagttctctgagatcatgaagatctgttccaccattgaagaactcagacggcaaaaataat

SEQ ID NO: 208996 - DNA, 75 bp, Artificial Sequence
  Synthetic
atggaaagaataaaagaactacggaatctgatgtcgcaatctcgcactcgcgagatactgacaaaaaccacagtg

SEQ ID NO: 208997 - DNA, 75 bp, Artificial Sequence
  Synthetic
ggactcgacctgcgagtggccacaatggaaggcaaaaagattgttgaagacatcctaaagagtgaaacggatgaa

SEQ ID NO: 208998 - DNA, 75 bp, Artificial Sequence
  Synthetic
agggtaggatacctatgtgcaggcctccccagtgacactccaagaggagaagatagtcagttcacagggtcatgc

SEQ ID NO: 208999 - DNA, 75 bp, Artificial Sequence
  Synthetic
gaatggtacatgctcatgccaaggcagaaaataacagggggtctgatggtgaaaatggatcaggccatcatggac

SEQ ID NO: 209000 - DNA, 75 bp, Artificial Sequence
  Synthetic
acacatcaggaaggcaagagaagaaccccgcactcagaatgaagtggatgatggcaatgaaatatccaattacag

SEQ ID NO: 209001 - DNA, 75 bp, Artificial Sequence
  Synthetic
ccgaacaatggcctggacagtggtgaatagcatctgcaacaccacaggggtcgagaagcctaaatttctcccgga

SEQ ID NO: 209002 - DNA, 75 bp, Artificial Sequence
  Synthetic
cagggtttgaaatcctgaaagtcagaaatggctgggtacaaaatagtaaagagcagatcaaaaggcaagttgtgg

SEQ ID NO: 209003 - DNA, 75 bp, Artificial Sequence
  Synthetic
aatggaacctcaaaaattaaaatgaaatggggaatggagatgaggcgttgtctcctccagtcacttcaacaaatt

SEQ ID NO: 209004 - DNA, 75 bp, Artificial Sequence
  Synthetic
aaggggcaagccagaagaaaagacgatatggacctcaagtagctccattgtgatgtgtggagtagaccatgagat

SEQ ID NO: 209005 - DNA, 75 bp, Artificial Sequence
  Synthetic
gataatgaaccaagtggatatgcacaaacagactgcgtcctggaggccatggctttccttgaagaatctcaccca

SEQ ID NO: 209006 - DNA, 75 bp, Artificial Sequence
  Synthetic
tgccgactggtcgtggcacgatggagctatctcctttgacatcgaaaagatgtaatttacgaaaaaactccttgt

SEQ ID NO: 209007 - DNA, 75 bp, Artificial Sequence
  Synthetic
atggatgtcaatccgactttacttttcttgaaagtgccagtgcaaaatgctataagtaccacattcccttatact

SEQ ID NO: 209008 - DNA, 75 bp, Artificial Sequence
  Synthetic
cgccagacttatgattggacattaaacaggaatcaaccggcagcaactgcattggccaacaccatagaagttttt

SEQ ID NO: 209009 - DNA, 75 bp, Artificial Sequence
  Synthetic
attgtcgagcttgcggaaaaggcaatgaaagaatatggggaagatccgaaaatcgaaacgaacaaatttgccgca

SEQ ID NO: 209010 - DNA, 75 bp, Artificial Sequence
  Synthetic
tcatgtattcggatttccactttattgatgaacgaggcgaatcaataattgtagaatctggcgatccgaatgcat

SEQ ID NO: 209011 - DNA, 75 bp, Artificial Sequence
  Synthetic
aacccgactgaagaacaagctgtggatatatgcaaggctgcaatgggattgagaatcagctcatccttcagcttt

SEQ ID NO: 209012 - DNA, 75 bp, Artificial Sequence
  Synthetic
aatccaacagaggaacaagccgtggacatatgcaaggcagcaatggggctgaggattagctcctctttcagcttt

SEQ ID NO: 209013 - DNA, 75 bp, Artificial Sequence
  Synthetic
gtccaaaatgcccttaatgggaatggggatccaaacaacatggacagagcagtcaaactgtacaggaagcttaaa

SEQ ID NO: 209014 - DNA, 75 bp, Artificial Sequence
  Synthetic
ctgcaatctattcgagaaattcttccctagcagctcatacaggagaccagttggaatttccagcatggtggaggc

SEQ ID NO: 209015 - DNA, 75 bp, Artificial Sequence
  Synthetic
tatggagagaataaaagaactaagagatctaatgtcacagtctcgcactcgcgagatactcactaaaaccactgt

SEQ ID NO: 209016 - DNA, 75 bp, Artificial Sequence
  Synthetic
cactgtaccagaatgtgggaacatatgtttccattggaacatcaacactaaataagagatcaatccctgaaatag

SEQ ID NO: 209017 - DNA, 75 bp, Artificial Sequence
  Synthetic
aatacttacgtcggagtcacaactgacgataacaaaagagaagaaggaggaactccaggactgcaaaatcgctcc

SEQ ID NO: 209018 - DNA, 75 bp, Artificial Sequence
  Synthetic
tgcccttccacaacattcacccattgacaataggtgagtgccccaagtatgtcaagtcagatagactggttttgg

SEQ ID NO: 209019 - DNA, 75 bp, Artificial Sequence
  Synthetic
gtatggatatcatcacagcaatgatcaaggatcaggatatgcagcagacaaagaatccactcaaaaggcaattga

SEQ ID NO: 209020 - DNA, 75 bp, Artificial Sequence
  Synthetic
acaagccaattgaagtgggcacttggtgagaacatggcaccagagaaagtagactttgaggactgcaaagatgtt

SEQ ID NO: 209021 - DNA, 75 bp, Artificial Sequence
  Synthetic
gtgagaacatggcaccagagaaagtagactttgaggactgcaaagatgttagcgatctaagacagtatgacagtg

SEQ ID NO: 209022 - DNA, 75 bp, Artificial Sequence
  Synthetic
aagctggatccagagcgaattcaacaaagcatgcgaattgacagattcaagttggattgaacttgatgaaatagg

SEQ ID NO: 209023 - DNA, 75 bp, Artificial Sequence
  Synthetic
atcaatgaccgaaacttctggagaggtgaaaatggacgaaggacaaggattgcatatgagagaatgtgcaatatt

SEQ ID NO: 209024 - DNA, 75 bp, Artificial Sequence
  Synthetic
ccatgcagacctcagtgccaaagaggcacaggatgtaatcatggaagttgtctttccaaatgaagtgggagcgag

SEQ ID NO: 209025 - DNA, 75 bp, Artificial Sequence
  Synthetic
ttctcccagtggctggtggaacaagcagtgtctacattgaggtgctgcatttgacccaggggacatgctgggagc

SEQ ID NO: 209026 - DNA, 75 bp, Artificial Sequence
  Synthetic
atggaagattttgtgcgacaatgcttcaacccgatgattgtcgaacttgcagaaaaagcaatgaaagagtatggg

SEQ ID NO: 209027 - DNA, 75 bp, Artificial Sequence
  Synthetic
tgagcatggaattctctcttactgacccgaggctggagccacacaagtgggaaaagtactgtgttctcgagatag

SEQ ID NO: 209028 - DNA, 75 bp, Artificial Sequence
  Synthetic
ccaagatcaagatgaaatggggcatggagatgaggcggtgccttcttcaatcccttcaacaaatcgagagcatga

SEQ ID NO: 209029 - DNA, 75 bp, Artificial Sequence
  Synthetic
gaactatgcgcaagcttgccgaccaaagtctcccaccgaacttctccagccttgaaaactttagagcctatgtag

SEQ ID NO: 209030 - DNA, 75 bp, Artificial Sequence
  Synthetic
ggaaggctccattgggaaggtgtgcagaacattactagcaaaatctgtattcaacagcctatatgcatctccaca

SEQ ID NO: 209031 - DNA, 75 bp, Artificial Sequence
  Synthetic
acagtgggttcgtaaggacattattccagcaaatgcgggatgtgcttggaacatttgacactgttcagataataa

SEQ ID NO: 209032 - DNA, 75 bp, Artificial Sequence
  Synthetic
agaaaattgcttctcattgttcaggcacttagggacaacctggaacctgggaccttcgatcttggggggctatat

SEQ ID NO: 209033 - DNA, 75 bp, Artificial Sequence
  Synthetic
tgcggaaaaggcaatgaaagaatatggggaagatccaaaaatcgagacaaacaaatttgctgcaatatgcacaca

SEQ ID NO: 209034 - DNA, 75 bp, Artificial Sequence
  Synthetic
ggggaagatccaaaaatcgagacaaacaaatttgctgcaatatgcacacacttagaagtgtgtttcatgtattca

SEQ ID NO: 209035 - DNA, 75 bp, Artificial Sequence
  Synthetic
tcattaatcatgaagaccgtcattgctttaagctacattttctgtctggctttcggtcaggatcttccagggaat

SEQ ID NO: 209036 - DNA, 75 bp, Artificial Sequence
  Synthetic
ctttaagctacattttctgtctggctttcggtcaggatcttccagggaatgacaacagtacagcgacactgtgcc

SEQ ID NO: 209037 - DNA, 75 bp, Artificial Sequence
  Synthetic
aagtagagcgaggatcaaaaccagactattcaccataaggcaagagatggccagtagaggcctctgggattcctt

SEQ ID NO: 209038 - DNA, 75 bp, Artificial Sequence
  Synthetic
tcgaatggaccaggcgatcatggaaaagaacatcatactgaaagcgaacttcagtgtgatctttaaccgattaga

SEQ ID NO: 209039 - DNA, 75 bp, Artificial Sequence
  Synthetic
gatcaaattgaggtaactaatgctactgagctagttcaaagctcctcaacagggaaaatatgcaacaatccccac

SEQ ID NO: 209040 - DNA, 75 bp, Artificial Sequence
  Synthetic
gaaacatgggacctttttgtggagcggagcaatgctttcagcaattgttacccttacgatgtaccagactatgca

SEQ ID NO: 209041 - DNA, 75 bp, Artificial Sequence
  Synthetic
aggattcacttggccaggagtaactcagaatggaggaagcggtgcctgcaaaaggggacccgctaatggtttttt

SEQ ID NO: 209042 - DNA, 75 bp, Artificial Sequence
  Synthetic
atgtgactatgccgaacaatgacaattttgacaaactatacatctggggagttcaccacccaagcacaaatcaag

SEQ ID NO: 209043 - DNA, 75 bp, Artificial Sequence
  Synthetic
gaaagccaacaagataaaatccgagaagacacatattcacatcttttcatttactggagaagaaatggccaccaa

SEQ ID NO: 209044 - DNA, 75 bp, Artificial Sequence
  Synthetic
tccaaatcagaaaataataaccattggctcagtgtcattaggattggtagtccttaatattctcctacatatagt

SEQ ID NO: 209045 - DNA, 75 bp, Artificial Sequence
  Synthetic
ttttgacaaactatacatctggggagttcaccacccaagcacaaatcaagaacagaccagcttatacgttcaagc

SEQ ID NO: 209046 - DNA, 75 bp, Artificial Sequence
  Synthetic
caaacattggatctagaccttgggtaaggggccaatctggcagaattagcatctattggacaatagttaaacctg

SEQ ID NO: 209047 - DNA, 75 bp, Artificial Sequence
  Synthetic
gagacgtactggtaatcaatagtaatggaaacctaatcgcccctcggggttatttcaagatgcgcactgggaaaa

SEQ ID NO: 209048 - DNA, 75 bp, Artificial Sequence
  Synthetic
gccattcctgaaaacaacaccacgccctctcaaattacctgatgggcccccttgctcccagcgatcaaaattctt

SEQ ID NO: 209049 - DNA, 75 bp, Artificial Sequence
  Synthetic
accaagatatgccttcgcaatgaaaagaggctatggatctggtattatcgtttcagatgcaccagtccatgattg

SEQ ID NO: 209050 - DNA, 75 bp, Artificial Sequence
  Synthetic
tccatggagccaaggaagtagcgctcagttactctgctggtgcacttgccagttgcatgggcctaatatacaaca

SEQ ID NO: 209051 - DNA, 75 bp, Artificial Sequence
  Synthetic
cagttactctgctggtgcacttgccagttgcatgggcctaatatacaacagaatggggactgtcgccactgaggt

SEQ ID NO: 209052 - DNA, 75 bp, Artificial Sequence
  Synthetic
catgtttttgttataagggaaccatttgtttcttgctctccaacagagtgcaggacgttcttccttacccagggt

SEQ ID NO: 209053 - DNA, 75 bp, Artificial Sequence
  Synthetic
atcactccaaatggaagcattcccaatgacaagccctttcaaaatgtaaacaagatcacatacggagcatgtccc

SEQ ID NO: 209054 - DNA, 75 bp, Artificial Sequence
  Synthetic
atgacaagccctttcaaaatgtaaacaagatcacatacggagcatgtcccaaatatgtgaagcagaacaccctga

SEQ ID NO: 209055 - DNA, 75 bp, Artificial Sequence
  Synthetic
agttgcatgggcctaatatacaacagaatggggactgtcgccactgaggtggcatttggtctggtatgcgcaacc

SEQ ID NO: 209056 - DNA, 75 bp, Artificial Sequence
  Synthetic
aacaaccaatccactaatcaagcacgagaacagaatggtaatagccagcacaacagctaaggccatggaacaaat

SEQ ID NO: 209057 - DNA, 75 bp, Artificial Sequence
  Synthetic
aggcaaggtttgaagcagtagcgtggtcagccactgcatgccatgatgggaagaaatggatgacaattggagtaa

SEQ ID NO: 209058 - DNA, 75 bp, Artificial Sequence
  Synthetic
ggctgggtcaagtgaacaagcagcagaggctatggaggttgccagccaggctagacaaatgatacaggcaatgag

SEQ ID NO: 209059 - DNA, 75 bp, Artificial Sequence
  Synthetic
aattccgaaggtacaggacaagcagcagaccttaaaagcactcaggcagctatcgatcagatcaacgggaaattg

SEQ ID NO: 209060 - DNA, 75 bp, Artificial Sequence
  Synthetic
cgggccctgatgccaaagcagtagcagtggtgcattatgggggaattcctactgatgtaatcaattcctgggcag

SEQ ID NO: 209061 - DNA, 75 bp, Artificial Sequence
  Synthetic
gataatgagccaagcgggtatgcacaaacagattgtgtattggaggcaatggctttccttgaagaatcccaccca

SEQ ID NO: 209062 - DNA, 75 bp, Artificial Sequence
  Synthetic
gcaagcatcattgggattttgcacctgatattgtggattttcgatcgtctttttttcaaatgcatttaccgtcgc

SEQ ID NO: 209063 - DNA, 75 bp, Artificial Sequence
  Synthetic
acacaaagatagatctctggtcttacaatgcggagcttcttattgctctagagaatcagcatacaattgatttga

SEQ ID NO: 209064 - DNA, 75 bp, Artificial Sequence
  Synthetic
tcaatggaggtcatatagaagaatgctcatgctaccccaatgaaggtaaagtggaatgtgtttgtagggacaact

SEQ ID NO: 209065 - DNA, 75 bp, Artificial Sequence
  Synthetic
tcgattccagatcaagggtgttgagctaaaatctggatacaaagactggatcctgtggatttcctttgccatatc

SEQ ID NO: 209066 - DNA, 75 bp, Artificial Sequence
  Synthetic
gagcagatcaaaaggcaagttgtggtcgataacttgaattggtcaggatacagtggttccttcacactaccggtg

SEQ ID NO: 209067 - DNA, 75 bp, Artificial Sequence
  Synthetic
tagagaattctttgagaacaagtcggaaacgtggccaattggagaatcccccagaggggttgaggaaggttctat

SEQ ID NO: 209068 - DNA, 75 bp, Artificial Sequence
  Synthetic
ggaatgagaatcaaaaccccaggatgtttctggcgatgataacgtacatcacaagaaatcagcctgaatggttca

SEQ ID NO: 209069 - DNA, 75 bp, Artificial Sequence
  Synthetic
cgatattggtagcagccggaaggtcagacaagatctgcattggatatcatgccaacaattcaacaacacaagtgg

SEQ ID NO: 209070 - DNA, 75 bp, Artificial Sequence
  Synthetic
agacaagatctgcattggatatcatgccaacaattcaacaacacaagtggatactatacttgagaagaatgtcac

SEQ ID NO: 209071 - DNA, 75 bp, Artificial Sequence
  Synthetic
atactatacttgagaagaatgtcactgtcacacactcagttgaattgctagagaaccagaaggaagaaagattct

SEQ ID NO: 209072 - DNA, 75 bp, Artificial Sequence
  Synthetic
ggttggatcctggggaatcctcaatgcgacctattgcttggtgatcaaagctggtcatatatagtggaaaggcct

SEQ ID NO: 209073 - DNA, 75 bp, Artificial Sequence
  Synthetic
ctgtaaagatccaatggtcccaagaccccacaatgctatacaacaagatggaatttgagccatttcagtctctag

SEQ ID NO: 209074 - DNA, 75 bp, Artificial Sequence
  Synthetic
gaaagggtagagagatttgagatgtttcccaaaagtacatggacaggagtagacaccagcagtggggtaacaaag

SEQ ID NO: 209075 - DNA, 75 bp, Artificial Sequence
  Synthetic
gccaacaactcaactgacactgttgacacagtacttgaaaagaatgtgacagtgacacactctgtcaacctactt

SEQ ID NO: 209076 - DNA, 75 bp, Artificial Sequence
  Synthetic
aataaagaccaagtcagcagcatatccagtaattaaaggaacttacaacaacactggaaaccagccaatccttta

SEQ ID NO: 209077 - DNA, 75 bp, Artificial Sequence
  Synthetic
tttctggggtgtgcaccatccacctgacaccaatgagcaaaataccctatatggctctggtgataggtacgttag

SEQ ID NO: 209078 - DNA, 75 bp, Artificial Sequence
  Synthetic
gacctgctgtgaacggtcaaagaggcagaattgattattactggtctgttttaaaaccaggggaaaccttgaatg

SEQ ID NO: 209079 - DNA, 75 bp, Artificial Sequence
  Synthetic
gtggagtgtgtttgtagggacaactggactggaaccaacaggccagtattggtgatttctccagatttgtcttac

SEQ ID NO: 209080 - DNA, 75 bp, Artificial Sequence
  Synthetic
catttcagaatgtgagtcctctgtggataggagaatgccccaaatacgtgaaaagtgaaagtttgaggcttgcaa

SEQ ID NO: 209081 - DNA, 75 bp, Artificial Sequence
  Synthetic
agagcatctgttggaaggatggttggtggaattgggaggttttacatacagatgtgcactgaactcaaactcagc

SEQ ID NO: 209082 - DNA, 75 bp, Artificial Sequence
  Synthetic
cttatgaacagatggaaactggtggagaacgccaaaatactactgaaatcagagcatctgttgggagaatggttg

SEQ ID NO: 209083 - DNA, 75 bp, Artificial Sequence
  Synthetic
tggctatcaccatgaaaattctcaaggctcaggatatgcagcagacaaagaaagcactcaaaaggctatagacgg

SEQ ID NO: 209084 - DNA, 75 bp, Artificial Sequence
  Synthetic
cgatattggcagcagccggaagatcagacaagatctgcattggatatcatgccaacaattcaacaacacaagtgg

SEQ ID NO: 209085 - DNA, 75 bp, Artificial Sequence
  Synthetic
attgacaaaatgaacacacaatttgaggctgttgaccacgaattttcaaatctggagagaagaattgacaatctg

SEQ ID NO: 209086 - DNA, 75 bp, Artificial Sequence
  Synthetic
ttctgtatgacaaagaggagatcaggagaatctggcgtcaagcgaataatggagaagacgcaactgctggtctca

SEQ ID NO: 209087 - DNA, 75 bp, Artificial Sequence
  Synthetic
tacaatgggaggcttgtagatagtattggttcatggtccaaaaatatactcagaacccaggagtcggaatgcgtc

SEQ ID NO: 209088 - DNA, 75 bp, Artificial Sequence
  Synthetic
caggacatactaatgaggatgtcaaaaatgcaattggggtcctcatcggaggacttgaatggaatggtaacacag

SEQ ID NO: 209089 - DNA, 75 bp, Artificial Sequence
  Synthetic
cagaggtttgtttggggccattgccggtttcattgaaggggggtggactggaatggtagatgggtggtatggtta

SEQ ID NO: 209090 - DNA, 75 bp, Artificial Sequence
  Synthetic
tctggagctgctggcgcagcagtaaagggagtcggaacgatggtgatggaactaattcggatgataaaacgaggg

SEQ ID NO: 209091 - DNA, 75 bp, Artificial Sequence
  Synthetic
aatgatctaggaaatgggtgctttgaattctggcataaatgtgacaatgagtgcatagagtctgtcaaaaatggt

SEQ ID NO: 209092 - DNA, 75 bp, Artificial Sequence
  Synthetic
aaacaaggtgaattctgtaattgagaaaatgaacactcaattcacagctgtgggcaaggaattcaacaaattgga

SEQ ID NO: 209093 - DNA, 75 bp, Artificial Sequence
  Synthetic
aatagaatcggtaaagctagaaaatcttggtgtgtatcaaattcttgctatttatagtacggtatcgagcagtct

SEQ ID NO: 209094 - DNA, 75 bp, Artificial Sequence
  Synthetic
ctaacaatgagaaaggtggtcatggggtgaaaggctgggcctttgatgatggaaatgacgtgtggatgggaagga

SEQ ID NO: 209095 - DNA, 75 bp, Artificial Sequence
  Synthetic
ctgtggccagtggatatgactttgagagagaagggtactctctagttggaatagatcctttccgtctgcttcaaa

SEQ ID NO: 209096 - DNA, 75 bp, Artificial Sequence
  Synthetic
gctgagattgaagatctcatctttttggcacgatctgcactcattctgagaggatcagtggctcataaatcctgc

SEQ ID NO: 209097 - DNA, 75 bp, Artificial Sequence
  Synthetic
accaaatgagaacccagcacacaagagtcaattggtatggatggcatgccattctgcagcatttgaggacctgag

SEQ ID NO: 209098 - DNA, 75 bp, Artificial Sequence
  Synthetic
ccaccagaggagttcaaattgcttcaaatgaaaacatggaaacaatggactccagcactcttgaactgaggagca

SEQ ID NO: 209099 - DNA, 75 bp, Artificial Sequence
  Synthetic
tccagcactcttgaactgaggagcagatattgggctataaggaccaggagtggaggaaacaccaaccaacagaga

SEQ ID NO: 209100 - DNA, 75 bp, Artificial Sequence
  Synthetic
aggggcggggagtcttcgagctctcggacgaaaaggcaacgaacccgatcgtgccttcctttgacatgagtaatg

SEQ ID NO: 209101 - DNA, 75 bp, Artificial Sequence
  Synthetic
gcatctgcagggcaaatcagtgtacagcctactttctcagtacagagaaatcttcctttcgagagagcgaccatc

SEQ ID NO: 209102 - DNA, 75 bp, Artificial Sequence
  Synthetic
tcaatggtcacaagatcccacaatgttatacaacaaaatggaatttgaaccatttcagtctcttgtccctaaggc

SEQ ID NO: 209103 - DNA, 75 bp, Artificial Sequence
  Synthetic
caggagatttcatcaattatgaggagctaagagagcaattgagctcagtgtcatcatttgaaaggtttgagatat

SEQ ID NO: 209104 - DNA, 75 bp, Artificial Sequence
  Synthetic
cagaatggaccaggcaataatggacaagaacatcacattgaaagcaaacttcagtgtgatttttaaccggctgga

SEQ ID NO: 209105 - DNA, 75 bp, Artificial Sequence
  Synthetic
gactggttcatgctcatgcccaagcagaaagtggcaggttccctttgcatcaaaatggaccaggcaataatggat

SEQ ID NO: 209106 - DNA, 75 bp, Artificial Sequence
  Synthetic
agatggggtaaagctggaatcaacaaggatttaccagattttggcgatctattcaactgtcgccagttcattggt

SEQ ID NO: 209107 - DNA, 75 bp, Artificial Sequence
  Synthetic
atggaagcaagattatttgtattattctgtgcattcactacactaaaagctgacaccatttgtgtaggctaccac

SEQ ID NO: 209108 - DNA, 75 bp, Artificial Sequence
  Synthetic
acagaaacggaaaatggcgagaacaattgggccagaagtttgaagaaataagatggctaattgaggaaatgcgac

SEQ ID NO: 209109 - DNA, 75 bp, Artificial Sequence
  Synthetic
acaactgggaaactgcaacgtagcaggatggatccttggcaacccaaaatgtgacttgctgctcacagcgaattc

SEQ ID NO: 209110 - DNA, 75 bp, Artificial Sequence
  Synthetic
atgaatacaaatcaaagaataataaccattgggactgtttgtttgataattgggatagttagtctattgttacaa

SEQ ID NO: 209111 - DNA, 75 bp, Artificial Sequence
  Synthetic
tgggatagttagtctattgttacaaataggaaacatggtttcgatatggatcagccatccaattcagactggagg

SEQ ID NO: 209112 - DNA, 75 bp, Artificial Sequence
  Synthetic
ataggaaacatggtttcgatatggatcagccatccaattcagactggaggggaaaatcacactgagatgtgcaac

SEQ ID NO: 209113 - DNA, 75 bp, Artificial Sequence
  Synthetic
aaaatggtaagactaggaaaagggtacatgttcgagagtaaaataatgaagctccgaacacagataccagcagaa

SEQ ID NO: 209114 - DNA, 75 bp, Artificial Sequence
  Synthetic
cagctactcaacaggtgcacttgcaagttgcttgggtctcatatataacagaatgggaacagtgaccacagaagg

SEQ ID NO: 209115 - DNA, 75 bp, Artificial Sequence
  Synthetic
aaacattagcaacaccaaaacagtcaaagtgcaggacatggcttcagtaatcttaaccggcaattcctctctttg

SEQ ID NO: 209116 - DNA, 75 bp, Artificial Sequence
  Synthetic
aaagtgcaggacatggcttcagtaatcttaaccggcaattcctctctttgctcaataaatgggtgggctatacac

SEQ ID NO: 209117 - DNA, 75 bp, Artificial Sequence
  Synthetic
atcggtctcacagacagatggtggccaccactaacccactaataaggcatgagaacagaatggtgctggccagca

SEQ ID NO: 209118 - DNA, 75 bp, Artificial Sequence
  Synthetic
aatacaccaggacaacatactggtgggatggactccaatcctccgacgattttgccctcatagtaaatgcaccaa

SEQ ID NO: 209119 - DNA, 75 bp, Artificial Sequence
  Synthetic
ggccgggtcgagtgaacaagcagcagaagctatggaggttgctagtcaggctaggcagatggtgcaggcgatgag

SEQ ID NO: 209120 - DNA, 75 bp, Artificial Sequence
  Synthetic
aggttcacaccagaaatagtagcaagacctaaagtcagagaacaagcaggcagaatgaattattactggacactg

SEQ ID NO: 209121 - DNA, 75 bp, Artificial Sequence
  Synthetic
taaagaacaacatgataaataatgaccttggacctgcaacagcccaaatggcccttcagctgttcatcaaagact

SEQ ID NO: 209122 - DNA, 75 bp, Artificial Sequence
  Synthetic
aactgatggcccaagcaatgggcaagcctcgtacagaatattcaaaatggaaaaaggaaaagtaattaaatcaat

SEQ ID NO: 209123 - DNA, 75 bp, Artificial Sequence
  Synthetic
tataagtactacattcccttacactggagatcctccatacagccatggaacaggaacaggatacaccatggacac

SEQ ID NO: 209124 - DNA, 75 bp, Artificial Sequence
  Synthetic
atgcaggtaaggtaatgtgtgtttgcagagacaactggcatgcctcgaaccggccatgggtctctttcgatcaaa

SEQ ID NO: 209125 - DNA, 75 bp, Artificial Sequence
  Synthetic
agtcaacagaacacaccaatactcagagaagggaaaatggacaacaaacacggagactggagcaccccaactcaa

SEQ ID NO: 209126 - DNA, 75 bp, Artificial Sequence
  Synthetic
aatttatacaatatccggaatcttcacattcctgaagtctgcttaaaatgggagctaatggatgaggattatcgg

SEQ ID NO: 209127 - DNA, 75 bp, Artificial Sequence
  Synthetic
ggagctaatggatgaggattatcggggaagactttgtaatcccctgaatccctttgtcagccataaagagattga

SEQ ID NO: 209128 - DNA, 75 bp, Artificial Sequence
  Synthetic
ttctgtaaacagtgctgtggtgatgccagcccatggtccagccaaaagcatggaatatgatgccgttgcaactac

SEQ ID NO: 209129 - DNA, 75 bp, Artificial Sequence
  Synthetic
ccagcccatggtccagccaaaagcatggaatatgatgccgttgcaactacacactcctggattcccaagaggaac

SEQ ID NO: 209130 - DNA, 75 bp, Artificial Sequence
  Synthetic
tggaatatgatgccgttgcaactacacactcctggattcccaagaggaaccgctctattctcaacacaagccaaa

SEQ ID NO: 209131 - DNA, 75 bp, Artificial Sequence
  Synthetic
cgccagacttatgattggacactgaatagaaaccaaccagccgcaactgctctggccaacactatagaagtcttc

SEQ ID NO: 209132 - DNA, 75 bp, Artificial Sequence
  Synthetic
caaggatgtgatggaatcaatggataaagaagaaatggaaataacaacacatttccagagaaagagaagagtaag

SEQ ID NO: 209133 - DNA, 75 bp, Artificial Sequence
  Synthetic
aaagaagaaatggaaataacaacacatttccagagaaagagaagagtaagggacaacatgaccaagaagatggtc

SEQ ID NO: 209134 - DNA, 75 bp, Artificial Sequence
  Synthetic
gaatgggaacagtgaccacagaagctgcttttggcctagtgtgtgccacttgtgagcagattgctgactcacagc

SEQ ID NO: 209135 - DNA, 75 bp, Artificial Sequence
  Synthetic
gcaaattgaaaaggagggcaattgcaacacccgggatgcagattaggggattcgtgtactttgtcgaaacactag

SEQ ID NO: 209136 - DNA, 75 bp, Artificial Sequence
  Synthetic
atgtcgtgagaaaaatgatgactaactcacaagatacagagctctcctttacaattactggagacaacaccaaat

SEQ ID NO: 209137 - DNA, 75 bp, Artificial Sequence
  Synthetic
agcagagctacaggacattgaaaatgaagagaagatcccaaggacaaagaacatgaagagaacaagccaattgaa

SEQ ID NO: 209138 - DNA, 75 bp, Artificial Sequence
  Synthetic
tcctaaaagttccagcgcaaaatgccataagcaccacattcccttatactggagatcctccatacagccatggaa

SEQ ID NO: 209139 - DNA, 75 bp, Artificial Sequence
  Synthetic
gtttttggcaatgataacatacatcacaagaaaccaacctgaatggtttagaaatgtcttgagcattgcccctat

SEQ ID NO: 209140 - DNA, 75 bp, Artificial Sequence
  Synthetic
ttttttcaaatgcatttatcgtcgctttaaatacggtttgaaaagagggccttctacggaaggagtgcctgagtc

SEQ ID NO: 209141 - DNA, 75 bp, Artificial Sequence
  Synthetic
tttgtagccaacttcagtatggagttacccagctttggggtatctggagttaatgaatcagctgacatgagcatt

SEQ ID NO: 209142 - DNA, 75 bp, Artificial Sequence
  Synthetic
attgatttgaaatacttcaacgaatcaacgagaaagaaaatcgagaaaataaggcctctgctgattgatggcaca

SEQ ID NO: 209143 - DNA, 75 bp, Artificial Sequence
  Synthetic
atactggagatcctccatacagccatggaacaggaacaggatacaccatggacacagtcaacagaacacaccaat

SEQ ID NO: 209144 - DNA, 75 bp, Artificial Sequence
  Synthetic
tgcctaaagctgccagaggccaatacagtggatttgtgagaacactattccaacaaatgcgtgacgtactgggaa

SEQ ID NO: 209145 - DNA, 75 bp, Artificial Sequence
  Synthetic
aaggaagtgagtgcccaaattgaaccattcttgaaaacaacaccacgcccactcagattgcctgaagggcctcct

SEQ ID NO: 209146 - DNA, 75 bp, Artificial Sequence
  Synthetic
cttggacaaaagaggtacaccaaaaccacatactggtgggatggactccaatcctctgatgatttcgctctcata

SEQ ID NO: 209147 - DNA, 75 bp, Artificial Sequence
  Synthetic
attcacaatggtcgggagaagagcaacagctattctcagaaaggcaaccaggagattgatccagttaatagtaag

SEQ ID NO: 209148 - DNA, 75 bp, Artificial Sequence
  Synthetic
atggcgtctcaaggcaccaaacgatcttatgaacagatggaaactggtggggaacgccagaatgctactgagatc

SEQ ID NO: 209149 - DNA, 75 bp, Artificial Sequence
  Synthetic
tttcacaagaggattgcatgatcaaggcagttaggggcgatctgaactttgtcaatagggcaaaccagcgactga

SEQ ID NO: 209150 - DNA, 75 bp, Artificial Sequence
  Synthetic
ggaacgccagaatgctactgagatcagagcatctgtcggaagaatggttggtggaattggaaggttttatataca

SEQ ID NO: 209151 - DNA, 75 bp, Artificial Sequence
  Synthetic
ctgagggagaatgctgaagacatgggcaatggttgcttcaaaatataccacaaatgtgacaactcatgtatagag

SEQ ID NO: 209152 - DNA, 75 bp, Artificial Sequence
  Synthetic
gatgaaataggagaagatgttgccccgattgaacacatcgcaagcatgaggaggaactattttacagcagaagtg

SEQ ID NO: 209153 - DNA, 75 bp, Artificial Sequence
  Synthetic
atggagagaataaaagaattaagagatctgatgtcgcagtctcgcactcgcgagatactgacaaaaaccactgtg

SEQ ID NO: 209154 - DNA, 75 bp, Artificial Sequence
  Synthetic
cgagatactgacaaaaaccactgtggaccatatggcaataataaaaaaatacacatcaggaagacaagagaagaa

SEQ ID NO: 209155 - DNA, 75 bp, Artificial Sequence
  Synthetic
tctgcttgaagtgggaactaatggatgaagactaccagggcaggctgtgtaatcctctgaacccgtttgtcagtc

SEQ ID NO: 209156 - DNA, 75 bp, Artificial Sequence
  Synthetic
tctctctgcatttgatgaaaggaggaacagataccttgaagagcatcccagtgcagggaaggacccaaagaaaac

SEQ ID NO: 209157 - DNA, 75 bp, Artificial Sequence
  Synthetic
ccagccaagagcatggaatatgatgctgttgcgaccacacactcatggattcctaagaggaaccgttccattctc

SEQ ID NO: 209158 - DNA, 75 bp, Artificial Sequence
  Synthetic
aaggatctggcgtcaagctaataatggagaggacgcgaccgctggtctaacccatatgatgatctggcattccaa

SEQ ID NO: 209159 - DNA, 75 bp, Artificial Sequence
  Synthetic
agcaaaagcaggggaatttcacaaccactcaagatggatacagcatcactgataactatactactagtagtaaca

SEQ ID NO: 209160 - DNA, 75 bp, Artificial Sequence
  Synthetic
aataccagccaaaggggaattcttgaagatgagcagatgtaccagaagtgctgcagtctattcgagaaattcttc

SEQ ID NO: 209161 - DNA, 75 bp, Artificial Sequence
  Synthetic
cagacaggagaataatggagatgattcctgaaagaaacgaacaaggacaaatactttggagtaagacaaatgatg

SEQ ID NO: 209162 - DNA, 75 bp, Artificial Sequence
  Synthetic
agaactgcgataggccaagtgtcgaggcccatgtttctatatgtaagaaccaatgggacctccaagatcaaaatg

SEQ ID NO: 209163 - DNA, 75 bp, Artificial Sequence
  Synthetic
tggatcccagaatgtgctctctaatgcaaggatcaactcttccaaggagatctggagctgctggtgcagcagtaa

SEQ ID NO: 209164 - DNA, 75 bp, Artificial Sequence
  Synthetic
attaatgaccgtaatttctggagaggtgaaaatggacgaaggacgagggtcgcatatgagagaatgtgcaatatc

SEQ ID NO: 209165 - DNA, 75 bp, Artificial Sequence
  Synthetic
gtgaaaatggacgaaggacgagggtcgcatatgagagaatgtgcaatatcctcaaagggaaatttcaaacagcag

SEQ ID NO: 209166 - DNA, 75 bp, Artificial Sequence
  Synthetic
gaccatatggccataatcaagaaatatacgtcaggaagacaggagaagaatcctgctcttaggatgaaatggatg

SEQ ID NO: 209167 - DNA, 75 bp, Artificial Sequence
  Synthetic
caataacaaaagaaaagaaagaagagctccaggattgtaaaattgctcccttgatggtggcgtacatgctagaaa

SEQ ID NO: 209168 - DNA, 75 bp, Artificial Sequence
  Synthetic
agagagtgatcagttcatgaataatacagaagcactgtgtgatgtcaagggttttgcacccttttccaaagacaa

SEQ ID NO: 209169 - DNA, 75 bp, Artificial Sequence
  Synthetic
gttttgcacccttttccaaagacaacggaataagaattggatcgagaggtcatgtttttgtcataagggaaccat

SEQ ID NO: 209170 - DNA, 75 bp, Artificial Sequence
  Synthetic
gaaatgggtgagagagctgatcctgtatgacaaagaggaaatcaggagaatttggcgacaagcgaacaatggaga

SEQ ID NO: 209171 - DNA, 75 bp, Artificial Sequence
  Synthetic
cggaataagaattggatcgagaggtcatgtttttgtcataagggaaccatttgtttcttgctctccaacagagtg

SEQ ID NO: 209172 - DNA, 75 bp, Artificial Sequence
  Synthetic
aggttcagtagcccataagtcctgtctgcctgcatgtgtgtacggacttgccgtggccagtgggtatgatttcga

SEQ ID NO: 209173 - DNA, 75 bp, Artificial Sequence
  Synthetic
atagatcctttccgtctgctgcaaaacagtcaggtcctcagtctaattaggtcaaatgagaatccatcacataaa

SEQ ID NO: 209174 - DNA, 75 bp, Artificial Sequence
  Synthetic
tgacacattatgtattggctatcatgcaaataattcaactgaaactgttgacacagtactagaaaagaatgtaac

SEQ ID NO: 209175 - DNA, 75 bp, Artificial Sequence
  Synthetic
atgaaggcaataatagtagtcttgctgtatacatttacaactgcagatgctgacacattatgtattggctatcat

SEQ ID NO: 209176 - DNA, 75 bp, Artificial Sequence
  Synthetic
actttcgaaatcaggtcaaaatacgtcgcagggttgacacaaacccgggccacgcagatctcagtgctaaagaag

SEQ ID NO: 209177 - DNA, 75 bp, Artificial Sequence
  Synthetic
gcaaataattcaactgaaactgttgacacagtactagaaaagaatgtaacagtaacacactctgtcaaccttcta

SEQ ID NO: 209178 - DNA, 75 bp, Artificial Sequence
  Synthetic
actctttggagcaaaacgaatgatgctggatcagacagagtgacggtatcacctctggctgtgacatggtggaac

SEQ ID NO: 209179 - DNA, 75 bp, Artificial Sequence
  Synthetic
agaatggtcccaaggggacaactatctactagaggagttcaaatagcttcaaatgagaacatggaagcaatagac

SEQ ID NO: 209180 - DNA, 75 bp, Artificial Sequence
  Synthetic
gcacctgggcaaatgtaacattgctggatggctcttgggaaacccagagtgtgagtcactattcacaacaagctc

SEQ ID NO: 209181 - DNA, 75 bp, Artificial Sequence
  Synthetic
atattgacatcagagtcacagttaacaataacaaaagaaaagaaggaggagctccaggactgtaagattgctcct

SEQ ID NO: 209182 - DNA, 75 bp, Artificial Sequence
  Synthetic
ggaggtttcactttcaaaagaacaagtggatcatctgtcaaaagggaagaagaagtgcttacaggcaatctccaa

SEQ ID NO: 209183 - DNA, 75 bp, Artificial Sequence
  Synthetic
tggaggaaacaccaaccagcagagagcatctgcaggacagatcagtgtgcaacctactttctcagtacagagaaa

SEQ ID NO: 209184 - DNA, 75 bp, Artificial Sequence
  Synthetic
caggagatttcatcaattatgaagagctaagagagcatttgagctctgtgtcatcatttgaaaggtttgaaatat

SEQ ID NO: 209185 - DNA, 75 bp, Artificial Sequence
  Synthetic
gctaagagagcatttgagctctgtgtcatcatttgaaaggtttgaaatattccccaaggcaaattcatggcccaa

SEQ ID NO: 209186 - DNA, 75 bp, Artificial Sequence
  Synthetic
atggcggcatttacagggaatacggaaggcagaacatctgacatgaggactgaaatcataaggatgatggagagt

SEQ ID NO: 209187 - DNA, 75 bp, Artificial Sequence
  Synthetic
tgacacaggggacctgctgggaacaaatgtacacaccgggaggagaggtgagaaatgatgatgttgatcagagtt

SEQ ID NO: 209188 - DNA, 75 bp, Artificial Sequence
  Synthetic
gctagttaaaaaaggaaattcatacccaaagctcagcaaatcctacattaacaataagaagaaggaagtcctcgt

SEQ ID NO: 209189 - DNA, 75 bp, Artificial Sequence
  Synthetic
taattattgctgctagaaatattgtcaggagagcaacagtatcagcagacccgctggcttcgctcttggaaatgt

SEQ ID NO: 209190 - DNA, 75 bp, Artificial Sequence
  Synthetic
atcagaatgcagatgcctatgtttttgtgggatcatcgaaatatagcaaaatattcaaaccagaaatagcaataa

SEQ ID NO: 209191 - DNA, 75 bp, Artificial Sequence
  Synthetic
ccgtatctgcattggttatcatgcaaacaattcaacaacacaagttgacacaatcatggagaagaatgtgacggt

SEQ ID NO: 209192 - DNA, 75 bp, Artificial Sequence
  Synthetic
caatagtcaacattgtcacaagtgaccgtatctgcattggttatcatgcaaacaattcaacaacacaagttgaca

SEQ ID NO: 209193 - DNA, 75 bp, Artificial Sequence
  Synthetic
aacaattcaacaacacaagttgacacaatcatggagaagaatgtgacggtcacacatgctcaggacatactggaa

SEQ ID NO: 209194 - DNA, 75 bp, Artificial Sequence
  Synthetic
gcctttgatgatggaaatgacgtgtggatgggaagaacaatcagcgagaagtcacgcttaggctatgaaaccttc

SEQ ID NO: 209195 - DNA, 75 bp, Artificial Sequence
  Synthetic
tgtgggatcatcgaaatatagcaaaatattcaaaccagaaatagcaataaggcccaaggtgagggatcaagcagg

SEQ ID NO: 209196 - DNA, 75 bp, Artificial Sequence
  Synthetic
acattgaaaataagagtgcacgaaggatatgaggaattcacaatggtcgggagaagagcaacagccattctgagg

SEQ ID NO: 209197 - DNA, 75 bp, Artificial Sequence
  Synthetic
tggacggattaagaaagaagagttctctgagatcatgaagatctgttccaccattgaagaactcagacggcaaaa

SEQ ID NO: 209198 - DNA, 75 bp, Artificial Sequence
  Synthetic
tttgaagaactgcagtgtagccggatggcttcttggaaatccaatgtgtgatgaattcctaaacgtaccggaatg

SEQ ID NO: 209199 - DNA, 75 bp, Artificial Sequence
  Synthetic
tcgaagcaactggaaatctagtggtaccaagatatgccttcgcaatgaaaagaggctatggatctggtattatcg

SEQ ID NO: 209200 - DNA, 75 bp, Artificial Sequence
  Synthetic
tggcttcttggaaatccaatgtgtgatgaattcctaaacgtaccggaatggtcatacattgtggaaaaagacaga

SEQ ID NO: 209201 - DNA, 75 bp, Artificial Sequence
  Synthetic
gatatgaggaattcacaatggtcgggagaagagcaacagccattctgaggaaagcaaccagaagactgattcaat

SEQ ID NO: 209202 - DNA, 75 bp, Artificial Sequence
  Synthetic
gcaatggtgttctcacaagaggattgcatgataaaagcagtgcgaggtgatttgaattttgtaaacagagcgaac

SEQ ID NO: 209203 - DNA, 75 bp, Artificial Sequence
  Synthetic
gaagcatttaatgagcagcacaaaccaatttgagaaaattcagatatttcctaggagcacttggtccaatcatga

SEQ ID NO: 209204 - DNA, 75 bp, Artificial Sequence
  Synthetic
ttcagaatatacatccagttacaattggagaatgtccaaaatatgtcaaaagcacaaaattgagaatggctacag

SEQ ID NO: 209205 - DNA, 75 bp, Artificial Sequence
  Synthetic
caatttgagaaaattcagatatttcctaggagcacttggtccaatcatgacgcctcatcaggagtgagctccgca

SEQ ID NO: 209206 - DNA, 75 bp, Artificial Sequence
  Synthetic
tggatgatggcaatgaaatacccaattacagcagacaggagaataatggacatgattccagagaggaatgaacaa

SEQ ID NO: 209207 - DNA, 75 bp, Artificial Sequence
  Synthetic
ccattggttcgatctgtatgacaattggaatagccagcttgatattacaaattggaaacataatatcaatatgga

SEQ ID NO: 209208 - DNA, 75 bp, Artificial Sequence
  Synthetic
aaaggtgctgtttcaaaactggggagttgaacccattgacaatgtcatgggtatgatcggaatattacctgacat

SEQ ID NO: 209209 - DNA, 75 bp, Artificial Sequence
  Synthetic
caagaagaacaatgtataccggacaataacaaggacctacaacaacaccaacatagaagaccttttaataatatg

SEQ ID NO: 209210 - DNA, 75 bp, Artificial Sequence
  Synthetic
aagaactgctccacacagagcataatgggatgctgtgtgcaacaagcttgggacaccctcttgttctagacacct

SEQ ID NO: 209211 - DNA, 75 bp, Artificial Sequence
  Synthetic
acatagaagaccttttaataatatggggaattcatcatcctaatgatgcagctgaacaaataaaactctaccaga

SEQ ID NO: 209212 - DNA, 75 bp, Artificial Sequence
  Synthetic
tggaagactttgtgcgacaatgcttcaatccaatgatcgtcgagcttgcggaaaaggcaatgaaagaatatgggg

SEQ ID NO: 209213 - DNA, 75 bp, Artificial Sequence
  Synthetic
cagtgggtaaagaattcagccaattagaaaaaagaatagaaagtttaaacaataaggttgatgatgggtttctgg

SEQ ID NO: 209214 - DNA, 75 bp, Artificial Sequence
  Synthetic
atcccagaaatagccaccagacccaaggtaaacggacagagtgggaggatggagtttttttggacaatactaaga

SEQ ID NO: 209215 - DNA, 75 bp, Artificial Sequence
  Synthetic
aataaggttgatgatgggtttctggatatttggacttacaatgccgaactgctggttctattggaaaatgaaagg

SEQ ID NO: 209216 - DNA, 75 bp, Artificial Sequence
  Synthetic
ggttagtgaaacacagggagcagaaaagctgacgataacatattcatcgtccatgatgtgggaaatcaatggccc

SEQ ID NO: 209217 - DNA, 75 bp, Artificial Sequence
  Synthetic
gcactgggaactttatagctcctgaatatgcatacaagattgttaaaaaaggagactcagcaatcatgaaaagtg

SEQ ID NO: 209218 - DNA, 75 bp, Artificial Sequence
  Synthetic
ctgtgaagattcagtggtcccaagaccctacaatgctatacaataagatggaatttgagccctttcaatccttgg

SEQ ID NO: 209219 - DNA, 75 bp, Artificial Sequence
  Synthetic
gaaattggagatggctgctttgaattttaccacaaatgcgatgacacgtgcatggagagtgtcaaaaatggaact

SEQ ID NO: 209220 - DNA, 75 bp, Artificial Sequence
  Synthetic
ataaattccagtatgcctttccacaatgtccatccctttaccattggggagtgccccaagtatgtcaaattgaaa

SEQ ID NO: 209221 - DNA, 75 bp, Artificial Sequence
  Synthetic
atgtccatccctttaccattggggagtgccccaagtatgtcaaattgaaaaaactggtcctagcaacaggactga

SEQ ID NO: 209222 - DNA, 75 bp, Artificial Sequence
  Synthetic
aattggaatttctggcccagataatggggcagtggctgtgctgaaatacaatggcataataacagacactatcaa

SEQ ID NO: 209223 - DNA, 75 bp, Artificial Sequence
  Synthetic
attcaactgtcgccagctcattggtactattagtctctctgggggcagtcagtttctggatgtgctccaatgggt

SEQ ID NO: 209224 - DNA, 75 bp, Artificial Sequence
  Synthetic
ttcatagaaggagggtggcaaggaatggtggatgggtggtatggataccatcacagcaatgagcaaggtagtgga

SEQ ID NO: 209225 - DNA, 75 bp, Artificial Sequence
  Synthetic
tggtggatgggtggtatggataccatcacagcaatgagcaaggtagtggatatgctgcagacaaagaatctacac

SEQ ID NO: 209226 - DNA, 75 bp, Artificial Sequence
  Synthetic
atgaacagtcagttcgaagccgttggaaaagagttcaacaacctagaaagaagaatagaaaatttgaataagaaa

SEQ ID NO: 209227 - DNA, 75 bp, Artificial Sequence
  Synthetic
gaaaagagttcaacaacctagaaagaagaatagaaaatttgaataagaaaatggaggatggctttatagatgtat

SEQ ID NO: 209228 - DNA, 75 bp, Artificial Sequence
  Synthetic
atggaagattttgtgcgacaatgcttcaatccaatgattgtcgagcttgcggaaaaagcaatgaaagaatatggg

SEQ ID NO: 209229 - DNA, 75 bp, Artificial Sequence
  Synthetic
gatttccatgattcaaatgttaagaatttatacgataaggtccgacgccagctgagggacaatgcaaaagaatta

SEQ ID NO: 209230 - DNA, 75 bp, Artificial Sequence
  Synthetic
tttaaatacggcaatggtgtttggatagggagaactaaaagcactagttcaaggatgggttttgagatgatttgg

SEQ ID NO: 209231 - DNA, 75 bp, Artificial Sequence
  Synthetic
aatttgccgcaatatgcacacacttagaagtctgcttcatgtattcagacttccacttcattgatgaacggggcg

SEQ ID NO: 209232 - DNA, 75 bp, Artificial Sequence
  Synthetic
aagcgtgaggaatggaacgtatgactacccacaatactcagaagaatcaaggctgaaaagagaggcaatagatgg

SEQ ID NO: 209233 - DNA, 75 bp, Artificial Sequence
  Synthetic
gatccggatggatggaccagaacagatgataaattctcagtaaagcaagatatcataggaataactgattggtca

SEQ ID NO: 209234 - DNA, 75 bp, Artificial Sequence
  Synthetic
cagtagcgagttccctagcactggcaatcatggtagctggtctatctttttggatgtgttccaatggatcattgc

SEQ ID NO: 209235 - DNA, 75 bp, Artificial Sequence
  Synthetic
tatgagaccttgcttttgggttgaactaatcagagggcgacccaaagagaacacaatctggactagcgggagcag

SEQ ID NO: 209236 - DNA, 75 bp, Artificial Sequence
  Synthetic
cattcttgagggaaacaccacgctctctcagattacctgatggacctccctgttctcaacgatcaaaattcctac

SEQ ID NO: 209237 - DNA, 75 bp, Artificial Sequence
  Synthetic
attcggaacgggacctacaacagaaggaagtatcaagaggagtcaaaattagaaagacagaaaatagagggggtc

SEQ ID NO: 209238 - DNA, 75 bp, Artificial Sequence
  Synthetic
aagccaacaagataaagtctgagaagacacacatccacatattctcattcactggagaggaaatggccaccaaag

SEQ ID NO: 209239 - DNA, 75 bp, Artificial Sequence
  Synthetic
cgtgcccagtgagcgaggactgcagcgtagacgctttgttcagaatgccctaaatggaaatggagatccaaacaa

SEQ ID NO: 209240 - DNA, 75 bp, Artificial Sequence
  Synthetic
taaatggaaatggagatccaaacaacatggatagggcagtcaagctatacaagaagttgaaaagggaagtaacat

SEQ ID NO: 209241 - DNA, 75 bp, Artificial Sequence
  Synthetic
ggactgcgataggccaagtgtcgaggcccatgttcctatatgtgagaaccaatggaacctccaagatcaagatga

SEQ ID NO: 209242 - DNA, 75 bp, Artificial Sequence
  Synthetic
ggttgtatgggtctcatatataatagaatgggaacagtaacaacagaagtggctttgggcctagtgtgtgccact

SEQ ID NO: 209243 - DNA, 75 bp, Artificial Sequence
  Synthetic
ctcttgtccctaaggcaaccagaagtcgttacagtggattcgtgaggacactgttccagcaaatgcgggatgtgc

SEQ ID NO: 209244 - DNA, 75 bp, Artificial Sequence
  Synthetic
gaatgggaacagtaacaacagaagtggctttgggcctagtgtgtgccacttgtgagcaaattgctgattcacagc

SEQ ID NO: 209245 - DNA, 75 bp, Artificial Sequence
  Synthetic
tctcaggttacccaatgggcctccctgctcccagcggtcaaagttcctgttgatggatgctcttaaattaagcat

SEQ ID NO: 209246 - DNA, 75 bp, Artificial Sequence
  Synthetic
atcctgtcacctctgactaaggggattttagggtttgttttcacgctcaccgtgcccagtgagcgaggactgcag

SEQ ID NO: 209247 - DNA, 75 bp, Artificial Sequence
  Synthetic
gaaaacagaatggtgctggccagcaccacagctaaagctatggagcagatggcaggatcaagtgagcaggcagca

SEQ ID NO: 209248 - DNA, 75 bp, Artificial Sequence
  Synthetic
gacggattccagctggatagagcttgacgaaataggagaggacgtcgctccaatcgaacatattgcgagtatgag

SEQ ID NO: 209249 - DNA, 75 bp, Artificial Sequence
  Synthetic
gaaagtgtgcaggaccttactggcaaaatctgtattcaacagtctatatgcgtctccacaacttgaggggttttc

SEQ ID NO: 209250 - DNA, 75 bp, Artificial Sequence
  Synthetic
atggagaaaataatgcttcttcttgcaataatcggtcttgttaaaagtgatcagatttgcgttggctaccatgca

SEQ ID NO: 209251 - DNA, 75 bp, Artificial Sequence
  Synthetic
gatgagaagatcccaaaaacaaagaacatgaagaaaacaagccagttgaagtgggcacttggtgagaacatggca

SEQ ID NO: 209252 - DNA, 75 bp, Artificial Sequence
  Synthetic
caatgataagcaaatgcagaacgaaagaaggaaggcggaagacaaatctatatgggttcattgtaaaaggaagat

SEQ ID NO: 209253 - DNA, 75 bp, Artificial Sequence
  Synthetic
gtcctgctatatacatttacaactgcaaatgccgacacattatgtataggttatcatgcgaacaattcaactgac

SEQ ID NO: 209254 - DNA, 75 bp, Artificial Sequence
  Synthetic
ccggaaaaagtagactttgaggattgcaaaggtgttagcgatctaagacagtatgacagcgatgaaccagagcct

SEQ ID NO: 209255 - DNA, 75 bp, Artificial Sequence
  Synthetic
caataatggaaaagaacgttactgttacacatgctcaagacatactggagaagacacacaacgggaagctctgca

SEQ ID NO: 209256 - DNA, 75 bp, Artificial Sequence
  Synthetic
aaactatgtaaactaagaggggtagctccattgcatttgggtaaatgtaacattgctggctggctcctgggaaat

SEQ ID NO: 209257 - DNA, 75 bp, Artificial Sequence
  Synthetic
tggctcctcggaaacccaatgtgtgacaaatttctcaatgtgtcagaatggtcttacatagtggagaaggccagt

SEQ ID NO: 209258 - DNA, 75 bp, Artificial Sequence
  Synthetic
atgaatccaaatcaaaagataataacaattggctctgcttctctcactattgccacaatttgcttccttatgcaa

SEQ ID NO: 209259 - DNA, 75 bp, Artificial Sequence
  Synthetic
caattggctctgcttctctcactattgccacaatttgcttccttatgcaaattgccatcttagtaattaatgtaa

SEQ ID NO: 209260 - DNA, 75 bp, Artificial Sequence
  Synthetic
ggccaatgtttctgtatgtgagaaccaatggaacctcaaaaatcaaaatgaaatggggtatggaaatgaggcgtt

SEQ ID NO: 209261 - DNA, 75 bp, Artificial Sequence
  Synthetic
ccagccaatggcctttgttacccaggggatttcaatgattatgaagaactgaaacacctattgagcagaataaac

SEQ ID NO: 209262 - DNA, 75 bp, Artificial Sequence
  Synthetic
atggatgtcaacccgactttacttttcttaaaaataccagcgcaaaatgctataagcactacattcccttacact

SEQ ID NO: 209263 - DNA, 75 bp, Artificial Sequence
  Synthetic
gatgaaataggggaagatattgctccaattgagcacattgcaagcatgagaaggaattatttcacagcggaggtg

SEQ ID NO: 209264 - DNA, 75 bp, Artificial Sequence
  Synthetic
caggaacagggtacaccatggacacagtcaatagaacacatcaatactcagagaaaggaaaatggacaacaaaca

SEQ ID NO: 209265 - DNA, 75 bp, Artificial Sequence
  Synthetic
agctctgttgaatgcgtcatgtgcagctatggatgacttccagctgattccaatgataagcaagtgtaggactaa

SEQ ID NO: 209266 - DNA, 75 bp, Artificial Sequence
  Synthetic
tcagaaatgtagtatggcttaccaaaaagaacaatacatacccaccaataaaggtgaactacaccaatgccaatc

SEQ ID NO: 209267 - DNA, 75 bp, Artificial Sequence
  Synthetic
caatgataagcaagtgtaggactaaagaagggagacggaaaactaatctgtatggattcatcataaaaggaagat

SEQ ID NO: 209268 - DNA, 75 bp, Artificial Sequence
  Synthetic
gagaaaggaaaatggacaacaaacacagaaactggagcaccccaactcaatccaattgatggaccactacctgag

SEQ ID NO: 209269 - DNA, 75 bp, Artificial Sequence
  Synthetic
gaaacacctattgagcagaataaaccgttttgagaaaattgagatcatccccaaaagtcattggtccaatcataa

SEQ ID NO: 209270 - DNA, 75 bp, Artificial Sequence
  Synthetic
aaggtgaactacaccaatgccaatcaaaaagatcttctggtactgtggggaatccaccaccccaataatgaggca

SEQ ID NO: 209271 - DNA, 75 bp, Artificial Sequence
  Synthetic
ggctttccttgaagaatcccacccaggaatttttgaaaattcatgccttgagacgatggaagttgttcagcaaac

SEQ ID NO: 209272 - DNA, 75 bp, Artificial Sequence
  Synthetic
taaacacttatgtttccgttggaacatcaacattaaaccagagattggtacccaaaatagctactagatccaaag

SEQ ID NO: 209273 - DNA, 75 bp, Artificial Sequence
  Synthetic
atagaaaccagccagctgcaactgctttggctaacactatagaggttttcagatcgaacggtctaacagccaatg

SEQ ID NO: 209274 - DNA, 75 bp, Artificial Sequence
  Synthetic
aatgatactatcaatttcgatagtgatggaaatttcattgccccaaaatatgcatacacaattgtcaagaaaggg

SEQ ID NO: 209275 - DNA, 75 bp, Artificial Sequence
  Synthetic
atgaatccaaatcaaaagataataacaatcggttctgtttctctcactattacaacaatgtgcctcttcatgcag

SEQ ID NO: 209276 - DNA, 75 bp, Artificial Sequence
  Synthetic
caaggatgtaatggagtcaatggacaaagaagaaatggaaataacaacacatttccagagaaagagaagagtaag

SEQ ID NO: 209277 - DNA, 75 bp, Artificial Sequence
  Synthetic
ttgtgtcactgggcatgatgcaaatgcaactgctagcgtcatttacaatgggagacttgtagatagcattggttc

SEQ ID NO: 209278 - DNA, 75 bp, Artificial Sequence
  Synthetic
tggagtatggtgactgcaacaccaaatgccaaactccaataggggcgataaattctagtatgccattccacaaca

SEQ ID NO: 209279 - DNA, 75 bp, Artificial Sequence
  Synthetic
acgcaaagaacaataggaaagaagaagcataggataaacaagaagagctacttaataagagcattgacattaaac

SEQ ID NO: 209280 - DNA, 75 bp, Artificial Sequence
  Synthetic
tcacaattggagaatgtccaaaatatgtaaaaagtactaaactgagaatggctacaggattaagaaatatcccgt

SEQ ID NO: 209281 - DNA, 75 bp, Artificial Sequence
  Synthetic
gatactaaaatattattcattgaagaggggaagatcgttcatattagcccattgttgggaagtgctcagcatgtt

SEQ ID NO: 209282 - DNA, 75 bp, Artificial Sequence
  Synthetic
ggctggacaggaatgatagatggatggtacggttatcaccatcaaaatgagcagggatcaggatatgcagccgac

SEQ ID NO: 209283 - DNA, 75 bp, Artificial Sequence
  Synthetic
ggtacggttatcaccatcaaaatgagcagggatcaggatatgcagccgacctgaagagcacacagaatgccattg

SEQ ID NO: 209284 - DNA, 75 bp, Artificial Sequence
  Synthetic
tgggtaccaccatagtaatgagcagggaagcggatacgctgcggacaaagaatccactcaaaaagcagtagatgg

SEQ ID NO: 209285 - DNA, 75 bp, Artificial Sequence
  Synthetic
tttgtgtacttcgttgaaacattagcgaggagtatctgtgaaaaactagaacagtcaggactccctgttggaggg

SEQ ID NO: 209286 - DNA, 75 bp, Artificial Sequence
  Synthetic
atgaatccaagtcaaaagataataacaattggctctgtctctctaatcattgcaacagtatgttgcttcatgcag

SEQ ID NO: 209287 - DNA, 75 bp, Artificial Sequence
  Synthetic
gcagggatcaggatatgcagccgacctgaagagcacacagaatgccattgacgggatcactaacaaggtaaattc

SEQ ID NO: 209288 - DNA, 75 bp, Artificial Sequence
  Synthetic
tgcaacagtatgttgcttcatgcagattgccatcctggcaatgaccataacacattacttcaatcaaaatgagtg

SEQ ID NO: 209289 - DNA, 75 bp, Artificial Sequence
  Synthetic
attgccatcctggcaatgaccataacacattacttcaatcaaaatgagtgcagcaccccattgagcaatcaagta

SEQ ID NO: 209290 - DNA, 75 bp, Artificial Sequence
  Synthetic
cttagaaaggagaatagaaaatttaaataaaaagatggaggacggattcctagatgtctggacttataacgctga

SEQ ID NO: 209291 - DNA, 75 bp, Artificial Sequence
  Synthetic
ggaagcggatacgctgcggacaaagaatccactcaaaaagcagtagatggaatcaccaataagatcaactcgatc

SEQ ID NO: 209292 - DNA, 75 bp, Artificial Sequence
  Synthetic
ggctgggcctttgatgacggaaatgatgtgtggatgggaagaactatcaacgagacgttacgcctaggttatgaa

SEQ ID NO: 209293 - DNA, 75 bp, Artificial Sequence
  Synthetic
tttgaataaaaccatcatagaaaaagaattttgccctaaattagcagaatacagggactggtcgaaaccacagtg

SEQ ID NO: 209294 - DNA, 75 bp, Artificial Sequence
  Synthetic
gaattttgccctaaattagcagaatacagggactggtcgaaaccacagtgtcagatcaaagggtttgctcctttc

SEQ ID NO: 209295 - DNA, 75 bp, Artificial Sequence
  Synthetic
gaaatgtcctgagtgttgcccctataatgttctcaaacaaaatggcaagactagggaaaggatacatgttcgaga

SEQ ID NO: 209296 - DNA, 75 bp, Artificial Sequence
  Synthetic
aaggagctgggtaacggttgcttcgagttctaccacaaatgtgataacgaatgtatggaaagtgtaaaaaacggg

SEQ ID NO: 209297 - DNA, 75 bp, Artificial Sequence
  Synthetic
ctagggaaaggatacatgttcgagagtaggagcatgaagctacgcacacaaatatcagcagaaatgcttgcaaac

SEQ ID NO: 209298 - DNA, 75 bp, Artificial Sequence
  Synthetic
aagggaaccttatgtgtcatgcagtcctagtaaatgttatcagttcgcacttgggcagggaaccacgctagacaa

SEQ ID NO: 209299 - DNA, 75 bp, Artificial Sequence
  Synthetic
cctagtaaatgttatcagttcgcacttgggcagggaaccacgctagacaacaaacattcaaatggcacaatacat

SEQ ID NO: 209300 - DNA, 75 bp, Artificial Sequence
  Synthetic
aataagtggagtaaaattggaatcaactgtaacttaccaaatactgtcaatttattcaacagtggcgagttccct

SEQ ID NO: 209301 - DNA, 75 bp, Artificial Sequence
  Synthetic
gcttcattgagccctggaatgatgatgggcatgttcaatatgctgagtacagtcttaggagtttcaattctgaat

SEQ ID NO: 209302 - DNA, 75 bp, Artificial Sequence
  Synthetic
tttattcaacagtggcgagttccctagtgttggcaatcatagtggctggtctatctttatggatgtgctccaatg

SEQ ID NO: 209303 - DNA, 75 bp, Artificial Sequence
  Synthetic
ccacatactggtgggatgggctccaatcttctgatgatttcgctctaatagtgaatgcaccgaatcatgaaggga

SEQ ID NO: 209304 - DNA, 75 bp, Artificial Sequence
  Synthetic
ccatttggggaccaaacaggtatgcatagcatggtccagctcaagctgccatgatggaaaagcatggctgcacgt

SEQ ID NO: 209305 - DNA, 75 bp, Artificial Sequence
  Synthetic
atcttctgatgatttcgctctaatagtgaatgcaccgaatcatgaagggatacaagctggagttgataggtttta

SEQ ID NO: 209306 - DNA, 75 bp, Artificial Sequence
  Synthetic
atgatggaaaagcatggctgcacgtttgtattactggagatgataggaatgcaactgccagtttcatttataatg

SEQ ID NO: 209307 - DNA, 75 bp, Artificial Sequence
  Synthetic
ggaacgccagaatgctactgagatcagggcatctgttggaagaatggttagcggcattgggagattctacataca

SEQ ID NO: 209308 - DNA, 75 bp, Artificial Sequence
  Synthetic
taaaccgaactgggacatttgagttcacaagttttttctaccgctatggatttgtagccaatttcagtatggaat

SEQ ID NO: 209309 - DNA, 75 bp, Artificial Sequence
  Synthetic
caggagtcagaatgtgtctgcatcaatggaacttgtacagtagtaatgactgatggaagtgcatcaggaagggct

SEQ ID NO: 209310 - DNA, 75 bp, Artificial Sequence
  Synthetic
catggagtggctaaagacaagaccaatcctgtcacctctgactaaagggattttgggatttgtattcacgctcac

SEQ ID NO: 209311 - DNA, 75 bp, Artificial Sequence
  Synthetic
atggcgtctcaaggcaccaaacgatcttacgaacaaatggagaccagtggagaacgccagaatgccactgagatc

SEQ ID NO: 209312 - DNA, 75 bp, Artificial Sequence
  Synthetic
tgcccagctttggggtatctggggtcaatgaatcagctgacatgagcattggggttacggtgatcaagaacaata

SEQ ID NO: 209313 - DNA, 75 bp, Artificial Sequence
  Synthetic
gtgcaggaaaggaccctaagaaaactggaggtccaatttacaggagaagagacggaaaatgggtgagagagctga

SEQ ID NO: 209314 - DNA, 75 bp, Artificial Sequence
  Synthetic
gaggaatgctcatgttatccccgccatccagatgtcagatgtgtctgcagagacaattggaaaggttcaaataga

SEQ ID NO: 209315 - DNA, 75 bp, Artificial Sequence
  Synthetic
tatggatagggcagtcaagctatataagaagctgaaaagagaaataacattccatggggctaaggaggtcgcact

SEQ ID NO: 209316 - DNA, 75 bp, Artificial Sequence
  Synthetic
atccagatgtcagatgtgtctgcagagacaattggaaaggttcaaatagacccgttatagacataaatatggcag

SEQ ID NO: 209317 - DNA, 75 bp, Artificial Sequence
  Synthetic
ggagaggatgcaactgctggtcttacccatctgatgatatggcattccaacctgaatgatgctacctatcagaga

SEQ ID NO: 209318 - DNA, 75 bp, Artificial Sequence
  Synthetic
tctctctgcatttgatgaaaggagaaacaaatacctggaagaacatcccagtgctgggaaggacccgaagaagac

SEQ ID NO: 209319 - DNA, 75 bp, Artificial Sequence
  Synthetic
gatccaaacgaggagatcattcgagttaaagaggctatgggaacagacccgttcaaaggcaggactgttggtctc

SEQ ID NO: 209320 - DNA, 75 bp, Artificial Sequence
  Synthetic
ccaagaaacgatgacggctctagtaatagcaactgcaaggatcctaataatgaaagagggaacccaggagtgaaa

SEQ ID NO: 209321 - DNA, 75 bp, Artificial Sequence
  Synthetic
atccgaaatcttcacatcccagaggtatgcctgaagtgggaactaatggatgaagattatcagggtaggttgtgt

SEQ ID NO: 209322 - DNA, 75 bp, Artificial Sequence
  Synthetic
ttctgtggcacttctggcacctatggttcaggctcatggcctgatggagcagacatcaatttcatgcctgtataa

SEQ ID NO: 209323 - DNA, 75 bp, Artificial Sequence
  Synthetic
tcctgtatgacaaagaggagataaggaggatctggcgtcaggcgaataatggggaagacgcaactgctggcctca

SEQ ID NO: 209324 - DNA, 75 bp, Artificial Sequence
  Synthetic
gggtgggcatttgactatggagatgatgtttggatgggaagaacaatcagcaaggattcacgctcaggttacgag

SEQ ID NO: 209325 - DNA, 75 bp, Artificial Sequence
  Synthetic
aatcctctgaacccgtttgttagtcacaaggaaatcgagtccgtaaacaatgctgtggtaatgcctgcccatgga

SEQ ID NO: 209326 - DNA, 75 bp, Artificial Sequence
  Synthetic
ctcaccttatgatctggcattccaacctgaatgatgccacataccagaggacaagagcactcgtgcgtactggaa

SEQ ID NO: 209327 - DNA, 75 bp, Artificial Sequence
  Synthetic
caaccgctaattccaaatctcagataaataggcaagtcatagttgacaataataactggtctggttattctggcc

SEQ ID NO: 209328 - DNA, 75 bp, Artificial Sequence
  Synthetic
ccctaagagaaaccgttctatcctcaataccagccaaagggggattcttgaagatgaacagatgtaccaaaagtg

SEQ ID NO: 209329 - DNA, 75 bp, Artificial Sequence
  Synthetic
atgaagactgtcattgctttaagctacgtcttttgtctggtttttggccaagattttccaggaaagggtaacaac

SEQ ID NO: 209330 - DNA, 75 bp, Artificial Sequence
  Synthetic
aataccagccaaagggggattcttgaagatgaacagatgtaccaaaagtgctgtaatctattcgaaaagtttttt

SEQ ID NO: 209331 - DNA, 75 bp, Artificial Sequence
  Synthetic
catcaataggtgtttttatgtggaattgataagaggaaggcctcaagagactagagtatggtggacctcaaacag

SEQ ID NO: 209332 - DNA, 75 bp, Artificial Sequence
  Synthetic
ttgaaaatttgcaggcctaccagaaacggatgggagtgcagatgcagcgattcaagtgatcctcttgttgttgct

SEQ ID NO: 209333 - DNA, 75 bp, Artificial Sequence
  Synthetic
ttctgtgggacttcaggtacttatggaacaggctcatggcctgatggggcgaatatcaatttcatgcctatataa

SEQ ID NO: 209334 - DNA, 75 bp, Artificial Sequence
  Synthetic
atgagaaaaatagtgcttttcctgtcaatagccagtcttgttaagagtgacaaaatctgcattggttatcatgca

SEQ ID NO: 209335 - DNA, 75 bp, Artificial Sequence
  Synthetic
ctcaaagggaaatttcaaacagcagcacaaagagcaatgatggatcaggtgcgagaaagcagaaatcctggaaat

SEQ ID NO: 209336 - DNA, 75 bp, Artificial Sequence
  Synthetic
caaaatctgcattggttatcatgcaaacaattcaacagcaaaggttgacacaataatggaaaagaatgtcactgt

SEQ ID NO: 209337 - DNA, 75 bp, Artificial Sequence
  Synthetic
gcgagaaagcagaaatcctggaaatgctgaaattgaggatctcatcttccttgcacgatctgcactcattctgag

SEQ ID NO: 209338 - DNA, 75 bp, Artificial Sequence
  Synthetic
aacaattcaacagcaaaggttgacacaataatggaaaagaatgtcactgtcacacatgcgaaagacatacttgaa

SEQ ID NO: 209339 - DNA, 75 bp, Artificial Sequence
  Synthetic
atggagagaataaaagaattaagagatctaatgttgcaatcccgcactcgcgagatactaacaaaaaccactgta

SEQ ID NO: 209340 - DNA, 75 bp, Artificial Sequence
  Synthetic
acagccaggtctttagtctcattagaccaaatgagaacccagcacataagagccaactagtgtggatggcatgcc

SEQ ID NO: 209341 - DNA, 75 bp, Artificial Sequence
  Synthetic
tttgagggactgtagtgtagctggttggctcctagggaacccaatgtgtgacgagttcctcatggtgccagaatg

SEQ ID NO: 209342 - DNA, 75 bp, Artificial Sequence
  Synthetic
ccctgaaaggaatgaacaaggacagaaactctggactaagacaagtgatgccgggtcagacagagtgatggtgtc

SEQ ID NO: 209343 - DNA, 75 bp, Artificial Sequence
  Synthetic
acgagttcctcatggtgccagaatggtcttacatagtggaaaagaacaaaccaaccaatggcttatgctacccag

SEQ ID NO: 209344 - DNA, 75 bp, Artificial Sequence
  Synthetic
ccctctagctgtgacttggtggaacaggaatggaccgacaacaagtacagtccattaccccaaagtttacaaaac

SEQ ID NO: 209345 - DNA, 75 bp, Artificial Sequence
  Synthetic
acccaatgagaacccagcacacaagagtcaattggtgtggatggcatgccattctgcagcattcgaagatctgag

SEQ ID NO: 209346 - DNA, 75 bp, Artificial Sequence
  Synthetic
taaacatctcttaagcagtacaacccattttgaaaaaatacagatattccccaggaattcttggccccaacatga

SEQ ID NO: 209347 - DNA, 75 bp, Artificial Sequence
  Synthetic
aggaatggaccgacaacaagtacagtccattaccccaaagtttacaaaacatattttgagaaggttgagaggtta

SEQ ID NO: 209348 - DNA, 75 bp, Artificial Sequence
  Synthetic
ccaggaattcttggccccaacatgacacttcaggagtaacagctgcatgtcaatttagtggaaggtcctcttttt

SEQ ID NO: 209349 - DNA, 75 bp, Artificial Sequence
  Synthetic
atggcagcatttacaggaaatactgagggtagaacgtctgacatgaggactgaaatcataagaatgatggaaagt

SEQ ID NO: 209350 - DNA, 75 bp, Artificial Sequence
  Synthetic
ccgccgagtggatataaatccaggccatgcagatcttagtgcaaaagaagcacaagatgttatcatggaggtggt

SEQ ID NO: 209351 - DNA, 75 bp, Artificial Sequence
  Synthetic
tgaggaggaactattttacagcagaagtgtcccattgcagggctactgaatacataatgaagggagtgtacataa

SEQ ID NO: 209352 - DNA, 75 bp, Artificial Sequence
  Synthetic
cacaagatgttatcatggaggtggtcttcccaaatgaagtgggtgctagaatactgacttcagagtcgcaattga

SEQ ID NO: 209353 - DNA, 75 bp, Artificial Sequence
  Synthetic
aagagatcatacaaaaatactaatcaggaagatcttttgatcatgtggggaatccaccaccccagtcatgatgaa

SEQ ID NO: 209354 - DNA, 75 bp, Artificial Sequence
  Synthetic
gcatctgcaggacaaatcagtgtacagcccactttctcagtacagagaaatcttcccttcgaaagagcgaccatt

SEQ ID NO: 209355 - DNA, 75 bp, Artificial Sequence
  Synthetic
aggaagatcttttgatcatgtggggaatccaccaccccagtcatgatgaagaacaagtgagactctataaaaacc

SEQ ID NO: 209356 - DNA, 75 bp, Artificial Sequence
  Synthetic
ttaatgatggcatacatgttggaaagggaactggtccgaaaaaccagattcctaccggtagcaggcggaacaagc

SEQ ID NO: 209357 - DNA, 75 bp, Artificial Sequence
  Synthetic
tgcagacaaaatctgcctcggacatcatgccgtgtcaaacggaaccaaagtaaacacattaactgaaagaggagt

SEQ ID NO: 209358 - DNA, 75 bp, Artificial Sequence
  Synthetic
ccaataataactgaaagaccccaagtaaatgggcaaagtggcagaatgagtttttattggacaattttaaagcca

SEQ ID NO: 209359 - DNA, 75 bp, Artificial Sequence
  Synthetic
taaatgggcaaagtggcagaatgagtttttattggacaattttaaagccaagagataccattaactttgagacta

SEQ ID NO: 209360 - DNA, 75 bp, Artificial Sequence
  Synthetic
gatgtacactccaggcggagaagtgaaaaatgatgatgtcgaccagagtttgatcatcgctgcccgaaatattgt

SEQ ID NO: 209361 - DNA, 75 bp, Artificial Sequence
  Synthetic
tcgaggcccatgttcctatatgtgagaaccaatggaacctccaagatcaagatgaaatggggcatggaaatgagg

SEQ ID NO: 209362 - DNA, 75 bp, Artificial Sequence
  Synthetic
gactcagcaattataagaagtgaattggaatatggcaactgcaacactaggtgccaaactccaatgggagcattg

SEQ ID NO: 209363 - DNA, 75 bp, Artificial Sequence
  Synthetic
gtgaccaattcctagaattttcagccgatttaattattgagaggcgagaaggaagtgatgtctgttatcctggga

SEQ ID NO: 209364 - DNA, 75 bp, Artificial Sequence
  Synthetic
gtcacagcacgcaaattggtggagtaaggatggtggacatccttaggcaaaacccaactgaggagcaagctgtgg

SEQ ID NO: 209365 - DNA, 75 bp, Artificial Sequence
  Synthetic
tggaatatggcaactgcaacactaggtgccaaactccaatgggagcattgaactccagcatgcctttccaaaaca

SEQ ID NO: 209366 - DNA, 75 bp, Artificial Sequence
  Synthetic
aaggatggtggacatccttaggcaaaacccaactgaggagcaagctgtggatatatgtaaagcagcaataggttt

SEQ ID NO: 209367 - DNA, 75 bp, Artificial Sequence
  Synthetic
ttagtccttgccactggcctcagaaacattcctcagatagagacaaggggactttttggggcaattgcagggttt

SEQ ID NO: 209368 - DNA, 75 bp, Artificial Sequence
  Synthetic
acattcctcagatagagacaaggggactttttggggcaattgcagggtttatagaagggggatggcaagggatgg

SEQ ID NO: 209369 - DNA, 75 bp, Artificial Sequence
  Synthetic
agcaaccagtgcatgtaggagatcaggatcttcattctatgcagaaatgaaatggctcctgtcaaacacagataa

SEQ ID NO: 209370 - DNA, 75 bp, Artificial Sequence
  Synthetic
gtggatcatccgtcaagaaggaagaagaagtgctcaccggcaacctccaaacactgaaaatacaagtacatgaag

SEQ ID NO: 209371 - DNA, 75 bp, Artificial Sequence
  Synthetic
acactgaaaatacaagtacatgaagggtacgaggaattcacaatggtggggcggagagcaacagctatcatgagg

SEQ ID NO: 209372 - DNA, 75 bp, Artificial Sequence
  Synthetic
tgctgcattcccgcagatgactaagtcatataaaaatacaagaaaaagcccagctctaatagtatgggggatcca

SEQ ID NO: 209373 - DNA, 75 bp, Artificial Sequence
  Synthetic
gctgctgacaaagaatccacccagagggctatagatggaatcacaaataaggtaaattcaatcattgacaagatg

SEQ ID NO: 209374 - DNA, 75 bp, Artificial Sequence
  Synthetic
gggctatagatggaatcacaaataaggtaaattcaatcattgacaagatgaacactcaatttgaggctgttggga

SEQ ID NO: 209375 - DNA, 75 bp, Artificial Sequence
  Synthetic
gcaatggtattctcacaggaggattgcatgataaaagcagtccgaggtgatctaaatttcgtaaacagagcaaat

SEQ ID NO: 209376 - DNA, 75 bp, Artificial Sequence
  Synthetic
gcatgataaaagcagtccgaggtgatctaaatttcgtaaacagagcaaatcaaagattgaaccccatgcatcaac

SEQ ID NO: 209377 - DNA, 75 bp, Artificial Sequence
  Synthetic
gaagatggatttttggacatttggacttacaatgctgagcttctagttctaatggaaaatgaaagaactctagac

SEQ ID NO: 209378 - DNA, 75 bp, Artificial Sequence
  Synthetic
cttacaatgctgagcttctagttctaatggaaaatgaaagaactctagaccttcatgattcaaatgtcaagaacc

SEQ ID NO: 209379 - DNA, 75 bp, Artificial Sequence
  Synthetic
ctttgtgctatttggatgggattcataatatgggcctgccagaaaggcaacattaggtgcaacatttgcatctga

SEQ ID NO: 209380 - DNA, 75 bp, Artificial Sequence
  Synthetic
ccaggagcgagaccacaagttaatggtctatctggaagaattgactttcattggctaatgctaaatcccaatgat

SEQ ID NO: 209381 - DNA, 75 bp, Artificial Sequence
  Synthetic
ctttcatagctccagaccgtgcaagcttcctgagaggaaaatctatgggaatccagagtggagtacaggttgatg

SEQ ID NO: 209382 - DNA, 75 bp, Artificial Sequence
  Synthetic
gaatgatcggaatattgcctgacatgacaccaagcacagaggtgtcactgagggggataagggttagtaagatgg

SEQ ID NO: 209383 - DNA, 75 bp, Artificial Sequence
  Synthetic
atccagagtggagtacaggttgatgccaattgtgaaggggactgctatcatagtggagggacaataataagtaac

SEQ ID NO: 209384 - DNA, 75 bp, Artificial Sequence
  Synthetic
aatggttgttttgagtttcaccacaaatgtgataatgagtgcatggaaagtgtaaagaatggaacatatgattac

SEQ ID NO: 209385 - DNA, 75 bp, Artificial Sequence
  Synthetic
aaactctgcagcctgaatggaaagaaccccttacaactggggaactgcaacgtagcaggatggatccttggcaac

SEQ ID NO: 209386 - DNA, 75 bp, Artificial Sequence
  Synthetic
aatgtgataatgagtgcatggaaagtgtaaagaatggaacatatgattacccacattattcagaggaggcaagac

SEQ ID NO: 209387 - DNA, 75 bp, Artificial Sequence
  Synthetic
ttcttaagagttaaagatcagagagggaacgtactcttatcaccagaagaggttagcgaaacacaggggacagag

SEQ ID NO: 209388 - DNA, 75 bp, Artificial Sequence
  Synthetic
tgttaagcaaaggagtctgctgctagcaacagggatgaagaatgttcctgagattccaaagggaagaggcctatt

SEQ ID NO: 209389 - DNA, 75 bp, Artificial Sequence
  Synthetic
caaatattatcaatttattcaacagcagcaagttccctagtactggcaatcatgatagctggtctatctttttgg

SEQ ID NO: 209390 - DNA, 75 bp, Artificial Sequence
  Synthetic
gcaacagggatgaagaatgttcctgagattccaaagggaagaggcctatttggtgctatagcgggtttcattgaa

SEQ ID NO: 209391 - DNA, 75 bp, Artificial Sequence
  Synthetic
tcctagttacgaccatgacactacatttcaagcataatgaatgcaccaactcctcgaacaatcaagcagcgccat

SEQ ID NO: 209392 - DNA, 75 bp, Artificial Sequence
  Synthetic
agagtcagtgcttgtcaacacttatcaatggatcatcagaaattgggagactgtaaagattcaatggtctcaaga

SEQ ID NO: 209393 - DNA, 75 bp, Artificial Sequence
  Synthetic
cagcaagttccctagtactggcaatcatgatagctggtctatctttttggatgtgttccaatgggtcattacagt

SEQ ID NO: 209394 - DNA, 75 bp, Artificial Sequence
  Synthetic
tgcacagggagagggaactgctgcagattacaaaagcactcaatcggcaattgatcaaataacaggaaaattaaa

SEQ ID NO: 209395 - DNA, 75 bp, Artificial Sequence
  Synthetic
ctgtaaagattcaatggtctcaagaccctacaatgctgtacaataagatagaatttgaaccgttccaatccttgg

SEQ ID NO: 209396 - DNA, 75 bp, Artificial Sequence
  Synthetic
ttgatcaaataacaggaaaattaaaccggcttatagaaaaaaccaaccaacaatttgagttgatagacaatgaat

SEQ ID NO: 209397 - DNA, 75 bp, Artificial Sequence
  Synthetic
gccctaaagtagcaggatacaggaattggtcgaaaccacaatgtcaaataacagggttcgctcctttctccaagg

SEQ ID NO: 209398 - DNA, 75 bp, Artificial Sequence
  Synthetic
cgaagggagactgatccaaaacagcataaccatagaaaggatggttctctcggcatttgatgagaggagaaacaa

SEQ ID NO: 209399 - DNA, 75 bp, Artificial Sequence
  Synthetic
gagaaagggaagtggacaacaaacacagagactggagcacctcaactcaatccaattgatgggccactacccgag

SEQ ID NO: 209400 - DNA, 75 bp, Artificial Sequence
  Synthetic
cagagactggagcacctcaactcaatccaattgatgggccactacccgaggataacgagccgagcggatatgccc

SEQ ID NO: 209401 - DNA, 75 bp, Artificial Sequence
  Synthetic
tctataacagaagtgtggtcatacaatgctgaactcttggtagcaatggagaaccagcatacaattgatctggct

SEQ ID NO: 209402 - DNA, 75 bp, Artificial Sequence
  Synthetic
atgctgaactcttggtagcaatggagaaccagcatacaattgatctggctgattcagaaatggacaaactgtacg

SEQ ID NO: 209403 - DNA, 75 bp, Artificial Sequence
  Synthetic
ccggagcaaagcagaatgcaattttcttctctaactgtaaatgttagaggttcaggaatgagaatacttgtaagg

SEQ ID NO: 209404 - DNA, 75 bp, Artificial Sequence
  Synthetic
aatgttatcagtttgcacttgggcaggggactaccttagacaacagccactcaaatggcacatcacatgatagga

SEQ ID NO: 209405 - DNA, 75 bp, Artificial Sequence
  Synthetic
gggatctttgacaattcatgtcttgaaacaatggaagttgttcagcaaacaagagtggacaaactgactcaagga

SEQ ID NO: 209406 - DNA, 75 bp, Artificial Sequence
  Synthetic
gtaaagcaaccaaaaggttgacagtcctggggaaggatgcaggcgcattggttgaggatccagaggagggaacag

SEQ ID NO: 209407 - DNA, 75 bp, Artificial Sequence
  Synthetic
ataacttttgaagccactgggaatttaatagcaccatggcacgcatttgcattgaaaaaaggctctagttctgga

SEQ ID NO: 209408 - DNA, 75 bp, Artificial Sequence
  Synthetic
tgctttgaaatatttcacaagtgtgatgatgactgtatggccagtattagaaataacacctatgatcacagcaaa

SEQ ID NO: 209409 - DNA, 75 bp, Artificial Sequence
  Synthetic
cgccagacctatgactggacactgaatagaaaccagccggcagcaactgctttggccaacactatagaggtcttc

SEQ ID NO: 209410 - DNA, 75 bp, Artificial Sequence
  Synthetic
gggattcctaattctaggcaaggaggacaaaagatatggtccagcattgagcatcaatgaactgagcaatcttgc

SEQ ID NO: 209411 - DNA, 75 bp, Artificial Sequence
  Synthetic
ggtccagctcaagctgtcatgatgggaaagcatggttacatgtttgtgttactggagatgatagaaatgcaactg

SEQ ID NO: 209412 - DNA, 75 bp, Artificial Sequence
  Synthetic
ccagtatcatctatggtggtatacttgttgatagcattggttcatggtctaaaaatatccccagaactcaggagt

SEQ ID NO: 209413 - DNA, 75 bp, Artificial Sequence
  Synthetic
caaggatgtaatggaatcaatggacaaagaagaaatagaaataacaacacatttccagagaaagagaagagtaag

SEQ ID NO: 209414 - DNA, 75 bp, Artificial Sequence
  Synthetic
tcactattggagaatgccccaaatatgttaaaagcacccaactgagaatggcaacaggactaaggaatatcccat

SEQ ID NO: 209415 - DNA, 75 bp, Artificial Sequence
  Synthetic
cttctagccattgtaatgggccttgtcttcatatgtgtaaagaatggaaacatgcggtgcactatttgtatataa

SEQ ID NO: 209416 - DNA, 75 bp, Artificial Sequence
  Synthetic
atgagtcttctaaccgaggtcgaaacgtacgttctctctatcattccatcaggccccctcaaagccgagatcgcg

SEQ ID NO: 209417 - DNA, 75 bp, Artificial Sequence
  Synthetic
agtgcttctgggaaagctgacactagaatactatttattagagaggggaaaatagtacacattagccctttgtca

SEQ ID NO: 209418 - DNA, 75 bp, Artificial Sequence
  Synthetic
gaatactatttattagagaggggaaaatagtacacattagccctttgtcaggaagtgctcagcatgtggaggaat

SEQ ID NO: 209419 - DNA, 75 bp, Artificial Sequence
  Synthetic
ggatggacaggaatgatagatggatggtatggatatcaccatcaaaatgagcagggatctggttacgcagcagat

SEQ ID NO: 209420 - DNA, 75 bp, Artificial Sequence
  Synthetic
cttaataagagcattgacattgaacacaatgacaaaagatgcagaaagaggcaaattgaagaggcgggcaattgc

SEQ ID NO: 209421 - DNA, 75 bp, Artificial Sequence
  Synthetic
tggaggggatctaatagacccgttctatacataaatatggcagattatagtattgactccggttatgtgtgctcg

SEQ ID NO: 209422 - DNA, 75 bp, Artificial Sequence
  Synthetic
aatcaataattgtagaatctggagatccaaatgcattattgaaacacagatttgaaataattgaagggagagacc

SEQ ID NO: 209423 - DNA, 75 bp, Artificial Sequence
  Synthetic
atgggatcagcaacaaagtgaactcagtgattgaaaaaatgaacattcaatttacttcagtgggcaaggagttca

SEQ ID NO: 209424 - DNA, 75 bp, Artificial Sequence
  Synthetic
gcagggatctggttacgcagcagatcagaaaagcacacaaatcgcaattgatgggatcagcaacaaagtgaactc

SEQ ID NO: 209425 - DNA, 75 bp, Artificial Sequence
  Synthetic
tatacataaatatggcagattatagtattgactccggttatgtgtgctcgggacttgttggtgacacaccaagaa

SEQ ID NO: 209426 - DNA, 75 bp, Artificial Sequence
  Synthetic
tagtatctgcaataacacaggagtcgagaagcctaaattcctcccagacctgtatgactacaaagaaaaccgatt

SEQ ID NO: 209427 - DNA, 75 bp, Artificial Sequence
  Synthetic
ggggccccaggagtgaaagggtgggcctttgacagtggaaatgacatttggatgggaagaactattgaaaaggat

SEQ ID NO: 209428 - DNA, 75 bp, Artificial Sequence
  Synthetic
ttcacaagatacagagctctcctttacaatcactggggacaataccaaatggaatgagaatcagaatcctcgtgt

SEQ ID NO: 209429 - DNA, 75 bp, Artificial Sequence
  Synthetic
caagcttcatcagaggaacaagagtagtcccaagaggacaactgtccaccagaggagttcagattgcttcaaatg

SEQ ID NO: 209430 - DNA, 75 bp, Artificial Sequence
  Synthetic
ttcatggagcaaaggaagttgcactcagttactcaactggtgcgcttgccagctgcatgggtctcatatacaaca

SEQ ID NO: 209431 - DNA, 75 bp, Artificial Sequence
  Synthetic
cctttgacagtggaaatgacatttggatgggaagaactattgaaaaggattcgcgctcaggttatgagactttca

SEQ ID NO: 209432 - DNA, 75 bp, Artificial Sequence
  Synthetic
gacacacattcatatattctcattcactggagaggaaatggcaaccaaagcggactacacccttgatgaagagag

SEQ ID NO: 209433 - DNA, 75 bp, Artificial Sequence
  Synthetic
caagtcatagttggcagtgacaatccgtccgggtattctggcattttctccgttgaaggcaaaagctgcatcaac

SEQ ID NO: 209434 - DNA, 75 bp, Artificial Sequence
  Synthetic
cgtccgggtattctggcattttctccgttgaaggcaaaagctgcatcaacaggtgtttttatgtagagctaataa

SEQ ID NO: 209435 - DNA, 75 bp, Artificial Sequence
  Synthetic
gtaaaagcatgaagctgcggacgcaaataccagcagaaatgcttgcaaatattgacctgaaatacttcaacgaat

SEQ ID NO: 209436 - DNA, 75 bp, Artificial Sequence
  Synthetic
aaaatgattgcaatcattgtaatagcgatactggcagcagccggaaagtcagacaagatctgcatagggtatcat

SEQ ID NO: 209437 - DNA, 75 bp, Artificial Sequence
  Synthetic
agacaagatctgcatagggtatcatgccaataattcaacaacacaagtggatacgatacttgaaaagaatgtaac

SEQ ID NO: 209438 - DNA, 75 bp, Artificial Sequence
  Synthetic
ggcaatcagcttctggatgtgttctaatgggtcattgcaatgcagaatatgcatttaagacttgaatttcagaat

SEQ ID NO: 209439 - DNA, 75 bp, Artificial Sequence
  Synthetic
atacgatacttgaaaagaatgtaaccgtcacacactcagttgaattgctggagaatcaaaaagaagaaagattct

SEQ ID NO: 209440 - DNA, 75 bp, Artificial Sequence
  Synthetic
tgagggaaagctttctcagatgtccaaagaagtgaacgccagaattgaaccatttctgaagacaacaccacgtcc

SEQ ID NO: 209441 - DNA, 75 bp, Artificial Sequence
  Synthetic
ttatggatgcccttaaactaagcattgaagacccgagtcatgagggagagggtattccattatatgatgcaatca

SEQ ID NO: 209442 - DNA, 75 bp, Artificial Sequence
  Synthetic
catgaaaagggcataaactccaattacctcatggcttggaagcaagtgctggcagaactccaagatattgaaaat

SEQ ID NO: 209443 - DNA, 75 bp, Artificial Sequence
  Synthetic
ttcccaaaagtacatggacaggagtagacaccagcagcggggtaacaaaagcttgcccttataacagtggttcat

SEQ ID NO: 209444 - DNA, 75 bp, Artificial Sequence
  Synthetic
aacagcccagatggctcttcagttatttatcaaggactatagatacacatatcggtgccacaggggtgatacaca

SEQ ID NO: 209445 - DNA, 75 bp, Artificial Sequence
  Synthetic
ggcaattctcctgtgttcaactacaacaaggcaaccaagaggcttacagtgcttggaaaggatgcaggtgcattg

SEQ ID NO: 209446 - DNA, 75 bp, Artificial Sequence
  Synthetic
tgccaggaacatagtaagaagagcaacagtatcagcagacccactagcatctctattggagatgtgccacagcac

SEQ ID NO: 209447 - DNA, 75 bp, Artificial Sequence
  Synthetic
ccagtaattaagggaacttacaacaacactggaactcaaccaatcctttacttctggggtgtgcaccatcctcct

SEQ ID NO: 209448 - DNA, 75 bp, Artificial Sequence
  Synthetic
cttctggggtgtgcaccatcctcctgacaccaatgagcaaaatactctgtacggctctggtgatcgatacgttag

SEQ ID NO: 209449 - DNA, 75 bp, Artificial Sequence
  Synthetic
gacaacgagccgagtgggtatgcacaaacggattgtgtattggaagcaatggctttccttgaagaatctcaccca

SEQ ID NO: 209450 - DNA, 75 bp, Artificial Sequence
  Synthetic
gacagattcaagttggattgaacttgatgagataggggaagacgttgctccaattgaacacattgcaagtatgag

SEQ ID NO: 209451 - DNA, 75 bp, Artificial Sequence
  Synthetic
agtacaggtctaaaagatgatcttattgaaaatttgcaggcttaccagaaccggatgggagtgcaactgcagcgg

SEQ ID NO: 209452 - DNA, 75 bp, Artificial Sequence
  Synthetic
ccagaaaaggtagactttgaggattgcaaagatgttagagatctaagacagtatgacagtgatgaaccagagtca

SEQ ID NO: 209453 - DNA, 75 bp, Artificial Sequence
  Synthetic
gaaaaaggaaagtggacaacgaacacagagactggagcaccccaactcaatccaattgatggaccattacctgag

SEQ ID NO: 209454 - DNA, 75 bp, Artificial Sequence
  Synthetic
aatcctctgaatccgtttgtcagccataaggaaattgagtccttaaacaatgctgtagtaatgccagcccatggt

SEQ ID NO: 209455 - DNA, 75 bp, Artificial Sequence
  Synthetic
taatgaagggagtttacataaacacagctttgttgaatgcatcctgtgcagccatggatgacttccaactgatcc

SEQ ID NO: 209456 - DNA, 75 bp, Artificial Sequence
  Synthetic
agctttgttgaatgcatcctgtgcagccatggatgacttccaactgatcccaatgataagcaaatgcagaaccaa

SEQ ID NO: 209457 - DNA, 75 bp, Artificial Sequence
  Synthetic
attggccaacactatagaggtattcagatcgaatggcctgacagccaatgaatcaggaaggttgatcgatttcct

SEQ ID NO: 209458 - DNA, 75 bp, Artificial Sequence
  Synthetic
caatgataagcaaatgcagaaccaaagagggaagaaggaagactaatctatatggattcattataaaagggagat

SEQ ID NO: 209459 - DNA, 75 bp, Artificial Sequence
  Synthetic
ccctaaaagaaaccgttccattctcaataccagtcaaagaggaattcttgaggatgaacaaatgtaccaaaagtg

SEQ ID NO: 209460 - DNA, 75 bp, Artificial Sequence
  Synthetic
agatcgaatggcctgacagccaatgaatcaggaaggttgatcgatttcctcaaggacgtgatggattcaatggat

SEQ ID NO: 209461 - DNA, 75 bp, Artificial Sequence
  Synthetic
gagaaacccaaatttcttccggatctgtatgactacaaggaaaaccgattcattgaaattggagtaacgaggagg

SEQ ID NO: 209462 - DNA, 75 bp, Artificial Sequence
  Synthetic
catttcagaatgtgagccctctgtggataggagaatgccccaaatatgtaaaaagtgagagcctgaggcttgcaa

SEQ ID NO: 209463 - DNA, 75 bp, Artificial Sequence
  Synthetic
ttaaacccaggggaaaccttgaatgtggaatctaatgggaatctaatcgccccttggtatgcatacagatttgtc

SEQ ID NO: 209464 - DNA, 75 bp, Artificial Sequence
  Synthetic
aacaaagactgaacaaaaggagctacctaataagagcactgacattgaacacaatgacaaaggatgctgaaagag

SEQ ID NO: 209465 - DNA, 75 bp, Artificial Sequence
  Synthetic
cggactgcaattggccaagtgtcaaggcctatgttcttgtatgtgagaaccaatggaacctccaagataaagatg

SEQ ID NO: 209466 - DNA, 75 bp, Artificial Sequence
  Synthetic
atggagagaataaaagaattaagagacctaatgtcgcagtcccgcactcgcgagatactaacaagaaccactgtg

SEQ ID NO: 209467 - DNA, 75 bp, Artificial Sequence
  Synthetic
atggagagattaaaagaattaagagacctaatgtcgcagtcccgcactcgcgagatactaacaagaaccactgtg

SEQ ID NO: 209468 - DNA, 75 bp, Artificial Sequence
  Synthetic
atggagagactaaaagaattaagagacctaatgtcgcagtcccgcactcgcgagatactaacaagaaccactgtg

SEQ ID NO: 209469 - DNA, 75 bp, Artificial Sequence
  Synthetic
atggagagagtaaaagaattaagagacctaatgtcgcagtcccgcactcgcgagatactaacaagaaccactgtg

SEQ ID NO: 209470 - DNA, 75 bp, Artificial Sequence
  Synthetic
ggactggaatgatagacgggtggtatggctatcatcatgaaaattctcaaggctcagggtatgcagcagacaggg

SEQ ID NO: 209471 - DNA, 75 bp, Artificial Sequence
  Synthetic
ttcgtgtattttgtagaagcactagcgaggagcatctgtgagaaacttgagcaatctggcctccctgtcggaggg

SEQ ID NO: 209472 - DNA, 75 bp, Artificial Sequence
  Synthetic
atggtatgctttcacactgagtagaggccttggatcaggaatcatcacctctaatgcaccaatggacaaatgtga

SEQ ID NO: 209473 - DNA, 75 bp, Artificial Sequence
  Synthetic
atcgacaaaatgaacacacaattcgaagctgtcgatcatgaattttcaaatttagagagaagaattgacaatctg

SEQ ID NO: 209474 - DNA, 75 bp, Artificial Sequence
  Synthetic
aagctgtcgatcatgaattttcaaatttagagagaagaattgacaatctgaacaaaagaatggaagatggatttc

SEQ ID NO: 209475 - DNA, 75 bp, Artificial Sequence
  Synthetic
aggggggtggaagaaggatccatcggaaaagtgtgcagaaccttattagcaaaatctgtattcaacagtttatat

SEQ ID NO: 209476 - DNA, 75 bp, Artificial Sequence
  Synthetic
acgctttggagcaagacaaatgatgctggatcagacagggtgatggtgtctcccctagctgtaacttggtggaac

SEQ ID NO: 209477 - DNA, 75 bp, Artificial Sequence
  Synthetic
acaattactggggacaacaccaaatggaatgagaatcaaaacccccggatgtttctagcaatgataacatacatc

SEQ ID NO: 209478 - DNA, 75 bp, Artificial Sequence
  Synthetic
agaacactagacctgcatgatgcgaatgtgaagaatctgtatgaaaaggtcaaatcacaactaagggacaatgct

SEQ ID NO: 209479 - DNA, 75 bp, Artificial Sequence
  Synthetic
tccattacccaaaggtttacaaaacatactttgagaaggttgaaaggttaaaacatggaaccttcggtcctgtcc

SEQ ID NO: 209480 - DNA, 75 bp, Artificial Sequence
  Synthetic
aatgatctagggaacggatgctttgaattttggcataagtgtgataatgaatgcatagagtctgtcaaaaatggt

SEQ ID NO: 209481 - DNA, 75 bp, Artificial Sequence
  Synthetic
gaagagaagattccaaagacaaagaacatgaagaaaacaagccaattaaagtgggcactcggtgagaacatggca

SEQ ID NO: 209482 - DNA, 75 bp, Artificial Sequence
  Synthetic
gtaagagtatgaagttacggacacaagtaccagcggaaatgctcgcaaatattgacctgaaatacttcaacaaat

SEQ ID NO: 209483 - DNA, 75 bp, Artificial Sequence
  Synthetic
atgaacccaaatcagaagataataacaatcggttcagtctctctaaccattgcaacagtatgtttcctcatgcag

SEQ ID NO: 209484 - DNA, 75 bp, Artificial Sequence
  Synthetic
tgcaacagtatgtttcctcatgcagatcgccatcttaacaatgactatgacactgcatttcaaccagaacgaatg

SEQ ID NO: 209485 - DNA, 75 bp, Artificial Sequence
  Synthetic
tgttcagataataaaactcctcccctttgctgctgccccaccagaacaaagtaggatgcagttctcctccctgac

SEQ ID NO: 209486 - DNA, 75 bp, Artificial Sequence
  Synthetic
ctcgggcagaagaagtacaccaaaaccacatattggtgggacggactccaatcctcagatgacttcgccctcata

SEQ ID NO: 209487 - DNA, 75 bp, Artificial Sequence
  Synthetic
agaagagcatcgactacagagactggtcaaaaccgcaatgtcgaatcacagggtttgctcctttttccaaggaca

SEQ ID NO: 209488 - DNA, 75 bp, Artificial Sequence
  Synthetic
gtatgataaaggcagtgagaggtgatttgaactttgtcaacagagcgaaccagcggctaaatcccatgcatcaac

SEQ ID NO: 209489 - DNA, 75 bp, Artificial Sequence
  Synthetic
cctaccggtagcaggcggaacaagcagtgtgtacattgaggtattgcatttgactcaagggacctgttgggaaca

SEQ ID NO: 209490 - DNA, 75 bp, Artificial Sequence
  Synthetic
tagaacctgcaaattagttgggataaacatgagcaagaagaaatcctacataaatcggacaggaacattcgaatt

SEQ ID NO: 209491 - DNA, 75 bp, Artificial Sequence
  Synthetic
tacgtgtcatgtgacactagtaaatgctatcaatttgcacttgggcaaggaaccacgctggacaacaaacattca

SEQ ID NO: 209492 - DNA, 75 bp, Artificial Sequence
  Synthetic
gctatcaatttgcacttgggcaaggaaccacgctggacaacaaacattcaaatggcacaatacatgatagaaccc

SEQ ID NO: 209493 - DNA, 75 bp, Artificial Sequence
  Synthetic
taaatcggacaggaacattcgaattcacaagctttttctaccgctatggattcgtagctaacttcagtatggagt

SEQ ID NO: 209494 - DNA, 75 bp, Artificial Sequence
  Synthetic
aatggcacaatacatgatagaacccctcaccggacccttttgatgagtgagttgggtgttccgtttcatttggga

SEQ ID NO: 209495 - DNA, 75 bp, Artificial Sequence
  Synthetic
ccagttcaagttgtcatgatgggaaagcatggttgcacatctgtattactggggatgataaaaatgcgactgcta

SEQ ID NO: 209496 - DNA, 75 bp, Artificial Sequence
  Synthetic
tttatcaaagactacagatacacataccgatgtcacaggggtgatacgcaaattcaaacgaggagagcattcgag

SEQ ID NO: 209497 - DNA, 75 bp, Artificial Sequence
  Synthetic
aattcaaacgaggagagcattcgagctgaagaagctgtgggagcagacccgttcgaaggcaggactgttggtttc

SEQ ID NO: 209498 - DNA, 75 bp, Artificial Sequence
  Synthetic
agtgtgtttgcatcaatgggacttgcacagtagtaatgactgatggaaacgcatcaggaaaagccgacactagaa

SEQ ID NO: 209499 - DNA, 75 bp, Artificial Sequence
  Synthetic
tgcgatgatatgttttctcatgcagattgccatcttaacaacgaccatgacactacatttcaggcagaatgaatg

SEQ ID NO: 209500 - DNA, 75 bp, Artificial Sequence
  Synthetic
tctgcttgaaatgggaattgatggatgaagactaccaaggcaggttgtgtaatcctatgaacccgtttgtcagtc

SEQ ID NO: 209501 - DNA, 75 bp, Artificial Sequence
  Synthetic
agtgctcagcatatagaggaatgttcctgttatcctagatacccaaatgtcagatgtgtatgcagagacaactgg

SEQ ID NO: 209502 - DNA, 75 bp, Artificial Sequence
  Synthetic
ggctttccttgaagaatcccacccaggaatctttgaaaactcgtgtcttgaaacgatggaagttgttcaacaaac

SEQ ID NO: 209503 - DNA, 75 bp, Artificial Sequence
  Synthetic
caaagattaaaccccatgcatcaactcctaaggcacttccaaaaagatgcaaaagtgctgtttcagaattggggt

SEQ ID NO: 209504 - DNA, 75 bp, Artificial Sequence
  Synthetic
cagatgtgtatgcagagacaactggaagggttctaataggcccgttatagacataaatatggcagattatagcat

SEQ ID NO: 209505 - DNA, 75 bp, Artificial Sequence
  Synthetic
gcatgataaaagcagtccgaggcgatctgaatttcgtaaacagagcaaaccaaagattaaaccccatgcatcaac

SEQ ID NO: 209506 - DNA, 75 bp, Artificial Sequence
  Synthetic
tgattccagttatgtgtgttcagggcttgttggagatacaccaagaaacgatgatagctccagcagcagcaactg

SEQ ID NO: 209507 - DNA, 75 bp, Artificial Sequence
  Synthetic
gagagtggttgtaagtattgaccggttcttaagggttcgagatcagcgggggaacgtactcttatctcccgaaga

SEQ ID NO: 209508 - DNA, 75 bp, Artificial Sequence
  Synthetic
ttgacgatggtgatgatatctggatgggaagaacaatcagtaaagactcgcgatcaggctatgagacttttaggg

SEQ ID NO: 209509 - DNA, 75 bp, Artificial Sequence
  Synthetic
gggaagaacaatcagtaaagactcgcgatcaggctatgagacttttagggtcattggtggttggaccattgccaa

SEQ ID NO: 209510 - DNA, 75 bp, Artificial Sequence
  Synthetic
gcacgaattgacttcgaatctggaaggattaagaaagaagagtttgctgagatcatgaagatctgttccaccatt

SEQ ID NO: 209511 - DNA, 75 bp, Artificial Sequence
  Synthetic
atggaaagaataaaagaactaagagatttgatgtcacagtctcgcactcgcgagatactgacaaaaacaactgtg

SEQ ID NO: 209512 - DNA, 75 bp, Artificial Sequence
  Synthetic
ctggttactctggcatcttctctgttgaaaacaaaagctgcatcaataggtgtttttatgtggaattgataagag

SEQ ID NO: 209513 - DNA, 75 bp, Artificial Sequence
  Synthetic
gtggacttcaaacagtattgtcgcattttgtggcacttcaggcacctatggaacaggctcatggcctgatggggc

SEQ ID NO: 209514 - DNA, 75 bp, Artificial Sequence
  Synthetic
cagtggatttgtgagaacactattccaacaaatgcgagacgtgctggggacattcgatactgtccagataataaa

SEQ ID NO: 209515 - DNA, 75 bp, Artificial Sequence
  Synthetic
aagtgctcagcacgtggaggaatgctcctgttacccccggtatcctgaagtttggtgtgtttgcagagacaactg

SEQ ID NO: 209516 - DNA, 75 bp, Artificial Sequence
  Synthetic
accggcttcgccgagatcagaagtctctaagaggaaggggcagcactcttggtctggatatcaaaacagctactc

SEQ ID NO: 209517 - DNA, 75 bp, Artificial Sequence
  Synthetic
cttctctgactgtgaatgtaagaggctcaggaatgagaatactcataaggggcaactcccctgcgttcaactaca

SEQ ID NO: 209518 - DNA, 75 bp, Artificial Sequence
  Synthetic
acacttaaaatgactattgcttctgtgccggcttcacgctacataactgacatgactcttgaggaaatgtcaagg

SEQ ID NO: 209519 - DNA, 75 bp, Artificial Sequence
  Synthetic
ccgcagggtcgacataaacccgggccatgcagatcttagtgctaaagaagcacaggatgtcatcatggaggtcgt

SEQ ID NO: 209520 - DNA, 75 bp, Artificial Sequence
  Synthetic
aaacatcctcagaacccaggagtcagaatgcgtttgcatcaatggaacttgtgcagtagtaatgactgatggaag

SEQ ID NO: 209521 - DNA, 75 bp, Artificial Sequence
  Synthetic
caggatggaccaagcaatactgaataaaaacatcacattgaaagcaaacttcagtgtgacttttgatcgattgga

SEQ ID NO: 209522 - DNA, 75 bp, Artificial Sequence
  Synthetic
tttgacgatgggaatgacatttggatgggacgaacaatcaaaagtgattcacgctcaggttatgagacttttagg

SEQ ID NO: 209523 - DNA, 75 bp, Artificial Sequence
  Synthetic
tgcccagctttggagtgtctgggatcaatgaatctgcagacatgagcattggagtaacagtgataaagaacaaca

SEQ ID NO: 209524 - DNA, 75 bp, Artificial Sequence
  Synthetic
gcttcaggactgcaaaattgcccctttaatggtggcttacatgttggagagagaactggttcgcaaaacaagatt

SEQ ID NO: 209525 - DNA, 75 bp, Artificial Sequence
  Synthetic
gacccccaacacagagatgtcactaagaggaataagagttagcaaaatgggggtagatgaatactccagtactga

SEQ ID NO: 209526 - DNA, 75 bp, Artificial Sequence
  Synthetic
agaaatgatgatgttgatcagagtttaattattgctgctagaaatattgttagaagagcaacagtatcagcagac

SEQ ID NO: 209527 - DNA, 75 bp, Artificial Sequence
  Synthetic
atgggggacctccactctcttcaaaacagaaacggaaagtggcgagaacaattgagccagaagtttgaagaaata

SEQ ID NO: 209528 - DNA, 75 bp, Artificial Sequence
  Synthetic
acagaaacggaaagtggcgagaacaattgagccagaagtttgaagaaataagatggctgattgaggaagtgcggt

SEQ ID NO: 209529 - DNA, 75 bp, Artificial Sequence
  Synthetic
tgagggcaagctttctcaaatgtcaaaagaagtgaacgccagaattgagccatttctgaagacaacaccacgccc

SEQ ID NO: 209530 - DNA, 75 bp, Artificial Sequence
  Synthetic
ataacaatagagagaatggttctctcagcatttgatgagagaagaaacaaatatctggaagaacatcccagtgct

SEQ ID NO: 209531 - DNA, 75 bp, Artificial Sequence
  Synthetic
aaagaagtgaacgccagaattgagccatttctgaagacaacaccacgccctctcagattacctgatgggcctccc

SEQ ID NO: 209532 - DNA, 75 bp, Artificial Sequence
  Synthetic
tgctctcagcggtcgaagttcttgctgatggatgccctcaaattaagcatcgaagacccgagccatgagggagaa

SEQ ID NO: 209533 - DNA, 75 bp, Artificial Sequence
  Synthetic
gggaaagaccccaagaagactggaggcccaatatacaggaggagagatgggaaatggatgagagaattgatcctg

SEQ ID NO: 209534 - DNA, 75 bp, Artificial Sequence
  Synthetic
ttcgcttggagaagcagcgatgaggatgggagacctccactctctacaaagtagaaacgggaaatggagagaaca

SEQ ID NO: 209535 - DNA, 75 bp, Artificial Sequence
  Synthetic
tcctgaggcatttccaaaaggatgcaaaggtcctgtttcaaaactggggaattgaacccattgacaatgtaatgg

SEQ ID NO: 209536 - DNA, 75 bp, Artificial Sequence
  Synthetic
catgaaaagggcataaaccccaattatcttctggcctggaagcaggtgctggcagaactccaagatattgaaaat

SEQ ID NO: 209537 - DNA, 75 bp, Artificial Sequence
  Synthetic
ggcagaactccaagatattgaaaatgaagagaaaatcccaaaaacaaagaacatgaagaaaacaagccaattaaa

SEQ ID NO: 209538 - DNA, 75 bp, Artificial Sequence
  Synthetic
acgtgtggatgggaaggacaatcaacgaaacgttacgcttaggttatgaaaccttcaaagtcattgaaggctggt

SEQ ID NO: 209539 - DNA, 75 bp, Artificial Sequence
  Synthetic
accttcaaagtcattgaaggctggtccaaagctaactccaaattacagacaaatagacaagtcatagttgaaaaa

SEQ ID NO: 209540 - DNA, 75 bp, Artificial Sequence
  Synthetic
ccatgatgtgggagatcaatggtccggaatcagtgctagttaacacatatcaatggatcattagaaattgggaaa

SEQ ID NO: 209541 - DNA, 75 bp, Artificial Sequence
  Synthetic
atgaaagaatgtgcaacatcctcaaagggaaattccaaacagcagcacaacgagcaatgatggaccaggtgagag

SEQ ID NO: 209542 - DNA, 75 bp, Artificial Sequence
  Synthetic
catttgacactgtccaaataataaagctattaccatttgcagcagccccgccggagcagagtaggatgcagttct

SEQ ID NO: 209543 - DNA, 75 bp, Artificial Sequence
  Synthetic
tctcgagataggagacatgctcctacggactgcaataggccaagtgtcaaggcccatgttcctgtatgtgagaac

SEQ ID NO: 209544 - DNA, 75 bp, Artificial Sequence
  Synthetic
ggtcccaagaggacaactgtcaaccagaggagtacagattgcttcaaatgagaacatggaaacaatggactccag

SEQ ID NO: 209545 - DNA, 75 bp, Artificial Sequence
  Synthetic
ggcccatgttcctgtatgtgagaaccaatgggacttccaagattaagatgaaatggggcatggagatgaggcgat

SEQ ID NO: 209546 - DNA, 75 bp, Artificial Sequence
  Synthetic
agaggagtacagattgcttcaaatgagaacatggaaacaatggactccagcactcttgaattgaggagcagatat

SEQ ID NO: 209547 - DNA, 75 bp, Artificial Sequence
  Synthetic
aaacggaaacgggactctagcatacttactgacagtcagacagcgaccaaaaggattcggatggccatcaattaa

SEQ ID NO: 209548 - DNA, 75 bp, Artificial Sequence
  Synthetic
atgaatccaaatcagaagattctatgcacttcagccactgctatcataataggcgcaatcgcagtactcattgga

SEQ ID NO: 209549 - DNA, 75 bp, Artificial Sequence
  Synthetic
aggcgcaatcgcagtactcattggaatagcaaacctaggattgaacataggactgcatctaaaaccgagctgcaa

SEQ ID NO: 209550 - DNA, 75 bp, Artificial Sequence
  Synthetic
gggaacgtactattgtcacccgaagaagtcagcgagacacaaggaacagagaaactgacaatcacttattcgtca

SEQ ID NO: 209551 - DNA, 75 bp, Artificial Sequence
  Synthetic
gactgcatctaaaaccgagctgcaattgctcacactcacaacctgaaacaaccaacacaagccaaacaataataa

SEQ ID NO: 209552 - DNA, 75 bp, Artificial Sequence
  Synthetic
agaacttcagacatgagaactgagatcataaggatgatggagaatgccagacctgaagatgtgtctttccaaggg

SEQ ID NO: 209553 - DNA, 75 bp, Artificial Sequence
  Synthetic
caccaacatccaaatggaagagagaacaagcaggaatttcaataacttaactaaagggctctgtactataaattc

SEQ ID NO: 209554 - DNA, 75 bp, Artificial Sequence
  Synthetic
taacgagggatcttatttcttcggagacaatgcagaggagtatgacaattaaagaaaaatacccttgtttctact

SEQ ID NO: 209555 - DNA, 75 bp, Artificial Sequence
  Synthetic
ctaaagggctctgtactataaattcatggcacatatatgggaaagacaatgcagtaagaattggagagagctcgg

SEQ ID NO: 209556 - DNA, 75 bp, Artificial Sequence
  Synthetic
atgaatccaagtcaaaagataataacaattggctctgtctcactaatcattgcaacagtatgtttcctcatgcaa

SEQ ID NO: 209557 - DNA, 75 bp, Artificial Sequence
  Synthetic
caacaatcagagggaaacactcaaacggaacaatacacgataggtcccagtatcgcgccctgataagctggccac

SEQ ID NO: 209558 - DNA, 75 bp, Artificial Sequence
  Synthetic
agcctactttctcagtacagagaaatcttcctttcgagagagcaaccatcatggcagcatttactggaaacactg

SEQ ID NO: 209559 - DNA, 75 bp, Artificial Sequence
  Synthetic
ggaaatggagagaacaattaagccagaagttcgaagaaataagatggttgattgaagaagtacgacatagattaa

SEQ ID NO: 209560 - DNA, 75 bp, Artificial Sequence
  Synthetic
tcaagtactagttgccatgatggcaaatccaggatgtcaatatgtatatcaggaccaaacaacaatgcatctgca

SEQ ID NO: 209561 - DNA, 75 bp, Artificial Sequence
  Synthetic
aatccaggatgtcaatatgtatatcaggaccaaacaacaatgcatctgcagtagtatggtacaacagaaggcctg

SEQ ID NO: 209562 - DNA, 75 bp, Artificial Sequence
  Synthetic
aaagaagaaatagaaataacaacacatttccagagaaagagaagagtaagggacaacatgaccaagaaaatgatc

SEQ ID NO: 209563 - DNA, 75 bp, Artificial Sequence
  Synthetic
gaatgtgtatgccacaacggcgtatgcccagtagtgttcaccgatgggtctgccactggacctgcagacacaaga

SEQ ID NO: 209564 - DNA, 75 bp, Artificial Sequence
  Synthetic
gcccagtagtgttcaccgatgggtctgccactggacctgcagacacaagaatatactattttaaagaggggaaaa

SEQ ID NO: 209565 - DNA, 75 bp, Artificial Sequence
  Synthetic
tcatgttacggggaacgaacaggaattacctgcacatgcagggacaattggcagggctcaaatagaccagtggtt

SEQ ID NO: 209566 - DNA, 75 bp, Artificial Sequence
  Synthetic
ttacctgcacatgcagggacaattggcagggctcaaatagaccagtggttcagatagatccagtagcaatgacac

SEQ ID NO: 209567 - DNA, 75 bp, Artificial Sequence
  Synthetic
aatgacccaaatataggtaagtgtaatgacccttatccaggtattaataacaatggagtcaagggattctcatac

SEQ ID NO: 209568 - DNA, 75 bp, Artificial Sequence
  Synthetic
ctggatggggctaacacttggctagggaggacaataagcacagcctcgaggtctggatacgagatgttaaaagtg

SEQ ID NO: 209569 - DNA, 75 bp, Artificial Sequence
  Synthetic
tgtattaaacgctgactggagtggttacagtggatctttcatggactattgggctgaaggggactgctatcgagc

SEQ ID NO: 209570 - DNA, 75 bp, Artificial Sequence
  Synthetic
aaagatgatcttcttgaaaatttgcaggcctaccagaaacggatgggagtgcaaatgcagcgattcaagtgatcc

SEQ ID NO: 209571 - DNA, 75 bp, Artificial Sequence
  Synthetic
attttgggcaaagaagacaagagatatggcccagcattaagcatcaatgaactgagcaatcttgcaaaaggagag

SEQ ID NO: 209572 - DNA, 75 bp, Artificial Sequence
  Synthetic
ggactggaaccaacaggccagtattggtgatttctccagatttgtcttacagagtcggatacttgtgtgcaggtc

SEQ ID NO: 209573 - DNA, 75 bp, Artificial Sequence
  Synthetic
tcgatgtgttccagtacagaattcctgggacaatggaactggcctgatggggctaaaatagagtacttcctctaa

SEQ ID NO: 209574 - DNA, 75 bp, Artificial Sequence
  Synthetic
ggaaaaggcaatgaaagaatatggggaagatccgaaaatcgaaacaaacaaattcgcatcaatatgcacacactt

SEQ ID NO: 209575 - DNA, 75 bp, Artificial Sequence
  Synthetic
ggttaacagaacacatcaatattcagaaaaagggaaatggacaacaaactcagagactggagcaccccaactcaa

SEQ ID NO: 209576 - DNA, 75 bp, Artificial Sequence
  Synthetic
aactcagtgactacgaagggagactgatccaaaacagcataaccatagagagaatggttctctcggcatttgacg

SEQ ID NO: 209577 - DNA, 75 bp, Artificial Sequence
  Synthetic
actagcccaatgggaaatcagggatatggagttaagggatttggattcaggcagggcaatgatgtatggatggga

SEQ ID NO: 209578 - DNA, 75 bp, Artificial Sequence
  Synthetic
ttccacttcatcgacgaacgaggcgaatcaactataatagaatctggcgatccaaatgcgctgctgaaacaccga

SEQ ID NO: 209579 - DNA, 75 bp, Artificial Sequence
  Synthetic
tccaaatgcgctgctgaaacaccgatttgaaataatcgaagggagagaccgaacaatggcctggacagtggtgaa

SEQ ID NO: 209580 - DNA, 75 bp, Artificial Sequence
  Synthetic
tagtatctgcaacaccacaggagccgaaaaacccaaatttctcccggatctgtatgactacaaggaaaaccgttt

SEQ ID NO: 209581 - DNA, 75 bp, Artificial Sequence
  Synthetic
cagtggttccttcacactaccagtggagttaacaaaaagaaattgtctggttccatgtttttgggttgagatgat

SEQ ID NO: 209582 - DNA, 75 bp, Artificial Sequence
  Synthetic
gcatttgggtaaatgtaacattgctggctggctcctgggaaatccagagtgtgaatcactctccacagcaagctc

SEQ ID NO: 209583 - DNA, 75 bp, Artificial Sequence
  Synthetic
gttggttctattggaaaatgaaagaactttggactaccacgattcaaatgtgaaaaacttatatgaaaaggtaag

SEQ ID NO: 209584 - DNA, 75 bp, Artificial Sequence
  Synthetic
actggagaagagatggccaccaaagcagattacactcttgacgaagaaagcagggcaagaatcaaaaccaggctg

SEQ ID NO: 209585 - DNA, 75 bp, Artificial Sequence
  Synthetic
ggacaacatgaccaagaagatggtcacacaaagaacaataggaaagaagaagcagagattaaacaagagaagcta

SEQ ID NO: 209586 - DNA, 75 bp, Artificial Sequence
  Synthetic
gcaggggtctatgggattcctttcgtcagtctgaaagaggcgaagaaacaattgaagaaagatttgaaatcacag

SEQ ID NO: 209587 - DNA, 75 bp, Artificial Sequence
  Synthetic
gggataggcaatttggctttcaatgcagttattcatggcaaagttgaagaccataaaggtgaaatttcaccaaac

SEQ ID NO: 209588 - DNA, 75 bp, Artificial Sequence
  Synthetic
aacagcagcacaacgagcaatgatggaccaagtgagagaaagccggaatcctgggaatgctgaaattgaagatct

SEQ ID NO: 209589 - DNA, 75 bp, Artificial Sequence
  Synthetic
ctgggaatgctgaaattgaagatctcatctttctcgcacggtctgctctcattctgaggggatcagtggctcata

SEQ ID NO: 209590 - DNA, 75 bp, Artificial Sequence
  Synthetic
tagtcggaattgatcctttccgtctgctccagaacagtcaagtcttcagcctcatcagaccaaatgaaaatccag

SEQ ID NO: 209591 - DNA, 75 bp, Artificial Sequence
  Synthetic
tgatggatgctctgaaattaagcattgaggacccgagccacgaaggggaggggataccgctatatgatgcgatca

SEQ ID NO: 209592 - DNA, 75 bp, Artificial Sequence
  Synthetic
atccaagatggaagcaaaactatttgtattattctgtgcgttcacttcactgaaagctgacaccatttgtgtagg

SEQ ID NO: 209593 - DNA, 75 bp, Artificial Sequence
  Synthetic
aatgcatgaaaacgttcttcgggtggaaagagcccaacattatcaaaccacatgagaaaggcataaaccccaatt

SEQ ID NO: 209594 - DNA, 75 bp, Artificial Sequence
  Synthetic
ctagggaaaggatatatgttcgaaagtaagagcatgaagcttcgaacacaaataccggcagaaatgctagcaagt

SEQ ID NO: 209595 - DNA, 75 bp, Artificial Sequence
  Synthetic
catgagaaaggcataaaccccaattatctcctgacttggaagcaggtgctagcagaacttcaggacattgaaaat

SEQ ID NO: 209596 - DNA, 75 bp, Artificial Sequence
  Synthetic
atctcctgacttggaagcaggtgctagcagaacttcaggacattgaaaatgaagagaagattccaaggacaaaga

SEQ ID NO: 209597 - DNA, 75 bp, Artificial Sequence
  Synthetic
attgatctgaagtatttcaatgagtcaacaagaaagaaaatagagaagataaggcctcttctaatagatggtaca

SEQ ID NO: 209598 - DNA, 75 bp, Artificial Sequence
  Synthetic
agatcactagcatgttggatccagaatgaattcaacaaggcgtgtgaactgactgactcaagctgggtagaactt

SEQ ID NO: 209599 - DNA, 75 bp, Artificial Sequence
  Synthetic
taatgaagggagtgtacataaatacagctttgctcaatgcatcttgtgcagccatggatgactttcaactgattc

SEQ ID NO: 209600 - DNA, 75 bp, Artificial Sequence
  Synthetic
tctgcttgaaatgggagctgatggacgaagactatcagggaaggctttgcaaccccctgaatccgtttgtcagcc

SEQ ID NO: 209601 - DNA, 75 bp, Artificial Sequence
  Synthetic
aatacaagccaaaggggaatccttgaagatgaacagatgtatcaaaagtgctgcaatctattcgagaaattcttc

SEQ ID NO: 209602 - DNA, 75 bp, Artificial Sequence
  Synthetic
acacaaaggacaataggaaagaaaaagcagaaactgaacaagaggaattatctaataagagcattgacattaaac

SEQ ID NO: 209603 - DNA, 75 bp, Artificial Sequence
  Synthetic
aaatggagaaaatagtgcttcttcttgcagtagtcagtattgttaaaagtgatcagatttgcattggttaccatg

SEQ ID NO: 209604 - DNA, 75 bp, Artificial Sequence
  Synthetic
gcaatcggggctcccagttggggggaatgagaagaaagccaaattggcaaacgttgtgagaaaaatgatgaccaa

SEQ ID NO: 209605 - DNA, 75 bp, Artificial Sequence
  Synthetic
cctgagaggaagaagcagcactcttggtctggacatcagaactgccacgcgtgaaggaaagcatatagtggagcg

SEQ ID NO: 209606 - DNA, 75 bp, Artificial Sequence
  Synthetic
aatctaatggaaatctaattgccccttggtatgcatacagatttgtcagcacaaataataaaggagccgtcttca

SEQ ID NO: 209607 - DNA, 75 bp, Artificial Sequence
  Synthetic
tgccagctccacgctatctaactgacatgactcttgaagaaatgtcaagagattggttaatgctcattcccaaac

SEQ ID NO: 209608 - DNA, 75 bp, Artificial Sequence
  Synthetic
caacaagagaaaagattgagaagataaggccactcctcatagatggcacggcatcactaagccctggaatgatga

SEQ ID NO: 209609 - DNA, 75 bp, Artificial Sequence
  Synthetic
aaaaacatcacattgaaagcaaatttcagtgtgattttcaatcggcttgaagccctgatactacttagagctttt

SEQ ID NO: 209610 - DNA, 75 bp, Artificial Sequence
  Synthetic
ccacatactggtgggatggactccaatcttctgatgacttcgccctcatagtgaatgcatctaattatgaaggaa

SEQ ID NO: 209611 - DNA, 75 bp, Artificial Sequence
  Synthetic
gcaggatttattgaaggaggatggactgggatgatagatgggtggtatggctatcatcatgaaaattctcaaggc

SEQ ID NO: 209612 - DNA, 75 bp, Artificial Sequence
  Synthetic
ttgattattgctgccaggaacatagtaagaagagcaacagtatcagcagacccactagcatctctattggagatg

SEQ ID NO: 209613 - DNA, 75 bp, Artificial Sequence
  Synthetic
acattgggcttcatttcaaggtaggagacacaccagaaacaggaccccctagtaccaatgagacaaactccacaa

SEQ ID NO: 209614 - DNA, 75 bp, Artificial Sequence
  Synthetic
taatgaatcggctgacatgagcattggagttacagtgataaagaacaacatgataaacaatgatctcgggccagc

SEQ ID NO: 209615 - DNA, 75 bp, Artificial Sequence
  Synthetic
atgtttggacatacaatgctgaattgctggttcttcttgaaaacgaaagaacactagacctgcatgatgcgaatg

SEQ ID NO: 209616 - DNA, 75 bp, Artificial Sequence
  Synthetic
ggagttacagtgataaagaacaacatgataaacaatgatctcgggccagcaaccgcccaaatggctcttcagcta

SEQ ID NO: 209617 - DNA, 75 bp, Artificial Sequence
  Synthetic
attgtgttaattaaagaagaaaacaaaatgttcacaaacctttctaagcccttgtgtgaagtgaactcatggcac

SEQ ID NO: 209618 - DNA, 75 bp, Artificial Sequence
  Synthetic
atagattaaaaattacggagaatagctttgagcaaataacttttatgcaagccttacaactattgcttgaagtgg

SEQ ID NO: 209619 - DNA, 75 bp, Artificial Sequence
  Synthetic
atcgcaattgagggacaatgctaatgatctaggaaatggatgctttgaattctggcataaatgtgacaatgagtg

SEQ ID NO: 209620 - DNA, 75 bp, Artificial Sequence
  Synthetic
attctatctaaggacaatgcgatcagaataggggaggatgcccacatccttgtcacaagagaaccatatctctca

SEQ ID NO: 209621 - DNA, 75 bp, Artificial Sequence
  Synthetic
aagaagtgcttacgggcaaccttcaaacattgaaaataagagtacatgaggggtatgaagagttcacaatggttg

SEQ ID NO: 209622 - DNA, 75 bp, Artificial Sequence
  Synthetic
aaggggtcggcatgcaaatgggactatacatgatagaagcccatttagggcattaataagttgggaaatggggca

SEQ ID NO: 209623 - DNA, 75 bp, Artificial Sequence
  Synthetic
ctaatagtaagtggaagagacgagcagtcaattgctgaagcaataattgtggccatggtattctcacaagaggac

SEQ ID NO: 209624 - DNA, 75 bp, Artificial Sequence
  Synthetic
cttggtagggctgatcatagcaatgggtctttggatgtgttcaaatggttcaatgcaatgcaggatatgtatata

SEQ ID NO: 209625 - DNA, 75 bp, Artificial Sequence
  Synthetic
ctcttgagacacttccaaaaggatgcaaaagtgcttttccaaaattggggaattgaacccattgacaatgtgatg

SEQ ID NO: 209626 - DNA, 75 bp, Artificial Sequence
  Synthetic
tccaaaaaggaatcgttccattctcaataccagccaaaggggaattcttgaggatgaacaaatgtaccagaagtg

SEQ ID NO: 209627 - DNA, 75 bp, Artificial Sequence
  Synthetic
ttaaggactcaggaatcggaatgtgtatgccataatggaatatgccctgtggtgatgacggatggcccagccaat

SEQ ID NO: 209628 - DNA, 75 bp, Artificial Sequence
  Synthetic
tatgccataatggaatatgccctgtggtgatgacggatggcccagccaataacagagcagagacaaaaataattt

SEQ ID NO: 209629 - DNA, 75 bp, Artificial Sequence
  Synthetic
gatagaggaactgacaggaagtgcacagcatatagaagaatgctcgtgctatggagcagaagaggtgattaaatg

SEQ ID NO: 209630 - DNA, 75 bp, Artificial Sequence
  Synthetic
gcaaatagaccagtaatcaccataaacccaaaaacgatgactcatacgagcaaatacttgtgttcaaagatccta

SEQ ID NO: 209631 - DNA, 75 bp, Artificial Sequence
  Synthetic
caaatacttgtgttcaaagatcctaactgacacaagtcggcctaatgatcccggaagcgggaactgtgatgcacc

SEQ ID NO: 209632 - DNA, 75 bp, Artificial Sequence
  Synthetic
gataacaggagggagcccagatcctggcgtaaagggatttgcattcttagatggagggaattcctggttgggaag

SEQ ID NO: 209633 - DNA, 75 bp, Artificial Sequence
  Synthetic
atggagggaattcctggttgggaaggaccataagcaaagattcaagatcagggtatgagatgttaaaagttccga

SEQ ID NO: 209634 - DNA, 75 bp, Artificial Sequence
  Synthetic
tgacagctaatgaatcaggaaggctaatagattttctcaaggatgtgatggaatcaatggataaagaggaaatgg

SEQ ID NO: 209635 - DNA, 75 bp, Artificial Sequence
  Synthetic
ccagcaaatgcgagatgtgcttggaacatttgacactgttcagataataaaactcctcccctttgctgctgcccc

SEQ ID NO: 209636 - DNA, 75 bp, Artificial Sequence
  Synthetic
tccactatcctaaagtatacaaaacatattttgaaaaagttgaaaggttgaagcatgggacctttggtccagtcc

SEQ ID NO: 209637 - DNA, 75 bp, Artificial Sequence
  Synthetic
tccagttgcacatcagataatagtgaacaatcaaaactggtcaggatactcaggagcgttcatcgattattgggc

SEQ ID NO: 209638 - DNA, 75 bp, Artificial Sequence
  Synthetic
caggagcgttcatcgattattgggctgatagagaatgtttcaatccttgcttttatgtggaattgatcagaggca

SEQ ID NO: 209639 - DNA, 75 bp, Artificial Sequence
  Synthetic
catgcagacctcagtgccaaggaagcacaagatgttatcatggaagttgttttcccaaatgaagtgggagccaga

SEQ ID NO: 209640 - DNA, 75 bp, Artificial Sequence
  Synthetic
tgtggatccaaggagcgattgggatcttggtcatggcatgatggggctgaaatcatctactttaagtagaaaaga

SEQ ID NO: 209641 - DNA, 75 bp, Artificial Sequence
  Synthetic
gataatcactcactgagtgacatcaacatcatggcgtctcaaggcaccaaacgatcttatgaacagatggaaact

SEQ ID NO: 209642 - DNA, 75 bp, Artificial Sequence
  Synthetic
tgcgacaatgcttcaatccaatgatcgtcgagcttgcggaaaaggcaatgaaagaatatggggaagatccgaaaa

SEQ ID NO: 209643 - DNA, 75 bp, Artificial Sequence
  Synthetic
aaggacggacatccgacatgcgaacagaagttataagaatgatggaaagtgcaaagccagaagatttgtccttcc

SEQ ID NO: 209644 - DNA, 75 bp, Artificial Sequence
  Synthetic
tcccagtgcggggaaggacccaaagaaaactggaggtccaatctacagaagaagagacggaaagtggatgaggga

SEQ ID NO: 209645 - DNA, 75 bp, Artificial Sequence
  Synthetic
tcgagaagcctaagttccttccggatctgtatgattacaaggagaaccgattcattgaaattggagtgacacgga

SEQ ID NO: 209646 - DNA, 75 bp, Artificial Sequence
  Synthetic
ttcattgaaattggagtgacacggagagaggtccatatatattacctagagaaagccaacaagataaaatccgag

SEQ ID NO: 209647 - DNA, 75 bp, Artificial Sequence
  Synthetic
gagaatcagctcctcctttagctttggaggcttcaccttcaaaagaacaagtggatcatctgttaaaaaggaaga

SEQ ID NO: 209648 - DNA, 75 bp, Artificial Sequence
  Synthetic
atggactccaatactgtgtcaagctttcaggtagactgtttcctttggcacatccgcaaacggtttgcagacaat

SEQ ID NO: 209649 - DNA, 75 bp, Artificial Sequence
  Synthetic
ctggaatgatgatgggcatgttcaacatgctaagtacagttttgggagtttcgattctaaatctaggacaaaaga

SEQ ID NO: 209650 - DNA, 75 bp, Artificial Sequence
  Synthetic
tccaacctgaatgatgccacatatcagaggacaagggctctcgtgcgcactggaatggatcccagaatgtgctct

SEQ ID NO: 209651 - DNA, 75 bp, Artificial Sequence
  Synthetic
gccaaaatactactgaaatcagagcatctgttgggagaatggttgaaggaattggacgattctacatacagatgt

SEQ ID NO: 209652 - DNA, 75 bp, Artificial Sequence
  Synthetic
ggtatgaggaatttacaatggttggaaaaagagcaacggccatcttaaggaaagcaaccagaaggttgattcagc

SEQ ID NO: 209653 - DNA, 75 bp, Artificial Sequence
  Synthetic
ataacgatagagagaatggtcctctctgcatttgacgagaggagaaacaaatacttggaagaacatcccagtgca

SEQ ID NO: 209654 - DNA, 75 bp, Artificial Sequence
  Synthetic
aaaaagagcaacggccatcttaaggaaagcaaccagaaggttgattcagctgatagtaagtggaagagacgaaca

SEQ ID NO: 209655 - DNA, 75 bp, Artificial Sequence
  Synthetic
ctggtcggaatcaacatgagcaaaaagaagtcctacataaacaggacaggaacatttgaattcacaagttttttc

SEQ ID NO: 209656 - DNA, 75 bp, Artificial Sequence
  Synthetic
aaaatggatgagagagctgattctgtatgacaaagatgagatcaggagaatttggcgccaagcaaacaatggtga

SEQ ID NO: 209657 - DNA, 75 bp, Artificial Sequence
  Synthetic
gtatgataaaggctgtccgaggtgatttaaattttgtaaacagagcaaatcaaagactaaatcccatgcatcaac

SEQ ID NO: 209658 - DNA, 75 bp, Artificial Sequence
  Synthetic
tcttgagacacttccagaaggatgcaaaagtgctgtttcaaaattggggaattgagcctattgataatatcatgg

SEQ ID NO: 209659 - DNA, 75 bp, Artificial Sequence
  Synthetic
ttgatgatttggcattccaacctgaatgatgccacatatcagagaacaagagccttagtgcgtactgggatggat

SEQ ID NO: 209660 - DNA, 75 bp, Artificial Sequence
  Synthetic
gccatttctgaagacaacaccacgccctctcaaattgcctgatgggcccccttgctctcagcggtcaaaattctt

SEQ ID NO: 209661 - DNA, 75 bp, Artificial Sequence
  Synthetic
gttcgactctcccaaggagatctggagctgctggtgcggcagtaaagggagttgggacactagtaatggagctga

SEQ ID NO: 209662 - DNA, 75 bp, Artificial Sequence
  Synthetic
gctcttcagctgttcatcaaggattacagatacacatatcggtgccacagaggagacacacaaattcagacaagg

SEQ ID NO: 209663 - DNA, 75 bp, Artificial Sequence
  Synthetic
tggaaagagcccaatataatcaaaccacatgaaaagggcataaatcctaactatctcctggcttggaagcaagtg

SEQ ID NO: 209664 - DNA, 75 bp, Artificial Sequence
  Synthetic
tgatcggaacttctggagaggcgagaatggacgaaggacaagaattgcatatgagagaatgtgtaacatcctcaa

SEQ ID NO: 209665 - DNA, 75 bp, Artificial Sequence
  Synthetic
attagaccaaatgaaaacccagcacataaaagccagttggtatggatggcatgccattcagcagcgtttgaggac

SEQ ID NO: 209666 - DNA, 75 bp, Artificial Sequence
  Synthetic
acatttatacaagccttacaactactgcttgaagtagaacaagagataagaactttctcgtttcagcttatttaa

SEQ ID NO: 209667 - DNA, 75 bp, Artificial Sequence
  Synthetic
atgagtcttctaaccgaggtcgaaacgtacgttctttctatcatcccgtcaggccccctcaaagccgagatcgcg

SEQ ID NO: 209668 - DNA, 75 bp, Artificial Sequence
  Synthetic
aaagcagaaatccaggaaatgctgagattgaagatctcatctttttggcacgatctgcactcattctgagaggat

SEQ ID NO: 209669 - DNA, 75 bp, Artificial Sequence
  Synthetic
actatccaccagaggagttcaaattgcatcaaatgaaaacatggaaacaatggactccagcactcttgaattgag

SEQ ID NO: 209670 - DNA, 75 bp, Artificial Sequence
  Synthetic
tacctaaagcatccagaggtcaatacagcggatttgtgagaacattattccagcaaatgcgtgatgtgctgggga

SEQ ID NO: 209671 - DNA, 75 bp, Artificial Sequence
  Synthetic
agagagcttctgcaggacaaatcagcgtacaacccaccttctcagtacagagaaatcttccctttgaaagagcga

SEQ ID NO: 209672 - DNA, 75 bp, Artificial Sequence
  Synthetic
ttgaccgactcaagctggatagaactggatgaaatcggggaagatgttgctccgattgaacacattgcaagtatg

SEQ ID NO: 209673 - DNA, 75 bp, Artificial Sequence
  Synthetic
atgaaaatccagtccataagagtcagttggtatggatggcatgccattctgcagcatttgaagatctgagggtgt

SEQ ID NO: 209674 - DNA, 75 bp, Artificial Sequence
  Synthetic
agaggagttcaaattgcttcaaatgaaaacatggaaacaatggactccataactcttgaacttagaagcaaatac

SEQ ID NO: 209675 - DNA, 75 bp, Artificial Sequence
  Synthetic
acagaagacccagatgagggaacatctggagtggaatctgcagtactaagagggtttctaattctagggaaggaa

SEQ ID NO: 209676 - DNA, 75 bp, Artificial Sequence
  Synthetic
ttcaatctgtcaaaatggagaaaatagtgcttcttcttgcagtggttagccttgttaaaagtgatcagatttgca

SEQ ID NO: 209677 - DNA, 75 bp, Artificial Sequence
  Synthetic
accacacaaatgggaaaagtactgcgttcttgaagtgggagatatgctactgaggactgcaataggccaagtatc

SEQ ID NO: 209678 - DNA, 75 bp, Artificial Sequence
  Synthetic
aaacaaatgatgccggctcagaccgagtgatggtatcacctctggctgtgacatggtggaataggaatggaccaa

SEQ ID NO: 209679 - DNA, 75 bp, Artificial Sequence
  Synthetic
gtgaagcccctgattctaaaggattgtagcgtagctgggtggctccttggaaatccaatgtgcgacgagttcatc

SEQ ID NO: 209680 - DNA, 75 bp, Artificial Sequence
  Synthetic
cctctgttacccagggaccctcaatgactatgaggaactgaaacacctattgagcagaataaatcattttgagaa

SEQ ID NO: 209681 - DNA, 75 bp, Artificial Sequence
  Synthetic
agttaaaataagacggagggttgatataaaccctggtcacgcagacctcagtgccaaagaggcacaggatgtgat

SEQ ID NO: 209682 - DNA, 75 bp, Artificial Sequence
  Synthetic
tccaaatgcactcctaaaacacagatttgaaataattgagggaagggatcgcacaatggcttggacagtggtaaa

SEQ ID NO: 209683 - DNA, 75 bp, Artificial Sequence
  Synthetic
aactctgatcatccccaagagttcttggcccaatcatgaaacatcattaggggtgagcgcagcatgtccatacca

SEQ ID NO: 209684 - DNA, 75 bp, Artificial Sequence
  Synthetic
ccagaggggtagaggaaggatccattgggaaggtatgcagaaccctgctggcaaaatctgtgttcaacagtctat

SEQ ID NO: 209685 - DNA, 75 bp, Artificial Sequence
  Synthetic
tttcaggtagactgctttctttggcatgtccgcaaactgtttgcggactgggggcttggcgatgccccatttctc

SEQ ID NO: 209686 - DNA, 75 bp, Artificial Sequence
  Synthetic
gagaaacccaagttccttccggatctatatgactataaagagaaccgattcgttgaaatcggtgtaacaagaagg

SEQ ID NO: 209687 - DNA, 75 bp, Artificial Sequence
  Synthetic
atgcatacccgacaataaagataagctacaataataccaatcgggaagatcttttgatactgtgggggattcatc

SEQ ID NO: 209688 - DNA, 75 bp, Artificial Sequence
  Synthetic
tggcctggaaatcgaaccagctactcgtgcgggaaaacaaatagtgaagcgtattctggaagaagaatacgagga

SEQ ID NO: 209689 - DNA, 75 bp, Artificial Sequence
  Synthetic
ggtggaacaagcagtgtttacattgaggtgctacatctgacccagggaacatgctgggagcaaatgtacacacca

SEQ ID NO: 209690 - DNA, 75 bp, Artificial Sequence
  Synthetic
tgcgaaatgaatccaaatcagaagataataacaatcggggtagtgaataccactctgtcaacgatagcccttctc

SEQ ID NO: 209691 - DNA, 75 bp, Artificial Sequence
  Synthetic
tatgtttccgttgggacatcaacattaaaccagagattggtgccaaaaatagctactagatcccaagtaaacggg

SEQ ID NO: 209692 - DNA, 75 bp, Artificial Sequence
  Synthetic
ttcactatcaggcaggaaatggccattagggccctatgggactcctttcgtcaatccgaaaagggcgaagagaca

SEQ ID NO: 209693 - DNA, 75 bp, Artificial Sequence
  Synthetic
tgacctgaaatacttcaacaaatcaacaagagagaaaatcgagaaaataagacctctactgatagatggcacagc

SEQ ID NO: 209694 - DNA, 75 bp, Artificial Sequence
  Synthetic
tcaaaatggaccaggcaataatggataaaaacatcacattgaaggcaaatttcagtgtggtttttaaccgactgg

SEQ ID NO: 209695 - DNA, 75 bp, Artificial Sequence
  Synthetic
gaaatctcaccattaccttctcttccaggacatactaacgaggatgtcaaaaatgcaattgggatcctcatcaaa

SEQ ID NO: 209696 - DNA, 75 bp, Artificial Sequence
  Synthetic
tcttaggagtttcaattctgaatctcgggcagaagaagtacaccaaaaccacatattggtgggacggactccaat

SEQ ID NO: 209697 - DNA, 75 bp, Artificial Sequence
  Synthetic
aaatgcaattgggatcctcatcaaaggacttgagtggaatgataacacagttcgagtctctgaggctctacagag

SEQ ID NO: 209698 - DNA, 75 bp, Artificial Sequence
  Synthetic
aaaagcctttcaaatctccactaccgctgtgccccttcagagggttcttccccttccacaaggacaatgcaatac

SEQ ID NO: 209699 - DNA, 75 bp, Artificial Sequence
  Synthetic
ctcaccatcggggaatgccccaaatacgtgaagtcaaacaaattagtccttgcgactgggctcagaaatagtcct

SEQ ID NO: 209700 - DNA, 75 bp, Artificial Sequence
  Synthetic
gctgtgccccttcagagggttcttccccttccacaaggacaatgcaatacggctgggtgagaacaaagatgtcat

SEQ ID NO: 209701 - DNA, 75 bp, Artificial Sequence
  Synthetic
ggcaaccttcaaacattaaaaatacgagtacatgaggggtatgaagagttcacaatggttgggaggagagcaaca

SEQ ID NO: 209702 - DNA, 75 bp, Artificial Sequence
  Synthetic
ttgccctcgcacaaggagcattgctaggaactaaacatagcaatgggaccattaaagacagaacaccatataggt

SEQ ID NO: 209703 - DNA, 75 bp, Artificial Sequence
  Synthetic
gactatttggagctatagcagggtttatagagggaggatggcagggaatggtagatggttggtatgggtaccacc

SEQ ID NO: 209704 - DNA, 75 bp, Artificial Sequence
  Synthetic
aggaactaaacatagcaatgggaccattaaagacagaacaccatataggtctctaattcgtttcccaataggaac

SEQ ID NO: 209705 - DNA, 75 bp, Artificial Sequence
  Synthetic
tatagagggaggatggcagggaatggtagatggttggtatgggtaccaccatagcaatgagcaggggagtgggta

SEQ ID NO: 209706 - DNA, 75 bp, Artificial Sequence
  Synthetic
gcagctgctttgatgggaaagagtggatgcatgtgtgcatgacagggaatgataatgatgcaagtgcccagataa

SEQ ID NO: 209707 - DNA, 75 bp, Artificial Sequence
  Synthetic
gatgcatgtgtgcatgacagggaatgataatgatgcaagtgcccagataatatatgcagggagaatgacagactc

SEQ ID NO: 209708 - DNA, 75 bp, Artificial Sequence
  Synthetic
aatgcattgacgggacttgtgttgttgctgtcacagatggtcctgctgctaatagtgcagatcacagggtttact

SEQ ID NO: 209709 - DNA, 75 bp, Artificial Sequence
  Synthetic
cttggacaaaagaaatacaccaggacaacatactggtgggatgggctccaatcctccgacgattttgccctcata

SEQ ID NO: 209710 - DNA, 75 bp, Artificial Sequence
  Synthetic
atacaacacttggaagaatgttcctgctatgtggacattgatgtctactgtatatgtagggacaattggaagggt

SEQ ID NO: 209711 - DNA, 75 bp, Artificial Sequence
  Synthetic
gctatgtggacattgatgtctactgtatatgtagggacaattggaagggttctaatagaccctggatgagaatca

SEQ ID NO: 209712 - DNA, 75 bp, Artificial Sequence
  Synthetic
catggatagggcagtcaaattatacaagaagctaaaaagagaaataacattccatggggccaaagaagtgtcact

SEQ ID NO: 209713 - DNA, 75 bp, Artificial Sequence
  Synthetic
ttaaaaagagaagaaataagcggagtgaaattagaatcaataggaacttaccaaatactgtcaatttattcaaca

SEQ ID NO: 209714 - DNA, 75 bp, Artificial Sequence
  Synthetic
accgaggtcgaaacgtacgttctctctatcgttccatcaggccccctcaaagccgagatcgcgcagagacttgaa

SEQ ID NO: 209715 - DNA, 75 bp, Artificial Sequence
  Synthetic
tcatagtggctggtctatctttatggatgtgctctaatgggtcgctacaatgcagaatttgcatctaaatttgtg

SEQ ID NO: 209716 - DNA, 75 bp, Artificial Sequence
  Synthetic
tacaacaagatggaattcgagccatttcagtctctggtccctaaagcagccagaggtcagtacagtggattcgtg

SEQ ID NO: 209717 - DNA, 75 bp, Artificial Sequence
  Synthetic
ttcatcaaagactacagatacacctatagatgccatagaggggacacacaaattcagacgagaagatcattcgag

SEQ ID NO: 209718 - DNA, 75 bp, Artificial Sequence
  Synthetic
tgtgagcaaatcgctgactcacagcatcggtcacacagacaaatggctactaccaccaacccactaatcagacat

SEQ ID NO: 209719 - DNA, 75 bp, Artificial Sequence
  Synthetic
aacaacgactggtcgggctactcaggcagtttcattgtcaaaaacaaggactgttttcagccctgtttttatgtt

SEQ ID NO: 209720 - DNA, 75 bp, Artificial Sequence
  Synthetic
aagaagactggaggcccaatctacaggaggagagatggaaaatggatgagagagttgatcctatatgacaaagaa

SEQ ID NO: 209721 - DNA, 75 bp, Artificial Sequence
  Synthetic
caatggaacctcaaaaattaaaatgaaatggggcatggaaatgaggcgttgtctccttcaatctctccaacagat

SEQ ID NO: 209722 - DNA, 75 bp, Artificial Sequence
  Synthetic
ttgaaaacttgcaggcctaccagaaacggatgggagtgcaaatacagcggttcaagtgatgtcatcgccaatgca

SEQ ID NO: 209723 - DNA, 75 bp, Artificial Sequence
  Synthetic
caatagtatagttactttctgtgggctagacaatgaacctggatcgggaaattggccggatggttccaacattgg

SEQ ID NO: 209724 - DNA, 75 bp, Artificial Sequence
  Synthetic
aagaattttttgaaaacaaatctgaagtatggcccattggggaatcacccaaaggggtggaagaaggctccatcg

SEQ ID NO: 209725 - DNA, 75 bp, Artificial Sequence
  Synthetic
accagagaacaagggcacttgtgcgtactgggatggatcccaggatgtgctctctgatgcaaggctcaactcttc

SEQ ID NO: 209726 - DNA, 75 bp, Artificial Sequence
  Synthetic
ggatacaaaatgaacactcaaattttggcactcattgcttgtatgctgattggagctaaaggagataaaatatgt

SEQ ID NO: 209727 - DNA, 75 bp, Artificial Sequence
  Synthetic
cttaaatacggtttgaaaagagggccttctacggaaggagtgcctgagtccatgagggaagaatatcaacaggaa

SEQ ID NO: 209728 - DNA, 75 bp, Artificial Sequence
  Synthetic
cttgggcaccatgctgtggcaaatggaacaaaagtgaacacattaacagagagaggaatcgaagtagtaaatgcc

SEQ ID NO: 209729 - DNA, 75 bp, Artificial Sequence
  Synthetic
aaaatctgtattcaatagcctgtatgcatcttcacaactcgagggattttcagctgaatcaagaaagttacttct

SEQ ID NO: 209730 - DNA, 75 bp, Artificial Sequence
  Synthetic
gaacaaaagtgaacacattaacagagagaggaatcgaagtagtaaatgccacagaaacggtggagactgcaaata

SEQ ID NO: 209731 - DNA, 75 bp, Artificial Sequence
  Synthetic
tgccagcacaaaatgctataagcactacattcccttatactggagatcccccatatagtcatggaactgggacag

SEQ ID NO: 209732 - DNA, 75 bp, Artificial Sequence
  Synthetic
caggcaaaccatttgaatggatgtcaacccgactctacttttcttaaaagtgccagcacaaaatgctataagcac

SEQ ID NO: 209733 - DNA, 75 bp, Artificial Sequence
  Synthetic
aacccgactctacttttcttaaaagtgccagcacaaaatgctataagcactacattcccttatactggagatccc

SEQ ID NO: 209734 - DNA, 75 bp, Artificial Sequence
  Synthetic
ggacttctaggaaccctaataggacctccccaatgcgatcaattcctggagtttgacgctgatttaataattgaa

SEQ ID NO: 209735 - DNA, 75 bp, Artificial Sequence
  Synthetic
ctccccaatgcgatcaattcctggagtttgacgctgatttaataattgaacgaagagaaggaaccgatgtgtgtt

SEQ ID NO: 209736 - DNA, 75 bp, Artificial Sequence
  Synthetic
agatggacaacaaacacagaaactggagcacctcagcttaacccaattgatggaccactacctgaggacaatgag

SEQ ID NO: 209737 - DNA, 75 bp, Artificial Sequence
  Synthetic
atgaatccaaatcagaagataataatcattagttcgatctgtatgacaaatggaattgctagcttgatattacaa

SEQ ID NO: 209738 - DNA, 75 bp, Artificial Sequence
  Synthetic
tggaccactacctgaggacaatgagccaagcgggtatgctcaaacagattgtgtcctggaggcaatggcttttct

SEQ ID NO: 209739 - DNA, 75 bp, Artificial Sequence
  Synthetic
tggaattgctagcttgatattacaaattgggaacataatctcaatatggattagccattcaattcaaattgggaa

SEQ ID NO: 209740 - DNA, 75 bp, Artificial Sequence
  Synthetic
tcaggaggaattgataaagagtcaatgggtttcacctatagtggaataagaaccaatggggtgacaagtgcttgc

SEQ ID NO: 209741 - DNA, 75 bp, Artificial Sequence
  Synthetic
tgggtttcacctatagtggaataagaaccaatggggtgacaagtgcttgcagaagatcaggttcttccttctatg

SEQ ID NO: 209742 - DNA, 75 bp, Artificial Sequence
  Synthetic
gactttgagagagagggatattccctagtcggaattgatcctttccgtctgctccaaaacagtcaagtcttcagt

SEQ ID NO: 209743 - DNA, 75 bp, Artificial Sequence
  Synthetic
attgggaacataatctcaatatggattagccattcaattcaaattgggaaccaaaaccagaccgaaacatgcaat

SEQ ID NO: 209744 - DNA, 75 bp, Artificial Sequence
  Synthetic
taacatcagcaacaacaattttgttgctgaacagacagtagtttcaatgaaattagtaggtagttcttctctatg

SEQ ID NO: 209745 - DNA, 75 bp, Artificial Sequence
  Synthetic
cacaggatgtgatcatggaagttgttttcccaaatgaagtgggggcaagaatactgacatcagagtcacagctga

SEQ ID NO: 209746 - DNA, 75 bp, Artificial Sequence
  Synthetic
gctgaacagacagtagtttcaatgaaattagtaggtagttcttctctatgccctgttagtgggtgggctatatac

SEQ ID NO: 209747 - DNA, 75 bp, Artificial Sequence
  Synthetic
cacaatagaagtcttcaggacgaacagtctaacagccaatgaatcgggaagattaatagatttccttaaggatgt

SEQ ID NO: 209748 - DNA, 75 bp, Artificial Sequence
  Synthetic
actttactcttcttgaaagtgccagcgcaaaatgctataagtaccacattcccttatactggagatcctccatac

SEQ ID NO: 209749 - DNA, 75 bp, Artificial Sequence
  Synthetic
gattaatagatttccttaaggatgtgatggaatcaatggataaagaagatatggaaataacaacacatttccaaa

SEQ ID NO: 209750 - DNA, 75 bp, Artificial Sequence
  Synthetic
aagagagcctttcatctcatgctctcacttggaatgtagaaccttcttcttaactcaaggggccctgctgaatga

SEQ ID NO: 209751 - DNA, 75 bp, Artificial Sequence
  Synthetic
tgataaacaatgatcttggaccagcaacagctcaaatggctcttcagctgttcatcaaggattacagatacacat

SEQ ID NO: 209752 - DNA, 75 bp, Artificial Sequence
  Synthetic
taactcaaggggccctgctgaatgataaacattctaatggaaccgttaaagacagaagcccctatcgaaccctga

SEQ ID NO: 209753 - DNA, 75 bp, Artificial Sequence
  Synthetic
tgattttcactggctactccttgatcccaatgacacagtgaccttcactttcaatggggcattcatagctcctga

SEQ ID NO: 209754 - DNA, 75 bp, Artificial Sequence
  Synthetic
tgctcccagcgatcaaaattcttactgatggatgcattgaaactaagcattgaagaccctagtcatgagggagag

SEQ ID NO: 209755 - DNA, 75 bp, Artificial Sequence
  Synthetic
attacctgaggataacgagccaagcggatatgcacaaacggattgtgtgttggaagcaatggctttccttgaaga

SEQ ID NO: 209756 - DNA, 75 bp, Artificial Sequence
  Synthetic
tcaataggaattcagagtgatgttcctttggattctggttgtgagggggattgcttccacaatgggggtacgata

SEQ ID NO: 209757 - DNA, 75 bp, Artificial Sequence
  Synthetic
tggaagcaatggctttccttgaagagtcccacccagggatctttgaaaactcatgtcttgaaacaatggaaattg

SEQ ID NO: 209758 - DNA, 75 bp, Artificial Sequence
  Synthetic
ggggcagtggctgtgctgaaatacaatgacataataacagacactatcaagagttgggaaaacaatatattgaga

SEQ ID NO: 209759 - DNA, 75 bp, Artificial Sequence
  Synthetic
actcccagttggggggaacgagaagaaagctaaattggcaaatgttgtgaggaaaatgatgaccaactcacaaga

SEQ ID NO: 209760 - DNA, 75 bp, Artificial Sequence
  Synthetic
ccctcgatatgtcaaacagacaagcctacttttggctacagggatgagaaacgtcccagagaaccccaagaccag

SEQ ID NO: 209761 - DNA, 75 bp, Artificial Sequence
  Synthetic
acatgaagaagacaagtcaattaaagtgggcacttggtgaaaatatggcaccagaaaaagtggactttgaggatt

SEQ ID NO: 209762 - DNA, 75 bp, Artificial Sequence
  Synthetic
tggacattgaatagaaaccagccggctgcaactgctttagccaacactatagaagtcttcagatcgaacggtcta

SEQ ID NO: 209763 - DNA, 75 bp, Artificial Sequence
  Synthetic
gactgatggaccaagtaatgggcaggcctcatacaagatcttcaaaatagaaaaggggaaagtagtcaaatcagt

SEQ ID NO: 209764 - DNA, 75 bp, Artificial Sequence
  Synthetic
ctacttttggctacagggatgagaaacgtcccagagaaccccaagaccagaggcctttttggagcgattgctgga

SEQ ID NO: 209765 - DNA, 75 bp, Artificial Sequence
  Synthetic
gcctcatacaagatcttcaaaatagaaaaggggaaagtagtcaaatcagtagagttgaatgctcctaattatcac

SEQ ID NO: 209766 - DNA, 75 bp, Artificial Sequence
  Synthetic
acatcaaaatgcacaaggagaaggaactgcagctgattacaaaagcactcaatctgcaatagatcagatcacagg

SEQ ID NO: 209767 - DNA, 75 bp, Artificial Sequence
  Synthetic
actgcagctgattacaaaagcactcaatctgcaatagatcagatcacaggcaaattgaatcgtctaattgacaaa

SEQ ID NO: 209768 - DNA, 75 bp, Artificial Sequence
  Synthetic
cagggacaactggcatggttcgaatcgaccatgggtgtctttcaatcagaatctggagtatcaaataggatacat

SEQ ID NO: 209769 - DNA, 75 bp, Artificial Sequence
  Synthetic
gacactgaacacaatgacaaaagatgcagaaagaggcaagttgaagaggcgggcaattgcaacacccgggatgca

SEQ ID NO: 209770 - DNA, 75 bp, Artificial Sequence
  Synthetic
acaaattgggaatgtcattaactggacacgagattcaatgactgaggtatggtcgtacaatgctgaattgctggt

SEQ ID NO: 209771 - DNA, 75 bp, Artificial Sequence
  Synthetic
aaaagatcgagaagataaggccactactcatcgatggcactgcctcgctaagtcctggaatgatgatgggcatgt

SEQ ID NO: 209772 - DNA, 75 bp, Artificial Sequence
  Synthetic
gggcaattgcaacacccgggatgcaaatcagagggttcgtgtactttgtcgaaacattagcgaggagcatctgcg

SEQ ID NO: 209773 - DNA, 75 bp, Artificial Sequence
  Synthetic
acacgagattcaatgactgaggtatggtcgtacaatgctgaattgctggtagctatggaaaatcagcacacaata

SEQ ID NO: 209774 - DNA, 75 bp, Artificial Sequence
  Synthetic
tagggagaactaaaagcactagctcaaggagcggttttgagatgatttgggatccaaacggatggactggaacag

SEQ ID NO: 209775 - DNA, 75 bp, Artificial Sequence
  Synthetic
atgcagcggggttctcggagacaatccgcgccctaatgacagaataggcagttgtggtccagtatcgtctcatgg

SEQ ID NO: 209776 - DNA, 75 bp, Artificial Sequence
  Synthetic
actgagggagaatgctgaagaggatgggactggatgctttgagatatttcataagtgtgatgatcagtgcatgga

SEQ ID NO: 209777 - DNA, 75 bp, Artificial Sequence
  Synthetic
aagaggtacactaaaaccaccttctggtgggatggactccaatcttctgatgactttgccctcatagtgaatgca

SEQ ID NO: 209778 - DNA, 75 bp, Artificial Sequence
  Synthetic
aaattggcaaatgtcgtgagaaagatgatgactaactcacaagacacagagctatcctttacaattactggagac

SEQ ID NO: 209779 - DNA, 75 bp, Artificial Sequence
  Synthetic
gctatcctttacaattactggagacaataccaagtggaacgagaatcagaatcctcggatttttttggcaatgat

SEQ ID NO: 209780 - DNA, 75 bp, Artificial Sequence
  Synthetic
aggtcagcgagacacaagggacagaaaagctgacaataacttattcgtcatcaatgatgtgggagatcaacggtc

SEQ ID NO: 209781 - DNA, 75 bp, Artificial Sequence
  Synthetic
gatccaaacggatggactggaacagacaataatttctcagtaaagcaagatatcataggaataactgaatggtca

SEQ ID NO: 209782 - DNA, 75 bp, Artificial Sequence
  Synthetic
agtgaaattgagtagtggatacaaagacataatcttatggtttagcttcggggcatcatgttttcttcttctagc

SEQ ID NO: 209783 - DNA, 75 bp, Artificial Sequence
  Synthetic
ttgcccctataatgttctcaaacaaaatggcaagattagggaaaggatacatgttcgaaagtaagagcatgaagc

SEQ ID NO: 209784 - DNA, 75 bp, Artificial Sequence
  Synthetic
ggtgggatggactccaatcttctgatgactttgccctcatagtgaatgcacctaatcatgaaggaatacaagctg

SEQ ID NO: 209785 - DNA, 75 bp, Artificial Sequence
  Synthetic
cattgcaatgggattggttttcatttgcataaagaatggaaacatgcggtgcactatttgtatatagtttgagaa

SEQ ID NO: 209786 - DNA, 75 bp, Artificial Sequence
  Synthetic
gccttcttcagtctcttcagcagattgaaagcatgattgaggccgagtcttctgtcaaagaaaaggacatgacta

SEQ ID NO: 209787 - DNA, 75 bp, Artificial Sequence
  Synthetic
atggatccaaatactgtgtcaagctttcaggtagactgcttcctttggcatgtccgcaaacgatttgcagactgt

SEQ ID NO: 209788 - DNA, 75 bp, Artificial Sequence
  Synthetic
tgtccgcaaacgatttgcagactgtggaatttgtgatgccccatttcttgataggcttcgccgagatcaaaagtc

SEQ ID NO: 209789 - DNA, 75 bp, Artificial Sequence
  Synthetic
ttgagaaaataaggcctctcctaatagaagggacagcctcgttgagtcctggaatgatgatgggcatgttcaaca

SEQ ID NO: 209790 - DNA, 75 bp, Artificial Sequence
  Synthetic
gactacaggtatacataccgatgccacagaggtgacacgcaaatccaaacgaaaagatcattcgagctaaaaaaa

SEQ ID NO: 209791 - DNA, 75 bp, Artificial Sequence
  Synthetic
cctaaggggaagaggcaacactcttggtctggaaattgaaccagccactcgtgctgggaaacaaatagtgaagcg

SEQ ID NO: 209792 - DNA, 75 bp, Artificial Sequence
  Synthetic
tacaccaaaaccacatactggtgggacggactccaatcctctgatgatttcgctctcatagtaaatgcaccgaat

SEQ ID NO: 209793 - DNA, 75 bp, Artificial Sequence
  Synthetic
acggactccaatcctctgatgatttcgctctcatagtaaatgcaccgaatcatgagggaatacaggcaggagtgg

SEQ ID NO: 209794 - DNA, 75 bp, Artificial Sequence
  Synthetic
caggacgttcttccttactcaaggttccctactcaatgacaaacattctaatggcacagtgaaagaccggagccc

SEQ ID NO: 209795 - DNA, 75 bp, Artificial Sequence
  Synthetic
tcggggaagactgtgtaatcctctgaatccgtttgtcaaccataaaggaattgagtctgtaaacagtgccgtggt

SEQ ID NO: 209796 - DNA, 75 bp, Artificial Sequence
  Synthetic
aaatcctatataaatcggacaggaacatttgaattcacaagctttttctaccgttatgggtttgtagccaacttc

SEQ ID NO: 209797 - DNA, 75 bp, Artificial Sequence
  Synthetic
agtgaaaatgaatccaaatcagaagataataacaattggttccgtctctctaaccattgcaacaatatgtttcct

SEQ ID NO: 209798 - DNA, 75 bp, Artificial Sequence
  Synthetic
ataataacaattggttccgtctctctaaccattgcaacaatatgtttccttatgcagattgccatcctagcaaca

SEQ ID NO: 209799 - DNA, 75 bp, Artificial Sequence
  Synthetic
catttgaattcacaagctttttctaccgttatgggtttgtagccaacttcagcatggagctgcccagctttggag

SEQ ID NO: 209800 - DNA, 75 bp, Artificial Sequence
  Synthetic
acagaagaaggggcaattgtaggtgagatctcaccgttaccttctcttccaggacatactgatgaggatgtcaaa

SEQ ID NO: 209801 - DNA, 75 bp, Artificial Sequence
  Synthetic
gcctcatctcttgtacttgcaatggggtttgctgccttcttattctgggccatgtcaaacggatcatgcaggtgc

SEQ ID NO: 209802 - DNA, 75 bp, Artificial Sequence
  Synthetic
aatgcaattgggatcctcatcaacggacttgaatggaatggtaacaaaattcgagtctctgaagctctacagaga

SEQ ID NO: 209803 - DNA, 75 bp, Artificial Sequence
  Synthetic
gtgatacacaaatacaaacgaggagatcattcgagctaaagaagctgtgggagcagacccgttcaaaggcaggac

SEQ ID NO: 209804 - DNA, 75 bp, Artificial Sequence
  Synthetic
gtagactacaggaattggtcaaaaccgcaatgtcaaattacaggatttgcccctttttccaaggacaactctatt

SEQ ID NO: 209805 - DNA, 75 bp, Artificial Sequence
  Synthetic
tcacgctcaccgtgcccagtgagcgaggactgcagcgtagacggtttgtccaaaatgccctaaatgggaatggag

SEQ ID NO: 209806 - DNA, 75 bp, Artificial Sequence
  Synthetic
cgactttctgctggtggggacatttgggtaacaagagaaccttatgtgtcatgtgataccagtaagtgttaccaa

SEQ ID NO: 209807 - DNA, 75 bp, Artificial Sequence
  Synthetic
aactgatggatgaagattaccagggtagactttgtaatcccctgaacccctttgtcagtcataaggaaattgagt

SEQ ID NO: 209808 - DNA, 75 bp, Artificial Sequence
  Synthetic
cttcgagcagataacattcatgcaagcattacaactactgcttgaagtagagcaagaaataaggacattctcttt

SEQ ID NO: 209809 - DNA, 75 bp, Artificial Sequence
  Synthetic
atggagttaaaggatttgggttcaggcagggcaatgatgtatggatgggaaggaccattagcagaacatcaagat

SEQ ID NO: 209810 - DNA, 75 bp, Artificial Sequence
  Synthetic
tagactttgtaatcccctgaacccctttgtcagtcataaggaaattgagtccgtaaacaatgctgtagtgatgcc

SEQ ID NO: 209811 - DNA, 75 bp, Artificial Sequence
  Synthetic
atatggacctcaagtagctccattgtgatgtgtggagtagaccatgaaattgccgactggtcgtggcacgatgga

SEQ ID NO: 209812 - DNA, 75 bp, Artificial Sequence
  Synthetic
acccttttgatgaatgagttaggtattccatttcacttgggaaccagacaagtgtgcatagcatggtccagctca

SEQ ID NO: 209813 - DNA, 75 bp, Artificial Sequence
  Synthetic
actcatgggtccctaagaggaaccgttccattctgaataccagtcaaagaggaatccttgaggatgaacagatgt

SEQ ID NO: 209814 - DNA, 75 bp, Artificial Sequence
  Synthetic
agcaggggctgaacaaaaggagttatttaataagagctttgacactaaacacaatgacaaaagatgcagaaagag

SEQ ID NO: 209815 - DNA, 75 bp, Artificial Sequence
  Synthetic
attcctgaaagaaacgaacaaggacaaatactttggagtaagacaaatgatgctggatcagatagggtgatggta

SEQ ID NO: 209816 - DNA, 75 bp, Artificial Sequence
  Synthetic
agttgccatgatgggaaagcatggttgcatgtttgtgttaccggggatgatagaaatgcaactgctagttttatt

SEQ ID NO: 209817 - DNA, 75 bp, Artificial Sequence
  Synthetic
atacacatcaggaagacaagagaagaaccccgctctcagaatgaaatggatgatggcaatgaagtatccaattac

SEQ ID NO: 209818 - DNA, 75 bp, Artificial Sequence
  Synthetic
gcacggattgacttcgagtctggaaggattaagttaatagagtttggtgagatcatgcaattctgttcccccata

SEQ ID NO: 209819 - DNA, 75 bp, Artificial Sequence
  Synthetic
agtccactaccctaaggtctacaaaacatattttgaaaaagtggaaagattgaagcatgggacctttggtccagt

SEQ ID NO: 209820 - DNA, 75 bp, Artificial Sequence
  Synthetic
atgagttcaacaaggcatgtgaattgaccgattcaagctggatagaacttgatgagataggagaagatgttgccc

SEQ ID NO: 209821 - DNA, 75 bp, Artificial Sequence
  Synthetic
ttagcccactgtcaggaagtgctcagcatatagaggaatgctcctgttatccccgatacccaaatgtcagatgtg

SEQ ID NO: 209822 - DNA, 75 bp, Artificial Sequence
  Synthetic
cgattgaacacatcgcaagcatgaggaggaactattttacagcagaagtgtcccattgcagggctactgaataca

SEQ ID NO: 209823 - DNA, 75 bp, Artificial Sequence
  Synthetic
ataatcaagaaatacacatcaggaagacaagagaagaaccctgctctcagaatgaaatggatgatggcaatgaaa

SEQ ID NO: 209824 - DNA, 75 bp, Artificial Sequence
  Synthetic
atggcagattatagcattgattccagttatgtgtgctcaggacttgttggagacacaccaaggaacgatgatagc

SEQ ID NO: 209825 - DNA, 75 bp, Artificial Sequence
  Synthetic
gtgccatggggtccaatcccaataggaaggaacctaacggggatagggcatttggatggccctttcttaaggaag

SEQ ID NO: 209826 - DNA, 75 bp, Artificial Sequence
  Synthetic
gttatgtgtgctcaggacttgttggagacacaccaaggaacgatgatagctctagcagcagcaattgcagggatc

SEQ ID NO: 209827 - DNA, 75 bp, Artificial Sequence
  Synthetic
agatggaggaccaaatctatacaatatccggaatctccacattccggaagtctgcttgaaatgggagctaatgga

SEQ ID NO: 209828 - DNA, 75 bp, Artificial Sequence
  Synthetic
agtggatcgtcagtcaaaagagaagaagaagtgcttacgggcaaccttcaaacattgaaaataagagtacatgag

SEQ ID NO: 209829 - DNA, 75 bp, Artificial Sequence
  Synthetic
gtagtgtctacattgaagtattgcacttaactcaaggaacatgctgggaacagatgtacactccaggtggagaag

SEQ ID NO: 209830 - DNA, 75 bp, Artificial Sequence
  Synthetic
tgaagaatgatgatgtagaccagagtttgatcattgctgccagaaacattgttagaagagcaatagtgtcagcag

SEQ ID NO: 209831 - DNA, 75 bp, Artificial Sequence
  Synthetic
gaggggataccgctgtatgatgcgatcaaatgcatgaagacctttttcggctggaaagagcctaacattgtcaag

SEQ ID NO: 209832 - DNA, 75 bp, Artificial Sequence
  Synthetic
aggtctacaaaacatactttgagaaggttgaaaggttaaagcatggaaccttcggtcccgttcacttccgaaacc

SEQ ID NO: 209833 - DNA, 75 bp, Artificial Sequence
  Synthetic
ctggaaagagcctaacattgtcaagccacatgaaaagggcataaaccccaattatctcctggcttggaagcaagt

SEQ ID NO: 209834 - DNA, 75 bp, Artificial Sequence
  Synthetic
ccaacggctgaacccaatgcatcaactcttgagacatttccaaaaggatgcaaaagtgcttttccagaattgggg

SEQ ID NO: 209835 - DNA, 75 bp, Artificial Sequence
  Synthetic
tcatggaggtcgttttcccaaatgaagtgggagctagaatattgacatcagagtcacaattgacaataacgaaag

SEQ ID NO: 209836 - DNA, 75 bp, Artificial Sequence
  Synthetic
caaatagtattgtcgtattttgtggcacttcaggcacctatggaacaggctcatggcctgatggggcgaatatca

SEQ ID NO: 209837 - DNA, 75 bp, Artificial Sequence
  Synthetic
cctagcagttcatacaggaggccagttggaatttccagcatggtggaggccatggtttctagggcccgaattgat

SEQ ID NO: 209838 - DNA, 75 bp, Artificial Sequence
  Synthetic
atggaacaggctcatggcctgatggggcgaatatcaatttcatgcctatataagctttcgcaattttagaaaaaa

SEQ ID NO: 209839 - DNA, 75 bp, Artificial Sequence
  Synthetic
tcacggcttgacttcgagtctggaaggactacgaaagaagagtttgctgagatcatgaagatcagttccaccatt

SEQ ID NO: 209840 - DNA, 75 bp, Artificial Sequence
  Synthetic
gggatatgaggaatttacaatggtcggaagaagagcaacagctatcttaaggaaagcaactagaaggctgattca

SEQ ID NO: 209841 - DNA, 75 bp, Artificial Sequence
  Synthetic
ggaagaagagcaacagctatcttaaggaaagcaactagaaggctgattcagttgatagtgagtggaagagacgaa

SEQ ID NO: 209842 - DNA, 75 bp, Artificial Sequence
  Synthetic
tagtatggtaaaggctgtccgaggtgatctaaattttgtaaacagagcaaaccagaggctgaatcccatgcatca

SEQ ID NO: 209843 - DNA, 75 bp, Artificial Sequence
  Synthetic
aatagaaagaaacataacggagatagtgcatttgaatggcactatcatagagaaggaaaattgtcccagagcatc

SEQ ID NO: 209844 - DNA, 75 bp, Artificial Sequence
  Synthetic
actgaaagcgaatttcagtgtgatctttgatcggctagagacactaatactactcagagctttcactgaagaggg

SEQ ID NO: 209845 - DNA, 75 bp, Artificial Sequence
  Synthetic
actcctaagacacttccagaaggatgcaaaagtgctatttcaaaattggggaattgaacctattgataatatcat

SEQ ID NO: 209846 - DNA, 75 bp, Artificial Sequence
  Synthetic
cgagacccatgttcttgtatgtgaggaccaatggaacttccaaaatcaaaatgaaatggggtatggagatgaggc

SEQ ID NO: 209847 - DNA, 75 bp, Artificial Sequence
  Synthetic
taagaggagtgagaatcagtaaaacgggagtagacgaatattccagtactgagagagtggttgtgagtattgatc

SEQ ID NO: 209848 - DNA, 75 bp, Artificial Sequence
  Synthetic
tgcacttgggcagggaaccactttaaacaacaaacactcaaatggcacaacacatgatagaagtccctatagaac

SEQ ID NO: 209849 - DNA, 75 bp, Artificial Sequence
  Synthetic
gaggtcagtgaaacacaaggaacagagaaattgacaataacctattcatcatcaatgatgtgggagatcaatgga

SEQ ID NO: 209850 - DNA, 75 bp, Artificial Sequence
  Synthetic
caaatcagaagataatatgcatctcagcaacaggaatgacactatccgtagtaagtctgctaataggattggcca

SEQ ID NO: 209851 - DNA, 75 bp, Artificial Sequence
  Synthetic
agtacctaaagcagccagaggtaaatacagcgggtttgtgagaacattattccagcagatgcgcgatgtactggg

SEQ ID NO: 209852 - DNA, 75 bp, Artificial Sequence
  Synthetic
tttcaaggtaggagacacaccggaaacaggaccccctagtaccaatgagacaaactccacaaccacaataatcaa

SEQ ID NO: 209853 - DNA, 75 bp, Artificial Sequence
  Synthetic
caccagagcagagtaggatgcaattctcttctctaactgtaaatgtgagaggatcaggactgagaatactcataa

SEQ ID NO: 209854 - DNA, 75 bp, Artificial Sequence
  Synthetic
gaagtactgtgttcttgaaataggagatatgctcctgaggactgcaataggacaagtgtcaaggcccatgttcct

SEQ ID NO: 209855 - DNA, 75 bp, Artificial Sequence
  Synthetic
agtccactgtcagggagtgctcagcatgtggaggagtgctcttgttaccctcggtacccagaagttagatgtgtt

SEQ ID NO: 209856 - DNA, 75 bp, Artificial Sequence
  Synthetic
ggatcaggactgagaatactcataagaggtaactccccagtatttaactacaataaggcaacaaaaaggctaacg

SEQ ID NO: 209857 - DNA, 75 bp, Artificial Sequence
  Synthetic
ccgcgtcctaatgatgggaagggcaattgtggcccagtaccttctaatggagcaaatggagtgaaaggattctca

SEQ ID NO: 209858 - DNA, 75 bp, Artificial Sequence
  Synthetic
agcaaatggagtgaaaggattctcatatagatatggtaatggtgtttggataggaagaactaagagtatcaactc

SEQ ID NO: 209859 - DNA, 75 bp, Artificial Sequence
  Synthetic
aggagcatgtaaaagagcaaatgtgaatgactttttcaacagactgaactggctaaccaaatctgatgggaatgc

SEQ ID NO: 209860 - DNA, 75 bp, Artificial Sequence
  Synthetic
tgacagaagatccagatgagggaaaggctggaatagaatctgcagtgctgagagggttcctaattatagggaagg

SEQ ID NO: 209861 - DNA, 75 bp, Artificial Sequence
  Synthetic
ggctggaatagaatctgcagtgctgagagggttcctaattatagggaaggaaaacaaaagatatgggccagcatt

SEQ ID NO: 209862 - DNA, 75 bp, Artificial Sequence
  Synthetic
gttagtaaaatgggagtagatgaatattccagcactgagagagtggttgtacgcattgaccgtttcttgcgggtt

SEQ ID NO: 209863 - DNA, 75 bp, Artificial Sequence
  Synthetic
gtcccaaggcaccaaacggtcttacgaacagatggagactgatggagaacgccagaatgccactgaaatcagagc

SEQ ID NO: 209864 - DNA, 75 bp, Artificial Sequence
  Synthetic
gactcccagcacagaattgtcactgagaggagtaagagttagtaaaatgggagtagatgaatattccagcactga

SEQ ID NO: 209865 - DNA, 75 bp, Artificial Sequence
  Synthetic
ctaatcaggcatgaaaacagaatggtgctggctagcactacggcaaaggctatggaacagatggctggatcgagt

SEQ ID NO: 209866 - DNA, 75 bp, Artificial Sequence
  Synthetic
gacgtattggggacatttgatactattcagataataaagctgttaccgtttgcagcagccccaccggagcatagc

SEQ ID NO: 209867 - DNA, 75 bp, Artificial Sequence
  Synthetic
tgacaataataactggtctggttattctggtattttctctgttgaaaacaaaagctgcatcaacaggtgctttta

SEQ ID NO: 209868 - DNA, 75 bp, Artificial Sequence
  Synthetic
gcacagaacttaaactcagtgattatgagggacggttgatccaaaacagcttaacaatagagagaatggtgctct

SEQ ID NO: 209869 - DNA, 75 bp, Artificial Sequence
  Synthetic
aaagaacatggggaagacccaaaaattgagacaaacaaatttgctgcaatatgcacacacatggaagtctgtttc

SEQ ID NO: 209870 - DNA, 75 bp, Artificial Sequence
  Synthetic
tgagggacggttgatccaaaacagcttaacaatagagagaatggtgctctctgcttttgacgaaaggagaaataa

SEQ ID NO: 209871 - DNA, 75 bp, Artificial Sequence
  Synthetic
ttgagacaaacaaatttgctgcaatatgcacacacatggaagtctgtttcatgtattctgatttccactttatcg

SEQ ID NO: 209872 - DNA, 75 bp, Artificial Sequence
  Synthetic
gacctatatacagaagagtaaacggaaagtggatgagagaactcatcctttatgacaaagaagaaataaggcgaa

SEQ ID NO: 209873 - DNA, 75 bp, Artificial Sequence
  Synthetic
cgcaggtgcattaacagaggatccagatgaggggacaacaggagtggaatctgcagtgctgagggggttcctaat

SEQ ID NO: 209874 - DNA, 75 bp, Artificial Sequence
  Synthetic
aaagtggatgagagaactcatcctttatgacaaagaagaaataaggcgaatctggcgccaagctaataatggtga

SEQ ID NO: 209875 - DNA, 75 bp, Artificial Sequence
  Synthetic
tgtgcgacaatgtttcaatccaataattgtcgaacttgcggaaaagacaatgaaagagtatggtgaagacccgaa

SEQ ID NO: 209876 - DNA, 75 bp, Artificial Sequence
  Synthetic
actacaggggttgaaaagcccaagttccttccggatctatatgactataaggagaaccgattcattgaaataggt

SEQ ID NO: 209877 - DNA, 75 bp, Artificial Sequence
  Synthetic
atgatgcaacttatcagaggacaagggctcttgttcgcaccggaatggatcccaggatgtgctctctgatgcaag

SEQ ID NO: 209878 - DNA, 75 bp, Artificial Sequence
  Synthetic
ggctcttgttcgcaccggaatggatcccaggatgtgctctctgatgcaaggttcaactctccctaggaggtctgg

SEQ ID NO: 209879 - DNA, 75 bp, Artificial Sequence
  Synthetic
tcatgtattcggatttccactttgttgatgaaaggggcgaatcagtaattgtggaatctggcgatccgaatgcat

SEQ ID NO: 209880 - DNA, 75 bp, Artificial Sequence
  Synthetic
aaaatcagagaagacacacatccacattttctcgtttactggagaagaaatggccactaaggcagattacacact

SEQ ID NO: 209881 - DNA, 75 bp, Artificial Sequence
  Synthetic
tcaggatgatcaaacgtgggatcaatgatcggaacttctggaggggtgagaatggacgaaaaacaagaattgctt

SEQ ID NO: 209882 - DNA, 75 bp, Artificial Sequence
  Synthetic
tgatcggaacttctggaggggtgagaatggacgaaaaacaagaattgcttatgaaagaatgtgcaacattctcaa

SEQ ID NO: 209883 - DNA, 75 bp, Artificial Sequence
  Synthetic
ggaatgtactcttatctcccgaagaggtcagtgaaacccagggaacggaaaagttgacaataacatattcgtcat

SEQ ID NO: 209884 - DNA, 75 bp, Artificial Sequence
  Synthetic
aggaaatggccatcagggccctatgggactcctttcgtcagtccgaaagaggcgaagagacagttgaagaaaggt

SEQ ID NO: 209885 - DNA, 75 bp, Artificial Sequence
  Synthetic
agagccgggacccagggaatgctgagttcgaagatctcacttttctagcacggtctgcactcatattgagagggt

SEQ ID NO: 209886 - DNA, 75 bp, Artificial Sequence
  Synthetic
gacccaaggtgagagaccaagcagggagaatgaactattactggacactagtagagcctggagacaagataacat

SEQ ID NO: 209887 - DNA, 75 bp, Artificial Sequence
  Synthetic
atgggggacctccactccttccaaaacagaaacggaaaatggcgagaacaattaagtcagaagtttgaggaaata

SEQ ID NO: 209888 - DNA, 75 bp, Artificial Sequence
  Synthetic
tgcctgtgtgtatggacctgccgtagccagtgggtacgactttgaaagagagggatactctctagtcggaataga

SEQ ID NO: 209889 - DNA, 75 bp, Artificial Sequence
  Synthetic
tgggattcctttcgccagtcagagagaggcgaagagacaattgaagaaagatttgaaatcaaaggaaccatgcgc

SEQ ID NO: 209890 - DNA, 75 bp, Artificial Sequence
  Synthetic
atcagagaagacacacattcacatattctcattcactggggaggagatggccaccaaagctgactatacccttga

SEQ ID NO: 209891 - DNA, 75 bp, Artificial Sequence
  Synthetic
catgagggagaggggataccgctatatgatgcaatcaagtgcatgaagacatttttcggatggaaagagccccac

SEQ ID NO: 209892 - DNA, 75 bp, Artificial Sequence
  Synthetic
agaggagttcaaattgcttccaatgaaaatatggagactatggaatcaagtacacttgaactgagaagcaggtac

SEQ ID NO: 209893 - DNA, 75 bp, Artificial Sequence
  Synthetic
actgaaagcgaacttcagtgtaatctttaaccgattagagaccttgatactactaagggctttcactgaggaggg

SEQ ID NO: 209894 - DNA, 75 bp, Artificial Sequence
  Synthetic
attgtcaagccgcatgagaaaggcataaatccaaactatctcctggcttggaaacaagtgctagctgaactacag

SEQ ID NO: 209895 - DNA, 75 bp, Artificial Sequence
  Synthetic
gaaacaccaatcaacagagggcatctgcgggccaaatcagcatacaacctacgttctcagtacagagaaatctcc

SEQ ID NO: 209896 - DNA, 75 bp, Artificial Sequence
  Synthetic
ccaaaactaaaaacatgaaaaaaacaagtcagttaaaatgggcacttggtgaaaacatggcacctgagaaggtgg

SEQ ID NO: 209897 - DNA, 75 bp, Artificial Sequence
  Synthetic
caaatgtcaaaagaagtgaacgccagaattgagccattcatgaagacaacaccacgccctctcagattacctgat

SEQ ID NO: 209898 - DNA, 75 bp, Artificial Sequence
  Synthetic
attttgaagattgcaaagatatcggtgatttaaaacagtatgatagtgatgagccaaaaattagatcactggcaa

SEQ ID NO: 209899 - DNA, 75 bp, Artificial Sequence
  Synthetic
atatttggacttacaatgccgaactgttggttctattggaaaatgaaagaactttggattaccacgactcaaatg

SEQ ID NO: 209900 - DNA, 75 bp, Artificial Sequence
  Synthetic
attgagcatcgaagacccaagccatgagggagaaggtataccgctatatgatgcaatcaaatgcatgaagacgtt

SEQ ID NO: 209901 - DNA, 75 bp, Artificial Sequence
  Synthetic
acagcagaagtgtctcattgcagggccacggaatacataatgaaaggagtgtatataaacacagccttactcaat

SEQ ID NO: 209902 - DNA, 75 bp, Artificial Sequence
  Synthetic
gtatataaacacagccttactcaatgcatcttgtgcagcaatggatgattttcagttaatcccaatgataagcaa

SEQ ID NO: 209903 - DNA, 75 bp, Artificial Sequence
  Synthetic
aatatggcacctgaaaaagtggactttgaggactgcagagatgttagcgatctaagacagtatgacagtgatgaa

SEQ ID NO: 209904 - DNA, 75 bp, Artificial Sequence
  Synthetic
attcaacggtcgccagttcattggtactggtagtctccctgggggcaatcagtttctggatgtgctctaatgggt

SEQ ID NO: 209905 - DNA, 75 bp, Artificial Sequence
  Synthetic
cgacactgatgtggtaaactttgtgagtatggaattttctctcactgacccgaggctggagccacataagtggga

SEQ ID NO: 209906 - DNA, 75 bp, Artificial Sequence
  Synthetic
agtatggaattttctctcactgacccgaggctggagccacataagtgggagaagtattgcgttcttgaaatagga

SEQ ID NO: 209907 - DNA, 75 bp, Artificial Sequence
  Synthetic
ggatccagagcgaattcaacaaagcatgcgaattgacagattcgagttggattgaacttgatgaaataggagaag

SEQ ID NO: 209908 - DNA, 75 bp, Artificial Sequence
  Synthetic
ctagcagaactccaggaccttgaaaatgaggagaaaatcccaaagacgaagaacatgaagaaaacaagccagctg

SEQ ID NO: 209909 - DNA, 75 bp, Artificial Sequence
  Synthetic
atgttgctccaattgagcacattgcgagtatgagaagaaactacttcacagcggaagtgtctcattgcagggcta

SEQ ID NO: 209910 - DNA, 75 bp, Artificial Sequence
  Synthetic
gcatgatgcaaatgtcagaaacttacatgatcaggtcaaaagggtattgaaggacaatgcaattgacgaaggaaa

SEQ ID NO: 209911 - DNA, 75 bp, Artificial Sequence
  Synthetic
aggacatgaccaaagaattttttgaaaacaagtctgaagtatggcccattggggaatcgcccaacggggtggaag

SEQ ID NO: 209912 - DNA, 75 bp, Artificial Sequence
  Synthetic
aaagtcgaaacccaggaaacgctgagattgaagacctcattttcctggcacggtcagcacttattctgaggggat

SEQ ID NO: 209913 - DNA, 75 bp, Artificial Sequence
  Synthetic
cattcgaaagagcaaccattatggcggcttttgcagggaatacagagggcagaacatcggacatgaggactgaaa

SEQ ID NO: 209914 - DNA, 75 bp, Artificial Sequence
  Synthetic
gaggatttggcgtcaagcgaacaatggagaggacgcaactgctggtcttacccatctgatgatatggcattccaa

SEQ ID NO: 209915 - DNA, 75 bp, Artificial Sequence
  Synthetic
tgtcccattgtcgggccactgaatacataatgaagggagtttacataaatacagctctgcttaacgcatcttgtg

SEQ ID NO: 209916 - DNA, 75 bp, Artificial Sequence
  Synthetic
aaagaaggaagacggaaaacaaacctgtatgggttcatcataaaaggaaggtctcatttgaggaatgatactgat

SEQ ID NO: 209917 - DNA, 75 bp, Artificial Sequence
  Synthetic
atggattccaacactgtgtcaagctttcaggtagattgttttctttggcgggttctcatacgattagcagaccaa

SEQ ID NO: 209918 - DNA, 75 bp, Artificial Sequence
  Synthetic
cttggttcaactccttccttatgcatgcactgaaataattatagcaatgctactacttgctatccatactgtcca

SEQ ID NO: 209919 - DNA, 75 bp, Artificial Sequence
  Synthetic
gttcttgaagtgggggatatgctcctgaggactgcaataggccaagtatcaaggcccatgttcctgtatgttaga

SEQ ID NO: 209920 - DNA, 75 bp, Artificial Sequence
  Synthetic
aatgtgccttttcatgcagattaccatcctaataactactataacattgcatttcaagcaatatgaatgcgattc

SEQ ID NO: 209921 - DNA, 75 bp, Artificial Sequence
  Synthetic
atcctaataactactataacattgcatttcaagcaatatgaatgcgattctcctgcaaacaaccaagtaataccg

SEQ ID NO: 209922 - DNA, 75 bp, Artificial Sequence
  Synthetic
gggatcagttgcacataaatcctgcctgcctgcttgtgtgtatgggcttgcagtagcaagtgggcatgactttga

SEQ ID NO: 209923 - DNA, 75 bp, Artificial Sequence
  Synthetic
tgaaatggggtatggaaatgaggcgctgccttcttcaatctcttcaacagattgaaagcatgattgaggccgagt

SEQ ID NO: 209924 - DNA, 75 bp, Artificial Sequence
  Synthetic
caataccaccatagagaaagaggtatgcccaaaattaggggaatacaggaattggtcaaaaccacaatgcaagat

SEQ ID NO: 209925 - DNA, 75 bp, Artificial Sequence
  Synthetic
tgcccaaaattaggggaatacaggaattggtcaaaaccacaatgcaagatcacaggatttgcacctttttccaag

SEQ ID NO: 209926 - DNA, 75 bp, Artificial Sequence
  Synthetic
tacaagcaggagtggatagattctacaggacctgcaagttagtaggaatcaacatgagcaaaaagaagtcctata

SEQ ID NO: 209927 - DNA, 75 bp, Artificial Sequence
  Synthetic
cttctctgactgtgaatgtgagaggctcaggaatgagaatactcgtaaggggcaactcccctgttttcaactaca

SEQ ID NO: 209928 - DNA, 75 bp, Artificial Sequence
  Synthetic
ttgcctgcttgtgtgtacggacttgcagtggccagtggatatgactttgagagagaaggatactccctggttgga

SEQ ID NO: 209929 - DNA, 75 bp, Artificial Sequence
  Synthetic
accttatgtgtcatgcgatcctaacaagtgttatcagtttgcattaggacagggaaccacgctagacaacagaca

SEQ ID NO: 209930 - DNA, 75 bp, Artificial Sequence
  Synthetic
agtaaccattggctccatttcattagggttggttgtattcaatgttctactgcatgccgtgagcatcatattaac

SEQ ID NO: 209931 - DNA, 75 bp, Artificial Sequence
  Synthetic
aagtgttatcagtttgcattaggacagggaaccacgctagacaacagacattcaaatgacacaatacatgataga

SEQ ID NO: 209932 - DNA, 75 bp, Artificial Sequence
  Synthetic
tggaggaaataccaatcaacaaaaggcatccgcaggccagatcagtgtgcagcctacattctcagtgcagcgaaa

SEQ ID NO: 209933 - DNA, 75 bp, Artificial Sequence
  Synthetic
tagtgagggaatacaatgaaacagttagaatagagaaagtgactcaatggtacaatactagcgtagtcgaatatg

SEQ ID NO: 209934 - DNA, 75 bp, Artificial Sequence
  Synthetic
gggaaccagacaagtatgtatagcatggtccagttcaagttgtcacgatggaaaagcttggttgcatgtttgtgt

SEQ ID NO: 209935 - DNA, 75 bp, Artificial Sequence
  Synthetic
tagaatagagaaagtgactcaatggtacaatactagcgtagtcgaatatgtaccgcattggaatgagggcactta

SEQ ID NO: 209936 - DNA, 75 bp, Artificial Sequence
  Synthetic
tggtccagttcaagttgtcacgatggaaaagcttggttgcatgtttgtgtcactgggcatgacaaaaatgcaact

SEQ ID NO: 209937 - DNA, 75 bp, Artificial Sequence
  Synthetic
ccaaggacaacgggataagagttggctccaggggacatatttttgtcataagagagcctttcgtctcttgttcac

SEQ ID NO: 209938 - DNA, 75 bp, Artificial Sequence
  Synthetic
taaaaacatactccggactcaggaatcagagtgtgtttgtatcaatggaatctgcacagtggtgatgactgatgg

SEQ ID NO: 209939 - DNA, 75 bp, Artificial Sequence
  Synthetic
atcgtgccttcctttgacatgagtaatgaagggtcttatttcttcggagacaatgcagaggagtatgacaattga

SEQ ID NO: 209940 - DNA, 75 bp, Artificial Sequence
  Synthetic
atgaaggcaatactagtagttctgctatacacatttgcaaccgcaaatgcagacacattatgtataggttatcat

SEQ ID NO: 209941 - DNA, 75 bp, Artificial Sequence
  Synthetic
ctccaggggacatatttttgtcataagagagcctttcgtctcttgttcacctgtagagtgcaggactttcttcct

SEQ ID NO: 209942 - DNA, 75 bp, Artificial Sequence
  Synthetic
gatcttattgaaaatttgcaggcttaccagaagcgaatggggttgcagatgcagcgattcaagtgatcctctcgt

SEQ ID NO: 209943 - DNA, 75 bp, Artificial Sequence
  Synthetic
atagaagcccattcagaactctcatgagtgtcgaagtgggccaatcacccaatgtatatcaagccaggtttgaag

SEQ ID NO: 209944 - DNA, 75 bp, Artificial Sequence
  Synthetic
gggaagtgctcagcatgtggaagaatgttcctgttaccctcgataccctgatgtcagatgtatttgcagggacaa

SEQ ID NO: 209945 - DNA, 75 bp, Artificial Sequence
  Synthetic
gagtgtcgaagtgggccaatcacccaatgtatatcaagccaggtttgaagctgtggcatggtcagcaacagcctg

SEQ ID NO: 209946 - DNA, 75 bp, Artificial Sequence
  Synthetic
tcagagtgtgtttgtatcaatggaatctgcacagtggtgatgactgatggaagtgcttcagggaaagctgatact

SEQ ID NO: 209947 - DNA, 75 bp, Artificial Sequence
  Synthetic
tgttcctgttaccctcgataccctgatgtcagatgtatttgcagggacaactggaaaggttcaaataggcccatc

SEQ ID NO: 209948 - DNA, 75 bp, Artificial Sequence
  Synthetic
cctgagaggaagaagcagcactcttggtctggacatcagaaccgcaactcgtgaaggaaagcatatagtggagcg

SEQ ID NO: 209949 - DNA, 75 bp, Artificial Sequence
  Synthetic
actgcaaggatgtcagcgatttgaggcagtatgacagcgatgagcctgagcaaagatcactagcaagttggattc

SEQ ID NO: 209950 - DNA, 75 bp, Artificial Sequence
  Synthetic
aagcagtagcagtagttcattacggaggggtgcctactgacgttgttaactcctgggcaggagatatattaagaa

SEQ ID NO: 209951 - DNA, 75 bp, Artificial Sequence
  Synthetic
aggacttgttggcgacacacccaggaacaatgatgggtctagtaatagcaattgccggaaccctaataatgaaag

SEQ ID NO: 209952 - DNA, 75 bp, Artificial Sequence
  Synthetic
aggggtgcctactgacgttgttaactcctgggcaggagatatattaagaactcaggagtcatcttgtacttgcat

SEQ ID NO: 209953 - DNA, 75 bp, Artificial Sequence
  Synthetic
aacaatgatgggtctagtaatagcaattgccggaaccctaataatgaaagaggaaatcatggggtgaaaggttgg

SEQ ID NO: 209954 - DNA, 75 bp, Artificial Sequence
  Synthetic
cgcagtatagaatatacaaagcaaatcaaggcaaaataattggccgaacagatgttagctttagtggaggacata

SEQ ID NO: 209955 - DNA, 75 bp, Artificial Sequence
  Synthetic
ctcacgcttaggttacgaaaccttcaaagttgttggtggttggtcccaacccaattccaaattccagataaatag

SEQ ID NO: 209956 - DNA, 75 bp, Artificial Sequence
  Synthetic
atttgatgtcgcagtcttgcactcgcgagatactgacaaaaaccacagtggaccacatggccataattaagaaat

SEQ ID NO: 209957 - DNA, 75 bp, Artificial Sequence
  Synthetic
tcaaggcaaaataattggccgaacagatgttagctttagtggaggacatattgaggaatgttcttgttatccaaa

SEQ ID NO: 209958 - DNA, 75 bp, Artificial Sequence
  Synthetic
aaagcttctacaaaaatttaatatggctagttaaaaaaggaaattcatacccaaagctcagcaaatcctacatta

SEQ ID NO: 209959 - DNA, 75 bp, Artificial Sequence
  Synthetic
agccctaatactacttagagcttttacggatgaaggagcaatagtaggcgaaatctcaccattaccttctcttcc

SEQ ID NO: 209960 - DNA, 75 bp, Artificial Sequence
  Synthetic
ggcctgtgctaattatttcgcctgatctctcttacagggttgggtatttatgtgcagggttgcccagtgacactc

SEQ ID NO: 209961 - DNA, 75 bp, Artificial Sequence
  Synthetic
taggtgcttttatgtggaactaataagaggaaggaggcaggaaactagagtgtggtggacttcgaacagtattgt

SEQ ID NO: 209962 - DNA, 75 bp, Artificial Sequence
  Synthetic
tctctcttacagggttgggtatttatgtgcagggttgcccagtgacactccaagaggggaagatactcaatttgt

SEQ ID NO: 209963 - DNA, 75 bp, Artificial Sequence
  Synthetic
aaagttgttggtggttggtcccaacccaattccaaattccagataaatagacaagtcattgttgacagcgataat

SEQ ID NO: 209964 - DNA, 75 bp, Artificial Sequence
  Synthetic
tcctcgaacaatcaagcagcgccatgcagaccaatcataatagaaaggaacgtaactgagatagtgcacctaaat

SEQ ID NO: 209965 - DNA, 75 bp, Artificial Sequence
  Synthetic
tatggttcaggctcatggcctgatggagcagacatcaatttcatgcctgtataagctttcgcaatttcagaaaaa

SEQ ID NO: 209966 - DNA, 75 bp, Artificial Sequence
  Synthetic
tcgggtttcgacagggaactgatgtgtgggtggggcggacaattagtcgaacctccagatcaggatttgaaataa

SEQ ID NO: 209967 - DNA, 75 bp, Artificial Sequence
  Synthetic
gtgggtggggcggacaattagtcgaacctccagatcaggatttgaaataataaggataaagaatggttggacgca

SEQ ID NO: 209968 - DNA, 75 bp, Artificial Sequence
  Synthetic
atagagccgggagacaaaataacattcgaagcaactggaaatctagtggtaccgagatatgcattcgcaatggaa

SEQ ID NO: 209969 - DNA, 75 bp, Artificial Sequence
  Synthetic
gccaagattttccaggaaagggcaacaacacagcaacactgtgcctaggacatcatgcagtgccaaatggaacac

SEQ ID NO: 209970 - DNA, 75 bp, Artificial Sequence
  Synthetic
caacacagcaacactgtgcctaggacatcatgcagtgccaaatggaacactagtgaaaacaatcacagatgatca

SEQ ID NO: 209971 - DNA, 75 bp, Artificial Sequence
  Synthetic
ggtcgggatacagtgggtctttcactttaccagtagaattgtctgggagggaatgtttggttccctgtttttggg

SEQ ID NO: 209972 - DNA, 75 bp, Artificial Sequence
  Synthetic
agctacgtcttttgtctggtttttggccaagattttccaggaaagggcaacaacacagcaacactgtgcctagga

SEQ ID NO: 209973 - DNA, 75 bp, Artificial Sequence
  Synthetic
aaatatgcaagaatcctcatcgaattcttgatggggcaaattgcacactgatagactctctattgggggaccctc

SEQ ID NO: 209974 - DNA, 75 bp, Artificial Sequence
  Synthetic
agctccattgtaatgtgtggagttgattatgaaattgccgattggtcatggcacgatggagctattcttcccttt

SEQ ID NO: 209975 - DNA, 75 bp, Artificial Sequence
  Synthetic
tctctcactgacccgaggctggagccacacaaatgggaaaagtactgtgttcttgaaataggagacatgctcctg

SEQ ID NO: 209976 - DNA, 75 bp, Artificial Sequence
  Synthetic
tcttgatggggcaaattgcacactgatagactctctattgggggaccctcactgtgatggttttcaaaatgagaa

SEQ ID NO: 209977 - DNA, 75 bp, Artificial Sequence
  Synthetic
ttggtcgaaaccacaatgtcaaataacagggttcgctcctttctccaaggacaattcaattaggctctccgcagg

SEQ ID NO: 209978 - DNA, 75 bp, Artificial Sequence
  Synthetic
aggaaaattgtcccagagcatcaggatacaagaattggtcaaaacctcaatgtcaaattacagggtttgtcccct

SEQ ID NO: 209979 - DNA, 75 bp, Artificial Sequence
  Synthetic
atgatgtgccggagtatacctctcttaggtcactaattgcctcatcaggcaccttggaatttaccaatgaaaatt

SEQ ID NO: 209980 - DNA, 75 bp, Artificial Sequence
  Synthetic
taggtcactaattgcctcatcaggcaccttggaatttaccaatgaaaatttcaattggactggagttacccaaaa

SEQ ID NO: 209981 - DNA, 75 bp, Artificial Sequence
  Synthetic
aattgagaaaataaggcctctcttaatagatggcacagcatcattgagccctgggatgatgatgggcatgttcaa

SEQ ID NO: 209982 - DNA, 75 bp, Artificial Sequence
  Synthetic
cagtgggtaaagagttcaaccacctggaaaaaagaatagagaatttaaataaaaaagttgatgatggtttcctgg

SEQ ID NO: 209983 - DNA, 75 bp, Artificial Sequence
  Synthetic
gattgaactggttgtacaaatcaggaaacacatatccaatgctaaatgttactatgccaaacagtgatgatttcg

SEQ ID NO: 209984 - DNA, 75 bp, Artificial Sequence
  Synthetic
tattgcttctgtaccgacttcacgctacctaactgacatgactcttgaagaaatgtcaagagactggttcatgct

SEQ ID NO: 209985 - DNA, 75 bp, Artificial Sequence
  Synthetic
aaacacatatccaatgctaaatgttactatgccaaacagtgatgatttcgacaaattgtacatttggggagttca

SEQ ID NO: 209986 - DNA, 75 bp, Artificial Sequence
  Synthetic
ggaaaataatagtatccacaaagagaagtcaacaaaccataatcccgaatatcgggtctagaccctgggtaaggg

SEQ ID NO: 209987 - DNA, 75 bp, Artificial Sequence
  Synthetic
aagtcaacaaaccataatcccgaatatcgggtctagaccctgggtaaggggtttgtctagtaggataagcatcta

SEQ ID NO: 209988 - DNA, 75 bp, Artificial Sequence
  Synthetic
acctaattgctcctcggggttacttcaaaatacagactgggaaaagttcagtaatgaaatcagatgcacctattg

SEQ ID NO: 209989 - DNA, 75 bp, Artificial Sequence
  Synthetic
caaaatacagactgggaaaagttcagtaatgaaatcagatgcacctattggcacctgcaattctgaatgcattac

SEQ ID NO: 209990 - DNA, 75 bp, Artificial Sequence
  Synthetic
ctcccttcaaaacagaaacggaaaatggcgagaacaattgagtcagaagttcgaggaaataagatggctgattga

SEQ ID NO: 209991 - DNA, 75 bp, Artificial Sequence
  Synthetic
ttacatatggggcatgcccccattacatcaagcaaagcactctgaagttagcaacaggaatgcggaatataccag

SEQ ID NO: 209992 - DNA, 75 bp, Artificial Sequence
  Synthetic
catcaagcaaagcactctgaagttagcaacaggaatgcggaatataccagaaagacaaaccagaggtatattcgg

SEQ ID NO: 209993 - DNA, 75 bp, Artificial Sequence
  Synthetic
acagtataacaatagagagaatggtactctctgcatttgatgaaagaaggaacagatacctggaagagcatccca

SEQ ID NO: 209994 - DNA, 75 bp, Artificial Sequence
  Synthetic
ggggactaccttagacaacagccactcaaatggcacatcacatgataggactccttataggacacttttgatgaa

SEQ ID NO: 209995 - DNA, 75 bp, Artificial Sequence
  Synthetic
ggtacggtttcagacaccaaaattctgagggcataggacaggcagcagatcttaaaagtacccaagcagctatca

SEQ ID NO: 209996 - DNA, 75 bp, Artificial Sequence
  Synthetic
tgtgctgcatggtccagtagcagctgcttcgatggaaaagaatggttgcatgtttgtatcacaggaaacgataat

SEQ ID NO: 209997 - DNA, 75 bp, Artificial Sequence
  Synthetic
cttaaaagtacccaagcagctatcaaccaaatcaatggaaaactgaatagagtaatcgagaagacaaacgagaaa

SEQ ID NO: 209998 - DNA, 75 bp, Artificial Sequence
  Synthetic
atttccagaggaagaggagagtgagggacaacatgaccaagaaaatgatcacacagagaacaataggaaagaaaa

SEQ ID NO: 209999 - DNA, 75 bp, Artificial Sequence
  Synthetic
ccttgaaagatatgttgaagatactaaaatagatctttggtcttacaacgcggaacttcttgtcgcactagagaa

SEQ ID NO: 210000 - DNA, 75 bp, Artificial Sequence
  Synthetic
aaaatagatctttggtcttacaacgcggaacttcttgtcgcactagagaatcaacacacaattgacctgactgac

SEQ ID NO: 210001 - DNA, 75 bp, Artificial Sequence
  Synthetic
caggtacatatggaacaggctcatggcctgatggggcggatatcaatttcatgcctatataagctttcgcaattt

SEQ ID NO: 210002 - DNA, 75 bp, Artificial Sequence
  Synthetic
tgctgaggacatgggaaatggttgcttcaaaatataccacaaatgtgacaactcttgcatggagtcaatcagaaa

SEQ ID NO: 210003 - DNA, 75 bp, Artificial Sequence
  Synthetic
ttcaaaatataccacaaatgtgacaactcttgcatggagtcaatcagaaatgggacttacgaccataatgaatac

SEQ ID NO: 210004 - DNA, 75 bp, Artificial Sequence
  Synthetic
gtcaggatacaaagactggatcctgtggatttcctttgccatatcatgctttttgctttgtactatttggatggg

SEQ ID NO: 210005 - DNA, 75 bp, Artificial Sequence
  Synthetic
attcataatatgggcctgccagaaaggcaacattagatgcaacatttgcatctgattttattggtaattaaaaac

SEQ ID NO: 210006 - DNA, 75 bp, Artificial Sequence
  Synthetic
aatgttctcaaacaagatggcgagattagggaaaggatacatgttcgaaagtaagagtatgaagttacggacaca

SEQ ID NO: 210007 - DNA, 75 bp, Artificial Sequence
  Synthetic
atccggaacctccacattccagaggtctgcttgaaatgggaattgatggatgaagactaccaaggcaggctgtgt

SEQ ID NO: 210008 - DNA, 75 bp, Artificial Sequence
  Synthetic
taacttattcgtcatcaatgatgtgggagatcaatggtcctgagtcagtgctagtcaacacttatcaatggatca

SEQ ID NO: 210009 - DNA, 75 bp, Artificial Sequence
  Synthetic
ccagccaaaagcatggagtatgatgccgttgcaactacacattcatggattcctaagaggaatcgctccattctc

SEQ ID NO: 210010 - DNA, 75 bp, Artificial Sequence
  Synthetic
atgaatccaaatcaaaagataatatgcatttcagccacaggaatgacactatcggtagtaagcctgctgatagga

SEQ ID NO: 210011 - DNA, 75 bp, Artificial Sequence
  Synthetic
atcggtagtaagcctgctgataggaattgccaatttgggcctaaacatcggactccattataaggtgggtgatac

SEQ ID NO: 210012 - DNA, 75 bp, Artificial Sequence
  Synthetic
attgccaatttgggcctaaacatcggactccattataaggtgggtgatacaccagatgtgagcatcccaaacatg

SEQ ID NO: 210013 - DNA, 75 bp, Artificial Sequence
  Synthetic
tttcacaaatatcactaatattatagtgaacaaaaacgaggaaaaaacgttcctaaatctgaccaagcccctatg

SEQ ID NO: 210014 - DNA, 75 bp, Artificial Sequence
  Synthetic
gtgaacaaaaacgaggaaaaaacgttcctaaatctgaccaagcccctatgtgaggtaaactcatggcacatcttg

SEQ ID NO: 210015 - DNA, 75 bp, Artificial Sequence
  Synthetic
aagggagccctacctgtcttgcgatccacaaggctgcaggatgtttgctctgagccaaggaacaacactcagagg

SEQ ID NO: 210016 - DNA, 75 bp, Artificial Sequence
  Synthetic
ccacaaggctgcaggatgtttgctctgagccaaggaacaacactcagagggcgacatgcgaatgggactatacat

SEQ ID NO: 210017 - DNA, 75 bp, Artificial Sequence
  Synthetic
cagtccatacaatgttaaggtcgaatgcgtaggatggtcgagcacatcgtgccatgatggcatatcaagaatgtc

SEQ ID NO: 210018 - DNA, 75 bp, Artificial Sequence
  Synthetic
tgcgtaggatggtcgagcacatcgtgccatgatggcatatcaagaatgtcaatatgcatgtcgggaccgaacaac

SEQ ID NO: 210019 - DNA, 75 bp, Artificial Sequence
  Synthetic
ataggtgccataggggagacacacaaattcagacgagaagatcatttgagttaaagaagctgtgggatcaaaccc

SEQ ID NO: 210020 - DNA, 75 bp, Artificial Sequence
  Synthetic
atcatgggcaggaaatattctcagaacccaagagtcagaatgtgtatgccataaagggatctgtccagtagtcat

SEQ ID NO: 210021 - DNA, 75 bp, Artificial Sequence
  Synthetic
atgagaaaggcataaaccccaattatctactggcttggaagcaagtgctagcagagctccaggacattgaaaatg

SEQ ID NO: 210022 - DNA, 75 bp, Artificial Sequence
  Synthetic
acccaagagtcagaatgtgtatgccataaagggatctgtccagtagtcatgacggatggcccagcaaacaacaga

SEQ ID NO: 210023 - DNA, 75 bp, Artificial Sequence
  Synthetic
acgatggaaaagcatggctgcatgtttgtataacgggggatgataaaaatgcaactgctagctttatttacaatg

SEQ ID NO: 210024 - DNA, 75 bp, Artificial Sequence
  Synthetic
taggatggttgacatccttagacaaaacccaacagaagaacaggctgtggatatatgcaaggcagcaatgggtct

SEQ ID NO: 210025 - DNA, 75 bp, Artificial Sequence
  Synthetic
agaactggcagggagtgcccagcacatcgaagaatgttcatgctatggggcagtcgaggtgatcaaatgcatatg

SEQ ID NO: 210026 - DNA, 75 bp, Artificial Sequence
  Synthetic
gcgatctattcaacggtcgccagttcattggtactggtagtctccctgggggcaatcagtttttggatgtgctct

SEQ ID NO: 210027 - DNA, 75 bp, Artificial Sequence
  Synthetic
atcgaagaatgttcatgctatggggcagtcgaggtgatcaaatgcatatgcagagacaattggaaaggggcaaat

SEQ ID NO: 210028 - DNA, 75 bp, Artificial Sequence
  Synthetic
tttgtgctcgaaggtcctaaccgatacaagtcgccccaatgatcccattaatgggaattgtgatgtgccaataac

SEQ ID NO: 210029 - DNA, 75 bp, Artificial Sequence
  Synthetic
acaagtcgccccaatgatcccattaatgggaattgtgatgtgccaataacaggagggagccccgatcctggagtg

SEQ ID NO: 210030 - DNA, 75 bp, Artificial Sequence
  Synthetic
gtgaactttgtaagcatggagttctccctcactgacccgagactggagccacacaaatgggaaaagtactgtgtt

SEQ ID NO: 210031 - DNA, 75 bp, Artificial Sequence
  Synthetic
gcaatggtgttctcacaagaggattgtatgataaaagcagtgagaggtgatttgaactttgtcaacagagcgaac

SEQ ID NO: 210032 - DNA, 75 bp, Artificial Sequence
  Synthetic
tagcaaagactccaggtcgggctacgaaatgttgaaagtcccaaatgcagagaccgacactcaatcagggccgac

SEQ ID NO: 210033 - DNA, 75 bp, Artificial Sequence
  Synthetic
atggagagaataaaagaactgagagatctaatgtcgcagtcccgcactcgcgagatactcactaagaccactgtg

SEQ ID NO: 210034 - DNA, 75 bp, Artificial Sequence
  Synthetic
gaaatgttgaaagtcccaaatgcagagaccgacactcaatcagggccgacatcacaccaagtaattgtcaacaac

SEQ ID NO: 210035 - DNA, 75 bp, Artificial Sequence
  Synthetic
gagcaattgagctcagtgtcatcatttgaaaggtttgagatattccccaagacaagttcatggcccaatcatgac

SEQ ID NO: 210036 - DNA, 75 bp, Artificial Sequence
  Synthetic
agagtgcttcaatccttgtttttatgtggaactaatcagagggagacccaaggagagtagtgtactgtggacttc

SEQ ID NO: 210037 - DNA, 75 bp, Artificial Sequence
  Synthetic
ttcaggaatgagagtagttgtgagaggcaattctcctgtgttcaactacaacaaggcaaccaaaaggcttacagt

SEQ ID NO: 210038 - DNA, 75 bp, Artificial Sequence
  Synthetic
aaatagcattgtagctctctgtggatccaaagagcgactgggatcatggtcctggcatgatggtgctgaaatcat

SEQ ID NO: 210039 - DNA, 75 bp, Artificial Sequence
  Synthetic
ctgaccaacaaagtctctatcagaatgcagatgcatatgtttttgtggggacatcaagatacagcaaaaagttca

SEQ ID NO: 210040 - DNA, 75 bp, Artificial Sequence
  Synthetic
ccctacaatgctatacaataagatggaatttgaaccctttcaatccctagtgcctaaagctgccagaggccaata

SEQ ID NO: 210041 - DNA, 75 bp, Artificial Sequence
  Synthetic
tttcccaaatgaagtgggggcaagaatactgacatcagagtcacagctggcaataacaaaagagaagaaagaaga

SEQ ID NO: 210042 - DNA, 75 bp, Artificial Sequence
  Synthetic
tggaatttacccaagaaagcttcaattggactggagttgctcaagacggatcaagcaatgcctgcagaaggggat

SEQ ID NO: 210043 - DNA, 75 bp, Artificial Sequence
  Synthetic
agaatgcagttttcttctctaactgtgaatgtgagaggctcaggaatgagaatactcgtaaggggcaattcccct

SEQ ID NO: 210044 - DNA, 75 bp, Artificial Sequence
  Synthetic
gtgttcaactacaataaggcaaccaaaaggcttaccgttcttggaaaggacgcaggtgcattaacagaggatcca

SEQ ID NO: 210045 - DNA, 75 bp, Artificial Sequence
  Synthetic
accccagctcaacccgattgatggaccactacctgaggataatgaaccaagtggatatgcacaaacagactgtgt

SEQ ID NO: 210046 - DNA, 75 bp, Artificial Sequence
  Synthetic
ccactacctgaggataatgaaccaagtggatatgcacaaacagactgtgtcctggaggccatggctttccttgaa

SEQ ID NO: 210047 - DNA, 75 bp, Artificial Sequence
  Synthetic
tggtccgatcatgaagcctcatcaggggtgagctcagcatgtccataccagggagtgccctcctttttcagaaat

SEQ ID NO: 210048 - DNA, 75 bp, Artificial Sequence
  Synthetic
gggtgagctcagcatgtccataccagggagtgccctcctttttcagaaatgtggtatggcttatcaaaaagaacc

SEQ ID NO: 210049 - DNA, 75 bp, Artificial Sequence
  Synthetic
gaatcaatggataaagaggaaatagagataacaacacactttcaaagaaaaaggagagtaagagacaacatgacc

SEQ ID NO: 210050 - DNA, 75 bp, Artificial Sequence
  Synthetic
cttttgatactgtgggggattcatcattctaacgatgcagcagagcagacaaagctttatcaaaacccaaccacc

SEQ ID NO: 210051 - DNA, 75 bp, Artificial Sequence
  Synthetic
actttcaaagaaaaaggagagtaagagacaacatgaccaagaagatggtcacacaaagaacaatagggaagaaaa

SEQ ID NO: 210052 - DNA, 75 bp, Artificial Sequence
  Synthetic
caatagtatagtatcgatgtgttccagtacagaattcctgggacaatggaactggcctgatggggctaaaataga

SEQ ID NO: 210053 - DNA, 75 bp, Artificial Sequence
  Synthetic
agtgtctggaataaatgaatcagctgacatgagtattggagtaacagtgataaagaacaacatgataaacaatga

SEQ ID NO: 210054 - DNA, 75 bp, Artificial Sequence
  Synthetic
taagagaagttatctaataagagcactaacattgaatacgatgaccaaagatgcagagagaggcaaattaaaaag

SEQ ID NO: 210055 - DNA, 75 bp, Artificial Sequence
  Synthetic
aaagctttatcaaaacccaaccacctatatttccgttgggacatcaacactgaaccagagattggtaccaacaat

SEQ ID NO: 210056 - DNA, 75 bp, Artificial Sequence
  Synthetic
ccagtagggggcaatgaaaagaaagccaaattggcaaatgttgtgagaaagatgatgactaattcacaagacaca

SEQ ID NO: 210057 - DNA, 75 bp, Artificial Sequence
  Synthetic
tgaaacaatggaagccgttcaacagacaagggtggacaaactaacccaaggtcgccaaacttatgattggacatt

SEQ ID NO: 210058 - DNA, 75 bp, Artificial Sequence
  Synthetic
atgaatccaaaccaaaagataataaccattggttcggtctgtatgacaattggaattgctaacttaatattacaa

SEQ ID NO: 210059 - DNA, 75 bp, Artificial Sequence
  Synthetic
tatgccattccacaacatacaccctctcactatcggggaatgccccaaatatgtgaaatcaaacaaattagtcct

SEQ ID NO: 210060 - DNA, 75 bp, Artificial Sequence
  Synthetic
caatgataagcaaatgcagaaccaaagaaggaagacggaaaacaaacctatatggattcattataaaaggaagat

SEQ ID NO: 210061 - DNA, 75 bp, Artificial Sequence
  Synthetic
aagaggtggcactcagttattcaactggtgcacttgccagctgcatgggcctcatatacaacagaatggggactg

SEQ ID NO: 210062 - DNA, 75 bp, Artificial Sequence
  Synthetic
ttagcatggagctgcccagttttggagtgtctggaataaacgaatcagctgatatgagtattggagtaacagtga

SEQ ID NO: 210063 - DNA, 75 bp, Artificial Sequence
  Synthetic
gcaatctggactccctgttggagggaatgagaagaaggctaaattggcaaatgtcgtgagaaaaatgatgactaa

SEQ ID NO: 210064 - DNA, 75 bp, Artificial Sequence
  Synthetic
ggtcaaaaccacaatgtcaaattacagggttcgctcctttctcaaaggacaactcaattaggctttctgcaggtg

SEQ ID NO: 210065 - DNA, 75 bp, Artificial Sequence
  Synthetic
tgttatcaatttgcacttgggcagggaaccaccctgaaaaacaagcactcaaatggcaccacacatgatagaact

SEQ ID NO: 210066 - DNA, 75 bp, Artificial Sequence
  Synthetic
aggaaatgtcacgagactggttcatgctcatgcctaggcaaaagataataggccctctttgcgtgcgattggacc

SEQ ID NO: 210067 - DNA, 75 bp, Artificial Sequence
  Synthetic
gttgtctccttcaatcccttcagcaaattgaaagcatgattgaggccgagtcctctgtcaaagaaaaagacatga

SEQ ID NO: 210068 - DNA, 75 bp, Artificial Sequence
  Synthetic
tggggatgataaaaatgctactgctagtatcatttatgatgggatgcttgttgacagtattggttcatggtccaa

SEQ ID NO: 210069 - DNA, 75 bp, Artificial Sequence
  Synthetic
gtgcagtagtaatgactgatggaagtgcatcaggaaaggctgacactagaatattattcataagagaggggaaaa

SEQ ID NO: 210070 - DNA, 75 bp, Artificial Sequence
  Synthetic
gagtgctcagcacgttgaggaatgctcctgttacccccggtatcctgaagttaggtgtgtttgcagagacaattg

SEQ ID NO: 210071 - DNA, 75 bp, Artificial Sequence
  Synthetic
tttgacgatggtaatgatgtttggatgggacgaacaatcagaaatgattcacgctcaggttatgagacttttagg

SEQ ID NO: 210072 - DNA, 75 bp, Artificial Sequence
  Synthetic
acgctcaggttatgagacttttagggtaatcaatggttggaccacggctaattcaaagtcacaaataaataggca

SEQ ID NO: 210073 - DNA, 75 bp, Artificial Sequence
  Synthetic
ttcactataagacaagaaatggccagtaggagtctatgggattcctttcgtcagtccgaaagaggcgaagagaca

SEQ ID NO: 210074 - DNA, 75 bp, Artificial Sequence
  Synthetic
ggtggacttcaaatagcatcattgtattctgtggaacctcaggtacatatggaacaggctcatggcctgatggag

SEQ ID NO: 210075 - DNA, 75 bp, Artificial Sequence
  Synthetic
tactactagtagtaacagtaagcaatgcagataagatctgcatcggctatcaatcaacaaactccacagaaactg

SEQ ID NO: 210076 - DNA, 75 bp, Artificial Sequence
  Synthetic
tgcagataagatctgcatcggctatcaatcaacaaactccacagaaactgtagacacactaacagaaaacaatgt

SEQ ID NO: 210077 - DNA, 75 bp, Artificial Sequence
  Synthetic
gtcgcctcatctcttgtacttgcaatggggtttgctgccttcttattctgggccatgtcaatcggatcaggcaga

SEQ ID NO: 210078 - DNA, 75 bp, Artificial Sequence
  Synthetic
tgagggcaagctttcccaaatgtcaaaagaagtgaacgccaaaattgaaccattcttgaggacgacaccacgccc

SEQ ID NO: 210079 - DNA, 75 bp, Artificial Sequence
  Synthetic
tgtgtgcaacaagcttgggacaccctcttattctagacacctgtaccattgaaggactaatctatggcaatcctt

SEQ ID NO: 210080 - DNA, 75 bp, Artificial Sequence
  Synthetic
agaatggtcctatatcgtcgagagaccatcagctgttaacggattgtgttatcccgggaatgtagaaaatctaga

SEQ ID NO: 210081 - DNA, 75 bp, Artificial Sequence
  Synthetic
ccatcagctgttaacggattgtgttatcccgggaatgtagaaaatctagaagagctaaggtcactttttagttct

SEQ ID NO: 210082 - DNA, 75 bp, Artificial Sequence
  Synthetic
ttcttttcatgtggggcataaatcacccacccactgatactgcgcagacaaatctgtacacaagaaccgacacaa

SEQ ID NO: 210083 - DNA, 75 bp, Artificial Sequence
  Synthetic
gagcagatattgggccataagaaccaggagtgggggaaacaccaaccagcagagagcatctgcaggacaaatcag

SEQ ID NO: 210084 - DNA, 75 bp, Artificial Sequence
  Synthetic
agatctctagcaagctgggtccaaaatgaattcaataaggcatgtgaattgactgattcaagctggatagaactt

SEQ ID NO: 210085 - DNA, 75 bp, Artificial Sequence
  Synthetic
atcctgaagactgatttaaaaaggggtagctgcacagtgcagtgtcagacagagaagggtggcttaaacacaaca

SEQ ID NO: 210086 - DNA, 75 bp, Artificial Sequence
  Synthetic
atggagagaataaaggaattaagagatttgatttcccagtttggcactcgcgagatactgacaaaaaccacagtg

SEQ ID NO: 210087 - DNA, 75 bp, Artificial Sequence
  Synthetic
atgcatttggaaactgctcaaaatacattggcatgaagagtctcaaacttgcagttggtctgaggaatgtgcctt

SEQ ID NO: 210088 - DNA, 75 bp, Artificial Sequence
  Synthetic
ctagatctagtagaggactattcggggccatagcaggatttatagagggaggttggtcaggactagttgctggtt

SEQ ID NO: 210089 - DNA, 75 bp, Artificial Sequence
  Synthetic
gatcaataataagattgatgatcaaatccaagatatatgggcatataatgcagaattgctagttctgcttgaaaa

SEQ ID NO: 210090 - DNA, 75 bp, Artificial Sequence
  Synthetic
agtcaacagaacacataaatactcagaaaaaggaaagtggacaacaaacacagagactggagcaccccaactcaa

SEQ ID NO: 210091 - DNA, 75 bp, Artificial Sequence
  Synthetic
gcaaatgtaaacaatctatataataaagtgaagagggcgttgggttccaatgcggtggaagatgggaaaggatgt

SEQ ID NO: 210092 - DNA, 75 bp, Artificial Sequence
  Synthetic
tcatgaagatctgttccaccattgaagagctcagacggcaaaaataatgaatttagcttgtccttcatgaaaaaa

SEQ ID NO: 210093 - DNA, 75 bp, Artificial Sequence
  Synthetic
cagagaaagtagactttgaagactgcaaagatgttagtgatctaagacagtatgacagtgatgaaccagagtcta

SEQ ID NO: 210094 - DNA, 75 bp, Artificial Sequence
  Synthetic
atctgaaggaacttacaaaatcctcaccatttattcgactgtcgcctcatctcttgtgattgcaatggggtttgc

SEQ ID NO: 210095 - DNA, 75 bp, Artificial Sequence
  Synthetic
ggcaactctccagtgttcaattacaacaaagcaaccaaaaggcttacaattcttggaaaagatgcaggtgcattg

SEQ ID NO: 210096 - DNA, 75 bp, Artificial Sequence
  Synthetic
gactggttcatgcttatgcctaggcaaaagataataggccctctttgcgtgcgattggaccaggcggtcatggaa

SEQ ID NO: 210097 - DNA, 75 bp, Artificial Sequence
  Synthetic
aatgtaccagagaaacaaactagaggcatatttggcgcaatagcaggtttcatagaaaatggttgggagggaatg

SEQ ID NO: 210098 - DNA, 75 bp, Artificial Sequence
  Synthetic
ataaacactaataggagcttccacaatgtccataggaacacaataggagactgccctaaatatgtaaatgttaaa

SEQ ID NO: 210099 - DNA, 75 bp, Artificial Sequence
  Synthetic
atgggagaccttcattacctccagagcagaaatgagaagtggcgagagcaattgggacagaaatttgaggaaata

SEQ ID NO: 210100 - DNA, 75 bp, Artificial Sequence
  Synthetic
cagtgtgcaacctacattctcagtgcagcgaaatctcccttttgaaagagcaaccgttatggcagcattcagcgg

SEQ ID NO: 210101 - DNA, 75 bp, Artificial Sequence
  Synthetic
ggaaacaatgctatcaatcacgattctgttcctgctcatagcagaggtatcctctcagaactacacaggaaatcc

SEQ ID NO: 210102 - DNA, 75 bp, Artificial Sequence
  Synthetic
cctctcagaactacacaggaaatcctgtgatatgtctgggacaccatgctgtacctaatgggacaatggtgaaaa

SEQ ID NO: 210103 - DNA, 75 bp, Artificial Sequence
  Synthetic
tgtgatatgtctgggacaccatgctgtacctaatgggacaatggtgaaaaccttaactgatgaccaaatagaggt

SEQ ID NO: 210104 - DNA, 75 bp, Artificial Sequence
  Synthetic
ctagccctttgagattagtagatggccaaacttgtgacatcgtcaatggtgctctgggaagcccgggctgtgatc

SEQ ID NO: 210105 - DNA, 75 bp, Artificial Sequence
  Synthetic
ccaaacttgtgacatcgtcaatggtgctctgggaagcccgggctgtgatcacttaaatggtgcagaatgggatgt

SEQ ID NO: 210106 - DNA, 75 bp, Artificial Sequence
  Synthetic
taatgaatcggctgacatgagcattggagttacagtgataaagaacaatatgataaacaatgaccttggaccagc

SEQ ID NO: 210107 - DNA, 75 bp, Artificial Sequence
  Synthetic
cagattaccagagcctgcggagtatcctagcaaacaatgggaaatttgagttcatcgcagaggaattccaatgga

SEQ ID NO: 210108 - DNA, 75 bp, Artificial Sequence
  Synthetic
aggatttaccaaattttggcgatctattcaactgtcgccagttcattggtactggtagtctccctgggggcaatc

SEQ ID NO: 210109 - DNA, 75 bp, Artificial Sequence
  Synthetic
ttcatagaaggtggttggccaggtctaatcaatggttggtatggattccaacacaggaatgaggaaggaacaggg

SEQ ID NO: 210110 - DNA, 75 bp, Artificial Sequence
  Synthetic
tttacatatggggagttcaccatccttcaactgacacagaacaaaccaacttgtataagaacaaccctggaaggg

SEQ ID NO: 210111 - DNA, 75 bp, Artificial Sequence
  Synthetic
ttcaactgacacagaacaaaccaacttgtataagaacaaccctggaagggtgaccgtctccacccaaactagtca

SEQ ID NO: 210112 - DNA, 75 bp, Artificial Sequence
  Synthetic
gcggtaggatcagcttctattggacaattgtagaaccaggagatctcatagttttcaataccatagggaatttaa

SEQ ID NO: 210113 - DNA, 75 bp, Artificial Sequence
  Synthetic
aatgtttctggaaaggtggatccatcaacaccaaacttccttttcagaatctttctccaagaactgtgggtcaat

SEQ ID NO: 210114 - DNA, 75 bp, Artificial Sequence
  Synthetic
aagcaggaatcctgggaatgccgagattgaagacctcatcttcctggcacggtctgcactcattctaagaggatc

SEQ ID NO: 210115 - DNA, 75 bp, Artificial Sequence
  Synthetic
caacagtcaaaagaagagcacaatcctgaatactgcagttcctataggatcctgtgttagtaagtgccacactga

SEQ ID NO: 210116 - DNA, 75 bp, Artificial Sequence
  Synthetic
gaggcctatttggggccattgctggcttcattgaaggggggtggacagggatggtagatggatggtacggttatc

SEQ ID NO: 210117 - DNA, 75 bp, Artificial Sequence
  Synthetic
caatcggggactgtcctaagtatgtcaaacaggggtctttgaaactggctacaggaatgaggaacatcccagaga

SEQ ID NO: 210118 - DNA, 75 bp, Artificial Sequence
  Synthetic
cagcgttcgaagatctgagagtctcaagtttcatcagaggaacaagagtaatcccaagaggacaactatctacca

SEQ ID NO: 210119 - DNA, 75 bp, Artificial Sequence
  Synthetic
atgggtttaggcaccagaatgcagaagggacaggaacggctgcagatctcaagtcgactcaggcagctattgacc

SEQ ID NO: 210120 - DNA, 75 bp, Artificial Sequence
  Synthetic
cacaaatgcgataacacgtgcatggaaagtgtcaaaaatgggacttatgattacccaaaatactcagaggaagca

SEQ ID NO: 210121 - DNA, 75 bp, Artificial Sequence
  Synthetic
caccaaattgagaaggaatttgaacaagtagagggaagaatccaagacttggagaagtatgttgaagacacaaag

SEQ ID NO: 210122 - DNA, 75 bp, Artificial Sequence
  Synthetic
aagtagagggaagaatccaagacttggagaagtatgttgaagacacaaagattgacctgtggtcttacaatgctg

SEQ ID NO: 210123 - DNA, 75 bp, Artificial Sequence
  Synthetic
acagtctgggctcccagtagggggcaatgaaaagaaggccaaattggcaaatgttgtgagaaagatgatgactaa

SEQ ID NO: 210124 - DNA, 75 bp, Artificial Sequence
  Synthetic
ctttgagcaaataacttttatgcaagccttacaactattgcctgaagtggaggtcgagataagaactttctcgtt

SEQ ID NO: 210125 - DNA, 75 bp, Artificial Sequence
  Synthetic
gaaatgaacaaactctttgaaagagttaggcgccaactaagagagaatgctgaggacaaaggaaatggatgtttt

SEQ ID NO: 210126 - DNA, 75 bp, Artificial Sequence
  Synthetic
aaaggcaacgaacccgatcgtgccttcctttgacatgagtaatgaaggatcttatttcttcggagacaatgcaga

SEQ ID NO: 210127 - DNA, 75 bp, Artificial Sequence
  Synthetic
tagtgtggatggcatgccactctgctgcatttgaggatctaagggtatcaagtttcataagagggaagaaagtga

SEQ ID NO: 210128 - DNA, 75 bp, Artificial Sequence
  Synthetic
aggatacaaagacatcattctctggatttccttttccatatcatgctttttactcgttgcactacttttagcctt

SEQ ID NO: 210129 - DNA, 75 bp, Artificial Sequence
  Synthetic
tactcgttgcactacttttagcctttgttttgtgggcttgtcagaatggaaacatccggtgccagatttgcattt

SEQ ID NO: 210130 - DNA, 75 bp, Artificial Sequence
  Synthetic
agccaattagtgtggatggcatgccactctgcagcatttgaggaccttagggtctcaagtttcattagagggaca

SEQ ID NO: 210131 - DNA, 75 bp, Artificial Sequence
  Synthetic
caccttaatactactcagagctttcacagaagagggagcaattgtgggagaaatctcaccgttaccttctcttcc

SEQ ID NO: 210132 - DNA, 75 bp, Artificial Sequence
  Synthetic
ttagaaactgggaaactgtgaaaattcaatggtcacaagaccccacaatgttatataataagatggaattcgaac

SEQ ID NO: 210133 - DNA, 75 bp, Artificial Sequence
  Synthetic
gagtagatgaatactccagcacggagagagtggtagtgagtattgaccgatttttaagggttagagatcaaagag

SEQ ID NO: 210134 - DNA, 75 bp, Artificial Sequence
  Synthetic
cacttggctctgcttccctaactattgcgacaatatgtttactcattcagattgccatcttagcaacgactatga

SEQ ID NO: 210135 - DNA, 75 bp, Artificial Sequence
  Synthetic
aagatcaagatgaaatggggtatggaaatgaggcgctgccttcttcaatctcttcaacagatcgagagcatgatt

SEQ ID NO: 210136 - DNA, 75 bp, Artificial Sequence
  Synthetic
ccacactgtaaccggagtgtcagcatcatgctcccataatggggaaagaagtttttacagaaatctgatatggct

SEQ ID NO: 210137 - DNA, 75 bp, Artificial Sequence
  Synthetic
tgagctgtcctattggtgaagttccctctccatacaactcaagatttgagtcagtcgcttggtcagcaagtgctt

SEQ ID NO: 210138 - DNA, 75 bp, Artificial Sequence
  Synthetic
tgagggacgactaatccaaaatagcataacaatagagagaatggtgctctctgctttcgatgagagaagaaataa

SEQ ID NO: 210139 - DNA, 75 bp, Artificial Sequence
  Synthetic
aggcaaatggaaatctaatagctccatggtatgctttcgcactgagtagaggccttggatcaggaatcatcacct

SEQ ID NO: 210140 - DNA, 75 bp, Artificial Sequence
  Synthetic
atctggaatatcagataggatacatatgcagtggggttttcggagacaatccacgccctaatgataagacaggca

SEQ ID NO: 210141 - DNA, 75 bp, Artificial Sequence
  Synthetic
atgtagtgagaaagatgatgactaactcacaagataccgagctctcctttacaattactggagacaataccaaat

SEQ ID NO: 210142 - DNA, 75 bp, Artificial Sequence
  Synthetic
ggagagtgtgagaaatggaacttatgactacccaaaatattccgaagaatcaaagttaaacagggaaaaaattga

SEQ ID NO: 210143 - DNA, 75 bp, Artificial Sequence
  Synthetic
caaagttaaacagggaaaaaattgatggagtaaaattggactcaatgggggtctatcggattctggcgatctact

SEQ ID NO: 210144 - DNA, 75 bp, Artificial Sequence
  Synthetic
caactgtcgccagttccctggttcttttggtctccctgggggcaatcagcttctggatgtgttccaatgggtctt

SEQ ID NO: 210145 - DNA, 75 bp, Artificial Sequence
  Synthetic
atcctctgatgatttcgctctcatagtgaatgcaccgaatcatgagggcatacaagcgggagtggacaggttcta

SEQ ID NO: 210146 - DNA, 75 bp, Artificial Sequence
  Synthetic
agcaaaagcagggtgacaaagacataatggatccaaacactgtgtcaagctttcaggtagattgctttctttggc

SEQ ID NO: 210147 - DNA, 75 bp, Artificial Sequence
  Synthetic
taaatcggacagggacatttgagttcacaagttttttctaccgctatggatttgtagccaacttcagtatggagc

SEQ ID NO: 210148 - DNA, 75 bp, Artificial Sequence
  Synthetic
gatcggcttcgccgagatcagaaatccctaagaggaaggggcagcactcttggtctggacatcgagacagccaca

SEQ ID NO: 210149 - DNA, 75 bp, Artificial Sequence
  Synthetic
gaggcaataattgtggccatggtattctcacaagaggattgcatgatcaaggcagttaggggcgatttgaacttt

SEQ ID NO: 210150 - DNA, 75 bp, Artificial Sequence
  Synthetic
ggcacttaaaatgaccatggcctctgtacctgcgtcgcgttacctaaccgacatgactcttgaggaaatgtcaag

SEQ ID NO: 210151 - DNA, 75 bp, Artificial Sequence
  Synthetic
aacaaaggctgaacaaaaggagctacctgataagagcgctgacactgaacacaatgaccaaggatgcagaaagag

SEQ ID NO: 210152 - DNA, 75 bp, Artificial Sequence
  Synthetic
cagaaagtggcaggccctctttgtatcagaatggaccaggcgatcatggataaaaacatcatactgaaagcgaac

SEQ ID NO: 210153 - DNA, 75 bp, Artificial Sequence
  Synthetic
gattttgaaagaggaatccagcgagacacttagaatgacaattgcatctgtacctacttcgcgctacatttctga

SEQ ID NO: 210154 - DNA, 75 bp, Artificial Sequence
  Synthetic
atctcctggcttggaagcaagtactggcagaactccaagatatcgaaaatgatgagaaaattccgaaaacaaaaa

SEQ ID NO: 210155 - DNA, 75 bp, Artificial Sequence
  Synthetic
aacagaaacgagaaatggcgggaacaattaggtcagaagtttgaagaaataagatggttgattgaagaagtgaga

SEQ ID NO: 210156 - DNA, 75 bp, Artificial Sequence
  Synthetic
cttaaaagtgccagcacaaaatgctataagcacaactttcccttataccggagaccctccttacagccatgggac

SEQ ID NO: 210157 - DNA, 75 bp, Artificial Sequence
  Synthetic
ataagcacaactttcccttataccggagaccctccttacagccatgggacaggaacaggatacaccatggatact

SEQ ID NO: 210158 - DNA, 75 bp, Artificial Sequence
  Synthetic
cgaaactggagcaccgcaactcaacccgattgatgggccactgccagaagacaatgaaccaagtggttatgccca

SEQ ID NO: 210159 - DNA, 75 bp, Artificial Sequence
  Synthetic
ccgattgatgggccactgccagaagacaatgaaccaagtggttatgcccaaacagattgtgtattggaagcaatg

SEQ ID NO: 210160 - DNA, 75 bp, Artificial Sequence
  Synthetic
ggcacaggacaagcagcagatcttaaaagcactcaagcagcaatcaaccaaatcaccgggaaactaaatagagta

SEQ ID NO: 210161 - DNA, 75 bp, Artificial Sequence
  Synthetic
aaagcactcaagcagcaatcaaccaaatcaccgggaaactaaatagagtaatcaagaaaacgaacgagaaattcc

SEQ ID NO: 210162 - DNA, 75 bp, Artificial Sequence
  Synthetic
aatcaccgggaaactaaatagagtaatcaagaaaacgaacgagaaattccatcaaatcgaaaaagaattctcaga

SEQ ID NO: 210163 - DNA, 75 bp, Artificial Sequence
  Synthetic
atgcgaataataccactgacgactatactactattagtaacaacaagcaatgcagataaaatatgcattggccac

SEQ ID NO: 210164 - DNA, 75 bp, Artificial Sequence
  Synthetic
aacgatggaggttgttcagcaaacacgagtagacaagctgacacaaggccgacagacctatgactggactttaaa

SEQ ID NO: 210165 - DNA, 75 bp, Artificial Sequence
  Synthetic
cgagtagacaagctgacacaaggccgacagacctatgactggactttaaatagaaaccagcctgctgcaacagca

SEQ ID NO: 210166 - DNA, 75 bp, Artificial Sequence
  Synthetic
ggaggtttcacttttaaaaggacaagtggatcatctatcaaaagggaggaggaagtgctcacgggcaatctccag

SEQ ID NO: 210167 - DNA, 75 bp, Artificial Sequence
  Synthetic
gtctggaaggctcatagacttccttaaggatgtaatggagtcaatgaaaaaagaagaaatggggatcacaactca

SEQ ID NO: 210168 - DNA, 75 bp, Artificial Sequence
  Synthetic
tcccaagaggaaccgctctattctcaacacaagccaaaggggaattcttgaggatgaacagatgtaccagaagtg

SEQ ID NO: 210169 - DNA, 75 bp, Artificial Sequence
  Synthetic
acgaagagcaacagccattctaaggaaagcaaccagaaggttgatacaactgatagtgagtggaagagatgaaca

SEQ ID NO: 210170 - DNA, 75 bp, Artificial Sequence
  Synthetic
aaggatgtaatggagtcaatgaaaaaagaagaaatggggatcacaactcattttcagagaaagagacgggtgaga

SEQ ID NO: 210171 - DNA, 75 bp, Artificial Sequence
  Synthetic
tcctaaaagaaatcgttccattctcaacacgagtcaaaggggaattcttgaggatgaacagatgtaccaaaagtg

SEQ ID NO: 210172 - DNA, 75 bp, Artificial Sequence
  Synthetic
acagagattgaacaaaaggagttatctaattagagcattgaccctgaacacaatgaccaaagatgctgagagagg

SEQ ID NO: 210173 - DNA, 75 bp, Artificial Sequence
  Synthetic
ctaattagagcattgaccctgaacacaatgaccaaagatgctgagagagggaagctaaaacggagagcaattgca

SEQ ID NO: 210174 - DNA, 75 bp, Artificial Sequence
  Synthetic
aaggagtatatgtgagaaacttgaacaatcagggttgccagttggaggcaatgagaagaaagcaaagttggcaaa

SEQ ID NO: 210175 - DNA, 75 bp, Artificial Sequence
  Synthetic
caatcagggttgccagttggaggcaatgagaagaaagcaaagttggcaaatgttgtaaggaagatgatgaccaat

SEQ ID NO: 210176 - DNA, 75 bp, Artificial Sequence
  Synthetic
caatgggacctccaaaatcaagatgaaatggggtatggaaatgagacgctgccttcttcaatctctccaacagat

SEQ ID NO: 210177 - DNA, 75 bp, Artificial Sequence
  Synthetic
gaacgaaaatcagaatcctcggatgtttttggccatgatcacatatatgaccagaaatcagcccgaatggttcag

SEQ ID NO: 210178 - DNA, 75 bp, Artificial Sequence
  Synthetic
tttttggccatgatcacatatatgaccagaaatcagcccgaatggttcagaaatgttctaagtattgctccaata

SEQ ID NO: 210179 - DNA, 75 bp, Artificial Sequence
  Synthetic
aggagtgggccgacgacaagtacagttcattatccaaaagtttacaaaacatacttcgagaaggttgaaaggtta

SEQ ID NO: 210180 - DNA, 75 bp, Artificial Sequence
  Synthetic
caagagtatgaaacttagaactcaaatacctgcagaaatgctagcaagcattgatttgaaatatttcaatgattc

SEQ ID NO: 210181 - DNA, 75 bp, Artificial Sequence
  Synthetic
gctaagggagcaattgagttcagtatcttcatttgagagattcgagatattccccaaagaaagctcatggcccaa

SEQ ID NO: 210182 - DNA, 75 bp, Artificial Sequence
  Synthetic
atacctgcagaaatgctagcaagcattgatttgaaatatttcaatgattcaacaagaaagaagattgaaaaaatc

SEQ ID NO: 210183 - DNA, 75 bp, Artificial Sequence
  Synthetic
caaaccatttgaatggatgtcaatccgaccctacttttcctaaaggttccagcgcagaatgccataagcatcaca

SEQ ID NO: 210184 - DNA, 75 bp, Artificial Sequence
  Synthetic
aatgcttcaatccaatgatcgtcgagcttgcggaaaaggcaatgaaagaatatggggaagatccaaaaatcgaaa

SEQ ID NO: 210185 - DNA, 75 bp, Artificial Sequence
  Synthetic
ttcccttatactggagatcctccatacagccatggaacaggaacaggatacaccatggacacagtcaacagaaca

SEQ ID NO: 210186 - DNA, 75 bp, Artificial Sequence
  Synthetic
gggcatgttcaatatgttaagcactgtattaggcgtctccatcctgaatcttggacaaaagagatacaccaagac

SEQ ID NO: 210187 - DNA, 75 bp, Artificial Sequence
  Synthetic
gtattaggcgtctccatcctgaatcttggacaaaagagatacaccaagactacttactggtgggatggtcttcaa

SEQ ID NO: 210188 - DNA, 75 bp, Artificial Sequence
  Synthetic
tgcgacaatatgtttactcattcaaattgccatcttagcaacgactatgacgctacatttcaagcagaacgaata

SEQ ID NO: 210189 - DNA, 75 bp, Artificial Sequence
  Synthetic
tcaagccggagtcgacaggttttatcgaacctgtaagctacatggaatcaatatgagcaagaaaaagtcttacat

SEQ ID NO: 210190 - DNA, 75 bp, Artificial Sequence
  Synthetic
cgaacctgtaagctacatggaatcaatatgagcaagaaaaagtcttacataaacagaacaggtacatttgaattc

SEQ ID NO: 210191 - DNA, 75 bp, Artificial Sequence
  Synthetic
ttgggtcagaggccaatcagggaggataagcatctactggacaatagtgaagccgggagatgtactagtaattaa

SEQ ID NO: 210192 - DNA, 75 bp, Artificial Sequence
  Synthetic
ggcagcaactgcattggccaacaccatagaagtttttagatcaaatggtctaacagctaatgagtcaggaaggct

SEQ ID NO: 210193 - DNA, 75 bp, Artificial Sequence
  Synthetic
tcccagttttggtgtgtctgggagcaacgagtcagcggacatgagtattggagttactgtcatcaaaaacaatat

SEQ ID NO: 210194 - DNA, 75 bp, Artificial Sequence
  Synthetic
gaggatcagctcatcctttagttttggaggtttcactttcaaaagaacaagtgggtcatctgtcgcgaaggaaga

SEQ ID NO: 210195 - DNA, 75 bp, Artificial Sequence
  Synthetic
aacgagtcagcggacatgagtattggagttactgtcatcaaaaacaatatgataaacaatgatcttggtccagca

SEQ ID NO: 210196 - DNA, 75 bp, Artificial Sequence
  Synthetic
ccgatgccatagaggtgacacacaaatacaaacccgaagatcatttgaaataaagaaactgtgggagcaaacccg

SEQ ID NO: 210197 - DNA, 75 bp, Artificial Sequence
  Synthetic
atacaaacccgaagatcatttgaaataaagaaactgtgggagcaaacccgttccaaagctggactgctggtctcc

SEQ ID NO: 210198 - DNA, 75 bp, Artificial Sequence
  Synthetic
ctgcctaaaatgggaattgatggatgaggattaccaggggcgtttatgcaacccactgaacccatttgtcagcca

SEQ ID NO: 210199 - DNA, 75 bp, Artificial Sequence
  Synthetic
gaggattaccaggggcgtttatgcaacccactgaacccatttgtcagccataaagaaattgaatcaatgaacaat

SEQ ID NO: 210200 - DNA, 75 bp, Artificial Sequence
  Synthetic
gctggatccagagtgaattcaataaggcatgtgaattgaccgattcaagctggatagaacttgatgaaataggag

SEQ ID NO: 210201 - DNA, 75 bp, Artificial Sequence
  Synthetic
tgttgcaacaacacactcctggatccccaaaagaaatcgatccatcttgaatacaagtcaaagaggagtacttga

SEQ ID NO: 210202 - DNA, 75 bp, Artificial Sequence
  Synthetic
ccgagtggttcagaaacatcctgagcatggcacccataatgttctcaaacaaaatggcaagactaggaaaagggt

SEQ ID NO: 210203 - DNA, 75 bp, Artificial Sequence
  Synthetic
tgcaatttatttgaaaaattcttccccagcagttcatacagaagaccagtcgggatatccagtatggtggaggct

SEQ ID NO: 210204 - DNA, 75 bp, Artificial Sequence
  Synthetic
catttgatactgtccagataataaagctgctaccatttgcagcagcaccacctgagcagagcagaatgcagtttt

SEQ ID NO: 210205 - DNA, 75 bp, Artificial Sequence
  Synthetic
tattctctgttgaaggaaaaatctgcatcaacaggtgtttttatgtggagttaataagagggagaccacaggagg

SEQ ID NO: 210206 - DNA, 75 bp, Artificial Sequence
  Synthetic
cgctacctaactgacatgactcttgaagagatgtcaagagactggttcatgctcatgcccaaacagaaagtggca

SEQ ID NO: 210207 - DNA, 75 bp, Artificial Sequence
  Synthetic
aaccaaagaaggaagacggaaaacaaacctgtatgggttcattataaaaggaagatctcatttgagaaatgatac

SEQ ID NO: 210208 - DNA, 75 bp, Artificial Sequence
  Synthetic
aagagaccgaacaatggcctggacagtggtgaacagcatctgcaacaccacaggagtcgagaaacccaaatttct

SEQ ID NO: 210209 - DNA, 75 bp, Artificial Sequence
  Synthetic
tgactaaggaattctttgaaaacaaatcggaaacatggccaatcggagagtcacccaggggagtggaggaaggct

SEQ ID NO: 210210 - DNA, 75 bp, Artificial Sequence
  Synthetic
ccaggctgttcactataaggcaagaaatggccagtaggagtctatgggattcctttcgccagtcagagagaggcg

SEQ ID NO: 210211 - DNA, 75 bp, Artificial Sequence
  Synthetic
cctgggttttgcttaatgcatcctggttcaactccttcctcacacatgcactgaagtagttgtggcaatgctact

SEQ ID NO: 210212 - DNA, 75 bp, Artificial Sequence
  Synthetic
ttaagtatcgaagacccgagtcatgaaggggaggggataccactttatgatgcaatcaaatgcatgaagactttt

SEQ ID NO: 210213 - DNA, 75 bp, Artificial Sequence
  Synthetic
gccatggatgacttccaattgattccaatgataagcaaatgcagaaccaaagaaggaagacggaagacaaatctg

SEQ ID NO: 210214 - DNA, 75 bp, Artificial Sequence
  Synthetic
aaccaggctgttcaccataagacaagaaatggccaacagaggcctctgggattcctttcgtcagtccgaaagagg

SEQ ID NO: 210215 - DNA, 75 bp, Artificial Sequence
  Synthetic
tcaagtagtgccatgtgaaccaatcataatagagaggaacataacagagatagtgtatttgaataatactaccat

SEQ ID NO: 210216 - DNA, 75 bp, Artificial Sequence
  Synthetic
gggggctatatgaagcaattgaggagtgcctgattaatgatccctgggttttgcttaatgcatcttggttcaact

SEQ ID NO: 210217 - DNA, 75 bp, Artificial Sequence
  Synthetic
aggtggttaattgaagaagtacggcacagattgaaagcgacagagaatagtttcgaacaaataacatttatgcaa

SEQ ID NO: 210218 - DNA, 75 bp, Artificial Sequence
  Synthetic
cagaactcaggagtcagagtgcgtttgcatcagtgggacttgcacagtagtaatgactgatggaagtgcatcagg

SEQ ID NO: 210219 - DNA, 75 bp, Artificial Sequence
  Synthetic
catgactaaagaattctttgaaaacaaatcagaaacatggccaattggggagtcccccaaaggggtggaagaagg

SEQ ID NO: 210220 - DNA, 75 bp, Artificial Sequence
  Synthetic
tgtgggtgaggttccctccccatacaactcaaggtttgagtctgttgcttggtcagcaagtgcttgccatgatgg

SEQ ID NO: 210221 - DNA, 75 bp, Artificial Sequence
  Synthetic
aatatgcttccttatgcaagttgccatcctggtgactactgtaacactgcatttcaagcaatatgattgcgactc

SEQ ID NO: 210222 - DNA, 75 bp, Artificial Sequence
  Synthetic
ttccaagaggaaagctttccacaagaggggtccagattgcttcaaatgagaatgtggaaaccatggactccaata

SEQ ID NO: 210223 - DNA, 75 bp, Artificial Sequence
  Synthetic
gctcaaaggcaggactgctggtctcagatggaggaccaaatctatacaatatccggaatctccacattccggaag

SEQ ID NO: 210224 - DNA, 75 bp, Artificial Sequence
  Synthetic
tgtgaaccaacaataatagaaagaaacaaaacggagattgtgtatctgaccaacaccattgtagagaaggaaata

SEQ ID NO: 210225 - DNA, 75 bp, Artificial Sequence
  Synthetic
gatgtacactccaggaggagaagtgagaaatgatgatgtcgaccagagtttgatcattgctgccagaaatattgt

SEQ ID NO: 210226 - DNA, 75 bp, Artificial Sequence
  Synthetic
tgctgtggtgatgccagctcatggcccagccaagagcatggaatatgatgctgttgctaccacgcactcctggat

SEQ ID NO: 210227 - DNA, 75 bp, Artificial Sequence
  Synthetic
tagcaaaatggaaataataccactgatgactatactgctattagtaacaacaaacaatgcagataaaatatgcat

SEQ ID NO: 210228 - DNA, 75 bp, Artificial Sequence
  Synthetic
aagtgttatcaatttgcccttgggcagggaacaacactaaacaacgggcattcaaatgacactgtacatgatagg

SEQ ID NO: 210229 - DNA, 75 bp, Artificial Sequence
  Synthetic
tcaaataggatatatatgcagtggagttttcggagacaatccacgccccaatgatggaacaggtagttgtggccc

SEQ ID NO: 210230 - DNA, 75 bp, Artificial Sequence
  Synthetic
acaattgggtaattgcagcattgccggatggatattaggaaacccagaatgcgaatcactgatttccaagaaatc

SEQ ID NO: 210231 - DNA, 75 bp, Artificial Sequence
  Synthetic
ggatggatattaggaaacccagaatgcgaatcactgatttccaagaaatcatggtcctacattgtagaaacacca

SEQ ID NO: 210232 - DNA, 75 bp, Artificial Sequence
  Synthetic
tcggaatgcgtttgtattaatggaacttgtacagtagtcatgactgatggaagcgcttccggaaaagctgatact

SEQ ID NO: 210233 - DNA, 75 bp, Artificial Sequence
  Synthetic
cttgtacagtagtcatgactgatggaagcgcttccggaaaagctgatactaagatattattcattgaggagggga

SEQ ID NO: 210234 - DNA, 75 bp, Artificial Sequence
  Synthetic
caggggagttcgccgactatgaggagctaagggagcaattgagttcagtatcttcatttgagagattcgaaatat

SEQ ID NO: 210235 - DNA, 75 bp, Artificial Sequence
  Synthetic
gctaagggagcaattgagttcagtatcttcatttgagagattcgaaatattccccaaagaaagctcatggcccaa

SEQ ID NO: 210236 - DNA, 75 bp, Artificial Sequence
  Synthetic
tacacatgcccaagacatactggaaaagacacacaacgggaagctctgcgatctaaatggagtgaaacctctgat

SEQ ID NO: 210237 - DNA, 75 bp, Artificial Sequence
  Synthetic
tggacttgttggagacacacccagaaaaaacgacagcttcagcagtagtcattgcctagatcctaacaatgagga

SEQ ID NO: 210238 - DNA, 75 bp, Artificial Sequence
  Synthetic
aatggtctgattggaagaattaattattattggtcggtactaaaaccaggccagacattgcgagtaagatccaat

SEQ ID NO: 210239 - DNA, 75 bp, Artificial Sequence
  Synthetic
tggctcctcggaaacccaatgtgtgacgaattcatcaatgtgccagaatggtcttacatagtagagaaggccaat

SEQ ID NO: 210240 - DNA, 75 bp, Artificial Sequence
  Synthetic
acaaagagaaagaagtccttatactatggggtattcatcatccgcctaacatagagaaccaaaggaccctctatc

SEQ ID NO: 210241 - DNA, 75 bp, Artificial Sequence
  Synthetic
acacagaaaatgcttatgtctctgtagtgtcttcatattatagcggaagattcaccccagaaataaccaaaaggc

SEQ ID NO: 210242 - DNA, 75 bp, Artificial Sequence
  Synthetic
ccaaagtaagagatcaggaaggaagaatcaactactactggactctgctggaacccggggatacaataatatttg

SEQ ID NO: 210243 - DNA, 75 bp, Artificial Sequence
  Synthetic
aaagtcatcaaaggatggtccaaacccaacttcaaattacagacaaataggcaagttatagttggtagaggtaac

SEQ ID NO: 210244 - DNA, 75 bp, Artificial Sequence
  Synthetic
gaacccggggatacaataatatttgaggcaaatggaaatctaatagcgccatggtatgctttcacactgactaga

SEQ ID NO: 210245 - DNA, 75 bp, Artificial Sequence
  Synthetic
agccagctggtatggatggcatgtcattctgcagcatttgaagacttgagagtgtcgagcttcatcagaggaaca

SEQ ID NO: 210246 - DNA, 75 bp, Artificial Sequence
  Synthetic
gctataaacagcagtcttcctttccagaatgtacacccagtcacaataggagaatgtccaaagtatgtcaggagt

SEQ ID NO: 210247 - DNA, 75 bp, Artificial Sequence
  Synthetic
gcatctgcaggacaaatcagtgttcaaccaactttctcagtacagagaaaccttcctttcgagagagcaaccatc

SEQ ID NO: 210248 - DNA, 75 bp, Artificial Sequence
  Synthetic
cagtatgatagcgatgagccagagcctagatcgctagcaagctggatccagagtgaattcaataaggcatgtgaa

SEQ ID NO: 210249 - DNA, 75 bp, Artificial Sequence
  Synthetic
tgtgatgatcaatgcatggaaactattcggaacgggacctataataggagaaagtacaaagaggaatcaagacta

SEQ ID NO: 210250 - DNA, 75 bp, Artificial Sequence
  Synthetic
ggttctactggaaaatgaaagaactttggacttccacgactccaatgtgaagagtttgtacgagaaagtaaaaag

SEQ ID NO: 210251 - DNA, 75 bp, Artificial Sequence
  Synthetic
atgcagagagaggaaaattaaaaaggagggctatcgcaacacctgggatgcaaatcagaggtttcgtgtattttg

SEQ ID NO: 210252 - DNA, 75 bp, Artificial Sequence
  Synthetic
ccaattaaagaataatgctaaggaaatagggaatgggtgctttgaattctatcacaagtgtaacaacgaatgcat

SEQ ID NO: 210253 - DNA, 75 bp, Artificial Sequence
  Synthetic
aatctactcaaaaggcaatagacggagtcaccaataaggtcaactcgatcattgacaaaatgaacactcagtttg

SEQ ID NO: 210254 - DNA, 75 bp, Artificial Sequence
  Synthetic
gaacacaaatacctgcagaaatgctagcaagcattgatctgaagtatttcaatgaatcaacaaggaagaaaattg

SEQ ID NO: 210255 - DNA, 75 bp, Artificial Sequence
  Synthetic
tagagaattctttgagaacaagtcggagacatggccaattggagaatcccccagaggagttgaggaaggctctat

SEQ ID NO: 210256 - DNA, 75 bp, Artificial Sequence
  Synthetic
tagatgtctggacttataatgctgagcttctggttctcatggaaaatgagagaactctagacttccatgattcaa

SEQ ID NO: 210257 - DNA, 75 bp, Artificial Sequence
  Synthetic
ttagtagggatcaatatgagcaaaaagaagtcctatataaataagactgggacatttgaattcacaagctttttt

SEQ ID NO: 210258 - DNA, 75 bp, Artificial Sequence
  Synthetic
tgatagtaagcggaagggatgaacaatcaatcgctgaagcgatcattgtagcaatggtgttctcacaggaggatt

SEQ ID NO: 210259 - DNA, 75 bp, Artificial Sequence
  Synthetic
atctggcgatccgaatgcattattgaaacaccgatttgagataattgaagggagagaccgaacaatggcttggac

SEQ ID NO: 210260 - DNA, 75 bp, Artificial Sequence
  Synthetic
ggctttccttgaagaatcccacccagggatatttgagaattcatgccttgaaacaatggaaattgttcaacaaac

SEQ ID NO: 210261 - DNA, 75 bp, Artificial Sequence
  Synthetic
ccatggatgactttcagctgatcccaatgataagcaaatgtaggaccaaagaaggaagacgaaaaacaaatctgt

SEQ ID NO: 210262 - DNA, 75 bp, Artificial Sequence
  Synthetic
cgaggagcatttgtgagaaacttgagcaatctggactccctgttggaggaaatgagaagaaagccaaattggcaa

SEQ ID NO: 210263 - DNA, 75 bp, Artificial Sequence
  Synthetic
agggcatctgttggaagaatggttagtggcattgggagattctacatacagatgtgtacagaactcaaactcagt

SEQ ID NO: 210264 - DNA, 75 bp, Artificial Sequence
  Synthetic
ccaagttaaaataagacggagggttgacacaaaccctggtcatgcagatctcagtgccaaggaggcacaggatgt

SEQ ID NO: 210265 - DNA, 75 bp, Artificial Sequence
  Synthetic
ggatgatcggaatattgcctgacatgactccaagcacagagatgtcactgaggggggtaagaattagtaagatgg

SEQ ID NO: 210266 - DNA, 75 bp, Artificial Sequence
  Synthetic
gtgaatgcaccgaatcatgaggggatacaagccggagtggataggttctataggacctgcaaactggttgggatc

SEQ ID NO: 210267 - DNA, 75 bp, Artificial Sequence
  Synthetic
tagcctcgacatcgaaacagccactcttgttgggaaacaaattgtggagtggattttgaaagaggaatccagcga

SEQ ID NO: 210268 - DNA, 75 bp, Artificial Sequence
  Synthetic
aggaacaagccgtggacatatgcaaggcagcaatggggctgaggattagctcctctttcagctttggtgggttca

SEQ ID NO: 210269 - DNA, 75 bp, Artificial Sequence
  Synthetic
ctggcaatcatgatggctggtctatctttatggatgtgttccaacgggtcgttacagtgcagaatttgcatttaa

SEQ ID NO: 210270 - DNA, 75 bp, Artificial Sequence
  Synthetic
acgggcaacctccaaacactgaaaataagagtacatgaagggtatgaagaattcacaatggtcgggagaagagca

SEQ ID NO: 210271 - DNA, 75 bp, Artificial Sequence
  Synthetic
tgctggctagcactacggcaaaggctatggaacaggtggctggatcaagtgaacaggcagcagaggccatggagg

SEQ ID NO: 210272 - DNA, 75 bp, Artificial Sequence
  Synthetic
tgaagattaccaaggcagactgtgtaatcctctgaatccatttgtcagtcataaggaaattgaatctgtaaacaa

SEQ ID NO: 210273 - DNA, 75 bp, Artificial Sequence
  Synthetic
gtctgcactcatcctgagaggatcagtggcccataagtcctgcttgcctgcttgtgtgtacggacttgcagtggc

SEQ ID NO: 210274 - DNA, 75 bp, Artificial Sequence
  Synthetic
atggggtgttcatcatccgcctaacatagagaaccaaaggactctctatcacacagagacaacttatgtctctgt

SEQ ID NO: 210275 - DNA, 75 bp, Artificial Sequence
  Synthetic
atggatcccaacactgtgtcaagcttccaggtagactgctttctttggcatgtccgcaaacggtttgcagaccaa

SEQ ID NO: 210276 - DNA, 75 bp, Artificial Sequence
  Synthetic
tggagctgattcggatgataaaacgagggatcaacgaccggaatttctggagaggcgaaaatggaagaagaacaa

SEQ ID NO: 210277 - DNA, 75 bp, Artificial Sequence
  Synthetic
gagcaggttgacacaataatggaaaagaacgttactgttacacatgcccaagacatactggaaaagacacacaac

SEQ ID NO: 210278 - DNA, 75 bp, Artificial Sequence
  Synthetic
aaaatgaacactcaattcacagctgtgggcaaggaattcaacaaattggaaagaaggatggaaaacttaaataaa

SEQ ID NO: 210279 - DNA, 75 bp, Artificial Sequence
  Synthetic
atcacaagtgtaacaacgaatgcatggagagtgtgaaaaatggaacttatgactatccaaaatattccgaagaat

SEQ ID NO: 210280 - DNA, 75 bp, Artificial Sequence
  Synthetic
tgtgagcagattgctgattcacagcatcggtctcacagacagatggcaactatcaccaacccactaatcaggcat

SEQ ID NO: 210281 - DNA, 75 bp, Artificial Sequence
  Synthetic
gtcaaaatggagaaaatagtgcttctttttgcgatagtcagtcttgttaaaagtgaccagatttgcattggctac

SEQ ID NO: 210282 - DNA, 75 bp, Artificial Sequence
  Synthetic
ttgacacgataatggaaaagaacgttactgttacacatgcccaagacatactagaaaagacacataacggaaagc

SEQ ID NO: 210283 - DNA, 75 bp, Artificial Sequence
  Synthetic
gaggattagctcctctttcagctttggtggcttcaccttcaaaagaacaagcggatcatcagttaagaaagaaga

SEQ ID NO: 210284 - DNA, 75 bp, Artificial Sequence
  Synthetic
tgtgtgacgaattcatcaatgtgccagaatggtcttatatagtggagaaggccaatccagtcaatgacctctgct

SEQ ID NO: 210285 - DNA, 75 bp, Artificial Sequence
  Synthetic
ataaaccattttgagaaaattcagatcatccccaagaattcttggcccagtcatgaagcctcattgggggtgagc

SEQ ID NO: 210286 - DNA, 75 bp, Artificial Sequence
  Synthetic
tcatccccaagaattcttggcccagtcatgaagcctcattgggggtgagcgcagcatgtccataccaggggcagt

SEQ ID NO: 210287 - DNA, 75 bp, Artificial Sequence
  Synthetic
ccaacaataaagaggagttacaataataccaaccaagaagatcttttggtaatgtgggggatccaccatcctaat

SEQ ID NO: 210288 - DNA, 75 bp, Artificial Sequence
  Synthetic
ctcagattgcctgatgggcctccctgctctcagcggtcgaaattcttgctgatggatgctctgaaattaagcatt

SEQ ID NO: 210289 - DNA, 75 bp, Artificial Sequence
  Synthetic
cgttgggacgtcaacattaaaccagagattgacaccaagaatagctactagatccaaagtaaacggacaaagtgg

SEQ ID NO: 210290 - DNA, 75 bp, Artificial Sequence
  Synthetic
gagtagatgaatattccagcacggagagagtggtagtgagcattgaccgatttttgagggttcgggatcaacgag

SEQ ID NO: 210291 - DNA, 75 bp, Artificial Sequence
  Synthetic
agagggataagagtcagtaaaatgggagtagatgaatattccagcacggagagagtggtagtgagcattgaccga

SEQ ID NO: 210292 - DNA, 75 bp, Artificial Sequence
  Synthetic
cagagcaagaatcaaaaccaggctgttcaccataagacaagaaatggccagcaggggtctatgggattcctttcg

SEQ ID NO: 210293 - DNA, 75 bp, Artificial Sequence
  Synthetic
ggtcagcgaaacacaaggaacagagaaattgacaataacttattcatcatcaatgatgtgggagatcaatggtcc

SEQ ID NO: 210294 - DNA, 75 bp, Artificial Sequence
  Synthetic
tgagggcaagctttctcaaatgtcaaaagaagtgaacgccaggattgaaccatttctgaagacaacaccacgtcc

SEQ ID NO: 210295 - DNA, 75 bp, Artificial Sequence
  Synthetic
tccacaatatacatcctctcactattggagaatgccccaaatatgtgaaatcaaccagattagtccttgcgactg

SEQ ID NO: 210296 - DNA, 75 bp, Artificial Sequence
  Synthetic
cctcgctgactgtgaatgtgagaggatcagggttgaggatactggtaagaggcaattctccagtgttcaattaca

SEQ ID NO: 210297 - DNA, 75 bp, Artificial Sequence
  Synthetic
tatagatggagtcaccaataaggtcaactcgatcattgacaaaatgaacactcagtttgaggctgttgggaggga

SEQ ID NO: 210298 - DNA, 75 bp, Artificial Sequence
  Synthetic
atgaaagtaaaaataatggttctgctatgtacacttacagctacatacgcagacacaatatgtgtaggctaccat

SEQ ID NO: 210299 - DNA, 75 bp, Artificial Sequence
  Synthetic
tcactacctccagagcagaaatgaaaagtggcgagagcaattgggacagaaatttgaggaaataaggtggttaat

SEQ ID NO: 210300 - DNA, 75 bp, Artificial Sequence
  Synthetic
acacagtacttgagaagaatgtgacagtgacacactctgtcaacctacttgagaacagccacaatggaaaactat

SEQ ID NO: 210301 - DNA, 75 bp, Artificial Sequence
  Synthetic
ggatggatcttaggaaacccagattgcgaattgctgatttccaaggaatcatggtcctacattgtagaaacacca

SEQ ID NO: 210302 - DNA, 75 bp, Artificial Sequence
  Synthetic
gcgaattgctgatttccaaggaatcatggtcctacattgtagaaacaccaaatcctgagaatggaacatgttacc

SEQ ID NO: 210303 - DNA, 75 bp, Artificial Sequence
  Synthetic
tcttcatttaagaggttccaaatattccccaaagagagctcatggcccaaccacaccgtaaccggagtgtcatca

SEQ ID NO: 210304 - DNA, 75 bp, Artificial Sequence
  Synthetic
gagttccctagcactggcaatcatggtagctggtctatccttatggatgtgctccaatgggtcgttacaatgcag

SEQ ID NO: 210305 - DNA, 75 bp, Artificial Sequence
  Synthetic
tccccaaagagagctcatggcccaaccacaccgtaaccggagtgtcatcatcatgctcccataacgggaaaagca

SEQ ID NO: 210306 - DNA, 75 bp, Artificial Sequence
  Synthetic
tcgatactgaatcttggacaaaagaaatacaccaagacaatatactggtgggatgggctccaatcatccgacgat

SEQ ID NO: 210307 - DNA, 75 bp, Artificial Sequence
  Synthetic
aacctgagcaagtcctatacaaacaaaaaggagaaagaagtccttgtactatggggtgttcatcacccatctaac

SEQ ID NO: 210308 - DNA, 75 bp, Artificial Sequence
  Synthetic
aaaaggagaaagaagtccttgtactatggggtgttcatcacccatctaacataggggaccaaaaggccctctatc

SEQ ID NO: 210309 - DNA, 75 bp, Artificial Sequence
  Synthetic
ttcaccccagaaatagtcaaaagacccaaggtgagaaatcaggaaggaagaatcaactactactggactctgcta

SEQ ID NO: 210310 - DNA, 75 bp, Artificial Sequence
  Synthetic
aagcaaatggaaatctaatagcaccaaggtatgccttcgaactgagtaaaggttttggatcaggaataatcacat

SEQ ID NO: 210311 - DNA, 75 bp, Artificial Sequence
  Synthetic
cagttgcatgggtctcatatacaacaggatgggaacggtgaccacagaagtggcttttggcctagtgtgtgccac

SEQ ID NO: 210312 - DNA, 75 bp, Artificial Sequence
  Synthetic
atctaatgtcacagtcccgcactcgcgagatactcactaagaccactgtggaccatatggccataatcaaaaagt

SEQ ID NO: 210313 - DNA, 75 bp, Artificial Sequence
  Synthetic
gtgacaccacaattacatacaacaacactgtggtaaacaacataacaacaacaataataaataaagcggaaaagc

SEQ ID NO: 210314 - DNA, 75 bp, Artificial Sequence
  Synthetic
ggtttcattgaaggagggtggactggaatggtagatggttggtatggttatcaccatcagaatgagcaaggatcc

SEQ ID NO: 210315 - DNA, 75 bp, Artificial Sequence
  Synthetic
aagggagccttatgtcagttgcgacaatgatgattgctggtcctttgcccttgcccaaggggctctactaggaac

SEQ ID NO: 210316 - DNA, 75 bp, Artificial Sequence
  Synthetic
acggagatgtcgctgagagggataagagtcagcaaaatgggagtagatgaatactccagcacggagagagtggta

SEQ ID NO: 210317 - DNA, 75 bp, Artificial Sequence
  Synthetic
catcaatcggtgcttttatgtggagttgataaggggaaggaaagaggaaactaaagtctggtggacctcaaacag

SEQ ID NO: 210318 - DNA, 75 bp, Artificial Sequence
  Synthetic
cggcatctcaagaatgtcaatctgcatgtcaggacctaataacaatgcttcggcagtggtctggtacaagggaag

SEQ ID NO: 210319 - DNA, 75 bp, Artificial Sequence
  Synthetic
atggaagactttgtgcgacaatgcttcaatccaatgatcgtcgagcttgcggaaaaggcaatgaaagaatatgga

SEQ ID NO: 210320 - DNA, 75 bp, Artificial Sequence
  Synthetic
tatacgactacaaagaaaaccgattcgttgaaattggagtgacacgaagggaggtccacatatactacctagaga

SEQ ID NO: 210321 - DNA, 75 bp, Artificial Sequence
  Synthetic
aagccaacaaaataaaatccgagaagacacacattcacattttttcattcactggagaggagatggccaccaaag

SEQ ID NO: 210322 - DNA, 75 bp, Artificial Sequence
  Synthetic
gggatctttgaaaactcttgtcttgaaacgatggaaattgttcaacaaacaagagtggacaaactgactcaaggt

SEQ ID NO: 210323 - DNA, 75 bp, Artificial Sequence
  Synthetic
gaatgatcgggatattacctgatatgaccccaagcacggaaatatcgctgagagggataagagtcagcaaaatgg

SEQ ID NO: 210324 - DNA, 75 bp, Artificial Sequence
  Synthetic
cagcagatgcgtgacgtactggggacatttgacactgtccaaataataaagctattaccatttgcagcagccccg

SEQ ID NO: 210325 - DNA, 75 bp, Artificial Sequence
  Synthetic
ccacaaggggcgttcaaatcgcatccaacgagaacatggaaactatgagctccagcacccttgaattgagaagca

SEQ ID NO: 210326 - DNA, 75 bp, Artificial Sequence
  Synthetic
attcactggagaggagatggccaccaaagcggactacacccttgacgaagagagcagggcaagaatcaaaactag

SEQ ID NO: 210327 - DNA, 75 bp, Artificial Sequence
  Synthetic
agtgcatgaagacattttttggctggaaagagcctaacataatcaaaccacatgagaaaggcataaatcccaatt

SEQ ID NO: 210328 - DNA, 75 bp, Artificial Sequence
  Synthetic
atgaatccaaatcagaagatagtagcaattggctctacttctctaatcattgcgataatatgttttctcatgcag

SEQ ID NO: 210329 - DNA, 75 bp, Artificial Sequence
  Synthetic
aactggtgacagttgggagttctaattatcaacaatcttttgtgccgagtccaggagcgagaccacaagttaatg

SEQ ID NO: 210330 - DNA, 75 bp, Artificial Sequence
  Synthetic
ttatcaacaatcttttgtgccgagtccaggagcgagaccacaagttaatggtcaatctggaaggattgactttca

SEQ ID NO: 210331 - DNA, 75 bp, Artificial Sequence
  Synthetic
tacataatgaagggagtgtacataaatacggccttgctcaatgcatcctgtgcagccatggatgactttcagctg

SEQ ID NO: 210332 - DNA, 75 bp, Artificial Sequence
  Synthetic
gtgttcttgaaataggagacatgctcttgaggactgcgataggccaagtgtcgaggcccatgttcctatatgtga

SEQ ID NO: 210333 - DNA, 75 bp, Artificial Sequence
  Synthetic
caatgataagcaaatgtaggaccaaagaaggaagacgaaaaacaaatctgtatggtttcattataaaaggaaggt

SEQ ID NO: 210334 - DNA, 75 bp, Artificial Sequence
  Synthetic
ttcaggtagactgtttcctttggcatatccgcaagcgatttgcagacaatggattgggtgatgccccattccttg

SEQ ID NO: 210335 - DNA, 75 bp, Artificial Sequence
  Synthetic
gactcccagcacagaattgtcactgagaggagtgagagttagtaaaatgggagtggatgaatattccagcactga

SEQ ID NO: 210336 - DNA, 75 bp, Artificial Sequence
  Synthetic
agtcatagttgacagtgacagctggtctgggtattctggcatcttctctgttgaaggcaaaaactgcatcaacag

SEQ ID NO: 210337 - DNA, 75 bp, Artificial Sequence
  Synthetic
tctgggtattctggcatcttctctgttgaaggcaaaaactgcatcaacaggtgtttttatgtggagttgataaga

SEQ ID NO: 210338 - DNA, 75 bp, Artificial Sequence
  Synthetic
ggaatgaaaaccaaaatcctcgaatgttcctggcgatgattacatacatcaccagaaatcaacccgagtggttca

SEQ ID NO: 210339 - DNA, 75 bp, Artificial Sequence
  Synthetic
ttccacaatatgcttcttcatgcaaattgccatcttaataactactgtaacattgcatttcaagcaatatgaatt

SEQ ID NO: 210340 - DNA, 75 bp, Artificial Sequence
  Synthetic
ttgcattcttagatggggggaactcctggttgggaagaaccattagcaaagattcaaggtcaggatatgagatgc

SEQ ID NO: 210341 - DNA, 75 bp, Artificial Sequence
  Synthetic
agtggccacaatggaaggcaaaaagattgttgaagacatcttaaagagtgaaacggatgaaaatctcaaaattgc

SEQ ID NO: 210342 - DNA, 75 bp, Artificial Sequence
  Synthetic
gaacagatggaaactggtggggaacgccagaatgccactgaaatcagagcatctgttgggagaatggttggtgga

SEQ ID NO: 210343 - DNA, 75 bp, Artificial Sequence
  Synthetic
ggaagtcgtcaatgcaactgaaacagtggaacgaacaaacatccccaggatctgctcaaaagggaaaaggacagt

SEQ ID NO: 210344 - DNA, 75 bp, Artificial Sequence
  Synthetic
gatactaaaatactatttgttgaggaggggaaaatcgttcatattagcacattgtcaggaagtgctcagcatgtc

SEQ ID NO: 210345 - DNA, 75 bp, Artificial Sequence
  Synthetic
gatgtacactccaggcggagaagtaagaaatgacgatgttgaccagagtttgatcatcgctgccagaaacattgt

SEQ ID NO: 210346 - DNA, 75 bp, Artificial Sequence
  Synthetic
aatccaactgaggaacaagctgtggatatatgcaaagcagcaatgggtttgaggatcagctcatcctttagtttt

SEQ ID NO: 210347 - DNA, 75 bp, Artificial Sequence
  Synthetic
ggtcggggtactcaggggcgtttatcgattattgggctgataaagagtgcttcaatccttgcttttatgtggaat

SEQ ID NO: 210348 - DNA, 75 bp, Artificial Sequence
  Synthetic
ggaagtgcttacgggcaacctccaaacattgaaaataagagtacatgaggggtatgaagaattcacaatggttgg

SEQ ID NO: 210349 - DNA, 75 bp, Artificial Sequence
  Synthetic
accttcaaagtcatcgaaggctggtccaaacctaattccaaattacagacaaataggcaagtcatagttgaaaga

SEQ ID NO: 210350 - DNA, 75 bp, Artificial Sequence
  Synthetic
gttggaacgatggtaatggaattgattcggatgatcaagcgggggatcaatgaccggaacttctggagaggtgaa

SEQ ID NO: 210351 - DNA, 75 bp, Artificial Sequence
  Synthetic
ttcggatgatcaagcgggggatcaatgaccggaacttctggagaggtgaaaatggacggaggacaagaattgctt

SEQ ID NO: 210352 - DNA, 75 bp, Artificial Sequence
  Synthetic
ggctggatcaagtgaacaggcagcggaagccatggaagttgcaagtcaggctaggcaaatggtgcaggctatgag

SEQ ID NO: 210353 - DNA, 75 bp, Artificial Sequence
  Synthetic
gccagcggatatgactttgagagggaggggtactctctagtcggaattgatcctttccgtctgctccaaaacagt

SEQ ID NO: 210354 - DNA, 75 bp, Artificial Sequence
  Synthetic
agtacaggtctaaaagatgatcttattgaaaatttgcaggcctaccagaaccggatgggagtgcaactgcagcgg

SEQ ID NO: 210355 - DNA, 75 bp, Artificial Sequence
  Synthetic
gaaacacctattgagcagaataaactattttgagagaattaaaatcatccccaaaagtcattggtccaatcataa

SEQ ID NO: 210356 - DNA, 75 bp, Artificial Sequence
  Synthetic
caatggatcatcagaaattgggaaactgtgaagattcaatggtctcaggatcccacgatgctgtataataagatg

SEQ ID NO: 210357 - DNA, 75 bp, Artificial Sequence
  Synthetic
caggaacatagtaagaagagcagcagtatcagcagatccactagcatctttattggagatgtgccacagcacgca

SEQ ID NO: 210358 - DNA, 75 bp, Artificial Sequence
  Synthetic
tacctaaagctaccagaggtcaatacagtggatttgtgagaacattatttcaacaaatgcgtgatgtactaggga

SEQ ID NO: 210359 - DNA, 75 bp, Artificial Sequence
  Synthetic
gcatcaatgaactgagcaatcttgcaaaaggggagaaagctaatgtgctgatagggcaaggagacgtggtgttgg

SEQ ID NO: 210360 - DNA, 75 bp, Artificial Sequence
  Synthetic
aaaatgaatccaaatcagaagataataaccatcggatcaatctgtatggtaactggagtagttagcttaatgtta

SEQ ID NO: 210361 - DNA, 75 bp, Artificial Sequence
  Synthetic
atgaatgcagatcagaagatcataccaattggctctgtttctttcatcattgccacaatatgtttccttatgcaa

SEQ ID NO: 210362 - DNA, 75 bp, Artificial Sequence
  Synthetic
tgccacaatatgtttccttatgcaaatagggatcctagtaactacggtaacattacatttcccgcagcatgacta

SEQ ID NO: 210363 - DNA, 75 bp, Artificial Sequence
  Synthetic
gaatcaacaccaagctgagccaatcagcaatactaatttccatactgagaaagctgtggtctcagctaaattagc

SEQ ID NO: 210364 - DNA, 75 bp, Artificial Sequence
  Synthetic
gagatctggagctgccggtgcagcagtgaagggggtaggaacaatggtgatggagctgattcggatgataaaacg

SEQ ID NO: 210365 - DNA, 75 bp, Artificial Sequence
  Synthetic
ccattcatctcatgctctcactcggaatgcagaactttctttttgactcaaggagctttgctgaatgataaacac

SEQ ID NO: 210366 - DNA, 75 bp, Artificial Sequence
  Synthetic
cttggtcagcaagtgcttgccatgatggcaccagttggttgacaattggaatttctggcccagacaatggggctg

SEQ ID NO: 210367 - DNA, 75 bp, Artificial Sequence
  Synthetic
acccaaataacatggacaaagcagttaaactgtataggaaacttaagagggagataacattccatggggccaaag

SEQ ID NO: 210368 - DNA, 75 bp, Artificial Sequence
  Synthetic
aataacagacactatcaagagttggaggaacaacatactgagaactcaagagtctgaatgtgcatgtgtaaatgg

SEQ ID NO: 210369 - DNA, 75 bp, Artificial Sequence
  Synthetic
cctaaaaggaagaggcaacacccttggcctcgatatcgaaactgccactcttgttgggaagcaaattgtggagtg

SEQ ID NO: 210370 - DNA, 75 bp, Artificial Sequence
  Synthetic
ataagatcttcaaaatggaaaaagggaaagtaattaaatcagtcgaattggatgctcctaattatcactatgagg

SEQ ID NO: 210371 - DNA, 75 bp, Artificial Sequence
  Synthetic
gaaagtaattaaatcagtcgaattggatgctcctaattatcactatgaggaatgctcctgttatcctgatgccgg

SEQ ID NO: 210372 - DNA, 75 bp, Artificial Sequence
  Synthetic
acggcaatggtgtctggatcgggagaatcaaaagcactaattccaggagcggctttgaaatgatttgggatccaa

SEQ ID NO: 210373 - DNA, 75 bp, Artificial Sequence
  Synthetic
ttggactagtgggagcagcatatctttctgtggtgtgagtggtgacactgtgggttggtcttggccagacggtgc

SEQ ID NO: 210374 - DNA, 75 bp, Artificial Sequence
  Synthetic
ttctgtggtgtgagtggtgacactgtgggttggtcttggccagacggtgctgagttgccattcaccattgacaag

SEQ ID NO: 210375 - DNA, 75 bp, Artificial Sequence
  Synthetic
atggatacttttattacaagaaacttccagactacaataatacaaaaggccaaaaacacaatggcagaatttagt

SEQ ID NO: 210376 - DNA, 75 bp, Artificial Sequence
  Synthetic
gaagatcctgaattacaaccagcaatgctattcaacatctgtgtccatctagaggtttgctatgtaataagtgac

SEQ ID NO: 210377 - DNA, 75 bp, Artificial Sequence
  Synthetic
atgaattttcttgatgaagaaggaaaagcatatacagcattagaaggacaagggaaagaacaaaatttgagacca

SEQ ID NO: 210378 - DNA, 75 bp, Artificial Sequence
  Synthetic
agggaaagaacaaaatttgagaccacaatatgaagtaattgagggaatgccaagaaccatagcatggatggtcca

SEQ ID NO: 210379 - DNA, 75 bp, Artificial Sequence
  Synthetic
aatcatgagctaccagaagttccatataatgcctttcttctaatgtctgatgaactggggctggccaatatgact

SEQ ID NO: 210380 - DNA, 75 bp, Artificial Sequence
  Synthetic
aagatccttagctcaagagcatgggatagagactcccaaatatctggctgatttgtttgattataagaccaagag

SEQ ID NO: 210381 - DNA, 75 bp, Artificial Sequence
  Synthetic
atttatagaagttggaataacaaaaggattggctgatgattacttttggaaaaagaaagaaaagctgggaaatag

SEQ ID NO: 210382 - DNA, 75 bp, Artificial Sequence
  Synthetic
agaaaaccaattatgccaaatgggccacaggggatggattaacataccagaaaataatgaaagaagtagcaatag

SEQ ID NO: 210383 - DNA, 75 bp, Artificial Sequence
  Synthetic
ggattggctgatgattacttttggaaaaagaaagaaaagctgggaaatagcatggaactaatgatattcagctac

SEQ ID NO: 210384 - DNA, 75 bp, Artificial Sequence
  Synthetic
tttagtagtacagacccaagagtggacttgggaaagtggccaaaatatactgtgtttaggattggctccctattt

SEQ ID NO: 210385 - DNA, 75 bp, Artificial Sequence
  Synthetic
agggagagtgctaagcagactcacagaacttcaagctgaattaagtctgaaaaacttatggcaagttctcatagg

SEQ ID NO: 210386 - DNA, 75 bp, Artificial Sequence
  Synthetic
atggcggacaacatgaccacaacacaaattgaggtgggtccgggagcaaccaatgccaccataaactttgaagca

SEQ ID NO: 210387 - DNA, 75 bp, Artificial Sequence
  Synthetic
caatgccaccataaactttgaagcaggaattctggagtgctatgaaaggctttcatggcaaagggcccttgacta

SEQ ID NO: 210388 - DNA, 75 bp, Artificial Sequence
  Synthetic
atgaggagctacatagacaatatagacccgaaaggagcaatagagagaaatctagcaaggatgtctcccttagta

SEQ ID NO: 210389 - DNA, 75 bp, Artificial Sequence
  Synthetic
tcagtcacacctaaaaagctgaaatgggaggatctaagaccaatagggcctcacatttacaaccatgagctacca

SEQ ID NO: 210390 - DNA, 75 bp, Artificial Sequence
  Synthetic
tgatgaaagtactcctatttatgaatccgtctgctggaattgaagggtttgagccatactgtatgaaaagttcct

SEQ ID NO: 210391 - DNA, 75 bp, Artificial Sequence
  Synthetic
gaagttccatataatgcctttcttttaatgtctgatgaactggggctggccaatatgacggagggaaagtccaaa

SEQ ID NO: 210392 - DNA, 75 bp, Artificial Sequence
  Synthetic
aaaccaaagacattagccaaagaatgtctagaaaagtactcaacactacgggatcagactgacccaatattaata

SEQ ID NO: 210393 - DNA, 75 bp, Artificial Sequence
  Synthetic
aagaaccagatgatgttgatggcccaactgaaatagtattaagggacatgaacaacaaagatgcaaggcaaaaga

SEQ ID NO: 210394 - DNA, 75 bp, Artificial Sequence
  Synthetic
ctgtgtaaatacaataagtaatgaggaaatgagtaacgaactacagaaaaccaattatgccaagtgggccacagg

SEQ ID NO: 210395 - DNA, 75 bp, Artificial Sequence
  Synthetic
ggatggtttaacataccaaaaaataatgaaagaagtagcaatagatgacgaaacaatgtgccaagaagagcctaa

SEQ ID NO: 210396 - DNA, 75 bp, Artificial Sequence
  Synthetic
atgaaagaagtagcaatagatgacgaaacaatgtgccaagaagagcctaagatccctaacaagtgtagagttgct

SEQ ID NO: 210397 - DNA, 75 bp, Artificial Sequence
  Synthetic
ctagtaaaaggatcctttggaaaagcactaagagtaatatttactaaatgcttgatgcactatgtatttggaaat
